United States Patent 11,640,849 (METHODS FOR HISTOLOGICAL DIAGNOSIS AND TREATMENT OF DISEASES) - sequence listing, part 13

SEQ ID NO: 487163 - protein, 7 aa, Mycobacterium
GHAPAGK

SEQ ID NO: 487164 - protein, 8 aa, Mycobacterium
GHAPAPAV

SEQ ID NO: 487165 - protein, 11 aa, Mycobacterium
GHAPDRTAPDI

SEQ ID NO: 487166 - protein, 6 aa, Mycobacterium
GHAPPW

SEQ ID NO: 487167 - protein, 38 aa, Mycobacterium
GHAPRRPAYTPAPPRATASSSVSARAGVPADDVAPTQV

SEQ ID NO: 487168 - protein, 7 aa, Mycobacterium
GHAPTEQ

SEQ ID NO: 487169 - protein, 12 aa, Mycobacterium
GHAPTRPSRYRA

SEQ ID NO: 487170 - protein, 4 aa, Mycobacterium
GHAQ

SEQ ID NO: 487171 - protein, 14 aa, Mycobacterium
GHAQAQQSAAAKIR

SEQ ID NO: 487172 - protein, 11 aa, Mycobacterium
GHAQRPGDPTL

SEQ ID NO: 487173 - protein, 4 aa, Mycobacterium
GHAR

SEQ ID NO: 487174 - protein, 12 aa, Mycobacterium
GHAREGYEGPEL

SEQ ID NO: 487175 - protein, 7 aa, Mycobacterium
GHARSGD

SEQ ID NO: 487176 - protein, 8 aa, Mycobacterium
GHARTSGA

SEQ ID NO: 487177 - protein, 7 aa, Mycobacterium
GHASGEA

SEQ ID NO: 487178 - protein, 6 aa, Mycobacterium
GHATDA

SEQ ID NO: 487179 - protein, 11 aa, Mycobacterium
GHATGRDPARN

SEQ ID NO: 487180 - protein, 15 aa, Mycobacterium
GHATPQSRNRPDRGP

SEQ ID NO: 487181 - protein, 6 aa, Mycobacterium
GHATPT

SEQ ID NO: 487182 - protein, 8 aa, Mycobacterium
GHATSETF

SEQ ID NO: 487183 - protein, 8 aa, Mycobacterium
GHATTIEG

SEQ ID NO: 487184 - protein, 7 aa, Mycobacterium
GHCGSGA

SEQ ID NO: 487185 - protein, 4 aa, Mycobacterium
GHDA

SEQ ID NO: 487186 - protein, 7 aa, Mycobacterium
GHDAAGR

SEQ ID NO: 487187 - protein, 5 aa, Mycobacterium
GHDAD

SEQ ID NO: 487188 - protein, 8 aa, Mycobacterium
GHDADTPC

SEQ ID NO: 487189 - protein, 6 aa, Mycobacterium
GHDAEA

SEQ ID NO: 487190 - protein, 8 aa, Mycobacterium
GHDAPREF

SEQ ID NO: 487191 - protein, 10 aa, Mycobacterium
GHDATPASDV

SEQ ID NO: 487192 - protein, 8 aa, Mycobacterium
GHDATPDL

SEQ ID NO: 487193 - protein, 5 aa, Mycobacterium
GHDDE

SEQ ID NO: 487194 - protein, 17 aa, Mycobacterium
GHDDEPPWTVEEIAAQV

SEQ ID NO: 487195 - protein, 9 aa, Mycobacterium
GHDDPAAGL

SEQ ID NO: 487196 - protein, 5 aa, Mycobacterium
GHDET

SEQ ID NO: 487197 - protein, 4 aa, Mycobacterium
GHDG

SEQ ID NO: 487198 - protein, 7 aa, Mycobacterium
GHDGESW

SEQ ID NO: 487199 - protein, 6 aa, Mycobacterium
GHDGGQ

SEQ ID NO: 487200 - protein, 20 aa, Mycobacterium
GHDGPEAGRAGYDQIAQGEA

SEQ ID NO: 487201 - protein, 6 aa, Mycobacterium
GHDGPV

SEQ ID NO: 487202 - protein, 8 aa, Mycobacterium
GHDGSEIA

SEQ ID NO: 487203 - protein, 8 aa, Mycobacterium
GHDGTVQQ

SEQ ID NO: 487204 - protein, 37 aa, Mycobacterium
GHDHDERPSSSDGNGGARAGLASKSRDFSNDPQRAAA

SEQ ID NO: 487205 - protein, 11 aa, Mycobacterium
GHDHQGQGGSS

SEQ ID NO: 487206 - protein, 10 aa, Mycobacterium
GHDHSDDCPS

SEQ ID NO: 487207 - protein, 4 aa, Mycobacterium
GHDK

SEQ ID NO: 487208 - protein, 10 aa, Mycobacterium
GHDPAAHESR

SEQ ID NO: 487209 - protein, 10 aa, Mycobacterium
GHDPAVPSLN

SEQ ID NO: 487210 - protein, 8 aa, Mycobacterium
GHDPGGHR

SEQ ID NO: 487211 - protein, 9 aa, Mycobacterium
GHDPNTMTA

SEQ ID NO: 487212 - protein, 6 aa, Mycobacterium
GHDPRI

SEQ ID NO: 487213 - protein, 7 aa, Mycobacterium
GHDPRRF

SEQ ID NO: 487214 - protein, 9 aa, Mycobacterium
GHDPSDQES

SEQ ID NO: 487215 - protein, 16 aa, Mycobacterium
GHDPSVVRASPIPYRG

SEQ ID NO: 487216 - protein, 5 aa, Mycobacterium
GHDPY

SEQ ID NO: 487217 - protein, 6 aa, Mycobacterium
GHDPYP

SEQ ID NO: 487218 - protein, 5 aa, Mycobacterium
GHDQA

SEQ ID NO: 487219 - protein, 8 aa, Mycobacterium
GHDRATGN

SEQ ID NO: 487220 - protein, 12 aa, Mycobacterium
GHDRDGNGGMEG

SEQ ID NO: 487221 - protein, 6 aa, Mycobacterium
GHDRDH

SEQ ID NO: 487222 - protein, 5 aa, Mycobacterium
GHDRG

SEQ ID NO: 487223 - protein, 5 aa, Mycobacterium
GHDRQ

SEQ ID NO: 487224 - protein, 12 aa, Mycobacterium
GHDRQGNGGLEG

SEQ ID NO: 487225 - protein, 11 aa, Mycobacterium
GHDSQSQSFSG

SEQ ID NO: 487226 - protein, 6 aa, Mycobacterium
GHDTID

SEQ ID NO: 487227 - protein, 11 aa, Mycobacterium
GHDTTSATIAG

SEQ ID NO: 487228 - protein, 6 aa, Mycobacterium
GHDTVT

SEQ ID NO: 487229 - protein, 4 aa, Mycobacterium
GHDV

SEQ ID NO: 487230 - protein, 17 aa, Mycobacterium
GHDVDELGRDGGDASDA

SEQ ID NO: 487231 - protein, 9 aa, Mycobacterium
GHDVDERTA

SEQ ID NO: 487232 - protein, 11 aa, Mycobacterium
GHDWGGRALNE

SEQ ID NO: 487233 - protein, 5 aa, Mycobacterium
GHDYR

SEQ ID NO: 487234 - protein, 18 aa, Mycobacterium
GHEADSSHAFTALFGGHG

SEQ ID NO: 487235 - protein, 11 aa, Mycobacterium
GHEAGGHTGEI

SEQ ID NO: 487236 - protein, 6 aa, Mycobacterium
GHEAQR

SEQ ID NO: 487237 - protein, 4 aa, Mycobacterium
GHED

SEQ ID NO: 487238 - protein, 9 aa, Mycobacterium
GHEDDPSRH

SEQ ID NO: 487239 - protein, 11 aa, Mycobacterium
GHEDPRAATAL

SEQ ID NO: 487240 - protein, 5 aa, Mycobacterium
GHEDR

SEQ ID NO: 487241 - protein, 5 aa, Mycobacterium
GHEGA

SEQ ID NO: 487242 - protein, 18 aa, Mycobacterium
GHEGSHEKGGVEGEGGRF

SEQ ID NO: 487243 - protein, 9 aa, Mycobacterium
GHELPPGVP

SEQ ID NO: 487244 - protein, 7 aa, Mycobacterium
GHELTGK

SEQ ID NO: 487245 - protein, 6 aa, Mycobacterium
GHEPAG

SEQ ID NO: 487246 - protein, 7 aa, Mycobacterium
GHEPAGE

SEQ ID NO: 487247 - protein, 7 aa, Mycobacterium
GHEPDNP

SEQ ID NO: 487248 - protein, 9 aa, Mycobacterium
GHEPDNPLS

SEQ ID NO: 487249 - protein, 7 aa, Mycobacterium
GHEPNQD

SEQ ID NO: 487250 - protein, 12 aa, Mycobacterium
GHEPNRPDGGRS

SEQ ID NO: 487251 - protein, 8 aa, Mycobacterium
GHEPPETA

SEQ ID NO: 487252 - protein, 4 aa, Mycobacterium
GHER

SEQ ID NO: 487253 - protein, 26 aa, Mycobacterium
GHERAGTTTTGPTKPGAGPGSAAPLT

SEQ ID NO: 487254 - protein, 5 aa, Mycobacterium
GHERD

SEQ ID NO: 487255 - protein, 6 aa, Mycobacterium
GHERDH

SEQ ID NO: 487256 - protein, 7 aa, Mycobacterium
GHERDQD

SEQ ID NO: 487257 - protein, 8 aa, Mycobacterium
GHERREEP

SEQ ID NO: 487258 - protein, 8 aa, Mycobacterium
GHERTSVG

SEQ ID NO: 487259 - protein, 6 aa, Mycobacterium
GHESQA

SEQ ID NO: 487260 - protein, 5 aa, Mycobacterium
GHETD

SEQ ID NO: 487261 - protein, 7 aa, Mycobacterium
GHETTAS

SEQ ID NO: 487262 - protein, 7 aa, Mycobacterium
GHETTAT

SEQ ID NO: 487263 - protein, 13 aa, Mycobacterium
GHEVPERGRLPKA

SEQ ID NO: 487264 - protein, 9 aa, Mycobacterium
GHEVTGTVQ

SEQ ID NO: 487265 - protein, 12 aa, Mycobacterium
GHFGGSTALSGG

SEQ ID NO: 487266 - protein, 7 aa, Mycobacterium
GHFPSEA

SEQ ID NO: 487267 - protein, 12 aa, Mycobacterium
GHFSENPDFQTS

SEQ ID NO: 487268 - protein, 13 aa, Mycobacterium
GHGAADWSKRPLP

SEQ ID NO: 487269 - protein, 13 aa, Mycobacterium
GHGAAELARDGDT

SEQ ID NO: 487270 - protein, 7 aa, Mycobacterium
GHGADAV

SEQ ID NO: 487271 - protein, 8 aa, Mycobacterium
GHGADEAA

SEQ ID NO: 487272 - protein, 6 aa, Mycobacterium
GHGADG

SEQ ID NO: 487273 - protein, 6 aa, Mycobacterium
GHGAEH

SEQ ID NO: 487274 - protein, 11 aa, Mycobacterium
GHGAGPANDAA

SEQ ID NO: 487275 - protein, 5 aa, Mycobacterium
GHGAP

SEQ ID NO: 487276 - protein, 5 aa, Mycobacterium
GHGAQ

SEQ ID NO: 487277 - protein, 14 aa, Mycobacterium
GHGASEKPDHPGGY

SEQ ID NO: 487278 - protein, 9 aa, Mycobacterium
GHGASPQAL

SEQ ID NO: 487279 - protein, 14 aa, Mycobacterium
GHGDQLQADGMTAD

SEQ ID NO: 487280 - protein, 11 aa, Mycobacterium
GHGDSGSRANY

SEQ ID NO: 487281 - protein, 9 aa, Mycobacterium
GHGDSTTIG

SEQ ID NO: 487282 - protein, 10 aa, Mycobacterium
GHGDSTTVGD

SEQ ID NO: 487283 - protein, 7 aa, Mycobacterium
GHGDTER

SEQ ID NO: 487284 - protein, 9 aa, Mycobacterium
GHGDTTTIG

SEQ ID NO: 487285 - protein, 10 aa, Mycobacterium
GHGDTTTIGG

SEQ ID NO: 487286 - protein, 4 aa, Mycobacterium
GHGE

SEQ ID NO: 487287 - protein, 5 aa, Mycobacterium
GHGEH

SEQ ID NO: 487288 - protein, 13 aa, Mycobacterium
GHGESDWSDDGDY

SEQ ID NO: 487289 - protein, 13 aa, Mycobacterium
GHGESDWSPDGDY

SEQ ID NO: 487290 - protein, 12 aa, Mycobacterium
GHGESDWSPHGD

SEQ ID NO: 487291 - protein, 8 aa, Mycobacterium
GHGESIDI

SEQ ID NO: 487292 - protein, 16 aa, Mycobacterium
GHGESLPERTEAPGYR

SEQ ID NO: 487293 - protein, 5 aa, Mycobacterium
GHGFA

SEQ ID NO: 487294 - protein, 18 aa, Mycobacterium
GHGFSSGADHKSAGSVPH

SEQ ID NO: 487295 - protein, 307 aa, Mycobacterium
GHGGAGGAGGNGGIGGENASNRGATGGAGGAGGIGGAGSLSINGGGYGGLGGNGGTGGAGGAGANETYGGSGGSGGAAGNGGVGGLNGVGGNGGVGGHGGTGANGQFNGGNGGRGGVGGTGGAGTTAGNGGHGGTGGTGGDGQTAAGVGGSGGTGGNGGSSNTADGVAGKGGAGGDAGDGGRGAQTGAQGGHGGKGGLGGDNVYGAGGAGGDGGRGGAGGYAGNGGPWSSPGTGGTGGTGGAGGTGVTGGDGGRGGSGGDGGDGAGTFAGNGGNGGLGGAGGLGTDGYGGWGGEGGWGGDAGTTRLS

SEQ ID NO: 487296 - protein, 21 aa, Mycobacterium
GHGGAGGASLGIGGTGGVGGA

SEQ ID NO: 487297 - protein, 13 aa, Mycobacterium
GHGGAGGDGGRAG

SEQ ID NO: 487298 - protein, 11 aa, Mycobacterium
GHGGAGGSSLN

SEQ ID NO: 487299 - protein, 36 aa, Mycobacterium
GHGGDGAHGGAGASGGAGDAGSGGGDAGDGGAGGRG

SEQ ID NO: 487300 - protein, 9 aa, Mycobacterium
GHGGDGGNA

SEQ ID NO: 487301 - protein, 8 aa, Mycobacterium
GHGGDQIE

SEQ ID NO: 487302 - protein, 10 aa, Mycobacterium
GHGGGAALPG

SEQ ID NO: 487303 - protein, 10 aa, Mycobacterium
GHGGGGAMSG

SEQ ID NO: 487304 - protein, 17 aa, Mycobacterium
GHGGGGGAGGTGTGMGV

SEQ ID NO: 487305 - protein, 27 aa, Mycobacterium
GHGGNGGVGGNSSNGGAGAGGNGGNGG

SEQ ID NO: 487306 - protein, 8 aa, Mycobacterium
GHGGNHGA

SEQ ID NO: 487307 - protein, 13 aa, Mycobacterium
GHGGQTVLSGTTS

SEQ ID NO: 487308 - protein, 7 aa, Mycobacterium
GHGGSWR

SEQ ID NO: 487309 - protein, 10 aa, Mycobacterium
GHGGTHEGMT

SEQ ID NO: 487310 - protein, 29 aa, Mycobacterium
GHGGTVTARRGRETRQAAAAQSGSDVSQA

SEQ ID NO: 487311 - protein, 24 aa, Mycobacterium
GHGGVGGLASGSAAGAGGAGGAGG

SEQ ID NO: 487312 - protein, 7 aa, Mycobacterium
GHGGVSA

SEQ ID NO: 487313 - protein, 18 aa, Mycobacterium
GHGHASGDSHTGGVTTPP

SEQ ID NO: 487314 - protein, 20 aa, Mycobacterium
GHGHSGWREDGDYSPQHNAD

SEQ ID NO: 487315 - protein, 18 aa, Mycobacterium
GHGHSGWREDGDYSPQIN

SEQ ID NO: 487316 - protein, 11 aa, Mycobacterium
GHGHSPVPADG

SEQ ID NO: 487317 - protein, 6 aa, Mycobacterium
GHGIGR

SEQ ID NO: 487318 - protein, 4 aa, Mycobacterium
GHGK

SEQ ID NO: 487319 - protein, 9 aa, Mycobacterium
GHGKKAAHS

SEQ ID NO: 487320 - protein, 21 aa, Mycobacterium
GHGNATSIGDERRANPFLEGI

SEQ ID NO: 487321 - protein, 5 aa, Mycobacterium
GHGNC

SEQ ID NO: 487322 - protein, 11 aa, Mycobacterium
GHGNSTSIGAE

SEQ ID NO: 487323 - protein, 9 aa, Mycobacterium
GHGPAAAEA

SEQ ID NO: 487324 - protein, 10 aa, Mycobacterium
GHGPAAESAA

SEQ ID NO: 487325 - protein, 10 aa, Mycobacterium
GHGPEAARAA

SEQ ID NO: 487326 - protein, 9 aa, Mycobacterium
GHGPEAATA

SEQ ID NO: 487327 - protein, 6 aa, Mycobacterium
GHGPEL

SEQ ID NO: 487328 - protein, 8 aa, Mycobacterium
GHGPELGD

SEQ ID NO: 487329 - protein, 10 aa, Mycobacterium
GHGPKELNDA

SEQ ID NO: 487330 - protein, 9 aa, Mycobacterium
GHGPKPSEQ

SEQ ID NO: 487331 - protein, 5 aa, Mycobacterium
GHGPR

SEQ ID NO: 487332 - protein, 4 aa, Mycobacterium
GHGQ

SEQ ID NO: 487333 - protein, 10 aa, Mycobacterium
GHGQDTQRST

SEQ ID NO: 487334 - protein, 8 aa, Mycobacterium
GHGQPDPR

SEQ ID NO: 487335 - protein, 6 aa, Mycobacterium
GHGQRV

SEQ ID NO: 487336 - protein, 4 aa, Mycobacterium
GHGR

SEQ ID NO: 487337 - protein, 17 aa, Mycobacterium
GHGRADGELDTDTSGTV

SEQ ID NO: 487338 - protein, 12 aa, Mycobacterium
GHGRDEDVGPRV

SEQ ID NO: 487339 - protein, 9 aa, Mycobacterium
GHGRDEELA

SEQ ID NO: 487340 - protein, 6 aa, Mycobacterium
GHGRGG

SEQ ID NO: 487341 - protein, 17 aa, Mycobacterium
GHGRGGKDEDDDDHATP

SEQ ID NO: 487342 - protein, 8 aa, Mycobacterium
GHGRGRRA

SEQ ID NO: 487343 - protein, 20 aa, Mycobacterium
GHGRGSGDSHTGGVTTPPLS

SEQ ID NO: 487344 - protein, 5 aa, Mycobacterium
GHGRH

SEQ ID NO: 487345 - protein, 7 aa, Mycobacterium
GHGRHEE

SEQ ID NO: 487346 - protein, 12 aa, Mycobacterium
GHGRNDELSPGM

SEQ ID NO: 487347 - protein, 7 aa, Mycobacterium
GHGRNEE

SEQ ID NO: 487348 - protein, 9 aa, Mycobacterium
GHGRNEEIA

SEQ ID NO: 487349 - protein, 8 aa, Mycobacterium
GHGRPDDR

SEQ ID NO: 487350 - protein, 6 aa, Mycobacterium
GHGRQE

SEQ ID NO: 487351 - protein, 8 aa, Mycobacterium
GHGRQEEL

SEQ ID NO: 487352 - protein, 9 aa, Mycobacterium
GHGRQEELG

SEQ ID NO: 487353 - protein, 10 aa, Mycobacterium
GHGRQEELGP

SEQ ID NO: 487354 - protein, 12 aa, Mycobacterium
GHGRSEELGPQV

SEQ ID NO: 487355 - protein, 12 aa, Mycobacterium
GHGRSGIPRRGG

SEQ ID NO: 487356 - protein, 12 aa, Mycobacterium
GHGRSGIPRRSS

SEQ ID NO: 487357 - protein, 13 aa, Mycobacterium
GHGRSGMPRRDGY

SEQ ID NO: 487358 - protein, 12 aa, Mycobacterium
GHGRSGVPRAKA

SEQ ID NO: 487359 - protein, 11 aa, Mycobacterium
GHGRSPTAKPL

SEQ ID NO: 487360 - protein, 10 aa, Mycobacterium
GHGRSSTPQL

SEQ ID NO: 487361 - protein, 7 aa, Mycobacterium
GHGRTEE

SEQ ID NO: 487362 - protein, 6 aa, Mycobacterium
GHGSAR

SEQ ID NO: 487363 - protein, 10 aa, Mycobacterium
GHGSDPRIPA

SEQ ID NO: 487364 - protein, 18 aa, Mycobacterium
GHGSKSVTYSVGGSGSQV

SEQ ID NO: 487365 - protein, 7 aa, Mycobacterium
GHGSPQD

SEQ ID NO: 487366 - protein, 6 aa, Mycobacterium
GHGSVS

SEQ ID NO: 487367 - protein, 5 aa, Mycobacterium
GHGSW

SEQ ID NO: 487368 - protein, 6 aa, Mycobacterium
GHGTAE

SEQ ID NO: 487369 - protein, 8 aa, Mycobacterium
GHGTASAT

SEQ ID NO: 487370 - protein, 10 aa, Mycobacterium
GHGTDGEHAV

SEQ ID NO: 487371 - protein, 11 aa, Mycobacterium
GHGTDGGQAVG

SEQ ID NO: 487372 - protein, 14 aa, Mycobacterium
GHGTGTRLGDRTEL

SEQ ID NO: 487373 - protein, 7 aa, Mycobacterium
GHGTGTV

SEQ ID NO: 487374 - protein, 8 aa, Mycobacterium
GHGTINGR

SEQ ID NO: 487375 - protein, 6 aa, Mycobacterium
GHGTPF

SEQ ID NO: 487376 - protein, 16 aa, Mycobacterium
GHGTPLGAAGGDREAS

SEQ ID NO: 487377 - protein, 12 aa, Mycobacterium
GHGTSPTAKPLR

SEQ ID NO: 487378 - protein, 7 aa, Mycobacterium
GHGTTLG

SEQ ID NO: 487379 - protein, 5 aa, Mycobacterium
GHGTV

SEQ ID NO: 487380 - protein, 25 aa, Mycobacterium
GHGVGRTKKEAELKAAASAYKTLDE

SEQ ID NO: 487381 - protein, 18 aa, Mycobacterium
GHGVKTTARGSSAKADDV

SEQ ID NO: 487382 - protein, 5 aa, Mycobacterium
GHGVP

SEQ ID NO: 487383 - protein, 5 aa, Mycobacterium
GHGVT

SEQ ID NO: 487384 - protein, 9 aa, Mycobacterium
GHGYRRSDD

SEQ ID NO: 487385 - protein, 9 aa, Mycobacterium
GHHDGGVEE

SEQ ID NO: 487386 - protein, 4 aa, Mycobacterium
GHHG

SEQ ID NO: 487387 - protein, 14 aa, Mycobacterium
GHHPGIGHDPGIDH

SEQ ID NO: 487388 - protein, 8 aa, Mycobacterium
GHHRGAGR

SEQ ID NO: 487389 - protein, 18 aa, Mycobacterium
GHHVGRSGRLATYAQRRC

SEQ ID NO: 487390 - protein, 6 aa, Mycobacterium
GHHVPE

SEQ ID NO: 487391 - protein, 9 aa, Mycobacterium
GHIDTDSAR

SEQ ID NO: 487392 - protein, 4 aa, Mycobacterium
GHIG

SEQ ID NO: 487393 - protein, 14 aa, Mycobacterium
GHIGSDGSSPQARI

SEQ ID NO: 487394 - protein, 10 aa, Mycobacterium
GHIPGAKNLP

SEQ ID NO: 487395 - protein, 13 aa, Mycobacterium
GHIPGAKNLPSGA

SEQ ID NO: 487396 - protein, 5 aa, Mycobacterium
GHIPT

SEQ ID NO: 487397 - protein, 27 aa, Mycobacterium
GHKAGDTVTYSTPQGEDQVELIAVKLP

SEQ ID NO: 487398 - protein, 13 aa, Mycobacterium
GHKAVGPGQRLLA

SEQ ID NO: 487399 - protein, 5 aa, Mycobacterium
GHKED

SEQ ID NO: 487400 - protein, 11 aa, Mycobacterium
GHKGNANIDGH

SEQ ID NO: 487401 - protein, 10 aa, Mycobacterium
GHKIRQRAES

SEQ ID NO: 487402 - protein, 6 aa, Mycobacterium
GHKPLD

SEQ ID NO: 487403 - protein, 7 aa, Mycobacterium
GHKPQDV

SEQ ID NO: 487404 - protein, 14 aa, Mycobacterium
GHKPVRREGGREGR

SEQ ID NO: 487405 - protein, 9 aa, Mycobacterium
GHKQTLTDV

SEQ ID NO: 487406 - protein, 5 aa, Mycobacterium
GHKSA

SEQ ID NO: 487407 - protein, 16 aa, Mycobacterium
GHKVGSKGRPLPGGGQ

SEQ ID NO: 487408 - protein, 7 aa, Mycobacterium
GHLDRTE

SEQ ID NO: 487409 - protein, 4 aa, Mycobacterium
GHLG

SEQ ID NO: 487410 - protein, 13 aa, Mycobacterium
GHLGERDKARMSR

SEQ ID NO: 487411 - protein, 12 aa, Mycobacterium
GHLGETAPTGLP

SEQ ID NO: 487412 - protein, 17 aa, Mycobacterium
GHLPGDDGHSAAAKDGF

SEQ ID NO: 487413 - protein, 4 aa, Mycobacterium
GHLQ

SEQ ID NO: 487414 - protein, 7 aa, Mycobacterium
GHLSDTG

SEQ ID NO: 487415 - protein, 11 aa, Mycobacterium
GHNATTAQVDT

SEQ ID NO: 487416 - protein, 4 aa, Mycobacterium
GHND

SEQ ID NO: 487417 - protein, 12 aa, Mycobacterium
GHNEGDDPSMTN

SEQ ID NO: 487418 - protein, 8 aa, Mycobacterium
GHNENGKL

SEQ ID NO: 487419 - protein, 8 aa, Mycobacterium
GHNGGPYA

SEQ ID NO: 487420 - protein, 12 aa, Mycobacterium
GHNGGSPVSSRY

SEQ ID NO: 487421 - protein, 6 aa, Mycobacterium
GHNPET

SEQ ID NO: 487422 - protein, 10 aa, Mycobacterium
GHNPNGMKDR

SEQ ID NO: 487423 - protein, 8 aa, Mycobacterium
GHNPQTGW

SEQ ID NO: 487424 - protein, 4 aa, Mycobacterium
GHNY

SEQ ID NO: 487425 - protein, 10 aa, Mycobacterium
GHPAAAPDLG

SEQ ID NO: 487426 - protein, 6 aa, Mycobacterium
GHPAAL

SEQ ID NO: 487427 - protein, 5 aa, Mycobacterium
GHPAD

SEQ ID NO: 487428 - protein, 7 aa, Mycobacterium
GHPAGDV

SEQ ID NO: 487429 - protein, 7 aa, Mycobacterium
GHPAPDN

SEQ ID NO: 487430 - protein, 7 aa, Mycobacterium
GHPAPDS

SEQ ID NO: 487431 - protein, 12 aa, Mycobacterium
GHPDDAASDRLR

SEQ ID NO: 487432 - protein, 10 aa, Mycobacterium
GHPDDSSISG

SEQ ID NO: 487433 - protein, 10 aa, Mycobacterium
GHPDEANPAL

SEQ ID NO: 487434 - protein, 10 aa, Mycobacterium
GHPDESSISG

SEQ ID NO: 487435 - protein, 6 aa, Mycobacterium
GHPDGE

SEQ ID NO: 487436 - protein, 15 aa, Mycobacterium
GHPDMPAKPGPPVAD

SEQ ID NO: 487437 - protein, 13 aa, Mycobacterium
GHPDPADRQQPPH

SEQ ID NO: 487438 - protein, 13 aa, Mycobacterium
GHPDPPRRAVGQR

SEQ ID NO: 487439 - protein, 6 aa, Mycobacterium
GHPDRA

SEQ ID NO: 487440 - protein, 7 aa, Mycobacterium
GHPDRTY

SEQ ID NO: 487441 - protein, 5 aa, Mycobacterium
GHPEA

SEQ ID NO: 487442 - protein, 6 aa, Mycobacterium
GHPEGD

SEQ ID NO: 487443 - protein, 7 aa, Mycobacterium
GHPEIDS

SEQ ID NO: 487444 - protein, 11 aa, Mycobacterium
GHPEPERPKLT

SEQ ID NO: 487445 - protein, 18 aa, Mycobacterium
GHPEPTISRAQAAPGAGI

SEQ ID NO: 487446 - protein, 6 aa, Mycobacterium
GHPGAQ

SEQ ID NO: 487447 - protein, 8 aa, Mycobacterium
GHPGEDDI

SEQ ID NO: 487448 - protein, 8 aa, Mycobacterium
GHPGEDDV

SEQ ID NO: 487449 - protein, 8 aa, Mycobacterium
GHPGGAGF

SEQ ID NO: 487450 - protein, 6 aa, Mycobacterium
GHPGGE

SEQ ID NO: 487451 - protein, 7 aa, Mycobacterium
GHPGPAA

SEQ ID NO: 487452 - protein, 8 aa, Mycobacterium
GHPGRNGV

SEQ ID NO: 487453 - protein, 12 aa, Mycobacterium
GHPISPTDASDA

SEQ ID NO: 487454 - protein, 5 aa, Mycobacterium
GHPKA

SEQ ID NO: 487455 - protein, 15 aa, Mycobacterium
GHPKDTSKRFWPPRR

SEQ ID NO: 487456 - protein, 9 aa, Mycobacterium
GHPKNMKRP

SEQ ID NO: 487457 - protein, 4 aa, Mycobacterium
GHPL

SEQ ID NO: 487458 - protein, 5 aa, Mycobacterium
GHPLA

SEQ ID NO: 487459 - protein, 14 aa, Mycobacterium
GHPLAGSKNVEPAD

SEQ ID NO: 487460 - protein, 4 aa, Mycobacterium
GHPM

SEQ ID NO: 487461 - protein, 8 aa, Mycobacterium
GHPPATPD

SEQ ID NO: 487462 - protein, 9 aa, Mycobacterium
GHPPDPAEV

SEQ ID NO: 487463 - protein, 11 aa, Mycobacterium
GHPPEEANPAL

SEQ ID NO: 487464 - protein, 8 aa, Mycobacterium
GHPPSGNR

SEQ ID NO: 487465 - protein, 15 aa, Mycobacterium
GHPPSPEQRARGEER

SEQ ID NO: 487466 - protein, 5 aa, Mycobacterium
GHPPV

SEQ ID NO: 487467 - protein, 4 aa, Mycobacterium
GHPQ

SEQ ID NO: 487468 - protein, 5 aa, Mycobacterium
GHPQA

SEQ ID NO: 487469 - protein, 14 aa, Mycobacterium
GHPQPPAHFRRHRS

SEQ ID NO: 487470 - protein, 13 aa, Mycobacterium
GHPRAGDRDGAIR

SEQ ID NO: 487471 - protein, 9 aa, Mycobacterium
GHPRNPYTR

SEQ ID NO: 487472 - protein, 11 aa, Mycobacterium
GHPRTADRDGV

SEQ ID NO: 487473 - protein, 6 aa, Mycobacterium
GHPRVA

SEQ ID NO: 487474 - protein, 11 aa, Mycobacterium
GHPRVADPTGV

SEQ ID NO: 487475 - protein, 42 aa, Mycobacterium
GHPRYADDTDSPAAKAKADNDETDEDKQVAENLDKDKAYNEE

SEQ ID NO: 487476 - protein, 13 aa, Mycobacterium
GHPSATDLNPAST

SEQ ID NO: 487477 - protein, 12 aa, Mycobacterium
GHPSGTAKDVED

SEQ ID NO: 487478 - protein, 15 aa, Mycobacterium
GHPSPVPMPAPTGDL

SEQ ID NO: 487479 - protein, 7 aa, Mycobacterium
GHPSSSL

SEQ ID NO: 487480 - protein, 7 aa, Mycobacterium
GHPSSTI

SEQ ID NO: 487481 - protein, 9 aa, Mycobacterium
GHPTAETAI

SEQ ID NO: 487482 - protein, 7 aa, Mycobacterium
GHPTDQE

SEQ ID NO: 487483 - protein, 5 aa, Mycobacterium
GHPTE

SEQ ID NO: 487484 - protein, 5 aa, Mycobacterium
GHPTL

SEQ ID NO: 487485 - protein, 7 aa, Mycobacterium
GHPVGAS

SEQ ID NO: 487486 - protein, 16 aa, Mycobacterium
GHPVGRADDPKSAVDE

SEQ ID NO: 487487 - protein, 7 aa, Mycobacterium
GHPVPGG

SEQ ID NO: 487488 - protein, 5 aa, Mycobacterium
GHPVT

SEQ ID NO: 487489 - protein, 7 aa, Mycobacterium
GHPVTGD

SEQ ID NO: 487490 - protein, 18 aa, Mycobacterium
GHPYDDGYEGRYAEADAH

SEQ ID NO: 487491 - protein, 27 aa, Mycobacterium
GHPYDDGYEGRYAEADARKALEELRDD

SEQ ID NO: 487492 - protein, 6 aa, Mycobacterium
GHQADA

SEQ ID NO: 487493 - protein, 9 aa, Mycobacterium
GHQAGGVEE

SEQ ID NO: 487494 - protein, 4 aa, Mycobacterium
GHQD

SEQ ID NO: 487495 - protein, 9 aa, Mycobacterium
GHQDASTAT

SEQ ID NO: 487496 - protein, 4 aa, Mycobacterium
GHQG

SEQ ID NO: 487497 - protein, 8 aa, Mycobacterium
GHQGPTIG

SEQ ID NO: 487498 - protein, 4 aa, Mycobacterium
GHQP

SEQ ID NO: 487499 - protein, 11 aa, Mycobacterium
GHQPGDPDKAA

SEQ ID NO: 487500 - protein, 8 aa, Mycobacterium
GHQPRTEA

SEQ ID NO: 487501 - protein, 11 aa, Mycobacterium
GHQPVERYGAS

SEQ ID NO: 487502 - protein, 6 aa, Mycobacterium
GHQVGE

SEQ ID NO: 487503 - protein, 5 aa, Mycobacterium
GHRAS

SEQ ID NO: 487504 - protein, 10 aa, Mycobacterium
GHRDDPGGRV

SEQ ID NO: 487505 - protein, 7 aa, Mycobacterium
GHRDPGA

SEQ ID NO: 487506 - protein, 7 aa, Mycobacterium
GHRDTSH

SEQ ID NO: 487507 - protein, 41 aa, Mycobacterium
GHRGDDAVRRAAGGAETPCATSGPRSTRFSGRRARRPGADH

SEQ ID NO: 487508 - protein, 7 aa, Mycobacterium
GHRGDQI

SEQ ID NO: 487509 - protein, 18 aa, Mycobacterium
GHRGPGEGELASRTYADD

SEQ ID NO: 487510 - protein, 11 aa, Mycobacterium
GHRGRTSDPLY

SEQ ID NO: 487511 - protein, 19 aa, Mycobacterium
GHRGSGEAELANPAFGDDP

SEQ ID NO: 487512 - protein, 24 aa, Mycobacterium
GHRHTSGDGIGGGVRARYPRTATR

SEQ ID NO: 487513 - protein, 11 aa, Mycobacterium
GHRKPSGVSTI

SEQ ID NO: 487514 - protein, 6 aa, Mycobacterium
GHRKRA

SEQ ID NO: 487515 - protein, 7 aa, Mycobacterium
GHRLTDE

SEQ ID NO: 487516 - protein, 7 aa, Mycobacterium
GHRNKRS

SEQ ID NO: 487517 - protein, 9 aa, Mycobacterium
GHRPADTEP

SEQ ID NO: 487518 - protein, 12 aa, Mycobacterium
GHRPAGDTTMTD

SEQ ID NO: 487519 - protein, 13 aa, Mycobacterium
GHRPANTDSTSAQ

SEQ ID NO: 487520 - protein, 5 aa, Mycobacterium
GHRPD

SEQ ID NO: 487521 - protein, 5 aa, Mycobacterium
GHRPG

SEQ ID NO: 487522 - protein, 5 aa, Mycobacterium
GHRPN

SEQ ID NO: 487523 - protein, 6 aa, Mycobacterium
GHRPPD

SEQ ID NO: 487524 - protein, 6 aa, Mycobacterium
GHRPPV

SEQ ID NO: 487525 - protein, 13 aa, Mycobacterium
GHRQAAGPWPGPA

SEQ ID NO: 487526 - protein, 7 aa, Mycobacterium
GHRQPRE

SEQ ID NO: 487527 - protein, 12 aa, Mycobacterium
GHRQRPVAGPLD

SEQ ID NO: 487528 - protein, 6 aa, Mycobacterium
GHRQYN

SEQ ID NO: 487529 - protein, 11 aa, Mycobacterium
GHRRASLGGRV

SEQ ID NO: 487530 - protein, 7 aa, Mycobacterium
GHRRERL

SEQ ID NO: 487531 - protein, 10 aa, Mycobacterium
GHRRNPEGTI

SEQ ID NO: 487532 - protein, 8 aa, Mycobacterium
GHRRRAGG

SEQ ID NO: 487533 - protein, 7 aa, Mycobacterium
GHRSAER

SEQ ID NO: 487534 - protein, 4 aa, Mycobacterium
GHRV

SEQ ID NO: 487535 - protein, 7 aa, Mycobacterium
GHRVEGG

SEQ ID NO: 487536 - protein, 7 aa, Mycobacterium
GHRYGGA

SEQ ID NO: 487537 - protein, 8 aa, Mycobacterium
GHSADDAE

SEQ ID NO: 487538 - protein, 9 aa, Mycobacterium
GHSADGAGF

SEQ ID NO: 487539 - protein, 7 aa, Mycobacterium
GHSARSA

SEQ ID NO: 487540 - protein, 5 aa, Mycobacterium
GHSAS

SEQ ID NO: 487541 - protein, 7 aa, Mycobacterium
GHSATRE

SEQ ID NO: 487542 - protein, 10 aa, Mycobacterium
GHSDAAGSDF

SEQ ID NO: 487543 - protein, 9 aa, Mycobacterium
GHSDAPWAT

SEQ ID NO: 487544 - protein, 10 aa, Mycobacterium
GHSDDQGAGL

SEQ ID NO: 487545 - protein, 5 aa, Mycobacterium
GHSDH

SEQ ID NO: 487546 - protein, 12 aa, Mycobacterium
GHSDHTRRAYRG

SEQ ID NO: 487547 - protein, 8 aa, Mycobacterium
GHSDPLTD

SEQ ID NO: 487548 - protein, 12 aa, Mycobacterium
GHSEAAANEDFE

SEQ ID NO: 487549 - protein, 5 aa, Mycobacterium
GHSED

SEQ ID NO: 487550 - protein, 12 aa, Mycobacterium
GHSEDAANQDFD

SEQ ID NO: 487551 - protein, 5 aa, Mycobacterium
GHSEP

SEQ ID NO: 487552 - protein, 4 aa, Mycobacterium
GHSG

SEQ ID NO: 487553 - protein, 10 aa, Mycobacterium
GHSGDEDDEF

SEQ ID NO: 487554 - protein, 58 aa, Mycobacterium
GHSGGDGGRGGLGGNGGHGGVGGGHTAGNGFHDGTTGAGGVGGVGGTGGVGGTGGDGL

SEQ ID NO: 487555 - protein, 9 aa, Mycobacterium
GHSGGSPHA

SEQ ID NO: 487556 - protein, 28 aa, Mycobacterium
GHSKPAPPPLRSPLSTPAGVWAPSPGSS

SEQ ID NO: 487557 - protein, 13 aa, Mycobacterium
GHSKSTGTPPTTM

SEQ ID NO: 487558 - protein, 6 aa, Mycobacterium
GHSMPD

SEQ ID NO: 487559 - protein, 7 aa, Mycobacterium
GHSNTGI

SEQ ID NO: 487560 - protein, 6 aa, Mycobacterium
GHSPAQ

SEQ ID NO: 487561 - protein, 9 aa, Mycobacterium
GHSPDTGWT

SEQ ID NO: 487562 - protein, 5 aa, Mycobacterium
GHSPG

SEQ ID NO: 487563 - protein, 12 aa, Mycobacterium
GHSQTHSAGEAA

SEQ ID NO: 487564 - protein, 7 aa, Mycobacterium
GHSRPRA

SEQ ID NO: 487565 - protein, 9 aa, Mycobacterium
GHSRRSGPA

SEQ ID NO: 487566 - protein, 13 aa, Mycobacterium
GHSSASGRRGQST

SEQ ID NO: 487567 - protein, 11 aa, Mycobacterium
GHSSDPRIPET

SEQ ID NO: 487568 - protein, 11 aa, Mycobacterium
GHSTGDDPASH

SEQ ID NO: 487569 - protein, 11 aa, Mycobacterium
GHSTGGDPASH

SEQ ID NO: 487570 - protein, 10 aa, Mycobacterium
GHSTGRDPAN

SEQ ID NO: 487571 - protein, 11 aa, Mycobacterium
GHSTGRDPARN

SEQ ID NO: 487572 - protein, 10 aa, Mycobacterium
GHSTGRDPAT

SEQ ID NO: 487573 - protein, 6 aa, Mycobacterium
GHSTPV

SEQ ID NO: 487574 - protein, 7 aa, Mycobacterium
GHSTSAP

SEQ ID NO: 487575 - protein, 5 aa, Mycobacterium
GHSVN

SEQ ID NO: 487576 - protein, 11 aa, Mycobacterium
GHSVQGDQPAK

SEQ ID NO: 487577 - protein, 4 aa, Mycobacterium
GHSY

SEQ ID NO: 487578 - protein, 5 aa, Mycobacterium
GHTAF

SEQ ID NO: 487579 - protein, 5 aa, Mycobacterium
GHTDP

SEQ ID NO: 487580 - protein, 6 aa, Mycobacterium
GHTDPW

SEQ ID NO: 487581 - protein, 7 aa, Mycobacterium
GHTDTSH

SEQ ID NO: 487582 - protein, 4 aa, Mycobacterium
GHTE

SEQ ID NO: 487583 - protein, 11 aa, Mycobacterium
GHTEDAANRDF

SEQ ID NO: 487584 - protein, 11 aa, Mycobacterium
GHTEEAAQRDF

SEQ ID NO: 487585 - protein, 5 aa, Mycobacterium
GHTEL

SEQ ID NO: 487586 - protein, 5 aa, Mycobacterium
GHTEN

SEQ ID NO: 487587 - protein, 13 aa, Mycobacterium
GHTETDDGRDIER

SEQ ID NO: 487588 - protein, 11 aa, Mycobacterium
GHTETDDGRGI

SEQ ID NO: 487589 - protein, 10 aa, Mycobacterium
GHTETGTENH

SEQ ID NO: 487590 - protein, 5 aa, Mycobacterium
GHTEY

SEQ ID NO: 487591 - protein, 13 aa, Mycobacterium
GHTGATAIEDRQD

SEQ ID NO: 487592 - protein, 5 aa, Mycobacterium
GHTGR

SEQ ID NO: 487593 - protein, 16 aa, Mycobacterium
GHTNADDPLRYRTDDE

SEQ ID NO: 487594 - protein, 14 aa, Mycobacterium
GHTNTGLANPTDYN

SEQ ID NO: 487595 - protein, 23 aa, Mycobacterium
GHTPAPVGDRRPLPPRGNQQSEL

SEQ ID NO: 487596 - protein, 12 aa, Mycobacterium
GHTPDEAEITAP

SEQ ID NO: 487597 - protein, 8 aa, Mycobacterium
GHTPPADP

SEQ ID NO: 487598 - protein, 12 aa, Mycobacterium
GHTPSAEVPTNR

SEQ ID NO: 487599 - protein, 14 aa, Mycobacterium
GHTPSASVPTDQDL

SEQ ID NO: 487600 - protein, 5 aa, Mycobacterium
GHTPT

SEQ ID NO: 487601 - protein, 6 aa, Mycobacterium
GHTPTL

SEQ ID NO: 487602 - protein, 6 aa, Mycobacterium
GHTQDT

SEQ ID NO: 487603 - protein, 7 aa, Mycobacterium
GHTRGEF

SEQ ID NO: 487604 - protein, 8 aa, Mycobacterium
GHTSDTRV

SEQ ID NO: 487605 - protein, 4 aa, Mycobacterium
GHTV

SEQ ID NO: 487606 - protein, 6 aa, Mycobacterium
GHVATE

SEQ ID NO: 487607 - protein, 5 aa, Mycobacterium
GHVEP

SEQ ID NO: 487608 - protein, 17 aa, Mycobacterium
GHVEPGSGVARRSVDGA

SEQ ID NO: 487609 - protein, 21 aa, Mycobacterium
GHVPGHEDQEIERKPSTDEPF

SEQ ID NO: 487610 - protein, 21 aa, Mycobacterium
GHVPGKEDEVISRKPSVDEPF

SEQ ID NO: 487611 - protein, 10 aa, Mycobacterium
GHVPNKEDEV

SEQ ID NO: 487612 - protein, 4 aa, Mycobacterium
GHVR

SEQ ID NO: 487613 - protein, 9 aa, Mycobacterium
GHVRDGHGD

SEQ ID NO: 487614 - protein, 9 aa, Mycobacterium
GHVTPTSHP

SEQ ID NO: 487615 - protein, 12 aa, Mycobacterium
GHWTDAPSTDDH

SEQ ID NO: 487616 - protein, 5 aa, Mycobacterium
GHYDD

SEQ ID NO: 487617 - protein, 6 aa, Mycobacterium
GHYGPP

SEQ ID NO: 487618 - protein, 17 aa, Mycobacterium
GHYQAPGHTGKPESGDL

SEQ ID NO: 487619 - protein, 12 aa, Mycobacterium
GHYSDLDEETAR

SEQ ID NO: 487620 - protein, 6 aa, Mycobacterium
GHYSGA

SEQ ID NO: 487621 - protein, 7 aa, Mycobacterium
GHYSGAA

SEQ ID NO: 487622 - protein, 8 aa, Mycobacterium
GHYSGAAK

SEQ ID NO: 487623 - protein, 11 aa, Mycobacterium
GHYSGAAKLGN

SEQ ID NO: 487624 - protein, 8 aa, Mycobacterium
GHYSGAEA

SEQ ID NO: 487625 - protein, 12 aa, Mycobacterium
GHYSGAQKLGNA

SEQ ID NO: 487626 - protein, 7 aa, Mycobacterium
GHYSRPE

SEQ ID NO: 487627 - protein, 10 aa, Mycobacterium
GHYTDADRAR

SEQ ID NO: 487628 - protein, 7 aa, Mycobacterium
GIAAADT

SEQ ID NO: 487629 - protein, 11 aa, Mycobacterium
GIAAKGGWGPG

SEQ ID NO: 487630 - protein, 13 aa, Mycobacterium
GIADAYKTGRGSI

SEQ ID NO: 487631 - protein, 5 aa, Mycobacterium
GIADG

SEQ ID NO: 487632 - protein, 18 aa, Mycobacterium
GIADGKDEPVPSTIEDPS

SEQ ID NO: 487633 - protein, 16 aa, Mycobacterium
GIADGNGEKIKAGLGE

SEQ ID NO: 487634 - protein, 7 aa, Mycobacterium
GIADGRG

SEQ ID NO: 487635 - protein, 7 aa, Mycobacterium
GIADGRS

SEQ ID NO: 487636 - protein, 12 aa, Mycobacterium
GIADKAGKYPKY

SEQ ID NO: 487637 - protein, 9 aa, Mycobacterium
GIADPRGRA

SEQ ID NO: 487638 - protein, 11 aa, Mycobacterium
GIADSATRYPT

SEQ ID NO: 487639 - protein, 6 aa, Mycobacterium
GIADTG

SEQ ID NO: 487640 - protein, 7 aa, Mycobacterium
GIADTGV

SEQ ID NO: 487641 - protein, 8 aa, Mycobacterium
GIADTGVK

SEQ ID NO: 487642 - protein, 4 aa, Mycobacterium
GIAE

SEQ ID NO: 487643 - protein, 12 aa, Mycobacterium
GIAGAAADAAVS

SEQ ID NO: 487644 - protein, 10 aa, Mycobacterium
GIAGDSGDAR

SEQ ID NO: 487645 - protein, 5 aa, Mycobacterium
GIAGE

SEQ ID NO: 487646 - protein, 6 aa, Mycobacterium
GIAGEK

SEQ ID NO: 487647 - protein, 6 aa, Mycobacterium
GIAGGY

SEQ ID NO: 487648 - protein, 13 aa, Mycobacterium
GIAGNGASDISAA

SEQ ID NO: 487649 - protein, 31 aa, Mycobacterium
GIAGNTAASAGQQGAQRSAEAAAAAPMESSQ

SEQ ID NO: 487650 - protein, 16 aa, Mycobacterium
GIAGPATAAAVALLGP

SEQ ID NO: 487651 - protein, 13 aa, Mycobacterium
GIAGPGPDGRPRY

SEQ ID NO: 487652 - protein, 5 aa, Mycobacterium
GIAGT

SEQ ID NO: 487653 - protein, 17 aa, Mycobacterium
GIAHTGTTLTTPLTPQQ

SEQ ID NO: 487654 - protein, 6 aa, Mycobacterium
GIANTG

SEQ ID NO: 487655 - protein, 4 aa, Mycobacterium
GIAP

SEQ ID NO: 487656 - protein, 5 aa, Mycobacterium
GIAPA

SEQ ID NO: 487657 - protein, 7 aa, Mycobacterium
GIAPADL

SEQ ID NO: 487658 - protein, 8 aa, Mycobacterium
GIAPEREV

SEQ ID NO: 487659 - protein, 5 aa, Mycobacterium
GIAPG

SEQ ID NO: 487660 - protein, 10 aa, Mycobacterium
GIAPGYQQQE

SEQ ID NO: 487661 - protein, 5 aa, Mycobacterium
GIAPL

SEQ ID NO: 487662 - protein, 7 aa, Mycobacterium
GIAPNPL

SEQ ID NO: 487663 - protein, 7 aa, Mycobacterium
GIAPPEV

SEQ ID NO: 487664 - protein, 10 aa, Mycobacterium
GIAPQNPSRL

SEQ ID NO: 487665 - protein, 16 aa, Mycobacterium
GIAPSELTTHQHGDTV

SEQ ID NO: 487666 - protein, 13 aa, Mycobacterium
GIAPSNAYPCADG

SEQ ID NO: 487667 - protein, 12 aa, Mycobacterium
GIAPTDLAETNS

SEQ ID NO: 487668 - protein, 25 aa, Mycobacterium
GIAPTLSTATASATAPAAAPAPAAG

SEQ ID NO: 487669 - protein, 13 aa, Mycobacterium
GIAPTSLANSNTG

SEQ ID NO: 487670 - protein, 12 aa, Mycobacterium
GIAPTTDAEAGQ

SEQ ID NO: 487671 - protein, 4 aa, Mycobacterium
GIAR

SEQ ID NO: 487672 - protein, 5 aa, Mycobacterium
GIARS

SEQ ID NO: 487673 - protein, 15 aa, Mycobacterium
GIASDGNEVIGEPAA

SEQ ID NO: 487674 - protein, 11 aa, Mycobacterium
GIASDGSEVIG

SEQ ID NO: 487675 - protein, 10 aa, Mycobacterium
GIASGGTSVN

SEQ ID NO: 487676 - protein, 6 aa, Mycobacterium
GIASGR

SEQ ID NO: 487677 - protein, 6 aa, Mycobacterium
GIASPE

SEQ ID NO: 487678 - protein, 10 aa, Mycobacterium
GIASSATKDT

SEQ ID NO: 487679 - protein, 8 aa, Mycobacterium
GIATDDPV

SEQ ID NO: 487680 - protein, 8 aa, Mycobacterium
GIATPPQR

SEQ ID NO: 487681 - protein, 6 aa, Mycobacterium
GIATPR

SEQ ID NO: 487682 - protein, 8 aa, Mycobacterium
GIATQDPH

SEQ ID NO: 487683 - protein, 5 aa, Mycobacterium
GIATT

SEQ ID NO: 487684 - protein, 9 aa, Mycobacterium
GIATTTAEE

SEQ ID NO: 487685 - protein, 4 aa, Mycobacterium
GIDA

SEQ ID NO: 487686 - protein, 5 aa, Mycobacterium
GIDAA

SEQ ID NO: 487687 - protein, 6 aa, Mycobacterium
GIDAGD

SEQ ID NO: 487688 - protein, 9 aa, Mycobacterium
GIDAGTAAQ

SEQ ID NO: 487689 - protein, 6 aa, Mycobacterium
GIDAPG

SEQ ID NO: 487690 - protein, 11 aa, Mycobacterium
GIDAPPASRYE

SEQ ID NO: 487691 - protein, 9 aa, Mycobacterium
GIDARRSHG

SEQ ID NO: 487692 - protein, 9 aa, Mycobacterium
GIDASNVDT

SEQ ID NO: 487693 - protein, 5 aa, Mycobacterium
GIDAT

SEQ ID NO: 487694 - protein, 7 aa, Mycobacterium
GIDDATA

SEQ ID NO: 487695 - protein, 6 aa, Mycobacterium
GIDDNG

SEQ ID NO: 487696 - protein, 9 aa, Mycobacterium
GIDDPHSAE

SEQ ID NO: 487697 - protein, 15 aa, Mycobacterium
GIDDPQRRAAQYPHE

SEQ ID NO: 487698 - protein, 4 aa, Mycobacterium
GIDE

SEQ ID NO: 487699 - protein, 7 aa, Mycobacterium
GIDEDTK

SEQ ID NO: 487700 - protein, 5 aa, Mycobacterium
GIDEG

SEQ ID NO: 487701 - protein, 12 aa, Mycobacterium
GIDEPRSIQPRR

SEQ ID NO: 487702 - protein, 29 aa, Mycobacterium
GIDGDPGGPPDGGAGGGGGAGGIGGAGAV

SEQ ID NO: 487703 - protein, 6 aa, Mycobacterium
GIDGGR

SEQ ID NO: 487704 - protein, 6 aa, Mycobacterium
GIDGGV

SEQ ID NO: 487705 - protein, 15 aa, Mycobacterium
GIDGKDPAATLTDGT

SEQ ID NO: 487706 - protein, 7 aa, Mycobacterium
GIDGRDA

SEQ ID NO: 487707 - protein, 7 aa, Mycobacterium
GIDGSDW

SEQ ID NO: 487708 - protein, 9 aa, Mycobacterium
GIDKQKVGQ

SEQ ID NO: 487709 - protein, 8 aa, Mycobacterium
GIDKRRRA

SEQ ID NO: 487710 - protein, 18 aa, Mycobacterium
GIDNSTGGFADAPDDDLR

SEQ ID NO: 487711 - protein, 5 aa, Mycobacterium
GIDPA

SEQ ID NO: 487712 - protein, 8 aa, Mycobacterium
GIDPAAAS

SEQ ID NO: 487713 - protein, 10 aa, Mycobacterium
GIDPADVTTG

SEQ ID NO: 487714 - protein, 10 aa, Mycobacterium
GIDPAKRGAV

SEQ ID NO: 487715 - protein, 13 aa, Mycobacterium
GIDPARLRGSATG

SEQ ID NO: 487716 - protein, 10 aa, Mycobacterium
GIDPDRGWGH

SEQ ID NO: 487717 - protein, 6 aa, Mycobacterium
GIDPDT

SEQ ID NO: 487718 - protein, 5 aa, Mycobacterium
GIDPE

SEQ ID NO: 487719 - protein, 7 aa, Mycobacterium
GIDPEEY

SEQ ID NO: 487720 - protein, 11 aa, Mycobacterium
GIDPEKVNVNG

SEQ ID NO: 487721 - protein, 7 aa, Mycobacterium
GIDPEQY

SEQ ID NO: 487722 - protein, 9 aa, Mycobacterium
GIDPERGWG

SEQ ID NO: 487723 - protein, 5 aa, Mycobacterium
GIDPF

SEQ ID NO: 487724 - protein, 6 aa, Mycobacterium
GIDPGA

SEQ ID NO: 487725 - protein, 16 aa, Mycobacterium
GIDPNSVSAWSQRASQ

SEQ ID NO: 487726 - protein, 9 aa, Mycobacterium
GIDPPDVTT

SEQ ID NO: 487727 - protein, 8 aa, Mycobacterium
GIDPQPLR

SEQ ID NO: 487728 - protein, 8 aa, Mycobacterium
GIDPQTGS

SEQ ID NO: 487729 - protein, 6 aa, Mycobacterium
GIDPTV

SEQ ID NO: 487730 - protein, 7 aa, Mycobacterium
GIDQDRR

SEQ ID NO: 487731 - protein, 5 aa, Mycobacterium
GIDQG

SEQ ID NO: 487732 - protein, 8 aa, Mycobacterium
GIDRDGPV

SEQ ID NO: 487733 - protein, 6 aa, Mycobacterium
GIDREA

SEQ ID NO: 487734 - protein, 7 aa, Mycobacterium
GIDREQA

SEQ ID NO: 487735 - protein, 5 aa, Mycobacterium
GIDRS

SEQ ID NO: 487736 - protein, 16 aa, Mycobacterium
GIDRSARRQEPAAERQ

SEQ ID NO: 487737 - protein, 5 aa, Mycobacterium
GIDRY

SEQ ID NO: 487738 - protein, 4 aa, Mycobacterium
GIDS

SEQ ID NO: 487739 - protein, 6 aa, Mycobacterium
GIDSGA

SEQ ID NO: 487740 - protein, 11 aa, Mycobacterium
GIDSPDGLVPR

SEQ ID NO: 487741 - protein, 10 aa, Mycobacterium
GIDSSNATGR

SEQ ID NO: 487742 - protein, 6 aa, Mycobacterium
GIDSST

SEQ ID NO: 487743 - protein, 5 aa, Mycobacterium
GIDTD

SEQ ID NO: 487744 - protein, 6 aa, Mycobacterium
GIDTDQ

SEQ ID NO: 487745 - protein, 14 aa, Mycobacterium
GIDTLPSARADNTA

SEQ ID NO: 487746 - protein, 5 aa, Mycobacterium
GIDTR

SEQ ID NO: 487747 - protein, 10 aa, Mycobacterium
GIDTSNATGR

SEQ ID NO: 487748 - protein, 11 aa, Mycobacterium
GIDTTQATLSR

SEQ ID NO: 487749 - protein, 5 aa, Mycobacterium
GIDTV

SEQ ID NO: 487750 - protein, 11 aa, Mycobacterium
GIDTVDGTHRQ

SEQ ID NO: 487751 - protein, 7 aa, Mycobacterium
GIEAGAP

SEQ ID NO: 487752 - protein, 6 aa, Mycobacterium
GIEAGD

SEQ ID NO: 487753 - protein, 5 aa, Mycobacterium
GIEAQ

SEQ ID NO: 487754 - protein, 9 aa, Mycobacterium
GIEAQGAEA

SEQ ID NO: 487755 - protein, 7 aa, Mycobacterium
GIEASDD

SEQ ID NO: 487756 - protein, 9 aa, Mycobacterium
GIEATSDGF

SEQ ID NO: 487757 - protein, 64 aa, Mycobacterium
GIEDESPALTYSGPSEDGSAQVQRNGGGAAKTPAGVPAGGSRRERREAARRQGRGAKPPKSVKK

SEQ ID NO: 487758 - protein, 6 aa, Mycobacterium
GIEDGT

SEQ ID NO: 487759 - protein, 6 aa, Mycobacterium
GIEDTD

SEQ ID NO: 487760 - protein, 13 aa, Mycobacterium
GIEDTYKTGRGSI

SEQ ID NO: 487761 - protein, 7 aa, Mycobacterium
GIEETPT

SEQ ID NO: 487762 - protein, 9 aa, Mycobacterium
GIEGDSAGR

SEQ ID NO: 487763 - protein, 5 aa, Mycobacterium
GIEGL

SEQ ID NO: 487764 - protein, 6 aa, Mycobacterium
GIEGNR

SEQ ID NO: 487765 - protein, 7 aa, Mycobacterium
GIEHPEH

SEQ ID NO: 487766 - protein, 4 aa, Mycobacterium
GIEL

SEQ ID NO: 487767 - protein, 4 aa, Mycobacterium
GIEP

SEQ ID NO: 487768 - protein, 15 aa, Mycobacterium
GIEPADAKRITADSQ

SEQ ID NO: 487769 - protein, 22 aa, Mycobacterium
GIEPDPKQRLGGSSLSGDTGRE

SEQ ID NO: 487770 - protein, 12 aa, Mycobacterium
GIEPGGLRGSAT

SEQ ID NO: 487771 - protein, 7 aa, Mycobacterium
GIEPGSE

SEQ ID NO: 487772 - protein, 7 aa, Mycobacterium
GIEPHRN

SEQ ID NO: 487773 - protein, 9 aa, Mycobacterium
GIEPKPLTT

SEQ ID NO: 487774 - protein, 8 aa, Mycobacterium
GIEPNSIG

SEQ ID NO: 487775 - protein, 6 aa, Mycobacterium
GIEPQY

SEQ ID NO: 487776 - protein, 7 aa, Mycobacterium
GIEPRSS

SEQ ID NO: 487777 - protein, 7 aa, Mycobacterium
GIEPSEV

SEQ ID NO: 487778 - protein, 7 aa, Mycobacterium
GIEPSRT

SEQ ID NO: 487779 - protein, 20 aa, Mycobacterium
GIEPTAVTSRRTGRADVTGP

SEQ ID NO: 487780 - protein, 9 aa, Mycobacterium
GIEPTNRQP

SEQ ID NO: 487781 - protein, 4 aa, Mycobacterium
GIEQ

SEQ ID NO: 487782 - protein, 4 aa, Mycobacterium
GIER

SEQ ID NO: 487783 - protein, 5 aa, Mycobacterium
GIERG

SEQ ID NO: 487784 - protein, 5 aa, Mycobacterium
GIERP

SEQ ID NO: 487785 - protein, 5 aa, Mycobacterium
GIESE

SEQ ID NO: 487786 - protein, 23 aa, Mycobacterium
GIESPALPPAPAPQRPAAPPRDA

SEQ ID NO: 487787 - protein, 4 aa, Mycobacterium
GIEV

SEQ ID NO: 487788 - protein, 4 aa, Mycobacterium
GIEY

SEQ ID NO: 487789 - protein, 7 aa, Mycobacterium
GIGAATA

SEQ ID NO: 487790 - protein, 5 aa, Mycobacterium
GIGAD

SEQ ID NO: 487791 - protein, 24 aa, Mycobacterium
GIGADGQSGGPGVGGGSGGNGGAA

SEQ ID NO: 487792 - protein, 14 aa, Mycobacterium
GIGAGASAAPTGAL

SEQ ID NO: 487793 - protein, 14 aa, Mycobacterium
GIGAGGNRIGATSI

SEQ ID NO: 487794 - protein, 14 aa, Mycobacterium
GIGAGGNRIGATSV

SEQ ID NO: 487795 - protein, 18 aa, Mycobacterium
GIGAGGNVVGATSTSDWS

SEQ ID NO: 487796 - protein, 7 aa, Mycobacterium
GIGAGGQ

SEQ ID NO: 487797 - protein, 9 aa, Mycobacterium
GIGAPGDSY

SEQ ID NO: 487798 - protein, 16 aa, Mycobacterium
GIGAPSWTADYGSETL

SEQ ID NO: 487799 - protein, 7 aa, Mycobacterium
GIGASAA

SEQ ID NO: 487800 - protein, 12 aa, Mycobacterium
GIGASESKIGSV

SEQ ID NO: 487801 - protein, 14 aa, Mycobacterium
GIGATENADGFSTQ

SEQ ID NO: 487802 - protein, 13 aa, Mycobacterium
GIGATENAQGFTT

SEQ ID NO: 487803 - protein, 17 aa, Mycobacterium
GIGDAYSAGDGTYPPIQ

SEQ ID NO: 487804 - protein, 7 aa, Mycobacterium
GIGDRRQ

SEQ ID NO: 487805 - protein, 10 aa, Mycobacterium
GIGDSTAKRL

SEQ ID NO: 487806 - protein, 6 aa, Mycobacterium
GIGDTG

SEQ ID NO: 487807 - protein, 7 aa, Mycobacterium
GIGDTGA

SEQ ID NO: 487808 - protein, 7 aa, Mycobacterium
GIGDTPA

SEQ ID NO: 487809 - protein, 13 aa, Mycobacterium
GIGEATARKLAAA

SEQ ID NO: 487810 - protein, 5 aa, Mycobacterium
GIGEG

SEQ ID NO: 487811 - protein, 41 aa, Mycobacterium
GIGEGGKIGDAGFGGNPPNSQTGEGGSGGAGGAGGAGGDPS

SEQ ID NO: 487812 - protein, 8 aa, Mycobacterium
GIGEKTAA

SEQ ID NO: 487813 - protein, 8 aa, Mycobacterium
GIGENQRN

SEQ ID NO: 487814 - protein, 17 aa, Mycobacterium
GIGEQDRRTSAAATALG

SEQ ID NO: 487815 - protein, 12 aa, Mycobacterium
GIGGADVRSGTG

SEQ ID NO: 487816 - protein, 24 aa, Mycobacterium
GIGGAGGAGYFSSGGVGGGGGTGG

SEQ ID NO: 487817 - protein, 70 aa, Mycobacterium
GIGGAGGGGGIGGTGAVGGGGGAGGAAGDGAFGGGPFHTGQGGVGGDGGDGGAGGDGGNGGNGGAGGAGG

SEQ ID NO: 487818 - protein, 5 aa, Mycobacterium
GIGGD

SEQ ID NO: 487819 - protein, 8 aa, Mycobacterium
GIGGDGGD

SEQ ID NO: 487820 - protein, 11 aa, Mycobacterium
GIGGDTGRELA

SEQ ID NO: 487821 - protein, 7 aa, Mycobacterium
GIGGEPL

SEQ ID NO: 487822 - protein, 9 aa, Mycobacterium
GIGGGGVAG

SEQ ID NO: 487823 - protein, 70 aa, Mycobacterium
GIGGIGGTGGVGGIGGTGGDGGTGGVGGSALNTGSGVADANIGGDGGDAGTGGDGGTGGVGGVGGSGGAG

SEQ ID NO: 487824 - protein, 5 aa, Mycobacterium
GIGGL

SEQ ID NO: 487825 - protein, 23 aa, Mycobacterium
GIGGNGGYGTTGGGDGGNGGNAA

SEQ ID NO: 487826 - protein, 7 aa, Mycobacterium
GIGGPGG

SEQ ID NO: 487827 - protein, 10 aa, Mycobacterium
GIGGQGGTAM

SEQ ID NO: 487828 - protein, 34 aa, Mycobacterium
GIGGQGGTGGEAGGGTGIHAGNGGTGGNGGGGGW

SEQ ID NO: 487829 - protein, 24 aa, Mycobacterium
GIGGQVTANGARGLGVGTAATAEV

SEQ ID NO: 487830 - protein, 6 aa, Mycobacterium
GIGGRR

SEQ ID NO: 487831 - protein, 6 aa, Mycobacterium
GIGGST

SEQ ID NO: 487832 - protein, 43 aa, Mycobacterium
GIGGTGGAGATGGSGGAGGVGFGSGGTGGFGGAGAAGGTGGDG

SEQ ID NO: 487833 - protein, 23 aa, Mycobacterium
GIGGTGGANALGTGGTGGLGGSA

SEQ ID NO: 487834 - protein, 22 aa, Mycobacterium
GIGGTGGSGIDGGAGGAGGAGG

SEQ ID NO: 487835 - protein, 19 aa, Mycobacterium
GIGGTGGSNANGGVGGQAG

SEQ ID NO: 487836 - protein, 4 aa, Mycobacterium
GIGH

SEQ ID NO: 487837 - protein, 12 aa, Mycobacterium
GIGKGSVSVPDV

SEQ ID NO: 487838 - protein, 11 aa, Mycobacterium
GIGKPEPLKGE

SEQ ID NO: 487839 - protein, 8 aa, Mycobacterium
GIGKRGAE

SEQ ID NO: 487840 - protein, 13 aa, Mycobacterium
GIGKSGNPRTMDG

SEQ ID NO: 487841 - protein, 6 aa, Mycobacterium
GIGKTR

SEQ ID NO: 487842 - protein, 5 aa, Mycobacterium
GIGMS

SEQ ID NO: 487843 - protein, 5 aa, Mycobacterium
GIGMT

SEQ ID NO: 487844 - protein, 4 aa, Mycobacterium
GIGN

SEQ ID NO: 487845 - protein, 49 aa, Mycobacterium
GIGNAGDFNTGTFNAGDANTGNANSGSYNTGGFNSGNYDTGWANTGDVD

SEQ ID NO: 487846 - protein, 12 aa, Mycobacterium
GIGNAGNYNTGC

SEQ ID NO: 487847 - protein, 16 aa, Mycobacterium
GIGNAGVPSTGPTVSG

SEQ ID NO: 487848 - protein, 17 aa, Mycobacterium
GIGNGGATLDKTSEADW

SEQ ID NO: 487849 - protein, 16 aa, Mycobacterium
GIGNGGATLDKTSEHD

SEQ ID NO: 487850 - protein, 17 aa, Mycobacterium
GIGNGGDTLDKTSEEDW

SEQ ID NO: 487851 - protein, 16 aa, Mycobacterium
GIGNGGDTLDKTTEHD

SEQ ID NO: 487852 - protein, 17 aa, Mycobacterium
GIGNGGDTLDQTSEEDW

SEQ ID NO: 487853 - protein, 17 aa, Mycobacterium
GIGNGGETLDKTSEEDW

SEQ ID NO: 487854 - protein, 17 aa, Mycobacterium
GIGNGGQTLDHTSEEDW

SEQ ID NO: 487855 - protein, 17 aa, Mycobacterium
GIGNGGQTLDKTDEPDW

SEQ ID NO: 487856 - protein, 17 aa, Mycobacterium
GIGNGGQTLDKTSEDDW

SEQ ID NO: 487857 - protein, 17 aa, Mycobacterium
GIGNGGQTLDKTSEEDW

SEQ ID NO: 487858 - protein, 10 aa, Mycobacterium
GIGNGGQTVE

SEQ ID NO: 487859 - protein, 12 aa, Mycobacterium
GIGNGGVGSNGI

SEQ ID NO: 487860 - protein, 59 aa, Mycobacterium
GIGNSGFRNTGIGNSGAGPLAGSNTGFGNTGEHNTGFANAGDFNAGSFNGGNHSTGSFN

SEQ ID NO: 487861 - protein, 5 aa, Mycobacterium
GIGNT

SEQ ID NO: 487862 - protein, 6 aa, Mycobacterium
GIGNTG

SEQ ID NO: 487863 - protein, 4 aa, Mycobacterium
GIGP

SEQ ID NO: 487864 - protein, 7 aa, Mycobacterium
GIGPADL

SEQ ID NO: 487865 - protein, 6 aa, Mycobacterium
GIGPAE

SEQ ID NO: 487866 - protein, 7 aa, Mycobacterium
GIGPAQL

SEQ ID NO: 487867 - protein, 7 aa, Mycobacterium
GIGPEKT

SEQ ID NO: 487868 - protein, 7 aa, Mycobacterium
GIGPGAA

SEQ ID NO: 487869 - protein, 8 aa, Mycobacterium
GIGPGATW

SEQ ID NO: 487870 - protein, 6 aa, Mycobacterium
GIGPGD

SEQ ID NO: 487871 - protein, 10 aa, Mycobacterium
GIGPGDAPFG

SEQ ID NO: 487872 - protein, 27 aa, Mycobacterium
GIGPGGRNSRRHGERQDQGGFSKGRVK

SEQ ID NO: 487873 - protein, 6 aa, Mycobacterium
GIGPGQ

SEQ ID NO: 487874 - protein, 6 aa, Mycobacterium
GIGPGS

SEQ ID NO: 487875 - protein, 20 aa, Mycobacterium
GIGPRAPGSPRAAGRSARNY

SEQ ID NO: 487876 - protein, 18 aa, Mycobacterium
GIGPRSPLPGDDGLSPVT

SEQ ID NO: 487877 - protein, 7 aa, Mycobacterium
GIGPSRT

SEQ ID NO: 487878 - protein, 9 aa, Mycobacterium
GIGPTAPLG

SEQ ID NO: 487879 - protein, 8 aa, Mycobacterium
GIGPVGGR

SEQ ID NO: 487880 - protein, 5 aa, Mycobacterium
GIGQQ

SEQ ID NO: 487881 - protein, 11 aa, Mycobacterium
GIGRATAERFG

SEQ ID NO: 487882 - protein, 6 aa, Mycobacterium
GIGRDQ

SEQ ID NO: 487883 - protein, 8 aa, Mycobacterium
GIGRENGI

SEQ ID NO: 487884 - protein, 6 aa, Mycobacterium
GIGRET

SEQ ID NO: 487885 - protein, 17 aa, Mycobacterium
GIGRPARQRTTDYTPLA

SEQ ID NO: 487886 - protein, 17 aa, Mycobacterium
GIGRPARQRTTTYAPRA

SEQ ID NO: 487887 - protein, 19 aa, Mycobacterium
GIGRPAVERTTTYARRPSA

SEQ ID NO: 487888 - protein, 12 aa, Mycobacterium
GIGRPQSPDAAT

SEQ ID NO: 487889 - protein, 9 aa, Mycobacterium
GIGRQNGIE

SEQ ID NO: 487890 - protein, 12 aa, Mycobacterium
GIGSDAAAPAVE

SEQ ID NO: 487891 - protein, 7 aa, Mycobacterium
GIGSGQQ

SEQ ID NO: 487892 - protein, 6 aa, Mycobacterium
GIGSGY

SEQ ID NO: 487893 - protein, 11 aa, Mycobacterium
GIGSKGGAGDV

SEQ ID NO: 487894 - protein, 15 aa, Mycobacterium
GIGSPKPLHETDDET

SEQ ID NO: 487895 - protein, 8 aa, Mycobacterium
GIGSPPDA

SEQ ID NO: 487896 - protein, 9 aa, Mycobacterium
GIGSSNKKL

SEQ ID NO: 487897 - protein, 19 aa, Mycobacterium
GIGSTIDAASAAAAGPTSR

SEQ ID NO: 487898 - protein, 4 aa, Mycobacterium
GIGT

SEQ ID NO: 487899 - protein, 6 aa, Mycobacterium
GIGTAR

SEQ ID NO: 487900 - protein, 16 aa, Mycobacterium
GIGTASRVTDTAAGRY

SEQ ID NO: 487901 - protein, 13 aa, Mycobacterium
GIGTCTPHDGRPD

SEQ ID NO: 487902 - protein, 6 aa, Mycobacterium
GIGTEQ

SEQ ID NO: 487903 - protein, 7 aa, Mycobacterium
GIGTGAI

SEQ ID NO: 487904 - protein, 6 aa, Mycobacterium
GIGTGG

SEQ ID NO: 487905 - protein, 7 aa, Mycobacterium
GIGTGGL

SEQ ID NO: 487906 - protein, 7 aa, Mycobacterium
GIGTGHR

SEQ ID NO: 487907 - protein, 15 aa, Mycobacterium
GIGTGHSSVGDQEKA

SEQ ID NO: 487908 - protein, 15 aa, Mycobacterium
GIGTGHSSVGDQQRA

SEQ ID NO: 487909 - protein, 8 aa, Mycobacterium
GIGTGKST

SEQ ID NO: 487910 - protein, 7 aa, Mycobacterium
GIGTGKT

SEQ ID NO: 487911 - protein, 10 aa, Mycobacterium
GIGTPEQAAE

SEQ ID NO: 487912 - protein, 11 aa, Mycobacterium
GIGTPERSAEY

SEQ ID NO: 487913 - protein, 8 aa, Mycobacterium
GIHDPRAG

SEQ ID NO: 487914 - protein, 5 aa, Mycobacterium
GIHER

SEQ ID NO: 487915 - protein, 8 aa, Mycobacterium
GIKATDSL

SEQ ID NO: 487916 - protein, 5 aa, Mycobacterium
GIKDA

SEQ ID NO: 487917 - protein, 13 aa, Mycobacterium
GIKDEDGRQPPSY

SEQ ID NO: 487918 - protein, 7 aa, Mycobacterium
GIKDSLS

SEQ ID NO: 487919 - protein, 7 aa, Mycobacterium
GIKDTSE

SEQ ID NO: 487920 - protein, 4 aa, Mycobacterium
GIKN

SEQ ID NO: 487921 - protein, 5 aa, Mycobacterium
GIKNE

SEQ ID NO: 487922 - protein, 20 aa, Mycobacterium
GIKPSAPGAPRRAGRSARNY

SEQ ID NO: 487923 - protein, 11 aa, Mycobacterium
GIKRDPDDSSE

SEQ ID NO: 487924 - protein, 8 aa, Mycobacterium
GIKRPDYS

SEQ ID NO: 487925 - protein, 4 aa, Mycobacterium
GIKS

SEQ ID NO: 487926 - protein, 9 aa, Mycobacterium
GIKSSGAPD

SEQ ID NO: 487927 - protein, 10 aa, Mycobacterium
GILEDADGNR

SEQ ID NO: 487928 - protein, 4 aa, Mycobacterium
GINA

SEQ ID NO: 487929 - protein, 13 aa, Mycobacterium
GINDDTIEQAAEA

SEQ ID NO: 487930 - protein, 13 aa, Mycobacterium
GINGDTIEQAAEA

SEQ ID NO: 487931 - protein, 5 aa, Mycobacterium
GINGE

SEQ ID NO: 487932 - protein, 13 aa, Mycobacterium
GINGTYPGRPQRI

SEQ ID NO: 487933 - protein, 8 aa, Mycobacterium
GINNDEAR

SEQ ID NO: 487934 - protein, 31 aa, Mycobacterium
GINPADLQDPLRPDGTRTNGSYRLKSIPDEL

SEQ ID NO: 487935 - protein, 6 aa, Mycobacterium
GINPAE

SEQ ID NO: 487936 - protein, 8 aa, Mycobacterium
GINPDGVV

SEQ ID NO: 487937 - protein, 10 aa, Mycobacterium
GINPGEAAIR

SEQ ID NO: 487938 - protein, 8 aa, Mycobacterium
GINPGEAG

SEQ ID NO: 487939 - protein, 8 aa, Mycobacterium
GINPGEAK

SEQ ID NO: 487940 - protein, 7 aa, Mycobacterium
GINPPNG

SEQ ID NO: 487941 - protein, 8 aa, Mycobacterium
GINPPPHI

SEQ ID NO: 487942 - protein, 10 aa, Mycobacterium
GINPQSDWRS

SEQ ID NO: 487943 - protein, 5 aa, Mycobacterium
GINPR

SEQ ID NO: 487944 - protein, 8 aa, Mycobacterium
GINRRTTQ

SEQ ID NO: 487945 - protein, 25 aa, Mycobacterium
GINSPPVAVPPAEPGPPTPGRDEPL

SEQ ID NO: 487946 - protein, 13 aa, Mycobacterium
GINTDTIEQAAEA

SEQ ID NO: 487947 - protein, 12 aa, Mycobacterium
GINTTVPGNGAD

SEQ ID NO: 487948 - protein, 7 aa, Mycobacterium
GIPAAPV

SEQ ID NO: 487949 - protein, 6 aa, Mycobacterium
GIPADY

SEQ ID NO: 487950 - protein, 5 aa, Mycobacterium
GIPAE

SEQ ID NO: 487951 - protein, 8 aa, Mycobacterium
GIPAGRAN

SEQ ID NO: 487952 - protein, 33 aa, Mycobacterium
GIPAHRGSDGLVGRPGSGSSSGAAGVRAKPGAA

SEQ ID NO: 487953 - protein, 15 aa, Mycobacterium
GIPASSKSTQQAGSA

SEQ ID NO: 487954 - protein, 12 aa, Mycobacterium
GIPDKEAGNSAS

SEQ ID NO: 487955 - protein, 9 aa, Mycobacterium
GIPDPGQPA

SEQ ID NO: 487956 - protein, 12 aa, Mycobacterium
GIPDRDARGQRV

SEQ ID NO: 487957 - protein, 9 aa, Mycobacterium
GIPDSHEDG

SEQ ID NO: 487958 - protein, 5 aa, Mycobacterium
GIPDY

SEQ ID NO: 487959 - protein, 4 aa, Mycobacterium
GIPE

SEQ ID NO: 487960 - protein, 9 aa, Mycobacterium
GIPEAEKQR

SEQ ID NO: 487961 - protein, 7 aa, Mycobacterium
GIPEAKG

SEQ ID NO: 487962 - protein, 25 aa, Mycobacterium
GIPEDTGLRPDLPRPGVPSGAGDSV

SEQ ID NO: 487963 - protein, 7 aa, Mycobacterium
GIPEEDA

SEQ ID NO: 487964 - protein, 6 aa, Mycobacterium
GIPEEQ

SEQ ID NO: 487965 - protein, 7 aa, Mycobacterium
GIPEEQA

SEQ ID NO: 487966 - protein, 18 aa, Mycobacterium
GIPEPDPTDSAASSWAPT

SEQ ID NO: 487967 - protein, 7 aa, Mycobacterium
GIPEPER

SEQ ID NO: 487968 - protein, 4 aa, Mycobacterium
GIPG

SEQ ID NO: 487969 - protein, 6 aa, Mycobacterium
GIPGAI

SEQ ID NO: 487970 - protein, 18 aa, Mycobacterium
GIPGASGYSASKAAVESL

SEQ ID NO: 487971 - protein, 12 aa, Mycobacterium
GIPGDEKGVTAA

SEQ ID NO: 487972 - protein, 8 aa, Mycobacterium
GIPGDSAV

SEQ ID NO: 487973 - protein, 7 aa, Mycobacterium
GIPGELD

SEQ ID NO: 487974 - protein, 6 aa, Mycobacterium
GIPGPL

SEQ ID NO: 487975 - protein, 6 aa, Mycobacterium
GIPGPR

SEQ ID NO: 487976 - protein, 7 aa, Mycobacterium
GIPGPRK

SEQ ID NO: 487977 - protein, 11 aa, Mycobacterium
GIPGPRKVPGP

SEQ ID NO: 487978 - protein, 6 aa, Mycobacterium
GIPGQD

SEQ ID NO: 487979 - protein, 11 aa, Mycobacterium
GIPGQNPSQNL

SEQ ID NO: 487980 - protein, 7 aa, Mycobacterium
GIPGRDA

SEQ ID NO: 487981 - protein, 12 aa, Mycobacterium
GIPGRDERGQRV

SEQ ID NO: 487982 - protein, 12 aa, Mycobacterium
GIPGSDTEHHSA

SEQ ID NO: 487983 - protein, 13 aa, Mycobacterium
GIPGSSALEPEVE

SEQ ID NO: 487984 - protein, 7 aa, Mycobacterium
GIPGSTA

SEQ ID NO: 487985 - protein, 5 aa, Mycobacterium
GIPGV

SEQ ID NO: 487986 - protein, 9 aa, Mycobacterium
GIPGVAEGT

SEQ ID NO: 487987 - protein, 5 aa, Mycobacterium
GIPGY

SEQ ID NO: 487988 - protein, 10 aa, Mycobacterium
GIPHTRTGKK

SEQ ID NO: 487989 - protein, 4 aa, Mycobacterium
GIPK

SEQ ID NO: 487990 - protein, 8 aa, Mycobacterium
GIPKPHRR

SEQ ID NO: 487991 - protein, 12 aa, Mycobacterium
GIPNDRYSGSPV

SEQ ID NO: 487992 - protein, 5 aa, Mycobacterium
GIPNP

SEQ ID NO: 487993 - protein, 12 aa, Mycobacterium
GIPPDSLAGTRT

SEQ ID NO: 487994 - protein, 5 aa, Mycobacterium
GIPPE

SEQ ID NO: 487995 - protein, 6 aa, Mycobacterium
GIPPEQ

SEQ ID NO: 487996 - protein, 19 aa, Mycobacterium
GIPPPPPPPPEDAPPVPVG

SEQ ID NO: 487997 - protein, 10 aa, Mycobacterium
GIPPPPPPPV

SEQ ID NO: 487998 - protein, 12 aa, Mycobacterium
GIPPRSLAGSDT

SEQ ID NO: 487999 - protein, 13 aa, Mycobacterium
GIPPSSLRRSQTG

SEQ ID NO: 488000 - protein, 6 aa, Mycobacterium
GIPPTR

SEQ ID NO: 488001 - protein, 13 aa, Mycobacterium
GIPPTSLRRSQTG

SEQ ID NO: 488002 - protein, 12 aa, Mycobacterium
GIPPTTESADGF

SEQ ID NO: 488003 - protein, 8 aa, Mycobacterium
GIPPTVDT

SEQ ID NO: 488004 - protein, 12 aa, Mycobacterium
GIPRPDHNDRMP

SEQ ID NO: 488005 - protein, 19 aa, Mycobacterium
GIPSHTAPETPGSIHEGGE

SEQ ID NO: 488006 - protein, 9 aa, Mycobacterium
GIPSTRPLT

SEQ ID NO: 488007 - protein, 10 aa, Mycobacterium
GIPSYPSNNS

SEQ ID NO: 488008 - protein, 9 aa, Mycobacterium
GIPTAQPLT

SEQ ID NO: 488009 - protein, 8 aa, Mycobacterium
GIPTEGPV

SEQ ID NO: 488010 - protein, 9 aa, Mycobacterium
GIPTEGTAA

SEQ ID NO: 488011 - protein, 11 aa, Mycobacterium
GIPTESLAGTR

SEQ ID NO: 488012 - protein, 6 aa, Mycobacterium
GIPTGP

SEQ ID NO: 488013 - protein, 5 aa, Mycobacterium
GIPTH

SEQ ID NO: 488014 - protein, 6 aa, Mycobacterium
GIPTRS

SEQ ID NO: 488015 - protein, 19 aa, Mycobacterium
GIPTSPSDAPPSQPAAHAN

SEQ ID NO: 488016 - protein, 13 aa, Mycobacterium
GIPTTPHPTLTSS

SEQ ID NO: 488017 - protein, 4 aa, Mycobacterium
GIPV

SEQ ID NO: 488018 - protein, 11 aa, Mycobacterium
GIPVDDPDGYR

SEQ ID NO: 488019 - protein, 9 aa, Mycobacterium
GIPVDDPNG

SEQ ID NO: 488020 - protein, 12 aa, Mycobacterium
GIPVSRGSATPL

SEQ ID NO: 488021 - protein, 6 aa, Mycobacterium
GIQAGG

SEQ ID NO: 488022 - protein, 14 aa, Mycobacterium
GIQAGGGVSTYRAS

SEQ ID NO: 488023 - protein, 4 aa, Mycobacterium
GIQD

SEQ ID NO: 488024 - protein, 5 aa, Mycobacterium
GIQDG

SEQ ID NO: 488025 - protein, 5 aa, Mycobacterium
GIQEG

SEQ ID NO: 488026 - protein, 13 aa, Mycobacterium
GIQKTSDANREAF

SEQ ID NO: 488027 - protein, 12 aa, Mycobacterium
GIQPDSLSGSRT

SEQ ID NO: 488028 - protein, 8 aa, Mycobacterium
GIQPETAR

SEQ ID NO: 488029 - protein, 14 aa, Mycobacterium
GIQPSPNVVSIATT

SEQ ID NO: 488030 - protein, 5 aa, Mycobacterium
GIQQR

SEQ ID NO: 488031 - protein, 8 aa, Mycobacterium
GIQSPRGA

SEQ ID NO: 488032 - protein, 6 aa, Mycobacterium
GIRATT

SEQ ID NO: 488033 - protein, 5 aa, Mycobacterium
GIRDG

SEQ ID NO: 488034 - protein, 16 aa, Mycobacterium
GIRGAGAGPDLPTARR

SEQ ID NO: 488035 - protein, 18 aa, Mycobacterium
GIRGDDVEDDDAVRAGQT

SEQ ID NO: 488036 - protein, 6 aa, Mycobacterium
GIRKNT

SEQ ID NO: 488037 - protein, 5 aa, Mycobacterium
GIRPD

SEQ ID NO: 488038 - protein, 5 aa, Mycobacterium
GIRPG

SEQ ID NO: 488039 - protein, 6 aa, Mycobacterium
GIRPGD

SEQ ID NO: 488040 - protein, 7 aa, Mycobacterium
GIRPGDT

SEQ ID NO: 488041 - protein, 5 aa, Mycobacterium
GIRRE

SEQ ID NO: 488042 - protein, 9 aa, Mycobacterium
GIRRGGTVE

SEQ ID NO: 488043 - protein, 6 aa, Mycobacterium
GIRSAT

SEQ ID NO: 488044 - protein, 7 aa, Mycobacterium
GIRSDSD

SEQ ID NO: 488045 - protein, 5 aa, Mycobacterium
GIRSS

SEQ ID NO: 488046 - protein, 6 aa, Mycobacterium
GIRTGM

SEQ ID NO: 488047 - protein, 6 aa, Mycobacterium
GIRTPA

SEQ ID NO: 488048 - protein, 7 aa, Mycobacterium
GIRTPRP

SEQ ID NO: 488049 - protein, 11 aa, Mycobacterium
GIRTRGGAQRD

SEQ ID NO: 488050 - protein, 21 aa, Mycobacterium
GIRTTSSSAQRADYVPDADSV

SEQ ID NO: 488051 - protein, 15 aa, Mycobacterium
GISAANGANAAEGAL

SEQ ID NO: 488052 - protein, 13 aa, Mycobacterium
GISAGIKASGKPD

SEQ ID NO: 488053 - protein, 10 aa, Mycobacterium
GISAPAAATD

SEQ ID NO: 488054 - protein, 8 aa, Mycobacterium
GISAPGGV

SEQ ID NO: 488055 - protein, 10 aa, Mycobacterium
GISASPQSTS

SEQ ID NO: 488056 - protein, 15 aa, Mycobacterium
GISDADAEAAGKGIK

SEQ ID NO: 488057 - protein, 13 aa, Mycobacterium
GISDASPAALAAD

SEQ ID NO: 488058 - protein, 12 aa, Mycobacterium
GISDAYKTGRGS

SEQ ID NO: 488059 - protein, 9 aa, Mycobacterium
GISDPGAIG

SEQ ID NO: 488060 - protein, 9 aa, Mycobacterium
GISDTRPAA

SEQ ID NO: 488061 - protein, 30 aa, Mycobacterium
GISEAEAPEGGAVPRPGTPVRGSGSGQPLN

SEQ ID NO: 488062 - protein, 10 aa, Mycobacterium
GISEDQAREA

SEQ ID NO: 488063 - protein, 5 aa, Mycobacterium
GISEP

SEQ ID NO: 488064 - protein, 5 aa, Mycobacterium
GISES

SEQ ID NO: 488065 - protein, 18 aa, Mycobacterium
GISESRRLPGSGAGPSPD

SEQ ID NO: 488066 - protein, 5 aa, Mycobacterium
GISGE

SEQ ID NO: 488067 - protein, 17 aa, Mycobacterium
GISGEHERRNGRDRPAT

SEQ ID NO: 488068 - protein, 7 aa, Mycobacterium
GISGEPL

SEQ ID NO: 488069 - protein, 6 aa, Mycobacterium
GISGES

SEQ ID NO: 488070 - protein, 12 aa, Mycobacterium
GISGGAASAEEA

SEQ ID NO: 488071 - protein, 20 aa, Mycobacterium
GISGGAASAEEAAMHIIEDG

SEQ ID NO: 488072 - protein, 6 aa, Mycobacterium
GISGPE

SEQ ID NO: 488073 - protein, 11 aa, Mycobacterium
GISGPGLDGRT

SEQ ID NO: 488074 - protein, 29 aa, Mycobacterium
GISGQAEFKGTGSHPPPEPDSLDVPVHPG

SEQ ID NO: 488075 - protein, 5 aa, Mycobacterium
GISGR

SEQ ID NO: 488076 - protein, 5 aa, Mycobacterium
GISGS

SEQ ID NO: 488077 - protein, 5 aa, Mycobacterium
GISGV

SEQ ID NO: 488078 - protein, 5 aa, Mycobacterium
GISHS

SEQ ID NO: 488079 - protein, 10 aa, Mycobacterium
GISKDQLAKG

SEQ ID NO: 488080 - protein, 7 aa, Mycobacterium
GISKEGS

SEQ ID NO: 488081 - protein, 6 aa, Mycobacterium
GISNGR

SEQ ID NO: 488082 - protein, 33 aa, Mycobacterium
GISNSGDDSSGFLNSGDQNSGGFNSGTGLSGFF

SEQ ID NO: 488083 - protein, 4 aa, Mycobacterium
GISP

SEQ ID NO: 488084 - protein, 7 aa, Mycobacterium
GISPDGS

SEQ ID NO: 488085 - protein, 11 aa, Mycobacterium
GISPDVSRRSG

SEQ ID NO: 488086 - protein, 10 aa, Mycobacterium
GISPEPETTV

SEQ ID NO: 488087 - protein, 16 aa, Mycobacterium
GISPEQRSKDLTDDQV

SEQ ID NO: 488088 - protein, 9 aa, Mycobacterium
GISPERAEE

SEQ ID NO: 488089 - protein, 15 aa, Mycobacterium
GISPESRASTGGEEA

SEQ ID NO: 488090 - protein, 6 aa, Mycobacterium
GISPET

SEQ ID NO: 488091 - protein, 9 aa, Mycobacterium
GISPPDDDV

SEQ ID NO: 488092 - protein, 9 aa, Mycobacterium
GISPPSEEV

SEQ ID NO: 488093 - protein, 18 aa, Mycobacterium
GISPRSPLPGADGLSPVT

SEQ ID NO: 488094 - protein, 16 aa, Mycobacterium
GISPRSPLPGDDGLSS

SEQ ID NO: 488095 - protein, 10 aa, Mycobacterium
GISPSSASLR

SEQ ID NO: 488096 - protein, 7 aa, Mycobacterium
GISPVNP

SEQ ID NO: 488097 - protein, 9 aa, Mycobacterium
GISQRYPDR

SEQ ID NO: 488098 - protein, 5 aa, Mycobacterium
GISRD

SEQ ID NO: 488099 - protein, 16 aa, Mycobacterium
GISRDQRTKDLTDDQV

SEQ ID NO: 488100 - protein, 9 aa, Mycobacterium
GISREDSDA

SEQ ID NO: 488101 - protein, 9 aa, Mycobacterium
GISSGDPAE

SEQ ID NO: 488102 - protein, 7 aa, Mycobacterium
GISSPID

SEQ ID NO: 488103 - protein, 6 aa, Mycobacterium
GISSPL

SEQ ID NO: 488104 - protein, 22 aa, Mycobacterium
GISTDSGIPDYRGPDSPPSNPM

SEQ ID NO: 488105 - protein, 5 aa, Mycobacterium
GISTE

SEQ ID NO: 488106 - protein, 10 aa, Mycobacterium
GISTPRKHGF

SEQ ID NO: 488107 - protein, 5 aa, Mycobacterium
GISTR

SEQ ID NO: 488108 - protein, 9 aa, Mycobacterium
GISTRTPRG

SEQ ID NO: 488109 - protein, 4 aa, Mycobacterium
GISV

SEQ ID NO: 488110 - protein, 11 aa, Mycobacterium
GITADSDPGAE

SEQ ID NO: 488111 - protein, 11 aa, Mycobacterium
GITAENDGRPI

SEQ ID NO: 488112 - protein, 5 aa, Mycobacterium
GITAG

SEQ ID NO: 488113 - protein, 15 aa, Mycobacterium
GITASGGDAKARPCD

SEQ ID NO: 488114 - protein, 5 aa, Mycobacterium
GITAT

SEQ ID NO: 488115 - protein, 9 aa, Mycobacterium
GITDDPDAA

SEQ ID NO: 488116 - protein, 13 aa, Mycobacterium
GITDEGGRIPPSH

SEQ ID NO: 488117 - protein, 14 aa, Mycobacterium
GITDEGGRRPPSHR

SEQ ID NO: 488118 - protein, 7 aa, Mycobacterium
GITDGQD

SEQ ID NO: 488119 - protein, 13 aa, Mycobacterium
GITDGSLTADGSH

SEQ ID NO: 488120 - protein, 5 aa, Mycobacterium
GITDN

SEQ ID NO: 488121 - protein, 5 aa, Mycobacterium
GITDP

SEQ ID NO: 488122 - protein, 9 aa, Mycobacterium
GITDPADAM

SEQ ID NO: 488123 - protein, 7 aa, Mycobacterium
GITEAEG

SEQ ID NO: 488124 - protein, 7 aa, Mycobacterium
GITEGTG

SEQ ID NO: 488125 - protein, 9 aa, Mycobacterium
GITEPEGLK

SEQ ID NO: 488126 - protein, 4 aa, Mycobacterium
GITG

SEQ ID NO: 488127 - protein, 8 aa, Mycobacterium
GITGATSR

SEQ ID NO: 488128 - protein, 8 aa, Mycobacterium
GITGDRGG

SEQ ID NO: 488129 - protein, 12 aa, Mycobacterium
GITGERPAVTPT

SEQ ID NO: 488130 - protein, 5 aa, Mycobacterium
GITGG

SEQ ID NO: 488131 - protein, 6 aa, Mycobacterium
GITGGA

SEQ ID NO: 488132 - protein, 10 aa, Mycobacterium
GITGGDHQAG

SEQ ID NO: 488133 - protein, 6 aa, Mycobacterium
GITGGE

SEQ ID NO: 488134 - protein, 5 aa, Mycobacterium
GITGP

SEQ ID NO: 488135 - protein, 10 aa, Mycobacterium
GITGPDGASH

SEQ ID NO: 488136 - protein, 6 aa, Mycobacterium
GITGPQ

SEQ ID NO: 488137 - protein, 7 aa, Mycobacterium
GITGPRS

SEQ ID NO: 488138 - protein, 7 aa, Mycobacterium
GITGPTT

SEQ ID NO: 488139 - protein, 11 aa, Mycobacterium
GITGQSAGGFA

SEQ ID NO: 488140 - protein, 25 aa, Mycobacterium
GITGRGLTSAPIGPDGASQLDELST

SEQ ID NO: 488141 - protein, 11 aa, Mycobacterium
GITGSDGASHN

SEQ ID NO: 488142 - protein, 12 aa, Mycobacterium
GITGSDGPAHNG

SEQ ID NO: 488143 - protein, 11 aa, Mycobacterium
GITGSDGPSHN

SEQ ID NO: 488144 - protein, 8 aa, Mycobacterium
GITGSNNA

SEQ ID NO: 488145 - protein, 5 aa, Mycobacterium
GITKR

SEQ ID NO: 488146 - protein, 10 aa, Mycobacterium
GITNAPGHGG

SEQ ID NO: 488147 - protein, 15 aa, Mycobacterium
GITPADVGRLRDGLL

SEQ ID NO: 488148 - protein, 8 aa, Mycobacterium
GITPAERT

SEQ ID NO: 488149 - protein, 6 aa, Mycobacterium
GITPAN

SEQ ID NO: 488150 - protein, 16 aa, Mycobacterium
GITPCAPGSATNAAGT

SEQ ID NO: 488151 - protein, 8 aa, Mycobacterium
GITPERQA

SEQ ID NO: 488152 - protein, 7 aa, Mycobacterium
GITPGTN

SEQ ID NO: 488153 - protein, 8 aa, Mycobacterium
GITPPAAA

SEQ ID NO: 488154 - protein, 5 aa, Mycobacterium
GITPR

SEQ ID NO: 488155 - protein, 5 aa, Mycobacterium
GITRA

SEQ ID NO: 488156 - protein, 10 aa, Mycobacterium
GITRPSAANA

SEQ ID NO: 488157 - protein, 13 aa, Mycobacterium
GITRPSGANTDAF

SEQ ID NO: 488158 - protein, 9 aa, Mycobacterium
GITRPTGDN

SEQ ID NO: 488159 - protein, 7 aa, Mycobacterium
GITSGPL

SEQ ID NO: 488160 - protein, 6 aa, Mycobacterium
GITSPI

SEQ ID NO: 488161 - protein, 25 aa, Mycobacterium
GITSPPVPAPDDHRPASTPQRDDPL

SEQ ID NO: 488162 - protein, 8 aa, Mycobacterium
GITSPSPT

SEQ ID NO: 488163 - protein, 5 aa, Mycobacterium
GITSR

SEQ ID NO: 488164 - protein, 21 aa, Mycobacterium
GITSSSGDDADRPVSSKERRA

SEQ ID NO: 488165 - protein, 7 aa, Mycobacterium
GITTERE

SEQ ID NO: 488166 - protein, 26 aa, Mycobacterium
GITTETGTHLDTTRDDGIAHPDPEES

SEQ ID NO: 488167 - protein, 6 aa, Mycobacterium
GITTPA

SEQ ID NO: 488168 - protein, 4 aa, Mycobacterium
GITV

SEQ ID NO: 488169 - protein, 5 aa, Mycobacterium
GITVP

SEQ ID NO: 488170 - protein, 6 aa, Mycobacterium
GITYEA

SEQ ID NO: 488171 - protein, 6 aa, Mycobacterium
GITYPD

SEQ ID NO: 488172 - protein, 7 aa, Mycobacterium
GITYTDT

SEQ ID NO: 488173 - protein, 9 aa, Mycobacterium
GIVEDADGN

SEQ ID NO: 488174 - protein, 6 aa, Mycobacterium
GIVPGE

SEQ ID NO: 488175 - protein, 11 aa, Mycobacterium
GIVSGGRTDLN

SEQ ID NO: 488176 - protein, 5 aa, Mycobacterium
GIYPD

SEQ ID NO: 488177 - protein, 6 aa, Mycobacterium
GIYPDT

SEQ ID NO: 488178 - protein, 13 aa, Mycobacterium
GIYRDEDRARRRG

SEQ ID NO: 488179 - protein, 12 aa, Mycobacterium
GIYRPPEEEERH

SEQ ID NO: 488180 - protein, 4 aa, Mycobacterium
GKAA

SEQ ID NO: 488181 - protein, 20 aa, Mycobacterium
GKAAAKAGSAIGNAIGDSPL

SEQ ID NO: 488182 - protein, 16 aa, Mycobacterium
GKAADAARDNARTLDA

SEQ ID NO: 488183 - protein, 6 aa, Mycobacterium
GKAAED

SEQ ID NO: 488184 - protein, 11 aa, Mycobacterium
GKAANAGGVAT

SEQ ID NO: 488185 - protein, 15 aa, Mycobacterium
GKAANGMASGRSQLG

SEQ ID NO: 488186 - protein, 9 aa, Mycobacterium
GKAAPGYDT

SEQ ID NO: 488187 - protein, 20 aa, Mycobacterium
GKAARDAGQGSAGDAQSPRA

SEQ ID NO: 488188 - protein, 8 aa, Mycobacterium
GKAASVTG

SEQ ID NO: 488189 - protein, 13 aa, Mycobacterium
GKAATTTAVAGGS

SEQ ID NO: 488190 - protein, 5 aa, Mycobacterium
GKAAV

SEQ ID NO: 488191 - protein, 10 aa, Mycobacterium
GKADDAETIR

SEQ ID NO: 488192 - protein, 17 aa, Mycobacterium
GKADKRQVAGAATKDGV

SEQ ID NO: 488193 - protein, 8 aa, Mycobacterium
GKADPAEL

SEQ ID NO: 488194 - protein, 11 aa, Mycobacterium
GKADPQSPHQK

SEQ ID NO: 488195 - protein, 6 aa, Mycobacterium
GKADQL

SEQ ID NO: 488196 - protein, 6 aa, Mycobacterium
GKADVV

SEQ ID NO: 488197 - protein, 9 aa, Mycobacterium
GKAEHARRH

SEQ ID NO: 488198 - protein, 5 aa, Mycobacterium
GKAEN

SEQ ID NO: 488199 - protein, 6 aa, Mycobacterium
GKAEPL

SEQ ID NO: 488200 - protein, 6 aa, Mycobacterium
GKAEPV

SEQ ID NO: 488201 - protein, 6 aa, Mycobacterium
GKAERF

SEQ ID NO: 488202 - protein, 13 aa, Mycobacterium
GKAERNQRTDEIK

SEQ ID NO: 488203 - protein, 8 aa, Mycobacterium
GKAESTVK

SEQ ID NO: 488204 - protein, 10 aa, Mycobacterium
GKAFESAEGS

SEQ ID NO: 488205 - protein, 9 aa, Mycobacterium
GKAFSAPPA

SEQ ID NO: 488206 - protein, 9 aa, Mycobacterium
GKAFSSGGS

SEQ ID NO: 488207 - protein, 4 aa, Mycobacterium
GKAG

SEQ ID NO: 488208 - protein, 8 aa, Mycobacterium
GKAGADIP

SEQ ID NO: 488209 - protein, 9 aa, Mycobacterium
GKAGAPAPV

SEQ ID NO: 488210 - protein, 7 aa, Mycobacterium
GKAGDVT

SEQ ID NO: 488211 - protein, 21 aa, Mycobacterium
GKAGESVQQMGQQASQAASQL

SEQ ID NO: 488212 - protein, 12 aa, Mycobacterium
GKAGGAIGRNDS

SEQ ID NO: 488213 - protein, 12 aa, Mycobacterium
GKAGGAIGRNES

SEQ ID NO: 488214 - protein, 12 aa, Mycobacterium
GKAGGAIGRNQS

SEQ ID NO: 488215 - protein, 12 aa, Mycobacterium
GKAGGAIGRNSS

SEQ ID NO: 488216 - protein, 12 aa, Mycobacterium
GKAGGSIGRNSS

SEQ ID NO: 488217 - protein, 12 aa, Mycobacterium
GKAGGTIGRNNS

SEQ ID NO: 488218 - protein, 12 aa, Mycobacterium
GKAGGTIGRNSS

SEQ ID NO: 488219 - protein, 10 aa, Mycobacterium
GKAGKHPGGI

SEQ ID NO: 488220 - protein, 7 aa, Mycobacterium
GKAGQKR

SEQ ID NO: 488221 - protein, 8 aa, Mycobacterium
GKAGQKRW

SEQ ID NO: 488222 - protein, 24 aa, Mycobacterium
GKAGRAERRASAAAEPAAPAAAPA

SEQ ID NO: 488223 - protein, 8 aa, Mycobacterium
GKAGRQAV

SEQ ID NO: 488224 - protein, 13 aa, Mycobacterium
GKAGSETDYGSAI

SEQ ID NO: 488225 - protein, 9 aa, Mycobacterium
GKAGTGKSA

SEQ ID NO: 488226 - protein, 5 aa, Mycobacterium
GKAGV

SEQ ID NO: 488227 - protein, 7 aa, Mycobacterium
GKAGVAN

SEQ ID NO: 488228 - protein, 9 aa, Mycobacterium
GKAIDERGA

SEQ ID NO: 488229 - protein, 7 aa, Mycobacterium
GKAKGAV

SEQ ID NO: 488230 - protein, 4 aa, Mycobacterium
GKAL

SEQ ID NO: 488231 - protein, 9 aa, Mycobacterium
GKALPARSD

SEQ ID NO: 488232 - protein, 12 aa, Mycobacterium
GKAMTINPDDDN

SEQ ID NO: 488233 - protein, 5 aa, Mycobacterium
GKANR

SEQ ID NO: 488234 - protein, 17 aa, Mycobacterium
GKANRLPGELSGGEQQR

SEQ ID NO: 488235 - protein, 17 aa, Mycobacterium
GKANRLPSELSGGEQQR

SEQ ID NO: 488236 - protein, 8 aa, Mycobacterium
GKAPDRPG

SEQ ID NO: 488237 - protein, 16 aa, Mycobacterium
GKAPEPGQPANTTVPN

SEQ ID NO: 488238 - protein, 13 aa, Mycobacterium
GKAPGHDLKSEEF

SEQ ID NO: 488239 - protein, 10 aa, Mycobacterium
GKAPKARLDG

SEQ ID NO: 488240 - protein, 11 aa, Mycobacterium
GKAPKARLDGQ

SEQ ID NO: 488241 - protein, 7 aa, Mycobacterium
GKAPPTW

SEQ ID NO: 488242 - protein, 8 aa, Mycobacterium
GKAPRELP

SEQ ID NO: 488243 - protein, 9 aa, Mycobacterium
GKAPTPASD

SEQ ID NO: 488244 - protein, 12 aa, Mycobacterium
GKAPTRLKASGA

SEQ ID NO: 488245 - protein, 5 aa, Mycobacterium
GKAPV

SEQ ID NO: 488246 - protein, 6 aa, Mycobacterium
GKAPVA

SEQ ID NO: 488247 - protein, 7 aa, Mycobacterium
GKAPYTP

SEQ ID NO: 488248 - protein, 15 aa, Mycobacterium
GKAQGGMASSRSQLG

SEQ ID NO: 488249 - protein, 5 aa, Mycobacterium
GKAQI

SEQ ID NO: 488250 - protein, 9 aa, Mycobacterium
GKAQPGQIA

SEQ ID NO: 488251 - protein, 8 aa, Mycobacterium
GKAQPGQV

SEQ ID NO: 488252 - protein, 6 aa, Mycobacterium
GKARAV

SEQ ID NO: 488253 - protein, 9 aa, Mycobacterium
GKARDERAL

SEQ ID NO: 488254 - protein, 5 aa, Mycobacterium
GKARE

SEQ ID NO: 488255 - protein, 15 aa, Mycobacterium
GKARGASRKPGAADW

SEQ ID NO: 488256 - protein, 15 aa, Mycobacterium
GKARGGMASSRSQLG

SEQ ID NO: 488257 - protein, 12 aa, Mycobacterium
GKARLKRDDHDR

SEQ ID NO: 488258 - protein, 5 aa, Mycobacterium
GKARR

SEQ ID NO: 488259 - protein, 17 aa, Mycobacterium
GKARRDIEADGQESRQV

SEQ ID NO: 488260 - protein, 7 aa, Mycobacterium
GKARRSV

SEQ ID NO: 488261 - protein, 16 aa, Mycobacterium
GKARTGASVDVPADAT

SEQ ID NO: 488262 - protein, 5 aa, Mycobacterium
GKARY

SEQ ID NO: 488263 - protein, 4 aa, Mycobacterium
GKAS

SEQ ID NO: 488264 - protein, 7 aa, Mycobacterium
GKASEET

SEQ ID NO: 488265 - protein, 14 aa, Mycobacterium
GKASGAPKLADGPI

SEQ ID NO: 488266 - protein, 15 aa, Mycobacterium
GKASGGMASSRSQLG

SEQ ID NO: 488267 - protein, 9 aa, Mycobacterium
GKASGTVEF

SEQ ID NO: 488268 - protein, 7 aa, Mycobacterium
GKASGYL

SEQ ID NO: 488269 - protein, 11 aa, Mycobacterium
GKASPPGGARV

SEQ ID NO: 488270 - protein, 18 aa, Mycobacterium
GKASRLPSELSGGEQQRV

SEQ ID NO: 488271 - protein, 5 aa, Mycobacterium
GKASV

SEQ ID NO: 488272 - protein, 7 aa, Mycobacterium
GKASVDI

SEQ ID NO: 488273 - protein, 4 aa, Mycobacterium
GKAT

SEQ ID NO: 488274 - protein, 8 aa, Mycobacterium
GKATEANA

SEQ ID NO: 488275 - protein, 9 aa, Mycobacterium
GKATGALPE

SEQ ID NO: 488276 - protein, 8 aa, Mycobacterium
GKATGTVK

SEQ ID NO: 488277 - protein, 14 aa, Mycobacterium
GKATGVSDRVAANT

SEQ ID NO: 488278 - protein, 6 aa, Mycobacterium
GKATPD

SEQ ID NO: 488279 - protein, 8 aa, Mycobacterium
GKATPETL

SEQ ID NO: 488280 - protein, 6 aa, Mycobacterium
GKATWS

SEQ ID NO: 488281 - protein, 13 aa, Mycobacterium
GKAVVSAGSREAM

SEQ ID NO: 488282 - protein, 14 aa, Mycobacterium
GKAVVSAGSRESME

SEQ ID NO: 488283 - protein, 15 aa, Mycobacterium
GKAVVSAGSRESMEA

SEQ ID NO: 488284 - protein, 16 aa, Mycobacterium
GKAVVSAGSRESMETD

SEQ ID NO: 488285 - protein, 13 aa, Mycobacterium
GKAWAAKAGGTSG

SEQ ID NO: 488286 - protein, 8 aa, Mycobacterium
GKAYATSN

SEQ ID NO: 488287 - protein, 13 aa, Mycobacterium
GKCGSCSAEINGR

SEQ ID NO: 488288 - protein, 5 aa, Mycobacterium
GKCTA

SEQ ID NO: 488289 - protein, 6 aa, Mycobacterium
GKCTPC

SEQ ID NO: 488290 - protein, 9 aa, Mycobacterium
GKDARPGGH

SEQ ID NO: 488291 - protein, 21 aa, Mycobacterium
GKDDLGAYGDSDAEQTDRYAR

SEQ ID NO: 488292 - protein, 10 aa, Mycobacterium
GKDDLPTRRR

SEQ ID NO: 488293 - protein, 7 aa, Mycobacterium
GKDEKHV

SEQ ID NO: 488294 - protein, 10 aa, Mycobacterium
GKDESAGPRF

SEQ ID NO: 488295 - protein, 10 aa, Mycobacterium
GKDESSDGSL

SEQ ID NO: 488296 - protein, 4 aa, Mycobacterium
GKDG

SEQ ID NO: 488297 - protein, 7 aa, Mycobacterium
GKDGDAN

SEQ ID NO: 488298 - protein, 9 aa, Mycobacterium
GKDGDTPRM

SEQ ID NO: 488299 - protein, 7 aa, Mycobacterium
GKDGGTM

SEQ ID NO: 488300 - protein, 6 aa, Mycobacterium
GKDGIQ

SEQ ID NO: 488301 - protein, 10 aa, Mycobacterium
GKDGSKDRTD

SEQ ID NO: 488302 - protein, 17 aa, Mycobacterium
GKDIAPEVGNKRKTEHM

SEQ ID NO: 488303 - protein, 8 aa, Mycobacterium
GKDIDAAH

SEQ ID NO: 488304 - protein, 11 aa, Mycobacterium
GKDIDAARAEK

SEQ ID NO: 488305 - protein, 6 aa, Mycobacterium
GKDIHQ

SEQ ID NO: 488306 - protein, 8 aa, Mycobacterium
GKDITESG

SEQ ID NO: 488307 - protein, 9 aa, Mycobacterium
GKDLDAKQQ

SEQ ID NO: 488308 - protein, 10 aa, Mycobacterium
GKDMPSVEST

SEQ ID NO: 488309 - protein, 11 aa, Mycobacterium
GKDNLPRRRGS

SEQ ID NO: 488310 - protein, 8 aa, Mycobacterium
GKDPDVDA

SEQ ID NO: 488311 - protein, 7 aa, Mycobacterium
GKDPLVP

SEQ ID NO: 488312 - protein, 7 aa, Mycobacterium
GKDPNTV

SEQ ID NO: 488313 - protein, 9 aa, Mycobacterium
GKDPSPTYF

SEQ ID NO: 488314 - protein, 8 aa, Mycobacterium
GKDPTPPA

SEQ ID NO: 488315 - protein, 9 aa, Mycobacterium
GKDQPNGYT

SEQ ID NO: 488316 - protein, 4 aa, Mycobacterium
GKDR

SEQ ID NO: 488317 - protein, 14 aa, Mycobacterium
GKDRATGETKWTAT

SEQ ID NO: 488318 - protein, 7 aa, Mycobacterium
GKDRPER

SEQ ID NO: 488319 - protein, 6 aa, Mycobacterium
GKDRTG

SEQ ID NO: 488320 - protein, 9 aa, Mycobacterium
GKDSKDGKD

SEQ ID NO: 488321 - protein, 8 aa, Mycobacterium
GKDSPAAA

SEQ ID NO: 488322 - protein, 9 aa, Mycobacterium
GKDSPAASR

SEQ ID NO: 488323 - protein, 7 aa, Mycobacterium
GKDSPDF

SEQ ID NO: 488324 - protein, 9 aa, Mycobacterium
GKDSPDFGT

SEQ ID NO: 488325 - protein, 8 aa, Mycobacterium
GKDSPDFK

SEQ ID NO: 488326 - protein, 4 aa, Mycobacterium
GKDT

SEQ ID NO: 488327 - protein, 9 aa, Mycobacterium
GKDTDGKPV

SEQ ID NO: 488328 - protein, 24 aa, Mycobacterium
GKDVDPAAYGQQAHPATDEPAPIR

SEQ ID NO: 488329 - protein, 5 aa, Mycobacterium
GKDVT

SEQ ID NO: 488330 - protein, 8 aa, Mycobacterium
GKDWSQRG

SEQ ID NO: 488331 - protein, 7 aa, Mycobacterium
GKDWSRR

SEQ ID NO: 488332 - protein, 6 aa, Mycobacterium
GKDYEE

SEQ ID NO: 488333 - protein, 9 aa, Mycobacterium
GKDYHDDPD

SEQ ID NO: 488334 - protein, 7 aa, Mycobacterium
GKDYTPA

SEQ ID NO: 488335 - protein, 7 aa, Mycobacterium
GKEAAAA

SEQ ID NO: 488336 - protein, 10 aa, Mycobacterium
GKEADRRPGD

SEQ ID NO: 488337 - protein, 7 aa, Mycobacterium
GKEAHES

SEQ ID NO: 488338 - protein, 5 aa, Mycobacterium
GKEAI

SEQ ID NO: 488339 - protein, 8 aa, Mycobacterium
GKEAPGTV

SEQ ID NO: 488340 - protein, 12 aa, Mycobacterium
GKEARDDRTNEI

SEQ ID NO: 488341 - protein, 10 aa, Mycobacterium
GKEDALDPQA

SEQ ID NO: 488342 - protein, 11 aa, Mycobacterium
GKEDANGGGRV

SEQ ID NO: 488343 - protein, 20 aa, Mycobacterium
GKEDGAKVITGGERADLGGD

SEQ ID NO: 488344 - protein, 8 aa, Mycobacterium
GKEEFDTE

SEQ ID NO: 488345 - protein, 6 aa, Mycobacterium
GKEEIE

SEQ ID NO: 488346 - protein, 6 aa, Mycobacterium
GKEELA

SEQ ID NO: 488347 - protein, 7 aa, Mycobacterium
GKEGAAM

SEQ ID NO: 488348 - protein, 8 aa, Mycobacterium
GKEGGWPA

SEQ ID NO: 488349 - protein, 8 aa, Mycobacterium
GKEGQNAR

SEQ ID NO: 488350 - protein, 7 aa, Mycobacterium
GKEGSGL

SEQ ID NO: 488351 - protein, 10 aa, Mycobacterium
GKEGVEPQSE

SEQ ID NO: 488352 - protein, 4 aa, Mycobacterium
GKEI

SEQ ID NO: 488353 - protein, 10 aa, Mycobacterium
GKEIDRRPGD

SEQ ID NO: 488354 - protein, 10 aa, Mycobacterium
GKEIDRSPAD

SEQ ID NO: 488355 - protein, 6 aa, Mycobacterium
GKELEG

SEQ ID NO: 488356 - protein, 7 aa, Mycobacterium
GKELSGH

SEQ ID NO: 488357 - protein, 12 aa, Mycobacterium
GKELTTEREQVA

SEQ ID NO: 488358 - protein, 5 aa, Mycobacterium
GKEMS

SEQ ID NO: 488359 - protein, 7 aa, Mycobacterium
GKEMTTT

SEQ ID NO: 488360 - protein, 5 aa, Mycobacterium
GKENG

SEQ ID NO: 488361 - protein, 8 aa, Mycobacterium
GKENSRRA

SEQ ID NO: 488362 - protein, 7 aa, Mycobacterium
GKEPAQM

SEQ ID NO: 488363 - protein, 8 aa, Mycobacterium
GKEPPVTR

SEQ ID NO: 488364 - protein, 7 aa, Mycobacterium
GKEPRRL

SEQ ID NO: 488365 - protein, 4 aa, Mycobacterium
GKEQ

SEQ ID NO: 488366 - protein, 5 aa, Mycobacterium
GKEQL

SEQ ID NO: 488367 - protein, 6 aa, Mycobacterium
GKEQRI

SEQ ID NO: 488368 - protein, 9 aa, Mycobacterium
GKERREDRV

SEQ ID NO: 488369 - protein, 7 aa, Mycobacterium
GKESEVA

SEQ ID NO: 488370 - protein, 7 aa, Mycobacterium
GKESRRA

SEQ ID NO: 488371 - protein, 25 aa, Mycobacterium
GKETDIGDTASFRGGRAVTRSDRVG

SEQ ID NO: 488372 - protein, 10 aa, Mycobacterium
GKEVDRSPAD

SEQ ID NO: 488373 - protein, 6 aa, Mycobacterium
GKEVSF

SEQ ID NO: 488374 - protein, 4 aa, Mycobacterium
GKFD

SEQ ID NO: 488375 - protein, 8 aa, Mycobacterium
GKFDEQSL

SEQ ID NO: 488376 - protein, 9 aa, Mycobacterium
GKFDGETYA

SEQ ID NO: 488377 - protein, 9 aa, Mycobacterium
GKFEANDEV

SEQ ID NO: 488378 - protein, 9 aa, Mycobacterium
GKFEEGAYQ

SEQ ID NO: 488379 - protein, 13 aa, Mycobacterium
GKFGGENSGYNVS

SEQ ID NO: 488380 - protein, 14 aa, Mycobacterium
GKFGGENSGYNVSG

SEQ ID NO: 488381 - protein, 13 aa, Mycobacterium
GKFGGENSGYTVS

SEQ ID NO: 488382 - protein, 10 aa, Mycobacterium
GKFKASARKA

SEQ ID NO: 488383 - protein, 8 aa, Mycobacterium
GKFPAPLT

SEQ ID NO: 488384 - protein, 7 aa, Mycobacterium
GKFTDTT

SEQ ID NO: 488385 - protein, 26 aa, Mycobacterium
GKFTGSGGNLEQTVTRNNLEAAEETV

SEQ ID NO: 488386 - protein, 6 aa, Mycobacterium
GKFTGT

SEQ ID NO: 488387 - protein, 11 aa, Mycobacterium
GKFTSDESRTL

SEQ ID NO: 488388 - protein, 10 aa, Mycobacterium
GKFTSEESRK

SEQ ID NO: 488389 - protein, 11 aa, Mycobacterium
GKGAAADTPSA

SEQ ID NO: 488390 - protein, 15 aa, Mycobacterium
GKGAADGAPDSKNPI

SEQ ID NO: 488391 - protein, 8 aa, Mycobacterium
GKGAERKE

SEQ ID NO: 488392 - protein, 6 aa, Mycobacterium
GKGAEV

SEQ ID NO: 488393 - protein, 15 aa, Mycobacterium
GKGAEVTVESDDEAA

SEQ ID NO: 488394 - protein, 13 aa, Mycobacterium
GKGAHGELPPNNW

SEQ ID NO: 488395 - protein, 14 aa, Mycobacterium
GKGAMPDDHPNSMG

SEQ ID NO: 488396 - protein, 6 aa, Mycobacterium
GKGATN

SEQ ID NO: 488397 - protein, 14 aa, Mycobacterium
GKGCAEAMKGQGAR

SEQ ID NO: 488398 - protein, 15 aa, Mycobacterium
GKGCAEAMKGQGARV

SEQ ID NO: 488399 - protein, 15 aa, Mycobacterium
GKGCAESLAGQGARV

SEQ ID NO: 488400 - protein, 13 aa, Mycobacterium
GKGCAESVKGQGA

SEQ ID NO: 488401 - protein, 6 aa, Mycobacterium
GKGDGS

SEQ ID NO: 488402 - protein, 18 aa, Mycobacterium
GKGDPQVYAGQAGAPKFS

SEQ ID NO: 488403 - protein, 17 aa, Mycobacterium
GKGDPQVYAGRAGEPRF

SEQ ID NO: 488404 - protein, 4 aa, Mycobacterium
GKGE

SEQ ID NO: 488405 - protein, 9 aa, Mycobacterium
GKGEADGAQ

SEQ ID NO: 488406 - protein, 8 aa, Mycobacterium
GKGEAKDF

SEQ ID NO: 488407 - protein, 5 aa, Mycobacterium
GKGEF

SEQ ID NO: 488408 - protein, 8 aa, Mycobacterium
GKGEGGAF

SEQ ID NO: 488409 - protein, 8 aa, Mycobacterium
GKGEKRTL

SEQ ID NO: 488410 - protein, 9 aa, Mycobacterium
GKGERISAQ

SEQ ID NO: 488411 - protein, 9 aa, Mycobacterium
GKGERPGRK

SEQ ID NO: 488412 - protein, 7 aa, Mycobacterium
GKGESTR

SEQ ID NO: 488413 - protein, 9 aa, Mycobacterium
GKGEVDAAN

SEQ ID NO: 488414 - protein, 7 aa, Mycobacterium
GKGFTSG

SEQ ID NO: 488415 - protein, 14 aa, Mycobacterium
GKGGAGGAGGSGGL

SEQ ID NO: 488416 - protein, 34 aa, Mycobacterium
GKGGDGGTGGDGGNGGTGTPVGAGGLAGTGGAGG

SEQ ID NO: 488417 - protein, 18 aa, Mycobacterium
GKGGKAGPRAKLVGQHPR

SEQ ID NO: 488418 - protein, 10 aa, Mycobacterium
GKGGKHRSVP

SEQ ID NO: 488419 - protein, 8 aa, Mycobacterium
GKGGKTRI

SEQ ID NO: 488420 - protein, 22 aa, Mycobacterium
GKGGRNAHGRITTRHKGGGHKR

SEQ ID NO: 488421 - protein, 10 aa, Mycobacterium
GKGGSGKTAM

SEQ ID NO: 488422 - protein, 12 aa, Mycobacterium
GKGGVGKTSVAA

SEQ ID NO: 488423 - protein, 13 aa, Mycobacterium
GKGGVGKTSVAAS

SEQ ID NO: 488424 - protein, 15 aa, Mycobacterium
GKGGVGSAELRAAES

SEQ ID NO: 488425 - protein, 7 aa, Mycobacterium
GKGGVGV

SEQ ID NO: 488426 - protein, 21 aa, Mycobacterium
GKGGYGGNGGAGQTGGTGGSV

SEQ ID NO: 488427 - protein, 13 aa, Mycobacterium
GKGHRIATPDEAN

SEQ ID NO: 488428 - protein, 7 aa, Mycobacterium
GKGIPTF

SEQ ID NO: 488429 - protein, 14 aa, Mycobacterium
GKGIRGNRSGCGGG

SEQ ID NO: 488430 - protein, 11 aa, Mycobacterium
GKGKDGAPRST

SEQ ID NO: 488431 - protein, 6 aa, Mycobacterium
GKGKRI

SEQ ID NO: 488432 - protein, 10 aa, Mycobacterium
GKGKSDRLSR

SEQ ID NO: 488433 - protein, 16 aa, Mycobacterium
GKGLEHGVEPPQIDDP

SEQ ID NO: 488434 - protein, 14 aa, Mycobacterium
GKGLGDYAEAPARL

SEQ ID NO: 488435 - protein, 9 aa, Mycobacterium
GKGLPGTTM

SEQ ID NO: 488436 - protein, 7 aa, Mycobacterium
GKGNHDS

SEQ ID NO: 488437 - protein, 10 aa, Mycobacterium
GKGNKDRRIP

SEQ ID NO: 488438 - protein, 8 aa, Mycobacterium
GKGNTDGA

SEQ ID NO: 488439 - protein, 6 aa, Mycobacterium
GKGPGG

SEQ ID NO: 488440 - protein, 7 aa, Mycobacterium
GKGPGHE

SEQ ID NO: 488441 - protein, 13 aa, Mycobacterium
GKGPKDDPAEVAR

SEQ ID NO: 488442 - protein, 8 aa, Mycobacterium
GKGQGDVD

SEQ ID NO: 488443 - protein, 8 aa, Mycobacterium
GKGRGADH

SEQ ID NO: 488444 - protein, 9 aa, Mycobacterium
GKGRGADHS

SEQ ID NO: 488445 - protein, 10 aa, Mycobacterium
GKGRGGDHSV

SEQ ID NO: 488446 - protein, 7 aa, Mycobacterium
GKGRGTD

SEQ ID NO: 488447 - protein, 6 aa, Mycobacterium
GKGRGV

SEQ ID NO: 488448 - protein, 7 aa, Mycobacterium
GKGRGVD

SEQ ID NO: 488449 - protein, 8 aa, Mycobacterium
GKGRHRAG

SEQ ID NO: 488450 - protein, 9 aa, Mycobacterium
GKGRTAGEV

SEQ ID NO: 488451 - protein, 9 aa, Mycobacterium
GKGSDAATV

SEQ ID NO: 488452 - protein, 9 aa, Mycobacterium
GKGSDASTV

SEQ ID NO: 488453 - protein, 10 aa, Mycobacterium
GKGSDASTVV

SEQ ID NO: 488454 - protein, 9 aa, Mycobacterium
GKGSESAND

SEQ ID NO: 488455 - protein, 8 aa, Mycobacterium
GKGSKLTE

SEQ ID NO: 488456 - protein, 6 aa, Mycobacterium
GKGSLD

SEQ ID NO: 488457 - protein, 8 aa, Mycobacterium
GKGSTEGA

SEQ ID NO: 488458 - protein, 7 aa, Mycobacterium
GKGSVEG

SEQ ID NO: 488459 - protein, 6 aa, Mycobacterium
GKGSVT

SEQ ID NO: 488460 - protein, 6 aa, Mycobacterium
GKGSVV

SEQ ID NO: 488461 - protein, 8 aa, Mycobacterium
GKGTDNCR

SEQ ID NO: 488462 - protein, 11 aa, Mycobacterium
GKGTQAEKLSE

SEQ ID NO: 488463 - protein, 6 aa, Mycobacterium
GKGTRL

SEQ ID NO: 488464 - protein, 10 aa, Mycobacterium
GKGVTSVQEG

SEQ ID NO: 488465 - protein, 4 aa, Mycobacterium
GKGY

SEQ ID NO: 488466 - protein, 14 aa, Mycobacterium
GKGYPDPALTGQAA

SEQ ID NO: 488467 - protein, 15 aa, Mycobacterium
GKGYPGEGARARLST

SEQ ID NO: 488468 - protein, 12 aa, Mycobacterium
GKGYQATTPDEV

SEQ ID NO: 488469 - protein, 9 aa, Mycobacterium
GKHAAADQR

SEQ ID NO: 488470 - protein, 10 aa, Mycobacterium
GKHAASPHVT

SEQ ID NO: 488471 - protein, 9 aa, Mycobacterium
GKHDGPDQL

SEQ ID NO: 488472 - protein, 12 aa, Mycobacterium
GKHGDTGRSELD

SEQ ID NO: 488473 - protein, 5 aa, Mycobacterium
GKHGE

SEQ ID NO: 488474 - protein, 8 aa, Mycobacterium
GKHGPLRR

SEQ ID NO: 488475 - protein, 9 aa, Mycobacterium
GKHGPSAAM

SEQ ID NO: 488476 - protein, 9 aa, Mycobacterium
GKHGPVRRR

SEQ ID NO: 488477 - protein, 8 aa, Mycobacterium
GKHHDGKP

SEQ ID NO: 488478 - protein, 5 aa, Mycobacterium
GKHLG

SEQ ID NO: 488479 - protein, 9 aa, Mycobacterium
GKHNGLSDR

SEQ ID NO: 488480 - protein, 8 aa, Mycobacterium
GKHPGALS

SEQ ID NO: 488481 - protein, 6 aa, Mycobacterium
GKHPGP

SEQ ID NO: 488482 - protein, 9 aa, Mycobacterium
GKHRHTPEI

SEQ ID NO: 488483 - protein, 8 aa, Mycobacterium
GKHVNDNG

SEQ ID NO: 488484 - protein, 12 aa, Mycobacterium
GKHYDTDAESRN

SEQ ID NO: 488485 - protein, 7 aa, Mycobacterium
GKHYQAD

SEQ ID NO: 488486 - protein, 8 aa, Mycobacterium
GKHYSSKE

SEQ ID NO: 488487 - protein, 5 aa, Mycobacterium
GKIAS

SEQ ID NO: 488488 - protein, 5 aa, Mycobacterium
GKIDA

SEQ ID NO: 488489 - protein, 14 aa, Mycobacterium
GKIDIGSGSAGGQQ

SEQ ID NO: 488490 - protein, 6 aa, Mycobacterium
GKIDRQ

SEQ ID NO: 488491 - protein, 6 aa, Mycobacterium
GKIDRR

SEQ ID NO: 488492 - protein, 4 aa, Mycobacterium
GKIE

SEQ ID NO: 488493 - protein, 5 aa, Mycobacterium
GKIEA

SEQ ID NO: 488494 - protein, 9 aa, Mycobacterium
GKIEASERT

SEQ ID NO: 488495 - protein, 8 aa, Mycobacterium
GKIERGES

SEQ ID NO: 488496 - protein, 9 aa, Mycobacterium
GKIGAAGVS

SEQ ID NO: 488497 - protein, 9 aa, Mycobacterium
GKIGPGKAQ

SEQ ID NO: 488498 - protein, 8 aa, Mycobacterium
GKIGVTPE

SEQ ID NO: 488499 - protein, 13 aa, Mycobacterium
GKIIGEDSYNPGV

SEQ ID NO: 488500 - protein, 4 aa, Mycobacterium
GKIP

SEQ ID NO: 488501 - protein, 23 aa, Mycobacterium
GKIPKAELKQKYGSGRSTVASAQ

SEQ ID NO: 488502 - protein, 8 aa, Mycobacterium
GKIPNQGI

SEQ ID NO: 488503 - protein, 9 aa, Mycobacterium
GKIPRSSAT

SEQ ID NO: 488504 - protein, 4 aa, Mycobacterium
GKIQ

SEQ ID NO: 488505 - protein, 5 aa, Mycobacterium
GKIQL

SEQ ID NO: 488506 - protein, 5 aa, Mycobacterium
GKIRS

SEQ ID NO: 488507 - protein, 18 aa, Mycobacterium
GKIRSDVPAPRRSEAGVR

SEQ ID NO: 488508 - protein, 6 aa, Mycobacterium
GKIRSR

SEQ ID NO: 488509 - protein, 8 aa, Mycobacterium
GKIRSRQV

SEQ ID NO: 488510 - protein, 7 aa, Mycobacterium
GKIRSRR

SEQ ID NO: 488511 - protein, 7 aa, Mycobacterium
GKIRSRT

SEQ ID NO: 488512 - protein, 8 aa, Mycobacterium
GKISQRNF

SEQ ID NO: 488513 - protein, 9 aa, Mycobacterium
GKISQRNFG

SEQ ID NO: 488514 - protein, 10 aa, Mycobacterium
GKISQRQDQD

SEQ ID NO: 488515 - protein, 8 aa, Mycobacterium
GKITSEAL

SEQ ID NO: 488516 - protein, 7 aa, Mycobacterium
GKKAGFT

SEQ ID NO: 488517 - protein, 5 aa, Mycobacterium
GKKGA

SEQ ID NO: 488518 - protein, 14 aa, Mycobacterium
GKKHESRQQEVSEF

SEQ ID NO: 488519 - protein, 5 aa, Mycobacterium
GKKIG

SEQ ID NO: 488520 - protein, 12 aa, Mycobacterium
GKKKASPPPPLG

SEQ ID NO: 488521 - protein, 8 aa, Mycobacterium
GKKKREVL

SEQ ID NO: 488522 - protein, 10 aa, Mycobacterium
GKKLGNEEDP

SEQ ID NO: 488523 - protein, 4 aa, Mycobacterium
GKKP

SEQ ID NO: 488524 - protein, 13 aa, Mycobacterium
GKKRGQGAGETRF

SEQ ID NO: 488525 - protein, 10 aa, Mycobacterium
GKKSIGPDKV

SEQ ID NO: 488526 - protein, 13 aa, Mycobacterium
GKKSVANTGRPEV

SEQ ID NO: 488527 - protein, 8 aa, Mycobacterium
GKKVEGTW

SEQ ID NO: 488528 - protein, 13 aa, Mycobacterium
GKKVESRQQEVSE

SEQ ID NO: 488529 - protein, 11 aa, Mycobacterium
GKKVESRQTEV

SEQ ID NO: 488530 - protein, 14 aa, Mycobacterium
GKKYESRQQEVSDF

SEQ ID NO: 488531 - protein, 9 aa, Mycobacterium
GKLAGPDDL

SEQ ID NO: 488532 - protein, 9 aa, Mycobacterium
GKLDDSAIR

SEQ ID NO: 488533 - protein, 7 aa, Mycobacterium
GKLDEEL

SEQ ID NO: 488534 - protein, 8 aa, Mycobacterium
GKLDGGAL

SEQ ID NO: 488535 - protein, 9 aa, Mycobacterium
GKLDGLPPA

SEQ ID NO: 488536 - protein, 8 aa, Mycobacterium
GKLDNTPA

SEQ ID NO: 488537 - protein, 8 aa, Mycobacterium
GKLDNTPE

SEQ ID NO: 488538 - protein, 6 aa, Mycobacterium
GKLDVP

SEQ ID NO: 488539 - protein, 9 aa, Mycobacterium
GKLGAASTA

SEQ ID NO: 488540 - protein, 6 aa, Mycobacterium
GKLGDP

SEQ ID NO: 488541 - protein, 6 aa, Mycobacterium
GKLGGA

SEQ ID NO: 488542 - protein, 8 aa, Mycobacterium
GKLGGDPA

SEQ ID NO: 488543 - protein, 16 aa, Mycobacterium
GKLGQVGVEGTGAYGA

SEQ ID NO: 488544 - protein, 7 aa, Mycobacterium
GKLGRGL

SEQ ID NO: 488545 - protein, 8 aa, Mycobacterium
GKLGSEPA

SEQ ID NO: 488546 - protein, 9 aa, Mycobacterium
GKLGVKSGE

SEQ ID NO: 488547 - protein, 6 aa, Mycobacterium
GKLHQR

SEQ ID NO: 488548 - protein, 9 aa, Mycobacterium
GKLKQRTVD

SEQ ID NO: 488549 - protein, 4 aa, Mycobacterium
GKLP

SEQ ID NO: 488550 - protein, 7 aa, Mycobacterium
GKLPAGQ

SEQ ID NO: 488551 - protein, 8 aa, Mycobacterium
GKLPDATV

SEQ ID NO: 488552 - protein, 26 aa, Mycobacterium
GKLPDTDLDAGGEIAEAERDAEKARF

SEQ ID NO: 488553 - protein, 12 aa, Mycobacterium
GKLPEEETKPAS

SEQ ID NO: 488554 - protein, 13 aa, Mycobacterium
GKLPGALSAEQRE

SEQ ID NO: 488555 - protein, 14 aa, Mycobacterium
GKLPGVTGDSGTAL

SEQ ID NO: 488556 - protein, 7 aa, Mycobacterium
GKLPKLS

SEQ ID NO: 488557 - protein, 9 aa, Mycobacterium
GKLPKTAEH

SEQ ID NO: 488558 - protein, 8 aa, Mycobacterium
GKLPPPVH

SEQ ID NO: 488559 - protein, 6 aa, Mycobacterium
GKLPRL

SEQ ID NO: 488560 - protein, 6 aa, Mycobacterium
GKLPSE

SEQ ID NO: 488561 - protein, 7 aa, Mycobacterium
GKLREQQ

SEQ ID NO: 488562 - protein, 9 aa, Mycobacterium
GKLRGPVAR

SEQ ID NO: 488563 - protein, 9 aa, Mycobacterium
GKLRGTDER

SEQ ID NO: 488564 - protein, 7 aa, Mycobacterium
GKLSTKL

SEQ ID NO: 488565 - protein, 10 aa, Mycobacterium
GKLTDPAGRL

SEQ ID NO: 488566 - protein, 12 aa, Mycobacterium
GKLTEPAAKPEA

SEQ ID NO: 488567 - protein, 7 aa, Mycobacterium
GKLTGRA

SEQ ID NO: 488568 - protein, 7 aa, Mycobacterium
GKLTGRP

SEQ ID NO: 488569 - protein, 12 aa, Mycobacterium
GKLTGYGGGLDR

SEQ ID NO: 488570 - protein, 7 aa, Mycobacterium
GKLTPRE

SEQ ID NO: 488571 - protein, 9 aa, Mycobacterium
GKMGRPEEV

SEQ ID NO: 488572 - protein, 4 aa, Mycobacterium
GKMK

SEQ ID NO: 488573 - protein, 7 aa, Mycobacterium
GKMPDDP

SEQ ID NO: 488574 - protein, 30 aa, Mycobacterium
GKMSPPMSARTNSWQQPYGATSAAHTLAQN

SEQ ID NO: 488575 - protein, 4 aa, Mycobacterium
GKNA

SEQ ID NO: 488576 - protein, 8 aa, Mycobacterium
GKNADQDF

SEQ ID NO: 488577 - protein, 7 aa, Mycobacterium
GKNAGEH

SEQ ID NO: 488578 - protein, 7 aa, Mycobacterium
GKNASLG

SEQ ID NO: 488579 - protein, 10 aa, Mycobacterium
GKNATQLTED

SEQ ID NO: 488580 - protein, 6 aa, Mycobacterium
GKNAVA

SEQ ID NO: 488581 - protein, 5 aa, Mycobacterium
GKNES

SEQ ID NO: 488582 - protein, 26 aa, Mycobacterium
GKNFGRQPANSPAGSMARALRDAGFG

SEQ ID NO: 488583 - protein, 15 aa, Mycobacterium
GKNFSAGHDLGSEAA

SEQ ID NO: 488584 - protein, 29 aa, Mycobacterium
GKNFSAGHDLGSEEALAEREPGPGQHPTF

SEQ ID NO: 488585 - protein, 5 aa, Mycobacterium
GKNGE

SEQ ID NO: 488586 - protein, 7 aa, Mycobacterium
GKNGKRA

SEQ ID NO: 488587 - protein, 10 aa, Mycobacterium
GKNHHSAGSF

SEQ ID NO: 488588 - protein, 6 aa, Mycobacterium
GKNIAR

SEQ ID NO: 488589 - protein, 9 aa, Mycobacterium
GKNLAEQKR

SEQ ID NO: 488590 - protein, 8 aa, Mycobacterium
GKNMSPAN

SEQ ID NO: 488591 - protein, 9 aa, Mycobacterium
GKNMSPTNI

SEQ ID NO: 488592 - protein, 9 aa, Mycobacterium
GKNPDEALG

SEQ ID NO: 488593 - protein, 8 aa, Mycobacterium
GKNQAARA

SEQ ID NO: 488594 - protein, 7 aa, Mycobacterium
GKNRNRW

SEQ ID NO: 488595 - protein, 8 aa, Mycobacterium
GKNSPACS

SEQ ID NO: 488596 - protein, 5 aa, Mycobacterium
GKNVA

SEQ ID NO: 488597 - protein, 6 aa, Mycobacterium
GKNVAP

SEQ ID NO: 488598 - protein, 9 aa, Mycobacterium
GKNVAPAQL

SEQ ID NO: 488599 - protein, 8 aa, Mycobacterium
GKNVPGSI

SEQ ID NO: 488600 - protein, 9 aa, Mycobacterium
GKNYTPQEI

SEQ ID NO: 488601 - protein, 10 aa, Mycobacterium
GKNYTPQEIS

SEQ ID NO: 488602 - protein, 14 aa, Mycobacterium
GKPAALPATDTQGR

SEQ ID NO: 488603 - protein, 5 aa, Mycobacterium
GKPAD

SEQ ID NO: 488604 - protein, 7 aa, Mycobacterium
GKPADLV

SEQ ID NO: 488605 - protein, 10 aa, Mycobacterium
GKPAEISTGP

SEQ ID NO: 488606 - protein, 7 aa, Mycobacterium
GKPAEVL

SEQ ID NO: 488607 - protein, 5 aa, Mycobacterium
GKPAG

SEQ ID NO: 488608 - protein, 14 aa, Mycobacterium
GKPAGKAVEPSADP

SEQ ID NO: 488609 - protein, 7 aa, Mycobacterium
GKPAGLQ

SEQ ID NO: 488610 - protein, 7 aa, Mycobacterium
GKPAKAD

SEQ ID NO: 488611 - protein, 7 aa, Mycobacterium
GKPAPEL

SEQ ID NO: 488612 - protein, 11 aa, Mycobacterium
GKPAPVRDRGL

SEQ ID NO: 488613 - protein, 9 aa, Mycobacterium
GKPATEETF

SEQ ID NO: 488614 - protein, 13 aa, Mycobacterium
GKPATRKHEPDGG

SEQ ID NO: 488615 - protein, 13 aa, Mycobacterium
GKPATRRHEEGGG

SEQ ID NO: 488616 - protein, 13 aa, Mycobacterium
GKPATRRHEPDGG

SEQ ID NO: 488617 - protein, 4 aa, Mycobacterium
GKPC

SEQ ID NO: 488618 - protein, 8 aa, Mycobacterium
GKPCGREA

SEQ ID NO: 488619 - protein, 10 aa, Mycobacterium
GKPCGREANT

SEQ ID NO: 488620 - protein, 6 aa, Mycobacterium
GKPCPA

SEQ ID NO: 488621 - protein, 8 aa, Mycobacterium
GKPDARDH

SEQ ID NO: 488622 - protein, 6 aa, Mycobacterium
GKPDDV

SEQ ID NO: 488623 - protein, 9 aa, Mycobacterium
GKPDGHVPA

SEQ ID NO: 488624 - protein, 8 aa, Mycobacterium
GKPDLAPA

SEQ ID NO: 488625 - protein, 7 aa, Mycobacterium
GKPDPCP

SEQ ID NO: 488626 - protein, 15 aa, Mycobacterium
GKPDPYEAGTWGPDS

SEQ ID NO: 488627 - protein, 20 aa, Mycobacterium
GKPDSSGGGDMGAGTADTPR

SEQ ID NO: 488628 - protein, 6 aa, Mycobacterium
GKPEDI

SEQ ID NO: 488629 - protein, 6 aa, Mycobacterium
GKPEEI

SEQ ID NO: 488630 - protein, 7 aa, Mycobacterium
GKPEESV

SEQ ID NO: 488631 - protein, 12 aa, Mycobacterium
GKPEHPSQSVEH

SEQ ID NO: 488632 - protein, 17 aa, Mycobacterium
GKPEPYESGTWGPPSAD

SEQ ID NO: 488633 - protein, 6 aa, Mycobacterium
GKPERL

SEQ ID NO: 488634 - protein, 6 aa, Mycobacterium
GKPETF

SEQ ID NO: 488635 - protein, 9 aa, Mycobacterium
GKPETVDDA

SEQ ID NO: 488636 - protein, 5 aa, Mycobacterium
GKPFG

SEQ ID NO: 488637 - protein, 6 aa, Mycobacterium
GKPFKD

SEQ ID NO: 488638 - protein, 4 aa, Mycobacterium
GKPG

SEQ ID NO: 488639 - protein, 6 aa, Mycobacterium
GKPGAG

SEQ ID NO: 488640 - protein, 7 aa, Mycobacterium
GKPGARV

SEQ ID NO: 488641 - protein, 7 aa, Mycobacterium
GKPGDGW

SEQ ID NO: 488642 - protein, 5 aa, Mycobacterium
GKPGE

SEQ ID NO: 488643 - protein, 8 aa, Mycobacterium
GKPGEDVA

SEQ ID NO: 488644 - protein, 7 aa, Mycobacterium
GKPGKAV

SEQ ID NO: 488645 - protein, 6 aa, Mycobacterium
GKPGRP

SEQ ID NO: 488646 - protein, 6 aa, Mycobacterium
GKPGSA

SEQ ID NO: 488647 - protein, 12 aa, Mycobacterium
GKPGSADAAASQ

SEQ ID NO: 488648 - protein, 19 aa, Mycobacterium
GKPGTAAGLTDGLKAAGAA

SEQ ID NO: 488649 - protein, 18 aa, Mycobacterium
GKPGTAAPLTDGLKEAGA

SEQ ID NO: 488650 - protein, 8 aa, Mycobacterium
GKPGTRMY

SEQ ID NO: 488651 - protein, 9 aa, Mycobacterium
GKPGTSEGL

SEQ ID NO: 488652 - protein, 23 aa, Mycobacterium
GKPGWPDPSDCTRGHEGGVADAQ

SEQ ID NO: 488653 - protein, 11 aa, Mycobacterium
GKPGYDTPNGT

SEQ ID NO: 488654 - protein, 8 aa, Mycobacterium
GKPHDPAV

SEQ ID NO: 488655 - protein, 4 aa, Mycobacterium
GKPI

SEQ ID NO: 488656 - protein, 56 aa, Mycobacterium
GKPIATPGAGPTEPSFPTRRPTTSPPPPTSTSPSQPTSPASPTSPAGAIPLPPDDN

SEQ ID NO: 488657 - protein, 7 aa, Mycobacterium
GKPIDGP

SEQ ID NO: 488658 - protein, 17 aa, Mycobacterium
GKPIEAPAATRNPEDRI

SEQ ID NO: 488659 - protein, 7 aa, Mycobacterium
GKPISPA

SEQ ID NO: 488660 - protein, 8 aa, Mycobacterium
GKPISPAQ

SEQ ID NO: 488661 - protein, 7 aa, Mycobacterium
GKPITPA

SEQ ID NO: 488662 - protein, 9 aa, Mycobacterium
GKPKGEPVE

SEQ ID NO: 488663 - protein, 9 aa, Mycobacterium
GKPLAGSPR

SEQ ID NO: 488664 - protein, 9 aa, Mycobacterium
GKPLASSNR

SEQ ID NO: 488665 - protein, 10 aa, Mycobacterium
GKPLGAGGRR

SEQ ID NO: 488666 - protein, 6 aa, Mycobacterium
GKPLGN

SEQ ID NO: 488667 - protein, 33 aa, Mycobacterium
GKPLQSVAKGEVDLDSEADKEAQETERQQREKE

SEQ ID NO: 488668 - protein, 13 aa, Mycobacterium
GKPLRSYRAPRRR

SEQ ID NO: 488669 - protein, 6 aa, Mycobacterium
GKPLTA

SEQ ID NO: 488670 - protein, 19 aa, Mycobacterium
GKPLTPLRPAPRVGEHNDS

SEQ ID NO: 488671 - protein, 10 aa, Mycobacterium
GKPNAVTPAH

SEQ ID NO: 488672 - protein, 7 aa, Mycobacterium
GKPNMPS

SEQ ID NO: 488673 - protein, 12 aa, Mycobacterium
GKPNYSPPKARA

SEQ ID NO: 488674 - protein, 14 aa, Mycobacterium
GKPPAAYRASLPPA

SEQ ID NO: 488675 - protein, 9 aa, Mycobacterium
GKPPADVPD

SEQ ID NO: 488676 - protein, 7 aa, Mycobacterium
GKPPEFT

SEQ ID NO: 488677 - protein, 8 aa, Mycobacterium
GKPPEHRP

SEQ ID NO: 488678 - protein, 8 aa, Mycobacterium
GKPPENDV

SEQ ID NO: 488679 - protein, 6 aa, Mycobacterium
GKPPFR

SEQ ID NO: 488680 - protein, 7 aa, Mycobacterium
GKPPFTA

SEQ ID NO: 488681 - protein, 10 aa, Mycobacterium
GKPPQIESPL

SEQ ID NO: 488682 - protein, 5 aa, Mycobacterium
GKPPR

SEQ ID NO: 488683 - protein, 9 aa, Mycobacterium
GKPPSDGTV

SEQ ID NO: 488684 - protein, 12 aa, Mycobacterium
GKPQHPSQSVEH

SEQ ID NO: 488685 - protein, 6 aa, Mycobacterium
GKPQIR

SEQ ID NO: 488686 - protein, 8 aa, Mycobacterium
GKPQKLSE

SEQ ID NO: 488687 - protein, 8 aa, Mycobacterium
GKPQPGET

SEQ ID NO: 488688 - protein, 8 aa, Mycobacterium
GKPQPGQS

SEQ ID NO: 488689 - protein, 8 aa, Mycobacterium
GKPRDEAL

SEQ ID NO: 488690 - protein, 11 aa, Mycobacterium
GKPRDERVESE

SEQ ID NO: 488691 - protein, 9 aa, Mycobacterium
GKPRDQSLG

SEQ ID NO: 488692 - protein, 44 aa, Mycobacterium
GKPRHAGAPVAAEPADDAGLEGPWSRQRGTYQPPENARVRSSAA

SEQ ID NO: 488693 - protein, 8 aa, Mycobacterium
GKPRPGDY

SEQ ID NO: 488694 - protein, 8 aa, Mycobacterium
GKPRPGNY

SEQ ID NO: 488695 - protein, 8 aa, Mycobacterium
GKPRSEWP

SEQ ID NO: 488696 - protein, 11 aa, Mycobacterium
GKPRTHARGQG

SEQ ID NO: 488697 - protein, 7 aa, Mycobacterium
GKPSAAQ

SEQ ID NO: 488698 - protein, 6 aa, Mycobacterium
GKPSDF

SEQ ID NO: 488699 - protein, 11 aa, Mycobacterium
GKPSELAPEDA

SEQ ID NO: 488700 - protein, 5 aa, Mycobacterium
GKPSF

SEQ ID NO: 488701 - protein, 8 aa, Mycobacterium
GKPSQPTV

SEQ ID NO: 488702 - protein, 7 aa, Mycobacterium
GKPSSGF

SEQ ID NO: 488703 - protein, 11 aa, Mycobacterium
GKPSSTAAQQD

SEQ ID NO: 488704 - protein, 13 aa, Mycobacterium
GKPTAAGYAQAGG

SEQ ID NO: 488705 - protein, 10 aa, Mycobacterium
GKPTAITPAH

SEQ ID NO: 488706 - protein, 15 aa, Mycobacterium
GKPTALPGIFASALR

SEQ ID NO: 488707 - protein, 9 aa, Mycobacterium
GKPTDPTAA

SEQ ID NO: 488708 - protein, 12 aa, Mycobacterium
GKPTDQLPGHGR

SEQ ID NO: 488709 - protein, 12 aa, Mycobacterium
GKPTDQLPGPGK

SEQ ID NO: 488710 - protein, 9 aa, Mycobacterium
GKPTDTPMP

SEQ ID NO: 488711 - protein, 7 aa, Mycobacterium
GKPTEGI

SEQ ID NO: 488712 - protein, 8 aa, Mycobacterium
GKPTGEWA

SEQ ID NO: 488713 - protein, 5 aa, Mycobacterium
GKPTL

SEQ ID NO: 488714 - protein, 15 aa, Mycobacterium
GKPTPEGYAQARTDF

SEQ ID NO: 488715 - protein, 19 aa, Mycobacterium
GKPTTNKDEKKDEKSDLGA

SEQ ID NO: 488716 - protein, 13 aa, Mycobacterium
GKPTTRRHEANGG

SEQ ID NO: 488717 - protein, 6 aa, Mycobacterium
GKPVAI

SEQ ID NO: 488718 - protein, 7 aa, Mycobacterium
GKPVDGP

SEQ ID NO: 488719 - protein, 18 aa, Mycobacterium
GKPVEGYSDDLSAARERV

SEQ ID NO: 488720 - protein, 8 aa, Mycobacterium
GKPVGTVE

SEQ ID NO: 488721 - protein, 6 aa, Mycobacterium
GKPVLS

SEQ ID NO: 488722 - protein, 7 aa, Mycobacterium
GKPVPEA

SEQ ID NO: 488723 - protein, 6 aa, Mycobacterium
GKPVPG

SEQ ID NO: 488724 - protein, 6 aa, Mycobacterium
GKPVPL

SEQ ID NO: 488725 - protein, 5 aa, Mycobacterium
GKPVR

SEQ ID NO: 488726 - protein, 10 aa, Mycobacterium
GKPVTGPDPS

SEQ ID NO: 488727 - protein, 5 aa, Mycobacterium
GKPVV

SEQ ID NO: 488728 - protein, 8 aa, Mycobacterium
GKPWTEPA

SEQ ID NO: 488729 - protein, 8 aa, Mycobacterium
GKPWTPAA

SEQ ID NO: 488730 - protein, 30 aa, Mycobacterium
GKQAHDKRQDIAKRDASREITRELGRRAKG

SEQ ID NO: 488731 - protein, 18 aa, Mycobacterium
GKQAHDKRQDLARRDAQR

SEQ ID NO: 488732 - protein, 32 aa, Mycobacterium
GKQAHDKRQDMARRDAQREVTRELGRRVKGMT

SEQ ID NO: 488733 - protein, 16 aa, Mycobacterium
GKQALTAAGSSAQANA

SEQ ID NO: 488734 - protein, 11 aa, Mycobacterium
GKQDGDPCKDA

SEQ ID NO: 488735 - protein, 6 aa, Mycobacterium
GKQEKY

SEQ ID NO: 488736 - protein, 9 aa, Mycobacterium
GKQFDGTGN

SEQ ID NO: 488737 - protein, 7 aa, Mycobacterium
GKQGGKK

SEQ ID NO: 488738 - protein, 6 aa, Mycobacterium
GKQGPE

SEQ ID NO: 488739 - protein, 8 aa, Mycobacterium
GKQGTKGR

SEQ ID NO: 488740 - protein, 4 aa, Mycobacterium
GKQL

SEQ ID NO: 488741 - protein, 7 aa, Mycobacterium
GKQLEND

SEQ ID NO: 488742 - protein, 9 aa, Mycobacterium
GKQMAKGDE

SEQ ID NO: 488743 - protein, 15 aa, Mycobacterium
GKQPPNTDDNQPGLF

SEQ ID NO: 488744 - protein, 7 aa, Mycobacterium
GKQPSPN

SEQ ID NO: 488745 - protein, 18 aa, Mycobacterium
GKQQPQRSGTELRSLNDT

SEQ ID NO: 488746 - protein, 10 aa, Mycobacterium
GKQQRPAPTV

SEQ ID NO: 488747 - protein, 4 aa, Mycobacterium
GKQR

SEQ ID NO: 488748 - protein, 8 aa, Mycobacterium
GKQRGNRR

SEQ ID NO: 488749 - protein, 8 aa, Mycobacterium
GKQRPGSF

SEQ ID NO: 488750 - protein, 8 aa, Mycobacterium
GKQRPGSI

SEQ ID NO: 488751 - protein, 9 aa, Mycobacterium
GKQRPGSVR

SEQ ID NO: 488752 - protein, 6 aa, Mycobacterium
GKQRRH

SEQ ID NO: 488753 - protein, 27 aa, Mycobacterium
GKQRRPLPTGLGAPSADPLDELDERSE

SEQ ID NO: 488754 - protein, 8 aa, Mycobacterium
GKQTGAEG

SEQ ID NO: 488755 - protein, 12 aa, Mycobacterium
GKQTITSLPGSS

SEQ ID NO: 488756 - protein, 7 aa, Mycobacterium
GKQYGSV

SEQ ID NO: 488757 - protein, 9 aa, Mycobacterium
GKRADGAVA

SEQ ID NO: 488758 - protein, 18 aa, Mycobacterium
GKRAHDKRQDMARRDAQR

SEQ ID NO: 488759 - protein, 6 aa, Mycobacterium
GKRAIT

SEQ ID NO: 488760 - protein, 5 aa, Mycobacterium
GKRAP

SEQ ID NO: 488761 - protein, 18 aa, Mycobacterium
GKRASTPKAEVALRQGPL

SEQ ID NO: 488762 - protein, 7 aa, Mycobacterium
GKRATSA

SEQ ID NO: 488763 - protein, 19 aa, Mycobacterium
GKRAYDKRQDMAQRDAQRE

SEQ ID NO: 488764 - protein, 6 aa, Mycobacterium
GKRCGT

SEQ ID NO: 488765 - protein, 10 aa, Mycobacterium
GKREPEEERN

SEQ ID NO: 488766 - protein, 12 aa, Mycobacterium
GKRESKSRPGEG

SEQ ID NO: 488767 - protein, 7 aa, Mycobacterium
GKREVGN

SEQ ID NO: 488768 - protein, 4 aa, Mycobacterium
GKRF

SEQ ID NO: 488769 - protein, 4 aa, Mycobacterium
GKRG

SEQ ID NO: 488770 - protein, 9 aa, Mycobacterium
GKRGPVPVD

SEQ ID NO: 488771 - protein, 8 aa, Mycobacterium
GKRGTTID

SEQ ID NO: 488772 - protein, 9 aa, Mycobacterium
GKRHSTGDD

SEQ ID NO: 488773 - protein, 4 aa, Mycobacterium
GKRI

SEQ ID NO: 488774 - protein, 8 aa, Mycobacterium
GKRIASDF

SEQ ID NO: 488775 - protein, 5 aa, Mycobacterium
GKRID

SEQ ID NO: 488776 - protein, 8 aa, Mycobacterium
GKRISEAA

SEQ ID NO: 488777 - protein, 15 aa, Mycobacterium
GKRKAGADKDQAAAD

SEQ ID NO: 488778 - protein, 7 aa, Mycobacterium
GKRKGLD

SEQ ID NO: 488779 - protein, 15 aa, Mycobacterium
GKRKVGADKDEAAAK

SEQ ID NO: 488780 - protein, 9 aa, Mycobacterium
GKRLDPRQA

SEQ ID NO: 488781 - protein, 10 aa, Mycobacterium
GKRLNDNGSI

SEQ ID NO: 488782 - protein, 17 aa, Mycobacterium
GKRPAAEEFSGRSDYGP

SEQ ID NO: 488783 - protein, 15 aa, Mycobacterium
GKRPAQSPTGERVAL

SEQ ID NO: 488784 - protein, 20 aa, Mycobacterium
GKRPASPDVAAPQPPEVGAG

SEQ ID NO: 488785 - protein, 7 aa, Mycobacterium
GKRPMTK

SEQ ID NO: 488786 - protein, 7 aa, Mycobacterium
GKRPYTE

SEQ ID NO: 488787 - protein, 9 aa, Mycobacterium
GKRREAIDP

SEQ ID NO: 488788 - protein, 8 aa, Mycobacterium
GKRREDGV

SEQ ID NO: 488789 - protein, 12 aa, Mycobacterium
GKRRGNQAESGI

SEQ ID NO: 488790 - protein, 13 aa, Mycobacterium
GKRRGSQAEGGIN

SEQ ID NO: 488791 - protein, 11 aa, Mycobacterium
GKRRPDSDDEA

SEQ ID NO: 488792 - protein, 12 aa, Mycobacterium
GKRRRPLDPARA

SEQ ID NO: 488793 - protein, 10 aa, Mycobacterium
GKRRSGQAEL

SEQ ID NO: 488794 - protein, 12 aa, Mycobacterium
GKRRSNQAAEGI

SEQ ID NO: 488795 - protein, 12 aa, Mycobacterium
GKRRSNQAEAGI

SEQ ID NO: 488796 - protein, 12 aa, Mycobacterium
GKRRSNQAENGI

SEQ ID NO: 488797 - protein, 13 aa, Mycobacterium
GKRRSNQAENGIS

SEQ ID NO: 488798 - protein, 9 aa, Mycobacterium
GKRSGEVTT

SEQ ID NO: 488799 - protein, 7 aa, Mycobacterium
GKRSGTA

SEQ ID NO: 488800 - protein, 32 aa, Mycobacterium
GKRSKGGKAAPSRQRKAAKSPASRARTKAPAA

SEQ ID NO: 488801 - protein, 6 aa, Mycobacterium
GKRSRV

SEQ ID NO: 488802 - protein, 4 aa, Mycobacterium
GKRT

SEQ ID NO: 488803 - protein, 7 aa, Mycobacterium
GKRTDRI

SEQ ID NO: 488804 - protein, 7 aa, Mycobacterium
GKRTDRV

SEQ ID NO: 488805 - protein, 13 aa, Mycobacterium
GKRTFQPNNRRRA

SEQ ID NO: 488806 - protein, 7 aa, Mycobacterium
GKRTLTE

SEQ ID NO: 488807 - protein, 4 aa, Mycobacterium
GKRV

SEQ ID NO: 488808 - protein, 14 aa, Mycobacterium
GKRVESRQAEVGEF

SEQ ID NO: 488809 - protein, 8 aa, Mycobacterium
GKRVYSGS

SEQ ID NO: 488810 - protein, 12 aa, Mycobacterium
GKSAAQLSGSGI

SEQ ID NO: 488811 - protein, 8 aa, Mycobacterium
GKSAERIA

SEQ ID NO: 488812 - protein, 6 aa, Mycobacterium
GKSALT

SEQ ID NO: 488813 - protein, 9 aa, Mycobacterium
GKSARPGGH

SEQ ID NO: 488814 - protein, 7 aa, Mycobacterium
GKSAWDY

SEQ ID NO: 488815 - protein, 16 aa, Mycobacterium
GKSDDELIDLKVSGAV

SEQ ID NO: 488816 - protein, 13 aa, Mycobacterium
GKSDQALAAQAGR

SEQ ID NO: 488817 - protein, 17 aa, Mycobacterium
GKSDQPYGVPSPRFEGT

SEQ ID NO: 488818 - protein, 10 aa, Mycobacterium
GKSDRPGRNQ

SEQ ID NO: 488819 - protein, 4 aa, Mycobacterium
GKSE

SEQ ID NO: 488820 - protein, 24 aa, Mycobacterium
GKSEGAKLITGGERAQLGGDLNGG

SEQ ID NO: 488821 - protein, 24 aa, Mycobacterium
GKSEGARLVTGGDRADLGGDLSGG

SEQ ID NO: 488822 - protein, 6 aa, Mycobacterium
GKSEYG

SEQ ID NO: 488823 - protein, 8 aa, Mycobacterium
GKSFSGSD

SEQ ID NO: 488824 - protein, 7 aa, Mycobacterium
GKSGFVS

SEQ ID NO: 488825 - protein, 14 aa, Mycobacterium
GKSGGAPETVRHNE

SEQ ID NO: 488826 - protein, 13 aa, Mycobacterium
GKSGQALAAQAGR

SEQ ID NO: 488827 - protein, 6 aa, Mycobacterium
GKSGVS

SEQ ID NO: 488828 - protein, 7 aa, Mycobacterium
GKSHGSR

SEQ ID NO: 488829 - protein, 6 aa, Mycobacterium
GKSIPL

SEQ ID NO: 488830 - protein, 9 aa, Mycobacterium
GKSKANERV

SEQ ID NO: 488831 - protein, 11 aa, Mycobacterium
GKSKRDRLSTA

SEQ ID NO: 488832 - protein, 12 aa, Mycobacterium
GKSLKNSISPDD

SEQ ID NO: 488833 - protein, 12 aa, Mycobacterium
GKSLKNSISPDE

SEQ ID NO: 488834 - protein, 12 aa, Mycobacterium
GKSLKNSVSPDE

SEQ ID NO: 488835 - protein, 15 aa, Mycobacterium
GKSLNVGGSDNTLTV

SEQ ID NO: 488836 - protein, 8 aa, Mycobacterium
GKSNKDVA

SEQ ID NO: 488837 - protein, 7 aa, Mycobacterium
GKSPGGI

SEQ ID NO: 488838 - protein, 7 aa, Mycobacterium
GKSPRFT

SEQ ID NO: 488839 - protein, 9 aa, Mycobacterium
GKSPSRKNP

SEQ ID NO: 488840 - protein, 8 aa, Mycobacterium
GKSQWAES

SEQ ID NO: 488841 - protein, 10 aa, Mycobacterium
GKSRDEWSAE

SEQ ID NO: 488842 - protein, 7 aa, Mycobacterium
GKSRHAE

SEQ ID NO: 488843 - protein, 5 aa, Mycobacterium
GKSRW

SEQ ID NO: 488844 - protein, 7 aa, Mycobacterium
GKSRWAE

SEQ ID NO: 488845 - protein, 8 aa, Mycobacterium
GKSRWAEE

SEQ ID NO: 488846 - protein, 4 aa, Mycobacterium
GKSS

SEQ ID NO: 488847 - protein, 9 aa, Mycobacterium
GKSSPDARL

SEQ ID NO: 488848 - protein, 5 aa, Mycobacterium
GKSTF

SEQ ID NO: 488849 - protein, 6 aa, Mycobacterium
GKSTFE

SEQ ID NO: 488850 - protein, 8 aa, Mycobacterium
GKSTGPEI

SEQ ID NO: 488851 - protein, 5 aa, Mycobacterium
GKSTI

SEQ ID NO: 488852 - protein, 7 aa, Mycobacterium
GKSTVDA

SEQ ID NO: 488853 - protein, 14 aa, Mycobacterium
GKSTVSSDPDAVRD

SEQ ID NO: 488854 - protein, 7 aa, Mycobacterium
GKSVPLS

SEQ ID NO: 488855 - protein, 6 aa, Mycobacterium
GKSVST

SEQ ID NO: 488856 - protein, 6 aa, Mycobacterium
GKSVVT

SEQ ID NO: 488857 - protein, 7 aa, Mycobacterium
GKSYGNI

SEQ ID NO: 488858 - protein, 5 aa, Mycobacterium
GKSYL

SEQ ID NO: 488859 - protein, 17 aa, Mycobacterium
GKTADGVPLTGDEESAL

SEQ ID NO: 488860 - protein, 5 aa, Mycobacterium
GKTAG

SEQ ID NO: 488861 - protein, 22 aa, Mycobacterium
GKTAYASDPGMTDTGITRNGSG

SEQ ID NO: 488862 - protein, 4 aa, Mycobacterium
GKTD

SEQ ID NO: 488863 - protein, 6 aa, Mycobacterium
GKTDAI

SEQ ID NO: 488864 - protein, 6 aa, Mycobacterium
GKTDFP

SEQ ID NO: 488865 - protein, 9 aa, Mycobacterium
GKTDGSVEL

SEQ ID NO: 488866 - protein, 10 aa, Mycobacterium
GKTEDKPEVA

SEQ ID NO: 488867 - protein, 15 aa, Mycobacterium
GKTEPGWDARKPERP

SEQ ID NO: 488868 - protein, 12 aa, Mycobacterium
GKTERNDRTDEI

SEQ ID NO: 488869 - protein, 6 aa, Mycobacterium
GKTFNS

SEQ ID NO: 488870 - protein, 4 aa, Mycobacterium
GKTG

SEQ ID NO: 488871 - protein, 7 aa, Mycobacterium
GKTGMDT

SEQ ID NO: 488872 - protein, 9 aa, Mycobacterium
GKTGSEALG

SEQ ID NO: 488873 - protein, 8 aa, Mycobacterium
GKTHGAAD

SEQ ID NO: 488874 - protein, 23 aa, Mycobacterium
GKTHGAGDADLVGPEPEAAPIEQ

SEQ ID NO: 488875 - protein, 25 aa, Mycobacterium
GKTHGAGDADLVGPEPEAAPIEQQG

SEQ ID NO: 488876 - protein, 21 aa, Mycobacterium
GKTHGAGDAGLVGPDPEAAPL

SEQ ID NO: 488877 - protein, 25 aa, Mycobacterium
GKTHGAGDASLVGPEPEAAPIEQQG

SEQ ID NO: 488878 - protein, 25 aa, Mycobacterium
GKTHGAGSGDLVGPEPEAAPIEQQG

SEQ ID NO: 488879 - protein, 21 aa, Mycobacterium
GKTHGNGDASLVGPEPEAAPL

SEQ ID NO: 488880 - protein, 25 aa, Mycobacterium
GKTHGRGDPELVGPEPEAAPIEQQG

SEQ ID NO: 488881 - protein, 8 aa, Mycobacterium
GKTHMSPQ

SEQ ID NO: 488882 - protein, 8 aa, Mycobacterium
GKTHRDHR

SEQ ID NO: 488883 - protein, 4 aa, Mycobacterium
GKTI

SEQ ID NO: 488884 - protein, 5 aa, Mycobacterium
GKTID

SEQ ID NO: 488885 - protein, 8 aa, Mycobacterium
GKTIPADA

SEQ ID NO: 488886 - protein, 8 aa, Mycobacterium
GKTIPANA

SEQ ID NO: 488887 - protein, 8 aa, Mycobacterium
GKTIPPDA

SEQ ID NO: 488888 - protein, 5 aa, Mycobacterium
GKTKR

SEQ ID NO: 488889 - protein, 15 aa, Mycobacterium
GKTKRESVGRALPDT

SEQ ID NO: 488890 - protein, 9 aa, Mycobacterium
GKTLEDPHE

SEQ ID NO: 488891 - protein, 7 aa, Mycobacterium
GKTNSAI

SEQ ID NO: 488892 - protein, 8 aa, Mycobacterium
GKTNSAIA

SEQ ID NO: 488893 - protein, 7 aa, Mycobacterium
GKTPARI

SEQ ID NO: 488894 - protein, 7 aa, Mycobacterium
GKTPDNV

SEQ ID NO: 488895 - protein, 7 aa, Mycobacterium
GKTPDYD

SEQ ID NO: 488896 - protein, 8 aa, Mycobacterium
GKTPERIA

SEQ ID NO: 488897 - protein, 8 aa, Mycobacterium
GKTPQGSW

SEQ ID NO: 488898 - protein, 8 aa, Mycobacterium
GKTPQRLA

SEQ ID NO: 488899 - protein, 7 aa, Mycobacterium
GKTPQRV

SEQ ID NO: 488900 - protein, 8 aa, Mycobacterium
GKTPQRVA

SEQ ID NO: 488901 - protein, 8 aa, Mycobacterium
GKTPSQRY

SEQ ID NO: 488902 - protein, 5 aa, Mycobacterium
GKTQA

SEQ ID NO: 488903 - protein, 10 aa, Mycobacterium
GKTQKATRSR

SEQ ID NO: 488904 - protein, 10 aa, Mycobacterium
GKTRDPGGDG

SEQ ID NO: 488905 - protein, 8 aa, Mycobacterium
GKTRRALD

SEQ ID NO: 488906 - protein, 11 aa, Mycobacterium
GKTRTAEAGES

SEQ ID NO: 488907 - protein, 10 aa, Mycobacterium
GKTRTAERAR

SEQ ID NO: 488908 - protein, 4 aa, Mycobacterium
GKTS

SEQ ID NO: 488909 - protein, 10 aa, Mycobacterium
GKTSDAATTL

SEQ ID NO: 488910 - protein, 9 aa, Mycobacterium
GKTSPEELA

SEQ ID NO: 488911 - protein, 11 aa, Mycobacterium
GKTTESAAMRP

SEQ ID NO: 488912 - protein, 7 aa, Mycobacterium
GKTTHPL

SEQ ID NO: 488913 - protein, 5 aa, Mycobacterium
GKTTL

SEQ ID NO: 488914 - protein, 6 aa, Mycobacterium
GKTTTA

SEQ ID NO: 488915 - protein, 6 aa, Mycobacterium
GKTTVA

SEQ ID NO: 488916 - protein, 10 aa, Mycobacterium
GKTVDKYTTD

SEQ ID NO: 488917 - protein, 5 aa, Mycobacterium
GKTVN

SEQ ID NO: 488918 - protein, 6 aa, Mycobacterium
GKTVTS

SEQ ID NO: 488919 - protein, 13 aa, Mycobacterium
GKTWADDNAPPFA

SEQ ID NO: 488920 - protein, 5 aa, Mycobacterium
GKTYD

SEQ ID NO: 488921 - protein, 8 aa, Mycobacterium
GKVADDGE

SEQ ID NO: 488922 - protein, 7 aa, Mycobacterium
GKVADEG

SEQ ID NO: 488923 - protein, 12 aa, Mycobacterium
GKVAGGETEPAA

SEQ ID NO: 488924 - protein, 11 aa, Mycobacterium
GKVAKANRAAY

SEQ ID NO: 488925 - protein, 10 aa, Mycobacterium
GKVAPSPARV

SEQ ID NO: 488926 - protein, 5 aa, Mycobacterium
GKVDE

SEQ ID NO: 488927 - protein, 16 aa, Mycobacterium
GKVDKKRLRAELKAAA

SEQ ID NO: 488928 - protein, 10 aa, Mycobacterium
GKVDPDERKG

SEQ ID NO: 488929 - protein, 9 aa, Mycobacterium
GKVDSGSQV

SEQ ID NO: 488930 - protein, 20 aa, Mycobacterium
GKVDSGSQVINSTKGKKERL

SEQ ID NO: 488931 - protein, 7 aa, Mycobacterium
GKVEGSI

SEQ ID NO: 488932 - protein, 7 aa, Mycobacterium
GKVEPDT

SEQ ID NO: 488933 - protein, 4 aa, Mycobacterium
GKVG

SEQ ID NO: 488934 - protein, 14 aa, Mycobacterium
GKVGAEVSAEEAKE

SEQ ID NO: 488935 - protein, 9 aa, Mycobacterium
GKVGDTIAS

SEQ ID NO: 488936 - protein, 6 aa, Mycobacterium
GKVGEQ

SEQ ID NO: 488937 - protein, 13 aa, Mycobacterium
GKVGGDRSAAGHF

SEQ ID NO: 488938 - protein, 13 aa, Mycobacterium
GKVGQVNATEVPR

SEQ ID NO: 488939 - protein, 9 aa, Mycobacterium
GKVKADERK

SEQ ID NO: 488940 - protein, 7 aa, Mycobacterium
GKVKGNV

SEQ ID NO: 488941 - protein, 10 aa, Mycobacterium
GKVKPEERKP

SEQ ID NO: 488942 - protein, 4 aa, Mycobacterium
GKVN

SEQ ID NO: 488943 - protein, 4 aa, Mycobacterium
GKVP

SEQ ID NO: 488944 - protein, 10 aa, Mycobacterium
GKVPKTASGK

SEQ ID NO: 488945 - protein, 9 aa, Mycobacterium
GKVRTDERK

SEQ ID NO: 488946 - protein, 7 aa, Mycobacterium
GKVSGKN

SEQ ID NO: 488947 - protein, 16 aa, Mycobacterium
GKVSKDWNTDATKGIP

SEQ ID NO: 488948 - protein, 12 aa, Mycobacterium
GKVSTAAGARNV

SEQ ID NO: 488949 - protein, 5 aa, Mycobacterium
GKVSY

SEQ ID NO: 488950 - protein, 4 aa, Mycobacterium
GKVT

SEQ ID NO: 488951 - protein, 14 aa, Mycobacterium
GKVTNTGKGQYDGV

SEQ ID NO: 488952 - protein, 9 aa, Mycobacterium
GKVTNTHKG

SEQ ID NO: 488953 - protein, 14 aa, Mycobacterium
GKVTPGESDADALA

SEQ ID NO: 488954 - protein, 16 aa, Mycobacterium
GKVTQIEGNPDSPISR

SEQ ID NO: 488955 - protein, 11 aa, Mycobacterium
GKVTSAQQGID

SEQ ID NO: 488956 - protein, 8 aa, Mycobacterium
GKVTTGQT

SEQ ID NO: 488957 - protein, 12 aa, Mycobacterium
GKVTTTDGPYLE

SEQ ID NO: 488958 - protein, 4 aa, Mycobacterium
GKWD

SEQ ID NO: 488959 - protein, 7 aa, Mycobacterium
GKWDPGK

SEQ ID NO: 488960 - protein, 7 aa, Mycobacterium
GKWNEEQ

SEQ ID NO: 488961 - protein, 22 aa, Mycobacterium
GKWPPTSQPPATALRFSLICWQ

SEQ ID NO: 488962 - protein, 6 aa, Mycobacterium
GKWTEE

SEQ ID NO: 488963 - protein, 9 aa, Mycobacterium
GKWYPGEPL

SEQ ID NO: 488964 - protein, 6 aa, Mycobacterium
GKYGTT

SEQ ID NO: 488965 - protein, 9 aa, Mycobacterium
GKYGTTADQ

SEQ ID NO: 488966 - protein, 5 aa, Mycobacterium
GKYGV

SEQ ID NO: 488967 - protein, 4 aa, Mycobacterium
GKYP

SEQ ID NO: 488968 - protein, 11 aa, Mycobacterium
GKYPPPPGASE

SEQ ID NO: 488969 - protein, 19 aa, Mycobacterium
GKYPPVRDTGDTQNTTIRR

SEQ ID NO: 488970 - protein, 8 aa, Mycobacterium
GKYPSTDF

SEQ ID NO: 488971 - protein, 7 aa, Mycobacterium
GKYPSTE

SEQ ID NO: 488972 - protein, 9 aa, Mycobacterium
GKYRRDDLT

SEQ ID NO: 488973 - protein, 8 aa, Mycobacterium
GKYSELDA

SEQ ID NO: 488974 - protein, 14 aa, Mycobacterium
GKYSSSRGPSFSSY

SEQ ID NO: 488975 - protein, 16 aa, Mycobacterium
GKYTRANSGRHDADRG

SEQ ID NO: 488976 - protein, 4 aa, Mycobacterium
GKYY

SEQ ID NO: 488977 - protein, 4 aa, Mycobacterium
GLAA

SEQ ID NO: 488978 - protein, 11 aa, Mycobacterium
GLAADDPRRQT

SEQ ID NO: 488979 - protein, 6 aa, Mycobacterium
GLAADG

SEQ ID NO: 488980 - protein, 5 aa, Mycobacterium
GLAAE

SEQ ID NO: 488981 - protein, 14 aa, Mycobacterium
GLAAEQSSDQPGIC

SEQ ID NO: 488982 - protein, 8 aa, Mycobacterium
GLAAETAN

SEQ ID NO: 488983 - protein, 17 aa, Mycobacterium
GLAAGAAALAPGTTENA

SEQ ID NO: 488984 - protein, 7 aa, Mycobacterium
GLAAGAR

SEQ ID NO: 488985 - protein, 8 aa, Mycobacterium
GLAAGEVR

SEQ ID NO: 488986 - protein, 23 aa, Mycobacterium
GLAAGNDAQHKADTVSKEQYAKD

SEQ ID NO: 488987 - protein, 10 aa, Mycobacterium
GLAAKTGVEE

SEQ ID NO: 488988 - protein, 6 aa, Mycobacterium
GLAASG

SEQ ID NO: 488989 - protein, 13 aa, Mycobacterium
GLAATDDDVDAGA

SEQ ID NO: 488990 - protein, 8 aa, Mycobacterium
GLADASND

SEQ ID NO: 488991 - protein, 14 aa, Mycobacterium
GLADEAKATGDERH

SEQ ID NO: 488992 - protein, 6 aa, Mycobacterium
GLADGA

SEQ ID NO: 488993 - protein, 18 aa, Mycobacterium
GLADGPLPTHYEPHESPV

SEQ ID NO: 488994 - protein, 6 aa, Mycobacterium
GLADGY

SEQ ID NO: 488995 - protein, 5 aa, Mycobacterium
GLADK

SEQ ID NO: 488996 - protein, 5 aa, Mycobacterium
GLADP

SEQ ID NO: 488997 - protein, 8 aa, Mycobacterium
GLADPDGT

SEQ ID NO: 488998 - protein, 9 aa, Mycobacterium
GLADPHAES

SEQ ID NO: 488999 - protein, 7 aa, Mycobacterium
GLADQAR

SEQ ID NO: 489000 - protein, 7 aa, Mycobacterium
GLADTSA

SEQ ID NO: 489001 - protein, 20 aa, Mycobacterium
GLADTTRGDGGHGSSGGHAS

SEQ ID NO: 489002 - protein, 20 aa, Mycobacterium
GLADTTRGDGGYGSSGGHAS

SEQ ID NO: 489003 - protein, 7 aa, Mycobacterium
GLAEAAD

SEQ ID NO: 489004 - protein, 7 aa, Mycobacterium
GLAEAKT

SEQ ID NO: 489005 - protein, 8 aa, Mycobacterium
GLAEEADG

SEQ ID NO: 489006 - protein, 10 aa, Mycobacterium
GLAEEKDGAQ

SEQ ID NO: 489007 - protein, 8 aa, Mycobacterium
GLAEGGIP

SEQ ID NO: 489008 - protein, 7 aa, Mycobacterium
GLAEPAA

SEQ ID NO: 489009 - protein, 13 aa, Mycobacterium
GLAEREPESRGYR

SEQ ID NO: 489010 - protein, 9 aa, Mycobacterium
GLAESRGYA

SEQ ID NO: 489011 - protein, 9 aa, Mycobacterium
GLAETASDD

SEQ ID NO: 489012 - protein, 6 aa, Mycobacterium
GLAETE

SEQ ID NO: 489013 - protein, 8 aa, Mycobacterium
GLAETEAQ

SEQ ID NO: 489014 - protein, 7 aa, Mycobacterium
GLAGAAS

SEQ ID NO: 489015 - protein, 21 aa, Mycobacterium
GLAGAGGNGNVGNGLTGTNQI

SEQ ID NO: 489016 - protein, 12 aa, Mycobacterium
GLAGAQRSATGQ

SEQ ID NO: 489017 - protein, 6 aa, Mycobacterium
GLAGAR

SEQ ID NO: 489018 - protein, 7 aa, Mycobacterium
GLAGATT

SEQ ID NO: 489019 - protein, 27 aa, Mycobacterium
GLAGDTNKNGPSEEGPSGQPSEDGGGV

SEQ ID NO: 489020 - protein, 9 aa, Mycobacterium
GLAGEGSMR

SEQ ID NO: 489021 - protein, 16 aa, Mycobacterium
GLAGFGSADAGSIGYT

SEQ ID NO: 489022 - protein, 83 aa, Mycobacterium
GLAGGGSVLPPPVTPPPAQPASSTAGAYGSPSAGGAPSVPAGGGPVAQSAPPAAAGGLAAPAGPVGTPTMSPAPAPAGPLPPF

SEQ ID NO: 489023 - protein, 67 aa, Mycobacterium
GLAGGGSVLPPPVTPPPAQPASSTAGAYGSPSAGGAPSVPAGGGPVAQSAPPAAAIGSAAPAGPVGT

SEQ ID NO: 489024 - protein, 54 aa, Mycobacterium
GLAGGPRGAGVPGRRRRAAAQRAQAGVGDPDPDRAGTRPGAGADTAARLGARRG

SEQ ID NO: 489025 - protein, 19 aa, Mycobacterium
GLAGGSWQGPASTAMASAA

SEQ ID NO: 489026 - protein, 9 aa, Mycobacterium
GLAGHDGNR

SEQ ID NO: 489027 - protein, 30 aa, Mycobacterium
GLAGKGDLTGPAPSGAPVPGQPIPPGPTGG

SEQ ID NO: 489028 - protein, 7 aa, Mycobacterium
GLAGPGR

SEQ ID NO: 489029 - protein, 23 aa, Mycobacterium
GLAGQAAAAGQAAGTSAGTAAQS

SEQ ID NO: 489030 - protein, 13 aa, Mycobacterium
GLAGQKRQAAYGP

SEQ ID NO: 489031 - protein, 5 aa, Mycobacterium
GLAGR

SEQ ID NO: 489032 - protein, 10 aa, Mycobacterium
GLAGSPELPT

SEQ ID NO: 489033 - protein, 15 aa, Mycobacterium
GLAGTGGNGGNGGDA

SEQ ID NO: 489034 - protein, 7 aa, Mycobacterium
GLAGTSL

SEQ ID NO: 489035 - protein, 8 aa, Mycobacterium
GLAKPDGI

SEQ ID NO: 489036 - protein, 8 aa, Mycobacterium
GLAKPDGV

SEQ ID NO: 489037 - protein, 10 aa, Mycobacterium
GLAKTTAARA

SEQ ID NO: 489038 - protein, 10 aa, Mycobacterium
GLANDDGGSY

SEQ ID NO: 489039 - protein, 22 aa, Mycobacterium
GLANQAAAAGQAASTSAGAAAQ

SEQ ID NO: 489040 - protein, 22 aa, Mycobacterium
GLAPAAKAASEGAKAAASLPAV

SEQ ID NO: 489041 - protein, 6 aa, Mycobacterium
GLAPAD

SEQ ID NO: 489042 - protein, 13 aa, Mycobacterium
GLAPAGADEVSAQ

SEQ ID NO: 489043 - protein, 9 aa, Mycobacterium
GLAPASGEY

SEQ ID NO: 489044 - protein, 10 aa, Mycobacterium
GLAPDGQREL

SEQ ID NO: 489045 - protein, 22 aa, Mycobacterium
GLAPDGRSKAYAGAADGVGWSE

SEQ ID NO: 489046 - protein, 5 aa, Mycobacterium
GLAPE

SEQ ID NO: 489047 - protein, 12 aa, Mycobacterium
GLAPGSLAQTQT

SEQ ID NO: 489048 - protein, 9 aa, Mycobacterium
GLAPGTGIR

SEQ ID NO: 489049 - protein, 5 aa, Mycobacterium
GLAPH

SEQ ID NO: 489050 - protein, 9 aa, Mycobacterium
GLAPIDRAG

SEQ ID NO: 489051 - protein, 9 aa, Mycobacterium
GLAPKAKQA

SEQ ID NO: 489052 - protein, 7 aa, Mycobacterium
GLAPQGE

SEQ ID NO: 489053 - protein, 8 aa, Mycobacterium
GLAPQGLD

SEQ ID NO: 489054 - protein, 14 aa, Mycobacterium
GLAPQGSVPEADSG

SEQ ID NO: 489055 - protein, 6 aa, Mycobacterium
GLAPRG

SEQ ID NO: 489056 - protein, 13 aa, Mycobacterium
GLAPSSAPPAPYS

SEQ ID NO: 489057 - protein, 10 aa, Mycobacterium
GLAPTAKEVT

SEQ ID NO: 489058 - protein, 7 aa, Mycobacterium
GLAPVTS

SEQ ID NO: 489059 - protein, 5 aa, Mycobacterium
GLAPW

SEQ ID NO: 489060 - protein, 6 aa, Mycobacterium
GLAQKE

SEQ ID NO: 489061 - protein, 14 aa, Mycobacterium
GLAQPPGTSPAEDN

SEQ ID NO: 489062 - protein, 14 aa, Mycobacterium
GLAQPSGVSPAADS

SEQ ID NO: 489063 - protein, 6 aa, Mycobacterium
GLAQQE

SEQ ID NO: 489064 - protein, 12 aa, Mycobacterium
GLAQRDPSHTHG

SEQ ID NO: 489065 - protein, 17 aa, Mycobacterium
GLAQSGDLDPGRAMAGA

SEQ ID NO: 489066 - protein, 5 aa, Mycobacterium
GLARA

SEQ ID NO: 489067 - protein, 14 aa, Mycobacterium
GLARAARARFRHRG

SEQ ID NO: 489068 - protein, 6 aa, Mycobacterium
GLARAG

SEQ ID NO: 489069 - protein, 9 aa, Mycobacterium
GLARPQGER

SEQ ID NO: 489070 - protein, 12 aa, Mycobacterium
GLARVGPGKGGS

SEQ ID NO: 489071 - protein, 4 aa, Mycobacterium
GLAS

SEQ ID NO: 489072 - protein, 10 aa, Mycobacterium
GLASAAGGTA

SEQ ID NO: 489073 - protein, 12 aa, Mycobacterium
GLASGAGTRVGA

SEQ ID NO: 489074 - protein, 10 aa, Mycobacterium
GLASGNSYHE

SEQ ID NO: 489075 - protein, 7 aa, Mycobacterium
GLASGSG

SEQ ID NO: 489076 - protein, 24 aa, Mycobacterium
GLASPAAALSEAAAANPAAALPVP

SEQ ID NO: 489077 - protein, 17 aa, Mycobacterium
GLASPAAASPIDAIPGS

SEQ ID NO: 489078 - protein, 7 aa, Mycobacterium
GLASPAK

SEQ ID NO: 489079 - protein, 7 aa, Mycobacterium
GLASPTV

SEQ ID NO: 489080 - protein, 12 aa, Mycobacterium
GLASSTAAVGGA

SEQ ID NO: 489081 - protein, 9 aa, Mycobacterium
GLASTTSMD

SEQ ID NO: 489082 - protein, 9 aa, Mycobacterium
GLATATKSA

SEQ ID NO: 489083 - protein, 11 aa, Mycobacterium
GLATDDPRGLT

SEQ ID NO: 489084 - protein, 7 aa, Mycobacterium
GLATDGI

SEQ ID NO: 489085 - protein, 6 aa, Mycobacterium
GLATEL

SEQ ID NO: 489086 - protein, 7 aa, Mycobacterium
GLATGEV

SEQ ID NO: 489087 - protein, 5 aa, Mycobacterium
GLATP

SEQ ID NO: 489088 - protein, 17 aa, Mycobacterium
GLATPESLDPGADAPDR

SEQ ID NO: 489089 - protein, 14 aa, Mycobacterium
GLATPESLDPGAES

SEQ ID NO: 489090 - protein, 9 aa, Mycobacterium
GLATTSEEM

SEQ ID NO: 489091 - protein, 4 aa, Mycobacterium
GLCG

SEQ ID NO: 489092 - protein, 9 aa, Mycobacterium
GLDAADPPI

SEQ ID NO: 489093 - protein, 7 aa, Mycobacterium
GLDADRA

SEQ ID NO: 489094 - protein, 11 aa, Mycobacterium
GLDAGPAALTE

SEQ ID NO: 489095 - protein, 6 aa, Mycobacterium
GLDAQA

SEQ ID NO: 489096 - protein, 7 aa, Mycobacterium
GLDAQTQ

SEQ ID NO: 489097 - protein, 5 aa, Mycobacterium
GLDAT

SEQ ID NO: 489098 - protein, 7 aa, Mycobacterium
GLDATDP

SEQ ID NO: 489099 - protein, 8 aa, Mycobacterium
GLDATDPH

SEQ ID NO: 489100 - protein, 7 aa, Mycobacterium
GLDATNP

SEQ ID NO: 489101 - protein, 4 aa, Mycobacterium
GLDD

SEQ ID NO: 489102 - protein, 11 aa, Mycobacterium
GLDDDEKAAAV

SEQ ID NO: 489103 - protein, 7 aa, Mycobacterium
GLDDDGA

SEQ ID NO: 489104 - protein, 6 aa, Mycobacterium
GLDDEA

SEQ ID NO: 489105 - protein, 7 aa, Mycobacterium
GLDDEGV

SEQ ID NO: 489106 - protein, 12 aa, Mycobacterium
GLDDEPQRNEIP

SEQ ID NO: 489107 - protein, 12 aa, Mycobacterium
GLDDFGDDDTWR

SEQ ID NO: 489108 - protein, 13 aa, Mycobacterium
GLDDGDDPSGYRL

SEQ ID NO: 489109 - protein, 17 aa, Mycobacterium
GLDDGTRFRPDPETYSG

SEQ ID NO: 489110 - protein, 12 aa, Mycobacterium
GLDDPSPAALAS

SEQ ID NO: 489111 - protein, 8 aa, Mycobacterium
GLDDSENV

SEQ ID NO: 489112 - protein, 7 aa, Mycobacterium
GLDDTDL

SEQ ID NO: 489113 - protein, 7 aa, Mycobacterium
GLDEDDV

SEQ ID NO: 489114 - protein, 6 aa, Mycobacterium
GLDEDT

SEQ ID NO: 489115 - protein, 7 aa, Mycobacterium
GLDEEDV

SEQ ID NO: 489116 - protein, 10 aa, Mycobacterium
GLDEKSTLGP

SEQ ID NO: 489117 - protein, 7 aa, Mycobacterium
GLDEQQA

SEQ ID NO: 489118 - protein, 5 aa, Mycobacterium
GLDES

SEQ ID NO: 489119 - protein, 13 aa, Mycobacterium
GLDGAAASDDMNR

SEQ ID NO: 489120 - protein, 12 aa, Mycobacterium
GLDGAAASEDMR

SEQ ID NO: 489121 - protein, 12 aa, Mycobacterium
GLDGAPATDDMN

SEQ ID NO: 489122 - protein, 7 aa, Mycobacterium
GLDGDEA

SEQ ID NO: 489123 - protein, 7 aa, Mycobacterium
GLDGDEP

SEQ ID NO: 489124 - protein, 8 aa, Mycobacterium
GLDGDKET

SEQ ID NO: 489125 - protein, 20 aa, Mycobacterium
GLDGGAASAEEAAMHVIEDE

SEQ ID NO: 489126 - protein, 13 aa, Mycobacterium
GLDGGEDDVIVLR

SEQ ID NO: 489127 - protein, 9 aa, Mycobacterium
GLDGPPDGI

SEQ ID NO: 489128 - protein, 8 aa, Mycobacterium
GLDGQSAD

SEQ ID NO: 489129 - protein, 5 aa, Mycobacterium
GLDGR

SEQ ID NO: 489130 - protein, 6 aa, Mycobacterium
GLDGSA

SEQ ID NO: 489131 - protein, 9 aa, Mycobacterium
GLDGTPPAV

SEQ ID NO: 489132 - protein, 7 aa, Mycobacterium
GLDHGAS

SEQ ID NO: 489133 - protein, 21 aa, Mycobacterium
GLDKGEAGRIGPNPDTFDYVP

SEQ ID NO: 489134 - protein, 8 aa, Mycobacterium
GLDKPSLG

SEQ ID NO: 489135 - protein, 11 aa, Mycobacterium
GLDPAQPSAAR

SEQ ID NO: 489136 - protein, 8 aa, Mycobacterium
GLDPAQRS

SEQ ID NO: 489137 - protein, 11 aa, Mycobacterium
GLDPASETGPL

SEQ ID NO: 489138 - protein, 6 aa, Mycobacterium
GLDPAT

SEQ ID NO: 489139 - protein, 10 aa, Mycobacterium
GLDPATAALT

SEQ ID NO: 489140 - protein, 5 aa, Mycobacterium
GLDPD

SEQ ID NO: 489141 - protein, 9 aa, Mycobacterium
GLDPDRGEF

SEQ ID NO: 489142 - protein, 5 aa, Mycobacterium
GLDPE

SEQ ID NO: 489143 - protein, 6 aa, Mycobacterium
GLDPEN

SEQ ID NO: 489144 - protein, 14 aa, Mycobacterium
GLDPERGLTAAEAD

SEQ ID NO: 489145 - protein, 22 aa, Mycobacterium
GLDPFDPANGFGTAEEGGSQYS

SEQ ID NO: 489146 - protein, 11 aa, Mycobacterium
GLDPGADGQDL

SEQ ID NO: 489147 - protein, 6 aa, Mycobacterium
GLDPHP

SEQ ID NO: 489148 - protein, 7 aa, Mycobacterium
GLDPNEV

SEQ ID NO: 489149 - protein, 7 aa, Mycobacterium
GLDPPDR

SEQ ID NO: 489150 - protein, 6 aa, Mycobacterium
GLDPRH

SEQ ID NO: 489151 - protein, 10 aa, Mycobacterium
GLDPSSTLGP

SEQ ID NO: 489152 - protein, 17 aa, Mycobacterium
GLDPTDEDDDADAGAKI

SEQ ID NO: 489153 - protein, 9 aa, Mycobacterium
GLDPTDPAQ

SEQ ID NO: 489154 - protein, 9 aa, Mycobacterium
GLDPTGPAR

SEQ ID NO: 489155 - protein, 12 aa, Mycobacterium
GLDPTPVVSQDV

SEQ ID NO: 489156 - protein, 6 aa, Mycobacterium
GLDQPV

SEQ ID NO: 489157 - protein, 11 aa, Mycobacterium
GLDRAGGRVSA

SEQ ID NO: 489158 - protein, 20 aa, Mycobacterium
GLDRDERKLQRSDERASAAI

SEQ ID NO: 489159 - protein, 6 aa, Mycobacterium
GLDRRS

SEQ ID NO: 489160 - protein, 7 aa, Mycobacterium
GLDRRSR

SEQ ID NO: 489161 - protein, 9 aa, Mycobacterium
GLDRTAEAW

SEQ ID NO: 489162 - protein, 4 aa, Mycobacterium
GLDS

SEQ ID NO: 489163 - protein, 9 aa, Mycobacterium
GLDSAAPTA

SEQ ID NO: 489164 - protein, 12 aa, Mycobacterium
GLDSGPVSLRSG

SEQ ID NO: 489165 - protein, 18 aa, Mycobacterium
GLDSPSGPAATSEGTSAD

SEQ ID NO: 489166 - protein, 8 aa, Mycobacterium
GLDTDDPR

SEQ ID NO: 489167 - protein, 6 aa, Mycobacterium
GLDTRG

SEQ ID NO: 489168 - protein, 9 aa, Mycobacterium
GLDTSGPAA

SEQ ID NO: 489169 - protein, 9 aa, Mycobacterium
GLDTSTPDG

SEQ ID NO: 489170 - protein, 4 aa, Mycobacterium
GLEA

SEQ ID NO: 489171 - protein, 9 aa, Mycobacterium
GLEAARGRT

SEQ ID NO: 489172 - protein, 7 aa, Mycobacterium
GLEAGAD

SEQ ID NO: 489173 - protein, 9 aa, Mycobacterium
GLEAGADDY

SEQ ID NO: 489174 - protein, 10 aa, Mycobacterium
GLEAGPDGRD

SEQ ID NO: 489175 - protein, 6 aa, Mycobacterium
GLEAQR

SEQ ID NO: 489176 - protein, 7 aa, Mycobacterium
GLEDDPE

SEQ ID NO: 489177 - protein, 6 aa, Mycobacterium
GLEDRD

SEQ ID NO: 489178 - protein, 5 aa, Mycobacterium
GLEDS

SEQ ID NO: 489179 - protein, 6 aa, Mycobacterium
GLEEEG

SEQ ID NO: 489180 - protein, 17 aa, Mycobacterium
GLEEPGRQEKAPVTPPA

SEQ ID NO: 489181 - protein, 8 aa, Mycobacterium
GLEEPQAR

SEQ ID NO: 489182 - protein, 5 aa, Mycobacterium
GLEER

SEQ ID NO: 489183 - protein, 5 aa, Mycobacterium
GLEET

SEQ ID NO: 489184 - protein, 6 aa, Mycobacterium
GLEETR

SEQ ID NO: 489185 - protein, 9 aa, Mycobacterium
GLEGDAEGH

SEQ ID NO: 489186 - protein, 6 aa, Mycobacterium
GLEGHR

SEQ ID NO: 489187 - protein, 6 aa, Mycobacterium
GLEGSE

SEQ ID NO: 489188 - protein, 12 aa, Mycobacterium
GLEGSPLREAAS

SEQ ID NO: 489189 - protein, 6 aa, Mycobacterium
GLEGTA

SEQ ID NO: 489190 - protein, 16 aa, Mycobacterium
GLEGTAGGSAYNASKG

SEQ ID NO: 489191 - protein, 8 aa, Mycobacterium
GLEHGAPA

SEQ ID NO: 489192 - protein, 7 aa, Mycobacterium
GLEHGAS

SEQ ID NO: 489193 - protein, 10 aa, Mycobacterium
GLEKTSPPLR

SEQ ID NO: 489194 - protein, 5 aa, Mycobacterium
GLENR

SEQ ID NO: 489195 - protein, 5 aa, Mycobacterium
GLEPA

SEQ ID NO: 489196 - protein, 6 aa, Mycobacterium
GLEPAD

SEQ ID NO: 489197 - protein, 10 aa, Mycobacterium
GLEPARALPG

SEQ ID NO: 489198 - protein, 5 aa, Mycobacterium
GLEPD

SEQ ID NO: 489199 - protein, 6 aa, Mycobacterium
GLEPDK

SEQ ID NO: 489200 - protein, 6 aa, Mycobacterium
GLEPDR

SEQ ID NO: 489201 - protein, 5 aa, Mycobacterium
GLEPN

SEQ ID NO: 489202 - protein, 11 aa, Mycobacterium
GLEPPEPYAGN

SEQ ID NO: 489203 - protein, 8 aa, Mycobacterium
GLEPPYGK

SEQ ID NO: 489204 - protein, 7 aa, Mycobacterium
GLEPTAV

SEQ ID NO: 489205 - protein, 5 aa, Mycobacterium
GLERP

SEQ ID NO: 489206 - protein, 5 aa, Mycobacterium
GLERR

SEQ ID NO: 489207 - protein, 6 aa, Mycobacterium
GLERST

SEQ ID NO: 489208 - protein, 17 aa, Mycobacterium
GLERTRERRPDLLPPDA

SEQ ID NO: 489209 - protein, 8 aa, Mycobacterium
GLESGRRA

SEQ ID NO: 489210 - protein, 9 aa, Mycobacterium
GLESPANVS

SEQ ID NO: 489211 - protein, 7 aa, Mycobacterium
GLETEED

SEQ ID NO: 489212 - protein, 5 aa, Mycobacterium
GLETR

SEQ ID NO: 489213 - protein, 4 aa, Mycobacterium
GLEW

SEQ ID NO: 489214 - protein, 5 aa, Mycobacterium
GLGAA

SEQ ID NO: 489215 - protein, 9 aa, Mycobacterium
GLGADDARE

SEQ ID NO: 489216 - protein, 12 aa, Mycobacterium
GLGADDESALAQ

SEQ ID NO: 489217 - protein, 5 aa, Mycobacterium
GLGAP

SEQ ID NO: 489218 - protein, 10 aa, Mycobacterium
GLGAPAGATR

SEQ ID NO: 489219 - protein, 7 aa, Mycobacterium
GLGAPEG

SEQ ID NO: 489220 - protein, 12 aa, Mycobacterium
GLGAQPTADRRP

SEQ ID NO: 489221 - protein, 9 aa, Mycobacterium
GLGASAEQL

SEQ ID NO: 489222 - protein, 12 aa, Mycobacterium
GLGATGAPTGRG

SEQ ID NO: 489223 - protein, 9 aa, Mycobacterium
GLGATPSTH

SEQ ID NO: 489224 - protein, 4 aa, Mycobacterium
GLGD

SEQ ID NO: 489225 - protein, 9 aa, Mycobacterium
GLGDDEKRV

SEQ ID NO: 489226 - protein, 15 aa, Mycobacterium
GLGDDTAADTDIATA

SEQ ID NO: 489227 - protein, 6 aa, Mycobacterium
GLGDER

SEQ ID NO: 489228 - protein, 13 aa, Mycobacterium
GLGDGDGADWRGP

SEQ ID NO: 489229 - protein, 9 aa, Mycobacterium
GLGDGPRDG

SEQ ID NO: 489230 - protein, 7 aa, Mycobacterium
GLGDGTH

SEQ ID NO: 489231 - protein, 11 aa, Mycobacterium
GLGDQTADRHR

SEQ ID NO: 489232 - protein, 10 aa, Mycobacterium
GLGDRGRIAA

SEQ ID NO: 489233 - protein, 11 aa, Mycobacterium
GLGEAAPAPRI

SEQ ID NO: 489234 - protein, 10 aa, Mycobacterium
GLGEASRLDP

SEQ ID NO: 489235 - protein, 9 aa, Mycobacterium
GLGEESGFG

SEQ ID NO: 489236 - protein, 18 aa, Mycobacterium
GLGEGASASLGQGGSLGT

SEQ ID NO: 489237 - protein, 6 aa, Mycobacterium
GLGEGP

SEQ ID NO: 489238 - protein, 9 aa, Mycobacterium
GLGEGPLED

SEQ ID NO: 489239 - protein, 5 aa, Mycobacterium
GLGEH

SEQ ID NO: 489240 - protein, 6 aa, Mycobacterium
GLGEHR

SEQ ID NO: 489241 - protein, 9 aa, Mycobacterium
GLGEIAGSA

SEQ ID NO: 489242 - protein, 5 aa, Mycobacterium
GLGEN

SEQ ID NO: 489243 - protein, 13 aa, Mycobacterium
GLGEPPPARLDPR

SEQ ID NO: 489244 - protein, 6 aa, Mycobacterium
GLGEQE

SEQ ID NO: 489245 - protein, 9 aa, Mycobacterium
GLGEQSGFG

SEQ ID NO: 489246 - protein, 10 aa, Mycobacterium
GLGEQSGFGR

SEQ ID NO: 489247 - protein, 7 aa, Mycobacterium
GLGESDN

SEQ ID NO: 489248 - protein, 9 aa, Mycobacterium
GLGETRQTV

SEQ ID NO: 489249 - protein, 12 aa, Mycobacterium
GLGGAAGNPLDS

SEQ ID NO: 489250 - protein, 9 aa, Mycobacterium
GLGGADPAQ

SEQ ID NO: 489251 - protein, 10 aa, Mycobacterium
GLGGADRKIE

SEQ ID NO: 489252 - protein, 16 aa, Mycobacterium
GLGGADRKIEQALKPG

SEQ ID NO: 489253 - protein, 25 aa, Mycobacterium
GLGGAGGAGVNGDGGGGGSGGAGGL

SEQ ID NO: 489254 - protein, 8 aa, Mycobacterium
GLGGAGLG

SEQ ID NO: 489255 - protein, 10 aa, Mycobacterium
GLGGAQRKIE

SEQ ID NO: 489256 - protein, 7 aa, Mycobacterium
GLGGEGG

SEQ ID NO: 489257 - protein, 8 aa, Mycobacterium
GLGGEPKV

SEQ ID NO: 489258 - protein, 7 aa, Mycobacterium
GLGGEPV

SEQ ID NO: 489259 - protein, 11 aa, Mycobacterium
GLGGETPVADM

SEQ ID NO: 489260 - protein, 13 aa, Mycobacterium
GLGGETYRSDPLD

SEQ ID NO: 489261 - protein, 9 aa, Mycobacterium
GLGGGASAS

SEQ ID NO: 489262 - protein, 21 aa, Mycobacterium
GLGGGDRGRIVPGREGPTSEA

SEQ ID NO: 489263 - protein, 7 aa, Mycobacterium
GLGGGER

SEQ ID NO: 489264 - protein, 8 aa, Mycobacterium
GLGGGTDA

SEQ ID NO: 489265 - protein, 6 aa, Mycobacterium
GLGGKD

SEQ ID NO: 489266 - protein, 15 aa, Mycobacterium
GLGGKGGSGGLGPHA

SEQ ID NO: 489267 - protein, 5 aa, Mycobacterium
GLGGP

SEQ ID NO: 489268 - protein, 11 aa, Mycobacterium
GLGGPGSEHEA

SEQ ID NO: 489269 - protein, 9 aa, Mycobacterium
GLGGQAQAS

SEQ ID NO: 489270 - protein, 37 aa, Mycobacterium
GLGGQGGDGGDATGSTNAAGTGGTAGSAGNGGDGGHS

SEQ ID NO: 489271 - protein, 16 aa, Mycobacterium
GLGGQNRKIEQALKPG

SEQ ID NO: 489272 - protein, 14 aa, Mycobacterium
GLGGQTPVADMTDD

SEQ ID NO: 489273 - protein, 9 aa, Mycobacterium
GLGGRAGYY

SEQ ID NO: 489274 - protein, 16 aa, Mycobacterium
GLGGSDRKIEQALKPG

SEQ ID NO: 489275 - protein, 17 aa, Mycobacterium
GLGGSGGVGGTGGAGGI

SEQ ID NO: 489276 - protein, 6 aa, Mycobacterium
GLGGSP

SEQ ID NO: 489277 - protein, 9 aa, Mycobacterium
GLGGTFGGN

SEQ ID NO: 489278 - protein, 24 aa, Mycobacterium
GLGGTGGASGMDTGGDGGAGGAGG

SEQ ID NO: 489279 - protein, 6 aa, Mycobacterium
GLGGTN

SEQ ID NO: 489280 - protein, 10 aa, Mycobacterium
GLGGTYGGNP

SEQ ID NO: 489281 - protein, 12 aa, Mycobacterium
GLGGTYGGNPVT

SEQ ID NO: 489282 - protein, 4 aa, Mycobacterium
GLGH

SEQ ID NO: 489283 - protein, 9 aa, Mycobacterium
GLGHTPKSV

SEQ ID NO: 489284 - protein, 20 aa, Mycobacterium
GLGIDPARTAIAGDSAGGNL

SEQ ID NO: 489285 - protein, 15 aa, Mycobacterium
GLGIPGPGPDGSPRY

SEQ ID NO: 489286 - protein, 8 aa, Mycobacterium
GLGKPFKD

SEQ ID NO: 489287 - protein, 22 aa, Mycobacterium
GLGLPDESYYREEQHAATRDAY

SEQ ID NO: 489288 - protein, 8 aa, Mycobacterium
GLGNAGSE

SEQ ID NO: 489289 - protein, 6 aa, Mycobacterium
GLGNRK

SEQ ID NO: 489290 - protein, 12 aa, Mycobacterium
GLGNSGDSNTGL

SEQ ID NO: 489291 - protein, 7 aa, Mycobacterium
GLGNVGS

SEQ ID NO: 489292 - protein, 4 aa, Mycobacterium
GLGP

SEQ ID NO: 489293 - protein, 7 aa, Mycobacterium
GLGPAER

SEQ ID NO: 489294 - protein, 6 aa, Mycobacterium
GLGPAG

SEQ ID NO: 489295 - protein, 10 aa, Mycobacterium
GLGPAQGGVP

SEQ ID NO: 489296 - protein, 8 aa, Mycobacterium
GLGPDAGA

SEQ ID NO: 489297 - protein, 12 aa, Mycobacterium
GLGPDAPEQPKA

SEQ ID NO: 489298 - protein, 19 aa, Mycobacterium
GLGPDGPAPAEPAGAPTVS

SEQ ID NO: 489299 - protein, 6 aa, Mycobacterium
GLGPDQ

SEQ ID NO: 489300 - protein, 7 aa, Mycobacterium
GLGPDRN

SEQ ID NO: 489301 - protein, 25 aa, Mycobacterium
GLGPGDVQTQRTELGKTVEGMKDGS

SEQ ID NO: 489302 - protein, 34 aa, Mycobacterium
GLGPGGPGAPTTVTVTDSTSYQRQTPSDAQAITN

SEQ ID NO: 489303 - protein, 12 aa, Mycobacterium
GLGPGPGAERPR

SEQ ID NO: 489304 - protein, 10 aa, Mycobacterium
GLGPGPGRDR

SEQ ID NO: 489305 - protein, 10 aa, Mycobacterium
GLGPGPGRER

SEQ ID NO: 489306 - protein, 10 aa, Mycobacterium
GLGPPDGDPV

SEQ ID NO: 489307 - protein, 5 aa, Mycobacterium
GLGPQ

SEQ ID NO: 489308 - protein, 16 aa, Mycobacterium
GLGPRERAKIMRNREA

SEQ ID NO: 489309 - protein, 10 aa, Mycobacterium
GLGPRGERRE

SEQ ID NO: 489310 - protein, 7 aa, Mycobacterium
GLGPSAR

SEQ ID NO: 489311 - protein, 17 aa, Mycobacterium
GLGPSASLPGDPGDDRG

SEQ ID NO: 489312 - protein, 11 aa, Mycobacterium
GLGPSPGPDRL

SEQ ID NO: 489313 - protein, 9 aa, Mycobacterium
GLGPSQGAE

SEQ ID NO: 489314 - protein, 8 aa, Mycobacterium
GLGPTADD

SEQ ID NO: 489315 - protein, 7 aa, Mycobacterium
GLGPTGQ

SEQ ID NO: 489316 - protein, 6 aa, Mycobacterium
GLGPVA

SEQ ID NO: 489317 - protein, 6 aa, Mycobacterium
GLGPVG

SEQ ID NO: 489318 - protein, 7 aa, Mycobacterium
GLGQDDV

SEQ ID NO: 489319 - protein, 28 aa, Mycobacterium
GLGQQGAHRAVSQPAAGQVGRGQRTRRT

SEQ ID NO: 489320 - protein, 7 aa, Mycobacterium
GLGQQSS

SEQ ID NO: 489321 - protein, 10 aa, Mycobacterium
GLGREGGGIG

SEQ ID NO: 489322 - protein, 7 aa, Mycobacterium
GLGRKGY

SEQ ID NO: 489323 - protein, 45 aa, Mycobacterium
GLGRKSATRKSKAARGKAGKKGKKGARGPTPPKVKSPFGTPGMPG

SEQ ID NO: 489324 - protein, 5 aa, Mycobacterium
GLGRP

SEQ ID NO: 489325 - protein, 7 aa, Mycobacterium
GLGRPQR

SEQ ID NO: 489326 - protein, 7 aa, Mycobacterium
GLGRRRS

SEQ ID NO: 489327 - protein, 12 aa, Mycobacterium
GLGRSGDSLPTR

SEQ ID NO: 489328 - protein, 7 aa, Mycobacterium
GLGRSTT

SEQ ID NO: 489329 - protein, 5 aa, Mycobacterium
GLGSA

SEQ ID NO: 489330 - protein, 7 aa, Mycobacterium
GLGSAEK

SEQ ID NO: 489331 - protein, 5 aa, Mycobacterium
GLGSD

SEQ ID NO: 489332 - protein, 16 aa, Mycobacterium
GLGSDAAGFGADGGGV

SEQ ID NO: 489333 - protein, 9 aa, Mycobacterium
GLGSDDRDR

SEQ ID NO: 489334 - protein, 8 aa, Mycobacterium
GLGSDPRD

SEQ ID NO: 489335 - protein, 10 aa, Mycobacterium
GLGSGAPTVV

SEQ ID NO: 489336 - protein, 8 aa, Mycobacterium
GLGSGEKI

SEQ ID NO: 489337 - protein, 17 aa, Mycobacterium
GLGSGPNLAGSAGLGGA

SEQ ID NO: 489338 - protein, 7 aa, Mycobacterium
GLGSQEK

SEQ ID NO: 489339 - protein, 6 aa, Mycobacterium
GLGSQT

SEQ ID NO: 489340 - protein, 9 aa, Mycobacterium
GLGSRAANL

SEQ ID NO: 489341 - protein, 6 aa, Mycobacterium
GLGSSA

SEQ ID NO: 489342 - protein, 6 aa, Mycobacterium
GLGSSR

SEQ ID NO: 489343 - protein, 8 aa, Mycobacterium
GLGSSRPV

SEQ ID NO: 489344 - protein, 11 aa, Mycobacterium
GLGSTARERNV

SEQ ID NO: 489345 - protein, 7 aa, Mycobacterium
GLGSTSA

SEQ ID NO: 489346 - protein, 8 aa, Mycobacterium
GLGSYGTQ

SEQ ID NO: 489347 - protein, 7 aa, Mycobacterium
GLGTADE

SEQ ID NO: 489348 - protein, 8 aa, Mycobacterium
GLGTADEI

SEQ ID NO: 489349 - protein, 6 aa, Mycobacterium
GLGTAG

SEQ ID NO: 489350 - protein, 6 aa, Mycobacterium
GLGTAV

SEQ ID NO: 489351 - protein, 9 aa, Mycobacterium
GLGTDDTAK

SEQ ID NO: 489352 - protein, 9 aa, Mycobacterium
GLGTDEPGA

SEQ ID NO: 489353 - protein, 7 aa, Mycobacterium
GLGTDEV

SEQ ID NO: 489354 - protein, 11 aa, Mycobacterium
GLGTDTGGSIR

SEQ ID NO: 489355 - protein, 5 aa, Mycobacterium
GLGTG

SEQ ID NO: 489356 - protein, 8 aa, Mycobacterium
GLGTGPGD

SEQ ID NO: 489357 - protein, 8 aa, Mycobacterium
GLGTPDDL

SEQ ID NO: 489358 - protein, 6 aa, Mycobacterium
GLGTRA

SEQ ID NO: 489359 - protein, 11 aa, Mycobacterium
GLGTSARERNL

SEQ ID NO: 489360 - protein, 10 aa, Mycobacterium
GLGTSDEEAA

SEQ ID NO: 489361 - protein, 10 aa, Mycobacterium
GLGVDGRGRI

SEQ ID NO: 489362 - protein, 11 aa, Mycobacterium
GLHGGIGSSVS

SEQ ID NO: 489363 - protein, 11 aa, Mycobacterium
GLHPPSTATTV

SEQ ID NO: 489364 - protein, 5 aa, Mycobacterium
GLHPS

SEQ ID NO: 489365 - protein, 10 aa, Mycobacterium
GLHPSGKGSE

SEQ ID NO: 489366 - protein, 7 aa, Mycobacterium
GLHRERE

SEQ ID NO: 489367 - protein, 4 aa, Mycobacterium
GLHS

SEQ ID NO: 489368 - protein, 8 aa, Mycobacterium
GLHSNGYS

SEQ ID NO: 489369 - protein, 16 aa, Mycobacterium
GLHTRGGSVEADNAVA

SEQ ID NO: 489370 - protein, 28 aa, Mycobacterium
GLIGGGGSGGAGGNGSNGGNGGNGGNAQ

SEQ ID NO: 489371 - protein, 9 aa, Mycobacterium
GLKAEAAAL

SEQ ID NO: 489372 - protein, 7 aa, Mycobacterium
GLKAGQK

SEQ ID NO: 489373 - protein, 15 aa, Mycobacterium
GLKARSEQFSRADGS

SEQ ID NO: 489374 - protein, 16 aa, Mycobacterium
GLKARSEQLSRADGAH

SEQ ID NO: 489375 - protein, 7 aa, Mycobacterium
GLKDEPA

SEQ ID NO: 489376 - protein, 10 aa, Mycobacterium
GLKDPGAGDT

SEQ ID NO: 489377 - protein, 8 aa, Mycobacterium
GLKEGGSA

SEQ ID NO: 489378 - protein, 5 aa, Mycobacterium
GLKGH

SEQ ID NO: 489379 - protein, 13 aa, Mycobacterium
GLKGPDRDAGAYD

SEQ ID NO: 489380 - protein, 5 aa, Mycobacterium
GLKGQ

SEQ ID NO: 489381 - protein, 5 aa, Mycobacterium
GLKGR

SEQ ID NO: 489382 - protein, 11 aa, Mycobacterium
GLKGTPGNGAY

SEQ ID NO: 489383 - protein, 13 aa, Mycobacterium
GLKKARKAPQYSK

SEQ ID NO: 489384 - protein, 4 aa, Mycobacterium
GLKP

SEQ ID NO: 489385 - protein, 7 aa, Mycobacterium
GLKPADI

SEQ ID NO: 489386 - protein, 16 aa, Mycobacterium
GLKPATASAGGDDDSW

SEQ ID NO: 489387 - protein, 16 aa, Mycobacterium
GLKPATVSAGGDDDSW

SEQ ID NO: 489388 - protein, 7 aa, Mycobacterium
GLKPDEI

SEQ ID NO: 489389 - protein, 9 aa, Mycobacterium
GLKPGKSAI

SEQ ID NO: 489390 - protein, 7 aa, Mycobacterium
GLKPGQR

SEQ ID NO: 489391 - protein, 7 aa, Mycobacterium
GLKPTDI

SEQ ID NO: 489392 - protein, 8 aa, Mycobacterium
GLKPVTDA

SEQ ID NO: 489393 - protein, 5 aa, Mycobacterium
GLKQG

SEQ ID NO: 489394 - protein, 16 aa, Mycobacterium
GLKSRAEQLGRARGAH

SEQ ID NO: 489395 - protein, 6 aa, Mycobacterium
GLKTTA

SEQ ID NO: 489396 - protein, 5 aa, Mycobacterium
GLLEG

SEQ ID NO: 489397 - protein, 6 aa, Mycobacterium
GLLGPT

SEQ ID NO: 489398 - protein, 4 aa, Mycobacterium
GLLP

SEQ ID NO: 489399 - protein, 5 aa, Mycobacterium
GLLPG

SEQ ID NO: 489400 - protein, 7 aa, Mycobacterium
GLLPGNG

SEQ ID NO: 489401 - protein, 5 aa, Mycobacterium
GLLPQ

SEQ ID NO: 489402 - protein, 14 aa, Mycobacterium
GLNAAGGAERGSEA

SEQ ID NO: 489403 - protein, 16 aa, Mycobacterium
GLNAGKPITSSTLTEE

SEQ ID NO: 489404 - protein, 12 aa, Mycobacterium
GLNDDVEAEANA

SEQ ID NO: 489405 - protein, 5 aa, Mycobacterium
GLNDT

SEQ ID NO: 489406 - protein, 7 aa, Mycobacterium
GLNDTKI

SEQ ID NO: 489407 - protein, 10 aa, Mycobacterium
GLNEGAEVPE

SEQ ID NO: 489408 - protein, 9 aa, Mycobacterium
GLNGGDDPA

SEQ ID NO: 489409 - protein, 4 aa, Mycobacterium
GLNP

SEQ ID NO: 489410 - protein, 5 aa, Mycobacterium
GLNPA

SEQ ID NO: 489411 - protein, 7 aa, Mycobacterium
GLNPESV

SEQ ID NO: 489412 - protein, 9 aa, Mycobacterium
GLNPSNDGS

SEQ ID NO: 489413 - protein, 8 aa, Mycobacterium
GLNPTAAS

SEQ ID NO: 489414 - protein, 10 aa, Mycobacterium
GLNPTGSFKD

SEQ ID NO: 489415 - protein, 7 aa, Mycobacterium
GLNRNGV

SEQ ID NO: 489416 - protein, 13 aa, Mycobacterium
GLNSASGPRALPA

SEQ ID NO: 489417 - protein, 6 aa, Mycobacterium
GLNSDD

SEQ ID NO: 489418 - protein, 19 aa, Mycobacterium
GLNSGAGNVGFGNSGSGNV

SEQ ID NO: 489419 - protein, 18 aa, Mycobacterium
GLNSGNNNIGFGNSGDNN

SEQ ID NO: 489420 - protein, 8 aa, Mycobacterium
GLNSGSGN

SEQ ID NO: 489421 - protein, 9 aa, Mycobacterium
GLNSGSGNI

SEQ ID NO: 489422 - protein, 19 aa, Mycobacterium
GLNSGSGNIGFGNSGSNNV

SEQ ID NO: 489423 - protein, 10 aa, Mycobacterium
GLNSGTGNAG

SEQ ID NO: 489424 - protein, 10 aa, Mycobacterium
GLNSGTGNTG

SEQ ID NO: 489425 - protein, 13 aa, Mycobacterium
GLNSPAPEPVAAS

SEQ ID NO: 489426 - protein, 8 aa, Mycobacterium
GLNSVGPQ

SEQ ID NO: 489427 - protein, 4 aa, Mycobacterium
GLNT

SEQ ID NO: 489428 - protein, 6 aa, Mycobacterium
GLNTGI

SEQ ID NO: 489429 - protein, 8 aa, Mycobacterium
GLPAAGAD

SEQ ID NO: 489430 - protein, 10 aa, Mycobacterium
GLPAAGHRRV

SEQ ID NO: 489431 - protein, 15 aa, Mycobacterium
GLPAATLSARERERA

SEQ ID NO: 489432 - protein, 5 aa, Mycobacterium
GLPAD

SEQ ID NO: 489433 - protein, 7 aa, Mycobacterium
GLPADAK

SEQ ID NO: 489434 - protein, 20 aa, Mycobacterium
GLPADAQTDEYLPGEARPDT

SEQ ID NO: 489435 - protein, 8 aa, Mycobacterium
GLPADGTR

SEQ ID NO: 489436 - protein, 6 aa, Mycobacterium
GLPADL

SEQ ID NO: 489437 - protein, 9 aa, Mycobacterium
GLPADSDDA

SEQ ID NO: 489438 - protein, 6 aa, Mycobacterium
GLPADT

SEQ ID NO: 489439 - protein, 9 aa, Mycobacterium
GLPADTRAL

SEQ ID NO: 489440 - protein, 6 aa, Mycobacterium
GLPADV

SEQ ID NO: 489441 - protein, 10 aa, Mycobacterium
GLPAEDPGPL

SEQ ID NO: 489442 - protein, 18 aa, Mycobacterium
GLPAEPKKLGSLAPQANA

SEQ ID NO: 489443 - protein, 6 aa, Mycobacterium
GLPAET

SEQ ID NO: 489444 - protein, 5 aa, Mycobacterium
GLPAG

SEQ ID NO: 489445 - protein, 8 aa, Mycobacterium
GLPAGAPA

SEQ ID NO: 489446 - protein, 17 aa, Mycobacterium
GLPAGTAELGDLSEDER

SEQ ID NO: 489447 - protein, 9 aa, Mycobacterium
GLPAGTQFG

SEQ ID NO: 489448 - protein, 9 aa, Mycobacterium
GLPAHPRAQ

SEQ ID NO: 489449 - protein, 7 aa, Mycobacterium
GLPAKGS

SEQ ID NO: 489450 - protein, 11 aa, Mycobacterium
GLPAPALDGDR

SEQ ID NO: 489451 - protein, 6 aa, Mycobacterium
GLPAPG

SEQ ID NO: 489452 - protein, 14 aa, Mycobacterium
GLPAPKGNPPKDVT

SEQ ID NO: 489453 - protein, 7 aa, Mycobacterium
GLPAPKY

SEQ ID NO: 489454 - protein, 14 aa, Mycobacterium
GLPAPKYGTATTFD

SEQ ID NO: 489455 - protein, 31 aa, Mycobacterium
GLPAPPEEQVDTVTASPALSQVTDAGDTIES

SEQ ID NO: 489456 - protein, 7 aa, Mycobacterium
GLPAPSI

SEQ ID NO: 489457 - protein, 14 aa, Mycobacterium
GLPAPTDPVTAAPA

SEQ ID NO: 489458 - protein, 8 aa, Mycobacterium
GLPAPTGR

SEQ ID NO: 489459 - protein, 8 aa, Mycobacterium
GLPAQNDV

SEQ ID NO: 489460 - protein, 7 aa, Mycobacterium
GLPARAT

SEQ ID NO: 489461 - protein, 11 aa, Mycobacterium
GLPARKPGTAV

SEQ ID NO: 489462 - protein, 6 aa, Mycobacterium
GLPARS

SEQ ID NO: 489463 - protein, 12 aa, Mycobacterium
GLPASERKQRAE

SEQ ID NO: 489464 - protein, 13 aa, Mycobacterium
GLPASGQTTGQLG

SEQ ID NO: 489465 - protein, 9 aa, Mycobacterium
GLPASTPIT

SEQ ID NO: 489466 - protein, 13 aa, Mycobacterium
GLPATAVKPSYGM

SEQ ID NO: 489467 - protein, 9 aa, Mycobacterium
GLPATGEIP

SEQ ID NO: 489468 - protein, 8 aa, Mycobacterium
GLPATSAQ

SEQ ID NO: 489469 - protein, 6 aa, Mycobacterium
GLPATT

SEQ ID NO: 489470 - protein, 4 aa, Mycobacterium
GLPD

SEQ ID NO: 489471 - protein, 5 aa, Mycobacterium
GLPDA

SEQ ID NO: 489472 - protein, 7 aa, Mycobacterium
GLPDAAA

SEQ ID NO: 489473 - protein, 7 aa, Mycobacterium
GLPDAEA

SEQ ID NO: 489474 - protein, 7 aa, Mycobacterium
GLPDDDE

SEQ ID NO: 489475 - protein, 8 aa, Mycobacterium
GLPDDEIK

SEQ ID NO: 489476 - protein, 7 aa, Mycobacterium
GLPDDEQ

SEQ ID NO: 489477 - protein, 12 aa, Mycobacterium
GLPDDRSPDLRG

SEQ ID NO: 489478 - protein, 7 aa, Mycobacterium
GLPDEER

SEQ ID NO: 489479 - protein, 10 aa, Mycobacterium
GLPDEQPAAL

SEQ ID NO: 489480 - protein, 10 aa, Mycobacterium
GLPDGFAPAD

SEQ ID NO: 489481 - protein, 7 aa, Mycobacterium
GLPDGGR

SEQ ID NO: 489482 - protein, 7 aa, Mycobacterium
GLPDGPA

SEQ ID NO: 489483 - protein, 8 aa, Mycobacterium
GLPDKRDA

SEQ ID NO: 489484 - protein, 8 aa, Mycobacterium
GLPDNKVG

SEQ ID NO: 489485 - protein, 7 aa, Mycobacterium
GLPDPAG

SEQ ID NO: 489486 - protein, 10 aa, Mycobacterium
GLPDPDRPHR

SEQ ID NO: 489487 - protein, 7 aa, Mycobacterium
GLPDPFP

SEQ ID NO: 489488 - protein, 12 aa, Mycobacterium
GLPDQPGRSPEK

SEQ ID NO: 489489 - protein, 11 aa, Mycobacterium
GLPDQPGRSTM

SEQ ID NO: 489490 - protein, 7 aa, Mycobacterium
GLPDQPI

SEQ ID NO: 489491 - protein, 7 aa, Mycobacterium
GLPDRPG

SEQ ID NO: 489492 - protein, 10 aa, Mycobacterium
GLPDRSDVKT

SEQ ID NO: 489493 - protein, 12 aa, Mycobacterium
GLPDSATGTPEQ

SEQ ID NO: 489494 - protein, 9 aa, Mycobacterium
GLPDTTGGV

SEQ ID NO: 489495 - protein, 11 aa, Mycobacterium
GLPEAQRPTVR

SEQ ID NO: 489496 - protein, 25 aa, Mycobacterium
GLPEDTGLRPDFPRQPVPSGEGESV

SEQ ID NO: 489497 - protein, 25 aa, Mycobacterium
GLPEDTGPRPDFPRQPVPSGEGESV

SEQ ID NO: 489498 - protein, 15 aa, Mycobacterium
GLPEEDAGFREHGTN

SEQ ID NO: 489499 - protein, 6 aa, Mycobacterium
GLPEEL

SEQ ID NO: 489500 - protein, 8 aa, Mycobacterium
GLPEENGL

SEQ ID NO: 489501 - protein, 10 aa, Mycobacterium
GLPEESQDAM

SEQ ID NO: 489502 - protein, 15 aa, Mycobacterium
GLPEEWSPDSESSRE

SEQ ID NO: 489503 - protein, 14 aa, Mycobacterium
GLPEEWSPESESSR

SEQ ID NO: 489504 - protein, 9 aa, Mycobacterium
GLPEGDTST

SEQ ID NO: 489505 - protein, 11 aa, Mycobacterium
GLPEGDTSTIE

SEQ ID NO: 489506 - protein, 25 aa, Mycobacterium
GLPEGDTSTVENLTAPQQQEPQEVS

SEQ ID NO: 489507 - protein, 15 aa, Mycobacterium
GLPEGGGPPEAKKAA

SEQ ID NO: 489508 - protein, 8 aa, Mycobacterium
GLPEKQRH

SEQ ID NO: 489509 - protein, 5 aa, Mycobacterium
GLPEL

SEQ ID NO: 489510 - protein, 7 aa, Mycobacterium
GLPENTN

SEQ ID NO: 489511 - protein, 5 aa, Mycobacterium
GLPEP

SEQ ID NO: 489512 - protein, 7 aa, Mycobacterium
GLPEPET

SEQ ID NO: 489513 - protein, 12 aa, Mycobacterium
GLPEPGVPLPDE

SEQ ID NO: 489514 - protein, 9 aa, Mycobacterium
GLPERQRQN

SEQ ID NO: 489515 - protein, 11 aa, Mycobacterium
GLPERTARQRR

SEQ ID NO: 489516 - protein, 5 aa, Mycobacterium
GLPES

SEQ ID NO: 489517 - protein, 12 aa, Mycobacterium
GLPESGPATEEI

SEQ ID NO: 489518 - protein, 8 aa, Mycobacterium
GLPESVPG

SEQ ID NO: 489519 - protein, 5 aa, Mycobacterium
GLPET

SEQ ID NO: 489520 - protein, 6 aa, Mycobacterium
GLPEYR

SEQ ID NO: 489521 - protein, 4 aa, Mycobacterium
GLPG

SEQ ID NO: 489522 - protein, 12 aa, Mycobacterium
GLPGAAAAYGTT

SEQ ID NO: 489523 - protein, 9 aa, Mycobacterium
GLPGAEGSL

SEQ ID NO: 489524 - protein, 19 aa, Mycobacterium
GLPGAEGTLKHKEPKPSKL

SEQ ID NO: 489525 - protein, 10 aa, Mycobacterium
GLPGAGPRAY

SEQ ID NO: 489526 - protein, 10 aa, Mycobacterium
GLPGDETTSD

SEQ ID NO: 489527 - protein, 5 aa, Mycobacterium
GLPGE

SEQ ID NO: 489528 - protein, 9 aa, Mycobacterium
GLPGEDVSD

SEQ ID NO: 489529 - protein, 24 aa, Mycobacterium
GLPGGMAPPTGLGAPGLQGSPMPS

SEQ ID NO: 489530 - protein, 59 aa, Mycobacterium
GLPGGNGGAGGAGGAGGLFGNGGNGGTGGGSLDGNGGAGGAGGAAGVLGSGGRGGAGGV

SEQ ID NO: 489531 - protein, 7 aa, Mycobacterium
GLPGGTG

SEQ ID NO: 489532 - protein, 12 aa, Mycobacterium
GLPGGTPPMPYA

SEQ ID NO: 489533 - protein, 7 aa, Mycobacterium
GLPGGTS

SEQ ID NO: 489534 - protein, 10 aa, Mycobacterium
GLPGIGGGAA

SEQ ID NO: 489535 - protein, 24 aa, Mycobacterium
GLPGLGQAAASAVGAAAASPAAAP

SEQ ID NO: 489536 - protein, 7 aa, Mycobacterium
GLPGNKV

SEQ ID NO: 489537 - protein, 6 aa, Mycobacterium
GLPGPF

SEQ ID NO: 489538 - protein, 11 aa, Mycobacterium
GLPGPPIPGEV

SEQ ID NO: 489539 - protein, 9 aa, Mycobacterium
GLPGPRQIP

SEQ ID NO: 489540 - protein, 8 aa, Mycobacterium
GLPGPTGR

SEQ ID NO: 489541 - protein, 12 aa, Mycobacterium
GLPGQASSYGTS

SEQ ID NO: 489542 - protein, 19 aa, Mycobacterium
GLPGQLAGSATAAAAANGW

SEQ ID NO: 489543 - protein, 9 aa, Mycobacterium
GLPGQMSRT

SEQ ID NO: 489544 - protein, 15 aa, Mycobacterium
GLPGQNASVTRNVTQ

SEQ ID NO: 489545 - protein, 15 aa, Mycobacterium
GLPGQRSVKSPADRD

SEQ ID NO: 489546 - protein, 8 aa, Mycobacterium
GLPGQTSQ

SEQ ID NO: 489547 - protein, 22 aa, Mycobacterium
GLPGQWPTGYDDPTQPNTPAWQ

SEQ ID NO: 489548 - protein, 15 aa, Mycobacterium
GLPGSAGSGVAGAPG

SEQ ID NO: 489549 - protein, 11 aa, Mycobacterium
GLPGSWDSEAA

SEQ ID NO: 489550 - protein, 7 aa, Mycobacterium
GLPGTQV

SEQ ID NO: 489551 - protein, 6 aa, Mycobacterium
GLPHEN

SEQ ID NO: 489552 - protein, 4 aa, Mycobacterium
GLPI

SEQ ID NO: 489553 - protein, 17 aa, Mycobacterium
GLPINPNSVSRYSGVSR

SEQ ID NO: 489554 - protein, 5 aa, Mycobacterium
GLPKG

SEQ ID NO: 489555 - protein, 9 aa, Mycobacterium
GLPKGDALA

SEQ ID NO: 489556 - protein, 12 aa, Mycobacterium
GLPKGDPPPPLP

SEQ ID NO: 489557 - protein, 6 aa, Mycobacterium
GLPKGS

SEQ ID NO: 489558 - protein, 8 aa, Mycobacterium
GLPKPGRQ

SEQ ID NO: 489559 - protein, 8 aa, Mycobacterium
GLPKPSDW

SEQ ID NO: 489560 - protein, 13 aa, Mycobacterium
GLPKQTDPWVSTP

SEQ ID NO: 489561 - protein, 5 aa, Mycobacterium
GLPLD

SEQ ID NO: 489562 - protein, 9 aa, Mycobacterium
GLPLGSTDM

SEQ ID NO: 489563 - protein, 5 aa, Mycobacterium
GLPLP

SEQ ID NO: 489564 - protein, 14 aa, Mycobacterium
GLPLPSRAHHGDAG

SEQ ID NO: 489565 - protein, 4 aa, Mycobacterium
GLPN

SEQ ID NO: 489566 - protein, 8 aa, Mycobacterium
GLPNEERA

SEQ ID NO: 489567 - protein, 7 aa, Mycobacterium
GLPPAEP

SEQ ID NO: 489568 - protein, 15 aa, Mycobacterium
GLPPAGVTDLSSRSR

SEQ ID NO: 489569 - protein, 15 aa, Mycobacterium
GLPPAGVTDLSSRTR

SEQ ID NO: 489570 - protein, 15 aa, Mycobacterium
GLPPAGVVDLGSRSR

SEQ ID NO: 489571 - protein, 15 aa, Mycobacterium
GLPPAGVVDLSSRSR

SEQ ID NO: 489572 - protein, 11 aa, Mycobacterium
GLPPAKQPSVR

SEQ ID NO: 489573 - protein, 24 aa, Mycobacterium
GLPPAPQPLSDDQVAQRAATVRGA

SEQ ID NO: 489574 - protein, 15 aa, Mycobacterium
GLPPAPQPLSDEQVA

SEQ ID NO: 489575 - protein, 26 aa, Mycobacterium
GLPPAPQPPSDDEVAARAARVDGATL

SEQ ID NO: 489576 - protein, 7 aa, Mycobacterium
GLPPCQP

SEQ ID NO: 489577 - protein, 12 aa, Mycobacterium
GLPPDSLSGTRT

SEQ ID NO: 489578 - protein, 5 aa, Mycobacterium
GLPPE

SEQ ID NO: 489579 - protein, 6 aa, Mycobacterium
GLPPEE

SEQ ID NO: 489580 - protein, 6 aa, Mycobacterium
GLPPEH

SEQ ID NO: 489581 - protein, 10 aa, Mycobacterium
GLPPEKRPSV

SEQ ID NO: 489582 - protein, 10 aa, Mycobacterium
GLPPEKRPTV

SEQ ID NO: 489583 - protein, 6 aa, Mycobacterium
GLPPEL

SEQ ID NO: 489584 - protein, 7 aa, Mycobacterium
GLPPETV

SEQ ID NO: 489585 - protein, 14 aa, Mycobacterium
GLPPGDESDGPRAA

SEQ ID NO: 489586 - protein, 9 aa, Mycobacterium
GLPPGEAAA

SEQ ID NO: 489587 - protein, 8 aa, Mycobacterium
GLPPGPPV

SEQ ID NO: 489588 - protein, 8 aa, Mycobacterium
GLPPGSLQ

SEQ ID NO: 489589 - protein, 13 aa, Mycobacterium
GLPPGSLQSTVTA

SEQ ID NO: 489590 - protein, 13 aa, Mycobacterium
GLPPGTSAISPAR

SEQ ID NO: 489591 - protein, 13 aa, Mycobacterium
GLPPIAPDSKANY

SEQ ID NO: 489592 - protein, 7 aa, Mycobacterium
GLPPLED

SEQ ID NO: 489593 - protein, 5 aa, Mycobacterium
GLPPN

SEQ ID NO: 489594 - protein, 11 aa, Mycobacterium
GLPPNSALSPR

SEQ ID NO: 489595 - protein, 8 aa, Mycobacterium
GLPPPDAR

SEQ ID NO: 489596 - protein, 8 aa, Mycobacterium
GLPPPRQG

SEQ ID NO: 489597 - protein, 7 aa, Mycobacterium
GLPPQTD

SEQ ID NO: 489598 - protein, 5 aa, Mycobacterium
GLPPR

SEQ ID NO: 489599 - protein, 6 aa, Mycobacterium
GLPPSA

SEQ ID NO: 489600 - protein, 18 aa, Mycobacterium
GLPPSTSAQIADAAGLDE

SEQ ID NO: 489601 - protein, 15 aa, Mycobacterium
GLPPTGVTDLNSRTR

SEQ ID NO: 489602 - protein, 15 aa, Mycobacterium
GLPPTGVTDLSSRSR

SEQ ID NO: 489603 - protein, 14 aa, Mycobacterium
GLPPVGSGLAPGVG

SEQ ID NO: 489604 - protein, 15 aa, Mycobacterium
GLPPVGVTDLGSRHR

SEQ ID NO: 489605 - protein, 6 aa, Mycobacterium
GLPPVS

SEQ ID NO: 489606 - protein, 4 aa, Mycobacterium
GLPQ

SEQ ID NO: 489607 - protein, 8 aa, Mycobacterium
GLPQASSA

SEQ ID NO: 489608 - protein, 13 aa, Mycobacterium
GLPQGDPLPPLPS

SEQ ID NO: 489609 - protein, 13 aa, Mycobacterium
GLPQGDPPPPLPE

SEQ ID NO: 489610 - protein, 41 aa, Mycobacterium
GLPQPDTTHAGETLPPPAPNTPPSPTAPPPPPTEMPPPAMD

SEQ ID NO: 489611 - protein, 6 aa, Mycobacterium
GLPQPT

SEQ ID NO: 489612 - protein, 13 aa, Mycobacterium
GLPQPTEPLLLDA

SEQ ID NO: 489613 - protein, 23 aa, Mycobacterium
GLPQRAPQAHRDPDDRPAHPDEL

SEQ ID NO: 489614 - protein, 8 aa, Mycobacterium
GLPQRQPG

SEQ ID NO: 489615 - protein, 5 aa, Mycobacterium
GLPQS

SEQ ID NO: 489616 - protein, 6 aa, Mycobacterium
GLPQTV

SEQ ID NO: 489617 - protein, 56 aa, Mycobacterium
GLPRAAGDVAAGRRDLRRGRAARRGRRAGRRLRDTSGVVGRGAARDRCGRRAGPDA

SEQ ID NO: 489618 - protein, 7 aa, Mycobacterium
GLPRAQT

SEQ ID NO: 489619 - protein, 5 aa, Mycobacterium
GLPRD

SEQ ID NO: 489620 - protein, 12 aa, Mycobacterium
GLPRDDEPPLDL

SEQ ID NO: 489621 - protein, 7 aa, Mycobacterium
GLPREYA

SEQ ID NO: 489622 - protein, 6 aa, Mycobacterium
GLPRGD

SEQ ID NO: 489623 - protein, 7 aa, Mycobacterium
GLPRGLE

SEQ ID NO: 489624 - protein, 14 aa, Mycobacterium
GLPRGVSGAADPRF

SEQ ID NO: 489625 - protein, 8 aa, Mycobacterium
GLPRPQTQ

SEQ ID NO: 489626 - protein, 12 aa, Mycobacterium
GLPRPRRGSGHF

SEQ ID NO: 489627 - protein, 5 aa, Mycobacterium
GLPRR

SEQ ID NO: 489628 - protein, 12 aa, Mycobacterium
GLPRTEGHKMGE

SEQ ID NO: 489629 - protein, 6 aa, Mycobacterium
GLPSAR

SEQ ID NO: 489630 - protein, 9 aa, Mycobacterium
GLPSDDPVL

SEQ ID NO: 489631 - protein, 9 aa, Mycobacterium
GLPSDPDGM

SEQ ID NO: 489632 - protein, 8 aa, Mycobacterium
GLPSGAEK

SEQ ID NO: 489633 - protein, 18 aa, Mycobacterium
GLPSGRLGDKPADPDTFT

SEQ ID NO: 489634 - protein, 9 aa, Mycobacterium
GLPSGRRTV

SEQ ID NO: 489635 - protein, 10 aa, Mycobacterium
GLPSKPSGWR

SEQ ID NO: 489636 - protein, 11 aa, Mycobacterium
GLPSNPSNWRK

SEQ ID NO: 489637 - protein, 5 aa, Mycobacterium
GLPSP

SEQ ID NO: 489638 - protein, 8 aa, Mycobacterium
GLPSPAAY

SEQ ID NO: 489639 - protein, 22 aa, Mycobacterium
GLPSPTVSDSAVRDAGIRPTPA

SEQ ID NO: 489640 - protein, 7 aa, Mycobacterium
GLPSQQQ

SEQ ID NO: 489641 - protein, 14 aa, Mycobacterium
GLPSSPGVTGATAA

SEQ ID NO: 489642 - protein, 7 aa, Mycobacterium
GLPSSPW

SEQ ID NO: 489643 - protein, 8 aa, Mycobacterium
GLPSSPWY

SEQ ID NO: 489644 - protein, 13 aa, Mycobacterium
GLPSTPNRYAAVS

SEQ ID NO: 489645 - protein, 8 aa, Mycobacterium
GLPSTPSH

SEQ ID NO: 489646 - protein, 8 aa, Mycobacterium
GLPSTTNV

SEQ ID NO: 489647 - protein, 8 aa, Mycobacterium
GLPSTTSA

SEQ ID NO: 489648 - protein, 11 aa, Mycobacterium
GLPTAAERAAA

SEQ ID NO: 489649 - protein, 5 aa, Mycobacterium
GLPTD

SEQ ID NO: 489650 - protein, 12 aa, Mycobacterium
GLPTDDPARPLT

SEQ ID NO: 489651 - protein, 6 aa, Mycobacterium
GLPTDE

SEQ ID NO: 489652 - protein, 15 aa, Mycobacterium
GLPTDSGQDSEQVRA

SEQ ID NO: 489653 - protein, 11 aa, Mycobacterium
GLPTGCGDGDA

SEQ ID NO: 489654 - protein, 10 aa, Mycobacterium
GLPTGDVPAE

SEQ ID NO: 489655 - protein, 9 aa, Mycobacterium
GLPTGEDLD

SEQ ID NO: 489656 - protein, 30 aa, Mycobacterium
GLPTGESDHRPAKTAPLGEGTFDDGYDQVT

SEQ ID NO: 489657 - protein, 10 aa, Mycobacterium
GLPTGPEDAE

SEQ ID NO: 489658 - protein, 10 aa, Mycobacterium
GLPTGQAAAA

SEQ ID NO: 489659 - protein, 16 aa, Mycobacterium
GLPTGRGGKFTASEIP

SEQ ID NO: 489660 - protein, 5 aa, Mycobacterium
GLPTN

SEQ ID NO: 489661 - protein, 5 aa, Mycobacterium
GLPTP

SEQ ID NO: 489662 - protein, 6 aa, Mycobacterium
GLPTPA

SEQ ID NO: 489663 - protein, 23 aa, Mycobacterium
GLPTPEEAAEAEAAYTARYTRER

SEQ ID NO: 489664 - protein, 9 aa, Mycobacterium
GLPTPEGNT

SEQ ID NO: 489665 - protein, 8 aa, Mycobacterium
GLPTPGLP

SEQ ID NO: 489666 - protein, 9 aa, Mycobacterium
GLPTPGLPF

SEQ ID NO: 489667 - protein, 7 aa, Mycobacterium
GLPTPTN

SEQ ID NO: 489668 - protein, 9 aa, Mycobacterium
GLPTQGEHA

SEQ ID NO: 489669 - protein, 6 aa, Mycobacterium
GLPTQR

SEQ ID NO: 489670 - protein, 5 aa, Mycobacterium
GLPTR

SEQ ID NO: 489671 - protein, 14 aa, Mycobacterium
GLPTRRADDLETAL

SEQ ID NO: 489672 - protein, 16 aa, Mycobacterium
GLPTSAFKPVTGGSSH

SEQ ID NO: 489673 - protein, 14 aa, Mycobacterium
GLPTSLSPPTPTRG

SEQ ID NO: 489674 - protein, 7 aa, Mycobacterium
GLPTSPW

SEQ ID NO: 489675 - protein, 5 aa, Mycobacterium
GLPTT

SEQ ID NO: 489676 - protein, 8 aa, Mycobacterium
GLPTTAAC

SEQ ID NO: 489677 - protein, 26 aa, Mycobacterium
GLPTTHPRERTSRHGVEEEEPAPGGE

SEQ ID NO: 489678 - protein, 10 aa, Mycobacterium
GLPVPDRGRL

SEQ ID NO: 489679 - protein, 9 aa, Mycobacterium
GLPVTPNGG

SEQ ID NO: 489680 - protein, 15 aa, Mycobacterium
GLPWGGSQVRTEATG

SEQ ID NO: 489681 - protein, 7 aa, Mycobacterium
GLPYAAE

SEQ ID NO: 489682 - protein, 29 aa, Mycobacterium
GLPYDESSAVVPNDRGRVVDPASRAPVPG

SEQ ID NO: 489683 - protein, 5 aa, Mycobacterium
GLPYE

SEQ ID NO: 489684 - protein, 12 aa, Mycobacterium
GLPYKESYGMAS

SEQ ID NO: 489685 - protein, 6 aa, Mycobacterium
GLPYPA

SEQ ID NO: 489686 - protein, 13 aa, Mycobacterium
GLQAPKDLVDEPE

SEQ ID NO: 489687 - protein, 25 aa, Mycobacterium
GLQARAGAGADKAEAGQDGAAAEPL

SEQ ID NO: 489688 - protein, 23 aa, Mycobacterium
GLQARAGLGRGDGKPEAETAEPL

SEQ ID NO: 489689 - protein, 21 aa, Mycobacterium
GLQARAGQGSGEKPAEGAEPL

SEQ ID NO: 489690 - protein, 21 aa, Mycobacterium
GLQARSGLAGGDEKPEAGEPL

SEQ ID NO: 489691 - protein, 8 aa, Mycobacterium
GLQDTGTE

SEQ ID NO: 489692 - protein, 9 aa, Mycobacterium
GLQEARGRT

SEQ ID NO: 489693 - protein, 5 aa, Mycobacterium
GLQEG

SEQ ID NO: 489694 - protein, 5 aa, Mycobacterium
GLQEK

SEQ ID NO: 489695 - protein, 18 aa, Mycobacterium
GLQESTNWSPLSPRGARQ

SEQ ID NO: 489696 - protein, 7 aa, Mycobacterium
GLQGPDE

SEQ ID NO: 489697 - protein, 7 aa, Mycobacterium
GLQGPDP

SEQ ID NO: 489698 - protein, 6 aa, Mycobacterium
GLQNYG

SEQ ID NO: 489699 - protein, 4 aa, Mycobacterium
GLQP

SEQ ID NO: 489700 - protein, 6 aa, Mycobacterium
GLQPAS

SEQ ID NO: 489701 - protein, 11 aa, Mycobacterium
GLQPDPESAGL

SEQ ID NO: 489702 - protein, 10 aa, Mycobacterium
GLQPEELPNA

SEQ ID NO: 489703 - protein, 8 aa, Mycobacterium
GLQPGGPV

SEQ ID NO: 489704 - protein, 15 aa, Mycobacterium
GLQPGSVADANDAAQ

SEQ ID NO: 489705 - protein, 34 aa, Mycobacterium
GLQPRPAPRFSRTAPETPRPATPVADAEAVLNDW

SEQ ID NO: 489706 - protein, 10 aa, Mycobacterium
GLQPSHNPQV

SEQ ID NO: 489707 - protein, 7 aa, Mycobacterium
GLQPYQP

SEQ ID NO: 489708 - protein, 5 aa, Mycobacterium
GLQQS

SEQ ID NO: 489709 - protein, 4 aa, Mycobacterium
GLQR

SEQ ID NO: 489710 - protein, 5 aa, Mycobacterium
GLQRD

SEQ ID NO: 489711 - protein, 8 aa, Mycobacterium
GLQSDQAS

SEQ ID NO: 489712 - protein, 8 aa, Mycobacterium
GLQSSNPR

SEQ ID NO: 489713 - protein, 9 aa, Mycobacterium
GLQSVKPGD

SEQ ID NO: 489714 - protein, 9 aa, Mycobacterium
GLQSYTRDT

SEQ ID NO: 489715 - protein, 6 aa, Mycobacterium
GLQTDG

SEQ ID NO: 489716 - protein, 15 aa, Mycobacterium
GLRAAGAAVADRSVP

SEQ ID NO: 489717 - protein, 5 aa, Mycobacterium
GLRAD

SEQ ID NO: 489718 - protein, 8 aa, Mycobacterium
GLRAEADD

SEQ ID NO: 489719 - protein, 9 aa, Mycobacterium
GLRAKGGKL

SEQ ID NO: 489720 - protein, 7 aa, Mycobacterium
GLRAQGG

SEQ ID NO: 489721 - protein, 4 aa, Mycobacterium
GLRD

SEQ ID NO: 489722 - protein, 8 aa, Mycobacterium
GLRDAQQK

SEQ ID NO: 489723 - protein, 12 aa, Mycobacterium
GLRDARAAARRM

SEQ ID NO: 489724 - protein, 14 aa, Mycobacterium
GLRDSTRALTNRAP

SEQ ID NO: 489725 - protein, 5 aa, Mycobacterium
GLREE

SEQ ID NO: 489726 - protein, 9 aa, Mycobacterium
GLREEGGAL

SEQ ID NO: 489727 - protein, 7 aa, Mycobacterium
GLREGSD

SEQ ID NO: 489728 - protein, 9 aa, Mycobacterium
GLREGYDTS

SEQ ID NO: 489729 - protein, 7 aa, Mycobacterium
GLRESHP

SEQ ID NO: 489730 - protein, 4 aa, Mycobacterium
GLRG

SEQ ID NO: 489731 - protein, 8 aa, Mycobacterium
GLRGDPRA

SEQ ID NO: 489732 - protein, 7 aa, Mycobacterium
GLRGEVD

SEQ ID NO: 489733 - protein, 6 aa, Mycobacterium
GLRGGG

SEQ ID NO: 489734 - protein, 12 aa, Mycobacterium
GLRGKGRLSDAD

SEQ ID NO: 489735 - protein, 18 aa, Mycobacterium
GLRGKGRLTDADIEATTR

SEQ ID NO: 489736 - protein, 6 aa, Mycobacterium
GLRGLT

SEQ ID NO: 489737 - protein, 13 aa, Mycobacterium
GLRGRGGAGFPTG

SEQ ID NO: 489738 - protein, 7 aa, Mycobacterium
GLRGRST

SEQ ID NO: 489739 - protein, 8 aa, Mycobacterium
GLRGSPTA

SEQ ID NO: 489740 - protein, 12 aa, Mycobacterium
GLRGTERLRSEV

SEQ ID NO: 489741 - protein, 9 aa, Mycobacterium
GLRGYPEDP

SEQ ID NO: 489742 - protein, 8 aa, Mycobacterium
GLRKPSAE

SEQ ID NO: 489743 - protein, 9 aa, Mycobacterium
GLRNASGAV

SEQ ID NO: 489744 - protein, 9 aa, Mycobacterium
GLRNEDEGL

SEQ ID NO: 489745 - protein, 27 aa, Mycobacterium
GLRNPDRDAITTPGGQRLASPPSPPVA

SEQ ID NO: 489746 - protein, 5 aa, Mycobacterium
GLRNT

SEQ ID NO: 489747 - protein, 6 aa, Mycobacterium
GLRPAP

SEQ ID NO: 489748 - protein, 12 aa, Mycobacterium
GLRPAVGSSRVR

SEQ ID NO: 489749 - protein, 5 aa, Mycobacterium
GLRPD

SEQ ID NO: 489750 - protein, 13 aa, Mycobacterium
GLRPDKDPSEVVR

SEQ ID NO: 489751 - protein, 13 aa, Mycobacterium
GLRPDKEASEVVR

SEQ ID NO: 489752 - protein, 13 aa, Mycobacterium
GLRPDKEPSEVVR

SEQ ID NO: 489753 - protein, 13 aa, Mycobacterium
GLRPDKNPSEVVR

SEQ ID NO: 489754 - protein, 22 aa, Mycobacterium
GLRPDSPALPSPESGEQDRGSA

SEQ ID NO: 489755 - protein, 10 aa, Mycobacterium
GLRPEGRNGP

SEQ ID NO: 489756 - protein, 10 aa, Mycobacterium
GLRPEGRSGP

SEQ ID NO: 489757 - protein, 6 aa, Mycobacterium
GLRPEQ

SEQ ID NO: 489758 - protein, 5 aa, Mycobacterium
GLRPG

SEQ ID NO: 489759 - protein, 6 aa, Mycobacterium
GLRPGD

SEQ ID NO: 489760 - protein, 6 aa, Mycobacterium
GLRPGE

SEQ ID NO: 489761 - protein, 11 aa, Mycobacterium
GLRPGRTEREV

SEQ ID NO: 489762 - protein, 12 aa, Mycobacterium
GLRPGRTEREVA

SEQ ID NO: 489763 - protein, 9 aa, Mycobacterium
GLRPISRNP

SEQ ID NO: 489764 - protein, 8 aa, Mycobacterium
GLRPPPPV

SEQ ID NO: 489765 - protein, 7 aa, Mycobacterium
GLRPRPE

SEQ ID NO: 489766 - protein, 6 aa, Mycobacterium
GLRPTD

SEQ ID NO: 489767 - protein, 11 aa, Mycobacterium
GLRQASDGSFA

SEQ ID NO: 489768 - protein, 5 aa, Mycobacterium
GLRQG

SEQ ID NO: 489769 - protein, 6 aa, Mycobacterium
GLRQQS

SEQ ID NO: 489770 - protein, 10 aa, Mycobacterium
GLRQSSPTAI

SEQ ID NO: 489771 - protein, 6 aa, Mycobacterium
GLRRGD

SEQ ID NO: 489772 - protein, 8 aa, Mycobacterium
GLRRGDAV

SEQ ID NO: 489773 - protein, 4 aa, Mycobacterium
GLRS

SEQ ID NO: 489774 - protein, 5 aa, Mycobacterium
GLRSG

SEQ ID NO: 489775 - protein, 8 aa, Mycobacterium
GLRSQPSE

SEQ ID NO: 489776 - protein, 18 aa, Mycobacterium
GLRSSDEANAAQADQRAA

SEQ ID NO: 489777 - protein, 8 aa, Mycobacterium
GLRSTPSE

SEQ ID NO: 489778 - protein, 6 aa, Mycobacterium
GLRTAD

SEQ ID NO: 489779 - protein, 5 aa, Mycobacterium
GLRTD

SEQ ID NO: 489780 - protein, 18 aa, Mycobacterium
GLRTEADEVPHLPYGRVV

SEQ ID NO: 489781 - protein, 9 aa, Mycobacterium
GLRTGPDGR

SEQ ID NO: 489782 - protein, 7 aa, Mycobacterium
GLRTGSR

SEQ ID NO: 489783 - protein, 12 aa, Mycobacterium
GLRVSGRATLDR

SEQ ID NO: 489784 - protein, 5 aa, Mycobacterium
GLSAA

SEQ ID NO: 489785 - protein, 7 aa, Mycobacterium
GLSAAEA

SEQ ID NO: 489786 - protein, 23 aa, Mycobacterium
GLSAAPDVTGTTGSLPAQDDSLT

SEQ ID NO: 489787 - protein, 26 aa, Mycobacterium
GLSAAVNDNDSKFPPEFRLSKRNRAK

SEQ ID NO: 489788 - protein, 15 aa, Mycobacterium
GLSAAVNDNDSRFPP

SEQ ID NO: 489789 - protein, 10 aa, Mycobacterium
GLSADQDDQR

SEQ ID NO: 489790 - protein, 10 aa, Mycobacterium
GLSADQRAQL

SEQ ID NO: 489791 - protein, 12 aa, Mycobacterium
GLSAEDAARITH

SEQ ID NO: 489792 - protein, 8 aa, Mycobacterium
GLSAEDIE

SEQ ID NO: 489793 - protein, 7 aa, Mycobacterium
GLSAGSG

SEQ ID NO: 489794 - protein, 8 aa, Mycobacterium
GLSAGTQF

SEQ ID NO: 489795 - protein, 9 aa, Mycobacterium
GLSAGTQFE

SEQ ID NO: 489796 - protein, 9 aa, Mycobacterium
GLSAPDGRC

SEQ ID NO: 489797 - protein, 9 aa, Mycobacterium
GLSAPQQTG

SEQ ID NO: 489798 - protein, 10 aa, Mycobacterium
GLSAPSRGGT

SEQ ID NO: 489799 - protein, 6 aa, Mycobacterium
GLSARA

SEQ ID NO: 489800 - protein, 9 aa, Mycobacterium
GLSARSGQR

SEQ ID NO: 489801 - protein, 11 aa, Mycobacterium
GLSARVGADQL

SEQ ID NO: 489802 - protein, 10 aa, Mycobacterium
GLSASPEGAF

SEQ ID NO: 489803 - protein, 11 aa, Mycobacterium
GLSDAKAAGKR

SEQ ID NO: 489804 - protein, 13 aa, Mycobacterium
GLSDASPAALAAD

SEQ ID NO: 489805 - protein, 8 aa, Mycobacterium
GLSDDEKA

SEQ ID NO: 489806 - protein, 10 aa, Mycobacterium
GLSDDLTAEG

SEQ ID NO: 489807 - protein, 9 aa, Mycobacterium
GLSDKARSW

SEQ ID NO: 489808 - protein, 8 aa, Mycobacterium
GLSDPAIA

SEQ ID NO: 489809 - protein, 10 aa, Mycobacterium
GLSDPTDDDE

SEQ ID NO: 489810 - protein, 6 aa, Mycobacterium
GLSDQE

SEQ ID NO: 489811 - protein, 9 aa, Mycobacterium
GLSDRAATF

SEQ ID NO: 489812 - protein, 7 aa, Mycobacterium
GLSDSEL

SEQ ID NO: 489813 - protein, 16 aa, Mycobacterium
GLSEAQLTERVNGLTG

SEQ ID NO: 489814 - protein, 9 aa, Mycobacterium
GLSEGAASE

SEQ ID NO: 489815 - protein, 7 aa, Mycobacterium
GLSEGAK

SEQ ID NO: 489816 - protein, 9 aa, Mycobacterium
GLSEGEKQV

SEQ ID NO: 489817 - protein, 8 aa, Mycobacterium
GLSEGGIP

SEQ ID NO: 489818 - protein, 8 aa, Mycobacterium
GLSENGGV

SEQ ID NO: 489819 - protein, 18 aa, Mycobacterium
GLSEPEQVSAPPQASRAK

SEQ ID NO: 489820 - protein, 8 aa, Mycobacterium
GLSEPGAA

SEQ ID NO: 489821 - protein, 13 aa, Mycobacterium
GLSEPSAGTATLD

SEQ ID NO: 489822 - protein, 8 aa, Mycobacterium
GLSEPSPR

SEQ ID NO: 489823 - protein, 8 aa, Mycobacterium
GLSEQAAQ

SEQ ID NO: 489824 - protein, 10 aa, Mycobacterium
GLSEQQADDI

SEQ ID NO: 489825 - protein, 16 aa, Mycobacterium
GLSESKGAARRTVKEG

SEQ ID NO: 489826 - protein, 18 aa, Mycobacterium
GLSESRKAARRTIGEGGV

SEQ ID NO: 489827 - protein, 19 aa, Mycobacterium
GLSESRKAARRTLNEGGVS

SEQ ID NO: 489828 - protein, 12 aa, Mycobacterium
GLSESVGSQRFG

SEQ ID NO: 489829 - protein, 4 aa, Mycobacterium
GLSG

SEQ ID NO: 489830 - protein, 5 aa, Mycobacterium
GLSGA

SEQ ID NO: 489831 - protein, 6 aa, Mycobacterium
GLSGAA

SEQ ID NO: 489832 - protein, 9 aa, Mycobacterium
GLSGDAARD

SEQ ID NO: 489833 - protein, 12 aa, Mycobacterium
GLSGDLSAGLPS

SEQ ID NO: 489834 - protein, 8 aa, Mycobacterium
GLSGGGPY

SEQ ID NO: 489835 - protein, 8 aa, Mycobacterium
GLSGGKAA

SEQ ID NO: 489836 - protein, 7 aa, Mycobacterium
GLSGKAR

SEQ ID NO: 489837 - protein, 8 aa, Mycobacterium
GLSGLPPT

SEQ ID NO: 489838 - protein, 7 aa, Mycobacterium
GLSGPDR

SEQ ID NO: 489839 - protein, 14 aa, Mycobacterium
GLSGPKAERPGFGT

SEQ ID NO: 489840 - protein, 14 aa, Mycobacterium
GLSGPKSERPGFGT

SEQ ID NO: 489841 - protein, 15 aa, Mycobacterium
GLSGPTTLPIEFDAG

SEQ ID NO: 489842 - protein, 6 aa, Mycobacterium
GLSGPV

SEQ ID NO: 489843 - protein, 10 aa, Mycobacterium
GLSGQDNGKW

SEQ ID NO: 489844 - protein, 13 aa, Mycobacterium
GLSGQSAAPGCPA

SEQ ID NO: 489845 - protein, 13 aa, Mycobacterium
GLSGQSAAPGSLA

SEQ ID NO: 489846 - protein, 15 aa, Mycobacterium
GLSGQSAAPGSPATL

SEQ ID NO: 489847 - protein, 11 aa, Mycobacterium
GLSGSSTRFGE

SEQ ID NO: 489848 - protein, 6 aa, Mycobacterium
GLSGTC

SEQ ID NO: 489849 - protein, 8 aa, Mycobacterium
GLSHDPPV

SEQ ID NO: 489850 - protein, 11 aa, Mycobacterium
GLSHDPPVPTL

SEQ ID NO: 489851 - protein, 18 aa, Mycobacterium
GLSHDPPVPTLATAPPAA

SEQ ID NO: 489852 - protein, 10 aa, Mycobacterium
GLSHSPPSLE

SEQ ID NO: 489853 - protein, 10 aa, Mycobacterium
GLSHSPPVPT

SEQ ID NO: 489854 - protein, 18 aa, Mycobacterium
GLSHSPPVPTLATAGPPV

SEQ ID NO: 489855 - protein, 19 aa, Mycobacterium
GLSHSPPVPTLDDAGPAGL

SEQ ID NO: 489856 - protein, 6 aa, Mycobacterium
GLSISG

SEQ ID NO: 489857 - protein, 5 aa, Mycobacterium
GLSKA

SEQ ID NO: 489858 - protein, 11 aa, Mycobacterium
GLSKDERRRRV

SEQ ID NO: 489859 - protein, 5 aa, Mycobacterium
GLSNE

SEQ ID NO: 489860 - protein, 6 aa, Mycobacterium
GLSNEE

SEQ ID NO: 489861 - protein, 10 aa, Mycobacterium
GLSNRERAYE

SEQ ID NO: 489862 - protein, 5 aa, Mycobacterium
GLSPA

SEQ ID NO: 489863 - protein, 10 aa, Mycobacterium
GLSPAQASAQ

SEQ ID NO: 489864 - protein, 7 aa, Mycobacterium
GLSPDRL

SEQ ID NO: 489865 - protein, 5 aa, Mycobacterium
GLSPE

SEQ ID NO: 489866 - protein, 6 aa, Mycobacterium
GLSPEA

SEQ ID NO: 489867 - protein, 9 aa, Mycobacterium
GLSPEDAFD

SEQ ID NO: 489868 - protein, 16 aa, Mycobacterium
GLSPEDEAKRQQQGAG

SEQ ID NO: 489869 - protein, 6 aa, Mycobacterium
GLSPEQ

SEQ ID NO: 489870 - protein, 7 aa, Mycobacterium
GLSPEQQ

SEQ ID NO: 489871 - protein, 9 aa, Mycobacterium
GLSPEQRQA

SEQ ID NO: 489872 - protein, 8 aa, Mycobacterium
GLSPGQVG

SEQ ID NO: 489873 - protein, 19 aa, Mycobacterium
GLSPGTRGDFGSIEDSSAL

SEQ ID NO: 489874 - protein, 7 aa, Mycobacterium
GLSPKDV

SEQ ID NO: 489875 - protein, 5 aa, Mycobacterium
GLSPL

SEQ ID NO: 489876 - protein, 8 aa, Mycobacterium
GLSPNDPL

SEQ ID NO: 489877 - protein, 11 aa, Mycobacterium
GLSPNPKRRQR

SEQ ID NO: 489878 - protein, 5 aa, Mycobacterium
GLSPQ

SEQ ID NO: 489879 - protein, 9 aa, Mycobacterium
GLSPQQAVQ

SEQ ID NO: 489880 - protein, 16 aa, Mycobacterium
GLSPQQPTEPQPQQIA

SEQ ID NO: 489881 - protein, 10 aa, Mycobacterium
GLSPRAGRAL

SEQ ID NO: 489882 - protein, 9 aa, Mycobacterium
GLSPRPGVV

SEQ ID NO: 489883 - protein, 17 aa, Mycobacterium
GLSPRSPLPGADGLSPV

SEQ ID NO: 489884 - protein, 8 aa, Mycobacterium
GLSPSAEE

SEQ ID NO: 489885 - protein, 7 aa, Mycobacterium
GLSPTDH

SEQ ID NO: 489886 - protein, 11 aa, Mycobacterium
GLSPYGPQTGE

SEQ ID NO: 489887 - protein, 12 aa, Mycobacterium
GLSPYGPQTGEP

SEQ ID NO: 489888 - protein, 6 aa, Mycobacterium
GLSQDG

SEQ ID NO: 489889 - protein, 5 aa, Mycobacterium
GLSQE

SEQ ID NO: 489890 - protein, 22 aa, Mycobacterium
GLSQGDVVESGANADIKPGNNL

SEQ ID NO: 489891 - protein, 22 aa, Mycobacterium
GLSQGDVVESGPNADIKPGNNL

SEQ ID NO: 489892 - protein, 22 aa, Mycobacterium
GLSQGDVVETGPNADIKPGNNL

SEQ ID NO: 489893 - protein, 7 aa, Mycobacterium
GLSQPTV

SEQ ID NO: 489894 - protein, 4 aa, Mycobacterium
GLSR

SEQ ID NO: 489895 - protein, 7 aa, Mycobacterium
GLSRPNI

SEQ ID NO: 489896 - protein, 31 aa, Mycobacterium
GLSRPRRGGPSDDRLGPAHGERARLASCAIG

SEQ ID NO: 489897 - protein, 11 aa, Mycobacterium
GLSRQGRRGPI

SEQ ID NO: 489898 - protein, 7 aa, Mycobacterium
GLSRRDR

SEQ ID NO: 489899 - protein, 11 aa, Mycobacterium
GLSRSDSPDRF

SEQ ID NO: 489900 - protein, 6 aa, Mycobacterium
GLSRTA

SEQ ID NO: 489901 - protein, 5 aa, Mycobacterium
GLSRV

SEQ ID NO: 489902 - protein, 11 aa, Mycobacterium
GLSSAARQRNV

SEQ ID NO: 489903 - protein, 10 aa, Mycobacterium
GLSSDQPLRR

SEQ ID NO: 489904 - protein, 12 aa, Mycobacterium
GLSSGTAADPVA

SEQ ID NO: 489905 - protein, 6 aa, Mycobacterium
GLSSQR

SEQ ID NO: 489906 - protein, 18 aa, Mycobacterium
GLSSRQAAAEPVSRTVIL

SEQ ID NO: 489907 - protein, 4 aa, Mycobacterium
GLST

SEQ ID NO: 489908 - protein, 5 aa, Mycobacterium
GLSTE

SEQ ID NO: 489909 - protein, 6 aa, Mycobacterium
GLSTED

SEQ ID NO: 489910 - protein, 6 aa, Mycobacterium
GLSTEQ

SEQ ID NO: 489911 - protein, 5 aa, Mycobacterium
GLSTH

SEQ ID NO: 489912 - protein, 9 aa, Mycobacterium
GLSTKQRGK

SEQ ID NO: 489913 - protein, 5 aa, Mycobacterium
GLSTN

SEQ ID NO: 489914 - protein, 5 aa, Mycobacterium
GLSTP

SEQ ID NO: 489915 - protein, 5 aa, Mycobacterium
GLSTR

SEQ ID NO: 489916 - protein, 15 aa, Mycobacterium
GLSTSPSNTPPPYNA

SEQ ID NO: 489917 - protein, 7 aa, Mycobacterium
GLSTTTE

SEQ ID NO: 489918 - protein, 5 aa, Mycobacterium
GLSTV

SEQ ID NO: 489919 - protein, 7 aa, Mycobacterium
GLSVDEK

SEQ ID NO: 489920 - protein, 7 aa, Mycobacterium
GLSVDQE

SEQ ID NO: 489921 - protein, 11 aa, Mycobacterium
GLTAAPKSLPP

SEQ ID NO: 489922 - protein, 9 aa, Mycobacterium
GLTAGGDDY

SEQ ID NO: 489923 - protein, 10 aa, Mycobacterium
GLTAPYNPYA

SEQ ID NO: 489924 - protein, 12 aa, Mycobacterium
GLTAQQSDDEFN

SEQ ID NO: 489925 - protein, 7 aa, Mycobacterium
GLTATRQ

SEQ ID NO: 489926 - protein, 9 aa, Mycobacterium
GLTATRQGE

SEQ ID NO: 489927 - protein, 11 aa, Mycobacterium
GLTATRQGLED

SEQ ID NO: 489928 - protein, 11 aa, Mycobacterium
GLTATTNRIAD

SEQ ID NO: 489929 - protein, 5 aa, Mycobacterium
GLTDA

SEQ ID NO: 489930 - protein, 10 aa, Mycobacterium
GLTDDQMSDN

SEQ ID NO: 489931 - protein, 13 aa, Mycobacterium
GLTDEAKRLKEEG

SEQ ID NO: 489932 - protein, 15 aa, Mycobacterium
GLTDERDNDEAGVTV

SEQ ID NO: 489933 - protein, 8 aa, Mycobacterium
GLTDPGDR

SEQ ID NO: 489934 - protein, 17 aa, Mycobacterium
GLTDPNAPGGAPGAATL

SEQ ID NO: 489935 - protein, 11 aa, Mycobacterium
GLTDRERAYGA

SEQ ID NO: 489936 - protein, 8 aa, Mycobacterium
GLTDSDDH

SEQ ID NO: 489937 - protein, 6 aa, Mycobacterium
GLTDSQ

SEQ ID NO: 489938 - protein, 18 aa, Mycobacterium
GLTEANSAEFEPGTPDPV

SEQ ID NO: 489939 - protein, 6 aa, Mycobacterium
GLTEQD

SEQ ID NO: 489940 - protein, 5 aa, Mycobacterium
GLTES

SEQ ID NO: 489941 - protein, 5 aa, Mycobacterium
GLTET

SEQ ID NO: 489942 - protein, 5 aa, Mycobacterium
GLTGA

SEQ ID NO: 489943 - protein, 5 aa, Mycobacterium
GLTGD

SEQ ID NO: 489944 - protein, 11 aa, Mycobacterium
GLTGDDPDDAK

SEQ ID NO: 489945 - protein, 6 aa, Mycobacterium
GLTGDG

SEQ ID NO: 489946 - protein, 24 aa, Mycobacterium
GLTGDHQRDRLQARGRERARRRRG

SEQ ID NO: 489947 - protein, 14 aa, Mycobacterium
GLTGDRGGEPTVAS

SEQ ID NO: 489948 - protein, 6 aa, Mycobacterium
GLTGDS

SEQ ID NO: 489949 - protein, 11 aa, Mycobacterium
GLTGGAEYEPV

SEQ ID NO: 489950 - protein, 8 aa, Mycobacterium
GLTGGDDA

SEQ ID NO: 489951 - protein, 9 aa, Mycobacterium
GLTGGEEAA

SEQ ID NO: 489952 - protein, 12 aa, Mycobacterium
GLTGGGGAISAT

SEQ ID NO: 489953 - protein, 8 aa, Mycobacterium
GLTGGPAL

SEQ ID NO: 489954 - protein, 11 aa, Mycobacterium
GLTGNSWRGPA

SEQ ID NO: 489955 - protein, 13 aa, Mycobacterium
GLTGRQSELAESP

SEQ ID NO: 489956 - protein, 13 aa, Mycobacterium
GLTGSDPASLSPA

SEQ ID NO: 489957 - protein, 12 aa, Mycobacterium
GLTGSEPASLSK

SEQ ID NO: 489958 - protein, 12 aa, Mycobacterium
GLTGSTSSVASG

SEQ ID NO: 489959 - protein, 13 aa, Mycobacterium
GLTGTKKGCDQGA

SEQ ID NO: 489960 - protein, 39 aa, Mycobacterium
GLTHGGGGTVSPGMPGVQSGGMSISPAGLGQGAQPNLAQ

SEQ ID NO: 489961 - protein, 5 aa, Mycobacterium
GLTKN

SEQ ID NO: 489962 - protein, 12 aa, Mycobacterium
GLTKTGEPTRHA

SEQ ID NO: 489963 - protein, 7 aa, Mycobacterium
GLTNGGS

SEQ ID NO: 489964 - protein, 6 aa, Mycobacterium
GLTNKD

SEQ ID NO: 489965 - protein, 7 aa, Mycobacterium
GLTNTEI

SEQ ID NO: 489966 - protein, 6 aa, Mycobacterium
GLTPAD

SEQ ID NO: 489967 - protein, 7 aa, Mycobacterium
GLTPAQY

SEQ ID NO: 489968 - protein, 9 aa, Mycobacterium
GLTPDDPRY

SEQ ID NO: 489969 - protein, 14 aa, Mycobacterium
GLTPDSSDEEFRAA

SEQ ID NO: 489970 - protein, 7 aa, Mycobacterium
GLTPDTD

SEQ ID NO: 489971 - protein, 7 aa, Mycobacterium
GLTPEAI

SEQ ID NO: 489972 - protein, 6 aa, Mycobacterium
GLTPEQ

SEQ ID NO: 489973 - protein, 7 aa, Mycobacterium
GLTPEQI

SEQ ID NO: 489974 - protein, 7 aa, Mycobacterium
GLTPEQM

SEQ ID NO: 489975 - protein, 20 aa, Mycobacterium
GLTPETRTRSDLCRAGYSCG

SEQ ID NO: 489976 - protein, 10 aa, Mycobacterium
GLTPGRRTDA

SEQ ID NO: 489977 - protein, 19 aa, Mycobacterium
GLTPGTRGDFGKIEDSSAL

SEQ ID NO: 489978 - protein, 9 aa, Mycobacterium
GLTPGYEQR

SEQ ID NO: 489979 - protein, 5 aa, Mycobacterium
GLTPK

SEQ ID NO: 489980 - protein, 7 aa, Mycobacterium
GLTPKAA

SEQ ID NO: 489981 - protein, 13 aa, Mycobacterium
GLTPKQDAEITRN

SEQ ID NO: 489982 - protein, 10 aa, Mycobacterium
GLTPQQQRQV

SEQ ID NO: 489983 - protein, 15 aa, Mycobacterium
GLTPQSGDDELRAAA

SEQ ID NO: 489984 - protein, 10 aa, Mycobacterium
GLTPQSTEEQ

SEQ ID NO: 489985 - protein, 6 aa, Mycobacterium
GLTPQY

SEQ ID NO: 489986 - protein, 7 aa, Mycobacterium
GLTPRKA

SEQ ID NO: 489987 - protein, 15 aa, Mycobacterium
GLTPRQAADDPTRRG

SEQ ID NO: 489988 - protein, 12 aa, Mycobacterium
GLTPRTPRRNQP

SEQ ID NO: 489989 - protein, 5 aa, Mycobacterium
GLTPS

SEQ ID NO: 489990 - protein, 17 aa, Mycobacterium
GLTPSGRQRLVRAISEH

SEQ ID NO: 489991 - protein, 7 aa, Mycobacterium
GLTPSQT

SEQ ID NO: 489992 - protein, 5 aa, Mycobacterium
GLTPT

SEQ ID NO: 489993 - protein, 9 aa, Mycobacterium
GLTPTAADD

SEQ ID NO: 489994 - protein, 6 aa, Mycobacterium
GLTPYR

SEQ ID NO: 489995 - protein, 12 aa, Mycobacterium
GLTQAGRGGIGS

SEQ ID NO: 489996 - protein, 7 aa, Mycobacterium
GLTQPTV

SEQ ID NO: 489997 - protein, 10 aa, Mycobacterium
GLTQQQELPG

SEQ ID NO: 489998 - protein, 6 aa, Mycobacterium
GLTQSQ

SEQ ID NO: 489999 - protein, 13 aa, Mycobacterium
GLTREDEARAGHA

SEQ ID NO: 490000 - protein, 7 aa, Mycobacterium
GLTRGGH

SEQ ID NO: 490001 - protein, 6 aa, Mycobacterium
GLTRPE

SEQ ID NO: 490002 - protein, 12 aa, Mycobacterium
GLTRPSPATADA

SEQ ID NO: 490003 - protein, 5 aa, Mycobacterium
GLTRR

SEQ ID NO: 490004 - protein, 13 aa, Mycobacterium
GLTSGEKPSGQAE

SEQ ID NO: 490005 - protein, 7 aa, Mycobacterium
GLTSLGD

SEQ ID NO: 490006 - protein, 7 aa, Mycobacterium
GLTSPTL

SEQ ID NO: 490007 - protein, 14 aa, Mycobacterium
GLTTGSSQRKTEVQ

SEQ ID NO: 490008 - protein, 10 aa, Mycobacterium
GLTTNEQQER

SEQ ID NO: 490009 - protein, 5 aa, Mycobacterium
GLTTP

SEQ ID NO: 490010 - protein, 11 aa, Mycobacterium
GLTTPDPEEAA

SEQ ID NO: 490011 - protein, 12 aa, Mycobacterium
GLTTPQIAIARR

SEQ ID NO: 490012 - protein, 11 aa, Mycobacterium
GLTTRDAARLG

SEQ ID NO: 490013 - protein, 11 aa, Mycobacterium
GLTTRPGPAYT

SEQ ID NO: 490014 - protein, 6 aa, Mycobacterium
GLTVDE

SEQ ID NO: 490015 - protein, 4 aa, Mycobacterium
GLVD

SEQ ID NO: 490016 - protein, 29 aa, Mycobacterium
GLVGGGDENRTESTGLGAPGDSDAISGAL

SEQ ID NO: 490017 - protein, 26 aa, Mycobacterium
GLVGGGGVAADRGAAVAGPGPAAPRR

SEQ ID NO: 490018 - protein, 6 aa, Mycobacterium
GLVPEA

SEQ ID NO: 490019 - protein, 21 aa, Mycobacterium
GLVPSRRSNRGAPERDVDPEL

SEQ ID NO: 490020 - protein, 28 aa, Mycobacterium
GLVTPDRDSGRAARSGAQTGNKLTVCVR

SEQ ID NO: 490021 - protein, 4 aa, Mycobacterium
GLYE

SEQ ID NO: 490022 - protein, 7 aa, Mycobacterium
GLYGRSD

SEQ ID NO: 490023 - protein, 12 aa, Mycobacterium
GLYSPNSPPTVP

SEQ ID NO: 490024 - protein, 11 aa, Mycobacterium
GMAAPQATARA

SEQ ID NO: 490025 - protein, 5 aa, Mycobacterium
GMADA

SEQ ID NO: 490026 - protein, 10 aa, Mycobacterium
GMADAAKEAF

SEQ ID NO: 490027 - protein, 19 aa, Mycobacterium
GMADEDTLGRPRPGADTDR

SEQ ID NO: 490028 - protein, 6 aa, Mycobacterium
GMADPS

SEQ ID NO: 490029 - protein, 9 aa, Mycobacterium
GMADPTALQ

SEQ ID NO: 490030 - protein, 22 aa, Mycobacterium
GMADRSSRPHRSPRRTPTRTER

SEQ ID NO: 490031 - protein, 21 aa, Mycobacterium
GMAEKSAEFADHGNRVYLPIT

SEQ ID NO: 490032 - protein, 11 aa, Mycobacterium
GMAEKSREFAE

SEQ ID NO: 490033 - protein, 21 aa, Mycobacterium
GMAEKSREFAEHGNRVYLPIT

SEQ ID NO: 490034 - protein, 5 aa, Mycobacterium
GMAGA

SEQ ID NO: 490035 - protein, 9 aa, Mycobacterium
GMAGGSADA

SEQ ID NO: 490036 - protein, 10 aa, Mycobacterium
GMAGGSADAA

SEQ ID NO: 490037 - protein, 12 aa, Mycobacterium
GMAGRPPQTESM

SEQ ID NO: 490038 - protein, 6 aa, Mycobacterium
GMANGM

SEQ ID NO: 490039 - protein, 5 aa, Mycobacterium
GMAPP

SEQ ID NO: 490040 - protein, 8 aa, Mycobacterium
GMAPPQPD

SEQ ID NO: 490041 - protein, 12 aa, Mycobacterium
GMAPTDRTASTQ

SEQ ID NO: 490042 - protein, 8 aa, Mycobacterium
GMAPTPDE

SEQ ID NO: 490043 - protein, 7 aa, Mycobacterium
GMAQDGG

SEQ ID NO: 490044 - protein, 13 aa, Mycobacterium
GMATDGGDFVSSG

SEQ ID NO: 490045 - protein, 19 aa, Mycobacterium
GMATGQPAGAGAQGISSGA

SEQ ID NO: 490046 - protein, 36 aa, Mycobacterium
GMCNPDDEAPVSDGAPSEEAVQRDTRSPAQRNHDGL

SEQ ID NO: 490047 - protein, 35 aa, Mycobacterium
GMCNPDDEAPVVDGPATEAAVQRDTRTAAQRNHDG

SEQ ID NO: 490048 - protein, 33 aa, Mycobacterium
GMCNPDDESPVVQAPAGADAVSRDRRSVGQRHH

SEQ ID NO: 490049 - protein, 8 aa, Mycobacterium
GMCNPEDE

SEQ ID NO: 490050 - protein, 29 aa, Mycobacterium
GMCNPNDQSPLVDGQPADDAAERDTRTVA

SEQ ID NO: 490051 - protein, 36 aa, Mycobacterium
GMCNPQDESPVVDGPPPQDVAQRDTRSESQRTHDGL

SEQ ID NO: 490052 - protein, 9 aa, Mycobacterium
GMDASGAEP

SEQ ID NO: 490053 - protein, 6 aa, Mycobacterium
GMDDPD

SEQ ID NO: 490054 - protein, 5 aa, Mycobacterium
GMDER

SEQ ID NO: 490055 - protein, 14 aa, Mycobacterium
GMDERRAGGPSPEL

SEQ ID NO: 490056 - protein, 10 aa, Mycobacterium
GMDGADLSDQ

SEQ ID NO: 490057 - protein, 5 aa, Mycobacterium
GMDKE

SEQ ID NO: 490058 - protein, 5 aa, Mycobacterium
GMDND

SEQ ID NO: 490059 - protein, 9 aa, Mycobacterium
GMDNSPRWD

SEQ ID NO: 490060 - protein, 4 aa, Mycobacterium
GMDP

SEQ ID NO: 490061 - protein, 5 aa, Mycobacterium
GMDPG

SEQ ID NO: 490062 - protein, 7 aa, Mycobacterium
GMDPPDV

SEQ ID NO: 490063 - protein, 13 aa, Mycobacterium
GMDTGYGAHGGEH

SEQ ID NO: 490064 - protein, 10 aa, Mycobacterium
GMEAEQEAED

SEQ ID NO: 490065 - protein, 7 aa, Mycobacterium
GMEDDPD

SEQ ID NO: 490066 - protein, 7 aa, Mycobacterium
GMEDDPE

SEQ ID NO: 490067 - protein, 9 aa, Mycobacterium
GMEGPRDGL

SEQ ID NO: 490068 - protein, 9 aa, Mycobacterium
GMEQSRAHE

SEQ ID NO: 490069 - protein, 5 aa, Mycobacterium
GMEQT

SEQ ID NO: 490070 - protein, 6 aa, Mycobacterium
GMEQTR

SEQ ID NO: 490071 - protein, 12 aa, Mycobacterium
GMESGHAYGKSL

SEQ ID NO: 490072 - protein, 12 aa, Mycobacterium
GMESGQAYGKSL

SEQ ID NO: 490073 - protein, 4 aa, Mycobacterium
GMGA

SEQ ID NO: 490074 - protein, 10 aa, Mycobacterium
GMGAGAGNAP

SEQ ID NO: 490075 - protein, 9 aa, Mycobacterium
GMGAGAGNC

SEQ ID NO: 490076 - protein, 12 aa, Mycobacterium
GMGDGDAADWRG

SEQ ID NO: 490077 - protein, 6 aa, Mycobacterium
GMGDSE

SEQ ID NO: 490078 - protein, 6 aa, Mycobacterium
GMGEAS

SEQ ID NO: 490079 - protein, 4 aa, Mycobacterium
GMGG

SEQ ID NO: 490080 - protein, 10 aa, Mycobacterium
GMGGDARSWA

SEQ ID NO: 490081 - protein, 14 aa, Mycobacterium
GMGGLGGAGGAGGQ

SEQ ID NO: 490082 - protein, 5 aa, Mycobacterium
GMGGM

SEQ ID NO: 490083 - protein, 6 aa, Mycobacterium
GMGGNS

SEQ ID NO: 490084 - protein, 13 aa, Mycobacterium
GMGHETAQRLRAG

SEQ ID NO: 490085 - protein, 4 aa, Mycobacterium
GMGN

SEQ ID NO: 490086 - protein, 12 aa, Mycobacterium
GMGNATASRLRE

SEQ ID NO: 490087 - protein, 15 aa, Mycobacterium
GMGPDQAQETITRGQ

SEQ ID NO: 490088 - protein, 4 aa, Mycobacterium
GMGQ

SEQ ID NO: 490089 - protein, 11 aa, Mycobacterium
GMGQAGSVGSL

SEQ ID NO: 490090 - protein, 7 aa, Mycobacterium
GMGQRAA

SEQ ID NO: 490091 - protein, 4 aa, Mycobacterium
GMGR

SEQ ID NO: 490092 - protein, 5 aa, Mycobacterium
GMGRA

SEQ ID NO: 490093 - protein, 13 aa, Mycobacterium
GMGRADNASQYSW

SEQ ID NO: 490094 - protein, 9 aa, Mycobacterium
GMGRAETPV

SEQ ID NO: 490095 - protein, 15 aa, Mycobacterium
GMGRETAQRLRDGGH

SEQ ID NO: 490096 - protein, 34 aa, Mycobacterium
GMGRKSATRKAKGAKGKKGKKGGRGPTPPKARNP

SEQ ID NO: 490097 - protein, 39 aa, Mycobacterium
GMGRKSATRKSKGAKGKAGKKAKKGGRGPTPPKARNPLA

SEQ ID NO: 490098 - protein, 8 aa, Mycobacterium
GMGRRRPD

SEQ ID NO: 490099 - protein, 11 aa, Mycobacterium
GMGSEPARKSR

SEQ ID NO: 490100 - protein, 59 aa, Mycobacterium
GMGSGGAPKLPGGLGSGGLPGMGSNPLGSGVDQMPSAGSGLPSAGGVPGDGSGAGSPAV

SEQ ID NO: 490101 - protein, 9 aa, Mycobacterium
GMGSSSTNF

SEQ ID NO: 490102 - protein, 11 aa, Mycobacterium
GMGSSSTNYYN

SEQ ID NO: 490103 - protein, 18 aa, Mycobacterium
GMKASDAKRLKDLEAENA

SEQ ID NO: 490104 - protein, 22 aa, Mycobacterium
GMKNEIDPGAPTQGSSYDAPVD

SEQ ID NO: 490105 - protein, 7 aa, Mycobacterium
GMKPGQQ

SEQ ID NO: 490106 - protein, 13 aa, Mycobacterium
GMLPGSRSERAGV

SEQ ID NO: 490107 - protein, 7 aa, Mycobacterium
GMNAGKD

SEQ ID NO: 490108 - protein, 12 aa, Mycobacterium
GMNANEAKQLKE

SEQ ID NO: 490109 - protein, 5 aa, Mycobacterium
GMNTA

SEQ ID NO: 490110 - protein, 12 aa, Mycobacterium
GMNTRTPGNGAD

SEQ ID NO: 490111 - protein, 12 aa, Mycobacterium
GMPAAKPATAVS

SEQ ID NO: 490112 - protein, 13 aa, Mycobacterium
GMPAAPGHVLAGG

SEQ ID NO: 490113 - protein, 16 aa, Mycobacterium
GMPAGGPVNAVTEDEL

SEQ ID NO: 490114 - protein, 11 aa, Mycobacterium
GMPAMPGQTGM

SEQ ID NO: 490115 - protein, 8 aa, Mycobacterium
GMPAPPPL

SEQ ID NO: 490116 - protein, 15 aa, Mycobacterium
GMPAPQKAMRGALGL

SEQ ID NO: 490117 - protein, 16 aa, Mycobacterium
GMPAPRDAMTCALAEL

SEQ ID NO: 490118 - protein, 5 aa, Mycobacterium
GMPAY

SEQ ID NO: 490119 - protein, 4 aa, Mycobacterium
GMPD

SEQ ID NO: 490120 - protein, 15 aa, Mycobacterium
GMPDPAKQAGRYPHQ

SEQ ID NO: 490121 - protein, 15 aa, Mycobacterium
GMPDPDPGDGTGPYW

SEQ ID NO: 490122 - protein, 14 aa, Mycobacterium
GMPDPEPAAGEAPY

SEQ ID NO: 490123 - protein, 14 aa, Mycobacterium
GMPDPEPATGDGPY

SEQ ID NO: 490124 - protein, 14 aa, Mycobacterium
GMPDPTKQAGRYPH

SEQ ID NO: 490125 - protein, 5 aa, Mycobacterium
GMPEG

SEQ ID NO: 490126 - protein, 19 aa, Mycobacterium
GMPEGVPPAALRPEPRLPV

SEQ ID NO: 490127 - protein, 16 aa, Mycobacterium
GMPELDPKAANGYAPN

SEQ ID NO: 490128 - protein, 7 aa, Mycobacterium
GMPESSV

SEQ ID NO: 490129 - protein, 13 aa, Mycobacterium
GMPGAPGPVPEGG

SEQ ID NO: 490130 - protein, 6 aa, Mycobacterium
GMPGSD

SEQ ID NO: 490131 - protein, 17 aa, Mycobacterium
GMPHPDWRGSTEDRDTA

SEQ ID NO: 490132 - protein, 6 aa, Mycobacterium
GMPKES

SEQ ID NO: 490133 - protein, 17 aa, Mycobacterium
GMPKTHDDEHKLDSAQR

SEQ ID NO: 490134 - protein, 9 aa, Mycobacterium
GMPNGDGKG

SEQ ID NO: 490135 - protein, 5 aa, Mycobacterium
GMPPF

SEQ ID NO: 490136 - protein, 13 aa, Mycobacterium
GMPPFSGPQGPFA

SEQ ID NO: 490137 - protein, 8 aa, Mycobacterium
GMPPQTAD

SEQ ID NO: 490138 - protein, 5 aa, Mycobacterium
GMPPR

SEQ ID NO: 490139 - protein, 9 aa, Mycobacterium
GMPQHRDQT

SEQ ID NO: 490140 - protein, 4 aa, Mycobacterium
GMPR

SEQ ID NO: 490141 - protein, 6 aa, Mycobacterium
GMPRPQ

SEQ ID NO: 490142 - protein, 4 aa, Mycobacterium
GMPS

SEQ ID NO: 490143 - protein, 6 aa, Mycobacterium
GMPSTS

SEQ ID NO: 490144 - protein, 12 aa, Mycobacterium
GMPSVSDSTVSD

SEQ ID NO: 490145 - protein, 4 aa, Mycobacterium
GMPT

SEQ ID NO: 490146 - protein, 7 aa, Mycobacterium
GMPTDDA

SEQ ID NO: 490147 - protein, 14 aa, Mycobacterium
GMPWSSNPTTGDGA

SEQ ID NO: 490148 - protein, 10 aa, Mycobacterium
GMQGGGLGYA

SEQ ID NO: 490149 - protein, 7 aa, Mycobacterium
GMQPPDQ

SEQ ID NO: 490150 - protein, 9 aa, Mycobacterium
GMRATGSND

SEQ ID NO: 490151 - protein, 23 aa, Mycobacterium
GMRDASKTPEPVPRTKPTTGQGN

SEQ ID NO: 490152 - protein, 18 aa, Mycobacterium
GMRDDRPLKRDGTPDDVA

SEQ ID NO: 490153 - protein, 18 aa, Mycobacterium
GMRDDRPLKREGTPEDVA

SEQ ID NO: 490154 - protein, 6 aa, Mycobacterium
GMRERG

SEQ ID NO: 490155 - protein, 8 aa, Mycobacterium
GMRERGDG

SEQ ID NO: 490156 - protein, 4 aa, Mycobacterium
GMRG

SEQ ID NO: 490157 - protein, 11 aa, Mycobacterium
GMRHRADRGAL

SEQ ID NO: 490158 - protein, 8 aa, Mycobacterium
GMRPAEGL

SEQ ID NO: 490159 - protein, 6 aa, Mycobacterium
GMRPSH

SEQ ID NO: 490160 - protein, 10 aa, Mycobacterium
GMRRRTGEVR

SEQ ID NO: 490161 - protein, 11 aa, Mycobacterium
GMSAESGLPTF

SEQ ID NO: 490162 - protein, 8 aa, Mycobacterium
GMSAGNAA

SEQ ID NO: 490163 - protein, 6 aa, Mycobacterium
GMSATG

SEQ ID NO: 490164 - protein, 4 aa, Mycobacterium
GMSD

SEQ ID NO: 490165 - protein, 5 aa, Mycobacterium
GMSDD

SEQ ID NO: 490166 - protein, 11 aa, Mycobacterium
GMSEDDARARI

SEQ ID NO: 490167 - protein, 6 aa, Mycobacterium
GMSEDG

SEQ ID NO: 490168 - protein, 7 aa, Mycobacterium
GMSETAG

SEQ ID NO: 490169 - protein, 11 aa, Mycobacterium
GMSGADQRAGC

SEQ ID NO: 490170 - protein, 5 aa, Mycobacterium
GMSGD

SEQ ID NO: 490171 - protein, 5 aa, Mycobacterium
GMSGG

SEQ ID NO: 490172 - protein, 6 aa, Mycobacterium
GMSGGL

SEQ ID NO: 490173 - protein, 10 aa, Mycobacterium
GMSKLDGSIK

SEQ ID NO: 490174 - protein, 7 aa, Mycobacterium
GMSNTSM

SEQ ID NO: 490175 - protein, 9 aa, Mycobacterium
GMSPADTAD

SEQ ID NO: 490176 - protein, 12 aa, Mycobacterium
GMSPAQAQQAEW

SEQ ID NO: 490177 - protein, 13 aa, Mycobacterium
GMSPSSYRKVYQG

SEQ ID NO: 490178 - protein, 20 aa, Mycobacterium
GMSQSGGDRTYRRHDNLATA

SEQ ID NO: 490179 - protein, 12 aa, Mycobacterium
GMSRAAARARAE

SEQ ID NO: 490180 - protein, 23 aa, Mycobacterium
GMSRAAGNIERIGEASSSVRDHD

SEQ ID NO: 490181 - protein, 5 aa, Mycobacterium
GMSSD

SEQ ID NO: 490182 - protein, 9 aa, Mycobacterium
GMSSDRPLA

SEQ ID NO: 490183 - protein, 8 aa, Mycobacterium
GMSSGKAA

SEQ ID NO: 490184 - protein, 5 aa, Mycobacterium
GMSSQ

SEQ ID NO: 490185 - protein, 52 aa, Mycobacterium
GMSTGGAIGGGMPAAPAPAPASPSPALSAGAQAAPVPATAGGGVPPAAAQSG

SEQ ID NO: 490186 - protein, 5 aa, Mycobacterium
GMSTR

SEQ ID NO: 490187 - protein, 36 aa, Mycobacterium
GMSTSASASAKKKTPEPDTAAAAAARERARARRRRR

SEQ ID NO: 490188 - protein, 18 aa, Mycobacterium
GMTADTGKAGSSAADRAS

SEQ ID NO: 490189 - protein, 5 aa, Mycobacterium
GMTAG

SEQ ID NO: 490190 - protein, 6 aa, Mycobacterium
GMTDEQ

SEQ ID NO: 490191 - protein, 6 aa, Mycobacterium
GMTDGE

SEQ ID NO: 490192 - protein, 4 aa, Mycobacterium
GMTG

SEQ ID NO: 490193 - protein, 5 aa, Mycobacterium
GMTGD

SEQ ID NO: 490194 - protein, 7 aa, Mycobacterium
GMTGESL

SEQ ID NO: 490195 - protein, 9 aa, Mycobacterium
GMTGPRDAR

SEQ ID NO: 490196 - protein, 8 aa, Mycobacterium
GMTGSDHK

SEQ ID NO: 490197 - protein, 5 aa, Mycobacterium
GMTGT

SEQ ID NO: 490198 - protein, 12 aa, Mycobacterium
GMTGTAQTEAAE

SEQ ID NO: 490199 - protein, 11 aa, Mycobacterium
GMTKPGESAVA

SEQ ID NO: 490200 - protein, 5 aa, Mycobacterium
GMTNR

SEQ ID NO: 490201 - protein, 4 aa, Mycobacterium
GMTP

SEQ ID NO: 490202 - protein, 6 aa, Mycobacterium
GMTPGE

SEQ ID NO: 490203 - protein, 5 aa, Mycobacterium
GMTPP

SEQ ID NO: 490204 - protein, 7 aa, Mycobacterium
GMTPPDV

SEQ ID NO: 490205 - protein, 7 aa, Mycobacterium
GMTPPEV

SEQ ID NO: 490206 - protein, 8 aa, Mycobacterium
GMTPPHRR

SEQ ID NO: 490207 - protein, 4 aa, Mycobacterium
GMTR

SEQ ID NO: 490208 - protein, 8 aa, Mycobacterium
GMTRPAES

SEQ ID NO: 490209 - protein, 8 aa, Mycobacterium
GMTSGYSP

SEQ ID NO: 490210 - protein, 14 aa, Mycobacterium
GMTTDEPVVTGTST

SEQ ID NO: 490211 - protein, 11 aa, Mycobacterium
GMYGDESPGAG

SEQ ID NO: 490212 - protein, 18 aa, Mycobacterium
GNAAAAGDSDAWEQTKTD

SEQ ID NO: 490213 - protein, 12 aa, Mycobacterium
GNAAAAGPTTGV

SEQ ID NO: 490214 - protein, 5 aa, Mycobacterium
GNAAD

SEQ ID NO: 490215 - protein, 12 aa, Mycobacterium
GNAADHELQSDD

SEQ ID NO: 490216 - protein, 5 aa, Mycobacterium
GNAAK

SEQ ID NO: 490217 - protein, 16 aa, Mycobacterium
GNAAPAVVSRAGSQLA

SEQ ID NO: 490218 - protein, 8 aa, Mycobacterium
GNAARMDK

SEQ ID NO: 490219 - protein, 6 aa, Mycobacterium
GNAARS

SEQ ID NO: 490220 - protein, 10 aa, Mycobacterium
GNAASLGPLS

SEQ ID NO: 490221 - protein, 6 aa, Mycobacterium
GNADAE

SEQ ID NO: 490222 - protein, 8 aa, Mycobacterium
GNADPTAQ

SEQ ID NO: 490223 - protein, 6 aa, Mycobacterium
GNADRE

SEQ ID NO: 490224 - protein, 9 aa, Mycobacterium
GNADSPGIG

SEQ ID NO: 490225 - protein, 15 aa, Mycobacterium
GNAERAARSSAPDRA

SEQ ID NO: 490226 - protein, 9 aa, Mycobacterium
GNAESLNAS

SEQ ID NO: 490227 - protein, 4 aa, Mycobacterium
GNAG

SEQ ID NO: 490228 - protein, 19 aa, Mycobacterium
GNAGAGGAGGAGGSTNGIG

SEQ ID NO: 490229 - protein, 16 aa, Mycobacterium
GNAGAGGAGGAGGVLD

SEQ ID NO: 490230 - protein, 33 aa, Mycobacterium
GNAGAGGAGGDGGGPVGDLGGNGGIGGDGGAAG

SEQ ID NO: 490231 - protein, 12 aa, Mycobacterium
GNAGAGGAGGPG

SEQ ID NO: 490232 - protein, 38 aa, Mycobacterium
GNAGAGGGGGAGGAVDNHGSGGDYAGGGGAGGSGGAAG

SEQ ID NO: 490233 - protein, 8 aa, Mycobacterium
GNAGAGLT

SEQ ID NO: 490234 - protein, 8 aa, Mycobacterium
GNAGASSS

SEQ ID NO: 490235 - protein, 7 aa, Mycobacterium
GNAGDNN

SEQ ID NO: 490236 - protein, 5 aa, Mycobacterium
GNAGG

SEQ ID NO: 490237 - protein, 6 aa, Mycobacterium
GNAGHE

SEQ ID NO: 490238 - protein, 27 aa, Mycobacterium
GNAGNGGAGGDGWTNGNGGDGGDGGDA

SEQ ID NO: 490239 - protein, 27 aa, Mycobacterium
GNAGNGGAGGDGWTNGNGGDGGDGGDV

SEQ ID NO: 490240 - protein, 8 aa, Mycobacterium
GNAGPGLT

SEQ ID NO: 490241 - protein, 54 aa, Mycobacterium
GNAGPSSTAGNGNVGNGNLGSHNLGSGNTGNDNVGSGNNGNANVGYGNTGEANW

SEQ ID NO: 490242 - protein, 6 aa, Mycobacterium
GNAGSG

SEQ ID NO: 490243 - protein, 13 aa, Mycobacterium
GNAGSGNAGFGNS

SEQ ID NO: 490244 - protein, 15 aa, Mycobacterium
GNAGSINTGGFNGNN

SEQ ID NO: 490245 - protein, 10 aa, Mycobacterium
GNAGSNTAAD

SEQ ID NO: 490246 - protein, 12 aa, Mycobacterium
GNAGSRTHGYGQ

SEQ ID NO: 490247 - protein, 5 aa, Mycobacterium
GNAGT

SEQ ID NO: 490248 - protein, 8 aa, Mycobacterium
GNAGTGVA

SEQ ID NO: 490249 - protein, 6 aa, Mycobacterium
GNAIGD

SEQ ID NO: 490250 - protein, 5 aa, Mycobacterium
GNAIT

SEQ ID NO: 490251 - protein, 9 aa, Mycobacterium
GNAKSPDIG

SEQ ID NO: 490252 - protein, 7 aa, Mycobacterium
GNALGDP

SEQ ID NO: 490253 - protein, 9 aa, Mycobacterium
GNALGGGAE

SEQ ID NO: 490254 - protein, 6 aa, Mycobacterium
GNAMTD

SEQ ID NO: 490255 - protein, 8 aa, Mycobacterium
GNAMTDDT

SEQ ID NO: 490256 - protein, 6 aa, Mycobacterium
GNANPE

SEQ ID NO: 490257 - protein, 7 aa, Mycobacterium
GNANSGG

SEQ ID NO: 490258 - protein, 12 aa, Mycobacterium
GNANTGSLNTGS

SEQ ID NO: 490259 - protein, 9 aa, Mycobacterium
GNANTGYLN

SEQ ID NO: 490260 - protein, 8 aa, Mycobacterium
GNANVGTF

SEQ ID NO: 490261 - protein, 15 aa, Mycobacterium
GNANYGFANSGSVDT

SEQ ID NO: 490262 - protein, 9 aa, Mycobacterium
GNAPAPRRA

SEQ ID NO: 490263 - protein, 7 aa, Mycobacterium
GNAPAVG

SEQ ID NO: 490264 - protein, 18 aa, Mycobacterium
GNAPSDAPDAEKIPVSTD

SEQ ID NO: 490265 - protein, 18 aa, Mycobacterium
GNAPSDPPDAEKIPVTPD

SEQ ID NO: 490266 - protein, 17 aa, Mycobacterium
GNAPSDPPDAERIPVTP

SEQ ID NO: 490267 - protein, 8 aa, Mycobacterium
GNAPSGFD

SEQ ID NO: 490268 - protein, 18 aa, Mycobacterium
GNAPTDPPDAEKVPVTTD

SEQ ID NO: 490269 - protein, 10 aa, Mycobacterium
GNAPTDPVDA

SEQ ID NO: 490270 - protein, 8 aa, Mycobacterium
GNAPTEHV

SEQ ID NO: 490271 - protein, 13 aa, Mycobacterium
GNAQRVLKEALPG

SEQ ID NO: 490272 - protein, 7 aa, Mycobacterium
GNARDRR

SEQ ID NO: 490273 - protein, 7 aa, Mycobacterium
GNARISR

SEQ ID NO: 490274 - protein, 38 aa, Mycobacterium
GNARKPDESCAKDAAAVDPSAPREVRHAQGETEVPEDA

SEQ ID NO: 490275 - protein, 7 aa, Mycobacterium
GNARPAQ

SEQ ID NO: 490276 - protein, 13 aa, Mycobacterium
GNARTSAVDYTES

SEQ ID NO: 490277 - protein, 11 aa, Mycobacterium
GNASADGSTLR

SEQ ID NO: 490278 - protein, 7 aa, Mycobacterium
GNASAPM

SEQ ID NO: 490279 - protein, 7 aa, Mycobacterium
GNASGAV

SEQ ID NO: 490280 - protein, 9 aa, Mycobacterium
GNASGTVGF

SEQ ID NO: 490281 - protein, 6 aa, Mycobacterium
GNASPR

SEQ ID NO: 490282 - protein, 12 aa, Mycobacterium
GNASQSAGATAH

SEQ ID NO: 490283 - protein, 5 aa, Mycobacterium
GNASR

SEQ ID NO: 490284 - protein, 5 aa, Mycobacterium
GNASS

SEQ ID NO: 490285 - protein, 21 aa, Mycobacterium
GNASSLHGSGRAARRRMEEAR

SEQ ID NO: 490286 - protein, 20 aa, Mycobacterium
GNASSLHTSGRAARRRIEES

SEQ ID NO: 490287 - protein, 20 aa, Mycobacterium
GNASSLHTTGRAARRRLEES

SEQ ID NO: 490288 - protein, 15 aa, Mycobacterium
GNASTEIGSTPAGGF

SEQ ID NO: 490289 - protein, 6 aa, Mycobacterium
GNASTV

SEQ ID NO: 490290 - protein, 4 aa, Mycobacterium
GNAT

SEQ ID NO: 490291 - protein, 6 aa, Mycobacterium
GNATAG

SEQ ID NO: 490292 - protein, 11 aa, Mycobacterium
GNATESPEEAD

SEQ ID NO: 490293 - protein, 5 aa, Mycobacterium
GNATS

SEQ ID NO: 490294 - protein, 15 aa, Mycobacterium
GNAYTSGAERLPTTL

SEQ ID NO: 490295 - protein, 8 aa, Mycobacterium
GNCEQTSD

SEQ ID NO: 490296 - protein, 8 aa, Mycobacterium
GNDAEQVA

SEQ ID NO: 490297 - protein, 10 aa, Mycobacterium
GNDAGATTSV

SEQ ID NO: 490298 - protein, 6 aa, Mycobacterium
GNDAGD

SEQ ID NO: 490299 - protein, 9 aa, Mycobacterium
GNDAPPGDV

SEQ ID NO: 490300 - protein, 7 aa, Mycobacterium
GNDATDL

SEQ ID NO: 490301 - protein, 7 aa, Mycobacterium
GNDATVR

SEQ ID NO: 490302 - protein, 10 aa, Mycobacterium
GNDDAASARP

SEQ ID NO: 490303 - protein, 16 aa, Mycobacterium
GNDDDEMGRGSSAEEL

SEQ ID NO: 490304 - protein, 7 aa, Mycobacterium
GNDDEPL

SEQ ID NO: 490305 - protein, 7 aa, Mycobacterium
GNDDEQL

SEQ ID NO: 490306 - protein, 9 aa, Mycobacterium
GNDEKRRLS

SEQ ID NO: 490307 - protein, 14 aa, Mycobacterium
GNDEMRNTLEQNTP

SEQ ID NO: 490308 - protein, 10 aa, Mycobacterium
GNDEPGGGLT

SEQ ID NO: 490309 - protein, 11 aa, Mycobacterium
GNDETTADGSV

SEQ ID NO: 490310 - protein, 11 aa, Mycobacterium
GNDETTADGTV

SEQ ID NO: 490311 - protein, 11 aa, Mycobacterium
GNDETTPDGSV

SEQ ID NO: 490312 - protein, 5 aa, Mycobacterium
GNDFY

SEQ ID NO: 490313 - protein, 9 aa, Mycobacterium
GNDGAVPGT

SEQ ID NO: 490314 - protein, 8 aa, Mycobacterium
GNDGEPFD

SEQ ID NO: 490315 - protein, 7 aa, Mycobacterium
GNDGGLN

SEQ ID NO: 490316 - protein, 6 aa, Mycobacterium
GNDGNA

SEQ ID NO: 490317 - protein, 6 aa, Mycobacterium
GNDGQA

SEQ ID NO: 490318 - protein, 4 aa, Mycobacterium
GNDH

SEQ ID NO: 490319 - protein, 11 aa, Mycobacterium
GNDHDGARRIA

SEQ ID NO: 490320 - protein, 21 aa, Mycobacterium
GNDNTVRAGGNPAVAGGATSN

SEQ ID NO: 490321 - protein, 4 aa, Mycobacterium
GNDP

SEQ ID NO: 490322 - protein, 8 aa, Mycobacterium
GNDPARIR

SEQ ID NO: 490323 - protein, 13 aa, Mycobacterium
GNDPAVSVTDAQG

SEQ ID NO: 490324 - protein, 6 aa, Mycobacterium
GNDPFD

SEQ ID NO: 490325 - protein, 7 aa, Mycobacterium
GNDPFGV

SEQ ID NO: 490326 - protein, 8 aa, Mycobacterium
GNDPSHPG

SEQ ID NO: 490327 - protein, 9 aa, Mycobacterium
GNDPVSGKP

SEQ ID NO: 490328 - protein, 5 aa, Mycobacterium
GNDQV

SEQ ID NO: 490329 - protein, 4 aa, Mycobacterium
GNDR

SEQ ID NO: 490330 - protein, 7 aa, Mycobacterium
GNDRNTF

SEQ ID NO: 490331 - protein, 5 aa, Mycobacterium
GNDRQ

SEQ ID NO: 490332 - protein, 7 aa, Mycobacterium
GNDRRGI

SEQ ID NO: 490333 - protein, 40 aa, Mycobacterium
GNDRRPDESCAPEPARLDDGPPDREVRNADAHGVTPPIPE

SEQ ID NO: 490334 - protein, 4 aa, Mycobacterium
GNDS

SEQ ID NO: 490335 - protein, 5 aa, Mycobacterium
GNDSA

SEQ ID NO: 490336 - protein, 8 aa, Mycobacterium
GNDSNAVA

SEQ ID NO: 490337 - protein, 9 aa, Mycobacterium
GNDSPVSRA

SEQ ID NO: 490338 - protein, 7 aa, Mycobacterium
GNDSRTA

SEQ ID NO: 490339 - protein, 16 aa, Mycobacterium
GNDSTDPGDSPSADAF

SEQ ID NO: 490340 - protein, 9 aa, Mycobacterium
GNDTAARAR

SEQ ID NO: 490341 - protein, 6 aa, Mycobacterium
GNDTES

SEQ ID NO: 490342 - protein, 7 aa, Mycobacterium
GNDTESI

SEQ ID NO: 490343 - protein, 7 aa, Mycobacterium
GNDTEYG

SEQ ID NO: 490344 - protein, 7 aa, Mycobacterium
GNDTGGG

SEQ ID NO: 490345 - protein, 9 aa, Mycobacterium
GNDTNAGAR

SEQ ID NO: 490346 - protein, 12 aa, Mycobacterium
GNDTTRQATSHT

SEQ ID NO: 490347 - protein, 10 aa, Mycobacterium
GNDTTRTTTT

SEQ ID NO: 490348 - protein, 4 aa, Mycobacterium
GNDW

SEQ ID NO: 490349 - protein, 17 aa, Mycobacterium
GNEAGLGNEAGLGNEDV

SEQ ID NO: 490350 - protein, 14 aa, Mycobacterium
GNECPGSGPATTAT

SEQ ID NO: 490351 - protein, 9 aa, Mycobacterium
GNEDGAHKI

SEQ ID NO: 490352 - protein, 6 aa, Mycobacterium
GNEDPA

SEQ ID NO: 490353 - protein, 7 aa, Mycobacterium
GNEDPQI

SEQ ID NO: 490354 - protein, 6 aa, Mycobacterium
GNEDSV

SEQ ID NO: 490355 - protein, 11 aa, Mycobacterium
GNEDTAERYRH

SEQ ID NO: 490356 - protein, 5 aa, Mycobacterium
GNEDV

SEQ ID NO: 490357 - protein, 12 aa, Mycobacterium
GNEEATAATIEP

SEQ ID NO: 490358 - protein, 7 aa, Mycobacterium
GNEEQRE

SEQ ID NO: 490359 - protein, 8 aa, Mycobacterium
GNEEQRRW

SEQ ID NO: 490360 - protein, 6 aa, Mycobacterium
GNEESL

SEQ ID NO: 490361 - protein, 7 aa, Mycobacterium
GNEEVNC

SEQ ID NO: 490362 - protein, 4 aa, Mycobacterium
GNEG

SEQ ID NO: 490363 - protein, 15 aa, Mycobacterium
GNEGGPEAAARTARY

SEQ ID NO: 490364 - protein, 5 aa, Mycobacterium
GNEHV

SEQ ID NO: 490365 - protein, 5 aa, Mycobacterium
GNEIP

SEQ ID NO: 490366 - protein, 6 aa, Mycobacterium
GNEISS

SEQ ID NO: 490367 - protein, 4 aa, Mycobacterium
GNEL

SEQ ID NO: 490368 - protein, 7 aa, Mycobacterium
GNENGSH

SEQ ID NO: 490369 - protein, 11 aa, Mycobacterium
GNENNVTASAF

SEQ ID NO: 490370 - protein, 17 aa, Mycobacterium
GNEPDRVPALHNVFVPI

SEQ ID NO: 490371 - protein, 6 aa, Mycobacterium
GNEPGR

SEQ ID NO: 490372 - protein, 7 aa, Mycobacterium
GNEPISI

SEQ ID NO: 490373 - protein, 10 aa, Mycobacterium
GNEPPDLDDS

SEQ ID NO: 490374 - protein, 9 aa, Mycobacterium
GNEQGTVSR

SEQ ID NO: 490375 - protein, 6 aa, Mycobacterium
GNEQQR

SEQ ID NO: 490376 - protein, 5 aa, Mycobacterium
GNERM

SEQ ID NO: 490377 - protein, 8 aa, Mycobacterium
GNERSGSR

SEQ ID NO: 490378 - protein, 16 aa, Mycobacterium
GNESHRAGGHAQEGAD

SEQ ID NO: 490379 - protein, 23 aa, Mycobacterium
GNESHRAGGHAQEGADQLARGPL

SEQ ID NO: 490380 - protein, 6 aa, Mycobacterium
GNESIG

SEQ ID NO: 490381 - protein, 12 aa, Mycobacterium
GNESTDGSGGAV

SEQ ID NO: 490382 - protein, 16 aa, Mycobacterium
GNETALAADADARAEL

SEQ ID NO: 490383 - protein, 9 aa, Mycobacterium
GNETSRNAI

SEQ ID NO: 490384 - protein, 10 aa, Mycobacterium
GNETTRNATT

SEQ ID NO: 490385 - protein, 7 aa, Mycobacterium
GNEVGTA

SEQ ID NO: 490386 - protein, 7 aa, Mycobacterium
GNEVTGA

SEQ ID NO: 490387 - protein, 4 aa, Mycobacterium
GNEY

SEQ ID NO: 490388 - protein, 7 aa, Mycobacterium
GNEYDRS

SEQ ID NO: 490389 - protein, 7 aa, Mycobacterium
GNFDTPS

SEQ ID NO: 490390 - protein, 4 aa, Mycobacterium
GNFE

SEQ ID NO: 490391 - protein, 4 aa, Mycobacterium
GNFG

SEQ ID NO: 490392 - protein, 6 aa, Mycobacterium
GNFGAP

SEQ ID NO: 490393 - protein, 12 aa, Mycobacterium
GNFGNSNSGGFN

SEQ ID NO: 490394 - protein, 5 aa, Mycobacterium
GNFGQ

SEQ ID NO: 490395 - protein, 7 aa, Mycobacterium
GNFNEPD

SEQ ID NO: 490396 - protein, 4 aa, Mycobacterium
GNFP

SEQ ID NO: 490397 - protein, 13 aa, Mycobacterium
GNFPGEDADPAVE

SEQ ID NO: 490398 - protein, 6 aa, Mycobacterium
GNFPTT

SEQ ID NO: 490399 - protein, 7 aa, Mycobacterium
GNFRQAG

SEQ ID NO: 490400 - protein, 13 aa, Mycobacterium
GNGAAQVAQARRG

SEQ ID NO: 490401 - protein, 5 aa, Mycobacterium
GNGAD

SEQ ID NO: 490402 - protein, 18 aa, Mycobacterium
GNGADGAAGTGENGGDGG

SEQ ID NO: 490403 - protein, 17 aa, Mycobacterium
GNGADGAAPGQSGDDGG

SEQ ID NO: 490404 - protein, 18 aa, Mycobacterium
GNGADGAPGTGANGGPGG

SEQ ID NO: 490405 - protein, 17 aa, Mycobacterium
GNGADGSAPGQAGAPGG

SEQ ID NO: 490406 - protein, 16 aa, Mycobacterium
GNGADGTAANPNGGAG

SEQ ID NO: 490407 - protein, 17 aa, Mycobacterium
GNGADGTATSPNGGAGG

SEQ ID NO: 490408 - protein, 18 aa, Mycobacterium
GNGANGAAGTGAAGGDGG

SEQ ID NO: 490409 - protein, 17 aa, Mycobacterium
GNGANGAAGTGANGGAA

SEQ ID NO: 490410 - protein, 18 aa, Mycobacterium
GNGANGAPGTGADGAPGG

SEQ ID NO: 490411 - protein, 18 aa, Mycobacterium
GNGANGAPGTGANGAPGG

SEQ ID NO: 490412 - protein, 18 aa, Mycobacterium
GNGANGAPGTGANGGAGG

SEQ ID NO: 490413 - protein, 17 aa, Mycobacterium
GNGANGAPGTGQNGGDA

SEQ ID NO: 490414 - protein, 18 aa, Mycobacterium
GNGANGAPGTGQNGGPGG

SEQ ID NO: 490415 - protein, 17 aa, Mycobacterium
GNGANGVPGTGANGAAG

SEQ ID NO: 490416 - protein, 8 aa, Mycobacterium
GNGAQAER

SEQ ID NO: 490417 - protein, 7 aa, Mycobacterium
GNGAQYD

SEQ ID NO: 490418 - protein, 6 aa, Mycobacterium
GNGASG

SEQ ID NO: 490419 - protein, 9 aa, Mycobacterium
GNGASTDEH

SEQ ID NO: 490420 - protein, 5 aa, Mycobacterium
GNGAT

SEQ ID NO: 490421 - protein, 25 aa, Mycobacterium
GNGAVGGAGGIGTTDGGAGGQGGNA

SEQ ID NO: 490422 - protein, 10 aa, Mycobacterium
GNGAYAAAKA

SEQ ID NO: 490423 - protein, 4 aa, Mycobacterium
GNGD

SEQ ID NO: 490424 - protein, 16 aa, Mycobacterium
GNGDCDAATNPRPPRE

SEQ ID NO: 490425 - protein, 18 aa, Mycobacterium
GNGDDGVAGTGQSGGDGG

SEQ ID NO: 490426 - protein, 15 aa, Mycobacterium
GNGDDPHVVDMIRTY

SEQ ID NO: 490427 - protein, 6 aa, Mycobacterium
GNGDEQ

SEQ ID NO: 490428 - protein, 12 aa, Mycobacterium
GNGDGLALQGSR

SEQ ID NO: 490429 - protein, 10 aa, Mycobacterium
GNGDPAEPRK

SEQ ID NO: 490430 - protein, 10 aa, Mycobacterium
GNGDPTEPRK

SEQ ID NO: 490431 - protein, 6 aa, Mycobacterium
GNGDRA

SEQ ID NO: 490432 - protein, 9 aa, Mycobacterium
GNGDTARRA

SEQ ID NO: 490433 - protein, 9 aa, Mycobacterium
GNGDVSATA

SEQ ID NO: 490434 - protein, 7 aa, Mycobacterium
GNGEEAH

SEQ ID NO: 490435 - protein, 8 aa, Mycobacterium
GNGEEPEW

SEQ ID NO: 490436 - protein, 7 aa, Mycobacterium
GNGEKRT

SEQ ID NO: 490437 - protein, 8 aa, Mycobacterium
GNGEMTGT

SEQ ID NO: 490438 - protein, 39 aa, Mycobacterium
GNGGAGANGGNTGNPGNLNGGGTGSVYQTSNGGNGGQGG

SEQ ID NO: 490439 - protein, 22 aa, Mycobacterium
GNGGAGGAGGAAAAGGSGGQGG

SEQ ID NO: 490440 - protein, 28 aa, Mycobacterium
GNGGAGGAGGAAGGGLGNGGNGGNGGEA

SEQ ID NO: 490441 - protein, 21 aa, Mycobacterium
GNGGAGGAGGAGATGGVGGSG

SEQ ID NO: 490442 - protein, 43 aa, Mycobacterium
GNGGAGGAGGAGGMGGMGGTGASIGGGGGTGGAGGTGAAGGDG

SEQ ID NO: 490443 - protein, 34 aa, Mycobacterium
GNGGAGGAGGAGSASGPSGYSGGNGGNGGNGGAA

SEQ ID NO: 490444 - protein, 26 aa, Mycobacterium
GNGGAGGAGGASTVGTGAAGGAGGAG

SEQ ID NO: 490445 - protein, 98 aa, Mycobacterium
GNGGAGGAGGDGTAGAAGVNPTTMPAGNGTPGLTGRDTGGPGGPGADGTEYGQTGGTGGTGGYGRVEGGDGGVGGVGGQGAPGGVGGSGGAGGGGGHG

SEQ ID NO: 490446 - protein, 77 aa, Mycobacterium
GNGGAGGAGGDRVAGSQGNGGDGGDGGHGGTYFGSGGAGGHGGYDDSGSGGQGGHGGDGGAAGTIGNGGDGGTGGDA

SEQ ID NO: 490447 - protein, 24 aa, Mycobacterium
GNGGAGGAGGGAGVSGGTGGNGGA

SEQ ID NO: 490448 - protein, 34 aa, Mycobacterium
GNGGAGGAGGGGGAAPVSGAAAAGGAGGGGGAGG

SEQ ID NO: 490449 - protein, 24 aa, Mycobacterium
GNGGAGGAGGHGPTDGGAGGTGGN

SEQ ID NO: 490450 - protein, 11 aa, Mycobacterium
GNGGAGGAGGM

SEQ ID NO: 490451 - protein, 33 aa, Mycobacterium
GNGGAGGAGGNGSAAGYNGYSGNGGNGGNGGAA

SEQ ID NO: 490452 - protein, 33 aa, Mycobacterium
GNGGAGGAGGNGSTGGVGLAGGDGGAGGAGGRA

SEQ ID NO: 490453 - protein, 24 aa, Mycobacterium
GNGGAGGAGGQGGNDGGAGGLGGN

SEQ ID NO: 490454 - protein, 25 aa, Mycobacterium
GNGGAGGAGGSGAATGGSGGTGGSS

SEQ ID NO: 490455 - protein, 22 aa, Mycobacterium
GNGGAGGAGGTGQTQGGAGGAG

SEQ ID NO: 490456 - protein, 21 aa, Mycobacterium
GNGGAGGAGVAGIGGNGGNTF

SEQ ID NO: 490457 - protein, 28 aa, Mycobacterium
GNGGAGGDAGTSGSSRNFGDGGNGGDAQ

SEQ ID NO: 490458 - protein, 11 aa, Mycobacterium
GNGGAGGDAGV

SEQ ID NO: 490459 - protein, 57 aa, Mycobacterium
GNGGAGGDGANGAAGGAGGDGGMLSGNGGNGGAGGDLNDPAVPTGSQVGGRGGNAGL

SEQ ID NO: 490460 - protein, 54 aa, Mycobacterium
GNGGAGGDSTQGAGGMGGAGGAGGALASIGGAGGAGGTGTTSGGDGGVGGEGSG

SEQ ID NO: 490461 - protein, 21 aa, Mycobacterium
GNGGAGGEGGEGDGAGGVGGN

SEQ ID NO: 490462 - protein, 20 aa, Mycobacterium
GNGGAGGGATMSDAGDGGDA

SEQ ID NO: 490463 - protein, 21 aa, Mycobacterium
GNGGAGGGGGAGALGGNGGAG

SEQ ID NO: 490464 - protein, 27 aa, Mycobacterium
GNGGAGGGGGSGSTTAGGGGSGGDAGA

SEQ ID NO: 490465 - protein, 35 aa, Mycobacterium
GNGGAGGHGGFGGTATAPVGDGGVGGNGGAGGNGG

SEQ ID NO: 490466 - protein, 39 aa, Mycobacterium
GNGGAGGHGGSGLAGNSGVNPTPTHDTALNGADGDSNIY

SEQ ID NO: 490467 - protein, 39 aa, Mycobacterium
GNGGAGGNGGLGVTTNGGKGGAGGAGGLFGSGGAGGNGG

SEQ ID NO: 490468 - protein, 13 aa, Mycobacterium
GNGGAGGNGGPAG

SEQ ID NO: 490469 - protein, 24 aa, Mycobacterium
GNGGAGGPAKPSSNQAAGGNGGAG

SEQ ID NO: 490470 - protein, 34 aa, Mycobacterium
GNGGAGGSGGAGAAASGSGDGGDGGAGGAGGSGG

SEQ ID NO: 490471 - protein, 34 aa, Mycobacterium
GNGGAGGSGGAGVPPATGGFGGRGGRLFGSPGAQ

SEQ ID NO: 490472 - protein, 39 aa, Mycobacterium
GNGGAGGSGQFGVGASSAGGIGGNGGRVIGDGGDGGVGG

SEQ ID NO: 490473 - protein, 28 aa, Mycobacterium
GNGGAGGTGGISRNGNGGDGGAGGSGGE

SEQ ID NO: 490474 - protein, 13 aa, Mycobacterium
GNGGAGGVGGAAY

SEQ ID NO: 490475 - protein, 33 aa, Mycobacterium
GNGGAGGVGGAGNTNQVSGYSGNGGNGGNGGAA

SEQ ID NO: 490476 - protein, 27 aa, Mycobacterium
GNGGAGGVGGVGRNANAGGSGGSGGNA

SEQ ID NO: 490477 - protein, 73 aa, Mycobacterium
GNGGASGTGGAGGAGGAGGAGGAGGAGGTSSVSGNIGAVGGNGGVGGDGGDGGDGGDGGAAGAAGGAGGQGGF

SEQ ID NO: 490478 - protein, 9 aa, Mycobacterium
GNGGATPAH

SEQ ID NO: 490479 - protein, 25 aa, Mycobacterium
GNGGDGGAAGTSIGQSASGGNGGNA

SEQ ID NO: 490480 - protein, 40 aa, Mycobacterium
GNGGDGGAGAPGGNSAPPGDGGVGGAGGTLSGTPGATGAS

SEQ ID NO: 490481 - protein, 26 aa, Mycobacterium
GNGGDGGAGGAGANLDGGNGGLGGNA

SEQ ID NO: 490482 - protein, 14 aa, Mycobacterium
GNGGDGGHGGSGAL

SEQ ID NO: 490483 - protein, 42 aa, Mycobacterium
GNGGDGGNGAPGVLGPAGTAPIPPSSLPAATGTRGDSPPYGY

SEQ ID NO: 490484 - protein, 11 aa, Mycobacterium
GNGGDGGPGIF

SEQ ID NO: 490485 - protein, 91 aa, Mycobacterium
GNGGDGGRGGDALSDYSTVTGPSATGGNGGAGHDGHIGGGAGGTGGAGGNGTSADGVGHGGNGGIGGNGNSASNGGGDGGNGGAGGTGGHG

SEQ ID NO: 490486 - protein, 107 aa, Mycobacterium
GNGGDGGTGGQGADGGAGISASAQGGFGTAGGDGGAGGVGGTGGQGGTQAGNGGVGGAGGAGGKGADGGNGANGDSGNGVGSDGFAGGNGGAGGSGGTGGDGGAGGL

SEQ ID NO: 490487 - protein, 12 aa, Mycobacterium
GNGGDSDEAAAS

SEQ ID NO: 490488 - protein, 21 aa, Mycobacterium
GNGGGGGAGGPGAAGGAGGAG

SEQ ID NO: 490489 - protein, 19 aa, Mycobacterium
GNGGGGGAGGVGGAGGAGI

SEQ ID NO: 490490 - protein, 21 aa, Mycobacterium
GNGGGGGGGGAGGGAGGLGGD

SEQ ID NO: 490491 - protein, 19 aa, Mycobacterium
GNGGGGGSSFLGGGGNGGR

SEQ ID NO: 490492 - protein, 13 aa, Mycobacterium
GNGGGGGTGGAGF

SEQ ID NO: 490493 - protein, 27 aa, Mycobacterium
GNGGGGGVGGFGATQGGDGGDGGATGI

SEQ ID NO: 490494 - protein, 14 aa, Mycobacterium
GNGGGTTYKLPDGS

SEQ ID NO: 490495 - protein, 7 aa, Mycobacterium
GNGGHGG

SEQ ID NO: 490496 - protein, 29 aa, Mycobacterium
GNGGHGGAGGGGGTGGAGGAGGTSGDGVT

SEQ ID NO: 490497 - protein, 9 aa, Mycobacterium
GNGGHGGHA

SEQ ID NO: 490498 - protein, 13 aa, Mycobacterium
GNGGIGGAGGYGE

SEQ ID NO: 490499 - protein, 33 aa, Mycobacterium
GNGGIGGHGGDGGAAIGTGTDGGNGGNGGLAGA

SEQ ID NO: 490500 - protein, 21 aa, Mycobacterium
GNGGIGGQGGPGGTGGAGGGA

SEQ ID NO: 490501 - protein, 16 aa, Mycobacterium
GNGGILSEQTTLVLEG

SEQ ID NO: 490502 - protein, 21 aa, Mycobacterium
GNGGLGGNGFGGGTGGMGGTG

SEQ ID NO: 490503 - protein, 6 aa, Mycobacterium
GNGGLT

SEQ ID NO: 490504 - protein, 13 aa, Mycobacterium
GNGGMGGAGGEGF

SEQ ID NO: 490505 - protein, 8 aa, Mycobacterium
GNGGMTPR

SEQ ID NO: 490506 - protein, 23 aa, Mycobacterium
GNGGNAGQGAGGPANGGDGGNVG

SEQ ID NO: 490507 - protein, 22 aa, Mycobacterium
GNGGNGAAGGPNQAGGAGGNAG

SEQ ID NO: 490508 - protein, 21 aa, Mycobacterium
GNGGNGAAGMTPGVAGGAGGV

SEQ ID NO: 490509 - protein, 12 aa, Mycobacterium
GNGGNGFSQATA

SEQ ID NO: 490510 - protein, 24 aa, Mycobacterium
GNGGNGGAGAVGGAGGNGADGGIG

SEQ ID NO: 490511 - protein, 130 aa, Mycobacterium
GNGGNGGAGGAGYAADGPAGPAIGNGGDGGRGGAGGFYGNGGAGGAGGNSAPGGGNGGNGGTGGDSGAMGSSGGRGGDGGVGTNGGAGGGGGNATSYGTANATGGAGGDGGAGSRGTGGTGGAGGGGGAA

SEQ ID NO: 490512 - protein, 37 aa, Mycobacterium
GNGGNGGAGGTAAPGGTDGTSGAAGKGGVLFGTDGAT

SEQ ID NO: 490513 - protein, 19 aa, Mycobacterium
GNGGNGGAGGVANGGMGAG

SEQ ID NO: 490514 - protein, 14 aa, Mycobacterium
GNGGNGGDGGTSGW

SEQ ID NO: 490515 - protein, 23 aa, Mycobacterium
GNGGNGGIGGTGPTTGTTGAGGI

SEQ ID NO: 490516 - protein, 13 aa, Mycobacterium
GNGGNGGNAGSIP

SEQ ID NO: 490517 - protein, 25 aa, Mycobacterium
GNGGNGGNAGTGTTAGGPGAGGTGG

SEQ ID NO: 490518 - protein, 24 aa, Mycobacterium
GNGGNGGNGGAGSTDGEGGQGGAA

SEQ ID NO: 490519 - protein, 36 aa, Mycobacterium
GNGGNGGNGGLGPPNGNGGLGGAGGSLLGQPGLTGT

SEQ ID NO: 490520 - protein, 26 aa, Mycobacterium
GNGGNGGNGGSGQPDNGNAGAAGAGG

SEQ ID NO: 490521 - protein, 13 aa, Mycobacterium
GNGGNGGNGGTGL

SEQ ID NO: 490522 - protein, 21 aa, Mycobacterium
GNGGNGGTGGWSGHGGAGGRG

SEQ ID NO: 490523 - protein, 19 aa, Mycobacterium
GNGGNGGTGVLGGNGGDAR

SEQ ID NO: 490524 - protein, 34 aa, Mycobacterium
GNGGNGGVGTATTGTGGQGGDGGQLIGVPGNPGL

SEQ ID NO: 490525 - protein, 8 aa, Mycobacterium
GNGGNNTG

SEQ ID NO: 490526 - protein, 17 aa, Mycobacterium
GNGGPGGAGGGSPLPEN

SEQ ID NO: 490527 - protein, 31 aa, Mycobacterium
GNGGPGGTGGVSGPSPSGGDGGKGGSGGDAG

SEQ ID NO: 490528 - protein, 16 aa, Mycobacterium
GNGGRGGDSTLAGVAG

SEQ ID NO: 490529 - protein, 5 aa, Mycobacterium
GNGGS

SEQ ID NO: 490530 - protein, 10 aa, Mycobacterium
GNGGSATING

SEQ ID NO: 490531 - protein, 22 aa, Mycobacterium
GNGGSGAAGAAGQAGGAGGAAG

SEQ ID NO: 490532 - protein, 46 aa, Mycobacterium
GNGGSGAAGTNTGVAGGAGGDAGLIGNGGSGGAGGGGAAGGAGGNG

SEQ ID NO: 490533 - protein, 28 aa, Mycobacterium
GNGGSGGAGGAGGIGTFAGGPGGIGGNA

SEQ ID NO: 490534 - protein, 15 aa, Mycobacterium
GNGGSGGAGGKGGVA

SEQ ID NO: 490535 - protein, 51 aa, Mycobacterium
GNGGSGGNGGIGQAGGAGGDAGLIGNGGSGGIGGPDSTGLPGGAGGGPADG

SEQ ID NO: 490536 - protein, 6 aa, Mycobacterium
GNGGSI

SEQ ID NO: 490537 - protein, 11 aa, Mycobacterium
GNGGSSTDAAT

SEQ ID NO: 490538 - protein, 29 aa, Mycobacterium
GNGGTGGAGGASNMGGDGGMGGTGGTGGF

SEQ ID NO: 490539 - protein, 55 aa, Mycobacterium
GNGGTGGAGGFGPTGGAGGAGGAGGTLSGSGGDGGIGGYGAGGDGGGAGGAGGDA

SEQ ID NO: 490540 - protein, 58 aa, Mycobacterium
GNGGTGGAGGLGPIGGAGGNGGGGGLIGNGGNGGAGGAASATVGTPAPGVGGNGGAAG

SEQ ID NO: 490541 - protein, 23 aa, Mycobacterium
GNGGTGGAGGSGTTSYGAAGVGG

SEQ ID NO: 490542 - protein, 38 aa, Mycobacterium
GNGGTGGAGGTGVTGTPGAAGESGGTGGTGGAGGLGGH

SEQ ID NO: 490543 - protein, 29 aa, Mycobacterium
GNGGTGGNGGVGGHGGDGGAGGEGGSGSL

SEQ ID NO: 490544 - protein, 21 aa, Mycobacterium
GNGGTGGTGGEGAAGGLGGRG

SEQ ID NO: 490545 - protein, 11 aa, Mycobacterium
GNGGTGGTGGF

SEQ ID NO: 490546 - protein, 26 aa, Mycobacterium
GNGGTGGTGGFSGSGLGGDGGYGGTA

SEQ ID NO: 490547 - protein, 6 aa, Mycobacterium
GNGGTL

SEQ ID NO: 490548 - protein, 53 aa, Mycobacterium
GNGGVGGNAPQGTGGIGGAGGAGGALSAVGGTGGTGGSGGVAGGDGGAGGAGR

SEQ ID NO: 490549 - protein, 32 aa, Mycobacterium
GNGGVGGNGGFSGPITAGGAGGTGGTGGSAGL

SEQ ID NO: 490550 - protein, 42 aa, Mycobacterium
GNGGVGGTGGNSLGTGGGMGGAGGQSGVFGDGGAGGTGGDSV

SEQ ID NO: 490551 - protein, 22 aa, Mycobacterium
GNGGVGGVGGIGGGVGGVGGTG

SEQ ID NO: 490552 - protein, 7 aa, Mycobacterium
GNGHNGI

SEQ ID NO: 490553 - protein, 15 aa, Mycobacterium
GNGHSEIDYSDEYRK

SEQ ID NO: 490554 - protein, 15 aa, Mycobacterium
GNGIGGEAYRTDPVD

SEQ ID NO: 490555 - protein, 7 aa, Mycobacterium
GNGISAE

SEQ ID NO: 490556 - protein, 8 aa, Mycobacterium
GNGKPNYR

SEQ ID NO: 490557 - protein, 8 aa, Mycobacterium
GNGLGTEM

SEQ ID NO: 490558 - protein, 14 aa, Mycobacterium
GNGLKDPDNALSGM

SEQ ID NO: 490559 - protein, 12 aa, Mycobacterium
GNGLKDPDTALK

SEQ ID NO: 490560 - protein, 13 aa, Mycobacterium
GNGLKDPDTALKG

SEQ ID NO: 490561 - protein, 9 aa, Mycobacterium
GNGLPAAPL

SEQ ID NO: 490562 - protein, 9 aa, Mycobacterium
GNGLPPAEP

SEQ ID NO: 490563 - protein, 4 aa, Mycobacterium
GNGN

SEQ ID NO: 490564 - protein, 5 aa, Mycobacterium
GNGNF

SEQ ID NO: 490565 - protein, 14 aa, Mycobacterium
GNGNFGIGNTGDFN

SEQ ID NO: 490566 - protein, 9 aa, Mycobacterium
GNGNGPEYV

SEQ ID NO: 490567 - protein, 7 aa, Mycobacterium
GNGNIGA

SEQ ID NO: 490568 - protein, 20 aa, Mycobacterium
GNGNIGDGNIGSNNAGFGNV

SEQ ID NO: 490569 - protein, 8 aa, Mycobacterium
GNGNREAA

SEQ ID NO: 490570 - protein, 9 aa, Mycobacterium
GNGNRGDLN

SEQ ID NO: 490571 - protein, 15 aa, Mycobacterium
GNGNTGDNNLGSGNI

SEQ ID NO: 490572 - protein, 5 aa, Mycobacterium
GNGNV

SEQ ID NO: 490573 - protein, 7 aa, Mycobacterium
GNGPGEI

SEQ ID NO: 490574 - protein, 6 aa, Mycobacterium
GNGPIS

SEQ ID NO: 490575 - protein, 8 aa, Mycobacterium
GNGPPSWA

SEQ ID NO: 490576 - protein, 6 aa, Mycobacterium
GNGPRV

SEQ ID NO: 490577 - protein, 8 aa, Mycobacterium
GNGPSFCS

SEQ ID NO: 490578 - protein, 8 aa, Mycobacterium
GNGPVAQR

SEQ ID NO: 490579 - protein, 6 aa, Mycobacterium
GNGPVS

SEQ ID NO: 490580 - protein, 7 aa, Mycobacterium
GNGQQAL

SEQ ID NO: 490581 - protein, 8 aa, Mycobacterium
GNGQQALD

SEQ ID NO: 490582 - protein, 5 aa, Mycobacterium
GNGQY

SEQ ID NO: 490583 - protein, 13 aa, Mycobacterium
GNGRDGAAQVEAR

SEQ ID NO: 490584 - protein, 5 aa, Mycobacterium
GNGRG

SEQ ID NO: 490585 - protein, 8 aa, Mycobacterium
GNGRRRAE

SEQ ID NO: 490586 - protein, 5 aa, Mycobacterium
GNGRY

SEQ ID NO: 490587 - protein, 7 aa, Mycobacterium
GNGRYAR

SEQ ID NO: 490588 - protein, 14 aa, Mycobacterium
GNGRYRAQAPAGMY

SEQ ID NO: 490589 - protein, 10 aa, Mycobacterium
GNGSADTDTP

SEQ ID NO: 490590 - protein, 7 aa, Mycobacterium
GNGSGLG

SEQ ID NO: 490591 - protein, 8 aa, Mycobacterium
GNGSITPI

SEQ ID NO: 490592 - protein, 18 aa, Mycobacterium
GNGSNGAPGTGAPGGDGG

SEQ ID NO: 490593 - protein, 16 aa, Mycobacterium
GNGSNGTYPGQDGRDG

SEQ ID NO: 490594 - protein, 7 aa, Mycobacterium
GNGSRKH

SEQ ID NO: 490595 - protein, 15 aa, Mycobacterium
GNGSSENRQTVAAPA

SEQ ID NO: 490596 - protein, 14 aa, Mycobacterium
GNGSSGEGSDAEDL

SEQ ID NO: 490597 - protein, 4 aa, Mycobacterium
GNGT

SEQ ID NO: 490598 - protein, 18 aa, Mycobacterium
GNGTDGAAGTGANGGDGG

SEQ ID NO: 490599 - protein, 17 aa, Mycobacterium
GNGTDGAAGTGQAGGAG

SEQ ID NO: 490600 - protein, 18 aa, Mycobacterium
GNGTDGAPGTGADGGAGG

SEQ ID NO: 490601 - protein, 17 aa, Mycobacterium
GNGTDGLAGTGAAGGAG

SEQ ID NO: 490602 - protein, 16 aa, Mycobacterium
GNGTDGTAANPNGGAG

SEQ ID NO: 490603 - protein, 18 aa, Mycobacterium
GNGTNGAPGTGQAGGPGG

SEQ ID NO: 490604 - protein, 19 aa, Mycobacterium
GNGTNGLPNTGQDGGPGGL

SEQ ID NO: 490605 - protein, 16 aa, Mycobacterium
GNGTNGTAANPNGGAG

SEQ ID NO: 490606 - protein, 17 aa, Mycobacterium
GNGTPAAAGSGADGAAG

SEQ ID NO: 490607 - protein, 17 aa, Mycobacterium
GNGTPGAAGSGAAGTAG

SEQ ID NO: 490608 - protein, 18 aa, Mycobacterium
GNGTPGAAGSGTDGTPGG

SEQ ID NO: 490609 - protein, 17 aa, Mycobacterium
GNGTPGAAGTGAIGTPG

SEQ ID NO: 490610 - protein, 18 aa, Mycobacterium
GNGTPGATGSGADGTPGG

SEQ ID NO: 490611 - protein, 18 aa, Mycobacterium
GNGTPGDAGSGTDGTPGG

SEQ ID NO: 490612 - protein, 16 aa, Mycobacterium
GNGTPSEIGEGSLPGQ

SEQ ID NO: 490613 - protein, 5 aa, Mycobacterium
GNGVP

SEQ ID NO: 490614 - protein, 5 aa, Mycobacterium
GNGWR

SEQ ID NO: 490615 - protein, 6 aa, Mycobacterium
GNGWTS

SEQ ID NO: 490616 - protein, 5 aa, Mycobacterium
GNGYR

SEQ ID NO: 490617 - protein, 10 aa, Mycobacterium
GNGYRDYTDD

SEQ ID NO: 490618 - protein, 15 aa, Mycobacterium
GNGYTEDDVRAGARA

SEQ ID NO: 490619 - protein, 5 aa, Mycobacterium
GNHAQ

SEQ ID NO: 490620 - protein, 4 aa, Mycobacterium
GNHC

SEQ ID NO: 490621 - protein, 4 aa, Mycobacterium
GNHD

SEQ ID NO: 490622 - protein, 5 aa, Mycobacterium
GNHED

SEQ ID NO: 490623 - protein, 14 aa, Mycobacterium
GNHENEWGNGPIGY

SEQ ID NO: 490624 - protein, 6 aa, Mycobacterium
GNHGYG

SEQ ID NO: 490625 - protein, 27 aa, Mycobacterium
GNHNSGSFNVGTESTGFGNSGAGNTGF

SEQ ID NO: 490626 - protein, 7 aa, Mycobacterium
GNHPGNL

SEQ ID NO: 490627 - protein, 5 aa, Mycobacterium
GNHPH

SEQ ID NO: 490628 - protein, 9 aa, Mycobacterium
GNHQTPNGT

SEQ ID NO: 490629 - protein, 4 aa, Mycobacterium
GNHR

SEQ ID NO: 490630 - protein, 5 aa, Mycobacterium
GNHRP

SEQ ID NO: 490631 - protein, 5 aa, Mycobacterium
GNIEA

SEQ ID NO: 490632 - protein, 14 aa, Mycobacterium
GNIEPAQLAAILAG

SEQ ID NO: 490633 - protein, 17 aa, Mycobacterium
GNIEPSTLRQILTEAAP

SEQ ID NO: 490634 - protein, 7 aa, Mycobacterium
GNIERAR

SEQ ID NO: 490635 - protein, 6 aa, Mycobacterium
GNIERT

SEQ ID NO: 490636 - protein, 18 aa, Mycobacterium
GNIGGGAVSAGAGTASHV

SEQ ID NO: 490637 - protein, 11 aa, Mycobacterium
GNIGHTEGAAG

SEQ ID NO: 490638 - protein, 6 aa, Mycobacterium
GNIGPG

SEQ ID NO: 490639 - protein, 18 aa, Mycobacterium
GNIGSNNFGSGNRGNGNI

SEQ ID NO: 490640 - protein, 7 aa, Mycobacterium
GNIGTNN

SEQ ID NO: 490641 - protein, 5 aa, Mycobacterium
GNIPG

SEQ ID NO: 490642 - protein, 10 aa, Mycobacterium
GNIPKGEYGA

SEQ ID NO: 490643 - protein, 8 aa, Mycobacterium
GNIPSSGG

SEQ ID NO: 490644 - protein, 6 aa, Mycobacterium
GNIPTP

SEQ ID NO: 490645 - protein, 4 aa, Mycobacterium
GNIS

SEQ ID NO: 490646 - protein, 8 aa, Mycobacterium
GNIYEKDG

SEQ ID NO: 490647 - protein, 10 aa, Mycobacterium
GNIYEKDGAS

SEQ ID NO: 490648 - protein, 8 aa, Mycobacterium
GNIYQKDG

SEQ ID NO: 490649 - protein, 8 aa, Mycobacterium
GNKARAIA

SEQ ID NO: 490650 - protein, 9 aa, Mycobacterium
GNKARAIAA

SEQ ID NO: 490651 - protein, 14 aa, Mycobacterium
GNKARAIAAAREAG

SEQ ID NO: 490652 - protein, 14 aa, Mycobacterium
GNKARAIAAARSAG

SEQ ID NO: 490653 - protein, 5 aa, Mycobacterium
GNKDP

SEQ ID NO: 490654 - protein, 13 aa, Mycobacterium
GNKFSNTEAMGGE

SEQ ID NO: 490655 - protein, 62 aa, Mycobacterium
GNKGGTGNIGNGNTGTANVGSGNTGSGNVGSGNGSSAIASSGNIGNGNQGNNNFGSGNFGNQ

SEQ ID NO: 490656 - protein, 57 aa, Mycobacterium
GNKGGTGNIGSGNTGSTNIGNGNTGSSNFGGGNVGSNNIGDGNLGSGNWGSGNLGNE

SEQ ID NO: 490657 - protein, 5 aa, Mycobacterium
GNKGH

SEQ ID NO: 490658 - protein, 12 aa, Mycobacterium
GNKGVDEMRGDI

SEQ ID NO: 490659 - protein, 4 aa, Mycobacterium
GNKL

SEQ ID NO: 490660 - protein, 4 aa, Mycobacterium
GNKP

SEQ ID NO: 490661 - protein, 9 aa, Mycobacterium
GNKPDAEDL

SEQ ID NO: 490662 - protein, 15 aa, Mycobacterium
GNKPVAESLHPSSPD

SEQ ID NO: 490663 - protein, 10 aa, Mycobacterium
GNKPVDQQTL

SEQ ID NO: 490664 - protein, 6 aa, Mycobacterium
GNKRTA

SEQ ID NO: 490665 - protein, 7 aa, Mycobacterium
GNKSALA

SEQ ID NO: 490666 - protein, 8 aa, Mycobacterium
GNKSLTKD

SEQ ID NO: 490667 - protein, 13 aa, Mycobacterium
GNKSRAVTAAREA

SEQ ID NO: 490668 - protein, 12 aa, Mycobacterium
GNKTTNTATNGG

SEQ ID NO: 490669 - protein, 12 aa, Mycobacterium
GNLADEPGQASL

SEQ ID NO: 490670 - protein, 5 aa, Mycobacterium
GNLAG

SEQ ID NO: 490671 - protein, 12 aa, Mycobacterium
GNLAPEEREERV

SEQ ID NO: 490672 - protein, 11 aa, Mycobacterium
GNLDADGAKEY

SEQ ID NO: 490673 - protein, 6 aa, Mycobacterium
GNLDDA

SEQ ID NO: 490674 - protein, 11 aa, Mycobacterium
GNLDENGHRGG

SEQ ID NO: 490675 - protein, 8 aa, Mycobacterium
GNLDRPGG

SEQ ID NO: 490676 - protein, 4 aa, Mycobacterium
GNLG

SEQ ID NO: 490677 - protein, 9 aa, Mycobacterium
GNLGAGREK

SEQ ID NO: 490678 - protein, 8 aa, Mycobacterium
GNLGQDRG

SEQ ID NO: 490679 - protein, 9 aa, Mycobacterium
GNLGQHNGL

SEQ ID NO: 490680 - protein, 7 aa, Mycobacterium
GNLGSTN

SEQ ID NO: 490681 - protein, 6 aa, Mycobacterium
GNLGTA

SEQ ID NO: 490682 - protein, 4 aa, Mycobacterium
GNLN

SEQ ID NO: 490683 - protein, 5 aa, Mycobacterium
GNLPA

SEQ ID NO: 490684 - protein, 6 aa, Mycobacterium
GNLPGA

SEQ ID NO: 490685 - protein, 15 aa, Mycobacterium
GNLPPAAKRQVRRKQ

SEQ ID NO: 490686 - protein, 8 aa, Mycobacterium
GNLPTTPW

SEQ ID NO: 490687 - protein, 6 aa, Mycobacterium
GNLQSI

SEQ ID NO: 490688 - protein, 13 aa, Mycobacterium
GNLRGDESFPHAA

SEQ ID NO: 490689 - protein, 6 aa, Mycobacterium
GNLSSS

SEQ ID NO: 490690 - protein, 10 aa, Mycobacterium
GNLTDQGTVS

SEQ ID NO: 490691 - protein, 10 aa, Mycobacterium
GNLTTPSEFQ

SEQ ID NO: 490692 - protein, 4 aa, Mycobacterium
GNLV

SEQ ID NO: 490693 - protein, 4 aa, Mycobacterium
GNMD

SEQ ID NO: 490694 - protein, 22 aa, Mycobacterium
GNMGAGTDTGGLSGGIVGPQAG

SEQ ID NO: 490695 - protein, 6 aa, Mycobacterium
GNMPGA

SEQ ID NO: 490696 - protein, 8 aa, Mycobacterium
GNMSPEYG

SEQ ID NO: 490697 - protein, 11 aa, Mycobacterium
GNNAGSGTGFG

SEQ ID NO: 490698 - protein, 8 aa, Mycobacterium
GNNDSGAH

SEQ ID NO: 490699 - protein, 30 aa, Mycobacterium
GNNGAVSGTATGGRGGDGIDGGTGGAGGMG

SEQ ID NO: 490700 - protein, 28 aa, Mycobacterium
GNNGDLGLGSGNTGDVNVGSGNNGGGNI

SEQ ID NO: 490701 - protein, 14 aa, Mycobacterium
GNNGWRGKGHWKHW

SEQ ID NO: 490702 - protein, 4 aa, Mycobacterium
GNNK

SEQ ID NO: 490703 - protein, 10 aa, Mycobacterium
GNNKSEAELA

SEQ ID NO: 490704 - protein, 8 aa, Mycobacterium
GNNKSVAE

SEQ ID NO: 490705 - protein, 7 aa, Mycobacterium
GNNLAGE

SEQ ID NO: 490706 - protein, 8 aa, Mycobacterium
GNNNPTVT

SEQ ID NO: 490707 - protein, 19 aa, Mycobacterium
GNNNSAIANATGVGGTLGT

SEQ ID NO: 490708 - protein, 7 aa, Mycobacterium
GNNNTDV

SEQ ID NO: 490709 - protein, 4 aa, Mycobacterium
GNNQ

SEQ ID NO: 490710 - protein, 6 aa, Mycobacterium
GNNQKA

SEQ ID NO: 490711 - protein, 6 aa, Mycobacterium
GNNQVG

SEQ ID NO: 490712 - protein, 21 aa, Mycobacterium
GNPAAMGDGIRAGEKVGGATE

SEQ ID NO: 490713 - protein, 7 aa, Mycobacterium
GNPAATA

SEQ ID NO: 490714 - protein, 21 aa, Mycobacterium
GNPAATGDGIRAAQKVGAATD

SEQ ID NO: 490715 - protein, 7 aa, Mycobacterium
GNPADAV

SEQ ID NO: 490716 - protein, 7 aa, Mycobacterium
GNPADEH

SEQ ID NO: 490717 - protein, 6 aa, Mycobacterium
GNPADP

SEQ ID NO: 490718 - protein, 8 aa, Mycobacterium
GNPADRHT

SEQ ID NO: 490719 - protein, 11 aa, Mycobacterium
GNPAEATNSTM

SEQ ID NO: 490720 - protein, 5 aa, Mycobacterium
GNPAG

SEQ ID NO: 490721 - protein, 19 aa, Mycobacterium
GNPAGAGGGLEAAARTARY

SEQ ID NO: 490722 - protein, 16 aa, Mycobacterium
GNPANADAHYRGTGPE

SEQ ID NO: 490723 - protein, 8 aa, Mycobacterium
GNPANSDA

SEQ ID NO: 490724 - protein, 16 aa, Mycobacterium
GNPANSDSHYRGTGPE

SEQ ID NO: 490725 - protein, 17 aa, Mycobacterium
GNPANTDAHYRGTGPEL

SEQ ID NO: 490726 - protein, 7 aa, Mycobacterium
GNPANTN

SEQ ID NO: 490727 - protein, 14 aa, Mycobacterium
GNPASHREDSHSPA

SEQ ID NO: 490728 - protein, 15 aa, Mycobacterium
GNPASRHDDSHSPAL

SEQ ID NO: 490729 - protein, 13 aa, Mycobacterium
GNPATSPNPGHNV

SEQ ID NO: 490730 - protein, 4 aa, Mycobacterium
GNPD

SEQ ID NO: 490731 - protein, 21 aa, Mycobacterium
GNPDAVNREPLDDAGYDSSPM

SEQ ID NO: 490732 - protein, 9 aa, Mycobacterium
GNPDDASAR

SEQ ID NO: 490733 - protein, 5 aa, Mycobacterium
GNPDE

SEQ ID NO: 490734 - protein, 9 aa, Mycobacterium
GNPDEAREH

SEQ ID NO: 490735 - protein, 6 aa, Mycobacterium
GNPDEV

SEQ ID NO: 490736 - protein, 7 aa, Mycobacterium
GNPDEVA

SEQ ID NO: 490737 - protein, 5 aa, Mycobacterium
GNPDF

SEQ ID NO: 490738 - protein, 7 aa, Mycobacterium
GNPDGPQ

SEQ ID NO: 490739 - protein, 9 aa, Mycobacterium
GNPDGSSSI

SEQ ID NO: 490740 - protein, 7 aa, Mycobacterium
GNPDGST

SEQ ID NO: 490741 - protein, 7 aa, Mycobacterium
GNPDGTT

SEQ ID NO: 490742 - protein, 9 aa, Mycobacterium
GNPDKSRNT

SEQ ID NO: 490743 - protein, 5 aa, Mycobacterium
GNPDL

SEQ ID NO: 490744 - protein, 7 aa, Mycobacterium
GNPDQQI

SEQ ID NO: 490745 - protein, 12 aa, Mycobacterium
GNPDQSDEEVNE

SEQ ID NO: 490746 - protein, 9 aa, Mycobacterium
GNPDQTAGP

SEQ ID NO: 490747 - protein, 5 aa, Mycobacterium
GNPDR

SEQ ID NO: 490748 - protein, 7 aa, Mycobacterium
GNPDRAA

SEQ ID NO: 490749 - protein, 9 aa, Mycobacterium
GNPDRAQNT

SEQ ID NO: 490750 - protein, 8 aa, Mycobacterium
GNPDRPGM

SEQ ID NO: 490751 - protein, 7 aa, Mycobacterium
GNPDRQL

SEQ ID NO: 490752 - protein, 8 aa, Mycobacterium
GNPDSTLS

SEQ ID NO: 490753 - protein, 7 aa, Mycobacterium
GNPDSVQ

SEQ ID NO: 490754 - protein, 9 aa, Mycobacterium
GNPDTAKNT

SEQ ID NO: 490755 - protein, 6 aa, Mycobacterium
GNPDTF

SEQ ID NO: 490756 - protein, 8 aa, Mycobacterium
GNPDYARN

SEQ ID NO: 490757 - protein, 7 aa, Mycobacterium
GNPDYAT

SEQ ID NO: 490758 - protein, 17 aa, Mycobacterium
GNPDYGYSTGPANVPTP

SEQ ID NO: 490759 - protein, 8 aa, Mycobacterium
GNPEEIAE

SEQ ID NO: 490760 - protein, 6 aa, Mycobacterium
GNPEGE

SEQ ID NO: 490761 - protein, 10 aa, Mycobacterium
GNPEGKSRRE

SEQ ID NO: 490762 - protein, 6 aa, Mycobacterium
GNPEGV

SEQ ID NO: 490763 - protein, 11 aa, Mycobacterium
GNPEIQEGKGF

SEQ ID NO: 490764 - protein, 5 aa, Mycobacterium
GNPEL

SEQ ID NO: 490765 - protein, 17 aa, Mycobacterium
GNPERASAAVEHGDTHT

SEQ ID NO: 490766 - protein, 7 aa, Mycobacterium
GNPERTQ

SEQ ID NO: 490767 - protein, 10 aa, Mycobacterium
GNPEVQHTET

SEQ ID NO: 490768 - protein, 4 aa, Mycobacterium
GNPF

SEQ ID NO: 490769 - protein, 19 aa, Mycobacterium
GNPGAPPRRALYDAVLRAR

SEQ ID NO: 490770 - protein, 7 aa, Mycobacterium
GNPGASL

SEQ ID NO: 490771 - protein, 12 aa, Mycobacterium
GNPGATGTPGGH

SEQ ID NO: 490772 - protein, 13 aa, Mycobacterium
GNPGDAEQGTQDI

SEQ ID NO: 490773 - protein, 7 aa, Mycobacterium
GNPGDGW

SEQ ID NO: 490774 - protein, 6 aa, Mycobacterium
GNPGDP

SEQ ID NO: 490775 - protein, 5 aa, Mycobacterium
GNPGL

SEQ ID NO: 490776 - protein, 9 aa, Mycobacterium
GNPGPGSAN

SEQ ID NO: 490777 - protein, 10 aa, Mycobacterium
GNPGPNYAKT

SEQ ID NO: 490778 - protein, 6 aa, Mycobacterium
GNPGQG

SEQ ID NO: 490779 - protein, 9 aa, Mycobacterium
GNPGSTEES

SEQ ID NO: 490780 - protein, 10 aa, Mycobacterium
GNPGTGKSTL

SEQ ID NO: 490781 - protein, 11 aa, Mycobacterium
GNPGTGKSTVA

SEQ ID NO: 490782 - protein, 12 aa, Mycobacterium
GNPGTGKSTVAR

SEQ ID NO: 490783 - protein, 9 aa, Mycobacterium
GNPGTPGSF

SEQ ID NO: 490784 - protein, 21 aa, Mycobacterium
GNPGTPGSQGATGANGQHGLD

SEQ ID NO: 490785 - protein, 4 aa, Mycobacterium
GNPH

SEQ ID NO: 490786 - protein, 5 aa, Mycobacterium
GNPHG

SEQ ID NO: 490787 - protein, 6 aa, Mycobacterium
GNPHPE

SEQ ID NO: 490788 - protein, 11 aa, Mycobacterium
GNPIATRDESY

SEQ ID NO: 490789 - protein, 5 aa, Mycobacterium
GNPIG

SEQ ID NO: 490790 - protein, 8 aa, Mycobacterium
GNPIPGAT

SEQ ID NO: 490791 - protein, 8 aa, Mycobacterium
GNPITPEE

SEQ ID NO: 490792 - protein, 18 aa, Mycobacterium
GNPITPEELDDAARAQGV

SEQ ID NO: 490793 - protein, 10 aa, Mycobacterium
GNPKDSTRSV

SEQ ID NO: 490794 - protein, 6 aa, Mycobacterium
GNPKHI

SEQ ID NO: 490795 - protein, 12 aa, Mycobacterium
GNPKKSTSSDMT

SEQ ID NO: 490796 - protein, 5 aa, Mycobacterium
GNPKY

SEQ ID NO: 490797 - protein, 7 aa, Mycobacterium
GNPLDDS

SEQ ID NO: 490798 - protein, 7 aa, Mycobacterium
GNPLENK

SEQ ID NO: 490799 - protein, 8 aa, Mycobacterium
GNPLPGRR

SEQ ID NO: 490800 - protein, 10 aa, Mycobacterium
GNPLPPGGGA

SEQ ID NO: 490801 - protein, 6 aa, Mycobacterium
GNPLTG

SEQ ID NO: 490802 - protein, 6 aa, Mycobacterium
GNPNAV

SEQ ID NO: 490803 - protein, 9 aa, Mycobacterium
GNPNNPDGG

SEQ ID NO: 490804 - protein, 9 aa, Mycobacterium
GNPNNPNGG

SEQ ID NO: 490805 - protein, 12 aa, Mycobacterium
GNPPADNSELTA

SEQ ID NO: 490806 - protein, 12 aa, Mycobacterium
GNPPDYEPTPDM

SEQ ID NO: 490807 - protein, 6 aa, Mycobacterium
GNPPGL

SEQ ID NO: 490808 - protein, 13 aa, Mycobacterium
GNPPLELPAAGSY

SEQ ID NO: 490809 - protein, 6 aa, Mycobacterium
GNPPNP

SEQ ID NO: 490810 - protein, 16 aa, Mycobacterium
GNPPQNPTNNNRGSMM

SEQ ID NO: 490811 - protein, 5 aa, Mycobacterium
GNPPY

SEQ ID NO: 490812 - protein, 6 aa, Mycobacterium
GNPQAP

SEQ ID NO: 490813 - protein, 12 aa, Mycobacterium
GNPQESSRSDMT

SEQ ID NO: 490814 - protein, 4 aa, Mycobacterium
GNPR

SEQ ID NO: 490815 - protein, 5 aa, Mycobacterium
GNPRA

SEQ ID NO: 490816 - protein, 6 aa, Mycobacterium
GNPRDG

SEQ ID NO: 490817 - protein, 9 aa, Mycobacterium
GNPRIGAGR

SEQ ID NO: 490818 - protein, 8 aa, Mycobacterium
GNPRPGQS

SEQ ID NO: 490819 - protein, 7 aa, Mycobacterium
GNPRPID

SEQ ID NO: 490820 - protein, 6 aa, Mycobacterium
GNPRQA

SEQ ID NO: 490821 - protein, 7 aa, Mycobacterium
GNPSEVG

SEQ ID NO: 490822 - protein, 9 aa, Mycobacterium
GNPSGRAGN

SEQ ID NO: 490823 - protein, 9 aa, Mycobacterium
GNPSLGTVS

SEQ ID NO: 490824 - protein, 5 aa, Mycobacterium
GNPSM

SEQ ID NO: 490825 - protein, 7 aa, Mycobacterium
GNPSMTG

SEQ ID NO: 490826 - protein, 6 aa, Mycobacterium
GNPSNA

SEQ ID NO: 490827 - protein, 22 aa, Mycobacterium
GNPSSRHGAGRDAADALAAARK

SEQ ID NO: 490828 - protein, 6 aa, Mycobacterium
GNPSSS

SEQ ID NO: 490829 - protein, 5 aa, Mycobacterium
GNPSV

SEQ ID NO: 490830 - protein, 9 aa, Mycobacterium
GNPTIGNSG

SEQ ID NO: 490831 - protein, 20 aa, Mycobacterium
GNPTNARERKSAQADDLDAA

SEQ ID NO: 490832 - protein, 7 aa, Mycobacterium
GNPTQDV

SEQ ID NO: 490833 - protein, 8 aa, Mycobacterium
GNPTTGFD

SEQ ID NO: 490834 - protein, 5 aa, Mycobacterium
GNPVH

SEQ ID NO: 490835 - protein, 7 aa, Mycobacterium
GNPVPKP

SEQ ID NO: 490836 - protein, 9 aa, Mycobacterium
GNPVSAAAS

SEQ ID NO: 490837 - protein, 9 aa, Mycobacterium
GNPVTPEEL

SEQ ID NO: 490838 - protein, 6 aa, Mycobacterium
GNPVVS

SEQ ID NO: 490839 - protein, 4 aa, Mycobacterium
GNPW

SEQ ID NO: 490840 - protein, 7 aa, Mycobacterium
GNPWEIG

SEQ ID NO: 490841 - protein, 5 aa, Mycobacterium
GNPWG

SEQ ID NO: 490842 - protein, 22 aa, Mycobacterium
GNPYAGYQRSTTRDIPVVICEP

SEQ ID NO: 490843 - protein, 6 aa, Mycobacterium
GNQADL

SEQ ID NO: 490844 - protein, 8 aa, Mycobacterium
GNQANASM

SEQ ID NO: 490845 - protein, 6 aa, Mycobacterium
GNQAPL

SEQ ID NO: 490846 - protein, 5 aa, Mycobacterium
GNQAV

SEQ ID NO: 490847 - protein, 8 aa, Mycobacterium
GNQDDARS

SEQ ID NO: 490848 - protein, 7 aa, Mycobacterium
GNQDPEF

SEQ ID NO: 490849 - protein, 7 aa, Mycobacterium
GNQEGIS

SEQ ID NO: 490850 - protein, 8 aa, Mycobacterium
GNQEGYSF

SEQ ID NO: 490851 - protein, 4 aa, Mycobacterium
GNQF

SEQ ID NO: 490852 - protein, 9 aa, Mycobacterium
GNQFPPPKK

SEQ ID NO: 490853 - protein, 7 aa, Mycobacterium
GNQGVGT

SEQ ID NO: 490854 - protein, 11 aa, Mycobacterium
GNQKPSSTTAH

SEQ ID NO: 490855 - protein, 9 aa, Mycobacterium
GNQNVANPM

SEQ ID NO: 490856 - protein, 7 aa, Mycobacterium
GNQPRPA

SEQ ID NO: 490857 - protein, 9 aa, Mycobacterium
GNQPTDAWT

SEQ ID NO: 490858 - protein, 8 aa, Mycobacterium
GNQPTREY

SEQ ID NO: 490859 - protein, 9 aa, Mycobacterium
GNQQSDGMS

SEQ ID NO: 490860 - protein, 6 aa, Mycobacterium
GNQRDG

SEQ ID NO: 490861 - protein, 7 aa, Mycobacterium
GNQSQAT

SEQ ID NO: 490862 - protein, 9 aa, Mycobacterium
GNRAAAAGE

SEQ ID NO: 490863 - protein, 6 aa, Mycobacterium
GNRAAT

SEQ ID NO: 490864 - protein, 16 aa, Mycobacterium
GNRAEHRPSELSGGQM

SEQ ID NO: 490865 - protein, 17 aa, Mycobacterium
GNRANTAAKQADADRII

SEQ ID NO: 490866 - protein, 16 aa, Mycobacterium
GNRAQHRPAELSGGQM

SEQ ID NO: 490867 - protein, 5 aa, Mycobacterium
GNRAR

SEQ ID NO: 490868 - protein, 10 aa, Mycobacterium
GNRATGARAG

SEQ ID NO: 490869 - protein, 7 aa, Mycobacterium
GNRCHDG

SEQ ID NO: 490870 - protein, 6 aa, Mycobacterium
GNRDDV

SEQ ID NO: 490871 - protein, 9 aa, Mycobacterium
GNRDEDAFE

SEQ ID NO: 490872 - protein, 7 aa, Mycobacterium
GNRDEEV

SEQ ID NO: 490873 - protein, 6 aa, Mycobacterium
GNRDER

SEQ ID NO: 490874 - protein, 11 aa, Mycobacterium
GNRDNTVSASL

SEQ ID NO: 490875 - protein, 9 aa, Mycobacterium
GNRDPRRFT

SEQ ID NO: 490876 - protein, 15 aa, Mycobacterium
GNRDRAQQTADEITA

SEQ ID NO: 490877 - protein, 12 aa, Mycobacterium
GNRDTGDTSGYG

SEQ ID NO: 490878 - protein, 10 aa, Mycobacterium
GNRDTTAIGD

SEQ ID NO: 490879 - protein, 6 aa, Mycobacterium
GNREDP

SEQ ID NO: 490880 - protein, 6 aa, Mycobacterium
GNRERI

SEQ ID NO: 490881 - protein, 7 aa, Mycobacterium
GNRGELA

SEQ ID NO: 490882 - protein, 7 aa, Mycobacterium
GNRGFGG

SEQ ID NO: 490883 - protein, 6 aa, Mycobacterium
GNRGIG

SEQ ID NO: 490884 - protein, 7 aa, Mycobacterium
GNRGIPP

SEQ ID NO: 490885 - protein, 11 aa, Mycobacterium
GNRGIRPQSKF

SEQ ID NO: 490886 - protein, 5 aa, Mycobacterium
GNRGM

SEQ ID NO: 490887 - protein, 5 aa, Mycobacterium
GNRHG

SEQ ID NO: 490888 - protein, 4 aa, Mycobacterium
GNRI

SEQ ID NO: 490889 - protein, 9 aa, Mycobacterium
GNRLDTAGL

SEQ ID NO: 490890 - protein, 6 aa, Mycobacterium
GNRLPD

SEQ ID NO: 490891 - protein, 7 aa, Mycobacterium
GNRLPGL

SEQ ID NO: 490892 - protein, 7 aa, Mycobacterium
GNRPDFD

SEQ ID NO: 490893 - protein, 13 aa, Mycobacterium
GNRPQPNDSRARA

SEQ ID NO: 490894 - protein, 5 aa, Mycobacterium
GNRPR

SEQ ID NO: 490895 - protein, 6 aa, Mycobacterium
GNRPSE

SEQ ID NO: 490896 - protein, 6 aa, Mycobacterium
GNRPSQ

SEQ ID NO: 490897 - protein, 14 aa, Mycobacterium
GNRPTHIVNPEVLG

SEQ ID NO: 490898 - protein, 8 aa, Mycobacterium
GNRPYDAS

SEQ ID NO: 490899 - protein, 4 aa, Mycobacterium
GNRQ

SEQ ID NO: 490900 - protein, 7 aa, Mycobacterium
GNRQVPE

SEQ ID NO: 490901 - protein, 9 aa, Mycobacterium
GNRRAVATA

SEQ ID NO: 490902 - protein, 13 aa, Mycobacterium
GNRRGDKPYPSGT

SEQ ID NO: 490903 - protein, 8 aa, Mycobacterium
GNRRRDSG

SEQ ID NO: 490904 - protein, 10 aa, Mycobacterium
GNRSDAVRRS

SEQ ID NO: 490905 - protein, 9 aa, Mycobacterium
GNRSDESIS

SEQ ID NO: 490906 - protein, 11 aa, Mycobacterium
GNRSDIRERST

SEQ ID NO: 490907 - protein, 8 aa, Mycobacterium
GNRSGSGM

SEQ ID NO: 490908 - protein, 5 aa, Mycobacterium
GNRSH

SEQ ID NO: 490909 - protein, 22 aa, Mycobacterium
GNRSIEARRRARTELPRSPGTV

SEQ ID NO: 490910 - protein, 8 aa, Mycobacterium
GNRSIGAA

SEQ ID NO: 490911 - protein, 19 aa, Mycobacterium
GNRSIGAAEAATAAGIGPS

SEQ ID NO: 490912 - protein, 19 aa, Mycobacterium
GNRSIGAAEAATEAGIGPS

SEQ ID NO: 490913 - protein, 13 aa, Mycobacterium
GNRSIGAAEAATR

SEQ ID NO: 490914 - protein, 17 aa, Mycobacterium
GNRSIGAAQAATEAGIR

SEQ ID NO: 490915 - protein, 19 aa, Mycobacterium
GNRSIGSAELATEAGITPS

SEQ ID NO: 490916 - protein, 11 aa, Mycobacterium
GNRSRDAAPQG

SEQ ID NO: 490917 - protein, 13 aa, Mycobacterium
GNRSSAPATTDSD

SEQ ID NO: 490918 - protein, 11 aa, Mycobacterium
GNRSSRPGTVE

SEQ ID NO: 490919 - protein, 6 aa, Mycobacterium
GNRTAA

SEQ ID NO: 490920 - protein, 9 aa, Mycobacterium
GNRTDAEDL

SEQ ID NO: 490921 - protein, 8 aa, Mycobacterium
GNRTDDYA

SEQ ID NO: 490922 - protein, 5 aa, Mycobacterium
GNRTE

SEQ ID NO: 490923 - protein, 5 aa, Mycobacterium
GNRTP

SEQ ID NO: 490924 - protein, 5 aa, Mycobacterium
GNRWT

SEQ ID NO: 490925 - protein, 13 aa, Mycobacterium
GNRYAPPGGHTYN

SEQ ID NO: 490926 - protein, 9 aa, Mycobacterium
GNRYERGEQ

SEQ ID NO: 490927 - protein, 5 aa, Mycobacterium
GNSAE

SEQ ID NO: 490928 - protein, 7 aa, Mycobacterium
GNSAGRV

SEQ ID NO: 490929 - protein, 6 aa, Mycobacterium
GNSAPR

SEQ ID NO: 490930 - protein, 7 aa, Mycobacterium
GNSAPRV

SEQ ID NO: 490931 - protein, 9 aa, Mycobacterium
GNSATALQA

SEQ ID NO: 490932 - protein, 6 aa, Mycobacterium
GNSAVH

SEQ ID NO: 490933 - protein, 7 aa, Mycobacterium
GNSDAAM

SEQ ID NO: 490934 - protein, 7 aa, Mycobacterium
GNSDATV

SEQ ID NO: 490935 - protein, 6 aa, Mycobacterium
GNSDKE

SEQ ID NO: 490936 - protein, 7 aa, Mycobacterium
GNSDTRE

SEQ ID NO: 490937 - protein, 9 aa, Mycobacterium
GNSECPSNP

SEQ ID NO: 490938 - protein, 8 aa, Mycobacterium
GNSERPSD

SEQ ID NO: 490939 - protein, 5 aa, Mycobacterium
GNSET

SEQ ID NO: 490940 - protein, 5 aa, Mycobacterium
GNSFE

SEQ ID NO: 490941 - protein, 8 aa, Mycobacterium
GNSGAGDV

SEQ ID NO: 490942 - protein, 8 aa, Mycobacterium
GNSGAYGT

SEQ ID NO: 490943 - protein, 10 aa, Mycobacterium
GNSGDANLGL

SEQ ID NO: 490944 - protein, 22 aa, Mycobacterium
GNSGEMAMSPQAATAIAPPSVG

SEQ ID NO: 490945 - protein, 8 aa, Mycobacterium
GNSGFVSD

SEQ ID NO: 490946 - protein, 16 aa, Mycobacterium
GNSGGAPETVRAGETG

SEQ ID NO: 490947 - protein, 6 aa, Mycobacterium
GNSGIG

SEQ ID NO: 490948 - protein, 8 aa, Mycobacterium
GNSGNNNF

SEQ ID NO: 490949 - protein, 19 aa, Mycobacterium
GNSGNYNTGVGNTGAANTG

SEQ ID NO: 490950 - protein, 22 aa, Mycobacterium
GNSGSFNAGSFNSSTSNLGSFN

SEQ ID NO: 490951 - protein, 19 aa, Mycobacterium
GNSGSYNTGIGNTGTTNTG

SEQ ID NO: 490952 - protein, 5 aa, Mycobacterium
GNSGT

SEQ ID NO: 490953 - protein, 13 aa, Mycobacterium
GNSGTGNVGFGNS

SEQ ID NO: 490954 - protein, 11 aa, Mycobacterium
GNSGTRNTGSF

SEQ ID NO: 490955 - protein, 13 aa, Mycobacterium
GNSGVSNAGPALV

SEQ ID NO: 490956 - protein, 5 aa, Mycobacterium
GNSGY

SEQ ID NO: 490957 - protein, 21 aa, Mycobacterium
GNSHGQPLAGKRNESAEGTFN

SEQ ID NO: 490958 - protein, 6 aa, Mycobacterium
GNSHPK

SEQ ID NO: 490959 - protein, 6 aa, Mycobacterium
GNSIAP

SEQ ID NO: 490960 - protein, 4 aa, Mycobacterium
GNSK

SEQ ID NO: 490961 - protein, 11 aa, Mycobacterium
GNSLRAHEGSL

SEQ ID NO: 490962 - protein, 6 aa, Mycobacterium
GNSNGD

SEQ ID NO: 490963 - protein, 48 aa, Mycobacterium
GNSNSGLQNAGNTVSGFQNSATAVASAGFGNRATNDAGVGNSGNNSSG

SEQ ID NO: 490964 - protein, 6 aa, Mycobacterium
GNSPRF

SEQ ID NO: 490965 - protein, 9 aa, Mycobacterium
GNSPSGATR

SEQ ID NO: 490966 - protein, 30 aa, Mycobacterium
GNSQATGGGNIGSGNSGSGNIGNGNTGNFN

SEQ ID NO: 490967 - protein, 6 aa, Mycobacterium
GNSRFN

SEQ ID NO: 490968 - protein, 12 aa, Mycobacterium
GNSSPDAIDPDR

SEQ ID NO: 490969 - protein, 12 aa, Mycobacterium
GNSSPESIDPDR

SEQ ID NO: 490970 - protein, 10 aa, Mycobacterium
GNSSQITDGS

SEQ ID NO: 490971 - protein, 17 aa, Mycobacterium
GNSSRDLPQAAAVTLQG

SEQ ID NO: 490972 - protein, 14 aa, Mycobacterium
GNSSVPSPSENPER

SEQ ID NO: 490973 - protein, 22 aa, Mycobacterium
GNSTRASAARRAAQKTESARRH

SEQ ID NO: 490974 - protein, 8 aa, Mycobacterium
GNSTVDAN

SEQ ID NO: 490975 - protein, 4 aa, Mycobacterium
GNSV

SEQ ID NO: 490976 - protein, 11 aa, Mycobacterium
GNSVAASVEPR

SEQ ID NO: 490977 - protein, 6 aa, Mycobacterium
GNSVRA

SEQ ID NO: 490978 - protein, 13 aa, Mycobacterium
GNSWAATAGSGDV

SEQ ID NO: 490979 - protein, 7 aa, Mycobacterium
GNSWPQT

SEQ ID NO: 490980 - protein, 4 aa, Mycobacterium
GNSY

SEQ ID NO: 490981 - protein, 5 aa, Mycobacterium
GNSYL

SEQ ID NO: 490982 - protein, 6 aa, Mycobacterium
GNSYYR

SEQ ID NO: 490983 - protein, 7 aa, Mycobacterium
GNSYYRD

SEQ ID NO: 490984 - protein, 4 aa, Mycobacterium
GNTA

SEQ ID NO: 490985 - protein, 9 aa, Mycobacterium
GNTAAEGTG

SEQ ID NO: 490986 - protein, 9 aa, Mycobacterium
GNTAAERRA

SEQ ID NO: 490987 - protein, 11 aa, Mycobacterium
GNTADAGQPLR

SEQ ID NO: 490988 - protein, 8 aa, Mycobacterium
GNTADEPA

SEQ ID NO: 490989 - protein, 11 aa, Mycobacterium
GNTAEEQSFRT

SEQ ID NO: 490990 - protein, 8 aa, Mycobacterium
GNTAETTT

SEQ ID NO: 490991 - protein, 6 aa, Mycobacterium
GNTAGR

SEQ ID NO: 490992 - protein, 7 aa, Mycobacterium
GNTAQGL

SEQ ID NO: 490993 - protein, 13 aa, Mycobacterium
GNTATGGSDLNGL

SEQ ID NO: 490994 - protein, 9 aa, Mycobacterium
GNTDCPGNA

SEQ ID NO: 490995 - protein, 6 aa, Mycobacterium
GNTDIT

SEQ ID NO: 490996 - protein, 10 aa, Mycobacterium
GNTDNDLADH

SEQ ID NO: 490997 - protein, 7 aa, Mycobacterium
GNTDPQY

SEQ ID NO: 490998 - protein, 8 aa, Mycobacterium
GNTDPQYS

SEQ ID NO: 490999 - protein, 78 aa, Mycobacterium
GNTDSNVGSGDVGTQNLGSGNTGNTNLGSGNTGNGNLGSGNRGDSNVGSGNLGNSNWGSGNTGNYNQGSGNHGDNNVG

SEQ ID NO: 491000 - protein, 26 aa, Mycobacterium
GNTDSSPSDQSRYLKPGSTGPLQTSQ

SEQ ID NO: 491001 - protein, 8 aa, Mycobacterium
GNTEGTGF

SEQ ID NO: 491002 - protein, 4 aa, Mycobacterium
GNTF

SEQ ID NO: 491003 - protein, 6 aa, Mycobacterium
GNTFNS

SEQ ID NO: 491004 - protein, 4 aa, Mycobacterium
GNTG

SEQ ID NO: 491005 - protein, 7 aa, Mycobacterium
GNTGARS

SEQ ID NO: 491006 - protein, 8 aa, Mycobacterium
GNTGDGNI

SEQ ID NO: 491007 - protein, 18 aa, Mycobacterium
GNTGDGNIGFGNSGNGNI

SEQ ID NO: 491008 - protein, 18 aa, Mycobacterium
GNTGDNNIGFGNTGNGNF

SEQ ID NO: 491009 - protein, 28 aa, Mycobacterium
GNTGDNNIGFGNTGNGNIGFGNTGNGNI

SEQ ID NO: 491010 - protein, 6 aa, Mycobacterium
GNTGGA

SEQ ID NO: 491011 - protein, 11 aa, Mycobacterium
GNTGGTGAAAV

SEQ ID NO: 491012 - protein, 6 aa, Mycobacterium
GNTGIA

SEQ ID NO: 491013 - protein, 5 aa, Mycobacterium
GNTGN

SEQ ID NO: 491014 - protein, 8 aa, Mycobacterium
GNTGNGNI

SEQ ID NO: 491015 - protein, 8 aa, Mycobacterium
GNTGNGNL

SEQ ID NO: 491016 - protein, 8 aa, Mycobacterium
GNTGNNNI

SEQ ID NO: 491017 - protein, 14 aa, Mycobacterium
GNTGPGGAVTTPTS

SEQ ID NO: 491018 - protein, 5 aa, Mycobacterium
GNTGS

SEQ ID NO: 491019 - protein, 9 aa, Mycobacterium
GNTGSGNIG

SEQ ID NO: 491020 - protein, 30 aa, Mycobacterium
GNTGSGNIGIGNTGNGNVGFGNGGLGGDNN

SEQ ID NO: 491021 - protein, 39 aa, Mycobacterium
GNTGSGNIGIGNTGSGNLGIGNTGSSNIGGGNTGNNNVG

SEQ ID NO: 491022 - protein, 8 aa, Mycobacterium
GNTGSNNF

SEQ ID NO: 491023 - protein, 8 aa, Mycobacterium
GNTGSNNI

SEQ ID NO: 491024 - protein, 13 aa, Mycobacterium
GNTGVADSLPGIA

SEQ ID NO: 491025 - protein, 12 aa, Mycobacterium
GNTHESPSGYKT

SEQ ID NO: 491026 - protein, 8 aa, Mycobacterium
GNTHPDPV

SEQ ID NO: 491027 - protein, 8 aa, Mycobacterium
GNTIEGGQ

SEQ ID NO: 491028 - protein, 8 aa, Mycobacterium
GNTITTDN

SEQ ID NO: 491029 - protein, 6 aa, Mycobacterium
GNTNFG

SEQ ID NO: 491030 - protein, 8 aa, Mycobacterium
GNTNFGPE

SEQ ID NO: 491031 - protein, 23 aa, Mycobacterium
GNTNFGPGNLGSTNIGGANIGDT

SEQ ID NO: 491032 - protein, 20 aa, Mycobacterium
GNTNIGSGNIGDTNFGSGNI

SEQ ID NO: 491033 - protein, 9 aa, Mycobacterium
GNTNPKDNW

SEQ ID NO: 491034 - protein, 5 aa, Mycobacterium
GNTPF

SEQ ID NO: 491035 - protein, 17 aa, Mycobacterium
GNTPGQPVKAGSMGRPM

SEQ ID NO: 491036 - protein, 5 aa, Mycobacterium
GNTPL

SEQ ID NO: 491037 - protein, 7 aa, Mycobacterium
GNTPQQV

SEQ ID NO: 491038 - protein, 4 aa, Mycobacterium
GNTQ

SEQ ID NO: 491039 - protein, 5 aa, Mycobacterium
GNTQT

SEQ ID NO: 491040 - protein, 8 aa, Mycobacterium
GNTSAPVM

SEQ ID NO: 491041 - protein, 12 aa, Mycobacterium
GNTSPEAIDPDR

SEQ ID NO: 491042 - protein, 10 aa, Mycobacterium
GNTSPQARKH

SEQ ID NO: 491043 - protein, 7 aa, Mycobacterium
GNTSRFA

SEQ ID NO: 491044 - protein, 4 aa, Mycobacterium
GNTT

SEQ ID NO: 491045 - protein, 7 aa, Mycobacterium
GNTTHPV

SEQ ID NO: 491046 - protein, 5 aa, Mycobacterium
GNTTN

SEQ ID NO: 491047 - protein, 6 aa, Mycobacterium
GNTVMT

SEQ ID NO: 491048 - protein, 7 aa, Mycobacterium
GNTVNPD

SEQ ID NO: 491049 - protein, 13 aa, Mycobacterium
GNTVNVTGDSQSA

SEQ ID NO: 491050 - protein, 17 aa, Mycobacterium
GNTVPASGAAASAAGIG

SEQ ID NO: 491051 - protein, 7 aa, Mycobacterium
GNTVSAD

SEQ ID NO: 491052 - protein, 6 aa, Mycobacterium
GNTYRN

SEQ ID NO: 491053 - protein, 8 aa, Mycobacterium
GNTYRNPT

SEQ ID NO: 491054 - protein, 5 aa, Mycobacterium
GNVAG

SEQ ID NO: 491055 - protein, 7 aa, Mycobacterium
GNVATGA

SEQ ID NO: 491056 - protein, 5 aa, Mycobacterium
GNVDP

SEQ ID NO: 491057 - protein, 4 aa, Mycobacterium
GNVE

SEQ ID NO: 491058 - protein, 8 aa, Mycobacterium
GNVGAARA

SEQ ID NO: 491059 - protein, 9 aa, Mycobacterium
GNVGATRAA

SEQ ID NO: 491060 - protein, 12 aa, Mycobacterium
GNVGDRSEHTRR

SEQ ID NO: 491061 - protein, 9 aa, Mycobacterium
GNVGKSSVA

SEQ ID NO: 491062 - protein, 12 aa, Mycobacterium
GNVGNTPGRGFH

SEQ ID NO: 491063 - protein, 11 aa, Mycobacterium
GNVGPVGSQYE

SEQ ID NO: 491064 - protein, 7 aa, Mycobacterium
GNVGRER

SEQ ID NO: 491065 - protein, 4 aa, Mycobacterium
GNVI

SEQ ID NO: 491066 - protein, 10 aa, Mycobacterium
GNVLPPGETG

SEQ ID NO: 491067 - protein, 4 aa, Mycobacterium
GNVN

SEQ ID NO: 491068 - protein, 8 aa, Mycobacterium
GNVNTAGQ

SEQ ID NO: 491069 - protein, 17 aa, Mycobacterium
GNVNTGYANAGGQNTGL

SEQ ID NO: 491070 - protein, 5 aa, Mycobacterium
GNVPR

SEQ ID NO: 491071 - protein, 8 aa, Mycobacterium
GNVPSTEF

SEQ ID NO: 491072 - protein, 6 aa, Mycobacterium
GNVPTA

SEQ ID NO: 491073 - protein, 7 aa, Mycobacterium
GNVRDGV

SEQ ID NO: 491074 - protein, 7 aa, Mycobacterium
GNVRDMR

SEQ ID NO: 491075 - protein, 13 aa, Mycobacterium
GNVRGTEGPRNAV

SEQ ID NO: 491076 - protein, 9 aa, Mycobacterium
GNVRNSGVE

SEQ ID NO: 491077 - protein, 7 aa, Mycobacterium
GNVRRGS

SEQ ID NO: 491078 - protein, 7 aa, Mycobacterium
GNVSGPD

SEQ ID NO: 491079 - protein, 14 aa, Mycobacterium
GNVSSEHGIGSRKR

SEQ ID NO: 491080 - protein, 16 aa, Mycobacterium
GNVSSEHGVGSRKRPY

SEQ ID NO: 491081 - protein, 6 aa, Mycobacterium
GNVSTP

SEQ ID NO: 491082 - protein, 7 aa, Mycobacterium
GNVTGPD

SEQ ID NO: 491083 - protein, 7 aa, Mycobacterium
GNVTGPE

SEQ ID NO: 491084 - protein, 13 aa, Mycobacterium
GNVTRRRKPRPLT

SEQ ID NO: 491085 - protein, 11 aa, Mycobacterium
GNWESGDEKKQ

SEQ ID NO: 491086 - protein, 4 aa, Mycobacterium
GNYA

SEQ ID NO: 491087 - protein, 11 aa, Mycobacterium
GNYGQAREQVE

SEQ ID NO: 491088 - protein, 18 aa, Mycobacterium
GNYLPKKPVESIEGGEAH

SEQ ID NO: 491089 - protein, 9 aa, Mycobacterium
GNYNSKTAR

SEQ ID NO: 491090 - protein, 5 aa, Mycobacterium
GNYQA

SEQ ID NO: 491091 - protein, 5 aa, Mycobacterium
GNYRS

SEQ ID NO: 491092 - protein, 4 aa, Mycobacterium
GNYS

SEQ ID NO: 491093 - protein, 5 aa, Mycobacterium
GNYTV

SEQ ID NO: 491094 - protein, 9 aa, Mycobacterium
GPAAADGRL

SEQ ID NO: 491095 - protein, 10 aa, Mycobacterium
GPAAAGTANT

SEQ ID NO: 491096 - protein, 9 aa, Mycobacterium
GPAAAPAMA

SEQ ID NO: 491097 - protein, 16 aa, Mycobacterium
GPAAARALGESVPDGR

SEQ ID NO: 491098 - protein, 8 aa, Mycobacterium
GPAAARES

SEQ ID NO: 491099 - protein, 11 aa, Mycobacterium
GPAADPASEIG

SEQ ID NO: 491100 - protein, 11 aa, Mycobacterium
GPAAGGHRGTF

SEQ ID NO: 491101 - protein, 8 aa, Mycobacterium
GPAAKPVE

SEQ ID NO: 491102 - protein, 9 aa, Mycobacterium
GPAAPADPN

SEQ ID NO: 491103 - protein, 9 aa, Mycobacterium
GPAAPAGDD

SEQ ID NO: 491104 - protein, 8 aa, Mycobacterium
GPAAPATR

SEQ ID NO: 491105 - protein, 7 aa, Mycobacterium
GPAAPAV

SEQ ID NO: 491106 - protein, 16 aa, Mycobacterium
GPAAPDLDHGQDPGDP

SEQ ID NO: 491107 - protein, 6 aa, Mycobacterium
GPAAPI

SEQ ID NO: 491108 - protein, 7 aa, Mycobacterium
GPAAPWG

SEQ ID NO: 491109 - protein, 13 aa, Mycobacterium
GPAAQRGRVTTTA

SEQ ID NO: 491110 - protein, 6 aa, Mycobacterium
GPAARR

SEQ ID NO: 491111 - protein, 13 aa, Mycobacterium
GPAARSHAAKTIS

SEQ ID NO: 491112 - protein, 20 aa, Mycobacterium
GPAARTGRTCGEPPARRENP

SEQ ID NO: 491113 - protein, 9 aa, Mycobacterium
GPAASAATA

SEQ ID NO: 491114 - protein, 8 aa, Mycobacterium
GPAASGKS

SEQ ID NO: 491115 - protein, 10 aa, Mycobacterium
GPAASGRNYE

SEQ ID NO: 491116 - protein, 18 aa, Mycobacterium
GPAASSTGREMNSPALQY

SEQ ID NO: 491117 - protein, 5 aa, Mycobacterium
GPAAT

SEQ ID NO: 491118 - protein, 8 aa, Mycobacterium
GPAATGKS

SEQ ID NO: 491119 - protein, 7 aa, Mycobacterium
GPAATLA

SEQ ID NO: 491120 - protein, 14 aa, Mycobacterium
GPAATLGDKPPPEA

SEQ ID NO: 491121 - protein, 8 aa, Mycobacterium
GPAATPAD

SEQ ID NO: 491122 - protein, 27 aa, Mycobacterium
GPAATPLSRVSRGAGNRTGDGSDGVVQ

SEQ ID NO: 491123 - protein, 16 aa, Mycobacterium
GPAAYRNRTRLPAFAR

SEQ ID NO: 491124 - protein, 6 aa, Mycobacterium
GPACGK

SEQ ID NO: 491125 - protein, 5 aa, Mycobacterium
GPACT

SEQ ID NO: 491126 - protein, 4 aa, Mycobacterium
GPAD

SEQ ID NO: 491127 - protein, 10 aa, Mycobacterium
GPADAPDTRR

SEQ ID NO: 491128 - protein, 10 aa, Mycobacterium
GPADDPDGIV

SEQ ID NO: 491129 - protein, 12 aa, Mycobacterium
GPADDPRVTDDG

SEQ ID NO: 491130 - protein, 5 aa, Mycobacterium
GPADE

SEQ ID NO: 491131 - protein, 11 aa, Mycobacterium
GPADEYDQHGK

SEQ ID NO: 491132 - protein, 5 aa, Mycobacterium
GPADG

SEQ ID NO: 491133 - protein, 8 aa, Mycobacterium
GPADGASN

SEQ ID NO: 491134 - protein, 10 aa, Mycobacterium
GPADGDGPQN

SEQ ID NO: 491135 - protein, 8 aa, Mycobacterium
GPADGGSN

SEQ ID NO: 491136 - protein, 8 aa, Mycobacterium
GPADGSSN

SEQ ID NO: 491137 - protein, 6 aa, Mycobacterium
GPADGV

SEQ ID NO: 491138 - protein, 5 aa, Mycobacterium
GPADH

SEQ ID NO: 491139 - protein, 12 aa, Mycobacterium
GPADHPDPEGLD

SEQ ID NO: 491140 - protein, 6 aa, Mycobacterium
GPADIA

SEQ ID NO: 491141 - protein, 11 aa, Mycobacterium
GPADIDTARAQ

SEQ ID NO: 491142 - protein, 6 aa, Mycobacterium
GPADLA

SEQ ID NO: 491143 - protein, 19 aa, Mycobacterium
GPADLAGGYHRPDAYPVEE

SEQ ID NO: 491144 - protein, 15 aa, Mycobacterium
GPADLDRRPYPVEET

SEQ ID NO: 491145 - protein, 12 aa, Mycobacterium
GPADPDRGAGGP

SEQ ID NO: 491146 - protein, 12 aa, Mycobacterium
GPADQSPGAPRD

SEQ ID NO: 491147 - protein, 7 aa, Mycobacterium
GPADRAG

SEQ ID NO: 491148 - protein, 13 aa, Mycobacterium
GPADSHRAATARQ

SEQ ID NO: 491149 - protein, 5 aa, Mycobacterium
GPADT

SEQ ID NO: 491150 - protein, 5 aa, Mycobacterium
GPADY

SEQ ID NO: 491151 - protein, 8 aa, Mycobacterium
GPAEAPQR

SEQ ID NO: 491152 - protein, 6 aa, Mycobacterium
GPAEDV

SEQ ID NO: 491153 - protein, 6 aa, Mycobacterium
GPAEEL

SEQ ID NO: 491154 - protein, 5 aa, Mycobacterium
GPAEF

SEQ ID NO: 491155 - protein, 8 aa, Mycobacterium
GPAEPPPW

SEQ ID NO: 491156 - protein, 6 aa, Mycobacterium
GPAEQA

SEQ ID NO: 491157 - protein, 8 aa, Mycobacterium
GPAEQKAL

SEQ ID NO: 491158 - protein, 6 aa, Mycobacterium
GPAERA

SEQ ID NO: 491159 - protein, 7 aa, Mycobacterium
GPAERAA

SEQ ID NO: 491160 - protein, 6 aa, Mycobacterium
GPAERI

SEQ ID NO: 491161 - protein, 5 aa, Mycobacterium
GPAET

SEQ ID NO: 491162 - protein, 8 aa, Mycobacterium
GPAETRPL

SEQ ID NO: 491163 - protein, 4 aa, Mycobacterium
GPAF

SEQ ID NO: 491164 - protein, 5 aa, Mycobacterium
GPAFA

SEQ ID NO: 491165 - protein, 9 aa, Mycobacterium
GPAFPRAKS

SEQ ID NO: 491166 - protein, 10 aa, Mycobacterium
GPAGDPDGIV

SEQ ID NO: 491167 - protein, 12 aa, Mycobacterium
GPAGEGSIGPDD

SEQ ID NO: 491168 - protein, 8 aa, Mycobacterium
GPAGEPNH

SEQ ID NO: 491169 - protein, 6 aa, Mycobacterium
GPAGER

SEQ ID NO: 491170 - protein, 7 aa, Mycobacterium
GPAGERY

SEQ ID NO: 491171 - protein, 13 aa, Mycobacterium
GPAGGKGPSWPQV

SEQ ID NO: 491172 - protein, 5 aa, Mycobacterium
GPAGI

SEQ ID NO: 491173 - protein, 6 aa, Mycobacterium
GPAGIA

SEQ ID NO: 491174 - protein, 6 aa, Mycobacterium
GPAGID

SEQ ID NO: 491175 - protein, 6 aa, Mycobacterium
GPAGIG

SEQ ID NO: 491176 - protein, 5 aa, Mycobacterium
GPAGL

SEQ ID NO: 491177 - protein, 8 aa, Mycobacterium
GPAGLDPG

SEQ ID NO: 491178 - protein, 6 aa, Mycobacterium
GPAGLG

SEQ ID NO: 491179 - protein, 5 aa, Mycobacterium
GPAGM

SEQ ID NO: 491180 - protein, 27 aa, Mycobacterium
GPAGPQPASPPPADPAGGASGSDPVDA

SEQ ID NO: 491181 - protein, 9 aa, Mycobacterium
GPAGPSWRK

SEQ ID NO: 491182 - protein, 5 aa, Mycobacterium
GPAGQ

SEQ ID NO: 491183 - protein, 14 aa, Mycobacterium
GPAGRGRSAPDSIV

SEQ ID NO: 491184 - protein, 8 aa, Mycobacterium
GPAGSGKT

SEQ ID NO: 491185 - protein, 9 aa, Mycobacterium
GPAGSSVMQ

SEQ ID NO: 491186 - protein, 7 aa, Mycobacterium
GPAGTQL

SEQ ID NO: 491187 - protein, 7 aa, Mycobacterium
GPAGVDQ

SEQ ID NO: 491188 - protein, 7 aa, Mycobacterium
GPAGVGK

SEQ ID NO: 491189 - protein, 8 aa, Mycobacterium
GPAGVGKA

SEQ ID NO: 491190 - protein, 9 aa, Mycobacterium
GPAGVGKAT

SEQ ID NO: 491191 - protein, 10 aa, Mycobacterium
GPAGVGKTEL

SEQ ID NO: 491192 - protein, 4 aa, Mycobacterium
GPAH

SEQ ID NO: 491193 - protein, 9 aa, Mycobacterium
GPAHAAGDH

SEQ ID NO: 491194 - protein, 9 aa, Mycobacterium
GPAHSVGAT

SEQ ID NO: 491195 - protein, 8 aa, Mycobacterium
GPAHVPPA

SEQ ID NO: 491196 - protein, 14 aa, Mycobacterium
GPAIAAPAATRNPV

SEQ ID NO: 491197 - protein, 7 aa, Mycobacterium
GPAIAGG

SEQ ID NO: 491198 - protein, 9 aa, Mycobacterium
GPAIDPDRL

SEQ ID NO: 491199 - protein, 6 aa, Mycobacterium
GPAIEA

SEQ ID NO: 491200 - protein, 18 aa, Mycobacterium
GPAIEAHKGEQRNPVATG

SEQ ID NO: 491201 - protein, 17 aa, Mycobacterium
GPAIEAPAATRNPADRV

SEQ ID NO: 491202 - protein, 14 aa, Mycobacterium
GPAKDAGAAGGAGE

SEQ ID NO: 491203 - protein, 20 aa, Mycobacterium
GPAKELEDHREAYGDTSGLS

SEQ ID NO: 491204 - protein, 8 aa, Mycobacterium
GPAKGARA

SEQ ID NO: 491205 - protein, 22 aa, Mycobacterium
GPAKTPSGHVSGSLGPTTAGRM

SEQ ID NO: 491206 - protein, 9 aa, Mycobacterium
GPAKTTKVE

SEQ ID NO: 491207 - protein, 9 aa, Mycobacterium
GPAKTTQIE

SEQ ID NO: 491208 - protein, 14 aa, Mycobacterium
GPALASRSDNTPYE

SEQ ID NO: 491209 - protein, 7 aa, Mycobacterium
GPALDDP

SEQ ID NO: 491210 - protein, 9 aa, Mycobacterium
GPALDEPAR

SEQ ID NO: 491211 - protein, 5 aa, Mycobacterium
GPALE

SEQ ID NO: 491212 - protein, 7 aa, Mycobacterium
GPALHGG

SEQ ID NO: 491213 - protein, 6 aa, Mycobacterium
GPALSR

SEQ ID NO: 491214 - protein, 9 aa, Mycobacterium
GPALTAEQV

SEQ ID NO: 491215 - protein, 8 aa, Mycobacterium
GPAMQPAS

SEQ ID NO: 491216 - protein, 16 aa, Mycobacterium
GPANEEPPERPTPGPL

SEQ ID NO: 491217 - protein, 5 aa, Mycobacterium
GPANL

SEQ ID NO: 491218 - protein, 8 aa, Mycobacterium
GPANPGGE

SEQ ID NO: 491219 - protein, 7 aa, Mycobacterium
GPAPAAP

SEQ ID NO: 491220 - protein, 11 aa, Mycobacterium
GPAPADDSRPN

SEQ ID NO: 491221 - protein, 9 aa, Mycobacterium
GPAPAEGQA

SEQ ID NO: 491222 - protein, 6 aa, Mycobacterium
GPAPAG

SEQ ID NO: 491223 - protein, 12 aa, Mycobacterium
GPAPAPPRPRYV

SEQ ID NO: 491224 - protein, 8 aa, Mycobacterium
GPAPARQS

SEQ ID NO: 491225 - protein, 10 aa, Mycobacterium
GPAPASGDAL

SEQ ID NO: 491226 - protein, 15 aa, Mycobacterium
GPAPDRDPAPTEPRR

SEQ ID NO: 491227 - protein, 8 aa, Mycobacterium
GPAPEPVK

SEQ ID NO: 491228 - protein, 7 aa, Mycobacterium
GPAPERV

SEQ ID NO: 491229 - protein, 10 aa, Mycobacterium
GPAPGGLRPA

SEQ ID NO: 491230 - protein, 6 aa, Mycobacterium
GPAPGL

SEQ ID NO: 491231 - protein, 7 aa, Mycobacterium
GPAPLQA

SEQ ID NO: 491232 - protein, 5 aa, Mycobacterium
GPAPM

SEQ ID NO: 491233 - protein, 8 aa, Mycobacterium
GPAPQKAR

SEQ ID NO: 491234 - protein, 5 aa, Mycobacterium
GPAPR

SEQ ID NO: 491235 - protein, 14 aa, Mycobacterium
GPAPRAQRHRAQEA

SEQ ID NO: 491236 - protein, 19 aa, Mycobacterium
GPAPRSPESVEGWDRSLTH

SEQ ID NO: 491237 - protein, 19 aa, Mycobacterium
GPAPRSPESVEGWDRSLTN

SEQ ID NO: 491238 - protein, 10 aa, Mycobacterium
GPAPSGLRAP

SEQ ID NO: 491239 - protein, 13 aa, Mycobacterium
GPAPTAPTENPIQ

SEQ ID NO: 491240 - protein, 8 aa, Mycobacterium
GPAPTPVK

SEQ ID NO: 491241 - protein, 7 aa, Mycobacterium
GPAPTSV

SEQ ID NO: 491242 - protein, 8 aa, Mycobacterium
GPAPTSVH

SEQ ID NO: 491243 - protein, 10 aa, Mycobacterium
GPAPTTTSIP

SEQ ID NO: 491244 - protein, 11 aa, Mycobacterium
GPAPVQPGGPP

SEQ ID NO: 491245 - protein, 8 aa, Mycobacterium
GPAPVTNA

SEQ ID NO: 491246 - protein, 15 aa, Mycobacterium
GPAQADFADDPQARQ

SEQ ID NO: 491247 - protein, 6 aa, Mycobacterium
GPAQDP

SEQ ID NO: 491248 - protein, 11 aa, Mycobacterium
GPAQGGRGEGV

SEQ ID NO: 491249 - protein, 9 aa, Mycobacterium
GPAQPRPAA

SEQ ID NO: 491250 - protein, 5 aa, Mycobacterium
GPAQQ

SEQ ID NO: 491251 - protein, 5 aa, Mycobacterium
GPARA

SEQ ID NO: 491252 - protein, 20 aa, Mycobacterium
GPARDLREQPSGRNSATPIA

SEQ ID NO: 491253 - protein, 8 aa, Mycobacterium
GPARGASK

SEQ ID NO: 491254 - protein, 6 aa, Mycobacterium
GPARGM

SEQ ID NO: 491255 - protein, 5 aa, Mycobacterium
GPARN

SEQ ID NO: 491256 - protein, 232 aa, Mycobacterium
GPARPGDEYYDERYGRQDDPRGGQYPPEQGGYPPQDQGGYPPRGGGYPDQGGYPDQGGYPDQGGYPDQGGYPPQSYEQRPPAGYGPPPQGGGYDRGYGQPAGGYPPAGPPAGPPPGGQPGYGGADYDYGRQAPRHDDYGRPDPRQGYPEQGGYPEQGGYGGQAYGRPDYGQPDYGQQPGRGYPEQGGYPEQGGYGEPAGRDYEYGGDYGAPAGQGGYGGGYGADYPAGGTTV

SEQ ID NO: 491257 - protein, 9 aa, Mycobacterium
GPARSPGAE

SEQ ID NO: 491258 - protein, 8 aa, Mycobacterium
GPARSSGA

SEQ ID NO: 491259 - protein, 13 aa, Mycobacterium
GPARSWTDAQSSV

SEQ ID NO: 491260 - protein, 5 aa, Mycobacterium
GPART

SEQ ID NO: 491261 - protein, 6 aa, Mycobacterium
GPARVL

SEQ ID NO: 491262 - protein, 6 aa, Mycobacterium
GPASAA

SEQ ID NO: 491263 - protein, 15 aa, Mycobacterium
GPASAAMASAAAPYT

SEQ ID NO: 491264 - protein, 7 aa, Mycobacterium
GPASASM

SEQ ID NO: 491265 - protein, 12 aa, Mycobacterium
GPASELSPASPI

SEQ ID NO: 491266 - protein, 9 aa, Mycobacterium
GPASESCHG

SEQ ID NO: 491267 - protein, 7 aa, Mycobacterium
GPASESM

SEQ ID NO: 491268 - protein, 12 aa, Mycobacterium
GPASESSIGSDT

SEQ ID NO: 491269 - protein, 5 aa, Mycobacterium
GPASF

SEQ ID NO: 491270 - protein, 7 aa, Mycobacterium
GPASGLG

SEQ ID NO: 491271 - protein, 8 aa, Mycobacterium
GPASQADG

SEQ ID NO: 491272 - protein, 14 aa, Mycobacterium
GPASRWAAAAKAGD

SEQ ID NO: 491273 - protein, 10 aa, Mycobacterium
GPASTGKTTL

SEQ ID NO: 491274 - protein, 6 aa, Mycobacterium
GPASTR

SEQ ID NO: 491275 - protein, 12 aa, Mycobacterium
GPASTSMATAAS

SEQ ID NO: 491276 - protein, 9 aa, Mycobacterium
GPASVPAQP

SEQ ID NO: 491277 - protein, 5 aa, Mycobacterium
GPASY

SEQ ID NO: 491278 - protein, 11 aa, Mycobacterium
GPATAQATPTQ

SEQ ID NO: 491279 - protein, 5 aa, Mycobacterium
GPATD

SEQ ID NO: 491280 - protein, 7 aa, Mycobacterium
GPATDLG

SEQ ID NO: 491281 - protein, 7 aa, Mycobacterium
GPATDTA

SEQ ID NO: 491282 - protein, 8 aa, Mycobacterium
GPATDVTA

SEQ ID NO: 491283 - protein, 6 aa, Mycobacterium
GPATGA

SEQ ID NO: 491284 - protein, 15 aa, Mycobacterium
GPATLKSRNLAANPA

SEQ ID NO: 491285 - protein, 13 aa, Mycobacterium
GPATNNDGPPQTY

SEQ ID NO: 491286 - protein, 7 aa, Mycobacterium
GPATNSD

SEQ ID NO: 491287 - protein, 6 aa, Mycobacterium
GPATPR

SEQ ID NO: 491288 - protein, 8 aa, Mycobacterium
GPATQSDD

SEQ ID NO: 491289 - protein, 7 aa, Mycobacterium
GPATRAS

SEQ ID NO: 491290 - protein, 7 aa, Mycobacterium
GPATSRP

SEQ ID NO: 491291 - protein, 5 aa, Mycobacterium
GPATV

SEQ ID NO: 491292 - protein, 6 aa, Mycobacterium
GPATYR

SEQ ID NO: 491293 - protein, 13 aa, Mycobacterium
GPAVDAADADTAA

SEQ ID NO: 491294 - protein, 12 aa, Mycobacterium
GPAVDAGDADAA

SEQ ID NO: 491295 - protein, 13 aa, Mycobacterium
GPAVDAGDPDAAA

SEQ ID NO: 491296 - protein, 6 aa, Mycobacterium
GPAVDD

SEQ ID NO: 491297 - protein, 18 aa, Mycobacterium
GPAVEAHAGERKNPVATG

SEQ ID NO: 491298 - protein, 9 aa, Mycobacterium
GPAVEVADD

SEQ ID NO: 491299 - protein, 8 aa, Mycobacterium
GPAVPRPT

SEQ ID NO: 491300 - protein, 53 aa, Mycobacterium
GPAVQAGPLPAYGSDLRQSGSVPPAMSSAPAAPVSGAPVAPSPSSSPSAGGPL

SEQ ID NO: 491301 - protein, 8 aa, Mycobacterium
GPAVQTSS

SEQ ID NO: 491302 - protein, 22 aa, Mycobacterium
GPAWASKGPNEITGELGGTVTG

SEQ ID NO: 491303 - protein, 5 aa, Mycobacterium
GPAYD

SEQ ID NO: 491304 - protein, 12 aa, Mycobacterium
GPAYGRSPGDPY

SEQ ID NO: 491305 - protein, 21 aa, Mycobacterium
GPAYNTGGPWGYTPKGGTGVP

SEQ ID NO: 491306 - protein, 9 aa, Mycobacterium
GPAYNTGSA

SEQ ID NO: 491307 - protein, 6 aa, Mycobacterium
GPAYQA

SEQ ID NO: 491308 - protein, 11 aa, Mycobacterium
GPCERSDLTAG

SEQ ID NO: 491309 - protein, 7 aa, Mycobacterium
GPCGPSS

SEQ ID NO: 491310 - protein, 6 aa, Mycobacterium
GPCGQE

SEQ ID NO: 491311 - protein, 4 aa, Mycobacterium
GPCP

SEQ ID NO: 491312 - protein, 4 aa, Mycobacterium
GPCR

SEQ ID NO: 491313 - protein, 5 aa, Mycobacterium
GPCRQ

SEQ ID NO: 491314 - protein, 8 aa, Mycobacterium
GPCTQNGE

SEQ ID NO: 491315 - protein, 13 aa, Mycobacterium
GPDAALRARQQSA

SEQ ID NO: 491316 - protein, 9 aa, Mycobacterium
GPDAALSAA

SEQ ID NO: 491317 - protein, 6 aa, Mycobacterium
GPDAAY

SEQ ID NO: 491318 - protein, 8 aa, Mycobacterium
GPDADAMD

SEQ ID NO: 491319 - protein, 10 aa, Mycobacterium
GPDADDVAVG

SEQ ID NO: 491320 - protein, 11 aa, Mycobacterium
GPDADGPDGSI

SEQ ID NO: 491321 - protein, 5 aa, Mycobacterium
GPDAF

SEQ ID NO: 491322 - protein, 5 aa, Mycobacterium
GPDAG

SEQ ID NO: 491323 - protein, 11 aa, Mycobacterium
GPDAGGHRGTF

SEQ ID NO: 491324 - protein, 10 aa, Mycobacterium
GPDAGWQGAG

SEQ ID NO: 491325 - protein, 11 aa, Mycobacterium
GPDAHDSASAQ

SEQ ID NO: 491326 - protein, 11 aa, Mycobacterium
GPDAISEHDRI

SEQ ID NO: 491327 - protein, 6 aa, Mycobacterium
GPDAKR

SEQ ID NO: 491328 - protein, 16 aa, Mycobacterium
GPDALADTRQSGGGED

SEQ ID NO: 491329 - protein, 21 aa, Mycobacterium
GPDALPADGEGIASPDWAQHS

SEQ ID NO: 491330 - protein, 25 aa, Mycobacterium
GPDALPADGSHGDEIASPTWAQTSA

SEQ ID NO: 491331 - protein, 21 aa, Mycobacterium
GPDALPANGEDISSPSWAQHS

SEQ ID NO: 491332 - protein, 8 aa, Mycobacterium
GPDALQTR

SEQ ID NO: 491333 - protein, 8 aa, Mycobacterium
GPDAPTGF

SEQ ID NO: 491334 - protein, 8 aa, Mycobacterium
GPDAPTGV

SEQ ID NO: 491335 - protein, 9 aa, Mycobacterium
GPDAPTGVP

SEQ ID NO: 491336 - protein, 5 aa, Mycobacterium
GPDAQ

SEQ ID NO: 491337 - protein, 9 aa, Mycobacterium
GPDAQRTPG

SEQ ID NO: 491338 - protein, 5 aa, Mycobacterium
GPDAS

SEQ ID NO: 491339 - protein, 10 aa, Mycobacterium
GPDASGAWSQ

SEQ ID NO: 491340 - protein, 12 aa, Mycobacterium
GPDATREAFTSE

SEQ ID NO: 491341 - protein, 24 aa, Mycobacterium
GPDCGGAGGRAASADPAGEDKAAR

SEQ ID NO: 491342 - protein, 4 aa, Mycobacterium
GPDD

SEQ ID NO: 491343 - protein, 19 aa, Mycobacterium
GPDDADARASGATGEGSVA

SEQ ID NO: 491344 - protein, 6 aa, Mycobacterium
GPDDAG

SEQ ID NO: 491345 - protein, 5 aa, Mycobacterium
GPDDD

SEQ ID NO: 491346 - protein, 12 aa, Mycobacterium
GPDDDGNIDPDY

SEQ ID NO: 491347 - protein, 6 aa, Mycobacterium
GPDDEI

SEQ ID NO: 491348 - protein, 10 aa, Mycobacterium
GPDDHHSGFR

SEQ ID NO: 491349 - protein, 11 aa, Mycobacterium
GPDDIGQTGGM

SEQ ID NO: 491350 - protein, 6 aa, Mycobacterium
GPDDPA

SEQ ID NO: 491351 - protein, 11 aa, Mycobacterium
GPDDPAPGVDA

SEQ ID NO: 491352 - protein, 9 aa, Mycobacterium
GPDDPSVDE

SEQ ID NO: 491353 - protein, 6 aa, Mycobacterium
GPDDQA

SEQ ID NO: 491354 - protein, 6 aa, Mycobacterium
GPDDTF

SEQ ID NO: 491355 - protein, 5 aa, Mycobacterium
GPDDV

SEQ ID NO: 491356 - protein, 8 aa, Mycobacterium
GPDDVARS

SEQ ID NO: 491357 - protein, 8 aa, Mycobacterium
GPDDVNSG

SEQ ID NO: 491358 - protein, 11 aa, Mycobacterium
GPDDVSGPRWG

SEQ ID NO: 491359 - protein, 5 aa, Mycobacterium
GPDDY

SEQ ID NO: 491360 - protein, 6 aa, Mycobacterium
GPDDYR

SEQ ID NO: 491361 - protein, 8 aa, Mycobacterium
GPDEADAL

SEQ ID NO: 491362 - protein, 8 aa, Mycobacterium
GPDEAEQI

SEQ ID NO: 491363 - protein, 10 aa, Mycobacterium
GPDELQSRNP

SEQ ID NO: 491364 - protein, 7 aa, Mycobacterium
GPDENAM

SEQ ID NO: 491365 - protein, 16 aa, Mycobacterium
GPDEQDAHGGSAGRPV

SEQ ID NO: 491366 - protein, 8 aa, Mycobacterium
GPDERNAQ

SEQ ID NO: 491367 - protein, 6 aa, Mycobacterium
GPDESA

SEQ ID NO: 491368 - protein, 6 aa, Mycobacterium
GPDETL

SEQ ID NO: 491369 - protein, 15 aa, Mycobacterium
GPDETPPEGWDQDPD

SEQ ID NO: 491370 - protein, 13 aa, Mycobacterium
GPDETPPQGWEQD

SEQ ID NO: 491371 - protein, 17 aa, Mycobacterium
GPDETTPADEVPGGGTL

SEQ ID NO: 491372 - protein, 5 aa, Mycobacterium
GPDEV

SEQ ID NO: 491373 - protein, 8 aa, Mycobacterium
GPDEVRDR

SEQ ID NO: 491374 - protein, 4 aa, Mycobacterium
GPDF

SEQ ID NO: 491375 - protein, 5 aa, Mycobacterium
GPDFP

SEQ ID NO: 491376 - protein, 6 aa, Mycobacterium
GPDFPT

SEQ ID NO: 491377 - protein, 7 aa, Mycobacterium
GPDFPTS

SEQ ID NO: 491378 - protein, 5 aa, Mycobacterium
GPDFR

SEQ ID NO: 491379 - protein, 7 aa, Mycobacterium
GPDFRPS

SEQ ID NO: 491380 - protein, 10 aa, Mycobacterium
GPDGAAEPAE

SEQ ID NO: 491381 - protein, 13 aa, Mycobacterium
GPDGAIAAQGATR

SEQ ID NO: 491382 - protein, 8 aa, Mycobacterium
GPDGAREV

SEQ ID NO: 491383 - protein, 10 aa, Mycobacterium
GPDGDSITSV

SEQ ID NO: 491384 - protein, 5 aa, Mycobacterium
GPDGE

SEQ ID NO: 491385 - protein, 13 aa, Mycobacterium
GPDGEDVAPGQTG

SEQ ID NO: 491386 - protein, 9 aa, Mycobacterium
GPDGEPTRV

SEQ ID NO: 491387 - protein, 48 aa, Mycobacterium
GPDGGGRTPTTNGKALAGATADAVAPAARLPGDQARATSRRARTAQKR

SEQ ID NO: 491388 - protein, 10 aa, Mycobacterium
GPDGGPGVAE

SEQ ID NO: 491389 - protein, 12 aa, Mycobacterium
GPDGHDPRQSAA

SEQ ID NO: 491390 - protein, 8 aa, Mycobacterium
GPDGHGKY

SEQ ID NO: 491391 - protein, 17 aa, Mycobacterium
GPDGKPTAEERYSRDLS

SEQ ID NO: 491392 - protein, 10 aa, Mycobacterium
GPDGKRQPAH

SEQ ID NO: 491393 - protein, 7 aa, Mycobacterium
GPDGLGP

SEQ ID NO: 491394 - protein, 6 aa, Mycobacterium
GPDGLT

SEQ ID NO: 491395 - protein, 5 aa, Mycobacterium
GPDGM

SEQ ID NO: 491396 - protein, 9 aa, Mycobacterium
GPDGPDNRA

SEQ ID NO: 491397 - protein, 12 aa, Mycobacterium
GPDGPDRLPPEH

SEQ ID NO: 491398 - protein, 9 aa, Mycobacterium
GPDGPGGRR

SEQ ID NO: 491399 - protein, 8 aa, Mycobacterium
GPDGPISE

SEQ ID NO: 491400 - protein, 9 aa, Mycobacterium
GPDGPSRAD

SEQ ID NO: 491401 - protein, 10 aa, Mycobacterium
GPDGPSVGGS

SEQ ID NO: 491402 - protein, 7 aa, Mycobacterium
GPDGQQW

SEQ ID NO: 491403 - protein, 8 aa, Mycobacterium
GPDGRDCP

SEQ ID NO: 491404 - protein, 7 aa, Mycobacterium
GPDGRGH

SEQ ID NO: 491405 - protein, 8 aa, Mycobacterium
GPDGRRHK

SEQ ID NO: 491406 - protein, 6 aa, Mycobacterium
GPDGSA

SEQ ID NO: 491407 - protein, 10 aa, Mycobacterium
GPDGSESTRE

SEQ ID NO: 491408 - protein, 10 aa, Mycobacterium
GPDGSLPDDL

SEQ ID NO: 491409 - protein, 8 aa, Mycobacterium
GPDGSNTY

SEQ ID NO: 491410 - protein, 12 aa, Mycobacterium
GPDGTKTPGVKV

SEQ ID NO: 491411 - protein, 8 aa, Mycobacterium
GPDGTNRY

SEQ ID NO: 491412 - protein, 6 aa, Mycobacterium
GPDGTR

SEQ ID NO: 491413 - protein, 9 aa, Mycobacterium
GPDGTRDVS

SEQ ID NO: 491414 - protein, 7 aa, Mycobacterium
GPDGTVA

SEQ ID NO: 491415 - protein, 9 aa, Mycobacterium
GPDGTVTSY

SEQ ID NO: 491416 - protein, 5 aa, Mycobacterium
GPDGV

SEQ ID NO: 491417 - protein, 10 aa, Mycobacterium
GPDGVGKSTL

SEQ ID NO: 491418 - protein, 5 aa, Mycobacterium
GPDGW

SEQ ID NO: 491419 - protein, 6 aa, Mycobacterium
GPDHES

SEQ ID NO: 491420 - protein, 5 aa, Mycobacterium
GPDHT

SEQ ID NO: 491421 - protein, 6 aa, Mycobacterium
GPDIGG

SEQ ID NO: 491422 - protein, 15 aa, Mycobacterium
GPDITSRATVPADAE

SEQ ID NO: 491423 - protein, 19 aa, Mycobacterium
GPDKITDDGREQLRALGFT

SEQ ID NO: 491424 - protein, 6 aa, Mycobacterium
GPDKVG

SEQ ID NO: 491425 - protein, 14 aa, Mycobacterium
GPDLASRSANTPYE

SEQ ID NO: 491426 - protein, 5 aa, Mycobacterium
GPDLG

SEQ ID NO: 491427 - protein, 7 aa, Mycobacterium
GPDLGEH

SEQ ID NO: 491428 - protein, 6 aa, Mycobacterium
GPDLGG

SEQ ID NO: 491429 - protein, 7 aa, Mycobacterium
GPDLGGE

SEQ ID NO: 491430 - protein, 7 aa, Mycobacterium
GPDLGGR

SEQ ID NO: 491431 - protein, 9 aa, Mycobacterium
GPDLKPAYT

SEQ ID NO: 491432 - protein, 114 aa, Mycobacterium
GPDLPDVDEGGAVTSDIDEDAVAQRDSASSTERSAPAEESRSAVGGADSDGRDDVVDPEPAAPEAETSEAETVTETEADDADDADDGADADDEDIDADGADADGEDTAGNTAEA

SEQ ID NO: 491433 - protein, 5 aa, Mycobacterium
GPDLS

SEQ ID NO: 491434 - protein, 8 aa, Mycobacterium
GPDNAAES

SEQ ID NO: 491435 - protein, 8 aa, Mycobacterium
GPDNANAA

SEQ ID NO: 491436 - protein, 10 aa, Mycobacterium
GPDNGESEEQ

SEQ ID NO: 491437 - protein, 13 aa, Mycobacterium
GPDNRSVTDGGWT

SEQ ID NO: 491438 - protein, 12 aa, Mycobacterium
GPDPAEYVGGSP

SEQ ID NO: 491439 - protein, 7 aa, Mycobacterium
GPDPARE

SEQ ID NO: 491440 - protein, 15 aa, Mycobacterium
GPDPDALYGGSYSAD

SEQ ID NO: 491441 - protein, 8 aa, Mycobacterium
GPDPDAQA

SEQ ID NO: 491442 - protein, 6 aa, Mycobacterium
GPDPDD

SEQ ID NO: 491443 - protein, 10 aa, Mycobacterium
GPDPDGEGDL

SEQ ID NO: 491444 - protein, 6 aa, Mycobacterium
GPDPDM

SEQ ID NO: 491445 - protein, 15 aa, Mycobacterium
GPDPEANYAGSYTAD

SEQ ID NO: 491446 - protein, 11 aa, Mycobacterium
GPDPESAQATY

SEQ ID NO: 491447 - protein, 8 aa, Mycobacterium
GPDPEVNT

SEQ ID NO: 491448 - protein, 9 aa, Mycobacterium
GPDPKEING

SEQ ID NO: 491449 - protein, 13 aa, Mycobacterium
GPDPLRGDADPSW

SEQ ID NO: 491450 - protein, 12 aa, Mycobacterium
GPDPLRKDADPS

SEQ ID NO: 491451 - protein, 12 aa, Mycobacterium
GPDPLRPDADAS

SEQ ID NO: 491452 - protein, 13 aa, Mycobacterium
GPDPLRPDADPSL

SEQ ID NO: 491453 - protein, 15 aa, Mycobacterium
GPDPLRPRSDPASAF

SEQ ID NO: 491454 - protein, 12 aa, Mycobacterium
GPDPLRRDADPS

SEQ ID NO: 491455 - protein, 9 aa, Mycobacterium
GPDPRTEGA

SEQ ID NO: 491456 - protein, 10 aa, Mycobacterium
GPDPSPDTET

SEQ ID NO: 491457 - protein, 8 aa, Mycobacterium
GPDPSSLS

SEQ ID NO: 491458 - protein, 7 aa, Mycobacterium
GPDPVAE

SEQ ID NO: 491459 - protein, 8 aa, Mycobacterium
GPDPVDEG

SEQ ID NO: 491460 - protein, 8 aa, Mycobacterium
GPDQAGDV

SEQ ID NO: 491461 - protein, 5 aa, Mycobacterium
GPDQD

SEQ ID NO: 491462 - protein, 8 aa, Mycobacterium
GPDQGGCG

SEQ ID NO: 491463 - protein, 12 aa, Mycobacterium
GPDQPDGAPGLA

SEQ ID NO: 491464 - protein, 17 aa, Mycobacterium
GPDQRNQADTAYGPNAE

SEQ ID NO: 491465 - protein, 8 aa, Mycobacterium
GPDQRSGD

SEQ ID NO: 491466 - protein, 5 aa, Mycobacterium
GPDRA

SEQ ID NO: 491467 - protein, 6 aa, Mycobacterium
GPDRAA

SEQ ID NO: 491468 - protein, 11 aa, Mycobacterium
GPDRAHTGQIG

SEQ ID NO: 491469 - protein, 6 aa, Mycobacterium
GPDRGT

SEQ ID NO: 491470 - protein, 6 aa, Mycobacterium
GPDRPA

SEQ ID NO: 491471 - protein, 8 aa, Mycobacterium
GPDRPGDT

SEQ ID NO: 491472 - protein, 8 aa, Mycobacterium
GPDRPGQT

SEQ ID NO: 491473 - protein, 5 aa, Mycobacterium
GPDRT

SEQ ID NO: 491474 - protein, 11 aa, Mycobacterium
GPDRVRDTPLS

SEQ ID NO: 491475 - protein, 8 aa, Mycobacterium
GPDRVRPG

SEQ ID NO: 491476 - protein, 8 aa, Mycobacterium
GPDSAEDT

SEQ ID NO: 491477 - protein, 5 aa, Mycobacterium
GPDSD

SEQ ID NO: 491478 - protein, 9 aa, Mycobacterium
GPDSDREGT

SEQ ID NO: 491479 - protein, 6 aa, Mycobacterium
GPDSDV

SEQ ID NO: 491480 - protein, 20 aa, Mycobacterium
GPDSDYMTGQAGLIDGGLVY

SEQ ID NO: 491481 - protein, 6 aa, Mycobacterium
GPDSED

SEQ ID NO: 491482 - protein, 8 aa, Mycobacterium
GPDSETPM

SEQ ID NO: 491483 - protein, 19 aa, Mycobacterium
GPDSGWDRNGDQAPPPLPP

SEQ ID NO: 491484 - protein, 7 aa, Mycobacterium
GPDSHTA

SEQ ID NO: 491485 - protein, 8 aa, Mycobacterium
GPDSKTAL

SEQ ID NO: 491486 - protein, 8 aa, Mycobacterium
GPDSPAGR

SEQ ID NO: 491487 - protein, 11 aa, Mycobacterium
GPDSPLEPEKP

SEQ ID NO: 491488 - protein, 6 aa, Mycobacterium
GPDSPT

SEQ ID NO: 491489 - protein, 9 aa, Mycobacterium
GPDSPVSGV

SEQ ID NO: 491490 - protein, 8 aa, Mycobacterium
GPDSRERV

SEQ ID NO: 491491 - protein, 8 aa, Mycobacterium
GPDSSGET

SEQ ID NO: 491492 - protein, 5 aa, Mycobacterium
GPDST

SEQ ID NO: 491493 - protein, 4 aa, Mycobacterium
GPDT

SEQ ID NO: 491494 - protein, 27 aa, Mycobacterium
GPDTASHLHGPDSDAAVESYRTSDATL

SEQ ID NO: 491495 - protein, 5 aa, Mycobacterium
GPDTD

SEQ ID NO: 491496 - protein, 6 aa, Mycobacterium
GPDTDI

SEQ ID NO: 491497 - protein, 9 aa, Mycobacterium
GPDTDVREL

SEQ ID NO: 491498 - protein, 6 aa, Mycobacterium
GPDTEA

SEQ ID NO: 491499 - protein, 6 aa, Mycobacterium
GPDTEL

SEQ ID NO: 491500 - protein, 8 aa, Mycobacterium
GPDTEPLQ

SEQ ID NO: 491501 - protein, 7 aa, Mycobacterium
GPDTFAD

SEQ ID NO: 491502 - protein, 8 aa, Mycobacterium
GPDTFGGV

SEQ ID NO: 491503 - protein, 9 aa, Mycobacterium
GPDTKPSPR

SEQ ID NO: 491504 - protein, 8 aa, Mycobacterium
GPDTPAGK

SEQ ID NO: 491505 - protein, 32 aa, Mycobacterium
GPDTPTASGRSAYARTKGYADRAARRLQDEGA

SEQ ID NO: 491506 - protein, 9 aa, Mycobacterium
GPDTRSAAG

SEQ ID NO: 491507 - protein, 8 aa, Mycobacterium
GPDTRTID

SEQ ID NO: 491508 - protein, 5 aa, Mycobacterium
GPDTS

SEQ ID NO: 491509 - protein, 14 aa, Mycobacterium
GPDVAAAPVDPAPK

SEQ ID NO: 491510 - protein, 15 aa, Mycobacterium
GPDVDATALADRLSS

SEQ ID NO: 491511 - protein, 10 aa, Mycobacterium
GPDVGQNHEQ

SEQ ID NO: 491512 - protein, 10 aa, Mycobacterium
GPDVNEADAQ

SEQ ID NO: 491513 - protein, 11 aa, Mycobacterium
GPDVPPPPPVR

SEQ ID NO: 491514 - protein, 9 aa, Mycobacterium
GPDVPTLSQ

SEQ ID NO: 491515 - protein, 10 aa, Mycobacterium
GPDVPTLSQA

SEQ ID NO: 491516 - protein, 6 aa, Mycobacterium
GPDVRE

SEQ ID NO: 491517 - protein, 10 aa, Mycobacterium
GPDVTEHEVG

SEQ ID NO: 491518 - protein, 7 aa, Mycobacterium
GPDVTTH

SEQ ID NO: 491519 - protein, 13 aa, Mycobacterium
GPDWGSGASVVGT

SEQ ID NO: 491520 - protein, 16 aa, Mycobacterium
GPDWRPERAPHDDLST

SEQ ID NO: 491521 - protein, 5 aa, Mycobacterium
GPDYA

SEQ ID NO: 491522 - protein, 9 aa, Mycobacterium
GPDYAGSDR

SEQ ID NO: 491523 - protein, 6 aa, Mycobacterium
GPDYGH

SEQ ID NO: 491524 - protein, 5 aa, Mycobacterium
GPEAA

SEQ ID NO: 491525 - protein, 7 aa, Mycobacterium
GPEAAEG

SEQ ID NO: 491526 - protein, 6 aa, Mycobacterium
GPEAED

SEQ ID NO: 491527 - protein, 5 aa, Mycobacterium
GPEAF

SEQ ID NO: 491528 - protein, 8 aa, Mycobacterium
GPEAGDEF

SEQ ID NO: 491529 - protein, 8 aa, Mycobacterium
GPEAPAAV

SEQ ID NO: 491530 - protein, 9 aa, Mycobacterium
GPEAPGGYS

SEQ ID NO: 491531 - protein, 4 aa, Mycobacterium
GPEC

SEQ ID NO: 491532 - protein, 5 aa, Mycobacterium
GPECP

SEQ ID NO: 491533 - protein, 6 aa, Mycobacterium
GPEDEI

SEQ ID NO: 491534 - protein, 13 aa, Mycobacterium
GPEDEIPLTAPDG

SEQ ID NO: 491535 - protein, 5 aa, Mycobacterium
GPEDG

SEQ ID NO: 491536 - protein, 6 aa, Mycobacterium
GPEDGA

SEQ ID NO: 491537 - protein, 16 aa, Mycobacterium
GPEDGAKTLAQRRLGG

SEQ ID NO: 491538 - protein, 5 aa, Mycobacterium
GPEDL

SEQ ID NO: 491539 - protein, 9 aa, Mycobacterium
GPEDLRARN

SEQ ID NO: 491540 - protein, 14 aa, Mycobacterium
GPEDLSTQLPRTGS

SEQ ID NO: 491541 - protein, 21 aa, Mycobacterium
GPEDPAGAGKPRKSRPSQRRR

SEQ ID NO: 491542 - protein, 11 aa, Mycobacterium
GPEDPDPEQRV

SEQ ID NO: 491543 - protein, 9 aa, Mycobacterium
GPEDPELSA

SEQ ID NO: 491544 - protein, 7 aa, Mycobacterium
GPEDPQW

SEQ ID NO: 491545 - protein, 12 aa, Mycobacterium
GPEDQVAGPDAV

SEQ ID NO: 491546 - protein, 5 aa, Mycobacterium
GPEDR

SEQ ID NO: 491547 - protein, 7 aa, Mycobacterium
GPEDRAG

SEQ ID NO: 491548 - protein, 7 aa, Mycobacterium
GPEDTDR

SEQ ID NO: 491549 - protein, 6 aa, Mycobacterium
GPEDVA

SEQ ID NO: 491550 - protein, 9 aa, Mycobacterium
GPEECAKRN

SEQ ID NO: 491551 - protein, 17 aa, Mycobacterium
GPEEETPAEEVPGGGTL

SEQ ID NO: 491552 - protein, 12 aa, Mycobacterium
GPEEGERGTLPE

SEQ ID NO: 491553 - protein, 21 aa, Mycobacterium
GPEELKGAHRTGKAEGTVRTR

SEQ ID NO: 491554 - protein, 5 aa, Mycobacterium
GPEEV

SEQ ID NO: 491555 - protein, 13 aa, Mycobacterium
GPEFNSATQAAGG

SEQ ID NO: 491556 - protein, 4 aa, Mycobacterium
GPEG

SEQ ID NO: 491557 - protein, 5 aa, Mycobacterium
GPEGA

SEQ ID NO: 491558 - protein, 17 aa, Mycobacterium
GPEGAESAGIGEDSSMS

SEQ ID NO: 491559 - protein, 8 aa, Mycobacterium
GPEGAQRA

SEQ ID NO: 491560 - protein, 5 aa, Mycobacterium
GPEGD

SEQ ID NO: 491561 - protein, 8 aa, Mycobacterium
GPEGDKHA

SEQ ID NO: 491562 - protein, 8 aa, Mycobacterium
GPEGEADK

SEQ ID NO: 491563 - protein, 11 aa, Mycobacterium
GPEGGAGGGTV

SEQ ID NO: 491564 - protein, 22 aa, Mycobacterium
GPEGGGVDKHPYPTFDSQRGAQ

SEQ ID NO: 491565 - protein, 29 aa, Mycobacterium
GPEGGSGGGTVVAEGTPESVAQTAGSYTG

SEQ ID NO: 491566 - protein, 9 aa, Mycobacterium
GPEGLPSPM

SEQ ID NO: 491567 - protein, 8 aa, Mycobacterium
GPEGNPLT

SEQ ID NO: 491568 - protein, 8 aa, Mycobacterium
GPEGPDQV

SEQ ID NO: 491569 - protein, 11 aa, Mycobacterium
GPEGPERLPAD

SEQ ID NO: 491570 - protein, 11 aa, Mycobacterium
GPEGPERLPDD

SEQ ID NO: 491571 - protein, 10 aa, Mycobacterium
GPEGQARPEY

SEQ ID NO: 491572 - protein, 10 aa, Mycobacterium
GPEGQGRPGY

SEQ ID NO: 491573 - protein, 7 aa, Mycobacterium
GPEGQRY

SEQ ID NO: 491574 - protein, 5 aa, Mycobacterium
GPEGR

SEQ ID NO: 491575 - protein, 5 aa, Mycobacterium
GPEGS

SEQ ID NO: 491576 - protein, 5 aa, Mycobacterium
GPEGT

SEQ ID NO: 491577 - protein, 8 aa, Mycobacterium
GPEGTNTY

SEQ ID NO: 491578 - protein, 5 aa, Mycobacterium
GPEGW

SEQ ID NO: 491579 - protein, 5 aa, Mycobacterium
GPEHT

SEQ ID NO: 491580 - protein, 5 aa, Mycobacterium
GPEIG

SEQ ID NO: 491581 - protein, 6 aa, Mycobacterium
GPEKAV

SEQ ID NO: 491582 - protein, 15 aa, Mycobacterium
GPEKAVADAEHQPDQ

SEQ ID NO: 491583 - protein, 17 aa, Mycobacterium
GPEKAVAEADSKPDGYL

SEQ ID NO: 491584 - protein, 14 aa, Mycobacterium
GPEKAVGDAEHRPD

SEQ ID NO: 491585 - protein, 17 aa, Mycobacterium
GPEKSVPAAESKPDGHL

SEQ ID NO: 491586 - protein, 8 aa, Mycobacterium
GPEKVGVD

SEQ ID NO: 491587 - protein, 5 aa, Mycobacterium
GPELA

SEQ ID NO: 491588 - protein, 5 aa, Mycobacterium
GPELG

SEQ ID NO: 491589 - protein, 6 aa, Mycobacterium
GPELGA

SEQ ID NO: 491590 - protein, 5 aa, Mycobacterium
GPELP

SEQ ID NO: 491591 - protein, 5 aa, Mycobacterium
GPELT

SEQ ID NO: 491592 - protein, 21 aa, Mycobacterium
GPELTPASDAGSHPDTHPDAQ

SEQ ID NO: 491593 - protein, 8 aa, Mycobacterium
GPENAAES

SEQ ID NO: 491594 - protein, 9 aa, Mycobacterium
GPENAGEAF

SEQ ID NO: 491595 - protein, 5 aa, Mycobacterium
GPENW

SEQ ID NO: 491596 - protein, 10 aa, Mycobacterium
GPEPADPPAI

SEQ ID NO: 491597 - protein, 16 aa, Mycobacterium
GPEPFGTRSSSEARIA

SEQ ID NO: 491598 - protein, 10 aa, Mycobacterium
GPEPGEPLRT

SEQ ID NO: 491599 - protein, 7 aa, Mycobacterium
GPEPGLS

SEQ ID NO: 491600 - protein, 6 aa, Mycobacterium
GPEPGT

SEQ ID NO: 491601 - protein, 16 aa, Mycobacterium
GPEPHGAAMSNSGFRR

SEQ ID NO: 491602 - protein, 9 aa, Mycobacterium
GPEPHGAGL

SEQ ID NO: 491603 - protein, 8 aa, Mycobacterium
GPEPPAWK

SEQ ID NO: 491604 - protein, 11 aa, Mycobacterium
GPEPRSAEAVE

SEQ ID NO: 491605 - protein, 8 aa, Mycobacterium
GPEPTSPY

SEQ ID NO: 491606 - protein, 5 aa, Mycobacterium
GPEPV

SEQ ID NO: 491607 - protein, 5 aa, Mycobacterium
GPEQD

SEQ ID NO: 491608 - protein, 9 aa, Mycobacterium
GPEQGPDTF

SEQ ID NO: 491609 - protein, 5 aa, Mycobacterium
GPEQK

SEQ ID NO: 491610 - protein, 17 aa, Mycobacterium
GPEQPSPMADLPSGAKF

SEQ ID NO: 491611 - protein, 8 aa, Mycobacterium
GPEQRAAV

SEQ ID NO: 491612 - protein, 5 aa, Mycobacterium
GPERD

SEQ ID NO: 491613 - protein, 5 aa, Mycobacterium
GPERG

SEQ ID NO: 491614 - protein, 8 aa, Mycobacterium
GPERGPIQ

SEQ ID NO: 491615 - protein, 15 aa, Mycobacterium
GPERGSRWAPAGSAV

SEQ ID NO: 491616 - protein, 5 aa, Mycobacterium
GPERH

SEQ ID NO: 491617 - protein, 5 aa, Mycobacterium
GPERM

SEQ ID NO: 491618 - protein, 15 aa, Mycobacterium
GPERTRRDHSAPPVL

SEQ ID NO: 491619 - protein, 5 aa, Mycobacterium
GPERV

SEQ ID NO: 491620 - protein, 4 aa, Mycobacterium
GPES

SEQ ID NO: 491621 - protein, 12 aa, Mycobacterium
GPESADGRVPTD

SEQ ID NO: 491622 - protein, 15 aa, Mycobacterium
GPESAPPDGGVPDDA

SEQ ID NO: 491623 - protein, 9 aa, Mycobacterium
GPESDEPVS

SEQ ID NO: 491624 - protein, 8 aa, Mycobacterium
GPESEADR

SEQ ID NO: 491625 - protein, 8 aa, Mycobacterium
GPESFPDT

SEQ ID NO: 491626 - protein, 14 aa, Mycobacterium
GPESGRADGGVPDD

SEQ ID NO: 491627 - protein, 19 aa, Mycobacterium
GPESGWDRASDTPPPPLPD

SEQ ID NO: 491628 - protein, 18 aa, Mycobacterium
GPESGWDRHGNTPPPALP

SEQ ID NO: 491629 - protein, 18 aa, Mycobacterium
GPESGWDRHGSQPPPPLP

SEQ ID NO: 491630 - protein, 8 aa, Mycobacterium
GPESGYVT

SEQ ID NO: 491631 - protein, 14 aa, Mycobacterium
GPESLNRARRTGVV

SEQ ID NO: 491632 - protein, 8 aa, Mycobacterium
GPESPEDI

SEQ ID NO: 491633 - protein, 10 aa, Mycobacterium
GPESRTQQTA

SEQ ID NO: 491634 - protein, 5 aa, Mycobacterium
GPESV

SEQ ID NO: 491635 - protein, 4 aa, Mycobacterium
GPET

SEQ ID NO: 491636 - protein, 8 aa, Mycobacterium
GPETRYQP

SEQ ID NO: 491637 - protein, 7 aa, Mycobacterium
GPETTTY

SEQ ID NO: 491638 - protein, 29 aa, Mycobacterium
GPETVPSDEDDTDDTDAVPDIDAADEPPA

SEQ ID NO: 491639 - protein, 7 aa, Mycobacterium
GPEVDSN

SEQ ID NO: 491640 - protein, 5 aa, Mycobacterium
GPEVG

SEQ ID NO: 491641 - protein, 13 aa, Mycobacterium
GPEVGALAPDDRL

SEQ ID NO: 491642 - protein, 8 aa, Mycobacterium
GPEVGNQE

SEQ ID NO: 491643 - protein, 8 aa, Mycobacterium
GPEVGSLR

SEQ ID NO: 491644 - protein, 5 aa, Mycobacterium
GPEVT

SEQ ID NO: 491645 - protein, 4 aa, Mycobacterium
GPEW

SEQ ID NO: 491646 - protein, 12 aa, Mycobacterium
GPEYGDYANEAH

SEQ ID NO: 491647 - protein, 12 aa, Mycobacterium
GPFAPGEWTDDT

SEQ ID NO: 491648 - protein, 4 aa, Mycobacterium
GPFD

SEQ ID NO: 491649 - protein, 16 aa, Mycobacterium
GPFEQTKTDTSQRYDK

SEQ ID NO: 491650 - protein, 4 aa, Mycobacterium
GPFG

SEQ ID NO: 491651 - protein, 14 aa, Mycobacterium
GPFGDRYGQNPGGL

SEQ ID NO: 491652 - protein, 20 aa, Mycobacterium
GPFGGASGGAGGAGGAGGIG

SEQ ID NO: 491653 - protein, 5 aa, Mycobacterium
GPFGP

SEQ ID NO: 491654 - protein, 14 aa, Mycobacterium
GPFGRGADGAFGHT

SEQ ID NO: 491655 - protein, 12 aa, Mycobacterium
GPFGRNSPAAFG

SEQ ID NO: 491656 - protein, 12 aa, Mycobacterium
GPFGRNTESAFG

SEQ ID NO: 491657 - protein, 5 aa, Mycobacterium
GPFGT

SEQ ID NO: 491658 - protein, 13 aa, Mycobacterium
GPFKEVEDPPTPT

SEQ ID NO: 491659 - protein, 18 aa, Mycobacterium
GPFNERRRDAATHTDARG

SEQ ID NO: 491660 - protein, 4 aa, Mycobacterium
GPFP

SEQ ID NO: 491661 - protein, 7 aa, Mycobacterium
GPFPAAD

SEQ ID NO: 491662 - protein, 9 aa, Mycobacterium
GPFPGNPDP

SEQ ID NO: 491663 - protein, 6 aa, Mycobacterium
GPFPGY

SEQ ID NO: 491664 - protein, 16 aa, Mycobacterium
GPFPSTSDSRTTSVGA

SEQ ID NO: 491665 - protein, 7 aa, Mycobacterium
GPFPTDR

SEQ ID NO: 491666 - protein, 8 aa, Mycobacterium
GPFPYPRN

SEQ ID NO: 491667 - protein, 12 aa, Mycobacterium
GPFSARSDAVET

SEQ ID NO: 491668 - protein, 7 aa, Mycobacterium
GPFTATR

SEQ ID NO: 491669 - protein, 14 aa, Mycobacterium
GPFTPEDITASRPI

SEQ ID NO: 491670 - protein, 4 aa, Mycobacterium
GPFV

SEQ ID NO: 491671 - protein, 5 aa, Mycobacterium
GPGAA

SEQ ID NO: 491672 - protein, 7 aa, Mycobacterium
GPGAADA

SEQ ID NO: 491673 - protein, 8 aa, Mycobacterium
GPGAAEFT

SEQ ID NO: 491674 - protein, 9 aa, Mycobacterium
GPGAAGTFE

SEQ ID NO: 491675 - protein, 7 aa, Mycobacterium
GPGAALS

SEQ ID NO: 491676 - protein, 9 aa, Mycobacterium
GPGAANSAN

SEQ ID NO: 491677 - protein, 16 aa, Mycobacterium
GPGAAQPDSDAPPHRY

SEQ ID NO: 491678 - protein, 8 aa, Mycobacterium
GPGADEAR

SEQ ID NO: 491679 - protein, 9 aa, Mycobacterium
GPGADENRI

SEQ ID NO: 491680 - protein, 6 aa, Mycobacterium
GPGADL

SEQ ID NO: 491681 - protein, 15 aa, Mycobacterium
GPGADQPRPFPKVPL

SEQ ID NO: 491682 - protein, 8 aa, Mycobacterium
GPGAEDTL

SEQ ID NO: 491683 - protein, 7 aa, Mycobacterium
GPGAEVG

SEQ ID NO: 491684 - protein, 7 aa, Mycobacterium
GPGAEVP

SEQ ID NO: 491685 - protein, 8 aa, Mycobacterium
GPGAGEWG

SEQ ID NO: 491686 - protein, 11 aa, Mycobacterium
GPGAGLSTSVE

SEQ ID NO: 491687 - protein, 7 aa, Mycobacterium
GPGAGPM

SEQ ID NO: 491688 - protein, 11 aa, Mycobacterium
GPGAGSDGGRV

SEQ ID NO: 491689 - protein, 9 aa, Mycobacterium
GPGAGTAGG

SEQ ID NO: 491690 - protein, 8 aa, Mycobacterium
GPGALPTD

SEQ ID NO: 491691 - protein, 6 aa, Mycobacterium
GPGALT

SEQ ID NO: 491692 - protein, 19 aa, Mycobacterium
GPGARASLDDGAVDRRDGR

SEQ ID NO: 491693 - protein, 11 aa, Mycobacterium
GPGARYDAAPP

SEQ ID NO: 491694 - protein, 12 aa, Mycobacterium
GPGATAADAGGI

SEQ ID NO: 491695 - protein, 9 aa, Mycobacterium
GPGATGRSF

SEQ ID NO: 491696 - protein, 8 aa, Mycobacterium
GPGDAEVR

SEQ ID NO: 491697 - protein, 6 aa, Mycobacterium
GPGDAP

SEQ ID NO: 491698 - protein, 10 aa, Mycobacterium
GPGDAPTSAS

SEQ ID NO: 491699 - protein, 5 aa, Mycobacterium
GPGDD

SEQ ID NO: 491700 - protein, 5 aa, Mycobacterium
GPGDE

SEQ ID NO: 491701 - protein, 5 aa, Mycobacterium
GPGDG

SEQ ID NO: 491702 - protein, 6 aa, Mycobacterium
GPGDGY

SEQ ID NO: 491703 - protein, 5 aa, Mycobacterium
GPGDL

SEQ ID NO: 491704 - protein, 6 aa, Mycobacterium
GPGDPE

SEQ ID NO: 491705 - protein, 7 aa, Mycobacterium
GPGDPEL

SEQ ID NO: 491706 - protein, 9 aa, Mycobacterium
GPGDRPDEP

SEQ ID NO: 491707 - protein, 7 aa, Mycobacterium
GPGDRWQ

SEQ ID NO: 491708 - protein, 15 aa, Mycobacterium
GPGEACGLHSNRQAA

SEQ ID NO: 491709 - protein, 8 aa, Mycobacterium
GPGEAPKL

SEQ ID NO: 491710 - protein, 8 aa, Mycobacterium
GPGEAPRL

SEQ ID NO: 491711 - protein, 6 aa, Mycobacterium
GPGEAV

SEQ ID NO: 491712 - protein, 6 aa, Mycobacterium
GPGEDL

SEQ ID NO: 491713 - protein, 7 aa, Mycobacterium
GPGEGAV

SEQ ID NO: 491714 - protein, 8 aa, Mycobacterium
GPGEGGPF

SEQ ID NO: 491715 - protein, 7 aa, Mycobacterium
GPGEKPH

SEQ ID NO: 491716 - protein, 5 aa, Mycobacterium
GPGEL

SEQ ID NO: 491717 - protein, 11 aa, Mycobacterium
GPGEPMPEAGH

SEQ ID NO: 491718 - protein, 7 aa, Mycobacterium
GPGERRP

SEQ ID NO: 491719 - protein, 7 aa, Mycobacterium
GPGERTG

SEQ ID NO: 491720 - protein, 8 aa, Mycobacterium
GPGERTGI

SEQ ID NO: 491721 - protein, 10 aa, Mycobacterium
GPGERVPRGQ

SEQ ID NO: 491722 - protein, 11 aa, Mycobacterium
GPGESLPPERE

SEQ ID NO: 491723 - protein, 5 aa, Mycobacterium
GPGEY

SEQ ID NO: 491724 - protein, 6 aa, Mycobacterium
GPGFAD

SEQ ID NO: 491725 - protein, 15 aa, Mycobacterium
GPGFANSTTSPSSGF

SEQ ID NO: 491726 - protein, 5 aa, Mycobacterium
GPGFE

SEQ ID NO: 491727 - protein, 5 aa, Mycobacterium
GPGFG

SEQ ID NO: 491728 - protein, 28 aa, Mycobacterium
GPGFGHTRNPWSRKHTPGGSSGGSAAAV

SEQ ID NO: 491729 - protein, 28 aa, Mycobacterium
GPGGAGGSGGHGGAGIAGNGGAGGPGGA

SEQ ID NO: 491730 - protein, 22 aa, Mycobacterium
GPGGARGGGRRGGPGRGRRGDV

SEQ ID NO: 491731 - protein, 6 aa, Mycobacterium
GPGGAS

SEQ ID NO: 491732 - protein, 7 aa, Mycobacterium
GPGGAVG

SEQ ID NO: 491733 - protein, 5 aa, Mycobacterium
GPGGD

SEQ ID NO: 491734 - protein, 6 aa, Mycobacterium
GPGGDP

SEQ ID NO: 491735 - protein, 11 aa, Mycobacterium
GPGGGDDGGTV

SEQ ID NO: 491736 - protein, 9 aa, Mycobacterium
GPGGGVPGT

SEQ ID NO: 491737 - protein, 15 aa, Mycobacterium
GPGGHKLDDATEDRI

SEQ ID NO: 491738 - protein, 6 aa, Mycobacterium
GPGGKT

SEQ ID NO: 491739 - protein, 6 aa, Mycobacterium
GPGGLL

SEQ ID NO: 491740 - protein, 65 aa, Mycobacterium
GPGGPDHPGGPPGGPGGPDHPGGPGGPGDPDHPGGPGGPGGPGGPDHPGGPGGPGGPWHGDPQRG

SEQ ID NO: 491741 - protein, 22 aa, Mycobacterium
GPGGPRGGWRRGGRGRGRRGDI

SEQ ID NO: 491742 - protein, 9 aa, Mycobacterium
GPGGPTGLD

SEQ ID NO: 491743 - protein, 5 aa, Mycobacterium
GPGGR

SEQ ID NO: 491744 - protein, 8 aa, Mycobacterium
GPGGRGMT

SEQ ID NO: 491745 - protein, 15 aa, Mycobacterium
GPGGRKLDDDTEDRI

SEQ ID NO: 491746 - protein, 15 aa, Mycobacterium
GPGGRKLDDGTEDQI

SEQ ID NO: 491747 - protein, 5 aa, Mycobacterium
GPGGS

SEQ ID NO: 491748 - protein, 16 aa, Mycobacterium
GPGGSGGDGGAGGTGG

SEQ ID NO: 491749 - protein, 10 aa, Mycobacterium
GPGGSLTGSA

SEQ ID NO: 491750 - protein, 9 aa, Mycobacterium
GPGGSSTVY

SEQ ID NO: 491751 - protein, 16 aa, Mycobacterium
GPGGTLTSSAGRHPRW

SEQ ID NO: 491752 - protein, 8 aa, Mycobacterium
GPGGTSFD

SEQ ID NO: 491753 - protein, 8 aa, Mycobacterium
GPGHGGPA

SEQ ID NO: 491754 - protein, 9 aa, Mycobacterium
GPGHGGPGV

SEQ ID NO: 491755 - protein, 6 aa, Mycobacterium
GPGHPC

SEQ ID NO: 491756 - protein, 8 aa, Mycobacterium
GPGHSDLP

SEQ ID NO: 491757 - protein, 6 aa, Mycobacterium
GPGIAQ

SEQ ID NO: 491758 - protein, 7 aa, Mycobacterium
GPGIGSE

SEQ ID NO: 491759 - protein, 8 aa, Mycobacterium
GPGIGSES

SEQ ID NO: 491760 - protein, 14 aa, Mycobacterium
GPGIPGGRGGDGGD

SEQ ID NO: 491761 - protein, 13 aa, Mycobacterium
GPGITEDAKTGAA

SEQ ID NO: 491762 - protein, 6 aa, Mycobacterium
GPGITP

SEQ ID NO: 491763 - protein, 4 aa, Mycobacterium
GPGK

SEQ ID NO: 491764 - protein, 5 aa, Mycobacterium
GPGKP

SEQ ID NO: 491765 - protein, 5 aa, Mycobacterium
GPGLA

SEQ ID NO: 491766 - protein, 10 aa, Mycobacterium
GPGLAGAQGV

SEQ ID NO: 491767 - protein, 8 aa, Mycobacterium
GPGLDRSG

SEQ ID NO: 491768 - protein, 7 aa, Mycobacterium
GPGLGGP

SEQ ID NO: 491769 - protein, 6 aa, Mycobacterium
GPGLGR

SEQ ID NO: 491770 - protein, 5 aa, Mycobacterium
GPGLP

SEQ ID NO: 491771 - protein, 10 aa, Mycobacterium
GPGLPPNDRA

SEQ ID NO: 491772 - protein, 8 aa, Mycobacterium
GPGLRPVG

SEQ ID NO: 491773 - protein, 10 aa, Mycobacterium
GPGLSTPGVP

SEQ ID NO: 491774 - protein, 6 aa, Mycobacterium
GPGLTN

SEQ ID NO: 491775 - protein, 13 aa, Mycobacterium
GPGLTPRAGRPYR

SEQ ID NO: 491776 - protein, 10 aa, Mycobacterium
GPGMDPEDGR

SEQ ID NO: 491777 - protein, 5 aa, Mycobacterium
GPGNF

SEQ ID NO: 491778 - protein, 6 aa, Mycobacterium
GPGNLT

SEQ ID NO: 491779 - protein, 5 aa, Mycobacterium
GPGPA

SEQ ID NO: 491780 - protein, 6 aa, Mycobacterium
GPGPAA

SEQ ID NO: 491781 - protein, 7 aa, Mycobacterium
GPGPESL

SEQ ID NO: 491782 - protein, 5 aa, Mycobacterium
GPGPF

SEQ ID NO: 491783 - protein, 5 aa, Mycobacterium
GPGPG

SEQ ID NO: 491784 - protein, 7 aa, Mycobacterium
GPGPGPM

SEQ ID NO: 491785 - protein, 7 aa, Mycobacterium
GPGPGSM

SEQ ID NO: 491786 - protein, 5 aa, Mycobacterium
GPGPI

SEQ ID NO: 491787 - protein, 7 aa, Mycobacterium
GPGPLRA

SEQ ID NO: 491788 - protein, 6 aa, Mycobacterium
GPGPML

SEQ ID NO: 491789 - protein, 9 aa, Mycobacterium
GPGPRPIES

SEQ ID NO: 491790 - protein, 19 aa, Mycobacterium
GPGPRSPESVAGWNQVLTS

SEQ ID NO: 491791 - protein, 11 aa, Mycobacterium
GPGPTDVAEGD

SEQ ID NO: 491792 - protein, 5 aa, Mycobacterium
GPGPV

SEQ ID NO: 491793 - protein, 4 aa, Mycobacterium
GPGQ

SEQ ID NO: 491794 - protein, 9 aa, Mycobacterium
GPGQGAALR

SEQ ID NO: 491795 - protein, 7 aa, Mycobacterium
GPGQPDT

SEQ ID NO: 491796 - protein, 8 aa, Mycobacterium
GPGQPERS

SEQ ID NO: 491797 - protein, 11 aa, Mycobacterium
GPGQTDAGVPE

SEQ ID NO: 491798 - protein, 6 aa, Mycobacterium
GPGQTL

SEQ ID NO: 491799 - protein, 14 aa, Mycobacterium
GPGRAKWADSATPY

SEQ ID NO: 491800 - protein, 6 aa, Mycobacterium
GPGRAQ

SEQ ID NO: 491801 - protein, 11 aa, Mycobacterium
GPGRARSGGRL

SEQ ID NO: 491802 - protein, 5 aa, Mycobacterium
GPGRD

SEQ ID NO: 491803 - protein, 6 aa, Mycobacterium
GPGRDQ

SEQ ID NO: 491804 - protein, 16 aa, Mycobacterium
GPGRDQTIVRRDILSR

SEQ ID NO: 491805 - protein, 7 aa, Mycobacterium
GPGREPE

SEQ ID NO: 491806 - protein, 5 aa, Mycobacterium
GPGRF

SEQ ID NO: 491807 - protein, 9 aa, Mycobacterium
GPGRGKTAS

SEQ ID NO: 491808 - protein, 6 aa, Mycobacterium
GPGRPR

SEQ ID NO: 491809 - protein, 5 aa, Mycobacterium
GPGRS

SEQ ID NO: 491810 - protein, 6 aa, Mycobacterium
GPGRSE

SEQ ID NO: 491811 - protein, 9 aa, Mycobacterium
GPGRTSGAW

SEQ ID NO: 491812 - protein, 5 aa, Mycobacterium
GPGRV

SEQ ID NO: 491813 - protein, 11 aa, Mycobacterium
GPGSAQPAANH

SEQ ID NO: 491814 - protein, 8 aa, Mycobacterium
GPGSASPV

SEQ ID NO: 491815 - protein, 5 aa, Mycobacterium
GPGSD

SEQ ID NO: 491816 - protein, 11 aa, Mycobacterium
GPGSDIDGAAE

SEQ ID NO: 491817 - protein, 15 aa, Mycobacterium
GPGSDLGTGGMTSKL

SEQ ID NO: 491818 - protein, 5 aa, Mycobacterium
GPGSE

SEQ ID NO: 491819 - protein, 8 aa, Mycobacterium
GPGSEVPL

SEQ ID NO: 491820 - protein, 11 aa, Mycobacterium
GPGSGLTSSIE

SEQ ID NO: 491821 - protein, 7 aa, Mycobacterium
GPGSGPM

SEQ ID NO: 491822 - protein, 9 aa, Mycobacterium
GPGSGTNAL

SEQ ID NO: 491823 - protein, 12 aa, Mycobacterium
GPGSMTESGYPR

SEQ ID NO: 491824 - protein, 16 aa, Mycobacterium
GPGSPEAVGGGGGDAI

SEQ ID NO: 491825 - protein, 9 aa, Mycobacterium
GPGSPSAAS

SEQ ID NO: 491826 - protein, 9 aa, Mycobacterium
GPGSPSAAT

SEQ ID NO: 491827 - protein, 6 aa, Mycobacterium
GPGSTF

SEQ ID NO: 491828 - protein, 7 aa, Mycobacterium
GPGSTFS

SEQ ID NO: 491829 - protein, 8 aa, Mycobacterium
GPGTAEAA

SEQ ID NO: 491830 - protein, 8 aa, Mycobacterium
GPGTESID

SEQ ID NO: 491831 - protein, 8 aa, Mycobacterium
GPGTESRA

SEQ ID NO: 491832 - protein, 7 aa, Mycobacterium
GPGTGAF

SEQ ID NO: 491833 - protein, 12 aa, Mycobacterium
GPGTGGEPTAQD

SEQ ID NO: 491834 - protein, 10 aa, Mycobacterium
GPGTGNGGED

SEQ ID NO: 491835 - protein, 5 aa, Mycobacterium
GPGTI

SEQ ID NO: 491836 - protein, 6 aa, Mycobacterium
GPGTIT

SEQ ID NO: 491837 - protein, 13 aa, Mycobacterium
GPGTRKAPRPGTR

SEQ ID NO: 491838 - protein, 12 aa, Mycobacterium
GPGTRMRSDTPK

SEQ ID NO: 491839 - protein, 5 aa, Mycobacterium
GPGTS

SEQ ID NO: 491840 - protein, 10 aa, Mycobacterium
GPGTSTIPET

SEQ ID NO: 491841 - protein, 7 aa, Mycobacterium
GPGTTAR

SEQ ID NO: 491842 - protein, 4 aa, Mycobacterium
GPGV

SEQ ID NO: 491843 - protein, 6 aa, Mycobacterium
GPGVAN

SEQ ID NO: 491844 - protein, 10 aa, Mycobacterium
GPGVEPSAKG

SEQ ID NO: 491845 - protein, 13 aa, Mycobacterium
GPGVFGPPRDHDQ

SEQ ID NO: 491846 - protein, 7 aa, Mycobacterium
GPGVGQA

SEQ ID NO: 491847 - protein, 9 aa, Mycobacterium
GPGVNPLGD

SEQ ID NO: 491848 - protein, 6 aa, Mycobacterium
GPGVQT

SEQ ID NO: 491849 - protein, 7 aa, Mycobacterium
GPGVTET

SEQ ID NO: 491850 - protein, 10 aa, Mycobacterium
GPGVTGWSEG

SEQ ID NO: 491851 - protein, 13 aa, Mycobacterium
GPGVTRAAPGDRV

SEQ ID NO: 491852 - protein, 6 aa, Mycobacterium
GPGVTT

SEQ ID NO: 491853 - protein, 6 aa, Mycobacterium
GPGWPR

SEQ ID NO: 491854 - protein, 5 aa, Mycobacterium
GPGYG

SEQ ID NO: 491855 - protein, 12 aa, Mycobacterium
GPGYPDAPAGRD

SEQ ID NO: 491856 - protein, 13 aa, Mycobacterium
GPHAADPHHGYSD

SEQ ID NO: 491857 - protein, 15 aa, Mycobacterium
GPHACPGAPLARTEA

SEQ ID NO: 491858 - protein, 4 aa, Mycobacterium
GPHD

SEQ ID NO: 491859 - protein, 15 aa, Mycobacterium
GPHDENGSSTGTKIP

SEQ ID NO: 491860 - protein, 5 aa, Mycobacterium
GPHDT

SEQ ID NO: 491861 - protein, 6 aa, Mycobacterium
GPHEIE

SEQ ID NO: 491862 - protein, 13 aa, Mycobacterium
GPHGADPHHGYSD

SEQ ID NO: 491863 - protein, 6 aa, Mycobacterium
GPHGDT

SEQ ID NO: 491864 - protein, 6 aa, Mycobacterium
GPHGPE

SEQ ID NO: 491865 - protein, 6 aa, Mycobacterium
GPHGPQ

SEQ ID NO: 491866 - protein, 5 aa, Mycobacterium
GPHGV

SEQ ID NO: 491867 - protein, 25 aa, Mycobacterium
GPHGVRRQSGASDHLGVGGSEPATC

SEQ ID NO: 491868 - protein, 12 aa, Mycobacterium
GPHHGPGSTHTP

SEQ ID NO: 491869 - protein, 17 aa, Mycobacterium
GPHHREGQTVDQVRNGN

SEQ ID NO: 491870 - protein, 5 aa, Mycobacterium
GPHIG

SEQ ID NO: 491871 - protein, 8 aa, Mycobacterium
GPHKPSGF

SEQ ID NO: 491872 - protein, 8 aa, Mycobacterium
GPHKTLQG

SEQ ID NO: 491873 - protein, 5 aa, Mycobacterium
GPHLK

SEQ ID NO: 491874 - protein, 8 aa, Mycobacterium
GPHNPEAP

SEQ ID NO: 491875 - protein, 6 aa, Mycobacterium
GPHPAG

SEQ ID NO: 491876 - protein, 7 aa, Mycobacterium
GPHPDWD

SEQ ID NO: 491877 - protein, 15 aa, Mycobacterium
GPHPRDGARCAGMDF

SEQ ID NO: 491878 - protein, 4 aa, Mycobacterium
GPHR

SEQ ID NO: 491879 - protein, 9 aa, Mycobacterium
GPHRGQPLT

SEQ ID NO: 491880 - protein, 15 aa, Mycobacterium
GPHRNSTSSTGGVGE

SEQ ID NO: 491881 - protein, 4 aa, Mycobacterium
GPHS

SEQ ID NO: 491882 - protein, 5 aa, Mycobacterium
GPHSA

SEQ ID NO: 491883 - protein, 16 aa, Mycobacterium
GPHSAAASTAAADVDT

SEQ ID NO: 491884 - protein, 21 aa, Mycobacterium
GPHSRRASLRPARATQKATAS

SEQ ID NO: 491885 - protein, 18 aa, Mycobacterium
GPHTTSDDPSRYRTQEEV

SEQ ID NO: 491886 - protein, 5 aa, Mycobacterium
GPIAA

SEQ ID NO: 491887 - protein, 11 aa, Mycobacterium
GPIAGRTDDTL

SEQ ID NO: 491888 - protein, 19 aa, Mycobacterium
GPIAGSSKAYREVAGPDGV

SEQ ID NO: 491889 - protein, 11 aa, Mycobacterium
GPIDAPDPKVD

SEQ ID NO: 491890 - protein, 5 aa, Mycobacterium
GPIDD

SEQ ID NO: 491891 - protein, 5 aa, Mycobacterium
GPIDP

SEQ ID NO: 491892 - protein, 5 aa, Mycobacterium
GPIDR

SEQ ID NO: 491893 - protein, 6 aa, Mycobacterium
GPIEGP

SEQ ID NO: 491894 - protein, 4 aa, Mycobacterium
GPIG

SEQ ID NO: 491895 - protein, 7 aa, Mycobacterium
GPIGQNV

SEQ ID NO: 491896 - protein, 9 aa, Mycobacterium
GPIGSTESA

SEQ ID NO: 491897 - protein, 7 aa, Mycobacterium
GPIGTSS

SEQ ID NO: 491898 - protein, 4 aa, Mycobacterium
GPIP

SEQ ID NO: 491899 - protein, 6 aa, Mycobacterium
GPIPAR

SEQ ID NO: 491900 - protein, 8 aa, Mycobacterium
GPIPDDNW

SEQ ID NO: 491901 - protein, 7 aa, Mycobacterium
GPIPDRG

SEQ ID NO: 491902 - protein, 8 aa, Mycobacterium
GPIPNGEH

SEQ ID NO: 491903 - protein, 6 aa, Mycobacterium
GPIPPR

SEQ ID NO: 491904 - protein, 14 aa, Mycobacterium
GPIPQTDDNRQTMN

SEQ ID NO: 491905 - protein, 6 aa, Mycobacterium
GPIQGG

SEQ ID NO: 491906 - protein, 4 aa, Mycobacterium
GPIR

SEQ ID NO: 491907 - protein, 16 aa, Mycobacterium
GPIRANVAPRGPDHYT

SEQ ID NO: 491908 - protein, 19 aa, Mycobacterium
GPIREQRRTVNEAALDSGA

SEQ ID NO: 491909 - protein, 8 aa, Mycobacterium
GPIRTPGL

SEQ ID NO: 491910 - protein, 4 aa, Mycobacterium
GPIS

SEQ ID NO: 491911 - protein, 17 aa, Mycobacterium
GPISKAASKGRDLADGL

SEQ ID NO: 491912 - protein, 12 aa, Mycobacterium
GPISTGEEHAGE

SEQ ID NO: 491913 - protein, 4 aa, Mycobacterium
GPIT

SEQ ID NO: 491914 - protein, 5 aa, Mycobacterium
GPITE

SEQ ID NO: 491915 - protein, 6 aa, Mycobacterium
GPITQQ

SEQ ID NO: 491916 - protein, 6 aa, Mycobacterium
GPITRT

SEQ ID NO: 491917 - protein, 9 aa, Mycobacterium
GPITSAADS

SEQ ID NO: 491918 - protein, 8 aa, Mycobacterium
GPITSASS

SEQ ID NO: 491919 - protein, 4 aa, Mycobacterium
GPKA

SEQ ID NO: 491920 - protein, 7 aa, Mycobacterium
GPKADYA

SEQ ID NO: 491921 - protein, 5 aa, Mycobacterium
GPKAI

SEQ ID NO: 491922 - protein, 8 aa, Mycobacterium
GPKAISGA

SEQ ID NO: 491923 - protein, 16 aa, Mycobacterium
GPKALKSNPGDTSARI

SEQ ID NO: 491924 - protein, 8 aa, Mycobacterium
GPKALRDN

SEQ ID NO: 491925 - protein, 9 aa, Mycobacterium
GPKAPEGAP

SEQ ID NO: 491926 - protein, 8 aa, Mycobacterium
GPKARAEA

SEQ ID NO: 491927 - protein, 17 aa, Mycobacterium
GPKATWAHKSTEDFEPL

SEQ ID NO: 491928 - protein, 15 aa, Mycobacterium
GPKAVRGQTAVAEGY

SEQ ID NO: 491929 - protein, 9 aa, Mycobacterium
GPKAVRSAA

SEQ ID NO: 491930 - protein, 6 aa, Mycobacterium
GPKDEI

SEQ ID NO: 491931 - protein, 5 aa, Mycobacterium
GPKDG

SEQ ID NO: 491932 - protein, 6 aa, Mycobacterium
GPKDGR

SEQ ID NO: 491933 - protein, 4 aa, Mycobacterium
GPKE

SEQ ID NO: 491934 - protein, 5 aa, Mycobacterium
GPKEA

SEQ ID NO: 491935 - protein, 6 aa, Mycobacterium
GPKEHA

SEQ ID NO: 491936 - protein, 7 aa, Mycobacterium
GPKEHAS

SEQ ID NO: 491937 - protein, 7 aa, Mycobacterium
GPKEHAT

SEQ ID NO: 491938 - protein, 9 aa, Mycobacterium
GPKFGDEAA

SEQ ID NO: 491939 - protein, 11 aa, Mycobacterium
GPKFGDESSPG

SEQ ID NO: 491940 - protein, 7 aa, Mycobacterium
GPKGADA

SEQ ID NO: 491941 - protein, 6 aa, Mycobacterium
GPKGAI

SEQ ID NO: 491942 - protein, 11 aa, Mycobacterium
GPKGGDAQLRA

SEQ ID NO: 491943 - protein, 8 aa, Mycobacterium
GPKGPDQI

SEQ ID NO: 491944 - protein, 8 aa, Mycobacterium
GPKGQGSL

SEQ ID NO: 491945 - protein, 13 aa, Mycobacterium
GPKGTDAKLRERG

SEQ ID NO: 491946 - protein, 10 aa, Mycobacterium
GPKGTDAQLR

SEQ ID NO: 491947 - protein, 4 aa, Mycobacterium
GPKK

SEQ ID NO: 491948 - protein, 8 aa, Mycobacterium
GPKKIADR

SEQ ID NO: 491949 - protein, 9 aa, Mycobacterium
GPKKIADRI

SEQ ID NO: 491950 - protein, 13 aa, Mycobacterium
GPKLRTGPIRPGP

SEQ ID NO: 491951 - protein, 4 aa, Mycobacterium
GPKN

SEQ ID NO: 491952 - protein, 6 aa, Mycobacterium
GPKNTL

SEQ ID NO: 491953 - protein, 6 aa, Mycobacterium
GPKPAD

SEQ ID NO: 491954 - protein, 8 aa, Mycobacterium
GPKPADAV

SEQ ID NO: 491955 - protein, 6 aa, Mycobacterium
GPKPAE

SEQ ID NO: 491956 - protein, 9 aa, Mycobacterium
GPKPISTPH

SEQ ID NO: 491957 - protein, 5 aa, Mycobacterium
GPKPL

SEQ ID NO: 491958 - protein, 8 aa, Mycobacterium
GPKPLRAG

SEQ ID NO: 491959 - protein, 5 aa, Mycobacterium
GPKPP

SEQ ID NO: 491960 - protein, 10 aa, Mycobacterium
GPKPVNVGTG

SEQ ID NO: 491961 - protein, 6 aa, Mycobacterium
GPKPVV

SEQ ID NO: 491962 - protein, 13 aa, Mycobacterium
GPKQGDDDGGAGS

SEQ ID NO: 491963 - protein, 7 aa, Mycobacterium
GPKQTAL

SEQ ID NO: 491964 - protein, 4 aa, Mycobacterium
GPKR

SEQ ID NO: 491965 - protein, 13 aa, Mycobacterium
GPKRDHRTELTPE

SEQ ID NO: 491966 - protein, 15 aa, Mycobacterium
GPKRSPVRTPEQAAA

SEQ ID NO: 491967 - protein, 13 aa, Mycobacterium
GPKSAGDDSASGG

SEQ ID NO: 491968 - protein, 7 aa, Mycobacterium
GPKSLAR

SEQ ID NO: 491969 - protein, 7 aa, Mycobacterium
GPKTLRS

SEQ ID NO: 491970 - protein, 11 aa, Mycobacterium
GPKTLRSAAPW

SEQ ID NO: 491971 - protein, 7 aa, Mycobacterium
GPKTVRD

SEQ ID NO: 491972 - protein, 8 aa, Mycobacterium
GPKTVSRS

SEQ ID NO: 491973 - protein, 6 aa, Mycobacterium
GPKVAG

SEQ ID NO: 491974 - protein, 7 aa, Mycobacterium
GPKYNPW

SEQ ID NO: 491975 - protein, 5 aa, Mycobacterium
GPLAD

SEQ ID NO: 491976 - protein, 8 aa, Mycobacterium
GPLADASF

SEQ ID NO: 491977 - protein, 11 aa, Mycobacterium
GPLADGDTDTW

SEQ ID NO: 491978 - protein, 18 aa, Mycobacterium
GPLAGGLGDLGGGLGLPG

SEQ ID NO: 491979 - protein, 14 aa, Mycobacterium
GPLAGGMGGLGLPG

SEQ ID NO: 491980 - protein, 10 aa, Mycobacterium
GPLAGRKPGD

SEQ ID NO: 491981 - protein, 8 aa, Mycobacterium
GPLANASF

SEQ ID NO: 491982 - protein, 23 aa, Mycobacterium
GPLATAEAGPVSGRSAPAAATAL

SEQ ID NO: 491983 - protein, 5 aa, Mycobacterium
GPLDA

SEQ ID NO: 491984 - protein, 8 aa, Mycobacterium
GPLDADAL

SEQ ID NO: 491985 - protein, 8 aa, Mycobacterium
GPLDATAL

SEQ ID NO: 491986 - protein, 14 aa, Mycobacterium
GPLDGADQLTEQKG

SEQ ID NO: 491987 - protein, 8 aa, Mycobacterium
GPLDGGPA

SEQ ID NO: 491988 - protein, 12 aa, Mycobacterium
GPLDGPSSLQGR

SEQ ID NO: 491989 - protein, 11 aa, Mycobacterium
GPLDPREPSGC

SEQ ID NO: 491990 - protein, 6 aa, Mycobacterium
GPLDSA

SEQ ID NO: 491991 - protein, 15 aa, Mycobacterium
GPLDSDRLGAPQPDD

SEQ ID NO: 491992 - protein, 6 aa, Mycobacterium
GPLDTD

SEQ ID NO: 491993 - protein, 16 aa, Mycobacterium
GPLDTDRLGAEPPSDY

SEQ ID NO: 491994 - protein, 5 aa, Mycobacterium
GPLDV

SEQ ID NO: 491995 - protein, 5 aa, Mycobacterium
GPLEG

SEQ ID NO: 491996 - protein, 9 aa, Mycobacterium
GPLEPTNDA

SEQ ID NO: 491997 - protein, 9 aa, Mycobacterium
GPLEPTNNT

SEQ ID NO: 491998 - protein, 4 aa, Mycobacterium
GPLG

SEQ ID NO: 491999 - protein, 5 aa, Mycobacterium
GPLGA

SEQ ID NO: 492000 - protein, 5 aa, Mycobacterium
GPLGD

SEQ ID NO: 492001 - protein, 6 aa, Mycobacterium
GPLGEI

SEQ ID NO: 492002 - protein, 8 aa, Mycobacterium
GPLGGGVG

SEQ ID NO: 492003 - protein, 30 aa, Mycobacterium
GPLGGRGSKPRPGDRIDDAPCSRPDGTATR

SEQ ID NO: 492004 - protein, 10 aa, Mycobacterium
GPLGNRPTLN

SEQ ID NO: 492005 - protein, 5 aa, Mycobacterium
GPLGP

SEQ ID NO: 492006 - protein, 8 aa, Mycobacterium
GPLGPDDW

SEQ ID NO: 492007 - protein, 8 aa, Mycobacterium
GPLGPDEV

SEQ ID NO: 492008 - protein, 12 aa, Mycobacterium
GPLGSSEAAEEI

SEQ ID NO: 492009 - protein, 8 aa, Mycobacterium
GPLGTHPG

SEQ ID NO: 492010 - protein, 7 aa, Mycobacterium
GPLGTSS

SEQ ID NO: 492011 - protein, 12 aa, Mycobacterium
GPLGVTPSRQGH

SEQ ID NO: 492012 - protein, 5 aa, Mycobacterium
GPLHT

SEQ ID NO: 492013 - protein, 6 aa, Mycobacterium
GPLKPR

SEQ ID NO: 492014 - protein, 4 aa, Mycobacterium
GPLL

SEQ ID NO: 492015 - protein, 5 aa, Mycobacterium
GPLND

SEQ ID NO: 492016 - protein, 14 aa, Mycobacterium
GPLNTAPSPQGRPT

SEQ ID NO: 492017 - protein, 9 aa, Mycobacterium
GPLPATGRA

SEQ ID NO: 492018 - protein, 10 aa, Mycobacterium
GPLPATGRGL

SEQ ID NO: 492019 - protein, 11 aa, Mycobacterium
GPLPATGRGLR

SEQ ID NO: 492020 - protein, 13 aa, Mycobacterium
GPLPDNPDFSRSK

SEQ ID NO: 492021 - protein, 6 aa, Mycobacterium
GPLPDS

SEQ ID NO: 492022 - protein, 5 aa, Mycobacterium
GPLPE

SEQ ID NO: 492023 - protein, 6 aa, Mycobacterium
GPLPEP

SEQ ID NO: 492024 - protein, 7 aa, Mycobacterium
GPLPEPA

SEQ ID NO: 492025 - protein, 11 aa, Mycobacterium
GPLPGQAAYGA

SEQ ID NO: 492026 - protein, 9 aa, Mycobacterium
GPLPLPPSK

SEQ ID NO: 492027 - protein, 7 aa, Mycobacterium
GPLPMPP

SEQ ID NO: 492028 - protein, 8 aa, Mycobacterium
GPLPMPPG

SEQ ID NO: 492029 - protein, 20 aa, Mycobacterium
GPLPPSVPYDSATPEDLAET

SEQ ID NO: 492030 - protein, 19 aa, Mycobacterium
GPLPPSVPYDSPTPEDLAE

SEQ ID NO: 492031 - protein, 20 aa, Mycobacterium
GPLPPSVPYDSPTSDDLAET

SEQ ID NO: 492032 - protein, 5 aa, Mycobacterium
GPLPQ

SEQ ID NO: 492033 - protein, 8 aa, Mycobacterium
GPLPRAPQ

SEQ ID NO: 492034 - protein, 30 aa, Mycobacterium
GPLPRAPQALRTPAAENRWDTGGHGAQPCA

SEQ ID NO: 492035 - protein, 5 aa, Mycobacterium
GPLPS

SEQ ID NO: 492036 - protein, 11 aa, Mycobacterium
GPLPSNPEDDD

SEQ ID NO: 492037 - protein, 11 aa, Mycobacterium
GPLPTNPDEDD

SEQ ID NO: 492038 - protein, 4 aa, Mycobacterium
GPLQ

SEQ ID NO: 492039 - protein, 5 aa, Mycobacterium
GPLQA

SEQ ID NO: 492040 - protein, 6 aa, Mycobacterium
GPLQDS

SEQ ID NO: 492041 - protein, 14 aa, Mycobacterium
GPLQKQGVPKPSRN

SEQ ID NO: 492042 - protein, 8 aa, Mycobacterium
GPLQRASE

SEQ ID NO: 492043 - protein, 8 aa, Mycobacterium
GPLQRRNE

SEQ ID NO: 492044 - protein, 12 aa, Mycobacterium
GPLRAEPPASDA

SEQ ID NO: 492045 - protein, 6 aa, Mycobacterium
GPLRGR

SEQ ID NO: 492046 - protein, 38 aa, Mycobacterium
GPLRNAAARPRRAGTRAAHPGSRQPAAGSRVGAAAGPV

SEQ ID NO: 492047 - protein, 7 aa, Mycobacterium
GPLRPTD

SEQ ID NO: 492048 - protein, 5 aa, Mycobacterium
GPLRQ

SEQ ID NO: 492049 - protein, 6 aa, Mycobacterium
GPLRSR

SEQ ID NO: 492050 - protein, 6 aa, Mycobacterium
GPLSAE

SEQ ID NO: 492051 - protein, 5 aa, Mycobacterium
GPLSD

SEQ ID NO: 492052 - protein, 9 aa, Mycobacterium
GPLSERPTY

SEQ ID NO: 492053 - protein, 8 aa, Mycobacterium
GPLSGDPY

SEQ ID NO: 492054 - protein, 16 aa, Mycobacterium
GPLSPAPDLPDDPKEF

SEQ ID NO: 492055 - protein, 14 aa, Mycobacterium
GPLSSPLSSAASHV

SEQ ID NO: 492056 - protein, 11 aa, Mycobacterium
GPLSTDSDNDA

SEQ ID NO: 492057 - protein, 11 aa, Mycobacterium
GPLSTGDANGY

SEQ ID NO: 492058 - protein, 8 aa, Mycobacterium
GPLTGLAR

SEQ ID NO: 492059 - protein, 7 aa, Mycobacterium
GPLTPDG

SEQ ID NO: 492060 - protein, 18 aa, Mycobacterium
GPLTPGSGVAPIGSPVPG

SEQ ID NO: 492061 - protein, 4 aa, Mycobacterium
GPLV

SEQ ID NO: 492062 - protein, 4 aa, Mycobacterium
GPMA

SEQ ID NO: 492063 - protein, 5 aa, Mycobacterium
GPMAG

SEQ ID NO: 492064 - protein, 10 aa, Mycobacterium
GPMDGEAAES

SEQ ID NO: 492065 - protein, 8 aa, Mycobacterium
GPMEGGRA

SEQ ID NO: 492066 - protein, 7 aa, Mycobacterium
GPMEGGS

SEQ ID NO: 492067 - protein, 7 aa, Mycobacterium
GPMEPDQ

SEQ ID NO: 492068 - protein, 4 aa, Mycobacterium
GPMF

SEQ ID NO: 492069 - protein, 6 aa, Mycobacterium
GPMGGF

SEQ ID NO: 492070 - protein, 6 aa, Mycobacterium
GPMHGG

SEQ ID NO: 492071 - protein, 4 aa, Mycobacterium
GPMP

SEQ ID NO: 492072 - protein, 15 aa, Mycobacterium
GPMPAGVAEKASAAG

SEQ ID NO: 492073 - protein, 17 aa, Mycobacterium
GPMPGKDGRPSPSSTTT

SEQ ID NO: 492074 - protein, 10 aa, Mycobacterium
GPMPNSLPGQ

SEQ ID NO: 492075 - protein, 7 aa, Mycobacterium
GPMSDGG

SEQ ID NO: 492076 - protein, 7 aa, Mycobacterium
GPMSPAA

SEQ ID NO: 492077 - protein, 4 aa, Mycobacterium
GPNA

SEQ ID NO: 492078 - protein, 9 aa, Mycobacterium
GPNAAVKAA

SEQ ID NO: 492079 - protein, 7 aa, Mycobacterium
GPNADEL

SEQ ID NO: 492080 - protein, 9 aa, Mycobacterium
GPNAGAFED

SEQ ID NO: 492081 - protein, 20 aa, Mycobacterium
GPNAGGPGISSPTTALPGQL

SEQ ID NO: 492082 - protein, 9 aa, Mycobacterium
GPNAGSVTP

SEQ ID NO: 492083 - protein, 7 aa, Mycobacterium
GPNAHRT

SEQ ID NO: 492084 - protein, 16 aa, Mycobacterium
GPNAPEPQAPPTDGAS

SEQ ID NO: 492085 - protein, 8 aa, Mycobacterium
GPNAPGYA

SEQ ID NO: 492086 - protein, 7 aa, Mycobacterium
GPNATAL

SEQ ID NO: 492087 - protein, 21 aa, Mycobacterium
GPNATGPGPSIPNQALPGDLN

SEQ ID NO: 492088 - protein, 6 aa, Mycobacterium
GPNAVD

SEQ ID NO: 492089 - protein, 5 aa, Mycobacterium
GPNDF

SEQ ID NO: 492090 - protein, 12 aa, Mycobacterium
GPNDFTGLPPED

SEQ ID NO: 492091 - protein, 6 aa, Mycobacterium
GPNEDL

SEQ ID NO: 492092 - protein, 5 aa, Mycobacterium
GPNEY

SEQ ID NO: 492093 - protein, 10 aa, Mycobacterium
GPNGAGKSTA

SEQ ID NO: 492094 - protein, 9 aa, Mycobacterium
GPNGAGKTS

SEQ ID NO: 492095 - protein, 10 aa, Mycobacterium
GPNGAGKTTA

SEQ ID NO: 492096 - protein, 7 aa, Mycobacterium
GPNGAGT

SEQ ID NO: 492097 - protein, 7 aa, Mycobacterium
GPNGDAF

SEQ ID NO: 492098 - protein, 6 aa, Mycobacterium
GPNGDL

SEQ ID NO: 492099 - protein, 22 aa, Mycobacterium
GPNGEDSTNDQKAQPPMTPPTE

SEQ ID NO: 492100 - protein, 15 aa, Mycobacterium
GPNGGGTGEQQGVQD

SEQ ID NO: 492101 - protein, 14 aa, Mycobacterium
GPNGPEPDPATAPL

SEQ ID NO: 492102 - protein, 8 aa, Mycobacterium
GPNGPVPE

SEQ ID NO: 492103 - protein, 9 aa, Mycobacterium
GPNGSGKST

SEQ ID NO: 492104 - protein, 10 aa, Mycobacterium
GPNGSGKSTL

SEQ ID NO: 492105 - protein, 10 aa, Mycobacterium
GPNGSGKSTT

SEQ ID NO: 492106 - protein, 11 aa, Mycobacterium
GPNGTPEEPKG

SEQ ID NO: 492107 - protein, 13 aa, Mycobacterium
GPNGTPEEPKGTP

SEQ ID NO: 492108 - protein, 13 aa, Mycobacterium
GPNGTPEEPQGTP

SEQ ID NO: 492109 - protein, 6 aa, Mycobacterium
GPNISD

SEQ ID NO: 492110 - protein, 6 aa, Mycobacterium
GPNLAS

SEQ ID NO: 492111 - protein, 12 aa, Mycobacterium
GPNLTGKTTTAG

SEQ ID NO: 492112 - protein, 6 aa, Mycobacterium
GPNNAH

SEQ ID NO: 492113 - protein, 8 aa, Mycobacterium
GPNNCGKS

SEQ ID NO: 492114 - protein, 11 aa, Mycobacterium
GPNNETDCEPE

SEQ ID NO: 492115 - protein, 14 aa, Mycobacterium
GPNNPCDGHRGKHP

SEQ ID NO: 492116 - protein, 4 aa, Mycobacterium
GPNP

SEQ ID NO: 492117 - protein, 28 aa, Mycobacterium
GPNPGAPCGRAVPGRGAAAADHDRLPRR

SEQ ID NO: 492118 - protein, 12 aa, Mycobacterium
GPNPGATIDALD

SEQ ID NO: 492119 - protein, 13 aa, Mycobacterium
GPNPIDAGSALGA

SEQ ID NO: 492120 - protein, 6 aa, Mycobacterium
GPNPIS

SEQ ID NO: 492121 - protein, 7 aa, Mycobacterium
GPNPRAA

SEQ ID NO: 492122 - protein, 8 aa, Mycobacterium
GPNPRAGY

SEQ ID NO: 492123 - protein, 7 aa, Mycobacterium
GPNPVNN

SEQ ID NO: 492124 - protein, 5 aa, Mycobacterium
GPNQW

SEQ ID NO: 492125 - protein, 6 aa, Mycobacterium
GPNRIG

SEQ ID NO: 492126 - protein, 9 aa, Mycobacterium
GPNRPGPRG

SEQ ID NO: 492127 - protein, 4 aa, Mycobacterium
GPNT

SEQ ID NO: 492128 - protein, 8 aa, Mycobacterium
GPNTEASV

SEQ ID NO: 492129 - protein, 10 aa, Mycobacterium
GPNTGTPITS

SEQ ID NO: 492130 - protein, 6 aa, Mycobacterium
GPNTHS

SEQ ID NO: 492131 - protein, 8 aa, Mycobacterium
GPNTKPTR

SEQ ID NO: 492132 - protein, 5 aa, Mycobacterium
GPNTN

SEQ ID NO: 492133 - protein, 9 aa, Mycobacterium
GPNTPMPEG

SEQ ID NO: 492134 - protein, 5 aa, Mycobacterium
GPNVG

SEQ ID NO: 492135 - protein, 4 aa, Mycobacterium
GPPA

SEQ ID NO: 492136 - protein, 7 aa, Mycobacterium
GPPAATR

SEQ ID NO: 492137 - protein, 5 aa, Mycobacterium
GPPAD

SEQ ID NO: 492138 - protein, 10 aa, Mycobacterium
GPPADASRDA

SEQ ID NO: 492139 - protein, 6 aa, Mycobacterium
GPPADM

SEQ ID NO: 492140 - protein, 8 aa, Mycobacterium
GPPADPIA

SEQ ID NO: 492141 - protein, 5 aa, Mycobacterium
GPPAE

SEQ ID NO: 492142 - protein, 8 aa, Mycobacterium
GPPAGGET

SEQ ID NO: 492143 - protein, 12 aa, Mycobacterium
GPPAGSAHRPSQ

SEQ ID NO: 492144 - protein, 18 aa, Mycobacterium
GPPANSTRPPGTTPDVEP

SEQ ID NO: 492145 - protein, 33 aa, Mycobacterium
GPPAPRGPFGGGDDDRHGGGFPGFGGGHGHGGF

SEQ ID NO: 492146 - protein, 6 aa, Mycobacterium
GPPAQR

SEQ ID NO: 492147 - protein, 10 aa, Mycobacterium
GPPARTAKPK

SEQ ID NO: 492148 - protein, 10 aa, Mycobacterium
GPPARTSKPK

SEQ ID NO: 492149 - protein, 11 aa, Mycobacterium
GPPARTSKPKF

SEQ ID NO: 492150 - protein, 12 aa, Mycobacterium
GPPARTSKPRYR

SEQ ID NO: 492151 - protein, 14 aa, Mycobacterium
GPPATSTFSPDQWG

SEQ ID NO: 492152 - protein, 14 aa, Mycobacterium
GPPATTGKPNGGDL

SEQ ID NO: 492153 - protein, 5 aa, Mycobacterium
GPPAV

SEQ ID NO: 492154 - protein, 12 aa, Mycobacterium
GPPDAPAGVLPD

SEQ ID NO: 492155 - protein, 14 aa, Mycobacterium
GPPDDSVNGDAAGR

SEQ ID NO: 492156 - protein, 8 aa, Mycobacterium
GPPDEDVA

SEQ ID NO: 492157 - protein, 12 aa, Mycobacterium
GPPDPTPAPRAP

SEQ ID NO: 492158 - protein, 9 aa, Mycobacterium
GPPDSQAAA

SEQ ID NO: 492159 - protein, 5 aa, Mycobacterium
GPPDV

SEQ ID NO: 492160 - protein, 17 aa, Mycobacterium
GPPDVPGTVPPSETKGL

SEQ ID NO: 492161 - protein, 4 aa, Mycobacterium
GPPE

SEQ ID NO: 492162 - protein, 14 aa, Mycobacterium
GPPEADQRVSGSAE

SEQ ID NO: 492163 - protein, 7 aa, Mycobacterium
GPPEAPE

SEQ ID NO: 492164 - protein, 8 aa, Mycobacterium
GPPELSTP

SEQ ID NO: 492165 - protein, 6 aa, Mycobacterium
GPPEQV

SEQ ID NO: 492166 - protein, 7 aa, Mycobacterium
GPPEYPA

SEQ ID NO: 492167 - protein, 13 aa, Mycobacterium
GPPFSTSAAARAL

SEQ ID NO: 492168 - protein, 6 aa, Mycobacterium
GPPGAL

SEQ ID NO: 492169 - protein, 8 aa, Mycobacterium
GPPGALDE

SEQ ID NO: 492170 - protein, 12 aa, Mycobacterium
GPPGAQVSYSSP

SEQ ID NO: 492171 - protein, 7 aa, Mycobacterium
GPPGARD

SEQ ID NO: 492172 - protein, 6 aa, Mycobacterium
GPPGDL

SEQ ID NO: 492173 - protein, 11 aa, Mycobacterium
GPPGERFAPPG

SEQ ID NO: 492174 - protein, 7 aa, Mycobacterium
GPPGIGK

SEQ ID NO: 492175 - protein, 7 aa, Mycobacterium
GPPGLGK

SEQ ID NO: 492176 - protein, 11 aa, Mycobacterium
GPPGPAGENAP

SEQ ID NO: 492177 - protein, 18 aa, Mycobacterium
GPPGPAYGDTISGTNLAG

SEQ ID NO: 492178 - protein, 146 aa, Mycobacterium
GPPGPPGPPGPPGPAGSGGPPGPPGPPGPPGPNPAIPGPPGPPGPPGPPGPPGPAGSGGPPGPPGPNPPIPGPPGPPGPAGSGGPPGPPGPPGPPGPPGPSSPMPGPPGPPGPPGPPGPPGPPGQPGPGSRGLGPWGPNSARPDSS

SEQ ID NO: 492179 - protein, 7 aa, Mycobacterium
GPPGQDD

SEQ ID NO: 492180 - protein, 7 aa, Mycobacterium
GPPGQED

SEQ ID NO: 492181 - protein, 6 aa, Mycobacterium
GPPGQS

SEQ ID NO: 492182 - protein, 6 aa, Mycobacterium
GPPGSH

SEQ ID NO: 492183 - protein, 7 aa, Mycobacterium
GPPGSLA

SEQ ID NO: 492184 - protein, 18 aa, Mycobacterium
GPPGSVSKTTSGKVQRSR

SEQ ID NO: 492185 - protein, 9 aa, Mycobacterium
GPPGTAETV

SEQ ID NO: 492186 - protein, 9 aa, Mycobacterium
GPPGTAKTS

SEQ ID NO: 492187 - protein, 10 aa, Mycobacterium
GPPGTGKSAI

SEQ ID NO: 492188 - protein, 10 aa, Mycobacterium
GPPGTGKSAV

SEQ ID NO: 492189 - protein, 11 aa, Mycobacterium
GPPGTGKSQTI

SEQ ID NO: 492190 - protein, 9 aa, Mycobacterium
GPPGTGKTY

SEQ ID NO: 492191 - protein, 6 aa, Mycobacterium
GPPGTQ

SEQ ID NO: 492192 - protein, 8 aa, Mycobacterium
GPPGTTAD

SEQ ID NO: 492193 - protein, 9 aa, Mycobacterium
GPPGTTGSI

SEQ ID NO: 492194 - protein, 6 aa, Mycobacterium
GPPGVG

SEQ ID NO: 492195 - protein, 13 aa, Mycobacterium
GPPGVGKTSLGES

SEQ ID NO: 492196 - protein, 17 aa, Mycobacterium
GPPGVPGTVPASETKGL

SEQ ID NO: 492197 - protein, 9 aa, Mycobacterium
GPPHDGGPG

SEQ ID NO: 492198 - protein, 5 aa, Mycobacterium
GPPHE

SEQ ID NO: 492199 - protein, 5 aa, Mycobacterium
GPPIG

SEQ ID NO: 492200 - protein, 7 aa, Mycobacterium
GPPISST

SEQ ID NO: 492201 - protein, 8 aa, Mycobacterium
GPPKPSRA

SEQ ID NO: 492202 - protein, 8 aa, Mycobacterium
GPPKTRAA

SEQ ID NO: 492203 - protein, 5 aa, Mycobacterium
GPPMA

SEQ ID NO: 492204 - protein, 8 aa, Mycobacterium
GPPNQPGT

SEQ ID NO: 492205 - protein, 7 aa, Mycobacterium
GPPPAAD

SEQ ID NO: 492206 - protein, 5 aa, Mycobacterium
GPPPD

SEQ ID NO: 492207 - protein, 8 aa, Mycobacterium
GPPPDEPN

SEQ ID NO: 492208 - protein, 13 aa, Mycobacterium
GPPPDLGPAPAQF

SEQ ID NO: 492209 - protein, 8 aa, Mycobacterium
GPPPEEPN

SEQ ID NO: 492210 - protein, 9 aa, Mycobacterium
GPPPEEPNQ

SEQ ID NO: 492211 - protein, 5 aa, Mycobacterium
GPPPG

SEQ ID NO: 492212 - protein, 6 aa, Mycobacterium
GPPPGE

SEQ ID NO: 492213 - protein, 7 aa, Mycobacterium
GPPPGLR

SEQ ID NO: 492214 - protein, 19 aa, Mycobacterium
GPPPGRVQQREAPPDDGVA

SEQ ID NO: 492215 - protein, 8 aa, Mycobacterium
GPPPGSPR

SEQ ID NO: 492216 - protein, 6 aa, Mycobacterium
GPPPIH

SEQ ID NO: 492217 - protein, 9 aa, Mycobacterium
GPPPITDPP

SEQ ID NO: 492218 - protein, 9 aa, Mycobacterium
GPPPNSPRE

SEQ ID NO: 492219 - protein, 7 aa, Mycobacterium
GPPPPAS

SEQ ID NO: 492220 - protein, 17 aa, Mycobacterium
GPPPPGGWNGPPPPGGW

SEQ ID NO: 492221 - protein, 48 aa, Mycobacterium
GPPPPGPGGGGGPKANAQRNSAAPAVPTAPTSRPSRPEPTSIPVEKRR

SEQ ID NO: 492222 - protein, 12 aa, Mycobacterium
GPPPPPPPPPPF

SEQ ID NO: 492223 - protein, 13 aa, Mycobacterium
GPPPQDASATASM

SEQ ID NO: 492224 - protein, 9 aa, Mycobacterium
GPPPSSPRE

SEQ ID NO: 492225 - protein, 8 aa, Mycobacterium
GPPPTTDH

SEQ ID NO: 492226 - protein, 6 aa, Mycobacterium
GPPPVE

SEQ ID NO: 492227 - protein, 24 aa, Mycobacterium
GPPPVPTSSPPTTPAGAPTKPASM

SEQ ID NO: 492228 - protein, 4 aa, Mycobacterium
GPPQ

SEQ ID NO: 492229 - protein, 6 aa, Mycobacterium
GPPQEA

SEQ ID NO: 492230 - protein, 9 aa, Mycobacterium
GPPQTPQTL

SEQ ID NO: 492231 - protein, 5 aa, Mycobacterium
GPPQV

SEQ ID NO: 492232 - protein, 17 aa, Mycobacterium
GPPQVRPPSFPNAGGGL

SEQ ID NO: 492233 - protein, 4 aa, Mycobacterium
GPPR

SEQ ID NO: 492234 - protein, 5 aa, Mycobacterium
GPPRA

SEQ ID NO: 492235 - protein, 7 aa, Mycobacterium
GPPRCAP

SEQ ID NO: 492236 - protein, 13 aa, Mycobacterium
GPPRDASSQTPRA

SEQ ID NO: 492237 - protein, 8 aa, Mycobacterium
GPPRDHDQ

SEQ ID NO: 492238 - protein, 15 aa, Mycobacterium
GPPRSQNRDPAPGKM

SEQ ID NO: 492239 - protein, 6 aa, Mycobacterium
GPPRWH

SEQ ID NO: 492240 - protein, 4 aa, Mycobacterium
GPPS

SEQ ID NO: 492241 - protein, 16 aa, Mycobacterium
GPPSAAAFTPDQWGDR

SEQ ID NO: 492242 - protein, 8 aa, Mycobacterium
GPPSAPFP

SEQ ID NO: 492243 - protein, 6 aa, Mycobacterium
GPPSCP

SEQ ID NO: 492244 - protein, 16 aa, Mycobacterium
GPPSELPTHRGRRTQA

SEQ ID NO: 492245 - protein, 18 aa, Mycobacterium
GPPSRYRSEPARGHVVTA

SEQ ID NO: 492246 - protein, 8 aa, Mycobacterium
GPPSSPDH

SEQ ID NO: 492247 - protein, 12 aa, Mycobacterium
GPPTDPEVTDDG

SEQ ID NO: 492248 - protein, 6 aa, Mycobacterium
GPPTFA

SEQ ID NO: 492249 - protein, 10 aa, Mycobacterium
GPPTPAKDYA

SEQ ID NO: 492250 - protein, 11 aa, Mycobacterium
GPPTPAKDYSG

SEQ ID NO: 492251 - protein, 9 aa, Mycobacterium
GPPTPDEVA

SEQ ID NO: 492252 - protein, 7 aa, Mycobacterium
GPPTVRT

SEQ ID NO: 492253 - protein, 16 aa, Mycobacterium
GPPTVSGAALGDSNTG

SEQ ID NO: 492254 - protein, 13 aa, Mycobacterium
GPPVDPVTEGKDS

SEQ ID NO: 492255 - protein, 40 aa, Mycobacterium
GPPVPADTTVTDQTAVAAGPAITAGAAGGDSGRTVAAGPA

SEQ ID NO: 492256 - protein, 5 aa, Mycobacterium
GPPVV

SEQ ID NO: 492257 - protein, 23 aa, Mycobacterium
GPPVVKESTGEDISKEALGGPDV

SEQ ID NO: 492258 - protein, 22 aa, Mycobacterium
GPPVVKESTGEDISKEDLGGPD

SEQ ID NO: 492259 - protein, 24 aa, Mycobacterium
GPPVVKESTGEDISKEDLGGPDVA

SEQ ID NO: 492260 - protein, 23 aa, Mycobacterium
GPPVVKESTGEDISKEDLGGPSV

SEQ ID NO: 492261 - protein, 24 aa, Mycobacterium
GPPVVKESTGEEISKEDLGGPVTA

SEQ ID NO: 492262 - protein, 6 aa, Mycobacterium
GPPWRD

SEQ ID NO: 492263 - protein, 5 aa, Mycobacterium
GPPYQ

SEQ ID NO: 492264 - protein, 5 aa, Mycobacterium
GPQAA

SEQ ID NO: 492265 - protein, 9 aa, Mycobacterium
GPQAAGNLA

SEQ ID NO: 492266 - protein, 7 aa, Mycobacterium
GPQAGRV

SEQ ID NO: 492267 - protein, 6 aa, Mycobacterium
GPQAIG

SEQ ID NO: 492268 - protein, 7 aa, Mycobacterium
GPQAKKE

SEQ ID NO: 492269 - protein, 5 aa, Mycobacterium
GPQAP

SEQ ID NO: 492270 - protein, 20 aa, Mycobacterium
GPQARSIESPEFAARLAARR

SEQ ID NO: 492271 - protein, 9 aa, Mycobacterium
GPQATASGL

SEQ ID NO: 492272 - protein, 7 aa, Mycobacterium
GPQATSR

SEQ ID NO: 492273 - protein, 5 aa, Mycobacterium
GPQAV

SEQ ID NO: 492274 - protein, 13 aa, Mycobacterium
GPQDAADRITGTA

SEQ ID NO: 492275 - protein, 7 aa, Mycobacterium
GPQDDSD

SEQ ID NO: 492276 - protein, 6 aa, Mycobacterium
GPQDEI

SEQ ID NO: 492277 - protein, 5 aa, Mycobacterium
GPQDG

SEQ ID NO: 492278 - protein, 16 aa, Mycobacterium
GPQDGADPAAIRDRDG

SEQ ID NO: 492279 - protein, 7 aa, Mycobacterium
GPQDRAS

SEQ ID NO: 492280 - protein, 6 aa, Mycobacterium
GPQDVQ

SEQ ID NO: 492281 - protein, 9 aa, Mycobacterium
GPQELPDET

SEQ ID NO: 492282 - protein, 5 aa, Mycobacterium
GPQFP

SEQ ID NO: 492283 - protein, 4 aa, Mycobacterium
GPQG

SEQ ID NO: 492284 - protein, 24 aa, Mycobacterium
GPQGAAEQVAGLSEQSGTPASSTS

SEQ ID NO: 492285 - protein, 5 aa, Mycobacterium
GPQGF

SEQ ID NO: 492286 - protein, 6 aa, Mycobacterium
GPQGLA

SEQ ID NO: 492287 - protein, 7 aa, Mycobacterium
GPQGNPI

SEQ ID NO: 492288 - protein, 10 aa, Mycobacterium
GPQGPDGMSP

SEQ ID NO: 492289 - protein, 11 aa, Mycobacterium
GPQGPERLPAD

SEQ ID NO: 492290 - protein, 9 aa, Mycobacterium
GPQGPTSLE

SEQ ID NO: 492291 - protein, 5 aa, Mycobacterium
GPQGQ

SEQ ID NO: 492292 - protein, 7 aa, Mycobacterium
GPQGQRY

SEQ ID NO: 492293 - protein, 11 aa, Mycobacterium
GPQGYDTGAEL

SEQ ID NO: 492294 - protein, 5 aa, Mycobacterium
GPQIG

SEQ ID NO: 492295 - protein, 9 aa, Mycobacterium
GPQIGDGRR

SEQ ID NO: 492296 - protein, 10 aa, Mycobacterium
GPQIGEGRKS

SEQ ID NO: 492297 - protein, 10 aa, Mycobacterium
GPQISETQRQ

SEQ ID NO: 492298 - protein, 11 aa, Mycobacterium
GPQKGADPDTV

SEQ ID NO: 492299 - protein, 11 aa, Mycobacterium
GPQKGADTATV

SEQ ID NO: 492300 - protein, 9 aa, Mycobacterium
GPQKGADTV

SEQ ID NO: 492301 - protein, 12 aa, Mycobacterium
GPQLSTPDGRGP

SEQ ID NO: 492302 - protein, 4 aa, Mycobacterium
GPQM

SEQ ID NO: 492303 - protein, 6 aa, Mycobacterium
GPQPDG

SEQ ID NO: 492304 - protein, 6 aa, Mycobacterium
GPQPGA

SEQ ID NO: 492305 - protein, 7 aa, Mycobacterium
GPQPHPV

SEQ ID NO: 492306 - protein, 5 aa, Mycobacterium
GPQPV

SEQ ID NO: 492307 - protein, 4 aa, Mycobacterium
GPQQ

SEQ ID NO: 492308 - protein, 6 aa, Mycobacterium
GPQQLK

SEQ ID NO: 492309 - protein, 10 aa, Mycobacterium
GPQQPDGSYH

SEQ ID NO: 492310 - protein, 6 aa, Mycobacterium
GPQQRG

SEQ ID NO: 492311 - protein, 7 aa, Mycobacterium
GPQRATG

SEQ ID NO: 492312 - protein, 13 aa, Mycobacterium
GPQRPPIGGLGKS

SEQ ID NO: 492313 - protein, 5 aa, Mycobacterium
GPQRT

SEQ ID NO: 492314 - protein, 7 aa, Mycobacterium
GPQRYGD

SEQ ID NO: 492315 - protein, 8 aa, Mycobacterium
GPQSDSDR

SEQ ID NO: 492316 - protein, 8 aa, Mycobacterium
GPQSEAER

SEQ ID NO: 492317 - protein, 15 aa, Mycobacterium
GPQSGPPGGGPPDDA

SEQ ID NO: 492318 - protein, 15 aa, Mycobacterium
GPQSPDAPRDSEETI

SEQ ID NO: 492319 - protein, 5 aa, Mycobacterium
GPQTD

SEQ ID NO: 492320 - protein, 5 aa, Mycobacterium
GPQTL

SEQ ID NO: 492321 - protein, 8 aa, Mycobacterium
GPQTSTEQ

SEQ ID NO: 492322 - protein, 4 aa, Mycobacterium
GPQV

SEQ ID NO: 492323 - protein, 24 aa, Mycobacterium
GPQVGASASPGAVAAAAGPDTDTA

SEQ ID NO: 492324 - protein, 10 aa, Mycobacterium
GPQVGEGNKS

SEQ ID NO: 492325 - protein, 8 aa, Mycobacterium
GPQVPGGV

SEQ ID NO: 492326 - protein, 6 aa, Mycobacterium
GPQYNP

SEQ ID NO: 492327 - protein, 8 aa, Mycobacterium
GPRADAAR

SEQ ID NO: 492328 - protein, 9 aa, Mycobacterium
GPRADAARV

SEQ ID NO: 492329 - protein, 9 aa, Mycobacterium
GPRAEAPPR

SEQ ID NO: 492330 - protein, 6 aa, Mycobacterium
GPRAQR

SEQ ID NO: 492331 - protein, 6 aa, Mycobacterium
GPRARG

SEQ ID NO: 492332 - protein, 6 aa, Mycobacterium
GPRARY

SEQ ID NO: 492333 - protein, 5 aa, Mycobacterium
GPRAY

SEQ ID NO: 492334 - protein, 9 aa, Mycobacterium
GPRDAARTR

SEQ ID NO: 492335 - protein, 6 aa, Mycobacterium
GPRDAD

SEQ ID NO: 492336 - protein, 8 aa, Mycobacterium
GPRDPDTL

SEQ ID NO: 492337 - protein, 5 aa, Mycobacterium
GPRDV

SEQ ID NO: 492338 - protein, 5 aa, Mycobacterium
GPREA

SEQ ID NO: 492339 - protein, 11 aa, Mycobacterium
GPRESLTEGGR

SEQ ID NO: 492340 - protein, 6 aa, Mycobacterium
GPRFAE

SEQ ID NO: 492341 - protein, 14 aa, Mycobacterium
GPRFDRDPDKFASA

SEQ ID NO: 492342 - protein, 6 aa, Mycobacterium
GPRGEF

SEQ ID NO: 492343 - protein, 9 aa, Mycobacterium
GPRGEQPRP

SEQ ID NO: 492344 - protein, 5 aa, Mycobacterium
GPRGG

SEQ ID NO: 492345 - protein, 17 aa, Mycobacterium
GPRGGARLRRGGRRCGG

SEQ ID NO: 492346 - protein, 14 aa, Mycobacterium
GPRGGGGGGTAASL

SEQ ID NO: 492347 - protein, 8 aa, Mycobacterium
GPRGGPGM

SEQ ID NO: 492348 - protein, 8 aa, Mycobacterium
GPRGGPGT

SEQ ID NO: 492349 - protein, 11 aa, Mycobacterium
GPRGPERLPAD

SEQ ID NO: 492350 - protein, 7 aa, Mycobacterium
GPRGPVG

SEQ ID NO: 492351 - protein, 9 aa, Mycobacterium
GPRGRGLPK

SEQ ID NO: 492352 - protein, 7 aa, Mycobacterium
GPRGTGY

SEQ ID NO: 492353 - protein, 5 aa, Mycobacterium
GPRGV

SEQ ID NO: 492354 - protein, 21 aa, Mycobacterium
GPRHEDEAEHRDALESARARL

SEQ ID NO: 492355 - protein, 5 aa, Mycobacterium
GPRHP

SEQ ID NO: 492356 - protein, 11 aa, Mycobacterium
GPRHTAPATPG

SEQ ID NO: 492357 - protein, 17 aa, Mycobacterium
GPRHTRGTPPNVVETTP

SEQ ID NO: 492358 - protein, 4 aa, Mycobacterium
GPRI

SEQ ID NO: 492359 - protein, 14 aa, Mycobacterium
GPRLASREDEDVSA

SEQ ID NO: 492360 - protein, 7 aa, Mycobacterium
GPRLGNP

SEQ ID NO: 492361 - protein, 4 aa, Mycobacterium
GPRN

SEQ ID NO: 492362 - protein, 13 aa, Mycobacterium
GPRNGASDSYAAT

SEQ ID NO: 492363 - protein, 6 aa, Mycobacterium
GPRNQP

SEQ ID NO: 492364 - protein, 14 aa, Mycobacterium
GPRPASEHIQDIPL

SEQ ID NO: 492365 - protein, 6 aa, Mycobacterium
GPRPDK

SEQ ID NO: 492366 - protein, 9 aa, Mycobacterium
GPRPDTSSR

SEQ ID NO: 492367 - protein, 13 aa, Mycobacterium
GPRPEGDESPLPI

SEQ ID NO: 492368 - protein, 5 aa, Mycobacterium
GPRPP

SEQ ID NO: 492369 - protein, 6 aa, Mycobacterium
GPRPRG

SEQ ID NO: 492370 - protein, 14 aa, Mycobacterium
GPRPRRPRIATRLR

SEQ ID NO: 492371 - protein, 19 aa, Mycobacterium
GPRPSAPSRRRKIPGRSTP

SEQ ID NO: 492372 - protein, 7 aa, Mycobacterium
GPRPSER

SEQ ID NO: 492373 - protein, 14 aa, Mycobacterium
GPRPSSEHGHDIPL

SEQ ID NO: 492374 - protein, 5 aa, Mycobacterium
GPRPV

SEQ ID NO: 492375 - protein, 9 aa, Mycobacterium
GPRQGAADA

SEQ ID NO: 492376 - protein, 9 aa, Mycobacterium
GPRQKQQAD

SEQ ID NO: 492377 - protein, 6 aa, Mycobacterium
GPRQRM

SEQ ID NO: 492378 - protein, 6 aa, Mycobacterium
GPRRES

SEQ ID NO: 492379 - protein, 52 aa, Mycobacterium
GPRRGGADEAGAEAEAAEEKPAKAKKSADSEKTDKSEKAEKKSKKKSKDDDA

SEQ ID NO: 492380 - protein, 9 aa, Mycobacterium
GPRRPGGDH

SEQ ID NO: 492381 - protein, 21 aa, Mycobacterium
GPRRQPSAKGSSTMAKQNSAI

SEQ ID NO: 492382 - protein, 11 aa, Mycobacterium
GPRRRQGGRGP

SEQ ID NO: 492383 - protein, 9 aa, Mycobacterium
GPRRRRRTA

SEQ ID NO: 492384 - protein, 5 aa, Mycobacterium
GPRRT

SEQ ID NO: 492385 - protein, 5 aa, Mycobacterium
GPRRY

SEQ ID NO: 492386 - protein, 6 aa, Mycobacterium
GPRRYG

SEQ ID NO: 492387 - protein, 6 aa, Mycobacterium
GPRSGG

SEQ ID NO: 492388 - protein, 6 aa, Mycobacterium
GPRSLP

SEQ ID NO: 492389 - protein, 9 aa, Mycobacterium
GPRSREAIE

SEQ ID NO: 492390 - protein, 6 aa, Mycobacterium
GPRSSF

SEQ ID NO: 492391 - protein, 5 aa, Mycobacterium
GPRST

SEQ ID NO: 492392 - protein, 10 aa, Mycobacterium
GPRSTQTLAE

SEQ ID NO: 492393 - protein, 10 aa, Mycobacterium
GPRTASYRTA

SEQ ID NO: 492394 - protein, 14 aa, Mycobacterium
GPRTSSASAAREEG

SEQ ID NO: 492395 - protein, 13 aa, Mycobacterium
GPRTVGGRSGEEI

SEQ ID NO: 492396 - protein, 4 aa, Mycobacterium
GPRV

SEQ ID NO: 492397 - protein, 7 aa, Mycobacterium
GPRVGDR

SEQ ID NO: 492398 - protein, 11 aa, Mycobacterium
GPRVSASQGEY

SEQ ID NO: 492399 - protein, 17 aa, Mycobacterium
GPRWPDVSGNSQATGTR

SEQ ID NO: 492400 - protein, 27 aa, Mycobacterium
GPRWPDVSGNSQATGTRAVTSGAASPE

SEQ ID NO: 492401 - protein, 26 aa, Mycobacterium
GPRWPDVSGNSQATGTRAVTTGAPNP

SEQ ID NO: 492402 - protein, 6 aa, Mycobacterium
GPRWST

SEQ ID NO: 492403 - protein, 5 aa, Mycobacterium
GPRYL

SEQ ID NO: 492404 - protein, 11 aa, Mycobacterium
GPRYQAPTRQR

SEQ ID NO: 492405 - protein, 5 aa, Mycobacterium
GPSAD

SEQ ID NO: 492406 - protein, 7 aa, Mycobacterium
GPSADPE

SEQ ID NO: 492407 - protein, 9 aa, Mycobacterium
GPSADPELQ

SEQ ID NO: 492408 - protein, 16 aa, Mycobacterium
GPSAPPAPRHHGHDAP

SEQ ID NO: 492409 - protein, 9 aa, Mycobacterium
GPSAPQPHV

SEQ ID NO: 492410 - protein, 7 aa, Mycobacterium
GPSAPTL

SEQ ID NO: 492411 - protein, 15 aa, Mycobacterium
GPSAPYDGPPPGAEH

SEQ ID NO: 492412 - protein, 7 aa, Mycobacterium
GPSAQLQ

SEQ ID NO: 492413 - protein, 8 aa, Mycobacterium
GPSAQVDG

SEQ ID NO: 492414 - protein, 6 aa, Mycobacterium
GPSATA

SEQ ID NO: 492415 - protein, 6 aa, Mycobacterium
GPSATY

SEQ ID NO: 492416 - protein, 6 aa, Mycobacterium
GPSAVA

SEQ ID NO: 492417 - protein, 8 aa, Mycobacterium
GPSAVGKS

SEQ ID NO: 492418 - protein, 7 aa, Mycobacterium
GPSAVGT

SEQ ID NO: 492419 - protein, 4 aa, Mycobacterium
GPSD

SEQ ID NO: 492420 - protein, 7 aa, Mycobacterium
GPSDAVA

SEQ ID NO: 492421 - protein, 15 aa, Mycobacterium
GPSDIDPPERPIPGP

SEQ ID NO: 492422 - protein, 10 aa, Mycobacterium
GPSDPNSGRH

SEQ ID NO: 492423 - protein, 22 aa, Mycobacterium
GPSDQAWTTTIDGDGNMSASDT

SEQ ID NO: 492424 - protein, 7 aa, Mycobacterium
GPSDTVT

SEQ ID NO: 492425 - protein, 7 aa, Mycobacterium
GPSDTWS

SEQ ID NO: 492426 - protein, 7 aa, Mycobacterium
GPSDVGD

SEQ ID NO: 492427 - protein, 6 aa, Mycobacterium
GPSEDI

SEQ ID NO: 492428 - protein, 27 aa, Mycobacterium
GPSELDPPHVPAAPTAEEDLRDKPAAQ

SEQ ID NO: 492429 - protein, 8 aa, Mycobacterium
GPSERIDR

SEQ ID NO: 492430 - protein, 4 aa, Mycobacterium
GPSF

SEQ ID NO: 492431 - protein, 6 aa, Mycobacterium
GPSGAE

SEQ ID NO: 492432 - protein, 8 aa, Mycobacterium
GPSGAGKS

SEQ ID NO: 492433 - protein, 9 aa, Mycobacterium
GPSGAGKST

SEQ ID NO: 492434 - protein, 11 aa, Mycobacterium
GPSGAGKSTLS

SEQ ID NO: 492435 - protein, 6 aa, Mycobacterium
GPSGAT

SEQ ID NO: 492436 - protein, 10 aa, Mycobacterium
GPSGCGKTTS

SEQ ID NO: 492437 - protein, 41 aa, Mycobacterium
GPSGDQAAAQQGAGEDDSEAAVEVSEDTADDASEDDTADDT

SEQ ID NO: 492438 - protein, 6 aa, Mycobacterium
GPSGDT

SEQ ID NO: 492439 - protein, 5 aa, Mycobacterium
GPSGF

SEQ ID NO: 492440 - protein, 7 aa, Mycobacterium
GPSGFIG

SEQ ID NO: 492441 - protein, 7 aa, Mycobacterium
GPSGGAD

SEQ ID NO: 492442 - protein, 9 aa, Mycobacterium
GPSGGGKTT

SEQ ID NO: 492443 - protein, 10 aa, Mycobacterium
GPSGGGKTTA

SEQ ID NO: 492444 - protein, 9 aa, Mycobacterium
GPSGGLTAS

SEQ ID NO: 492445 - protein, 6 aa, Mycobacterium
GPSGGW

SEQ ID NO: 492446 - protein, 11 aa, Mycobacterium
GPSGKRPGAIA

SEQ ID NO: 492447 - protein, 5 aa, Mycobacterium
GPSGL

SEQ ID NO: 492448 - protein, 5 aa, Mycobacterium
GPSGN

SEQ ID NO: 492449 - protein, 7 aa, Mycobacterium
GPSGQAE

SEQ ID NO: 492450 - protein, 11 aa, Mycobacterium
GPSGSGKSTAL

SEQ ID NO: 492451 - protein, 13 aa, Mycobacterium
GPSGSGLDEPTAL

SEQ ID NO: 492452 - protein, 5 aa, Mycobacterium
GPSGW

SEQ ID NO: 492453 - protein, 8 aa, Mycobacterium
GPSGYGEE

SEQ ID NO: 492454 - protein, 4 aa, Mycobacterium
GPSH

SEQ ID NO: 492455 - protein, 5 aa, Mycobacterium
GPSHE

SEQ ID NO: 492456 - protein, 6 aa, Mycobacterium
GPSHEP

SEQ ID NO: 492457 - protein, 4 aa, Mycobacterium
GPSI

SEQ ID NO: 492458 - protein, 6 aa, Mycobacterium
GPSIAA

SEQ ID NO: 492459 - protein, 12 aa, Mycobacterium
GPSIDGDVVPDD

SEQ ID NO: 492460 - protein, 6 aa, Mycobacterium
GPSIGF

SEQ ID NO: 492461 - protein, 6 aa, Mycobacterium
GPSISE

SEQ ID NO: 492462 - protein, 13 aa, Mycobacterium
GPSITPRSPQGQA

SEQ ID NO: 492463 - protein, 4 aa, Mycobacterium
GPSK

SEQ ID NO: 492464 - protein, 6 aa, Mycobacterium
GPSKAA

SEQ ID NO: 492465 - protein, 14 aa, Mycobacterium
GPSKDAARIEGSKA

SEQ ID NO: 492466 - protein, 11 aa, Mycobacterium
GPSKDAQGARR

SEQ ID NO: 492467 - protein, 7 aa, Mycobacterium
GPSLPPT

SEQ ID NO: 492468 - protein, 8 aa, Mycobacterium
GPSLRPSA

SEQ ID NO: 492469 - protein, 5 aa, Mycobacterium
GPSLS

SEQ ID NO: 492470 - protein, 13 aa, Mycobacterium
GPSLSGPGRRSVT

SEQ ID NO: 492471 - protein, 8 aa, Mycobacterium
GPSLSGTH

SEQ ID NO: 492472 - protein, 12 aa, Mycobacterium
GPSLSQAGTVEL

SEQ ID NO: 492473 - protein, 6 aa, Mycobacterium
GPSMTT

SEQ ID NO: 492474 - protein, 13 aa, Mycobacterium
GPSMTVDSGQSSS

SEQ ID NO: 492475 - protein, 9 aa, Mycobacterium
GPSNPHGAN

SEQ ID NO: 492476 - protein, 7 aa, Mycobacterium
GPSNRTL

SEQ ID NO: 492477 - protein, 10 aa, Mycobacterium
GPSPDELSSG

SEQ ID NO: 492478 - protein, 10 aa, Mycobacterium
GPSPDERRAA

SEQ ID NO: 492479 - protein, 7 aa, Mycobacterium
GPSPGGL

SEQ ID NO: 492480 - protein, 11 aa, Mycobacterium
GPSPGTPPGPW

SEQ ID NO: 492481 - protein, 8 aa, Mycobacterium
GPSPLRPG

SEQ ID NO: 492482 - protein, 7 aa, Mycobacterium
GPSPRAG

SEQ ID NO: 492483 - protein, 5 aa, Mycobacterium
GPSPW

SEQ ID NO: 492484 - protein, 11 aa, Mycobacterium
GPSQGGAGAVA

SEQ ID NO: 492485 - protein, 7 aa, Mycobacterium
GPSRAVS

SEQ ID NO: 492486 - protein, 6 aa, Mycobacterium
GPSRDG

SEQ ID NO: 492487 - protein, 7 aa, Mycobacterium
GPSRERS

SEQ ID NO: 492488 - protein, 15 aa, Mycobacterium
GPSRPPYTDAPPDMV

SEQ ID NO: 492489 - protein, 9 aa, Mycobacterium
GPSRTGDLP

SEQ ID NO: 492490 - protein, 25 aa, Mycobacterium
GPSSAAARGASDVTTQHNDAAAKVT

SEQ ID NO: 492491 - protein, 8 aa, Mycobacterium
GPSSGLTA

SEQ ID NO: 492492 - protein, 9 aa, Mycobacterium
GPSSGLTAS

SEQ ID NO: 492493 - protein, 10 aa, Mycobacterium
GPSSGPTGLN

SEQ ID NO: 492494 - protein, 5 aa, Mycobacterium
GPSSK

SEQ ID NO: 492495 - protein, 14 aa, Mycobacterium
GPSTAPAVRAVRDT

SEQ ID NO: 492496 - protein, 15 aa, Mycobacterium
GPSTGGSGGAGGAGG

SEQ ID NO: 492497 - protein, 7 aa, Mycobacterium
GPSTRNS

SEQ ID NO: 492498 - protein, 7 aa, Mycobacterium
GPSTTDD

SEQ ID NO: 492499 - protein, 20 aa, Mycobacterium
GPSVAPAKTMPKGLGAETGE

SEQ ID NO: 492500 - protein, 5 aa, Mycobacterium
GPSVD

SEQ ID NO: 492501 - protein, 9 aa, Mycobacterium
GPSVDAADA

SEQ ID NO: 492502 - protein, 5 aa, Mycobacterium
GPSVP

SEQ ID NO: 492503 - protein, 10 aa, Mycobacterium
GPSVPADDAE

SEQ ID NO: 492504 - protein, 5 aa, Mycobacterium
GPSWG

SEQ ID NO: 492505 - protein, 9 aa, Mycobacterium
GPSYTRPAS

SEQ ID NO: 492506 - protein, 9 aa, Mycobacterium
GPSYTRPPT

SEQ ID NO: 492507 - protein, 4 aa, Mycobacterium
GPTA

SEQ ID NO: 492508 - protein, 7 aa, Mycobacterium
GPTADIE

SEQ ID NO: 492509 - protein, 5 aa, Mycobacterium
GPTAE

SEQ ID NO: 492510 - protein, 6 aa, Mycobacterium
GPTAFA

SEQ ID NO: 492511 - protein, 7 aa, Mycobacterium
GPTAGDR

SEQ ID NO: 492512 - protein, 19 aa, Mycobacterium
GPTAGGYTAAAADGTSGGV

SEQ ID NO: 492513 - protein, 14 aa, Mycobacterium
GPTAGSLSASHTSA

SEQ ID NO: 492514 - protein, 15 aa, Mycobacterium
GPTAGTGTPTGDYGI

SEQ ID NO: 492515 - protein, 10 aa, Mycobacterium
GPTALTPNLG

SEQ ID NO: 492516 - protein, 9 aa, Mycobacterium
GPTAPGALR

SEQ ID NO: 492517 - protein, 5 aa, Mycobacterium
GPTAQ

SEQ ID NO: 492518 - protein, 8 aa, Mycobacterium
GPTARVGA

SEQ ID NO: 492519 - protein, 5 aa, Mycobacterium
GPTAT

SEQ ID NO: 492520 - protein, 45 aa, Mycobacterium
GPTAVPGMDAPERDRRAGDGGIAGDRRRTRRRPARGRLPATRRRC

SEQ ID NO: 492521 - protein, 4 aa, Mycobacterium
GPTC

SEQ ID NO: 492522 - protein, 7 aa, Mycobacterium
GPTCDGD

SEQ ID NO: 492523 - protein, 10 aa, Mycobacterium
GPTDHRPVTP

SEQ ID NO: 492524 - protein, 6 aa, Mycobacterium
GPTDIA

SEQ ID NO: 492525 - protein, 5 aa, Mycobacterium
GPTDV

SEQ ID NO: 492526 - protein, 4 aa, Mycobacterium
GPTE

SEQ ID NO: 492527 - protein, 8 aa, Mycobacterium
GPTEAYTA

SEQ ID NO: 492528 - protein, 6 aa, Mycobacterium
GPTELK

SEQ ID NO: 492529 - protein, 12 aa, Mycobacterium
GPTEPEYGTSVH

SEQ ID NO: 492530 - protein, 9 aa, Mycobacterium
GPTEPTPRK

SEQ ID NO: 492531 - protein, 9 aa, Mycobacterium
GPTEPTPRS

SEQ ID NO: 492532 - protein, 16 aa, Mycobacterium
GPTEQEYGTRVGGGPV

SEQ ID NO: 492533 - protein, 17 aa, Mycobacterium
GPTEREYSTSVAGGPIV

SEQ ID NO: 492534 - protein, 7 aa, Mycobacterium
GPTERID

SEQ ID NO: 492535 - protein, 5 aa, Mycobacterium
GPTES

SEQ ID NO: 492536 - protein, 8 aa, Mycobacterium
GPTESTVG

SEQ ID NO: 492537 - protein, 5 aa, Mycobacterium
GPTEV

SEQ ID NO: 492538 - protein, 6 aa, Mycobacterium
GPTEVE

SEQ ID NO: 492539 - protein, 5 aa, Mycobacterium
GPTEY

SEQ ID NO: 492540 - protein, 8 aa, Mycobacterium
GPTGAGQK

SEQ ID NO: 492541 - protein, 8 aa, Mycobacterium
GPTGATAA

SEQ ID NO: 492542 - protein, 6 aa, Mycobacterium
GPTGGL

SEQ ID NO: 492543 - protein, 6 aa, Mycobacterium
GPTGIT

SEQ ID NO: 492544 - protein, 5 aa, Mycobacterium
GPTGL

SEQ ID NO: 492545 - protein, 13 aa, Mycobacterium
GPTGLTSEVPAED

SEQ ID NO: 492546 - protein, 12 aa, Mycobacterium
GPTGLTSEVPAR

SEQ ID NO: 492547 - protein, 7 aa, Mycobacterium
GPTGPMP

SEQ ID NO: 492548 - protein, 11 aa, Mycobacterium
GPTGPNGSMSA

SEQ ID NO: 492549 - protein, 15 aa, Mycobacterium
GPTGPTDPDHELPWR

SEQ ID NO: 492550 - protein, 15 aa, Mycobacterium
GPTGSNNEADDRHTS

SEQ ID NO: 492551 - protein, 5 aa, Mycobacterium
GPTGT

SEQ ID NO: 492552 - protein, 9 aa, Mycobacterium
GPTGTGKSQ

SEQ ID NO: 492553 - protein, 17 aa, Mycobacterium
GPTGVIGSNKKDSADTV

SEQ ID NO: 492554 - protein, 5 aa, Mycobacterium
GPTHA

SEQ ID NO: 492555 - protein, 5 aa, Mycobacterium
GPTHD

SEQ ID NO: 492556 - protein, 17 aa, Mycobacterium
GPTHGDQATRPDPVTPD

SEQ ID NO: 492557 - protein, 7 aa, Mycobacterium
GPTHPSN

SEQ ID NO: 492558 - protein, 7 aa, Mycobacterium
GPTHTAG

SEQ ID NO: 492559 - protein, 15 aa, Mycobacterium
GPTHTRGNPPNVVET

SEQ ID NO: 492560 - protein, 17 aa, Mycobacterium
GPTHTRGTPPNVVETDP

SEQ ID NO: 492561 - protein, 5 aa, Mycobacterium
GPTIG

SEQ ID NO: 492562 - protein, 6 aa, Mycobacterium
GPTIGA

SEQ ID NO: 492563 - protein, 6 aa, Mycobacterium
GPTIRP

SEQ ID NO: 492564 - protein, 6 aa, Mycobacterium
GPTISA

SEQ ID NO: 492565 - protein, 14 aa, Mycobacterium
GPTKDAARIEGSKA

SEQ ID NO: 492566 - protein, 6 aa, Mycobacterium
GPTKEF

SEQ ID NO: 492567 - protein, 20 aa, Mycobacterium
GPTKEFEEHRETYGDTSQLS

SEQ ID NO: 492568 - protein, 6 aa, Mycobacterium
GPTKER

SEQ ID NO: 492569 - protein, 5 aa, Mycobacterium
GPTLA

SEQ ID NO: 492570 - protein, 17 aa, Mycobacterium
GPTLGRPTVDKVKGSKF

SEQ ID NO: 492571 - protein, 9 aa, Mycobacterium
GPTLPDGLA

SEQ ID NO: 492572 - protein, 8 aa, Mycobacterium
GPTLPDGM

SEQ ID NO: 492573 - protein, 9 aa, Mycobacterium
GPTLPEGLS

SEQ ID NO: 492574 - protein, 10 aa, Mycobacterium
GPTLPGTEGL

SEQ ID NO: 492575 - protein, 5 aa, Mycobacterium
GPTLR

SEQ ID NO: 492576 - protein, 10 aa, Mycobacterium
GPTLTDRSPV

SEQ ID NO: 492577 - protein, 14 aa, Mycobacterium
GPTLTGNIGGPTTS

SEQ ID NO: 492578 - protein, 5 aa, Mycobacterium
GPTNV

SEQ ID NO: 492579 - protein, 6 aa, Mycobacterium
GPTPAS

SEQ ID NO: 492580 - protein, 32 aa, Mycobacterium
GPTPATGPEPTNGPDPTGFGSGHDTDPSDGTF

SEQ ID NO: 492581 - protein, 6 aa, Mycobacterium
GPTPDV

SEQ ID NO: 492582 - protein, 7 aa, Mycobacterium
GPTPDVV

SEQ ID NO: 492583 - protein, 6 aa, Mycobacterium
GPTPEA

SEQ ID NO: 492584 - protein, 8 aa, Mycobacterium
GPTPELGA

SEQ ID NO: 492585 - protein, 7 aa, Mycobacterium
GPTPGGA

SEQ ID NO: 492586 - protein, 12 aa, Mycobacterium
GPTPKRGPDNGM

SEQ ID NO: 492587 - protein, 17 aa, Mycobacterium
GPTPKVTANHRGGRRSN

SEQ ID NO: 492588 - protein, 18 aa, Mycobacterium
GPTPKVTANHRGGRRTNV

SEQ ID NO: 492589 - protein, 5 aa, Mycobacterium
GPTPL

SEQ ID NO: 492590 - protein, 6 aa, Mycobacterium
GPTPRD

SEQ ID NO: 492591 - protein, 6 aa, Mycobacterium
GPTPRL

SEQ ID NO: 492592 - protein, 15 aa, Mycobacterium
GPTPRVTANHRGGRR

SEQ ID NO: 492593 - protein, 7 aa, Mycobacterium
GPTPTAD

SEQ ID NO: 492594 - protein, 9 aa, Mycobacterium
GPTPTEGQK

SEQ ID NO: 492595 - protein, 7 aa, Mycobacterium
GPTPTGL

SEQ ID NO: 492596 - protein, 4 aa, Mycobacterium
GPTQ

SEQ ID NO: 492597 - protein, 14 aa, Mycobacterium
GPTQLTRDSSAPWA

SEQ ID NO: 492598 - protein, 8 aa, Mycobacterium
GPTQPGIT

SEQ ID NO: 492599 - protein, 7 aa, Mycobacterium
GPTRAYG

SEQ ID NO: 492600 - protein, 7 aa, Mycobacterium
GPTRGDR

SEQ ID NO: 492601 - protein, 12 aa, Mycobacterium
GPTRGIADRNDF

SEQ ID NO: 492602 - protein, 5 aa, Mycobacterium
GPTRN

SEQ ID NO: 492603 - protein, 24 aa, Mycobacterium
GPTRNPWDTSRTPGGSSGGSAAAV

SEQ ID NO: 492604 - protein, 5 aa, Mycobacterium
GPTRR

SEQ ID NO: 492605 - protein, 8 aa, Mycobacterium
GPTSDIEE

SEQ ID NO: 492606 - protein, 5 aa, Mycobacterium
GPTSK

SEQ ID NO: 492607 - protein, 9 aa, Mycobacterium
GPTSSTRCC

SEQ ID NO: 492608 - protein, 10 aa, Mycobacterium
GPTSVLTPTE

SEQ ID NO: 492609 - protein, 12 aa, Mycobacterium
GPTSVYSPFSDA

SEQ ID NO: 492610 - protein, 8 aa, Mycobacterium
GPTTASSR

SEQ ID NO: 492611 - protein, 11 aa, Mycobacterium
GPTTEHLRREG

SEQ ID NO: 492612 - protein, 12 aa, Mycobacterium
GPTTGAPVSEAG

SEQ ID NO: 492613 - protein, 9 aa, Mycobacterium
GPTTGRASA

SEQ ID NO: 492614 - protein, 7 aa, Mycobacterium
GPTTSPE

SEQ ID NO: 492615 - protein, 9 aa, Mycobacterium
GPTTTPDQA

SEQ ID NO: 492616 - protein, 5 aa, Mycobacterium
GPTTV

SEQ ID NO: 492617 - protein, 5 aa, Mycobacterium
GPTVG

SEQ ID NO: 492618 - protein, 5 aa, Mycobacterium
GPTWN

SEQ ID NO: 492619 - protein, 6 aa, Mycobacterium
GPTYGT

SEQ ID NO: 492620 - protein, 5 aa, Mycobacterium
GPVAD

SEQ ID NO: 492621 - protein, 6 aa, Mycobacterium
GPVAEP

SEQ ID NO: 492622 - protein, 5 aa, Mycobacterium
GPVAG

SEQ ID NO: 492623 - protein, 11 aa, Mycobacterium
GPVAGQDPTPF

SEQ ID NO: 492624 - protein, 7 aa, Mycobacterium
GPVAPDD

SEQ ID NO: 492625 - protein, 16 aa, Mycobacterium
GPVAPRPAPDAQPNEV

SEQ ID NO: 492626 - protein, 13 aa, Mycobacterium
GPVATNSEGANMD

SEQ ID NO: 492627 - protein, 13 aa, Mycobacterium
GPVATNTEGSNMD

SEQ ID NO: 492628 - protein, 6 aa, Mycobacterium
GPVDEY

SEQ ID NO: 492629 - protein, 5 aa, Mycobacterium
GPVDF

SEQ ID NO: 492630 - protein, 6 aa, Mycobacterium
GPVDGP

SEQ ID NO: 492631 - protein, 6 aa, Mycobacterium
GPVDLP

SEQ ID NO: 492632 - protein, 5 aa, Mycobacterium
GPVDP

SEQ ID NO: 492633 - protein, 14 aa, Mycobacterium
GPVDPPNTGSLRGD

SEQ ID NO: 492634 - protein, 5 aa, Mycobacterium
GPVDQ

SEQ ID NO: 492635 - protein, 12 aa, Mycobacterium
GPVDTSRPEPAI

SEQ ID NO: 492636 - protein, 5 aa, Mycobacterium
GPVEE

SEQ ID NO: 492637 - protein, 14 aa, Mycobacterium
GPVEPDPDFDHPKT

SEQ ID NO: 492638 - protein, 5 aa, Mycobacterium
GPVEQ

SEQ ID NO: 492639 - protein, 5 aa, Mycobacterium
GPVET

SEQ ID NO: 492640 - protein, 5 aa, Mycobacterium
GPVGA

SEQ ID NO: 492641 - protein, 10 aa, Mycobacterium
GPVGDPGWFG

SEQ ID NO: 492642 - protein, 13 aa, Mycobacterium
GPVGEATALPANR

SEQ ID NO: 492643 - protein, 12 aa, Mycobacterium
GPVGENAADRCQ

SEQ ID NO: 492644 - protein, 5 aa, Mycobacterium
GPVGI

SEQ ID NO: 492645 - protein, 19 aa, Mycobacterium
GPVGKGGKAGARDRADDLA

SEQ ID NO: 492646 - protein, 17 aa, Mycobacterium
GPVGPAARAFLERARAV

SEQ ID NO: 492647 - protein, 15 aa, Mycobacterium
GPVGQNVADRARAAG

SEQ ID NO: 492648 - protein, 17 aa, Mycobacterium
GPVGSDDGDDTDGGPGS

SEQ ID NO: 492649 - protein, 56 aa, Mycobacterium
GPVGTTAPSVPGPTESVGTGHGADTGSTGAGGASVRPRPRGAGRGEAKTPTPQGDA

SEQ ID NO: 492650 - protein, 10 aa, Mycobacterium
GPVHGAQQRK

SEQ ID NO: 492651 - protein, 12 aa, Mycobacterium
GPVHPGGTSPVD

SEQ ID NO: 492652 - protein, 6 aa, Mycobacterium
GPVKGF

SEQ ID NO: 492653 - protein, 14 aa, Mycobacterium
GPVNAPETPEIQPD

SEQ ID NO: 492654 - protein, 6 aa, Mycobacterium
GPVPAE

SEQ ID NO: 492655 - protein, 10 aa, Mycobacterium
GPVPASPATG

SEQ ID NO: 492656 - protein, 11 aa, Mycobacterium
GPVPASRPAGD

SEQ ID NO: 492657 - protein, 11 aa, Mycobacterium
GPVPDKIEEGT

SEQ ID NO: 492658 - protein, 5 aa, Mycobacterium
GPVPH

SEQ ID NO: 492659 - protein, 11 aa, Mycobacterium
GPVPHPSSPLS

SEQ ID NO: 492660 - protein, 18 aa, Mycobacterium
GPVPKAPLGRSNNYPRSV

SEQ ID NO: 492661 - protein, 9 aa, Mycobacterium
GPVPNPQEL

SEQ ID NO: 492662 - protein, 17 aa, Mycobacterium
GPVPPVRAHEPPVIRTL

SEQ ID NO: 492663 - protein, 6 aa, Mycobacterium
GPVPQA

SEQ ID NO: 492664 - protein, 6 aa, Mycobacterium
GPVPSA

SEQ ID NO: 492665 - protein, 12 aa, Mycobacterium
GPVPTALPPTVP

SEQ ID NO: 492666 - protein, 7 aa, Mycobacterium
GPVPTPA

SEQ ID NO: 492667 - protein, 10 aa, Mycobacterium
GPVQQTRHEP

SEQ ID NO: 492668 - protein, 4 aa, Mycobacterium
GPVR

SEQ ID NO: 492669 - protein, 13 aa, Mycobacterium
GPVRGADDGRVSS

SEQ ID NO: 492670 - protein, 20 aa, Mycobacterium
GPVRGAEDGIAAAGSGVRTK

SEQ ID NO: 492671 - protein, 11 aa, Mycobacterium
GPVRGAEGRRW

SEQ ID NO: 492672 - protein, 7 aa, Mycobacterium
GPVRPPV

SEQ ID NO: 492673 - protein, 14 aa, Mycobacterium
GPVRTDLPDASEAS

SEQ ID NO: 492674 - protein, 13 aa, Mycobacterium
GPVRTDLPDEAEA

SEQ ID NO: 492675 - protein, 14 aa, Mycobacterium
GPVRTVEPDPAEAS

SEQ ID NO: 492676 - protein, 5 aa, Mycobacterium
GPVRV

SEQ ID NO: 492677 - protein, 10 aa, Mycobacterium
GPVRVSPSNV

SEQ ID NO: 492678 - protein, 4 aa, Mycobacterium
GPVS

SEQ ID NO: 492679 - protein, 5 aa, Mycobacterium
GPVSE

SEQ ID NO: 492680 - protein, 5 aa, Mycobacterium
GPVSG

SEQ ID NO: 492681 - protein, 7 aa, Mycobacterium
GPVSGPL

SEQ ID NO: 492682 - protein, 11 aa, Mycobacterium
GPVSGSARTAE

SEQ ID NO: 492683 - protein, 8 aa, Mycobacterium
GPVSGSDL

SEQ ID NO: 492684 - protein, 6 aa, Mycobacterium
GPVSPA

SEQ ID NO: 492685 - protein, 22 aa, Mycobacterium
GPVSPDAADRDSRSVGQRQHDG

SEQ ID NO: 492686 - protein, 121 aa, Mycobacterium
GPVSQSTSGQSGPSASTPKTADSKVSSSGASGFQTSDTGTPESKMSDTKTATGTTAGTKATETKPKAAETKPSDAKSSGSTTSGTKSPGTTAHDSANKPSASASSAAKSGGEGSKSSSGSH

SEQ ID NO: 492687 - protein, 5 aa, Mycobacterium
GPVSR

SEQ ID NO: 492688 - protein, 13 aa, Mycobacterium
GPVSSADEAGVRN

SEQ ID NO: 492689 - protein, 10 aa, Mycobacterium
GPVSSTTPHY

SEQ ID NO: 492690 - protein, 6 aa, Mycobacterium
GPVSTQ

SEQ ID NO: 492691 - protein, 6 aa, Mycobacterium
GPVTAG

SEQ ID NO: 492692 - protein, 9 aa, Mycobacterium
GPVTDPDGI

SEQ ID NO: 492693 - protein, 5 aa, Mycobacterium
GPVTE

SEQ ID NO: 492694 - protein, 22 aa, Mycobacterium
GPVTGSVAPAVGAPAGPLPAYG

SEQ ID NO: 492695 - protein, 11 aa, Mycobacterium
GPVTPEQARTI

SEQ ID NO: 492696 - protein, 13 aa, Mycobacterium
GPVTSSSQHPATA

SEQ ID NO: 492697 - protein, 10 aa, Mycobacterium
GPVTTPRNET

SEQ ID NO: 492698 - protein, 13 aa, Mycobacterium
GPWAGPTSASMAA

SEQ ID NO: 492699 - protein, 14 aa, Mycobacterium
GPWEGARETPGAVR

SEQ ID NO: 492700 - protein, 11 aa, Mycobacterium
GPWGRSEPAER

SEQ ID NO: 492701 - protein, 5 aa, Mycobacterium
GPWGT

SEQ ID NO: 492702 - protein, 4 aa, Mycobacterium
GPWI

SEQ ID NO: 492703 - protein, 5 aa, Mycobacterium
GPWQG

SEQ ID NO: 492704 - protein, 9 aa, Mycobacterium
GPWREGEGQ

SEQ ID NO: 492705 - protein, 6 aa, Mycobacterium
GPWRGS

SEQ ID NO: 492706 - protein, 13 aa, Mycobacterium
GPWSGPAAAAMSA

SEQ ID NO: 492707 - protein, 8 aa, Mycobacterium
GPWTDRAA

SEQ ID NO: 492708 - protein, 5 aa, Mycobacterium
GPWTG

SEQ ID NO: 492709 - protein, 12 aa, Mycobacterium
GPWTTEKPETMP

SEQ ID NO: 492710 - protein, 6 aa, Mycobacterium
GPWVGP

SEQ ID NO: 492711 - protein, 9 aa, Mycobacterium
GPWVGPAST

SEQ ID NO: 492712 - protein, 11 aa, Mycobacterium
GPYAAASTAPI

SEQ ID NO: 492713 - protein, 6 aa, Mycobacterium
GPYAEP

SEQ ID NO: 492714 - protein, 10 aa, Mycobacterium
GPYAGRAASE

SEQ ID NO: 492715 - protein, 11 aa, Mycobacterium
GPYALAAGPDG

SEQ ID NO: 492716 - protein, 7 aa, Mycobacterium
GPYASSG

SEQ ID NO: 492717 - protein, 6 aa, Mycobacterium
GPYATA

SEQ ID NO: 492718 - protein, 13 aa, Mycobacterium
GPYDGTLSASTDL

SEQ ID NO: 492719 - protein, 13 aa, Mycobacterium
GPYDPAAGHRCNP

SEQ ID NO: 492720 - protein, 25 aa, Mycobacterium
GPYDPGYNSDSTRTYSIGEPDPEVA

SEQ ID NO: 492721 - protein, 12 aa, Mycobacterium
GPYDPQAGHRCN

SEQ ID NO: 492722 - protein, 11 aa, Mycobacterium
GPYDPQNGLRC

SEQ ID NO: 492723 - protein, 12 aa, Mycobacterium
GPYDPRAGHRCN

SEQ ID NO: 492724 - protein, 4 aa, Mycobacterium
GPYE

SEQ ID NO: 492725 - protein, 7 aa, Mycobacterium
GPYEPGT

SEQ ID NO: 492726 - protein, 14 aa, Mycobacterium
GPYEPGYNSDCTRT

SEQ ID NO: 492727 - protein, 4 aa, Mycobacterium
GPYG

SEQ ID NO: 492728 - protein, 15 aa, Mycobacterium
GPYGLPDNAIKPSYG

SEQ ID NO: 492729 - protein, 17 aa, Mycobacterium
GPYGSKRQLPQQLRAMV

SEQ ID NO: 492730 - protein, 5 aa, Mycobacterium
GPYGT

SEQ ID NO: 492731 - protein, 11 aa, Mycobacterium
GPYIESRRKAE

SEQ ID NO: 492732 - protein, 4 aa, Mycobacterium
GPYL

SEQ ID NO: 492733 - protein, 16 aa, Mycobacterium
GPYLEATPPYAPGKPL

SEQ ID NO: 492734 - protein, 6 aa, Mycobacterium
GPYLPG

SEQ ID NO: 492735 - protein, 18 aa, Mycobacterium
GPYNVSDDAAGKSATQVR

SEQ ID NO: 492736 - protein, 4 aa, Mycobacterium
GPYP

SEQ ID NO: 492737 - protein, 15 aa, Mycobacterium
GPYPGPGNRRSIESV

SEQ ID NO: 492738 - protein, 4 aa, Mycobacterium
GPYQ

SEQ ID NO: 492739 - protein, 14 aa, Mycobacterium
GPYQIGAEPERTDW

SEQ ID NO: 492740 - protein, 6 aa, Mycobacterium
GPYRDE

SEQ ID NO: 492741 - protein, 6 aa, Mycobacterium
GPYRGR

SEQ ID NO: 492742 - protein, 20 aa, Mycobacterium
GPYRSKRTLPRTLRTMIEST

SEQ ID NO: 492743 - protein, 4 aa, Mycobacterium
GPYS

SEQ ID NO: 492744 - protein, 7 aa, Mycobacterium
GPYSAAK

SEQ ID NO: 492745 - protein, 20 aa, Mycobacterium
GPYSAAPAQITSFAPIRVLV

SEQ ID NO: 492746 - protein, 5 aa, Mycobacterium
GPYSL

SEQ ID NO: 492747 - protein, 7 aa, Mycobacterium
GPYSPGQ

SEQ ID NO: 492748 - protein, 6 aa, Mycobacterium
GPYSYS

SEQ ID NO: 492749 - protein, 4 aa, Mycobacterium
GPYT

SEQ ID NO: 492750 - protein, 5 aa, Mycobacterium
GPYTA

SEQ ID NO: 492751 - protein, 8 aa, Mycobacterium
GPYTAGQP

SEQ ID NO: 492752 - protein, 5 aa, Mycobacterium
GPYTN

SEQ ID NO: 492753 - protein, 7 aa, Mycobacterium
GPYTPTG

SEQ ID NO: 492754 - protein, 5 aa, Mycobacterium
GPYVG

SEQ ID NO: 492755 - protein, 5 aa, Mycobacterium
GPYYD

SEQ ID NO: 492756 - protein, 4 aa, Mycobacterium
GQAA

SEQ ID NO: 492757 - protein, 10 aa, Mycobacterium
GQAAAAGHSL

SEQ ID NO: 492758 - protein, 15 aa, Mycobacterium
GQAAAEGRISPVGGS

SEQ ID NO: 492759 - protein, 8 aa, Mycobacterium
GQAADGLR

SEQ ID NO: 492760 - protein, 8 aa, Mycobacterium
GQAAEELG

SEQ ID NO: 492761 - protein, 8 aa, Mycobacterium
GQAAERGL

SEQ ID NO: 492762 - protein, 6 aa, Mycobacterium
GQAAET

SEQ ID NO: 492763 - protein, 6 aa, Mycobacterium
GQAAGA

SEQ ID NO: 492764 - protein, 9 aa, Mycobacterium
GQAAGLNED

SEQ ID NO: 492765 - protein, 10 aa, Mycobacterium
GQAAGSSASA

SEQ ID NO: 492766 - protein, 12 aa, Mycobacterium
GQAAGYLPSNEQ

SEQ ID NO: 492767 - protein, 18 aa, Mycobacterium
GQAAPDAVAGEHTTVQGA

SEQ ID NO: 492768 - protein, 19 aa, Mycobacterium
GQAAPGDDLAEPAAEAGED

SEQ ID NO: 492769 - protein, 8 aa, Mycobacterium
GQAAPGLQ

SEQ ID NO: 492770 - protein, 9 aa, Mycobacterium
GQAAPLGIP

SEQ ID NO: 492771 - protein, 23 aa, Mycobacterium
GQAAPVAATAPTGPAPGPTAGAP

SEQ ID NO: 492772 - protein, 7 aa, Mycobacterium
GQAAPVT

SEQ ID NO: 492773 - protein, 10 aa, Mycobacterium
GQAARPRQRV

SEQ ID NO: 492774 - protein, 6 aa, Mycobacterium
GQAATE

SEQ ID NO: 492775 - protein, 14 aa, Mycobacterium
GQAATSAADSVGRK

SEQ ID NO: 492776 - protein, 6 aa, Mycobacterium
GQAAYN

SEQ ID NO: 492777 - protein, 7 aa, Mycobacterium
GQAAYNS

SEQ ID NO: 492778 - protein, 11 aa, Mycobacterium
GQAAYSASKGG

SEQ ID NO: 492779 - protein, 8 aa, Mycobacterium
GQACTGTS

SEQ ID NO: 492780 - protein, 4 aa, Mycobacterium
GQAD

SEQ ID NO: 492781 - protein, 5 aa, Mycobacterium
GQADA

SEQ ID NO: 492782 - protein, 10 aa, Mycobacterium
GQADAAGHSL

SEQ ID NO: 492783 - protein, 5 aa, Mycobacterium
GQADE

SEQ ID NO: 492784 - protein, 8 aa, Mycobacterium
GQADEHAG

SEQ ID NO: 492785 - protein, 5 aa, Mycobacterium
GQADH

SEQ ID NO: 492786 - protein, 127 aa, Mycobacterium
GQADPGTDGIDTTGIGGDGGPGSPGAFAGQQGGNGGEGGTGVDVGGGGGDGQTGGPGTLGGNGGNGGTASMGGSGGGGGSGGDGGGGGGAGGNGAIGGFSGGNGGAGGNGGSGGGAGGNGGDGGNAT

SEQ ID NO: 492787 - protein, 10 aa, Mycobacterium
GQAEDLRRNG

SEQ ID NO: 492788 - protein, 11 aa, Mycobacterium
GQAEDLRRNGA

SEQ ID NO: 492789 - protein, 13 aa, Mycobacterium
GQAEETAGHARAA

SEQ ID NO: 492790 - protein, 11 aa, Mycobacterium
GQAEGANTSRA

SEQ ID NO: 492791 - protein, 13 aa, Mycobacterium
GQAEHAPTIDDSQ

SEQ ID NO: 492792 - protein, 6 aa, Mycobacterium
GQAEIA

SEQ ID NO: 492793 - protein, 8 aa, Mycobacterium
GQAELGAA

SEQ ID NO: 492794 - protein, 5 aa, Mycobacterium
GQAEP

SEQ ID NO: 492795 - protein, 7 aa, Mycobacterium
GQAERGL

SEQ ID NO: 492796 - protein, 9 aa, Mycobacterium
GQAESLNAS

SEQ ID NO: 492797 - protein, 7 aa, Mycobacterium
GQAGAKL

SEQ ID NO: 492798 - protein, 10 aa, Mycobacterium
GQAGAPPTLP

SEQ ID NO: 492799 - protein, 10 aa, Mycobacterium
GQAGDGQEAV

SEQ ID NO: 492800 - protein, 11 aa, Mycobacterium
GQAGDRQVEGA

SEQ ID NO: 492801 - protein, 8 aa, Mycobacterium
GQAGGGAV

SEQ ID NO: 492802 - protein, 5 aa, Mycobacterium
GQAGI

SEQ ID NO: 492803 - protein, 7 aa, Mycobacterium
GQAGKQD

SEQ ID NO: 492804 - protein, 5 aa, Mycobacterium
GQAGM

SEQ ID NO: 492805 - protein, 8 aa, Mycobacterium
GQAGNAGG

SEQ ID NO: 492806 - protein, 7 aa, Mycobacterium
GQAGNGL

SEQ ID NO: 492807 - protein, 13 aa, Mycobacterium
GQAGPASDRPGVD

SEQ ID NO: 492808 - protein, 7 aa, Mycobacterium
GQAGPPL

SEQ ID NO: 492809 - protein, 8 aa, Mycobacterium
GQAGPPLA

SEQ ID NO: 492810 - protein, 12 aa, Mycobacterium
GQAGPRSQQAGH

SEQ ID NO: 492811 - protein, 16 aa, Mycobacterium
GQAGPSLASRLTGAGQ

SEQ ID NO: 492812 - protein, 7 aa, Mycobacterium
GQAGPVG

SEQ ID NO: 492813 - protein, 12 aa, Mycobacterium
GQAGSETEYGSA

SEQ ID NO: 492814 - protein, 6 aa, Mycobacterium
GQAGVT

SEQ ID NO: 492815 - protein, 5 aa, Mycobacterium
GQAHR

SEQ ID NO: 492816 - protein, 6 aa, Mycobacterium
GQAHRA

SEQ ID NO: 492817 - protein, 4 aa, Mycobacterium
GQAI

SEQ ID NO: 492818 - protein, 5 aa, Mycobacterium
GQAID

SEQ ID NO: 492819 - protein, 10 aa, Mycobacterium
GQAIDSAAAG

SEQ ID NO: 492820 - protein, 9 aa, Mycobacterium
GQAKAGADI

SEQ ID NO: 492821 - protein, 11 aa, Mycobacterium
GQAKGKDSGVT

SEQ ID NO: 492822 - protein, 8 aa, Mycobacterium
GQALDTAS

SEQ ID NO: 492823 - protein, 5 aa, Mycobacterium
GQALP

SEQ ID NO: 492824 - protein, 6 aa, Mycobacterium
GQALTD

SEQ ID NO: 492825 - protein, 25 aa, Mycobacterium
GQAPALSRLGGSDWTNTKTKARKAV

SEQ ID NO: 492826 - protein, 11 aa, Mycobacterium
GQAPGRRDKDD

SEQ ID NO: 492827 - protein, 8 aa, Mycobacterium
GQAPPDTE

SEQ ID NO: 492828 - protein, 8 aa, Mycobacterium
GQAPPELR

SEQ ID NO: 492829 - protein, 13 aa, Mycobacterium
GQAPPEPRYRPSR

SEQ ID NO: 492830 - protein, 11 aa, Mycobacterium
GQAPPLGGEGA

SEQ ID NO: 492831 - protein, 8 aa, Mycobacterium
GQAPSTGE

SEQ ID NO: 492832 - protein, 10 aa, Mycobacterium
GQAPSTNPAF

SEQ ID NO: 492833 - protein, 10 aa, Mycobacterium
GQAPSTRPEF

SEQ ID NO: 492834 - protein, 5 aa, Mycobacterium
GQAPT

SEQ ID NO: 492835 - protein, 7 aa, Mycobacterium
GQAPTAR

SEQ ID NO: 492836 - protein, 17 aa, Mycobacterium
GQAPTRGRKGSRESVEG

SEQ ID NO: 492837 - protein, 10 aa, Mycobacterium
GQAPVGAPPM

SEQ ID NO: 492838 - protein, 6 aa, Mycobacterium
GQAPVR

SEQ ID NO: 492839 - protein, 16 aa, Mycobacterium
GQAPYLPNSIDGGEPL

SEQ ID NO: 492840 - protein, 5 aa, Mycobacterium
GQAQE

SEQ ID NO: 492841 - protein, 5 aa, Mycobacterium
GQAQN

SEQ ID NO: 492842 - protein, 35 aa, Mycobacterium
GQARAGGAAAQPTQTIPAYEPEPEPAPEPEPEPVY

SEQ ID NO: 492843 - protein, 22 aa, Mycobacterium
GQARDDTRKRPARHRDSITIDP

SEQ ID NO: 492844 - protein, 16 aa, Mycobacterium
GQAREIEDLSGDGTLS

SEQ ID NO: 492845 - protein, 11 aa, Mycobacterium
GQARHTPTGAT

SEQ ID NO: 492846 - protein, 15 aa, Mycobacterium
GQARNQQWDPPGGSD

SEQ ID NO: 492847 - protein, 5 aa, Mycobacterium
GQARS

SEQ ID NO: 492848 - protein, 11 aa, Mycobacterium
GQASARQVTAP

SEQ ID NO: 492849 - protein, 10 aa, Mycobacterium
GQASDAAQLQ

SEQ ID NO: 492850 - protein, 8 aa, Mycobacterium
GQASGGLG

SEQ ID NO: 492851 - protein, 9 aa, Mycobacterium
GQASGPAPD

SEQ ID NO: 492852 - protein, 10 aa, Mycobacterium
GQASGPASSI

SEQ ID NO: 492853 - protein, 16 aa, Mycobacterium
GQASPSKIDGTHTTLQ

SEQ ID NO: 492854 - protein, 15 aa, Mycobacterium
GQASTAVRPGPPPTV

SEQ ID NO: 492855 - protein, 5 aa, Mycobacterium
GQASV

SEQ ID NO: 492856 - protein, 4 aa, Mycobacterium
GQAT

SEQ ID NO: 492857 - protein, 5 aa, Mycobacterium
GQATG

SEQ ID NO: 492858 - protein, 10 aa, Mycobacterium
GQATGRQVED

SEQ ID NO: 492859 - protein, 10 aa, Mycobacterium
GQATGRQVEG

SEQ ID NO: 492860 - protein, 12 aa, Mycobacterium
GQATGRQVENAT

SEQ ID NO: 492861 - protein, 7 aa, Mycobacterium
GQATPPP

SEQ ID NO: 492862 - protein, 8 aa, Mycobacterium
GQATSTGE

SEQ ID NO: 492863 - protein, 21 aa, Mycobacterium
GQAVPAPAQPGPTSAASMGNH

SEQ ID NO: 492864 - protein, 19 aa, Mycobacterium
GQAVQTPPPAASASPETQP

SEQ ID NO: 492865 - protein, 9 aa, Mycobacterium
GQAVRTASS

SEQ ID NO: 492866 - protein, 7 aa, Mycobacterium
GQAVTGA

SEQ ID NO: 492867 - protein, 4 aa, Mycobacterium
GQAY

SEQ ID NO: 492868 - protein, 8 aa, Mycobacterium
GQAYEDPS

SEQ ID NO: 492869 - protein, 8 aa, Mycobacterium
GQAYPDTC

SEQ ID NO: 492870 - protein, 8 aa, Mycobacterium
GQCEETED

SEQ ID NO: 492871 - protein, 12 aa, Mycobacterium
GQCGAADSVRRA

SEQ ID NO: 492872 - protein, 7 aa, Mycobacterium
GQCPPRQ

SEQ ID NO: 492873 - protein, 4 aa, Mycobacterium
GQDA

SEQ ID NO: 492874 - protein, 7 aa, Mycobacterium
GQDAARL

SEQ ID NO: 492875 - protein, 9 aa, Mycobacterium
GQDAGPVAG

SEQ ID NO: 492876 - protein, 9 aa, Mycobacterium
GQDAHVGSV

SEQ ID NO: 492877 - protein, 9 aa, Mycobacterium
GQDAKTGQT

SEQ ID NO: 492878 - protein, 10 aa, Mycobacterium
GQDARAADDE

SEQ ID NO: 492879 - protein, 10 aa, Mycobacterium
GQDARGAEEE

SEQ ID NO: 492880 - protein, 12 aa, Mycobacterium
GQDAVGAHHDPS

SEQ ID NO: 492881 - protein, 5 aa, Mycobacterium
GQDDE

SEQ ID NO: 492882 - protein, 5 aa, Mycobacterium
GQDDL

SEQ ID NO: 492883 - protein, 6 aa, Mycobacterium
GQDDLT

SEQ ID NO: 492884 - protein, 6 aa, Mycobacterium
GQDDSR

SEQ ID NO: 492885 - protein, 5 aa, Mycobacterium
GQDDV

SEQ ID NO: 492886 - protein, 6 aa, Mycobacterium
GQDEHG

SEQ ID NO: 492887 - protein, 4 aa, Mycobacterium
GQDG

SEQ ID NO: 492888 - protein, 5 aa, Mycobacterium
GQDGA

SEQ ID NO: 492889 - protein, 6 aa, Mycobacterium
GQDGAA

SEQ ID NO: 492890 - protein, 7 aa, Mycobacterium
GQDGDSC

SEQ ID NO: 492891 - protein, 5 aa, Mycobacterium
GQDGE

SEQ ID NO: 492892 - protein, 9 aa, Mycobacterium
GQDGERREF

SEQ ID NO: 492893 - protein, 9 aa, Mycobacterium
GQDGHDRGQ

SEQ ID NO: 492894 - protein, 6 aa, Mycobacterium
GQDGKL

SEQ ID NO: 492895 - protein, 5 aa, Mycobacterium
GQDGS

SEQ ID NO: 492896 - protein, 8 aa, Mycobacterium
GQDGSFSE

SEQ ID NO: 492897 - protein, 9 aa, Mycobacterium
GQDGSYNED

SEQ ID NO: 492898 - protein, 9 aa, Mycobacterium
GQDGSYSEE

SEQ ID NO: 492899 - protein, 10 aa, Mycobacterium
GQDGSYTEEG

SEQ ID NO: 492900 - protein, 9 aa, Mycobacterium
GQDGTGQNG

SEQ ID NO: 492901 - protein, 7 aa, Mycobacterium
GQDHTLA

SEQ ID NO: 492902 - protein, 7 aa, Mycobacterium
GQDKPFQ

SEQ ID NO: 492903 - protein, 4 aa, Mycobacterium
GQDL

SEQ ID NO: 492904 - protein, 6 aa, Mycobacterium
GQDLRG

SEQ ID NO: 492905 - protein, 7 aa, Mycobacterium
GQDLSER

SEQ ID NO: 492906 - protein, 15 aa, Mycobacterium
GQDLSQHDSGAYTGD

SEQ ID NO: 492907 - protein, 10 aa, Mycobacterium
GQDNDAARSA

SEQ ID NO: 492908 - protein, 5 aa, Mycobacterium
GQDNL

SEQ ID NO: 492909 - protein, 7 aa, Mycobacterium
GQDPDGL

SEQ ID NO: 492910 - protein, 7 aa, Mycobacterium
GQDPDRL

SEQ ID NO: 492911 - protein, 13 aa, Mycobacterium
GQDPFDRAEIWRQ

SEQ ID NO: 492912 - protein, 10 aa, Mycobacterium
GQDPRLAPKP

SEQ ID NO: 492913 - protein, 11 aa, Mycobacterium
GQDPRLAPPPV

SEQ ID NO: 492914 - protein, 8 aa, Mycobacterium
GQDPSDID

SEQ ID NO: 492915 - protein, 4 aa, Mycobacterium
GQDR

SEQ ID NO: 492916 - protein, 8 aa, Mycobacterium
GQDRLDSQ

SEQ ID NO: 492917 - protein, 8 aa, Mycobacterium
GQDRPADR

SEQ ID NO: 492918 - protein, 17 aa, Mycobacterium
GQDRSRAAQLGEAGGRY

SEQ ID NO: 492919 - protein, 13 aa, Mycobacterium
GQDRVRATYGPNY

SEQ ID NO: 492920 - protein, 9 aa, Mycobacterium
GQDSPQDRG

SEQ ID NO: 492921 - protein, 9 aa, Mycobacterium
GQDSPSTRG

SEQ ID NO: 492922 - protein, 9 aa, Mycobacterium
GQDTEPLDK

SEQ ID NO: 492923 - protein, 9 aa, Mycobacterium
GQDTEPLET

SEQ ID NO: 492924 - protein, 10 aa, Mycobacterium
GQDTPNQTTP

SEQ ID NO: 492925 - protein, 10 aa, Mycobacterium
GQDTRRGTFS

SEQ ID NO: 492926 - protein, 8 aa, Mycobacterium
GQDVPSEP

SEQ ID NO: 492927 - protein, 7 aa, Mycobacterium
GQDVPVG

SEQ ID NO: 492928 - protein, 6 aa, Mycobacterium
GQDVTT

SEQ ID NO: 492929 - protein, 4 aa, Mycobacterium
GQDW

SEQ ID NO: 492930 - protein, 9 aa, Mycobacterium
GQDYTAKAA

SEQ ID NO: 492931 - protein, 7 aa, Mycobacterium
GQEAAQV

SEQ ID NO: 492932 - protein, 8 aa, Mycobacterium
GQEAAQVG

SEQ ID NO: 492933 - protein, 14 aa, Mycobacterium
GQEAASSPEAGLTP

SEQ ID NO: 492934 - protein, 10 aa, Mycobacterium
GQEAETLGDQ

SEQ ID NO: 492935 - protein, 14 aa, Mycobacterium
GQEAGPDERISRGD

SEQ ID NO: 492936 - protein, 5 aa, Mycobacterium
GQEAL

SEQ ID NO: 492937 - protein, 9 aa, Mycobacterium
GQEARGAHQ

SEQ ID NO: 492938 - protein, 18 aa, Mycobacterium
GQEAVNEAAARAKASFES

SEQ ID NO: 492939 - protein, 13 aa, Mycobacterium
GQEDEIPLTAPEG

SEQ ID NO: 492940 - protein, 5 aa, Mycobacterium
GQEDN

SEQ ID NO: 492941 - protein, 4 aa, Mycobacterium
GQEE

SEQ ID NO: 492942 - protein, 6 aa, Mycobacterium
GQEEDL

SEQ ID NO: 492943 - protein, 14 aa, Mycobacterium
GQEEQAAGSPAPVT

SEQ ID NO: 492944 - protein, 10 aa, Mycobacterium
GQEEVHTART

SEQ ID NO: 492945 - protein, 7 aa, Mycobacterium
GQEFPTL

SEQ ID NO: 492946 - protein, 9 aa, Mycobacterium
GQEGGAHDH

SEQ ID NO: 492947 - protein, 13 aa, Mycobacterium
GQEGKSWSQPAEA

SEQ ID NO: 492948 - protein, 7 aa, Mycobacterium
GQEKDDA

SEQ ID NO: 492949 - protein, 10 aa, Mycobacterium
GQEKDDADWQ

SEQ ID NO: 492950 - protein, 7 aa, Mycobacterium
GQEKFDS

SEQ ID NO: 492951 - protein, 9 aa, Mycobacterium
GQELPPELP

SEQ ID NO: 492952 - protein, 7 aa, Mycobacterium
GQELQGP

SEQ ID NO: 492953 - protein, 12 aa, Mycobacterium
GQELSGSELERM

SEQ ID NO: 492954 - protein, 5 aa, Mycobacterium
GQENE

SEQ ID NO: 492955 - protein, 13 aa, Mycobacterium
GQEPGAALDTDTA

SEQ ID NO: 492956 - protein, 10 aa, Mycobacterium
GQEPGSAEEI

SEQ ID NO: 492957 - protein, 8 aa, Mycobacterium
GQEPPAEK

SEQ ID NO: 492958 - protein, 11 aa, Mycobacterium
GQEPSTKSAKS

SEQ ID NO: 492959 - protein, 5 aa, Mycobacterium
GQEQL

SEQ ID NO: 492960 - protein, 4 aa, Mycobacterium
GQER

SEQ ID NO: 492961 - protein, 5 aa, Mycobacterium
GQERD

SEQ ID NO: 492962 - protein, 7 aa, Mycobacterium
GQERDAM

SEQ ID NO: 492963 - protein, 10 aa, Mycobacterium
GQERGLRPGT

SEQ ID NO: 492964 - protein, 6 aa, Mycobacterium
GQERVG

SEQ ID NO: 492965 - protein, 8 aa, Mycobacterium
GQESEALA

SEQ ID NO: 492966 - protein, 5 aa, Mycobacterium
GQESL

SEQ ID NO: 492967 - protein, 8 aa, Mycobacterium
GQESMSQA

SEQ ID NO: 492968 - protein, 7 aa, Mycobacterium
GQESMTK

SEQ ID NO: 492969 - protein, 8 aa, Mycobacterium
GQESMTNA

SEQ ID NO: 492970 - protein, 7 aa, Mycobacterium
GQESMTQ

SEQ ID NO: 492971 - protein, 9 aa, Mycobacterium
GQESRRAWT

SEQ ID NO: 492972 - protein, 8 aa, Mycobacterium
GQETRTAA

SEQ ID NO: 492973 - protein, 5 aa, Mycobacterium
GQETT

SEQ ID NO: 492974 - protein, 6 aa, Mycobacterium
GQETTA

SEQ ID NO: 492975 - protein, 6 aa, Mycobacterium
GQETYE

SEQ ID NO: 492976 - protein, 7 aa, Mycobacterium
GQETYEG

SEQ ID NO: 492977 - protein, 7 aa, Mycobacterium
GQEVRTA

SEQ ID NO: 492978 - protein, 11 aa, Mycobacterium
GQEVSAGETIG

SEQ ID NO: 492979 - protein, 6 aa, Mycobacterium
GQEVSI

SEQ ID NO: 492980 - protein, 6 aa, Mycobacterium
GQEVTT

SEQ ID NO: 492981 - protein, 6 aa, Mycobacterium
GQFAGP

SEQ ID NO: 492982 - protein, 6 aa, Mycobacterium
GQFAGR

SEQ ID NO: 492983 - protein, 7 aa, Mycobacterium
GQFDPRT

SEQ ID NO: 492984 - protein, 8 aa, Mycobacterium
GQFDPTTM

SEQ ID NO: 492985 - protein, 14 aa, Mycobacterium
GQFEESAALVVAVS

SEQ ID NO: 492986 - protein, 6 aa, Mycobacterium
GQFPDT

SEQ ID NO: 492987 - protein, 6 aa, Mycobacterium
GQFPGS

SEQ ID NO: 492988 - protein, 26 aa, Mycobacterium
GQFRRGHPAPLKDAADEAVSQPDSPV

SEQ ID NO: 492989 - protein, 26 aa, Mycobacterium
GQFRRGKPAPLKDAADEAVNDPESPV

SEQ ID NO: 492990 - protein, 26 aa, Mycobacterium
GQFRRGKPAPLKDAADEAVSDPDSPI

SEQ ID NO: 492991 - protein, 6 aa, Mycobacterium
GQFSGY

SEQ ID NO: 492992 - protein, 20 aa, Mycobacterium
GQFTSPDGKTIPIKDSENDT

SEQ ID NO: 492993 - protein, 8 aa, Mycobacterium
GQGAALSA

SEQ ID NO: 492994 - protein, 20 aa, Mycobacterium
GQGAASAGSGPTGGDPGAAV

SEQ ID NO: 492995 - protein, 14 aa, Mycobacterium
GQGAFGSFNGTTRK

SEQ ID NO: 492996 - protein, 25 aa, Mycobacterium
GQGAGGAGGDGGAGGGAGNGGDGAV

SEQ ID NO: 492997 - protein, 9 aa, Mycobacterium
GQGAGTPAI

SEQ ID NO: 492998 - protein, 14 aa, Mycobacterium
GQGAKGPQATGVTA

SEQ ID NO: 492999 - protein, 16 aa, Mycobacterium
GQGAKPGEGGQLPAPK

SEQ ID NO: 493000 - protein, 5 aa, Mycobacterium
GQGAP

SEQ ID NO: 493001 - protein, 7 aa, Mycobacterium
GQGAPVD

SEQ ID NO: 493002 - protein, 6 aa, Mycobacterium
GQGARE

SEQ ID NO: 493003 - protein, 5 aa, Mycobacterium
GQGAS

SEQ ID NO: 493004 - protein, 6 aa, Mycobacterium
GQGAYN

SEQ ID NO: 493005 - protein, 4 aa, Mycobacterium
GQGC

SEQ ID NO: 493006 - protein, 5 aa, Mycobacterium
GQGCT

SEQ ID NO: 493007 - protein, 5 aa, Mycobacterium
GQGDG

SEQ ID NO: 493008 - protein, 10 aa, Mycobacterium
GQGDRPSRTK

SEQ ID NO: 493009 - protein, 8 aa, Mycobacterium
GQGDRVEG

SEQ ID NO: 493010 - protein, 16 aa, Mycobacterium
GQGDSDKLDDTGPGSY

SEQ ID NO: 493011 - protein, 6 aa, Mycobacterium
GQGDVD

SEQ ID NO: 493012 - protein, 4 aa, Mycobacterium
GQGE

SEQ ID NO: 493013 - protein, 9 aa, Mycobacterium
GQGEAPKLI

SEQ ID NO: 493014 - protein, 12 aa, Mycobacterium
GQGEGTVPTDER

SEQ ID NO: 493015 - protein, 5 aa, Mycobacterium
GQGEH

SEQ ID NO: 493016 - protein, 8 aa, Mycobacterium
GQGEPGGS

SEQ ID NO: 493017 - protein, 7 aa, Mycobacterium
GQGERAR

SEQ ID NO: 493018 - protein, 7 aa, Mycobacterium
GQGERKT

SEQ ID NO: 493019 - protein, 5 aa, Mycobacterium
GQGGA

SEQ ID NO: 493020 - protein, 6 aa, Mycobacterium
GQGGAD

SEQ ID NO: 493021 - protein, 39 aa, Mycobacterium
GQGGAGGIGGAGGIGGTGSATQDGGIGGTGGHGGIGGSA

SEQ ID NO: 493022 - protein, 16 aa, Mycobacterium
GQGGAGGNGGQGGGDD

SEQ ID NO: 493023 - protein, 33 aa, Mycobacterium
GQGGAGGNGGQGGGENFASTAGAGGPAGTGGHG

SEQ ID NO: 493024 - protein, 5 aa, Mycobacterium
GQGGI

SEQ ID NO: 493025 - protein, 6 aa, Mycobacterium
GQGGIA

SEQ ID NO: 493026 - protein, 8 aa, Mycobacterium
GQGGKESI

SEQ ID NO: 493027 - protein, 13 aa, Mycobacterium
GQGGLEVACSAGM

SEQ ID NO: 493028 - protein, 8 aa, Mycobacterium
GQGGLKRN

SEQ ID NO: 493029 - protein, 8 aa, Mycobacterium
GQGGLQRN

SEQ ID NO: 493030 - protein, 9 aa, Mycobacterium
GQGGLSRNL

SEQ ID NO: 493031 - protein, 6 aa, Mycobacterium
GQGGMD

SEQ ID NO: 493032 - protein, 36 aa, Mycobacterium
GQGGMGGNGSSAVAVPSGAGLNGGAGGNGGPGGNGG

SEQ ID NO: 493033 - protein, 10 aa, Mycobacterium
GQGGPGAPSV

SEQ ID NO: 493034 - protein, 6 aa, Mycobacterium
GQGGPW

SEQ ID NO: 493035 - protein, 6 aa, Mycobacterium
GQGGTI

SEQ ID NO: 493036 - protein, 6 aa, Mycobacterium
GQGGVA

SEQ ID NO: 493037 - protein, 8 aa, Mycobacterium
GQGGVSAG

SEQ ID NO: 493038 - protein, 5 aa, Mycobacterium
GQGHT

SEQ ID NO: 493039 - protein, 7 aa, Mycobacterium
GQGHTMA

SEQ ID NO: 493040 - protein, 4 aa, Mycobacterium
GQGI

SEQ ID NO: 493041 - protein, 8 aa, Mycobacterium
GQGIQSKG

SEQ ID NO: 493042 - protein, 6 aa, Mycobacterium
GQGISP

SEQ ID NO: 493043 - protein, 8 aa, Mycobacterium
GQGKTDWA

SEQ ID NO: 493044 - protein, 5 aa, Mycobacterium
GQGLA

SEQ ID NO: 493045 - protein, 7 aa, Mycobacterium
GQGLAQA

SEQ ID NO: 493046 - protein, 9 aa, Mycobacterium
GQGLGGTDD

SEQ ID NO: 493047 - protein, 9 aa, Mycobacterium
GQGLPPAEP

SEQ ID NO: 493048 - protein, 8 aa, Mycobacterium
GQGLTNQE

SEQ ID NO: 493049 - protein, 7 aa, Mycobacterium
GQGNQWP

SEQ ID NO: 493050 - protein, 5 aa, Mycobacterium
GQGNV

SEQ ID NO: 493051 - protein, 4 aa, Mycobacterium
GQGP

SEQ ID NO: 493052 - protein, 8 aa, Mycobacterium
GQGPEAAA

SEQ ID NO: 493053 - protein, 5 aa, Mycobacterium
GQGPG

SEQ ID NO: 493054 - protein, 6 aa, Mycobacterium
GQGPNA

SEQ ID NO: 493055 - protein, 16 aa, Mycobacterium
GQGPQGPPTVPSLGSS

SEQ ID NO: 493056 - protein, 10 aa, Mycobacterium
GQGQPRPPVR

SEQ ID NO: 493057 - protein, 6 aa, Mycobacterium
GQGQYL

SEQ ID NO: 493058 - protein, 6 aa, Mycobacterium
GQGREG

SEQ ID NO: 493059 - protein, 5 aa, Mycobacterium
GQGRG

SEQ ID NO: 493060 - protein, 7 aa, Mycobacterium
GQGRGGV

SEQ ID NO: 493061 - protein, 227 aa, Mycobacterium
GQGRPDEYYNRPPENRPEDEGGYNRPENRGDEQRGGYPHGDQGGYPAQDQGYPPRGGYPEQGGYQDQGGYQGQGGYPPQSYEQRPPAGYGPPPGYPDQGYRQGPGGYGPPPGGAPGYGGPAGDYDYGRRPDDGGYGQPPRPAYPDQGGYPDQGGYGAPGGQQSYGRQDYAQPDYGRYGEPAGYGDQGYGEQGYGDQGYGDQGYGAPAGQQGGYGGYGAGQGDYPAGA

SEQ ID NO: 493062 - protein, 14 aa, Mycobacterium
GQGRSPELTHIEGV

SEQ ID NO: 493063 - protein, 8 aa, Mycobacterium
GQGSALSA

SEQ ID NO: 493064 - protein, 11 aa, Mycobacterium
GQGSALSSGAH

SEQ ID NO: 493065 - protein, 7 aa, Mycobacterium
GQGSGGS

SEQ ID NO: 493066 - protein, 14 aa, Mycobacterium
GQGSHLGTGGMASK

SEQ ID NO: 493067 - protein, 7 aa, Mycobacterium
GQGSQRL

SEQ ID NO: 493068 - protein, 7 aa, Mycobacterium
GQGSQWA

SEQ ID NO: 493069 - protein, 8 aa, Mycobacterium
GQGSQWAG

SEQ ID NO: 493070 - protein, 8 aa, Mycobacterium
GQGSQWPG

SEQ ID NO: 493071 - protein, 7 aa, Mycobacterium
GQGSQYR

SEQ ID NO: 493072 - protein, 6 aa, Mycobacterium
GQGTAE

SEQ ID NO: 493073 - protein, 5 aa, Mycobacterium
GQGTG

SEQ ID NO: 493074 - protein, 10 aa, Mycobacterium
GQGTPGAPKV

SEQ ID NO: 493075 - protein, 5 aa, Mycobacterium
GQGTT

SEQ ID NO: 493076 - protein, 9 aa, Mycobacterium
GQGVADGTV

SEQ ID NO: 493077 - protein, 8 aa, Mycobacterium
GQGVDADA

SEQ ID NO: 493078 - protein, 7 aa, Mycobacterium
GQGVGRG

SEQ ID NO: 493079 - protein, 7 aa, Mycobacterium
GQGVPAP

SEQ ID NO: 493080 - protein, 15 aa, Mycobacterium
GQGVRANTVSPGNTY

SEQ ID NO: 493081 - protein, 8 aa, Mycobacterium
GQGVSESE

SEQ ID NO: 493082 - protein, 4 aa, Mycobacterium
GQHA

SEQ ID NO: 493083 - protein, 11 aa, Mycobacterium
GQHADNPANRV

SEQ ID NO: 493084 - protein, 7 aa, Mycobacterium
GQHAQAG

SEQ ID NO: 493085 - protein, 9 aa, Mycobacterium
GQHASPGDR

SEQ ID NO: 493086 - protein, 10 aa, Mycobacterium
GQHDEQRRAV

SEQ ID NO: 493087 - protein, 4 aa, Mycobacterium
GQHF

SEQ ID NO: 493088 - protein, 7 aa, Mycobacterium
GQHGADP

SEQ ID NO: 493089 - protein, 5 aa, Mycobacterium
GQHGD

SEQ ID NO: 493090 - protein, 10 aa, Mycobacterium
GQHGDLASSA

SEQ ID NO: 493091 - protein, 5 aa, Mycobacterium
GQHGE

SEQ ID NO: 493092 - protein, 26 aa, Mycobacterium
GQHGGGAGGAGGNAGMVGNGGDGGTA

SEQ ID NO: 493093 - protein, 6 aa, Mycobacterium
GQHGPD

SEQ ID NO: 493094 - protein, 8 aa, Mycobacterium
GQHGQDTR

SEQ ID NO: 493095 - protein, 5 aa, Mycobacterium
GQHGR

SEQ ID NO: 493096 - protein, 8 aa, Mycobacterium
GQHGTTTS

SEQ ID NO: 493097 - protein, 8 aa, Mycobacterium
GQHHTDPV

SEQ ID NO: 493098 - protein, 10 aa, Mycobacterium
GQHPAEDPYE

SEQ ID NO: 493099 - protein, 83 aa, Mycobacterium
GQHPGGGEPQHGGDQSPQSPEPPSAGDLSPPDDLGAGGGGGDTEPAGGESPMAAPPEVAAPAAAAPASAPSAPAAAEAPAPAM

SEQ ID NO: 493100 - protein, 5 aa, Mycobacterium
GQHPR

SEQ ID NO: 493101 - protein, 10 aa, Mycobacterium
GQHPTDAATL

SEQ ID NO: 493102 - protein, 7 aa, Mycobacterium
GQHQPDR

SEQ ID NO: 493103 - protein, 8 aa, Mycobacterium
GQHQPDRV

SEQ ID NO: 493104 - protein, 6 aa, Mycobacterium
GQHRRA

SEQ ID NO: 493105 - protein, 9 aa, Mycobacterium
GQHRTNTYH

SEQ ID NO: 493106 - protein, 6 aa, Mycobacterium
GQHTDG

SEQ ID NO: 493107 - protein, 13 aa, Mycobacterium
GQHTITKEQTGTR

SEQ ID NO: 493108 - protein, 7 aa, Mycobacterium
GQIAERA

SEQ ID NO: 493109 - protein, 4 aa, Mycobacterium
GQID

SEQ ID NO: 493110 - protein, 6 aa, Mycobacterium
GQIEAG

SEQ ID NO: 493111 - protein, 5 aa, Mycobacterium
GQIER

SEQ ID NO: 493112 - protein, 4 aa, Mycobacterium
GQIG

SEQ ID NO: 493113 - protein, 10 aa, Mycobacterium
GQIGDGREAA

SEQ ID NO: 493114 - protein, 7 aa, Mycobacterium
GQIGNGD

SEQ ID NO: 493115 - protein, 7 aa, Mycobacterium
GQIGRGD

SEQ ID NO: 493116 - protein, 4 aa, Mycobacterium
GQIN

SEQ ID NO: 493117 - protein, 7 aa, Mycobacterium
GQINSQI

SEQ ID NO: 493118 - protein, 7 aa, Mycobacterium
GQIPDEM

SEQ ID NO: 493119 - protein, 8 aa, Mycobacterium
GQIPNQGI

SEQ ID NO: 493120 - protein, 6 aa, Mycobacterium
GQISGE

SEQ ID NO: 493121 - protein, 4 aa, Mycobacterium
GQIT

SEQ ID NO: 493122 - protein, 8 aa, Mycobacterium
GQKAPELA

SEQ ID NO: 493123 - protein, 10 aa, Mycobacterium
GQKASELAAR

SEQ ID NO: 493124 - protein, 9 aa, Mycobacterium
GQKATSRHI

SEQ ID NO: 493125 - protein, 8 aa, Mycobacterium
GQKCSAAS

SEQ ID NO: 493126 - protein, 11 aa, Mycobacterium
GQKDDPELSYP

SEQ ID NO: 493127 - protein, 8 aa, Mycobacterium
GQKGKDAV

SEQ ID NO: 493128 - protein, 12 aa, Mycobacterium
GQKNGPGSPPPH

SEQ ID NO: 493129 - protein, 12 aa, Mycobacterium
GQKNVKAAGYGL

SEQ ID NO: 493130 - protein, 10 aa, Mycobacterium
GQKPEIRKAR

SEQ ID NO: 493131 - protein, 10 aa, Mycobacterium
GQKPEVRRAR

SEQ ID NO: 493132 - protein, 6 aa, Mycobacterium
GQKSGV

SEQ ID NO: 493133 - protein, 7 aa, Mycobacterium
GQKSGVT

SEQ ID NO: 493134 - protein, 15 aa, Mycobacterium
GQKSRGRHLSWVALI

SEQ ID NO: 493135 - protein, 8 aa, Mycobacterium
GQKTDLGD

SEQ ID NO: 493136 - protein, 16 aa, Mycobacterium
GQKTRRREKKNVPHGA

SEQ ID NO: 493137 - protein, 7 aa, Mycobacterium
GQKVASA

SEQ ID NO: 493138 - protein, 17 aa, Mycobacterium
GQKVASAKLGLPEGSKP

SEQ ID NO: 493139 - protein, 9 aa, Mycobacterium
GQLAGPDYG

SEQ ID NO: 493140 - protein, 7 aa, Mycobacterium
GQLAGQG

SEQ ID NO: 493141 - protein, 8 aa, Mycobacterium
GQLAPNLP

SEQ ID NO: 493142 - protein, 7 aa, Mycobacterium
GQLASIS

SEQ ID NO: 493143 - protein, 12 aa, Mycobacterium
GQLATTEILQPN

SEQ ID NO: 493144 - protein, 8 aa, Mycobacterium
GQLDPEYN

SEQ ID NO: 493145 - protein, 5 aa, Mycobacterium
GQLEA

SEQ ID NO: 493146 - protein, 7 aa, Mycobacterium
GQLEDRG

SEQ ID NO: 493147 - protein, 5 aa, Mycobacterium
GQLGA

SEQ ID NO: 493148 - protein, 9 aa, Mycobacterium
GQLGAAGRI

SEQ ID NO: 493149 - protein, 5 aa, Mycobacterium
GQLGG

SEQ ID NO: 493150 - protein, 13 aa, Mycobacterium
GQLGKKSGKGFYS

SEQ ID NO: 493151 - protein, 7 aa, Mycobacterium
GQLPAGV

SEQ ID NO: 493152 - protein, 7 aa, Mycobacterium
GQLPDGG

SEQ ID NO: 493153 - protein, 8 aa, Mycobacterium
GQLPDGQR

SEQ ID NO: 493154 - protein, 7 aa, Mycobacterium
GQLPGAE

SEQ ID NO: 493155 - protein, 7 aa, Mycobacterium
GQLPGDH

SEQ ID NO: 493156 - protein, 14 aa, Mycobacterium
GQLPKTGSVIGSNA

SEQ ID NO: 493157 - protein, 19 aa, Mycobacterium
GQLPPEALETDDTVNPTVS

SEQ ID NO: 493158 - protein, 8 aa, Mycobacterium
GQLPPGVS

SEQ ID NO: 493159 - protein, 7 aa, Mycobacterium
GQLPRTG

SEQ ID NO: 493160 - protein, 9 aa, Mycobacterium
GQLPRTGSV

SEQ ID NO: 493161 - protein, 17 aa, Mycobacterium
GQLPSAAADVAAAGTEL

SEQ ID NO: 493162 - protein, 10 aa, Mycobacterium
GQLPSASADV

SEQ ID NO: 493163 - protein, 9 aa, Mycobacterium
GQLPSAVDE

SEQ ID NO: 493164 - protein, 13 aa, Mycobacterium
GQLQPGDHLPSER

SEQ ID NO: 493165 - protein, 6 aa, Mycobacterium
GQLRAG

SEQ ID NO: 493166 - protein, 6 aa, Mycobacterium
GQLRSG

SEQ ID NO: 493167 - protein, 6 aa, Mycobacterium
GQLRSP

SEQ ID NO: 493168 - protein, 4 aa, Mycobacterium
GQLS

SEQ ID NO: 493169 - protein, 10 aa, Mycobacterium
GQLSAAKGRL

SEQ ID NO: 493170 - protein, 5 aa, Mycobacterium
GQLSE

SEQ ID NO: 493171 - protein, 16 aa, Mycobacterium
GQLSGAGGLGDAVGRS

SEQ ID NO: 493172 - protein, 7 aa, Mycobacterium
GQLSGGE

SEQ ID NO: 493173 - protein, 23 aa, Mycobacterium
GQLSGSSKRSLGPVARASPQEPS

SEQ ID NO: 493174 - protein, 6 aa, Mycobacterium
GQLSLT

SEQ ID NO: 493175 - protein, 16 aa, Mycobacterium
GQLSSPEGLGDAVGRS

SEQ ID NO: 493176 - protein, 6 aa, Mycobacterium
GQLSTA

SEQ ID NO: 493177 - protein, 11 aa, Mycobacterium
GQLTDDPGTGK

SEQ ID NO: 493178 - protein, 7 aa, Mycobacterium
GQLTEVQ

SEQ ID NO: 493179 - protein, 7 aa, Mycobacterium
GQLTPEA

SEQ ID NO: 493180 - protein, 6 aa, Mycobacterium
GQLTTA

SEQ ID NO: 493181 - protein, 8 aa, Mycobacterium
GQLVGEDP

SEQ ID NO: 493182 - protein, 8 aa, Mycobacterium
GQMAPADG

SEQ ID NO: 493183 - protein, 12 aa, Mycobacterium
GQMDTARTEPGT

SEQ ID NO: 493184 - protein, 11 aa, Mycobacterium
GQMGDGRESAC

SEQ ID NO: 493185 - protein, 7 aa, Mycobacterium
GQMGSGI

SEQ ID NO: 493186 - protein, 16 aa, Mycobacterium
GQNAGQPPDNVGPRAE

SEQ ID NO: 493187 - protein, 5 aa, Mycobacterium
GQNAH

SEQ ID NO: 493188 - protein, 6 aa, Mycobacterium
GQNDPA

SEQ ID NO: 493189 - protein, 6 aa, Mycobacterium
GQNEGA

SEQ ID NO: 493190 - protein, 14 aa, Mycobacterium
GQNGPAIAATEARY

SEQ ID NO: 493191 - protein, 9 aa, Mycobacterium
GQNGQGAAA

SEQ ID NO: 493192 - protein, 19 aa, Mycobacterium
GQNGQSAAAYLSGPKAITG

SEQ ID NO: 493193 - protein, 32 aa, Mycobacterium
GQNGSGGAAGGAPSGITGGSGGNGGRGGFGGG

SEQ ID NO: 493194 - protein, 5 aa, Mycobacterium
GQNLS

SEQ ID NO: 493195 - protein, 5 aa, Mycobacterium
GQNLY

SEQ ID NO: 493196 - protein, 9 aa, Mycobacterium
GQNNPQLTE

SEQ ID NO: 493197 - protein, 8 aa, Mycobacterium
GQNPTTAL

SEQ ID NO: 493198 - protein, 8 aa, Mycobacterium
GQNQREAR

SEQ ID NO: 493199 - protein, 5 aa, Mycobacterium
GQNRF

SEQ ID NO: 493200 - protein, 6 aa, Mycobacterium
GQNRPR

SEQ ID NO: 493201 - protein, 6 aa, Mycobacterium
GQNSAA

SEQ ID NO: 493202 - protein, 14 aa, Mycobacterium
GQNSPAIAAAETEY

SEQ ID NO: 493203 - protein, 14 aa, Mycobacterium
GQNSPAIAATEAQY

SEQ ID NO: 493204 - protein, 11 aa, Mycobacterium
GQNSSASAAGL

SEQ ID NO: 493205 - protein, 4 aa, Mycobacterium
GQNT

SEQ ID NO: 493206 - protein, 5 aa, Mycobacterium
GQNTA

SEQ ID NO: 493207 - protein, 5 aa, Mycobacterium
GQNTP

SEQ ID NO: 493208 - protein, 6 aa, Mycobacterium
GQNTPA

SEQ ID NO: 493209 - protein, 8 aa, Mycobacterium
GQNTPAIT

SEQ ID NO: 493210 - protein, 13 aa, Mycobacterium
GQPAAAGAQSLSA

SEQ ID NO: 493211 - protein, 12 aa, Mycobacterium
GQPAAPVTRESA

SEQ ID NO: 493212 - protein, 6 aa, Mycobacterium
GQPAAV

SEQ ID NO: 493213 - protein, 26 aa, Mycobacterium
GQPADTSVETAQRPAGTPPPRYPELS

SEQ ID NO: 493214 - protein, 5 aa, Mycobacterium
GQPAF

SEQ ID NO: 493215 - protein, 9 aa, Mycobacterium
GQPAGEAAN

SEQ ID NO: 493216 - protein, 7 aa, Mycobacterium
GQPAGEF

SEQ ID NO: 493217 - protein, 9 aa, Mycobacterium
GQPAGESGY

SEQ ID NO: 493218 - protein, 6 aa, Mycobacterium
GQPAGS

SEQ ID NO: 493219 - protein, 13 aa, Mycobacterium
GQPALNAYSGAFT

SEQ ID NO: 493220 - protein, 5 aa, Mycobacterium
GQPAM

SEQ ID NO: 493221 - protein, 10 aa, Mycobacterium
GQPAPPSPEL

SEQ ID NO: 493222 - protein, 8 aa, Mycobacterium
GQPAPPVP

SEQ ID NO: 493223 - protein, 8 aa, Mycobacterium
GQPAPSRA

SEQ ID NO: 493224 - protein, 6 aa, Mycobacterium
GQPARE

SEQ ID NO: 493225 - protein, 38 aa, Mycobacterium
GQPASGGGTGTGGGTGTGGGTSTGTGTGTGTSTGGATV

SEQ ID NO: 493226 - protein, 6 aa, Mycobacterium
GQPASS

SEQ ID NO: 493227 - protein, 6 aa, Mycobacterium
GQPAST

SEQ ID NO: 493228 - protein, 5 aa, Mycobacterium
GQPAT

SEQ ID NO: 493229 - protein, 7 aa, Mycobacterium
GQPATLG

SEQ ID NO: 493230 - protein, 6 aa, Mycobacterium
GQPATS

SEQ ID NO: 493231 - protein, 20 aa, Mycobacterium
GQPAWSGKPEVAAAAEARAV

SEQ ID NO: 493232 - protein, 4 aa, Mycobacterium
GQPC

SEQ ID NO: 493233 - protein, 4 aa, Mycobacterium
GQPD

SEQ ID NO: 493234 - protein, 20 aa, Mycobacterium
GQPDASAREENRGEPVGPSG

SEQ ID NO: 493235 - protein, 7 aa, Mycobacterium
GQPDEEL

SEQ ID NO: 493236 - protein, 16 aa, Mycobacterium
GQPDERALGKAAGQAD

SEQ ID NO: 493237 - protein, 16 aa, Mycobacterium
GQPDERALGKAASQAE

SEQ ID NO: 493238 - protein, 21 aa, Mycobacterium
GQPDGTTEGRAAGGRGPARGM

SEQ ID NO: 493239 - protein, 5 aa, Mycobacterium
GQPDL

SEQ ID NO: 493240 - protein, 16 aa, Mycobacterium
GQPDPESVEPNAGVEC

SEQ ID NO: 493241 - protein, 7 aa, Mycobacterium
GQPDTAS

SEQ ID NO: 493242 - protein, 10 aa, Mycobacterium
GQPDTPIDDE

SEQ ID NO: 493243 - protein, 6 aa, Mycobacterium
GQPDWA

SEQ ID NO: 493244 - protein, 8 aa, Mycobacterium
GQPEATAT

SEQ ID NO: 493245 - protein, 6 aa, Mycobacterium
GQPEFS

SEQ ID NO: 493246 - protein, 6 aa, Mycobacterium
GQPELT

SEQ ID NO: 493247 - protein, 15 aa, Mycobacterium
GQPEYHDKDGIPRDN

SEQ ID NO: 493248 - protein, 6 aa, Mycobacterium
GQPFGK

SEQ ID NO: 493249 - protein, 7 aa, Mycobacterium
GQPGADE

SEQ ID NO: 493250 - protein, 8 aa, Mycobacterium
GQPGADQQ

SEQ ID NO: 493251 - protein, 6 aa, Mycobacterium
GQPGDG

SEQ ID NO: 493252 - protein, 11 aa, Mycobacterium
GQPGDSGAPVT

SEQ ID NO: 493253 - protein, 17 aa, Mycobacterium
GQPGEEGPVGAGGGQAL

SEQ ID NO: 493254 - protein, 6 aa, Mycobacterium
GQPGHE

SEQ ID NO: 493255 - protein, 12 aa, Mycobacterium
GQPGHPAPGPLP

SEQ ID NO: 493256 - protein, 6 aa, Mycobacterium
GQPGLD

SEQ ID NO: 493257 - protein, 11 aa, Mycobacterium
GQPGPNASAEE

SEQ ID NO: 493258 - protein, 16 aa, Mycobacterium
GQPGQRPAWAPEESRP

SEQ ID NO: 493259 - protein, 9 aa, Mycobacterium
GQPGRTQAD

SEQ ID NO: 493260 - protein, 5 aa, Mycobacterium
GQPGV

SEQ ID NO: 493261 - protein, 5 aa, Mycobacterium
GQPHG

SEQ ID NO: 493262 - protein, 31 aa, Mycobacterium
GQPHGEQPAVGDGAAGGDGEPLRARTRGQRA

SEQ ID NO: 493263 - protein, 17 aa, Mycobacterium
GQPHPFPSLPHRLRQVD

SEQ ID NO: 493264 - protein, 15 aa, Mycobacterium
GQPIDGQGDIAAETR

SEQ ID NO: 493265 - protein, 16 aa, Mycobacterium
GQPIDGQGDIESDTRR

SEQ ID NO: 493266 - protein, 13 aa, Mycobacterium
GQPIDGQGDIETD

SEQ ID NO: 493267 - protein, 15 aa, Mycobacterium
GQPIDGRGDIDAETR

SEQ ID NO: 493268 - protein, 5 aa, Mycobacterium
GQPIS

SEQ ID NO: 493269 - protein, 7 aa, Mycobacterium
GQPISPA

SEQ ID NO: 493270 - protein, 6 aa, Mycobacterium
GQPISS

SEQ ID NO: 493271 - protein, 18 aa, Mycobacterium
GQPKNVERYTGTEFDGSP

SEQ ID NO: 493272 - protein, 4 aa, Mycobacterium
GQPL

SEQ ID NO: 493273 - protein, 5 aa, Mycobacterium
GQPLA

SEQ ID NO: 493274 - protein, 10 aa, Mycobacterium
GQPLAAPGSY

SEQ ID NO: 493275 - protein, 9 aa, Mycobacterium
GQPLDDERN

SEQ ID NO: 493276 - protein, 9 aa, Mycobacterium
GQPLGGTND

SEQ ID NO: 493277 - protein, 7 aa, Mycobacterium
GQPLPDL

SEQ ID NO: 493278 - protein, 6 aa, Mycobacterium
GQPLPP

SEQ ID NO: 493279 - protein, 36 aa, Mycobacterium
GQPLPPPRRRHTGSTLSSGTLGRPQHRRPRLGRRSA

SEQ ID NO: 493280 - protein, 6 aa, Mycobacterium
GQPLPS

SEQ ID NO: 493281 - protein, 7 aa, Mycobacterium
GQPLPTQ

SEQ ID NO: 493282 - protein, 7 aa, Mycobacterium
GQPLSGL

SEQ ID NO: 493283 - protein, 7 aa, Mycobacterium
GQPLSRP

SEQ ID NO: 493284 - protein, 6 aa, Mycobacterium
GQPLSS

SEQ ID NO: 493285 - protein, 5 aa, Mycobacterium
GQPLT

SEQ ID NO: 493286 - protein, 5 aa, Mycobacterium
GQPMD

SEQ ID NO: 493287 - protein, 5 aa, Mycobacterium
GQPMP

SEQ ID NO: 493288 - protein, 7 aa, Mycobacterium
GQPNGAA

SEQ ID NO: 493289 - protein, 8 aa, Mycobacterium
GQPNGASS

SEQ ID NO: 493290 - protein, 6 aa, Mycobacterium
GQPNHD

SEQ ID NO: 493291 - protein, 7 aa, Mycobacterium
GQPPAGG

SEQ ID NO: 493292 - protein, 8 aa, Mycobacterium
GQPPEGTG

SEQ ID NO: 493293 - protein, 10 aa, Mycobacterium
GQPPGPTSSI

SEQ ID NO: 493294 - protein, 5 aa, Mycobacterium
GQPPH

SEQ ID NO: 493295 - protein, 9 aa, Mycobacterium
GQPPLEPAG

SEQ ID NO: 493296 - protein, 10 aa, Mycobacterium
GQPPLESRGP

SEQ ID NO: 493297 - protein, 26 aa, Mycobacterium
GQPPLGVETDGDVTERRELLRAIGYK

SEQ ID NO: 493298 - protein, 9 aa, Mycobacterium
GQPPLTADG

SEQ ID NO: 493299 - protein, 13 aa, Mycobacterium
GQPPVGNRLNPRG

SEQ ID NO: 493300 - protein, 35 aa, Mycobacterium
GQPQADPSGRGATPLNTDGQNIPLDPSPDYDASDE

SEQ ID NO: 493301 - protein, 6 aa, Mycobacterium
GQPQPE

SEQ ID NO: 493302 - protein, 8 aa, Mycobacterium
GQPRPGQT

SEQ ID NO: 493303 - protein, 18 aa, Mycobacterium
GQPRPTRAPALSHDEPAV

SEQ ID NO: 493304 - protein, 8 aa, Mycobacterium
GQPRTGAS

SEQ ID NO: 493305 - protein, 8 aa, Mycobacterium
GQPSGATV

SEQ ID NO: 493306 - protein, 10 aa, Mycobacterium
GQPSGPASSI

SEQ ID NO: 493307 - protein, 6 aa, Mycobacterium
GQPSHQ

SEQ ID NO: 493308 - protein, 5 aa, Mycobacterium
GQPSI

SEQ ID NO: 493309 - protein, 6 aa, Mycobacterium
GQPSKT

SEQ ID NO: 493310 - protein, 9 aa, Mycobacterium
GQPSLAADG

SEQ ID NO: 493311 - protein, 6 aa, Mycobacterium
GQPSRT

SEQ ID NO: 493312 - protein, 12 aa, Mycobacterium
GQPSTPRGETTM

SEQ ID NO: 493313 - protein, 6 aa, Mycobacterium
GQPSVT

SEQ ID NO: 493314 - protein, 19 aa, Mycobacterium
GQPTAENTRECGADGDLPG

SEQ ID NO: 493315 - protein, 6 aa, Mycobacterium
GQPTDD

SEQ ID NO: 493316 - protein, 18 aa, Mycobacterium
GQPTGGTGKPSVAPDPVN

SEQ ID NO: 493317 - protein, 8 aa, Mycobacterium
GQPTHRPQ

SEQ ID NO: 493318 - protein, 7 aa, Mycobacterium
GQPTMTV

SEQ ID NO: 493319 - protein, 12 aa, Mycobacterium
GQPTWSGKPEVA

SEQ ID NO: 493320 - protein, 17 aa, Mycobacterium
GQPVATRGFEEREGPLR

SEQ ID NO: 493321 - protein, 12 aa, Mycobacterium
GQPVDDPDIPAK

SEQ ID NO: 493322 - protein, 13 aa, Mycobacterium
GQPVDDPDIPSKL

SEQ ID NO: 493323 - protein, 12 aa, Mycobacterium
GQPVDDPEIPGK

SEQ ID NO: 493324 - protein, 10 aa, Mycobacterium
GQPVERAGGT

SEQ ID NO: 493325 - protein, 5 aa, Mycobacterium
GQPVG

SEQ ID NO: 493326 - protein, 10 aa, Mycobacterium
GQPVNLPDTT

SEQ ID NO: 493327 - protein, 8 aa, Mycobacterium
GQPVPSTY

SEQ ID NO: 493328 - protein, 11 aa, Mycobacterium
GQPVSRDPADP

SEQ ID NO: 493329 - protein, 10 aa, Mycobacterium
GQPVTAATDQ

SEQ ID NO: 493330 - protein, 7 aa, Mycobacterium
GQPWQKD

SEQ ID NO: 493331 - protein, 15 aa, Mycobacterium
GQPWQKDRDVSAAED

SEQ ID NO: 493332 - protein, 15 aa, Mycobacterium
GQPWQKGGDVSAAED

SEQ ID NO: 493333 - protein, 15 aa, Mycobacterium
GQPWQKGRRVSPAED

SEQ ID NO: 493334 - protein, 15 aa, Mycobacterium
GQPWQKQGRKVSPAE

SEQ ID NO: 493335 - protein, 15 aa, Mycobacterium
GQPWQKRSRPVTPAE

SEQ ID NO: 493336 - protein, 4 aa, Mycobacterium
GQPY

SEQ ID NO: 493337 - protein, 5 aa, Mycobacterium
GQPYP

SEQ ID NO: 493338 - protein, 6 aa, Mycobacterium
GQPYPE

SEQ ID NO: 493339 - protein, 9 aa, Mycobacterium
GQPYPEGLD

SEQ ID NO: 493340 - protein, 6 aa, Mycobacterium
GQPYTA

SEQ ID NO: 493341 - protein, 6 aa, Mycobacterium
GQQAAD

SEQ ID NO: 493342 - protein, 16 aa, Mycobacterium
GQQAAQHGNTQRAAEL

SEQ ID NO: 493343 - protein, 17 aa, Mycobacterium
GQQAHRPAERRPAGEAV

SEQ ID NO: 493344 - protein, 7 aa, Mycobacterium
GQQARRD

SEQ ID NO: 493345 - protein, 5 aa, Mycobacterium
GQQAT

SEQ ID NO: 493346 - protein, 9 aa, Mycobacterium
GQQDNPAKG

SEQ ID NO: 493347 - protein, 9 aa, Mycobacterium
GQQDPRARV

SEQ ID NO: 493348 - protein, 6 aa, Mycobacterium
GQQDPV

SEQ ID NO: 493349 - protein, 10 aa, Mycobacterium
GQQDSPPAWQ

SEQ ID NO: 493350 - protein, 9 aa, Mycobacterium
GQQDTDGDY

SEQ ID NO: 493351 - protein, 14 aa, Mycobacterium
GQQEYRVTETTQEI

SEQ ID NO: 493352 - protein, 9 aa, Mycobacterium
GQQGTVADA

SEQ ID NO: 493353 - protein, 9 aa, Mycobacterium
GQQLTPSTV

SEQ ID NO: 493354 - protein, 10 aa, Mycobacterium
GQQPDGDPLA

SEQ ID NO: 493355 - protein, 9 aa, Mycobacterium
GQQPIPAPL

SEQ ID NO: 493356 - protein, 9 aa, Mycobacterium
GQQPQQGSL

SEQ ID NO: 493357 - protein, 7 aa, Mycobacterium
GQQPRHE

SEQ ID NO: 493358 - protein, 8 aa, Mycobacterium
GQQPTPAD

SEQ ID NO: 493359 - protein, 8 aa, Mycobacterium
GQQQAQNI

SEQ ID NO: 493360 - protein, 14 aa, Mycobacterium
GQQQPDSGRVTRRS

SEQ ID NO: 493361 - protein, 5 aa, Mycobacterium
GQQQR

SEQ ID NO: 493362 - protein, 11 aa, Mycobacterium
GQQRATQRHES

SEQ ID NO: 493363 - protein, 13 aa, Mycobacterium
GQQRGTQRPDGHH

SEQ ID NO: 493364 - protein, 9 aa, Mycobacterium
GQQRPQPGV

SEQ ID NO: 493365 - protein, 4 aa, Mycobacterium
GQQS

SEQ ID NO: 493366 - protein, 8 aa, Mycobacterium
GQQSADKA

SEQ ID NO: 493367 - protein, 6 aa, Mycobacterium
GQQSGV

SEQ ID NO: 493368 - protein, 17 aa, Mycobacterium
GQQTASEPAPAPSPAQV

SEQ ID NO: 493369 - protein, 10 aa, Mycobacterium
GQQTGVPTGA

SEQ ID NO: 493370 - protein, 5 aa, Mycobacterium
GQQTL

SEQ ID NO: 493371 - protein, 6 aa, Mycobacterium
GQQTRE

SEQ ID NO: 493372 - protein, 5 aa, Mycobacterium
GQRAA

SEQ ID NO: 493373 - protein, 21 aa, Mycobacterium
GQRAERDAGGADELEAGGPSF

SEQ ID NO: 493374 - protein, 5 aa, Mycobacterium
GQRAL

SEQ ID NO: 493375 - protein, 5 aa, Mycobacterium
GQRAM

SEQ ID NO: 493376 - protein, 9 aa, Mycobacterium
GQRASELAA

SEQ ID NO: 493377 - protein, 11 aa, Mycobacterium
GQRATASGSVH

SEQ ID NO: 493378 - protein, 14 aa, Mycobacterium
GQRAVGAETVLAEL

SEQ ID NO: 493379 - protein, 4 aa, Mycobacterium
GQRC

SEQ ID NO: 493380 - protein, 4 aa, Mycobacterium
GQRD

SEQ ID NO: 493381 - protein, 5 aa, Mycobacterium
GQRDD

SEQ ID NO: 493382 - protein, 7 aa, Mycobacterium
GQRDDYR

SEQ ID NO: 493383 - protein, 7 aa, Mycobacterium
GQRDEDG

SEQ ID NO: 493384 - protein, 7 aa, Mycobacterium
GQRDGAR

SEQ ID NO: 493385 - protein, 13 aa, Mycobacterium
GQRDSTTQQTSEV

SEQ ID NO: 493386 - protein, 9 aa, Mycobacterium
GQREQERHR

SEQ ID NO: 493387 - protein, 8 aa, Mycobacterium
GQRERGPT

SEQ ID NO: 493388 - protein, 7 aa, Mycobacterium
GQRGAER

SEQ ID NO: 493389 - protein, 8 aa, Mycobacterium
GQRGAERV

SEQ ID NO: 493390 - protein, 10 aa, Mycobacterium
GQRGAPTRQQ

SEQ ID NO: 493391 - protein, 12 aa, Mycobacterium
GQRGASAPRPAR

SEQ ID NO: 493392 - protein, 14 aa, Mycobacterium
GQRGEPIVGPDRPG

SEQ ID NO: 493393 - protein, 8 aa, Mycobacterium
GQRGGERH

SEQ ID NO: 493394 - protein, 7 aa, Mycobacterium
GQRGMPV

SEQ ID NO: 493395 - protein, 20 aa, Mycobacterium
GQRGPDGRGPGGGNTGDQDG

SEQ ID NO: 493396 - protein, 9 aa, Mycobacterium
GQRGPLPPP

SEQ ID NO: 493397 - protein, 18 aa, Mycobacterium
GQRGTPPKSAAQSARERD

SEQ ID NO: 493398 - protein, 7 aa, Mycobacterium
GQRGTTP

SEQ ID NO: 493399 - protein, 4 aa, Mycobacterium
GQRH

SEQ ID NO: 493400 - protein, 11 aa, Mycobacterium
GQRHTGSGTTV

SEQ ID NO: 493401 - protein, 4 aa, Mycobacterium
GQRI

SEQ ID NO: 493402 - protein, 13 aa, Mycobacterium
GQRISEQTQEAVR

SEQ ID NO: 493403 - protein, 13 aa, Mycobacterium
GQRITRAKNKIRR

SEQ ID NO: 493404 - protein, 7 aa, Mycobacterium
GQRKPLA

SEQ ID NO: 493405 - protein, 9 aa, Mycobacterium
GQRKPLASC

SEQ ID NO: 493406 - protein, 7 aa, Mycobacterium
GQRKPMA

SEQ ID NO: 493407 - protein, 8 aa, Mycobacterium
GQRKPMAS

SEQ ID NO: 493408 - protein, 9 aa, Mycobacterium
GQRLEGADT

SEQ ID NO: 493409 - protein, 9 aa, Mycobacterium
GQRLERDDT

SEQ ID NO: 493410 - protein, 11 aa, Mycobacterium
GQRLQGAPINP

SEQ ID NO: 493411 - protein, 6 aa, Mycobacterium
GQRLTP

SEQ ID NO: 493412 - protein, 6 aa, Mycobacterium
GQRNAI

SEQ ID NO: 493413 - protein, 6 aa, Mycobacterium
GQRNKY

SEQ ID NO: 493414 - protein, 7 aa, Mycobacterium
GQRNKYE

SEQ ID NO: 493415 - protein, 14 aa, Mycobacterium
GQRNKYEVDHETGR

SEQ ID NO: 493416 - protein, 6 aa, Mycobacterium
GQRNRV

SEQ ID NO: 493417 - protein, 4 aa, Mycobacterium
GQRP

SEQ ID NO: 493418 - protein, 9 aa, Mycobacterium
GQRPEIRRA

SEQ ID NO: 493419 - protein, 14 aa, Mycobacterium
GQRPLTEADPPGVP

SEQ ID NO: 493420 - protein, 14 aa, Mycobacterium
GQRPLTEFDPPGVP

SEQ ID NO: 493421 - protein, 13 aa, Mycobacterium
GQRPRAAGEPRID

SEQ ID NO: 493422 - protein, 9 aa, Mycobacterium
GQRPRPGSL

SEQ ID NO: 493423 - protein, 6 aa, Mycobacterium
GQRPRT

SEQ ID NO: 493424 - protein, 7 aa, Mycobacterium
GQRPTAY

SEQ ID NO: 493425 - protein, 5 aa, Mycobacterium
GQRPV

SEQ ID NO: 493426 - protein, 6 aa, Mycobacterium
GQRPVE

SEQ ID NO: 493427 - protein, 12 aa, Mycobacterium
GQRQNRPVTPWS

SEQ ID NO: 493428 - protein, 12 aa, Mycobacterium
GQRRIDARGDEV

SEQ ID NO: 493429 - protein, 6 aa, Mycobacterium
GQRRQL

SEQ ID NO: 493430 - protein, 20 aa, Mycobacterium
GQRRSWSGPGPDARDPQPLG

SEQ ID NO: 493431 - protein, 10 aa, Mycobacterium
GQRRTGTGTT

SEQ ID NO: 493432 - protein, 8 aa, Mycobacterium
GQRRYNPG

SEQ ID NO: 493433 - protein, 5 aa, Mycobacterium
GQRSA

SEQ ID NO: 493434 - protein, 7 aa, Mycobacterium
GQRSASP

SEQ ID NO: 493435 - protein, 9 aa, Mycobacterium
GQRSDGGTS

SEQ ID NO: 493436 - protein, 10 aa, Mycobacterium
GQRSDGGTSR

SEQ ID NO: 493437 - protein, 8 aa, Mycobacterium
GQRSEAHR

SEQ ID NO: 493438 - protein, 10 aa, Mycobacterium
GQRSPTDQGA

SEQ ID NO: 493439 - protein, 6 aa, Mycobacterium
GQRSRA

SEQ ID NO: 493440 - protein, 34 aa, Mycobacterium
GQRTARAPQPPLADAEDPAENLKTEENEAEWGFT

SEQ ID NO: 493441 - protein, 9 aa, Mycobacterium
GQRTGRAHG

SEQ ID NO: 493442 - protein, 7 aa, Mycobacterium
GQRTPTA

SEQ ID NO: 493443 - protein, 6 aa, Mycobacterium
GQRTSA

SEQ ID NO: 493444 - protein, 6 aa, Mycobacterium
GQRTST

SEQ ID NO: 493445 - protein, 10 aa, Mycobacterium
GQRVDQRGDR

SEQ ID NO: 493446 - protein, 6 aa, Mycobacterium
GQRVEA

SEQ ID NO: 493447 - protein, 13 aa, Mycobacterium
GQRVNEKAPKDRD

SEQ ID NO: 493448 - protein, 12 aa, Mycobacterium
GQRVTDTDTVVP

SEQ ID NO: 493449 - protein, 16 aa, Mycobacterium
GQRWTEPAKTRFGPPL

SEQ ID NO: 493450 - protein, 4 aa, Mycobacterium
GQRY

SEQ ID NO: 493451 - protein, 10 aa, Mycobacterium
GQSAAEQEAT

SEQ ID NO: 493452 - protein, 9 aa, Mycobacterium
GQSAAPTSL

SEQ ID NO: 493453 - protein, 7 aa, Mycobacterium
GQSAESR

SEQ ID NO: 493454 - protein, 6 aa, Mycobacterium
GQSAGA

SEQ ID NO: 493455 - protein, 11 aa, Mycobacterium
GQSAGGNLSAA

SEQ ID NO: 493456 - protein, 12 aa, Mycobacterium
GQSAGGNLSAAA

SEQ ID NO: 493457 - protein, 8 aa, Mycobacterium
GQSANKSV

SEQ ID NO: 493458 - protein, 10 aa, Mycobacterium
GQSAYGAAKA

SEQ ID NO: 493459 - protein, 7 aa, Mycobacterium
GQSCGST

SEQ ID NO: 493460 - protein, 7 aa, Mycobacterium
GQSCNAP

SEQ ID NO: 493461 - protein, 8 aa, Mycobacterium
GQSDADGL

SEQ ID NO: 493462 - protein, 7 aa, Mycobacterium
GQSDPLL

SEQ ID NO: 493463 - protein, 8 aa, Mycobacterium
GQSDRVGT

SEQ ID NO: 493464 - protein, 6 aa, Mycobacterium
GQSEAP

SEQ ID NO: 493465 - protein, 15 aa, Mycobacterium
GQSECATGDTASPTT

SEQ ID NO: 493466 - protein, 7 aa, Mycobacterium
GQSEGQG

SEQ ID NO: 493467 - protein, 13 aa, Mycobacterium
GQSEPAAAGSKLD

SEQ ID NO: 493468 - protein, 10 aa, Mycobacterium
GQSEQREGQD

SEQ ID NO: 493469 - protein, 7 aa, Mycobacterium
GQSERGL

SEQ ID NO: 493470 - protein, 4 aa, Mycobacterium
GQSG

SEQ ID NO: 493471 - protein, 61 aa, Mycobacterium
GQSGAAGAGGTAGAGGAGGTGGTGGVGGTGGTGAGGGGRTGGVGGDGVTGATGASGQPGAS

SEQ ID NO: 493472 - protein, 6 aa, Mycobacterium
GQSGAL

SEQ ID NO: 493473 - protein, 32 aa, Mycobacterium
GQSGDPGQSGPPVVDGNGGAGGQGGPGGAGGS

SEQ ID NO: 493474 - protein, 13 aa, Mycobacterium
GQSGGAPETVRHN

SEQ ID NO: 493475 - protein, 7 aa, Mycobacterium
GQSGIGR

SEQ ID NO: 493476 - protein, 5 aa, Mycobacterium
GQSGT

SEQ ID NO: 493477 - protein, 4 aa, Mycobacterium
GQSI

SEQ ID NO: 493478 - protein, 6 aa, Mycobacterium
GQSIPA

SEQ ID NO: 493479 - protein, 6 aa, Mycobacterium
GQSIPT

SEQ ID NO: 493480 - protein, 5 aa, Mycobacterium
GQSIR

SEQ ID NO: 493481 - protein, 6 aa, Mycobacterium
GQSKAT

SEQ ID NO: 493482 - protein, 4 aa, Mycobacterium
GQSL

SEQ ID NO: 493483 - protein, 14 aa, Mycobacterium
GQSLDRDGEKIARD

SEQ ID NO: 493484 - protein, 9 aa, Mycobacterium
GQSLNPNSK

SEQ ID NO: 493485 - protein, 8 aa, Mycobacterium
GQSLRGGE

SEQ ID NO: 493486 - protein, 7 aa, Mycobacterium
GQSLTPE

SEQ ID NO: 493487 - protein, 4 aa, Mycobacterium
GQSM

SEQ ID NO: 493488 - protein, 6 aa, Mycobacterium
GQSMPG

SEQ ID NO: 493489 - protein, 16 aa, Mycobacterium
GQSNDLDPMAAPSQWS

SEQ ID NO: 493490 - protein, 13 aa, Mycobacterium
GQSNTAKAANENL

SEQ ID NO: 493491 - protein, 8 aa, Mycobacterium
GQSPDEVE

SEQ ID NO: 493492 - protein, 14 aa, Mycobacterium
GQSPKGPQATGVRT

SEQ ID NO: 493493 - protein, 5 aa, Mycobacterium
GQSPL

SEQ ID NO: 493494 - protein, 7 aa, Mycobacterium
GQSPPAD

SEQ ID NO: 493495 - protein, 8 aa, Mycobacterium
GQSPPADL

SEQ ID NO: 493496 - protein, 7 aa, Mycobacterium
GQSPPWA

SEQ ID NO: 493497 - protein, 7 aa, Mycobacterium
GQSPQHL

SEQ ID NO: 493498 - protein, 5 aa, Mycobacterium
GQSPT

SEQ ID NO: 493499 - protein, 6 aa, Mycobacterium
GQSPTV

SEQ ID NO: 493500 - protein, 13 aa, Mycobacterium
GQSPYRLSGTRGT

SEQ ID NO: 493501 - protein, 4 aa, Mycobacterium
GQSQ

SEQ ID NO: 493502 - protein, 10 aa, Mycobacterium
GQSQGGGAAV

SEQ ID NO: 493503 - protein, 4 aa, Mycobacterium
GQSR

SEQ ID NO: 493504 - protein, 11 aa, Mycobacterium
GQSRDGEPQCI

SEQ ID NO: 493505 - protein, 17 aa, Mycobacterium
GQSRERMRKRGGGPGAA

SEQ ID NO: 493506 - protein, 10 aa, Mycobacterium
GQSRRAARAA

SEQ ID NO: 493507 - protein, 4 aa, Mycobacterium
GQSS

SEQ ID NO: 493508 - protein, 20 aa, Mycobacterium
GQSSAAIGSADHYDGGGRLP

SEQ ID NO: 493509 - protein, 5 aa, Mycobacterium
GQSSQ

SEQ ID NO: 493510 - protein, 11 aa, Mycobacterium
GQSSSFRRSAQ

SEQ ID NO: 493511 - protein, 17 aa, Mycobacterium
GQSSTRSQRGQTPRSIG

SEQ ID NO: 493512 - protein, 7 aa, Mycobacterium
GQSSYNA

SEQ ID NO: 493513 - protein, 9 aa, Mycobacterium
GQSTNDVYP

SEQ ID NO: 493514 - protein, 15 aa, Mycobacterium
GQSTSTDDAEGEPVH

SEQ ID NO: 493515 - protein, 13 aa, Mycobacterium
GQSTSTDDAEGEV

SEQ ID NO: 493516 - protein, 4 aa, Mycobacterium
GQSV

SEQ ID NO: 493517 - protein, 12 aa, Mycobacterium
GQSVFPGKAGTD

SEQ ID NO: 493518 - protein, 6 aa, Mycobacterium
GQSVPA

SEQ ID NO: 493519 - protein, 10 aa, Mycobacterium
GQSVSQTDEE

SEQ ID NO: 493520 - protein, 7 aa, Mycobacterium
GQSYQTL

SEQ ID NO: 493521 - protein, 18 aa, Mycobacterium
GQSYRMKDAQHRKENPQP

SEQ ID NO: 493522 - protein, 6 aa, Mycobacterium
GQTAAV

SEQ ID NO: 493523 - protein, 6 aa, Mycobacterium
GQTADD

SEQ ID NO: 493524 - protein, 12 aa, Mycobacterium
GQTADGLGADGR

SEQ ID NO: 493525 - protein, 9 aa, Mycobacterium
GQTAGHDER

SEQ ID NO: 493526 - protein, 5 aa, Mycobacterium
GQTAR

SEQ ID NO: 493527 - protein, 6 aa, Mycobacterium
GQTASN

SEQ ID NO: 493528 - protein, 5 aa, Mycobacterium
GQTAT

SEQ ID NO: 493529 - protein, 9 aa, Mycobacterium
GQTATSRHV

SEQ ID NO: 493530 - protein, 7 aa, Mycobacterium
GQTAYSA

SEQ ID NO: 493531 - protein, 6 aa, Mycobacterium
GQTCQA

SEQ ID NO: 493532 - protein, 4 aa, Mycobacterium
GQTD

SEQ ID NO: 493533 - protein, 126 aa, Mycobacterium
GQTDETEETDETDETDETDDFDDDSDDSDDSDEDDDSDETNDTDVDAGEDEDTDDDSDEDSDDDSDEDEDTEDDELDDDLDEDDLDDDLDEDDDDLDDELDDDDSDSDDEDGESELTEPAAGRPAA

SEQ ID NO: 493534 - protein, 11 aa, Mycobacterium
GQTDGDTAVSE

SEQ ID NO: 493535 - protein, 5 aa, Mycobacterium
GQTDN

SEQ ID NO: 493536 - protein, 11 aa, Mycobacterium
GQTDSTGAWRP

SEQ ID NO: 493537 - protein, 4 aa, Mycobacterium
GQTE

SEQ ID NO: 493538 - protein, 10 aa, Mycobacterium
GQTEAAARVD

SEQ ID NO: 493539 - protein, 5 aa, Mycobacterium
GQTEE

SEQ ID NO: 493540 - protein, 16 aa, Mycobacterium
GQTEGSPITSLGPADH

SEQ ID NO: 493541 - protein, 6 aa, Mycobacterium
GQTELG

SEQ ID NO: 493542 - protein, 6 aa, Mycobacterium
GQTERG

SEQ ID NO: 493543 - protein, 4 aa, Mycobacterium
GQTF

SEQ ID NO: 493544 - protein, 9 aa, Mycobacterium
GQTGDDPIL

SEQ ID NO: 493545 - protein, 10 aa, Mycobacterium
GQTGDDPIYQ

SEQ ID NO: 493546 - protein, 6 aa, Mycobacterium
GQTGLG

SEQ ID NO: 493547 - protein, 7 aa, Mycobacterium
GQTGPFR

SEQ ID NO: 493548 - protein, 11 aa, Mycobacterium
GQTGPMSERPG

SEQ ID NO: 493549 - protein, 7 aa, Mycobacterium
GQTGQCS

SEQ ID NO: 493550 - protein, 6 aa, Mycobacterium
GQTGRL

SEQ ID NO: 493551 - protein, 13 aa, Mycobacterium
GQTGYDELPATDV

SEQ ID NO: 493552 - protein, 13 aa, Mycobacterium
GQTGYDGLPTTDV

SEQ ID NO: 493553 - protein, 7 aa, Mycobacterium
GQTHASA

SEQ ID NO: 493554 - protein, 13 aa, Mycobacterium
GQTHSPRTITGPD

SEQ ID NO: 493555 - protein, 12 aa, Mycobacterium
GQTIKSDTGQLV

SEQ ID NO: 493556 - protein, 7 aa, Mycobacterium
GQTIPAG

SEQ ID NO: 493557 - protein, 8 aa, Mycobacterium
GQTIRAGE

SEQ ID NO: 493558 - protein, 10 aa, Mycobacterium
GQTKAAGDQL

SEQ ID NO: 493559 - protein, 7 aa, Mycobacterium
GQTLDPD

SEQ ID NO: 493560 - protein, 7 aa, Mycobacterium
GQTLQPD

SEQ ID NO: 493561 - protein, 5 aa, Mycobacterium
GQTLR

SEQ ID NO: 493562 - protein, 8 aa, Mycobacterium
GQTLTPDA

SEQ ID NO: 493563 - protein, 6 aa, Mycobacterium
GQTLTS

SEQ ID NO: 493564 - protein, 9 aa, Mycobacterium
GQTNASGRF

SEQ ID NO: 493565 - protein, 7 aa, Mycobacterium
GQTNPDA

SEQ ID NO: 493566 - protein, 6 aa, Mycobacterium
GQTPAV

SEQ ID NO: 493567 - protein, 5 aa, Mycobacterium
GQTPD

SEQ ID NO: 493568 - protein, 10 aa, Mycobacterium
GQTPDDPDAE

SEQ ID NO: 493569 - protein, 6 aa, Mycobacterium
GQTPLD

SEQ ID NO: 493570 - protein, 7 aa, Mycobacterium
GQTPLGV

SEQ ID NO: 493571 - protein, 8 aa, Mycobacterium
GQTPPPYL

SEQ ID NO: 493572 - protein, 7 aa, Mycobacterium
GQTPPQL

SEQ ID NO: 493573 - protein, 16 aa, Mycobacterium
GQTPRPELPGYGAPVG

SEQ ID NO: 493574 - protein, 6 aa, Mycobacterium
GQTPSG

SEQ ID NO: 493575 - protein, 7 aa, Mycobacterium
GQTPSLG

SEQ ID NO: 493576 - protein, 15 aa, Mycobacterium
GQTPSPESVPGRRGQ

SEQ ID NO: 493577 - protein, 10 aa, Mycobacterium
GQTPSTKNAR

SEQ ID NO: 493578 - protein, 10 aa, Mycobacterium
GQTPSTKSAR

SEQ ID NO: 493579 - protein, 26 aa, Mycobacterium
GQTPVAVEGERDAAERHDLLRTIGYK

SEQ ID NO: 493580 - protein, 4 aa, Mycobacterium
GQTQ

SEQ ID NO: 493581 - protein, 6 aa, Mycobacterium
GQTQGY

SEQ ID NO: 493582 - protein, 7 aa, Mycobacterium
GQTQRER

SEQ ID NO: 493583 - protein, 8 aa, Mycobacterium
GQTRGGAQ

SEQ ID NO: 493584 - protein, 14 aa, Mycobacterium
GQTRKLENAASRAE

SEQ ID NO: 493585 - protein, 8 aa, Mycobacterium
GQTRSELT

SEQ ID NO: 493586 - protein, 13 aa, Mycobacterium
GQTRTGKAVLTPV

SEQ ID NO: 493587 - protein, 13 aa, Mycobacterium
GQTSAYNQTERGH

SEQ ID NO: 493588 - protein, 8 aa, Mycobacterium
GQTSDKID

SEQ ID NO: 493589 - protein, 8 aa, Mycobacterium
GQTSMTVP

SEQ ID NO: 493590 - protein, 6 aa, Mycobacterium
GQTSTD

SEQ ID NO: 493591 - protein, 8 aa, Mycobacterium
GQTSVTTI

SEQ ID NO: 493592 - protein, 29 aa, Mycobacterium
GQTSVTTIDADGRAEQALRAGDGATTMAA

SEQ ID NO: 493593 - protein, 17 aa, Mycobacterium
GQTSVTTVDPSGTKAAH

SEQ ID NO: 493594 - protein, 6 aa, Mycobacterium
GQTTAN

SEQ ID NO: 493595 - protein, 8 aa, Mycobacterium
GQTTEAAH

SEQ ID NO: 493596 - protein, 11 aa, Mycobacterium
GQTTMTAPGGV

SEQ ID NO: 493597 - protein, 6 aa, Mycobacterium
GQTTPG

SEQ ID NO: 493598 - protein, 12 aa, Mycobacterium
GQTTSTEDAEGE

SEQ ID NO: 493599 - protein, 16 aa, Mycobacterium
GQTTSTEDAEGEPLAS

SEQ ID NO: 493600 - protein, 12 aa, Mycobacterium
GQTTSTEDTEGE

SEQ ID NO: 493601 - protein, 29 aa, Mycobacterium
GQTTTLNGHPTTAPAATNGHQTAVAPLPG

SEQ ID NO: 493602 - protein, 5 aa, Mycobacterium
GQTTV

SEQ ID NO: 493603 - protein, 5 aa, Mycobacterium
GQTVA

SEQ ID NO: 493604 - protein, 5 aa, Mycobacterium
GQTVD

SEQ ID NO: 493605 - protein, 10 aa, Mycobacterium
GQTVPRRDRG

SEQ ID NO: 493606 - protein, 9 aa, Mycobacterium
GQTVSQPKL

SEQ ID NO: 493607 - protein, 8 aa, Mycobacterium
GQTVSTRE

SEQ ID NO: 493608 - protein, 6 aa, Mycobacterium
GQTVTD

SEQ ID NO: 493609 - protein, 8 aa, Mycobacterium
GQTVTGEG

SEQ ID NO: 493610 - protein, 13 aa, Mycobacterium
GQTYGDTAPGAGA

SEQ ID NO: 493611 - protein, 10 aa, Mycobacterium
GQTYQGQVEP

SEQ ID NO: 493612 - protein, 5 aa, Mycobacterium
GQTYT

SEQ ID NO: 493613 - protein, 9 aa, Mycobacterium
GQTYVTTPG

SEQ ID NO: 493614 - protein, 4 aa, Mycobacterium
GQVA

SEQ ID NO: 493615 - protein, 11 aa, Mycobacterium
GQVAASAGRLS

SEQ ID NO: 493616 - protein, 12 aa, Mycobacterium
GQVADSGNWGRV

SEQ ID NO: 493617 - protein, 16 aa, Mycobacterium
GQVAGVGGTQPTGGPH

SEQ ID NO: 493618 - protein, 5 aa, Mycobacterium
GQVAK

SEQ ID NO: 493619 - protein, 8 aa, Mycobacterium
GQVDDEED

SEQ ID NO: 493620 - protein, 23 aa, Mycobacterium
GQVDDNTAGYDADDPSDEPGITR

SEQ ID NO: 493621 - protein, 4 aa, Mycobacterium
GQVE

SEQ ID NO: 493622 - protein, 12 aa, Mycobacterium
GQVEEANTKGTL

SEQ ID NO: 493623 - protein, 10 aa, Mycobacterium
GQVEPGDRQR

SEQ ID NO: 493624 - protein, 4 aa, Mycobacterium
GQVG

SEQ ID NO: 493625 - protein, 6 aa, Mycobacterium
GQVGAP

SEQ ID NO: 493626 - protein, 7 aa, Mycobacterium
GQVGDGK

SEQ ID NO: 493627 - protein, 12 aa, Mycobacterium
GQVGEQSSNTAR

SEQ ID NO: 493628 - protein, 11 aa, Mycobacterium
GQVGGGDRGDR

SEQ ID NO: 493629 - protein, 5 aa, Mycobacterium
GQVGK

SEQ ID NO: 493630 - protein, 17 aa, Mycobacterium
GQVGTGDDVRGPGRGGA

SEQ ID NO: 493631 - protein, 19 aa, Mycobacterium
GQVHDGSAGASHESVDPTR

SEQ ID NO: 493632 - protein, 9 aa, Mycobacterium
GQVKAKGPI

SEQ ID NO: 493633 - protein, 13 aa, Mycobacterium
GQVLPNDGTAVGE

SEQ ID NO: 493634 - protein, 16 aa, Mycobacterium
GQVNQRTDADTPFSEI

SEQ ID NO: 493635 - protein, 4 aa, Mycobacterium
GQVP

SEQ ID NO: 493636 - protein, 8 aa, Mycobacterium
GQVPDDPV

SEQ ID NO: 493637 - protein, 7 aa, Mycobacterium
GQVPDGE

SEQ ID NO: 493638 - protein, 8 aa, Mycobacterium
GQVPDGED

SEQ ID NO: 493639 - protein, 8 aa, Mycobacterium
GQVPDSRH

SEQ ID NO: 493640 - protein, 5 aa, Mycobacterium
GQVPP

SEQ ID NO: 493641 - protein, 4 aa, Mycobacterium
GQVQ

SEQ ID NO: 493642 - protein, 4 aa, Mycobacterium
GQVR

SEQ ID NO: 493643 - protein, 10 aa, Mycobacterium
GQVRAKGPVP

SEQ ID NO: 493644 - protein, 7 aa, Mycobacterium
GQVRATH

SEQ ID NO: 493645 - protein, 9 aa, Mycobacterium
GQVRTRYSS

SEQ ID NO: 493646 - protein, 8 aa, Mycobacterium
GQVRTTTT

SEQ ID NO: 493647 - protein, 7 aa, Mycobacterium
GQVSDAD

SEQ ID NO: 493648 - protein, 6 aa, Mycobacterium
GQVSEG

SEQ ID NO: 493649 - protein, 9 aa, Mycobacterium
GQVSERGRL

SEQ ID NO: 493650 - protein, 14 aa, Mycobacterium
GQVSGGAPLPPDQV

SEQ ID NO: 493651 - protein, 10 aa, Mycobacterium
GQVSNDPERI

SEQ ID NO: 493652 - protein, 5 aa, Mycobacterium
GQVTA

SEQ ID NO: 493653 - protein, 8 aa, Mycobacterium
GQVTGRPV

SEQ ID NO: 493654 - protein, 6 aa, Mycobacterium
GQVTSG

SEQ ID NO: 493655 - protein, 4 aa, Mycobacterium
GQWP

SEQ ID NO: 493656 - protein, 9 aa, Mycobacterium
GQWPSPLAT

SEQ ID NO: 493657 - protein, 36 aa, Mycobacterium
GQWRRGTAAPLKSQVDEALGAAGPATSDLGGEPSSV

SEQ ID NO: 493658 - protein, 13 aa, Mycobacterium
GQYAKPRSKPTEM

SEQ ID NO: 493659 - protein, 14 aa, Mycobacterium
GQYGGQGVPSDDRS

SEQ ID NO: 493660 - protein, 13 aa, Mycobacterium
GQYGQGPGPGENL

SEQ ID NO: 493661 - protein, 6 aa, Mycobacterium
GQYKSA

SEQ ID NO: 493662 - protein, 4 aa, Mycobacterium
GQYN

SEQ ID NO: 493663 - protein, 4 aa, Mycobacterium
GQYP

SEQ ID NO: 493664 - protein, 6 aa, Mycobacterium
GQYQAA

SEQ ID NO: 493665 - protein, 11 aa, Mycobacterium
GQYRGGDPDEF

SEQ ID NO: 493666 - protein, 7 aa, Mycobacterium
GQYRSGD

SEQ ID NO: 493667 - protein, 4 aa, Mycobacterium
GQYS

SEQ ID NO: 493668 - protein, 19 aa, Mycobacterium
GQYSPTSETGKVTKSTPMG

SEQ ID NO: 493669 - protein, 20 aa, Mycobacterium
GQYSPTSETGKVTKSTPMGS

SEQ ID NO: 493670 - protein, 20 aa, Mycobacterium
GQYSPTSEVGKVTKSTPMGS

SEQ ID NO: 493671 - protein, 9 aa, Mycobacterium
GQYTKDEAA

SEQ ID NO: 493672 - protein, 6 aa, Mycobacterium
GRAAAA

SEQ ID NO: 493673 - protein, 12 aa, Mycobacterium
GRAAAHGRDPDQ

SEQ ID NO: 493674 - protein, 10 aa, Mycobacterium
GRAAAKEVRD

SEQ ID NO: 493675 - protein, 12 aa, Mycobacterium
GRAAATGESADA

SEQ ID NO: 493676 - protein, 7 aa, Mycobacterium
GRAADAA

SEQ ID NO: 493677 - protein, 11 aa, Mycobacterium
GRAADPEATAQ

SEQ ID NO: 493678 - protein, 6 aa, Mycobacterium
GRAADR

SEQ ID NO: 493679 - protein, 5 aa, Mycobacterium
GRAAG

SEQ ID NO: 493680 - protein, 8 aa, Mycobacterium
GRAAGEVD

SEQ ID NO: 493681 - protein, 16 aa, Mycobacterium
GRAAGLSRTGERFRPP

SEQ ID NO: 493682 - protein, 15 aa, Mycobacterium
GRAAGQAAQSGPGHA

SEQ ID NO: 493683 - protein, 12 aa, Mycobacterium
GRAAGRGAADDI

SEQ ID NO: 493684 - protein, 12 aa, Mycobacterium
GRAAGRGAAEDI

SEQ ID NO: 493685 - protein, 12 aa, Mycobacterium
GRAAGRGVADDI

SEQ ID NO: 493686 - protein, 12 aa, Mycobacterium
GRAAGRGVAEDI

SEQ ID NO: 493687 - protein, 14 aa, Mycobacterium
GRAAGSQGVGAHRD

SEQ ID NO: 493688 - protein, 9 aa, Mycobacterium
GRAAGTGFT

SEQ ID NO: 493689 - protein, 18 aa, Mycobacterium
GRAAHRIGGGTAGGPHSA

SEQ ID NO: 493690 - protein, 8 aa, Mycobacterium
GRAALGRR

SEQ ID NO: 493691 - protein, 9 aa, Mycobacterium
GRAAPPDTT

SEQ ID NO: 493692 - protein, 6 aa, Mycobacterium
GRAAQE

SEQ ID NO: 493693 - protein, 14 aa, Mycobacterium
GRAAQIQAAAKAEG

SEQ ID NO: 493694 - protein, 10 aa, Mycobacterium
GRAAQPDEIA

SEQ ID NO: 493695 - protein, 7 aa, Mycobacterium
GRAARDM

SEQ ID NO: 493696 - protein, 8 aa, Mycobacterium
GRAARNAK

SEQ ID NO: 493697 - protein, 10 aa, Mycobacterium
GRAARPRYRA

SEQ ID NO: 493698 - protein, 13 aa, Mycobacterium
GRAASATSTATWG

SEQ ID NO: 493699 - protein, 22 aa, Mycobacterium
GRAASDGFKALGGGPGADPGTE

SEQ ID NO: 493700 - protein, 7 aa, Mycobacterium
GRAASGR

SEQ ID NO: 493701 - protein, 9 aa, Mycobacterium
GRAASTRRE

SEQ ID NO: 493702 - protein, 5 aa, Mycobacterium
GRAAT

SEQ ID NO: 493703 - protein, 6 aa, Mycobacterium
GRAATT

SEQ ID NO: 493704 - protein, 9 aa, Mycobacterium
GRAATVPAP

SEQ ID NO: 493705 - protein, 5 aa, Mycobacterium
GRAAV

SEQ ID NO: 493706 - protein, 14 aa, Mycobacterium
GRADAGASSAARDH

SEQ ID NO: 493707 - protein, 6 aa, Mycobacterium
GRADDD

SEQ ID NO: 493708 - protein, 14 aa, Mycobacterium
GRADDRVNHGRLDP

SEQ ID NO: 493709 - protein, 10 aa, Mycobacterium
GRADERLGAT

SEQ ID NO: 493710 - protein, 10 aa, Mycobacterium
GRADGGTGVD

SEQ ID NO: 493711 - protein, 24 aa, Mycobacterium
GRADGKAVPLANAPDSNDGGRTTF

SEQ ID NO: 493712 - protein, 12 aa, Mycobacterium
GRADGYVRGEGG

SEQ ID NO: 493713 - protein, 7 aa, Mycobacterium
GRADNKP

SEQ ID NO: 493714 - protein, 9 aa, Mycobacterium
GRADNKPQF

SEQ ID NO: 493715 - protein, 8 aa, Mycobacterium
GRADPRYV

SEQ ID NO: 493716 - protein, 10 aa, Mycobacterium
GRADRDEART

SEQ ID NO: 493717 - protein, 6 aa, Mycobacterium
GRADRP

SEQ ID NO: 493718 - protein, 14 aa, Mycobacterium
GRADRTLAPSSSAM

SEQ ID NO: 493719 - protein, 9 aa, Mycobacterium
GRADSAVTG

SEQ ID NO: 493720 - protein, 6 aa, Mycobacterium
GRADSE

SEQ ID NO: 493721 - protein, 10 aa, Mycobacterium
GRADSEAGQR

SEQ ID NO: 493722 - protein, 10 aa, Mycobacterium
GRADSGAPAW

SEQ ID NO: 493723 - protein, 6 aa, Mycobacterium
GRADTR

SEQ ID NO: 493724 - protein, 9 aa, Mycobacterium
GRADVSGLG

SEQ ID NO: 493725 - protein, 6 aa, Mycobacterium
GRAEAD

SEQ ID NO: 493726 - protein, 15 aa, Mycobacterium
GRAEAGSPSATRDHA

SEQ ID NO: 493727 - protein, 6 aa, Mycobacterium
GRAEDP

SEQ ID NO: 493728 - protein, 9 aa, Mycobacterium
GRAEDPAVR

SEQ ID NO: 493729 - protein, 11 aa, Mycobacterium
GRAEDREVRDR

SEQ ID NO: 493730 - protein, 15 aa, Mycobacterium
GRAEDRSVREEVGPT

SEQ ID NO: 493731 - protein, 7 aa, Mycobacterium
GRAEEPA

SEQ ID NO: 493732 - protein, 20 aa, Mycobacterium
GRAEEPGVRDRFGSRDAAVS

SEQ ID NO: 493733 - protein, 8 aa, Mycobacterium
GRAEGRQV

SEQ ID NO: 493734 - protein, 8 aa, Mycobacterium
GRAEIADA

SEQ ID NO: 493735 - protein, 10 aa, Mycobacterium
GRAESPMESE

SEQ ID NO: 493736 - protein, 8 aa, Mycobacterium
GRAETPPV

SEQ ID NO: 493737 - protein, 8 aa, Mycobacterium
GRAFSSGN

SEQ ID NO: 493738 - protein, 9 aa, Mycobacterium
GRAGADYAA

SEQ ID NO: 493739 - protein, 9 aa, Mycobacterium
GRAGDFDTL

SEQ ID NO: 493740 - protein, 7 aa, Mycobacterium
GRAGEHR

SEQ ID NO: 493741 - protein, 8 aa, Mycobacterium
GRAGEPLG

SEQ ID NO: 493742 - protein, 9 aa, Mycobacterium
GRAGESSGF

SEQ ID NO: 493743 - protein, 8 aa, Mycobacterium
GRAGETAA

SEQ ID NO: 493744 - protein, 9 aa, Mycobacterium
GRAGETPAS

SEQ ID NO: 493745 - protein, 11 aa, Mycobacterium
GRAGGAPPPET

SEQ ID NO: 493746 - protein, 8 aa, Mycobacterium
GRAGGGTV

SEQ ID NO: 493747 - protein, 7 aa, Mycobacterium
GRAGGRD

SEQ ID NO: 493748 - protein, 14 aa, Mycobacterium
GRAGGTDAAAAERI

SEQ ID NO: 493749 - protein, 22 aa, Mycobacterium
GRAGIASTEQPADGEVPAGENL

SEQ ID NO: 493750 - protein, 22 aa, Mycobacterium
GRAGIASTIEPADGQAPDGTNL

SEQ ID NO: 493751 - protein, 22 aa, Mycobacterium
GRAGIASTTAPANGENPDGENL

SEQ ID NO: 493752 - protein, 13 aa, Mycobacterium
GRAGKGAAAHAAA

SEQ ID NO: 493753 - protein, 6 aa, Mycobacterium
GRAGLG

SEQ ID NO: 493754 - protein, 7 aa, Mycobacterium
GRAGPPT

SEQ ID NO: 493755 - protein, 10 aa, Mycobacterium
GRAGRATESA

SEQ ID NO: 493756 - protein, 11 aa, Mycobacterium
GRAGRDDEPAS

SEQ ID NO: 493757 - protein, 9 aa, Mycobacterium
GRAGRGAAA

SEQ ID NO: 493758 - protein, 10 aa, Mycobacterium
GRAGRGANPF

SEQ ID NO: 493759 - protein, 9 aa, Mycobacterium
GRAGRPEEV

SEQ ID NO: 493760 - protein, 8 aa, Mycobacterium
GRAGRPLK

SEQ ID NO: 493761 - protein, 6 aa, Mycobacterium
GRAGRQ

SEQ ID NO: 493762 - protein, 9 aa, Mycobacterium
GRAGRRGQG

SEQ ID NO: 493763 - protein, 10 aa, Mycobacterium
GRAGRSTDSA

SEQ ID NO: 493764 - protein, 6 aa, Mycobacterium
GRAGSA

SEQ ID NO: 493765 - protein, 8 aa, Mycobacterium
GRAGSGGK

SEQ ID NO: 493766 - protein, 7 aa, Mycobacterium
GRAGSPK

SEQ ID NO: 493767 - protein, 8 aa, Mycobacterium
GRAGTGGV

SEQ ID NO: 493768 - protein, 5 aa, Mycobacterium
GRAHA

SEQ ID NO: 493769 - protein, 5 aa, Mycobacterium
GRAHG

SEQ ID NO: 493770 - protein, 7 aa, Mycobacterium
GRAHLQQ

SEQ ID NO: 493771 - protein, 8 aa, Mycobacterium
GRAHPLPE

SEQ ID NO: 493772 - protein, 18 aa, Mycobacterium
GRAHRARAAELSTDEGGD

SEQ ID NO: 493773 - protein, 9 aa, Mycobacterium
GRAHTARGD

SEQ ID NO: 493774 - protein, 9 aa, Mycobacterium
GRAIAGPGT

SEQ ID NO: 493775 - protein, 7 aa, Mycobacterium
GRAIPGI

SEQ ID NO: 493776 - protein, 11 aa, Mycobacterium
GRAIPTGSCPT

SEQ ID NO: 493777 - protein, 8 aa, Mycobacterium
GRAISGRA

SEQ ID NO: 493778 - protein, 4 aa, Mycobacterium
GRAK

SEQ ID NO: 493779 - protein, 9 aa, Mycobacterium
GRAKAEEIG

SEQ ID NO: 493780 - protein, 12 aa, Mycobacterium
GRAKEKSPYPNQ

SEQ ID NO: 493781 - protein, 9 aa, Mycobacterium
GRAKHTSTL

SEQ ID NO: 493782 - protein, 11 aa, Mycobacterium
GRAKNPGPDDL

SEQ ID NO: 493783 - protein, 5 aa, Mycobacterium
GRAKR

SEQ ID NO: 493784 - protein, 8 aa, Mycobacterium
GRAKRDDT

SEQ ID NO: 493785 - protein, 9 aa, Mycobacterium
GRAKRTGPP

SEQ ID NO: 493786 - protein, 4 aa, Mycobacterium
GRAL

SEQ ID NO: 493787 - protein, 9 aa, Mycobacterium
GRALEPAES

SEQ ID NO: 493788 - protein, 22 aa, Mycobacterium
GRALGTGAFGSGGGGGASKAIG

SEQ ID NO: 493789 - protein, 11 aa, Mycobacterium
GRALNAGAGRD

SEQ ID NO: 493790 - protein, 9 aa, Mycobacterium
GRALRDDDS

SEQ ID NO: 493791 - protein, 8 aa, Mycobacterium
GRALRDDG

SEQ ID NO: 493792 - protein, 14 aa, Mycobacterium
GRALSRQSVRAATD

SEQ ID NO: 493793 - protein, 9 aa, Mycobacterium
GRANAPAAG

SEQ ID NO: 493794 - protein, 8 aa, Mycobacterium
GRANDGTV

SEQ ID NO: 493795 - protein, 5 aa, Mycobacterium
GRANR

SEQ ID NO: 493796 - protein, 19 aa, Mycobacterium
GRAPAPRWTATNSTPCTNS

SEQ ID NO: 493797 - protein, 7 aa, Mycobacterium
GRAPATV

SEQ ID NO: 493798 - protein, 5 aa, Mycobacterium
GRAPD

SEQ ID NO: 493799 - protein, 7 aa, Mycobacterium
GRAPDSL

SEQ ID NO: 493800 - protein, 5 aa, Mycobacterium
GRAPE

SEQ ID NO: 493801 - protein, 8 aa, Mycobacterium
GRAPEALD

SEQ ID NO: 493802 - protein, 6 aa, Mycobacterium
GRAPEG

SEQ ID NO: 493803 - protein, 9 aa, Mycobacterium
GRAPGDPVV

SEQ ID NO: 493804 - protein, 8 aa, Mycobacterium
GRAPGEAI

SEQ ID NO: 493805 - protein, 21 aa, Mycobacterium
GRAPGNPSVPDKCSPAKISDA

SEQ ID NO: 493806 - protein, 25 aa, Mycobacterium
GRAPGPSRSGADATIPVSVAPAGHV

SEQ ID NO: 493807 - protein, 9 aa, Mycobacterium
GRAPGTDQV

SEQ ID NO: 493808 - protein, 8 aa, Mycobacterium
GRAPIGGA

SEQ ID NO: 493809 - protein, 5 aa, Mycobacterium
GRAPQ

SEQ ID NO: 493810 - protein, 8 aa, Mycobacterium
GRAPQELT

SEQ ID NO: 493811 - protein, 6 aa, Mycobacterium
GRAPRA

SEQ ID NO: 493812 - protein, 7 aa, Mycobacterium
GRAPRGI

SEQ ID NO: 493813 - protein, 11 aa, Mycobacterium
GRAPRIAPQSP

SEQ ID NO: 493814 - protein, 8 aa, Mycobacterium
GRAPRTDD

SEQ ID NO: 493815 - protein, 16 aa, Mycobacterium
GRAPSASGAPRAAGGS

SEQ ID NO: 493816 - protein, 16 aa, Mycobacterium
GRAPSGAAAPRAAGGN

SEQ ID NO: 493817 - protein, 8 aa, Mycobacterium
GRAPSRDT

SEQ ID NO: 493818 - protein, 14 aa, Mycobacterium
GRAPSRVSGPDPVP

SEQ ID NO: 493819 - protein, 18 aa, Mycobacterium
GRAPSSALPTTRAACAAS

SEQ ID NO: 493820 - protein, 6 aa, Mycobacterium
GRAPST

SEQ ID NO: 493821 - protein, 9 aa, Mycobacterium
GRAPTPSEV

SEQ ID NO: 493822 - protein, 6 aa, Mycobacterium
GRAPTR

SEQ ID NO: 493823 - protein, 6 aa, Mycobacterium
GRAPTS

SEQ ID NO: 493824 - protein, 8 aa, Mycobacterium
GRAPTTED

SEQ ID NO: 493825 - protein, 8 aa, Mycobacterium
GRAPVSNL

SEQ ID NO: 493826 - protein, 10 aa, Mycobacterium
GRAPVTRSGA

SEQ ID NO: 493827 - protein, 13 aa, Mycobacterium
GRAPWKAGVGQGR

SEQ ID NO: 493828 - protein, 7 aa, Mycobacterium
GRAPYRP

SEQ ID NO: 493829 - protein, 5 aa, Mycobacterium
GRAQA

SEQ ID NO: 493830 - protein, 11 aa, Mycobacterium
GRAQAGALDAS

SEQ ID NO: 493831 - protein, 5 aa, Mycobacterium
GRAQE

SEQ ID NO: 493832 - protein, 10 aa, Mycobacterium
GRAQPGEPVQ

SEQ ID NO: 493833 - protein, 15 aa, Mycobacterium
GRAQPGGLTTPEAPD

SEQ ID NO: 493834 - protein, 14 aa, Mycobacterium
GRAQPLGSPGGAAK

SEQ ID NO: 493835 - protein, 7 aa, Mycobacterium
GRAQPSR

SEQ ID NO: 493836 - protein, 7 aa, Mycobacterium
GRAQRNP

SEQ ID NO: 493837 - protein, 7 aa, Mycobacterium
GRAQTTV

SEQ ID NO: 493838 - protein, 7 aa, Mycobacterium
GRARATR

SEQ ID NO: 493839 - protein, 5 aa, Mycobacterium
GRARE

SEQ ID NO: 493840 - protein, 14 aa, Mycobacterium
GRARGDTSNGFPGD

SEQ ID NO: 493841 - protein, 16 aa, Mycobacterium
GRARITTAAGSAEATV

SEQ ID NO: 493842 - protein, 16 aa, Mycobacterium
GRARITTAAGTAEATV

SEQ ID NO: 493843 - protein, 16 aa, Mycobacterium
GRARLTAQDPDPPPTC

SEQ ID NO: 493844 - protein, 14 aa, Mycobacterium
GRARPAAEGVRARL

SEQ ID NO: 493845 - protein, 8 aa, Mycobacterium
GRARQERA

SEQ ID NO: 493846 - protein, 5 aa, Mycobacterium
GRARR

SEQ ID NO: 493847 - protein, 13 aa, Mycobacterium
GRARRPHPKKPKK

SEQ ID NO: 493848 - protein, 10 aa, Mycobacterium
GRARRSGPPI

SEQ ID NO: 493849 - protein, 9 aa, Mycobacterium
GRARRTAPP

SEQ ID NO: 493850 - protein, 5 aa, Mycobacterium
GRARS

SEQ ID NO: 493851 - protein, 16 aa, Mycobacterium
GRARSGNLKPDELSGG

SEQ ID NO: 493852 - protein, 12 aa, Mycobacterium
GRARSYGRDPNR

SEQ ID NO: 493853 - protein, 5 aa, Mycobacterium
GRART

SEQ ID NO: 493854 - protein, 19 aa, Mycobacterium
GRARTARLTPARPAGGDAM

SEQ ID NO: 493855 - protein, 7 aa, Mycobacterium
GRARTGV

SEQ ID NO: 493856 - protein, 7 aa, Mycobacterium
GRARTVS

SEQ ID NO: 493857 - protein, 11 aa, Mycobacterium
GRASANRNGFT

SEQ ID NO: 493858 - protein, 7 aa, Mycobacterium
GRASATR

SEQ ID NO: 493859 - protein, 16 aa, Mycobacterium
GRASDADQAAERARQT

SEQ ID NO: 493860 - protein, 10 aa, Mycobacterium
GRASDFSSGA

SEQ ID NO: 493861 - protein, 9 aa, Mycobacterium
GRASEEGSG

SEQ ID NO: 493862 - protein, 8 aa, Mycobacterium
GRASEYPQ

SEQ ID NO: 493863 - protein, 10 aa, Mycobacterium
GRASGRPRQA

SEQ ID NO: 493864 - protein, 9 aa, Mycobacterium
GRASKAVSD

SEQ ID NO: 493865 - protein, 13 aa, Mycobacterium
GRASKETDPAGAV

SEQ ID NO: 493866 - protein, 10 aa, Mycobacterium
GRASPDAPEL

SEQ ID NO: 493867 - protein, 10 aa, Mycobacterium
GRASPGGLTR

SEQ ID NO: 493868 - protein, 8 aa, Mycobacterium
GRASRAAE

SEQ ID NO: 493869 - protein, 6 aa, Mycobacterium
GRASRG

SEQ ID NO: 493870 - protein, 9 aa, Mycobacterium
GRASSLVPP

SEQ ID NO: 493871 - protein, 10 aa, Mycobacterium
GRASTPGVEV

SEQ ID NO: 493872 - protein, 6 aa, Mycobacterium
GRASVT

SEQ ID NO: 493873 - protein, 13 aa, Mycobacterium
GRATAGLRGNEKL

SEQ ID NO: 493874 - protein, 13 aa, Mycobacterium
GRATAGPDPLGRS

SEQ ID NO: 493875 - protein, 16 aa, Mycobacterium
GRATAGPDPLGRSRAA

SEQ ID NO: 493876 - protein, 17 aa, Mycobacterium
GRATAGPDPLGRTRSAA

SEQ ID NO: 493877 - protein, 7 aa, Mycobacterium
GRATASQ

SEQ ID NO: 493878 - protein, 7 aa, Mycobacterium
GRATCPP

SEQ ID NO: 493879 - protein, 7 aa, Mycobacterium
GRATDPV

SEQ ID NO: 493880 - protein, 7 aa, Mycobacterium
GRATGAG

SEQ ID NO: 493881 - protein, 18 aa, Mycobacterium
GRATGGPDPLGRTRTAAS

SEQ ID NO: 493882 - protein, 16 aa, Mycobacterium
GRATGGPDPLQRARRA

SEQ ID NO: 493883 - protein, 16 aa, Mycobacterium
GRATGGRDPLGRTRRA

SEQ ID NO: 493884 - protein, 34 aa, Mycobacterium; identical to SEQ ID NO: 66145

SEQ ID NO: 493885 - protein, 10 aa, Mycobacterium
GRATGRQVEN

SEQ ID NO: 493886 - protein, 10 aa, Mycobacterium
GRATGVPDRV

SEQ ID NO: 493887 - protein, 11 aa, Mycobacterium
GRATHAGEDIT

SEQ ID NO: 493888 - protein, 7 aa, Mycobacterium
GRATRSH

SEQ ID NO: 493889 - protein, 8 aa, Mycobacterium
GRATRSRT

SEQ ID NO: 493890 - protein, 13 aa, Mycobacterium
GRATSGPDPLGRS

SEQ ID NO: 493891 - protein, 8 aa, Mycobacterium
GRATTHPI

SEQ ID NO: 493892 - protein, 8 aa, Mycobacterium
GRATTSIE

SEQ ID NO: 493893 - protein, 5 aa, Mycobacterium
GRATW

SEQ ID NO: 493894 - protein, 7 aa, Mycobacterium
GRATYGG

SEQ ID NO: 493895 - protein, 4 aa, Mycobacterium
GRAV

SEQ ID NO: 493896 - protein, 7 aa, Mycobacterium
GRAVGPR

SEQ ID NO: 493897 - protein, 6 aa, Mycobacterium
GRAVNP

SEQ ID NO: 493898 - protein, 12 aa, Mycobacterium
GRAVPTDPDTPH

SEQ ID NO: 493899 - protein, 9 aa, Mycobacterium
GRAVRDRRP

SEQ ID NO: 493900 - protein, 9 aa, Mycobacterium
GRAVSPSAV

SEQ ID NO: 493901 - protein, 12 aa, Mycobacterium
GRAVTSTRGQLA

SEQ ID NO: 493902 - protein, 7 aa, Mycobacterium
GRAYGDG

SEQ ID NO: 493903 - protein, 5 aa, Mycobacterium
GRAYI

SEQ ID NO: 493904 - protein, 7 aa, Mycobacterium
GRAYRDG

SEQ ID NO: 493905 - protein, 8 aa, Mycobacterium
GRAYSDVD

SEQ ID NO: 493906 - protein, 13 aa, Mycobacterium
GRAYVGSQARGGG

SEQ ID NO: 493907 - protein, 9 aa, Mycobacterium
GRCEETQDG

SEQ ID NO: 493908 - protein, 10 aa, Mycobacterium
GRCNDGPDVE

SEQ ID NO: 493909 - protein, 7 aa, Mycobacterium
GRCPGDD

SEQ ID NO: 493910 - protein, 13 aa, Mycobacterium
GRCPGDDFGDQVT

SEQ ID NO: 493911 - protein, 6 aa, Mycobacterium
GRCPTC

SEQ ID NO: 493912 - protein, 15 aa, Mycobacterium
GRDAAPDWPSGHDDD

SEQ ID NO: 493913 - protein, 9 aa, Mycobacterium
GRDAARAEL

SEQ ID NO: 493914 - protein, 8 aa, Mycobacterium
GRDAATRQ

SEQ ID NO: 493915 - protein, 11 aa, Mycobacterium
GRDADARTASA

SEQ ID NO: 493916 - protein, 9 aa, Mycobacterium
GRDADAVEQ

SEQ ID NO: 493917 - protein, 7 aa, Mycobacterium
GRDADDE

SEQ ID NO: 493918 - protein, 8 aa, Mycobacterium
GRDADPSI

SEQ ID NO: 493919 - protein, 14 aa, Mycobacterium
GRDAEATRRPHGQH

SEQ ID NO: 493920 - protein, 8 aa, Mycobacterium
GRDAGAGE

SEQ ID NO: 493921 - protein, 8 aa, Mycobacterium
GRDAGELT

SEQ ID NO: 493922 - protein, 12 aa, Mycobacterium
GRDAISEVPADR

SEQ ID NO: 493923 - protein, 5 aa, Mycobacterium
GRDAM

SEQ ID NO: 493924 - protein, 17 aa, Mycobacterium
GRDANGVGVGPDGSGIA

SEQ ID NO: 493925 - protein, 16 aa, Mycobacterium
GRDAPLGSPGGADTVG

SEQ ID NO: 493926 - protein, 32 aa, Mycobacterium
GRDAPPPAGCGRRQPPRRTRPRATREGQGLAA

SEQ ID NO: 493927 - protein, 7 aa, Mycobacterium
GRDAPQA

SEQ ID NO: 493928 - protein, 15 aa, Mycobacterium
GRDAQRGEQAAADIG

SEQ ID NO: 493929 - protein, 6 aa, Mycobacterium
GRDARI

SEQ ID NO: 493930 - protein, 5 aa, Mycobacterium
GRDAT

SEQ ID NO: 493931 - protein, 7 aa, Mycobacterium
GRDATEV

SEQ ID NO: 493932 - protein, 9 aa, Mycobacterium
GRDATEVRA

SEQ ID NO: 493933 - protein, 4 aa, Mycobacterium
GRDC

SEQ ID NO: 493934 - protein, 10 aa, Mycobacterium
GRDDDGANTY

SEQ ID NO: 493935 - protein, 9 aa, Mycobacterium
GRDDDRGTE

SEQ ID NO: 493936 - protein, 10 aa, Mycobacterium
GRDDDRGTET

SEQ ID NO: 493937 - protein, 8 aa, Mycobacterium
GRDDEQIK

SEQ ID NO: 493938 - protein, 6 aa, Mycobacterium
GRDDMN

SEQ ID NO: 493939 - protein, 5 aa, Mycobacterium
GRDDP

SEQ ID NO: 493940 - protein, 7 aa, Mycobacterium
GRDDPWA

SEQ ID NO: 493941 - protein, 22 aa, Mycobacterium
GRDDRAATITAAAADEDRLPDQ

SEQ ID NO: 493942 - protein, 19 aa, Mycobacterium
GRDDTDPPATTAPAGGHTR

SEQ ID NO: 493943 - protein, 5 aa, Mycobacterium
GRDDV

SEQ ID NO: 493944 - protein, 13 aa, Mycobacterium
GRDDVAEHVVFLD

SEQ ID NO: 493945 - protein, 9 aa, Mycobacterium
GRDEATEVA

SEQ ID NO: 493946 - protein, 7 aa, Mycobacterium
GRDELDE

SEQ ID NO: 493947 - protein, 11 aa, Mycobacterium
GRDESAYPNAR

SEQ ID NO: 493948 - protein, 10 aa, Mycobacterium
GRDEVTETAR

SEQ ID NO: 493949 - protein, 6 aa, Mycobacterium
GRDFAA

SEQ ID NO: 493950 - protein, 12 aa, Mycobacterium
GRDGAESTTKAY

SEQ ID NO: 493951 - protein, 8 aa, Mycobacterium
GRDGDHVP

SEQ ID NO: 493952 - protein, 7 aa, Mycobacterium
GRDGDNK

SEQ ID NO: 493953 - protein, 9 aa, Mycobacterium
GRDGDPARA

SEQ ID NO: 493954 - protein, 17 aa, Mycobacterium
GRDGDPARDKATLPEPF

SEQ ID NO: 493955 - protein, 7 aa, Mycobacterium
GRDGDPI

SEQ ID NO: 493956 - protein, 10 aa, Mycobacterium
GRDGHDGEDL

SEQ ID NO: 493957 - protein, 6 aa, Mycobacterium
GRDGHN

SEQ ID NO: 493958 - protein, 10 aa, Mycobacterium
GRDGLPQTAG

SEQ ID NO: 493959 - protein, 6 aa, Mycobacterium
GRDGQS

SEQ ID NO: 493960 - protein, 7 aa, Mycobacterium
GRDGRDV

SEQ ID NO: 493961 - protein, 8 aa, Mycobacterium
GRDGSPED

SEQ ID NO: 493962 - protein, 6 aa, Mycobacterium
GRDGTD

SEQ ID NO: 493963 - protein, 6 aa, Mycobacterium
GRDGTV

SEQ ID NO: 493964 - protein, 18 aa, Mycobacterium
GRDGYDYNQHGRAGNTHA

SEQ ID NO: 493965 - protein, 6 aa, Mycobacterium
GRDHNE

SEQ ID NO: 493966 - protein, 11 aa, Mycobacterium
GRDHPTVAAPR

SEQ ID NO: 493967 - protein, 5 aa, Mycobacterium
GRDHT

SEQ ID NO: 493968 - protein, 8 aa, Mycobacterium
GRDHTPDA

SEQ ID NO: 493969 - protein, 7 aa, Mycobacterium
GRDIDPR

SEQ ID NO: 493970 - protein, 23 aa, Mycobacterium
GRDIPADLPDATPNSAFLFAQKA

SEQ ID NO: 493971 - protein, 9 aa, Mycobacterium
GRDKDSAEA

SEQ ID NO: 493972 - protein, 7 aa, Mycobacterium
GRDKEWP

SEQ ID NO: 493973 - protein, 5 aa, Mycobacterium
GRDKQ

SEQ ID NO: 493974 - protein, 6 aa, Mycobacterium
GRDKRI

SEQ ID NO: 493975 - protein, 4 aa, Mycobacterium
GRDL

SEQ ID NO: 493976 - protein, 5 aa, Mycobacterium
GRDLP

SEQ ID NO: 493977 - protein, 8 aa, Mycobacterium
GRDLPEEY

SEQ ID NO: 493978 - protein, 11 aa, Mycobacterium
GRDLSELPASP

SEQ ID NO: 493979 - protein, 7 aa, Mycobacterium
GRDNGGM

SEQ ID NO: 493980 - protein, 4 aa, Mycobacterium
GRDP

SEQ ID NO: 493981 - protein, 9 aa, Mycobacterium
GRDPAGESD

SEQ ID NO: 493982 - protein, 34 aa, Mycobacterium
GRDPAGGLGERQQQGDRADQPQPTARHARGPHTR

SEQ ID NO: 493983 - protein, 7 aa, Mycobacterium
GRDPAGV

SEQ ID NO: 493984 - protein, 10 aa, Mycobacterium
GRDPAKARQR

SEQ ID NO: 493985 - protein, 11 aa, Mycobacterium
GRDPALRSRET

SEQ ID NO: 493986 - protein, 8 aa, Mycobacterium
GRDPARGA

SEQ ID NO: 493987 - protein, 9 aa, Mycobacterium
GRDPATIER

SEQ ID NO: 493988 - protein, 14 aa, Mycobacterium
GRDPDTAPSPTELR

SEQ ID NO: 493989 - protein, 15 aa, Mycobacterium
GRDPEHNFSASALMD

SEQ ID NO: 493990 - protein, 6 aa, Mycobacterium
GRDPEL

SEQ ID NO: 493991 - protein, 6 aa, Mycobacterium
GRDPEQ

SEQ ID NO: 493992 - protein, 15 aa, Mycobacterium
GRDPERNFSAVGLME

SEQ ID NO: 493993 - protein, 10 aa, Mycobacterium
GRDPGAQSSV

SEQ ID NO: 493994 - protein, 12 aa, Mycobacterium
GRDPGTEMPRLP

SEQ ID NO: 493995 - protein, 9 aa, Mycobacterium
GRDPGTISR

SEQ ID NO: 493996 - protein, 7 aa, Mycobacterium
GRDPIPG

SEQ ID NO: 493997 - protein, 8 aa, Mycobacterium
GRDPMQPR

SEQ ID NO: 493998 - protein, 10 aa, Mycobacterium
GRDPNGFPTT

SEQ ID NO: 493999 - protein, 8 aa, Mycobacterium
GRDPNPHL

SEQ ID NO: 494000 - protein, 5 aa, Mycobacterium
GRDPR

SEQ ID NO: 494001 - protein, 7 aa, Mycobacterium
GRDPRAA

SEQ ID NO: 494002 - protein, 10 aa, Mycobacterium
GRDPRAAAQG

SEQ ID NO: 494003 - protein, 9 aa, Mycobacterium
GRDPRASGE

SEQ ID NO: 494004 - protein, 8 aa, Mycobacterium
GRDPRIGG

SEQ ID NO: 494005 - protein, 7 aa, Mycobacterium
GRDPTEL

SEQ ID NO: 494006 - protein, 14 aa, Mycobacterium
GRDPVAGADPQTVD

SEQ ID NO: 494007 - protein, 9 aa, Mycobacterium
GRDPYHPNQ

SEQ ID NO: 494008 - protein, 6 aa, Mycobacterium
GRDPYP

SEQ ID NO: 494009 - protein, 6 aa, Mycobacterium
GRDPYS

SEQ ID NO: 494010 - protein, 11 aa, Mycobacterium
GRDQGGSLQAG

SEQ ID NO: 494011 - protein, 5 aa, Mycobacterium
GRDQL

SEQ ID NO: 494012 - protein, 8 aa, Mycobacterium
GRDQPGVT

SEQ ID NO: 494013 - protein, 8 aa, Mycobacterium
GRDQPSAR

SEQ ID NO: 494014 - protein, 5 aa, Mycobacterium
GRDQQ

SEQ ID NO: 494015 - protein, 15 aa, Mycobacterium
GRDQVNPQAGRDAAK

SEQ ID NO: 494016 - protein, 14 aa, Mycobacterium
GRDQVNPQASRDAA

SEQ ID NO: 494017 - protein, 8 aa, Mycobacterium
GRDRAPLG

SEQ ID NO: 494018 - protein, 14 aa, Mycobacterium
GRDRASGAIRTAHG

SEQ ID NO: 494019 - protein, 26 aa, Mycobacterium
GRDRDAHHDYSAPPYPGQAASFIAGL

SEQ ID NO: 494020 - protein, 6 aa, Mycobacterium
GRDRDH

SEQ ID NO: 494021 - protein, 7 aa, Mycobacterium
GRDRDRS

SEQ ID NO: 494022 - protein, 6 aa, Mycobacterium
GRDRGE

SEQ ID NO: 494023 - protein, 8 aa, Mycobacterium
GRDRGVDA

SEQ ID NO: 494024 - protein, 7 aa, Mycobacterium
GRDRGVR

SEQ ID NO: 494025 - protein, 9 aa, Mycobacterium
GRDRHPSWS

SEQ ID NO: 494026 - protein, 12 aa, Mycobacterium
GRDRNEALARSR

SEQ ID NO: 494027 - protein, 12 aa, Mycobacterium
GRDRTFTETARR

SEQ ID NO: 494028 - protein, 12 aa, Mycobacterium
GRDRTGQGTRVE

SEQ ID NO: 494029 - protein, 5 aa, Mycobacterium
GRDSE

SEQ ID NO: 494030 - protein, 7 aa, Mycobacterium
GRDSETL

SEQ ID NO: 494031 - protein, 7 aa, Mycobacterium
GRDSGAR

SEQ ID NO: 494032 - protein, 7 aa, Mycobacterium
GRDSGLD

SEQ ID NO: 494033 - protein, 8 aa, Mycobacterium
GRDSPQTR

SEQ ID NO: 494034 - protein, 5 aa, Mycobacterium
GRDTA

SEQ ID NO: 494035 - protein, 8 aa, Mycobacterium
GRDTAGRR

SEQ ID NO: 494036 - protein, 10 aa, Mycobacterium
GRDTEDDVPP

SEQ ID NO: 494037 - protein, 5 aa, Mycobacterium
GRDTF

SEQ ID NO: 494038 - protein, 10 aa, Mycobacterium
GRDTGTRVGD

SEQ ID NO: 494039 - protein, 7 aa, Mycobacterium
GRDTGVP

SEQ ID NO: 494040 - protein, 9 aa, Mycobacterium
GRDTPAAGW

SEQ ID NO: 494041 - protein, 8 aa, Mycobacterium
GRDTQPHI

SEQ ID NO: 494042 - protein, 12 aa, Mycobacterium
GRDTSKGRALHR

SEQ ID NO: 494043 - protein, 22 aa, Mycobacterium
GRDTTAARGLTGAGRAGENADL

SEQ ID NO: 494044 - protein, 17 aa, Mycobacterium
GRDTTLDVPSKHTEGYP

SEQ ID NO: 494045 - protein, 17 aa, Mycobacterium
GRDTTLDVPTKQTTGYP

SEQ ID NO: 494046 - protein, 6 aa, Mycobacterium
GRDTVS

SEQ ID NO: 494047 - protein, 13 aa, Mycobacterium
GRDVASDPPHKRP

SEQ ID NO: 494048 - protein, 28 aa, Mycobacterium
GRDVDPSTYGAQRHPRTDEPDTDSRARD

SEQ ID NO: 494049 - protein, 17 aa, Mycobacterium
GRDVSAEPGAGAAGGIG

SEQ ID NO: 494050 - protein, 9 aa, Mycobacterium
GRDYHDDPD

SEQ ID NO: 494051 - protein, 10 aa, Mycobacterium
GREAARRGLT

SEQ ID NO: 494052 - protein, 5 aa, Mycobacterium
GREAD

SEQ ID NO: 494053 - protein, 5 aa, Mycobacterium
GREAE

SEQ ID NO: 494054 - protein, 30 aa, Mycobacterium
GREALGGRPFGDGAPPGPPVEGERVLAGHG

SEQ ID NO: 494055 - protein, 31 aa, Mycobacterium
GREALGGRPFGDGTPPGPTRDGERVPAGHGA

SEQ ID NO: 494056 - protein, 14 aa, Mycobacterium
GREARARTRLKEGD

SEQ ID NO: 494057 - protein, 13 aa, Mycobacterium
GREARARTRLTEG

SEQ ID NO: 494058 - protein, 14 aa, Mycobacterium
GREARARTRMKEGD

SEQ ID NO: 494059 - protein, 8 aa, Mycobacterium
GREARSRG

SEQ ID NO: 494060 - protein, 17 aa, Mycobacterium
GREASDEELAEESGIPV

SEQ ID NO: 494061 - protein, 16 aa, Mycobacterium
GREATDEELAAESGIP

SEQ ID NO: 494062 - protein, 8 aa, Mycobacterium
GREATEPM

SEQ ID NO: 494063 - protein, 5 aa, Mycobacterium
GREAV

SEQ ID NO: 494064 - protein, 15 aa, Mycobacterium
GREDELAADPDARAR

SEQ ID NO: 494065 - protein, 7 aa, Mycobacterium
GREDETA

SEQ ID NO: 494066 - protein, 6 aa, Mycobacterium
GREDGG

SEQ ID NO: 494067 - protein, 6 aa, Mycobacterium
GREDLD

SEQ ID NO: 494068 - protein, 8 aa, Mycobacterium
GREDPDYS

SEQ ID NO: 494069 - protein, 7 aa, Mycobacterium
GREDPWA

SEQ ID NO: 494070 - protein, 7 aa, Mycobacterium
GREEAEA

SEQ ID NO: 494071 - protein, 9 aa, Mycobacterium
GREEAEAEI

SEQ ID NO: 494072 - protein, 11 aa, Mycobacterium
GREEATETAAR

SEQ ID NO: 494073 - protein, 12 aa, Mycobacterium
GREEATETARRV

SEQ ID NO: 494074 - protein, 4 aa, Mycobacterium
GREG

SEQ ID NO: 494075 - protein, 7 aa, Mycobacterium
GREGAGD

SEQ ID NO: 494076 - protein, 5 aa, Mycobacterium
GREGD

SEQ ID NO: 494077 - protein, 6 aa, Mycobacterium
GREGDA

SEQ ID NO: 494078 - protein, 6 aa, Mycobacterium
GREGDG

SEQ ID NO: 494079 - protein, 10 aa, Mycobacterium
GREGGSTPTA

SEQ ID NO: 494080 - protein, 10 aa, Mycobacterium
GREGGTTPTT

SEQ ID NO: 494081 - protein, 5 aa, Mycobacterium
GREGI

SEQ ID NO: 494082 - protein, 12 aa, Mycobacterium
GREGLAKGRLPA

SEQ ID NO: 494083 - protein, 6 aa, Mycobacterium
GREGRD

SEQ ID NO: 494084 - protein, 14 aa, Mycobacterium
GREGSPELPPGSTI

SEQ ID NO: 494085 - protein, 8 aa, Mycobacterium
GREGTDGY

SEQ ID NO: 494086 - protein, 5 aa, Mycobacterium
GREGV

SEQ ID NO: 494087 - protein, 4 aa, Mycobacterium
GREH

SEQ ID NO: 494088 - protein, 11 aa, Mycobacterium
GREHGSEPTAY

SEQ ID NO: 494089 - protein, 9 aa, Mycobacterium
GREHPTVAA

SEQ ID NO: 494090 - protein, 12 aa, Mycobacterium
GREHPTVAAPRT

SEQ ID NO: 494091 - protein, 16 aa, Mycobacterium
GREHSKSFARKPDAQQ

SEQ ID NO: 494092 - protein, 4 aa, Mycobacterium
GREI

SEQ ID NO: 494093 - protein, 9 aa, Mycobacterium
GREIDEATA

SEQ ID NO: 494094 - protein, 7 aa, Mycobacterium
GRELDKA

SEQ ID NO: 494095 - protein, 11 aa, Mycobacterium
GRELDTESAQF

SEQ ID NO: 494096 - protein, 7 aa, Mycobacterium
GRELEKN

SEQ ID NO: 494097 - protein, 5 aa, Mycobacterium
GRELG

SEQ ID NO: 494098 - protein, 5 aa, Mycobacterium
GRELP

SEQ ID NO: 494099 - protein, 7 aa, Mycobacterium
GRELPDV

SEQ ID NO: 494100 - protein, 19 aa, Mycobacterium
GRELPPPQQARMRDSQRAG

SEQ ID NO: 494101 - protein, 4 aa, Mycobacterium
GREN

SEQ ID NO: 494102 - protein, 11 aa, Mycobacterium
GRENDPQTGDD

SEQ ID NO: 494103 - protein, 19 aa, Mycobacterium
GRENPTRSAGIESAVPGLR

SEQ ID NO: 494104 - protein, 11 aa, Mycobacterium
GREPDAVRDAT

SEQ ID NO: 494105 - protein, 6 aa, Mycobacterium
GREPEI

SEQ ID NO: 494106 - protein, 7 aa, Mycobacterium
GREPGGE

SEQ ID NO: 494107 - protein, 6 aa, Mycobacterium
GREPIT

SEQ ID NO: 494108 - protein, 5 aa, Mycobacterium
GREPP

SEQ ID NO: 494109 - protein, 6 aa, Mycobacterium
GREPPI

SEQ ID NO: 494110 - protein, 10 aa, Mycobacterium
GREPQGPFAA

SEQ ID NO: 494111 - protein, 7 aa, Mycobacterium
GREPSDR

SEQ ID NO: 494112 - protein, 8 aa, Mycobacterium
GREPTRAS

SEQ ID NO: 494113 - protein, 10 aa, Mycobacterium
GREPTSAADW

SEQ ID NO: 494114 - protein, 7 aa, Mycobacterium
GREPTTV

SEQ ID NO: 494115 - protein, 6 aa, Mycobacterium
GREPVG

SEQ ID NO: 494116 - protein, 6 aa, Mycobacterium
GREPVS

SEQ ID NO: 494117 - protein, 7 aa, Mycobacterium
GREPYPV

SEQ ID NO: 494118 - protein, 8 aa, Mycobacterium
GREQETND

SEQ ID NO: 494119 - protein, 5 aa, Mycobacterium
GREQF

SEQ ID NO: 494120 - protein, 6 aa, Mycobacterium
GREQSL

SEQ ID NO: 494121 - protein, 5 aa, Mycobacterium
GREQT

SEQ ID NO: 494122 - protein, 8 aa, Mycobacterium
GRERASDD

SEQ ID NO: 494123 - protein, 9 aa, Mycobacterium
GRERASDDL

SEQ ID NO: 494124 - protein, 5 aa, Mycobacterium
GRERD

SEQ ID NO: 494125 - protein, 8 aa, Mycobacterium
GRERDGKA

SEQ ID NO: 494126 - protein, 5 aa, Mycobacterium
GRERE

SEQ ID NO: 494127 - protein, 5 aa, Mycobacterium
GRERF

SEQ ID NO: 494128 - protein, 9 aa, Mycobacterium
GRERHPSWS

SEQ ID NO: 494129 - protein, 5 aa, Mycobacterium
GRERI

SEQ ID NO: 494130 - protein, 5 aa, Mycobacterium
GRERL

SEQ ID NO: 494131 - protein, 5 aa, Mycobacterium
GRERP

SEQ ID NO: 494132 - protein, 4 aa, Mycobacterium
GRES

SEQ ID NO: 494133 - protein, 5 aa, Mycobacterium
GRESA

SEQ ID NO: 494134 - protein, 7 aa, Mycobacterium
GRESDGA

SEQ ID NO: 494135 - protein, 7 aa, Mycobacterium
GRESEDA

SEQ ID NO: 494136 - protein, 17 aa, Mycobacterium
GRESGPPQAAGAPAAPT

SEQ ID NO: 494137 - protein, 9 aa, Mycobacterium
GRESGSAPT

SEQ ID NO: 494138 - protein, 6 aa, Mycobacterium
GRESGT

SEQ ID NO: 494139 - protein, 5 aa, Mycobacterium
GRESL

SEQ ID NO: 494140 - protein, 4 aa, Mycobacterium
GRET

SEQ ID NO: 494141 - protein, 13 aa, Mycobacterium
GRETAGPMAGSAD

SEQ ID NO: 494142 - protein, 7 aa, Mycobacterium
GRETAIP

SEQ ID NO: 494143 - protein, 11 aa, Mycobacterium
GRETDKLERAA

SEQ ID NO: 494144 - protein, 5 aa, Mycobacterium
GRETF

SEQ ID NO: 494145 - protein, 8 aa, Mycobacterium
GRETLGDT

SEQ ID NO: 494146 - protein, 9 aa, Mycobacterium
GRETQPDIP

SEQ ID NO: 494147 - protein, 8 aa, Mycobacterium
GRETQPHI

SEQ ID NO: 494148 - protein, 6 aa, Mycobacterium
GRETRT

SEQ ID NO: 494149 - protein, 8 aa, Mycobacterium
GRETVGDS

SEQ ID NO: 494150 - protein, 9 aa, Mycobacterium
GRETYGSDL

SEQ ID NO: 494151 - protein, 8 aa, Mycobacterium
GREVEATA

SEQ ID NO: 494152 - protein, 18 aa, Mycobacterium
GREVGASDSYGDAGSRQQ

SEQ ID NO: 494153 - protein, 12 aa, Mycobacterium
GREVGGGDSRCE

SEQ ID NO: 494154 - protein, 11 aa, Mycobacterium
GREVGGGEERC

SEQ ID NO: 494155 - protein, 11 aa, Mycobacterium
GREVGGGETRC

SEQ ID NO: 494156 - protein, 9 aa, Mycobacterium
GREVNTAGD

SEQ ID NO: 494157 - protein, 9 aa, Mycobacterium
GREVNTSGD

SEQ ID NO: 494158 - protein, 5 aa, Mycobacterium
GREYA

SEQ ID NO: 494159 - protein, 18 aa, Mycobacterium
GREYPGELSGNPDRKPRR

SEQ ID NO: 494160 - protein, 7 aa, Mycobacterium
GREYRRS

SEQ ID NO: 494161 - protein, 9 aa, Mycobacterium
GRFANDEQL

SEQ ID NO: 494162 - protein, 7 aa, Mycobacterium
GRFARDG

SEQ ID NO: 494163 - protein, 6 aa, Mycobacterium
GRFDEN

SEQ ID NO: 494164 - protein, 6 aa, Mycobacterium
GRFDEQ

SEQ ID NO: 494165 - protein, 6 aa, Mycobacterium
GRFDPG

SEQ ID NO: 494166 - protein, 5 aa, Mycobacterium
GRFGA

SEQ ID NO: 494167 - protein, 6 aa, Mycobacterium
GRFGRR

SEQ ID NO: 494168 - protein, 7 aa, Mycobacterium
GRFGSRT

SEQ ID NO: 494169 - protein, 11 aa, Mycobacterium
GRFPADEPLND

SEQ ID NO: 494170 - protein, 5 aa, Mycobacterium
GRFPD

SEQ ID NO: 494171 - protein, 8 aa, Mycobacterium
GRFPDSEL

SEQ ID NO: 494172 - protein, 6 aa, Mycobacterium
GRFPPA

SEQ ID NO: 494173 - protein, 21 aa, Mycobacterium
GRFPSSSTLTALESSGGALAE

SEQ ID NO: 494174 - protein, 24 aa, Mycobacterium
GRFRADPSKIDAIGGQRARVRTGS

SEQ ID NO: 494175 - protein, 15 aa, Mycobacterium
GRFRTPSLRQPGGRL

SEQ ID NO: 494176 - protein, 12 aa, Mycobacterium
GRGADGELPPNN

SEQ ID NO: 494177 - protein, 10 aa, Mycobacterium
GRGADGTNTY

SEQ ID NO: 494178 - protein, 9 aa, Mycobacterium
GRGADGVNT

SEQ ID NO: 494179 - protein, 12 aa, Mycobacterium
GRGADRPNGPDG

SEQ ID NO: 494180 - protein, 10 aa, Mycobacterium
GRGAGADLPG

SEQ ID NO: 494181 - protein, 11 aa, Mycobacterium
GRGAGEPDSAS

SEQ ID NO: 494182 - protein, 9 aa, Mycobacterium
GRGAGPGES

SEQ ID NO: 494183 - protein, 22 aa, Mycobacterium
GRGAHEGRTALSAPGGTRVGEK

SEQ ID NO: 494184 - protein, 5 aa, Mycobacterium
GRGAK

SEQ ID NO: 494185 - protein, 14 aa, Mycobacterium
GRGAPSGLFPRNGD

SEQ ID NO: 494186 - protein, 23 aa, Mycobacterium
GRGAQEGRSALSAPGGGTRVGEK

SEQ ID NO: 494187 - protein, 23 aa, Mycobacterium
GRGAQEGRTAFSAPGGGTRVGER

SEQ ID NO: 494188 - protein, 12 aa, Mycobacterium
GRGARAASTAEE

SEQ ID NO: 494189 - protein, 22 aa, Mycobacterium
GRGAREGRTAFSAPGGGTRVGE

SEQ ID NO: 494190 - protein, 49 aa, Mycobacterium
GRGARRGDRSFPGRDRGGVRGGGAVAGGRRARGGAAQPAAGRPVGRGRH

SEQ ID NO: 494191 - protein, 9 aa, Mycobacterium
GRGARTITS

SEQ ID NO: 494192 - protein, 7 aa, Mycobacterium
GRGARTV

SEQ ID NO: 494193 - protein, 9 aa, Mycobacterium
GRGARTVPD

SEQ ID NO: 494194 - protein, 13 aa, Mycobacterium
GRGATRRANSAVP

SEQ ID NO: 494195 - protein, 7 aa, Mycobacterium
GRGATVA

SEQ ID NO: 494196 - protein, 12 aa, Mycobacterium
GRGDASERYLTP

SEQ ID NO: 494197 - protein, 17 aa, Mycobacterium
GRGDDDYKRRAKTGETV

SEQ ID NO: 494198 - protein, 6 aa, Mycobacterium
GRGDDI

SEQ ID NO: 494199 - protein, 6 aa, Mycobacterium
GRGDDL

SEQ ID NO: 494200 - protein, 5 aa, Mycobacterium
GRGDI

SEQ ID NO: 494201 - protein, 6 aa, Mycobacterium
GRGDNM

SEQ ID NO: 494202 - protein, 9 aa, Mycobacterium
GRGDPDEIS

SEQ ID NO: 494203 - protein, 5 aa, Mycobacterium
GRGDR

SEQ ID NO: 494204 - protein, 6 aa, Mycobacterium
GRGDRA

SEQ ID NO: 494205 - protein, 11 aa, Mycobacterium
GRGDREQDARA

SEQ ID NO: 494206 - protein, 6 aa, Mycobacterium
GRGDRG

SEQ ID NO: 494207 - protein, 13 aa, Mycobacterium
GRGDRRGPVGRGE

SEQ ID NO: 494208 - protein, 9 aa, Mycobacterium
GRGDRRRAT

SEQ ID NO: 494209 - protein, 9 aa, Mycobacterium
GRGDRTWEQ

SEQ ID NO: 494210 - protein, 6 aa, Mycobacterium
GRGDSA

SEQ ID NO: 494211 - protein, 19 aa, Mycobacterium
GRGDSAVRTLSGKPSSLAT

SEQ ID NO: 494212 - protein, 17 aa, Mycobacterium
GRGDSAVRVTGGTPTTL

SEQ ID NO: 494213 - protein, 6 aa, Mycobacterium
GRGDSE

SEQ ID NO: 494214 - protein, 7 aa, Mycobacterium
GRGDTCA

SEQ ID NO: 494215 - protein, 9 aa, Mycobacterium
GRGDTYAAG

SEQ ID NO: 494216 - protein, 5 aa, Mycobacterium
GRGEE

SEQ ID NO: 494217 - protein, 7 aa, Mycobacterium
GRGEGHE

SEQ ID NO: 494218 - protein, 15 aa, Mycobacterium
GRGELAEAAARQAGT

SEQ ID NO: 494219 - protein, 8 aa, Mycobacterium
GRGELGGL

SEQ ID NO: 494220 - protein, 18 aa, Mycobacterium
GRGENPGLSQVQDDPPTR

SEQ ID NO: 494221 - protein, 8 aa, Mycobacterium
GRGEPDRA

SEQ ID NO: 494222 - protein, 8 aa, Mycobacterium
GRGEPSDD

SEQ ID NO: 494223 - protein, 9 aa, Mycobacterium
GRGEQERPP

SEQ ID NO: 494224 - protein, 5 aa, Mycobacterium
GRGER

SEQ ID NO: 494225 - protein, 8 aa, Mycobacterium
GRGERLPA

SEQ ID NO: 494226 - protein, 13 aa, Mycobacterium
GRGERSDGGEQRG

SEQ ID NO: 494227 - protein, 7 aa, Mycobacterium
GRGERTS

SEQ ID NO: 494228 - protein, 7 aa, Mycobacterium
GRGETGP

SEQ ID NO: 494229 - protein, 18 aa, Mycobacterium
GRGETPGLSQVQDDPATR

SEQ ID NO: 494230 - protein, 18 aa, Mycobacterium
GRGETPGLSQVQDDPPTR

SEQ ID NO: 494231 - protein, 14 aa, Mycobacterium
GRGEYTTGRGPTPF

SEQ ID NO: 494232 - protein, 9 aa, Mycobacterium
GRGFGGSSA

SEQ ID NO: 494233 - protein, 8 aa, Mycobacterium
GRGFNAGA

SEQ ID NO: 494234 - protein, 18 aa, Mycobacterium
GRGFSSGADHKSAGSVPH

SEQ ID NO: 494235 - protein, 28 aa, Mycobacterium
GRGGAGGAGGAGTAAGAGAAGGAGGRGG

SEQ ID NO: 494236 - protein, 6 aa, Mycobacterium
GRGGAP

SEQ ID NO: 494237 - protein, 7 aa, Mycobacterium
GRGGAPA

SEQ ID NO: 494238 - protein, 11 aa, Mycobacterium
GRGGAPARDGA

SEQ ID NO: 494239 - protein, 22 aa, Mycobacterium
GRGGASPNPIQSRPSVVPRTGI

SEQ ID NO: 494240 - protein, 113 aa, Mycobacterium
GRGGDGGDGGQGGYGGAGSFEQPGGTGGAGGTGGTGGNSGTGGTSGNGGTGGTGGGGGYGGPGDYNENGYAGGSGGTGGTGGDPGTGGTAAVGGDGGTGGIGGGGGYGGTGFD

SEQ ID NO: 494241 - protein, 65 aa, Mycobacterium
GRGGDGGVGGDATIAGGPGGNGGAGGANGLIGGGNGGAGGAGGAGAPGGDIAGGTGGAGGIGGAN

SEQ ID NO: 494242 - protein, 11 aa, Mycobacterium
GRGGDGSAATF

SEQ ID NO: 494243 - protein, 7 aa, Mycobacterium
GRGGFTP

SEQ ID NO: 494244 - protein, 8 aa, Mycobacterium
GRGGGGAS

SEQ ID NO: 494245 - protein, 6 aa, Mycobacterium
GRGGGT

SEQ ID NO: 494246 - protein, 11 aa, Mycobacterium
GRGGGTGSAPT

SEQ ID NO: 494247 - protein, 16 aa, Mycobacterium
GRGGGTTYKLPEGSFE

SEQ ID NO: 494248 - protein, 9 aa, Mycobacterium
GRGGHAQRA

SEQ ID NO: 494249 - protein, 5 aa, Mycobacterium
GRGGL

SEQ ID NO: 494250 - protein, 6 aa, Mycobacterium
GRGGNA

SEQ ID NO: 494251 - protein, 7 aa, Mycobacterium
GRGGNGA

SEQ ID NO: 494252 - protein, 29 aa, Mycobacterium
GRGGNGGAGGTGVAGGAGGNGGSGGANGL

SEQ ID NO: 494253 - protein, 34 aa, Mycobacterium
GRGGNGGLGGTGADGASGQAGSAGGAGGNGGAGG

SEQ ID NO: 494254 - protein, 131 aa, Mycobacterium
GRGGNGGNGAIGPGGDGGDGGDAPNQQRVSSSSPGYEGADGGNGGNGTIGGNGGNGGTGGPGYDASLGGEATAGGEGGDGGDGGKGFNGAGGAGGDGGAGGAGGSGAPAPFGSGGAYGGTGGQGGTGGSGV

SEQ ID NO: 494255 - protein, 6 aa, Mycobacterium
GRGGPQ

SEQ ID NO: 494256 - protein, 7 aa, Mycobacterium
GRGGQDL

SEQ ID NO: 494257 - protein, 8 aa, Mycobacterium
GRGGQSLR

SEQ ID NO: 494258 - protein, 6 aa, Mycobacterium
GRGGQV

SEQ ID NO: 494259 - protein, 5 aa, Mycobacterium
GRGGR

SEQ ID NO: 494260 - protein, 19 aa, Mycobacterium
GRGGRAVGPRRGDRRDRSS

SEQ ID NO: 494261 - protein, 6 aa, Mycobacterium
GRGGRT

SEQ ID NO: 494262 - protein, 16 aa, Mycobacterium
GRGGRVDAELERQAER

SEQ ID NO: 494263 - protein, 6 aa, Mycobacterium
GRGGSH

SEQ ID NO: 494264 - protein, 8 aa, Mycobacterium
GRGGSTPL

SEQ ID NO: 494265 - protein, 16 aa, Mycobacterium
GRGGTEAPASSDDVPP

SEQ ID NO: 494266 - protein, 37 aa, Mycobacterium
GRGGTTTGTGTTGGAAGTGGASGGGGAGSGAATGGFN

SEQ ID NO: 494267 - protein, 6 aa, Mycobacterium
GRGGVA

SEQ ID NO: 494268 - protein, 9 aa, Mycobacterium
GRGGVAPDQ

SEQ ID NO: 494269 - protein, 7 aa, Mycobacterium
GRGGVDV

SEQ ID NO: 494270 - protein, 13 aa, Mycobacterium
GRGHGPVSPLFRL

SEQ ID NO: 494271 - protein, 11 aa, Mycobacterium
GRGHPGGPTGL

SEQ ID NO: 494272 - protein, 12 aa, Mycobacterium
GRGIAEDPAWGT

SEQ ID NO: 494273 - protein, 17 aa, Mycobacterium
GRGIDTPPGARNPEDRI

SEQ ID NO: 494274 - protein, 6 aa, Mycobacterium
GRGIGA

SEQ ID NO: 494275 - protein, 6 aa, Mycobacterium
GRGIGR

SEQ ID NO: 494276 - protein, 6 aa, Mycobacterium
GRGIPD

SEQ ID NO: 494277 - protein, 6 aa, Mycobacterium
GRGIPP

SEQ ID NO: 494278 - protein, 5 aa, Mycobacterium
GRGKA

SEQ ID NO: 494279 - protein, 10 aa, Mycobacterium
GRGKDESAAV

SEQ ID NO: 494280 - protein, 11 aa, Mycobacterium
GRGKGEVSRAD

SEQ ID NO: 494281 - protein, 8 aa, Mycobacterium
GRGKLTAR

SEQ ID NO: 494282 - protein, 7 aa, Mycobacterium
GRGKNHA

SEQ ID NO: 494283 - protein, 5 aa, Mycobacterium
GRGKR

SEQ ID NO: 494284 - protein, 6 aa, Mycobacterium
GRGKRI

SEQ ID NO: 494285 - protein, 7 aa, Mycobacterium
GRGLGTA

SEQ ID NO: 494286 - protein, 16 aa, Mycobacterium
GRGLPPEPAYTGDTDE

SEQ ID NO: 494287 - protein, 7 aa, Mycobacterium
GRGLPQR

SEQ ID NO: 494288 - protein, 8 aa, Mycobacterium
GRGLRPSA

SEQ ID NO: 494289 - protein, 5 aa, Mycobacterium
GRGLT

SEQ ID NO: 494290 - protein, 4 aa, Mycobacterium
GRGM

SEQ ID NO: 494291 - protein, 8 aa, Mycobacterium
GRGMGESK

SEQ ID NO: 494292 - protein, 8 aa, Mycobacterium
GRGMTEST

SEQ ID NO: 494293 - protein, 5 aa, Mycobacterium
GRGNA

SEQ ID NO: 494294 - protein, 10 aa, Mycobacterium
GRGNADEARQ

SEQ ID NO: 494295 - protein, 59 aa, Mycobacterium
GRGPAAEGGRRTGGAAAARRAAPAPGAAAAGSRADDRRRARRRAAGAGGDRHRHPRRAR

SEQ ID NO: 494296 - protein, 7 aa, Mycobacterium
GRGPAAN

SEQ ID NO: 494297 - protein, 12 aa, Mycobacterium
GRGPDFKDGGYQ

SEQ ID NO: 494298 - protein, 12 aa, Mycobacterium
GRGPDGAQPPNN

SEQ ID NO: 494299 - protein, 12 aa, Mycobacterium
GRGPDGSLPPNN

SEQ ID NO: 494300 - protein, 7 aa, Mycobacterium
GRGPEEF

SEQ ID NO: 494301 - protein, 20 aa, Mycobacterium
GRGPGGSGAAPATVTRSPDL

SEQ ID NO: 494302 - protein, 12 aa, Mycobacterium
GRGPGGVRPPNN

SEQ ID NO: 494303 - protein, 15 aa, Mycobacterium
GRGPGHADVRWVVET

SEQ ID NO: 494304 - protein, 22 aa, Mycobacterium
GRGPGSGVPARPNAEAANNKNP

SEQ ID NO: 494305 - protein, 6 aa, Mycobacterium
GRGPGY

SEQ ID NO: 494306 - protein, 5 aa, Mycobacterium
GRGPI

SEQ ID NO: 494307 - protein, 5 aa, Mycobacterium
GRGPL

SEQ ID NO: 494308 - protein, 6 aa, Mycobacterium
GRGPNE

SEQ ID NO: 494309 - protein, 10 aa, Mycobacterium
GRGPNSPQVP

SEQ ID NO: 494310 - protein, 10 aa, Mycobacterium
GRGPRADSEI

SEQ ID NO: 494311 - protein, 14 aa, Mycobacterium
GRGPVPDDRTAADI

SEQ ID NO: 494312 - protein, 8 aa, Mycobacterium
GRGQADDQ

SEQ ID NO: 494313 - protein, 6 aa, Mycobacterium
GRGQDV

SEQ ID NO: 494314 - protein, 19 aa, Mycobacterium
GRGQRRQVRSRSAVPEGEQ

SEQ ID NO: 494315 - protein, 7 aa, Mycobacterium
GRGQWAP

SEQ ID NO: 494316 - protein, 5 aa, Mycobacterium
GRGRA

SEQ ID NO: 494317 - protein, 9 aa, Mycobacterium
GRGRADDTD

SEQ ID NO: 494318 - protein, 10 aa, Mycobacterium
GRGRADDTDD

SEQ ID NO: 494319 - protein, 21 aa, Mycobacterium
GRGRDADKPALLGSAKSNFGH

SEQ ID NO: 494320 - protein, 8 aa, Mycobacterium
GRGREADG

SEQ ID NO: 494321 - protein, 7 aa, Mycobacterium
GRGREAE

SEQ ID NO: 494322 - protein, 8 aa, Mycobacterium
GRGREAGQ

SEQ ID NO: 494323 - protein, 5 aa, Mycobacterium
GRGRG

SEQ ID NO: 494324 - protein, 6 aa, Mycobacterium
GRGRGG

SEQ ID NO: 494325 - protein, 6 aa, Mycobacterium
GRGRGR

SEQ ID NO: 494326 - protein, 44 aa, Mycobacterium
GRGRGRGRSSRGLRGGRLGRRGLRGGRRAGCRSAGLGGRGRRRA

SEQ ID NO: 494327 - protein, 10 aa, Mycobacterium
GRGRHTSTQS

SEQ ID NO: 494328 - protein, 6 aa, Mycobacterium
GRGRIS

SEQ ID NO: 494329 - protein, 10 aa, Mycobacterium
GRGRKRSEAL

SEQ ID NO: 494330 - protein, 9 aa, Mycobacterium
GRGRPEESP

SEQ ID NO: 494331 - protein, 6 aa, Mycobacterium
GRGRPR

SEQ ID NO: 494332 - protein, 5 aa, Mycobacterium
GRGRR

SEQ ID NO: 494333 - protein, 5 aa, Mycobacterium
GRGRS

SEQ ID NO: 494334 - protein, 5 aa, Mycobacterium
GRGRT

SEQ ID NO: 494335 - protein, 10 aa, Mycobacterium
GRGRTGSGKT

SEQ ID NO: 494336 - protein, 9 aa, Mycobacterium
GRGRTPDEV

SEQ ID NO: 494337 - protein, 15 aa, Mycobacterium
GRGRYGPGYLPRSTE

SEQ ID NO: 494338 - protein, 15 aa, Mycobacterium
GRGRYPDGKPASGEQ

SEQ ID NO: 494339 - protein, 4 aa, Mycobacterium
GRGS

SEQ ID NO: 494340 - protein, 7 aa, Mycobacterium
GRGSAAA

SEQ ID NO: 494341 - protein, 10 aa, Mycobacterium
GRGSAGRSKA

SEQ ID NO: 494342 - protein, 6 aa, Mycobacterium
GRGSGA

SEQ ID NO: 494343 - protein, 10 aa, Mycobacterium
GRGSGDPLVP

SEQ ID NO: 494344 - protein, 8 aa, Mycobacterium
GRGSGQDG

SEQ ID NO: 494345 - protein, 16 aa, Mycobacterium
GRGSPQGLAASKALTT

SEQ ID NO: 494346 - protein, 8 aa, Mycobacterium
GRGSPQNL

SEQ ID NO: 494347 - protein, 7 aa, Mycobacterium
GRGSQWA

SEQ ID NO: 494348 - protein, 9 aa, Mycobacterium
GRGSSDPAA

SEQ ID NO: 494349 - protein, 19 aa, Mycobacterium
GRGTAMAEGDNAIAPDEGA

SEQ ID NO: 494350 - protein, 32 aa, Mycobacterium
GRGTDARLERSERTGAAERKAARRQRRERGDE

SEQ ID NO: 494351 - protein, 8 aa, Mycobacterium
GRGTETPD

SEQ ID NO: 494352 - protein, 10 aa, Mycobacterium
GRGTETPEAM

SEQ ID NO: 494353 - protein, 9 aa, Mycobacterium
GRGTETPEV

SEQ ID NO: 494354 - protein, 5 aa, Mycobacterium
GRGTF

SEQ ID NO: 494355 - protein, 18 aa, Mycobacterium
GRGTFQKDKGKGLDPERL

SEQ ID NO: 494356 - protein, 13 aa, Mycobacterium
GRGTNGRQTRTRS

SEQ ID NO: 494357 - protein, 9 aa, Mycobacterium
GRGTNRRVD

SEQ ID NO: 494358 - protein, 19 aa, Mycobacterium
GRGTRRRPSSGWGSLTPTE

SEQ ID NO: 494359 - protein, 8 aa, Mycobacterium
GRGTTDGV

SEQ ID NO: 494360 - protein, 20 aa, Mycobacterium
GRGVARDRQARDELESNSKE

SEQ ID NO: 494361 - protein, 5 aa, Mycobacterium
GRGVG

SEQ ID NO: 494362 - protein, 12 aa, Mycobacterium
GRGVGDNQSPDL

SEQ ID NO: 494363 - protein, 6 aa, Mycobacterium
GRGVPG

SEQ ID NO: 494364 - protein, 10 aa, Mycobacterium
GRGVPLSGGT

SEQ ID NO: 494365 - protein, 6 aa, Mycobacterium
GRGWNG

SEQ ID NO: 494366 - protein, 7 aa, Mycobacterium
GRGWSDE

SEQ ID NO: 494367 - protein, 4 aa, Mycobacterium
GRGY

SEQ ID NO: 494368 - protein, 7 aa, Mycobacterium
GRGYDRA

SEQ ID NO: 494369 - protein, 9 aa, Mycobacterium
GRGYETAES

SEQ ID NO: 494370 - protein, 4 aa, Mycobacterium
GRHA

SEQ ID NO: 494371 - protein, 10 aa, Mycobacterium
GRHAAAEDAA

SEQ ID NO: 494372 - protein, 15 aa, Mycobacterium
GRHAKGATPSPMRNA

SEQ ID NO: 494373 - protein, 8 aa, Mycobacterium
GRHAPTPV

SEQ ID NO: 494374 - protein, 24 aa, Mycobacterium
GRHASASGVPARNTPVSDPAAPLP

SEQ ID NO: 494375 - protein, 7 aa, Mycobacterium
GRHATSR

SEQ ID NO: 494376 - protein, 5 aa, Mycobacterium
GRHDE

SEQ ID NO: 494377 - protein, 8 aa, Mycobacterium
GRHDEALT

SEQ ID NO: 494378 - protein, 15 aa, Mycobacterium
GRHDPSGFKDWLTVA

SEQ ID NO: 494379 - protein, 15 aa, Mycobacterium
GRHDPSGFSDWLTVA

SEQ ID NO: 494380 - protein, 15 aa, Mycobacterium
GRHDPSGFTDWLTVA

SEQ ID NO: 494381 - protein, 6 aa, Mycobacterium
GRHEDY

SEQ ID NO: 494382 - protein, 5 aa, Mycobacterium
GRHES

SEQ ID NO: 494383 - protein, 6 aa, Mycobacterium
GRHGED

SEQ ID NO: 494384 - protein, 21 aa, Mycobacterium
GRHGLDGNDLSVTGSRVPEVP

SEQ ID NO: 494385 - protein, 10 aa, Mycobacterium
GRHGPDADRA

SEQ ID NO: 494386 - protein, 5 aa, Mycobacterium
GRHHP

SEQ ID NO: 494387 - protein, 4 aa, Mycobacterium
GRHI

SEQ ID NO: 494388 - protein, 4 aa, Mycobacterium
GRHL

SEQ ID NO: 494389 - protein, 5 aa, Mycobacterium
GRHLT

SEQ ID NO: 494390 - protein, 5 aa, Mycobacterium
GRHNG

SEQ ID NO: 494391 - protein, 8 aa, Mycobacterium
GRHNTERL

SEQ ID NO: 494392 - protein, 4 aa, Mycobacterium
GRHP

SEQ ID NO: 494393 - protein, 7 aa, Mycobacterium
GRHPASD

SEQ ID NO: 494394 - protein, 6 aa, Mycobacterium
GRHPED

SEQ ID NO: 494395 - protein, 6 aa, Mycobacterium
GRHPGG

SEQ ID NO: 494396 - protein, 7 aa, Mycobacterium
GRHPGPE

SEQ ID NO: 494397 - protein, 5 aa, Mycobacterium
GRHPR

SEQ ID NO: 494398 - protein, 10 aa, Mycobacterium
GRHPTTLPPG

SEQ ID NO: 494399 - protein, 8 aa, Mycobacterium
GRHQARKR

SEQ ID NO: 494400 - protein, 5 aa, Mycobacterium
GRHQR

SEQ ID NO: 494401 - protein, 7 aa, Mycobacterium
GRHQVTP

SEQ ID NO: 494402 - protein, 14 aa, Mycobacterium
GRHRGPRGPAVEGR

SEQ ID NO: 494403 - protein, 13 aa, Mycobacterium
GRHRSPDYRPGPA

SEQ ID NO: 494404 - protein, 8 aa, Mycobacterium
GRHRTERL

SEQ ID NO: 494405 - protein, 4 aa, Mycobacterium
GRHS

SEQ ID NO: 494406 - protein, 5 aa, Mycobacterium
GRHSN

SEQ ID NO: 494407 - protein, 7 aa, Mycobacterium
GRHSPEQ

SEQ ID NO: 494408 - protein, 4 aa, Mycobacterium
GRHT

SEQ ID NO: 494409 - protein, 7 aa, Mycobacterium
GRHTAEA

SEQ ID NO: 494410 - protein, 8 aa, Mycobacterium
GRHTGRTD

SEQ ID NO: 494411 - protein, 5 aa, Mycobacterium
GRHTN

SEQ ID NO: 494412 - protein, 5 aa, Mycobacterium
GRHVD

SEQ ID NO: 494413 - protein, 5 aa, Mycobacterium
GRHYH

SEQ ID NO: 494414 - protein, 4 aa, Mycobacterium
GRIA

SEQ ID NO: 494415 - protein, 10 aa, Mycobacterium
GRIADTGTQF

SEQ ID NO: 494416 - protein, 11 aa, Mycobacterium
GRIADTGTQFD

SEQ ID NO: 494417 - protein, 11 aa, Mycobacterium
GRIAGTGTPFD

SEQ ID NO: 494418 - protein, 8 aa, Mycobacterium
GRIAPGAA

SEQ ID NO: 494419 - protein, 11 aa, Mycobacterium
GRIAPTDAAGF

SEQ ID NO: 494420 - protein, 9 aa, Mycobacterium
GRIASTKGD

SEQ ID NO: 494421 - protein, 7 aa, Mycobacterium
GRIDDDG

SEQ ID NO: 494422 - protein, 16 aa, Mycobacterium
GRIDGSPEDAAKVAAT

SEQ ID NO: 494423 - protein, 14 aa, Mycobacterium
GRIDPARRRRRRAD

SEQ ID NO: 494424 - protein, 6 aa, Mycobacterium
GRIDPD

SEQ ID NO: 494425 - protein, 7 aa, Mycobacterium
GRIDPED

SEQ ID NO: 494426 - protein, 6 aa, Mycobacterium
GRIDRK

SEQ ID NO: 494427 - protein, 14 aa, Mycobacterium
GRIDVSGDSGDDWA

SEQ ID NO: 494428 - protein, 9 aa, Mycobacterium
GRIEGSRNE

SEQ ID NO: 494429 - protein, 9 aa, Mycobacterium
GRIEPAPRR

SEQ ID NO: 494430 - protein, 10 aa, Mycobacterium
GRIGADPDSV

SEQ ID NO: 494431 - protein, 5 aa, Mycobacterium
GRIGE

SEQ ID NO: 494432 - protein, 22 aa, Mycobacterium
GRIGNPLGGLPSATDPDKIPGV

SEQ ID NO: 494433 - protein, 5 aa, Mycobacterium
GRIGP

SEQ ID NO: 494434 - protein, 4 aa, Mycobacterium
GRIH

SEQ ID NO: 494435 - protein, 7 aa, Mycobacterium
GRIKPGE

SEQ ID NO: 494436 - protein, 17 aa, Mycobacterium
GRINTDALDNSAGVDCS

SEQ ID NO: 494437 - protein, 17 aa, Mycobacterium
GRINTDAMDNSAGVDCS

SEQ ID NO: 494438 - protein, 4 aa, Mycobacterium
GRIP

SEQ ID NO: 494439 - protein, 8 aa, Mycobacterium
GRIPADTP

SEQ ID NO: 494440 - protein, 7 aa, Mycobacterium
GRIPDGF

SEQ ID NO: 494441 - protein, 11 aa, Mycobacterium
GRIPGAGPDEV

SEQ ID NO: 494442 - protein, 12 aa, Mycobacterium
GRIPGSSEVEPV

SEQ ID NO: 494443 - protein, 5 aa, Mycobacterium
GRIPL

SEQ ID NO: 494444 - protein, 6 aa, Mycobacterium
GRIPQT

SEQ ID NO: 494445 - protein, 4 aa, Mycobacterium
GRIR

SEQ ID NO: 494446 - protein, 5 aa, Mycobacterium
GRISE

SEQ ID NO: 494447 - protein, 9 aa, Mycobacterium
GRISEQSSE

SEQ ID NO: 494448 - protein, 12 aa, Mycobacterium
GRISGSTDSQVV

SEQ ID NO: 494449 - protein, 17 aa, Mycobacterium
GRISSADYSGASAPLGS

SEQ ID NO: 494450 - protein, 14 aa, Mycobacterium
GRISSADYSGMSAP

SEQ ID NO: 494451 - protein, 11 aa, Mycobacterium
GRITERSSGGK

SEQ ID NO: 494452 - protein, 5 aa, Mycobacterium
GRITG

SEQ ID NO: 494453 - protein, 6 aa, Mycobacterium
GRITGP

SEQ ID NO: 494454 - protein, 11 aa, Mycobacterium
GRITKDDGNPY

SEQ ID NO: 494455 - protein, 17 aa, Mycobacterium
GRITYSGPFDRRPSGDA

SEQ ID NO: 494456 - protein, 6 aa, Mycobacterium
GRKDEQ

SEQ ID NO: 494457 - protein, 9 aa, Mycobacterium
GRKDGPTTN

SEQ ID NO: 494458 - protein, 8 aa, Mycobacterium
GRKEAFER

SEQ ID NO: 494459 - protein, 14 aa, Mycobacterium
GRKELAEAAAKQAE

SEQ ID NO: 494460 - protein, 15 aa, Mycobacterium
GRKELAEAAAKQAEK

SEQ ID NO: 494461 - protein, 10 aa, Mycobacterium
GRKGCAGDLG

SEQ ID NO: 494462 - protein, 9 aa, Mycobacterium
GRKGDGRIE

SEQ ID NO: 494463 - protein, 11 aa, Mycobacterium
GRKGEDDDDVD

SEQ ID NO: 494464 - protein, 5 aa, Mycobacterium
GRKGF

SEQ ID NO: 494465 - protein, 7 aa, Mycobacterium
GRKGGLV

SEQ ID NO: 494466 - protein, 10 aa, Mycobacterium
GRKGGRPVPP

SEQ ID NO: 494467 - protein, 6 aa, Mycobacterium
GRKGQE

SEQ ID NO: 494468 - protein, 9 aa, Mycobacterium
GRKGSTGLP

SEQ ID NO: 494469 - protein, 4 aa, Mycobacterium
GRKH

SEQ ID NO: 494470 - protein, 9 aa, Mycobacterium
GRKKSAATL

SEQ ID NO: 494471 - protein, 6 aa, Mycobacterium
GRKPAR

SEQ ID NO: 494472 - protein, 8 aa, Mycobacterium
GRKPGTRV

SEQ ID NO: 494473 - protein, 5 aa, Mycobacterium
GRKPK

SEQ ID NO: 494474 - protein, 8 aa, Mycobacterium
GRKPNPHL

SEQ ID NO: 494475 - protein, 8 aa, Mycobacterium
GRKPRGSY

SEQ ID NO: 494476 - protein, 5 aa, Mycobacterium
GRKPT

SEQ ID NO: 494477 - protein, 6 aa, Mycobacterium
GRKPVD

SEQ ID NO: 494478 - protein, 13 aa, Mycobacterium
GRKQDAAIKKGLP

SEQ ID NO: 494479 - protein, 15 aa, Mycobacterium
GRKQTSLRGKAHRSA

SEQ ID NO: 494480 - protein, 6 aa, Mycobacterium
GRKSAH

SEQ ID NO: 494481 - protein, 14 aa, Mycobacterium
GRKSGAPRSTPVTP

SEQ ID NO: 494482 - protein, 10 aa, Mycobacterium
GRKSGEPRDT

SEQ ID NO: 494483 - protein, 10 aa, Mycobacterium
GRKSGEPRES

SEQ ID NO: 494484 - protein, 10 aa, Mycobacterium
GRKSGERRST

SEQ ID NO: 494485 - protein, 9 aa, Mycobacterium
GRKSGKEYN

SEQ ID NO: 494486 - protein, 13 aa, Mycobacterium
GRKSGKRYSTPVS

SEQ ID NO: 494487 - protein, 11 aa, Mycobacterium
GRKSGQPRHTA

SEQ ID NO: 494488 - protein, 6 aa, Mycobacterium
GRKSGR

SEQ ID NO: 494489 - protein, 8 aa, Mycobacterium
GRKSGRTF

SEQ ID NO: 494490 - protein, 7 aa, Mycobacterium
GRKSGRV

SEQ ID NO: 494491 - protein, 15 aa, Mycobacterium
GRKSGTPRSTPVTPM

SEQ ID NO: 494492 - protein, 16 aa, Mycobacterium
GRKSPSRSWRRSDDRP

SEQ ID NO: 494493 - protein, 5 aa, Mycobacterium
GRKSR

SEQ ID NO: 494494 - protein, 6 aa, Mycobacterium
GRKSRH

SEQ ID NO: 494495 - protein, 6 aa, Mycobacterium
GRKSTH

SEQ ID NO: 494496 - protein, 8 aa, Mycobacterium
GRKSWGRE

SEQ ID NO: 494497 - protein, 9 aa, Mycobacterium
GRKTGKPRP

SEQ ID NO: 494498 - protein, 14 aa, Mycobacterium
GRKTGLPRSTPATP

SEQ ID NO: 494499 - protein, 13 aa, Mycobacterium
GRKTGQPRPTPIT

SEQ ID NO: 494500 - protein, 8 aa, Mycobacterium
GRKTGRPF

SEQ ID NO: 494501 - protein, 7 aa, Mycobacterium
GRKTGRQ

SEQ ID NO: 494502 - protein, 8 aa, Mycobacterium
GRKTGRRI

SEQ ID NO: 494503 - protein, 9 aa, Mycobacterium
GRKTGRTYS

SEQ ID NO: 494504 - protein, 14 aa, Mycobacterium
GRKTLAGPTLSSRQ

SEQ ID NO: 494505 - protein, 14 aa, Mycobacterium
GRKTRAGSQRADHR

SEQ ID NO: 494506 - protein, 9 aa, Mycobacterium
GRKVRGDVG

SEQ ID NO: 494507 - protein, 5 aa, Mycobacterium
GRLAG

SEQ ID NO: 494508 - protein, 11 aa, Mycobacterium
GRLAGGPTAAF

SEQ ID NO: 494509 - protein, 5 aa, Mycobacterium
GRLDA

SEQ ID NO: 494510 - protein, 5 aa, Mycobacterium
GRLDD

SEQ ID NO: 494511 - protein, 11 aa, Mycobacterium
GRLDDAKAMKD

SEQ ID NO: 494512 - protein, 6 aa, Mycobacterium
GRLDGP

SEQ ID NO: 494513 - protein, 13 aa, Mycobacterium
GRLDNDKSPAAPI

SEQ ID NO: 494514 - protein, 5 aa, Mycobacterium
GRLEP

SEQ ID NO: 494515 - protein, 18 aa, Mycobacterium
GRLEPGGDVPPPAPADEP

SEQ ID NO: 494516 - protein, 4 aa, Mycobacterium
GRLG

SEQ ID NO: 494517 - protein, 5 aa, Mycobacterium
GRLGE

SEQ ID NO: 494518 - protein, 9 aa, Mycobacterium
GRLGPEGRA

SEQ ID NO: 494519 - protein, 18 aa, Mycobacterium
GRLGRAGEHGHAGTAVRP

SEQ ID NO: 494520 - protein, 8 aa, Mycobacterium
GRLGRSPR

SEQ ID NO: 494521 - protein, 8 aa, Mycobacterium
GRLGSNKA

SEQ ID NO: 494522 - protein, 5 aa, Mycobacterium
GRLNG

SEQ ID NO: 494523 - protein, 12 aa, Mycobacterium
GRLNPERISEST

SEQ ID NO: 494524 - protein, 10 aa, Mycobacterium
GRLNPERITE

SEQ ID NO: 494525 - protein, 12 aa, Mycobacterium
GRLNPERITEST

SEQ ID NO: 494526 - protein, 10 aa, Mycobacterium
GRLNPERVTE

SEQ ID NO: 494527 - protein, 8 aa, Mycobacterium
GRLNPGVS

SEQ ID NO: 494528 - protein, 5 aa, Mycobacterium
GRLPA

SEQ ID NO: 494529 - protein, 5 aa, Mycobacterium
GRLPD

SEQ ID NO: 494530 - protein, 8 aa, Mycobacterium
GRLPDETA

SEQ ID NO: 494531 - protein, 12 aa, Mycobacterium
GRLPEEEAKPPS

SEQ ID NO: 494532 - protein, 16 aa, Mycobacterium
GRLPEEKTVAADNERV

SEQ ID NO: 494533 - protein, 8 aa, Mycobacterium
GRLPETGT

SEQ ID NO: 494534 - protein, 6 aa, Mycobacterium
GRLPQT

SEQ ID NO: 494535 - protein, 7 aa, Mycobacterium
GRLPRGP

SEQ ID NO: 494536 - protein, 7 aa, Mycobacterium
GRLPSRS

SEQ ID NO: 494537 - protein, 5 aa, Mycobacterium
GRLPT

SEQ ID NO: 494538 - protein, 7 aa, Mycobacterium
GRLRDVP

SEQ ID NO: 494539 - protein, 20 aa, Mycobacterium
GRLRPDHETERLQLLVDRMS

SEQ ID NO: 494540 - protein, 4 aa, Mycobacterium
GRLS

SEQ ID NO: 494541 - protein, 10 aa, Mycobacterium
GRLSASATDV

SEQ ID NO: 494542 - protein, 7 aa, Mycobacterium
GRLSEPA

SEQ ID NO: 494543 - protein, 9 aa, Mycobacterium
GRLSERRRA

SEQ ID NO: 494544 - protein, 7 aa, Mycobacterium
GRLSGGE

SEQ ID NO: 494545 - protein, 8 aa, Mycobacterium
GRLSGPRT

SEQ ID NO: 494546 - protein, 10 aa, Mycobacterium
GRLSLSGPQM

SEQ ID NO: 494547 - protein, 10 aa, Mycobacterium
GRLSPSDTAT

SEQ ID NO: 494548 - protein, 5 aa, Mycobacterium
GRLSS

SEQ ID NO: 494549 - protein, 13 aa, Mycobacterium
GRLSSDASPHTTV

SEQ ID NO: 494550 - protein, 4 aa, Mycobacterium
GRLT

SEQ ID NO: 494551 - protein, 8 aa, Mycobacterium
GRLTNQEL

SEQ ID NO: 494552 - protein, 6 aa, Mycobacterium
GRLTPD

SEQ ID NO: 494553 - protein, 33 aa, Mycobacterium
GRLTPDQAAAYSLSSQSVSERGAKRLRELLSRI

SEQ ID NO: 494554 - protein, 8 aa, Mycobacterium
GRMDPSVT

SEQ ID NO: 494555 - protein, 11 aa, Mycobacterium
GRMENTGQACN

SEQ ID NO: 494556 - protein, 7 aa, Mycobacterium
GRMGNDR

SEQ ID NO: 494557 - protein, 6 aa, Mycobacterium
GRMPEA

SEQ ID NO: 494558 - protein, 7 aa, Mycobacterium
GRMPTDT

SEQ ID NO: 494559 - protein, 7 aa, Mycobacterium
GRMSDDD

SEQ ID NO: 494560 - protein, 11 aa, Mycobacterium
GRMSGASGKVP

SEQ ID NO: 494561 - protein, 4 aa, Mycobacterium
GRMT

SEQ ID NO: 494562 - protein, 4 aa, Mycobacterium
GRNA

SEQ ID NO: 494563 - protein, 21 aa, Mycobacterium
GRNADEDKTDARGRRGGENPH

SEQ ID NO: 494564 - protein, 5 aa, Mycobacterium
GRNAE

SEQ ID NO: 494565 - protein, 6 aa, Mycobacterium
GRNAEI

SEQ ID NO: 494566 - protein, 17 aa, Mycobacterium
GRNAGVRPEKSEGASVA

SEQ ID NO: 494567 - protein, 7 aa, Mycobacterium
GRNAPRV

SEQ ID NO: 494568 - protein, 7 aa, Mycobacterium
GRNATHQ

SEQ ID NO: 494569 - protein, 7 aa, Mycobacterium
GRNATQV

SEQ ID NO: 494570 - protein, 6 aa, Mycobacterium
GRNATT

SEQ ID NO: 494571 - protein, 10 aa, Mycobacterium
GRNDAAAPVR

SEQ ID NO: 494572 - protein, 9 aa, Mycobacterium
GRNDSDAEL

SEQ ID NO: 494573 - protein, 5 aa, Mycobacterium
GRNEA

SEQ ID NO: 494574 - protein, 6 aa, Mycobacterium
GRNEAP

SEQ ID NO: 494575 - protein, 9 aa, Mycobacterium
GRNGDGKSS

SEQ ID NO: 494576 - protein, 10 aa, Mycobacterium
GRNGDGKSSL

SEQ ID NO: 494577 - protein, 9 aa, Mycobacterium
GRNGDGKST

SEQ ID NO: 494578 - protein, 9 aa, Mycobacterium
GRNGDGKTT

SEQ ID NO: 494579 - protein, 12 aa, Mycobacterium
GRNGEAVDEDTP

SEQ ID NO: 494580 - protein, 6 aa, Mycobacterium
GRNGED

SEQ ID NO: 494581 - protein, 7 aa, Mycobacterium
GRNGESP

SEQ ID NO: 494582 - protein, 8 aa, Mycobacterium
GRNGESPI

SEQ ID NO: 494583 - protein, 11 aa, Mycobacterium
GRNGSGKSTLA

SEQ ID NO: 494584 - protein, 8 aa, Mycobacterium
GRNGTTRL

SEQ ID NO: 494585 - protein, 12 aa, Mycobacterium
GRNGVGPAPESP

SEQ ID NO: 494586 - protein, 4 aa, Mycobacterium
GRNH

SEQ ID NO: 494587 - protein, 12 aa, Mycobacterium
GRNIRGVIDFAG

SEQ ID NO: 494588 - protein, 9 aa, Mycobacterium
GRNKVDEDD

SEQ ID NO: 494589 - protein, 5 aa, Mycobacterium
GRNLP

SEQ ID NO: 494590 - protein, 8 aa, Mycobacterium
GRNLSEEN

SEQ ID NO: 494591 - protein, 10 aa, Mycobacterium
GRNNYRNPEA

SEQ ID NO: 494592 - protein, 10 aa, Mycobacterium
GRNNYRNPET

SEQ ID NO: 494593 - protein, 4 aa, Mycobacterium
GRNP

SEQ ID NO: 494594 - protein, 20 aa, Mycobacterium
GRNPADIRKTSGGLATTDPF

SEQ ID NO: 494595 - protein, 12 aa, Mycobacterium
GRNPDGSLDGQG

SEQ ID NO: 494596 - protein, 11 aa, Mycobacterium
GRNPDGSWDGN

SEQ ID NO: 494597 - protein, 5 aa, Mycobacterium
GRNPE

SEQ ID NO: 494598 - protein, 6 aa, Mycobacterium
GRNPQV

SEQ ID NO: 494599 - protein, 8 aa, Mycobacterium
GRNPRGAD

SEQ ID NO: 494600 - protein, 8 aa, Mycobacterium
GRNPSNDL

SEQ ID NO: 494601 - protein, 6 aa, Mycobacterium
GRNPTG

SEQ ID NO: 494602 - protein, 8 aa, Mycobacterium
GRNPTGIA

SEQ ID NO: 494603 - protein, 7 aa, Mycobacterium
GRNPTTV

SEQ ID NO: 494604 - protein, 10 aa, Mycobacterium
GRNQDDLDRT

SEQ ID NO: 494605 - protein, 6 aa, Mycobacterium
GRNQHG

SEQ ID NO: 494606 - protein, 13 aa, Mycobacterium
GRNQNHQRAPGAV

SEQ ID NO: 494607 - protein, 5 aa, Mycobacterium
GRNQP

SEQ ID NO: 494608 - protein, 6 aa, Mycobacterium
GRNQRA

SEQ ID NO: 494609 - protein, 7 aa, Mycobacterium
GRNQRRN

SEQ ID NO: 494610 - protein, 8 aa, Mycobacterium
GRNQSGKA

SEQ ID NO: 494611 - protein, 8 aa, Mycobacterium
GRNQSGRA

SEQ ID NO: 494612 - protein, 5 aa, Mycobacterium
GRNRA

SEQ ID NO: 494613 - protein, 5 aa, Mycobacterium
GRNRD

SEQ ID NO: 494614 - protein, 7 aa, Mycobacterium
GRNRQRL

SEQ ID NO: 494615 - protein, 8 aa, Mycobacterium
GRNRRPDE

SEQ ID NO: 494616 - protein, 14 aa, Mycobacterium
GRNRRVQQGDPSLH

SEQ ID NO: 494617 - protein, 13 aa, Mycobacterium
GRNRRVQRGDPSL

SEQ ID NO: 494618 - protein, 5 aa, Mycobacterium
GRNSA

SEQ ID NO: 494619 - protein, 7 aa, Mycobacterium
GRNSEYA

SEQ ID NO: 494620 - protein, 7 aa, Mycobacterium
GRNSFEG

SEQ ID NO: 494621 - protein, 10 aa, Mycobacterium
GRNSFEGRRT

SEQ ID NO: 494622 - protein, 11 aa, Mycobacterium
GRNSFEGRRTQ

SEQ ID NO: 494623 - protein, 6 aa, Mycobacterium
GRNSGN

SEQ ID NO: 494624 - protein, 4 aa, Mycobacterium
GRNT

SEQ ID NO: 494625 - protein, 7 aa, Mycobacterium
GRNTGAV

SEQ ID NO: 494626 - protein, 13 aa, Mycobacterium
GRNTGAVTHRRAR

SEQ ID NO: 494627 - protein, 5 aa, Mycobacterium
GRNTV

SEQ ID NO: 494628 - protein, 5 aa, Mycobacterium
GRNVT

SEQ ID NO: 494629 - protein, 23 aa, Mycobacterium
GRNYPEDRGPGAGCPPEHGISSA

SEQ ID NO: 494630 - protein, 7 aa, Mycobacterium
GRNYQSH

SEQ ID NO: 494631 - protein, 5 aa, Mycobacterium
GRPAA

SEQ ID NO: 494632 - protein, 8 aa, Mycobacterium
GRPAAEAD

SEQ ID NO: 494633 - protein, 9 aa, Mycobacterium
GRPAAEGAL

SEQ ID NO: 494634 - protein, 6 aa, Mycobacterium
GRPAAG

SEQ ID NO: 494635 - protein, 6 aa, Mycobacterium
GRPAAL

SEQ ID NO: 494636 - protein, 8 aa, Mycobacterium
GRPAAREA

SEQ ID NO: 494637 - protein, 7 aa, Mycobacterium
GRPACAD

SEQ ID NO: 494638 - protein, 8 aa, Mycobacterium
GRPADGDP

SEQ ID NO: 494639 - protein, 8 aa, Mycobacterium
GRPADGEP

SEQ ID NO: 494640 - protein, 10 aa, Mycobacterium
GRPADVRGAE

SEQ ID NO: 494641 - protein, 5 aa, Mycobacterium
GRPAE

SEQ ID NO: 494642 - protein, 6 aa, Mycobacterium
GRPAEA

SEQ ID NO: 494643 - protein, 23 aa, Mycobacterium
GRPAEELAQATTSNARRVYGLAR

SEQ ID NO: 494644 - protein, 9 aa, Mycobacterium
GRPAEGPPA

SEQ ID NO: 494645 - protein, 7 aa, Mycobacterium
GRPAEIA

SEQ ID NO: 494646 - protein, 7 aa, Mycobacterium
GRPAEPE

SEQ ID NO: 494647 - protein, 7 aa, Mycobacterium
GRPAESD

SEQ ID NO: 494648 - protein, 5 aa, Mycobacterium
GRPAG

SEQ ID NO: 494649 - protein, 16 aa, Mycobacterium
GRPAGAPVRRRIAKNE

SEQ ID NO: 494650 - protein, 35 aa, Mycobacterium
GRPAGVATSRARSSAITYPRSTCSNHRTPRSVATS

SEQ ID NO: 494651 - protein, 16 aa, Mycobacterium
GRPALRASGVNPVPGY

SEQ ID NO: 494652 - protein, 21 aa, Mycobacterium
GRPANEDTFAEAGRRAGQACE

SEQ ID NO: 494653 - protein, 10 aa, Mycobacterium
GRPANQEPLR

SEQ ID NO: 494654 - protein, 5 aa, Mycobacterium
GRPAP

SEQ ID NO: 494655 - protein, 9 aa, Mycobacterium
GRPAPAGKD

SEQ ID NO: 494656 - protein, 14 aa, Mycobacterium
GRPAPAPDSEAAQM

SEQ ID NO: 494657 - protein, 8 aa, Mycobacterium
GRPAPDLP

SEQ ID NO: 494658 - protein, 14 aa, Mycobacterium
GRPAPEDIDPDSGF

SEQ ID NO: 494659 - protein, 9 aa, Mycobacterium
GRPAPETPL

SEQ ID NO: 494660 - protein, 11 aa, Mycobacterium
GRPAPGFGSAR

SEQ ID NO: 494661 - protein, 12 aa, Mycobacterium
GRPAPGRGSAQS

SEQ ID NO: 494662 - protein, 15 aa, Mycobacterium
GRPAPKEAMRAALEE

SEQ ID NO: 494663 - protein, 7 aa, Mycobacterium
GRPAPPH

SEQ ID NO: 494664 - protein, 8 aa, Mycobacterium
GRPAPTHR

SEQ ID NO: 494665 - protein, 6 aa, Mycobacterium
GRPAQI

SEQ ID NO: 494666 - protein, 8 aa, Mycobacterium
GRPAQIDG

SEQ ID NO: 494667 - protein, 8 aa, Mycobacterium
GRPAQING

SEQ ID NO: 494668 - protein, 8 aa, Mycobacterium
GRPARSIS

SEQ ID NO: 494669 - protein, 10 aa, Mycobacterium
GRPASEPDGG

SEQ ID NO: 494670 - protein, 22 aa, Mycobacterium
GRPATEETFAEAGRQASQACDP

SEQ ID NO: 494671 - protein, 22 aa, Mycobacterium
GRPATEETLAEAGRRAAQACEP

SEQ ID NO: 494672 - protein, 8 aa, Mycobacterium
GRPATERF

SEQ ID NO: 494673 - protein, 13 aa, Mycobacterium
GRPATRKRWPNGV

SEQ ID NO: 494674 - protein, 16 aa, Mycobacterium
GRPATRKRWPNGVDQP

SEQ ID NO: 494675 - protein, 15 aa, Mycobacterium
GRPAYAAAKAGLTGL

SEQ ID NO: 494676 - protein, 8 aa, Mycobacterium
GRPDAREH

SEQ ID NO: 494677 - protein, 6 aa, Mycobacterium
GRPDDI

SEQ ID NO: 494678 - protein, 6 aa, Mycobacterium
GRPDDS

SEQ ID NO: 494679 - protein, 12 aa, Mycobacterium
GRPDEAGAAGMG

SEQ ID NO: 494680 - protein, 12 aa, Mycobacterium
GRPDEAGAGGMG

SEQ ID NO: 494681 - protein, 9 aa, Mycobacterium
GRPDETRHT

SEQ ID NO: 494682 - protein, 11 aa, Mycobacterium
GRPDGAPAGLS

SEQ ID NO: 494683 - protein, 10 aa, Mycobacterium
GRPDGAPAGM

SEQ ID NO: 494684 - protein, 17 aa, Mycobacterium
GRPDGEDHDGERGTLSD

SEQ ID NO: 494685 - protein, 6 aa, Mycobacterium
GRPDGF

SEQ ID NO: 494686 - protein, 12 aa, Mycobacterium
GRPDGKPDPKLS

SEQ ID NO: 494687 - protein, 9 aa, Mycobacterium
GRPDGSDAD

SEQ ID NO: 494688 - protein, 9 aa, Mycobacterium
GRPDHPDPR

SEQ ID NO: 494689 - protein, 7 aa, Mycobacterium
GRPDHRD

SEQ ID NO: 494690 - protein, 10 aa, Mycobacterium
GRPDKSPLGG

SEQ ID NO: 494691 - protein, 13 aa, Mycobacterium
GRPDPARDARATY

SEQ ID NO: 494692 - protein, 7 aa, Mycobacterium
GRPDPDV

SEQ ID NO: 494693 - protein, 9 aa, Mycobacterium
GRPDPLRDA

SEQ ID NO: 494694 - protein, 7 aa, Mycobacterium
GRPDPTL

SEQ ID NO: 494695 - protein, 8 aa, Mycobacterium
GRPDPTLG

SEQ ID NO: 494696 - protein, 16 aa, Mycobacterium
GRPDPVDEFEQPVFAW

SEQ ID NO: 494697 - protein, 8 aa, Mycobacterium
GRPDPVRD

SEQ ID NO: 494698 - protein, 16 aa, Mycobacterium
GRPDPVYDLEQPVFAW

SEQ ID NO: 494699 - protein, 8 aa, Mycobacterium
GRPDPWAG

SEQ ID NO: 494700 - protein, 6 aa, Mycobacterium
GRPDQL

SEQ ID NO: 494701 - protein, 8 aa, Mycobacterium
GRPDQLPG

SEQ ID NO: 494702 - protein, 5 aa, Mycobacterium
GRPDT

SEQ ID NO: 494703 - protein, 6 aa, Mycobacterium
GRPDTQ

SEQ ID NO: 494704 - protein, 7 aa, Mycobacterium
GRPDVDD

SEQ ID NO: 494705 - protein, 12 aa, Mycobacterium
GRPDVEGLGTAY

SEQ ID NO: 494706 - protein, 7 aa, Mycobacterium
GRPDVND

SEQ ID NO: 494707 - protein, 17 aa, Mycobacterium
GRPDVNDLGTSYGEAHL

SEQ ID NO: 494708 - protein, 18 aa, Mycobacterium
GRPDVNDLGTSYGEAHLD

SEQ ID NO: 494709 - protein, 17 aa, Mycobacterium
GRPDVQLGGSSQYTGEQ

SEQ ID NO: 494710 - protein, 7 aa, Mycobacterium
GRPEAAA

SEQ ID NO: 494711 - protein, 15 aa, Mycobacterium
GRPEALAASAADMQR

SEQ ID NO: 494712 - protein, 9 aa, Mycobacterium
GRPEATEVA

SEQ ID NO: 494713 - protein, 5 aa, Mycobacterium
GRPED

SEQ ID NO: 494714 - protein, 7 aa, Mycobacterium
GRPEDTE

SEQ ID NO: 494715 - protein, 8 aa, Mycobacterium
GRPEDTER

SEQ ID NO: 494716 - protein, 15 aa, Mycobacterium
GRPEELTDAADGEFE

SEQ ID NO: 494717 - protein, 15 aa, Mycobacterium
GRPEELTETPDGDFE

SEQ ID NO: 494718 - protein, 10 aa, Mycobacterium
GRPEETREAF

SEQ ID NO: 494719 - protein, 8 aa, Mycobacterium
GRPEFAGP

SEQ ID NO: 494720 - protein, 6 aa, Mycobacterium
GRPEGR

SEQ ID NO: 494721 - protein, 7 aa, Mycobacterium
GRPEHQR

SEQ ID NO: 494722 - protein, 7 aa, Mycobacterium
GRPEQAE

SEQ ID NO: 494723 - protein, 14 aa, Mycobacterium
GRPERTYRGTLREN

SEQ ID NO: 494724 - protein, 9 aa, Mycobacterium
GRPETADTA

SEQ ID NO: 494725 - protein, 10 aa, Mycobacterium
GRPETDDSAS

SEQ ID NO: 494726 - protein, 9 aa, Mycobacterium
GRPETEDAE

SEQ ID NO: 494727 - protein, 6 aa, Mycobacterium
GRPETY

SEQ ID NO: 494728 - protein, 5 aa, Mycobacterium
GRPEV

SEQ ID NO: 494729 - protein, 8 aa, Mycobacterium
GRPEVDPD

SEQ ID NO: 494730 - protein, 5 aa, Mycobacterium
GRPFG

SEQ ID NO: 494731 - protein, 6 aa, Mycobacterium
GRPFGK

SEQ ID NO: 494732 - protein, 6 aa, Mycobacterium
GRPFRD

SEQ ID NO: 494733 - protein, 13 aa, Mycobacterium
GRPGAQPGPIGPV

SEQ ID NO: 494734 - protein, 5 aa, Mycobacterium
GRPGD

SEQ ID NO: 494735 - protein, 7 aa, Mycobacterium
GRPGDID

SEQ ID NO: 494736 - protein, 9 aa, Mycobacterium
GRPGEPEDV

SEQ ID NO: 494737 - protein, 8 aa, Mycobacterium
GRPGETAA

SEQ ID NO: 494738 - protein, 5 aa, Mycobacterium
GRPGG

SEQ ID NO: 494739 - protein, 12 aa, Mycobacterium
GRPGGPEFRPSE

SEQ ID NO: 494740 - protein, 12 aa, Mycobacterium
GRPGGPKFRPSE

SEQ ID NO: 494741 - protein, 6 aa, Mycobacterium
GRPGGV

SEQ ID NO: 494742 - protein, 18 aa, Mycobacterium
GRPGGWQQAQQPDAGDAA

SEQ ID NO: 494743 - protein, 6 aa, Mycobacterium
GRPGID

SEQ ID NO: 494744 - protein, 5 aa, Mycobacterium
GRPGK

SEQ ID NO: 494745 - protein, 7 aa, Mycobacterium
GRPGLDI

SEQ ID NO: 494746 - protein, 6 aa, Mycobacterium
GRPGLS

SEQ ID NO: 494747 - protein, 7 aa, Mycobacterium
GRPGLSS

SEQ ID NO: 494748 - protein, 5 aa, Mycobacterium
GRPGM

SEQ ID NO: 494749 - protein, 6 aa, Mycobacterium
GRPGNP

SEQ ID NO: 494750 - protein, 7 aa, Mycobacterium
GRPGPTW

SEQ ID NO: 494751 - protein, 9 aa, Mycobacterium
GRPGQGKST

SEQ ID NO: 494752 - protein, 9 aa, Mycobacterium
GRPGQPEEV

SEQ ID NO: 494753 - protein, 6 aa, Mycobacterium
GRPGQV

SEQ ID NO: 494754 - protein, 6 aa, Mycobacterium
GRPGRL

SEQ ID NO: 494755 - protein, 8 aa, Mycobacterium
GRPGRRTD

SEQ ID NO: 494756 - protein, 7 aa, Mycobacterium
GRPGRVD

SEQ ID NO: 494757 - protein, 12 aa, Mycobacterium
GRPGSTPSGPIP

SEQ ID NO: 494758 - protein, 11 aa, Mycobacterium
GRPGSTPTGPL

SEQ ID NO: 494759 - protein, 12 aa, Mycobacterium
GRPGTLPSGPVP

SEQ ID NO: 494760 - protein, 6 aa, Mycobacterium
GRPGVS

SEQ ID NO: 494761 - protein, 5 aa, Mycobacterium
GRPGW

SEQ ID NO: 494762 - protein, 7 aa, Mycobacterium
GRPHDPL

SEQ ID NO: 494763 - protein, 9 aa, Mycobacterium
GRPHNPDNR

SEQ ID NO: 494764 - protein, 6 aa, Mycobacterium
GRPHPG

SEQ ID NO: 494765 - protein, 5 aa, Mycobacterium
GRPHR

SEQ ID NO: 494766 - protein, 6 aa, Mycobacterium
GRPHRA

SEQ ID NO: 494767 - protein, 5 aa, Mycobacterium
GRPHT

SEQ ID NO: 494768 - protein, 19 aa, Mycobacterium
GRPIEARAAAERGRGLAET

SEQ ID NO: 494769 - protein, 5 aa, Mycobacterium
GRPIN

SEQ ID NO: 494770 - protein, 12 aa, Mycobacterium
GRPINPKNPTHA

SEQ ID NO: 494771 - protein, 44 aa, Mycobacterium
GRPIPADARQTTEQQEELQDEFDRRGADPEAPGLHESREQIADE

SEQ ID NO: 494772 - protein, 7 aa, Mycobacterium
GRPISPA

SEQ ID NO: 494773 - protein, 8 aa, Mycobacterium
GRPKAGET

SEQ ID NO: 494774 - protein, 11 aa, Mycobacterium
GRPKAGPDPKL

SEQ ID NO: 494775 - protein, 11 aa, Mycobacterium
GRPKDGPDPKL

SEQ ID NO: 494776 - protein, 12 aa, Mycobacterium
GRPKDGPDPKLS

SEQ ID NO: 494777 - protein, 8 aa, Mycobacterium
GRPKELPD

SEQ ID NO: 494778 - protein, 8 aa, Mycobacterium
GRPKETDF

SEQ ID NO: 494779 - protein, 11 aa, Mycobacterium
GRPKGEPDPKF

SEQ ID NO: 494780 - protein, 11 aa, Mycobacterium
GRPKGEPDPKL

SEQ ID NO: 494781 - protein, 11 aa, Mycobacterium
GRPKNGPDPKL

SEQ ID NO: 494782 - protein, 5 aa, Mycobacterium
GRPKP

SEQ ID NO: 494783 - protein, 8 aa, Mycobacterium
GRPKPGQT

SEQ ID NO: 494784 - protein, 11 aa, Mycobacterium
GRPKSEAVEGT

SEQ ID NO: 494785 - protein, 7 aa, Mycobacterium
GRPKSVT

SEQ ID NO: 494786 - protein, 6 aa, Mycobacterium
GRPLGK

SEQ ID NO: 494787 - protein, 10 aa, Mycobacterium
GRPLGTQPSG

SEQ ID NO: 494788 - protein, 6 aa, Mycobacterium
GRPLPL

SEQ ID NO: 494789 - protein, 14 aa, Mycobacterium
GRPLPPGSEGVPRI

SEQ ID NO: 494790 - protein, 15 aa, Mycobacterium
GRPLPPGSEGVPRIP

SEQ ID NO: 494791 - protein, 13 aa, Mycobacterium
GRPLPPHGAPEQL

SEQ ID NO: 494792 - protein, 9 aa, Mycobacterium
GRPLPQAPL

SEQ ID NO: 494793 - protein, 8 aa, Mycobacterium
GRPLPRTP

SEQ ID NO: 494794 - protein, 14 aa, Mycobacterium
GRPLPSEYTSGDRG

SEQ ID NO: 494795 - protein, 6 aa, Mycobacterium
GRPLRD

SEQ ID NO: 494796 - protein, 5 aa, Mycobacterium
GRPLS

SEQ ID NO: 494797 - protein, 6 aa, Mycobacterium
GRPLSG

SEQ ID NO: 494798 - protein, 24 aa, Mycobacterium
GRPLSTDAVSRPATSYTAVAPDNS

SEQ ID NO: 494799 - protein, 13 aa, Mycobacterium
GRPLTEDDPPGVP

SEQ ID NO: 494800 - protein, 6 aa, Mycobacterium
GRPLTG

SEQ ID NO: 494801 - protein, 9 aa, Mycobacterium
GRPLTGAQA

SEQ ID NO: 494802 - protein, 6 aa, Mycobacterium
GRPMEE

SEQ ID NO: 494803 - protein, 5 aa, Mycobacterium
GRPND

SEQ ID NO: 494804 - protein, 12 aa, Mycobacterium
GRPNGDDVDPEH

SEQ ID NO: 494805 - protein, 5 aa, Mycobacterium
GRPNQ

SEQ ID NO: 494806 - protein, 7 aa, Mycobacterium
GRPNTHH

SEQ ID NO: 494807 - protein, 13 aa, Mycobacterium
GRPPADAPTTAAQ

SEQ ID NO: 494808 - protein, 11 aa, Mycobacterium
GRPPADSPTIP

SEQ ID NO: 494809 - protein, 13 aa, Mycobacterium
GRPPADSPTTAAQ

SEQ ID NO: 494810 - protein, 6 aa, Mycobacterium
GRPPAG

SEQ ID NO: 494811 - protein, 10 aa, Mycobacterium
GRPPASPRLP

SEQ ID NO: 494812 - protein, 8 aa, Mycobacterium
GRPPEDVS

SEQ ID NO: 494813 - protein, 12 aa, Mycobacterium
GRPPEGSPTTPA

SEQ ID NO: 494814 - protein, 5 aa, Mycobacterium
GRPPF

SEQ ID NO: 494815 - protein, 5 aa, Mycobacterium
GRPPG

SEQ ID NO: 494816 - protein, 23 aa, Mycobacterium
GRPPGDPTLNDQRSTDQRTHWYE

SEQ ID NO: 494817 - protein, 10 aa, Mycobacterium
GRPPGQKSGA

SEQ ID NO: 494818 - protein, 26 aa, Mycobacterium
GRPPGTAAGIRPRPEFDTAKRSLRQR

SEQ ID NO: 494819 - protein, 7 aa, Mycobacterium
GRPPGTM

SEQ ID NO: 494820 - protein, 10 aa, Mycobacterium
GRPPLGTDGG

SEQ ID NO: 494821 - protein, 17 aa, Mycobacterium
GRPPNPARARERQRALT

SEQ ID NO: 494822 - protein, 7 aa, Mycobacterium
GRPPPGI

SEQ ID NO: 494823 - protein, 10 aa, Mycobacterium
GRPPPPQADA

SEQ ID NO: 494824 - protein, 11 aa, Mycobacterium
GRPPQGSPTTA

SEQ ID NO: 494825 - protein, 30 aa, Mycobacterium
GRPPQRVPGENPVPGYGSSVNGALCTELCG

SEQ ID NO: 494826 - protein, 10 aa, Mycobacterium
GRPPRGGAER

SEQ ID NO: 494827 - protein, 13 aa, Mycobacterium
GRPPRTASTKAAS

SEQ ID NO: 494828 - protein, 14 aa, Mycobacterium
GRPPRTGELDSDTI

SEQ ID NO: 494829 - protein, 83 aa, Mycobacterium
GRPPSAPAPTAGGPSGPGSAISPSAPTPVSSSGPPTGGGGGTSIAPSSPLSSGSSLGGSGAEQAADASAAALGQNPVGRAPVD

SEQ ID NO: 494830 - protein, 10 aa, Mycobacterium
GRPPTPVPKE

SEQ ID NO: 494831 - protein, 5 aa, Mycobacterium
GRPPY

SEQ ID NO: 494832 - protein, 4 aa, Mycobacterium
GRPQ

SEQ ID NO: 494833 - protein, 6 aa, Mycobacterium
GRPQGR

SEQ ID NO: 494834 - protein, 5 aa, Mycobacterium
GRPQH

SEQ ID NO: 494835 - protein, 6 aa, Mycobacterium
GRPQLG

SEQ ID NO: 494836 - protein, 12 aa, Mycobacterium
GRPQLSIPESGP

SEQ ID NO: 494837 - protein, 6 aa, Mycobacterium
GRPQPE

SEQ ID NO: 494838 - protein, 8 aa, Mycobacterium
GRPQPGQT

SEQ ID NO: 494839 - protein, 6 aa, Mycobacterium
GRPQPQ

SEQ ID NO: 494840 - protein, 8 aa, Mycobacterium
GRPQQGET

SEQ ID NO: 494841 - protein, 15 aa, Mycobacterium
GRPQQLPPTDDQGRN

SEQ ID NO: 494842 - protein, 5 aa, Mycobacterium
GRPQR

SEQ ID NO: 494843 - protein, 7 aa, Mycobacterium
GRPQRIG

SEQ ID NO: 494844 - protein, 7 aa, Mycobacterium
GRPQTLQ

SEQ ID NO: 494845 - protein, 4 aa, Mycobacterium
GRPR

SEQ ID NO: 494846 - protein, 16 aa, Mycobacterium
GRPRAAKSTSRPAKLS

SEQ ID NO: 494847 - protein, 11 aa, Mycobacterium
GRPRADSAIGP

SEQ ID NO: 494848 - protein, 8 aa, Mycobacterium
GRPRAGET

SEQ ID NO: 494849 - protein, 6 aa, Mycobacterium
GRPRDE

SEQ ID NO: 494850 - protein, 18 aa, Mycobacterium
GRPRDGDAGDQPGDSSDA

SEQ ID NO: 494851 - protein, 12 aa, Mycobacterium
GRPREAARPAYG

SEQ ID NO: 494852 - protein, 9 aa, Mycobacterium
GRPRPGEHT

SEQ ID NO: 494853 - protein, 8 aa, Mycobacterium
GRPRPLPG

SEQ ID NO: 494854 - protein, 5 aa, Mycobacterium
GRPRR

SEQ ID NO: 494855 - protein, 8 aa, Mycobacterium
GRPRRAGV

SEQ ID NO: 494856 - protein, 10 aa, Mycobacterium
GRPRRPARPT

SEQ ID NO: 494857 - protein, 13 aa, Mycobacterium
GRPRRSGARGPCL

SEQ ID NO: 494858 - protein, 7 aa, Mycobacterium
GRPRRVP

SEQ ID NO: 494859 - protein, 12 aa, Mycobacterium
GRPRSGAEREYT

SEQ ID NO: 494860 - protein, 4 aa, Mycobacterium
GRPS

SEQ ID NO: 494861 - protein, 6 aa, Mycobacterium
GRPSAA

SEQ ID NO: 494862 - protein, 16 aa, Mycobacterium
GRPSADDQLAGPPSEL

SEQ ID NO: 494863 - protein, 7 aa, Mycobacterium
GRPSAEV

SEQ ID NO: 494864 - protein, 6 aa, Mycobacterium
GRPSAG

SEQ ID NO: 494865 - protein, 15 aa, Mycobacterium
GRPSASTALQTGVDE

SEQ ID NO: 494866 - protein, 9 aa, Mycobacterium
GRPSDTNTV

SEQ ID NO: 494867 - protein, 8 aa, Mycobacterium
GRPSEAEL

SEQ ID NO: 494868 - protein, 12 aa, Mycobacterium
GRPSGNSDTRER

SEQ ID NO: 494869 - protein, 7 aa, Mycobacterium
GRPSNIG

SEQ ID NO: 494870 - protein, 8 aa, Mycobacterium
GRPSPAHD

SEQ ID NO: 494871 - protein, 12 aa, Mycobacterium
GRPSPGARQFSS

SEQ ID NO: 494872 - protein, 8 aa, Mycobacterium
GRPSPRWG

SEQ ID NO: 494873 - protein, 9 aa, Mycobacterium
GRPSRAAEL

SEQ ID NO: 494874 - protein, 5 aa, Mycobacterium
GRPST

SEQ ID NO: 494875 - protein, 7 aa, Mycobacterium
GRPSTYT

SEQ ID NO: 494876 - protein, 7 aa, Mycobacterium
GRPSVEI

SEQ ID NO: 494877 - protein, 8 aa, Mycobacterium
GRPSVGGA

SEQ ID NO: 494878 - protein, 6 aa, Mycobacterium
GRPTAA

SEQ ID NO: 494879 - protein, 10 aa, Mycobacterium
GRPTDTAQQE

SEQ ID NO: 494880 - protein, 5 aa, Mycobacterium
GRPTE

SEQ ID NO: 494881 - protein, 6 aa, Mycobacterium
GRPTEL

SEQ ID NO: 494882 - protein, 10 aa, Mycobacterium
GRPTEVPDRY

SEQ ID NO: 494883 - protein, 5 aa, Mycobacterium
GRPTG

SEQ ID NO: 494884 - protein, 14 aa, Mycobacterium
GRPTGAEHDATNDA

SEQ ID NO: 494885 - protein, 8 aa, Mycobacterium
GRPTGDRV

SEQ ID NO: 494886 - protein, 14 aa, Mycobacterium
GRPTGGRSLSTHNA

SEQ ID NO: 494887 - protein, 10 aa, Mycobacterium
GRPTGTSNTR

SEQ ID NO: 494888 - protein, 18 aa, Mycobacterium
GRPTKEALSNPTEEERQA

SEQ ID NO: 494889 - protein, 10 aa, Mycobacterium
GRPTKSAGKT

SEQ ID NO: 494890 - protein, 12 aa, Mycobacterium
GRPTLDASGEAS

SEQ ID NO: 494891 - protein, 5 aa, Mycobacterium
GRPTP

SEQ ID NO: 494892 - protein, 17 aa, Mycobacterium
GRPTPESLQNPTDEERR

SEQ ID NO: 494893 - protein, 9 aa, Mycobacterium
GRPTPGTPL

SEQ ID NO: 494894 - protein, 9 aa, Mycobacterium
GRPTQPHIP

SEQ ID NO: 494895 - protein, 8 aa, Mycobacterium
GRPTRANF

SEQ ID NO: 494896 - protein, 6 aa, Mycobacterium
GRPTRD

SEQ ID NO: 494897 - protein, 7 aa, Mycobacterium
GRPTRIH

SEQ ID NO: 494898 - protein, 6 aa, Mycobacterium
GRPTRQ

SEQ ID NO: 494899 - protein, 9 aa, Mycobacterium
GRPTTVPPS

SEQ ID NO: 494900 - protein, 5 aa, Mycobacterium
GRPTV

SEQ ID NO: 494901 - protein, 30 aa, Mycobacterium
GRPVAADPGGCGSGCGPAVDPGKGLCDERR

SEQ ID NO: 494902 - protein, 5 aa, Mycobacterium
GRPVE

SEQ ID NO: 494903 - protein, 6 aa, Mycobacterium
GRPVET

SEQ ID NO: 494904 - protein, 5 aa, Mycobacterium
GRPVG

SEQ ID NO: 494905 - protein, 9 aa, Mycobacterium
GRPVGDPRR

SEQ ID NO: 494906 - protein, 8 aa, Mycobacterium
GRPVGDVP

SEQ ID NO: 494907 - protein, 11 aa, Mycobacterium
GRPVNDAEGTL

SEQ ID NO: 494908 - protein, 9 aa, Mycobacterium
GRPVPAAHP

SEQ ID NO: 494909 - protein, 12 aa, Mycobacterium
GRPVPGPETEAA

SEQ ID NO: 494910 - protein, 6 aa, Mycobacterium
GRPVPL

SEQ ID NO: 494911 - protein, 6 aa, Mycobacterium
GRPVRD

SEQ ID NO: 494912 - protein, 9 aa, Mycobacterium
GRPVRKPRP

SEQ ID NO: 494913 - protein, 5 aa, Mycobacterium
GRPVS

SEQ ID NO: 494914 - protein, 7 aa, Mycobacterium
GRPVSAR

SEQ ID NO: 494915 - protein, 6 aa, Mycobacterium
GRPVSD

SEQ ID NO: 494916 - protein, 6 aa, Mycobacterium
GRPVTG

SEQ ID NO: 494917 - protein, 17 aa, Mycobacterium
GRPWQEPDEATESLGRT

SEQ ID NO: 494918 - protein, 6 aa, Mycobacterium
GRPWSE

SEQ ID NO: 494919 - protein, 15 aa, Mycobacterium
GRPYAASAPRIGSPR

SEQ ID NO: 494920 - protein, 7 aa, Mycobacterium
GRPYDPV

SEQ ID NO: 494921 - protein, 6 aa, Mycobacterium
GRPYEA

SEQ ID NO: 494922 - protein, 14 aa, Mycobacterium
GRQAADEVLGALSN

SEQ ID NO: 494923 - protein, 7 aa, Mycobacterium
GRQALQQ

SEQ ID NO: 494924 - protein, 7 aa, Mycobacterium
GRQAMTD

SEQ ID NO: 494925 - protein, 10 aa, Mycobacterium
GRQATGEPSV

SEQ ID NO: 494926 - protein, 12 aa, Mycobacterium
GRQDPLGAFSRK

SEQ ID NO: 494927 - protein, 11 aa, Mycobacterium
GRQDRAAEPSC

SEQ ID NO: 494928 - protein, 13 aa, Mycobacterium
GRQDRAGEPALPT

SEQ ID NO: 494929 - protein, 4 aa, Mycobacterium
GRQE

SEQ ID NO: 494930 - protein, 27 aa, Mycobacterium
GRQEAAAAVQAAADAYPAWSQTTPREK

SEQ ID NO: 494931 - protein, 9 aa, Mycobacterium
GRQEDPNRV

SEQ ID NO: 494932 - protein, 27 aa, Mycobacterium
GRQESWEDSPPGWPQRPPYEWFRLHDA

SEQ ID NO: 494933 - protein, 7 aa, Mycobacterium
GRQGGGV

SEQ ID NO: 494934 - protein, 70 aa, Mycobacterium
GRQGNGGAGGHGGSGNQGGYGGLSGDESSRAAQGATGNDGNGGNGGKGANGNAALGANRNGGNGGVGGTG

SEQ ID NO: 494935 - protein, 10 aa, Mycobacterium
GRQGPTGAGR

SEQ ID NO: 494936 - protein, 8 aa, Mycobacterium
GRQGQTDH

SEQ ID NO: 494937 - protein, 9 aa, Mycobacterium
GRQGRDGMS

SEQ ID NO: 494938 - protein, 10 aa, Mycobacterium
GRQGVGDSAN

SEQ ID NO: 494939 - protein, 5 aa, Mycobacterium
GRQGW

SEQ ID NO: 494940 - protein, 4 aa, Mycobacterium
GRQI

SEQ ID NO: 494941 - protein, 12 aa, Mycobacterium
GRQIQPASGRER

SEQ ID NO: 494942 - protein, 9 aa, Mycobacterium
GRQITTTGA

SEQ ID NO: 494943 - protein, 5 aa, Mycobacterium
GRQKY

SEQ ID NO: 494944 - protein, 4 aa, Mycobacterium
GRQM

SEQ ID NO: 494945 - protein, 4 aa, Mycobacterium
GRQP

SEQ ID NO: 494946 - protein, 11 aa, Mycobacterium
GRQPGVGQRGA

SEQ ID NO: 494947 - protein, 6 aa, Mycobacterium
GRQPTG

SEQ ID NO: 494948 - protein, 5 aa, Mycobacterium
GRQPV

SEQ ID NO: 494949 - protein, 4 aa, Mycobacterium
GRQR

SEQ ID NO: 494950 - protein, 18 aa, Mycobacterium
GRQRAGRPGSRPTKLSRE

SEQ ID NO: 494951 - protein, 19 aa, Mycobacterium
GRQRAGRTGSRPAKLSRDG

SEQ ID NO: 494952 - protein, 12 aa, Mycobacterium
GRQRESAGQPVQ

SEQ ID NO: 494953 - protein, 6 aa, Mycobacterium
GRQRGE

SEQ ID NO: 494954 - protein, 11 aa, Mycobacterium
GRQRHVDRDAE

SEQ ID NO: 494955 - protein, 5 aa, Mycobacterium
GRQRK

SEQ ID NO: 494956 - protein, 6 aa, Mycobacterium
GRQRRD

SEQ ID NO: 494957 - protein, 22 aa, Mycobacterium
GRQRRPLPTGLAASGSDPTAPL

SEQ ID NO: 494958 - protein, 14 aa, Mycobacterium
GRQRSLAIPAVSLR

SEQ ID NO: 494959 - protein, 14 aa, Mycobacterium
GRQRSLAIPTVSLR

SEQ ID NO: 494960 - protein, 4 aa, Mycobacterium
GRQS

SEQ ID NO: 494961 - protein, 19 aa, Mycobacterium
GRQSEQLESALSTRDRIGQ

SEQ ID NO: 494962 - protein, 12 aa, Mycobacterium
GRQSGLAAEGLG

SEQ ID NO: 494963 - protein, 11 aa, Mycobacterium
GRQSPDIAQGV

SEQ ID NO: 494964 - protein, 8 aa, Mycobacterium
GRQSVDSL

SEQ ID NO: 494965 - protein, 8 aa, Mycobacterium
GRQTGLEP

SEQ ID NO: 494966 - protein, 9 aa, Mycobacterium
GRQTGRTNR

SEQ ID NO: 494967 - protein, 8 aa, Mycobacterium
GRQTSPEV

SEQ ID NO: 494968 - protein, 6 aa, Mycobacterium
GRQVDD

SEQ ID NO: 494969 - protein, 6 aa, Mycobacterium
GRQVED

SEQ ID NO: 494970 - protein, 7 aa, Mycobacterium
GRQVEDD

SEQ ID NO: 494971 - protein, 4 aa, Mycobacterium
GRQY

SEQ ID NO: 494972 - protein, 5 aa, Mycobacterium
GRRAA

SEQ ID NO: 494973 - protein, 13 aa, Mycobacterium
GRRAAAPVQPTLP

SEQ ID NO: 494974 - protein, 7 aa, Mycobacterium
GRRAEMA

SEQ ID NO: 494975 - protein, 7 aa, Mycobacterium
GRRAERA

SEQ ID NO: 494976 - protein, 26 aa, Mycobacterium
GRRAGQPGVPAAGPGARRPGSPRGRR

SEQ ID NO: 494977 - protein, 13 aa, Mycobacterium
GRRAGTETGRRID

SEQ ID NO: 494978 - protein, 26 aa, Mycobacterium
GRRAGTGTATGARTTGAGTGPGASRA

SEQ ID NO: 494979 - protein, 10 aa, Mycobacterium
GRRARRGRSA

SEQ ID NO: 494980 - protein, 7 aa, Mycobacterium
GRRASVD

SEQ ID NO: 494981 - protein, 5 aa, Mycobacterium
GRRAT

SEQ ID NO: 494982 - protein, 9 aa, Mycobacterium
GRRATSPAW

SEQ ID NO: 494983 - protein, 5 aa, Mycobacterium
GRRDF

SEQ ID NO: 494984 - protein, 9 aa, Mycobacterium
GRRDGEIYQ

SEQ ID NO: 494985 - protein, 9 aa, Mycobacterium
GRRDHDAAE

SEQ ID NO: 494986 - protein, 7 aa, Mycobacterium
GRRDHTL

SEQ ID NO: 494987 - protein, 6 aa, Mycobacterium
GRRDPV

SEQ ID NO: 494988 - protein, 5 aa, Mycobacterium
GRRDQ

SEQ ID NO: 494989 - protein, 6 aa, Mycobacterium
GRRDRA

SEQ ID NO: 494990 - protein, 11 aa, Mycobacterium
GRRDRDDAELQ

SEQ ID NO: 494991 - protein, 8 aa, Mycobacterium
GRRDSHDE

SEQ ID NO: 494992 - protein, 6 aa, Mycobacterium
GRRDVD

SEQ ID NO: 494993 - protein, 7 aa, Mycobacterium
GRRDVER

SEQ ID NO: 494994 - protein, 4 aa, Mycobacterium
GRRE

SEQ ID NO: 494995 - protein, 5 aa, Mycobacterium
GRREG

SEQ ID NO: 494996 - protein, 10 aa, Mycobacterium
GRRELEPGDV

SEQ ID NO: 494997 - protein, 7 aa, Mycobacterium
GRRELTR

SEQ ID NO: 494998 - protein, 12 aa, Mycobacterium
GRREPAAAVPAI

SEQ ID NO: 494999 - protein, 14 aa, Mycobacterium
GRREPDADAQQAIS

SEQ ID NO: 495000 - protein, 7 aa, Mycobacterium
GRREPGA

SEQ ID NO: 495001 - protein, 4 aa, Mycobacterium
GRRF

SEQ ID NO: 495002 - protein, 11 aa, Mycobacterium
GRRFANESSDY

SEQ ID NO: 495003 - protein, 5 aa, Mycobacterium
GRRFD

SEQ ID NO: 495004 - protein, 14 aa, Mycobacterium
GRRGAHRKETTGAL

SEQ ID NO: 495005 - protein, 11 aa, Mycobacterium
GRRGAHSRQQS

SEQ ID NO: 495006 - protein, 7 aa, Mycobacterium
GRRGAQV

SEQ ID NO: 495007 - protein, 8 aa, Mycobacterium
GRRGARGY

SEQ ID NO: 495008 - protein, 8 aa, Mycobacterium
GRRGASVS

SEQ ID NO: 495009 - protein, 5 aa, Mycobacterium
GRRGD

SEQ ID NO: 495010 - protein, 7 aa, Mycobacterium
GRRGDYV

SEQ ID NO: 495011 - protein, 5 aa, Mycobacterium
GRRGE

SEQ ID NO: 495012 - protein, 6 aa, Mycobacterium
GRRGEA

SEQ ID NO: 495013 - protein, 7 aa, Mycobacterium
GRRGEGL

SEQ ID NO: 495014 - protein, 13 aa, Mycobacterium
GRRGERQFNEPRD

SEQ ID NO: 495015 - protein, 29 aa, Mycobacterium
GRRGGGGRPRDRARRGAGFRSGGGGLRSR

SEQ ID NO: 495016 - protein, 6 aa, Mycobacterium
GRRGGL

SEQ ID NO: 495017 - protein, 12 aa, Mycobacterium
GRRGKARTRRRA

SEQ ID NO: 495018 - protein, 5 aa, Mycobacterium
GRRGL

SEQ ID NO: 495019 - protein, 15 aa, Mycobacterium
GRRGPDADRPAYDDT

SEQ ID NO: 495020 - protein, 15 aa, Mycobacterium
GRRGPERDRPAYDDT

SEQ ID NO: 495021 - protein, 14 aa, Mycobacterium
GRRGPNRDLPAYDD

SEQ ID NO: 495022 - protein, 7 aa, Mycobacterium
GRRGPQA

SEQ ID NO: 495023 - protein, 7 aa, Mycobacterium
GRRGPQV

SEQ ID NO: 495024 - protein, 8 aa, Mycobacterium
GRRGPYRD

SEQ ID NO: 495025 - protein, 5 aa, Mycobacterium
GRRGQ

SEQ ID NO: 495026 - protein, 6 aa, Mycobacterium
GRRGQE

SEQ ID NO: 495027 - protein, 7 aa, Mycobacterium
GRRGRHV

SEQ ID NO: 495028 - protein, 6 aa, Mycobacterium
GRRGRR

SEQ ID NO: 495029 - protein, 12 aa, Mycobacterium
GRRGSSPNPVFA

SEQ ID NO: 495030 - protein, 7 aa, Mycobacterium
GRRGSSV

SEQ ID NO: 495031 - protein, 13 aa, Mycobacterium
GRRGTPASCTTPV

SEQ ID NO: 495032 - protein, 9 aa, Mycobacterium
GRRGTVSPA

SEQ ID NO: 495033 - protein, 7 aa, Mycobacterium
GRRGVGR

SEQ ID NO: 495034 - protein, 4 aa, Mycobacterium
GRRH

SEQ ID NO: 495035 - protein, 5 aa, Mycobacterium
GRRHG

SEQ ID NO: 495036 - protein, 7 aa, Mycobacterium
GRRHGPE

SEQ ID NO: 495037 - protein, 5 aa, Mycobacterium
GRRHS

SEQ ID NO: 495038 - protein, 5 aa, Mycobacterium
GRRIE

SEQ ID NO: 495039 - protein, 5 aa, Mycobacterium
GRRIP

SEQ ID NO: 495040 - protein, 13 aa, Mycobacterium
GRRIPDEQAERAE

SEQ ID NO: 495041 - protein, 8 aa, Mycobacterium
GRRITPSR

SEQ ID NO: 495042 - protein, 4 aa, Mycobacterium
GRRK

SEQ ID NO: 495043 - protein, 8 aa, Mycobacterium
GRRKGQEM

SEQ ID NO: 495044 - protein, 6 aa, Mycobacterium
GRRKGV

SEQ ID NO: 495045 - protein, 5 aa, Mycobacterium
GRRLA

SEQ ID NO: 495046 - protein, 9 aa, Mycobacterium
GRRLDARQA

SEQ ID NO: 495047 - protein, 9 aa, Mycobacterium
GRRLDPRQA

SEQ ID NO: 495048 - protein, 6 aa, Mycobacterium
GRRLGS

SEQ ID NO: 495049 - protein, 5 aa, Mycobacterium
GRRLP

SEQ ID NO: 495050 - protein, 8 aa, Mycobacterium
GRRLTEDS

SEQ ID NO: 495051 - protein, 4 aa, Mycobacterium
GRRN

SEQ ID NO: 495052 - protein, 9 aa, Mycobacterium
GRRNAALNP

SEQ ID NO: 495053 - protein, 9 aa, Mycobacterium
GRRNAASNP

SEQ ID NO: 495054 - protein, 11 aa, Mycobacterium
GRRNPAVTAQA

SEQ ID NO: 495055 - protein, 9 aa, Mycobacterium
GRRNPGDVH

SEQ ID NO: 495056 - protein, 10 aa, Mycobacterium
GRRNQPTPPP

SEQ ID NO: 495057 - protein, 8 aa, Mycobacterium
GRRNVQPR

SEQ ID NO: 495058 - protein, 5 aa, Mycobacterium
GRRPA

SEQ ID NO: 495059 - protein, 6 aa, Mycobacterium
GRRPAA

SEQ ID NO: 495060 - protein, 15 aa, Mycobacterium
GRRPAPVAGAPPLGE

SEQ ID NO: 495061 - protein, 6 aa, Mycobacterium
GRRPAQ

SEQ ID NO: 495062 - protein, 13 aa, Mycobacterium
GRRPAQAPAAVAL

SEQ ID NO: 495063 - protein, 11 aa, Mycobacterium
GRRPDETDRRR

SEQ ID NO: 495064 - protein, 9 aa, Mycobacterium
GRRPGDPVV

SEQ ID NO: 495065 - protein, 22 aa, Mycobacterium
GRRPGDSVVPDRATPAKITDED

SEQ ID NO: 495066 - protein, 7 aa, Mycobacterium
GRRPGEA

SEQ ID NO: 495067 - protein, 8 aa, Mycobacterium
GRRPGFGN

SEQ ID NO: 495068 - protein, 44 aa, Mycobacterium
GRRPGSSRGQTQPERKRTAREKTLAKQAARAAAGKVARKPGRSR

SEQ ID NO: 495069 - protein, 11 aa, Mycobacterium
GRRPKSFRPDD

SEQ ID NO: 495070 - protein, 10 aa, Mycobacterium
GRRPNTDDLG

SEQ ID NO: 495071 - protein, 10 aa, Mycobacterium
GRRPPGPDDQ

SEQ ID NO: 495072 - protein, 24 aa, Mycobacterium
GRRPPVATRGTDSTDVTARADLPA

SEQ ID NO: 495073 - protein, 5 aa, Mycobacterium
GRRPQ

SEQ ID NO: 495074 - protein, 8 aa, Mycobacterium
GRRPRRDR

SEQ ID NO: 495075 - protein, 21 aa, Mycobacterium
GRRPSPGTGAYGAAKAGLESL

SEQ ID NO: 495076 - protein, 20 aa, Mycobacterium
GRRPTPGTAAYGAAKAGFES

SEQ ID NO: 495077 - protein, 20 aa, Mycobacterium
GRRPTPGTAAYGAAKAGLEN

SEQ ID NO: 495078 - protein, 6 aa, Mycobacterium
GRRPTV

SEQ ID NO: 495079 - protein, 5 aa, Mycobacterium
GRRPV

SEQ ID NO: 495080 - protein, 6 aa, Mycobacterium
GRRQAV

SEQ ID NO: 495081 - protein, 10 aa, Mycobacterium
GRRQGDPVSR

SEQ ID NO: 495082 - protein, 15 aa, Mycobacterium
GRRQHTRAHDRSRPA

SEQ ID NO: 495083 - protein, 5 aa, Mycobacterium
GRRQP

SEQ ID NO: 495084 - protein, 7 aa, Mycobacterium
GRRQPAA

SEQ ID NO: 495085 - protein, 6 aa, Mycobacterium
GRRQPP

SEQ ID NO: 495086 - protein, 32 aa, Mycobacterium
GRRQRPGGASRTARGATDGGGEGGRGDDCGGH

SEQ ID NO: 495087 - protein, 38 aa, Mycobacterium
GRRQRSSDETGGQREQVKDSQDSDEDDSDNQGASDEEA

SEQ ID NO: 495088 - protein, 7 aa, Mycobacterium
GRRQSAR

SEQ ID NO: 495089 - protein, 4 aa, Mycobacterium
GRRR

SEQ ID NO: 495090 - protein, 5 aa, Mycobacterium
GRRRD

SEQ ID NO: 495091 - protein, 6 aa, Mycobacterium
GRRRDE

SEQ ID NO: 495092 - protein, 7 aa, Mycobacterium
GRRREAA

SEQ ID NO: 495093 - protein, 7 aa, Mycobacterium
GRRREAV

SEQ ID NO: 495094 - protein, 7 aa, Mycobacterium
GRRREER

SEQ ID NO: 495095 - protein, 6 aa, Mycobacterium
GRRRGA

SEQ ID NO: 495096 - protein, 20 aa, Mycobacterium
GRRRGGCRGRGRGGGSGRRG

SEQ ID NO: 495097 - protein, 24 aa, Mycobacterium
GRRRGGIERGHGEHPDSLKRPERV

SEQ ID NO: 495098 - protein, 8 aa, Mycobacterium
GRRRGLQP

SEQ ID NO: 495099 - protein, 5 aa, Mycobacterium
GRRRL

SEQ ID NO: 495100 - protein, 36 aa, Mycobacterium
GRRRNRRSPPSGLGDPQQTPANRSRQTYANCRKGWS

SEQ ID NO: 495101 - protein, 6 aa, Mycobacterium
GRRRPI

SEQ ID NO: 495102 - protein, 21 aa, Mycobacterium
GRRRRTSTIDTHPDGAGGSLA

SEQ ID NO: 495103 - protein, 9 aa, Mycobacterium
GRRRTEART

SEQ ID NO: 495104 - protein, 6 aa, Mycobacterium
GRRSAA

SEQ ID NO: 495105 - protein, 13 aa, Mycobacterium
GRRSAGGDGRPTA

SEQ ID NO: 495106 - protein, 10 aa, Mycobacterium
GRRSAQSGAR

SEQ ID NO: 495107 - protein, 13 aa, Mycobacterium
GRRSARPSGDDRE

SEQ ID NO: 495108 - protein, 14 aa, Mycobacterium
GRRSARPSGDDREA

SEQ ID NO: 495109 - protein, 8 aa, Mycobacterium
GRRSEPKQ

SEQ ID NO: 495110 - protein, 10 aa, Mycobacterium
GRRSGLATEG

SEQ ID NO: 495111 - protein, 11 aa, Mycobacterium
GRRSGQTFETP

SEQ ID NO: 495112 - protein, 10 aa, Mycobacterium
GRRSGRPEWA

SEQ ID NO: 495113 - protein, 11 aa, Mycobacterium
GRRSGSGPDEL

SEQ ID NO: 495114 - protein, 11 aa, Mycobacterium
GRRSHFADPRG

SEQ ID NO: 495115 - protein, 7 aa, Mycobacterium
GRRSNAD

SEQ ID NO: 495116 - protein, 10 aa, Mycobacterium
GRRSNSDRLD

SEQ ID NO: 495117 - protein, 13 aa, Mycobacterium
GRRSQAAGHTVSA

SEQ ID NO: 495118 - protein, 6 aa, Mycobacterium
GRRSRD

SEQ ID NO: 495119 - protein, 29 aa, Mycobacterium
GRRSRRFPAGGRIPAGPLAYTSSEPITPI

SEQ ID NO: 495120 - protein, 16 aa, Mycobacterium
GRRSYDAGLGRRGIPE

SEQ ID NO: 495121 - protein, 5 aa, Mycobacterium
GRRTA

SEQ ID NO: 495122 - protein, 6 aa, Mycobacterium
GRRTAQ

SEQ ID NO: 495123 - protein, 6 aa, Mycobacterium
GRRTAR

SEQ ID NO: 495124 - protein, 5 aa, Mycobacterium
GRRTE

SEQ ID NO: 495125 - protein, 5 aa, Mycobacterium
GRRTF

SEQ ID NO: 495126 - protein, 13 aa, Mycobacterium
GRRTGKPRSTPIT

SEQ ID NO: 495127 - protein, 21 aa, Mycobacterium
GRRTGRVAETDRVRNRRAGGG

SEQ ID NO: 495128 - protein, 5 aa, Mycobacterium
GRRTI

SEQ ID NO: 495129 - protein, 7 aa, Mycobacterium
GRRTPAD

SEQ ID NO: 495130 - protein, 8 aa, Mycobacterium
GRRTPGPS

SEQ ID NO: 495131 - protein, 7 aa, Mycobacterium
GRRTSGT

SEQ ID NO: 495132 - protein, 4 aa, Mycobacterium
GRRV

SEQ ID NO: 495133 - protein, 12 aa, Mycobacterium
GRRVAARSDDAE

SEQ ID NO: 495134 - protein, 8 aa, Mycobacterium
GRRVDPRQ

SEQ ID NO: 495135 - protein, 7 aa, Mycobacterium
GRRVRNS

SEQ ID NO: 495136 - protein, 4 aa, Mycobacterium
GRRY

SEQ ID NO: 495137 - protein, 5 aa, Mycobacterium
GRRYK

SEQ ID NO: 495138 - protein, 4 aa, Mycobacterium
GRSA

SEQ ID NO: 495139 - protein, 7 aa, Mycobacterium
GRSAAAA

SEQ ID NO: 495140 - protein, 12 aa, Mycobacterium
GRSAAAELMRQL

SEQ ID NO: 495141 - protein, 14 aa, Mycobacterium
GRSAAALSSWLSEQ

SEQ ID NO: 495142 - protein, 9 aa, Mycobacterium
GRSAAEVTR

SEQ ID NO: 495143 - protein, 12 aa, Mycobacterium
GRSAENGEGGDT

SEQ ID NO: 495144 - protein, 5 aa, Mycobacterium
GRSAL

SEQ ID NO: 495145 - protein, 5 aa, Mycobacterium
GRSAM

SEQ ID NO: 495146 - protein, 7 aa, Mycobacterium
GRSANTA

SEQ ID NO: 495147 - protein, 10 aa, Mycobacterium
GRSAPDDEVG

SEQ ID NO: 495148 - protein, 14 aa, Mycobacterium
GRSAPRSRSCGPTR

SEQ ID NO: 495149 - protein, 9 aa, Mycobacterium
GRSATGAYA

SEQ ID NO: 495150 - protein, 5 aa, Mycobacterium
GRSAV

SEQ ID NO: 495151 - protein, 5 aa, Mycobacterium
GRSCG

SEQ ID NO: 495152 - protein, 4 aa, Mycobacterium
GRSD

SEQ ID NO: 495153 - protein, 9 aa, Mycobacterium
GRSDAETSE

SEQ ID NO: 495154 - protein, 6 aa, Mycobacterium
GRSDEQ

SEQ ID NO: 495155 - protein, 11 aa, Mycobacterium
GRSDKPTRIED

SEQ ID NO: 495156 - protein, 11 aa, Mycobacterium
GRSDKPTRLDD

SEQ ID NO: 495157 - protein, 13 aa, Mycobacterium
GRSDKPTRREDHS

SEQ ID NO: 495158 - protein, 7 aa, Mycobacterium
GRSDNQV

SEQ ID NO: 495159 - protein, 10 aa, Mycobacterium
GRSDPTDDQR

SEQ ID NO: 495160 - protein, 8 aa, Mycobacterium
GRSDQQQA

SEQ ID NO: 495161 - protein, 10 aa, Mycobacterium
GRSDQRLGQT

SEQ ID NO: 495162 - protein, 8 aa, Mycobacterium
GRSDRDHI

SEQ ID NO: 495163 - protein, 5 aa, Mycobacterium
GRSDV

SEQ ID NO: 495164 - protein, 4 aa, Mycobacterium
GRSE

SEQ ID NO: 495165 - protein, 27 aa, Mycobacterium
GRSEDFDTLRSKDGLSGYPSRSESDHD

SEQ ID NO: 495166 - protein, 5 aa, Mycobacterium
GRSEE

SEQ ID NO: 495167 - protein, 6 aa, Mycobacterium
GRSEEQ

SEQ ID NO: 495168 - protein, 8 aa, Mycobacterium
GRSEFAGP

SEQ ID NO: 495169 - protein, 17 aa, Mycobacterium
GRSEGVDLDDKGREQAA

SEQ ID NO: 495170 - protein, 18 aa, Mycobacterium
GRSEGVDLDDKGRQQASG

SEQ ID NO: 495171 - protein, 18 aa, Mycobacterium
GRSEGVGLDDKGREQATG

SEQ ID NO: 495172 - protein, 15 aa, Mycobacterium
GRSENAGDAALPGTI

SEQ ID NO: 495173 - protein, 8 aa, Mycobacterium
GRSENAVS

SEQ ID NO: 495174 - protein, 9 aa, Mycobacterium
GRSEPSDDV

SEQ ID NO: 495175 - protein, 10 aa, Mycobacterium
GRSEPSDEQR

SEQ ID NO: 495176 - protein, 8 aa, Mycobacterium
GRSERGEA

SEQ ID NO: 495177 - protein, 9 aa, Mycobacterium
GRSESDRHD

SEQ ID NO: 495178 - protein, 6 aa, Mycobacterium
GRSEVS

SEQ ID NO: 495179 - protein, 6 aa, Mycobacterium
GRSFTG

SEQ ID NO: 495180 - protein, 10 aa, Mycobacterium
GRSGAAGAQA

SEQ ID NO: 495181 - protein, 11 aa, Mycobacterium
GRSGALSDRGT

SEQ ID NO: 495182 - protein, 6 aa, Mycobacterium
GRSGAS

SEQ ID NO: 495183 - protein, 6 aa, Mycobacterium
GRSGAV

SEQ ID NO: 495184 - protein, 6 aa, Mycobacterium
GRSGDF

SEQ ID NO: 495185 - protein, 8 aa, Mycobacterium
GRSGEPFP

SEQ ID NO: 495186 - protein, 23 aa, Mycobacterium
GRSGGAPETVLDGKTGTVVDGTD

SEQ ID NO: 495187 - protein, 16 aa, Mycobacterium
GRSGGAPETVRDGETG

SEQ ID NO: 495188 - protein, 8 aa, Mycobacterium
GRSGGHLS

SEQ ID NO: 495189 - protein, 5 aa, Mycobacterium
GRSGI

SEQ ID NO: 495190 - protein, 7 aa, Mycobacterium
GRSGIEA

SEQ ID NO: 495191 - protein, 26 aa, Mycobacterium
GRSGNPGRRPGDPARRRERDGPARRV

SEQ ID NO: 495192 - protein, 10 aa, Mycobacterium
GRSGPSPEAQ

SEQ ID NO: 495193 - protein, 26 aa, Mycobacterium
GRSGQRRQEAATSRAPQPDRAPEPWR

SEQ ID NO: 495194 - protein, 8 aa, Mycobacterium
GRSGQRRV

SEQ ID NO: 495195 - protein, 9 aa, Mycobacterium
GRSGRDGIH

SEQ ID NO: 495196 - protein, 24 aa, Mycobacterium
GRSGRRARPPRPDGQKRTPRPVPP

SEQ ID NO: 495197 - protein, 9 aa, Mycobacterium
GRSGSGKST

SEQ ID NO: 495198 - protein, 12 aa, Mycobacterium
GRSGSGKSTLAD

SEQ ID NO: 495199 - protein, 11 aa, Mycobacterium
GRSGSGKTTLA

SEQ ID NO: 495200 - protein, 7 aa, Mycobacterium
GRSGTAA

SEQ ID NO: 495201 - protein, 7 aa, Mycobacterium
GRSGTPV

SEQ ID NO: 495202 - protein, 5 aa, Mycobacterium
GRSGV

SEQ ID NO: 495203 - protein, 16 aa, Mycobacterium
GRSGVGATEAAASYTV

SEQ ID NO: 495204 - protein, 10 aa, Mycobacterium
GRSGVPIEPE

SEQ ID NO: 495205 - protein, 6 aa, Mycobacterium
GRSGVS

SEQ ID NO: 495206 - protein, 5 aa, Mycobacterium
GRSHP

SEQ ID NO: 495207 - protein, 12 aa, Mycobacterium
GRSHPSPNAGVA

SEQ ID NO: 495208 - protein, 12 aa, Mycobacterium
GRSHRDGQTPHF

SEQ ID NO: 495209 - protein, 12 aa, Mycobacterium
GRSHRPGQTPHF

SEQ ID NO: 495210 - protein, 4 aa, Mycobacterium
GRSI

SEQ ID NO: 495211 - protein, 9 aa, Mycobacterium
GRSIDSPHY

SEQ ID NO: 495212 - protein, 6 aa, Mycobacterium
GRSIRR

SEQ ID NO: 495213 - protein, 8 aa, Mycobacterium
GRSIRRPL

SEQ ID NO: 495214 - protein, 10 aa, Mycobacterium
GRSKAQSARD

SEQ ID NO: 495215 - protein, 6 aa, Mycobacterium
GRSKLA

SEQ ID NO: 495216 - protein, 19 aa, Mycobacterium
GRSKPFSARADGYGRGEGA

SEQ ID NO: 495217 - protein, 8 aa, Mycobacterium
GRSKPNDI

SEQ ID NO: 495218 - protein, 14 aa, Mycobacterium
GRSKVNSDADAVRD

SEQ ID NO: 495219 - protein, 39 aa, Mycobacterium
GRSLKQSAAAIDDYADTAGKRRKEHDRVHGTQPGDPVKA

SEQ ID NO: 495220 - protein, 6 aa, Mycobacterium
GRSLPS

SEQ ID NO: 495221 - protein, 4 aa, Mycobacterium
GRSN

SEQ ID NO: 495222 - protein, 13 aa, Mycobacterium
GRSNASVGAGETI

SEQ ID NO: 495223 - protein, 8 aa, Mycobacterium
GRSNERAG

SEQ ID NO: 495224 - protein, 5 aa, Mycobacterium
GRSNG

SEQ ID NO: 495225 - protein, 4 aa, Mycobacterium
GRSP

SEQ ID NO: 495226 - protein, 6 aa, Mycobacterium
GRSPDD

SEQ ID NO: 495227 - protein, 8 aa, Mycobacterium
GRSPEEFA

SEQ ID NO: 495228 - protein, 13 aa, Mycobacterium
GRSPEHIRELAAL

SEQ ID NO: 495229 - protein, 16 aa, Mycobacterium
GRSPEPAEDAADGDAE

SEQ ID NO: 495230 - protein, 12 aa, Mycobacterium
GRSPGLPPRTDS

SEQ ID NO: 495231 - protein, 18 aa, Mycobacterium
GRSPGQRLDSSARSLNPA

SEQ ID NO: 495232 - protein, 8 aa, Mycobacterium
GRSPNQTY

SEQ ID NO: 495233 - protein, 8 aa, Mycobacterium
GRSPNTAD

SEQ ID NO: 495234 - protein, 7 aa, Mycobacterium
GRSPQEW

SEQ ID NO: 495235 - protein, 10 aa, Mycobacterium
GRSPQGTPGA

SEQ ID NO: 495236 - protein, 4 aa, Mycobacterium
GRSQ

SEQ ID NO: 495237 - protein, 9 aa, Mycobacterium
GRSQAGGLG

SEQ ID NO: 495238 - protein, 6 aa, Mycobacterium
GRSQET

SEQ ID NO: 495239 - protein, 5 aa, Mycobacterium
GRSQM

SEQ ID NO: 495240 - protein, 6 aa, Mycobacterium
GRSQRV

SEQ ID NO: 495241 - protein, 10 aa, Mycobacterium
GRSRAHGRGG

SEQ ID NO: 495242 - protein, 5 aa, Mycobacterium
GRSRD

SEQ ID NO: 495243 - protein, 8 aa, Mycobacterium
GRSRDFDT

SEQ ID NO: 495244 - protein, 14 aa, Mycobacterium
GRSRDPEIVHLAGV

SEQ ID NO: 495245 - protein, 10 aa, Mycobacterium
GRSRELYKSG

SEQ ID NO: 495246 - protein, 17 aa, Mycobacterium
GRSRGSDRQRAAATRSI

SEQ ID NO: 495247 - protein, 6 aa, Mycobacterium
GRSRGT

SEQ ID NO: 495248 - protein, 12 aa, Mycobacterium
GRSRPDWPSVPT

SEQ ID NO: 495249 - protein, 11 aa, Mycobacterium
GRSRRDGQTPH

SEQ ID NO: 495250 - protein, 17 aa, Mycobacterium
GRSRSSATSQLIKKRSA

SEQ ID NO: 495251 - protein, 9 aa, Mycobacterium
GRSRSTGKR

SEQ ID NO: 495252 - protein, 5 aa, Mycobacterium
GRSRT

SEQ ID NO: 495253 - protein, 6 aa, Mycobacterium
GRSSAY

SEQ ID NO: 495254 - protein, 7 aa, Mycobacterium
GRSSDYA

SEQ ID NO: 495255 - protein, 9 aa, Mycobacterium
GRSSDYPQK

SEQ ID NO: 495256 - protein, 5 aa, Mycobacterium
GRSSG

SEQ ID NO: 495257 - protein, 23 aa, Mycobacterium
GRSSGDGRTPRRPALAQLDDELT

SEQ ID NO: 495258 - protein, 15 aa, Mycobacterium
GRSSHLGTGGMASKV

SEQ ID NO: 495259 - protein, 8 aa, Mycobacterium
GRSSMNKE

SEQ ID NO: 495260 - protein, 22 aa, Mycobacterium
GRSSRTGTCRSDYDRPETIEET

SEQ ID NO: 495261 - protein, 6 aa, Mycobacterium
GRSSRY

SEQ ID NO: 495262 - protein, 9 aa, Mycobacterium
GRSSSNTAG

SEQ ID NO: 495263 - protein, 5 aa, Mycobacterium
GRSST

SEQ ID NO: 495264 - protein, 13 aa, Mycobacterium
GRSSTPTALGGSS

SEQ ID NO: 495265 - protein, 16 aa, Mycobacterium
GRSSTRSQRHDTRRSL

SEQ ID NO: 495266 - protein, 13 aa, Mycobacterium
GRSSVPGLPLIHQ

SEQ ID NO: 495267 - protein, 10 aa, Mycobacterium
GRSSVREVPE

SEQ ID NO: 495268 - protein, 11 aa, Mycobacterium
GRSTADATDQI

SEQ ID NO: 495269 - protein, 7 aa, Mycobacterium
GRSTDRL

SEQ ID NO: 495270 - protein, 6 aa, Mycobacterium
GRSTEL

SEQ ID NO: 495271 - protein, 13 aa, Mycobacterium
GRSTEQVRELASL

SEQ ID NO: 495272 - protein, 8 aa, Mycobacterium
GRSTERTG

SEQ ID NO: 495273 - protein, 7 aa, Mycobacterium
GRSTGPE

SEQ ID NO: 495274 - protein, 8 aa, Mycobacterium
GRSTHDAA

SEQ ID NO: 495275 - protein, 8 aa, Mycobacterium
GRSTMNKG

SEQ ID NO: 495276 - protein, 7 aa, Mycobacterium
GRSTMTK

SEQ ID NO: 495277 - protein, 8 aa, Mycobacterium
GRSTMTKS

SEQ ID NO: 495278 - protein, 10 aa, Mycobacterium
GRSTPGAQAV

SEQ ID NO: 495279 - protein, 8 aa, Mycobacterium
GRSTPSFR

SEQ ID NO: 495280 - protein, 16 aa, Mycobacterium
GRSTQLGREETLEDTG

SEQ ID NO: 495281 - protein, 8 aa, Mycobacterium
GRSTQTAL

SEQ ID NO: 495282 - protein, 5 aa, Mycobacterium
GRSTR

SEQ ID NO: 495283 - protein, 10 aa, Mycobacterium
GRSTRTTSRA

SEQ ID NO: 495284 - protein, 13 aa, Mycobacterium
GRSTSAYNQGLEK

SEQ ID NO: 495285 - protein, 13 aa, Mycobacterium
GRSTSTDDAEGEV

SEQ ID NO: 495286 - protein, 11 aa, Mycobacterium
GRSTTAPLETR

SEQ ID NO: 495287 - protein, 14 aa, Mycobacterium
GRSTTYGELDEAAN

SEQ ID NO: 495288 - protein, 6 aa, Mycobacterium
GRSTVP

SEQ ID NO: 495289 - protein, 9 aa, Mycobacterium
GRSVDKGEK

SEQ ID NO: 495290 - protein, 7 aa, Mycobacterium
GRSVETR

SEQ ID NO: 495291 - protein, 5 aa, Mycobacterium
GRSVG

SEQ ID NO: 495292 - protein, 9 aa, Mycobacterium
GRSVGEKVA

SEQ ID NO: 495293 - protein, 11 aa, Mycobacterium
GRSVHTQRAYR

SEQ ID NO: 495294 - protein, 9 aa, Mycobacterium
GRSVPAKSL

SEQ ID NO: 495295 - protein, 11 aa, Mycobacterium
GRSVPAKSLGD

SEQ ID NO: 495296 - protein, 12 aa, Mycobacterium
GRSVPAKSLGDF

SEQ ID NO: 495297 - protein, 8 aa, Mycobacterium
GRSVPGEQ

SEQ ID NO: 495298 - protein, 9 aa, Mycobacterium
GRSVPPSRT

SEQ ID NO: 495299 - protein, 13 aa, Mycobacterium
GRSVPSDLEDSMP

SEQ ID NO: 495300 - protein, 7 aa, Mycobacterium
GRSVRSA

SEQ ID NO: 495301 - protein, 6 aa, Mycobacterium
GRSVSD

SEQ ID NO: 495302 - protein, 12 aa, Mycobacterium
GRSVSRDTTDRT

SEQ ID NO: 495303 - protein, 12 aa, Mycobacterium
GRSVTANAADEA

SEQ ID NO: 495304 - protein, 7 aa, Mycobacterium
GRSWPNA

SEQ ID NO: 495305 - protein, 9 aa, Mycobacterium
GRSWPRRST

SEQ ID NO: 495306 - protein, 5 aa, Mycobacterium
GRSWQ

SEQ ID NO: 495307 - protein, 6 aa, Mycobacterium
GRSWQA

SEQ ID NO: 495308 - protein, 6 aa, Mycobacterium
GRSYDD

SEQ ID NO: 495309 - protein, 12 aa, Mycobacterium
GRSYGDHACNGG

SEQ ID NO: 495310 - protein, 5 aa, Mycobacterium
GRSYL

SEQ ID NO: 495311 - protein, 19 aa, Mycobacterium
GRSYPEDRGPGAGCPPEHG

SEQ ID NO: 495312 - protein, 5 aa, Mycobacterium
GRTAA

SEQ ID NO: 495313 - protein, 6 aa, Mycobacterium
GRTAAE

SEQ ID NO: 495314 - protein, 7 aa, Mycobacterium
GRTAAGV

SEQ ID NO: 495315 - protein, 7 aa, Mycobacterium
GRTAASI

SEQ ID NO: 495316 - protein, 5 aa, Mycobacterium
GRTAD

SEQ ID NO: 495317 - protein, 15 aa, Mycobacterium
GRTADTADDGTEGPT

SEQ ID NO: 495318 - protein, 7 aa, Mycobacterium
GRTAEDV

SEQ ID NO: 495319 - protein, 8 aa, Mycobacterium
GRTAEGAL

SEQ ID NO: 495320 - protein, 11 aa, Mycobacterium
GRTAEKRRELE

SEQ ID NO: 495321 - protein, 7 aa, Mycobacterium
GRTAGSA

SEQ ID NO: 495322 - protein, 12 aa, Mycobacterium
GRTAGTAGGGRL

SEQ ID NO: 495323 - protein, 8 aa, Mycobacterium
GRTAKRPE

SEQ ID NO: 495324 - protein, 5 aa, Mycobacterium
GRTAL

SEQ ID NO: 495325 - protein, 6 aa, Mycobacterium
GRTANG

SEQ ID NO: 495326 - protein, 6 aa, Mycobacterium
GRTAPS

SEQ ID NO: 495327 - protein, 7 aa, Mycobacterium
GRTAPTV

SEQ ID NO: 495328 - protein, 5 aa, Mycobacterium
GRTAS

SEQ ID NO: 495329 - protein, 6 aa, Mycobacterium
GRTASA

SEQ ID NO: 495330 - protein, 7 aa, Mycobacterium
GRTATGI

SEQ ID NO: 495331 - protein, 8 aa, Mycobacterium
GRTATIDA

SEQ ID NO: 495332 - protein, 6 aa, Mycobacterium
GRTATT

SEQ ID NO: 495333 - protein, 5 aa, Mycobacterium
GRTAY

SEQ ID NO: 495334 - protein, 6 aa, Mycobacterium
GRTDCY

SEQ ID NO: 495335 - protein, 21 aa, Mycobacterium
GRTDEKRTAVAGSGATPVAAA

SEQ ID NO: 495336 - protein, 6 aa, Mycobacterium
GRTDEQ

SEQ ID NO: 495337 - protein, 16 aa, Mycobacterium
GRTDGAPFQISPKGKP

SEQ ID NO: 495338 - protein, 13 aa, Mycobacterium
GRTDKDIQKSGKQ

SEQ ID NO: 495339 - protein, 6 aa, Mycobacterium
GRTDLD

SEQ ID NO: 495340 - protein, 12 aa, Mycobacterium
GRTDLPGGSGRD

SEQ ID NO: 495341 - protein, 13 aa, Mycobacterium
GRTDRDVQAGGKQ

SEQ ID NO: 495342 - protein, 13 aa, Mycobacterium
GRTDRDVRGGRKQ

SEQ ID NO: 495343 - protein, 10 aa, Mycobacterium
GRTDTAPSDV

SEQ ID NO: 495344 - protein, 6 aa, Mycobacterium
GRTDVE

SEQ ID NO: 495345 - protein, 7 aa, Mycobacterium
GRTEADV

SEQ ID NO: 495346 - protein, 7 aa, Mycobacterium
GRTEAQV

SEQ ID NO: 495347 - protein, 10 aa, Mycobacterium
GRTEARNDEI

SEQ ID NO: 495348 - protein, 6 aa, Mycobacterium
GRTEDI

SEQ ID NO: 495349 - protein, 7 aa, Mycobacterium
GRTEDIE

SEQ ID NO: 495350 - protein, 7 aa, Mycobacterium
GRTEDPA

SEQ ID NO: 495351 - protein, 5 aa, Mycobacterium
GRTEE

SEQ ID NO: 495352 - protein, 6 aa, Mycobacterium
GRTEET

SEQ ID NO: 495353 - protein, 12 aa, Mycobacterium
GRTEGAPHEPIS

SEQ ID NO: 495354 - protein, 11 aa, Mycobacterium
GRTEGLSDVER

SEQ ID NO: 495355 - protein, 12 aa, Mycobacterium
GRTEIADATRQI

SEQ ID NO: 495356 - protein, 11 aa, Mycobacterium
GRTEIAEATRD

SEQ ID NO: 495357 - protein, 6 aa, Mycobacterium
GRTEKE

SEQ ID NO: 495358 - protein, 7 aa, Mycobacterium
GRTENLG

SEQ ID NO: 495359 - protein, 7 aa, Mycobacterium
GRTEQEY

SEQ ID NO: 495360 - protein, 14 aa, Mycobacterium
GRTESPSAADAAGE

SEQ ID NO: 495361 - protein, 10 aa, Mycobacterium
GRTESYIDER

SEQ ID NO: 495362 - protein, 8 aa, Mycobacterium
GRTETAQY

SEQ ID NO: 495363 - protein, 20 aa, Mycobacterium
GRTETGPDIDAYGSPSSVAA

SEQ ID NO: 495364 - protein, 5 aa, Mycobacterium
GRTEV

SEQ ID NO: 495365 - protein, 6 aa, Mycobacterium
GRTEVT

SEQ ID NO: 495366 - protein, 6 aa, Mycobacterium
GRTFGT

SEQ ID NO: 495367 - protein, 32 aa, Mycobacterium
GRTGAAELTDPVRAGGAISDNATDTPRRRRRD

SEQ ID NO: 495368 - protein, 6 aa, Mycobacterium
GRTGDF

SEQ ID NO: 495369 - protein, 5 aa, Mycobacterium
GRTGE

SEQ ID NO: 495370 - protein, 6 aa, Mycobacterium
GRTGEG

SEQ ID NO: 495371 - protein, 9 aa, Mycobacterium
GRTGEKRKL

SEQ ID NO: 495372 - protein, 12 aa, Mycobacterium
GRTGEPAPGSRV

SEQ ID NO: 495373 - protein, 7 aa, Mycobacterium
GRTGEQT

SEQ ID NO: 495374 - protein, 7 aa, Mycobacterium
GRTGEVR

SEQ ID NO: 495375 - protein, 5 aa, Mycobacterium
GRTGG

SEQ ID NO: 495376 - protein, 8 aa, Mycobacterium
GRTGGAGF

SEQ ID NO: 495377 - protein, 7 aa, Mycobacterium
GRTGGPV

SEQ ID NO: 495378 - protein, 18 aa, Mycobacterium
GRTGGWQQAQQPDASDAA

SEQ ID NO: 495379 - protein, 12 aa, Mycobacterium
GRTGPGPGAAAR

SEQ ID NO: 495380 - protein, 15 aa, Mycobacterium
GRTGPYAARPAYDDT

SEQ ID NO: 495381 - protein, 10 aa, Mycobacterium
GRTGRRPGTL

SEQ ID NO: 495382 - protein, 10 aa, Mycobacterium
GRTGRSLSRP

SEQ ID NO: 495383 - protein, 7 aa, Mycobacterium
GRTGSRR

SEQ ID NO: 495384 - protein, 5 aa, Mycobacterium
GRTGY

SEQ ID NO: 495385 - protein, 8 aa, Mycobacterium
GRTGYAAT

SEQ ID NO: 495386 - protein, 6 aa, Mycobacterium
GRTGYV

SEQ ID NO: 495387 - protein, 6 aa, Mycobacterium
GRTHPA

SEQ ID NO: 495388 - protein, 8 aa, Mycobacterium
GRTHRGGG

SEQ ID NO: 495389 - protein, 6 aa, Mycobacterium
GRTIGT

SEQ ID NO: 495390 - protein, 12 aa, Mycobacterium
GRTIPDSETRAA

SEQ ID NO: 495391 - protein, 6 aa, Mycobacterium
GRTITE

SEQ ID NO: 495392 - protein, 12 aa, Mycobacterium
GRTIYREPATQS

SEQ ID NO: 495393 - protein, 4 aa, Mycobacterium
GRTK

SEQ ID NO: 495394 - protein, 26 aa, Mycobacterium
GRTKKELAADEGISPSAVSQRASRDG

SEQ ID NO: 495395 - protein, 7 aa, Mycobacterium
GRTKLSS

SEQ ID NO: 495396 - protein, 8 aa, Mycobacterium
GRTKPLSV

SEQ ID NO: 495397 - protein, 8 aa, Mycobacterium
GRTLEDPH

SEQ ID NO: 495398 - protein, 8 aa, Mycobacterium
GRTLEEAV

SEQ ID NO: 495399 - protein, 6 aa, Mycobacterium
GRTNPD

SEQ ID NO: 495400 - protein, 7 aa, Mycobacterium
GRTNQQI

SEQ ID NO: 495401 - protein, 7 aa, Mycobacterium
GRTNREI

SEQ ID NO: 495402 - protein, 10 aa, Mycobacterium
GRTNRNGMRE

SEQ ID NO: 495403 - protein, 8 aa, Mycobacterium
GRTNYRNP

SEQ ID NO: 495404 - protein, 10 aa, Mycobacterium
GRTNYRNPAT

SEQ ID NO: 495405 - protein, 4 aa, Mycobacterium
GRTP

SEQ ID NO: 495406 - protein, 19 aa, Mycobacterium
GRTPAAAELQDPLAAGPDV

SEQ ID NO: 495407 - protein, 14 aa, Mycobacterium
GRTPAASELQDPRL

SEQ ID NO: 495408 - protein, 6 aa, Mycobacterium
GRTPAL

SEQ ID NO: 495409 - protein, 17 aa, Mycobacterium
GRTPAPMGKSNNYPRSV

SEQ ID NO: 495410 - protein, 17 aa, Mycobacterium
GRTPAPMGKSNSYPRSV

SEQ ID NO: 495411 - protein, 6 aa, Mycobacterium
GRTPAT

SEQ ID NO: 495412 - protein, 5 aa, Mycobacterium
GRTPD

SEQ ID NO: 495413 - protein, 34 aa, Mycobacterium
GRTPEATRKLASRARRRVQEADPAPAGDMAAQRE

SEQ ID NO: 495414 - protein, 20 aa, Mycobacterium
GRTPGDPYGETTGDKARTSI

SEQ ID NO: 495415 - protein, 8 aa, Mycobacterium
GRTPGGPI

SEQ ID NO: 495416 - protein, 15 aa, Mycobacterium
GRTPGGSSGGSAAAV

SEQ ID NO: 495417 - protein, 13 aa, Mycobacterium
GRTPGPASRPAPC

SEQ ID NO: 495418 - protein, 5 aa, Mycobacterium
GRTPK

SEQ ID NO: 495419 - protein, 22 aa, Mycobacterium
GRTPKAEGRELDGRRWDEMPAA

SEQ ID NO: 495420 - protein, 13 aa, Mycobacterium
GRTPKALGRELDG

SEQ ID NO: 495421 - protein, 9 aa, Mycobacterium
GRTPNGDQL

SEQ ID NO: 495422 - protein, 8 aa, Mycobacterium
GRTPNTTH

SEQ ID NO: 495423 - protein, 6 aa, Mycobacterium
GRTPPF

SEQ ID NO: 495424 - protein, 12 aa, Mycobacterium
GRTPPHPRWPGN

SEQ ID NO: 495425 - protein, 8 aa, Mycobacterium
GRTPRAGV

SEQ ID NO: 495426 - protein, 7 aa, Mycobacterium
GRTPRQG

SEQ ID NO: 495427 - protein, 5 aa, Mycobacterium
GRTPS

SEQ ID NO: 495428 - protein, 6 aa, Mycobacterium
GRTPTD

SEQ ID NO: 495429 - protein, 5 aa, Mycobacterium
GRTPV

SEQ ID NO: 495430 - protein, 7 aa, Mycobacterium
GRTPVEL

SEQ ID NO: 495431 - protein, 7 aa, Mycobacterium
GRTPVPA

SEQ ID NO: 495432 - protein, 8 aa, Mycobacterium
GRTPVPAE

SEQ ID NO: 495433 - protein, 6 aa, Mycobacterium
GRTPVR

SEQ ID NO: 495434 - protein, 7 aa, Mycobacterium
GRTPVTG

SEQ ID NO: 495435 - protein, 5 aa, Mycobacterium
GRTQA

SEQ ID NO: 495436 - protein, 8 aa, Mycobacterium
GRTQAPAP

SEQ ID NO: 495437 - protein, 7 aa, Mycobacterium
GRTQFGA

SEQ ID NO: 495438 - protein, 7 aa, Mycobacterium
GRTQPLH

SEQ ID NO: 495439 - protein, 10 aa, Mycobacterium
GRTQQNLARR

SEQ ID NO: 495440 - protein, 8 aa, Mycobacterium
GRTQSTGK

SEQ ID NO: 495441 - protein, 8 aa, Mycobacterium
GRTRAEEV

SEQ ID NO: 495442 - protein, 6 aa, Mycobacterium
GRTRGI

SEQ ID NO: 495443 - protein, 9 aa, Mycobacterium
GRTRGRVAT

SEQ ID NO: 495444 - protein, 5 aa, Mycobacterium
GRTRP

SEQ ID NO: 495445 - protein, 8 aa, Mycobacterium
GRTRPEKI

SEQ ID NO: 495446 - protein, 10 aa, Mycobacterium
GRTRQNLARR

SEQ ID NO: 495447 - protein, 5 aa, Mycobacterium
GRTRR

SEQ ID NO: 495448 - protein, 6 aa, Mycobacterium
GRTRSW

SEQ ID NO: 495449 - protein, 4 aa, Mycobacterium
GRTS

SEQ ID NO: 495450 - protein, 5 aa, Mycobacterium
GRTSA

SEQ ID NO: 495451 - protein, 8 aa, Mycobacterium
GRTSAPIT

SEQ ID NO: 495452 - protein, 8 aa, Mycobacterium
GRTSGHTQ

SEQ ID NO: 495453 - protein, 7 aa, Mycobacterium
GRTSGRT

SEQ ID NO: 495454 - protein, 6 aa, Mycobacterium
GRTSGV

SEQ ID NO: 495455 - protein, 15 aa, Mycobacterium
GRTSPAGTQAGMSRS

SEQ ID NO: 495456 - protein, 20 aa, Mycobacterium
GRTSSLSNAAGKASVFGGQP

SEQ ID NO: 495457 - protein, 9 aa, Mycobacterium
GRTSTVRAQ

SEQ ID NO: 495458 - protein, 9 aa, Mycobacterium
GRTTGPAPI

SEQ ID NO: 495459 - protein, 6 aa, Mycobacterium
GRTTGY

SEQ ID NO: 495460 - protein, 7 aa, Mycobacterium
GRTTPGR

SEQ ID NO: 495461 - protein, 9 aa, Mycobacterium
GRTTSGPEY

SEQ ID NO: 495462 - protein, 13 aa, Mycobacterium
GRTTVAADGGPDL

SEQ ID NO: 495463 - protein, 6 aa, Mycobacterium
GRTVAD

SEQ ID NO: 495464 - protein, 6 aa, Mycobacterium
GRTVAG

SEQ ID NO: 495465 - protein, 7 aa, Mycobacterium
GRTVDGS

SEQ ID NO: 495466 - protein, 17 aa, Mycobacterium
GRTVDGYDADRDARIRA

SEQ ID NO: 495467 - protein, 11 aa, Mycobacterium
GRTVDKEPRWR

SEQ ID NO: 495468 - protein, 18 aa, Mycobacterium
GRTVDQPWSAPQNGAVTA

SEQ ID NO: 495469 - protein, 10 aa, Mycobacterium
GRTVGHAGKR

SEQ ID NO: 495470 - protein, 13 aa, Mycobacterium
GRTVPATDHSGRE

SEQ ID NO: 495471 - protein, 7 aa, Mycobacterium
GRTVPEG

SEQ ID NO: 495472 - protein, 8 aa, Mycobacterium
GRTVRSGT

SEQ ID NO: 495473 - protein, 5 aa, Mycobacterium
GRTVS

SEQ ID NO: 495474 - protein, 5 aa, Mycobacterium
GRTVT

SEQ ID NO: 495475 - protein, 18 aa, Mycobacterium
GRTVTTNPAGTAGPARPL

SEQ ID NO: 495476 - protein, 7 aa, Mycobacterium
GRTWTDT

SEQ ID NO: 495477 - protein, 4 aa, Mycobacterium
GRTY

SEQ ID NO: 495478 - protein, 7 aa, Mycobacterium
GRTYAEH

SEQ ID NO: 495479 - protein, 8 aa, Mycobacterium
GRTYTTVP

SEQ ID NO: 495480 - protein, 5 aa, Mycobacterium
GRVAA

SEQ ID NO: 495481 - protein, 20 aa, Mycobacterium
GRVAARRRADQRADASRQHP

SEQ ID NO: 495482 - protein, 10 aa, Mycobacterium
GRVAGTGTQF

SEQ ID NO: 495483 - protein, 11 aa, Mycobacterium
GRVAKDDGTPY

SEQ ID NO: 495484 - protein, 17 aa, Mycobacterium
GRVAPAAPWPPRPHPSH

SEQ ID NO: 495485 - protein, 7 aa, Mycobacterium
GRVAPEQ

SEQ ID NO: 495486 - protein, 10 aa, Mycobacterium
GRVAPSPARV

SEQ ID NO: 495487 - protein, 4 aa, Mycobacterium
GRVD

SEQ ID NO: 495488 - protein, 5 aa, Mycobacterium
GRVDA

SEQ ID NO: 495489 - protein, 5 aa, Mycobacterium
GRVDD

SEQ ID NO: 495490 - protein, 9 aa, Mycobacterium
GRVDDARAD

SEQ ID NO: 495491 - protein, 7 aa, Mycobacterium
GRVDGRS

SEQ ID NO: 495492 - protein, 9 aa, Mycobacterium
GRVDNDATL

SEQ ID NO: 495493 - protein, 9 aa, Mycobacterium
GRVDNDATN

SEQ ID NO: 495494 - protein, 7 aa, Mycobacterium
GRVDPRS

SEQ ID NO: 495495 - protein, 15 aa, Mycobacterium
GRVEDPVGSAPHRGR

SEQ ID NO: 495496 - protein, 8 aa, Mycobacterium
GRVEGDED

SEQ ID NO: 495497 - protein, 13 aa, Mycobacterium
GRVGATGTAIKDD

SEQ ID NO: 495498 - protein, 6 aa, Mycobacterium
GRVGDG

SEQ ID NO: 495499 - protein, 6 aa, Mycobacterium
GRVGDV

SEQ ID NO: 495500 - protein, 43 aa, Mycobacterium
GRVGHQGKQSTHRASMSDRRRCPAQHPSESPVAALGCNRVVYA

SEQ ID NO: 495501 - protein, 5 aa, Mycobacterium
GRVGN

SEQ ID NO: 495502 - protein, 6 aa, Mycobacterium
GRVGPD

SEQ ID NO: 495503 - protein, 8 aa, Mycobacterium
GRVGSTAA

SEQ ID NO: 495504 - protein, 12 aa, Mycobacterium
GRVGSTAQLSVD

SEQ ID NO: 495505 - protein, 5 aa, Mycobacterium
GRVGT

SEQ ID NO: 495506 - protein, 9 aa, Mycobacterium
GRVKRDNDS

SEQ ID NO: 495507 - protein, 13 aa, Mycobacterium
GRVNATRARGTDR

SEQ ID NO: 495508 - protein, 7 aa, Mycobacterium
GRVNPGA

SEQ ID NO: 495509 - protein, 10 aa, Mycobacterium
GRVNPGDSAA

SEQ ID NO: 495510 - protein, 7 aa, Mycobacterium
GRVNTAD

SEQ ID NO: 495511 - protein, 6 aa, Mycobacterium
GRVPAE

SEQ ID NO: 495512 - protein, 5 aa, Mycobacterium
GRVPD

SEQ ID NO: 495513 - protein, 8 aa, Mycobacterium
GRVPDDPV

SEQ ID NO: 495514 - protein, 9 aa, Mycobacterium
GRVPDPALP

SEQ ID NO: 495515 - protein, 6 aa, Mycobacterium
GRVPHQ

SEQ ID NO: 495516 - protein, 4 aa, Mycobacterium
GRVQ

SEQ ID NO: 495517 - protein, 22 aa, Mycobacterium
GRVQDEQSTEGHRAQTSCLVKA

SEQ ID NO: 495518 - protein, 6 aa, Mycobacterium
GRVQEP

SEQ ID NO: 495519 - protein, 15 aa, Mycobacterium
GRVQHEEHDAEGTRI

SEQ ID NO: 495520 - protein, 8 aa, Mycobacterium
GRVQPQDR

SEQ ID NO: 495521 - protein, 14 aa, Mycobacterium
GRVQQAEHQPEGTR

SEQ ID NO: 495522 - protein, 15 aa, Mycobacterium
GRVQQEEHNPDGTRI

SEQ ID NO: 495523 - protein, 9 aa, Mycobacterium
GRVQRASED

SEQ ID NO: 495524 - protein, 9 aa, Mycobacterium
GRVQSTESV

SEQ ID NO: 495525 - protein, 24 aa, Mycobacterium
GRVRATDADRDKLSYTATASQGTV

SEQ ID NO: 495526 - protein, 13 aa, Mycobacterium
GRVRDVNSAGERI

SEQ ID NO: 495527 - protein, 13 aa, Mycobacterium
GRVRPGASAVAGR

SEQ ID NO: 495528 - protein, 12 aa, Mycobacterium
GRVRRATESGAC

SEQ ID NO: 495529 - protein, 5 aa, Mycobacterium
GRVRS

SEQ ID NO: 495530 - protein, 6 aa, Mycobacterium
GRVRSE

SEQ ID NO: 495531 - protein, 4 aa, Mycobacterium
GRVS

SEQ ID NO: 495532 - protein, 9 aa, Mycobacterium
GRVSGSTLS

SEQ ID NO: 495533 - protein, 8 aa, Mycobacterium
GRVSGTTL

SEQ ID NO: 495534 - protein, 8 aa, Mycobacterium
GRVSKSAA

SEQ ID NO: 495535 - protein, 8 aa, Mycobacterium
GRVSPSLE

SEQ ID NO: 495536 - protein, 4 aa, Mycobacterium
GRVT

SEQ ID NO: 495537 - protein, 5 aa, Mycobacterium
GRVTA

SEQ ID NO: 495538 - protein, 11 aa, Mycobacterium
GRVTAGGRHYP

SEQ ID NO: 495539 - protein, 5 aa, Mycobacterium
GRVTG

SEQ ID NO: 495540 - protein, 11 aa, Mycobacterium
GRVTKPDGSPY

SEQ ID NO: 495541 - protein, 11 aa, Mycobacterium
GRVTKQDGTPY

SEQ ID NO: 495542 - protein, 8 aa, Mycobacterium
GRVTRDEM

SEQ ID NO: 495543 - protein, 7 aa, Mycobacterium
GRVTREE

SEQ ID NO: 495544 - protein, 6 aa, Mycobacterium
GRWADD

SEQ ID NO: 495545 - protein, 6 aa, Mycobacterium
GRWATE

SEQ ID NO: 495546 - protein, 19 aa, Mycobacterium
GRWATEQGLTRTDGHRAGE

SEQ ID NO: 495547 - protein, 6 aa, Mycobacterium
GRWATQ

SEQ ID NO: 495548 - protein, 19 aa, Mycobacterium
GRWATQQGLTRTDGHRAGE

SEQ ID NO: 495549 - protein, 11 aa, Mycobacterium
GRWDAQTARTA

SEQ ID NO: 495550 - protein, 7 aa, Mycobacterium
GRWDPGK

SEQ ID NO: 495551 - protein, 11 aa, Mycobacterium
GRWGDEPIERY

SEQ ID NO: 495552 - protein, 8 aa, Mycobacterium
GRWPGRQL

SEQ ID NO: 495553 - protein, 18 aa, Mycobacterium
GRWRDSGMAGTEQRSKRR

SEQ ID NO: 495554 - protein, 16 aa, Mycobacterium
GRWRDSGMEGTPARRR

SEQ ID NO: 495555 - protein, 15 aa, Mycobacterium
GRWRDSGMRGTPTRH

SEQ ID NO: 495556 - protein, 11 aa, Mycobacterium
GRWRTGQQNKQ

SEQ ID NO: 495557 - protein, 18 aa, Mycobacterium
GRWRTRQTEPAPRTRGRG

SEQ ID NO: 495558 - protein, 12 aa, Mycobacterium
GRWTARAKASRI

SEQ ID NO: 495559 - protein, 9 aa, Mycobacterium
GRYAAEGSN

SEQ ID NO: 495560 - protein, 7 aa, Mycobacterium
GRYAAET

SEQ ID NO: 495561 - protein, 10 aa, Mycobacterium
GRYANPDVTT

SEQ ID NO: 495562 - protein, 9 aa, Mycobacterium
GRYAPRSGW

SEQ ID NO: 495563 - protein, 6 aa, Mycobacterium
GRYDTD

SEQ ID NO: 495564 - protein, 20 aa, Mycobacterium
GRYEGGDADGAQSISAAGGG

SEQ ID NO: 495565 - protein, 16 aa, Mycobacterium
GRYGAGRRLAERLGLP

SEQ ID NO: 495566 - protein, 5 aa, Mycobacterium
GRYGD

SEQ ID NO: 495567 - protein, 12 aa, Mycobacterium
GRYGDEALGART

SEQ ID NO: 495568 - protein, 7 aa, Mycobacterium
GRYGNAA

SEQ ID NO: 495569 - protein, 10 aa, Mycobacterium
GRYGPTTRRP

SEQ ID NO: 495570 - protein, 12 aa, Mycobacterium
GRYGSAGNKDDR

SEQ ID NO: 495571 - protein, 23 aa, Mycobacterium
GRYGSRAGVPAHSTTEHDCGATV

SEQ ID NO: 495572 - protein, 6 aa, Mycobacterium
GRYHPK

SEQ ID NO: 495573 - protein, 4 aa, Mycobacterium
GRYP

SEQ ID NO: 495574 - protein, 6 aa, Mycobacterium
GRYPAK

SEQ ID NO: 495575 - protein, 8 aa, Mycobacterium
GRYPDDDK

SEQ ID NO: 495576 - protein, 5 aa, Mycobacterium
GRYPE

SEQ ID NO: 495577 - protein, 12 aa, Mycobacterium
GRYPGEDAEPAH

SEQ ID NO: 495578 - protein, 14 aa, Mycobacterium
GRYPNQLSGGQRQR

SEQ ID NO: 495579 - protein, 44 aa, Mycobacterium
GRYRAQPPVEHEQPGPGDRRADRGRTRTRAQRRARRGEDRGLGR

SEQ ID NO: 495580 - protein, 5 aa, Mycobacterium
GRYRE

SEQ ID NO: 495581 - protein, 12 aa, Mycobacterium
GRYRTQAAAQVP

SEQ ID NO: 495582 - protein, 11 aa, Mycobacterium
GRYTSSPTGAG

SEQ ID NO: 495583 - protein, 6 aa, Mycobacterium
GRYYTG

SEQ ID NO: 495584 - protein, 5 aa, Mycobacterium
GSAAA

SEQ ID NO: 495585 - protein, 12 aa, Mycobacterium
GSAAAAAPARPA

SEQ ID NO: 495586 - protein, 23 aa, Mycobacterium
GSAAARAVKGDVEKSLQQFVELY

SEQ ID NO: 495587 - protein, 9 aa, Mycobacterium
GSAAATEHW

SEQ ID NO: 495588 - protein, 8 aa, Mycobacterium
GSAAATEK

SEQ ID NO: 495589 - protein, 7 aa, Mycobacterium
GSAADGP

SEQ ID NO: 495590 - protein, 10 aa, Mycobacterium
GSAADTEASM

SEQ ID NO: 495591 - protein, 5 aa, Mycobacterium
GSAAE

SEQ ID NO: 495592 - protein, 10 aa, Mycobacterium
GSAAEAATRL

SEQ ID NO: 495593 - protein, 10 aa, Mycobacterium
GSAAEPGTVG

SEQ ID NO: 495594 - protein, 17 aa, Mycobacterium
GSAAERDAERRYPTAEY

SEQ ID NO: 495595 - protein, 14 aa, Mycobacterium
GSAAEVNTARADGM

SEQ ID NO: 495596 - protein, 11 aa, Mycobacterium
GSAAFDRPDDE

SEQ ID NO: 495597 - protein, 15 aa, Mycobacterium
GSAAFRAQGTSLSPG

SEQ ID NO: 495598 - protein, 6 aa, Mycobacterium
GSAAGE

SEQ ID NO: 495599 - protein, 9 aa, Mycobacterium
GSAAGGSLS

SEQ ID NO: 495600 - protein, 19 aa, Mycobacterium
GSAAGNSPIPNNATYAASK

SEQ ID NO: 495601 - protein, 18 aa, Mycobacterium
GSAAGNSPIPNNATYAAT

SEQ ID NO: 495602 - protein, 19 aa, Mycobacterium
GSAAGNSPIPNNATYAATK

SEQ ID NO: 495603 - protein, 5 aa, Mycobacterium
GSAAN

SEQ ID NO: 495604 - protein, 8 aa, Mycobacterium
GSAANPRE

SEQ ID NO: 495605 - protein, 8 aa, Mycobacterium
GSAANSAA

SEQ ID NO: 495606 - protein, 6 aa, Mycobacterium
GSAANV

SEQ ID NO: 495607 - protein, 8 aa, Mycobacterium
GSAAPEDA

SEQ ID NO: 495608 - protein, 10 aa, Mycobacterium
GSAAPPQEVT

SEQ ID NO: 495609 - protein, 9 aa, Mycobacterium
GSAAPRSAS

SEQ ID NO: 495610 - protein, 9 aa, Mycobacterium
GSAAPTADE

SEQ ID NO: 495611 - protein, 8 aa, Mycobacterium
GSAAPTHA

SEQ ID NO: 495612 - protein, 8 aa, Mycobacterium
GSAAPVRT

SEQ ID NO: 495613 - protein, 5 aa, Mycobacterium
GSAAQ

SEQ ID NO: 495614 - protein, 9 aa, Mycobacterium
GSAAQEDQY

SEQ ID NO: 495615 - protein, 6 aa, Mycobacterium
GSAARW

SEQ ID NO: 495616 - protein, 8 aa, Mycobacterium
GSAASDAA

SEQ ID NO: 495617 - protein, 11 aa, Mycobacterium
GSAASDVANPR

SEQ ID NO: 495618 - protein, 8 aa, Mycobacterium
GSAASKRV

SEQ ID NO: 495619 - protein, 6 aa, Mycobacterium
GSAASY

SEQ ID NO: 495620 - protein, 8 aa, Mycobacterium
GSAATDPR

SEQ ID NO: 495621 - protein, 10 aa, Mycobacterium
GSAATQLRDA

SEQ ID NO: 495622 - protein, 15 aa, Mycobacterium
GSAATTGLRTAAPGI

SEQ ID NO: 495623 - protein, 8 aa, Mycobacterium
GSAATVGK

SEQ ID NO: 495624 - protein, 6 aa, Mycobacterium
GSAAVA

SEQ ID NO: 495625 - protein, 19 aa, Mycobacterium
GSAAVPRSERRPAPEPNWY

SEQ ID NO: 495626 - protein, 5 aa, Mycobacterium
GSAAY

SEQ ID NO: 495627 - protein, 6 aa, Mycobacterium
GSAAYT

SEQ ID NO: 495628 - protein, 21 aa, Mycobacterium
GSADAAAGYDKTMAKAKDANL

SEQ ID NO: 495629 - protein, 14 aa, Mycobacterium
GSADAAGSRPWRQD

SEQ ID NO: 495630 - protein, 8 aa, Mycobacterium
GSADDAGV

SEQ ID NO: 495631 - protein, 16 aa, Mycobacterium
GSADFEQTATASAWNP

SEQ ID NO: 495632 - protein, 8 aa, Mycobacterium
GSADPAAI

SEQ ID NO: 495633 - protein, 8 aa, Mycobacterium
GSADPADA

SEQ ID NO: 495634 - protein, 6 aa, Mycobacterium
GSADPH

SEQ ID NO: 495635 - protein, 7 aa, Mycobacterium
GSADPTL

SEQ ID NO: 495636 - protein, 13 aa, Mycobacterium
GSADPVSEFADPD

SEQ ID NO: 495637 - protein, 5 aa, Mycobacterium
GSADR

SEQ ID NO: 495638 - protein, 16 aa, Mycobacterium
GSADRPDGGQAGPRCG

SEQ ID NO: 495639 - protein, 10 aa, Mycobacterium
GSADRRIQSA

SEQ ID NO: 495640 - protein, 12 aa, Mycobacterium
GSADSPTPPESL

SEQ ID NO: 495641 - protein, 6 aa, Mycobacterium
GSADST

SEQ ID NO: 495642 - protein, 4 aa, Mycobacterium
GSAE

SEQ ID NO: 495643 - protein, 5 aa, Mycobacterium
GSAEA

SEQ ID NO: 495644 - protein, 20 aa, Mycobacterium
GSAEAAAPAASRPAKAAPRV

SEQ ID NO: 495645 - protein, 6 aa, Mycobacterium
GSAEEF

SEQ ID NO: 495646 - protein, 6 aa, Mycobacterium
GSAEEL

SEQ ID NO: 495647 - protein, 10 aa, Mycobacterium
GSAEFPGADM

SEQ ID NO: 495648 - protein, 9 aa, Mycobacterium
GSAEGEPPY

SEQ ID NO: 495649 - protein, 11 aa, Mycobacterium
GSAELAQNSVQ

SEQ ID NO: 495650 - protein, 8 aa, Mycobacterium
GSAEPAAL

SEQ ID NO: 495651 - protein, 10 aa, Mycobacterium
GSAEPEGAPL

SEQ ID NO: 495652 - protein, 16 aa, Mycobacterium
GSAEPYSLDNERPAHP

SEQ ID NO: 495653 - protein, 8 aa, Mycobacterium
GSAEQAAL

SEQ ID NO: 495654 - protein, 5 aa, Mycobacterium
GSAET

SEQ ID NO: 495655 - protein, 24 aa, Mycobacterium
GSAFPGDSWQGSAAENYAGKNKDQ

SEQ ID NO: 495656 - protein, 14 aa, Mycobacterium
GSAFPYRKDPEDKN

SEQ ID NO: 495657 - protein, 5 aa, Mycobacterium
GSAFT

SEQ ID NO: 495658 - protein, 5 aa, Mycobacterium
GSAGA

SEQ ID NO: 495659 - protein, 6 aa, Mycobacterium
GSAGAD

SEQ ID NO: 495660 - protein, 31 aa, Mycobacterium
GSAGAGGAGGTATGIGGGYGGAGGAGGSGGL

SEQ ID NO: 495661 - protein, 10 aa, Mycobacterium
GSAGAGGALG

SEQ ID NO: 495662 - protein, 7 aa, Mycobacterium
GSAGAKV

SEQ ID NO: 495663 - protein, 8 aa, Mycobacterium
GSAGAPLA

SEQ ID NO: 495664 - protein, 7 aa, Mycobacterium
GSAGARP

SEQ ID NO: 495665 - protein, 5 aa, Mycobacterium
GSAGD

SEQ ID NO: 495666 - protein, 109 aa, Mycobacterium
GSAGDGLGDGEPFDRGNAFDGEPFEADDTDGQTPETGAEDPGDVEDVEDTAEAEPEAAAEPAAPPPPPGAAPVDVPPPPGAAPVDAPAPADAPAAGGPAPPADETKTPC

SEQ ID NO: 495667 - protein, 7 aa, Mycobacterium
GSAGEAI

SEQ ID NO: 495668 - protein, 9 aa, Mycobacterium
GSAGELAPQ

SEQ ID NO: 495669 - protein, 11 aa, Mycobacterium
GSAGEPGTVGR

SEQ ID NO: 495670 - protein, 16 aa, Mycobacterium
GSAGERTVRISRAQLK

SEQ ID NO: 495671 - protein, 5 aa, Mycobacterium
GSAGG

SEQ ID NO: 495672 - protein, 17 aa, Mycobacterium
GSAGGGLSSAASAGMGR

SEQ ID NO: 495673 - protein, 8 aa, Mycobacterium
GSAGGLTK

SEQ ID NO: 495674 - protein, 18 aa, Mycobacterium
GSAGGSRGPRGRVQPGAD

SEQ ID NO: 495675 - protein, 8 aa, Mycobacterium
GSAGGSYA

SEQ ID NO: 495676 - protein, 19 aa, Mycobacterium
GSAGHTAGGLAAPSAAAEA

SEQ ID NO: 495677 - protein, 26 aa, Mycobacterium
GSAGHTGDDVGNAGNLHSSPFNYVSR

SEQ ID NO: 495678 - protein, 7 aa, Mycobacterium
GSAGKPL

SEQ ID NO: 495679 - protein, 5 aa, Mycobacterium
GSAGL

SEQ ID NO: 495680 - protein, 7 aa, Mycobacterium
GSAGQSI

SEQ ID NO: 495681 - protein, 7 aa, Mycobacterium
GSAGQSL

SEQ ID NO: 495682 - protein, 5 aa, Mycobacterium
GSAGR

SEQ ID NO: 495683 - protein, 7 aa, Mycobacterium
GSAGRKA

SEQ ID NO: 495684 - protein, 34 aa, Mycobacterium
GSAGSAGGSGVGGAGGAAGNGGSAGAGGDGGVAA

SEQ ID NO: 495685 - protein, 9 aa, Mycobacterium
GSAGSETAL

SEQ ID NO: 495686 - protein, 9 aa, Mycobacterium
GSAGSGKTH

SEQ ID NO: 495687 - protein, 27 aa, Mycobacterium
GSAGSKSRFSGDDTQRPLDKKGRAQAE

SEQ ID NO: 495688 - protein, 20 aa, Mycobacterium
GSAGSTVAVTDGPNAPWGPI

SEQ ID NO: 495689 - protein, 6 aa, Mycobacterium
GSAGSV

SEQ ID NO: 495690 - protein, 14 aa, Mycobacterium
GSAGTGKSSAYHAS

SEQ ID NO: 495691 - protein, 10 aa, Mycobacterium
GSAGTGTAPL

SEQ ID NO: 495692 - protein, 8 aa, Mycobacterium
GSAGTLAS

SEQ ID NO: 495693 - protein, 9 aa, Mycobacterium
GSAGTRPAG

SEQ ID NO: 495694 - protein, 8 aa, Mycobacterium
GSAGVGYS

SEQ ID NO: 495695 - protein, 6 aa, Mycobacterium
GSAGYP

SEQ ID NO: 495696 - protein, 4 aa, Mycobacterium
GSAH

SEQ ID NO: 495697 - protein, 8 aa, Mycobacterium
GSAHHTQT

SEQ ID NO: 495698 - protein, 9 aa, Mycobacterium
GSAIDNEDN

SEQ ID NO: 495699 - protein, 9 aa, Mycobacterium
GSAIGTITN

SEQ ID NO: 495700 - protein, 25 aa, Mycobacterium
GSAITAGTAVTAGPERADATVASGA

SEQ ID NO: 495701 - protein, 10 aa, Mycobacterium
GSAKGARPGC

SEQ ID NO: 495702 - protein, 7 aa, Mycobacterium
GSAKPDA

SEQ ID NO: 495703 - protein, 15 aa, Mycobacterium
GSAKSNLGHTEAASG

SEQ ID NO: 495704 - protein, 16 aa, Mycobacterium
GSAKSNMGHSTAAAGA

SEQ ID NO: 495705 - protein, 14 aa, Mycobacterium
GSAKSRLKGTDERM

SEQ ID NO: 495706 - protein, 12 aa, Mycobacterium
GSALATGNGGIG

SEQ ID NO: 495707 - protein, 7 aa, Mycobacterium
GSALPAA

SEQ ID NO: 495708 - protein, 8 aa, Mycobacterium
GSALSTND

SEQ ID NO: 495709 - protein, 14 aa, Mycobacterium
GSAMAGGKQSGPVN

SEQ ID NO: 495710 - protein, 9 aa, Mycobacterium
GSANAKNVG

SEQ ID NO: 495711 - protein, 10 aa, Mycobacterium
GSANATTAGF

SEQ ID NO: 495712 - protein, 9 aa, Mycobacterium
GSANGGGLN

SEQ ID NO: 495713 - protein, 54 aa, Mycobacterium
GSANLGNGNNGSVNAGNGNTGNQNLGSGNKGSFNIGSGNSGNANFGSGNIGNDN

SEQ ID NO: 495714 - protein, 9 aa, Mycobacterium
GSANRDDRV

SEQ ID NO: 495715 - protein, 7 aa, Mycobacterium
GSANRDP

SEQ ID NO: 495716 - protein, 5 aa, Mycobacterium
GSANV

SEQ ID NO: 495717 - protein, 30 aa, Mycobacterium
GSANVGDANLGSANVGSANVGGGNVGGGNV

SEQ ID NO: 495718 - protein, 4 aa, Mycobacterium
GSAP

SEQ ID NO: 495719 - protein, 10 aa, Mycobacterium
GSAPAGAGLG

SEQ ID NO: 495720 - protein, 9 aa, Mycobacterium
GSAPDARSD

SEQ ID NO: 495721 - protein, 13 aa, Mycobacterium
GSAPDIAGQGIAN

SEQ ID NO: 495722 - protein, 14 aa, Mycobacterium
GSAPDIAGQGVANP

SEQ ID NO: 495723 - protein, 16 aa, Mycobacterium
GSAPDIAGRGISNPIG

SEQ ID NO: 495724 - protein, 7 aa, Mycobacterium
GSAPDLS

SEQ ID NO: 495725 - protein, 14 aa, Mycobacterium
GSAPDQPAVVVVAD

SEQ ID NO: 495726 - protein, 6 aa, Mycobacterium
GSAPDT

SEQ ID NO: 495727 - protein, 5 aa, Mycobacterium
GSAPF

SEQ ID NO: 495728 - protein, 11 aa, Mycobacterium
GSAPGAPAATG

SEQ ID NO: 495729 - protein, 6 aa, Mycobacterium
GSAPGV

SEQ ID NO: 495730 - protein, 20 aa, Mycobacterium
GSAPHIQTGPAPSGTNGRPQ

SEQ ID NO: 495731 - protein, 6 aa, Mycobacterium
GSAPLR

SEQ ID NO: 495732 - protein, 9 aa, Mycobacterium
GSAPPEARY

SEQ ID NO: 495733 - protein, 9 aa, Mycobacterium
GSAPPLDPA

SEQ ID NO: 495734 - protein, 11 aa, Mycobacterium
GSAPPLDPATI

SEQ ID NO: 495735 - protein, 9 aa, Mycobacterium
GSAPPQRSA

SEQ ID NO: 495736 - protein, 6 aa, Mycobacterium
GSAPPY

SEQ ID NO: 495737 - protein, 8 aa, Mycobacterium
GSAPQAKG

SEQ ID NO: 495738 - protein, 8 aa, Mycobacterium
GSAPQGPG

SEQ ID NO: 495739 - protein, 7 aa, Mycobacterium
GSAPQQL

SEQ ID NO: 495740 - protein, 13 aa, Mycobacterium
GSAPQRRPSTEEV

SEQ ID NO: 495741 - protein, 8 aa, Mycobacterium
GSAPREHR

SEQ ID NO: 495742 - protein, 16 aa, Mycobacterium
GSAPRRAGQDVANPSG

SEQ ID NO: 495743 - protein, 19 aa, Mycobacterium
GSAPRRPDPEDDAASGAAL

SEQ ID NO: 495744 - protein, 29 aa, Mycobacterium
GSAPRSADLETDRANAAALAASGKNRHEH

SEQ ID NO: 495745 - protein, 28 aa, Mycobacterium
GSAPRSSDPSQDRRTGEDLAGSHKNRHE

SEQ ID NO: 495746 - protein, 8 aa, Mycobacterium
GSAPSGEI

SEQ ID NO: 495747 - protein, 6 aa, Mycobacterium
GSAPST

SEQ ID NO: 495748 - protein, 19 aa, Mycobacterium
GSAPTATAALPKGLGAETG

SEQ ID NO: 495749 - protein, 6 aa, Mycobacterium
GSAPTM

SEQ ID NO: 495750 - protein, 7 aa, Mycobacterium
GSAPTTI

SEQ ID NO: 495751 - protein, 5 aa, Mycobacterium
GSAPV

SEQ ID NO: 495752 - protein, 8 aa, Mycobacterium
GSAPVGTR

SEQ ID NO: 495753 - protein, 10 aa, Mycobacterium
GSAPVPPGLA

SEQ ID NO: 495754 - protein, 14 aa, Mycobacterium
GSAQPPWDFPPPSL

SEQ ID NO: 495755 - protein, 9 aa, Mycobacterium
GSAQPQQDI

SEQ ID NO: 495756 - protein, 7 aa, Mycobacterium
GSAQQAN

SEQ ID NO: 495757 - protein, 7 aa, Mycobacterium
GSAQSDA

SEQ ID NO: 495758 - protein, 14 aa, Mycobacterium
GSAQSKQELVDRPR

SEQ ID NO: 495759 - protein, 5 aa, Mycobacterium
GSARA

SEQ ID NO: 495760 - protein, 13 aa, Mycobacterium
GSARDVTPTPEHM

SEQ ID NO: 495761 - protein, 5 aa, Mycobacterium
GSARH

SEQ ID NO: 495762 - protein, 10 aa, Mycobacterium
GSARIGPRRE

SEQ ID NO: 495763 - protein, 6 aa, Mycobacterium
GSARPP

SEQ ID NO: 495764 - protein, 6 aa, Mycobacterium
GSARQA

SEQ ID NO: 495765 - protein, 6 aa, Mycobacterium
GSARSP

SEQ ID NO: 495766 - protein, 13 aa, Mycobacterium
GSARTGRDRGLPQ

SEQ ID NO: 495767 - protein, 20 aa, Mycobacterium
GSARTTGAAGTTGSAGAAVA

SEQ ID NO: 495768 - protein, 15 aa, Mycobacterium
GSARVTSPDPEGTYQ

SEQ ID NO: 495769 - protein, 23 aa, Mycobacterium
GSASAAAAGPTSSLAAAAADEVS

SEQ ID NO: 495770 - protein, 8 aa, Mycobacterium
GSASAAPA

SEQ ID NO: 495771 - protein, 10 aa, Mycobacterium
GSASASASNI

SEQ ID NO: 495772 - protein, 7 aa, Mycobacterium
GSASDMA

SEQ ID NO: 495773 - protein, 18 aa, Mycobacterium
GSASDQFDPASAGIGAYD

SEQ ID NO: 495774 - protein, 12 aa, Mycobacterium
GSASEAPPSAKA

SEQ ID NO: 495775 - protein, 8 aa, Mycobacterium
GSASENGV

SEQ ID NO: 495776 - protein, 5 aa, Mycobacterium
GSASG

SEQ ID NO: 495777 - protein, 8 aa, Mycobacterium
GSASGKVP

SEQ ID NO: 495778 - protein, 10 aa, Mycobacterium
GSASKSLAPG

SEQ ID NO: 495779 - protein, 11 aa, Mycobacterium
GSASLTGQGQT

SEQ ID NO: 495780 - protein, 7 aa, Mycobacterium
GSASPAL

SEQ ID NO: 495781 - protein, 8 aa, Mycobacterium
GSASPDPL

SEQ ID NO: 495782 - protein, 8 aa, Mycobacterium
GSASPSIP

SEQ ID NO: 495783 - protein, 6 aa, Mycobacterium
GSASQH

SEQ ID NO: 495784 - protein, 9 aa, Mycobacterium
GSASSTAPL

SEQ ID NO: 495785 - protein, 10 aa, Mycobacterium
GSASTDGGAG

SEQ ID NO: 495786 - protein, 8 aa, Mycobacterium
GSASTDPV

SEQ ID NO: 495787 - protein, 6 aa, Mycobacterium
GSASTG

SEQ ID NO: 495788 - protein, 18 aa, Mycobacterium
GSATDLSTALDAGDGSYG

SEQ ID NO: 495789 - protein, 5 aa, Mycobacterium
GSATE

SEQ ID NO: 495790 - protein, 12 aa, Mycobacterium
GSATENPPAPRL

SEQ ID NO: 495791 - protein, 8 aa, Mycobacterium
GSATENRS

SEQ ID NO: 495792 - protein, 11 aa, Mycobacterium
GSATGASSSGI

SEQ ID NO: 495793 - protein, 8 aa, Mycobacterium
GSATGMQA

SEQ ID NO: 495794 - protein, 9 aa, Mycobacterium
GSATHGARH

SEQ ID NO: 495795 - protein, 16 aa, Mycobacterium
GSATHGARHAGEAIER

SEQ ID NO: 495796 - protein, 15 aa, Mycobacterium
GSATIGESAAHVSRV

SEQ ID NO: 495797 - protein, 12 aa, Mycobacterium
GSATLTDPGQIA

SEQ ID NO: 495798 - protein, 11 aa, Mycobacterium
GSATNDGGTGM

SEQ ID NO: 495799 - protein, 19 aa, Mycobacterium
GSATNQDGRSNGMTAPNAL

SEQ ID NO: 495800 - protein, 22 aa, Mycobacterium
GSATNQDGRTDNISTPSPDAQV

SEQ ID NO: 495801 - protein, 7 aa, Mycobacterium
GSATPGA

SEQ ID NO: 495802 - protein, 8 aa, Mycobacterium
GSATRDER

SEQ ID NO: 495803 - protein, 15 aa, Mycobacterium
GSATSQISYTASKGG

SEQ ID NO: 495804 - protein, 8 aa, Mycobacterium
GSATSRDA

SEQ ID NO: 495805 - protein, 6 aa, Mycobacterium
GSATSW

SEQ ID NO: 495806 - protein, 7 aa, Mycobacterium
GSATTDP

SEQ ID NO: 495807 - protein, 9 aa, Mycobacterium
GSATTGTDH

SEQ ID NO: 495808 - protein, 4 aa, Mycobacterium
GSAV

SEQ ID NO: 495809 - protein, 6 aa, Mycobacterium
GSAVAS

SEQ ID NO: 495810 - protein, 17 aa, Mycobacterium
GSAVGRGAVTPAPDGTR

SEQ ID NO: 495811 - protein, 23 aa, Mycobacterium
GSAVNNDGRHKTGFTAPSVTAQS

SEQ ID NO: 495812 - protein, 5 aa, Mycobacterium
GSAVP

SEQ ID NO: 495813 - protein, 6 aa, Mycobacterium
GSAVPE

SEQ ID NO: 495814 - protein, 5 aa, Mycobacterium
GSAVS

SEQ ID NO: 495815 - protein, 19 aa, Mycobacterium
GSAVTPQASVATRTTNPAR

SEQ ID NO: 495816 - protein, 6 aa, Mycobacterium
GSAWDE

SEQ ID NO: 495817 - protein, 10 aa, Mycobacterium
GSAWQGPAAA

SEQ ID NO: 495818 - protein, 5 aa, Mycobacterium
GSAYA

SEQ ID NO: 495819 - protein, 5 aa, Mycobacterium
GSAYG

SEQ ID NO: 495820 - protein, 6 aa, Mycobacterium
GSAYGA

SEQ ID NO: 495821 - protein, 18 aa, Mycobacterium
GSAYGDKGAERDTGGYDG

SEQ ID NO: 495822 - protein, 18 aa, Mycobacterium
GSAYGDKGAERDVGGYDG

SEQ ID NO: 495823 - protein, 12 aa, Mycobacterium
GSAYGDKGPERL

SEQ ID NO: 495824 - protein, 15 aa, Mycobacterium
GSAYGDKGPERLAGG

SEQ ID NO: 495825 - protein, 9 aa, Mycobacterium
GSAYSESFA

SEQ ID NO: 495826 - protein, 10 aa, Mycobacterium
GSAYSESFGG

SEQ ID NO: 495827 - protein, 11 aa, Mycobacterium
GSCAGSKDAEL

SEQ ID NO: 495828 - protein, 8 aa, Mycobacterium
GSCAPSAP

SEQ ID NO: 495829 - protein, 4 aa, Mycobacterium
GSCG

SEQ ID NO: 495830 - protein, 6 aa, Mycobacterium
GSCGAT

SEQ ID NO: 495831 - protein, 5 aa, Mycobacterium
GSCNG

SEQ ID NO: 495832 - protein, 13 aa, Mycobacterium
GSCNGSGVINRNQ

SEQ ID NO: 495833 - protein, 11 aa, Mycobacterium
GSCSPPRRARG

SEQ ID NO: 495834 - protein, 7 aa, Mycobacterium
GSDAAIN

SEQ ID NO: 495835 - protein, 6 aa, Mycobacterium
GSDAAL

SEQ ID NO: 495836 - protein, 9 aa, Mycobacterium
GSDAATALR

SEQ ID NO: 495837 - protein, 10 aa, Mycobacterium
GSDAEANRRV

SEQ ID NO: 495838 - protein, 6 aa, Mycobacterium
GSDAGT

SEQ ID NO: 495839 - protein, 7 aa, Mycobacterium
GSDAGTM

SEQ ID NO: 495840 - protein, 9 aa, Mycobacterium
GSDAHKTAS

SEQ ID NO: 495841 - protein, 6 aa, Mycobacterium
GSDANI

SEQ ID NO: 495842 - protein, 9 aa, Mycobacterium
GSDAPDSFG

SEQ ID NO: 495843 - protein, 6 aa, Mycobacterium
GSDAPI

SEQ ID NO: 495844 - protein, 17 aa, Mycobacterium
GSDAPKSVTARELPREE

SEQ ID NO: 495845 - protein, 8 aa, Mycobacterium
GSDAQKQK

SEQ ID NO: 495846 - protein, 8 aa, Mycobacterium
GSDARIPA

SEQ ID NO: 495847 - protein, 19 aa, Mycobacterium
GSDARKAYEDRASHSGPST

SEQ ID NO: 495848 - protein, 32 aa, Mycobacterium
GSDARNAGGASQPGPAVTAGTASAQQPGITTG

SEQ ID NO: 495849 - protein, 27 aa, Mycobacterium
GSDARPLGRVTKGDGNLAGGGVDGAVQ

SEQ ID NO: 495850 - protein, 10 aa, Mycobacterium
GSDATIAKDP

SEQ ID NO: 495851 - protein, 9 aa, Mycobacterium
GSDAYDEAA

SEQ ID NO: 495852 - protein, 5 aa, Mycobacterium
GSDCG

SEQ ID NO: 495853 - protein, 4 aa, Mycobacterium
GSDD

SEQ ID NO: 495854 - protein, 5 aa, Mycobacterium
GSDDA

SEQ ID NO: 495855 - protein, 8 aa, Mycobacterium
GSDDAGDV

SEQ ID NO: 495856 - protein, 8 aa, Mycobacterium
GSDDDPEQ

SEQ ID NO: 495857 - protein, 7 aa, Mycobacterium
GSDDDVA

SEQ ID NO: 495858 - protein, 7 aa, Mycobacterium
GSDDGLT

SEQ ID NO: 495859 - protein, 11 aa, Mycobacterium
GSDDGTGAADP

SEQ ID NO: 495860 - protein, 7 aa, Mycobacterium
GSDDNPA

SEQ ID NO: 495861 - protein, 8 aa, Mycobacterium
GSDDPATV

SEQ ID NO: 495862 - protein, 16 aa, Mycobacterium
GSDDPEFAGNDALTSA

SEQ ID NO: 495863 - protein, 10 aa, Mycobacterium
GSDDPRRRQA

SEQ ID NO: 495864 - protein, 17 aa, Mycobacterium
GSDDSEFKRGSSNEDQL

SEQ ID NO: 495865 - protein, 17 aa, Mycobacterium
GSDDSEFKRGTTNEDQL

SEQ ID NO: 495866 - protein, 17 aa, Mycobacterium
GSDDSEYQRGTSSEDQL

SEQ ID NO: 495867 - protein, 7 aa, Mycobacterium
GSDDSVD

SEQ ID NO: 495868 - protein, 12 aa, Mycobacterium
GSDDVVLRSVVV

SEQ ID NO: 495869 - protein, 4 aa, Mycobacterium
GSDE

SEQ ID NO: 495870 - protein, 8 aa, Mycobacterium
GSDEASVV

SEQ ID NO: 495871 - protein, 7 aa, Mycobacterium
GSDEDVA

SEQ ID NO: 495872 - protein, 9 aa, Mycobacterium
GSDEEARQR

SEQ ID NO: 495873 - protein, 9 aa, Mycobacterium
GSDEEARRR

SEQ ID NO: 495874 - protein, 6 aa, Mycobacterium
GSDEEF

SEQ ID NO: 495875 - protein, 7 aa, Mycobacterium
GSDEEFA

SEQ ID NO: 495876 - protein, 7 aa, Mycobacterium
GSDEEFN

SEQ ID NO: 495877 - protein, 9 aa, Mycobacterium
GSDEENAGL

SEQ ID NO: 495878 - protein, 7 aa, Mycobacterium
GSDEEYE

SEQ ID NO: 495879 - protein, 6 aa, Mycobacterium
GSDEIA

SEQ ID NO: 495880 - protein, 5 aa, Mycobacterium
GSDEK

SEQ ID NO: 495881 - protein, 6 aa, Mycobacterium
GSDELK

SEQ ID NO: 495882 - protein, 7 aa, Mycobacterium
GSDEMGG

SEQ ID NO: 495883 - protein, 7 aa, Mycobacterium
GSDEMSG

SEQ ID NO: 495884 - protein, 5 aa, Mycobacterium
GSDEP

SEQ ID NO: 495885 - protein, 7 aa, Mycobacterium
GSDEQKA

SEQ ID NO: 495886 - protein, 8 aa, Mycobacterium
GSDEQKDQ

SEQ ID NO: 495887 - protein, 8 aa, Mycobacterium
GSDEQKQR

SEQ ID NO: 495888 - protein, 5 aa, Mycobacterium
GSDER

SEQ ID NO: 495889 - protein, 5 aa, Mycobacterium
GSDFP

SEQ ID NO: 495890 - protein, 5 aa, Mycobacterium
GSDFS

SEQ ID NO: 495891 - protein, 4 aa, Mycobacterium
GSDG

SEQ ID NO: 495892 - protein, 7 aa, Mycobacterium
GSDGAAP

SEQ ID NO: 495893 - protein, 10 aa, Mycobacterium
GSDGAELDPE

SEQ ID NO: 495894 - protein, 8 aa, Mycobacterium
GSDGARAE

SEQ ID NO: 495895 - protein, 11 aa, Mycobacterium
GSDGDGGRTQV

SEQ ID NO: 495896 - protein, 10 aa, Mycobacterium
GSDGDQATAI

SEQ ID NO: 495897 - protein, 9 aa, Mycobacterium
GSDGDRGRF

SEQ ID NO: 495898 - protein, 18 aa, Mycobacterium
GSDGDTLPVTDKASGAVI

SEQ ID NO: 495899 - protein, 9 aa, Mycobacterium
GSDGEAGCT

SEQ ID NO: 495900 - protein, 7 aa, Mycobacterium
GSDGEQA

SEQ ID NO: 495901 - protein, 9 aa, Mycobacterium
GSDGEQAAA

SEQ ID NO: 495902 - protein, 9 aa, Mycobacterium
GSDGGGSIR

SEQ ID NO: 495903 - protein, 138 aa, Mycobacterium
GSDGGIGTGGNGGLGGNGGAGSIGTTGTDGTAPTTGGPGGAGGAGGDGGAGGAGIGGVGGGSGGNGGLGGNGGAGGHGGINTGTGGTASASGGTGGNGGAGGNGGAPGAANAIGGQGGQGGIGGNGGNGGNNTSGIDT

SEQ ID NO: 495904 - protein, 56 aa, Mycobacterium
GSDGGPGGRGGSGGDAGVGGVGGIGGAGSTPGVDGATGSTPDGGDGGAGGNGGDAI

SEQ ID NO: 495905 - protein, 9 aa, Mycobacterium
GSDGGRIET

SEQ ID NO: 495906 - protein, 7 aa, Mycobacterium
GSDGHTR

SEQ ID NO: 495907 - protein, 5 aa, Mycobacterium
GSDGI

SEQ ID NO: 495908 - protein, 9 aa, Mycobacterium
GSDGKVTGL

SEQ ID NO: 495909 - protein, 10 aa, Mycobacterium
GSDGLDRTTV

SEQ ID NO: 495910 - protein, 10 aa, Mycobacterium
GSDGNQASAI

SEQ ID NO: 495911 - protein, 8 aa, Mycobacterium
GSDGPASA

SEQ ID NO: 495912 - protein, 14 aa, Mycobacterium
GSDGPQSRRATHSF

SEQ ID NO: 495913 - protein, 32 aa, Mycobacterium
GSDGQQREASGVAGAAASLTGQSAQSLGAPAA

SEQ ID NO: 495914 - protein, 17 aa, Mycobacterium
GSDGQSLAATELSAGER

SEQ ID NO: 495915 - protein, 5 aa, Mycobacterium
GSDGS

SEQ ID NO: 495916 - protein, 11 aa, Mycobacterium
GSDGSGSGPQL

SEQ ID NO: 495917 - protein, 11 aa, Mycobacterium
GSDGSQSNAIR

SEQ ID NO: 495918 - protein, 13 aa, Mycobacterium
GSDGVALDACVAA

SEQ ID NO: 495919 - protein, 8 aa, Mycobacterium
GSDHPDKV

SEQ ID NO: 495920 - protein, 6 aa, Mycobacterium
GSDHPI

SEQ ID NO: 495921 - protein, 11 aa, Mycobacterium
GSDHSDDRHSC

SEQ ID NO: 495922 - protein, 4 aa, Mycobacterium
GSDI

SEQ ID NO: 495923 - protein, 23 aa, Mycobacterium
GSDIRDEGNGRKSVAGWLLQAHL

SEQ ID NO: 495924 - protein, 10 aa, Mycobacterium
GSDISEDGIA

SEQ ID NO: 495925 - protein, 10 aa, Mycobacterium
GSDKDGDSVT

SEQ ID NO: 495926 - protein, 5 aa, Mycobacterium
GSDKT

SEQ ID NO: 495927 - protein, 8 aa, Mycobacterium
GSDKTHQF

SEQ ID NO: 495928 - protein, 8 aa, Mycobacterium
GSDKTQEF

SEQ ID NO: 495929 - protein, 6 aa, Mycobacterium
GSDLQR

SEQ ID NO: 495930 - protein, 5 aa, Mycobacterium
GSDLT

SEQ ID NO: 495931 - protein, 7 aa, Mycobacterium
GSDNAAV

SEQ ID NO: 495932 - protein, 7 aa, Mycobacterium
GSDNFNR

SEQ ID NO: 495933 - protein, 14 aa, Mycobacterium
GSDNIGIGNSGIGN

SEQ ID NO: 495934 - protein, 14 aa, Mycobacterium
GSDNLGSGNIGSGN

SEQ ID NO: 495935 - protein, 4 aa, Mycobacterium
GSDP

SEQ ID NO: 495936 - protein, 5 aa, Mycobacterium
GSDPA

SEQ ID NO: 495937 - protein, 10 aa, Mycobacterium
GSDPAEVRPA

SEQ ID NO: 495938 - protein, 11 aa, Mycobacterium
GSDPAQPVPGA

SEQ ID NO: 495939 - protein, 9 aa, Mycobacterium
GSDPATSVA

SEQ ID NO: 495940 - protein, 5 aa, Mycobacterium
GSDPD

SEQ ID NO: 495941 - protein, 9 aa, Mycobacterium
GSDPDQVRE

SEQ ID NO: 495942 - protein, 8 aa, Mycobacterium
GSDPEAAE

SEQ ID NO: 495943 - protein, 6 aa, Mycobacterium
GSDPEE

SEQ ID NO: 495944 - protein, 9 aa, Mycobacterium
GSDPFGSTT

SEQ ID NO: 495945 - protein, 16 aa, Mycobacterium
GSDPGRVPAPAEPRRG

SEQ ID NO: 495946 - protein, 6 aa, Mycobacterium
GSDPHL

SEQ ID NO: 495947 - protein, 15 aa, Mycobacterium
GSDPKTRISSSYAPM

SEQ ID NO: 495948 - protein, 8 aa, Mycobacterium
GSDPNPLA

SEQ ID NO: 495949 - protein, 10 aa, Mycobacterium
GSDPPDDPYE

SEQ ID NO: 495950 - protein, 14 aa, Mycobacterium
GSDPPVDGAYPPGA

SEQ ID NO: 495951 - protein, 12 aa, Mycobacterium
GSDPSGFEDGPN

SEQ ID NO: 495952 - protein, 8 aa, Mycobacterium
GSDPSKHQ

SEQ ID NO: 495953 - protein, 7 aa, Mycobacterium
GSDPSTF

SEQ ID NO: 495954 - protein, 6 aa, Mycobacterium
GSDPSV

SEQ ID NO: 495955 - protein, 10 aa, Mycobacterium
GSDPSVRGRG

SEQ ID NO: 495956 - protein, 10 aa, Mycobacterium
GSDPTAGIAE

SEQ ID NO: 495957 - protein, 7 aa, Mycobacterium
GSDPVAD

SEQ ID NO: 495958 - protein, 7 aa, Mycobacterium
GSDPVGV

SEQ ID NO: 495959 - protein, 15 aa, Mycobacterium
GSDPYANAGRLDESA

SEQ ID NO: 495960 - protein, 4 aa, Mycobacterium
GSDQ

SEQ ID NO: 495961 - protein, 5 aa, Mycobacterium
GSDQQ

SEQ ID NO: 495962 - protein, 8 aa, Mycobacterium
GSDRDTAR

SEQ ID NO: 495963 - protein, 6 aa, Mycobacterium
GSDRGA

SEQ ID NO: 495964 - protein, 7 aa, Mycobacterium
GSDRNTY

SEQ ID NO: 495965 - protein, 6 aa, Mycobacterium
GSDRTV

SEQ ID NO: 495966 - protein, 21 aa, Mycobacterium
GSDSAAARRGIGGTGADDPAF

SEQ ID NO: 495967 - protein, 6 aa, Mycobacterium
GSDSAE

SEQ ID NO: 495968 - protein, 6 aa, Mycobacterium
GSDSAS

SEQ ID NO: 495969 - protein, 9 aa, Mycobacterium
GSDSDGGTI

SEQ ID NO: 495970 - protein, 17 aa, Mycobacterium
GSDSEDGALGADGARDL

SEQ ID NO: 495971 - protein, 8 aa, Mycobacterium
GSDSFSDP

SEQ ID NO: 495972 - protein, 8 aa, Mycobacterium
GSDSGADA

SEQ ID NO: 495973 - protein, 10 aa, Mycobacterium
GSDSGGGAGI

SEQ ID NO: 495974 - protein, 5 aa, Mycobacterium
GSDSK

SEQ ID NO: 495975 - protein, 18 aa, Mycobacterium
GSDSPDSAAREIALWFPG

SEQ ID NO: 495976 - protein, 18 aa, Mycobacterium
GSDSPESAAREIALWFPA

SEQ ID NO: 495977 - protein, 9 aa, Mycobacterium
GSDSRWPKY

SEQ ID NO: 495978 - protein, 9 aa, Mycobacterium
GSDSSGDEP

SEQ ID NO: 495979 - protein, 10 aa, Mycobacterium
GSDTAGNERT

SEQ ID NO: 495980 - protein, 21 aa, Mycobacterium
GSDTATAASIANGRPDLPGPL

SEQ ID NO: 495981 - protein, 21 aa, Mycobacterium
GSDTPKDPGPWEGEQRNMWKP

SEQ ID NO: 495982 - protein, 8 aa, Mycobacterium
GSDTQALD

SEQ ID NO: 495983 - protein, 6 aa, Mycobacterium
GSDTSQ

SEQ ID NO: 495984 - protein, 6 aa, Mycobacterium
GSDTTF

SEQ ID NO: 495985 - protein, 12 aa, Mycobacterium
GSDTVRTNANAD

SEQ ID NO: 495986 - protein, 13 aa, Mycobacterium
GSDTVRTNANADA

SEQ ID NO: 495987 - protein, 12 aa, Mycobacterium
GSDVDKADPQVS

SEQ ID NO: 495988 - protein, 6 aa, Mycobacterium
GSDVGG

SEQ ID NO: 495989 - protein, 5 aa, Mycobacterium
GSDVP

SEQ ID NO: 495990 - protein, 6 aa, Mycobacterium
GSDVPH

SEQ ID NO: 495991 - protein, 12 aa, Mycobacterium
GSDVQASNVPVY

SEQ ID NO: 495992 - protein, 9 aa, Mycobacterium
GSDVTDHQI

SEQ ID NO: 495993 - protein, 7 aa, Mycobacterium
GSDWEAA

SEQ ID NO: 495994 - protein, 13 aa, Mycobacterium
GSDWPGAAEDRDT

SEQ ID NO: 495995 - protein, 4 aa, Mycobacterium
GSDY

SEQ ID NO: 495996 - protein, 8 aa, Mycobacterium
GSDYATPT

SEQ ID NO: 495997 - protein, 12 aa, Mycobacterium
GSDYEPSYRRPE

SEQ ID NO: 495998 - protein, 17 aa, Mycobacterium
GSDYGAAGKRPADFPAT

SEQ ID NO: 495999 - protein, 7 aa, Mycobacterium
GSDYSPV

SEQ ID NO: 496000 - protein, 8 aa, Mycobacterium
GSEADAAE

SEQ ID NO: 496001 - protein, 11 aa, Mycobacterium
GSEADGPLNQK

SEQ ID NO: 496002 - protein, 8 aa, Mycobacterium
GSEAGVTP

SEQ ID NO: 496003 - protein, 8 aa, Mycobacterium
GSEAHRRL

SEQ ID NO: 496004 - protein, 11 aa, Mycobacterium
GSEAPGPLPLD

SEQ ID NO: 496005 - protein, 11 aa, Mycobacterium
GSEAPKSATVR

SEQ ID NO: 496006 - protein, 21 aa, Mycobacterium
GSEASVRGAQSHTGALTSDSA

SEQ ID NO: 496007 - protein, 5 aa, Mycobacterium
GSEAT

SEQ ID NO: 496008 - protein, 7 aa, Mycobacterium
GSEATVD

SEQ ID NO: 496009 - protein, 7 aa, Mycobacterium
GSEDADK

SEQ ID NO: 496010 - protein, 13 aa, Mycobacterium
GSEDARDHAKPGY

SEQ ID NO: 496011 - protein, 10 aa, Mycobacterium
GSEDDRDAYR

SEQ ID NO: 496012 - protein, 6 aa, Mycobacterium
GSEDGR

SEQ ID NO: 496013 - protein, 8 aa, Mycobacterium
GSEDGYAG

SEQ ID NO: 496014 - protein, 8 aa, Mycobacterium
GSEDPAEQ

SEQ ID NO: 496015 - protein, 9 aa, Mycobacterium
GSEDTGRRI

SEQ ID NO: 496016 - protein, 14 aa, Mycobacterium
GSEEAVEAAGESLH

SEQ ID NO: 496017 - protein, 13 aa, Mycobacterium
GSEEEATVYAGTG

SEQ ID NO: 496018 - protein, 6 aa, Mycobacterium
GSEEGR

SEQ ID NO: 496019 - protein, 6 aa, Mycobacterium
GSEEGV

SEQ ID NO: 496020 - protein, 8 aa, Mycobacterium
GSEELQQG

SEQ ID NO: 496021 - protein, 7 aa, Mycobacterium
GSEEQKQ

SEQ ID NO: 496022 - protein, 8 aa, Mycobacterium
GSEEQKQQ

SEQ ID NO: 496023 - protein, 10 aa, Mycobacterium
GSEEQKQTHI

SEQ ID NO: 496024 - protein, 7 aa, Mycobacterium
GSEEQKR

SEQ ID NO: 496025 - protein, 8 aa, Mycobacterium
GSEEQKRA

SEQ ID NO: 496026 - protein, 7 aa, Mycobacterium
GSEEQRE

SEQ ID NO: 496027 - protein, 8 aa, Mycobacterium
GSEERATA

SEQ ID NO: 496028 - protein, 14 aa, Mycobacterium
GSEFSQDADPRYAN

SEQ ID NO: 496029 - protein, 4 aa, Mycobacterium
GSEG

SEQ ID NO: 496030 - protein, 13 aa, Mycobacterium
GSEGAEDSPRGQP

SEQ ID NO: 496031 - protein, 7 aa, Mycobacterium
GSEGAEF

SEQ ID NO: 496032 - protein, 10 aa, Mycobacterium
GSEGGGSAHE

SEQ ID NO: 496033 - protein, 14 aa, Mycobacterium
GSEGGMTPLSGAEK

SEQ ID NO: 496034 - protein, 11 aa, Mycobacterium
GSEGQAANGDR

SEQ ID NO: 496035 - protein, 20 aa, Mycobacterium
GSEGRQGKLDAAETEREHAA

SEQ ID NO: 496036 - protein, 32 aa, Mycobacterium
GSEGRQGKLDAAETEREHAATEHSQIGARARA

SEQ ID NO: 496037 - protein, 32 aa, Mycobacterium
GSEGRQGKLDAAETQREHAAGRHARVGQRARA

SEQ ID NO: 496038 - protein, 31 aa, Mycobacterium
GSEGRQSKLDAAETEREHAASQHARIGRRAR

SEQ ID NO: 496039 - protein, 4 aa, Mycobacterium
GSEH

SEQ ID NO: 496040 - protein, 7 aa, Mycobacterium
GSEHARL

SEQ ID NO: 496041 - protein, 13 aa, Mycobacterium
GSEIGSAGPPMPL

SEQ ID NO: 496042 - protein, 5 aa, Mycobacterium
GSEIT

SEQ ID NO: 496043 - protein, 8 aa, Mycobacterium
GSEKTAQL

SEQ ID NO: 496044 - protein, 8 aa, Mycobacterium
GSEKTEQF

SEQ ID NO: 496045 - protein, 4 aa, Mycobacterium
GSEL

SEQ ID NO: 496046 - protein, 8 aa, Mycobacterium
GSELARKV

SEQ ID NO: 496047 - protein, 7 aa, Mycobacterium
GSELPEP

SEQ ID NO: 496048 - protein, 6 aa, Mycobacterium
GSELPY

SEQ ID NO: 496049 - protein, 11 aa, Mycobacterium
GSELSSGIPDI

SEQ ID NO: 496050 - protein, 9 aa, Mycobacterium
GSELSYGSD

SEQ ID NO: 496051 - protein, 19 aa, Mycobacterium
GSELTAGSTFGEVESTKSV

SEQ ID NO: 496052 - protein, 10 aa, Mycobacterium
GSELTDSQVG

SEQ ID NO: 496053 - protein, 5 aa, Mycobacterium
GSELV

SEQ ID NO: 496054 - protein, 4 aa, Mycobacterium
GSEM

SEQ ID NO: 496055 - protein, 7 aa, Mycobacterium
GSEMADE

SEQ ID NO: 496056 - protein, 6 aa, Mycobacterium
GSENAG

SEQ ID NO: 496057 - protein, 17 aa, Mycobacterium
GSENSGAFRSHTPPVQR

SEQ ID NO: 496058 - protein, 7 aa, Mycobacterium
GSENTGF

SEQ ID NO: 496059 - protein, 5 aa, Mycobacterium
GSEPA

SEQ ID NO: 496060 - protein, 6 aa, Mycobacterium
GSEPAG

SEQ ID NO: 496061 - protein, 6 aa, Mycobacterium
GSEPEK

SEQ ID NO: 496062 - protein, 5 aa, Mycobacterium
GSEPF

SEQ ID NO: 496063 - protein, 15 aa, Mycobacterium
GSEPGDAPGEAPATA

SEQ ID NO: 496064 - protein, 7 aa, Mycobacterium
GSEPGKR

SEQ ID NO: 496065 - protein, 59 aa, Mycobacterium
GSEPGLADRDERELDSGDPDHERAGHADDPTENREDRGDTDAQPSPDKPDSPPTGPTAV

SEQ ID NO: 496066 - protein, 12 aa, Mycobacterium
GSEPIDGGNDDY

SEQ ID NO: 496067 - protein, 5 aa, Mycobacterium
GSEPL

SEQ ID NO: 496068 - protein, 5 aa, Mycobacterium
GSEPM

SEQ ID NO: 496069 - protein, 7 aa, Mycobacterium
GSEPRLP

SEQ ID NO: 496070 - protein, 6 aa, Mycobacterium
GSEPTA

SEQ ID NO: 496071 - protein, 5 aa, Mycobacterium
GSEPV

SEQ ID NO: 496072 - protein, 6 aa, Mycobacterium
GSEPVR

SEQ ID NO: 496073 - protein, 9 aa, Mycobacterium
GSEPVSTAS

SEQ ID NO: 496074 - protein, 6 aa, Mycobacterium
GSEPVT

SEQ ID NO: 496075 - protein, 7 aa, Mycobacterium
GSEPVTA

SEQ ID NO: 496076 - protein, 11 aa, Mycobacterium
GSEQGANGNHI

SEQ ID NO: 496077 - protein, 7 aa, Mycobacterium
GSEQGSI

SEQ ID NO: 496078 - protein, 10 aa, Mycobacterium
GSEQQKRDRI

SEQ ID NO: 496079 - protein, 17 aa, Mycobacterium
GSEQTAAAEGKVGNVRR

SEQ ID NO: 496080 - protein, 17 aa, Mycobacterium
GSEQTAAAEGKVGTVRR

SEQ ID NO: 496081 - protein, 10 aa, Mycobacterium
GSEQVDGNDP

SEQ ID NO: 496082 - protein, 9 aa, Mycobacterium
GSEQVEPAD

SEQ ID NO: 496083 - protein, 4 aa, Mycobacterium
GSER

SEQ ID NO: 496084 - protein, 57 aa, Mycobacterium
GSERSDSSRPAVPTVADEESAVTSATAIGEHPSRPTRTAVTEPPGITPVPTSTATCG

SEQ ID NO: 496085 - protein, 5 aa, Mycobacterium
GSERT

SEQ ID NO: 496086 - protein, 7 aa, Mycobacterium
GSERTFA

SEQ ID NO: 496087 - protein, 4 aa, Mycobacterium
GSES

SEQ ID NO: 496088 - protein, 5 aa, Mycobacterium
GSESA

SEQ ID NO: 496089 - protein, 11 aa, Mycobacterium
GSESAAVGLPT

SEQ ID NO: 496090 - protein, 13 aa, Mycobacterium
GSESGPDEATSID

SEQ ID NO: 496091 - protein, 10 aa, Mycobacterium
GSESGPNLGE

SEQ ID NO: 496092 - protein, 19 aa, Mycobacterium
GSESSGMARAATPPRQRGH

SEQ ID NO: 496093 - protein, 7 aa, Mycobacterium
GSETAYA

SEQ ID NO: 496094 - protein, 12 aa, Mycobacterium
GSETGGDEKFRR

SEQ ID NO: 496095 - protein, 13 aa, Mycobacterium
GSETGKPKVHPDD

SEQ ID NO: 496096 - protein, 12 aa, Mycobacterium
GSETGPGGPHVT

SEQ ID NO: 496097 - protein, 8 aa, Mycobacterium
GSETTRNS

SEQ ID NO: 496098 - protein, 13 aa, Mycobacterium
GSETVDEARKGLQ

SEQ ID NO: 496099 - protein, 8 aa, Mycobacterium
GSETVSAE

SEQ ID NO: 496100 - protein, 6 aa, Mycobacterium
GSEVSG

SEQ ID NO: 496101 - protein, 10 aa, Mycobacterium
GSEVTSVKPG

SEQ ID NO: 496102 - protein, 14 aa, Mycobacterium
GSFAGRGAAEYSRR

SEQ ID NO: 496103 - protein, 7 aa, Mycobacterium
GSFAPSD

SEQ ID NO: 496104 - protein, 15 aa, Mycobacterium
GSFGAGNYGMSGRAY

SEQ ID NO: 496105 - protein, 15 aa, Mycobacterium
GSFGGEQGSVSGASA

SEQ ID NO: 496106 - protein, 5 aa, Mycobacterium
GSFGI

SEQ ID NO: 496107 - protein, 14 aa, Mycobacterium
GSFGPGPRSRPEAQ

SEQ ID NO: 496108 - protein, 5 aa, Mycobacterium
GSFPS

SEQ ID NO: 496109 - protein, 11 aa, Mycobacterium
GSFQGPAAYDD

SEQ ID NO: 496110 - protein, 10 aa, Mycobacterium
GSFQGPAAYE

SEQ ID NO: 496111 - protein, 15 aa, Mycobacterium
GSFRDGTRVAATDPS

SEQ ID NO: 496112 - protein, 6 aa, Mycobacterium
GSFRTE

SEQ ID NO: 496113 - protein, 13 aa, Mycobacterium
GSFSADARGRFPG

SEQ ID NO: 496114 - protein, 6 aa, Mycobacterium
GSFSDA

SEQ ID NO: 496115 - protein, 6 aa, Mycobacterium
GSFTPS

SEQ ID NO: 496116 - protein, 41 aa, Mycobacterium
GSFTPTPVGYGGNGGNGVNGGTGGTGGTGGTLIGTDGTNGS

SEQ ID NO: 496117 - protein, 6 aa, Mycobacterium
GSFTSW

SEQ ID NO: 496118 - protein, 4 aa, Mycobacterium
GSFY

SEQ ID NO: 496119 - protein, 11 aa, Mycobacterium
GSGAARRGGGI

SEQ ID NO: 496120 - protein, 16 aa, Mycobacterium
GSGAASRATAFLCRPS

SEQ ID NO: 496121 - protein, 6 aa, Mycobacterium
GSGAAY

SEQ ID NO: 496122 - protein, 5 aa, Mycobacterium
GSGAD

SEQ ID NO: 496123 - protein, 13 aa, Mycobacterium
GSGADGDAHPLSD

SEQ ID NO: 496124 - protein, 7 aa, Mycobacterium
GSGADRE

SEQ ID NO: 496125 - protein, 6 aa, Mycobacterium
GSGAEI

SEQ ID NO: 496126 - protein, 8 aa, Mycobacterium
GSGAELDR

SEQ ID NO: 496127 - protein, 6 aa, Mycobacterium
GSGAES

SEQ ID NO: 496128 - protein, 9 aa, Mycobacterium
GSGAEVGTA

SEQ ID NO: 496129 - protein, 5 aa, Mycobacterium
GSGAG

SEQ ID NO: 496130 - protein, 16 aa, Mycobacterium
GSGAGGVTGAYTAARE

SEQ ID NO: 496131 - protein, 14 aa, Mycobacterium
GSGAGQAPQAPPLP

SEQ ID NO: 496132 - protein, 8 aa, Mycobacterium
GSGAGTSV

SEQ ID NO: 496133 - protein, 15 aa, Mycobacterium
GSGAGVQVIDHAAGR

SEQ ID NO: 496134 - protein, 15 aa, Mycobacterium
GSGAGVQVIEHAAGP

SEQ ID NO: 496135 - protein, 7 aa, Mycobacterium
GSGAIQG

SEQ ID NO: 496136 - protein, 21 aa, Mycobacterium
GSGALDNRITTTATAPEPAAD

SEQ ID NO: 496137 - protein, 5 aa, Mycobacterium
GSGAP

SEQ ID NO: 496138 - protein, 13 aa, Mycobacterium
GSGAPDTSAAARV

SEQ ID NO: 496139 - protein, 6 aa, Mycobacterium
GSGAPK

SEQ ID NO: 496140 - protein, 9 aa, Mycobacterium
GSGAPPAEV

SEQ ID NO: 496141 - protein, 12 aa, Mycobacterium
GSGAPPIGSPVS

SEQ ID NO: 496142 - protein, 14 aa, Mycobacterium
GSGAQATVDQGTSI

SEQ ID NO: 496143 - protein, 11 aa, Mycobacterium
GSGAQTFNGGQ

SEQ ID NO: 496144 - protein, 8 aa, Mycobacterium
GSGARIES

SEQ ID NO: 496145 - protein, 9 aa, Mycobacterium
GSGARPFTA

SEQ ID NO: 496146 - protein, 13 aa, Mycobacterium
GSGARPGTSPKVC

SEQ ID NO: 496147 - protein, 11 aa, Mycobacterium
GSGARPGTSPR

SEQ ID NO: 496148 - protein, 16 aa, Mycobacterium
GSGASGRATAFVCRAS

SEQ ID NO: 496149 - protein, 7 aa, Mycobacterium
GSGASYD

SEQ ID NO: 496150 - protein, 7 aa, Mycobacterium
GSGATHA

SEQ ID NO: 496151 - protein, 15 aa, Mycobacterium
GSGATLGPALTDNPQ

SEQ ID NO: 496152 - protein, 14 aa, Mycobacterium
GSGATPFARGGDGL

SEQ ID NO: 496153 - protein, 19 aa, Mycobacterium
GSGATVEGQITGQETHGGV

SEQ ID NO: 496154 - protein, 19 aa, Mycobacterium
GSGATVEGQVTGEETHGGV

SEQ ID NO: 496155 - protein, 7 aa, Mycobacterium
GSGAVAG

SEQ ID NO: 496156 - protein, 4 aa, Mycobacterium
GSGC

SEQ ID NO: 496157 - protein, 4 aa, Mycobacterium
GSGD

SEQ ID NO: 496158 - protein, 7 aa, Mycobacterium
GSGDAPV

SEQ ID NO: 496159 - protein, 26 aa, Mycobacterium
GSGDGSDSRDGAPHRNGGTHERPAVD

SEQ ID NO: 496160 - protein, 9 aa, Mycobacterium
GSGDLPEPT

SEQ ID NO: 496161 - protein, 5 aa, Mycobacterium
GSGDP

SEQ ID NO: 496162 - protein, 10 aa, Mycobacterium
GSGDPKEARA

SEQ ID NO: 496163 - protein, 5 aa, Mycobacterium
GSGDQ

SEQ ID NO: 496164 - protein, 11 aa, Mycobacterium
GSGDRPSTGDA

SEQ ID NO: 496165 - protein, 16 aa, Mycobacterium
GSGDRVDDLEQPVFAW

SEQ ID NO: 496166 - protein, 8 aa, Mycobacterium
GSGDVGAV

SEQ ID NO: 496167 - protein, 11 aa, Mycobacterium
GSGDWDETKTD

SEQ ID NO: 496168 - protein, 12 aa, Mycobacterium
GSGDWQSTKDDV

SEQ ID NO: 496169 - protein, 6 aa, Mycobacterium
GSGEAK

SEQ ID NO: 496170 - protein, 11 aa, Mycobacterium
GSGEASNERIT

SEQ ID NO: 496171 - protein, 7 aa, Mycobacterium
GSGEDNV

SEQ ID NO: 496172 - protein, 9 aa, Mycobacterium
GSGEGGEPI

SEQ ID NO: 496173 - protein, 8 aa, Mycobacterium
GSGEKKTF

SEQ ID NO: 496174 - protein, 8 aa, Mycobacterium
GSGEKKTI

SEQ ID NO: 496175 - protein, 9 aa, Mycobacterium
GSGEKRTLP

SEQ ID NO: 496176 - protein, 12 aa, Mycobacterium
GSGELKLKRLRR

SEQ ID NO: 496177 - protein, 6 aa, Mycobacterium
GSGENL

SEQ ID NO: 496178 - protein, 5 aa, Mycobacterium
GSGEP

SEQ ID NO: 496179 - protein, 7 aa, Mycobacterium
GSGEPSE

SEQ ID NO: 496180 - protein, 7 aa, Mycobacterium
GSGEQRE

SEQ ID NO: 496181 - protein, 7 aa, Mycobacterium
GSGERKT

SEQ ID NO: 496182 - protein, 12 aa, Mycobacterium
GSGESAANLAGR

SEQ ID NO: 496183 - protein, 5 aa, Mycobacterium
GSGEV

SEQ ID NO: 496184 - protein, 5 aa, Mycobacterium
GSGFG

SEQ ID NO: 496185 - protein, 6 aa, Mycobacterium
GSGFGA

SEQ ID NO: 496186 - protein, 12 aa, Mycobacterium
GSGFGDAPDAEN

SEQ ID NO: 496187 - protein, 9 aa, Mycobacterium
GSGGAASGQ

SEQ ID NO: 496188 - protein, 6 aa, Mycobacterium
GSGGAG

SEQ ID NO: 496189 - protein, 7 aa, Mycobacterium
GSGGAGA

SEQ ID NO: 496190 - protein, 28 aa, Mycobacterium
GSGGAGGAGGGSTVHGRGGAGGDGGAGG

SEQ ID NO: 496191 - protein, 14 aa, Mycobacterium
GSGGAGGAGGNTDL

SEQ ID NO: 496192 - protein, 26 aa, Mycobacterium
GSGGAGGAGGSTSSGVAGAGGAGGAG

SEQ ID NO: 496193 - protein, 11 aa, Mycobacterium
GSGGAGGDGGF

SEQ ID NO: 496194 - protein, 10 aa, Mycobacterium
GSGGAGGIGG

SEQ ID NO: 496195 - protein, 14 aa, Mycobacterium
GSGGAGGNGGDANA

SEQ ID NO: 496196 - protein, 14 aa, Mycobacterium
GSGGAGGQGGTGLA

SEQ ID NO: 496197 - protein, 182 aa, Mycobacterium
GSGGAGGQGGTGLAGTDGTNPTPGATAGTGSAGADQSNNGNVTGDNGNPGDAGTGDEIGGTGGAGGLGESTDGNSGTGGMGGGGGTAGPNGGNGGEGGMGGEGRTDGSSGGTATGGDGGAGADGGTGGGDGGAGGDGGFGNNTISGAAIGGNGGIGGAGSTLQGATGGNGDTGGAGGNGGRG

SEQ ID NO: 496198 - protein, 19 aa, Mycobacterium
GSGGAGGSGGIGGLNAGAQ

SEQ ID NO: 496199 - protein, 31 aa, Mycobacterium
GSGGAGGTAGDGGAGIYPGGAGGTGGSGGAA

SEQ ID NO: 496200 - protein, 27 aa, Mycobacterium
GSGGAGGTGGSSSTGNGGAGGAGGAGG

SEQ ID NO: 496201 - protein, 31 aa, Mycobacterium
GSGGAGGTGGVGGLGDSASGTGGSGGGGGAA

SEQ ID NO: 496202 - protein, 26 aa, Mycobacterium
GSGGAGGVAGTSIGQPAAGGNGGNAR

SEQ ID NO: 496203 - protein, 26 aa, Mycobacterium
GSGGAGGVATDATGIGGTGGAGGESG

SEQ ID NO: 496204 - protein, 7 aa, Mycobacterium
GSGGARG

SEQ ID NO: 496205 - protein, 8 aa, Mycobacterium
GSGGARGY

SEQ ID NO: 496206 - protein, 15 aa, Mycobacterium
GSGGASGGDGGNGGS

SEQ ID NO: 496207 - protein, 7 aa, Mycobacterium
GSGGDGL

SEQ ID NO: 496208 - protein, 8 aa, Mycobacterium
GSGGDYQF

SEQ ID NO: 496209 - protein, 7 aa, Mycobacterium
GSGGEGA

SEQ ID NO: 496210 - protein, 24 aa, Mycobacterium
GSGGFGGFGQGPSGGIGGDGGDAG

SEQ ID NO: 496211 - protein, 9 aa, Mycobacterium
GSGGGATEF

SEQ ID NO: 496212 - protein, 8 aa, Mycobacterium
GSGGGERA

SEQ ID NO: 496213 - protein, 26 aa, Mycobacterium
GSGGGGGNGGSGYSGIGGTGGTGGSA

SEQ ID NO: 496214 - protein, 8 aa, Mycobacterium
GSGGGGMT

SEQ ID NO: 496215 - protein, 55 aa, Mycobacterium
GSGGGNGGNGGFGSVNGGAGGDGGDGGALAGPGGSGGSGAFGGTLGGDGGAGGAA

SEQ ID NO: 496216 - protein, 15 aa, Mycobacterium
GSGGGVAGAYTAARE

SEQ ID NO: 496217 - protein, 8 aa, Mycobacterium
GSGGHNSG

SEQ ID NO: 496218 - protein, 8 aa, Mycobacterium
GSGGKVTG

SEQ ID NO: 496219 - protein, 6 aa, Mycobacterium
GSGGLD

SEQ ID NO: 496220 - protein, 6 aa, Mycobacterium
GSGGLG

SEQ ID NO: 496221 - protein, 1372 aa, Mycobacterium
GSGGLGGHGGTGADNTTAVSAGAQGATGGTGGAGGQGGTGGAAGTGTGGIQGAGGQGGTGGTGGQGGTGGTGTDSTDPTLAGQAGGQGGTGGTGGAAGSGGTGSTMGAEGSSGDGGTGGLGGDGGTGGQGTTAVNPGDTGGQGASGGAGGTGGTGGAAGTGTGGTQGAGGQGGTGGTGGQGGTGGDGTDNSTTPGAAGGAGGQGGTGGTGGAAGSGGTGSTMGAEGSSGDGGTGGLGGDGGTGGQGTTAVNPGDTGGQGASGGAGGTGGTGGAAGTGTGGTQGAGGQGGTGGTGGQGGTGGDGTDNSTTPGAAGGAGGQGGTGGTGGAAGSGGTGSTMGAEGSSGDGGTGGLGGAGGTGGQGTTAVNPGDTGGQGASGGAGGTGGTGGAAGTGTGGIQGAGGQGGTGGAGGSGGTGGDGTDNSTTPGAAGGAGGQGGTGGTGGAAGSGGTGSTMGAEGSSGDGGTGGLGGAGGTGGQGTTAVNPGDTGGQGASGGAGGTGGTGGAAGTGTGGIQGAGGQGGTGGTGGQGGTGGDGAESTDPTLAGQAGGQGGTGGTGGAAGQGGTGSVAGTDGSAGDGGTGGLGGHGGAGADNTTTVSAGAQGATGGTGGAGGQGGTGGAAGTGTGGTQGAGGQGGTGGTGGTGGIGGTGTDSTDPSQIAQAGGQGGTGGTGGAAGQGGTGSTMGSAGTAGDGGTGGLGGGGGTGADNTTAVSAGAQGATGGTGGAGGQGGTGGAAGTGTGGIQGAGGQGGTGGTGGTGGIGGTGTDSTDPTLAGQAGGQGGTGGTGGAAGTGGTGSVTGTDGTAGDGGTGGLGGHGGAGADNTTTVSAGAQGATGGTGGAGGTGGTGGAAGTGTGGTQGAGGQGGTGGTGGTGGIGGTGTDSTDPSQIAQAGGQGGTGGTGGAAGSGGTGSVTGTDGTAGDGGTGGLGGDGGAGADNTTTVSAGAQGATGGTGGAGGQGGTGGAAGTGTGGIQGAGGQGGTGGAGGSGGTGGDGTDNSTTPGAAGGAGGQGGTGGTGGAAGQGGTGSTMGSDGSSGDGGTGGLGGDGGGAGQGTTGTAGAGTGGQGASGGAGGQGGTGGAAGTGTGGTQGAGGQGGTGGTGGTGGTGGTGTDSTDPSQIAQAGGQGGTGGTGGAAGQGGTGSTMGAEGSSGDGGTGGLGGHGGAGADNTTTVSAGAQGATGGTGGAGGQGGTGGAAGTGTGGTQGAGGQGGTGGTGGTGGIGGTGTDSTDPSQIAQAGGQGGTGGTGGAAGQGGTGSTMGSAGTAGDGGTGGLGGGGGTGADNTTTVSAGAQGATGGTGGAGGQGGTGGAAGTGTGGIQGAGGQGGTGGTGGTGGIGGTGTDSTDPTLAGQAGGQGGTGETGGAAGSGGTG

SEQ ID NO: 496222 - protein, 5 aa, Mycobacterium
GSGGM

SEQ ID NO: 496223 - protein, 10 aa, Mycobacterium
GSGGNGGGGL

SEQ ID NO: 496224 - protein, 8 aa, Mycobacterium
GSGGPEVS

SEQ ID NO: 496225 - protein, 7 aa, Mycobacterium
GSGGPGE

SEQ ID NO: 496226 - protein, 22 aa, Mycobacterium
GSGGPGGAGGDGNTSGGNGGFG

SEQ ID NO: 496227 - protein, 28 aa, Mycobacterium
GSGGPKVVPPRSRWTPPTLATPVRHHPG

SEQ ID NO: 496228 - protein, 9 aa, Mycobacterium
GSGGQRLPT

SEQ ID NO: 496229 - protein, 7 aa, Mycobacterium
GSGGRRV

SEQ ID NO: 496230 - protein, 8 aa, Mycobacterium
GSGGRSLD

SEQ ID NO: 496231 - protein, 9 aa, Mycobacterium
GSGGSDALH

SEQ ID NO: 496232 - protein, 7 aa, Mycobacterium
GSGGSFC

SEQ ID NO: 496233 - protein, 36 aa, Mycobacterium
GSGGSGGAGGEGGAFGDGNAGGSGSGGHGGNGGNGG

SEQ ID NO: 496234 - protein, 59 aa, Mycobacterium
GSGGSGGGGGAGSSAGGDGGAGGASGYGIGNGGAGGAAGDGGGAGSLGTGGNGGSGGRA

SEQ ID NO: 496235 - protein, 33 aa, Mycobacterium
GSGGSGGTGGVGGIGNTIGGTGGVGGGGGAAGL

SEQ ID NO: 496236 - protein, 11 aa, Mycobacterium
GSGGSTGRPKL

SEQ ID NO: 496237 - protein, 21 aa, Mycobacterium
GSGGSTGRPKLIESGGDSRIP

SEQ ID NO: 496238 - protein, 8 aa, Mycobacterium
GSGGTAPA

SEQ ID NO: 496239 - protein, 22 aa, Mycobacterium
GSGGTGGAGGAGAAGGSGGNGG

SEQ ID NO: 496240 - protein, 17 aa, Mycobacterium
GSGGTGGDGGNAGAGVT

SEQ ID NO: 496241 - protein, 55 aa, Mycobacterium
GSGGTGGHGAAGAVAGGDGGRGGTGGGLAGSGGTGGNGAVGTVSGVGGDGGNAAG

SEQ ID NO: 496242 - protein, 24 aa, Mycobacterium
GSGGTGGTGGYGGAGGAGGSGGDA

SEQ ID NO: 496243 - protein, 6 aa, Mycobacterium
GSGGTV

SEQ ID NO: 496244 - protein, 14 aa, Mycobacterium
GSGGVIDDPAASPL

SEQ ID NO: 496245 - protein, 7 aa, Mycobacterium
GSGGYNS

SEQ ID NO: 496246 - protein, 4 aa, Mycobacterium
GSGH

SEQ ID NO: 496247 - protein, 11 aa, Mycobacterium
GSGHAADETLA

SEQ ID NO: 496248 - protein, 7 aa, Mycobacterium
GSGHRDE

SEQ ID NO: 496249 - protein, 5 aa, Mycobacterium
GSGHS

SEQ ID NO: 496250 - protein, 4 aa, Mycobacterium
GSGI

SEQ ID NO: 496251 - protein, 7 aa, Mycobacterium
GSGIADS

SEQ ID NO: 496252 - protein, 6 aa, Mycobacterium
GSGIAR

SEQ ID NO: 496253 - protein, 15 aa, Mycobacterium
GSGIDPTDPRVSPLR

SEQ ID NO: 496254 - protein, 7 aa, Mycobacterium
GSGIDQV

SEQ ID NO: 496255 - protein, 7 aa, Mycobacterium
GSGIGGT

SEQ ID NO: 496256 - protein, 6 aa, Mycobacterium
GSGIGR

SEQ ID NO: 496257 - protein, 6 aa, Mycobacterium
GSGIRG

SEQ ID NO: 496258 - protein, 8 aa, Mycobacterium
GSGISPSI

SEQ ID NO: 496259 - protein, 6 aa, Mycobacterium
GSGITE

SEQ ID NO: 496260 - protein, 5 aa, Mycobacterium
GSGKG

SEQ ID NO: 496261 - protein, 9 aa, Mycobacterium
GSGKPATVP

SEQ ID NO: 496262 - protein, 9 aa, Mycobacterium
GSGKSAVEN

SEQ ID NO: 496263 - protein, 9 aa, Mycobacterium
GSGKSTVGA

SEQ ID NO: 496264 - protein, 9 aa, Mycobacterium
GSGKTITGT

SEQ ID NO: 496265 - protein, 10 aa, Mycobacterium
GSGKTITGTA

SEQ ID NO: 496266 - protein, 7 aa, Mycobacterium
GSGKTRT

SEQ ID NO: 496267 - protein, 14 aa, Mycobacterium
GSGLASRSANTPFE

SEQ ID NO: 496268 - protein, 7 aa, Mycobacterium
GSGLEAG

SEQ ID NO: 496269 - protein, 5 aa, Mycobacterium
GSGLG

SEQ ID NO: 496270 - protein, 7 aa, Mycobacterium
GSGLPGA

SEQ ID NO: 496271 - protein, 11 aa, Mycobacterium
GSGLQGPGDIA

SEQ ID NO: 496272 - protein, 7 aa, Mycobacterium
GSGLQRK

SEQ ID NO: 496273 - protein, 5 aa, Mycobacterium
GSGLR

SEQ ID NO: 496274 - protein, 13 aa, Mycobacterium
GSGLREQDPAEPV

SEQ ID NO: 496275 - protein, 4 aa, Mycobacterium
GSGM

SEQ ID NO: 496276 - protein, 7 aa, Mycobacterium
GSGNAGA

SEQ ID NO: 496277 - protein, 11 aa, Mycobacterium
GSGNAKTETVQ

SEQ ID NO: 496278 - protein, 9 aa, Mycobacterium
GSGNESADR

SEQ ID NO: 496279 - protein, 8 aa, Mycobacterium
GSGNESAN

SEQ ID NO: 496280 - protein, 9 aa, Mycobacterium
GSGNESANR

SEQ ID NO: 496281 - protein, 7 aa, Mycobacterium
GSGNFGI

SEQ ID NO: 496282 - protein, 8 aa, Mycobacterium
GSGNFGIG

SEQ ID NO: 496283 - protein, 20 aa, Mycobacterium
GSGNFGIGNSGDTSTGLANS

SEQ ID NO: 496284 - protein, 7 aa, Mycobacterium
GSGNFGN

SEQ ID NO: 496285 - protein, 15 aa, Mycobacterium
GSGNFGNANLGSGNR

SEQ ID NO: 496286 - protein, 15 aa, Mycobacterium
GSGNFGSGNLGSGNI

SEQ ID NO: 496287 - protein, 6 aa, Mycobacterium
GSGNGC

SEQ ID NO: 496288 - protein, 8 aa, Mycobacterium
GSGNHGSY

SEQ ID NO: 496289 - protein, 6 aa, Mycobacterium
GSGNIG

SEQ ID NO: 496290 - protein, 15 aa, Mycobacterium
GSGNIGDGNLGSGNI

SEQ ID NO: 496291 - protein, 16 aa, Mycobacterium
GSGNIGNYNVGPGNLG

SEQ ID NO: 496292 - protein, 6 aa, Mycobacterium
GSGNLG

SEQ ID NO: 496293 - protein, 24 aa, Mycobacterium
GSGNLGFGNAGNSNTGFGNAGDVN

SEQ ID NO: 496294 - protein, 7 aa, Mycobacterium
GSGNLGL

SEQ ID NO: 496295 - protein, 29 aa, Mycobacterium
GSGNLGSGNFGSGNFGSSNIGASNLGSNN

SEQ ID NO: 496296 - protein, 10 aa, Mycobacterium
GSGNPIPSPA

SEQ ID NO: 496297 - protein, 10 aa, Mycobacterium
GSGNPLPGPD

SEQ ID NO: 496298 - protein, 9 aa, Mycobacterium
GSGNPRADI

SEQ ID NO: 496299 - protein, 9 aa, Mycobacterium
GSGNPTPGI

SEQ ID NO: 496300 - protein, 15 aa, Mycobacterium
GSGNRGGNVNFGNGN

SEQ ID NO: 496301 - protein, 10 aa, Mycobacterium
GSGNRGTSNV

SEQ ID NO: 496302 - protein, 11 aa, Mycobacterium
GSGNSGAQNVG

SEQ ID NO: 496303 - protein, 10 aa, Mycobacterium
GSGNSGSNNI

SEQ ID NO: 496304 - protein, 7 aa, Mycobacterium
GSGNSIV

SEQ ID NO: 496305 - protein, 6 aa, Mycobacterium
GSGNTG

SEQ ID NO: 496306 - protein, 35 aa, Mycobacterium
GSGNTGGSNVGSGNYGDGNLGSGNYGNSNLGSGNG

SEQ ID NO: 496307 - protein, 10 aa, Mycobacterium
GSGNTGNTNF

SEQ ID NO: 496308 - protein, 31 aa, Mycobacterium
GSGNTGSFNMGSGNRGSRNFGAGNRGNGNFG

SEQ ID NO: 496309 - protein, 6 aa, Mycobacterium
GSGNTI

SEQ ID NO: 496310 - protein, 7 aa, Mycobacterium
GSGNTTV

SEQ ID NO: 496311 - protein, 20 aa, Mycobacterium
GSGNVGNANNGIGNLGSGNL

SEQ ID NO: 496312 - protein, 25 aa, Mycobacterium
GSGNYGNANLGSGNVANGNLGSGNR

SEQ ID NO: 496313 - protein, 5 aa, Mycobacterium
GSGPA

SEQ ID NO: 496314 - protein, 7 aa, Mycobacterium
GSGPAAM

SEQ ID NO: 496315 - protein, 10 aa, Mycobacterium
GSGPAGLAAA

SEQ ID NO: 496316 - protein, 9 aa, Mycobacterium
GSGPAPARS

SEQ ID NO: 496317 - protein, 14 aa, Mycobacterium
GSGPAPGRFTGPAP

SEQ ID NO: 496318 - protein, 19 aa, Mycobacterium
GSGPDISERHPAHGYRGMF

SEQ ID NO: 496319 - protein, 11 aa, Mycobacterium
GSGPDNGEDPA

SEQ ID NO: 496320 - protein, 6 aa, Mycobacterium
GSGPDR

SEQ ID NO: 496321 - protein, 8 aa, Mycobacterium
GSGPDRAI

SEQ ID NO: 496322 - protein, 7 aa, Mycobacterium
GSGPFPS

SEQ ID NO: 496323 - protein, 6 aa, Mycobacterium
GSGPGD

SEQ ID NO: 496324 - protein, 9 aa, Mycobacterium
GSGPGGDHA

SEQ ID NO: 496325 - protein, 7 aa, Mycobacterium
GSGPIDE

SEQ ID NO: 496326 - protein, 7 aa, Mycobacterium
GSGPKAL

SEQ ID NO: 496327 - protein, 9 aa, Mycobacterium
GSGPKALDQ

SEQ ID NO: 496328 - protein, 8 aa, Mycobacterium
GSGPKALE

SEQ ID NO: 496329 - protein, 6 aa, Mycobacterium
GSGPQA

SEQ ID NO: 496330 - protein, 11 aa, Mycobacterium
GSGPQIPDGAH

SEQ ID NO: 496331 - protein, 6 aa, Mycobacterium
GSGPSG

SEQ ID NO: 496332 - protein, 6 aa, Mycobacterium
GSGPSI

SEQ ID NO: 496333 - protein, 5 aa, Mycobacterium
GSGPT

SEQ ID NO: 496334 - protein, 7 aa, Mycobacterium
GSGPTEG

SEQ ID NO: 496335 - protein, 13 aa, Mycobacterium
GSGPTPFARGGDG

SEQ ID NO: 496336 - protein, 14 aa, Mycobacterium
GSGPTPFARGGDGL

SEQ ID NO: 496337 - protein, 16 aa, Mycobacterium
GSGQASGYLGRSDLTT

SEQ ID NO: 496338 - protein, 6 aa, Mycobacterium
GSGQGG

SEQ ID NO: 496339 - protein, 5 aa, Mycobacterium
GSGQL

SEQ ID NO: 496340 - protein, 8 aa, Mycobacterium
GSGQPAQR

SEQ ID NO: 496341 - protein, 10 aa, Mycobacterium
GSGQQAATVA

SEQ ID NO: 496342 - protein, 7 aa, Mycobacterium
GSGQQAV

SEQ ID NO: 496343 - protein, 20 aa, Mycobacterium
GSGQSRERMRRRGGGPGPAI

SEQ ID NO: 496344 - protein, 5 aa, Mycobacterium
GSGRA

SEQ ID NO: 496345 - protein, 6 aa, Mycobacterium
GSGRAD

SEQ ID NO: 496346 - protein, 17 aa, Mycobacterium
GSGRAGKRRVWTVHATR

SEQ ID NO: 496347 - protein, 11 aa, Mycobacterium
GSGRDGRAPAV

SEQ ID NO: 496348 - protein, 8 aa, Mycobacterium
GSGRDVSR

SEQ ID NO: 496349 - protein, 22 aa, Mycobacterium
GSGRERSRESQSREERKEATRR

SEQ ID NO: 496350 - protein, 8 aa, Mycobacterium
GSGRGGDD

SEQ ID NO: 496351 - protein, 12 aa, Mycobacterium
GSGRGGGSEKKG

SEQ ID NO: 496352 - protein, 18 aa, Mycobacterium
GSGRGTRSRWSHYLDDAL

SEQ ID NO: 496353 - protein, 22 aa, Mycobacterium
GSGRKALDQLEEEGASVDPAEL

SEQ ID NO: 496354 - protein, 10 aa, Mycobacterium
GSGRKDPTFA

SEQ ID NO: 496355 - protein, 34 aa, Mycobacterium
GSGRMRRAGGPSFHQPAAGQDSRTAMRRSSFVAR

SEQ ID NO: 496356 - protein, 7 aa, Mycobacterium
GSGRNKV

SEQ ID NO: 496357 - protein, 5 aa, Mycobacterium
GSGRP

SEQ ID NO: 496358 - protein, 8 aa, Mycobacterium
GSGRPEIV

SEQ ID NO: 496359 - protein, 8 aa, Mycobacterium
GSGRPERK

SEQ ID NO: 496360 - protein, 9 aa, Mycobacterium
GSGRPLPPA

SEQ ID NO: 496361 - protein, 14 aa, Mycobacterium
GSGRRLASTTKETL

SEQ ID NO: 496362 - protein, 9 aa, Mycobacterium
GSGRRLTGT

SEQ ID NO: 496363 - protein, 9 aa, Mycobacterium
GSGRRQGKL

SEQ ID NO: 496364 - protein, 8 aa, Mycobacterium
GSGRRRGK

SEQ ID NO: 496365 - protein, 9 aa, Mycobacterium
GSGRRSGKL

SEQ ID NO: 496366 - protein, 7 aa, Mycobacterium
GSGRRYA

SEQ ID NO: 496367 - protein, 6 aa, Mycobacterium
GSGRTA

SEQ ID NO: 496368 - protein, 8 aa, Mycobacterium
GSGRTADR

SEQ ID NO: 496369 - protein, 12 aa, Mycobacterium
GSGRTPFARGGD

SEQ ID NO: 496370 - protein, 14 aa, Mycobacterium
GSGRTPFARGGDGL

SEQ ID NO: 496371 - protein, 8 aa, Mycobacterium
GSGRVAEP

SEQ ID NO: 496372 - protein, 13 aa, Mycobacterium
GSGRVTSPEPEAT

SEQ ID NO: 496373 - protein, 6 aa, Mycobacterium
GSGSAQ

SEQ ID NO: 496374 - protein, 10 aa, Mycobacterium
GSGSARRDAY

SEQ ID NO: 496375 - protein, 9 aa, Mycobacterium
GSGSDQANA

SEQ ID NO: 496376 - protein, 9 aa, Mycobacterium
GSGSEAAAS

SEQ ID NO: 496377 - protein, 9 aa, Mycobacterium
GSGSEGAAL

SEQ ID NO: 496378 - protein, 10 aa, Mycobacterium
GSGSEKSEIE

SEQ ID NO: 496379 - protein, 13 aa, Mycobacterium
GSGSGAGPSPVRW

SEQ ID NO: 496380 - protein, 9 aa, Mycobacterium
GSGSGASAF

SEQ ID NO: 496381 - protein, 14 aa, Mycobacterium
GSGSGDARKIKTAA

SEQ ID NO: 496382 - protein, 7 aa, Mycobacterium
GSGSGKT

SEQ ID NO: 496383 - protein, 7 aa, Mycobacterium
GSGSGLR

SEQ ID NO: 496384 - protein, 7 aa, Mycobacterium
GSGSGSI

SEQ ID NO: 496385 - protein, 7 aa, Mycobacterium
GSGSHGK

SEQ ID NO: 496386 - protein, 11 aa, Mycobacterium
GSGSIEDEHRR

SEQ ID NO: 496387 - protein, 8 aa, Mycobacterium
GSGSLETE

SEQ ID NO: 496388 - protein, 12 aa, Mycobacterium
GSGSLKSEIEDS

SEQ ID NO: 496389 - protein, 11 aa, Mycobacterium
GSGSLKSEIEE

SEQ ID NO: 496390 - protein, 11 aa, Mycobacterium
GSGSNISPYPR

SEQ ID NO: 496391 - protein, 10 aa, Mycobacterium
GSGSNITPLP

SEQ ID NO: 496392 - protein, 11 aa, Mycobacterium
GSGSSDAGAWT

SEQ ID NO: 496393 - protein, 9 aa, Mycobacterium
GSGSSGVQN

SEQ ID NO: 496394 - protein, 14 aa, Mycobacterium
GSGSSNGSGTATAA

SEQ ID NO: 496395 - protein, 11 aa, Mycobacterium
GSGSSRHSPRN

SEQ ID NO: 496396 - protein, 6 aa, Mycobacterium
GSGSTA

SEQ ID NO: 496397 - protein, 7 aa, Mycobacterium
GSGSTAQ

SEQ ID NO: 496398 - protein, 7 aa, Mycobacterium
GSGSTGV

SEQ ID NO: 496399 - protein, 6 aa, Mycobacterium
GSGSTV

SEQ ID NO: 496400 - protein, 13 aa, Mycobacterium
GSGSVVRDPEGLT

SEQ ID NO: 496401 - protein, 5 aa, Mycobacterium
GSGTA

SEQ ID NO: 496402 - protein, 6 aa, Mycobacterium
GSGTED

SEQ ID NO: 496403 - protein, 11 aa, Mycobacterium
GSGTEDERNEC

SEQ ID NO: 496404 - protein, 8 aa, Mycobacterium
GSGTEVAD

SEQ ID NO: 496405 - protein, 26 aa, Mycobacterium
GSGTGEFAHSPDTDRPATEPGLGADD

SEQ ID NO: 496406 - protein, 13 aa, Mycobacterium
GSGTGGWSGRATR

SEQ ID NO: 496407 - protein, 8 aa, Mycobacterium
GSGTGHAE

SEQ ID NO: 496408 - protein, 8 aa, Mycobacterium
GSGTGKTS

SEQ ID NO: 496409 - protein, 16 aa, Mycobacterium
GSGTGTGGEAKWGGYA

SEQ ID NO: 496410 - protein, 9 aa, Mycobacterium
GSGTGTSTL

SEQ ID NO: 496411 - protein, 7 aa, Mycobacterium
GSGTHPV

SEQ ID NO: 496412 - protein, 23 aa, Mycobacterium
GSGTITTPTKTTQLGVLDAVQWG

SEQ ID NO: 496413 - protein, 5 aa, Mycobacterium
GSGTL

SEQ ID NO: 496414 - protein, 6 aa, Mycobacterium
GSGTLA

SEQ ID NO: 496415 - protein, 7 aa, Mycobacterium
GSGTLVP

SEQ ID NO: 496416 - protein, 8 aa, Mycobacterium
GSGTPALD

SEQ ID NO: 496417 - protein, 8 aa, Mycobacterium
GSGTPIPS

SEQ ID NO: 496418 - protein, 19 aa, Mycobacterium
GSGTRRGDAAGRRAKQDER

SEQ ID NO: 496419 - protein, 7 aa, Mycobacterium
GSGTSLG

SEQ ID NO: 496420 - protein, 15 aa, Mycobacterium
GSGTSLHRKQSRGNS

SEQ ID NO: 496421 - protein, 7 aa, Mycobacterium
GSGTSNA

SEQ ID NO: 496422 - protein, 8 aa, Mycobacterium
GSGTSSGF

SEQ ID NO: 496423 - protein, 6 aa, Mycobacterium
GSGTST

SEQ ID NO: 496424 - protein, 15 aa, Mycobacterium
GSGTTKDPGPWEGEQ

SEQ ID NO: 496425 - protein, 5 aa, Mycobacterium
GSGTV

SEQ ID NO: 496426 - protein, 13 aa, Mycobacterium
GSGTVHASAQAEY

SEQ ID NO: 496427 - protein, 6 aa, Mycobacterium
GSGTVP

SEQ ID NO: 496428 - protein, 7 aa, Mycobacterium
GSGTYAE

SEQ ID NO: 496429 - protein, 11 aa, Mycobacterium
GSGVAASGYGL

SEQ ID NO: 496430 - protein, 6 aa, Mycobacterium
GSGVDG

SEQ ID NO: 496431 - protein, 21 aa, Mycobacterium
GSGVGGGGGNGCGRDWVGGGC

SEQ ID NO: 496432 - protein, 7 aa, Mycobacterium
GSGVGRG

SEQ ID NO: 496433 - protein, 11 aa, Mycobacterium
GSGVGSQGPDH

SEQ ID NO: 496434 - protein, 9 aa, Mycobacterium
GSGVISRNQ

SEQ ID NO: 496435 - protein, 6 aa, Mycobacterium
GSGVKG

SEQ ID NO: 496436 - protein, 9 aa, Mycobacterium
GSGVQPPVA

SEQ ID NO: 496437 - protein, 5 aa, Mycobacterium
GSGVS

SEQ ID NO: 496438 - protein, 5 aa, Mycobacterium
GSGVT

SEQ ID NO: 496439 - protein, 6 aa, Mycobacterium
GSGVTD

SEQ ID NO: 496440 - protein, 9 aa, Mycobacterium
GSGVTGQDI

SEQ ID NO: 496441 - protein, 5 aa, Mycobacterium
GSGWS

SEQ ID NO: 496442 - protein, 18 aa, Mycobacterium
GSGWSSAPRTSYRKDEMA

SEQ ID NO: 496443 - protein, 5 aa, Mycobacterium
GSGYG

SEQ ID NO: 496444 - protein, 9 aa, Mycobacterium
GSGYPRGLA

SEQ ID NO: 496445 - protein, 9 aa, Mycobacterium
GSGYPRGLP

SEQ ID NO: 496446 - protein, 10 aa, Mycobacterium
GSGYQNYGGL

SEQ ID NO: 496447 - protein, 5 aa, Mycobacterium
GSHAE

SEQ ID NO: 496448 - protein, 8 aa, Mycobacterium
GSHCSART

SEQ ID NO: 496449 - protein, 4 aa, Mycobacterium
GSHD

SEQ ID NO: 496450 - protein, 5 aa, Mycobacterium
GSHDD

SEQ ID NO: 496451 - protein, 8 aa, Mycobacterium
GSHEDPGI

SEQ ID NO: 496452 - protein, 6 aa, Mycobacterium
GSHEVS

SEQ ID NO: 496453 - protein, 5 aa, Mycobacterium
GSHGA

SEQ ID NO: 496454 - protein, 6 aa, Mycobacterium
GSHGGD

SEQ ID NO: 496455 - protein, 8 aa, Mycobacterium
GSHGGRIE

SEQ ID NO: 496456 - protein, 8 aa, Mycobacterium
GSHGTSPI

SEQ ID NO: 496457 - protein, 9 aa, Mycobacterium
GSHHSEDRR

SEQ ID NO: 496458 - protein, 4 aa, Mycobacterium
GSHL

SEQ ID NO: 496459 - protein, 4 aa, Mycobacterium
GSHM

SEQ ID NO: 496460 - protein, 5 aa, Mycobacterium
GSHMH

SEQ ID NO: 496461 - protein, 17 aa, Mycobacterium
GSHNTGFGNGSDSNFGF

SEQ ID NO: 496462 - protein, 16 aa, Mycobacterium
GSHNTGIGNSGDTNTG

SEQ ID NO: 496463 - protein, 6 aa, Mycobacterium
GSHPAQ

SEQ ID NO: 496464 - protein, 9 aa, Mycobacterium
GSHPDAAEV

SEQ ID NO: 496465 - protein, 6 aa, Mycobacterium
GSHPEA

SEQ ID NO: 496466 - protein, 6 aa, Mycobacterium
GSHPEK

SEQ ID NO: 496467 - protein, 6 aa, Mycobacterium
GSHPRF

SEQ ID NO: 496468 - protein, 7 aa, Mycobacterium
GSHPRTD

SEQ ID NO: 496469 - protein, 5 aa, Mycobacterium
GSHPS

SEQ ID NO: 496470 - protein, 12 aa, Mycobacterium
GSHPVTTDGGTM

SEQ ID NO: 496471 - protein, 7 aa, Mycobacterium
GSHQDGD

SEQ ID NO: 496472 - protein, 17 aa, Mycobacterium
GSHQSALDKARRPDHPT

SEQ ID NO: 496473 - protein, 7 aa, Mycobacterium
GSHRGTV

SEQ ID NO: 496474 - protein, 4 aa, Mycobacterium
GSHS

SEQ ID NO: 496475 - protein, 5 aa, Mycobacterium
GSHSG

SEQ ID NO: 496476 - protein, 8 aa, Mycobacterium
GSHTGPVE

SEQ ID NO: 496477 - protein, 8 aa, Mycobacterium
GSHTGRAR

SEQ ID NO: 496478 - protein, 6 aa, Mycobacterium
GSIAAT

SEQ ID NO: 496479 - protein, 10 aa, Mycobacterium
GSIADGKKEI

SEQ ID NO: 496480 - protein, 10 aa, Mycobacterium
GSIAGNEDAE

SEQ ID NO: 496481 - protein, 8 aa, Mycobacterium
GSIAHGEN

SEQ ID NO: 496482 - protein, 8 aa, Mycobacterium
GSIAPTDR

SEQ ID NO: 496483 - protein, 15 aa, Mycobacterium
GSIATATERADGTME

SEQ ID NO: 496484 - protein, 24 aa, Mycobacterium
GSIATDSPDCGAARRPTTVSAGSP

SEQ ID NO: 496485 - protein, 9 aa, Mycobacterium
GSIDKAENS

SEQ ID NO: 496486 - protein, 6 aa, Mycobacterium
GSIESR

SEQ ID NO: 496487 - protein, 8 aa, Mycobacterium
GSIGDAEA

SEQ ID NO: 496488 - protein, 6 aa, Mycobacterium
GSIGGA

SEQ ID NO: 496489 - protein, 7 aa, Mycobacterium
GSIGPAN

SEQ ID NO: 496490 - protein, 9 aa, Mycobacterium
GSIGPDGIG

SEQ ID NO: 496491 - protein, 11 aa, Mycobacterium
GSIGPGGNAKR

SEQ ID NO: 496492 - protein, 16 aa, Mycobacterium
GSIGPSSTAPDGKAWG

SEQ ID NO: 496493 - protein, 5 aa, Mycobacterium
GSIGS

SEQ ID NO: 496494 - protein, 5 aa, Mycobacterium
GSIGT

SEQ ID NO: 496495 - protein, 14 aa, Mycobacterium
GSIKPGDPTSKRTV

SEQ ID NO: 496496 - protein, 16 aa, Mycobacterium
GSIKSGITDATGGYIP

SEQ ID NO: 496497 - protein, 17 aa, Mycobacterium
GSIKSGITDATGGYIPK

SEQ ID NO: 496498 - protein, 18 aa, Mycobacterium
GSIKSGITDATGGYLPQD

SEQ ID NO: 496499 - protein, 5 aa, Mycobacterium
GSIPA

SEQ ID NO: 496500 - protein, 6 aa, Mycobacterium
GSIPAT

SEQ ID NO: 496501 - protein, 8 aa, Mycobacterium
GSIPDGGR

SEQ ID NO: 496502 - protein, 11 aa, Mycobacterium
GSIPEGETPRW

SEQ ID NO: 496503 - protein, 21 aa, Mycobacterium
GSIPKTPSGKLRRANSVSLVT

SEQ ID NO: 496504 - protein, 20 aa, Mycobacterium
GSIPKTPSGKLRRSTSVALV

SEQ ID NO: 496505 - protein, 20 aa, Mycobacterium
GSIPKTSSGKLRRSNSVSLV

SEQ ID NO: 496506 - protein, 7 aa, Mycobacterium
GSIPPLT

SEQ ID NO: 496507 - protein, 9 aa, Mycobacterium
GSIPSGPSA

SEQ ID NO: 496508 - protein, 12 aa, Mycobacterium
GSIPTTTSGKIR

SEQ ID NO: 496509 - protein, 12 aa, Mycobacterium
GSIPTTTSGKVR

SEQ ID NO: 496510 - protein, 5 aa, Mycobacterium
GSIPV

SEQ ID NO: 496511 - protein, 11 aa, Mycobacterium
GSIRTGRANPG

SEQ ID NO: 496512 - protein, 8 aa, Mycobacterium
GSISGPLR

SEQ ID NO: 496513 - protein, 7 aa, Mycobacterium
GSISTDD

SEQ ID NO: 496514 - protein, 6 aa, Mycobacterium
GSITAA

SEQ ID NO: 496515 - protein, 4 aa, Mycobacterium
GSIV

SEQ ID NO: 496516 - protein, 6 aa, Mycobacterium
GSIYEK

SEQ ID NO: 496517 - protein, 6 aa, Mycobacterium
GSKAAL

SEQ ID NO: 496518 - protein, 8 aa, Mycobacterium
GSKAATQA

SEQ ID NO: 496519 - protein, 23 aa, Mycobacterium
GSKAENGKAEQEQPKSRPSQRRR

SEQ ID NO: 496520 - protein, 15 aa, Mycobacterium
GSKAHVGSMRTSDVD

SEQ ID NO: 496521 - protein, 9 aa, Mycobacterium
GSKANDYRE

SEQ ID NO: 496522 - protein, 10 aa, Mycobacterium
GSKAPPQEQI

SEQ ID NO: 496523 - protein, 8 aa, Mycobacterium
GSKAVATR

SEQ ID NO: 496524 - protein, 5 aa, Mycobacterium
GSKDN

SEQ ID NO: 496525 - protein, 7 aa, Mycobacterium
GSKDQLD

SEQ ID NO: 496526 - protein, 6 aa, Mycobacterium
GSKEHA

SEQ ID NO: 496527 - protein, 6 aa, Mycobacterium
GSKEQV

SEQ ID NO: 496528 - protein, 10 aa, Mycobacterium
GSKESRIAET

SEQ ID NO: 496529 - protein, 20 aa, Mycobacterium
GSKGGSDALGSILGGLLGGK

SEQ ID NO: 496530 - protein, 8 aa, Mycobacterium
GSKHAEYK

SEQ ID NO: 496531 - protein, 8 aa, Mycobacterium
GSKIAPGN

SEQ ID NO: 496532 - protein, 7 aa, Mycobacterium
GSKIESK

SEQ ID NO: 496533 - protein, 6 aa, Mycobacterium
GSKIGK

SEQ ID NO: 496534 - protein, 13 aa, Mycobacterium
GSKLADLEGEKTY

SEQ ID NO: 496535 - protein, 15 aa, Mycobacterium
GSKLAELQGEKSYAQ

SEQ ID NO: 496536 - protein, 13 aa, Mycobacterium
GSKLAKKPKQAKR

SEQ ID NO: 496537 - protein, 5 aa, Mycobacterium
GSKLL

SEQ ID NO: 496538 - protein, 9 aa, Mycobacterium
GSKLPDAAY

SEQ ID NO: 496539 - protein, 10 aa, Mycobacterium
GSKLPGRPTM

SEQ ID NO: 496540 - protein, 10 aa, Mycobacterium
GSKLSKDPGA

SEQ ID NO: 496541 - protein, 14 aa, Mycobacterium
GSKPASDQANDQAQ

SEQ ID NO: 496542 - protein, 6 aa, Mycobacterium
GSKPAW

SEQ ID NO: 496543 - protein, 13 aa, Mycobacterium
GSKPTEHKPRRGI

SEQ ID NO: 496544 - protein, 8 aa, Mycobacterium
GSKQRRSA

SEQ ID NO: 496545 - protein, 4 aa, Mycobacterium
GSKR

SEQ ID NO: 496546 - protein, 7 aa, Mycobacterium
GSKRKTV

SEQ ID NO: 496547 - protein, 9 aa, Mycobacterium
GSKRSTERM

SEQ ID NO: 496548 - protein, 9 aa, Mycobacterium
GSKSGAAQS

SEQ ID NO: 496549 - protein, 7 aa, Mycobacterium
GSKSTVA

SEQ ID NO: 496550 - protein, 7 aa, Mycobacterium
GSKTGAE

SEQ ID NO: 496551 - protein, 5 aa, Mycobacterium
GSKTP

SEQ ID NO: 496552 - protein, 10 aa, Mycobacterium
GSKTPGHPEF

SEQ ID NO: 496553 - protein, 6 aa, Mycobacterium
GSKTSL

SEQ ID NO: 496554 - protein, 15 aa, Mycobacterium
GSKVARAAYSPVIVV

SEQ ID NO: 496555 - protein, 12 aa, Mycobacterium
GSKVGSSSLPEG

SEQ ID NO: 496556 - protein, 5 aa, Mycobacterium
GSLAA

SEQ ID NO: 496557 - protein, 11 aa, Mycobacterium
GSLAAGPAMSA

SEQ ID NO: 496558 - protein, 11 aa, Mycobacterium
GSLAASGEATT

SEQ ID NO: 496559 - protein, 11 aa, Mycobacterium
GSLAEKESQKA

SEQ ID NO: 496560 - protein, 11 aa, Mycobacterium
GSLAEPGSGVE

SEQ ID NO: 496561 - protein, 9 aa, Mycobacterium
GSLAEPGVG

SEQ ID NO: 496562 - protein, 6 aa, Mycobacterium
GSLAGE

SEQ ID NO: 496563 - protein, 9 aa, Mycobacterium
GSLAGPRRR

SEQ ID NO: 496564 - protein, 6 aa, Mycobacterium
GSLAGT

SEQ ID NO: 496565 - protein, 24 aa, Mycobacterium
GSLAHPPTRPPPAVPPCPGPTGER

SEQ ID NO: 496566 - protein, 8 aa, Mycobacterium
GSLANTAG

SEQ ID NO: 496567 - protein, 13 aa, Mycobacterium
GSLAPADGSAVPA

SEQ ID NO: 496568 - protein, 10 aa, Mycobacterium
GSLAPRTDRR

SEQ ID NO: 496569 - protein, 14 aa, Mycobacterium
GSLAPSDGSPVPED

SEQ ID NO: 496570 - protein, 28 aa, Mycobacterium
GSLAPSQTNRRTAAVTPQPGGGNPLRGD

SEQ ID NO: 496571 - protein, 6 aa, Mycobacterium
GSLAPT

SEQ ID NO: 496572 - protein, 14 aa, Mycobacterium
GSLAPTDGSDVPAD

SEQ ID NO: 496573 - protein, 13 aa, Mycobacterium
GSLAPTDGTPIPA

SEQ ID NO: 496574 - protein, 11 aa, Mycobacterium
GSLAQPGSGVE

SEQ ID NO: 496575 - protein, 17 aa, Mycobacterium
GSLAQPGVGVDTGQARP

SEQ ID NO: 496576 - protein, 6 aa, Mycobacterium
GSLASA

SEQ ID NO: 496577 - protein, 9 aa, Mycobacterium
GSLASQSAL

SEQ ID NO: 496578 - protein, 8 aa, Mycobacterium
GSLATPVP

SEQ ID NO: 496579 - protein, 4 aa, Mycobacterium
GSLD

SEQ ID NO: 496580 - protein, 7 aa, Mycobacterium
GSLDDGG

SEQ ID NO: 496581 - protein, 6 aa, Mycobacterium
GSLDEA

SEQ ID NO: 496582 - protein, 8 aa, Mycobacterium
GSLDPQQL

SEQ ID NO: 496583 - protein, 6 aa, Mycobacterium
GSLDPS

SEQ ID NO: 496584 - protein, 8 aa, Mycobacterium
GSLDQEDE

SEQ ID NO: 496585 - protein, 5 aa, Mycobacterium
GSLED

SEQ ID NO: 496586 - protein, 5 aa, Mycobacterium
GSLEG

SEQ ID NO: 496587 - protein, 7 aa, Mycobacterium
GSLEPGK

SEQ ID NO: 496588 - protein, 8 aa, Mycobacterium
GSLESNSP

SEQ ID NO: 496589 - protein, 7 aa, Mycobacterium
GSLGAEV

SEQ ID NO: 496590 - protein, 13 aa, Mycobacterium
GSLGDIAASAAPL

SEQ ID NO: 496591 - protein, 13 aa, Mycobacterium
GSLGGGTATFGMP

SEQ ID NO: 496592 - protein, 7 aa, Mycobacterium
GSLGGTV

SEQ ID NO: 496593 - protein, 9 aa, Mycobacterium
GSLGHPAGY

SEQ ID NO: 496594 - protein, 21 aa, Mycobacterium
GSLGNAGGAVTAGAGQAAQVG

SEQ ID NO: 496595 - protein, 11 aa, Mycobacterium
GSLGQDSGFGR

SEQ ID NO: 496596 - protein, 8 aa, Mycobacterium
GSLGQRTG

SEQ ID NO: 496597 - protein, 14 aa, Mycobacterium
GSLGQTRETINSPE

SEQ ID NO: 496598 - protein, 11 aa, Mycobacterium
GSLGSERADAA

SEQ ID NO: 496599 - protein, 6 aa, Mycobacterium
GSLGSG

SEQ ID NO: 496600 - protein, 14 aa, Mycobacterium
GSLGSGSPEPATDL

SEQ ID NO: 496601 - protein, 4 aa, Mycobacterium
GSLK

SEQ ID NO: 496602 - protein, 11 aa, Mycobacterium
GSLKPPSAELR

SEQ ID NO: 496603 - protein, 4 aa, Mycobacterium
GSLN

SEQ ID NO: 496604 - protein, 5 aa, Mycobacterium
GSLNG

SEQ ID NO: 496605 - protein, 28 aa, Mycobacterium
GSLNSSPAQASNQASKPAPPAPPPRATV

SEQ ID NO: 496606 - protein, 56 aa, Mycobacterium
GSLNTGLSNAGSTNTGNLNTGGLNTGDFNTGSGNTGYYNNGNLNTGAFNSGNRNNG

SEQ ID NO: 496607 - protein, 15 aa, Mycobacterium
GSLPKTERADAGKRV

SEQ ID NO: 496608 - protein, 19 aa, Mycobacterium
GSLPKTTSGKLRREGARAL

SEQ ID NO: 496609 - protein, 8 aa, Mycobacterium
GSLPMPQS

SEQ ID NO: 496610 - protein, 7 aa, Mycobacterium
GSLPPGR

SEQ ID NO: 496611 - protein, 8 aa, Mycobacterium
GSLPPGVD

SEQ ID NO: 496612 - protein, 9 aa, Mycobacterium
GSLPPGVPA

SEQ ID NO: 496613 - protein, 9 aa, Mycobacterium
GSLPPGVPP

SEQ ID NO: 496614 - protein, 8 aa, Mycobacterium
GSLPRQPG

SEQ ID NO: 496615 - protein, 10 aa, Mycobacterium
GSLPRTSSGK

SEQ ID NO: 496616 - protein, 11 aa, Mycobacterium
GSLPRTSSGKL

SEQ ID NO: 496617 - protein, 14 aa, Mycobacterium
GSLPSSGEADSSFA

SEQ ID NO: 496618 - protein, 6 aa, Mycobacterium
GSLPSY

SEQ ID NO: 496619 - protein, 12 aa, Mycobacterium
GSLPTTTSGKIR

SEQ ID NO: 496620 - protein, 18 aa, Mycobacterium
GSLQSDKPEIVEAVAALN

SEQ ID NO: 496621 - protein, 8 aa, Mycobacterium
GSLRGPGG

SEQ ID NO: 496622 - protein, 11 aa, Mycobacterium
GSLRKEGRERI

SEQ ID NO: 496623 - protein, 5 aa, Mycobacterium
GSLRP

SEQ ID NO: 496624 - protein, 18 aa, Mycobacterium
GSLSANRGGVTGRGDVAA

SEQ ID NO: 496625 - protein, 13 aa, Mycobacterium
GSLSAQDQSKAAH

SEQ ID NO: 496626 - protein, 9 aa, Mycobacterium
GSLSATEVA

SEQ ID NO: 496627 - protein, 15 aa, Mycobacterium
GSLSGEHGDGQSRGE

SEQ ID NO: 496628 - protein, 9 aa, Mycobacterium
GSLSGGERQ

SEQ ID NO: 496629 - protein, 16 aa, Mycobacterium
GSLSGIGAAGQDAANE

SEQ ID NO: 496630 - protein, 9 aa, Mycobacterium
GSLSGLPPT

SEQ ID NO: 496631 - protein, 14 aa, Mycobacterium
GSLSGQPARLDDEK

SEQ ID NO: 496632 - protein, 10 aa, Mycobacterium
GSLSQEPAPA

SEQ ID NO: 496633 - protein, 9 aa, Mycobacterium
GSLTEPGVG

SEQ ID NO: 496634 - protein, 7 aa, Mycobacterium
GSLTERQ

SEQ ID NO: 496635 - protein, 8 aa, Mycobacterium
GSLTGDQA

SEQ ID NO: 496636 - protein, 5 aa, Mycobacterium
GSLTT

SEQ ID NO: 496637 - protein, 6 aa, Mycobacterium
GSLTTQ

SEQ ID NO: 496638 - protein, 36 aa, Mycobacterium
GSLYPAPAPRFSRSVPSAPKAPGVPGADTEAVLQEW

SEQ ID NO: 496639 - protein, 15 aa, Mycobacterium
GSMAAAKAAGKVRME

SEQ ID NO: 496640 - protein, 7 aa, Mycobacterium
GSMAARD

SEQ ID NO: 496641 - protein, 7 aa, Mycobacterium
GSMATTG

SEQ ID NO: 496642 - protein, 44 aa, Mycobacterium
GSMGPPAGPVPPPAATVPAGALGAGSNAPSAAPPAAAAGAGPTL

SEQ ID NO: 496643 - protein, 5 aa, Mycobacterium
GSMGR

SEQ ID NO: 496644 - protein, 7 aa, Mycobacterium
GSMGSQV

SEQ ID NO: 496645 - protein, 5 aa, Mycobacterium
GSMGT

SEQ ID NO: 496646 - protein, 5 aa, Mycobacterium
GSMGY

SEQ ID NO: 496647 - protein, 5 aa, Mycobacterium
GSMNE

SEQ ID NO: 496648 - protein, 8 aa, Mycobacterium
GSMNEPGL

SEQ ID NO: 496649 - protein, 9 aa, Mycobacterium
GSMNEPGLA

SEQ ID NO: 496650 - protein, 6 aa, Mycobacterium
GSMPEE

SEQ ID NO: 496651 - protein, 5 aa, Mycobacterium
GSMPM

SEQ ID NO: 496652 - protein, 7 aa, Mycobacterium
GSMPQDR

SEQ ID NO: 496653 - protein, 16 aa, Mycobacterium
GSMPTTSSAHPAARRS

SEQ ID NO: 496654 - protein, 7 aa, Mycobacterium
GSMRTQQ

SEQ ID NO: 496655 - protein, 17 aa, Mycobacterium
GSMSASAAGSAPVAATH

SEQ ID NO: 496656 - protein, 13 aa, Mycobacterium
GSMSSKTNGEDRI

SEQ ID NO: 496657 - protein, 12 aa, Mycobacterium
GSMSSNALREGE

SEQ ID NO: 496658 - protein, 11 aa, Mycobacterium
GSMSSNSNGEG

SEQ ID NO: 496659 - protein, 8 aa, Mycobacterium
GSMTAGPN

SEQ ID NO: 496660 - protein, 12 aa, Mycobacterium
GSMTPGVLKACG

SEQ ID NO: 496661 - protein, 4 aa, Mycobacterium
GSNA

SEQ ID NO: 496662 - protein, 10 aa, Mycobacterium
GSNARSMADG

SEQ ID NO: 496663 - protein, 29 aa, Mycobacterium
GSNASGTATGGDGGNGGTLGATNGTGGAA

SEQ ID NO: 496664 - protein, 5 aa, Mycobacterium
GSNDL

SEQ ID NO: 496665 - protein, 7 aa, Mycobacterium
GSNDRQV

SEQ ID NO: 496666 - protein, 8 aa, Mycobacterium
GSNDVERD

SEQ ID NO: 496667 - protein, 8 aa, Mycobacterium
GSNGQNNV

SEQ ID NO: 496668 - protein, 9 aa, Mycobacterium
GSNGSGKST

SEQ ID NO: 496669 - protein, 12 aa, Mycobacterium
GSNKAGKDAGAL

SEQ ID NO: 496670 - protein, 5 aa, Mycobacterium
GSNLS

SEQ ID NO: 496671 - protein, 12 aa, Mycobacterium
GSNLTEGKEFAP

SEQ ID NO: 496672 - protein, 4 aa, Mycobacterium
GSNM

SEQ ID NO: 496673 - protein, 4 aa, Mycobacterium
GSNN

SEQ ID NO: 496674 - protein, 8 aa, Mycobacterium
GSNPAEAL

SEQ ID NO: 496675 - protein, 5 aa, Mycobacterium
GSNPG

SEQ ID NO: 496676 - protein, 6 aa, Mycobacterium
GSNPGE

SEQ ID NO: 496677 - protein, 6 aa, Mycobacterium
GSNQIG

SEQ ID NO: 496678 - protein, 4 aa, Mycobacterium
GSNR

SEQ ID NO: 496679 - protein, 10 aa, Mycobacterium
GSNRASAELR

SEQ ID NO: 496680 - protein, 8 aa, Mycobacterium
GSNRYGTR

SEQ ID NO: 496681 - protein, 9 aa, Mycobacterium
GSNSAGNNA

SEQ ID NO: 496682 - protein, 4 aa, Mycobacterium
GSNT

SEQ ID NO: 496683 - protein, 9 aa, Mycobacterium
GSNTGLGYE

SEQ ID NO: 496684 - protein, 5 aa, Mycobacterium
GSNVS

SEQ ID NO: 496685 - protein, 7 aa, Mycobacterium
GSNYSKS

SEQ ID NO: 496686 - protein, 6 aa, Mycobacterium
GSPAAA

SEQ ID NO: 496687 - protein, 9 aa, Mycobacterium
GSPAADLSS

SEQ ID NO: 496688 - protein, 9 aa, Mycobacterium
GSPAAEAAT

SEQ ID NO: 496689 - protein, 14 aa, Mycobacterium
GSPAAQRRRLSQRY

SEQ ID NO: 496690 - protein, 5 aa, Mycobacterium
GSPAE

SEQ ID NO: 496691 - protein, 6 aa, Mycobacterium
GSPAEL

SEQ ID NO: 496692 - protein, 6 aa, Mycobacterium
GSPAEP

SEQ ID NO: 496693 - protein, 6 aa, Mycobacterium
GSPAKV

SEQ ID NO: 496694 - protein, 15 aa, Mycobacterium
GSPALPKPAQSPHPP

SEQ ID NO: 496695 - protein, 5 aa, Mycobacterium
GSPAM

SEQ ID NO: 496696 - protein, 5 aa, Mycobacterium
GSPAN

SEQ ID NO: 496697 - protein, 10 aa, Mycobacterium
GSPARGAGLE

SEQ ID NO: 496698 - protein, 9 aa, Mycobacterium
GSPASEAAT

SEQ ID NO: 496699 - protein, 9 aa, Mycobacterium
GSPASENAT

SEQ ID NO: 496700 - protein, 9 aa, Mycobacterium
GSPASEVAT

SEQ ID NO: 496701 - protein, 8 aa, Mycobacterium
GSPASNAA

SEQ ID NO: 496702 - protein, 10 aa, Mycobacterium
GSPASVLGPQ

SEQ ID NO: 496703 - protein, 9 aa, Mycobacterium
GSPASWNSA

SEQ ID NO: 496704 - protein, 9 aa, Mycobacterium
GSPASWSGA

SEQ ID NO: 496705 - protein, 9 aa, Mycobacterium
GSPASWSSA

SEQ ID NO: 496706 - protein, 6 aa, Mycobacterium
GSPASY

SEQ ID NO: 496707 - protein, 14 aa, Mycobacterium
GSPAYGELRAMLSE

SEQ ID NO: 496708 - protein, 7 aa, Mycobacterium
GSPAYSV

SEQ ID NO: 496709 - protein, 8 aa, Mycobacterium
GSPAYTAP

SEQ ID NO: 496710 - protein, 6 aa, Mycobacterium
GSPDAD

SEQ ID NO: 496711 - protein, 15 aa, Mycobacterium
GSPDCPAAQRPPGTN

SEQ ID NO: 496712 - protein, 10 aa, Mycobacterium
GSPDDSGARA

SEQ ID NO: 496713 - protein, 9 aa, Mycobacterium
GSPDHRDSV

SEQ ID NO: 496714 - protein, 7 aa, Mycobacterium
GSPDHRQ

SEQ ID NO: 496715 - protein, 5 aa, Mycobacterium
GSPDI

SEQ ID NO: 496716 - protein, 6 aa, Mycobacterium
GSPDLD

SEQ ID NO: 496717 - protein, 7 aa, Mycobacterium
GSPDPQL

SEQ ID NO: 496718 - protein, 8 aa, Mycobacterium
GSPDRKHQ

SEQ ID NO: 496719 - protein, 7 aa, Mycobacterium
GSPDTMR

SEQ ID NO: 496720 - protein, 6 aa, Mycobacterium
GSPDTV

SEQ ID NO: 496721 - protein, 5 aa, Mycobacterium
GSPDW

SEQ ID NO: 496722 - protein, 6 aa, Mycobacterium
GSPEAD

SEQ ID NO: 496723 - protein, 9 aa, Mycobacterium
GSPEEAAEQ

SEQ ID NO: 496724 - protein, 20 aa, Mycobacterium
GSPEEREAARSQSDGSDAAG

SEQ ID NO: 496725 - protein, 13 aa, Mycobacterium
GSPEHTASRHAET

SEQ ID NO: 496726 - protein, 5 aa, Mycobacterium
GSPEL

SEQ ID NO: 496727 - protein, 15 aa, Mycobacterium
GSPEPDDDPADNGMS

SEQ ID NO: 496728 - protein, 6 aa, Mycobacterium
GSPEQK

SEQ ID NO: 496729 - protein, 7 aa, Mycobacterium
GSPEQTA

SEQ ID NO: 496730 - protein, 14 aa, Mycobacterium
GSPESAAPITDGRH

SEQ ID NO: 496731 - protein, 7 aa, Mycobacterium
GSPESQQ

SEQ ID NO: 496732 - protein, 13 aa, Mycobacterium
GSPETFRTAGERG

SEQ ID NO: 496733 - protein, 6 aa, Mycobacterium
GSPETH

SEQ ID NO: 496734 - protein, 7 aa, Mycobacterium
GSPETRL

SEQ ID NO: 496735 - protein, 4 aa, Mycobacterium
GSPF

SEQ ID NO: 496736 - protein, 7 aa, Mycobacterium
GSPFAPL

SEQ ID NO: 496737 - protein, 12 aa, Mycobacterium
GSPFPNDGVDPQ

SEQ ID NO: 496738 - protein, 6 aa, Mycobacterium
GSPGAD

SEQ ID NO: 496739 - protein, 13 aa, Mycobacterium
GSPGADAAAEKAR

SEQ ID NO: 496740 - protein, 10 aa, Mycobacterium
GSPGAPGELD

SEQ ID NO: 496741 - protein, 7 aa, Mycobacterium
GSPGAVD

SEQ ID NO: 496742 - protein, 16 aa, Mycobacterium
GSPGFRGDPAGPPLSI

SEQ ID NO: 496743 - protein, 28 aa, Mycobacterium
GSPGGAAKVGKTDYDPPSVKELPPMGEG

SEQ ID NO: 496744 - protein, 28 aa, Mycobacterium
GSPGGAAKVGLTENDPAPVKNLESRAEA

SEQ ID NO: 496745 - protein, 28 aa, Mycobacterium
GSPGGAAKVGLTENDPQVVKDLPPQGEG

SEQ ID NO: 496746 - protein, 17 aa, Mycobacterium
GSPGGAAKVGMTENDPQ

SEQ ID NO: 496747 - protein, 8 aa, Mycobacterium
GSPGGAPD

SEQ ID NO: 496748 - protein, 17 aa, Mycobacterium
GSPGGASKIGMTENDPA

SEQ ID NO: 496749 - protein, 28 aa, Mycobacterium
GSPGGASKVGLTENDPAAVKALESRAEA

SEQ ID NO: 496750 - protein, 27 aa, Mycobacterium
GSPGGASKVGQTDNDPQAIKDLPPQGE

SEQ ID NO: 496751 - protein, 27 aa, Mycobacterium
GSPGGASKVGQTDNDPQAVKDLPPQGE

SEQ ID NO: 496752 - protein, 7 aa, Mycobacterium
GSPGGST

SEQ ID NO: 496753 - protein, 7 aa, Mycobacterium
GSPGHPD

SEQ ID NO: 496754 - protein, 12 aa, Mycobacterium
GSPGPNRQPRAA

SEQ ID NO: 496755 - protein, 10 aa, Mycobacterium
GSPGQGAYAA

SEQ ID NO: 496756 - protein, 10 aa, Mycobacterium
GSPGRAPEFD

SEQ ID NO: 496757 - protein, 6 aa, Mycobacterium
GSPGRL

SEQ ID NO: 496758 - protein, 8 aa, Mycobacterium
GSPGSGGL

SEQ ID NO: 496759 - protein, 9 aa, Mycobacterium
GSPGSLTTA

SEQ ID NO: 496760 - protein, 10 aa, Mycobacterium
GSPGSSERVY

SEQ ID NO: 496761 - protein, 10 aa, Mycobacterium
GSPGTELTNA

SEQ ID NO: 496762 - protein, 8 aa, Mycobacterium
GSPGTGRH

SEQ ID NO: 496763 - protein, 17 aa, Mycobacterium
GSPGYRRAAAAAGASVA

SEQ ID NO: 496764 - protein, 4 aa, Mycobacterium
GSPH

SEQ ID NO: 496765 - protein, 6 aa, Mycobacterium
GSPHGG

SEQ ID NO: 496766 - protein, 6 aa, Mycobacterium
GSPIGN

SEQ ID NO: 496767 - protein, 20 aa, Mycobacterium
GSPIGRTRDAMPGTPPDRPV

SEQ ID NO: 496768 - protein, 14 aa, Mycobacterium
GSPIPDPNRAGPAT

SEQ ID NO: 496769 - protein, 7 aa, Mycobacterium
GSPIREP

SEQ ID NO: 496770 - protein, 18 aa, Mycobacterium
GSPITDTDTALPMVELRL

SEQ ID NO: 496771 - protein, 6 aa, Mycobacterium
GSPITI

SEQ ID NO: 496772 - protein, 12 aa, Mycobacterium
GSPKFAESQSLP

SEQ ID NO: 496773 - protein, 13 aa, Mycobacterium
GSPKQARKHADAG

SEQ ID NO: 496774 - protein, 9 aa, Mycobacterium
GSPLAGDSL

SEQ ID NO: 496775 - protein, 6 aa, Mycobacterium
GSPLET

SEQ ID NO: 496776 - protein, 6 aa, Mycobacterium
GSPLPE

SEQ ID NO: 496777 - protein, 5 aa, Mycobacterium
GSPLQ

SEQ ID NO: 496778 - protein, 5 aa, Mycobacterium
GSPLR

SEQ ID NO: 496779 - protein, 20 aa, Mycobacterium
GSPMGRTRDAAPGAAPDRPV

SEQ ID NO: 496780 - protein, 20 aa, Mycobacterium
GSPMGRTRDAAPGAAVDRPV

SEQ ID NO: 496781 - protein, 21 aa, Mycobacterium
GSPMGRTRDAAPGAPADRPVP

SEQ ID NO: 496782 - protein, 14 aa, Mycobacterium
GSPNCTASGPSTSP

SEQ ID NO: 496783 - protein, 6 aa, Mycobacterium
GSPNGL

SEQ ID NO: 496784 - protein, 7 aa, Mycobacterium
GSPNITQ

SEQ ID NO: 496785 - protein, 7 aa, Mycobacterium
GSPNPGY

SEQ ID NO: 496786 - protein, 7 aa, Mycobacterium
GSPNTAN

SEQ ID NO: 496787 - protein, 5 aa, Mycobacterium
GSPPA

SEQ ID NO: 496788 - protein, 7 aa, Mycobacterium
GSPPAAE

SEQ ID NO: 496789 - protein, 9 aa, Mycobacterium
GSPPAGDLP

SEQ ID NO: 496790 - protein, 7 aa, Mycobacterium
GSPPEAG

SEQ ID NO: 496791 - protein, 7 aa, Mycobacterium
GSPPEFA

SEQ ID NO: 496792 - protein, 7 aa, Mycobacterium
GSPPESG

SEQ ID NO: 496793 - protein, 11 aa, Mycobacterium
GSPPGGPADSR

SEQ ID NO: 496794 - protein, 7 aa, Mycobacterium
GSPPNRR

SEQ ID NO: 496795 - protein, 8 aa, Mycobacterium
GSPPNRRE

SEQ ID NO: 496796 - protein, 7 aa, Mycobacterium
GSPPPWA

SEQ ID NO: 496797 - protein, 6 aa, Mycobacterium
GSPPTD

SEQ ID NO: 496798 - protein, 8 aa, Mycobacterium
GSPPYTGD

SEQ ID NO: 496799 - protein, 7 aa, Mycobacterium
GSPQGAD

SEQ ID NO: 496800 - protein, 8 aa, Mycobacterium
GSPQLPED

SEQ ID NO: 496801 - protein, 9 aa, Mycobacterium
GSPQLPGNT

SEQ ID NO: 496802 - protein, 5 aa, Mycobacterium
GSPQV

SEQ ID NO: 496803 - protein, 4 aa, Mycobacterium
GSPR

SEQ ID NO: 496804 - protein, 6 aa, Mycobacterium
GSPREH

SEQ ID NO: 496805 - protein, 6 aa, Mycobacterium
GSPREL

SEQ ID NO: 496806 - protein, 6 aa, Mycobacterium
GSPREM

SEQ ID NO: 496807 - protein, 6 aa, Mycobacterium
GSPRGL

SEQ ID NO: 496808 - protein, 6 aa, Mycobacterium
GSPRGR

SEQ ID NO: 496809 - protein, 6 aa, Mycobacterium
GSPRHE

SEQ ID NO: 496810 - protein, 9 aa, Mycobacterium
GSPRIGPRR

SEQ ID NO: 496811 - protein, 15 aa, Mycobacterium
GSPRLSNPQKPPKHD

SEQ ID NO: 496812 - protein, 13 aa, Mycobacterium
GSPRMPARPTDAH

SEQ ID NO: 496813 - protein, 9 aa, Mycobacterium
GSPRPGNYN

SEQ ID NO: 496814 - protein, 7 aa, Mycobacterium
GSPRPIN

SEQ ID NO: 496815 - protein, 11 aa, Mycobacterium
GSPRPYAQSRP

SEQ ID NO: 496816 - protein, 7 aa, Mycobacterium
GSPRPYV

SEQ ID NO: 496817 - protein, 11 aa, Mycobacterium
GSPRSLSGSGM

SEQ ID NO: 496818 - protein, 19 aa, Mycobacterium
GSPSAQAVADQARGLAQHD

SEQ ID NO: 496819 - protein, 15 aa, Mycobacterium
GSPSDDLKQARTATL

SEQ ID NO: 496820 - protein, 5 aa, Mycobacterium
GSPSF

SEQ ID NO: 496821 - protein, 12 aa, Mycobacterium
GSPSQARKHANA

SEQ ID NO: 496822 - protein, 10 aa, Mycobacterium
GSPSQARKHV

SEQ ID NO: 496823 - protein, 7 aa, Mycobacterium
GSPSRPL

SEQ ID NO: 496824 - protein, 9 aa, Mycobacterium
GSPSRPLPD

SEQ ID NO: 496825 - protein, 5 aa, Mycobacterium
GSPSV

SEQ ID NO: 496826 - protein, 6 aa, Mycobacterium
GSPSVA

SEQ ID NO: 496827 - protein, 7 aa, Mycobacterium
GSPSVAE

SEQ ID NO: 496828 - protein, 24 aa, Mycobacterium
GSPSWATDPALATADGRRAREDAI

SEQ ID NO: 496829 - protein, 8 aa, Mycobacterium
GSPSYREA

SEQ ID NO: 496830 - protein, 4 aa, Mycobacterium
GSPT

SEQ ID NO: 496831 - protein, 8 aa, Mycobacterium
GSPTARHP

SEQ ID NO: 496832 - protein, 8 aa, Mycobacterium
GSPTARRA

SEQ ID NO: 496833 - protein, 11 aa, Mycobacterium
GSPTASEPAVG

SEQ ID NO: 496834 - protein, 12 aa, Mycobacterium
GSPTDTRSLDDR

SEQ ID NO: 496835 - protein, 15 aa, Mycobacterium
GSPTDTRSLDDRDDL

SEQ ID NO: 496836 - protein, 15 aa, Mycobacterium
GSPTDTRSLDDRDDM

SEQ ID NO: 496837 - protein, 6 aa, Mycobacterium
GSPTEF

SEQ ID NO: 496838 - protein, 7 aa, Mycobacterium
GSPTGAI

SEQ ID NO: 496839 - protein, 16 aa, Mycobacterium
GSPTGRDTELPANSAV

SEQ ID NO: 496840 - protein, 12 aa, Mycobacterium
GSPTIDGRNPDF

SEQ ID NO: 496841 - protein, 7 aa, Mycobacterium
GSPTITL

SEQ ID NO: 496842 - protein, 7 aa, Mycobacterium
GSPTQAA

SEQ ID NO: 496843 - protein, 6 aa, Mycobacterium
GSPTTL

SEQ ID NO: 496844 - protein, 7 aa, Mycobacterium
GSPTTVA

SEQ ID NO: 496845 - protein, 8 aa, Mycobacterium
GSPTYPKA

SEQ ID NO: 496846 - protein, 5 aa, Mycobacterium
GSPVE

SEQ ID NO: 496847 - protein, 6 aa, Mycobacterium
GSPVFD

SEQ ID NO: 496848 - protein, 5 aa, Mycobacterium
GSPVM

SEQ ID NO: 496849 - protein, 6 aa, Mycobacterium
GSPVNA

SEQ ID NO: 496850 - protein, 7 aa, Mycobacterium
GSPVPDA

SEQ ID NO: 496851 - protein, 24 aa, Mycobacterium
GSPVRPGTGWPGDPASSQTPVAAE

SEQ ID NO: 496852 - protein, 5 aa, Mycobacterium
GSPVS

SEQ ID NO: 496853 - protein, 6 aa, Mycobacterium
GSPVSE

SEQ ID NO: 496854 - protein, 6 aa, Mycobacterium
GSPVSP

SEQ ID NO: 496855 - protein, 21 aa, Mycobacterium
GSPYPGAGQMPMPGGGGSGIQ

SEQ ID NO: 496856 - protein, 12 aa, Mycobacterium
GSPYTTGEAGYH

SEQ ID NO: 496857 - protein, 4 aa, Mycobacterium
GSQA

SEQ ID NO: 496858 - protein, 7 aa, Mycobacterium
GSQAAVN

SEQ ID NO: 496859 - protein, 6 aa, Mycobacterium
GSQADR

SEQ ID NO: 496860 - protein, 10 aa, Mycobacterium
GSQAGDIART

SEQ ID NO: 496861 - protein, 11 aa, Mycobacterium
GSQAGIDRSYG

SEQ ID NO: 496862 - protein, 8 aa, Mycobacterium
GSQAGTAY

SEQ ID NO: 496863 - protein, 5 aa, Mycobacterium
GSQAI

SEQ ID NO: 496864 - protein, 13 aa, Mycobacterium
GSQALKKAAQAAQ

SEQ ID NO: 496865 - protein, 11 aa, Mycobacterium
GSQARWKDDPD

SEQ ID NO: 496866 - protein, 7 aa, Mycobacterium
GSQASAA

SEQ ID NO: 496867 - protein, 9 aa, Mycobacterium
GSQASNDQF

SEQ ID NO: 496868 - protein, 7 aa, Mycobacterium
GSQDGAD

SEQ ID NO: 496869 - protein, 6 aa, Mycobacterium
GSQDIN

SEQ ID NO: 496870 - protein, 5 aa, Mycobacterium
GSQDR

SEQ ID NO: 496871 - protein, 4 aa, Mycobacterium
GSQE

SEQ ID NO: 496872 - protein, 8 aa, Mycobacterium
GSQEAYER

SEQ ID NO: 496873 - protein, 9 aa, Mycobacterium
GSQEAYESA

SEQ ID NO: 496874 - protein, 7 aa, Mycobacterium
GSQEPGV

SEQ ID NO: 496875 - protein, 6 aa, Mycobacterium
GSQEQK

SEQ ID NO: 496876 - protein, 6 aa, Mycobacterium
GSQGIT

SEQ ID NO: 496877 - protein, 8 aa, Mycobacterium
GSQGITGT

SEQ ID NO: 496878 - protein, 11 aa, Mycobacterium
GSQGVQNGGID

SEQ ID NO: 496879 - protein, 5 aa, Mycobacterium
GSQIS

SEQ ID NO: 496880 - protein, 4 aa, Mycobacterium
GSQK

SEQ ID NO: 496881 - protein, 11 aa, Mycobacterium
GSQLGDPVKGA

SEQ ID NO: 496882 - protein, 6 aa, Mycobacterium
GSQLTG

SEQ ID NO: 496883 - protein, 14 aa, Mycobacterium
GSQLTTDAGRGRYQ

SEQ ID NO: 496884 - protein, 14 aa, Mycobacterium
GSQNDLPRGSRSYD

SEQ ID NO: 496885 - protein, 6 aa, Mycobacterium
GSQNFQ

SEQ ID NO: 496886 - protein, 15 aa, Mycobacterium
GSQNTAVSATLSGGR

SEQ ID NO: 496887 - protein, 8 aa, Mycobacterium
GSQNTPYV

SEQ ID NO: 496888 - protein, 6 aa, Mycobacterium
GSQPAV

SEQ ID NO: 496889 - protein, 8 aa, Mycobacterium
GSQPDSAL

SEQ ID NO: 496890 - protein, 10 aa, Mycobacterium
GSQPEAREDW

SEQ ID NO: 496891 - protein, 7 aa, Mycobacterium
GSQPREM

SEQ ID NO: 496892 - protein, 18 aa, Mycobacterium
GSQPSARELARTKTADEV

SEQ ID NO: 496893 - protein, 15 aa, Mycobacterium
GSQPSDQSVTFDVDR

SEQ ID NO: 496894 - protein, 9 aa, Mycobacterium
GSQPTEGAV

SEQ ID NO: 496895 - protein, 8 aa, Mycobacterium
GSQQAPAA

SEQ ID NO: 496896 - protein, 7 aa, Mycobacterium
GSQQAYE

SEQ ID NO: 496897 - protein, 5 aa, Mycobacterium
GSQRA

SEQ ID NO: 496898 - protein, 8 aa, Mycobacterium
GSQRAYER

SEQ ID NO: 496899 - protein, 6 aa, Mycobacterium
GSQRDN

SEQ ID NO: 496900 - protein, 6 aa, Mycobacterium
GSQRRM

SEQ ID NO: 496901 - protein, 7 aa, Mycobacterium
GSQSADA

SEQ ID NO: 496902 - protein, 8 aa, Mycobacterium
GSQSGLSS

SEQ ID NO: 496903 - protein, 4 aa, Mycobacterium
GSQT

SEQ ID NO: 496904 - protein, 7 aa, Mycobacterium
GSQTAGT

SEQ ID NO: 496905 - protein, 5 aa, Mycobacterium
GSQTK

SEQ ID NO: 496906 - protein, 9 aa, Mycobacterium
GSQTQDGGG

SEQ ID NO: 496907 - protein, 4 aa, Mycobacterium
GSQV

SEQ ID NO: 496908 - protein, 7 aa, Mycobacterium
GSQVHPP

SEQ ID NO: 496909 - protein, 14 aa, Mycobacterium
GSQVPASAGLSEGD

SEQ ID NO: 496910 - protein, 8 aa, Mycobacterium
GSQVSEDQ

SEQ ID NO: 496911 - protein, 6 aa, Mycobacterium
GSQVTK

SEQ ID NO: 496912 - protein, 5 aa, Mycobacterium
GSQWP

SEQ ID NO: 496913 - protein, 6 aa, Mycobacterium
GSQWPR

SEQ ID NO: 496914 - protein, 5 aa, Mycobacterium
GSQWS

SEQ ID NO: 496915 - protein, 5 aa, Mycobacterium
GSQWT

SEQ ID NO: 496916 - protein, 13 aa, Mycobacterium
GSQYASAEAANVE

SEQ ID NO: 496917 - protein, 7 aa, Mycobacterium
GSQYPGM

SEQ ID NO: 496918 - protein, 9 aa, Mycobacterium
GSQYSESFA

SEQ ID NO: 496919 - protein, 7 aa, Mycobacterium
GSRAAVN

SEQ ID NO: 496920 - protein, 5 aa, Mycobacterium
GSRAD

SEQ ID NO: 496921 - protein, 8 aa, Mycobacterium
GSRAEQLE

SEQ ID NO: 496922 - protein, 6 aa, Mycobacterium
GSRAFS

SEQ ID NO: 496923 - protein, 13 aa, Mycobacterium
GSRAGAPREGGHI

SEQ ID NO: 496924 - protein, 7 aa, Mycobacterium
GSRAGGL

SEQ ID NO: 496925 - protein, 8 aa, Mycobacterium
GSRAGGLH

SEQ ID NO: 496926 - protein, 5 aa, Mycobacterium
GSRAI

SEQ ID NO: 496927 - protein, 9 aa, Mycobacterium
GSRAPRPDI

SEQ ID NO: 496928 - protein, 18 aa, Mycobacterium
GSRAPSHYGDEREYKSDN

SEQ ID NO: 496929 - protein, 15 aa, Mycobacterium
GSRAQSDASNPTSVE

SEQ ID NO: 496930 - protein, 8 aa, Mycobacterium
GSRAQTDL

SEQ ID NO: 496931 - protein, 7 aa, Mycobacterium
GSRASEF

SEQ ID NO: 496932 - protein, 7 aa, Mycobacterium
GSRASTH

SEQ ID NO: 496933 - protein, 8 aa, Mycobacterium
GSRATAGE

SEQ ID NO: 496934 - protein, 13 aa, Mycobacterium
GSRATNTHRPDSD

SEQ ID NO: 496935 - protein, 4 aa, Mycobacterium
GSRD

SEQ ID NO: 496936 - protein, 6 aa, Mycobacterium
GSRDAG

SEQ ID NO: 496937 - protein, 10 aa, Mycobacterium
GSRDARFAQN

SEQ ID NO: 496938 - protein, 6 aa, Mycobacterium
GSRDAV

SEQ ID NO: 496939 - protein, 10 aa, Mycobacterium
GSRDEGATVA

SEQ ID NO: 496940 - protein, 10 aa, Mycobacterium
GSRDEGRSVA

SEQ ID NO: 496941 - protein, 9 aa, Mycobacterium
GSRDKTPAQ

SEQ ID NO: 496942 - protein, 15 aa, Mycobacterium
GSRDPSAAARPDRWR

SEQ ID NO: 496943 - protein, 19 aa, Mycobacterium
GSRDQLAEGDFRREQPRFS

SEQ ID NO: 496944 - protein, 10 aa, Mycobacterium
GSRDRQPNRY

SEQ ID NO: 496945 - protein, 19 aa, Mycobacterium
GSRDSATLGGMASTNAGGL

SEQ ID NO: 496946 - protein, 7 aa, Mycobacterium
GSREALA

SEQ ID NO: 496947 - protein, 7 aa, Mycobacterium
GSREDTP

SEQ ID NO: 496948 - protein, 6 aa, Mycobacterium
GSREGQ

SEQ ID NO: 496949 - protein, 4 aa, Mycobacterium
GSRF

SEQ ID NO: 496950 - protein, 21 aa, Mycobacterium
GSRGDGVETFSTTTTLPVSGS

SEQ ID NO: 496951 - protein, 7 aa, Mycobacterium
GSRGLGR

SEQ ID NO: 496952 - protein, 8 aa, Mycobacterium
GSRGLTHG

SEQ ID NO: 496953 - protein, 6 aa, Mycobacterium
GSRGMG

SEQ ID NO: 496954 - protein, 5 aa, Mycobacterium
GSRGP

SEQ ID NO: 496955 - protein, 13 aa, Mycobacterium
GSRGPDAKPYSAL

SEQ ID NO: 496956 - protein, 8 aa, Mycobacterium
GSRGPQVA

SEQ ID NO: 496957 - protein, 7 aa, Mycobacterium
GSRGRGD

SEQ ID NO: 496958 - protein, 10 aa, Mycobacterium
GSRGSADTVR

SEQ ID NO: 496959 - protein, 13 aa, Mycobacterium
GSRGSADTVRDTR

SEQ ID NO: 496960 - protein, 12 aa, Mycobacterium
GSRGSISDPPQA

SEQ ID NO: 496961 - protein, 7 aa, Mycobacterium
GSRGTEN

SEQ ID NO: 496962 - protein, 11 aa, Mycobacterium
GSRHPLDRGAA

SEQ ID NO: 496963 - protein, 6 aa, Mycobacterium
GSRHPV

SEQ ID NO: 496964 - protein, 11 aa, Mycobacterium
GSRHTPESVED

SEQ ID NO: 496965 - protein, 5 aa, Mycobacterium
GSRIP

SEQ ID NO: 496966 - protein, 5 aa, Mycobacterium
GSRIS

SEQ ID NO: 496967 - protein, 6 aa, Mycobacterium
GSRISE

SEQ ID NO: 496968 - protein, 15 aa, Mycobacterium
GSRKGPLVETADDGT

SEQ ID NO: 496969 - protein, 15 aa, Mycobacterium
GSRKGPLVETGSDAE

SEQ ID NO: 496970 - protein, 5 aa, Mycobacterium
GSRKQ

SEQ ID NO: 496971 - protein, 6 aa, Mycobacterium
GSRKQL

SEQ ID NO: 496972 - protein, 12 aa, Mycobacterium
GSRLAKNPRRAK

SEQ ID NO: 496973 - protein, 7 aa, Mycobacterium
GSRLDTA

SEQ ID NO: 496974 - protein, 9 aa, Mycobacterium
GSRLEPTLD

SEQ ID NO: 496975 - protein, 7 aa, Mycobacterium
GSRLPGR

SEQ ID NO: 496976 - protein, 9 aa, Mycobacterium
GSRLPPADA

SEQ ID NO: 496977 - protein, 7 aa, Mycobacterium
GSRLTGR

SEQ ID NO: 496978 - protein, 15 aa, Mycobacterium
GSRLTGRVGETRGDT

SEQ ID NO: 496979 - protein, 4 aa, Mycobacterium
GSRM

SEQ ID NO: 496980 - protein, 4 aa, Mycobacterium
GSRN

SEQ ID NO: 496981 - protein, 9 aa, Mycobacterium
GSRNGPRVE

SEQ ID NO: 496982 - protein, 15 aa, Mycobacterium
GSRNKYEVDHESGKV

SEQ ID NO: 496983 - protein, 14 aa, Mycobacterium
GSRNKYEVDHETGR

SEQ ID NO: 496984 - protein, 5 aa, Mycobacterium
GSRPA

SEQ ID NO: 496985 - protein, 7 aa, Mycobacterium
GSRPAAL

SEQ ID NO: 496986 - protein, 8 aa, Mycobacterium
GSRPAALS

SEQ ID NO: 496987 - protein, 22 aa, Mycobacterium
GSRPAGLARRGLGPDDVAPRPG

SEQ ID NO: 496988 - protein, 6 aa, Mycobacterium
GSRPDG

SEQ ID NO: 496989 - protein, 7 aa, Mycobacterium
GSRPERL

SEQ ID NO: 496990 - protein, 10 aa, Mycobacterium
GSRPETIESE

SEQ ID NO: 496991 - protein, 57 aa, Mycobacterium
GSRPGSDSSGSATGSGSGSPIGREPGTGHHSTGSEPVGTGGNRSTLEADDDTDSDAI

SEQ ID NO: 496992 - protein, 7 aa, Mycobacterium
GSRPISD

SEQ ID NO: 496993 - protein, 8 aa, Mycobacterium
GSRPLDKT

SEQ ID NO: 496994 - protein, 9 aa, Mycobacterium
GSRPLDKTR

SEQ ID NO: 496995 - protein, 8 aa, Mycobacterium
GSRPLPAE

SEQ ID NO: 496996 - protein, 7 aa, Mycobacterium
GSRPPLC

SEQ ID NO: 496997 - protein, 6 aa, Mycobacterium
GSRPTA

SEQ ID NO: 496998 - protein, 11 aa, Mycobacterium
GSRPTAMNSRT

SEQ ID NO: 496999 - protein, 9 aa, Mycobacterium
GSRPTPGVT

SEQ ID NO: 497000 - protein, 13 aa, Mycobacterium
GSRPTSRKPTASI

SEQ ID NO: 497001 - protein, 14 aa, Mycobacterium
GSRPTSRKPTESIS

SEQ ID NO: 497002 - protein, 13 aa, Mycobacterium
GSRPTSRKPTSSI

SEQ ID NO: 497003 - protein, 14 aa, Mycobacterium
GSRPTSRKPTSSIS

SEQ ID NO: 497004 - protein, 13 aa, Mycobacterium
GSRPTSRKPTTSI

SEQ ID NO: 497005 - protein, 14 aa, Mycobacterium
GSRPTSRKPTTSIS

SEQ ID NO: 497006 - protein, 15 aa, Mycobacterium
GSRPVQPSAEQPVVL

SEQ ID NO: 497007 - protein, 7 aa, Mycobacterium
GSRPVSA

SEQ ID NO: 497008 - protein, 8 aa, Mycobacterium
GSRQGLAQ

SEQ ID NO: 497009 - protein, 13 aa, Mycobacterium
GSRQSGDLDRDIE

SEQ ID NO: 497010 - protein, 9 aa, Mycobacterium
GSRQTHDDR

SEQ ID NO: 497011 - protein, 5 aa, Mycobacterium
GSRQV

SEQ ID NO: 497012 - protein, 4 aa, Mycobacterium
GSRR

SEQ ID NO: 497013 - protein, 8 aa, Mycobacterium
GSRRAPHR

SEQ ID NO: 497014 - protein, 6 aa, Mycobacterium
GSRRAT

SEQ ID NO: 497015 - protein, 9 aa, Mycobacterium
GSRRDGFKP

SEQ ID NO: 497016 - protein, 11 aa, Mycobacterium
GSRRHPPGTTA

SEQ ID NO: 497017 - protein, 6 aa, Mycobacterium
GSRRKT

SEQ ID NO: 497018 - protein, 12 aa, Mycobacterium
GSRRQLRTIEWA

SEQ ID NO: 497019 - protein, 7 aa, Mycobacterium
GSRRQRT

SEQ ID NO: 497020 - protein, 5 aa, Mycobacterium
GSRRR

SEQ ID NO: 497021 - protein, 7 aa, Mycobacterium
GSRRRGA

SEQ ID NO: 497022 - protein, 9 aa, Mycobacterium
GSRRTHDDR

SEQ ID NO: 497023 - protein, 10 aa, Mycobacterium
GSRRTHDDRV

SEQ ID NO: 497024 - protein, 6 aa, Mycobacterium
GSRRYG

SEQ ID NO: 497025 - protein, 7 aa, Mycobacterium
GSRSARV

SEQ ID NO: 497026 - protein, 10 aa, Mycobacterium
GSRSATDRRA

SEQ ID NO: 497027 - protein, 8 aa, Mycobacterium
GSRSATVT

SEQ ID NO: 497028 - protein, 6 aa, Mycobacterium
GSRSAV

SEQ ID NO: 497029 - protein, 12 aa, Mycobacterium
GSRSDAQADAAR

SEQ ID NO: 497030 - protein, 8 aa, Mycobacterium
GSRSDGAY

SEQ ID NO: 497031 - protein, 8 aa, Mycobacterium
GSRSELAP

SEQ ID NO: 497032 - protein, 6 aa, Mycobacterium
GSRSKA

SEQ ID NO: 497033 - protein, 10 aa, Mycobacterium
GSRSTPSDVC

SEQ ID NO: 497034 - protein, 17 aa, Mycobacterium
GSRTAAVARAQAAGRYE

SEQ ID NO: 497035 - protein, 9 aa, Mycobacterium
GSRTANAGP

SEQ ID NO: 497036 - protein, 11 aa, Mycobacterium
GSRTGIERSTP

SEQ ID NO: 497037 - protein, 8 aa, Mycobacterium
GSRTGLTK

SEQ ID NO: 497038 - protein, 14 aa, Mycobacterium
GSRTGSELERTRTE

SEQ ID NO: 497039 - protein, 11 aa, Mycobacterium
GSRTGVPREGG

SEQ ID NO: 497040 - protein, 9 aa, Mycobacterium
GSRTKEPDD

SEQ ID NO: 497041 - protein, 7 aa, Mycobacterium
GSRTPGL

SEQ ID NO: 497042 - protein, 17 aa, Mycobacterium
GSRTQESTDGLDSNAYE

SEQ ID NO: 497043 - protein, 19 aa, Mycobacterium
GSRTSKLPDASRHRPSMYI

SEQ ID NO: 497044 - protein, 6 aa, Mycobacterium
GSRVDK

SEQ ID NO: 497045 - protein, 9 aa, Mycobacterium
GSRVDPRAH

SEQ ID NO: 497046 - protein, 12 aa, Mycobacterium
GSRVDSPPGTGR

SEQ ID NO: 497047 - protein, 6 aa, Mycobacterium
GSRVSN

SEQ ID NO: 497048 - protein, 6 aa, Mycobacterium
GSRWES

SEQ ID NO: 497049 - protein, 6 aa, Mycobacterium
GSRYGS

SEQ ID NO: 497050 - protein, 9 aa, Mycobacterium
GSRYPLDRG

SEQ ID NO: 497051 - protein, 13 aa, Mycobacterium
GSSAAAAPAAVSQ

SEQ ID NO: 497052 - protein, 7 aa, Mycobacterium
GSSAAAS

SEQ ID NO: 497053 - protein, 31 aa, Mycobacterium
GSSAAATALTPLTSPGQNTDPAGPARQAAAV

SEQ ID NO: 497054 - protein, 8 aa, Mycobacterium
GSSAAATR

SEQ ID NO: 497055 - protein, 9 aa, Mycobacterium
GSSADPGEL

SEQ ID NO: 497056 - protein, 11 aa, Mycobacterium
GSSAGDGSAPL

SEQ ID NO: 497057 - protein, 8 aa, Mycobacterium
GSSAGGSL

SEQ ID NO: 497058 - protein, 7 aa, Mycobacterium
GSSAGHG

SEQ ID NO: 497059 - protein, 5 aa, Mycobacterium
GSSAI

SEQ ID NO: 497060 - protein, 6 aa, Mycobacterium
GSSAIA

SEQ ID NO: 497061 - protein, 11 aa, Mycobacterium
GSSAMTKPIPP

SEQ ID NO: 497062 - protein, 9 aa, Mycobacterium
GSSAPPQPL

SEQ ID NO: 497063 - protein, 5 aa, Mycobacterium
GSSAQ

SEQ ID NO: 497064 - protein, 9 aa, Mycobacterium
GSSAQGREF

SEQ ID NO: 497065 - protein, 6 aa, Mycobacterium
GSSARN

SEQ ID NO: 497066 - protein, 9 aa, Mycobacterium
GSSASAAQL

SEQ ID NO: 497067 - protein, 9 aa, Mycobacterium
GSSASATKI

SEQ ID NO: 497068 - protein, 9 aa, Mycobacterium
GSSASTVGK

SEQ ID NO: 497069 - protein, 28 aa, Mycobacterium
GSSATATQVTPFTEPPQITSPSGAVSQA

SEQ ID NO: 497070 - protein, 8 aa, Mycobacterium
GSSATGAK

SEQ ID NO: 497071 - protein, 9 aa, Mycobacterium
GSSATGAKV

SEQ ID NO: 497072 - protein, 6 aa, Mycobacterium
GSSAVG

SEQ ID NO: 497073 - protein, 7 aa, Mycobacterium
GSSAVGR

SEQ ID NO: 497074 - protein, 6 aa, Mycobacterium
GSSAVT

SEQ ID NO: 497075 - protein, 10 aa, Mycobacterium
GSSCTDGGAG

SEQ ID NO: 497076 - protein, 10 aa, Mycobacterium
GSSCTDGGRG

SEQ ID NO: 497077 - protein, 13 aa, Mycobacterium
GSSDGEDDSAVAS

SEQ ID NO: 497078 - protein, 9 aa, Mycobacterium
GSSDGSPVV

SEQ ID NO: 497079 - protein, 8 aa, Mycobacterium
GSSDPQRI

SEQ ID NO: 497080 - protein, 9 aa, Mycobacterium
GSSDPQRVG

SEQ ID NO: 497081 - protein, 12 aa, Mycobacterium
GSSDRPATGDPV

SEQ ID NO: 497082 - protein, 22 aa, Mycobacterium
GSSDTPVCSSGRNSRNAPRSVA

SEQ ID NO: 497083 - protein, 8 aa, Mycobacterium
GSSDVERD

SEQ ID NO: 497084 - protein, 4 aa, Mycobacterium
GSSE

SEQ ID NO: 497085 - protein, 13 aa, Mycobacterium
GSSEAEAEIREHL

SEQ ID NO: 497086 - protein, 11 aa, Mycobacterium
GSSEAESMRRG

SEQ ID NO: 497087 - protein, 7 aa, Mycobacterium
GSSEAPV

SEQ ID NO: 497088 - protein, 15 aa, Mycobacterium
GSSELATQLTQGATA

SEQ ID NO: 497089 - protein, 6 aa, Mycobacterium
GSSELR

SEQ ID NO: 497090 - protein, 6 aa, Mycobacterium
GSSEQA

SEQ ID NO: 497091 - protein, 5 aa, Mycobacterium
GSSER

SEQ ID NO: 497092 - protein, 8 aa, Mycobacterium
GSSESISA

SEQ ID NO: 497093 - protein, 5 aa, Mycobacterium
GSSET

SEQ ID NO: 497094 - protein, 8 aa, Mycobacterium
GSSETGNM

SEQ ID NO: 497095 - protein, 8 aa, Mycobacterium
GSSETGRA

SEQ ID NO: 497096 - protein, 18 aa, Mycobacterium
GSSETPVSTSGLRTEPRD

SEQ ID NO: 497097 - protein, 8 aa, Mycobacterium
GSSFGEPE

SEQ ID NO: 497098 - protein, 4 aa, Mycobacterium
GSSG

SEQ ID NO: 497099 - protein, 6 aa, Mycobacterium
GSSGAL

SEQ ID NO: 497100 - protein, 6 aa, Mycobacterium
GSSGAQ

SEQ ID NO: 497101 - protein, 6 aa, Mycobacterium
GSSGDR

SEQ ID NO: 497102 - protein, 9 aa, Mycobacterium
GSSGEPTLA

SEQ ID NO: 497103 - protein, 20 aa, Mycobacterium
GSSGGGHGSLGGNGGKGGNA

SEQ ID NO: 497104 - protein, 8 aa, Mycobacterium
GSSGGPNL

SEQ ID NO: 497105 - protein, 8 aa, Mycobacterium
GSSGGRRP

SEQ ID NO: 497106 - protein, 8 aa, Mycobacterium
GSSGIGEA

SEQ ID NO: 497107 - protein, 10 aa, Mycobacterium
GSSGIGEAAA

SEQ ID NO: 497108 - protein, 5 aa, Mycobacterium
GSSGL

SEQ ID NO: 497109 - protein, 9 aa, Mycobacterium
GSSGLGTDD

SEQ ID NO: 497110 - protein, 6 aa, Mycobacterium
GSSGLR

SEQ ID NO: 497111 - protein, 6 aa, Mycobacterium
GSSGLV

SEQ ID NO: 497112 - protein, 22 aa, Mycobacterium
GSSGRDGDKISKLRSKPGVTGA

SEQ ID NO: 497113 - protein, 12 aa, Mycobacterium
GSSGSAGPVAAK

SEQ ID NO: 497114 - protein, 9 aa, Mycobacterium
GSSGSGKST

SEQ ID NO: 497115 - protein, 10 aa, Mycobacterium
GSSGSGKSTL

SEQ ID NO: 497116 - protein, 17 aa, Mycobacterium
GSSGSSPSTTADAPPDV

SEQ ID NO: 497117 - protein, 17 aa, Mycobacterium
GSSGSSPSTTDDAPADV

SEQ ID NO: 497118 - protein, 6 aa, Mycobacterium
GSSGTL

SEQ ID NO: 497119 - protein, 6 aa, Mycobacterium
GSSGVV

SEQ ID NO: 497120 - protein, 4 aa, Mycobacterium
GSSH

SEQ ID NO: 497121 - protein, 13 aa, Mycobacterium
GSSHAAANARTAE

SEQ ID NO: 497122 - protein, 24 aa, Mycobacterium
GSSHGYDVTDPTTVSAELGGPDGL

SEQ ID NO: 497123 - protein, 10 aa, Mycobacterium
GSSHNGARSI

SEQ ID NO: 497124 - protein, 7 aa, Mycobacterium
GSSHRFT

SEQ ID NO: 497125 - protein, 10 aa, Mycobacterium
GSSHTPESLE

SEQ ID NO: 497126 - protein, 9 aa, Mycobacterium
GSSISAANA

SEQ ID NO: 497127 - protein, 6 aa, Mycobacterium
GSSITQ

SEQ ID NO: 497128 - protein, 8 aa, Mycobacterium
GSSITSEY

SEQ ID NO: 497129 - protein, 4 aa, Mycobacterium
GSSK

SEQ ID NO: 497130 - protein, 6 aa, Mycobacterium
GSSKGI

SEQ ID NO: 497131 - protein, 6 aa, Mycobacterium
GSSKPD

SEQ ID NO: 497132 - protein, 14 aa, Mycobacterium
GSSKVNSDADAVRD

SEQ ID NO: 497133 - protein, 6 aa, Mycobacterium
GSSLAA

SEQ ID NO: 497134 - protein, 21 aa, Mycobacterium
GSSLEGDRRTYQQDPGNGREA

SEQ ID NO: 497135 - protein, 8 aa, Mycobacterium
GSSLPPSS

SEQ ID NO: 497136 - protein, 8 aa, Mycobacterium
GSSLPQTS

SEQ ID NO: 497137 - protein, 9 aa, Mycobacterium
GSSLPRTTV

SEQ ID NO: 497138 - protein, 16 aa, Mycobacterium
GSSLQTANASAAAPTT

SEQ ID NO: 497139 - protein, 21 aa, Mycobacterium
GSSLRGDRRTYQQDVANGREA

SEQ ID NO: 497140 - protein, 15 aa, Mycobacterium
GSSLTGDGMDPSPAH

SEQ ID NO: 497141 - protein, 4 aa, Mycobacterium
GSSM

SEQ ID NO: 497142 - protein, 5 aa, Mycobacterium
GSSMT

SEQ ID NO: 497143 - protein, 9 aa, Mycobacterium
GSSNESASG

SEQ ID NO: 497144 - protein, 6 aa, Mycobacterium
GSSNLG

SEQ ID NO: 497145 - protein, 9 aa, Mycobacterium
GSSNPRHDI

SEQ ID NO: 497146 - protein, 14 aa, Mycobacterium
GSSNTGFGSAGDGN

SEQ ID NO: 497147 - protein, 5 aa, Mycobacterium
GSSPA

SEQ ID NO: 497148 - protein, 8 aa, Mycobacterium
GSSPAALP

SEQ ID NO: 497149 - protein, 7 aa, Mycobacterium
GSSPAAM

SEQ ID NO: 497150 - protein, 9 aa, Mycobacterium
GSSPADSYE

SEQ ID NO: 497151 - protein, 8 aa, Mycobacterium
GSSPAEYR

SEQ ID NO: 497152 - protein, 8 aa, Mycobacterium
GSSPAGQL

SEQ ID NO: 497153 - protein, 13 aa, Mycobacterium
GSSPDDQDALAAP

SEQ ID NO: 497154 - protein, 6 aa, Mycobacterium
GSSPED

SEQ ID NO: 497155 - protein, 16 aa, Mycobacterium
GSSPGGGVPGMPEPDP

SEQ ID NO: 497156 - protein, 6 aa, Mycobacterium
GSSPGL

SEQ ID NO: 497157 - protein, 35 aa, Mycobacterium
GSSPGSSDSSSGGAELRTGGARRARAPGLEARPLP

SEQ ID NO: 497158 - protein, 19 aa, Mycobacterium
GSSPIEGTQVSAEDSAVDG

SEQ ID NO: 497159 - protein, 16 aa, Mycobacterium
GSSPISGTDVTAEQPV

SEQ ID NO: 497160 - protein, 8 aa, Mycobacterium
GSSPLAPL

SEQ ID NO: 497161 - protein, 6 aa, Mycobacterium
GSSPNV

SEQ ID NO: 497162 - protein, 10 aa, Mycobacterium
GSSPQGTPGA

SEQ ID NO: 497163 - protein, 9 aa, Mycobacterium
GSSPRPNAR

SEQ ID NO: 497164 - protein, 7 aa, Mycobacterium
GSSPRPY

SEQ ID NO: 497165 - protein, 8 aa, Mycobacterium
GSSPRPYG

SEQ ID NO: 497166 - protein, 9 aa, Mycobacterium
GSSPRPYGG

SEQ ID NO: 497167 - protein, 7 aa, Mycobacterium
GSSPTQH

SEQ ID NO: 497168 - protein, 8 aa, Mycobacterium
GSSPYPDD

SEQ ID NO: 497169 - protein, 5 aa, Mycobacterium
GSSQF

SEQ ID NO: 497170 - protein, 5 aa, Mycobacterium
GSSQI

SEQ ID NO: 497171 - protein, 5 aa, Mycobacterium
GSSQR

SEQ ID NO: 497172 - protein, 5 aa, Mycobacterium
GSSQT

SEQ ID NO: 497173 - protein, 5 aa, Mycobacterium
GSSRA

SEQ ID NO: 497174 - protein, 14 aa, Mycobacterium
GSSRAAANANTEAV

SEQ ID NO: 497175 - protein, 26 aa, Mycobacterium
GSSRDPVGSDGFSGAGGRLAAVTGQP

SEQ ID NO: 497176 - protein, 8 aa, Mycobacterium
GSSRETVN

SEQ ID NO: 497177 - protein, 18 aa, Mycobacterium
GSSRGDGRALKAAETAIN

SEQ ID NO: 497178 - protein, 8 aa, Mycobacterium
GSSRGLGK

SEQ ID NO: 497179 - protein, 6 aa, Mycobacterium
GSSRHD

SEQ ID NO: 497180 - protein, 14 aa, Mycobacterium
GSSRNPQATTLRSA

SEQ ID NO: 497181 - protein, 9 aa, Mycobacterium
GSSRPTVSQ

SEQ ID NO: 497182 - protein, 17 aa, Mycobacterium
GSSRRGLAEEKPDAYKD

SEQ ID NO: 497183 - protein, 6 aa, Mycobacterium
GSSRRS

SEQ ID NO: 497184 - protein, 7 aa, Mycobacterium
GSSRTLT

SEQ ID NO: 497185 - protein, 13 aa, Mycobacterium
GSSRYAEAAQATL

SEQ ID NO: 497186 - protein, 10 aa, Mycobacterium
GSSSAARSNA

SEQ ID NO: 497187 - protein, 10 aa, Mycobacterium
GSSSAARSNE

SEQ ID NO: 497188 - protein, 11 aa, Mycobacterium
GSSSAATSNTE

SEQ ID NO: 497189 - protein, 10 aa, Mycobacterium
GSSSASRSNQ

SEQ ID NO: 497190 - protein, 10 aa, Mycobacterium
GSSSATRSNQ

SEQ ID NO: 497191 - protein, 9 aa, Mycobacterium
GSSSFPGKI

SEQ ID NO: 497192 - protein, 6 aa, Mycobacterium
GSSSGE

SEQ ID NO: 497193 - protein, 7 aa, Mycobacterium
GSSSHQS

SEQ ID NO: 497194 - protein, 7 aa, Mycobacterium
GSSSHSL

SEQ ID NO: 497195 - protein, 7 aa, Mycobacterium
GSSSLGV

SEQ ID NO: 497196 - protein, 5 aa, Mycobacterium
GSSSM

SEQ ID NO: 497197 - protein, 10 aa, Mycobacterium
GSSSPEAIHP

SEQ ID NO: 497198 - protein, 8 aa, Mycobacterium
GSSSPGLE

SEQ ID NO: 497199 - protein, 6 aa, Mycobacterium
GSSSRV

SEQ ID NO: 497200 - protein, 7 aa, Mycobacterium
GSSSSGL

SEQ ID NO: 497201 - protein, 10 aa, Mycobacterium
GSSSTAPART

SEQ ID NO: 497202 - protein, 9 aa, Mycobacterium
GSSSTNAHT

SEQ ID NO: 497203 - protein, 32 aa, Mycobacterium
GSSTENSAYGPTRNPWDTERVPGGSGGGSAAA

SEQ ID NO: 497204 - protein, 33 aa, Mycobacterium
GSSTENSAYGPTRNPWNTERVPGGSGGGSAAAL

SEQ ID NO: 497205 - protein, 6 aa, Mycobacterium
GSSTLP

SEQ ID NO: 497206 - protein, 24 aa, Mycobacterium
GSSTPAAGAVGASAVTAGLGNAGL

SEQ ID NO: 497207 - protein, 9 aa, Mycobacterium
GSSTPAKDY

SEQ ID NO: 497208 - protein, 17 aa, Mycobacterium
GSSTTAVASEAATLGSA

SEQ ID NO: 497209 - protein, 8 aa, Mycobacterium
GSSTTGRA

SEQ ID NO: 497210 - protein, 7 aa, Mycobacterium
GSSTVPG

SEQ ID NO: 497211 - protein, 9 aa, Mycobacterium
GSSTVPGVG

SEQ ID NO: 497212 - protein, 6 aa, Mycobacterium
GSSVAD

SEQ ID NO: 497213 - protein, 8 aa, Mycobacterium
GSSVADGL

SEQ ID NO: 497214 - protein, 7 aa, Mycobacterium
GSSVEEA

SEQ ID NO: 497215 - protein, 9 aa, Mycobacterium
GSSVEESQQ

SEQ ID NO: 497216 - protein, 7 aa, Mycobacterium
GSSVEQA

SEQ ID NO: 497217 - protein, 17 aa, Mycobacterium
GSSVGAANAAAAGSTTA

SEQ ID NO: 497218 - protein, 16 aa, Mycobacterium
GSSVNTANAMATTQTT

SEQ ID NO: 497219 - protein, 6 aa, Mycobacterium
GSSVSH

SEQ ID NO: 497220 - protein, 6 aa, Mycobacterium
GSSWSR

SEQ ID NO: 497221 - protein, 28 aa, Mycobacterium
GSSWSSSAAPVGGSSIPSGSLPAYGSDL

SEQ ID NO: 497222 - protein, 5 aa, Mycobacterium
GSSYN

SEQ ID NO: 497223 - protein, 23 aa, Mycobacterium
GSTAAPRTATARAKLDAAGSASY

SEQ ID NO: 497224 - protein, 9 aa, Mycobacterium
GSTAATTLT

SEQ ID NO: 497225 - protein, 9 aa, Mycobacterium
GSTADAGVP

SEQ ID NO: 497226 - protein, 9 aa, Mycobacterium
GSTADPAAW

SEQ ID NO: 497227 - protein, 16 aa, Mycobacterium
GSTADSVDSAPEGEPI

SEQ ID NO: 497228 - protein, 5 aa, Mycobacterium
GSTAE

SEQ ID NO: 497229 - protein, 9 aa, Mycobacterium
GSTAEADPH

SEQ ID NO: 497230 - protein, 8 aa, Mycobacterium
GSTAEAVA

SEQ ID NO: 497231 - protein, 8 aa, Mycobacterium
GSTAEAVT

SEQ ID NO: 497232 - protein, 9 aa, Mycobacterium
GSTAEGEKI

SEQ ID NO: 497233 - protein, 8 aa, Mycobacterium
GSTAEGLD

SEQ ID NO: 497234 - protein, 13 aa, Mycobacterium
GSTALGDRRPAAD

SEQ ID NO: 497235 - protein, 11 aa, Mycobacterium
GSTAPAKGTPA

SEQ ID NO: 497236 - protein, 6 aa, Mycobacterium
GSTAQM

SEQ ID NO: 497237 - protein, 6 aa, Mycobacterium
GSTARA

SEQ ID NO: 497238 - protein, 14 aa, Mycobacterium
GSTARSDVKRQLRA

SEQ ID NO: 497239 - protein, 9 aa, Mycobacterium
GSTASATRL

SEQ ID NO: 497240 - protein, 13 aa, Mycobacterium
GSTASVAHRNGET

SEQ ID NO: 497241 - protein, 6 aa, Mycobacterium
GSTATE

SEQ ID NO: 497242 - protein, 8 aa, Mycobacterium
GSTATGKK

SEQ ID NO: 497243 - protein, 21 aa, Mycobacterium
GSTATPGSDRLAAQTDPEASI

SEQ ID NO: 497244 - protein, 7 aa, Mycobacterium
GSTAVGK

SEQ ID NO: 497245 - protein, 7 aa, Mycobacterium
GSTAVGR

SEQ ID NO: 497246 - protein, 7 aa, Mycobacterium
GSTDAPD

SEQ ID NO: 497247 - protein, 13 aa, Mycobacterium
GSTDDLVKPGSDK

SEQ ID NO: 497248 - protein, 18 aa, Mycobacterium
GSTDEAGAPERSTPDEVN

SEQ ID NO: 497249 - protein, 7 aa, Mycobacterium
GSTDEVT

SEQ ID NO: 497250 - protein, 5 aa, Mycobacterium
GSTDF

SEQ ID NO: 497251 - protein, 10 aa, Mycobacterium
GSTDGDPGLQ

SEQ ID NO: 497252 - protein, 6 aa, Mycobacterium
GSTDMG

SEQ ID NO: 497253 - protein, 10 aa, Mycobacterium
GSTDRDAPTA

SEQ ID NO: 497254 - protein, 12 aa, Mycobacterium
GSTDRPSTGDSV

SEQ ID NO: 497255 - protein, 4 aa, Mycobacterium
GSTE

SEQ ID NO: 497256 - protein, 5 aa, Mycobacterium
GSTEA

SEQ ID NO: 497257 - protein, 9 aa, Mycobacterium
GSTEAPDPK

SEQ ID NO: 497258 - protein, 5 aa, Mycobacterium
GSTED

SEQ ID NO: 497259 - protein, 7 aa, Mycobacterium
GSTEGGV

SEQ ID NO: 497260 - protein, 10 aa, Mycobacterium
GSTEGREQAR

SEQ ID NO: 497261 - protein, 31 aa, Mycobacterium
GSTEHPSITGSSPSAPEGKRLYTDGNPRPGV

SEQ ID NO: 497262 - protein, 6 aa, Mycobacterium
GSTENA

SEQ ID NO: 497263 - protein, 17 aa, Mycobacterium
GSTETSGAVSRGPLGLP

SEQ ID NO: 497264 - protein, 20 aa, Mycobacterium
GSTETSGAVSRGRLEPPNPL

SEQ ID NO: 497265 - protein, 8 aa, Mycobacterium
GSTEVGAR

SEQ ID NO: 497266 - protein, 4 aa, Mycobacterium
GSTF

SEQ ID NO: 497267 - protein, 14 aa, Mycobacterium
GSTGAGQAPASVHP

SEQ ID NO: 497268 - protein, 11 aa, Mycobacterium
GSTGAKTSAAE

SEQ ID NO: 497269 - protein, 63 aa, Mycobacterium
GSTGATGAGGTGGQGGQGGAGGSGGNGGTAQTGGTGGAGGDLALGGQGGAGGAAGGTGGDTGL

SEQ ID NO: 497270 - protein, 8 aa, Mycobacterium
GSTGDNLA

SEQ ID NO: 497271 - protein, 5 aa, Mycobacterium
GSTGE

SEQ ID NO: 497272 - protein, 9 aa, Mycobacterium
GSTGEPKGV

SEQ ID NO: 497273 - protein, 10 aa, Mycobacterium
GSTGEPKGVV

SEQ ID NO: 497274 - protein, 12 aa, Mycobacterium
GSTGEPKGVVGT

SEQ ID NO: 497275 - protein, 5 aa, Mycobacterium
GSTGF

SEQ ID NO: 497276 - protein, 6 aa, Mycobacterium
GSTGFG

SEQ ID NO: 497277 - protein, 10 aa, Mycobacterium
GSTGFPGSDG

SEQ ID NO: 497278 - protein, 7 aa, Mycobacterium
GSTGHPK

SEQ ID NO: 497279 - protein, 8 aa, Mycobacterium
GSTGLGRD

SEQ ID NO: 497280 - protein, 6 aa, Mycobacterium
GSTGLT

SEQ ID NO: 497281 - protein, 8 aa, Mycobacterium
GSTGMPKG

SEQ ID NO: 497282 - protein, 22 aa, Mycobacterium
GSTGNVGKAVQAAGEAVATTIS

SEQ ID NO: 497283 - protein, 6 aa, Mycobacterium
GSTGQP

SEQ ID NO: 497284 - protein, 9 aa, Mycobacterium
GSTGQPKGV

SEQ ID NO: 497285 - protein, 6 aa, Mycobacterium
GSTGTA

SEQ ID NO: 497286 - protein, 16 aa, Mycobacterium
GSTGTLFPTGNPVDDV

SEQ ID NO: 497287 - protein, 13 aa, Mycobacterium
GSTGTPKGALGTH

SEQ ID NO: 497288 - protein, 9 aa, Mycobacterium
GSTGTPKGV

SEQ ID NO: 497289 - protein, 6 aa, Mycobacterium
GSTGVG

SEQ ID NO: 497290 - protein, 8 aa, Mycobacterium
GSTGYGKA

SEQ ID NO: 497291 - protein, 10 aa, Mycobacterium
GSTHRSSPHT

SEQ ID NO: 497292 - protein, 17 aa, Mycobacterium
GSTHTARPAACSQEQSY

SEQ ID NO: 497293 - protein, 4 aa, Mycobacterium
GSTI

SEQ ID NO: 497294 - protein, 14 aa, Mycobacterium
GSTIAAPGQGNYAA

SEQ ID NO: 497295 - protein, 5 aa, Mycobacterium
GSTIG

SEQ ID NO: 497296 - protein, 16 aa, Mycobacterium
GSTIGAANGAAAATTR

SEQ ID NO: 497297 - protein, 17 aa, Mycobacterium
GSTINTANAAASALTTS

SEQ ID NO: 497298 - protein, 7 aa, Mycobacterium
GSTIRQT

SEQ ID NO: 497299 - protein, 6 aa, Mycobacterium
GSTIRS

SEQ ID NO: 497300 - protein, 19 aa, Mycobacterium
GSTISAANAAASASTTAVA

SEQ ID NO: 497301 - protein, 9 aa, Mycobacterium
GSTISQANA

SEQ ID NO: 497302 - protein, 9 aa, Mycobacterium
GSTISQANV

SEQ ID NO: 497303 - protein, 18 aa, Mycobacterium
GSTISTANATAAGPTAAA

SEQ ID NO: 497304 - protein, 17 aa, Mycobacterium
GSTISTANTAAAAPTTT

SEQ ID NO: 497305 - protein, 5 aa, Mycobacterium
GSTKG

SEQ ID NO: 497306 - protein, 5 aa, Mycobacterium
GSTLG

SEQ ID NO: 497307 - protein, 14 aa, Mycobacterium
GSTLGDDEDERLRR

SEQ ID NO: 497308 - protein, 16 aa, Mycobacterium
GSTLGEAGAAAATPTT

SEQ ID NO: 497309 - protein, 6 aa, Mycobacterium
GSTLGG

SEQ ID NO: 497310 - protein, 8 aa, Mycobacterium
GSTLPANT

SEQ ID NO: 497311 - protein, 6 aa, Mycobacterium
GSTLRE

SEQ ID NO: 497312 - protein, 21 aa, Mycobacterium
GSTLREGAAIDADARRLTGQP

SEQ ID NO: 497313 - protein, 13 aa, Mycobacterium
GSTLSTSSHGYGA

SEQ ID NO: 497314 - protein, 20 aa, Mycobacterium
GSTLTNPSANVVKAKLADVG

SEQ ID NO: 497315 - protein, 8 aa, Mycobacterium
GSTNGTYL

SEQ ID NO: 497316 - protein, 6 aa, Mycobacterium
GSTNSG

SEQ ID NO: 497317 - protein, 9 aa, Mycobacterium
GSTNTTGID

SEQ ID NO: 497318 - protein, 9 aa, Mycobacterium
GSTPADTIY

SEQ ID NO: 497319 - protein, 8 aa, Mycobacterium
GSTPAENA

SEQ ID NO: 497320 - protein, 9 aa, Mycobacterium
GSTPDNSFP

SEQ ID NO: 497321 - protein, 10 aa, Mycobacterium
GSTPEAITNT

SEQ ID NO: 497322 - protein, 11 aa, Mycobacterium
GSTPERGTAAE

SEQ ID NO: 497323 - protein, 14 aa, Mycobacterium
GSTPGEYAATYGQG

SEQ ID NO: 497324 - protein, 10 aa, Mycobacterium
GSTPGFDNAL

SEQ ID NO: 497325 - protein, 6 aa, Mycobacterium
GSTPLA

SEQ ID NO: 497326 - protein, 14 aa, Mycobacterium
GSTPMTEPPDHWPP

SEQ ID NO: 497327 - protein, 11 aa, Mycobacterium
GSTPPDTPYPT

SEQ ID NO: 497328 - protein, 12 aa, Mycobacterium
GSTPPGDGTMPG

SEQ ID NO: 497329 - protein, 9 aa, Mycobacterium
GSTPTATGK

SEQ ID NO: 497330 - protein, 7 aa, Mycobacterium
GSTPTGR

SEQ ID NO: 497331 - protein, 8 aa, Mycobacterium
GSTPTGRR

SEQ ID NO: 497332 - protein, 9 aa, Mycobacterium
GSTPTSSGK

SEQ ID NO: 497333 - protein, 6 aa, Mycobacterium
GSTPVG

SEQ ID NO: 497334 - protein, 15 aa, Mycobacterium
GSTPVGVTTSGTFSP

SEQ ID NO: 497335 - protein, 13 aa, Mycobacterium
GSTPVPKLADAAN

SEQ ID NO: 497336 - protein, 7 aa, Mycobacterium
GSTPYKG

SEQ ID NO: 497337 - protein, 7 aa, Mycobacterium
GSTQEFT

SEQ ID NO: 497338 - protein, 10 aa, Mycobacterium
GSTQGVTTTD

SEQ ID NO: 497339 - protein, 8 aa, Mycobacterium
GSTQSVSA

SEQ ID NO: 497340 - protein, 14 aa, Mycobacterium
GSTQVSPVGTDEQV

SEQ ID NO: 497341 - protein, 11 aa, Mycobacterium
GSTRAAGQQYA

SEQ ID NO: 497342 - protein, 7 aa, Mycobacterium
GSTRAGV

SEQ ID NO: 497343 - protein, 11 aa, Mycobacterium
GSTRGVTTSDE

SEQ ID NO: 497344 - protein, 6 aa, Mycobacterium
GSTRHE

SEQ ID NO: 497345 - protein, 12 aa, Mycobacterium
GSTRLTAGTAQK

SEQ ID NO: 497346 - protein, 56 aa, Mycobacterium
GSTRPLSRAERRAQAARVTADETAPAAPEPQNTDIPPAPVATPPDGEQEARQAEPV

SEQ ID NO: 497347 - protein, 8 aa, Mycobacterium
GSTRPNGL

SEQ ID NO: 497348 - protein, 5 aa, Mycobacterium
GSTRR

SEQ ID NO: 497349 - protein, 6 aa, Mycobacterium
GSTRRA

SEQ ID NO: 497350 - protein, 15 aa, Mycobacterium
GSTRRGTRRARPSDR

SEQ ID NO: 497351 - protein, 5 aa, Mycobacterium
GSTRV

SEQ ID NO: 497352 - protein, 6 aa, Mycobacterium
GSTSAA

SEQ ID NO: 497353 - protein, 9 aa, Mycobacterium
GSTSAGVSG

SEQ ID NO: 497354 - protein, 5 aa, Mycobacterium
GSTSG

SEQ ID NO: 497355 - protein, 12 aa, Mycobacterium
GSTSGSGVSPPA

SEQ ID NO: 497356 - protein, 10 aa, Mycobacterium
GSTSKSLAPG

SEQ ID NO: 497357 - protein, 16 aa, Mycobacterium
GSTSPSAGRPEPADPV

SEQ ID NO: 497358 - protein, 10 aa, Mycobacterium
GSTSSPIPLP

SEQ ID NO: 497359 - protein, 9 aa, Mycobacterium
GSTSVPGLA

SEQ ID NO: 497360 - protein, 5 aa, Mycobacterium
GSTTA

SEQ ID NO: 497361 - protein, 11 aa, Mycobacterium
GSTTADRGRAG

SEQ ID NO: 497362 - protein, 21 aa, Mycobacterium
GSTTAESGADSDGGAGAAPMS

SEQ ID NO: 497363 - protein, 7 aa, Mycobacterium
GSTTDDH

SEQ ID NO: 497364 - protein, 7 aa, Mycobacterium
GSTTDNH

SEQ ID NO: 497365 - protein, 5 aa, Mycobacterium
GSTTI

SEQ ID NO: 497366 - protein, 15 aa, Mycobacterium
GSTTPASLDADTGHY

SEQ ID NO: 497367 - protein, 16 aa, Mycobacterium
GSTTPGAVAGATVDSR

SEQ ID NO: 497368 - protein, 6 aa, Mycobacterium
GSTTQR

SEQ ID NO: 497369 - protein, 11 aa, Mycobacterium
GSTTSTPDVPG

SEQ ID NO: 497370 - protein, 10 aa, Mycobacterium
GSTTTAENFS

SEQ ID NO: 497371 - protein, 9 aa, Mycobacterium
GSTTTAPYY

SEQ ID NO: 497372 - protein, 7 aa, Mycobacterium
GSTTTGR

SEQ ID NO: 497373 - protein, 11 aa, Mycobacterium
GSTTTYTAEHA

SEQ ID NO: 497374 - protein, 6 aa, Mycobacterium
GSTTYE

SEQ ID NO: 497375 - protein, 13 aa, Mycobacterium
GSTVDDAAGEAYD

SEQ ID NO: 497376 - protein, 5 aa, Mycobacterium
GSTVE

SEQ ID NO: 497377 - protein, 7 aa, Mycobacterium
GSTVEDA

SEQ ID NO: 497378 - protein, 6 aa, Mycobacterium
GSTVEQ

SEQ ID NO: 497379 - protein, 5 aa, Mycobacterium
GSTVT

SEQ ID NO: 497380 - protein, 4 aa, Mycobacterium
GSTW

SEQ ID NO: 497381 - protein, 4 aa, Mycobacterium
GSTY

SEQ ID NO: 497382 - protein, 7 aa, Mycobacterium
GSTYESA

SEQ ID NO: 497383 - protein, 9 aa, Mycobacterium
GSTYPNPPV

SEQ ID NO: 497384 - protein, 6 aa, Mycobacterium
GSVAAP

SEQ ID NO: 497385 - protein, 10 aa, Mycobacterium
GSVADGKKEI

SEQ ID NO: 497386 - protein, 8 aa, Mycobacterium
GSVADGNA

SEQ ID NO: 497387 - protein, 10 aa, Mycobacterium
GSVADPNEEG

SEQ ID NO: 497388 - protein, 5 aa, Mycobacterium
GSVAG

SEQ ID NO: 497389 - protein, 7 aa, Mycobacterium
GSVAGGA

SEQ ID NO: 497390 - protein, 28 aa, Mycobacterium
GSVAKDQRADAGKRVNAARGEAQQGYDE

SEQ ID NO: 497391 - protein, 26 aa, Mycobacterium
GSVAQRKATTGLASGDLGEKPGDAEQ

SEQ ID NO: 497392 - protein, 9 aa, Mycobacterium
GSVARAETA

SEQ ID NO: 497393 - protein, 7 aa, Mycobacterium
GSVARPP

SEQ ID NO: 497394 - protein, 7 aa, Mycobacterium
GSVARTA

SEQ ID NO: 497395 - protein, 19 aa, Mycobacterium
GSVASGSSVVAGDVAAVPS

SEQ ID NO: 497396 - protein, 32 aa, Mycobacterium
GSVATTPAVADEAAERATPETPLQESGLTPRA

SEQ ID NO: 497397 - protein, 4 aa, Mycobacterium
GSVD

SEQ ID NO: 497398 - protein, 8 aa, Mycobacterium
GSVDAERT

SEQ ID NO: 497399 - protein, 5 aa, Mycobacterium
GSVDD

SEQ ID NO: 497400 - protein, 12 aa, Mycobacterium
GSVDGARSAAAT

SEQ ID NO: 497401 - protein, 12 aa, Mycobacterium
GSVDGARSASAT

SEQ ID NO: 497402 - protein, 8 aa, Mycobacterium
GSVDGVPS

SEQ ID NO: 497403 - protein, 72 aa, Mycobacterium
GSVDPADGGDRSGADAVDDVGDENPSEPRKPDAATETGASDEKSDNGEAPEAADGSPPGAPAGDGAERSAMP

SEQ ID NO: 497404 - protein, 6 aa, Mycobacterium
GSVDRT

SEQ ID NO: 497405 - protein, 4 aa, Mycobacterium
GSVE

SEQ ID NO: 497406 - protein, 5 aa, Mycobacterium
GSVEE

SEQ ID NO: 497407 - protein, 5 aa, Mycobacterium
GSVEG

SEQ ID NO: 497408 - protein, 7 aa, Mycobacterium
GSVEKTV

SEQ ID NO: 497409 - protein, 7 aa, Mycobacterium
GSVEPDT

SEQ ID NO: 497410 - protein, 8 aa, Mycobacterium
GSVEPGAD

SEQ ID NO: 497411 - protein, 29 aa, Mycobacterium
GSVEQRTAARGLASGRLGDQPADPDTFTE

SEQ ID NO: 497412 - protein, 9 aa, Mycobacterium
GSVERPARQ

SEQ ID NO: 497413 - protein, 7 aa, Mycobacterium
GSVGAEI

SEQ ID NO: 497414 - protein, 14 aa, Mycobacterium
GSVGGGPRPRPTVP

SEQ ID NO: 497415 - protein, 8 aa, Mycobacterium
GSVGGSTG

SEQ ID NO: 497416 - protein, 10 aa, Mycobacterium
GSVGHNDAEH

SEQ ID NO: 497417 - protein, 8 aa, Mycobacterium
GSVGKPAL

SEQ ID NO: 497418 - protein, 13 aa, Mycobacterium
GSVGRGEALPGSD

SEQ ID NO: 497419 - protein, 10 aa, Mycobacterium
GSVGRSPARE

SEQ ID NO: 497420 - protein, 8 aa, Mycobacterium
GSVGSGAH

SEQ ID NO: 497421 - protein, 12 aa, Mycobacterium
GSVGTPVSIGSP

SEQ ID NO: 497422 - protein, 6 aa, Mycobacterium
GSVIDT

SEQ ID NO: 497423 - protein, 4 aa, Mycobacterium
GSVN

SEQ ID NO: 497424 - protein, 6 aa, Mycobacterium
GSVNAS

SEQ ID NO: 497425 - protein, 5 aa, Mycobacterium
GSVNT

SEQ ID NO: 497426 - protein, 16 aa, Mycobacterium
GSVNTGIGNTGGTNTG

SEQ ID NO: 497427 - protein, 8 aa, Mycobacterium
GSVPGGQA

SEQ ID NO: 497428 - protein, 7 aa, Mycobacterium
GSVPGSF

SEQ ID NO: 497429 - protein, 7 aa, Mycobacterium
GSVPPEA

SEQ ID NO: 497430 - protein, 10 aa, Mycobacterium
GSVPPPAAGV

SEQ ID NO: 497431 - protein, 7 aa, Mycobacterium
GSVPPTV

SEQ ID NO: 497432 - protein, 13 aa, Mycobacterium
GSVPQRKATVGLA

SEQ ID NO: 497433 - protein, 13 aa, Mycobacterium
GSVPQSAATSFTP

SEQ ID NO: 497434 - protein, 8 aa, Mycobacterium
GSVPRGIG

SEQ ID NO: 497435 - protein, 8 aa, Mycobacterium
GSVPRGVG

SEQ ID NO: 497436 - protein, 11 aa, Mycobacterium
GSVPTAERPAA

SEQ ID NO: 497437 - protein, 7 aa, Mycobacterium
GSVPTGL

SEQ ID NO: 497438 - protein, 8 aa, Mycobacterium
GSVPVAGA

SEQ ID NO: 497439 - protein, 20 aa, Mycobacterium
GSVPVESSTVRTPVAETTGY

SEQ ID NO: 497440 - protein, 8 aa, Mycobacterium
GSVQESTV

SEQ ID NO: 497441 - protein, 7 aa, Mycobacterium
GSVQGDP

SEQ ID NO: 497442 - protein, 6 aa, Mycobacterium
GSVQQR

SEQ ID NO: 497443 - protein, 7 aa, Mycobacterium
GSVQTPD

SEQ ID NO: 497444 - protein, 9 aa, Mycobacterium
GSVQTTPEV

SEQ ID NO: 497445 - protein, 12 aa, Mycobacterium
GSVREISREEPQ

SEQ ID NO: 497446 - protein, 14 aa, Mycobacterium
GSVRPREGNRHRDY

SEQ ID NO: 497447 - protein, 22 aa, Mycobacterium
GSVRPRRRNPPPGARRSDMSDA

SEQ ID NO: 497448 - protein, 10 aa, Mycobacterium
GSVRQSGASR

SEQ ID NO: 497449 - protein, 13 aa, Mycobacterium
GSVRSDIAGDPDA

SEQ ID NO: 497450 - protein, 6 aa, Mycobacterium
GSVRTG

SEQ ID NO: 497451 - protein, 48 aa, Mycobacterium
GSVSATDNGGNGGNGGNAGLVGNGGNGGAGADSEFDGGNGGNGGSAQL

SEQ ID NO: 497452 - protein, 5 aa, Mycobacterium
GSVSG

SEQ ID NO: 497453 - protein, 14 aa, Mycobacterium
GSVSGEHGDGRARS

SEQ ID NO: 497454 - protein, 7 aa, Mycobacterium
GSVSGRE

SEQ ID NO: 497455 - protein, 6 aa, Mycobacterium
GSVSGV

SEQ ID NO: 497456 - protein, 8 aa, Mycobacterium
GSVSGVAG

SEQ ID NO: 497457 - protein, 19 aa, Mycobacterium
GSVSKEARADVEDALKSGR

SEQ ID NO: 497458 - protein, 9 aa, Mycobacterium
GSVSKEQRA

SEQ ID NO: 497459 - protein, 18 aa, Mycobacterium
GSVSKEQRADIEDDLKTG

SEQ ID NO: 497460 - protein, 17 aa, Mycobacterium
GSVSKEQRAQVEEDLKR

SEQ ID NO: 497461 - protein, 17 aa, Mycobacterium
GSVSSRDGRGGTAPARV

SEQ ID NO: 497462 - protein, 5 aa, Mycobacterium
GSVSV

SEQ ID NO: 497463 - protein, 4 aa, Mycobacterium
GSVT

SEQ ID NO: 497464 - protein, 7 aa, Mycobacterium
GSVTDEK

SEQ ID NO: 497465 - protein, 5 aa, Mycobacterium
GSVTE

SEQ ID NO: 497466 - protein, 7 aa, Mycobacterium
GSVTETA

SEQ ID NO: 497467 - protein, 5 aa, Mycobacterium
GSVTG

SEQ ID NO: 497468 - protein, 14 aa, Mycobacterium
GSVTGKSEGSGGEN

SEQ ID NO: 497469 - protein, 14 aa, Mycobacterium
GSVTGKSEGTGGEN

SEQ ID NO: 497470 - protein, 8 aa, Mycobacterium
GSVTNRPP

SEQ ID NO: 497471 - protein, 6 aa, Mycobacterium
GSVTPA

SEQ ID NO: 497472 - protein, 30 aa, Mycobacterium
GSVTQRKATTGLASGELGANPTDAKQFTED

SEQ ID NO: 497473 - protein, 30 aa, Mycobacterium
GSVTQRKATTGLASGGLGTKPGDAKQFTED

SEQ ID NO: 497474 - protein, 8 aa, Mycobacterium
GSVTRKTW

SEQ ID NO: 497475 - protein, 5 aa, Mycobacterium
GSVTS

SEQ ID NO: 497476 - protein, 9 aa, Mycobacterium
GSVTSRRDG

SEQ ID NO: 497477 - protein, 7 aa, Mycobacterium
GSVTVRR

SEQ ID NO: 497478 - protein, 4 aa, Mycobacterium
GSVV

SEQ ID NO: 497479 - protein, 15 aa, Mycobacterium
GSVYTQAEAAGTATL

SEQ ID NO: 497480 - protein, 10 aa, Mycobacterium
GSWARRDRRT

SEQ ID NO: 497481 - protein, 4 aa, Mycobacterium
GSWD

SEQ ID NO: 497482 - protein, 9 aa, Mycobacterium
GSWDGSTAE

SEQ ID NO: 497483 - protein, 10 aa, Mycobacterium
GSWDYDGRPS

SEQ ID NO: 497484 - protein, 8 aa, Mycobacterium
GSWDYEGR

SEQ ID NO: 497485 - protein, 5 aa, Mycobacterium
GSWER

SEQ ID NO: 497486 - protein, 4 aa, Mycobacterium
GSWF

SEQ ID NO: 497487 - protein, 4 aa, Mycobacterium
GSWG

SEQ ID NO: 497488 - protein, 7 aa, Mycobacterium
GSWGGAA

SEQ ID NO: 497489 - protein, 9 aa, Mycobacterium
GSWGSESTM

SEQ ID NO: 497490 - protein, 5 aa, Mycobacterium
GSWGT

SEQ ID NO: 497491 - protein, 15 aa, Mycobacterium
GSWKPPSAIPDTYRG

SEQ ID NO: 497492 - protein, 8 aa, Mycobacterium
GSWPSATT

SEQ ID NO: 497493 - protein, 9 aa, Mycobacterium
GSWQGPSSR

SEQ ID NO: 497494 - protein, 18 aa, Mycobacterium
GSWQHPPAQRLSDPRRSR

SEQ ID NO: 497495 - protein, 8 aa, Mycobacterium
GSWRTDSA

SEQ ID NO: 497496 - protein, 8 aa, Mycobacterium
GSWRTDSR

SEQ ID NO: 497497 - protein, 9 aa, Mycobacterium
GSWSEATGL

SEQ ID NO: 497498 - protein, 24 aa, Mycobacterium
GSWSGTAASVSGGPSVPAGPLPAY

SEQ ID NO: 497499 - protein, 5 aa, Mycobacterium
GSYAA

SEQ ID NO: 497500 - protein, 14 aa, Mycobacterium
GSYAATEAANTVAV

SEQ ID NO: 497501 - protein, 14 aa, Mycobacterium
GSYAATEAINAAAA

SEQ ID NO: 497502 - protein, 12 aa, Mycobacterium
GSYANGYGNSKW

SEQ ID NO: 497503 - protein, 7 aa, Mycobacterium
GSYARRP

SEQ ID NO: 497504 - protein, 13 aa, Mycobacterium
GSYASGGFASGAD

SEQ ID NO: 497505 - protein, 13 aa, Mycobacterium
GSYASGGFATGAD

SEQ ID NO: 497506 - protein, 14 aa, Mycobacterium
GSYDGQTGAASGQY

SEQ ID NO: 497507 - protein, 26 aa, Mycobacterium
GSYDTGFGNAGSGNAGAFNAGSHNTG

SEQ ID NO: 497508 - protein, 4 aa, Mycobacterium
GSYE

SEQ ID NO: 497509 - protein, 12 aa, Mycobacterium
GSYEDGPSQALA

SEQ ID NO: 497510 - protein, 5 aa, Mycobacterium
GSYEE

SEQ ID NO: 497511 - protein, 9 aa, Mycobacterium
GSYEGEFTE

SEQ ID NO: 497512 - protein, 13 aa, Mycobacterium
GSYEGGAAQALAS

SEQ ID NO: 497513 - protein, 25 aa, Mycobacterium
GSYEPGYNSDSTRTYSIGEPDPDVA

SEQ ID NO: 497514 - protein, 6 aa, Mycobacterium
GSYETE

SEQ ID NO: 497515 - protein, 14 aa, Mycobacterium
GSYETEREDHARGR

SEQ ID NO: 497516 - protein, 4 aa, Mycobacterium
GSYF

SEQ ID NO: 497517 - protein, 4 aa, Mycobacterium
GSYG

SEQ ID NO: 497518 - protein, 12 aa, Mycobacterium
GSYGEEEGSRPP

SEQ ID NO: 497519 - protein, 7 aa, Mycobacterium
GSYGPYT

SEQ ID NO: 497520 - protein, 7 aa, Mycobacterium
GSYGWSS

SEQ ID NO: 497521 - protein, 4 aa, Mycobacterium
GSYH

SEQ ID NO: 497522 - protein, 10 aa, Mycobacterium
GSYIESRRAA

SEQ ID NO: 497523 - protein, 4 aa, Mycobacterium
GSYM

SEQ ID NO: 497524 - protein, 6 aa, Mycobacterium
GSYNEP

SEQ ID NO: 497525 - protein, 53 aa, Mycobacterium
GSYNTGFGNSGEASTGVFNPGNANTGWANTGNHNTGSFNAGNTNTGGFNPGNL

SEQ ID NO: 497526 - protein, 6 aa, Mycobacterium
GSYPEI

SEQ ID NO: 497527 - protein, 9 aa, Mycobacterium
GSYPQTTAI

SEQ ID NO: 497528 - protein, 5 aa, Mycobacterium
GSYPR

SEQ ID NO: 497529 - protein, 13 aa, Mycobacterium
GSYPRREDEQRAV

SEQ ID NO: 497530 - protein, 6 aa, Mycobacterium
GSYPTE

SEQ ID NO: 497531 - protein, 5 aa, Mycobacterium
GSYQA

SEQ ID NO: 497532 - protein, 6 aa, Mycobacterium
GSYQDR

SEQ ID NO: 497533 - protein, 8 aa, Mycobacterium
GSYRGDPA

SEQ ID NO: 497534 - protein, 8 aa, Mycobacterium
GSYRQRPQ

SEQ ID NO: 497535 - protein, 7 aa, Mycobacterium
GSYSDGE

SEQ ID NO: 497536 - protein, 8 aa, Mycobacterium
GSYSPDDL

SEQ ID NO: 497537 - protein, 7 aa, Mycobacterium
GSYSRGR

SEQ ID NO: 497538 - protein, 6 aa, Mycobacterium
GSYTAP

SEQ ID NO: 497539 - protein, 8 aa, Mycobacterium
GSYTPDNM

SEQ ID NO: 497540 - protein, 9 aa, Mycobacterium
GSYTPDSGT

SEQ ID NO: 497541 - protein, 43 aa, Mycobacterium
GTAAAASALTPFTEPPQTTNPVAGAAQSAAVAQASSTAASSDV

SEQ ID NO: 497542 - protein, 7 aa, Mycobacterium
GTAAALT

SEQ ID NO: 497543 - protein, 10 aa, Mycobacterium
GTAADDPWSA

SEQ ID NO: 497544 - protein, 8 aa, Mycobacterium
GTAADEHP

SEQ ID NO: 497545 - protein, 7 aa, Mycobacterium
GTAADEV

SEQ ID NO: 497546 - protein, 10 aa, Mycobacterium
GTAADNQASL

SEQ ID NO: 497547 - protein, 8 aa, Mycobacterium
GTAAEAGA

SEQ ID NO: 497548 - protein, 8 aa, Mycobacterium
GTAAEGET

SEQ ID NO: 497549 - protein, 23 aa, Mycobacterium
GTAAEIGADDGDEVTVSTARGSI

SEQ ID NO: 497550 - protein, 10 aa, Mycobacterium
GTAAERESRA

SEQ ID NO: 497551 - protein, 8 aa, Mycobacterium
GTAAETRS

SEQ ID NO: 497552 - protein, 7 aa, Mycobacterium
GTAAGAG

SEQ ID NO: 497553 - protein, 6 aa, Mycobacterium
GTAAGE

SEQ ID NO: 497554 - protein, 136 aa, Mycobacterium
GTAAGGHAGADGTTAGEIGGVGGRGGAAWAQSPTGTPNVTGGAGGGGGDGGSGAMGGGGGAGGDATAGTGAVATGGAGGDGGAGGAGAIGGAGGAGGSAGTVLGTGSAHGGAGGAGGAGGAGAAGGIGGAGGSADV

SEQ ID NO: 497555 - protein, 10 aa, Mycobacterium
GTAAGGRDGQ

SEQ ID NO: 497556 - protein, 14 aa, Mycobacterium
GTAAGTSATGPLAA

SEQ ID NO: 497557 - protein, 17 aa, Mycobacterium
GTAAKLEKQRREDARQR

SEQ ID NO: 497558 - protein, 5 aa, Mycobacterium
GTAAL

SEQ ID NO: 497559 - protein, 28 aa, Mycobacterium
GTAALTGDPDGPPTLPGYSSADNSTGMS

SEQ ID NO: 497560 - protein, 10 aa, Mycobacterium
GTAANQDGHT

SEQ ID NO: 497561 - protein, 8 aa, Mycobacterium
GTAAPGGK

SEQ ID NO: 497562 - protein, 9 aa, Mycobacterium
GTAAPQTAA

SEQ ID NO: 497563 - protein, 5 aa, Mycobacterium
GTAAQ

SEQ ID NO: 497564 - protein, 8 aa, Mycobacterium
GTAAQAGL

SEQ ID NO: 497565 - protein, 9 aa, Mycobacterium
GTAAQKAKH

SEQ ID NO: 497566 - protein, 10 aa, Mycobacterium
GTAAQNAVDA

SEQ ID NO: 497567 - protein, 10 aa, Mycobacterium
GTAAQVASPT

SEQ ID NO: 497568 - protein, 13 aa, Mycobacterium
GTAARDLGWIPSW

SEQ ID NO: 497569 - protein, 7 aa, Mycobacterium
GTAARSQ

SEQ ID NO: 497570 - protein, 7 aa, Mycobacterium
GTAARTQ

SEQ ID NO: 497571 - protein, 10 aa, Mycobacterium
GTAASTSGAM

SEQ ID NO: 497572 - protein, 7 aa, Mycobacterium
GTAATAR

SEQ ID NO: 497573 - protein, 10 aa, Mycobacterium
GTAATGERSR

SEQ ID NO: 497574 - protein, 6 aa, Mycobacterium
GTADAA

SEQ ID NO: 497575 - protein, 15 aa, Mycobacterium
GTADAARKAASDGIA

SEQ ID NO: 497576 - protein, 10 aa, Mycobacterium
GTADAGAARA

SEQ ID NO: 497577 - protein, 5 aa, Mycobacterium
GTADD

SEQ ID NO: 497578 - protein, 7 aa, Mycobacterium
GTADDLD

SEQ ID NO: 497579 - protein, 6 aa, Mycobacterium
GTADEG

SEQ ID NO: 497580 - protein, 9 aa, Mycobacterium
GTADEVARD

SEQ ID NO: 497581 - protein, 9 aa, Mycobacterium
GTADEVRNG

SEQ ID NO: 497582 - protein, 7 aa, Mycobacterium
GTADGDS

SEQ ID NO: 497583 - protein, 7 aa, Mycobacterium
GTADGES

SEQ ID NO: 497584 - protein, 8 aa, Mycobacterium
GTADGGRI

SEQ ID NO: 497585 - protein, 9 aa, Mycobacterium
GTADGSGDL

SEQ ID NO: 497586 - protein, 10 aa, Mycobacterium
GTADGVRGAT

SEQ ID NO: 497587 - protein, 11 aa, Mycobacterium
GTADKRQVDGV

SEQ ID NO: 497588 - protein, 10 aa, Mycobacterium
GTADKRQVDN

SEQ ID NO: 497589 - protein, 5 aa, Mycobacterium
GTADL

SEQ ID NO: 497590 - protein, 6 aa, Mycobacterium
GTADNN

SEQ ID NO: 497591 - protein, 8 aa, Mycobacterium
GTADPAAI

SEQ ID NO: 497592 - protein, 9 aa, Mycobacterium
GTADPAAIR

SEQ ID NO: 497593 - protein, 8 aa, Mycobacterium
GTADPAAL

SEQ ID NO: 497594 - protein, 12 aa, Mycobacterium
GTADPAEARARL

SEQ ID NO: 497595 - protein, 12 aa, Mycobacterium
GTADPAEARTAL

SEQ ID NO: 497596 - protein, 9 aa, Mycobacterium
GTADPAEIR

SEQ ID NO: 497597 - protein, 9 aa, Mycobacterium
GTADPAELR

SEQ ID NO: 497598 - protein, 8 aa, Mycobacterium
GTADPAGL

SEQ ID NO: 497599 - protein, 7 aa, Mycobacterium
GTADPAH

SEQ ID NO: 497600 - protein, 8 aa, Mycobacterium
GTADPAHL

SEQ ID NO: 497601 - protein, 11 aa, Mycobacterium
GTADPGEARTA

SEQ ID NO: 497602 - protein, 6 aa, Mycobacterium
GTADPI

SEQ ID NO: 497603 - protein, 6 aa, Mycobacterium
GTADPT

SEQ ID NO: 497604 - protein, 6 aa, Mycobacterium
GTADPV

SEQ ID NO: 497605 - protein, 7 aa, Mycobacterium
GTADPVD

SEQ ID NO: 497606 - protein, 7 aa, Mycobacterium
GTADPVK

SEQ ID NO: 497607 - protein, 8 aa, Mycobacterium
GTADQSEG

SEQ ID NO: 497608 - protein, 9 aa, Mycobacterium
GTADRRQVD

SEQ ID NO: 497609 - protein, 5 aa, Mycobacterium
GTADS

SEQ ID NO: 497610 - protein, 12 aa, Mycobacterium
GTADTRARQSAV

SEQ ID NO: 497611 - protein, 6 aa, Mycobacterium
GTADTV

SEQ ID NO: 497612 - protein, 5 aa, Mycobacterium
GTAEE

SEQ ID NO: 497613 - protein, 13 aa, Mycobacterium
GTAEEIAEDTGPT

SEQ ID NO: 497614 - protein, 6 aa, Mycobacterium
GTAEEQ

SEQ ID NO: 497615 - protein, 5 aa, Mycobacterium
GTAEI

SEQ ID NO: 497616 - protein, 8 aa, Mycobacterium
GTAEKDLR

SEQ ID NO: 497617 - protein, 8 aa, Mycobacterium
GTAELRRP

SEQ ID NO: 497618 - protein, 5 aa, Mycobacterium
GTAEP

SEQ ID NO: 497619 - protein, 8 aa, Mycobacterium
GTAEPAAL

SEQ ID NO: 497620 - protein, 9 aa, Mycobacterium
GTAEPRGSS

SEQ ID NO: 497621 - protein, 15 aa, Mycobacterium
GTAEPSRTRRRSSKA

SEQ ID NO: 497622 - protein, 8 aa, Mycobacterium
GTAEQKAK

SEQ ID NO: 497623 - protein, 7 aa, Mycobacterium
GTAEQRK

SEQ ID NO: 497624 - protein, 8 aa, Mycobacterium
GTAERGRE

SEQ ID NO: 497625 - protein, 14 aa, Mycobacterium
GTAERTPYAATKGA

SEQ ID NO: 497626 - protein, 7 aa, Mycobacterium
GTAESSR

SEQ ID NO: 497627 - protein, 14 aa, Mycobacterium
GTAETALNPVGTGL

SEQ ID NO: 497628 - protein, 8 aa, Mycobacterium
GTAETRAV

SEQ ID NO: 497629 - protein, 4 aa, Mycobacterium
GTAF

SEQ ID NO: 497630 - protein, 7 aa, Mycobacterium
GTAGAAV

SEQ ID NO: 497631 - protein, 28 aa, Mycobacterium
GTAGAGGSGGLGAAGAGGAGGQGGTGGL

SEQ ID NO: 497632 - protein, 9 aa, Mycobacterium
GTAGDDGTA

SEQ ID NO: 497633 - protein, 6 aa, Mycobacterium
GTAGDI

SEQ ID NO: 497634 - protein, 28 aa, Mycobacterium
GTAGDKKRYRGDDRKRPLDKHGRAQAES

SEQ ID NO: 497635 - protein, 6 aa, Mycobacterium
GTAGDQ

SEQ ID NO: 497636 - protein, 9 aa, Mycobacterium
GTAGEAPEH

SEQ ID NO: 497637 - protein, 9 aa, Mycobacterium
GTAGEGNHD

SEQ ID NO: 497638 - protein, 19 aa, Mycobacterium
GTAGFDTTGVSTRRPTLPD

SEQ ID NO: 497639 - protein, 7 aa, Mycobacterium
GTAGGHH

SEQ ID NO: 497640 - protein, 8 aa, Mycobacterium
GTAGGHHD

SEQ ID NO: 497641 - protein, 9 aa, Mycobacterium
GTAGGHHDI

SEQ ID NO: 497642 - protein, 11 aa, Mycobacterium
GTAGIDGDDPE

SEQ ID NO: 497643 - protein, 7 aa, Mycobacterium
GTAGIDP

SEQ ID NO: 497644 - protein, 5 aa, Mycobacterium
GTAGL

SEQ ID NO: 497645 - protein, 6 aa, Mycobacterium
GTAGNI

SEQ ID NO: 497646 - protein, 12 aa, Mycobacterium
GTAGNISARRAD

SEQ ID NO: 497647 - protein, 13 aa, Mycobacterium
GTAGNISARRDDG

SEQ ID NO: 497648 - protein, 13 aa, Mycobacterium
GTAGNISARRSDG

SEQ ID NO: 497649 - protein, 5 aa, Mycobacterium
GTAGP

SEQ ID NO: 497650 - protein, 9 aa, Mycobacterium
GTAGPNYDA

SEQ ID NO: 497651 - protein, 7 aa, Mycobacterium
GTAGQRC

SEQ ID NO: 497652 - protein, 27 aa, Mycobacterium
GTAGRKSRFKGDDTQRPLDKRGRAQAE

SEQ ID NO: 497653 - protein, 27 aa, Mycobacterium
GTAGRRSRYKGDDRKRPLDKRGRAQAE

SEQ ID NO: 497654 - protein, 11 aa, Mycobacterium
GTAGSAGITTG

SEQ ID NO: 497655 - protein, 10 aa, Mycobacterium
GTAGSATTQL

SEQ ID NO: 497656 - protein, 8 aa, Mycobacterium
GTAGSGKT

SEQ ID NO: 497657 - protein, 27 aa, Mycobacterium
GTAGSKSRFSGDDTRRPLDKKGRAQAE

SEQ ID NO: 497658 - protein, 12 aa, Mycobacterium
GTAGSTGDPRTA

SEQ ID NO: 497659 - protein, 17 aa, Mycobacterium
GTAGSTGSPKTAALSPR

SEQ ID NO: 497660 - protein, 16 aa, Mycobacterium
GTAGSTGTPRTAQLRP

SEQ ID NO: 497661 - protein, 14 aa, Mycobacterium
GTAGVAQPEHTGAG

SEQ ID NO: 497662 - protein, 12 aa, Mycobacterium
GTAGVGGAGGNA

SEQ ID NO: 497663 - protein, 8 aa, Mycobacterium
GTAGVPKG

SEQ ID NO: 497664 - protein, 6 aa, Mycobacterium
GTAGVS

SEQ ID NO: 497665 - protein, 8 aa, Mycobacterium
GTAHASGE

SEQ ID NO: 497666 - protein, 9 aa, Mycobacterium
GTAHATSGF

SEQ ID NO: 497667 - protein, 13 aa, Mycobacterium
GTAHGKAAARATG

SEQ ID NO: 497668 - protein, 11 aa, Mycobacterium
GTAHPGAPGRV

SEQ ID NO: 497669 - protein, 10 aa, Mycobacterium
GTAHPMTRDE

SEQ ID NO: 497670 - protein, 16 aa, Mycobacterium
GTAIAKAKQAATDRGL

SEQ ID NO: 497671 - protein, 13 aa, Mycobacterium
GTAIGAGDATSAT

SEQ ID NO: 497672 - protein, 7 aa, Mycobacterium
GTAIGPD

SEQ ID NO: 497673 - protein, 13 aa, Mycobacterium
GTAIGTGLNTHPE

SEQ ID NO: 497674 - protein, 10 aa, Mycobacterium
GTAIPEGNDG

SEQ ID NO: 497675 - protein, 5 aa, Mycobacterium
GTAIR

SEQ ID NO: 497676 - protein, 12 aa, Mycobacterium
GTAIYDSSPLQR

SEQ ID NO: 497677 - protein, 6 aa, Mycobacterium
GTAKEI

SEQ ID NO: 497678 - protein, 10 aa, Mycobacterium
GTAKGPAGQN

SEQ ID NO: 497679 - protein, 9 aa, Mycobacterium
GTAKMGRDE

SEQ ID NO: 497680 - protein, 6 aa, Mycobacterium
GTAKPL

SEQ ID NO: 497681 - protein, 13 aa, Mycobacterium
GTAKSDRTGTGTR

SEQ ID NO: 497682 - protein, 10 aa, Mycobacterium
GTALAEATTR

SEQ ID NO: 497683 - protein, 14 aa, Mycobacterium
GTALASTPQTAPAP

SEQ ID NO: 497684 - protein, 10 aa, Mycobacterium
GTALGGGSEL

SEQ ID NO: 497685 - protein, 7 aa, Mycobacterium
GTALTGN

SEQ ID NO: 497686 - protein, 5 aa, Mycobacterium
GTAMT

SEQ ID NO: 497687 - protein, 9 aa, Mycobacterium
GTANGTPVT

SEQ ID NO: 497688 - protein, 8 aa, Mycobacterium
GTANPAEL

SEQ ID NO: 497689 - protein, 12 aa, Mycobacterium
GTANRYPDGSYR

SEQ ID NO: 497690 - protein, 5 aa, Mycobacterium
GTANT

SEQ ID NO: 497691 - protein, 9 aa, Mycobacterium
GTANTGSLN

SEQ ID NO: 497692 - protein, 14 aa, Mycobacterium
GTANTVAAAREAPA

SEQ ID NO: 497693 - protein, 4 aa, Mycobacterium
GTAP

SEQ ID NO: 497694 - protein, 16 aa, Mycobacterium
GTAPAAAPAPEAAPAG

SEQ ID NO: 497695 - protein, 13 aa, Mycobacterium
GTAPADGTHERRG

SEQ ID NO: 497696 - protein, 14 aa, Mycobacterium
GTAPAKSATTPAGL

SEQ ID NO: 497697 - protein, 13 aa, Mycobacterium
GTAPAQQHAPRSA

SEQ ID NO: 497698 - protein, 7 aa, Mycobacterium
GTAPASV

SEQ ID NO: 497699 - protein, 10 aa, Mycobacterium
GTAPATERGE

SEQ ID NO: 497700 - protein, 10 aa, Mycobacterium
GTAPATPTGT

SEQ ID NO: 497701 - protein, 5 aa, Mycobacterium
GTAPG

SEQ ID NO: 497702 - protein, 10 aa, Mycobacterium
GTAPGANTPL

SEQ ID NO: 497703 - protein, 7 aa, Mycobacterium
GTAPGID

SEQ ID NO: 497704 - protein, 7 aa, Mycobacterium
GTAPNGQ

SEQ ID NO: 497705 - protein, 13 aa, Mycobacterium
GTAPNQQSPDGVI

SEQ ID NO: 497706 - protein, 21 aa, Mycobacterium
GTAPPRDDATGWEAGARQSVA

SEQ ID NO: 497707 - protein, 5 aa, Mycobacterium
GTAPR

SEQ ID NO: 497708 - protein, 10 aa, Mycobacterium
GTAPRAPSAL

SEQ ID NO: 497709 - protein, 8 aa, Mycobacterium
GTAPSPEA

SEQ ID NO: 497710 - protein, 8 aa, Mycobacterium
GTAPTGPL

SEQ ID NO: 497711 - protein, 5 aa, Mycobacterium
GTAPV

SEQ ID NO: 497712 - protein, 8 aa, Mycobacterium
GTAPVGTT

SEQ ID NO: 497713 - protein, 4 aa, Mycobacterium
GTAQ

SEQ ID NO: 497714 - protein, 12 aa, Mycobacterium
GTAQDDLGGAAT

SEQ ID NO: 497715 - protein, 5 aa, Mycobacterium
GTAQI

SEQ ID NO: 497716 - protein, 9 aa, Mycobacterium
GTAQQQAAS

SEQ ID NO: 497717 - protein, 18 aa, Mycobacterium
GTAQRAQSDPADPNRSYG

SEQ ID NO: 497718 - protein, 10 aa, Mycobacterium
GTAQREAGMT

SEQ ID NO: 497719 - protein, 5 aa, Mycobacterium
GTAQS

SEQ ID NO: 497720 - protein, 6 aa, Mycobacterium
GTAQSL

SEQ ID NO: 497721 - protein, 5 aa, Mycobacterium
GTAQT

SEQ ID NO: 497722 - protein, 4 aa, Mycobacterium
GTAR

SEQ ID NO: 497723 - protein, 10 aa, Mycobacterium
GTARAENYGP

SEQ ID NO: 497724 - protein, 10 aa, Mycobacterium
GTARAESYGP

SEQ ID NO: 497725 - protein, 26 aa, Mycobacterium
GTARAGGKFSAHKDATSTGAGLNGIG

SEQ ID NO: 497726 - protein, 25 aa, Mycobacterium
GTARAGGKFSAHTDATSTGAGLNGI

SEQ ID NO: 497727 - protein, 18 aa, Mycobacterium
GTARAVSEQRILKAINAA

SEQ ID NO: 497728 - protein, 5 aa, Mycobacterium
GTARE

SEQ ID NO: 497729 - protein, 13 aa, Mycobacterium
GTAREGSVEVQQV

SEQ ID NO: 497730 - protein, 6 aa, Mycobacterium
GTARFG

SEQ ID NO: 497731 - protein, 5 aa, Mycobacterium
GTARG

SEQ ID NO: 497732 - protein, 9 aa, Mycobacterium
GTARPALEG

SEQ ID NO: 497733 - protein, 5 aa, Mycobacterium
GTARQ

SEQ ID NO: 497734 - protein, 16 aa, Mycobacterium
GTARRDDGAVVSSGGR

SEQ ID NO: 497735 - protein, 15 aa, Mycobacterium
GTARRDDGEVVSSGG

SEQ ID NO: 497736 - protein, 15 aa, Mycobacterium
GTARRDDGSVVSSGG

SEQ ID NO: 497737 - protein, 16 aa, Mycobacterium
GTARREDGAVVSSGGR

SEQ ID NO: 497738 - protein, 15 aa, Mycobacterium
GTARREDGEIVSSGG

SEQ ID NO: 497739 - protein, 8 aa, Mycobacterium
GTARRNAR

SEQ ID NO: 497740 - protein, 9 aa, Mycobacterium
GTARTESDI

SEQ ID NO: 497741 - protein, 10 aa, Mycobacterium
GTARTNPDRL

SEQ ID NO: 497742 - protein, 12 aa, Mycobacterium
GTARTSSEVEAT

SEQ ID NO: 497743 - protein, 9 aa, Mycobacterium
GTARVGAGA

SEQ ID NO: 497744 - protein, 4 aa, Mycobacterium
GTAS

SEQ ID NO: 497745 - protein, 12 aa, Mycobacterium
GTASAAALSSND

SEQ ID NO: 497746 - protein, 11 aa, Mycobacterium
GTASAANLGRA

SEQ ID NO: 497747 - protein, 12 aa, Mycobacterium
GTASAANLSRSD

SEQ ID NO: 497748 - protein, 10 aa, Mycobacterium
GTASAARDMD

SEQ ID NO: 497749 - protein, 11 aa, Mycobacterium
GTASAGADPAV

SEQ ID NO: 497750 - protein, 12 aa, Mycobacterium
GTASAPKGVQHT

SEQ ID NO: 497751 - protein, 6 aa, Mycobacterium
GTASEI

SEQ ID NO: 497752 - protein, 7 aa, Mycobacterium
GTASEVR

SEQ ID NO: 497753 - protein, 7 aa, Mycobacterium
GTASGEY

SEQ ID NO: 497754 - protein, 9 aa, Mycobacterium
GTASGSSIG

SEQ ID NO: 497755 - protein, 5 aa, Mycobacterium
GTASI

SEQ ID NO: 497756 - protein, 5 aa, Mycobacterium
GTASL

SEQ ID NO: 497757 - protein, 23 aa, Mycobacterium
GTASNQDGRTVNQSTPSSEAQAA

SEQ ID NO: 497758 - protein, 11 aa, Mycobacterium
GTASPGADPAV

SEQ ID NO: 497759 - protein, 6 aa, Mycobacterium
GTASPL

SEQ ID NO: 497760 - protein, 7 aa, Mycobacterium
GTASPTL

SEQ ID NO: 497761 - protein, 12 aa, Mycobacterium
GTASSAVGTDSW

SEQ ID NO: 497762 - protein, 8 aa, Mycobacterium
GTASSVGR

SEQ ID NO: 497763 - protein, 12 aa, Mycobacterium
GTASTASLDRKD

SEQ ID NO: 497764 - protein, 9 aa, Mycobacterium
GTASTNERR

SEQ ID NO: 497765 - protein, 13 aa, Mycobacterium
GTATATGGSNPIT

SEQ ID NO: 497766 - protein, 13 aa, Mycobacterium
GTATATGGTNPIT

SEQ ID NO: 497767 - protein, 25 aa, Mycobacterium
GTATAYPLPRPGDGPAPKPVTLPAG

SEQ ID NO: 497768 - protein, 5 aa, Mycobacterium
GTATD

SEQ ID NO: 497769 - protein, 6 aa, Mycobacterium
GTATDL

SEQ ID NO: 497770 - protein, 10 aa, Mycobacterium
GTATDTTESL

SEQ ID NO: 497771 - protein, 12 aa, Mycobacterium
GTATEEQKARVQ

SEQ ID NO: 497772 - protein, 6 aa, Mycobacterium
GTATHE

SEQ ID NO: 497773 - protein, 9 aa, Mycobacterium
GTATLAGDP

SEQ ID NO: 497774 - protein, 5 aa, Mycobacterium
GTATM

SEQ ID NO: 497775 - protein, 5 aa, Mycobacterium
GTATN

SEQ ID NO: 497776 - protein, 20 aa, Mycobacterium
GTATNQDGRTETLTMPSEDA

SEQ ID NO: 497777 - protein, 8 aa, Mycobacterium
GTATPAQI

SEQ ID NO: 497778 - protein, 6 aa, Mycobacterium
GTATPI

SEQ ID NO: 497779 - protein, 14 aa, Mycobacterium
GTATPIGDSAEANA

SEQ ID NO: 497780 - protein, 9 aa, Mycobacterium
GTATPIGDV

SEQ ID NO: 497781 - protein, 12 aa, Mycobacterium
GTATPQATAPAL

SEQ ID NO: 497782 - protein, 5 aa, Mycobacterium
GTATQ

SEQ ID NO: 497783 - protein, 17 aa, Mycobacterium
GTATRDIPYEGSPDMDM

SEQ ID NO: 497784 - protein, 10 aa, Mycobacterium
GTATRLPADE

SEQ ID NO: 497785 - protein, 8 aa, Mycobacterium
GTATSGEQ

SEQ ID NO: 497786 - protein, 6 aa, Mycobacterium
GTATVD

SEQ ID NO: 497787 - protein, 7 aa, Mycobacterium
GTATVHT

SEQ ID NO: 497788 - protein, 10 aa, Mycobacterium
GTAVATAAAP

SEQ ID NO: 497789 - protein, 6 aa, Mycobacterium
GTAVGR

SEQ ID NO: 497790 - protein, 14 aa, Mycobacterium
GTAVGTGLNAPEGF

SEQ ID NO: 497791 - protein, 15 aa, Mycobacterium
GTAVGTGLNAPEGFG

SEQ ID NO: 497792 - protein, 14 aa, Mycobacterium
GTAVGTGLNAPESF

SEQ ID NO: 497793 - protein, 7 aa, Mycobacterium
GTAVGTT

SEQ ID NO: 497794 - protein, 18 aa, Mycobacterium
GTAVPAEASADSAAAGHG

SEQ ID NO: 497795 - protein, 15 aa, Mycobacterium
GTAVPDGALPAGSTI

SEQ ID NO: 497796 - protein, 8 aa, Mycobacterium
GTAVSGGK

SEQ ID NO: 497797 - protein, 12 aa, Mycobacterium
GTAVSTAELTQS

SEQ ID NO: 497798 - protein, 7 aa, Mycobacterium
GTAVTPA

SEQ ID NO: 497799 - protein, 4 aa, Mycobacterium
GTAW

SEQ ID NO: 497800 - protein, 15 aa, Mycobacterium
GTAYGDASLDSEASY

SEQ ID NO: 497801 - protein, 6 aa, Mycobacterium
GTAYGE

SEQ ID NO: 497802 - protein, 21 aa, Mycobacterium
GTAYPPPVKPNGDGHSAPKDW

SEQ ID NO: 497803 - protein, 5 aa, Mycobacterium
GTCGA

SEQ ID NO: 497804 - protein, 9 aa, Mycobacterium
GTCGDGVAR

SEQ ID NO: 497805 - protein, 7 aa, Mycobacterium
GTCGSEG

SEQ ID NO: 497806 - protein, 8 aa, Mycobacterium
GTCGSGGT

SEQ ID NO: 497807 - protein, 9 aa, Mycobacterium
GTCPPQPLT

SEQ ID NO: 497808 - protein, 11 aa, Mycobacterium
GTCPRSQHRRQ

SEQ ID NO: 497809 - protein, 8 aa, Mycobacterium
GTDAAGRR

SEQ ID NO: 497810 - protein, 15 aa, Mycobacterium
GTDAAIGDTDQLPGK

SEQ ID NO: 497811 - protein, 6 aa, Mycobacterium
GTDAAL

SEQ ID NO: 497812 - protein, 9 aa, Mycobacterium
GTDAALGDQ

SEQ ID NO: 497813 - protein, 9 aa, Mycobacterium
GTDAASGKP

SEQ ID NO: 497814 - protein, 15 aa, Mycobacterium
GTDAAVGDTGELPGK

SEQ ID NO: 497815 - protein, 10 aa, Mycobacterium
GTDAEGVSRG

SEQ ID NO: 497816 - protein, 13 aa, Mycobacterium
GTDAERASRRQRL

SEQ ID NO: 497817 - protein, 9 aa, Mycobacterium
GTDAGGSIA

SEQ ID NO: 497818 - protein, 9 aa, Mycobacterium
GTDAGGTIQ

SEQ ID NO: 497819 - protein, 9 aa, Mycobacterium
GTDAGPSTL

SEQ ID NO: 497820 - protein, 11 aa, Mycobacterium
GTDAHDTPAIA

SEQ ID NO: 497821 - protein, 11 aa, Mycobacterium
GTDAHDTPSIA

SEQ ID NO: 497822 - protein, 18 aa, Mycobacterium
GTDAHDTSAIAERDELHR

SEQ ID NO: 497823 - protein, 7 aa, Mycobacterium
GTDAKSF

SEQ ID NO: 497824 - protein, 21 aa, Mycobacterium
GTDALGASPDTPLSSEDAAEL

SEQ ID NO: 497825 - protein, 6 aa, Mycobacterium
GTDANR

SEQ ID NO: 497826 - protein, 17 aa, Mycobacterium
GTDAQGTEAIGFGFEPA

SEQ ID NO: 497827 - protein, 13 aa, Mycobacterium
GTDAQKEQLDDVA

SEQ ID NO: 497828 - protein, 6 aa, Mycobacterium
GTDAQR

SEQ ID NO: 497829 - protein, 10 aa, Mycobacterium
GTDARADLSA

SEQ ID NO: 497830 - protein, 9 aa, Mycobacterium
GTDARHKTS

SEQ ID NO: 497831 - protein, 9 aa, Mycobacterium
GTDASAEQL

SEQ ID NO: 497832 - protein, 7 aa, Mycobacterium
GTDASID

SEQ ID NO: 497833 - protein, 7 aa, Mycobacterium
GTDASLT

SEQ ID NO: 497834 - protein, 8 aa, Mycobacterium
GTDASLTD

SEQ ID NO: 497835 - protein, 11 aa, Mycobacterium
GTDATADDYYP

SEQ ID NO: 497836 - protein, 10 aa, Mycobacterium
GTDDAERARA

SEQ ID NO: 497837 - protein, 9 aa, Mycobacterium
GTDDAGKPD

SEQ ID NO: 497838 - protein, 7 aa, Mycobacterium
GTDDGLT

SEQ ID NO: 497839 - protein, 9 aa, Mycobacterium
GTDDPEQVR

SEQ ID NO: 497840 - protein, 10 aa, Mycobacterium
GTDDPPPVAE

SEQ ID NO: 497841 - protein, 12 aa, Mycobacterium
GTDDQRAARRQR

SEQ ID NO: 497842 - protein, 9 aa, Mycobacterium
GTDDSAQAL

SEQ ID NO: 497843 - protein, 9 aa, Mycobacterium
GTDDSEPIR

SEQ ID NO: 497844 - protein, 9 aa, Mycobacterium
GTDDTIDEQ

SEQ ID NO: 497845 - protein, 7 aa, Mycobacterium
GTDDTIE

SEQ ID NO: 497846 - protein, 7 aa, Mycobacterium
GTDEAAD

SEQ ID NO: 497847 - protein, 7 aa, Mycobacterium
GTDEALA

SEQ ID NO: 497848 - protein, 8 aa, Mycobacterium
GTDEDDLV

SEQ ID NO: 497849 - protein, 8 aa, Mycobacterium
GTDEDVDR

SEQ ID NO: 497850 - protein, 7 aa, Mycobacterium
GTDEEFR

SEQ ID NO: 497851 - protein, 7 aa, Mycobacterium
GTDEFGG

SEQ ID NO: 497852 - protein, 7 aa, Mycobacterium
GTDEGLT

SEQ ID NO: 497853 - protein, 15 aa, Mycobacterium
GTDEGRNYSVRRQRG

SEQ ID NO: 497854 - protein, 6 aa, Mycobacterium
GTDEHG

SEQ ID NO: 497855 - protein, 9 aa, Mycobacterium
GTDELPDGH

SEQ ID NO: 497856 - protein, 10 aa, Mycobacterium
GTDEPPSADE

SEQ ID NO: 497857 - protein, 7 aa, Mycobacterium
GTDEPRR

SEQ ID NO: 497858 - protein, 15 aa, Mycobacterium
GTDEPTLTGRQVQPA

SEQ ID NO: 497859 - protein, 5 aa, Mycobacterium
GTDEQ

SEQ ID NO: 497860 - protein, 7 aa, Mycobacterium
GTDEQAI

SEQ ID NO: 497861 - protein, 6 aa, Mycobacterium
GTDEQK

SEQ ID NO: 497862 - protein, 7 aa, Mycobacterium
GTDEQKA

SEQ ID NO: 497863 - protein, 13 aa, Mycobacterium
GTDEQKEKLAEAG

SEQ ID NO: 497864 - protein, 7 aa, Mycobacterium
GTDEQKK

SEQ ID NO: 497865 - protein, 8 aa, Mycobacterium
GTDEQKQQ

SEQ ID NO: 497866 - protein, 6 aa, Mycobacterium
GTDERC

SEQ ID NO: 497867 - protein, 7 aa, Mycobacterium
GTDERRS

SEQ ID NO: 497868 - protein, 7 aa, Mycobacterium
GTDESDA

SEQ ID NO: 497869 - protein, 9 aa, Mycobacterium
GTDESDERI

SEQ ID NO: 497870 - protein, 6 aa, Mycobacterium
GTDEST

SEQ ID NO: 497871 - protein, 5 aa, Mycobacterium
GTDEW

SEQ ID NO: 497872 - protein, 7 aa, Mycobacterium
GTDEYGR

SEQ ID NO: 497873 - protein, 9 aa, Mycobacterium
GTDFGDSPR

SEQ ID NO: 497874 - protein, 9 aa, Mycobacterium
GTDFRPAKR

SEQ ID NO: 497875 - protein, 20 aa, Mycobacterium
GTDFRPAKRLPAEQVTHWNA

SEQ ID NO: 497876 - protein, 20 aa, Mycobacterium
GTDFRPAKRLPAEQVTHWNS

SEQ ID NO: 497877 - protein, 20 aa, Mycobacterium
GTDFRPAKRLPTESLTHWNS

SEQ ID NO: 497878 - protein, 4 aa, Mycobacterium
GTDG

SEQ ID NO: 497879 - protein, 5 aa, Mycobacterium
GTDGA

SEQ ID NO: 497880 - protein, 6 aa, Mycobacterium
GTDGAA

SEQ ID NO: 497881 - protein, 18 aa, Mycobacterium
GTDGDSCCGSGSSPASGC

SEQ ID NO: 497882 - protein, 10 aa, Mycobacterium
GTDGEPLAAG

SEQ ID NO: 497883 - protein, 17 aa, Mycobacterium
GTDGGAGSAGATGATGT

SEQ ID NO: 497884 - protein, 6 aa, Mycobacterium
GTDGLT

SEQ ID NO: 497885 - protein, 9 aa, Mycobacterium
GTDGPNCDA

SEQ ID NO: 497886 - protein, 8 aa, Mycobacterium
GTDGPSAL

SEQ ID NO: 497887 - protein, 19 aa, Mycobacterium
GTDGQCAAGSAEPDEQTQT

SEQ ID NO: 497888 - protein, 9 aa, Mycobacterium
GTDGRPDRK

SEQ ID NO: 497889 - protein, 6 aa, Mycobacterium
GTDGRQ

SEQ ID NO: 497890 - protein, 6 aa, Mycobacterium
GTDGRV

SEQ ID NO: 497891 - protein, 7 aa, Mycobacterium
GTDGSDA

SEQ ID NO: 497892 - protein, 5 aa, Mycobacterium
GTDGT

SEQ ID NO: 497893 - protein, 7 aa, Mycobacterium
GTDGTTF

SEQ ID NO: 497894 - protein, 9 aa, Mycobacterium
GTDHAGIAT

SEQ ID NO: 497895 - protein, 7 aa, Mycobacterium
GTDHRRR

SEQ ID NO: 497896 - protein, 10 aa, Mycobacterium
GTDHSPAPGT

SEQ ID NO: 497897 - protein, 9 aa, Mycobacterium
GTDISDANL

SEQ ID NO: 497898 - protein, 8 aa, Mycobacterium
GTDITDDA

SEQ ID NO: 497899 - protein, 8 aa, Mycobacterium
GTDITDEA

SEQ ID NO: 497900 - protein, 12 aa, Mycobacterium
GTDKEGLGTTTG

SEQ ID NO: 497901 - protein, 10 aa, Mycobacterium
GTDKHDADRT

SEQ ID NO: 497902 - protein, 5 aa, Mycobacterium
GTDKI

SEQ ID NO: 497903 - protein, 6 aa, Mycobacterium
GTDKTA

SEQ ID NO: 497904 - protein, 7 aa, Mycobacterium
GTDKYRA

SEQ ID NO: 497905 - protein, 4 aa, Mycobacterium
GTDL

SEQ ID NO: 497906 - protein, 7 aa, Mycobacterium
GTDLRGP

SEQ ID NO: 497907 - protein, 7 aa, Mycobacterium
GTDLRGV

SEQ ID NO: 497908 - protein, 8 aa, Mycobacterium
GTDLSDAQ

SEQ ID NO: 497909 - protein, 6 aa, Mycobacterium
GTDLSR

SEQ ID NO: 497910 - protein, 4 aa, Mycobacterium
GTDM

SEQ ID NO: 497911 - protein, 9 aa, Mycobacterium
GTDNESPAE

SEQ ID NO: 497912 - protein, 9 aa, Mycobacterium
GTDNPFRGS

SEQ ID NO: 497913 - protein, 27 aa, Mycobacterium
GTDNVGIGNSGTGNSGIGNTGSYNTGI

SEQ ID NO: 497914 - protein, 19 aa, Mycobacterium
GTDPASGEEITAQNGRYGP

SEQ ID NO: 497915 - protein, 9 aa, Mycobacterium
GTDPEGVAR

SEQ ID NO: 497916 - protein, 8 aa, Mycobacterium
GTDPELDQ

SEQ ID NO: 497917 - protein, 11 aa, Mycobacterium
GTDPESDGLSH

SEQ ID NO: 497918 - protein, 6 aa, Mycobacterium
GTDPGT

SEQ ID NO: 497919 - protein, 10 aa, Mycobacterium
GTDPLAVGPR

SEQ ID NO: 497920 - protein, 15 aa, Mycobacterium
GTDPLRRPERVNPGA

SEQ ID NO: 497921 - protein, 10 aa, Mycobacterium
GTDPPYGFSS

SEQ ID NO: 497922 - protein, 8 aa, Mycobacterium
GTDPSNVS

SEQ ID NO: 497923 - protein, 6 aa, Mycobacterium
GTDPSR

SEQ ID NO: 497924 - protein, 8 aa, Mycobacterium
GTDPSSDI

SEQ ID NO: 497925 - protein, 8 aa, Mycobacterium
GTDPSSNL

SEQ ID NO: 497926 - protein, 17 aa, Mycobacterium
GTDPTVYTTDPLKPGGY

SEQ ID NO: 497927 - protein, 19 aa, Mycobacterium
GTDPVTPREPVPTDGLLVR

SEQ ID NO: 497928 - protein, 6 aa, Mycobacterium
GTDQAG

SEQ ID NO: 497929 - protein, 5 aa, Mycobacterium
GTDQG

SEQ ID NO: 497930 - protein, 8 aa, Mycobacterium
GTDQGAVS

SEQ ID NO: 497931 - protein, 8 aa, Mycobacterium
GTDQHGDR

SEQ ID NO: 497932 - protein, 5 aa, Mycobacterium
GTDRA

SEQ ID NO: 497933 - protein, 8 aa, Mycobacterium
GTDRAERV

SEQ ID NO: 497934 - protein, 8 aa, Mycobacterium
GTDRAQPI

SEQ ID NO: 497935 - protein, 7 aa, Mycobacterium
GTDRDGI

SEQ ID NO: 497936 - protein, 22 aa, Mycobacterium
GTDRGGPGSSTRVERGAVTERQ

SEQ ID NO: 497937 - protein, 7 aa, Mycobacterium
GTDRMRG

SEQ ID NO: 497938 - protein, 6 aa, Mycobacterium
GTDRQL

SEQ ID NO: 497939 - protein, 10 aa, Mycobacterium
GTDRRPATAI

SEQ ID NO: 497940 - protein, 6 aa, Mycobacterium
GTDRTR

SEQ ID NO: 497941 - protein, 8 aa, Mycobacterium
GTDRVDPT

SEQ ID NO: 497942 - protein, 5 aa, Mycobacterium
GTDSA

SEQ ID NO: 497943 - protein, 8 aa, Mycobacterium
GTDSDPDL

SEQ ID NO: 497944 - protein, 13 aa, Mycobacterium
GTDSEPRKANLGI

SEQ ID NO: 497945 - protein, 11 aa, Mycobacterium
GTDSGGGAGIQ

SEQ ID NO: 497946 - protein, 10 aa, Mycobacterium
GTDSGSARQG

SEQ ID NO: 497947 - protein, 10 aa, Mycobacterium
GTDSHDTYAI

SEQ ID NO: 497948 - protein, 9 aa, Mycobacterium
GTDSHTTME

SEQ ID NO: 497949 - protein, 5 aa, Mycobacterium
GTDSL

SEQ ID NO: 497950 - protein, 6 aa, Mycobacterium
GTDSLN

SEQ ID NO: 497951 - protein, 15 aa, Mycobacterium
GTDSTGAQKPVEPED

SEQ ID NO: 497952 - protein, 5 aa, Mycobacterium
GTDTA

SEQ ID NO: 497953 - protein, 9 aa, Mycobacterium
GTDTAGSVR

SEQ ID NO: 497954 - protein, 10 aa, Mycobacterium
GTDTDGAEGA

SEQ ID NO: 497955 - protein, 6 aa, Mycobacterium
GTDTDW

SEQ ID NO: 497956 - protein, 7 aa, Mycobacterium
GTDTMEE

SEQ ID NO: 497957 - protein, 17 aa, Mycobacterium
GTDTPAPHSVRPPQRWQ

SEQ ID NO: 497958 - protein, 10 aa, Mycobacterium
GTDTPGGTGV

SEQ ID NO: 497959 - protein, 7 aa, Mycobacterium
GTDTTIE

SEQ ID NO: 497960 - protein, 9 aa, Mycobacterium
GTDTTRNQL

SEQ ID NO: 497961 - protein, 12 aa, Mycobacterium
GTDTTRNQLAAS

SEQ ID NO: 497962 - protein, 9 aa, Mycobacterium
GTDVARRSV

SEQ ID NO: 497963 - protein, 20 aa, Mycobacterium
GTDVCSSPIKGTLAATEDPA

SEQ ID NO: 497964 - protein, 7 aa, Mycobacterium
GTDVDGH

SEQ ID NO: 497965 - protein, 7 aa, Mycobacterium
GTDVPEP

SEQ ID NO: 497966 - protein, 6 aa, Mycobacterium
GTDVPH

SEQ ID NO: 497967 - protein, 9 aa, Mycobacterium
GTDVSGYGN

SEQ ID NO: 497968 - protein, 10 aa, Mycobacterium
GTDVTGVPAR

SEQ ID NO: 497969 - protein, 33 aa, Mycobacterium
GTDYEAAEAGRDGVLGTADDVQNDFEETPYSAA

SEQ ID NO: 497970 - protein, 13 aa, Mycobacterium
GTDYETDSDSRNV

SEQ ID NO: 497971 - protein, 8 aa, Mycobacterium
GTDYSQRT

SEQ ID NO: 497972 - protein, 22 aa, Mycobacterium
GTEADVRQAADAARDALAVLQG

SEQ ID NO: 497973 - protein, 16 aa, Mycobacterium
GTEADYQAAVREFGAS

SEQ ID NO: 497974 - protein, 5 aa, Mycobacterium
GTEAE

SEQ ID NO: 497975 - protein, 12 aa, Mycobacterium
GTEAGRAAAEAG

SEQ ID NO: 497976 - protein, 13 aa, Mycobacterium
GTEAGRAAANAGV

SEQ ID NO: 497977 - protein, 12 aa, Mycobacterium
GTEAGRAAARAG

SEQ ID NO: 497978 - protein, 12 aa, Mycobacterium
GTEAGRAARRAG

SEQ ID NO: 497979 - protein, 12 aa, Mycobacterium
GTEAGRTATQAG

SEQ ID NO: 497980 - protein, 7 aa, Mycobacterium
GTEANEA

SEQ ID NO: 497981 - protein, 6 aa, Mycobacterium
GTEAQK

SEQ ID NO: 497982 - protein, 8 aa, Mycobacterium
GTEAQKAK

SEQ ID NO: 497983 - protein, 9 aa, Mycobacterium
GTEAQKKEW

SEQ ID NO: 497984 - protein, 6 aa, Mycobacterium
GTEARQ

SEQ ID NO: 497985 - protein, 11 aa, Mycobacterium
GTEASPDDQAQ

SEQ ID NO: 497986 - protein, 7 aa, Mycobacterium
GTEASTW

SEQ ID NO: 497987 - protein, 5 aa, Mycobacterium
GTEAV

SEQ ID NO: 497988 - protein, 10 aa, Mycobacterium
GTEAVAEGNR

SEQ ID NO: 497989 - protein, 11 aa, Mycobacterium
GTEAVGEFPAD

SEQ ID NO: 497990 - protein, 4 aa, Mycobacterium
GTED

SEQ ID NO: 497991 - protein, 16 aa, Mycobacterium
GTEDAETAAVTEGKRV

SEQ ID NO: 497992 - protein, 6 aa, Mycobacterium
GTEDAL

SEQ ID NO: 497993 - protein, 14 aa, Mycobacterium
GTEDATLAYTPRDR

SEQ ID NO: 497994 - protein, 17 aa, Mycobacterium
GTEDPGTTSSGTPIVTV

SEQ ID NO: 497995 - protein, 5 aa, Mycobacterium
GTEDQ

SEQ ID NO: 497996 - protein, 7 aa, Mycobacterium
GTEDQKR

SEQ ID NO: 497997 - protein, 11 aa, Mycobacterium
GTEDQKRDRIS

SEQ ID NO: 497998 - protein, 9 aa, Mycobacterium
GTEEDGTPD

SEQ ID NO: 497999 - protein, 8 aa, Mycobacterium
GTEEDGVS

SEQ ID NO: 498000 - protein, 11 aa, Mycobacterium
GTEEDNAGTQV

SEQ ID NO: 498001 - protein, 14 aa, Mycobacterium
GTEEPDTGGLEPGH

SEQ ID NO: 498002 - protein, 11 aa, Mycobacterium
GTEEPSYRAEQ

SEQ ID NO: 498003 - protein, 5 aa, Mycobacterium
GTEEQ

SEQ ID NO: 498004 - protein, 7 aa, Mycobacterium
GTEEQKA

SEQ ID NO: 498005 - protein, 8 aa, Mycobacterium
GTEEQKAK

SEQ ID NO: 498006 - protein, 7 aa, Mycobacterium
GTEEQKH

SEQ ID NO: 498007 - protein, 8 aa, Mycobacterium
GTEEQKKE

SEQ ID NO: 498008 - protein, 9 aa, Mycobacterium
GTEEQKQKY

SEQ ID NO: 498009 - protein, 9 aa, Mycobacterium
GTEEQKREW

SEQ ID NO: 498010 - protein, 8 aa, Mycobacterium
GTEEQQRR

SEQ ID NO: 498011 - protein, 8 aa, Mycobacterium
GTEEQRRR

SEQ ID NO: 498012 - protein, 6 aa, Mycobacterium
GTEFDD

SEQ ID NO: 498013 - protein, 5 aa, Mycobacterium
GTEFG

SEQ ID NO: 498014 - protein, 8 aa, Mycobacterium
GTEGAAQR

SEQ ID NO: 498015 - protein, 6 aa, Mycobacterium
GTEGAG

SEQ ID NO: 498016 - protein, 11 aa, Mycobacterium
GTEGDITYSTN

SEQ ID NO: 498017 - protein, 9 aa, Mycobacterium
GTEGGLAQQ

SEQ ID NO: 498018 - protein, 16 aa, Mycobacterium
GTEGGYLSGGRSEMST

SEQ ID NO: 498019 - protein, 14 aa, Mycobacterium
GTEGITVEEDPSMG

SEQ ID NO: 498020 - protein, 5 aa, Mycobacterium
GTEGL

SEQ ID NO: 498021 - protein, 13 aa, Mycobacterium
GTEGPYTGNGGAL

SEQ ID NO: 498022 - protein, 12 aa, Mycobacterium
GTEGPYTGTGGA

SEQ ID NO: 498023 - protein, 21 aa, Mycobacterium
GTEGPYTGTGGAIRTGTPHEV

SEQ ID NO: 498024 - protein, 6 aa, Mycobacterium
GTEGQG

SEQ ID NO: 498025 - protein, 22 aa, Mycobacterium
GTEGRKGNLDAAETERERAEAE

SEQ ID NO: 498026 - protein, 15 aa, Mycobacterium
GTEGTAASANDNAME

SEQ ID NO: 498027 - protein, 5 aa, Mycobacterium
GTEGV

SEQ ID NO: 498028 - protein, 5 aa, Mycobacterium
GTEHD

SEQ ID NO: 498029 - protein, 8 aa, Mycobacterium
GTEHQQSE

SEQ ID NO: 498030 - protein, 8 aa, Mycobacterium
GTEHRPGP

SEQ ID NO: 498031 - protein, 8 aa, Mycobacterium
GTEHRPSD

SEQ ID NO: 498032 - protein, 23 aa, Mycobacterium
GTEHTADRAESAGWTSPLRSAGP

SEQ ID NO: 498033 - protein, 4 aa, Mycobacterium
GTEI

SEQ ID NO: 498034 - protein, 5 aa, Mycobacterium
GTEIN

SEQ ID NO: 498035 - protein, 10 aa, Mycobacterium
GTEITRERGQ

SEQ ID NO: 498036 - protein, 10 aa, Mycobacterium
GTEKNDHPAV

SEQ ID NO: 498037 - protein, 14 aa, Mycobacterium
GTEKPDAGHLEPGH

SEQ ID NO: 498038 - protein, 8 aa, Mycobacterium
GTEKSPGF

SEQ ID NO: 498039 - protein, 5 aa, Mycobacterium
GTELA

SEQ ID NO: 498040 - protein, 8 aa, Mycobacterium
GTELDSDA

SEQ ID NO: 498041 - protein, 8 aa, Mycobacterium
GTELDTDT

SEQ ID NO: 498042 - protein, 8 aa, Mycobacterium
GTELGGDV

SEQ ID NO: 498043 - protein, 15 aa, Mycobacterium
GTELQRAEASPAQAL

SEQ ID NO: 498044 - protein, 8 aa, Mycobacterium
GTELRRTD

SEQ ID NO: 498045 - protein, 8 aa, Mycobacterium
GTELSDTQ

SEQ ID NO: 498046 - protein, 6 aa, Mycobacterium
GTELTD

SEQ ID NO: 498047 - protein, 20 aa, Mycobacterium
GTELTGGQSFGEVESTKSVS

SEQ ID NO: 498048 - protein, 8 aa, Mycobacterium
GTEMTPED

SEQ ID NO: 498049 - protein, 12 aa, Mycobacterium
GTENPDGADAAA

SEQ ID NO: 498050 - protein, 8 aa, Mycobacterium
GTENPDGN

SEQ ID NO: 498051 - protein, 11 aa, Mycobacterium
GTENPDGPIAV

SEQ ID NO: 498052 - protein, 10 aa, Mycobacterium
GTENPDGPLA

SEQ ID NO: 498053 - protein, 24 aa, Mycobacterium
GTENPDGPLADSATRIGDEDPDFA

SEQ ID NO: 498054 - protein, 8 aa, Mycobacterium
GTENPGGA

SEQ ID NO: 498055 - protein, 23 aa, Mycobacterium
GTENPSGPTAVSATAIGDEDPAF

SEQ ID NO: 498056 - protein, 7 aa, Mycobacterium
GTENREA

SEQ ID NO: 498057 - protein, 5 aa, Mycobacterium
GTEPA

SEQ ID NO: 498058 - protein, 6 aa, Mycobacterium
GTEPDL

SEQ ID NO: 498059 - protein, 6 aa, Mycobacterium
GTEPEG

SEQ ID NO: 498060 - protein, 6 aa, Mycobacterium
GTEPEH

SEQ ID NO: 498061 - protein, 8 aa, Mycobacterium
GTEPGRPE

SEQ ID NO: 498062 - protein, 6 aa, Mycobacterium
GTEPNL

SEQ ID NO: 498063 - protein, 5 aa, Mycobacterium
GTEPP

SEQ ID NO: 498064 - protein, 9 aa, Mycobacterium
GTEPPASGF

SEQ ID NO: 498065 - protein, 8 aa, Mycobacterium
GTEPPEQE

SEQ ID NO: 498066 - protein, 17 aa, Mycobacterium
GTEPPGYRLQPLLLPSL

SEQ ID NO: 498067 - protein, 9 aa, Mycobacterium
GTEPPSRET

SEQ ID NO: 498068 - protein, 7 aa, Mycobacterium
GTEPPTH

SEQ ID NO: 498069 - protein, 5 aa, Mycobacterium
GTEPS

SEQ ID NO: 498070 - protein, 7 aa, Mycobacterium
GTEPSVA

SEQ ID NO: 498071 - protein, 11 aa, Mycobacterium
GTEPYTTDHAP

SEQ ID NO: 498072 - protein, 6 aa, Mycobacterium
GTEQNL

SEQ ID NO: 498073 - protein, 6 aa, Mycobacterium
GTEQVS

SEQ ID NO: 498074 - protein, 5 aa, Mycobacterium
GTERA

SEQ ID NO: 498075 - protein, 14 aa, Mycobacterium
GTERAEALRRYHDI

SEQ ID NO: 498076 - protein, 14 aa, Mycobacterium
GTERAEALRRYRGM

SEQ ID NO: 498077 - protein, 7 aa, Mycobacterium
GTERAGH

SEQ ID NO: 498078 - protein, 9 aa, Mycobacterium
GTERGEAAT

SEQ ID NO: 498079 - protein, 6 aa, Mycobacterium
GTERGL

SEQ ID NO: 498080 - protein, 5 aa, Mycobacterium
GTERI

SEQ ID NO: 498081 - protein, 8 aa, Mycobacterium
GTERNKSE

SEQ ID NO: 498082 - protein, 15 aa, Mycobacterium
GTERPPALESGSPIR

SEQ ID NO: 498083 - protein, 7 aa, Mycobacterium
GTERQKQ

SEQ ID NO: 498084 - protein, 6 aa, Mycobacterium
GTERTR

SEQ ID NO: 498085 - protein, 7 aa, Mycobacterium
GTESDPL

SEQ ID NO: 498086 - protein, 7 aa, Mycobacterium
GTESGYR

SEQ ID NO: 498087 - protein, 6 aa, Mycobacterium
GTESNL

SEQ ID NO: 498088 - protein, 5 aa, Mycobacterium
GTESP

SEQ ID NO: 498089 - protein, 6 aa, Mycobacterium
GTESQK

SEQ ID NO: 498090 - protein, 8 aa, Mycobacterium
GTESQKRT

SEQ ID NO: 498091 - protein, 29 aa, Mycobacterium
GTESRSTASVRDHRYRDDGRDPRRGQGRL

SEQ ID NO: 498092 - protein, 9 aa, Mycobacterium
GTESRTPSA

SEQ ID NO: 498093 - protein, 4 aa, Mycobacterium
GTET

SEQ ID NO: 498094 - protein, 5 aa, Mycobacterium
GTETA

SEQ ID NO: 498095 - protein, 15 aa, Mycobacterium
GTETAAIPSLPAVFK

SEQ ID NO: 498096 - protein, 10 aa, Mycobacterium
GTETAANERT

SEQ ID NO: 498097 - protein, 28 aa, Mycobacterium
GTETGGRRAGTGAHNNENLSQRAKWSSE

SEQ ID NO: 498098 - protein, 8 aa, Mycobacterium
GTETQKDE

SEQ ID NO: 498099 - protein, 7 aa, Mycobacterium
GTETQKR

SEQ ID NO: 498100 - protein, 11 aa, Mycobacterium
GTETTEPRPEA

SEQ ID NO: 498101 - protein, 8 aa, Mycobacterium
GTETTTKL

SEQ ID NO: 498102 - protein, 14 aa, Mycobacterium
GTEVDAARGIGGSD

SEQ ID NO: 498103 - protein, 13 aa, Mycobacterium
GTEVDGGRRVGGA

SEQ ID NO: 498104 - protein, 14 aa, Mycobacterium
GTEVEPLEREERAR

SEQ ID NO: 498105 - protein, 6 aa, Mycobacterium
GTEVGR

SEQ ID NO: 498106 - protein, 6 aa, Mycobacterium
GTEVPA

SEQ ID NO: 498107 - protein, 9 aa, Mycobacterium
GTEVPPGVP

SEQ ID NO: 498108 - protein, 6 aa, Mycobacterium
GTEVPR

SEQ ID NO: 498109 - protein, 4 aa, Mycobacterium
GTFA

SEQ ID NO: 498110 - protein, 40 aa, Mycobacterium
GTFAGRGAAEFSRRRTTRAARAGAESPLNVRTRNGAPTVD

SEQ ID NO: 498111 - protein, 6 aa, Mycobacterium
GTFAPT

SEQ ID NO: 498112 - protein, 6 aa, Mycobacterium
GTFATG

SEQ ID NO: 498113 - protein, 6 aa, Mycobacterium
GTFDNT

SEQ ID NO: 498114 - protein, 5 aa, Mycobacterium
GTFEG

SEQ ID NO: 498115 - protein, 9 aa, Mycobacterium
GTFESNGHS

SEQ ID NO: 498116 - protein, 11 aa, Mycobacterium
GTFGSAGEFEP

SEQ ID NO: 498117 - protein, 8 aa, Mycobacterium
GTFGSAGQ

SEQ ID NO: 498118 - protein, 11 aa, Mycobacterium
GTFGSGGEFEP

SEQ ID NO: 498119 - protein, 6 aa, Mycobacterium
GTFGST

SEQ ID NO: 498120 - protein, 6 aa, Mycobacterium
GTFGTE

SEQ ID NO: 498121 - protein, 10 aa, Mycobacterium
GTFQADRAGY

SEQ ID NO: 498122 - protein, 11 aa, Mycobacterium
GTFSPAPPREA

SEQ ID NO: 498123 - protein, 5 aa, Mycobacterium
GTFTS

SEQ ID NO: 498124 - protein, 10 aa, Mycobacterium
GTGAARETGV

SEQ ID NO: 498125 - protein, 6 aa, Mycobacterium
GTGADL

SEQ ID NO: 498126 - protein, 7 aa, Mycobacterium
GTGADTT

SEQ ID NO: 498127 - protein, 90 aa, Mycobacterium
GTGAGGNGGHGGDPGSGGAGGAGGAGSSAGAAGAGGLSPTTGGNGGNGGRGADGYGTGISGASGGAGGDGGRYGNGGDGGAGGDGMGGAS

SEQ ID NO: 498128 - protein, 10 aa, Mycobacterium
GTGAGPLDQV

SEQ ID NO: 498129 - protein, 6 aa, Mycobacterium
GTGAIQ

SEQ ID NO: 498130 - protein, 8 aa, Mycobacterium
GTGAPGRA

SEQ ID NO: 498131 - protein, 13 aa, Mycobacterium
GTGAPRQLTTETQ

SEQ ID NO: 498132 - protein, 8 aa, Mycobacterium
GTGAPSAI

SEQ ID NO: 498133 - protein, 10 aa, Mycobacterium
GTGAPSARRN

SEQ ID NO: 498134 - protein, 11 aa, Mycobacterium
GTGAPSDNPHA

SEQ ID NO: 498135 - protein, 6 aa, Mycobacterium
GTGAPY

SEQ ID NO: 498136 - protein, 9 aa, Mycobacterium
GTGAQPGEH

SEQ ID NO: 498137 - protein, 7 aa, Mycobacterium
GTGASTA

SEQ ID NO: 498138 - protein, 5 aa, Mycobacterium
GTGAT

SEQ ID NO: 498139 - protein, 10 aa, Mycobacterium
GTGATDETGV

SEQ ID NO: 498140 - protein, 6 aa, Mycobacterium
GTGATG

SEQ ID NO: 498141 - protein, 13 aa, Mycobacterium
GTGATNHRQPRSL

SEQ ID NO: 498142 - protein, 6 aa, Mycobacterium
GTGATV

SEQ ID NO: 498143 - protein, 6 aa, Mycobacterium
GTGAVV

SEQ ID NO: 498144 - protein, 9 aa, Mycobacterium
GTGCRSGEH

SEQ ID NO: 498145 - protein, 5 aa, Mycobacterium
GTGCS

SEQ ID NO: 498146 - protein, 16 aa, Mycobacterium
GTGCSAQAGSGNFNAA

SEQ ID NO: 498147 - protein, 9 aa, Mycobacterium
GTGDDAGQA

SEQ ID NO: 498148 - protein, 16 aa, Mycobacterium
GTGDDGVTVDPAPPLT

SEQ ID NO: 498149 - protein, 6 aa, Mycobacterium
GTGDDI

SEQ ID NO: 498150 - protein, 5 aa, Mycobacterium
GTGDE

SEQ ID NO: 498151 - protein, 7 aa, Mycobacterium
GTGDEGA

SEQ ID NO: 498152 - protein, 11 aa, Mycobacterium
GTGDPKIESSI

SEQ ID NO: 498153 - protein, 5 aa, Mycobacterium
GTGDQ

SEQ ID NO: 498154 - protein, 10 aa, Mycobacterium
GTGDTPVGTS

SEQ ID NO: 498155 - protein, 6 aa, Mycobacterium
GTGDVE

SEQ ID NO: 498156 - protein, 4 aa, Mycobacterium
GTGE

SEQ ID NO: 498157 - protein, 13 aa, Mycobacterium
GTGEAPGVGPTGQ

SEQ ID NO: 498158 - protein, 6 aa, Mycobacterium
GTGEHA

SEQ ID NO: 498159 - protein, 11 aa, Mycobacterium
GTGEPPGVGGV

SEQ ID NO: 498160 - protein, 15 aa, Mycobacterium
GTGEPQELSRKESPS

SEQ ID NO: 498161 - protein, 15 aa, Mycobacterium
GTGEPQPSGSRLKQA

SEQ ID NO: 498162 - protein, 6 aa, Mycobacterium
GTGEPT

SEQ ID NO: 498163 - protein, 30 aa, Mycobacterium
GTGEQPQIPGPPQATLPQSPDGQGPAQDRI

SEQ ID NO: 498164 - protein, 12 aa, Mycobacterium
GTGEREGNEPYG

SEQ ID NO: 498165 - protein, 9 aa, Mycobacterium
GTGERPGPL

SEQ ID NO: 498166 - protein, 15 aa, Mycobacterium
GTGFGNSTTSPSSGF

SEQ ID NO: 498167 - protein, 13 aa, Mycobacterium
GTGFPPPDAPPGY

SEQ ID NO: 498168 - protein, 6 aa, Mycobacterium
GTGFTD

SEQ ID NO: 498169 - protein, 7 aa, Mycobacterium
GTGFTER

SEQ ID NO: 498170 - protein, 5 aa, Mycobacterium
GTGGA

SEQ ID NO: 498171 - protein, 10 aa, Mycobacterium
GTGGAARELD

SEQ ID NO: 498172 - protein, 12 aa, Mycobacterium
GTGGAATNAKHK

SEQ ID NO: 498173 - protein, 12 aa, Mycobacterium
GTGGAGGAGGAA

SEQ ID NO: 498174 - protein, 32 aa, Mycobacterium
GTGGAGGAGGAGGTAVGGSLTANGGAGGAGGL

SEQ ID NO: 498175 - protein, 14 aa, Mycobacterium
GTGGAGGAGGAGGV

SEQ ID NO: 498176 - protein, 15 aa, Mycobacterium
GTGGAGGAGGFGTAN

SEQ ID NO: 498177 - protein, 62 aa, Mycobacterium
GTGGAGGAGGFSPATGTGAGGVGGAGGAGGLFGGGGGGGVGGGSLAGPGGGGGAGGAGGPLS

SEQ ID NO: 498178 - protein, 14 aa, Mycobacterium
GTGGAGGAGGGTIL

SEQ ID NO: 498179 - protein, 28 aa, Mycobacterium
GTGGAGGAGGLSLAGGGAGGDGGVGGGG

SEQ ID NO: 498180 - protein, 26 aa, Mycobacterium
GTGGAGGAGGRTFNGDGGNGGAGGAG

SEQ ID NO: 498181 - protein, 26 aa, Mycobacterium
GTGGAGGAGGSGVAGAGGVGGAGGNA

SEQ ID NO: 498182 - protein, 26 aa, Mycobacterium
GTGGAGGHGGLGSVGAAGTNPSGPYL

SEQ ID NO: 498183 - protein, 11 aa, Mycobacterium
GTGGAGGNGGF

SEQ ID NO: 498184 - protein, 17 aa, Mycobacterium
GTGGAGGTGGAGGTNGL

SEQ ID NO: 498185 - protein, 30 aa, Mycobacterium
GTGGAGGTGGDNSLGLTGQGGQGGDGGYGG

SEQ ID NO: 498186 - protein, 25 aa, Mycobacterium
GTGGAGGTGGFGSTSGAAGGTGGDG

SEQ ID NO: 498187 - protein, 6 aa, Mycobacterium
GTGGAT

SEQ ID NO: 498188 - protein, 6 aa, Mycobacterium
GTGGDG

SEQ ID NO: 498189 - protein, 10 aa, Mycobacterium
GTGGDGANTV

SEQ ID NO: 498190 - protein, 11 aa, Mycobacterium
GTGGDGANTVN

SEQ ID NO: 498191 - protein, 9 aa, Mycobacterium
GTGGDGGHA

SEQ ID NO: 498192 - protein, 23 aa, Mycobacterium
GTGGDGGQGGLGGSGGTAEQAAT

SEQ ID NO: 498193 - protein, 7 aa, Mycobacterium
GTGGDGH

SEQ ID NO: 498194 - protein, 8 aa, Mycobacterium
GTGGDGVN

SEQ ID NO: 498195 - protein, 9 aa, Mycobacterium
GTGGDGVNT

SEQ ID NO: 498196 - protein, 7 aa, Mycobacterium
GTGGFGA

SEQ ID NO: 498197 - protein, 8 aa, Mycobacterium
GTGGGAER

SEQ ID NO: 498198 - protein, 9 aa, Mycobacterium
GTGGGDGGL

SEQ ID NO: 498199 - protein, 9 aa, Mycobacterium
GTGGGEARA

SEQ ID NO: 498200 - protein, 8 aa, Mycobacterium
GTGGGELA

SEQ ID NO: 498201 - protein, 7 aa, Mycobacterium
GTGGGQG

SEQ ID NO: 498202 - protein, 5 aa, Mycobacterium
GTGGH

SEQ ID NO: 498203 - protein, 9 aa, Mycobacterium
GTGGHSSGV

SEQ ID NO: 498204 - protein, 12 aa, Mycobacterium
GTGGKDLTVEEA

SEQ ID NO: 498205 - protein, 6 aa, Mycobacterium
GTGGLD

SEQ ID NO: 498206 - protein, 8 aa, Mycobacterium
GTGGLGEA

SEQ ID NO: 498207 - protein, 33 aa, Mycobacterium
GTGGLGGLGGNGGAATTAGTNGGAGGDGGLGGR

SEQ ID NO: 498208 - protein, 7 aa, Mycobacterium
GTGGLGP

SEQ ID NO: 498209 - protein, 5 aa, Mycobacterium
GTGGM

SEQ ID NO: 498210 - protein, 5 aa, Mycobacterium
GTGGN

SEQ ID NO: 498211 - protein, 20 aa, Mycobacterium
GTGGNGGAGGIGAAGGMGGA

SEQ ID NO: 498212 - protein, 13 aa, Mycobacterium
GTGGNGGAGGSAG

SEQ ID NO: 498213 - protein, 33 aa, Mycobacterium
GTGGNGGNGGTPTGSGGHGGSGGLLGQDGLNGL

SEQ ID NO: 498214 - protein, 30 aa, Mycobacterium
GTGGNGGNPGLGVPAGTAGEAGAPGLATSN

SEQ ID NO: 498215 - protein, 9 aa, Mycobacterium
GTGGPSAVR

SEQ ID NO: 498216 - protein, 14 aa, Mycobacterium
GTGGQDLSVEQAEQ

SEQ ID NO: 498217 - protein, 11 aa, Mycobacterium
GTGGQRQVPGA

SEQ ID NO: 498218 - protein, 7 aa, Mycobacterium
GTGGQSL

SEQ ID NO: 498219 - protein, 13 aa, Mycobacterium
GTGGRDLSVEEAE

SEQ ID NO: 498220 - protein, 6 aa, Mycobacterium
GTGGRT

SEQ ID NO: 498221 - protein, 29 aa, Mycobacterium
GTGGSGGAGAAGIGGGLTGGAGGAGGAGG

SEQ ID NO: 498222 - protein, 141 aa, Mycobacterium
GTGGSGSQSATTGTSTSGVTSGSVASGSAAGSVSSGATAGTVSTGATTGSVSSGATAGTVSAGATDGAVTSGTTASSSDGTTVSAGGVAATDPGSDGGVAVSDPGSDGGVAVSGSGSGSGVAVGGTDTPGTSAPAPVTPNT

SEQ ID NO: 498223 - protein, 25 aa, Mycobacterium
GTGGSPGQEPVGINDQTPRWAVELC

SEQ ID NO: 498224 - protein, 15 aa, Mycobacterium
GTGGTDLTVEQAEQS

SEQ ID NO: 498225 - protein, 28 aa, Mycobacterium
GTGGTGGAGARSTTGNGGAGGAGGAGGW

SEQ ID NO: 498226 - protein, 25 aa, Mycobacterium
GTGGTGGAGGRGGTGGDGGAGGAGG

SEQ ID NO: 498227 - protein, 33 aa, Mycobacterium
GTGGTGGAGGSGGTDSISGIAGGDGGAGGAGGW

SEQ ID NO: 498228 - protein, 27 aa, Mycobacterium
GTGGTGGAGGTSTGGLGGAGGEGGAGG

SEQ ID NO: 498229 - protein, 15 aa, Mycobacterium
GTGGTGGAGGVGGAS

SEQ ID NO: 498230 - protein, 34 aa, Mycobacterium
GTGGTGGAGGWGGTDEITGGTGGAGGTGGGGGWL

SEQ ID NO: 498231 - protein, 35 aa, Mycobacterium
GTGGTGGTGGTGGAANPFGAAGGSGGSGGAGGAGG

SEQ ID NO: 498232 - protein, 11 aa, Mycobacterium
GTGGTITGTGR

SEQ ID NO: 498233 - protein, 7 aa, Mycobacterium
GTGGTLT

SEQ ID NO: 498234 - protein, 33 aa, Mycobacterium
GTGGVGGVGGAATGGGATIGADGGTGGNGGNAT

SEQ ID NO: 498235 - protein, 5 aa, Mycobacterium
GTGGW

SEQ ID NO: 498236 - protein, 12 aa, Mycobacterium
GTGGYSELDEET

SEQ ID NO: 498237 - protein, 8 aa, Mycobacterium
GTGHHGGY

SEQ ID NO: 498238 - protein, 6 aa, Mycobacterium
GTGHRP

SEQ ID NO: 498239 - protein, 5 aa, Mycobacterium
GTGHS

SEQ ID NO: 498240 - protein, 10 aa, Mycobacterium
GTGHTSAVPQ

SEQ ID NO: 498241 - protein, 6 aa, Mycobacterium
GTGIDD

SEQ ID NO: 498242 - protein, 5 aa, Mycobacterium
GTGIG

SEQ ID NO: 498243 - protein, 6 aa, Mycobacterium
GTGIGR

SEQ ID NO: 498244 - protein, 11 aa, Mycobacterium
GTGIKSPEDLV

SEQ ID NO: 498245 - protein, 10 aa, Mycobacterium
GTGINPDDLA

SEQ ID NO: 498246 - protein, 6 aa, Mycobacterium
GTGIST

SEQ ID NO: 498247 - protein, 10 aa, Mycobacterium
GTGISYEAGD

SEQ ID NO: 498248 - protein, 6 aa, Mycobacterium
GTGKSA

SEQ ID NO: 498249 - protein, 5 aa, Mycobacterium
GTGKT

SEQ ID NO: 498250 - protein, 5 aa, Mycobacterium
GTGKV

SEQ ID NO: 498251 - protein, 7 aa, Mycobacterium
GTGLDDD

SEQ ID NO: 498252 - protein, 6 aa, Mycobacterium
GTGLPG

SEQ ID NO: 498253 - protein, 7 aa, Mycobacterium
GTGLPNA

SEQ ID NO: 498254 - protein, 22 aa, Mycobacterium
GTGLPRQPGGAITAGAALTADA

SEQ ID NO: 498255 - protein, 8 aa, Mycobacterium
GTGLSDPA

SEQ ID NO: 498256 - protein, 9 aa, Mycobacterium
GTGLSEADL

SEQ ID NO: 498257 - protein, 4 aa, Mycobacterium
GTGM

SEQ ID NO: 498258 - protein, 5 aa, Mycobacterium
GTGMA

SEQ ID NO: 498259 - protein, 10 aa, Mycobacterium
GTGMGGGTSM

SEQ ID NO: 498260 - protein, 6 aa, Mycobacterium
GTGMPE

SEQ ID NO: 498261 - protein, 5 aa, Mycobacterium
GTGNA

SEQ ID NO: 498262 - protein, 6 aa, Mycobacterium
GTGNAE

SEQ ID NO: 498263 - protein, 7 aa, Mycobacterium
GTGNAEL

SEQ ID NO: 498264 - protein, 5 aa, Mycobacterium
GTGND

SEQ ID NO: 498265 - protein, 6 aa, Mycobacterium
GTGNDE

SEQ ID NO: 498266 - protein, 8 aa, Mycobacterium
GTGNDHAR

SEQ ID NO: 498267 - protein, 14 aa, Mycobacterium
GTGNDLDSGAARDA

SEQ ID NO: 498268 - protein, 22 aa, Mycobacterium
GTGNERNGGASGSVSTTARRVE

SEQ ID NO: 498269 - protein, 5 aa, Mycobacterium
GTGNF

SEQ ID NO: 498270 - protein, 26 aa, Mycobacterium
GTGNFGIGNSGNYNTGIANAGGTNTG

SEQ ID NO: 498271 - protein, 16 aa, Mycobacterium
GTGNFGIGNSGTGNWG

SEQ ID NO: 498272 - protein, 10 aa, Mycobacterium
GTGNGGDETI

SEQ ID NO: 498273 - protein, 11 aa, Mycobacterium
GTGNGNDTVTS

SEQ ID NO: 498274 - protein, 34 aa, Mycobacterium
GTGNIGSGNTGNDNLGGGNNGPSSAGGGNGNVGL

SEQ ID NO: 498275 - protein, 20 aa, Mycobacterium
GTGNPAPDFDGAVREGDNLY

SEQ ID NO: 498276 - protein, 19 aa, Mycobacterium
GTGNRAGSTGPSSPTDTGI

SEQ ID NO: 498277 - protein, 27 aa, Mycobacterium
GTGNRAGSTGPSSPTDTGIATVPTAAP

SEQ ID NO: 498278 - protein, 53 aa, Mycobacterium
GTGNSGFGHNDPSGSGNSGLQNSGFGNSGYVNTSTTSTFGGNSGALDTGYGNA

SEQ ID NO: 498279 - protein, 9 aa, Mycobacterium
GTGNTGSFN

SEQ ID NO: 498280 - protein, 10 aa, Mycobacterium
GTGPAAGPGY

SEQ ID NO: 498281 - protein, 10 aa, Mycobacterium
GTGPAVGPGY

SEQ ID NO: 498282 - protein, 12 aa, Mycobacterium
GTGPDTAALAPK

SEQ ID NO: 498283 - protein, 5 aa, Mycobacterium
GTGPE

SEQ ID NO: 498284 - protein, 5 aa, Mycobacterium
GTGPF

SEQ ID NO: 498285 - protein, 8 aa, Mycobacterium
GTGPGAAR

SEQ ID NO: 498286 - protein, 10 aa, Mycobacterium
GTGPGDRDEP

SEQ ID NO: 498287 - protein, 7 aa, Mycobacterium
GTGPGDS

SEQ ID NO: 498288 - protein, 16 aa, Mycobacterium
GTGPGRVEKGIRTGAV

SEQ ID NO: 498289 - protein, 10 aa, Mycobacterium
GTGPGVGPGY

SEQ ID NO: 498290 - protein, 5 aa, Mycobacterium
GTGPH

SEQ ID NO: 498291 - protein, 11 aa, Mycobacterium
GTGPIRNATPA

SEQ ID NO: 498292 - protein, 7 aa, Mycobacterium
GTGPKRT

SEQ ID NO: 498293 - protein, 9 aa, Mycobacterium
GTGPPRESV

SEQ ID NO: 498294 - protein, 7 aa, Mycobacterium
GTGPQVA

SEQ ID NO: 498295 - protein, 5 aa, Mycobacterium
GTGPR

SEQ ID NO: 498296 - protein, 11 aa, Mycobacterium
GTGPTVSTTTA

SEQ ID NO: 498297 - protein, 8 aa, Mycobacterium
GTGQGESA

SEQ ID NO: 498298 - protein, 5 aa, Mycobacterium
GTGQH

SEQ ID NO: 498299 - protein, 8 aa, Mycobacterium
GTGQTGAT

SEQ ID NO: 498300 - protein, 9 aa, Mycobacterium
GTGQTGATY

SEQ ID NO: 498301 - protein, 7 aa, Mycobacterium
GTGQTIG

SEQ ID NO: 498302 - protein, 8 aa, Mycobacterium
GTGQTKYV

SEQ ID NO: 498303 - protein, 10 aa, Mycobacterium
GTGQTLTVPS

SEQ ID NO: 498304 - protein, 20 aa, Mycobacterium
GTGQVQGGEVGVDASGSSQF

SEQ ID NO: 498305 - protein, 13 aa, Mycobacterium
GTGQVSGNVPNGT

SEQ ID NO: 498306 - protein, 14 aa, Mycobacterium
GTGQVSGTVPAGTT

SEQ ID NO: 498307 - protein, 11 aa, Mycobacterium
GTGRAADRDRA

SEQ ID NO: 498308 - protein, 10 aa, Mycobacterium
GTGRATRTVN

SEQ ID NO: 498309 - protein, 9 aa, Mycobacterium
GTGRGEAAT

SEQ ID NO: 498310 - protein, 28 aa, Mycobacterium
GTGRGFSSGAGMSAQDMGRKTSTSSLTE

SEQ ID NO: 498311 - protein, 12 aa, Mycobacterium
GTGRGGAELDTA

SEQ ID NO: 498312 - protein, 10 aa, Mycobacterium
GTGRGGQRDQ

SEQ ID NO: 498313 - protein, 8 aa, Mycobacterium
GTGRHGGY

SEQ ID NO: 498314 - protein, 6 aa, Mycobacterium
GTGRML

SEQ ID NO: 498315 - protein, 7 aa, Mycobacterium
GTGRPAA

SEQ ID NO: 498316 - protein, 9 aa, Mycobacterium
GTGRPAGPA

SEQ ID NO: 498317 - protein, 11 aa, Mycobacterium
GTGRPDGVDKG

SEQ ID NO: 498318 - protein, 6 aa, Mycobacterium
GTGRPL

SEQ ID NO: 498319 - protein, 7 aa, Mycobacterium
GTGRPVV

SEQ ID NO: 498320 - protein, 7 aa, Mycobacterium
GTGRQGD

SEQ ID NO: 498321 - protein, 8 aa, Mycobacterium
GTGRQYAR

SEQ ID NO: 498322 - protein, 5 aa, Mycobacterium
GTGRR

SEQ ID NO: 498323 - protein, 6 aa, Mycobacterium
GTGRRT

SEQ ID NO: 498324 - protein, 12 aa, Mycobacterium
GTGRRYQSAGRD

SEQ ID NO: 498325 - protein, 6 aa, Mycobacterium
GTGRSR

SEQ ID NO: 498326 - protein, 19 aa, Mycobacterium
GTGRTIDGYPSLKADGSTA

SEQ ID NO: 498327 - protein, 17 aa, Mycobacterium
GTGSAALAAAAAGADVT

SEQ ID NO: 498328 - protein, 16 aa, Mycobacterium
GTGSAALDAAARGARV

SEQ ID NO: 498329 - protein, 16 aa, Mycobacterium
GTGSASHVTAYVCCPS

SEQ ID NO: 498330 - protein, 9 aa, Mycobacterium
GTGSATSAD

SEQ ID NO: 498331 - protein, 24 aa, Mycobacterium
GTGSCDAGGGRYGNAGGGSIALRS

SEQ ID NO: 498332 - protein, 9 aa, Mycobacterium
GTGSDQSQY

SEQ ID NO: 498333 - protein, 9 aa, Mycobacterium
GTGSEVASD

SEQ ID NO: 498334 - protein, 26 aa, Mycobacterium
GTGSFGIGNSGNYNTGIGNAGATNTG

SEQ ID NO: 498335 - protein, 12 aa, Mycobacterium
GTGSGLSAHTSG

SEQ ID NO: 498336 - protein, 5 aa, Mycobacterium
GTGSL

SEQ ID NO: 498337 - protein, 6 aa, Mycobacterium
GTGSLP

SEQ ID NO: 498338 - protein, 8 aa, Mycobacterium
GTGSPFQP

SEQ ID NO: 498339 - protein, 9 aa, Mycobacterium
GTGSPGTNL

SEQ ID NO: 498340 - protein, 9 aa, Mycobacterium
GTGSRTAPL

SEQ ID NO: 498341 - protein, 12 aa, Mycobacterium
GTGSSDDEQRDQ

SEQ ID NO: 498342 - protein, 7 aa, Mycobacterium
GTGSSGV

SEQ ID NO: 498343 - protein, 11 aa, Mycobacterium
GTGSSPVDLDP

SEQ ID NO: 498344 - protein, 9 aa, Mycobacterium
GTGSSRPMP

SEQ ID NO: 498345 - protein, 6 aa, Mycobacterium
GTGSVA

SEQ ID NO: 498346 - protein, 9 aa, Mycobacterium
GTGSVAGGT

SEQ ID NO: 498347 - protein, 11 aa, Mycobacterium
GTGSVTDDELG

SEQ ID NO: 498348 - protein, 8 aa, Mycobacterium
GTGSYGAG

SEQ ID NO: 498349 - protein, 7 aa, Mycobacterium
GTGTESI

SEQ ID NO: 498350 - protein, 18 aa, Mycobacterium
GTGTESIEPVEHSDGSAT

SEQ ID NO: 498351 - protein, 19 aa, Mycobacterium
GTGTESIESVDHPDGSTSM

SEQ ID NO: 498352 - protein, 12 aa, Mycobacterium
GTGTLTARPGAQ

SEQ ID NO: 498353 - protein, 8 aa, Mycobacterium
GTGTLTNL

SEQ ID NO: 498354 - protein, 28 aa, Mycobacterium
GTGTPEDPAPPPTGRHTVSPQRSEQPVS

SEQ ID NO: 498355 - protein, 10 aa, Mycobacterium
GTGTPIPSTS

SEQ ID NO: 498356 - protein, 8 aa, Mycobacterium
GTGTPLGD

SEQ ID NO: 498357 - protein, 19 aa, Mycobacterium
GTGTPVPPPEYVNGQTDNY

SEQ ID NO: 498358 - protein, 14 aa, Mycobacterium
GTGTRIGDTTEAQA

SEQ ID NO: 498359 - protein, 12 aa, Mycobacterium
GTGTSESAERNR

SEQ ID NO: 498360 - protein, 12 aa, Mycobacterium
GTGTSESGERDR

SEQ ID NO: 498361 - protein, 6 aa, Mycobacterium
GTGTST

SEQ ID NO: 498362 - protein, 5 aa, Mycobacterium
GTGTT

SEQ ID NO: 498363 - protein, 6 aa, Mycobacterium
GTGTTL

SEQ ID NO: 498364 - protein, 11 aa, Mycobacterium
GTGTVRGRTHP

SEQ ID NO: 498365 - protein, 20 aa, Mycobacterium
GTGTVSGGTVEIDASGSSQF

SEQ ID NO: 498366 - protein, 14 aa, Mycobacterium
GTGVAPRDVTPEST

SEQ ID NO: 498367 - protein, 5 aa, Mycobacterium
GTGVD

SEQ ID NO: 498368 - protein, 9 aa, Mycobacterium
GTGVDPERL

SEQ ID NO: 498369 - protein, 5 aa, Mycobacterium
GTGVG

SEQ ID NO: 498370 - protein, 12 aa, Mycobacterium
GTGVHSSSLRDA

SEQ ID NO: 498371 - protein, 14 aa, Mycobacterium
GTGVPTSGLILAPA

SEQ ID NO: 498372 - protein, 30 aa, Mycobacterium
GTGVRARGRAVRGTRADRRRVPGGHRRTVD

SEQ ID NO: 498373 - protein, 6 aa, Mycobacterium
GTGVRE

SEQ ID NO: 498374 - protein, 9 aa, Mycobacterium
GTGVRSEAT

SEQ ID NO: 498375 - protein, 17 aa, Mycobacterium
GTGVTPRDVAPEATQPL

SEQ ID NO: 498376 - protein, 16 aa, Mycobacterium
GTGVTPRDVTPESTRE

SEQ ID NO: 498377 - protein, 4 aa, Mycobacterium
GTGW

SEQ ID NO: 498378 - protein, 4 aa, Mycobacterium
GTGY

SEQ ID NO: 498379 - protein, 5 aa, Mycobacterium
GTGYE

SEQ ID NO: 498380 - protein, 8 aa, Mycobacterium
GTGYGDAA

SEQ ID NO: 498381 - protein, 8 aa, Mycobacterium
GTGYGEAA

SEQ ID NO: 498382 - protein, 9 aa, Mycobacterium
GTGYGPDGA

SEQ ID NO: 498383 - protein, 9 aa, Mycobacterium
GTGYGTDGT

SEQ ID NO: 498384 - protein, 20 aa, Mycobacterium
GTGYISGGPANRWDDPYTGK

SEQ ID NO: 498385 - protein, 5 aa, Mycobacterium
GTHAD

SEQ ID NO: 498386 - protein, 7 aa, Mycobacterium
GTHADGA

SEQ ID NO: 498387 - protein, 9 aa, Mycobacterium
GTHAPTGEF

SEQ ID NO: 498388 - protein, 10 aa, Mycobacterium
GTHAPTGEFN

SEQ ID NO: 498389 - protein, 12 aa, Mycobacterium
GTHASRKPDSSQ

SEQ ID NO: 498390 - protein, 5 aa, Mycobacterium
GTHAV

SEQ ID NO: 498391 - protein, 6 aa, Mycobacterium
GTHGQP

SEQ ID NO: 498392 - protein, 6 aa, Mycobacterium
GTHGSA

SEQ ID NO: 498393 - protein, 10 aa, Mycobacterium
GTHLDSREGI

SEQ ID NO: 498394 - protein, 4 aa, Mycobacterium
GTHN

SEQ ID NO: 498395 - protein, 6 aa, Mycobacterium
GTHNND

SEQ ID NO: 498396 - protein, 5 aa, Mycobacterium
GTHPA

SEQ ID NO: 498397 - protein, 5 aa, Mycobacterium
GTHPS

SEQ ID NO: 498398 - protein, 8 aa, Mycobacterium
GTHRTENS

SEQ ID NO: 498399 - protein, 11 aa, Mycobacterium
GTHRTISPDQT

SEQ ID NO: 498400 - protein, 4 aa, Mycobacterium
GTHS

SEQ ID NO: 498401 - protein, 4 aa, Mycobacterium
GTIA

SEQ ID NO: 498402 - protein, 7 aa, Mycobacterium
GTIAGLP

SEQ ID NO: 498403 - protein, 10 aa, Mycobacterium
GTIAPGKKAD

SEQ ID NO: 498404 - protein, 14 aa, Mycobacterium
GTIAQSGRSGGRPA

SEQ ID NO: 498405 - protein, 5 aa, Mycobacterium
GTIDE

SEQ ID NO: 498406 - protein, 5 aa, Mycobacterium
GTIDG

SEQ ID NO: 498407 - protein, 10 aa, Mycobacterium
GTIDSDHSSP

SEQ ID NO: 498408 - protein, 12 aa, Mycobacterium
GTIDTDAGPQLQ

SEQ ID NO: 498409 - protein, 4 aa, Mycobacterium
GTIE

SEQ ID NO: 498410 - protein, 7 aa, Mycobacterium
GTIEERA

SEQ ID NO: 498411 - protein, 7 aa, Mycobacterium
GTIEPGS

SEQ ID NO: 498412 - protein, 4 aa, Mycobacterium
GTIG

SEQ ID NO: 498413 - protein, 18 aa, Mycobacterium
GTIGGGRSSATDKNPHPV

SEQ ID NO: 498414 - protein, 18 aa, Mycobacterium
GTIGTVGSGAGDAANSSI

SEQ ID NO: 498415 - protein, 7 aa, Mycobacterium
GTIIGDG

SEQ ID NO: 498416 - protein, 13 aa, Mycobacterium
GTINGERLTNEQA

SEQ ID NO: 498417 - protein, 13 aa, Mycobacterium
GTINGSSAESQQL

SEQ ID NO: 498418 - protein, 8 aa, Mycobacterium
GTIPAGSP

SEQ ID NO: 498419 - protein, 7 aa, Mycobacterium
GTIPGTA

SEQ ID NO: 498420 - protein, 10 aa, Mycobacterium
GTIPKGEYGA

SEQ ID NO: 498421 - protein, 20 aa, Mycobacterium
GTIPKTPSGKLRRAHALSLV

SEQ ID NO: 498422 - protein, 20 aa, Mycobacterium
GTIPKTPSGKLRRANSVTLV

SEQ ID NO: 498423 - protein, 20 aa, Mycobacterium
GTIPKTPSGKLRRSHSATLV

SEQ ID NO: 498424 - protein, 20 aa, Mycobacterium
GTIPKTPSGKLRRSNSLTLV

SEQ ID NO: 498425 - protein, 20 aa, Mycobacterium
GTIPKTPSGKLRRSNSVTLV

SEQ ID NO: 498426 - protein, 7 aa, Mycobacterium
GTIPPGR

SEQ ID NO: 498427 - protein, 13 aa, Mycobacterium
GTIPRARSAEVQQ

SEQ ID NO: 498428 - protein, 12 aa, Mycobacterium
GTIPRPRRQPIP

SEQ ID NO: 498429 - protein, 7 aa, Mycobacterium
GTIPSKT

SEQ ID NO: 498430 - protein, 34 aa, Mycobacterium
GTIQGDTATTPYGAGTQGSRSGPMTAGAVSEAGT

SEQ ID NO: 498431 - protein, 4 aa, Mycobacterium
GTIR

SEQ ID NO: 498432 - protein, 6 aa, Mycobacterium
GTIRGG

SEQ ID NO: 498433 - protein, 5 aa, Mycobacterium
GTIRS

SEQ ID NO: 498434 - protein, 9 aa, Mycobacterium
GTISDGSRY

SEQ ID NO: 498435 - protein, 12 aa, Mycobacterium
GTISDSNGVTVE

SEQ ID NO: 498436 - protein, 11 aa, Mycobacterium
GTISSAAPGTC

SEQ ID NO: 498437 - protein, 4 aa, Mycobacterium
GTIT

SEQ ID NO: 498438 - protein, 11 aa, Mycobacterium
GTITGEHGVGT

SEQ ID NO: 498439 - protein, 4 aa, Mycobacterium
GTKA

SEQ ID NO: 498440 - protein, 11 aa, Mycobacterium
GTKAARHGQNL

SEQ ID NO: 498441 - protein, 13 aa, Mycobacterium
GTKADGVHATDQQ

SEQ ID NO: 498442 - protein, 12 aa, Mycobacterium
GTKADRRPASEA

SEQ ID NO: 498443 - protein, 6 aa, Mycobacterium
GTKAEA

SEQ ID NO: 498444 - protein, 8 aa, Mycobacterium
GTKAGGQV

SEQ ID NO: 498445 - protein, 8 aa, Mycobacterium
GTKAGRPV

SEQ ID NO: 498446 - protein, 15 aa, Mycobacterium
GTKAKIRDTRKTLPG

SEQ ID NO: 498447 - protein, 17 aa, Mycobacterium
GTKASLGHTYQRSYAPA

SEQ ID NO: 498448 - protein, 15 aa, Mycobacterium
GTKDDIKEAQDNGGS

SEQ ID NO: 498449 - protein, 6 aa, Mycobacterium
GTKDKN

SEQ ID NO: 498450 - protein, 8 aa, Mycobacterium
GTKDNLER

SEQ ID NO: 498451 - protein, 5 aa, Mycobacterium
GTKED

SEQ ID NO: 498452 - protein, 15 aa, Mycobacterium
GTKEDIKEAQDNGGS

SEQ ID NO: 498453 - protein, 19 aa, Mycobacterium
GTKEYSTQNASGSTSGPFY

SEQ ID NO: 498454 - protein, 8 aa, Mycobacterium
GTKGAKTP

SEQ ID NO: 498455 - protein, 12 aa, Mycobacterium
GTKGGPRTDRDG

SEQ ID NO: 498456 - protein, 13 aa, Mycobacterium
GTKGGPRTDRDGR

SEQ ID NO: 498457 - protein, 8 aa, Mycobacterium
GTKGKRHA

SEQ ID NO: 498458 - protein, 7 aa, Mycobacterium
GTKGKRY

SEQ ID NO: 498459 - protein, 23 aa, Mycobacterium
GTKGPGSRRTAAPSHRHRRPPRL

SEQ ID NO: 498460 - protein, 7 aa, Mycobacterium
GTKGPSL

SEQ ID NO: 498461 - protein, 9 aa, Mycobacterium
GTKMKSGDK

SEQ ID NO: 498462 - protein, 9 aa, Mycobacterium
GTKNMPGAD

SEQ ID NO: 498463 - protein, 10 aa, Mycobacterium
GTKNMPGADK

SEQ ID NO: 498464 - protein, 9 aa, Mycobacterium
GTKNMTGAD

SEQ ID NO: 498465 - protein, 10 aa, Mycobacterium
GTKPARPAGV

SEQ ID NO: 498466 - protein, 7 aa, Mycobacterium
GTKPFDR

SEQ ID NO: 498467 - protein, 5 aa, Mycobacterium
GTKPT

SEQ ID NO: 498468 - protein, 8 aa, Mycobacterium
GTKQGISD

SEQ ID NO: 498469 - protein, 9 aa, Mycobacterium
GTKQKASRI

SEQ ID NO: 498470 - protein, 16 aa, Mycobacterium
GTKQTTRNIPAPKADR

SEQ ID NO: 498471 - protein, 15 aa, Mycobacterium
GTKQTTRNIPTPKAD

SEQ ID NO: 498472 - protein, 9 aa, Mycobacterium
GTKRRAEAR

SEQ ID NO: 498473 - protein, 15 aa, Mycobacterium
GTKSGGAIKPVEPED

SEQ ID NO: 498474 - protein, 9 aa, Mycobacterium
GTKSGSDQI

SEQ ID NO: 498475 - protein, 10 aa, Mycobacterium
GTKSKRESAN

SEQ ID NO: 498476 - protein, 9 aa, Mycobacterium
GTKTDNERA

SEQ ID NO: 498477 - protein, 5 aa, Mycobacterium
GTKTQ

SEQ ID NO: 498478 - protein, 6 aa, Mycobacterium
GTKTQI

SEQ ID NO: 498479 - protein, 4 aa, Mycobacterium
GTLA

SEQ ID NO: 498480 - protein, 13 aa, Mycobacterium
GTLAEKENDKAKF

SEQ ID NO: 498481 - protein, 20 aa, Mycobacterium
GTLAGKGFYDNTKRTTTPNA

SEQ ID NO: 498482 - protein, 10 aa, Mycobacterium
GTLAPGPDGT

SEQ ID NO: 498483 - protein, 6 aa, Mycobacterium
GTLARQ

SEQ ID NO: 498484 - protein, 6 aa, Mycobacterium
GTLDEA

SEQ ID NO: 498485 - protein, 6 aa, Mycobacterium
GTLDGT

SEQ ID NO: 498486 - protein, 17 aa, Mycobacterium
GTLDPEQLADKFRMAWS

SEQ ID NO: 498487 - protein, 8 aa, Mycobacterium
GTLDQEPE

SEQ ID NO: 498488 - protein, 12 aa, Mycobacterium
GTLDRTAPIGEG

SEQ ID NO: 498489 - protein, 9 aa, Mycobacterium
GTLDTATGP

SEQ ID NO: 498490 - protein, 11 aa, Mycobacterium
GTLDTEAGPHL

SEQ ID NO: 498491 - protein, 23 aa, Mycobacterium
GTLDYDEDSENVVSPLTSGAKEG

SEQ ID NO: 498492 - protein, 4 aa, Mycobacterium
GTLE

SEQ ID NO: 498493 - protein, 12 aa, Mycobacterium
GTLEESRGVTRQ

SEQ ID NO: 498494 - protein, 9 aa, Mycobacterium
GTLEPDPEL

SEQ ID NO: 498495 - protein, 14 aa, Mycobacterium
GTLESTKDEAGRKV

SEQ ID NO: 498496 - protein, 4 aa, Mycobacterium
GTLG

SEQ ID NO: 498497 - protein, 14 aa, Mycobacterium
GTLGAGGSGEGAGF

SEQ ID NO: 498498 - protein, 5 aa, Mycobacterium
GTLGP

SEQ ID NO: 498499 - protein, 6 aa, Mycobacterium
GTLGQH

SEQ ID NO: 498500 - protein, 13 aa, Mycobacterium
GTLGSSSPRARDC

SEQ ID NO: 498501 - protein, 4 aa, Mycobacterium
GTLP

SEQ ID NO: 498502 - protein, 5 aa, Mycobacterium
GTLPG

SEQ ID NO: 498503 - protein, 6 aa, Mycobacterium
GTLPGD

SEQ ID NO: 498504 - protein, 10 aa, Mycobacterium
GTLPGGSGME

SEQ ID NO: 498505 - protein, 20 aa, Mycobacterium
GTLPGGYTAHPHTDPDTGEM

SEQ ID NO: 498506 - protein, 8 aa, Mycobacterium
GTLPGPNL

SEQ ID NO: 498507 - protein, 10 aa, Mycobacterium
GTLPKPGVRA

SEQ ID NO: 498508 - protein, 8 aa, Mycobacterium
GTLPMPES

SEQ ID NO: 498509 - protein, 7 aa, Mycobacterium
GTLPPGQ

SEQ ID NO: 498510 - protein, 8 aa, Mycobacterium
GTLPPGRI

SEQ ID NO: 498511 - protein, 10 aa, Mycobacterium
GTLPPPPLPD

SEQ ID NO: 498512 - protein, 5 aa, Mycobacterium
GTLPR

SEQ ID NO: 498513 - protein, 11 aa, Mycobacterium
GTLPSGTGARR

SEQ ID NO: 498514 - protein, 14 aa, Mycobacterium
GTLPTQDESVSADD

SEQ ID NO: 498515 - protein, 6 aa, Mycobacterium
GTLPTR

SEQ ID NO: 498516 - protein, 20 aa, Mycobacterium
GTLPTSLKGAPLSNQSGSAQ

SEQ ID NO: 498517 - protein, 5 aa, Mycobacterium
GTLQG

SEQ ID NO: 498518 - protein, 10 aa, Mycobacterium
GTLQRDASDS

SEQ ID NO: 498519 - protein, 5 aa, Mycobacterium
GTLRG

SEQ ID NO: 498520 - protein, 36 aa, Mycobacterium
GTLRGNRSSRAEEWRDPEPPADDDPEVPTAGPPTRD

SEQ ID NO: 498521 - protein, 4 aa, Mycobacterium
GTLS

SEQ ID NO: 498522 - protein, 5 aa, Mycobacterium
GTLSA

SEQ ID NO: 498523 - protein, 11 aa, Mycobacterium
GTLSADGDLSI

SEQ ID NO: 498524 - protein, 8 aa, Mycobacterium
GTLSEPAT

SEQ ID NO: 498525 - protein, 9 aa, Mycobacterium
GTLSEPPEL

SEQ ID NO: 498526 - protein, 7 aa, Mycobacterium
GTLSGNP

SEQ ID NO: 498527 - protein, 7 aa, Mycobacterium
GTLSGPQ

SEQ ID NO: 498528 - protein, 7 aa, Mycobacterium
GTLSPAG

SEQ ID NO: 498529 - protein, 8 aa, Mycobacterium
GTLSQAGD

SEQ ID NO: 498530 - protein, 7 aa, Mycobacterium
GTLSRGL

SEQ ID NO: 498531 - protein, 13 aa, Mycobacterium
GTLSTGSVEPGAD

SEQ ID NO: 498532 - protein, 5 aa, Mycobacterium
GTLSV

SEQ ID NO: 498533 - protein, 7 aa, Mycobacterium
GTLTESA

SEQ ID NO: 498534 - protein, 13 aa, Mycobacterium
GTLTNGSLAPTTD

SEQ ID NO: 498535 - protein, 16 aa, Mycobacterium
GTLTNHETGEEHPLRP

SEQ ID NO: 498536 - protein, 8 aa, Mycobacterium
GTLTRRDV

SEQ ID NO: 498537 - protein, 12 aa, Mycobacterium
GTLTSELLVLRS

SEQ ID NO: 498538 - protein, 11 aa, Mycobacterium
GTLTSSGSLDR

SEQ ID NO: 498539 - protein, 11 aa, Mycobacterium
GTMDTADGPHL

SEQ ID NO: 498540 - protein, 9 aa, Mycobacterium
GTMDTEDGP

SEQ ID NO: 498541 - protein, 10 aa, Mycobacterium
GTMETANGPV

SEQ ID NO: 498542 - protein, 48 aa, Mycobacterium
GTMGAGGGKGGGNGPGVERVPAPAGEANTAPGAPEDGEAAAPETPPRA

SEQ ID NO: 498543 - protein, 8 aa, Mycobacterium
GTMKGREE

SEQ ID NO: 498544 - protein, 5 aa, Mycobacterium
GTMKS

SEQ ID NO: 498545 - protein, 4 aa, Mycobacterium
GTMP

SEQ ID NO: 498546 - protein, 29 aa, Mycobacterium
GTMPASTAGWEAPGGLPFSGGDADDPALQ

SEQ ID NO: 498547 - protein, 16 aa, Mycobacterium
GTMPEGSQSSERHRSR

SEQ ID NO: 498548 - protein, 7 aa, Mycobacterium
GTMRGRD

SEQ ID NO: 498549 - protein, 7 aa, Mycobacterium
GTMRGRE

SEQ ID NO: 498550 - protein, 4 aa, Mycobacterium
GTMT

SEQ ID NO: 498551 - protein, 6 aa, Mycobacterium
GTMTAA

SEQ ID NO: 498552 - protein, 5 aa, Mycobacterium
GTMTE

SEQ ID NO: 498553 - protein, 8 aa, Mycobacterium
GTNAAATS

SEQ ID NO: 498554 - protein, 11 aa, Mycobacterium
GTNADTAEQTA

SEQ ID NO: 498555 - protein, 5 aa, Mycobacterium
GTNAI

SEQ ID NO: 498556 - protein, 10 aa, Mycobacterium
GTNAIGTAAG

SEQ ID NO: 498557 - protein, 11 aa, Mycobacterium
GTNANTGQKQG

SEQ ID NO: 498558 - protein, 9 aa, Mycobacterium
GTNAPSSDL

SEQ ID NO: 498559 - protein, 6 aa, Mycobacterium
GTNAQA

SEQ ID NO: 498560 - protein, 15 aa, Mycobacterium
GTNARGKSEGIQSKR

SEQ ID NO: 498561 - protein, 7 aa, Mycobacterium
GTNAVNG

SEQ ID NO: 498562 - protein, 7 aa, Mycobacterium
GTNCENL

SEQ ID NO: 498563 - protein, 11 aa, Mycobacterium
GTNDVGVGNSA

SEQ ID NO: 498564 - protein, 9 aa, Mycobacterium
GTNDYDNNH

SEQ ID NO: 498565 - protein, 5 aa, Mycobacterium
GTNEA

SEQ ID NO: 498566 - protein, 35 aa, Mycobacterium
GTNEAAARQLASRARKALASEAADAPQRPDPAHNE

SEQ ID NO: 498567 - protein, 7 aa, Mycobacterium
GTNEQRL

SEQ ID NO: 498568 - protein, 8 aa, Mycobacterium
GTNERAVR

SEQ ID NO: 498569 - protein, 13 aa, Mycobacterium
GTNESVPGEPGRL

SEQ ID NO: 498570 - protein, 19 aa, Mycobacterium
GTNEYDPDEPGGLRRARDG

SEQ ID NO: 498571 - protein, 13 aa, Mycobacterium
GTNFSRGQRGSYA

SEQ ID NO: 498572 - protein, 11 aa, Mycobacterium
GTNGHHRAGNE

SEQ ID NO: 498573 - protein, 52 aa, Mycobacterium
GTNGIGGTGGAGGAGAVGGDGGVGGDPGVGTTYNGISGHNGVQGGTGADGAA

SEQ ID NO: 498574 - protein, 7 aa, Mycobacterium
GTNGKTS

SEQ ID NO: 498575 - protein, 9 aa, Mycobacterium
GTNGKTSVT

SEQ ID NO: 498576 - protein, 10 aa, Mycobacterium
GTNGKTTTTA

SEQ ID NO: 498577 - protein, 6 aa, Mycobacterium
GTNGRQ

SEQ ID NO: 498578 - protein, 7 aa, Mycobacterium
GTNGSLT

SEQ ID NO: 498579 - protein, 5 aa, Mycobacterium
GTNGW

SEQ ID NO: 498580 - protein, 9 aa, Mycobacterium
GTNHSVAAT

SEQ ID NO: 498581 - protein, 6 aa, Mycobacterium
GTNIQD

SEQ ID NO: 498582 - protein, 4 aa, Mycobacterium
GTNL

SEQ ID NO: 498583 - protein, 9 aa, Mycobacterium
GTNLGADGK

SEQ ID NO: 498584 - protein, 16 aa, Mycobacterium
GTNNIGFGNSGTGNWG

SEQ ID NO: 498585 - protein, 36 aa, Mycobacterium
GTNNIGIGNSGTGNWGIGNSGSYNTGIGNTGSTNTG

SEQ ID NO: 498586 - protein, 7 aa, Mycobacterium
GTNNLPD

SEQ ID NO: 498587 - protein, 14 aa, Mycobacterium
GTNNPVPAAHNAAP

SEQ ID NO: 498588 - protein, 16 aa, Mycobacterium
GTNNVGIGNSGTGNWG

SEQ ID NO: 498589 - protein, 10 aa, Mycobacterium
GTNPARPDGV

SEQ ID NO: 498590 - protein, 8 aa, Mycobacterium
GTNPDGDL

SEQ ID NO: 498591 - protein, 7 aa, Mycobacterium
GTNPEFD

SEQ ID NO: 498592 - protein, 8 aa, Mycobacterium
GTNPGQGV

SEQ ID NO: 498593 - protein, 5 aa, Mycobacterium
GTNPP

SEQ ID NO: 498594 - protein, 18 aa, Mycobacterium
GTNPRKSTKTGSGERDAE

SEQ ID NO: 498595 - protein, 8 aa, Mycobacterium
GTNPRSYA

SEQ ID NO: 498596 - protein, 7 aa, Mycobacterium
GTNPTEL

SEQ ID NO: 498597 - protein, 12 aa, Mycobacterium
GTNPTFSGRTRT

SEQ ID NO: 498598 - protein, 10 aa, Mycobacterium
GTNRAAAPGA

SEQ ID NO: 498599 - protein, 7 aa, Mycobacterium
GTNRAAD

SEQ ID NO: 498600 - protein, 8 aa, Mycobacterium
GTNRDDDL

SEQ ID NO: 498601 - protein, 6 aa, Mycobacterium
GTNRID

SEQ ID NO: 498602 - protein, 14 aa, Mycobacterium
GTNSSPLAGKVSGH

SEQ ID NO: 498603 - protein, 8 aa, Mycobacterium
GTNSSVRG

SEQ ID NO: 498604 - protein, 7 aa, Mycobacterium
GTNTGEQ

SEQ ID NO: 498605 - protein, 12 aa, Mycobacterium
GTNTLAQATSPY

SEQ ID NO: 498606 - protein, 15 aa, Mycobacterium
GTNTLKGKAIRRDPR

SEQ ID NO: 498607 - protein, 16 aa, Mycobacterium
GTNTNLNGSGSNHESA

SEQ ID NO: 498608 - protein, 15 aa, Mycobacterium
GTNTRTKLEALLSGG

SEQ ID NO: 498609 - protein, 15 aa, Mycobacterium
GTNTSPLAGKVPGHK

SEQ ID NO: 498610 - protein, 13 aa, Mycobacterium
GTNTSPLAGKVSG

SEQ ID NO: 498611 - protein, 15 aa, Mycobacterium
GTNTSPLAGKVSGHK

SEQ ID NO: 498612 - protein, 4 aa, Mycobacterium
GTNV

SEQ ID NO: 498613 - protein, 9 aa, Mycobacterium
GTNVDTGDG

SEQ ID NO: 498614 - protein, 10 aa, Mycobacterium
GTNVGSAAGS

SEQ ID NO: 498615 - protein, 11 aa, Mycobacterium
GTNWKSNPNAM

SEQ ID NO: 498616 - protein, 18 aa, Mycobacterium
GTNYPGQGDIRGRQDRLA

SEQ ID NO: 498617 - protein, 9 aa, Mycobacterium
GTPAADTYE

SEQ ID NO: 498618 - protein, 5 aa, Mycobacterium
GTPAD

SEQ ID NO: 498619 - protein, 6 aa, Mycobacterium
GTPADV

SEQ ID NO: 498620 - protein, 13 aa, Mycobacterium
GTPADVLVDEPVG

SEQ ID NO: 498621 - protein, 5 aa, Mycobacterium
GTPAE

SEQ ID NO: 498622 - protein, 9 aa, Mycobacterium
GTPAEAAEQ

SEQ ID NO: 498623 - protein, 10 aa, Mycobacterium
GTPAEAAEQM

SEQ ID NO: 498624 - protein, 8 aa, Mycobacterium
GTPAECGQ

SEQ ID NO: 498625 - protein, 6 aa, Mycobacterium
GTPAEL

SEQ ID NO: 498626 - protein, 6 aa, Mycobacterium
GTPAES

SEQ ID NO: 498627 - protein, 12 aa, Mycobacterium
GTPAGTAIEGGV

SEQ ID NO: 498628 - protein, 15 aa, Mycobacterium
GTPAGTALSAPPKPV

SEQ ID NO: 498629 - protein, 15 aa, Mycobacterium
GTPAGVGPIEDGDTV

SEQ ID NO: 498630 - protein, 5 aa, Mycobacterium
GTPAH

SEQ ID NO: 498631 - protein, 12 aa, Mycobacterium
GTPAHASSAADY

SEQ ID NO: 498632 - protein, 6 aa, Mycobacterium
GTPAKF

SEQ ID NO: 498633 - protein, 10 aa, Mycobacterium
GTPALATRGF

SEQ ID NO: 498634 - protein, 13 aa, Mycobacterium
GTPALTSRGFGAD

SEQ ID NO: 498635 - protein, 20 aa, Mycobacterium
GTPAPADVSGDRDPGRRPSV

SEQ ID NO: 498636 - protein, 11 aa, Mycobacterium
GTPAPGPAPDG

SEQ ID NO: 498637 - protein, 19 aa, Mycobacterium
GTPAPGPAPDGMRVPPSAD

SEQ ID NO: 498638 - protein, 17 aa, Mycobacterium
GTPAPRATWTERRTERS

SEQ ID NO: 498639 - protein, 8 aa, Mycobacterium
GTPAQATH

SEQ ID NO: 498640 - protein, 9 aa, Mycobacterium
GTPAQKTQH

SEQ ID NO: 498641 - protein, 6 aa, Mycobacterium
GTPAQL

SEQ ID NO: 498642 - protein, 5 aa, Mycobacterium
GTPAR

SEQ ID NO: 498643 - protein, 6 aa, Mycobacterium
GTPARA

SEQ ID NO: 498644 - protein, 15 aa, Mycobacterium
GTPARDASGADRPYW

SEQ ID NO: 498645 - protein, 6 aa, Mycobacterium
GTPARP

SEQ ID NO: 498646 - protein, 9 aa, Mycobacterium
GTPASGVDG

SEQ ID NO: 498647 - protein, 13 aa, Mycobacterium
GTPASLGATPAEI

SEQ ID NO: 498648 - protein, 9 aa, Mycobacterium
GTPASSREL

SEQ ID NO: 498649 - protein, 21 aa, Mycobacterium
GTPASTSGASGSSESGFRCKR

SEQ ID NO: 498650 - protein, 6 aa, Mycobacterium
GTPAVA

SEQ ID NO: 498651 - protein, 30 aa, Mycobacterium
GTPAVAGRASTEDDPFNTEGPMAGRGRTGQ

SEQ ID NO: 498652 - protein, 30 aa, Mycobacterium
GTPAWQRSGRPLEYGAGSELPAPATVSPEL

SEQ ID NO: 498653 - protein, 8 aa, Mycobacterium
GTPCGAGA

SEQ ID NO: 498654 - protein, 10 aa, Mycobacterium
GTPCTPRSVA

SEQ ID NO: 498655 - protein, 6 aa, Mycobacterium
GTPDAI

SEQ ID NO: 498656 - protein, 5 aa, Mycobacterium
GTPDD

SEQ ID NO: 498657 - protein, 7 aa, Mycobacterium
GTPDDAI

SEQ ID NO: 498658 - protein, 6 aa, Mycobacterium
GTPDEV

SEQ ID NO: 498659 - protein, 7 aa, Mycobacterium
GTPDEVA

SEQ ID NO: 498660 - protein, 7 aa, Mycobacterium
GTPDGDW

SEQ ID NO: 498661 - protein, 8 aa, Mycobacterium
GTPDGPPL

SEQ ID NO: 498662 - protein, 6 aa, Mycobacterium
GTPDKK

SEQ ID NO: 498663 - protein, 6 aa, Mycobacterium
GTPDLS

SEQ ID NO: 498664 - protein, 21 aa, Mycobacterium
GTPDPATRAKQAALTLMQASG

SEQ ID NO: 498665 - protein, 27 aa, Mycobacterium
GTPDPVPEGDAAEQSIPAGYDEEPGLD

SEQ ID NO: 498666 - protein, 6 aa, Mycobacterium
GTPDQI

SEQ ID NO: 498667 - protein, 5 aa, Mycobacterium
GTPDR

SEQ ID NO: 498668 - protein, 10 aa, Mycobacterium
GTPDSALTGP

SEQ ID NO: 498669 - protein, 9 aa, Mycobacterium
GTPDVIPPA

SEQ ID NO: 498670 - protein, 13 aa, Mycobacterium
GTPDVPWGAPADD

SEQ ID NO: 498671 - protein, 5 aa, Mycobacterium
GTPEA

SEQ ID NO: 498672 - protein, 11 aa, Mycobacterium
GTPEAGDPDNR

SEQ ID NO: 498673 - protein, 11 aa, Mycobacterium
GTPEEATQGPM

SEQ ID NO: 498674 - protein, 10 aa, Mycobacterium
GTPEEAVQGP

SEQ ID NO: 498675 - protein, 17 aa, Mycobacterium
GTPEENAAVGITLPGFT

SEQ ID NO: 498676 - protein, 10 aa, Mycobacterium
GTPEEQQQQW

SEQ ID NO: 498677 - protein, 6 aa, Mycobacterium
GTPEEV

SEQ ID NO: 498678 - protein, 14 aa, Mycobacterium
GTPEFADRQQRTLS

SEQ ID NO: 498679 - protein, 13 aa, Mycobacterium
GTPEFADRQRRTL

SEQ ID NO: 498680 - protein, 5 aa, Mycobacterium
GTPEG

SEQ ID NO: 498681 - protein, 12 aa, Mycobacterium
GTPEGLPSERTR

SEQ ID NO: 498682 - protein, 8 aa, Mycobacterium
GTPEGVGP

SEQ ID NO: 498683 - protein, 15 aa, Mycobacterium
GTPEGVGPIEDGDTV

SEQ ID NO: 498684 - protein, 12 aa, Mycobacterium
GTPEGVGPLEHG

SEQ ID NO: 498685 - protein, 6 aa, Mycobacterium
GTPEKK

SEQ ID NO: 498686 - protein, 9 aa, Mycobacterium
GTPELDTGA

SEQ ID NO: 498687 - protein, 7 aa, Mycobacterium
GTPEPED

SEQ ID NO: 498688 - protein, 15 aa, Mycobacterium
GTPEPEGGMPVPSGD

SEQ ID NO: 498689 - protein, 8 aa, Mycobacterium
GTPEPRHD

SEQ ID NO: 498690 - protein, 6 aa, Mycobacterium
GTPEQH

SEQ ID NO: 498691 - protein, 6 aa, Mycobacterium
GTPEQI

SEQ ID NO: 498692 - protein, 9 aa, Mycobacterium
GTPEQIAEQ

SEQ ID NO: 498693 - protein, 7 aa, Mycobacterium
GTPEQKQ

SEQ ID NO: 498694 - protein, 7 aa, Mycobacterium
GTPEQQK

SEQ ID NO: 498695 - protein, 7 aa, Mycobacterium
GTPERAG

SEQ ID NO: 498696 - protein, 8 aa, Mycobacterium
GTPERDGL

SEQ ID NO: 498697 - protein, 6 aa, Mycobacterium
GTPERI

SEQ ID NO: 498698 - protein, 6 aa, Mycobacterium
GTPERP

SEQ ID NO: 498699 - protein, 12 aa, Mycobacterium
GTPFAPTRPETV

SEQ ID NO: 498700 - protein, 5 aa, Mycobacterium
GTPFP

SEQ ID NO: 498701 - protein, 9 aa, Mycobacterium
GTPFRSDDS

SEQ ID NO: 498702 - protein, 5 aa, Mycobacterium
GTPGA

SEQ ID NO: 498703 - protein, 6 aa, Mycobacterium
GTPGAL

SEQ ID NO: 498704 - protein, 9 aa, Mycobacterium
GTPGDAPGF

SEQ ID NO: 498705 - protein, 18 aa, Mycobacterium
GTPGEAPGYDLTEAGTQK

SEQ ID NO: 498706 - protein, 10 aa, Mycobacterium
GTPGESDDDL

SEQ ID NO: 498707 - protein, 11 aa, Mycobacterium
GTPGETDDDLR

SEQ ID NO: 498708 - protein, 6 aa, Mycobacterium
GTPGFA

SEQ ID NO: 498709 - protein, 10 aa, Mycobacterium
GTPGFSRGRN

SEQ ID NO: 498710 - protein, 6 aa, Mycobacterium
GTPGGC

SEQ ID NO: 498711 - protein, 6 aa, Mycobacterium
GTPGLR

SEQ ID NO: 498712 - protein, 10 aa, Mycobacterium
GTPGQGNYAA

SEQ ID NO: 498713 - protein, 11 aa, Mycobacterium
GTPGTPRTVEE

SEQ ID NO: 498714 - protein, 6 aa, Mycobacterium
GTPGVT

SEQ ID NO: 498715 - protein, 5 aa, Mycobacterium
GTPHC

SEQ ID NO: 498716 - protein, 5 aa, Mycobacterium
GTPHE

SEQ ID NO: 498717 - protein, 9 aa, Mycobacterium
GTPHTPRLT

SEQ ID NO: 498718 - protein, 4 aa, Mycobacterium
GTPI

SEQ ID NO: 498719 - protein, 7 aa, Mycobacterium
GTPIAAG

SEQ ID NO: 498720 - protein, 5 aa, Mycobacterium
GTPIE

SEQ ID NO: 498721 - protein, 5 aa, Mycobacterium
GTPIK

SEQ ID NO: 498722 - protein, 5 aa, Mycobacterium
GTPIN

SEQ ID NO: 498723 - protein, 11 aa, Mycobacterium
GTPIPPDTGEI

SEQ ID NO: 498724 - protein, 11 aa, Mycobacterium
GTPKGKAEQDA

SEQ ID NO: 498725 - protein, 5 aa, Mycobacterium
GTPKH

SEQ ID NO: 498726 - protein, 4 aa, Mycobacterium
GTPL

SEQ ID NO: 498727 - protein, 7 aa, Mycobacterium
GTPLDRT

SEQ ID NO: 498728 - protein, 6 aa, Mycobacterium
GTPLPE

SEQ ID NO: 498729 - protein, 4 aa, Mycobacterium
GTPM

SEQ ID NO: 498730 - protein, 4 aa, Mycobacterium
GTPN

SEQ ID NO: 498731 - protein, 6 aa, Mycobacterium
GTPNAG

SEQ ID NO: 498732 - protein, 6 aa, Mycobacterium
GTPNFT

SEQ ID NO: 498733 - protein, 5 aa, Mycobacterium
GTPPA

SEQ ID NO: 498734 - protein, 6 aa, Mycobacterium
GTPPAA

SEQ ID NO: 498735 - protein, 12 aa, Mycobacterium
GTPPAYPGWPDY

SEQ ID NO: 498736 - protein, 8 aa, Mycobacterium
GTPPEHEY

SEQ ID NO: 498737 - protein, 25 aa, Mycobacterium
GTPPGKAGTGGKGGQLLGQDGNIGR

SEQ ID NO: 498738 - protein, 10 aa, Mycobacterium
GTPPGRGGSA

SEQ ID NO: 498739 - protein, 5 aa, Mycobacterium
GTPPH

SEQ ID NO: 498740 - protein, 5 aa, Mycobacterium
GTPPI

SEQ ID NO: 498741 - protein, 7 aa, Mycobacterium
GTPPNRR

SEQ ID NO: 498742 - protein, 7 aa, Mycobacterium
GTPPPEI

SEQ ID NO: 498743 - protein, 6 aa, Mycobacterium
GTPPPI

SEQ ID NO: 498744 - protein, 17 aa, Mycobacterium
GTPPPPNGAQPSEDPLQ

SEQ ID NO: 498745 - protein, 6 aa, Mycobacterium
GTPPPV

SEQ ID NO: 498746 - protein, 9 aa, Mycobacterium
GTPPPYPGW

SEQ ID NO: 498747 - protein, 8 aa, Mycobacterium
GTPPSRRD

SEQ ID NO: 498748 - protein, 5 aa, Mycobacterium
GTPPV

SEQ ID NO: 498749 - protein, 5 aa, Mycobacterium
GTPQH

SEQ ID NO: 498750 - protein, 7 aa, Mycobacterium
GTPQRIG

SEQ ID NO: 498751 - protein, 5 aa, Mycobacterium
GTPRA

SEQ ID NO: 498752 - protein, 6 aa, Mycobacterium
GTPRAG

SEQ ID NO: 498753 - protein, 9 aa, Mycobacterium
GTPRGADER

SEQ ID NO: 498754 - protein, 7 aa, Mycobacterium
GTPRGLE

SEQ ID NO: 498755 - protein, 13 aa, Mycobacterium
GTPRPGDTQSYGR

SEQ ID NO: 498756 - protein, 8 aa, Mycobacterium
GTPRPVSE

SEQ ID NO: 498757 - protein, 10 aa, Mycobacterium
GTPSADPPLE

SEQ ID NO: 498758 - protein, 14 aa, Mycobacterium
GTPSAQAISPPPVD

SEQ ID NO: 498759 - protein, 8 aa, Mycobacterium
GTPSDAAT

SEQ ID NO: 498760 - protein, 8 aa, Mycobacterium
GTPSGETP

SEQ ID NO: 498761 - protein, 12 aa, Mycobacterium
GTPSGVGMGRNP

SEQ ID NO: 498762 - protein, 5 aa, Mycobacterium
GTPSI

SEQ ID NO: 498763 - protein, 9 aa, Mycobacterium
GTPSKDPAQ

SEQ ID NO: 498764 - protein, 8 aa, Mycobacterium
GTPSPDDL

SEQ ID NO: 498765 - protein, 5 aa, Mycobacterium
GTPSQ

SEQ ID NO: 498766 - protein, 9 aa, Mycobacterium
GTPSQVATE

SEQ ID NO: 498767 - protein, 14 aa, Mycobacterium
GTPSSTLPRSRRVS

SEQ ID NO: 498768 - protein, 14 aa, Mycobacterium
GTPSSTLPRSRTIT

SEQ ID NO: 498769 - protein, 8 aa, Mycobacterium
GTPSSVAD

SEQ ID NO: 498770 - protein, 4 aa, Mycobacterium
GTPT

SEQ ID NO: 498771 - protein, 8 aa, Mycobacterium
GTPTAGVR

SEQ ID NO: 498772 - protein, 15 aa, Mycobacterium
GTPTCYDPAPHERCE

SEQ ID NO: 498773 - protein, 18 aa, Mycobacterium
GTPTDGVGRPSRAPDPVN

SEQ ID NO: 498774 - protein, 6 aa, Mycobacterium
GTPTDI

SEQ ID NO: 498775 - protein, 7 aa, Mycobacterium
GTPTEGL

SEQ ID NO: 498776 - protein, 8 aa, Mycobacterium
GTPTERTV

SEQ ID NO: 498777 - protein, 7 aa, Mycobacterium
GTPTGEF

SEQ ID NO: 498778 - protein, 7 aa, Mycobacterium
GTPTGEH

SEQ ID NO: 498779 - protein, 7 aa, Mycobacterium
GTPTGID

SEQ ID NO: 498780 - protein, 8 aa, Mycobacterium
GTPTPRTR

SEQ ID NO: 498781 - protein, 9 aa, Mycobacterium
GTPTQENGS

SEQ ID NO: 498782 - protein, 7 aa, Mycobacterium
GTPTQLG

SEQ ID NO: 498783 - protein, 9 aa, Mycobacterium
GTPTQPRTK

SEQ ID NO: 498784 - protein, 14 aa, Mycobacterium
GTPTRARGYPPYAG

SEQ ID NO: 498785 - protein, 14 aa, Mycobacterium
GTPTRARGYPPYEG

SEQ ID NO: 498786 - protein, 7 aa, Mycobacterium
GTPTRAT

SEQ ID NO: 498787 - protein, 8 aa, Mycobacterium
GTPTSGYD

SEQ ID NO: 498788 - protein, 8 aa, Mycobacterium
GTPTSVPI

SEQ ID NO: 498789 - protein, 14 aa, Mycobacterium
GTPTTAHPTVTSRG

SEQ ID NO: 498790 - protein, 11 aa, Mycobacterium
GTPVDDGALPG

SEQ ID NO: 498791 - protein, 7 aa, Mycobacterium
GTPVGHP

SEQ ID NO: 498792 - protein, 15 aa, Mycobacterium
GTPVGTALSAPAKPV

SEQ ID NO: 498793 - protein, 15 aa, Mycobacterium
GTPVGTALSAPPKPV

SEQ ID NO: 498794 - protein, 16 aa, Mycobacterium
GTPVGTALSAPPKPVE

SEQ ID NO: 498795 - protein, 5 aa, Mycobacterium
GTPVL

SEQ ID NO: 498796 - protein, 5 aa, Mycobacterium
GTPVN

SEQ ID NO: 498797 - protein, 5 aa, Mycobacterium
GTPVR

SEQ ID NO: 498798 - protein, 5 aa, Mycobacterium
GTPVT

SEQ ID NO: 498799 - protein, 15 aa, Mycobacterium
GTPVTVTDGRYASHG

SEQ ID NO: 498800 - protein, 6 aa, Mycobacterium
GTPWRA

SEQ ID NO: 498801 - protein, 10 aa, Mycobacterium
GTPYGMTPNP

SEQ ID NO: 498802 - protein, 15 aa, Mycobacterium
GTPYKEATASQLADR

SEQ ID NO: 498803 - protein, 6 aa, Mycobacterium
GTPYPL

SEQ ID NO: 498804 - protein, 7 aa, Mycobacterium
GTPYPLG

SEQ ID NO: 498805 - protein, 4 aa, Mycobacterium
GTQA

SEQ ID NO: 498806 - protein, 13 aa, Mycobacterium
GTQAEQAASQAAA

SEQ ID NO: 498807 - protein, 5 aa, Mycobacterium
GTQAQ

SEQ ID NO: 498808 - protein, 12 aa, Mycobacterium
GTQATRKVADAS

SEQ ID NO: 498809 - protein, 8 aa, Mycobacterium
GTQDQKDR

SEQ ID NO: 498810 - protein, 8 aa, Mycobacterium
GTQDQKER

SEQ ID NO: 498811 - protein, 5 aa, Mycobacterium
GTQDV

SEQ ID NO: 498812 - protein, 6 aa, Mycobacterium
GTQEAV

SEQ ID NO: 498813 - protein, 7 aa, Mycobacterium
GTQEGGA

SEQ ID NO: 498814 - protein, 8 aa, Mycobacterium
GTQEQKDR

SEQ ID NO: 498815 - protein, 9 aa, Mycobacterium
GTQEQKDRY

SEQ ID NO: 498816 - protein, 7 aa, Mycobacterium
GTQFSGD

SEQ ID NO: 498817 - protein, 6 aa, Mycobacterium
GTQGAL

SEQ ID NO: 498818 - protein, 8 aa, Mycobacterium
GTQGALGH

SEQ ID NO: 498819 - protein, 6 aa, Mycobacterium
GTQGAV

SEQ ID NO: 498820 - protein, 7 aa, Mycobacterium
GTQGEPM

SEQ ID NO: 498821 - protein, 10 aa, Mycobacterium
GTQGGLGHRK

SEQ ID NO: 498822 - protein, 7 aa, Mycobacterium
GTQGQPV

SEQ ID NO: 498823 - protein, 9 aa, Mycobacterium
GTQIPTDTL

SEQ ID NO: 498824 - protein, 11 aa, Mycobacterium
GTQITDSDTGF

SEQ ID NO: 498825 - protein, 4 aa, Mycobacterium
GTQL

SEQ ID NO: 498826 - protein, 10 aa, Mycobacterium
GTQLDGPETM

SEQ ID NO: 498827 - protein, 7 aa, Mycobacterium
GTQLGET

SEQ ID NO: 498828 - protein, 8 aa, Mycobacterium
GTQNMRGA

SEQ ID NO: 498829 - protein, 8 aa, Mycobacterium
GTQPDTPN

SEQ ID NO: 498830 - protein, 6 aa, Mycobacterium
GTQPEA

SEQ ID NO: 498831 - protein, 5 aa, Mycobacterium
GTQPI

SEQ ID NO: 498832 - protein, 11 aa, Mycobacterium
GTQPSDQSAAD

SEQ ID NO: 498833 - protein, 7 aa, Mycobacterium
GTQPTAF

SEQ ID NO: 498834 - protein, 11 aa, Mycobacterium
GTQQGISDAAA

SEQ ID NO: 498835 - protein, 7 aa, Mycobacterium
GTQQQKD

SEQ ID NO: 498836 - protein, 8 aa, Mycobacterium
GTQQRGEG

SEQ ID NO: 498837 - protein, 11 aa, Mycobacterium
GTQQTMPSPGR

SEQ ID NO: 498838 - protein, 5 aa, Mycobacterium
GTQRF

SEQ ID NO: 498839 - protein, 6 aa, Mycobacterium
GTQRGL

SEQ ID NO: 498840 - protein, 7 aa, Mycobacterium
GTQRKIT

SEQ ID NO: 498841 - protein, 4 aa, Mycobacterium
GTQS

SEQ ID NO: 498842 - protein, 7 aa, Mycobacterium
GTQSASG

SEQ ID NO: 498843 - protein, 10 aa, Mycobacterium
GTQSSATDQL

SEQ ID NO: 498844 - protein, 4 aa, Mycobacterium
GTQT

SEQ ID NO: 498845 - protein, 8 aa, Mycobacterium
GTQTGDLR

SEQ ID NO: 498846 - protein, 6 aa, Mycobacterium
GTQTGV

SEQ ID NO: 498847 - protein, 8 aa, Mycobacterium
GTQTLASG

SEQ ID NO: 498848 - protein, 4 aa, Mycobacterium
GTQV

SEQ ID NO: 498849 - protein, 7 aa, Mycobacterium
GTQVPNE

SEQ ID NO: 498850 - protein, 4 aa, Mycobacterium
GTRA

SEQ ID NO: 498851 - protein, 7 aa, Mycobacterium
GTRADAA

SEQ ID NO: 498852 - protein, 9 aa, Mycobacterium
GTRADYDGL

SEQ ID NO: 498853 - protein, 12 aa, Mycobacterium
GTRAGATAASPA

SEQ ID NO: 498854 - protein, 13 aa, Mycobacterium
GTRAGTPREGGHI

SEQ ID NO: 498855 - protein, 9 aa, Mycobacterium
GTRAKHTGD

SEQ ID NO: 498856 - protein, 14 aa, Mycobacterium
GTRAQGRTALERAR

SEQ ID NO: 498857 - protein, 11 aa, Mycobacterium
GTRASQVPSSY

SEQ ID NO: 498858 - protein, 26 aa, Mycobacterium
GTRATAGTRAGTRSTATGCGRRTGRH

SEQ ID NO: 498859 - protein, 5 aa, Mycobacterium
GTRAV

SEQ ID NO: 498860 - protein, 5 aa, Mycobacterium
GTRDA

SEQ ID NO: 498861 - protein, 6 aa, Mycobacterium
GTRDAA

SEQ ID NO: 498862 - protein, 5 aa, Mycobacterium
GTRDL

SEQ ID NO: 498863 - protein, 10 aa, Mycobacterium
GTRDQDLPDE

SEQ ID NO: 498864 - protein, 7 aa, Mycobacterium
GTREARS

SEQ ID NO: 498865 - protein, 11 aa, Mycobacterium
GTREFSTRGRD

SEQ ID NO: 498866 - protein, 12 aa, Mycobacterium
GTREFSTRGRDD

SEQ ID NO: 498867 - protein, 6 aa, Mycobacterium
GTREGA

SEQ ID NO: 498868 - protein, 8 aa, Mycobacterium
GTREGNSL

SEQ ID NO: 498869 - protein, 12 aa, Mycobacterium
GTREGSSVRGGA

SEQ ID NO: 498870 - protein, 13 aa, Mycobacterium
GTREGTSVRGGAL

SEQ ID NO: 498871 - protein, 30 aa, Mycobacterium
GTREGTSVRGGDLGGLAPSTLADGNAVDTA

SEQ ID NO: 498872 - protein, 12 aa, Mycobacterium
GTREGTSVRGSA

SEQ ID NO: 498873 - protein, 5 aa, Mycobacterium
GTREI

SEQ ID NO: 498874 - protein, 8 aa, Mycobacterium
GTREQMAR

SEQ ID NO: 498875 - protein, 17 aa, Mycobacterium
GTRESTREVLRATRLAL

SEQ ID NO: 498876 - protein, 16 aa, Mycobacterium
GTRGAIPRREDTSHRA

SEQ ID NO: 498877 - protein, 13 aa, Mycobacterium
GTRGALPRQQSLS

SEQ ID NO: 498878 - protein, 10 aa, Mycobacterium
GTRGEPTAQD

SEQ ID NO: 498879 - protein, 14 aa, Mycobacterium
GTRGFNDPSPAFAQ

SEQ ID NO: 498880 - protein, 13 aa, Mycobacterium
GTRGGGGAPGFEP

SEQ ID NO: 498881 - protein, 12 aa, Mycobacterium
GTRGPDAKPYGA

SEQ ID NO: 498882 - protein, 12 aa, Mycobacterium
GTRGPDGKPFGA

SEQ ID NO: 498883 - protein, 16 aa, Mycobacterium
GTRGPLYGKKDLEDDR

SEQ ID NO: 498884 - protein, 26 aa, Mycobacterium
GTRGPNYDAESVRAAAAKLAKAGLPG

SEQ ID NO: 498885 - protein, 6 aa, Mycobacterium
GTRGRM

SEQ ID NO: 498886 - protein, 9 aa, Mycobacterium
GTRGSPSGT

SEQ ID NO: 498887 - protein, 9 aa, Mycobacterium
GTRGSRPAL

SEQ ID NO: 498888 - protein, 7 aa, Mycobacterium
GTRGSTV

SEQ ID NO: 498889 - protein, 19 aa, Mycobacterium
GTRGTVTVSPDEDSARAEV

SEQ ID NO: 498890 - protein, 5 aa, Mycobacterium
GTRGV

SEQ ID NO: 498891 - protein, 6 aa, Mycobacterium
GTRGVA

SEQ ID NO: 498892 - protein, 7 aa, Mycobacterium
GTRGYLD

SEQ ID NO: 498893 - protein, 6 aa, Mycobacterium
GTRHNH

SEQ ID NO: 498894 - protein, 5 aa, Mycobacterium
GTRHP

SEQ ID NO: 498895 - protein, 7 aa, Mycobacterium
GTRHPTG

SEQ ID NO: 498896 - protein, 6 aa, Mycobacterium
GTRHPV

SEQ ID NO: 498897 - protein, 6 aa, Mycobacterium
GTRIER

SEQ ID NO: 498898 - protein, 19 aa, Mycobacterium
GTRIPTGATIEATSPDGTE

SEQ ID NO: 498899 - protein, 8 aa, Mycobacterium
GTRISERY

SEQ ID NO: 498900 - protein, 9 aa, Mycobacterium
GTRISERYT

SEQ ID NO: 498901 - protein, 26 aa, Mycobacterium
GTRKPPSEPDLAKAGAHSAGGPGPTE

SEQ ID NO: 498902 - protein, 4 aa, Mycobacterium
GTRL

SEQ ID NO: 498903 - protein, 14 aa, Mycobacterium
GTRLARPIDSVNEI

SEQ ID NO: 498904 - protein, 14 aa, Mycobacterium
GTRLARPLDNVREI

SEQ ID NO: 498905 - protein, 6 aa, Mycobacterium
GTRLPA

SEQ ID NO: 498906 - protein, 9 aa, Mycobacterium
GTRLPSSRA

SEQ ID NO: 498907 - protein, 11 aa, Mycobacterium
GTRLTPRPEQI

SEQ ID NO: 498908 - protein, 14 aa, Mycobacterium
GTRMARPTEAVDEI

SEQ ID NO: 498909 - protein, 5 aa, Mycobacterium
GTRMY

SEQ ID NO: 498910 - protein, 4 aa, Mycobacterium
GTRP

SEQ ID NO: 498911 - protein, 9 aa, Mycobacterium
GTRPAKVDN

SEQ ID NO: 498912 - protein, 7 aa, Mycobacterium
GTRPEAA

SEQ ID NO: 498913 - protein, 6 aa, Mycobacterium
GTRPGA

SEQ ID NO: 498914 - protein, 7 aa, Mycobacterium
GTRPGTE

SEQ ID NO: 498915 - protein, 9 aa, Mycobacterium
GTRPNIPAV

SEQ ID NO: 498916 - protein, 5 aa, Mycobacterium
GTRPP

SEQ ID NO: 498917 - protein, 12 aa, Mycobacterium
GTRPPARTVRGL

SEQ ID NO: 498918 - protein, 10 aa, Mycobacterium
GTRPPKGQEF

SEQ ID NO: 498919 - protein, 6 aa, Mycobacterium
GTRPQR

SEQ ID NO: 498920 - protein, 6 aa, Mycobacterium
GTRPRR

SEQ ID NO: 498921 - protein, 10 aa, Mycobacterium
GTRPRTPRTW

SEQ ID NO: 498922 - protein, 28 aa, Mycobacterium
GTRPTRASASRRRGVKRAAPGVADWSPG

SEQ ID NO: 498923 - protein, 5 aa, Mycobacterium
GTRPV

SEQ ID NO: 498924 - protein, 5 aa, Mycobacterium
GTRPY

SEQ ID NO: 498925 - protein, 10 aa, Mycobacterium
GTRQAAQAGT

SEQ ID NO: 498926 - protein, 12 aa, Mycobacterium
GTRQGIGAAAAD

SEQ ID NO: 498927 - protein, 11 aa, Mycobacterium
GTRQVGDGRSW

SEQ ID NO: 498928 - protein, 10 aa, Mycobacterium
GTRRAEVAAE

SEQ ID NO: 498929 - protein, 8 aa, Mycobacterium
GTRRGQEL

SEQ ID NO: 498930 - protein, 10 aa, Mycobacterium
GTRRGYEVDA

SEQ ID NO: 498931 - protein, 16 aa, Mycobacterium
GTRRKATADQPVDTDS

SEQ ID NO: 498932 - protein, 5 aa, Mycobacterium
GTRRP

SEQ ID NO: 498933 - protein, 9 aa, Mycobacterium
GTRRPAGAR

SEQ ID NO: 498934 - protein, 19 aa, Mycobacterium
GTRRQPATSIGGNRRCRDP

SEQ ID NO: 498935 - protein, 11 aa, Mycobacterium
GTRRRTPGLRR

SEQ ID NO: 498936 - protein, 5 aa, Mycobacterium
GTRRT

SEQ ID NO: 498937 - protein, 4 aa, Mycobacterium
GTRS

SEQ ID NO: 498938 - protein, 14 aa, Mycobacterium
GTRSAAEDEVGQTL

SEQ ID NO: 498939 - protein, 12 aa, Mycobacterium
GTRSAEVAAESA

SEQ ID NO: 498940 - protein, 11 aa, Mycobacterium
GTRSAGSKSIA

SEQ ID NO: 498941 - protein, 11 aa, Mycobacterium
GTRSASAGGNL

SEQ ID NO: 498942 - protein, 10 aa, Mycobacterium
GTRSGKGKFT

SEQ ID NO: 498943 - protein, 8 aa, Mycobacterium
GTRSGLQD

SEQ ID NO: 498944 - protein, 5 aa, Mycobacterium
GTRSN

SEQ ID NO: 498945 - protein, 6 aa, Mycobacterium
GTRSNI

SEQ ID NO: 498946 - protein, 12 aa, Mycobacterium
GTRSPDAKPYGA

SEQ ID NO: 498947 - protein, 6 aa, Mycobacterium
GTRSVT

SEQ ID NO: 498948 - protein, 4 aa, Mycobacterium
GTRT

SEQ ID NO: 498949 - protein, 6 aa, Mycobacterium
GTRTAH

SEQ ID NO: 498950 - protein, 6 aa, Mycobacterium
GTRTDA

SEQ ID NO: 498951 - protein, 9 aa, Mycobacterium
GTRTDDEHA

SEQ ID NO: 498952 - protein, 21 aa, Mycobacterium
GTRTDGCPGGSGRRDGDRVVP

SEQ ID NO: 498953 - protein, 12 aa, Mycobacterium
GTRTETKNVNSL

SEQ ID NO: 498954 - protein, 7 aa, Mycobacterium
GTRTGGR

SEQ ID NO: 498955 - protein, 10 aa, Mycobacterium
GTRTGTTTLR

SEQ ID NO: 498956 - protein, 14 aa, Mycobacterium
GTRTPYGAGQDWPQ

SEQ ID NO: 498957 - protein, 10 aa, Mycobacterium
GTRTQVGYGP

SEQ ID NO: 498958 - protein, 5 aa, Mycobacterium
GTRTR

SEQ ID NO: 498959 - protein, 30 aa, Mycobacterium
GTRTVRAEKRAKASIKGSGADVTPADAAPA

SEQ ID NO: 498960 - protein, 6 aa, Mycobacterium
GTRVDS

SEQ ID NO: 498961 - protein, 5 aa, Mycobacterium
GTRVK

SEQ ID NO: 498962 - protein, 7 aa, Mycobacterium
GTRVPGP

SEQ ID NO: 498963 - protein, 19 aa, Mycobacterium
GTRVQQGDAETAPLSNPEY

SEQ ID NO: 498964 - protein, 9 aa, Mycobacterium
GTRVRDSSG

SEQ ID NO: 498965 - protein, 5 aa, Mycobacterium
GTRVT

SEQ ID NO: 498966 - protein, 5 aa, Mycobacterium
GTRWA

SEQ ID NO: 498967 - protein, 4 aa, Mycobacterium
GTSA

SEQ ID NO: 498968 - protein, 5 aa, Mycobacterium
GTSAA

SEQ ID NO: 498969 - protein, 8 aa, Mycobacterium
GTSAADQR

SEQ ID NO: 498970 - protein, 6 aa, Mycobacterium
GTSAAG

SEQ ID NO: 498971 - protein, 18 aa, Mycobacterium
GTSAASYGAAEAVNTAAV

SEQ ID NO: 498972 - protein, 8 aa, Mycobacterium
GTSAATEL

SEQ ID NO: 498973 - protein, 9 aa, Mycobacterium
GTSAEEASE

SEQ ID NO: 498974 - protein, 7 aa, Mycobacterium
GTSAEGP

SEQ ID NO: 498975 - protein, 9 aa, Mycobacterium
GTSAEGVAR

SEQ ID NO: 498976 - protein, 8 aa, Mycobacterium
GTSAEKFT

SEQ ID NO: 498977 - protein, 6 aa, Mycobacterium
GTSAGG

SEQ ID NO: 498978 - protein, 7 aa, Mycobacterium
GTSAGGH

SEQ ID NO: 498979 - protein, 9 aa, Mycobacterium
GTSAGGSLS

SEQ ID NO: 498980 - protein, 5 aa, Mycobacterium
GTSAI

SEQ ID NO: 498981 - protein, 5 aa, Mycobacterium
GTSAL

SEQ ID NO: 498982 - protein, 7 aa, Mycobacterium
GTSANPT

SEQ ID NO: 498983 - protein, 6 aa, Mycobacterium
GTSAPK

SEQ ID NO: 498984 - protein, 12 aa, Mycobacterium
GTSAQTLLVQRL

SEQ ID NO: 498985 - protein, 6 aa, Mycobacterium
GTSARY

SEQ ID NO: 498986 - protein, 9 aa, Mycobacterium
GTSATNQTT

SEQ ID NO: 498987 - protein, 4 aa, Mycobacterium
GTSD

SEQ ID NO: 498988 - protein, 22 aa, Mycobacterium
GTSDAGGYGRSLGTASEIRERL

SEQ ID NO: 498989 - protein, 6 aa, Mycobacterium
GTSDDI

SEQ ID NO: 498990 - protein, 10 aa, Mycobacterium
GTSDETTAER

SEQ ID NO: 498991 - protein, 6 aa, Mycobacterium
GTSDHA

SEQ ID NO: 498992 - protein, 6 aa, Mycobacterium
GTSDIS

SEQ ID NO: 498993 - protein, 10 aa, Mycobacterium
GTSDPNRRRR

SEQ ID NO: 498994 - protein, 6 aa, Mycobacterium
GTSDRN

SEQ ID NO: 498995 - protein, 9 aa, Mycobacterium
GTSDTTKTA

SEQ ID NO: 498996 - protein, 5 aa, Mycobacterium
GTSEA

SEQ ID NO: 498997 - protein, 32 aa, Mycobacterium
GTSEAGARQLASRARKAVAAEPPPAPDPSHDE

SEQ ID NO: 498998 - protein, 10 aa, Mycobacterium
GTSEGDVKDR

SEQ ID NO: 498999 - protein, 7 aa, Mycobacterium
GTSEGGA

SEQ ID NO: 499000 - protein, 5 aa, Mycobacterium
GTSEI

SEQ ID NO: 499001 - protein, 7 aa, Mycobacterium
GTSEMDS

SEQ ID NO: 499002 - protein, 6 aa, Mycobacterium
GTSEQL

SEQ ID NO: 499003 - protein, 10 aa, Mycobacterium
GTSETDVKDR

SEQ ID NO: 499004 - protein, 6 aa, Mycobacterium
GTSETT

SEQ ID NO: 499005 - protein, 10 aa, Mycobacterium
GTSFATPDKL

SEQ ID NO: 499006 - protein, 27 aa, Mycobacterium
GTSGAEIGGAFGGEKQTGGGRESGSDA

SEQ ID NO: 499007 - protein, 10 aa, Mycobacterium
GTSGDDGSGI

SEQ ID NO: 499008 - protein, 9 aa, Mycobacterium
GTSGDPKAV

SEQ ID NO: 499009 - protein, 10 aa, Mycobacterium
GTSGDPKAVE

SEQ ID NO: 499010 - protein, 8 aa, Mycobacterium
GTSGEELA

SEQ ID NO: 499011 - protein, 10 aa, Mycobacterium
GTSGGLRTDE

SEQ ID NO: 499012 - protein, 6 aa, Mycobacterium
GTSGGR

SEQ ID NO: 499013 - protein, 8 aa, Mycobacterium
GTSGHRGS

SEQ ID NO: 499014 - protein, 10 aa, Mycobacterium
GTSGHRGSAL

SEQ ID NO: 499015 - protein, 13 aa, Mycobacterium
GTSGHRGSSLDTA

SEQ ID NO: 499016 - protein, 10 aa, Mycobacterium
GTSGLKDSRY

SEQ ID NO: 499017 - protein, 15 aa, Mycobacterium
GTSGLPAEDRRRAQQ

SEQ ID NO: 499018 - protein, 22 aa, Mycobacterium
GTSGMGSGSGMNGGSGMSGGNP

SEQ ID NO: 499019 - protein, 6 aa, Mycobacterium
GTSGPQ

SEQ ID NO: 499020 - protein, 6 aa, Mycobacterium
GTSGRI

SEQ ID NO: 499021 - protein, 11 aa, Mycobacterium
GTSGSHQRIGP

SEQ ID NO: 499022 - protein, 10 aa, Mycobacterium
GTSGSPKAVQ

SEQ ID NO: 499023 - protein, 14 aa, Mycobacterium
GTSGTSGTSGTELA

SEQ ID NO: 499024 - protein, 4 aa, Mycobacterium
GTSI

SEQ ID NO: 499025 - protein, 9 aa, Mycobacterium
GTSKEDAKK

SEQ ID NO: 499026 - protein, 11 aa, Mycobacterium
GTSKTTAAQER

SEQ ID NO: 499027 - protein, 18 aa, Mycobacterium
GTSLGAANAAVAASTTSV

SEQ ID NO: 499028 - protein, 8 aa, Mycobacterium
GTSLGEVP

SEQ ID NO: 499029 - protein, 6 aa, Mycobacterium
GTSLGQ

SEQ ID NO: 499030 - protein, 5 aa, Mycobacterium
GTSLK

SEQ ID NO: 499031 - protein, 5 aa, Mycobacterium
GTSLP

SEQ ID NO: 499032 - protein, 5 aa, Mycobacterium
GTSLR

SEQ ID NO: 499033 - protein, 5 aa, Mycobacterium
GTSLS

SEQ ID NO: 499034 - protein, 8 aa, Mycobacterium
GTSLTGQQ

SEQ ID NO: 499035 - protein, 9 aa, Mycobacterium
GTSNDEIQA

SEQ ID NO: 499036 - protein, 10 aa, Mycobacterium
GTSNSDGDTG

SEQ ID NO: 499037 - protein, 10 aa, Mycobacterium
GTSPAAADQA

SEQ ID NO: 499038 - protein, 14 aa, Mycobacterium
GTSPAAIDRAEDRG

SEQ ID NO: 499039 - protein, 7 aa, Mycobacterium
GTSPAGA

SEQ ID NO: 499040 - protein, 8 aa, Mycobacterium
GTSPDGFD

SEQ ID NO: 499041 - protein, 7 aa, Mycobacterium
GTSPDPV

SEQ ID NO: 499042 - protein, 62 aa, Mycobacterium
GTSPEASEEPDAGAEETPAGAEDSDVPAEAADVSAEAADVSAETADVPAVTDATDPPGHEHS

SEQ ID NO: 499043 - protein, 8 aa, Mycobacterium
GTSPENGV

SEQ ID NO: 499044 - protein, 5 aa, Mycobacterium
GTSPG

SEQ ID NO: 499045 - protein, 7 aa, Mycobacterium
GTSPGDV

SEQ ID NO: 499046 - protein, 8 aa, Mycobacterium
GTSPGGLP

SEQ ID NO: 499047 - protein, 13 aa, Mycobacterium
GTSPHPACTPARP

SEQ ID NO: 499048 - protein, 8 aa, Mycobacterium
GTSPKAID

SEQ ID NO: 499049 - protein, 7 aa, Mycobacterium
GTSPSRF

SEQ ID NO: 499050 - protein, 8 aa, Mycobacterium
GTSPSSRY

SEQ ID NO: 499051 - protein, 7 aa, Mycobacterium
GTSPVGL

SEQ ID NO: 499052 - protein, 7 aa, Mycobacterium
GTSPWPE

SEQ ID NO: 499053 - protein, 4 aa, Mycobacterium
GTSQ

SEQ ID NO: 499054 - protein, 9 aa, Mycobacterium
GTSQPQTAE

SEQ ID NO: 499055 - protein, 4 aa, Mycobacterium
GTSR

SEQ ID NO: 499056 - protein, 7 aa, Mycobacterium
GTSRANP

SEQ ID NO: 499057 - protein, 5 aa, Mycobacterium
GTSRE

SEQ ID NO: 499058 - protein, 10 aa, Mycobacterium
GTSREGVAKG

SEQ ID NO: 499059 - protein, 8 aa, Mycobacterium
GTSRERLG

SEQ ID NO: 499060 - protein, 7 aa, Mycobacterium
GTSRGLG

SEQ ID NO: 499061 - protein, 7 aa, Mycobacterium
GTSRGVG

SEQ ID NO: 499062 - protein, 7 aa, Mycobacterium
GTSRKLD

SEQ ID NO: 499063 - protein, 8 aa, Mycobacterium
GTSRNTIR

SEQ ID NO: 499064 - protein, 9 aa, Mycobacterium
GTSRPTAEH

SEQ ID NO: 499065 - protein, 8 aa, Mycobacterium
GTSRQRIG

SEQ ID NO: 499066 - protein, 13 aa, Mycobacterium
GTSRRFSASTRET

SEQ ID NO: 499067 - protein, 9 aa, Mycobacterium
GTSRRGGRA

SEQ ID NO: 499068 - protein, 11 aa, Mycobacterium
GTSRSGEPVEG

SEQ ID NO: 499069 - protein, 8 aa, Mycobacterium
GTSRTAAE

SEQ ID NO: 499070 - protein, 13 aa, Mycobacterium
GTSSAGKHRCGPN

SEQ ID NO: 499071 - protein, 5 aa, Mycobacterium
GTSSD

SEQ ID NO: 499072 - protein, 11 aa, Mycobacterium
GTSSGGSGSVG

SEQ ID NO: 499073 - protein, 10 aa, Mycobacterium
GTSSGPDGTR

SEQ ID NO: 499074 - protein, 8 aa, Mycobacterium
GTSSLEEA

SEQ ID NO: 499075 - protein, 14 aa, Mycobacterium
GTSSLLGGDPGDIS

SEQ ID NO: 499076 - protein, 9 aa, Mycobacterium
GTSSPRRAA

SEQ ID NO: 499077 - protein, 9 aa, Mycobacterium
GTSSPSAAA

SEQ ID NO: 499078 - protein, 7 aa, Mycobacterium
GTSSPSG

SEQ ID NO: 499079 - protein, 6 aa, Mycobacterium
GTSSRD

SEQ ID NO: 499080 - protein, 14 aa, Mycobacterium
GTSSSTLPRSRRIG

SEQ ID NO: 499081 - protein, 7 aa, Mycobacterium
GTSSTEL

SEQ ID NO: 499082 - protein, 7 aa, Mycobacterium
GTSSTSG

SEQ ID NO: 499083 - protein, 8 aa, Mycobacterium
GTSTAGRA

SEQ ID NO: 499084 - protein, 21 aa, Mycobacterium
GTSTDEGPTRRRKRTHEPAVG

SEQ ID NO: 499085 - protein, 7 aa, Mycobacterium
GTSTGSI

SEQ ID NO: 499086 - protein, 7 aa, Mycobacterium
GTSTGSR

SEQ ID NO: 499087 - protein, 5 aa, Mycobacterium
GTSTN

SEQ ID NO: 499088 - protein, 14 aa, Mycobacterium
GTSTPPIHSVRPPR

SEQ ID NO: 499089 - protein, 28 aa, Mycobacterium
GTSTQAARQLASRARRAVSSAPPPAADH

SEQ ID NO: 499090 - protein, 5 aa, Mycobacterium
GTSTR

SEQ ID NO: 499091 - protein, 8 aa, Mycobacterium
GTSTTEKR

SEQ ID NO: 499092 - protein, 7 aa, Mycobacterium
GTSTTGI

SEQ ID NO: 499093 - protein, 17 aa, Mycobacterium
GTSTTSRTAHRNRRAPR

SEQ ID NO: 499094 - protein, 4 aa, Mycobacterium
GTSV

SEQ ID NO: 499095 - protein, 7 aa, Mycobacterium
GTSVEEK

SEQ ID NO: 499096 - protein, 5 aa, Mycobacterium
GTSVG

SEQ ID NO: 499097 - protein, 8 aa, Mycobacterium
GTSVNPVP

SEQ ID NO: 499098 - protein, 7 aa, Mycobacterium
GTSVPED

SEQ ID NO: 499099 - protein, 8 aa, Mycobacterium
GTSVPSGD

SEQ ID NO: 499100 - protein, 5 aa, Mycobacterium
GTSVT

SEQ ID NO: 499101 - protein, 6 aa, Mycobacterium
GTSVTT

SEQ ID NO: 499102 - protein, 4 aa, Mycobacterium
GTSY

SEQ ID NO: 499103 - protein, 7 aa, Mycobacterium
GTSYAEA

SEQ ID NO: 499104 - protein, 6 aa, Mycobacterium
GTSYGQ

SEQ ID NO: 499105 - protein, 9 aa, Mycobacterium
GTSYSTHDE

SEQ ID NO: 499106 - protein, 16 aa, Mycobacterium
GTTAAATGGAASGLAG

SEQ ID NO: 499107 - protein, 7 aa, Mycobacterium
GTTAAQH

SEQ ID NO: 499108 - protein, 21 aa, Mycobacterium
GTTAARPNQPPAGGDDIAEQT

SEQ ID NO: 499109 - protein, 7 aa, Mycobacterium
GTTADNV

SEQ ID NO: 499110 - protein, 10 aa, Mycobacterium
GTTADSDSST

SEQ ID NO: 499111 - protein, 10 aa, Mycobacterium
GTTAEAARAA

SEQ ID NO: 499112 - protein, 7 aa, Mycobacterium
GTTAESA

SEQ ID NO: 499113 - protein, 8 aa, Mycobacterium
GTTAGHDE

SEQ ID NO: 499114 - protein, 10 aa, Mycobacterium
GTTAPASDEL

SEQ ID NO: 499115 - protein, 24 aa, Mycobacterium
GTTAPPGSPAARIGTAGADGLAGA

SEQ ID NO: 499116 - protein, 12 aa, Mycobacterium
GTTAPTEEITDT

SEQ ID NO: 499117 - protein, 7 aa, Mycobacterium
GTTARSA

SEQ ID NO: 499118 - protein, 6 aa, Mycobacterium
GTTART

SEQ ID NO: 499119 - protein, 9 aa, Mycobacterium
GTTASQQTL

SEQ ID NO: 499120 - protein, 13 aa, Mycobacterium
GTTATAEEITDTA

SEQ ID NO: 499121 - protein, 12 aa, Mycobacterium
GTTATTEEITDT

SEQ ID NO: 499122 - protein, 15 aa, Mycobacterium
GTTCQQRSVETTLQG

SEQ ID NO: 499123 - protein, 19 aa, Mycobacterium
GTTDAQTSTLTLPGGKQLG

SEQ ID NO: 499124 - protein, 5 aa, Mycobacterium
GTTDE

SEQ ID NO: 499125 - protein, 7 aa, Mycobacterium
GTTDEQR

SEQ ID NO: 499126 - protein, 5 aa, Mycobacterium
GTTDF

SEQ ID NO: 499127 - protein, 8 aa, Mycobacterium
GTTDGVGF

SEQ ID NO: 499128 - protein, 7 aa, Mycobacterium
GTTDHPG

SEQ ID NO: 499129 - protein, 6 aa, Mycobacterium
GTTDLT

SEQ ID NO: 499130 - protein, 20 aa, Mycobacterium
GTTDRVSTLDPAGAYDNGSF

SEQ ID NO: 499131 - protein, 6 aa, Mycobacterium
GTTDSA

SEQ ID NO: 499132 - protein, 8 aa, Mycobacterium
GTTDSQPW

SEQ ID NO: 499133 - protein, 6 aa, Mycobacterium
GTTDYG

SEQ ID NO: 499134 - protein, 7 aa, Mycobacterium
GTTEAAV

SEQ ID NO: 499135 - protein, 9 aa, Mycobacterium
GTTEAPGLG

SEQ ID NO: 499136 - protein, 6 aa, Mycobacterium
GTTEAV

SEQ ID NO: 499137 - protein, 5 aa, Mycobacterium
GTTEE

SEQ ID NO: 499138 - protein, 11 aa, Mycobacterium
GTTEGSPSYVR

SEQ ID NO: 499139 - protein, 13 aa, Mycobacterium
GTTEQARGRARQL

SEQ ID NO: 499140 - protein, 7 aa, Mycobacterium
GTTEQRD

SEQ ID NO: 499141 - protein, 7 aa, Mycobacterium
GTTEQTV

SEQ ID NO: 499142 - protein, 5 aa, Mycobacterium
GTTFA

SEQ ID NO: 499143 - protein, 5 aa, Mycobacterium
GTTFD

SEQ ID NO: 499144 - protein, 11 aa, Mycobacterium
GTTGAGDAIDR

SEQ ID NO: 499145 - protein, 8 aa, Mycobacterium
GTTGAPKG

SEQ ID NO: 499146 - protein, 15 aa, Mycobacterium
GTTGASKAVKCSQGR

SEQ ID NO: 499147 - protein, 14 aa, Mycobacterium
GTTGESPTTSDDEK

SEQ ID NO: 499148 - protein, 13 aa, Mycobacterium
GTTGESPTTTDDE

SEQ ID NO: 499149 - protein, 14 aa, Mycobacterium
GTTGESPTTTDDEK

SEQ ID NO: 499150 - protein, 15 aa, Mycobacterium
GTTGESPTTTDDEKR

SEQ ID NO: 499151 - protein, 16 aa, Mycobacterium
GTTGESPTTTDDEKRE

SEQ ID NO: 499152 - protein, 9 aa, Mycobacterium
GTTGFGKST

SEQ ID NO: 499153 - protein, 12 aa, Mycobacterium
GTTGGQAQAQCG

SEQ ID NO: 499154 - protein, 6 aa, Mycobacterium
GTTGGS

SEQ ID NO: 499155 - protein, 5 aa, Mycobacterium
GTTGH

SEQ ID NO: 499156 - protein, 8 aa, Mycobacterium
GTTGKPKG

SEQ ID NO: 499157 - protein, 5 aa, Mycobacterium
GTTGL

SEQ ID NO: 499158 - protein, 15 aa, Mycobacterium
GTTGLAGPGGGMGTL

SEQ ID NO: 499159 - protein, 6 aa, Mycobacterium
GTTGLT

SEQ ID NO: 499160 - protein, 5 aa, Mycobacterium
GTTGM

SEQ ID NO: 499161 - protein, 7 aa, Mycobacterium
GTTGMPK

SEQ ID NO: 499162 - protein, 8 aa, Mycobacterium
GTTGNPKG

SEQ ID NO: 499163 - protein, 12 aa, Mycobacterium
GTTGQPVEALRM

SEQ ID NO: 499164 - protein, 6 aa, Mycobacterium
GTTGRA

SEQ ID NO: 499165 - protein, 12 aa, Mycobacterium
GTTGRPKAVRHS

SEQ ID NO: 499166 - protein, 8 aa, Mycobacterium
GTTGRPRG

SEQ ID NO: 499167 - protein, 8 aa, Mycobacterium
GTTGRTDL

SEQ ID NO: 499168 - protein, 5 aa, Mycobacterium
GTTGS

SEQ ID NO: 499169 - protein, 6 aa, Mycobacterium
GTTGSL

SEQ ID NO: 499170 - protein, 7 aa, Mycobacterium
GTTGTPK

SEQ ID NO: 499171 - protein, 12 aa, Mycobacterium
GTTGTPKGAAFD

SEQ ID NO: 499172 - protein, 19 aa, Mycobacterium
GTTGTPKGAKHSGGSGGIG

SEQ ID NO: 499173 - protein, 19 aa, Mycobacterium
GTTGTPKGANQTGGNAGIG

SEQ ID NO: 499174 - protein, 15 aa, Mycobacterium
GTTGTPKGVPRSSHF

SEQ ID NO: 499175 - protein, 6 aa, Mycobacterium
GTTGYS

SEQ ID NO: 499176 - protein, 15 aa, Mycobacterium
GTTHKGTAKSKKTGD

SEQ ID NO: 499177 - protein, 8 aa, Mycobacterium
GTTHRPSS

SEQ ID NO: 499178 - protein, 4 aa, Mycobacterium
GTTI

SEQ ID NO: 499179 - protein, 6 aa, Mycobacterium
GTTIPK

SEQ ID NO: 499180 - protein, 6 aa, Mycobacterium
GTTLAE

SEQ ID NO: 499181 - protein, 5 aa, Mycobacterium
GTTLT

SEQ ID NO: 499182 - protein, 18 aa, Mycobacterium
GTTMRSRGGPNHRARPAR

SEQ ID NO: 499183 - protein, 4 aa, Mycobacterium
GTTN

SEQ ID NO: 499184 - protein, 7 aa, Mycobacterium
GTTNCEK

SEQ ID NO: 499185 - protein, 5 aa, Mycobacterium
GTTNF

SEQ ID NO: 499186 - protein, 5 aa, Mycobacterium
GTTNP

SEQ ID NO: 499187 - protein, 5 aa, Mycobacterium
GTTNQ

SEQ ID NO: 499188 - protein, 18 aa, Mycobacterium
GTTNRGNPTAYPVQQSDG

SEQ ID NO: 499189 - protein, 22 aa, Mycobacterium
GTTNRGNPTAYPVRQSDGSWAE

SEQ ID NO: 499190 - protein, 6 aa, Mycobacterium
GTTPAA

SEQ ID NO: 499191 - protein, 7 aa, Mycobacterium
GTTPAGM

SEQ ID NO: 499192 - protein, 7 aa, Mycobacterium
GTTPAGR

SEQ ID NO: 499193 - protein, 7 aa, Mycobacterium
GTTPAQH

SEQ ID NO: 499194 - protein, 13 aa, Mycobacterium
GTTPDAAASPHER

SEQ ID NO: 499195 - protein, 13 aa, Mycobacterium
GTTPDGAANPHER

SEQ ID NO: 499196 - protein, 18 aa, Mycobacterium
GTTPDNDFSTECSGVGGQ

SEQ ID NO: 499197 - protein, 6 aa, Mycobacterium
GTTPEH

SEQ ID NO: 499198 - protein, 8 aa, Mycobacterium
GTTPERPH

SEQ ID NO: 499199 - protein, 7 aa, Mycobacterium
GTTPGVG

SEQ ID NO: 499200 - protein, 16 aa, Mycobacterium
GTTPLGLKEAKPLPAS

SEQ ID NO: 499201 - protein, 5 aa, Mycobacterium
GTTPN

SEQ ID NO: 499202 - protein, 7 aa, Mycobacterium
GTTPPFG

SEQ ID NO: 499203 - protein, 9 aa, Mycobacterium
GTTPQIGQG

SEQ ID NO: 499204 - protein, 6 aa, Mycobacterium
GTTPQR

SEQ ID NO: 499205 - protein, 13 aa, Mycobacterium
GTTPSAYRSDRRR

SEQ ID NO: 499206 - protein, 15 aa, Mycobacterium
GTTPVGPTDAVPHGT

SEQ ID NO: 499207 - protein, 10 aa, Mycobacterium
GTTPVRSKNG

SEQ ID NO: 499208 - protein, 4 aa, Mycobacterium
GTTQ

SEQ ID NO: 499209 - protein, 7 aa, Mycobacterium
GTTQHAR

SEQ ID NO: 499210 - protein, 10 aa, Mycobacterium
GTTQHARRHA

SEQ ID NO: 499211 - protein, 7 aa, Mycobacterium
GTTQMGT

SEQ ID NO: 499212 - protein, 15 aa, Mycobacterium
GTTQPPTVPGAPTRI

SEQ ID NO: 499213 - protein, 6 aa, Mycobacterium
GTTRDF

SEQ ID NO: 499214 - protein, 6 aa, Mycobacterium
GTTREQ

SEQ ID NO: 499215 - protein, 11 aa, Mycobacterium
GTTRHAQRHAA

SEQ ID NO: 499216 - protein, 5 aa, Mycobacterium
GTTRR

SEQ ID NO: 499217 - protein, 13 aa, Mycobacterium
GTTRRFSATDRKT

SEQ ID NO: 499218 - protein, 12 aa, Mycobacterium
GTTRRFSATTRQ

SEQ ID NO: 499219 - protein, 13 aa, Mycobacterium
GTTRRFSKTNRRT

SEQ ID NO: 499220 - protein, 15 aa, Mycobacterium
GTTRRFSSTTVKTLT

SEQ ID NO: 499221 - protein, 19 aa, Mycobacterium
GTTSDINPQDPATLQDGGS

SEQ ID NO: 499222 - protein, 7 aa, Mycobacterium
GTTSDLS

SEQ ID NO: 499223 - protein, 13 aa, Mycobacterium
GTTSGAKAAVHSS

SEQ ID NO: 499224 - protein, 11 aa, Mycobacterium
GTTSIREGSRL

SEQ ID NO: 499225 - protein, 5 aa, Mycobacterium
GTTSL

SEQ ID NO: 499226 - protein, 6 aa, Mycobacterium
GTTSLA

SEQ ID NO: 499227 - protein, 15 aa, Mycobacterium
GTTSQAPRVDEGRAE

SEQ ID NO: 499228 - protein, 16 aa, Mycobacterium
GTTSQAPRVDEGREEA

SEQ ID NO: 499229 - protein, 8 aa, Mycobacterium
GTTSQLGG

SEQ ID NO: 499230 - protein, 8 aa, Mycobacterium
GTTSQPKA

SEQ ID NO: 499231 - protein, 16 aa, Mycobacterium
GTTSRRPTEPGAFGTV

SEQ ID NO: 499232 - protein, 9 aa, Mycobacterium
GTTSSQRTL

SEQ ID NO: 499233 - protein, 5 aa, Mycobacterium
GTTST

SEQ ID NO: 499234 - protein, 9 aa, Mycobacterium
GTTSTDINE

SEQ ID NO: 499235 - protein, 4 aa, Mycobacterium
GTTT

SEQ ID NO: 499236 - protein, 5 aa, Mycobacterium
GTTTA

SEQ ID NO: 499237 - protein, 6 aa, Mycobacterium
GTTTAM

SEQ ID NO: 499238 - protein, 22 aa, Mycobacterium
GTTTAYPLPKPGDGPAPKPVTL

SEQ ID NO: 499239 - protein, 7 aa, Mycobacterium
GTTTEGD

SEQ ID NO: 499240 - protein, 10 aa, Mycobacterium
GTTTERHDQH

SEQ ID NO: 499241 - protein, 14 aa, Mycobacterium
GTTTGGQASRSSRI

SEQ ID NO: 499242 - protein, 9 aa, Mycobacterium
GTTTKTSIP

SEQ ID NO: 499243 - protein, 6 aa, Mycobacterium
GTTTQE

SEQ ID NO: 499244 - protein, 6 aa, Mycobacterium
GTTTRG

SEQ ID NO: 499245 - protein, 10 aa, Mycobacterium
GTTTTTTQQA

SEQ ID NO: 499246 - protein, 4 aa, Mycobacterium
GTTV

SEQ ID NO: 499247 - protein, 7 aa, Mycobacterium
GTTVDNE

SEQ ID NO: 499248 - protein, 7 aa, Mycobacterium
GTTVERS

SEQ ID NO: 499249 - protein, 6 aa, Mycobacterium
GTTVGG

SEQ ID NO: 499250 - protein, 7 aa, Mycobacterium
GTTVPAG

SEQ ID NO: 499251 - protein, 15 aa, Mycobacterium
GTTVSSARPGRTGRG

SEQ ID NO: 499252 - protein, 7 aa, Mycobacterium
GTTVTRS

SEQ ID NO: 499253 - protein, 5 aa, Mycobacterium
GTTWP

SEQ ID NO: 499254 - protein, 4 aa, Mycobacterium
GTTY

SEQ ID NO: 499255 - protein, 12 aa, Mycobacterium
GTTYAAARQDGV

SEQ ID NO: 499256 - protein, 14 aa, Mycobacterium
GTTYDIGAEIGVIS

SEQ ID NO: 499257 - protein, 9 aa, Mycobacterium
GTTYPNPPV

SEQ ID NO: 499258 - protein, 4 aa, Mycobacterium
GTVA

SEQ ID NO: 499259 - protein, 9 aa, Mycobacterium
GTVAEADRE

SEQ ID NO: 499260 - protein, 9 aa, Mycobacterium
GTVAGRPHD

SEQ ID NO: 499261 - protein, 5 aa, Mycobacterium
GTVAR

SEQ ID NO: 499262 - protein, 9 aa, Mycobacterium
GTVARAESL

SEQ ID NO: 499263 - protein, 14 aa, Mycobacterium
GTVARTGTSEYGRT

SEQ ID NO: 499264 - protein, 7 aa, Mycobacterium
GTVDAAT

SEQ ID NO: 499265 - protein, 11 aa, Mycobacterium
GTVDAGGCADT

SEQ ID NO: 499266 - protein, 10 aa, Mycobacterium
GTVDDASGHV

SEQ ID NO: 499267 - protein, 6 aa, Mycobacterium
GTVDET

SEQ ID NO: 499268 - protein, 6 aa, Mycobacterium
GTVDNA

SEQ ID NO: 499269 - protein, 10 aa, Mycobacterium
GTVDNDPWSP

SEQ ID NO: 499270 - protein, 7 aa, Mycobacterium
GTVDNTD

SEQ ID NO: 499271 - protein, 6 aa, Mycobacterium
GTVDPA

SEQ ID NO: 499272 - protein, 10 aa, Mycobacterium
GTVDPEAARS

SEQ ID NO: 499273 - protein, 43 aa, Mycobacterium
GTVDPPSSEPVDPPTGQPTDPPAADEPAPPTNFPGERPAFGTP

SEQ ID NO: 499274 - protein, 7 aa, Mycobacterium
GTVDRDG

SEQ ID NO: 499275 - protein, 9 aa, Mycobacterium
GTVDREGVT

SEQ ID NO: 499276 - protein, 6 aa, Mycobacterium
GTVDTD

SEQ ID NO: 499277 - protein, 9 aa, Mycobacterium
GTVEEREQR

SEQ ID NO: 499278 - protein, 11 aa, Mycobacterium
GTVEERRRRDR

SEQ ID NO: 499279 - protein, 7 aa, Mycobacterium
GTVEGFT

SEQ ID NO: 499280 - protein, 5 aa, Mycobacterium
GTVEH

SEQ ID NO: 499281 - protein, 7 aa, Mycobacterium
GTVEPGY

SEQ ID NO: 499282 - protein, 10 aa, Mycobacterium
GTVEQAAQAL

SEQ ID NO: 499283 - protein, 9 aa, Mycobacterium
GTVESGSQV

SEQ ID NO: 499284 - protein, 20 aa, Mycobacterium
GTVESGSQVINSTKGKKERL

SEQ ID NO: 499285 - protein, 24 aa, Mycobacterium
GTVETAGRRGTRVRDRPASTPRSS

SEQ ID NO: 499286 - protein, 4 aa, Mycobacterium
GTVF

SEQ ID NO: 499287 - protein, 10 aa, Mycobacterium
GTVGEHTATR

SEQ ID NO: 499288 - protein, 5 aa, Mycobacterium
GTVGP

SEQ ID NO: 499289 - protein, 17 aa, Mycobacterium
GTVGPGQFKEGQDPSKM

SEQ ID NO: 499290 - protein, 15 aa, Mycobacterium
GTVGRSTPKSAALRA

SEQ ID NO: 499291 - protein, 9 aa, Mycobacterium
GTVGSASRA

SEQ ID NO: 499292 - protein, 11 aa, Mycobacterium
GTVGSTEATTF

SEQ ID NO: 499293 - protein, 7 aa, Mycobacterium
GTVGTLQ

SEQ ID NO: 499294 - protein, 11 aa, Mycobacterium
GTVGTPPPPTL

SEQ ID NO: 499295 - protein, 4 aa, Mycobacterium
GTVI

SEQ ID NO: 499296 - protein, 23 aa, Mycobacterium
GTVKSGKVRDLRSGEVSEPTGGD

SEQ ID NO: 499297 - protein, 6 aa, Mycobacterium
GTVKSR

SEQ ID NO: 499298 - protein, 7 aa, Mycobacterium
GTVLGTG

SEQ ID NO: 499299 - protein, 11 aa, Mycobacterium
GTVNRGNATQA

SEQ ID NO: 499300 - protein, 8 aa, Mycobacterium
GTVNTVRP

SEQ ID NO: 499301 - protein, 8 aa, Mycobacterium
GTVPAPEP

SEQ ID NO: 499302 - protein, 8 aa, Mycobacterium
GTVPDGGG

SEQ ID NO: 499303 - protein, 7 aa, Mycobacterium
GTVPDSP

SEQ ID NO: 499304 - protein, 8 aa, Mycobacterium
GTVPEDAG

SEQ ID NO: 499305 - protein, 14 aa, Mycobacterium
GTVPPDALQPYRPK

SEQ ID NO: 499306 - protein, 7 aa, Mycobacterium
GTVPPEA

SEQ ID NO: 499307 - protein, 7 aa, Mycobacterium
GTVPPPA

SEQ ID NO: 499308 - protein, 18 aa, Mycobacterium
GTVPQASGRGLGHTGGTL

SEQ ID NO: 499309 - protein, 8 aa, Mycobacterium
GTVPSNGL

SEQ ID NO: 499310 - protein, 10 aa, Mycobacterium
GTVPTQTTTC

SEQ ID NO: 499311 - protein, 12 aa, Mycobacterium
GTVQGDPRFTEY

SEQ ID NO: 499312 - protein, 7 aa, Mycobacterium
GTVQVDG

SEQ ID NO: 499313 - protein, 6 aa, Mycobacterium
GTVRAD

SEQ ID NO: 499314 - protein, 6 aa, Mycobacterium
GTVRAG

SEQ ID NO: 499315 - protein, 8 aa, Mycobacterium
GTVRAGDT

SEQ ID NO: 499316 - protein, 9 aa, Mycobacterium
GTVRAKGPV

SEQ ID NO: 499317 - protein, 10 aa, Mycobacterium
GTVRAKGPVP

SEQ ID NO: 499318 - protein, 6 aa, Mycobacterium
GTVRGD

SEQ ID NO: 499319 - protein, 9 aa, Mycobacterium
GTVRGDPRL

SEQ ID NO: 499320 - protein, 7 aa, Mycobacterium
GTVRGGI

SEQ ID NO: 499321 - protein, 7 aa, Mycobacterium
GTVRGRR

SEQ ID NO: 499322 - protein, 8 aa, Mycobacterium
GTVRRGAE

SEQ ID NO: 499323 - protein, 23 aa, Mycobacterium
GTVRSGKVRDLRSGEIAEPTGQD

SEQ ID NO: 499324 - protein, 8 aa, Mycobacterium
GTVRTGSR

SEQ ID NO: 499325 - protein, 9 aa, Mycobacterium
GTVSADGHT

SEQ ID NO: 499326 - protein, 7 aa, Mycobacterium
GTVSAPG

SEQ ID NO: 499327 - protein, 10 aa, Mycobacterium
GTVSEHHATR

SEQ ID NO: 499328 - protein, 7 aa, Mycobacterium
GTVSERD

SEQ ID NO: 499329 - protein, 6 aa, Mycobacterium
GTVSGK

SEQ ID NO: 499330 - protein, 11 aa, Mycobacterium
GTVSGLSDGGA

SEQ ID NO: 499331 - protein, 6 aa, Mycobacterium
GTVSGS

SEQ ID NO: 499332 - protein, 7 aa, Mycobacterium
GTVSPEA

SEQ ID NO: 499333 - protein, 7 aa, Mycobacterium
GTVSPTE

SEQ ID NO: 499334 - protein, 9 aa, Mycobacterium
GTVSRNGLP

SEQ ID NO: 499335 - protein, 8 aa, Mycobacterium
GTVSTTGV

SEQ ID NO: 499336 - protein, 9 aa, Mycobacterium
GTVTAASEW

SEQ ID NO: 499337 - protein, 12 aa, Mycobacterium
GTVTAASEWGGI

SEQ ID NO: 499338 - protein, 15 aa, Mycobacterium
GTVTAGNSSQQNDAA

SEQ ID NO: 499339 - protein, 14 aa, Mycobacterium
GTVTATSTPIHRGR

SEQ ID NO: 499340 - protein, 8 aa, Mycobacterium
GTVTDSTI

SEQ ID NO: 499341 - protein, 7 aa, Mycobacterium
GTVTEPG

SEQ ID NO: 499342 - protein, 9 aa, Mycobacterium
GTVTGAEPD

SEQ ID NO: 499343 - protein, 9 aa, Mycobacterium
GTVTGESAK

SEQ ID NO: 499344 - protein, 15 aa, Mycobacterium
GTVTGTSPAAEEQSR

SEQ ID NO: 499345 - protein, 7 aa, Mycobacterium
GTVTRDY

SEQ ID NO: 499346 - protein, 14 aa, Mycobacterium
GTVTSKGEGAEDPV

SEQ ID NO: 499347 - protein, 12 aa, Mycobacterium
GTVTSSSSPDFA

SEQ ID NO: 499348 - protein, 11 aa, Mycobacterium
GTVTVGADPDP

SEQ ID NO: 499349 - protein, 14 aa, Mycobacterium
GTVTVTSSGPLPAE

SEQ ID NO: 499350 - protein, 6 aa, Mycobacterium
GTVYGT

SEQ ID NO: 499351 - protein, 5 aa, Mycobacterium
GTVYT

SEQ ID NO: 499352 - protein, 7 aa, Mycobacterium
GTWKGQR

SEQ ID NO: 499353 - protein, 7 aa, Mycobacterium
GTWNGQR

SEQ ID NO: 499354 - protein, 18 aa, Mycobacterium
GTWPSGTTVHANPDGTAF

SEQ ID NO: 499355 - protein, 15 aa, Mycobacterium
GTWPSPAFTPARPDE

SEQ ID NO: 499356 - protein, 9 aa, Mycobacterium
GTWQGPTAE

SEQ ID NO: 499357 - protein, 6 aa, Mycobacterium
GTWRTD

SEQ ID NO: 499358 - protein, 8 aa, Mycobacterium
GTWSGQAT

SEQ ID NO: 499359 - protein, 7 aa, Mycobacterium
GTYADAE

SEQ ID NO: 499360 - protein, 5 aa, Mycobacterium
GTYDR

SEQ ID NO: 499361 - protein, 25 aa, Mycobacterium
GTYDTASAAATARGRVTAASQRKID

SEQ ID NO: 499362 - protein, 6 aa, Mycobacterium
GTYDTE

SEQ ID NO: 499363 - protein, 26 aa, Mycobacterium
GTYEPGYYSDSTRTYSIGDPSPDVAQ

SEQ ID NO: 499364 - protein, 21 aa, Mycobacterium
GTYETEKFRDNPPDGPAKGGE

SEQ ID NO: 499365 - protein, 10 aa, Mycobacterium
GTYETSDGKY

SEQ ID NO: 499366 - protein, 5 aa, Mycobacterium
GTYGT

SEQ ID NO: 499367 - protein, 6 aa, Mycobacterium
GTYNGR

SEQ ID NO: 499368 - protein, 6 aa, Mycobacterium
GTYPAS

SEQ ID NO: 499369 - protein, 8 aa, Mycobacterium
GTYPASEI

SEQ ID NO: 499370 - protein, 22 aa, Mycobacterium
GTYPRGATERLDSDAFSPNTAV

SEQ ID NO: 499371 - protein, 13 aa, Mycobacterium
GTYQKDGNTRVRA

SEQ ID NO: 499372 - protein, 4 aa, Mycobacterium
GTYR

SEQ ID NO: 499373 - protein, 8 aa, Mycobacterium
GTYSGNSG

SEQ ID NO: 499374 - protein, 5 aa, Mycobacterium
GTYSI

SEQ ID NO: 499375 - protein, 6 aa, Mycobacterium
GTYSPE

SEQ ID NO: 499376 - protein, 5 aa, Mycobacterium
GTYSQ

SEQ ID NO: 499377 - protein, 6 aa, Mycobacterium
GTYTAR

SEQ ID NO: 499378 - protein, 7 aa, Mycobacterium
GTYTDRP

SEQ ID NO: 499379 - protein, 12 aa, Mycobacterium
GTYTDTTHSQGY

SEQ ID NO: 499380 - protein, 9 aa, Mycobacterium
GTYTEPSHR

SEQ ID NO: 499381 - protein, 5 aa, Mycobacterium
GTYTG

SEQ ID NO: 499382 - protein, 14 aa, Mycobacterium
GTYTPGAPAGDGYP

SEQ ID NO: 499383 - protein, 7 aa, Mycobacterium
GTYTPGG

SEQ ID NO: 499384 - protein, 9 aa, Mycobacterium
GTYTSDASE

SEQ ID NO: 499385 - protein, 5 aa, Mycobacterium
GTYVT

SEQ ID NO: 499386 - protein, 6 aa, Mycobacterium
GVAAAR

SEQ ID NO: 499387 - protein, 5 aa, Mycobacterium
GVAAD

SEQ ID NO: 499388 - protein, 11 aa, Mycobacterium
GVAADATDLGL

SEQ ID NO: 499389 - protein, 10 aa, Mycobacterium
GVAAGASWGN

SEQ ID NO: 499390 - protein, 7 aa, Mycobacterium
GVAAGQS

SEQ ID NO: 499391 - protein, 8 aa, Mycobacterium
GVAAGRDA

SEQ ID NO: 499392 - protein, 12 aa, Mycobacterium
GVAAKDRQAARE

SEQ ID NO: 499393 - protein, 14 aa, Mycobacterium
GVAAKGGWGPGHDG

SEQ ID NO: 499394 - protein, 10 aa, Mycobacterium
GVAAPDPTVT

SEQ ID NO: 499395 - protein, 9 aa, Mycobacterium
GVAAPSYGL

SEQ ID NO: 499396 - protein, 11 aa, Mycobacterium
GVAATDRREAM

SEQ ID NO: 499397 - protein, 8 aa, Mycobacterium
GVAATEGA

SEQ ID NO: 499398 - protein, 5 aa, Mycobacterium
GVADA

SEQ ID NO: 499399 - protein, 12 aa, Mycobacterium
GVADAELNADPA

SEQ ID NO: 499400 - protein, 14 aa, Mycobacterium
GVADAELNSDPART

SEQ ID NO: 499401 - protein, 5 aa, Mycobacterium
GVADE

SEQ ID NO: 499402 - protein, 7 aa, Mycobacterium
GVADGPD

SEQ ID NO: 499403 - protein, 19 aa, Mycobacterium
GVADGPLPTHYEPHESPVR

SEQ ID NO: 499404 - protein, 8 aa, Mycobacterium
GVADGRGL

SEQ ID NO: 499405 - protein, 6 aa, Mycobacterium
GVADGT

SEQ ID NO: 499406 - protein, 9 aa, Mycobacterium
GVADGTPVS

SEQ ID NO: 499407 - protein, 5 aa, Mycobacterium
GVADP

SEQ ID NO: 499408 - protein, 9 aa, Mycobacterium
GVADPHPIS

SEQ ID NO: 499409 - protein, 7 aa, Mycobacterium
GVADRRQ

SEQ ID NO: 499410 - protein, 12 aa, Mycobacterium
GVADSVARSGGL

SEQ ID NO: 499411 - protein, 7 aa, Mycobacterium
GVADTTL

SEQ ID NO: 499412 - protein, 4 aa, Mycobacterium
GVAE

SEQ ID NO: 499413 - protein, 23 aa, Mycobacterium
GVAEADKPAARKALQETPLDPER

SEQ ID NO: 499414 - protein, 22 aa, Mycobacterium
GVAEADKPAARKALRETPLDPA

SEQ ID NO: 499415 - protein, 11 aa, Mycobacterium
GVAEADTRITG

SEQ ID NO: 499416 - protein, 6 aa, Mycobacterium
GVAEEA

SEQ ID NO: 499417 - protein, 25 aa, Mycobacterium
GVAEGGTKGDIGPTITENQVKPQKI

SEQ ID NO: 499418 - protein, 10 aa, Mycobacterium
GVAEGNDGDG

SEQ ID NO: 499419 - protein, 9 aa, Mycobacterium
GVAETQSRT

SEQ ID NO: 499420 - protein, 15 aa, Mycobacterium
GVAGADEYGLPADSA

SEQ ID NO: 499421 - protein, 9 aa, Mycobacterium
GVAGADPAS

SEQ ID NO: 499422 - protein, 8 aa, Mycobacterium
GVAGDANP

SEQ ID NO: 499423 - protein, 5 aa, Mycobacterium
GVAGF

SEQ ID NO: 499424 - protein, 5 aa, Mycobacterium
GVAGG

SEQ ID NO: 499425 - protein, 6 aa, Mycobacterium
GVAGGA

SEQ ID NO: 499426 - protein, 8 aa, Mycobacterium
GVAGGGAD

SEQ ID NO: 499427 - protein, 7 aa, Mycobacterium
GVAGGGP

SEQ ID NO: 499428 - protein, 7 aa, Mycobacterium
GVAGGTW

SEQ ID NO: 499429 - protein, 18 aa, Mycobacterium
GVAGPNRRTFGHGGSGGS

SEQ ID NO: 499430 - protein, 6 aa, Mycobacterium
GVAGPV

SEQ ID NO: 499431 - protein, 79 aa, Mycobacterium
GVAGSAGNGGHGGNGGSGADGDIGVAGSGAGADGGNGFAGGTGGDGGTGGNTTGGSNGSGGNAGHGGNAGDGAAGNTGV

SEQ ID NO: 499432 - protein, 5 aa, Mycobacterium
GVAGT

SEQ ID NO: 499433 - protein, 6 aa, Mycobacterium
GVAGTG

SEQ ID NO: 499434 - protein, 6 aa, Mycobacterium
GVAGTT

SEQ ID NO: 499435 - protein, 13 aa, Mycobacterium
GVAGTTDRCLTRY

SEQ ID NO: 499436 - protein, 6 aa, Mycobacterium
GVAKSG

SEQ ID NO: 499437 - protein, 10 aa, Mycobacterium
GVAKTEVEQR

SEQ ID NO: 499438 - protein, 7 aa, Mycobacterium
GVAKTTS

SEQ ID NO: 499439 - protein, 43 aa, Mycobacterium
GVANAGSKVLSSTPKPPKTAGEKVTDEGEGGKKVAEYLVAQKI

SEQ ID NO: 499440 - protein, 6 aa, Mycobacterium
GVANEA

SEQ ID NO: 499441 - protein, 7 aa, Mycobacterium
GVANGEA

SEQ ID NO: 499442 - protein, 7 aa, Mycobacterium
GVANGMS

SEQ ID NO: 499443 - protein, 6 aa, Mycobacterium
GVANSG

SEQ ID NO: 499444 - protein, 10 aa, Mycobacterium
GVAPAADRRT

SEQ ID NO: 499445 - protein, 13 aa, Mycobacterium
GVAPAASKAWRTS

SEQ ID NO: 499446 - protein, 6 aa, Mycobacterium
GVAPAG

SEQ ID NO: 499447 - protein, 21 aa, Mycobacterium
GVAPARVPSRQPRGARRDPAI

SEQ ID NO: 499448 - protein, 8 aa, Mycobacterium
GVAPATLA

SEQ ID NO: 499449 - protein, 11 aa, Mycobacterium
GVAPATPDIGA

SEQ ID NO: 499450 - protein, 5 aa, Mycobacterium
GVAPD

SEQ ID NO: 499451 - protein, 7 aa, Mycobacterium
GVAPDEI

SEQ ID NO: 499452 - protein, 6 aa, Mycobacterium
GVAPDF

SEQ ID NO: 499453 - protein, 10 aa, Mycobacterium
GVAPDGPGSF

SEQ ID NO: 499454 - protein, 7 aa, Mycobacterium
GVAPDPR

SEQ ID NO: 499455 - protein, 7 aa, Mycobacterium
GVAPEAV

SEQ ID NO: 499456 - protein, 6 aa, Mycobacterium
GVAPED

SEQ ID NO: 499457 - protein, 7 aa, Mycobacterium
GVAPETP

SEQ ID NO: 499458 - protein, 7 aa, Mycobacterium
GVAPGAS

SEQ ID NO: 499459 - protein, 7 aa, Mycobacterium
GVAPGDR

SEQ ID NO: 499460 - protein, 6 aa, Mycobacterium
GVAPGE

SEQ ID NO: 499461 - protein, 6 aa, Mycobacterium
GVAPGV

SEQ ID NO: 499462 - protein, 8 aa, Mycobacterium
GVAPPAAV

SEQ ID NO: 499463 - protein, 11 aa, Mycobacterium
GVAPPGDREAH

SEQ ID NO: 499464 - protein, 8 aa, Mycobacterium
GVAPPSLD

SEQ ID NO: 499465 - protein, 5 aa, Mycobacterium
GVAPR

SEQ ID NO: 499466 - protein, 6 aa, Mycobacterium
GVAPSG

SEQ ID NO: 499467 - protein, 23 aa, Mycobacterium
GVAQAEKSAARQALRDNPLDPER

SEQ ID NO: 499468 - protein, 7 aa, Mycobacterium
GVARESA

SEQ ID NO: 499469 - protein, 6 aa, Mycobacterium
GVARPG

SEQ ID NO: 499470 - protein, 7 aa, Mycobacterium
GVARPGT

SEQ ID NO: 499471 - protein, 9 aa, Mycobacterium
GVARPNESF

SEQ ID NO: 499472 - protein, 9 aa, Mycobacterium
GVARRDARG

SEQ ID NO: 499473 - protein, 14 aa, Mycobacterium
GVARSGVSAYPPEV

SEQ ID NO: 499474 - protein, 15 aa, Mycobacterium
GVARSGVSAYPPEVT

SEQ ID NO: 499475 - protein, 6 aa, Mycobacterium
GVARTP

SEQ ID NO: 499476 - protein, 4 aa, Mycobacterium
GVAS

SEQ ID NO: 499477 - protein, 8 aa, Mycobacterium
GVASEQGL

SEQ ID NO: 499478 - protein, 5 aa, Mycobacterium
GVASG

SEQ ID NO: 499479 - protein, 11 aa, Mycobacterium
GVASGRAYTDV

SEQ ID NO: 499480 - protein, 24 aa, Mycobacterium
GVASPASAGVAAAAATEPSGLLPS

SEQ ID NO: 499481 - protein, 13 aa, Mycobacterium
GVASPGGELSPVQ

SEQ ID NO: 499482 - protein, 8 aa, Mycobacterium
GVASPRGL

SEQ ID NO: 499483 - protein, 7 aa, Mycobacterium
GVATATA

SEQ ID NO: 499484 - protein, 9 aa, Mycobacterium
GVATDTPES

SEQ ID NO: 499485 - protein, 12 aa, Mycobacterium
GVATGELSPTSM

SEQ ID NO: 499486 - protein, 13 aa, Mycobacterium
GVATGYARRSGLT

SEQ ID NO: 499487 - protein, 6 aa, Mycobacterium
GVATKT

SEQ ID NO: 499488 - protein, 9 aa, Mycobacterium
GVATNGSAV

SEQ ID NO: 499489 - protein, 7 aa, Mycobacterium
GVATPRI

SEQ ID NO: 499490 - protein, 29 aa, Mycobacterium
GVATQTISTRAARATTASAATTATGTATG

SEQ ID NO: 499491 - protein, 14 aa, Mycobacterium
GVATTGKPDPETGM

SEQ ID NO: 499492 - protein, 9 aa, Mycobacterium
GVATTSEEM

SEQ ID NO: 499493 - protein, 4 aa, Mycobacterium
GVAV

SEQ ID NO: 499494 - protein, 4 aa, Mycobacterium
GVDA

SEQ ID NO: 499495 - protein, 9 aa, Mycobacterium
GVDAAGGGG

SEQ ID NO: 499496 - protein, 8 aa, Mycobacterium
GVDADGRR

SEQ ID NO: 499497 - protein, 8 aa, Mycobacterium
GVDADTAR

SEQ ID NO: 499498 - protein, 12 aa, Mycobacterium
GVDAEKSDPAHI

SEQ ID NO: 499499 - protein, 5 aa, Mycobacterium
GVDAG

SEQ ID NO: 499500 - protein, 17 aa, Mycobacterium
GVDARQDSAADQGTTRQ

SEQ ID NO: 499501 - protein, 14 aa, Mycobacterium
GVDATEDPWHGRPA

SEQ ID NO: 499502 - protein, 10 aa, Mycobacterium
GVDATGEFAP

SEQ ID NO: 499503 - protein, 19 aa, Mycobacterium
GVDATGELAPDAISRTRAA

SEQ ID NO: 499504 - protein, 10 aa, Mycobacterium
GVDATGQFAP

SEQ ID NO: 499505 - protein, 12 aa, Mycobacterium
GVDCGDPVWKIH

SEQ ID NO: 499506 - protein, 8 aa, Mycobacterium
GVDDATAA

SEQ ID NO: 499507 - protein, 9 aa, Mycobacterium
GVDDNESAV

SEQ ID NO: 499508 - protein, 6 aa, Mycobacterium
GVDDQA

SEQ ID NO: 499509 - protein, 13 aa, Mycobacterium
GVDDSAAAELEPD

SEQ ID NO: 499510 - protein, 4 aa, Mycobacterium
GVDE

SEQ ID NO: 499511 - protein, 10 aa, Mycobacterium
GVDEAGRGAC

SEQ ID NO: 499512 - protein, 5 aa, Mycobacterium
GVDEK

SEQ ID NO: 499513 - protein, 7 aa, Mycobacterium
GVDERAR

SEQ ID NO: 499514 - protein, 7 aa, Mycobacterium
GVDERTA

SEQ ID NO: 499515 - protein, 7 aa, Mycobacterium
GVDEVPD

SEQ ID NO: 499516 - protein, 5 aa, Mycobacterium
GVDGA

SEQ ID NO: 499517 - protein, 10 aa, Mycobacterium
GVDGADTRRK

SEQ ID NO: 499518 - protein, 19 aa, Mycobacterium
GVDGAGGRALPDWSPAGSL

SEQ ID NO: 499519 - protein, 17 aa, Mycobacterium
GVDGAQSFSTPEGLRDD

SEQ ID NO: 499520 - protein, 5 aa, Mycobacterium
GVDGG

SEQ ID NO: 499521 - protein, 13 aa, Mycobacterium
GVDGGAGQAGEDG

SEQ ID NO: 499522 - protein, 8 aa, Mycobacterium
GVDGGDPY

SEQ ID NO: 499523 - protein, 6 aa, Mycobacterium
GVDGHD

SEQ ID NO: 499524 - protein, 17 aa, Mycobacterium
GVDGPDSLPAVENNTAT

SEQ ID NO: 499525 - protein, 12 aa, Mycobacterium
GVDGQGSGDAVG

SEQ ID NO: 499526 - protein, 5 aa, Mycobacterium
GVDGR

SEQ ID NO: 499527 - protein, 20 aa, Mycobacterium
GVDGSPSAIERARRNADRAG

SEQ ID NO: 499528 - protein, 18 aa, Mycobacterium
GVDGSRLESIGTERTPGL

SEQ ID NO: 499529 - protein, 10 aa, Mycobacterium
GVDHASASLN

SEQ ID NO: 499530 - protein, 4 aa, Mycobacterium
GVDK

SEQ ID NO: 499531 - protein, 6 aa, Mycobacterium
GVDNAE

SEQ ID NO: 499532 - protein, 7 aa, Mycobacterium
GVDNPAT

SEQ ID NO: 499533 - protein, 10 aa, Mycobacterium
GVDNPVPPWQ

SEQ ID NO: 499534 - protein, 8 aa, Mycobacterium
GVDNRTYR

SEQ ID NO: 499535 - protein, 6 aa, Mycobacterium
GVDPAD

SEQ ID NO: 499536 - protein, 7 aa, Mycobacterium
GVDPADK

SEQ ID NO: 499537 - protein, 6 aa, Mycobacterium
GVDPAE

SEQ ID NO: 499538 - protein, 13 aa, Mycobacterium
GVDPAQTLRDGTA

SEQ ID NO: 499539 - protein, 7 aa, Mycobacterium
GVDPAQV

SEQ ID NO: 499540 - protein, 6 aa, Mycobacterium
GVDPAV

SEQ ID NO: 499541 - protein, 10 aa, Mycobacterium
GVDPAVPEAG

SEQ ID NO: 499542 - protein, 20 aa, Mycobacterium
GVDPDEVSDADKAGLAAAAP

SEQ ID NO: 499543 - protein, 7 aa, Mycobacterium
GVDPDSL

SEQ ID NO: 499544 - protein, 6 aa, Mycobacterium
GVDPEA

SEQ ID NO: 499545 - protein, 11 aa, Mycobacterium
GVDPEDQESLR

SEQ ID NO: 499546 - protein, 6 aa, Mycobacterium
GVDPES

SEQ ID NO: 499547 - protein, 5 aa, Mycobacterium
GVDPG

SEQ ID NO: 499548 - protein, 9 aa, Mycobacterium
GVDPGADPL

SEQ ID NO: 499549 - protein, 8 aa, Mycobacterium
GVDPGASL

SEQ ID NO: 499550 - protein, 6 aa, Mycobacterium
GVDPGK

SEQ ID NO: 499551 - protein, 8 aa, Mycobacterium
GVDPGPDL

SEQ ID NO: 499552 - protein, 8 aa, Mycobacterium
GVDPGPEL

SEQ ID NO: 499553 - protein, 8 aa, Mycobacterium
GVDPGPGN

SEQ ID NO: 499554 - protein, 8 aa, Mycobacterium
GVDPGPTH

SEQ ID NO: 499555 - protein, 7 aa, Mycobacterium
GVDPGVP

SEQ ID NO: 499556 - protein, 17 aa, Mycobacterium
GVDPKGTVQLESAGSHY

SEQ ID NO: 499557 - protein, 13 aa, Mycobacterium
GVDPKNLDDITTD

SEQ ID NO: 499558 - protein, 10 aa, Mycobacterium
GVDPKNQRET

SEQ ID NO: 499559 - protein, 8 aa, Mycobacterium
GVDPKTLD

SEQ ID NO: 499560 - protein, 7 aa, Mycobacterium
GVDPLDR

SEQ ID NO: 499561 - protein, 5 aa, Mycobacterium
GVDPN

SEQ ID NO: 499562 - protein, 20 aa, Mycobacterium
GVDPPRSAGLPCQSSAAAVN

SEQ ID NO: 499563 - protein, 13 aa, Mycobacterium
GVDPPSRAREEIR

SEQ ID NO: 499564 - protein, 9 aa, Mycobacterium
GVDPQRGWG

SEQ ID NO: 499565 - protein, 13 aa, Mycobacterium
GVDPRKLHNRAAA

SEQ ID NO: 499566 - protein, 16 aa, Mycobacterium
GVDPRRPAALPAERAA

SEQ ID NO: 499567 - protein, 16 aa, Mycobacterium
GVDPRRPPALPAESAA

SEQ ID NO: 499568 - protein, 9 aa, Mycobacterium
GVDPRSVAA

SEQ ID NO: 499569 - protein, 7 aa, Mycobacterium
GVDPRVR

SEQ ID NO: 499570 - protein, 11 aa, Mycobacterium
GVDPSAVPAAG

SEQ ID NO: 499571 - protein, 14 aa, Mycobacterium
GVDPTDPRRKAASP

SEQ ID NO: 499572 - protein, 8 aa, Mycobacterium
GVDPTGPY

SEQ ID NO: 499573 - protein, 5 aa, Mycobacterium
GVDPV

SEQ ID NO: 499574 - protein, 13 aa, Mycobacterium
GVDPVDRSSVATT

SEQ ID NO: 499575 - protein, 9 aa, Mycobacterium
GVDQATAQA

SEQ ID NO: 499576 - protein, 11 aa, Mycobacterium
GVDQTDPRIAG

SEQ ID NO: 499577 - protein, 10 aa, Mycobacterium
GVDRADARGG

SEQ ID NO: 499578 - protein, 5 aa, Mycobacterium
GVDRD

SEQ ID NO: 499579 - protein, 8 aa, Mycobacterium
GVDRDHRK

SEQ ID NO: 499580 - protein, 11 aa, Mycobacterium
GVDRDKLQSAM

SEQ ID NO: 499581 - protein, 5 aa, Mycobacterium
GVDRP

SEQ ID NO: 499582 - protein, 7 aa, Mycobacterium
GVDRPRG

SEQ ID NO: 499583 - protein, 5 aa, Mycobacterium
GVDRQ

SEQ ID NO: 499584 - protein, 5 aa, Mycobacterium
GVDRT

SEQ ID NO: 499585 - protein, 7 aa, Mycobacterium
GVDRTES

SEQ ID NO: 499586 - protein, 4 aa, Mycobacterium
GVDS

SEQ ID NO: 499587 - protein, 19 aa, Mycobacterium
GVDSAEEELAERSTPSTMP

SEQ ID NO: 499588 - protein, 5 aa, Mycobacterium
GVDSD

SEQ ID NO: 499589 - protein, 10 aa, Mycobacterium
GVDSGREDHG

SEQ ID NO: 499590 - protein, 9 aa, Mycobacterium
GVDSSGRRY

SEQ ID NO: 499591 - protein, 7 aa, Mycobacterium
GVDTGPI

SEQ ID NO: 499592 - protein, 8 aa, Mycobacterium
GVDTGSLR

SEQ ID NO: 499593 - protein, 11 aa, Mycobacterium
GVDTGTPTGRA

SEQ ID NO: 499594 - protein, 10 aa, Mycobacterium
GVDTRGNTTR

SEQ ID NO: 499595 - protein, 8 aa, Mycobacterium
GVDTSATY

SEQ ID NO: 499596 - protein, 7 aa, Mycobacterium
GVDTSDL

SEQ ID NO: 499597 - protein, 10 aa, Mycobacterium
GVDTTGAYSG

SEQ ID NO: 499598 - protein, 11 aa, Mycobacterium
GVDTTSDAPIN

SEQ ID NO: 499599 - protein, 9 aa, Mycobacterium
GVDTTTSQT

SEQ ID NO: 499600 - protein, 10 aa, Mycobacterium
GVDTTTSQTA

SEQ ID NO: 499601 - protein, 5 aa, Mycobacterium
GVDVG

SEQ ID NO: 499602 - protein, 5 aa, Mycobacterium
GVDVR

SEQ ID NO: 499603 - protein, 5 aa, Mycobacterium
GVEAA

SEQ ID NO: 499604 - protein, 8 aa, Mycobacterium
GVEAADGD

SEQ ID NO: 499605 - protein, 9 aa, Mycobacterium
GVEAGDTAD

SEQ ID NO: 499606 - protein, 8 aa, Mycobacterium
GVEAGPGG

SEQ ID NO: 499607 - protein, 10 aa, Mycobacterium
GVEAGTQITA

SEQ ID NO: 499608 - protein, 12 aa, Mycobacterium
GVEAKVSLNVVA

SEQ ID NO: 499609 - protein, 8 aa, Mycobacterium
GVEANDGD

SEQ ID NO: 499610 - protein, 12 aa, Mycobacterium
GVEAPYEAPENP

SEQ ID NO: 499611 - protein, 9 aa, Mycobacterium
GVEATDNPL

SEQ ID NO: 499612 - protein, 4 aa, Mycobacterium
GVED

SEQ ID NO: 499613 - protein, 12 aa, Mycobacterium
GVEDARAAAALG

SEQ ID NO: 499614 - protein, 7 aa, Mycobacterium
GVEDGRP

SEQ ID NO: 499615 - protein, 6 aa, Mycobacterium
GVEDGT

SEQ ID NO: 499616 - protein, 9 aa, Mycobacterium
GVEDLSEGD

SEQ ID NO: 499617 - protein, 19 aa, Mycobacterium
GVEDPAYPRTQNASGPDEL

SEQ ID NO: 499618 - protein, 7 aa, Mycobacterium
GVEDPQE

SEQ ID NO: 499619 - protein, 7 aa, Mycobacterium
GVEDRRQ

SEQ ID NO: 499620 - protein, 8 aa, Mycobacterium
GVEEGATA

SEQ ID NO: 499621 - protein, 6 aa, Mycobacterium
GVEELG

SEQ ID NO: 499622 - protein, 17 aa, Mycobacterium
GVEELGRSGASVAESGV

SEQ ID NO: 499623 - protein, 10 aa, Mycobacterium
GVEGASGLRK

SEQ ID NO: 499624 - protein, 10 aa, Mycobacterium
GVEGASGMRK

SEQ ID NO: 499625 - protein, 8 aa, Mycobacterium
GVEGGPSL

SEQ ID NO: 499626 - protein, 8 aa, Mycobacterium
GVEGGRGY

SEQ ID NO: 499627 - protein, 5 aa, Mycobacterium
GVEGN

SEQ ID NO: 499628 - protein, 24 aa, Mycobacterium
GVEGPGGDRVGDGDDEGGLQPPDR

SEQ ID NO: 499629 - protein, 5 aa, Mycobacterium
GVEGR

SEQ ID NO: 499630 - protein, 7 aa, Mycobacterium
GVEGTDI

SEQ ID NO: 499631 - protein, 4 aa, Mycobacterium
GVEH

SEQ ID NO: 499632 - protein, 10 aa, Mycobacterium
GVEHDAGSRI

SEQ ID NO: 499633 - protein, 8 aa, Mycobacterium
GVEHGQGV

SEQ ID NO: 499634 - protein, 14 aa, Mycobacterium
GVEHPPACTRETNP

SEQ ID NO: 499635 - protein, 15 aa, Mycobacterium
GVEHPPACTRETNPL

SEQ ID NO: 499636 - protein, 6 aa, Mycobacterium
GVEKGP

SEQ ID NO: 499637 - protein, 10 aa, Mycobacterium
GVEKPEPAAM

SEQ ID NO: 499638 - protein, 8 aa, Mycobacterium
GVEKPTAL

SEQ ID NO: 499639 - protein, 8 aa, Mycobacterium
GVEKTEYD

SEQ ID NO: 499640 - protein, 9 aa, Mycobacterium
GVENATTYV

SEQ ID NO: 499641 - protein, 7 aa, Mycobacterium
GVENNAT

SEQ ID NO: 499642 - protein, 11 aa, Mycobacterium
GVENTPVPDDM

SEQ ID NO: 499643 - protein, 4 aa, Mycobacterium
GVEP

SEQ ID NO: 499644 - protein, 6 aa, Mycobacterium
GVEPAE

SEQ ID NO: 499645 - protein, 9 aa, Mycobacterium
GVEPDQRAT

SEQ ID NO: 499646 - protein, 6 aa, Mycobacterium
GVEPES

SEQ ID NO: 499647 - protein, 5 aa, Mycobacterium
GVEPG

SEQ ID NO: 499648 - protein, 8 aa, Mycobacterium
GVEPGDGK

SEQ ID NO: 499649 - protein, 7 aa, Mycobacterium
GVEPGDR

SEQ ID NO: 499650 - protein, 6 aa, Mycobacterium
GVEPGE

SEQ ID NO: 499651 - protein, 11 aa, Mycobacterium
GVEPGERTDPL

SEQ ID NO: 499652 - protein, 8 aa, Mycobacterium
GVEPGEWT

SEQ ID NO: 499653 - protein, 6 aa, Mycobacterium
GVEPGQ

SEQ ID NO: 499654 - protein, 8 aa, Mycobacterium
GVEPGQWT

SEQ ID NO: 499655 - protein, 8 aa, Mycobacterium
GVEPGTQF

SEQ ID NO: 499656 - protein, 8 aa, Mycobacterium
GVEPRERP

SEQ ID NO: 499657 - protein, 8 aa, Mycobacterium
GVEPSDGP

SEQ ID NO: 499658 - protein, 9 aa, Mycobacterium
GVEPSGEAF

SEQ ID NO: 499659 - protein, 15 aa, Mycobacterium
GVEPVGSAAEALPGA

SEQ ID NO: 499660 - protein, 6 aa, Mycobacterium
GVEPYA

SEQ ID NO: 499661 - protein, 9 aa, Mycobacterium
GVEQKPVEG

SEQ ID NO: 499662 - protein, 5 aa, Mycobacterium
GVEQL

SEQ ID NO: 499663 - protein, 17 aa, Mycobacterium
GVERKDYNSLGSRRGNH

SEQ ID NO: 499664 - protein, 17 aa, Mycobacterium
GVERKDYNSYGSRRGNH

SEQ ID NO: 499665 - protein, 12 aa, Mycobacterium
GVERNPTDEAVA

SEQ ID NO: 499666 - protein, 9 aa, Mycobacterium
GVERPGQRE

SEQ ID NO: 499667 - protein, 11 aa, Mycobacterium
GVERSTTDEAV

SEQ ID NO: 499668 - protein, 5 aa, Mycobacterium
GVERT

SEQ ID NO: 499669 - protein, 4 aa, Mycobacterium
GVES

SEQ ID NO: 499670 - protein, 5 aa, Mycobacterium
GVESE

SEQ ID NO: 499671 - protein, 10 aa, Mycobacterium
GVESGAALES

SEQ ID NO: 499672 - protein, 10 aa, Mycobacterium
GVESGPQPGR

SEQ ID NO: 499673 - protein, 9 aa, Mycobacterium
GVESQGELD

SEQ ID NO: 499674 - protein, 5 aa, Mycobacterium
GVESR

SEQ ID NO: 499675 - protein, 8 aa, Mycobacterium
GVESSRGD

SEQ ID NO: 499676 - protein, 7 aa, Mycobacterium
GVESTGG

SEQ ID NO: 499677 - protein, 6 aa, Mycobacterium
GVESTR

SEQ ID NO: 499678 - protein, 14 aa, Mycobacterium
GVETEVSGAGNGPL

SEQ ID NO: 499679 - protein, 6 aa, Mycobacterium
GVETGR

SEQ ID NO: 499680 - protein, 6 aa, Mycobacterium
GVETPD

SEQ ID NO: 499681 - protein, 7 aa, Mycobacterium
GVETPGV

SEQ ID NO: 499682 - protein, 50 aa, Mycobacterium
GVETQVSADQAAARQSVEEAGRRDVARAQTQAEAKVAQESARAQAEQREE

SEQ ID NO: 499683 - protein, 6 aa, Mycobacterium
GVETTT

SEQ ID NO: 499684 - protein, 5 aa, Mycobacterium
GVFTD

SEQ ID NO: 499685 - protein, 9 aa, Mycobacterium
GVGAAGSML

SEQ ID NO: 499686 - protein, 5 aa, Mycobacterium
GVGAD

SEQ ID NO: 499687 - protein, 6 aa, Mycobacterium
GVGADG

SEQ ID NO: 499688 - protein, 20 aa, Mycobacterium
GVGAGAPGRRSRARNATGSV

SEQ ID NO: 499689 - protein, 13 aa, Mycobacterium
GVGAGGAAIGDAP

SEQ ID NO: 499690 - protein, 10 aa, Mycobacterium
GVGAGGAGIG

SEQ ID NO: 499691 - protein, 7 aa, Mycobacterium
GVGAPQL

SEQ ID NO: 499692 - protein, 7 aa, Mycobacterium
GVGAPVT

SEQ ID NO: 499693 - protein, 6 aa, Mycobacterium
GVGAQQ

SEQ ID NO: 499694 - protein, 8 aa, Mycobacterium
GVGATDKA

SEQ ID NO: 499695 - protein, 13 aa, Mycobacterium
GVGATENAEGFGT

SEQ ID NO: 499696 - protein, 13 aa, Mycobacterium
GVGATENAEGFTT

SEQ ID NO: 499697 - protein, 4 aa, Mycobacterium
GVGD

SEQ ID NO: 499698 - protein, 9 aa, Mycobacterium
GVGDEEELR

SEQ ID NO: 499699 - protein, 7 aa, Mycobacterium
GVGDKSL

SEQ ID NO: 499700 - protein, 7 aa, Mycobacterium
GVGDPDH

SEQ ID NO: 499701 - protein, 6 aa, Mycobacterium
GVGDPG

SEQ ID NO: 499702 - protein, 5 aa, Mycobacterium
GVGDQ

SEQ ID NO: 499703 - protein, 7 aa, Mycobacterium
GVGDRSL

SEQ ID NO: 499704 - protein, 15 aa, Mycobacterium
GVGDYGTHEGPLDVP

SEQ ID NO: 499705 - protein, 24 aa, Mycobacterium
GVGEAGASYLAGDTAAAATFGIAG

SEQ ID NO: 499706 - protein, 6 aa, Mycobacterium
GVGEDD

SEQ ID NO: 499707 - protein, 6 aa, Mycobacterium
GVGEDE

SEQ ID NO: 499708 - protein, 10 aa, Mycobacterium
GVGEDITGGL

SEQ ID NO: 499709 - protein, 11 aa, Mycobacterium
GVGEDITGGLP

SEQ ID NO: 499710 - protein, 6 aa, Mycobacterium
GVGEDQ

SEQ ID NO: 499711 - protein, 7 aa, Mycobacterium
GVGEEVN

SEQ ID NO: 499712 - protein, 6 aa, Mycobacterium
GVGEHD

SEQ ID NO: 499713 - protein, 10 aa, Mycobacterium
GVGEKELSDE

SEQ ID NO: 499714 - protein, 7 aa, Mycobacterium
GVGEPVP

SEQ ID NO: 499715 - protein, 9 aa, Mycobacterium
GVGEPVSPL

SEQ ID NO: 499716 - protein, 9 aa, Mycobacterium
GVGEQLKSG

SEQ ID NO: 499717 - protein, 15 aa, Mycobacterium
GVGERDVTRTEHKDA

SEQ ID NO: 499718 - protein, 7 aa, Mycobacterium
GVGESAT

SEQ ID NO: 499719 - protein, 6 aa, Mycobacterium
GVGESD

SEQ ID NO: 499720 - protein, 7 aa, Mycobacterium
GVGESGT

SEQ ID NO: 499721 - protein, 4 aa, Mycobacterium
GVGF

SEQ ID NO: 499722 - protein, 5 aa, Mycobacterium
GVGGA

SEQ ID NO: 499723 - protein, 15 aa, Mycobacterium
GVGGAGGAGAPAMPS

SEQ ID NO: 499724 - protein, 27 aa, Mycobacterium
GVGGAGGAGGFGDVGGNGGAGGMGGAG

SEQ ID NO: 499725 - protein, 13 aa, Mycobacterium
GVGGAGGAGTAGA

SEQ ID NO: 499726 - protein, 12 aa, Mycobacterium
GVGGAGGNGGDA

SEQ ID NO: 499727 - protein, 39 aa, Mycobacterium
GVGGAGGSAGLYGAGGAGGAGGASTAGLGGAGGAGGDAG

SEQ ID NO: 499728 - protein, 23 aa, Mycobacterium
GVGGAGGYGSSDGGAGGAGGNGG

SEQ ID NO: 499729 - protein, 9 aa, Mycobacterium
GVGGAGSML

SEQ ID NO: 499730 - protein, 6 aa, Mycobacterium
GVGGAS

SEQ ID NO: 499731 - protein, 7 aa, Mycobacterium
GVGGDAA

SEQ ID NO: 499732 - protein, 77 aa, Mycobacterium
GVGGDAGDGAAGGAGTNNFQSYAGAGGFGGFGGTGGQGGLFGNGGNGGSGGNGGDGGGGARNGADAGPGALGGQGGS

SEQ ID NO: 499733 - protein, 8 aa, Mycobacterium
GVGGDKGP

SEQ ID NO: 499734 - protein, 9 aa, Mycobacterium
GVGGDPEGD

SEQ ID NO: 499735 - protein, 16 aa, Mycobacterium
GVGGDVDSIVEAFLAS

SEQ ID NO: 499736 - protein, 5 aa, Mycobacterium
GVGGG

SEQ ID NO: 499737 - protein, 6 aa, Mycobacterium
GVGGIG

SEQ ID NO: 499738 - protein, 5 aa, Mycobacterium
GVGGN

SEQ ID NO: 499739 - protein, 11 aa, Mycobacterium
GVGGPAAYAAQ

SEQ ID NO: 499740 - protein, 10 aa, Mycobacterium
GVGGPESEHD

SEQ ID NO: 499741 - protein, 12 aa, Mycobacterium
GVGGQGGDGGGN

SEQ ID NO: 499742 - protein, 7 aa, Mycobacterium
GVGGQQV

SEQ ID NO: 499743 - protein, 6 aa, Mycobacterium
GVGGRA

SEQ ID NO: 499744 - protein, 12 aa, Mycobacterium
GVGGSGGTGGAG

SEQ ID NO: 499745 - protein, 6 aa, Mycobacterium
GVGGTG

SEQ ID NO: 499746 - protein, 29 aa, Mycobacterium
GVGGTGGAGGVGAVGGDGGRGGDSTTGTV

SEQ ID NO: 499747 - protein, 9 aa, Mycobacterium
GVGGTGGIG

SEQ ID NO: 499748 - protein, 62 aa, Mycobacterium
GVGGTGGTGGAGGAGAAGGNGGDGGSAIADSNEGGTGGTGGTGGTGGTGAVGGNGGTGGNGF

SEQ ID NO: 499749 - protein, 27 aa, Mycobacterium
GVGGTLGGGPVSSGGSSPVSAGLGRAA

SEQ ID NO: 499750 - protein, 6 aa, Mycobacterium
GVGGTS

SEQ ID NO: 499751 - protein, 26 aa, Mycobacterium
GVGGVGGAGEGSGNGGVGGEGGRGGQ

SEQ ID NO: 499752 - protein, 24 aa, Mycobacterium
GVGGVGGSGGDSGGTGGAGGQGGA

SEQ ID NO: 499753 - protein, 23 aa, Mycobacterium
GVGGVGGSSTGGVGGQGGTGGRA

SEQ ID NO: 499754 - protein, 5 aa, Mycobacterium
GVGHG

SEQ ID NO: 499755 - protein, 22 aa, Mycobacterium
GVGHGGHQRARRPGPRFGPAPV

SEQ ID NO: 499756 - protein, 5 aa, Mycobacterium
GVGIG

SEQ ID NO: 499757 - protein, 11 aa, Mycobacterium
GVGKCTPHDGQ

SEQ ID NO: 499758 - protein, 5 aa, Mycobacterium
GVGKG

SEQ ID NO: 499759 - protein, 7 aa, Mycobacterium
GVGKGDK

SEQ ID NO: 499760 - protein, 10 aa, Mycobacterium
GVGKGLQDHP

SEQ ID NO: 499761 - protein, 13 aa, Mycobacterium
GVGKGSAEPHKTK

SEQ ID NO: 499762 - protein, 10 aa, Mycobacterium
GVGKKTNKIQ

SEQ ID NO: 499763 - protein, 5 aa, Mycobacterium
GVGKS

SEQ ID NO: 499764 - protein, 5 aa, Mycobacterium
GVGKT

SEQ ID NO: 499765 - protein, 6 aa, Mycobacterium
GVGKTI

SEQ ID NO: 499766 - protein, 6 aa, Mycobacterium
GVGKTR

SEQ ID NO: 499767 - protein, 7 aa, Mycobacterium
GVGKTSM

SEQ ID NO: 499768 - protein, 6 aa, Mycobacterium
GVGKTT

SEQ ID NO: 499769 - protein, 10 aa, Mycobacterium
GVGKTTAAGR

SEQ ID NO: 499770 - protein, 7 aa, Mycobacterium
GVGKTTL

SEQ ID NO: 499771 - protein, 9 aa, Mycobacterium
GVGKTTLAR

SEQ ID NO: 499772 - protein, 8 aa, Mycobacterium
GVGKTVTT

SEQ ID NO: 499773 - protein, 17 aa, Mycobacterium
GVGNAGSIDTGAFNGNN

SEQ ID NO: 499774 - protein, 6 aa, Mycobacterium
GVGNDR

SEQ ID NO: 499775 - protein, 11 aa, Mycobacterium
GVGNDRPRPHM

SEQ ID NO: 499776 - protein, 13 aa, Mycobacterium
GVGNGGSGGVGGA

SEQ ID NO: 499777 - protein, 10 aa, Mycobacterium
GVGNGRDRPA

SEQ ID NO: 499778 - protein, 12 aa, Mycobacterium
GVGNNKERPDTP

SEQ ID NO: 499779 - protein, 6 aa, Mycobacterium
GVGNPK

SEQ ID NO: 499780 - protein, 15 aa, Mycobacterium
GVGNPKPLHETADES

SEQ ID NO: 499781 - protein, 4 aa, Mycobacterium
GVGP

SEQ ID NO: 499782 - protein, 9 aa, Mycobacterium
GVGPADGTG

SEQ ID NO: 499783 - protein, 13 aa, Mycobacterium
GVGPATAQAIAAH

SEQ ID NO: 499784 - protein, 12 aa, Mycobacterium
GVGPATARAIGH

SEQ ID NO: 499785 - protein, 5 aa, Mycobacterium
GVGPD

SEQ ID NO: 499786 - protein, 8 aa, Mycobacterium
GVGPDAPT

SEQ ID NO: 499787 - protein, 8 aa, Mycobacterium
GVGPDGRN

SEQ ID NO: 499788 - protein, 5 aa, Mycobacterium
GVGPE

SEQ ID NO: 499789 - protein, 5 aa, Mycobacterium
GVGPG

SEQ ID NO: 499790 - protein, 7 aa, Mycobacterium
GVGPGDT

SEQ ID NO: 499791 - protein, 6 aa, Mycobacterium
GVGPGE

SEQ ID NO: 499792 - protein, 6 aa, Mycobacterium
GVGPGG

SEQ ID NO: 499793 - protein, 25 aa, Mycobacterium
GVGPGGTRPHPAPKHPSGAVPPAIP

SEQ ID NO: 499794 - protein, 9 aa, Mycobacterium
GVGPGNARL

SEQ ID NO: 499795 - protein, 7 aa, Mycobacterium
GVGPGQT

SEQ ID NO: 499796 - protein, 7 aa, Mycobacterium
GVGPGSL

SEQ ID NO: 499797 - protein, 7 aa, Mycobacterium
GVGPGSR

SEQ ID NO: 499798 - protein, 17 aa, Mycobacterium
GVGPRDETNPEVAGGAP

SEQ ID NO: 499799 - protein, 9 aa, Mycobacterium
GVGPSGLGA

SEQ ID NO: 499800 - protein, 7 aa, Mycobacterium
GVGPTGQ

SEQ ID NO: 499801 - protein, 6 aa, Mycobacterium
GVGPYP

SEQ ID NO: 499802 - protein, 8 aa, Mycobacterium
GVGQGRLD

SEQ ID NO: 499803 - protein, 5 aa, Mycobacterium
GVGQP

SEQ ID NO: 499804 - protein, 8 aa, Mycobacterium
GVGQQPAD

SEQ ID NO: 499805 - protein, 5 aa, Mycobacterium
GVGQR

SEQ ID NO: 499806 - protein, 14 aa, Mycobacterium
GVGRDGEPTQGGYS

SEQ ID NO: 499807 - protein, 6 aa, Mycobacterium
GVGREA

SEQ ID NO: 499808 - protein, 7 aa, Mycobacterium
GVGREEA

SEQ ID NO: 499809 - protein, 7 aa, Mycobacterium
GVGRETA

SEQ ID NO: 499810 - protein, 10 aa, Mycobacterium
GVGRGDRSET

SEQ ID NO: 499811 - protein, 14 aa, Mycobacterium
GVGRHRGEPRTRGH

SEQ ID NO: 499812 - protein, 4 aa, Mycobacterium
GVGS

SEQ ID NO: 499813 - protein, 10 aa, Mycobacterium
GVGSADDTIE

SEQ ID NO: 499814 - protein, 9 aa, Mycobacterium
GVGSDENEV

SEQ ID NO: 499815 - protein, 9 aa, Mycobacterium
GVGSDSPVS

SEQ ID NO: 499816 - protein, 15 aa, Mycobacterium
GVGSPKPLHETDDES

SEQ ID NO: 499817 - protein, 15 aa, Mycobacterium
GVGSPKPVHETDDES

SEQ ID NO: 499818 - protein, 9 aa, Mycobacterium
GVGSSETGA

SEQ ID NO: 499819 - protein, 6 aa, Mycobacterium
GVGSYT

SEQ ID NO: 499820 - protein, 16 aa, Mycobacterium
GVGTAVPATRETPDQF

SEQ ID NO: 499821 - protein, 8 aa, Mycobacterium
GVGTDGRK

SEQ ID NO: 499822 - protein, 7 aa, Mycobacterium
GVGTESA

SEQ ID NO: 499823 - protein, 13 aa, Mycobacterium
GVGTGISASDRAT

SEQ ID NO: 499824 - protein, 5 aa, Mycobacterium
GVGTP

SEQ ID NO: 499825 - protein, 8 aa, Mycobacterium
GVGTQIAD

SEQ ID NO: 499826 - protein, 20 aa, Mycobacterium
GVGVGRSKKEAEQKAAAEAW

SEQ ID NO: 499827 - protein, 4 aa, Mycobacterium
GVHA

SEQ ID NO: 499828 - protein, 5 aa, Mycobacterium
GVHEG

SEQ ID NO: 499829 - protein, 11 aa, Mycobacterium
GVHGADPSSWY

SEQ ID NO: 499830 - protein, 5 aa, Mycobacterium
GVHGE

SEQ ID NO: 499831 - protein, 5 aa, Mycobacterium
GVHGP

SEQ ID NO: 499832 - protein, 7 aa, Mycobacterium
GVHGPRG

SEQ ID NO: 499833 - protein, 12 aa, Mycobacterium
GVHGRGPRDHDA

SEQ ID NO: 499834 - protein, 9 aa, Mycobacterium
GVHPEPVDT

SEQ ID NO: 499835 - protein, 6 aa, Mycobacterium
GVHPND

SEQ ID NO: 499836 - protein, 8 aa, Mycobacterium
GVHPTDAG

SEQ ID NO: 499837 - protein, 19 aa, Mycobacterium
GVHSESEGAEPSRRVVVLR

SEQ ID NO: 499838 - protein, 19 aa, Mycobacterium
GVHSESEGVEPARRVVVLH

SEQ ID NO: 499839 - protein, 19 aa, Mycobacterium
GVHSESEGVEPSRRVVILA

SEQ ID NO: 499840 - protein, 8 aa, Mycobacterium
GVHSGDSA

SEQ ID NO: 499841 - protein, 11 aa, Mycobacterium
GVHSVGEDRPV

SEQ ID NO: 499842 - protein, 5 aa, Mycobacterium
GVHTN

SEQ ID NO: 499843 - protein, 16 aa, Mycobacterium
GVIDGNETERLIRSQL

SEQ ID NO: 499844 - protein, 4 aa, Mycobacterium
GVIG

SEQ ID NO: 499845 - protein, 11 aa, Mycobacterium
GVIGNSRSPGH

SEQ ID NO: 499846 - protein, 6 aa, Mycobacterium
GVIGPN

SEQ ID NO: 499847 - protein, 7 aa, Mycobacterium
GVIGPQA

SEQ ID NO: 499848 - protein, 9 aa, Mycobacterium
GVIPTGRTL

SEQ ID NO: 499849 - protein, 4 aa, Mycobacterium
GVIQ

SEQ ID NO: 499850 - protein, 7 aa, Mycobacterium
GVISRNQ

SEQ ID NO: 499851 - protein, 6 aa, Mycobacterium
GVKADE

SEQ ID NO: 499852 - protein, 20 aa, Mycobacterium
GVKDGIESALNQTPEEGRRR

SEQ ID NO: 499853 - protein, 4 aa, Mycobacterium
GVKE

SEQ ID NO: 499854 - protein, 10 aa, Mycobacterium
GVKEENSSCA

SEQ ID NO: 499855 - protein, 5 aa, Mycobacterium
GVKEP

SEQ ID NO: 499856 - protein, 10 aa, Mycobacterium
GVKKKEAIDR

SEQ ID NO: 499857 - protein, 10 aa, Mycobacterium
GVKKQGLSGA

SEQ ID NO: 499858 - protein, 9 aa, Mycobacterium
GVKNEDEGL

SEQ ID NO: 499859 - protein, 8 aa, Mycobacterium
GVKPRGPS

SEQ ID NO: 499860 - protein, 6 aa, Mycobacterium
GVKRQE

SEQ ID NO: 499861 - protein, 8 aa, Mycobacterium
GVKRSDVG

SEQ ID NO: 499862 - protein, 9 aa, Mycobacterium
GVKSTGGGG

SEQ ID NO: 499863 - protein, 7 aa, Mycobacterium
GVKSTTA

SEQ ID NO: 499864 - protein, 10 aa, Mycobacterium
GVKYASPNAL

SEQ ID NO: 499865 - protein, 27 aa, Mycobacterium
GVLEASSDSLSADPVRHRRDRERSMML

SEQ ID NO: 499866 - protein, 11 aa, Mycobacterium
GVLGDDDARAA

SEQ ID NO: 499867 - protein, 10 aa, Mycobacterium
GVLGEANGAT

SEQ ID NO: 499868 - protein, 11 aa, Mycobacterium
GVLGGDKKALK

SEQ ID NO: 499869 - protein, 7 aa, Mycobacterium
GVLGPEH

SEQ ID NO: 499870 - protein, 8 aa, Mycobacterium
GVLPDADG

SEQ ID NO: 499871 - protein, 5 aa, Mycobacterium
GVLPP

SEQ ID NO: 499872 - protein, 7 aa, Mycobacterium
GVMPDDQ

SEQ ID NO: 499873 - protein, 13 aa, Mycobacterium
GVNADTIEQAAEA

SEQ ID NO: 499874 - protein, 8 aa, Mycobacterium
GVNAREAV

SEQ ID NO: 499875 - protein, 9 aa, Mycobacterium
GVNDAPALA

SEQ ID NO: 499876 - protein, 7 aa, Mycobacterium
GVNDYPA

SEQ ID NO: 499877 - protein, 5 aa, Mycobacterium
GVNES

SEQ ID NO: 499878 - protein, 4 aa, Mycobacterium
GVNG

SEQ ID NO: 499879 - protein, 7 aa, Mycobacterium
GVNGAGD

SEQ ID NO: 499880 - protein, 10 aa, Mycobacterium
GVNGGNQTVP

SEQ ID NO: 499881 - protein, 15 aa, Mycobacterium
GVNGGSPGHGGNGGN

SEQ ID NO: 499882 - protein, 8 aa, Mycobacterium
GVNGPRGW

SEQ ID NO: 499883 - protein, 21 aa, Mycobacterium
GVNGSDGADGNQGAPGTAGQD

SEQ ID NO: 499884 - protein, 5 aa, Mycobacterium
GVNLR

SEQ ID NO: 499885 - protein, 4 aa, Mycobacterium
GVNP

SEQ ID NO: 499886 - protein, 9 aa, Mycobacterium
GVNPDDLRP

SEQ ID NO: 499887 - protein, 7 aa, Mycobacterium
GVNPGFA

SEQ ID NO: 499888 - protein, 7 aa, Mycobacterium
GVNPNTV

SEQ ID NO: 499889 - protein, 5 aa, Mycobacterium
GVNPR

SEQ ID NO: 499890 - protein, 6 aa, Mycobacterium
GVNPRR

SEQ ID NO: 499891 - protein, 9 aa, Mycobacterium
GVNPTNDGN

SEQ ID NO: 499892 - protein, 9 aa, Mycobacterium
GVNPTNDGT

SEQ ID NO: 499893 - protein, 8 aa, Mycobacterium
GVNQAGRQ

SEQ ID NO: 499894 - protein, 8 aa, Mycobacterium
GVNQSQGV

SEQ ID NO: 499895 - protein, 6 aa, Mycobacterium
GVNRPG

SEQ ID NO: 499896 - protein, 5 aa, Mycobacterium
GVNSA

SEQ ID NO: 499897 - protein, 20 aa, Mycobacterium
GVNSDGRTKGMTAPSGDAQA

SEQ ID NO: 499898 - protein, 5 aa, Mycobacterium
GVNSP

SEQ ID NO: 499899 - protein, 5 aa, Mycobacterium
GVPAA

SEQ ID NO: 499900 - protein, 11 aa, Mycobacterium
GVPAAGADDVS

SEQ ID NO: 499901 - protein, 6 aa, Mycobacterium
GVPADA

SEQ ID NO: 499902 - protein, 7 aa, Mycobacterium
GVPADEL

SEQ ID NO: 499903 - protein, 11 aa, Mycobacterium
GVPADISDAAG

SEQ ID NO: 499904 - protein, 51 aa, Mycobacterium
GVPADRAARSGARTEPDDRAQRAHRAPGDPRTDGSVQHRRTDAEHPGASGH

SEQ ID NO: 499905 - protein, 16 aa, Mycobacterium
GVPADTELATGPQGSV

SEQ ID NO: 499906 - protein, 11 aa, Mycobacterium
GVPAELSNEPD

SEQ ID NO: 499907 - protein, 5 aa, Mycobacterium
GVPAG

SEQ ID NO: 499908 - protein, 9 aa, Mycobacterium
GVPAGASFE

SEQ ID NO: 499909 - protein, 13 aa, Mycobacterium
GVPAGEATIGQPG

SEQ ID NO: 499910 - protein, 11 aa, Mycobacterium
GVPAGKSATAV

SEQ ID NO: 499911 - protein, 11 aa, Mycobacterium
GVPAGKSDRLT

SEQ ID NO: 499912 - protein, 13 aa, Mycobacterium
GVPAGKSDRLTSG

SEQ ID NO: 499913 - protein, 15 aa, Mycobacterium
GVPAGPAHAARAADA

SEQ ID NO: 499914 - protein, 15 aa, Mycobacterium
GVPAGTGAPPLPTPH

SEQ ID NO: 499915 - protein, 43 aa, Mycobacterium
GVPALEPQGADGEAETKASKRRGGRGKAAEPQEPEPPDPQAAA

SEQ ID NO: 499916 - protein, 7 aa, Mycobacterium
GVPAPDA

SEQ ID NO: 499917 - protein, 17 aa, Mycobacterium
GVPAPDAAKYKADKGDR

SEQ ID NO: 499918 - protein, 6 aa, Mycobacterium
GVPAQA

SEQ ID NO: 499919 - protein, 6 aa, Mycobacterium
GVPAQY

SEQ ID NO: 499920 - protein, 9 aa, Mycobacterium
GVPARGTAA

SEQ ID NO: 499921 - protein, 17 aa, Mycobacterium
GVPARNTPAPDPTAKIP

SEQ ID NO: 499922 - protein, 19 aa, Mycobacterium
GVPARNTPIPDPAAAIPSR

SEQ ID NO: 499923 - protein, 5 aa, Mycobacterium
GVPAS

SEQ ID NO: 499924 - protein, 12 aa, Mycobacterium
GVPASDELADAR

SEQ ID NO: 499925 - protein, 7 aa, Mycobacterium
GVPATAD

SEQ ID NO: 499926 - protein, 10 aa, Mycobacterium
GVPATKSATA

SEQ ID NO: 499927 - protein, 5 aa, Mycobacterium
GVPAY

SEQ ID NO: 499928 - protein, 4 aa, Mycobacterium
GVPD

SEQ ID NO: 499929 - protein, 8 aa, Mycobacterium
GVPDAAAA

SEQ ID NO: 499930 - protein, 12 aa, Mycobacterium
GVPDADVEPVSE

SEQ ID NO: 499931 - protein, 14 aa, Mycobacterium
GVPDEDGPHGAQAI

SEQ ID NO: 499932 - protein, 16 aa, Mycobacterium
GVPDENASATKTDNSY

SEQ ID NO: 499933 - protein, 6 aa, Mycobacterium
GVPDES

SEQ ID NO: 499934 - protein, 7 aa, Mycobacterium
GVPDESA

SEQ ID NO: 499935 - protein, 8 aa, Mycobacterium
GVPDESYQ

SEQ ID NO: 499936 - protein, 9 aa, Mycobacterium
GVPDETTLT

SEQ ID NO: 499937 - protein, 5 aa, Mycobacterium
GVPDG

SEQ ID NO: 499938 - protein, 11 aa, Mycobacterium
GVPDGDVRTTD

SEQ ID NO: 499939 - protein, 7 aa, Mycobacterium
GVPDGLP

SEQ ID NO: 499940 - protein, 7 aa, Mycobacterium
GVPDPGG

SEQ ID NO: 499941 - protein, 9 aa, Mycobacterium
GVPDPSVVS

SEQ ID NO: 499942 - protein, 5 aa, Mycobacterium
GVPDS

SEQ ID NO: 499943 - protein, 7 aa, Mycobacterium
GVPDSGV

SEQ ID NO: 499944 - protein, 5 aa, Mycobacterium
GVPDT

SEQ ID NO: 499945 - protein, 6 aa, Mycobacterium
GVPDTY

SEQ ID NO: 499946 - protein, 10 aa, Mycobacterium
GVPEGGDETE

SEQ ID NO: 499947 - protein, 9 aa, Mycobacterium
GVPEGTTSY

SEQ ID NO: 499948 - protein, 7 aa, Mycobacterium
GVPEGTV

SEQ ID NO: 499949 - protein, 6 aa, Mycobacterium
GVPEGV

SEQ ID NO: 499950 - protein, 5 aa, Mycobacterium
GVPEH

SEQ ID NO: 499951 - protein, 13 aa, Mycobacterium
GVPEPDETYSTSP

SEQ ID NO: 499952 - protein, 6 aa, Mycobacterium
GVPESD

SEQ ID NO: 499953 - protein, 8 aa, Mycobacterium
GVPEYSGS

SEQ ID NO: 499954 - protein, 5 aa, Mycobacterium
GVPFD

SEQ ID NO: 499955 - protein, 6 aa, Mycobacterium
GVPGAA

SEQ ID NO: 499956 - protein, 13 aa, Mycobacterium
GVPGAGTRSHPDV

SEQ ID NO: 499957 - protein, 13 aa, Mycobacterium
GVPGAKGGNGGNA

SEQ ID NO: 499958 - protein, 320 aa, Mycobacterium
GVPGAPGAGGVTTAVSPTAGTPGPPGAGGVTTPASSTTGAPGAPGAGGVTTPPSPPVGTPGPPGAGGVTTPASSTTGTPGAPGAGGVTTPPSPPVGTPGPPGAGGVTTPASSTTGTPGAPGTGGGTAPPSPPAGGAGAGGAGGGTTPASPITGAPGIGGAGGGTSPPAAARGAPAGTAPPVPSTGAPPPPGPPMPEPPPAPPAPPEPAAGATGAAAPDGAAPASPNTGAPGAPGGAGGSATPAGTAAGPPGTGGAGGATRPAGPPAGPAGAGGSGGRTAPPSPNTGAPGTGGVGSPGLATGAPTGAPGTGGTGGVPPPVD

SEQ ID NO: 499959 - protein, 5 aa, Mycobacterium
GVPGD

SEQ ID NO: 499960 - protein, 6 aa, Mycobacterium
GVPGDA

SEQ ID NO: 499961 - protein, 8 aa, Mycobacterium
GVPGDGWP

SEQ ID NO: 499962 - protein, 7 aa, Mycobacterium
GVPGDHQ

SEQ ID NO: 499963 - protein, 9 aa, Mycobacterium
GVPGEEALT

SEQ ID NO: 499964 - protein, 7 aa, Mycobacterium
GVPGEEL

SEQ ID NO: 499965 - protein, 16 aa, Mycobacterium
GVPGFTGPQALGGSAL

SEQ ID NO: 499966 - protein, 13 aa, Mycobacterium
GVPGGDASAEETE

SEQ ID NO: 499967 - protein, 12 aa, Mycobacterium
GVPGGQLQATAE

SEQ ID NO: 499968 - protein, 9 aa, Mycobacterium
GVPGGSAAT

SEQ ID NO: 499969 - protein, 7 aa, Mycobacterium
GVPGGTK

SEQ ID NO: 499970 - protein, 9 aa, Mycobacterium
GVPGGVPDE

SEQ ID NO: 499971 - protein, 7 aa, Mycobacterium
GVPGKGF

SEQ ID NO: 499972 - protein, 8 aa, Mycobacterium
GVPGPSSV

SEQ ID NO: 499973 - protein, 6 aa, Mycobacterium
GVPGRA

SEQ ID NO: 499974 - protein, 13 aa, Mycobacterium
GVPGRRVTTAEEL

SEQ ID NO: 499975 - protein, 17 aa, Mycobacterium
GVPGTARDTMGGPGSRG

SEQ ID NO: 499976 - protein, 12 aa, Mycobacterium
GVPGTELRNTAE

SEQ ID NO: 499977 - protein, 5 aa, Mycobacterium
GVPGV

SEQ ID NO: 499978 - protein, 7 aa, Mycobacterium
GVPGYSD

SEQ ID NO: 499979 - protein, 9 aa, Mycobacterium
GVPHGPWPD

SEQ ID NO: 499980 - protein, 5 aa, Mycobacterium
GVPHR

SEQ ID NO: 499981 - protein, 9 aa, Mycobacterium
GVPHTDPAE

SEQ ID NO: 499982 - protein, 12 aa, Mycobacterium
GVPHTRTGKKLE

SEQ ID NO: 499983 - protein, 4 aa, Mycobacterium
GVPI

SEQ ID NO: 499984 - protein, 7 aa, Mycobacterium
GVPIPDE

SEQ ID NO: 499985 - protein, 8 aa, Mycobacterium
GVPIPEGS

SEQ ID NO: 499986 - protein, 10 aa, Mycobacterium
GVPKAATDKM

SEQ ID NO: 499987 - protein, 10 aa, Mycobacterium
GVPKAGTDKM

SEQ ID NO: 499988 - protein, 6 aa, Mycobacterium
GVPLDG

SEQ ID NO: 499989 - protein, 5 aa, Mycobacterium
GVPLP

SEQ ID NO: 499990 - protein, 12 aa, Mycobacterium
GVPNDKYSGSPV

SEQ ID NO: 499991 - protein, 9 aa, Mycobacterium
GVPNPKTTA

SEQ ID NO: 499992 - protein, 4 aa, Mycobacterium
GVPP

SEQ ID NO: 499993 - protein, 12 aa, Mycobacterium
GVPPAEMKKQHK

SEQ ID NO: 499994 - protein, 9 aa, Mycobacterium
GVPPAPTPI

SEQ ID NO: 499995 - protein, 16 aa, Mycobacterium
GVPPARGGVIARLGGS

SEQ ID NO: 499996 - protein, 14 aa, Mycobacterium
GVPPDVASERQRAG

SEQ ID NO: 499997 - protein, 8 aa, Mycobacterium
GVPPGTPI

SEQ ID NO: 499998 - protein, 5 aa, Mycobacterium
GVPPL

SEQ ID NO: 499999 - protein, 7 aa, Mycobacterium
GVPPNQI

SEQ ID NO: 500000 - protein, 13 aa, Mycobacterium
GVPPPDTAHYEAD

SEQ ID NO: 500001 - protein, 17 aa, Mycobacterium
GVPPPDTANYKADKGDR

SEQ ID NO: 500002 - protein, 15 aa, Mycobacterium
GVPPPDTVNYKADKG

SEQ ID NO: 500003 - protein, 16 aa, Mycobacterium
GVPPPDVANYKQDKGI

SEQ ID NO: 500004 - protein, 7 aa, Mycobacterium
GVPPPTV

SEQ ID NO: 500005 - protein, 15 aa, Mycobacterium
GVPPQITATPGMPER

SEQ ID NO: 500006 - protein, 13 aa, Mycobacterium
GVPPQNLRATAER

SEQ ID NO: 500007 - protein, 7 aa, Mycobacterium
GVPPQSY

SEQ ID NO: 500008 - protein, 13 aa, Mycobacterium
GVPPSALASDTER

SEQ ID NO: 500009 - protein, 14 aa, Mycobacterium
GVPPSAWGGPAATR

SEQ ID NO: 500010 - protein, 10 aa, Mycobacterium
GVPPSELPAP

SEQ ID NO: 500011 - protein, 7 aa, Mycobacterium
GVPPSQA

SEQ ID NO: 500012 - protein, 8 aa, Mycobacterium
GVPPSTEV

SEQ ID NO: 500013 - protein, 7 aa, Mycobacterium
GVPQEDR

SEQ ID NO: 500014 - protein, 12 aa, Mycobacterium
GVPQEVAPAPVA

SEQ ID NO: 500015 - protein, 14 aa, Mycobacterium
GVPQGSAGGDGKPY

SEQ ID NO: 500016 - protein, 9 aa, Mycobacterium
GVPQPEPLR

SEQ ID NO: 500017 - protein, 8 aa, Mycobacterium
GVPQPETL

SEQ ID NO: 500018 - protein, 5 aa, Mycobacterium
GVPQQ

SEQ ID NO: 500019 - protein, 7 aa, Mycobacterium
GVPRADA

SEQ ID NO: 500020 - protein, 6 aa, Mycobacterium
GVPRDA

SEQ ID NO: 500021 - protein, 5 aa, Mycobacterium
GVPRF

SEQ ID NO: 500022 - protein, 11 aa, Mycobacterium
GVPRPDGQPAL

SEQ ID NO: 500023 - protein, 16 aa, Mycobacterium
GVPRPGDGPASSSTTT

SEQ ID NO: 500024 - protein, 9 aa, Mycobacterium
GVPRPRLAP

SEQ ID NO: 500025 - protein, 5 aa, Mycobacterium
GVPRS

SEQ ID NO: 500026 - protein, 20 aa, Mycobacterium
GVPSDGGSSWGGTGGSTRSR

SEQ ID NO: 500027 - protein, 6 aa, Mycobacterium
GVPSEG

SEQ ID NO: 500028 - protein, 8 aa, Mycobacterium
GVPSELGE

SEQ ID NO: 500029 - protein, 9 aa, Mycobacterium
GVPSESDLA

SEQ ID NO: 500030 - protein, 10 aa, Mycobacterium
GVPSNTPAVD

SEQ ID NO: 500031 - protein, 7 aa, Mycobacterium
GVPSPLD

SEQ ID NO: 500032 - protein, 7 aa, Mycobacterium
GVPSPRA

SEQ ID NO: 500033 - protein, 16 aa, Mycobacterium
GVPSQVKSADPIPART

SEQ ID NO: 500034 - protein, 7 aa, Mycobacterium
GVPSSEL

SEQ ID NO: 500035 - protein, 9 aa, Mycobacterium
GVPSTKTLA

SEQ ID NO: 500036 - protein, 5 aa, Mycobacterium
GVPSV

SEQ ID NO: 500037 - protein, 6 aa, Mycobacterium
GVPTAR

SEQ ID NO: 500038 - protein, 7 aa, Mycobacterium
GVPTDAE

SEQ ID NO: 500039 - protein, 7 aa, Mycobacterium
GVPTDAY

SEQ ID NO: 500040 - protein, 9 aa, Mycobacterium
GVPTDDTAT

SEQ ID NO: 500041 - protein, 9 aa, Mycobacterium
GVPTDELED

SEQ ID NO: 500042 - protein, 5 aa, Mycobacterium
GVPTE

SEQ ID NO: 500043 - protein, 12 aa, Mycobacterium
GVPTEGKTLSTR

SEQ ID NO: 500044 - protein, 10 aa, Mycobacterium
GVPTEQSQRF

SEQ ID NO: 500045 - protein, 6 aa, Mycobacterium
GVPTEY

SEQ ID NO: 500046 - protein, 7 aa, Mycobacterium
GVPTFRD

SEQ ID NO: 500047 - protein, 15 aa, Mycobacterium
GVPTGLGDPLDWMRG

SEQ ID NO: 500048 - protein, 14 aa, Mycobacterium
GVPTGTAPGDAPGL

SEQ ID NO: 500049 - protein, 8 aa, Mycobacterium
GVPTPGLP

SEQ ID NO: 500050 - protein, 25 aa, Mycobacterium
GVPTQTEDAYTYAQTREGTAGARDE

SEQ ID NO: 500051 - protein, 10 aa, Mycobacterium
GVPTSSPERM

SEQ ID NO: 500052 - protein, 16 aa, Mycobacterium
GVPTWRRSGPDTITID

SEQ ID NO: 500053 - protein, 4 aa, Mycobacterium
GVPV

SEQ ID NO: 500054 - protein, 5 aa, Mycobacterium
GVPVD

SEQ ID NO: 500055 - protein, 13 aa, Mycobacterium
GVPVDGPAPELTE

SEQ ID NO: 500056 - protein, 5 aa, Mycobacterium
GVPVK

SEQ ID NO: 500057 - protein, 8 aa, Mycobacterium
GVQADGDV

SEQ ID NO: 500058 - protein, 15 aa, Mycobacterium
GVQAEEAASQARAAA

SEQ ID NO: 500059 - protein, 18 aa, Mycobacterium
GVQAEQAATQAKLAAGAY

SEQ ID NO: 500060 - protein, 8 aa, Mycobacterium
GVQAETEV

SEQ ID NO: 500061 - protein, 12 aa, Mycobacterium
GVQAGQAASQAR

SEQ ID NO: 500062 - protein, 21 aa, Mycobacterium
GVQAGTSTAGQSTSAGENFGN

SEQ ID NO: 500063 - protein, 5 aa, Mycobacterium
GVQAI

SEQ ID NO: 500064 - protein, 11 aa, Mycobacterium
GVQAVDPDGEV

SEQ ID NO: 500065 - protein, 8 aa, Mycobacterium
GVQDGEAF

SEQ ID NO: 500066 - protein, 8 aa, Mycobacterium
GVQDGGGG

SEQ ID NO: 500067 - protein, 5 aa, Mycobacterium
GVQDI

SEQ ID NO: 500068 - protein, 11 aa, Mycobacterium
GVQDPDRSGFT

SEQ ID NO: 500069 - protein, 4 aa, Mycobacterium
GVQG

SEQ ID NO: 500070 - protein, 6 aa, Mycobacterium
GVQGGS

SEQ ID NO: 500071 - protein, 11 aa, Mycobacterium
GVQGSSRYPGG

SEQ ID NO: 500072 - protein, 5 aa, Mycobacterium
GVQHT

SEQ ID NO: 500073 - protein, 4 aa, Mycobacterium
GVQI

SEQ ID NO: 500074 - protein, 7 aa, Mycobacterium
GVQKGDK

SEQ ID NO: 500075 - protein, 7 aa, Mycobacterium
GVQKGER

SEQ ID NO: 500076 - protein, 13 aa, Mycobacterium
GVQKGSGEPHKTK

SEQ ID NO: 500077 - protein, 9 aa, Mycobacterium
GVQKGWTDR

SEQ ID NO: 500078 - protein, 13 aa, Mycobacterium
GVQPARGTKSRAE

SEQ ID NO: 500079 - protein, 6 aa, Mycobacterium
GVQPDG

SEQ ID NO: 500080 - protein, 10 aa, Mycobacterium
GVQPDPRRAR

SEQ ID NO: 500081 - protein, 7 aa, Mycobacterium
GVQPGDR

SEQ ID NO: 500082 - protein, 6 aa, Mycobacterium
GVQPGQ

SEQ ID NO: 500083 - protein, 9 aa, Mycobacterium
GVQPPRRRM

SEQ ID NO: 500084 - protein, 11 aa, Mycobacterium
GVQPQRRPHGA

SEQ ID NO: 500085 - protein, 7 aa, Mycobacterium
GVQPSDV

SEQ ID NO: 500086 - protein, 9 aa, Mycobacterium
GVQPSTTGR

SEQ ID NO: 500087 - protein, 7 aa, Mycobacterium
GVQPTQY

SEQ ID NO: 500088 - protein, 6 aa, Mycobacterium
GVQRPD

SEQ ID NO: 500089 - protein, 5 aa, Mycobacterium
GVQRQ

SEQ ID NO: 500090 - protein, 5 aa, Mycobacterium
GVQSR

SEQ ID NO: 500091 - protein, 12 aa, Mycobacterium
GVQSTRIGGSAE

SEQ ID NO: 500092 - protein, 4 aa, Mycobacterium
GVQT

SEQ ID NO: 500093 - protein, 6 aa, Mycobacterium
GVQTDA

SEQ ID NO: 500094 - protein, 7 aa, Mycobacterium
GVQTDAR

SEQ ID NO: 500095 - protein, 6 aa, Mycobacterium
GVQTES

SEQ ID NO: 500096 - protein, 5 aa, Mycobacterium
GVQTK

SEQ ID NO: 500097 - protein, 8 aa, Mycobacterium
GVQTPDHT

SEQ ID NO: 500098 - protein, 13 aa, Mycobacterium
GVQTVGPRSAEPL

SEQ ID NO: 500099 - protein, 11 aa, Mycobacterium
GVQVTDDGRGI

SEQ ID NO: 500100 - protein, 4 aa, Mycobacterium
GVQY

SEQ ID NO: 500101 - protein, 13 aa, Mycobacterium
GVRADKSRNRKGS

SEQ ID NO: 500102 - protein, 7 aa, Mycobacterium
GVRADTD

SEQ ID NO: 500103 - protein, 9 aa, Mycobacterium
GVRAGGGSL

SEQ ID NO: 500104 - protein, 9 aa, Mycobacterium
GVRAKEQRA

SEQ ID NO: 500105 - protein, 8 aa, Mycobacterium
GVRAKNQR

SEQ ID NO: 500106 - protein, 13 aa, Mycobacterium
GVRANSVSPGNTY

SEQ ID NO: 500107 - protein, 10 aa, Mycobacterium
GVRAPSIDAD

SEQ ID NO: 500108 - protein, 8 aa, Mycobacterium
GVRARGQK

SEQ ID NO: 500109 - protein, 10 aa, Mycobacterium
GVRARGQKSM

SEQ ID NO: 500110 - protein, 8 aa, Mycobacterium
GVRASSEI

SEQ ID NO: 500111 - protein, 19 aa, Mycobacterium
GVRDAAATPTVTATRDGDA

SEQ ID NO: 500112 - protein, 10 aa, Mycobacterium
GVRDAAERGD

SEQ ID NO: 500113 - protein, 5 aa, Mycobacterium
GVRDG

SEQ ID NO: 500114 - protein, 17 aa, Mycobacterium
GVRDGKTGTLVPGAPAS

SEQ ID NO: 500115 - protein, 9 aa, Mycobacterium
GVREAADEI

SEQ ID NO: 500116 - protein, 12 aa, Mycobacterium
GVREAAEGGDAL

SEQ ID NO: 500117 - protein, 13 aa, Mycobacterium
GVREDAEKGDAIF

SEQ ID NO: 500118 - protein, 8 aa, Mycobacterium
GVREDAEM

SEQ ID NO: 500119 - protein, 14 aa, Mycobacterium
GVREPAEGAADDSA

SEQ ID NO: 500120 - protein, 6 aa, Mycobacterium
GVREPR

SEQ ID NO: 500121 - protein, 4 aa, Mycobacterium
GVRG

SEQ ID NO: 500122 - protein, 15 aa, Mycobacterium
GVRGDGGVLKNSDDK

SEQ ID NO: 500123 - protein, 15 aa, Mycobacterium
GVRGDGGVLKNSDGK

SEQ ID NO: 500124 - protein, 15 aa, Mycobacterium
GVRGDGGVLKNSENS

SEQ ID NO: 500125 - protein, 7 aa, Mycobacterium
GVRGDGR

SEQ ID NO: 500126 - protein, 9 aa, Mycobacterium
GVRGDRGRG

SEQ ID NO: 500127 - protein, 9 aa, Mycobacterium
GVRGGAPAA

SEQ ID NO: 500128 - protein, 15 aa, Mycobacterium
GVRGGARVTRPRRET

SEQ ID NO: 500129 - protein, 7 aa, Mycobacterium
GVRGGTP

SEQ ID NO: 500130 - protein, 19 aa, Mycobacterium
GVRGNGDSGFGHARLIVWP

SEQ ID NO: 500131 - protein, 8 aa, Mycobacterium
GVRGRRRE

SEQ ID NO: 500132 - protein, 9 aa, Mycobacterium
GVRGSGGRG

SEQ ID NO: 500133 - protein, 6 aa, Mycobacterium
GVRHPR

SEQ ID NO: 500134 - protein, 6 aa, Mycobacterium
GVRKGD

SEQ ID NO: 500135 - protein, 9 aa, Mycobacterium
GVRKGPDGQ

SEQ ID NO: 500136 - protein, 12 aa, Mycobacterium
GVRKPARTVRGL

SEQ ID NO: 500137 - protein, 7 aa, Mycobacterium
GVRNGTG

SEQ ID NO: 500138 - protein, 11 aa, Mycobacterium
GVRNKKTLDEV

SEQ ID NO: 500139 - protein, 7 aa, Mycobacterium
GVRPAGE

SEQ ID NO: 500140 - protein, 17 aa, Mycobacterium
GVRPDPGHVAEASAVSR

SEQ ID NO: 500141 - protein, 6 aa, Mycobacterium
GVRPDR

SEQ ID NO: 500142 - protein, 5 aa, Mycobacterium
GVRPG

SEQ ID NO: 500143 - protein, 6 aa, Mycobacterium
GVRPGD

SEQ ID NO: 500144 - protein, 6 aa, Mycobacterium
GVRPGE

SEQ ID NO: 500145 - protein, 13 aa, Mycobacterium
GVRPGGTTEDGKV

SEQ ID NO: 500146 - protein, 8 aa, Mycobacterium
GVRPGTPI

SEQ ID NO: 500147 - protein, 7 aa, Mycobacterium
GVRPPAV

SEQ ID NO: 500148 - protein, 11 aa, Mycobacterium
GVRPPDPTRDT

SEQ ID NO: 500149 - protein, 9 aa, Mycobacterium
GVRPPTPTS

SEQ ID NO: 500150 - protein, 7 aa, Mycobacterium
GVRPPVP

SEQ ID NO: 500151 - protein, 4 aa, Mycobacterium
GVRQ

SEQ ID NO: 500152 - protein, 8 aa, Mycobacterium
GVRQAGDR

SEQ ID NO: 500153 - protein, 5 aa, Mycobacterium
GVRQG

SEQ ID NO: 500154 - protein, 5 aa, Mycobacterium
GVRQR

SEQ ID NO: 500155 - protein, 13 aa, Mycobacterium
GVRQRPQSTFGTV

SEQ ID NO: 500156 - protein, 27 aa, Mycobacterium
GVRRGGRPRRADRRLRGRRRARAPDRR

SEQ ID NO: 500157 - protein, 6 aa, Mycobacterium
GVRRPD

SEQ ID NO: 500158 - protein, 5 aa, Mycobacterium
GVRRQ

SEQ ID NO: 500159 - protein, 5 aa, Mycobacterium
GVRRS

SEQ ID NO: 500160 - protein, 10 aa, Mycobacterium
GVRRSPGGPA

SEQ ID NO: 500161 - protein, 9 aa, Mycobacterium
GVRRSTGSV

SEQ ID NO: 500162 - protein, 5 aa, Mycobacterium
GVRSA

SEQ ID NO: 500163 - protein, 6 aa, Mycobacterium
GVRSAG

SEQ ID NO: 500164 - protein, 11 aa, Mycobacterium
GVRSASLNGQE

SEQ ID NO: 500165 - protein, 13 aa, Mycobacterium
GVRSDRSRNHKGS

SEQ ID NO: 500166 - protein, 19 aa, Mycobacterium
GVRSESEGVEPSRRVVILL

SEQ ID NO: 500167 - protein, 6 aa, Mycobacterium
GVRSGE

SEQ ID NO: 500168 - protein, 7 aa, Mycobacterium
GVRSGTA

SEQ ID NO: 500169 - protein, 25 aa, Mycobacterium
GVRSHRRTRAGDAHEAGKKPSTPGI

SEQ ID NO: 500170 - protein, 5 aa, Mycobacterium
GVRST

SEQ ID NO: 500171 - protein, 6 aa, Mycobacterium
GVRSTD

SEQ ID NO: 500172 - protein, 6 aa, Mycobacterium
GVRTAA

SEQ ID NO: 500173 - protein, 15 aa, Mycobacterium
GVRTADERDDSIPRN

SEQ ID NO: 500174 - protein, 9 aa, Mycobacterium
GVRTADGVE

SEQ ID NO: 500175 - protein, 29 aa, Mycobacterium
GVRTAGPAVNAPADVDPGPARAVAGSPEH

SEQ ID NO: 500176 - protein, 9 aa, Mycobacterium
GVRTAGSEI

SEQ ID NO: 500177 - protein, 16 aa, Mycobacterium
GVRTATSEVVDNPGHL

SEQ ID NO: 500178 - protein, 5 aa, Mycobacterium
GVRTD

SEQ ID NO: 500179 - protein, 6 aa, Mycobacterium
GVRTDA

SEQ ID NO: 500180 - protein, 7 aa, Mycobacterium
GVRTDAD

SEQ ID NO: 500181 - protein, 7 aa, Mycobacterium
GVRTEAG

SEQ ID NO: 500182 - protein, 7 aa, Mycobacterium
GVRTETP

SEQ ID NO: 500183 - protein, 29 aa, Mycobacterium
GVRTGGPGVDAPADVDHGGAQAVAGSPDH

SEQ ID NO: 500184 - protein, 8 aa, Mycobacterium
GVRTGGTV

SEQ ID NO: 500185 - protein, 16 aa, Mycobacterium
GVRTPRTRTMDPGTDI

SEQ ID NO: 500186 - protein, 10 aa, Mycobacterium
GVRTRADRRD

SEQ ID NO: 500187 - protein, 9 aa, Mycobacterium
GVRTSDGVE

SEQ ID NO: 500188 - protein, 4 aa, Mycobacterium
GVSA

SEQ ID NO: 500189 - protein, 7 aa, Mycobacterium
GVSAAGG

SEQ ID NO: 500190 - protein, 9 aa, Mycobacterium
GVSAAGSML

SEQ ID NO: 500191 - protein, 7 aa, Mycobacterium
GVSADDR

SEQ ID NO: 500192 - protein, 5 aa, Mycobacterium
GVSAG

SEQ ID NO: 500193 - protein, 8 aa, Mycobacterium
GVSAGPLS

SEQ ID NO: 500194 - protein, 7 aa, Mycobacterium
GVSAGQA

SEQ ID NO: 500195 - protein, 7 aa, Mycobacterium
GVSAKTV

SEQ ID NO: 500196 - protein, 18 aa, Mycobacterium
GVSALSARSVATEAGTST

SEQ ID NO: 500197 - protein, 12 aa, Mycobacterium
GVSARQEKPGAF

SEQ ID NO: 500198 - protein, 13 aa, Mycobacterium
GVSAYPGDGSNRW

SEQ ID NO: 500199 - protein, 17 aa, Mycobacterium
GVSDEHRDAFAGTEKRA

SEQ ID NO: 500200 - protein, 8 aa, Mycobacterium
GVSDERVS

SEQ ID NO: 500201 - protein, 7 aa, Mycobacterium
GVSDREA

SEQ ID NO: 500202 - protein, 5 aa, Mycobacterium
GVSEA

SEQ ID NO: 500203 - protein, 7 aa, Mycobacterium
GVSEAAK

SEQ ID NO: 500204 - protein, 7 aa, Mycobacterium
GVSEGDR

SEQ ID NO: 500205 - protein, 11 aa, Mycobacterium
GVSEGGYGLDP

SEQ ID NO: 500206 - protein, 7 aa, Mycobacterium
GVSEHER

SEQ ID NO: 500207 - protein, 7 aa, Mycobacterium
GVSEPTP

SEQ ID NO: 500208 - protein, 5 aa, Mycobacterium
GVSES

SEQ ID NO: 500209 - protein, 5 aa, Mycobacterium
GVSGD

SEQ ID NO: 500210 - protein, 9 aa, Mycobacterium
GVSGDADTF

SEQ ID NO: 500211 - protein, 5 aa, Mycobacterium
GVSGE

SEQ ID NO: 500212 - protein, 6 aa, Mycobacterium
GVSGGP

SEQ ID NO: 500213 - protein, 6 aa, Mycobacterium
GVSGGT

SEQ ID NO: 500214 - protein, 6 aa, Mycobacterium
GVSGLS

SEQ ID NO: 500215 - protein, 6 aa, Mycobacterium
GVSGMP

SEQ ID NO: 500216 - protein, 11 aa, Mycobacterium
GVSGNASARAP

SEQ ID NO: 500217 - protein, 5 aa, Mycobacterium
GVSGP

SEQ ID NO: 500218 - protein, 14 aa, Mycobacterium
GVSGPRTSGTGPAW

SEQ ID NO: 500219 - protein, 5 aa, Mycobacterium
GVSGR

SEQ ID NO: 500220 - protein, 19 aa, Mycobacterium
GVSGRGDLAGQLRTAAKQA

SEQ ID NO: 500221 - protein, 5 aa, Mycobacterium
GVSGS

SEQ ID NO: 500222 - protein, 7 aa, Mycobacterium
GVSGSEL

SEQ ID NO: 500223 - protein, 11 aa, Mycobacterium
GVSGSELESAG

SEQ ID NO: 500224 - protein, 11 aa, Mycobacterium
GVSGTLGDPMA

SEQ ID NO: 500225 - protein, 5 aa, Mycobacterium
GVSHA

SEQ ID NO: 500226 - protein, 10 aa, Mycobacterium
GVSHGSEGSL

SEQ ID NO: 500227 - protein, 6 aa, Mycobacterium
GVSHSH

SEQ ID NO: 500228 - protein, 14 aa, Mycobacterium
GVSHSPSEHADEED

SEQ ID NO: 500229 - protein, 5 aa, Mycobacterium
GVSKA

SEQ ID NO: 500230 - protein, 6 aa, Mycobacterium
GVSKGE

SEQ ID NO: 500231 - protein, 4 aa, Mycobacterium
GVSN

SEQ ID NO: 500232 - protein, 10 aa, Mycobacterium
GVSNPEGKRK

SEQ ID NO: 500233 - protein, 8 aa, Mycobacterium
GVSNTPDV

SEQ ID NO: 500234 - protein, 19 aa, Mycobacterium
GVSNVEKSGGTTASVGAPA

SEQ ID NO: 500235 - protein, 4 aa, Mycobacterium
GVSP

SEQ ID NO: 500236 - protein, 6 aa, Mycobacterium
GVSPAD

SEQ ID NO: 500237 - protein, 13 aa, Mycobacterium
GVSPAERADERRR

SEQ ID NO: 500238 - protein, 7 aa, Mycobacterium
GVSPDDV

SEQ ID NO: 500239 - protein, 6 aa, Mycobacterium
GVSPDI

SEQ ID NO: 500240 - protein, 10 aa, Mycobacterium
GVSPDVARRE

SEQ ID NO: 500241 - protein, 8 aa, Mycobacterium
GVSPERIA

SEQ ID NO: 500242 - protein, 7 aa, Mycobacterium
GVSPESV

SEQ ID NO: 500243 - protein, 6 aa, Mycobacterium
GVSPGF

SEQ ID NO: 500244 - protein, 10 aa, Mycobacterium
GVSPGNDGRG

SEQ ID NO: 500245 - protein, 10 aa, Mycobacterium
GVSPGNEGRG

SEQ ID NO: 500246 - protein, 17 aa, Mycobacterium
GVSPLTPDHVNPERPWP

SEQ ID NO: 500247 - protein, 6 aa, Mycobacterium
GVSPND

SEQ ID NO: 500248 - protein, 8 aa, Mycobacterium
GVSPPAGV

SEQ ID NO: 500249 - protein, 8 aa, Mycobacterium
GVSPPTFT

SEQ ID NO: 500250 - protein, 7 aa, Mycobacterium
GVSPQRA

SEQ ID NO: 500251 - protein, 9 aa, Mycobacterium
GVSPRKPGR

SEQ ID NO: 500252 - protein, 12 aa, Mycobacterium
GVSPSQDAEIER

SEQ ID NO: 500253 - protein, 10 aa, Mycobacterium
GVSPSTTGAA

SEQ ID NO: 500254 - protein, 8 aa, Mycobacterium
GVSPYNNP

SEQ ID NO: 500255 - protein, 10 aa, Mycobacterium
GVSQATASRV

SEQ ID NO: 500256 - protein, 11 aa, Mycobacterium
GVSQDAHGVTA

SEQ ID NO: 500257 - protein, 21 aa, Mycobacterium
GVSQDTKDVTTLGRGGSDTTA

SEQ ID NO: 500258 - protein, 7 aa, Mycobacterium
GVSQETR

SEQ ID NO: 500259 - protein, 5 aa, Mycobacterium
GVSQP

SEQ ID NO: 500260 - protein, 5 aa, Mycobacterium
GVSRA

SEQ ID NO: 500261 - protein, 8 aa, Mycobacterium
GVSRESIQ

SEQ ID NO: 500262 - protein, 8 aa, Mycobacterium
GVSRETIQ

SEQ ID NO: 500263 - protein, 5 aa, Mycobacterium
GVSRG

SEQ ID NO: 500264 - protein, 17 aa, Mycobacterium
GVSRGDAAERRRSQDER

SEQ ID NO: 500265 - protein, 12 aa, Mycobacterium
GVSRGELREAGA

SEQ ID NO: 500266 - protein, 9 aa, Mycobacterium
GVSRRGRDR

SEQ ID NO: 500267 - protein, 10 aa, Mycobacterium
GVSRRPANPE

SEQ ID NO: 500268 - protein, 7 aa, Mycobacterium
GVSRSTV

SEQ ID NO: 500269 - protein, 4 aa, Mycobacterium
GVSS

SEQ ID NO: 500270 - protein, 8 aa, Mycobacterium
GVSSADGR

SEQ ID NO: 500271 - protein, 9 aa, Mycobacterium
GVSSEDAGV

SEQ ID NO: 500272 - protein, 8 aa, Mycobacterium
GVSSESLK

SEQ ID NO: 500273 - protein, 8 aa, Mycobacterium
GVSSGKAA

SEQ ID NO: 500274 - protein, 9 aa, Mycobacterium
GVSSGLGGI

SEQ ID NO: 500275 - protein, 10 aa, Mycobacterium
GVSSKDRRGV

SEQ ID NO: 500276 - protein, 6 aa, Mycobacterium
GVSSPG

SEQ ID NO: 500277 - protein, 7 aa, Mycobacterium
GVSSPRP

SEQ ID NO: 500278 - protein, 8 aa, Mycobacterium
GVSSSGCA

SEQ ID NO: 500279 - protein, 6 aa, Mycobacterium
GVSTAE

SEQ ID NO: 500280 - protein, 7 aa, Mycobacterium
GVSTEAD

SEQ ID NO: 500281 - protein, 22 aa, Mycobacterium
GVSTEQLDTDPDSVPRGFRGQE

SEQ ID NO: 500282 - protein, 5 aa, Mycobacterium
GVSTG

SEQ ID NO: 500283 - protein, 7 aa, Mycobacterium
GVSTPAE

SEQ ID NO: 500284 - protein, 13 aa, Mycobacterium
GVSTPGLARSGGD

SEQ ID NO: 500285 - protein, 6 aa, Mycobacterium
GVSTST

SEQ ID NO: 500286 - protein, 26 aa, Mycobacterium
GVSTSTTKPPAKRRGRAQRVPKVRAA

SEQ ID NO: 500287 - protein, 13 aa, Mycobacterium
GVSYAGAEAANVQ

SEQ ID NO: 500288 - protein, 16 aa, Mycobacterium
GVTAAKPGSAMTPLPG

SEQ ID NO: 500289 - protein, 5 aa, Mycobacterium
GVTAD

SEQ ID NO: 500290 - protein, 14 aa, Mycobacterium
GVTADSDTLNEAPP

SEQ ID NO: 500291 - protein, 7 aa, Mycobacterium
GVTAGDL

SEQ ID NO: 500292 - protein, 9 aa, Mycobacterium
GVTAGEGVT

SEQ ID NO: 500293 - protein, 8 aa, Mycobacterium
GVTAGTGR

SEQ ID NO: 500294 - protein, 5 aa, Mycobacterium
GVTAP

SEQ ID NO: 500295 - protein, 9 aa, Mycobacterium
GVTAPAGFK

SEQ ID NO: 500296 - protein, 9 aa, Mycobacterium
GVTAPDRGF

SEQ ID NO: 500297 - protein, 8 aa, Mycobacterium
GVTAPESI

SEQ ID NO: 500298 - protein, 7 aa, Mycobacterium
GVTAPQA

SEQ ID NO: 500299 - protein, 5 aa, Mycobacterium
GVTAR

SEQ ID NO: 500300 - protein, 12 aa, Mycobacterium
GVTASAGQAARI

SEQ ID NO: 500301 - protein, 7 aa, Mycobacterium
GVTATAG

SEQ ID NO: 500302 - protein, 7 aa, Mycobacterium
GVTATDD

SEQ ID NO: 500303 - protein, 4 aa, Mycobacterium
GVTD

SEQ ID NO: 500304 - protein, 13 aa, Mycobacterium
GVTDATPDLGAGD

SEQ ID NO: 500305 - protein, 10 aa, Mycobacterium
GVTDGGDDAV

SEQ ID NO: 500306 - protein, 8 aa, Mycobacterium
GVTDGRGL

SEQ ID NO: 500307 - protein, 10 aa, Mycobacterium
GVTDPEGKRK

SEQ ID NO: 500308 - protein, 8 aa, Mycobacterium
GVTDPTTG

SEQ ID NO: 500309 - protein, 5 aa, Mycobacterium
GVTDQ

SEQ ID NO: 500310 - protein, 10 aa, Mycobacterium
GVTDRQRRRA

SEQ ID NO: 500311 - protein, 4 aa, Mycobacterium
GVTE

SEQ ID NO: 500312 - protein, 10 aa, Mycobacterium
GVTEEQRRRA

SEQ ID NO: 500313 - protein, 6 aa, Mycobacterium
GVTERG

SEQ ID NO: 500314 - protein, 5 aa, Mycobacterium
GVTES

SEQ ID NO: 500315 - protein, 7 aa, Mycobacterium
GVTEWSA

SEQ ID NO: 500316 - protein, 8 aa, Mycobacterium
GVTEWSEG

SEQ ID NO: 500317 - protein, 15 aa, Mycobacterium
GVTGARDAVSNAAPA

SEQ ID NO: 500318 - protein, 15 aa, Mycobacterium
GVTGARDAVSNAAPD

SEQ ID NO: 500319 - protein, 15 aa, Mycobacterium
GVTGARDAVSNAAPE

SEQ ID NO: 500320 - protein, 15 aa, Mycobacterium
GVTGARDAVSSSAPE

SEQ ID NO: 500321 - protein, 15 aa, Mycobacterium
GVTGAREAVSQAAPE

SEQ ID NO: 500322 - protein, 11 aa, Mycobacterium
GVTGEAPPPDL

SEQ ID NO: 500323 - protein, 7 aa, Mycobacterium
GVTGETE

SEQ ID NO: 500324 - protein, 7 aa, Mycobacterium
GVTGLTR

SEQ ID NO: 500325 - protein, 8 aa, Mycobacterium
GVTGPAAK

SEQ ID NO: 500326 - protein, 7 aa, Mycobacterium
GVTGPAQ

SEQ ID NO: 500327 - protein, 9 aa, Mycobacterium
GVTGPDAEK

SEQ ID NO: 500328 - protein, 6 aa, Mycobacterium
GVTGPK

SEQ ID NO: 500329 - protein, 8 aa, Mycobacterium
GVTGPKSL

SEQ ID NO: 500330 - protein, 7 aa, Mycobacterium
GVTGRGQ

SEQ ID NO: 500331 - protein, 13 aa, Mycobacterium
GVTGRTRVVVHDG

SEQ ID NO: 500332 - protein, 7 aa, Mycobacterium
GVTGSAA

SEQ ID NO: 500333 - protein, 12 aa, Mycobacterium
GVTGSDGPSHNG

SEQ ID NO: 500334 - protein, 10 aa, Mycobacterium
GVTGSRQRIQ

SEQ ID NO: 500335 - protein, 16 aa, Mycobacterium
GVTGVTDATPDLSDED

SEQ ID NO: 500336 - protein, 4 aa, Mycobacterium
GVTK

SEQ ID NO: 500337 - protein, 5 aa, Mycobacterium
GVTKD

SEQ ID NO: 500338 - protein, 11 aa, Mycobacterium
GVTKGGTLTDC

SEQ ID NO: 500339 - protein, 7 aa, Mycobacterium
GVTKSGL

SEQ ID NO: 500340 - protein, 7 aa, Mycobacterium
GVTKTNA

SEQ ID NO: 500341 - protein, 10 aa, Mycobacterium
GVTNPEGKRK

SEQ ID NO: 500342 - protein, 18 aa, Mycobacterium
GVTNPGYRPGDTATALPA

SEQ ID NO: 500343 - protein, 12 aa, Mycobacterium
GVTNQSASAALG

SEQ ID NO: 500344 - protein, 4 aa, Mycobacterium
GVTP

SEQ ID NO: 500345 - protein, 7 aa, Mycobacterium
GVTPAGY

SEQ ID NO: 500346 - protein, 8 aa, Mycobacterium
GVTPAQAR

SEQ ID NO: 500347 - protein, 10 aa, Mycobacterium
GVTPDNPAQF

SEQ ID NO: 500348 - protein, 8 aa, Mycobacterium
GVTPEELR

SEQ ID NO: 500349 - protein, 7 aa, Mycobacterium
GVTPEGW

SEQ ID NO: 500350 - protein, 6 aa, Mycobacterium
GVTPEQ

SEQ ID NO: 500351 - protein, 7 aa, Mycobacterium
GVTPETT

SEQ ID NO: 500352 - protein, 9 aa, Mycobacterium
GVTPGGRTT

SEQ ID NO: 500353 - protein, 6 aa, Mycobacterium
GVTPGS

SEQ ID NO: 500354 - protein, 9 aa, Mycobacterium
GVTPKANTV

SEQ ID NO: 500355 - protein, 15 aa, Mycobacterium
GVTPNGEAGRAFGTN

SEQ ID NO: 500356 - protein, 8 aa, Mycobacterium
GVTPPGWR

SEQ ID NO: 500357 - protein, 7 aa, Mycobacterium
GVTPQQV

SEQ ID NO: 500358 - protein, 5 aa, Mycobacterium
GVTPR

SEQ ID NO: 500359 - protein, 17 aa, Mycobacterium
GVTPRLRSGSRNRQRPR

SEQ ID NO: 500360 - protein, 15 aa, Mycobacterium
GVTPSGEAGRAFGTN

SEQ ID NO: 500361 - protein, 8 aa, Mycobacterium
GVTPSGPI

SEQ ID NO: 500362 - protein, 5 aa, Mycobacterium
GVTPT

SEQ ID NO: 500363 - protein, 6 aa, Mycobacterium
GVTQGH

SEQ ID NO: 500364 - protein, 7 aa, Mycobacterium
GVTQGHD

SEQ ID NO: 500365 - protein, 9 aa, Mycobacterium
GVTQKGDGY

SEQ ID NO: 500366 - protein, 10 aa, Mycobacterium
GVTQNSQTET

SEQ ID NO: 500367 - protein, 11 aa, Mycobacterium
GVTQSASARAP

SEQ ID NO: 500368 - protein, 5 aa, Mycobacterium
GVTRD

SEQ ID NO: 500369 - protein, 11 aa, Mycobacterium
GVTRPTGARLD

SEQ ID NO: 500370 - protein, 14 aa, Mycobacterium
GVTRSGVSAYPPDV

SEQ ID NO: 500371 - protein, 21 aa, Mycobacterium
GVTRVEDRNRVKDGDATRHPE

SEQ ID NO: 500372 - protein, 4 aa, Mycobacterium
GVTS

SEQ ID NO: 500373 - protein, 22 aa, Mycobacterium
GVTSAPRPGTHSGADAGALTPQ

SEQ ID NO: 500374 - protein, 6 aa, Mycobacterium
GVTSDG

SEQ ID NO: 500375 - protein, 10 aa, Mycobacterium
GVTSGDPGRA

SEQ ID NO: 500376 - protein, 9 aa, Mycobacterium
GVTSGEAPV

SEQ ID NO: 500377 - protein, 7 aa, Mycobacterium
GVTSGRQ

SEQ ID NO: 500378 - protein, 5 aa, Mycobacterium
GVTSK

SEQ ID NO: 500379 - protein, 5 aa, Mycobacterium
GVTSS

SEQ ID NO: 500380 - protein, 11 aa, Mycobacterium
GVTTAEGRTVA

SEQ ID NO: 500381 - protein, 20 aa, Mycobacterium
GVTTGRAASPRRLRKGEQVT

SEQ ID NO: 500382 - protein, 13 aa, Mycobacterium
GVTTVEPSQQAQD

SEQ ID NO: 500383 - protein, 4 aa, Mycobacterium
GVTV

SEQ ID NO: 500384 - protein, 5 aa, Mycobacterium
GVTVE

SEQ ID NO: 500385 - protein, 9 aa, Mycobacterium
GVVDEGGDF

SEQ ID NO: 500386 - protein, 10 aa, Mycobacterium
GVVDEGGRRV

SEQ ID NO: 500387 - protein, 12 aa, Mycobacterium
GVVDGPAGTVDH

SEQ ID NO: 500388 - protein, 6 aa, Mycobacterium
GVVDGR

SEQ ID NO: 500389 - protein, 11 aa, Mycobacterium
GVVDPKKRSMS

SEQ ID NO: 500390 - protein, 8 aa, Mycobacterium
GVVDSATG

SEQ ID NO: 500391 - protein, 9 aa, Mycobacterium
GVVDSATGY

SEQ ID NO: 500392 - protein, 5 aa, Mycobacterium
GVVGE

SEQ ID NO: 500393 - protein, 11 aa, Mycobacterium
GVVGEPGAGLE

SEQ ID NO: 500394 - protein, 12 aa, Mycobacterium
GVVGESGEGLET

SEQ ID NO: 500395 - protein, 13 aa, Mycobacterium
GVVGSTADKLAAE

SEQ ID NO: 500396 - protein, 6 aa, Mycobacterium
GVVKTT

SEQ ID NO: 500397 - protein, 6 aa, Mycobacterium
GVVPAD

SEQ ID NO: 500398 - protein, 14 aa, Mycobacterium
GVVPPDDEDDSTEH

SEQ ID NO: 500399 - protein, 10 aa, Mycobacterium
GVVPQTPQGR

SEQ ID NO: 500400 - protein, 20 aa, Mycobacterium
GVVQKPNVSRETWDSATSTW

SEQ ID NO: 500401 - protein, 8 aa, Mycobacterium
GVVSGSPA

SEQ ID NO: 500402 - protein, 6 aa, Mycobacterium
GVVSNE

SEQ ID NO: 500403 - protein, 9 aa, Mycobacterium
GVVSPRGED

SEQ ID NO: 500404 - protein, 26 aa, Mycobacterium
GVVSTPPRTEDGTIPGRSHVGYTSDV

SEQ ID NO: 500405 - protein, 6 aa, Mycobacterium
GVVTDD

SEQ ID NO: 500406 - protein, 6 aa, Mycobacterium
GVVTTT

SEQ ID NO: 500407 - protein, 4 aa, Mycobacterium
GVWP

SEQ ID NO: 500408 - protein, 4 aa, Mycobacterium
GVYN

SEQ ID NO: 500409 - protein, 5 aa, Mycobacterium
GVYQG

SEQ ID NO: 500410 - protein, 20 aa, Mycobacterium
GVYRGDEASGSTADPAPTAL

SEQ ID NO: 500411 - protein, 20 aa, Mycobacterium
GVYRGDGHNPASDDPSPTTL

SEQ ID NO: 500412 - protein, 7 aa, Mycobacterium
GVYSTTP

SEQ ID NO: 500413 - protein, 9 aa, Mycobacterium
GWADRGKRD

SEQ ID NO: 500414 - protein, 24 aa, Mycobacterium
GWADTESRPPSAPDPDGIPPTDPG

SEQ ID NO: 500415 - protein, 21 aa, Mycobacterium
GWAEGAHSDNEHRVDGDDETI

SEQ ID NO: 500416 - protein, 5 aa, Mycobacterium
GWANA

SEQ ID NO: 500417 - protein, 10 aa, Mycobacterium
GWANTGNVNT

SEQ ID NO: 500418 - protein, 5 aa, Mycobacterium
GWAPD

SEQ ID NO: 500419 - protein, 7 aa, Mycobacterium
GWAPSES

SEQ ID NO: 500420 - protein, 14 aa, Mycobacterium
GWAQSAAEREPGVA

SEQ ID NO: 500421 - protein, 15 aa, Mycobacterium
GWAQSPGAERLGDPR

SEQ ID NO: 500422 - protein, 5 aa, Mycobacterium
GWASG

SEQ ID NO: 500423 - protein, 5 aa, Mycobacterium
GWDAN

SEQ ID NO: 500424 - protein, 12 aa, Mycobacterium
GWDETPSSVEID

SEQ ID NO: 500425 - protein, 6 aa, Mycobacterium
GWDGEG

SEQ ID NO: 500426 - protein, 18 aa, Mycobacterium
GWDPEACAERGARPDQMP

SEQ ID NO: 500427 - protein, 13 aa, Mycobacterium
GWDPHAGDDAERS

SEQ ID NO: 500428 - protein, 9 aa, Mycobacterium
GWDPPRYTT

SEQ ID NO: 500429 - protein, 6 aa, Mycobacterium
GWDPRT

SEQ ID NO: 500430 - protein, 6 aa, Mycobacterium
GWDPST

SEQ ID NO: 500431 - protein, 4 aa, Mycobacterium
GWDR

SEQ ID NO: 500432 - protein, 8 aa, Mycobacterium
GWDSDPPY

SEQ ID NO: 500433 - protein, 5 aa, Mycobacterium
GWDSG

SEQ ID NO: 500434 - protein, 17 aa, Mycobacterium
GWDSPAADAARGRIGTA

SEQ ID NO: 500435 - protein, 4 aa, Mycobacterium
GWED

SEQ ID NO: 500436 - protein, 5 aa, Mycobacterium
GWEIP

SEQ ID NO: 500437 - protein, 6 aa, Mycobacterium
GWEPET

SEQ ID NO: 500438 - protein, 12 aa, Mycobacterium
GWEPPDAGQDSL

SEQ ID NO: 500439 - protein, 21 aa, Mycobacterium
GWGGDGGNGGAGGTAYTSGGV

SEQ ID NO: 500440 - protein, 14 aa, Mycobacterium
GWGNGPDDSPDTEK

SEQ ID NO: 500441 - protein, 8 aa, Mycobacterium
GWGNQRDG

SEQ ID NO: 500442 - protein, 4 aa, Mycobacterium
GWGP

SEQ ID NO: 500443 - protein, 6 aa, Mycobacterium
GWGPTL

SEQ ID NO: 500444 - protein, 12 aa, Mycobacterium
GWGRKAPPRRGL

SEQ ID NO: 500445 - protein, 10 aa, Mycobacterium
GWGSDDGGEF

SEQ ID NO: 500446 - protein, 6 aa, Mycobacterium
GWGSER

SEQ ID NO: 500447 - protein, 10 aa, Mycobacterium
GWGSTGPFRD

SEQ ID NO: 500448 - protein, 13 aa, Mycobacterium
GWKGGAGSAYSEQ

SEQ ID NO: 500449 - protein, 14 aa, Mycobacterium
GWKGTSPVGTFPPN

SEQ ID NO: 500450 - protein, 20 aa, Mycobacterium
GWKSAGGRVYTGTNVRSKTL

SEQ ID NO: 500451 - protein, 20 aa, Mycobacterium
GWNDESGSDRTADGNAADTA

SEQ ID NO: 500452 - protein, 17 aa, Mycobacterium
GWNGASADAAIESAERS

SEQ ID NO: 500453 - protein, 7 aa, Mycobacterium
GWNNPES

SEQ ID NO: 500454 - protein, 5 aa, Mycobacterium
GWNPQ

SEQ ID NO: 500455 - protein, 13 aa, Mycobacterium
GWNPQTQAVDPAG

SEQ ID NO: 500456 - protein, 8 aa, Mycobacterium
GWNSDPQD

SEQ ID NO: 500457 - protein, 5 aa, Mycobacterium
GWPAE

SEQ ID NO: 500458 - protein, 7 aa, Mycobacterium
GWPASRL

SEQ ID NO: 500459 - protein, 5 aa, Mycobacterium
GWPAV

SEQ ID NO: 500460 - protein, 4 aa, Mycobacterium
GWPD

SEQ ID NO: 500461 - protein, 7 aa, Mycobacterium
GWPDADE

SEQ ID NO: 500462 - protein, 10 aa, Mycobacterium
GWPDDGGRVT

SEQ ID NO: 500463 - protein, 9 aa, Mycobacterium
GWPDDQTID

SEQ ID NO: 500464 - protein, 9 aa, Mycobacterium
GWPDGDGGE

SEQ ID NO: 500465 - protein, 10 aa, Mycobacterium
GWPDGGRLAG

SEQ ID NO: 500466 - protein, 10 aa, Mycobacterium
GWPDGTDPRW

SEQ ID NO: 500467 - protein, 13 aa, Mycobacterium
GWPDPTGVRATSD

SEQ ID NO: 500468 - protein, 6 aa, Mycobacterium
GWPDSA

SEQ ID NO: 500469 - protein, 7 aa, Mycobacterium
GWPEPTG

SEQ ID NO: 500470 - protein, 10 aa, Mycobacterium
GWPEQSTHDH

SEQ ID NO: 500471 - protein, 6 aa, Mycobacterium
GWPERG

SEQ ID NO: 500472 - protein, 10 aa, Mycobacterium
GWPGAPRPVA

SEQ ID NO: 500473 - protein, 6 aa, Mycobacterium
GWPGEA

SEQ ID NO: 500474 - protein, 9 aa, Mycobacterium
GWPGEEVPP

SEQ ID NO: 500475 - protein, 7 aa, Mycobacterium
GWPGGRT

SEQ ID NO: 500476 - protein, 16 aa, Mycobacterium
GWPGTPPSDRRDISGA

SEQ ID NO: 500477 - protein, 4 aa, Mycobacterium
GWPK

SEQ ID NO: 500478 - protein, 9 aa, Mycobacterium
GWPKTSGAR

SEQ ID NO: 500479 - protein, 5 aa, Mycobacterium
GWPMP

SEQ ID NO: 500480 - protein, 4 aa, Mycobacterium
GWPP

SEQ ID NO: 500481 - protein, 9 aa, Mycobacterium
GWPPAAPEV

SEQ ID NO: 500482 - protein, 21 aa, Mycobacterium
GWPQNAAEASLRAARASSVLD

SEQ ID NO: 500483 - protein, 9 aa, Mycobacterium
GWPSDDGGE

SEQ ID NO: 500484 - protein, 6 aa, Mycobacterium
GWPSKL

SEQ ID NO: 500485 - protein, 9 aa, Mycobacterium
GWPTDEGGE

SEQ ID NO: 500486 - protein, 7 aa, Mycobacterium
GWPTGPL

SEQ ID NO: 500487 - protein, 12 aa, Mycobacterium
GWPTTDQDDHAV

SEQ ID NO: 500488 - protein, 5 aa, Mycobacterium
GWPVP

SEQ ID NO: 500489 - protein, 22 aa, Mycobacterium
GWQAPADADAKELADAANAGDA

SEQ ID NO: 500490 - protein, 9 aa, Mycobacterium
GWQAPDPRL

SEQ ID NO: 500491 - protein, 6 aa, Mycobacterium
GWQDER

SEQ ID NO: 500492 - protein, 5 aa, Mycobacterium
GWQET

SEQ ID NO: 500493 - protein, 15 aa, Mycobacterium
GWQGAASTAMASAAA

SEQ ID NO: 500494 - protein, 11 aa, Mycobacterium
GWQGASATAFD

SEQ ID NO: 500495 - protein, 19 aa, Mycobacterium
GWQGGKPSAPEARGPWGQG

SEQ ID NO: 500496 - protein, 6 aa, Mycobacterium
GWQGPA

SEQ ID NO: 500497 - protein, 5 aa, Mycobacterium
GWQPG

SEQ ID NO: 500498 - protein, 7 aa, Mycobacterium
GWQPTDA

SEQ ID NO: 500499 - protein, 6 aa, Mycobacterium
GWQTES

SEQ ID NO: 500500 - protein, 8 aa, Mycobacterium
GWQTTTGM

SEQ ID NO: 500501 - protein, 19 aa, Mycobacterium
GWRGDSTEDADARKAGRTL

SEQ ID NO: 500502 - protein, 8 aa, Mycobacterium
GWRGPSSS

SEQ ID NO: 500503 - protein, 11 aa, Mycobacterium
GWRGSASDSMA

SEQ ID NO: 500504 - protein, 5 aa, Mycobacterium
GWRPD

SEQ ID NO: 500505 - protein, 6 aa, Mycobacterium
GWRPDD

SEQ ID NO: 500506 - protein, 5 aa, Mycobacterium
GWRPG

SEQ ID NO: 500507 - protein, 24 aa, Mycobacterium
GWRPSGETLPSTMPNTSVHTRREP

SEQ ID NO: 500508 - protein, 4 aa, Mycobacterium
GWRR

SEQ ID NO: 500509 - protein, 13 aa, Mycobacterium
GWSAPPGAGARDL

SEQ ID NO: 500510 - protein, 10 aa, Mycobacterium
GWSDTAAATT

SEQ ID NO: 500511 - protein, 10 aa, Mycobacterium
GWSEADVQGK

SEQ ID NO: 500512 - protein, 5 aa, Mycobacterium
GWSEQ

SEQ ID NO: 500513 - protein, 10 aa, Mycobacterium
GWSGAGSEGM

SEQ ID NO: 500514 - protein, 5 aa, Mycobacterium
GWSGP

SEQ ID NO: 500515 - protein, 9 aa, Mycobacterium
GWSGQDPTI

SEQ ID NO: 500516 - protein, 4 aa, Mycobacterium
GWSP

SEQ ID NO: 500517 - protein, 14 aa, Mycobacterium
GWSPEKTATAAPNG

SEQ ID NO: 500518 - protein, 12 aa, Mycobacterium
GWSPPEDAQPIR

SEQ ID NO: 500519 - protein, 11 aa, Mycobacterium
GWSRGAGSLPV

SEQ ID NO: 500520 - protein, 10 aa, Mycobacterium
GWSSAPAGYT

SEQ ID NO: 500521 - protein, 9 aa, Mycobacterium
GWSSPATSR

SEQ ID NO: 500522 - protein, 5 aa, Mycobacterium
GWSTG

SEQ ID NO: 500523 - protein, 13 aa, Mycobacterium
GWTAGPTLTTITG

SEQ ID NO: 500524 - protein, 6 aa, Mycobacterium
GWTASA

SEQ ID NO: 500525 - protein, 6 aa, Mycobacterium
GWTDGQ

SEQ ID NO: 500526 - protein, 7 aa, Mycobacterium
GWTDPAT

SEQ ID NO: 500527 - protein, 11 aa, Mycobacterium
GWTEANNGTLA

SEQ ID NO: 500528 - protein, 10 aa, Mycobacterium
GWTEDGTQSV

SEQ ID NO: 500529 - protein, 9 aa, Mycobacterium
GWTERDGSV

SEQ ID NO: 500530 - protein, 15 aa, Mycobacterium
GWTGTSPVGTFPPNG

SEQ ID NO: 500531 - protein, 23 aa, Mycobacterium
GWTPEASVAGAAETDLDAPANRD

SEQ ID NO: 500532 - protein, 6 aa, Mycobacterium
GWTQEA

SEQ ID NO: 500533 - protein, 19 aa, Mycobacterium
GWTQRDADGYRTKDGKRLT

SEQ ID NO: 500534 - protein, 12 aa, Mycobacterium
GWTSTPGSGATA

SEQ ID NO: 500535 - protein, 13 aa, Mycobacterium
GWTTAKNSRNQTE

SEQ ID NO: 500536 - protein, 8 aa, Mycobacterium
GWTTASTK

SEQ ID NO: 500537 - protein, 10 aa, Mycobacterium
GWVGPSSEAM

SEQ ID NO: 500538 - protein, 17 aa, Mycobacterium
GWVTSGPELPEWDGTGL

SEQ ID NO: 500539 - protein, 11 aa, Mycobacterium
GWYGKTHDAAK

SEQ ID NO: 500540 - protein, 4 aa, Mycobacterium
GYAA

SEQ ID NO: 500541 - protein, 17 aa, Mycobacterium
GYAAAAQSVTTSEPTAT

SEQ ID NO: 500542 - protein, 9 aa, Mycobacterium
GYAAATTRR

SEQ ID NO: 500543 - protein, 10 aa, Mycobacterium
GYAAESEAGR

SEQ ID NO: 500544 - protein, 7 aa, Mycobacterium
GYAATTV

SEQ ID NO: 500545 - protein, 8 aa, Mycobacterium
GYADEEVA

SEQ ID NO: 500546 - protein, 5 aa, Mycobacterium
GYADG

SEQ ID NO: 500547 - protein, 6 aa, Mycobacterium
GYADPD

SEQ ID NO: 500548 - protein, 17 aa, Mycobacterium
GYADRGDAFAAAVRAAT

SEQ ID NO: 500549 - protein, 17 aa, Mycobacterium
GYADRGDAFAAAVRAAV

SEQ ID NO: 500550 - protein, 10 aa, Mycobacterium
GYADRPALGQ

SEQ ID NO: 500551 - protein, 10 aa, Mycobacterium
GYADSPSDEA

SEQ ID NO: 500552 - protein, 10 aa, Mycobacterium
GYAEAAQTTY

SEQ ID NO: 500553 - protein, 17 aa, Mycobacterium
GYAEADPTADVEGYDAA

SEQ ID NO: 500554 - protein, 9 aa, Mycobacterium
GYAEAEPFT

SEQ ID NO: 500555 - protein, 11 aa, Mycobacterium
GYAEATRSEIP

SEQ ID NO: 500556 - protein, 6 aa, Mycobacterium
GYAEEA

SEQ ID NO: 500557 - protein, 11 aa, Mycobacterium
GYAEGGLPSEH

SEQ ID NO: 500558 - protein, 17 aa, Mycobacterium
GYAERESGATGEQLPAP

SEQ ID NO: 500559 - protein, 17 aa, Mycobacterium
GYAGKGYGDLKKDTAEA

SEQ ID NO: 500560 - protein, 5 aa, Mycobacterium
GYAGL

SEQ ID NO: 500561 - protein, 6 aa, Mycobacterium
GYAGPP

SEQ ID NO: 500562 - protein, 7 aa, Mycobacterium
GYAGSHA

SEQ ID NO: 500563 - protein, 5 aa, Mycobacterium
GYAGT

SEQ ID NO: 500564 - protein, 6 aa, Mycobacterium
GYAGTV

SEQ ID NO: 500565 - protein, 5 aa, Mycobacterium
GYAND

SEQ ID NO: 500566 - protein, 20 aa, Mycobacterium
GYANPGTEEVTTYERNPDGT

SEQ ID NO: 500567 - protein, 6 aa, Mycobacterium
GYANTT

SEQ ID NO: 500568 - protein, 9 aa, Mycobacterium
GYANYGGAD

SEQ ID NO: 500569 - protein, 4 aa, Mycobacterium
GYAP

SEQ ID NO: 500570 - protein, 12 aa, Mycobacterium
GYAPAANHGVGR

SEQ ID NO: 500571 - protein, 14 aa, Mycobacterium
GYAPAEDDEAEQMH

SEQ ID NO: 500572 - protein, 7 aa, Mycobacterium
GYAPNRT

SEQ ID NO: 500573 - protein, 7 aa, Mycobacterium
GYAPQQV

SEQ ID NO: 500574 - protein, 5 aa, Mycobacterium
GYAPR

SEQ ID NO: 500575 - protein, 8 aa, Mycobacterium
GYAPRSAR

SEQ ID NO: 500576 - protein, 13 aa, Mycobacterium
GYAPSEIPADAEY

SEQ ID NO: 500577 - protein, 13 aa, Mycobacterium
GYAPTGPAPDGDY

SEQ ID NO: 500578 - protein, 5 aa, Mycobacterium
GYAQT

SEQ ID NO: 500579 - protein, 13 aa, Mycobacterium
GYARPTSTMATPP

SEQ ID NO: 500580 - protein, 17 aa, Mycobacterium
GYASGDLDTRGGSTIEQ

SEQ ID NO: 500581 - protein, 12 aa, Mycobacterium
GYATENEENTLG

SEQ ID NO: 500582 - protein, 6 aa, Mycobacterium
GYATGG

SEQ ID NO: 500583 - protein, 5 aa, Mycobacterium
GYATT

SEQ ID NO: 500584 - protein, 8 aa, Mycobacterium
GYATTGQA

SEQ ID NO: 500585 - protein, 9 aa, Mycobacterium
GYDAETAGA

SEQ ID NO: 500586 - protein, 9 aa, Mycobacterium
GYDAETGAA

SEQ ID NO: 500587 - protein, 14 aa, Mycobacterium
GYDAPKDLAQTKSK

SEQ ID NO: 500588 - protein, 6 aa, Mycobacterium
GYDARE

SEQ ID NO: 500589 - protein, 6 aa, Mycobacterium
GYDDEE

SEQ ID NO: 500590 - protein, 9 aa, Mycobacterium
GYDDEGVAA

SEQ ID NO: 500591 - protein, 10 aa, Mycobacterium
GYDDEGVASQ

SEQ ID NO: 500592 - protein, 4 aa, Mycobacterium
GYDE

SEQ ID NO: 500593 - protein, 8 aa, Mycobacterium
GYDEATEI

SEQ ID NO: 500594 - protein, 4 aa, Mycobacterium
GYDG

SEQ ID NO: 500595 - protein, 5 aa, Mycobacterium
GYDGA

SEQ ID NO: 500596 - protein, 10 aa, Mycobacterium
GYDGARPVRI

SEQ ID NO: 500597 - protein, 5 aa, Mycobacterium
GYDGD

SEQ ID NO: 500598 - protein, 16 aa, Mycobacterium
GYDGDRSLLDAPVVPP

SEQ ID NO: 500599 - protein, 9 aa, Mycobacterium
GYDGDVPGM

SEQ ID NO: 500600 - protein, 5 aa, Mycobacterium
GYDGR

SEQ ID NO: 500601 - protein, 10 aa, Mycobacterium
GYDGTSTNRI

SEQ ID NO: 500602 - protein, 9 aa, Mycobacterium
GYDKTSVRD

SEQ ID NO: 500603 - protein, 5 aa, Mycobacterium
GYDLG

SEQ ID NO: 500604 - protein, 6 aa, Mycobacterium
GYDPDA

SEQ ID NO: 500605 - protein, 7 aa, Mycobacterium
GYDPDRY

SEQ ID NO: 500606 - protein, 12 aa, Mycobacterium
GYDPDTASYDPA

SEQ ID NO: 500607 - protein, 10 aa, Mycobacterium
GYDPQTAQTY

SEQ ID NO: 500608 - protein, 8 aa, Mycobacterium
GYDQDAPR

SEQ ID NO: 500609 - protein, 8 aa, Mycobacterium
GYDQTSVR

SEQ ID NO: 500610 - protein, 12 aa, Mycobacterium
GYDRRDPGTANV

SEQ ID NO: 500611 - protein, 11 aa, Mycobacterium
GYDRSCKRGQA

SEQ ID NO: 500612 - protein, 6 aa, Mycobacterium
GYDRTY

SEQ ID NO: 500613 - protein, 13 aa, Mycobacterium
GYDSAPNTTAGST

SEQ ID NO: 500614 - protein, 11 aa, Mycobacterium
GYDSGDKTPLE

SEQ ID NO: 500615 - protein, 10 aa, Mycobacterium
GYDSNSRART

SEQ ID NO: 500616 - protein, 5 aa, Mycobacterium
GYDSP

SEQ ID NO: 500617 - protein, 7 aa, Mycobacterium
GYDTGLD

SEQ ID NO: 500618 - protein, 4 aa, Mycobacterium
GYDV

SEQ ID NO: 500619 - protein, 27 aa, Mycobacterium
GYDVGADGDIPGLPATGRPAGDGDGDT

SEQ ID NO: 500620 - protein, 11 aa, Mycobacterium
GYEAATPEDLK

SEQ ID NO: 500621 - protein, 7 aa, Mycobacterium
GYEATSI

SEQ ID NO: 500622 - protein, 16 aa, Mycobacterium
GYEDKYPSDLSGGMKQ

SEQ ID NO: 500623 - protein, 4 aa, Mycobacterium
GYEE

SEQ ID NO: 500624 - protein, 5 aa, Mycobacterium
GYEEA

SEQ ID NO: 500625 - protein, 17 aa, Mycobacterium
GYEGHEYDEGPAYRGGY

SEQ ID NO: 500626 - protein, 15 aa, Mycobacterium
GYEGQIGQTAYAAAK

SEQ ID NO: 500627 - protein, 16 aa, Mycobacterium
GYEHPADPRQPDNTHR

SEQ ID NO: 500628 - protein, 16 aa, Mycobacterium
GYEHPGDPRQPDNTHR

SEQ ID NO: 500629 - protein, 5 aa, Mycobacterium
GYENH

SEQ ID NO: 500630 - protein, 15 aa, Mycobacterium
GYEPAGIARLRAIGA

SEQ ID NO: 500631 - protein, 5 aa, Mycobacterium
GYEPE

SEQ ID NO: 500632 - protein, 6 aa, Mycobacterium
GYEPED

SEQ ID NO: 500633 - protein, 5 aa, Mycobacterium
GYEQP

SEQ ID NO: 500634 - protein, 9 aa, Mycobacterium
GYEQSKDKW

SEQ ID NO: 500635 - protein, 4 aa, Mycobacterium
GYER

SEQ ID NO: 500636 - protein, 10 aa, Mycobacterium
GYERAEEIAA

SEQ ID NO: 500637 - protein, 8 aa, Mycobacterium
GYERDARR

SEQ ID NO: 500638 - protein, 17 aa, Mycobacterium
GYERPDAGVAGTFPSEP

SEQ ID NO: 500639 - protein, 10 aa, Mycobacterium
GYESAATTPA

SEQ ID NO: 500640 - protein, 10 aa, Mycobacterium
GYESPSPIQA

SEQ ID NO: 500641 - protein, 9 aa, Mycobacterium
GYESPTAIQ

SEQ ID NO: 500642 - protein, 9 aa, Mycobacterium
GYESPTGIQ

SEQ ID NO: 500643 - protein, 7 aa, Mycobacterium
GYESRHR

SEQ ID NO: 500644 - protein, 8 aa, Mycobacterium
GYETPSAI

SEQ ID NO: 500645 - protein, 8 aa, Mycobacterium
GYETTSGA

SEQ ID NO: 500646 - protein, 12 aa, Mycobacterium
GYEVDGREVTPA

SEQ ID NO: 500647 - protein, 9 aa, Mycobacterium
GYEVTGTAN

SEQ ID NO: 500648 - protein, 11 aa, Mycobacterium
GYFTPNARNAY

SEQ ID NO: 500649 - protein, 15 aa, Mycobacterium
GYGADKLASPLGRGR

SEQ ID NO: 500650 - protein, 17 aa, Mycobacterium
GYGADKLASPVGRGRFT

SEQ ID NO: 500651 - protein, 15 aa, Mycobacterium
GYGADKLSSPVGRGR

SEQ ID NO: 500652 - protein, 8 aa, Mycobacterium
GYGAEADR

SEQ ID NO: 500653 - protein, 9 aa, Mycobacterium
GYGAPTYPT

SEQ ID NO: 500654 - protein, 8 aa, Mycobacterium
GYGASGDR

SEQ ID NO: 500655 - protein, 10 aa, Mycobacterium
GYGASGRNGG

SEQ ID NO: 500656 - protein, 10 aa, Mycobacterium
GYGDSGKTSL

SEQ ID NO: 500657 - protein, 4 aa, Mycobacterium
GYGE

SEQ ID NO: 500658 - protein, 6 aa, Mycobacterium
GYGENF

SEQ ID NO: 500659 - protein, 8 aa, Mycobacterium
GYGEPRPV

SEQ ID NO: 500660 - protein, 9 aa, Mycobacterium
GYGGEDTDF

SEQ ID NO: 500661 - protein, 11 aa, Mycobacterium
GYGGGATAYSG

SEQ ID NO: 500662 - protein, 12 aa, Mycobacterium
GYGGGNPNPQVN

SEQ ID NO: 500663 - protein, 9 aa, Mycobacterium
GYGGRAGLT

SEQ ID NO: 500664 - protein, 21 aa, Mycobacterium
GYGGSSRPAEMDGDPGTGRPL

SEQ ID NO: 500665 - protein, 5 aa, Mycobacterium
GYGGT

SEQ ID NO: 500666 - protein, 6 aa, Mycobacterium
GYGGTN

SEQ ID NO: 500667 - protein, 7 aa, Mycobacterium
GYGGTQR

SEQ ID NO: 500668 - protein, 10 aa, Mycobacterium
GYGHPTSQGT

SEQ ID NO: 500669 - protein, 5 aa, Mycobacterium
GYGKQ

SEQ ID NO: 500670 - protein, 6 aa, Mycobacterium
GYGKTE

SEQ ID NO: 500671 - protein, 49 aa, Mycobacterium
GYGNAGNVNAGFGNAGIQNTGWENSGTVNTGFGNAGMTNTGWGNSGNIN

SEQ ID NO: 500672 - protein, 12 aa, Mycobacterium
GYGNNPNTASGL

SEQ ID NO: 500673 - protein, 12 aa, Mycobacterium
GYGNNPNTGTGL

SEQ ID NO: 500674 - protein, 5 aa, Mycobacterium
GYGPD

SEQ ID NO: 500675 - protein, 11 aa, Mycobacterium
GYGPDGPYEKR

SEQ ID NO: 500676 - protein, 8 aa, Mycobacterium
GYGPDVAG

SEQ ID NO: 500677 - protein, 6 aa, Mycobacterium
GYGPED

SEQ ID NO: 500678 - protein, 6 aa, Mycobacterium
GYGPER

SEQ ID NO: 500679 - protein, 5 aa, Mycobacterium
GYGPG

SEQ ID NO: 500680 - protein, 6 aa, Mycobacterium
GYGPIP

SEQ ID NO: 500681 - protein, 6 aa, Mycobacterium
GYGPPL

SEQ ID NO: 500682 - protein, 5 aa, Mycobacterium
GYGPR

SEQ ID NO: 500683 - protein, 5 aa, Mycobacterium
GYGPS

SEQ ID NO: 500684 - protein, 22 aa, Mycobacterium
GYGPSDSAGQTRRRRRSGAGAA

SEQ ID NO: 500685 - protein, 9 aa, Mycobacterium
GYGPSSPDQ

SEQ ID NO: 500686 - protein, 14 aa, Mycobacterium
GYGPTGQHASRAGH

SEQ ID NO: 500687 - protein, 33 aa, Mycobacterium
GYGPTTGGKASGTAKAGHGGKASDGGKGGNGGD

SEQ ID NO: 500688 - protein, 5 aa, Mycobacterium
GYGQQ

SEQ ID NO: 500689 - protein, 17 aa, Mycobacterium
GYGQRSSDRTNSRNGYR

SEQ ID NO: 500690 - protein, 17 aa, Mycobacterium
GYGQRSSERTNSRNGYR

SEQ ID NO: 500691 - protein, 5 aa, Mycobacterium
GYGQS

SEQ ID NO: 500692 - protein, 16 aa, Mycobacterium
GYGQSDKRSGDYRQAG

SEQ ID NO: 500693 - protein, 23 aa, Mycobacterium
GYGQTGPDARKAGYASVAEAASG

SEQ ID NO: 500694 - protein, 23 aa, Mycobacterium
GYGQTGPDASKAGYASVAEAASG

SEQ ID NO: 500695 - protein, 23 aa, Mycobacterium
GYGQTGPEAGKAGYASVAEAASG

SEQ ID NO: 500696 - protein, 16 aa, Mycobacterium
GYGQTGPYRDRPGFGG

SEQ ID NO: 500697 - protein, 8 aa, Mycobacterium
GYGRPGRW

SEQ ID NO: 500698 - protein, 9 aa, Mycobacterium
GYGRTSDNV

SEQ ID NO: 500699 - protein, 20 aa, Mycobacterium
GYGRTTAPRDAAAYDRGTTV

SEQ ID NO: 500700 - protein, 16 aa, Mycobacterium
GYGSADQAEAGDVPVA

SEQ ID NO: 500701 - protein, 7 aa, Mycobacterium
GYGSARG

SEQ ID NO: 500702 - protein, 15 aa, Mycobacterium
GYGSDGPYKDRPGQD

SEQ ID NO: 500703 - protein, 6 aa, Mycobacterium
GYGSGA

SEQ ID NO: 500704 - protein, 11 aa, Mycobacterium
GYGSGGPLSHK

SEQ ID NO: 500705 - protein, 6 aa, Mycobacterium
GYGSPA

SEQ ID NO: 500706 - protein, 7 aa, Mycobacterium
GYGSPTQ

SEQ ID NO: 500707 - protein, 10 aa, Mycobacterium
GYGSSDAGEV

SEQ ID NO: 500708 - protein, 12 aa, Mycobacterium
GYGSSEGGGAVA

SEQ ID NO: 500709 - protein, 10 aa, Mycobacterium
GYGSTSTRRI

SEQ ID NO: 500710 - protein, 10 aa, Mycobacterium
GYGTAEGPQL

SEQ ID NO: 500711 - protein, 11 aa, Mycobacterium
GYGTAERQTRT

SEQ ID NO: 500712 - protein, 9 aa, Mycobacterium
GYGTTVPAG

SEQ ID NO: 500713 - protein, 14 aa, Mycobacterium
GYGTVDDATEDADV

SEQ ID NO: 500714 - protein, 12 aa, Mycobacterium
GYGWSGPPPHRW

SEQ ID NO: 500715 - protein, 4 aa, Mycobacterium
GYGY

SEQ ID NO: 500716 - protein, 9 aa, Mycobacterium
GYHGGAAPA

SEQ ID NO: 500717 - protein, 8 aa, Mycobacterium
GYHGPNEG

SEQ ID NO: 500718 - protein, 5 aa, Mycobacterium
GYHKA

SEQ ID NO: 500719 - protein, 6 aa, Mycobacterium
GYHNRE

SEQ ID NO: 500720 - protein, 13 aa, Mycobacterium
GYHQTSLGGGTKL

SEQ ID NO: 500721 - protein, 13 aa, Mycobacterium
GYIGRDDGANLTA

SEQ ID NO: 500722 - protein, 4 aa, Mycobacterium
GYKA

SEQ ID NO: 500723 - protein, 8 aa, Mycobacterium
GYKARNPF

SEQ ID NO: 500724 - protein, 17 aa, Mycobacterium
GYKATDANNANSFGQQG

SEQ ID NO: 500725 - protein, 9 aa, Mycobacterium
GYKATSVAQ

SEQ ID NO: 500726 - protein, 11 aa, Mycobacterium
GYKHSGNGREW

SEQ ID NO: 500727 - protein, 14 aa, Mycobacterium
GYKMPGGTPSSPAL

SEQ ID NO: 500728 - protein, 14 aa, Mycobacterium
GYKMPGGTPSSPGL

SEQ ID NO: 500729 - protein, 15 aa, Mycobacterium
GYKMPGGTPSSPGLA

SEQ ID NO: 500730 - protein, 8 aa, Mycobacterium
GYKPNPIE

SEQ ID NO: 500731 - protein, 14 aa, Mycobacterium
GYKPNTKPHNRQIR

SEQ ID NO: 500732 - protein, 14 aa, Mycobacterium
GYKPNTKPHSRQIR

SEQ ID NO: 500733 - protein, 9 aa, Mycobacterium
GYKPSAAGL

SEQ ID NO: 500734 - protein, 9 aa, Mycobacterium
GYKPTENYE

SEQ ID NO: 500735 - protein, 14 aa, Mycobacterium
GYKPTVKPHNRQIR

SEQ ID NO: 500736 - protein, 5 aa, Mycobacterium
GYKQP

SEQ ID NO: 500737 - protein, 10 aa, Mycobacterium
GYKRSGIGRE

SEQ ID NO: 500738 - protein, 5 aa, Mycobacterium
GYKSE

SEQ ID NO: 500739 - protein, 10 aa, Mycobacterium
GYLPDTATST

SEQ ID NO: 500740 - protein, 8 aa, Mycobacterium
GYMPEASA

SEQ ID NO: 500741 - protein, 11 aa, Mycobacterium
GYNDPRTPERW

SEQ ID NO: 500742 - protein, 8 aa, Mycobacterium
GYNENNQR

SEQ ID NO: 500743 - protein, 6 aa, Mycobacterium
GYNFPD

SEQ ID NO: 500744 - protein, 12 aa, Mycobacterium
GYNPGGPSVAET

SEQ ID NO: 500745 - protein, 4 aa, Mycobacterium
GYNQ

SEQ ID NO: 500746 - protein, 4 aa, Mycobacterium
GYPA

SEQ ID NO: 500747 - protein, 5 aa, Mycobacterium
GYPAA

SEQ ID NO: 500748 - protein, 13 aa, Mycobacterium
GYPAAQGPPRRVQ

SEQ ID NO: 500749 - protein, 12 aa, Mycobacterium
GYPAATGPARRV

SEQ ID NO: 500750 - protein, 6 aa, Mycobacterium
GYPADV

SEQ ID NO: 500751 - protein, 9 aa, Mycobacterium
GYPARSEGR

SEQ ID NO: 500752 - protein, 8 aa, Mycobacterium
GYPATGAA

SEQ ID NO: 500753 - protein, 6 aa, Mycobacterium
GYPDED

SEQ ID NO: 500754 - protein, 5 aa, Mycobacterium
GYPDL

SEQ ID NO: 500755 - protein, 8 aa, Mycobacterium
GYPDSEPL

SEQ ID NO: 500756 - protein, 8 aa, Mycobacterium
GYPDVAGS

SEQ ID NO: 500757 - protein, 6 aa, Mycobacterium
GYPDVN

SEQ ID NO: 500758 - protein, 6 aa, Mycobacterium
GYPDVR

SEQ ID NO: 500759 - protein, 6 aa, Mycobacterium
GYPDVT

SEQ ID NO: 500760 - protein, 21 aa, Mycobacterium
GYPEEGLDPRTPLPPGQMLVE

SEQ ID NO: 500761 - protein, 7 aa, Mycobacterium
GYPEGAA

SEQ ID NO: 500762 - protein, 4 aa, Mycobacterium
GYPG

SEQ ID NO: 500763 - protein, 9 aa, Mycobacterium
GYPGAPGYL

SEQ ID NO: 500764 - protein, 8 aa, Mycobacterium
GYPGDREE

SEQ ID NO: 500765 - protein, 7 aa, Mycobacterium
GYPGDRN

SEQ ID NO: 500766 - protein, 8 aa, Mycobacterium
GYPGDRPD

SEQ ID NO: 500767 - protein, 10 aa, Mycobacterium
GYPGDRQDAL

SEQ ID NO: 500768 - protein, 8 aa, Mycobacterium
GYPGGQAI

SEQ ID NO: 500769 - protein, 24 aa, Mycobacterium
GYPGSDWARNAAAAGSGTLTKGNK

SEQ ID NO: 500770 - protein, 8 aa, Mycobacterium
GYPGTEDA

SEQ ID NO: 500771 - protein, 9 aa, Mycobacterium
GYPGYTPRQ

SEQ ID NO: 500772 - protein, 8 aa, Mycobacterium
GYPHPGPQ

SEQ ID NO: 500773 - protein, 6 aa, Mycobacterium
GYPHPT

SEQ ID NO: 500774 - protein, 5 aa, Mycobacterium
GYPKG

SEQ ID NO: 500775 - protein, 11 aa, Mycobacterium
GYPKVTSEGRH

SEQ ID NO: 500776 - protein, 9 aa, Mycobacterium
GYPLGPANI

SEQ ID NO: 500777 - protein, 25 aa, Mycobacterium
GYPMQRKGSSAVTGSLDSASASEIG

SEQ ID NO: 500778 - protein, 7 aa, Mycobacterium
GYPNGAR

SEQ ID NO: 500779 - protein, 14 aa, Mycobacterium
GYPPAEQLASDGGW

SEQ ID NO: 500780 - protein, 12 aa, Mycobacterium
GYPPATGPARRV

SEQ ID NO: 500781 - protein, 6 aa, Mycobacterium
GYPPLS

SEQ ID NO: 500782 - protein, 11 aa, Mycobacterium
GYPPPGSRGRM

SEQ ID NO: 500783 - protein, 8 aa, Mycobacterium
GYPPPQTQ

SEQ ID NO: 500784 - protein, 10 aa, Mycobacterium
GYPPPRSGTR

SEQ ID NO: 500785 - protein, 12 aa, Mycobacterium
GYPPPRSRSRGR

SEQ ID NO: 500786 - protein, 7 aa, Mycobacterium
GYPPQSK

SEQ ID NO: 500787 - protein, 4 aa, Mycobacterium
GYPQ

SEQ ID NO: 500788 - protein, 6 aa, Mycobacterium
GYPQHS

SEQ ID NO: 500789 - protein, 9 aa, Mycobacterium
GYPQVTETR

SEQ ID NO: 500790 - protein, 7 aa, Mycobacterium
GYPRDIG

SEQ ID NO: 500791 - protein, 7 aa, Mycobacterium
GYPREGK

SEQ ID NO: 500792 - protein, 7 aa, Mycobacterium
GYPREGR

SEQ ID NO: 500793 - protein, 7 aa, Mycobacterium
GYPRTGP

SEQ ID NO: 500794 - protein, 10 aa, Mycobacterium
GYPSGEAPAI

SEQ ID NO: 500795 - protein, 6 aa, Mycobacterium
GYPSQA

SEQ ID NO: 500796 - protein, 19 aa, Mycobacterium
GYPSRKDLTPEALQRVEAY

SEQ ID NO: 500797 - protein, 6 aa, Mycobacterium
GYPTAH

SEQ ID NO: 500798 - protein, 7 aa, Mycobacterium
GYPTDGI

SEQ ID NO: 500799 - protein, 10 aa, Mycobacterium
GYPTEHRAAQ

SEQ ID NO: 500800 - protein, 21 aa, Mycobacterium
GYPTESEPSDIDVATLIVRDS

SEQ ID NO: 500801 - protein, 6 aa, Mycobacterium
GYPTTD

SEQ ID NO: 500802 - protein, 6 aa, Mycobacterium
GYPTTH

SEQ ID NO: 500803 - protein, 28 aa, Mycobacterium
GYPTTVDPPAAEPSAVSEHGANASEFSR

SEQ ID NO: 500804 - protein, 5 aa, Mycobacterium
GYPVG

SEQ ID NO: 500805 - protein, 4 aa, Mycobacterium
GYPY

SEQ ID NO: 500806 - protein, 11 aa, Mycobacterium
GYQAKPKLPGI

SEQ ID NO: 500807 - protein, 14 aa, Mycobacterium
GYQAPADYAATCKH

SEQ ID NO: 500808 - protein, 5 aa, Mycobacterium
GYQAT

SEQ ID NO: 500809 - protein, 8 aa, Mycobacterium
GYQAVGSG

SEQ ID NO: 500810 - protein, 4 aa, Mycobacterium
GYQG

SEQ ID NO: 500811 - protein, 8 aa, Mycobacterium
GYQGPGRN

SEQ ID NO: 500812 - protein, 5 aa, Mycobacterium
GYQGT

SEQ ID NO: 500813 - protein, 10 aa, Mycobacterium
GYQHAEPGTV

SEQ ID NO: 500814 - protein, 5 aa, Mycobacterium
GYQKS

SEQ ID NO: 500815 - protein, 5 aa, Mycobacterium
GYQPY

SEQ ID NO: 500816 - protein, 7 aa, Mycobacterium
GYQRTTI

SEQ ID NO: 500817 - protein, 7 aa, Mycobacterium
GYQSATA

SEQ ID NO: 500818 - protein, 8 aa, Mycobacterium
GYQSLSAQ

SEQ ID NO: 500819 - protein, 10 aa, Mycobacterium
GYQTTDSPAW

SEQ ID NO: 500820 - protein, 9 aa, Mycobacterium
GYQVSPGTL

SEQ ID NO: 500821 - protein, 12 aa, Mycobacterium
GYRADAQPVDLA

SEQ ID NO: 500822 - protein, 7 aa, Mycobacterium
GYRADED

SEQ ID NO: 500823 - protein, 12 aa, Mycobacterium
GYRASADHETIG

SEQ ID NO: 500824 - protein, 9 aa, Mycobacterium
GYRASKDYE

SEQ ID NO: 500825 - protein, 9 aa, Mycobacterium
GYRATTSTV

SEQ ID NO: 500826 - protein, 5 aa, Mycobacterium
GYRDE

SEQ ID NO: 500827 - protein, 15 aa, Mycobacterium
GYRDEDGVDDDSDVE

SEQ ID NO: 500828 - protein, 11 aa, Mycobacterium
GYRDPTALGGY

SEQ ID NO: 500829 - protein, 4 aa, Mycobacterium
GYRE

SEQ ID NO: 500830 - protein, 6 aa, Mycobacterium
GYREET

SEQ ID NO: 500831 - protein, 8 aa, Mycobacterium
GYRESTES

SEQ ID NO: 500832 - protein, 6 aa, Mycobacterium
GYRETT

SEQ ID NO: 500833 - protein, 4 aa, Mycobacterium
GYRG

SEQ ID NO: 500834 - protein, 7 aa, Mycobacterium
GYRGARG

SEQ ID NO: 500835 - protein, 11 aa, Mycobacterium
GYRGIDGPAYQ

SEQ ID NO: 500836 - protein, 11 aa, Mycobacterium
GYRGPRAEEAL

SEQ ID NO: 500837 - protein, 7 aa, Mycobacterium
GYRHPPG

SEQ ID NO: 500838 - protein, 4 aa, Mycobacterium
GYRI

SEQ ID NO: 500839 - protein, 4 aa, Mycobacterium
GYRN

SEQ ID NO: 500840 - protein, 4 aa, Mycobacterium
GYRP

SEQ ID NO: 500841 - protein, 10 aa, Mycobacterium
GYRPDPATGV

SEQ ID NO: 500842 - protein, 12 aa, Mycobacterium
GYRPDSATGAVN

SEQ ID NO: 500843 - protein, 7 aa, Mycobacterium
GYRPEDY

SEQ ID NO: 500844 - protein, 7 aa, Mycobacterium
GYRPETP

SEQ ID NO: 500845 - protein, 8 aa, Mycobacterium
GYRPETPT

SEQ ID NO: 500846 - protein, 5 aa, Mycobacterium
GYRPR

SEQ ID NO: 500847 - protein, 7 aa, Mycobacterium
GYRPSAG

SEQ ID NO: 500848 - protein, 7 aa, Mycobacterium
GYRPTLT

SEQ ID NO: 500849 - protein, 5 aa, Mycobacterium
GYRQF

SEQ ID NO: 500850 - protein, 7 aa, Mycobacterium
GYRQPSC

SEQ ID NO: 500851 - protein, 14 aa, Mycobacterium
GYRQTSLGGGTKLS

SEQ ID NO: 500852 - protein, 4 aa, Mycobacterium
GYRR

SEQ ID NO: 500853 - protein, 13 aa, Mycobacterium
GYRRAADGSDFGD

SEQ ID NO: 500854 - protein, 14 aa, Mycobacterium
GYRRGALGGSDDDE

SEQ ID NO: 500855 - protein, 10 aa, Mycobacterium
GYRRRGDAKD

SEQ ID NO: 500856 - protein, 11 aa, Mycobacterium
GYRRRSDPKDL

SEQ ID NO: 500857 - protein, 10 aa, Mycobacterium
GYRRRTDPKD

SEQ ID NO: 500858 - protein, 7 aa, Mycobacterium
GYRSETP

SEQ ID NO: 500859 - protein, 26 aa, Mycobacterium
GYRSGSAATALPHEPRSAYKSANPRM

SEQ ID NO: 500860 - protein, 9 aa, Mycobacterium
GYRSLEENQ

SEQ ID NO: 500861 - protein, 15 aa, Mycobacterium
GYRSSGGLTDSVTDG

SEQ ID NO: 500862 - protein, 7 aa, Mycobacterium
GYRSTSV

SEQ ID NO: 500863 - protein, 9 aa, Mycobacterium
GYSAPSDVL

SEQ ID NO: 500864 - protein, 16 aa, Mycobacterium
GYSASGDPQVDETAAE

SEQ ID NO: 500865 - protein, 16 aa, Mycobacterium
GYSASPSVSATTNSHG

SEQ ID NO: 500866 - protein, 10 aa, Mycobacterium
GYSATGDPLI

SEQ ID NO: 500867 - protein, 25 aa, Mycobacterium
GYSATGIDDSPSAIERAKRNAERAG

SEQ ID NO: 500868 - protein, 25 aa, Mycobacterium
GYSATGIDGSPGALERARENARRAG

SEQ ID NO: 500869 - protein, 7 aa, Mycobacterium
GYSDQER

SEQ ID NO: 500870 - protein, 5 aa, Mycobacterium
GYSDY

SEQ ID NO: 500871 - protein, 4 aa, Mycobacterium
GYSE

SEQ ID NO: 500872 - protein, 7 aa, Mycobacterium
GYSEDEV

SEQ ID NO: 500873 - protein, 15 aa, Mycobacterium
GYSEEGGNRARGASA

SEQ ID NO: 500874 - protein, 8 aa, Mycobacterium
GYSEETTQ

SEQ ID NO: 500875 - protein, 22 aa, Mycobacterium
GYSEPGAGSDLANVSTTATLDG

SEQ ID NO: 500876 - protein, 6 aa, Mycobacterium
GYSEPI

SEQ ID NO: 500877 - protein, 30 aa, Mycobacterium
GYSGATVTDGTATGGGGGAGTGGRGGLGGS

SEQ ID NO: 500878 - protein, 19 aa, Mycobacterium
GYSGETRWDSTKPDGTPRK

SEQ ID NO: 500879 - protein, 19 aa, Mycobacterium
GYSGGDTPNATYRNHGSHA

SEQ ID NO: 500880 - protein, 19 aa, Mycobacterium
GYSGGDVANATYRNHGTHA

SEQ ID NO: 500881 - protein, 7 aa, Mycobacterium
GYSGGEG

SEQ ID NO: 500882 - protein, 12 aa, Mycobacterium
GYSGSGRERLGE

SEQ ID NO: 500883 - protein, 12 aa, Mycobacterium
GYSGTGTRRLGE

SEQ ID NO: 500884 - protein, 12 aa, Mycobacterium
GYSGVTDEIRPG

SEQ ID NO: 500885 - protein, 11 aa, Mycobacterium
GYSISPQDAAS

SEQ ID NO: 500886 - protein, 9 aa, Mycobacterium
GYSKERRVD

SEQ ID NO: 500887 - protein, 5 aa, Mycobacterium
GYSKK

SEQ ID NO: 500888 - protein, 11 aa, Mycobacterium
GYSNGYGNSKW

SEQ ID NO: 500889 - protein, 11 aa, Mycobacterium
GYSPADDSPFA

SEQ ID NO: 500890 - protein, 7 aa, Mycobacterium
GYSPAER

SEQ ID NO: 500891 - protein, 5 aa, Mycobacterium
GYSPG

SEQ ID NO: 500892 - protein, 6 aa, Mycobacterium
GYSPGD

SEQ ID NO: 500893 - protein, 5 aa, Mycobacterium
GYSRA

SEQ ID NO: 500894 - protein, 8 aa, Mycobacterium
GYSRKESY

SEQ ID NO: 500895 - protein, 10 aa, Mycobacterium
GYSSPEPGHV

SEQ ID NO: 500896 - protein, 5 aa, Mycobacterium
GYSSS

SEQ ID NO: 500897 - protein, 7 aa, Mycobacterium
GYSSSEE

SEQ ID NO: 500898 - protein, 4 aa, Mycobacterium
GYST

SEQ ID NO: 500899 - protein, 5 aa, Mycobacterium
GYSTA

SEQ ID NO: 500900 - protein, 6 aa, Mycobacterium
GYSTRE

SEQ ID NO: 500901 - protein, 19 aa, Mycobacterium
GYSTTGPIEDAVAALRTAL

SEQ ID NO: 500902 - protein, 6 aa, Mycobacterium
GYSYGG

SEQ ID NO: 500903 - protein, 4 aa, Mycobacterium
GYTA

SEQ ID NO: 500904 - protein, 6 aa, Mycobacterium
GYTADD

SEQ ID NO: 500905 - protein, 12 aa, Mycobacterium
GYTAETVPAEGE

SEQ ID NO: 500906 - protein, 17 aa, Mycobacterium
GYTASGDPQVDETAAEI

SEQ ID NO: 500907 - protein, 5 aa, Mycobacterium
GYTAT

SEQ ID NO: 500908 - protein, 6 aa, Mycobacterium
GYTATR

SEQ ID NO: 500909 - protein, 5 aa, Mycobacterium
GYTDA

SEQ ID NO: 500910 - protein, 8 aa, Mycobacterium
GYTDNREP

SEQ ID NO: 500911 - protein, 19 aa, Mycobacterium
GYTDSGDPQVTETAGEIGL

SEQ ID NO: 500912 - protein, 5 aa, Mycobacterium
GYTEA

SEQ ID NO: 500913 - protein, 6 aa, Mycobacterium
GYTEDD

SEQ ID NO: 500914 - protein, 6 aa, Mycobacterium
GYTEES

SEQ ID NO: 500915 - protein, 5 aa, Mycobacterium
GYTEV

SEQ ID NO: 500916 - protein, 5 aa, Mycobacterium
GYTGA

SEQ ID NO: 500917 - protein, 10 aa, Mycobacterium
GYTGASSIEE

SEQ ID NO: 500918 - protein, 5 aa, Mycobacterium
GYTGE

SEQ ID NO: 500919 - protein, 19 aa, Mycobacterium
GYTGETDWDPTKPDGTPRK

SEQ ID NO: 500920 - protein, 6 aa, Mycobacterium
GYTGEV

SEQ ID NO: 500921 - protein, 19 aa, Mycobacterium
GYTGGDNDHPTYRNHPGHA

SEQ ID NO: 500922 - protein, 23 aa, Mycobacterium
GYTGGSAGSAPHAPQGATSPALA

SEQ ID NO: 500923 - protein, 23 aa, Mycobacterium
GYTGKPDDAEAAEQPDPGAEESA

SEQ ID NO: 500924 - protein, 18 aa, Mycobacterium
GYTGRQWDSTTSRNSAEL

SEQ ID NO: 500925 - protein, 8 aa, Mycobacterium
GYTGSASI

SEQ ID NO: 500926 - protein, 9 aa, Mycobacterium
GYTGSATIE

SEQ ID NO: 500927 - protein, 7 aa, Mycobacterium
GYTGSPT

SEQ ID NO: 500928 - protein, 9 aa, Mycobacterium
GYTGSPTIE

SEQ ID NO: 500929 - protein, 10 aa, Mycobacterium
GYTGSSTIEE

SEQ ID NO: 500930 - protein, 5 aa, Mycobacterium
GYTGT

SEQ ID NO: 500931 - protein, 4 aa, Mycobacterium
GYTL

SEQ ID NO: 500932 - protein, 4 aa, Mycobacterium
GYTP

SEQ ID NO: 500933 - protein, 13 aa, Mycobacterium
GYTPDQAAREFGQ

SEQ ID NO: 500934 - protein, 10 aa, Mycobacterium
GYTPDQDPFE

SEQ ID NO: 500935 - protein, 9 aa, Mycobacterium
GYTPEFPGR

SEQ ID NO: 500936 - protein, 6 aa, Mycobacterium
GYTPGD

SEQ ID NO: 500937 - protein, 7 aa, Mycobacterium
GYTPGHR

SEQ ID NO: 500938 - protein, 7 aa, Mycobacterium
GYTPSEL

SEQ ID NO: 500939 - protein, 10 aa, Mycobacterium
GYTPTEAQAD

SEQ ID NO: 500940 - protein, 5 aa, Mycobacterium
GYTQD

SEQ ID NO: 500941 - protein, 20 aa, Mycobacterium
GYTRAAPHRGNEPMTEKPSW

SEQ ID NO: 500942 - protein, 4 aa, Mycobacterium
GYTS

SEQ ID NO: 500943 - protein, 7 aa, Mycobacterium
GYTSDAA

SEQ ID NO: 500944 - protein, 7 aa, Mycobacterium
GYTSEDW

SEQ ID NO: 500945 - protein, 14 aa, Mycobacterium
GYTSPGRAKETAQD

SEQ ID NO: 500946 - protein, 14 aa, Mycobacterium
GYTSPGRTKETAQD

SEQ ID NO: 500947 - protein, 7 aa, Mycobacterium
GYTSSLA

SEQ ID NO: 500948 - protein, 5 aa, Mycobacterium
GYTST

SEQ ID NO: 500949 - protein, 4 aa, Mycobacterium
GYTT

SEQ ID NO: 500950 - protein, 5 aa, Mycobacterium
GYTTA

SEQ ID NO: 500951 - protein, 5 aa, Mycobacterium
GYTTD

SEQ ID NO: 500952 - protein, 7 aa, Mycobacterium
GYVEDSG

SEQ ID NO: 500953 - protein, 8 aa, Mycobacterium
GYVEDSGL

SEQ ID NO: 500954 - protein, 4 aa, Mycobacterium
GYVP

SEQ ID NO: 500955 - protein, 10 aa, Mycobacterium
GYVPDDPAVQ

SEQ ID NO: 500956 - protein, 8 aa, Mycobacterium
GYVRGEGA

SEQ ID NO: 500957 - protein, 7 aa, Mycobacterium
GYVTPDD

SEQ ID NO: 500958 - protein, 10 aa, Mycobacterium
GYYAASPQGL

SEQ ID NO: 500959 - protein, 4 aa, Mycobacterium
GYYE

SEQ ID NO: 500960 - protein, 5 aa, Mycobacterium
GYYGA

SEQ ID NO: 500961 - protein, 11 aa, Mycobacterium
GYYGAEGAHPN

SEQ ID NO: 500962 - protein, 10 aa, Mycobacterium
GYYGDSGDRI

SEQ ID NO: 500963 - protein, 13 aa, Mycobacterium
GYYNNEGRGGAVR

SEQ ID NO: 500964 - protein, 7 aa, Mycobacterium
GYYQTRR

SEQ ID NO: 500965 - protein, 20 aa, Mycobacterium
HAAAGESAVPNPDNALQHRI

SEQ ID NO: 500966 - protein, 8 aa, Mycobacterium
HAAAGGGE

SEQ ID NO: 500967 - protein, 18 aa, Mycobacterium
HAAAGGLGEFPKEGLGAG

SEQ ID NO: 500968 - protein, 7 aa, Mycobacterium
HAAANPD

SEQ ID NO: 500969 - protein, 7 aa, Mycobacterium
HAAANQS

SEQ ID NO: 500970 - protein, 16 aa, Mycobacterium
HAAAPGWAKTAPAARA

SEQ ID NO: 500971 - protein, 6 aa, Mycobacterium
HAAAQA

SEQ ID NO: 500972 - protein, 20 aa, Mycobacterium
HAAATSTAARAGAPPPAPGR

SEQ ID NO: 500973 - protein, 4 aa, Mycobacterium
HAAD

SEQ ID NO: 500974 - protein, 12 aa, Mycobacterium
HAADAGAGAALD

SEQ ID NO: 500975 - protein, 17 aa, Mycobacterium
HAADGATYDPDDPEDSA

SEQ ID NO: 500976 - protein, 10 aa, Mycobacterium
HAADGDQQRV

SEQ ID NO: 500977 - protein, 15 aa, Mycobacterium
HAADQRAMASADAQR

SEQ ID NO: 500978 - protein, 16 aa, Mycobacterium
HAADRGVPFREVKRNK

SEQ ID NO: 500979 - protein, 10 aa, Mycobacterium
HAADTRAGRQ

SEQ ID NO: 500980 - protein, 4 aa, Mycobacterium
HAAE

SEQ ID NO: 500981 - protein, 5 aa, Mycobacterium
HAAEA

SEQ ID NO: 500982 - protein, 5 aa, Mycobacterium
HAAES

SEQ ID NO: 500983 - protein, 8 aa, Mycobacterium
HAAESEQL

SEQ ID NO: 500984 - protein, 14 aa, Mycobacterium
HAAESGSTDGLDAA

SEQ ID NO: 500985 - protein, 16 aa, Mycobacterium
HAAESNARRFGGSGQD

SEQ ID NO: 500986 - protein, 14 aa, Mycobacterium
HAAGAPAPHLGQDT

SEQ ID NO: 500987 - protein, 20 aa, Mycobacterium
HAAGDEDSYAEAYTETSTAQ

SEQ ID NO: 500988 - protein, 6 aa, Mycobacterium
HAAGDL

SEQ ID NO: 500989 - protein, 7 aa, Mycobacterium
HAAGEAG

SEQ ID NO: 500990 - protein, 8 aa, Mycobacterium
HAAGEDTF

SEQ ID NO: 500991 - protein, 7 aa, Mycobacterium
HAAGENP

SEQ ID NO: 500992 - protein, 10 aa, Mycobacterium
HAAGGPTHAG

SEQ ID NO: 500993 - protein, 5 aa, Mycobacterium
HAAGH

SEQ ID NO: 500994 - protein, 10 aa, Mycobacterium
HAAGKQRVQE

SEQ ID NO: 500995 - protein, 11 aa, Mycobacterium
HAAGQDTQQDF

SEQ ID NO: 500996 - protein, 6 aa, Mycobacterium
HAAGQR

SEQ ID NO: 500997 - protein, 7 aa, Mycobacterium
HAAGSTA

SEQ ID NO: 500998 - protein, 10 aa, Mycobacterium
HAAGTGPEVE

SEQ ID NO: 500999 - protein, 5 aa, Mycobacterium
HAAIT

SEQ ID NO: 501000 - protein, 7 aa, Mycobacterium
HAAKNPD

SEQ ID NO: 501001 - protein, 6 aa, Mycobacterium
HAANNG

SEQ ID NO: 501002 - protein, 7 aa, Mycobacterium
HAANNPD

SEQ ID NO: 501003 - protein, 17 aa, Mycobacterium
HAAPAPEDFGPYRTFCG

SEQ ID NO: 501004 - protein, 5 aa, Mycobacterium
HAAPD

SEQ ID NO: 501005 - protein, 8 aa, Mycobacterium
HAAPGDID

SEQ ID NO: 501006 - protein, 7 aa, Mycobacterium
HAAPGRY

SEQ ID NO: 501007 - protein, 8 aa, Mycobacterium
HAAPHNSH

SEQ ID NO: 501008 - protein, 6 aa, Mycobacterium
HAAPPI

SEQ ID NO: 501009 - protein, 6 aa, Mycobacterium
HAAPSG

SEQ ID NO: 501010 - protein, 10 aa, Mycobacterium
HAAPTEHDQS

SEQ ID NO: 501011 - protein, 7 aa, Mycobacterium
HAAPTTF

SEQ ID NO: 501012 - protein, 4 aa, Mycobacterium
HAAQ

SEQ ID NO: 501013 - protein, 7 aa, Mycobacterium
HAAQGAT

SEQ ID NO: 501014 - protein, 6 aa, Mycobacterium
HAAQTG

SEQ ID NO: 501015 - protein, 5 aa, Mycobacterium
HAARG

SEQ ID NO: 501016 - protein, 18 aa, Mycobacterium
HAARGGAMGATQAASSKI

SEQ ID NO: 501017 - protein, 6 aa, Mycobacterium
HAARPY

SEQ ID NO: 501018 - protein, 7 aa, Mycobacterium
HAARTET

SEQ ID NO: 501019 - protein, 7 aa, Mycobacterium
HAARTSA

SEQ ID NO: 501020 - protein, 8 aa, Mycobacterium
HAARTSAD

SEQ ID NO: 501021 - protein, 10 aa, Mycobacterium
HAASAGLTTS

SEQ ID NO: 501022 - protein, 7 aa, Mycobacterium
HAASDEA

SEQ ID NO: 501023 - protein, 10 aa, Mycobacterium
HAASEPSRIP

SEQ ID NO: 501024 - protein, 13 aa, Mycobacterium
HAASGNLDRARAE

SEQ ID NO: 501025 - protein, 9 aa, Mycobacterium
HAASPEQQQ

SEQ ID NO: 501026 - protein, 21 aa, Mycobacterium
HAASSAGSSPPTVARSCPPHT

SEQ ID NO: 501027 - protein, 11 aa, Mycobacterium
HAASTAAGSHS

SEQ ID NO: 501028 - protein, 4 aa, Mycobacterium
HAAT

SEQ ID NO: 501029 - protein, 5 aa, Mycobacterium
HAATA

SEQ ID NO: 501030 - protein, 11 aa, Mycobacterium
HAATESHTDPL

SEQ ID NO: 501031 - protein, 14 aa, Mycobacterium
HAATGFARSAREEL

SEQ ID NO: 501032 - protein, 11 aa, Mycobacterium
HAATRARDRAA

SEQ ID NO: 501033 - protein, 9 aa, Mycobacterium
HAATRRGLE

SEQ ID NO: 501034 - protein, 16 aa, Mycobacterium
HAATSGNASAGSVATP

SEQ ID NO: 501035 - protein, 6 aa, Mycobacterium
HAATSI

SEQ ID NO: 501036 - protein, 17 aa, Mycobacterium
HAATSSAAVQTATASPL

SEQ ID NO: 501037 - protein, 6 aa, Mycobacterium
HAATTQ

SEQ ID NO: 501038 - protein, 6 aa, Mycobacterium
HAATVE

SEQ ID NO: 501039 - protein, 6 aa, Mycobacterium
HADAAG

SEQ ID NO: 501040 - protein, 9 aa, Mycobacterium
HADAAGEYP

SEQ ID NO: 501041 - protein, 6 aa, Mycobacterium
HADAES

SEQ ID NO: 501042 - protein, 11 aa, Mycobacterium
HADAGAARKVG

SEQ ID NO: 501043 - protein, 8 aa, Mycobacterium
HADAVDDV

SEQ ID NO: 501044 - protein, 12 aa, Mycobacterium
HADDAESNRIRT

SEQ ID NO: 501045 - protein, 5 aa, Mycobacterium
HADDD

SEQ ID NO: 501046 - protein, 11 aa, Mycobacterium
HADDDGDPRPV

SEQ ID NO: 501047 - protein, 8 aa, Mycobacterium
HADDGQRY

SEQ ID NO: 501048 - protein, 8 aa, Mycobacterium
HADDNDME

SEQ ID NO: 501049 - protein, 6 aa, Mycobacterium
HADDPA

SEQ ID NO: 501050 - protein, 10 aa, Mycobacterium
HADESGTSHV

SEQ ID NO: 501051 - protein, 4 aa, Mycobacterium
HADG

SEQ ID NO: 501052 - protein, 14 aa, Mycobacterium
HADGGAGAEQRPGL

SEQ ID NO: 501053 - protein, 9 aa, Mycobacterium
HADGGVNGP

SEQ ID NO: 501054 - protein, 9 aa, Mycobacterium
HADGPRRPV

SEQ ID NO: 501055 - protein, 16 aa, Mycobacterium
HADGRRDSAALGTVPD

SEQ ID NO: 501056 - protein, 6 aa, Mycobacterium
HADGSE

SEQ ID NO: 501057 - protein, 9 aa, Mycobacterium
HADGTEHSH

SEQ ID NO: 501058 - protein, 16 aa, Mycobacterium
HADHKPHKLSGGQQQR

SEQ ID NO: 501059 - protein, 4 aa, Mycobacterium
HADI

SEQ ID NO: 501060 - protein, 13 aa, Mycobacterium
HADLRDDPGPPMA

SEQ ID NO: 501061 - protein, 5 aa, Mycobacterium
HADMG

SEQ ID NO: 501062 - protein, 4 aa, Mycobacterium
HADN

SEQ ID NO: 501063 - protein, 10 aa, Mycobacterium
HADPAPLRAT

SEQ ID NO: 501064 - protein, 7 aa, Mycobacterium
HADPARV

SEQ ID NO: 501065 - protein, 9 aa, Mycobacterium
HADPARVAE

SEQ ID NO: 501066 - protein, 9 aa, Mycobacterium
HADPATQAD

SEQ ID NO: 501067 - protein, 10 aa, Mycobacterium
HADPDDEPTR

SEQ ID NO: 501068 - protein, 6 aa, Mycobacterium
HADPEG

SEQ ID NO: 501069 - protein, 7 aa, Mycobacterium
HADPGDV

SEQ ID NO: 501070 - protein, 5 aa, Mycobacterium
HADPH

SEQ ID NO: 501071 - protein, 9 aa, Mycobacterium
HADPKDPLG

SEQ ID NO: 501072 - protein, 14 aa, Mycobacterium
HADPLGHQQRVQVF

SEQ ID NO: 501073 - protein, 6 aa, Mycobacterium
HADPNS

SEQ ID NO: 501074 - protein, 9 aa, Mycobacterium
HADPQTAAG

SEQ ID NO: 501075 - protein, 9 aa, Mycobacterium
HADPTEDEL

SEQ ID NO: 501076 - protein, 6 aa, Mycobacterium
HADQLG

SEQ ID NO: 501077 - protein, 14 aa, Mycobacterium
HADQPAHRLSGGQK

SEQ ID NO: 501078 - protein, 19 aa, Mycobacterium
HADQRRSDVTTTLGPGATV

SEQ ID NO: 501079 - protein, 4 aa, Mycobacterium
HADR

SEQ ID NO: 501080 - protein, 5 aa, Mycobacterium
HADRF

SEQ ID NO: 501081 - protein, 9 aa, Mycobacterium
HADRGDGHR

SEQ ID NO: 501082 - protein, 6 aa, Mycobacterium
HADRGR

SEQ ID NO: 501083 - protein, 8 aa, Mycobacterium
HADRRGEV

SEQ ID NO: 501084 - protein, 5 aa, Mycobacterium
HADRS

SEQ ID NO: 501085 - protein, 17 aa, Mycobacterium
HADRSPAHLSGGQRRRA

SEQ ID NO: 501086 - protein, 5 aa, Mycobacterium
HADRV

SEQ ID NO: 501087 - protein, 6 aa, Mycobacterium
HADSID

SEQ ID NO: 501088 - protein, 11 aa, Mycobacterium
HADSIDDQQQK

SEQ ID NO: 501089 - protein, 9 aa, Mycobacterium
HADSPAGRT

SEQ ID NO: 501090 - protein, 7 aa, Mycobacterium
HADTGGL

SEQ ID NO: 501091 - protein, 9 aa, Mycobacterium
HADTLGEDV

SEQ ID NO: 501092 - protein, 7 aa, Mycobacterium
HADTPGL

SEQ ID NO: 501093 - protein, 10 aa, Mycobacterium
HADTRAAVTA

SEQ ID NO: 501094 - protein, 12 aa, Mycobacterium
HADTRAGKYSKG

SEQ ID NO: 501095 - protein, 6 aa, Mycobacterium
HADTYP

SEQ ID NO: 501096 - protein, 10 aa, Mycobacterium
HAEAAERGLS

SEQ ID NO: 501097 - protein, 8 aa, Mycobacterium
HAEADSDD

SEQ ID NO: 501098 - protein, 9 aa, Mycobacterium
HAEAGQGYA

SEQ ID NO: 501099 - protein, 6 aa, Mycobacterium
HAEAGV

SEQ ID NO: 501100 - protein, 7 aa, Mycobacterium
HAEAPIP

SEQ ID NO: 501101 - protein, 6 aa, Mycobacterium
HAEAST

SEQ ID NO: 501102 - protein, 87 aa, Mycobacterium
HAEDPTDAKGAEDAGDAEDADDTAEGSGPAEPVDGEAGQPDPTEHEQQAQPVETPPPADPAPAEPPAPAAAPAAEPTPAAGEGSTPC

SEQ ID NO: 501103 - protein, 12 aa, Mycobacterium
HAEDSLRARTRA

SEQ ID NO: 501104 - protein, 8 aa, Mycobacterium
HAEEEREL

SEQ ID NO: 501105 - protein, 10 aa, Mycobacterium
HAEEFSDATR

SEQ ID NO: 501106 - protein, 5 aa, Mycobacterium
HAEEG

SEQ ID NO: 501107 - protein, 18 aa, Mycobacterium
HAEEQTGRPARNRRQEET

SEQ ID NO: 501108 - protein, 5 aa, Mycobacterium
HAEGD

SEQ ID NO: 501109 - protein, 6 aa, Mycobacterium
HAEGDR

SEQ ID NO: 501110 - protein, 7 aa, Mycobacterium
HAEGTAA

SEQ ID NO: 501111 - protein, 4 aa, Mycobacterium
HAEI

SEQ ID NO: 501112 - protein, 11 aa, Mycobacterium
HAEKGDAQRGL

SEQ ID NO: 501113 - protein, 10 aa, Mycobacterium
HAENGWPEDE

SEQ ID NO: 501114 - protein, 8 aa, Mycobacterium
HAENPDYT

SEQ ID NO: 501115 - protein, 7 aa, Mycobacterium
HAENRNA

SEQ ID NO: 501116 - protein, 8 aa, Mycobacterium
HAEPEEER

SEQ ID NO: 501117 - protein, 7 aa, Mycobacterium
HAEPGTV

SEQ ID NO: 501118 - protein, 14 aa, Mycobacterium
HAEPVAADGPVATG

SEQ ID NO: 501119 - protein, 6 aa, Mycobacterium
HAEQPR

SEQ ID NO: 501120 - protein, 4 aa, Mycobacterium
HAER

SEQ ID NO: 501121 - protein, 7 aa, Mycobacterium
HAERDHD

SEQ ID NO: 501122 - protein, 5 aa, Mycobacterium
HAERL

SEQ ID NO: 501123 - protein, 9 aa, Mycobacterium
HAERTNHHP

SEQ ID NO: 501124 - protein, 5 aa, Mycobacterium
HAERV

SEQ ID NO: 501125 - protein, 8 aa, Mycobacterium
HAESDRLR

SEQ ID NO: 501126 - protein, 6 aa, Mycobacterium
HAESGL

SEQ ID NO: 501127 - protein, 6 aa, Mycobacterium
HAESTR

SEQ ID NO: 501128 - protein, 9 aa, Mycobacterium
HAESVTGER

SEQ ID NO: 501129 - protein, 4 aa, Mycobacterium
HAET

SEQ ID NO: 501130 - protein, 7 aa, Mycobacterium
HAETASA

SEQ ID NO: 501131 - protein, 5 aa, Mycobacterium
HAETD

SEQ ID NO: 501132 - protein, 5 aa, Mycobacterium
HAETR

SEQ ID NO: 501133 - protein, 7 aa, Mycobacterium
HAFSASP

SEQ ID NO: 501134 - protein, 9 aa, Mycobacterium
HAFSDDSRR

SEQ ID NO: 501135 - protein, 10 aa, Mycobacterium
HAFTGHPTSM

SEQ ID NO: 501136 - protein, 4 aa, Mycobacterium
HAGA

SEQ ID NO: 501137 - protein, 12 aa, Mycobacterium
HAGAAAPGGGWT

SEQ ID NO: 501138 - protein, 6 aa, Mycobacterium
HAGAAP

SEQ ID NO: 501139 - protein, 10 aa, Mycobacterium
HAGAATDGEW

SEQ ID NO: 501140 - protein, 13 aa, Mycobacterium
HAGAEKGRTPGGV

SEQ ID NO: 501141 - protein, 6 aa, Mycobacterium
HAGAGS

SEQ ID NO: 501142 - protein, 6 aa, Mycobacterium
HAGAKD

SEQ ID NO: 501143 - protein, 8 aa, Mycobacterium
HAGANTGV

SEQ ID NO: 501144 - protein, 9 aa, Mycobacterium
HAGASRQTL

SEQ ID NO: 501145 - protein, 26 aa, Mycobacterium
HAGDADPYKESAAEEPAAYEDDERRP

SEQ ID NO: 501146 - protein, 8 aa, Mycobacterium
HAGDGEDQ

SEQ ID NO: 501147 - protein, 6 aa, Mycobacterium
HAGDGN

SEQ ID NO: 501148 - protein, 10 aa, Mycobacterium
HAGDHDGPLG

SEQ ID NO: 501149 - protein, 12 aa, Mycobacterium
HAGDVVKPVLTW

SEQ ID NO: 501150 - protein, 4 aa, Mycobacterium
HAGE

SEQ ID NO: 501151 - protein, 12 aa, Mycobacterium
HAGERANPVATG

SEQ ID NO: 501152 - protein, 4 aa, Mycobacterium
HAGG

SEQ ID NO: 501153 - protein, 19 aa, Mycobacterium
HAGGAGGVDDVGDVFGCRR

SEQ ID NO: 501154 - protein, 10 aa, Mycobacterium
HAGGDPNGFG

SEQ ID NO: 501155 - protein, 7 aa, Mycobacterium
HAGGEKA

SEQ ID NO: 501156 - protein, 7 aa, Mycobacterium
HAGGEKT

SEQ ID NO: 501157 - protein, 13 aa, Mycobacterium
HAGGGHPGGYEGP

SEQ ID NO: 501158 - protein, 9 aa, Mycobacterium
HAGGPTLEG

SEQ ID NO: 501159 - protein, 6 aa, Mycobacterium
HAGGRK

SEQ ID NO: 501160 - protein, 12 aa, Mycobacterium
HAGGSGLWGLIT

SEQ ID NO: 501161 - protein, 6 aa, Mycobacterium
HAGGTA

SEQ ID NO: 501162 - protein, 7 aa, Mycobacterium
HAGHRET

SEQ ID NO: 501163 - protein, 8 aa, Mycobacterium
HAGISAPA

SEQ ID NO: 501164 - protein, 7 aa, Mycobacterium
HAGLSGP

SEQ ID NO: 501165 - protein, 4 aa, Mycobacterium
HAGM

SEQ ID NO: 501166 - protein, 14 aa, Mycobacterium
HAGNIQKQSGELEE

SEQ ID NO: 501167 - protein, 12 aa, Mycobacterium
HAGNPDDGANAI

SEQ ID NO: 501168 - protein, 4 aa, Mycobacterium
HAGP

SEQ ID NO: 501169 - protein, 14 aa, Mycobacterium
HAGPAPPGDDDPPP

SEQ ID NO: 501170 - protein, 7 aa, Mycobacterium
HAGPGVP

SEQ ID NO: 501171 - protein, 19 aa, Mycobacterium
HAGPGYHPDLPRDDVDTRT

SEQ ID NO: 501172 - protein, 16 aa, Mycobacterium
HAGPVADARSNKATAL

SEQ ID NO: 501173 - protein, 16 aa, Mycobacterium
HAGPVANAKSNKAKAL

SEQ ID NO: 501174 - protein, 16 aa, Mycobacterium
HAGPVANAKSNKARAL

SEQ ID NO: 501175 - protein, 16 aa, Mycobacterium
HAGPVANARTNKAKAL

SEQ ID NO: 501176 - protein, 16 aa, Mycobacterium
HAGPVANARTNKATAL

SEQ ID NO: 501177 - protein, 10 aa, Mycobacterium
HAGQEAAKAV

SEQ ID NO: 501178 - protein, 12 aa, Mycobacterium
HAGQEQETEGAQ

SEQ ID NO: 501179 - protein, 6 aa, Mycobacterium
HAGQGD

SEQ ID NO: 501180 - protein, 8 aa, Mycobacterium
HAGQPRHG

SEQ ID NO: 501181 - protein, 13 aa, Mycobacterium
HAGQQPDPATNAR

SEQ ID NO: 501182 - protein, 12 aa, Mycobacterium
HAGQQPDRTTHA

SEQ ID NO: 501183 - protein, 13 aa, Mycobacterium
HAGQSADAATNAR

SEQ ID NO: 501184 - protein, 12 aa, Mycobacterium
HAGQSPDSATHA

SEQ ID NO: 501185 - protein, 7 aa, Mycobacterium
HAGQTGG

SEQ ID NO: 501186 - protein, 13 aa, Mycobacterium
HAGQTPDSATNAR

SEQ ID NO: 501187 - protein, 4 aa, Mycobacterium
HAGR

SEQ ID NO: 501188 - protein, 10 aa, Mycobacterium
HAGRATAADR

SEQ ID NO: 501189 - protein, 7 aa, Mycobacterium
HAGRDGL

SEQ ID NO: 501190 - protein, 6 aa, Mycobacterium
HAGRRA

SEQ ID NO: 501191 - protein, 5 aa, Mycobacterium
HAGRV

SEQ ID NO: 501192 - protein, 5 aa, Mycobacterium
HAGSA

SEQ ID NO: 501193 - protein, 13 aa, Mycobacterium
HAGSAKYRTDNRG

SEQ ID NO: 501194 - protein, 13 aa, Mycobacterium
HAGTGRAGKAAAD

SEQ ID NO: 501195 - protein, 7 aa, Mycobacterium
HAGTLDP

SEQ ID NO: 501196 - protein, 8 aa, Mycobacterium
HAGTLDPM

SEQ ID NO: 501197 - protein, 9 aa, Mycobacterium
HAGTPDEQE

SEQ ID NO: 501198 - protein, 7 aa, Mycobacterium
HAGTPGL

SEQ ID NO: 501199 - protein, 8 aa, Mycobacterium
HAGTPGLD

SEQ ID NO: 501200 - protein, 10 aa, Mycobacterium
HAGTSEQALS

SEQ ID NO: 501201 - protein, 14 aa, Mycobacterium
HAGVTLGGDSHAGV

SEQ ID NO: 501202 - protein, 8 aa, Mycobacterium
HAGYSDQA

SEQ ID NO: 501203 - protein, 10 aa, Mycobacterium
HAHDDGTEHT

SEQ ID NO: 501204 - protein, 10 aa, Mycobacterium
HAHGSEGHGA

SEQ ID NO: 501205 - protein, 10 aa, Mycobacterium
HAHSSPHRRI

SEQ ID NO: 501206 - protein, 22 aa, Mycobacterium
HAISETGSSGPSMPKTVGRRKH

SEQ ID NO: 501207 - protein, 10 aa, Mycobacterium
HAKASADTGL

SEQ ID NO: 501208 - protein, 10 aa, Mycobacterium
HAKDTAPPSL

SEQ ID NO: 501209 - protein, 10 aa, Mycobacterium
HAKGKLDARA

SEQ ID NO: 501210 - protein, 8 aa, Mycobacterium
HAKGNRDA

SEQ ID NO: 501211 - protein, 7 aa, Mycobacterium
HAKGRSV

SEQ ID NO: 501212 - protein, 6 aa, Mycobacterium
HAKPGT

SEQ ID NO: 501213 - protein, 32 aa, Mycobacterium
HAKRQRAEAAAQQQQQTQPEPLPSQLPPRGPL

SEQ ID NO: 501214 - protein, 9 aa, Mycobacterium
HAKRRAADF

SEQ ID NO: 501215 - protein, 8 aa, Mycobacterium
HAKSSEVQ

SEQ ID NO: 501216 - protein, 4 aa, Mycobacterium
HAKT

SEQ ID NO: 501217 - protein, 9 aa, Mycobacterium
HAKTTRELA

SEQ ID NO: 501218 - protein, 10 aa, Mycobacterium
HALDTTANAG

SEQ ID NO: 501219 - protein, 8 aa, Mycobacterium
HALPDGKA

SEQ ID NO: 501220 - protein, 8 aa, Mycobacterium
HALPGETD

SEQ ID NO: 501221 - protein, 6 aa, Mycobacterium
HALSDD

SEQ ID NO: 501222 - protein, 11 aa, Mycobacterium
HALSDDGHCRP

SEQ ID NO: 501223 - protein, 12 aa, Mycobacterium
HALSDDGRCRPY

SEQ ID NO: 501224 - protein, 11 aa, Mycobacterium
HALSGAESAEL

SEQ ID NO: 501225 - protein, 58 aa, Mycobacterium
HAMSAEDKLKNKIEDLGGRAKEALGKATGDAQTRDEGRADQAKSALKDAGEKVKDAFK

SEQ ID NO: 501226 - protein, 7 aa, Mycobacterium
HAMTTQT

SEQ ID NO: 501227 - protein, 4 aa, Mycobacterium
HANA

SEQ ID NO: 501228 - protein, 6 aa, Mycobacterium
HANDEV

SEQ ID NO: 501229 - protein, 8 aa, Mycobacterium
HANDPKVA

SEQ ID NO: 501230 - protein, 13 aa, Mycobacterium
HANDRSRGTSAMM

SEQ ID NO: 501231 - protein, 6 aa, Mycobacterium
HANEDG

SEQ ID NO: 501232 - protein, 8 aa, Mycobacterium
HANEEGRA

SEQ ID NO: 501233 - protein, 5 aa, Mycobacterium
HANEV

SEQ ID NO: 501234 - protein, 17 aa, Mycobacterium
HANGAGSSDQRPPLPST

SEQ ID NO: 501235 - protein, 6 aa, Mycobacterium
HANGAR

SEQ ID NO: 501236 - protein, 6 aa, Mycobacterium
HANPAA

SEQ ID NO: 501237 - protein, 73 aa, Mycobacterium
HANPGTDGTTSNGGNGTTGSDGTAAGQQGGTGGAGYNSGGPGDTNPFGGNGGTGGMGGPGTQGGAGGSGGYGP

SEQ ID NO: 501238 - protein, 7 aa, Mycobacterium
HANPNPV

SEQ ID NO: 501239 - protein, 10 aa, Mycobacterium
HANQAVSHAE

SEQ ID NO: 501240 - protein, 8 aa, Mycobacterium
HANQSTSI

SEQ ID NO: 501241 - protein, 6 aa, Mycobacterium
HANREG

SEQ ID NO: 501242 - protein, 8 aa, Mycobacterium
HANRPGPA

SEQ ID NO: 501243 - protein, 8 aa, Mycobacterium
HANSGKDH

SEQ ID NO: 501244 - protein, 9 aa, Mycobacterium
HANSGKDHI

SEQ ID NO: 501245 - protein, 10 aa, Mycobacterium
HANVESRHTC

SEQ ID NO: 501246 - protein, 4 aa, Mycobacterium
HAPA

SEQ ID NO: 501247 - protein, 9 aa, Mycobacterium
HAPAEHSYE

SEQ ID NO: 501248 - protein, 6 aa, Mycobacterium
HAPAGI

SEQ ID NO: 501249 - protein, 7 aa, Mycobacterium
HAPAGPH

SEQ ID NO: 501250 - protein, 11 aa, Mycobacterium
HAPAPVPEHTS

SEQ ID NO: 501251 - protein, 13 aa, Mycobacterium
HAPASAPNSADDE

SEQ ID NO: 501252 - protein, 6 aa, Mycobacterium
HAPAVT

SEQ ID NO: 501253 - protein, 4 aa, Mycobacterium
HAPD

SEQ ID NO: 501254 - protein, 13 aa, Mycobacterium
HAPDAGAEEAEAA

SEQ ID NO: 501255 - protein, 13 aa, Mycobacterium
HAPDAGAGEAQAA

SEQ ID NO: 501256 - protein, 9 aa, Mycobacterium
HAPDAGPVP

SEQ ID NO: 501257 - protein, 17 aa, Mycobacterium
HAPDAPPGALGRPAHPG

SEQ ID NO: 501258 - protein, 9 aa, Mycobacterium
HAPDDPAPL

SEQ ID NO: 501259 - protein, 11 aa, Mycobacterium
HAPDVAGQAGA

SEQ ID NO: 501260 - protein, 4 aa, Mycobacterium
HAPE

SEQ ID NO: 501261 - protein, 6 aa, Mycobacterium
HAPEDI

SEQ ID NO: 501262 - protein, 11 aa, Mycobacterium
HAPELGADPAR

SEQ ID NO: 501263 - protein, 19 aa, Mycobacterium
HAPELPQGHPVSSAPYGSA

SEQ ID NO: 501264 - protein, 8 aa, Mycobacterium
HAPESRFP

SEQ ID NO: 501265 - protein, 5 aa, Mycobacterium
HAPGA

SEQ ID NO: 501266 - protein, 11 aa, Mycobacterium
HAPGAGGPVDI

SEQ ID NO: 501267 - protein, 8 aa, Mycobacterium
HAPGEETQ

SEQ ID NO: 501268 - protein, 10 aa, Mycobacterium
HAPGEGPRFN

SEQ ID NO: 501269 - protein, 6 aa, Mycobacterium
HAPGGH

SEQ ID NO: 501270 - protein, 7 aa, Mycobacterium
HAPGPRH

SEQ ID NO: 501271 - protein, 6 aa, Mycobacterium
HAPGRA

SEQ ID NO: 501272 - protein, 6 aa, Mycobacterium
HAPGRW

SEQ ID NO: 501273 - protein, 8 aa, Mycobacterium
HAPGSSTV

SEQ ID NO: 501274 - protein, 6 aa, Mycobacterium
HAPHAD

SEQ ID NO: 501275 - protein, 7 aa, Mycobacterium
HAPHGEH

SEQ ID NO: 501276 - protein, 6 aa, Mycobacterium
HAPKNA

SEQ ID NO: 501277 - protein, 9 aa, Mycobacterium
HAPLATGDA

SEQ ID NO: 501278 - protein, 31 aa, Mycobacterium
HAPLPGEPVPGTHPLEPPPVEHAPPAPHGDV

SEQ ID NO: 501279 - protein, 4 aa, Mycobacterium
HAPN

SEQ ID NO: 501280 - protein, 11 aa, Mycobacterium
HAPNRRQRKSC

SEQ ID NO: 501281 - protein, 6 aa, Mycobacterium
HAPPAA

SEQ ID NO: 501282 - protein, 12 aa, Mycobacterium
HAPPASKVFSRR

SEQ ID NO: 501283 - protein, 7 aa, Mycobacterium
HAPPELQ

SEQ ID NO: 501284 - protein, 10 aa, Mycobacterium
HAPPRRPRGH

SEQ ID NO: 501285 - protein, 17 aa, Mycobacterium
HAPPTVTGAQIGDSGTG

SEQ ID NO: 501286 - protein, 6 aa, Mycobacterium
HAPPVT

SEQ ID NO: 501287 - protein, 5 aa, Mycobacterium
HAPRA

SEQ ID NO: 501288 - protein, 12 aa, Mycobacterium
HAPRDSRTTTFG

SEQ ID NO: 501289 - protein, 6 aa, Mycobacterium
HAPRRN

SEQ ID NO: 501290 - protein, 20 aa, Mycobacterium
HAPRTATVTAREDVRGYTGY

SEQ ID NO: 501291 - protein, 10 aa, Mycobacterium
HAPSAENSQP

SEQ ID NO: 501292 - protein, 6 aa, Mycobacterium
HAPSDT

SEQ ID NO: 501293 - protein, 10 aa, Mycobacterium
HAPSNSNTQP

SEQ ID NO: 501294 - protein, 9 aa, Mycobacterium
HAPTGPDDV

SEQ ID NO: 501295 - protein, 6 aa, Mycobacterium
HAPTGV

SEQ ID NO: 501296 - protein, 9 aa, Mycobacterium
HAPTLNPAT

SEQ ID NO: 501297 - protein, 6 aa, Mycobacterium
HAPTVG

SEQ ID NO: 501298 - protein, 6 aa, Mycobacterium
HAPVRD

SEQ ID NO: 501299 - protein, 14 aa, Mycobacterium
HAQAKAGSSHTLRP

SEQ ID NO: 501300 - protein, 10 aa, Mycobacterium
HAQASADTGL

SEQ ID NO: 501301 - protein, 5 aa, Mycobacterium
HAQDG

SEQ ID NO: 501302 - protein, 15 aa, Mycobacterium
HAQDQGYGTELNPDH

SEQ ID NO: 501303 - protein, 54 aa, Mycobacterium
HAQDRGHDRPNQPRDRLRSGAPACASHSTQVSYGSTRRAAPATEFTNGAKDNTS

SEQ ID NO: 501304 - protein, 8 aa, Mycobacterium
HAQGHPVS

SEQ ID NO: 501305 - protein, 8 aa, Mycobacterium
HAQGRNNL

SEQ ID NO: 501306 - protein, 69 aa, Mycobacterium
HAQGTTYGGQGGGYPEAASPEYDYGQQPDYGQQAEYGQPADYGQPADYGQQAGGYGGYGQGGYGATGTT

SEQ ID NO: 501307 - protein, 7 aa, Mycobacterium
HAQNDEL

SEQ ID NO: 501308 - protein, 6 aa, Mycobacterium
HAQPDQ

SEQ ID NO: 501309 - protein, 7 aa, Mycobacterium
HAQQAGA

SEQ ID NO: 501310 - protein, 11 aa, Mycobacterium
HAQQPPPSPLS

SEQ ID NO: 501311 - protein, 13 aa, Mycobacterium
HAQQRSDDARRRI

SEQ ID NO: 501312 - protein, 4 aa, Mycobacterium
HAQR

SEQ ID NO: 501313 - protein, 10 aa, Mycobacterium
HAQRAAGRTI

SEQ ID NO: 501314 - protein, 32 aa, Mycobacterium
HAQRPHQGARHQQHDHQRDDDGRQHHDGVDDR

SEQ ID NO: 501315 - protein, 14 aa, Mycobacterium
HAQRSPEAAPPYTV

SEQ ID NO: 501316 - protein, 14 aa, Mycobacterium
HAQRTHACARAALA

SEQ ID NO: 501317 - protein, 7 aa, Mycobacterium
HAQSGVP

SEQ ID NO: 501318 - protein, 8 aa, Mycobacterium
HAQSPAVV

SEQ ID NO: 501319 - protein, 16 aa, Mycobacterium
HARAAQASATWGGSGC

SEQ ID NO: 501320 - protein, 15 aa, Mycobacterium
HARAESQRPPSGHAV

SEQ ID NO: 501321 - protein, 5 aa, Mycobacterium
HARAG

SEQ ID NO: 501322 - protein, 6 aa, Mycobacterium
HARAGQ

SEQ ID NO: 501323 - protein, 8 aa, Mycobacterium
HARANGAA

SEQ ID NO: 501324 - protein, 14 aa, Mycobacterium
HARANTAERELDDT

SEQ ID NO: 501325 - protein, 10 aa, Mycobacterium
HARAQAGQIT

SEQ ID NO: 501326 - protein, 7 aa, Mycobacterium
HARDGGP

SEQ ID NO: 501327 - protein, 8 aa, Mycobacterium
HARDLSGG

SEQ ID NO: 501328 - protein, 5 aa, Mycobacterium
HARDP

SEQ ID NO: 501329 - protein, 6 aa, Mycobacterium
HAREGV

SEQ ID NO: 501330 - protein, 6 aa, Mycobacterium
HARERG

SEQ ID NO: 501331 - protein, 6 aa, Mycobacterium
HARESR

SEQ ID NO: 501332 - protein, 12 aa, Mycobacterium
HARGAAPSPYGG

SEQ ID NO: 501333 - protein, 6 aa, Mycobacterium
HARGAG

SEQ ID NO: 501334 - protein, 9 aa, Mycobacterium
HARGAGAAT

SEQ ID NO: 501335 - protein, 11 aa, Mycobacterium
HARGEDTDQGF

SEQ ID NO: 501336 - protein, 11 aa, Mycobacterium
HARGEDTPQDF

SEQ ID NO: 501337 - protein, 11 aa, Mycobacterium
HARGEDTQEDF

SEQ ID NO: 501338 - protein, 10 aa, Mycobacterium
HARGQDTQQD

SEQ ID NO: 501339 - protein, 8 aa, Mycobacterium
HARGREEP

SEQ ID NO: 501340 - protein, 8 aa, Mycobacterium
HARGRGGL

SEQ ID NO: 501341 - protein, 5 aa, Mycobacterium
HARGY

SEQ ID NO: 501342 - protein, 13 aa, Mycobacterium
HARHGRPPRSLDA

SEQ ID NO: 501343 - protein, 6 aa, Mycobacterium
HARNAL

SEQ ID NO: 501344 - protein, 7 aa, Mycobacterium
HARNALS

SEQ ID NO: 501345 - protein, 11 aa, Mycobacterium
HARNQQDYAEL

SEQ ID NO: 501346 - protein, 12 aa, Mycobacterium
HARPAPQTDLST

SEQ ID NO: 501347 - protein, 7 aa, Mycobacterium
HARPDGL

SEQ ID NO: 501348 - protein, 5 aa, Mycobacterium
HARPE

SEQ ID NO: 501349 - protein, 11 aa, Mycobacterium
HARPGKPCASA

SEQ ID NO: 501350 - protein, 13 aa, Mycobacterium
HARPVAGASVKSG

SEQ ID NO: 501351 - protein, 9 aa, Mycobacterium
HARQSRSAF

SEQ ID NO: 501352 - protein, 11 aa, Mycobacterium
HARSAKRAVKS

SEQ ID NO: 501353 - protein, 8 aa, Mycobacterium
HARSDSLA

SEQ ID NO: 501354 - protein, 6 aa, Mycobacterium
HARSPA

SEQ ID NO: 501355 - protein, 7 aa, Mycobacterium
HARSQDV

SEQ ID NO: 501356 - protein, 8 aa, Mycobacterium
HARSTGPY

SEQ ID NO: 501357 - protein, 6 aa, Mycobacterium
HARTPF

SEQ ID NO: 501358 - protein, 13 aa, Mycobacterium
HASAAGDAAGDEY

SEQ ID NO: 501359 - protein, 17 aa, Mycobacterium
HASAGPAADIIAGLVAT

SEQ ID NO: 501360 - protein, 8 aa, Mycobacterium
HASAHGGV

SEQ ID NO: 501361 - protein, 7 aa, Mycobacterium
HASASPV

SEQ ID NO: 501362 - protein, 11 aa, Mycobacterium
HASEAAAESAA

SEQ ID NO: 501363 - protein, 5 aa, Mycobacterium
HASGA

SEQ ID NO: 501364 - protein, 16 aa, Mycobacterium
HASGDYPKLDDPSEAG

SEQ ID NO: 501365 - protein, 11 aa, Mycobacterium
HASGESDSRSY

SEQ ID NO: 501366 - protein, 6 aa, Mycobacterium
HASGGW

SEQ ID NO: 501367 - protein, 8 aa, Mycobacterium
HASGPGIG

SEQ ID NO: 501368 - protein, 5 aa, Mycobacterium
HASGV

SEQ ID NO: 501369 - protein, 13 aa, Mycobacterium
HASGVGGTFGGNP

SEQ ID NO: 501370 - protein, 11 aa, Mycobacterium
HASNGFTGAGT

SEQ ID NO: 501371 - protein, 4 aa, Mycobacterium
HASP

SEQ ID NO: 501372 - protein, 7 aa, Mycobacterium
HASPEAV

SEQ ID NO: 501373 - protein, 18 aa, Mycobacterium
HASPEAVRTAAASERGYD

SEQ ID NO: 501374 - protein, 7 aa, Mycobacterium
HASPEGI

SEQ ID NO: 501375 - protein, 18 aa, Mycobacterium
HASPKSASDNHHHGDSET

SEQ ID NO: 501376 - protein, 10 aa, Mycobacterium
HASPLQAEYG

SEQ ID NO: 501377 - protein, 8 aa, Mycobacterium
HASPPPDV

SEQ ID NO: 501378 - protein, 17 aa, Mycobacterium
HASPTTSFPDKAPSSQR

SEQ ID NO: 501379 - protein, 5 aa, Mycobacterium
HASQP

SEQ ID NO: 501380 - protein, 6 aa, Mycobacterium
HASQPV

SEQ ID NO: 501381 - protein, 14 aa, Mycobacterium
HASRGGEVQDTERF

SEQ ID NO: 501382 - protein, 13 aa, Mycobacterium
HASRQRAERRLPD

SEQ ID NO: 501383 - protein, 24 aa, Mycobacterium
HASRQRAQRRLPDTPVATPPDVAA

SEQ ID NO: 501384 - protein, 5 aa, Mycobacterium
HASRV

SEQ ID NO: 501385 - protein, 8 aa, Mycobacterium
HASRYRDG

SEQ ID NO: 501386 - protein, 11 aa, Mycobacterium
HASSDRLKSTL

SEQ ID NO: 501387 - protein, 14 aa, Mycobacterium
HASSSFKDPERFDP

SEQ ID NO: 501388 - protein, 7 aa, Mycobacterium
HASTAGS

SEQ ID NO: 501389 - protein, 6 aa, Mycobacterium
HASTAR

SEQ ID NO: 501390 - protein, 6 aa, Mycobacterium
HASTQA

SEQ ID NO: 501391 - protein, 4 aa, Mycobacterium
HATA

SEQ ID NO: 501392 - protein, 6 aa, Mycobacterium
HATAAE

SEQ ID NO: 501393 - protein, 5 aa, Mycobacterium
HATAE

SEQ ID NO: 501394 - protein, 6 aa, Mycobacterium
HATAEA

SEQ ID NO: 501395 - protein, 8 aa, Mycobacterium
HATAEQRE

SEQ ID NO: 501396 - protein, 15 aa, Mycobacterium
HATAEQVEAARHDSK

SEQ ID NO: 501397 - protein, 7 aa, Mycobacterium
HATAETF

SEQ ID NO: 501398 - protein, 6 aa, Mycobacterium
HATAGW

SEQ ID NO: 501399 - protein, 9 aa, Mycobacterium
HATATEVAN

SEQ ID NO: 501400 - protein, 12 aa, Mycobacterium
HATATPKTADDT

SEQ ID NO: 501401 - protein, 7 aa, Mycobacterium
HATDDPR

SEQ ID NO: 501402 - protein, 18 aa, Mycobacterium
HATDEAPGTDQRAHGRDI

SEQ ID NO: 501403 - protein, 11 aa, Mycobacterium
HATDLGSPTVP

SEQ ID NO: 501404 - protein, 7 aa, Mycobacterium
HATDPDR

SEQ ID NO: 501405 - protein, 4 aa, Mycobacterium
HATE

SEQ ID NO: 501406 - protein, 12 aa, Mycobacterium
HATESHPTAPSL

SEQ ID NO: 501407 - protein, 7 aa, Mycobacterium
HATEVGT

SEQ ID NO: 501408 - protein, 16 aa, Mycobacterium
HATGDYPRLEDHSEAA

SEQ ID NO: 501409 - protein, 5 aa, Mycobacterium
HATGH

SEQ ID NO: 501410 - protein, 5 aa, Mycobacterium
HATGM

SEQ ID NO: 501411 - protein, 15 aa, Mycobacterium
HATGTQVGDVAEGRA

SEQ ID NO: 501412 - protein, 7 aa, Mycobacterium
HATGTSV

SEQ ID NO: 501413 - protein, 17 aa, Mycobacterium
HATGTSVGDVAEGKAIN

SEQ ID NO: 501414 - protein, 15 aa, Mycobacterium
HATGTSVGDVAEGRA

SEQ ID NO: 501415 - protein, 6 aa, Mycobacterium
HATGTT

SEQ ID NO: 501416 - protein, 9 aa, Mycobacterium
HATGTTVGD

SEQ ID NO: 501417 - protein, 11 aa, Mycobacterium
HATKGAVRNMS

SEQ ID NO: 501418 - protein, 15 aa, Mycobacterium
HATNSTAAVVHSQAT

SEQ ID NO: 501419 - protein, 14 aa, Mycobacterium
HATPDRDGGRTSAV

SEQ ID NO: 501420 - protein, 5 aa, Mycobacterium
HATPE

SEQ ID NO: 501421 - protein, 17 aa, Mycobacterium
HATPPPDPTGIASSARN

SEQ ID NO: 501422 - protein, 9 aa, Mycobacterium
HATPQGIPT

SEQ ID NO: 501423 - protein, 17 aa, Mycobacterium
HATPQGYDRDGRPRATV

SEQ ID NO: 501424 - protein, 7 aa, Mycobacterium
HATPTAL

SEQ ID NO: 501425 - protein, 9 aa, Mycobacterium
HATPTERER

SEQ ID NO: 501426 - protein, 8 aa, Mycobacterium
HATPTSLD

SEQ ID NO: 501427 - protein, 9 aa, Mycobacterium
HATQFTGTA

SEQ ID NO: 501428 - protein, 5 aa, Mycobacterium
HATRV

SEQ ID NO: 501429 - protein, 12 aa, Mycobacterium
HATSPDTAPTLT

SEQ ID NO: 501430 - protein, 6 aa, Mycobacterium
HATSSG

SEQ ID NO: 501431 - protein, 10 aa, Mycobacterium
HATSTSIGDV

SEQ ID NO: 501432 - protein, 19 aa, Mycobacterium
HATTAAHGAHGGATEPVQP

SEQ ID NO: 501433 - protein, 7 aa, Mycobacterium
HATTEGR

SEQ ID NO: 501434 - protein, 8 aa, Mycobacterium
HATTGKPF

SEQ ID NO: 501435 - protein, 8 aa, Mycobacterium
HATTGRPV

SEQ ID NO: 501436 - protein, 24 aa, Mycobacterium
HATTGYINSDADGASIIGSSAGAA

SEQ ID NO: 501437 - protein, 8 aa, Mycobacterium
HATTKGKE

SEQ ID NO: 501438 - protein, 12 aa, Mycobacterium
HATTPNTAPTLT

SEQ ID NO: 501439 - protein, 8 aa, Mycobacterium
HATTSDDI

SEQ ID NO: 501440 - protein, 10 aa, Mycobacterium
HATVSDPDQL

SEQ ID NO: 501441 - protein, 9 aa, Mycobacterium
HAVAADSEQ

SEQ ID NO: 501442 - protein, 13 aa, Mycobacterium
HAVDPADDGVAEP

SEQ ID NO: 501443 - protein, 15 aa, Mycobacterium
HAVEGYSGSLDHETR

SEQ ID NO: 501444 - protein, 6 aa, Mycobacterium
HAVGDQ

SEQ ID NO: 501445 - protein, 11 aa, Mycobacterium
HAVKDKAAQGL

SEQ ID NO: 501446 - protein, 14 aa, Mycobacterium
HAVTATDGQARPPA

SEQ ID NO: 501447 - protein, 9 aa, Mycobacterium
HAVTESPSG

SEQ ID NO: 501448 - protein, 6 aa, Mycobacterium
HAYAAG

SEQ ID NO: 501449 - protein, 11 aa, Mycobacterium
HAYEADPEVPG

SEQ ID NO: 501450 - protein, 4 aa, Mycobacterium
HAYG

SEQ ID NO: 501451 - protein, 7 aa, Mycobacterium
HAYGGGA

SEQ ID NO: 501452 - protein, 7 aa, Mycobacterium
HAYPAGG

SEQ ID NO: 501453 - protein, 8 aa, Mycobacterium
HAYSADGG

SEQ ID NO: 501454 - protein, 16 aa, Mycobacterium
HAYSYDGVSGAEVPDH

SEQ ID NO: 501455 - protein, 7 aa, Mycobacterium
HAYTGDG

SEQ ID NO: 501456 - protein, 8 aa, Mycobacterium
HCESGDEI

SEQ ID NO: 501457 - protein, 9 aa, Mycobacterium
HCESGDEIA

SEQ ID NO: 501458 - protein, 9 aa, Mycobacterium
HCGRSNARV

SEQ ID NO: 501459 - protein, 6 aa, Mycobacterium
HCPQDK

SEQ ID NO: 501460 - protein, 5 aa, Mycobacterium
HCPQI

SEQ ID NO: 501461 - protein, 17 aa, Mycobacterium
HCPSSNARLGAGTAPIP

SEQ ID NO: 501462 - protein, 6 aa, Mycobacterium
HCQRSR

SEQ ID NO: 501463 - protein, 5 aa, Mycobacterium
HCRSS

SEQ ID NO: 501464 - protein, 14 aa, Mycobacterium
HDAAADEYGSEERA

SEQ ID NO: 501465 - protein, 14 aa, Mycobacterium
HDAAAEEYGEGERA

SEQ ID NO: 501466 - protein, 14 aa, Mycobacterium
HDAAAEEYGSEQRA

SEQ ID NO: 501467 - protein, 16 aa, Mycobacterium
HDAADAQARAFEPEPA

SEQ ID NO: 501468 - protein, 8 aa, Mycobacterium
HDAADELG

SEQ ID NO: 501469 - protein, 10 aa, Mycobacterium
HDAAETARHQ

SEQ ID NO: 501470 - protein, 6 aa, Mycobacterium
HDAAGG

SEQ ID NO: 501471 - protein, 18 aa, Mycobacterium
HDAAGGSADRRFDEAAPA

SEQ ID NO: 501472 - protein, 5 aa, Mycobacterium
HDAAR

SEQ ID NO: 501473 - protein, 9 aa, Mycobacterium
HDAARSEDV

SEQ ID NO: 501474 - protein, 7 aa, Mycobacterium
HDADNLT

SEQ ID NO: 501475 - protein, 9 aa, Mycobacterium
HDADPARAE

SEQ ID NO: 501476 - protein, 19 aa, Mycobacterium
HDADSYPADATATANLPPG

SEQ ID NO: 501477 - protein, 9 aa, Mycobacterium
HDAEGTTAT

SEQ ID NO: 501478 - protein, 5 aa, Mycobacterium
HDAEL

SEQ ID NO: 501479 - protein, 4 aa, Mycobacterium
HDAG

SEQ ID NO: 501480 - protein, 11 aa, Mycobacterium
HDAGAAAADEL

SEQ ID NO: 501481 - protein, 6 aa, Mycobacterium
HDAGAG

SEQ ID NO: 501482 - protein, 13 aa, Mycobacterium
HDAGEAGAGEAAN

SEQ ID NO: 501483 - protein, 11 aa, Mycobacterium
HDAGGNLQERR

SEQ ID NO: 501484 - protein, 7 aa, Mycobacterium
HDAGGRY

SEQ ID NO: 501485 - protein, 13 aa, Mycobacterium
HDAGKLRNTINPK

SEQ ID NO: 501486 - protein, 10 aa, Mycobacterium
HDAGPANDAA

SEQ ID NO: 501487 - protein, 6 aa, Mycobacterium
HDAGRL

SEQ ID NO: 501488 - protein, 15 aa, Mycobacterium
HDAHPAATLTEEAAA

SEQ ID NO: 501489 - protein, 5 aa, Mycobacterium
HDAID

SEQ ID NO: 501490 - protein, 12 aa, Mycobacterium
HDAKDSTSLETE

SEQ ID NO: 501491 - protein, 4 aa, Mycobacterium
HDAN

SEQ ID NO: 501492 - protein, 4 aa, Mycobacterium
HDAP

SEQ ID NO: 501493 - protein, 6 aa, Mycobacterium
HDAPDG

SEQ ID NO: 501494 - protein, 10 aa, Mycobacterium
HDAPKVARRS

SEQ ID NO: 501495 - protein, 7 aa, Mycobacterium
HDAPPAT

SEQ ID NO: 501496 - protein, 6 aa, Mycobacterium
HDAPRP

SEQ ID NO: 501497 - protein, 8 aa, Mycobacterium
HDAQPGSV

SEQ ID NO: 501498 - protein, 4 aa, Mycobacterium
HDAR

SEQ ID NO: 501499 - protein, 14 aa, Mycobacterium
HDARDSTSVKADVP

SEQ ID NO: 501500 - protein, 11 aa, Mycobacterium
HDARGKSATVK

SEQ ID NO: 501501 - protein, 7 aa, Mycobacterium
HDASAAP

SEQ ID NO: 501502 - protein, 7 aa, Mycobacterium
HDASDYR

SEQ ID NO: 501503 - protein, 9 aa, Mycobacterium
HDASEPSLA

SEQ ID NO: 501504 - protein, 22 aa, Mycobacterium
HDASTAGGASNDVAETVNVAAA

SEQ ID NO: 501505 - protein, 6 aa, Mycobacterium
HDASTD

SEQ ID NO: 501506 - protein, 6 aa, Mycobacterium
HDATGA

SEQ ID NO: 501507 - protein, 9 aa, Mycobacterium
HDATGPSVE

SEQ ID NO: 501508 - protein, 7 aa, Mycobacterium
HDATPSQ

SEQ ID NO: 501509 - protein, 11 aa, Mycobacterium
HDATPTSDRRE

SEQ ID NO: 501510 - protein, 6 aa, Mycobacterium
HDATTS

SEQ ID NO: 501511 - protein, 13 aa, Mycobacterium
HDATYAGGGSPTR

SEQ ID NO: 501512 - protein, 6 aa, Mycobacterium
HDAYDD

SEQ ID NO: 501513 - protein, 10 aa, Mycobacterium
HDCGPGKEGA

SEQ ID NO: 501514 - protein, 6 aa, Mycobacterium
HDDAEL

SEQ ID NO: 501515 - protein, 11 aa, Mycobacterium
HDDAESPVRPV

SEQ ID NO: 501516 - protein, 6 aa, Mycobacterium
HDDAPR

SEQ ID NO: 501517 - protein, 6 aa, Mycobacterium
HDDARE

SEQ ID NO: 501518 - protein, 10 aa, Mycobacterium
HDDATDGPVT

SEQ ID NO: 501519 - protein, 8 aa, Mycobacterium
HDDATHTA

SEQ ID NO: 501520 - protein, 11 aa, Mycobacterium
HDDDAAKAQRL

SEQ ID NO: 501521 - protein, 11 aa, Mycobacterium
HDDDAEKAAQL

SEQ ID NO: 501522 - protein, 9 aa, Mycobacterium
HDDDRDLPV

SEQ ID NO: 501523 - protein, 8 aa, Mycobacterium
HDDDRQLP

SEQ ID NO: 501524 - protein, 4 aa, Mycobacterium
HDDE

SEQ ID NO: 501525 - protein, 8 aa, Mycobacterium
HDDEQFPD

SEQ ID NO: 501526 - protein, 6 aa, Mycobacterium
HDDGAD

SEQ ID NO: 501527 - protein, 9 aa, Mycobacterium
HDDGAGELG

SEQ ID NO: 501528 - protein, 6 aa, Mycobacterium
HDDGDA

SEQ ID NO: 501529 - protein, 6 aa, Mycobacterium
HDDGET

SEQ ID NO: 501530 - protein, 8 aa, Mycobacterium
HDDGLDTT

SEQ ID NO: 501531 - protein, 9 aa, Mycobacterium
HDDGRPRRA

SEQ ID NO: 501532 - protein, 9 aa, Mycobacterium
HDDGSERLL

SEQ ID NO: 501533 - protein, 5 aa, Mycobacterium
HDDGV

SEQ ID NO: 501534 - protein, 9 aa, Mycobacterium
HDDHGGRNH

SEQ ID NO: 501535 - protein, 10 aa, Mycobacterium
HDDKAARTAM

SEQ ID NO: 501536 - protein, 6 aa, Mycobacterium
HDDKQV

SEQ ID NO: 501537 - protein, 5 aa, Mycobacterium
HDDPA

SEQ ID NO: 501538 - protein, 6 aa, Mycobacterium
HDDPAA

SEQ ID NO: 501539 - protein, 7 aa, Mycobacterium
HDDPAGP

SEQ ID NO: 501540 - protein, 8 aa, Mycobacterium
HDDPAGPV

SEQ ID NO: 501541 - protein, 8 aa, Mycobacterium
HDDPATPV

SEQ ID NO: 501542 - protein, 16 aa, Mycobacterium
HDDPDELRAPQGAYSH

SEQ ID NO: 501543 - protein, 6 aa, Mycobacterium
HDDPDQ

SEQ ID NO: 501544 - protein, 7 aa, Mycobacterium
HDDPEAS

SEQ ID NO: 501545 - protein, 7 aa, Mycobacterium
HDDPESS

SEQ ID NO: 501546 - protein, 5 aa, Mycobacterium
HDDPM

SEQ ID NO: 501547 - protein, 6 aa, Mycobacterium
HDDPMP

SEQ ID NO: 501548 - protein, 9 aa, Mycobacterium
HDDPPPMKE

SEQ ID NO: 501549 - protein, 7 aa, Mycobacterium
HDDPTGL

SEQ ID NO: 501550 - protein, 8 aa, Mycobacterium
HDDPTSPV

SEQ ID NO: 501551 - protein, 7 aa, Mycobacterium
HDDPVQE

SEQ ID NO: 501552 - protein, 14 aa, Mycobacterium
HDDPVSAAPAATDA

SEQ ID NO: 501553 - protein, 4 aa, Mycobacterium
HDDQ

SEQ ID NO: 501554 - protein, 11 aa, Mycobacterium
HDDQPQYRTRK

SEQ ID NO: 501555 - protein, 11 aa, Mycobacterium
HDDRAHPYATP

SEQ ID NO: 501556 - protein, 5 aa, Mycobacterium
HDDRH

SEQ ID NO: 501557 - protein, 10 aa, Mycobacterium
HDDSAPSPAP

SEQ ID NO: 501558 - protein, 5 aa, Mycobacterium
HDDSG

SEQ ID NO: 501559 - protein, 9 aa, Mycobacterium
HDDSGAVVG

SEQ ID NO: 501560 - protein, 11 aa, Mycobacterium
HDDSKGGRTRE

SEQ ID NO: 501561 - protein, 8 aa, Mycobacterium
HDDSSSIT

SEQ ID NO: 501562 - protein, 9 aa, Mycobacterium
HDDSTSQAT

SEQ ID NO: 501563 - protein, 7 aa, Mycobacterium
HDDTASI

SEQ ID NO: 501564 - protein, 13 aa, Mycobacterium
HDDTDTPPKDQLR

SEQ ID NO: 501565 - protein, 8 aa, Mycobacterium
HDDTTSGL

SEQ ID NO: 501566 - protein, 4 aa, Mycobacterium
HDDY

SEQ ID NO: 501567 - protein, 5 aa, Mycobacterium
HDDYR

SEQ ID NO: 501568 - protein, 7 aa, Mycobacterium
HDEADER

SEQ ID NO: 501569 - protein, 10 aa, Mycobacterium
HDEAGAAELG

SEQ ID NO: 501570 - protein, 5 aa, Mycobacterium
HDEAT

SEQ ID NO: 501571 - protein, 6 aa, Mycobacterium
HDEATQ

SEQ ID NO: 501572 - protein, 10 aa, Mycobacterium
HDEDFNRGDS

SEQ ID NO: 501573 - protein, 7 aa, Mycobacterium
HDEGDVV

SEQ ID NO: 501574 - protein, 4 aa, Mycobacterium
HDEH

SEQ ID NO: 501575 - protein, 11 aa, Mycobacterium
HDEHDHPREQR

SEQ ID NO: 501576 - protein, 21 aa, Mycobacterium
HDEHGSNPQTVPSATYGKGKR

SEQ ID NO: 501577 - protein, 10 aa, Mycobacterium
HDEHSAAGIG

SEQ ID NO: 501578 - protein, 10 aa, Mycobacterium
HDEKEFPQPD

SEQ ID NO: 501579 - protein, 4 aa, Mycobacterium
HDEP

SEQ ID NO: 501580 - protein, 6 aa, Mycobacterium
HDEPDR

SEQ ID NO: 501581 - protein, 5 aa, Mycobacterium
HDEPQ

SEQ ID NO: 501582 - protein, 10 aa, Mycobacterium
HDEPRQSLQT

SEQ ID NO: 501583 - protein, 7 aa, Mycobacterium
HDEPVDA

SEQ ID NO: 501584 - protein, 6 aa, Mycobacterium
HDEREA

SEQ ID NO: 501585 - protein, 9 aa, Mycobacterium
HDEREFDQP

SEQ ID NO: 501586 - protein, 5 aa, Mycobacterium
HDERN

SEQ ID NO: 501587 - protein, 8 aa, Mycobacterium
HDERYDRA

SEQ ID NO: 501588 - protein, 6 aa, Mycobacterium
HDETAA

SEQ ID NO: 501589 - protein, 9 aa, Mycobacterium
HDETEFDRP

SEQ ID NO: 501590 - protein, 13 aa, Mycobacterium
HDETGAYPPAVQA

SEQ ID NO: 501591 - protein, 6 aa, Mycobacterium
HDETRS

SEQ ID NO: 501592 - protein, 9 aa, Mycobacterium
HDETRVTPN

SEQ ID NO: 501593 - protein, 4 aa, Mycobacterium
HDEV

SEQ ID NO: 501594 - protein, 7 aa, Mycobacterium
HDFGTGA

SEQ ID NO: 501595 - protein, 12 aa, Mycobacterium
HDGAASSAGAMS

SEQ ID NO: 501596 - protein, 8 aa, Mycobacterium
HDGADTGT

SEQ ID NO: 501597 - protein, 5 aa, Mycobacterium
HDGAN

SEQ ID NO: 501598 - protein, 32 aa, Mycobacterium
HDGAPGAGGVGGDGGAGGNGGRGGDGANGVNA

SEQ ID NO: 501599 - protein, 9 aa, Mycobacterium
HDGAPIAGV

SEQ ID NO: 501600 - protein, 8 aa, Mycobacterium
HDGAPPPE

SEQ ID NO: 501601 - protein, 5 aa, Mycobacterium
HDGAQ

SEQ ID NO: 501602 - protein, 6 aa, Mycobacterium
HDGAQQ

SEQ ID NO: 501603 - protein, 10 aa, Mycobacterium
HDGASAAEIP

SEQ ID NO: 501604 - protein, 10 aa, Mycobacterium
HDGASKMPEP

SEQ ID NO: 501605 - protein, 10 aa, Mycobacterium
HDGASPAIGE

SEQ ID NO: 501606 - protein, 15 aa, Mycobacterium
HDGAVDAHTEARRQA

SEQ ID NO: 501607 - protein, 32 aa, Mycobacterium
HDGDAGAGGLGGKGGTGGTGGKGGTGGGGADA

SEQ ID NO: 501608 - protein, 7 aa, Mycobacterium
HDGDAGV

SEQ ID NO: 501609 - protein, 17 aa, Mycobacterium
HDGDDDALRQANDTDYG

SEQ ID NO: 501610 - protein, 5 aa, Mycobacterium
HDGDE

SEQ ID NO: 501611 - protein, 7 aa, Mycobacterium
HDGDPEL

SEQ ID NO: 501612 - protein, 5 aa, Mycobacterium
HDGDR

SEQ ID NO: 501613 - protein, 6 aa, Mycobacterium
HDGDRM

SEQ ID NO: 501614 - protein, 7 aa, Mycobacterium
HDGDSAK

SEQ ID NO: 501615 - protein, 6 aa, Mycobacterium
HDGDSV

SEQ ID NO: 501616 - protein, 6 aa, Mycobacterium
HDGDTA

SEQ ID NO: 501617 - protein, 11 aa, Mycobacterium
HDGDTGAEKHD

SEQ ID NO: 501618 - protein, 8 aa, Mycobacterium
HDGEGSKH

SEQ ID NO: 501619 - protein, 13 aa, Mycobacterium
HDGEPGAPATASL

SEQ ID NO: 501620 - protein, 7 aa, Mycobacterium
HDGEQKQ

SEQ ID NO: 501621 - protein, 6 aa, Mycobacterium
HDGESD

SEQ ID NO: 501622 - protein, 7 aa, Mycobacterium
HDGESDV

SEQ ID NO: 501623 - protein, 17 aa, Mycobacterium
HDGGGHPINDSDEVQRV

SEQ ID NO: 501624 - protein, 5 aa, Mycobacterium
HDGGR

SEQ ID NO: 501625 - protein, 9 aa, Mycobacterium
HDGGRMAAT

SEQ ID NO: 501626 - protein, 6 aa, Mycobacterium
HDGGRR

SEQ ID NO: 501627 - protein, 11 aa, Mycobacterium
HDGGTGAAPLT

SEQ ID NO: 501628 - protein, 12 aa, Mycobacterium
HDGGTGASPLTS

SEQ ID NO: 501629 - protein, 11 aa, Mycobacterium
HDGGTGATPMT

SEQ ID NO: 501630 - protein, 8 aa, Mycobacterium
HDGGTRAT

SEQ ID NO: 501631 - protein, 4 aa, Mycobacterium
HDGH

SEQ ID NO: 501632 - protein, 8 aa, Mycobacterium
HDGIDRSY

SEQ ID NO: 501633 - protein, 8 aa, Mycobacterium
HDGKPPVG

SEQ ID NO: 501634 - protein, 22 aa, Mycobacterium
HDGKRRRVERSSEKSAEDARRT

SEQ ID NO: 501635 - protein, 6 aa, Mycobacterium
HDGKTI

SEQ ID NO: 501636 - protein, 4 aa, Mycobacterium
HDGL

SEQ ID NO: 501637 - protein, 7 aa, Mycobacterium
HDGNGDG

SEQ ID NO: 501638 - protein, 16 aa, Mycobacterium
HDGNGHPVSAEATATG

SEQ ID NO: 501639 - protein, 8 aa, Mycobacterium
HDGPAAGL

SEQ ID NO: 501640 - protein, 9 aa, Mycobacterium
HDGPAPMSA

SEQ ID NO: 501641 - protein, 7 aa, Mycobacterium
HDGPDAR

SEQ ID NO: 501642 - protein, 7 aa, Mycobacterium
HDGPEFG

SEQ ID NO: 501643 - protein, 19 aa, Mycobacterium
HDGPENPRATHSSTGSRLQ

SEQ ID NO: 501644 - protein, 8 aa, Mycobacterium
HDGPESVR

SEQ ID NO: 501645 - protein, 6 aa, Mycobacterium
HDGPTT

SEQ ID NO: 501646 - protein, 9 aa, Mycobacterium
HDGQITKQG

SEQ ID NO: 501647 - protein, 16 aa, Mycobacterium
HDGQTQTATKQVRGGF

SEQ ID NO: 501648 - protein, 7 aa, Mycobacterium
HDGRPQL

SEQ ID NO: 501649 - protein, 10 aa, Mycobacterium
HDGRTARVTA

SEQ ID NO: 501650 - protein, 5 aa, Mycobacterium
HDGSA

SEQ ID NO: 501651 - protein, 7 aa, Mycobacterium
HDGSAEV

SEQ ID NO: 501652 - protein, 8 aa, Mycobacterium
HDGSALRD

SEQ ID NO: 501653 - protein, 21 aa, Mycobacterium
HDGSAPATGNAEISVSGPTRL

SEQ ID NO: 501654 - protein, 10 aa, Mycobacterium
HDGSARATGV

SEQ ID NO: 501655 - protein, 13 aa, Mycobacterium
HDGSATPSGTAGI

SEQ ID NO: 501656 - protein, 6 aa, Mycobacterium
HDGSAV

SEQ ID NO: 501657 - protein, 5 aa, Mycobacterium
HDGSE

SEQ ID NO: 501658 - protein, 14 aa, Mycobacterium
HDGSRDAISNARPV

SEQ ID NO: 501659 - protein, 4 aa, Mycobacterium
HDGT

SEQ ID NO: 501660 - protein, 5 aa, Mycobacterium
HDGTA

SEQ ID NO: 501661 - protein, 7 aa, Mycobacterium
HDGTERP

SEQ ID NO: 501662 - protein, 8 aa, Mycobacterium
HDGTPGRI

SEQ ID NO: 501663 - protein, 4 aa, Mycobacterium
HDGV

SEQ ID NO: 501664 - protein, 7 aa, Mycobacterium
HDGVPPS

SEQ ID NO: 501665 - protein, 11 aa, Mycobacterium
HDGVSDATGDI

SEQ ID NO: 501666 - protein, 12 aa, Mycobacterium
HDGVTGTLTPGA

SEQ ID NO: 501667 - protein, 6 aa, Mycobacterium
HDGYQG

SEQ ID NO: 501668 - protein, 12 aa, Mycobacterium
HDHDESEKRQEA

SEQ ID NO: 501669 - protein, 17 aa, Mycobacterium
HDHDHPHTHDHPPTETV

SEQ ID NO: 501670 - protein, 44 aa, Mycobacterium
HDHEEKPAGNGGGSRSWSKSRDFANDPQRAATVAEASRADRERY

SEQ ID NO: 501671 - protein, 8 aa, Mycobacterium
HDHEHGDV

SEQ ID NO: 501672 - protein, 15 aa, Mycobacterium
HDHGAPPYRPDRPRT

SEQ ID NO: 501673 - protein, 15 aa, Mycobacterium
HDHGAPSYAAGRPRT

SEQ ID NO: 501674 - protein, 15 aa, Mycobacterium
HDHGAPSYRPDRPRT

SEQ ID NO: 501675 - protein, 15 aa, Mycobacterium
HDHGAPSYRTGRPRT

SEQ ID NO: 501676 - protein, 11 aa, Mycobacterium
HDHGGLGAGGH

SEQ ID NO: 501677 - protein, 6 aa, Mycobacterium
HDHGQL

SEQ ID NO: 501678 - protein, 22 aa, Mycobacterium
HDIGSKQARAEFGPGPGQHPTV

SEQ ID NO: 501679 - protein, 11 aa, Mycobacterium
HDIHGERRGYK

SEQ ID NO: 501680 - protein, 17 aa, Mycobacterium
HDIPPESQLAADRESDV

SEQ ID NO: 501681 - protein, 5 aa, Mycobacterium
HDKDS

SEQ ID NO: 501682 - protein, 11 aa, Mycobacterium
HDKESTNKRIA

SEQ ID NO: 501683 - protein, 8 aa, Mycobacterium
HDKPGTRM

SEQ ID NO: 501684 - protein, 6 aa, Mycobacterium
HDKRAD

SEQ ID NO: 501685 - protein, 8 aa, Mycobacterium
HDKRESAE

SEQ ID NO: 501686 - protein, 8 aa, Mycobacterium
HDKRKSAE

SEQ ID NO: 501687 - protein, 4 aa, Mycobacterium
HDLA

SEQ ID NO: 501688 - protein, 10 aa, Mycobacterium
HDLASKTHNV

SEQ ID NO: 501689 - protein, 6 aa, Mycobacterium
HDLEPA

SEQ ID NO: 501690 - protein, 8 aa, Mycobacterium
HDLEPAGT

SEQ ID NO: 501691 - protein, 11 aa, Mycobacterium
HDLGDGAYSAT

SEQ ID NO: 501692 - protein, 6 aa, Mycobacterium
HDLGSA

SEQ ID NO: 501693 - protein, 22 aa, Mycobacterium
HDLGSADDVRERAPGPDQHPTY

SEQ ID NO: 501694 - protein, 7 aa, Mycobacterium
HDLPPGR

SEQ ID NO: 501695 - protein, 6 aa, Mycobacterium
HDLSER

SEQ ID NO: 501696 - protein, 5 aa, Mycobacterium
HDLTT

SEQ ID NO: 501697 - protein, 4 aa, Mycobacterium
HDNA

SEQ ID NO: 501698 - protein, 20 aa, Mycobacterium
HDNAAASATSGTEVTSGLSE

SEQ ID NO: 501699 - protein, 6 aa, Mycobacterium
HDNEYP

SEQ ID NO: 501700 - protein, 4 aa, Mycobacterium
HDNG

SEQ ID NO: 501701 - protein, 4 aa, Mycobacterium
HDNK

SEQ ID NO: 501702 - protein, 11 aa, Mycobacterium
HDNKSTSFAGG

SEQ ID NO: 501703 - protein, 5 aa, Mycobacterium
HDNPE

SEQ ID NO: 501704 - protein, 6 aa, Mycobacterium
HDNPET

SEQ ID NO: 501705 - protein, 8 aa, Mycobacterium
HDNRVDAG

SEQ ID NO: 501706 - protein, 5 aa, Mycobacterium
HDNTA

SEQ ID NO: 501707 - protein, 42 aa, Mycobacterium
HDNTEHPLPDQPPLHPEEEEQLPPDPLGEQRIDTGAALAGRD

SEQ ID NO: 501708 - protein, 5 aa, Mycobacterium
HDNTQ

SEQ ID NO: 501709 - protein, 11 aa, Mycobacterium
HDNTSTSFAGG

SEQ ID NO: 501710 - protein, 15 aa, Mycobacterium
HDNVASESTPPLPTT

SEQ ID NO: 501711 - protein, 5 aa, Mycobacterium
HDNVP

SEQ ID NO: 501712 - protein, 7 aa, Mycobacterium
HDNVPEK

SEQ ID NO: 501713 - protein, 5 aa, Mycobacterium
HDPAA

SEQ ID NO: 501714 - protein, 6 aa, Mycobacterium
HDPAAR

SEQ ID NO: 501715 - protein, 10 aa, Mycobacterium
HDPAASEFGG

SEQ ID NO: 501716 - protein, 15 aa, Mycobacterium
HDPADPYSSSAPVPD

SEQ ID NO: 501717 - protein, 5 aa, Mycobacterium
HDPAE

SEQ ID NO: 501718 - protein, 7 aa, Mycobacterium
HDPAPEA

SEQ ID NO: 501719 - protein, 6 aa, Mycobacterium
HDPAPL

SEQ ID NO: 501720 - protein, 5 aa, Mycobacterium
HDPAR

SEQ ID NO: 501721 - protein, 12 aa, Mycobacterium
HDPARADDEEYI

SEQ ID NO: 501722 - protein, 11 aa, Mycobacterium
HDPARAEDEAY

SEQ ID NO: 501723 - protein, 14 aa, Mycobacterium
HDPASSVARRVADE

SEQ ID NO: 501724 - protein, 11 aa, Mycobacterium
HDPASTLSKAH

SEQ ID NO: 501725 - protein, 8 aa, Mycobacterium
HDPATSAV

SEQ ID NO: 501726 - protein, 10 aa, Mycobacterium
HDPATTEPRD

SEQ ID NO: 501727 - protein, 5 aa, Mycobacterium
HDPAV

SEQ ID NO: 501728 - protein, 13 aa, Mycobacterium
HDPDAADLGGLAS

SEQ ID NO: 501729 - protein, 10 aa, Mycobacterium
HDPDAPTYQS

SEQ ID NO: 501730 - protein, 15 aa, Mycobacterium
HDPDAVRQSRAGDLD

SEQ ID NO: 501731 - protein, 15 aa, Mycobacterium
HDPDAVRQSRQHDVG

SEQ ID NO: 501732 - protein, 14 aa, Mycobacterium
HDPDAVRQTRQHDV

SEQ ID NO: 501733 - protein, 6 aa, Mycobacterium
HDPDDG

SEQ ID NO: 501734 - protein, 6 aa, Mycobacterium
HDPDDK

SEQ ID NO: 501735 - protein, 6 aa, Mycobacterium
HDPDFR

SEQ ID NO: 501736 - protein, 8 aa, Mycobacterium
HDPDGQAV

SEQ ID NO: 501737 - protein, 6 aa, Mycobacterium
HDPDHP

SEQ ID NO: 501738 - protein, 5 aa, Mycobacterium
HDPDK

SEQ ID NO: 501739 - protein, 6 aa, Mycobacterium
HDPDKL

SEQ ID NO: 501740 - protein, 7 aa, Mycobacterium
HDPDKLP

SEQ ID NO: 501741 - protein, 9 aa, Mycobacterium
HDPDPVESP

SEQ ID NO: 501742 - protein, 5 aa, Mycobacterium
HDPDS

SEQ ID NO: 501743 - protein, 5 aa, Mycobacterium
HDPDT

SEQ ID NO: 501744 - protein, 4 aa, Mycobacterium
HDPE

SEQ ID NO: 501745 - protein, 10 aa, Mycobacterium
HDPEALPPLT

SEQ ID NO: 501746 - protein, 7 aa, Mycobacterium
HDPEATV

SEQ ID NO: 501747 - protein, 6 aa, Mycobacterium
HDPEDV

SEQ ID NO: 501748 - protein, 7 aa, Mycobacterium
HDPEEAA

SEQ ID NO: 501749 - protein, 7 aa, Mycobacterium
HDPEESV

SEQ ID NO: 501750 - protein, 5 aa, Mycobacterium
HDPEL

SEQ ID NO: 501751 - protein, 20 aa, Mycobacterium
HDPETGGSLATNDDDGVVDP

SEQ ID NO: 501752 - protein, 7 aa, Mycobacterium
HDPETRA

SEQ ID NO: 501753 - protein, 5 aa, Mycobacterium
HDPEV

SEQ ID NO: 501754 - protein, 6 aa, Mycobacterium
HDPFES

SEQ ID NO: 501755 - protein, 6 aa, Mycobacterium
HDPGPL

SEQ ID NO: 501756 - protein, 6 aa, Mycobacterium
HDPGTG

SEQ ID NO: 501757 - protein, 6 aa, Mycobacterium
HDPGWN

SEQ ID NO: 501758 - protein, 9 aa, Mycobacterium
HDPISERDS

SEQ ID NO: 501759 - protein, 10 aa, Mycobacterium
HDPKSGMAKG

SEQ ID NO: 501760 - protein, 11 aa, Mycobacterium
HDPKSKMPKGL

SEQ ID NO: 501761 - protein, 10 aa, Mycobacterium
HDPKSTMAKG

SEQ ID NO: 501762 - protein, 13 aa, Mycobacterium
HDPKTGAYRLGPS

SEQ ID NO: 501763 - protein, 6 aa, Mycobacterium
HDPKTV

SEQ ID NO: 501764 - protein, 6 aa, Mycobacterium
HDPLQP

SEQ ID NO: 501765 - protein, 10 aa, Mycobacterium
HDPLRDDGAR

SEQ ID NO: 501766 - protein, 8 aa, Mycobacterium
HDPLRDEG

SEQ ID NO: 501767 - protein, 7 aa, Mycobacterium
HDPLTSL

SEQ ID NO: 501768 - protein, 4 aa, Mycobacterium
HDPN

SEQ ID NO: 501769 - protein, 4 aa, Mycobacterium
HDPP

SEQ ID NO: 501770 - protein, 8 aa, Mycobacterium
HDPPASWK

SEQ ID NO: 501771 - protein, 10 aa, Mycobacterium
HDPPDADRLP

SEQ ID NO: 501772 - protein, 4 aa, Mycobacterium
HDPQ

SEQ ID NO: 501773 - protein, 6 aa, Mycobacterium
HDPQQA

SEQ ID NO: 501774 - protein, 8 aa, Mycobacterium
HDPQTGAY

SEQ ID NO: 501775 - protein, 4 aa, Mycobacterium
HDPR

SEQ ID NO: 501776 - protein, 13 aa, Mycobacterium
HDPRDSTSVDAEV

SEQ ID NO: 501777 - protein, 8 aa, Mycobacterium
HDPRRVRG

SEQ ID NO: 501778 - protein, 6 aa, Mycobacterium
HDPRSE

SEQ ID NO: 501779 - protein, 13 aa, Mycobacterium
HDPRTGEYRLGPS

SEQ ID NO: 501780 - protein, 33 aa, Mycobacterium
HDPRTPGGRGLGVGTRSRSTRCPKPIRVPGSTR

SEQ ID NO: 501781 - protein, 8 aa, Mycobacterium
HDPSDTTW

SEQ ID NO: 501782 - protein, 36 aa, Mycobacterium
HDPSPPPGDRGDATLSATAADDTAARAPGTAGTDAM

SEQ ID NO: 501783 - protein, 5 aa, Mycobacterium
HDPST

SEQ ID NO: 501784 - protein, 4 aa, Mycobacterium
HDPT

SEQ ID NO: 501785 - protein, 6 aa, Mycobacterium
HDPTAA

SEQ ID NO: 501786 - protein, 12 aa, Mycobacterium
HDPTADVSEGRR

SEQ ID NO: 501787 - protein, 11 aa, Mycobacterium
HDPTADVTEGR

SEQ ID NO: 501788 - protein, 7 aa, Mycobacterium
HDPTGEI

SEQ ID NO: 501789 - protein, 17 aa, Mycobacterium
HDPTQGMRQGNDRGTQY

SEQ ID NO: 501790 - protein, 14 aa, Mycobacterium
HDPTSRGAEFRART

SEQ ID NO: 501791 - protein, 14 aa, Mycobacterium
HDPTSRGAEFRPRR

SEQ ID NO: 501792 - protein, 9 aa, Mycobacterium
HDPTTTDPR

SEQ ID NO: 501793 - protein, 4 aa, Mycobacterium
HDPV

SEQ ID NO: 501794 - protein, 14 aa, Mycobacterium
HDPVDELEQPVFAW

SEQ ID NO: 501795 - protein, 6 aa, Mycobacterium
HDPYPV

SEQ ID NO: 501796 - protein, 5 aa, Mycobacterium
HDQAE

SEQ ID NO: 501797 - protein, 8 aa, Mycobacterium
HDQANGTD

SEQ ID NO: 501798 - protein, 9 aa, Mycobacterium
HDQAPPSGR

SEQ ID NO: 501799 - protein, 6 aa, Mycobacterium
HDQEKP

SEQ ID NO: 501800 - protein, 6 aa, Mycobacterium
HDQGGT

SEQ ID NO: 501801 - protein, 7 aa, Mycobacterium
HDQPGVT

SEQ ID NO: 501802 - protein, 9 aa, Mycobacterium
HDQPTIPVN

SEQ ID NO: 501803 - protein, 9 aa, Mycobacterium
HDQQASPRF

SEQ ID NO: 501804 - protein, 6 aa, Mycobacterium
HDQSDH

SEQ ID NO: 501805 - protein, 7 aa, Mycobacterium
HDQTEGM

SEQ ID NO: 501806 - protein, 7 aa, Mycobacterium
HDQTPGY

SEQ ID NO: 501807 - protein, 6 aa, Mycobacterium
HDQTPH

SEQ ID NO: 501808 - protein, 15 aa, Mycobacterium
HDQVGTFQECAVLGA

SEQ ID NO: 501809 - protein, 6 aa, Mycobacterium
HDRAAA

SEQ ID NO: 501810 - protein, 7 aa, Mycobacterium
HDRADIP

SEQ ID NO: 501811 - protein, 5 aa, Mycobacterium
HDRAI

SEQ ID NO: 501812 - protein, 9 aa, Mycobacterium
HDRANATEY

SEQ ID NO: 501813 - protein, 4 aa, Mycobacterium
HDRD

SEQ ID NO: 501814 - protein, 9 aa, Mycobacterium
HDRDEQGRI

SEQ ID NO: 501815 - protein, 6 aa, Mycobacterium
HDRDGR

SEQ ID NO: 501816 - protein, 25 aa, Mycobacterium
HDRDGTGQKLAARAPGVNANQLNDG

SEQ ID NO: 501817 - protein, 13 aa, Mycobacterium
HDRDKAQAKGSKD

SEQ ID NO: 501818 - protein, 9 aa, Mycobacterium
HDRDPEYQR

SEQ ID NO: 501819 - protein, 7 aa, Mycobacterium
HDRDRMP

SEQ ID NO: 501820 - protein, 8 aa, Mycobacterium
HDRDTERK

SEQ ID NO: 501821 - protein, 9 aa, Mycobacterium
HDRETGDNF

SEQ ID NO: 501822 - protein, 21 aa, Mycobacterium
HDRETPRPRADHSRGKRIRQP

SEQ ID NO: 501823 - protein, 4 aa, Mycobacterium
HDRG

SEQ ID NO: 501824 - protein, 7 aa, Mycobacterium
HDRGNRL

SEQ ID NO: 501825 - protein, 5 aa, Mycobacterium
HDRGT

SEQ ID NO: 501826 - protein, 4 aa, Mycobacterium
HDRH

SEQ ID NO: 501827 - protein, 5 aa, Mycobacterium
HDRKD

SEQ ID NO: 501828 - protein, 6 aa, Mycobacterium
HDRPAT

SEQ ID NO: 501829 - protein, 16 aa, Mycobacterium
HDRPKVTTSGATPTEI

SEQ ID NO: 501830 - protein, 5 aa, Mycobacterium
HDRPQ

SEQ ID NO: 501831 - protein, 9 aa, Mycobacterium
HDRQHERDR

SEQ ID NO: 501832 - protein, 4 aa, Mycobacterium
HDRR

SEQ ID NO: 501833 - protein, 12 aa, Mycobacterium
HDRRDRDQGRKI

SEQ ID NO: 501834 - protein, 6 aa, Mycobacterium
HDRREA

SEQ ID NO: 501835 - protein, 11 aa, Mycobacterium
HDRSGDHRPGR

SEQ ID NO: 501836 - protein, 8 aa, Mycobacterium
HDRSRAKD

SEQ ID NO: 501837 - protein, 47 aa, Mycobacterium
HDRTKEHGAYATPHGRPRKPRQDAPDGSGVKATPLRGRPDGRALTPA

SEQ ID NO: 501838 - protein, 10 aa, Mycobacterium
HDRTTSLQQA

SEQ ID NO: 501839 - protein, 7 aa, Mycobacterium
HDRVDPG

SEQ ID NO: 501840 - protein, 4 aa, Mycobacterium
HDSA

SEQ ID NO: 501841 - protein, 5 aa, Mycobacterium
HDSAA

SEQ ID NO: 501842 - protein, 10 aa, Mycobacterium
HDSAAGVATG

SEQ ID NO: 501843 - protein, 8 aa, Mycobacterium
HDSAARRT

SEQ ID NO: 501844 - protein, 13 aa, Mycobacterium
HDSAVKTYGEGQH

SEQ ID NO: 501845 - protein, 6 aa, Mycobacterium
HDSDAS

SEQ ID NO: 501846 - protein, 8 aa, Mycobacterium
HDSDGDLD

SEQ ID NO: 501847 - protein, 14 aa, Mycobacterium
HDSDGTTIHLYARI

SEQ ID NO: 501848 - protein, 16 aa, Mycobacterium
HDSDKINAGLAADAGY

SEQ ID NO: 501849 - protein, 6 aa, Mycobacterium
HDSEGT

SEQ ID NO: 501850 - protein, 8 aa, Mycobacterium
HDSGLAGQ

SEQ ID NO: 501851 - protein, 9 aa, Mycobacterium
HDSGLTGQI

SEQ ID NO: 501852 - protein, 7 aa, Mycobacterium
HDSGTGL

SEQ ID NO: 501853 - protein, 10 aa, Mycobacterium
HDSKAQSFSG

SEQ ID NO: 501854 - protein, 18 aa, Mycobacterium
HDSLPEPIDDSPESDGRD

SEQ ID NO: 501855 - protein, 14 aa, Mycobacterium
HDSPASGLKSALAV

SEQ ID NO: 501856 - protein, 7 aa, Mycobacterium
HDSPPGI

SEQ ID NO: 501857 - protein, 6 aa, Mycobacterium
HDSPRR

SEQ ID NO: 501858 - protein, 13 aa, Mycobacterium
HDSPTDGGEKHDR

SEQ ID NO: 501859 - protein, 8 aa, Mycobacterium
HDSPVAGR

SEQ ID NO: 501860 - protein, 10 aa, Mycobacterium
HDSQAQSFSG

SEQ ID NO: 501861 - protein, 7 aa, Mycobacterium
HDSQSGT

SEQ ID NO: 501862 - protein, 9 aa, Mycobacterium
HDSRRSFAT

SEQ ID NO: 501863 - protein, 7 aa, Mycobacterium
HDSRSGA

SEQ ID NO: 501864 - protein, 5 aa, Mycobacterium
HDSRV

SEQ ID NO: 501865 - protein, 6 aa, Mycobacterium
HDSRVA

SEQ ID NO: 501866 - protein, 6 aa, Mycobacterium
HDSRVG

SEQ ID NO: 501867 - protein, 7 aa, Mycobacterium
HDSRVGG

SEQ ID NO: 501868 - protein, 7 aa, Mycobacterium
HDSSHEL

SEQ ID NO: 501869 - protein, 12 aa, Mycobacterium
HDSWADEPNRAL

SEQ ID NO: 501870 - protein, 4 aa, Mycobacterium
HDTA

SEQ ID NO: 501871 - protein, 10 aa, Mycobacterium
HDTAEKPQEA

SEQ ID NO: 501872 - protein, 8 aa, Mycobacterium
HDTAGGQL

SEQ ID NO: 501873 - protein, 11 aa, Mycobacterium
HDTAHDTGSVA

SEQ ID NO: 501874 - protein, 7 aa, Mycobacterium
HDTANET

SEQ ID NO: 501875 - protein, 7 aa, Mycobacterium
HDTAPQS

SEQ ID NO: 501876 - protein, 7 aa, Mycobacterium
HDTATDR

SEQ ID NO: 501877 - protein, 4 aa, Mycobacterium
HDTD

SEQ ID NO: 501878 - protein, 8 aa, Mycobacterium
HDTDGELD

SEQ ID NO: 501879 - protein, 6 aa, Mycobacterium
HDTDGR

SEQ ID NO: 501880 - protein, 9 aa, Mycobacterium
HDTEGGTTC

SEQ ID NO: 501881 - protein, 8 aa, Mycobacterium
HDTGAAVS

SEQ ID NO: 501882 - protein, 29 aa, Mycobacterium
HDTGLKPARVTGRNVPSESKAPYDPERAN

SEQ ID NO: 501883 - protein, 8 aa, Mycobacterium
HDTHDAAD

SEQ ID NO: 501884 - protein, 8 aa, Mycobacterium
HDTLDNDA

SEQ ID NO: 501885 - protein, 7 aa, Mycobacterium
HDTLTTR

SEQ ID NO: 501886 - protein, 6 aa, Mycobacterium
HDTPGA

SEQ ID NO: 501887 - protein, 16 aa, Mycobacterium
HDTPGAMAYPSGTEYD

SEQ ID NO: 501888 - protein, 9 aa, Mycobacterium
HDTPGGQLA

SEQ ID NO: 501889 - protein, 9 aa, Mycobacterium
HDTPLGPAR

SEQ ID NO: 501890 - protein, 5 aa, Mycobacterium
HDTPY

SEQ ID NO: 501891 - protein, 12 aa, Mycobacterium
HDTRDSTSVDAA

SEQ ID NO: 501892 - protein, 6 aa, Mycobacterium
HDTRNR

SEQ ID NO: 501893 - protein, 6 aa, Mycobacterium
HDTRPW

SEQ ID NO: 501894 - protein, 5 aa, Mycobacterium
HDTRT

SEQ ID NO: 501895 - protein, 5 aa, Mycobacterium
HDTRY

SEQ ID NO: 501896 - protein, 4 aa, Mycobacterium
HDTS

SEQ ID NO: 501897 - protein, 12 aa, Mycobacterium
HDTSPDGRDVEQ

SEQ ID NO: 501898 - protein, 15 aa, Mycobacterium
HDTSTLANDPNEQEL

SEQ ID NO: 501899 - protein, 7 aa, Mycobacterium
HDTTANG

SEQ ID NO: 501900 - protein, 6 aa, Mycobacterium
HDTTAT

SEQ ID NO: 501901 - protein, 7 aa, Mycobacterium
HDTTATG

SEQ ID NO: 501902 - protein, 6 aa, Mycobacterium
HDTTNR

SEQ ID NO: 501903 - protein, 4 aa, Mycobacterium
HDTV

SEQ ID NO: 501904 - protein, 5 aa, Mycobacterium
HDVEQ

SEQ ID NO: 501905 - protein, 4 aa, Mycobacterium
HDVG

SEQ ID NO: 501906 - protein, 6 aa, Mycobacterium
HDVGAA

SEQ ID NO: 501907 - protein, 13 aa, Mycobacterium
HDVGGEPDAPMKY

SEQ ID NO: 501908 - protein, 16 aa, Mycobacterium
HDVGRGAARHLRVGLR

SEQ ID NO: 501909 - protein, 11 aa, Mycobacterium
HDVGRGRGGVE

SEQ ID NO: 501910 - protein, 12 aa, Mycobacterium
HDVGRGRGGVGK

SEQ ID NO: 501911 - protein, 9 aa, Mycobacterium
HDVGRPRAG

SEQ ID NO: 501912 - protein, 24 aa, Mycobacterium
HDVGTAAGHVGGHRDPAAAARHGD

SEQ ID NO: 501913 - protein, 4 aa, Mycobacterium
HDVN

SEQ ID NO: 501914 - protein, 11 aa, Mycobacterium
HDVNNERRGYK

SEQ ID NO: 501915 - protein, 8 aa, Mycobacterium
HDVPGDQA

SEQ ID NO: 501916 - protein, 6 aa, Mycobacterium
HDVPPY

SEQ ID NO: 501917 - protein, 18 aa, Mycobacterium
HDVTEASRASGTDLVTGE

SEQ ID NO: 501918 - protein, 11 aa, Mycobacterium
HDVTTQSYSPL

SEQ ID NO: 501919 - protein, 12 aa, Mycobacterium
HDYAASAAAAGA

SEQ ID NO: 501920 - protein, 11 aa, Mycobacterium
HDYDDPGKPAI

SEQ ID NO: 501921 - protein, 7 aa, Mycobacterium
HDYGRSI

SEQ ID NO: 501922 - protein, 6 aa, Mycobacterium
HDYPNS

SEQ ID NO: 501923 - protein, 6 aa, Mycobacterium
HDYQAA

SEQ ID NO: 501924 - protein, 8 aa, Mycobacterium
HEAAAQRR

SEQ ID NO: 501925 - protein, 6 aa, Mycobacterium
HEAAAR

SEQ ID NO: 501926 - protein, 8 aa, Mycobacterium
HEAAARDE

SEQ ID NO: 501927 - protein, 5 aa, Mycobacterium
HEAAD

SEQ ID NO: 501928 - protein, 5 aa, Mycobacterium
HEAAE

SEQ ID NO: 501929 - protein, 15 aa, Mycobacterium
HEAAGAAVRAAEGRA

SEQ ID NO: 501930 - protein, 16 aa, Mycobacterium
HEAAGAAVRAAEQRGV

SEQ ID NO: 501931 - protein, 15 aa, Mycobacterium
HEAAGAAVRTAEERS

SEQ ID NO: 501932 - protein, 9 aa, Mycobacterium
HEADEETTL

SEQ ID NO: 501933 - protein, 16 aa, Mycobacterium
HEADRTLSDYRTRHPK

SEQ ID NO: 501934 - protein, 17 aa, Mycobacterium
HEADSSHAFSALFGHGG

SEQ ID NO: 501935 - protein, 13 aa, Mycobacterium
HEAEPRHATGKGD

SEQ ID NO: 501936 - protein, 4 aa, Mycobacterium
HEAG

SEQ ID NO: 501937 - protein, 10 aa, Mycobacterium
HEAGAANDAA

SEQ ID NO: 501938 - protein, 15 aa, Mycobacterium
HEAGASRPALPSPTL

SEQ ID NO: 501939 - protein, 5 aa, Mycobacterium
HEAGD

SEQ ID NO: 501940 - protein, 9 aa, Mycobacterium
HEAGEDPRY

SEQ ID NO: 501941 - protein, 5 aa, Mycobacterium
HEAGG

SEQ ID NO: 501942 - protein, 10 aa, Mycobacterium
HEAGGHTGEI

SEQ ID NO: 501943 - protein, 5 aa, Mycobacterium
HEAGH

SEQ ID NO: 501944 - protein, 6 aa, Mycobacterium
HEAGHT

SEQ ID NO: 501945 - protein, 10 aa, Mycobacterium
HEAGPDDHTV

SEQ ID NO: 501946 - protein, 10 aa, Mycobacterium
HEAGPRDHTV

SEQ ID NO: 501947 - protein, 9 aa, Mycobacterium
HEAGRMDPR

SEQ ID NO: 501948 - protein, 6 aa, Mycobacterium
HEAGRS

SEQ ID NO: 501949 - protein, 11 aa, Mycobacterium
HEAKGQNQLNG

SEQ ID NO: 501950 - protein, 9 aa, Mycobacterium
HEANDALAE

SEQ ID NO: 501951 - protein, 6 aa, Mycobacterium
HEANSG

SEQ ID NO: 501952 - protein, 8 aa, Mycobacterium
HEAPPATR

SEQ ID NO: 501953 - protein, 4 aa, Mycobacterium
HEAQ

SEQ ID NO: 501954 - protein, 5 aa, Mycobacterium
HEARE

SEQ ID NO: 501955 - protein, 21 aa, Mycobacterium
HEARGTKRTSPIAVVANRITG

SEQ ID NO: 501956 - protein, 8 aa, Mycobacterium
HEARRRQA

SEQ ID NO: 501957 - protein, 7 aa, Mycobacterium
HEARTDA

SEQ ID NO: 501958 - protein, 6 aa, Mycobacterium
HEARTG

SEQ ID NO: 501959 - protein, 9 aa, Mycobacterium
HEATPGAVE

SEQ ID NO: 501960 - protein, 9 aa, Mycobacterium
HEATVYPGP

SEQ ID NO: 501961 - protein, 25 aa, Mycobacterium
HECESTRPEGPGDATKPDELATTAS

SEQ ID NO: 501962 - protein, 9 aa, Mycobacterium
HEDAAGGNP

SEQ ID NO: 501963 - protein, 8 aa, Mycobacterium
HEDDPSRL

SEQ ID NO: 501964 - protein, 10 aa, Mycobacterium
HEDDPSRYAT

SEQ ID NO: 501965 - protein, 6 aa, Mycobacterium
HEDEAI

SEQ ID NO: 501966 - protein, 12 aa, Mycobacterium
HEDGAEPSTRLA

SEQ ID NO: 501967 - protein, 23 aa, Mycobacterium
HEDGENPINDSAEVQRAKTSLGV

SEQ ID NO: 501968 - protein, 10 aa, Mycobacterium
HEDGKTHPSM

SEQ ID NO: 501969 - protein, 12 aa, Mycobacterium
HEDGNPMSDQEI

SEQ ID NO: 501970 - protein, 9 aa, Mycobacterium
HEDGSADQW

SEQ ID NO: 501971 - protein, 7 aa, Mycobacterium
HEDKTRE

SEQ ID NO: 501972 - protein, 11 aa, Mycobacterium
HEDNKKAYAGP

SEQ ID NO: 501973 - protein, 10 aa, Mycobacterium
HEDNKRAYAG

SEQ ID NO: 501974 - protein, 4 aa, Mycobacterium
HEDP

SEQ ID NO: 501975 - protein, 8 aa, Mycobacterium
HEDPDQAQ

SEQ ID NO: 501976 - protein, 6 aa, Mycobacterium
HEDPGQ

SEQ ID NO: 501977 - protein, 4 aa, Mycobacterium
HEDQ

SEQ ID NO: 501978 - protein, 14 aa, Mycobacterium
HEDQTAAAVAIIEE

SEQ ID NO: 501979 - protein, 6 aa, Mycobacterium
HEDRAG

SEQ ID NO: 501980 - protein, 17 aa, Mycobacterium
HEDRRRSYELIAKEWGL

SEQ ID NO: 501981 - protein, 30 aa, Mycobacterium
HEDSKTASTSESENPAIPSPKPKSNAPLTN

SEQ ID NO: 501982 - protein, 7 aa, Mycobacterium
HEDTDDV

SEQ ID NO: 501983 - protein, 6 aa, Mycobacterium
HEDTRK

SEQ ID NO: 501984 - protein, 5 aa, Mycobacterium
HEEAD

SEQ ID NO: 501985 - protein, 5 aa, Mycobacterium
HEEAE

SEQ ID NO: 501986 - protein, 8 aa, Mycobacterium
HEEAPEEI

SEQ ID NO: 501987 - protein, 8 aa, Mycobacterium
HEEAPEEV

SEQ ID NO: 501988 - protein, 9 aa, Mycobacterium
HEEAPEEVN

SEQ ID NO: 501989 - protein, 7 aa, Mycobacterium
HEEARLP

SEQ ID NO: 501990 - protein, 6 aa, Mycobacterium
HEEEPD

SEQ ID NO: 501991 - protein, 6 aa, Mycobacterium
HEEGGG

SEQ ID NO: 501992 - protein, 13 aa, Mycobacterium
HEEHEETGSGGGL

SEQ ID NO: 501993 - protein, 9 aa, Mycobacterium
HEELRPRTR

SEQ ID NO: 501994 - protein, 10 aa, Mycobacterium
HEENKENFAG

SEQ ID NO: 501995 - protein, 9 aa, Mycobacterium
HEENKQAFA

SEQ ID NO: 501996 - protein, 6 aa, Mycobacterium
HEENNH

SEQ ID NO: 501997 - protein, 5 aa, Mycobacterium
HEEPA

SEQ ID NO: 501998 - protein, 7 aa, Mycobacterium
HEEPDRC

SEQ ID NO: 501999 - protein, 5 aa, Mycobacterium
HEEPP

SEQ ID NO: 502000 - protein, 9 aa, Mycobacterium
HEEPPKYPD

SEQ ID NO: 502001 - protein, 9 aa, Mycobacterium
HEEQPDAVN

SEQ ID NO: 502002 - protein, 7 aa, Mycobacterium
HEERRGT

SEQ ID NO: 502003 - protein, 7 aa, Mycobacterium
HEETAGT

SEQ ID NO: 502004 - protein, 8 aa, Mycobacterium
HEETAGTC

SEQ ID NO: 502005 - protein, 10 aa, Mycobacterium
HEETDGTLGV

SEQ ID NO: 502006 - protein, 4 aa, Mycobacterium
HEEY

SEQ ID NO: 502007 - protein, 10 aa, Mycobacterium
HEFRPDRKNV

SEQ ID NO: 502008 - protein, 8 aa, Mycobacterium
HEGAGGAA

SEQ ID NO: 502009 - protein, 8 aa, Mycobacterium
HEGAHGGL

SEQ ID NO: 502010 - protein, 10 aa, Mycobacterium
HEGATRSAFD

SEQ ID NO: 502011 - protein, 11 aa, Mycobacterium
HEGAVSADTPF

SEQ ID NO: 502012 - protein, 9 aa, Mycobacterium
HEGDEALAE

SEQ ID NO: 502013 - protein, 12 aa, Mycobacterium
HEGDGGDGSKPV

SEQ ID NO: 502014 - protein, 12 aa, Mycobacterium
HEGDGGQDAKPV

SEQ ID NO: 502015 - protein, 14 aa, Mycobacterium
HEGDTAAAVAILES

SEQ ID NO: 502016 - protein, 8 aa, Mycobacterium
HEGECGPG

SEQ ID NO: 502017 - protein, 9 aa, Mycobacterium
HEGERRARR

SEQ ID NO: 502018 - protein, 6 aa, Mycobacterium
HEGESD

SEQ ID NO: 502019 - protein, 5 aa, Mycobacterium
HEGET

SEQ ID NO: 502020 - protein, 10 aa, Mycobacterium
HEGGDGPPLR

SEQ ID NO: 502021 - protein, 8 aa, Mycobacterium
HEGGFPPN

SEQ ID NO: 502022 - protein, 12 aa, Mycobacterium
HEGGGGQDAKPV

SEQ ID NO: 502023 - protein, 6 aa, Mycobacterium
HEGGPL

SEQ ID NO: 502024 - protein, 16 aa, Mycobacterium
HEGGPLCSGRARGRTV

SEQ ID NO: 502025 - protein, 9 aa, Mycobacterium
HEGGREINP

SEQ ID NO: 502026 - protein, 9 aa, Mycobacterium
HEGGSSAHE

SEQ ID NO: 502027 - protein, 6 aa, Mycobacterium
HEGGTI

SEQ ID NO: 502028 - protein, 7 aa, Mycobacterium
HEGGTIA

SEQ ID NO: 502029 - protein, 5 aa, Mycobacterium
HEGKG

SEQ ID NO: 502030 - protein, 7 aa, Mycobacterium
HEGPGGE

SEQ ID NO: 502031 - protein, 7 aa, Mycobacterium
HEGPGKD

SEQ ID NO: 502032 - protein, 5 aa, Mycobacterium
HEGPI

SEQ ID NO: 502033 - protein, 8 aa, Mycobacterium
HEGPNAAQ

SEQ ID NO: 502034 - protein, 8 aa, Mycobacterium
HEGPNAAR

SEQ ID NO: 502035 - protein, 6 aa, Mycobacterium
HEGRDA

SEQ ID NO: 502036 - protein, 7 aa, Mycobacterium
HEGRGAV

SEQ ID NO: 502037 - protein, 4 aa, Mycobacterium
HEGS

SEQ ID NO: 502038 - protein, 5 aa, Mycobacterium
HEGSA

SEQ ID NO: 502039 - protein, 7 aa, Mycobacterium
HEGSGTV

SEQ ID NO: 502040 - protein, 6 aa, Mycobacterium
HEGSGV

SEQ ID NO: 502041 - protein, 6 aa, Mycobacterium
HEGTGI

SEQ ID NO: 502042 - protein, 7 aa, Mycobacterium
HEGTKGA

SEQ ID NO: 502043 - protein, 5 aa, Mycobacterium
HEHDD

SEQ ID NO: 502044 - protein, 13 aa, Mycobacterium
HEHGPAGLGDREL

SEQ ID NO: 502045 - protein, 7 aa, Mycobacterium
HEHGQRQ

SEQ ID NO: 502046 - protein, 5 aa, Mycobacterium
HEHHQ

SEQ ID NO: 502047 - protein, 11 aa, Mycobacterium
HEHHRDSPWGI

SEQ ID NO: 502048 - protein, 13 aa, Mycobacterium
HEIEPSASVESDQ

SEQ ID NO: 502049 - protein, 11 aa, Mycobacterium
HEIEPSPAEDG

SEQ ID NO: 502050 - protein, 9 aa, Mycobacterium
HEIERRSAP

SEQ ID NO: 502051 - protein, 7 aa, Mycobacterium
HEIPSGN

SEQ ID NO: 502052 - protein, 5 aa, Mycobacterium
HEIRS

SEQ ID NO: 502053 - protein, 13 aa, Mycobacterium
HEKAAAAQDSGAF

SEQ ID NO: 502054 - protein, 14 aa, Mycobacterium
HEKAAAAQDSGAFS

SEQ ID NO: 502055 - protein, 9 aa, Mycobacterium
HEKDETYPE

SEQ ID NO: 502056 - protein, 10 aa, Mycobacterium
HEKEGDADIR

SEQ ID NO: 502057 - protein, 14 aa, Mycobacterium
HEKETLRFGGVVDV

SEQ ID NO: 502058 - protein, 12 aa, Mycobacterium
HEKFGKPDLGGS

SEQ ID NO: 502059 - protein, 9 aa, Mycobacterium
HEKNETYPE

SEQ ID NO: 502060 - protein, 10 aa, Mycobacterium
HEKNRRQRKN

SEQ ID NO: 502061 - protein, 14 aa, Mycobacterium
HEKQKNKHGGKNAD

SEQ ID NO: 502062 - protein, 8 aa, Mycobacterium
HEKRPRGP

SEQ ID NO: 502063 - protein, 4 aa, Mycobacterium
HELQ

SEQ ID NO: 502064 - protein, 4 aa, Mycobacterium
HELS

SEQ ID NO: 502065 - protein, 10 aa, Mycobacterium
HELSGGQRQR

SEQ ID NO: 502066 - protein, 6 aa, Mycobacterium
HELTSS

SEQ ID NO: 502067 - protein, 7 aa, Mycobacterium
HEMNTTS

SEQ ID NO: 502068 - protein, 11 aa, Mycobacterium
HENADEALRSG

SEQ ID NO: 502069 - protein, 5 aa, Mycobacterium
HENAM

SEQ ID NO: 502070 - protein, 30 aa, Mycobacterium
HENARRRLAEAEQALTAAEDAVKSAKRAAG

SEQ ID NO: 502071 - protein, 7 aa, Mycobacterium
HENCGDT

SEQ ID NO: 502072 - protein, 5 aa, Mycobacterium
HENGS

SEQ ID NO: 502073 - protein, 5 aa, Mycobacterium
HENTE

SEQ ID NO: 502074 - protein, 4 aa, Mycobacterium
HEPA

SEQ ID NO: 502075 - protein, 9 aa, Mycobacterium
HEPADKTPF

SEQ ID NO: 502076 - protein, 8 aa, Mycobacterium
HEPADPDH

SEQ ID NO: 502077 - protein, 5 aa, Mycobacterium
HEPAF

SEQ ID NO: 502078 - protein, 5 aa, Mycobacterium
HEPAG

SEQ ID NO: 502079 - protein, 11 aa, Mycobacterium
HEPAGARARER

SEQ ID NO: 502080 - protein, 11 aa, Mycobacterium
HEPARADEPYR

SEQ ID NO: 502081 - protein, 5 aa, Mycobacterium
HEPAV

SEQ ID NO: 502082 - protein, 5 aa, Mycobacterium
HEPDA

SEQ ID NO: 502083 - protein, 9 aa, Mycobacterium
HEPDDALAE

SEQ ID NO: 502084 - protein, 11 aa, Mycobacterium
HEPDDASRPEG

SEQ ID NO: 502085 - protein, 7 aa, Mycobacterium
HEPDDCR

SEQ ID NO: 502086 - protein, 7 aa, Mycobacterium
HEPDEAL

SEQ ID NO: 502087 - protein, 6 aa, Mycobacterium
HEPDEC

SEQ ID NO: 502088 - protein, 14 aa, Mycobacterium
HEPDTDHHEPDPDE

SEQ ID NO: 502089 - protein, 8 aa, Mycobacterium
HEPEADPR

SEQ ID NO: 502090 - protein, 5 aa, Mycobacterium
HEPER

SEQ ID NO: 502091 - protein, 4 aa, Mycobacterium
HEPG

SEQ ID NO: 502092 - protein, 7 aa, Mycobacterium
HEPGAAI

SEQ ID NO: 502093 - protein, 10 aa, Mycobacterium
HEPGEPADYR

SEQ ID NO: 502094 - protein, 12 aa, Mycobacterium
HEPGEQPAKADG

SEQ ID NO: 502095 - protein, 9 aa, Mycobacterium
HEPGERRGQ

SEQ ID NO: 502096 - protein, 8 aa, Mycobacterium
HEPGGVVR

SEQ ID NO: 502097 - protein, 5 aa, Mycobacterium
HEPGQ

SEQ ID NO: 502098 - protein, 6 aa, Mycobacterium
HEPGRG

SEQ ID NO: 502099 - protein, 8 aa, Mycobacterium
HEPGSPEL

SEQ ID NO: 502100 - protein, 8 aa, Mycobacterium
HEPGSPEV

SEQ ID NO: 502101 - protein, 13 aa, Mycobacterium
HEPIDDTRTGGDS

SEQ ID NO: 502102 - protein, 5 aa, Mycobacterium
HEPNQ

SEQ ID NO: 502103 - protein, 9 aa, Mycobacterium
HEPPAAEGS

SEQ ID NO: 502104 - protein, 12 aa, Mycobacterium
HEPPDSPWPCPP

SEQ ID NO: 502105 - protein, 10 aa, Mycobacterium
HEPRPSGPVT

SEQ ID NO: 502106 - protein, 6 aa, Mycobacterium
HEPRQK

SEQ ID NO: 502107 - protein, 6 aa, Mycobacterium
HEPRSD

SEQ ID NO: 502108 - protein, 6 aa, Mycobacterium
HEPSES

SEQ ID NO: 502109 - protein, 8 aa, Mycobacterium
HEPSTSEL

SEQ ID NO: 502110 - protein, 6 aa, Mycobacterium
HEPTAR

SEQ ID NO: 502111 - protein, 7 aa, Mycobacterium
HEPTDDS

SEQ ID NO: 502112 - protein, 14 aa, Mycobacterium
HEPTGAAGQGPPGH

SEQ ID NO: 502113 - protein, 8 aa, Mycobacterium
HEPTPGAV

SEQ ID NO: 502114 - protein, 7 aa, Mycobacterium
HEPTTRE

SEQ ID NO: 502115 - protein, 8 aa, Mycobacterium
HEPVPADP

SEQ ID NO: 502116 - protein, 7 aa, Mycobacterium
HEQAPRS

SEQ ID NO: 502117 - protein, 7 aa, Mycobacterium
HEQEEDV

SEQ ID NO: 502118 - protein, 4 aa, Mycobacterium
HEQG

SEQ ID NO: 502119 - protein, 13 aa, Mycobacterium
HEQQGGVRVTGRA

SEQ ID NO: 502120 - protein, 6 aa, Mycobacterium
HEQQRA

SEQ ID NO: 502121 - protein, 6 aa, Mycobacterium
HEQTQA

SEQ ID NO: 502122 - protein, 13 aa, Mycobacterium
HERAAAALDGGAF

SEQ ID NO: 502123 - protein, 6 aa, Mycobacterium
HERAGS

SEQ ID NO: 502124 - protein, 8 aa, Mycobacterium
HERAGSAP

SEQ ID NO: 502125 - protein, 8 aa, Mycobacterium
HERAGSGS

SEQ ID NO: 502126 - protein, 7 aa, Mycobacterium
HERAGSR

SEQ ID NO: 502127 - protein, 10 aa, Mycobacterium
HERAGSSNVT

SEQ ID NO: 502128 - protein, 8 aa, Mycobacterium
HERAGSTN

SEQ ID NO: 502129 - protein, 10 aa, Mycobacterium
HERDARAGRR

SEQ ID NO: 502130 - protein, 7 aa, Mycobacterium
HERDDPD

SEQ ID NO: 502131 - protein, 9 aa, Mycobacterium
HERDRDQAA

SEQ ID NO: 502132 - protein, 4 aa, Mycobacterium
HERE

SEQ ID NO: 502133 - protein, 11 aa, Mycobacterium
HERGAAGFDDP

SEQ ID NO: 502134 - protein, 6 aa, Mycobacterium
HERGDD

SEQ ID NO: 502135 - protein, 8 aa, Mycobacterium
HERGEVSA

SEQ ID NO: 502136 - protein, 4 aa, Mycobacterium
HERK

SEQ ID NO: 502137 - protein, 9 aa, Mycobacterium
HERNETYPE

SEQ ID NO: 502138 - protein, 12 aa, Mycobacterium
HERNRRQKKSCQ

SEQ ID NO: 502139 - protein, 10 aa, Mycobacterium
HERNRRQRKN

SEQ ID NO: 502140 - protein, 12 aa, Mycobacterium
HERNRRQRKSCQ

SEQ ID NO: 502141 - protein, 38 aa, Mycobacterium
HERPAARGDEKASGGDKAAMAAPPVAAPQPAEAEPDVR

SEQ ID NO: 502142 - protein, 6 aa, Mycobacterium
HERPDY

SEQ ID NO: 502143 - protein, 10 aa, Mycobacterium
HERPLAPRGI

SEQ ID NO: 502144 - protein, 5 aa, Mycobacterium
HERPP

SEQ ID NO: 502145 - protein, 10 aa, Mycobacterium
HERPTDTVTT

SEQ ID NO: 502146 - protein, 14 aa, Mycobacterium
HERPTIGRPTAPTR

SEQ ID NO: 502147 - protein, 5 aa, Mycobacterium
HERQT

SEQ ID NO: 502148 - protein, 4 aa, Mycobacterium
HERS

SEQ ID NO: 502149 - protein, 14 aa, Mycobacterium
HERSNGCSYADSPH

SEQ ID NO: 502150 - protein, 17 aa, Mycobacterium
HERTAAPAPRAPCGQPA

SEQ ID NO: 502151 - protein, 14 aa, Mycobacterium
HERTAGEGSGRPRV

SEQ ID NO: 502152 - protein, 5 aa, Mycobacterium
HERTL

SEQ ID NO: 502153 - protein, 5 aa, Mycobacterium
HERWG

SEQ ID NO: 502154 - protein, 4 aa, Mycobacterium
HERY

SEQ ID NO: 502155 - protein, 6 aa, Mycobacterium
HERYTT

SEQ ID NO: 502156 - protein, 7 aa, Mycobacterium
HESAGAT

SEQ ID NO: 502157 - protein, 34 aa, Mycobacterium
HESAGFNATEEYASGAAYEGRADLGNTQPGDGVR

SEQ ID NO: 502158 - protein, 9 aa, Mycobacterium
HESDDALAE

SEQ ID NO: 502159 - protein, 8 aa, Mycobacterium
HESDEMKR

SEQ ID NO: 502160 - protein, 10 aa, Mycobacterium
HESDESLAEE

SEQ ID NO: 502161 - protein, 9 aa, Mycobacterium
HESEPRQRD

SEQ ID NO: 502162 - protein, 6 aa, Mycobacterium
HESEPW

SEQ ID NO: 502163 - protein, 7 aa, Mycobacterium
HESETPL

SEQ ID NO: 502164 - protein, 7 aa, Mycobacterium
HESGEGR

SEQ ID NO: 502165 - protein, 16 aa, Mycobacterium
HESGGARMGERPDNSV

SEQ ID NO: 502166 - protein, 6 aa, Mycobacterium
HESGID

SEQ ID NO: 502167 - protein, 9 aa, Mycobacterium
HESGSGADT

SEQ ID NO: 502168 - protein, 13 aa, Mycobacterium
HESNDDEADNPGA

SEQ ID NO: 502169 - protein, 7 aa, Mycobacterium
HESNEAL

SEQ ID NO: 502170 - protein, 5 aa, Mycobacterium
HESNQ

SEQ ID NO: 502171 - protein, 12 aa, Mycobacterium
HESNSAATGFDG

SEQ ID NO: 502172 - protein, 6 aa, Mycobacterium
HESPEL

SEQ ID NO: 502173 - protein, 7 aa, Mycobacterium
HESPQTR

SEQ ID NO: 502174 - protein, 9 aa, Mycobacterium
HESQPARRP

SEQ ID NO: 502175 - protein, 5 aa, Mycobacterium
HESRA

SEQ ID NO: 502176 - protein, 8 aa, Mycobacterium
HESSARSK

SEQ ID NO: 502177 - protein, 7 aa, Mycobacterium
HESSSAA

SEQ ID NO: 502178 - protein, 5 aa, Mycobacterium
HESST

SEQ ID NO: 502179 - protein, 7 aa, Mycobacterium
HESTQNA

SEQ ID NO: 502180 - protein, 10 aa, Mycobacterium
HESTQNAKEM

SEQ ID NO: 502181 - protein, 11 aa, Mycobacterium
HESTQSAKEMA

SEQ ID NO: 502182 - protein, 5 aa, Mycobacterium
HETAH

SEQ ID NO: 502183 - protein, 8 aa, Mycobacterium
HETAHQGR

SEQ ID NO: 502184 - protein, 5 aa, Mycobacterium
HETAK

SEQ ID NO: 502185 - protein, 10 aa, Mycobacterium
HETAPAGDGE

SEQ ID NO: 502186 - protein, 9 aa, Mycobacterium
HETASDEKT

SEQ ID NO: 502187 - protein, 9 aa, Mycobacterium
HETASYDPA

SEQ ID NO: 502188 - protein, 5 aa, Mycobacterium
HETDD

SEQ ID NO: 502189 - protein, 6 aa, Mycobacterium
HETDTA

SEQ ID NO: 502190 - protein, 24 aa, Mycobacterium
HETDTADRDFPDYTPERVRSDTGV

SEQ ID NO: 502191 - protein, 6 aa, Mycobacterium
HETDTD

SEQ ID NO: 502192 - protein, 5 aa, Mycobacterium
HETES

SEQ ID NO: 502193 - protein, 6 aa, Mycobacterium
HETETV

SEQ ID NO: 502194 - protein, 9 aa, Mycobacterium
HETGDPAAA

SEQ ID NO: 502195 - protein, 6 aa, Mycobacterium
HETGQP

SEQ ID NO: 502196 - protein, 6 aa, Mycobacterium
HETGQT

SEQ ID NO: 502197 - protein, 7 aa, Mycobacterium
HETGQTP

SEQ ID NO: 502198 - protein, 10 aa, Mycobacterium
HETGSSTDEL

SEQ ID NO: 502199 - protein, 8 aa, Mycobacterium
HETPDDHR

SEQ ID NO: 502200 - protein, 5 aa, Mycobacterium
HETPE

SEQ ID NO: 502201 - protein, 9 aa, Mycobacterium
HETPGHDSD

SEQ ID NO: 502202 - protein, 10 aa, Mycobacterium
HETPMPDTEL

SEQ ID NO: 502203 - protein, 16 aa, Mycobacterium
HETPSRTSGLDGHSMD

SEQ ID NO: 502204 - protein, 4 aa, Mycobacterium
HETR

SEQ ID NO: 502205 - protein, 5 aa, Mycobacterium
HETRA

SEQ ID NO: 502206 - protein, 6 aa, Mycobacterium
HETSAG

SEQ ID NO: 502207 - protein, 6 aa, Mycobacterium
HETSTW

SEQ ID NO: 502208 - protein, 4 aa, Mycobacterium
HETT

SEQ ID NO: 502209 - protein, 6 aa, Mycobacterium
HETTAS

SEQ ID NO: 502210 - protein, 7 aa, Mycobacterium
HETTASG

SEQ ID NO: 502211 - protein, 6 aa, Mycobacterium
HETTKR

SEQ ID NO: 502212 - protein, 5 aa, Mycobacterium
HETTS

SEQ ID NO: 502213 - protein, 7 aa, Mycobacterium
HETTSTA

SEQ ID NO: 502214 - protein, 7 aa, Mycobacterium
HETTSTQ

SEQ ID NO: 502215 - protein, 5 aa, Mycobacterium
HETTV

SEQ ID NO: 502216 - protein, 16 aa, Mycobacterium
HETVTTPESWADDPGA

SEQ ID NO: 502217 - protein, 4 aa, Mycobacterium
HEVP

SEQ ID NO: 502218 - protein, 4 aa, Mycobacterium
HEVR

SEQ ID NO: 502219 - protein, 5 aa, Mycobacterium
HEYGD

SEQ ID NO: 502220 - protein, 5 aa, Mycobacterium
HEYGG

SEQ ID NO: 502221 - protein, 10 aa, Mycobacterium
HEYGSTSEDL

SEQ ID NO: 502222 - protein, 20 aa, Mycobacterium
HFDPSTISAEPQSVKEAQRA

SEQ ID NO: 502223 - protein, 5 aa, Mycobacterium
HFGEA

SEQ ID NO: 502224 - protein, 11 aa, Mycobacterium
HFGGPPADYGT

SEQ ID NO: 502225 - protein, 4 aa, Mycobacterium
HFGS

SEQ ID NO: 502226 - protein, 16 aa, Mycobacterium
HFPDPNGFSGPRAQRL

SEQ ID NO: 502227 - protein, 5 aa, Mycobacterium
HFPPG

SEQ ID NO: 502228 - protein, 9 aa, Mycobacterium
HFPSSGPYQ

SEQ ID NO: 502229 - protein, 6 aa, Mycobacterium
HFPTPD

SEQ ID NO: 502230 - protein, 9 aa, Mycobacterium
HFQGSTSAL

SEQ ID NO: 502231 - protein, 10 aa, Mycobacterium
HFRPPEDPHT

SEQ ID NO: 502232 - protein, 11 aa, Mycobacterium
HFRPPEDPSTP

SEQ ID NO: 502233 - protein, 8 aa, Mycobacterium
HFSGGDPS

SEQ ID NO: 502234 - protein, 4 aa, Mycobacterium
HGAA

SEQ ID NO: 502235 - protein, 11 aa, Mycobacterium
HGAAAAANAAK

SEQ ID NO: 502236 - protein, 8 aa, Mycobacterium
HGAAATTL

SEQ ID NO: 502237 - protein, 5 aa, Mycobacterium
HGAAD

SEQ ID NO: 502238 - protein, 9 aa, Mycobacterium
HGAADGSLP

SEQ ID NO: 502239 - protein, 13 aa, Mycobacterium
HGAADWSKRPLPD

SEQ ID NO: 502240 - protein, 7 aa, Mycobacterium
HGAAGLS

SEQ ID NO: 502241 - protein, 21 aa, Mycobacterium
HGAAGSDTTGSTQPGEQSTCS

SEQ ID NO: 502242 - protein, 9 aa, Mycobacterium
HGAAGTRVK

SEQ ID NO: 502243 - protein, 9 aa, Mycobacterium
HGAAVPDPI

SEQ ID NO: 502244 - protein, 7 aa, Mycobacterium
HGADGDR

SEQ ID NO: 502245 - protein, 8 aa, Mycobacterium
HGADGPSF

SEQ ID NO: 502246 - protein, 15 aa, Mycobacterium
HGADPAAGPGPEVRS

SEQ ID NO: 502247 - protein, 9 aa, Mycobacterium
HGADPAEID

SEQ ID NO: 502248 - protein, 6 aa, Mycobacterium
HGADPL

SEQ ID NO: 502249 - protein, 4 aa, Mycobacterium
HGAE

SEQ ID NO: 502250 - protein, 5 aa, Mycobacterium
HGAEG

SEQ ID NO: 502251 - protein, 6 aa, Mycobacterium
HGAEGD

SEQ ID NO: 502252 - protein, 8 aa, Mycobacterium
HGAEGPKP

SEQ ID NO: 502253 - protein, 21 aa, Mycobacterium
HGAEQSRGRGRGRGRDVDGLE

SEQ ID NO: 502254 - protein, 19 aa, Mycobacterium
HGAERADAAEMERNPRSAA

SEQ ID NO: 502255 - protein, 18 aa, Mycobacterium
HGAERADADEVERNPRSA

SEQ ID NO: 502256 - protein, 9 aa, Mycobacterium
HGAGELADE

SEQ ID NO: 502257 - protein, 9 aa, Mycobacterium
HGAGELAEE

SEQ ID NO: 502258 - protein, 25 aa, Mycobacterium
HGAGGERGSRDKSEQPATVRVVDDR

SEQ ID NO: 502259 - protein, 10 aa, Mycobacterium
HGAGGKASAA

SEQ ID NO: 502260 - protein, 10 aa, Mycobacterium
HGAGGKSSAA

SEQ ID NO: 502261 - protein, 8 aa, Mycobacterium
HGAGGPAQ

SEQ ID NO: 502262 - protein, 10 aa, Mycobacterium
HGAGGSRESP

SEQ ID NO: 502263 - protein, 12 aa, Mycobacterium
HGAGLAGETLAR

SEQ ID NO: 502264 - protein, 5 aa, Mycobacterium
HGAGM

SEQ ID NO: 502265 - protein, 8 aa, Mycobacterium
HGAGPELS

SEQ ID NO: 502266 - protein, 8 aa, Mycobacterium
HGAGPGQA

SEQ ID NO: 502267 - protein, 15 aa, Mycobacterium
HGAGPTGSPGPADTR

SEQ ID NO: 502268 - protein, 5 aa, Mycobacterium
HGAGQ

SEQ ID NO: 502269 - protein, 6 aa, Mycobacterium
HGAGQP

SEQ ID NO: 502270 - protein, 7 aa, Mycobacterium
HGAGSIS

SEQ ID NO: 502271 - protein, 6 aa, Mycobacterium
HGAGVA

SEQ ID NO: 502272 - protein, 5 aa, Mycobacterium
HGAHP

SEQ ID NO: 502273 - protein, 13 aa, Mycobacterium
HGAKGSAAGGPGV

SEQ ID NO: 502274 - protein, 8 aa, Mycobacterium
HGAKPTAV

SEQ ID NO: 502275 - protein, 4 aa, Mycobacterium
HGAL

SEQ ID NO: 502276 - protein, 6 aa, Mycobacterium
HGALDA

SEQ ID NO: 502277 - protein, 9 aa, Mycobacterium
HGALDTEGI

SEQ ID NO: 502278 - protein, 8 aa, Mycobacterium
HGAPADLD

SEQ ID NO: 502279 - protein, 28 aa, Mycobacterium
HGAPALARQREAPRPRVDHSRKTSRPVP

SEQ ID NO: 502280 - protein, 12 aa, Mycobacterium
HGAPERARERAR

SEQ ID NO: 502281 - protein, 8 aa, Mycobacterium
HGAPGEAY

SEQ ID NO: 502282 - protein, 7 aa, Mycobacterium
HGAPLQK

SEQ ID NO: 502283 - protein, 12 aa, Mycobacterium
HGAPPDGAPPFP

SEQ ID NO: 502284 - protein, 13 aa, Mycobacterium
HGAPPNGATARRS

SEQ ID NO: 502285 - protein, 5 aa, Mycobacterium
HGAPT

SEQ ID NO: 502286 - protein, 5 aa, Mycobacterium
HGAQA

SEQ ID NO: 502287 - protein, 8 aa, Mycobacterium
HGAQAQRV

SEQ ID NO: 502288 - protein, 10 aa, Mycobacterium
HGAQPATDAA

SEQ ID NO: 502289 - protein, 7 aa, Mycobacterium
HGAQPGT

SEQ ID NO: 502290 - protein, 7 aa, Mycobacterium
HGAQTGS

SEQ ID NO: 502291 - protein, 4 aa, Mycobacterium
HGAR

SEQ ID NO: 502292 - protein, 6 aa, Mycobacterium
HGARAG

SEQ ID NO: 502293 - protein, 10 aa, Mycobacterium
HGARAGSAEA

SEQ ID NO: 502294 - protein, 19 aa, Mycobacterium
HGARSSSGHPASPAPPPRE

SEQ ID NO: 502295 - protein, 7 aa, Mycobacterium
HGARSTI

SEQ ID NO: 502296 - protein, 6 aa, Mycobacterium
HGASDN

SEQ ID NO: 502297 - protein, 8 aa, Mycobacterium
HGASGSLD

SEQ ID NO: 502298 - protein, 9 aa, Mycobacterium
HGASSEQAR

SEQ ID NO: 502299 - protein, 10 aa, Mycobacterium
HGASSKEARS

SEQ ID NO: 502300 - protein, 10 aa, Mycobacterium
HGASTDEITA

SEQ ID NO: 502301 - protein, 7 aa, Mycobacterium
HGATAGA

SEQ ID NO: 502302 - protein, 6 aa, Mycobacterium
HGATAR

SEQ ID NO: 502303 - protein, 6 aa, Mycobacterium
HGATAT

SEQ ID NO: 502304 - protein, 10 aa, Mycobacterium
HGATATNTPG

SEQ ID NO: 502305 - protein, 5 aa, Mycobacterium
HGATI

SEQ ID NO: 502306 - protein, 10 aa, Mycobacterium
HGATPADSAV

SEQ ID NO: 502307 - protein, 8 aa, Mycobacterium
HGATPRAV

SEQ ID NO: 502308 - protein, 10 aa, Mycobacterium
HGATSKAEGM

SEQ ID NO: 502309 - protein, 8 aa, Mycobacterium
HGATTHAS

SEQ ID NO: 502310 - protein, 5 aa, Mycobacterium
HGAVG

SEQ ID NO: 502311 - protein, 5 aa, Mycobacterium
HGAVT

SEQ ID NO: 502312 - protein, 33 aa, Mycobacterium
HGCANPAHKAEQARKPIRNESKDRYRVWPKKTV

SEQ ID NO: 502313 - protein, 10 aa, Mycobacterium
HGDAAEAIQR

SEQ ID NO: 502314 - protein, 11 aa, Mycobacterium
HGDAAGPTDPV

SEQ ID NO: 502315 - protein, 5 aa, Mycobacterium
HGDAD

SEQ ID NO: 502316 - protein, 9 aa, Mycobacterium
HGDAFGNQQ

SEQ ID NO: 502317 - protein, 26 aa, Mycobacterium
HGDAGPAQTETGPDGCTARPTPLPRG

SEQ ID NO: 502318 - protein, 6 aa, Mycobacterium
HGDARA

SEQ ID NO: 502319 - protein, 19 aa, Mycobacterium
HGDARTAIDENAKQHEVIN

SEQ ID NO: 502320 - protein, 6 aa, Mycobacterium
HGDATE

SEQ ID NO: 502321 - protein, 15 aa, Mycobacterium
HGDAVYSEDGSTVDQ

SEQ ID NO: 502322 - protein, 6 aa, Mycobacterium
HGDDAA

SEQ ID NO: 502323 - protein, 8 aa, Mycobacterium
HGDDAANT

SEQ ID NO: 502324 - protein, 6 aa, Mycobacterium
HGDDEQ

SEQ ID NO: 502325 - protein, 11 aa, Mycobacterium
HGDDGDKARRL

SEQ ID NO: 502326 - protein, 7 aa, Mycobacterium
HGDDGSI

SEQ ID NO: 502327 - protein, 6 aa, Mycobacterium
HGDDGT

SEQ ID NO: 502328 - protein, 8 aa, Mycobacterium
HGDDGTRI

SEQ ID NO: 502329 - protein, 5 aa, Mycobacterium
HGDDI

SEQ ID NO: 502330 - protein, 6 aa, Mycobacterium
HGDDPA

SEQ ID NO: 502331 - protein, 24 aa, Mycobacterium
HGDDPDPRSWAEKKAAEDAELGRT

SEQ ID NO: 502332 - protein, 8 aa, Mycobacterium
HGDDTTYA

SEQ ID NO: 502333 - protein, 9 aa, Mycobacterium
HGDEETATE

SEQ ID NO: 502334 - protein, 7 aa, Mycobacterium
HGDERRQ

SEQ ID NO: 502335 - protein, 5 aa, Mycobacterium
HGDFT

SEQ ID NO: 502336 - protein, 8 aa, Mycobacterium
HGDGDQEF

SEQ ID NO: 502337 - protein, 5 aa, Mycobacterium
HGDGE

SEQ ID NO: 502338 - protein, 6 aa, Mycobacterium
HGDGGE

SEQ ID NO: 502339 - protein, 6 aa, Mycobacterium
HGDGGV

SEQ ID NO: 502340 - protein, 9 aa, Mycobacterium
HGDGLNGSS

SEQ ID NO: 502341 - protein, 14 aa, Mycobacterium
HGDGNVAEADEPAV

SEQ ID NO: 502342 - protein, 14 aa, Mycobacterium
HGDGPLTDENLGPE

SEQ ID NO: 502343 - protein, 7 aa, Mycobacterium
HGDGRIS

SEQ ID NO: 502344 - protein, 11 aa, Mycobacterium
HGDGSGDTARG

SEQ ID NO: 502345 - protein, 17 aa, Mycobacterium
HGDHDHGDHTGYQTGAA

SEQ ID NO: 502346 - protein, 13 aa, Mycobacterium
HGDHSGYQTGTER

SEQ ID NO: 502347 - protein, 14 aa, Mycobacterium
HGDKDHMQSLPAYW

SEQ ID NO: 502348 - protein, 8 aa, Mycobacterium
HGDKNGDG

SEQ ID NO: 502349 - protein, 5 aa, Mycobacterium
HGDNF

SEQ ID NO: 502350 - protein, 11 aa, Mycobacterium
HGDNPAGAAGP

SEQ ID NO: 502351 - protein, 5 aa, Mycobacterium
HGDNV

SEQ ID NO: 502352 - protein, 9 aa, Mycobacterium
HGDPADPKT

SEQ ID NO: 502353 - protein, 10 aa, Mycobacterium
HGDPADPKTY

SEQ ID NO: 502354 - protein, 10 aa, Mycobacterium
HGDPAEPKTY

SEQ ID NO: 502355 - protein, 11 aa, Mycobacterium
HGDPAPGESTV

SEQ ID NO: 502356 - protein, 18 aa, Mycobacterium
HGDPGPFQSGDGNPLDYG

SEQ ID NO: 502357 - protein, 8 aa, Mycobacterium
HGDPKPAH

SEQ ID NO: 502358 - protein, 9 aa, Mycobacterium
HGDPRRGEQ

SEQ ID NO: 502359 - protein, 9 aa, Mycobacterium
HGDQAATPG

SEQ ID NO: 502360 - protein, 6 aa, Mycobacterium
HGDQAV

SEQ ID NO: 502361 - protein, 4 aa, Mycobacterium
HGDR

SEQ ID NO: 502362 - protein, 12 aa, Mycobacterium
HGDRAERLRSYA

SEQ ID NO: 502363 - protein, 8 aa, Mycobacterium
HGDRNGDG

SEQ ID NO: 502364 - protein, 5 aa, Mycobacterium
HGDSE

SEQ ID NO: 502365 - protein, 15 aa, Mycobacterium
HGDSELHQSQTQQEA

SEQ ID NO: 502366 - protein, 9 aa, Mycobacterium
HGDSLTPKY

SEQ ID NO: 502367 - protein, 4 aa, Mycobacterium
HGDT

SEQ ID NO: 502368 - protein, 5 aa, Mycobacterium
HGDTK

SEQ ID NO: 502369 - protein, 4 aa, Mycobacterium
HGDV

SEQ ID NO: 502370 - protein, 16 aa, Mycobacterium
HGDVDEQLAGHGARPW

SEQ ID NO: 502371 - protein, 7 aa, Mycobacterium
HGDYASA

SEQ ID NO: 502372 - protein, 7 aa, Mycobacterium
HGEADGQ

SEQ ID NO: 502373 - protein, 10 aa, Mycobacterium
HGEAETAAAL

SEQ ID NO: 502374 - protein, 5 aa, Mycobacterium
HGEAR

SEQ ID NO: 502375 - protein, 23 aa, Mycobacterium
HGEASDAQAHAQAQWREGAEQMR

SEQ ID NO: 502376 - protein, 8 aa, Mycobacterium
HGEDGGRY

SEQ ID NO: 502377 - protein, 9 aa, Mycobacterium
HGEDHAEQG

SEQ ID NO: 502378 - protein, 7 aa, Mycobacterium
HGEDPEF

SEQ ID NO: 502379 - protein, 8 aa, Mycobacterium
HGEDRAEA

SEQ ID NO: 502380 - protein, 4 aa, Mycobacterium
HGEG

SEQ ID NO: 502381 - protein, 6 aa, Mycobacterium
HGEGDI

SEQ ID NO: 502382 - protein, 10 aa, Mycobacterium
HGEGHDTTVA

SEQ ID NO: 502383 - protein, 11 aa, Mycobacterium
HGEGRGHDGDY

SEQ ID NO: 502384 - protein, 4 aa, Mycobacterium
HGEH

SEQ ID NO: 502385 - protein, 4 aa, Mycobacterium
HGEI

SEQ ID NO: 502386 - protein, 5 aa, Mycobacterium
HGEIE

SEQ ID NO: 502387 - protein, 10 aa, Mycobacterium
HGEIGTEAQR

SEQ ID NO: 502388 - protein, 9 aa, Mycobacterium
HGEKSYAQQ

SEQ ID NO: 502389 - protein, 8 aa, Mycobacterium
HGELPDNL

SEQ ID NO: 502390 - protein, 5 aa, Mycobacterium
HGELS

SEQ ID NO: 502391 - protein, 8 aa, Mycobacterium
HGELTSEQ

SEQ ID NO: 502392 - protein, 4 aa, Mycobacterium
HGEN

SEQ ID NO: 502393 - protein, 12 aa, Mycobacterium
HGEPAVTTTQIR

SEQ ID NO: 502394 - protein, 8 aa, Mycobacterium
HGEPDEER

SEQ ID NO: 502395 - protein, 8 aa, Mycobacterium
HGEPDSQR

SEQ ID NO: 502396 - protein, 11 aa, Mycobacterium
HGEPGRADSPV

SEQ ID NO: 502397 - protein, 14 aa, Mycobacterium
HGEPGRDRVPLQPA

SEQ ID NO: 502398 - protein, 8 aa, Mycobacterium
HGEPNAEA

SEQ ID NO: 502399 - protein, 9 aa, Mycobacterium
HGEPRGDRP

SEQ ID NO: 502400 - protein, 9 aa, Mycobacterium
HGEPSGGGS

SEQ ID NO: 502401 - protein, 5 aa, Mycobacterium
HGEQA

SEQ ID NO: 502402 - protein, 12 aa, Mycobacterium
HGERADRLRSYA

SEQ ID NO: 502403 - protein, 5 aa, Mycobacterium
HGERF

SEQ ID NO: 502404 - protein, 8 aa, Mycobacterium
HGERPVPP

SEQ ID NO: 502405 - protein, 11 aa, Mycobacterium
HGERREKLTGG

SEQ ID NO: 502406 - protein, 12 aa, Mycobacterium
HGESAKPRTDYS

SEQ ID NO: 502407 - protein, 7 aa, Mycobacterium
HGESGSG

SEQ ID NO: 502408 - protein, 4 aa, Mycobacterium
HGET

SEQ ID NO: 502409 - protein, 7 aa, Mycobacterium
HGETADA

SEQ ID NO: 502410 - protein, 10 aa, Mycobacterium
HGETDTENQR

SEQ ID NO: 502411 - protein, 8 aa, Mycobacterium
HGETGPQQ

SEQ ID NO: 502412 - protein, 6 aa, Mycobacterium
HGETGS

SEQ ID NO: 502413 - protein, 6 aa, Mycobacterium
HGETRD

SEQ ID NO: 502414 - protein, 7 aa, Mycobacterium
HGETTSA

SEQ ID NO: 502415 - protein, 5 aa, Mycobacterium
HGETV

SEQ ID NO: 502416 - protein, 6 aa, Mycobacterium
HGEVEG

SEQ ID NO: 502417 - protein, 7 aa, Mycobacterium
HGEYDGT

SEQ ID NO: 502418 - protein, 7 aa, Mycobacterium
HGEYQTG

SEQ ID NO: 502419 - protein, 4 aa, Mycobacterium
HGFS

SEQ ID NO: 502420 - protein, 4 aa, Mycobacterium
HGGA

SEQ ID NO: 502421 - protein, 5 aa, Mycobacterium
HGGAD

SEQ ID NO: 502422 - protein, 7 aa, Mycobacterium
HGGADPL

SEQ ID NO: 502423 - protein, 7 aa, Mycobacterium
HGGAGAT

SEQ ID NO: 502424 - protein, 21 aa, Mycobacterium
HGGAGGVGGAGAVGGNGGTGG

SEQ ID NO: 502425 - protein, 7 aa, Mycobacterium
HGGAGRT

SEQ ID NO: 502426 - protein, 11 aa, Mycobacterium
HGGAGTTAAGL

SEQ ID NO: 502427 - protein, 6 aa, Mycobacterium
HGGAGV

SEQ ID NO: 502428 - protein, 8 aa, Mycobacterium
HGGAPEHP

SEQ ID NO: 502429 - protein, 26 aa, Mycobacterium
HGGAPGTRPDKRQPRDRTRDRDPQND

SEQ ID NO: 502430 - protein, 10 aa, Mycobacterium
HGGARPEGFN

SEQ ID NO: 502431 - protein, 12 aa, Mycobacterium
HGGASAAAAGLA

SEQ ID NO: 502432 - protein, 8 aa, Mycobacterium
HGGATAEF

SEQ ID NO: 502433 - protein, 4 aa, Mycobacterium
HGGD

SEQ ID NO: 502434 - protein, 6 aa, Mycobacterium
HGGDDA

SEQ ID NO: 502435 - protein, 13 aa, Mycobacterium
HGGDDGRDVRSTV

SEQ ID NO: 502436 - protein, 7 aa, Mycobacterium
HGGDDPA

SEQ ID NO: 502437 - protein, 6 aa, Mycobacterium
HGGDDQ

SEQ ID NO: 502438 - protein, 14 aa, Mycobacterium
HGGDGGDQESWQPQ

SEQ ID NO: 502439 - protein, 15 aa, Mycobacterium
HGGDGGNAGDVGAGS

SEQ ID NO: 502440 - protein, 11 aa, Mycobacterium
HGGDGGTGGTL

SEQ ID NO: 502441 - protein, 6 aa, Mycobacterium
HGGDGV

SEQ ID NO: 502442 - protein, 26 aa, Mycobacterium
HGGDPSELQVQGATRAVKGDDGSIDY

SEQ ID NO: 502443 - protein, 6 aa, Mycobacterium
HGGDSQ

SEQ ID NO: 502444 - protein, 6 aa, Mycobacterium
HGGDSS

SEQ ID NO: 502445 - protein, 12 aa, Mycobacterium
HGGDTVDDTDGL

SEQ ID NO: 502446 - protein, 5 aa, Mycobacterium
HGGEA

SEQ ID NO: 502447 - protein, 7 aa, Mycobacterium
HGGEIGN

SEQ ID NO: 502448 - protein, 5 aa, Mycobacterium
HGGEL

SEQ ID NO: 502449 - protein, 6 aa, Mycobacterium
HGGELT

SEQ ID NO: 502450 - protein, 17 aa, Mycobacterium
HGGELTAGTEVTSPPGG

SEQ ID NO: 502451 - protein, 13 aa, Mycobacterium
HGGENVVVEWRIE

SEQ ID NO: 502452 - protein, 8 aa, Mycobacterium
HGGEPASR

SEQ ID NO: 502453 - protein, 8 aa, Mycobacterium
HGGEPRRS

SEQ ID NO: 502454 - protein, 5 aa, Mycobacterium
HGGEQ

SEQ ID NO: 502455 - protein, 18 aa, Mycobacterium
HGGEQKSITVEGETVSND

SEQ ID NO: 502456 - protein, 8 aa, Mycobacterium
HGGEREFS

SEQ ID NO: 502457 - protein, 5 aa, Mycobacterium
HGGEV

SEQ ID NO: 502458 - protein, 12 aa, Mycobacterium
HGGFGASGFGKD

SEQ ID NO: 502459 - protein, 13 aa, Mycobacterium
HGGFGASGFGKDM

SEQ ID NO: 502460 - protein, 12 aa, Mycobacterium
HGGFKSSGHGKD

SEQ ID NO: 502461 - protein, 4 aa, Mycobacterium
HGGG

SEQ ID NO: 502462 - protein, 9 aa, Mycobacterium
HGGGAAAGT

SEQ ID NO: 502463 - protein, 18 aa, Mycobacterium
HGGGAFSGKDPSKVDRSA

SEQ ID NO: 502464 - protein, 8 aa, Mycobacterium
HGGGERPA

SEQ ID NO: 502465 - protein, 18 aa, Mycobacterium
HGGGGGNFSAATDDETAR

SEQ ID NO: 502466 - protein, 7 aa, Mycobacterium
HGGGLPA

SEQ ID NO: 502467 - protein, 17 aa, Mycobacterium
HGGGQERDIRSGTADVA

SEQ ID NO: 502468 - protein, 13 aa, Mycobacterium
HGGGRPGDLRAAQ

SEQ ID NO: 502469 - protein, 5 aa, Mycobacterium
HGGGS

SEQ ID NO: 502470 - protein, 9 aa, Mycobacterium
HGGGSPHSF

SEQ ID NO: 502471 - protein, 6 aa, Mycobacterium
HGGHRN

SEQ ID NO: 502472 - protein, 8 aa, Mycobacterium
HGGIGPDQ

SEQ ID NO: 502473 - protein, 6 aa, Mycobacterium
HGGLAG

SEQ ID NO: 502474 - protein, 11 aa, Mycobacterium
HGGLNGQTPYE

SEQ ID NO: 502475 - protein, 5 aa, Mycobacterium
HGGLS

SEQ ID NO: 502476 - protein, 6 aa, Mycobacterium
HGGMQR

SEQ ID NO: 502477 - protein, 6 aa, Mycobacterium
HGGNDE

SEQ ID NO: 502478 - protein, 47 aa, Mycobacterium
HGGNGGAGGLFGDGGNGEAGGSGSPGEGNSVGRSGGTGGTGGAGGAA

SEQ ID NO: 502479 - protein, 13 aa, Mycobacterium
HGGNGGDGGTSGW

SEQ ID NO: 502480 - protein, 9 aa, Mycobacterium
HGGNGGNAR

SEQ ID NO: 502481 - protein, 8 aa, Mycobacterium
HGGNPPVG

SEQ ID NO: 502482 - protein, 12 aa, Mycobacterium
HGGNRSDRDDKS

SEQ ID NO: 502483 - protein, 5 aa, Mycobacterium
HGGNV

SEQ ID NO: 502484 - protein, 55 aa, Mycobacterium
HGGPADQHRAGARPGHRDDDRRRISGPAATRPQRHRRAPAPGAERNPPRHRTRPT

SEQ ID NO: 502485 - protein, 8 aa, Mycobacterium
HGGPADWQ

SEQ ID NO: 502486 - protein, 14 aa, Mycobacterium
HGGPDGTPAYEGPR

SEQ ID NO: 502487 - protein, 5 aa, Mycobacterium
HGGPE

SEQ ID NO: 502488 - protein, 7 aa, Mycobacterium
HGGPGEP

SEQ ID NO: 502489 - protein, 6 aa, Mycobacterium
HGGPGQ

SEQ ID NO: 502490 - protein, 17 aa, Mycobacterium
HGGPGSPAMPMDQPASN

SEQ ID NO: 502491 - protein, 8 aa, Mycobacterium
HGGPKSPT

SEQ ID NO: 502492 - protein, 7 aa, Mycobacterium
HGGQAWS

SEQ ID NO: 502493 - protein, 10 aa, Mycobacterium
HGGQEPVRSV

SEQ ID NO: 502494 - protein, 15 aa, Mycobacterium
HGGQHRKEPTSAARG

SEQ ID NO: 502495 - protein, 11 aa, Mycobacterium
HGGQLSHGRTH

SEQ ID NO: 502496 - protein, 7 aa, Mycobacterium
HGGQPPI

SEQ ID NO: 502497 - protein, 15 aa, Mycobacterium
HGGQPVQLPAGGTSF

SEQ ID NO: 502498 - protein, 7 aa, Mycobacterium
HGGQRPV

SEQ ID NO: 502499 - protein, 5 aa, Mycobacterium
HGGRA

SEQ ID NO: 502500 - protein, 10 aa, Mycobacterium
HGGRDAAEAL

SEQ ID NO: 502501 - protein, 7 aa, Mycobacterium
HGGRDRT

SEQ ID NO: 502502 - protein, 8 aa, Mycobacterium
HGGRDRTA

SEQ ID NO: 502503 - protein, 5 aa, Mycobacterium
HGGRE

SEQ ID NO: 502504 - protein, 5 aa, Mycobacterium
HGGRG

SEQ ID NO: 502505 - protein, 8 aa, Mycobacterium
HGGRGATV

SEQ ID NO: 502506 - protein, 12 aa, Mycobacterium
HGGRGRRRPGRV

SEQ ID NO: 502507 - protein, 10 aa, Mycobacterium
HGGRGSGAVE

SEQ ID NO: 502508 - protein, 10 aa, Mycobacterium
HGGRNAHGRI

SEQ ID NO: 502509 - protein, 11 aa, Mycobacterium
HGGRQANGGVP

SEQ ID NO: 502510 - protein, 8 aa, Mycobacterium
HGGSETSV

SEQ ID NO: 502511 - protein, 21 aa, Mycobacterium
HGGSGQGGSGQGGGASGVSQA

SEQ ID NO: 502512 - protein, 11 aa, Mycobacterium
HGGSGTTAASL

SEQ ID NO: 502513 - protein, 5 aa, Mycobacterium
HGGSL

SEQ ID NO: 502514 - protein, 17 aa, Mycobacterium
HGGSLAGDGADAAPAGQ

SEQ ID NO: 502515 - protein, 19 aa, Mycobacterium
HGGSSIPKYSHADAPNPLV

SEQ ID NO: 502516 - protein, 8 aa, Mycobacterium
HGGTAGAI

SEQ ID NO: 502517 - protein, 6 aa, Mycobacterium
HGGTAH

SEQ ID NO: 502518 - protein, 7 aa, Mycobacterium
HGGTDTA

SEQ ID NO: 502519 - protein, 5 aa, Mycobacterium
HGGTG

SEQ ID NO: 502520 - protein, 10 aa, Mycobacterium
HGGTGDVEAG

SEQ ID NO: 502521 - protein, 6 aa, Mycobacterium
HGGTKH

SEQ ID NO: 502522 - protein, 10 aa, Mycobacterium
HGGTNPRALR

SEQ ID NO: 502523 - protein, 9 aa, Mycobacterium
HGGTNPRDL

SEQ ID NO: 502524 - protein, 12 aa, Mycobacterium
HGGTNPRDLRST

SEQ ID NO: 502525 - protein, 9 aa, Mycobacterium
HGGTPSEAD

SEQ ID NO: 502526 - protein, 16 aa, Mycobacterium
HGGTSLGEGPAQAWER

SEQ ID NO: 502527 - protein, 8 aa, Mycobacterium
HGGTTTTY

SEQ ID NO: 502528 - protein, 4 aa, Mycobacterium
HGGV

SEQ ID NO: 502529 - protein, 12 aa, Mycobacterium
HGGVGASGFGKD

SEQ ID NO: 502530 - protein, 6 aa, Mycobacterium
HGGVPS

SEQ ID NO: 502531 - protein, 4 aa, Mycobacterium
HGGW

SEQ ID NO: 502532 - protein, 5 aa, Mycobacterium
HGGYE

SEQ ID NO: 502533 - protein, 5 aa, Mycobacterium
HGGYQ

SEQ ID NO: 502534 - protein, 4 aa, Mycobacterium
HGHA

SEQ ID NO: 502535 - protein, 7 aa, Mycobacterium
HGHARQA

SEQ ID NO: 502536 - protein, 10 aa, Mycobacterium
HGHDDAATRD

SEQ ID NO: 502537 - protein, 26 aa, Mycobacterium
HGHDDHDHEHGHDDDHGHGDLDPTDP

SEQ ID NO: 502538 - protein, 4 aa, Mycobacterium
HGHG

SEQ ID NO: 502539 - protein, 13 aa, Mycobacterium
HGHGPVSALFRLD

SEQ ID NO: 502540 - protein, 11 aa, Mycobacterium
HGHPAKNNYGS

SEQ ID NO: 502541 - protein, 10 aa, Mycobacterium
HGHPEPDRSS

SEQ ID NO: 502542 - protein, 12 aa, Mycobacterium
HGHPGEDERNAE

SEQ ID NO: 502543 - protein, 11 aa, Mycobacterium
HGHPPKNNYGS

SEQ ID NO: 502544 - protein, 9 aa, Mycobacterium
HGHPRNPYS

SEQ ID NO: 502545 - protein, 9 aa, Mycobacterium
HGHQPGPTM

SEQ ID NO: 502546 - protein, 4 aa, Mycobacterium
HGHR

SEQ ID NO: 502547 - protein, 12 aa, Mycobacterium
HGHRDKPEGTIS

SEQ ID NO: 502548 - protein, 6 aa, Mycobacterium
HGHRRG

SEQ ID NO: 502549 - protein, 14 aa, Mycobacterium
HGHRRGGADQRQPI

SEQ ID NO: 502550 - protein, 13 aa, Mycobacterium
HGHRSEQAQEENG

SEQ ID NO: 502551 - protein, 5 aa, Mycobacterium
HGHSP

SEQ ID NO: 502552 - protein, 6 aa, Mycobacterium
HGHSSQ

SEQ ID NO: 502553 - protein, 20 aa, Mycobacterium
HGHSTAAGPFDSGALAGDVG

SEQ ID NO: 502554 - protein, 9 aa, Mycobacterium
HGHTPGPTM

SEQ ID NO: 502555 - protein, 9 aa, Mycobacterium
HGIDPNSIG

SEQ ID NO: 502556 - protein, 9 aa, Mycobacterium
HGIEPNSIG

SEQ ID NO: 502557 - protein, 4 aa, Mycobacterium
HGIG

SEQ ID NO: 502558 - protein, 5 aa, Mycobacterium
HGIGG

SEQ ID NO: 502559 - protein, 6 aa, Mycobacterium
HGIGGA

SEQ ID NO: 502560 - protein, 5 aa, Mycobacterium
HGIPT

SEQ ID NO: 502561 - protein, 11 aa, Mycobacterium
HGISGAAARRL

SEQ ID NO: 502562 - protein, 12 aa, Mycobacterium
HGISSSRQATSQ

SEQ ID NO: 502563 - protein, 4 aa, Mycobacterium
HGIT

SEQ ID NO: 502564 - protein, 9 aa, Mycobacterium
HGITAGENR

SEQ ID NO: 502565 - protein, 10 aa, Mycobacterium
HGKAGRRSTV

SEQ ID NO: 502566 - protein, 9 aa, Mycobacterium
HGKDATASV

SEQ ID NO: 502567 - protein, 11 aa, Mycobacterium
HGKEAAPLEGE

SEQ ID NO: 502568 - protein, 7 aa, Mycobacterium
HGKEPQW

SEQ ID NO: 502569 - protein, 23 aa, Mycobacterium
HGKGGRNAHGRITTRHKGGGHKR

SEQ ID NO: 502570 - protein, 7 aa, Mycobacterium
HGKGTGC

SEQ ID NO: 502571 - protein, 12 aa, Mycobacterium
HGKGTVALRGSA

SEQ ID NO: 502572 - protein, 11 aa, Mycobacterium
HGKGTVAVRGG

SEQ ID NO: 502573 - protein, 9 aa, Mycobacterium
HGKLSGEQA

SEQ ID NO: 502574 - protein, 6 aa, Mycobacterium
HGKNRT

SEQ ID NO: 502575 - protein, 4 aa, Mycobacterium
HGKP

SEQ ID NO: 502576 - protein, 17 aa, Mycobacterium
HGKPAGEPDWPSYDDAD

SEQ ID NO: 502577 - protein, 7 aa, Mycobacterium
HGKPGTR

SEQ ID NO: 502578 - protein, 8 aa, Mycobacterium
HGKPGTRM

SEQ ID NO: 502579 - protein, 4 aa, Mycobacterium
HGKQ

SEQ ID NO: 502580 - protein, 9 aa, Mycobacterium
HGKQGRRAT

SEQ ID NO: 502581 - protein, 5 aa, Mycobacterium
HGKQS

SEQ ID NO: 502582 - protein, 6 aa, Mycobacterium
HGKSQS

SEQ ID NO: 502583 - protein, 4 aa, Mycobacterium
HGKT

SEQ ID NO: 502584 - protein, 13 aa, Mycobacterium
HGKTVPDARGDIQ

SEQ ID NO: 502585 - protein, 5 aa, Mycobacterium
HGLAG

SEQ ID NO: 502586 - protein, 6 aa, Mycobacterium
HGLAPR

SEQ ID NO: 502587 - protein, 4 aa, Mycobacterium
HGLD

SEQ ID NO: 502588 - protein, 9 aa, Mycobacterium
HGLDGATAA

SEQ ID NO: 502589 - protein, 9 aa, Mycobacterium
HGLDSEEAI

SEQ ID NO: 502590 - protein, 14 aa, Mycobacterium
HGLNQPGPDDGRTF

SEQ ID NO: 502591 - protein, 5 aa, Mycobacterium
HGLPD

SEQ ID NO: 502592 - protein, 5 aa, Mycobacterium
HGLPH

SEQ ID NO: 502593 - protein, 8 aa, Mycobacterium
HGLPPAEP

SEQ ID NO: 502594 - protein, 46 aa, Mycobacterium
HGLPSAPPLADPTKGFQSPVPAKPGVPLGTSPAPPGYTATPGSLDP

SEQ ID NO: 502595 - protein, 12 aa, Mycobacterium
HGLPTEGHPQNH

SEQ ID NO: 502596 - protein, 6 aa, Mycobacterium
HGLPTG

SEQ ID NO: 502597 - protein, 7 aa, Mycobacterium
HGLPTPV

SEQ ID NO: 502598 - protein, 10 aa, Mycobacterium
HGLPTSATTV

SEQ ID NO: 502599 - protein, 6 aa, Mycobacterium
HGLSEP

SEQ ID NO: 502600 - protein, 10 aa, Mycobacterium
HGLSPRDIGP

SEQ ID NO: 502601 - protein, 5 aa, Mycobacterium
HGLST

SEQ ID NO: 502602 - protein, 4 aa, Mycobacterium
HGLT

SEQ ID NO: 502603 - protein, 5 aa, Mycobacterium
HGLTN

SEQ ID NO: 502604 - protein, 5 aa, Mycobacterium
HGLTS

SEQ ID NO: 502605 - protein, 6 aa, Mycobacterium
HGMDSA

SEQ ID NO: 502606 - protein, 4 aa, Mycobacterium
HGMN

SEQ ID NO: 502607 - protein, 12 aa, Mycobacterium
HGMQAPGAPEGQ

SEQ ID NO: 502608 - protein, 4 aa, Mycobacterium
HGMS

SEQ ID NO: 502609 - protein, 12 aa, Mycobacterium
HGMTSPHEREER

SEQ ID NO: 502610 - protein, 9 aa, Mycobacterium
HGNATTIGA

SEQ ID NO: 502611 - protein, 19 aa, Mycobacterium
HGNATTIGAERRLNPFLEG

SEQ ID NO: 502612 - protein, 10 aa, Mycobacterium
HGNDGGGSIR

SEQ ID NO: 502613 - protein, 11 aa, Mycobacterium
HGNDRKTLDEH

SEQ ID NO: 502614 - protein, 7 aa, Mycobacterium
HGNEAIY

SEQ ID NO: 502615 - protein, 5 aa, Mycobacterium
HGNEL

SEQ ID NO: 502616 - protein, 22 aa, Mycobacterium
HGNGASQVLDSTPGNISTAVEG

SEQ ID NO: 502617 - protein, 6 aa, Mycobacterium
HGNGET

SEQ ID NO: 502618 - protein, 9 aa, Mycobacterium
HGNHASGRQ

SEQ ID NO: 502619 - protein, 16 aa, Mycobacterium
HGNHTGQEDLPATASG

SEQ ID NO: 502620 - protein, 6 aa, Mycobacterium
HGNKEA

SEQ ID NO: 502621 - protein, 4 aa, Mycobacterium
HGNP

SEQ ID NO: 502622 - protein, 7 aa, Mycobacterium
HGNPARI

SEQ ID NO: 502623 - protein, 8 aa, Mycobacterium
HGNPGSGV

SEQ ID NO: 502624 - protein, 6 aa, Mycobacterium
HGNPIS

SEQ ID NO: 502625 - protein, 7 aa, Mycobacterium
HGNPRFT

SEQ ID NO: 502626 - protein, 6 aa, Mycobacterium
HGNPVA

SEQ ID NO: 502627 - protein, 12 aa, Mycobacterium
HGNPVPHDGETV

SEQ ID NO: 502628 - protein, 15 aa, Mycobacterium
HGNQAEEQLPPAASG

SEQ ID NO: 502629 - protein, 8 aa, Mycobacterium
HGNRERAQ

SEQ ID NO: 502630 - protein, 9 aa, Mycobacterium
HGNRQRAHY

SEQ ID NO: 502631 - protein, 13 aa, Mycobacterium
HGNRTGRGQHQGR

SEQ ID NO: 502632 - protein, 10 aa, Mycobacterium
HGNSKISSIQ

SEQ ID NO: 502633 - protein, 15 aa, Mycobacterium
HGNSTESPEEADAIA

SEQ ID NO: 502634 - protein, 4 aa, Mycobacterium
HGNT

SEQ ID NO: 502635 - protein, 7 aa, Mycobacterium
HGNTADY

SEQ ID NO: 502636 - protein, 5 aa, Mycobacterium
HGNVE

SEQ ID NO: 502637 - protein, 4 aa, Mycobacterium
HGPA

SEQ ID NO: 502638 - protein, 8 aa, Mycobacterium
HGPANDRR

SEQ ID NO: 502639 - protein, 6 aa, Mycobacterium
HGPANG

SEQ ID NO: 502640 - protein, 10 aa, Mycobacterium
HGPAPEKSVQ

SEQ ID NO: 502641 - protein, 5 aa, Mycobacterium
HGPAR

SEQ ID NO: 502642 - protein, 5 aa, Mycobacterium
HGPDA

SEQ ID NO: 502643 - protein, 15 aa, Mycobacterium
HGPDGEGYTQHTSPV

SEQ ID NO: 502644 - protein, 6 aa, Mycobacterium
HGPDGL

SEQ ID NO: 502645 - protein, 10 aa, Mycobacterium
HGPDGPGELR

SEQ ID NO: 502646 - protein, 6 aa, Mycobacterium
HGPDGQ

SEQ ID NO: 502647 - protein, 6 aa, Mycobacterium
HGPDRN

SEQ ID NO: 502648 - protein, 11 aa, Mycobacterium
HGPDSEPVEEE

SEQ ID NO: 502649 - protein, 10 aa, Mycobacterium
HGPDTEEPEV

SEQ ID NO: 502650 - protein, 15 aa, Mycobacterium
HGPDTTSSGSPIVTV

SEQ ID NO: 502651 - protein, 6 aa, Mycobacterium
HGPEAV

SEQ ID NO: 502652 - protein, 5 aa, Mycobacterium
HGPEG

SEQ ID NO: 502653 - protein, 15 aa, Mycobacterium
HGPEIDKGARWDPAE

SEQ ID NO: 502654 - protein, 11 aa, Mycobacterium
HGPESEAVEEE

SEQ ID NO: 502655 - protein, 11 aa, Mycobacterium
HGPESEQVEEE

SEQ ID NO: 502656 - protein, 14 aa, Mycobacterium
HGPEVDKGAKWDPA

SEQ ID NO: 502657 - protein, 8 aa, Mycobacterium
HGPFPESD

SEQ ID NO: 502658 - protein, 12 aa, Mycobacterium
HGPFTTGEAAQR

SEQ ID NO: 502659 - protein, 7 aa, Mycobacterium
HGPGCTD

SEQ ID NO: 502660 - protein, 9 aa, Mycobacterium
HGPGDAEHF

SEQ ID NO: 502661 - protein, 9 aa, Mycobacterium
HGPGEAGPI

SEQ ID NO: 502662 - protein, 8 aa, Mycobacterium
HGPGGGAN

SEQ ID NO: 502663 - protein, 9 aa, Mycobacterium
HGPGGTGEP

SEQ ID NO: 502664 - protein, 5 aa, Mycobacterium
HGPGL

SEQ ID NO: 502665 - protein, 6 aa, Mycobacterium
HGPGLT

SEQ ID NO: 502666 - protein, 9 aa, Mycobacterium
HGPGPNDGH

SEQ ID NO: 502667 - protein, 7 aa, Mycobacterium
HGPGQDS

SEQ ID NO: 502668 - protein, 8 aa, Mycobacterium
HGPGQGRR

SEQ ID NO: 502669 - protein, 13 aa, Mycobacterium
HGPGRTADPAPQW

SEQ ID NO: 502670 - protein, 6 aa, Mycobacterium
HGPGST

SEQ ID NO: 502671 - protein, 10 aa, Mycobacterium
HGPGTPVGDP

SEQ ID NO: 502672 - protein, 7 aa, Mycobacterium
HGPGWPS

SEQ ID NO: 502673 - protein, 4 aa, Mycobacterium
HGPI

SEQ ID NO: 502674 - protein, 4 aa, Mycobacterium
HGPK

SEQ ID NO: 502675 - protein, 6 aa, Mycobacterium
HGPKNT

SEQ ID NO: 502676 - protein, 19 aa, Mycobacterium
HGPKNTLDLPPADPQAPPY

SEQ ID NO: 502677 - protein, 19 aa, Mycobacterium
HGPKNTLELPQSQPGDPPY

SEQ ID NO: 502678 - protein, 15 aa, Mycobacterium
HGPKPRDYAQRTPKK

SEQ ID NO: 502679 - protein, 9 aa, Mycobacterium
HGPKSVLDS

SEQ ID NO: 502680 - protein, 4 aa, Mycobacterium
HGPL

SEQ ID NO: 502681 - protein, 6 aa, Mycobacterium
HGPLPE

SEQ ID NO: 502682 - protein, 10 aa, Mycobacterium
HGPLPPQGRS

SEQ ID NO: 502683 - protein, 10 aa, Mycobacterium
HGPLPPQTKS

SEQ ID NO: 502684 - protein, 6 aa, Mycobacterium
HGPNTR

SEQ ID NO: 502685 - protein, 6 aa, Mycobacterium
HGPPAD

SEQ ID NO: 502686 - protein, 10 aa, Mycobacterium
HGPPGTGKTF

SEQ ID NO: 502687 - protein, 11 aa, Mycobacterium
HGPPGTGKTFT

SEQ ID NO: 502688 - protein, 13 aa, Mycobacterium
HGPPGTGKTHTAA

SEQ ID NO: 502689 - protein, 13 aa, Mycobacterium
HGPPGTGKTYTSG

SEQ ID NO: 502690 - protein, 6 aa, Mycobacterium
HGPPNL

SEQ ID NO: 502691 - protein, 5 aa, Mycobacterium
HGPQA

SEQ ID NO: 502692 - protein, 9 aa, Mycobacterium
HGPQAGKGH

SEQ ID NO: 502693 - protein, 6 aa, Mycobacterium
HGPQGG

SEQ ID NO: 502694 - protein, 14 aa, Mycobacterium
HGPQIDKGARWDPA

SEQ ID NO: 502695 - protein, 14 aa, Mycobacterium
HGPQVDKGARWDPA

SEQ ID NO: 502696 - protein, 16 aa, Mycobacterium
HGPQVDKGARWDPSEL

SEQ ID NO: 502697 - protein, 5 aa, Mycobacterium
HGPRD

SEQ ID NO: 502698 - protein, 5 aa, Mycobacterium
HGPRE

SEQ ID NO: 502699 - protein, 5 aa, Mycobacterium
HGPRG

SEQ ID NO: 502700 - protein, 6 aa, Mycobacterium
HGPRPL

SEQ ID NO: 502701 - protein, 4 aa, Mycobacterium
HGPS

SEQ ID NO: 502702 - protein, 10 aa, Mycobacterium
HGPSATTVGG

SEQ ID NO: 502703 - protein, 10 aa, Mycobacterium
HGPSGPADPS

SEQ ID NO: 502704 - protein, 6 aa, Mycobacterium
HGPSPA

SEQ ID NO: 502705 - protein, 10 aa, Mycobacterium
HGPSQTSLSD

SEQ ID NO: 502706 - protein, 6 aa, Mycobacterium
HGPSRQ

SEQ ID NO: 502707 - protein, 6 aa, Mycobacterium
HGPTCP

SEQ ID NO: 502708 - protein, 5 aa, Mycobacterium
HGPTD

SEQ ID NO: 502709 - protein, 8 aa, Mycobacterium
HGPTDAWS

SEQ ID NO: 502710 - protein, 8 aa, Mycobacterium
HGPTTPPF

SEQ ID NO: 502711 - protein, 5 aa, Mycobacterium
HGPVE

SEQ ID NO: 502712 - protein, 11 aa, Mycobacterium
HGPVTDSDGIR

SEQ ID NO: 502713 - protein, 6 aa, Mycobacterium
HGPYPL

SEQ ID NO: 502714 - protein, 5 aa, Mycobacterium
HGQAD

SEQ ID NO: 502715 - protein, 18 aa, Mycobacterium
HGQAPTRGRKGSRESLEG

SEQ ID NO: 502716 - protein, 25 aa, Mycobacterium
HGQAQGHASTNALGTDHAVQAGFRG

SEQ ID NO: 502717 - protein, 6 aa, Mycobacterium
HGQAYT

SEQ ID NO: 502718 - protein, 10 aa, Mycobacterium
HGQDGGRYRD

SEQ ID NO: 502719 - protein, 4 aa, Mycobacterium
HGQG

SEQ ID NO: 502720 - protein, 21 aa, Mycobacterium
HGQGQGSSKSKGAQQDDEALY

SEQ ID NO: 502721 - protein, 9 aa, Mycobacterium
HGQGSTIGA

SEQ ID NO: 502722 - protein, 6 aa, Mycobacterium
HGQHTK

SEQ ID NO: 502723 - protein, 10 aa, Mycobacterium
HGQLPSKVSH

SEQ ID NO: 502724 - protein, 11 aa, Mycobacterium
HGQNPQAACDG

SEQ ID NO: 502725 - protein, 15 aa, Mycobacterium
HGQPGPDSGHRNGVD

SEQ ID NO: 502726 - protein, 12 aa, Mycobacterium
HGQPPDDERNAA

SEQ ID NO: 502727 - protein, 5 aa, Mycobacterium
HGQPR

SEQ ID NO: 502728 - protein, 12 aa, Mycobacterium
HGQSAKPRTDYS

SEQ ID NO: 502729 - protein, 12 aa, Mycobacterium
HGQSDKPRADYS

SEQ ID NO: 502730 - protein, 9 aa, Mycobacterium
HGQSESHMR

SEQ ID NO: 502731 - protein, 13 aa, Mycobacterium
HGQSPLRSLNPDW

SEQ ID NO: 502732 - protein, 13 aa, Mycobacterium
HGQSPSAYRQRHQ

SEQ ID NO: 502733 - protein, 4 aa, Mycobacterium
HGQT

SEQ ID NO: 502734 - protein, 9 aa, Mycobacterium
HGQTEVSHN

SEQ ID NO: 502735 - protein, 16 aa, Mycobacterium
HGQTRENLSLDGQGRV

SEQ ID NO: 502736 - protein, 12 aa, Mycobacterium
HGQVDSSELETR

SEQ ID NO: 502737 - protein, 8 aa, Mycobacterium
HGRAETRF

SEQ ID NO: 502738 - protein, 5 aa, Mycobacterium
HGRAG

SEQ ID NO: 502739 - protein, 15 aa, Mycobacterium
HGRAPERVTGPDPVP

SEQ ID NO: 502740 - protein, 10 aa, Mycobacterium
HGRARSQTKQ

SEQ ID NO: 502741 - protein, 15 aa, Mycobacterium
HGRASTAMPSADGQL

SEQ ID NO: 502742 - protein, 4 aa, Mycobacterium
HGRD

SEQ ID NO: 502743 - protein, 7 aa, Mycobacterium
HGRDATE

SEQ ID NO: 502744 - protein, 8 aa, Mycobacterium
HGRDATEL

SEQ ID NO: 502745 - protein, 11 aa, Mycobacterium
HGRDEAVPVPD

SEQ ID NO: 502746 - protein, 13 aa, Mycobacterium
HGRDESNPPPTDL

SEQ ID NO: 502747 - protein, 6 aa, Mycobacterium
HGRDPL

SEQ ID NO: 502748 - protein, 32 aa, Mycobacterium
HGREALGGRPFGDGTAPGPTREGERVPEAHSA

SEQ ID NO: 502749 - protein, 7 aa, Mycobacterium
HGREHRE

SEQ ID NO: 502750 - protein, 6 aa, Mycobacterium
HGREPT

SEQ ID NO: 502751 - protein, 26 aa, Mycobacterium
HGRESLGGKPFGDGTPPGPPPAGERV

SEQ ID NO: 502752 - protein, 31 aa, Mycobacterium
HGRESLGGKPFGEGTPPGPPVEAERVPPGHG

SEQ ID NO: 502753 - protein, 5 aa, Mycobacterium
HGRFP

SEQ ID NO: 502754 - protein, 5 aa, Mycobacterium
HGRGA

SEQ ID NO: 502755 - protein, 8 aa, Mycobacterium
HGRGAELG

SEQ ID NO: 502756 - protein, 6 aa, Mycobacterium
HGRGAI

SEQ ID NO: 502757 - protein, 7 aa, Mycobacterium
HGRGDSA

SEQ ID NO: 502758 - protein, 7 aa, Mycobacterium
HGRGDSQ

SEQ ID NO: 502759 - protein, 5 aa, Mycobacterium
HGRGF

SEQ ID NO: 502760 - protein, 6 aa, Mycobacterium
HGRGGI

SEQ ID NO: 502761 - protein, 7 aa, Mycobacterium
HGRGGPH

SEQ ID NO: 502762 - protein, 10 aa, Mycobacterium
HGRGGTSNSL

SEQ ID NO: 502763 - protein, 6 aa, Mycobacterium
HGRGGV

SEQ ID NO: 502764 - protein, 12 aa, Mycobacterium
HGRGPGVTGPGE

SEQ ID NO: 502765 - protein, 6 aa, Mycobacterium
HGRGRL

SEQ ID NO: 502766 - protein, 4 aa, Mycobacterium
HGRH

SEQ ID NO: 502767 - protein, 22 aa, Mycobacterium
HGRHKGARHGVATRRPAPDAAG

SEQ ID NO: 502768 - protein, 11 aa, Mycobacterium
HGRKGADIGGA

SEQ ID NO: 502769 - protein, 9 aa, Mycobacterium
HGRLDDPAI

SEQ ID NO: 502770 - protein, 9 aa, Mycobacterium
HGRNRPDAP

SEQ ID NO: 502771 - protein, 10 aa, Mycobacterium
HGRNSPDDSM

SEQ ID NO: 502772 - protein, 4 aa, Mycobacterium
HGRP

SEQ ID NO: 502773 - protein, 10 aa, Mycobacterium
HGRPDGPLTA

SEQ ID NO: 502774 - protein, 5 aa, Mycobacterium
HGRPL

SEQ ID NO: 502775 - protein, 11 aa, Mycobacterium
HGRPLDTATIP

SEQ ID NO: 502776 - protein, 13 aa, Mycobacterium
HGRPLDTATIPGS

SEQ ID NO: 502777 - protein, 8 aa, Mycobacterium
HGRPPLEQ

SEQ ID NO: 502778 - protein, 6 aa, Mycobacterium
HGRPQL

SEQ ID NO: 502779 - protein, 16 aa, Mycobacterium
HGRPTDRNAHPHRDAA

SEQ ID NO: 502780 - protein, 6 aa, Mycobacterium
HGRPTT

SEQ ID NO: 502781 - protein, 8 aa, Mycobacterium
HGRQARDA

SEQ ID NO: 502782 - protein, 8 aa, Mycobacterium
HGRQEEIG

SEQ ID NO: 502783 - protein, 6 aa, Mycobacterium
HGRRKP

SEQ ID NO: 502784 - protein, 25 aa, Mycobacterium
HGRRQAAGSRYRAGHGTDGGAQPGF

SEQ ID NO: 502785 - protein, 14 aa, Mycobacterium
HGRRQKSATVGPDD

SEQ ID NO: 502786 - protein, 13 aa, Mycobacterium
HGRRRDDPPRVQD

SEQ ID NO: 502787 - protein, 8 aa, Mycobacterium
HGRRSATP

SEQ ID NO: 502788 - protein, 6 aa, Mycobacterium
HGRRTI

SEQ ID NO: 502789 - protein, 6 aa, Mycobacterium
HGRRVG

SEQ ID NO: 502790 - protein, 11 aa, Mycobacterium
HGRSATDKPLR

SEQ ID NO: 502791 - protein, 8 aa, Mycobacterium
HGRSDPKV

SEQ ID NO: 502792 - protein, 5 aa, Mycobacterium
HGRSI

SEQ ID NO: 502793 - protein, 7 aa, Mycobacterium
HGRSNPR

SEQ ID NO: 502794 - protein, 10 aa, Mycobacterium
HGRSPATAPW

SEQ ID NO: 502795 - protein, 11 aa, Mycobacterium
HGRSPTGASYQ

SEQ ID NO: 502796 - protein, 6 aa, Mycobacterium
HGRSSW

SEQ ID NO: 502797 - protein, 9 aa, Mycobacterium
HGRTEGEPG

SEQ ID NO: 502798 - protein, 6 aa, Mycobacterium
HGRTEL

SEQ ID NO: 502799 - protein, 6 aa, Mycobacterium
HGRTPP

SEQ ID NO: 502800 - protein, 7 aa, Mycobacterium
HGRTPPC

SEQ ID NO: 502801 - protein, 9 aa, Mycobacterium
HGRTRTQAD

SEQ ID NO: 502802 - protein, 15 aa, Mycobacterium
HGRTTRVVSVGALST

SEQ ID NO: 502803 - protein, 10 aa, Mycobacterium
HGRTVQPGPL

SEQ ID NO: 502804 - protein, 4 aa, Mycobacterium
HGRV

SEQ ID NO: 502805 - protein, 4 aa, Mycobacterium
HGSA

SEQ ID NO: 502806 - protein, 6 aa, Mycobacterium
HGSAAP

SEQ ID NO: 502807 - protein, 10 aa, Mycobacterium
HGSAASRALS

SEQ ID NO: 502808 - protein, 5 aa, Mycobacterium
HGSAF

SEQ ID NO: 502809 - protein, 7 aa, Mycobacterium
HGSAGDR

SEQ ID NO: 502810 - protein, 14 aa, Mycobacterium
HGSAPGQAGGPGGL

SEQ ID NO: 502811 - protein, 7 aa, Mycobacterium
HGSAQSR

SEQ ID NO: 502812 - protein, 9 aa, Mycobacterium
HGSARTTLD

SEQ ID NO: 502813 - protein, 6 aa, Mycobacterium
HGSATS

SEQ ID NO: 502814 - protein, 5 aa, Mycobacterium
HGSDA

SEQ ID NO: 502815 - protein, 6 aa, Mycobacterium
HGSDAA

SEQ ID NO: 502816 - protein, 7 aa, Mycobacterium
HGSDDAD

SEQ ID NO: 502817 - protein, 8 aa, Mycobacterium
HGSDELKA

SEQ ID NO: 502818 - protein, 9 aa, Mycobacterium
HGSDKTQEF

SEQ ID NO: 502819 - protein, 8 aa, Mycobacterium
HGSDMDRV

SEQ ID NO: 502820 - protein, 9 aa, Mycobacterium
HGSDNDSGA

SEQ ID NO: 502821 - protein, 11 aa, Mycobacterium
HGSDPDRRSWA

SEQ ID NO: 502822 - protein, 8 aa, Mycobacterium
HGSDRASA

SEQ ID NO: 502823 - protein, 10 aa, Mycobacterium
HGSDSPESAA

SEQ ID NO: 502824 - protein, 4 aa, Mycobacterium
HGSE

SEQ ID NO: 502825 - protein, 5 aa, Mycobacterium
HGSEA

SEQ ID NO: 502826 - protein, 6 aa, Mycobacterium
HGSEAS

SEQ ID NO: 502827 - protein, 6 aa, Mycobacterium
HGSEEH

SEQ ID NO: 502828 - protein, 8 aa, Mycobacterium
HGSEEHQA

SEQ ID NO: 502829 - protein, 6 aa, Mycobacterium
HGSEEL

SEQ ID NO: 502830 - protein, 5 aa, Mycobacterium
HGSEF

SEQ ID NO: 502831 - protein, 6 aa, Mycobacterium
HGSEPD

SEQ ID NO: 502832 - protein, 4 aa, Mycobacterium
HGSG

SEQ ID NO: 502833 - protein, 6 aa, Mycobacterium
HGSGAV

SEQ ID NO: 502834 - protein, 11 aa, Mycobacterium
HGSGCDAGKTV

SEQ ID NO: 502835 - protein, 10 aa, Mycobacterium
HGSGCDARKT

SEQ ID NO: 502836 - protein, 8 aa, Mycobacterium
HGSGGKSF

SEQ ID NO: 502837 - protein, 9 aa, Mycobacterium
HGSGGKSYR

SEQ ID NO: 502838 - protein, 5 aa, Mycobacterium
HGSGI

SEQ ID NO: 502839 - protein, 12 aa, Mycobacterium
HGSGPEVTGPGE

SEQ ID NO: 502840 - protein, 7 aa, Mycobacterium
HGSGQGE

SEQ ID NO: 502841 - protein, 6 aa, Mycobacterium
HGSGRV

SEQ ID NO: 502842 - protein, 8 aa, Mycobacterium
HGSGSEQS

SEQ ID NO: 502843 - protein, 9 aa, Mycobacterium
HGSGVGAGD

SEQ ID NO: 502844 - protein, 12 aa, Mycobacterium
HGSHATGTEPGA

SEQ ID NO: 502845 - protein, 5 aa, Mycobacterium
HGSHP

SEQ ID NO: 502846 - protein, 4 aa, Mycobacterium
HGSI

SEQ ID NO: 502847 - protein, 10 aa, Mycobacterium
HGSIAGADYD

SEQ ID NO: 502848 - protein, 6 aa, Mycobacterium
HGSKEL

SEQ ID NO: 502849 - protein, 5 aa, Mycobacterium
HGSLR

SEQ ID NO: 502850 - protein, 17 aa, Mycobacterium
HGSLTAAEQTVPLLLAH

SEQ ID NO: 502851 - protein, 11 aa, Mycobacterium
HGSNTLSDDTW

SEQ ID NO: 502852 - protein, 4 aa, Mycobacterium
HGSP

SEQ ID NO: 502853 - protein, 8 aa, Mycobacterium
HGSPAGVE

SEQ ID NO: 502854 - protein, 7 aa, Mycobacterium
HGSPEQI

SEQ ID NO: 502855 - protein, 7 aa, Mycobacterium
HGSPGGA

SEQ ID NO: 502856 - protein, 14 aa, Mycobacterium
HGSPGGTLIDESRS

SEQ ID NO: 502857 - protein, 9 aa, Mycobacterium
HGSPKTKEF

SEQ ID NO: 502858 - protein, 6 aa, Mycobacterium
HGSPNE

SEQ ID NO: 502859 - protein, 5 aa, Mycobacterium
HGSPP

SEQ ID NO: 502860 - protein, 7 aa, Mycobacterium
HGSQTEI

SEQ ID NO: 502861 - protein, 6 aa, Mycobacterium
HGSRRR

SEQ ID NO: 502862 - protein, 13 aa, Mycobacterium
HGSSAKIAEELGP

SEQ ID NO: 502863 - protein, 12 aa, Mycobacterium
HGSSAKPRGDYS

SEQ ID NO: 502864 - protein, 8 aa, Mycobacterium
HGSSATLK

SEQ ID NO: 502865 - protein, 10 aa, Mycobacterium
HGSSPGAALR

SEQ ID NO: 502866 - protein, 17 aa, Mycobacterium
HGSSPHSAALPVAHSSV

SEQ ID NO: 502867 - protein, 5 aa, Mycobacterium
HGSST

SEQ ID NO: 502868 - protein, 7 aa, Mycobacterium
HGSTLGG

SEQ ID NO: 502869 - protein, 5 aa, Mycobacterium
HGSTT

SEQ ID NO: 502870 - protein, 11 aa, Mycobacterium
HGSVRSGDPVQ

SEQ ID NO: 502871 - protein, 20 aa, Mycobacterium
HGSVSKEQRAQVEDDLKSGR

SEQ ID NO: 502872 - protein, 7 aa, Mycobacterium
HGSVSTI

SEQ ID NO: 502873 - protein, 5 aa, Mycobacterium
HGSYG

SEQ ID NO: 502874 - protein, 4 aa, Mycobacterium
HGTA

SEQ ID NO: 502875 - protein, 5 aa, Mycobacterium
HGTAS

SEQ ID NO: 502876 - protein, 9 aa, Mycobacterium
HGTASGTLT

SEQ ID NO: 502877 - protein, 10 aa, Mycobacterium
HGTATPAGDP

SEQ ID NO: 502878 - protein, 15 aa, Mycobacterium
HGTATPIGDAAEANA

SEQ ID NO: 502879 - protein, 15 aa, Mycobacterium
HGTATPIGDTAEANA

SEQ ID NO: 502880 - protein, 10 aa, Mycobacterium
HGTATRLGDP

SEQ ID NO: 502881 - protein, 12 aa, Mycobacterium
HGTATTLGDPIE

SEQ ID NO: 502882 - protein, 6 aa, Mycobacterium
HGTDAG

SEQ ID NO: 502883 - protein, 9 aa, Mycobacterium
HGTDAQKSH

SEQ ID NO: 502884 - protein, 8 aa, Mycobacterium
HGTDDDAY

SEQ ID NO: 502885 - protein, 8 aa, Mycobacterium
HGTDEQKQ

SEQ ID NO: 502886 - protein, 8 aa, Mycobacterium
HGTDEQKR

SEQ ID NO: 502887 - protein, 8 aa, Mycobacterium
HGTDEQQQ

SEQ ID NO: 502888 - protein, 8 aa, Mycobacterium
HGTDGARA

SEQ ID NO: 502889 - protein, 10 aa, Mycobacterium
HGTDPKTRGA

SEQ ID NO: 502890 - protein, 9 aa, Mycobacterium
HGTDPRSYY

SEQ ID NO: 502891 - protein, 6 aa, Mycobacterium
HGTDRA

SEQ ID NO: 502892 - protein, 8 aa, Mycobacterium
HGTEAQKQ

SEQ ID NO: 502893 - protein, 6 aa, Mycobacterium
HGTEDQ

SEQ ID NO: 502894 - protein, 8 aa, Mycobacterium
HGTEEQKK

SEQ ID NO: 502895 - protein, 8 aa, Mycobacterium
HGTEEQKR

SEQ ID NO: 502896 - protein, 6 aa, Mycobacterium
HGTGEF

SEQ ID NO: 502897 - protein, 212 aa, Mycobacterium
HGTGGAGGEGGSGGIAGDGGKGAAGTFGGGDGVGGAGGRGGDPGLGGAGGAGGTGSTIGAHGADGARPNSGGNGGAGGQGADALGPAFTSGATGGTGGDGGAGGLVGDGGNGGAGGRGATGGVGASATAPGASGGGGQAGGSGGSGGAGGAGGALAGTGGAGGEGGTGGDGGTGGNGAGGAPGAAAGAAGGNGGNGGVGGSGGIGGNGGAAG

SEQ ID NO: 502898 - protein, 23 aa, Mycobacterium
HGTGGRNAHGRITTRHKGGGHKR

SEQ ID NO: 502899 - protein, 7 aa, Mycobacterium
HGTGGYR

SEQ ID NO: 502900 - protein, 11 aa, Mycobacterium
HGTGTKVGDAI

SEQ ID NO: 502901 - protein, 11 aa, Mycobacterium
HGTGTLKGDPI

SEQ ID NO: 502902 - protein, 12 aa, Mycobacterium
HGTGTPTGDPVE

SEQ ID NO: 502903 - protein, 12 aa, Mycobacterium
HGTGTPVGDPIE

SEQ ID NO: 502904 - protein, 12 aa, Mycobacterium
HGTGTQANDECE

SEQ ID NO: 502905 - protein, 9 aa, Mycobacterium
HGTGTQLGD

SEQ ID NO: 502906 - protein, 10 aa, Mycobacterium
HGTGTRAGDP

SEQ ID NO: 502907 - protein, 9 aa, Mycobacterium
HGTGTRLGD

SEQ ID NO: 502908 - protein, 11 aa, Mycobacterium
HGTGTRLGDPI

SEQ ID NO: 502909 - protein, 11 aa, Mycobacterium
HGTGTRLGDRT

SEQ ID NO: 502910 - protein, 13 aa, Mycobacterium
HGTGTRLGDRTEL

SEQ ID NO: 502911 - protein, 11 aa, Mycobacterium
HGTGTSLGDPI

SEQ ID NO: 502912 - protein, 16 aa, Mycobacterium
HGTGTSLGDPIEAQAA

SEQ ID NO: 502913 - protein, 28 aa, Mycobacterium
HGTGTSLGDPIEAQAAGAALGPGREPQR

SEQ ID NO: 502914 - protein, 28 aa, Mycobacterium
HGTGTSLGDPIEAQAAGAAYGIGRETND

SEQ ID NO: 502915 - protein, 19 aa, Mycobacterium
HGTGTSLGDPIEAQAAGEV

SEQ ID NO: 502916 - protein, 13 aa, Mycobacterium
HGTGTSVGDPLEA

SEQ ID NO: 502917 - protein, 10 aa, Mycobacterium
HGTGTSVGDR

SEQ ID NO: 502918 - protein, 11 aa, Mycobacterium
HGTGTTLGDPI

SEQ ID NO: 502919 - protein, 6 aa, Mycobacterium
HGTGTV

SEQ ID NO: 502920 - protein, 4 aa, Mycobacterium
HGTL

SEQ ID NO: 502921 - protein, 4 aa, Mycobacterium
HGTP

SEQ ID NO: 502922 - protein, 7 aa, Mycobacterium
HGTPEAI

SEQ ID NO: 502923 - protein, 6 aa, Mycobacterium
HGTPEQ

SEQ ID NO: 502924 - protein, 10 aa, Mycobacterium
HGTPFRRASE

SEQ ID NO: 502925 - protein, 11 aa, Mycobacterium
HGTPFRRASEQ

SEQ ID NO: 502926 - protein, 7 aa, Mycobacterium
HGTPKEV

SEQ ID NO: 502927 - protein, 6 aa, Mycobacterium
HGTPKQ

SEQ ID NO: 502928 - protein, 6 aa, Mycobacterium
HGTPLD

SEQ ID NO: 502929 - protein, 7 aa, Mycobacterium
HGTRPSL

SEQ ID NO: 502930 - protein, 9 aa, Mycobacterium
HGTRQTDDG

SEQ ID NO: 502931 - protein, 17 aa, Mycobacterium
HGTSGAKAEDEPDDPDH

SEQ ID NO: 502932 - protein, 14 aa, Mycobacterium
HGTSPRQWRALPPR

SEQ ID NO: 502933 - protein, 14 aa, Mycobacterium
HGTSSSIGDGATVG

SEQ ID NO: 502934 - protein, 4 aa, Mycobacterium
HGTT

SEQ ID NO: 502935 - protein, 12 aa, Mycobacterium
HGTTAQAGQSDH

SEQ ID NO: 502936 - protein, 7 aa, Mycobacterium
HGTTGEH

SEQ ID NO: 502937 - protein, 5 aa, Mycobacterium
HGTTP

SEQ ID NO: 502938 - protein, 125 aa, Mycobacterium
HGTTPGANGQYGGDGGEGGRGGVGGAGGAGGAAAAGQAGSQGDGGNGGDGGDGGTPGNGGSGADGANSAIGVSAGDGGYGGAGGNAGAGGLGGEGGAGSTSGASGLDGSQAAGGDGGNGGFGGTG

SEQ ID NO: 502939 - protein, 4 aa, Mycobacterium
HGTY

SEQ ID NO: 502940 - protein, 4 aa, Mycobacterium
HGVA

SEQ ID NO: 502941 - protein, 4 aa, Mycobacterium
HGVD

SEQ ID NO: 502942 - protein, 6 aa, Mycobacterium
HGVDPA

SEQ ID NO: 502943 - protein, 5 aa, Mycobacterium
HGVDR

SEQ ID NO: 502944 - protein, 12 aa, Mycobacterium
HGVEGSIARAGG

SEQ ID NO: 502945 - protein, 12 aa, Mycobacterium
HGVEGSIAREGG

SEQ ID NO: 502946 - protein, 12 aa, Mycobacterium
HGVEGSVARAGG

SEQ ID NO: 502947 - protein, 16 aa, Mycobacterium
HGVEPQARAAGEPEVV

SEQ ID NO: 502948 - protein, 6 aa, Mycobacterium
HGVGET

SEQ ID NO: 502949 - protein, 8 aa, Mycobacterium
HGVGPDTA

SEQ ID NO: 502950 - protein, 6 aa, Mycobacterium
HGVGPE

SEQ ID NO: 502951 - protein, 9 aa, Mycobacterium
HGVHPGDPY

SEQ ID NO: 502952 - protein, 8 aa, Mycobacterium
HGVNAPRR

SEQ ID NO: 502953 - protein, 5 aa, Mycobacterium
HGVPA

SEQ ID NO: 502954 - protein, 5 aa, Mycobacterium
HGVPD

SEQ ID NO: 502955 - protein, 30 aa, Mycobacterium
HGVPGSSNHTNTARAEANSSRRYRIGSRSE

SEQ ID NO: 502956 - protein, 8 aa, Mycobacterium
HGVPPGRR

SEQ ID NO: 502957 - protein, 6 aa, Mycobacterium
HGVPTS

SEQ ID NO: 502958 - protein, 11 aa, Mycobacterium
HGVQPSESVEA

SEQ ID NO: 502959 - protein, 10 aa, Mycobacterium
HGVRTAPQQS

SEQ ID NO: 502960 - protein, 4 aa, Mycobacterium
HGVS

SEQ ID NO: 502961 - protein, 12 aa, Mycobacterium
HGVSDSVARAGG

SEQ ID NO: 502962 - protein, 11 aa, Mycobacterium
HGVSKMDGSTI

SEQ ID NO: 502963 - protein, 9 aa, Mycobacterium
HGVSSEAAR

SEQ ID NO: 502964 - protein, 5 aa, Mycobacterium
HGVTG

SEQ ID NO: 502965 - protein, 12 aa, Mycobacterium
HGVTKSGVSAFP

SEQ ID NO: 502966 - protein, 6 aa, Mycobacterium
HGVTPL

SEQ ID NO: 502967 - protein, 9 aa, Mycobacterium
HGWTASGEK

SEQ ID NO: 502968 - protein, 8 aa, Mycobacterium
HGYAASSL

SEQ ID NO: 502969 - protein, 11 aa, Mycobacterium
HGYATDVSDGV

SEQ ID NO: 502970 - protein, 8 aa, Mycobacterium
HGYDPDKL

SEQ ID NO: 502971 - protein, 7 aa, Mycobacterium
HGYDTTD

SEQ ID NO: 502972 - protein, 13 aa, Mycobacterium
HGYENGKSRWPDE

SEQ ID NO: 502973 - protein, 8 aa, Mycobacterium
HGYGTEVP

SEQ ID NO: 502974 - protein, 14 aa, Mycobacterium
HGYGTRGDLASQGG

SEQ ID NO: 502975 - protein, 4 aa, Mycobacterium
HGYP

SEQ ID NO: 502976 - protein, 14 aa, Mycobacterium
HGYSQGPADVPTPA

SEQ ID NO: 502977 - protein, 10 aa, Mycobacterium
HGYSTDVSDG

SEQ ID NO: 502978 - protein, 20 aa, Mycobacterium
HGYTRRPGGQIQDATDFNPS

SEQ ID NO: 502979 - protein, 21 aa, Mycobacterium
HGYTTGQTRDRKSGEPTASTV

SEQ ID NO: 502980 - protein, 9 aa, Mycobacterium
HHAPDGAGV

SEQ ID NO: 502981 - protein, 6 aa, Mycobacterium
HHAPGT

SEQ ID NO: 502982 - protein, 7 aa, Mycobacterium
HHAPTEH

SEQ ID NO: 502983 - protein, 5 aa, Mycobacterium
HHASG

SEQ ID NO: 502984 - protein, 6 aa, Mycobacterium
HHATGH

SEQ ID NO: 502985 - protein, 7 aa, Mycobacterium
HHATPSQ

SEQ ID NO: 502986 - protein, 7 aa, Mycobacterium
HHDGDPM

SEQ ID NO: 502987 - protein, 13 aa, Mycobacterium
HHDGGPTTAHNGL

SEQ ID NO: 502988 - protein, 13 aa, Mycobacterium
HHDGGTEEIEGVP

SEQ ID NO: 502989 - protein, 7 aa, Mycobacterium
HHDPEGT

SEQ ID NO: 502990 - protein, 9 aa, Mycobacterium
HHDPRQGLT

SEQ ID NO: 502991 - protein, 4 aa, Mycobacterium
HHDR

SEQ ID NO: 502992 - protein, 5 aa, Mycobacterium
HHDRE

SEQ ID NO: 502993 - protein, 15 aa, Mycobacterium
HHDRPRRVRKPGEPL

SEQ ID NO: 502994 - protein, 15 aa, Mycobacterium
HHEAEADAAVAAIAS

SEQ ID NO: 502995 - protein, 15 aa, Mycobacterium
HHEAEADATVAAIAA

SEQ ID NO: 502996 - protein, 8 aa, Mycobacterium
HHEGAESV

SEQ ID NO: 502997 - protein, 6 aa, Mycobacterium
HHEGSR

SEQ ID NO: 502998 - protein, 8 aa, Mycobacterium
HHEGTPRS

SEQ ID NO: 502999 - protein, 14 aa, Mycobacterium
HHEKTEGAYDAETQ

SEQ ID NO: 503000 - protein, 7 aa, Mycobacterium
HHEQTSE

SEQ ID NO: 503001 - protein, 15 aa, Mycobacterium
HHERLDGSGYPRGLA

SEQ ID NO: 503002 - protein, 11 aa, Mycobacterium
HHERTDDPDDT

SEQ ID NO: 503003 - protein, 6 aa, Mycobacterium
HHETQG

SEQ ID NO: 503004 - protein, 14 aa, Mycobacterium
HHGAPEKARERARR

SEQ ID NO: 503005 - protein, 15 aa, Mycobacterium
HHGAPEKARQRARRK

SEQ ID NO: 503006 - protein, 7 aa, Mycobacterium
HHGASAA

SEQ ID NO: 503007 - protein, 5 aa, Mycobacterium
HHGAT

SEQ ID NO: 503008 - protein, 5 aa, Mycobacterium
HHGDA

SEQ ID NO: 503009 - protein, 10 aa, Mycobacterium
HHGDPGPNVD

SEQ ID NO: 503010 - protein, 8 aa, Mycobacterium
HHGDPPPE

SEQ ID NO: 503011 - protein, 8 aa, Mycobacterium
HHGGPADL

SEQ ID NO: 503012 - protein, 11 aa, Mycobacterium
HHGKGKLDARG

SEQ ID NO: 503013 - protein, 6 aa, Mycobacterium
HHGLSD

SEQ ID NO: 503014 - protein, 12 aa, Mycobacterium
HHGPATERRYTY

SEQ ID NO: 503015 - protein, 9 aa, Mycobacterium
HHGPDGKPA

SEQ ID NO: 503016 - protein, 7 aa, Mycobacterium
HHGPGAY

SEQ ID NO: 503017 - protein, 5 aa, Mycobacterium
HHGPV

SEQ ID NO: 503018 - protein, 11 aa, Mycobacterium
HHGQGKLDARA

SEQ ID NO: 503019 - protein, 10 aa, Mycobacterium
HHGQPTRRHG

SEQ ID NO: 503020 - protein, 21 aa, Mycobacterium
HHGSEAAAGATVSAVSRSDTL

SEQ ID NO: 503021 - protein, 6 aa, Mycobacterium
HHGSGV

SEQ ID NO: 503022 - protein, 9 aa, Mycobacterium
HHGSPSTAL

SEQ ID NO: 503023 - protein, 9 aa, Mycobacterium
HHGSSIAST

SEQ ID NO: 503024 - protein, 10 aa, Mycobacterium
HHGTPSFAGD

SEQ ID NO: 503025 - protein, 4 aa, Mycobacterium
HHGV

SEQ ID NO: 503026 - protein, 17 aa, Mycobacterium
HHKASDASVADLADDPD

SEQ ID NO: 503027 - protein, 11 aa, Mycobacterium
HHLSASDDRNF

SEQ ID NO: 503028 - protein, 4 aa, Mycobacterium
HHNP

SEQ ID NO: 503029 - protein, 10 aa, Mycobacterium
HHNTPPPDGL

SEQ ID NO: 503030 - protein, 6 aa, Mycobacterium
HHPDGS

SEQ ID NO: 503031 - protein, 9 aa, Mycobacterium
HHPDGTGAT

SEQ ID NO: 503032 - protein, 10 aa, Mycobacterium
HHPDGTPRGG

SEQ ID NO: 503033 - protein, 8 aa, Mycobacterium
HHPEGGLG

SEQ ID NO: 503034 - protein, 5 aa, Mycobacterium
HHPGP

SEQ ID NO: 503035 - protein, 8 aa, Mycobacterium
HHPGPEAV

SEQ ID NO: 503036 - protein, 5 aa, Mycobacterium
HHPGS

SEQ ID NO: 503037 - protein, 6 aa, Mycobacterium
HHPHPR

SEQ ID NO: 503038 - protein, 47 aa, Mycobacterium
HHPPADKGWTTRKNTTATANGHPHPPRSRPTPHQHAPPQKTPPHRRR

SEQ ID NO: 503039 - protein, 6 aa, Mycobacterium
HHPQSY

SEQ ID NO: 503040 - protein, 14 aa, Mycobacterium
HHPSEGAPEDTTGL

SEQ ID NO: 503041 - protein, 5 aa, Mycobacterium
HHPSH

SEQ ID NO: 503042 - protein, 7 aa, Mycobacterium
HHPSPGL

SEQ ID NO: 503043 - protein, 6 aa, Mycobacterium
HHQKGD

SEQ ID NO: 503044 - protein, 5 aa, Mycobacterium
HHRGA

SEQ ID NO: 503045 - protein, 22 aa, Mycobacterium
HHRGEEPGSSVKAAQQRAEKAA

SEQ ID NO: 503046 - protein, 14 aa, Mycobacterium
HHRPQGPAGRREGR

SEQ ID NO: 503047 - protein, 13 aa, Mycobacterium
HHRSDGGLQAVTD

SEQ ID NO: 503048 - protein, 11 aa, Mycobacterium
HHRSQESTRRT

SEQ ID NO: 503049 - protein, 7 aa, Mycobacterium
HHRTGKP

SEQ ID NO: 503050 - protein, 10 aa, Mycobacterium
HHRTPSSSVS

SEQ ID NO: 503051 - protein, 4 aa, Mycobacterium
HHSD

SEQ ID NO: 503052 - protein, 5 aa, Mycobacterium
HHSDQ

SEQ ID NO: 503053 - protein, 8 aa, Mycobacterium
HHSESPEA

SEQ ID NO: 503054 - protein, 7 aa, Mycobacterium
HHSESTE

SEQ ID NO: 503055 - protein, 7 aa, Mycobacterium
HHSGPGE

SEQ ID NO: 503056 - protein, 6 aa, Mycobacterium
HHSNVD

SEQ ID NO: 503057 - protein, 4 aa, Mycobacterium
HHSR

SEQ ID NO: 503058 - protein, 6 aa, Mycobacterium
HHSTRN

SEQ ID NO: 503059 - protein, 10 aa, Mycobacterium
HHTDDDGHDR

SEQ ID NO: 503060 - protein, 11 aa, Mycobacterium
HHTPGSAVSAR

SEQ ID NO: 503061 - protein, 7 aa, Mycobacterium
HHTPKDV

SEQ ID NO: 503062 - protein, 14 aa, Mycobacterium
HIADPGRIDARGRR

SEQ ID NO: 503063 - protein, 9 aa, Mycobacterium
HIAESDEEA

SEQ ID NO: 503064 - protein, 15 aa, Mycobacterium
HIDSAGQVEKFRRRY

SEQ ID NO: 503065 - protein, 6 aa, Mycobacterium
HIEPGR

SEQ ID NO: 503066 - protein, 12 aa, Mycobacterium
HIEQGETAEQTA

SEQ ID NO: 503067 - protein, 4 aa, Mycobacterium
HIES

SEQ ID NO: 503068 - protein, 9 aa, Mycobacterium
HIESSTDAL

SEQ ID NO: 503069 - protein, 4 aa, Mycobacterium
HIET

SEQ ID NO: 503070 - protein, 4 aa, Mycobacterium
HIGD

SEQ ID NO: 503071 - protein, 7 aa, Mycobacterium
HIGDSRT

SEQ ID NO: 503072 - protein, 8 aa, Mycobacterium
HIGDSRTC

SEQ ID NO: 503073 - protein, 7 aa, Mycobacterium
HIGGDGG

SEQ ID NO: 503074 - protein, 20 aa, Mycobacterium
HIGGGNAGNAGNGGTGGSGG

SEQ ID NO: 503075 - protein, 16 aa, Mycobacterium
HIGGNAYSEPEPETGI

SEQ ID NO: 503076 - protein, 20 aa, Mycobacterium
HIGGNSSGAAGSSGDGPALQ

SEQ ID NO: 503077 - protein, 11 aa, Mycobacterium
HIGREASEPMR

SEQ ID NO: 503078 - protein, 13 aa, Mycobacterium
HIGSSAQTVLVQR

SEQ ID NO: 503079 - protein, 5 aa, Mycobacterium
HIPAG

SEQ ID NO: 503080 - protein, 7 aa, Mycobacterium
HIPEGSA

SEQ ID NO: 503081 - protein, 11 aa, Mycobacterium
HIPGGSGTASR

SEQ ID NO: 503082 - protein, 18 aa, Mycobacterium
HIPGPIDGPTRDPAELPE

SEQ ID NO: 503083 - protein, 8 aa, Mycobacterium
HIPKGSAA

SEQ ID NO: 503084 - protein, 9 aa, Mycobacterium
HIPQERADQ

SEQ ID NO: 503085 - protein, 7 aa, Mycobacterium
HIPQGSA

SEQ ID NO: 503086 - protein, 27 aa, Mycobacterium
HISAPQRVSNPAHQTRKGGLPGGGQAG

SEQ ID NO: 503087 - protein, 6 aa, Mycobacterium
HISDSR

SEQ ID NO: 503088 - protein, 7 aa, Mycobacterium
HISDSRS

SEQ ID NO: 503089 - protein, 7 aa, Mycobacterium
HISGESL

SEQ ID NO: 503090 - protein, 7 aa, Mycobacterium
HISPRTA

SEQ ID NO: 503091 - protein, 10 aa, Mycobacterium
HKAEAEQHIR

SEQ ID NO: 503092 - protein, 9 aa, Mycobacterium
HKAEKGRRR

SEQ ID NO: 503093 - protein, 13 aa, Mycobacterium
HKAGGKTTPIGTV

SEQ ID NO: 503094 - protein, 10 aa, Mycobacterium
HKAGGQDTPI

SEQ ID NO: 503095 - protein, 17 aa, Mycobacterium
HKAGSRPGMLSGGQQQR

SEQ ID NO: 503096 - protein, 6 aa, Mycobacterium
HKAKVA

SEQ ID NO: 503097 - protein, 8 aa, Mycobacterium
HKARAPYQ

SEQ ID NO: 503098 - protein, 7 aa, Mycobacterium
HKARTDA

SEQ ID NO: 503099 - protein, 11 aa, Mycobacterium
HKASAEGKHGL

SEQ ID NO: 503100 - protein, 7 aa, Mycobacterium
HKATAEQ

SEQ ID NO: 503101 - protein, 8 aa, Mycobacterium
HKATVGEI

SEQ ID NO: 503102 - protein, 10 aa, Mycobacterium
HKDDDEDAKR

SEQ ID NO: 503103 - protein, 9 aa, Mycobacterium
HKDTDGGWR

SEQ ID NO: 503104 - protein, 10 aa, Mycobacterium
HKDTRAGSSF

SEQ ID NO: 503105 - protein, 10 aa, Mycobacterium
HKDWDGPRGY

SEQ ID NO: 503106 - protein, 9 aa, Mycobacterium
HKEAPSKGW

SEQ ID NO: 503107 - protein, 17 aa, Mycobacterium
HKEERQRQRGRRAPSKP

SEQ ID NO: 503108 - protein, 12 aa, Mycobacterium
HKEGERGGGAGH

SEQ ID NO: 503109 - protein, 4 aa, Mycobacterium
HKES

SEQ ID NO: 503110 - protein, 8 aa, Mycobacterium
HKESDPEL

SEQ ID NO: 503111 - protein, 4 aa, Mycobacterium
HKGK

SEQ ID NO: 503112 - protein, 10 aa, Mycobacterium
HKGPDGNGTD

SEQ ID NO: 503113 - protein, 6 aa, Mycobacterium
HKGQPT

SEQ ID NO: 503114 - protein, 5 aa, Mycobacterium
HKGRE

SEQ ID NO: 503115 - protein, 5 aa, Mycobacterium
HKGST

SEQ ID NO: 503116 - protein, 8 aa, Mycobacterium
HKGTGGWT

SEQ ID NO: 503117 - protein, 6 aa, Mycobacterium
HKGTPV

SEQ ID NO: 503118 - protein, 18 aa, Mycobacterium
HKGTSAKPSTTTTPLSGA

SEQ ID NO: 503119 - protein, 8 aa, Mycobacterium
HKHPESEP

SEQ ID NO: 503120 - protein, 7 aa, Mycobacterium
HKHSPDE

SEQ ID NO: 503121 - protein, 9 aa, Mycobacterium
HKLAGNGWQ

SEQ ID NO: 503122 - protein, 6 aa, Mycobacterium
HKLSDD

SEQ ID NO: 503123 - protein, 6 aa, Mycobacterium
HKLSED

SEQ ID NO: 503124 - protein, 8 aa, Mycobacterium
HKLSSGAA

SEQ ID NO: 503125 - protein, 6 aa, Mycobacterium
HKLTPR

SEQ ID NO: 503126 - protein, 5 aa, Mycobacterium
HKNGG

SEQ ID NO: 503127 - protein, 16 aa, Mycobacterium
HKNKYANELSGGQQQR

SEQ ID NO: 503128 - protein, 7 aa, Mycobacterium
HKNRQRV

SEQ ID NO: 503129 - protein, 9 aa, Mycobacterium
HKPATAGWK

SEQ ID NO: 503130 - protein, 5 aa, Mycobacterium
HKPDA

SEQ ID NO: 503131 - protein, 24 aa, Mycobacterium
HKPDGNRHDGVNARAAPYCPARRL

SEQ ID NO: 503132 - protein, 4 aa, Mycobacterium
HKPG

SEQ ID NO: 503133 - protein, 16 aa, Mycobacterium
HKPGAVHNGDNGDVAD

SEQ ID NO: 503134 - protein, 5 aa, Mycobacterium
HKPGL

SEQ ID NO: 503135 - protein, 15 aa, Mycobacterium
HKPGTECEREPGTAG

SEQ ID NO: 503136 - protein, 4 aa, Mycobacterium
HKPH

SEQ ID NO: 503137 - protein, 6 aa, Mycobacterium
HKPHGD

SEQ ID NO: 503138 - protein, 21 aa, Mycobacterium
HKPISSDSGTGKKGGHDGQSF

SEQ ID NO: 503139 - protein, 7 aa, Mycobacterium
HKPNGSH

SEQ ID NO: 503140 - protein, 12 aa, Mycobacterium
HKPPVTSSTDPL

SEQ ID NO: 503141 - protein, 20 aa, Mycobacterium
HKPRGPSATPWVRADQATVT

SEQ ID NO: 503142 - protein, 4 aa, Mycobacterium
HKPT

SEQ ID NO: 503143 - protein, 7 aa, Mycobacterium
HKPTEGE

SEQ ID NO: 503144 - protein, 7 aa, Mycobacterium
HKPTFAP

SEQ ID NO: 503145 - protein, 4 aa, Mycobacterium
HKPV

SEQ ID NO: 503146 - protein, 7 aa, Mycobacterium
HKPYAQR

SEQ ID NO: 503147 - protein, 5 aa, Mycobacterium
HKPYV

SEQ ID NO: 503148 - protein, 7 aa, Mycobacterium
HKQESVN

SEQ ID NO: 503149 - protein, 10 aa, Mycobacterium
HKQTAAPSLA

SEQ ID NO: 503150 - protein, 4 aa, Mycobacterium
HKRG

SEQ ID NO: 503151 - protein, 6 aa, Mycobacterium
HKRGLD

SEQ ID NO: 503152 - protein, 8 aa, Mycobacterium
HKSAKYGV

SEQ ID NO: 503153 - protein, 6 aa, Mycobacterium
HKSAPG

SEQ ID NO: 503154 - protein, 19 aa, Mycobacterium
HKSDRQRRAGRQAAEMGRP

SEQ ID NO: 503155 - protein, 4 aa, Mycobacterium
HKSQ

SEQ ID NO: 503156 - protein, 6 aa, Mycobacterium
HKSSEE

SEQ ID NO: 503157 - protein, 8 aa, Mycobacterium
HKTDTPVT

SEQ ID NO: 503158 - protein, 10 aa, Mycobacterium
HKTPATPAQL

SEQ ID NO: 503159 - protein, 17 aa, Mycobacterium
HKVPTADLEDDRPALPD

SEQ ID NO: 503160 - protein, 4 aa, Mycobacterium
HKVT

SEQ ID NO: 503161 - protein, 12 aa, Mycobacterium
HKWDSGKRIPAE

SEQ ID NO: 503162 - protein, 6 aa, Mycobacterium
HKYGGT

SEQ ID NO: 503163 - protein, 14 aa, Mycobacterium
HLADPGRVDGAGRR

SEQ ID NO: 503164 - protein, 11 aa, Mycobacterium
HLAPPADESLK

SEQ ID NO: 503165 - protein, 8 aa, Mycobacterium
HLASSGTA

SEQ ID NO: 503166 - protein, 9 aa, Mycobacterium
HLDDAEGPA

SEQ ID NO: 503167 - protein, 6 aa, Mycobacterium
HLDDAG

SEQ ID NO: 503168 - protein, 17 aa, Mycobacterium
HLDGTISNGDPGTDSSR

SEQ ID NO: 503169 - protein, 10 aa, Mycobacterium
HLDPHEDPQR

SEQ ID NO: 503170 - protein, 5 aa, Mycobacterium
HLDPQ

SEQ ID NO: 503171 - protein, 6 aa, Mycobacterium
HLDRTE

SEQ ID NO: 503172 - protein, 13 aa, Mycobacterium
HLDSTRAVSPLRA

SEQ ID NO: 503173 - protein, 14 aa, Mycobacterium
HLDSTRAVSPLRAA

SEQ ID NO: 503174 - protein, 8 aa, Mycobacterium
HLDTEAAT

SEQ ID NO: 503175 - protein, 10 aa, Mycobacterium
HLDTETRSLR

SEQ ID NO: 503176 - protein, 21 aa, Mycobacterium
HLDTGQSRTNDHHHPERFIRR

SEQ ID NO: 503177 - protein, 20 aa, Mycobacterium
HLEGKASAEYSGDHTSSIRR

SEQ ID NO: 503178 - protein, 22 aa, Mycobacterium
HLEGKATAEYSADHTSSIRREA

SEQ ID NO: 503179 - protein, 20 aa, Mycobacterium
HLEGKATAEYSGDHTSSIRR

SEQ ID NO: 503180 - protein, 11 aa, Mycobacterium
HLEGTAPYSRE

SEQ ID NO: 503181 - protein, 21 aa, Mycobacterium
HLEPATPPAPADDTAEPDELT

SEQ ID NO: 503182 - protein, 8 aa, Mycobacterium
HLEPGDGP

SEQ ID NO: 503183 - protein, 8 aa, Mycobacterium
HLEPSERP

SEQ ID NO: 503184 - protein, 6 aa, Mycobacterium
HLEPSG

SEQ ID NO: 503185 - protein, 10 aa, Mycobacterium
HLGATAADYS

SEQ ID NO: 503186 - protein, 7 aa, Mycobacterium
HLGDRNK

SEQ ID NO: 503187 - protein, 4 aa, Mycobacterium
HLGG

SEQ ID NO: 503188 - protein, 9 aa, Mycobacterium
HLGGTPPAV

SEQ ID NO: 503189 - protein, 6 aa, Mycobacterium
HLGPGD

SEQ ID NO: 503190 - protein, 14 aa, Mycobacterium
HLGPRRALTGEPLR

SEQ ID NO: 503191 - protein, 8 aa, Mycobacterium
HLGSGQTV

SEQ ID NO: 503192 - protein, 8 aa, Mycobacterium
HLGSPEDV

SEQ ID NO: 503193 - protein, 6 aa, Mycobacterium
HLNERG

SEQ ID NO: 503194 - protein, 8 aa, Mycobacterium
HLNGPGGD

SEQ ID NO: 503195 - protein, 7 aa, Mycobacterium
HLNPGGT

SEQ ID NO: 503196 - protein, 6 aa, Mycobacterium
HLNTGT

SEQ ID NO: 503197 - protein, 11 aa, Mycobacterium
HLPAEESWETG

SEQ ID NO: 503198 - protein, 9 aa, Mycobacterium
HLPAPTGAV

SEQ ID NO: 503199 - protein, 5 aa, Mycobacterium
HLPAS

SEQ ID NO: 503200 - protein, 5 aa, Mycobacterium
HLPDT

SEQ ID NO: 503201 - protein, 6 aa, Mycobacterium
HLPEDH

SEQ ID NO: 503202 - protein, 7 aa, Mycobacterium
HLPEGTT

SEQ ID NO: 503203 - protein, 6 aa, Mycobacterium
HLPEPA

SEQ ID NO: 503204 - protein, 7 aa, Mycobacterium
HLPESER

SEQ ID NO: 503205 - protein, 7 aa, Mycobacterium
HLPESGR

SEQ ID NO: 503206 - protein, 18 aa, Mycobacterium
HLPGPGDGDMDTVLANWL

SEQ ID NO: 503207 - protein, 9 aa, Mycobacterium
HLPPDSPIP

SEQ ID NO: 503208 - protein, 9 aa, Mycobacterium
HLPPGTQPR

SEQ ID NO: 503209 - protein, 14 aa, Mycobacterium
HLPSAIDGPTVGSS

SEQ ID NO: 503210 - protein, 16 aa, Mycobacterium
HLPSAIDGPTVGSSPL

SEQ ID NO: 503211 - protein, 5 aa, Mycobacterium
HLPSD

SEQ ID NO: 503212 - protein, 12 aa, Mycobacterium
HLPSGVDEEEFA

SEQ ID NO: 503213 - protein, 5 aa, Mycobacterium
HLPTT

SEQ ID NO: 503214 - protein, 16 aa, Mycobacterium
HLRDTGGVGDRQSPLG

SEQ ID NO: 503215 - protein, 21 aa, Mycobacterium
HLRGEQRRDRHQGGHGRHGQH

SEQ ID NO: 503216 - protein, 6 aa, Mycobacterium
HLRPGD

SEQ ID NO: 503217 - protein, 6 aa, Mycobacterium
HLRPRS

SEQ ID NO: 503218 - protein, 6 aa, Mycobacterium
HLRSGA

SEQ ID NO: 503219 - protein, 7 aa, Mycobacterium
HLRSGDE

SEQ ID NO: 503220 - protein, 7 aa, Mycobacterium
HLRSSDR

SEQ ID NO: 503221 - protein, 8 aa, Mycobacterium
HLRSSDRS

SEQ ID NO: 503222 - protein, 10 aa, Mycobacterium
HLRSSDTSTD

SEQ ID NO: 503223 - protein, 7 aa, Mycobacterium
HLRSSER

SEQ ID NO: 503224 - protein, 7 aa, Mycobacterium
HLSAGRP

SEQ ID NO: 503225 - protein, 9 aa, Mycobacterium
HLSGGQQQR

SEQ ID NO: 503226 - protein, 8 aa, Mycobacterium
HLSGQTRS

SEQ ID NO: 503227 - protein, 10 aa, Mycobacterium
HLSGRPNATL

SEQ ID NO: 503228 - protein, 8 aa, Mycobacterium
HLSGRTRS

SEQ ID NO: 503229 - protein, 7 aa, Mycobacterium
HLSSGAA

SEQ ID NO: 503230 - protein, 4 aa, Mycobacterium
HLST

SEQ ID NO: 503231 - protein, 7 aa, Mycobacterium
HLTGDEV

SEQ ID NO: 503232 - protein, 21 aa, Mycobacterium
HLTGDQSQVLPTDSQKQTAYA

SEQ ID NO: 503233 - protein, 13 aa, Mycobacterium
HLTGPEQRARQTA

SEQ ID NO: 503234 - protein, 6 aa, Mycobacterium
HLTPRQ

SEQ ID NO: 503235 - protein, 6 aa, Mycobacterium
HLTSRH

SEQ ID NO: 503236 - protein, 6 aa, Mycobacterium
HMAKGE

SEQ ID NO: 503237 - protein, 16 aa, Mycobacterium
HMGGEYKTDNHVTGYA

SEQ ID NO: 503238 - protein, 6 aa, Mycobacterium
HMGKSD

SEQ ID NO: 503239 - protein, 10 aa, Mycobacterium
HMRPDTTLEG

SEQ ID NO: 503240 - protein, 12 aa, Mycobacterium
HMRPGTTAADLG

SEQ ID NO: 503241 - protein, 11 aa, Mycobacterium
HMRPGTTVESL

SEQ ID NO: 503242 - protein, 7 aa, Mycobacterium
HMSGPRP

SEQ ID NO: 503243 - protein, 11 aa, Mycobacterium
HNAAATATTTA

SEQ ID NO: 503244 - protein, 14 aa, Mycobacterium
HNAAEGPEQPADAR

SEQ ID NO: 503245 - protein, 7 aa, Mycobacterium
HNAANAQ

SEQ ID NO: 503246 - protein, 7 aa, Mycobacterium
HNAATEA

SEQ ID NO: 503247 - protein, 6 aa, Mycobacterium
HNADGT

SEQ ID NO: 503248 - protein, 5 aa, Mycobacterium
HNAEE

SEQ ID NO: 503249 - protein, 12 aa, Mycobacterium
HNAGKNIRRGQK

SEQ ID NO: 503250 - protein, 17 aa, Mycobacterium
HNAGPTGAGLASSASGF

SEQ ID NO: 503251 - protein, 9 aa, Mycobacterium
HNAGSAAAT

SEQ ID NO: 503252 - protein, 15 aa, Mycobacterium
HNAGSSINELIWKKQ

SEQ ID NO: 503253 - protein, 9 aa, Mycobacterium
HNAKADAAL

SEQ ID NO: 503254 - protein, 4 aa, Mycobacterium
HNDD

SEQ ID NO: 503255 - protein, 9 aa, Mycobacterium
HNDDSADDI

SEQ ID NO: 503256 - protein, 13 aa, Mycobacterium
HNDDSADDIRDAP

SEQ ID NO: 503257 - protein, 9 aa, Mycobacterium
HNDDSAEDI

SEQ ID NO: 503258 - protein, 4 aa, Mycobacterium
HNDE

SEQ ID NO: 503259 - protein, 11 aa, Mycobacterium
HNDGAVPDPPW

SEQ ID NO: 503260 - protein, 10 aa, Mycobacterium
HNDGPVADPP

SEQ ID NO: 503261 - protein, 4 aa, Mycobacterium
HNDN

SEQ ID NO: 503262 - protein, 16 aa, Mycobacterium
HNDNSFTRADGETLDK

SEQ ID NO: 503263 - protein, 12 aa, Mycobacterium
HNDPAPDRSQVP

SEQ ID NO: 503264 - protein, 9 aa, Mycobacterium
HNDRGTGVA

SEQ ID NO: 503265 - protein, 15 aa, Mycobacterium
HNDRPEVRTKPPLTG

SEQ ID NO: 503266 - protein, 9 aa, Mycobacterium
HNDSDGANS

SEQ ID NO: 503267 - protein, 11 aa, Mycobacterium
HNDTTGAGGTV

SEQ ID NO: 503268 - protein, 8 aa, Mycobacterium
HNDYDNNI

SEQ ID NO: 503269 - protein, 9 aa, Mycobacterium
HNEDNKELD

SEQ ID NO: 503270 - protein, 9 aa, Mycobacterium
HNEDNKNLE

SEQ ID NO: 503271 - protein, 9 aa, Mycobacterium
HNEDPQFKQ

SEQ ID NO: 503272 - protein, 4 aa, Mycobacterium
HNEE

SEQ ID NO: 503273 - protein, 5 aa, Mycobacterium
HNEER

SEQ ID NO: 503274 - protein, 8 aa, Mycobacterium
HNEGNKDL

SEQ ID NO: 503275 - protein, 9 aa, Mycobacterium
HNENRGRRW

SEQ ID NO: 503276 - protein, 5 aa, Mycobacterium
HNEPG

SEQ ID NO: 503277 - protein, 8 aa, Mycobacterium
HNEPPDRR

SEQ ID NO: 503278 - protein, 6 aa, Mycobacterium
HNEPTL

SEQ ID NO: 503279 - protein, 19 aa, Mycobacterium
HNEQAGRPSAASIDAPTRA

SEQ ID NO: 503280 - protein, 8 aa, Mycobacterium
HNESDKRG

SEQ ID NO: 503281 - protein, 9 aa, Mycobacterium
HNETGTSDD

SEQ ID NO: 503282 - protein, 6 aa, Mycobacterium
HNGAGS

SEQ ID NO: 503283 - protein, 11 aa, Mycobacterium
HNGASEDDCEA

SEQ ID NO: 503284 - protein, 9 aa, Mycobacterium
HNGASHQDP

SEQ ID NO: 503285 - protein, 8 aa, Mycobacterium
HNGASPFA

SEQ ID NO: 503286 - protein, 10 aa, Mycobacterium
HNGDTDFSGS

SEQ ID NO: 503287 - protein, 8 aa, Mycobacterium
HNGGTRST

SEQ ID NO: 503288 - protein, 18 aa, Mycobacterium
HNGGVPQSWTRGGHTEEA

SEQ ID NO: 503289 - protein, 6 aa, Mycobacterium
HNGKQA

SEQ ID NO: 503290 - protein, 9 aa, Mycobacterium
HNGPSEAYY

SEQ ID NO: 503291 - protein, 4 aa, Mycobacterium
HNGQ

SEQ ID NO: 503292 - protein, 11 aa, Mycobacterium
HNGRAVRPGGF

SEQ ID NO: 503293 - protein, 7 aa, Mycobacterium
HNGSGGW

SEQ ID NO: 503294 - protein, 10 aa, Mycobacterium
HNGSNTREGV

SEQ ID NO: 503295 - protein, 8 aa, Mycobacterium
HNGSPRAV

SEQ ID NO: 503296 - protein, 5 aa, Mycobacterium
HNGTH

SEQ ID NO: 503297 - protein, 4 aa, Mycobacterium
HNGW

SEQ ID NO: 503298 - protein, 5 aa, Mycobacterium
HNHES

SEQ ID NO: 503299 - protein, 5 aa, Mycobacterium
HNKND

SEQ ID NO: 503300 - protein, 13 aa, Mycobacterium
HNKPEATAESITE

SEQ ID NO: 503301 - protein, 13 aa, Mycobacterium
HNKPNPGADPGGM

SEQ ID NO: 503302 - protein, 8 aa, Mycobacterium
HNKSSARF

SEQ ID NO: 503303 - protein, 9 aa, Mycobacterium
HNLEEGQRL

SEQ ID NO: 503304 - protein, 49 aa, Mycobacterium
HNLGSGNIGNHNLGSGNIGNANVGSGNTGNANLGSGNFGNANVGSGNGN

SEQ ID NO: 503305 - protein, 5 aa, Mycobacterium
HNLRD

SEQ ID NO: 503306 - protein, 18 aa, Mycobacterium
HNMANGEDNRDGESHNRS

SEQ ID NO: 503307 - protein, 6 aa, Mycobacterium
HNNGAG

SEQ ID NO: 503308 - protein, 8 aa, Mycobacterium
HNNPLPGD

SEQ ID NO: 503309 - protein, 31 aa, Mycobacterium
HNNQRDGYGQHTIPRGRSSYYNNSLGGGCPA

SEQ ID NO: 503310 - protein, 6 aa, Mycobacterium
HNNTPV

SEQ ID NO: 503311 - protein, 6 aa, Mycobacterium
HNPAAY

SEQ ID NO: 503312 - protein, 6 aa, Mycobacterium
HNPADR

SEQ ID NO: 503313 - protein, 10 aa, Mycobacterium
HNPAGAAALS

SEQ ID NO: 503314 - protein, 6 aa, Mycobacterium
HNPASE

SEQ ID NO: 503315 - protein, 7 aa, Mycobacterium
HNPATSP

SEQ ID NO: 503316 - protein, 7 aa, Mycobacterium
HNPDGSD

SEQ ID NO: 503317 - protein, 5 aa, Mycobacterium
HNPDR

SEQ ID NO: 503318 - protein, 6 aa, Mycobacterium
HNPERV

SEQ ID NO: 503319 - protein, 8 aa, Mycobacterium
HNPGGAAA

SEQ ID NO: 503320 - protein, 6 aa, Mycobacterium
HNPGGI

SEQ ID NO: 503321 - protein, 10 aa, Mycobacterium
HNPGVAGGAP

SEQ ID NO: 503322 - protein, 4 aa, Mycobacterium
HNPH

SEQ ID NO: 503323 - protein, 6 aa, Mycobacterium
HNPHGA

SEQ ID NO: 503324 - protein, 6 aa, Mycobacterium
HNPIHT

SEQ ID NO: 503325 - protein, 7 aa, Mycobacterium
HNPIHTD

SEQ ID NO: 503326 - protein, 5 aa, Mycobacterium
HNPPA

SEQ ID NO: 503327 - protein, 6 aa, Mycobacterium
HNPPAV

SEQ ID NO: 503328 - protein, 6 aa, Mycobacterium
HNPPGD

SEQ ID NO: 503329 - protein, 5 aa, Mycobacterium
HNPTG

SEQ ID NO: 503330 - protein, 6 aa, Mycobacterium
HNPTGA

SEQ ID NO: 503331 - protein, 7 aa, Mycobacterium
HNPTGAV

SEQ ID NO: 503332 - protein, 9 aa, Mycobacterium
HNPTGSVHT

SEQ ID NO: 503333 - protein, 11 aa, Mycobacterium
HNPTGTIEPAE

SEQ ID NO: 503334 - protein, 7 aa, Mycobacterium
HNPTGTL

SEQ ID NO: 503335 - protein, 9 aa, Mycobacterium
HNPTGTLEP

SEQ ID NO: 503336 - protein, 12 aa, Mycobacterium
HNPTGTVHTPEE

SEQ ID NO: 503337 - protein, 23 aa, Mycobacterium
HNPTRRGLNTRRTVRRDAPPNPT

SEQ ID NO: 503338 - protein, 9 aa, Mycobacterium
HNPTTGDKD

SEQ ID NO: 503339 - protein, 6 aa, Mycobacterium
HNPVDG

SEQ ID NO: 503340 - protein, 4 aa, Mycobacterium
HNQA

SEQ ID NO: 503341 - protein, 10 aa, Mycobacterium
HNQAAGEDLG

SEQ ID NO: 503342 - protein, 8 aa, Mycobacterium
HNQDNKNF

SEQ ID NO: 503343 - protein, 9 aa, Mycobacterium
HNQGTGRDR

SEQ ID NO: 503344 - protein, 11 aa, Mycobacterium
HNRAYSDGDRD

SEQ ID NO: 503345 - protein, 8 aa, Mycobacterium
HNRGNQNE

SEQ ID NO: 503346 - protein, 18 aa, Mycobacterium
HNRKPRDYNINDPEQKKA

SEQ ID NO: 503347 - protein, 4 aa, Mycobacterium
HNRR

SEQ ID NO: 503348 - protein, 17 aa, Mycobacterium
HNRSTAVPDGSLAGGGI

SEQ ID NO: 503349 - protein, 17 aa, Mycobacterium
HNRSTAVPEGSLAGGGI

SEQ ID NO: 503350 - protein, 10 aa, Mycobacterium
HNRSTVVPDG

SEQ ID NO: 503351 - protein, 5 aa, Mycobacterium
HNRTL

SEQ ID NO: 503352 - protein, 4 aa, Mycobacterium
HNSA

SEQ ID NO: 503353 - protein, 14 aa, Mycobacterium
HNSDDSPSRSAAGL

SEQ ID NO: 503354 - protein, 14 aa, Mycobacterium
HNSDTPASDLGMLF

SEQ ID NO: 503355 - protein, 40 aa, Mycobacterium
HNSGAKVPSVGVPAPAAAVSAREQRRARRRRKTTEPQRQY

SEQ ID NO: 503356 - protein, 8 aa, Mycobacterium
HNSGKGQV

SEQ ID NO: 503357 - protein, 10 aa, Mycobacterium
HNSGNSCTPV

SEQ ID NO: 503358 - protein, 11 aa, Mycobacterium
HNSGPVDDPPL

SEQ ID NO: 503359 - protein, 11 aa, Mycobacterium
HNSGPVDDPPW

SEQ ID NO: 503360 - protein, 8 aa, Mycobacterium
HNSKEEPV

SEQ ID NO: 503361 - protein, 7 aa, Mycobacterium
HNSLEQD

SEQ ID NO: 503362 - protein, 9 aa, Mycobacterium
HNSSSAYAK

SEQ ID NO: 503363 - protein, 11 aa, Mycobacterium
HNSTADAVTDE

SEQ ID NO: 503364 - protein, 5 aa, Mycobacterium
HNTGD

SEQ ID NO: 503365 - protein, 4 aa, Mycobacterium
HNTH

SEQ ID NO: 503366 - protein, 5 aa, Mycobacterium
HNTLS

SEQ ID NO: 503367 - protein, 4 aa, Mycobacterium
HNTP

SEQ ID NO: 503368 - protein, 10 aa, Mycobacterium
HNTPGLPPWP

SEQ ID NO: 503369 - protein, 5 aa, Mycobacterium
HNTPR

SEQ ID NO: 503370 - protein, 4 aa, Mycobacterium
HNTS

SEQ ID NO: 503371 - protein, 5 aa, Mycobacterium
HNTTA

SEQ ID NO: 503372 - protein, 8 aa, Mycobacterium
HNTTPSRL

SEQ ID NO: 503373 - protein, 4 aa, Mycobacterium
HNVA

SEQ ID NO: 503374 - protein, 41 aa, Mycobacterium
HNVGAYNKGDNNVGVGNNTPDKGYCAPNGQRYDAKTTFDGN

SEQ ID NO: 503375 - protein, 6 aa, Mycobacterium
HNVPNS

SEQ ID NO: 503376 - protein, 14 aa, Mycobacterium
HPAAARAEKATGAW

SEQ ID NO: 503377 - protein, 6 aa, Mycobacterium
HPAADH

SEQ ID NO: 503378 - protein, 12 aa, Mycobacterium
HPAAGAALDGSH

SEQ ID NO: 503379 - protein, 46 aa, Mycobacterium
HPAAGSAKGAPGKKYAEGAAAGTDGEERAPVEAGVGGGQLVSARRV

SEQ ID NO: 503380 - protein, 6 aa, Mycobacterium
HPAAKA

SEQ ID NO: 503381 - protein, 11 aa, Mycobacterium
HPAALGAPGRQ

SEQ ID NO: 503382 - protein, 10 aa, Mycobacterium
HPAALGSAGK

SEQ ID NO: 503383 - protein, 12 aa, Mycobacterium
HPAAPAPAPPAE

SEQ ID NO: 503384 - protein, 6 aa, Mycobacterium
HPAARG

SEQ ID NO: 503385 - protein, 7 aa, Mycobacterium
HPAASAA

SEQ ID NO: 503386 - protein, 8 aa, Mycobacterium
HPAASASD

SEQ ID NO: 503387 - protein, 11 aa, Mycobacterium
HPADEHARTSS

SEQ ID NO: 503388 - protein, 8 aa, Mycobacterium
HPADGGGE

SEQ ID NO: 503389 - protein, 12 aa, Mycobacterium
HPADPPPGPEEH

SEQ ID NO: 503390 - protein, 5 aa, Mycobacterium
HPADR

SEQ ID NO: 503391 - protein, 8 aa, Mycobacterium
HPADRDRL

SEQ ID NO: 503392 - protein, 8 aa, Mycobacterium
HPADRPQV

SEQ ID NO: 503393 - protein, 15 aa, Mycobacterium
HPADSAVRAGGAQRV

SEQ ID NO: 503394 - protein, 5 aa, Mycobacterium
HPADT

SEQ ID NO: 503395 - protein, 4 aa, Mycobacterium
HPAE

SEQ ID NO: 503396 - protein, 12 aa, Mycobacterium
HPAEPGITDKAE

SEQ ID NO: 503397 - protein, 5 aa, Mycobacterium
HPAER

SEQ ID NO: 503398 - protein, 6 aa, Mycobacterium
HPAERA

SEQ ID NO: 503399 - protein, 5 aa, Mycobacterium
HPAGG

SEQ ID NO: 503400 - protein, 8 aa, Mycobacterium
HPAGGPPH

SEQ ID NO: 503401 - protein, 14 aa, Mycobacterium
HPAGPHSSIAKRAD

SEQ ID NO: 503402 - protein, 6 aa, Mycobacterium
HPAGQK

SEQ ID NO: 503403 - protein, 13 aa, Mycobacterium
HPAGRDAGGHARQ

SEQ ID NO: 503404 - protein, 6 aa, Mycobacterium
HPAGRP

SEQ ID NO: 503405 - protein, 8 aa, Mycobacterium
HPAGRPPI

SEQ ID NO: 503406 - protein, 8 aa, Mycobacterium
HPAGSAPL

SEQ ID NO: 503407 - protein, 7 aa, Mycobacterium
HPAGSKA

SEQ ID NO: 503408 - protein, 7 aa, Mycobacterium
HPAGSTA

SEQ ID NO: 503409 - protein, 26 aa, Mycobacterium
HPAGTAWSAAPGGPPVAAPPSPPPAP

SEQ ID NO: 503410 - protein, 9 aa, Mycobacterium
HPAGVQPTG

SEQ ID NO: 503411 - protein, 7 aa, Mycobacterium
HPAHRPG

SEQ ID NO: 503412 - protein, 10 aa, Mycobacterium
HPAIADSEGV

SEQ ID NO: 503413 - protein, 7 aa, Mycobacterium
HPAKPMS

SEQ ID NO: 503414 - protein, 15 aa, Mycobacterium
HPAKSGKPHEICVGR

SEQ ID NO: 503415 - protein, 4 aa, Mycobacterium
HPAL

SEQ ID NO: 503416 - protein, 12 aa, Mycobacterium
HPALPKGSSIYG

SEQ ID NO: 503417 - protein, 7 aa, Mycobacterium
HPANGQP

SEQ ID NO: 503418 - protein, 4 aa, Mycobacterium
HPAP

SEQ ID NO: 503419 - protein, 6 aa, Mycobacterium
HPAPAE

SEQ ID NO: 503420 - protein, 24 aa, Mycobacterium
HPAPALPPRPRAPRIGARRPGRVY

SEQ ID NO: 503421 - protein, 8 aa, Mycobacterium
HPAPEGAP

SEQ ID NO: 503422 - protein, 10 aa, Mycobacterium
HPAPETGSLR

SEQ ID NO: 503423 - protein, 9 aa, Mycobacterium
HPAPGEDVT

SEQ ID NO: 503424 - protein, 6 aa, Mycobacterium
HPAPGT

SEQ ID NO: 503425 - protein, 5 aa, Mycobacterium
HPAPK

SEQ ID NO: 503426 - protein, 7 aa, Mycobacterium
HPAPNLR

SEQ ID NO: 503427 - protein, 16 aa, Mycobacterium
HPAPPAADSQHDASKT

SEQ ID NO: 503428 - protein, 10 aa, Mycobacterium
HPAPQTYQEA

SEQ ID NO: 503429 - protein, 5 aa, Mycobacterium
HPAPR

SEQ ID NO: 503430 - protein, 13 aa, Mycobacterium
HPAPSEPSTTLST

SEQ ID NO: 503431 - protein, 6 aa, Mycobacterium
HPAPSQ

SEQ ID NO: 503432 - protein, 6 aa, Mycobacterium
HPAQAD

SEQ ID NO: 503433 - protein, 12 aa, Mycobacterium
HPAQRGGISGIP

SEQ ID NO: 503434 - protein, 6 aa, Mycobacterium
HPARAG

SEQ ID NO: 503435 - protein, 8 aa, Mycobacterium
HPARAGGN

SEQ ID NO: 503436 - protein, 10 aa, Mycobacterium
HPARGDTQRG

SEQ ID NO: 503437 - protein, 7 aa, Mycobacterium
HPARRDR

SEQ ID NO: 503438 - protein, 6 aa, Mycobacterium
HPARRG

SEQ ID NO: 503439 - protein, 8 aa, Mycobacterium
HPARSTQD

SEQ ID NO: 503440 - protein, 5 aa, Mycobacterium
HPART

SEQ ID NO: 503441 - protein, 10 aa, Mycobacterium
HPARTGTGAR

SEQ ID NO: 503442 - protein, 5 aa, Mycobacterium
HPARW

SEQ ID NO: 503443 - protein, 4 aa, Mycobacterium
HPAS

SEQ ID NO: 503444 - protein, 13 aa, Mycobacterium
HPASAFRRKPVHS

SEQ ID NO: 503445 - protein, 15 aa, Mycobacterium
HPASAPAPALGQDTA

SEQ ID NO: 503446 - protein, 8 aa, Mycobacterium
HPASDQSY

SEQ ID NO: 503447 - protein, 6 aa, Mycobacterium
HPASPE

SEQ ID NO: 503448 - protein, 4 aa, Mycobacterium
HPAT

SEQ ID NO: 503449 - protein, 10 aa, Mycobacterium
HPATESGGYF

SEQ ID NO: 503450 - protein, 7 aa, Mycobacterium
HPATPMT

SEQ ID NO: 503451 - protein, 9 aa, Mycobacterium
HPATRAADR

SEQ ID NO: 503452 - protein, 5 aa, Mycobacterium
HPAWD

SEQ ID NO: 503453 - protein, 6 aa, Mycobacterium
HPAYRS

SEQ ID NO: 503454 - protein, 4 aa, Mycobacterium
HPDA

SEQ ID NO: 503455 - protein, 5 aa, Mycobacterium
HPDAA

SEQ ID NO: 503456 - protein, 9 aa, Mycobacterium
HPDAADEPV

SEQ ID NO: 503457 - protein, 6 aa, Mycobacterium
HPDAAK

SEQ ID NO: 503458 - protein, 9 aa, Mycobacterium
HPDAASEPE

SEQ ID NO: 503459 - protein, 5 aa, Mycobacterium
HPDAD

SEQ ID NO: 503460 - protein, 18 aa, Mycobacterium
HPDADASLAAARATAAEI

SEQ ID NO: 503461 - protein, 6 aa, Mycobacterium
HPDAEQ

SEQ ID NO: 503462 - protein, 7 aa, Mycobacterium
HPDAGER

SEQ ID NO: 503463 - protein, 17 aa, Mycobacterium
HPDAGRERRVEARGDDV

SEQ ID NO: 503464 - protein, 10 aa, Mycobacterium
HPDAKDFGNA

SEQ ID NO: 503465 - protein, 8 aa, Mycobacterium
HPDANKGA

SEQ ID NO: 503466 - protein, 14 aa, Mycobacterium
HPDAQGVPSHEDFP

SEQ ID NO: 503467 - protein, 6 aa, Mycobacterium
HPDASG

SEQ ID NO: 503468 - protein, 6 aa, Mycobacterium
HPDATA

SEQ ID NO: 503469 - protein, 6 aa, Mycobacterium
HPDAVN

SEQ ID NO: 503470 - protein, 14 aa, Mycobacterium
HPDCPTDKPKIERT

SEQ ID NO: 503471 - protein, 4 aa, Mycobacterium
HPDD

SEQ ID NO: 503472 - protein, 5 aa, Mycobacterium
HPDDA

SEQ ID NO: 503473 - protein, 10 aa, Mycobacterium
HPDDAQLSPH

SEQ ID NO: 503474 - protein, 10 aa, Mycobacterium
HPDDARLGPP

SEQ ID NO: 503475 - protein, 5 aa, Mycobacterium
HPDDD

SEQ ID NO: 503476 - protein, 7 aa, Mycobacterium
HPDDDRY

SEQ ID NO: 503477 - protein, 21 aa, Mycobacterium
HPDDEASKGAATTARYAAEGN

SEQ ID NO: 503478 - protein, 20 aa, Mycobacterium
HPDDESSKGAATTARYAAEG

SEQ ID NO: 503479 - protein, 8 aa, Mycobacterium
HPDDETLG

SEQ ID NO: 503480 - protein, 5 aa, Mycobacterium
HPDDK

SEQ ID NO: 503481 - protein, 5 aa, Mycobacterium
HPDDL

SEQ ID NO: 503482 - protein, 6 aa, Mycobacterium
HPDDLD

SEQ ID NO: 503483 - protein, 9 aa, Mycobacterium
HPDDPEYGI

SEQ ID NO: 503484 - protein, 27 aa, Mycobacterium
HPDDPGPTEPAGQSESAGEDPDAATTW

SEQ ID NO: 503485 - protein, 13 aa, Mycobacterium
HPDDPQGPRARVG

SEQ ID NO: 503486 - protein, 7 aa, Mycobacterium
HPDDRAK

SEQ ID NO: 503487 - protein, 8 aa, Mycobacterium
HPDDREEV

SEQ ID NO: 503488 - protein, 20 aa, Mycobacterium
HPDDRESYENAKRAAVPGGG

SEQ ID NO: 503489 - protein, 8 aa, Mycobacterium
HPDDRNQI

SEQ ID NO: 503490 - protein, 27 aa, Mycobacterium
HPDDVKGTAGPAPVRPADCDRSDGDYA

SEQ ID NO: 503491 - protein, 6 aa, Mycobacterium
HPDDYR

SEQ ID NO: 503492 - protein, 9 aa, Mycobacterium
HPDEATRDL

SEQ ID NO: 503493 - protein, 6 aa, Mycobacterium
HPDEEG

SEQ ID NO: 503494 - protein, 5 aa, Mycobacterium
HPDEG

SEQ ID NO: 503495 - protein, 10 aa, Mycobacterium
HPDEPAEAAA

SEQ ID NO: 503496 - protein, 10 aa, Mycobacterium
HPDEPPPHQD

SEQ ID NO: 503497 - protein, 5 aa, Mycobacterium
HPDER

SEQ ID NO: 503498 - protein, 13 aa, Mycobacterium
HPDERARLQADPG

SEQ ID NO: 503499 - protein, 13 aa, Mycobacterium
HPDERARLSADRD

SEQ ID NO: 503500 - protein, 10 aa, Mycobacterium
HPDERDRLSR

SEQ ID NO: 503501 - protein, 13 aa, Mycobacterium
HPDERERLSRDRD

SEQ ID NO: 503502 - protein, 11 aa, Mycobacterium
HPDERERLSRE

SEQ ID NO: 503503 - protein, 13 aa, Mycobacterium
HPDERERLSRERD

SEQ ID NO: 503504 - protein, 5 aa, Mycobacterium
HPDFA

SEQ ID NO: 503505 - protein, 6 aa, Mycobacterium
HPDGAD

SEQ ID NO: 503506 - protein, 5 aa, Mycobacterium
HPDGG

SEQ ID NO: 503507 - protein, 18 aa, Mycobacterium
HPDGGDVDAVGADHEQAI

SEQ ID NO: 503508 - protein, 6 aa, Mycobacterium
HPDGGV

SEQ ID NO: 503509 - protein, 17 aa, Mycobacterium
HPDGHPDAGHWREPPSR

SEQ ID NO: 503510 - protein, 8 aa, Mycobacterium
HPDGHPRG

SEQ ID NO: 503511 - protein, 8 aa, Mycobacterium
HPDGIGAA

SEQ ID NO: 503512 - protein, 8 aa, Mycobacterium
HPDGISND

SEQ ID NO: 503513 - protein, 10 aa, Mycobacterium
HPDGLSDPGG

SEQ ID NO: 503514 - protein, 9 aa, Mycobacterium
HPDGLTDPA

SEQ ID NO: 503515 - protein, 10 aa, Mycobacterium
HPDGPPQPQV

SEQ ID NO: 503516 - protein, 6 aa, Mycobacterium
HPDGPY

SEQ ID NO: 503517 - protein, 21 aa, Mycobacterium
HPDGRDGQRHRDDDHRARRPA

SEQ ID NO: 503518 - protein, 7 aa, Mycobacterium
HPDGRGE

SEQ ID NO: 503519 - protein, 28 aa, Mycobacterium
HPDGRPVSIGAGDEAARDALRRWSLEHG

SEQ ID NO: 503520 - protein, 6 aa, Mycobacterium
HPDGRR

SEQ ID NO: 503521 - protein, 9 aa, Mycobacterium
HPDGTREPR

SEQ ID NO: 503522 - protein, 4 aa, Mycobacterium
HPDH

SEQ ID NO: 503523 - protein, 8 aa, Mycobacterium
HPDHADTT

SEQ ID NO: 503524 - protein, 12 aa, Mycobacterium
HPDLAADTATGQ

SEQ ID NO: 503525 - protein, 9 aa, Mycobacterium
HPDLDGPPW

SEQ ID NO: 503526 - protein, 12 aa, Mycobacterium
HPDLPVDTATDD

SEQ ID NO: 503527 - protein, 12 aa, Mycobacterium
HPDLPVDTTTDD

SEQ ID NO: 503528 - protein, 21 aa, Mycobacterium
HPDLSDRAHRNSPGVLVEIPH

SEQ ID NO: 503529 - protein, 5 aa, Mycobacterium
HPDMA

SEQ ID NO: 503530 - protein, 5 aa, Mycobacterium
HPDMP

SEQ ID NO: 503531 - protein, 5 aa, Mycobacterium
HPDNA

SEQ ID NO: 503532 - protein, 12 aa, Mycobacterium
HPDNAGAFEPGT

SEQ ID NO: 503533 - protein, 6 aa, Mycobacterium
HPDNPV

SEQ ID NO: 503534 - protein, 16 aa, Mycobacterium
HPDNPVNRTRSGGTQL

SEQ ID NO: 503535 - protein, 5 aa, Mycobacterium
HPDNY

SEQ ID NO: 503536 - protein, 12 aa, Mycobacterium
HPDPARDARASY

SEQ ID NO: 503537 - protein, 9 aa, Mycobacterium
HPDPLTPGH

SEQ ID NO: 503538 - protein, 9 aa, Mycobacterium
HPDPTLRGA

SEQ ID NO: 503539 - protein, 14 aa, Mycobacterium
HPDQIRAQRAQHAD

SEQ ID NO: 503540 - protein, 6 aa, Mycobacterium
HPDQRR

SEQ ID NO: 503541 - protein, 9 aa, Mycobacterium
HPDQSDVAA

SEQ ID NO: 503542 - protein, 9 aa, Mycobacterium
HPDQSGVPR

SEQ ID NO: 503543 - protein, 4 aa, Mycobacterium
HPDR

SEQ ID NO: 503544 - protein, 7 aa, Mycobacterium
HPDRAAQ

SEQ ID NO: 503545 - protein, 7 aa, Mycobacterium
HPDRDDP

SEQ ID NO: 503546 - protein, 12 aa, Mycobacterium
HPDRGAEPAAAT

SEQ ID NO: 503547 - protein, 8 aa, Mycobacterium
HPDRGDLN

SEQ ID NO: 503548 - protein, 6 aa, Mycobacterium
HPDRIG

SEQ ID NO: 503549 - protein, 6 aa, Mycobacterium
HPDRKE

SEQ ID NO: 503550 - protein, 5 aa, Mycobacterium
HPDRP

SEQ ID NO: 503551 - protein, 9 aa, Mycobacterium
HPDRPCAAA

SEQ ID NO: 503552 - protein, 9 aa, Mycobacterium
HPDRRRGKT

SEQ ID NO: 503553 - protein, 4 aa, Mycobacterium
HPDS

SEQ ID NO: 503554 - protein, 5 aa, Mycobacterium
HPDSD

SEQ ID NO: 503555 - protein, 5 aa, Mycobacterium
HPDSG

SEQ ID NO: 503556 - protein, 29 aa, Mycobacterium
HPDSNTASTSESENPAIPSPKPKAHAPLT

SEQ ID NO: 503557 - protein, 4 aa, Mycobacterium
HPDT

SEQ ID NO: 503558 - protein, 5 aa, Mycobacterium
HPDTD

SEQ ID NO: 503559 - protein, 7 aa, Mycobacterium
HPDTDDP

SEQ ID NO: 503560 - protein, 5 aa, Mycobacterium
HPDTV

SEQ ID NO: 503561 - protein, 4 aa, Mycobacterium
HPDV

SEQ ID NO: 503562 - protein, 6 aa, Mycobacterium
HPDVAG

SEQ ID NO: 503563 - protein, 5 aa, Mycobacterium
HPDVS

SEQ ID NO: 503564 - protein, 6 aa, Mycobacterium
HPDVTG

SEQ ID NO: 503565 - protein, 11 aa, Mycobacterium
HPDWARPENRL

SEQ ID NO: 503566 - protein, 5 aa, Mycobacterium
HPDYR

SEQ ID NO: 503567 - protein, 4 aa, Mycobacterium
HPEA

SEQ ID NO: 503568 - protein, 5 aa, Mycobacterium
HPEAA

SEQ ID NO: 503569 - protein, 10 aa, Mycobacterium
HPEAFSAKDT

SEQ ID NO: 503570 - protein, 10 aa, Mycobacterium
HPEAHQQYRR

SEQ ID NO: 503571 - protein, 8 aa, Mycobacterium
HPEAQGSF

SEQ ID NO: 503572 - protein, 8 aa, Mycobacterium
HPEASHAD

SEQ ID NO: 503573 - protein, 10 aa, Mycobacterium
HPEATAELAG

SEQ ID NO: 503574 - protein, 11 aa, Mycobacterium
HPEDAGRSTLP

SEQ ID NO: 503575 - protein, 10 aa, Mycobacterium
HPEDDAESLD

SEQ ID NO: 503576 - protein, 10 aa, Mycobacterium
HPEDEAGSFD

SEQ ID NO: 503577 - protein, 10 aa, Mycobacterium
HPEDEDAVSG

SEQ ID NO: 503578 - protein, 5 aa, Mycobacterium
HPEDP

SEQ ID NO: 503579 - protein, 5 aa, Mycobacterium
HPEDR

SEQ ID NO: 503580 - protein, 6 aa, Mycobacterium
HPEDRA

SEQ ID NO: 503581 - protein, 7 aa, Mycobacterium
HPEDRER

SEQ ID NO: 503582 - protein, 6 aa, Mycobacterium
HPEDRG

SEQ ID NO: 503583 - protein, 6 aa, Mycobacterium
HPEDRQ

SEQ ID NO: 503584 - protein, 7 aa, Mycobacterium
HPEDSRM

SEQ ID NO: 503585 - protein, 8 aa, Mycobacterium
HPEEGGTV

SEQ ID NO: 503586 - protein, 12 aa, Mycobacterium
HPEEIPAGRAYT

SEQ ID NO: 503587 - protein, 5 aa, Mycobacterium
HPEEV

SEQ ID NO: 503588 - protein, 14 aa, Mycobacterium
HPEGETMAKAYKNE

SEQ ID NO: 503589 - protein, 11 aa, Mycobacterium
HPEGGKLSPHL

SEQ ID NO: 503590 - protein, 6 aa, Mycobacterium
HPEGLS

SEQ ID NO: 503591 - protein, 5 aa, Mycobacterium
HPEGR

SEQ ID NO: 503592 - protein, 11 aa, Mycobacterium
HPEGRKLSPHL

SEQ ID NO: 503593 - protein, 6 aa, Mycobacterium
HPEGTD

SEQ ID NO: 503594 - protein, 15 aa, Mycobacterium
HPEHGQAYARSGKTG

SEQ ID NO: 503595 - protein, 8 aa, Mycobacterium
HPEHRTGD

SEQ ID NO: 503596 - protein, 12 aa, Mycobacterium
HPEHTEQYAKPY

SEQ ID NO: 503597 - protein, 12 aa, Mycobacterium
HPEHTGEYRKPY

SEQ ID NO: 503598 - protein, 6 aa, Mycobacterium
HPEHTQ

SEQ ID NO: 503599 - protein, 12 aa, Mycobacterium
HPEHTQEYQKPY

SEQ ID NO: 503600 - protein, 12 aa, Mycobacterium
HPEHTQEYTKPY

SEQ ID NO: 503601 - protein, 5 aa, Mycobacterium
HPEIT

SEQ ID NO: 503602 - protein, 16 aa, Mycobacterium
HPEKPIRGSQAPTDRF

SEQ ID NO: 503603 - protein, 9 aa, Mycobacterium
HPEKSGDAG

SEQ ID NO: 503604 - protein, 19 aa, Mycobacterium
HPEKSGDAGAAVLSNWVEN

SEQ ID NO: 503605 - protein, 19 aa, Mycobacterium
HPEKSGDAGAAVLSNWVGE

SEQ ID NO: 503606 - protein, 70 aa, Mycobacterium
HPELGRAAGPDQQGGRGRQAQRARAGDDQHRDGRGEGRGERGAQGEPRAERRQGDADDHGDEHAGDAVGE

SEQ ID NO: 503607 - protein, 6 aa, Mycobacterium
HPELSP

SEQ ID NO: 503608 - protein, 5 aa, Mycobacterium
HPELT

SEQ ID NO: 503609 - protein, 12 aa, Mycobacterium
HPELTLSDTCTT

SEQ ID NO: 503610 - protein, 11 aa, Mycobacterium
HPENADLSPHL

SEQ ID NO: 503611 - protein, 6 aa, Mycobacterium
HPENEQ

SEQ ID NO: 503612 - protein, 8 aa, Mycobacterium
HPENEQIE

SEQ ID NO: 503613 - protein, 14 aa, Mycobacterium
HPENEQVEQALSDT

SEQ ID NO: 503614 - protein, 13 aa, Mycobacterium
HPENEQVEQALTD

SEQ ID NO: 503615 - protein, 10 aa, Mycobacterium
HPENLTSEEA

SEQ ID NO: 503616 - protein, 8 aa, Mycobacterium
HPENTQVE

SEQ ID NO: 503617 - protein, 4 aa, Mycobacterium
HPEP

SEQ ID NO: 503618 - protein, 5 aa, Mycobacterium
HPEPE

SEQ ID NO: 503619 - protein, 7 aa, Mycobacterium
HPEPGSR

SEQ ID NO: 503620 - protein, 15 aa, Mycobacterium
HPEPLRPGADQSISG

SEQ ID NO: 503621 - protein, 5 aa, Mycobacterium
HPEPT

SEQ ID NO: 503622 - protein, 4 aa, Mycobacterium
HPEQ

SEQ ID NO: 503623 - protein, 5 aa, Mycobacterium
HPEQD

SEQ ID NO: 503624 - protein, 9 aa, Mycobacterium
HPEQGGWTQ

SEQ ID NO: 503625 - protein, 18 aa, Mycobacterium
HPEQPTQQAQSYRDPDHD

SEQ ID NO: 503626 - protein, 18 aa, Mycobacterium
HPEQQAQLARDPAAIKPA

SEQ ID NO: 503627 - protein, 5 aa, Mycobacterium
HPEQR

SEQ ID NO: 503628 - protein, 6 aa, Mycobacterium
HPEQRD

SEQ ID NO: 503629 - protein, 17 aa, Mycobacterium
HPEQRRRLGPGQGDHRR

SEQ ID NO: 503630 - protein, 10 aa, Mycobacterium
HPEQSKLSPH

SEQ ID NO: 503631 - protein, 6 aa, Mycobacterium
HPEQST

SEQ ID NO: 503632 - protein, 15 aa, Mycobacterium
HPERGAGRETTHAES

SEQ ID NO: 503633 - protein, 8 aa, Mycobacterium
HPERSWTT

SEQ ID NO: 503634 - protein, 11 aa, Mycobacterium
HPETAETMGVT

SEQ ID NO: 503635 - protein, 6 aa, Mycobacterium
HPETDA

SEQ ID NO: 503636 - protein, 11 aa, Mycobacterium
HPETGDPQRGL

SEQ ID NO: 503637 - protein, 6 aa, Mycobacterium
HPETGE

SEQ ID NO: 503638 - protein, 11 aa, Mycobacterium
HPETGQAEAAA

SEQ ID NO: 503639 - protein, 7 aa, Mycobacterium
HPETPGG

SEQ ID NO: 503640 - protein, 6 aa, Mycobacterium
HPETVT

SEQ ID NO: 503641 - protein, 6 aa, Mycobacterium
HPEVAE

SEQ ID NO: 503642 - protein, 6 aa, Mycobacterium
HPEYAD

SEQ ID NO: 503643 - protein, 6 aa, Mycobacterium
HPEYDD

SEQ ID NO: 503644 - protein, 11 aa, Mycobacterium
HPEYGDDDDWE

SEQ ID NO: 503645 - protein, 6 aa, Mycobacterium
HPEYGG

SEQ ID NO: 503646 - protein, 8 aa, Mycobacterium
HPEYQNRD

SEQ ID NO: 503647 - protein, 12 aa, Mycobacterium
HPEYSAPECTNP

SEQ ID NO: 503648 - protein, 12 aa, Mycobacterium
HPEYSAPEVTDP

SEQ ID NO: 503649 - protein, 5 aa, Mycobacterium
HPFPA

SEQ ID NO: 503650 - protein, 6 aa, Mycobacterium
HPFPAA

SEQ ID NO: 503651 - protein, 4 aa, Mycobacterium
HPFR

SEQ ID NO: 503652 - protein, 13 aa, Mycobacterium
HPFRPDDRTDRLR

SEQ ID NO: 503653 - protein, 11 aa, Mycobacterium
HPFSPQDIEDE

SEQ ID NO: 503654 - protein, 10 aa, Mycobacterium
HPFTEAGNTE

SEQ ID NO: 503655 - protein, 8 aa, Mycobacterium
HPGADHAT

SEQ ID NO: 503656 - protein, 10 aa, Mycobacterium
HPGAEPDGWG

SEQ ID NO: 503657 - protein, 7 aa, Mycobacterium
HPGAERL

SEQ ID NO: 503658 - protein, 15 aa, Mycobacterium
HPGAGTGDPGQPPSQ

SEQ ID NO: 503659 - protein, 5 aa, Mycobacterium
HPGAP

SEQ ID NO: 503660 - protein, 7 aa, Mycobacterium
HPGAPGW

SEQ ID NO: 503661 - protein, 8 aa, Mycobacterium
HPGAPRRE

SEQ ID NO: 503662 - protein, 6 aa, Mycobacterium
HPGARG

SEQ ID NO: 503663 - protein, 16 aa, Mycobacterium
HPGARPLDYAQALAAA

SEQ ID NO: 503664 - protein, 6 aa, Mycobacterium
HPGASL

SEQ ID NO: 503665 - protein, 9 aa, Mycobacterium
HPGATPTSV

SEQ ID NO: 503666 - protein, 4 aa, Mycobacterium
HPGD

SEQ ID NO: 503667 - protein, 14 aa, Mycobacterium
HPGDAPPEAGYVPS

SEQ ID NO: 503668 - protein, 5 aa, Mycobacterium
HPGDG

SEQ ID NO: 503669 - protein, 7 aa, Mycobacterium
HPGDGPQ

SEQ ID NO: 503670 - protein, 5 aa, Mycobacterium
HPGDH

SEQ ID NO: 503671 - protein, 13 aa, Mycobacterium
HPGDLPHDRNPFG

SEQ ID NO: 503672 - protein, 8 aa, Mycobacterium
HPGDPRGL

SEQ ID NO: 503673 - protein, 15 aa, Mycobacterium
HPGDRVRGRTRRRRL

SEQ ID NO: 503674 - protein, 25 aa, Mycobacterium
HPGEHVNRSGADFGAQRPPGNSPQV

SEQ ID NO: 503675 - protein, 6 aa, Mycobacterium
HPGENP

SEQ ID NO: 503676 - protein, 7 aa, Mycobacterium
HPGEPAG

SEQ ID NO: 503677 - protein, 16 aa, Mycobacterium
HPGEPGDHTTRGAGAD

SEQ ID NO: 503678 - protein, 5 aa, Mycobacterium
HPGER

SEQ ID NO: 503679 - protein, 5 aa, Mycobacterium
HPGEV

SEQ ID NO: 503680 - protein, 4 aa, Mycobacterium
HPGF

SEQ ID NO: 503681 - protein, 15 aa, Mycobacterium
HPGFPQADRIADRPD

SEQ ID NO: 503682 - protein, 12 aa, Mycobacterium
HPGGAEAETGTG

SEQ ID NO: 503683 - protein, 6 aa, Mycobacterium
HPGGAR

SEQ ID NO: 503684 - protein, 6 aa, Mycobacterium
HPGGDP

SEQ ID NO: 503685 - protein, 5 aa, Mycobacterium
HPGGE

SEQ ID NO: 503686 - protein, 6 aa, Mycobacterium
HPGGGA

SEQ ID NO: 503687 - protein, 5 aa, Mycobacterium
HPGGL

SEQ ID NO: 503688 - protein, 11 aa, Mycobacterium
HPGGLSQAEIG

SEQ ID NO: 503689 - protein, 8 aa, Mycobacterium
HPGGRRQH

SEQ ID NO: 503690 - protein, 13 aa, Mycobacterium
HPGGRSYDDPPVN

SEQ ID NO: 503691 - protein, 14 aa, Mycobacterium
HPGGRSYDSPPVNA

SEQ ID NO: 503692 - protein, 5 aa, Mycobacterium
HPGGS

SEQ ID NO: 503693 - protein, 18 aa, Mycobacterium
HPGGSVRDDEVTAAAEAA

SEQ ID NO: 503694 - protein, 14 aa, Mycobacterium
HPGGTGAGLDQGEG

SEQ ID NO: 503695 - protein, 5 aa, Mycobacterium
HPGGV

SEQ ID NO: 503696 - protein, 6 aa, Mycobacterium
HPGGVR

SEQ ID NO: 503697 - protein, 6 aa, Mycobacterium
HPGISN

SEQ ID NO: 503698 - protein, 35 aa, Mycobacterium
HPGKMSKKNPSPISHQATSSARWTSYRRRDLEGHG

SEQ ID NO: 503699 - protein, 4 aa, Mycobacterium
HPGL

SEQ ID NO: 503700 - protein, 5 aa, Mycobacterium
HPGLP

SEQ ID NO: 503701 - protein, 6 aa, Mycobacterium
HPGLSN

SEQ ID NO: 503702 - protein, 25 aa, Mycobacterium
HPGLYTPDEVNGGEEPDTDDGDVEA

SEQ ID NO: 503703 - protein, 26 aa, Mycobacterium
HPGLYTPESVNPSYPPDSDQGDVESA

SEQ ID NO: 503704 - protein, 4 aa, Mycobacterium
HPGN

SEQ ID NO: 503705 - protein, 16 aa, Mycobacterium
HPGNPVNRVRDGGAQL

SEQ ID NO: 503706 - protein, 6 aa, Mycobacterium
HPGNVN

SEQ ID NO: 503707 - protein, 4 aa, Mycobacterium
HPGP

SEQ ID NO: 503708 - protein, 6 aa, Mycobacterium
HPGPAT

SEQ ID NO: 503709 - protein, 9 aa, Mycobacterium
HPGPATADA

SEQ ID NO: 503710 - protein, 6 aa, Mycobacterium
HPGPIG

SEQ ID NO: 503711 - protein, 5 aa, Mycobacterium
HPGPR

SEQ ID NO: 503712 - protein, 10 aa, Mycobacterium
HPGPRPGGQA

SEQ ID NO: 503713 - protein, 14 aa, Mycobacterium
HPGPRQLNPPGIGG

SEQ ID NO: 503714 - protein, 8 aa, Mycobacterium
HPGPTKTA

SEQ ID NO: 503715 - protein, 9 aa, Mycobacterium
HPGPTKTGM

SEQ ID NO: 503716 - protein, 8 aa, Mycobacterium
HPGPTRTS

SEQ ID NO: 503717 - protein, 5 aa, Mycobacterium
HPGPV

SEQ ID NO: 503718 - protein, 12 aa, Mycobacterium
HPGPVNTPMGGG

SEQ ID NO: 503719 - protein, 12 aa, Mycobacterium
HPGPVNTPMGSG

SEQ ID NO: 503720 - protein, 12 aa, Mycobacterium
HPGPVNTPMGTG

SEQ ID NO: 503721 - protein, 6 aa, Mycobacterium
HPGQEP

SEQ ID NO: 503722 - protein, 6 aa, Mycobacterium
HPGQHP

SEQ ID NO: 503723 - protein, 17 aa, Mycobacterium
HPGQPQAWTPEESRADR

SEQ ID NO: 503724 - protein, 17 aa, Mycobacterium
HPGQPQAWTPEESRSDR

SEQ ID NO: 503725 - protein, 8 aa, Mycobacterium
HPGQTGPY

SEQ ID NO: 503726 - protein, 11 aa, Mycobacterium
HPGQTTPDGRV

SEQ ID NO: 503727 - protein, 15 aa, Mycobacterium
HPGRDYDRDAILFMA

SEQ ID NO: 503728 - protein, 6 aa, Mycobacterium
HPGRGF

SEQ ID NO: 503729 - protein, 8 aa, Mycobacterium
HPGRGHTG

SEQ ID NO: 503730 - protein, 8 aa, Mycobacterium
HPGRPTSH

SEQ ID NO: 503731 - protein, 11 aa, Mycobacterium
HPGRRGIQSAR

SEQ ID NO: 503732 - protein, 5 aa, Mycobacterium
HPGRT

SEQ ID NO: 503733 - protein, 8 aa, Mycobacterium
HPGRTDRP

SEQ ID NO: 503734 - protein, 16 aa, Mycobacterium
HPGRTKAYLENGRAGA

SEQ ID NO: 503735 - protein, 5 aa, Mycobacterium
HPGSA

SEQ ID NO: 503736 - protein, 6 aa, Mycobacterium
HPGSAV

SEQ ID NO: 503737 - protein, 8 aa, Mycobacterium
HPGSDVEE

SEQ ID NO: 503738 - protein, 5 aa, Mycobacterium
HPGSG

SEQ ID NO: 503739 - protein, 6 aa, Mycobacterium
HPGSLA

SEQ ID NO: 503740 - protein, 5 aa, Mycobacterium
HPGSP

SEQ ID NO: 503741 - protein, 9 aa, Mycobacterium
HPGSVGRGF

SEQ ID NO: 503742 - protein, 6 aa, Mycobacterium
HPGTAV

SEQ ID NO: 503743 - protein, 5 aa, Mycobacterium
HPGTE

SEQ ID NO: 503744 - protein, 5 aa, Mycobacterium
HPGTF

SEQ ID NO: 503745 - protein, 10 aa, Mycobacterium
HPGTGETDIP

SEQ ID NO: 503746 - protein, 5 aa, Mycobacterium
HPGTR

SEQ ID NO: 503747 - protein, 7 aa, Mycobacterium
HPGVAPT

SEQ ID NO: 503748 - protein, 6 aa, Mycobacterium
HPGVPD

SEQ ID NO: 503749 - protein, 8 aa, Mycobacterium
HPGYGHSP

SEQ ID NO: 503750 - protein, 12 aa, Mycobacterium
HPGYGRRRPRPG

SEQ ID NO: 503751 - protein, 6 aa, Mycobacterium
HPGYSH

SEQ ID NO: 503752 - protein, 10 aa, Mycobacterium
HPHADPRTGE

SEQ ID NO: 503753 - protein, 6 aa, Mycobacterium
HPHADT

SEQ ID NO: 503754 - protein, 4 aa, Mycobacterium
HPHD

SEQ ID NO: 503755 - protein, 4 aa, Mycobacterium
HPHG

SEQ ID NO: 503756 - protein, 12 aa, Mycobacterium
HPHGAANSGEYR

SEQ ID NO: 503757 - protein, 5 aa, Mycobacterium
HPHGD

SEQ ID NO: 503758 - protein, 6 aa, Mycobacterium
HPHGDA

SEQ ID NO: 503759 - protein, 6 aa, Mycobacterium
HPHGDG

SEQ ID NO: 503760 - protein, 8 aa, Mycobacterium
HPHGDSSI

SEQ ID NO: 503761 - protein, 35 aa, Mycobacterium
HPHGGGEGKTSGGRHPVSPWGKKEGRTRHPNKQSN

SEQ ID NO: 503762 - protein, 36 aa, Mycobacterium
HPHGGGEGKTSGGRHPVSPWGKPEGRTRKPNKPSDK

SEQ ID NO: 503763 - protein, 35 aa, Mycobacterium
HPHGGGEGKTSGGRHPVSPWGKPEGRTRNPNKASN

SEQ ID NO: 503764 - protein, 4 aa, Mycobacterium
HPHL

SEQ ID NO: 503765 - protein, 18 aa, Mycobacterium
HPHPGRAPGPDGARPAKR

SEQ ID NO: 503766 - protein, 11 aa, Mycobacterium
HPHPPPNQQRG

SEQ ID NO: 503767 - protein, 4 aa, Mycobacterium
HPHR

SEQ ID NO: 503768 - protein, 9 aa, Mycobacterium
HPHRGAPNE

SEQ ID NO: 503769 - protein, 13 aa, Mycobacterium
HPHSHDDGTQHTH

SEQ ID NO: 503770 - protein, 9 aa, Mycobacterium
HPHSSTADI

SEQ ID NO: 503771 - protein, 5 aa, Mycobacterium
HPHTG

SEQ ID NO: 503772 - protein, 5 aa, Mycobacterium
HPIGT

SEQ ID NO: 503773 - protein, 18 aa, Mycobacterium
HPINPSGGVLSGNPTGAT

SEQ ID NO: 503774 - protein, 19 aa, Mycobacterium
HPIRDGEPVRATGEHPERG

SEQ ID NO: 503775 - protein, 6 aa, Mycobacterium
HPISGA

SEQ ID NO: 503776 - protein, 6 aa, Mycobacterium
HPITGG

SEQ ID NO: 503777 - protein, 4 aa, Mycobacterium
HPKA

SEQ ID NO: 503778 - protein, 17 aa, Mycobacterium
HPKARPETRDDPTPATG

SEQ ID NO: 503779 - protein, 6 aa, Mycobacterium
HPKEEP

SEQ ID NO: 503780 - protein, 4 aa, Mycobacterium
HPKG

SEQ ID NO: 503781 - protein, 14 aa, Mycobacterium
HPKGPGSSIDDVPD

SEQ ID NO: 503782 - protein, 8 aa, Mycobacterium
HPKPSAGS

SEQ ID NO: 503783 - protein, 8 aa, Mycobacterium
HPKRGEHL

SEQ ID NO: 503784 - protein, 4 aa, Mycobacterium
HPKT

SEQ ID NO: 503785 - protein, 6 aa, Mycobacterium
HPKTGE

SEQ ID NO: 503786 - protein, 15 aa, Mycobacterium
HPKVDDHAGVPAGTT

SEQ ID NO: 503787 - protein, 9 aa, Mycobacterium
HPKVDDRTG

SEQ ID NO: 503788 - protein, 9 aa, Mycobacterium
HPKVDGKTG

SEQ ID NO: 503789 - protein, 8 aa, Mycobacterium
HPKVDNAT

SEQ ID NO: 503790 - protein, 9 aa, Mycobacterium
HPKVDSGTG

SEQ ID NO: 503791 - protein, 14 aa, Mycobacterium
HPKYTVTSGSITLD

SEQ ID NO: 503792 - protein, 16 aa, Mycobacterium
HPLADSVGKADAEGMS

SEQ ID NO: 503793 - protein, 9 aa, Mycobacterium
HPLGADAAE

SEQ ID NO: 503794 - protein, 10 aa, Mycobacterium
HPLGADAAEV

SEQ ID NO: 503795 - protein, 7 aa, Mycobacterium
HPLGARP

SEQ ID NO: 503796 - protein, 9 aa, Mycobacterium
HPLGPGEPE

SEQ ID NO: 503797 - protein, 12 aa, Mycobacterium
HPLGPTRGARRV

SEQ ID NO: 503798 - protein, 6 aa, Mycobacterium
HPLPDD

SEQ ID NO: 503799 - protein, 10 aa, Mycobacterium
HPLPPRAADT

SEQ ID NO: 503800 - protein, 5 aa, Mycobacterium
HPLRD

SEQ ID NO: 503801 - protein, 10 aa, Mycobacterium
HPLSDEEAEA

SEQ ID NO: 503802 - protein, 6 aa, Mycobacterium
HPLSPP

SEQ ID NO: 503803 - protein, 9 aa, Mycobacterium
HPLSPRGVK

SEQ ID NO: 503804 - protein, 15 aa, Mycobacterium
HPLTEGSAEGPHPRR

SEQ ID NO: 503805 - protein, 6 aa, Mycobacterium
HPLTGG

SEQ ID NO: 503806 - protein, 24 aa, Mycobacterium
HPLTPETSLTASDSEADDTARATV

SEQ ID NO: 503807 - protein, 6 aa, Mycobacterium
HPMKEG

SEQ ID NO: 503808 - protein, 7 aa, Mycobacterium
HPMNDPT

SEQ ID NO: 503809 - protein, 4 aa, Mycobacterium
HPMP

SEQ ID NO: 503810 - protein, 13 aa, Mycobacterium
HPMPASDGEFGGD

SEQ ID NO: 503811 - protein, 6 aa, Mycobacterium
HPMTEP

SEQ ID NO: 503812 - protein, 5 aa, Mycobacterium
HPNAD

SEQ ID NO: 503813 - protein, 6 aa, Mycobacterium
HPNADA

SEQ ID NO: 503814 - protein, 5 aa, Mycobacterium
HPNAQ

SEQ ID NO: 503815 - protein, 6 aa, Mycobacterium
HPNAYA

SEQ ID NO: 503816 - protein, 5 aa, Mycobacterium
HPNDD

SEQ ID NO: 503817 - protein, 18 aa, Mycobacterium
HPNDPLGAGVTPRPGKGP

SEQ ID NO: 503818 - protein, 5 aa, Mycobacterium
HPNEP

SEQ ID NO: 503819 - protein, 7 aa, Mycobacterium
HPNGADT

SEQ ID NO: 503820 - protein, 6 aa, Mycobacterium
HPNGTP

SEQ ID NO: 503821 - protein, 4 aa, Mycobacterium
HPNL

SEQ ID NO: 503822 - protein, 6 aa, Mycobacterium
HPNPAY

SEQ ID NO: 503823 - protein, 8 aa, Mycobacterium
HPNPPKGK

SEQ ID NO: 503824 - protein, 18 aa, Mycobacterium
HPNQAANKKSALALALNK

SEQ ID NO: 503825 - protein, 7 aa, Mycobacterium
HPNRADA

SEQ ID NO: 503826 - protein, 9 aa, Mycobacterium
HPNRENTAI

SEQ ID NO: 503827 - protein, 14 aa, Mycobacterium
HPNRPPVPVDPEEV

SEQ ID NO: 503828 - protein, 10 aa, Mycobacterium
HPNTPEGDET

SEQ ID NO: 503829 - protein, 4 aa, Mycobacterium
HPNV

SEQ ID NO: 503830 - protein, 7 aa, Mycobacterium
HPNVNQA

SEQ ID NO: 503831 - protein, 9 aa, Mycobacterium
HPPAATIER

SEQ ID NO: 503832 - protein, 7 aa, Mycobacterium
HPPAEPL

SEQ ID NO: 503833 - protein, 9 aa, Mycobacterium
HPPAFPPGA

SEQ ID NO: 503834 - protein, 9 aa, Mycobacterium
HPPAGPGVR

SEQ ID NO: 503835 - protein, 6 aa, Mycobacterium
HPPAGT

SEQ ID NO: 503836 - protein, 10 aa, Mycobacterium
HPPAGTTDPP

SEQ ID NO: 503837 - protein, 7 aa, Mycobacterium
HPPAPQV

SEQ ID NO: 503838 - protein, 9 aa, Mycobacterium
HPPAPTVRP

SEQ ID NO: 503839 - protein, 10 aa, Mycobacterium
HPPATSDPRE

SEQ ID NO: 503840 - protein, 8 aa, Mycobacterium
HPPATTPV

SEQ ID NO: 503841 - protein, 4 aa, Mycobacterium
HPPD

SEQ ID NO: 503842 - protein, 6 aa, Mycobacterium
HPPDGL

SEQ ID NO: 503843 - protein, 13 aa, Mycobacterium
HPPDGLDYPAAAS

SEQ ID NO: 503844 - protein, 7 aa, Mycobacterium
HPPDGLG

SEQ ID NO: 503845 - protein, 11 aa, Mycobacterium
HPPDGLSYSEA

SEQ ID NO: 503846 - protein, 5 aa, Mycobacterium
HPPDN

SEQ ID NO: 503847 - protein, 4 aa, Mycobacterium
HPPE

SEQ ID NO: 503848 - protein, 9 aa, Mycobacterium
HPPEGLGYD

SEQ ID NO: 503849 - protein, 12 aa, Mycobacterium
HPPETAADRYSP

SEQ ID NO: 503850 - protein, 17 aa, Mycobacterium
HPPGARGAPPHRLPGGP

SEQ ID NO: 503851 - protein, 9 aa, Mycobacterium
HPPGDRGAH

SEQ ID NO: 503852 - protein, 8 aa, Mycobacterium
HPPGKPDR

SEQ ID NO: 503853 - protein, 13 aa, Mycobacterium
HPPGKPDRARTEH

SEQ ID NO: 503854 - protein, 10 aa, Mycobacterium
HPPGKPERLR

SEQ ID NO: 503855 - protein, 7 aa, Mycobacterium
HPPGPNA

SEQ ID NO: 503856 - protein, 12 aa, Mycobacterium
HPPGRLPGHRER

SEQ ID NO: 503857 - protein, 13 aa, Mycobacterium
HPPGSTEQFGSGL

SEQ ID NO: 503858 - protein, 10 aa, Mycobacterium
HPPGTPTQSM

SEQ ID NO: 503859 - protein, 7 aa, Mycobacterium
HPPIGAG

SEQ ID NO: 503860 - protein, 7 aa, Mycobacterium
HPPKRET

SEQ ID NO: 503861 - protein, 4 aa, Mycobacterium
HPPP

SEQ ID NO: 503862 - protein, 10 aa, Mycobacterium
HPPPATGSLR

SEQ ID NO: 503863 - protein, 9 aa, Mycobacterium
HPPPATGSM

SEQ ID NO: 503864 - protein, 6 aa, Mycobacterium
HPPPRP

SEQ ID NO: 503865 - protein, 6 aa, Mycobacterium
HPPPRV

SEQ ID NO: 503866 - protein, 19 aa, Mycobacterium
HPPQTPHPPEPHPAIPATP

SEQ ID NO: 503867 - protein, 5 aa, Mycobacterium
HPPRE

SEQ ID NO: 503868 - protein, 6 aa, Mycobacterium
HPPRND

SEQ ID NO: 503869 - protein, 5 aa, Mycobacterium
HPPSA

SEQ ID NO: 503870 - protein, 13 aa, Mycobacterium
HPPSEGGLRHDDP

SEQ ID NO: 503871 - protein, 9 aa, Mycobacterium
HPPSGPGVR

SEQ ID NO: 503872 - protein, 8 aa, Mycobacterium
HPPSLTAP

SEQ ID NO: 503873 - protein, 9 aa, Mycobacterium
HPPSPEQVE

SEQ ID NO: 503874 - protein, 9 aa, Mycobacterium
HPPSPPTTD

SEQ ID NO: 503875 - protein, 6 aa, Mycobacterium
HPPTRP

SEQ ID NO: 503876 - protein, 8 aa, Mycobacterium
HPPVGGQG

SEQ ID NO: 503877 - protein, 5 aa, Mycobacterium
HPPVT

SEQ ID NO: 503878 - protein, 4 aa, Mycobacterium
HPQA

SEQ ID NO: 503879 - protein, 10 aa, Mycobacterium
HPQAAEADNP

SEQ ID NO: 503880 - protein, 5 aa, Mycobacterium
HPQDR

SEQ ID NO: 503881 - protein, 6 aa, Mycobacterium
HPQDRA

SEQ ID NO: 503882 - protein, 8 aa, Mycobacterium
HPQDRGQV

SEQ ID NO: 503883 - protein, 4 aa, Mycobacterium
HPQE

SEQ ID NO: 503884 - protein, 8 aa, Mycobacterium
HPQEQDGV

SEQ ID NO: 503885 - protein, 4 aa, Mycobacterium
HPQG

SEQ ID NO: 503886 - protein, 11 aa, Mycobacterium
HPQGDADAPTR

SEQ ID NO: 503887 - protein, 11 aa, Mycobacterium
HPQHPGSPHPH

SEQ ID NO: 503888 - protein, 4 aa, Mycobacterium
HPQL

SEQ ID NO: 503889 - protein, 4 aa, Mycobacterium
HPQP

SEQ ID NO: 503890 - protein, 13 aa, Mycobacterium
HPQRGSFKTVGSP

SEQ ID NO: 503891 - protein, 9 aa, Mycobacterium
HPQRKDYPL

SEQ ID NO: 503892 - protein, 15 aa, Mycobacterium
HPQRPRKVGSIGTPI

SEQ ID NO: 503893 - protein, 7 aa, Mycobacterium
HPQRRTG

SEQ ID NO: 503894 - protein, 5 aa, Mycobacterium
HPQSG

SEQ ID NO: 503895 - protein, 5 aa, Mycobacterium
HPQYD

SEQ ID NO: 503896 - protein, 10 aa, Mycobacterium
HPRAARCSAE

SEQ ID NO: 503897 - protein, 5 aa, Mycobacterium
HPRAG

SEQ ID NO: 503898 - protein, 5 aa, Mycobacterium
HPRAL

SEQ ID NO: 503899 - protein, 6 aa, Mycobacterium
HPRANY

SEQ ID NO: 503900 - protein, 9 aa, Mycobacterium
HPRAPDGLR

SEQ ID NO: 503901 - protein, 7 aa, Mycobacterium
HPRAPGV

SEQ ID NO: 503902 - protein, 16 aa, Mycobacterium
HPRARAGLDRASGRIP

SEQ ID NO: 503903 - protein, 12 aa, Mycobacterium
HPRELSGGQRQR

SEQ ID NO: 503904 - protein, 11 aa, Mycobacterium
HPRGDEPNAPL

SEQ ID NO: 503905 - protein, 12 aa, Mycobacterium
HPRGGADDDPPI

SEQ ID NO: 503906 - protein, 5 aa, Mycobacterium
HPRGL

SEQ ID NO: 503907 - protein, 9 aa, Mycobacterium
HPRGPDGPE

SEQ ID NO: 503908 - protein, 15 aa, Mycobacterium
HPRGRVAGRPRTSAA

SEQ ID NO: 503909 - protein, 13 aa, Mycobacterium
HPRHAPTASPRNP

SEQ ID NO: 503910 - protein, 8 aa, Mycobacterium
HPRHSHDR

SEQ ID NO: 503911 - protein, 6 aa, Mycobacterium
HPRKLG

SEQ ID NO: 503912 - protein, 5 aa, Mycobacterium
HPRLG

SEQ ID NO: 503913 - protein, 15 aa, Mycobacterium
HPRLGDDESSCQQQP

SEQ ID NO: 503914 - protein, 4 aa, Mycobacterium
HPRN

SEQ ID NO: 503915 - protein, 5 aa, Mycobacterium
HPRNL

SEQ ID NO: 503916 - protein, 4 aa, Mycobacterium
HPRP

SEQ ID NO: 503917 - protein, 5 aa, Mycobacterium
HPRPG

SEQ ID NO: 503918 - protein, 6 aa, Mycobacterium
HPRQDP

SEQ ID NO: 503919 - protein, 4 aa, Mycobacterium
HPRR

SEQ ID NO: 503920 - protein, 27 aa, Mycobacterium
HPRRARGPRPGPRGRGAAGAVGGDGVA

SEQ ID NO: 503921 - protein, 9 aa, Mycobacterium
HPRRDEPTA

SEQ ID NO: 503922 - protein, 8 aa, Mycobacterium
HPRRDTTV

SEQ ID NO: 503923 - protein, 5 aa, Mycobacterium
HPRRE

SEQ ID NO: 503924 - protein, 9 aa, Mycobacterium
HPRRGDTQR

SEQ ID NO: 503925 - protein, 6 aa, Mycobacterium
HPRRIG

SEQ ID NO: 503926 - protein, 5 aa, Mycobacterium
HPRRP

SEQ ID NO: 503927 - protein, 7 aa, Mycobacterium
HPRRRGE

SEQ ID NO: 503928 - protein, 16 aa, Mycobacterium
HPRRRPNSGARPPRQH

SEQ ID NO: 503929 - protein, 4 aa, Mycobacterium
HPRS

SEQ ID NO: 503930 - protein, 11 aa, Mycobacterium
HPRSAADDDAP

SEQ ID NO: 503931 - protein, 12 aa, Mycobacterium
HPRSALDDDPPV

SEQ ID NO: 503932 - protein, 9 aa, Mycobacterium
HPRSARGGK

SEQ ID NO: 503933 - protein, 12 aa, Mycobacterium
HPRSATDDDPPV

SEQ ID NO: 503934 - protein, 20 aa, Mycobacterium
HPRSDFPTQPPYPGWPIANP

SEQ ID NO: 503935 - protein, 6 aa, Mycobacterium
HPRSRG

SEQ ID NO: 503936 - protein, 22 aa, Mycobacterium
HPRSSAQSFPGLARTAALVRLT

SEQ ID NO: 503937 - protein, 4 aa, Mycobacterium
HPRT

SEQ ID NO: 503938 - protein, 9 aa, Mycobacterium
HPRTDARNL

SEQ ID NO: 503939 - protein, 5 aa, Mycobacterium
HPRTE

SEQ ID NO: 503940 - protein, 7 aa, Mycobacterium
HPRTGDP

SEQ ID NO: 503941 - protein, 5 aa, Mycobacterium
HPRTK

SEQ ID NO: 503942 - protein, 12 aa, Mycobacterium
HPRYGDDDGWEQ

SEQ ID NO: 503943 - protein, 20 aa, Mycobacterium
HPSADAGGLPALGPPFGQGE

SEQ ID NO: 503944 - protein, 7 aa, Mycobacterium
HPSAPER

SEQ ID NO: 503945 - protein, 9 aa, Mycobacterium
HPSAPPDQV

SEQ ID NO: 503946 - protein, 7 aa, Mycobacterium
HPSAVGT

SEQ ID NO: 503947 - protein, 11 aa, Mycobacterium
HPSDGGRGRYT

SEQ ID NO: 503948 - protein, 9 aa, Mycobacterium
HPSDGSTGL

SEQ ID NO: 503949 - protein, 10 aa, Mycobacterium
HPSDPGNPKK

SEQ ID NO: 503950 - protein, 11 aa, Mycobacterium
HPSDVGAPDVS

SEQ ID NO: 503951 - protein, 10 aa, Mycobacterium
HPSEARELGP

SEQ ID NO: 503952 - protein, 6 aa, Mycobacterium
HPSEDD

SEQ ID NO: 503953 - protein, 7 aa, Mycobacterium
HPSERGR

SEQ ID NO: 503954 - protein, 7 aa, Mycobacterium
HPSGADQ

SEQ ID NO: 503955 - protein, 12 aa, Mycobacterium
HPSGDGSACATR

SEQ ID NO: 503956 - protein, 12 aa, Mycobacterium
HPSGDPSAFTRR

SEQ ID NO: 503957 - protein, 75 aa, Mycobacterium
HPSGGDGATGGGDLADHSKPSSSTAAHETNPGSQPGIEESPPTSSAGEHPSEAARNSGDETSDQHRKPSGEHQLS

SEQ ID NO: 503958 - protein, 9 aa, Mycobacterium
HPSGGPPVH

SEQ ID NO: 503959 - protein, 11 aa, Mycobacterium
HPSGTAKDVED

SEQ ID NO: 503960 - protein, 16 aa, Mycobacterium
HPSGTDPSTHPSSDEV

SEQ ID NO: 503961 - protein, 7 aa, Mycobacterium
HPSGVDT

SEQ ID NO: 503962 - protein, 6 aa, Mycobacterium
HPSGVE

SEQ ID NO: 503963 - protein, 7 aa, Mycobacterium
HPSGVET

SEQ ID NO: 503964 - protein, 16 aa, Mycobacterium
HPSHNTPGREEQVRQA

SEQ ID NO: 503965 - protein, 5 aa, Mycobacterium
HPSIG

SEQ ID NO: 503966 - protein, 6 aa, Mycobacterium
HPSITP

SEQ ID NO: 503967 - protein, 8 aa, Mycobacterium
HPSKNPMR

SEQ ID NO: 503968 - protein, 9 aa, Mycobacterium
HPSKNPMRT

SEQ ID NO: 503969 - protein, 4 aa, Mycobacterium
HPSL

SEQ ID NO: 503970 - protein, 10 aa, Mycobacterium
HPSLDDPALA

SEQ ID NO: 503971 - protein, 5 aa, Mycobacterium
HPSLN

SEQ ID NO: 503972 - protein, 8 aa, Mycobacterium
HPSNQGRL

SEQ ID NO: 503973 - protein, 6 aa, Mycobacterium
HPSPDT

SEQ ID NO: 503974 - protein, 8 aa, Mycobacterium
HPSPLSAS

SEQ ID NO: 503975 - protein, 10 aa, Mycobacterium
HPSPRQYTRK

SEQ ID NO: 503976 - protein, 5 aa, Mycobacterium
HPSPV

SEQ ID NO: 503977 - protein, 10 aa, Mycobacterium
HPSQASPLGA

SEQ ID NO: 503978 - protein, 5 aa, Mycobacterium
HPSQL

SEQ ID NO: 503979 - protein, 8 aa, Mycobacterium
HPSQVNTP

SEQ ID NO: 503980 - protein, 8 aa, Mycobacterium
HPSRITQG

SEQ ID NO: 503981 - protein, 6 aa, Mycobacterium
HPSRPG

SEQ ID NO: 503982 - protein, 5 aa, Mycobacterium
HPSRS

SEQ ID NO: 503983 - protein, 12 aa, Mycobacterium
HPSRSQVLRDYL

SEQ ID NO: 503984 - protein, 7 aa, Mycobacterium
HPSSADI

SEQ ID NO: 503985 - protein, 9 aa, Mycobacterium
HPSSQQRAA

SEQ ID NO: 503986 - protein, 30 aa, Mycobacterium
HPSSSSDNVNSTVAKRQAEAGTAPRREGPP

SEQ ID NO: 503987 - protein, 29 aa, Mycobacterium
HPSSSSDRSKSTIARRQAQNAPAPDPEIP

SEQ ID NO: 503988 - protein, 30 aa, Mycobacterium
HPSSSSENANSTVAKRQAEAGTAPPRQGPP

SEQ ID NO: 503989 - protein, 11 aa, Mycobacterium
HPSSVNGAEMR

SEQ ID NO: 503990 - protein, 26 aa, Mycobacterium
HPSTRGSLRGKPGQADPSAGLFTRPE

SEQ ID NO: 503991 - protein, 26 aa, Mycobacterium
HPSTRGSLRGKPGRDDPSIGLFCPPS

SEQ ID NO: 503992 - protein, 9 aa, Mycobacterium
HPSTSGPYA

SEQ ID NO: 503993 - protein, 6 aa, Mycobacterium
HPSTSI

SEQ ID NO: 503994 - protein, 6 aa, Mycobacterium
HPSVGG

SEQ ID NO: 503995 - protein, 4 aa, Mycobacterium
HPSY

SEQ ID NO: 503996 - protein, 6 aa, Mycobacterium
HPSYDR

SEQ ID NO: 503997 - protein, 15 aa, Mycobacterium
HPSYQSRTLAPPLRV

SEQ ID NO: 503998 - protein, 4 aa, Mycobacterium
HPTA

SEQ ID NO: 503999 - protein, 6 aa, Mycobacterium
HPTADG

SEQ ID NO: 504000 - protein, 5 aa, Mycobacterium
HPTAS

SEQ ID NO: 504001 - protein, 6 aa, Mycobacterium
HPTDDE

SEQ ID NO: 504002 - protein, 6 aa, Mycobacterium
HPTDEE

SEQ ID NO: 504003 - protein, 8 aa, Mycobacterium
HPTDPDGE

SEQ ID NO: 504004 - protein, 8 aa, Mycobacterium
HPTDPQGE

SEQ ID NO: 504005 - protein, 6 aa, Mycobacterium
HPTDTR

SEQ ID NO: 504006 - protein, 6 aa, Mycobacterium
HPTFDD

SEQ ID NO: 504007 - protein, 4 aa, Mycobacterium
HPTG

SEQ ID NO: 504008 - protein, 17 aa, Mycobacterium
HPTGKGQKMPVEPGVST

SEQ ID NO: 504009 - protein, 6 aa, Mycobacterium
HPTGVD

SEQ ID NO: 504010 - protein, 12 aa, Mycobacterium
HPTGVETGMRPD

SEQ ID NO: 504011 - protein, 11 aa, Mycobacterium
HPTGVPTGMRP

SEQ ID NO: 504012 - protein, 5 aa, Mycobacterium
HPTHG

SEQ ID NO: 504013 - protein, 9 aa, Mycobacterium
HPTHPREMS

SEQ ID NO: 504014 - protein, 8 aa, Mycobacterium
HPTHPSGK

SEQ ID NO: 504015 - protein, 19 aa, Mycobacterium
HPTIAPATTAAEREATAQR

SEQ ID NO: 504016 - protein, 10 aa, Mycobacterium
HPTKDCDPSE

SEQ ID NO: 504017 - protein, 10 aa, Mycobacterium
HPTKGKHAEL

SEQ ID NO: 504018 - protein, 5 aa, Mycobacterium
HPTLE

SEQ ID NO: 504019 - protein, 5 aa, Mycobacterium
HPTLG

SEQ ID NO: 504020 - protein, 6 aa, Mycobacterium
HPTLGR

SEQ ID NO: 504021 - protein, 6 aa, Mycobacterium
HPTNVD

SEQ ID NO: 504022 - protein, 5 aa, Mycobacterium
HPTPA

SEQ ID NO: 504023 - protein, 17 aa, Mycobacterium
HPTPAATEKARQAPVSS

SEQ ID NO: 504024 - protein, 6 aa, Mycobacterium
HPTPDT

SEQ ID NO: 504025 - protein, 5 aa, Mycobacterium
HPTPE

SEQ ID NO: 504026 - protein, 5 aa, Mycobacterium
HPTPG

SEQ ID NO: 504027 - protein, 12 aa, Mycobacterium
HPTQGPPRGRAA

SEQ ID NO: 504028 - protein, 9 aa, Mycobacterium
HPTQLGPAR

SEQ ID NO: 504029 - protein, 13 aa, Mycobacterium
HPTRADALTEAAR

SEQ ID NO: 504030 - protein, 9 aa, Mycobacterium
HPTRASDDY

SEQ ID NO: 504031 - protein, 12 aa, Mycobacterium
HPTSDSVEVTFD

SEQ ID NO: 504032 - protein, 16 aa, Mycobacterium
HPTSGTATIDGKRYRE

SEQ ID NO: 504033 - protein, 12 aa, Mycobacterium
HPTSPDTAPALT

SEQ ID NO: 504034 - protein, 6 aa, Mycobacterium
HPTTEG

SEQ ID NO: 504035 - protein, 17 aa, Mycobacterium
HPTTEGLPITDRDPRRY

SEQ ID NO: 504036 - protein, 12 aa, Mycobacterium
HPTTLSGGQQQR

SEQ ID NO: 504037 - protein, 9 aa, Mycobacterium
HPTVNGGAG

SEQ ID NO: 504038 - protein, 15 aa, Mycobacterium
HPVADSIGKSDGENM

SEQ ID NO: 504039 - protein, 7 aa, Mycobacterium
HPVADSP

SEQ ID NO: 504040 - protein, 8 aa, Mycobacterium
HPVADSPV

SEQ ID NO: 504041 - protein, 9 aa, Mycobacterium
HPVAQATRT

SEQ ID NO: 504042 - protein, 10 aa, Mycobacterium
HPVDDPESIF

SEQ ID NO: 504043 - protein, 8 aa, Mycobacterium
HPVDTSRP

SEQ ID NO: 504044 - protein, 4 aa, Mycobacterium
HPVE

SEQ ID NO: 504045 - protein, 12 aa, Mycobacterium
HPVEAPYRQTQC

SEQ ID NO: 504046 - protein, 4 aa, Mycobacterium
HPVG

SEQ ID NO: 504047 - protein, 5 aa, Mycobacterium
HPVGE

SEQ ID NO: 504048 - protein, 5 aa, Mycobacterium
HPVKA

SEQ ID NO: 504049 - protein, 8 aa, Mycobacterium
HPVPADDP

SEQ ID NO: 504050 - protein, 7 aa, Mycobacterium
HPVPGGA

SEQ ID NO: 504051 - protein, 5 aa, Mycobacterium
HPVPP

SEQ ID NO: 504052 - protein, 11 aa, Mycobacterium
HPVPQTYAEAA

SEQ ID NO: 504053 - protein, 5 aa, Mycobacterium
HPVPR

SEQ ID NO: 504054 - protein, 6 aa, Mycobacterium
HPVPRR

SEQ ID NO: 504055 - protein, 8 aa, Mycobacterium
HPVQGEAA

SEQ ID NO: 504056 - protein, 4 aa, Mycobacterium
HPVR

SEQ ID NO: 504057 - protein, 20 aa, Mycobacterium
HPVRGTQQTDTRTPIPVDTR

SEQ ID NO: 504058 - protein, 12 aa, Mycobacterium
HPVRSARPADRS

SEQ ID NO: 504059 - protein, 11 aa, Mycobacterium
HPVRTDGNAYV

SEQ ID NO: 504060 - protein, 14 aa, Mycobacterium
HPWRRAGSGEVRPG

SEQ ID NO: 504061 - protein, 4 aa, Mycobacterium
HPYA

SEQ ID NO: 504062 - protein, 4 aa, Mycobacterium
HPYD

SEQ ID NO: 504063 - protein, 6 aa, Mycobacterium
HPYEEP

SEQ ID NO: 504064 - protein, 11 aa, Mycobacterium
HPYGTDTPMGN

SEQ ID NO: 504065 - protein, 13 aa, Mycobacterium
HPYGTDTPMGNDP

SEQ ID NO: 504066 - protein, 7 aa, Mycobacterium
HPYSAGG

SEQ ID NO: 504067 - protein, 4 aa, Mycobacterium
HQAA

SEQ ID NO: 504068 - protein, 12 aa, Mycobacterium
HQAAEEAAARWG

SEQ ID NO: 504069 - protein, 11 aa, Mycobacterium
HQAAETGSRRD

SEQ ID NO: 504070 - protein, 15 aa, Mycobacterium
HQAESRVKRAATRRA

SEQ ID NO: 504071 - protein, 7 aa, Mycobacterium
HQAGATA

SEQ ID NO: 504072 - protein, 9 aa, Mycobacterium
HQAGGARPR

SEQ ID NO: 504073 - protein, 6 aa, Mycobacterium
HQAPAA

SEQ ID NO: 504074 - protein, 16 aa, Mycobacterium
HQAQGRAQAAATTTAH

SEQ ID NO: 504075 - protein, 22 aa, Mycobacterium
HQARQRRTERRREAERADHVPQ

SEQ ID NO: 504076 - protein, 9 aa, Mycobacterium
HQARSQHRK

SEQ ID NO: 504077 - protein, 24 aa, Mycobacterium
HQASALGARATGPGHELDSSGTAE

SEQ ID NO: 504078 - protein, 9 aa, Mycobacterium
HQASGADRV

SEQ ID NO: 504079 - protein, 12 aa, Mycobacterium
HQATEDRAGADI

SEQ ID NO: 504080 - protein, 6 aa, Mycobacterium
HQDDAV

SEQ ID NO: 504081 - protein, 6 aa, Mycobacterium
HQDDTV

SEQ ID NO: 504082 - protein, 8 aa, Mycobacterium
HQDGGGDM

SEQ ID NO: 504083 - protein, 16 aa, Mycobacterium
HQDGGHPINDSEEVQR

SEQ ID NO: 504084 - protein, 7 aa, Mycobacterium
HQDGSTR

SEQ ID NO: 504085 - protein, 6 aa, Mycobacterium
HQDGVT

SEQ ID NO: 504086 - protein, 5 aa, Mycobacterium
HQDKE

SEQ ID NO: 504087 - protein, 5 aa, Mycobacterium
HQDNA

SEQ ID NO: 504088 - protein, 7 aa, Mycobacterium
HQDPDAA

SEQ ID NO: 504089 - protein, 14 aa, Mycobacterium
HQDPEHHRRVAELT

SEQ ID NO: 504090 - protein, 8 aa, Mycobacterium
HQDPQPVT

SEQ ID NO: 504091 - protein, 16 aa, Mycobacterium
HQDRDRHIEDRDRGID

SEQ ID NO: 504092 - protein, 5 aa, Mycobacterium
HQDRE

SEQ ID NO: 504093 - protein, 6 aa, Mycobacterium
HQDRGH

SEQ ID NO: 504094 - protein, 13 aa, Mycobacterium
HQDRSDDPSLPET

SEQ ID NO: 504095 - protein, 8 aa, Mycobacterium
HQDSAGEA

SEQ ID NO: 504096 - protein, 9 aa, Mycobacterium
HQDSHGGGG

SEQ ID NO: 504097 - protein, 10 aa, Mycobacterium
HQDSHGGGGL

SEQ ID NO: 504098 - protein, 7 aa, Mycobacterium
HQDSTVS

SEQ ID NO: 504099 - protein, 10 aa, Mycobacterium
HQDSYGGGGL

SEQ ID NO: 504100 - protein, 6 aa, Mycobacterium
HQDTSE

SEQ ID NO: 504101 - protein, 5 aa, Mycobacterium
HQDTT

SEQ ID NO: 504102 - protein, 6 aa, Mycobacterium
HQEEAA

SEQ ID NO: 504103 - protein, 7 aa, Mycobacterium
HQEESEE

SEQ ID NO: 504104 - protein, 9 aa, Mycobacterium
HQEGASSGG

SEQ ID NO: 504105 - protein, 10 aa, Mycobacterium
HQERGDAARN

SEQ ID NO: 504106 - protein, 43 aa, Mycobacterium
HQESRSGDHAAGACRQGRAGVGAVRDAPGEKHRPRPGHRKSLR

SEQ ID NO: 504107 - protein, 17 aa, Mycobacterium
HQETGSPGAVETPSATV

SEQ ID NO: 504108 - protein, 4 aa, Mycobacterium
HQEV

SEQ ID NO: 504109 - protein, 6 aa, Mycobacterium
HQFSGA

SEQ ID NO: 504110 - protein, 6 aa, Mycobacterium
HQGADG

SEQ ID NO: 504111 - protein, 7 aa, Mycobacterium
HQGAHGG

SEQ ID NO: 504112 - protein, 8 aa, Mycobacterium
HQGARTGT

SEQ ID NO: 504113 - protein, 11 aa, Mycobacterium
HQGERRAAYNG

SEQ ID NO: 504114 - protein, 9 aa, Mycobacterium
HQGESAASF

SEQ ID NO: 504115 - protein, 11 aa, Mycobacterium
HQGESRAGYNG

SEQ ID NO: 504116 - protein, 9 aa, Mycobacterium
HQGESSAAF

SEQ ID NO: 504117 - protein, 6 aa, Mycobacterium
HQGGGR

SEQ ID NO: 504118 - protein, 10 aa, Mycobacterium
HQGGPGVDAD

SEQ ID NO: 504119 - protein, 14 aa, Mycobacterium
HQGNSTESPEEADA

SEQ ID NO: 504120 - protein, 7 aa, Mycobacterium
HQGPPAR

SEQ ID NO: 504121 - protein, 7 aa, Mycobacterium
HQGRDRT

SEQ ID NO: 504122 - protein, 8 aa, Mycobacterium
HQGRTGPC

SEQ ID NO: 504123 - protein, 6 aa, Mycobacterium
HQGTGI

SEQ ID NO: 504124 - protein, 13 aa, Mycobacterium
HQGVSDYKGAVND

SEQ ID NO: 504125 - protein, 10 aa, Mycobacterium
HQHGAPPQIT

SEQ ID NO: 504126 - protein, 9 aa, Mycobacterium
HQLSGGQRQ

SEQ ID NO: 504127 - protein, 8 aa, Mycobacterium
HQMPSGDM

SEQ ID NO: 504128 - protein, 12 aa, Mycobacterium
HQMRRTESMTDE

SEQ ID NO: 504129 - protein, 9 aa, Mycobacterium
HQNDGQGRI

SEQ ID NO: 504130 - protein, 16 aa, Mycobacterium
HQNGDHPINGSEEVQR

SEQ ID NO: 504131 - protein, 6 aa, Mycobacterium
HQNGEA

SEQ ID NO: 504132 - protein, 30 aa, Mycobacterium
HQNGENPINDSAEVQRTAQALGAQSEQLPQ

SEQ ID NO: 504133 - protein, 8 aa, Mycobacterium
HQNSQVPD

SEQ ID NO: 504134 - protein, 7 aa, Mycobacterium
HQNSSAH

SEQ ID NO: 504135 - protein, 8 aa, Mycobacterium
HQNSVSSQ

SEQ ID NO: 504136 - protein, 15 aa, Mycobacterium
HQPAHDKGSSHGGSR

SEQ ID NO: 504137 - protein, 5 aa, Mycobacterium
HQPAK

SEQ ID NO: 504138 - protein, 15 aa, Mycobacterium
HQPAKPAADQNRGDA

SEQ ID NO: 504139 - protein, 5 aa, Mycobacterium
HQPAP

SEQ ID NO: 504140 - protein, 8 aa, Mycobacterium
HQPARKWE

SEQ ID NO: 504141 - protein, 17 aa, Mycobacterium
HQPARSQDRSRDTDGCD

SEQ ID NO: 504142 - protein, 53 aa, Mycobacterium
HQPATPADTATTAVARRADSTRSAGTAVAKQPGRPTGATGLTSRSRAAGTAVT

SEQ ID NO: 504143 - protein, 10 aa, Mycobacterium
HQPDPRLQGA

SEQ ID NO: 504144 - protein, 6 aa, Mycobacterium
HQPDQD

SEQ ID NO: 504145 - protein, 20 aa, Mycobacterium
HQPDTGEIRYDGEPVAPKGS

SEQ ID NO: 504146 - protein, 4 aa, Mycobacterium
HQPE

SEQ ID NO: 504147 - protein, 9 aa, Mycobacterium
HQPEKPQEA

SEQ ID NO: 504148 - protein, 11 aa, Mycobacterium
HQPEKTAEAID

SEQ ID NO: 504149 - protein, 5 aa, Mycobacterium
HQPEL

SEQ ID NO: 504150 - protein, 9 aa, Mycobacterium
HQPGDVPTR

SEQ ID NO: 504151 - protein, 7 aa, Mycobacterium
HQPGERL

SEQ ID NO: 504152 - protein, 5 aa, Mycobacterium
HQPGG

SEQ ID NO: 504153 - protein, 8 aa, Mycobacterium
HQPGGDAK

SEQ ID NO: 504154 - protein, 6 aa, Mycobacterium
HQPGGH

SEQ ID NO: 504155 - protein, 7 aa, Mycobacterium
HQPGGNV

SEQ ID NO: 504156 - protein, 5 aa, Mycobacterium
HQPGL

SEQ ID NO: 504157 - protein, 10 aa, Mycobacterium
HQPGRPAVTG

SEQ ID NO: 504158 - protein, 11 aa, Mycobacterium
HQPGTSNSAWD

SEQ ID NO: 504159 - protein, 8 aa, Mycobacterium
HQPGTSRD

SEQ ID NO: 504160 - protein, 8 aa, Mycobacterium
HQPGTSTD

SEQ ID NO: 504161 - protein, 5 aa, Mycobacterium
HQPHE

SEQ ID NO: 504162 - protein, 7 aa, Mycobacterium
HQPHPRE

SEQ ID NO: 504163 - protein, 30 aa, Mycobacterium
HQPIPAEASPPSNGRGPGSTPAGKRGTESW

SEQ ID NO: 504164 - protein, 6 aa, Mycobacterium
HQPPAQ

SEQ ID NO: 504165 - protein, 14 aa, Mycobacterium
HQPPASGGESEYIS

SEQ ID NO: 504166 - protein, 10 aa, Mycobacterium
HQPPHRRAGQ

SEQ ID NO: 504167 - protein, 7 aa, Mycobacterium
HQPPPAH

SEQ ID NO: 504168 - protein, 12 aa, Mycobacterium
HQPPQWPEGGVP

SEQ ID NO: 504169 - protein, 5 aa, Mycobacterium
HQPPT

SEQ ID NO: 504170 - protein, 12 aa, Mycobacterium
HQPQKKWDEAKA

SEQ ID NO: 504171 - protein, 14 aa, Mycobacterium
HQPQKQWDQAKATL

SEQ ID NO: 504172 - protein, 12 aa, Mycobacterium
HQPQKQWDTAKA

SEQ ID NO: 504173 - protein, 7 aa, Mycobacterium
HQPQPGY

SEQ ID NO: 504174 - protein, 6 aa, Mycobacterium
HQPQRQ

SEQ ID NO: 504175 - protein, 12 aa, Mycobacterium
HQPRGGRVVPGD

SEQ ID NO: 504176 - protein, 5 aa, Mycobacterium
HQPRP

SEQ ID NO: 504177 - protein, 7 aa, Mycobacterium
HQPTHDL

SEQ ID NO: 504178 - protein, 18 aa, Mycobacterium
HQPTPREDSSAAADRDIE

SEQ ID NO: 504179 - protein, 15 aa, Mycobacterium
HQPTRMSGGEQQRTA

SEQ ID NO: 504180 - protein, 5 aa, Mycobacterium
HQPVG

SEQ ID NO: 504181 - protein, 8 aa, Mycobacterium
HQPYPVTA

SEQ ID NO: 504182 - protein, 30 aa, Mycobacterium
HQQAGARRDDQHRRERHGAPGRHHGAPHGG

SEQ ID NO: 504183 - protein, 6 aa, Mycobacterium
HQQAST

SEQ ID NO: 504184 - protein, 5 aa, Mycobacterium
HQQGN

SEQ ID NO: 504185 - protein, 6 aa, Mycobacterium
HQQGNN

SEQ ID NO: 504186 - protein, 13 aa, Mycobacterium
HQQGRSDDARATC

SEQ ID NO: 504187 - protein, 12 aa, Mycobacterium
HQQPAQPNEGAS

SEQ ID NO: 504188 - protein, 6 aa, Mycobacterium
HQQQRT

SEQ ID NO: 504189 - protein, 11 aa, Mycobacterium
HQRAAAGHLPD

SEQ ID NO: 504190 - protein, 26 aa, Mycobacterium
HQRAAEKERDAARHDYQKAQEAERQG

SEQ ID NO: 504191 - protein, 16 aa, Mycobacterium
HQRADTPERRRARARS

SEQ ID NO: 504192 - protein, 12 aa, Mycobacterium
HQRAEKPDASYL

SEQ ID NO: 504193 - protein, 4 aa, Mycobacterium
HQRD

SEQ ID NO: 504194 - protein, 5 aa, Mycobacterium
HQRDP

SEQ ID NO: 504195 - protein, 11 aa, Mycobacterium
HQRDTQRVDGA

SEQ ID NO: 504196 - protein, 9 aa, Mycobacterium
HQRGGREVE

SEQ ID NO: 504197 - protein, 4 aa, Mycobacterium
HQRP

SEQ ID NO: 504198 - protein, 10 aa, Mycobacterium
HQRPDGSVRV

SEQ ID NO: 504199 - protein, 9 aa, Mycobacterium
HQRQAAATL

SEQ ID NO: 504200 - protein, 11 aa, Mycobacterium
HQRQAANAQMS

SEQ ID NO: 504201 - protein, 6 aa, Mycobacterium
HQRRAA

SEQ ID NO: 504202 - protein, 35 aa, Mycobacterium
HQRRAARGVDRDRGALQAQPVTDPARRRGGRRPDR

SEQ ID NO: 504203 - protein, 30 aa, Mycobacterium
HQRRPPRVAPTAAPPPPPVAPTQAGGAQVA

SEQ ID NO: 504204 - protein, 10 aa, Mycobacterium
HQRRSAEDSA

SEQ ID NO: 504205 - protein, 4 aa, Mycobacterium
HQRS

SEQ ID NO: 504206 - protein, 7 aa, Mycobacterium
HQRSDAM

SEQ ID NO: 504207 - protein, 10 aa, Mycobacterium
HQRSQRPAVR

SEQ ID NO: 504208 - protein, 12 aa, Mycobacterium
HQRSVSDETTMR

SEQ ID NO: 504209 - protein, 6 aa, Mycobacterium
HQRTAD

SEQ ID NO: 504210 - protein, 5 aa, Mycobacterium
HQRTP

SEQ ID NO: 504211 - protein, 25 aa, Mycobacterium
HQSASSGDVASARADVEAAADRMGR

SEQ ID NO: 504212 - protein, 10 aa, Mycobacterium
HQSDPAAVVP

SEQ ID NO: 504213 - protein, 6 aa, Mycobacterium
HQSFTT

SEQ ID NO: 504214 - protein, 7 aa, Mycobacterium
HQSFTTD

SEQ ID NO: 504215 - protein, 8 aa, Mycobacterium
HQSPDMQT

SEQ ID NO: 504216 - protein, 15 aa, Mycobacterium
HQSPEGSLESWQPQQ

SEQ ID NO: 504217 - protein, 10 aa, Mycobacterium
HQSPSRPARD

SEQ ID NO: 504218 - protein, 8 aa, Mycobacterium
HQSTSQDW

SEQ ID NO: 504219 - protein, 8 aa, Mycobacterium
HQTADGRE

SEQ ID NO: 504220 - protein, 20 aa, Mycobacterium
HQTAGRGRNGRQWTTPPRSQ

SEQ ID NO: 504221 - protein, 9 aa, Mycobacterium
HQTETGYGH

SEQ ID NO: 504222 - protein, 5 aa, Mycobacterium
HQTHA

SEQ ID NO: 504223 - protein, 13 aa, Mycobacterium
HQTQGQLAPGDPY

SEQ ID NO: 504224 - protein, 4 aa, Mycobacterium
HQTS

SEQ ID NO: 504225 - protein, 4 aa, Mycobacterium
HQTY

SEQ ID NO: 504226 - protein, 10 aa, Mycobacterium
HQVGDSASID

SEQ ID NO: 504227 - protein, 5 aa, Mycobacterium
HQVGE

SEQ ID NO: 504228 - protein, 12 aa, Mycobacterium
HQVGGSTARSGG

SEQ ID NO: 504229 - protein, 4 aa, Mycobacterium
HQVR

SEQ ID NO: 504230 - protein, 13 aa, Mycobacterium
HQVSGAKSDAADA

SEQ ID NO: 504231 - protein, 10 aa, Mycobacterium
HQWPGGTRGP

SEQ ID NO: 504232 - protein, 5 aa, Mycobacterium
HQYNP

SEQ ID NO: 504233 - protein, 6 aa, Mycobacterium
HQYPTG

SEQ ID NO: 504234 - protein, 19 aa, Mycobacterium
HQYQETNAQNRAALGSIQS

SEQ ID NO: 504235 - protein, 7 aa, Mycobacterium
HQYTKAE

SEQ ID NO: 504236 - protein, 30 aa, Mycobacterium
HRAADDAEIGSARAAVQAASQRMGRQMPDT

SEQ ID NO: 504237 - protein, 8 aa, Mycobacterium
HRAADGDL

SEQ ID NO: 504238 - protein, 6 aa, Mycobacterium
HRAAGA

SEQ ID NO: 504239 - protein, 12 aa, Mycobacterium
HRAAGAGARKRR

SEQ ID NO: 504240 - protein, 11 aa, Mycobacterium
HRAASGRSAHT

SEQ ID NO: 504241 - protein, 10 aa, Mycobacterium
HRAASSDEMD

SEQ ID NO: 504242 - protein, 4 aa, Mycobacterium
HRAD

SEQ ID NO: 504243 - protein, 5 aa, Mycobacterium
HRADD

SEQ ID NO: 504244 - protein, 7 aa, Mycobacterium
HRADDWP

SEQ ID NO: 504245 - protein, 16 aa, Mycobacterium
HRADGKAGTDVDDVDR

SEQ ID NO: 504246 - protein, 6 aa, Mycobacterium
HRADNT

SEQ ID NO: 504247 - protein, 16 aa, Mycobacterium
HRADRSSLRPHGLTPR

SEQ ID NO: 504248 - protein, 10 aa, Mycobacterium
HRADSRARRL

SEQ ID NO: 504249 - protein, 5 aa, Mycobacterium
HRADY

SEQ ID NO: 504250 - protein, 10 aa, Mycobacterium
HRAEAERHAA

SEQ ID NO: 504251 - protein, 14 aa, Mycobacterium
HRAEPRSNPPSTDY

SEQ ID NO: 504252 - protein, 12 aa, Mycobacterium
HRAGADLPSRAA

SEQ ID NO: 504253 - protein, 7 aa, Mycobacterium
HRAGDGT

SEQ ID NO: 504254 - protein, 5 aa, Mycobacterium
HRAGE

SEQ ID NO: 504255 - protein, 6 aa, Mycobacterium
HRAGGA

SEQ ID NO: 504256 - protein, 9 aa, Mycobacterium
HRAGGQAQY

SEQ ID NO: 504257 - protein, 10 aa, Mycobacterium
HRAGGQDTPI

SEQ ID NO: 504258 - protein, 11 aa, Mycobacterium
HRAGGQQQGCE

SEQ ID NO: 504259 - protein, 11 aa, Mycobacterium
HRAGPDRERRP

SEQ ID NO: 504260 - protein, 9 aa, Mycobacterium
HRAGPTDTA

SEQ ID NO: 504261 - protein, 7 aa, Mycobacterium
HRAGQDP

SEQ ID NO: 504262 - protein, 9 aa, Mycobacterium
HRAGQDPRY

SEQ ID NO: 504263 - protein, 8 aa, Mycobacterium
HRAGQEAR

SEQ ID NO: 504264 - protein, 9 aa, Mycobacterium
HRAGSGQPL

SEQ ID NO: 504265 - protein, 9 aa, Mycobacterium
HRAHEQAGR

SEQ ID NO: 504266 - protein, 8 aa, Mycobacterium
HRAKAGAA

SEQ ID NO: 504267 - protein, 7 aa, Mycobacterium
HRAPGPA

SEQ ID NO: 504268 - protein, 5 aa, Mycobacterium
HRAPS

SEQ ID NO: 504269 - protein, 11 aa, Mycobacterium
HRAPSVGNSQP

SEQ ID NO: 504270 - protein, 21 aa, Mycobacterium
HRAPWPESPRSRRPGPHRHEI

SEQ ID NO: 504271 - protein, 17 aa, Mycobacterium
HRAQDYKNSIDRPGGLP

SEQ ID NO: 504272 - protein, 9 aa, Mycobacterium
HRARPKNLD

SEQ ID NO: 504273 - protein, 5 aa, Mycobacterium
HRARR

SEQ ID NO: 504274 - protein, 8 aa, Mycobacterium
HRARTARR

SEQ ID NO: 504275 - protein, 8 aa, Mycobacterium
HRASDTRL

SEQ ID NO: 504276 - protein, 4 aa, Mycobacterium
HRAT

SEQ ID NO: 504277 - protein, 14 aa, Mycobacterium
HRATAADTRERIDR

SEQ ID NO: 504278 - protein, 7 aa, Mycobacterium
HRATPSQ

SEQ ID NO: 504279 - protein, 5 aa, Mycobacterium
HRCDG

SEQ ID NO: 504280 - protein, 12 aa, Mycobacterium
HRDAASDAGRRE

SEQ ID NO: 504281 - protein, 14 aa, Mycobacterium
HRDAIRDSRIGPTR

SEQ ID NO: 504282 - protein, 8 aa, Mycobacterium
HRDAQTTQ

SEQ ID NO: 504283 - protein, 11 aa, Mycobacterium
HRDAVKREDEI

SEQ ID NO: 504284 - protein, 7 aa, Mycobacterium
HRDDDAV

SEQ ID NO: 504285 - protein, 16 aa, Mycobacterium
HRDEAGKVSVTVQLDA

SEQ ID NO: 504286 - protein, 10 aa, Mycobacterium
HRDEDAGRAV

SEQ ID NO: 504287 - protein, 12 aa, Mycobacterium
HRDEHAENADGR

SEQ ID NO: 504288 - protein, 16 aa, Mycobacterium
HRDEHAQEAGEADRRT

SEQ ID NO: 504289 - protein, 13 aa, Mycobacterium
HRDEIDPAGPSIE

SEQ ID NO: 504290 - protein, 13 aa, Mycobacterium
HRDEIDPATRSVE

SEQ ID NO: 504291 - protein, 15 aa, Mycobacterium
HRDEPFGDYGRRASQ

SEQ ID NO: 504292 - protein, 15 aa, Mycobacterium
HRDEPFGDYGRRASS

SEQ ID NO: 504293 - protein, 6 aa, Mycobacterium
HRDETV

SEQ ID NO: 504294 - protein, 6 aa, Mycobacterium
HRDGGE

SEQ ID NO: 504295 - protein, 8 aa, Mycobacterium
HRDGGQAQ

SEQ ID NO: 504296 - protein, 5 aa, Mycobacterium
HRDGH

SEQ ID NO: 504297 - protein, 6 aa, Mycobacterium
HRDGHG

SEQ ID NO: 504298 - protein, 8 aa, Mycobacterium
HRDGLSDR

SEQ ID NO: 504299 - protein, 15 aa, Mycobacterium
HRDGPFGDYGRKASG

SEQ ID NO: 504300 - protein, 7 aa, Mycobacterium
HRDGQQR

SEQ ID NO: 504301 - protein, 9 aa, Mycobacterium
HRDGTTDHS

SEQ ID NO: 504302 - protein, 38 aa, Mycobacterium
HRDHDTGSAAEGGAGKPKRVPEDTPDVEMPDETTQEPP

SEQ ID NO: 504303 - protein, 6 aa, Mycobacterium
HRDHRG

SEQ ID NO: 504304 - protein, 8 aa, Mycobacterium
HRDISPAD

SEQ ID NO: 504305 - protein, 8 aa, Mycobacterium
HRDKLGGT

SEQ ID NO: 504306 - protein, 4 aa, Mycobacterium
HRDM

SEQ ID NO: 504307 - protein, 7 aa, Mycobacterium
HRDMDPA

SEQ ID NO: 504308 - protein, 4 aa, Mycobacterium
HRDP

SEQ ID NO: 504309 - protein, 8 aa, Mycobacterium
HRDPAEFD

SEQ ID NO: 504310 - protein, 11 aa, Mycobacterium
HRDPAELPGEG

SEQ ID NO: 504311 - protein, 17 aa, Mycobacterium
HRDPAEYDRPDTFDPDR

SEQ ID NO: 504312 - protein, 18 aa, Mycobacterium
HRDPAEYDRPEEFDPDRG

SEQ ID NO: 504313 - protein, 7 aa, Mycobacterium
HRDPEDV

SEQ ID NO: 504314 - protein, 17 aa, Mycobacterium
HRDPGREERLSSAGTLV

SEQ ID NO: 504315 - protein, 5 aa, Mycobacterium
HRDPP

SEQ ID NO: 504316 - protein, 11 aa, Mycobacterium
HRDPRAPQNLQ

SEQ ID NO: 504317 - protein, 6 aa, Mycobacterium
HRDPTI

SEQ ID NO: 504318 - protein, 8 aa, Mycobacterium
HRDQEAKE

SEQ ID NO: 504319 - protein, 9 aa, Mycobacterium
HRDQTNDQV

SEQ ID NO: 504320 - protein, 6 aa, Mycobacterium
HRDRAD

SEQ ID NO: 504321 - protein, 11 aa, Mycobacterium
HRDRAQARGLT

SEQ ID NO: 504322 - protein, 11 aa, Mycobacterium
HRDRDRARRVT

SEQ ID NO: 504323 - protein, 11 aa, Mycobacterium
HRDREQARELT

SEQ ID NO: 504324 - protein, 7 aa, Mycobacterium
HRDRGRR

SEQ ID NO: 504325 - protein, 8 aa, Mycobacterium
HRDRRPGH

SEQ ID NO: 504326 - protein, 9 aa, Mycobacterium
HRDRTDDQV

SEQ ID NO: 504327 - protein, 9 aa, Mycobacterium
HRDRTNDQV

SEQ ID NO: 504328 - protein, 8 aa, Mycobacterium
HRDSPTVV

SEQ ID NO: 504329 - protein, 11 aa, Mycobacterium
HRDSRAGDPDL

SEQ ID NO: 504330 - protein, 14 aa, Mycobacterium
HRDSSHAHAPAEPG

SEQ ID NO: 504331 - protein, 4 aa, Mycobacterium
HRDT

SEQ ID NO: 504332 - protein, 8 aa, Mycobacterium
HRDTTRRR

SEQ ID NO: 504333 - protein, 11 aa, Mycobacterium
HREAAAEDRKL

SEQ ID NO: 504334 - protein, 8 aa, Mycobacterium
HREAAEAR

SEQ ID NO: 504335 - protein, 6 aa, Mycobacterium
HREAGE

SEQ ID NO: 504336 - protein, 5 aa, Mycobacterium
HREAP

SEQ ID NO: 504337 - protein, 10 aa, Mycobacterium
HREATSTLGD

SEQ ID NO: 504338 - protein, 11 aa, Mycobacterium
HREEERAGSGN

SEQ ID NO: 504339 - protein, 10 aa, Mycobacterium
HREETGTPGI

SEQ ID NO: 504340 - protein, 12 aa, Mycobacterium
HREGAPDLYPEP

SEQ ID NO: 504341 - protein, 10 aa, Mycobacterium
HREGAPQLYP

SEQ ID NO: 504342 - protein, 8 aa, Mycobacterium
HREGQRPI

SEQ ID NO: 504343 - protein, 7 aa, Mycobacterium
HREGSQR

SEQ ID NO: 504344 - protein, 14 aa, Mycobacterium
HREKEYSQQLQRDG

SEQ ID NO: 504345 - protein, 14 aa, Mycobacterium
HREKRPARFSAGSG

SEQ ID NO: 504346 - protein, 14 aa, Mycobacterium
HREKRPARFTGGNA

SEQ ID NO: 504347 - protein, 14 aa, Mycobacterium
HREKRPARFTGGSA

SEQ ID NO: 504348 - protein, 8 aa, Mycobacterium
HRENGSSK

SEQ ID NO: 504349 - protein, 8 aa, Mycobacterium
HRENGSSS

SEQ ID NO: 504350 - protein, 7 aa, Mycobacterium
HREPGPA

SEQ ID NO: 504351 - protein, 6 aa, Mycobacterium
HREPGQ

SEQ ID NO: 504352 - protein, 17 aa, Mycobacterium
HREPGQVEVGEKGMQAN

SEQ ID NO: 504353 - protein, 5 aa, Mycobacterium
HREPT

SEQ ID NO: 504354 - protein, 7 aa, Mycobacterium
HREQGLP

SEQ ID NO: 504355 - protein, 12 aa, Mycobacterium
HREQLTGDEAHE

SEQ ID NO: 504356 - protein, 5 aa, Mycobacterium
HREQY

SEQ ID NO: 504357 - protein, 4 aa, Mycobacterium
HRER

SEQ ID NO: 504358 - protein, 8 aa, Mycobacterium
HRERGDGR

SEQ ID NO: 504359 - protein, 8 aa, Mycobacterium
HRERRPGH

SEQ ID NO: 504360 - protein, 7 aa, Mycobacterium
HRERRRA

SEQ ID NO: 504361 - protein, 8 aa, Mycobacterium
HRERSSLP

SEQ ID NO: 504362 - protein, 17 aa, Mycobacterium
HRESHVDAADPANDSVR

SEQ ID NO: 504363 - protein, 14 aa, Mycobacterium
HRFGDRGESALKGV

SEQ ID NO: 504364 - protein, 16 aa, Mycobacterium
HRFGDRGETALKGVPG

SEQ ID NO: 504365 - protein, 5 aa, Mycobacterium
HRGAA

SEQ ID NO: 504366 - protein, 15 aa, Mycobacterium
HRGAAGAEASSGDGA

SEQ ID NO: 504367 - protein, 26 aa, Mycobacterium
HRGAKTRAKAAEQAERPGGPAPDEDA

SEQ ID NO: 504368 - protein, 36 aa, Mycobacterium
HRGAKTRAKAAQQAEAPAGPATASAAAPAEQAPTEQ

SEQ ID NO: 504369 - protein, 25 aa, Mycobacterium
HRGAKTRARARHGEGPAGGDIKPSS

SEQ ID NO: 504370 - protein, 33 aa, Mycobacterium
HRGAKTRARARHPEEVGGAAAPDSDAADAEPSS

SEQ ID NO: 504371 - protein, 17 aa, Mycobacterium
HRGANGGDLESWQPQQM

SEQ ID NO: 504372 - protein, 8 aa, Mycobacterium
HRGAPGHR

SEQ ID NO: 504373 - protein, 9 aa, Mycobacterium
HRGAPTRQQ

SEQ ID NO: 504374 - protein, 7 aa, Mycobacterium
HRGARGL

SEQ ID NO: 504375 - protein, 12 aa, Mycobacterium
HRGDAAARRLSQ

SEQ ID NO: 504376 - protein, 8 aa, Mycobacterium
HRGDAHQD

SEQ ID NO: 504377 - protein, 10 aa, Mycobacterium
HRGDDAQERI

SEQ ID NO: 504378 - protein, 10 aa, Mycobacterium
HRGDDTQERI

SEQ ID NO: 504379 - protein, 5 aa, Mycobacterium
HRGDI

SEQ ID NO: 504380 - protein, 5 aa, Mycobacterium
HRGDS

SEQ ID NO: 504381 - protein, 4 aa, Mycobacterium
HRGE

SEQ ID NO: 504382 - protein, 13 aa, Mycobacterium
HRGEASEDGAEAQ

SEQ ID NO: 504383 - protein, 5 aa, Mycobacterium
HRGEP

SEQ ID NO: 504384 - protein, 10 aa, Mycobacterium
HRGESAYDRY

SEQ ID NO: 504385 - protein, 24 aa, Mycobacterium
HRGESAYDRYYGDPTNKPNPNLGE

SEQ ID NO: 504386 - protein, 189 aa, Mycobacterium
HRGESNGRTAEASSPATADAQTGEQAAEAPAPRRRERRASTRQAGAPVAEKGEAGEKAGEKTEAQPEAKTEAQPEAKAEAPAEAKTERAEKADKPAKEAQTKAAEAPEAGESQESQPRQRRERSGRQDRADRGEKDGQDGKQDQGKQDRSERDQDQQGGGQQNRGGGSGNNADSDDDGEGRQGRRGRRF

SEQ ID NO: 504387 - protein, 8 aa, Mycobacterium
HRGETGSV

SEQ ID NO: 504388 - protein, 5 aa, Mycobacterium
HRGFR

SEQ ID NO: 504389 - protein, 4 aa, Mycobacterium
HRGG

SEQ ID NO: 504390 - protein, 5 aa, Mycobacterium
HRGGD

SEQ ID NO: 504391 - protein, 5 aa, Mycobacterium
HRGGG

SEQ ID NO: 504392 - protein, 9 aa, Mycobacterium
HRGGGSTDE

SEQ ID NO: 504393 - protein, 33 aa, Mycobacterium
HRGGHHEGGQPFAQRGAQLGGVGAAGDVADEPL

SEQ ID NO: 504394 - protein, 32 aa, Mycobacterium
HRGGLEPADQHLGTADPHRTQRADHAGGGVKH

SEQ ID NO: 504395 - protein, 9 aa, Mycobacterium
HRGGPLADG

SEQ ID NO: 504396 - protein, 12 aa, Mycobacterium
HRGGPSFDSAGP

SEQ ID NO: 504397 - protein, 6 aa, Mycobacterium
HRGGQK

SEQ ID NO: 504398 - protein, 15 aa, Mycobacterium
HRGGQPVALPPGGTS

SEQ ID NO: 504399 - protein, 5 aa, Mycobacterium
HRGGR

SEQ ID NO: 504400 - protein, 12 aa, Mycobacterium
HRGGRGEATEQS

SEQ ID NO: 504401 - protein, 7 aa, Mycobacterium
HRGGRRS

SEQ ID NO: 504402 - protein, 17 aa, Mycobacterium
HRGHASELARRAADEGA

SEQ ID NO: 504403 - protein, 16 aa, Mycobacterium
HRGHGADAERVPRPAH

SEQ ID NO: 504404 - protein, 8 aa, Mycobacterium
HRGKTDWS

SEQ ID NO: 504405 - protein, 11 aa, Mycobacterium
HRGLSDSNHYR

SEQ ID NO: 504406 - protein, 4 aa, Mycobacterium
HRGN

SEQ ID NO: 504407 - protein, 11 aa, Mycobacterium
HRGPANPRKQF

SEQ ID NO: 504408 - protein, 15 aa, Mycobacterium
HRGPASNVGLCACSR

SEQ ID NO: 504409 - protein, 10 aa, Mycobacterium
HRGPGEAELA

SEQ ID NO: 504410 - protein, 5 aa, Mycobacterium
HRGPI

SEQ ID NO: 504411 - protein, 8 aa, Mycobacterium
HRGPQPGS

SEQ ID NO: 504412 - protein, 6 aa, Mycobacterium
HRGPVD

SEQ ID NO: 504413 - protein, 6 aa, Mycobacterium
HRGPVE

SEQ ID NO: 504414 - protein, 6 aa, Mycobacterium
HRGPYA

SEQ ID NO: 504415 - protein, 12 aa, Mycobacterium
HRGQPPAPGHTR

SEQ ID NO: 504416 - protein, 8 aa, Mycobacterium
HRGRDGGY

SEQ ID NO: 504417 - protein, 9 aa, Mycobacterium
HRGRDGGYA

SEQ ID NO: 504418 - protein, 9 aa, Mycobacterium
HRGRDGGYE

SEQ ID NO: 504419 - protein, 18 aa, Mycobacterium
HRGREGGYELARSGSDIS

SEQ ID NO: 504420 - protein, 8 aa, Mycobacterium
HRGRPGTV

SEQ ID NO: 504421 - protein, 6 aa, Mycobacterium
HRGRRP

SEQ ID NO: 504422 - protein, 7 aa, Mycobacterium
HRGRRTD

SEQ ID NO: 504423 - protein, 5 aa, Mycobacterium
HRGRS

SEQ ID NO: 504424 - protein, 14 aa, Mycobacterium
HRGRYVESSAPGEL

SEQ ID NO: 504425 - protein, 12 aa, Mycobacterium
HRGSDGAPSTRI

SEQ ID NO: 504426 - protein, 8 aa, Mycobacterium
HRGSGADR

SEQ ID NO: 504427 - protein, 9 aa, Mycobacterium
HRGSGAPDD

SEQ ID NO: 504428 - protein, 9 aa, Mycobacterium
HRGSGAPDG

SEQ ID NO: 504429 - protein, 10 aa, Mycobacterium
HRGSGAPEGL

SEQ ID NO: 504430 - protein, 6 aa, Mycobacterium
HRGSGV

SEQ ID NO: 504431 - protein, 10 aa, Mycobacterium
HRGSTSQDIL

SEQ ID NO: 504432 - protein, 4 aa, Mycobacterium
HRGT

SEQ ID NO: 504433 - protein, 5 aa, Mycobacterium
HRGTV

SEQ ID NO: 504434 - protein, 8 aa, Mycobacterium
HRGTVQPA

SEQ ID NO: 504435 - protein, 10 aa, Mycobacterium
HRHDRDEQWP

SEQ ID NO: 504436 - protein, 9 aa, Mycobacterium
HRHGPPGTV

SEQ ID NO: 504437 - protein, 7 aa, Mycobacterium
HRHPESE

SEQ ID NO: 504438 - protein, 5 aa, Mycobacterium
HRHRP

SEQ ID NO: 504439 - protein, 5 aa, Mycobacterium
HRHTG

SEQ ID NO: 504440 - protein, 7 aa, Mycobacterium
HRHTPEI

SEQ ID NO: 504441 - protein, 6 aa, Mycobacterium
HRHTSS

SEQ ID NO: 504442 - protein, 9 aa, Mycobacterium
HRIDGPRGG

SEQ ID NO: 504443 - protein, 5 aa, Mycobacterium
HRIGQ

SEQ ID NO: 504444 - protein, 16 aa, Mycobacterium
HRKAVEDADGAEAQPA

SEQ ID NO: 504445 - protein, 16 aa, Mycobacterium
HRKAVEDADGAEGEPA

SEQ ID NO: 504446 - protein, 5 aa, Mycobacterium
HRKGD

SEQ ID NO: 504447 - protein, 9 aa, Mycobacterium
HRKGQRPVL

SEQ ID NO: 504448 - protein, 19 aa, Mycobacterium
HRKGRNNSVTAAPGDVGSP

SEQ ID NO: 504449 - protein, 5 aa, Mycobacterium
HRKPY

SEQ ID NO: 504450 - protein, 6 aa, Mycobacterium
HRKRGE

SEQ ID NO: 504451 - protein, 11 aa, Mycobacterium
HRKRTGAAARE

SEQ ID NO: 504452 - protein, 14 aa, Mycobacterium
HRKRVRPDKAAKQT

SEQ ID NO: 504453 - protein, 9 aa, Mycobacterium
HRKSPMTAR

SEQ ID NO: 504454 - protein, 14 aa, Mycobacterium
HRLGPETDRDRQAE

SEQ ID NO: 504455 - protein, 24 aa, Mycobacterium
HRLGRSGQAVGRVRNGRREAQLQP

SEQ ID NO: 504456 - protein, 12 aa, Mycobacterium
HRLGTNPEKDVG

SEQ ID NO: 504457 - protein, 13 aa, Mycobacterium
HRLGTSPEKDVGF

SEQ ID NO: 504458 - protein, 9 aa, Mycobacterium
HRLSGPKGE

SEQ ID NO: 504459 - protein, 7 aa, Mycobacterium
HRMGEGE

SEQ ID NO: 504460 - protein, 7 aa, Mycobacterium
HRMGSGA

SEQ ID NO: 504461 - protein, 5 aa, Mycobacterium
HRNAR

SEQ ID NO: 504462 - protein, 5 aa, Mycobacterium
HRNEK

SEQ ID NO: 504463 - protein, 9 aa, Mycobacterium
HRNGGEKEF

SEQ ID NO: 504464 - protein, 17 aa, Mycobacterium
HRNGHRPKTVSTTSGDI

SEQ ID NO: 504465 - protein, 8 aa, Mycobacterium
HRNGPTAN

SEQ ID NO: 504466 - protein, 8 aa, Mycobacterium
HRNGPTAT

SEQ ID NO: 504467 - protein, 11 aa, Mycobacterium
HRNKGKQVTAG

SEQ ID NO: 504468 - protein, 8 aa, Mycobacterium
HRNPGEAE

SEQ ID NO: 504469 - protein, 9 aa, Mycobacterium
HRNPRARRD

SEQ ID NO: 504470 - protein, 4 aa, Mycobacterium
HRNR

SEQ ID NO: 504471 - protein, 22 aa, Mycobacterium
HRNRAAAHNQSDTTVFLSPAAE

SEQ ID NO: 504472 - protein, 7 aa, Mycobacterium
HRNTGAR

SEQ ID NO: 504473 - protein, 7 aa, Mycobacterium
HRNTSAR

SEQ ID NO: 504474 - protein, 5 aa, Mycobacterium
HRNTT

SEQ ID NO: 504475 - protein, 6 aa, Mycobacterium
HRNTTA

SEQ ID NO: 504476 - protein, 11 aa, Mycobacterium
HRPADKDRATK

SEQ ID NO: 504477 - protein, 6 aa, Mycobacterium
HRPAEG

SEQ ID NO: 504478 - protein, 31 aa, Mycobacterium
HRPAPSGGKARGARAHGAAVRRGRQLGGREH

SEQ ID NO: 504479 - protein, 21 aa, Mycobacterium
HRPAPVEDRRPLPARDGQQTE

SEQ ID NO: 504480 - protein, 14 aa, Mycobacterium
HRPATDQGLQQGAT

SEQ ID NO: 504481 - protein, 9 aa, Mycobacterium
HRPATTPRS

SEQ ID NO: 504482 - protein, 7 aa, Mycobacterium
HRPDPAN

SEQ ID NO: 504483 - protein, 14 aa, Mycobacterium
HRPDPERPSESTRF

SEQ ID NO: 504484 - protein, 9 aa, Mycobacterium
HRPDSDGRF

SEQ ID NO: 504485 - protein, 8 aa, Mycobacterium
HRPDSGPV

SEQ ID NO: 504486 - protein, 5 aa, Mycobacterium
HRPDY

SEQ ID NO: 504487 - protein, 5 aa, Mycobacterium
HRPEL

SEQ ID NO: 504488 - protein, 7 aa, Mycobacterium
HRPENAG

SEQ ID NO: 504489 - protein, 5 aa, Mycobacterium
HRPER

SEQ ID NO: 504490 - protein, 10 aa, Mycobacterium
HRPESAADLD

SEQ ID NO: 504491 - protein, 8 aa, Mycobacterium
HRPETTAD

SEQ ID NO: 504492 - protein, 32 aa, Mycobacterium
HRPGAPDHPGDPRLPGQPPRVGRRRRRAGRPT

SEQ ID NO: 504493 - protein, 10 aa, Mycobacterium
HRPGDSGVAR

SEQ ID NO: 504494 - protein, 6 aa, Mycobacterium
HRPGFG

SEQ ID NO: 504495 - protein, 6 aa, Mycobacterium
HRPGGE

SEQ ID NO: 504496 - protein, 6 aa, Mycobacterium
HRPGGG

SEQ ID NO: 504497 - protein, 6 aa, Mycobacterium
HRPGKQ

SEQ ID NO: 504498 - protein, 5 aa, Mycobacterium
HRPGR

SEQ ID NO: 504499 - protein, 10 aa, Mycobacterium
HRPGRTITDT

SEQ ID NO: 504500 - protein, 6 aa, Mycobacterium
HRPGTD

SEQ ID NO: 504501 - protein, 13 aa, Mycobacterium
HRPHSRVGARAEA

SEQ ID NO: 504502 - protein, 10 aa, Mycobacterium
HRPHTTAGTM

SEQ ID NO: 504503 - protein, 5 aa, Mycobacterium
HRPKQ

SEQ ID NO: 504504 - protein, 6 aa, Mycobacterium
HRPKQL

SEQ ID NO: 504505 - protein, 4 aa, Mycobacterium
HRPL

SEQ ID NO: 504506 - protein, 7 aa, Mycobacterium
HRPLPGR

SEQ ID NO: 504507 - protein, 15 aa, Mycobacterium
HRPLPPSGTARSEGK

SEQ ID NO: 504508 - protein, 11 aa, Mycobacterium
HRPLSASGEHA

SEQ ID NO: 504509 - protein, 8 aa, Mycobacterium
HRPNGPLP

SEQ ID NO: 504510 - protein, 9 aa, Mycobacterium
HRPPDSEPG

SEQ ID NO: 504511 - protein, 6 aa, Mycobacterium
HRPPLS

SEQ ID NO: 504512 - protein, 8 aa, Mycobacterium
HRPPPVTA

SEQ ID NO: 504513 - protein, 9 aa, Mycobacterium
HRPPQQPQP

SEQ ID NO: 504514 - protein, 11 aa, Mycobacterium
HRPPRSPADRH

SEQ ID NO: 504515 - protein, 11 aa, Mycobacterium
HRPPRTPADRH

SEQ ID NO: 504516 - protein, 12 aa, Mycobacterium
HRPPRTPADRRP

SEQ ID NO: 504517 - protein, 5 aa, Mycobacterium
HRPQV

SEQ ID NO: 504518 - protein, 22 aa, Mycobacterium
HRPRPGGDAARRHHHRSDRRVP

SEQ ID NO: 504519 - protein, 15 aa, Mycobacterium
HRPRQVSGGMAQRAG

SEQ ID NO: 504520 - protein, 16 aa, Mycobacterium
HRPRRARGVHRGQLRP

SEQ ID NO: 504521 - protein, 12 aa, Mycobacterium
HRPRRVRQPGEP

SEQ ID NO: 504522 - protein, 17 aa, Mycobacterium
HRPSAQHGESRRRGVVP

SEQ ID NO: 504523 - protein, 12 aa, Mycobacterium
HRPSRAEPYATR

SEQ ID NO: 504524 - protein, 8 aa, Mycobacterium
HRPSRQPA

SEQ ID NO: 504525 - protein, 14 aa, Mycobacterium
HRPSRSADYTTRTV

SEQ ID NO: 504526 - protein, 6 aa, Mycobacterium
HRPSVY

SEQ ID NO: 504527 - protein, 6 aa, Mycobacterium
HRPTAT

SEQ ID NO: 504528 - protein, 14 aa, Mycobacterium
HRPTDLDRNGGHPT

SEQ ID NO: 504529 - protein, 15 aa, Mycobacterium
HRPTPRAAPALPDAA

SEQ ID NO: 504530 - protein, 4 aa, Mycobacterium
HRPV

SEQ ID NO: 504531 - protein, 9 aa, Mycobacterium
HRPYPGGLT

SEQ ID NO: 504532 - protein, 5 aa, Mycobacterium
HRQAN

SEQ ID NO: 504533 - protein, 5 aa, Mycobacterium
HRQAP

SEQ ID NO: 504534 - protein, 6 aa, Mycobacterium
HRQARA

SEQ ID NO: 504535 - protein, 30 aa, Mycobacterium
HRQDRHDRLGRPRHRDRDPLARARAPLNEQ

SEQ ID NO: 504536 - protein, 6 aa, Mycobacterium
HRQEYR

SEQ ID NO: 504537 - protein, 4 aa, Mycobacterium
HRQF

SEQ ID NO: 504538 - protein, 9 aa, Mycobacterium
HRQGPGPTL

SEQ ID NO: 504539 - protein, 9 aa, Mycobacterium
HRQGQDPRY

SEQ ID NO: 504540 - protein, 15 aa, Mycobacterium
HRQKRPARFTDRTEG

SEQ ID NO: 504541 - protein, 17 aa, Mycobacterium
HRQLPGQPRIRRRSERR

SEQ ID NO: 504542 - protein, 5 aa, Mycobacterium
HRQPR

SEQ ID NO: 504543 - protein, 6 aa, Mycobacterium
HRQPRA

SEQ ID NO: 504544 - protein, 6 aa, Mycobacterium
HRQPRT

SEQ ID NO: 504545 - protein, 10 aa, Mycobacterium
HRQPSANADY

SEQ ID NO: 504546 - protein, 18 aa, Mycobacterium
HRQQGGAVPTATQSPARR

SEQ ID NO: 504547 - protein, 9 aa, Mycobacterium
HRQRPATAA

SEQ ID NO: 504548 - protein, 10 aa, Mycobacterium
HRQRPATAQG

SEQ ID NO: 504549 - protein, 5 aa, Mycobacterium
HRQRR

SEQ ID NO: 504550 - protein, 10 aa, Mycobacterium
HRQSQGDDID

SEQ ID NO: 504551 - protein, 6 aa, Mycobacterium
HRQSRR

SEQ ID NO: 504552 - protein, 7 aa, Mycobacterium
HRQTDEV

SEQ ID NO: 504553 - protein, 5 aa, Mycobacterium
HRQTE

SEQ ID NO: 504554 - protein, 7 aa, Mycobacterium
HRQTGVP

SEQ ID NO: 504555 - protein, 4 aa, Mycobacterium
HRQY

SEQ ID NO: 504556 - protein, 5 aa, Mycobacterium
HRQYG

SEQ ID NO: 504557 - protein, 4 aa, Mycobacterium
HRRA

SEQ ID NO: 504558 - protein, 15 aa, Mycobacterium
HRRAAAAGSAEAPLN

SEQ ID NO: 504559 - protein, 20 aa, Mycobacterium
HRRAAGATGVPGSGEAPLSD

SEQ ID NO: 504560 - protein, 6 aa, Mycobacterium
HRRAGV

SEQ ID NO: 504561 - protein, 10 aa, Mycobacterium
HRRASDAGMA

SEQ ID NO: 504562 - protein, 8 aa, Mycobacterium
HRRATARD

SEQ ID NO: 504563 - protein, 29 aa, Mycobacterium
HRRDHRSQGQAGDGQDQTLMPGPANQRGL

SEQ ID NO: 504564 - protein, 9 aa, Mycobacterium
HRRDSRHRR

SEQ ID NO: 504565 - protein, 6 aa, Mycobacterium
HRREQR

SEQ ID NO: 504566 - protein, 18 aa, Mycobacterium
HRRGHAAAASTGLPPGTE

SEQ ID NO: 504567 - protein, 27 aa, Mycobacterium
HRRGPGTGGRADERPRRPGTSVPIVGR

SEQ ID NO: 504568 - protein, 6 aa, Mycobacterium
HRRGRH

SEQ ID NO: 504569 - protein, 18 aa, Mycobacterium
HRRHSAPEAEPAAAPAAA

SEQ ID NO: 504570 - protein, 4 aa, Mycobacterium
HRRP

SEQ ID NO: 504571 - protein, 7 aa, Mycobacterium
HRRPDGR

SEQ ID NO: 504572 - protein, 11 aa, Mycobacterium
HRRPGSIGGCA

SEQ ID NO: 504573 - protein, 5 aa, Mycobacterium
HRRPY

SEQ ID NO: 504574 - protein, 13 aa, Mycobacterium
HRRRADAVSRRHT

SEQ ID NO: 504575 - protein, 6 aa, Mycobacterium
HRRRGY

SEQ ID NO: 504576 - protein, 15 aa, Mycobacterium
HRRRLDDGGHEPPSL

SEQ ID NO: 504577 - protein, 8 aa, Mycobacterium
HRRRPGHR

SEQ ID NO: 504578 - protein, 13 aa, Mycobacterium
HRRSQLSGSSGLR

SEQ ID NO: 504579 - protein, 10 aa, Mycobacterium
HRRSTGEGQL

SEQ ID NO: 504580 - protein, 13 aa, Mycobacterium
HRRTARRSYGPRH

SEQ ID NO: 504581 - protein, 9 aa, Mycobacterium
HRRTDGSGI

SEQ ID NO: 504582 - protein, 11 aa, Mycobacterium
HRRTDSRARRL

SEQ ID NO: 504583 - protein, 9 aa, Mycobacterium
HRRTEDTIT

SEQ ID NO: 504584 - protein, 5 aa, Mycobacterium
HRRTP

SEQ ID NO: 504585 - protein, 5 aa, Mycobacterium
HRSAE

SEQ ID NO: 504586 - protein, 8 aa, Mycobacterium
HRSAEFGR

SEQ ID NO: 504587 - protein, 13 aa, Mycobacterium
HRSAEGGGWEQVQ

SEQ ID NO: 504588 - protein, 6 aa, Mycobacterium
HRSAGA

SEQ ID NO: 504589 - protein, 8 aa, Mycobacterium
HRSATTVR

SEQ ID NO: 504590 - protein, 6 aa, Mycobacterium
HRSAVR

SEQ ID NO: 504591 - protein, 9 aa, Mycobacterium
HRSDDLGGL

SEQ ID NO: 504592 - protein, 5 aa, Mycobacterium
HRSDQ

SEQ ID NO: 504593 - protein, 14 aa, Mycobacterium
HRSESFRDLVDPRD

SEQ ID NO: 504594 - protein, 4 aa, Mycobacterium
HRSG

SEQ ID NO: 504595 - protein, 10 aa, Mycobacterium
HRSGAGDHSR

SEQ ID NO: 504596 - protein, 5 aa, Mycobacterium
HRSGG

SEQ ID NO: 504597 - protein, 10 aa, Mycobacterium
HRSGPGPMGP

SEQ ID NO: 504598 - protein, 6 aa, Mycobacterium
HRSGPR

SEQ ID NO: 504599 - protein, 10 aa, Mycobacterium
HRSGTGRMPP

SEQ ID NO: 504600 - protein, 18 aa, Mycobacterium
HRSGTPAAPVREAAAAGR

SEQ ID NO: 504601 - protein, 18 aa, Mycobacterium
HRSGTPAAPVREATRAGR

SEQ ID NO: 504602 - protein, 14 aa, Mycobacterium
HRSGTTPAECDTAG

SEQ ID NO: 504603 - protein, 20 aa, Mycobacterium
HRSKGAARFPRSPPPAEGAA

SEQ ID NO: 504604 - protein, 16 aa, Mycobacterium
HRSPITADVSESDART

SEQ ID NO: 504605 - protein, 5 aa, Mycobacterium
HRSRG

SEQ ID NO: 504606 - protein, 15 aa, Mycobacterium
HRSRGRGQSRDYGLE

SEQ ID NO: 504607 - protein, 8 aa, Mycobacterium
HRSRLGNA

SEQ ID NO: 504608 - protein, 9 aa, Mycobacterium
HRSRLGNNE

SEQ ID NO: 504609 - protein, 7 aa, Mycobacterium
HRSRPGA

SEQ ID NO: 504610 - protein, 6 aa, Mycobacterium
HRSRQG

SEQ ID NO: 504611 - protein, 18 aa, Mycobacterium
HRSRRPSQWTTAETTDIA

SEQ ID NO: 504612 - protein, 34 aa, Mycobacterium
HRSRRTAAGHRHGSGDHPVRETVTGDHRRTRRGR

SEQ ID NO: 504613 - protein, 10 aa, Mycobacterium
HRSRTRPEAL

SEQ ID NO: 504614 - protein, 12 aa, Mycobacterium
HRSRVQQFLAAR

SEQ ID NO: 504615 - protein, 9 aa, Mycobacterium
HRSSAKTQA

SEQ ID NO: 504616 - protein, 15 aa, Mycobacterium
HRSSAPAKVCHLDTH

SEQ ID NO: 504617 - protein, 13 aa, Mycobacterium
HRSSDFAAAPARG

SEQ ID NO: 504618 - protein, 11 aa, Mycobacterium
HRSSSAPVGHR

SEQ ID NO: 504619 - protein, 5 aa, Mycobacterium
HRSSV

SEQ ID NO: 504620 - protein, 19 aa, Mycobacterium
HRSTGGRVNPGDSRKDRER

SEQ ID NO: 504621 - protein, 5 aa, Mycobacterium
HRSTN

SEQ ID NO: 504622 - protein, 13 aa, Mycobacterium
HRSVEADPATVAG

SEQ ID NO: 504623 - protein, 7 aa, Mycobacterium
HRSVGEV

SEQ ID NO: 504624 - protein, 8 aa, Mycobacterium
HRSYAGTV

SEQ ID NO: 504625 - protein, 6 aa, Mycobacterium
HRTAEQ

SEQ ID NO: 504626 - protein, 11 aa, Mycobacterium
HRTAGSAVSAR

SEQ ID NO: 504627 - protein, 12 aa, Mycobacterium
HRTDPGLSGRAD

SEQ ID NO: 504628 - protein, 9 aa, Mycobacterium
HRTDQPPKA

SEQ ID NO: 504629 - protein, 5 aa, Mycobacterium
HRTEE

SEQ ID NO: 504630 - protein, 4 aa, Mycobacterium
HRTG

SEQ ID NO: 504631 - protein, 10 aa, Mycobacterium
HRTGAAGDVT

SEQ ID NO: 504632 - protein, 10 aa, Mycobacterium
HRTGASDHSR

SEQ ID NO: 504633 - protein, 13 aa, Mycobacterium
HRTGTKTVSPSAL

SEQ ID NO: 504634 - protein, 19 aa, Mycobacterium
HRTIPRATTTAERDAAAQR

SEQ ID NO: 504635 - protein, 16 aa, Mycobacterium
HRTNSGSFVGTDEAKT

SEQ ID NO: 504636 - protein, 7 aa, Mycobacterium
HRTPADT

SEQ ID NO: 504637 - protein, 27 aa, Mycobacterium
HRTPEVTPDVSEQAKFADDPTRGRRKR

SEQ ID NO: 504638 - protein, 5 aa, Mycobacterium
HRTPG

SEQ ID NO: 504639 - protein, 6 aa, Mycobacterium
HRTPGR

SEQ ID NO: 504640 - protein, 9 aa, Mycobacterium
HRTPPPEGL

SEQ ID NO: 504641 - protein, 5 aa, Mycobacterium
HRTPR

SEQ ID NO: 504642 - protein, 14 aa, Mycobacterium
HRTPWKADAPPPFD

SEQ ID NO: 504643 - protein, 5 aa, Mycobacterium
HRTRE

SEQ ID NO: 504644 - protein, 11 aa, Mycobacterium
HRTRGSVPSPE

SEQ ID NO: 504645 - protein, 11 aa, Mycobacterium
HRTRNPYRSTA

SEQ ID NO: 504646 - protein, 11 aa, Mycobacterium
HRTRPKNPDGL

SEQ ID NO: 504647 - protein, 11 aa, Mycobacterium
HRTRQTDARTL

SEQ ID NO: 504648 - protein, 6 aa, Mycobacterium
HRTTDV

SEQ ID NO: 504649 - protein, 9 aa, Mycobacterium
HRTTPSGAV

SEQ ID NO: 504650 - protein, 9 aa, Mycobacterium
HRVAEGDRL

SEQ ID NO: 504651 - protein, 13 aa, Mycobacterium
HRVDKDAAWKDLP

SEQ ID NO: 504652 - protein, 6 aa, Mycobacterium
HRVDTD

SEQ ID NO: 504653 - protein, 8 aa, Mycobacterium
HRVGQGDW

SEQ ID NO: 504654 - protein, 12 aa, Mycobacterium
HRVGSPRSRCQA

SEQ ID NO: 504655 - protein, 7 aa, Mycobacterium
HRVGTDA

SEQ ID NO: 504656 - protein, 5 aa, Mycobacterium
HRVPG

SEQ ID NO: 504657 - protein, 6 aa, Mycobacterium
HRVPGD

SEQ ID NO: 504658 - protein, 9 aa, Mycobacterium
HRVPGPRTI

SEQ ID NO: 504659 - protein, 8 aa, Mycobacterium
HRVPPDAQ

SEQ ID NO: 504660 - protein, 16 aa, Mycobacterium
HRVRGAGAASNGYAGP

SEQ ID NO: 504661 - protein, 5 aa, Mycobacterium
HRWPT

SEQ ID NO: 504662 - protein, 13 aa, Mycobacterium
HRYGPPDGAPRAY

SEQ ID NO: 504663 - protein, 9 aa, Mycobacterium
HRYGQPGKT

SEQ ID NO: 504664 - protein, 4 aa, Mycobacterium
HRYP

SEQ ID NO: 504665 - protein, 5 aa, Mycobacterium
HSAAD

SEQ ID NO: 504666 - protein, 8 aa, Mycobacterium
HSAADRAE

SEQ ID NO: 504667 - protein, 11 aa, Mycobacterium
HSAAPNSDGSV

SEQ ID NO: 504668 - protein, 8 aa, Mycobacterium
HSAARTDG

SEQ ID NO: 504669 - protein, 8 aa, Mycobacterium
HSADDESL

SEQ ID NO: 504670 - protein, 8 aa, Mycobacterium
HSADGHHP

SEQ ID NO: 504671 - protein, 8 aa, Mycobacterium
HSADRPPA

SEQ ID NO: 504672 - protein, 17 aa, Mycobacterium
HSADTGAGNLAEQAIWF

SEQ ID NO: 504673 - protein, 14 aa, Mycobacterium
HSADTREPVPSRLQ

SEQ ID NO: 504674 - protein, 11 aa, Mycobacterium
HSADYAPDETL

SEQ ID NO: 504675 - protein, 11 aa, Mycobacterium
HSAESHSAEGT

SEQ ID NO: 504676 - protein, 12 aa, Mycobacterium
HSAGTAPGSAVN

SEQ ID NO: 504677 - protein, 9 aa, Mycobacterium
HSALSNTQC

SEQ ID NO: 504678 - protein, 8 aa, Mycobacterium
HSAPDGDD

SEQ ID NO: 504679 - protein, 6 aa, Mycobacterium
HSAPGS

SEQ ID NO: 504680 - protein, 6 aa, Mycobacterium
HSARDT

SEQ ID NO: 504681 - protein, 5 aa, Mycobacterium
HSARS

SEQ ID NO: 504682 - protein, 6 aa, Mycobacterium
HSARSP

SEQ ID NO: 504683 - protein, 13 aa, Mycobacterium
HSASGNGVQGAPH

SEQ ID NO: 504684 - protein, 9 aa, Mycobacterium
HSASTDPLT

SEQ ID NO: 504685 - protein, 7 aa, Mycobacterium
HSATAAT

SEQ ID NO: 504686 - protein, 5 aa, Mycobacterium
HSATD

SEQ ID NO: 504687 - protein, 6 aa, Mycobacterium
HSATPY

SEQ ID NO: 504688 - protein, 6 aa, Mycobacterium
HSATSN

SEQ ID NO: 504689 - protein, 7 aa, Mycobacterium
HSATSNL

SEQ ID NO: 504690 - protein, 7 aa, Mycobacterium
HSATSSA

SEQ ID NO: 504691 - protein, 13 aa, Mycobacterium
HSCPEQAIVITDE

SEQ ID NO: 504692 - protein, 7 aa, Mycobacterium
HSCPGAS

SEQ ID NO: 504693 - protein, 5 aa, Mycobacterium
HSDAA

SEQ ID NO: 504694 - protein, 5 aa, Mycobacterium
HSDAD

SEQ ID NO: 504695 - protein, 8 aa, Mycobacterium
HSDAERAA

SEQ ID NO: 504696 - protein, 4 aa, Mycobacterium
HSDD

SEQ ID NO: 504697 - protein, 9 aa, Mycobacterium
HSDDDPRFN

SEQ ID NO: 504698 - protein, 6 aa, Mycobacterium
HSDDLR

SEQ ID NO: 504699 - protein, 9 aa, Mycobacterium
HSDDPAGEA

SEQ ID NO: 504700 - protein, 7 aa, Mycobacterium
HSDDPAY

SEQ ID NO: 504701 - protein, 11 aa, Mycobacterium
HSDDPDKARRL

SEQ ID NO: 504702 - protein, 6 aa, Mycobacterium
HSDDQH

SEQ ID NO: 504703 - protein, 6 aa, Mycobacterium
HSDDQQ

SEQ ID NO: 504704 - protein, 6 aa, Mycobacterium
HSDDRG

SEQ ID NO: 504705 - protein, 8 aa, Mycobacterium
HSDDTPRR

SEQ ID NO: 504706 - protein, 4 aa, Mycobacterium
HSDE

SEQ ID NO: 504707 - protein, 7 aa, Mycobacterium
HSDEASV

SEQ ID NO: 504708 - protein, 7 aa, Mycobacterium
HSDEQHE

SEQ ID NO: 504709 - protein, 6 aa, Mycobacterium
HSDERA

SEQ ID NO: 504710 - protein, 9 aa, Mycobacterium
HSDGSGVTR

SEQ ID NO: 504711 - protein, 7 aa, Mycobacterium
HSDGVPA

SEQ ID NO: 504712 - protein, 6 aa, Mycobacterium
HSDGVS

SEQ ID NO: 504713 - protein, 12 aa, Mycobacterium
HSDKESATPTYK

SEQ ID NO: 504714 - protein, 11 aa, Mycobacterium
HSDKQGAEATH

SEQ ID NO: 504715 - protein, 10 aa, Mycobacterium
HSDLTDRADH

SEQ ID NO: 504716 - protein, 7 aa, Mycobacterium
HSDNDIS

SEQ ID NO: 504717 - protein, 9 aa, Mycobacterium
HSDNPAAIT

SEQ ID NO: 504718 - protein, 6 aa, Mycobacterium
HSDNSA

SEQ ID NO: 504719 - protein, 4 aa, Mycobacterium
HSDP

SEQ ID NO: 504720 - protein, 8 aa, Mycobacterium
HSDPKGDR

SEQ ID NO: 504721 - protein, 10 aa, Mycobacterium
HSDPQRGEQL

SEQ ID NO: 504722 - protein, 9 aa, Mycobacterium
HSDPRRGEQ

SEQ ID NO: 504723 - protein, 10 aa, Mycobacterium
HSDPTSDTMT

SEQ ID NO: 504724 - protein, 9 aa, Mycobacterium
HSDQEDFTD

SEQ ID NO: 504725 - protein, 9 aa, Mycobacterium
HSDRPGFRR

SEQ ID NO: 504726 - protein, 11 aa, Mycobacterium
HSDRSGEPIEP

SEQ ID NO: 504727 - protein, 6 aa, Mycobacterium
HSDRVG

SEQ ID NO: 504728 - protein, 7 aa, Mycobacterium
HSDSPNL

SEQ ID NO: 504729 - protein, 4 aa, Mycobacterium
HSDT

SEQ ID NO: 504730 - protein, 5 aa, Mycobacterium
HSDVE

SEQ ID NO: 504731 - protein, 6 aa, Mycobacterium
HSDVEQ

SEQ ID NO: 504732 - protein, 6 aa, Mycobacterium
HSDVSY

SEQ ID NO: 504733 - protein, 13 aa, Mycobacterium
HSEAGGSEGGPPF

SEQ ID NO: 504734 - protein, 14 aa, Mycobacterium
HSEATAEYRNPQNA

SEQ ID NO: 504735 - protein, 11 aa, Mycobacterium
HSEAVAASRDA

SEQ ID NO: 504736 - protein, 6 aa, Mycobacterium
HSEDAT

SEQ ID NO: 504737 - protein, 6 aa, Mycobacterium
HSEDHR

SEQ ID NO: 504738 - protein, 18 aa, Mycobacterium
HSEEPIGRAPAAGPDEVE

SEQ ID NO: 504739 - protein, 14 aa, Mycobacterium
HSEEQGEGEAPLPQ

SEQ ID NO: 504740 - protein, 7 aa, Mycobacterium
HSEEYDR

SEQ ID NO: 504741 - protein, 9 aa, Mycobacterium
HSEGGITDK

SEQ ID NO: 504742 - protein, 9 aa, Mycobacterium
HSEGLPADD

SEQ ID NO: 504743 - protein, 9 aa, Mycobacterium
HSEGRSYNT

SEQ ID NO: 504744 - protein, 9 aa, Mycobacterium
HSEHRLGEA

SEQ ID NO: 504745 - protein, 4 aa, Mycobacterium
HSEI

SEQ ID NO: 504746 - protein, 4 aa, Mycobacterium
HSEL

SEQ ID NO: 504747 - protein, 4 aa, Mycobacterium
HSEN

SEQ ID NO: 504748 - protein, 7 aa, Mycobacterium
HSENAQA

SEQ ID NO: 504749 - protein, 7 aa, Mycobacterium
HSENATA

SEQ ID NO: 504750 - protein, 5 aa, Mycobacterium
HSENM

SEQ ID NO: 504751 - protein, 5 aa, Mycobacterium
HSENP

SEQ ID NO: 504752 - protein, 4 aa, Mycobacterium
HSEP

SEQ ID NO: 504753 - protein, 5 aa, Mycobacterium
HSEPA

SEQ ID NO: 504754 - protein, 14 aa, Mycobacterium
HSEPADLLPSDPKW

SEQ ID NO: 504755 - protein, 10 aa, Mycobacterium
HSEPDDEPTR

SEQ ID NO: 504756 - protein, 11 aa, Mycobacterium
HSEPDDQPSRR

SEQ ID NO: 504757 - protein, 11 aa, Mycobacterium
HSEPEDESTRR

SEQ ID NO: 504758 - protein, 8 aa, Mycobacterium
HSEPGTRV

SEQ ID NO: 504759 - protein, 7 aa, Mycobacterium
HSEPVGG

SEQ ID NO: 504760 - protein, 18 aa, Mycobacterium
HSEQGAREGEHPGRSRNP

SEQ ID NO: 504761 - protein, 18 aa, Mycobacterium
HSEQGARRGEHPGRSRNP

SEQ ID NO: 504762 - protein, 17 aa, Mycobacterium
HSEQGGLKGEHCGRARN

SEQ ID NO: 504763 - protein, 11 aa, Mycobacterium
HSESAATAAGL

SEQ ID NO: 504764 - protein, 17 aa, Mycobacterium
HSESEGVEPARRVVVLR

SEQ ID NO: 504765 - protein, 9 aa, Mycobacterium
HSESRHRNA

SEQ ID NO: 504766 - protein, 11 aa, Mycobacterium
HSETGIDRAGA

SEQ ID NO: 504767 - protein, 8 aa, Mycobacterium
HSETGQTP

SEQ ID NO: 504768 - protein, 6 aa, Mycobacterium
HSETSF

SEQ ID NO: 504769 - protein, 11 aa, Mycobacterium
HSETSIDAAGA

SEQ ID NO: 504770 - protein, 5 aa, Mycobacterium
HSEVA

SEQ ID NO: 504771 - protein, 7 aa, Mycobacterium
HSEYDTG

SEQ ID NO: 504772 - protein, 6 aa, Mycobacterium
HSFGDD

SEQ ID NO: 504773 - protein, 8 aa, Mycobacterium
HSFRGPGV

SEQ ID NO: 504774 - protein, 8 aa, Mycobacterium
HSGAADAL

SEQ ID NO: 504775 - protein, 7 aa, Mycobacterium
HSGADAI

SEQ ID NO: 504776 - protein, 7 aa, Mycobacterium
HSGADAL

SEQ ID NO: 504777 - protein, 8 aa, Mycobacterium
HSGADALG

SEQ ID NO: 504778 - protein, 8 aa, Mycobacterium
HSGADAVY

SEQ ID NO: 504779 - protein, 5 aa, Mycobacterium
HSGAG

SEQ ID NO: 504780 - protein, 11 aa, Mycobacterium
HSGAGTTAAGL

SEQ ID NO: 504781 - protein, 9 aa, Mycobacterium
HSGANGDYQ

SEQ ID NO: 504782 - protein, 9 aa, Mycobacterium
HSGAPRTVP

SEQ ID NO: 504783 - protein, 8 aa, Mycobacterium
HSGAPSFE

SEQ ID NO: 504784 - protein, 9 aa, Mycobacterium
HSGATMPDD

SEQ ID NO: 504785 - protein, 11 aa, Mycobacterium
HSGDAGNGLPF

SEQ ID NO: 504786 - protein, 5 aa, Mycobacterium
HSGDL

SEQ ID NO: 504787 - protein, 6 aa, Mycobacterium
HSGDNL

SEQ ID NO: 504788 - protein, 5 aa, Mycobacterium
HSGDP

SEQ ID NO: 504789 - protein, 12 aa, Mycobacterium
HSGDSDSTGAIA

SEQ ID NO: 504790 - protein, 8 aa, Mycobacterium
HSGDSTDI

SEQ ID NO: 504791 - protein, 12 aa, Mycobacterium
HSGEDYRRSAPN

SEQ ID NO: 504792 - protein, 5 aa, Mycobacterium
HSGEI

SEQ ID NO: 504793 - protein, 7 aa, Mycobacterium
HSGEPAE

SEQ ID NO: 504794 - protein, 7 aa, Mycobacterium
HSGEPIG

SEQ ID NO: 504795 - protein, 12 aa, Mycobacterium
HSGEPSHAIAPD

SEQ ID NO: 504796 - protein, 10 aa, Mycobacterium
HSGERRSGKR

SEQ ID NO: 504797 - protein, 6 aa, Mycobacterium
HSGERS

SEQ ID NO: 504798 - protein, 6 aa, Mycobacterium
HSGERY

SEQ ID NO: 504799 - protein, 10 aa, Mycobacterium
HSGESGAADH

SEQ ID NO: 504800 - protein, 7 aa, Mycobacterium
HSGETDD

SEQ ID NO: 504801 - protein, 5 aa, Mycobacterium
HSGGG

SEQ ID NO: 504802 - protein, 6 aa, Mycobacterium
HSGGLT

SEQ ID NO: 504803 - protein, 9 aa, Mycobacterium
HSGGNLPPD

SEQ ID NO: 504804 - protein, 9 aa, Mycobacterium
HSGGNVPPD

SEQ ID NO: 504805 - protein, 9 aa, Mycobacterium
HSGGPSADE

SEQ ID NO: 504806 - protein, 54 aa, Mycobacterium
HSGGSGLGGAAGGGGSGGAGGLGGAGGFGEGGGAAAGANGATGATGNSGHSGQA

SEQ ID NO: 504807 - protein, 9 aa, Mycobacterium
HSGGVEEAV

SEQ ID NO: 504808 - protein, 10 aa, Mycobacterium
HSGGVEEAVS

SEQ ID NO: 504809 - protein, 6 aa, Mycobacterium
HSGHGR

SEQ ID NO: 504810 - protein, 6 aa, Mycobacterium
HSGIED

SEQ ID NO: 504811 - protein, 10 aa, Mycobacterium
HSGKPGPPDH

SEQ ID NO: 504812 - protein, 13 aa, Mycobacterium
HSGKQPRRPGTKG

SEQ ID NO: 504813 - protein, 5 aa, Mycobacterium
HSGKW

SEQ ID NO: 504814 - protein, 9 aa, Mycobacterium
HSGNDPLPG

SEQ ID NO: 504815 - protein, 7 aa, Mycobacterium
HSGNGEI

SEQ ID NO: 504816 - protein, 15 aa, Mycobacterium
HSGNGNNLSGYANPQ

SEQ ID NO: 504817 - protein, 59 aa, Mycobacterium
HSGNPGLGGEGGTGGGGGDGGHWGDGGGPGSGSRRGMSGSHGSYGQPGGSGADGAHGQP

SEQ ID NO: 504818 - protein, 7 aa, Mycobacterium
HSGPARA

SEQ ID NO: 504819 - protein, 18 aa, Mycobacterium
HSGPEQAVGQRATPHFHR

SEQ ID NO: 504820 - protein, 9 aa, Mycobacterium
HSGQDRQSA

SEQ ID NO: 504821 - protein, 6 aa, Mycobacterium
HSGQEA

SEQ ID NO: 504822 - protein, 32 aa, Mycobacterium
HSGQPNTNNHHAPERRRLGSEPTRPMINSRVS

SEQ ID NO: 504823 - protein, 15 aa, Mycobacterium
HSGQPVALPAGGTSF

SEQ ID NO: 504824 - protein, 15 aa, Mycobacterium
HSGQPVALPTGGTSF

SEQ ID NO: 504825 - protein, 5 aa, Mycobacterium
HSGQQ

SEQ ID NO: 504826 - protein, 12 aa, Mycobacterium
HSGQTSRSAFDG

SEQ ID NO: 504827 - protein, 6 aa, Mycobacterium
HSGRAE

SEQ ID NO: 504828 - protein, 8 aa, Mycobacterium
HSGRAEVS

SEQ ID NO: 504829 - protein, 5 aa, Mycobacterium
HSGRG

SEQ ID NO: 504830 - protein, 13 aa, Mycobacterium
HSGRLPVLAEEYG

SEQ ID NO: 504831 - protein, 5 aa, Mycobacterium
HSGRP

SEQ ID NO: 504832 - protein, 9 aa, Mycobacterium
HSGRPGFKR

SEQ ID NO: 504833 - protein, 6 aa, Mycobacterium
HSGRSS

SEQ ID NO: 504834 - protein, 15 aa, Mycobacterium
HSGRWPERGTDVKGP

SEQ ID NO: 504835 - protein, 16 aa, Mycobacterium
HSGSRKGKFPAPRAFR

SEQ ID NO: 504836 - protein, 22 aa, Mycobacterium
HSGSTGAAGAAGNGGDGGNGGF

SEQ ID NO: 504837 - protein, 8 aa, Mycobacterium
HSGTAAIP

SEQ ID NO: 504838 - protein, 12 aa, Mycobacterium
HSGTANGLADPT

SEQ ID NO: 504839 - protein, 14 aa, Mycobacterium
HSGTAPSELANTNT

SEQ ID NO: 504840 - protein, 7 aa, Mycobacterium
HSGTDEL

SEQ ID NO: 504841 - protein, 6 aa, Mycobacterium
HSGYGK

SEQ ID NO: 504842 - protein, 8 aa, Mycobacterium
HSGYPGGL

SEQ ID NO: 504843 - protein, 15 aa, Mycobacterium
HSGYPGGLHSRTTGE

SEQ ID NO: 504844 - protein, 9 aa, Mycobacterium
HSGYPGGLR

SEQ ID NO: 504845 - protein, 12 aa, Mycobacterium
HSGYPGGLSSRT

SEQ ID NO: 504846 - protein, 13 aa, Mycobacterium
HSHAAGGLPSYPH

SEQ ID NO: 504847 - protein, 5 aa, Mycobacterium
HSHPG

SEQ ID NO: 504848 - protein, 10 aa, Mycobacterium
HSHRRTPRRW

SEQ ID NO: 504849 - protein, 8 aa, Mycobacterium
HSHRRTRR

SEQ ID NO: 504850 - protein, 12 aa, Mycobacterium
HSHRRTSRRWDP

SEQ ID NO: 504851 - protein, 5 aa, Mycobacterium
HSHSE

SEQ ID NO: 504852 - protein, 13 aa, Mycobacterium
HSHTSDMTSDEAQ

SEQ ID NO: 504853 - protein, 4 aa, Mycobacterium
HSIP

SEQ ID NO: 504854 - protein, 4 aa, Mycobacterium
HSIR

SEQ ID NO: 504855 - protein, 4 aa, Mycobacterium
HSIS

SEQ ID NO: 504856 - protein, 6 aa, Mycobacterium
HSITDA

SEQ ID NO: 504857 - protein, 7 aa, Mycobacterium
HSKADID

SEQ ID NO: 504858 - protein, 8 aa, Mycobacterium
HSKAEREL

SEQ ID NO: 504859 - protein, 5 aa, Mycobacterium
HSKGV

SEQ ID NO: 504860 - protein, 6 aa, Mycobacterium
HSKHSG

SEQ ID NO: 504861 - protein, 8 aa, Mycobacterium
HSKHSGTE

SEQ ID NO: 504862 - protein, 7 aa, Mycobacterium
HSKRTGA

SEQ ID NO: 504863 - protein, 8 aa, Mycobacterium
HSKTRDAE

SEQ ID NO: 504864 - protein, 9 aa, Mycobacterium
HSKTRDSEA

SEQ ID NO: 504865 - protein, 12 aa, Mycobacterium
HSLDDREERARV

SEQ ID NO: 504866 - protein, 5 aa, Mycobacterium
HSLDE

SEQ ID NO: 504867 - protein, 14 aa, Mycobacterium
HSLERTGASRSAVV

SEQ ID NO: 504868 - protein, 8 aa, Mycobacterium
HSLPRQGD

SEQ ID NO: 504869 - protein, 6 aa, Mycobacterium
HSLSEH

SEQ ID NO: 504870 - protein, 9 aa, Mycobacterium
HSLTNVGAS

SEQ ID NO: 504871 - protein, 10 aa, Mycobacterium
HSLTQVGDSG

SEQ ID NO: 504872 - protein, 17 aa, Mycobacterium
HSMKPGTTKTAEAGSRT

SEQ ID NO: 504873 - protein, 7 aa, Mycobacterium
HSNADGR

SEQ ID NO: 504874 - protein, 13 aa, Mycobacterium
HSNAGDNSGGEQE

SEQ ID NO: 504875 - protein, 4 aa, Mycobacterium
HSNG

SEQ ID NO: 504876 - protein, 10 aa, Mycobacterium
HSNGDHTHGN

SEQ ID NO: 504877 - protein, 5 aa, Mycobacterium
HSNGR

SEQ ID NO: 504878 - protein, 12 aa, Mycobacterium
HSNGSNASPATS

SEQ ID NO: 504879 - protein, 6 aa, Mycobacterium
HSNGTV

SEQ ID NO: 504880 - protein, 12 aa, Mycobacterium
HSNHRDDRYGGP

SEQ ID NO: 504881 - protein, 4 aa, Mycobacterium
HSNS

SEQ ID NO: 504882 - protein, 7 aa, Mycobacterium
HSNSHQI

SEQ ID NO: 504883 - protein, 6 aa, Mycobacterium
HSNSSA

SEQ ID NO: 504884 - protein, 7 aa, Mycobacterium
HSNSSAH

SEQ ID NO: 504885 - protein, 7 aa, Mycobacterium
HSNSSAY

SEQ ID NO: 504886 - protein, 7 aa, Mycobacterium
HSPAAEH

SEQ ID NO: 504887 - protein, 25 aa, Mycobacterium
HSPAGPLAAPTATTPGGDGLASSQL

SEQ ID NO: 504888 - protein, 9 aa, Mycobacterium
HSPAGSRAT

SEQ ID NO: 504889 - protein, 25 aa, Mycobacterium
HSPASAEDPAEHLKTESNEAQWGFT

SEQ ID NO: 504890 - protein, 7 aa, Mycobacterium
HSPDDPL

SEQ ID NO: 504891 - protein, 9 aa, Mycobacterium
HSPDRPPDL

SEQ ID NO: 504892 - protein, 6 aa, Mycobacterium
HSPDYR

SEQ ID NO: 504893 - protein, 4 aa, Mycobacterium
HSPE

SEQ ID NO: 504894 - protein, 6 aa, Mycobacterium
HSPEIP

SEQ ID NO: 504895 - protein, 12 aa, Mycobacterium
HSPEKAKAEEQL

SEQ ID NO: 504896 - protein, 5 aa, Mycobacterium
HSPEQ

SEQ ID NO: 504897 - protein, 7 aa, Mycobacterium
HSPGGET

SEQ ID NO: 504898 - protein, 8 aa, Mycobacterium
HSPGGQRC

SEQ ID NO: 504899 - protein, 9 aa, Mycobacterium
HSPGHDGPL

SEQ ID NO: 504900 - protein, 12 aa, Mycobacterium
HSPGRASAAARE

SEQ ID NO: 504901 - protein, 14 aa, Mycobacterium
HSPGRASAAAREAM

SEQ ID NO: 504902 - protein, 17 aa, Mycobacterium
HSPGRAVDAAREARAEG

SEQ ID NO: 504903 - protein, 8 aa, Mycobacterium
HSPGTPVG

SEQ ID NO: 504904 - protein, 4 aa, Mycobacterium
HSPH

SEQ ID NO: 504905 - protein, 11 aa, Mycobacterium
HSPHDDSDYIG

SEQ ID NO: 504906 - protein, 5 aa, Mycobacterium
HSPHS

SEQ ID NO: 504907 - protein, 7 aa, Mycobacterium
HSPKRLD

SEQ ID NO: 504908 - protein, 5 aa, Mycobacterium
HSPLG

SEQ ID NO: 504909 - protein, 9 aa, Mycobacterium
HSPNTAGGL

SEQ ID NO: 504910 - protein, 9 aa, Mycobacterium
HSPNTAGGM

SEQ ID NO: 504911 - protein, 5 aa, Mycobacterium
HSPPD

SEQ ID NO: 504912 - protein, 8 aa, Mycobacterium
HSPPGVAV

SEQ ID NO: 504913 - protein, 9 aa, Mycobacterium
HSPPLRPKS

SEQ ID NO: 504914 - protein, 4 aa, Mycobacterium
HSPQ

SEQ ID NO: 504915 - protein, 6 aa, Mycobacterium
HSPQQR

SEQ ID NO: 504916 - protein, 6 aa, Mycobacterium
HSPQRL

SEQ ID NO: 504917 - protein, 5 aa, Mycobacterium
HSPQS

SEQ ID NO: 504918 - protein, 13 aa, Mycobacterium
HSPRRVRSGLDGE

SEQ ID NO: 504919 - protein, 6 aa, Mycobacterium
HSPSTI

SEQ ID NO: 504920 - protein, 6 aa, Mycobacterium
HSPSTS

SEQ ID NO: 504921 - protein, 6 aa, Mycobacterium
HSPTQA

SEQ ID NO: 504922 - protein, 130 aa, Mycobacterium
HSPTQLPMSPARSPVEPPAPAAVHSPQPAPSAPGAPSPAAPHFSPPSGHPAEMPAPSGGGVHGPNDGLPHDGHPHEKSPHDGDSDGSRDGKPDEHDKPHSHHDTPDGNADGEIPANGDDPSDGLSAEKRD

SEQ ID NO: 504923 - protein, 14 aa, Mycobacterium
HSPTRNRPGESTFR

SEQ ID NO: 504924 - protein, 10 aa, Mycobacterium
HSPTSGPGTI

SEQ ID NO: 504925 - protein, 8 aa, Mycobacterium
HSPVDGRR

SEQ ID NO: 504926 - protein, 16 aa, Mycobacterium
HSPVGKNISETRRTSR

SEQ ID NO: 504927 - protein, 10 aa, Mycobacterium
HSPVPNGGNV

SEQ ID NO: 504928 - protein, 54 aa, Mycobacterium
HSQAGGPSHQPGVDHPGQRRLGDRQNHSAGRQSSRRQPQPSARARPPGGDRRRR

SEQ ID NO: 504929 - protein, 21 aa, Mycobacterium
HSQDPEHAGRIESAASSHAAR

SEQ ID NO: 504930 - protein, 6 aa, Mycobacterium
HSQGEI

SEQ ID NO: 504931 - protein, 7 aa, Mycobacterium
HSQGEIA

SEQ ID NO: 504932 - protein, 6 aa, Mycobacterium
HSQGEV

SEQ ID NO: 504933 - protein, 5 aa, Mycobacterium
HSQGK

SEQ ID NO: 504934 - protein, 6 aa, Mycobacterium
HSQGVT

SEQ ID NO: 504935 - protein, 6 aa, Mycobacterium
HSQHSG

SEQ ID NO: 504936 - protein, 11 aa, Mycobacterium
HSQMPEELRPN

SEQ ID NO: 504937 - protein, 5 aa, Mycobacterium
HSQNY

SEQ ID NO: 504938 - protein, 9 aa, Mycobacterium
HSQPLRPRS

SEQ ID NO: 504939 - protein, 10 aa, Mycobacterium
HSQRGNQAET

SEQ ID NO: 504940 - protein, 7 aa, Mycobacterium
HSQSAIG

SEQ ID NO: 504941 - protein, 9 aa, Mycobacterium
HSQSTTDEL

SEQ ID NO: 504942 - protein, 12 aa, Mycobacterium
HSQTKKSDFGGA

SEQ ID NO: 504943 - protein, 11 aa, Mycobacterium
HSQTTQTGETA

SEQ ID NO: 504944 - protein, 13 aa, Mycobacterium
HSRAAARRAGRFG

SEQ ID NO: 504945 - protein, 13 aa, Mycobacterium
HSREIAKADESLQ

SEQ ID NO: 504946 - protein, 4 aa, Mycobacterium
HSRG

SEQ ID NO: 504947 - protein, 10 aa, Mycobacterium
HSRGLGSSAA

SEQ ID NO: 504948 - protein, 4 aa, Mycobacterium
HSRH

SEQ ID NO: 504949 - protein, 5 aa, Mycobacterium
HSRKP

SEQ ID NO: 504950 - protein, 5 aa, Mycobacterium
HSRNA

SEQ ID NO: 504951 - protein, 9 aa, Mycobacterium
HSRPFRPRS

SEQ ID NO: 504952 - protein, 6 aa, Mycobacterium
HSRQEA

SEQ ID NO: 504953 - protein, 11 aa, Mycobacterium
HSRQPHAGVTA

SEQ ID NO: 504954 - protein, 8 aa, Mycobacterium
HSRQPVQS

SEQ ID NO: 504955 - protein, 22 aa, Mycobacterium
HSRRSRRNGTHFEGRPEGFGNT

SEQ ID NO: 504956 - protein, 10 aa, Mycobacterium
HSRSEKRPAM

SEQ ID NO: 504957 - protein, 5 aa, Mycobacterium
HSRSP

SEQ ID NO: 504958 - protein, 7 aa, Mycobacterium
HSRSRED

SEQ ID NO: 504959 - protein, 6 aa, Mycobacterium
HSRSSR

SEQ ID NO: 504960 - protein, 10 aa, Mycobacterium
HSRTEDGEEL

SEQ ID NO: 504961 - protein, 9 aa, Mycobacterium
HSRTGLNAD

SEQ ID NO: 504962 - protein, 6 aa, Mycobacterium
HSRTPF

SEQ ID NO: 504963 - protein, 8 aa, Mycobacterium
HSRYYKEN

SEQ ID NO: 504964 - protein, 6 aa, Mycobacterium
HSSAAA

SEQ ID NO: 504965 - protein, 9 aa, Mycobacterium
HSSADDPEL

SEQ ID NO: 504966 - protein, 9 aa, Mycobacterium
HSSADDPQL

SEQ ID NO: 504967 - protein, 13 aa, Mycobacterium
HSSAETLAALASA

SEQ ID NO: 504968 - protein, 7 aa, Mycobacterium
HSSAGRV

SEQ ID NO: 504969 - protein, 9 aa, Mycobacterium
HSSAKTTLD

SEQ ID NO: 504970 - protein, 10 aa, Mycobacterium
HSSAMKSRNG

SEQ ID NO: 504971 - protein, 11 aa, Mycobacterium
HSSAPDSATFG

SEQ ID NO: 504972 - protein, 7 aa, Mycobacterium
HSSASAT

SEQ ID NO: 504973 - protein, 8 aa, Mycobacterium
HSSDETSV

SEQ ID NO: 504974 - protein, 8 aa, Mycobacterium
HSSDNPNV

SEQ ID NO: 504975 - protein, 4 aa, Mycobacterium
HSSG

SEQ ID NO: 504976 - protein, 10 aa, Mycobacterium
HSSGDDGQAY

SEQ ID NO: 504977 - protein, 5 aa, Mycobacterium
HSSGR

SEQ ID NO: 504978 - protein, 4 aa, Mycobacterium
HSSH

SEQ ID NO: 504979 - protein, 6 aa, Mycobacterium
HSSPDT

SEQ ID NO: 504980 - protein, 12 aa, Mycobacterium
HSSPHFDTDDGR

SEQ ID NO: 504981 - protein, 12 aa, Mycobacterium
HSSPSELTESGR

SEQ ID NO: 504982 - protein, 4 aa, Mycobacterium
HSSR

SEQ ID NO: 504983 - protein, 27 aa, Mycobacterium
HSSRSRSKDGNSRETLSREERKEATRR

SEQ ID NO: 504984 - protein, 13 aa, Mycobacterium
HSSSANEKQDNVA

SEQ ID NO: 504985 - protein, 11 aa, Mycobacterium
HSSSASGPQVA

SEQ ID NO: 504986 - protein, 9 aa, Mycobacterium
HSSSHGPPV

SEQ ID NO: 504987 - protein, 5 aa, Mycobacterium
HSSSI

SEQ ID NO: 504988 - protein, 29 aa, Mycobacterium
HSSTAQRDPIPGAKRSNHQKARRMPGETG

SEQ ID NO: 504989 - protein, 8 aa, Mycobacterium
HSTAASYS

SEQ ID NO: 504990 - protein, 13 aa, Mycobacterium
HSTAPGAQQYGDA

SEQ ID NO: 504991 - protein, 14 aa, Mycobacterium
HSTAPGAQQYSDEE

SEQ ID NO: 504992 - protein, 6 aa, Mycobacterium
HSTASS

SEQ ID NO: 504993 - protein, 4 aa, Mycobacterium
HSTD

SEQ ID NO: 504994 - protein, 11 aa, Mycobacterium
HSTDPAEKAFG

SEQ ID NO: 504995 - protein, 10 aa, Mycobacterium
HSTDPDKKAF

SEQ ID NO: 504996 - protein, 7 aa, Mycobacterium
HSTDPSQ

SEQ ID NO: 504997 - protein, 20 aa, Mycobacterium
HSTEGRERGHGVHGGGERRE

SEQ ID NO: 504998 - protein, 8 aa, Mycobacterium
HSTEPVGG

SEQ ID NO: 504999 - protein, 6 aa, Mycobacterium
HSTGES

SEQ ID NO: 505000 - protein, 7 aa, Mycobacterium
HSTGGGE

SEQ ID NO: 505001 - protein, 6 aa, Mycobacterium
HSTPAA

SEQ ID NO: 505002 - protein, 11 aa, Mycobacterium
HSTPDDLDTTA

SEQ ID NO: 505003 - protein, 16 aa, Mycobacterium
HSTPESPVRYSGNAQR

SEQ ID NO: 505004 - protein, 13 aa, Mycobacterium
HSTPPPTGANAGR

SEQ ID NO: 505005 - protein, 15 aa, Mycobacterium
HSTPTGGADLGAEAA

SEQ ID NO: 505006 - protein, 6 aa, Mycobacterium
HSTQEV

SEQ ID NO: 505007 - protein, 5 aa, Mycobacterium
HSTRA

SEQ ID NO: 505008 - protein, 11 aa, Mycobacterium
HSTRAATPLHP

SEQ ID NO: 505009 - protein, 13 aa, Mycobacterium
HSTRPNASSGRPD

SEQ ID NO: 505010 - protein, 6 aa, Mycobacterium
HSTSNA

SEQ ID NO: 505011 - protein, 17 aa, Mycobacterium
HSTTGGSSYGSTSPHTQ

SEQ ID NO: 505012 - protein, 10 aa, Mycobacterium
HSVATREGGA

SEQ ID NO: 505013 - protein, 10 aa, Mycobacterium
HSVDDPEPKY

SEQ ID NO: 505014 - protein, 11 aa, Mycobacterium
HSVDDPEPKYG

SEQ ID NO: 505015 - protein, 12 aa, Mycobacterium
HSVDEANSPVSE

SEQ ID NO: 505016 - protein, 6 aa, Mycobacterium
HSVEGA

SEQ ID NO: 505017 - protein, 8 aa, Mycobacterium
HSVNNPYA

SEQ ID NO: 505018 - protein, 5 aa, Mycobacterium
HSVPD

SEQ ID NO: 505019 - protein, 15 aa, Mycobacterium
HSVPDSADPTAVERG

SEQ ID NO: 505020 - protein, 7 aa, Mycobacterium
HSVPPDE

SEQ ID NO: 505021 - protein, 12 aa, Mycobacterium
HSVQRGANPITL

SEQ ID NO: 505022 - protein, 7 aa, Mycobacterium
HSVSESR

SEQ ID NO: 505023 - protein, 20 aa, Mycobacterium
HSVTGRGRHPLPTPQALAAS

SEQ ID NO: 505024 - protein, 16 aa, Mycobacterium
HSWRSQPDVIGPTDTA

SEQ ID NO: 505025 - protein, 4 aa, Mycobacterium
HSYA

SEQ ID NO: 505026 - protein, 6 aa, Mycobacterium
HSYEPY

SEQ ID NO: 505027 - protein, 8 aa, Mycobacterium
HSYGGRQT

SEQ ID NO: 505028 - protein, 14 aa, Mycobacterium
HSYGSGAGKTTALG

SEQ ID NO: 505029 - protein, 8 aa, Mycobacterium
HSYRGLSG

SEQ ID NO: 505030 - protein, 9 aa, Mycobacterium
HSYRGPSAR

SEQ ID NO: 505031 - protein, 9 aa, Mycobacterium
HSYSGQQQL

SEQ ID NO: 505032 - protein, 6 aa, Mycobacterium
HTAAAT

SEQ ID NO: 505033 - protein, 5 aa, Mycobacterium
HTAAD

SEQ ID NO: 505034 - protein, 10 aa, Mycobacterium
HTAAPKTRQR

SEQ ID NO: 505035 - protein, 7 aa, Mycobacterium
HTAAQNV

SEQ ID NO: 505036 - protein, 10 aa, Mycobacterium
HTAAQRASVP

SEQ ID NO: 505037 - protein, 9 aa, Mycobacterium
HTAASAEDA

SEQ ID NO: 505038 - protein, 9 aa, Mycobacterium
HTAASAGEA

SEQ ID NO: 505039 - protein, 8 aa, Mycobacterium
HTAATAAD

SEQ ID NO: 505040 - protein, 11 aa, Mycobacterium
HTAATAAEAQD

SEQ ID NO: 505041 - protein, 10 aa, Mycobacterium
HTAATTDEAV

SEQ ID NO: 505042 - protein, 8 aa, Mycobacterium
HTADDTDK

SEQ ID NO: 505043 - protein, 5 aa, Mycobacterium
HTADP

SEQ ID NO: 505044 - protein, 5 aa, Mycobacterium
HTAEG

SEQ ID NO: 505045 - protein, 6 aa, Mycobacterium
HTAEGD

SEQ ID NO: 505046 - protein, 8 aa, Mycobacterium
HTAEPLRT

SEQ ID NO: 505047 - protein, 10 aa, Mycobacterium
HTAESNRPHV

SEQ ID NO: 505048 - protein, 5 aa, Mycobacterium
HTAGG

SEQ ID NO: 505049 - protein, 6 aa, Mycobacterium
HTAGGM

SEQ ID NO: 505050 - protein, 8 aa, Mycobacterium
HTAGHPGH

SEQ ID NO: 505051 - protein, 10 aa, Mycobacterium
HTAGSAVSAR

SEQ ID NO: 505052 - protein, 11 aa, Mycobacterium
HTAGSKEMRAA

SEQ ID NO: 505053 - protein, 7 aa, Mycobacterium
HTANPEN

SEQ ID NO: 505054 - protein, 6 aa, Mycobacterium
HTAPTG

SEQ ID NO: 505055 - protein, 5 aa, Mycobacterium
HTARE

SEQ ID NO: 505056 - protein, 5 aa, Mycobacterium
HTARG

SEQ ID NO: 505057 - protein, 6 aa, Mycobacterium
HTARSP

SEQ ID NO: 505058 - protein, 8 aa, Mycobacterium
HTASGHPV

SEQ ID NO: 505059 - protein, 11 aa, Mycobacterium
HTASPIATSDI

SEQ ID NO: 505060 - protein, 5 aa, Mycobacterium
HTATA

SEQ ID NO: 505061 - protein, 8 aa, Mycobacterium
HTATAKEI

SEQ ID NO: 505062 - protein, 5 aa, Mycobacterium
HTATG

SEQ ID NO: 505063 - protein, 15 aa, Mycobacterium
HTATPTGSVSKPVDQ

SEQ ID NO: 505064 - protein, 4 aa, Mycobacterium
HTCA

SEQ ID NO: 505065 - protein, 18 aa, Mycobacterium
HTCAGGAFNTAARGLGPA

SEQ ID NO: 505066 - protein, 9 aa, Mycobacterium
HTCGDPTSR

SEQ ID NO: 505067 - protein, 8 aa, Mycobacterium
HTDADGGQ

SEQ ID NO: 505068 - protein, 5 aa, Mycobacterium
HTDAE

SEQ ID NO: 505069 - protein, 11 aa, Mycobacterium
HTDAELRDNPK

SEQ ID NO: 505070 - protein, 7 aa, Mycobacterium
HTDAESY

SEQ ID NO: 505071 - protein, 10 aa, Mycobacterium
HTDDADRAYA

SEQ ID NO: 505072 - protein, 13 aa, Mycobacterium
HTDDALTAGVRGP

SEQ ID NO: 505073 - protein, 11 aa, Mycobacterium
HTDDRDKARRL

SEQ ID NO: 505074 - protein, 6 aa, Mycobacterium
HTDDSA

SEQ ID NO: 505075 - protein, 8 aa, Mycobacterium
HTDDTPRT

SEQ ID NO: 505076 - protein, 10 aa, Mycobacterium
HTDEAGVDDA

SEQ ID NO: 505077 - protein, 8 aa, Mycobacterium
HTDEDTPL

SEQ ID NO: 505078 - protein, 7 aa, Mycobacterium
HTDENDA

SEQ ID NO: 505079 - protein, 16 aa, Mycobacterium
HTDENTDIPVVIAAVN

SEQ ID NO: 505080 - protein, 6 aa, Mycobacterium
HTDGAE

SEQ ID NO: 505081 - protein, 5 aa, Mycobacterium
HTDGE

SEQ ID NO: 505082 - protein, 5 aa, Mycobacterium
HTDGS

SEQ ID NO: 505083 - protein, 11 aa, Mycobacterium
HTDHAGAAERL

SEQ ID NO: 505084 - protein, 9 aa, Mycobacterium
HTDKGVRQK

SEQ ID NO: 505085 - protein, 5 aa, Mycobacterium
HTDPA

SEQ ID NO: 505086 - protein, 18 aa, Mycobacterium
HTDPDEEFDQRVTAIGEL

SEQ ID NO: 505087 - protein, 6 aa, Mycobacterium
HTDPDT

SEQ ID NO: 505088 - protein, 9 aa, Mycobacterium
HTDPGGTDW

SEQ ID NO: 505089 - protein, 7 aa, Mycobacterium
HTDPKDP

SEQ ID NO: 505090 - protein, 10 aa, Mycobacterium
HTDPQQLSGP

SEQ ID NO: 505091 - protein, 5 aa, Mycobacterium
HTDPS

SEQ ID NO: 505092 - protein, 6 aa, Mycobacterium
HTDPSW

SEQ ID NO: 505093 - protein, 5 aa, Mycobacterium
HTDQK

SEQ ID NO: 505094 - protein, 9 aa, Mycobacterium
HTDQPSREI

SEQ ID NO: 505095 - protein, 8 aa, Mycobacterium
HTDRPDSG

SEQ ID NO: 505096 - protein, 4 aa, Mycobacterium
HTDS

SEQ ID NO: 505097 - protein, 12 aa, Mycobacterium
HTDSADSDGAAR

SEQ ID NO: 505098 - protein, 12 aa, Mycobacterium
HTDSPAEGQSGL

SEQ ID NO: 505099 - protein, 8 aa, Mycobacterium
HTDSPNLR

SEQ ID NO: 505100 - protein, 6 aa, Mycobacterium
HTDSRV

SEQ ID NO: 505101 - protein, 8 aa, Mycobacterium
HTDTGERI

SEQ ID NO: 505102 - protein, 9 aa, Mycobacterium
HTDTGPTPA

SEQ ID NO: 505103 - protein, 6 aa, Mycobacterium
HTDTLP

SEQ ID NO: 505104 - protein, 11 aa, Mycobacterium
HTDTRSDGEGL

SEQ ID NO: 505105 - protein, 8 aa, Mycobacterium
HTDTSRRL

SEQ ID NO: 505106 - protein, 14 aa, Mycobacterium
HTDVGQGTDDPTAR

SEQ ID NO: 505107 - protein, 10 aa, Mycobacterium
HTDVSSPRLD

SEQ ID NO: 505108 - protein, 7 aa, Mycobacterium
HTDYDTG

SEQ ID NO: 505109 - protein, 7 aa, Mycobacterium
HTDYGGQ

SEQ ID NO: 505110 - protein, 10 aa, Mycobacterium
HTEAAAAQDF

SEQ ID NO: 505111 - protein, 19 aa, Mycobacterium
HTEATYDQTRAAIDAGATV

SEQ ID NO: 505112 - protein, 9 aa, Mycobacterium
HTEEPTNWS

SEQ ID NO: 505113 - protein, 10 aa, Mycobacterium
HTEGDTGSTA

SEQ ID NO: 505114 - protein, 39 aa, Mycobacterium
HTEGPAALPPLPPSAPRRRPQTHSSTHRTPGRRSGRGQQ

SEQ ID NO: 505115 - protein, 49 aa, Mycobacterium
HTEGPGALPPLPHSAPRRRGQTHSHTRKHRSDPSAQQQPGRRTNGCGQG

SEQ ID NO: 505116 - protein, 6 aa, Mycobacterium
HTENDI

SEQ ID NO: 505117 - protein, 4 aa, Mycobacterium
HTEP

SEQ ID NO: 505118 - protein, 6 aa, Mycobacterium
HTEPEQ

SEQ ID NO: 505119 - protein, 24 aa, Mycobacterium
HTEPGLQGDRSSAGTKPATLETGA

SEQ ID NO: 505120 - protein, 9 aa, Mycobacterium
HTEPGRPSI

SEQ ID NO: 505121 - protein, 6 aa, Mycobacterium
HTEPLE

SEQ ID NO: 505122 - protein, 4 aa, Mycobacterium
HTEQ

SEQ ID NO: 505123 - protein, 19 aa, Mycobacterium
HTEQGHGDLTARGDPPRHG

SEQ ID NO: 505124 - protein, 9 aa, Mycobacterium
HTEQYEDVT

SEQ ID NO: 505125 - protein, 4 aa, Mycobacterium
HTER

SEQ ID NO: 505126 - protein, 6 aa, Mycobacterium
HTESAP

SEQ ID NO: 505127 - protein, 6 aa, Mycobacterium
HTESRP

SEQ ID NO: 505128 - protein, 10 aa, Mycobacterium
HTETARYADY

SEQ ID NO: 505129 - protein, 6 aa, Mycobacterium
HTETTT

SEQ ID NO: 505130 - protein, 5 aa, Mycobacterium
HTEVE

SEQ ID NO: 505131 - protein, 6 aa, Mycobacterium
HTEVPG

SEQ ID NO: 505132 - protein, 6 aa, Mycobacterium
HTEYDT

SEQ ID NO: 505133 - protein, 7 aa, Mycobacterium
HTEYRTK

SEQ ID NO: 505134 - protein, 5 aa, Mycobacterium
HTFTG

SEQ ID NO: 505135 - protein, 7 aa, Mycobacterium
HTGAAAE

SEQ ID NO: 505136 - protein, 6 aa, Mycobacterium
HTGAAN

SEQ ID NO: 505137 - protein, 10 aa, Mycobacterium
HTGADGDPYP

SEQ ID NO: 505138 - protein, 17 aa, Mycobacterium
HTGADRPPGETDNYDAL

SEQ ID NO: 505139 - protein, 7 aa, Mycobacterium
HTGAGGA

SEQ ID NO: 505140 - protein, 8 aa, Mycobacterium
HTGAPLPT

SEQ ID NO: 505141 - protein, 14 aa, Mycobacterium
HTGATVSSLSGGTD

SEQ ID NO: 505142 - protein, 4 aa, Mycobacterium
HTGD

SEQ ID NO: 505143 - protein, 7 aa, Mycobacterium
HTGDASG

SEQ ID NO: 505144 - protein, 12 aa, Mycobacterium
HTGDEPGFTQTH

SEQ ID NO: 505145 - protein, 5 aa, Mycobacterium
HTGDG

SEQ ID NO: 505146 - protein, 9 aa, Mycobacterium
HTGDGRRSG

SEQ ID NO: 505147 - protein, 6 aa, Mycobacterium
HTGDGY

SEQ ID NO: 505148 - protein, 8 aa, Mycobacterium
HTGDPEAR

SEQ ID NO: 505149 - protein, 5 aa, Mycobacterium
HTGDQ

SEQ ID NO: 505150 - protein, 7 aa, Mycobacterium
HTGDSPL

SEQ ID NO: 505151 - protein, 6 aa, Mycobacterium
HTGEDG

SEQ ID NO: 505152 - protein, 5 aa, Mycobacterium
HTGES

SEQ ID NO: 505153 - protein, 6 aa, Mycobacterium
HTGESQ

SEQ ID NO: 505154 - protein, 19 aa, Mycobacterium
HTGETIPEAPPGPPPAPAI

SEQ ID NO: 505155 - protein, 10 aa, Mycobacterium
HTGGAGTAGL

SEQ ID NO: 505156 - protein, 9 aa, Mycobacterium
HTGGDGADA

SEQ ID NO: 505157 - protein, 15 aa, Mycobacterium
HTGGEKRVSASGDTL

SEQ ID NO: 505158 - protein, 7 aa, Mycobacterium
HTGGGEV

SEQ ID NO: 505159 - protein, 6 aa, Mycobacterium
HTGGGQ

SEQ ID NO: 505160 - protein, 48 aa, Mycobacterium
HTGGPAALPPLPHSAPRRRAQTHSHTRNRRDDTAQPQARRRTNGCGQG

SEQ ID NO: 505161 - protein, 8 aa, Mycobacterium
HTGGSGSA

SEQ ID NO: 505162 - protein, 5 aa, Mycobacterium
HTGLT

SEQ ID NO: 505163 - protein, 11 aa, Mycobacterium
HTGNEQRDEHL

SEQ ID NO: 505164 - protein, 7 aa, Mycobacterium
HTGNSEI

SEQ ID NO: 505165 - protein, 7 aa, Mycobacterium
HTGPARS

SEQ ID NO: 505166 - protein, 7 aa, Mycobacterium
HTGPNGY

SEQ ID NO: 505167 - protein, 4 aa, Mycobacterium
HTGQ

SEQ ID NO: 505168 - protein, 5 aa, Mycobacterium
HTGQA

SEQ ID NO: 505169 - protein, 9 aa, Mycobacterium
HTGQEETVD

SEQ ID NO: 505170 - protein, 7 aa, Mycobacterium
HTGQGAV

SEQ ID NO: 505171 - protein, 11 aa, Mycobacterium
HTGQPATYHGR

SEQ ID NO: 505172 - protein, 21 aa, Mycobacterium
HTGQPDEGRALAGDALDGAAE

SEQ ID NO: 505173 - protein, 7 aa, Mycobacterium
HTGQRRL

SEQ ID NO: 505174 - protein, 4 aa, Mycobacterium
HTGR

SEQ ID NO: 505175 - protein, 10 aa, Mycobacterium
HTGRGRPAKR

SEQ ID NO: 505176 - protein, 31 aa, Mycobacterium
HTGRPLQSGTLARPPTQPPPAVPPYRGPSGE

SEQ ID NO: 505177 - protein, 11 aa, Mycobacterium
HTGRRSGKVYT

SEQ ID NO: 505178 - protein, 5 aa, Mycobacterium
HTGRS

SEQ ID NO: 505179 - protein, 7 aa, Mycobacterium
HTGRSAT

SEQ ID NO: 505180 - protein, 7 aa, Mycobacterium
HTGSAGA

SEQ ID NO: 505181 - protein, 12 aa, Mycobacterium
HTGSDDGDEVRA

SEQ ID NO: 505182 - protein, 6 aa, Mycobacterium
HTGSDP

SEQ ID NO: 505183 - protein, 10 aa, Mycobacterium
HTGSELPSAP

SEQ ID NO: 505184 - protein, 8 aa, Mycobacterium
HTGSGGQC

SEQ ID NO: 505185 - protein, 10 aa, Mycobacterium
HTGSGGRPVR

SEQ ID NO: 505186 - protein, 6 aa, Mycobacterium
HTGSPL

SEQ ID NO: 505187 - protein, 4 aa, Mycobacterium
HTGT

SEQ ID NO: 505188 - protein, 6 aa, Mycobacterium
HTGTDG

SEQ ID NO: 505189 - protein, 6 aa, Mycobacterium
HTGTEQ

SEQ ID NO: 505190 - protein, 15 aa, Mycobacterium
HTGTGRGEDRRYTQH

SEQ ID NO: 505191 - protein, 7 aa, Mycobacterium
HTGVDRA

SEQ ID NO: 505192 - protein, 5 aa, Mycobacterium
HTHGA

SEQ ID NO: 505193 - protein, 6 aa, Mycobacterium
HTHHPT

SEQ ID NO: 505194 - protein, 12 aa, Mycobacterium
HTHPDDSYGGKA

SEQ ID NO: 505195 - protein, 26 aa, Mycobacterium
HTHSTTPLSEIPSTCTGRTDSALTLR

SEQ ID NO: 505196 - protein, 4 aa, Mycobacterium
HTIR

SEQ ID NO: 505197 - protein, 8 aa, Mycobacterium
HTKAPAAL

SEQ ID NO: 505198 - protein, 13 aa, Mycobacterium
HTKGPADKPLVNP

SEQ ID NO: 505199 - protein, 9 aa, Mycobacterium
HTKKKEKEI

SEQ ID NO: 505200 - protein, 9 aa, Mycobacterium
HTKKSESEI

SEQ ID NO: 505201 - protein, 7 aa, Mycobacterium
HTKTQTI

SEQ ID NO: 505202 - protein, 17 aa, Mycobacterium
HTLETSGARQFAGGKAN

SEQ ID NO: 505203 - protein, 10 aa, Mycobacterium
HTLPAPEDTE

SEQ ID NO: 505204 - protein, 7 aa, Mycobacterium
HTLPNPN

SEQ ID NO: 505205 - protein, 11 aa, Mycobacterium
HTLRSSSADDV

SEQ ID NO: 505206 - protein, 9 aa, Mycobacterium
HTNANDAHR

SEQ ID NO: 505207 - protein, 7 aa, Mycobacterium
HTNAQRT

SEQ ID NO: 505208 - protein, 18 aa, Mycobacterium
HTNATYEQTQQAISAGAT

SEQ ID NO: 505209 - protein, 6 aa, Mycobacterium
HTNDEL

SEQ ID NO: 505210 - protein, 5 aa, Mycobacterium
HTNGL

SEQ ID NO: 505211 - protein, 23 aa, Mycobacterium
HTNGSTLNIGGDDDDVDVPPFMR

SEQ ID NO: 505212 - protein, 6 aa, Mycobacterium
HTNGTV

SEQ ID NO: 505213 - protein, 7 aa, Mycobacterium
HTNGTVG

SEQ ID NO: 505214 - protein, 21 aa, Mycobacterium
HTNPDEPELARPHSEVPAPED

SEQ ID NO: 505215 - protein, 15 aa, Mycobacterium
HTNPHPQKRDLDGGK

SEQ ID NO: 505216 - protein, 15 aa, Mycobacterium
HTNPHPQKRDMDGGK

SEQ ID NO: 505217 - protein, 4 aa, Mycobacterium
HTNQ

SEQ ID NO: 505218 - protein, 5 aa, Mycobacterium
HTNSQ

SEQ ID NO: 505219 - protein, 4 aa, Mycobacterium
HTPA

SEQ ID NO: 505220 - protein, 10 aa, Mycobacterium
HTPADKERAA

SEQ ID NO: 505221 - protein, 8 aa, Mycobacterium
HTPADRGT

SEQ ID NO: 505222 - protein, 5 aa, Mycobacterium
HTPAP

SEQ ID NO: 505223 - protein, 17 aa, Mycobacterium
HTPDDTPVAKAVATYKL

SEQ ID NO: 505224 - protein, 6 aa, Mycobacterium
HTPDEL

SEQ ID NO: 505225 - protein, 9 aa, Mycobacterium
HTPDGEPWR

SEQ ID NO: 505226 - protein, 6 aa, Mycobacterium
HTPDLH

SEQ ID NO: 505227 - protein, 7 aa, Mycobacterium
HTPEGYK

SEQ ID NO: 505228 - protein, 15 aa, Mycobacterium
HTPEPPGTRRRPVKA

SEQ ID NO: 505229 - protein, 7 aa, Mycobacterium
HTPEQRA

SEQ ID NO: 505230 - protein, 9 aa, Mycobacterium
HTPETEEYG

SEQ ID NO: 505231 - protein, 7 aa, Mycobacterium
HTPFTST

SEQ ID NO: 505232 - protein, 7 aa, Mycobacterium
HTPFTTA

SEQ ID NO: 505233 - protein, 4 aa, Mycobacterium
HTPG

SEQ ID NO: 505234 - protein, 5 aa, Mycobacterium
HTPGD

SEQ ID NO: 505235 - protein, 5 aa, Mycobacterium
HTPGG

SEQ ID NO: 505236 - protein, 14 aa, Mycobacterium
HTPGGSSGGSAAAV

SEQ ID NO: 505237 - protein, 14 aa, Mycobacterium
HTPGGSSGGSGAAV

SEQ ID NO: 505238 - protein, 6 aa, Mycobacterium
HTPGGY

SEQ ID NO: 505239 - protein, 8 aa, Mycobacterium
HTPGHTKG

SEQ ID NO: 505240 - protein, 10 aa, Mycobacterium
HTPGQRPHRG

SEQ ID NO: 505241 - protein, 4 aa, Mycobacterium
HTPL

SEQ ID NO: 505242 - protein, 11 aa, Mycobacterium
HTPLHANGAAA

SEQ ID NO: 505243 - protein, 9 aa, Mycobacterium
HTPNRDDPA

SEQ ID NO: 505244 - protein, 14 aa, Mycobacterium
HTPNRSAAAAREAL

SEQ ID NO: 505245 - protein, 13 aa, Mycobacterium
HTPNRSADAAREA

SEQ ID NO: 505246 - protein, 5 aa, Mycobacterium
HTPNT

SEQ ID NO: 505247 - protein, 6 aa, Mycobacterium
HTPPAA

SEQ ID NO: 505248 - protein, 6 aa, Mycobacterium
HTPPAE

SEQ ID NO: 505249 - protein, 5 aa, Mycobacterium
HTPPG

SEQ ID NO: 505250 - protein, 8 aa, Mycobacterium
HTPPGGQP

SEQ ID NO: 505251 - protein, 8 aa, Mycobacterium
HTPPGGSV

SEQ ID NO: 505252 - protein, 7 aa, Mycobacterium
HTPQDGD

SEQ ID NO: 505253 - protein, 7 aa, Mycobacterium
HTPRTKR

SEQ ID NO: 505254 - protein, 6 aa, Mycobacterium
HTPRTS

SEQ ID NO: 505255 - protein, 14 aa, Mycobacterium
HTPSAAETLERPRS

SEQ ID NO: 505256 - protein, 9 aa, Mycobacterium
HTPSGPVAT

SEQ ID NO: 505257 - protein, 11 aa, Mycobacterium
HTPSKAWRPTG

SEQ ID NO: 505258 - protein, 6 aa, Mycobacterium
HTPSMP

SEQ ID NO: 505259 - protein, 5 aa, Mycobacterium
HTPTG

SEQ ID NO: 505260 - protein, 12 aa, Mycobacterium
HTPTGKKPLPVP

SEQ ID NO: 505261 - protein, 11 aa, Mycobacterium
HTPTSNGADEY

SEQ ID NO: 505262 - protein, 13 aa, Mycobacterium
HTPTYTNHLKNFL

SEQ ID NO: 505263 - protein, 4 aa, Mycobacterium
HTPV

SEQ ID NO: 505264 - protein, 6 aa, Mycobacterium
HTPVRA

SEQ ID NO: 505265 - protein, 7 aa, Mycobacterium
HTPYPEL

SEQ ID NO: 505266 - protein, 4 aa, Mycobacterium
HTQE

SEQ ID NO: 505267 - protein, 9 aa, Mycobacterium
HTQGHQTDA

SEQ ID NO: 505268 - protein, 6 aa, Mycobacterium
HTQGRY

SEQ ID NO: 505269 - protein, 11 aa, Mycobacterium
HTQPGSSWADY

SEQ ID NO: 505270 - protein, 14 aa, Mycobacterium
HTQPPHYYRPNEDT

SEQ ID NO: 505271 - protein, 14 aa, Mycobacterium
HTQRHTDRIDPYRA

SEQ ID NO: 505272 - protein, 9 aa, Mycobacterium
HTQSSSRFD

SEQ ID NO: 505273 - protein, 9 aa, Mycobacterium
HTQTDGRPQ

SEQ ID NO: 505274 - protein, 6 aa, Mycobacterium
HTQYDT

SEQ ID NO: 505275 - protein, 4 aa, Mycobacterium
HTRA

SEQ ID NO: 505276 - protein, 11 aa, Mycobacterium
HTRADGDPASF

SEQ ID NO: 505277 - protein, 10 aa, Mycobacterium
HTRAEAQEQV

SEQ ID NO: 505278 - protein, 13 aa, Mycobacterium
HTRAESHETQSIV

SEQ ID NO: 505279 - protein, 11 aa, Mycobacterium
HTRAGAGANEV

SEQ ID NO: 505280 - protein, 9 aa, Mycobacterium
HTRAGTSVS

SEQ ID NO: 505281 - protein, 4 aa, Mycobacterium
HTRD

SEQ ID NO: 505282 - protein, 7 aa, Mycobacterium
HTRDESF

SEQ ID NO: 505283 - protein, 6 aa, Mycobacterium
HTRDRL

SEQ ID NO: 505284 - protein, 29 aa, Mycobacterium
HTRDTEYKGHKRHCTKDDPQYEIRSDKTD

SEQ ID NO: 505285 - protein, 7 aa, Mycobacterium
HTREESF

SEQ ID NO: 505286 - protein, 5 aa, Mycobacterium
HTRGE

SEQ ID NO: 505287 - protein, 6 aa, Mycobacterium
HTRGEF

SEQ ID NO: 505288 - protein, 5 aa, Mycobacterium
HTRGH

SEQ ID NO: 505289 - protein, 7 aa, Mycobacterium
HTRGPTQ

SEQ ID NO: 505290 - protein, 6 aa, Mycobacterium
HTRKAG

SEQ ID NO: 505291 - protein, 6 aa, Mycobacterium
HTRKES

SEQ ID NO: 505292 - protein, 6 aa, Mycobacterium
HTRPED

SEQ ID NO: 505293 - protein, 5 aa, Mycobacterium
HTRPV

SEQ ID NO: 505294 - protein, 15 aa, Mycobacterium
HTRPYPQGPTHPSNT

SEQ ID NO: 505295 - protein, 25 aa, Mycobacterium
HTRQQARDRRRRTERNLNREQRLQR

SEQ ID NO: 505296 - protein, 7 aa, Mycobacterium
HTRRGGR

SEQ ID NO: 505297 - protein, 6 aa, Mycobacterium
HTRTAD

SEQ ID NO: 505298 - protein, 12 aa, Mycobacterium
HTRTDDNRDIET

SEQ ID NO: 505299 - protein, 7 aa, Mycobacterium
HTRTPDE

SEQ ID NO: 505300 - protein, 6 aa, Mycobacterium
HTRTPG

SEQ ID NO: 505301 - protein, 5 aa, Mycobacterium
HTRTW

SEQ ID NO: 505302 - protein, 4 aa, Mycobacterium
HTRY

SEQ ID NO: 505303 - protein, 24 aa, Mycobacterium
HTSADPSAPRPFPHNRTTTTRRGR

SEQ ID NO: 505304 - protein, 8 aa, Mycobacterium
HTSAPAMS

SEQ ID NO: 505305 - protein, 9 aa, Mycobacterium
HTSASGTTI

SEQ ID NO: 505306 - protein, 6 aa, Mycobacterium
HTSDDP

SEQ ID NO: 505307 - protein, 6 aa, Mycobacterium
HTSDNG

SEQ ID NO: 505308 - protein, 6 aa, Mycobacterium
HTSDNH

SEQ ID NO: 505309 - protein, 10 aa, Mycobacterium
HTSGNLDAQT

SEQ ID NO: 505310 - protein, 7 aa, Mycobacterium
HTSGRVD

SEQ ID NO: 505311 - protein, 23 aa, Mycobacterium
HTSGTQYTSTDEDQAGTLASSMN

SEQ ID NO: 505312 - protein, 5 aa, Mycobacterium
HTSHE

SEQ ID NO: 505313 - protein, 7 aa, Mycobacterium
HTSNLPT

SEQ ID NO: 505314 - protein, 5 aa, Mycobacterium
HTSPN

SEQ ID NO: 505315 - protein, 5 aa, Mycobacterium
HTSPP

SEQ ID NO: 505316 - protein, 5 aa, Mycobacterium
HTSPV

SEQ ID NO: 505317 - protein, 9 aa, Mycobacterium
HTSRDDLNE

SEQ ID NO: 505318 - protein, 10 aa, Mycobacterium
HTSRTGPAVK

SEQ ID NO: 505319 - protein, 9 aa, Mycobacterium
HTSRTQQEV

SEQ ID NO: 505320 - protein, 9 aa, Mycobacterium
HTSRTQQQV

SEQ ID NO: 505321 - protein, 18 aa, Mycobacterium
HTSRYSRYTGGPDPLAPP

SEQ ID NO: 505322 - protein, 22 aa, Mycobacterium
HTSSAARERGSRTQRLNNSKGC

SEQ ID NO: 505323 - protein, 9 aa, Mycobacterium
HTSSAEGQV

SEQ ID NO: 505324 - protein, 6 aa, Mycobacterium
HTSSEG

SEQ ID NO: 505325 - protein, 6 aa, Mycobacterium
HTSSEP

SEQ ID NO: 505326 - protein, 34 aa, Mycobacterium
HTSSGGSVYGTPPAYPTSEDMPVNPASPYAAGKV

SEQ ID NO: 505327 - protein, 7 aa, Mycobacterium
HTSSGRL

SEQ ID NO: 505328 - protein, 7 aa, Mycobacterium
HTSSGTA

SEQ ID NO: 505329 - protein, 8 aa, Mycobacterium
HTSSGTAS

SEQ ID NO: 505330 - protein, 8 aa, Mycobacterium
HTSSGTSS

SEQ ID NO: 505331 - protein, 10 aa, Mycobacterium
HTSTAGSDSL

SEQ ID NO: 505332 - protein, 7 aa, Mycobacterium
HTSTEAD

SEQ ID NO: 505333 - protein, 9 aa, Mycobacterium
HTSTEADVD

SEQ ID NO: 505334 - protein, 7 aa, Mycobacterium
HTSTSKP

SEQ ID NO: 505335 - protein, 4 aa, Mycobacterium
HTTA

SEQ ID NO: 505336 - protein, 14 aa, Mycobacterium
HTTADDPGRYRSQE

SEQ ID NO: 505337 - protein, 13 aa, Mycobacterium
HTTAGNPPTPRQL

SEQ ID NO: 505338 - protein, 6 aa, Mycobacterium
HTTAGW

SEQ ID NO: 505339 - protein, 7 aa, Mycobacterium
HTTDPSD

SEQ ID NO: 505340 - protein, 7 aa, Mycobacterium
HTTEGWS

SEQ ID NO: 505341 - protein, 7 aa, Mycobacterium
HTTEPSG

SEQ ID NO: 505342 - protein, 8 aa, Mycobacterium
HTTGATTQ

SEQ ID NO: 505343 - protein, 8 aa, Mycobacterium
HTTGEGAV

SEQ ID NO: 505344 - protein, 10 aa, Mycobacterium
HTTGKDSSAE

SEQ ID NO: 505345 - protein, 31 aa, Mycobacterium
HTTGLKPARVTGRNVPSEQKAPYEPERADRA

SEQ ID NO: 505346 - protein, 6 aa, Mycobacterium
HTTGSG

SEQ ID NO: 505347 - protein, 9 aa, Mycobacterium
HTTGTGRAA

SEQ ID NO: 505348 - protein, 16 aa, Mycobacterium
HTTPGKSQIGGASNAG

SEQ ID NO: 505349 - protein, 8 aa, Mycobacterium
HTTPPART

SEQ ID NO: 505350 - protein, 6 aa, Mycobacterium
HTTPRE

SEQ ID NO: 505351 - protein, 8 aa, Mycobacterium
HTTPSGTT

SEQ ID NO: 505352 - protein, 8 aa, Mycobacterium
HTTRTGTT

SEQ ID NO: 505353 - protein, 11 aa, Mycobacterium
HTTSPTRDDGS

SEQ ID NO: 505354 - protein, 10 aa, Mycobacterium
HTTSSDGTVD

SEQ ID NO: 505355 - protein, 6 aa, Mycobacterium
HTTSTR

SEQ ID NO: 505356 - protein, 7 aa, Mycobacterium
HTTTDAV

SEQ ID NO: 505357 - protein, 6 aa, Mycobacterium
HTTTFK

SEQ ID NO: 505358 - protein, 7 aa, Mycobacterium
HTTTGER

SEQ ID NO: 505359 - protein, 26 aa, Mycobacterium
HTTTSARIAARTDPWDPETEPSEEDF

SEQ ID NO: 505360 - protein, 5 aa, Mycobacterium
HTVAE

SEQ ID NO: 505361 - protein, 8 aa, Mycobacterium
HTVAEQDE

SEQ ID NO: 505362 - protein, 7 aa, Mycobacterium
HTVAQAP

SEQ ID NO: 505363 - protein, 7 aa, Mycobacterium
HTVATRP

SEQ ID NO: 505364 - protein, 6 aa, Mycobacterium
HTVEGD

SEQ ID NO: 505365 - protein, 13 aa, Mycobacterium
HTVGRNGGFGPTE

SEQ ID NO: 505366 - protein, 4 aa, Mycobacterium
HTVP

SEQ ID NO: 505367 - protein, 15 aa, Mycobacterium
HTVRGRGRHPLPSGR

SEQ ID NO: 505368 - protein, 16 aa, Mycobacterium
HTVRPPKTPQRGGPRV

SEQ ID NO: 505369 - protein, 15 aa, Mycobacterium
HTVTATDGKARPPAR

SEQ ID NO: 505370 - protein, 4 aa, Mycobacterium
HTYD

SEQ ID NO: 505371 - protein, 12 aa, Mycobacterium
HTYSGKGKRALA

SEQ ID NO: 505372 - protein, 8 aa, Mycobacterium
HTYTPEGV

SEQ ID NO: 505373 - protein, 7 aa, Mycobacterium
HVAAGRE

SEQ ID NO: 505374 - protein, 5 aa, Mycobacterium
HVAER

SEQ ID NO: 505375 - protein, 4 aa, Mycobacterium
HVAG

SEQ ID NO: 505376 - protein, 7 aa, Mycobacterium
HVAPPKR

SEQ ID NO: 505377 - protein, 10 aa, Mycobacterium
HVDADTEEAA

SEQ ID NO: 505378 - protein, 5 aa, Mycobacterium
HVDDE

SEQ ID NO: 505379 - protein, 9 aa, Mycobacterium
HVDGSPSEA

SEQ ID NO: 505380 - protein, 11 aa, Mycobacterium
HVDPETARLGR

SEQ ID NO: 505381 - protein, 6 aa, Mycobacterium
HVEAAS

SEQ ID NO: 505382 - protein, 6 aa, Mycobacterium
HVEAGT

SEQ ID NO: 505383 - protein, 10 aa, Mycobacterium
HVEQAAGEFP

SEQ ID NO: 505384 - protein, 7 aa, Mycobacterium
HVETPAA

SEQ ID NO: 505385 - protein, 7 aa, Mycobacterium
HVGARGH

SEQ ID NO: 505386 - protein, 8 aa, Mycobacterium
HVGDARAT

SEQ ID NO: 505387 - protein, 9 aa, Mycobacterium
HVGDARATE

SEQ ID NO: 505388 - protein, 15 aa, Mycobacterium
HVGDARATEVGADGQ

SEQ ID NO: 505389 - protein, 9 aa, Mycobacterium
HVGDQDALT

SEQ ID NO: 505390 - protein, 32 aa, Mycobacterium
HVGGGGRRRGDQDGAGDPARGDAQDPARGCAD

SEQ ID NO: 505391 - protein, 39 aa, Mycobacterium
HVGGGISESLGGSGSVGGSTAVGGGAHTGVGGGVNTGVG

SEQ ID NO: 505392 - protein, 39 aa, Mycobacterium
HVGGGISESLGGSGSVGGSTAVGGGAHTGVGGGVSTGVG

SEQ ID NO: 505393 - protein, 31 aa, Mycobacterium
HVGGGISESLGGSGSVGGSTAVGGGAHTSAI

SEQ ID NO: 505394 - protein, 8 aa, Mycobacterium
HVGGNNAV

SEQ ID NO: 505395 - protein, 6 aa, Mycobacterium
HVGGNT

SEQ ID NO: 505396 - protein, 7 aa, Mycobacterium
HVGGPSI

SEQ ID NO: 505397 - protein, 13 aa, Mycobacterium
HVGPDGRRPAIAD

SEQ ID NO: 505398 - protein, 11 aa, Mycobacterium
HVGPGQDVTTA

SEQ ID NO: 505399 - protein, 13 aa, Mycobacterium
HVGPQAQTRGPGW

SEQ ID NO: 505400 - protein, 5 aa, Mycobacterium
HVGQH

SEQ ID NO: 505401 - protein, 20 aa, Mycobacterium
HVGTDSPAVQEDSSHGRVVP

SEQ ID NO: 505402 - protein, 7 aa, Mycobacterium
HVNEGQG

SEQ ID NO: 505403 - protein, 7 aa, Mycobacterium
HVNPDNR

SEQ ID NO: 505404 - protein, 5 aa, Mycobacterium
HVNPG

SEQ ID NO: 505405 - protein, 4 aa, Mycobacterium
HVPA

SEQ ID NO: 505406 - protein, 5 aa, Mycobacterium
HVPDG

SEQ ID NO: 505407 - protein, 6 aa, Mycobacterium
HVPDPG

SEQ ID NO: 505408 - protein, 9 aa, Mycobacterium
HVPGDTHGP

SEQ ID NO: 505409 - protein, 10 aa, Mycobacterium
HVPPADAPGM

SEQ ID NO: 505410 - protein, 16 aa, Mycobacterium
HVPPADPARGCLGPTE

SEQ ID NO: 505411 - protein, 9 aa, Mycobacterium
HVPPAEAPG

SEQ ID NO: 505412 - protein, 9 aa, Mycobacterium
HVPPDQAPG

SEQ ID NO: 505413 - protein, 6 aa, Mycobacterium
HVPPGS

SEQ ID NO: 505414 - protein, 9 aa, Mycobacterium
HVPSGTIPA

SEQ ID NO: 505415 - protein, 8 aa, Mycobacterium
HVQPGELA

SEQ ID NO: 505416 - protein, 6 aa, Mycobacterium
HVQSRR

SEQ ID NO: 505417 - protein, 15 aa, Mycobacterium
HVRGGEDGGDGGGFG

SEQ ID NO: 505418 - protein, 4 aa, Mycobacterium
HVRP

SEQ ID NO: 505419 - protein, 7 aa, Mycobacterium
HVRTGSD

SEQ ID NO: 505420 - protein, 6 aa, Mycobacterium
HVSAAE

SEQ ID NO: 505421 - protein, 12 aa, Mycobacterium
HVSAQPDGTVTE

SEQ ID NO: 505422 - protein, 17 aa, Mycobacterium
HVSDDSPTAQAPPAPER

SEQ ID NO: 505423 - protein, 8 aa, Mycobacterium
HVSEPERK

SEQ ID NO: 505424 - protein, 8 aa, Mycobacterium
HVSEPERR

SEQ ID NO: 505425 - protein, 7 aa, Mycobacterium
HVSEPSA

SEQ ID NO: 505426 - protein, 9 aa, Mycobacterium
HVSSDGEPL

SEQ ID NO: 505427 - protein, 7 aa, Mycobacterium
HVSSERA

SEQ ID NO: 505428 - protein, 7 aa, Mycobacterium
HVSTDPD

SEQ ID NO: 505429 - protein, 7 aa, Mycobacterium
HVTAPER

SEQ ID NO: 505430 - protein, 13 aa, Mycobacterium
HVTATTSSALRGE

SEQ ID NO: 505431 - protein, 10 aa, Mycobacterium
HVTGKPLPAP

SEQ ID NO: 505432 - protein, 5 aa, Mycobacterium
HVTGQ

SEQ ID NO: 505433 - protein, 6 aa, Mycobacterium
HVTPDA

SEQ ID NO: 505434 - protein, 4 aa, Mycobacterium
HVTT

SEQ ID NO: 505435 - protein, 12 aa, Mycobacterium
HWAAPSTTAPVD

SEQ ID NO: 505436 - protein, 6 aa, Mycobacterium
HWAGSS

SEQ ID NO: 505437 - protein, 5 aa, Mycobacterium
HWASE

SEQ ID NO: 505438 - protein, 6 aa, Mycobacterium
HWDGRA

SEQ ID NO: 505439 - protein, 13 aa, Mycobacterium
HWDTTKPDGTPQK

SEQ ID NO: 505440 - protein, 17 aa, Mycobacterium
HWEPGSKALATRAASGE

SEQ ID NO: 505441 - protein, 37 aa, Mycobacterium
HWEPKEEKGPSDERAKSGGPRASGPTAEGVDANASKK

SEQ ID NO: 505442 - protein, 37 aa, Mycobacterium
HWEPKEKKGPSDERAERGGLRPSGESAEGVDANASKK

SEQ ID NO: 505443 - protein, 37 aa, Mycobacterium
HWEPKKKKGPSDELAKGGGPRNTGRSAEGVDANASKR

SEQ ID NO: 505444 - protein, 10 aa, Mycobacterium
HWGPAEAPVT

SEQ ID NO: 505445 - protein, 7 aa, Mycobacterium
HWPQPGA

SEQ ID NO: 505446 - protein, 5 aa, Mycobacterium
HWRGK

SEQ ID NO: 505447 - protein, 12 aa, Mycobacterium
HWSTSPPDAAVT

SEQ ID NO: 505448 - protein, 4 aa, Mycobacterium
HYAR

SEQ ID NO: 505449 - protein, 5 aa, Mycobacterium
HYDKS

SEQ ID NO: 505450 - protein, 8 aa, Mycobacterium
HYDPDNTH

SEQ ID NO: 505451 - protein, 11 aa, Mycobacterium
HYDPKNLTDHV

SEQ ID NO: 505452 - protein, 4 aa, Mycobacterium
HYDR

SEQ ID NO: 505453 - protein, 14 aa, Mycobacterium
HYEDPSAADPRPSA

SEQ ID NO: 505454 - protein, 16 aa, Mycobacterium
HYEQQEQTSQKILGSD

SEQ ID NO: 505455 - protein, 9 aa, Mycobacterium
HYGAGRNQS

SEQ ID NO: 505456 - protein, 9 aa, Mycobacterium
HYGAGRNQT

SEQ ID NO: 505457 - protein, 10 aa, Mycobacterium
HYGDKTPVSL

SEQ ID NO: 505458 - protein, 9 aa, Mycobacterium
HYGSRTTTG

SEQ ID NO: 505459 - protein, 8 aa, Mycobacterium
HYGTTTAV

SEQ ID NO: 505460 - protein, 5 aa, Mycobacterium
HYHPK

SEQ ID NO: 505461 - protein, 4 aa, Mycobacterium
HYPA

SEQ ID NO: 505462 - protein, 5 aa, Mycobacterium
HYPAD

SEQ ID NO: 505463 - protein, 21 aa, Mycobacterium
HYPAEENPAELAAALRGFLLG

SEQ ID NO: 505464 - protein, 7 aa, Mycobacterium
HYPASGQ

SEQ ID NO: 505465 - protein, 18 aa, Mycobacterium
HYPDADDELSMEDNNTSA

SEQ ID NO: 505466 - protein, 6 aa, Mycobacterium
HYPDDI

SEQ ID NO: 505467 - protein, 9 aa, Mycobacterium
HYPDDSARE

SEQ ID NO: 505468 - protein, 32 aa, Mycobacterium
HYPDSPNHPGFPSTELTPGQTYDSTTVFGFGA

SEQ ID NO: 505469 - protein, 10 aa, Mycobacterium
HYPGATRTHS

SEQ ID NO: 505470 - protein, 11 aa, Mycobacterium
HYPGSDPESVS

SEQ ID NO: 505471 - protein, 10 aa, Mycobacterium
HYPGSDPETV

SEQ ID NO: 505472 - protein, 6 aa, Mycobacterium
HYPGSR

SEQ ID NO: 505473 - protein, 4 aa, Mycobacterium
HYPQ

SEQ ID NO: 505474 - protein, 5 aa, Mycobacterium
HYPQD

SEQ ID NO: 505475 - protein, 6 aa, Mycobacterium
HYPTGV

SEQ ID NO: 505476 - protein, 11 aa, Mycobacterium
HYQEPGGTLPA

SEQ ID NO: 505477 - protein, 8 aa, Mycobacterium
HYRAPEDA

SEQ ID NO: 505478 - protein, 9 aa, Mycobacterium
HYRAPGDAV

SEQ ID NO: 505479 - protein, 4 aa, Mycobacterium
HYRE

SEQ ID NO: 505480 - protein, 11 aa, Mycobacterium
HYRPSPGAART

SEQ ID NO: 505481 - protein, 14 aa, Mycobacterium
HYRQGEGEACGTAV

SEQ ID NO: 505482 - protein, 14 aa, Mycobacterium
HYRQGEGESCGTAV

SEQ ID NO: 505483 - protein, 5 aa, Mycobacterium
HYSGA

SEQ ID NO: 505484 - protein, 15 aa, Mycobacterium
HYSGIETPQRLELFA

SEQ ID NO: 505485 - protein, 12 aa, Mycobacterium
HYSQNQISEEGW

SEQ ID NO: 505486 - protein, 6 aa, Mycobacterium
HYTRTK

SEQ ID NO: 505487 - protein, 5 aa, Mycobacterium
HYYSE

SEQ ID NO: 505488 - protein, 9 aa, Mycobacterium
IAAAGAQHR

SEQ ID NO: 505489 - protein, 30 aa, Mycobacterium
IAAAPQSELAPSRATVAGSGTGAVGSGTGM

SEQ ID NO: 505490 - protein, 9 aa, Mycobacterium
IAAASEADT

SEQ ID NO: 505491 - protein, 9 aa, Mycobacterium
IAAATTELA

SEQ ID NO: 505492 - protein, 30 aa, Mycobacterium
IAADDADRRAHAADAAAKFPANEADAAQQF

SEQ ID NO: 505493 - protein, 16 aa, Mycobacterium
IAADDRRVAPVDAGQG

SEQ ID NO: 505494 - protein, 7 aa, Mycobacterium
IAADGRP

SEQ ID NO: 505495 - protein, 8 aa, Mycobacterium
IAADKAAA

SEQ ID NO: 505496 - protein, 13 aa, Mycobacterium
IAADPGANRGAGL

SEQ ID NO: 505497 - protein, 8 aa, Mycobacterium
IAADPTQV

SEQ ID NO: 505498 - protein, 11 aa, Mycobacterium
IAADRGIDGDV

SEQ ID NO: 505499 - protein, 6 aa, Mycobacterium
IAADTT

SEQ ID NO: 505500 - protein, 10 aa, Mycobacterium
IAAERGYEGT

SEQ ID NO: 505501 - protein, 12 aa, Mycobacterium
IAAGDDESGEIR

SEQ ID NO: 505502 - protein, 6 aa, Mycobacterium
IAAGEN

SEQ ID NO: 505503 - protein, 13 aa, Mycobacterium
IAAGGAEARAQTE

SEQ ID NO: 505504 - protein, 8 aa, Mycobacterium
IAAGGDQP

SEQ ID NO: 505505 - protein, 8 aa, Mycobacterium
IAAGQPAA

SEQ ID NO: 505506 - protein, 6 aa, Mycobacterium
IAAGSE

SEQ ID NO: 505507 - protein, 8 aa, Mycobacterium
IAAGSQAA

SEQ ID NO: 505508 - protein, 5 aa, Mycobacterium
IAAGT

SEQ ID NO: 505509 - protein, 6 aa, Mycobacterium
IAAKDK

SEQ ID NO: 505510 - protein, 9 aa, Mycobacterium
IAANGGRKP

SEQ ID NO: 505511 - protein, 10 aa, Mycobacterium
IAAPAPEPLA

SEQ ID NO: 505512 - protein, 12 aa, Mycobacterium
IAAPDGTLSPVQ

SEQ ID NO: 505513 - protein, 6 aa, Mycobacterium
IAAPDR

SEQ ID NO: 505514 - protein, 9 aa, Mycobacterium
IAAPDTPGV

SEQ ID NO: 505515 - protein, 6 aa, Mycobacterium
IAAPGA

SEQ ID NO: 505516 - protein, 6 aa, Mycobacterium
IAAPGD

SEQ ID NO: 505517 - protein, 12 aa, Mycobacterium
IAAPGTDGSQIP

SEQ ID NO: 505518 - protein, 13 aa, Mycobacterium
IAAPQWSKEDMFV

SEQ ID NO: 505519 - protein, 17 aa, Mycobacterium
IAAPSDDQSLTVGPDGP

SEQ ID NO: 505520 - protein, 8 aa, Mycobacterium
IAAPTGPQ

SEQ ID NO: 505521 - protein, 8 aa, Mycobacterium
IAAQGTGG

SEQ ID NO: 505522 - protein, 8 aa, Mycobacterium
IAAQSDGV

SEQ ID NO: 505523 - protein, 8 aa, Mycobacterium
IAARSEDF

SEQ ID NO: 505524 - protein, 8 aa, Mycobacterium
IAASDASA

SEQ ID NO: 505525 - protein, 11 aa, Mycobacterium
IAASGDDGIPQ

SEQ ID NO: 505526 - protein, 19 aa, Mycobacterium
IAASNDAIAARKSDPRLNN

SEQ ID NO: 505527 - protein, 8 aa, Mycobacterium
IAASPREF

SEQ ID NO: 505528 - protein, 4 aa, Mycobacterium
IAAT

SEQ ID NO: 505529 - protein, 6 aa, Mycobacterium
IAATDD

SEQ ID NO: 505530 - protein, 26 aa, Mycobacterium
IAATDSNSRSRRGGRRGPVAAPPSAW

SEQ ID NO: 505531 - protein, 8 aa, Mycobacterium
IAATEAEY

SEQ ID NO: 505532 - protein, 8 aa, Mycobacterium
IAATEAQY

SEQ ID NO: 505533 - protein, 13 aa, Mycobacterium
IAATEPAPVNVGA

SEQ ID NO: 505534 - protein, 7 aa, Mycobacterium
IAATETA

SEQ ID NO: 505535 - protein, 9 aa, Mycobacterium
IAATGGAAT

SEQ ID NO: 505536 - protein, 11 aa, Mycobacterium
IAATGSAEDFK

SEQ ID NO: 505537 - protein, 10 aa, Mycobacterium
IAATKVPATT

SEQ ID NO: 505538 - protein, 18 aa, Mycobacterium
IAATPGERVKLIETLREL

SEQ ID NO: 505539 - protein, 8 aa, Mycobacterium
IAATQDEY

SEQ ID NO: 505540 - protein, 10 aa, Mycobacterium
IAATQESSGA

SEQ ID NO: 505541 - protein, 6 aa, Mycobacterium
IAATQP

SEQ ID NO: 505542 - protein, 10 aa, Mycobacterium
IAATSQQLGV

SEQ ID NO: 505543 - protein, 5 aa, Mycobacterium
IADAG

SEQ ID NO: 505544 - protein, 7 aa, Mycobacterium
IADARRR

SEQ ID NO: 505545 - protein, 9 aa, Mycobacterium
IADDDPGRR

SEQ ID NO: 505546 - protein, 9 aa, Mycobacterium
IADDGSAAY

SEQ ID NO: 505547 - protein, 6 aa, Mycobacterium
IADDPA

SEQ ID NO: 505548 - protein, 8 aa, Mycobacterium
IADDQDRR

SEQ ID NO: 505549 - protein, 12 aa, Mycobacterium
IADDREAAARAE

SEQ ID NO: 505550 - protein, 5 aa, Mycobacterium
IADDT

SEQ ID NO: 505551 - protein, 4 aa, Mycobacterium
IADE

SEQ ID NO: 505552 - protein, 6 aa, Mycobacterium
IADEGL

SEQ ID NO: 505553 - protein, 4 aa, Mycobacterium
IADG

SEQ ID NO: 505554 - protein, 11 aa, Mycobacterium
IADGAAPGRAI

SEQ ID NO: 505555 - protein, 12 aa, Mycobacterium
IADGAQPRPFGP

SEQ ID NO: 505556 - protein, 7 aa, Mycobacterium
IADGATE

SEQ ID NO: 505557 - protein, 6 aa, Mycobacterium
IADGDS

SEQ ID NO: 505558 - protein, 7 aa, Mycobacterium
IADGGAA

SEQ ID NO: 505559 - protein, 7 aa, Mycobacterium
IADGGGG

SEQ ID NO: 505560 - protein, 19 aa, Mycobacterium
IADGNPDGMWRTVDGQLTK

SEQ ID NO: 505561 - protein, 5 aa, Mycobacterium
IADGS

SEQ ID NO: 505562 - protein, 5 aa, Mycobacterium
IADGT

SEQ ID NO: 505563 - protein, 11 aa, Mycobacterium
IADGTGLGTIR

SEQ ID NO: 505564 - protein, 8 aa, Mycobacterium
IADHDPEA

SEQ ID NO: 505565 - protein, 8 aa, Mycobacterium
IADKTPEC

SEQ ID NO: 505566 - protein, 18 aa, Mycobacterium
IADNNDGNRALGTPGYDA

SEQ ID NO: 505567 - protein, 14 aa, Mycobacterium
IADPADGRVSSARD

SEQ ID NO: 505568 - protein, 18 aa, Mycobacterium
IADPGASGPTAGLSTKYG

SEQ ID NO: 505569 - protein, 21 aa, Mycobacterium
IADPGASGPTTGLSTKYGNDR

SEQ ID NO: 505570 - protein, 7 aa, Mycobacterium
IADPNDV

SEQ ID NO: 505571 - protein, 7 aa, Mycobacterium
IADPSKA

SEQ ID NO: 505572 - protein, 6 aa, Mycobacterium
IADPSN

SEQ ID NO: 505573 - protein, 8 aa, Mycobacterium
IADPTALD

SEQ ID NO: 505574 - protein, 10 aa, Mycobacterium
IADPTPGTPV

SEQ ID NO: 505575 - protein, 7 aa, Mycobacterium
IADPTTA

SEQ ID NO: 505576 - protein, 10 aa, Mycobacterium
IADQGDDGFG

SEQ ID NO: 505577 - protein, 12 aa, Mycobacterium
IADQPRRTRPNY

SEQ ID NO: 505578 - protein, 5 aa, Mycobacterium
IADQT

SEQ ID NO: 505579 - protein, 5 aa, Mycobacterium
IADRD

SEQ ID NO: 505580 - protein, 6 aa, Mycobacterium
IADSAG

SEQ ID NO: 505581 - protein, 7 aa, Mycobacterium
IADSDTA

SEQ ID NO: 505582 - protein, 8 aa, Mycobacterium
IADSHEDG

SEQ ID NO: 505583 - protein, 9 aa, Mycobacterium
IADSPERGV

SEQ ID NO: 505584 - protein, 9 aa, Mycobacterium
IADTAAKYD

SEQ ID NO: 505585 - protein, 12 aa, Mycobacterium
IADTADDRRSLA

SEQ ID NO: 505586 - protein, 8 aa, Mycobacterium
IADTGTVT

SEQ ID NO: 505587 - protein, 5 aa, Mycobacterium
IADTR

SEQ ID NO: 505588 - protein, 8 aa, Mycobacterium
IADTSKSR

SEQ ID NO: 505589 - protein, 9 aa, Mycobacterium
IADTSTFDD

SEQ ID NO: 505590 - protein, 7 aa, Mycobacterium
IADYDPE

SEQ ID NO: 505591 - protein, 5 aa, Mycobacterium
IAEAA

SEQ ID NO: 505592 - protein, 8 aa, Mycobacterium
IAEAENEY

SEQ ID NO: 505593 - protein, 6 aa, Mycobacterium
IAEAGG

SEQ ID NO: 505594 - protein, 6 aa, Mycobacterium
IAEANA

SEQ ID NO: 505595 - protein, 7 aa, Mycobacterium
IAEAPAT

SEQ ID NO: 505596 - protein, 5 aa, Mycobacterium
IAEAQ

SEQ ID NO: 505597 - protein, 5 aa, Mycobacterium
IAEAT

SEQ ID NO: 505598 - protein, 14 aa, Mycobacterium
IAEATRKELADQRD

SEQ ID NO: 505599 - protein, 7 aa, Mycobacterium
IAEDPAQ

SEQ ID NO: 505600 - protein, 11 aa, Mycobacterium
IAEDTGKAAFA

SEQ ID NO: 505601 - protein, 6 aa, Mycobacterium
IAEEGL

SEQ ID NO: 505602 - protein, 8 aa, Mycobacterium
IAEEGSTA

SEQ ID NO: 505603 - protein, 5 aa, Mycobacterium
IAEGA

SEQ ID NO: 505604 - protein, 19 aa, Mycobacterium
IAEGDIPATEETVAQPLSG

SEQ ID NO: 505605 - protein, 11 aa, Mycobacterium
IAEGDKEKAGE

SEQ ID NO: 505606 - protein, 9 aa, Mycobacterium
IAEGDVDRA

SEQ ID NO: 505607 - protein, 23 aa, Mycobacterium
IAEGGYKASSDNHLYGSTRNPWH

SEQ ID NO: 505608 - protein, 18 aa, Mycobacterium
IAEGKADGARLSAAVKER

SEQ ID NO: 505609 - protein, 18 aa, Mycobacterium
IAEGKADGARLSTAVKER

SEQ ID NO: 505610 - protein, 9 aa, Mycobacterium
IAEGRRADP

SEQ ID NO: 505611 - protein, 12 aa, Mycobacterium
IAEGSAPAKPAV

SEQ ID NO: 505612 - protein, 8 aa, Mycobacterium
IAEGSFRP

SEQ ID NO: 505613 - protein, 10 aa, Mycobacterium
IAEGSNGTTL

SEQ ID NO: 505614 - protein, 16 aa, Mycobacterium
IAEGTADQLKERTGGT

SEQ ID NO: 505615 - protein, 12 aa, Mycobacterium
IAEGTPEQAERD

SEQ ID NO: 505616 - protein, 6 aa, Mycobacterium
IAEGTT

SEQ ID NO: 505617 - protein, 7 aa, Mycobacterium
IAEGVEA

SEQ ID NO: 505618 - protein, 14 aa, Mycobacterium
IAEKDREQSRGGLT

SEQ ID NO: 505619 - protein, 9 aa, Mycobacterium
IAEKGGEAA

SEQ ID NO: 505620 - protein, 9 aa, Mycobacterium
IAEKTPECL

SEQ ID NO: 505621 - protein, 7 aa, Mycobacterium
IAENDRE

SEQ ID NO: 505622 - protein, 5 aa, Mycobacterium
IAENN

SEQ ID NO: 505623 - protein, 8 aa, Mycobacterium
IAEPATAD

SEQ ID NO: 505624 - protein, 8 aa, Mycobacterium
IAEPATAE

SEQ ID NO: 505625 - protein, 6 aa, Mycobacterium
IAEPDG

SEQ ID NO: 505626 - protein, 12 aa, Mycobacterium
IAEPDKDGGSLR

SEQ ID NO: 505627 - protein, 9 aa, Mycobacterium
IAEPDSDAW

SEQ ID NO: 505628 - protein, 6 aa, Mycobacterium
IAEPDT

SEQ ID NO: 505629 - protein, 8 aa, Mycobacterium
IAEPDTAQ

SEQ ID NO: 505630 - protein, 5 aa, Mycobacterium
IAEPE

SEQ ID NO: 505631 - protein, 7 aa, Mycobacterium
IAEPGSA

SEQ ID NO: 505632 - protein, 8 aa, Mycobacterium
IAEPGTAE

SEQ ID NO: 505633 - protein, 8 aa, Mycobacterium
IAEPGTAR

SEQ ID NO: 505634 - protein, 9 aa, Mycobacterium
IAEPPAGQP

SEQ ID NO: 505635 - protein, 8 aa, Mycobacterium
IAEPPGSS

SEQ ID NO: 505636 - protein, 6 aa, Mycobacterium
IAEPQP

SEQ ID NO: 505637 - protein, 13 aa, Mycobacterium
IAEPTRHEPDAGG

SEQ ID NO: 505638 - protein, 13 aa, Mycobacterium
IAEQDQELRYWSN

SEQ ID NO: 505639 - protein, 15 aa, Mycobacterium
IAEQRRALDASAEQR

SEQ ID NO: 505640 - protein, 9 aa, Mycobacterium
IAEQSSTEL

SEQ ID NO: 505641 - protein, 8 aa, Mycobacterium
IAERGGPV

SEQ ID NO: 505642 - protein, 9 aa, Mycobacterium
IAERGRAGL

SEQ ID NO: 505643 - protein, 5 aa, Mycobacterium
IAERR

SEQ ID NO: 505644 - protein, 8 aa, Mycobacterium
IAERRGEP

SEQ ID NO: 505645 - protein, 10 aa, Mycobacterium
IAESAPTAGL

SEQ ID NO: 505646 - protein, 8 aa, Mycobacterium
IAESEGAA

SEQ ID NO: 505647 - protein, 5 aa, Mycobacterium
IAESG

SEQ ID NO: 505648 - protein, 11 aa, Mycobacterium
IAESGGPELAD

SEQ ID NO: 505649 - protein, 12 aa, Mycobacterium
IAESGSADSVSS

SEQ ID NO: 505650 - protein, 16 aa, Mycobacterium
IAESLKKTAKAVEGAV

SEQ ID NO: 505651 - protein, 8 aa, Mycobacterium
IAETAPDR

SEQ ID NO: 505652 - protein, 7 aa, Mycobacterium
IAETEAE

SEQ ID NO: 505653 - protein, 15 aa, Mycobacterium
IAETKKEDLNANDID

SEQ ID NO: 505654 - protein, 16 aa, Mycobacterium
IAETKKEDLNANDIDQ

SEQ ID NO: 505655 - protein, 7 aa, Mycobacterium
IAGADNS

SEQ ID NO: 505656 - protein, 11 aa, Mycobacterium
IAGADQPDAPG

SEQ ID NO: 505657 - protein, 8 aa, Mycobacterium
IAGADRRT

SEQ ID NO: 505658 - protein, 23 aa, Mycobacterium
IAGAEKSLRTVQDKKPKDAETKQ

SEQ ID NO: 505659 - protein, 6 aa, Mycobacterium
IAGAET

SEQ ID NO: 505660 - protein, 12 aa, Mycobacterium
IAGARVSGNPDA

SEQ ID NO: 505661 - protein, 4 aa, Mycobacterium
IAGD

SEQ ID NO: 505662 - protein, 15 aa, Mycobacterium
IAGDADAVGEHRPLT

SEQ ID NO: 505663 - protein, 8 aa, Mycobacterium
IAGDELSG

SEQ ID NO: 505664 - protein, 7 aa, Mycobacterium
IAGDERR

SEQ ID NO: 505665 - protein, 8 aa, Mycobacterium
IAGDRGTA

SEQ ID NO: 505666 - protein, 10 aa, Mycobacterium
IAGDSSQAEA

SEQ ID NO: 505667 - protein, 7 aa, Mycobacterium
IAGEADA

SEQ ID NO: 505668 - protein, 6 aa, Mycobacterium
IAGEGA

SEQ ID NO: 505669 - protein, 5 aa, Mycobacterium
IAGEK

SEQ ID NO: 505670 - protein, 11 aa, Mycobacterium
IAGENGELSPV

SEQ ID NO: 505671 - protein, 7 aa, Mycobacterium
IAGEQAA

SEQ ID NO: 505672 - protein, 5 aa, Mycobacterium
IAGES

SEQ ID NO: 505673 - protein, 8 aa, Mycobacterium
IAGESSVR

SEQ ID NO: 505674 - protein, 4 aa, Mycobacterium
IAGG

SEQ ID NO: 505675 - protein, 28 aa, Mycobacterium
IAGGAAGGSTFASGAPHGVAFADGAGPT

SEQ ID NO: 505676 - protein, 15 aa, Mycobacterium
IAGGALSAHTDPAPV

SEQ ID NO: 505677 - protein, 8 aa, Mycobacterium
IAGGASGI

SEQ ID NO: 505678 - protein, 10 aa, Mycobacterium
IAGGDREEIG

SEQ ID NO: 505679 - protein, 7 aa, Mycobacterium
IAGGELK

SEQ ID NO: 505680 - protein, 8 aa, Mycobacterium
IAGGGEQD

SEQ ID NO: 505681 - protein, 7 aa, Mycobacterium
IAGGGTA

SEQ ID NO: 505682 - protein, 22 aa, Mycobacterium
IAGGPDAPVVTDGPFAENAEVA

SEQ ID NO: 505683 - protein, 15 aa, Mycobacterium
IAGGPGINDNGSGVS

SEQ ID NO: 505684 - protein, 14 aa, Mycobacterium
IAGGQGGVPTPGCG

SEQ ID NO: 505685 - protein, 6 aa, Mycobacterium
IAGGQR

SEQ ID NO: 505686 - protein, 19 aa, Mycobacterium
IAGGRASTVGPASLREARR

SEQ ID NO: 505687 - protein, 6 aa, Mycobacterium
IAGGSA

SEQ ID NO: 505688 - protein, 7 aa, Mycobacterium
IAGGSGA

SEQ ID NO: 505689 - protein, 7 aa, Mycobacterium
IAGGSSE

SEQ ID NO: 505690 - protein, 9 aa, Mycobacterium
IAGGTSEIQ

SEQ ID NO: 505691 - protein, 8 aa, Mycobacterium
IAGGTVQG

SEQ ID NO: 505692 - protein, 9 aa, Mycobacterium
IAGGTVQGI

SEQ ID NO: 505693 - protein, 6 aa, Mycobacterium
IAGGVD

SEQ ID NO: 505694 - protein, 4 aa, Mycobacterium
IAGH

SEQ ID NO: 505695 - protein, 10 aa, Mycobacterium
IAGKDPDFNR

SEQ ID NO: 505696 - protein, 10 aa, Mycobacterium
IAGKDPDYNR

SEQ ID NO: 505697 - protein, 8 aa, Mycobacterium
IAGKPSTT

SEQ ID NO: 505698 - protein, 10 aa, Mycobacterium
IAGNGTHSPD

SEQ ID NO: 505699 - protein, 9 aa, Mycobacterium
IAGNNQPAV

SEQ ID NO: 505700 - protein, 5 aa, Mycobacterium
IAGNP

SEQ ID NO: 505701 - protein, 14 aa, Mycobacterium
IAGNRGQTNYAATK

SEQ ID NO: 505702 - protein, 15 aa, Mycobacterium
IAGNRGQTNYATTKA

SEQ ID NO: 505703 - protein, 15 aa, Mycobacterium
IAGNRGQTNYGTTKA

SEQ ID NO: 505704 - protein, 7 aa, Mycobacterium
IAGNSGY

SEQ ID NO: 505705 - protein, 6 aa, Mycobacterium
IAGNTS

SEQ ID NO: 505706 - protein, 4 aa, Mycobacterium
IAGP

SEQ ID NO: 505707 - protein, 10 aa, Mycobacterium
IAGPASPAAN

SEQ ID NO: 505708 - protein, 5 aa, Mycobacterium
IAGPC

SEQ ID NO: 505709 - protein, 8 aa, Mycobacterium
IAGPDGDL

SEQ ID NO: 505710 - protein, 10 aa, Mycobacterium
IAGPDSDGDD

SEQ ID NO: 505711 - protein, 7 aa, Mycobacterium
IAGPETT

SEQ ID NO: 505712 - protein, 21 aa, Mycobacterium
IAGPGDDGVGGAETDQAALTS

SEQ ID NO: 505713 - protein, 10 aa, Mycobacterium
IAGPGGADRV

SEQ ID NO: 505714 - protein, 13 aa, Mycobacterium
IAGPGGGSTEKPV

SEQ ID NO: 505715 - protein, 13 aa, Mycobacterium
IAGPGGGTDEKPV

SEQ ID NO: 505716 - protein, 13 aa, Mycobacterium
IAGPGGGTEDKPV

SEQ ID NO: 505717 - protein, 13 aa, Mycobacterium
IAGPGGGTEQKPV

SEQ ID NO: 505718 - protein, 13 aa, Mycobacterium
IAGPGGGTPAKPV

SEQ ID NO: 505719 - protein, 13 aa, Mycobacterium
IAGPGGGTREKPV

SEQ ID NO: 505720 - protein, 11 aa, Mycobacterium
IAGPGPVDVEN

SEQ ID NO: 505721 - protein, 8 aa, Mycobacterium
IAGPHGDG

SEQ ID NO: 505722 - protein, 10 aa, Mycobacterium
IAGPKPQLDH

SEQ ID NO: 505723 - protein, 9 aa, Mycobacterium
IAGPKRPQD

SEQ ID NO: 505724 - protein, 10 aa, Mycobacterium
IAGPKRPQDR

SEQ ID NO: 505725 - protein, 10 aa, Mycobacterium
IAGPNSDGDD

SEQ ID NO: 505726 - protein, 8 aa, Mycobacterium
IAGPPRAH

SEQ ID NO: 505727 - protein, 6 aa, Mycobacterium
IAGPTR

SEQ ID NO: 505728 - protein, 15 aa, Mycobacterium
IAGQEAGKRLAAEGA

SEQ ID NO: 505729 - protein, 6 aa, Mycobacterium
IAGQGT

SEQ ID NO: 505730 - protein, 5 aa, Mycobacterium
IAGRG

SEQ ID NO: 505731 - protein, 10 aa, Mycobacterium
IAGRNNESSY

SEQ ID NO: 505732 - protein, 5 aa, Mycobacterium
IAGRP

SEQ ID NO: 505733 - protein, 15 aa, Mycobacterium
IAGRPAASVEQHDGQ

SEQ ID NO: 505734 - protein, 7 aa, Mycobacterium
IAGRSDT

SEQ ID NO: 505735 - protein, 9 aa, Mycobacterium
IAGRSGRLT

SEQ ID NO: 505736 - protein, 15 aa, Mycobacterium
IAGRSPLATTTKGRV

SEQ ID NO: 505737 - protein, 8 aa, Mycobacterium
IAGRTDQA

SEQ ID NO: 505738 - protein, 5 aa, Mycobacterium
IAGSD

SEQ ID NO: 505739 - protein, 6 aa, Mycobacterium
IAGSEE

SEQ ID NO: 505740 - protein, 8 aa, Mycobacterium
IAGSEQAR

SEQ ID NO: 505741 - protein, 6 aa, Mycobacterium
IAGSGA

SEQ ID NO: 505742 - protein, 42 aa, Mycobacterium
IAGSGGAGGNAGILGGNGGAGGAAGISQSGIGAPGGAGGNAG

SEQ ID NO: 505743 - protein, 10 aa, Mycobacterium
IAGSPDPTAV

SEQ ID NO: 505744 - protein, 18 aa, Mycobacterium
IAGSPKPACVAESVVRYI

SEQ ID NO: 505745 - protein, 5 aa, Mycobacterium
IAGSS

SEQ ID NO: 505746 - protein, 10 aa, Mycobacterium
IAGSTTGSAM

SEQ ID NO: 505747 - protein, 6 aa, Mycobacterium
IAGTAD

SEQ ID NO: 505748 - protein, 7 aa, Mycobacterium
IAGTAPN

SEQ ID NO: 505749 - protein, 6 aa, Mycobacterium
IAGTAT

SEQ ID NO: 505750 - protein, 13 aa, Mycobacterium
IAGTDTATLTESQ

SEQ ID NO: 505751 - protein, 15 aa, Mycobacterium
IAGTGGSGGAGGTGG

SEQ ID NO: 505752 - protein, 7 aa, Mycobacterium
IAGTGRR

SEQ ID NO: 505753 - protein, 10 aa, Mycobacterium
IAGTNTSQAM

SEQ ID NO: 505754 - protein, 8 aa, Mycobacterium
IAGTPEEV

SEQ ID NO: 505755 - protein, 8 aa, Mycobacterium
IAGTPERP

SEQ ID NO: 505756 - protein, 8 aa, Mycobacterium
IAGTPQRP

SEQ ID NO: 505757 - protein, 4 aa, Mycobacterium
IAHA

SEQ ID NO: 505758 - protein, 28 aa, Mycobacterium
IAHDGDAQQLGAGRSDAAESSSSRPKGR

SEQ ID NO: 505759 - protein, 6 aa, Mycobacterium
IAHQGQ

SEQ ID NO: 505760 - protein, 8 aa, Mycobacterium
IAHSKSPQ

SEQ ID NO: 505761 - protein, 9 aa, Mycobacterium
IAINDGKAA

SEQ ID NO: 505762 - protein, 11 aa, Mycobacterium
IAKAQRPAEAV

SEQ ID NO: 505763 - protein, 11 aa, Mycobacterium
IAKDRGIGGPV

SEQ ID NO: 505764 - protein, 17 aa, Mycobacterium
IAKGSPQGLAASKALTT

SEQ ID NO: 505765 - protein, 7 aa, Mycobacterium
IAKGTAA

SEQ ID NO: 505766 - protein, 9 aa, Mycobacterium
IAKKGAKQK

SEQ ID NO: 505767 - protein, 11 aa, Mycobacterium
IAKNSPSAMRA

SEQ ID NO: 505768 - protein, 17 aa, Mycobacterium
IAKPASALYRGSDDRLG

SEQ ID NO: 505769 - protein, 8 aa, Mycobacterium
IAKQTPQQ

SEQ ID NO: 505770 - protein, 12 aa, Mycobacterium
IAKTSRLADNPR

SEQ ID NO: 505771 - protein, 5 aa, Mycobacterium
IALPP

SEQ ID NO: 505772 - protein, 7 aa, Mycobacterium
IALPPGT

SEQ ID NO: 505773 - protein, 6 aa, Mycobacterium
IANEAD

SEQ ID NO: 505774 - protein, 6 aa, Mycobacterium
IANEKA

SEQ ID NO: 505775 - protein, 6 aa, Mycobacterium
IANGDN

SEQ ID NO: 505776 - protein, 9 aa, Mycobacterium
IANGQEQRT

SEQ ID NO: 505777 - protein, 7 aa, Mycobacterium
IANGRVD

SEQ ID NO: 505778 - protein, 5 aa, Mycobacterium
IANGV

SEQ ID NO: 505779 - protein, 8 aa, Mycobacterium
IANPGDYN

SEQ ID NO: 505780 - protein, 12 aa, Mycobacterium
IANPPKDKSDRD

SEQ ID NO: 505781 - protein, 12 aa, Mycobacterium
IANPPTDKSDRD

SEQ ID NO: 505782 - protein, 7 aa, Mycobacterium
IANPRER

SEQ ID NO: 505783 - protein, 9 aa, Mycobacterium
IANTGNEEI

SEQ ID NO: 505784 - protein, 4 aa, Mycobacterium
IAPA

SEQ ID NO: 505785 - protein, 10 aa, Mycobacterium
IAPAAPAPAA

SEQ ID NO: 505786 - protein, 6 aa, Mycobacterium
IAPAEE

SEQ ID NO: 505787 - protein, 8 aa, Mycobacterium
IAPAEGSR

SEQ ID NO: 505788 - protein, 8 aa, Mycobacterium
IAPAGASA

SEQ ID NO: 505789 - protein, 17 aa, Mycobacterium
IAPAGDDAPRAAARGPL

SEQ ID NO: 505790 - protein, 6 aa, Mycobacterium
IAPAGG

SEQ ID NO: 505791 - protein, 9 aa, Mycobacterium
IAPAGSGNS

SEQ ID NO: 505792 - protein, 11 aa, Mycobacterium
IAPAGTRRGGV

SEQ ID NO: 505793 - protein, 6 aa, Mycobacterium
IAPAKF

SEQ ID NO: 505794 - protein, 6 aa, Mycobacterium
IAPANG

SEQ ID NO: 505795 - protein, 14 aa, Mycobacterium
IAPAPTAPPTPSTV

SEQ ID NO: 505796 - protein, 9 aa, Mycobacterium
IAPARAEAQ

SEQ ID NO: 505797 - protein, 4 aa, Mycobacterium
IAPD

SEQ ID NO: 505798 - protein, 5 aa, Mycobacterium
IAPDA

SEQ ID NO: 505799 - protein, 6 aa, Mycobacterium
IAPDAG

SEQ ID NO: 505800 - protein, 12 aa, Mycobacterium
IAPDAGRIKRGK

SEQ ID NO: 505801 - protein, 5 aa, Mycobacterium
IAPDE

SEQ ID NO: 505802 - protein, 6 aa, Mycobacterium
IAPDEA

SEQ ID NO: 505803 - protein, 6 aa, Mycobacterium
IAPDEI

SEQ ID NO: 505804 - protein, 5 aa, Mycobacterium
IAPDG

SEQ ID NO: 505805 - protein, 7 aa, Mycobacterium
IAPDGSA

SEQ ID NO: 505806 - protein, 8 aa, Mycobacterium
IAPDGSRQ

SEQ ID NO: 505807 - protein, 7 aa, Mycobacterium
IAPDIES

SEQ ID NO: 505808 - protein, 5 aa, Mycobacterium
IAPDK

SEQ ID NO: 505809 - protein, 18 aa, Mycobacterium
IAPDPDRAAEPASAPTAG

SEQ ID NO: 505810 - protein, 7 aa, Mycobacterium
IAPDSTL

SEQ ID NO: 505811 - protein, 5 aa, Mycobacterium
IAPDT

SEQ ID NO: 505812 - protein, 13 aa, Mycobacterium
IAPDTGRVKRGKT

SEQ ID NO: 505813 - protein, 5 aa, Mycobacterium
IAPEA

SEQ ID NO: 505814 - protein, 5 aa, Mycobacterium
IAPEE

SEQ ID NO: 505815 - protein, 5 aa, Mycobacterium
IAPEQ

SEQ ID NO: 505816 - protein, 11 aa, Mycobacterium
IAPETDRDSEV

SEQ ID NO: 505817 - protein, 6 aa, Mycobacterium
IAPETL

SEQ ID NO: 505818 - protein, 6 aa, Mycobacterium
IAPGAD

SEQ ID NO: 505819 - protein, 9 aa, Mycobacterium
IAPGAPTPA

SEQ ID NO: 505820 - protein, 9 aa, Mycobacterium
IAPGARAAW

SEQ ID NO: 505821 - protein, 11 aa, Mycobacterium
IAPGDDERGTI

SEQ ID NO: 505822 - protein, 7 aa, Mycobacterium
IAPGEDA

SEQ ID NO: 505823 - protein, 14 aa, Mycobacterium
IAPGETSGQPVSYP

SEQ ID NO: 505824 - protein, 8 aa, Mycobacterium
IAPGKKAD

SEQ ID NO: 505825 - protein, 7 aa, Mycobacterium
IAPGPAV

SEQ ID NO: 505826 - protein, 7 aa, Mycobacterium
IAPGPMD

SEQ ID NO: 505827 - protein, 12 aa, Mycobacterium
IAPGPTDTPGVA

SEQ ID NO: 505828 - protein, 9 aa, Mycobacterium
IAPGRSSAL

SEQ ID NO: 505829 - protein, 5 aa, Mycobacterium
IAPGS

SEQ ID NO: 505830 - protein, 6 aa, Mycobacterium
IAPGSR

SEQ ID NO: 505831 - protein, 14 aa, Mycobacterium
IAPGTAAGTGPEIH

SEQ ID NO: 505832 - protein, 14 aa, Mycobacterium
IAPGTAGGTGPEVH

SEQ ID NO: 505833 - protein, 13 aa, Mycobacterium
IAPGTGDGTGAQV

SEQ ID NO: 505834 - protein, 14 aa, Mycobacterium
IAPGTGEGTGPEVH

SEQ ID NO: 505835 - protein, 12 aa, Mycobacterium
IAPGTGSGTGAE

SEQ ID NO: 505836 - protein, 8 aa, Mycobacterium
IAPGTITK

SEQ ID NO: 505837 - protein, 8 aa, Mycobacterium
IAPGTPGA

SEQ ID NO: 505838 - protein, 7 aa, Mycobacterium
IAPGTTL

SEQ ID NO: 505839 - protein, 4 aa, Mycobacterium
IAPH

SEQ ID NO: 505840 - protein, 11 aa, Mycobacterium
IAPHGPAEHNG

SEQ ID NO: 505841 - protein, 6 aa, Mycobacterium
IAPKAD

SEQ ID NO: 505842 - protein, 9 aa, Mycobacterium
IAPKDTGLA

SEQ ID NO: 505843 - protein, 10 aa, Mycobacterium
IAPKPVQRPH

SEQ ID NO: 505844 - protein, 4 aa, Mycobacterium
IAPL

SEQ ID NO: 505845 - protein, 7 aa, Mycobacterium
IAPNGAC

SEQ ID NO: 505846 - protein, 4 aa, Mycobacterium
IAPP

SEQ ID NO: 505847 - protein, 6 aa, Mycobacterium
IAPPAA

SEQ ID NO: 505848 - protein, 7 aa, Mycobacterium
IAPPAKV

SEQ ID NO: 505849 - protein, 7 aa, Mycobacterium
IAPPDGA

SEQ ID NO: 505850 - protein, 8 aa, Mycobacterium
IAPPPDLG

SEQ ID NO: 505851 - protein, 6 aa, Mycobacterium
IAPPPE

SEQ ID NO: 505852 - protein, 8 aa, Mycobacterium
IAPPPVPV

SEQ ID NO: 505853 - protein, 5 aa, Mycobacterium
IAPPS

SEQ ID NO: 505854 - protein, 8 aa, Mycobacterium
IAPPSTDV

SEQ ID NO: 505855 - protein, 9 aa, Mycobacterium
IAPRGGGHS

SEQ ID NO: 505856 - protein, 6 aa, Mycobacterium
IAPRPG

SEQ ID NO: 505857 - protein, 7 aa, Mycobacterium
IAPRQAR

SEQ ID NO: 505858 - protein, 36 aa, Mycobacterium
IAPRQVSAASASAPPGVPAAPASSAAGGPGTPLPPG

SEQ ID NO: 505859 - protein, 6 aa, Mycobacterium
IAPSAA

SEQ ID NO: 505860 - protein, 9 aa, Mycobacterium
IAPSARTRM

SEQ ID NO: 505861 - protein, 16 aa, Mycobacterium
IAPSDDTSVLTQDDEI

SEQ ID NO: 505862 - protein, 6 aa, Mycobacterium
IAPSDK

SEQ ID NO: 505863 - protein, 8 aa, Mycobacterium
IAPSDTTS

SEQ ID NO: 505864 - protein, 11 aa, Mycobacterium
IAPSRVKTPNY

SEQ ID NO: 505865 - protein, 9 aa, Mycobacterium
IAPSSDEGF

SEQ ID NO: 505866 - protein, 10 aa, Mycobacterium
IAPTDATEAT

SEQ ID NO: 505867 - protein, 7 aa, Mycobacterium
IAPTDDD

SEQ ID NO: 505868 - protein, 12 aa, Mycobacterium
IAPTHPHPGVES

SEQ ID NO: 505869 - protein, 9 aa, Mycobacterium
IAPTLPAPE

SEQ ID NO: 505870 - protein, 6 aa, Mycobacterium
IAPTPK

SEQ ID NO: 505871 - protein, 12 aa, Mycobacterium
IAPTTPTESRHA

SEQ ID NO: 505872 - protein, 11 aa, Mycobacterium
IAPVPGAAATG

SEQ ID NO: 505873 - protein, 17 aa, Mycobacterium
IAPYGTAERNDDPTAPW

SEQ ID NO: 505874 - protein, 10 aa, Mycobacterium
IAQAEAAGDG

SEQ ID NO: 505875 - protein, 11 aa, Mycobacterium
IAQAGPPEEVY

SEQ ID NO: 505876 - protein, 19 aa, Mycobacterium
IAQAPRAPHAPQGAYPGTC

SEQ ID NO: 505877 - protein, 19 aa, Mycobacterium
IAQAPTAPHAPPGAYPGTC

SEQ ID NO: 505878 - protein, 6 aa, Mycobacterium
IAQATG

SEQ ID NO: 505879 - protein, 8 aa, Mycobacterium
IAQDGTGV

SEQ ID NO: 505880 - protein, 5 aa, Mycobacterium
IAQNA

SEQ ID NO: 505881 - protein, 8 aa, Mycobacterium
IAQPDTAA

SEQ ID NO: 505882 - protein, 7 aa, Mycobacterium
IAQPEDI

SEQ ID NO: 505883 - protein, 7 aa, Mycobacterium
IAQPEDV

SEQ ID NO: 505884 - protein, 11 aa, Mycobacterium
IAQPKAGATTA

SEQ ID NO: 505885 - protein, 10 aa, Mycobacterium
IAQQAASDAT

SEQ ID NO: 505886 - protein, 16 aa, Mycobacterium
IAQQGAPQDVYARPAD

SEQ ID NO: 505887 - protein, 5 aa, Mycobacterium
IAQQR

SEQ ID NO: 505888 - protein, 7 aa, Mycobacterium
IAQRDGT

SEQ ID NO: 505889 - protein, 8 aa, Mycobacterium
IAQSDPNV

SEQ ID NO: 505890 - protein, 13 aa, Mycobacterium
IAQTATRALQPAG

SEQ ID NO: 505891 - protein, 8 aa, Mycobacterium
IAQTDAAL

SEQ ID NO: 505892 - protein, 6 aa, Mycobacterium
IAQTEQ

SEQ ID NO: 505893 - protein, 4 aa, Mycobacterium
IAQV

SEQ ID NO: 505894 - protein, 10 aa, Mycobacterium
IAQVGTPEEL

SEQ ID NO: 505895 - protein, 6 aa, Mycobacterium
IARAGD

SEQ ID NO: 505896 - protein, 17 aa, Mycobacterium
IARAGNRMATDADFGAR

SEQ ID NO: 505897 - protein, 12 aa, Mycobacterium
IARDGASGISAA

SEQ ID NO: 505898 - protein, 19 aa, Mycobacterium
IARDGGRTRADRERPNQWR

SEQ ID NO: 505899 - protein, 4 aa, Mycobacterium
IARE

SEQ ID NO: 505900 - protein, 5 aa, Mycobacterium
IAREE

SEQ ID NO: 505901 - protein, 11 aa, Mycobacterium
IAREPRGDGGF

SEQ ID NO: 505902 - protein, 13 aa, Mycobacterium
IARGEAAGGINPI

SEQ ID NO: 505903 - protein, 12 aa, Mycobacterium
IARGKGAGRPRD

SEQ ID NO: 505904 - protein, 14 aa, Mycobacterium
IARGNGEGRPRNKF

SEQ ID NO: 505905 - protein, 12 aa, Mycobacterium
IARGRGQEIRLW

SEQ ID NO: 505906 - protein, 14 aa, Mycobacterium
IARGRNAAGPDAPE

SEQ ID NO: 505907 - protein, 4 aa, Mycobacterium
IARL

SEQ ID NO: 505908 - protein, 7 aa, Mycobacterium
IARNDDD

SEQ ID NO: 505909 - protein, 14 aa, Mycobacterium
IARNSTTAEGYDQQ

SEQ ID NO: 505910 - protein, 10 aa, Mycobacterium
IARPENFSSN

SEQ ID NO: 505911 - protein, 11 aa, Mycobacterium
IARQGRREAAQ

SEQ ID NO: 505912 - protein, 14 aa, Mycobacterium
IARRGRRDQPPAGV

SEQ ID NO: 505913 - protein, 6 aa, Mycobacterium
IARRPG

SEQ ID NO: 505914 - protein, 9 aa, Mycobacterium
IARSAGPAF

SEQ ID NO: 505915 - protein, 10 aa, Mycobacterium
IARSAGPSFP

SEQ ID NO: 505916 - protein, 10 aa, Mycobacterium
IARTEENTPL

SEQ ID NO: 505917 - protein, 7 aa, Mycobacterium
IARTERS

SEQ ID NO: 505918 - protein, 8 aa, Mycobacterium
IARTPEYA

SEQ ID NO: 505919 - protein, 8 aa, Mycobacterium
IASAGTAE

SEQ ID NO: 505920 - protein, 5 aa, Mycobacterium
IASAK

SEQ ID NO: 505921 - protein, 11 aa, Mycobacterium
IASAPSSAQRT

SEQ ID NO: 505922 - protein, 7 aa, Mycobacterium
IASASDR

SEQ ID NO: 505923 - protein, 7 aa, Mycobacterium
IASATNS

SEQ ID NO: 505924 - protein, 16 aa, Mycobacterium
IASDGRPTGNPTQYGN

SEQ ID NO: 505925 - protein, 10 aa, Mycobacterium
IASDPPGLRP

SEQ ID NO: 505926 - protein, 5 aa, Mycobacterium
IASDT

SEQ ID NO: 505927 - protein, 5 aa, Mycobacterium
IASEA

SEQ ID NO: 505928 - protein, 10 aa, Mycobacterium
IASEEALARD

SEQ ID NO: 505929 - protein, 5 aa, Mycobacterium
IASEG

SEQ ID NO: 505930 - protein, 6 aa, Mycobacterium
IASEQA

SEQ ID NO: 505931 - protein, 9 aa, Mycobacterium
IASETGRTA

SEQ ID NO: 505932 - protein, 17 aa, Mycobacterium
IASEVPAAEKADRNNAD

SEQ ID NO: 505933 - protein, 4 aa, Mycobacterium
IASG

SEQ ID NO: 505934 - protein, 5 aa, Mycobacterium
IASGA

SEQ ID NO: 505935 - protein, 15 aa, Mycobacterium
IASGADTENAAGPGF

SEQ ID NO: 505936 - protein, 9 aa, Mycobacterium
IASGDPTAT

SEQ ID NO: 505937 - protein, 10 aa, Mycobacterium
IASGEVTAAE

SEQ ID NO: 505938 - protein, 11 aa, Mycobacterium
IASGGSTGRPK

SEQ ID NO: 505939 - protein, 9 aa, Mycobacterium
IASGGTSTV

SEQ ID NO: 505940 - protein, 12 aa, Mycobacterium
IASGPAGGSERN

SEQ ID NO: 505941 - protein, 9 aa, Mycobacterium
IASGPGQLQ

SEQ ID NO: 505942 - protein, 7 aa, Mycobacterium
IASKDTR

SEQ ID NO: 505943 - protein, 18 aa, Mycobacterium
IASKEQPRASPRALNNAI

SEQ ID NO: 505944 - protein, 10 aa, Mycobacterium
IASKGDSADG

SEQ ID NO: 505945 - protein, 17 aa, Mycobacterium
IASKSDLERQESKAKTG

SEQ ID NO: 505946 - protein, 8 aa, Mycobacterium
IASPEDDV

SEQ ID NO: 505947 - protein, 6 aa, Mycobacterium
IASPGT

SEQ ID NO: 505948 - protein, 8 aa, Mycobacterium
IASPHNGE

SEQ ID NO: 505949 - protein, 5 aa, Mycobacterium
IASPQ

SEQ ID NO: 505950 - protein, 18 aa, Mycobacterium
IASPSGLARASFGGRPGH

SEQ ID NO: 505951 - protein, 9 aa, Mycobacterium
IASQSETAA

SEQ ID NO: 505952 - protein, 7 aa, Mycobacterium
IASRAPG

SEQ ID NO: 505953 - protein, 19 aa, Mycobacterium
IASRARARQASATWGGSGY

SEQ ID NO: 505954 - protein, 8 aa, Mycobacterium
IASRGTAA

SEQ ID NO: 505955 - protein, 12 aa, Mycobacterium
IASRPGANEKSR

SEQ ID NO: 505956 - protein, 5 aa, Mycobacterium
IASRR

SEQ ID NO: 505957 - protein, 6 aa, Mycobacterium
IASRRA

SEQ ID NO: 505958 - protein, 12 aa, Mycobacterium
IASSARDGSRPH

SEQ ID NO: 505959 - protein, 18 aa, Mycobacterium
IASSVPAAEKADRGNPGH

SEQ ID NO: 505960 - protein, 10 aa, Mycobacterium
IASTAAESAR

SEQ ID NO: 505961 - protein, 8 aa, Mycobacterium
IASTEPNA

SEQ ID NO: 505962 - protein, 6 aa, Mycobacterium
IASTGG

SEQ ID NO: 505963 - protein, 9 aa, Mycobacterium
IASTGLAKT

SEQ ID NO: 505964 - protein, 13 aa, Mycobacterium
IASTGMAKTAETV

SEQ ID NO: 505965 - protein, 6 aa, Mycobacterium
IASTGV

SEQ ID NO: 505966 - protein, 7 aa, Mycobacterium
IASTNAD

SEQ ID NO: 505967 - protein, 7 aa, Mycobacterium
IASTTAE

SEQ ID NO: 505968 - protein, 5 aa, Mycobacterium
IASYP

SEQ ID NO: 505969 - protein, 19 aa, Mycobacterium
IASYPGPGVPDAGFSGATV

SEQ ID NO: 505970 - protein, 7 aa, Mycobacterium
IATAGAR

SEQ ID NO: 505971 - protein, 21 aa, Mycobacterium
IATAGSAGVAGSIATARSAAV

SEQ ID NO: 505972 - protein, 14 aa, Mycobacterium
IATAQSRAEIRASR

SEQ ID NO: 505973 - protein, 10 aa, Mycobacterium
IATASGNLTG

SEQ ID NO: 505974 - protein, 6 aa, Mycobacterium
IATASI

SEQ ID NO: 505975 - protein, 7 aa, Mycobacterium
IATATES

SEQ ID NO: 505976 - protein, 25 aa, Mycobacterium
IATATSGSGGAGGDGTDGGNGGSGG

SEQ ID NO: 505977 - protein, 10 aa, Mycobacterium
IATDDGIGAT

SEQ ID NO: 505978 - protein, 8 aa, Mycobacterium
IATDGADA

SEQ ID NO: 505979 - protein, 8 aa, Mycobacterium
IATDGELA

SEQ ID NO: 505980 - protein, 7 aa, Mycobacterium
IATDSTA

SEQ ID NO: 505981 - protein, 15 aa, Mycobacterium
IATDSTAAVPAPDRA

SEQ ID NO: 505982 - protein, 12 aa, Mycobacterium
IATDSTAVVPAP

SEQ ID NO: 505983 - protein, 13 aa, Mycobacterium
IATDSTAVVPAPE

SEQ ID NO: 505984 - protein, 64 aa, Mycobacterium
IATEGTGNFTPAPVGTPGLSPTASGPATPSVAAAPLGPQAPKSGPMAPQPDQPPVQPKKPAGPL

SEQ ID NO: 505985 - protein, 7 aa, Mycobacterium
IATEQAA

SEQ ID NO: 505986 - protein, 7 aa, Mycobacterium
IATESDQ

SEQ ID NO: 505987 - protein, 10 aa, Mycobacterium
IATETGTPVT

SEQ ID NO: 505988 - protein, 11 aa, Mycobacterium
IATGATAKAGC

SEQ ID NO: 505989 - protein, 12 aa, Mycobacterium
IATGNDADADRH

SEQ ID NO: 505990 - protein, 13 aa, Mycobacterium
IATGNDADSDRHG

SEQ ID NO: 505991 - protein, 15 aa, Mycobacterium
IATGNDHGGGDTLAS

SEQ ID NO: 505992 - protein, 8 aa, Mycobacterium
IATGNTTG

SEQ ID NO: 505993 - protein, 15 aa, Mycobacterium
IATGPNPQPNEPSLT

SEQ ID NO: 505994 - protein, 7 aa, Mycobacterium
IATGPSQ

SEQ ID NO: 505995 - protein, 6 aa, Mycobacterium
IATGRK

SEQ ID NO: 505996 - protein, 17 aa, Mycobacterium
IATGSDDYTDGPTAWDG

SEQ ID NO: 505997 - protein, 9 aa, Mycobacterium
IATKADNPL

SEQ ID NO: 505998 - protein, 7 aa, Mycobacterium
IATKDTR

SEQ ID NO: 505999 - protein, 6 aa, Mycobacterium
IATKRD

SEQ ID NO: 506000 - protein, 5 aa, Mycobacterium
IATNA

SEQ ID NO: 506001 - protein, 8 aa, Mycobacterium
IATNADNP

SEQ ID NO: 506002 - protein, 9 aa, Mycobacterium
IATNADNPL

SEQ ID NO: 506003 - protein, 4 aa, Mycobacterium
IATP

SEQ ID NO: 506004 - protein, 6 aa, Mycobacterium
IATPAD

SEQ ID NO: 506005 - protein, 8 aa, Mycobacterium
IATPGEGQ

SEQ ID NO: 506006 - protein, 5 aa, Mycobacterium
IATPI

SEQ ID NO: 506007 - protein, 7 aa, Mycobacterium
IATPKNL

SEQ ID NO: 506008 - protein, 7 aa, Mycobacterium
IATPPTN

SEQ ID NO: 506009 - protein, 13 aa, Mycobacterium
IATPSDGDRPDAV

SEQ ID NO: 506010 - protein, 10 aa, Mycobacterium
IATPSSTSAA

SEQ ID NO: 506011 - protein, 8 aa, Mycobacterium
IATQGAEL

SEQ ID NO: 506012 - protein, 5 aa, Mycobacterium
IATRT

SEQ ID NO: 506013 - protein, 7 aa, Mycobacterium
IATSDGA

SEQ ID NO: 506014 - protein, 9 aa, Mycobacterium
IATSGGDRY

SEQ ID NO: 506015 - protein, 20 aa, Mycobacterium
IATSITEPADRPDNLPVASL

SEQ ID NO: 506016 - protein, 10 aa, Mycobacterium
IATSRAAACG

SEQ ID NO: 506017 - protein, 6 aa, Mycobacterium
IATTEQ

SEQ ID NO: 506018 - protein, 7 aa, Mycobacterium
IATTGAR

SEQ ID NO: 506019 - protein, 9 aa, Mycobacterium
IATTPRDEV

SEQ ID NO: 506020 - protein, 7 aa, Mycobacterium
IATTSDA

SEQ ID NO: 506021 - protein, 11 aa, Mycobacterium
IATTSKTLPDF

SEQ ID NO: 506022 - protein, 15 aa, Mycobacterium
IATYKRGDQGEIGEI

SEQ ID NO: 506023 - protein, 15 aa, Mycobacterium
IAVDGGAGSSSGILG

SEQ ID NO: 506024 - protein, 25 aa, Mycobacterium
IAVDGGTAASGILGSGKDLASGDTI

SEQ ID NO: 506025 - protein, 6 aa, Mycobacterium
IAVTDG

SEQ ID NO: 506026 - protein, 6 aa, Mycobacterium
IAVTEA

SEQ ID NO: 506027 - protein, 11 aa, Mycobacterium
IAVTGSSGLVG

SEQ ID NO: 506028 - protein, 5 aa, Mycobacterium
ICPEA

SEQ ID NO: 506029 - protein, 43 aa, Mycobacterium
ICPGEAEEGPTQGGPDSVIPGRPRPSTPGGGRLTTPPQPPTVA

SEQ ID NO: 506030 - protein, 6 aa, Mycobacterium
IDAAAG

SEQ ID NO: 506031 - protein, 8 aa, Mycobacterium
IDAAGAAD

SEQ ID NO: 506032 - protein, 10 aa, Mycobacterium
IDAAKANAKD

SEQ ID NO: 506033 - protein, 8 aa, Mycobacterium
IDAARAEK

SEQ ID NO: 506034 - protein, 11 aa, Mycobacterium
IDAARGRFAGR

SEQ ID NO: 506035 - protein, 6 aa, Mycobacterium
IDAASY

SEQ ID NO: 506036 - protein, 6 aa, Mycobacterium
IDAATA

SEQ ID NO: 506037 - protein, 4 aa, Mycobacterium
IDAD

SEQ ID NO: 506038 - protein, 10 aa, Mycobacterium
IDADDARRRL

SEQ ID NO: 506039 - protein, 9 aa, Mycobacterium
IDADDGTRR

SEQ ID NO: 506040 - protein, 22 aa, Mycobacterium
IDADDKDSGPEEAEEKRPPPVP

SEQ ID NO: 506041 - protein, 6 aa, Mycobacterium
IDADEA

SEQ ID NO: 506042 - protein, 5 aa, Mycobacterium
IDADG

SEQ ID NO: 506043 - protein, 12 aa, Mycobacterium
IDADPQNCGGRA

SEQ ID NO: 506044 - protein, 6 aa, Mycobacterium
IDADRD

SEQ ID NO: 506045 - protein, 5 aa, Mycobacterium
IDADS

SEQ ID NO: 506046 - protein, 4 aa, Mycobacterium
IDAE

SEQ ID NO: 506047 - protein, 7 aa, Mycobacterium
IDAEGEL

SEQ ID NO: 506048 - protein, 6 aa, Mycobacterium
IDAEPA

SEQ ID NO: 506049 - protein, 8 aa, Mycobacterium
IDAEPGKK

SEQ ID NO: 506050 - protein, 7 aa, Mycobacterium
IDAERAA

SEQ ID NO: 506051 - protein, 6 aa, Mycobacterium
IDAESV

SEQ ID NO: 506052 - protein, 12 aa, Mycobacterium
IDAGAERDRAEQ

SEQ ID NO: 506053 - protein, 5 aa, Mycobacterium
IDAGD

SEQ ID NO: 506054 - protein, 6 aa, Mycobacterium
IDAGDV

SEQ ID NO: 506055 - protein, 17 aa, Mycobacterium
IDAGSRPGTASEESAEL

SEQ ID NO: 506056 - protein, 12 aa, Mycobacterium
IDAGYSRNDDRL

SEQ ID NO: 506057 - protein, 10 aa, Mycobacterium
IDANDAAGNY

SEQ ID NO: 506058 - protein, 8 aa, Mycobacterium
IDANGMSS

SEQ ID NO: 506059 - protein, 7 aa, Mycobacterium
IDANPAA

SEQ ID NO: 506060 - protein, 7 aa, Mycobacterium
IDANPAS

SEQ ID NO: 506061 - protein, 4 aa, Mycobacterium
IDAP

SEQ ID NO: 506062 - protein, 8 aa, Mycobacterium
IDAPAGSD

SEQ ID NO: 506063 - protein, 7 aa, Mycobacterium
IDAPDGA

SEQ ID NO: 506064 - protein, 7 aa, Mycobacterium
IDAPDRV

SEQ ID NO: 506065 - protein, 5 aa, Mycobacterium
IDAPG

SEQ ID NO: 506066 - protein, 6 aa, Mycobacterium
IDAPPE

SEQ ID NO: 506067 - protein, 8 aa, Mycobacterium
IDAPPGSR

SEQ ID NO: 506068 - protein, 7 aa, Mycobacterium
IDAPPSK

SEQ ID NO: 506069 - protein, 9 aa, Mycobacterium
IDAPQSQAA

SEQ ID NO: 506070 - protein, 7 aa, Mycobacterium
IDAPTAH

SEQ ID NO: 506071 - protein, 16 aa, Mycobacterium
IDAPTASRLGKPYPQE

SEQ ID NO: 506072 - protein, 11 aa, Mycobacterium
IDAQTKAVGGA

SEQ ID NO: 506073 - protein, 4 aa, Mycobacterium
IDAR

SEQ ID NO: 506074 - protein, 10 aa, Mycobacterium
IDARAGSRQI

SEQ ID NO: 506075 - protein, 8 aa, Mycobacterium
IDAREGGR

SEQ ID NO: 506076 - protein, 10 aa, Mycobacterium
IDARGRDAVR

SEQ ID NO: 506077 - protein, 9 aa, Mycobacterium
IDARRAPSV

SEQ ID NO: 506078 - protein, 7 aa, Mycobacterium
IDASDAR

SEQ ID NO: 506079 - protein, 9 aa, Mycobacterium
IDASGNDIA

SEQ ID NO: 506080 - protein, 9 aa, Mycobacterium
IDASGSSQF

SEQ ID NO: 506081 - protein, 13 aa, Mycobacterium
IDASGTKSSFRTG

SEQ ID NO: 506082 - protein, 5 aa, Mycobacterium
IDASS

SEQ ID NO: 506083 - protein, 4 aa, Mycobacterium
IDAT

SEQ ID NO: 506084 - protein, 11 aa, Mycobacterium
IDATAAGLAER

SEQ ID NO: 506085 - protein, 10 aa, Mycobacterium
IDATAPDGAP

SEQ ID NO: 506086 - protein, 10 aa, Mycobacterium
IDATAPDGTP

SEQ ID NO: 506087 - protein, 6 aa, Mycobacterium
IDATAR

SEQ ID NO: 506088 - protein, 10 aa, Mycobacterium
IDATRPDGTP

SEQ ID NO: 506089 - protein, 8 aa, Mycobacterium
IDDAEAQI

SEQ ID NO: 506090 - protein, 14 aa, Mycobacterium
IDDAGTPSATTDVI

SEQ ID NO: 506091 - protein, 9 aa, Mycobacterium
IDDAPDADA

SEQ ID NO: 506092 - protein, 9 aa, Mycobacterium
IDDATAEKL

SEQ ID NO: 506093 - protein, 27 aa, Mycobacterium
IDDDDDSTETSSEDEPDNSTDDESEDN

SEQ ID NO: 506094 - protein, 5 aa, Mycobacterium
IDDDE

SEQ ID NO: 506095 - protein, 6 aa, Mycobacterium
IDDDER

SEQ ID NO: 506096 - protein, 8 aa, Mycobacterium
IDDDGASI

SEQ ID NO: 506097 - protein, 8 aa, Mycobacterium
IDDDPVAE

SEQ ID NO: 506098 - protein, 10 aa, Mycobacterium
IDDDRTKARD

SEQ ID NO: 506099 - protein, 9 aa, Mycobacterium
IDDEAPGAR

SEQ ID NO: 506100 - protein, 6 aa, Mycobacterium
IDDEDA

SEQ ID NO: 506101 - protein, 5 aa, Mycobacterium
IDDEG

SEQ ID NO: 506102 - protein, 16 aa, Mycobacterium
IDDEGLRFSKKRAPVR

SEQ ID NO: 506103 - protein, 8 aa, Mycobacterium
IDDEPAGL

SEQ ID NO: 506104 - protein, 8 aa, Mycobacterium
IDDETVDI

SEQ ID NO: 506105 - protein, 7 aa, Mycobacterium
IDDEYPG

SEQ ID NO: 506106 - protein, 13 aa, Mycobacterium
IDDGATDGTQRHP

SEQ ID NO: 506107 - protein, 11 aa, Mycobacterium
IDDGGNGETRF

SEQ ID NO: 506108 - protein, 21 aa, Mycobacterium
IDDGHAPGVTSTESAKVKELE

SEQ ID NO: 506109 - protein, 22 aa, Mycobacterium
IDDGHAPGVTTAESAKVKELEQ

SEQ ID NO: 506110 - protein, 9 aa, Mycobacterium
IDDGPGGAA

SEQ ID NO: 506111 - protein, 17 aa, Mycobacterium
IDDGYAPGVSTAESRRV

SEQ ID NO: 506112 - protein, 7 aa, Mycobacterium
IDDNGSV

SEQ ID NO: 506113 - protein, 5 aa, Mycobacterium
IDDPA

SEQ ID NO: 506114 - protein, 5 aa, Mycobacterium
IDDPD

SEQ ID NO: 506115 - protein, 9 aa, Mycobacterium
IDDPDARKR

SEQ ID NO: 506116 - protein, 7 aa, Mycobacterium
IDDPDER

SEQ ID NO: 506117 - protein, 8 aa, Mycobacterium
IDDPDVSQ

SEQ ID NO: 506118 - protein, 28 aa, Mycobacterium
IDDPEAQAPRPADDPGEPGGPAPPEGEA

SEQ ID NO: 506119 - protein, 7 aa, Mycobacterium
IDDPKLS

SEQ ID NO: 506120 - protein, 5 aa, Mycobacterium
IDDPN

SEQ ID NO: 506121 - protein, 6 aa, Mycobacterium
IDDPRD

SEQ ID NO: 506122 - protein, 9 aa, Mycobacterium
IDDPRGLGG

SEQ ID NO: 506123 - protein, 11 aa, Mycobacterium
IDDPSTAVPIG

SEQ ID NO: 506124 - protein, 4 aa, Mycobacterium
IDDQ

SEQ ID NO: 506125 - protein, 4 aa, Mycobacterium
IDDR

SEQ ID NO: 506126 - protein, 7 aa, Mycobacterium
IDDRTAA

SEQ ID NO: 506127 - protein, 7 aa, Mycobacterium
IDDRTAT

SEQ ID NO: 506128 - protein, 4 aa, Mycobacterium
IDDS

SEQ ID NO: 506129 - protein, 12 aa, Mycobacterium
IDDSGKLTRRGA

SEQ ID NO: 506130 - protein, 9 aa, Mycobacterium
IDDSPPGDY

SEQ ID NO: 506131 - protein, 7 aa, Mycobacterium
IDDSPVR

SEQ ID NO: 506132 - protein, 8 aa, Mycobacterium
IDDSPVRA

SEQ ID NO: 506133 - protein, 14 aa, Mycobacterium
IDDSPVRAFDSDSE

SEQ ID NO: 506134 - protein, 9 aa, Mycobacterium
IDDSSGNPE

SEQ ID NO: 506135 - protein, 6 aa, Mycobacterium
IDDTRP

SEQ ID NO: 506136 - protein, 18 aa, Mycobacterium
IDDVERGSQDSDWDPVKA

SEQ ID NO: 506137 - protein, 19 aa, Mycobacterium
IDDVERGSQDSDWDPVKAA

SEQ ID NO: 506138 - protein, 7 aa, Mycobacterium
IDDVSDD

SEQ ID NO: 506139 - protein, 4 aa, Mycobacterium
IDEA

SEQ ID NO: 506140 - protein, 7 aa, Mycobacterium
IDEAADG

SEQ ID NO: 506141 - protein, 6 aa, Mycobacterium
IDEAAQ

SEQ ID NO: 506142 - protein, 8 aa, Mycobacterium
IDEADGAG

SEQ ID NO: 506143 - protein, 5 aa, Mycobacterium
IDEAE

SEQ ID NO: 506144 - protein, 8 aa, Mycobacterium
IDEAGQPI

SEQ ID NO: 506145 - protein, 10 aa, Mycobacterium
IDEAKERANR

SEQ ID NO: 506146 - protein, 11 aa, Mycobacterium
IDEAKRALGER

SEQ ID NO: 506147 - protein, 11 aa, Mycobacterium
IDEARENDWDI

SEQ ID NO: 506148 - protein, 11 aa, Mycobacterium
IDEARENPDTA

SEQ ID NO: 506149 - protein, 14 aa, Mycobacterium
IDEARENRWDTAGS

SEQ ID NO: 506150 - protein, 15 aa, Mycobacterium
IDEARQAHSARRETL

SEQ ID NO: 506151 - protein, 21 aa, Mycobacterium
IDEATGAGSTAEAPNYNVAPT

SEQ ID NO: 506152 - protein, 24 aa, Mycobacterium
IDEATGASEGAGAPNYNVAPTSTI

SEQ ID NO: 506153 - protein, 6 aa, Mycobacterium
IDEAYG

SEQ ID NO: 506154 - protein, 22 aa, Mycobacterium
IDEDDDPGAQEQNAKAPETAEG

SEQ ID NO: 506155 - protein, 6 aa, Mycobacterium
IDEDEL

SEQ ID NO: 506156 - protein, 5 aa, Mycobacterium
IDEDG

SEQ ID NO: 506157 - protein, 6 aa, Mycobacterium
IDEDGN

SEQ ID NO: 506158 - protein, 131 aa, Mycobacterium
IDEDNGTDDEAADDSDDDDEHEQIDRPSGRRRRRGRRGRGRGRGEQGGSDGPGEDDGDEADRKANGDSARSDDSESDDAADSDDTDTDAGDDDNGSAEGASRRRRRRRRRKSGSGEDGDEGPAPDDPPNTV

SEQ ID NO: 506159 - protein, 4 aa, Mycobacterium
IDEE

SEQ ID NO: 506160 - protein, 7 aa, Mycobacterium
IDEESAA

SEQ ID NO: 506161 - protein, 8 aa, Mycobacterium
IDEESAAR

SEQ ID NO: 506162 - protein, 4 aa, Mycobacterium
IDEG

SEQ ID NO: 506163 - protein, 7 aa, Mycobacterium
IDEGAAP

SEQ ID NO: 506164 - protein, 20 aa, Mycobacterium
IDEGAKPGKSTGESAELREA

SEQ ID NO: 506165 - protein, 17 aa, Mycobacterium
IDEGAKPGKTTSDSAEL

SEQ ID NO: 506166 - protein, 9 aa, Mycobacterium
IDEGDIEIG

SEQ ID NO: 506167 - protein, 7 aa, Mycobacterium
IDEGGGA

SEQ ID NO: 506168 - protein, 5 aa, Mycobacterium
IDEGR

SEQ ID NO: 506169 - protein, 11 aa, Mycobacterium
IDEGSDDAPEL

SEQ ID NO: 506170 - protein, 11 aa, Mycobacterium
IDEGSIPGPRI

SEQ ID NO: 506171 - protein, 10 aa, Mycobacterium
IDENADPKVQ

SEQ ID NO: 506172 - protein, 22 aa, Mycobacterium
IDENDEPEKEEPSAKPSETAEG

SEQ ID NO: 506173 - protein, 23 aa, Mycobacterium
IDENDKPSGGKENEGRQAGPPPI

SEQ ID NO: 506174 - protein, 32 aa, Mycobacterium
IDENDTADGKADGKAKKAKKTSESDQQGPPPV

SEQ ID NO: 506175 - protein, 25 aa, Mycobacterium
IDENGAEVTGAGDVTPADPAGDGNA

SEQ ID NO: 506176 - protein, 6 aa, Mycobacterium
IDENSA

SEQ ID NO: 506177 - protein, 6 aa, Mycobacterium
IDENTW

SEQ ID NO: 506178 - protein, 10 aa, Mycobacterium
IDEPASAALA

SEQ ID NO: 506179 - protein, 13 aa, Mycobacterium
IDEPDEMSPYAPR

SEQ ID NO: 506180 - protein, 13 aa, Mycobacterium
IDEPDGTRRPLSR

SEQ ID NO: 506181 - protein, 12 aa, Mycobacterium
IDEPDGTRRRLS

SEQ ID NO: 506182 - protein, 6 aa, Mycobacterium
IDEPDY

SEQ ID NO: 506183 - protein, 10 aa, Mycobacterium
IDEPGPDGSI

SEQ ID NO: 506184 - protein, 8 aa, Mycobacterium
IDEPPHEP

SEQ ID NO: 506185 - protein, 9 aa, Mycobacterium
IDEPRPINS

SEQ ID NO: 506186 - protein, 8 aa, Mycobacterium
IDEQDADA

SEQ ID NO: 506187 - protein, 5 aa, Mycobacterium
IDEQG

SEQ ID NO: 506188 - protein, 8 aa, Mycobacterium
IDEQPDAT

SEQ ID NO: 506189 - protein, 9 aa, Mycobacterium
IDEQPEAAA

SEQ ID NO: 506190 - protein, 6 aa, Mycobacterium
IDERGS

SEQ ID NO: 506191 - protein, 6 aa, Mycobacterium
IDERNS

SEQ ID NO: 506192 - protein, 8 aa, Mycobacterium
IDERRNEG

SEQ ID NO: 506193 - protein, 22 aa, Mycobacterium
IDESDEPDKEPAGTKPAETAEG

SEQ ID NO: 506194 - protein, 20 aa, Mycobacterium
IDESDESDNAENGARPSATA

SEQ ID NO: 506195 - protein, 9 aa, Mycobacterium
IDESDQGKI

SEQ ID NO: 506196 - protein, 6 aa, Mycobacterium
IDESEQ

SEQ ID NO: 506197 - protein, 13 aa, Mycobacterium
IDESGKLTRKGAD

SEQ ID NO: 506198 - protein, 9 aa, Mycobacterium
IDESPPGDY

SEQ ID NO: 506199 - protein, 25 aa, Mycobacterium
IDESTAASKDRPTADYPTANYPTAN

SEQ ID NO: 506200 - protein, 13 aa, Mycobacterium
IDESTAKSSGDRL

SEQ ID NO: 506201 - protein, 18 aa, Mycobacterium
IDETAAASSGDKDVAGAN

SEQ ID NO: 506202 - protein, 6 aa, Mycobacterium
IDETDT

SEQ ID NO: 506203 - protein, 9 aa, Mycobacterium
IDETEELDR

SEQ ID NO: 506204 - protein, 10 aa, Mycobacterium
IDETERRRAK

SEQ ID NO: 506205 - protein, 13 aa, Mycobacterium
IDETGGDQPIPEL

SEQ ID NO: 506206 - protein, 6 aa, Mycobacterium
IDETRT

SEQ ID NO: 506207 - protein, 24 aa, Mycobacterium
IDETTGADADSSAPNYNVAPTSTI

SEQ ID NO: 506208 - protein, 4 aa, Mycobacterium
IDEV

SEQ ID NO: 506209 - protein, 5 aa, Mycobacterium
IDEVG

SEQ ID NO: 506210 - protein, 5 aa, Mycobacterium
IDEYA

SEQ ID NO: 506211 - protein, 5 aa, Mycobacterium
IDEYD

SEQ ID NO: 506212 - protein, 5 aa, Mycobacterium
IDEYE

SEQ ID NO: 506213 - protein, 4 aa, Mycobacterium
IDGA

SEQ ID NO: 506214 - protein, 5 aa, Mycobacterium
IDGAA

SEQ ID NO: 506215 - protein, 9 aa, Mycobacterium
IDGAADRAS

SEQ ID NO: 506216 - protein, 8 aa, Mycobacterium
IDGADPAA

SEQ ID NO: 506217 - protein, 7 aa, Mycobacterium
IDGAQSY

SEQ ID NO: 506218 - protein, 6 aa, Mycobacterium
IDGASG

SEQ ID NO: 506219 - protein, 4 aa, Mycobacterium
IDGD

SEQ ID NO: 506220 - protein, 7 aa, Mycobacterium
IDGDGRD

SEQ ID NO: 506221 - protein, 6 aa, Mycobacterium
IDGDPK

SEQ ID NO: 506222 - protein, 6 aa, Mycobacterium
IDGDPR

SEQ ID NO: 506223 - protein, 12 aa, Mycobacterium
IDGEAERSRAAE

SEQ ID NO: 506224 - protein, 20 aa, Mycobacterium
IDGEEVPGAAAEGLSHEVGS

SEQ ID NO: 506225 - protein, 20 aa, Mycobacterium
IDGEEVPGATAQGLSHEVGS

SEQ ID NO: 506226 - protein, 7 aa, Mycobacterium
IDGEKLD

SEQ ID NO: 506227 - protein, 8 aa, Mycobacterium
IDGEKLSE

SEQ ID NO: 506228 - protein, 7 aa, Mycobacterium
IDGEPHT

SEQ ID NO: 506229 - protein, 8 aa, Mycobacterium
IDGEPLSD

SEQ ID NO: 506230 - protein, 5 aa, Mycobacterium
IDGER

SEQ ID NO: 506231 - protein, 7 aa, Mycobacterium
IDGETHQ

SEQ ID NO: 506232 - protein, 7 aa, Mycobacterium
IDGEYPD

SEQ ID NO: 506233 - protein, 8 aa, Mycobacterium
IDGGGHPI

SEQ ID NO: 506234 - protein, 11 aa, Mycobacterium
IDGGGPPPMPA

SEQ ID NO: 506235 - protein, 6 aa, Mycobacterium
IDGGPL

SEQ ID NO: 506236 - protein, 4 aa, Mycobacterium
IDGK

SEQ ID NO: 506237 - protein, 16 aa, Mycobacterium
IDGKETEISGSGNGPL

SEQ ID NO: 506238 - protein, 4 aa, Mycobacterium
IDGN

SEQ ID NO: 506239 - protein, 7 aa, Mycobacterium
IDGNDPL

SEQ ID NO: 506240 - protein, 11 aa, Mycobacterium
IDGNHGDLDRA

SEQ ID NO: 506241 - protein, 7 aa, Mycobacterium
IDGNQTQ

SEQ ID NO: 506242 - protein, 8 aa, Mycobacterium
IDGNTLDP

SEQ ID NO: 506243 - protein, 9 aa, Mycobacterium
IDGPAARDV

SEQ ID NO: 506244 - protein, 7 aa, Mycobacterium
IDGPDNT

SEQ ID NO: 506245 - protein, 22 aa, Mycobacterium
IDGPGLPPDSNIGSPDKPGRDS

SEQ ID NO: 506246 - protein, 8 aa, Mycobacterium
IDGPGNSV

SEQ ID NO: 506247 - protein, 9 aa, Mycobacterium
IDGPKDSQV

SEQ ID NO: 506248 - protein, 7 aa, Mycobacterium
IDGPLPD

SEQ ID NO: 506249 - protein, 7 aa, Mycobacterium
IDGPQSA

SEQ ID NO: 506250 - protein, 8 aa, Mycobacterium
IDGPRDEQ

SEQ ID NO: 506251 - protein, 8 aa, Mycobacterium
IDGPRPEQ

SEQ ID NO: 506252 - protein, 9 aa, Mycobacterium
IDGQAQRLT

SEQ ID NO: 506253 - protein, 9 aa, Mycobacterium
IDGQKLSDD

SEQ ID NO: 506254 - protein, 16 aa, Mycobacterium
IDGQPSSALPTPEPDD

SEQ ID NO: 506255 - protein, 4 aa, Mycobacterium
IDGR

SEQ ID NO: 506256 - protein, 10 aa, Mycobacterium
IDGRGDIDTD

SEQ ID NO: 506257 - protein, 7 aa, Mycobacterium
IDGRHPE

SEQ ID NO: 506258 - protein, 12 aa, Mycobacterium
IDGRPLRGDGAA

SEQ ID NO: 506259 - protein, 8 aa, Mycobacterium
IDGRPTDT

SEQ ID NO: 506260 - protein, 10 aa, Mycobacterium
IDGRRRQTAA

SEQ ID NO: 506261 - protein, 5 aa, Mycobacterium
IDGRS

SEQ ID NO: 506262 - protein, 6 aa, Mycobacterium
IDGRTN

SEQ ID NO: 506263 - protein, 6 aa, Mycobacterium
IDGSDT

SEQ ID NO: 506264 - protein, 14 aa, Mycobacterium
IDGSGKLTRKGADK

SEQ ID NO: 506265 - protein, 9 aa, Mycobacterium
IDGSLAPTL

SEQ ID NO: 506266 - protein, 9 aa, Mycobacterium
IDGSPLREV

SEQ ID NO: 506267 - protein, 10 aa, Mycobacterium
IDGSPLREVS

SEQ ID NO: 506268 - protein, 8 aa, Mycobacterium
IDGSSSAI

SEQ ID NO: 506269 - protein, 14 aa, Mycobacterium
IDGSSSAISETVPA

SEQ ID NO: 506270 - protein, 9 aa, Mycobacterium
IDGSSSAVD

SEQ ID NO: 506271 - protein, 9 aa, Mycobacterium
IDGSTSGST

SEQ ID NO: 506272 - protein, 12 aa, Mycobacterium
IDGTAQRDAGMT

SEQ ID NO: 506273 - protein, 14 aa, Mycobacterium
IDGTATNPNGGDGG

SEQ ID NO: 506274 - protein, 7 aa, Mycobacterium
IDGTLPE

SEQ ID NO: 506275 - protein, 8 aa, Mycobacterium
IDGTRIPG

SEQ ID NO: 506276 - protein, 8 aa, Mycobacterium
IDGTRTGL

SEQ ID NO: 506277 - protein, 9 aa, Mycobacterium
IDGTSSAVS

SEQ ID NO: 506278 - protein, 7 aa, Mycobacterium
IDGYEDK

SEQ ID NO: 506279 - protein, 7 aa, Mycobacterium
IDGYSDE

SEQ ID NO: 506280 - protein, 4 aa, Mycobacterium
IDHD

SEQ ID NO: 506281 - protein, 12 aa, Mycobacterium
IDHGGTASPGWS

SEQ ID NO: 506282 - protein, 9 aa, Mycobacterium
IDHKATAEQ

SEQ ID NO: 506283 - protein, 10 aa, Mycobacterium
IDHKGTPEQI

SEQ ID NO: 506284 - protein, 5 aa, Mycobacterium
IDHTT

SEQ ID NO: 506285 - protein, 5 aa, Mycobacterium
IDIPS

SEQ ID NO: 506286 - protein, 4 aa, Mycobacterium
IDKA

SEQ ID NO: 506287 - protein, 10 aa, Mycobacterium
IDKPGKGAFY

SEQ ID NO: 506288 - protein, 7 aa, Mycobacterium
IDKSTDK

SEQ ID NO: 506289 - protein, 9 aa, Mycobacterium
IDKSTDKTL

SEQ ID NO: 506290 - protein, 6 aa, Mycobacterium
IDKTVA

SEQ ID NO: 506291 - protein, 5 aa, Mycobacterium
IDKVG

SEQ ID NO: 506292 - protein, 10 aa, Mycobacterium
IDLSDNEAAR

SEQ ID NO: 506293 - protein, 9 aa, Mycobacterium
IDNAAGVDC

SEQ ID NO: 506294 - protein, 9 aa, Mycobacterium
IDNEASDKA

SEQ ID NO: 506295 - protein, 10 aa, Mycobacterium
IDNEASDKAA

SEQ ID NO: 506296 - protein, 15 aa, Mycobacterium
IDNENNGAIETRYSS

SEQ ID NO: 506297 - protein, 6 aa, Mycobacterium
IDNGEK

SEQ ID NO: 506298 - protein, 7 aa, Mycobacterium
IDNGGTA

SEQ ID NO: 506299 - protein, 6 aa, Mycobacterium
IDNGQF

SEQ ID NO: 506300 - protein, 6 aa, Mycobacterium
IDNGRA

SEQ ID NO: 506301 - protein, 6 aa, Mycobacterium
IDNGRE

SEQ ID NO: 506302 - protein, 8 aa, Mycobacterium
IDNGSFGT

SEQ ID NO: 506303 - protein, 16 aa, Mycobacterium
IDNPNAGGSCACGDSF

SEQ ID NO: 506304 - protein, 16 aa, Mycobacterium
IDNPNATGSCACGDSF

SEQ ID NO: 506305 - protein, 6 aa, Mycobacterium
IDNPTE

SEQ ID NO: 506306 - protein, 6 aa, Mycobacterium
IDNPTV

SEQ ID NO: 506307 - protein, 4 aa, Mycobacterium
IDNR

SEQ ID NO: 506308 - protein, 4 aa, Mycobacterium
IDNS

SEQ ID NO: 506309 - protein, 17 aa, Mycobacterium
IDNSPGGTAIDMTFRLP

SEQ ID NO: 506310 - protein, 19 aa, Mycobacterium
IDNSPGGTAIDMTFRLPSE

SEQ ID NO: 506311 - protein, 9 aa, Mycobacterium
IDNTTGKET

SEQ ID NO: 506312 - protein, 9 aa, Mycobacterium
IDPAANEDV

SEQ ID NO: 506313 - protein, 17 aa, Mycobacterium
IDPADAPAVGDCASTAQ

SEQ ID NO: 506314 - protein, 8 aa, Mycobacterium
IDPADEQA

SEQ ID NO: 506315 - protein, 13 aa, Mycobacterium
IDPADPRSGRGEG

SEQ ID NO: 506316 - protein, 5 aa, Mycobacterium
IDPAE

SEQ ID NO: 506317 - protein, 9 aa, Mycobacterium
IDPAGGTEF

SEQ ID NO: 506318 - protein, 10 aa, Mycobacterium
IDPAHTRSKL

SEQ ID NO: 506319 - protein, 9 aa, Mycobacterium
IDPAHTRSR

SEQ ID NO: 506320 - protein, 8 aa, Mycobacterium
IDPAREPI

SEQ ID NO: 506321 - protein, 7 aa, Mycobacterium
IDPASDV

SEQ ID NO: 506322 - protein, 11 aa, Mycobacterium
IDPATGAPVPG

SEQ ID NO: 506323 - protein, 7 aa, Mycobacterium
IDPATGH

SEQ ID NO: 506324 - protein, 17 aa, Mycobacterium
IDPATGQATKLAGPGWT

SEQ ID NO: 506325 - protein, 7 aa, Mycobacterium
IDPATGR

SEQ ID NO: 506326 - protein, 42 aa, Mycobacterium
IDPATGRSLGPVARGGFDESDRAVNAARAASAPWRDTSPEER

SEQ ID NO: 506327 - protein, 7 aa, Mycobacterium
IDPATGV

SEQ ID NO: 506328 - protein, 8 aa, Mycobacterium
IDPATTED

SEQ ID NO: 506329 - protein, 6 aa, Mycobacterium
IDPDAP

SEQ ID NO: 506330 - protein, 9 aa, Mycobacterium
IDPDGAPQQ

SEQ ID NO: 506331 - protein, 9 aa, Mycobacterium
IDPDGPLAE

SEQ ID NO: 506332 - protein, 10 aa, Mycobacterium
IDPDGPWDVD

SEQ ID NO: 506333 - protein, 7 aa, Mycobacterium
IDPDHSA

SEQ ID NO: 506334 - protein, 10 aa, Mycobacterium
IDPDLTNAGK

SEQ ID NO: 506335 - protein, 7 aa, Mycobacterium
IDPDNPA

SEQ ID NO: 506336 - protein, 16 aa, Mycobacterium
IDPDPRRRFTSAEEMS

SEQ ID NO: 506337 - protein, 15 aa, Mycobacterium
IDPDPSARFGSAEEM

SEQ ID NO: 506338 - protein, 10 aa, Mycobacterium
IDPDQAAEAY

SEQ ID NO: 506339 - protein, 5 aa, Mycobacterium
IDPDR

SEQ ID NO: 506340 - protein, 10 aa, Mycobacterium
IDPDRSLPDY

SEQ ID NO: 506341 - protein, 7 aa, Mycobacterium
IDPDSAG

SEQ ID NO: 506342 - protein, 6 aa, Mycobacterium
IDPDSL

SEQ ID NO: 506343 - protein, 8 aa, Mycobacterium
IDPDSPVA

SEQ ID NO: 506344 - protein, 16 aa, Mycobacterium
IDPDSSTDLPYPPAAI

SEQ ID NO: 506345 - protein, 8 aa, Mycobacterium
IDPEALGS

SEQ ID NO: 506346 - protein, 8 aa, Mycobacterium
IDPEETGE

SEQ ID NO: 506347 - protein, 15 aa, Mycobacterium
IDPEGYPRISADDAN

SEQ ID NO: 506348 - protein, 8 aa, Mycobacterium
IDPEHGPS

SEQ ID NO: 506349 - protein, 6 aa, Mycobacterium
IDPEHP

SEQ ID NO: 506350 - protein, 7 aa, Mycobacterium
IDPEKTP

SEQ ID NO: 506351 - protein, 8 aa, Mycobacterium
IDPEKTPL

SEQ ID NO: 506352 - protein, 6 aa, Mycobacterium
IDPEPD

SEQ ID NO: 506353 - protein, 7 aa, Mycobacterium
IDPEQMP

SEQ ID NO: 506354 - protein, 8 aa, Mycobacterium
IDPERNAR

SEQ ID NO: 506355 - protein, 9 aa, Mycobacterium
IDPESGGVG

SEQ ID NO: 506356 - protein, 5 aa, Mycobacterium
IDPET

SEQ ID NO: 506357 - protein, 6 aa, Mycobacterium
IDPETA

SEQ ID NO: 506358 - protein, 6 aa, Mycobacterium
IDPETL

SEQ ID NO: 506359 - protein, 6 aa, Mycobacterium
IDPETP

SEQ ID NO: 506360 - protein, 6 aa, Mycobacterium
IDPETV

SEQ ID NO: 506361 - protein, 6 aa, Mycobacterium
IDPEVG

SEQ ID NO: 506362 - protein, 4 aa, Mycobacterium
IDPG

SEQ ID NO: 506363 - protein, 7 aa, Mycobacterium
IDPGATS

SEQ ID NO: 506364 - protein, 7 aa, Mycobacterium
IDPGDVD

SEQ ID NO: 506365 - protein, 7 aa, Mycobacterium
IDPGGAQ

SEQ ID NO: 506366 - protein, 7 aa, Mycobacterium
IDPGNEP

SEQ ID NO: 506367 - protein, 7 aa, Mycobacterium
IDPGNPA

SEQ ID NO: 506368 - protein, 7 aa, Mycobacterium
IDPGPAL

SEQ ID NO: 506369 - protein, 7 aa, Mycobacterium
IDPGPTL

SEQ ID NO: 506370 - protein, 8 aa, Mycobacterium
IDPGPTLR

SEQ ID NO: 506371 - protein, 6 aa, Mycobacterium
IDPGQR

SEQ ID NO: 506372 - protein, 6 aa, Mycobacterium
IDPGRE

SEQ ID NO: 506373 - protein, 7 aa, Mycobacterium
IDPGTGV

SEQ ID NO: 506374 - protein, 6 aa, Mycobacterium
IDPGWA

SEQ ID NO: 506375 - protein, 4 aa, Mycobacterium
IDPH

SEQ ID NO: 506376 - protein, 12 aa, Mycobacterium
IDPHSLRGSQTG

SEQ ID NO: 506377 - protein, 6 aa, Mycobacterium
IDPHTE

SEQ ID NO: 506378 - protein, 14 aa, Mycobacterium
IDPHTGRTIIEMIE

SEQ ID NO: 506379 - protein, 6 aa, Mycobacterium
IDPLGT

SEQ ID NO: 506380 - protein, 9 aa, Mycobacterium
IDPNAGPLA

SEQ ID NO: 506381 - protein, 14 aa, Mycobacterium
IDPNPRRDGPAGGY

SEQ ID NO: 506382 - protein, 4 aa, Mycobacterium
IDPP

SEQ ID NO: 506383 - protein, 12 aa, Mycobacterium
IDPPAQAKPPEQ

SEQ ID NO: 506384 - protein, 23 aa, Mycobacterium
IDPPAVPGDIGRTPKGTATTQAA

SEQ ID NO: 506385 - protein, 8 aa, Mycobacterium
IDPPDLPG

SEQ ID NO: 506386 - protein, 11 aa, Mycobacterium
IDPPPPAQPQG

SEQ ID NO: 506387 - protein, 5 aa, Mycobacterium
IDPPR

SEQ ID NO: 506388 - protein, 8 aa, Mycobacterium
IDPPWETR

SEQ ID NO: 506389 - protein, 11 aa, Mycobacterium
IDPPWETRSDY

SEQ ID NO: 506390 - protein, 7 aa, Mycobacterium
IDPQGSA

SEQ ID NO: 506391 - protein, 7 aa, Mycobacterium
IDPQPQG

SEQ ID NO: 506392 - protein, 7 aa, Mycobacterium
IDPQQGS

SEQ ID NO: 506393 - protein, 7 aa, Mycobacterium
IDPQTTP

SEQ ID NO: 506394 - protein, 5 aa, Mycobacterium
IDPRA

SEQ ID NO: 506395 - protein, 11 aa, Mycobacterium
IDPRALAGSQT

SEQ ID NO: 506396 - protein, 6 aa, Mycobacterium
IDPRNS

SEQ ID NO: 506397 - protein, 6 aa, Mycobacterium
IDPRPI

SEQ ID NO: 506398 - protein, 6 aa, Mycobacterium
IDPRRP

SEQ ID NO: 506399 - protein, 15 aa, Mycobacterium
IDPRRVDGGRRRRSI

SEQ ID NO: 506400 - protein, 9 aa, Mycobacterium
IDPRSTSLR

SEQ ID NO: 506401 - protein, 6 aa, Mycobacterium
IDPRTS

SEQ ID NO: 506402 - protein, 5 aa, Mycobacterium
IDPRV

SEQ ID NO: 506403 - protein, 4 aa, Mycobacterium
IDPS

SEQ ID NO: 506404 - protein, 9 aa, Mycobacterium
IDPSADSTT

SEQ ID NO: 506405 - protein, 9 aa, Mycobacterium
IDPSANEDV

SEQ ID NO: 506406 - protein, 10 aa, Mycobacterium
IDPSHTRSKL

SEQ ID NO: 506407 - protein, 6 aa, Mycobacterium
IDPSQS

SEQ ID NO: 506408 - protein, 10 aa, Mycobacterium
IDPSRRGETL

SEQ ID NO: 506409 - protein, 9 aa, Mycobacterium
IDPSSPDAR

SEQ ID NO: 506410 - protein, 13 aa, Mycobacterium
IDPSTGACEEDGC

SEQ ID NO: 506411 - protein, 5 aa, Mycobacterium
IDPTA

SEQ ID NO: 506412 - protein, 10 aa, Mycobacterium
IDPTDATRGL

SEQ ID NO: 506413 - protein, 9 aa, Mycobacterium
IDPTDGCGA

SEQ ID NO: 506414 - protein, 9 aa, Mycobacterium
IDPTDTDVT

SEQ ID NO: 506415 - protein, 7 aa, Mycobacterium
IDPTMPS

SEQ ID NO: 506416 - protein, 6 aa, Mycobacterium
IDPTPG

SEQ ID NO: 506417 - protein, 9 aa, Mycobacterium
IDPTSETAQ

SEQ ID NO: 506418 - protein, 13 aa, Mycobacterium
IDPTTGKAAADEL

SEQ ID NO: 506419 - protein, 11 aa, Mycobacterium
IDPTTLEGSDT

SEQ ID NO: 506420 - protein, 9 aa, Mycobacterium
IDQADRDNV

SEQ ID NO: 506421 - protein, 27 aa, Mycobacterium
IDQAEEELAERATPTTIPRRPRSSDDV

SEQ ID NO: 506422 - protein, 37 aa, Mycobacterium
IDQAEEELAERSTPTTMPRRQRSSDDVGVSVPGAPGV

SEQ ID NO: 506423 - protein, 10 aa, Mycobacterium
IDQAERDNAG

SEQ ID NO: 506424 - protein, 19 aa, Mycobacterium
IDQARTTSQTASRATKNAF

SEQ ID NO: 506425 - protein, 15 aa, Mycobacterium
IDQKSTNRNPRSTVG

SEQ ID NO: 506426 - protein, 8 aa, Mycobacterium
IDQPDAAE

SEQ ID NO: 506427 - protein, 6 aa, Mycobacterium
IDQPEQ

SEQ ID NO: 506428 - protein, 7 aa, Mycobacterium
IDQPGKQ

SEQ ID NO: 506429 - protein, 18 aa, Mycobacterium
IDQPPTAQPYPPAPPQDY

SEQ ID NO: 506430 - protein, 6 aa, Mycobacterium
IDQPQQ

SEQ ID NO: 506431 - protein, 5 aa, Mycobacterium
IDQRD

SEQ ID NO: 506432 - protein, 5 aa, Mycobacterium
IDQRR

SEQ ID NO: 506433 - protein, 6 aa, Mycobacterium
IDQWQD

SEQ ID NO: 506434 - protein, 10 aa, Mycobacterium
IDRADADNAG

SEQ ID NO: 506435 - protein, 8 aa, Mycobacterium
IDRADADP

SEQ ID NO: 506436 - protein, 10 aa, Mycobacterium
IDRAKSAGVT

SEQ ID NO: 506437 - protein, 17 aa, Mycobacterium
IDRATKSVVTADGQRHS

SEQ ID NO: 506438 - protein, 8 aa, Mycobacterium
IDRATSGA

SEQ ID NO: 506439 - protein, 36 aa, Mycobacterium
IDRDGNSSTVTESRLPGFGGAPNMGHDPHGRRHASP

SEQ ID NO: 506440 - protein, 9 aa, Mycobacterium
IDRDPSTLE

SEQ ID NO: 506441 - protein, 4 aa, Mycobacterium
IDRE

SEQ ID NO: 506442 - protein, 23 aa, Mycobacterium
IDREAADSYAARSHQRAAAAQRA

SEQ ID NO: 506443 - protein, 21 aa, Mycobacterium
IDREERKGKGASDHAPVVVDL

SEQ ID NO: 506444 - protein, 8 aa, Mycobacterium
IDRGGTQQ

SEQ ID NO: 506445 - protein, 6 aa, Mycobacterium
IDRGTW

SEQ ID NO: 506446 - protein, 4 aa, Mycobacterium
IDRN

SEQ ID NO: 506447 - protein, 11 aa, Mycobacterium
IDRNTLDDDHR

SEQ ID NO: 506448 - protein, 6 aa, Mycobacterium
IDRPDA

SEQ ID NO: 506449 - protein, 5 aa, Mycobacterium
IDRPG

SEQ ID NO: 506450 - protein, 6 aa, Mycobacterium
IDRPGT

SEQ ID NO: 506451 - protein, 5 aa, Mycobacterium
IDRPR

SEQ ID NO: 506452 - protein, 4 aa, Mycobacterium
IDRR

SEQ ID NO: 506453 - protein, 6 aa, Mycobacterium
IDRRQQ

SEQ ID NO: 506454 - protein, 4 aa, Mycobacterium
IDRS

SEQ ID NO: 506455 - protein, 8 aa, Mycobacterium
IDRSDDPL

SEQ ID NO: 506456 - protein, 14 aa, Mycobacterium
IDRSDEGQADYSGP

SEQ ID NO: 506457 - protein, 11 aa, Mycobacterium
IDRSDSEWDRE

SEQ ID NO: 506458 - protein, 7 aa, Mycobacterium
IDRSGAQ

SEQ ID NO: 506459 - protein, 8 aa, Mycobacterium
IDRSGAQQ

SEQ ID NO: 506460 - protein, 11 aa, Mycobacterium
IDRSPYGNGLG

SEQ ID NO: 506461 - protein, 14 aa, Mycobacterium
IDRTGREPLSPADL

SEQ ID NO: 506462 - protein, 9 aa, Mycobacterium
IDRTPRGTR

SEQ ID NO: 506463 - protein, 6 aa, Mycobacterium
IDRTRR

SEQ ID NO: 506464 - protein, 10 aa, Mycobacterium
IDSAAAETGS

SEQ ID NO: 506465 - protein, 6 aa, Mycobacterium
IDSAAK

SEQ ID NO: 506466 - protein, 9 aa, Mycobacterium
IDSAGTDNA

SEQ ID NO: 506467 - protein, 12 aa, Mycobacterium
IDSANETAAVPT

SEQ ID NO: 506468 - protein, 9 aa, Mycobacterium
IDSAQGLTA

SEQ ID NO: 506469 - protein, 17 aa, Mycobacterium
IDSAQGLTSGSRDTRGT

SEQ ID NO: 506470 - protein, 8 aa, Mycobacterium
IDSARGDA

SEQ ID NO: 506471 - protein, 14 aa, Mycobacterium
IDSARSAPDGSAGD

SEQ ID NO: 506472 - protein, 13 aa, Mycobacterium
IDSDPINNYYIAR

SEQ ID NO: 506473 - protein, 5 aa, Mycobacterium
IDSDR

SEQ ID NO: 506474 - protein, 5 aa, Mycobacterium
IDSDT

SEQ ID NO: 506475 - protein, 8 aa, Mycobacterium
IDSDTAAG

SEQ ID NO: 506476 - protein, 10 aa, Mycobacterium
IDSEDGDLGD

SEQ ID NO: 506477 - protein, 16 aa, Mycobacterium
IDSEGRNTETRSDIDS

SEQ ID NO: 506478 - protein, 8 aa, Mycobacterium
IDSEPADR

SEQ ID NO: 506479 - protein, 10 aa, Mycobacterium
IDSEPGRGTT

SEQ ID NO: 506480 - protein, 9 aa, Mycobacterium
IDSEPGSSV

SEQ ID NO: 506481 - protein, 7 aa, Mycobacterium
IDSEPQR

SEQ ID NO: 506482 - protein, 6 aa, Mycobacterium
IDSEPS

SEQ ID NO: 506483 - protein, 15 aa, Mycobacterium
IDSETENDDEHGSAL

SEQ ID NO: 506484 - protein, 11 aa, Mycobacterium
IDSETLDDEHR

SEQ ID NO: 506485 - protein, 19 aa, Mycobacterium
IDSETTAAAQQVDEATGPM

SEQ ID NO: 506486 - protein, 4 aa, Mycobacterium
IDSF

SEQ ID NO: 506487 - protein, 4 aa, Mycobacterium
IDSG

SEQ ID NO: 506488 - protein, 5 aa, Mycobacterium
IDSGA

SEQ ID NO: 506489 - protein, 6 aa, Mycobacterium
IDSGAR

SEQ ID NO: 506490 - protein, 9 aa, Mycobacterium
IDSGDAELS

SEQ ID NO: 506491 - protein, 5 aa, Mycobacterium
IDSGG

SEQ ID NO: 506492 - protein, 13 aa, Mycobacterium
IDSGGGGDEEAPA

SEQ ID NO: 506493 - protein, 14 aa, Mycobacterium
IDSGGGGEEEEARA

SEQ ID NO: 506494 - protein, 15 aa, Mycobacterium
IDSGGGNEDDDARAI

SEQ ID NO: 506495 - protein, 15 aa, Mycobacterium
IDSGGGSDEDEARAI

SEQ ID NO: 506496 - protein, 17 aa, Mycobacterium
IDSGGGSGNEDAPAIAD

SEQ ID NO: 506497 - protein, 19 aa, Mycobacterium
IDSGQTPHSGDADHPDATA

SEQ ID NO: 506498 - protein, 5 aa, Mycobacterium
IDSGR

SEQ ID NO: 506499 - protein, 9 aa, Mycobacterium
IDSGSAPLA

SEQ ID NO: 506500 - protein, 15 aa, Mycobacterium
IDSGSGSEDDDARAI

SEQ ID NO: 506501 - protein, 9 aa, Mycobacterium
IDSGTEVLE

SEQ ID NO: 506502 - protein, 6 aa, Mycobacterium
IDSGYG

SEQ ID NO: 506503 - protein, 8 aa, Mycobacterium
IDSNRSRE

SEQ ID NO: 506504 - protein, 8 aa, Mycobacterium
IDSPEGDL

SEQ ID NO: 506505 - protein, 10 aa, Mycobacterium
IDSPGSQKAK

SEQ ID NO: 506506 - protein, 9 aa, Mycobacterium
IDSPQSQAA

SEQ ID NO: 506507 - protein, 4 aa, Mycobacterium
IDSQ

SEQ ID NO: 506508 - protein, 6 aa, Mycobacterium
IDSRPV

SEQ ID NO: 506509 - protein, 7 aa, Mycobacterium
IDSSEED

SEQ ID NO: 506510 - protein, 7 aa, Mycobacterium
IDSSGDM

SEQ ID NO: 506511 - protein, 5 aa, Mycobacterium
IDTAA

SEQ ID NO: 506512 - protein, 9 aa, Mycobacterium
IDTADGPLE

SEQ ID NO: 506513 - protein, 23 aa, Mycobacterium
IDTAKGSMAGPVEEYADQAANAS

SEQ ID NO: 506514 - protein, 6 aa, Mycobacterium
IDTARA

SEQ ID NO: 506515 - protein, 10 aa, Mycobacterium
IDTATPTGRA

SEQ ID NO: 506516 - protein, 10 aa, Mycobacterium
IDTATSTGRA

SEQ ID NO: 506517 - protein, 8 aa, Mycobacterium
IDTDRGGK

SEQ ID NO: 506518 - protein, 5 aa, Mycobacterium
IDTDS

SEQ ID NO: 506519 - protein, 9 aa, Mycobacterium
IDTEDGSLR

SEQ ID NO: 506520 - protein, 7 aa, Mycobacterium
IDTEETA

SEQ ID NO: 506521 - protein, 17 aa, Mycobacterium
IDTEGRATEARSDLDSA

SEQ ID NO: 506522 - protein, 17 aa, Mycobacterium
IDTEGRSTEARSDLDSA

SEQ ID NO: 506523 - protein, 8 aa, Mycobacterium
IDTEPDGG

SEQ ID NO: 506524 - protein, 8 aa, Mycobacterium
IDTEPDGS

SEQ ID NO: 506525 - protein, 5 aa, Mycobacterium
IDTES

SEQ ID NO: 506526 - protein, 21 aa, Mycobacterium
IDTETGDEIEIPAEGESAPGE

SEQ ID NO: 506527 - protein, 29 aa, Mycobacterium
IDTGAHAGHYPPVPAPTGLRSAPATSEQQ

SEQ ID NO: 506528 - protein, 8 aa, Mycobacterium
IDTGDAPL

SEQ ID NO: 506529 - protein, 5 aa, Mycobacterium
IDTGE

SEQ ID NO: 506530 - protein, 9 aa, Mycobacterium
IDTGGEDPV

SEQ ID NO: 506531 - protein, 12 aa, Mycobacterium
IDTGNQPDHQTT

SEQ ID NO: 506532 - protein, 4 aa, Mycobacterium
IDTP

SEQ ID NO: 506533 - protein, 11 aa, Mycobacterium
IDTPDQVPAPV

SEQ ID NO: 506534 - protein, 6 aa, Mycobacterium
IDTPEA

SEQ ID NO: 506535 - protein, 9 aa, Mycobacterium
IDTPGDGQI

SEQ ID NO: 506536 - protein, 11 aa, Mycobacterium
IDTPGPKFQSE

SEQ ID NO: 506537 - protein, 5 aa, Mycobacterium
IDTPL

SEQ ID NO: 506538 - protein, 14 aa, Mycobacterium
IDTPRDDPGLLTTI

SEQ ID NO: 506539 - protein, 8 aa, Mycobacterium
IDTPTAEL

SEQ ID NO: 506540 - protein, 7 aa, Mycobacterium
IDTPTGE

SEQ ID NO: 506541 - protein, 8 aa, Mycobacterium
IDTPWTPD

SEQ ID NO: 506542 - protein, 5 aa, Mycobacterium
IDTQA

SEQ ID NO: 506543 - protein, 7 aa, Mycobacterium
IDTQPTD

SEQ ID NO: 506544 - protein, 10 aa, Mycobacterium
IDTSAYPPMD

SEQ ID NO: 506545 - protein, 5 aa, Mycobacterium
IDTSR

SEQ ID NO: 506546 - protein, 10 aa, Mycobacterium
IDTSRSPDLV

SEQ ID NO: 506547 - protein, 14 aa, Mycobacterium
IDTSRWPAGPGGED

SEQ ID NO: 506548 - protein, 20 aa, Mycobacterium
IDTSSAGVSVRTDDGETYRG

SEQ ID NO: 506549 - protein, 11 aa, Mycobacterium
IDTSSSDVSAV

SEQ ID NO: 506550 - protein, 8 aa, Mycobacterium
IDTSTPVK

SEQ ID NO: 506551 - protein, 8 aa, Mycobacterium
IDTTAAAA

SEQ ID NO: 506552 - protein, 14 aa, Mycobacterium
IDTTDYDESAAEDP

SEQ ID NO: 506553 - protein, 12 aa, Mycobacterium
IDTTQPDGRATQ

SEQ ID NO: 506554 - protein, 6 aa, Mycobacterium
IDTVPT

SEQ ID NO: 506555 - protein, 6 aa, Mycobacterium
IDTYET

SEQ ID NO: 506556 - protein, 7 aa, Mycobacterium
IDVPTHD

SEQ ID NO: 506557 - protein, 13 aa, Mycobacterium
IDYDSADASFQPS

SEQ ID NO: 506558 - protein, 11 aa, Mycobacterium
IDYESAEAGFQ

SEQ ID NO: 506559 - protein, 13 aa, Mycobacterium
IDYESAEAGFQPS

SEQ ID NO: 506560 - protein, 7 aa, Mycobacterium
IDYGPSG

SEQ ID NO: 506561 - protein, 9 aa, Mycobacterium
IDYPPDGAP

SEQ ID NO: 506562 - protein, 4 aa, Mycobacterium
IEAA

SEQ ID NO: 506563 - protein, 7 aa, Mycobacterium
IEAADDG

SEQ ID NO: 506564 - protein, 21 aa, Mycobacterium
IEAAQQTFETAESVADEPGVD

SEQ ID NO: 506565 - protein, 11 aa, Mycobacterium
IEAARQRGDVA

SEQ ID NO: 506566 - protein, 13 aa, Mycobacterium
IEAASREAESAFG

SEQ ID NO: 506567 - protein, 20 aa, Mycobacterium
IEAATATLRDGVPDAQLAQE

SEQ ID NO: 506568 - protein, 5 aa, Mycobacterium
IEADE

SEQ ID NO: 506569 - protein, 11 aa, Mycobacterium
IEADPGGAHSI

SEQ ID NO: 506570 - protein, 9 aa, Mycobacterium
IEADSDRDR

SEQ ID NO: 506571 - protein, 6 aa, Mycobacterium
IEADSE

SEQ ID NO: 506572 - protein, 9 aa, Mycobacterium
IEAEERTRR

SEQ ID NO: 506573 - protein, 13 aa, Mycobacterium
IEAEPADGAGEQV

SEQ ID NO: 506574 - protein, 12 aa, Mycobacterium
IEAEPGGSHSVD

SEQ ID NO: 506575 - protein, 11 aa, Mycobacterium
IEAEPGSEHSI

SEQ ID NO: 506576 - protein, 13 aa, Mycobacterium
IEAEPTEGAGEQV

SEQ ID NO: 506577 - protein, 9 aa, Mycobacterium
IEAETGRTA

SEQ ID NO: 506578 - protein, 4 aa, Mycobacterium
IEAG

SEQ ID NO: 506579 - protein, 11 aa, Mycobacterium
IEAGADLDEAE

SEQ ID NO: 506580 - protein, 5 aa, Mycobacterium
IEAGD

SEQ ID NO: 506581 - protein, 6 aa, Mycobacterium
IEAGDR

SEQ ID NO: 506582 - protein, 8 aa, Mycobacterium
IEAGDSDI

SEQ ID NO: 506583 - protein, 5 aa, Mycobacterium
IEAGE

SEQ ID NO: 506584 - protein, 12 aa, Mycobacterium
IEAGGNTEFDPR

SEQ ID NO: 506585 - protein, 6 aa, Mycobacterium
IEAGPV

SEQ ID NO: 506586 - protein, 5 aa, Mycobacterium
IEAGQ

SEQ ID NO: 506587 - protein, 16 aa, Mycobacterium
IEAGTRAALEITNALR

SEQ ID NO: 506588 - protein, 11 aa, Mycobacterium
IEAKRAAATEL

SEQ ID NO: 506589 - protein, 5 aa, Mycobacterium
IEANQ

SEQ ID NO: 506590 - protein, 9 aa, Mycobacterium
IEAPAGDPL

SEQ ID NO: 506591 - protein, 7 aa, Mycobacterium
IEAPDRA

SEQ ID NO: 506592 - protein, 16 aa, Mycobacterium
IEAREGHRAPETAEQE

SEQ ID NO: 506593 - protein, 19 aa, Mycobacterium
IEARTDPWDPDTEPSAEDF

SEQ ID NO: 506594 - protein, 18 aa, Mycobacterium
IEARTDPWDPETEPSADD

SEQ ID NO: 506595 - protein, 19 aa, Mycobacterium
IEARTDPWDPETEPSAEDF

SEQ ID NO: 506596 - protein, 4 aa, Mycobacterium
IEAS

SEQ ID NO: 506597 - protein, 8 aa, Mycobacterium
IEASGGKG

SEQ ID NO: 506598 - protein, 12 aa, Mycobacterium
IEATAAAAAAEL

SEQ ID NO: 506599 - protein, 12 aa, Mycobacterium
IEATASAVAGGL

SEQ ID NO: 506600 - protein, 7 aa, Mycobacterium
IEATEAE

SEQ ID NO: 506601 - protein, 10 aa, Mycobacterium
IEATGTQSKL

SEQ ID NO: 506602 - protein, 10 aa, Mycobacterium
IEATKKALAR

SEQ ID NO: 506603 - protein, 8 aa, Mycobacterium
IEATPRPR

SEQ ID NO: 506604 - protein, 11 aa, Mycobacterium
IEATSARGVRE

SEQ ID NO: 506605 - protein, 12 aa, Mycobacterium
IEATSGRGTRRI

SEQ ID NO: 506606 - protein, 6 aa, Mycobacterium
IEATTD

SEQ ID NO: 506607 - protein, 17 aa, Mycobacterium
IECSTGSACTAGVAQPS

SEQ ID NO: 506608 - protein, 15 aa, Mycobacterium
IECSTGSACTAGVAR

SEQ ID NO: 506609 - protein, 4 aa, Mycobacterium
IEDA

SEQ ID NO: 506610 - protein, 30 aa, Mycobacterium
IEDAETTETTEAPAAEAPEESTEEVDPAAA

SEQ ID NO: 506611 - protein, 10 aa, Mycobacterium
IEDAPGPESV

SEQ ID NO: 506612 - protein, 10 aa, Mycobacterium
IEDAQSSEAL

SEQ ID NO: 506613 - protein, 4 aa, Mycobacterium
IEDC

SEQ ID NO: 506614 - protein, 12 aa, Mycobacterium
IEDDADKAADAK

SEQ ID NO: 506615 - protein, 12 aa, Mycobacterium
IEDDEDKAADAE

SEQ ID NO: 506616 - protein, 5 aa, Mycobacterium
IEDEG

SEQ ID NO: 506617 - protein, 15 aa, Mycobacterium
IEDGGGPARKKLPSV

SEQ ID NO: 506618 - protein, 6 aa, Mycobacterium
IEDGQE

SEQ ID NO: 506619 - protein, 5 aa, Mycobacterium
IEDGR

SEQ ID NO: 506620 - protein, 11 aa, Mycobacterium
IEDNGSGQDAV

SEQ ID NO: 506621 - protein, 5 aa, Mycobacterium
IEDPE

SEQ ID NO: 506622 - protein, 8 aa, Mycobacterium
IEDPETAR

SEQ ID NO: 506623 - protein, 7 aa, Mycobacterium
IEDPGER

SEQ ID NO: 506624 - protein, 5 aa, Mycobacterium
IEDPT

SEQ ID NO: 506625 - protein, 9 aa, Mycobacterium
IEDQGSERV

SEQ ID NO: 506626 - protein, 16 aa, Mycobacterium
IEDQRDADLEARAQKL

SEQ ID NO: 506627 - protein, 9 aa, Mycobacterium
IEDQSSDRV

SEQ ID NO: 506628 - protein, 8 aa, Mycobacterium
IEDSDGDS

SEQ ID NO: 506629 - protein, 18 aa, Mycobacterium
IEDSEKPAAVAESIVRFI

SEQ ID NO: 506630 - protein, 9 aa, Mycobacterium
IEDSETREY

SEQ ID NO: 506631 - protein, 6 aa, Mycobacterium
IEDSRT

SEQ ID NO: 506632 - protein, 9 aa, Mycobacterium
IEDSSKEPE

SEQ ID NO: 506633 - protein, 8 aa, Mycobacterium
IEDVSDPS

SEQ ID NO: 506634 - protein, 11 aa, Mycobacterium
IEEAEREPTLP

SEQ ID NO: 506635 - protein, 9 aa, Mycobacterium
IEEAKRRDT

SEQ ID NO: 506636 - protein, 20 aa, Mycobacterium
IEEANERIPAGESFDTPTGH

SEQ ID NO: 506637 - protein, 10 aa, Mycobacterium
IEEDSKGRTS

SEQ ID NO: 506638 - protein, 12 aa, Mycobacterium
IEEGQQVKRTGE

SEQ ID NO: 506639 - protein, 7 aa, Mycobacterium
IEEGRPC

SEQ ID NO: 506640 - protein, 19 aa, Mycobacterium
IEEGSDEGESGVPVDPGEA

SEQ ID NO: 506641 - protein, 12 aa, Mycobacterium
IEEGTHHPVHLY

SEQ ID NO: 506642 - protein, 20 aa, Mycobacterium
IEEGTKPGKSASESGELREA

SEQ ID NO: 506643 - protein, 4 aa, Mycobacterium
IEEL

SEQ ID NO: 506644 - protein, 6 aa, Mycobacterium
IEENPS

SEQ ID NO: 506645 - protein, 7 aa, Mycobacterium
IEEPRPI

SEQ ID NO: 506646 - protein, 10 aa, Mycobacterium
IEEQGKLTDE

SEQ ID NO: 506647 - protein, 5 aa, Mycobacterium
IEEQP

SEQ ID NO: 506648 - protein, 4 aa, Mycobacterium
IEER

SEQ ID NO: 506649 - protein, 9 aa, Mycobacterium
IEERSRAQL

SEQ ID NO: 506650 - protein, 4 aa, Mycobacterium
IEES

SEQ ID NO: 506651 - protein, 6 aa, Mycobacterium
IEESGR

SEQ ID NO: 506652 - protein, 8 aa, Mycobacterium
IEESLPDT

SEQ ID NO: 506653 - protein, 10 aa, Mycobacterium
IEESRGERDA

SEQ ID NO: 506654 - protein, 5 aa, Mycobacterium
IEETI

SEQ ID NO: 506655 - protein, 6 aa, Mycobacterium
IEETLR

SEQ ID NO: 506656 - protein, 4 aa, Mycobacterium
IEEV

SEQ ID NO: 506657 - protein, 11 aa, Mycobacterium
IEFGSRNERPM

SEQ ID NO: 506658 - protein, 5 aa, Mycobacterium
IEGAA

SEQ ID NO: 506659 - protein, 12 aa, Mycobacterium
IEGAARDITADG

SEQ ID NO: 506660 - protein, 11 aa, Mycobacterium
IEGAEDAFDPA

SEQ ID NO: 506661 - protein, 10 aa, Mycobacterium
IEGAGSPTMT

SEQ ID NO: 506662 - protein, 11 aa, Mycobacterium
IEGAGTSTLTV

SEQ ID NO: 506663 - protein, 18 aa, Mycobacterium
IEGAPKPACVAESIVRYI

SEQ ID NO: 506664 - protein, 9 aa, Mycobacterium
IEGARRAGE

SEQ ID NO: 506665 - protein, 9 aa, Mycobacterium
IEGATSPEW

SEQ ID NO: 506666 - protein, 4 aa, Mycobacterium
IEGD

SEQ ID NO: 506667 - protein, 11 aa, Mycobacterium
IEGDATEMTPP

SEQ ID NO: 506668 - protein, 26 aa, Mycobacterium
IEGDKGEFTPAAKDQPESGVYSSPAE

SEQ ID NO: 506669 - protein, 8 aa, Mycobacterium
IEGDPAAA

SEQ ID NO: 506670 - protein, 11 aa, Mycobacterium
IEGDPDSPISR

SEQ ID NO: 506671 - protein, 10 aa, Mycobacterium
IEGDSADSRY

SEQ ID NO: 506672 - protein, 5 aa, Mycobacterium
IEGEP

SEQ ID NO: 506673 - protein, 7 aa, Mycobacterium
IEGEPEW

SEQ ID NO: 506674 - protein, 12 aa, Mycobacterium
IEGETDLSTGTV

SEQ ID NO: 506675 - protein, 5 aa, Mycobacterium
IEGGD

SEQ ID NO: 506676 - protein, 11 aa, Mycobacterium
IEGGGQTAVEP

SEQ ID NO: 506677 - protein, 18 aa, Mycobacterium
IEGGPDAPVVTDGPFAEA

SEQ ID NO: 506678 - protein, 6 aa, Mycobacterium
IEGGPP

SEQ ID NO: 506679 - protein, 19 aa, Mycobacterium
IEGGRRQTGVHGAGRQRTE

SEQ ID NO: 506680 - protein, 5 aa, Mycobacterium
IEGGS

SEQ ID NO: 506681 - protein, 4 aa, Mycobacterium
IEGH

SEQ ID NO: 506682 - protein, 10 aa, Mycobacterium
IEGIGRPRVE

SEQ ID NO: 506683 - protein, 22 aa, Mycobacterium
IEGIRSASSNKPLTLPADPREI

SEQ ID NO: 506684 - protein, 23 aa, Mycobacterium
IEGIRSASSNKTLTLPADPSEIP

SEQ ID NO: 506685 - protein, 22 aa, Mycobacterium
IEGIRSASSNRPLTLPEDPREI

SEQ ID NO: 506686 - protein, 15 aa, Mycobacterium
IEGIRSSSSNPALAL

SEQ ID NO: 506687 - protein, 4 aa, Mycobacterium
IEGN

SEQ ID NO: 506688 - protein, 8 aa, Mycobacterium
IEGNGDVA

SEQ ID NO: 506689 - protein, 20 aa, Mycobacterium
IEGNPAERASGSPKVRGDAE

SEQ ID NO: 506690 - protein, 5 aa, Mycobacterium
IEGPS

SEQ ID NO: 506691 - protein, 5 aa, Mycobacterium
IEGQI

SEQ ID NO: 506692 - protein, 7 aa, Mycobacterium
IEGQKTA

SEQ ID NO: 506693 - protein, 5 aa, Mycobacterium
IEGRD

SEQ ID NO: 506694 - protein, 9 aa, Mycobacterium
IEGRDEFRG

SEQ ID NO: 506695 - protein, 6 aa, Mycobacterium
IEGRDG

SEQ ID NO: 506696 - protein, 8 aa, Mycobacterium
IEGREEFA

SEQ ID NO: 506697 - protein, 5 aa, Mycobacterium
IEGRK

SEQ ID NO: 506698 - protein, 5 aa, Mycobacterium
IEGRR

SEQ ID NO: 506699 - protein, 18 aa, Mycobacterium
IEGSAKPACVAESVVRFV

SEQ ID NO: 506700 - protein, 12 aa, Mycobacterium
IEGSRAAPGYAA

SEQ ID NO: 506701 - protein, 4 aa, Mycobacterium
IEGT

SEQ ID NO: 506702 - protein, 8 aa, Mycobacterium
IEGTPQRP

SEQ ID NO: 506703 - protein, 7 aa, Mycobacterium
IEGTPVT

SEQ ID NO: 506704 - protein, 7 aa, Mycobacterium
IEGTPVY

SEQ ID NO: 506705 - protein, 5 aa, Mycobacterium
IEGTR

SEQ ID NO: 506706 - protein, 8 aa, Mycobacterium
IEGVADPS

SEQ ID NO: 506707 - protein, 8 aa, Mycobacterium
IEHEPGSR

SEQ ID NO: 506708 - protein, 4 aa, Mycobacterium
IEHG

SEQ ID NO: 506709 - protein, 4 aa, Mycobacterium
IEIP

SEQ ID NO: 506710 - protein, 14 aa, Mycobacterium
IEIPTSRRSVDSRR

SEQ ID NO: 506711 - protein, 10 aa, Mycobacterium
IEKAGDGYRL

SEQ ID NO: 506712 - protein, 10 aa, Mycobacterium
IEKANDTEYG

SEQ ID NO: 506713 - protein, 15 aa, Mycobacterium
IEKDGRSDNLATATR

SEQ ID NO: 506714 - protein, 19 aa, Mycobacterium
IEKESAPPEGQEDTRQGRI

SEQ ID NO: 506715 - protein, 4 aa, Mycobacterium
IEKR

SEQ ID NO: 506716 - protein, 10 aa, Mycobacterium
IEKSNDLNKA

SEQ ID NO: 506717 - protein, 10 aa, Mycobacterium
IEKSPRPWAQ

SEQ ID NO: 506718 - protein, 7 aa, Mycobacterium
IEKTAAN

SEQ ID NO: 506719 - protein, 9 aa, Mycobacterium
IEKTADGYR

SEQ ID NO: 506720 - protein, 10 aa, Mycobacterium
IELESGEELP

SEQ ID NO: 506721 - protein, 19 aa, Mycobacterium
IELGGSKATVRSDPDKSVT

SEQ ID NO: 506722 - protein, 7 aa, Mycobacterium
IELPNGP

SEQ ID NO: 506723 - protein, 7 aa, Mycobacterium
IELPPGT

SEQ ID NO: 506724 - protein, 11 aa, Mycobacterium
IELSSSQSTSI

SEQ ID NO: 506725 - protein, 6 aa, Mycobacterium
IENADD

SEQ ID NO: 506726 - protein, 7 aa, Mycobacterium
IENDPAV

SEQ ID NO: 506727 - protein, 8 aa, Mycobacterium
IENDPAVA

SEQ ID NO: 506728 - protein, 8 aa, Mycobacterium
IENEERIP

SEQ ID NO: 506729 - protein, 26 aa, Mycobacterium
IENEGAREEAVRAATKAAEEHAKALN

SEQ ID NO: 506730 - protein, 5 aa, Mycobacterium
IENGS

SEQ ID NO: 506731 - protein, 14 aa, Mycobacterium
IENGSTDQTDFDTV

SEQ ID NO: 506732 - protein, 13 aa, Mycobacterium
IENGTATPVPQDL

SEQ ID NO: 506733 - protein, 10 aa, Mycobacterium
IENKDPRARS

SEQ ID NO: 506734 - protein, 11 aa, Mycobacterium
IENKTSAQTRT

SEQ ID NO: 506735 - protein, 7 aa, Mycobacterium
IENNGPL

SEQ ID NO: 506736 - protein, 12 aa, Mycobacterium
IENPKRARTSGI

SEQ ID NO: 506737 - protein, 9 aa, Mycobacterium
IENPTTSDY

SEQ ID NO: 506738 - protein, 7 aa, Mycobacterium
IENQSSG

SEQ ID NO: 506739 - protein, 4 aa, Mycobacterium
IENR

SEQ ID NO: 506740 - protein, 5 aa, Mycobacterium
IENSA

SEQ ID NO: 506741 - protein, 11 aa, Mycobacterium
IENSRGASDRA

SEQ ID NO: 506742 - protein, 12 aa, Mycobacterium
IENSRGEQDRTY

SEQ ID NO: 506743 - protein, 6 aa, Mycobacterium
IENSTN

SEQ ID NO: 506744 - protein, 7 aa, Mycobacterium
IENYEPG

SEQ ID NO: 506745 - protein, 13 aa, Mycobacterium
IEPAAPTRLRRAP

SEQ ID NO: 506746 - protein, 15 aa, Mycobacterium
IEPADQGRVSRAGDL

SEQ ID NO: 506747 - protein, 16 aa, Mycobacterium
IEPAPAPKRKTAQRRS

SEQ ID NO: 506748 - protein, 6 aa, Mycobacterium
IEPARD

SEQ ID NO: 506749 - protein, 7 aa, Mycobacterium
IEPARDS

SEQ ID NO: 506750 - protein, 8 aa, Mycobacterium
IEPATDAT

SEQ ID NO: 506751 - protein, 10 aa, Mycobacterium
IEPDEHAEPV

SEQ ID NO: 506752 - protein, 8 aa, Mycobacterium
IEPDGRAS

SEQ ID NO: 506753 - protein, 5 aa, Mycobacterium
IEPDP

SEQ ID NO: 506754 - protein, 9 aa, Mycobacterium
IEPEDVPDD

SEQ ID NO: 506755 - protein, 8 aa, Mycobacterium
IEPEGAVP

SEQ ID NO: 506756 - protein, 5 aa, Mycobacterium
IEPEP

SEQ ID NO: 506757 - protein, 9 aa, Mycobacterium
IEPEPERRI

SEQ ID NO: 506758 - protein, 8 aa, Mycobacterium
IEPEQTQA

SEQ ID NO: 506759 - protein, 6 aa, Mycobacterium
IEPETQ

SEQ ID NO: 506760 - protein, 4 aa, Mycobacterium
IEPG

SEQ ID NO: 506761 - protein, 14 aa, Mycobacterium
IEPGASQHRTTGVG

SEQ ID NO: 506762 - protein, 9 aa, Mycobacterium
IEPGDFDPA

SEQ ID NO: 506763 - protein, 17 aa, Mycobacterium
IEPGGDGTVSAASVPKG

SEQ ID NO: 506764 - protein, 10 aa, Mycobacterium
IEPGGSTGWH

SEQ ID NO: 506765 - protein, 5 aa, Mycobacterium
IEPGP

SEQ ID NO: 506766 - protein, 11 aa, Mycobacterium
IEPGPAADDLP

SEQ ID NO: 506767 - protein, 7 aa, Mycobacterium
IEPGPRQ

SEQ ID NO: 506768 - protein, 15 aa, Mycobacterium
IEPGQPLDPHERTAV

SEQ ID NO: 506769 - protein, 12 aa, Mycobacterium
IEPGQPLDPQER

SEQ ID NO: 506770 - protein, 6 aa, Mycobacterium
IEPGQR

SEQ ID NO: 506771 - protein, 11 aa, Mycobacterium
IEPGQTAEDLP

SEQ ID NO: 506772 - protein, 6 aa, Mycobacterium
IEPGRP

SEQ ID NO: 506773 - protein, 6 aa, Mycobacterium
IEPGRR

SEQ ID NO: 506774 - protein, 6 aa, Mycobacterium
IEPGSE

SEQ ID NO: 506775 - protein, 10 aa, Mycobacterium
IEPGTAPELA

SEQ ID NO: 506776 - protein, 11 aa, Mycobacterium
IEPGTLEGSNT

SEQ ID NO: 506777 - protein, 9 aa, Mycobacterium
IEPHRRPYG

SEQ ID NO: 506778 - protein, 8 aa, Mycobacterium
IEPKPDWE

SEQ ID NO: 506779 - protein, 7 aa, Mycobacterium
IEPKPSW

SEQ ID NO: 506780 - protein, 8 aa, Mycobacterium
IEPKSGQT

SEQ ID NO: 506781 - protein, 4 aa, Mycobacterium
IEPL

SEQ ID NO: 506782 - protein, 10 aa, Mycobacterium
IEPLEADEDS

SEQ ID NO: 506783 - protein, 4 aa, Mycobacterium
IEPN

SEQ ID NO: 506784 - protein, 9 aa, Mycobacterium
IEPNGDGVT

SEQ ID NO: 506785 - protein, 9 aa, Mycobacterium
IEPNGRRPR

SEQ ID NO: 506786 - protein, 7 aa, Mycobacterium
IEPNSLG

SEQ ID NO: 506787 - protein, 14 aa, Mycobacterium
IEPPEEVFAAPPSP

SEQ ID NO: 506788 - protein, 14 aa, Mycobacterium
IEPPEEVFAAPPTP

SEQ ID NO: 506789 - protein, 10 aa, Mycobacterium
IEPPGGDPGR

SEQ ID NO: 506790 - protein, 13 aa, Mycobacterium
IEPPGGPTAPAEV

SEQ ID NO: 506791 - protein, 7 aa, Mycobacterium
IEPPQDW

SEQ ID NO: 506792 - protein, 7 aa, Mycobacterium
IEPPQGD

SEQ ID NO: 506793 - protein, 11 aa, Mycobacterium
IEPPQGDPLRT

SEQ ID NO: 506794 - protein, 11 aa, Mycobacterium
IEPPTGDPART

SEQ ID NO: 506795 - protein, 8 aa, Mycobacterium
IEPQPDWG

SEQ ID NO: 506796 - protein, 7 aa, Mycobacterium
IEPRKGT

SEQ ID NO: 506797 - protein, 9 aa, Mycobacterium
IEPRPSSTS

SEQ ID NO: 506798 - protein, 5 aa, Mycobacterium
IEPRQ

SEQ ID NO: 506799 - protein, 6 aa, Mycobacterium
IEPRTG

SEQ ID NO: 506800 - protein, 7 aa, Mycobacterium
IEPRTGH

SEQ ID NO: 506801 - protein, 8 aa, Mycobacterium
IEPRTGRQ

SEQ ID NO: 506802 - protein, 6 aa, Mycobacterium
IEPSAH

SEQ ID NO: 506803 - protein, 8 aa, Mycobacterium
IEPSASTT

SEQ ID NO: 506804 - protein, 23 aa, Mycobacterium
IEPSEFDDVDEPTHIPAPSDTYH

SEQ ID NO: 506805 - protein, 11 aa, Mycobacterium
IEPSEVTPEKS

SEQ ID NO: 506806 - protein, 15 aa, Mycobacterium
IEPSRRASIAANATK

SEQ ID NO: 506807 - protein, 4 aa, Mycobacterium
IEPT

SEQ ID NO: 506808 - protein, 5 aa, Mycobacterium
IEPTG

SEQ ID NO: 506809 - protein, 5 aa, Mycobacterium
IEPTK

SEQ ID NO: 506810 - protein, 7 aa, Mycobacterium
IEPTKGR

SEQ ID NO: 506811 - protein, 25 aa, Mycobacterium
IEPTKRQPNSCYAGTPLKANRSAHG

SEQ ID NO: 506812 - protein, 8 aa, Mycobacterium
IEPTLPTA

SEQ ID NO: 506813 - protein, 8 aa, Mycobacterium
IEPTNREP

SEQ ID NO: 506814 - protein, 15 aa, Mycobacterium
IEPTPKRKPVPRKRS

SEQ ID NO: 506815 - protein, 14 aa, Mycobacterium
IEPTQRGSDEFGSG

SEQ ID NO: 506816 - protein, 10 aa, Mycobacterium
IEPTSGNTGI

SEQ ID NO: 506817 - protein, 13 aa, Mycobacterium
IEPTTGARLKGTG

SEQ ID NO: 506818 - protein, 5 aa, Mycobacterium
IEPVR

SEQ ID NO: 506819 - protein, 4 aa, Mycobacterium
IEQA

SEQ ID NO: 506820 - protein, 5 aa, Mycobacterium
IEQAQ

SEQ ID NO: 506821 - protein, 10 aa, Mycobacterium
IEQDPAAAEY

SEQ ID NO: 506822 - protein, 13 aa, Mycobacterium
IEQDTSNYFYIAR

SEQ ID NO: 506823 - protein, 6 aa, Mycobacterium
IEQEAG

SEQ ID NO: 506824 - protein, 8 aa, Mycobacterium
IEQEQAGK

SEQ ID NO: 506825 - protein, 4 aa, Mycobacterium
IEQG

SEQ ID NO: 506826 - protein, 5 aa, Mycobacterium
IEQGD

SEQ ID NO: 506827 - protein, 10 aa, Mycobacterium
IEQGNNDSHA

SEQ ID NO: 506828 - protein, 10 aa, Mycobacterium
IEQGNNSSHA

SEQ ID NO: 506829 - protein, 15 aa, Mycobacterium
IEQIGSPTEVYDQPA

SEQ ID NO: 506830 - protein, 8 aa, Mycobacterium
IEQKPIEG

SEQ ID NO: 506831 - protein, 8 aa, Mycobacterium
IEQLPTGG

SEQ ID NO: 506832 - protein, 17 aa, Mycobacterium
IEQPADSEEAISTAPQR

SEQ ID NO: 506833 - protein, 17 aa, Mycobacterium
IEQPPDSEEAISAAPQR

SEQ ID NO: 506834 - protein, 6 aa, Mycobacterium
IEQRTD

SEQ ID NO: 506835 - protein, 12 aa, Mycobacterium
IEQRTSADGAPE

SEQ ID NO: 506836 - protein, 18 aa, Mycobacterium
IEQRYGTGSVQIPSKTTA

SEQ ID NO: 506837 - protein, 7 aa, Mycobacterium
IEQTGYR

SEQ ID NO: 506838 - protein, 5 aa, Mycobacterium
IEQTR

SEQ ID NO: 506839 - protein, 7 aa, Mycobacterium
IEQTSAH

SEQ ID NO: 506840 - protein, 7 aa, Mycobacterium
IEQTSTD

SEQ ID NO: 506841 - protein, 15 aa, Mycobacterium
IEQVGSPEDLYDRPA

SEQ ID NO: 506842 - protein, 14 aa, Mycobacterium
IEQVGSPSEVYDAP

SEQ ID NO: 506843 - protein, 14 aa, Mycobacterium
IEQVGSPTDVYDAP

SEQ ID NO: 506844 - protein, 13 aa, Mycobacterium
IEQVGSPTEVYDA

SEQ ID NO: 506845 - protein, 5 aa, Mycobacterium
IERAA

SEQ ID NO: 506846 - protein, 12 aa, Mycobacterium
IERADPTSGPVD

SEQ ID NO: 506847 - protein, 12 aa, Mycobacterium
IERAETEKRERR

SEQ ID NO: 506848 - protein, 10 aa, Mycobacterium
IERAKGAAGV

SEQ ID NO: 506849 - protein, 9 aa, Mycobacterium
IERAKGAPH

SEQ ID NO: 506850 - protein, 11 aa, Mycobacterium
IERAKSAPGVT

SEQ ID NO: 506851 - protein, 9 aa, Mycobacterium
IERAPGGEG

SEQ ID NO: 506852 - protein, 10 aa, Mycobacterium
IERDDGQLTK

SEQ ID NO: 506853 - protein, 7 aa, Mycobacterium
IERDEDV

SEQ ID NO: 506854 - protein, 7 aa, Mycobacterium
IERDGAG

SEQ ID NO: 506855 - protein, 9 aa, Mycobacterium
IERDGQVEK

SEQ ID NO: 506856 - protein, 9 aa, Mycobacterium
IERDQTEAQ

SEQ ID NO: 506857 - protein, 10 aa, Mycobacterium
IEREDGQVTN

SEQ ID NO: 506858 - protein, 8 aa, Mycobacterium
IEREEQDE

SEQ ID NO: 506859 - protein, 7 aa, Mycobacterium
IEREGSD

SEQ ID NO: 506860 - protein, 5 aa, Mycobacterium
IEREQ

SEQ ID NO: 506861 - protein, 4 aa, Mycobacterium
IERG

SEQ ID NO: 506862 - protein, 7 aa, Mycobacterium
IERGGKQ

SEQ ID NO: 506863 - protein, 9 aa, Mycobacterium
IERGGPGEH

SEQ ID NO: 506864 - protein, 8 aa, Mycobacterium
IERGTGGN

SEQ ID NO: 506865 - protein, 9 aa, Mycobacterium
IERNEPDLT

SEQ ID NO: 506866 - protein, 10 aa, Mycobacterium
IERNPRQPRQ

SEQ ID NO: 506867 - protein, 9 aa, Mycobacterium
IERPDGSDG

SEQ ID NO: 506868 - protein, 30 aa, Mycobacterium
IERPPGQSSSPPGGDNAIGTADAAYSLSYP

SEQ ID NO: 506869 - protein, 13 aa, Mycobacterium
IERPQPSLGITRS

SEQ ID NO: 506870 - protein, 6 aa, Mycobacterium
IERPSW

SEQ ID NO: 506871 - protein, 5 aa, Mycobacterium
IERQG

SEQ ID NO: 506872 - protein, 21 aa, Mycobacterium
IERQGPDGSSERVRYWCPACQ

SEQ ID NO: 506873 - protein, 11 aa, Mycobacterium
IERREARAGEV

SEQ ID NO: 506874 - protein, 5 aa, Mycobacterium
IERRG

SEQ ID NO: 506875 - protein, 8 aa, Mycobacterium
IERRGPRL

SEQ ID NO: 506876 - protein, 8 aa, Mycobacterium
IERRGRGT

SEQ ID NO: 506877 - protein, 15 aa, Mycobacterium
IERSDSDWDREKLGE

SEQ ID NO: 506878 - protein, 11 aa, Mycobacterium
IERSGLTADDV

SEQ ID NO: 506879 - protein, 7 aa, Mycobacterium
IERSTDA

SEQ ID NO: 506880 - protein, 21 aa, Mycobacterium
IERTADRVSGENSEPASLDNR

SEQ ID NO: 506881 - protein, 9 aa, Mycobacterium
IERTPGDDG

SEQ ID NO: 506882 - protein, 11 aa, Mycobacterium
IERTTSGQVEF

SEQ ID NO: 506883 - protein, 10 aa, Mycobacterium
IESAAAGAAT

SEQ ID NO: 506884 - protein, 6 aa, Mycobacterium
IESAGG

SEQ ID NO: 506885 - protein, 10 aa, Mycobacterium
IESAKAGKLT

SEQ ID NO: 506886 - protein, 8 aa, Mycobacterium
IESDEEVR

SEQ ID NO: 506887 - protein, 10 aa, Mycobacterium
IESDGEASFR

SEQ ID NO: 506888 - protein, 13 aa, Mycobacterium
IESDPLNNYYIAR

SEQ ID NO: 506889 - protein, 7 aa, Mycobacterium
IESDTAP

SEQ ID NO: 506890 - protein, 7 aa, Mycobacterium
IESEEHR

SEQ ID NO: 506891 - protein, 9 aa, Mycobacterium
IESEKEDLR

SEQ ID NO: 506892 - protein, 9 aa, Mycobacterium
IESEKEELR

SEQ ID NO: 506893 - protein, 10 aa, Mycobacterium
IESESQRAYA

SEQ ID NO: 506894 - protein, 5 aa, Mycobacterium
IESEV

SEQ ID NO: 506895 - protein, 4 aa, Mycobacterium
IESG

SEQ ID NO: 506896 - protein, 8 aa, Mycobacterium
IESGARPV

SEQ ID NO: 506897 - protein, 9 aa, Mycobacterium
IESGDDAAE

SEQ ID NO: 506898 - protein, 19 aa, Mycobacterium
IESGDENAVRDVVTRHNAA

SEQ ID NO: 506899 - protein, 8 aa, Mycobacterium
IESGDRPV

SEQ ID NO: 506900 - protein, 8 aa, Mycobacterium
IESGERPV

SEQ ID NO: 506901 - protein, 10 aa, Mycobacterium
IESGGDSRIP

SEQ ID NO: 506902 - protein, 14 aa, Mycobacterium
IESGGQAPAPRPHA

SEQ ID NO: 506903 - protein, 16 aa, Mycobacterium
IESGHTPDGWVCQHAS

SEQ ID NO: 506904 - protein, 6 aa, Mycobacterium
IESGQF

SEQ ID NO: 506905 - protein, 24 aa, Mycobacterium
IESGRAGGASVLTGGGRAQGVGSK

SEQ ID NO: 506906 - protein, 11 aa, Mycobacterium
IESGRRGASAE

SEQ ID NO: 506907 - protein, 7 aa, Mycobacterium
IESNGTG

SEQ ID NO: 506908 - protein, 8 aa, Mycobacterium
IESPSVTV

SEQ ID NO: 506909 - protein, 6 aa, Mycobacterium
IESQSD

SEQ ID NO: 506910 - protein, 5 aa, Mycobacterium
IESRD

SEQ ID NO: 506911 - protein, 5 aa, Mycobacterium
IESRG

SEQ ID NO: 506912 - protein, 10 aa, Mycobacterium
IESRGGDVPP

SEQ ID NO: 506913 - protein, 7 aa, Mycobacterium
IESRPAS

SEQ ID NO: 506914 - protein, 9 aa, Mycobacterium
IESRPHDTA

SEQ ID NO: 506915 - protein, 10 aa, Mycobacterium
IESRPTRTEL

SEQ ID NO: 506916 - protein, 5 aa, Mycobacterium
IESRY

SEQ ID NO: 506917 - protein, 8 aa, Mycobacterium
IESSGSPG

SEQ ID NO: 506918 - protein, 8 aa, Mycobacterium
IESTGRGT

SEQ ID NO: 506919 - protein, 7 aa, Mycobacterium
IESTGSV

SEQ ID NO: 506920 - protein, 12 aa, Mycobacterium
IESTPAFREPGP

SEQ ID NO: 506921 - protein, 7 aa, Mycobacterium
IESVTKT

SEQ ID NO: 506922 - protein, 4 aa, Mycobacterium
IESY

SEQ ID NO: 506923 - protein, 4 aa, Mycobacterium
IETA

SEQ ID NO: 506924 - protein, 6 aa, Mycobacterium
IETAED

SEQ ID NO: 506925 - protein, 9 aa, Mycobacterium
IETASSADG

SEQ ID NO: 506926 - protein, 9 aa, Mycobacterium
IETDGDVGA

SEQ ID NO: 506927 - protein, 5 aa, Mycobacterium
IETDL

SEQ ID NO: 506928 - protein, 7 aa, Mycobacterium
IETDPGV

SEQ ID NO: 506929 - protein, 8 aa, Mycobacterium
IETEATRT

SEQ ID NO: 506930 - protein, 6 aa, Mycobacterium
IETEEG

SEQ ID NO: 506931 - protein, 7 aa, Mycobacterium
IETEQPD

SEQ ID NO: 506932 - protein, 9 aa, Mycobacterium
IETEQPDPL

SEQ ID NO: 506933 - protein, 9 aa, Mycobacterium
IETERPDPL

SEQ ID NO: 506934 - protein, 6 aa, Mycobacterium
IETETG

SEQ ID NO: 506935 - protein, 7 aa, Mycobacterium
IETETGV

SEQ ID NO: 506936 - protein, 14 aa, Mycobacterium
IETETGVRVSPTKI

SEQ ID NO: 506937 - protein, 5 aa, Mycobacterium
IETEW

SEQ ID NO: 506938 - protein, 4 aa, Mycobacterium
IETG

SEQ ID NO: 506939 - protein, 7 aa, Mycobacterium
IETGARP

SEQ ID NO: 506940 - protein, 5 aa, Mycobacterium
IETPA

SEQ ID NO: 506941 - protein, 8 aa, Mycobacterium
IETPPAMP

SEQ ID NO: 506942 - protein, 8 aa, Mycobacterium
IETQPGGC

SEQ ID NO: 506943 - protein, 8 aa, Mycobacterium
IETQSGAA

SEQ ID NO: 506944 - protein, 4 aa, Mycobacterium
IETR

SEQ ID NO: 506945 - protein, 38 aa, Mycobacterium
IETRYGTAIGSSELAGETPEGRRVEEQYEERQRAAAER

SEQ ID NO: 506946 - protein, 6 aa, Mycobacterium
IETSAE

SEQ ID NO: 506947 - protein, 7 aa, Mycobacterium
IETSDDA

SEQ ID NO: 506948 - protein, 5 aa, Mycobacterium
IETSK

SEQ ID NO: 506949 - protein, 6 aa, Mycobacterium
IETSPA

SEQ ID NO: 506950 - protein, 10 aa, Mycobacterium
IETSPREKAT

SEQ ID NO: 506951 - protein, 8 aa, Mycobacterium
IETTAGDM

SEQ ID NO: 506952 - protein, 10 aa, Mycobacterium
IEVDGDDQAV

SEQ ID NO: 506953 - protein, 9 aa, Mycobacterium
IEVQDKERA

SEQ ID NO: 506954 - protein, 18 aa, Mycobacterium
IEVTDTADGPQWALIERD

SEQ ID NO: 506955 - protein, 18 aa, Mycobacterium
IEVTDTADGPQWTLGGDG

SEQ ID NO: 506956 - protein, 17 aa, Mycobacterium
IEYDPAKSIAAYTPGPH

SEQ ID NO: 506957 - protein, 13 aa, Mycobacterium
IEYDSAEASFQPS

SEQ ID NO: 506958 - protein, 11 aa, Mycobacterium
IEYTTDEGFDA

SEQ ID NO: 506959 - protein, 16 aa, Mycobacterium
IFEPSDQALRGNPTTV

SEQ ID NO: 506960 - protein, 17 aa, Mycobacterium
IFGPDGARAFEKDATDA

SEQ ID NO: 506961 - protein, 7 aa, Mycobacterium
IFPGEDG

SEQ ID NO: 506962 - protein, 8 aa, Mycobacterium
IGAAASGY

SEQ ID NO: 506963 - protein, 10 aa, Mycobacterium
IGAADDRTGF

SEQ ID NO: 506964 - protein, 11 aa, Mycobacterium
IGAAGDRTGFD

SEQ ID NO: 506965 - protein, 13 aa, Mycobacterium
IGAAGQIRTGFDT

SEQ ID NO: 506966 - protein, 6 aa, Mycobacterium
IGAAGR

SEQ ID NO: 506967 - protein, 10 aa, Mycobacterium
IGAAGSARAV

SEQ ID NO: 506968 - protein, 6 aa, Mycobacterium
IGAAGV

SEQ ID NO: 506969 - protein, 6 aa, Mycobacterium
IGAAPA

SEQ ID NO: 506970 - protein, 11 aa, Mycobacterium
IGAASGAYAPY

SEQ ID NO: 506971 - protein, 17 aa, Mycobacterium
IGAATDSAKDGVPDADL

SEQ ID NO: 506972 - protein, 17 aa, Mycobacterium
IGADAPPPTSDPTAEWD

SEQ ID NO: 506973 - protein, 7 aa, Mycobacterium
IGADDQN

SEQ ID NO: 506974 - protein, 10 aa, Mycobacterium
IGADEARRNR

SEQ ID NO: 506975 - protein, 13 aa, Mycobacterium
IGADGDAQSYAEP

SEQ ID NO: 506976 - protein, 19 aa, Mycobacterium
IGADTAAPSDMAELSGGRA

SEQ ID NO: 506977 - protein, 5 aa, Mycobacterium
IGAED

SEQ ID NO: 506978 - protein, 11 aa, Mycobacterium
IGAEDHSEIDS

SEQ ID NO: 506979 - protein, 11 aa, Mycobacterium
IGAEPTADRRT

SEQ ID NO: 506980 - protein, 8 aa, Mycobacterium
IGAETGTK

SEQ ID NO: 506981 - protein, 4 aa, Mycobacterium
IGAG

SEQ ID NO: 506982 - protein, 28 aa, Mycobacterium
IGAGGRHGSACDGQSYPHDTASPCPAAA

SEQ ID NO: 506983 - protein, 8 aa, Mycobacterium
IGAGNTAS

SEQ ID NO: 506984 - protein, 7 aa, Mycobacterium
IGAGQRP

SEQ ID NO: 506985 - protein, 10 aa, Mycobacterium
IGAGRATRTI

SEQ ID NO: 506986 - protein, 10 aa, Mycobacterium
IGAHQERDTI

SEQ ID NO: 506987 - protein, 11 aa, Mycobacterium
IGAKAADREEA

SEQ ID NO: 506988 - protein, 14 aa, Mycobacterium
IGANPEDPHAGGHG

SEQ ID NO: 506989 - protein, 4 aa, Mycobacterium
IGAP

SEQ ID NO: 506990 - protein, 20 aa, Mycobacterium
IGAPAATHPVTGTPGTAPAS

SEQ ID NO: 506991 - protein, 9 aa, Mycobacterium
IGAPADGRR

SEQ ID NO: 506992 - protein, 16 aa, Mycobacterium
IGAPATRLPPERAEQF

SEQ ID NO: 506993 - protein, 19 aa, Mycobacterium
IGAPDSSAHAAATDGRVGA

SEQ ID NO: 506994 - protein, 8 aa, Mycobacterium
IGAPDTPV

SEQ ID NO: 506995 - protein, 14 aa, Mycobacterium
IGAPEPAPVTQGCA

SEQ ID NO: 506996 - protein, 8 aa, Mycobacterium
IGAPERTR

SEQ ID NO: 506997 - protein, 6 aa, Mycobacterium
IGAPGA

SEQ ID NO: 506998 - protein, 10 aa, Mycobacterium
IGAPGSARAV

SEQ ID NO: 506999 - protein, 15 aa, Mycobacterium
IGAPKTERIEVAGCG

SEQ ID NO: 507000 - protein, 14 aa, Mycobacterium
IGAPPDNFTPRGQD

SEQ ID NO: 507001 - protein, 14 aa, Mycobacterium
IGAPPGVAPKPLRG

SEQ ID NO: 507002 - protein, 8 aa, Mycobacterium
IGAPPTSA

SEQ ID NO: 507003 - protein, 11 aa, Mycobacterium
IGAPPVPAGTD

SEQ ID NO: 507004 - protein, 8 aa, Mycobacterium
IGAPTDSV

SEQ ID NO: 507005 - protein, 9 aa, Mycobacterium
IGAQATGVR

SEQ ID NO: 507006 - protein, 10 aa, Mycobacterium
IGARDSDFEA

SEQ ID NO: 507007 - protein, 10 aa, Mycobacterium
IGARPDSALP

SEQ ID NO: 507008 - protein, 8 aa, Mycobacterium
IGARRGAL

SEQ ID NO: 507009 - protein, 10 aa, Mycobacterium
IGARSATRAE

SEQ ID NO: 507010 - protein, 6 aa, Mycobacterium
IGASAS

SEQ ID NO: 507011 - protein, 10 aa, Mycobacterium
IGASPASVTA

SEQ ID NO: 507012 - protein, 7 aa, Mycobacterium
IGASPEL

SEQ ID NO: 507013 - protein, 6 aa, Mycobacterium
IGASYG

SEQ ID NO: 507014 - protein, 6 aa, Mycobacterium
IGATGT

SEQ ID NO: 507015 - protein, 5 aa, Mycobacterium
IGATP

SEQ ID NO: 507016 - protein, 11 aa, Mycobacterium
IGATRDVAGAG

SEQ ID NO: 507017 - protein, 14 aa, Mycobacterium
IGATSGSGSQARRA

SEQ ID NO: 507018 - protein, 10 aa, Mycobacterium
IGCTSPDGRE

SEQ ID NO: 507019 - protein, 6 aa, Mycobacterium
IGDADE

SEQ ID NO: 507020 - protein, 6 aa, Mycobacterium
IGDADH

SEQ ID NO: 507021 - protein, 10 aa, Mycobacterium
IGDAGLRPAD

SEQ ID NO: 507022 - protein, 6 aa, Mycobacterium
IGDAND

SEQ ID NO: 507023 - protein, 18 aa, Mycobacterium
IGDAPPPAAPGRRPVARQ

SEQ ID NO: 507024 - protein, 9 aa, Mycobacterium
IGDATPDSL

SEQ ID NO: 507025 - protein, 4 aa, Mycobacterium
IGDD

SEQ ID NO: 507026 - protein, 19 aa, Mycobacterium
IGDDAEPAPEAAEPAEPVD

SEQ ID NO: 507027 - protein, 9 aa, Mycobacterium
IGDDATARQ

SEQ ID NO: 507028 - protein, 14 aa, Mycobacterium
IGDDGTVRKPGQDY

SEQ ID NO: 507029 - protein, 7 aa, Mycobacterium
IGDDLSN

SEQ ID NO: 507030 - protein, 8 aa, Mycobacterium
IGDDRNAG

SEQ ID NO: 507031 - protein, 14 aa, Mycobacterium
IGDDYRDVSTATGQ

SEQ ID NO: 507032 - protein, 4 aa, Mycobacterium
IGDE

SEQ ID NO: 507033 - protein, 6 aa, Mycobacterium
IGDEAR

SEQ ID NO: 507034 - protein, 7 aa, Mycobacterium
IGDESQV

SEQ ID NO: 507035 - protein, 9 aa, Mycobacterium
IGDGEPGEV

SEQ ID NO: 507036 - protein, 5 aa, Mycobacterium
IGDGG

SEQ ID NO: 507037 - protein, 30 aa, Mycobacterium
IGDGGAGGAGGNGGDGTGAGGLGGNGASAD

SEQ ID NO: 507038 - protein, 28 aa, Mycobacterium
IGDGGAGGDGGDGSGAGGLGGDGGNADW

SEQ ID NO: 507039 - protein, 16 aa, Mycobacterium
IGDGGGFSISRDGYQL

SEQ ID NO: 507040 - protein, 26 aa, Mycobacterium
IGDGGNGGNAGAGPTPGSPGGGGTGG

SEQ ID NO: 507041 - protein, 7 aa, Mycobacterium
IGDGGRT

SEQ ID NO: 507042 - protein, 8 aa, Mycobacterium
IGDGGRTL

SEQ ID NO: 507043 - protein, 29 aa, Mycobacterium
IGDGGSGGAGGDAGSGDAGDGGDGGDARL

SEQ ID NO: 507044 - protein, 9 aa, Mycobacterium
IGDGGSRAS

SEQ ID NO: 507045 - protein, 18 aa, Mycobacterium
IGDGNTEVTADAGGLGGN

SEQ ID NO: 507046 - protein, 13 aa, Mycobacterium
IGDGPAMRQATPR

SEQ ID NO: 507047 - protein, 10 aa, Mycobacterium
IGDGRGGAGA

SEQ ID NO: 507048 - protein, 22 aa, Mycobacterium
IGDGRYSNDPTNPLGTHNPDGG

SEQ ID NO: 507049 - protein, 12 aa, Mycobacterium
IGDGTKDSDMGP

SEQ ID NO: 507050 - protein, 8 aa, Mycobacterium
IGDGTPLG

SEQ ID NO: 507051 - protein, 6 aa, Mycobacterium
IGDLPR

SEQ ID NO: 507052 - protein, 14 aa, Mycobacterium
IGDLPSTPVPEAPG

SEQ ID NO: 507053 - protein, 15 aa, Mycobacterium
IGDNNGLTANAPGLG

SEQ ID NO: 507054 - protein, 11 aa, Mycobacterium
IGDNTRPDAIR

SEQ ID NO: 507055 - protein, 10 aa, Mycobacterium
IGDPAANAAS

SEQ ID NO: 507056 - protein, 10 aa, Mycobacterium
IGDPDRPLTV

SEQ ID NO: 507057 - protein, 5 aa, Mycobacterium
IGDPE

SEQ ID NO: 507058 - protein, 7 aa, Mycobacterium
IGDPGDL

SEQ ID NO: 507059 - protein, 21 aa, Mycobacterium
IGDPPEVLENTQGRPLSPDDE

SEQ ID NO: 507060 - protein, 20 aa, Mycobacterium
IGDPSAQKAIDARRHHTKER

SEQ ID NO: 507061 - protein, 9 aa, Mycobacterium
IGDPTDARR

SEQ ID NO: 507062 - protein, 7 aa, Mycobacterium
IGDPVSS

SEQ ID NO: 507063 - protein, 4 aa, Mycobacterium
IGDQ

SEQ ID NO: 507064 - protein, 17 aa, Mycobacterium
IGDQDGATAIPLKVPYT

SEQ ID NO: 507065 - protein, 4 aa, Mycobacterium
IGDR

SEQ ID NO: 507066 - protein, 18 aa, Mycobacterium
IGDRGKVADSTTAAKTIS

SEQ ID NO: 507067 - protein, 4 aa, Mycobacterium
IGDS

SEQ ID NO: 507068 - protein, 7 aa, Mycobacterium
IGDSDQI

SEQ ID NO: 507069 - protein, 9 aa, Mycobacterium
IGDSTRSTG

SEQ ID NO: 507070 - protein, 4 aa, Mycobacterium
IGDT

SEQ ID NO: 507071 - protein, 5 aa, Mycobacterium
IGDTG

SEQ ID NO: 507072 - protein, 17 aa, Mycobacterium
IGDTPKSQIRAEAARRG

SEQ ID NO: 507073 - protein, 9 aa, Mycobacterium
IGDTTVPAG

SEQ ID NO: 507074 - protein, 4 aa, Mycobacterium
IGEA

SEQ ID NO: 507075 - protein, 7 aa, Mycobacterium
IGEAGAD

SEQ ID NO: 507076 - protein, 5 aa, Mycobacterium
IGEAP

SEQ ID NO: 507077 - protein, 7 aa, Mycobacterium
IGEASEA

SEQ ID NO: 507078 - protein, 7 aa, Mycobacterium
IGEDAEG

SEQ ID NO: 507079 - protein, 11 aa, Mycobacterium
IGEDASGTTVA

SEQ ID NO: 507080 - protein, 4 aa, Mycobacterium
IGEE

SEQ ID NO: 507081 - protein, 6 aa, Mycobacterium
IGEEAG

SEQ ID NO: 507082 - protein, 7 aa, Mycobacterium
IGEEGKG

SEQ ID NO: 507083 - protein, 7 aa, Mycobacterium
IGEEGNG

SEQ ID NO: 507084 - protein, 12 aa, Mycobacterium
IGEEGSPVPDHD

SEQ ID NO: 507085 - protein, 9 aa, Mycobacterium
IGEEHPELH

SEQ ID NO: 507086 - protein, 15 aa, Mycobacterium
IGEEISKEDLGGPDV

SEQ ID NO: 507087 - protein, 12 aa, Mycobacterium
IGEEQPGAHEKE

SEQ ID NO: 507088 - protein, 7 aa, Mycobacterium
IGEETGF

SEQ ID NO: 507089 - protein, 6 aa, Mycobacterium
IGEEVS

SEQ ID NO: 507090 - protein, 7 aa, Mycobacterium
IGEGGNL

SEQ ID NO: 507091 - protein, 12 aa, Mycobacterium
IGEGGNLGLTSR

SEQ ID NO: 507092 - protein, 10 aa, Mycobacterium
IGEGGRTPSR

SEQ ID NO: 507093 - protein, 8 aa, Mycobacterium
IGEGHRST

SEQ ID NO: 507094 - protein, 7 aa, Mycobacterium
IGEGTAA

SEQ ID NO: 507095 - protein, 7 aa, Mycobacterium
IGEGTTE

SEQ ID NO: 507096 - protein, 19 aa, Mycobacterium
IGELETATTERAHERAAQR

SEQ ID NO: 507097 - protein, 10 aa, Mycobacterium
IGENDAAVRR

SEQ ID NO: 507098 - protein, 11 aa, Mycobacterium
IGENDAAVRRD

SEQ ID NO: 507099 - protein, 6 aa, Mycobacterium
IGENPW

SEQ ID NO: 507100 - protein, 7 aa, Mycobacterium
IGEPAAN

SEQ ID NO: 507101 - protein, 7 aa, Mycobacterium
IGEPADV

SEQ ID NO: 507102 - protein, 5 aa, Mycobacterium
IGEPE

SEQ ID NO: 507103 - protein, 7 aa, Mycobacterium
IGEPEEP

SEQ ID NO: 507104 - protein, 9 aa, Mycobacterium
IGEPGARGL

SEQ ID NO: 507105 - protein, 7 aa, Mycobacterium
IGEPGHG

SEQ ID NO: 507106 - protein, 16 aa, Mycobacterium
IGEPPGDTDAFRVWPR

SEQ ID NO: 507107 - protein, 7 aa, Mycobacterium
IGEPQPE

SEQ ID NO: 507108 - protein, 12 aa, Mycobacterium
IGEPRDTVSADP

SEQ ID NO: 507109 - protein, 23 aa, Mycobacterium
IGEPRDTVSADVPADGATVSEAT

SEQ ID NO: 507110 - protein, 17 aa, Mycobacterium
IGEPRDTVTAEPAGLQG

SEQ ID NO: 507111 - protein, 7 aa, Mycobacterium
IGEPRDV

SEQ ID NO: 507112 - protein, 8 aa, Mycobacterium
IGEPRRGE

SEQ ID NO: 507113 - protein, 7 aa, Mycobacterium
IGEPSEV

SEQ ID NO: 507114 - protein, 9 aa, Mycobacterium
IGEPSGEIS

SEQ ID NO: 507115 - protein, 4 aa, Mycobacterium
IGEQ

SEQ ID NO: 507116 - protein, 6 aa, Mycobacterium
IGEQAE

SEQ ID NO: 507117 - protein, 9 aa, Mycobacterium
IGEQTQRIA

SEQ ID NO: 507118 - protein, 5 aa, Mycobacterium
IGERE

SEQ ID NO: 507119 - protein, 24 aa, Mycobacterium
IGERERAQSRASRLQRRRAATDAL

SEQ ID NO: 507120 - protein, 10 aa, Mycobacterium
IGERGGAPIE

SEQ ID NO: 507121 - protein, 9 aa, Mycobacterium
IGERGYRAT

SEQ ID NO: 507122 - protein, 5 aa, Mycobacterium
IGERS

SEQ ID NO: 507123 - protein, 6 aa, Mycobacterium
IGESKG

SEQ ID NO: 507124 - protein, 9 aa, Mycobacterium
IGESKMSGS

SEQ ID NO: 507125 - protein, 6 aa, Mycobacterium
IGESVS

SEQ ID NO: 507126 - protein, 6 aa, Mycobacterium
IGETEQ

SEQ ID NO: 507127 - protein, 10 aa, Mycobacterium
IGETSGLTAT

SEQ ID NO: 507128 - protein, 4 aa, Mycobacterium
IGEV

SEQ ID NO: 507129 - protein, 17 aa, Mycobacterium
IGEVDESDCPCGRTGQT

SEQ ID NO: 507130 - protein, 11 aa, Mycobacterium
IGFGNKGSGNI

SEQ ID NO: 507131 - protein, 9 aa, Mycobacterium
IGFPGHDPS

SEQ ID NO: 507132 - protein, 4 aa, Mycobacterium
IGGA

SEQ ID NO: 507133 - protein, 5 aa, Mycobacterium
IGGAA

SEQ ID NO: 507134 - protein, 10 aa, Mycobacterium
IGGADPVAVP

SEQ ID NO: 507135 - protein, 9 aa, Mycobacterium
IGGAPKNPA

SEQ ID NO: 507136 - protein, 10 aa, Mycobacterium
IGGAQPVDIP

SEQ ID NO: 507137 - protein, 7 aa, Mycobacterium
IGGARNA

SEQ ID NO: 507138 - protein, 5 aa, Mycobacterium
IGGAS

SEQ ID NO: 507139 - protein, 5 aa, Mycobacterium
IGGAT

SEQ ID NO: 507140 - protein, 10 aa, Mycobacterium
IGGATDETGM

SEQ ID NO: 507141 - protein, 6 aa, Mycobacterium
IGGATT

SEQ ID NO: 507142 - protein, 15 aa, Mycobacterium
IGGATTGSSQRKTEV

SEQ ID NO: 507143 - protein, 5 aa, Mycobacterium
IGGDG

SEQ ID NO: 507144 - protein, 15 aa, Mycobacterium
IGGDGEAPPESVTRT

SEQ ID NO: 507145 - protein, 64 aa, Mycobacterium
IGGDGGDGGDGGAGGDAQHIGNGGAGGERGAAGTGGSGFADGSAGSGGAGGTGGSLWGANGASG

SEQ ID NO: 507146 - protein, 13 aa, Mycobacterium
IGGDPSDHPPAEL

SEQ ID NO: 507147 - protein, 7 aa, Mycobacterium
IGGDQDP

SEQ ID NO: 507148 - protein, 10 aa, Mycobacterium
IGGDQVEQGV

SEQ ID NO: 507149 - protein, 8 aa, Mycobacterium
IGGDRPPF

SEQ ID NO: 507150 - protein, 7 aa, Mycobacterium
IGGDTRG

SEQ ID NO: 507151 - protein, 11 aa, Mycobacterium
IGGDTSGIDEA

SEQ ID NO: 507152 - protein, 12 aa, Mycobacterium
IGGDYADDDRLS

SEQ ID NO: 507153 - protein, 6 aa, Mycobacterium
IGGEEA

SEQ ID NO: 507154 - protein, 18 aa, Mycobacterium
IGGEGGVGGRGGDAGTSG

SEQ ID NO: 507155 - protein, 8 aa, Mycobacterium
IGGEGRAK

SEQ ID NO: 507156 - protein, 8 aa, Mycobacterium
IGGEPATR

SEQ ID NO: 507157 - protein, 17 aa, Mycobacterium
IGGEPGDPENEVPGRQL

SEQ ID NO: 507158 - protein, 9 aa, Mycobacterium
IGGEPQNEW

SEQ ID NO: 507159 - protein, 13 aa, Mycobacterium
IGGEQGPGSTYTP

SEQ ID NO: 507160 - protein, 8 aa, Mycobacterium
IGGESRAK

SEQ ID NO: 507161 - protein, 9 aa, Mycobacterium
IGGETGARE

SEQ ID NO: 507162 - protein, 26 aa, Mycobacterium
IGGGGAGGAGGEGATTGGDGGAGGTG

SEQ ID NO: 507163 - protein, 12 aa, Mycobacterium
IGGGGGAAAPGV

SEQ ID NO: 507164 - protein, 18 aa, Mycobacterium
IGGGGGSMPSPMGGTGDV

SEQ ID NO: 507165 - protein, 6 aa, Mycobacterium
IGGGGI

SEQ ID NO: 507166 - protein, 12 aa, Mycobacterium
IGGGGRRGDVGA

SEQ ID NO: 507167 - protein, 21 aa, Mycobacterium
IGGGLTAPQPPVPNPNNAPGV

SEQ ID NO: 507168 - protein, 6 aa, Mycobacterium
IGGGPV

SEQ ID NO: 507169 - protein, 6 aa, Mycobacterium
IGGHPD

SEQ ID NO: 507170 - protein, 7 aa, Mycobacterium
IGGKDAV

SEQ ID NO: 507171 - protein, 14 aa, Mycobacterium
IGGKTGINTDAGKN

SEQ ID NO: 507172 - protein, 4 aa, Mycobacterium
IGGL

SEQ ID NO: 507173 - protein, 32 aa, Mycobacterium
IGGNGGNGGTGGTGTDGLAGSGGGSGGAGGRG

SEQ ID NO: 507174 - protein, 7 aa, Mycobacterium
IGGNRAS

SEQ ID NO: 507175 - protein, 9 aa, Mycobacterium
IGGNTAAES

SEQ ID NO: 507176 - protein, 6 aa, Mycobacterium
IGGPAF

SEQ ID NO: 507177 - protein, 6 aa, Mycobacterium
IGGPAV

SEQ ID NO: 507178 - protein, 6 aa, Mycobacterium
IGGPDQ

SEQ ID NO: 507179 - protein, 8 aa, Mycobacterium
IGGPEHRE

SEQ ID NO: 507180 - protein, 9 aa, Mycobacterium
IGGPGSARV

SEQ ID NO: 507181 - protein, 9 aa, Mycobacterium
IGGPGSATL

SEQ ID NO: 507182 - protein, 45 aa, Mycobacterium
IGGPPPAPPEPPPAPPEPPEPPAPPQAAAEPAPAGPKSPLPPMPI

SEQ ID NO: 507183 - protein, 7 aa, Mycobacterium
IGGPSFD

SEQ ID NO: 507184 - protein, 11 aa, Mycobacterium
IGGPVGSGKTA

SEQ ID NO: 507185 - protein, 12 aa, Mycobacterium
IGGQDPGAASSV

SEQ ID NO: 507186 - protein, 6 aa, Mycobacterium
IGGQED

SEQ ID NO: 507187 - protein, 38 aa, Mycobacterium
IGGQGGTGGAAGGFANTAPSTNGLLGGNGGNGGDGGAG

SEQ ID NO: 507188 - protein, 18 aa, Mycobacterium
IGGQGGTGGAAGGNPGIY

SEQ ID NO: 507189 - protein, 16 aa, Mycobacterium
IGGQPGGAVESGENPT

SEQ ID NO: 507190 - protein, 9 aa, Mycobacterium
IGGQPQREW

SEQ ID NO: 507191 - protein, 9 aa, Mycobacterium
IGGQTSGDT

SEQ ID NO: 507192 - protein, 6 aa, Mycobacterium
IGGRES

SEQ ID NO: 507193 - protein, 5 aa, Mycobacterium
IGGRG

SEQ ID NO: 507194 - protein, 11 aa, Mycobacterium
IGGRGKAGGVK

SEQ ID NO: 507195 - protein, 17 aa, Mycobacterium
IGGRTPAQAIEDGVDPR

SEQ ID NO: 507196 - protein, 6 aa, Mycobacterium
IGGSDE

SEQ ID NO: 507197 - protein, 9 aa, Mycobacterium
IGGSDGSGG

SEQ ID NO: 507198 - protein, 42 aa, Mycobacterium
IGGSDGTATGQQGGDGGYGADSTAVGGTGGAGGTGGNGGNGG

SEQ ID NO: 507199 - protein, 22 aa, Mycobacterium
IGGSGRNASRGRRAQGEPGRAV

SEQ ID NO: 507200 - protein, 9 aa, Mycobacterium
IGGSKTRAV

SEQ ID NO: 507201 - protein, 9 aa, Mycobacterium
IGGSRTHGT

SEQ ID NO: 507202 - protein, 11 aa, Mycobacterium
IGGTATTDEMT

SEQ ID NO: 507203 - protein, 15 aa, Mycobacterium
IGGTDGTGWKGRTPN

SEQ ID NO: 507204 - protein, 11 aa, Mycobacterium
IGGTEKKTSAI

SEQ ID NO: 507205 - protein, 23 aa, Mycobacterium
IGGTGGTGFSGVGGNAGAGGDGG

SEQ ID NO: 507206 - protein, 5 aa, Mycobacterium
IGGTK

SEQ ID NO: 507207 - protein, 7 aa, Mycobacterium
IGGTNNK

SEQ ID NO: 507208 - protein, 5 aa, Mycobacterium
IGGTP

SEQ ID NO: 507209 - protein, 8 aa, Mycobacterium
IGGTPEGI

SEQ ID NO: 507210 - protein, 4 aa, Mycobacterium
IGGY

SEQ ID NO: 507211 - protein, 4 aa, Mycobacterium
IGHP

SEQ ID NO: 507212 - protein, 8 aa, Mycobacterium
IGHPAASA

SEQ ID NO: 507213 - protein, 12 aa, Mycobacterium
IGHPPGKEDEEV

SEQ ID NO: 507214 - protein, 6 aa, Mycobacterium
IGHQAT

SEQ ID NO: 507215 - protein, 7 aa, Mycobacterium
IGHSSGS

SEQ ID NO: 507216 - protein, 7 aa, Mycobacterium
IGIDDDS

SEQ ID NO: 507217 - protein, 45 aa, Mycobacterium
IGIGGDGGSGGDGGLIGNGGDGGAGGGTLTTGSTGGNGGNGGNAR

SEQ ID NO: 507218 - protein, 29 aa, Mycobacterium
IGIGNTGNGNFGLGNTGDGNIGGGNTGIG

SEQ ID NO: 507219 - protein, 9 aa, Mycobacterium
IGINDGSAA

SEQ ID NO: 507220 - protein, 9 aa, Mycobacterium
IGKAADAVS

SEQ ID NO: 507221 - protein, 10 aa, Mycobacterium
IGKAQARLEA

SEQ ID NO: 507222 - protein, 4 aa, Mycobacterium
IGKD

SEQ ID NO: 507223 - protein, 13 aa, Mycobacterium
IGKDGQSTQGGYS

SEQ ID NO: 507224 - protein, 7 aa, Mycobacterium
IGKDKPI

SEQ ID NO: 507225 - protein, 4 aa, Mycobacterium
IGKG

SEQ ID NO: 507226 - protein, 6 aa, Mycobacterium
IGKGDR

SEQ ID NO: 507227 - protein, 5 aa, Mycobacterium
IGKGV

SEQ ID NO: 507228 - protein, 23 aa, Mycobacterium
IGKHQRPATEGANAPEGDKTTTI

SEQ ID NO: 507229 - protein, 18 aa, Mycobacterium
IGKPATRLTENRPKGSDY

SEQ ID NO: 507230 - protein, 8 aa, Mycobacterium
IGKPERLR

SEQ ID NO: 507231 - protein, 7 aa, Mycobacterium
IGKPTDD

SEQ ID NO: 507232 - protein, 5 aa, Mycobacterium
IGKRR

SEQ ID NO: 507233 - protein, 13 aa, Mycobacterium
IGKRTSDDKPIAA

SEQ ID NO: 507234 - protein, 5 aa, Mycobacterium
IGKTA

SEQ ID NO: 507235 - protein, 26 aa, Mycobacterium
IGKTMGKKRYKSSTTTRNLRTLDKVL

SEQ ID NO: 507236 - protein, 5 aa, Mycobacterium
IGKTV

SEQ ID NO: 507237 - protein, 6 aa, Mycobacterium
IGLGPR

SEQ ID NO: 507238 - protein, 18 aa, Mycobacterium
IGLGTNDPARSGHENAAR

SEQ ID NO: 507239 - protein, 5 aa, Mycobacterium
IGLPD

SEQ ID NO: 507240 - protein, 12 aa, Mycobacterium
IGLPDESYYRDE

SEQ ID NO: 507241 - protein, 13 aa, Mycobacterium
IGLPDESYYRDEQ

SEQ ID NO: 507242 - protein, 11 aa, Mycobacterium
IGLPGKGASAY

SEQ ID NO: 507243 - protein, 15 aa, Mycobacterium
IGLPGQANYSASKAG

SEQ ID NO: 507244 - protein, 6 aa, Mycobacterium
IGLTQT

SEQ ID NO: 507245 - protein, 5 aa, Mycobacterium
IGNAP

SEQ ID NO: 507246 - protein, 9 aa, Mycobacterium
IGNATSGQL

SEQ ID NO: 507247 - protein, 8 aa, Mycobacterium
IGNDEQKA

SEQ ID NO: 507248 - protein, 10 aa, Mycobacterium
IGNDLSTPAP

SEQ ID NO: 507249 - protein, 10 aa, Mycobacterium
IGNDLSTPVP

SEQ ID NO: 507250 - protein, 4 aa, Mycobacterium
IGNE

SEQ ID NO: 507251 - protein, 6 aa, Mycobacterium
IGNGAR

SEQ ID NO: 507252 - protein, 7 aa, Mycobacterium
IGNGDGR

SEQ ID NO: 507253 - protein, 27 aa, Mycobacterium
IGNGGAAGAGGASTSGVGGAGGAGGAG

SEQ ID NO: 507254 - protein, 26 aa, Mycobacterium
IGNGGAGGAGGAGATGGAGGTGGAGG

SEQ ID NO: 507255 - protein, 29 aa, Mycobacterium
IGNGGAGGAGGAPGPNGGFSGGNGGNGGD

SEQ ID NO: 507256 - protein, 14 aa, Mycobacterium
IGNGGAGGAGGQGM

SEQ ID NO: 507257 - protein, 10 aa, Mycobacterium
IGNGGAGGAL

SEQ ID NO: 507258 - protein, 22 aa, Mycobacterium
IGNGGAGGDGGGVSGNGGNGGN

SEQ ID NO: 507259 - protein, 28 aa, Mycobacterium
IGNGGAGGTGGSGAAGGSGAAGGNGGAG

SEQ ID NO: 507260 - protein, 31 aa, Mycobacterium
IGNGGAGGTGYSPTTGSGAVGGNGGAGGTGG

SEQ ID NO: 507261 - protein, 10 aa, Mycobacterium
IGNGGASGAL

SEQ ID NO: 507262 - protein, 26 aa, Mycobacterium
IGNGGNGGAGGAGSNGLAGGSGGAGG

SEQ ID NO: 507263 - protein, 29 aa, Mycobacterium
IGNGGNGGDGGVGFGGGANGSGGTGGAAG

SEQ ID NO: 507264 - protein, 23 aa, Mycobacterium
IGNGGNGGNGGAFPPGNGGNGGN

SEQ ID NO: 507265 - protein, 40 aa, Mycobacterium
IGNGGNGGNGGASVGVGSNGTGGKAGTGGTLIGLDGLNGL

SEQ ID NO: 507266 - protein, 33 aa, Mycobacterium
IGNGGNGGRGGVNGTGGTGGNGGTVAGANGTDG

SEQ ID NO: 507267 - protein, 44 aa, Mycobacterium
IGNGGNGGSGINGGANGTGGTPGQLGSPGLAGGVAPPPSTTNAY

SEQ ID NO: 507268 - protein, 22 aa, Mycobacterium
IGNGGPGGAGFGGGTGGMGGTG

SEQ ID NO: 507269 - protein, 25 aa, Mycobacterium
IGNGGSGGAGGADFAGTSGGMGGTG

SEQ ID NO: 507270 - protein, 21 aa, Mycobacterium
IGNGGSGGAGGPNAAGGPGGL

SEQ ID NO: 507271 - protein, 56 aa, Mycobacterium
IGNGGSGGAGGSGGLGAHAGAGGNGGSLYGNGGSGGVGGTGASGAGGNGGGGGAAG

SEQ ID NO: 507272 - protein, 26 aa, Mycobacterium
IGNGGSGGNAGPGVPPGVPGAGGTGG

SEQ ID NO: 507273 - protein, 23 aa, Mycobacterium
IGNGGSGGNGGIGAAGGAGGSGG

SEQ ID NO: 507274 - protein, 50 aa, Mycobacterium
IGNGGSGGTAGTGGAGGPDDPPNNIPAGTDGQDGAGGAGGSGGLVFGDSG

SEQ ID NO: 507275 - protein, 36 aa, Mycobacterium
IGNGGTGGAGGSGGAGGSGGTENGDAGPGGFGGHGG

SEQ ID NO: 507276 - protein, 15 aa, Mycobacterium
IGNLPGPARHGDGVP

SEQ ID NO: 507277 - protein, 10 aa, Mycobacterium
IGNNNTAVAN

SEQ ID NO: 507278 - protein, 10 aa, Mycobacterium
IGNNNTGNFN

SEQ ID NO: 507279 - protein, 5 aa, Mycobacterium
IGNPA

SEQ ID NO: 507280 - protein, 8 aa, Mycobacterium
IGNPTTDV

SEQ ID NO: 507281 - protein, 26 aa, Mycobacterium
IGNPVDDQPQRASENRPEPETQQVSR

SEQ ID NO: 507282 - protein, 4 aa, Mycobacterium
IGNR

SEQ ID NO: 507283 - protein, 16 aa, Mycobacterium
IGNRRPTSTAPDAPLR

SEQ ID NO: 507284 - protein, 21 aa, Mycobacterium
IGNSGALNTGIGNSGLNAGSG

SEQ ID NO: 507285 - protein, 21 aa, Mycobacterium
IGNSGNSYNTGIGNSGDANTG

SEQ ID NO: 507286 - protein, 19 aa, Mycobacterium
IGNSGSHNSGIGNTGSYNT

SEQ ID NO: 507287 - protein, 20 aa, Mycobacterium
IGNSGSLNTGFGNAGSTNTG

SEQ ID NO: 507288 - protein, 18 aa, Mycobacterium
IGNSGTANSGIANSGSTN

SEQ ID NO: 507289 - protein, 9 aa, Mycobacterium
IGNSSTPGH

SEQ ID NO: 507290 - protein, 16 aa, Mycobacterium
IGNTGARNAGIANSAP

SEQ ID NO: 507291 - protein, 29 aa, Mycobacterium
IGNTGNGNFGVGNSGNLNVGGGNTGNGNL

SEQ ID NO: 507292 - protein, 8 aa, Mycobacterium
IGNTGNNN

SEQ ID NO: 507293 - protein, 7 aa, Mycobacterium
IGNTRLG

SEQ ID NO: 507294 - protein, 6 aa, Mycobacterium
IGNTTA

SEQ ID NO: 507295 - protein, 8 aa, Mycobacterium
IGNTTAAT

SEQ ID NO: 507296 - protein, 8 aa, Mycobacterium
IGNTTPAT

SEQ ID NO: 507297 - protein, 9 aa, Mycobacterium
IGNTTPATT

SEQ ID NO: 507298 - protein, 19 aa, Mycobacterium
IGNYGSVEATDEPWHGRPA

SEQ ID NO: 507299 - protein, 13 aa, Mycobacterium
IGPAADRCGGNPA

SEQ ID NO: 507300 - protein, 13 aa, Mycobacterium
IGPAADRCKGNPA

SEQ ID NO: 507301 - protein, 6 aa, Mycobacterium
IGPAAP

SEQ ID NO: 507302 - protein, 8 aa, Mycobacterium
IGPAAQDA

SEQ ID NO: 507303 - protein, 13 aa, Mycobacterium
IGPAASRCGGNPA

SEQ ID NO: 507304 - protein, 5 aa, Mycobacterium
IGPAD

SEQ ID NO: 507305 - protein, 8 aa, Mycobacterium
IGPADPAQ

SEQ ID NO: 507306 - protein, 8 aa, Mycobacterium
IGPAGEAA

SEQ ID NO: 507307 - protein, 7 aa, Mycobacterium
IGPAGEL

SEQ ID NO: 507308 - protein, 12 aa, Mycobacterium
IGPAKAAHPNLT

SEQ ID NO: 507309 - protein, 5 aa, Mycobacterium
IGPAN

SEQ ID NO: 507310 - protein, 9 aa, Mycobacterium
IGPAPDLAE

SEQ ID NO: 507311 - protein, 8 aa, Mycobacterium
IGPAPVST

SEQ ID NO: 507312 - protein, 6 aa, Mycobacterium
IGPAQT

SEQ ID NO: 507313 - protein, 5 aa, Mycobacterium
IGPAT

SEQ ID NO: 507314 - protein, 6 aa, Mycobacterium
IGPATA

SEQ ID NO: 507315 - protein, 8 aa, Mycobacterium
IGPAYQGK

SEQ ID NO: 507316 - protein, 16 aa, Mycobacterium
IGPDAETVTAGRGHRI

SEQ ID NO: 507317 - protein, 6 aa, Mycobacterium
IGPDAG

SEQ ID NO: 507318 - protein, 6 aa, Mycobacterium
IGPDGA

SEQ ID NO: 507319 - protein, 7 aa, Mycobacterium
IGPDGAP

SEQ ID NO: 507320 - protein, 13 aa, Mycobacterium
IGPDGKPTGSRSN

SEQ ID NO: 507321 - protein, 8 aa, Mycobacterium
IGPDGPGE

SEQ ID NO: 507322 - protein, 8 aa, Mycobacterium
IGPDGTAH

SEQ ID NO: 507323 - protein, 7 aa, Mycobacterium
IGPDPRF

SEQ ID NO: 507324 - protein, 7 aa, Mycobacterium
IGPDSQA

SEQ ID NO: 507325 - protein, 7 aa, Mycobacterium
IGPDTTL

SEQ ID NO: 507326 - protein, 12 aa, Mycobacterium
IGPEAAAPAEAA

SEQ ID NO: 507327 - protein, 6 aa, Mycobacterium
IGPEDV

SEQ ID NO: 507328 - protein, 20 aa, Mycobacterium
IGPEDYPSEVAAARRDTPLD

SEQ ID NO: 507329 - protein, 6 aa, Mycobacterium
IGPEGA

SEQ ID NO: 507330 - protein, 11 aa, Mycobacterium
IGPEGEGETRD

SEQ ID NO: 507331 - protein, 6 aa, Mycobacterium
IGPEGR

SEQ ID NO: 507332 - protein, 16 aa, Mycobacterium
IGPEQAAAEASEAADD

SEQ ID NO: 507333 - protein, 17 aa, Mycobacterium
IGPEQAAAEASEASDEM

SEQ ID NO: 507334 - protein, 14 aa, Mycobacterium
IGPEREPLDDPAEP

SEQ ID NO: 507335 - protein, 29 aa, Mycobacterium
IGPEVGAAAASAGGAAADAAGTLGRGAPI

SEQ ID NO: 507336 - protein, 6 aa, Mycobacterium
IGPGAE

SEQ ID NO: 507337 - protein, 10 aa, Mycobacterium
IGPGAEPTTV

SEQ ID NO: 507338 - protein, 10 aa, Mycobacterium
IGPGAQPGTI

SEQ ID NO: 507339 - protein, 10 aa, Mycobacterium
IGPGDENGVQ

SEQ ID NO: 507340 - protein, 7 aa, Mycobacterium
IGPGDSA

SEQ ID NO: 507341 - protein, 7 aa, Mycobacterium
IGPGGRV

SEQ ID NO: 507342 - protein, 5 aa, Mycobacterium
IGPGH

SEQ ID NO: 507343 - protein, 6 aa, Mycobacterium
IGPGKA

SEQ ID NO: 507344 - protein, 6 aa, Mycobacterium
IGPGLG

SEQ ID NO: 507345 - protein, 7 aa, Mycobacterium
IGPGNLG

SEQ ID NO: 507346 - protein, 11 aa, Mycobacterium
IGPGNRPLPAP

SEQ ID NO: 507347 - protein, 17 aa, Mycobacterium
IGPGQAPADAAPGPDAL

SEQ ID NO: 507348 - protein, 15 aa, Mycobacterium
IGPGRTPAEPTVTPG

SEQ ID NO: 507349 - protein, 6 aa, Mycobacterium
IGPGSQ

SEQ ID NO: 507350 - protein, 8 aa, Mycobacterium
IGPGTEGF

SEQ ID NO: 507351 - protein, 6 aa, Mycobacterium
IGPGTK

SEQ ID NO: 507352 - protein, 13 aa, Mycobacterium
IGPGVTSRCPRTS

SEQ ID NO: 507353 - protein, 12 aa, Mycobacterium
IGPGVTSVRPGD

SEQ ID NO: 507354 - protein, 6 aa, Mycobacterium
IGPGYG

SEQ ID NO: 507355 - protein, 12 aa, Mycobacterium
IGPHGTGAPNGL

SEQ ID NO: 507356 - protein, 4 aa, Mycobacterium
IGPK

SEQ ID NO: 507357 - protein, 6 aa, Mycobacterium
IGPKAK

SEQ ID NO: 507358 - protein, 8 aa, Mycobacterium
IGPKGDWA

SEQ ID NO: 507359 - protein, 13 aa, Mycobacterium
IGPKTKRLAARPE

SEQ ID NO: 507360 - protein, 13 aa, Mycobacterium
IGPLASARTGIPT

SEQ ID NO: 507361 - protein, 6 aa, Mycobacterium
IGPLDT

SEQ ID NO: 507362 - protein, 8 aa, Mycobacterium
IGPLPEGR

SEQ ID NO: 507363 - protein, 13 aa, Mycobacterium
IGPLTSARTGIPT

SEQ ID NO: 507364 - protein, 5 aa, Mycobacterium
IGPMT

SEQ ID NO: 507365 - protein, 6 aa, Mycobacterium
IGPMTA

SEQ ID NO: 507366 - protein, 13 aa, Mycobacterium
IGPMTSARTGIPT

SEQ ID NO: 507367 - protein, 5 aa, Mycobacterium
IGPNQ

SEQ ID NO: 507368 - protein, 11 aa, Mycobacterium
IGPPSGPGPHA

SEQ ID NO: 507369 - protein, 7 aa, Mycobacterium
IGPQAGN

SEQ ID NO: 507370 - protein, 8 aa, Mycobacterium
IGPQRSAH

SEQ ID NO: 507371 - protein, 5 aa, Mycobacterium
IGPQS

SEQ ID NO: 507372 - protein, 4 aa, Mycobacterium
IGPR

SEQ ID NO: 507373 - protein, 5 aa, Mycobacterium
IGPRA

SEQ ID NO: 507374 - protein, 9 aa, Mycobacterium
IGPRDASEV

SEQ ID NO: 507375 - protein, 7 aa, Mycobacterium
IGPRDDQ

SEQ ID NO: 507376 - protein, 7 aa, Mycobacterium
IGPRETG

SEQ ID NO: 507377 - protein, 22 aa, Mycobacterium
IGPRPSRPETGQLAPDTAPEPL

SEQ ID NO: 507378 - protein, 6 aa, Mycobacterium
IGPRPV

SEQ ID NO: 507379 - protein, 10 aa, Mycobacterium
IGPRQSSPWA

SEQ ID NO: 507380 - protein, 6 aa, Mycobacterium
IGPRRR

SEQ ID NO: 507381 - protein, 5 aa, Mycobacterium
IGPRS

SEQ ID NO: 507382 - protein, 14 aa, Mycobacterium
IGPSAASPAAGSTA

SEQ ID NO: 507383 - protein, 6 aa, Mycobacterium
IGPSAS

SEQ ID NO: 507384 - protein, 6 aa, Mycobacterium
IGPSDV

SEQ ID NO: 507385 - protein, 10 aa, Mycobacterium
IGPSGSGKST

SEQ ID NO: 507386 - protein, 10 aa, Mycobacterium
IGPSGSGKTT

SEQ ID NO: 507387 - protein, 10 aa, Mycobacterium
IGPSSSAMAT

SEQ ID NO: 507388 - protein, 11 aa, Mycobacterium
IGPSSSHTVGP

SEQ ID NO: 507389 - protein, 22 aa, Mycobacterium
IGPSSSPQPYGVTAETGPAGGE

SEQ ID NO: 507390 - protein, 4 aa, Mycobacterium
IGPT

SEQ ID NO: 507391 - protein, 8 aa, Mycobacterium
IGPTDTAT

SEQ ID NO: 507392 - protein, 7 aa, Mycobacterium
IGPTPEN

SEQ ID NO: 507393 - protein, 12 aa, Mycobacterium
IGPTSSEESPPF

SEQ ID NO: 507394 - protein, 7 aa, Mycobacterium
IGPTTAD

SEQ ID NO: 507395 - protein, 23 aa, Mycobacterium
IGPTTRTASISPDVNDPGARNIS

SEQ ID NO: 507396 - protein, 5 aa, Mycobacterium
IGPTV

SEQ ID NO: 507397 - protein, 14 aa, Mycobacterium
IGPVSAGGGAAVGG

SEQ ID NO: 507398 - protein, 18 aa, Mycobacterium
IGPVTGPTIGQPGAGPMA

SEQ ID NO: 507399 - protein, 9 aa, Mycobacterium
IGQAETERE

SEQ ID NO: 507400 - protein, 15 aa, Mycobacterium
IGQEPDYDAALAAVS

SEQ ID NO: 507401 - protein, 15 aa, Mycobacterium
IGQEPDYDAALSALK

SEQ ID NO: 507402 - protein, 14 aa, Mycobacterium
IGQEPDYEAALKAL

SEQ ID NO: 507403 - protein, 4 aa, Mycobacterium
IGQG

SEQ ID NO: 507404 - protein, 6 aa, Mycobacterium
IGQGDS

SEQ ID NO: 507405 - protein, 6 aa, Mycobacterium
IGQGEQ

SEQ ID NO: 507406 - protein, 76 aa, Mycobacterium
IGQGGNGGVGGLGATGAAGVNPSPLPAGTPAAAGTPGGSDLGQPGAPGGPGDYGVSTATVGQPGGEGGAGGDGNYV

SEQ ID NO: 507407 - protein, 7 aa, Mycobacterium
IGQGIPT

SEQ ID NO: 507408 - protein, 7 aa, Mycobacterium
IGQGRHR

SEQ ID NO: 507409 - protein, 6 aa, Mycobacterium
IGQNGL

SEQ ID NO: 507410 - protein, 12 aa, Mycobacterium
IGQNRPGPKGYI

SEQ ID NO: 507411 - protein, 10 aa, Mycobacterium
IGQNRPGPRG

SEQ ID NO: 507412 - protein, 6 aa, Mycobacterium
IGQPNL

SEQ ID NO: 507413 - protein, 6 aa, Mycobacterium
IGQPPM

SEQ ID NO: 507414 - protein, 4 aa, Mycobacterium
IGQQ

SEQ ID NO: 507415 - protein, 12 aa, Mycobacterium
IGQQPSPYTKGN

SEQ ID NO: 507416 - protein, 4 aa, Mycobacterium
IGQR

SEQ ID NO: 507417 - protein, 12 aa, Mycobacterium
IGQRQTGSGTTI

SEQ ID NO: 507418 - protein, 7 aa, Mycobacterium
IGQSGHA

SEQ ID NO: 507419 - protein, 11 aa, Mycobacterium
IGQSSAGSTIA

SEQ ID NO: 507420 - protein, 14 aa, Mycobacterium
IGQTEFSKESGRSE

SEQ ID NO: 507421 - protein, 26 aa, Mycobacterium
IGQTMGKKRYKSSTTTRNLRTLDKVL

SEQ ID NO: 507422 - protein, 8 aa, Mycobacterium
IGQTPSPC

SEQ ID NO: 507423 - protein, 6 aa, Mycobacterium
IGQTPT

SEQ ID NO: 507424 - protein, 6 aa, Mycobacterium
IGRADE

SEQ ID NO: 507425 - protein, 15 aa, Mycobacterium
IGRANTAEDKVNAAC

SEQ ID NO: 507426 - protein, 6 aa, Mycobacterium
IGRAQA

SEQ ID NO: 507427 - protein, 4 aa, Mycobacterium
IGRD

SEQ ID NO: 507428 - protein, 11 aa, Mycobacterium
IGRDGGTPEEL

SEQ ID NO: 507429 - protein, 10 aa, Mycobacterium
IGRDGQTSAL

SEQ ID NO: 507430 - protein, 6 aa, Mycobacterium
IGRDGV

SEQ ID NO: 507431 - protein, 6 aa, Mycobacterium
IGRDPA

SEQ ID NO: 507432 - protein, 8 aa, Mycobacterium
IGRDPDEI

SEQ ID NO: 507433 - protein, 7 aa, Mycobacterium
IGRDPDS

SEQ ID NO: 507434 - protein, 6 aa, Mycobacterium
IGRDPK

SEQ ID NO: 507435 - protein, 9 aa, Mycobacterium
IGRDPKEIT

SEQ ID NO: 507436 - protein, 7 aa, Mycobacterium
IGREGDG

SEQ ID NO: 507437 - protein, 10 aa, Mycobacterium
IGRERDCERK

SEQ ID NO: 507438 - protein, 11 aa, Mycobacterium
IGRERGWPAPR

SEQ ID NO: 507439 - protein, 5 aa, Mycobacterium
IGRGA

SEQ ID NO: 507440 - protein, 6 aa, Mycobacterium
IGRGAH

SEQ ID NO: 507441 - protein, 5 aa, Mycobacterium
IGRGD

SEQ ID NO: 507442 - protein, 6 aa, Mycobacterium
IGRGDV

SEQ ID NO: 507443 - protein, 5 aa, Mycobacterium
IGRGE

SEQ ID NO: 507444 - protein, 10 aa, Mycobacterium
IGRGEAAPTA

SEQ ID NO: 507445 - protein, 6 aa, Mycobacterium
IGRGEN

SEQ ID NO: 507446 - protein, 6 aa, Mycobacterium
IGRGGA

SEQ ID NO: 507447 - protein, 12 aa, Mycobacterium
IGRGGSGLIAPT

SEQ ID NO: 507448 - protein, 6 aa, Mycobacterium
IGRGLR

SEQ ID NO: 507449 - protein, 12 aa, Mycobacterium
IGRGPVTSGAAA

SEQ ID NO: 507450 - protein, 6 aa, Mycobacterium
IGRGQH

SEQ ID NO: 507451 - protein, 8 aa, Mycobacterium
IGRGSGEA

SEQ ID NO: 507452 - protein, 4 aa, Mycobacterium
IGRH

SEQ ID NO: 507453 - protein, 4 aa, Mycobacterium
IGRK

SEQ ID NO: 507454 - protein, 5 aa, Mycobacterium
IGRKR

SEQ ID NO: 507455 - protein, 11 aa, Mycobacterium
IGRKSGQARRV

SEQ ID NO: 507456 - protein, 4 aa, Mycobacterium
IGRP

SEQ ID NO: 507457 - protein, 16 aa, Mycobacterium
IGRPARQRSTDYSPLA

SEQ ID NO: 507458 - protein, 16 aa, Mycobacterium
IGRPARQRTTTYAPLA

SEQ ID NO: 507459 - protein, 16 aa, Mycobacterium
IGRPARQRTTTYASLA

SEQ ID NO: 507460 - protein, 24 aa, Mycobacterium
IGRPARQRTTTYASPAAQERIRAR

SEQ ID NO: 507461 - protein, 6 aa, Mycobacterium
IGRPDL

SEQ ID NO: 507462 - protein, 7 aa, Mycobacterium
IGRPGEA

SEQ ID NO: 507463 - protein, 7 aa, Mycobacterium
IGRPGGE

SEQ ID NO: 507464 - protein, 7 aa, Mycobacterium
IGRPGRY

SEQ ID NO: 507465 - protein, 17 aa, Mycobacterium
IGRPPPGRAGDDHTPKT

SEQ ID NO: 507466 - protein, 7 aa, Mycobacterium
IGRPSTP

SEQ ID NO: 507467 - protein, 8 aa, Mycobacterium
IGRPSTYS

SEQ ID NO: 507468 - protein, 5 aa, Mycobacterium
IGRQF

SEQ ID NO: 507469 - protein, 10 aa, Mycobacterium
IGRQGADGMS

SEQ ID NO: 507470 - protein, 12 aa, Mycobacterium
IGRQSGRAAEGL

SEQ ID NO: 507471 - protein, 6 aa, Mycobacterium
IGRREE

SEQ ID NO: 507472 - protein, 6 aa, Mycobacterium
IGRRPL

SEQ ID NO: 507473 - protein, 11 aa, Mycobacterium
IGRRSDSAERS

SEQ ID NO: 507474 - protein, 9 aa, Mycobacterium
IGRRSGKVE

SEQ ID NO: 507475 - protein, 15 aa, Mycobacterium
IGRSAPAIAGHQADS

SEQ ID NO: 507476 - protein, 8 aa, Mycobacterium
IGRSATGR

SEQ ID NO: 507477 - protein, 9 aa, Mycobacterium
IGRSEPSVD

SEQ ID NO: 507478 - protein, 6 aa, Mycobacterium
IGRSGA

SEQ ID NO: 507479 - protein, 8 aa, Mycobacterium
IGRSRTRD

SEQ ID NO: 507480 - protein, 18 aa, Mycobacterium
IGRSSTRSRRDASPRSLD

SEQ ID NO: 507481 - protein, 13 aa, Mycobacterium
IGRTEKDCRDENL

SEQ ID NO: 507482 - protein, 8 aa, Mycobacterium
IGRTGGSR

SEQ ID NO: 507483 - protein, 8 aa, Mycobacterium
IGRTPGQH

SEQ ID NO: 507484 - protein, 10 aa, Mycobacterium
IGRTQGGNNN

SEQ ID NO: 507485 - protein, 11 aa, Mycobacterium
IGRTSSLQPPP

SEQ ID NO: 507486 - protein, 22 aa, Mycobacterium
IGSAATPAGATSSGFGNTGTNV

SEQ ID NO: 507487 - protein, 9 aa, Mycobacterium
IGSADDHTG

SEQ ID NO: 507488 - protein, 8 aa, Mycobacterium
IGSADTAL

SEQ ID NO: 507489 - protein, 16 aa, Mycobacterium
IGSAGPIDLPGGTVSP

SEQ ID NO: 507490 - protein, 13 aa, Mycobacterium
IGSANDSTTTEDT

SEQ ID NO: 507491 - protein, 17 aa, Mycobacterium
IGSAPGSRGDELGEDDV

SEQ ID NO: 507492 - protein, 7 aa, Mycobacterium
IGSATDE

SEQ ID NO: 507493 - protein, 5 aa, Mycobacterium
IGSDA

SEQ ID NO: 507494 - protein, 15 aa, Mycobacterium
IGSDDDDAKLSAEAG

SEQ ID NO: 507495 - protein, 18 aa, Mycobacterium
IGSDGRAQLPAWLVSAHR

SEQ ID NO: 507496 - protein, 5 aa, Mycobacterium
IGSDK

SEQ ID NO: 507497 - protein, 11 aa, Mycobacterium
IGSDPDPRALQ

SEQ ID NO: 507498 - protein, 14 aa, Mycobacterium
IGSDTGGSIRQPAA

SEQ ID NO: 507499 - protein, 7 aa, Mycobacterium
IGSEGDG

SEQ ID NO: 507500 - protein, 5 aa, Mycobacterium
IGSEK

SEQ ID NO: 507501 - protein, 7 aa, Mycobacterium
IGSESDR

SEQ ID NO: 507502 - protein, 6 aa, Mycobacterium
IGSESE

SEQ ID NO: 507503 - protein, 14 aa, Mycobacterium
IGSETGRISGATES

SEQ ID NO: 507504 - protein, 11 aa, Mycobacterium
IGSEYAADPDE

SEQ ID NO: 507505 - protein, 6 aa, Mycobacterium
IGSGAE

SEQ ID NO: 507506 - protein, 73 aa, Mycobacterium
IGSGAEAASAPPPPPAPKPEPKPEPKPEPKAEAKPEPQPIAQPEPAPAPKAQPPQAQPAAEPTGSGPNGSPYV

SEQ ID NO: 507507 - protein, 11 aa, Mycobacterium
IGSGAERVNPA

SEQ ID NO: 507508 - protein, 8 aa, Mycobacterium
IGSGAIQG

SEQ ID NO: 507509 - protein, 16 aa, Mycobacterium
IGSGGNGGNAGTGTQM

SEQ ID NO: 507510 - protein, 49 aa, Mycobacterium
IGSGGSGGAAGTGGAGGPDSPPDIPAGNDGQDGVGGAGGSGGLVFGNSG

SEQ ID NO: 507511 - protein, 21 aa, Mycobacterium
IGSGGSGGTGGLGAAGGAGGS

SEQ ID NO: 507512 - protein, 26 aa, Mycobacterium
IGSGGTGGAGGQSFSGTGGKGGDGGS

SEQ ID NO: 507513 - protein, 12 aa, Mycobacterium
IGSGNVGSGNIG

SEQ ID NO: 507514 - protein, 22 aa, Mycobacterium
IGSGNVGSGNIGGANVGSGNIG

SEQ ID NO: 507515 - protein, 24 aa, Mycobacterium
IGSGRKFAQDAKHRARQHGRSPDE

SEQ ID NO: 507516 - protein, 15 aa, Mycobacterium
IGSGRRLAATTKETL

SEQ ID NO: 507517 - protein, 8 aa, Mycobacterium
IGSGSTAQ

SEQ ID NO: 507518 - protein, 8 aa, Mycobacterium
IGSGSTAT

SEQ ID NO: 507519 - protein, 7 aa, Mycobacterium
IGSGSVP

SEQ ID NO: 507520 - protein, 8 aa, Mycobacterium
IGSGTATT

SEQ ID NO: 507521 - protein, 7 aa, Mycobacterium
IGSGTVP

SEQ ID NO: 507522 - protein, 6 aa, Mycobacterium
IGSHPA

SEQ ID NO: 507523 - protein, 7 aa, Mycobacterium
IGSPDRL

SEQ ID NO: 507524 - protein, 9 aa, Mycobacterium
IGSPGPGYG

SEQ ID NO: 507525 - protein, 8 aa, Mycobacterium
IGSPKGEG

SEQ ID NO: 507526 - protein, 5 aa, Mycobacterium
IGSPQ

SEQ ID NO: 507527 - protein, 11 aa, Mycobacterium
IGSPRRQKYTA

SEQ ID NO: 507528 - protein, 6 aa, Mycobacterium
IGSPTY

SEQ ID NO: 507529 - protein, 6 aa, Mycobacterium
IGSPYG

SEQ ID NO: 507530 - protein, 15 aa, Mycobacterium
IGSPYSWGGSGPNAF

SEQ ID NO: 507531 - protein, 10 aa, Mycobacterium
IGSQSRSVSQ

SEQ ID NO: 507532 - protein, 8 aa, Mycobacterium
IGSQVTDG

SEQ ID NO: 507533 - protein, 9 aa, Mycobacterium
IGSRQQGKV

SEQ ID NO: 507534 - protein, 8 aa, Mycobacterium
IGSSAQDA

SEQ ID NO: 507535 - protein, 19 aa, Mycobacterium
IGSSDELLGGGSSDAPANS

SEQ ID NO: 507536 - protein, 15 aa, Mycobacterium
IGSSPQAALPPGATW

SEQ ID NO: 507537 - protein, 9 aa, Mycobacterium
IGSSTTPEH

SEQ ID NO: 507538 - protein, 4 aa, Mycobacterium
IGST

SEQ ID NO: 507539 - protein, 9 aa, Mycobacterium
IGSVSERDI

SEQ ID NO: 507540 - protein, 13 aa, Mycobacterium
IGSWPGTAARPAA

SEQ ID NO: 507541 - protein, 6 aa, Mycobacterium
IGSYGE

SEQ ID NO: 507542 - protein, 16 aa, Mycobacterium
IGTADYDRADADDPNV

SEQ ID NO: 507543 - protein, 10 aa, Mycobacterium
IGTAERSGAR

SEQ ID NO: 507544 - protein, 10 aa, Mycobacterium
IGTAESPVPP

SEQ ID NO: 507545 - protein, 18 aa, Mycobacterium
IGTARGSDDASGSPVVTV

SEQ ID NO: 507546 - protein, 8 aa, Mycobacterium
IGTATPRR

SEQ ID NO: 507547 - protein, 9 aa, Mycobacterium
IGTATPRRV

SEQ ID NO: 507548 - protein, 12 aa, Mycobacterium
IGTATVAASGPI

SEQ ID NO: 507549 - protein, 22 aa, Mycobacterium
IGTDAPTTAPTTTAVKPDPSTV

SEQ ID NO: 507550 - protein, 10 aa, Mycobacterium
IGTDGGGSVR

SEQ ID NO: 507551 - protein, 9 aa, Mycobacterium
IGTDRVGTA

SEQ ID NO: 507552 - protein, 15 aa, Mycobacterium
IGTDSGVPGLTTDGA

SEQ ID NO: 507553 - protein, 7 aa, Mycobacterium
IGTDTAV

SEQ ID NO: 507554 - protein, 10 aa, Mycobacterium
IGTELTDTQV

SEQ ID NO: 507555 - protein, 12 aa, Mycobacterium
IGTEPGAAKRVT

SEQ ID NO: 507556 - protein, 4 aa, Mycobacterium
IGTF

SEQ ID NO: 507557 - protein, 4 aa, Mycobacterium
IGTG

SEQ ID NO: 507558 - protein, 14 aa, Mycobacterium
IGTGASGAALASSA

SEQ ID NO: 507559 - protein, 10 aa, Mycobacterium
IGTGDSSLRT

SEQ ID NO: 507560 - protein, 6 aa, Mycobacterium
IGTGDV

SEQ ID NO: 507561 - protein, 5 aa, Mycobacterium
IGTGE

SEQ ID NO: 507562 - protein, 12 aa, Mycobacterium
IGTGGAATNPKY

SEQ ID NO: 507563 - protein, 27 aa, Mycobacterium
IGTGGAGGAGGSSSTVNGGVGGTGGAG

SEQ ID NO: 507564 - protein, 22 aa, Mycobacterium
IGTGGAGGKEAPSMPGGLGGRG

SEQ ID NO: 507565 - protein, 29 aa, Mycobacterium
IGTGGTGGAGAGSASDDGGGGGSGGAGGW

SEQ ID NO: 507566 - protein, 22 aa, Mycobacterium
IGTGGTGGAGGTGAAGGNGGAG

SEQ ID NO: 507567 - protein, 23 aa, Mycobacterium
IGTGGTGGSSVYGGAPGGAGGPA

SEQ ID NO: 507568 - protein, 50 aa, Mycobacterium
IGTGGTGGTAGTGGAGGPDDPPNNIPAGNDGQDGVGGAGGSGGLVFGNSG

SEQ ID NO: 507569 - protein, 14 aa, Mycobacterium
IGTGKSGKATVSRA

SEQ ID NO: 507570 - protein, 6 aa, Mycobacterium
IGTGKT

SEQ ID NO: 507571 - protein, 11 aa, Mycobacterium
IGTGNGAAAST

SEQ ID NO: 507572 - protein, 12 aa, Mycobacterium
IGTGNGNAPSEL

SEQ ID NO: 507573 - protein, 7 aa, Mycobacterium
IGTGPWA

SEQ ID NO: 507574 - protein, 10 aa, Mycobacterium
IGTGQTGATY

SEQ ID NO: 507575 - protein, 7 aa, Mycobacterium
IGTGSSG

SEQ ID NO: 507576 - protein, 9 aa, Mycobacterium
IGTGSSGIQ

SEQ ID NO: 507577 - protein, 8 aa, Mycobacterium
IGTGSTGA

SEQ ID NO: 507578 - protein, 11 aa, Mycobacterium
IGTIGDSYDNA

SEQ ID NO: 507579 - protein, 14 aa, Mycobacterium
IGTIPSDVTAASEM

SEQ ID NO: 507580 - protein, 4 aa, Mycobacterium
IGTM

SEQ ID NO: 507581 - protein, 5 aa, Mycobacterium
IGTNA

SEQ ID NO: 507582 - protein, 8 aa, Mycobacterium
IGTNSDVA

SEQ ID NO: 507583 - protein, 8 aa, Mycobacterium
IGTNSSSF

SEQ ID NO: 507584 - protein, 10 aa, Mycobacterium
IGTPANVSGV

SEQ ID NO: 507585 - protein, 6 aa, Mycobacterium
IGTPDD

SEQ ID NO: 507586 - protein, 7 aa, Mycobacterium
IGTPDQP

SEQ ID NO: 507587 - protein, 8 aa, Mycobacterium
IGTPDRAG

SEQ ID NO: 507588 - protein, 7 aa, Mycobacterium
IGTPEDI

SEQ ID NO: 507589 - protein, 6 aa, Mycobacterium
IGTPGS

SEQ ID NO: 507590 - protein, 8 aa, Mycobacterium
IGTPNDGW

SEQ ID NO: 507591 - protein, 7 aa, Mycobacterium
IGTPNQG

SEQ ID NO: 507592 - protein, 21 aa, Mycobacterium
IGTPPTDEELQKHRNEANRRI

SEQ ID NO: 507593 - protein, 5 aa, Mycobacterium
IGTRG

SEQ ID NO: 507594 - protein, 13 aa, Mycobacterium
IGTRNPEGITSPV

SEQ ID NO: 507595 - protein, 4 aa, Mycobacterium
IGTS

SEQ ID NO: 507596 - protein, 13 aa, Mycobacterium
IGTSAQTLLVMRA

SEQ ID NO: 507597 - protein, 17 aa, Mycobacterium
IGTSDGGAGGAGGAGGK

SEQ ID NO: 507598 - protein, 5 aa, Mycobacterium
IGTSE

SEQ ID NO: 507599 - protein, 29 aa, Mycobacterium
IGTSGAEIGGAFGGEKETGGGRESGTDSW

SEQ ID NO: 507600 - protein, 10 aa, Mycobacterium
IGTSGEAPDH

SEQ ID NO: 507601 - protein, 6 aa, Mycobacterium
IGTSPF

SEQ ID NO: 507602 - protein, 7 aa, Mycobacterium
IGTSPYA

SEQ ID NO: 507603 - protein, 6 aa, Mycobacterium
IGTSRA

SEQ ID NO: 507604 - protein, 4 aa, Mycobacterium
IGTT

SEQ ID NO: 507605 - protein, 7 aa, Mycobacterium
IGTTAAP

SEQ ID NO: 507606 - protein, 10 aa, Mycobacterium
IGTTAKTLPD

SEQ ID NO: 507607 - protein, 10 aa, Mycobacterium
IGTTAPSEEL

SEQ ID NO: 507608 - protein, 12 aa, Mycobacterium
IGTTGDFRPNPS

SEQ ID NO: 507609 - protein, 7 aa, Mycobacterium
IGTTGTK

SEQ ID NO: 507610 - protein, 8 aa, Mycobacterium
IGTTSSEL

SEQ ID NO: 507611 - protein, 7 aa, Mycobacterium
IGTTTTA

SEQ ID NO: 507612 - protein, 14 aa, Mycobacterium
IGTYNQNDGAQDWQ

SEQ ID NO: 507613 - protein, 5 aa, Mycobacterium
IGVAS

SEQ ID NO: 507614 - protein, 6 aa, Mycobacterium
IGVGGN

SEQ ID NO: 507615 - protein, 6 aa, Mycobacterium
IGVGSN

SEQ ID NO: 507616 - protein, 13 aa, Mycobacterium
IGVPAEEQPGVGA

SEQ ID NO: 507617 - protein, 6 aa, Mycobacterium
IGVPGA

SEQ ID NO: 507618 - protein, 7 aa, Mycobacterium
IGVPGGR

SEQ ID NO: 507619 - protein, 10 aa, Mycobacterium
IGVPPASPTL

SEQ ID NO: 507620 - protein, 9 aa, Mycobacterium
IGVSSGQQL

SEQ ID NO: 507621 - protein, 11 aa, Mycobacterium
IGVTAEGAENI

SEQ ID NO: 507622 - protein, 5 aa, Mycobacterium
IGVTS

SEQ ID NO: 507623 - protein, 10 aa, Mycobacterium
IGYGRGGKPT

SEQ ID NO: 507624 - protein, 10 aa, Mycobacterium
IGYHPQDDSE

SEQ ID NO: 507625 - protein, 17 aa, Mycobacterium
IGYRANAAARGLRSSRT

SEQ ID NO: 507626 - protein, 10 aa, Mycobacterium
IGYSQTGAGI

SEQ ID NO: 507627 - protein, 9 aa, Mycobacterium
IHAGNTPVS

SEQ ID NO: 507628 - protein, 7 aa, Mycobacterium
IHEETGH

SEQ ID NO: 507629 - protein, 13 aa, Mycobacterium
IHGGASRLHESNE

SEQ ID NO: 507630 - protein, 7 aa, Mycobacterium
IHGGREN

SEQ ID NO: 507631 - protein, 8 aa, Mycobacterium
IHGQAGGG

SEQ ID NO: 507632 - protein, 7 aa, Mycobacterium
IHGTPGP

SEQ ID NO: 507633 - protein, 10 aa, Mycobacterium
IHNKGNKDLD

SEQ ID NO: 507634 - protein, 10 aa, Mycobacterium
IHNQDNKDLP

SEQ ID NO: 507635 - protein, 4 aa, Mycobacterium
IHPA

SEQ ID NO: 507636 - protein, 12 aa, Mycobacterium
IHPAPNNANATP

SEQ ID NO: 507637 - protein, 7 aa, Mycobacterium
IHPEPNT

SEQ ID NO: 507638 - protein, 4 aa, Mycobacterium
IHPG

SEQ ID NO: 507639 - protein, 6 aa, Mycobacterium
IHPGGI

SEQ ID NO: 507640 - protein, 16 aa, Mycobacterium
IHPGRTDLGIHLSEAL

SEQ ID NO: 507641 - protein, 8 aa, Mycobacterium
IHPGTETP

SEQ ID NO: 507642 - protein, 5 aa, Mycobacterium
IHPGY

SEQ ID NO: 507643 - protein, 10 aa, Mycobacterium
IHPNAEGEKR

SEQ ID NO: 507644 - protein, 9 aa, Mycobacterium
IHPNSTKST

SEQ ID NO: 507645 - protein, 10 aa, Mycobacterium
IHPPESTAAA

SEQ ID NO: 507646 - protein, 6 aa, Mycobacterium
IHPQDV

SEQ ID NO: 507647 - protein, 7 aa, Mycobacterium
IHPTADT

SEQ ID NO: 507648 - protein, 4 aa, Mycobacterium
IHRG

SEQ ID NO: 507649 - protein, 5 aa, Mycobacterium
IHRGR

SEQ ID NO: 507650 - protein, 8 aa, Mycobacterium
IHRRSDGA

SEQ ID NO: 507651 - protein, 5 aa, Mycobacterium
IHSED

SEQ ID NO: 507652 - protein, 6 aa, Mycobacterium
IHSPRG

SEQ ID NO: 507653 - protein, 4 aa, Mycobacterium
IHSR

SEQ ID NO: 507654 - protein, 17 aa, Mycobacterium
IHTGGSTPSTLLLPVIP

SEQ ID NO: 507655 - protein, 20 aa, Mycobacterium
IHTGPRPDVTKVNDSEYTRQ

SEQ ID NO: 507656 - protein, 6 aa, Mycobacterium
IHTSGE

SEQ ID NO: 507657 - protein, 20 aa, Mycobacterium
IIETDGTPRLSGAATGTTGV

SEQ ID NO: 507658 - protein, 10 aa, Mycobacterium
IIGAEEPKWE

SEQ ID NO: 507659 - protein, 11 aa, Mycobacterium
IIGPSGSGKTT

SEQ ID NO: 507660 - protein, 6 aa, Mycobacterium
IIGRGQ

SEQ ID NO: 507661 - protein, 7 aa, Mycobacterium
IIGRGQD

SEQ ID NO: 507662 - protein, 4 aa, Mycobacterium
IITT

SEQ ID NO: 507663 - protein, 5 aa, Mycobacterium
IKAAS

SEQ ID NO: 507664 - protein, 7 aa, Mycobacterium
IKADPRG

SEQ ID NO: 507665 - protein, 4 aa, Mycobacterium
IKAG

SEQ ID NO: 507666 - protein, 5 aa, Mycobacterium
IKAGD

SEQ ID NO: 507667 - protein, 6 aa, Mycobacterium
IKAGQR

SEQ ID NO: 507668 - protein, 9 aa, Mycobacterium
IKANGGTKP

SEQ ID NO: 507669 - protein, 7 aa, Mycobacterium
IKANKGI

SEQ ID NO: 507670 - protein, 6 aa, Mycobacterium
IKANRG

SEQ ID NO: 507671 - protein, 7 aa, Mycobacterium
IKANRGI

SEQ ID NO: 507672 - protein, 7 aa, Mycobacterium
IKANRGV

SEQ ID NO: 507673 - protein, 21 aa, Mycobacterium
IKAPKSEAKTDGLTAEERQEL

SEQ ID NO: 507674 - protein, 5 aa, Mycobacterium
IKAPR

SEQ ID NO: 507675 - protein, 5 aa, Mycobacterium
IKASD

SEQ ID NO: 507676 - protein, 6 aa, Mycobacterium
IKASGA

SEQ ID NO: 507677 - protein, 7 aa, Mycobacterium
IKASGAR

SEQ ID NO: 507678 - protein, 6 aa, Mycobacterium
IKASGK

SEQ ID NO: 507679 - protein, 8 aa, Mycobacterium
IKASGKRD

SEQ ID NO: 507680 - protein, 8 aa, Mycobacterium
IKASGNRD

SEQ ID NO: 507681 - protein, 11 aa, Mycobacterium
IKDANQAVSHA

SEQ ID NO: 507682 - protein, 6 aa, Mycobacterium
IKDGPR

SEQ ID NO: 507683 - protein, 8 aa, Mycobacterium
IKDGQFPD

SEQ ID NO: 507684 - protein, 14 aa, Mycobacterium
IKDNSKLGDEDAGK

SEQ ID NO: 507685 - protein, 7 aa, Mycobacterium
IKDPAGQ

SEQ ID NO: 507686 - protein, 7 aa, Mycobacterium
IKDPASS

SEQ ID NO: 507687 - protein, 6 aa, Mycobacterium
IKDQEG

SEQ ID NO: 507688 - protein, 8 aa, Mycobacterium
IKDSAAEL

SEQ ID NO: 507689 - protein, 5 aa, Mycobacterium
IKDSL

SEQ ID NO: 507690 - protein, 6 aa, Mycobacterium
IKDTSD

SEQ ID NO: 507691 - protein, 6 aa, Mycobacterium
IKEAGL

SEQ ID NO: 507692 - protein, 4 aa, Mycobacterium
IKEG

SEQ ID NO: 507693 - protein, 11 aa, Mycobacterium
IKEGRGTPRGG

SEQ ID NO: 507694 - protein, 7 aa, Mycobacterium
IKESTRQ

SEQ ID NO: 507695 - protein, 8 aa, Mycobacterium
IKGAAPDS

SEQ ID NO: 507696 - protein, 7 aa, Mycobacterium
IKGDGKV

SEQ ID NO: 507697 - protein, 7 aa, Mycobacterium
IKGEPVA

SEQ ID NO: 507698 - protein, 6 aa, Mycobacterium
IKGGDG

SEQ ID NO: 507699 - protein, 7 aa, Mycobacterium
IKGGDKV

SEQ ID NO: 507700 - protein, 9 aa, Mycobacterium
IKGGDWNSS

SEQ ID NO: 507701 - protein, 9 aa, Mycobacterium
IKGGGDREN

SEQ ID NO: 507702 - protein, 8 aa, Mycobacterium
IKGGSSSK

SEQ ID NO: 507703 - protein, 5 aa, Mycobacterium
IKGKA

SEQ ID NO: 507704 - protein, 14 aa, Mycobacterium
IKGPAPLPSEEEAA

SEQ ID NO: 507705 - protein, 8 aa, Mycobacterium
IKGPDGKE

SEQ ID NO: 507706 - protein, 7 aa, Mycobacterium
IKGRDGV

SEQ ID NO: 507707 - protein, 13 aa, Mycobacterium
IKGREAKNASFSK

SEQ ID NO: 507708 - protein, 7 aa, Mycobacterium
IKGRSSR

SEQ ID NO: 507709 - protein, 6 aa, Mycobacterium
IKGSDT

SEQ ID NO: 507710 - protein, 18 aa, Mycobacterium
IKGSGEEPTPGSGAPLEP

SEQ ID NO: 507711 - protein, 8 aa, Mycobacterium
IKGSPTAE

SEQ ID NO: 507712 - protein, 6 aa, Mycobacterium
IKGTGW

SEQ ID NO: 507713 - protein, 8 aa, Mycobacterium
IKHGNKTE

SEQ ID NO: 507714 - protein, 7 aa, Mycobacterium
IKIGDRE

SEQ ID NO: 507715 - protein, 11 aa, Mycobacterium
IKKGADPVRNG

SEQ ID NO: 507716 - protein, 5 aa, Mycobacterium
IKKGQ

SEQ ID NO: 507717 - protein, 8 aa, Mycobacterium
IKKPSAAV

SEQ ID NO: 507718 - protein, 14 aa, Mycobacterium
IKKSASNETAPPTI

SEQ ID NO: 507719 - protein, 8 aa, Mycobacterium
IKNDGQAD

SEQ ID NO: 507720 - protein, 5 aa, Mycobacterium
IKNGS

SEQ ID NO: 507721 - protein, 7 aa, Mycobacterium
IKPAEMA

SEQ ID NO: 507722 - protein, 15 aa, Mycobacterium
IKPAGAVKDGVDDAS

SEQ ID NO: 507723 - protein, 9 aa, Mycobacterium
IKPAGGMEN

SEQ ID NO: 507724 - protein, 6 aa, Mycobacterium
IKPDAT

SEQ ID NO: 507725 - protein, 7 aa, Mycobacterium
IKPDDYP

SEQ ID NO: 507726 - protein, 10 aa, Mycobacterium
IKPDSTLKEE

SEQ ID NO: 507727 - protein, 12 aa, Mycobacterium
IKPGDELTPQQD

SEQ ID NO: 507728 - protein, 7 aa, Mycobacterium
IKPGDTL

SEQ ID NO: 507729 - protein, 6 aa, Mycobacterium
IKPGEA

SEQ ID NO: 507730 - protein, 7 aa, Mycobacterium
IKPGEPV

SEQ ID NO: 507731 - protein, 7 aa, Mycobacterium
IKPGGGS

SEQ ID NO: 507732 - protein, 12 aa, Mycobacterium
IKPGPADYRPAT

SEQ ID NO: 507733 - protein, 7 aa, Mycobacterium
IKPGPVN

SEQ ID NO: 507734 - protein, 13 aa, Mycobacterium
IKPGPVQKSGPPI

SEQ ID NO: 507735 - protein, 5 aa, Mycobacterium
IKPGT

SEQ ID NO: 507736 - protein, 7 aa, Mycobacterium
IKPGTQL

SEQ ID NO: 507737 - protein, 6 aa, Mycobacterium
IKPPQN

SEQ ID NO: 507738 - protein, 12 aa, Mycobacterium
IKPQARTLAEDR

SEQ ID NO: 507739 - protein, 12 aa, Mycobacterium
IKPQARTLATDR

SEQ ID NO: 507740 - protein, 19 aa, Mycobacterium
IKPRDGRFGCGPSKVRPEQ

SEQ ID NO: 507741 - protein, 7 aa, Mycobacterium
IKPRGPS

SEQ ID NO: 507742 - protein, 13 aa, Mycobacterium
IKPSIADPSGSGV

SEQ ID NO: 507743 - protein, 10 aa, Mycobacterium
IKPSRDPRAR

SEQ ID NO: 507744 - protein, 7 aa, Mycobacterium
IKPSYGL

SEQ ID NO: 507745 - protein, 9 aa, Mycobacterium
IKPTDNGAT

SEQ ID NO: 507746 - protein, 15 aa, Mycobacterium
IKPTTHGPSLWAMYR

SEQ ID NO: 507747 - protein, 7 aa, Mycobacterium
IKQASGR

SEQ ID NO: 507748 - protein, 12 aa, Mycobacterium
IKQSVSMDTNTS

SEQ ID NO: 507749 - protein, 14 aa, Mycobacterium
IKRASTDTSFPAKQ

SEQ ID NO: 507750 - protein, 7 aa, Mycobacterium
IKRGTTK

SEQ ID NO: 507751 - protein, 4 aa, Mycobacterium
IKRP

SEQ ID NO: 507752 - protein, 7 aa, Mycobacterium
IKRPDYG

SEQ ID NO: 507753 - protein, 7 aa, Mycobacterium
IKRPDYS

SEQ ID NO: 507754 - protein, 5 aa, Mycobacterium
IKRSQ

SEQ ID NO: 507755 - protein, 20 aa, Mycobacterium
IKRSTDPGAVGQGVSTQPLP

SEQ ID NO: 507756 - protein, 10 aa, Mycobacterium
IKSAQGPEIE

SEQ ID NO: 507757 - protein, 6 aa, Mycobacterium
IKSGGE

SEQ ID NO: 507758 - protein, 30 aa, Mycobacterium
IKSKSAPAAAPAAEVTSDKKVTGPKQLTRD

SEQ ID NO: 507759 - protein, 10 aa, Mycobacterium
IKSPPPGGRF

SEQ ID NO: 507760 - protein, 7 aa, Mycobacterium
IKSSNGA

SEQ ID NO: 507761 - protein, 8 aa, Mycobacterium
IKSSQSTL

SEQ ID NO: 507762 - protein, 8 aa, Mycobacterium
IKSTGTHP

SEQ ID NO: 507763 - protein, 7 aa, Mycobacterium
IKSTNGD

SEQ ID NO: 507764 - protein, 9 aa, Mycobacterium
IKSTPKGRW

SEQ ID NO: 507765 - protein, 5 aa, Mycobacterium
IKTDE

SEQ ID NO: 507766 - protein, 8 aa, Mycobacterium
IKTDPELN

SEQ ID NO: 507767 - protein, 8 aa, Mycobacterium
IKTGNARA

SEQ ID NO: 507768 - protein, 13 aa, Mycobacterium
IKTGNSDAPRDPT

SEQ ID NO: 507769 - protein, 8 aa, Mycobacterium
IKTGPGGF

SEQ ID NO: 507770 - protein, 11 aa, Mycobacterium
IKTKDGTETNI

SEQ ID NO: 507771 - protein, 7 aa, Mycobacterium
IKTNPTV

SEQ ID NO: 507772 - protein, 4 aa, Mycobacterium
IKTP

SEQ ID NO: 507773 - protein, 7 aa, Mycobacterium
IKTPDEI

SEQ ID NO: 507774 - protein, 7 aa, Mycobacterium
IKTPEEI

SEQ ID NO: 507775 - protein, 6 aa, Mycobacterium
IKTQGQ

SEQ ID NO: 507776 - protein, 8 aa, Mycobacterium
IKTRASGG

SEQ ID NO: 507777 - protein, 14 aa, Mycobacterium
IKTRRSGNSEVTPE

SEQ ID NO: 507778 - protein, 10 aa, Mycobacterium
IKTTARDEGD

SEQ ID NO: 507779 - protein, 8 aa, Mycobacterium
IKTTETKA

SEQ ID NO: 507780 - protein, 6 aa, Mycobacterium
IKVDGN

SEQ ID NO: 507781 - protein, 8 aa, Mycobacterium
IKVESAKD

SEQ ID NO: 507782 - protein, 9 aa, Mycobacterium
ILDGSSEQV

SEQ ID NO: 507783 - protein, 7 aa, Mycobacterium
ILDPQGQ

SEQ ID NO: 507784 - protein, 11 aa, Mycobacterium
ILGPSGSGKTT

SEQ ID NO: 507785 - protein, 7 aa, Mycobacterium
ILNRGAP

SEQ ID NO: 507786 - protein, 10 aa, Mycobacterium
ILPDDSSTNQ

SEQ ID NO: 507787 - protein, 9 aa, Mycobacterium
ILPTNGNNF

SEQ ID NO: 507788 - protein, 5 aa, Mycobacterium
ILSPD

SEQ ID NO: 507789 - protein, 5 aa, Mycobacterium
ILSPS

SEQ ID NO: 507790 - protein, 16 aa, Mycobacterium
ILTEGRSVGEKVATGV

SEQ ID NO: 507791 - protein, 8 aa, Mycobacterium
INAAGGRA

SEQ ID NO: 507792 - protein, 10 aa, Mycobacterium
INAAGTAAAV

SEQ ID NO: 507793 - protein, 7 aa, Mycobacterium
INAANKG

SEQ ID NO: 507794 - protein, 12 aa, Mycobacterium
INADTIEQAAEA

SEQ ID NO: 507795 - protein, 4 aa, Mycobacterium
INAE

SEQ ID NO: 507796 - protein, 5 aa, Mycobacterium
INAGA

SEQ ID NO: 507797 - protein, 5 aa, Mycobacterium
INAGD

SEQ ID NO: 507798 - protein, 5 aa, Mycobacterium
INAGE

SEQ ID NO: 507799 - protein, 9 aa, Mycobacterium
INAGGGAAI

SEQ ID NO: 507800 - protein, 22 aa, Mycobacterium
INAGKGKRALASELRNKGVDSE

SEQ ID NO: 507801 - protein, 16 aa, Mycobacterium
INAGSTAAAASTTEVA

SEQ ID NO: 507802 - protein, 19 aa, Mycobacterium
INAGTQIGNIGAEGQSADG

SEQ ID NO: 507803 - protein, 6 aa, Mycobacterium
INANPA

SEQ ID NO: 507804 - protein, 8 aa, Mycobacterium
INAQTPDS

SEQ ID NO: 507805 - protein, 10 aa, Mycobacterium
INASEQATNF

SEQ ID NO: 507806 - protein, 4 aa, Mycobacterium
INDG

SEQ ID NO: 507807 - protein, 8 aa, Mycobacterium
INDGGGLR

SEQ ID NO: 507808 - protein, 10 aa, Mycobacterium
INDGKTPKTV

SEQ ID NO: 507809 - protein, 8 aa, Mycobacterium
INDGPGVR

SEQ ID NO: 507810 - protein, 6 aa, Mycobacterium
INDGRV

SEQ ID NO: 507811 - protein, 8 aa, Mycobacterium
INDGSGVR

SEQ ID NO: 507812 - protein, 9 aa, Mycobacterium
INDHTDPAH

SEQ ID NO: 507813 - protein, 4 aa, Mycobacterium
INDL

SEQ ID NO: 507814 - protein, 5 aa, Mycobacterium
INDPG

SEQ ID NO: 507815 - protein, 11 aa, Mycobacterium
INDPGNTESAI

SEQ ID NO: 507816 - protein, 10 aa, Mycobacterium
INDPNGPQSL

SEQ ID NO: 507817 - protein, 4 aa, Mycobacterium
INDY

SEQ ID NO: 507818 - protein, 10 aa, Mycobacterium
INEASTAPVP

SEQ ID NO: 507819 - protein, 8 aa, Mycobacterium
INEDGGWA

SEQ ID NO: 507820 - protein, 5 aa, Mycobacterium
INEEP

SEQ ID NO: 507821 - protein, 18 aa, Mycobacterium
INEKPAPATLSDPDRRQI

SEQ ID NO: 507822 - protein, 4 aa, Mycobacterium
INGA

SEQ ID NO: 507823 - protein, 15 aa, Mycobacterium
INGAPGTGQDGGPGG

SEQ ID NO: 507824 - protein, 6 aa, Mycobacterium
INGDDL

SEQ ID NO: 507825 - protein, 9 aa, Mycobacterium
INGDETEPT

SEQ ID NO: 507826 - protein, 7 aa, Mycobacterium
INGDIPQ

SEQ ID NO: 507827 - protein, 8 aa, Mycobacterium
INGDPAGG

SEQ ID NO: 507828 - protein, 12 aa, Mycobacterium
INGDQFSGIGGA

SEQ ID NO: 507829 - protein, 10 aa, Mycobacterium
INGDSSPTAN

SEQ ID NO: 507830 - protein, 4 aa, Mycobacterium
INGE

SEQ ID NO: 507831 - protein, 10 aa, Mycobacterium
INGEGATVAR

SEQ ID NO: 507832 - protein, 8 aa, Mycobacterium
INGEPLSD

SEQ ID NO: 507833 - protein, 6 aa, Mycobacterium
INGEPR

SEQ ID NO: 507834 - protein, 7 aa, Mycobacterium
INGEQHE

SEQ ID NO: 507835 - protein, 12 aa, Mycobacterium
INGESEEVRNGS

SEQ ID NO: 507836 - protein, 11 aa, Mycobacterium
INGETNEANTM

SEQ ID NO: 507837 - protein, 11 aa, Mycobacterium
INGETVQHSRT

SEQ ID NO: 507838 - protein, 18 aa, Mycobacterium
INGGPAKPTDKPPRPFEA

SEQ ID NO: 507839 - protein, 17 aa, Mycobacterium
INGGPAKPTDKPPRPYE

SEQ ID NO: 507840 - protein, 12 aa, Mycobacterium
INGGTRDGAERT

SEQ ID NO: 507841 - protein, 6 aa, Mycobacterium
INGHDD

SEQ ID NO: 507842 - protein, 8 aa, Mycobacterium
INGKREKN

SEQ ID NO: 507843 - protein, 16 aa, Mycobacterium
INGKRGDASAWAGIGT

SEQ ID NO: 507844 - protein, 6 aa, Mycobacterium
INGPRG

SEQ ID NO: 507845 - protein, 5 aa, Mycobacterium
INGPS

SEQ ID NO: 507846 - protein, 12 aa, Mycobacterium
INGQPTKRTTKY

SEQ ID NO: 507847 - protein, 6 aa, Mycobacterium
INGQTV

SEQ ID NO: 507848 - protein, 5 aa, Mycobacterium
INGRP

SEQ ID NO: 507849 - protein, 16 aa, Mycobacterium
INGSPRVDGPSVPSVS

SEQ ID NO: 507850 - protein, 8 aa, Mycobacterium
INGSQAAI

SEQ ID NO: 507851 - protein, 9 aa, Mycobacterium
INGSTGPVP

SEQ ID NO: 507852 - protein, 14 aa, Mycobacterium
INGTADNPNGGTGG

SEQ ID NO: 507853 - protein, 8 aa, Mycobacterium
INGTAPAG

SEQ ID NO: 507854 - protein, 25 aa, Mycobacterium
INGTPESARHARDAAEALLTAQREG

SEQ ID NO: 507855 - protein, 7 aa, Mycobacterium
INGVPRE

SEQ ID NO: 507856 - protein, 31 aa, Mycobacterium
INHDQTEEASTLNQRDAYGAPITPPGESAGT

SEQ ID NO: 507857 - protein, 9 aa, Mycobacterium
INKGETVEV

SEQ ID NO: 507858 - protein, 65 aa, Mycobacterium
INNGSGEAIGGAPGAGGTGAVGGDGGQGGAAYSYGTGDATGSAGAAGTAGTTGVGGTGGAGGAAY

SEQ ID NO: 507859 - protein, 36 aa, Mycobacterium
INNGSGNAVGGAGANGTSGGNNAAGGNGGSGGSASI

SEQ ID NO: 507860 - protein, 7 aa, Mycobacterium
INNNGPL

SEQ ID NO: 507861 - protein, 8 aa, Mycobacterium
INNPEPLQ

SEQ ID NO: 507862 - protein, 6 aa, Mycobacterium
INPADL

SEQ ID NO: 507863 - protein, 6 aa, Mycobacterium
INPANG

SEQ ID NO: 507864 - protein, 4 aa, Mycobacterium
INPD

SEQ ID NO: 507865 - protein, 7 aa, Mycobacterium
INPDAHK

SEQ ID NO: 507866 - protein, 8 aa, Mycobacterium
INPDGSTW

SEQ ID NO: 507867 - protein, 7 aa, Mycobacterium
INPDTGK

SEQ ID NO: 507868 - protein, 4 aa, Mycobacterium
INPE

SEQ ID NO: 507869 - protein, 11 aa, Mycobacterium
INPEGGVPDSA

SEQ ID NO: 507870 - protein, 8 aa, Mycobacterium
INPEGKTL

SEQ ID NO: 507871 - protein, 6 aa, Mycobacterium
INPENG

SEQ ID NO: 507872 - protein, 5 aa, Mycobacterium
INPEV

SEQ ID NO: 507873 - protein, 9 aa, Mycobacterium
INPGESPKV

SEQ ID NO: 507874 - protein, 7 aa, Mycobacterium
INPGGDK

SEQ ID NO: 507875 - protein, 15 aa, Mycobacterium
INPGHRAAGATPDRP

SEQ ID NO: 507876 - protein, 27 aa, Mycobacterium
INPGITDGAPRTPPHPPAGIAGTGPSI

SEQ ID NO: 507877 - protein, 12 aa, Mycobacterium
INPGPASYRPAS

SEQ ID NO: 507878 - protein, 6 aa, Mycobacterium
INPGQR

SEQ ID NO: 507879 - protein, 6 aa, Mycobacterium
INPGTV

SEQ ID NO: 507880 - protein, 10 aa, Mycobacterium
INPGTVDASG

SEQ ID NO: 507881 - protein, 16 aa, Mycobacterium
INPHGEPDVTGPDGRA

SEQ ID NO: 507882 - protein, 8 aa, Mycobacterium
INPHPDRE

SEQ ID NO: 507883 - protein, 4 aa, Mycobacterium
INPK

SEQ ID NO: 507884 - protein, 5 aa, Mycobacterium
INPND

SEQ ID NO: 507885 - protein, 45 aa, Mycobacterium
INPNPNLTDPNPPLAPGITPSPPVPGSANPDNPSPGAPAAPQPHE

SEQ ID NO: 507886 - protein, 8 aa, Mycobacterium
INPPPYDE

SEQ ID NO: 507887 - protein, 5 aa, Mycobacterium
INPQT

SEQ ID NO: 507888 - protein, 6 aa, Mycobacterium
INPSGG

SEQ ID NO: 507889 - protein, 6 aa, Mycobacterium
INPSNR

SEQ ID NO: 507890 - protein, 21 aa, Mycobacterium
INPTKNQTAGKLRGKPSDGVG

SEQ ID NO: 507891 - protein, 7 aa, Mycobacterium
INPTPAS

SEQ ID NO: 507892 - protein, 6 aa, Mycobacterium
INPTTV

SEQ ID NO: 507893 - protein, 10 aa, Mycobacterium
INQDGRSNGL

SEQ ID NO: 507894 - protein, 6 aa, Mycobacterium
INQPTV

SEQ ID NO: 507895 - protein, 5 aa, Mycobacterium
INRDT

SEQ ID NO: 507896 - protein, 10 aa, Mycobacterium
INREKSDSGL

SEQ ID NO: 507897 - protein, 4 aa, Mycobacterium
INRG

SEQ ID NO: 507898 - protein, 11 aa, Mycobacterium
INRGPVSDDVY

SEQ ID NO: 507899 - protein, 10 aa, Mycobacterium
INRNSASLDE

SEQ ID NO: 507900 - protein, 9 aa, Mycobacterium
INRNSATLD

SEQ ID NO: 507901 - protein, 9 aa, Mycobacterium
INRNSATLE

SEQ ID NO: 507902 - protein, 7 aa, Mycobacterium
INRPGDH

SEQ ID NO: 507903 - protein, 7 aa, Mycobacterium
INRSGSE

SEQ ID NO: 507904 - protein, 10 aa, Mycobacterium
INRTPPKTQA

SEQ ID NO: 507905 - protein, 7 aa, Mycobacterium
INRYPDN

SEQ ID NO: 507906 - protein, 9 aa, Mycobacterium
INSAGSKAV

SEQ ID NO: 507907 - protein, 19 aa, Mycobacterium
INSAPDGGTRVHWTAPLGD

SEQ ID NO: 507908 - protein, 5 aa, Mycobacterium
INSAQ

SEQ ID NO: 507909 - protein, 22 aa, Mycobacterium
INSGAADKLERDAKKAIDEFGA

SEQ ID NO: 507910 - protein, 16 aa, Mycobacterium
INSGFGNAGNVNTGWA

SEQ ID NO: 507911 - protein, 11 aa, Mycobacterium
INSGKNPDVEV

SEQ ID NO: 507912 - protein, 10 aa, Mycobacterium
INSGKNPEVE

SEQ ID NO: 507913 - protein, 6 aa, Mycobacterium
INSGTA

SEQ ID NO: 507914 - protein, 6 aa, Mycobacterium
INSGTG

SEQ ID NO: 507915 - protein, 6 aa, Mycobacterium
INSGYQ

SEQ ID NO: 507916 - protein, 11 aa, Mycobacterium
INSPSAVTVAG

SEQ ID NO: 507917 - protein, 13 aa, Mycobacterium
INSRRSLSGRARA

SEQ ID NO: 507918 - protein, 9 aa, Mycobacterium
INSSGSKAV

SEQ ID NO: 507919 - protein, 7 aa, Mycobacterium
INTAATA

SEQ ID NO: 507920 - protein, 7 aa, Mycobacterium
INTASGA

SEQ ID NO: 507921 - protein, 9 aa, Mycobacterium
INTATSDAT

SEQ ID NO: 507922 - protein, 9 aa, Mycobacterium
INTATTSAS

SEQ ID NO: 507923 - protein, 5 aa, Mycobacterium
INTDG

SEQ ID NO: 507924 - protein, 7 aa, Mycobacterium
INTDTSS

SEQ ID NO: 507925 - protein, 4 aa, Mycobacterium
INTE

SEQ ID NO: 507926 - protein, 9 aa, Mycobacterium
INTGNGFSG

SEQ ID NO: 507927 - protein, 7 aa, Mycobacterium
INTGNGY

SEQ ID NO: 507928 - protein, 4 aa, Mycobacterium
INTN

SEQ ID NO: 507929 - protein, 6 aa, Mycobacterium
INTNGG

SEQ ID NO: 507930 - protein, 11 aa, Mycobacterium
INTPSEYGGAG

SEQ ID NO: 507931 - protein, 10 aa, Mycobacterium
INTSQPGVQR

SEQ ID NO: 507932 - protein, 10 aa, Mycobacterium
INTTSSSQKM

SEQ ID NO: 507933 - protein, 10 aa, Mycobacterium
INTVRGNRNR

SEQ ID NO: 507934 - protein, 9 aa, Mycobacterium
IPAAEGSAT

SEQ ID NO: 507935 - protein, 11 aa, Mycobacterium
IPAAGAAGGLP

SEQ ID NO: 507936 - protein, 10 aa, Mycobacterium
IPAANGVATA

SEQ ID NO: 507937 - protein, 15 aa, Mycobacterium
IPAAPTSFKAKPGQR

SEQ ID NO: 507938 - protein, 5 aa, Mycobacterium
IPAAT

SEQ ID NO: 507939 - protein, 48 aa, Mycobacterium
IPADAGGTVGAARKAQGARRTGERATQKPGQKSEKTARRSGTRRRTRG

SEQ ID NO: 507940 - protein, 6 aa, Mycobacterium
IPADEP

SEQ ID NO: 507941 - protein, 7 aa, Mycobacterium
IPADEPV

SEQ ID NO: 507942 - protein, 5 aa, Mycobacterium
IPADG

SEQ ID NO: 507943 - protein, 13 aa, Mycobacterium
IPADPERGEPGRC

SEQ ID NO: 507944 - protein, 7 aa, Mycobacterium
IPADPQG

SEQ ID NO: 507945 - protein, 14 aa, Mycobacterium
IPADTANLREGPDL

SEQ ID NO: 507946 - protein, 6 aa, Mycobacterium
IPADVR

SEQ ID NO: 507947 - protein, 10 aa, Mycobacterium
IPADVSDAAG

SEQ ID NO: 507948 - protein, 8 aa, Mycobacterium
IPAEASGS

SEQ ID NO: 507949 - protein, 5 aa, Mycobacterium
IPAEE

SEQ ID NO: 507950 - protein, 6 aa, Mycobacterium
IPAEEA

SEQ ID NO: 507951 - protein, 8 aa, Mycobacterium
IPAEEPPL

SEQ ID NO: 507952 - protein, 15 aa, Mycobacterium
IPAEGGTMRTGGQGE

SEQ ID NO: 507953 - protein, 6 aa, Mycobacterium
IPAETA

SEQ ID NO: 507954 - protein, 16 aa, Mycobacterium
IPAGDDVLDPDEPTYD

SEQ ID NO: 507955 - protein, 12 aa, Mycobacterium
IPAGDPDKGQLR

SEQ ID NO: 507956 - protein, 12 aa, Mycobacterium
IPAGDPGKGQLR

SEQ ID NO: 507957 - protein, 8 aa, Mycobacterium
IPAGDTSW

SEQ ID NO: 507958 - protein, 6 aa, Mycobacterium
IPAGNL

SEQ ID NO: 507959 - protein, 8 aa, Mycobacterium
IPAGPDAL

SEQ ID NO: 507960 - protein, 10 aa, Mycobacterium
IPAGPGGRLD

SEQ ID NO: 507961 - protein, 7 aa, Mycobacterium
IPAGQKY

SEQ ID NO: 507962 - protein, 8 aa, Mycobacterium
IPAGQNGF

SEQ ID NO: 507963 - protein, 5 aa, Mycobacterium
IPAGR

SEQ ID NO: 507964 - protein, 6 aa, Mycobacterium
IPAGRL

SEQ ID NO: 507965 - protein, 11 aa, Mycobacterium
IPAGRLGTGAD

SEQ ID NO: 507966 - protein, 8 aa, Mycobacterium
IPAGRTDA

SEQ ID NO: 507967 - protein, 17 aa, Mycobacterium
IPAGRTDDVALAPGTAR

SEQ ID NO: 507968 - protein, 6 aa, Mycobacterium
IPAGSG

SEQ ID NO: 507969 - protein, 15 aa, Mycobacterium
IPAGSGGNGGAGGAG

SEQ ID NO: 507970 - protein, 8 aa, Mycobacterium
IPAGSPGR

SEQ ID NO: 507971 - protein, 7 aa, Mycobacterium
IPAGTNV

SEQ ID NO: 507972 - protein, 11 aa, Mycobacterium
IPAGTQPGAVT

SEQ ID NO: 507973 - protein, 4 aa, Mycobacterium
IPAN

SEQ ID NO: 507974 - protein, 10 aa, Mycobacterium
IPANRPGRAV

SEQ ID NO: 507975 - protein, 9 aa, Mycobacterium
IPAPDGPGV

SEQ ID NO: 507976 - protein, 5 aa, Mycobacterium
IPAPE

SEQ ID NO: 507977 - protein, 12 aa, Mycobacterium
IPAPEAQQDSAG

SEQ ID NO: 507978 - protein, 5 aa, Mycobacterium
IPAPG

SEQ ID NO: 507979 - protein, 22 aa, Mycobacterium
IPAPGLGGLGAGRGGKDSQLAR

SEQ ID NO: 507980 - protein, 7 aa, Mycobacterium
IPAPGRA

SEQ ID NO: 507981 - protein, 8 aa, Mycobacterium
IPAPGTAN

SEQ ID NO: 507982 - protein, 5 aa, Mycobacterium
IPAPP

SEQ ID NO: 507983 - protein, 8 aa, Mycobacterium
IPAPPAVS

SEQ ID NO: 507984 - protein, 7 aa, Mycobacterium
IPAPRAV

SEQ ID NO: 507985 - protein, 7 aa, Mycobacterium
IPAPREG

SEQ ID NO: 507986 - protein, 9 aa, Mycobacterium
IPAPRERYR

SEQ ID NO: 507987 - protein, 8 aa, Mycobacterium
IPAPSSDT

SEQ ID NO: 507988 - protein, 8 aa, Mycobacterium
IPAPVNPW

SEQ ID NO: 507989 - protein, 5 aa, Mycobacterium
IPAQP

SEQ ID NO: 507990 - protein, 5 aa, Mycobacterium
IPARE

SEQ ID NO: 507991 - protein, 8 aa, Mycobacterium
IPARPPAD

SEQ ID NO: 507992 - protein, 21 aa, Mycobacterium
IPARPQIPGNLGAELQLTKIS

SEQ ID NO: 507993 - protein, 8 aa, Mycobacterium
IPARSAEF

SEQ ID NO: 507994 - protein, 10 aa, Mycobacterium
IPASATGSSK

SEQ ID NO: 507995 - protein, 5 aa, Mycobacterium
IPASE

SEQ ID NO: 507996 - protein, 18 aa, Mycobacterium
IPASRESAYPGGDELPQK

SEQ ID NO: 507997 - protein, 13 aa, Mycobacterium
IPASRESAYPLGG

SEQ ID NO: 507998 - protein, 10 aa, Mycobacterium
IPASSGKTHR

SEQ ID NO: 507999 - protein, 6 aa, Mycobacterium
IPASTN

SEQ ID NO: 508000 - protein, 12 aa, Mycobacterium
IPASTPEDLAET

SEQ ID NO: 508001 - protein, 12 aa, Mycobacterium
IPATADTSSQLT

SEQ ID NO: 508002 - protein, 9 aa, Mycobacterium
IPATDHSGR

SEQ ID NO: 508003 - protein, 9 aa, Mycobacterium
IPATDPRSV

SEQ ID NO: 508004 - protein, 11 aa, Mycobacterium
IPATPYPDARY

SEQ ID NO: 508005 - protein, 11 aa, Mycobacterium
IPATPYPDHRY

SEQ ID NO: 508006 - protein, 13 aa, Mycobacterium
IPATQKALKRSGL

SEQ ID NO: 508007 - protein, 7 aa, Mycobacterium
IPATTPA

SEQ ID NO: 508008 - protein, 8 aa, Mycobacterium
IPAYPSAE

SEQ ID NO: 508009 - protein, 5 aa, Mycobacterium
IPCGP

SEQ ID NO: 508010 - protein, 4 aa, Mycobacterium
IPDA

SEQ ID NO: 508011 - protein, 5 aa, Mycobacterium
IPDAA

SEQ ID NO: 508012 - protein, 11 aa, Mycobacterium
IPDADAALQPG

SEQ ID NO: 508013 - protein, 11 aa, Mycobacterium
IPDADAPLQPG

SEQ ID NO: 508014 - protein, 15 aa, Mycobacterium
IPDAPADQPDDAPVR

SEQ ID NO: 508015 - protein, 5 aa, Mycobacterium
IPDAQ

SEQ ID NO: 508016 - protein, 13 aa, Mycobacterium
IPDASGAAETAGW

SEQ ID NO: 508017 - protein, 6 aa, Mycobacterium
IPDDES

SEQ ID NO: 508018 - protein, 5 aa, Mycobacterium
IPDDS

SEQ ID NO: 508019 - protein, 6 aa, Mycobacterium
IPDDTV

SEQ ID NO: 508020 - protein, 9 aa, Mycobacterium
IPDDTVAPQ

SEQ ID NO: 508021 - protein, 10 aa, Mycobacterium
IPDDTVAPQE

SEQ ID NO: 508022 - protein, 9 aa, Mycobacterium
IPDDVRSEL

SEQ ID NO: 508023 - protein, 4 aa, Mycobacterium
IPDE

SEQ ID NO: 508024 - protein, 8 aa, Mycobacterium
IPDEAGEG

SEQ ID NO: 508025 - protein, 8 aa, Mycobacterium
IPDENGQM

SEQ ID NO: 508026 - protein, 11 aa, Mycobacterium
IPDERSDAEPA

SEQ ID NO: 508027 - protein, 5 aa, Mycobacterium
IPDGA

SEQ ID NO: 508028 - protein, 5 aa, Mycobacterium
IPDGG

SEQ ID NO: 508029 - protein, 10 aa, Mycobacterium
IPDGGGGSVE

SEQ ID NO: 508030 - protein, 6 aa, Mycobacterium
IPDGMR

SEQ ID NO: 508031 - protein, 44 aa, Mycobacterium
IPDGSKGKINGVYGEAKENDRQKRVESGETLEAAERESVDAGRS

SEQ ID NO: 508032 - protein, 7 aa, Mycobacterium
IPDGSYQ

SEQ ID NO: 508033 - protein, 4 aa, Mycobacterium
IPDH

SEQ ID NO: 508034 - protein, 27 aa, Mycobacterium
IPDHPTPPTFSKDNANKDGSGPDQYGI

SEQ ID NO: 508035 - protein, 11 aa, Mycobacterium
IPDIAEPTEMH

SEQ ID NO: 508036 - protein, 4 aa, Mycobacterium
IPDL

SEQ ID NO: 508037 - protein, 12 aa, Mycobacterium
IPDLPQQQPRDP

SEQ ID NO: 508038 - protein, 21 aa, Mycobacterium
IPDLSNNPTTFSAENDKMGPE

SEQ ID NO: 508039 - protein, 4 aa, Mycobacterium
IPDN

SEQ ID NO: 508040 - protein, 7 aa, Mycobacterium
IPDNPWR

SEQ ID NO: 508041 - protein, 4 aa, Mycobacterium
IPDP

SEQ ID NO: 508042 - protein, 9 aa, Mycobacterium
IPDPAAPDE

SEQ ID NO: 508043 - protein, 8 aa, Mycobacterium
IPDPAVGD

SEQ ID NO: 508044 - protein, 9 aa, Mycobacterium
IPDPDGGLT

SEQ ID NO: 508045 - protein, 9 aa, Mycobacterium
IPDPDNPDH

SEQ ID NO: 508046 - protein, 14 aa, Mycobacterium
IPDPDTPPGNAPPA

SEQ ID NO: 508047 - protein, 7 aa, Mycobacterium
IPDPGAT

SEQ ID NO: 508048 - protein, 7 aa, Mycobacterium
IPDPGTE

SEQ ID NO: 508049 - protein, 6 aa, Mycobacterium
IPDPGV

SEQ ID NO: 508050 - protein, 6 aa, Mycobacterium
IPDPLP

SEQ ID NO: 508051 - protein, 8 aa, Mycobacterium
IPDPPAPG

SEQ ID NO: 508052 - protein, 7 aa, Mycobacterium
IPDPPEH

SEQ ID NO: 508053 - protein, 8 aa, Mycobacterium
IPDPPPGG

SEQ ID NO: 508054 - protein, 11 aa, Mycobacterium
IPDPQMGDAVQ

SEQ ID NO: 508055 - protein, 19 aa, Mycobacterium
IPDPRERPADREDAARQKH

SEQ ID NO: 508056 - protein, 19 aa, Mycobacterium
IPDPRERPADREEAARQKH

SEQ ID NO: 508057 - protein, 19 aa, Mycobacterium
IPDPRERPSDREEAAREKH

SEQ ID NO: 508058 - protein, 19 aa, Mycobacterium
IPDPRERPSDREEAARQKH

SEQ ID NO: 508059 - protein, 18 aa, Mycobacterium
IPDPRERPSDREEAARQR

SEQ ID NO: 508060 - protein, 18 aa, Mycobacterium
IPDPRERPTDREEAARQK

SEQ ID NO: 508061 - protein, 10 aa, Mycobacterium
IPDPRRNAAR

SEQ ID NO: 508062 - protein, 6 aa, Mycobacterium
IPDPTV

SEQ ID NO: 508063 - protein, 6 aa, Mycobacterium
IPDQED

SEQ ID NO: 508064 - protein, 9 aa, Mycobacterium
IPDQTGRTA

SEQ ID NO: 508065 - protein, 4 aa, Mycobacterium
IPDR

SEQ ID NO: 508066 - protein, 6 aa, Mycobacterium
IPDRDD

SEQ ID NO: 508067 - protein, 6 aa, Mycobacterium
IPDRDL

SEQ ID NO: 508068 - protein, 6 aa, Mycobacterium
IPDRGG

SEQ ID NO: 508069 - protein, 10 aa, Mycobacterium
IPDRPGNKLA

SEQ ID NO: 508070 - protein, 11 aa, Mycobacterium
IPDRPRQDVEK

SEQ ID NO: 508071 - protein, 4 aa, Mycobacterium
IPDS

SEQ ID NO: 508072 - protein, 11 aa, Mycobacterium
IPDSAGESFEA

SEQ ID NO: 508073 - protein, 13 aa, Mycobacterium
IPDSARASFAPTE

SEQ ID NO: 508074 - protein, 5 aa, Mycobacterium
IPDSD

SEQ ID NO: 508075 - protein, 12 aa, Mycobacterium
IPDSDAADPSGL

SEQ ID NO: 508076 - protein, 5 aa, Mycobacterium
IPDSG

SEQ ID NO: 508077 - protein, 11 aa, Mycobacterium
IPDSGGPGLHR

SEQ ID NO: 508078 - protein, 9 aa, Mycobacterium
IPDSPTRPI

SEQ ID NO: 508079 - protein, 5 aa, Mycobacterium
IPDSQ

SEQ ID NO: 508080 - protein, 6 aa, Mycobacterium
IPDSTA

SEQ ID NO: 508081 - protein, 6 aa, Mycobacterium
IPDTDY

SEQ ID NO: 508082 - protein, 8 aa, Mycobacterium
IPDTESVG

SEQ ID NO: 508083 - protein, 6 aa, Mycobacterium
IPDTQY

SEQ ID NO: 508084 - protein, 19 aa, Mycobacterium
IPDVPGADAGAEGLPPRSA

SEQ ID NO: 508085 - protein, 17 aa, Mycobacterium
IPDYPADPKTDEEKALK

SEQ ID NO: 508086 - protein, 9 aa, Mycobacterium
IPDYVPPDS

SEQ ID NO: 508087 - protein, 8 aa, Mycobacterium
IPEAEKQR

SEQ ID NO: 508088 - protein, 6 aa, Mycobacterium
IPEAHR

SEQ ID NO: 508089 - protein, 8 aa, Mycobacterium
IPEAKRGA

SEQ ID NO: 508090 - protein, 6 aa, Mycobacterium
IPEAPP

SEQ ID NO: 508091 - protein, 5 aa, Mycobacterium
IPEAQ

SEQ ID NO: 508092 - protein, 4 aa, Mycobacterium
IPED

SEQ ID NO: 508093 - protein, 18 aa, Mycobacterium
IPEDDGAEKGTSYNKVRG

SEQ ID NO: 508094 - protein, 8 aa, Mycobacterium
IPEDEKPF

SEQ ID NO: 508095 - protein, 11 aa, Mycobacterium
IPEEPTPDSVA

SEQ ID NO: 508096 - protein, 11 aa, Mycobacterium
IPEEPTPDTIP

SEQ ID NO: 508097 - protein, 4 aa, Mycobacterium
IPEG

SEQ ID NO: 508098 - protein, 8 aa, Mycobacterium
IPEGEKID

SEQ ID NO: 508099 - protein, 10 aa, Mycobacterium
IPEGGGGSVE

SEQ ID NO: 508100 - protein, 5 aa, Mycobacterium
IPEGP

SEQ ID NO: 508101 - protein, 9 aa, Mycobacterium
IPEGSQGQL

SEQ ID NO: 508102 - protein, 8 aa, Mycobacterium
IPEGVDPA

SEQ ID NO: 508103 - protein, 8 aa, Mycobacterium
IPEGVRAQ

SEQ ID NO: 508104 - protein, 24 aa, Mycobacterium
IPENEHDLRGTTDRLYGGDQEHRI

SEQ ID NO: 508105 - protein, 5 aa, Mycobacterium
IPENP

SEQ ID NO: 508106 - protein, 17 aa, Mycobacterium
IPEPAPVDNPPGLGARD

SEQ ID NO: 508107 - protein, 7 aa, Mycobacterium
IPEPDGS

SEQ ID NO: 508108 - protein, 5 aa, Mycobacterium
IPEPE

SEQ ID NO: 508109 - protein, 8 aa, Mycobacterium
IPEPEAGS

SEQ ID NO: 508110 - protein, 8 aa, Mycobacterium
IPEPGPGE

SEQ ID NO: 508111 - protein, 7 aa, Mycobacterium
IPEPGRG

SEQ ID NO: 508112 - protein, 15 aa, Mycobacterium
IPEPQPIDDDGRDEY

SEQ ID NO: 508113 - protein, 8 aa, Mycobacterium
IPEPTGSS

SEQ ID NO: 508114 - protein, 8 aa, Mycobacterium
IPEPTIPD

SEQ ID NO: 508115 - protein, 24 aa, Mycobacterium
IPEQDGGALNTLPEPPAPVRPTET

SEQ ID NO: 508116 - protein, 25 aa, Mycobacterium
IPEQSSNGIQHRDSAARPIPEPASR

SEQ ID NO: 508117 - protein, 12 aa, Mycobacterium
IPERDAGDSVEA

SEQ ID NO: 508118 - protein, 6 aa, Mycobacterium
IPERDD

SEQ ID NO: 508119 - protein, 10 aa, Mycobacterium
IPERPAPDYD

SEQ ID NO: 508120 - protein, 11 aa, Mycobacterium
IPERPGNKRVD

SEQ ID NO: 508121 - protein, 13 aa, Mycobacterium
IPERQPHAKGGGA

SEQ ID NO: 508122 - protein, 14 aa, Mycobacterium
IPERQPHAKGGGAH

SEQ ID NO: 508123 - protein, 10 aa, Mycobacterium
IPERSDGDAF

SEQ ID NO: 508124 - protein, 18 aa, Mycobacterium
IPESDGAEKGTSYNKVRG

SEQ ID NO: 508125 - protein, 5 aa, Mycobacterium
IPESE

SEQ ID NO: 508126 - protein, 5 aa, Mycobacterium
IPESG

SEQ ID NO: 508127 - protein, 9 aa, Mycobacterium
IPESGAFEP

SEQ ID NO: 508128 - protein, 9 aa, Mycobacterium
IPESGEPRI

SEQ ID NO: 508129 - protein, 9 aa, Mycobacterium
IPESPENWR

SEQ ID NO: 508130 - protein, 8 aa, Mycobacterium
IPETGSIE

SEQ ID NO: 508131 - protein, 4 aa, Mycobacterium
IPEY

SEQ ID NO: 508132 - protein, 4 aa, Mycobacterium
IPFP

SEQ ID NO: 508133 - protein, 7 aa, Mycobacterium
IPFPPEP

SEQ ID NO: 508134 - protein, 14 aa, Mycobacterium
IPGAASSVAVPPTR

SEQ ID NO: 508135 - protein, 5 aa, Mycobacterium
IPGAD

SEQ ID NO: 508136 - protein, 11 aa, Mycobacterium
IPGAFTPDTPH

SEQ ID NO: 508137 - protein, 5 aa, Mycobacterium
IPGAG

SEQ ID NO: 508138 - protein, 8 aa, Mycobacterium
IPGAGGTQ

SEQ ID NO: 508139 - protein, 6 aa, Mycobacterium
IPGAPE

SEQ ID NO: 508140 - protein, 6 aa, Mycobacterium
IPGAPV

SEQ ID NO: 508141 - protein, 7 aa, Mycobacterium
IPGARGG

SEQ ID NO: 508142 - protein, 9 aa, Mycobacterium
IPGATMEQA

SEQ ID NO: 508143 - protein, 13 aa, Mycobacterium
IPGATNAPSTGVL

SEQ ID NO: 508144 - protein, 9 aa, Mycobacterium
IPGATNLPS

SEQ ID NO: 508145 - protein, 11 aa, Mycobacterium
IPGATPEKAGE

SEQ ID NO: 508146 - protein, 10 aa, Mycobacterium
IPGATVDEAG

SEQ ID NO: 508147 - protein, 11 aa, Mycobacterium
IPGATVDEAGE

SEQ ID NO: 508148 - protein, 4 aa, Mycobacterium
IPGD

SEQ ID NO: 508149 - protein, 11 aa, Mycobacterium
IPGDAGSAQPL

SEQ ID NO: 508150 - protein, 24 aa, Mycobacterium
IPGDDQPAGPQVTSSTSAAGGYDE

SEQ ID NO: 508151 - protein, 5 aa, Mycobacterium
IPGDG

SEQ ID NO: 508152 - protein, 8 aa, Mycobacterium
IPGEDGQL

SEQ ID NO: 508153 - protein, 9 aa, Mycobacterium
IPGEELPGS

SEQ ID NO: 508154 - protein, 8 aa, Mycobacterium
IPGEGGQL

SEQ ID NO: 508155 - protein, 9 aa, Mycobacterium
IPGENGEMR

SEQ ID NO: 508156 - protein, 6 aa, Mycobacterium
IPGEQR

SEQ ID NO: 508157 - protein, 11 aa, Mycobacterium
IPGGARPPLRG

SEQ ID NO: 508158 - protein, 5 aa, Mycobacterium
IPGGN

SEQ ID NO: 508159 - protein, 10 aa, Mycobacterium
IPGGNGEPTF

SEQ ID NO: 508160 - protein, 12 aa, Mycobacterium
IPGGNGGYGGDG

SEQ ID NO: 508161 - protein, 13 aa, Mycobacterium
IPGGPHGADPDEM

SEQ ID NO: 508162 - protein, 6 aa, Mycobacterium
IPGGQT

SEQ ID NO: 508163 - protein, 12 aa, Mycobacterium
IPGGSSGGTGAA

SEQ ID NO: 508164 - protein, 15 aa, Mycobacterium
IPGGSVTGTPGTVGG

SEQ ID NO: 508165 - protein, 11 aa, Mycobacterium
IPGHDERYAQA

SEQ ID NO: 508166 - protein, 6 aa, Mycobacterium
IPGHGT

SEQ ID NO: 508167 - protein, 11 aa, Mycobacterium
IPGHNPAHENL

SEQ ID NO: 508168 - protein, 16 aa, Mycobacterium
IPGITTDDPHDSDTAH

SEQ ID NO: 508169 - protein, 10 aa, Mycobacterium
IPGKAEPEDY

SEQ ID NO: 508170 - protein, 9 aa, Mycobacterium
IPGKEEFGE

SEQ ID NO: 508171 - protein, 8 aa, Mycobacterium
IPGKEEFN

SEQ ID NO: 508172 - protein, 9 aa, Mycobacterium
IPGKEEFNE

SEQ ID NO: 508173 - protein, 5 aa, Mycobacterium
IPGKP

SEQ ID NO: 508174 - protein, 6 aa, Mycobacterium
IPGKPR

SEQ ID NO: 508175 - protein, 11 aa, Mycobacterium
IPGLDNAPTKH

SEQ ID NO: 508176 - protein, 20 aa, Mycobacterium
IPGLSTPTAPATPPAPQIPQ

SEQ ID NO: 508177 - protein, 4 aa, Mycobacterium
IPGN

SEQ ID NO: 508178 - protein, 6 aa, Mycobacterium
IPGNAA

SEQ ID NO: 508179 - protein, 5 aa, Mycobacterium
IPGNE

SEQ ID NO: 508180 - protein, 13 aa, Mycobacterium
IPGNRGWQTPNPH

SEQ ID NO: 508181 - protein, 8 aa, Mycobacterium
IPGNSATQ

SEQ ID NO: 508182 - protein, 8 aa, Mycobacterium
IPGNTGDL

SEQ ID NO: 508183 - protein, 4 aa, Mycobacterium
IPGP

SEQ ID NO: 508184 - protein, 15 aa, Mycobacterium
IPGPAGLAAPAAPVG

SEQ ID NO: 508185 - protein, 8 aa, Mycobacterium
IPGPAGPI

SEQ ID NO: 508186 - protein, 22 aa, Mycobacterium
IPGPGPGGYKGAGEGGAIGSAP

SEQ ID NO: 508187 - protein, 22 aa, Mycobacterium
IPGPGPGGYKGAGEGGAIGSTP

SEQ ID NO: 508188 - protein, 20 aa, Mycobacterium
IPGPGPGGYKGVGEGGAIGS

SEQ ID NO: 508189 - protein, 23 aa, Mycobacterium
IPGPGVGGYKGAGEGGAIGSTPA

SEQ ID NO: 508190 - protein, 10 aa, Mycobacterium
IPGPPIPGEV

SEQ ID NO: 508191 - protein, 25 aa, Mycobacterium
IPGPRSRDLAERRNAALPAGLASGA

SEQ ID NO: 508192 - protein, 15 aa, Mycobacterium
IPGPTKVNPSGGALA

SEQ ID NO: 508193 - protein, 15 aa, Mycobacterium
IPGPTKVNPSGGPLA

SEQ ID NO: 508194 - protein, 9 aa, Mycobacterium
IPGQDTTSD

SEQ ID NO: 508195 - protein, 10 aa, Mycobacterium
IPGQGGTGHV

SEQ ID NO: 508196 - protein, 10 aa, Mycobacterium
IPGQRPDSAL

SEQ ID NO: 508197 - protein, 11 aa, Mycobacterium
IPGQRPDSTLG

SEQ ID NO: 508198 - protein, 4 aa, Mycobacterium
IPGR

SEQ ID NO: 508199 - protein, 5 aa, Mycobacterium
IPGRA

SEQ ID NO: 508200 - protein, 8 aa, Mycobacterium
IPGREAEL

SEQ ID NO: 508201 - protein, 6 aa, Mycobacterium
IPGREG

SEQ ID NO: 508202 - protein, 6 aa, Mycobacterium
IPGRKG

SEQ ID NO: 508203 - protein, 6 aa, Mycobacterium
IPGRPV

SEQ ID NO: 508204 - protein, 12 aa, Mycobacterium
IPGSAGATPVQN

SEQ ID NO: 508205 - protein, 5 aa, Mycobacterium
IPGSD

SEQ ID NO: 508206 - protein, 7 aa, Mycobacterium
IPGSDDG

SEQ ID NO: 508207 - protein, 7 aa, Mycobacterium
IPGSDQT

SEQ ID NO: 508208 - protein, 18 aa, Mycobacterium
IPGSEATAGRPAEPADRP

SEQ ID NO: 508209 - protein, 6 aa, Mycobacterium
IPGSEV

SEQ ID NO: 508210 - protein, 7 aa, Mycobacterium
IPGSPDP

SEQ ID NO: 508211 - protein, 8 aa, Mycobacterium
IPGSPSQQ

SEQ ID NO: 508212 - protein, 9 aa, Mycobacterium
IPGSPSQRH

SEQ ID NO: 508213 - protein, 8 aa, Mycobacterium
IPGSTGEV

SEQ ID NO: 508214 - protein, 8 aa, Mycobacterium
IPGTADAR

SEQ ID NO: 508215 - protein, 12 aa, Mycobacterium
IPGTAGATPVQN

SEQ ID NO: 508216 - protein, 15 aa, Mycobacterium
IPGTASGAGASGSSV

SEQ ID NO: 508217 - protein, 9 aa, Mycobacterium
IPGTHGEPG

SEQ ID NO: 508218 - protein, 8 aa, Mycobacterium
IPGTPQAI

SEQ ID NO: 508219 - protein, 15 aa, Mycobacterium
IPGTRSWEGKDRAER

SEQ ID NO: 508220 - protein, 6 aa, Mycobacterium
IPGTSS

SEQ ID NO: 508221 - protein, 13 aa, Mycobacterium
IPGTTNPTNPYTL

SEQ ID NO: 508222 - protein, 6 aa, Mycobacterium
IPGTVP

SEQ ID NO: 508223 - protein, 9 aa, Mycobacterium
IPGVDGPGA

SEQ ID NO: 508224 - protein, 5 aa, Mycobacterium
IPGVE

SEQ ID NO: 508225 - protein, 11 aa, Mycobacterium
IPGVGKSTTIE

SEQ ID NO: 508226 - protein, 6 aa, Mycobacterium
IPGVGP

SEQ ID NO: 508227 - protein, 5 aa, Mycobacterium
IPGVT

SEQ ID NO: 508228 - protein, 8 aa, Mycobacterium
IPGYPEAR

SEQ ID NO: 508229 - protein, 5 aa, Mycobacterium
IPHDE

SEQ ID NO: 508230 - protein, 5 aa, Mycobacterium
IPHDQ

SEQ ID NO: 508231 - protein, 4 aa, Mycobacterium
IPHS

SEQ ID NO: 508232 - protein, 37 aa, Mycobacterium
IPHSGSQATAPSSSVLAPPEHRSGRRRGHLRVLPDPS

SEQ ID NO: 508233 - protein, 5 aa, Mycobacterium
IPIPG

SEQ ID NO: 508234 - protein, 5 aa, Mycobacterium
IPIPT

SEQ ID NO: 508235 - protein, 14 aa, Mycobacterium
IPITTSGKIRRQSC

SEQ ID NO: 508236 - protein, 12 aa, Mycobacterium
IPITTSGKIRRS

SEQ ID NO: 508237 - protein, 10 aa, Mycobacterium
IPITTSGKVR

SEQ ID NO: 508238 - protein, 4 aa, Mycobacterium
IPKD

SEQ ID NO: 508239 - protein, 7 aa, Mycobacterium
IPKDQPA

SEQ ID NO: 508240 - protein, 15 aa, Mycobacterium
IPKEGAITLHVAVPD

SEQ ID NO: 508241 - protein, 10 aa, Mycobacterium
IPKGATGNTG

SEQ ID NO: 508242 - protein, 8 aa, Mycobacterium
IPKGEYGA

SEQ ID NO: 508243 - protein, 9 aa, Mycobacterium
IPKGEYGGG

SEQ ID NO: 508244 - protein, 6 aa, Mycobacterium
IPKGGT

SEQ ID NO: 508245 - protein, 10 aa, Mycobacterium
IPKGPAGNTG

SEQ ID NO: 508246 - protein, 7 aa, Mycobacterium
IPKHPEH

SEQ ID NO: 508247 - protein, 6 aa, Mycobacterium
IPKPGD

SEQ ID NO: 508248 - protein, 7 aa, Mycobacterium
IPKPGDY

SEQ ID NO: 508249 - protein, 10 aa, Mycobacterium
IPKPTQKPHP

SEQ ID NO: 508250 - protein, 9 aa, Mycobacterium
IPKTNPELV

SEQ ID NO: 508251 - protein, 14 aa, Mycobacterium
IPKTTSGKIRRSST

SEQ ID NO: 508252 - protein, 8 aa, Mycobacterium
IPLAPAGA

SEQ ID NO: 508253 - protein, 5 aa, Mycobacterium
IPLED

SEQ ID NO: 508254 - protein, 6 aa, Mycobacterium
IPLEDN

SEQ ID NO: 508255 - protein, 12 aa, Mycobacterium
IPLEGRKGNLLS

SEQ ID NO: 508256 - protein, 9 aa, Mycobacterium
IPLESPSAT

SEQ ID NO: 508257 - protein, 10 aa, Mycobacterium
IPLESPSDTV

SEQ ID NO: 508258 - protein, 4 aa, Mycobacterium
IPLP

SEQ ID NO: 508259 - protein, 7 aa, Mycobacterium
IPLPDDS

SEQ ID NO: 508260 - protein, 6 aa, Mycobacterium
IPLPDN

SEQ ID NO: 508261 - protein, 11 aa, Mycobacterium
IPMPDAPPKDT

SEQ ID NO: 508262 - protein, 7 aa, Mycobacterium
IPNAPDT

SEQ ID NO: 508263 - protein, 5 aa, Mycobacterium
IPNCP

SEQ ID NO: 508264 - protein, 66 aa, Mycobacterium
IPNDAASKARACANRAAGATANSGASLTTHASPTTEATADRTTSTTADRTTSLATNTGTNTDASLT

SEQ ID NO: 508265 - protein, 6 aa, Mycobacterium
IPNDAQ

SEQ ID NO: 508266 - protein, 11 aa, Mycobacterium
IPNDRRPTDDE

SEQ ID NO: 508267 - protein, 6 aa, Mycobacterium
IPNDSP

SEQ ID NO: 508268 - protein, 4 aa, Mycobacterium
IPNE

SEQ ID NO: 508269 - protein, 4 aa, Mycobacterium
IPNG

SEQ ID NO: 508270 - protein, 5 aa, Mycobacterium
IPNGA

SEQ ID NO: 508271 - protein, 5 aa, Mycobacterium
IPNGI

SEQ ID NO: 508272 - protein, 6 aa, Mycobacterium
IPNGMS

SEQ ID NO: 508273 - protein, 9 aa, Mycobacterium
IPNGNGGSI

SEQ ID NO: 508274 - protein, 15 aa, Mycobacterium
IPNGSAGRRGSANAL

SEQ ID NO: 508275 - protein, 7 aa, Mycobacterium
IPNKQRA

SEQ ID NO: 508276 - protein, 11 aa, Mycobacterium
IPNPGGLSEHP

SEQ ID NO: 508277 - protein, 8 aa, Mycobacterium
IPNPLRGQ

SEQ ID NO: 508278 - protein, 4 aa, Mycobacterium
IPNQ

SEQ ID NO: 508279 - protein, 9 aa, Mycobacterium
IPNRAAAEK

SEQ ID NO: 508280 - protein, 23 aa, Mycobacterium
IPNREGQWAQQAEAELPTRRHRE

SEQ ID NO: 508281 - protein, 6 aa, Mycobacterium
IPNTAG

SEQ ID NO: 508282 - protein, 14 aa, Mycobacterium
IPNTAGRVQGSSNE

SEQ ID NO: 508283 - protein, 7 aa, Mycobacterium
IPNTSGL

SEQ ID NO: 508284 - protein, 6 aa, Mycobacterium
IPPADE

SEQ ID NO: 508285 - protein, 5 aa, Mycobacterium
IPPAL

SEQ ID NO: 508286 - protein, 17 aa, Mycobacterium
IPPANDSHGATTPGEGR

SEQ ID NO: 508287 - protein, 11 aa, Mycobacterium
IPPAPAAMSPV

SEQ ID NO: 508288 - protein, 15 aa, Mycobacterium
IPPAPSVPGRRPKPT

SEQ ID NO: 508289 - protein, 7 aa, Mycobacterium
IPPAQAY

SEQ ID NO: 508290 - protein, 10 aa, Mycobacterium
IPPAQSPNEE

SEQ ID NO: 508291 - protein, 5 aa, Mycobacterium
IPPAR

SEQ ID NO: 508292 - protein, 13 aa, Mycobacterium
IPPARETQTERPD

SEQ ID NO: 508293 - protein, 17 aa, Mycobacterium
IPPARGGDGGNGGDGGD

SEQ ID NO: 508294 - protein, 30 aa, Mycobacterium
IPPASPVGAEKPATTPGCPATENVGATRPA

SEQ ID NO: 508295 - protein, 12 aa, Mycobacterium
IPPATTEALRTD

SEQ ID NO: 508296 - protein, 28 aa, Mycobacterium
IPPDGNGNGDGSGKGKGKRKGNSDGGGK

SEQ ID NO: 508297 - protein, 7 aa, Mycobacterium
IPPDPEG

SEQ ID NO: 508298 - protein, 9 aa, Mycobacterium
IPPDRATDG

SEQ ID NO: 508299 - protein, 11 aa, Mycobacterium
IPPEDNRPIYS

SEQ ID NO: 508300 - protein, 9 aa, Mycobacterium
IPPEGDDLH

SEQ ID NO: 508301 - protein, 6 aa, Mycobacterium
IPPEIN

SEQ ID NO: 508302 - protein, 8 aa, Mycobacterium
IPPEPGSA

SEQ ID NO: 508303 - protein, 13 aa, Mycobacterium
IPPEQSTAKPTLP

SEQ ID NO: 508304 - protein, 28 aa, Mycobacterium
IPPEQVTGKPRPPEAKAPDDPSWPPIPA

SEQ ID NO: 508305 - protein, 5 aa, Mycobacterium
IPPER

SEQ ID NO: 508306 - protein, 8 aa, Mycobacterium
IPPERDAV

SEQ ID NO: 508307 - protein, 6 aa, Mycobacterium
IPPETA

SEQ ID NO: 508308 - protein, 11 aa, Mycobacterium
IPPETYNNAAQ

SEQ ID NO: 508309 - protein, 10 aa, Mycobacterium
IPPEVKTGKK

SEQ ID NO: 508310 - protein, 6 aa, Mycobacterium
IPPEVN

SEQ ID NO: 508311 - protein, 6 aa, Mycobacterium
IPPEWE

SEQ ID NO: 508312 - protein, 6 aa, Mycobacterium
IPPFNQ

SEQ ID NO: 508313 - protein, 5 aa, Mycobacterium
IPPGA

SEQ ID NO: 508314 - protein, 50 aa, Mycobacterium
IPPGAEPDPGTPIVGPPPPGVVPGPGPLPNKQPAYDPPPPNDNGPPPPFT

SEQ ID NO: 508315 - protein, 6 aa, Mycobacterium
IPPGAK

SEQ ID NO: 508316 - protein, 7 aa, Mycobacterium
IPPGGAA

SEQ ID NO: 508317 - protein, 7 aa, Mycobacterium
IPPGGAQ

SEQ ID NO: 508318 - protein, 6 aa, Mycobacterium
IPPGNL

SEQ ID NO: 508319 - protein, 6 aa, Mycobacterium
IPPGSG

SEQ ID NO: 508320 - protein, 7 aa, Mycobacterium
IPPGSGP

SEQ ID NO: 508321 - protein, 8 aa, Mycobacterium
IPPGSSRS

SEQ ID NO: 508322 - protein, 17 aa, Mycobacterium
IPPGTARCSGGSARTVC

SEQ ID NO: 508323 - protein, 8 aa, Mycobacterium
IPPGTTPA

SEQ ID NO: 508324 - protein, 5 aa, Mycobacterium
IPPHN

SEQ ID NO: 508325 - protein, 9 aa, Mycobacterium
IPPKTELEK

SEQ ID NO: 508326 - protein, 4 aa, Mycobacterium
IPPL

SEQ ID NO: 508327 - protein, 5 aa, Mycobacterium
IPPNG

SEQ ID NO: 508328 - protein, 5 aa, Mycobacterium
IPPNS

SEQ ID NO: 508329 - protein, 11 aa, Mycobacterium
IPPPEGGLTSY

SEQ ID NO: 508330 - protein, 16 aa, Mycobacterium
IPPPGTPVSDPIDPAR

SEQ ID NO: 508331 - protein, 7 aa, Mycobacterium
IPPPKGG

SEQ ID NO: 508332 - protein, 50 aa, Mycobacterium
IPPPPTDPTGPGGAPIPPPPSDPSGPAQAASATDAPAGTVNKATAAAAAA

SEQ ID NO: 508333 - protein, 12 aa, Mycobacterium
IPPPQGDPDAPA

SEQ ID NO: 508334 - protein, 17 aa, Mycobacterium
IPPPTPRRSLADVFEIR

SEQ ID NO: 508335 - protein, 12 aa, Mycobacterium
IPPPTRAGAELA

SEQ ID NO: 508336 - protein, 4 aa, Mycobacterium
IPPQ

SEQ ID NO: 508337 - protein, 17 aa, Mycobacterium
IPPQAAPAVQGGTYTEV

SEQ ID NO: 508338 - protein, 7 aa, Mycobacterium
IPPQADA

SEQ ID NO: 508339 - protein, 5 aa, Mycobacterium
IPPQH

SEQ ID NO: 508340 - protein, 17 aa, Mycobacterium
IPPQSAPAVAGGTYQEV

SEQ ID NO: 508341 - protein, 5 aa, Mycobacterium
IPPRQ

SEQ ID NO: 508342 - protein, 17 aa, Mycobacterium
IPPRQGHTPLGHEPAGE

SEQ ID NO: 508343 - protein, 7 aa, Mycobacterium
IPPRQGR

SEQ ID NO: 508344 - protein, 9 aa, Mycobacterium
IPPRTKDPF

SEQ ID NO: 508345 - protein, 14 aa, Mycobacterium
IPPSLNHAGPDPEV

SEQ ID NO: 508346 - protein, 13 aa, Mycobacterium
IPPSWATATPSVR

SEQ ID NO: 508347 - protein, 4 aa, Mycobacterium
IPPT

SEQ ID NO: 508348 - protein, 10 aa, Mycobacterium
IPPTAQNQAA

SEQ ID NO: 508349 - protein, 5 aa, Mycobacterium
IPPTE

SEQ ID NO: 508350 - protein, 32 aa, Mycobacterium
IPPTGGAGGTPDVNTAELTSAGREAASNLSKG

SEQ ID NO: 508351 - protein, 7 aa, Mycobacterium
IPPTGSR

SEQ ID NO: 508352 - protein, 8 aa, Mycobacterium
IPPTGSTV

SEQ ID NO: 508353 - protein, 5 aa, Mycobacterium
IPPTI

SEQ ID NO: 508354 - protein, 16 aa, Mycobacterium
IPPTPASHTEASHQRE

SEQ ID NO: 508355 - protein, 16 aa, Mycobacterium
IPPTPTVRTQTSDHRE

SEQ ID NO: 508356 - protein, 5 aa, Mycobacterium
IPPTQ

SEQ ID NO: 508357 - protein, 7 aa, Mycobacterium
IPPTQRG

SEQ ID NO: 508358 - protein, 5 aa, Mycobacterium
IPPTR

SEQ ID NO: 508359 - protein, 11 aa, Mycobacterium
IPPTSQNQAAI

SEQ ID NO: 508360 - protein, 12 aa, Mycobacterium
IPPTSQNQAAIE

SEQ ID NO: 508361 - protein, 8 aa, Mycobacterium
IPPTTTGE

SEQ ID NO: 508362 - protein, 5 aa, Mycobacterium
IPPTV

SEQ ID NO: 508363 - protein, 6 aa, Mycobacterium
IPPVPP

SEQ ID NO: 508364 - protein, 7 aa, Mycobacterium
IPPVPPH

SEQ ID NO: 508365 - protein, 5 aa, Mycobacterium
IPPVS

SEQ ID NO: 508366 - protein, 5 aa, Mycobacterium
IPQDA

SEQ ID NO: 508367 - protein, 7 aa, Mycobacterium
IPQDGSQ

SEQ ID NO: 508368 - protein, 5 aa, Mycobacterium
IPQED

SEQ ID NO: 508369 - protein, 4 aa, Mycobacterium
IPQG

SEQ ID NO: 508370 - protein, 9 aa, Mycobacterium
IPQGDDGKP

SEQ ID NO: 508371 - protein, 4 aa, Mycobacterium
IPQK

SEQ ID NO: 508372 - protein, 11 aa, Mycobacterium
IPQNGEPRTGL

SEQ ID NO: 508373 - protein, 8 aa, Mycobacterium
IPQPDTVR

SEQ ID NO: 508374 - protein, 7 aa, Mycobacterium
IPQPEKL

SEQ ID NO: 508375 - protein, 7 aa, Mycobacterium
IPQPESR

SEQ ID NO: 508376 - protein, 5 aa, Mycobacterium
IPQPG

SEQ ID NO: 508377 - protein, 12 aa, Mycobacterium
IPQPSAARPGIP

SEQ ID NO: 508378 - protein, 4 aa, Mycobacterium
IPQQ

SEQ ID NO: 508379 - protein, 8 aa, Mycobacterium
IPQQGHSV

SEQ ID NO: 508380 - protein, 9 aa, Mycobacterium
IPQREHEPH

SEQ ID NO: 508381 - protein, 11 aa, Mycobacterium
IPQREHEPRHE

SEQ ID NO: 508382 - protein, 6 aa, Mycobacterium
IPQRGV

SEQ ID NO: 508383 - protein, 8 aa, Mycobacterium
IPQRRTDR

SEQ ID NO: 508384 - protein, 8 aa, Mycobacterium
IPQRTDPD

SEQ ID NO: 508385 - protein, 4 aa, Mycobacterium
IPQS

SEQ ID NO: 508386 - protein, 8 aa, Mycobacterium
IPQSAGKS

SEQ ID NO: 508387 - protein, 15 aa, Mycobacterium
IPQSPVPELPTPTLP

SEQ ID NO: 508388 - protein, 11 aa, Mycobacterium
IPRADAQSAAA

SEQ ID NO: 508389 - protein, 15 aa, Mycobacterium
IPRADAQSAAAAAAI

SEQ ID NO: 508390 - protein, 16 aa, Mycobacterium
IPRADGPRQKSPSMAA

SEQ ID NO: 508391 - protein, 4 aa, Mycobacterium
IPRE

SEQ ID NO: 508392 - protein, 5 aa, Mycobacterium
IPRES

SEQ ID NO: 508393 - protein, 10 aa, Mycobacterium
IPRESGERED

SEQ ID NO: 508394 - protein, 4 aa, Mycobacterium
IPRG

SEQ ID NO: 508395 - protein, 8 aa, Mycobacterium
IPRGDTSV

SEQ ID NO: 508396 - protein, 8 aa, Mycobacterium
IPRGEQAG

SEQ ID NO: 508397 - protein, 7 aa, Mycobacterium
IPRGGAQ

SEQ ID NO: 508398 - protein, 6 aa, Mycobacterium
IPRGLG

SEQ ID NO: 508399 - protein, 6 aa, Mycobacterium
IPRGRQ

SEQ ID NO: 508400 - protein, 7 aa, Mycobacterium
IPRGVGT

SEQ ID NO: 508401 - protein, 11 aa, Mycobacterium
IPRKPNGKVDG

SEQ ID NO: 508402 - protein, 14 aa, Mycobacterium
IPRKPNGKVDKDGL

SEQ ID NO: 508403 - protein, 5 aa, Mycobacterium
IPRNP

SEQ ID NO: 508404 - protein, 15 aa, Mycobacterium
IPRNPAGKVVRKELS

SEQ ID NO: 508405 - protein, 15 aa, Mycobacterium
IPRNPTGKVLRRELS

SEQ ID NO: 508406 - protein, 7 aa, Mycobacterium
IPRPAPV

SEQ ID NO: 508407 - protein, 8 aa, Mycobacterium
IPRPASAG

SEQ ID NO: 508408 - protein, 5 aa, Mycobacterium
IPRPE

SEQ ID NO: 508409 - protein, 6 aa, Mycobacterium
IPRPET

SEQ ID NO: 508410 - protein, 9 aa, Mycobacterium
IPRPGGEAV

SEQ ID NO: 508411 - protein, 9 aa, Mycobacterium
IPRPPTPAL

SEQ ID NO: 508412 - protein, 11 aa, Mycobacterium
IPRQAAPMRPQ

SEQ ID NO: 508413 - protein, 12 aa, Mycobacterium
IPRQGASYQRQR

SEQ ID NO: 508414 - protein, 12 aa, Mycobacterium
IPRRGASYQRQR

SEQ ID NO: 508415 - protein, 20 aa, Mycobacterium
IPRRPRPRHAHGGGVGRSAR

SEQ ID NO: 508416 - protein, 7 aa, Mycobacterium
IPRRSPQ

SEQ ID NO: 508417 - protein, 6 aa, Mycobacterium
IPRTAR

SEQ ID NO: 508418 - protein, 12 aa, Mycobacterium
IPRTPVEPTGES

SEQ ID NO: 508419 - protein, 29 aa, Mycobacterium
IPRTSVGKYDKKTIRSRYAEGGYDVVEVH

SEQ ID NO: 508420 - protein, 24 aa, Mycobacterium
IPSAANGGEGRPSKPVKVTSAERG

SEQ ID NO: 508421 - protein, 5 aa, Mycobacterium
IPSAI

SEQ ID NO: 508422 - protein, 5 aa, Mycobacterium
IPSAN

SEQ ID NO: 508423 - protein, 11 aa, Mycobacterium
IPSAQAQAQAY

SEQ ID NO: 508424 - protein, 4 aa, Mycobacterium
IPSD

SEQ ID NO: 508425 - protein, 18 aa, Mycobacterium
IPSDPEAALPDFMRPGPS

SEQ ID NO: 508426 - protein, 6 aa, Mycobacterium
IPSDRP

SEQ ID NO: 508427 - protein, 8 aa, Mycobacterium
IPSDVGED

SEQ ID NO: 508428 - protein, 11 aa, Mycobacterium
IPSEERTAAIA

SEQ ID NO: 508429 - protein, 6 aa, Mycobacterium
IPSERA

SEQ ID NO: 508430 - protein, 12 aa, Mycobacterium
IPSESRDEARLA

SEQ ID NO: 508431 - protein, 11 aa, Mycobacterium
IPSESRNEARI

SEQ ID NO: 508432 - protein, 11 aa, Mycobacterium
IPSESRNEARL

SEQ ID NO: 508433 - protein, 5 aa, Mycobacterium
IPSGG

SEQ ID NO: 508434 - protein, 11 aa, Mycobacterium
IPSGPSGSPLR

SEQ ID NO: 508435 - protein, 8 aa, Mycobacterium
IPSGRPVS

SEQ ID NO: 508436 - protein, 6 aa, Mycobacterium
IPSGTA

SEQ ID NO: 508437 - protein, 6 aa, Mycobacterium
IPSHDA

SEQ ID NO: 508438 - protein, 39 aa, Mycobacterium
IPSLGGGGGGGLGDLGSAIGGALRDGGHDPDQASDEHVD

SEQ ID NO: 508439 - protein, 5 aa, Mycobacterium
IPSNN

SEQ ID NO: 508440 - protein, 5 aa, Mycobacterium
IPSPA

SEQ ID NO: 508441 - protein, 6 aa, Mycobacterium
IPSPAD

SEQ ID NO: 508442 - protein, 6 aa, Mycobacterium
IPSPHD

SEQ ID NO: 508443 - protein, 6 aa, Mycobacterium
IPSPQQ

SEQ ID NO: 508444 - protein, 5 aa, Mycobacterium
IPSPT

SEQ ID NO: 508445 - protein, 6 aa, Mycobacterium
IPSQHS

SEQ ID NO: 508446 - protein, 6 aa, Mycobacterium
IPSRDA

SEQ ID NO: 508447 - protein, 7 aa, Mycobacterium
IPSRDIK

SEQ ID NO: 508448 - protein, 7 aa, Mycobacterium
IPSRNPM

SEQ ID NO: 508449 - protein, 7 aa, Mycobacterium
IPSRTPR

SEQ ID NO: 508450 - protein, 4 aa, Mycobacterium
IPSS

SEQ ID NO: 508451 - protein, 7 aa, Mycobacterium
IPSSDHG

SEQ ID NO: 508452 - protein, 25 aa, Mycobacterium
IPSSGGAQPQSSTESGGPASHDYTD

SEQ ID NO: 508453 - protein, 4 aa, Mycobacterium
IPST

SEQ ID NO: 508454 - protein, 12 aa, Mycobacterium
IPSTEAARRGSR

SEQ ID NO: 508455 - protein, 10 aa, Mycobacterium
IPSYPSNNGA

SEQ ID NO: 508456 - protein, 11 aa, Mycobacterium
IPTAGAAGFEA

SEQ ID NO: 508457 - protein, 11 aa, Mycobacterium
IPTAGAPGFEA

SEQ ID NO: 508458 - protein, 14 aa, Mycobacterium
IPTAGAVAEEPAGR

SEQ ID NO: 508459 - protein, 9 aa, Mycobacterium
IPTASAPPV

SEQ ID NO: 508460 - protein, 6 aa, Mycobacterium
IPTASR

SEQ ID NO: 508461 - protein, 4 aa, Mycobacterium
IPTD

SEQ ID NO: 508462 - protein, 103 aa, Mycobacterium
IPTDATGTVGKPAKRATKASDEDEHRISSADRPARTRTRSRRRTRGGKPLTGHPESHPEAHPESASAAPEDTEAAPAGESEAGEQTTRRRRRRRPRKTEAATA

SEQ ID NO: 508463 - protein, 12 aa, Mycobacterium
IPTDGGTAAAGG

SEQ ID NO: 508464 - protein, 9 aa, Mycobacterium
IPTDGPAGG

SEQ ID NO: 508465 - protein, 5 aa, Mycobacterium
IPTDS

SEQ ID NO: 508466 - protein, 102 aa, Mycobacterium
IPTEAGGSIGKPARSADKPKREPREPRAERPARDRTRRRTRGGQSVSGHPEGTPDAADTSSSEASDSDSAGDGAPRPARRRRRRRPNKATAAGTSAGTSAGT

SEQ ID NO: 508467 - protein, 6 aa, Mycobacterium
IPTEAP

SEQ ID NO: 508468 - protein, 16 aa, Mycobacterium
IPTEDGPSADDEQETA

SEQ ID NO: 508469 - protein, 11 aa, Mycobacterium
IPTEDGQPSNL

SEQ ID NO: 508470 - protein, 5 aa, Mycobacterium
IPTEE

SEQ ID NO: 508471 - protein, 5 aa, Mycobacterium
IPTEP

SEQ ID NO: 508472 - protein, 8 aa, Mycobacterium
IPTGDETN

SEQ ID NO: 508473 - protein, 10 aa, Mycobacterium
IPTGDPEAAA

SEQ ID NO: 508474 - protein, 5 aa, Mycobacterium
IPTGF

SEQ ID NO: 508475 - protein, 5 aa, Mycobacterium
IPTGG

SEQ ID NO: 508476 - protein, 6 aa, Mycobacterium
IPTGGD

SEQ ID NO: 508477 - protein, 10 aa, Mycobacterium
IPTGHSGDEV

SEQ ID NO: 508478 - protein, 10 aa, Mycobacterium
IPTGNSANFA

SEQ ID NO: 508479 - protein, 5 aa, Mycobacterium
IPTGP

SEQ ID NO: 508480 - protein, 7 aa, Mycobacterium
IPTGPGV

SEQ ID NO: 508481 - protein, 12 aa, Mycobacterium
IPTGRGPAAPPL

SEQ ID NO: 508482 - protein, 9 aa, Mycobacterium
IPTGSATDL

SEQ ID NO: 508483 - protein, 6 aa, Mycobacterium
IPTGTT

SEQ ID NO: 508484 - protein, 4 aa, Mycobacterium
IPTI

SEQ ID NO: 508485 - protein, 7 aa, Mycobacterium
IPTKAPG

SEQ ID NO: 508486 - protein, 35 aa, Mycobacterium
IPTLPPPAAKKRSRRSTAADRDEPTAPDAQTAATG

SEQ ID NO: 508487 - protein, 11 aa, Mycobacterium
IPTLPSGKFDR

SEQ ID NO: 508488 - protein, 11 aa, Mycobacterium
IPTLPSGKLNR

SEQ ID NO: 508489 - protein, 4 aa, Mycobacterium
IPTN

SEQ ID NO: 508490 - protein, 5 aa, Mycobacterium
IPTND

SEQ ID NO: 508491 - protein, 4 aa, Mycobacterium
IPTP

SEQ ID NO: 508492 - protein, 5 aa, Mycobacterium
IPTPA

SEQ ID NO: 508493 - protein, 5 aa, Mycobacterium
IPTPD

SEQ ID NO: 508494 - protein, 13 aa, Mycobacterium
IPTPENLDDASAA

SEQ ID NO: 508495 - protein, 6 aa, Mycobacterium
IPTPGF

SEQ ID NO: 508496 - protein, 9 aa, Mycobacterium
IPTPGHTSG

SEQ ID NO: 508497 - protein, 5 aa, Mycobacterium
IPTPL

SEQ ID NO: 508498 - protein, 6 aa, Mycobacterium
IPTPRA

SEQ ID NO: 508499 - protein, 15 aa, Mycobacterium
IPTPYGGPQLPIEPP

SEQ ID NO: 508500 - protein, 5 aa, Mycobacterium
IPTQD

SEQ ID NO: 508501 - protein, 5 aa, Mycobacterium
IPTQH

SEQ ID NO: 508502 - protein, 10 aa, Mycobacterium
IPTQRRAEAR

SEQ ID NO: 508503 - protein, 4 aa, Mycobacterium
IPTR

SEQ ID NO: 508504 - protein, 6 aa, Mycobacterium
IPTRDD

SEQ ID NO: 508505 - protein, 12 aa, Mycobacterium
IPTRVGGRQPAH

SEQ ID NO: 508506 - protein, 10 aa, Mycobacterium
IPTSDEDDTL

SEQ ID NO: 508507 - protein, 6 aa, Mycobacterium
IPTTEV

SEQ ID NO: 508508 - protein, 6 aa, Mycobacterium
IPTTGA

SEQ ID NO: 508509 - protein, 12 aa, Mycobacterium
IPTTSSGKIRRN

SEQ ID NO: 508510 - protein, 26 aa, Mycobacterium
IPTTTAARIEARSNPWDPETEPGEAD

SEQ ID NO: 508511 - protein, 13 aa, Mycobacterium
IPTTTSGKVRRSA

SEQ ID NO: 508512 - protein, 12 aa, Mycobacterium
IPTYPRPLSAEE

SEQ ID NO: 508513 - protein, 7 aa, Mycobacterium
IPTYTEK

SEQ ID NO: 508514 - protein, 4 aa, Mycobacterium
IPVA

SEQ ID NO: 508515 - protein, 6 aa, Mycobacterium
IPVAEG

SEQ ID NO: 508516 - protein, 6 aa, Mycobacterium
IPVDPE

SEQ ID NO: 508517 - protein, 13 aa, Mycobacterium
IPVDRSAGAGAYA

SEQ ID NO: 508518 - protein, 12 aa, Mycobacterium
IPVDRSAGHGAY

SEQ ID NO: 508519 - protein, 5 aa, Mycobacterium
IPVDT

SEQ ID NO: 508520 - protein, 9 aa, Mycobacterium
IPVESPAET

SEQ ID NO: 508521 - protein, 10 aa, Mycobacterium
IPVGTQGGSL

SEQ ID NO: 508522 - protein, 24 aa, Mycobacterium
IPVNPEDGRRQGKYSWAKSPRYAV

SEQ ID NO: 508523 - protein, 4 aa, Mycobacterium
IPVP

SEQ ID NO: 508524 - protein, 7 aa, Mycobacterium
IPVPESV

SEQ ID NO: 508525 - protein, 6 aa, Mycobacterium
IPVPGP

SEQ ID NO: 508526 - protein, 10 aa, Mycobacterium
IPVPRSQVRP

SEQ ID NO: 508527 - protein, 11 aa, Mycobacterium
IPVPTDEEGLD

SEQ ID NO: 508528 - protein, 13 aa, Mycobacterium
IPVPTGPRPDITR

SEQ ID NO: 508529 - protein, 9 aa, Mycobacterium
IPVQSPTAT

SEQ ID NO: 508530 - protein, 4 aa, Mycobacterium
IPVS

SEQ ID NO: 508531 - protein, 24 aa, Mycobacterium
IPVSPHPRSTPPQHPAPPQHRERA

SEQ ID NO: 508532 - protein, 4 aa, Mycobacterium
IPVT

SEQ ID NO: 508533 - protein, 9 aa, Mycobacterium
IPVTETPGA

SEQ ID NO: 508534 - protein, 12 aa, Mycobacterium
IPVTTSGKVRRS

SEQ ID NO: 508535 - protein, 29 aa, Mycobacterium
IPVTTSGKVRRSSCAERYRNDGFTRLDRS

SEQ ID NO: 508536 - protein, 5 aa, Mycobacterium
IPYAG

SEQ ID NO: 508537 - protein, 5 aa, Mycobacterium
IPYEE

SEQ ID NO: 508538 - protein, 12 aa, Mycobacterium
IPYGDGGATHAS

SEQ ID NO: 508539 - protein, 10 aa, Mycobacterium
IPYGGGSSVV

SEQ ID NO: 508540 - protein, 8 aa, Mycobacterium
IPYPSAGA

SEQ ID NO: 508541 - protein, 9 aa, Mycobacterium
IPYPTAGER

SEQ ID NO: 508542 - protein, 6 aa, Mycobacterium
IPYTAK

SEQ ID NO: 508543 - protein, 8 aa, Mycobacterium
IQADGGAA

SEQ ID NO: 508544 - protein, 4 aa, Mycobacterium
IQAG

SEQ ID NO: 508545 - protein, 9 aa, Mycobacterium
IQAGDPAYV

SEQ ID NO: 508546 - protein, 5 aa, Mycobacterium
IQAGG

SEQ ID NO: 508547 - protein, 31 aa, Mycobacterium
IQAGKDAARAAATPAISSEAAALSSAGARPA

SEQ ID NO: 508548 - protein, 5 aa, Mycobacterium
IQAPE

SEQ ID NO: 508549 - protein, 7 aa, Mycobacterium
IQARSGL

SEQ ID NO: 508550 - protein, 7 aa, Mycobacterium
IQASAAA

SEQ ID NO: 508551 - protein, 9 aa, Mycobacterium
IQASPAGAQ

SEQ ID NO: 508552 - protein, 6 aa, Mycobacterium
IQASPD

SEQ ID NO: 508553 - protein, 13 aa, Mycobacterium
IQASTHQPVTGLH

SEQ ID NO: 508554 - protein, 5 aa, Mycobacterium
IQATG

SEQ ID NO: 508555 - protein, 9 aa, Mycobacterium
IQATPDGNT

SEQ ID NO: 508556 - protein, 7 aa, Mycobacterium
IQATPEL

SEQ ID NO: 508557 - protein, 9 aa, Mycobacterium
IQDASTPDE

SEQ ID NO: 508558 - protein, 13 aa, Mycobacterium
IQDETGVKPPWAA

SEQ ID NO: 508559 - protein, 4 aa, Mycobacterium
IQDG

SEQ ID NO: 508560 - protein, 13 aa, Mycobacterium
IQDGPGASSDRSQ

SEQ ID NO: 508561 - protein, 7 aa, Mycobacterium
IQDGTKL

SEQ ID NO: 508562 - protein, 5 aa, Mycobacterium
IQDPA

SEQ ID NO: 508563 - protein, 10 aa, Mycobacterium
IQDPDQRAAL

SEQ ID NO: 508564 - protein, 7 aa, Mycobacterium
IQDPRVT

SEQ ID NO: 508565 - protein, 9 aa, Mycobacterium
IQDSDGEWH

SEQ ID NO: 508566 - protein, 11 aa, Mycobacterium
IQEAREACGGA

SEQ ID NO: 508567 - protein, 5 aa, Mycobacterium
IQEGN

SEQ ID NO: 508568 - protein, 5 aa, Mycobacterium
IQEPR

SEQ ID NO: 508569 - protein, 11 aa, Mycobacterium
IQESGRSRPEA

SEQ ID NO: 508570 - protein, 15 aa, Mycobacterium
IQESREKEAAAQERA

SEQ ID NO: 508571 - protein, 4 aa, Mycobacterium
IQGA

SEQ ID NO: 508572 - protein, 24 aa, Mycobacterium
IQGARRGKRVRTTKPDLTAPRHPD

SEQ ID NO: 508573 - protein, 4 aa, Mycobacterium
IQGD

SEQ ID NO: 508574 - protein, 8 aa, Mycobacterium
IQGEGGDH

SEQ ID NO: 508575 - protein, 10 aa, Mycobacterium
IQGETGIKPE

SEQ ID NO: 508576 - protein, 8 aa, Mycobacterium
IQGETRDK

SEQ ID NO: 508577 - protein, 9 aa, Mycobacterium
IQGGTTAEG

SEQ ID NO: 508578 - protein, 4 aa, Mycobacterium
IQGK

SEQ ID NO: 508579 - protein, 8 aa, Mycobacterium
IQGNKSRY

SEQ ID NO: 508580 - protein, 10 aa, Mycobacterium
IQGSSAAQQL

SEQ ID NO: 508581 - protein, 6 aa, Mycobacterium
IQGTAA

SEQ ID NO: 508582 - protein, 14 aa, Mycobacterium
IQGTRTVPIGTPKI

SEQ ID NO: 508583 - protein, 14 aa, Mycobacterium
IQHRPTTALPAPAP

SEQ ID NO: 508584 - protein, 6 aa, Mycobacterium
IQKASG

SEQ ID NO: 508585 - protein, 4 aa, Mycobacterium
IQPD

SEQ ID NO: 508586 - protein, 9 aa, Mycobacterium
IQPDPDDVA

SEQ ID NO: 508587 - protein, 9 aa, Mycobacterium
IQPDPGDVA

SEQ ID NO: 508588 - protein, 13 aa, Mycobacterium
IQPDSGRVKRGKT

SEQ ID NO: 508589 - protein, 6 aa, Mycobacterium
IQPDTT

SEQ ID NO: 508590 - protein, 6 aa, Mycobacterium
IQPDTV

SEQ ID NO: 508591 - protein, 7 aa, Mycobacterium
IQPEPRN

SEQ ID NO: 508592 - protein, 5 aa, Mycobacterium
IQPGA

SEQ ID NO: 508593 - protein, 11 aa, Mycobacterium
IQPGRRPRGPQ

SEQ ID NO: 508594 - protein, 5 aa, Mycobacterium
IQPGT

SEQ ID NO: 508595 - protein, 16 aa, Mycobacterium
IQPGTYATGGPADGQT

SEQ ID NO: 508596 - protein, 6 aa, Mycobacterium
IQPGVT

SEQ ID NO: 508597 - protein, 10 aa, Mycobacterium
IQPKPVQRPH

SEQ ID NO: 508598 - protein, 26 aa, Mycobacterium
IQPLPTGPAGAGPGPSVSGGLAPVRL

SEQ ID NO: 508599 - protein, 15 aa, Mycobacterium
IQPPDRLSDDLGASA

SEQ ID NO: 508600 - protein, 12 aa, Mycobacterium
IQPPGKKPMQAA

SEQ ID NO: 508601 - protein, 7 aa, Mycobacterium
IQPPPGF

SEQ ID NO: 508602 - protein, 5 aa, Mycobacterium
IQPQA

SEQ ID NO: 508603 - protein, 5 aa, Mycobacterium
IQPQQ

SEQ ID NO: 508604 - protein, 4 aa, Mycobacterium
IQPR

SEQ ID NO: 508605 - protein, 9 aa, Mycobacterium
IQPRARGPV

SEQ ID NO: 508606 - protein, 16 aa, Mycobacterium
IQPSGSVARYESRVGD

SEQ ID NO: 508607 - protein, 5 aa, Mycobacterium
IQPSP

SEQ ID NO: 508608 - protein, 7 aa, Mycobacterium
IQPTADS

SEQ ID NO: 508609 - protein, 16 aa, Mycobacterium
IQPTSRPGHPRTTPNA

SEQ ID NO: 508610 - protein, 7 aa, Mycobacterium
IQPTTDG

SEQ ID NO: 508611 - protein, 12 aa, Mycobacterium
IQQADPRRSPKG

SEQ ID NO: 508612 - protein, 51 aa, Mycobacterium
IQQGASNYSHAEAASTLGGGSAALEPPSPPAELAAPGPPGTWGPGQPPPPL

SEQ ID NO: 508613 - protein, 5 aa, Mycobacterium
IQQRP

SEQ ID NO: 508614 - protein, 7 aa, Mycobacterium
IQQRPAD

SEQ ID NO: 508615 - protein, 12 aa, Mycobacterium
IQQTAEAQRQPG

SEQ ID NO: 508616 - protein, 12 aa, Mycobacterium
IQQTAETQRQPG

SEQ ID NO: 508617 - protein, 14 aa, Mycobacterium
IQRDRPDEAGYRGD

SEQ ID NO: 508618 - protein, 9 aa, Mycobacterium
IQRGEDRQR

SEQ ID NO: 508619 - protein, 12 aa, Mycobacterium
IQRGNATREVGD

SEQ ID NO: 508620 - protein, 12 aa, Mycobacterium
IQRNGDTDFSGS

SEQ ID NO: 508621 - protein, 9 aa, Mycobacterium
IQRPDGHRY

SEQ ID NO: 508622 - protein, 10 aa, Mycobacterium
IQRPDGHRYS

SEQ ID NO: 508623 - protein, 7 aa, Mycobacterium
IQRPDGI

SEQ ID NO: 508624 - protein, 5 aa, Mycobacterium
IQRPP

SEQ ID NO: 508625 - protein, 6 aa, Mycobacterium
IQRQNP

SEQ ID NO: 508626 - protein, 5 aa, Mycobacterium
IQRSA

SEQ ID NO: 508627 - protein, 7 aa, Mycobacterium
IQRSTGV

SEQ ID NO: 508628 - protein, 6 aa, Mycobacterium
IQSEPR

SEQ ID NO: 508629 - protein, 9 aa, Mycobacterium
IQSERPDDY

SEQ ID NO: 508630 - protein, 5 aa, Mycobacterium
IQSHG

SEQ ID NO: 508631 - protein, 14 aa, Mycobacterium
IQSHPNEVDPAPRF

SEQ ID NO: 508632 - protein, 4 aa, Mycobacterium
IQSP

SEQ ID NO: 508633 - protein, 17 aa, Mycobacterium
IQSPGPWRRSGAGQPAG

SEQ ID NO: 508634 - protein, 7 aa, Mycobacterium
IQSPRGA

SEQ ID NO: 508635 - protein, 11 aa, Mycobacterium
IQSSGRPDYDR

SEQ ID NO: 508636 - protein, 8 aa, Mycobacterium
IQSSPQSE

SEQ ID NO: 508637 - protein, 11 aa, Mycobacterium
IQSTDPPGSMA

SEQ ID NO: 508638 - protein, 17 aa, Mycobacterium
IQTGQTARQAATAASAF

SEQ ID NO: 508639 - protein, 11 aa, Mycobacterium
IQTGTRDGDDD

SEQ ID NO: 508640 - protein, 10 aa, Mycobacterium
IQTPKKSNPH

SEQ ID NO: 508641 - protein, 11 aa, Mycobacterium
IQTQGARRVPG

SEQ ID NO: 508642 - protein, 7 aa, Mycobacterium
IQTQRGQ

SEQ ID NO: 508643 - protein, 5 aa, Mycobacterium
IQTRQ

SEQ ID NO: 508644 - protein, 12 aa, Mycobacterium
IQTRRDSLDERR

SEQ ID NO: 508645 - protein, 6 aa, Mycobacterium
IQTRSQ

SEQ ID NO: 508646 - protein, 10 aa, Mycobacterium
IQVKDDGRGI

SEQ ID NO: 508647 - protein, 6 aa, Mycobacterium
IQVTGK

SEQ ID NO: 508648 - protein, 8 aa, Mycobacterium
IRAAAPKK

SEQ ID NO: 508649 - protein, 4 aa, Mycobacterium
IRAD

SEQ ID NO: 508650 - protein, 9 aa, Mycobacterium
IRADGGTAE

SEQ ID NO: 508651 - protein, 11 aa, Mycobacterium
IRAEGGTATAA

SEQ ID NO: 508652 - protein, 17 aa, Mycobacterium
IRAERERGAAPDTLPAE

SEQ ID NO: 508653 - protein, 4 aa, Mycobacterium
IRAG

SEQ ID NO: 508654 - protein, 10 aa, Mycobacterium
IRAGASVEQI

SEQ ID NO: 508655 - protein, 12 aa, Mycobacterium
IRAGNGPALRAA

SEQ ID NO: 508656 - protein, 15 aa, Mycobacterium
IRAGTPAPAFPSTVG

SEQ ID NO: 508657 - protein, 7 aa, Mycobacterium
IRAKEQR

SEQ ID NO: 508658 - protein, 22 aa, Mycobacterium
IRAKGTVAAAGEPVVPGSVGAL

SEQ ID NO: 508659 - protein, 7 aa, Mycobacterium
IRAPQPV

SEQ ID NO: 508660 - protein, 6 aa, Mycobacterium
IRARGP

SEQ ID NO: 508661 - protein, 14 aa, Mycobacterium
IRARHSAGEYQIET

SEQ ID NO: 508662 - protein, 8 aa, Mycobacterium
IRARSPKA

SEQ ID NO: 508663 - protein, 12 aa, Mycobacterium
IRASGPDSGRAR

SEQ ID NO: 508664 - protein, 5 aa, Mycobacterium
IRASH

SEQ ID NO: 508665 - protein, 18 aa, Mycobacterium
IRASTAAGSGHPTSSMSA

SEQ ID NO: 508666 - protein, 13 aa, Mycobacterium
IRATADAAEALAG

SEQ ID NO: 508667 - protein, 6 aa, Mycobacterium
IRATTV

SEQ ID NO: 508668 - protein, 15 aa, Mycobacterium
IRDAAGAALGMATGE

SEQ ID NO: 508669 - protein, 10 aa, Mycobacterium
IRDADAAAEI

SEQ ID NO: 508670 - protein, 23 aa, Mycobacterium
IRDAPTGGVDPEAQARADQFRER

SEQ ID NO: 508671 - protein, 20 aa, Mycobacterium
IRDEGNGRKSVGAWLLSAHL

SEQ ID NO: 508672 - protein, 4 aa, Mycobacterium
IRDG

SEQ ID NO: 508673 - protein, 14 aa, Mycobacterium
IRDGEPLAHLVNEA

SEQ ID NO: 508674 - protein, 18 aa, Mycobacterium
IRDGTADTVRRRGGVWSS

SEQ ID NO: 508675 - protein, 16 aa, Mycobacterium
IRDKGGEYYNPDEAAR

SEQ ID NO: 508676 - protein, 4 aa, Mycobacterium
IRDQ

SEQ ID NO: 508677 - protein, 7 aa, Mycobacterium
IRDRGGD

SEQ ID NO: 508678 - protein, 6 aa, Mycobacterium
IRDRPA

SEQ ID NO: 508679 - protein, 6 aa, Mycobacterium
IRDRPS

SEQ ID NO: 508680 - protein, 18 aa, Mycobacterium
IRDSASDRAVSPRALENR

SEQ ID NO: 508681 - protein, 8 aa, Mycobacterium
IRDSEPDW

SEQ ID NO: 508682 - protein, 7 aa, Mycobacterium
IRDSETL

SEQ ID NO: 508683 - protein, 9 aa, Mycobacterium
IRDSGQKDL

SEQ ID NO: 508684 - protein, 4 aa, Mycobacterium
IRDT

SEQ ID NO: 508685 - protein, 8 aa, Mycobacterium
IRDTGRHD

SEQ ID NO: 508686 - protein, 6 aa, Mycobacterium
IREAAD

SEQ ID NO: 508687 - protein, 20 aa, Mycobacterium
IREAPTGGVDPEAKARADQF

SEQ ID NO: 508688 - protein, 12 aa, Mycobacterium
IREATDVAQTHP

SEQ ID NO: 508689 - protein, 10 aa, Mycobacterium
IREERPRRVG

SEQ ID NO: 508690 - protein, 5 aa, Mycobacterium
IREEV

SEQ ID NO: 508691 - protein, 8 aa, Mycobacterium
IREEVDNN

SEQ ID NO: 508692 - protein, 5 aa, Mycobacterium
IREGE

SEQ ID NO: 508693 - protein, 12 aa, Mycobacterium
IREGRLDDRPEE

SEQ ID NO: 508694 - protein, 15 aa, Mycobacterium
IREGSADVRVEPADR

SEQ ID NO: 508695 - protein, 15 aa, Mycobacterium
IREPGDAGDVPTGRA

SEQ ID NO: 508696 - protein, 4 aa, Mycobacterium
IRER

SEQ ID NO: 508697 - protein, 10 aa, Mycobacterium
IRERGGAPVE

SEQ ID NO: 508698 - protein, 10 aa, Mycobacterium
IRERGGDEAV

SEQ ID NO: 508699 - protein, 14 aa, Mycobacterium
IRERRKKTGAAARE

SEQ ID NO: 508700 - protein, 16 aa, Mycobacterium
IRERTRTGSEANRDDI

SEQ ID NO: 508701 - protein, 11 aa, Mycobacterium
IRESGERADPG

SEQ ID NO: 508702 - protein, 7 aa, Mycobacterium
IRESGTG

SEQ ID NO: 508703 - protein, 10 aa, Mycobacterium
IRESPAAGEL

SEQ ID NO: 508704 - protein, 14 aa, Mycobacterium
IRESTQRRKERQKV

SEQ ID NO: 508705 - protein, 5 aa, Mycobacterium
IRETH

SEQ ID NO: 508706 - protein, 9 aa, Mycobacterium
IRETQGSKT

SEQ ID NO: 508707 - protein, 4 aa, Mycobacterium
IRGA

SEQ ID NO: 508708 - protein, 14 aa, Mycobacterium
IRGADGDLSPEQVN

SEQ ID NO: 508709 - protein, 7 aa, Mycobacterium
IRGDGKV

SEQ ID NO: 508710 - protein, 9 aa, Mycobacterium
IRGEKDKFT

SEQ ID NO: 508711 - protein, 6 aa, Mycobacterium
IRGEMA

SEQ ID NO: 508712 - protein, 9 aa, Mycobacterium
IRGGAENLA

SEQ ID NO: 508713 - protein, 5 aa, Mycobacterium
IRGGP

SEQ ID NO: 508714 - protein, 6 aa, Mycobacterium
IRGNPA

SEQ ID NO: 508715 - protein, 7 aa, Mycobacterium
IRGNSTR

SEQ ID NO: 508716 - protein, 4 aa, Mycobacterium
IRGP

SEQ ID NO: 508717 - protein, 10 aa, Mycobacterium
IRGPETTTYG

SEQ ID NO: 508718 - protein, 14 aa, Mycobacterium
IRGPRKGLFGRTKT

SEQ ID NO: 508719 - protein, 140 aa, Mycobacterium
IRGQSNGTSAPAEPEGGGKTDTAGAEKAETPAAEGEHQNGSTTTEAPRRERRSASREPGSARGGDETDGERSRDREGAATREDDTRQGGKRDNQGGGRGQDGGSDQSGDQQGSGGQQSRGGSNQQDDDGEGRGGRRGRRF

SEQ ID NO: 508720 - protein, 14 aa, Mycobacterium
IRGQYEDQGNPYYS

SEQ ID NO: 508721 - protein, 4 aa, Mycobacterium
IRGR

SEQ ID NO: 508722 - protein, 5 aa, Mycobacterium
IRGRD

SEQ ID NO: 508723 - protein, 21 aa, Mycobacterium
IRGRDGKKLTEEWGDSPRAYR

SEQ ID NO: 508724 - protein, 22 aa, Mycobacterium
IRGRDNLASPEVTGYSAAKAAL

SEQ ID NO: 508725 - protein, 27 aa, Mycobacterium
IRGRGGKKLADEWGDRPRAYRGGTVPG

SEQ ID NO: 508726 - protein, 5 aa, Mycobacterium
IRGRR

SEQ ID NO: 508727 - protein, 11 aa, Mycobacterium
IRGSGGGDGGL

SEQ ID NO: 508728 - protein, 7 aa, Mycobacterium
IRGSTGG

SEQ ID NO: 508729 - protein, 9 aa, Mycobacterium
IRGTGARGW

SEQ ID NO: 508730 - protein, 6 aa, Mycobacterium
IRHDRA

SEQ ID NO: 508731 - protein, 4 aa, Mycobacterium
IRHR

SEQ ID NO: 508732 - protein, 7 aa, Mycobacterium
IRKAEDP

SEQ ID NO: 508733 - protein, 12 aa, Mycobacterium
IRKDPNDAQKVA

SEQ ID NO: 508734 - protein, 6 aa, Mycobacterium
IRKESV

SEQ ID NO: 508735 - protein, 5 aa, Mycobacterium
IRKGE

SEQ ID NO: 508736 - protein, 14 aa, Mycobacterium
IRLGGSDEADHDRV

SEQ ID NO: 508737 - protein, 12 aa, Mycobacterium
IRLGGSDETDYD

SEQ ID NO: 508738 - protein, 14 aa, Mycobacterium
IRLGTGDDPRVSTA

SEQ ID NO: 508739 - protein, 12 aa, Mycobacterium
IRLGTGDPRIST

SEQ ID NO: 508740 - protein, 6 aa, Mycobacterium
IRNDPR

SEQ ID NO: 508741 - protein, 11 aa, Mycobacterium
IRNDTSASTRT

SEQ ID NO: 508742 - protein, 15 aa, Mycobacterium
IRNGPGGGSLSEGAH

SEQ ID NO: 508743 - protein, 19 aa, Mycobacterium
IRNNRPADAGLLPSERSNF

SEQ ID NO: 508744 - protein, 6 aa, Mycobacterium
IRNPAQ

SEQ ID NO: 508745 - protein, 14 aa, Mycobacterium
IRNPDGSNGYSPCE

SEQ ID NO: 508746 - protein, 4 aa, Mycobacterium
IRNT

SEQ ID NO: 508747 - protein, 11 aa, Mycobacterium
IRNTGAGKRRP

SEQ ID NO: 508748 - protein, 15 aa, Mycobacterium
IRNTKSEAIQSNDPA

SEQ ID NO: 508749 - protein, 8 aa, Mycobacterium
IRNTPGLD

SEQ ID NO: 508750 - protein, 5 aa, Mycobacterium
IRNTS

SEQ ID NO: 508751 - protein, 12 aa, Mycobacterium
IRNYSTPGGQHG

SEQ ID NO: 508752 - protein, 12 aa, Mycobacterium
IRPAGETFATPD

SEQ ID NO: 508753 - protein, 9 aa, Mycobacterium
IRPAPGYPA

SEQ ID NO: 508754 - protein, 8 aa, Mycobacterium
IRPAQPAV

SEQ ID NO: 508755 - protein, 16 aa, Mycobacterium
IRPARAVGASARPLPT

SEQ ID NO: 508756 - protein, 5 aa, Mycobacterium
IRPDA

SEQ ID NO: 508757 - protein, 8 aa, Mycobacterium
IRPDGQVR

SEQ ID NO: 508758 - protein, 10 aa, Mycobacterium
IRPDGRHDAA

SEQ ID NO: 508759 - protein, 11 aa, Mycobacterium
IRPDGRNDAAG

SEQ ID NO: 508760 - protein, 11 aa, Mycobacterium
IRPDGTHDAQG

SEQ ID NO: 508761 - protein, 6 aa, Mycobacterium
IRPDSK

SEQ ID NO: 508762 - protein, 5 aa, Mycobacterium
IRPDT

SEQ ID NO: 508763 - protein, 6 aa, Mycobacterium
IRPDTT

SEQ ID NO: 508764 - protein, 6 aa, Mycobacterium
IRPEGQ

SEQ ID NO: 508765 - protein, 26 aa, Mycobacterium
IRPESNGDQSPHAERDEEDEEKVSVH

SEQ ID NO: 508766 - protein, 7 aa, Mycobacterium
IRPGAES

SEQ ID NO: 508767 - protein, 21 aa, Mycobacterium
IRPGAETAIPASTSDDLAETA

SEQ ID NO: 508768 - protein, 5 aa, Mycobacterium
IRPGD

SEQ ID NO: 508769 - protein, 6 aa, Mycobacterium
IRPGGV

SEQ ID NO: 508770 - protein, 7 aa, Mycobacterium
IRPGLTK

SEQ ID NO: 508771 - protein, 6 aa, Mycobacterium
IRPGPH

SEQ ID NO: 508772 - protein, 8 aa, Mycobacterium
IRPGPTRW

SEQ ID NO: 508773 - protein, 7 aa, Mycobacterium
IRPGQRK

SEQ ID NO: 508774 - protein, 6 aa, Mycobacterium
IRPGTD

SEQ ID NO: 508775 - protein, 6 aa, Mycobacterium
IRPGTT

SEQ ID NO: 508776 - protein, 9 aa, Mycobacterium
IRPGTTIES

SEQ ID NO: 508777 - protein, 5 aa, Mycobacterium
IRPGV

SEQ ID NO: 508778 - protein, 8 aa, Mycobacterium
IRPGYTGQ

SEQ ID NO: 508779 - protein, 17 aa, Mycobacterium
IRPKSLRDKLSTGRGFD

SEQ ID NO: 508780 - protein, 4 aa, Mycobacterium
IRPN

SEQ ID NO: 508781 - protein, 15 aa, Mycobacterium
IRPPEAGVWHGEDFS

SEQ ID NO: 508782 - protein, 8 aa, Mycobacterium
IRPPQGAP

SEQ ID NO: 508783 - protein, 5 aa, Mycobacterium
IRPSA

SEQ ID NO: 508784 - protein, 14 aa, Mycobacterium
IRPSDEDVTYGEAP

SEQ ID NO: 508785 - protein, 16 aa, Mycobacterium
IRPSGKASGCAAADYG

SEQ ID NO: 508786 - protein, 22 aa, Mycobacterium
IRPSGNGFSPPAVKRPGIGAPA

SEQ ID NO: 508787 - protein, 6 aa, Mycobacterium
IRPSQP

SEQ ID NO: 508788 - protein, 22 aa, Mycobacterium
IRPSSDPAGYGTTTSSRPYGGI

SEQ ID NO: 508789 - protein, 6 aa, Mycobacterium
IRPSTM

SEQ ID NO: 508790 - protein, 16 aa, Mycobacterium
IRPSVGTADEKESYQF

SEQ ID NO: 508791 - protein, 5 aa, Mycobacterium
IRPSY

SEQ ID NO: 508792 - protein, 9 aa, Mycobacterium
IRPTDTAGE

SEQ ID NO: 508793 - protein, 24 aa, Mycobacterium
IRPTGDGFKPSAVQRPGSGTPAGM

SEQ ID NO: 508794 - protein, 10 aa, Mycobacterium
IRPTGGGIGR

SEQ ID NO: 508795 - protein, 5 aa, Mycobacterium
IRPVA

SEQ ID NO: 508796 - protein, 21 aa, Mycobacterium
IRPVSRRDGYVSSRATGWSPR

SEQ ID NO: 508797 - protein, 4 aa, Mycobacterium
IRQE

SEQ ID NO: 508798 - protein, 8 aa, Mycobacterium
IRQETNRR

SEQ ID NO: 508799 - protein, 7 aa, Mycobacterium
IRQGGDL

SEQ ID NO: 508800 - protein, 7 aa, Mycobacterium
IRQPPER

SEQ ID NO: 508801 - protein, 11 aa, Mycobacterium
IRQRAAPTAPV

SEQ ID NO: 508802 - protein, 6 aa, Mycobacterium
IRQRAE

SEQ ID NO: 508803 - protein, 17 aa, Mycobacterium
IRQSDTDAGGYDTGAFG

SEQ ID NO: 508804 - protein, 11 aa, Mycobacterium
IRQTAKSKYEA

SEQ ID NO: 508805 - protein, 6 aa, Mycobacterium
IRQTAP

SEQ ID NO: 508806 - protein, 13 aa, Mycobacterium
IRRAGEDVAPGTT

SEQ ID NO: 508807 - protein, 22 aa, Mycobacterium
IRRAGGGKSGKSDAGANARSQN

SEQ ID NO: 508808 - protein, 5 aa, Mycobacterium
IRRDD

SEQ ID NO: 508809 - protein, 9 aa, Mycobacterium
IRRDGENAH

SEQ ID NO: 508810 - protein, 9 aa, Mycobacterium
IRRDTDGYG

SEQ ID NO: 508811 - protein, 4 aa, Mycobacterium
IRRE

SEQ ID NO: 508812 - protein, 5 aa, Mycobacterium
IRREQ

SEQ ID NO: 508813 - protein, 9 aa, Mycobacterium
IRRGDRAAL

SEQ ID NO: 508814 - protein, 6 aa, Mycobacterium
IRRGRD

SEQ ID NO: 508815 - protein, 15 aa, Mycobacterium
IRRKAQASVPGDGAA

SEQ ID NO: 508816 - protein, 15 aa, Mycobacterium
IRRKAQSAVPGDGAA

SEQ ID NO: 508817 - protein, 10 aa, Mycobacterium
IRRPDGSTGL

SEQ ID NO: 508818 - protein, 9 aa, Mycobacterium
IRRPDPRSP

SEQ ID NO: 508819 - protein, 23 aa, Mycobacterium
IRRPGAGARSAKRGAGPTRRPRR

SEQ ID NO: 508820 - protein, 14 aa, Mycobacterium
IRRPGANPPADRPW

SEQ ID NO: 508821 - protein, 9 aa, Mycobacterium
IRRRNEPDV

SEQ ID NO: 508822 - protein, 6 aa, Mycobacterium
IRRRST

SEQ ID NO: 508823 - protein, 7 aa, Mycobacterium
IRRSQGP

SEQ ID NO: 508824 - protein, 8 aa, Mycobacterium
IRRSRGYA

SEQ ID NO: 508825 - protein, 6 aa, Mycobacterium
IRRTDD

SEQ ID NO: 508826 - protein, 8 aa, Mycobacterium
IRRTEGGS

SEQ ID NO: 508827 - protein, 14 aa, Mycobacterium
IRRTQEELEEGKRR

SEQ ID NO: 508828 - protein, 16 aa, Mycobacterium
IRRTRAGLKDPRRPSG

SEQ ID NO: 508829 - protein, 16 aa, Mycobacterium
IRSASDAARDALPGLR

SEQ ID NO: 508830 - protein, 5 aa, Mycobacterium
IRSDS

SEQ ID NO: 508831 - protein, 9 aa, Mycobacterium
IRSDSPGTG

SEQ ID NO: 508832 - protein, 16 aa, Mycobacterium
IRSEKSTAMQSRDPAT

SEQ ID NO: 508833 - protein, 14 aa, Mycobacterium
IRSEPSGLRAAAAA

SEQ ID NO: 508834 - protein, 5 aa, Mycobacterium
IRSGA

SEQ ID NO: 508835 - protein, 10 aa, Mycobacterium
IRSGDPDDAV

SEQ ID NO: 508836 - protein, 14 aa, Mycobacterium
IRSGEIGVDAPSTA

SEQ ID NO: 508837 - protein, 7 aa, Mycobacterium
IRSGEIS

SEQ ID NO: 508838 - protein, 24 aa, Mycobacterium
IRSGERAAAEVTAADTATVAASSV

SEQ ID NO: 508839 - protein, 19 aa, Mycobacterium
IRSGERAATEVREAETAAV

SEQ ID NO: 508840 - protein, 11 aa, Mycobacterium
IRSGKSPTSSK

SEQ ID NO: 508841 - protein, 22 aa, Mycobacterium
IRSGPPDSDDAHAHSFLNRVKT

SEQ ID NO: 508842 - protein, 14 aa, Mycobacterium
IRSGQRAAAEITAL

SEQ ID NO: 508843 - protein, 7 aa, Mycobacterium
IRSGQSD

SEQ ID NO: 508844 - protein, 20 aa, Mycobacterium
IRSGRGSRPRTKTRPEHADA

SEQ ID NO: 508845 - protein, 15 aa, Mycobacterium
IRSGRLGTGTVLPPS

SEQ ID NO: 508846 - protein, 6 aa, Mycobacterium
IRSGSR

SEQ ID NO: 508847 - protein, 21 aa, Mycobacterium
IRSGSSPPAVTTQASPASGST

SEQ ID NO: 508848 - protein, 29 aa, Mycobacterium
IRSPHRPALPAGTGVPPHSRRGRHGRTRA

SEQ ID NO: 508849 - protein, 10 aa, Mycobacterium
IRSRGDSADG

SEQ ID NO: 508850 - protein, 5 aa, Mycobacterium
IRSRS

SEQ ID NO: 508851 - protein, 7 aa, Mycobacterium
IRSSAPD

SEQ ID NO: 508852 - protein, 7 aa, Mycobacterium
IRSSRTQ

SEQ ID NO: 508853 - protein, 6 aa, Mycobacterium
IRSTDA

SEQ ID NO: 508854 - protein, 9 aa, Mycobacterium
IRSTDNRGQ

SEQ ID NO: 508855 - protein, 15 aa, Mycobacterium
IRSTRQGRRPESPAE

SEQ ID NO: 508856 - protein, 5 aa, Mycobacterium
IRSTT

SEQ ID NO: 508857 - protein, 11 aa, Mycobacterium
IRTAANALPRR

SEQ ID NO: 508858 - protein, 10 aa, Mycobacterium
IRTAKDTGLA

SEQ ID NO: 508859 - protein, 6 aa, Mycobacterium
IRTDDE

SEQ ID NO: 508860 - protein, 13 aa, Mycobacterium
IRTDDRDGLPGAS

SEQ ID NO: 508861 - protein, 5 aa, Mycobacterium
IRTDG

SEQ ID NO: 508862 - protein, 7 aa, Mycobacterium
IRTDSTD

SEQ ID NO: 508863 - protein, 8 aa, Mycobacterium
IRTDTDGY

SEQ ID NO: 508864 - protein, 10 aa, Mycobacterium
IRTEADDDVV

SEQ ID NO: 508865 - protein, 9 aa, Mycobacterium
IRTEGGTAI

SEQ ID NO: 508866 - protein, 17 aa, Mycobacterium
IRTEHNDPYNVRCQLGQ

SEQ ID NO: 508867 - protein, 10 aa, Mycobacterium
IRTEVSPRHV

SEQ ID NO: 508868 - protein, 5 aa, Mycobacterium
IRTGA

SEQ ID NO: 508869 - protein, 8 aa, Mycobacterium
IRTGDADA

SEQ ID NO: 508870 - protein, 6 aa, Mycobacterium
IRTGDD

SEQ ID NO: 508871 - protein, 7 aa, Mycobacterium
IRTGNPV

SEQ ID NO: 508872 - protein, 9 aa, Mycobacterium
IRTGRANPG

SEQ ID NO: 508873 - protein, 5 aa, Mycobacterium
IRTGT

SEQ ID NO: 508874 - protein, 10 aa, Mycobacterium
IRTKEVSPVE

SEQ ID NO: 508875 - protein, 5 aa, Mycobacterium
IRTNE

SEQ ID NO: 508876 - protein, 7 aa, Mycobacterium
IRTPGGA

SEQ ID NO: 508877 - protein, 4 aa, Mycobacterium
IRTQ

SEQ ID NO: 508878 - protein, 14 aa, Mycobacterium
IRTRASDAGRDPES

SEQ ID NO: 508879 - protein, 5 aa, Mycobacterium
IRTRT

SEQ ID NO: 508880 - protein, 4 aa, Mycobacterium
IRTS

SEQ ID NO: 508881 - protein, 16 aa, Mycobacterium
IRTSKSEALQSKDPAT

SEQ ID NO: 508882 - protein, 16 aa, Mycobacterium
IRTTARGWDAATAPAW

SEQ ID NO: 508883 - protein, 10 aa, Mycobacterium
IRTTARRDGD

SEQ ID NO: 508884 - protein, 11 aa, Mycobacterium
IRTTEKIPPGR

SEQ ID NO: 508885 - protein, 17 aa, Mycobacterium
IRTTNAGQGFQGFWRPT

SEQ ID NO: 508886 - protein, 6 aa, Mycobacterium
IRTTNP

SEQ ID NO: 508887 - protein, 4 aa, Mycobacterium
ISAA

SEQ ID NO: 508888 - protein, 5 aa, Mycobacterium
ISAAA

SEQ ID NO: 508889 - protein, 8 aa, Mycobacterium
ISAAAQGV

SEQ ID NO: 508890 - protein, 8 aa, Mycobacterium
ISAAEGDR

SEQ ID NO: 508891 - protein, 10 aa, Mycobacterium
ISAANSAAVV

SEQ ID NO: 508892 - protein, 8 aa, Mycobacterium
ISAASRPM

SEQ ID NO: 508893 - protein, 18 aa, Mycobacterium
ISAATGATGRFADDGPRR

SEQ ID NO: 508894 - protein, 21 aa, Mycobacterium
ISAATGATGRFADDGPRRNIE

SEQ ID NO: 508895 - protein, 13 aa, Mycobacterium
ISADGALTAGTGA

SEQ ID NO: 508896 - protein, 6 aa, Mycobacterium
ISADGP

SEQ ID NO: 508897 - protein, 7 aa, Mycobacterium
ISADGSE

SEQ ID NO: 508898 - protein, 9 aa, Mycobacterium
ISADNADVA

SEQ ID NO: 508899 - protein, 12 aa, Mycobacterium
ISADSGDVGLPP

SEQ ID NO: 508900 - protein, 9 aa, Mycobacterium
ISADTGEPE

SEQ ID NO: 508901 - protein, 21 aa, Mycobacterium
ISAEAARPAERSAPHNNDPPP

SEQ ID NO: 508902 - protein, 6 aa, Mycobacterium
ISAENA

SEQ ID NO: 508903 - protein, 5 aa, Mycobacterium
ISAEP

SEQ ID NO: 508904 - protein, 7 aa, Mycobacterium
ISAEQAA

SEQ ID NO: 508905 - protein, 18 aa, Mycobacterium
ISAEQATLSNAWQGDTGM

SEQ ID NO: 508906 - protein, 7 aa, Mycobacterium
ISAEQRS

SEQ ID NO: 508907 - protein, 11 aa, Mycobacterium
ISAETAQSEGL

SEQ ID NO: 508908 - protein, 7 aa, Mycobacterium
ISAETTE

SEQ ID NO: 508909 - protein, 4 aa, Mycobacterium
ISAG

SEQ ID NO: 508910 - protein, 29 aa, Mycobacterium
ISAGGAGGNGGTGLSGFGGAGGAGGNAGL

SEQ ID NO: 508911 - protein, 10 aa, Mycobacterium
ISAGRHPDAD

SEQ ID NO: 508912 - protein, 9 aa, Mycobacterium
ISAGRSGEA

SEQ ID NO: 508913 - protein, 11 aa, Mycobacterium
ISAGSTAATAL

SEQ ID NO: 508914 - protein, 6 aa, Mycobacterium
ISAGTD

SEQ ID NO: 508915 - protein, 7 aa, Mycobacterium
ISAKAAV

SEQ ID NO: 508916 - protein, 10 aa, Mycobacterium
ISANGDNPVT

SEQ ID NO: 508917 - protein, 6 aa, Mycobacterium
ISANNP

SEQ ID NO: 508918 - protein, 8 aa, Mycobacterium
ISANTADA

SEQ ID NO: 508919 - protein, 10 aa, Mycobacterium
ISAPAGKRQF

SEQ ID NO: 508920 - protein, 7 aa, Mycobacterium
ISAPERL

SEQ ID NO: 508921 - protein, 8 aa, Mycobacterium
ISAPETVT

SEQ ID NO: 508922 - protein, 8 aa, Mycobacterium
ISAPGVKS

SEQ ID NO: 508923 - protein, 11 aa, Mycobacterium
ISAPNARGERV

SEQ ID NO: 508924 - protein, 6 aa, Mycobacterium
ISAPPD

SEQ ID NO: 508925 - protein, 8 aa, Mycobacterium
ISAPQPNY

SEQ ID NO: 508926 - protein, 7 aa, Mycobacterium
ISAPQRL

SEQ ID NO: 508927 - protein, 47 aa, Mycobacterium
ISAPRGNMPPPLAPPSPGAPAVGVGGPSIPGVSTPAASAPPLSPQSL

SEQ ID NO: 508928 - protein, 6 aa, Mycobacterium
ISAPTR

SEQ ID NO: 508929 - protein, 12 aa, Mycobacterium
ISAQEARQARVT

SEQ ID NO: 508930 - protein, 21 aa, Mycobacterium
ISAQREDDHAYAQNEKGLGTA

SEQ ID NO: 508931 - protein, 9 aa, Mycobacterium
ISARERVTR

SEQ ID NO: 508932 - protein, 8 aa, Mycobacterium
ISARPDSK

SEQ ID NO: 508933 - protein, 5 aa, Mycobacterium
ISARR

SEQ ID NO: 508934 - protein, 25 aa, Mycobacterium
ISARTDAPNDPRRYAPQGSSPARCP

SEQ ID NO: 508935 - protein, 8 aa, Mycobacterium
ISASENNT

SEQ ID NO: 508936 - protein, 9 aa, Mycobacterium
ISASPNEVD

SEQ ID NO: 508937 - protein, 9 aa, Mycobacterium
ISASPSDPT

SEQ ID NO: 508938 - protein, 10 aa, Mycobacterium
ISASSAAHYR

SEQ ID NO: 508939 - protein, 6 aa, Mycobacterium
ISATDD

SEQ ID NO: 508940 - protein, 6 aa, Mycobacterium
ISATRP

SEQ ID NO: 508941 - protein, 6 aa, Mycobacterium
ISATTP

SEQ ID NO: 508942 - protein, 4 aa, Mycobacterium
ISDA

SEQ ID NO: 508943 - protein, 13 aa, Mycobacterium
ISDARFSRANDRR

SEQ ID NO: 508944 - protein, 10 aa, Mycobacterium
ISDDAPTVAA

SEQ ID NO: 508945 - protein, 5 aa, Mycobacterium
ISDDD

SEQ ID NO: 508946 - protein, 10 aa, Mycobacterium
ISDDDVDAEL

SEQ ID NO: 508947 - protein, 6 aa, Mycobacterium
ISDDEW

SEQ ID NO: 508948 - protein, 8 aa, Mycobacterium
ISDDPQGI

SEQ ID NO: 508949 - protein, 9 aa, Mycobacterium
ISDDPQRVA

SEQ ID NO: 508950 - protein, 5 aa, Mycobacterium
ISDDY

SEQ ID NO: 508951 - protein, 8 aa, Mycobacterium
ISDEDPVA

SEQ ID NO: 508952 - protein, 6 aa, Mycobacterium
ISDEPA

SEQ ID NO: 508953 - protein, 7 aa, Mycobacterium
ISDESDD

SEQ ID NO: 508954 - protein, 6 aa, Mycobacterium
ISDETP

SEQ ID NO: 508955 - protein, 14 aa, Mycobacterium
ISDGGAGPARGSTA

SEQ ID NO: 508956 - protein, 12 aa, Mycobacterium
ISDKDDAGRPRM

SEQ ID NO: 508957 - protein, 6 aa, Mycobacterium
ISDNDG

SEQ ID NO: 508958 - protein, 4 aa, Mycobacterium
ISDP

SEQ ID NO: 508959 - protein, 7 aa, Mycobacterium
ISDPADL

SEQ ID NO: 508960 - protein, 8 aa, Mycobacterium
ISDPAELA

SEQ ID NO: 508961 - protein, 7 aa, Mycobacterium
ISDPGRR

SEQ ID NO: 508962 - protein, 14 aa, Mycobacterium
ISDPGTPDEYSPEG

SEQ ID NO: 508963 - protein, 6 aa, Mycobacterium
ISDPKG

SEQ ID NO: 508964 - protein, 10 aa, Mycobacterium
ISDPQLPGRA

SEQ ID NO: 508965 - protein, 6 aa, Mycobacterium
ISDPTS

SEQ ID NO: 508966 - protein, 8 aa, Mycobacterium
ISDQGSHI

SEQ ID NO: 508967 - protein, 12 aa, Mycobacterium
ISDQPARTPSST

SEQ ID NO: 508968 - protein, 8 aa, Mycobacterium
ISDQTVSE

SEQ ID NO: 508969 - protein, 14 aa, Mycobacterium
ISDRDADAARGAAQ

SEQ ID NO: 508970 - protein, 11 aa, Mycobacterium
ISDRPESAQAF

SEQ ID NO: 508971 - protein, 6 aa, Mycobacterium
ISDSGV

SEQ ID NO: 508972 - protein, 6 aa, Mycobacterium
ISDTPA

SEQ ID NO: 508973 - protein, 16 aa, Mycobacterium
ISDTPVSSAPRRWQAP

SEQ ID NO: 508974 - protein, 8 aa, Mycobacterium
ISDTTAEE

SEQ ID NO: 508975 - protein, 7 aa, Mycobacterium
ISDVRQG

SEQ ID NO: 508976 - protein, 14 aa, Mycobacterium
ISDYSATRLAAGIT

SEQ ID NO: 508977 - protein, 7 aa, Mycobacterium
ISDYSTD

SEQ ID NO: 508978 - protein, 9 aa, Mycobacterium
ISEAESSMV

SEQ ID NO: 508979 - protein, 19 aa, Mycobacterium
ISEAGQAMSSTEGNVAGMF

SEQ ID NO: 508980 - protein, 19 aa, Mycobacterium
ISEAGQAMSSTEGNVTGMF

SEQ ID NO: 508981 - protein, 11 aa, Mycobacterium
ISEAGRTVANT

SEQ ID NO: 508982 - protein, 8 aa, Mycobacterium
ISEAREGG

SEQ ID NO: 508983 - protein, 10 aa, Mycobacterium
ISEDAKKRYA

SEQ ID NO: 508984 - protein, 6 aa, Mycobacterium
ISEDET

SEQ ID NO: 508985 - protein, 6 aa, Mycobacterium
ISEDGL

SEQ ID NO: 508986 - protein, 5 aa, Mycobacterium
ISEED

SEQ ID NO: 508987 - protein, 10 aa, Mycobacterium
ISEEGSRIEA

SEQ ID NO: 508988 - protein, 8 aa, Mycobacterium
ISEESVNR

SEQ ID NO: 508989 - protein, 12 aa, Mycobacterium
ISEGEGGEVSPK

SEQ ID NO: 508990 - protein, 19 aa, Mycobacterium
ISEGGGVYSREQKSIPVSD

SEQ ID NO: 508991 - protein, 19 aa, Mycobacterium
ISEGGGVYSRQQKSIPISP

SEQ ID NO: 508992 - protein, 7 aa, Mycobacterium
ISEGTEL

SEQ ID NO: 508993 - protein, 7 aa, Mycobacterium
ISEGTTA

SEQ ID NO: 508994 - protein, 5 aa, Mycobacterium
ISEIG

SEQ ID NO: 508995 - protein, 9 aa, Mycobacterium
ISEKKSEPE

SEQ ID NO: 508996 - protein, 14 aa, Mycobacterium
ISEKLTTIEAAMAP

SEQ ID NO: 508997 - protein, 12 aa, Mycobacterium
ISELENGRRTAR

SEQ ID NO: 508998 - protein, 17 aa, Mycobacterium
ISEPGHRVRPATGSAMR

SEQ ID NO: 508999 - protein, 18 aa, Mycobacterium
ISEPNPLSPTAANPLGPA

SEQ ID NO: 509000 - protein, 16 aa, Mycobacterium
ISEPRIKSGSANPSPK

SEQ ID NO: 509001 - protein, 17 aa, Mycobacterium
ISEPRIKSGSANPSPKL

SEQ ID NO: 509002 - protein, 5 aa, Mycobacterium
ISEPW

SEQ ID NO: 509003 - protein, 4 aa, Mycobacterium
ISEQ

SEQ ID NO: 509004 - protein, 33 aa, Mycobacterium
ISEQSEQNVYGASSPVPAGESSPSAASAPRTKV

SEQ ID NO: 509005 - protein, 6 aa, Mycobacterium
ISEQTG

SEQ ID NO: 509006 - protein, 8 aa, Mycobacterium
ISERDPQM

SEQ ID NO: 509007 - protein, 16 aa, Mycobacterium
ISERERAQSRASRLQR

SEQ ID NO: 509008 - protein, 11 aa, Mycobacterium
ISERRDSDGRL

SEQ ID NO: 509009 - protein, 11 aa, Mycobacterium
ISERSGNGSVL

SEQ ID NO: 509010 - protein, 4 aa, Mycobacterium
ISES

SEQ ID NO: 509011 - protein, 6 aa, Mycobacterium
ISESAL

SEQ ID NO: 509012 - protein, 19 aa, Mycobacterium
ISESDLPATIGDAPWDQST

SEQ ID NO: 509013 - protein, 7 aa, Mycobacterium
ISESETE

SEQ ID NO: 509014 - protein, 11 aa, Mycobacterium
ISESGGPAGEV

SEQ ID NO: 509015 - protein, 13 aa, Mycobacterium
ISESHAEGAPDDG

SEQ ID NO: 509016 - protein, 9 aa, Mycobacterium
ISESTPVPE

SEQ ID NO: 509017 - protein, 37 aa, Mycobacterium
ISESVNGTCPKPHESTPGGASSTPPSGSPSPAPAKPA

SEQ ID NO: 509018 - protein, 4 aa, Mycobacterium
ISET

SEQ ID NO: 509019 - protein, 9 aa, Mycobacterium
ISETETRTQ

SEQ ID NO: 509020 - protein, 10 aa, Mycobacterium
ISETETRTQA

SEQ ID NO: 509021 - protein, 5 aa, Mycobacterium
ISETH

SEQ ID NO: 509022 - protein, 11 aa, Mycobacterium
ISETPDGTQQL

SEQ ID NO: 509023 - protein, 7 aa, Mycobacterium
ISGAASR

SEQ ID NO: 509024 - protein, 5 aa, Mycobacterium
ISGAD

SEQ ID NO: 509025 - protein, 7 aa, Mycobacterium
ISGADGT

SEQ ID NO: 509026 - protein, 14 aa, Mycobacterium
ISGADTRKVGSTAA

SEQ ID NO: 509027 - protein, 6 aa, Mycobacterium
ISGAGA

SEQ ID NO: 509028 - protein, 7 aa, Mycobacterium
ISGAGTL

SEQ ID NO: 509029 - protein, 14 aa, Mycobacterium
ISGANTAAAAPTTE

SEQ ID NO: 509030 - protein, 9 aa, Mycobacterium
ISGASDGIG

SEQ ID NO: 509031 - protein, 8 aa, Mycobacterium
ISGATSTV

SEQ ID NO: 509032 - protein, 16 aa, Mycobacterium
ISGDANAPHLLIAHAV

SEQ ID NO: 509033 - protein, 5 aa, Mycobacterium
ISGDE

SEQ ID NO: 509034 - protein, 6 aa, Mycobacterium
ISGDGD

SEQ ID NO: 509035 - protein, 11 aa, Mycobacterium
ISGDGKRSTTR

SEQ ID NO: 509036 - protein, 11 aa, Mycobacterium
ISGDPSVTDGS

SEQ ID NO: 509037 - protein, 9 aa, Mycobacterium
ISGDSSAAH

SEQ ID NO: 509038 - protein, 27 aa, Mycobacterium
ISGDSTSEDVARQHASGDVGTRETLGK

SEQ ID NO: 509039 - protein, 5 aa, Mycobacterium
ISGEG

SEQ ID NO: 509040 - protein, 8 aa, Mycobacterium
ISGEHGLG

SEQ ID NO: 509041 - protein, 10 aa, Mycobacterium
ISGEHGLGRA

SEQ ID NO: 509042 - protein, 13 aa, Mycobacterium
ISGEHGLGRAKTP

SEQ ID NO: 509043 - protein, 12 aa, Mycobacterium
ISGEHGVGRAKT

SEQ ID NO: 509044 - protein, 9 aa, Mycobacterium
ISGEQSRAL

SEQ ID NO: 509045 - protein, 6 aa, Mycobacterium
ISGESL

SEQ ID NO: 509046 - protein, 6 aa, Mycobacterium
ISGETI

SEQ ID NO: 509047 - protein, 4 aa, Mycobacterium
ISGG

SEQ ID NO: 509048 - protein, 5 aa, Mycobacterium
ISGGA

SEQ ID NO: 509049 - protein, 8 aa, Mycobacterium
ISGGAPLG

SEQ ID NO: 509050 - protein, 10 aa, Mycobacterium
ISGGDSGIGR

SEQ ID NO: 509051 - protein, 10 aa, Mycobacterium
ISGGEEGALH

SEQ ID NO: 509052 - protein, 25 aa, Mycobacterium
ISGGEEGALNGPSIMPGGPAESYAS

SEQ ID NO: 509053 - protein, 25 aa, Mycobacterium
ISGGEEGALNGPSIMPGGPAESYKS

SEQ ID NO: 509054 - protein, 25 aa, Mycobacterium
ISGGEEGALNGPSIMPGGPAESYTS

SEQ ID NO: 509055 - protein, 26 aa, Mycobacterium
ISGGEEGALNGPSIMPGGPKKSYESL

SEQ ID NO: 509056 - protein, 24 aa, Mycobacterium
ISGGGSAQVDPAGGNPVITPGVNS

SEQ ID NO: 509057 - protein, 11 aa, Mycobacterium
ISGGGSGHEPL

SEQ ID NO: 509058 - protein, 10 aa, Mycobacterium
ISGGGSHNGS

SEQ ID NO: 509059 - protein, 7 aa, Mycobacterium
ISGGHAE

SEQ ID NO: 509060 - protein, 9 aa, Mycobacterium
ISGGHEAQR

SEQ ID NO: 509061 - protein, 12 aa, Mycobacterium
ISGGNGEQDKAV

SEQ ID NO: 509062 - protein, 11 aa, Mycobacterium
ISGGPATPTLL

SEQ ID NO: 509063 - protein, 19 aa, Mycobacterium
ISGGPDAPTVTDGPFAESA

SEQ ID NO: 509064 - protein, 8 aa, Mycobacterium
ISGGPTLP

SEQ ID NO: 509065 - protein, 8 aa, Mycobacterium
ISGGRQNF

SEQ ID NO: 509066 - protein, 9 aa, Mycobacterium
ISGGSGLGS

SEQ ID NO: 509067 - protein, 7 aa, Mycobacterium
ISGGSSE

SEQ ID NO: 509068 - protein, 6 aa, Mycobacterium
ISGGTD

SEQ ID NO: 509069 - protein, 4 aa, Mycobacterium
ISGK

SEQ ID NO: 509070 - protein, 9 aa, Mycobacterium
ISGKKNEPE

SEQ ID NO: 509071 - protein, 8 aa, Mycobacterium
ISGKPGTY

SEQ ID NO: 509072 - protein, 10 aa, Mycobacterium
ISGKPTTVSA

SEQ ID NO: 509073 - protein, 10 aa, Mycobacterium
ISGKTARNHV

SEQ ID NO: 509074 - protein, 18 aa, Mycobacterium
ISGLPNAGLDAANAAPTV

SEQ ID NO: 509075 - protein, 10 aa, Mycobacterium
ISGNKGDSAY

SEQ ID NO: 509076 - protein, 8 aa, Mycobacterium
ISGNRGDS

SEQ ID NO: 509077 - protein, 10 aa, Mycobacterium
ISGNVGTDPA

SEQ ID NO: 509078 - protein, 8 aa, Mycobacterium
ISGPARAP

SEQ ID NO: 509079 - protein, 10 aa, Mycobacterium
ISGPDGDGND

SEQ ID NO: 509080 - protein, 7 aa, Mycobacterium
ISGPGKV

SEQ ID NO: 509081 - protein, 6 aa, Mycobacterium
ISGPKG

SEQ ID NO: 509082 - protein, 5 aa, Mycobacterium
ISGPR

SEQ ID NO: 509083 - protein, 25 aa, Mycobacterium
ISGPTAPSWRKGPRHIAGRGPRDTY

SEQ ID NO: 509084 - protein, 5 aa, Mycobacterium
ISGPY

SEQ ID NO: 509085 - protein, 7 aa, Mycobacterium
ISGQGGM

SEQ ID NO: 509086 - protein, 9 aa, Mycobacterium
ISGQGGWDD

SEQ ID NO: 509087 - protein, 12 aa, Mycobacterium
ISGQLAKAAAGP

SEQ ID NO: 509088 - protein, 4 aa, Mycobacterium
ISGR

SEQ ID NO: 509089 - protein, 7 aa, Mycobacterium
ISGRDEQ

SEQ ID NO: 509090 - protein, 6 aa, Mycobacterium
ISGRES

SEQ ID NO: 509091 - protein, 8 aa, Mycobacterium
ISGRGAGS

SEQ ID NO: 509092 - protein, 8 aa, Mycobacterium
ISGRGPLR

SEQ ID NO: 509093 - protein, 5 aa, Mycobacterium
ISGRR

SEQ ID NO: 509094 - protein, 8 aa, Mycobacterium
ISGRREEI

SEQ ID NO: 509095 - protein, 6 aa, Mycobacterium
ISGRTG

SEQ ID NO: 509096 - protein, 8 aa, Mycobacterium
ISGRTTAI

SEQ ID NO: 509097 - protein, 9 aa, Mycobacterium
ISGSARTAE

SEQ ID NO: 509098 - protein, 14 aa, Mycobacterium
ISGSASASGGGAAI

SEQ ID NO: 509099 - protein, 9 aa, Mycobacterium
ISGSGKSSL

SEQ ID NO: 509100 - protein, 11 aa, Mycobacterium
ISGSGNQRLPT

SEQ ID NO: 509101 - protein, 11 aa, Mycobacterium
ISGSGSLRPAA

SEQ ID NO: 509102 - protein, 13 aa, Mycobacterium
ISGSGYRSLEENQ

SEQ ID NO: 509103 - protein, 9 aa, Mycobacterium
ISGSSGPVI

SEQ ID NO: 509104 - protein, 6 aa, Mycobacterium
ISGSSM

SEQ ID NO: 509105 - protein, 8 aa, Mycobacterium
ISGTDRRG

SEQ ID NO: 509106 - protein, 7 aa, Mycobacterium
ISGTESL

SEQ ID NO: 509107 - protein, 8 aa, Mycobacterium
ISGTVADR

SEQ ID NO: 509108 - protein, 4 aa, Mycobacterium
ISGV

SEQ ID NO: 509109 - protein, 11 aa, Mycobacterium
ISGVATDEQLE

SEQ ID NO: 509110 - protein, 4 aa, Mycobacterium
ISGY

SEQ ID NO: 509111 - protein, 13 aa, Mycobacterium
ISHKDVDKAAGAV

SEQ ID NO: 509112 - protein, 12 aa, Mycobacterium
ISHNAKGAVPKD

SEQ ID NO: 509113 - protein, 14 aa, Mycobacterium
ISHPDTAILAMLLA

SEQ ID NO: 509114 - protein, 7 aa, Mycobacterium
ISHPQPV

SEQ ID NO: 509115 - protein, 39 aa, Mycobacterium
ISHRSTGVTPTTPPNHSQGQRNGYSAGSEAANPGQAGSR

SEQ ID NO: 509116 - protein, 6 aa, Mycobacterium
ISHSGR

SEQ ID NO: 509117 - protein, 6 aa, Mycobacterium
ISIGGK

SEQ ID NO: 509118 - protein, 7 aa, Mycobacterium
ISIQGST

SEQ ID NO: 509119 - protein, 9 aa, Mycobacterium
ISKAADAVS

SEQ ID NO: 509120 - protein, 7 aa, Mycobacterium
ISKAGGR

SEQ ID NO: 509121 - protein, 23 aa, Mycobacterium
ISKAPDINCRSTEGVLGDADRDH

SEQ ID NO: 509122 - protein, 5 aa, Mycobacterium
ISKAS

SEQ ID NO: 509123 - protein, 8 aa, Mycobacterium
ISKATGVA

SEQ ID NO: 509124 - protein, 9 aa, Mycobacterium
ISKEQVAKG

SEQ ID NO: 509125 - protein, 5 aa, Mycobacterium
ISKGD

SEQ ID NO: 509126 - protein, 8 aa, Mycobacterium
ISKNPSHA

SEQ ID NO: 509127 - protein, 12 aa, Mycobacterium
ISKSHAEGAEDD

SEQ ID NO: 509128 - protein, 11 aa, Mycobacterium
ISKVPGRAEEM

SEQ ID NO: 509129 - protein, 7 aa, Mycobacterium
ISLGSAA

SEQ ID NO: 509130 - protein, 8 aa, Mycobacterium
ISLSGDKL

SEQ ID NO: 509131 - protein, 12 aa, Mycobacterium
ISNAELAKASRT

SEQ ID NO: 509132 - protein, 7 aa, Mycobacterium
ISNAGGK

SEQ ID NO: 509133 - protein, 7 aa, Mycobacterium
ISNAGGR

SEQ ID NO: 509134 - protein, 12 aa, Mycobacterium
ISNAYNRPDQLS

SEQ ID NO: 509135 - protein, 10 aa, Mycobacterium
ISNDEAKEQM

SEQ ID NO: 509136 - protein, 5 aa, Mycobacterium
ISNEK

SEQ ID NO: 509137 - protein, 7 aa, Mycobacterium
ISNGQSG

SEQ ID NO: 509138 - protein, 10 aa, Mycobacterium
ISNPADADEH

SEQ ID NO: 509139 - protein, 9 aa, Mycobacterium
ISNPDQCAT

SEQ ID NO: 509140 - protein, 10 aa, Mycobacterium
ISNPPRASDA

SEQ ID NO: 509141 - protein, 7 aa, Mycobacterium
ISNPQND

SEQ ID NO: 509142 - protein, 13 aa, Mycobacterium
ISNPVTSGTGQAT

SEQ ID NO: 509143 - protein, 9 aa, Mycobacterium
ISNRDDRAA

SEQ ID NO: 509144 - protein, 9 aa, Mycobacterium
ISNSGDTAL

SEQ ID NO: 509145 - protein, 9 aa, Mycobacterium
ISNSGGDNV

SEQ ID NO: 509146 - protein, 7 aa, Mycobacterium
ISNTSAE

SEQ ID NO: 509147 - protein, 9 aa, Mycobacterium
ISPADSETL

SEQ ID NO: 509148 - protein, 9 aa, Mycobacterium
ISPAESAAL

SEQ ID NO: 509149 - protein, 9 aa, Mycobacterium
ISPAGAGYA

SEQ ID NO: 509150 - protein, 8 aa, Mycobacterium
ISPAQRPV

SEQ ID NO: 509151 - protein, 12 aa, Mycobacterium
ISPASASEHTSA

SEQ ID NO: 509152 - protein, 21 aa, Mycobacterium
ISPATGSVLGTTSAASAGDMD

SEQ ID NO: 509153 - protein, 12 aa, Mycobacterium
ISPAVADQARHH

SEQ ID NO: 509154 - protein, 12 aa, Mycobacterium
ISPDEIRATNPP

SEQ ID NO: 509155 - protein, 5 aa, Mycobacterium
ISPDG

SEQ ID NO: 509156 - protein, 6 aa, Mycobacterium
ISPDGR

SEQ ID NO: 509157 - protein, 10 aa, Mycobacterium
ISPDGSANLD

SEQ ID NO: 509158 - protein, 8 aa, Mycobacterium
ISPDGTTA

SEQ ID NO: 509159 - protein, 9 aa, Mycobacterium
ISPDSYPTE

SEQ ID NO: 509160 - protein, 6 aa, Mycobacterium
ISPDTD

SEQ ID NO: 509161 - protein, 14 aa, Mycobacterium
ISPEDADAAAARFG

SEQ ID NO: 509162 - protein, 13 aa, Mycobacterium
ISPEELTALRDAL

SEQ ID NO: 509163 - protein, 5 aa, Mycobacterium
ISPEG

SEQ ID NO: 509164 - protein, 7 aa, Mycobacterium
ISPEGDR

SEQ ID NO: 509165 - protein, 18 aa, Mycobacterium
ISPEGLDDTTGKAGEFSS

SEQ ID NO: 509166 - protein, 7 aa, Mycobacterium
ISPELSD

SEQ ID NO: 509167 - protein, 5 aa, Mycobacterium
ISPEM

SEQ ID NO: 509168 - protein, 7 aa, Mycobacterium
ISPERAA

SEQ ID NO: 509169 - protein, 6 aa, Mycobacterium
ISPETY

SEQ ID NO: 509170 - protein, 23 aa, Mycobacterium
ISPETYPAAAAKFGRDAPVPAEQ

SEQ ID NO: 509171 - protein, 4 aa, Mycobacterium
ISPG

SEQ ID NO: 509172 - protein, 11 aa, Mycobacterium
ISPGGAANRAV

SEQ ID NO: 509173 - protein, 8 aa, Mycobacterium
ISPGGVGL

SEQ ID NO: 509174 - protein, 11 aa, Mycobacterium
ISPGNSAGDMR

SEQ ID NO: 509175 - protein, 7 aa, Mycobacterium
ISPGSTL

SEQ ID NO: 509176 - protein, 9 aa, Mycobacterium
ISPGSTPEA

SEQ ID NO: 509177 - protein, 6 aa, Mycobacterium
ISPGTA

SEQ ID NO: 509178 - protein, 18 aa, Mycobacterium
ISPGTSAGDMHENDTVST

SEQ ID NO: 509179 - protein, 7 aa, Mycobacterium
ISPGVGT

SEQ ID NO: 509180 - protein, 5 aa, Mycobacterium
ISPGY

SEQ ID NO: 509181 - protein, 4 aa, Mycobacterium
ISPH

SEQ ID NO: 509182 - protein, 6 aa, Mycobacterium
ISPHGD

SEQ ID NO: 509183 - protein, 6 aa, Mycobacterium
ISPIAK

SEQ ID NO: 509184 - protein, 19 aa, Mycobacterium
ISPKAPPPPPPPPPPPTTR

SEQ ID NO: 509185 - protein, 9 aa, Mycobacterium
ISPKEGESI

SEQ ID NO: 509186 - protein, 9 aa, Mycobacterium
ISPKGSGSV

SEQ ID NO: 509187 - protein, 8 aa, Mycobacterium
ISPPDSGH

SEQ ID NO: 509188 - protein, 9 aa, Mycobacterium
ISPPLPPWQ

SEQ ID NO: 509189 - protein, 19 aa, Mycobacterium
ISPPRPSAAQISLPSPPAA

SEQ ID NO: 509190 - protein, 10 aa, Mycobacterium
ISPPTSGENL

SEQ ID NO: 509191 - protein, 15 aa, Mycobacterium
ISPQDAQQLGVADGE

SEQ ID NO: 509192 - protein, 7 aa, Mycobacterium
ISPQDNR

SEQ ID NO: 509193 - protein, 6 aa, Mycobacterium
ISPQGE

SEQ ID NO: 509194 - protein, 21 aa, Mycobacterium
ISPQGPYGGYKQSGSGRTGGL

SEQ ID NO: 509195 - protein, 11 aa, Mycobacterium
ISPRDDTHGDI

SEQ ID NO: 509196 - protein, 6 aa, Mycobacterium
ISPREH

SEQ ID NO: 509197 - protein, 13 aa, Mycobacterium
ISPRKVNKPVTGQ

SEQ ID NO: 509198 - protein, 21 aa, Mycobacterium
ISPRKVNKPVTGQYAAAGVNP

SEQ ID NO: 509199 - protein, 22 aa, Mycobacterium
ISPRKVNKPVTGQYSAAGVNPR

SEQ ID NO: 509200 - protein, 15 aa, Mycobacterium
ISPRKVNKPVTGQYT

SEQ ID NO: 509201 - protein, 23 aa, Mycobacterium
ISPRKVTKPLTGQYTAAGVNPRR

SEQ ID NO: 509202 - protein, 13 aa, Mycobacterium
ISPRKVTKPVTGQ

SEQ ID NO: 509203 - protein, 6 aa, Mycobacterium
ISPRRH

SEQ ID NO: 509204 - protein, 7 aa, Mycobacterium
ISPRRKG

SEQ ID NO: 509205 - protein, 12 aa, Mycobacterium
ISPRRRARHRTR

SEQ ID NO: 509206 - protein, 4 aa, Mycobacterium
ISPS

SEQ ID NO: 509207 - protein, 14 aa, Mycobacterium
ISPSGGPALPAGPT

SEQ ID NO: 509208 - protein, 10 aa, Mycobacterium
ISPSGPRLAG

SEQ ID NO: 509209 - protein, 8 aa, Mycobacterium
ISPSGRTR

SEQ ID NO: 509210 - protein, 10 aa, Mycobacterium
ISPSLGGNSL

SEQ ID NO: 509211 - protein, 10 aa, Mycobacterium
ISPSPLQEAA

SEQ ID NO: 509212 - protein, 5 aa, Mycobacterium
ISPSQ

SEQ ID NO: 509213 - protein, 9 aa, Mycobacterium
ISPTAEATA

SEQ ID NO: 509214 - protein, 14 aa, Mycobacterium
ISPTATRTPPAFTK

SEQ ID NO: 509215 - protein, 18 aa, Mycobacterium
ISPTDREIEAATAAAPFA

SEQ ID NO: 509216 - protein, 5 aa, Mycobacterium
ISPTT

SEQ ID NO: 509217 - protein, 6 aa, Mycobacterium
ISPVRT

SEQ ID NO: 509218 - protein, 4 aa, Mycobacterium
ISPY

SEQ ID NO: 509219 - protein, 4 aa, Mycobacterium
ISQA

SEQ ID NO: 509220 - protein, 10 aa, Mycobacterium
ISQAESAALS

SEQ ID NO: 509221 - protein, 12 aa, Mycobacterium
ISQEEPVDEFGE

SEQ ID NO: 509222 - protein, 11 aa, Mycobacterium
ISQFGPNAPGY

SEQ ID NO: 509223 - protein, 10 aa, Mycobacterium
ISQGPAAQEM

SEQ ID NO: 509224 - protein, 6 aa, Mycobacterium
ISQKDD

SEQ ID NO: 509225 - protein, 7 aa, Mycobacterium
ISQPERL

SEQ ID NO: 509226 - protein, 17 aa, Mycobacterium
ISQPSVGDTLPEPRGTG

SEQ ID NO: 509227 - protein, 6 aa, Mycobacterium
ISQPTL

SEQ ID NO: 509228 - protein, 20 aa, Mycobacterium
ISQQTDGKLKATAAETSASL

SEQ ID NO: 509229 - protein, 6 aa, Mycobacterium
ISQQTT

SEQ ID NO: 509230 - protein, 9 aa, Mycobacterium
ISQRGARPV

SEQ ID NO: 509231 - protein, 13 aa, Mycobacterium
ISQSHAEGAPDDG

SEQ ID NO: 509232 - protein, 8 aa, Mycobacterium
ISQSVGEN

SEQ ID NO: 509233 - protein, 4 aa, Mycobacterium
ISRA

SEQ ID NO: 509234 - protein, 8 aa, Mycobacterium
ISRAADAV

SEQ ID NO: 509235 - protein, 6 aa, Mycobacterium
ISRADE

SEQ ID NO: 509236 - protein, 11 aa, Mycobacterium
ISRAELQEAGA

SEQ ID NO: 509237 - protein, 6 aa, Mycobacterium
ISRAGG

SEQ ID NO: 509238 - protein, 20 aa, Mycobacterium
ISRAGGPDIQRESNEKAPIG

SEQ ID NO: 509239 - protein, 20 aa, Mycobacterium
ISRAGGPDVQRESTEKAPIG

SEQ ID NO: 509240 - protein, 14 aa, Mycobacterium
ISRASGDFRRETAS

SEQ ID NO: 509241 - protein, 9 aa, Mycobacterium
ISRATAELT

SEQ ID NO: 509242 - protein, 4 aa, Mycobacterium
ISRE

SEQ ID NO: 509243 - protein, 8 aa, Mycobacterium
ISREEQDE

SEQ ID NO: 509244 - protein, 8 aa, Mycobacterium
ISRESDGG

SEQ ID NO: 509245 - protein, 11 aa, Mycobacterium
ISRGDPEAAMR

SEQ ID NO: 509246 - protein, 8 aa, Mycobacterium
ISRGGGPY

SEQ ID NO: 509247 - protein, 6 aa, Mycobacterium
ISRGGR

SEQ ID NO: 509248 - protein, 9 aa, Mycobacterium
ISRGGRYTQ

SEQ ID NO: 509249 - protein, 5 aa, Mycobacterium
ISRGS

SEQ ID NO: 509250 - protein, 4 aa, Mycobacterium
ISRK

SEQ ID NO: 509251 - protein, 9 aa, Mycobacterium
ISRKPNPHL

SEQ ID NO: 509252 - protein, 11 aa, Mycobacterium
ISRKPSTDEPF

SEQ ID NO: 509253 - protein, 10 aa, Mycobacterium
ISRNSGRREK

SEQ ID NO: 509254 - protein, 8 aa, Mycobacterium
ISRPATNR

SEQ ID NO: 509255 - protein, 6 aa, Mycobacterium
ISRPDA

SEQ ID NO: 509256 - protein, 10 aa, Mycobacterium
ISRPEDFSSN

SEQ ID NO: 509257 - protein, 14 aa, Mycobacterium
ISRPESADHGRSLP

SEQ ID NO: 509258 - protein, 19 aa, Mycobacterium
ISRPKDAPKWSDDARKRFK

SEQ ID NO: 509259 - protein, 12 aa, Mycobacterium
ISRPSDVIASTH

SEQ ID NO: 509260 - protein, 10 aa, Mycobacterium
ISRPSRREAE

SEQ ID NO: 509261 - protein, 8 aa, Mycobacterium
ISRQEQDE

SEQ ID NO: 509262 - protein, 6 aa, Mycobacterium
ISRRRT

SEQ ID NO: 509263 - protein, 6 aa, Mycobacterium
ISRSGA

SEQ ID NO: 509264 - protein, 6 aa, Mycobacterium
ISRTDG

SEQ ID NO: 509265 - protein, 9 aa, Mycobacterium
ISRTDSDAL

SEQ ID NO: 509266 - protein, 9 aa, Mycobacterium
ISRTEAARR

SEQ ID NO: 509267 - protein, 11 aa, Mycobacterium
ISRTGSPLATD

SEQ ID NO: 509268 - protein, 4 aa, Mycobacterium
ISRV

SEQ ID NO: 509269 - protein, 11 aa, Mycobacterium
ISRVDDPAAEH

SEQ ID NO: 509270 - protein, 12 aa, Mycobacterium
ISSAAQAIRAGE

SEQ ID NO: 509271 - protein, 15 aa, Mycobacterium
ISSADYSGGAPPVGS

SEQ ID NO: 509272 - protein, 10 aa, Mycobacterium
ISSAGSKGVA

SEQ ID NO: 509273 - protein, 6 aa, Mycobacterium
ISSANG

SEQ ID NO: 509274 - protein, 6 aa, Mycobacterium
ISSANT

SEQ ID NO: 509275 - protein, 9 aa, Mycobacterium
ISSASQLAT

SEQ ID NO: 509276 - protein, 5 aa, Mycobacterium
ISSDG

SEQ ID NO: 509277 - protein, 13 aa, Mycobacterium
ISSDMTKGTQLEP

SEQ ID NO: 509278 - protein, 9 aa, Mycobacterium
ISSDTASLS

SEQ ID NO: 509279 - protein, 6 aa, Mycobacterium
ISSDTL

SEQ ID NO: 509280 - protein, 4 aa, Mycobacterium
ISSE

SEQ ID NO: 509281 - protein, 7 aa, Mycobacterium
ISSEEAG

SEQ ID NO: 509282 - protein, 8 aa, Mycobacterium
ISSETGDA

SEQ ID NO: 509283 - protein, 10 aa, Mycobacterium
ISSETSWEAP

SEQ ID NO: 509284 - protein, 13 aa, Mycobacterium
ISSGDSAFDSRSA

SEQ ID NO: 509285 - protein, 9 aa, Mycobacterium
ISSGENAST

SEQ ID NO: 509286 - protein, 10 aa, Mycobacterium
ISSGGSDESV

SEQ ID NO: 509287 - protein, 11 aa, Mycobacterium
ISSGHSGQLQQ

SEQ ID NO: 509288 - protein, 15 aa, Mycobacterium
ISSGSYGDTEAINAS

SEQ ID NO: 509289 - protein, 11 aa, Mycobacterium
ISSKEARRRCT

SEQ ID NO: 509290 - protein, 12 aa, Mycobacterium
ISSKKAGPTVPD

SEQ ID NO: 509291 - protein, 6 aa, Mycobacterium
ISSPDP

SEQ ID NO: 509292 - protein, 12 aa, Mycobacterium
ISSPSDPTANPI

SEQ ID NO: 509293 - protein, 14 aa, Mycobacterium
ISSPTAAVNQNAAV

SEQ ID NO: 509294 - protein, 13 aa, Mycobacterium
ISSPTDPAANPIL

SEQ ID NO: 509295 - protein, 13 aa, Mycobacterium
ISSPTDPTANPIL

SEQ ID NO: 509296 - protein, 9 aa, Mycobacterium
ISSRDGGFD

SEQ ID NO: 509297 - protein, 8 aa, Mycobacterium
ISSRQASE

SEQ ID NO: 509298 - protein, 8 aa, Mycobacterium
ISSSQPAL

SEQ ID NO: 509299 - protein, 9 aa, Mycobacterium
ISSTDTPPF

SEQ ID NO: 509300 - protein, 8 aa, Mycobacterium
ISSTTERF

SEQ ID NO: 509301 - protein, 10 aa, Mycobacterium
ISSVAGRKGY

SEQ ID NO: 509302 - protein, 13 aa, Mycobacterium
ISTADRPANGADL

SEQ ID NO: 509303 - protein, 5 aa, Mycobacterium
ISTAE

SEQ ID NO: 509304 - protein, 6 aa, Mycobacterium
ISTAEV

SEQ ID NO: 509305 - protein, 5 aa, Mycobacterium
ISTDE

SEQ ID NO: 509306 - protein, 5 aa, Mycobacterium
ISTDG

SEQ ID NO: 509307 - protein, 7 aa, Mycobacterium
ISTEDAK

SEQ ID NO: 509308 - protein, 19 aa, Mycobacterium
ISTEDRRRPVNAGTRQGRN

SEQ ID NO: 509309 - protein, 10 aa, Mycobacterium
ISTEEAKDQM

SEQ ID NO: 509310 - protein, 9 aa, Mycobacterium
ISTEPVAGA

SEQ ID NO: 509311 - protein, 6 aa, Mycobacterium
ISTEQF

SEQ ID NO: 509312 - protein, 8 aa, Mycobacterium
ISTGGGAS

SEQ ID NO: 509313 - protein, 6 aa, Mycobacterium
ISTGQV

SEQ ID NO: 509314 - protein, 4 aa, Mycobacterium
ISTP

SEQ ID NO: 509315 - protein, 7 aa, Mycobacterium
ISTPSRD

SEQ ID NO: 509316 - protein, 12 aa, Mycobacterium
ISTRAPGNSEVT

SEQ ID NO: 509317 - protein, 7 aa, Mycobacterium
ISTRSPL

SEQ ID NO: 509318 - protein, 6 aa, Mycobacterium
ISTRTA

SEQ ID NO: 509319 - protein, 60 aa, Mycobacterium
ISTSSAGPAVPAGTATHQDAAASAGPAVATHASGGADCGSSPAGPAVSAGASSAQQPSGV

SEQ ID NO: 509320 - protein, 5 aa, Mycobacterium
ISTTE

SEQ ID NO: 509321 - protein, 11 aa, Mycobacterium
ISVAEKGSGPA

SEQ ID NO: 509322 - protein, 6 aa, Mycobacterium
ISVDDA

SEQ ID NO: 509323 - protein, 11 aa, Mycobacterium
ISVGPSETVDA

SEQ ID NO: 509324 - protein, 4 aa, Mycobacterium
ISVP

SEQ ID NO: 509325 - protein, 6 aa, Mycobacterium
ISVSDA

SEQ ID NO: 509326 - protein, 13 aa, Mycobacterium
ISVSDPADVAREG

SEQ ID NO: 509327 - protein, 9 aa, Mycobacterium
ISVSRNDDG

SEQ ID NO: 509328 - protein, 5 aa, Mycobacterium
ISVTP

SEQ ID NO: 509329 - protein, 6 aa, Mycobacterium
ITAAGE

SEQ ID NO: 509330 - protein, 9 aa, Mycobacterium
ITAAGQSHR

SEQ ID NO: 509331 - protein, 9 aa, Mycobacterium
ITAAPAGTA

SEQ ID NO: 509332 - protein, 11 aa, Mycobacterium
ITAATGRQPRG

SEQ ID NO: 509333 - protein, 6 aa, Mycobacterium
ITADAA

SEQ ID NO: 509334 - protein, 6 aa, Mycobacterium
ITADEG

SEQ ID NO: 509335 - protein, 5 aa, Mycobacterium
ITADG

SEQ ID NO: 509336 - protein, 5 aa, Mycobacterium
ITADQ

SEQ ID NO: 509337 - protein, 12 aa, Mycobacterium
ITAEAESALGTV

SEQ ID NO: 509338 - protein, 6 aa, Mycobacterium
ITAEAG

SEQ ID NO: 509339 - protein, 8 aa, Mycobacterium
ITAEEAER

SEQ ID NO: 509340 - protein, 9 aa, Mycobacterium
ITAEQQRRA

SEQ ID NO: 509341 - protein, 5 aa, Mycobacterium
ITAES

SEQ ID NO: 509342 - protein, 14 aa, Mycobacterium
ITAGAALYRKPLPA

SEQ ID NO: 509343 - protein, 25 aa, Mycobacterium
ITAGGGSAEASTTRLPALAQREPVL

SEQ ID NO: 509344 - protein, 6 aa, Mycobacterium
ITAGRG

SEQ ID NO: 509345 - protein, 11 aa, Mycobacterium
ITAGSKSNVIP

SEQ ID NO: 509346 - protein, 20 aa, Mycobacterium
ITAGTTGTTGNPGRSGWTGG

SEQ ID NO: 509347 - protein, 21 aa, Mycobacterium
ITAGTTGTTGNPGRSGWTGGA

SEQ ID NO: 509348 - protein, 7 aa, Mycobacterium
ITAHGGN

SEQ ID NO: 509349 - protein, 13 aa, Mycobacterium
ITANTPRPSSRPA

SEQ ID NO: 509350 - protein, 6 aa, Mycobacterium
ITAPAG

SEQ ID NO: 509351 - protein, 6 aa, Mycobacterium
ITAPGA

SEQ ID NO: 509352 - protein, 13 aa, Mycobacterium
ITAPGVSPASPMR

SEQ ID NO: 509353 - protein, 9 aa, Mycobacterium
ITAPKAGTV

SEQ ID NO: 509354 - protein, 10 aa, Mycobacterium
ITAPNDGTVE

SEQ ID NO: 509355 - protein, 5 aa, Mycobacterium
ITAPR

SEQ ID NO: 509356 - protein, 14 aa, Mycobacterium
ITAPTRVAAGPTGC

SEQ ID NO: 509357 - protein, 5 aa, Mycobacterium
ITASE

SEQ ID NO: 509358 - protein, 7 aa, Mycobacterium
ITASPAD

SEQ ID NO: 509359 - protein, 11 aa, Mycobacterium
ITATDDLRNPA

SEQ ID NO: 509360 - protein, 6 aa, Mycobacterium
ITATSE

SEQ ID NO: 509361 - protein, 4 aa, Mycobacterium
ITCG

SEQ ID NO: 509362 - protein, 7 aa, Mycobacterium
ITDADDV

SEQ ID NO: 509363 - protein, 8 aa, Mycobacterium
ITDARSNT

SEQ ID NO: 509364 - protein, 10 aa, Mycobacterium
ITDAVGKGAN

SEQ ID NO: 509365 - protein, 4 aa, Mycobacterium
ITDC

SEQ ID NO: 509366 - protein, 8 aa, Mycobacterium
ITDDAEVE

SEQ ID NO: 509367 - protein, 5 aa, Mycobacterium
ITDDD

SEQ ID NO: 509368 - protein, 6 aa, Mycobacterium
ITDDDE

SEQ ID NO: 509369 - protein, 7 aa, Mycobacterium
ITDDDQV

SEQ ID NO: 509370 - protein, 5 aa, Mycobacterium
ITDDG

SEQ ID NO: 509371 - protein, 14 aa, Mycobacterium
ITDEEAGWQRTTRE

SEQ ID NO: 509372 - protein, 13 aa, Mycobacterium
ITDEGGRTPPSHR

SEQ ID NO: 509373 - protein, 8 aa, Mycobacterium
ITDEPGAR

SEQ ID NO: 509374 - protein, 6 aa, Mycobacterium
ITDEQY

SEQ ID NO: 509375 - protein, 12 aa, Mycobacterium
ITDFGSARASQT

SEQ ID NO: 509376 - protein, 12 aa, Mycobacterium
ITDGEGGEVNPK

SEQ ID NO: 509377 - protein, 12 aa, Mycobacterium
ITDGEGGEVSPK

SEQ ID NO: 509378 - protein, 9 aa, Mycobacterium
ITDGPGDPL

SEQ ID NO: 509379 - protein, 7 aa, Mycobacterium
ITDGTGS

SEQ ID NO: 509380 - protein, 9 aa, Mycobacterium
ITDINGGGQ

SEQ ID NO: 509381 - protein, 4 aa, Mycobacterium
ITDN

SEQ ID NO: 509382 - protein, 6 aa, Mycobacterium
ITDNPE

SEQ ID NO: 509383 - protein, 7 aa, Mycobacterium
ITDPAAA

SEQ ID NO: 509384 - protein, 9 aa, Mycobacterium
ITDPAAAGR

SEQ ID NO: 509385 - protein, 9 aa, Mycobacterium
ITDPAEAMT

SEQ ID NO: 509386 - protein, 21 aa, Mycobacterium
ITDPATGRPLATNDKNGAVDA

SEQ ID NO: 509387 - protein, 5 aa, Mycobacterium
ITDPD

SEQ ID NO: 509388 - protein, 11 aa, Mycobacterium
ITDPESGRELG

SEQ ID NO: 509389 - protein, 8 aa, Mycobacterium
ITDPGAAG

SEQ ID NO: 509390 - protein, 59 aa, Mycobacterium
ITDPGNAASAITVGSTHRSRPHTSGVTYDSSKGPTLDGRTKPDLVAPGERITSAAAGQM

SEQ ID NO: 509391 - protein, 7 aa, Mycobacterium
ITDPGQQ

SEQ ID NO: 509392 - protein, 14 aa, Mycobacterium
ITDPSALADTAGYA

SEQ ID NO: 509393 - protein, 19 aa, Mycobacterium
ITDQGSWKTPAADPDNGGR

SEQ ID NO: 509394 - protein, 7 aa, Mycobacterium
ITDQQGR

SEQ ID NO: 509395 - protein, 13 aa, Mycobacterium
ITDQSRTPVYDSS

SEQ ID NO: 509396 - protein, 9 aa, Mycobacterium
ITDRQQVGD

SEQ ID NO: 509397 - protein, 7 aa, Mycobacterium
ITDSEGV

SEQ ID NO: 509398 - protein, 8 aa, Mycobacterium
ITDSETAA

SEQ ID NO: 509399 - protein, 14 aa, Mycobacterium
ITDSKTGESYTLTP

SEQ ID NO: 509400 - protein, 9 aa, Mycobacterium
ITDSPTRRA

SEQ ID NO: 509401 - protein, 7 aa, Mycobacterium
ITDSSGL

SEQ ID NO: 509402 - protein, 9 aa, Mycobacterium
ITDVNGGGQ

SEQ ID NO: 509403 - protein, 4 aa, Mycobacterium
ITEA

SEQ ID NO: 509404 - protein, 7 aa, Mycobacterium
ITEAETA

SEQ ID NO: 509405 - protein, 10 aa, Mycobacterium
ITEARGGPLG

SEQ ID NO: 509406 - protein, 13 aa, Mycobacterium
ITEASGGSDPARA

SEQ ID NO: 509407 - protein, 9 aa, Mycobacterium
ITEDDAHHA

SEQ ID NO: 509408 - protein, 13 aa, Mycobacterium
ITEDPRPATSRMT

SEQ ID NO: 509409 - protein, 15 aa, Mycobacterium
ITEDTSAEPGAAATV

SEQ ID NO: 509410 - protein, 14 aa, Mycobacterium
ITEETGANISIEDD

SEQ ID NO: 509411 - protein, 8 aa, Mycobacterium
ITEETGAQ

SEQ ID NO: 509412 - protein, 4 aa, Mycobacterium
ITEG

SEQ ID NO: 509413 - protein, 14 aa, Mycobacterium
ITEGDSDPEHEEQD

SEQ ID NO: 509414 - protein, 12 aa, Mycobacterium
ITEGEGGEVSPK

SEQ ID NO: 509415 - protein, 14 aa, Mycobacterium
ITEGESEREHEEQD

SEQ ID NO: 509416 - protein, 9 aa, Mycobacterium
ITEGGARSV

SEQ ID NO: 509417 - protein, 10 aa, Mycobacterium
ITEGGDEAQV

SEQ ID NO: 509418 - protein, 15 aa, Mycobacterium
ITEGPHDREHEEQDM

SEQ ID NO: 509419 - protein, 6 aa, Mycobacterium
ITEGSG

SEQ ID NO: 509420 - protein, 5 aa, Mycobacterium
ITEGT

SEQ ID NO: 509421 - protein, 4 aa, Mycobacterium
ITEN

SEQ ID NO: 509422 - protein, 28 aa, Mycobacterium
ITEPDAGSDVSSLTTTATRTADGWSVNG

SEQ ID NO: 509423 - protein, 19 aa, Mycobacterium
ITEPDGTTTKINEPGATLD

SEQ ID NO: 509424 - protein, 11 aa, Mycobacterium
ITEPDTGSDVA

SEQ ID NO: 509425 - protein, 17 aa, Mycobacterium
ITEPDTSESLGAPTQHR

SEQ ID NO: 509426 - protein, 6 aa, Mycobacterium
ITEPEQ

SEQ ID NO: 509427 - protein, 7 aa, Mycobacterium
ITEPPPC

SEQ ID NO: 509428 - protein, 8 aa, Mycobacterium
ITEPPPHG

SEQ ID NO: 509429 - protein, 14 aa, Mycobacterium
ITEPTAELKPELNS

SEQ ID NO: 509430 - protein, 6 aa, Mycobacterium
ITEPTH

SEQ ID NO: 509431 - protein, 6 aa, Mycobacterium
ITEPTL

SEQ ID NO: 509432 - protein, 10 aa, Mycobacterium
ITERGYRAST

SEQ ID NO: 509433 - protein, 4 aa, Mycobacterium
ITES

SEQ ID NO: 509434 - protein, 10 aa, Mycobacterium
ITESDNAAAE

SEQ ID NO: 509435 - protein, 11 aa, Mycobacterium
ITESDNRASEQ

SEQ ID NO: 509436 - protein, 7 aa, Mycobacterium
ITESDNV

SEQ ID NO: 509437 - protein, 7 aa, Mycobacterium
ITESRNA

SEQ ID NO: 509438 - protein, 4 aa, Mycobacterium
ITET

SEQ ID NO: 509439 - protein, 12 aa, Mycobacterium
ITETGSATNRAE

SEQ ID NO: 509440 - protein, 14 aa, Mycobacterium
ITETRAVAGDRPLK

SEQ ID NO: 509441 - protein, 6 aa, Mycobacterium
ITETSK

SEQ ID NO: 509442 - protein, 9 aa, Mycobacterium
ITETSSPAL

SEQ ID NO: 509443 - protein, 20 aa, Mycobacterium
ITEVPAPPAEQPPERPRREL

SEQ ID NO: 509444 - protein, 11 aa, Mycobacterium
ITEVSAPSAAT

SEQ ID NO: 509445 - protein, 5 aa, Mycobacterium
ITEYE

SEQ ID NO: 509446 - protein, 4 aa, Mycobacterium
ITGA

SEQ ID NO: 509447 - protein, 7 aa, Mycobacterium
ITGADPE

SEQ ID NO: 509448 - protein, 10 aa, Mycobacterium
ITGAGEQRSQ

SEQ ID NO: 509449 - protein, 5 aa, Mycobacterium
ITGAP

SEQ ID NO: 509450 - protein, 11 aa, Mycobacterium
ITGASKSTIAN

SEQ ID NO: 509451 - protein, 16 aa, Mycobacterium
ITGDHPAAPDVLTGAD

SEQ ID NO: 509452 - protein, 17 aa, Mycobacterium
ITGDPVARVPADATIAD

SEQ ID NO: 509453 - protein, 4 aa, Mycobacterium
ITGE

SEQ ID NO: 509454 - protein, 5 aa, Mycobacterium
ITGEA

SEQ ID NO: 509455 - protein, 7 aa, Mycobacterium
ITGEDGD

SEQ ID NO: 509456 - protein, 14 aa, Mycobacterium
ITGEDGEPTPQRAN

SEQ ID NO: 509457 - protein, 9 aa, Mycobacterium
ITGEPADEG

SEQ ID NO: 509458 - protein, 9 aa, Mycobacterium
ITGEPEDSY

SEQ ID NO: 509459 - protein, 4 aa, Mycobacterium
ITGG

SEQ ID NO: 509460 - protein, 6 aa, Mycobacterium
ITGGAP

SEQ ID NO: 509461 - protein, 7 aa, Mycobacterium
ITGGATA

SEQ ID NO: 509462 - protein, 5 aa, Mycobacterium
ITGGG

SEQ ID NO: 509463 - protein, 19 aa, Mycobacterium
ITGGPDAPITTDGPFAESA

SEQ ID NO: 509464 - protein, 10 aa, Mycobacterium
ITGGPGKPPV

SEQ ID NO: 509465 - protein, 5 aa, Mycobacterium
ITGGR

SEQ ID NO: 509466 - protein, 6 aa, Mycobacterium
ITGGSD

SEQ ID NO: 509467 - protein, 8 aa, Mycobacterium
ITGGSKGI

SEQ ID NO: 509468 - protein, 11 aa, Mycobacterium
ITGGSKGIGAA

SEQ ID NO: 509469 - protein, 6 aa, Mycobacterium
ITGGTQ

SEQ ID NO: 509470 - protein, 9 aa, Mycobacterium
ITGGTSGIG

SEQ ID NO: 509471 - protein, 26 aa, Mycobacterium
ITGHDDDITDYSPDGVATRAEAARAT

SEQ ID NO: 509472 - protein, 5 aa, Mycobacterium
ITGIQ

SEQ ID NO: 509473 - protein, 10 aa, Mycobacterium
ITGKDEEDLV

SEQ ID NO: 509474 - protein, 10 aa, Mycobacterium
ITGKSRDLRT

SEQ ID NO: 509475 - protein, 11 aa, Mycobacterium
ITGLREEGGAL

SEQ ID NO: 509476 - protein, 8 aa, Mycobacterium
ITGNTARG

SEQ ID NO: 509477 - protein, 12 aa, Mycobacterium
ITGPETEREHGG

SEQ ID NO: 509478 - protein, 15 aa, Mycobacterium
ITGPETYQEPARPPN

SEQ ID NO: 509479 - protein, 10 aa, Mycobacterium
ITGPKTQAYT

SEQ ID NO: 509480 - protein, 7 aa, Mycobacterium
ITGPMPA

SEQ ID NO: 509481 - protein, 19 aa, Mycobacterium
ITGPPEGGTRVHWVAPLID

SEQ ID NO: 509482 - protein, 10 aa, Mycobacterium
ITGPQGPDAL

SEQ ID NO: 509483 - protein, 5 aa, Mycobacterium
ITGPR

SEQ ID NO: 509484 - protein, 6 aa, Mycobacterium
ITGPRA

SEQ ID NO: 509485 - protein, 7 aa, Mycobacterium
ITGPSSA

SEQ ID NO: 509486 - protein, 14 aa, Mycobacterium
ITGPTTLPLEFDVR

SEQ ID NO: 509487 - protein, 5 aa, Mycobacterium
ITGPV

SEQ ID NO: 509488 - protein, 9 aa, Mycobacterium
ITGPVTGYP

SEQ ID NO: 509489 - protein, 7 aa, Mycobacterium
ITGQTHA

SEQ ID NO: 509490 - protein, 4 aa, Mycobacterium
ITGR

SEQ ID NO: 509491 - protein, 5 aa, Mycobacterium
ITGRD

SEQ ID NO: 509492 - protein, 14 aa, Mycobacterium
ITGRDDPGAVTTTA

SEQ ID NO: 509493 - protein, 6 aa, Mycobacterium
ITGRDG

SEQ ID NO: 509494 - protein, 11 aa, Mycobacterium
ITGRDGHPAST

SEQ ID NO: 509495 - protein, 6 aa, Mycobacterium
ITGREN

SEQ ID NO: 509496 - protein, 5 aa, Mycobacterium
ITGRG

SEQ ID NO: 509497 - protein, 6 aa, Mycobacterium
ITGRPA

SEQ ID NO: 509498 - protein, 11 aa, Mycobacterium
ITGRPATDAGQ

SEQ ID NO: 509499 - protein, 6 aa, Mycobacterium
ITGRRP

SEQ ID NO: 509500 - protein, 17 aa, Mycobacterium
ITGRTADRLAEASSTTA

SEQ ID NO: 509501 - protein, 10 aa, Mycobacterium
ITGSAGGEFG

SEQ ID NO: 509502 - protein, 11 aa, Mycobacterium
ITGSDADPTPL

SEQ ID NO: 509503 - protein, 6 aa, Mycobacterium
ITGSEL

SEQ ID NO: 509504 - protein, 14 aa, Mycobacterium
ITGSELRADGGFQL

SEQ ID NO: 509505 - protein, 7 aa, Mycobacterium
ITGSEPT

SEQ ID NO: 509506 - protein, 8 aa, Mycobacterium
ITGSESDQ

SEQ ID NO: 509507 - protein, 8 aa, Mycobacterium
ITGSGAAL

SEQ ID NO: 509508 - protein, 7 aa, Mycobacterium
ITGSGIE

SEQ ID NO: 509509 - protein, 9 aa, Mycobacterium
ITGSRGTSA

SEQ ID NO: 509510 - protein, 6 aa, Mycobacterium
ITGSRR

SEQ ID NO: 509511 - protein, 12 aa, Mycobacterium
ITGSSGSGKSSL

SEQ ID NO: 509512 - protein, 6 aa, Mycobacterium
ITGSSK

SEQ ID NO: 509513 - protein, 10 aa, Mycobacterium
ITGSTAGDAL

SEQ ID NO: 509514 - protein, 16 aa, Mycobacterium
ITGTADKDWHRTIFAK

SEQ ID NO: 509515 - protein, 10 aa, Mycobacterium
ITGTAESGTV

SEQ ID NO: 509516 - protein, 18 aa, Mycobacterium
ITGTDTDGDIAGDGDGAE

SEQ ID NO: 509517 - protein, 12 aa, Mycobacterium
ITGTDTGAAGDY

SEQ ID NO: 509518 - protein, 11 aa, Mycobacterium
ITGTDTGAAHD

SEQ ID NO: 509519 - protein, 12 aa, Mycobacterium
ITGTDTGAANDH

SEQ ID NO: 509520 - protein, 7 aa, Mycobacterium
ITGTGRH

SEQ ID NO: 509521 - protein, 6 aa, Mycobacterium
ITGTSD

SEQ ID NO: 509522 - protein, 9 aa, Mycobacterium
ITGTSPLNT

SEQ ID NO: 509523 - protein, 11 aa, Mycobacterium
ITGVGGEPAGD

SEQ ID NO: 509524 - protein, 7 aa, Mycobacterium
ITGYRNG

SEQ ID NO: 509525 - protein, 18 aa, Mycobacterium
ITGYSDKNKGELVKMLRN

SEQ ID NO: 509526 - protein, 10 aa, Mycobacterium
ITHGANAATE

SEQ ID NO: 509527 - protein, 10 aa, Mycobacterium
ITHKSGTTTY

SEQ ID NO: 509528 - protein, 6 aa, Mycobacterium
ITHPSA

SEQ ID NO: 509529 - protein, 11 aa, Mycobacterium
ITHPSAANAEA

SEQ ID NO: 509530 - protein, 13 aa, Mycobacterium
ITHQGRKSGKPYK

SEQ ID NO: 509531 - protein, 13 aa, Mycobacterium
ITHRGRKSGKSYR

SEQ ID NO: 509532 - protein, 11 aa, Mycobacterium
ITKDGGTAIAS

SEQ ID NO: 509533 - protein, 5 aa, Mycobacterium
ITKET

SEQ ID NO: 509534 - protein, 4 aa, Mycobacterium
ITKG

SEQ ID NO: 509535 - protein, 9 aa, Mycobacterium
ITKGDTTVT

SEQ ID NO: 509536 - protein, 6 aa, Mycobacterium
ITKGRK

SEQ ID NO: 509537 - protein, 6 aa, Mycobacterium
ITKGSS

SEQ ID NO: 509538 - protein, 7 aa, Mycobacterium
ITKGTGL

SEQ ID NO: 509539 - protein, 6 aa, Mycobacterium
ITKNNP

SEQ ID NO: 509540 - protein, 7 aa, Mycobacterium
ITKNNPE

SEQ ID NO: 509541 - protein, 6 aa, Mycobacterium
ITKPRG

SEQ ID NO: 509542 - protein, 10 aa, Mycobacterium
ITKRDSSVGG

SEQ ID NO: 509543 - protein, 9 aa, Mycobacterium
ITKRTNGYA

SEQ ID NO: 509544 - protein, 7 aa, Mycobacterium
ITKTSEV

SEQ ID NO: 509545 - protein, 6 aa, Mycobacterium
ITNADG

SEQ ID NO: 509546 - protein, 9 aa, Mycobacterium
ITNEAKSDI

SEQ ID NO: 509547 - protein, 4 aa, Mycobacterium
ITNG

SEQ ID NO: 509548 - protein, 25 aa, Mycobacterium
ITNGAPAKTAKPKKKSKPPAKRKIP

SEQ ID NO: 509549 - protein, 6 aa, Mycobacterium
ITNGQN

SEQ ID NO: 509550 - protein, 6 aa, Mycobacterium
ITNGQQ

SEQ ID NO: 509551 - protein, 12 aa, Mycobacterium
ITNNSVPGAPNR

SEQ ID NO: 509552 - protein, 7 aa, Mycobacterium
ITNPDDR

SEQ ID NO: 509553 - protein, 6 aa, Mycobacterium
ITNPPI

SEQ ID NO: 509554 - protein, 9 aa, Mycobacterium
ITNSGGHTI

SEQ ID NO: 509555 - protein, 5 aa, Mycobacterium
ITNTA

SEQ ID NO: 509556 - protein, 8 aa, Mycobacterium
ITNTGAQV

SEQ ID NO: 509557 - protein, 10 aa, Mycobacterium
ITPAAGGTQR

SEQ ID NO: 509558 - protein, 15 aa, Mycobacterium
ITPAAPLPGAPRRAG

SEQ ID NO: 509559 - protein, 8 aa, Mycobacterium
ITPADSPL

SEQ ID NO: 509560 - protein, 11 aa, Mycobacterium
ITPAEDDIRPG

SEQ ID NO: 509561 - protein, 7 aa, Mycobacterium
ITPAEGI

SEQ ID NO: 509562 - protein, 6 aa, Mycobacterium
ITPAER

SEQ ID NO: 509563 - protein, 5 aa, Mycobacterium
ITPAG

SEQ ID NO: 509564 - protein, 7 aa, Mycobacterium
ITPAGTP

SEQ ID NO: 509565 - protein, 6 aa, Mycobacterium
ITPAPI

SEQ ID NO: 509566 - protein, 5 aa, Mycobacterium
ITPDE

SEQ ID NO: 509567 - protein, 7 aa, Mycobacterium
ITPDEGV

SEQ ID NO: 509568 - protein, 7 aa, Mycobacterium
ITPDGAA

SEQ ID NO: 509569 - protein, 6 aa, Mycobacterium
ITPDGE

SEQ ID NO: 509570 - protein, 9 aa, Mycobacterium
ITPDGQKLS

SEQ ID NO: 509571 - protein, 6 aa, Mycobacterium
ITPDGS

SEQ ID NO: 509572 - protein, 6 aa, Mycobacterium
ITPDPG

SEQ ID NO: 509573 - protein, 7 aa, Mycobacterium
ITPDPRQ

SEQ ID NO: 509574 - protein, 6 aa, Mycobacterium
ITPDTK

SEQ ID NO: 509575 - protein, 6 aa, Mycobacterium
ITPDTT

SEQ ID NO: 509576 - protein, 4 aa, Mycobacterium
ITPE

SEQ ID NO: 509577 - protein, 8 aa, Mycobacterium
ITPEAADP

SEQ ID NO: 509578 - protein, 5 aa, Mycobacterium
ITPEG

SEQ ID NO: 509579 - protein, 7 aa, Mycobacterium
ITPEGDQ

SEQ ID NO: 509580 - protein, 6 aa, Mycobacterium
ITPETT

SEQ ID NO: 509581 - protein, 21 aa, Mycobacterium
ITPGATTIDTQAKYTAAQEEL

SEQ ID NO: 509582 - protein, 16 aa, Mycobacterium
ITPGDNYFTSGGGRPH

SEQ ID NO: 509583 - protein, 8 aa, Mycobacterium
ITPGKGGL

SEQ ID NO: 509584 - protein, 9 aa, Mycobacterium
ITPGQEPID

SEQ ID NO: 509585 - protein, 6 aa, Mycobacterium
ITPGQR

SEQ ID NO: 509586 - protein, 9 aa, Mycobacterium
ITPGSGEKR

SEQ ID NO: 509587 - protein, 8 aa, Mycobacterium
ITPGTPGA

SEQ ID NO: 509588 - protein, 12 aa, Mycobacterium
ITPHNSGDVRGW

SEQ ID NO: 509589 - protein, 13 aa, Mycobacterium
ITPHSGRVTRRGG

SEQ ID NO: 509590 - protein, 8 aa, Mycobacterium
ITPKGDNW

SEQ ID NO: 509591 - protein, 6 aa, Mycobacterium
ITPNEV

SEQ ID NO: 509592 - protein, 20 aa, Mycobacterium
ITPPATRADLDKTSELVESA

SEQ ID NO: 509593 - protein, 8 aa, Mycobacterium
ITPPGNRG

SEQ ID NO: 509594 - protein, 8 aa, Mycobacterium
ITPPPLRG

SEQ ID NO: 509595 - protein, 7 aa, Mycobacterium
ITPPPLS

SEQ ID NO: 509596 - protein, 4 aa, Mycobacterium
ITPQ

SEQ ID NO: 509597 - protein, 5 aa, Mycobacterium
ITPQA

SEQ ID NO: 509598 - protein, 4 aa, Mycobacterium
ITPR

SEQ ID NO: 509599 - protein, 5 aa, Mycobacterium
ITPRT

SEQ ID NO: 509600 - protein, 10 aa, Mycobacterium
ITPSDAREEA

SEQ ID NO: 509601 - protein, 9 aa, Mycobacterium
ITPSGGAQF

SEQ ID NO: 509602 - protein, 6 aa, Mycobacterium
ITPSGR

SEQ ID NO: 509603 - protein, 5 aa, Mycobacterium
ITPSK

SEQ ID NO: 509604 - protein, 12 aa, Mycobacterium
ITPSSKKKPRPL

SEQ ID NO: 509605 - protein, 15 aa, Mycobacterium
ITPTAASSDQASRTQ

SEQ ID NO: 509606 - protein, 14 aa, Mycobacterium
ITPTDPTEAAGPDA

SEQ ID NO: 509607 - protein, 14 aa, Mycobacterium
ITPTDYRKAFAVAA

SEQ ID NO: 509608 - protein, 7 aa, Mycobacterium
ITPTGGH

SEQ ID NO: 509609 - protein, 18 aa, Mycobacterium
ITPTNPAAAPSDQASRAQ

SEQ ID NO: 509610 - protein, 5 aa, Mycobacterium
ITPTP

SEQ ID NO: 509611 - protein, 7 aa, Mycobacterium
ITPTPRY

SEQ ID NO: 509612 - protein, 5 aa, Mycobacterium
ITPTQ

SEQ ID NO: 509613 - protein, 8 aa, Mycobacterium
ITPTSDGD

SEQ ID NO: 509614 - protein, 9 aa, Mycobacterium
ITPTSTGTS

SEQ ID NO: 509615 - protein, 5 aa, Mycobacterium
ITPVP

SEQ ID NO: 509616 - protein, 8 aa, Mycobacterium
ITQDDNGV

SEQ ID NO: 509617 - protein, 9 aa, Mycobacterium
ITQERDGRT

SEQ ID NO: 509618 - protein, 9 aa, Mycobacterium
ITQGDPAPI

SEQ ID NO: 509619 - protein, 5 aa, Mycobacterium
ITQGG

SEQ ID NO: 509620 - protein, 10 aa, Mycobacterium
ITQGGDDAEM

SEQ ID NO: 509621 - protein, 10 aa, Mycobacterium
ITQGGDEADV

SEQ ID NO: 509622 - protein, 15 aa, Mycobacterium
ITQGGEVIDPDGDWR

SEQ ID NO: 509623 - protein, 6 aa, Mycobacterium
ITQGKG

SEQ ID NO: 509624 - protein, 8 aa, Mycobacterium
ITQGKGSV

SEQ ID NO: 509625 - protein, 8 aa, Mycobacterium
ITQGNGSV

SEQ ID NO: 509626 - protein, 11 aa, Mycobacterium
ITQPGGLPGAL

SEQ ID NO: 509627 - protein, 6 aa, Mycobacterium
ITQPGL

SEQ ID NO: 509628 - protein, 10 aa, Mycobacterium
ITQPPSTEDL

SEQ ID NO: 509629 - protein, 4 aa, Mycobacterium
ITRD

SEQ ID NO: 509630 - protein, 7 aa, Mycobacterium
ITRDGRR

SEQ ID NO: 509631 - protein, 11 aa, Mycobacterium
ITRDGTPDGVV

SEQ ID NO: 509632 - protein, 7 aa, Mycobacterium
ITRDSDR

SEQ ID NO: 509633 - protein, 8 aa, Mycobacterium
ITREDPPA

SEQ ID NO: 509634 - protein, 5 aa, Mycobacterium
ITREG

SEQ ID NO: 509635 - protein, 4 aa, Mycobacterium
ITRG

SEQ ID NO: 509636 - protein, 6 aa, Mycobacterium
ITRGDA

SEQ ID NO: 509637 - protein, 5 aa, Mycobacterium
ITRGE

SEQ ID NO: 509638 - protein, 5 aa, Mycobacterium
ITRKD

SEQ ID NO: 509639 - protein, 6 aa, Mycobacterium
ITRNGQ

SEQ ID NO: 509640 - protein, 4 aa, Mycobacterium
ITRP

SEQ ID NO: 509641 - protein, 15 aa, Mycobacterium
ITRPDHPPFPKRSEA

SEQ ID NO: 509642 - protein, 6 aa, Mycobacterium
ITRPET

SEQ ID NO: 509643 - protein, 11 aa, Mycobacterium
ITRQPDDLVPT

SEQ ID NO: 509644 - protein, 4 aa, Mycobacterium
ITRS

SEQ ID NO: 509645 - protein, 6 aa, Mycobacterium
ITRSTL

SEQ ID NO: 509646 - protein, 9 aa, Mycobacterium
ITRSTPEKS

SEQ ID NO: 509647 - protein, 7 aa, Mycobacterium
ITRSTTK

SEQ ID NO: 509648 - protein, 4 aa, Mycobacterium
ITRT

SEQ ID NO: 509649 - protein, 7 aa, Mycobacterium
ITRTERS

SEQ ID NO: 509650 - protein, 7 aa, Mycobacterium
ITRTGGS

SEQ ID NO: 509651 - protein, 14 aa, Mycobacterium
ITRTGRALGPGPLC

SEQ ID NO: 509652 - protein, 7 aa, Mycobacterium
ITSAADT

SEQ ID NO: 509653 - protein, 10 aa, Mycobacterium
ITSAAGKSPA

SEQ ID NO: 509654 - protein, 12 aa, Mycobacterium
ITSAAGRAPGLP

SEQ ID NO: 509655 - protein, 6 aa, Mycobacterium
ITSANR

SEQ ID NO: 509656 - protein, 8 aa, Mycobacterium
ITSDGGAA

SEQ ID NO: 509657 - protein, 17 aa, Mycobacterium
ITSDQAKANYVKAAGKG

SEQ ID NO: 509658 - protein, 9 aa, Mycobacterium
ITSEAAGEV

SEQ ID NO: 509659 - protein, 6 aa, Mycobacterium
ITSEEI

SEQ ID NO: 509660 - protein, 12 aa, Mycobacterium
ITSEKQLGTYSD

SEQ ID NO: 509661 - protein, 7 aa, Mycobacterium
ITSEPAG

SEQ ID NO: 509662 - protein, 10 aa, Mycobacterium
ITSERQLGTY

SEQ ID NO: 509663 - protein, 20 aa, Mycobacterium
ITSERQLGTYSDLDQARRGL

SEQ ID NO: 509664 - protein, 8 aa, Mycobacterium
ITSGDRAA

SEQ ID NO: 509665 - protein, 7 aa, Mycobacterium
ITSGGDD

SEQ ID NO: 509666 - protein, 9 aa, Mycobacterium
ITSGGDTVV

SEQ ID NO: 509667 - protein, 7 aa, Mycobacterium
ITSGGHS

SEQ ID NO: 509668 - protein, 7 aa, Mycobacterium
ITSGPAE

SEQ ID NO: 509669 - protein, 8 aa, Mycobacterium
ITSGPDGT

SEQ ID NO: 509670 - protein, 6 aa, Mycobacterium
ITSGPL

SEQ ID NO: 509671 - protein, 5 aa, Mycobacterium
ITSGR

SEQ ID NO: 509672 - protein, 15 aa, Mycobacterium
ITSGRGEHTFAGHVW

SEQ ID NO: 509673 - protein, 4 aa, Mycobacterium
ITSK

SEQ ID NO: 509674 - protein, 10 aa, Mycobacterium
ITSKASRAAA

SEQ ID NO: 509675 - protein, 10 aa, Mycobacterium
ITSMPGRKGY

SEQ ID NO: 509676 - protein, 7 aa, Mycobacterium
ITSPAGL

SEQ ID NO: 509677 - protein, 11 aa, Mycobacterium
ITSPDEPKYDA

SEQ ID NO: 509678 - protein, 5 aa, Mycobacterium
ITSPE

SEQ ID NO: 509679 - protein, 7 aa, Mycobacterium
ITSPEKA

SEQ ID NO: 509680 - protein, 7 aa, Mycobacterium
ITSPENT

SEQ ID NO: 509681 - protein, 10 aa, Mycobacterium
ITSPGGTTAA

SEQ ID NO: 509682 - protein, 5 aa, Mycobacterium
ITSPI

SEQ ID NO: 509683 - protein, 9 aa, Mycobacterium
ITSPPGSRQ

SEQ ID NO: 509684 - protein, 9 aa, Mycobacterium
ITSPPGSRR

SEQ ID NO: 509685 - protein, 9 aa, Mycobacterium
ITSPPRGGT

SEQ ID NO: 509686 - protein, 9 aa, Mycobacterium
ITSPRNTAS

SEQ ID NO: 509687 - protein, 9 aa, Mycobacterium
ITSPTDHEI

SEQ ID NO: 509688 - protein, 11 aa, Mycobacterium
ITSSERDGATY

SEQ ID NO: 509689 - protein, 11 aa, Mycobacterium
ITSSGPRPSVR

SEQ ID NO: 509690 - protein, 22 aa, Mycobacterium
ITSSPAKLAEVGAPAEDQSQQL

SEQ ID NO: 509691 - protein, 19 aa, Mycobacterium
ITSSPGGGTRVRWSAPLRN

SEQ ID NO: 509692 - protein, 10 aa, Mycobacterium
ITSSPGSQRL

SEQ ID NO: 509693 - protein, 12 aa, Mycobacterium
ITSSSIGSRTEL

SEQ ID NO: 509694 - protein, 17 aa, Mycobacterium
ITSTAQQSPSAAASRYQ

SEQ ID NO: 509695 - protein, 10 aa, Mycobacterium
ITSTDGRPLA

SEQ ID NO: 509696 - protein, 8 aa, Mycobacterium
ITSTTGPY

SEQ ID NO: 509697 - protein, 10 aa, Mycobacterium
ITTAGGDATA

SEQ ID NO: 509698 - protein, 10 aa, Mycobacterium
ITTATRPDIA

SEQ ID NO: 509699 - protein, 5 aa, Mycobacterium
ITTDA

SEQ ID NO: 509700 - protein, 9 aa, Mycobacterium
ITTDDADNA

SEQ ID NO: 509701 - protein, 7 aa, Mycobacterium
ITTDDGT

SEQ ID NO: 509702 - protein, 8 aa, Mycobacterium
ITTDGAAE

SEQ ID NO: 509703 - protein, 8 aa, Mycobacterium
ITTDGGTA

SEQ ID NO: 509704 - protein, 7 aa, Mycobacterium
ITTEDEL

SEQ ID NO: 509705 - protein, 6 aa, Mycobacterium
ITTEPA

SEQ ID NO: 509706 - protein, 6 aa, Mycobacterium
ITTEQK

SEQ ID NO: 509707 - protein, 10 aa, Mycobacterium
ITTESTAAGF

SEQ ID NO: 509708 - protein, 4 aa, Mycobacterium
ITTG

SEQ ID NO: 509709 - protein, 5 aa, Mycobacterium
ITTGD

SEQ ID NO: 509710 - protein, 12 aa, Mycobacterium
ITTGGGAKGQVV

SEQ ID NO: 509711 - protein, 10 aa, Mycobacterium
ITTGKQPQAL

SEQ ID NO: 509712 - protein, 20 aa, Mycobacterium
ITTGKQPQALREFDPLRRTG

SEQ ID NO: 509713 - protein, 7 aa, Mycobacterium
ITTGNAR

SEQ ID NO: 509714 - protein, 6 aa, Mycobacterium
ITTGPA

SEQ ID NO: 509715 - protein, 7 aa, Mycobacterium
ITTGPGG

SEQ ID NO: 509716 - protein, 11 aa, Mycobacterium
ITTGPKPPFAG

SEQ ID NO: 509717 - protein, 6 aa, Mycobacterium
ITTGRG

SEQ ID NO: 509718 - protein, 16 aa, Mycobacterium
ITTLGSAGSTAGDEPS

SEQ ID NO: 509719 - protein, 4 aa, Mycobacterium
ITTP

SEQ ID NO: 509720 - protein, 10 aa, Mycobacterium
ITTPDQTTRT

SEQ ID NO: 509721 - protein, 8 aa, Mycobacterium
ITTPGRGQ

SEQ ID NO: 509722 - protein, 7 aa, Mycobacterium
ITTPGRR

SEQ ID NO: 509723 - protein, 17 aa, Mycobacterium
ITTPLATQSPSGPTVPP

SEQ ID NO: 509724 - protein, 8 aa, Mycobacterium
ITTPPGGL

SEQ ID NO: 509725 - protein, 9 aa, Mycobacterium
ITTPQSGGF

SEQ ID NO: 509726 - protein, 19 aa, Mycobacterium
ITTPTEGGTRISWTVPFGD

SEQ ID NO: 509727 - protein, 7 aa, Mycobacterium
ITTPTGT

SEQ ID NO: 509728 - protein, 18 aa, Mycobacterium
ITTQGTGSGTGISQAAAG

SEQ ID NO: 509729 - protein, 7 aa, Mycobacterium
ITTRHDE

SEQ ID NO: 509730 - protein, 20 aa, Mycobacterium
ITTSDGTVLSSNSNDSPQTS

SEQ ID NO: 509731 - protein, 20 aa, Mycobacterium
ITTSDGTVLSSNTNDAPQTS

SEQ ID NO: 509732 - protein, 7 aa, Mycobacterium
ITTSEFS

SEQ ID NO: 509733 - protein, 8 aa, Mycobacterium
ITTSGSFT

SEQ ID NO: 509734 - protein, 8 aa, Mycobacterium
ITTSNAAR

SEQ ID NO: 509735 - protein, 6 aa, Mycobacterium
ITTSTQ

SEQ ID NO: 509736 - protein, 6 aa, Mycobacterium
ITTTPM

SEQ ID NO: 509737 - protein, 9 aa, Mycobacterium
ITTTPPQDR

SEQ ID NO: 509738 - protein, 11 aa, Mycobacterium
ITTTTGDWQEY

SEQ ID NO: 509739 - protein, 7 aa, Mycobacterium
ITTYTKR

SEQ ID NO: 509740 - protein, 6 aa, Mycobacterium
ITTYTR

SEQ ID NO: 509741 - protein, 9 aa, Mycobacterium
ITVEPGGAV

SEQ ID NO: 509742 - protein, 10 aa, Mycobacterium
ITVPDPAIEN

SEQ ID NO: 509743 - protein, 14 aa, Mycobacterium
ITVPDQSTAPTDSA

SEQ ID NO: 509744 - protein, 5 aa, Mycobacterium
ITVPK

SEQ ID NO: 509745 - protein, 14 aa, Mycobacterium
ITVTPGSEFGPGHD

SEQ ID NO: 509746 - protein, 7 aa, Mycobacterium
ITYGTNN

SEQ ID NO: 509747 - protein, 15 aa, Mycobacterium
ITYPATEPWSPSNTV

SEQ ID NO: 509748 - protein, 12 aa, Mycobacterium
ITYPSATPEDLA

SEQ ID NO: 509749 - protein, 6 aa, Mycobacterium
ITYSTD

SEQ ID NO: 509750 - protein, 9 aa, Mycobacterium
IVAGDGTKT

SEQ ID NO: 509751 - protein, 7 aa, Mycobacterium
IVDETTD

SEQ ID NO: 509752 - protein, 6 aa, Mycobacterium
IVDGTQ

SEQ ID NO: 509753 - protein, 8 aa, Mycobacterium
IVDTGTQF

SEQ ID NO: 509754 - protein, 6 aa, Mycobacterium
IVEKTS

SEQ ID NO: 509755 - protein, 11 aa, Mycobacterium
IVEPTSGNTGV

SEQ ID NO: 509756 - protein, 8 aa, Mycobacterium
IVGPAGAS

SEQ ID NO: 509757 - protein, 7 aa, Mycobacterium
IVGPDGG

SEQ ID NO: 509758 - protein, 13 aa, Mycobacterium
IVGQPRIAAAFSA

SEQ ID NO: 509759 - protein, 10 aa, Mycobacterium
IVNPSNLDPG

SEQ ID NO: 509760 - protein, 8 aa, Mycobacterium
IVPAGGDA

SEQ ID NO: 509761 - protein, 13 aa, Mycobacterium
IVPEPGEFAPEDT

SEQ ID NO: 509762 - protein, 12 aa, Mycobacterium
IVPGPETAKTWM

SEQ ID NO: 509763 - protein, 6 aa, Mycobacterium
IVPPGR

SEQ ID NO: 509764 - protein, 5 aa, Mycobacterium
IVPPN

SEQ ID NO: 509765 - protein, 13 aa, Mycobacterium
IVPPTSQNQGAIE

SEQ ID NO: 509766 - protein, 7 aa, Mycobacterium
IVQPGTG

SEQ ID NO: 509767 - protein, 22 aa, Mycobacterium
IVRPSGQRRAADQAQPEFGPST

SEQ ID NO: 509768 - protein, 12 aa, Mycobacterium
IVSAGTANVVRQ

SEQ ID NO: 509769 - protein, 12 aa, Mycobacterium
IVSGGAGGLGEA

SEQ ID NO: 509770 - protein, 11 aa, Mycobacterium
IVSGPGDQGPF

SEQ ID NO: 509771 - protein, 7 aa, Mycobacterium
IVSPGAD

SEQ ID NO: 509772 - protein, 11 aa, Mycobacterium
IVSPGTGFDTH

SEQ ID NO: 509773 - protein, 13 aa, Mycobacterium
IVTGGASGIGAAS

SEQ ID NO: 509774 - protein, 13 aa, Mycobacterium
IVTGTDESGIGDA

SEQ ID NO: 509775 - protein, 7 aa, Mycobacterium
IVTPGAG

SEQ ID NO: 509776 - protein, 6 aa, Mycobacterium
IVTPSA

SEQ ID NO: 509777 - protein, 8 aa, Mycobacterium
IVTTGTVS

SEQ ID NO: 509778 - protein, 4 aa, Mycobacterium
IYDD

SEQ ID NO: 509779 - protein, 9 aa, Mycobacterium
IYDKDRPID

SEQ ID NO: 509780 - protein, 10 aa, Mycobacterium
IYGDSRSSDQ

SEQ ID NO: 509781 - protein, 12 aa, Mycobacterium
IYGGSPENRARL

SEQ ID NO: 509782 - protein, 6 aa, Mycobacterium
IYGGTA

SEQ ID NO: 509783 - protein, 11 aa, Mycobacterium
IYGGTKSAWDY

SEQ ID NO: 509784 - protein, 7 aa, Mycobacterium
IYGGTRS

SEQ ID NO: 509785 - protein, 9 aa, Mycobacterium
IYGGTSEIQ

SEQ ID NO: 509786 - protein, 11 aa, Mycobacterium
IYGHPRNPYSR

SEQ ID NO: 509787 - protein, 5 aa, Mycobacterium
IYGPG

SEQ ID NO: 509788 - protein, 10 aa, Mycobacterium
IYGPGVDPVG

SEQ ID NO: 509789 - protein, 6 aa, Mycobacterium
IYGPSG

SEQ ID NO: 509790 - protein, 9 aa, Mycobacterium
IYPDPKQFR

SEQ ID NO: 509791 - protein, 5 aa, Mycobacterium
IYPDT

SEQ ID NO: 509792 - protein, 10 aa, Mycobacterium
IYPEGPDTMA

SEQ ID NO: 509793 - protein, 4 aa, Mycobacterium
IYPG

SEQ ID NO: 509794 - protein, 5 aa, Mycobacterium
IYPGN

SEQ ID NO: 509795 - protein, 7 aa, Mycobacterium
IYPGPDG

SEQ ID NO: 509796 - protein, 8 aa, Mycobacterium
IYPPGDAT

SEQ ID NO: 509797 - protein, 7 aa, Mycobacterium
IYPPPSA

SEQ ID NO: 509798 - protein, 10 aa, Mycobacterium
IYPQASTFDQ

SEQ ID NO: 509799 - protein, 7 aa, Mycobacterium
IYQPDAE

SEQ ID NO: 509800 - protein, 10 aa, Mycobacterium
IYSSTATGTH

SEQ ID NO: 509801 - protein, 10 aa, Mycobacterium
IYTGPGPGSL

SEQ ID NO: 509802 - protein, 17 aa, Mycobacterium
IYTSTDDGATVNVLTTV

SEQ ID NO: 509803 - protein, 10 aa, Mycobacterium
KAAAAAGSGD

SEQ ID NO: 509804 - protein, 7 aa, Mycobacterium
KAAAAAQ

SEQ ID NO: 509805 - protein, 7 aa, Mycobacterium
KAAAADA

SEQ ID NO: 509806 - protein, 11 aa, Mycobacterium
KAAAAEGSGDF

SEQ ID NO: 509807 - protein, 8 aa, Mycobacterium
KAAAAGAR

SEQ ID NO: 509808 - protein, 7 aa, Mycobacterium
KAAAAMP

SEQ ID NO: 509809 - protein, 9 aa, Mycobacterium
KAAAANPPM

SEQ ID NO: 509810 - protein, 11 aa, Mycobacterium
KAAAAQDSGAF

SEQ ID NO: 509811 - protein, 13 aa, Mycobacterium
KAAAASRSNPEAR

SEQ ID NO: 509812 - protein, 9 aa, Mycobacterium
KAAAATGLA

SEQ ID NO: 509813 - protein, 6 aa, Mycobacterium
KAAADA

SEQ ID NO: 509814 - protein, 7 aa, Mycobacterium
KAAADAG

SEQ ID NO: 509815 - protein, 7 aa, Mycobacterium
KAAADAH

SEQ ID NO: 509816 - protein, 8 aa, Mycobacterium
KAAADDSL

SEQ ID NO: 509817 - protein, 7 aa, Mycobacterium
KAAADSA

SEQ ID NO: 509818 - protein, 8 aa, Mycobacterium
KAAADSAG

SEQ ID NO: 509819 - protein, 14 aa, Mycobacterium
KAAAEDGTFKSDEE

SEQ ID NO: 509820 - protein, 8 aa, Mycobacterium
KAAAENPP

SEQ ID NO: 509821 - protein, 8 aa, Mycobacterium
KAAAESAE

SEQ ID NO: 509822 - protein, 8 aa, Mycobacterium
KAAAESAG

SEQ ID NO: 509823 - protein, 12 aa, Mycobacterium
KAAAGETGPVKA

SEQ ID NO: 509824 - protein, 10 aa, Mycobacterium
KAAAGKAALT

SEQ ID NO: 509825 - protein, 13 aa, Mycobacterium
KAAAGKAALTAAK

SEQ ID NO: 509826 - protein, 9 aa, Mycobacterium
KAAAGRAHR

SEQ ID NO: 509827 - protein, 7 aa, Mycobacterium
KAAAGTA

SEQ ID NO: 509828 - protein, 7 aa, Mycobacterium
KAAAHGR

SEQ ID NO: 509829 - protein, 8 aa, Mycobacterium
KAAAKRYR

SEQ ID NO: 509830 - protein, 8 aa, Mycobacterium
KAAAPRVK

SEQ ID NO: 509831 - protein, 9 aa, Mycobacterium
KAAAPTGGM

SEQ ID NO: 509832 - protein, 9 aa, Mycobacterium
KAAAQQGLS

SEQ ID NO: 509833 - protein, 8 aa, Mycobacterium
KAAAQSAE

SEQ ID NO: 509834 - protein, 30 aa, Mycobacterium
KAAARDKAGAIADAREAARTAERGGQSTAA

SEQ ID NO: 509835 - protein, 8 aa, Mycobacterium
KAAARELS

SEQ ID NO: 509836 - protein, 12 aa, Mycobacterium
KAAARGAAAAAG

SEQ ID NO: 509837 - protein, 8 aa, Mycobacterium
KAAASARL

SEQ ID NO: 509838 - protein, 8 aa, Mycobacterium
KAAASGLS

SEQ ID NO: 509839 - protein, 5 aa, Mycobacterium
KAAAT

SEQ ID NO: 509840 - protein, 21 aa, Mycobacterium
KAAATAHGNYTGAMSTNLGMW

SEQ ID NO: 509841 - protein, 8 aa, Mycobacterium
KAAATAPY

SEQ ID NO: 509842 - protein, 12 aa, Mycobacterium
KAAATTEATAAI

SEQ ID NO: 509843 - protein, 4 aa, Mycobacterium
KAAC

SEQ ID NO: 509844 - protein, 4 aa, Mycobacterium
KAAD

SEQ ID NO: 509845 - protein, 8 aa, Mycobacterium
KAADAASE

SEQ ID NO: 509846 - protein, 11 aa, Mycobacterium
KAADADGQAGD

SEQ ID NO: 509847 - protein, 6 aa, Mycobacterium
KAADAL

SEQ ID NO: 509848 - protein, 6 aa, Mycobacterium
KAADDV

SEQ ID NO: 509849 - protein, 30 aa, Mycobacterium
KAADEAKSAKTAAQSAHTQTVATRIPAAAS

SEQ ID NO: 509850 - protein, 6 aa, Mycobacterium
KAADGV

SEQ ID NO: 509851 - protein, 9 aa, Mycobacterium
KAADLPAAT

SEQ ID NO: 509852 - protein, 12 aa, Mycobacterium
KAADNAGRPAPR

SEQ ID NO: 509853 - protein, 5 aa, Mycobacterium
KAADP

SEQ ID NO: 509854 - protein, 9 aa, Mycobacterium
KAADRSGAK

SEQ ID NO: 509855 - protein, 6 aa, Mycobacterium
KAADRT

SEQ ID NO: 509856 - protein, 11 aa, Mycobacterium
KAADSAGEAGD

SEQ ID NO: 509857 - protein, 9 aa, Mycobacterium
KAADSSPAQ

SEQ ID NO: 509858 - protein, 18 aa, Mycobacterium
KAAEAADELQKTDPDSVA

SEQ ID NO: 509859 - protein, 13 aa, Mycobacterium
KAAEAAQAEAEAA

SEQ ID NO: 509860 - protein, 7 aa, Mycobacterium
KAAEASQ

SEQ ID NO: 509861 - protein, 8 aa, Mycobacterium
KAAEGHDV

SEQ ID NO: 509862 - protein, 7 aa, Mycobacterium
KAAEGYL

SEQ ID NO: 509863 - protein, 5 aa, Mycobacterium
KAAEI

SEQ ID NO: 509864 - protein, 9 aa, Mycobacterium
KAAEKAESR

SEQ ID NO: 509865 - protein, 7 aa, Mycobacterium
KAAENRL

SEQ ID NO: 509866 - protein, 12 aa, Mycobacterium
KAAEQAGRDPRD

SEQ ID NO: 509867 - protein, 9 aa, Mycobacterium
KAAEQYADE

SEQ ID NO: 509868 - protein, 6 aa, Mycobacterium
KAAERA

SEQ ID NO: 509869 - protein, 11 aa, Mycobacterium
KAAERAKIDEA

SEQ ID NO: 509870 - protein, 9 aa, Mycobacterium
KAAERAQEV

SEQ ID NO: 509871 - protein, 6 aa, Mycobacterium
KAAERT

SEQ ID NO: 509872 - protein, 12 aa, Mycobacterium
KAAEVKQKAAGA

SEQ ID NO: 509873 - protein, 13 aa, Mycobacterium
KAAEVTAKKAGAA

SEQ ID NO: 509874 - protein, 12 aa, Mycobacterium
KAAFSAPRSVAG

SEQ ID NO: 509875 - protein, 13 aa, Mycobacterium
KAAFTGAAADQVD

SEQ ID NO: 509876 - protein, 4 aa, Mycobacterium
KAAG

SEQ ID NO: 509877 - protein, 7 aa, Mycobacterium
KAAGADD

SEQ ID NO: 509878 - protein, 17 aa, Mycobacterium
KAAGAEVHGTASPAKHA

SEQ ID NO: 509879 - protein, 7 aa, Mycobacterium
KAAGAGL

SEQ ID NO: 509880 - protein, 7 aa, Mycobacterium
KAAGAPI

SEQ ID NO: 509881 - protein, 17 aa, Mycobacterium
KAAGGEPAGLGARDTLR

SEQ ID NO: 509882 - protein, 7 aa, Mycobacterium
KAAGGGS

SEQ ID NO: 509883 - protein, 9 aa, Mycobacterium
KAAGGKVSA

SEQ ID NO: 509884 - protein, 17 aa, Mycobacterium
KAAGGPKPRAGRDPVNQ

SEQ ID NO: 509885 - protein, 9 aa, Mycobacterium
KAAGGRAVA

SEQ ID NO: 509886 - protein, 5 aa, Mycobacterium
KAAGI

SEQ ID NO: 509887 - protein, 8 aa, Mycobacterium
KAAGIPAA

SEQ ID NO: 509888 - protein, 7 aa, Mycobacterium
KAAGISR

SEQ ID NO: 509889 - protein, 9 aa, Mycobacterium
KAAGKTPGL

SEQ ID NO: 509890 - protein, 9 aa, Mycobacterium
KAAGLPAAE

SEQ ID NO: 509891 - protein, 5 aa, Mycobacterium
KAAGM

SEQ ID NO: 509892 - protein, 9 aa, Mycobacterium
KAAGPTMGG

SEQ ID NO: 509893 - protein, 8 aa, Mycobacterium
KAAGRDGD

SEQ ID NO: 509894 - protein, 6 aa, Mycobacterium
KAAGRE

SEQ ID NO: 509895 - protein, 7 aa, Mycobacterium
KAAGRGS

SEQ ID NO: 509896 - protein, 9 aa, Mycobacterium
KAAGRPDDE

SEQ ID NO: 509897 - protein, 8 aa, Mycobacterium
KAAGRPED

SEQ ID NO: 509898 - protein, 9 aa, Mycobacterium
KAAGRQRNL

SEQ ID NO: 509899 - protein, 17 aa, Mycobacterium
KAAGSSKPRAARDPVNQ

SEQ ID NO: 509900 - protein, 9 aa, Mycobacterium
KAAGSSPLL

SEQ ID NO: 509901 - protein, 7 aa, Mycobacterium
KAAGSVD

SEQ ID NO: 509902 - protein, 8 aa, Mycobacterium
KAAGTTRR

SEQ ID NO: 509903 - protein, 9 aa, Mycobacterium
KAAGVDPDT

SEQ ID NO: 509904 - protein, 7 aa, Mycobacterium
KAAGVSR

SEQ ID NO: 509905 - protein, 5 aa, Mycobacterium
KAAIR

SEQ ID NO: 509906 - protein, 26 aa, Mycobacterium
KAAKAAKAARAAHAAGAAADEAEGGA

SEQ ID NO: 509907 - protein, 13 aa, Mycobacterium
KAAKAPISPVPPS

SEQ ID NO: 509908 - protein, 13 aa, Mycobacterium
KAAKGGFGQPRPM

SEQ ID NO: 509909 - protein, 11 aa, Mycobacterium
KAAKLAAAEAH

SEQ ID NO: 509910 - protein, 9 aa, Mycobacterium
KAAKPGSPV

SEQ ID NO: 509911 - protein, 6 aa, Mycobacterium
KAAKPI

SEQ ID NO: 509912 - protein, 16 aa, Mycobacterium
KAAKSKSLAKHETGVG

SEQ ID NO: 509913 - protein, 11 aa, Mycobacterium
KAAKTGDTTVE

SEQ ID NO: 509914 - protein, 14 aa, Mycobacterium
KAAKTTFSDEESER

SEQ ID NO: 509915 - protein, 4 aa, Mycobacterium
KAAL

SEQ ID NO: 509916 - protein, 7 aa, Mycobacterium
KAALADP

SEQ ID NO: 509917 - protein, 11 aa, Mycobacterium
KAALDKSDFDE

SEQ ID NO: 509918 - protein, 14 aa, Mycobacterium
KAALETATKTWAGE

SEQ ID NO: 509919 - protein, 5 aa, Mycobacterium
KAALT

SEQ ID NO: 509920 - protein, 17 aa, Mycobacterium
KAANAGEDSPAVGSDGV

SEQ ID NO: 509921 - protein, 10 aa, Mycobacterium
KAANAGPSRD

SEQ ID NO: 509922 - protein, 14 aa, Mycobacterium
KAANEDGTFKSDED

SEQ ID NO: 509923 - protein, 15 aa, Mycobacterium
KAANEDGTFKSDEEL

SEQ ID NO: 509924 - protein, 14 aa, Mycobacterium
KAANEDGTFKSDEQ

SEQ ID NO: 509925 - protein, 8 aa, Mycobacterium
KAANMSES

SEQ ID NO: 509926 - protein, 5 aa, Mycobacterium
KAANT

SEQ ID NO: 509927 - protein, 10 aa, Mycobacterium
KAANTQPQYF

SEQ ID NO: 509928 - protein, 51 aa, Mycobacterium
KAAPAGAGSAAAGGLAPVGAGAGGGAGAPVAHAGQNSKSGGKKDGLVAPTP

SEQ ID NO: 509929 - protein, 28 aa, Mycobacterium
KAAPDAEVRSAAKAAVGDVRRGVVAVDG

SEQ ID NO: 509930 - protein, 83 aa, Mycobacterium
KAAPDPPAGPRAPPATAAPEDSAATAAKAAKAPPERRAPAPEAKAHQAAQAAKVAPAAQPEPAPAVPKAPAARAAPAEPEARA

SEQ ID NO: 509931 - protein, 8 aa, Mycobacterium
KAAPDPPW

SEQ ID NO: 509932 - protein, 9 aa, Mycobacterium
KAAPEPGRI

SEQ ID NO: 509933 - protein, 14 aa, Mycobacterium
KAAPEWAATPPERR

SEQ ID NO: 509934 - protein, 10 aa, Mycobacterium
KAAPGPRGAA

SEQ ID NO: 509935 - protein, 7 aa, Mycobacterium
KAAPGYT

SEQ ID NO: 509936 - protein, 6 aa, Mycobacterium
KAAPNA

SEQ ID NO: 509937 - protein, 14 aa, Mycobacterium
KAAPPLERLGEPAD

SEQ ID NO: 509938 - protein, 16 aa, Mycobacterium
KAAPPPPRMAGGDHSV

SEQ ID NO: 509939 - protein, 22 aa, Mycobacterium
KAAPSPLDVPSDPGLPVVKGQV

SEQ ID NO: 509940 - protein, 12 aa, Mycobacterium
KAAPVKKAPVKK

SEQ ID NO: 509941 - protein, 46 aa, Mycobacterium
KAAPVKKAVTKAPAKKAATKAPAKKAATKAPAKKAPAKKAPAKKGR

SEQ ID NO: 509942 - protein, 6 aa, Mycobacterium
KAAQAQ

SEQ ID NO: 509943 - protein, 28 aa, Mycobacterium
KAAQAQQDAPVGQAPAKKNGKPAPEKPS

SEQ ID NO: 509944 - protein, 6 aa, Mycobacterium
KAAQES

SEQ ID NO: 509945 - protein, 8 aa, Mycobacterium
KAAQEVLD

SEQ ID NO: 509946 - protein, 9 aa, Mycobacterium
KAAQGPEIE

SEQ ID NO: 509947 - protein, 9 aa, Mycobacterium
KAAQGPGDI

SEQ ID NO: 509948 - protein, 8 aa, Mycobacterium
KAAQQAQP

SEQ ID NO: 509949 - protein, 10 aa, Mycobacterium
KAAQTSGAAT

SEQ ID NO: 509950 - protein, 5 aa, Mycobacterium
KAARA

SEQ ID NO: 509951 - protein, 8 aa, Mycobacterium
KAARAAKN

SEQ ID NO: 509952 - protein, 14 aa, Mycobacterium
KAARAKDSELKRRR

SEQ ID NO: 509953 - protein, 10 aa, Mycobacterium
KAARATELAD

SEQ ID NO: 509954 - protein, 10 aa, Mycobacterium
KAARDEAGAA

SEQ ID NO: 509955 - protein, 6 aa, Mycobacterium
KAARDQ

SEQ ID NO: 509956 - protein, 7 aa, Mycobacterium
KAAREGK

SEQ ID NO: 509957 - protein, 12 aa, Mycobacterium
KAAREPGADRAV

SEQ ID NO: 509958 - protein, 7 aa, Mycobacterium
KAARGEV

SEQ ID NO: 509959 - protein, 6 aa, Mycobacterium
KAARGI

SEQ ID NO: 509960 - protein, 17 aa, Mycobacterium
KAARHQAAAAAAAADAG

SEQ ID NO: 509961 - protein, 5 aa, Mycobacterium
KAARK

SEQ ID NO: 509962 - protein, 8 aa, Mycobacterium
KAARPQAG

SEQ ID NO: 509963 - protein, 5 aa, Mycobacterium
KAARR

SEQ ID NO: 509964 - protein, 9 aa, Mycobacterium
KAARRLTPR

SEQ ID NO: 509965 - protein, 11 aa, Mycobacterium
KAARTAAGELP

SEQ ID NO: 509966 - protein, 9 aa, Mycobacterium
KAASADEIN

SEQ ID NO: 509967 - protein, 12 aa, Mycobacterium
KAASAGGKTVEQ

SEQ ID NO: 509968 - protein, 8 aa, Mycobacterium
KAASDAGR

SEQ ID NO: 509969 - protein, 8 aa, Mycobacterium
KAASESAE

SEQ ID NO: 509970 - protein, 11 aa, Mycobacterium
KAASLGSQQDK

SEQ ID NO: 509971 - protein, 10 aa, Mycobacterium
KAASLRDKEK

SEQ ID NO: 509972 - protein, 7 aa, Mycobacterium
KAASSGY

SEQ ID NO: 509973 - protein, 9 aa, Mycobacterium
KAASSIRAG

SEQ ID NO: 509974 - protein, 10 aa, Mycobacterium
KAASVDRDSL

SEQ ID NO: 509975 - protein, 8 aa, Mycobacterium
KAATAEEI

SEQ ID NO: 509976 - protein, 10 aa, Mycobacterium
KAATAGPSRD

SEQ ID NO: 509977 - protein, 6 aa, Mycobacterium
KAATAR

SEQ ID NO: 509978 - protein, 9 aa, Mycobacterium
KAATDNADE

SEQ ID NO: 509979 - protein, 6 aa, Mycobacterium
KAATEK

SEQ ID NO: 509980 - protein, 15 aa, Mycobacterium
KAATGSLTAAATGAV

SEQ ID NO: 509981 - protein, 7 aa, Mycobacterium
KAATIEG

SEQ ID NO: 509982 - protein, 10 aa, Mycobacterium
KAATPQQKPL

SEQ ID NO: 509983 - protein, 7 aa, Mycobacterium
KAATTRL

SEQ ID NO: 509984 - protein, 5 aa, Mycobacterium
KAATY

SEQ ID NO: 509985 - protein, 4 aa, Mycobacterium
KAAV

SEQ ID NO: 509986 - protein, 5 aa, Mycobacterium
KAAVE

SEQ ID NO: 509987 - protein, 5 aa, Mycobacterium
KAAVG

SEQ ID NO: 509988 - protein, 7 aa, Mycobacterium
KAAVQQF

SEQ ID NO: 509989 - protein, 7 aa, Mycobacterium
KAAVRAG

SEQ ID NO: 509990 - protein, 7 aa, Mycobacterium
KAAVSPG

SEQ ID NO: 509991 - protein, 17 aa, Mycobacterium
KAAYNKAAGADAKERTL

SEQ ID NO: 509992 - protein, 17 aa, Mycobacterium
KAAYNKAAGAEARERTL

SEQ ID NO: 509993 - protein, 8 aa, Mycobacterium
KAAYPDEH

SEQ ID NO: 509994 - protein, 7 aa, Mycobacterium
KACAGGV

SEQ ID NO: 509995 - protein, 7 aa, Mycobacterium
KACSGGV

SEQ ID NO: 509996 - protein, 8 aa, Mycobacterium
KADADPRS

SEQ ID NO: 509997 - protein, 8 aa, Mycobacterium
KADAGAFD

SEQ ID NO: 509998 - protein, 10 aa, Mycobacterium
KADAGPSGAH

SEQ ID NO: 509999 - protein, 10 aa, Mycobacterium
KADANGGEAD

SEQ ID NO: 510000 - protein, 7 aa, Mycobacterium
KADAPQG

SEQ ID NO: 510001 - protein, 12 aa, Mycobacterium
KADAPSGTAART

SEQ ID NO: 510002 - protein, 12 aa, Mycobacterium
KADAPSGTATRT

SEQ ID NO: 510003 - protein, 9 aa, Mycobacterium
KADARPGML

SEQ ID NO: 510004 - protein, 7 aa, Mycobacterium
KADASAG

SEQ ID NO: 510005 - protein, 9 aa, Mycobacterium
KADCGGEPA

SEQ ID NO: 510006 - protein, 4 aa, Mycobacterium
KADD

SEQ ID NO: 510007 - protein, 8 aa, Mycobacterium
KADDAKRL

SEQ ID NO: 510008 - protein, 17 aa, Mycobacterium
KADDGSSIVEEEGRPSL

SEQ ID NO: 510009 - protein, 12 aa, Mycobacterium
KADDGTDSLEPD

SEQ ID NO: 510010 - protein, 9 aa, Mycobacterium
KADDPFAEE

SEQ ID NO: 510011 - protein, 6 aa, Mycobacterium
KADEAA

SEQ ID NO: 510012 - protein, 9 aa, Mycobacterium
KADEAGDII

SEQ ID NO: 510013 - protein, 17 aa, Mycobacterium
KADEDTPESSPGDADRE

SEQ ID NO: 510014 - protein, 15 aa, Mycobacterium
KADEGGDDGALGRNL

SEQ ID NO: 510015 - protein, 10 aa, Mycobacterium
KADENAAEVR

SEQ ID NO: 510016 - protein, 6 aa, Mycobacterium
KADERA

SEQ ID NO: 510017 - protein, 8 aa, Mycobacterium
KADETTGQ

SEQ ID NO: 510018 - protein, 28 aa, Mycobacterium
KADFEGTSGDDAAAQAGEEKPDNWIGVK

SEQ ID NO: 510019 - protein, 8 aa, Mycobacterium
KADGGSAR

SEQ ID NO: 510020 - protein, 6 aa, Mycobacterium
KADGHN

SEQ ID NO: 510021 - protein, 12 aa, Mycobacterium
KADGKAPQDSEA

SEQ ID NO: 510022 - protein, 7 aa, Mycobacterium
KADGNGS

SEQ ID NO: 510023 - protein, 15 aa, Mycobacterium
KADGPSAPRLARDPV

SEQ ID NO: 510024 - protein, 8 aa, Mycobacterium
KADGSHET

SEQ ID NO: 510025 - protein, 10 aa, Mycobacterium
KADGTAPDGI

SEQ ID NO: 510026 - protein, 9 aa, Mycobacterium
KADGTQGEI

SEQ ID NO: 510027 - protein, 5 aa, Mycobacterium
KADGV

SEQ ID NO: 510028 - protein, 12 aa, Mycobacterium
KADIAQKVSETA

SEQ ID NO: 510029 - protein, 13 aa, Mycobacterium
KADIGNNVDGAQR

SEQ ID NO: 510030 - protein, 8 aa, Mycobacterium
KADKEEGI

SEQ ID NO: 510031 - protein, 7 aa, Mycobacterium
KADKTIE

SEQ ID NO: 510032 - protein, 7 aa, Mycobacterium
KADLHGG

SEQ ID NO: 510033 - protein, 5 aa, Mycobacterium
KADLP

SEQ ID NO: 510034 - protein, 7 aa, Mycobacterium
KADLTRR

SEQ ID NO: 510035 - protein, 8 aa, Mycobacterium
KADPERRE

SEQ ID NO: 510036 - protein, 8 aa, Mycobacterium
KADPGAPA

SEQ ID NO: 510037 - protein, 8 aa, Mycobacterium
KADPNLAT

SEQ ID NO: 510038 - protein, 4 aa, Mycobacterium
KADQ

SEQ ID NO: 510039 - protein, 12 aa, Mycobacterium
KADQPRANHPDM

SEQ ID NO: 510040 - protein, 7 aa, Mycobacterium
KADRCDR

SEQ ID NO: 510041 - protein, 12 aa, Mycobacterium
KADRDGAKQTVR

SEQ ID NO: 510042 - protein, 10 aa, Mycobacterium
KADRDGEAAI

SEQ ID NO: 510043 - protein, 8 aa, Mycobacterium
KADRSADS

SEQ ID NO: 510044 - protein, 7 aa, Mycobacterium
KADRSDS

SEQ ID NO: 510045 - protein, 7 aa, Mycobacterium
KADRSQV

SEQ ID NO: 510046 - protein, 7 aa, Mycobacterium
KADRTEL

SEQ ID NO: 510047 - protein, 13 aa, Mycobacterium
KADRTLAPSTSAM

SEQ ID NO: 510048 - protein, 6 aa, Mycobacterium
KADRVA

SEQ ID NO: 510049 - protein, 4 aa, Mycobacterium
KADS

SEQ ID NO: 510050 - protein, 14 aa, Mycobacterium
KADSANGSSGLRKT

SEQ ID NO: 510051 - protein, 10 aa, Mycobacterium
KADSGDPSQR

SEQ ID NO: 510052 - protein, 21 aa, Mycobacterium
KADSQAPGDSFKDGSYDPSKI

SEQ ID NO: 510053 - protein, 4 aa, Mycobacterium
KADT

SEQ ID NO: 510054 - protein, 18 aa, Mycobacterium
KADTGLSRNGVSPADHPG

SEQ ID NO: 510055 - protein, 9 aa, Mycobacterium
KADTSGVEA

SEQ ID NO: 510056 - protein, 13 aa, Mycobacterium
KADTTHTAEPFDS

SEQ ID NO: 510057 - protein, 6 aa, Mycobacterium
KADVAT

SEQ ID NO: 510058 - protein, 16 aa, Mycobacterium
KADVRPSTLSGGQQQR

SEQ ID NO: 510059 - protein, 4 aa, Mycobacterium
KADY

SEQ ID NO: 510060 - protein, 8 aa, Mycobacterium
KAEAAAHV

SEQ ID NO: 510061 - protein, 9 aa, Mycobacterium
KAEAAPAPS

SEQ ID NO: 510062 - protein, 21 aa, Mycobacterium
KAEADSLNAQISGSSANIAPL

SEQ ID NO: 510063 - protein, 22 aa, Mycobacterium
KAEADSLNAQISGSSASIGPLQ

SEQ ID NO: 510064 - protein, 8 aa, Mycobacterium
KAEAERSL

SEQ ID NO: 510065 - protein, 9 aa, Mycobacterium
KAEAGRRID

SEQ ID NO: 510066 - protein, 5 aa, Mycobacterium
KAEAP

SEQ ID NO: 510067 - protein, 6 aa, Mycobacterium
KAEAPG

SEQ ID NO: 510068 - protein, 7 aa, Mycobacterium
KAEASDR

SEQ ID NO: 510069 - protein, 22 aa, Mycobacterium
KAEASHSDEGYDRERDAAAQRL

SEQ ID NO: 510070 - protein, 7 aa, Mycobacterium
KAEASSH

SEQ ID NO: 510071 - protein, 9 aa, Mycobacterium
KAEASTRAR

SEQ ID NO: 510072 - protein, 16 aa, Mycobacterium
KAEDAGSSRTSNARTR

SEQ ID NO: 510073 - protein, 13 aa, Mycobacterium
KAEDVARRTGARP

SEQ ID NO: 510074 - protein, 5 aa, Mycobacterium
KAEEA

SEQ ID NO: 510075 - protein, 8 aa, Mycobacterium
KAEEKNGG

SEQ ID NO: 510076 - protein, 7 aa, Mycobacterium
KAEERAF

SEQ ID NO: 510077 - protein, 9 aa, Mycobacterium
KAEEYGSHD

SEQ ID NO: 510078 - protein, 16 aa, Mycobacterium
KAEGARLRANPGPTTI

SEQ ID NO: 510079 - protein, 8 aa, Mycobacterium
KAEGDRPL

SEQ ID NO: 510080 - protein, 8 aa, Mycobacterium
KAEGGGAL

SEQ ID NO: 510081 - protein, 7 aa, Mycobacterium
KAEGIPY

SEQ ID NO: 510082 - protein, 17 aa, Mycobacterium
KAEGKSDPRKGRDPVNQ

SEQ ID NO: 510083 - protein, 14 aa, Mycobacterium
KAEIAKKVEETART

SEQ ID NO: 510084 - protein, 24 aa, Mycobacterium
KAEIDKAQAEAAQAGPLAEAQAQR

SEQ ID NO: 510085 - protein, 7 aa, Mycobacterium
KAEIDTQ

SEQ ID NO: 510086 - protein, 19 aa, Mycobacterium
KAEIESATARLRSAARDGS

SEQ ID NO: 510087 - protein, 16 aa, Mycobacterium
KAEKGGFGKPRPTPGY

SEQ ID NO: 510088 - protein, 14 aa, Mycobacterium
KAEKTAAPHADAHG

SEQ ID NO: 510089 - protein, 7 aa, Mycobacterium
KAELPDF

SEQ ID NO: 510090 - protein, 8 aa, Mycobacterium
KAEMPSPD

SEQ ID NO: 510091 - protein, 22 aa, Mycobacterium
KAENKPDHSETVDGQLEDRGYG

SEQ ID NO: 510092 - protein, 8 aa, Mycobacterium
KAENKTLE

SEQ ID NO: 510093 - protein, 6 aa, Mycobacterium
KAENLT

SEQ ID NO: 510094 - protein, 10 aa, Mycobacterium
KAENTEAPHA

SEQ ID NO: 510095 - protein, 5 aa, Mycobacterium
KAEPA

SEQ ID NO: 510096 - protein, 8 aa, Mycobacterium
KAEPGGLV

SEQ ID NO: 510097 - protein, 8 aa, Mycobacterium
KAEPPKDL

SEQ ID NO: 510098 - protein, 4 aa, Mycobacterium
KAEQ

SEQ ID NO: 510099 - protein, 6 aa, Mycobacterium
KAEQAK

SEQ ID NO: 510100 - protein, 15 aa, Mycobacterium
KAEQEIEAGASGTVQ

SEQ ID NO: 510101 - protein, 6 aa, Mycobacterium
KAEQGV

SEQ ID NO: 510102 - protein, 11 aa, Mycobacterium
KAEQVAGGLDG

SEQ ID NO: 510103 - protein, 16 aa, Mycobacterium
KAEQVATTLTGQQASV

SEQ ID NO: 510104 - protein, 7 aa, Mycobacterium
KAERAGD

SEQ ID NO: 510105 - protein, 8 aa, Mycobacterium
KAERAQGL

SEQ ID NO: 510106 - protein, 15 aa, Mycobacterium
KAERDAQRAERDPVG

SEQ ID NO: 510107 - protein, 8 aa, Mycobacterium
KAERDGVA

SEQ ID NO: 510108 - protein, 12 aa, Mycobacterium
KAERDSDAVQSS

SEQ ID NO: 510109 - protein, 39 aa, Mycobacterium
KAEREDNAHQRALETERAAARRSGLPPPAPPDYGDDPPP

SEQ ID NO: 510110 - protein, 16 aa, Mycobacterium
KAERGRGAAPDTVPAE

SEQ ID NO: 510111 - protein, 7 aa, Mycobacterium
KAERHQR

SEQ ID NO: 510112 - protein, 8 aa, Mycobacterium
KAERPGRK

SEQ ID NO: 510113 - protein, 21 aa, Mycobacterium
KAERPPKPTDFPQLPPAPDDY

SEQ ID NO: 510114 - protein, 8 aa, Mycobacterium
KAERRLTD

SEQ ID NO: 510115 - protein, 20 aa, Mycobacterium
KAERRLTDTALKDLKKRAEV

SEQ ID NO: 510116 - protein, 20 aa, Mycobacterium
KAERRLTDTALKDLKKRVEA

SEQ ID NO: 510117 - protein, 20 aa, Mycobacterium
KAERRLTDTALKDLKKRVET

SEQ ID NO: 510118 - protein, 9 aa, Mycobacterium
KAERRQRAR

SEQ ID NO: 510119 - protein, 15 aa, Mycobacterium
KAERSEKKEFDGRSE

SEQ ID NO: 510120 - protein, 13 aa, Mycobacterium
KAERSEKKEFNGR

SEQ ID NO: 510121 - protein, 15 aa, Mycobacterium
KAERTEKKEFDGRSE

SEQ ID NO: 510122 - protein, 15 aa, Mycobacterium
KAERTEKKEFEGRSE

SEQ ID NO: 510123 - protein, 9 aa, Mycobacterium
KAESGRAAE

SEQ ID NO: 510124 - protein, 5 aa, Mycobacterium
KAEST

SEQ ID NO: 510125 - protein, 7 aa, Mycobacterium
KAESTSH

SEQ ID NO: 510126 - protein, 8 aa, Mycobacterium
KAETDGQL

SEQ ID NO: 510127 - protein, 8 aa, Mycobacterium
KAETDGRL

SEQ ID NO: 510128 - protein, 6 aa, Mycobacterium
KAETDQ

SEQ ID NO: 510129 - protein, 8 aa, Mycobacterium
KAETGGRG

SEQ ID NO: 510130 - protein, 9 aa, Mycobacterium
KAETPASEL

SEQ ID NO: 510131 - protein, 27 aa, Mycobacterium
KAETSTPSAAPGLEERTSRQDETDIKP

SEQ ID NO: 510132 - protein, 24 aa, Mycobacterium
KAEVDKAQAEAAQAGPLAEAEAQR

SEQ ID NO: 510133 - protein, 24 aa, Mycobacterium
KAEVDKAQAQAAQAGPLAEAQSQR

SEQ ID NO: 510134 - protein, 8 aa, Mycobacterium
KAFDEGPW

SEQ ID NO: 510135 - protein, 6 aa, Mycobacterium
KAFGDN

SEQ ID NO: 510136 - protein, 6 aa, Mycobacterium
KAFGTP

SEQ ID NO: 510137 - protein, 6 aa, Mycobacterium
KAFPRE

SEQ ID NO: 510138 - protein, 4 aa, Mycobacterium
KAFR

SEQ ID NO: 510139 - protein, 6 aa, Mycobacterium
KAFSQD

SEQ ID NO: 510140 - protein, 7 aa, Mycobacterium
KAFTPKA

SEQ ID NO: 510141 - protein, 7 aa, Mycobacterium
KAFTPRA

SEQ ID NO: 510142 - protein, 9 aa, Mycobacterium
KAGAASNPA

SEQ ID NO: 510143 - protein, 9 aa, Mycobacterium
KAGAAVGKP

SEQ ID NO: 510144 - protein, 5 aa, Mycobacterium
KAGAD

SEQ ID NO: 510145 - protein, 16 aa, Mycobacterium
KAGADLPDRDALRAAQ

SEQ ID NO: 510146 - protein, 8 aa, Mycobacterium
KAGAEGKV

SEQ ID NO: 510147 - protein, 11 aa, Mycobacterium
KAGATAADLGR

SEQ ID NO: 510148 - protein, 22 aa, Mycobacterium
KAGATCGDLGRAATKAAGGQKP

SEQ ID NO: 510149 - protein, 10 aa, Mycobacterium
KAGATSGDLA

SEQ ID NO: 510150 - protein, 11 aa, Mycobacterium
KAGCQGAIDRS

SEQ ID NO: 510151 - protein, 6 aa, Mycobacterium
KAGCST

SEQ ID NO: 510152 - protein, 5 aa, Mycobacterium
KAGDA

SEQ ID NO: 510153 - protein, 21 aa, Mycobacterium
KAGDEATSATGENSTQGRTAH

SEQ ID NO: 510154 - protein, 7 aa, Mycobacterium
KAGDESL

SEQ ID NO: 510155 - protein, 8 aa, Mycobacterium
KAGDGSTR

SEQ ID NO: 510156 - protein, 8 aa, Mycobacterium
KAGDRELT

SEQ ID NO: 510157 - protein, 16 aa, Mycobacterium
KAGEAVVNDDGTLTAG

SEQ ID NO: 510158 - protein, 10 aa, Mycobacterium
KAGEEQARYD

SEQ ID NO: 510159 - protein, 17 aa, Mycobacterium
KAGEGVVNDDGTLTAGP

SEQ ID NO: 510160 - protein, 17 aa, Mycobacterium
KAGEGVVNPDGTLTAGP

SEQ ID NO: 510161 - protein, 17 aa, Mycobacterium
KAGEGVVNSDGTLTAGP

SEQ ID NO: 510162 - protein, 6 aa, Mycobacterium
KAGELS

SEQ ID NO: 510163 - protein, 10 aa, Mycobacterium
KAGELSANGK

SEQ ID NO: 510164 - protein, 7 aa, Mycobacterium
KAGELTP

SEQ ID NO: 510165 - protein, 18 aa, Mycobacterium
KAGEPKVDNIGSGNNIEK

SEQ ID NO: 510166 - protein, 15 aa, Mycobacterium
KAGEPSDSSKRRFDA

SEQ ID NO: 510167 - protein, 5 aa, Mycobacterium
KAGER

SEQ ID NO: 510168 - protein, 19 aa, Mycobacterium
KAGESDATKWESSGEGTYT

SEQ ID NO: 510169 - protein, 19 aa, Mycobacterium
KAGESEATKWESSGEGTYT

SEQ ID NO: 510170 - protein, 20 aa, Mycobacterium
KAGESEATRWESSGDGTYTI

SEQ ID NO: 510171 - protein, 19 aa, Mycobacterium
KAGESEATRWESSGEGTYT

SEQ ID NO: 510172 - protein, 19 aa, Mycobacterium
KAGESEATRWESTGEGSYT

SEQ ID NO: 510173 - protein, 5 aa, Mycobacterium
KAGET

SEQ ID NO: 510174 - protein, 6 aa, Mycobacterium
KAGETS

SEQ ID NO: 510175 - protein, 5 aa, Mycobacterium
KAGEV

SEQ ID NO: 510176 - protein, 5 aa, Mycobacterium
KAGFS

SEQ ID NO: 510177 - protein, 6 aa, Mycobacterium
KAGFSD

SEQ ID NO: 510178 - protein, 7 aa, Mycobacterium
KAGFSRE

SEQ ID NO: 510179 - protein, 4 aa, Mycobacterium
KAGG

SEQ ID NO: 510180 - protein, 10 aa, Mycobacterium
KAGGANEGHS

SEQ ID NO: 510181 - protein, 7 aa, Mycobacterium
KAGGARD

SEQ ID NO: 510182 - protein, 10 aa, Mycobacterium
KAGGGIPPQE

SEQ ID NO: 510183 - protein, 5 aa, Mycobacterium
KAGGL

SEQ ID NO: 510184 - protein, 5 aa, Mycobacterium
KAGGR

SEQ ID NO: 510185 - protein, 6 aa, Mycobacterium
KAGGRI

SEQ ID NO: 510186 - protein, 9 aa, Mycobacterium
KAGGVDAEE

SEQ ID NO: 510187 - protein, 9 aa, Mycobacterium
KAGGVDTHD

SEQ ID NO: 510188 - protein, 6 aa, Mycobacterium
KAGGVL

SEQ ID NO: 510189 - protein, 13 aa, Mycobacterium
KAGHSELVDREAV

SEQ ID NO: 510190 - protein, 24 aa, Mycobacterium
KAGHTAAGDDNDAFSDAVVKFVKR

SEQ ID NO: 510191 - protein, 4 aa, Mycobacterium
KAGI

SEQ ID NO: 510192 - protein, 9 aa, Mycobacterium
KAGIDPEGL

SEQ ID NO: 510193 - protein, 6 aa, Mycobacterium
KAGIEE

SEQ ID NO: 510194 - protein, 6 aa, Mycobacterium
KAGIPR

SEQ ID NO: 510195 - protein, 6 aa, Mycobacterium
KAGITL

SEQ ID NO: 510196 - protein, 15 aa, Mycobacterium
KAGKAGARDRADDLA

SEQ ID NO: 510197 - protein, 8 aa, Mycobacterium
KAGKAGMV

SEQ ID NO: 510198 - protein, 9 aa, Mycobacterium
KAGKAHPSF

SEQ ID NO: 510199 - protein, 6 aa, Mycobacterium
KAGKAV

SEQ ID NO: 510200 - protein, 31 aa, Mycobacterium
KAGKHGAAQDYDGYADQRDEADTASIPILRG

SEQ ID NO: 510201 - protein, 14 aa, Mycobacterium
KAGKKINKDDGIQR

SEQ ID NO: 510202 - protein, 7 aa, Mycobacterium
KAGKSTV

SEQ ID NO: 510203 - protein, 12 aa, Mycobacterium
KAGKTKRDPALG

SEQ ID NO: 510204 - protein, 7 aa, Mycobacterium
KAGKTVD

SEQ ID NO: 510205 - protein, 9 aa, Mycobacterium
KAGLDTTKA

SEQ ID NO: 510206 - protein, 9 aa, Mycobacterium
KAGLEADRR

SEQ ID NO: 510207 - protein, 6 aa, Mycobacterium
KAGLGE

SEQ ID NO: 510208 - protein, 7 aa, Mycobacterium
KAGLPPQ

SEQ ID NO: 510209 - protein, 8 aa, Mycobacterium
KAGLSRPT

SEQ ID NO: 510210 - protein, 8 aa, Mycobacterium
KAGNPDIM

SEQ ID NO: 510211 - protein, 11 aa, Mycobacterium
KAGNPDTMPGV

SEQ ID NO: 510212 - protein, 10 aa, Mycobacterium
KAGNPDTMSG

SEQ ID NO: 510213 - protein, 9 aa, Mycobacterium
KAGNPDTMT

SEQ ID NO: 510214 - protein, 7 aa, Mycobacterium
KAGNPHR

SEQ ID NO: 510215 - protein, 20 aa, Mycobacterium
KAGNPIGPSPYLRGGSRKSL

SEQ ID NO: 510216 - protein, 7 aa, Mycobacterium
KAGNPNI

SEQ ID NO: 510217 - protein, 17 aa, Mycobacterium
KAGPAIKAGDALAPAAS

SEQ ID NO: 510218 - protein, 6 aa, Mycobacterium
KAGPAL

SEQ ID NO: 510219 - protein, 10 aa, Mycobacterium
KAGPEDGLKE

SEQ ID NO: 510220 - protein, 5 aa, Mycobacterium
KAGPL

SEQ ID NO: 510221 - protein, 9 aa, Mycobacterium
KAGPRRARN

SEQ ID NO: 510222 - protein, 18 aa, Mycobacterium
KAGPSNATGSETLPSGTE

SEQ ID NO: 510223 - protein, 5 aa, Mycobacterium
KAGPV

SEQ ID NO: 510224 - protein, 10 aa, Mycobacterium
KAGQLELSRG

SEQ ID NO: 510225 - protein, 5 aa, Mycobacterium
KAGQR

SEQ ID NO: 510226 - protein, 7 aa, Mycobacterium
KAGQTVA

SEQ ID NO: 510227 - protein, 11 aa, Mycobacterium
KAGQVEARRAQ

SEQ ID NO: 510228 - protein, 7 aa, Mycobacterium
KAGQVST

SEQ ID NO: 510229 - protein, 28 aa, Mycobacterium
KAGRKERYSGDDTLRPLDKKGRAQAEAL

SEQ ID NO: 510230 - protein, 5 aa, Mycobacterium
KAGRL

SEQ ID NO: 510231 - protein, 6 aa, Mycobacterium
KAGRPV

SEQ ID NO: 510232 - protein, 6 aa, Mycobacterium
KAGRRR

SEQ ID NO: 510233 - protein, 7 aa, Mycobacterium
KAGRRTE

SEQ ID NO: 510234 - protein, 5 aa, Mycobacterium
KAGRS

SEQ ID NO: 510235 - protein, 8 aa, Mycobacterium
KAGRSRGV

SEQ ID NO: 510236 - protein, 5 aa, Mycobacterium
KAGRT

SEQ ID NO: 510237 - protein, 7 aa, Mycobacterium
KAGRWPR

SEQ ID NO: 510238 - protein, 8 aa, Mycobacterium
KAGSAAAK

SEQ ID NO: 510239 - protein, 6 aa, Mycobacterium
KAGSDN

SEQ ID NO: 510240 - protein, 9 aa, Mycobacterium
KAGSDRARW

SEQ ID NO: 510241 - protein, 6 aa, Mycobacterium
KAGSER

SEQ ID NO: 510242 - protein, 8 aa, Mycobacterium
KAGSGSKY

SEQ ID NO: 510243 - protein, 15 aa, Mycobacterium
KAGSIGSLSTPSSWD

SEQ ID NO: 510244 - protein, 6 aa, Mycobacterium
KAGSKN

SEQ ID NO: 510245 - protein, 9 aa, Mycobacterium
KAGSPTVPM

SEQ ID NO: 510246 - protein, 6 aa, Mycobacterium
KAGSRE

SEQ ID NO: 510247 - protein, 8 aa, Mycobacterium
KAGSREDA

SEQ ID NO: 510248 - protein, 4 aa, Mycobacterium
KAGT

SEQ ID NO: 510249 - protein, 10 aa, Mycobacterium
KAGTAHPISD

SEQ ID NO: 510250 - protein, 6 aa, Mycobacterium
KAGTAL

SEQ ID NO: 510251 - protein, 11 aa, Mycobacterium
KAGTARPISDD

SEQ ID NO: 510252 - protein, 12 aa, Mycobacterium
KAGTEVLVVETS

SEQ ID NO: 510253 - protein, 8 aa, Mycobacterium
KAGTGGHG

SEQ ID NO: 510254 - protein, 8 aa, Mycobacterium
KAGTGKST

SEQ ID NO: 510255 - protein, 10 aa, Mycobacterium
KAGTLSANGR

SEQ ID NO: 510256 - protein, 8 aa, Mycobacterium
KAGTRTFE

SEQ ID NO: 510257 - protein, 7 aa, Mycobacterium
KAGTSMA

SEQ ID NO: 510258 - protein, 5 aa, Mycobacterium
KAGTT

SEQ ID NO: 510259 - protein, 8 aa, Mycobacterium
KAGTTGQL

SEQ ID NO: 510260 - protein, 6 aa, Mycobacterium
KAGTTW

SEQ ID NO: 510261 - protein, 4 aa, Mycobacterium
KAGV

SEQ ID NO: 510262 - protein, 5 aa, Mycobacterium
KAGVD

SEQ ID NO: 510263 - protein, 10 aa, Mycobacterium
KAGVDPDGLQ

SEQ ID NO: 510264 - protein, 12 aa, Mycobacterium
KAGVELDDGPAH

SEQ ID NO: 510265 - protein, 6 aa, Mycobacterium
KAGVIK

SEQ ID NO: 510266 - protein, 5 aa, Mycobacterium
KAGVL

SEQ ID NO: 510267 - protein, 9 aa, Mycobacterium
KAGVPDGTT

SEQ ID NO: 510268 - protein, 24 aa, Mycobacterium
KAGVPNRAAARQPKRNPDAGARSK

SEQ ID NO: 510269 - protein, 8 aa, Mycobacterium
KAGVRGRA

SEQ ID NO: 510270 - protein, 6 aa, Mycobacterium
KAGVSQ

SEQ ID NO: 510271 - protein, 10 aa, Mycobacterium
KAGVSQPTVS

SEQ ID NO: 510272 - protein, 5 aa, Mycobacterium
KAGVT

SEQ ID NO: 510273 - protein, 6 aa, Mycobacterium
KAGVTE

SEQ ID NO: 510274 - protein, 6 aa, Mycobacterium
KAGVTP

SEQ ID NO: 510275 - protein, 7 aa, Mycobacterium
KAGYAND

SEQ ID NO: 510276 - protein, 15 aa, Mycobacterium
KAGYATTTAPVSGPI

SEQ ID NO: 510277 - protein, 7 aa, Mycobacterium
KAGYDSR

SEQ ID NO: 510278 - protein, 6 aa, Mycobacterium
KAGYLT

SEQ ID NO: 510279 - protein, 8 aa, Mycobacterium
KAGYPNRG

SEQ ID NO: 510280 - protein, 16 aa, Mycobacterium
KAHAEAAAELIIRGLL

SEQ ID NO: 510281 - protein, 12 aa, Mycobacterium
KAHDAVKRAREQ

SEQ ID NO: 510282 - protein, 13 aa, Mycobacterium
KAHDENESAGIGD

SEQ ID NO: 510283 - protein, 13 aa, Mycobacterium
KAHDENSTAGIGD

SEQ ID NO: 510284 - protein, 6 aa, Mycobacterium
KAHDGG

SEQ ID NO: 510285 - protein, 7 aa, Mycobacterium
KAHDNGV

SEQ ID NO: 510286 - protein, 4 aa, Mycobacterium
KAHE

SEQ ID NO: 510287 - protein, 9 aa, Mycobacterium
KAHEENPDY

SEQ ID NO: 510288 - protein, 9 aa, Mycobacterium
KAHGFGDPT

SEQ ID NO: 510289 - protein, 10 aa, Mycobacterium
KAHGLGDPSG

SEQ ID NO: 510290 - protein, 5 aa, Mycobacterium
KAHGN

SEQ ID NO: 510291 - protein, 10 aa, Mycobacterium
KAHHGRPGTV

SEQ ID NO: 510292 - protein, 4 aa, Mycobacterium
KAHP

SEQ ID NO: 510293 - protein, 6 aa, Mycobacterium
KAHPGE

SEQ ID NO: 510294 - protein, 7 aa, Mycobacterium
KAHPGVN

SEQ ID NO: 510295 - protein, 6 aa, Mycobacterium
KAHPQR

SEQ ID NO: 510296 - protein, 14 aa, Mycobacterium
KAHPRAQERDDALS

SEQ ID NO: 510297 - protein, 5 aa, Mycobacterium
KAHRG

SEQ ID NO: 510298 - protein, 8 aa, Mycobacterium
KAHSPNAV

SEQ ID NO: 510299 - protein, 12 aa, Mycobacterium
KAHTARVRGSRA

SEQ ID NO: 510300 - protein, 12 aa, Mycobacterium
KAHTKKSPPVRK

SEQ ID NO: 510301 - protein, 7 aa, Mycobacterium
KAHYAAK

SEQ ID NO: 510302 - protein, 6 aa, Mycobacterium
KAIASA

SEQ ID NO: 510303 - protein, 9 aa, Mycobacterium
KAIATEHGA

SEQ ID NO: 510304 - protein, 6 aa, Mycobacterium
KAIDAG

SEQ ID NO: 510305 - protein, 7 aa, Mycobacterium
KAIEEAV

SEQ ID NO: 510306 - protein, 8 aa, Mycobacterium
KAIEERGA

SEQ ID NO: 510307 - protein, 9 aa, Mycobacterium
KAIKDAGLS

SEQ ID NO: 510308 - protein, 9 aa, Mycobacterium
KAIKPSYGL

SEQ ID NO: 510309 - protein, 4 aa, Mycobacterium
KAIN

SEQ ID NO: 510310 - protein, 5 aa, Mycobacterium
KAINS

SEQ ID NO: 510311 - protein, 7 aa, Mycobacterium
KAIPDKF

SEQ ID NO: 510312 - protein, 7 aa, Mycobacterium
KAIPEDG

SEQ ID NO: 510313 - protein, 5 aa, Mycobacterium
KAIPG

SEQ ID NO: 510314 - protein, 7 aa, Mycobacterium
KAIPGDG

SEQ ID NO: 510315 - protein, 7 aa, Mycobacterium
KAIPISP

SEQ ID NO: 510316 - protein, 13 aa, Mycobacterium
KAISGATSKGLAA

SEQ ID NO: 510317 - protein, 22 aa, Mycobacterium
KAISKPAKKTQSTGTDNDNKDS

SEQ ID NO: 510318 - protein, 7 aa, Mycobacterium
KAISRPE

SEQ ID NO: 510319 - protein, 5 aa, Mycobacterium
KAISS

SEQ ID NO: 510320 - protein, 5 aa, Mycobacterium
KAIST

SEQ ID NO: 510321 - protein, 6 aa, Mycobacterium
KAITEA

SEQ ID NO: 510322 - protein, 6 aa, Mycobacterium
KAITGT

SEQ ID NO: 510323 - protein, 4 aa, Mycobacterium
KAKA

SEQ ID NO: 510324 - protein, 8 aa, Mycobacterium
KAKAAHKH

SEQ ID NO: 510325 - protein, 41 aa, Mycobacterium
KAKADLEQHAKDQAADKARARAQNAGHDDDAAARAAEQAAQ

SEQ ID NO: 510326 - protein, 10 aa, Mycobacterium
KAKAESPYGA

SEQ ID NO: 510327 - protein, 9 aa, Mycobacterium
KAKAGDGTV

SEQ ID NO: 510328 - protein, 8 aa, Mycobacterium
KAKALGLK

SEQ ID NO: 510329 - protein, 6 aa, Mycobacterium
KAKAQP

SEQ ID NO: 510330 - protein, 7 aa, Mycobacterium
KAKARAA

SEQ ID NO: 510331 - protein, 14 aa, Mycobacterium
KAKARRTPAGVSTA

SEQ ID NO: 510332 - protein, 12 aa, Mycobacterium
KAKASGKTYAAT

SEQ ID NO: 510333 - protein, 9 aa, Mycobacterium
KAKDAGGTV

SEQ ID NO: 510334 - protein, 8 aa, Mycobacterium
KAKDKRED

SEQ ID NO: 510335 - protein, 6 aa, Mycobacterium
KAKDLG

SEQ ID NO: 510336 - protein, 18 aa, Mycobacterium
KAKDPASHDEAAAAELGH

SEQ ID NO: 510337 - protein, 8 aa, Mycobacterium
KAKDPNYS

SEQ ID NO: 510338 - protein, 5 aa, Mycobacterium
KAKDR

SEQ ID NO: 510339 - protein, 8 aa, Mycobacterium
KAKEADGK

SEQ ID NO: 510340 - protein, 8 aa, Mycobacterium
KAKEAGHD

SEQ ID NO: 510341 - protein, 9 aa, Mycobacterium
KAKEGDGTI

SEQ ID NO: 510342 - protein, 6 aa, Mycobacterium
KAKELG

SEQ ID NO: 510343 - protein, 6 aa, Mycobacterium
KAKEQP

SEQ ID NO: 510344 - protein, 7 aa, Mycobacterium
KAKEVPA

SEQ ID NO: 510345 - protein, 4 aa, Mycobacterium
KAKG

SEQ ID NO: 510346 - protein, 6 aa, Mycobacterium
KAKGAD

SEQ ID NO: 510347 - protein, 5 aa, Mycobacterium
KAKGE

SEQ ID NO: 510348 - protein, 8 aa, Mycobacterium
KAKGVQQL

SEQ ID NO: 510349 - protein, 6 aa, Mycobacterium
KAKGVR

SEQ ID NO: 510350 - protein, 13 aa, Mycobacterium
KAKIRDTRKTLPG

SEQ ID NO: 510351 - protein, 6 aa, Mycobacterium
KAKKFG

SEQ ID NO: 510352 - protein, 16 aa, Mycobacterium
KAKKKKKKSAGAGRHK

SEQ ID NO: 510353 - protein, 28 aa, Mycobacterium
KAKKNSVPNDNIERARKRGAGEEAGGAD

SEQ ID NO: 510354 - protein, 8 aa, Mycobacterium
KAKKPVRT

SEQ ID NO: 510355 - protein, 29 aa, Mycobacterium
KAKKSSVPNDNIERARKRGAGEEAGGADW

SEQ ID NO: 510356 - protein, 28 aa, Mycobacterium
KAKKTSVPNDNIERARKRGAGEEAGGAD

SEQ ID NO: 510357 - protein, 14 aa, Mycobacterium
KAKMSQNQPARNRA

SEQ ID NO: 510358 - protein, 12 aa, Mycobacterium
KAKPDQMPAETS

SEQ ID NO: 510359 - protein, 10 aa, Mycobacterium
KAKPGRGVEQ

SEQ ID NO: 510360 - protein, 11 aa, Mycobacterium
KAKPGRSAEQL

SEQ ID NO: 510361 - protein, 9 aa, Mycobacterium
KAKPKRKNT

SEQ ID NO: 510362 - protein, 6 aa, Mycobacterium
KAKQQP

SEQ ID NO: 510363 - protein, 7 aa, Mycobacterium
KAKQSQA

SEQ ID NO: 510364 - protein, 8 aa, Mycobacterium
KAKQYTDS

SEQ ID NO: 510365 - protein, 6 aa, Mycobacterium
KAKREL

SEQ ID NO: 510366 - protein, 6 aa, Mycobacterium
KAKSLG

SEQ ID NO: 510367 - protein, 9 aa, Mycobacterium
KAKSLGRKP

SEQ ID NO: 510368 - protein, 5 aa, Mycobacterium
KAKSM

SEQ ID NO: 510369 - protein, 7 aa, Mycobacterium
KAKSQKV

SEQ ID NO: 510370 - protein, 18 aa, Mycobacterium
KAKSTDEVYEQYLADAVK

SEQ ID NO: 510371 - protein, 9 aa, Mycobacterium
KAKSYATEA

SEQ ID NO: 510372 - protein, 10 aa, Mycobacterium
KAKTPTDNGA

SEQ ID NO: 510373 - protein, 5 aa, Mycobacterium
KAKTV

SEQ ID NO: 510374 - protein, 9 aa, Mycobacterium
KAKYGGTAT

SEQ ID NO: 510375 - protein, 6 aa, Mycobacterium
KALARR

SEQ ID NO: 510376 - protein, 6 aa, Mycobacterium
KALDDE

SEQ ID NO: 510377 - protein, 5 aa, Mycobacterium
KALDG

SEQ ID NO: 510378 - protein, 7 aa, Mycobacterium
KALDGRG

SEQ ID NO: 510379 - protein, 9 aa, Mycobacterium
KALDGRSDL

SEQ ID NO: 510380 - protein, 6 aa, Mycobacterium
KALDNA

SEQ ID NO: 510381 - protein, 5 aa, Mycobacterium
KALDP

SEQ ID NO: 510382 - protein, 9 aa, Mycobacterium
KALEAEAPL

SEQ ID NO: 510383 - protein, 6 aa, Mycobacterium
KALENS

SEQ ID NO: 510384 - protein, 6 aa, Mycobacterium
KALEQP

SEQ ID NO: 510385 - protein, 15 aa, Mycobacterium
KALERGKTTKEKSDA

SEQ ID NO: 510386 - protein, 14 aa, Mycobacterium
KALERGRTTQERSD

SEQ ID NO: 510387 - protein, 4 aa, Mycobacterium
KALG

SEQ ID NO: 510388 - protein, 6 aa, Mycobacterium
KALGEA

SEQ ID NO: 510389 - protein, 10 aa, Mycobacterium
KALGGGGPKY

SEQ ID NO: 510390 - protein, 8 aa, Mycobacterium
KALGGRPV

SEQ ID NO: 510391 - protein, 8 aa, Mycobacterium
KALGGTSN

SEQ ID NO: 510392 - protein, 7 aa, Mycobacterium
KALGNGR

SEQ ID NO: 510393 - protein, 14 aa, Mycobacterium
KALGSQGGAVLGPE

SEQ ID NO: 510394 - protein, 18 aa, Mycobacterium
KALNASLGDAKPPETHTE

SEQ ID NO: 510395 - protein, 7 aa, Mycobacterium
KALNSVA

SEQ ID NO: 510396 - protein, 6 aa, Mycobacterium
KALPAD

SEQ ID NO: 510397 - protein, 16 aa, Mycobacterium
KALPDTELPAGDEPDP

SEQ ID NO: 510398 - protein, 6 aa, Mycobacterium
KALPGD

SEQ ID NO: 510399 - protein, 10 aa, Mycobacterium
KALPKDNLAH

SEQ ID NO: 510400 - protein, 6 aa, Mycobacterium
KALPTG

SEQ ID NO: 510401 - protein, 8 aa, Mycobacterium
KALRDKGL

SEQ ID NO: 510402 - protein, 6 aa, Mycobacterium
KALRDS

SEQ ID NO: 510403 - protein, 5 aa, Mycobacterium
KALRN

SEQ ID NO: 510404 - protein, 12 aa, Mycobacterium
KALRRRADGDDL

SEQ ID NO: 510405 - protein, 5 aa, Mycobacterium
KALRS

SEQ ID NO: 510406 - protein, 8 aa, Mycobacterium
KALRSATD

SEQ ID NO: 510407 - protein, 8 aa, Mycobacterium
KALRSATT

SEQ ID NO: 510408 - protein, 8 aa, Mycobacterium
KALRSQGF

SEQ ID NO: 510409 - protein, 6 aa, Mycobacterium
KALSED

SEQ ID NO: 510410 - protein, 5 aa, Mycobacterium
KALSR

SEQ ID NO: 510411 - protein, 11 aa, Mycobacterium
KALSRAESRHG

SEQ ID NO: 510412 - protein, 9 aa, Mycobacterium
KALSSPDRP

SEQ ID NO: 510413 - protein, 4 aa, Mycobacterium
KALT

SEQ ID NO: 510414 - protein, 6 aa, Mycobacterium
KALTDN

SEQ ID NO: 510415 - protein, 8 aa, Mycobacterium
KALTEAGA

SEQ ID NO: 510416 - protein, 6 aa, Mycobacterium
KALTGY

SEQ ID NO: 510417 - protein, 12 aa, Mycobacterium
KALTNAGDTWPI

SEQ ID NO: 510418 - protein, 5 aa, Mycobacterium
KALVG

SEQ ID NO: 510419 - protein, 8 aa, Mycobacterium
KAMGDNRR

SEQ ID NO: 510420 - protein, 12 aa, Mycobacterium
KAMGTGPNVPMP

SEQ ID NO: 510421 - protein, 6 aa, Mycobacterium
KAMPEA

SEQ ID NO: 510422 - protein, 4 aa, Mycobacterium
KAMR

SEQ ID NO: 510423 - protein, 6 aa, Mycobacterium
KAMRDA

SEQ ID NO: 510424 - protein, 4 aa, Mycobacterium
KANA

SEQ ID NO: 510425 - protein, 10 aa, Mycobacterium
KANAANLPLR

SEQ ID NO: 510426 - protein, 9 aa, Mycobacterium
KANAPDKVN

SEQ ID NO: 510427 - protein, 8 aa, Mycobacterium
KANARPDM

SEQ ID NO: 510428 - protein, 4 aa, Mycobacterium
KANE

SEQ ID NO: 510429 - protein, 8 aa, Mycobacterium
KANEIGQP

SEQ ID NO: 510430 - protein, 6 aa, Mycobacterium
KANEVQ

SEQ ID NO: 510431 - protein, 4 aa, Mycobacterium
KANG

SEQ ID NO: 510432 - protein, 6 aa, Mycobacterium
KANGAE

SEQ ID NO: 510433 - protein, 7 aa, Mycobacterium
KANGDPC

SEQ ID NO: 510434 - protein, 9 aa, Mycobacterium
KANGGPAHV

SEQ ID NO: 510435 - protein, 5 aa, Mycobacterium
KANGH

SEQ ID NO: 510436 - protein, 9 aa, Mycobacterium
KANGNQRPL

SEQ ID NO: 510437 - protein, 9 aa, Mycobacterium
KANGPDNHE

SEQ ID NO: 510438 - protein, 7 aa, Mycobacterium
KANGVKP

SEQ ID NO: 510439 - protein, 7 aa, Mycobacterium
KANIDPY

SEQ ID NO: 510440 - protein, 9 aa, Mycobacterium
KANKPGSGT

SEQ ID NO: 510441 - protein, 4 aa, Mycobacterium
KANM

SEQ ID NO: 510442 - protein, 4 aa, Mycobacterium
KANP

SEQ ID NO: 510443 - protein, 5 aa, Mycobacterium
KANPA

SEQ ID NO: 510444 - protein, 7 aa, Mycobacterium
KANPETV

SEQ ID NO: 510445 - protein, 12 aa, Mycobacterium
KANPFSSIRNNC

SEQ ID NO: 510446 - protein, 7 aa, Mycobacterium
KANPGEP

SEQ ID NO: 510447 - protein, 7 aa, Mycobacterium
KANPGGL

SEQ ID NO: 510448 - protein, 12 aa, Mycobacterium
KANPGYGISPTK

SEQ ID NO: 510449 - protein, 7 aa, Mycobacterium
KANPNGI

SEQ ID NO: 510450 - protein, 13 aa, Mycobacterium
KANPTGRRTSALD

SEQ ID NO: 510451 - protein, 5 aa, Mycobacterium
KANPY

SEQ ID NO: 510452 - protein, 5 aa, Mycobacterium
KANQA

SEQ ID NO: 510453 - protein, 11 aa, Mycobacterium
KANQKKAGFLP

SEQ ID NO: 510454 - protein, 5 aa, Mycobacterium
KANQN

SEQ ID NO: 510455 - protein, 6 aa, Mycobacterium
KANQRL

SEQ ID NO: 510456 - protein, 4 aa, Mycobacterium
KANR

SEQ ID NO: 510457 - protein, 6 aa, Mycobacterium
KANRLG

SEQ ID NO: 510458 - protein, 11 aa, Mycobacterium
KANRSARGIAA

SEQ ID NO: 510459 - protein, 8 aa, Mycobacterium
KANRSTFG

SEQ ID NO: 510460 - protein, 8 aa, Mycobacterium
KANRSTHG

SEQ ID NO: 510461 - protein, 7 aa, Mycobacterium
KANSEAV

SEQ ID NO: 510462 - protein, 6 aa, Mycobacterium
KANVAR

SEQ ID NO: 510463 - protein, 7 aa, Mycobacterium
KANVDAS

SEQ ID NO: 510464 - protein, 5 aa, Mycobacterium
KANVE

SEQ ID NO: 510465 - protein, 6 aa, Mycobacterium
KANWGV

SEQ ID NO: 510466 - protein, 41 aa, Mycobacterium
KAPAARAAPAEPEAKAAPAATAPTTAPPQEQPAAPAAKAAP

SEQ ID NO: 510467 - protein, 5 aa, Mycobacterium
KAPAD

SEQ ID NO: 510468 - protein, 7 aa, Mycobacterium
KAPAEQL

SEQ ID NO: 510469 - protein, 22 aa, Mycobacterium
KAPAFSLPDANGNKVSLSDYKG

SEQ ID NO: 510470 - protein, 5 aa, Mycobacterium
KAPAG

SEQ ID NO: 510471 - protein, 7 aa, Mycobacterium
KAPAQGA

SEQ ID NO: 510472 - protein, 29 aa, Mycobacterium
KAPATTTASAKFPAATSAADSTVGRSGRA

SEQ ID NO: 510473 - protein, 5 aa, Mycobacterium
KAPAY

SEQ ID NO: 510474 - protein, 7 aa, Mycobacterium
KAPDALS

SEQ ID NO: 510475 - protein, 8 aa, Mycobacterium
KAPDALSL

SEQ ID NO: 510476 - protein, 9 aa, Mycobacterium
KAPDALSLP

SEQ ID NO: 510477 - protein, 14 aa, Mycobacterium
KAPDAQYQAGRRGA

SEQ ID NO: 510478 - protein, 7 aa, Mycobacterium
KAPDEAY

SEQ ID NO: 510479 - protein, 26 aa, Mycobacterium
KAPDFTSDPDRAAAVRASSQADRERY

SEQ ID NO: 510480 - protein, 8 aa, Mycobacterium
KAPDPPQR

SEQ ID NO: 510481 - protein, 11 aa, Mycobacterium
KAPDYRPPAGA

SEQ ID NO: 510482 - protein, 4 aa, Mycobacterium
KAPE

SEQ ID NO: 510483 - protein, 5 aa, Mycobacterium
KAPEA

SEQ ID NO: 510484 - protein, 7 aa, Mycobacterium
KAPEAKD

SEQ ID NO: 510485 - protein, 6 aa, Mycobacterium
KAPEGR

SEQ ID NO: 510486 - protein, 8 aa, Mycobacterium
KAPEGTDA

SEQ ID NO: 510487 - protein, 8 aa, Mycobacterium
KAPEHPDD

SEQ ID NO: 510488 - protein, 4 aa, Mycobacterium
KAPF

SEQ ID NO: 510489 - protein, 5 aa, Mycobacterium
KAPFE

SEQ ID NO: 510490 - protein, 13 aa, Mycobacterium
KAPFSRRPLEGPH

SEQ ID NO: 510491 - protein, 14 aa, Mycobacterium
KAPGAPYQAGRRGA

SEQ ID NO: 510492 - protein, 7 aa, Mycobacterium
KAPGLST

SEQ ID NO: 510493 - protein, 9 aa, Mycobacterium
KAPGQRIPR

SEQ ID NO: 510494 - protein, 5 aa, Mycobacterium
KAPGS

SEQ ID NO: 510495 - protein, 8 aa, Mycobacterium
KAPGVASK

SEQ ID NO: 510496 - protein, 19 aa, Mycobacterium
KAPGVEVGAKDAKMGQEGA

SEQ ID NO: 510497 - protein, 7 aa, Mycobacterium
KAPGYEV

SEQ ID NO: 510498 - protein, 4 aa, Mycobacterium
KAPK

SEQ ID NO: 510499 - protein, 5 aa, Mycobacterium
KAPKA

SEQ ID NO: 510500 - protein, 8 aa, Mycobacterium
KAPKELQA

SEQ ID NO: 510501 - protein, 7 aa, Mycobacterium
KAPKKLP

SEQ ID NO: 510502 - protein, 7 aa, Mycobacterium
KAPLAST

SEQ ID NO: 510503 - protein, 6 aa, Mycobacterium
KAPLRK

SEQ ID NO: 510504 - protein, 6 aa, Mycobacterium
KAPLRP

SEQ ID NO: 510505 - protein, 8 aa, Mycobacterium
KAPPAPDI

SEQ ID NO: 510506 - protein, 6 aa, Mycobacterium
KAPPEL

SEQ ID NO: 510507 - protein, 8 aa, Mycobacterium
KAPPELQA

SEQ ID NO: 510508 - protein, 7 aa, Mycobacterium
KAPPHPD

SEQ ID NO: 510509 - protein, 8 aa, Mycobacterium
KAPPHPDL

SEQ ID NO: 510510 - protein, 9 aa, Mycobacterium
KAPPNEPAT

SEQ ID NO: 510511 - protein, 8 aa, Mycobacterium
KAPPRTLD

SEQ ID NO: 510512 - protein, 8 aa, Mycobacterium
KAPQGPPV

SEQ ID NO: 510513 - protein, 6 aa, Mycobacterium
KAPQHY

SEQ ID NO: 510514 - protein, 6 aa, Mycobacterium
KAPQNV

SEQ ID NO: 510515 - protein, 9 aa, Mycobacterium
KAPRAEVTR

SEQ ID NO: 510516 - protein, 8 aa, Mycobacterium
KAPRDAEG

SEQ ID NO: 510517 - protein, 7 aa, Mycobacterium
KAPRDTV

SEQ ID NO: 510518 - protein, 5 aa, Mycobacterium
KAPRL

SEQ ID NO: 510519 - protein, 20 aa, Mycobacterium
KAPRVNDKRVDPDTGERKRF

SEQ ID NO: 510520 - protein, 6 aa, Mycobacterium
KAPSAF

SEQ ID NO: 510521 - protein, 5 aa, Mycobacterium
KAPSF

SEQ ID NO: 510522 - protein, 16 aa, Mycobacterium
KAPSFNLPDADGNKVS

SEQ ID NO: 510523 - protein, 7 aa, Mycobacterium
KAPSGAM

SEQ ID NO: 510524 - protein, 7 aa, Mycobacterium
KAPSGIH

SEQ ID NO: 510525 - protein, 7 aa, Mycobacterium
KAPSKVV

SEQ ID NO: 510526 - protein, 11 aa, Mycobacterium
KAPSPDSAPFT

SEQ ID NO: 510527 - protein, 8 aa, Mycobacterium
KAPSSQHV

SEQ ID NO: 510528 - protein, 75 aa, Mycobacterium
KAPSSSGGSPSPTPNPNPDPSPTPDPTPTPTPDPTPTPTPDPTPAPTPEPTPAPAPEPAPEPTPVEPAPVTVLPT

SEQ ID NO: 510529 - protein, 10 aa, Mycobacterium
KAPSVTAGPT

SEQ ID NO: 510530 - protein, 9 aa, Mycobacterium
KAPSVVAGP

SEQ ID NO: 510531 - protein, 4 aa, Mycobacterium
KAPT

SEQ ID NO: 510532 - protein, 17 aa, Mycobacterium
KAPTFSLPDADGNTVSL

SEQ ID NO: 510533 - protein, 5 aa, Mycobacterium
KAPTL

SEQ ID NO: 510534 - protein, 6 aa, Mycobacterium
KAPTLA

SEQ ID NO: 510535 - protein, 8 aa, Mycobacterium
KAPTPEQL

SEQ ID NO: 510536 - protein, 6 aa, Mycobacterium
KAPTPM

SEQ ID NO: 510537 - protein, 7 aa, Mycobacterium
KAPTQTL

SEQ ID NO: 510538 - protein, 6 aa, Mycobacterium
KAPTRG

SEQ ID NO: 510539 - protein, 7 aa, Mycobacterium
KAPTTDL

SEQ ID NO: 510540 - protein, 5 aa, Mycobacterium
KAPTV

SEQ ID NO: 510541 - protein, 6 aa, Mycobacterium
KAPTVQ

SEQ ID NO: 510542 - protein, 8 aa, Mycobacterium
KAPTVVPG

SEQ ID NO: 510543 - protein, 4 aa, Mycobacterium
KAPV

SEQ ID NO: 510544 - protein, 13 aa, Mycobacterium
KAPVAASRASRLP

SEQ ID NO: 510545 - protein, 7 aa, Mycobacterium
KAPVQQR

SEQ ID NO: 510546 - protein, 6 aa, Mycobacterium
KAPVSD

SEQ ID NO: 510547 - protein, 7 aa, Mycobacterium
KAPYTTL

SEQ ID NO: 510548 - protein, 4 aa, Mycobacterium
KAQA

SEQ ID NO: 510549 - protein, 13 aa, Mycobacterium
KAQARVEAARPYA

SEQ ID NO: 510550 - protein, 15 aa, Mycobacterium
KAQARVEAARPYSTE

SEQ ID NO: 510551 - protein, 9 aa, Mycobacterium
KAQDKGGPG

SEQ ID NO: 510552 - protein, 15 aa, Mycobacterium
KAQEDVWGDDPTVRV

SEQ ID NO: 510553 - protein, 5 aa, Mycobacterium
KAQEL

SEQ ID NO: 510554 - protein, 9 aa, Mycobacterium
KAQGHLDAG

SEQ ID NO: 510555 - protein, 22 aa, Mycobacterium
KAQGRHSNIGYDAPEDMEATKS

SEQ ID NO: 510556 - protein, 23 aa, Mycobacterium
KAQGRHSNIGYDAPKGMDETKSK

SEQ ID NO: 510557 - protein, 9 aa, Mycobacterium
KAQKQARHW

SEQ ID NO: 510558 - protein, 10 aa, Mycobacterium
KAQKQARRWS

SEQ ID NO: 510559 - protein, 13 aa, Mycobacterium
KAQKQARRWSRDS

SEQ ID NO: 510560 - protein, 8 aa, Mycobacterium
KAQKQARY

SEQ ID NO: 510561 - protein, 13 aa, Mycobacterium
KAQKQSRRWSRES

SEQ ID NO: 510562 - protein, 12 aa, Mycobacterium
KAQLGRLSAGGK

SEQ ID NO: 510563 - protein, 8 aa, Mycobacterium
KAQLPPGE

SEQ ID NO: 510564 - protein, 5 aa, Mycobacterium
KAQMP

SEQ ID NO: 510565 - protein, 14 aa, Mycobacterium
KAQMPGNDATPDIR

SEQ ID NO: 510566 - protein, 7 aa, Mycobacterium
KAQNAET

SEQ ID NO: 510567 - protein, 10 aa, Mycobacterium
KAQNAGPSRD

SEQ ID NO: 510568 - protein, 6 aa, Mycobacterium
KAQNRY

SEQ ID NO: 510569 - protein, 4 aa, Mycobacterium
KAQP

SEQ ID NO: 510570 - protein, 9 aa, Mycobacterium
KAQPHPPYE

SEQ ID NO: 510571 - protein, 9 aa, Mycobacterium
KAQPQSLAD

SEQ ID NO: 510572 - protein, 7 aa, Mycobacterium
KAQPSWE

SEQ ID NO: 510573 - protein, 6 aa, Mycobacterium
KAQRGP

SEQ ID NO: 510574 - protein, 13 aa, Mycobacterium
KAQRTSARRRESY

SEQ ID NO: 510575 - protein, 9 aa, Mycobacterium
KAQSDYARE

SEQ ID NO: 510576 - protein, 9 aa, Mycobacterium
KAQSTDGAA

SEQ ID NO: 510577 - protein, 6 aa, Mycobacterium
KAQTPE

SEQ ID NO: 510578 - protein, 8 aa, Mycobacterium
KAQVRSGE

SEQ ID NO: 510579 - protein, 5 aa, Mycobacterium
KARAA

SEQ ID NO: 510580 - protein, 6 aa, Mycobacterium
KARADA

SEQ ID NO: 510581 - protein, 8 aa, Mycobacterium
KARAELTQ

SEQ ID NO: 510582 - protein, 8 aa, Mycobacterium
KARAGHGS

SEQ ID NO: 510583 - protein, 5 aa, Mycobacterium
KARAR

SEQ ID NO: 510584 - protein, 9 aa, Mycobacterium
KARARGAGR

SEQ ID NO: 510585 - protein, 10 aa, Mycobacterium
KARASTGFPV

SEQ ID NO: 510586 - protein, 7 aa, Mycobacterium
KARAVGR

SEQ ID NO: 510587 - protein, 7 aa, Mycobacterium
KARDAFA

SEQ ID NO: 510588 - protein, 20 aa, Mycobacterium
KARDAFTASGLPSVADDSGL

SEQ ID NO: 510589 - protein, 7 aa, Mycobacterium
KARDAGA

SEQ ID NO: 510590 - protein, 8 aa, Mycobacterium
KARDGFEA

SEQ ID NO: 510591 - protein, 6 aa, Mycobacterium
KARDNG

SEQ ID NO: 510592 - protein, 6 aa, Mycobacterium
KARDPR

SEQ ID NO: 510593 - protein, 8 aa, Mycobacterium
KARDRARR

SEQ ID NO: 510594 - protein, 7 aa, Mycobacterium
KAREAEA

SEQ ID NO: 510595 - protein, 21 aa, Mycobacterium
KAREEMSGAADESDDEAPAGT

SEQ ID NO: 510596 - protein, 22 aa, Mycobacterium
KAREEMSTEATADDEESTEGAI

SEQ ID NO: 510597 - protein, 5 aa, Mycobacterium
KAREL

SEQ ID NO: 510598 - protein, 8 aa, Mycobacterium
KARELGAD

SEQ ID NO: 510599 - protein, 8 aa, Mycobacterium
KAREPGDD

SEQ ID NO: 510600 - protein, 21 aa, Mycobacterium
KAREQATSGEHATEDVAAEGT

SEQ ID NO: 510601 - protein, 20 aa, Mycobacterium
KAREQMSSDASAVQEESAPG

SEQ ID NO: 510602 - protein, 7 aa, Mycobacterium
KAREVRG

SEQ ID NO: 510603 - protein, 7 aa, Mycobacterium
KAREVRP

SEQ ID NO: 510604 - protein, 4 aa, Mycobacterium
KARF

SEQ ID NO: 510605 - protein, 6 aa, Mycobacterium
KARGAK

SEQ ID NO: 510606 - protein, 7 aa, Mycobacterium
KARGAMT

SEQ ID NO: 510607 - protein, 6 aa, Mycobacterium
KARGAT

SEQ ID NO: 510608 - protein, 13 aa, Mycobacterium
KARGEDSEGKRRQ

SEQ ID NO: 510609 - protein, 22 aa, Mycobacterium
KARGGSIRYEPADVTNEEETAR

SEQ ID NO: 510610 - protein, 15 aa, Mycobacterium
KARGQRIPRTVDESE

SEQ ID NO: 510611 - protein, 6 aa, Mycobacterium
KARGTE

SEQ ID NO: 510612 - protein, 7 aa, Mycobacterium
KARGYTL

SEQ ID NO: 510613 - protein, 8 aa, Mycobacterium
KARIAADP

SEQ ID NO: 510614 - protein, 6 aa, Mycobacterium
KARIGD

SEQ ID NO: 510615 - protein, 6 aa, Mycobacterium
KARKDG

SEQ ID NO: 510616 - protein, 8 aa, Mycobacterium
KARKESAE

SEQ ID NO: 510617 - protein, 5 aa, Mycobacterium
KARKI

SEQ ID NO: 510618 - protein, 9 aa, Mycobacterium
KARKRGKPV

SEQ ID NO: 510619 - protein, 5 aa, Mycobacterium
KARLG

SEQ ID NO: 510620 - protein, 6 aa, Mycobacterium
KARLTD

SEQ ID NO: 510621 - protein, 8 aa, Mycobacterium
KARLTTES

SEQ ID NO: 510622 - protein, 7 aa, Mycobacterium
KARNEGQ

SEQ ID NO: 510623 - protein, 38 aa, Mycobacterium
KARNNSADTGLPPEATLAPQPSSQTACQPAGQACPNVG

SEQ ID NO: 510624 - protein, 5 aa, Mycobacterium
KARPD

SEQ ID NO: 510625 - protein, 8 aa, Mycobacterium
KARPDGST

SEQ ID NO: 510626 - protein, 7 aa, Mycobacterium
KARPGGL

SEQ ID NO: 510627 - protein, 6 aa, Mycobacterium
KARPLS

SEQ ID NO: 510628 - protein, 15 aa, Mycobacterium
KARPLSARARRDAEL

SEQ ID NO: 510629 - protein, 6 aa, Mycobacterium
KARPRK

SEQ ID NO: 510630 - protein, 8 aa, Mycobacterium
KARPTDTV

SEQ ID NO: 510631 - protein, 9 aa, Mycobacterium
KARQAGAPI

SEQ ID NO: 510632 - protein, 6 aa, Mycobacterium
KARQPA

SEQ ID NO: 510633 - protein, 14 aa, Mycobacterium
KARQRPGEMATGLG

SEQ ID NO: 510634 - protein, 9 aa, Mycobacterium
KARQSGAPI

SEQ ID NO: 510635 - protein, 12 aa, Mycobacterium
KARQSMQPLSHT

SEQ ID NO: 510636 - protein, 12 aa, Mycobacterium
KARQTDTPEAAR

SEQ ID NO: 510637 - protein, 20 aa, Mycobacterium
KARQTFGEGPPSDGAEFDQS

SEQ ID NO: 510638 - protein, 11 aa, Mycobacterium
KARQWNSTSDI

SEQ ID NO: 510639 - protein, 14 aa, Mycobacterium
KARRATAHTPATNL

SEQ ID NO: 510640 - protein, 8 aa, Mycobacterium
KARRDGSA

SEQ ID NO: 510641 - protein, 7 aa, Mycobacterium
KARREKT

SEQ ID NO: 510642 - protein, 6 aa, Mycobacterium
KARRGP

SEQ ID NO: 510643 - protein, 14 aa, Mycobacterium
KARRHAKRDAVAAA

SEQ ID NO: 510644 - protein, 5 aa, Mycobacterium
KARRQ

SEQ ID NO: 510645 - protein, 5 aa, Mycobacterium
KARRR

SEQ ID NO: 510646 - protein, 20 aa, Mycobacterium
KARRSRTSTVRGWDSMPAVI

SEQ ID NO: 510647 - protein, 23 aa, Mycobacterium
KARSGTAPPPVNEPTTGPPPVSR

SEQ ID NO: 510648 - protein, 4 aa, Mycobacterium
KART

SEQ ID NO: 510649 - protein, 6 aa, Mycobacterium
KARTAE

SEQ ID NO: 510650 - protein, 6 aa, Mycobacterium
KARTAL

SEQ ID NO: 510651 - protein, 17 aa, Mycobacterium
KARTELGYEPRSTETTV

SEQ ID NO: 510652 - protein, 10 aa, Mycobacterium
KARTPAENSE

SEQ ID NO: 510653 - protein, 13 aa, Mycobacterium
KARTPCGRGDPRI

SEQ ID NO: 510654 - protein, 12 aa, Mycobacterium
KARTPVPVYGSQ

SEQ ID NO: 510655 - protein, 6 aa, Mycobacterium
KARTVA

SEQ ID NO: 510656 - protein, 5 aa, Mycobacterium
KARVA

SEQ ID NO: 510657 - protein, 7 aa, Mycobacterium
KASAAMT

SEQ ID NO: 510658 - protein, 10 aa, Mycobacterium
KASAATDTEV

SEQ ID NO: 510659 - protein, 9 aa, Mycobacterium
KASADHADE

SEQ ID NO: 510660 - protein, 6 aa, Mycobacterium
KASADV

SEQ ID NO: 510661 - protein, 8 aa, Mycobacterium
KASAGTRL

SEQ ID NO: 510662 - protein, 8 aa, Mycobacterium
KASAPRLP

SEQ ID NO: 510663 - protein, 9 aa, Mycobacterium
KASARGVAT

SEQ ID NO: 510664 - protein, 5 aa, Mycobacterium
KASDE

SEQ ID NO: 510665 - protein, 31 aa, Mycobacterium
KASDEDKPAPKAAKAPANKSRTPANKSAEGD

SEQ ID NO: 510666 - protein, 5 aa, Mycobacterium
KASDT

SEQ ID NO: 510667 - protein, 7 aa, Mycobacterium
KASDTAA

SEQ ID NO: 510668 - protein, 5 aa, Mycobacterium
KASDV

SEQ ID NO: 510669 - protein, 9 aa, Mycobacterium
KASEAAENV

SEQ ID NO: 510670 - protein, 7 aa, Mycobacterium
KASEAMR

SEQ ID NO: 510671 - protein, 9 aa, Mycobacterium
KASEEQTRP

SEQ ID NO: 510672 - protein, 7 aa, Mycobacterium
KASEPGA

SEQ ID NO: 510673 - protein, 13 aa, Mycobacterium
KASEQRFGPDPQD

SEQ ID NO: 510674 - protein, 8 aa, Mycobacterium
KASEQTWP

SEQ ID NO: 510675 - protein, 5 aa, Mycobacterium
KASER

SEQ ID NO: 510676 - protein, 7 aa, Mycobacterium
KASERAD

SEQ ID NO: 510677 - protein, 19 aa, Mycobacterium
KASETAENVYEGRDRASGA

SEQ ID NO: 510678 - protein, 8 aa, Mycobacterium
KASGAADG

SEQ ID NO: 510679 - protein, 8 aa, Mycobacterium
KASGAPVG

SEQ ID NO: 510680 - protein, 9 aa, Mycobacterium
KASGERQAA

SEQ ID NO: 510681 - protein, 11 aa, Mycobacterium
KASGGIRTAEQ

SEQ ID NO: 510682 - protein, 10 aa, Mycobacterium
KASGGIRTAT

SEQ ID NO: 510683 - protein, 7 aa, Mycobacterium
KASGIAS

SEQ ID NO: 510684 - protein, 6 aa, Mycobacterium
KASGKK

SEQ ID NO: 510685 - protein, 9 aa, Mycobacterium
KASGPDNHE

SEQ ID NO: 510686 - protein, 11 aa, Mycobacterium
KASGQREGGTA

SEQ ID NO: 510687 - protein, 8 aa, Mycobacterium
KASGRDLS

SEQ ID NO: 510688 - protein, 9 aa, Mycobacterium
KASGRDLST

SEQ ID NO: 510689 - protein, 7 aa, Mycobacterium
KASGSAV

SEQ ID NO: 510690 - protein, 5 aa, Mycobacterium
KASGT

SEQ ID NO: 510691 - protein, 15 aa, Mycobacterium
KASGYGRELGPEGLD

SEQ ID NO: 510692 - protein, 6 aa, Mycobacterium
KASHGT

SEQ ID NO: 510693 - protein, 6 aa, Mycobacterium
KASIST

SEQ ID NO: 510694 - protein, 7 aa, Mycobacterium
KASKVAR

SEQ ID NO: 510695 - protein, 7 aa, Mycobacterium
KASKYGM

SEQ ID NO: 510696 - protein, 12 aa, Mycobacterium
KASKYLSAGDRD

SEQ ID NO: 510697 - protein, 9 aa, Mycobacterium
KASPGGERE

SEQ ID NO: 510698 - protein, 16 aa, Mycobacterium
KASPIRGAGDTEGRRQ

SEQ ID NO: 510699 - protein, 11 aa, Mycobacterium
KASPPRSGDEL

SEQ ID NO: 510700 - protein, 10 aa, Mycobacterium
KASPQFSDRR

SEQ ID NO: 510701 - protein, 8 aa, Mycobacterium
KASPSNML

SEQ ID NO: 510702 - protein, 7 aa, Mycobacterium
KASREDP

SEQ ID NO: 510703 - protein, 12 aa, Mycobacterium
KASREGKQKSGV

SEQ ID NO: 510704 - protein, 7 aa, Mycobacterium
KASREIT

SEQ ID NO: 510705 - protein, 13 aa, Mycobacterium
KASRGSPPKRRTV

SEQ ID NO: 510706 - protein, 15 aa, Mycobacterium
KASRSVSAVEIDIES

SEQ ID NO: 510707 - protein, 11 aa, Mycobacterium
KASSKQRLTDS

SEQ ID NO: 510708 - protein, 12 aa, Mycobacterium
KASSKQRLTDSV

SEQ ID NO: 510709 - protein, 10 aa, Mycobacterium
KASSNRRVEV

SEQ ID NO: 510710 - protein, 8 aa, Mycobacterium
KASSPVEP

SEQ ID NO: 510711 - protein, 10 aa, Mycobacterium
KASSSSTSRI

SEQ ID NO: 510712 - protein, 5 aa, Mycobacterium
KASSV

SEQ ID NO: 510713 - protein, 17 aa, Mycobacterium
KASTALPGLLQRLPALL

SEQ ID NO: 510714 - protein, 10 aa, Mycobacterium
KASTASGGAS

SEQ ID NO: 510715 - protein, 7 aa, Mycobacterium
KASTATV

SEQ ID NO: 510716 - protein, 8 aa, Mycobacterium
KASTDPQA

SEQ ID NO: 510717 - protein, 8 aa, Mycobacterium
KASTDTVT

SEQ ID NO: 510718 - protein, 8 aa, Mycobacterium
KASTETWP

SEQ ID NO: 510719 - protein, 7 aa, Mycobacterium
KASTPAV

SEQ ID NO: 510720 - protein, 11 aa, Mycobacterium
KASTQTEPELR

SEQ ID NO: 510721 - protein, 4 aa, Mycobacterium
KASV

SEQ ID NO: 510722 - protein, 6 aa, Mycobacterium
KASVEE

SEQ ID NO: 510723 - protein, 14 aa, Mycobacterium
KASVGNAAGLAAGA

SEQ ID NO: 510724 - protein, 7 aa, Mycobacterium
KASVNRD

SEQ ID NO: 510725 - protein, 5 aa, Mycobacterium
KASVS

SEQ ID NO: 510726 - protein, 12 aa, Mycobacterium
KASWAPAEGEPL

SEQ ID NO: 510727 - protein, 7 aa, Mycobacterium
KASYTTL

SEQ ID NO: 510728 - protein, 7 aa, Mycobacterium
KATAAAR

SEQ ID NO: 510729 - protein, 6 aa, Mycobacterium
KATAAE

SEQ ID NO: 510730 - protein, 7 aa, Mycobacterium
KATAAGA

SEQ ID NO: 510731 - protein, 6 aa, Mycobacterium
KATAAL

SEQ ID NO: 510732 - protein, 8 aa, Mycobacterium
KATADDIR

SEQ ID NO: 510733 - protein, 12 aa, Mycobacterium
KATADKSPGSAG

SEQ ID NO: 510734 - protein, 6 aa, Mycobacterium
KATAEA

SEQ ID NO: 510735 - protein, 8 aa, Mycobacterium
KATAGNSL

SEQ ID NO: 510736 - protein, 23 aa, Mycobacterium
KATAPKPAPPLPSLPGRKSKPTI

SEQ ID NO: 510737 - protein, 13 aa, Mycobacterium
KATAQDGTTSEYE

SEQ ID NO: 510738 - protein, 9 aa, Mycobacterium
KATAQGGRF

SEQ ID NO: 510739 - protein, 29 aa, Mycobacterium
KATAQRPVAAARSGPQPRRPVSDRVSDQR

SEQ ID NO: 510740 - protein, 9 aa, Mycobacterium
KATASRITQ

SEQ ID NO: 510741 - protein, 9 aa, Mycobacterium
KATATSEAV

SEQ ID NO: 510742 - protein, 4 aa, Mycobacterium
KATC

SEQ ID NO: 510743 - protein, 7 aa, Mycobacterium
KATDDLA

SEQ ID NO: 510744 - protein, 8 aa, Mycobacterium
KATDDNDF

SEQ ID NO: 510745 - protein, 9 aa, Mycobacterium
KATDEQKEV

SEQ ID NO: 510746 - protein, 12 aa, Mycobacterium
KATDEVEGSPGF

SEQ ID NO: 510747 - protein, 7 aa, Mycobacterium
KATDPAT

SEQ ID NO: 510748 - protein, 12 aa, Mycobacterium
KATEEGARAACA

SEQ ID NO: 510749 - protein, 12 aa, Mycobacterium
KATEITEKAAGA

SEQ ID NO: 510750 - protein, 13 aa, Mycobacterium
KATERADGHTLNG

SEQ ID NO: 510751 - protein, 5 aa, Mycobacterium
KATET

SEQ ID NO: 510752 - protein, 8 aa, Mycobacterium
KATGADAI

SEQ ID NO: 510753 - protein, 8 aa, Mycobacterium
KATGAGRE

SEQ ID NO: 510754 - protein, 6 aa, Mycobacterium
KATGAK

SEQ ID NO: 510755 - protein, 13 aa, Mycobacterium
KATGARGSNAKKV

SEQ ID NO: 510756 - protein, 8 aa, Mycobacterium
KATGGRLG

SEQ ID NO: 510757 - protein, 13 aa, Mycobacterium
KATGGYPTGADGA

SEQ ID NO: 510758 - protein, 6 aa, Mycobacterium
KATGKL

SEQ ID NO: 510759 - protein, 8 aa, Mycobacterium
KATGLEDN

SEQ ID NO: 510760 - protein, 11 aa, Mycobacterium
KATGNPLASGS

SEQ ID NO: 510761 - protein, 13 aa, Mycobacterium
KATGPRGGNKKVK

SEQ ID NO: 510762 - protein, 6 aa, Mycobacterium
KATGQC

SEQ ID NO: 510763 - protein, 8 aa, Mycobacterium
KATGREPY

SEQ ID NO: 510764 - protein, 7 aa, Mycobacterium
KATGTTP

SEQ ID NO: 510765 - protein, 7 aa, Mycobacterium
KATGVDE

SEQ ID NO: 510766 - protein, 9 aa, Mycobacterium
KATGVDPDA

SEQ ID NO: 510767 - protein, 6 aa, Mycobacterium
KATGVR

SEQ ID NO: 510768 - protein, 6 aa, Mycobacterium
KATGVT

SEQ ID NO: 510769 - protein, 9 aa, Mycobacterium
KATHGDAKG

SEQ ID NO: 510770 - protein, 8 aa, Mycobacterium
KATHPDTA

SEQ ID NO: 510771 - protein, 8 aa, Mycobacterium
KATHPPTA

SEQ ID NO: 510772 - protein, 8 aa, Mycobacterium
KATKDGGG

SEQ ID NO: 510773 - protein, 6 aa, Mycobacterium
KATKDL

SEQ ID NO: 510774 - protein, 7 aa, Mycobacterium
KATKEQL

SEQ ID NO: 510775 - protein, 10 aa, Mycobacterium
KATKWGPAEV

SEQ ID NO: 510776 - protein, 10 aa, Mycobacterium
KATLSPTSTV

SEQ ID NO: 510777 - protein, 10 aa, Mycobacterium
KATPAAAGEP

SEQ ID NO: 510778 - protein, 22 aa, Mycobacterium
KATPDGFDDGETEDTQDGPGMV

SEQ ID NO: 510779 - protein, 7 aa, Mycobacterium
KATPGKF

SEQ ID NO: 510780 - protein, 6 aa, Mycobacterium
KATPMR

SEQ ID NO: 510781 - protein, 8 aa, Mycobacterium
KATPPATF

SEQ ID NO: 510782 - protein, 11 aa, Mycobacterium
KATPRQVTADS

SEQ ID NO: 510783 - protein, 5 aa, Mycobacterium
KATQR

SEQ ID NO: 510784 - protein, 7 aa, Mycobacterium
KATQVAA

SEQ ID NO: 510785 - protein, 5 aa, Mycobacterium
KATRA

SEQ ID NO: 510786 - protein, 12 aa, Mycobacterium
KATRAAPSDGYV

SEQ ID NO: 510787 - protein, 5 aa, Mycobacterium
KATRD

SEQ ID NO: 510788 - protein, 7 aa, Mycobacterium
KATRDAD

SEQ ID NO: 510789 - protein, 7 aa, Mycobacterium
KATREDI

SEQ ID NO: 510790 - protein, 13 aa, Mycobacterium
KATRGNIDVTVTA

SEQ ID NO: 510791 - protein, 6 aa, Mycobacterium
KATRQT

SEQ ID NO: 510792 - protein, 9 aa, Mycobacterium
KATRQTLTE

SEQ ID NO: 510793 - protein, 8 aa, Mycobacterium
KATRQTMT

SEQ ID NO: 510794 - protein, 6 aa, Mycobacterium
KATRSA

SEQ ID NO: 510795 - protein, 21 aa, Mycobacterium
KATRSHQSYDHNSDNKNTSRH

SEQ ID NO: 510796 - protein, 32 aa, Mycobacterium
KATSGEAADSEESEEPKDSDKPEDSKADGESS

SEQ ID NO: 510797 - protein, 16 aa, Mycobacterium
KATSRDTVRSRSFTGK

SEQ ID NO: 510798 - protein, 8 aa, Mycobacterium
KATTARQV

SEQ ID NO: 510799 - protein, 7 aa, Mycobacterium
KATTDAD

SEQ ID NO: 510800 - protein, 7 aa, Mycobacterium
KATTDPV

SEQ ID NO: 510801 - protein, 7 aa, Mycobacterium
KATTEAE

SEQ ID NO: 510802 - protein, 9 aa, Mycobacterium
KATTGQGSV

SEQ ID NO: 510803 - protein, 6 aa, Mycobacterium
KATTSL

SEQ ID NO: 510804 - protein, 7 aa, Mycobacterium
KATTVTE

SEQ ID NO: 510805 - protein, 8 aa, Mycobacterium
KATYQSSL

SEQ ID NO: 510806 - protein, 8 aa, Mycobacterium
KATYREDG

SEQ ID NO: 510807 - protein, 5 aa, Mycobacterium
KAVAD

SEQ ID NO: 510808 - protein, 5 aa, Mycobacterium
KAVDA

SEQ ID NO: 510809 - protein, 18 aa, Mycobacterium
KAVDAQKEPLGGLIELLV

SEQ ID NO: 510810 - protein, 6 aa, Mycobacterium
KAVDGR

SEQ ID NO: 510811 - protein, 18 aa, Mycobacterium
KAVEDQRDADLEARAQKL

SEQ ID NO: 510812 - protein, 13 aa, Mycobacterium
KAVEKDGAKQLDK

SEQ ID NO: 510813 - protein, 8 aa, Mycobacterium
KAVGAEDF

SEQ ID NO: 510814 - protein, 5 aa, Mycobacterium
KAVGD

SEQ ID NO: 510815 - protein, 6 aa, Mycobacterium
KAVGDG

SEQ ID NO: 510816 - protein, 240 aa, Mycobacterium
KAVGNGAPAPVPAPAPAPTPAPAPAPAQPADSGVAPPAATPAAPAASAAPAPPKAPLPGQRPAPTPGKPAAPQAPHPGMAPGARPGPVPKPGVRTPRVGNNPFSSAQPVDRPIPRPQAPRPGAPRPGAPRPGGASPGNMPPRPGGASGGPRPPRTGAPRPGGGRPGGPGGGRSDGGGGNYRGGGGGVGAAPGGGFRGRPGGGGGGGRPGQRGGAAGAFGRPGGAPRRGRKSKRAKRAEYE

SEQ ID NO: 510817 - protein, 10 aa, Mycobacterium
KAVGTSPYTG

SEQ ID NO: 510818 - protein, 10 aa, Mycobacterium
KAVKETRDAV

SEQ ID NO: 510819 - protein, 7 aa, Mycobacterium
KAVNDND

SEQ ID NO: 510820 - protein, 14 aa, Mycobacterium
KAVNGMASSRSQLG

SEQ ID NO: 510821 - protein, 12 aa, Mycobacterium
KAVNGRSADSSV

SEQ ID NO: 510822 - protein, 5 aa, Mycobacterium
KAVPA

SEQ ID NO: 510823 - protein, 17 aa, Mycobacterium
KAVQRNAGKGSAKTLPK

SEQ ID NO: 510824 - protein, 6 aa, Mycobacterium
KAVQTA

SEQ ID NO: 510825 - protein, 7 aa, Mycobacterium
KAVQVGG

SEQ ID NO: 510826 - protein, 4 aa, Mycobacterium
KAVR

SEQ ID NO: 510827 - protein, 6 aa, Mycobacterium
KAVRAD

SEQ ID NO: 510828 - protein, 9 aa, Mycobacterium
KAVRAQQDG

SEQ ID NO: 510829 - protein, 6 aa, Mycobacterium
KAVRDG

SEQ ID NO: 510830 - protein, 7 aa, Mycobacterium
KAVRDGD

SEQ ID NO: 510831 - protein, 7 aa, Mycobacterium
KAVRDGS

SEQ ID NO: 510832 - protein, 7 aa, Mycobacterium
KAVRDNR

SEQ ID NO: 510833 - protein, 8 aa, Mycobacterium
KAVRDNRM

SEQ ID NO: 510834 - protein, 7 aa, Mycobacterium
KAVRDSG

SEQ ID NO: 510835 - protein, 11 aa, Mycobacterium
KAVREPSVAKG

SEQ ID NO: 510836 - protein, 17 aa, Mycobacterium
KAVSTAVTGRVQNNGQS

SEQ ID NO: 510837 - protein, 7 aa, Mycobacterium
KAVTDRP

SEQ ID NO: 510838 - protein, 6 aa, Mycobacterium
KAVTPT

SEQ ID NO: 510839 - protein, 11 aa, Mycobacterium
KAVTSAVSRNQ

SEQ ID NO: 510840 - protein, 6 aa, Mycobacterium
KAVTTR

SEQ ID NO: 510841 - protein, 4 aa, Mycobacterium
KAWP

SEQ ID NO: 510842 - protein, 5 aa, Mycobacterium
KAYAA

SEQ ID NO: 510843 - protein, 5 aa, Mycobacterium
KAYAD

SEQ ID NO: 510844 - protein, 7 aa, Mycobacterium
KAYADAG

SEQ ID NO: 510845 - protein, 5 aa, Mycobacterium
KAYDA

SEQ ID NO: 510846 - protein, 7 aa, Mycobacterium
KAYDADA

SEQ ID NO: 510847 - protein, 7 aa, Mycobacterium
KAYDTGD

SEQ ID NO: 510848 - protein, 8 aa, Mycobacterium
KAYEDGGA

SEQ ID NO: 510849 - protein, 46 aa, Mycobacterium
KAYEDVDEQAAAALRNGGKGSVSPAALAANPAADPPTQADTETVSS

SEQ ID NO: 510850 - protein, 6 aa, Mycobacterium
KAYEGV

SEQ ID NO: 510851 - protein, 4 aa, Mycobacterium
KAYG

SEQ ID NO: 510852 - protein, 5 aa, Mycobacterium
KAYGA

SEQ ID NO: 510853 - protein, 11 aa, Mycobacterium
KAYGESQTLAD

SEQ ID NO: 510854 - protein, 12 aa, Mycobacterium
KAYGGEGLPDDT

SEQ ID NO: 510855 - protein, 9 aa, Mycobacterium
KAYGGQDLP

SEQ ID NO: 510856 - protein, 12 aa, Mycobacterium
KAYGGQGLPDGS

SEQ ID NO: 510857 - protein, 6 aa, Mycobacterium
KAYGPT

SEQ ID NO: 510858 - protein, 6 aa, Mycobacterium
KAYPDT

SEQ ID NO: 510859 - protein, 9 aa, Mycobacterium
KAYPPGSFP

SEQ ID NO: 510860 - protein, 14 aa, Mycobacterium
KAYQDKAAAREAEL

SEQ ID NO: 510861 - protein, 5 aa, Mycobacterium
KAYSA

SEQ ID NO: 510862 - protein, 6 aa, Mycobacterium
KAYSGM

SEQ ID NO: 510863 - protein, 12 aa, Mycobacterium
KAYSQQLQRSGK

SEQ ID NO: 510864 - protein, 17 aa, Mycobacterium
KCADTAPAFAGDPQYPY

SEQ ID NO: 510865 - protein, 7 aa, Mycobacterium
KCDPSTL

SEQ ID NO: 510866 - protein, 17 aa, Mycobacterium
KCEPNSVAPTGGAPGDF

SEQ ID NO: 510867 - protein, 10 aa, Mycobacterium
KCESPASHDV

SEQ ID NO: 510868 - protein, 4 aa, Mycobacterium
KCGA

SEQ ID NO: 510869 - protein, 5 aa, Mycobacterium
KCGAQ

SEQ ID NO: 510870 - protein, 9 aa, Mycobacterium
KCNADPRTV

SEQ ID NO: 510871 - protein, 4 aa, Mycobacterium
KCPL

SEQ ID NO: 510872 - protein, 17 aa, Mycobacterium
KCRPGTEAAEPAEVTAV

SEQ ID NO: 510873 - protein, 6 aa, Mycobacterium
KCSDTQ

SEQ ID NO: 510874 - protein, 7 aa, Mycobacterium
KCSGGEM

SEQ ID NO: 510875 - protein, 12 aa, Mycobacterium
KCSPPKISDEDA

SEQ ID NO: 510876 - protein, 7 aa, Mycobacterium
KCTEDDV

SEQ ID NO: 510877 - protein, 6 aa, Mycobacterium
KCTYGT

SEQ ID NO: 510878 - protein, 7 aa, Mycobacterium
KDAAAAR

SEQ ID NO: 510879 - protein, 8 aa, Mycobacterium
KDAAGRSL

SEQ ID NO: 510880 - protein, 5 aa, Mycobacterium
KDAAR

SEQ ID NO: 510881 - protein, 9 aa, Mycobacterium
KDADDAQRE

SEQ ID NO: 510882 - protein, 10 aa, Mycobacterium
KDADENASVP

SEQ ID NO: 510883 - protein, 5 aa, Mycobacterium
KDADG

SEQ ID NO: 510884 - protein, 11 aa, Mycobacterium
KDADPSDKAAH

SEQ ID NO: 510885 - protein, 9 aa, Mycobacterium
KDAEARAGA

SEQ ID NO: 510886 - protein, 12 aa, Mycobacterium
KDAEARAGATEL

SEQ ID NO: 510887 - protein, 9 aa, Mycobacterium
KDAEARTGA

SEQ ID NO: 510888 - protein, 13 aa, Mycobacterium
KDAEARTGATGLA

SEQ ID NO: 510889 - protein, 24 aa, Mycobacterium
KDAEGDQGSADPAGPDGSVASNAH

SEQ ID NO: 510890 - protein, 12 aa, Mycobacterium
KDAEKARTILAR

SEQ ID NO: 510891 - protein, 6 aa, Mycobacterium
KDAEQL

SEQ ID NO: 510892 - protein, 6 aa, Mycobacterium
KDAESV

SEQ ID NO: 510893 - protein, 7 aa, Mycobacterium
KDAETRI

SEQ ID NO: 510894 - protein, 10 aa, Mycobacterium
KDAEVTTKAV

SEQ ID NO: 510895 - protein, 4 aa, Mycobacterium
KDAF

SEQ ID NO: 510896 - protein, 10 aa, Mycobacterium
KDAGADEVAD

SEQ ID NO: 510897 - protein, 10 aa, Mycobacterium
KDAGARAGAA

SEQ ID NO: 510898 - protein, 7 aa, Mycobacterium
KDAGEIA

SEQ ID NO: 510899 - protein, 9 aa, Mycobacterium
KDAGIDPRS

SEQ ID NO: 510900 - protein, 9 aa, Mycobacterium
KDAGINPRD

SEQ ID NO: 510901 - protein, 5 aa, Mycobacterium
KDAGL

SEQ ID NO: 510902 - protein, 6 aa, Mycobacterium
KDAGLA

SEQ ID NO: 510903 - protein, 6 aa, Mycobacterium
KDAGLG

SEQ ID NO: 510904 - protein, 7 aa, Mycobacterium
KDAGLKS

SEQ ID NO: 510905 - protein, 6 aa, Mycobacterium
KDAGLQ

SEQ ID NO: 510906 - protein, 12 aa, Mycobacterium
KDAGVRAAAATP

SEQ ID NO: 510907 - protein, 5 aa, Mycobacterium
KDAIA

SEQ ID NO: 510908 - protein, 8 aa, Mycobacterium
KDAIEGAT

SEQ ID NO: 510909 - protein, 10 aa, Mycobacterium
KDAKAGADGA

SEQ ID NO: 510910 - protein, 22 aa, Mycobacterium
KDAKAGRRSQTAPAAIDDRREG

SEQ ID NO: 510911 - protein, 8 aa, Mycobacterium
KDAKEQLR

SEQ ID NO: 510912 - protein, 9 aa, Mycobacterium
KDAKEQLRA

SEQ ID NO: 510913 - protein, 9 aa, Mycobacterium
KDAKETDDA

SEQ ID NO: 510914 - protein, 9 aa, Mycobacterium
KDAKPNNER

SEQ ID NO: 510915 - protein, 8 aa, Mycobacterium
KDAKPQSN

SEQ ID NO: 510916 - protein, 7 aa, Mycobacterium
KDALQES

SEQ ID NO: 510917 - protein, 8 aa, Mycobacterium
KDAMEGAT

SEQ ID NO: 510918 - protein, 8 aa, Mycobacterium
KDANLTKA

SEQ ID NO: 510919 - protein, 7 aa, Mycobacterium
KDANSSM

SEQ ID NO: 510920 - protein, 6 aa, Mycobacterium
KDANST

SEQ ID NO: 510921 - protein, 4 aa, Mycobacterium
KDAP

SEQ ID NO: 510922 - protein, 5 aa, Mycobacterium
KDAPA

SEQ ID NO: 510923 - protein, 8 aa, Mycobacterium
KDAPGIAG

SEQ ID NO: 510924 - protein, 11 aa, Mycobacterium
KDAPHSGGPRV

SEQ ID NO: 510925 - protein, 6 aa, Mycobacterium
KDAPLE

SEQ ID NO: 510926 - protein, 8 aa, Mycobacterium
KDAPPLPA

SEQ ID NO: 510927 - protein, 9 aa, Mycobacterium
KDAPPLPAN

SEQ ID NO: 510928 - protein, 11 aa, Mycobacterium
KDAPQSGGPRV

SEQ ID NO: 510929 - protein, 11 aa, Mycobacterium
KDAPRKPAPAL

SEQ ID NO: 510930 - protein, 26 aa, Mycobacterium
KDAPTGPAPTGGPQPGQPVSPGPSGA

SEQ ID NO: 510931 - protein, 24 aa, Mycobacterium
KDAPTGPAPTGGPTSGQPIRPGPA

SEQ ID NO: 510932 - protein, 4 aa, Mycobacterium
KDAQ

SEQ ID NO: 510933 - protein, 7 aa, Mycobacterium
KDARARG

SEQ ID NO: 510934 - protein, 6 aa, Mycobacterium
KDARRS

SEQ ID NO: 510935 - protein, 10 aa, Mycobacterium
KDARSGSSVA

SEQ ID NO: 510936 - protein, 8 aa, Mycobacterium
KDARSQRV

SEQ ID NO: 510937 - protein, 6 aa, Mycobacterium
KDARTL

SEQ ID NO: 510938 - protein, 8 aa, Mycobacterium
KDASGYRL

SEQ ID NO: 510939 - protein, 8 aa, Mycobacterium
KDATARGK

SEQ ID NO: 510940 - protein, 8 aa, Mycobacterium
KDATGSTV

SEQ ID NO: 510941 - protein, 9 aa, Mycobacterium
KDATSPDKL

SEQ ID NO: 510942 - protein, 9 aa, Mycobacterium
KDATSPEKL

SEQ ID NO: 510943 - protein, 10 aa, Mycobacterium
KDATTPEQRG

SEQ ID NO: 510944 - protein, 5 aa, Mycobacterium
KDATV

SEQ ID NO: 510945 - protein, 12 aa, Mycobacterium
KDAYEDRPATYR

SEQ ID NO: 510946 - protein, 12 aa, Mycobacterium
KDDAARAGAEEL

SEQ ID NO: 510947 - protein, 6 aa, Mycobacterium
KDDAGR

SEQ ID NO: 510948 - protein, 9 aa, Mycobacterium
KDDASARRR

SEQ ID NO: 510949 - protein, 11 aa, Mycobacterium
KDDAYSDLETA

SEQ ID NO: 510950 - protein, 4 aa, Mycobacterium
KDDD

SEQ ID NO: 510951 - protein, 10 aa, Mycobacterium
KDDDDRGGNM

SEQ ID NO: 510952 - protein, 6 aa, Mycobacterium
KDDDPD

SEQ ID NO: 510953 - protein, 8 aa, Mycobacterium
KDDEGNPV

SEQ ID NO: 510954 - protein, 5 aa, Mycobacterium
KDDEP

SEQ ID NO: 510955 - protein, 7 aa, Mycobacterium
KDDETGG

SEQ ID NO: 510956 - protein, 17 aa, Mycobacterium
KDDGQPQIPVENPATGE

SEQ ID NO: 510957 - protein, 7 aa, Mycobacterium
KDDHPAH

SEQ ID NO: 510958 - protein, 5 aa, Mycobacterium
KDDLA

SEQ ID NO: 510959 - protein, 12 aa, Mycobacterium
KDDPAQVAKQGY

SEQ ID NO: 510960 - protein, 6 aa, Mycobacterium
KDDPEM

SEQ ID NO: 510961 - protein, 8 aa, Mycobacterium
KDDPTGAR

SEQ ID NO: 510962 - protein, 8 aa, Mycobacterium
KDDPTGER

SEQ ID NO: 510963 - protein, 22 aa, Mycobacterium
KDDPVRNRQQRRVSDSAAYYTG

SEQ ID NO: 510964 - protein, 14 aa, Mycobacterium
KDDRARTGATELAG

SEQ ID NO: 510965 - protein, 7 aa, Mycobacterium
KDDRRPV

SEQ ID NO: 510966 - protein, 9 aa, Mycobacterium
KDDRSWQDK

SEQ ID NO: 510967 - protein, 10 aa, Mycobacterium
KDDRSWQQSL

SEQ ID NO: 510968 - protein, 6 aa, Mycobacterium
KDDSDI

SEQ ID NO: 510969 - protein, 9 aa, Mycobacterium
KDDVTPYAK

SEQ ID NO: 510970 - protein, 4 aa, Mycobacterium
KDDW

SEQ ID NO: 510971 - protein, 4 aa, Mycobacterium
KDDY

SEQ ID NO: 510972 - protein, 4 aa, Mycobacterium
KDEA

SEQ ID NO: 510973 - protein, 10 aa, Mycobacterium
KDEAPPTTEQ

SEQ ID NO: 510974 - protein, 7 aa, Mycobacterium
KDEAQTV

SEQ ID NO: 510975 - protein, 10 aa, Mycobacterium
KDEASDRAQR

SEQ ID NO: 510976 - protein, 11 aa, Mycobacterium
KDEDGTPRFSA

SEQ ID NO: 510977 - protein, 9 aa, Mycobacterium
KDEDKTPPW

SEQ ID NO: 510978 - protein, 6 aa, Mycobacterium
KDEDQL

SEQ ID NO: 510979 - protein, 7 aa, Mycobacterium
KDEEPHN

SEQ ID NO: 510980 - protein, 20 aa, Mycobacterium
KDEGAKVITGGERAELGGDL

SEQ ID NO: 510981 - protein, 8 aa, Mycobacterium
KDEGYKMA

SEQ ID NO: 510982 - protein, 7 aa, Mycobacterium
KDEHGEY

SEQ ID NO: 510983 - protein, 17 aa, Mycobacterium
KDEHPAHHDEDAARECG

SEQ ID NO: 510984 - protein, 6 aa, Mycobacterium
KDEKHV

SEQ ID NO: 510985 - protein, 14 aa, Mycobacterium
KDELDGEKQWRTRK

SEQ ID NO: 510986 - protein, 19 aa, Mycobacterium
KDELPSTLRRSNAKAQRTF

SEQ ID NO: 510987 - protein, 5 aa, Mycobacterium
KDELT

SEQ ID NO: 510988 - protein, 4 aa, Mycobacterium
KDEM

SEQ ID NO: 510989 - protein, 6 aa, Mycobacterium
KDEPDI

SEQ ID NO: 510990 - protein, 6 aa, Mycobacterium
KDEPDV

SEQ ID NO: 510991 - protein, 6 aa, Mycobacterium
KDEQFD

SEQ ID NO: 510992 - protein, 5 aa, Mycobacterium
KDERI

SEQ ID NO: 510993 - protein, 8 aa, Mycobacterium
KDERPGRK

SEQ ID NO: 510994 - protein, 11 aa, Mycobacterium
KDESYKVTGTA

SEQ ID NO: 510995 - protein, 10 aa, Mycobacterium
KDETARQTKT

SEQ ID NO: 510996 - protein, 6 aa, Mycobacterium
KDETIS

SEQ ID NO: 510997 - protein, 17 aa, Mycobacterium
KDETTIVEGAGDAEAIQ

SEQ ID NO: 510998 - protein, 17 aa, Mycobacterium
KDETTIVEGAGDTDAIA

SEQ ID NO: 510999 - protein, 6 aa, Mycobacterium
KDEVST

SEQ ID NO: 511000 - protein, 8 aa, Mycobacterium
KDEYPATA

SEQ ID NO: 511001 - protein, 7 aa, Mycobacterium
KDFATEE

SEQ ID NO: 511002 - protein, 4 aa, Mycobacterium
KDFD

SEQ ID NO: 511003 - protein, 6 aa, Mycobacterium
KDFDGF

SEQ ID NO: 511004 - protein, 11 aa, Mycobacterium
KDFDNTDEHQA

SEQ ID NO: 511005 - protein, 6 aa, Mycobacterium
KDFPNN

SEQ ID NO: 511006 - protein, 5 aa, Mycobacterium
KDFSG

SEQ ID NO: 511007 - protein, 5 aa, Mycobacterium
KDFSK

SEQ ID NO: 511008 - protein, 7 aa, Mycobacterium
KDFSRLD

SEQ ID NO: 511009 - protein, 7 aa, Mycobacterium
KDFVPPE

SEQ ID NO: 511010 - protein, 10 aa, Mycobacterium
KDGAAEQKSR

SEQ ID NO: 511011 - protein, 7 aa, Mycobacterium
KDGAAIE

SEQ ID NO: 511012 - protein, 6 aa, Mycobacterium
KDGADA

SEQ ID NO: 511013 - protein, 6 aa, Mycobacterium
KDGAEL

SEQ ID NO: 511014 - protein, 9 aa, Mycobacterium
KDGAIAGPR

SEQ ID NO: 511015 - protein, 8 aa, Mycobacterium
KDGALGQI

SEQ ID NO: 511016 - protein, 5 aa, Mycobacterium
KDGAP

SEQ ID NO: 511017 - protein, 5 aa, Mycobacterium
KDGAV

SEQ ID NO: 511018 - protein, 6 aa, Mycobacterium
KDGCGD

SEQ ID NO: 511019 - protein, 6 aa, Mycobacterium
KDGDDA

SEQ ID NO: 511020 - protein, 6 aa, Mycobacterium
KDGDKR

SEQ ID NO: 511021 - protein, 13 aa, Mycobacterium
KDGDPGFQNGTEL

SEQ ID NO: 511022 - protein, 12 aa, Mycobacterium
KDGDRGFQTNTE

SEQ ID NO: 511023 - protein, 23 aa, Mycobacterium
KDGEAGEDEVARAEKDLDKSTHQ

SEQ ID NO: 511024 - protein, 21 aa, Mycobacterium
KDGEAGEDEVGRAEKDLDKTT

SEQ ID NO: 511025 - protein, 26 aa, Mycobacterium
KDGEAGEDEVGRAEKDLDKTTHQYTT

SEQ ID NO: 511026 - protein, 25 aa, Mycobacterium
KDGEAGEDEVGRAEKELDKATHQYT

SEQ ID NO: 511027 - protein, 9 aa, Mycobacterium
KDGEEFDGK

SEQ ID NO: 511028 - protein, 7 aa, Mycobacterium
KDGEPRV

SEQ ID NO: 511029 - protein, 7 aa, Mycobacterium
KDGEQDL

SEQ ID NO: 511030 - protein, 9 aa, Mycobacterium
KDGEYDETD

SEQ ID NO: 511031 - protein, 6 aa, Mycobacterium
KDGGAL

SEQ ID NO: 511032 - protein, 5 aa, Mycobacterium
KDGGG

SEQ ID NO: 511033 - protein, 7 aa, Mycobacterium
KDGGGRA

SEQ ID NO: 511034 - protein, 14 aa, Mycobacterium
KDGGGVLIELVEPA

SEQ ID NO: 511035 - protein, 7 aa, Mycobacterium
KDGGKVE

SEQ ID NO: 511036 - protein, 14 aa, Mycobacterium
KDGGVLRRPGHTEA

SEQ ID NO: 511037 - protein, 7 aa, Mycobacterium
KDGHAPE

SEQ ID NO: 511038 - protein, 6 aa, Mycobacterium
KDGKAV

SEQ ID NO: 511039 - protein, 6 aa, Mycobacterium
KDGKLG

SEQ ID NO: 511040 - protein, 10 aa, Mycobacterium
KDGKPKPTPI

SEQ ID NO: 511041 - protein, 7 aa, Mycobacterium
KDGKPVD

SEQ ID NO: 511042 - protein, 7 aa, Mycobacterium
KDGKQRA

SEQ ID NO: 511043 - protein, 6 aa, Mycobacterium
KDGLRK

SEQ ID NO: 511044 - protein, 7 aa, Mycobacterium
KDGLTED

SEQ ID NO: 511045 - protein, 5 aa, Mycobacterium
KDGNA

SEQ ID NO: 511046 - protein, 9 aa, Mycobacterium
KDGNADTAS

SEQ ID NO: 511047 - protein, 13 aa, Mycobacterium
KDGNPGFQTGTEL

SEQ ID NO: 511048 - protein, 9 aa, Mycobacterium
KDGNSEELK

SEQ ID NO: 511049 - protein, 8 aa, Mycobacterium
KDGPEREA

SEQ ID NO: 511050 - protein, 5 aa, Mycobacterium
KDGPW

SEQ ID NO: 511051 - protein, 4 aa, Mycobacterium
KDGQ

SEQ ID NO: 511052 - protein, 6 aa, Mycobacterium
KDGQGE

SEQ ID NO: 511053 - protein, 6 aa, Mycobacterium
KDGQNK

SEQ ID NO: 511054 - protein, 5 aa, Mycobacterium
KDGQT

SEQ ID NO: 511055 - protein, 5 aa, Mycobacterium
KDGRA

SEQ ID NO: 511056 - protein, 9 aa, Mycobacterium
KDGRGESRI

SEQ ID NO: 511057 - protein, 6 aa, Mycobacterium
KDGRHS

SEQ ID NO: 511058 - protein, 10 aa, Mycobacterium
KDGRPKPTPI

SEQ ID NO: 511059 - protein, 18 aa, Mycobacterium
KDGRPKPTPVWGAPDGDG

SEQ ID NO: 511060 - protein, 8 aa, Mycobacterium
KDGRPKPV

SEQ ID NO: 511061 - protein, 16 aa, Mycobacterium
KDGSDADDAGRRGARR

SEQ ID NO: 511062 - protein, 9 aa, Mycobacterium
KDGSDEPDG

SEQ ID NO: 511063 - protein, 8 aa, Mycobacterium
KDGSSGAL

SEQ ID NO: 511064 - protein, 6 aa, Mycobacterium
KDGSVK

SEQ ID NO: 511065 - protein, 8 aa, Mycobacterium
KDGTETTI

SEQ ID NO: 511066 - protein, 8 aa, Mycobacterium
KDGTGDFD

SEQ ID NO: 511067 - protein, 16 aa, Mycobacterium
KDGTITAGSASQISDG

SEQ ID NO: 511068 - protein, 5 aa, Mycobacterium
KDGTL

SEQ ID NO: 511069 - protein, 11 aa, Mycobacterium
KDGTNAVGNRT

SEQ ID NO: 511070 - protein, 6 aa, Mycobacterium
KDGTVK

SEQ ID NO: 511071 - protein, 17 aa, Mycobacterium
KDGTVTAGSSSQISDGA

SEQ ID NO: 511072 - protein, 4 aa, Mycobacterium
KDGV

SEQ ID NO: 511073 - protein, 6 aa, Mycobacterium
KDGYSI

SEQ ID NO: 511074 - protein, 7 aa, Mycobacterium
KDHADEL

SEQ ID NO: 511075 - protein, 17 aa, Mycobacterium
KDHAESTVSTANAEADS

SEQ ID NO: 511076 - protein, 12 aa, Mycobacterium
KDHDEKRLTSCG

SEQ ID NO: 511077 - protein, 5 aa, Mycobacterium
KDHGD

SEQ ID NO: 511078 - protein, 6 aa, Mycobacterium
KDHGEA

SEQ ID NO: 511079 - protein, 8 aa, Mycobacterium
KDHGVSTA

SEQ ID NO: 511080 - protein, 11 aa, Mycobacterium
KDHGVYQDTAR

SEQ ID NO: 511081 - protein, 7 aa, Mycobacterium
KDHPEAE

SEQ ID NO: 511082 - protein, 6 aa, Mycobacterium
KDHPEV

SEQ ID NO: 511083 - protein, 6 aa, Mycobacterium
KDHPGR

SEQ ID NO: 511084 - protein, 7 aa, Mycobacterium
KDHPKKV

SEQ ID NO: 511085 - protein, 7 aa, Mycobacterium
KDHPRRG

SEQ ID NO: 511086 - protein, 8 aa, Mycobacterium
KDHPRRGF

SEQ ID NO: 511087 - protein, 14 aa, Mycobacterium
KDHREGEKGRGRGL

SEQ ID NO: 511088 - protein, 8 aa, Mycobacterium
KDIDSADD

SEQ ID NO: 511089 - protein, 8 aa, Mycobacterium
KDIESADD

SEQ ID NO: 511090 - protein, 4 aa, Mycobacterium
KDIG

SEQ ID NO: 511091 - protein, 8 aa, Mycobacterium
KDIGNADD

SEQ ID NO: 511092 - protein, 14 aa, Mycobacterium
KDIPDTPRPPLAQG

SEQ ID NO: 511093 - protein, 4 aa, Mycobacterium
KDIT

SEQ ID NO: 511094 - protein, 7 aa, Mycobacterium
KDKAGKL

SEQ ID NO: 511095 - protein, 8 aa, Mycobacterium
KDKARENA

SEQ ID NO: 511096 - protein, 6 aa, Mycobacterium
KDKDMT

SEQ ID NO: 511097 - protein, 5 aa, Mycobacterium
KDKER

SEQ ID NO: 511098 - protein, 9 aa, Mycobacterium
KDKFAPPRY

SEQ ID NO: 511099 - protein, 8 aa, Mycobacterium
KDKFAQPR

SEQ ID NO: 511100 - protein, 9 aa, Mycobacterium
KDKFASPRY

SEQ ID NO: 511101 - protein, 5 aa, Mycobacterium
KDKGG

SEQ ID NO: 511102 - protein, 11 aa, Mycobacterium
KDKGTGKENTI

SEQ ID NO: 511103 - protein, 12 aa, Mycobacterium
KDKGTGKENTIR

SEQ ID NO: 511104 - protein, 4 aa, Mycobacterium
KDKI

SEQ ID NO: 511105 - protein, 9 aa, Mycobacterium
KDKKDEAVA

SEQ ID NO: 511106 - protein, 4 aa, Mycobacterium
KDKN

SEQ ID NO: 511107 - protein, 10 aa, Mycobacterium
KDKPLSDDVD

SEQ ID NO: 511108 - protein, 7 aa, Mycobacterium
KDKPMED

SEQ ID NO: 511109 - protein, 5 aa, Mycobacterium
KDKPV

SEQ ID NO: 511110 - protein, 8 aa, Mycobacterium
KDKQTARV

SEQ ID NO: 511111 - protein, 8 aa, Mycobacterium
KDKRDAYP

SEQ ID NO: 511112 - protein, 11 aa, Mycobacterium
KDKRGSVGKSA

SEQ ID NO: 511113 - protein, 13 aa, Mycobacterium
KDKSQKQGADATT

SEQ ID NO: 511114 - protein, 13 aa, Mycobacterium
KDKSQKQGAEATT

SEQ ID NO: 511115 - protein, 13 aa, Mycobacterium
KDKSSRQGAESTT

SEQ ID NO: 511116 - protein, 6 aa, Mycobacterium
KDKTPI

SEQ ID NO: 511117 - protein, 5 aa, Mycobacterium
KDLAD

SEQ ID NO: 511118 - protein, 6 aa, Mycobacterium
KDLASG

SEQ ID NO: 511119 - protein, 10 aa, Mycobacterium
KDLASGDSVY

SEQ ID NO: 511120 - protein, 4 aa, Mycobacterium
KDLD

SEQ ID NO: 511121 - protein, 10 aa, Mycobacterium
KDLEADDRVA

SEQ ID NO: 511122 - protein, 7 aa, Mycobacterium
KDLGAEA

SEQ ID NO: 511123 - protein, 6 aa, Mycobacterium
KDLGDS

SEQ ID NO: 511124 - protein, 41 aa, Mycobacterium
KDLGGRPEGTGHHHGQTRQRGLPVQGARPGGRQDPGQASPG

SEQ ID NO: 511125 - protein, 8 aa, Mycobacterium
KDLGPTGP

SEQ ID NO: 511126 - protein, 8 aa, Mycobacterium
KDLGSLAP

SEQ ID NO: 511127 - protein, 4 aa, Mycobacterium
KDLP

SEQ ID NO: 511128 - protein, 15 aa, Mycobacterium
KDLPAVEPPASDEDS

SEQ ID NO: 511129 - protein, 11 aa, Mycobacterium
KDLPDRSGSGL

SEQ ID NO: 511130 - protein, 7 aa, Mycobacterium
KDLPGFE

SEQ ID NO: 511131 - protein, 6 aa, Mycobacterium
KDLPGQ

SEQ ID NO: 511132 - protein, 16 aa, Mycobacterium
KDLPPGEEGELVSSGP

SEQ ID NO: 511133 - protein, 5 aa, Mycobacterium
KDLPS

SEQ ID NO: 511134 - protein, 10 aa, Mycobacterium
KDLPTAEDPR

SEQ ID NO: 511135 - protein, 6 aa, Mycobacterium
KDLPTQ

SEQ ID NO: 511136 - protein, 4 aa, Mycobacterium
KDLQ

SEQ ID NO: 511137 - protein, 11 aa, Mycobacterium
KDLRSPAQRRH

SEQ ID NO: 511138 - protein, 12 aa, Mycobacterium
KDLRTRDLTDDQ

SEQ ID NO: 511139 - protein, 11 aa, Mycobacterium
KDLTDGRDIDA

SEQ ID NO: 511140 - protein, 7 aa, Mycobacterium
KDLTEGI

SEQ ID NO: 511141 - protein, 6 aa, Mycobacterium
KDLTGK

SEQ ID NO: 511142 - protein, 6 aa, Mycobacterium
KDLTKG

SEQ ID NO: 511143 - protein, 6 aa, Mycobacterium
KDLTTG

SEQ ID NO: 511144 - protein, 6 aa, Mycobacterium
KDMARG

SEQ ID NO: 511145 - protein, 16 aa, Mycobacterium
KDMEPNDPMEPEVTFV

SEQ ID NO: 511146 - protein, 4 aa, Mycobacterium
KDMG

SEQ ID NO: 511147 - protein, 6 aa, Mycobacterium
KDMNAG

SEQ ID NO: 511148 - protein, 7 aa, Mycobacterium
KDMPAAA

SEQ ID NO: 511149 - protein, 12 aa, Mycobacterium
KDMRESATKSIK

SEQ ID NO: 511150 - protein, 9 aa, Mycobacterium
KDNDGTQRR

SEQ ID NO: 511151 - protein, 7 aa, Mycobacterium
KDNEGNP

SEQ ID NO: 511152 - protein, 16 aa, Mycobacterium
KDNEVEDNSKTAGGDL

SEQ ID NO: 511153 - protein, 14 aa, Mycobacterium
KDNGIDASPGEWDA

SEQ ID NO: 511154 - protein, 5 aa, Mycobacterium
KDNGR

SEQ ID NO: 511155 - protein, 6 aa, Mycobacterium
KDNGRI

SEQ ID NO: 511156 - protein, 7 aa, Mycobacterium
KDNGTPV

SEQ ID NO: 511157 - protein, 8 aa, Mycobacterium
KDNIIPDD

SEQ ID NO: 511158 - protein, 14 aa, Mycobacterium
KDNPAPQSMNPGVS

SEQ ID NO: 511159 - protein, 8 aa, Mycobacterium
KDNPDPVF

SEQ ID NO: 511160 - protein, 7 aa, Mycobacterium
KDNPGYT

SEQ ID NO: 511161 - protein, 8 aa, Mycobacterium
KDNPLAAS

SEQ ID NO: 511162 - protein, 8 aa, Mycobacterium
KDNPSDDI

SEQ ID NO: 511163 - protein, 8 aa, Mycobacterium
KDNPSDDL

SEQ ID NO: 511164 - protein, 13 aa, Mycobacterium
KDNPSNPSPPEAH

SEQ ID NO: 511165 - protein, 6 aa, Mycobacterium
KDNTAV

SEQ ID NO: 511166 - protein, 5 aa, Mycobacterium
KDNVT

SEQ ID NO: 511167 - protein, 6 aa, Mycobacterium
KDNYAK

SEQ ID NO: 511168 - protein, 12 aa, Mycobacterium
KDPADEAKYADW

SEQ ID NO: 511169 - protein, 6 aa, Mycobacterium
KDPADR

SEQ ID NO: 511170 - protein, 7 aa, Mycobacterium
KDPADTS

SEQ ID NO: 511171 - protein, 7 aa, Mycobacterium
KDPAGMA

SEQ ID NO: 511172 - protein, 9 aa, Mycobacterium
KDPAGSGKL

SEQ ID NO: 511173 - protein, 6 aa, Mycobacterium
KDPAIS

SEQ ID NO: 511174 - protein, 7 aa, Mycobacterium
KDPAISA

SEQ ID NO: 511175 - protein, 6 aa, Mycobacterium
KDPATA

SEQ ID NO: 511176 - protein, 8 aa, Mycobacterium
KDPATPKI

SEQ ID NO: 511177 - protein, 9 aa, Mycobacterium
KDPDAAERL

SEQ ID NO: 511178 - protein, 8 aa, Mycobacterium
KDPDELSD

SEQ ID NO: 511179 - protein, 20 aa, Mycobacterium
KDPDGAGYPDTFNSNGSHNM

SEQ ID NO: 511180 - protein, 10 aa, Mycobacterium
KDPDGAGYPE

SEQ ID NO: 511181 - protein, 7 aa, Mycobacterium
KDPDHAK

SEQ ID NO: 511182 - protein, 9 aa, Mycobacterium
KDPDTTGSL

SEQ ID NO: 511183 - protein, 8 aa, Mycobacterium
KDPDYQEQ

SEQ ID NO: 511184 - protein, 4 aa, Mycobacterium
KDPE

SEQ ID NO: 511185 - protein, 10 aa, Mycobacterium
KDPEAEADRM

SEQ ID NO: 511186 - protein, 8 aa, Mycobacterium
KDPEELGD

SEQ ID NO: 511187 - protein, 16 aa, Mycobacterium
KDPEHERTRQFLARVL

SEQ ID NO: 511188 - protein, 6 aa, Mycobacterium
KDPETF

SEQ ID NO: 511189 - protein, 7 aa, Mycobacterium
KDPETKI

SEQ ID NO: 511190 - protein, 5 aa, Mycobacterium
KDPEV

SEQ ID NO: 511191 - protein, 6 aa, Mycobacterium
KDPGFS

SEQ ID NO: 511192 - protein, 7 aa, Mycobacterium
KDPGHDV

SEQ ID NO: 511193 - protein, 9 aa, Mycobacterium
KDPHLTASE

SEQ ID NO: 511194 - protein, 6 aa, Mycobacterium
KDPHSV

SEQ ID NO: 511195 - protein, 10 aa, Mycobacterium
KDPITAKESA

SEQ ID NO: 511196 - protein, 5 aa, Mycobacterium
KDPLA

SEQ ID NO: 511197 - protein, 7 aa, Mycobacterium
KDPLAPC

SEQ ID NO: 511198 - protein, 7 aa, Mycobacterium
KDPMDPR

SEQ ID NO: 511199 - protein, 7 aa, Mycobacterium
KDPMEQE

SEQ ID NO: 511200 - protein, 4 aa, Mycobacterium
KDPN

SEQ ID NO: 511201 - protein, 9 aa, Mycobacterium
KDPNFAPPP

SEQ ID NO: 511202 - protein, 11 aa, Mycobacterium
KDPNPTSGSHR

SEQ ID NO: 511203 - protein, 9 aa, Mycobacterium
KDPNTTGSL

SEQ ID NO: 511204 - protein, 5 aa, Mycobacterium
KDPQA

SEQ ID NO: 511205 - protein, 6 aa, Mycobacterium
KDPQAG

SEQ ID NO: 511206 - protein, 5 aa, Mycobacterium
KDPQD

SEQ ID NO: 511207 - protein, 16 aa, Mycobacterium
KDPQHNHAIVLRDFLA

SEQ ID NO: 511208 - protein, 8 aa, Mycobacterium
KDPQRGAW

SEQ ID NO: 511209 - protein, 9 aa, Mycobacterium
KDPQTAEAL

SEQ ID NO: 511210 - protein, 7 aa, Mycobacterium
KDPQTKI

SEQ ID NO: 511211 - protein, 5 aa, Mycobacterium
KDPQV

SEQ ID NO: 511212 - protein, 6 aa, Mycobacterium
KDPRDA

SEQ ID NO: 511213 - protein, 7 aa, Mycobacterium
KDPRETR

SEQ ID NO: 511214 - protein, 12 aa, Mycobacterium
KDPRSAANARAV

SEQ ID NO: 511215 - protein, 7 aa, Mycobacterium
KDPSRAR

SEQ ID NO: 511216 - protein, 13 aa, Mycobacterium
KDPTAPGRTADDR

SEQ ID NO: 511217 - protein, 16 aa, Mycobacterium
KDPVPDLASRGRGGQG

SEQ ID NO: 511218 - protein, 12 aa, Mycobacterium
KDQAAKQNWPTE

SEQ ID NO: 511219 - protein, 5 aa, Mycobacterium
KDQAE

SEQ ID NO: 511220 - protein, 8 aa, Mycobacterium
KDQAGMGE

SEQ ID NO: 511221 - protein, 9 aa, Mycobacterium
KDQDGNPVL

SEQ ID NO: 511222 - protein, 8 aa, Mycobacterium
KDQDGNTV

SEQ ID NO: 511223 - protein, 6 aa, Mycobacterium
KDQEEE

SEQ ID NO: 511224 - protein, 12 aa, Mycobacterium
KDQGAEAEPQQF

SEQ ID NO: 511225 - protein, 18 aa, Mycobacterium
KDQREAEGGSKVPEDTLS

SEQ ID NO: 511226 - protein, 18 aa, Mycobacterium
KDQREAEGGSKVPEETLS

SEQ ID NO: 511227 - protein, 5 aa, Mycobacterium
KDQRL

SEQ ID NO: 511228 - protein, 13 aa, Mycobacterium
KDQSDHAGAVDEQ

SEQ ID NO: 511229 - protein, 19 aa, Mycobacterium
KDQSTEARAKITADRDAVQ

SEQ ID NO: 511230 - protein, 8 aa, Mycobacterium
KDQTRDGA

SEQ ID NO: 511231 - protein, 6 aa, Mycobacterium
KDQVTS

SEQ ID NO: 511232 - protein, 10 aa, Mycobacterium
KDRDAPPLSY

SEQ ID NO: 511233 - protein, 7 aa, Mycobacterium
KDRDEWP

SEQ ID NO: 511234 - protein, 5 aa, Mycobacterium
KDRDG

SEQ ID NO: 511235 - protein, 9 aa, Mycobacterium
KDRDSVREA

SEQ ID NO: 511236 - protein, 9 aa, Mycobacterium
KDREANAAG

SEQ ID NO: 511237 - protein, 6 aa, Mycobacterium
KDRELR

SEQ ID NO: 511238 - protein, 5 aa, Mycobacterium
KDRER

SEQ ID NO: 511239 - protein, 6 aa, Mycobacterium
KDRERF

SEQ ID NO: 511240 - protein, 4 aa, Mycobacterium
KDRG

SEQ ID NO: 511241 - protein, 8 aa, Mycobacterium
KDRGGNPV

SEQ ID NO: 511242 - protein, 8 aa, Mycobacterium
KDRGKHGG

SEQ ID NO: 511243 - protein, 10 aa, Mycobacterium
KDRGRSVGDA

SEQ ID NO: 511244 - protein, 8 aa, Mycobacterium
KDRIAGTT

SEQ ID NO: 511245 - protein, 10 aa, Mycobacterium
KDRKPKWSPA

SEQ ID NO: 511246 - protein, 9 aa, Mycobacterium
KDRKQFGKS

SEQ ID NO: 511247 - protein, 9 aa, Mycobacterium
KDRNPAHFD

SEQ ID NO: 511248 - protein, 6 aa, Mycobacterium
KDRNPK

SEQ ID NO: 511249 - protein, 9 aa, Mycobacterium
KDRNPKWSP

SEQ ID NO: 511250 - protein, 10 aa, Mycobacterium
KDRNPKWSPA

SEQ ID NO: 511251 - protein, 18 aa, Mycobacterium
KDRNPKWSPATLPEVNPA

SEQ ID NO: 511252 - protein, 7 aa, Mycobacterium
KDRNTLR

SEQ ID NO: 511253 - protein, 9 aa, Mycobacterium
KDRPASFGE

SEQ ID NO: 511254 - protein, 7 aa, Mycobacterium
KDRPELA

SEQ ID NO: 511255 - protein, 6 aa, Mycobacterium
KDRPEP

SEQ ID NO: 511256 - protein, 8 aa, Mycobacterium
KDRPEPTA

SEQ ID NO: 511257 - protein, 7 aa, Mycobacterium
KDRPEPV

SEQ ID NO: 511258 - protein, 8 aa, Mycobacterium
KDRPPMPP

SEQ ID NO: 511259 - protein, 5 aa, Mycobacterium
KDRQV

SEQ ID NO: 511260 - protein, 7 aa, Mycobacterium
KDRRAER

SEQ ID NO: 511261 - protein, 17 aa, Mycobacterium
KDRREGADTVVLLARGV

SEQ ID NO: 511262 - protein, 7 aa, Mycobacterium
KDRRQSL

SEQ ID NO: 511263 - protein, 5 aa, Mycobacterium
KDRRR

SEQ ID NO: 511264 - protein, 8 aa, Mycobacterium
KDRRRAER

SEQ ID NO: 511265 - protein, 5 aa, Mycobacterium
KDRRT

SEQ ID NO: 511266 - protein, 8 aa, Mycobacterium
KDRSGTNE

SEQ ID NO: 511267 - protein, 23 aa, Mycobacterium
KDRSSKKEVKQVKPTHADVGAEV

SEQ ID NO: 511268 - protein, 14 aa, Mycobacterium
KDRTAMASTPDADI

SEQ ID NO: 511269 - protein, 6 aa, Mycobacterium
KDRTGA

SEQ ID NO: 511270 - protein, 5 aa, Mycobacterium
KDRVE

SEQ ID NO: 511271 - protein, 6 aa, Mycobacterium
KDRVEA

SEQ ID NO: 511272 - protein, 14 aa, Mycobacterium
KDRVGAGGVVSDPE

SEQ ID NO: 511273 - protein, 6 aa, Mycobacterium
KDRYGQ

SEQ ID NO: 511274 - protein, 8 aa, Mycobacterium
KDSASGAR

SEQ ID NO: 511275 - protein, 8 aa, Mycobacterium
KDSGAEAL

SEQ ID NO: 511276 - protein, 8 aa, Mycobacterium
KDSGGPAP

SEQ ID NO: 511277 - protein, 5 aa, Mycobacterium
KDSGI

SEQ ID NO: 511278 - protein, 16 aa, Mycobacterium
KDSGLRGRGGAGFATG

SEQ ID NO: 511279 - protein, 16 aa, Mycobacterium
KDSGLRGRGGAGFPTG

SEQ ID NO: 511280 - protein, 17 aa, Mycobacterium
KDSGVDRAERQVGASRS

SEQ ID NO: 511281 - protein, 13 aa, Mycobacterium
KDSIAPRYAADPY

SEQ ID NO: 511282 - protein, 13 aa, Mycobacterium
KDSIAPRYDADPY

SEQ ID NO: 511283 - protein, 6 aa, Mycobacterium
KDSIAR

SEQ ID NO: 511284 - protein, 8 aa, Mycobacterium
KDSIATRY

SEQ ID NO: 511285 - protein, 6 aa, Mycobacterium
KDSLAS

SEQ ID NO: 511286 - protein, 11 aa, Mycobacterium
KDSLATRRIDE

SEQ ID NO: 511287 - protein, 12 aa, Mycobacterium
KDSLGEGRPLGQ

SEQ ID NO: 511288 - protein, 14 aa, Mycobacterium
KDSLRRRGENVSSV

SEQ ID NO: 511289 - protein, 13 aa, Mycobacterium
KDSPASFDPSEVA

SEQ ID NO: 511290 - protein, 13 aa, Mycobacterium
KDSPASFDPSQVA

SEQ ID NO: 511291 - protein, 41 aa, Mycobacterium
KDSPATFDPSEVAGYDAATGTWTSDAGYDLDDNQDYAETEQ

SEQ ID NO: 511292 - protein, 15 aa, Mycobacterium
KDSPGLPKPVQTPHP

SEQ ID NO: 511293 - protein, 13 aa, Mycobacterium
KDSPPSFDPSEVA

SEQ ID NO: 511294 - protein, 13 aa, Mycobacterium
KDSPPSFDPSQVA

SEQ ID NO: 511295 - protein, 14 aa, Mycobacterium
KDSPPTFDPSEVAG

SEQ ID NO: 511296 - protein, 14 aa, Mycobacterium
KDSPTSFDPSEVAG

SEQ ID NO: 511297 - protein, 6 aa, Mycobacterium
KDSRLG

SEQ ID NO: 511298 - protein, 8 aa, Mycobacterium
KDSRSQEE

SEQ ID NO: 511299 - protein, 9 aa, Mycobacterium
KDSSGTTDN

SEQ ID NO: 511300 - protein, 17 aa, Mycobacterium
KDSSPPTMAARASRGLA

SEQ ID NO: 511301 - protein, 9 aa, Mycobacterium
KDSTQVYPT

SEQ ID NO: 511302 - protein, 6 aa, Mycobacterium
KDSTRQ

SEQ ID NO: 511303 - protein, 18 aa, Mycobacterium
KDSTTTDGSVTQPDGSAG

SEQ ID NO: 511304 - protein, 12 aa, Mycobacterium
KDSTTVNPSGGA

SEQ ID NO: 511305 - protein, 4 aa, Mycobacterium
KDSV

SEQ ID NO: 511306 - protein, 10 aa, Mycobacterium
KDSVKPANLT

SEQ ID NO: 511307 - protein, 10 aa, Mycobacterium
KDSVKPANVK

SEQ ID NO: 511308 - protein, 5 aa, Mycobacterium
KDSVS

SEQ ID NO: 511309 - protein, 16 aa, Mycobacterium
KDSYRRTTTGDPRSGR

SEQ ID NO: 511310 - protein, 4 aa, Mycobacterium
KDTA

SEQ ID NO: 511311 - protein, 23 aa, Mycobacterium
KDTAEAPKTADEKAAEATGPSKV

SEQ ID NO: 511312 - protein, 7 aa, Mycobacterium
KDTATFE

SEQ ID NO: 511313 - protein, 13 aa, Mycobacterium
KDTDALAATGAKF

SEQ ID NO: 511314 - protein, 6 aa, Mycobacterium
KDTDGK

SEQ ID NO: 511315 - protein, 10 aa, Mycobacterium
KDTDPRKVGR

SEQ ID NO: 511316 - protein, 6 aa, Mycobacterium
KDTDSF

SEQ ID NO: 511317 - protein, 6 aa, Mycobacterium
KDTESA

SEQ ID NO: 511318 - protein, 4 aa, Mycobacterium
KDTG

SEQ ID NO: 511319 - protein, 8 aa, Mycobacterium
KDTGAREE

SEQ ID NO: 511320 - protein, 5 aa, Mycobacterium
KDTGG

SEQ ID NO: 511321 - protein, 5 aa, Mycobacterium
KDTGM

SEQ ID NO: 511322 - protein, 10 aa, Mycobacterium
KDTGPQDAPD

SEQ ID NO: 511323 - protein, 9 aa, Mycobacterium
KDTGVQDAP

SEQ ID NO: 511324 - protein, 7 aa, Mycobacterium
KDTIAAT

SEQ ID NO: 511325 - protein, 7 aa, Mycobacterium
KDTKGTP

SEQ ID NO: 511326 - protein, 5 aa, Mycobacterium
KDTLN

SEQ ID NO: 511327 - protein, 9 aa, Mycobacterium
KDTPGLSFG

SEQ ID NO: 511328 - protein, 7 aa, Mycobacterium
KDTRRSL

SEQ ID NO: 511329 - protein, 8 aa, Mycobacterium
KDTSIGMG

SEQ ID NO: 511330 - protein, 10 aa, Mycobacterium
KDTSPPNALQ

SEQ ID NO: 511331 - protein, 19 aa, Mycobacterium
KDTTEERPADEVHAKHVGA

SEQ ID NO: 511332 - protein, 7 aa, Mycobacterium
KDTTGSD

SEQ ID NO: 511333 - protein, 9 aa, Mycobacterium
KDTTSGTDE

SEQ ID NO: 511334 - protein, 9 aa, Mycobacterium
KDTTTGDTL

SEQ ID NO: 511335 - protein, 14 aa, Mycobacterium
KDTTTGDTLADPNN

SEQ ID NO: 511336 - protein, 12 aa, Mycobacterium
KDTTTGDTLCDP

SEQ ID NO: 511337 - protein, 13 aa, Mycobacterium
KDTTTGDTLCDPN

SEQ ID NO: 511338 - protein, 15 aa, Mycobacterium
KDTTTGDTLSDPNEQ

SEQ ID NO: 511339 - protein, 15 aa, Mycobacterium
KDTTTGDTLSDPNQQ

SEQ ID NO: 511340 - protein, 10 aa, Mycobacterium
KDVAEDREQM

SEQ ID NO: 511341 - protein, 6 aa, Mycobacterium
KDVEAG

SEQ ID NO: 511342 - protein, 6 aa, Mycobacterium
KDVGRT

SEQ ID NO: 511343 - protein, 8 aa, Mycobacterium
KDVNGAPA

SEQ ID NO: 511344 - protein, 18 aa, Mycobacterium
KDVPATAREGPPGAPGDG

SEQ ID NO: 511345 - protein, 13 aa, Mycobacterium
KDVPDTPRPPLAE

SEQ ID NO: 511346 - protein, 14 aa, Mycobacterium
KDVPDTPRPPLAEG

SEQ ID NO: 511347 - protein, 9 aa, Mycobacterium
KDVPTGEQG

SEQ ID NO: 511348 - protein, 9 aa, Mycobacterium
KDVQPATAD

SEQ ID NO: 511349 - protein, 4 aa, Mycobacterium
KDVS

SEQ ID NO: 511350 - protein, 7 aa, Mycobacterium
KDVTQDY

SEQ ID NO: 511351 - protein, 4 aa, Mycobacterium
KDWD

SEQ ID NO: 511352 - protein, 8 aa, Mycobacterium
KDWKGRTP

SEQ ID NO: 511353 - protein, 9 aa, Mycobacterium
KDWPAGPLP

SEQ ID NO: 511354 - protein, 8 aa, Mycobacterium
KDWPASPF

SEQ ID NO: 511355 - protein, 4 aa, Mycobacterium
KDYD

SEQ ID NO: 511356 - protein, 6 aa, Mycobacterium
KDYDEA

SEQ ID NO: 511357 - protein, 8 aa, Mycobacterium
KDYDPQLG

SEQ ID NO: 511358 - protein, 5 aa, Mycobacterium
KDYEK

SEQ ID NO: 511359 - protein, 7 aa, Mycobacterium
KDYGPRG

SEQ ID NO: 511360 - protein, 18 aa, Mycobacterium
KDYKAASRTTSADAISDT

SEQ ID NO: 511361 - protein, 4 aa, Mycobacterium
KDYP

SEQ ID NO: 511362 - protein, 11 aa, Mycobacterium
KDYPEGAPRAA

SEQ ID NO: 511363 - protein, 6 aa, Mycobacterium
KDYRDR

SEQ ID NO: 511364 - protein, 5 aa, Mycobacterium
KDYRT

SEQ ID NO: 511365 - protein, 20 aa, Mycobacterium
KEAADEAKAKLEAAGATVTV

SEQ ID NO: 511366 - protein, 20 aa, Mycobacterium
KEAADEAKTKLEAAGATVTV

SEQ ID NO: 511367 - protein, 11 aa, Mycobacterium
KEAADGPVDPA

SEQ ID NO: 511368 - protein, 20 aa, Mycobacterium
KEAAEEAKAKLEAAGASVSV

SEQ ID NO: 511369 - protein, 10 aa, Mycobacterium
KEAAKNGEDV

SEQ ID NO: 511370 - protein, 28 aa, Mycobacterium
KEAAPGANMAEQEKAGDTRTQGQRNHDG

SEQ ID NO: 511371 - protein, 6 aa, Mycobacterium
KEAAPL

SEQ ID NO: 511372 - protein, 8 aa, Mycobacterium
KEADAETG

SEQ ID NO: 511373 - protein, 8 aa, Mycobacterium
KEADGGRA

SEQ ID NO: 511374 - protein, 6 aa, Mycobacterium
KEADNP

SEQ ID NO: 511375 - protein, 6 aa, Mycobacterium
KEADTI

SEQ ID NO: 511376 - protein, 11 aa, Mycobacterium
KEAEDALRDYQ

SEQ ID NO: 511377 - protein, 6 aa, Mycobacterium
KEAENA

SEQ ID NO: 511378 - protein, 8 aa, Mycobacterium
KEAETQET

SEQ ID NO: 511379 - protein, 15 aa, Mycobacterium
KEAFGTQKRQRGMDR

SEQ ID NO: 511380 - protein, 4 aa, Mycobacterium
KEAG

SEQ ID NO: 511381 - protein, 5 aa, Mycobacterium
KEAGA

SEQ ID NO: 511382 - protein, 6 aa, Mycobacterium
KEAGAA

SEQ ID NO: 511383 - protein, 7 aa, Mycobacterium
KEAGADF

SEQ ID NO: 511384 - protein, 12 aa, Mycobacterium
KEAGEIEDTRRQ

SEQ ID NO: 511385 - protein, 9 aa, Mycobacterium
KEAGGRAVA

SEQ ID NO: 511386 - protein, 9 aa, Mycobacterium
KEAGLKAGE

SEQ ID NO: 511387 - protein, 7 aa, Mycobacterium
KEAGLQP

SEQ ID NO: 511388 - protein, 4 aa, Mycobacterium
KEAI

SEQ ID NO: 511389 - protein, 12 aa, Mycobacterium
KEAIGRATNNVA

SEQ ID NO: 511390 - protein, 6 aa, Mycobacterium
KEAIRG

SEQ ID NO: 511391 - protein, 25 aa, Mycobacterium
KEALGEDYTKQVARPSASAPSVSAE

SEQ ID NO: 511392 - protein, 6 aa, Mycobacterium
KEANDR

SEQ ID NO: 511393 - protein, 6 aa, Mycobacterium
KEANSF

SEQ ID NO: 511394 - protein, 6 aa, Mycobacterium
KEANTV

SEQ ID NO: 511395 - protein, 6 aa, Mycobacterium
KEAPGY

SEQ ID NO: 511396 - protein, 5 aa, Mycobacterium
KEAPI

SEQ ID NO: 511397 - protein, 10 aa, Mycobacterium
KEAQGPQVTK

SEQ ID NO: 511398 - protein, 12 aa, Mycobacterium
KEAQKTLDKLPP

SEQ ID NO: 511399 - protein, 18 aa, Mycobacterium
KEAQPGPAADIIAGLVEA

SEQ ID NO: 511400 - protein, 10 aa, Mycobacterium
KEARALEDEA

SEQ ID NO: 511401 - protein, 9 aa, Mycobacterium
KEAREAGTP

SEQ ID NO: 511402 - protein, 13 aa, Mycobacterium
KEARNNKERKPVH

SEQ ID NO: 511403 - protein, 6 aa, Mycobacterium
KEARPR

SEQ ID NO: 511404 - protein, 10 aa, Mycobacterium
KEARSNPDGI

SEQ ID NO: 511405 - protein, 13 aa, Mycobacterium
KEARTTKERKPVY

SEQ ID NO: 511406 - protein, 8 aa, Mycobacterium
KEASTNSF

SEQ ID NO: 511407 - protein, 8 aa, Mycobacterium
KEATAIDP

SEQ ID NO: 511408 - protein, 12 aa, Mycobacterium
KEATGGLDDGQL

SEQ ID NO: 511409 - protein, 11 aa, Mycobacterium
KEATGSLDDGQ

SEQ ID NO: 511410 - protein, 5 aa, Mycobacterium
KEATP

SEQ ID NO: 511411 - protein, 20 aa, Mycobacterium
KECDGNRQRGSSRGGSRKRS

SEQ ID NO: 511412 - protein, 7 aa, Mycobacterium
KEDAVAE

SEQ ID NO: 511413 - protein, 8 aa, Mycobacterium
KEDAVAEG

SEQ ID NO: 511414 - protein, 8 aa, Mycobacterium
KEDDTVEV

SEQ ID NO: 511415 - protein, 7 aa, Mycobacterium
KEDEAAE

SEQ ID NO: 511416 - protein, 7 aa, Mycobacterium
KEDEEAL

SEQ ID NO: 511417 - protein, 9 aa, Mycobacterium
KEDEENLDR

SEQ ID NO: 511418 - protein, 8 aa, Mycobacterium
KEDEIGPA

SEQ ID NO: 511419 - protein, 6 aa, Mycobacterium
KEDGKC

SEQ ID NO: 511420 - protein, 4 aa, Mycobacterium
KEDI

SEQ ID NO: 511421 - protein, 6 aa, Mycobacterium
KEDLQR

SEQ ID NO: 511422 - protein, 8 aa, Mycobacterium
KEDPEGRY

SEQ ID NO: 511423 - protein, 9 aa, Mycobacterium
KEDPSSVDS

SEQ ID NO: 511424 - protein, 8 aa, Mycobacterium
KEDPTGIG

SEQ ID NO: 511425 - protein, 12 aa, Mycobacterium
KEDRCTKVILNP

SEQ ID NO: 511426 - protein, 8 aa, Mycobacterium
KEDRSWRE

SEQ ID NO: 511427 - protein, 10 aa, Mycobacterium
KEDRSWREGV

SEQ ID NO: 511428 - protein, 9 aa, Mycobacterium
KEDSARAKG

SEQ ID NO: 511429 - protein, 5 aa, Mycobacterium
KEDTE

SEQ ID NO: 511430 - protein, 7 aa, Mycobacterium
KEDTESG

SEQ ID NO: 511431 - protein, 9 aa, Mycobacterium
KEEAGPDGL

SEQ ID NO: 511432 - protein, 12 aa, Mycobacterium
KEEDEASKDRLE

SEQ ID NO: 511433 - protein, 8 aa, Mycobacterium
KEEEIGPA

SEQ ID NO: 511434 - protein, 7 aa, Mycobacterium
KEEESAQ

SEQ ID NO: 511435 - protein, 5 aa, Mycobacterium
KEEGA

SEQ ID NO: 511436 - protein, 20 aa, Mycobacterium
KEEGAKVITGGERAELGGDL

SEQ ID NO: 511437 - protein, 13 aa, Mycobacterium
KEEGARVVTGGER

SEQ ID NO: 511438 - protein, 6 aa, Mycobacterium
KEEGIG

SEQ ID NO: 511439 - protein, 39 aa, Mycobacterium
KEELEAPAKKAPAKKAPAAKKAPAKKAPAKKAPAKKVTQ

SEQ ID NO: 511440 - protein, 7 aa, Mycobacterium
KEERLSE

SEQ ID NO: 511441 - protein, 15 aa, Mycobacterium
KEERRTHGRKGHEAR

SEQ ID NO: 511442 - protein, 6 aa, Mycobacterium
KEERYA

SEQ ID NO: 511443 - protein, 6 aa, Mycobacterium
KEETPA

SEQ ID NO: 511444 - protein, 15 aa, Mycobacterium
KEEVSGKQARELSDE

SEQ ID NO: 511445 - protein, 4 aa, Mycobacterium
KEFA

SEQ ID NO: 511446 - protein, 6 aa, Mycobacterium
KEFDDE

SEQ ID NO: 511447 - protein, 9 aa, Mycobacterium
KEFGGQDLP

SEQ ID NO: 511448 - protein, 10 aa, Mycobacterium
KEFGSGPGAG

SEQ ID NO: 511449 - protein, 9 aa, Mycobacterium
KEFSDTGDE

SEQ ID NO: 511450 - protein, 7 aa, Mycobacterium
KEFTGND

SEQ ID NO: 511451 - protein, 13 aa, Mycobacterium
KEGAAAADRDADA

SEQ ID NO: 511452 - protein, 7 aa, Mycobacterium
KEGAEER

SEQ ID NO: 511453 - protein, 4 aa, Mycobacterium
KEGD

SEQ ID NO: 511454 - protein, 10 aa, Mycobacterium
KEGDADRGGN

SEQ ID NO: 511455 - protein, 6 aa, Mycobacterium
KEGDEL

SEQ ID NO: 511456 - protein, 5 aa, Mycobacterium
KEGDF

SEQ ID NO: 511457 - protein, 6 aa, Mycobacterium
KEGEEK

SEQ ID NO: 511458 - protein, 16 aa, Mycobacterium
KEGEPFQPYARDPETL

SEQ ID NO: 511459 - protein, 7 aa, Mycobacterium
KEGFDSI

SEQ ID NO: 511460 - protein, 7 aa, Mycobacterium
KEGFESI

SEQ ID NO: 511461 - protein, 6 aa, Mycobacterium
KEGGAG

SEQ ID NO: 511462 - protein, 9 aa, Mycobacterium
KEGGDGAAV

SEQ ID NO: 511463 - protein, 13 aa, Mycobacterium
KEGGKTGLWEKPA

SEQ ID NO: 511464 - protein, 81 aa, Mycobacterium
KEGGPGGPKFKQAGNGTDNKDPSTDGPGTPDLGPPRQPGGGRVHASSDGPNDGAAPPAPGGSGRVHAPSSDAPFGSPRHNP

SEQ ID NO: 511465 - protein, 6 aa, Mycobacterium
KEGHFG

SEQ ID NO: 511466 - protein, 5 aa, Mycobacterium
KEGIG

SEQ ID NO: 511467 - protein, 11 aa, Mycobacterium
KEGIGRTADGT

SEQ ID NO: 511468 - protein, 7 aa, Mycobacterium
KEGKDFQ

SEQ ID NO: 511469 - protein, 6 aa, Mycobacterium
KEGLAD

SEQ ID NO: 511470 - protein, 36 aa, Mycobacterium
KEGLQKQIEKKKAREAALAAGEQPAESKKSDGGGAM

SEQ ID NO: 511471 - protein, 5 aa, Mycobacterium
KEGLR

SEQ ID NO: 511472 - protein, 12 aa, Mycobacterium
KEGMTANGFSEG

SEQ ID NO: 511473 - protein, 9 aa, Mycobacterium
KEGPAPGPV

SEQ ID NO: 511474 - protein, 6 aa, Mycobacterium
KEGPKA

SEQ ID NO: 511475 - protein, 5 aa, Mycobacterium
KEGQE

SEQ ID NO: 511476 - protein, 4 aa, Mycobacterium
KEGR

SEQ ID NO: 511477 - protein, 13 aa, Mycobacterium
KEGRTIYRRPVAA

SEQ ID NO: 511478 - protein, 5 aa, Mycobacterium
KEGSD

SEQ ID NO: 511479 - protein, 9 aa, Mycobacterium
KEGSDEQQT

SEQ ID NO: 511480 - protein, 10 aa, Mycobacterium
KEGSIAGPRS

SEQ ID NO: 511481 - protein, 15 aa, Mycobacterium
KEGSKSRAKVEEQGI

SEQ ID NO: 511482 - protein, 15 aa, Mycobacterium
KEGSKSRAKVEEQGL

SEQ ID NO: 511483 - protein, 15 aa, Mycobacterium
KEGSKSRAKVTEQGL

SEQ ID NO: 511484 - protein, 15 aa, Mycobacterium
KEGSKSRDKVTEQGL

SEQ ID NO: 511485 - protein, 9 aa, Mycobacterium
KEGSTEPDG

SEQ ID NO: 511486 - protein, 5 aa, Mycobacterium
KEGTA

SEQ ID NO: 511487 - protein, 5 aa, Mycobacterium
KEGTN

SEQ ID NO: 511488 - protein, 5 aa, Mycobacterium
KEGTY

SEQ ID NO: 511489 - protein, 6 aa, Mycobacterium
KEGVAA

SEQ ID NO: 511490 - protein, 6 aa, Mycobacterium
KEGVAD

SEQ ID NO: 511491 - protein, 9 aa, Mycobacterium
KEGVEPQSE

SEQ ID NO: 511492 - protein, 8 aa, Mycobacterium
KEGVSAEA

SEQ ID NO: 511493 - protein, 4 aa, Mycobacterium
KEHE

SEQ ID NO: 511494 - protein, 10 aa, Mycobacterium
KEHEDESKRV

SEQ ID NO: 511495 - protein, 9 aa, Mycobacterium
KEHGGGGGS

SEQ ID NO: 511496 - protein, 10 aa, Mycobacterium
KEHGGGGGSI

SEQ ID NO: 511497 - protein, 9 aa, Mycobacterium
KEHPAKPMS

SEQ ID NO: 511498 - protein, 9 aa, Mycobacterium
KEHPAKPMT

SEQ ID NO: 511499 - protein, 7 aa, Mycobacterium
KEHPDAA

SEQ ID NO: 511500 - protein, 7 aa, Mycobacterium
KEHRDAV

SEQ ID NO: 511501 - protein, 9 aa, Mycobacterium
KEHRDAVPR

SEQ ID NO: 511502 - protein, 8 aa, Mycobacterium
KEHREEVP

SEQ ID NO: 511503 - protein, 6 aa, Mycobacterium
KEIAPY

SEQ ID NO: 511504 - protein, 8 aa, Mycobacterium
KEIARRAD

SEQ ID NO: 511505 - protein, 7 aa, Mycobacterium
KEIDADA

SEQ ID NO: 511506 - protein, 8 aa, Mycobacterium
KEIDRSPA

SEQ ID NO: 511507 - protein, 8 aa, Mycobacterium
KEIDSADK

SEQ ID NO: 511508 - protein, 12 aa, Mycobacterium
KEIEQRRGDLPN

SEQ ID NO: 511509 - protein, 7 aa, Mycobacterium
KEIESRV

SEQ ID NO: 511510 - protein, 6 aa, Mycobacterium
KEIGDR

SEQ ID NO: 511511 - protein, 6 aa, Mycobacterium
KEIPDA

SEQ ID NO: 511512 - protein, 10 aa, Mycobacterium
KEISKRSDVF

SEQ ID NO: 511513 - protein, 18 aa, Mycobacterium
KEKADGRFPDPAKQSRWE

SEQ ID NO: 511514 - protein, 15 aa, Mycobacterium
KEKAQREAAMAAHRE

SEQ ID NO: 511515 - protein, 14 aa, Mycobacterium
KEKDPNLTGDDIRE

SEQ ID NO: 511516 - protein, 9 aa, Mycobacterium
KEKGDGAAV

SEQ ID NO: 511517 - protein, 12 aa, Mycobacterium
KEKLSHYSDGTV

SEQ ID NO: 511518 - protein, 5 aa, Mycobacterium
KEKRF

SEQ ID NO: 511519 - protein, 6 aa, Mycobacterium
KELARR

SEQ ID NO: 511520 - protein, 10 aa, Mycobacterium
KELATDGELA

SEQ ID NO: 511521 - protein, 8 aa, Mycobacterium
KELDGDGV

SEQ ID NO: 511522 - protein, 7 aa, Mycobacterium
KELDSDG

SEQ ID NO: 511523 - protein, 7 aa, Mycobacterium
KELEGTH

SEQ ID NO: 511524 - protein, 7 aa, Mycobacterium
KELEKGA

SEQ ID NO: 511525 - protein, 7 aa, Mycobacterium
KELEQTR

SEQ ID NO: 511526 - protein, 9 aa, Mycobacterium
KELERENQR

SEQ ID NO: 511527 - protein, 11 aa, Mycobacterium
KELGATTQAAV

SEQ ID NO: 511528 - protein, 7 aa, Mycobacterium
KELGRDD

SEQ ID NO: 511529 - protein, 4 aa, Mycobacterium
KELI

SEQ ID NO: 511530 - protein, 7 aa, Mycobacterium
KELQNDP

SEQ ID NO: 511531 - protein, 14 aa, Mycobacterium
KELRDRGDIHGESG

SEQ ID NO: 511532 - protein, 8 aa, Mycobacterium
KELREPSV

SEQ ID NO: 511533 - protein, 7 aa, Mycobacterium
KELRRGA

SEQ ID NO: 511534 - protein, 7 aa, Mycobacterium
KELSASQ

SEQ ID NO: 511535 - protein, 8 aa, Mycobacterium
KELSSTEL

SEQ ID NO: 511536 - protein, 7 aa, Mycobacterium
KELTEPS

SEQ ID NO: 511537 - protein, 6 aa, Mycobacterium
KELTES

SEQ ID NO: 511538 - protein, 4 aa, Mycobacterium
KEMA

SEQ ID NO: 511539 - protein, 4 aa, Mycobacterium
KEMG

SEQ ID NO: 511540 - protein, 13 aa, Mycobacterium
KEMGGSGNGTNPE

SEQ ID NO: 511541 - protein, 13 aa, Mycobacterium
KEMKAAAKAKAAK

SEQ ID NO: 511542 - protein, 20 aa, Mycobacterium
KEMQSDSNAAKSDQPEQITS

SEQ ID NO: 511543 - protein, 7 aa, Mycobacterium
KEMSEQS

SEQ ID NO: 511544 - protein, 9 aa, Mycobacterium
KEMSPDEVR

SEQ ID NO: 511545 - protein, 11 aa, Mycobacterium
KEMSPVEATQA

SEQ ID NO: 511546 - protein, 6 aa, Mycobacterium
KEMTTD

SEQ ID NO: 511547 - protein, 8 aa, Mycobacterium
KENAEHPI

SEQ ID NO: 511548 - protein, 8 aa, Mycobacterium
KENDARAR

SEQ ID NO: 511549 - protein, 19 aa, Mycobacterium
KENDEGVTNDRYEHQDTTP

SEQ ID NO: 511550 - protein, 5 aa, Mycobacterium
KENET

SEQ ID NO: 511551 - protein, 18 aa, Mycobacterium
KENGMQAPEPPESAPEGN

SEQ ID NO: 511552 - protein, 9 aa, Mycobacterium
KENGPTAVE

SEQ ID NO: 511553 - protein, 6 aa, Mycobacterium
KENGYA

SEQ ID NO: 511554 - protein, 5 aa, Mycobacterium
KENNL

SEQ ID NO: 511555 - protein, 5 aa, Mycobacterium
KENPA

SEQ ID NO: 511556 - protein, 6 aa, Mycobacterium
KENPAH

SEQ ID NO: 511557 - protein, 10 aa, Mycobacterium
KENPDPAFTD

SEQ ID NO: 511558 - protein, 7 aa, Mycobacterium
KENPGYT

SEQ ID NO: 511559 - protein, 8 aa, Mycobacterium
KENPVETA

SEQ ID NO: 511560 - protein, 6 aa, Mycobacterium
KENSDV

SEQ ID NO: 511561 - protein, 9 aa, Mycobacterium
KENSQNAYH

SEQ ID NO: 511562 - protein, 5 aa, Mycobacterium
KENYA

SEQ ID NO: 511563 - protein, 13 aa, Mycobacterium
KEPAAIARADDAA

SEQ ID NO: 511564 - protein, 5 aa, Mycobacterium
KEPAL

SEQ ID NO: 511565 - protein, 7 aa, Mycobacterium
KEPDAEL

SEQ ID NO: 511566 - protein, 5 aa, Mycobacterium
KEPDR

SEQ ID NO: 511567 - protein, 6 aa, Mycobacterium
KEPDVE

SEQ ID NO: 511568 - protein, 5 aa, Mycobacterium
KEPEH

SEQ ID NO: 511569 - protein, 8 aa, Mycobacterium
KEPEPTTS

SEQ ID NO: 511570 - protein, 8 aa, Mycobacterium
KEPFQDGN

SEQ ID NO: 511571 - protein, 12 aa, Mycobacterium
KEPGDLKSTAER

SEQ ID NO: 511572 - protein, 20 aa, Mycobacterium
KEPGEARDQAAWTRALAALR

SEQ ID NO: 511573 - protein, 13 aa, Mycobacterium
KEPGGASDIPPEH

SEQ ID NO: 511574 - protein, 21 aa, Mycobacterium
KEPGGEKAAAKRDKKGIPSAR

SEQ ID NO: 511575 - protein, 7 aa, Mycobacterium
KEPGRRS

SEQ ID NO: 511576 - protein, 13 aa, Mycobacterium
KEPGVLDQPDDRM

SEQ ID NO: 511577 - protein, 7 aa, Mycobacterium
KEPHPRD

SEQ ID NO: 511578 - protein, 5 aa, Mycobacterium
KEPIA

SEQ ID NO: 511579 - protein, 10 aa, Mycobacterium
KEPKQAHPNI

SEQ ID NO: 511580 - protein, 4 aa, Mycobacterium
KEPL

SEQ ID NO: 511581 - protein, 7 aa, Mycobacterium
KEPLPQK

SEQ ID NO: 511582 - protein, 8 aa, Mycobacterium
KEPMSADD

SEQ ID NO: 511583 - protein, 6 aa, Mycobacterium
KEPPKR

SEQ ID NO: 511584 - protein, 14 aa, Mycobacterium
KEPPPPLPAELPPN

SEQ ID NO: 511585 - protein, 17 aa, Mycobacterium
KEPPTVEPTGADAAASW

SEQ ID NO: 511586 - protein, 5 aa, Mycobacterium
KEPQV

SEQ ID NO: 511587 - protein, 4 aa, Mycobacterium
KEPR

SEQ ID NO: 511588 - protein, 6 aa, Mycobacterium
KEPRTF

SEQ ID NO: 511589 - protein, 6 aa, Mycobacterium
KEPSQI

SEQ ID NO: 511590 - protein, 8 aa, Mycobacterium
KEPTAEEI

SEQ ID NO: 511591 - protein, 9 aa, Mycobacterium
KEPTNNQDV

SEQ ID NO: 511592 - protein, 8 aa, Mycobacterium
KEPTTLPG

SEQ ID NO: 511593 - protein, 9 aa, Mycobacterium
KEPTTNQDV

SEQ ID NO: 511594 - protein, 6 aa, Mycobacterium
KEPYGA

SEQ ID NO: 511595 - protein, 5 aa, Mycobacterium
KEQAP

SEQ ID NO: 511596 - protein, 6 aa, Mycobacterium
KEQAQW

SEQ ID NO: 511597 - protein, 15 aa, Mycobacterium
KEQARAGRLRAQATD

SEQ ID NO: 511598 - protein, 10 aa, Mycobacterium
KEQARARGTE

SEQ ID NO: 511599 - protein, 34 aa, Mycobacterium
KEQENKTGAKIRSAAAPLPGHDSPQAGDATTTAA

SEQ ID NO: 511600 - protein, 13 aa, Mycobacterium
KEQETFPLSDYAI

SEQ ID NO: 511601 - protein, 5 aa, Mycobacterium
KEQHR

SEQ ID NO: 511602 - protein, 10 aa, Mycobacterium
KEQKSRGREQ

SEQ ID NO: 511603 - protein, 6 aa, Mycobacterium
KEQLRA

SEQ ID NO: 511604 - protein, 5 aa, Mycobacterium
KEQPD

SEQ ID NO: 511605 - protein, 112 aa, Mycobacterium
KEQRAGQRHRGQQHVQPKNRLPGPPLQQQTRGEQAHHPAGTGDGCPDADRSGAPLRRKAAGDGRQRGGHDQRGADSQQGTQPGQRGGVGGQGGHPGSGAEHNQADQQRQPSA

SEQ ID NO: 511606 - protein, 21 aa, Mycobacterium
KEQREPAEGSEKVVSDETLSK

SEQ ID NO: 511607 - protein, 7 aa, Mycobacterium
KEQRPRS

SEQ ID NO: 511608 - protein, 6 aa, Mycobacterium
KEQSHG

SEQ ID NO: 511609 - protein, 7 aa, Mycobacterium
KEQVGAG

SEQ ID NO: 511610 - protein, 14 aa, Mycobacterium
KERAHNAGAKNVEE

SEQ ID NO: 511611 - protein, 16 aa, Mycobacterium
KERAHNAGAKNVEERP

SEQ ID NO: 511612 - protein, 9 aa, Mycobacterium
KERAIDPSV

SEQ ID NO: 511613 - protein, 11 aa, Mycobacterium
KERAKAAPPPL

SEQ ID NO: 511614 - protein, 13 aa, Mycobacterium
KERDENISVDSPE

SEQ ID NO: 511615 - protein, 9 aa, Mycobacterium
KERDNPTSE

SEQ ID NO: 511616 - protein, 12 aa, Mycobacterium
KERELPDADDDF

SEQ ID NO: 511617 - protein, 12 aa, Mycobacterium
KERELPDPDDEF

SEQ ID NO: 511618 - protein, 15 aa, Mycobacterium
KEREQLRESRRRSYD

SEQ ID NO: 511619 - protein, 4 aa, Mycobacterium
KERG

SEQ ID NO: 511620 - protein, 7 aa, Mycobacterium
KERGEGD

SEQ ID NO: 511621 - protein, 16 aa, Mycobacterium
KERGFNRGHQAHEEVS

SEQ ID NO: 511622 - protein, 16 aa, Mycobacterium
KERGFNRGQQAHEEVS

SEQ ID NO: 511623 - protein, 5 aa, Mycobacterium
KERGG

SEQ ID NO: 511624 - protein, 7 aa, Mycobacterium
KERGIDA

SEQ ID NO: 511625 - protein, 6 aa, Mycobacterium
KERGRT

SEQ ID NO: 511626 - protein, 7 aa, Mycobacterium
KERIGED

SEQ ID NO: 511627 - protein, 7 aa, Mycobacterium
KERKAFG

SEQ ID NO: 511628 - protein, 17 aa, Mycobacterium
KERKEGDVLGRNQSGKA

SEQ ID NO: 511629 - protein, 11 aa, Mycobacterium
KERKGSVQSPK

SEQ ID NO: 511630 - protein, 5 aa, Mycobacterium
KERLG

SEQ ID NO: 511631 - protein, 31 aa, Mycobacterium
KERNMGSSERSEAFGTPRESGISSGDAAELE

SEQ ID NO: 511632 - protein, 8 aa, Mycobacterium
KERPEPVG

SEQ ID NO: 511633 - protein, 9 aa, Mycobacterium
KERPGTAAD

SEQ ID NO: 511634 - protein, 9 aa, Mycobacterium
KERPQDERS

SEQ ID NO: 511635 - protein, 7 aa, Mycobacterium
KERQENE

SEQ ID NO: 511636 - protein, 10 aa, Mycobacterium
KERRNATGND

SEQ ID NO: 511637 - protein, 10 aa, Mycobacterium
KERRQATGND

SEQ ID NO: 511638 - protein, 9 aa, Mycobacterium
KERRRADGS

SEQ ID NO: 511639 - protein, 15 aa, Mycobacterium
KERRRTHGRPGHEAT

SEQ ID NO: 511640 - protein, 7 aa, Mycobacterium
KERRSPD

SEQ ID NO: 511641 - protein, 15 aa, Mycobacterium
KERRSSDFAAAPARG

SEQ ID NO: 511642 - protein, 8 aa, Mycobacterium
KERSAENR

SEQ ID NO: 511643 - protein, 11 aa, Mycobacterium
KERSGDIADSE

SEQ ID NO: 511644 - protein, 12 aa, Mycobacterium
KERSPQPPDHLS

SEQ ID NO: 511645 - protein, 4 aa, Mycobacterium
KERT

SEQ ID NO: 511646 - protein, 8 aa, Mycobacterium
KERTDLDD

SEQ ID NO: 511647 - protein, 8 aa, Mycobacterium
KERTRAQY

SEQ ID NO: 511648 - protein, 8 aa, Mycobacterium
KERTRRSH

SEQ ID NO: 511649 - protein, 6 aa, Mycobacterium
KERTTA

SEQ ID NO: 511650 - protein, 7 aa, Mycobacterium
KERTVGG

SEQ ID NO: 511651 - protein, 9 aa, Mycobacterium
KERVDGTPA

SEQ ID NO: 511652 - protein, 5 aa, Mycobacterium
KERVN

SEQ ID NO: 511653 - protein, 6 aa, Mycobacterium
KERYGD

SEQ ID NO: 511654 - protein, 7 aa, Mycobacterium
KESAASD

SEQ ID NO: 511655 - protein, 6 aa, Mycobacterium
KESAVT

SEQ ID NO: 511656 - protein, 4 aa, Mycobacterium
KESD

SEQ ID NO: 511657 - protein, 11 aa, Mycobacterium
KESEGGGHRSD

SEQ ID NO: 511658 - protein, 8 aa, Mycobacterium
KESEIGPA

SEQ ID NO: 511659 - protein, 9 aa, Mycobacterium
KESGEAAGL

SEQ ID NO: 511660 - protein, 6 aa, Mycobacterium
KESGSF

SEQ ID NO: 511661 - protein, 14 aa, Mycobacterium
KESGSGKDAGTESF

SEQ ID NO: 511662 - protein, 7 aa, Mycobacterium
KESHAAV

SEQ ID NO: 511663 - protein, 7 aa, Mycobacterium
KESITGA

SEQ ID NO: 511664 - protein, 4 aa, Mycobacterium
KESL

SEQ ID NO: 511665 - protein, 5 aa, Mycobacterium
KESLA

SEQ ID NO: 511666 - protein, 7 aa, Mycobacterium
KESNPYN

SEQ ID NO: 511667 - protein, 6 aa, Mycobacterium
KESPLP

SEQ ID NO: 511668 - protein, 12 aa, Mycobacterium
KESRAKVTGAAP

SEQ ID NO: 511669 - protein, 28 aa, Mycobacterium
KESRKRGESAEIYTQNGRGDLAANEHAE

SEQ ID NO: 511670 - protein, 8 aa, Mycobacterium
KESTGASA

SEQ ID NO: 511671 - protein, 10 aa, Mycobacterium
KESTPNQERW

SEQ ID NO: 511672 - protein, 6 aa, Mycobacterium
KESVPY

SEQ ID NO: 511673 - protein, 21 aa, Mycobacterium
KETAEAAKAEGKELPDDPAGR

SEQ ID NO: 511674 - protein, 6 aa, Mycobacterium
KETALG

SEQ ID NO: 511675 - protein, 5 aa, Mycobacterium
KETAR

SEQ ID NO: 511676 - protein, 8 aa, Mycobacterium
KETDASTL

SEQ ID NO: 511677 - protein, 10 aa, Mycobacterium
KETEKSLRGP

SEQ ID NO: 511678 - protein, 6 aa, Mycobacterium
KETFKD

SEQ ID NO: 511679 - protein, 23 aa, Mycobacterium
KETGKPGKYKAISRSTAYHGTPH

SEQ ID NO: 511680 - protein, 5 aa, Mycobacterium
KETGV

SEQ ID NO: 511681 - protein, 20 aa, Mycobacterium
KETKPADTAPGWTGARGKPT

SEQ ID NO: 511682 - protein, 5 aa, Mycobacterium
KETLH

SEQ ID NO: 511683 - protein, 4 aa, Mycobacterium
KETN

SEQ ID NO: 511684 - protein, 5 aa, Mycobacterium
KETPE

SEQ ID NO: 511685 - protein, 21 aa, Mycobacterium
KETRAAKQWAEGTRELANAED

SEQ ID NO: 511686 - protein, 10 aa, Mycobacterium
KETREATKQR

SEQ ID NO: 511687 - protein, 8 aa, Mycobacterium
KETRTAEQ

SEQ ID NO: 511688 - protein, 8 aa, Mycobacterium
KETSAQLA

SEQ ID NO: 511689 - protein, 12 aa, Mycobacterium
KETSDALTPEET

SEQ ID NO: 511690 - protein, 9 aa, Mycobacterium
KEVATYGGD

SEQ ID NO: 511691 - protein, 5 aa, Mycobacterium
KEVDP

SEQ ID NO: 511692 - protein, 11 aa, Mycobacterium
KEVEDAQRREL

SEQ ID NO: 511693 - protein, 8 aa, Mycobacterium
KEVEPNEL

SEQ ID NO: 511694 - protein, 7 aa, Mycobacterium
KEVGASR

SEQ ID NO: 511695 - protein, 8 aa, Mycobacterium
KEVGGRGI

SEQ ID NO: 511696 - protein, 9 aa, Mycobacterium
KEVPAPDEG

SEQ ID NO: 511697 - protein, 25 aa, Mycobacterium
KEVPEKPTGPSDGSPRVERGARAGR

SEQ ID NO: 511698 - protein, 6 aa, Mycobacterium
KEVREE

SEQ ID NO: 511699 - protein, 15 aa, Mycobacterium
KEVSFEDRAAGRRTQ

SEQ ID NO: 511700 - protein, 6 aa, Mycobacterium
KEVSRR

SEQ ID NO: 511701 - protein, 7 aa, Mycobacterium
KEVSRRS

SEQ ID NO: 511702 - protein, 6 aa, Mycobacterium
KEVTGS

SEQ ID NO: 511703 - protein, 9 aa, Mycobacterium
KEYAKANDK

SEQ ID NO: 511704 - protein, 13 aa, Mycobacterium
KEYANGGTTACAE

SEQ ID NO: 511705 - protein, 7 aa, Mycobacterium
KEYASSS

SEQ ID NO: 511706 - protein, 10 aa, Mycobacterium
KEYDSPEQAW

SEQ ID NO: 511707 - protein, 6 aa, Mycobacterium
KEYEDL

SEQ ID NO: 511708 - protein, 11 aa, Mycobacterium
KEYGGGGYSPV

SEQ ID NO: 511709 - protein, 9 aa, Mycobacterium
KEYGGHGFG

SEQ ID NO: 511710 - protein, 6 aa, Mycobacterium
KEYGGL

SEQ ID NO: 511711 - protein, 8 aa, Mycobacterium
KEYGGQGR

SEQ ID NO: 511712 - protein, 8 aa, Mycobacterium
KEYGGRDV

SEQ ID NO: 511713 - protein, 8 aa, Mycobacterium
KEYGGRGF

SEQ ID NO: 511714 - protein, 17 aa, Mycobacterium
KEYGSGSSRDWAAKGTS

SEQ ID NO: 511715 - protein, 13 aa, Mycobacterium
KEYGSSQGPPASL

SEQ ID NO: 511716 - protein, 5 aa, Mycobacterium
KEYKR

SEQ ID NO: 511717 - protein, 6 aa, Mycobacterium
KEYQDL

SEQ ID NO: 511718 - protein, 4 aa, Mycobacterium
KEYR

SEQ ID NO: 511719 - protein, 5 aa, Mycobacterium
KEYRD

SEQ ID NO: 511720 - protein, 8 aa, Mycobacterium
KEYSDGGV

SEQ ID NO: 511721 - protein, 7 aa, Mycobacterium
KEYSNLP

SEQ ID NO: 511722 - protein, 13 aa, Mycobacterium
KFAAGSAEGMLSP

SEQ ID NO: 511723 - protein, 7 aa, Mycobacterium
KFADGTE

SEQ ID NO: 511724 - protein, 9 aa, Mycobacterium
KFADTAPAD

SEQ ID NO: 511725 - protein, 7 aa, Mycobacterium
KFAERRT

SEQ ID NO: 511726 - protein, 5 aa, Mycobacterium
KFAGE

SEQ ID NO: 511727 - protein, 5 aa, Mycobacterium
KFAGQ

SEQ ID NO: 511728 - protein, 6 aa, Mycobacterium
KFAGRG

SEQ ID NO: 511729 - protein, 55 aa, Mycobacterium
KFAPGGDKSEEDKNEKDDDVQKVTGDDADKDERDGKADGEALAEQANLPSAHRDP

SEQ ID NO: 511730 - protein, 7 aa, Mycobacterium
KFDAGQR

SEQ ID NO: 511731 - protein, 7 aa, Mycobacterium
KFDNEQN

SEQ ID NO: 511732 - protein, 10 aa, Mycobacterium
KFDSGTGWPS

SEQ ID NO: 511733 - protein, 5 aa, Mycobacterium
KFEDH

SEQ ID NO: 511734 - protein, 8 aa, Mycobacterium
KFEQAAKS

SEQ ID NO: 511735 - protein, 8 aa, Mycobacterium
KFETTEDG

SEQ ID NO: 511736 - protein, 9 aa, Mycobacterium
KFGAGRNNT

SEQ ID NO: 511737 - protein, 18 aa, Mycobacterium
KFGATAGASGTDPHAVAA

SEQ ID NO: 511738 - protein, 11 aa, Mycobacterium
KFGATDSQYDT

SEQ ID NO: 511739 - protein, 15 aa, Mycobacterium
KFGDDPSGPSPEGPI

SEQ ID NO: 511740 - protein, 13 aa, Mycobacterium
KFGDGSKERETSA

SEQ ID NO: 511741 - protein, 10 aa, Mycobacterium
KFGEDPDIDE

SEQ ID NO: 511742 - protein, 5 aa, Mycobacterium
KFGES

SEQ ID NO: 511743 - protein, 8 aa, Mycobacterium
KFGGATAS

SEQ ID NO: 511744 - protein, 13 aa, Mycobacterium
KFGGDSLAETRAN

SEQ ID NO: 511745 - protein, 13 aa, Mycobacterium
KFGGDSLAETRRN

SEQ ID NO: 511746 - protein, 13 aa, Mycobacterium
KFGGDSLGETRAN

SEQ ID NO: 511747 - protein, 14 aa, Mycobacterium
KFGGDSLSETKTNV

SEQ ID NO: 511748 - protein, 5 aa, Mycobacterium
KFGGF

SEQ ID NO: 511749 - protein, 6 aa, Mycobacterium
KFGGFE

SEQ ID NO: 511750 - protein, 5 aa, Mycobacterium
KFGGG

SEQ ID NO: 511751 - protein, 7 aa, Mycobacterium
KFGGRGL

SEQ ID NO: 511752 - protein, 4 aa, Mycobacterium
KFGI

SEQ ID NO: 511753 - protein, 13 aa, Mycobacterium
KFGPGGGSSPHHH

SEQ ID NO: 511754 - protein, 16 aa, Mycobacterium
KFGPGVDVRMKLVEWN

SEQ ID NO: 511755 - protein, 13 aa, Mycobacterium
KFGRHSQARHAEL

SEQ ID NO: 511756 - protein, 8 aa, Mycobacterium
KFGSPELK

SEQ ID NO: 511757 - protein, 8 aa, Mycobacterium
KFHGPSGL

SEQ ID NO: 511758 - protein, 6 aa, Mycobacterium
KFPDGS

SEQ ID NO: 511759 - protein, 5 aa, Mycobacterium
KFPDQ

SEQ ID NO: 511760 - protein, 4 aa, Mycobacterium
KFPG

SEQ ID NO: 511761 - protein, 6 aa, Mycobacterium
KFPGTG

SEQ ID NO: 511762 - protein, 8 aa, Mycobacterium
KFPGTGSY

SEQ ID NO: 511763 - protein, 7 aa, Mycobacterium
KFPPGPI

SEQ ID NO: 511764 - protein, 5 aa, Mycobacterium
KFPPP

SEQ ID NO: 511765 - protein, 4 aa, Mycobacterium
KFPT

SEQ ID NO: 511766 - protein, 5 aa, Mycobacterium
KFPTS

SEQ ID NO: 511767 - protein, 6 aa, Mycobacterium
KFQGQQ

SEQ ID NO: 511768 - protein, 4 aa, Mycobacterium
KFQP

SEQ ID NO: 511769 - protein, 11 aa, Mycobacterium
KFQQSGSGKTL

SEQ ID NO: 511770 - protein, 7 aa, Mycobacterium
KFREETR

SEQ ID NO: 511771 - protein, 5 aa, Mycobacterium
KFRGP

SEQ ID NO: 511772 - protein, 10 aa, Mycobacterium
KFRPSGVEEE

SEQ ID NO: 511773 - protein, 6 aa, Mycobacterium
KFSDPE

SEQ ID NO: 511774 - protein, 7 aa, Mycobacterium
KFSETPA

SEQ ID NO: 511775 - protein, 13 aa, Mycobacterium
KFSNSNSQTSSEY

SEQ ID NO: 511776 - protein, 5 aa, Mycobacterium
KFSSA

SEQ ID NO: 511777 - protein, 12 aa, Mycobacterium
KFSSSSSLPPNE

SEQ ID NO: 511778 - protein, 4 aa, Mycobacterium
KFTG

SEQ ID NO: 511779 - protein, 5 aa, Mycobacterium
KFTGD

SEQ ID NO: 511780 - protein, 7 aa, Mycobacterium
KFTGPNS

SEQ ID NO: 511781 - protein, 5 aa, Mycobacterium
KFTPE

SEQ ID NO: 511782 - protein, 14 aa, Mycobacterium
KFTPRDVSSPPFQG

SEQ ID NO: 511783 - protein, 22 aa, Mycobacterium
KFTRAEQDEYAAQSHQKAAAAW

SEQ ID NO: 511784 - protein, 5 aa, Mycobacterium
KFTRE

SEQ ID NO: 511785 - protein, 21 aa, Mycobacterium
KFTRQEQDEFAAGSHQKAAAA

SEQ ID NO: 511786 - protein, 22 aa, Mycobacterium
KFTRQEQDEFAARSHQKAAAAW

SEQ ID NO: 511787 - protein, 4 aa, Mycobacterium
KGAA

SEQ ID NO: 511788 - protein, 13 aa, Mycobacterium
KGAAAAAAPSTTG

SEQ ID NO: 511789 - protein, 9 aa, Mycobacterium
KGAAALAER

SEQ ID NO: 511790 - protein, 7 aa, Mycobacterium
KGAADDL

SEQ ID NO: 511791 - protein, 32 aa, Mycobacterium
KGAAGGDGGDGGLYGNGGKGGDGGTGGTGQGG

SEQ ID NO: 511792 - protein, 8 aa, Mycobacterium
KGAALDDQ

SEQ ID NO: 511793 - protein, 11 aa, Mycobacterium
KGAAQDARPIG

SEQ ID NO: 511794 - protein, 12 aa, Mycobacterium
KGAATSSKGKGS

SEQ ID NO: 511795 - protein, 12 aa, Mycobacterium
KGAATSSKGKGT

SEQ ID NO: 511796 - protein, 6 aa, Mycobacterium
KGACDS

SEQ ID NO: 511797 - protein, 17 aa, Mycobacterium
KGADGQSTDSATTCSPT

SEQ ID NO: 511798 - protein, 23 aa, Mycobacterium
KGADKKPPGDSFKDGSYDPSKIP

SEQ ID NO: 511799 - protein, 8 aa, Mycobacterium
KGAEAANA

SEQ ID NO: 511800 - protein, 9 aa, Mycobacterium
KGAEDAQRR

SEQ ID NO: 511801 - protein, 6 aa, Mycobacterium
KGAEEL

SEQ ID NO: 511802 - protein, 15 aa, Mycobacterium
KGAEEYDEKAARSGY

SEQ ID NO: 511803 - protein, 8 aa, Mycobacterium
KGAESPRE

SEQ ID NO: 511804 - protein, 9 aa, Mycobacterium
KGAEYPLRP

SEQ ID NO: 511805 - protein, 14 aa, Mycobacterium
KGAGDVKKSLDPAV

SEQ ID NO: 511806 - protein, 8 aa, Mycobacterium
KGAGFTPD

SEQ ID NO: 511807 - protein, 9 aa, Mycobacterium
KGAGGGDGG

SEQ ID NO: 511808 - protein, 10 aa, Mycobacterium
KGAGGGDGGL

SEQ ID NO: 511809 - protein, 11 aa, Mycobacterium
KGAGGSSKPLL

SEQ ID NO: 511810 - protein, 7 aa, Mycobacterium
KGAGKWP

SEQ ID NO: 511811 - protein, 6 aa, Mycobacterium
KGAGPG

SEQ ID NO: 511812 - protein, 5 aa, Mycobacterium
KGAGV

SEQ ID NO: 511813 - protein, 10 aa, Mycobacterium
KGAGVNPLGD

SEQ ID NO: 511814 - protein, 9 aa, Mycobacterium
KGAHGSHSS

SEQ ID NO: 511815 - protein, 11 aa, Mycobacterium
KGAHGSKSSVK

SEQ ID NO: 511816 - protein, 8 aa, Mycobacterium
KGAKERRV

SEQ ID NO: 511817 - protein, 9 aa, Mycobacterium
KGAKETDDA

SEQ ID NO: 511818 - protein, 8 aa, Mycobacterium
KGAKGAVA

SEQ ID NO: 511819 - protein, 11 aa, Mycobacterium
KGAKGSGPRPR

SEQ ID NO: 511820 - protein, 8 aa, Mycobacterium
KGAKNPVY

SEQ ID NO: 511821 - protein, 9 aa, Mycobacterium
KGAKSGVER

SEQ ID NO: 511822 - protein, 7 aa, Mycobacterium
KGALHNR

SEQ ID NO: 511823 - protein, 9 aa, Mycobacterium
KGANTAPPL

SEQ ID NO: 511824 - protein, 4 aa, Mycobacterium
KGAP

SEQ ID NO: 511825 - protein, 7 aa, Mycobacterium
KGAPGLN

SEQ ID NO: 511826 - protein, 7 aa, Mycobacterium
KGAPGTY

SEQ ID NO: 511827 - protein, 9 aa, Mycobacterium
KGAPMPAPK

SEQ ID NO: 511828 - protein, 9 aa, Mycobacterium
KGAQGYDDV

SEQ ID NO: 511829 - protein, 9 aa, Mycobacterium
KGAQPQAAK

SEQ ID NO: 511830 - protein, 6 aa, Mycobacterium
KGAQQV

SEQ ID NO: 511831 - protein, 5 aa, Mycobacterium
KGARI

SEQ ID NO: 511832 - protein, 8 aa, Mycobacterium
KGARLDPA

SEQ ID NO: 511833 - protein, 7 aa, Mycobacterium
KGARTLT

SEQ ID NO: 511834 - protein, 9 aa, Mycobacterium
KGARTSREI

SEQ ID NO: 511835 - protein, 9 aa, Mycobacterium
KGASAEKQI

SEQ ID NO: 511836 - protein, 9 aa, Mycobacterium
KGASDAEIK

SEQ ID NO: 511837 - protein, 13 aa, Mycobacterium
KGASDKGSGAGQY

SEQ ID NO: 511838 - protein, 9 aa, Mycobacterium
KGASETEIK

SEQ ID NO: 511839 - protein, 9 aa, Mycobacterium
KGASGSAYA

SEQ ID NO: 511840 - protein, 16 aa, Mycobacterium
KGASPDRVEEGRRRST

SEQ ID NO: 511841 - protein, 4 aa, Mycobacterium
KGAT

SEQ ID NO: 511842 - protein, 7 aa, Mycobacterium
KGATDEL

SEQ ID NO: 511843 - protein, 7 aa, Mycobacterium
KGATPPF

SEQ ID NO: 511844 - protein, 12 aa, Mycobacterium
KGATRSLPPHHP

SEQ ID NO: 511845 - protein, 8 aa, Mycobacterium
KGAVVTTG

SEQ ID NO: 511846 - protein, 20 aa, Mycobacterium
KGAWSLPGGRLRSDEDLTTS

SEQ ID NO: 511847 - protein, 4 aa, Mycobacterium
KGAY

SEQ ID NO: 511848 - protein, 14 aa, Mycobacterium
KGCGESGTAAAPPA

SEQ ID NO: 511849 - protein, 11 aa, Mycobacterium
KGCSAAGVNTY

SEQ ID NO: 511850 - protein, 12 aa, Mycobacterium
KGCSVDGSIEAG

SEQ ID NO: 511851 - protein, 9 aa, Mycobacterium
KGDAAKTAA

SEQ ID NO: 511852 - protein, 9 aa, Mycobacterium
KGDATKTAA

SEQ ID NO: 511853 - protein, 8 aa, Mycobacterium
KGDATSAN

SEQ ID NO: 511854 - protein, 8 aa, Mycobacterium
KGDAWEPV

SEQ ID NO: 511855 - protein, 7 aa, Mycobacterium
KGDEAGV

SEQ ID NO: 511856 - protein, 9 aa, Mycobacterium
KGDEEANNR

SEQ ID NO: 511857 - protein, 10 aa, Mycobacterium
KGDEERYRQA

SEQ ID NO: 511858 - protein, 6 aa, Mycobacterium
KGDERY

SEQ ID NO: 511859 - protein, 7 aa, Mycobacterium
KGDGIRK

SEQ ID NO: 511860 - protein, 16 aa, Mycobacterium
KGDGPNGDGSAERAGV

SEQ ID NO: 511861 - protein, 5 aa, Mycobacterium
KGDGR

SEQ ID NO: 511862 - protein, 7 aa, Mycobacterium
KGDGVGK

SEQ ID NO: 511863 - protein, 16 aa, Mycobacterium
KGDHDAKRLSSCGRPS

SEQ ID NO: 511864 - protein, 14 aa, Mycobacterium
KGDHDEKRLTSCGR

SEQ ID NO: 511865 - protein, 17 aa, Mycobacterium
KGDIQESLDRFKTVFAP

SEQ ID NO: 511866 - protein, 14 aa, Mycobacterium
KGDKAKVVPTDAQP

SEQ ID NO: 511867 - protein, 17 aa, Mycobacterium
KGDKERTVPFGDPAADA

SEQ ID NO: 511868 - protein, 12 aa, Mycobacterium
KGDKLTTGAQRT

SEQ ID NO: 511869 - protein, 14 aa, Mycobacterium
KGDKSKVLPADAQI

SEQ ID NO: 511870 - protein, 10 aa, Mycobacterium
KGDLAADDRV

SEQ ID NO: 511871 - protein, 4 aa, Mycobacterium
KGDM

SEQ ID NO: 511872 - protein, 8 aa, Mycobacterium
KGDMEKPI

SEQ ID NO: 511873 - protein, 7 aa, Mycobacterium
KGDMEKS

SEQ ID NO: 511874 - protein, 8 aa, Mycobacterium
KGDMTGPV

SEQ ID NO: 511875 - protein, 16 aa, Mycobacterium
KGDPAAARDALGGSPL

SEQ ID NO: 511876 - protein, 8 aa, Mycobacterium
KGDPSASV

SEQ ID NO: 511877 - protein, 15 aa, Mycobacterium
KGDPTIDAGELLKAS

SEQ ID NO: 511878 - protein, 15 aa, Mycobacterium
KGDPTINAGELLAGA

SEQ ID NO: 511879 - protein, 15 aa, Mycobacterium
KGDPTINAGELMSAG

SEQ ID NO: 511880 - protein, 15 aa, Mycobacterium
KGDPTLDAAELLKAS

SEQ ID NO: 511881 - protein, 15 aa, Mycobacterium
KGDPTLDAGELLKAS

SEQ ID NO: 511882 - protein, 15 aa, Mycobacterium
KGDPTLDATELLKQS

SEQ ID NO: 511883 - protein, 6 aa, Mycobacterium
KGDPVP

SEQ ID NO: 511884 - protein, 7 aa, Mycobacterium
KGDQKSD

SEQ ID NO: 511885 - protein, 6 aa, Mycobacterium
KGDQTG

SEQ ID NO: 511886 - protein, 14 aa, Mycobacterium
KGDREVSTKTVTDA

SEQ ID NO: 511887 - protein, 4 aa, Mycobacterium
KGDS

SEQ ID NO: 511888 - protein, 7 aa, Mycobacterium
KGDTAGN

SEQ ID NO: 511889 - protein, 9 aa, Mycobacterium
KGDTDRARL

SEQ ID NO: 511890 - protein, 9 aa, Mycobacterium
KGDVDSSTV

SEQ ID NO: 511891 - protein, 8 aa, Mycobacterium
KGDVEKAT

SEQ ID NO: 511892 - protein, 4 aa, Mycobacterium
KGEA

SEQ ID NO: 511893 - protein, 10 aa, Mycobacterium
KGEAAPALGK

SEQ ID NO: 511894 - protein, 8 aa, Mycobacterium
KGEAEETL

SEQ ID NO: 511895 - protein, 6 aa, Mycobacterium
KGEAEQ

SEQ ID NO: 511896 - protein, 15 aa, Mycobacterium
KGEAHYGSPDKDPAV

SEQ ID NO: 511897 - protein, 6 aa, Mycobacterium
KGEAKD

SEQ ID NO: 511898 - protein, 7 aa, Mycobacterium
KGEAKSD

SEQ ID NO: 511899 - protein, 5 aa, Mycobacterium
KGEDA

SEQ ID NO: 511900 - protein, 9 aa, Mycobacterium
KGEDGRYRS

SEQ ID NO: 511901 - protein, 9 aa, Mycobacterium
KGEDRGGSF

SEQ ID NO: 511902 - protein, 7 aa, Mycobacterium
KGEDRKQ

SEQ ID NO: 511903 - protein, 7 aa, Mycobacterium
KGEDRRQ

SEQ ID NO: 511904 - protein, 10 aa, Mycobacterium
KGEEGPEPQD

SEQ ID NO: 511905 - protein, 14 aa, Mycobacterium
KGEENTGGRDKSSI

SEQ ID NO: 511906 - protein, 9 aa, Mycobacterium
KGEEPGTEW

SEQ ID NO: 511907 - protein, 7 aa, Mycobacterium
KGEEPHT

SEQ ID NO: 511908 - protein, 9 aa, Mycobacterium
KGEEPQTEW

SEQ ID NO: 511909 - protein, 4 aa, Mycobacterium
KGEF

SEQ ID NO: 511910 - protein, 7 aa, Mycobacterium
KGEGEGF

SEQ ID NO: 511911 - protein, 7 aa, Mycobacterium
KGEGEQL

SEQ ID NO: 511912 - protein, 8 aa, Mycobacterium
KGEGGPFI

SEQ ID NO: 511913 - protein, 6 aa, Mycobacterium
KGEGID

SEQ ID NO: 511914 - protein, 6 aa, Mycobacterium
KGEGRG

SEQ ID NO: 511915 - protein, 5 aa, Mycobacterium
KGEIT

SEQ ID NO: 511916 - protein, 8 aa, Mycobacterium
KGEKRSGL

SEQ ID NO: 511917 - protein, 10 aa, Mycobacterium
KGELPLPPAR

SEQ ID NO: 511918 - protein, 7 aa, Mycobacterium
KGEMPAK

SEQ ID NO: 511919 - protein, 4 aa, Mycobacterium
KGEN

SEQ ID NO: 511920 - protein, 7 aa, Mycobacterium
KGEPAPV

SEQ ID NO: 511921 - protein, 13 aa, Mycobacterium
KGEPGHPPDPAQG

SEQ ID NO: 511922 - protein, 10 aa, Mycobacterium
KGEPPQRRSP

SEQ ID NO: 511923 - protein, 7 aa, Mycobacterium
KGEPSPA

SEQ ID NO: 511924 - protein, 8 aa, Mycobacterium
KGEQTRER

SEQ ID NO: 511925 - protein, 9 aa, Mycobacterium
KGERETDEG

SEQ ID NO: 511926 - protein, 8 aa, Mycobacterium
KGERPGRK

SEQ ID NO: 511927 - protein, 7 aa, Mycobacterium
KGERRDD

SEQ ID NO: 511928 - protein, 11 aa, Mycobacterium
KGERSNPAPEI

SEQ ID NO: 511929 - protein, 12 aa, Mycobacterium
KGESHTGGPRVT

SEQ ID NO: 511930 - protein, 5 aa, Mycobacterium
KGESK

SEQ ID NO: 511931 - protein, 5 aa, Mycobacterium
KGESV

SEQ ID NO: 511932 - protein, 6 aa, Mycobacterium
KGESVT

SEQ ID NO: 511933 - protein, 4 aa, Mycobacterium
KGET

SEQ ID NO: 511934 - protein, 7 aa, Mycobacterium
KGETKSD

SEQ ID NO: 511935 - protein, 8 aa, Mycobacterium
KGEVGEDI

SEQ ID NO: 511936 - protein, 6 aa, Mycobacterium
KGEWTG

SEQ ID NO: 511937 - protein, 12 aa, Mycobacterium
KGEYAEGEDPWA

SEQ ID NO: 511938 - protein, 10 aa, Mycobacterium
KGFDGPTGFP

SEQ ID NO: 511939 - protein, 11 aa, Mycobacterium
KGFEPLPPRYK

SEQ ID NO: 511940 - protein, 5 aa, Mycobacterium
KGFGA

SEQ ID NO: 511941 - protein, 7 aa, Mycobacterium
KGFGASA

SEQ ID NO: 511942 - protein, 6 aa, Mycobacterium
KGFPAA

SEQ ID NO: 511943 - protein, 18 aa, Mycobacterium
KGFPGTSVYGATKAALES

SEQ ID NO: 511944 - protein, 8 aa, Mycobacterium
KGFPPSTL

SEQ ID NO: 511945 - protein, 4 aa, Mycobacterium
KGFQ

SEQ ID NO: 511946 - protein, 5 aa, Mycobacterium
KGFSD

SEQ ID NO: 511947 - protein, 8 aa, Mycobacterium
KGFSPGSE

SEQ ID NO: 511948 - protein, 5 aa, Mycobacterium
KGFTG

SEQ ID NO: 511949 - protein, 6 aa, Mycobacterium
KGFTSG

SEQ ID NO: 511950 - protein, 7 aa, Mycobacterium
KGGAARD

SEQ ID NO: 511951 - protein, 6 aa, Mycobacterium
KGGADE

SEQ ID NO: 511952 - protein, 9 aa, Mycobacterium
KGGADSHPD

SEQ ID NO: 511953 - protein, 67 aa, Mycobacterium
KGGAGGDGGAGGGTTSSGTGGSGGTGGTGGSSFIGSGGTGGAGGAGGTATGSGASGAGGAGGSGGYN

SEQ ID NO: 511954 - protein, 12 aa, Mycobacterium
KGGAGKTTTTVT

SEQ ID NO: 511955 - protein, 6 aa, Mycobacterium
KGGAMK

SEQ ID NO: 511956 - protein, 6 aa, Mycobacterium
KGGAPA

SEQ ID NO: 511957 - protein, 9 aa, Mycobacterium
KGGAPEAPG

SEQ ID NO: 511958 - protein, 5 aa, Mycobacterium
KGGAW

SEQ ID NO: 511959 - protein, 7 aa, Mycobacterium
KGGDAYG

SEQ ID NO: 511960 - protein, 22 aa, Mycobacterium
KGGDGAPGGPGQPGGNGGAAGL

SEQ ID NO: 511961 - protein, 11 aa, Mycobacterium
KGGDHQVPNAR

SEQ ID NO: 511962 - protein, 8 aa, Mycobacterium
KGGDSGAL

SEQ ID NO: 511963 - protein, 15 aa, Mycobacterium
KGGEKKGFSSPDEVP

SEQ ID NO: 511964 - protein, 6 aa, Mycobacterium
KGGEQL

SEQ ID NO: 511965 - protein, 6 aa, Mycobacterium
KGGEVE

SEQ ID NO: 511966 - protein, 18 aa, Mycobacterium
KGGFESGEALSKLDNDRT

SEQ ID NO: 511967 - protein, 114 aa, Mycobacterium
KGGFGGGGGSAGLTNAGAAGSATGGEGGAGGNGTIGGTGGSGGDGSTNGTGFGIGGTGGDGGDSFTPSAKGGNGGNGGDAHAPDPDNATVGAGGVGGAGGPEGSPGATGSKGTV

SEQ ID NO: 511968 - protein, 14 aa, Mycobacterium
KGGGSVKCCTLEVH

SEQ ID NO: 511969 - protein, 4 aa, Mycobacterium
KGGH

SEQ ID NO: 511970 - protein, 14 aa, Mycobacterium
KGGHGEDDDEHETP

SEQ ID NO: 511971 - protein, 6 aa, Mycobacterium
KGGHTE

SEQ ID NO: 511972 - protein, 9 aa, Mycobacterium
KGGIGTSSR

SEQ ID NO: 511973 - protein, 17 aa, Mycobacterium
KGGKEGPRAKLVGQHPR

SEQ ID NO: 511974 - protein, 17 aa, Mycobacterium
KGGKEGPRATLVGQHPR

SEQ ID NO: 511975 - protein, 8 aa, Mycobacterium
KGGKERHV

SEQ ID NO: 511976 - protein, 10 aa, Mycobacterium
KGGKERSVPI

SEQ ID NO: 511977 - protein, 6 aa, Mycobacterium
KGGKLD

SEQ ID NO: 511978 - protein, 10 aa, Mycobacterium
KGGKLPPPVH

SEQ ID NO: 511979 - protein, 9 aa, Mycobacterium
KGGKQRVAP

SEQ ID NO: 511980 - protein, 4 aa, Mycobacterium
KGGL

SEQ ID NO: 511981 - protein, 9 aa, Mycobacterium
KGGNGTASR

SEQ ID NO: 511982 - protein, 8 aa, Mycobacterium
KGGNLPGD

SEQ ID NO: 511983 - protein, 8 aa, Mycobacterium
KGGNPGIA

SEQ ID NO: 511984 - protein, 17 aa, Mycobacterium
KGGPGGSPNTHDDAQYD

SEQ ID NO: 511985 - protein, 5 aa, Mycobacterium
KGGPR

SEQ ID NO: 511986 - protein, 7 aa, Mycobacterium
KGGPTGY

SEQ ID NO: 511987 - protein, 8 aa, Mycobacterium
KGGPYLAR

SEQ ID NO: 511988 - protein, 4 aa, Mycobacterium
KGGQ

SEQ ID NO: 511989 - protein, 20 aa, Mycobacterium
KGGQDRDPATYRRADGGLDP

SEQ ID NO: 511990 - protein, 6 aa, Mycobacterium
KGGQMA

SEQ ID NO: 511991 - protein, 14 aa, Mycobacterium
KGGQPNVHDDAGYD

SEQ ID NO: 511992 - protein, 6 aa, Mycobacterium
KGGQTR

SEQ ID NO: 511993 - protein, 11 aa, Mycobacterium
KGGQVTSAPGA

SEQ ID NO: 511994 - protein, 4 aa, Mycobacterium
KGGR

SEQ ID NO: 511995 - protein, 5 aa, Mycobacterium
KGGRA

SEQ ID NO: 511996 - protein, 10 aa, Mycobacterium
KGGRDAAGDL

SEQ ID NO: 511997 - protein, 5 aa, Mycobacterium
KGGRL

SEQ ID NO: 511998 - protein, 6 aa, Mycobacterium
KGGRMP

SEQ ID NO: 511999 - protein, 9 aa, Mycobacterium
KGGRPADTP

SEQ ID NO: 512000 - protein, 16 aa, Mycobacterium
KGGRPLDEKGEPDGSA

SEQ ID NO: 512001 - protein, 10 aa, Mycobacterium
KGGSREDAAS

SEQ ID NO: 512002 - protein, 34 aa, Mycobacterium
KGGTLDSTIGKTMGKARYKSSTTTRNLRTLDKVL

SEQ ID NO: 512003 - protein, 6 aa, Mycobacterium
KGGTVS

SEQ ID NO: 512004 - protein, 20 aa, Mycobacterium
KGGVETATDGLRKQVLKVKK

SEQ ID NO: 512005 - protein, 20 aa, Mycobacterium
KGGVETATEGLKKQVHKVLK

SEQ ID NO: 512006 - protein, 7 aa, Mycobacterium
KGGVGKS

SEQ ID NO: 512007 - protein, 12 aa, Mycobacterium
KGGVGKSTISAS

SEQ ID NO: 512008 - protein, 12 aa, Mycobacterium
KGGVGKTRVTAG

SEQ ID NO: 512009 - protein, 8 aa, Mycobacterium
KGGVGKTS

SEQ ID NO: 512010 - protein, 12 aa, Mycobacterium
KGGVGKTSVAAS

SEQ ID NO: 512011 - protein, 9 aa, Mycobacterium
KGGVGKTTV

SEQ ID NO: 512012 - protein, 12 aa, Mycobacterium
KGGVGKTTVSAT

SEQ ID NO: 512013 - protein, 10 aa, Mycobacterium
KGGVHEAGGY

SEQ ID NO: 512014 - protein, 5 aa, Mycobacterium
KGGVP

SEQ ID NO: 512015 - protein, 6 aa, Mycobacterium
KGGYRH

SEQ ID NO: 512016 - protein, 11 aa, Mycobacterium
KGHARPSMTPT

SEQ ID NO: 512017 - protein, 10 aa, Mycobacterium
KGHASTIEGE

SEQ ID NO: 512018 - protein, 6 aa, Mycobacterium
KGHAYD

SEQ ID NO: 512019 - protein, 12 aa, Mycobacterium
KGHDPRSGLNGR

SEQ ID NO: 512020 - protein, 21 aa, Mycobacterium
KGHEAGQTSQGRTRPFDDRDE

SEQ ID NO: 512021 - protein, 12 aa, Mycobacterium
KGHEEPKGPKRV

SEQ ID NO: 512022 - protein, 11 aa, Mycobacterium
KGHEERRGPSR

SEQ ID NO: 512023 - protein, 13 aa, Mycobacterium
KGHESGQKTGDVT

SEQ ID NO: 512024 - protein, 15 aa, Mycobacterium
KGHETGQRGAGEVRP

SEQ ID NO: 512025 - protein, 14 aa, Mycobacterium
KGHETGQRGGAEVR

SEQ ID NO: 512026 - protein, 16 aa, Mycobacterium
KGHETGQSAGGHTRPF

SEQ ID NO: 512027 - protein, 15 aa, Mycobacterium
KGHGAADWSKRPLPP

SEQ ID NO: 512028 - protein, 7 aa, Mycobacterium
KGHGGSW

SEQ ID NO: 512029 - protein, 6 aa, Mycobacterium
KGHGIQ

SEQ ID NO: 512030 - protein, 8 aa, Mycobacterium
KGHKREPV

SEQ ID NO: 512031 - protein, 13 aa, Mycobacterium
KGHPNVVGPNKRP

SEQ ID NO: 512032 - protein, 8 aa, Mycobacterium
KGHQGVPG

SEQ ID NO: 512033 - protein, 9 aa, Mycobacterium
KGHQMTTAT

SEQ ID NO: 512034 - protein, 7 aa, Mycobacterium
KGHRHRA

SEQ ID NO: 512035 - protein, 14 aa, Mycobacterium
KGHSSSGSSALAKS

SEQ ID NO: 512036 - protein, 8 aa, Mycobacterium
KGHVTREK

SEQ ID NO: 512037 - protein, 9 aa, Mycobacterium
KGIASGKHY

SEQ ID NO: 512038 - protein, 4 aa, Mycobacterium
KGID

SEQ ID NO: 512039 - protein, 7 aa, Mycobacterium
KGIDEGQ

SEQ ID NO: 512040 - protein, 5 aa, Mycobacterium
KGIDP

SEQ ID NO: 512041 - protein, 6 aa, Mycobacterium
KGIDTG

SEQ ID NO: 512042 - protein, 4 aa, Mycobacterium
KGIE

SEQ ID NO: 512043 - protein, 5 aa, Mycobacterium
KGIES

SEQ ID NO: 512044 - protein, 8 aa, Mycobacterium
KGIGGTRA

SEQ ID NO: 512045 - protein, 5 aa, Mycobacterium
KGIHT

SEQ ID NO: 512046 - protein, 4 aa, Mycobacterium
KGIK

SEQ ID NO: 512047 - protein, 5 aa, Mycobacterium
KGIKS

SEQ ID NO: 512048 - protein, 13 aa, Mycobacterium
KGIPLDPSGDVKE

SEQ ID NO: 512049 - protein, 5 aa, Mycobacterium
KGISY

SEQ ID NO: 512050 - protein, 4 aa, Mycobacterium
KGIT

SEQ ID NO: 512051 - protein, 7 aa, Mycobacterium
KGITANT

SEQ ID NO: 512052 - protein, 15 aa, Mycobacterium
KGITEPEAWGPTRNP

SEQ ID NO: 512053 - protein, 15 aa, Mycobacterium
KGITEPQAYGPARNP

SEQ ID NO: 512054 - protein, 6 aa, Mycobacterium
KGITHE

SEQ ID NO: 512055 - protein, 16 aa, Mycobacterium
KGITIPDPSQPEPVQE

SEQ ID NO: 512056 - protein, 6 aa, Mycobacterium
KGKADI

SEQ ID NO: 512057 - protein, 7 aa, Mycobacterium
KGKAKEV

SEQ ID NO: 512058 - protein, 7 aa, Mycobacterium
KGKEAPV

SEQ ID NO: 512059 - protein, 25 aa, Mycobacterium
KGKFPQPAARRRDYPGSPVSLPAPD

SEQ ID NO: 512060 - protein, 5 aa, Mycobacterium
KGKGI

SEQ ID NO: 512061 - protein, 9 aa, Mycobacterium
KGKHGPLRR

SEQ ID NO: 512062 - protein, 14 aa, Mycobacterium
KGKKPKIVPSDAQL

SEQ ID NO: 512063 - protein, 6 aa, Mycobacterium
KGKKSL

SEQ ID NO: 512064 - protein, 8 aa, Mycobacterium
KGKNAAEV

SEQ ID NO: 512065 - protein, 7 aa, Mycobacterium
KGKNQVI

SEQ ID NO: 512066 - protein, 7 aa, Mycobacterium
KGKPPNV

SEQ ID NO: 512067 - protein, 8 aa, Mycobacterium
KGKPPNVY

SEQ ID NO: 512068 - protein, 5 aa, Mycobacterium
KGKPR

SEQ ID NO: 512069 - protein, 4 aa, Mycobacterium
KGKR

SEQ ID NO: 512070 - protein, 8 aa, Mycobacterium
KGKRGDHV

SEQ ID NO: 512071 - protein, 17 aa, Mycobacterium
KGKRSVAADMRSPEGQQ

SEQ ID NO: 512072 - protein, 7 aa, Mycobacterium
KGKRSVT

SEQ ID NO: 512073 - protein, 6 aa, Mycobacterium
KGKRVP

SEQ ID NO: 512074 - protein, 9 aa, Mycobacterium
KGKSVVPVT

SEQ ID NO: 512075 - protein, 6 aa, Mycobacterium
KGKTGL

SEQ ID NO: 512076 - protein, 25 aa, Mycobacterium
KGKTSKPATSSTTDNAGEGGEGGGD

SEQ ID NO: 512077 - protein, 6 aa, Mycobacterium
KGKTVI

SEQ ID NO: 512078 - protein, 7 aa, Mycobacterium
KGKVGST

SEQ ID NO: 512079 - protein, 58 aa, Mycobacterium
KGKVKEAAGKLTGDESLEREGQAQQDKAEAQREVATKEAEAEKARAEAAVHEAREDAE

SEQ ID NO: 512080 - protein, 7 aa, Mycobacterium
KGKVKEV

SEQ ID NO: 512081 - protein, 10 aa, Mycobacterium
KGLADGEWTP

SEQ ID NO: 512082 - protein, 6 aa, Mycobacterium
KGLAGG

SEQ ID NO: 512083 - protein, 7 aa, Mycobacterium
KGLDGDT

SEQ ID NO: 512084 - protein, 14 aa, Mycobacterium
KGLDPDFGRGQSAY

SEQ ID NO: 512085 - protein, 60 aa, Mycobacterium
KGLEESTPELTYSGPAEDGSAQSRHENGAASASGGGTRRERREAARNAGRTSKPAKSRRK

SEQ ID NO: 512086 - protein, 6 aa, Mycobacterium
KGLEPQ

SEQ ID NO: 512087 - protein, 7 aa, Mycobacterium
KGLGGGL

SEQ ID NO: 512088 - protein, 24 aa, Mycobacterium
KGLGKKGYLEDDEYDGKPNLRTRK

SEQ ID NO: 512089 - protein, 6 aa, Mycobacterium
KGLGRK

SEQ ID NO: 512090 - protein, 13 aa, Mycobacterium
KGLGSGGAKGCPK

SEQ ID NO: 512091 - protein, 13 aa, Mycobacterium
KGLGSGGARGCPP

SEQ ID NO: 512092 - protein, 6 aa, Mycobacterium
KGLPDG

SEQ ID NO: 512093 - protein, 8 aa, Mycobacterium
KGLPGLEG

SEQ ID NO: 512094 - protein, 14 aa, Mycobacterium
KGLPPLGSGLAPGV

SEQ ID NO: 512095 - protein, 24 aa, Mycobacterium
KGLPPNPDATSTGLPGARGADVDG

SEQ ID NO: 512096 - protein, 24 aa, Mycobacterium
KGLPPNPDATSTSLPGARGADVDG

SEQ ID NO: 512097 - protein, 8 aa, Mycobacterium
KGLPTDDP

SEQ ID NO: 512098 - protein, 19 aa, Mycobacterium
KGLPTGESEPQPAGGEALR

SEQ ID NO: 512099 - protein, 8 aa, Mycobacterium
KGLSGTTM

SEQ ID NO: 512100 - protein, 9 aa, Mycobacterium
KGLTGTGYD

SEQ ID NO: 512101 - protein, 7 aa, Mycobacterium
KGLTHTP

SEQ ID NO: 512102 - protein, 10 aa, Mycobacterium
KGLTKAGSAE

SEQ ID NO: 512103 - protein, 12 aa, Mycobacterium
KGLTWNGRRASI

SEQ ID NO: 512104 - protein, 4 aa, Mycobacterium
KGMA

SEQ ID NO: 512105 - protein, 24 aa, Mycobacterium
KGMPPNPDATSTGLEGARGADVDG

SEQ ID NO: 512106 - protein, 4 aa, Mycobacterium
KGMR

SEQ ID NO: 512107 - protein, 8 aa, Mycobacterium
KGMRTSRR

SEQ ID NO: 512108 - protein, 8 aa, Mycobacterium
KGMTPDRA

SEQ ID NO: 512109 - protein, 14 aa, Mycobacterium
KGNAAAKDHTAAVG

SEQ ID NO: 512110 - protein, 6 aa, Mycobacterium
KGNAPI

SEQ ID NO: 512111 - protein, 14 aa, Mycobacterium
KGNASQSAGATAHG

SEQ ID NO: 512112 - protein, 4 aa, Mycobacterium
KGND

SEQ ID NO: 512113 - protein, 8 aa, Mycobacterium
KGNEDRQY

SEQ ID NO: 512114 - protein, 31 aa, Mycobacterium
KGNGGAGGAGGIGGTGGIGGDGSRGDTPLGP

SEQ ID NO: 512115 - protein, 7 aa, Mycobacterium
KGNGIDK

SEQ ID NO: 512116 - protein, 17 aa, Mycobacterium
KGNKQRSVPFGAPAAEA

SEQ ID NO: 512117 - protein, 16 aa, Mycobacterium
KGNKQRTAPFGQPAAE

SEQ ID NO: 512118 - protein, 8 aa, Mycobacterium
KGNKQRTV

SEQ ID NO: 512119 - protein, 13 aa, Mycobacterium
KGNKQRTVPFGEP

SEQ ID NO: 512120 - protein, 15 aa, Mycobacterium
KGNKQRTVPYGEPAH

SEQ ID NO: 512121 - protein, 16 aa, Mycobacterium
KGNKQRTVPYGRPAAE

SEQ ID NO: 512122 - protein, 13 aa, Mycobacterium
KGNLTVQSQPGDT

SEQ ID NO: 512123 - protein, 12 aa, Mycobacterium
KGNNPLERGTMD

SEQ ID NO: 512124 - protein, 7 aa, Mycobacterium
KGNPQKT

SEQ ID NO: 512125 - protein, 4 aa, Mycobacterium
KGNR

SEQ ID NO: 512126 - protein, 5 aa, Mycobacterium
KGNRP

SEQ ID NO: 512127 - protein, 8 aa, Mycobacterium
KGNTVNPD

SEQ ID NO: 512128 - protein, 8 aa, Mycobacterium
KGNTVSAE

SEQ ID NO: 512129 - protein, 7 aa, Mycobacterium
KGNTVSH

SEQ ID NO: 512130 - protein, 8 aa, Mycobacterium
KGNTVSSE

SEQ ID NO: 512131 - protein, 4 aa, Mycobacterium
KGPA

SEQ ID NO: 512132 - protein, 5 aa, Mycobacterium
KGPAE

SEQ ID NO: 512133 - protein, 8 aa, Mycobacterium
KGPAGQAK

SEQ ID NO: 512134 - protein, 6 aa, Mycobacterium
KGPCGA

SEQ ID NO: 512135 - protein, 7 aa, Mycobacterium
KGPDDAP

SEQ ID NO: 512136 - protein, 15 aa, Mycobacterium
KGPDGQDWPAQDTVR

SEQ ID NO: 512137 - protein, 9 aa, Mycobacterium
KGPDGQEWP

SEQ ID NO: 512138 - protein, 6 aa, Mycobacterium
KGPDLS

SEQ ID NO: 512139 - protein, 9 aa, Mycobacterium
KGPDTEPLE

SEQ ID NO: 512140 - protein, 8 aa, Mycobacterium
KGPEEAGW

SEQ ID NO: 512141 - protein, 8 aa, Mycobacterium
KGPEVSNT

SEQ ID NO: 512142 - protein, 9 aa, Mycobacterium
KGPEVSTDD

SEQ ID NO: 512143 - protein, 6 aa, Mycobacterium
KGPGGA

SEQ ID NO: 512144 - protein, 7 aa, Mycobacterium
KGPGGED

SEQ ID NO: 512145 - protein, 23 aa, Mycobacterium
KGPGGLGGRLGHDDGEDGTATSW

SEQ ID NO: 512146 - protein, 12 aa, Mycobacterium
KGPGLDRASDAL

SEQ ID NO: 512147 - protein, 10 aa, Mycobacterium
KGPGLDRATD

SEQ ID NO: 512148 - protein, 5 aa, Mycobacterium
KGPGY

SEQ ID NO: 512149 - protein, 11 aa, Mycobacterium
KGPHQPGTGAG

SEQ ID NO: 512150 - protein, 7 aa, Mycobacterium
KGPIGTG

SEQ ID NO: 512151 - protein, 9 aa, Mycobacterium
KGPKGAPLI

SEQ ID NO: 512152 - protein, 7 aa, Mycobacterium
KGPKPAA

SEQ ID NO: 512153 - protein, 17 aa, Mycobacterium
KGPLGGHGRRPRLGDRI

SEQ ID NO: 512154 - protein, 8 aa, Mycobacterium
KGPMGTGQ

SEQ ID NO: 512155 - protein, 8 aa, Mycobacterium
KGPMGTSQ

SEQ ID NO: 512156 - protein, 13 aa, Mycobacterium
KGPNDYDAASPEI

SEQ ID NO: 512157 - protein, 6 aa, Mycobacterium
KGPNQF

SEQ ID NO: 512158 - protein, 12 aa, Mycobacterium
KGPPAPDDRETA

SEQ ID NO: 512159 - protein, 13 aa, Mycobacterium
KGPPAPQDRDTAA

SEQ ID NO: 512160 - protein, 8 aa, Mycobacterium
KGPPATWG

SEQ ID NO: 512161 - protein, 13 aa, Mycobacterium
KGPPTADDRETPA

SEQ ID NO: 512162 - protein, 10 aa, Mycobacterium
KGPPTLSGRA

SEQ ID NO: 512163 - protein, 4 aa, Mycobacterium
KGPQ

SEQ ID NO: 512164 - protein, 8 aa, Mycobacterium
KGPQADQI

SEQ ID NO: 512165 - protein, 9 aa, Mycobacterium
KGPQGEPWP

SEQ ID NO: 512166 - protein, 6 aa, Mycobacterium
KGPQGV

SEQ ID NO: 512167 - protein, 5 aa, Mycobacterium
KGPQY

SEQ ID NO: 512168 - protein, 14 aa, Mycobacterium
KGPRLTAREDEDVS

SEQ ID NO: 512169 - protein, 15 aa, Mycobacterium
KGPRLTAREDEDVSA

SEQ ID NO: 512170 - protein, 6 aa, Mycobacterium
KGPRNA

SEQ ID NO: 512171 - protein, 6 aa, Mycobacterium
KGPRNN

SEQ ID NO: 512172 - protein, 12 aa, Mycobacterium
KGPSAKADQLTD

SEQ ID NO: 512173 - protein, 5 aa, Mycobacterium
KGPSG

SEQ ID NO: 512174 - protein, 9 aa, Mycobacterium
KGPSGESWP

SEQ ID NO: 512175 - protein, 10 aa, Mycobacterium
KGPSKGGDGR

SEQ ID NO: 512176 - protein, 12 aa, Mycobacterium
KGPSSPPEERGS

SEQ ID NO: 512177 - protein, 7 aa, Mycobacterium
KGPWPSD

SEQ ID NO: 512178 - protein, 10 aa, Mycobacterium
KGPYDDAHER

SEQ ID NO: 512179 - protein, 9 aa, Mycobacterium
KGQAAQANI

SEQ ID NO: 512180 - protein, 8 aa, Mycobacterium
KGQALEPD

SEQ ID NO: 512181 - protein, 4 aa, Mycobacterium
KGQD

SEQ ID NO: 512182 - protein, 13 aa, Mycobacterium
KGQDPLGGRFTPA

SEQ ID NO: 512183 - protein, 9 aa, Mycobacterium
KGQEPQTEW

SEQ ID NO: 512184 - protein, 9 aa, Mycobacterium
KGQEPRTEW

SEQ ID NO: 512185 - protein, 5 aa, Mycobacterium
KGQET

SEQ ID NO: 512186 - protein, 20 aa, Mycobacterium
KGQGGEDLGERWSSQGVTAH

SEQ ID NO: 512187 - protein, 10 aa, Mycobacterium
KGQGGRSSGI

SEQ ID NO: 512188 - protein, 6 aa, Mycobacterium
KGQGGS

SEQ ID NO: 512189 - protein, 11 aa, Mycobacterium
KGQHRKTEVPV

SEQ ID NO: 512190 - protein, 7 aa, Mycobacterium
KGQIADD

SEQ ID NO: 512191 - protein, 13 aa, Mycobacterium
KGQKGFSGLGAPA

SEQ ID NO: 512192 - protein, 11 aa, Mycobacterium
KGQLDGKYDDL

SEQ ID NO: 512193 - protein, 10 aa, Mycobacterium
KGQPKDQIAE

SEQ ID NO: 512194 - protein, 9 aa, Mycobacterium
KGQPREDIR

SEQ ID NO: 512195 - protein, 6 aa, Mycobacterium
KGQPRR

SEQ ID NO: 512196 - protein, 5 aa, Mycobacterium
KGQRM

SEQ ID NO: 512197 - protein, 14 aa, Mycobacterium
KGQSASGSRPLART

SEQ ID NO: 512198 - protein, 15 aa, Mycobacterium
KGQSASSLGLDGTET

SEQ ID NO: 512199 - protein, 10 aa, Mycobacterium
KGQSGTKKDV

SEQ ID NO: 512200 - protein, 12 aa, Mycobacterium
KGQSHTGGPRVT

SEQ ID NO: 512201 - protein, 7 aa, Mycobacterium
KGQSKDE

SEQ ID NO: 512202 - protein, 15 aa, Mycobacterium
KGQSPAKLRERGKET

SEQ ID NO: 512203 - protein, 7 aa, Mycobacterium
KGQTIDY

SEQ ID NO: 512204 - protein, 33 aa, Mycobacterium
KGQTNLAADGYDPARVRGADGHEAETPRQAERD

SEQ ID NO: 512205 - protein, 10 aa, Mycobacterium
KGQVGPGGVV

SEQ ID NO: 512206 - protein, 7 aa, Mycobacterium
KGQYDEN

SEQ ID NO: 512207 - protein, 5 aa, Mycobacterium
KGRAA

SEQ ID NO: 512208 - protein, 18 aa, Mycobacterium
KGRAAGMARQAAPYEPPT

SEQ ID NO: 512209 - protein, 17 aa, Mycobacterium
KGRAAGMTRTGERFVPP

SEQ ID NO: 512210 - protein, 5 aa, Mycobacterium
KGRAL

SEQ ID NO: 512211 - protein, 7 aa, Mycobacterium
KGRAPHN

SEQ ID NO: 512212 - protein, 5 aa, Mycobacterium
KGRAQ

SEQ ID NO: 512213 - protein, 9 aa, Mycobacterium
KGRASYLGQ

SEQ ID NO: 512214 - protein, 14 aa, Mycobacterium
KGRATTAGASPAEL

SEQ ID NO: 512215 - protein, 11 aa, Mycobacterium
KGRDDRKATMG

SEQ ID NO: 512216 - protein, 9 aa, Mycobacterium
KGRDDRNAT

SEQ ID NO: 512217 - protein, 7 aa, Mycobacterium
KGREDPW

SEQ ID NO: 512218 - protein, 8 aa, Mycobacterium
KGREDSVF

SEQ ID NO: 512219 - protein, 7 aa, Mycobacterium
KGREGTS

SEQ ID NO: 512220 - protein, 4 aa, Mycobacterium
KGRF

SEQ ID NO: 512221 - protein, 10 aa, Mycobacterium
KGRFPTSGDA

SEQ ID NO: 512222 - protein, 11 aa, Mycobacterium
KGRGAESAADL

SEQ ID NO: 512223 - protein, 14 aa, Mycobacterium
KGRGFSEVEDREGW

SEQ ID NO: 512224 - protein, 13 aa, Mycobacterium
KGRGIEEAAPLGV

SEQ ID NO: 512225 - protein, 14 aa, Mycobacterium
KGRGIESAAPLGVS

SEQ ID NO: 512226 - protein, 12 aa, Mycobacterium
KGRGRADDTDEV

SEQ ID NO: 512227 - protein, 7 aa, Mycobacterium
KGRGRDM

SEQ ID NO: 512228 - protein, 12 aa, Mycobacterium
KGRGREDDTEDV

SEQ ID NO: 512229 - protein, 15 aa, Mycobacterium
KGRHGKQIVYPVLKR

SEQ ID NO: 512230 - protein, 7 aa, Mycobacterium
KGRHPAA

SEQ ID NO: 512231 - protein, 8 aa, Mycobacterium
KGRHPAAV

SEQ ID NO: 512232 - protein, 7 aa, Mycobacterium
KGRIPAD

SEQ ID NO: 512233 - protein, 18 aa, Mycobacterium
KGRIPGDDGRSGPEKDGF

SEQ ID NO: 512234 - protein, 13 aa, Mycobacterium
KGRKAGSGPQAPE

SEQ ID NO: 512235 - protein, 5 aa, Mycobacterium
KGRKR

SEQ ID NO: 512236 - protein, 11 aa, Mycobacterium
KGRKSGKEFRT

SEQ ID NO: 512237 - protein, 6 aa, Mycobacterium
KGRLGD

SEQ ID NO: 512238 - protein, 7 aa, Mycobacterium
KGRLQPD

SEQ ID NO: 512239 - protein, 5 aa, Mycobacterium
KGRLR

SEQ ID NO: 512240 - protein, 6 aa, Mycobacterium
KGRLSA

SEQ ID NO: 512241 - protein, 15 aa, Mycobacterium
KGRNGVPAGSAATEI

SEQ ID NO: 512242 - protein, 7 aa, Mycobacterium
KGRNVGA

SEQ ID NO: 512243 - protein, 7 aa, Mycobacterium
KGRPADA

SEQ ID NO: 512244 - protein, 10 aa, Mycobacterium
KGRPADKPAL

SEQ ID NO: 512245 - protein, 6 aa, Mycobacterium
KGRPEV

SEQ ID NO: 512246 - protein, 7 aa, Mycobacterium
KGRPEVD

SEQ ID NO: 512247 - protein, 6 aa, Mycobacterium
KGRPGV

SEQ ID NO: 512248 - protein, 8 aa, Mycobacterium
KGRPKNLY

SEQ ID NO: 512249 - protein, 8 aa, Mycobacterium
KGRQREHS

SEQ ID NO: 512250 - protein, 11 aa, Mycobacterium
KGRQTRDALAQ

SEQ ID NO: 512251 - protein, 9 aa, Mycobacterium
KGRRARAER

SEQ ID NO: 512252 - protein, 8 aa, Mycobacterium
KGRRGANQ

SEQ ID NO: 512253 - protein, 10 aa, Mycobacterium
KGRRSIRRAR

SEQ ID NO: 512254 - protein, 5 aa, Mycobacterium
KGRRT

SEQ ID NO: 512255 - protein, 8 aa, Mycobacterium
KGRSESGL

SEQ ID NO: 512256 - protein, 4 aa, Mycobacterium
KGRT

SEQ ID NO: 512257 - protein, 12 aa, Mycobacterium
KGRTDAGSVEQT

SEQ ID NO: 512258 - protein, 6 aa, Mycobacterium
KGRTPD

SEQ ID NO: 512259 - protein, 16 aa, Mycobacterium
KGRTRTSDNARPAEHV

SEQ ID NO: 512260 - protein, 8 aa, Mycobacterium
KGRVGPGG

SEQ ID NO: 512261 - protein, 7 aa, Mycobacterium
KGRVSTA

SEQ ID NO: 512262 - protein, 13 aa, Mycobacterium
KGRYPDRKTARRV

SEQ ID NO: 512263 - protein, 4 aa, Mycobacterium
KGSA

SEQ ID NO: 512264 - protein, 7 aa, Mycobacterium
KGSAASI

SEQ ID NO: 512265 - protein, 6 aa, Mycobacterium
KGSADD

SEQ ID NO: 512266 - protein, 10 aa, Mycobacterium
KGSAESQLSY

SEQ ID NO: 512267 - protein, 13 aa, Mycobacterium
KGSAGLSFGAPEE

SEQ ID NO: 512268 - protein, 5 aa, Mycobacterium
KGSAI

SEQ ID NO: 512269 - protein, 10 aa, Mycobacterium
KGSATSKAVS

SEQ ID NO: 512270 - protein, 9 aa, Mycobacterium
KGSDAQLRA

SEQ ID NO: 512271 - protein, 7 aa, Mycobacterium
KGSDLPA

SEQ ID NO: 512272 - protein, 10 aa, Mycobacterium
KGSDPRDGSL

SEQ ID NO: 512273 - protein, 5 aa, Mycobacterium
KGSDT

SEQ ID NO: 512274 - protein, 10 aa, Mycobacterium
KGSEAAGPTL

SEQ ID NO: 512275 - protein, 4 aa, Mycobacterium
KGSF

SEQ ID NO: 512276 - protein, 15 aa, Mycobacterium
KGSFPTKSYDTADGF

SEQ ID NO: 512277 - protein, 8 aa, Mycobacterium
KGSGDWRP

SEQ ID NO: 512278 - protein, 5 aa, Mycobacterium
KGSGE

SEQ ID NO: 512279 - protein, 8 aa, Mycobacterium
KGSGKTDL

SEQ ID NO: 512280 - protein, 6 aa, Mycobacterium
KGSGPA

SEQ ID NO: 512281 - protein, 6 aa, Mycobacterium
KGSGPG

SEQ ID NO: 512282 - protein, 8 aa, Mycobacterium
KGSGPQRI

SEQ ID NO: 512283 - protein, 9 aa, Mycobacterium
KGSGQQEVA

SEQ ID NO: 512284 - protein, 6 aa, Mycobacterium
KGSGRM

SEQ ID NO: 512285 - protein, 14 aa, Mycobacterium
KGSGRTPFARGGDG

SEQ ID NO: 512286 - protein, 6 aa, Mycobacterium
KGSGTA

SEQ ID NO: 512287 - protein, 5 aa, Mycobacterium
KGSII

SEQ ID NO: 512288 - protein, 5 aa, Mycobacterium
KGSIV

SEQ ID NO: 512289 - protein, 5 aa, Mycobacterium
KGSKA

SEQ ID NO: 512290 - protein, 6 aa, Mycobacterium
KGSLGA

SEQ ID NO: 512291 - protein, 5 aa, Mycobacterium
KGSNV

SEQ ID NO: 512292 - protein, 22 aa, Mycobacterium
KGSPSAASDRDADATDATAVIT

SEQ ID NO: 512293 - protein, 11 aa, Mycobacterium
KGSPSAHPDDV

SEQ ID NO: 512294 - protein, 9 aa, Mycobacterium
KGSQPQAAK

SEQ ID NO: 512295 - protein, 10 aa, Mycobacterium
KGSRKSTPFA

SEQ ID NO: 512296 - protein, 11 aa, Mycobacterium
KGSRPNPSEYL

SEQ ID NO: 512297 - protein, 10 aa, Mycobacterium
KGSRSANAGP

SEQ ID NO: 512298 - protein, 11 aa, Mycobacterium
KGSRSANAGPV

SEQ ID NO: 512299 - protein, 24 aa, Mycobacterium
KGSSAAREAAASALSEGAGQGSVL

SEQ ID NO: 512300 - protein, 8 aa, Mycobacterium
KGSSGIDL

SEQ ID NO: 512301 - protein, 16 aa, Mycobacterium
KGSTAARHPNTTTTER

SEQ ID NO: 512302 - protein, 5 aa, Mycobacterium
KGSTL

SEQ ID NO: 512303 - protein, 8 aa, Mycobacterium
KGSTLNSA

SEQ ID NO: 512304 - protein, 6 aa, Mycobacterium
KGSTWR

SEQ ID NO: 512305 - protein, 7 aa, Mycobacterium
KGSVGGS

SEQ ID NO: 512306 - protein, 5 aa, Mycobacterium
KGSVT

SEQ ID NO: 512307 - protein, 5 aa, Mycobacterium
KGSYI

SEQ ID NO: 512308 - protein, 8 aa, Mycobacterium
KGTAGAAV

SEQ ID NO: 512309 - protein, 5 aa, Mycobacterium
KGTAH

SEQ ID NO: 512310 - protein, 6 aa, Mycobacterium
KGTAKE

SEQ ID NO: 512311 - protein, 7 aa, Mycobacterium
KGTAPAE

SEQ ID NO: 512312 - protein, 16 aa, Mycobacterium
KGTATARRVGTDALTP

SEQ ID NO: 512313 - protein, 11 aa, Mycobacterium
KGTDARLRSEG

SEQ ID NO: 512314 - protein, 21 aa, Mycobacterium
KGTDFKKAKRLPAEQLTHWNT

SEQ ID NO: 512315 - protein, 5 aa, Mycobacterium
KGTDL

SEQ ID NO: 512316 - protein, 10 aa, Mycobacterium
KGTDSQMRSG

SEQ ID NO: 512317 - protein, 5 aa, Mycobacterium
KGTFR

SEQ ID NO: 512318 - protein, 11 aa, Mycobacterium
KGTGAQRGSLD

SEQ ID NO: 512319 - protein, 7 aa, Mycobacterium
KGTGDMP

SEQ ID NO: 512320 - protein, 10 aa, Mycobacterium
KGTGDTSGYG

SEQ ID NO: 512321 - protein, 7 aa, Mycobacterium
KGTGSNT

SEQ ID NO: 512322 - protein, 23 aa, Mycobacterium
KGTHGDSTPTSCDTCGGRGEVQT

SEQ ID NO: 512323 - protein, 9 aa, Mycobacterium
KGTIGDGSR

SEQ ID NO: 512324 - protein, 5 aa, Mycobacterium
KGTIR

SEQ ID NO: 512325 - protein, 9 aa, Mycobacterium
KGTKDVDGD

SEQ ID NO: 512326 - protein, 6 aa, Mycobacterium
KGTKID

SEQ ID NO: 512327 - protein, 6 aa, Mycobacterium
KGTLHN

SEQ ID NO: 512328 - protein, 7 aa, Mycobacterium
KGTLHNR

SEQ ID NO: 512329 - protein, 6 aa, Mycobacterium
KGTLKE

SEQ ID NO: 512330 - protein, 6 aa, Mycobacterium
KGTNDF

SEQ ID NO: 512331 - protein, 22 aa, Mycobacterium
KGTNGNSSPATCDTCGGRGEIQ

SEQ ID NO: 512332 - protein, 4 aa, Mycobacterium
KGTP

SEQ ID NO: 512333 - protein, 7 aa, Mycobacterium
KGTPGLS

SEQ ID NO: 512334 - protein, 13 aa, Mycobacterium
KGTPGLSFGAPER

SEQ ID NO: 512335 - protein, 6 aa, Mycobacterium
KGTPQQ

SEQ ID NO: 512336 - protein, 7 aa, Mycobacterium
KGTPRSR

SEQ ID NO: 512337 - protein, 17 aa, Mycobacterium
KGTPSDAGTPPVSAGSS

SEQ ID NO: 512338 - protein, 8 aa, Mycobacterium
KGTQPQAA

SEQ ID NO: 512339 - protein, 9 aa, Mycobacterium
KGTQPQAAK

SEQ ID NO: 512340 - protein, 8 aa, Mycobacterium
KGTRAHSA

SEQ ID NO: 512341 - protein, 15 aa, Mycobacterium
KGTRLARPIDAVREI

SEQ ID NO: 512342 - protein, 15 aa, Mycobacterium
KGTRLARPVDAVREI

SEQ ID NO: 512343 - protein, 8 aa, Mycobacterium
KGTRVTPS

SEQ ID NO: 512344 - protein, 4 aa, Mycobacterium
KGTS

SEQ ID NO: 512345 - protein, 7 aa, Mycobacterium
KGTSGID

SEQ ID NO: 512346 - protein, 11 aa, Mycobacterium
KGTSLSTYTPD

SEQ ID NO: 512347 - protein, 9 aa, Mycobacterium
KGTSTARGR

SEQ ID NO: 512348 - protein, 6 aa, Mycobacterium
KGTTSR

SEQ ID NO: 512349 - protein, 6 aa, Mycobacterium
KGTTTA

SEQ ID NO: 512350 - protein, 6 aa, Mycobacterium
KGTTTG

SEQ ID NO: 512351 - protein, 7 aa, Mycobacterium
KGTVASQ

SEQ ID NO: 512352 - protein, 16 aa, Mycobacterium
KGTVERNASFDSSGTT

SEQ ID NO: 512353 - protein, 7 aa, Mycobacterium
KGTVESG

SEQ ID NO: 512354 - protein, 8 aa, Mycobacterium
KGVADRRQ

SEQ ID NO: 512355 - protein, 19 aa, Mycobacterium
KGVAGASTYSASKAAVESL

SEQ ID NO: 512356 - protein, 7 aa, Mycobacterium
KGVDEAR

SEQ ID NO: 512357 - protein, 8 aa, Mycobacterium
KGVDESDV

SEQ ID NO: 512358 - protein, 8 aa, Mycobacterium
KGVDNRHQ

SEQ ID NO: 512359 - protein, 6 aa, Mycobacterium
KGVDPA

SEQ ID NO: 512360 - protein, 7 aa, Mycobacterium
KGVEEAR

SEQ ID NO: 512361 - protein, 7 aa, Mycobacterium
KGVGGYE

SEQ ID NO: 512362 - protein, 4 aa, Mycobacterium
KGVI

SEQ ID NO: 512363 - protein, 6 aa, Mycobacterium
KGVKEP

SEQ ID NO: 512364 - protein, 7 aa, Mycobacterium
KGVPDGR

SEQ ID NO: 512365 - protein, 7 aa, Mycobacterium
KGVPEGQ

SEQ ID NO: 512366 - protein, 6 aa, Mycobacterium
KGVPTP

SEQ ID NO: 512367 - protein, 16 aa, Mycobacterium
KGVRDNGKYYYFYLER

SEQ ID NO: 512368 - protein, 8 aa, Mycobacterium
KGVRELPN

SEQ ID NO: 512369 - protein, 7 aa, Mycobacterium
KGVRRTR

SEQ ID NO: 512370 - protein, 9 aa, Mycobacterium
KGVRTRDGV

SEQ ID NO: 512371 - protein, 4 aa, Mycobacterium
KGVS

SEQ ID NO: 512372 - protein, 6 aa, Mycobacterium
KGVSAT

SEQ ID NO: 512373 - protein, 10 aa, Mycobacterium
KGVSEETTTG

SEQ ID NO: 512374 - protein, 9 aa, Mycobacterium
KGVSGEAAH

SEQ ID NO: 512375 - protein, 10 aa, Mycobacterium
KGVSGSSASV

SEQ ID NO: 512376 - protein, 4 aa, Mycobacterium
KGVT

SEQ ID NO: 512377 - protein, 9 aa, Mycobacterium
KGVTEETTT

SEQ ID NO: 512378 - protein, 10 aa, Mycobacterium
KGVTGESGYP

SEQ ID NO: 512379 - protein, 5 aa, Mycobacterium
KGVTV

SEQ ID NO: 512380 - protein, 6 aa, Mycobacterium
KGVTVE

SEQ ID NO: 512381 - protein, 7 aa, Mycobacterium
KGWEGRR

SEQ ID NO: 512382 - protein, 16 aa, Mycobacterium
KGWNPATQAVDPAGTT

SEQ ID NO: 512383 - protein, 27 aa, Mycobacterium
KGWPLDDPREPADHGEEPGSGQATDHP

SEQ ID NO: 512384 - protein, 18 aa, Mycobacterium
KGWTGPATVDGKKVEGTW

SEQ ID NO: 512385 - protein, 8 aa, Mycobacterium
KGWTGPDY

SEQ ID NO: 512386 - protein, 5 aa, Mycobacterium
KGYAN

SEQ ID NO: 512387 - protein, 7 aa, Mycobacterium
KGYDGRT

SEQ ID NO: 512388 - protein, 6 aa, Mycobacterium
KGYGEV

SEQ ID NO: 512389 - protein, 6 aa, Mycobacterium
KGYLDG

SEQ ID NO: 512390 - protein, 15 aa, Mycobacterium
KGYLTPGANGVSRDD

SEQ ID NO: 512391 - protein, 8 aa, Mycobacterium
KGYPGAGH

SEQ ID NO: 512392 - protein, 11 aa, Mycobacterium
KGYQQGDPYGN

SEQ ID NO: 512393 - protein, 27 aa, Mycobacterium
KGYSATGIDGSAGAIERARANAEKAGV

SEQ ID NO: 512394 - protein, 27 aa, Mycobacterium
KGYSATGIDGSATAIERARDNAAKAGV

SEQ ID NO: 512395 - protein, 6 aa, Mycobacterium
KGYSDN

SEQ ID NO: 512396 - protein, 11 aa, Mycobacterium
KGYSQGDPYGN

SEQ ID NO: 512397 - protein, 8 aa, Mycobacterium
KGYSTPAH

SEQ ID NO: 512398 - protein, 11 aa, Mycobacterium
KGYSTPAHSTA

SEQ ID NO: 512399 - protein, 7 aa, Mycobacterium
KGYSTRA

SEQ ID NO: 512400 - protein, 9 aa, Mycobacterium
KGYSTRAHS

SEQ ID NO: 512401 - protein, 6 aa, Mycobacterium
KGYYGA

SEQ ID NO: 512402 - protein, 7 aa, Mycobacterium
KGYYGAS

SEQ ID NO: 512403 - protein, 10 aa, Mycobacterium
KHAANNPKAH

SEQ ID NO: 512404 - protein, 8 aa, Mycobacterium
KHAEPSQV

SEQ ID NO: 512405 - protein, 8 aa, Mycobacterium
KHAGDTPA

SEQ ID NO: 512406 - protein, 10 aa, Mycobacterium
KHAGTGGAVS

SEQ ID NO: 512407 - protein, 5 aa, Mycobacterium
KHAPA

SEQ ID NO: 512408 - protein, 6 aa, Mycobacterium
KHAPAA

SEQ ID NO: 512409 - protein, 5 aa, Mycobacterium
KHAPG

SEQ ID NO: 512410 - protein, 5 aa, Mycobacterium
KHDAA

SEQ ID NO: 512411 - protein, 7 aa, Mycobacterium
KHDDKLA

SEQ ID NO: 512412 - protein, 6 aa, Mycobacterium
KHDDYD

SEQ ID NO: 512413 - protein, 6 aa, Mycobacterium
KHDETA

SEQ ID NO: 512414 - protein, 5 aa, Mycobacterium
KHDEV

SEQ ID NO: 512415 - protein, 6 aa, Mycobacterium
KHDPAG

SEQ ID NO: 512416 - protein, 20 aa, Mycobacterium
KHDPAGRGAPNSRNGTRTKT

SEQ ID NO: 512417 - protein, 20 aa, Mycobacterium
KHDPAGRGSGNSRNDTRAKT

SEQ ID NO: 512418 - protein, 19 aa, Mycobacterium
KHDPVGRGSGNARNGTRAK

SEQ ID NO: 512419 - protein, 11 aa, Mycobacterium
KHDRDKVTESL

SEQ ID NO: 512420 - protein, 4 aa, Mycobacterium
KHEA

SEQ ID NO: 512421 - protein, 6 aa, Mycobacterium
KHEADR

SEQ ID NO: 512422 - protein, 6 aa, Mycobacterium
KHEGDW

SEQ ID NO: 512423 - protein, 6 aa, Mycobacterium
KHEPAF

SEQ ID NO: 512424 - protein, 6 aa, Mycobacterium
KHEPAY

SEQ ID NO: 512425 - protein, 7 aa, Mycobacterium
KHEPEYS

SEQ ID NO: 512426 - protein, 7 aa, Mycobacterium
KHEPGAY

SEQ ID NO: 512427 - protein, 6 aa, Mycobacterium
KHEQIT

SEQ ID NO: 512428 - protein, 9 aa, Mycobacterium
KHESTQEIT

SEQ ID NO: 512429 - protein, 17 aa, Mycobacterium
KHETMPPEKRTAEPVTG

SEQ ID NO: 512430 - protein, 4 aa, Mycobacterium
KHGA

SEQ ID NO: 512431 - protein, 9 aa, Mycobacterium
KHGAEPTCN

SEQ ID NO: 512432 - protein, 16 aa, Mycobacterium
KHGAKNLTRQLNSRGI

SEQ ID NO: 512433 - protein, 9 aa, Mycobacterium
KHGAPARRQ

SEQ ID NO: 512434 - protein, 13 aa, Mycobacterium
KHGAQPSESVESD

SEQ ID NO: 512435 - protein, 10 aa, Mycobacterium
KHGASSEQAR

SEQ ID NO: 512436 - protein, 11 aa, Mycobacterium
KHGASSKEARS

SEQ ID NO: 512437 - protein, 9 aa, Mycobacterium
KHGDARRTR

SEQ ID NO: 512438 - protein, 8 aa, Mycobacterium
KHGDDRRT

SEQ ID NO: 512439 - protein, 7 aa, Mycobacterium
KHGDEAV

SEQ ID NO: 512440 - protein, 8 aa, Mycobacterium
KHGDERRT

SEQ ID NO: 512441 - protein, 4 aa, Mycobacterium
KHGE

SEQ ID NO: 512442 - protein, 8 aa, Mycobacterium
KHGEEGPF

SEQ ID NO: 512443 - protein, 6 aa, Mycobacterium
KHGNKI

SEQ ID NO: 512444 - protein, 13 aa, Mycobacterium
KHGPAGDRRYTYE

SEQ ID NO: 512445 - protein, 5 aa, Mycobacterium
KHGPP

SEQ ID NO: 512446 - protein, 8 aa, Mycobacterium
KHGPQGSL

SEQ ID NO: 512447 - protein, 10 aa, Mycobacterium
KHGPTGAREL

SEQ ID NO: 512448 - protein, 10 aa, Mycobacterium
KHGQPPPNGL

SEQ ID NO: 512449 - protein, 6 aa, Mycobacterium
KHGREP

SEQ ID NO: 512450 - protein, 9 aa, Mycobacterium
KHGRHANDQ

SEQ ID NO: 512451 - protein, 7 aa, Mycobacterium
KHGSDEL

SEQ ID NO: 512452 - protein, 11 aa, Mycobacterium
KHGSNTIERDR

SEQ ID NO: 512453 - protein, 7 aa, Mycobacterium
KHGSYSW

SEQ ID NO: 512454 - protein, 10 aa, Mycobacterium
KHGTASGTLT

SEQ ID NO: 512455 - protein, 7 aa, Mycobacterium
KHGYSDV

SEQ ID NO: 512456 - protein, 7 aa, Mycobacterium
KHIDGQG

SEQ ID NO: 512457 - protein, 4 aa, Mycobacterium
KHKP

SEQ ID NO: 512458 - protein, 5 aa, Mycobacterium
KHKVP

SEQ ID NO: 512459 - protein, 8 aa, Mycobacterium
KHLEPGQA

SEQ ID NO: 512460 - protein, 10 aa, Mycobacterium
KHLPTNDGRK

SEQ ID NO: 512461 - protein, 5 aa, Mycobacterium
KHLSD

SEQ ID NO: 512462 - protein, 9 aa, Mycobacterium
KHNGEGPWN

SEQ ID NO: 512463 - protein, 10 aa, Mycobacterium
KHNKETARKR

SEQ ID NO: 512464 - protein, 7 aa, Mycobacterium
KHNKTPA

SEQ ID NO: 512465 - protein, 8 aa, Mycobacterium
KHNPDVPA

SEQ ID NO: 512466 - protein, 8 aa, Mycobacterium
KHNSPPAL

SEQ ID NO: 512467 - protein, 12 aa, Mycobacterium
KHPAPQNFEEAT

SEQ ID NO: 512468 - protein, 12 aa, Mycobacterium
KHPAPQTYEEAA

SEQ ID NO: 512469 - protein, 11 aa, Mycobacterium
KHPAPQTYQEA

SEQ ID NO: 512470 - protein, 7 aa, Mycobacterium
KHPDADI

SEQ ID NO: 512471 - protein, 9 aa, Mycobacterium
KHPDDKATV

SEQ ID NO: 512472 - protein, 8 aa, Mycobacterium
KHPDDRDQ

SEQ ID NO: 512473 - protein, 10 aa, Mycobacterium
KHPDDRGQVA

SEQ ID NO: 512474 - protein, 8 aa, Mycobacterium
KHPDGRPH

SEQ ID NO: 512475 - protein, 8 aa, Mycobacterium
KHPDGRPY

SEQ ID NO: 512476 - protein, 5 aa, Mycobacterium
KHPDL

SEQ ID NO: 512477 - protein, 6 aa, Mycobacterium
KHPDRV

SEQ ID NO: 512478 - protein, 6 aa, Mycobacterium
KHPEAA

SEQ ID NO: 512479 - protein, 8 aa, Mycobacterium
KHPELSPQ

SEQ ID NO: 512480 - protein, 6 aa, Mycobacterium
KHPENV

SEQ ID NO: 512481 - protein, 4 aa, Mycobacterium
KHPG

SEQ ID NO: 512482 - protein, 5 aa, Mycobacterium
KHPGA

SEQ ID NO: 512483 - protein, 14 aa, Mycobacterium
KHPGTGGAVTTGTV

SEQ ID NO: 512484 - protein, 14 aa, Mycobacterium
KHPGTGGLVSPDTV

SEQ ID NO: 512485 - protein, 7 aa, Mycobacterium
KHPHRSI

SEQ ID NO: 512486 - protein, 6 aa, Mycobacterium
KHPNAQ

SEQ ID NO: 512487 - protein, 6 aa, Mycobacterium
KHPPQS

SEQ ID NO: 512488 - protein, 9 aa, Mycobacterium
KHPPSHERQ

SEQ ID NO: 512489 - protein, 5 aa, Mycobacterium
KHPQG

SEQ ID NO: 512490 - protein, 45 aa, Mycobacterium
KHPRARAGLDRASRRIPADAPLPQTPARNLPPLDRRGDPSHYCPE

SEQ ID NO: 512491 - protein, 16 aa, Mycobacterium
KHPRGAFGADPSVSGL

SEQ ID NO: 512492 - protein, 10 aa, Mycobacterium
KHPRGAFTED

SEQ ID NO: 512493 - protein, 12 aa, Mycobacterium
KHPRGAFTEDPG

SEQ ID NO: 512494 - protein, 10 aa, Mycobacterium
KHPRGRAGWD

SEQ ID NO: 512495 - protein, 9 aa, Mycobacterium
KHPRSPLET

SEQ ID NO: 512496 - protein, 5 aa, Mycobacterium
KHPSA

SEQ ID NO: 512497 - protein, 11 aa, Mycobacterium
KHPSEQPPSRA

SEQ ID NO: 512498 - protein, 9 aa, Mycobacterium
KHPSGGPVS

SEQ ID NO: 512499 - protein, 6 aa, Mycobacterium
KHPTRD

SEQ ID NO: 512500 - protein, 5 aa, Mycobacterium
KHQNP

SEQ ID NO: 512501 - protein, 12 aa, Mycobacterium
KHQSADSGPRAL

SEQ ID NO: 512502 - protein, 16 aa, Mycobacterium
KHRDTDNVPEQSEGDA

SEQ ID NO: 512503 - protein, 16 aa, Mycobacterium
KHRGHATELGEAAAAA

SEQ ID NO: 512504 - protein, 8 aa, Mycobacterium
KHRHDTAS

SEQ ID NO: 512505 - protein, 10 aa, Mycobacterium
KHRKDGTLTE

SEQ ID NO: 512506 - protein, 9 aa, Mycobacterium
KHRNDGTLT

SEQ ID NO: 512507 - protein, 12 aa, Mycobacterium
KHRNDPDPAPCG

SEQ ID NO: 512508 - protein, 7 aa, Mycobacterium
KHRPNQA

SEQ ID NO: 512509 - protein, 6 aa, Mycobacterium
KHRPRT

SEQ ID NO: 512510 - protein, 6 aa, Mycobacterium
KHRPSA

SEQ ID NO: 512511 - protein, 7 aa, Mycobacterium
KHRSKNF

SEQ ID NO: 512512 - protein, 7 aa, Mycobacterium
KHRSTNF

SEQ ID NO: 512513 - protein, 10 aa, Mycobacterium
KHRVSGPKGD

SEQ ID NO: 512514 - protein, 6 aa, Mycobacterium
KHRYGG

SEQ ID NO: 512515 - protein, 7 aa, Mycobacterium
KHRYGGT

SEQ ID NO: 512516 - protein, 5 aa, Mycobacterium
KHSDC

SEQ ID NO: 512517 - protein, 5 aa, Mycobacterium
KHSEL

SEQ ID NO: 512518 - protein, 16 aa, Mycobacterium
KHSFAERGEHELKGVP

SEQ ID NO: 512519 - protein, 8 aa, Mycobacterium
KHSGGEFT

SEQ ID NO: 512520 - protein, 8 aa, Mycobacterium
KHSGLSDR

SEQ ID NO: 512521 - protein, 10 aa, Mycobacterium
KHSRMSVGST

SEQ ID NO: 512522 - protein, 9 aa, Mycobacterium
KHSRSTGRI

SEQ ID NO: 512523 - protein, 11 aa, Mycobacterium
KHSRTQVGSSG

SEQ ID NO: 512524 - protein, 11 aa, Mycobacterium
KHSVNNPYSQF

SEQ ID NO: 512525 - protein, 18 aa, Mycobacterium
KHTAESRTERGAASGGIV

SEQ ID NO: 512526 - protein, 6 aa, Mycobacterium
KHTDAT

SEQ ID NO: 512527 - protein, 9 aa, Mycobacterium
KHTDGASCQ

SEQ ID NO: 512528 - protein, 6 aa, Mycobacterium
KHTDTA

SEQ ID NO: 512529 - protein, 4 aa, Mycobacterium
KHTE

SEQ ID NO: 512530 - protein, 34 aa, Mycobacterium
KHTEAGEGRPARTPRRGGGRGQQRPTRKAGNSGS

SEQ ID NO: 512531 - protein, 9 aa, Mycobacterium
KHTKNDRLD

SEQ ID NO: 512532 - protein, 18 aa, Mycobacterium
KHTPQSANERGASSGGIV

SEQ ID NO: 512533 - protein, 4 aa, Mycobacterium
KHTR

SEQ ID NO: 512534 - protein, 10 aa, Mycobacterium
KHTVSGPKGD

SEQ ID NO: 512535 - protein, 10 aa, Mycobacterium
KHVENEATHY

SEQ ID NO: 512536 - protein, 4 aa, Mycobacterium
KHVP

SEQ ID NO: 512537 - protein, 16 aa, Mycobacterium
KHVQEGDAETAPLSNP

SEQ ID NO: 512538 - protein, 16 aa, Mycobacterium
KHVQQGDAETAPLSNP

SEQ ID NO: 512539 - protein, 17 aa, Mycobacterium
KHVRTTKADPAAPRHPD

SEQ ID NO: 512540 - protein, 6 aa, Mycobacterium
KHWQSS

SEQ ID NO: 512541 - protein, 9 aa, Mycobacterium
KHYGSTTAV

SEQ ID NO: 512542 - protein, 11 aa, Mycobacterium
KHYQGDDTDLK

SEQ ID NO: 512543 - protein, 4 aa, Mycobacterium
KIAA

SEQ ID NO: 512544 - protein, 13 aa, Mycobacterium
KIAAAKKTFAETG

SEQ ID NO: 512545 - protein, 6 aa, Mycobacterium
KIADDG

SEQ ID NO: 512546 - protein, 7 aa, Mycobacterium
KIADDGE

SEQ ID NO: 512547 - protein, 14 aa, Mycobacterium
KIAEDVREGMEKTQ

SEQ ID NO: 512548 - protein, 7 aa, Mycobacterium
KIAEGTK

SEQ ID NO: 512549 - protein, 4 aa, Mycobacterium
KIAG

SEQ ID NO: 512550 - protein, 8 aa, Mycobacterium
KIAGGETV

SEQ ID NO: 512551 - protein, 12 aa, Mycobacterium
KIAKDRGVGGPV

SEQ ID NO: 512552 - protein, 4 aa, Mycobacterium
KIAN

SEQ ID NO: 512553 - protein, 6 aa, Mycobacterium
KIANNE

SEQ ID NO: 512554 - protein, 11 aa, Mycobacterium
KIAPPGGRTTS

SEQ ID NO: 512555 - protein, 27 aa, Mycobacterium
KIAPPPPNPPVPSEDDVQPRPRRHLQV

SEQ ID NO: 512556 - protein, 6 aa, Mycobacterium
KIAPSM

SEQ ID NO: 512557 - protein, 10 aa, Mycobacterium
KIARDGAGTI

SEQ ID NO: 512558 - protein, 15 aa, Mycobacterium
KIASRRAQTVTGPAE

SEQ ID NO: 512559 - protein, 6 aa, Mycobacterium
KIATDA

SEQ ID NO: 512560 - protein, 5 aa, Mycobacterium
KIDAE

SEQ ID NO: 512561 - protein, 4 aa, Mycobacterium
KIDE

SEQ ID NO: 512562 - protein, 9 aa, Mycobacterium
KIDEDSDVD

SEQ ID NO: 512563 - protein, 10 aa, Mycobacterium
KIDEDSDVDR

SEQ ID NO: 512564 - protein, 10 aa, Mycobacterium
KIDEDSDVDS

SEQ ID NO: 512565 - protein, 6 aa, Mycobacterium
KIDEGM

SEQ ID NO: 512566 - protein, 5 aa, Mycobacterium
KIDGD

SEQ ID NO: 512567 - protein, 12 aa, Mycobacterium
KIDPEADVDAAR

SEQ ID NO: 512568 - protein, 10 aa, Mycobacterium
KIDPSHTRSR

SEQ ID NO: 512569 - protein, 4 aa, Mycobacterium
KIDS

SEQ ID NO: 512570 - protein, 7 aa, Mycobacterium
KIDSDAH

SEQ ID NO: 512571 - protein, 9 aa, Mycobacterium
KIEADPANP

SEQ ID NO: 512572 - protein, 6 aa, Mycobacterium
KIEAGA

SEQ ID NO: 512573 - protein, 9 aa, Mycobacterium
KIEEDPANP

SEQ ID NO: 512574 - protein, 6 aa, Mycobacterium
KIEEGQ

SEQ ID NO: 512575 - protein, 6 aa, Mycobacterium
KIEGGS

SEQ ID NO: 512576 - protein, 8 aa, Mycobacterium
KIEKGQPL

SEQ ID NO: 512577 - protein, 4 aa, Mycobacterium
KIEP

SEQ ID NO: 512578 - protein, 12 aa, Mycobacterium
KIEPAGGEISRS

SEQ ID NO: 512579 - protein, 27 aa, Mycobacterium
KIEPPQGDPLRRYSPSCSPVPDGLPAS

SEQ ID NO: 512580 - protein, 13 aa, Mycobacterium
KIEPRGGEISRSV

SEQ ID NO: 512581 - protein, 7 aa, Mycobacterium
KIESGAQ

SEQ ID NO: 512582 - protein, 25 aa, Mycobacterium
KIESRSSTAAGSAELDAESAEGRAV

SEQ ID NO: 512583 - protein, 7 aa, Mycobacterium
KIGAAKP

SEQ ID NO: 512584 - protein, 10 aa, Mycobacterium
KIGAASAGAV

SEQ ID NO: 512585 - protein, 5 aa, Mycobacterium
KIGAD

SEQ ID NO: 512586 - protein, 5 aa, Mycobacterium
KIGAT

SEQ ID NO: 512587 - protein, 67 aa, Mycobacterium
KIGDAGAAAEPKPEPKPEPKAEPKPEPKPEPKPEPKAEPKPEPKPEPKPEPKAEPAPAASSDGSPYV

SEQ ID NO: 512588 - protein, 85 aa, Mycobacterium
KIGDAGAEEESEPEPEPEPEPEPEPEPEPKQTKPESKPSEEAAPEPKSESKPEAESKPEPKPKPEPEPKRESKPEAESSGDSPYV

SEQ ID NO: 512589 - protein, 8 aa, Mycobacterium
KIGDRALS

SEQ ID NO: 512590 - protein, 12 aa, Mycobacterium
KIGGDANAGEGG

SEQ ID NO: 512591 - protein, 13 aa, Mycobacterium
KIGGDANAGEGGT

SEQ ID NO: 512592 - protein, 14 aa, Mycobacterium
KIGGGEVQAGEGGT

SEQ ID NO: 512593 - protein, 22 aa, Mycobacterium
KIGGRGKAGGVKYAATPDDAYQ

SEQ ID NO: 512594 - protein, 13 aa, Mycobacterium
KIGPKRSPLHTPE

SEQ ID NO: 512595 - protein, 7 aa, Mycobacterium
KIGPKTA

SEQ ID NO: 512596 - protein, 9 aa, Mycobacterium
KIGQYSADT

SEQ ID NO: 512597 - protein, 11 aa, Mycobacterium
KIGRKSVDGRE

SEQ ID NO: 512598 - protein, 6 aa, Mycobacterium
KIGSEE

SEQ ID NO: 512599 - protein, 11 aa, Mycobacterium
KIGSPGASRAV

SEQ ID NO: 512600 - protein, 9 aa, Mycobacterium
KIGTTGRGI

SEQ ID NO: 512601 - protein, 12 aa, Mycobacterium
KIGTTGRGIGPC

SEQ ID NO: 512602 - protein, 6 aa, Mycobacterium
KIGVSE

SEQ ID NO: 512603 - protein, 6 aa, Mycobacterium
KIGYPP

SEQ ID NO: 512604 - protein, 7 aa, Mycobacterium
KIGYPPT

SEQ ID NO: 512605 - protein, 17 aa, Mycobacterium
KIKDPVKREARIKSPGV

SEQ ID NO: 512606 - protein, 15 aa, Mycobacterium
KIKKGPDDQAGSPTI

SEQ ID NO: 512607 - protein, 12 aa, Mycobacterium
KIKKGPNDQEAA

SEQ ID NO: 512608 - protein, 5 aa, Mycobacterium
KIKTR

SEQ ID NO: 512609 - protein, 9 aa, Mycobacterium
KINDPKFKS

SEQ ID NO: 512610 - protein, 10 aa, Mycobacterium
KINRPAGGPK

SEQ ID NO: 512611 - protein, 4 aa, Mycobacterium
KIPA

SEQ ID NO: 512612 - protein, 38 aa, Mycobacterium
KIPAGGSGGDGGTGGIGGDGGLGGDGGAGGQGGAGGRA

SEQ ID NO: 512613 - protein, 6 aa, Mycobacterium
KIPASY

SEQ ID NO: 512614 - protein, 8 aa, Mycobacterium
KIPATEPT

SEQ ID NO: 512615 - protein, 7 aa, Mycobacterium
KIPATTS

SEQ ID NO: 512616 - protein, 6 aa, Mycobacterium
KIPDSA

SEQ ID NO: 512617 - protein, 19 aa, Mycobacterium
KIPDYNSIDPASVSVSPDG

SEQ ID NO: 512618 - protein, 7 aa, Mycobacterium
KIPEAQQ

SEQ ID NO: 512619 - protein, 7 aa, Mycobacterium
KIPGDGR

SEQ ID NO: 512620 - protein, 12 aa, Mycobacterium
KIPGGTPATPAL

SEQ ID NO: 512621 - protein, 9 aa, Mycobacterium
KIPGKASQQ

SEQ ID NO: 512622 - protein, 7 aa, Mycobacterium
KIPNGIG

SEQ ID NO: 512623 - protein, 8 aa, Mycobacterium
KIPPGSDG

SEQ ID NO: 512624 - protein, 7 aa, Mycobacterium
KIPPSPD

SEQ ID NO: 512625 - protein, 8 aa, Mycobacterium
KIPPTGSR

SEQ ID NO: 512626 - protein, 7 aa, Mycobacterium
KIPSGQM

SEQ ID NO: 512627 - protein, 7 aa, Mycobacterium
KIPSGRM

SEQ ID NO: 512628 - protein, 4 aa, Mycobacterium
KIPT

SEQ ID NO: 512629 - protein, 8 aa, Mycobacterium
KIPTEPEL

SEQ ID NO: 512630 - protein, 7 aa, Mycobacterium
KIPTERT

SEQ ID NO: 512631 - protein, 7 aa, Mycobacterium
KIPVTTD

SEQ ID NO: 512632 - protein, 9 aa, Mycobacterium
KIQAAGPLG

SEQ ID NO: 512633 - protein, 10 aa, Mycobacterium
KIQPGTSAAA

SEQ ID NO: 512634 - protein, 7 aa, Mycobacterium
KIQSGEM

SEQ ID NO: 512635 - protein, 7 aa, Mycobacterium
KIRDNPR

SEQ ID NO: 512636 - protein, 6 aa, Mycobacterium
KIREGE

SEQ ID NO: 512637 - protein, 8 aa, Mycobacterium
KIREPGED

SEQ ID NO: 512638 - protein, 10 aa, Mycobacterium
KIREPNRTVS

SEQ ID NO: 512639 - protein, 27 aa, Mycobacterium
KIRGDQSAHDTESLRTARDVDTATSEA

SEQ ID NO: 512640 - protein, 7 aa, Mycobacterium
KIRNGDP

SEQ ID NO: 512641 - protein, 22 aa, Mycobacterium
KIRSGRGSRPRTKTRPGHADAQ

SEQ ID NO: 512642 - protein, 6 aa, Mycobacterium
KISAAG

SEQ ID NO: 512643 - protein, 7 aa, Mycobacterium
KISDEGL

SEQ ID NO: 512644 - protein, 17 aa, Mycobacterium
KISDHKKSLDQRRVDEE

SEQ ID NO: 512645 - protein, 10 aa, Mycobacterium
KISDSTTPAL

SEQ ID NO: 512646 - protein, 6 aa, Mycobacterium
KISDTR

SEQ ID NO: 512647 - protein, 61 aa, Mycobacterium
KISEAKEARQAKLKAAKEAKKAKAAAKAEAKAAKAAAKDTKSNTGSESKGSGESKGGSDSS

SEQ ID NO: 512648 - protein, 4 aa, Mycobacterium
KISG

SEQ ID NO: 512649 - protein, 20 aa, Mycobacterium
KISGVSADEEARMQQAGDRA

SEQ ID NO: 512650 - protein, 4 aa, Mycobacterium
KISI

SEQ ID NO: 512651 - protein, 11 aa, Mycobacterium
KISNDGRNVSL

SEQ ID NO: 512652 - protein, 8 aa, Mycobacterium
KISPDAIA

SEQ ID NO: 512653 - protein, 4 aa, Mycobacterium
KISR

SEQ ID NO: 512654 - protein, 5 aa, Mycobacterium
KISTD

SEQ ID NO: 512655 - protein, 109 aa, Mycobacterium
KISTDSDAEQADVPAERTSSKPAVDDAADDDEAAANEDAEADAADAKVDAKEDAEAAVKDDADASAGTNDDGEEGADSGSNDSAAAAGDTDSSDGSSSEGPGSSDSGSS

SEQ ID NO: 512656 - protein, 6 aa, Mycobacterium
KISTGY

SEQ ID NO: 512657 - protein, 10 aa, Mycobacterium
KISVRGDDKE

SEQ ID NO: 512658 - protein, 7 aa, Mycobacterium
KISYTGK

SEQ ID NO: 512659 - protein, 21 aa, Mycobacterium
KITADTEAGGRTVRASEEEPQ

SEQ ID NO: 512660 - protein, 10 aa, Mycobacterium
KITDGPAPGR

SEQ ID NO: 512661 - protein, 22 aa, Mycobacterium
KITDSTLPVGPPPVQPGGPPLQ

SEQ ID NO: 512662 - protein, 6 aa, Mycobacterium
KITERT

SEQ ID NO: 512663 - protein, 20 aa, Mycobacterium
KITESRRPIGPAPVQAGGPP

SEQ ID NO: 512664 - protein, 4 aa, Mycobacterium
KITG

SEQ ID NO: 512665 - protein, 7 aa, Mycobacterium
KITGTAR

SEQ ID NO: 512666 - protein, 7 aa, Mycobacterium
KITGTRK

SEQ ID NO: 512667 - protein, 6 aa, Mycobacterium
KITHPQ

SEQ ID NO: 512668 - protein, 7 aa, Mycobacterium
KITKGSL

SEQ ID NO: 512669 - protein, 15 aa, Mycobacterium
KITPDAVATTDGETH

SEQ ID NO: 512670 - protein, 5 aa, Mycobacterium
KITPR

SEQ ID NO: 512671 - protein, 14 aa, Mycobacterium
KITPSAVATTDGVD

SEQ ID NO: 512672 - protein, 7 aa, Mycobacterium
KITRDGP

SEQ ID NO: 512673 - protein, 7 aa, Mycobacterium
KITSEAL

SEQ ID NO: 512674 - protein, 63 aa, Mycobacterium
KKAAAKAGSRATKTTAKKAAAKKGAAKKGAAKKGAAKKAPAKAASKSPAKKAAPKANPNASEV

SEQ ID NO: 512675 - protein, 28 aa, Mycobacterium
KKAAAKGAGEDKKGNVDDALKMHSGGKP

SEQ ID NO: 512676 - protein, 8 aa, Mycobacterium
KKAAETAR

SEQ ID NO: 512677 - protein, 9 aa, Mycobacterium
KKAAGNVET

SEQ ID NO: 512678 - protein, 7 aa, Mycobacterium
KKAAGVT

SEQ ID NO: 512679 - protein, 19 aa, Mycobacterium
KKAARTQPRKSSLTSQQTR

SEQ ID NO: 512680 - protein, 6 aa, Mycobacterium
KKAARW

SEQ ID NO: 512681 - protein, 7 aa, Mycobacterium
KKAEAAK

SEQ ID NO: 512682 - protein, 7 aa, Mycobacterium
KKAEAIA

SEQ ID NO: 512683 - protein, 8 aa, Mycobacterium
KKAEAIDA

SEQ ID NO: 512684 - protein, 11 aa, Mycobacterium
KKAEATDAVPD

SEQ ID NO: 512685 - protein, 10 aa, Mycobacterium
KKAEDSQRRA

SEQ ID NO: 512686 - protein, 39 aa, Mycobacterium
KKAESGKKAPAKKAPAAAKKAAPAKKAPAKKAPAKKVTQ

SEQ ID NO: 512687 - protein, 13 aa, Mycobacterium
KKAFTGAAGDQVD

SEQ ID NO: 512688 - protein, 11 aa, Mycobacterium
KKAGGIDTQRR

SEQ ID NO: 512689 - protein, 9 aa, Mycobacterium
KKAGGPNLD

SEQ ID NO: 512690 - protein, 11 aa, Mycobacterium
KKAGGPNLDKR

SEQ ID NO: 512691 - protein, 10 aa, Mycobacterium
KKAGGPNLEK

SEQ ID NO: 512692 - protein, 8 aa, Mycobacterium
KKAGKPLT

SEQ ID NO: 512693 - protein, 7 aa, Mycobacterium
KKAGKQL

SEQ ID NO: 512694 - protein, 11 aa, Mycobacterium
KKAGLEPSSEH

SEQ ID NO: 512695 - protein, 5 aa, Mycobacterium
KKAGN

SEQ ID NO: 512696 - protein, 5 aa, Mycobacterium
KKAGV

SEQ ID NO: 512697 - protein, 16 aa, Mycobacterium
KKAIAGQLSADATGHG

SEQ ID NO: 512698 - protein, 11 aa, Mycobacterium
KKAKAPKYADV

SEQ ID NO: 512699 - protein, 8 aa, Mycobacterium
KKAPDEDL

SEQ ID NO: 512700 - protein, 8 aa, Mycobacterium
KKAPDPTL

SEQ ID NO: 512701 - protein, 7 aa, Mycobacterium
KKAPRAQ

SEQ ID NO: 512702 - protein, 8 aa, Mycobacterium
KKAPTPTI

SEQ ID NO: 512703 - protein, 6 aa, Mycobacterium
KKAQEA

SEQ ID NO: 512704 - protein, 25 aa, Mycobacterium
KKAQHTDHTTDPDAGTDAGTDAVAA

SEQ ID NO: 512705 - protein, 18 aa, Mycobacterium
KKAQKTRRREKKNVPHGA

SEQ ID NO: 512706 - protein, 5 aa, Mycobacterium
KKAQL

SEQ ID NO: 512707 - protein, 6 aa, Mycobacterium
KKAQRQ

SEQ ID NO: 512708 - protein, 13 aa, Mycobacterium
KKARKKAKAKKKN

SEQ ID NO: 512709 - protein, 6 aa, Mycobacterium
KKARSG

SEQ ID NO: 512710 - protein, 8 aa, Mycobacterium
KKARTAAF

SEQ ID NO: 512711 - protein, 9 aa, Mycobacterium
KKARTRGGY

SEQ ID NO: 512712 - protein, 7 aa, Mycobacterium
KKASDVA

SEQ ID NO: 512713 - protein, 10 aa, Mycobacterium
KKASGQATPL

SEQ ID NO: 512714 - protein, 14 aa, Mycobacterium
KKASGSSTSADNTF

SEQ ID NO: 512715 - protein, 17 aa, Mycobacterium
KKASNGSTLIPPDGELT

SEQ ID NO: 512716 - protein, 8 aa, Mycobacterium
KKATAGEI

SEQ ID NO: 512717 - protein, 9 aa, Mycobacterium
KKATAKSVA

SEQ ID NO: 512718 - protein, 9 aa, Mycobacterium
KKATGNVET

SEQ ID NO: 512719 - protein, 10 aa, Mycobacterium
KKATRPEVRG

SEQ ID NO: 512720 - protein, 7 aa, Mycobacterium
KKAVEAV

SEQ ID NO: 512721 - protein, 11 aa, Mycobacterium
KKCCKSKPRCT

SEQ ID NO: 512722 - protein, 8 aa, Mycobacterium
KKCCRSKP

SEQ ID NO: 512723 - protein, 24 aa, Mycobacterium
KKDADTPKPAGPAQQPDRMPESAA

SEQ ID NO: 512724 - protein, 4 aa, Mycobacterium
KKDD

SEQ ID NO: 512725 - protein, 6 aa, Mycobacterium
KKDDYA

SEQ ID NO: 512726 - protein, 28 aa, Mycobacterium
KKDGDAGEDDVTRAEKDLDKSTHQYTSQ

SEQ ID NO: 512727 - protein, 25 aa, Mycobacterium
KKDGEAGEDEVGRAEKDLDKTTAQY

SEQ ID NO: 512728 - protein, 26 aa, Mycobacterium
KKDGEAGEDEVSRAEKDLDKSTHTYT

SEQ ID NO: 512729 - protein, 17 aa, Mycobacterium
KKDGLSGYPSRSESEHD

SEQ ID NO: 512730 - protein, 17 aa, Mycobacterium
KKDGTNESRDADIEAGQ

SEQ ID NO: 512731 - protein, 17 aa, Mycobacterium
KKDGTTESQEADIQAGQ

SEQ ID NO: 512732 - protein, 14 aa, Mycobacterium
KKDHDEKRLTSCGR

SEQ ID NO: 512733 - protein, 13 aa, Mycobacterium
KKDMKAAAKAAKN

SEQ ID NO: 512734 - protein, 6 aa, Mycobacterium
KKDPEA

SEQ ID NO: 512735 - protein, 6 aa, Mycobacterium
KKDPFS

SEQ ID NO: 512736 - protein, 14 aa, Mycobacterium
KKDPFSARPLEGPR

SEQ ID NO: 512737 - protein, 14 aa, Mycobacterium
KKDPFSRRPLEGPR

SEQ ID NO: 512738 - protein, 14 aa, Mycobacterium
KKDPFSRRPLQGPR

SEQ ID NO: 512739 - protein, 14 aa, Mycobacterium
KKDPQIAASASTLR

SEQ ID NO: 512740 - protein, 7 aa, Mycobacterium
KKDTELR

SEQ ID NO: 512741 - protein, 15 aa, Mycobacterium
KKEAESVATGRAGEV

SEQ ID NO: 512742 - protein, 10 aa, Mycobacterium
KKEDPEGARM

SEQ ID NO: 512743 - protein, 14 aa, Mycobacterium
KKEHDDKRLTSCGR

SEQ ID NO: 512744 - protein, 6 aa, Mycobacterium
KKEKRF

SEQ ID NO: 512745 - protein, 8 aa, Mycobacterium
KKELQNDP

SEQ ID NO: 512746 - protein, 6 aa, Mycobacterium
KKENGV

SEQ ID NO: 512747 - protein, 9 aa, Mycobacterium
KKENPKFPA

SEQ ID NO: 512748 - protein, 8 aa, Mycobacterium
KKEQTPMR

SEQ ID NO: 512749 - protein, 5 aa, Mycobacterium
KKERR

SEQ ID NO: 512750 - protein, 6 aa, Mycobacterium
KKETGV

SEQ ID NO: 512751 - protein, 6 aa, Mycobacterium
KKEVTT

SEQ ID NO: 512752 - protein, 7 aa, Mycobacterium
KKEYGEE

SEQ ID NO: 512753 - protein, 7 aa, Mycobacterium
KKEYGQE

SEQ ID NO: 512754 - protein, 5 aa, Mycobacterium
KKFES

SEQ ID NO: 512755 - protein, 9 aa, Mycobacterium
KKFKGSEAR

SEQ ID NO: 512756 - protein, 4 aa, Mycobacterium
KKFN

SEQ ID NO: 512757 - protein, 6 aa, Mycobacterium
KKFTAE

SEQ ID NO: 512758 - protein, 6 aa, Mycobacterium
KKFTEQ

SEQ ID NO: 512759 - protein, 8 aa, Mycobacterium
KKFTEQEK

SEQ ID NO: 512760 - protein, 8 aa, Mycobacterium
KKFTPPRY

SEQ ID NO: 512761 - protein, 5 aa, Mycobacterium
KKGAS

SEQ ID NO: 512762 - protein, 15 aa, Mycobacterium
KKGDKSKVLPTDAQL

SEQ ID NO: 512763 - protein, 8 aa, Mycobacterium
KKGDLHNR

SEQ ID NO: 512764 - protein, 5 aa, Mycobacterium
KKGDS

SEQ ID NO: 512765 - protein, 9 aa, Mycobacterium
KKGEASMSE

SEQ ID NO: 512766 - protein, 10 aa, Mycobacterium
KKGELSANGK

SEQ ID NO: 512767 - protein, 7 aa, Mycobacterium
KKGERIA

SEQ ID NO: 512768 - protein, 7 aa, Mycobacterium
KKGFDGE

SEQ ID NO: 512769 - protein, 8 aa, Mycobacterium
KKGFDGTE

SEQ ID NO: 512770 - protein, 6 aa, Mycobacterium
KKGGAD

SEQ ID NO: 512771 - protein, 7 aa, Mycobacterium
KKGGADW

SEQ ID NO: 512772 - protein, 7 aa, Mycobacterium
KKGGAGW

SEQ ID NO: 512773 - protein, 10 aa, Mycobacterium
KKGGLDQTRT

SEQ ID NO: 512774 - protein, 8 aa, Mycobacterium
KKGGLKKG

SEQ ID NO: 512775 - protein, 16 aa, Mycobacterium
KKGGLSGYPSRAESEH

SEQ ID NO: 512776 - protein, 9 aa, Mycobacterium
KKGGSEAEA

SEQ ID NO: 512777 - protein, 6 aa, Mycobacterium
KKGGVE

SEQ ID NO: 512778 - protein, 6 aa, Mycobacterium
KKGHPV

SEQ ID NO: 512779 - protein, 10 aa, Mycobacterium
KKGLRSSKRY

SEQ ID NO: 512780 - protein, 6 aa, Mycobacterium
KKGMPS

SEQ ID NO: 512781 - protein, 6 aa, Mycobacterium
KKGPEF

SEQ ID NO: 512782 - protein, 13 aa, Mycobacterium
KKGPGSWGGTLTP

SEQ ID NO: 512783 - protein, 4 aa, Mycobacterium
KKGQ

SEQ ID NO: 512784 - protein, 17 aa, Mycobacterium
KKGQKTRKREKKNIPHG

SEQ ID NO: 512785 - protein, 17 aa, Mycobacterium
KKGQKTRRREKKNVPHG

SEQ ID NO: 512786 - protein, 18 aa, Mycobacterium
KKGRKGKNAKKEPDRKRK

SEQ ID NO: 512787 - protein, 6 aa, Mycobacterium
KKGRTV

SEQ ID NO: 512788 - protein, 6 aa, Mycobacterium
KKGSFA

SEQ ID NO: 512789 - protein, 10 aa, Mycobacterium
KKGSGNQEVA

SEQ ID NO: 512790 - protein, 11 aa, Mycobacterium
KKGSGNQEVAT

SEQ ID NO: 512791 - protein, 10 aa, Mycobacterium
KKGSGTQEVA

SEQ ID NO: 512792 - protein, 14 aa, Mycobacterium
KKGSLGKGLGKTTG

SEQ ID NO: 512793 - protein, 8 aa, Mycobacterium
KKGTLHNR

SEQ ID NO: 512794 - protein, 8 aa, Mycobacterium
KKGVDDEV

SEQ ID NO: 512795 - protein, 10 aa, Mycobacterium
KKGYETPNGT

SEQ ID NO: 512796 - protein, 9 aa, Mycobacterium
KKHGYKGPF

SEQ ID NO: 512797 - protein, 6 aa, Mycobacterium
KKHPWE

SEQ ID NO: 512798 - protein, 8 aa, Mycobacterium
KKIAEAGG

SEQ ID NO: 512799 - protein, 17 aa, Mycobacterium
KKIAPTRPHPDTPPNPA

SEQ ID NO: 512800 - protein, 8 aa, Mycobacterium
KKIATDGA

SEQ ID NO: 512801 - protein, 7 aa, Mycobacterium
KKIGDGV

SEQ ID NO: 512802 - protein, 13 aa, Mycobacterium
KKIGTLGRKGYPV

SEQ ID NO: 512803 - protein, 13 aa, Mycobacterium
KKIGTTGRGIGPC

SEQ ID NO: 512804 - protein, 17 aa, Mycobacterium
KKIQGSVYGASDPARDI

SEQ ID NO: 512805 - protein, 8 aa, Mycobacterium
KKISMGPR

SEQ ID NO: 512806 - protein, 24 aa, Mycobacterium
KKKGYTPGQVRDRESGEPTTSSIA

SEQ ID NO: 512807 - protein, 7 aa, Mycobacterium
KKKIAAA

SEQ ID NO: 512808 - protein, 5 aa, Mycobacterium
KKKPR

SEQ ID NO: 512809 - protein, 6 aa, Mycobacterium
KKKPRV

SEQ ID NO: 512810 - protein, 12 aa, Mycobacterium
KKKRRSSPLSPL

SEQ ID NO: 512811 - protein, 4 aa, Mycobacterium
KKLA

SEQ ID NO: 512812 - protein, 9 aa, Mycobacterium
KKLAKNPLK

SEQ ID NO: 512813 - protein, 7 aa, Mycobacterium
KKLDPRT

SEQ ID NO: 512814 - protein, 9 aa, Mycobacterium
KKLGADKGM

SEQ ID NO: 512815 - protein, 8 aa, Mycobacterium
KKLGADVT

SEQ ID NO: 512816 - protein, 16 aa, Mycobacterium
KKLGPDEKGLEPPYGK

SEQ ID NO: 512817 - protein, 8 aa, Mycobacterium
KKLPAPVG

SEQ ID NO: 512818 - protein, 8 aa, Mycobacterium
KKLPPEKL

SEQ ID NO: 512819 - protein, 9 aa, Mycobacterium
KKLPPGSEV

SEQ ID NO: 512820 - protein, 8 aa, Mycobacterium
KKLQKNPL

SEQ ID NO: 512821 - protein, 8 aa, Mycobacterium
KKLSAPVG

SEQ ID NO: 512822 - protein, 5 aa, Mycobacterium
KKLTD

SEQ ID NO: 512823 - protein, 6 aa, Mycobacterium
KKLTGV

SEQ ID NO: 512824 - protein, 12 aa, Mycobacterium
KKLTNMRSSTAD

SEQ ID NO: 512825 - protein, 8 aa, Mycobacterium
KKLTRARD

SEQ ID NO: 512826 - protein, 6 aa, Mycobacterium
KKMSHQ

SEQ ID NO: 512827 - protein, 8 aa, Mycobacterium
KKNADGIE

SEQ ID NO: 512828 - protein, 14 aa, Mycobacterium
KKNAKVGDTVDGQS

SEQ ID NO: 512829 - protein, 7 aa, Mycobacterium
KKNHPVR

SEQ ID NO: 512830 - protein, 6 aa, Mycobacterium
KKNKPR

SEQ ID NO: 512831 - protein, 8 aa, Mycobacterium
KKNMEGSH

SEQ ID NO: 512832 - protein, 6 aa, Mycobacterium
KKNQSQ

SEQ ID NO: 512833 - protein, 11 aa, Mycobacterium
KKNRRNDPDRM

SEQ ID NO: 512834 - protein, 4 aa, Mycobacterium
KKNT

SEQ ID NO: 512835 - protein, 6 aa, Mycobacterium
KKNVAK

SEQ ID NO: 512836 - protein, 11 aa, Mycobacterium
KKNWGAASKGV

SEQ ID NO: 512837 - protein, 11 aa, Mycobacterium
KKNWGPASKGV

SEQ ID NO: 512838 - protein, 13 aa, Mycobacterium
KKNWGPSSKGVSP

SEQ ID NO: 512839 - protein, 7 aa, Mycobacterium
KKPAAVG

SEQ ID NO: 512840 - protein, 7 aa, Mycobacterium
KKPADTH

SEQ ID NO: 512841 - protein, 7 aa, Mycobacterium
KKPADTK

SEQ ID NO: 512842 - protein, 7 aa, Mycobacterium
KKPDVAE

SEQ ID NO: 512843 - protein, 7 aa, Mycobacterium
KKPEQSL

SEQ ID NO: 512844 - protein, 7 aa, Mycobacterium
KKPETEL

SEQ ID NO: 512845 - protein, 8 aa, Mycobacterium
KKPETRAR

SEQ ID NO: 512846 - protein, 4 aa, Mycobacterium
KKPG

SEQ ID NO: 512847 - protein, 9 aa, Mycobacterium
KKPGHGIND

SEQ ID NO: 512848 - protein, 4 aa, Mycobacterium
KKPH

SEQ ID NO: 512849 - protein, 16 aa, Mycobacterium
KKPIGYSTTAASRRTR

SEQ ID NO: 512850 - protein, 9 aa, Mycobacterium
KKPKAEIKE

SEQ ID NO: 512851 - protein, 9 aa, Mycobacterium
KKPKAEIKK

SEQ ID NO: 512852 - protein, 26 aa, Mycobacterium
KKPKARKRGAHAGAAASGDAVTAPMQ

SEQ ID NO: 512853 - protein, 6 aa, Mycobacterium
KKPKFK

SEQ ID NO: 512854 - protein, 26 aa, Mycobacterium
KKPKPRKRGAHAGAAASGDAVTAPMQ

SEQ ID NO: 512855 - protein, 26 aa, Mycobacterium
KKPKPRKRGGGGAKAASGDAVTAPMQ

SEQ ID NO: 512856 - protein, 9 aa, Mycobacterium
KKPPATDVP

SEQ ID NO: 512857 - protein, 144 aa, Mycobacterium
KKPPEIPQPPSIKPPEVKAPEVKPPEVKAPEAKPPEPGRPAPAPSGKPAPGPADGPLPHSPTESKPPVGGTPHSGEPKPIAVPPESGGKPPVSAPAEGTPPPHPPPHEPAPTRVPPAEPAAVTPAASAPAASMPAASAPSMPSM

SEQ ID NO: 512858 - protein, 8 aa, Mycobacterium
KKPRPARP

SEQ ID NO: 512859 - protein, 5 aa, Mycobacterium
KKPSL

SEQ ID NO: 512860 - protein, 6 aa, Mycobacterium
KKPSTA

SEQ ID NO: 512861 - protein, 6 aa, Mycobacterium
KKPYDA

SEQ ID NO: 512862 - protein, 7 aa, Mycobacterium
KKQAKER

SEQ ID NO: 512863 - protein, 13 aa, Mycobacterium
KKQAQEPIAEEAT

SEQ ID NO: 512864 - protein, 13 aa, Mycobacterium
KKQAQESIAEEAT

SEQ ID NO: 512865 - protein, 13 aa, Mycobacterium
KKQAQESIAQEAT

SEQ ID NO: 512866 - protein, 14 aa, Mycobacterium
KKQAQESVAAEATR

SEQ ID NO: 512867 - protein, 12 aa, Mycobacterium
KKQDGAVKIILK

SEQ ID NO: 512868 - protein, 12 aa, Mycobacterium
KKQDGAVKVILK

SEQ ID NO: 512869 - protein, 12 aa, Mycobacterium
KKQDGAVKVILN

SEQ ID NO: 512870 - protein, 12 aa, Mycobacterium
KKQDGAVKVMLR

SEQ ID NO: 512871 - protein, 12 aa, Mycobacterium
KKQMKAAAKAAK

SEQ ID NO: 512872 - protein, 12 aa, Mycobacterium
KKQRPNRKKKKG

SEQ ID NO: 512873 - protein, 7 aa, Mycobacterium
KKRAEPV

SEQ ID NO: 512874 - protein, 11 aa, Mycobacterium
KKRATGKSHRE

SEQ ID NO: 512875 - protein, 15 aa, Mycobacterium
KKRDSTYQPGRRSAS

SEQ ID NO: 512876 - protein, 12 aa, Mycobacterium
KKRGDSAEQFTA

SEQ ID NO: 512877 - protein, 14 aa, Mycobacterium
KKRGKNGKPGPPVH

SEQ ID NO: 512878 - protein, 10 aa, Mycobacterium
KKRGSNRPWR

SEQ ID NO: 512879 - protein, 7 aa, Mycobacterium
KKRGWSG

SEQ ID NO: 512880 - protein, 10 aa, Mycobacterium
KKRGWSGRVA

SEQ ID NO: 512881 - protein, 7 aa, Mycobacterium
KKRGWTA

SEQ ID NO: 512882 - protein, 7 aa, Mycobacterium
KKRRGDL

SEQ ID NO: 512883 - protein, 31 aa, Mycobacterium
KKRRGPSDERALSGGPNAKGRSAEGVDAHAS

SEQ ID NO: 512884 - protein, 9 aa, Mycobacterium
KKRRQRSRE

SEQ ID NO: 512885 - protein, 5 aa, Mycobacterium
KKRRS

SEQ ID NO: 512886 - protein, 6 aa, Mycobacterium
KKRRTI

SEQ ID NO: 512887 - protein, 5 aa, Mycobacterium
KKRSA

SEQ ID NO: 512888 - protein, 20 aa, Mycobacterium
KKRYKASTTTRNLRTLDKVL

SEQ ID NO: 512889 - protein, 12 aa, Mycobacterium
KKSDAKKWDSET

SEQ ID NO: 512890 - protein, 9 aa, Mycobacterium
KKSDRGEYE

SEQ ID NO: 512891 - protein, 7 aa, Mycobacterium
KKSEGQP

SEQ ID NO: 512892 - protein, 8 aa, Mycobacterium
KKSEGQPF

SEQ ID NO: 512893 - protein, 12 aa, Mycobacterium
KKSGAEVTTGRL

SEQ ID NO: 512894 - protein, 8 aa, Mycobacterium
KKSGAEVV

SEQ ID NO: 512895 - protein, 20 aa, Mycobacterium
KKSGKDSGSESALLVGQHPR

SEQ ID NO: 512896 - protein, 32 aa, Mycobacterium
KKSGKSLKEKRAAKRGKAAEISQAEALLVTKK

SEQ ID NO: 512897 - protein, 33 aa, Mycobacterium
KKSGKSLKEKRADKHAKSDAKTSAAESIHEIKK

SEQ ID NO: 512898 - protein, 32 aa, Mycobacterium
KKSGQSLKQKRAEKRAKTDSASPTDSVHEMRK

SEQ ID NO: 512899 - protein, 8 aa, Mycobacterium
KKSGYDSR

SEQ ID NO: 512900 - protein, 5 aa, Mycobacterium
KKSIA

SEQ ID NO: 512901 - protein, 5 aa, Mycobacterium
KKSMP

SEQ ID NO: 512902 - protein, 11 aa, Mycobacterium
KKSPKPSSSEL

SEQ ID NO: 512903 - protein, 19 aa, Mycobacterium
KKSRAKDGTGKPAKQKKKK

SEQ ID NO: 512904 - protein, 8 aa, Mycobacterium
KKSTATLT

SEQ ID NO: 512905 - protein, 7 aa, Mycobacterium
KKSTQHA

SEQ ID NO: 512906 - protein, 9 aa, Mycobacterium
KKSTTTTLR

SEQ ID NO: 512907 - protein, 6 aa, Mycobacterium
KKSVEE

SEQ ID NO: 512908 - protein, 10 aa, Mycobacterium
KKSVINRGQA

SEQ ID NO: 512909 - protein, 7 aa, Mycobacterium
KKSVSAR

SEQ ID NO: 512910 - protein, 21 aa, Mycobacterium
KKSWTGNARATIDPNHTPAVE

SEQ ID NO: 512911 - protein, 15 aa, Mycobacterium
KKTAAAPASESVAVN

SEQ ID NO: 512912 - protein, 10 aa, Mycobacterium
KKTDTRRALS

SEQ ID NO: 512913 - protein, 4 aa, Mycobacterium
KKTG

SEQ ID NO: 512914 - protein, 8 aa, Mycobacterium
KKTGGEIG

SEQ ID NO: 512915 - protein, 5 aa, Mycobacterium
KKTGL

SEQ ID NO: 512916 - protein, 6 aa, Mycobacterium
KKTGLA

SEQ ID NO: 512917 - protein, 6 aa, Mycobacterium
KKTGNR

SEQ ID NO: 512918 - protein, 15 aa, Mycobacterium
KKTGRPWNPTPEFSD

SEQ ID NO: 512919 - protein, 7 aa, Mycobacterium
KKTGTDR

SEQ ID NO: 512920 - protein, 8 aa, Mycobacterium
KKTHSSGD

SEQ ID NO: 512921 - protein, 13 aa, Mycobacterium
KKTPAKAADDTPT

SEQ ID NO: 512922 - protein, 14 aa, Mycobacterium
KKTPFSRRPLEGPR

SEQ ID NO: 512923 - protein, 6 aa, Mycobacterium
KKTPRR

SEQ ID NO: 512924 - protein, 8 aa, Mycobacterium
KKTPVTNS

SEQ ID NO: 512925 - protein, 4 aa, Mycobacterium
KKTR

SEQ ID NO: 512926 - protein, 8 aa, Mycobacterium
KKTRRALD

SEQ ID NO: 512927 - protein, 10 aa, Mycobacterium
KKTRTRETVR

SEQ ID NO: 512928 - protein, 38 aa, Mycobacterium
KKTSKGTASRAGREISSSDQGGVGDAGFDGDSARRLYS

SEQ ID NO: 512929 - protein, 8 aa, Mycobacterium
KKTTRGKA

SEQ ID NO: 512930 - protein, 16 aa, Mycobacterium
KKTVPWDGRSAGEIQA

SEQ ID NO: 512931 - protein, 5 aa, Mycobacterium
KKTWP

SEQ ID NO: 512932 - protein, 9 aa, Mycobacterium
KKVGPLAGR

SEQ ID NO: 512933 - protein, 10 aa, Mycobacterium
KKVGRENDAA

SEQ ID NO: 512934 - protein, 6 aa, Mycobacterium
KKVKSG

SEQ ID NO: 512935 - protein, 13 aa, Mycobacterium
KKVPHGSRWRRRA

SEQ ID NO: 512936 - protein, 4 aa, Mycobacterium
KKVQ

SEQ ID NO: 512937 - protein, 6 aa, Mycobacterium
KKVRTE

SEQ ID NO: 512938 - protein, 13 aa, Mycobacterium
KKVRTYSKGNRQK

SEQ ID NO: 512939 - protein, 10 aa, Mycobacterium
KKVSKNGGEV

SEQ ID NO: 512940 - protein, 9 aa, Mycobacterium
KKVTKNGAE

SEQ ID NO: 512941 - protein, 19 aa, Mycobacterium
KKWATDRLGRSEAVGTPDI

SEQ ID NO: 512942 - protein, 9 aa, Mycobacterium
KKYDRTAPR

SEQ ID NO: 512943 - protein, 9 aa, Mycobacterium
KKYEDKAAS

SEQ ID NO: 512944 - protein, 7 aa, Mycobacterium
KKYGGTV

SEQ ID NO: 512945 - protein, 8 aa, Mycobacterium
KKYNGSRP

SEQ ID NO: 512946 - protein, 7 aa, Mycobacterium
KKYPDTN

SEQ ID NO: 512947 - protein, 6 aa, Mycobacterium
KKYPDV

SEQ ID NO: 512948 - protein, 7 aa, Mycobacterium
KKYPGTQ

SEQ ID NO: 512949 - protein, 8 aa, Mycobacterium
KKYQDDAP

SEQ ID NO: 512950 - protein, 9 aa, Mycobacterium
KKYQDDAPR

SEQ ID NO: 512951 - protein, 8 aa, Mycobacterium
KKYTAPEI

SEQ ID NO: 512952 - protein, 7 aa, Mycobacterium
KKYTAQE

SEQ ID NO: 512953 - protein, 8 aa, Mycobacterium
KKYTAQEI

SEQ ID NO: 512954 - protein, 8 aa, Mycobacterium
KKYTPQEI

SEQ ID NO: 512955 - protein, 10 aa, Mycobacterium
KLAAAGALTS

SEQ ID NO: 512956 - protein, 7 aa, Mycobacterium
KLAAPDA

SEQ ID NO: 512957 - protein, 11 aa, Mycobacterium
KLAARTGVPEE

SEQ ID NO: 512958 - protein, 8 aa, Mycobacterium
KLADDEPL

SEQ ID NO: 512959 - protein, 12 aa, Mycobacterium
KLADDLGPAAVQ

SEQ ID NO: 512960 - protein, 21 aa, Mycobacterium
KLADDLGPATVQDLDDQNRIT

SEQ ID NO: 512961 - protein, 11 aa, Mycobacterium
KLADDLGPGAV

SEQ ID NO: 512962 - protein, 5 aa, Mycobacterium
KLADG

SEQ ID NO: 512963 - protein, 10 aa, Mycobacterium
KLADKPPPEA

SEQ ID NO: 512964 - protein, 18 aa, Mycobacterium
KLADRYPAQLSGGQQQRV

SEQ ID NO: 512965 - protein, 9 aa, Mycobacterium
KLAEAAENA

SEQ ID NO: 512966 - protein, 14 aa, Mycobacterium
KLAEAKQSHSGRAA

SEQ ID NO: 512967 - protein, 12 aa, Mycobacterium
KLAEDPEPITVD

SEQ ID NO: 512968 - protein, 12 aa, Mycobacterium
KLAEPGPKSPSL

SEQ ID NO: 512969 - protein, 12 aa, Mycobacterium
KLAERQGEKSYA

SEQ ID NO: 512970 - protein, 10 aa, Mycobacterium
KLAESGEVEA

SEQ ID NO: 512971 - protein, 5 aa, Mycobacterium
KLAGG

SEQ ID NO: 512972 - protein, 7 aa, Mycobacterium
KLAGSGA

SEQ ID NO: 512973 - protein, 7 aa, Mycobacterium
KLAGSGI

SEQ ID NO: 512974 - protein, 23 aa, Mycobacterium
KLAGSHKNRFTQAKQATPTTTEF

SEQ ID NO: 512975 - protein, 12 aa, Mycobacterium
KLAGSTDERDRP

SEQ ID NO: 512976 - protein, 17 aa, Mycobacterium
KLAGTSAATLPRSRRID

SEQ ID NO: 512977 - protein, 20 aa, Mycobacterium
KLAKAAAKAPSSPAESAAVD

SEQ ID NO: 512978 - protein, 6 aa, Mycobacterium
KLAKLS

SEQ ID NO: 512979 - protein, 5 aa, Mycobacterium
KLANS

SEQ ID NO: 512980 - protein, 10 aa, Mycobacterium
KLAPAAGTAR

SEQ ID NO: 512981 - protein, 6 aa, Mycobacterium
KLAPDF

SEQ ID NO: 512982 - protein, 20 aa, Mycobacterium
KLAPDSEAAEAVAQSGRWIT

SEQ ID NO: 512983 - protein, 6 aa, Mycobacterium
KLAPED

SEQ ID NO: 512984 - protein, 7 aa, Mycobacterium
KLAPPEF

SEQ ID NO: 512985 - protein, 8 aa, Mycobacterium
KLAPSAAR

SEQ ID NO: 512986 - protein, 15 aa, Mycobacterium
KLARQEPKATDYTRR

SEQ ID NO: 512987 - protein, 12 aa, Mycobacterium
KLARRTRDNYRG

SEQ ID NO: 512988 - protein, 13 aa, Mycobacterium
KLASPSEGTPEGP

SEQ ID NO: 512989 - protein, 8 aa, Mycobacterium
KLATDKGM

SEQ ID NO: 512990 - protein, 5 aa, Mycobacterium
KLATP

SEQ ID NO: 512991 - protein, 6 aa, Mycobacterium
KLATTD

SEQ ID NO: 512992 - protein, 8 aa, Mycobacterium
KLDAAGNL

SEQ ID NO: 512993 - protein, 7 aa, Mycobacterium
KLDAAQQ

SEQ ID NO: 512994 - protein, 8 aa, Mycobacterium
KLDARGNL

SEQ ID NO: 512995 - protein, 10 aa, Mycobacterium
KLDDDAEAAI

SEQ ID NO: 512996 - protein, 6 aa, Mycobacterium
KLDDRQ

SEQ ID NO: 512997 - protein, 54 aa, Mycobacterium
KLDEATYSDKAKESGEGEESAKAEESDESDESEKAEKSEDSDGPEDSDESDKSS

SEQ ID NO: 512998 - protein, 6 aa, Mycobacterium
KLDESL

SEQ ID NO: 512999 - protein, 12 aa, Mycobacterium
KLDGELADEPIA

SEQ ID NO: 513000 - protein, 6 aa, Mycobacterium
KLDGPV

SEQ ID NO: 513001 - protein, 5 aa, Mycobacterium
KLDGQ

SEQ ID NO: 513002 - protein, 7 aa, Mycobacterium
KLDGSTV

SEQ ID NO: 513003 - protein, 13 aa, Mycobacterium
KLDGTVDAYNEAQ

SEQ ID NO: 513004 - protein, 13 aa, Mycobacterium
KLDKQGLPAPEYS

SEQ ID NO: 513005 - protein, 39 aa, Mycobacterium
KLDNDDEEEDEDGDGEDEDDEDDEGDADAEDEGSEDSER

SEQ ID NO: 513006 - protein, 17 aa, Mycobacterium
KLDNGSKAIYNPHYEIQ

SEQ ID NO: 513007 - protein, 7 aa, Mycobacterium
KLDPAEV

SEQ ID NO: 513008 - protein, 6 aa, Mycobacterium
KLDPDR

SEQ ID NO: 513009 - protein, 5 aa, Mycobacterium
KLDPN

SEQ ID NO: 513010 - protein, 6 aa, Mycobacterium
KLDPND

SEQ ID NO: 513011 - protein, 8 aa, Mycobacterium
KLDPPLAH

SEQ ID NO: 513012 - protein, 6 aa, Mycobacterium
KLDPVQ

SEQ ID NO: 513013 - protein, 11 aa, Mycobacterium
KLDQPDSRTVA

SEQ ID NO: 513014 - protein, 7 aa, Mycobacterium
KLDQPLP

SEQ ID NO: 513015 - protein, 4 aa, Mycobacterium
KLDR

SEQ ID NO: 513016 - protein, 9 aa, Mycobacterium
KLDRPGNDA

SEQ ID NO: 513017 - protein, 7 aa, Mycobacterium
KLDTRGK

SEQ ID NO: 513018 - protein, 11 aa, Mycobacterium
KLDTSSPSTIA

SEQ ID NO: 513019 - protein, 8 aa, Mycobacterium
KLDTTQQI

SEQ ID NO: 513020 - protein, 6 aa, Mycobacterium
KLEGKG

SEQ ID NO: 513021 - protein, 9 aa, Mycobacterium
KLEKRIGKP

SEQ ID NO: 513022 - protein, 17 aa, Mycobacterium
KLENGGKVIHNPYYEIQ

SEQ ID NO: 513023 - protein, 17 aa, Mycobacterium
KLENGTKAIYNPHYEIQ

SEQ ID NO: 513024 - protein, 6 aa, Mycobacterium
KLEQAA

SEQ ID NO: 513025 - protein, 7 aa, Mycobacterium
KLERSGE

SEQ ID NO: 513026 - protein, 12 aa, Mycobacterium
KLERSTKPITAA

SEQ ID NO: 513027 - protein, 9 aa, Mycobacterium
KLESNGRSV

SEQ ID NO: 513028 - protein, 7 aa, Mycobacterium
KLESSSD

SEQ ID NO: 513029 - protein, 5 aa, Mycobacterium
KLETT

SEQ ID NO: 513030 - protein, 13 aa, Mycobacterium
KLGADESGLEPAY

SEQ ID NO: 513031 - protein, 7 aa, Mycobacterium
KLGAPER

SEQ ID NO: 513032 - protein, 6 aa, Mycobacterium
KLGAPT

SEQ ID NO: 513033 - protein, 25 aa, Mycobacterium
KLGAQGHDVTAASRRSGVDALTGEG

SEQ ID NO: 513034 - protein, 12 aa, Mycobacterium
KLGARSEGERAA

SEQ ID NO: 513035 - protein, 16 aa, Mycobacterium
KLGATAPKKGCDHGQC

SEQ ID NO: 513036 - protein, 7 aa, Mycobacterium
KLGDAAQ

SEQ ID NO: 513037 - protein, 10 aa, Mycobacterium
KLGDDPEHGE

SEQ ID NO: 513038 - protein, 15 aa, Mycobacterium
KLGDELPNLEPPYGK

SEQ ID NO: 513039 - protein, 18 aa, Mycobacterium
KLGDESTPAVAAPAGLRG

SEQ ID NO: 513040 - protein, 6 aa, Mycobacterium
KLGDRH

SEQ ID NO: 513041 - protein, 4 aa, Mycobacterium
KLGE

SEQ ID NO: 513042 - protein, 5 aa, Mycobacterium
KLGEA

SEQ ID NO: 513043 - protein, 5 aa, Mycobacterium
KLGEK

SEQ ID NO: 513044 - protein, 7 aa, Mycobacterium
KLGENKG

SEQ ID NO: 513045 - protein, 16 aa, Mycobacterium
KLGENYDGTKRSLSDW

SEQ ID NO: 513046 - protein, 6 aa, Mycobacterium
KLGEPS

SEQ ID NO: 513047 - protein, 6 aa, Mycobacterium
KLGEQF

SEQ ID NO: 513048 - protein, 9 aa, Mycobacterium
KLGEQSQAL

SEQ ID NO: 513049 - protein, 6 aa, Mycobacterium
KLGGAR

SEQ ID NO: 513050 - protein, 7 aa, Mycobacterium
KLGGDDE

SEQ ID NO: 513051 - protein, 7 aa, Mycobacterium
KLGGDDQ

SEQ ID NO: 513052 - protein, 7 aa, Mycobacterium
KLGGDDS

SEQ ID NO: 513053 - protein, 7 aa, Mycobacterium
KLGGPVD

SEQ ID NO: 513054 - protein, 11 aa, Mycobacterium
KLGGSTDERDR

SEQ ID NO: 513055 - protein, 18 aa, Mycobacterium
KLGKKPAALKRHAWGPFS

SEQ ID NO: 513056 - protein, 18 aa, Mycobacterium
KLGKKPATLERHAWGPFA

SEQ ID NO: 513057 - protein, 6 aa, Mycobacterium
KLGKPQ

SEQ ID NO: 513058 - protein, 4 aa, Mycobacterium
KLGL

SEQ ID NO: 513059 - protein, 4 aa, Mycobacterium
KLGN

SEQ ID NO: 513060 - protein, 6 aa, Mycobacterium
KLGNAT

SEQ ID NO: 513061 - protein, 15 aa, Mycobacterium
KLGNHANASSEVEYD

SEQ ID NO: 513062 - protein, 16 aa, Mycobacterium
KLGNHANASSEVEYDG

SEQ ID NO: 513063 - protein, 16 aa, Mycobacterium
KLGNHSNASSEVEYDE

SEQ ID NO: 513064 - protein, 4 aa, Mycobacterium
KLGP

SEQ ID NO: 513065 - protein, 5 aa, Mycobacterium
KLGPA

SEQ ID NO: 513066 - protein, 8 aa, Mycobacterium
KLGPALAA

SEQ ID NO: 513067 - protein, 15 aa, Mycobacterium
KLGPDEATLEPPYGK

SEQ ID NO: 513068 - protein, 9 aa, Mycobacterium
KLGPEGGSV

SEQ ID NO: 513069 - protein, 5 aa, Mycobacterium
KLGPQ

SEQ ID NO: 513070 - protein, 9 aa, Mycobacterium
KLGQESQAL

SEQ ID NO: 513071 - protein, 9 aa, Mycobacterium
KLGQPEHPD

SEQ ID NO: 513072 - protein, 10 aa, Mycobacterium
KLGRGPATAI

SEQ ID NO: 513073 - protein, 10 aa, Mycobacterium
KLGRNGQDVD

SEQ ID NO: 513074 - protein, 6 aa, Mycobacterium
KLGRPP

SEQ ID NO: 513075 - protein, 6 aa, Mycobacterium
KLGRQI

SEQ ID NO: 513076 - protein, 4 aa, Mycobacterium
KLGS

SEQ ID NO: 513077 - protein, 6 aa, Mycobacterium
KLGSDG

SEQ ID NO: 513078 - protein, 12 aa, Mycobacterium
KLGSDRRQATAA

SEQ ID NO: 513079 - protein, 7 aa, Mycobacterium
KLGSPVI

SEQ ID NO: 513080 - protein, 10 aa, Mycobacterium
KLGSVGRPLP

SEQ ID NO: 513081 - protein, 4 aa, Mycobacterium
KLGT

SEQ ID NO: 513082 - protein, 7 aa, Mycobacterium
KLGTAAE

SEQ ID NO: 513083 - protein, 7 aa, Mycobacterium
KLGTPGM

SEQ ID NO: 513084 - protein, 11 aa, Mycobacterium
KLGTPSVDPPL

SEQ ID NO: 513085 - protein, 10 aa, Mycobacterium
KLGTRSVASG

SEQ ID NO: 513086 - protein, 28 aa, Mycobacterium
KLGVGSDAVRTNANADAWSTNAPFTDEQ

SEQ ID NO: 513087 - protein, 29 aa, Mycobacterium
KLGVGSDSLRTNANADAWSSNEPFTDEQR

SEQ ID NO: 513088 - protein, 18 aa, Mycobacterium
KLIRPGGDRVKTDARDAA

SEQ ID NO: 513089 - protein, 8 aa, Mycobacterium
KLKKPQKL

SEQ ID NO: 513090 - protein, 5 aa, Mycobacterium
KLKNR

SEQ ID NO: 513091 - protein, 14 aa, Mycobacterium
KLKPATRNDIRARE

SEQ ID NO: 513092 - protein, 6 aa, Mycobacterium
KLKPDG

SEQ ID NO: 513093 - protein, 6 aa, Mycobacterium
KLKPQG

SEQ ID NO: 513094 - protein, 7 aa, Mycobacterium
KLLGGPQ

SEQ ID NO: 513095 - protein, 6 aa, Mycobacterium
KLLPPG

SEQ ID NO: 513096 - protein, 13 aa, Mycobacterium
KLMPESRANPSWA

SEQ ID NO: 513097 - protein, 6 aa, Mycobacterium
KLNAQR

SEQ ID NO: 513098 - protein, 7 aa, Mycobacterium
KLNPAAG

SEQ ID NO: 513099 - protein, 6 aa, Mycobacterium
KLNPGP

SEQ ID NO: 513100 - protein, 8 aa, Mycobacterium
KLNPQPVR

SEQ ID NO: 513101 - protein, 8 aa, Mycobacterium
KLNRSPKE

SEQ ID NO: 513102 - protein, 22 aa, Mycobacterium
KLNSEELRKAAESYADQATATY

SEQ ID NO: 513103 - protein, 8 aa, Mycobacterium
KLNSRGEE

SEQ ID NO: 513104 - protein, 6 aa, Mycobacterium
KLPAER

SEQ ID NO: 513105 - protein, 7 aa, Mycobacterium
KLPAGSP

SEQ ID NO: 513106 - protein, 9 aa, Mycobacterium
KLPAQRYPG

SEQ ID NO: 513107 - protein, 7 aa, Mycobacterium
KLPASEL

SEQ ID NO: 513108 - protein, 15 aa, Mycobacterium
KLPASTIDQLKSDSN

SEQ ID NO: 513109 - protein, 12 aa, Mycobacterium
KLPATAHGRRTR

SEQ ID NO: 513110 - protein, 13 aa, Mycobacterium
KLPAVTEASGTEL

SEQ ID NO: 513111 - protein, 4 aa, Mycobacterium
KLPD

SEQ ID NO: 513112 - protein, 5 aa, Mycobacterium
KLPDD

SEQ ID NO: 513113 - protein, 13 aa, Mycobacterium
KLPDPPSPTQSAP

SEQ ID NO: 513114 - protein, 5 aa, Mycobacterium
KLPDS

SEQ ID NO: 513115 - protein, 11 aa, Mycobacterium
KLPEASEEFQG

SEQ ID NO: 513116 - protein, 5 aa, Mycobacterium
KLPEG

SEQ ID NO: 513117 - protein, 8 aa, Mycobacterium
KLPEPTID

SEQ ID NO: 513118 - protein, 11 aa, Mycobacterium
KLPERPPGAPR

SEQ ID NO: 513119 - protein, 8 aa, Mycobacterium
KLPETPQW

SEQ ID NO: 513120 - protein, 5 aa, Mycobacterium
KLPGD

SEQ ID NO: 513121 - protein, 9 aa, Mycobacterium
KLPGDPTVY

SEQ ID NO: 513122 - protein, 6 aa, Mycobacterium
KLPGET

SEQ ID NO: 513123 - protein, 6 aa, Mycobacterium
KLPGKT

SEQ ID NO: 513124 - protein, 6 aa, Mycobacterium
KLPGQP

SEQ ID NO: 513125 - protein, 10 aa, Mycobacterium
KLPGSDSENE

SEQ ID NO: 513126 - protein, 5 aa, Mycobacterium
KLPIE

SEQ ID NO: 513127 - protein, 14 aa, Mycobacterium
KLPKNATAKIGQTS

SEQ ID NO: 513128 - protein, 6 aa, Mycobacterium
KLPKST

SEQ ID NO: 513129 - protein, 19 aa, Mycobacterium
KLPMDTDEDGRIVSPKTGS

SEQ ID NO: 513130 - protein, 5 aa, Mycobacterium
KLPPA

SEQ ID NO: 513131 - protein, 9 aa, Mycobacterium
KLPPAPPRV

SEQ ID NO: 513132 - protein, 7 aa, Mycobacterium
KLPPGVT

SEQ ID NO: 513133 - protein, 8 aa, Mycobacterium
KLPPPASQ

SEQ ID NO: 513134 - protein, 6 aa, Mycobacterium
KLPPTE

SEQ ID NO: 513135 - protein, 15 aa, Mycobacterium
KLPPVAAASDPLREE

SEQ ID NO: 513136 - protein, 15 aa, Mycobacterium
KLPPVGDVTSPGKRR

SEQ ID NO: 513137 - protein, 7 aa, Mycobacterium
KLPPYKR

SEQ ID NO: 513138 - protein, 5 aa, Mycobacterium
KLPQD

SEQ ID NO: 513139 - protein, 7 aa, Mycobacterium
KLPQDRT

SEQ ID NO: 513140 - protein, 7 aa, Mycobacterium
KLPRGRT

SEQ ID NO: 513141 - protein, 5 aa, Mycobacterium
KLPRP

SEQ ID NO: 513142 - protein, 10 aa, Mycobacterium
KLPRQSLEAT

SEQ ID NO: 513143 - protein, 4 aa, Mycobacterium
KLPS

SEQ ID NO: 513144 - protein, 6 aa, Mycobacterium
KLPSAD

SEQ ID NO: 513145 - protein, 7 aa, Mycobacterium
KLPSAVD

SEQ ID NO: 513146 - protein, 8 aa, Mycobacterium
KLPSGAGQ

SEQ ID NO: 513147 - protein, 5 aa, Mycobacterium
KLPSI

SEQ ID NO: 513148 - protein, 8 aa, Mycobacterium
KLPSPASQ

SEQ ID NO: 513149 - protein, 9 aa, Mycobacterium
KLPSPGSQV

SEQ ID NO: 513150 - protein, 8 aa, Mycobacterium
KLPSSELE

SEQ ID NO: 513151 - protein, 9 aa, Mycobacterium
KLPSSGRPA

SEQ ID NO: 513152 - protein, 5 aa, Mycobacterium
KLPSV

SEQ ID NO: 513153 - protein, 13 aa, Mycobacterium
KLPTAGEAQGVPN

SEQ ID NO: 513154 - protein, 7 aa, Mycobacterium
KLPTDRT

SEQ ID NO: 513155 - protein, 19 aa, Mycobacterium
KLPTETDENGRIVSPKAGG

SEQ ID NO: 513156 - protein, 13 aa, Mycobacterium
KLPTGLNPGGIEP

SEQ ID NO: 513157 - protein, 14 aa, Mycobacterium
KLPTIRKATGDRPL

SEQ ID NO: 513158 - protein, 9 aa, Mycobacterium
KLPTPEEYQ

SEQ ID NO: 513159 - protein, 13 aa, Mycobacterium
KLPTPTSQDDEVP

SEQ ID NO: 513160 - protein, 9 aa, Mycobacterium
KLPTRQDQD

SEQ ID NO: 513161 - protein, 5 aa, Mycobacterium
KLPTS

SEQ ID NO: 513162 - protein, 10 aa, Mycobacterium
KLPTTKAGIT

SEQ ID NO: 513163 - protein, 18 aa, Mycobacterium
KLQEQQAESVPDDVPAEQ

SEQ ID NO: 513164 - protein, 4 aa, Mycobacterium
KLQG

SEQ ID NO: 513165 - protein, 8 aa, Mycobacterium
KLQGGSPV

SEQ ID NO: 513166 - protein, 19 aa, Mycobacterium
KLQPGPAFYPDGELTDEPE

SEQ ID NO: 513167 - protein, 8 aa, Mycobacterium
KLQPTDST

SEQ ID NO: 513168 - protein, 7 aa, Mycobacterium
KLQSAQP

SEQ ID NO: 513169 - protein, 13 aa, Mycobacterium
KLQTKGAGHTSQM

SEQ ID NO: 513170 - protein, 9 aa, Mycobacterium
KLQTNPHAV

SEQ ID NO: 513171 - protein, 6 aa, Mycobacterium
KLRAEG

SEQ ID NO: 513172 - protein, 6 aa, Mycobacterium
KLRAQG

SEQ ID NO: 513173 - protein, 8 aa, Mycobacterium
KLRAQGQG

SEQ ID NO: 513174 - protein, 6 aa, Mycobacterium
KLRARA

SEQ ID NO: 513175 - protein, 7 aa, Mycobacterium
KLRASGA

SEQ ID NO: 513176 - protein, 15 aa, Mycobacterium
KLRDDEVGSHPSFRP

SEQ ID NO: 513177 - protein, 7 aa, Mycobacterium
KLRDPQI

SEQ ID NO: 513178 - protein, 5 aa, Mycobacterium
KLRDR

SEQ ID NO: 513179 - protein, 7 aa, Mycobacterium
KLRDSQI

SEQ ID NO: 513180 - protein, 4 aa, Mycobacterium
KLRE

SEQ ID NO: 513181 - protein, 8 aa, Mycobacterium
KLREAHDR

SEQ ID NO: 513182 - protein, 5 aa, Mycobacterium
KLREE

SEQ ID NO: 513183 - protein, 7 aa, Mycobacterium
KLRGGSG

SEQ ID NO: 513184 - protein, 8 aa, Mycobacterium
KLRGSGGI

SEQ ID NO: 513185 - protein, 10 aa, Mycobacterium
KLRGSIPASQ

SEQ ID NO: 513186 - protein, 11 aa, Mycobacterium
KLRGSLSAGQY

SEQ ID NO: 513187 - protein, 7 aa, Mycobacterium
KLRGTTA

SEQ ID NO: 513188 - protein, 4 aa, Mycobacterium
KLRH

SEQ ID NO: 513189 - protein, 4 aa, Mycobacterium
KLRK

SEQ ID NO: 513190 - protein, 10 aa, Mycobacterium
KLRPDGKPLH

SEQ ID NO: 513191 - protein, 15 aa, Mycobacterium
KLRPKIDPHDYETKK

SEQ ID NO: 513192 - protein, 8 aa, Mycobacterium
KLRPSARV

SEQ ID NO: 513193 - protein, 16 aa, Mycobacterium
KLRQAAADCNAVILAG

SEQ ID NO: 513194 - protein, 19 aa, Mycobacterium
KLRQGSAAWPAHNGVTEGP

SEQ ID NO: 513195 - protein, 17 aa, Mycobacterium
KLRQRTAGRLDRSRDPA

SEQ ID NO: 513196 - protein, 9 aa, Mycobacterium
KLRRGTHRS

SEQ ID NO: 513197 - protein, 10 aa, Mycobacterium
KLRRGTHTSV

SEQ ID NO: 513198 - protein, 12 aa, Mycobacterium
KLRRSTHTSVPQ

SEQ ID NO: 513199 - protein, 8 aa, Mycobacterium
KLRSEAID

SEQ ID NO: 513200 - protein, 58 aa, Mycobacterium
KLSAEAEDELAEEREEDETEDAVEESAADDIDDDIDDEDEEDDDTEARAAGDTAVLGG

SEQ ID NO: 513201 - protein, 8 aa, Mycobacterium
KLSAGGEA

SEQ ID NO: 513202 - protein, 12 aa, Mycobacterium
KLSDDSKSEATA

SEQ ID NO: 513203 - protein, 5 aa, Mycobacterium
KLSDE

SEQ ID NO: 513204 - protein, 7 aa, Mycobacterium
KLSDEDL

SEQ ID NO: 513205 - protein, 6 aa, Mycobacterium
KLSDEQ

SEQ ID NO: 513206 - protein, 4 aa, Mycobacterium
KLSE

SEQ ID NO: 513207 - protein, 9 aa, Mycobacterium
KLSEAATSF

SEQ ID NO: 513208 - protein, 6 aa, Mycobacterium
KLSEEQ

SEQ ID NO: 513209 - protein, 18 aa, Mycobacterium
KLSEGAAQRCPAQGGSPL

SEQ ID NO: 513210 - protein, 7 aa, Mycobacterium
KLSEGMQ

SEQ ID NO: 513211 - protein, 6 aa, Mycobacterium
KLSEGR

SEQ ID NO: 513212 - protein, 19 aa, Mycobacterium
KLSGAGDEGQPEEVDPQLE

SEQ ID NO: 513213 - protein, 11 aa, Mycobacterium
KLSGGLGGRTA

SEQ ID NO: 513214 - protein, 7 aa, Mycobacterium
KLSGKTV

SEQ ID NO: 513215 - protein, 14 aa, Mycobacterium
KLSGTSTREQRPGL

SEQ ID NO: 513216 - protein, 6 aa, Mycobacterium
KLSPAD

SEQ ID NO: 513217 - protein, 6 aa, Mycobacterium
KLSPAL

SEQ ID NO: 513218 - protein, 5 aa, Mycobacterium
KLSPD

SEQ ID NO: 513219 - protein, 17 aa, Mycobacterium
KLSPDQVSATELAGEPI

SEQ ID NO: 513220 - protein, 11 aa, Mycobacterium
KLSPEQVTATE

SEQ ID NO: 513221 - protein, 18 aa, Mycobacterium
KLSPEQVTATEVAGEPIT

SEQ ID NO: 513222 - protein, 9 aa, Mycobacterium
KLSPKGTGA

SEQ ID NO: 513223 - protein, 7 aa, Mycobacterium
KLSPKTL

SEQ ID NO: 513224 - protein, 7 aa, Mycobacterium
KLSPSTL

SEQ ID NO: 513225 - protein, 7 aa, Mycobacterium
KLSPTID

SEQ ID NO: 513226 - protein, 7 aa, Mycobacterium
KLSPTVD

SEQ ID NO: 513227 - protein, 8 aa, Mycobacterium
KLSRAERR

SEQ ID NO: 513228 - protein, 8 aa, Mycobacterium
KLSRDEAL

SEQ ID NO: 513229 - protein, 9 aa, Mycobacterium
KLSSEYPGR

SEQ ID NO: 513230 - protein, 9 aa, Mycobacterium
KLSTASPEL

SEQ ID NO: 513231 - protein, 7 aa, Mycobacterium
KLSTRDT

SEQ ID NO: 513232 - protein, 9 aa, Mycobacterium
KLSTRSRGL

SEQ ID NO: 513233 - protein, 11 aa, Mycobacterium
KLTADSPVVEG

SEQ ID NO: 513234 - protein, 7 aa, Mycobacterium
KLTDAPR

SEQ ID NO: 513235 - protein, 7 aa, Mycobacterium
KLTDDDW

SEQ ID NO: 513236 - protein, 6 aa, Mycobacterium
KLTDDE

SEQ ID NO: 513237 - protein, 11 aa, Mycobacterium
KLTDDSDDLAR

SEQ ID NO: 513238 - protein, 7 aa, Mycobacterium
KLTDEEV

SEQ ID NO: 513239 - protein, 6 aa, Mycobacterium
KLTDNQ

SEQ ID NO: 513240 - protein, 8 aa, Mycobacterium
KLTDSPEN

SEQ ID NO: 513241 - protein, 8 aa, Mycobacterium
KLTEAQRA

SEQ ID NO: 513242 - protein, 12 aa, Mycobacterium
KLTEFDSNRSGG

SEQ ID NO: 513243 - protein, 6 aa, Mycobacterium
KLTEGD

SEQ ID NO: 513244 - protein, 12 aa, Mycobacterium
KLTGGADQLASG

SEQ ID NO: 513245 - protein, 8 aa, Mycobacterium
KLTGGGRG

SEQ ID NO: 513246 - protein, 6 aa, Mycobacterium
KLTGKQ

SEQ ID NO: 513247 - protein, 6 aa, Mycobacterium
KLTGTI

SEQ ID NO: 513248 - protein, 17 aa, Mycobacterium
KLTGTPPVRLRQERREG

SEQ ID NO: 513249 - protein, 6 aa, Mycobacterium
KLTGVT

SEQ ID NO: 513250 - protein, 11 aa, Mycobacterium
KLTNMRSSTAD

SEQ ID NO: 513251 - protein, 21 aa, Mycobacterium
KLTPAASDEDDPMLMARGAER

SEQ ID NO: 513252 - protein, 6 aa, Mycobacterium
KLTPAQ

SEQ ID NO: 513253 - protein, 6 aa, Mycobacterium
KLTPAR

SEQ ID NO: 513254 - protein, 5 aa, Mycobacterium
KLTPT

SEQ ID NO: 513255 - protein, 9 aa, Mycobacterium
KLTPTTDTL

SEQ ID NO: 513256 - protein, 12 aa, Mycobacterium
KLTRERADKPYQ

SEQ ID NO: 513257 - protein, 4 aa, Mycobacterium
KLTS

SEQ ID NO: 513258 - protein, 7 aa, Mycobacterium
KLTSGAG

SEQ ID NO: 513259 - protein, 7 aa, Mycobacterium
KLTTEGM

SEQ ID NO: 513260 - protein, 6 aa, Mycobacterium
KLTTSL

SEQ ID NO: 513261 - protein, 6 aa, Mycobacterium
KMAAGD

SEQ ID NO: 513262 - protein, 17 aa, Mycobacterium
KMAEPTTVAGQHNDTEL

SEQ ID NO: 513263 - protein, 5 aa, Mycobacterium
KMAPF

SEQ ID NO: 513264 - protein, 6 aa, Mycobacterium
KMAPRE

SEQ ID NO: 513265 - protein, 6 aa, Mycobacterium
KMEPGS

SEQ ID NO: 513266 - protein, 10 aa, Mycobacterium
KMEQPSARQP

SEQ ID NO: 513267 - protein, 4 aa, Mycobacterium
KMGE

SEQ ID NO: 513268 - protein, 11 aa, Mycobacterium
KMGNTGNSTGP

SEQ ID NO: 513269 - protein, 6 aa, Mycobacterium
KMGPEY

SEQ ID NO: 513270 - protein, 7 aa, Mycobacterium
KMGPEYK

SEQ ID NO: 513271 - protein, 7 aa, Mycobacterium
KMGPEYT

SEQ ID NO: 513272 - protein, 6 aa, Mycobacterium
KMGRPE

SEQ ID NO: 513273 - protein, 7 aa, Mycobacterium
KMGRPTV

SEQ ID NO: 513274 - protein, 12 aa, Mycobacterium
KMGTDRRQATAA

SEQ ID NO: 513275 - protein, 17 aa, Mycobacterium
KMGTTAVGEGLRTSDEF

SEQ ID NO: 513276 - protein, 18 aa, Mycobacterium
KMNPDGRRPLTTPSYRGQ

SEQ ID NO: 513277 - protein, 12 aa, Mycobacterium
KMPAGAYGDSLG

SEQ ID NO: 513278 - protein, 6 aa, Mycobacterium
KMPASA

SEQ ID NO: 513279 - protein, 12 aa, Mycobacterium
KMPEAEYPGAEG

SEQ ID NO: 513280 - protein, 5 aa, Mycobacterium
KMPPR

SEQ ID NO: 513281 - protein, 14 aa, Mycobacterium
KMPQPQRLCLNPYV

SEQ ID NO: 513282 - protein, 7 aa, Mycobacterium
KMPSLAE

SEQ ID NO: 513283 - protein, 6 aa, Mycobacterium
KMPSQR

SEQ ID NO: 513284 - protein, 6 aa, Mycobacterium
KMQEQV

SEQ ID NO: 513285 - protein, 12 aa, Mycobacterium
KMQEQVSSSLRS

SEQ ID NO: 513286 - protein, 9 aa, Mycobacterium
KMRDSAVAG

SEQ ID NO: 513287 - protein, 5 aa, Mycobacterium
KMREG

SEQ ID NO: 513288 - protein, 7 aa, Mycobacterium
KMRGDVE

SEQ ID NO: 513289 - protein, 8 aa, Mycobacterium
KMRGTTER

SEQ ID NO: 513290 - protein, 5 aa, Mycobacterium
KMSDG

SEQ ID NO: 513291 - protein, 7 aa, Mycobacterium
KMSGSNI

SEQ ID NO: 513292 - protein, 11 aa, Mycobacterium
KMSKSRGNGID

SEQ ID NO: 513293 - protein, 36 aa, Mycobacterium
KMSKSSGGSDHKDSGGKQSRAHGAAGGGRREFRRKS

SEQ ID NO: 513294 - protein, 5 aa, Mycobacterium
KMSNE

SEQ ID NO: 513295 - protein, 14 aa, Mycobacterium
KMSSDESWRSSGRL

SEQ ID NO: 513296 - protein, 5 aa, Mycobacterium
KMTEP

SEQ ID NO: 513297 - protein, 27 aa, Mycobacterium
KMTGYEGMENGTRGTVYAETRDAAGDL

SEQ ID NO: 513298 - protein, 20 aa, Mycobacterium
KMYGADGKLKDTKAVNPEST

SEQ ID NO: 513299 - protein, 5 aa, Mycobacterium
KMYGK

SEQ ID NO: 513300 - protein, 7 aa, Mycobacterium
KNAADRG

SEQ ID NO: 513301 - protein, 15 aa, Mycobacterium
KNAAEIGQLRMLRAA

SEQ ID NO: 513302 - protein, 13 aa, Mycobacterium
KNAAETARIYREI

SEQ ID NO: 513303 - protein, 18 aa, Mycobacterium
KNAAGVVSSGRQGLDSTA

SEQ ID NO: 513304 - protein, 8 aa, Mycobacterium
KNAAPTVK

SEQ ID NO: 513305 - protein, 9 aa, Mycobacterium
KNAARHAKG

SEQ ID NO: 513306 - protein, 8 aa, Mycobacterium
KNADESKM

SEQ ID NO: 513307 - protein, 19 aa, Mycobacterium
KNAEATIPDPFGGPPRKPT

SEQ ID NO: 513308 - protein, 8 aa, Mycobacterium
KNAEPSDI

SEQ ID NO: 513309 - protein, 4 aa, Mycobacterium
KNAF

SEQ ID NO: 513310 - protein, 6 aa, Mycobacterium
KNAGAQ

SEQ ID NO: 513311 - protein, 18 aa, Mycobacterium
KNAGDQPPCARCSPGRCG

SEQ ID NO: 513312 - protein, 8 aa, Mycobacterium
KNAGVRAA

SEQ ID NO: 513313 - protein, 5 aa, Mycobacterium
KNAIN

SEQ ID NO: 513314 - protein, 15 aa, Mycobacterium
KNAKDSLATSHPLPN

SEQ ID NO: 513315 - protein, 8 aa, Mycobacterium
KNAKGNRV

SEQ ID NO: 513316 - protein, 8 aa, Mycobacterium
KNANRREK

SEQ ID NO: 513317 - protein, 6 aa, Mycobacterium
KNAPRG

SEQ ID NO: 513318 - protein, 7 aa, Mycobacterium
KNAQDSA

SEQ ID NO: 513319 - protein, 7 aa, Mycobacterium
KNAQEAH

SEQ ID NO: 513320 - protein, 8 aa, Mycobacterium
KNAQEAHE

SEQ ID NO: 513321 - protein, 13 aa, Mycobacterium
KNCDNSVDNLGRP

SEQ ID NO: 513322 - protein, 8 aa, Mycobacterium
KNDAEEAE

SEQ ID NO: 513323 - protein, 8 aa, Mycobacterium
KNDAEEAR

SEQ ID NO: 513324 - protein, 9 aa, Mycobacterium
KNDAPASRA

SEQ ID NO: 513325 - protein, 10 aa, Mycobacterium
KNDDADAERI

SEQ ID NO: 513326 - protein, 8 aa, Mycobacterium
KNDDRNDR

SEQ ID NO: 513327 - protein, 7 aa, Mycobacterium
KNDFPSR

SEQ ID NO: 513328 - protein, 7 aa, Mycobacterium
KNDGHAD

SEQ ID NO: 513329 - protein, 8 aa, Mycobacterium
KNDGIAAR

SEQ ID NO: 513330 - protein, 7 aa, Mycobacterium
KNDGSPY

SEQ ID NO: 513331 - protein, 4 aa, Mycobacterium
KNDI

SEQ ID NO: 513332 - protein, 5 aa, Mycobacterium
KNDIH

SEQ ID NO: 513333 - protein, 12 aa, Mycobacterium
KNDLRRNTRFGT

SEQ ID NO: 513334 - protein, 9 aa, Mycobacterium
KNDPAYQPA

SEQ ID NO: 513335 - protein, 8 aa, Mycobacterium
KNDPQHER

SEQ ID NO: 513336 - protein, 13 aa, Mycobacterium
KNDPVDAEGEERG

SEQ ID NO: 513337 - protein, 7 aa, Mycobacterium
KNDRIDS

SEQ ID NO: 513338 - protein, 5 aa, Mycobacterium
KNEDP

SEQ ID NO: 513339 - protein, 10 aa, Mycobacterium
KNEEGPEPQD

SEQ ID NO: 513340 - protein, 5 aa, Mycobacterium
KNEGV

SEQ ID NO: 513341 - protein, 5 aa, Mycobacterium
KNEIS

SEQ ID NO: 513342 - protein, 13 aa, Mycobacterium
KNEPEDPDTGERG

SEQ ID NO: 513343 - protein, 12 aa, Mycobacterium
KNEPEDPETGER

SEQ ID NO: 513344 - protein, 12 aa, Mycobacterium
KNEPVDDEAEER

SEQ ID NO: 513345 - protein, 11 aa, Mycobacterium
KNESEAVGLPT

SEQ ID NO: 513346 - protein, 8 aa, Mycobacterium
KNETTNAP

SEQ ID NO: 513347 - protein, 8 aa, Mycobacterium
KNETWNAK

SEQ ID NO: 513348 - protein, 4 aa, Mycobacterium
KNFP

SEQ ID NO: 513349 - protein, 12 aa, Mycobacterium
KNFRNGALNPNA

SEQ ID NO: 513350 - protein, 13 aa, Mycobacterium
KNFRNGARNPNAF

SEQ ID NO: 513351 - protein, 12 aa, Mycobacterium
KNFSAGHDLGSE

SEQ ID NO: 513352 - protein, 8 aa, Mycobacterium
KNFSGNGD

SEQ ID NO: 513353 - protein, 9 aa, Mycobacterium
KNGAGPGAL

SEQ ID NO: 513354 - protein, 7 aa, Mycobacterium
KNGAQFN

SEQ ID NO: 513355 - protein, 11 aa, Mycobacterium
KNGDGSAGANG

SEQ ID NO: 513356 - protein, 9 aa, Mycobacterium
KNGDSRVPA

SEQ ID NO: 513357 - protein, 5 aa, Mycobacterium
KNGGG

SEQ ID NO: 513358 - protein, 9 aa, Mycobacterium
KNGGPETYV

SEQ ID NO: 513359 - protein, 10 aa, Mycobacterium
KNGGRARRDT

SEQ ID NO: 513360 - protein, 23 aa, Mycobacterium
KNGHNVSSRGRIPAEVVDAFNAA

SEQ ID NO: 513361 - protein, 5 aa, Mycobacterium
KNGIA

SEQ ID NO: 513362 - protein, 7 aa, Mycobacterium
KNGIEEA

SEQ ID NO: 513363 - protein, 6 aa, Mycobacterium
KNGKLA

SEQ ID NO: 513364 - protein, 7 aa, Mycobacterium
KNGLSED

SEQ ID NO: 513365 - protein, 5 aa, Mycobacterium
KNGMP

SEQ ID NO: 513366 - protein, 8 aa, Mycobacterium
KNGPADEQ

SEQ ID NO: 513367 - protein, 16 aa, Mycobacterium
KNGPGPTTPPHPPVHD

SEQ ID NO: 513368 - protein, 7 aa, Mycobacterium
KNGPLEQ

SEQ ID NO: 513369 - protein, 9 aa, Mycobacterium
KNGPSGERP

SEQ ID NO: 513370 - protein, 9 aa, Mycobacterium
KNGRGTPGD

SEQ ID NO: 513371 - protein, 6 aa, Mycobacterium
KNGRHS

SEQ ID NO: 513372 - protein, 6 aa, Mycobacterium
KNGRTT

SEQ ID NO: 513373 - protein, 9 aa, Mycobacterium
KNGSDVTTA

SEQ ID NO: 513374 - protein, 5 aa, Mycobacterium
KNGSY

SEQ ID NO: 513375 - protein, 8 aa, Mycobacterium
KNGTDGNI

SEQ ID NO: 513376 - protein, 8 aa, Mycobacterium
KNGTDGNV

SEQ ID NO: 513377 - protein, 11 aa, Mycobacterium
KNGTGAAATNG

SEQ ID NO: 513378 - protein, 10 aa, Mycobacterium
KNGTGAAGLN

SEQ ID NO: 513379 - protein, 12 aa, Mycobacterium
KNGTRNAQKAHQ

SEQ ID NO: 513380 - protein, 5 aa, Mycobacterium
KNGTY

SEQ ID NO: 513381 - protein, 9 aa, Mycobacterium
KNHHSAGSF

SEQ ID NO: 513382 - protein, 12 aa, Mycobacterium
KNHKHSVNNPYA

SEQ ID NO: 513383 - protein, 12 aa, Mycobacterium
KNHPHPSGKPVS

SEQ ID NO: 513384 - protein, 8 aa, Mycobacterium
KNIARDGQ

SEQ ID NO: 513385 - protein, 5 aa, Mycobacterium
KNIDK

SEQ ID NO: 513386 - protein, 6 aa, Mycobacterium
KNIDTG

SEQ ID NO: 513387 - protein, 5 aa, Mycobacterium
KNIHE

SEQ ID NO: 513388 - protein, 4 aa, Mycobacterium
KNIP

SEQ ID NO: 513389 - protein, 8 aa, Mycobacterium
KNIRPPGV

SEQ ID NO: 513390 - protein, 7 aa, Mycobacterium
KNISAAQ

SEQ ID NO: 513391 - protein, 9 aa, Mycobacterium
KNISAGQVE

SEQ ID NO: 513392 - protein, 15 aa, Mycobacterium
KNISASQVEDAVTTH

SEQ ID NO: 513393 - protein, 8 aa, Mycobacterium
KNISATQV

SEQ ID NO: 513394 - protein, 5 aa, Mycobacterium
KNITA

SEQ ID NO: 513395 - protein, 8 aa, Mycobacterium
KNKDFSQR

SEQ ID NO: 513396 - protein, 8 aa, Mycobacterium
KNKGRPQE

SEQ ID NO: 513397 - protein, 5 aa, Mycobacterium
KNKGT

SEQ ID NO: 513398 - protein, 9 aa, Mycobacterium
KNKLDRSLG

SEQ ID NO: 513399 - protein, 7 aa, Mycobacterium
KNKLERS

SEQ ID NO: 513400 - protein, 7 aa, Mycobacterium
KNKPNDI

SEQ ID NO: 513401 - protein, 6 aa, Mycobacterium
KNLADM

SEQ ID NO: 513402 - protein, 9 aa, Mycobacterium
KNLEPQSSR

SEQ ID NO: 513403 - protein, 6 aa, Mycobacterium
KNLGHG

SEQ ID NO: 513404 - protein, 13 aa, Mycobacterium
KNLGPRRAMTGEP

SEQ ID NO: 513405 - protein, 6 aa, Mycobacterium
KNLNGD

SEQ ID NO: 513406 - protein, 10 aa, Mycobacterium
KNLPNRSGDG

SEQ ID NO: 513407 - protein, 18 aa, Mycobacterium
KNLQPAEPARGAFAPTDR

SEQ ID NO: 513408 - protein, 5 aa, Mycobacterium
KNLQS

SEQ ID NO: 513409 - protein, 7 aa, Mycobacterium
KNLRNGA

SEQ ID NO: 513410 - protein, 5 aa, Mycobacterium
KNLRS

SEQ ID NO: 513411 - protein, 10 aa, Mycobacterium
KNLSDAERDG

SEQ ID NO: 513412 - protein, 11 aa, Mycobacterium
KNLSDSERDGL

SEQ ID NO: 513413 - protein, 16 aa, Mycobacterium
KNLTGQGGPGSPGVAE

SEQ ID NO: 513414 - protein, 13 aa, Mycobacterium
KNMDGSDDLTADK

SEQ ID NO: 513415 - protein, 22 aa, Mycobacterium
KNMSPKAIREARESGQLDELMG

SEQ ID NO: 513416 - protein, 6 aa, Mycobacterium
KNNALP

SEQ ID NO: 513417 - protein, 8 aa, Mycobacterium
KNNQAGTP

SEQ ID NO: 513418 - protein, 4 aa, Mycobacterium
KNNR

SEQ ID NO: 513419 - protein, 5 aa, Mycobacterium
KNNWD

SEQ ID NO: 513420 - protein, 6 aa, Mycobacterium
KNPADR

SEQ ID NO: 513421 - protein, 8 aa, Mycobacterium
KNPAPLKA

SEQ ID NO: 513422 - protein, 4 aa, Mycobacterium
KNPD

SEQ ID NO: 513423 - protein, 10 aa, Mycobacterium
KNPDGVAVDG

SEQ ID NO: 513424 - protein, 7 aa, Mycobacterium
KNPDLAG

SEQ ID NO: 513425 - protein, 7 aa, Mycobacterium
KNPDPQI

SEQ ID NO: 513426 - protein, 7 aa, Mycobacterium
KNPDQLA

SEQ ID NO: 513427 - protein, 5 aa, Mycobacterium
KNPDW

SEQ ID NO: 513428 - protein, 7 aa, Mycobacterium
KNPEAEA

SEQ ID NO: 513429 - protein, 10 aa, Mycobacterium
KNPEEAQRRE

SEQ ID NO: 513430 - protein, 7 aa, Mycobacterium
KNPEQSL

SEQ ID NO: 513431 - protein, 7 aa, Mycobacterium
KNPESRA

SEQ ID NO: 513432 - protein, 9 aa, Mycobacterium
KNPGAGPHL

SEQ ID NO: 513433 - protein, 8 aa, Mycobacterium
KNPGERPK

SEQ ID NO: 513434 - protein, 8 aa, Mycobacterium
KNPGWSNA

SEQ ID NO: 513435 - protein, 7 aa, Mycobacterium
KNPHAEK

SEQ ID NO: 513436 - protein, 7 aa, Mycobacterium
KNPNGYC

SEQ ID NO: 513437 - protein, 12 aa, Mycobacterium
KNPPAANPLGED

SEQ ID NO: 513438 - protein, 15 aa, Mycobacterium
KNPPAGSFSPGGHDA

SEQ ID NO: 513439 - protein, 9 aa, Mycobacterium
KNPPHRTEA

SEQ ID NO: 513440 - protein, 6 aa, Mycobacterium
KNPPLL

SEQ ID NO: 513441 - protein, 7 aa, Mycobacterium
KNPPSRA

SEQ ID NO: 513442 - protein, 7 aa, Mycobacterium
KNPQEAI

SEQ ID NO: 513443 - protein, 6 aa, Mycobacterium
KNPRLA

SEQ ID NO: 513444 - protein, 10 aa, Mycobacterium
KNPRLGARPR

SEQ ID NO: 513445 - protein, 6 aa, Mycobacterium
KNPRVE

SEQ ID NO: 513446 - protein, 7 aa, Mycobacterium
KNPRVEL

SEQ ID NO: 513447 - protein, 8 aa, Mycobacterium
KNPRYPVG

SEQ ID NO: 513448 - protein, 6 aa, Mycobacterium
KNQAAH

SEQ ID NO: 513449 - protein, 9 aa, Mycobacterium
KNQDPACPA

SEQ ID NO: 513450 - protein, 8 aa, Mycobacterium
KNQDPPRY

SEQ ID NO: 513451 - protein, 7 aa, Mycobacterium
KNQHARA

SEQ ID NO: 513452 - protein, 6 aa, Mycobacterium
KNQKAY

SEQ ID NO: 513453 - protein, 7 aa, Mycobacterium
KNQQAHV

SEQ ID NO: 513454 - protein, 11 aa, Mycobacterium
KNQRDTNPDAL

SEQ ID NO: 513455 - protein, 7 aa, Mycobacterium
KNQRSAI

SEQ ID NO: 513456 - protein, 9 aa, Mycobacterium
KNQSEYSRK

SEQ ID NO: 513457 - protein, 12 aa, Mycobacterium
KNQSSDEGARAI

SEQ ID NO: 513458 - protein, 11 aa, Mycobacterium
KNQSSDIGPRA

SEQ ID NO: 513459 - protein, 10 aa, Mycobacterium
KNQTYNTPAI

SEQ ID NO: 513460 - protein, 12 aa, Mycobacterium
KNRANDNAPGDF

SEQ ID NO: 513461 - protein, 5 aa, Mycobacterium
KNREA

SEQ ID NO: 513462 - protein, 6 aa, Mycobacterium
KNREDN

SEQ ID NO: 513463 - protein, 6 aa, Mycobacterium
KNREEG

SEQ ID NO: 513464 - protein, 4 aa, Mycobacterium
KNRG

SEQ ID NO: 513465 - protein, 10 aa, Mycobacterium
KNRGHFPDRD

SEQ ID NO: 513466 - protein, 8 aa, Mycobacterium
KNRGTLST

SEQ ID NO: 513467 - protein, 6 aa, Mycobacterium
KNRHPQ

SEQ ID NO: 513468 - protein, 8 aa, Mycobacterium
KNRPDTEF

SEQ ID NO: 513469 - protein, 7 aa, Mycobacterium
KNRPLGD

SEQ ID NO: 513470 - protein, 7 aa, Mycobacterium
KNRPVGA

SEQ ID NO: 513471 - protein, 8 aa, Mycobacterium
KNRRIADG

SEQ ID NO: 513472 - protein, 10 aa, Mycobacterium
KNRRPGNIGA

SEQ ID NO: 513473 - protein, 7 aa, Mycobacterium
KNRTARQ

SEQ ID NO: 513474 - protein, 5 aa, Mycobacterium
KNSAG

SEQ ID NO: 513475 - protein, 6 aa, Mycobacterium
KNSAGQ

SEQ ID NO: 513476 - protein, 8 aa, Mycobacterium
KNSDKRDD

SEQ ID NO: 513477 - protein, 7 aa, Mycobacterium
KNSDPAF

SEQ ID NO: 513478 - protein, 8 aa, Mycobacterium
KNSGGAMT

SEQ ID NO: 513479 - protein, 9 aa, Mycobacterium
KNSGGTMTS

SEQ ID NO: 513480 - protein, 11 aa, Mycobacterium
KNSGIGRENGW

SEQ ID NO: 513481 - protein, 8 aa, Mycobacterium
KNSGNTLP

SEQ ID NO: 513482 - protein, 16 aa, Mycobacterium
KNSISPRDALASAGGT

SEQ ID NO: 513483 - protein, 15 aa, Mycobacterium
KNSISPRDALASAGK

SEQ ID NO: 513484 - protein, 15 aa, Mycobacterium
KNSITPRDALASAGK

SEQ ID NO: 513485 - protein, 8 aa, Mycobacterium
KNSNPQAR

SEQ ID NO: 513486 - protein, 9 aa, Mycobacterium
KNSRHGLHN

SEQ ID NO: 513487 - protein, 20 aa, Mycobacterium
KNSRHGLNNPNARFRKESSV

SEQ ID NO: 513488 - protein, 16 aa, Mycobacterium
KNSRHGLQNPNARYRK

SEQ ID NO: 513489 - protein, 22 aa, Mycobacterium
KNSRHGLQNPNARYRKEASADD

SEQ ID NO: 513490 - protein, 6 aa, Mycobacterium
KNSRRV

SEQ ID NO: 513491 - protein, 15 aa, Mycobacterium
KNSTGGSASAQLGQA

SEQ ID NO: 513492 - protein, 9 aa, Mycobacterium
KNSTIGAGT

SEQ ID NO: 513493 - protein, 10 aa, Mycobacterium
KNSTIGTGSK

SEQ ID NO: 513494 - protein, 10 aa, Mycobacterium
KNSTIGTGTK

SEQ ID NO: 513495 - protein, 8 aa, Mycobacterium
KNSVTGSY

SEQ ID NO: 513496 - protein, 7 aa, Mycobacterium
KNTANRY

SEQ ID NO: 513497 - protein, 7 aa, Mycobacterium
KNTDHRP

SEQ ID NO: 513498 - protein, 14 aa, Mycobacterium
KNTDTREHDIADSD

SEQ ID NO: 513499 - protein, 12 aa, Mycobacterium
KNTGDQPQDYFS

SEQ ID NO: 513500 - protein, 8 aa, Mycobacterium
KNTKVGDM

SEQ ID NO: 513501 - protein, 20 aa, Mycobacterium
KNTNPTAKATVGKGNPANGI

SEQ ID NO: 513502 - protein, 14 aa, Mycobacterium
KNTPGAAGAEETQY

SEQ ID NO: 513503 - protein, 5 aa, Mycobacterium
KNTPV

SEQ ID NO: 513504 - protein, 7 aa, Mycobacterium
KNTQGVE

SEQ ID NO: 513505 - protein, 5 aa, Mycobacterium
KNVAK

SEQ ID NO: 513506 - protein, 7 aa, Mycobacterium
KNVGADA

SEQ ID NO: 513507 - protein, 8 aa, Mycobacterium
KNVHGEAP

SEQ ID NO: 513508 - protein, 6 aa, Mycobacterium
KNVPDL

SEQ ID NO: 513509 - protein, 9 aa, Mycobacterium
KNVPTARSE

SEQ ID NO: 513510 - protein, 10 aa, Mycobacterium
KNVPTARSED

SEQ ID NO: 513511 - protein, 8 aa, Mycobacterium
KNVPTPGQ

SEQ ID NO: 513512 - protein, 9 aa, Mycobacterium
KNVPTSRSE

SEQ ID NO: 513513 - protein, 10 aa, Mycobacterium
KNVPTSRSEN

SEQ ID NO: 513514 - protein, 9 aa, Mycobacterium
KNVPTSRTE

SEQ ID NO: 513515 - protein, 9 aa, Mycobacterium
KNVTGIEEG

SEQ ID NO: 513516 - protein, 7 aa, Mycobacterium
KNVTPGA

SEQ ID NO: 513517 - protein, 19 aa, Mycobacterium
KNWGKGRDNRRQRYADGQS

SEQ ID NO: 513518 - protein, 17 aa, Mycobacterium
KNYAGTSPLTIASGRKR

SEQ ID NO: 513519 - protein, 17 aa, Mycobacterium
KNYAGTSPLTVASGKKR

SEQ ID NO: 513520 - protein, 7 aa, Mycobacterium
KNYRGTD

SEQ ID NO: 513521 - protein, 10 aa, Mycobacterium
KPAAARGATR

SEQ ID NO: 513522 - protein, 9 aa, Mycobacterium
KPAADGSRM

SEQ ID NO: 513523 - protein, 5 aa, Mycobacterium
KPAAE

SEQ ID NO: 513524 - protein, 13 aa, Mycobacterium
KPAAGADPRSGRW

SEQ ID NO: 513525 - protein, 7 aa, Mycobacterium
KPAAGRV

SEQ ID NO: 513526 - protein, 5 aa, Mycobacterium
KPAAI

SEQ ID NO: 513527 - protein, 6 aa, Mycobacterium
KPAAMP

SEQ ID NO: 513528 - protein, 9 aa, Mycobacterium
KPAAPTPCS

SEQ ID NO: 513529 - protein, 14 aa, Mycobacterium
KPAATAAERATAAE

SEQ ID NO: 513530 - protein, 4 aa, Mycobacterium
KPAD

SEQ ID NO: 513531 - protein, 6 aa, Mycobacterium
KPADFA

SEQ ID NO: 513532 - protein, 8 aa, Mycobacterium
KPADGEGL

SEQ ID NO: 513533 - protein, 7 aa, Mycobacterium
KPADGTV

SEQ ID NO: 513534 - protein, 10 aa, Mycobacterium
KPADHAPPGL

SEQ ID NO: 513535 - protein, 5 aa, Mycobacterium
KPADI

SEQ ID NO: 513536 - protein, 7 aa, Mycobacterium
KPADLDA

SEQ ID NO: 513537 - protein, 8 aa, Mycobacterium
KPADPAVA

SEQ ID NO: 513538 - protein, 14 aa, Mycobacterium
KPADPPGTPDDPEM

SEQ ID NO: 513539 - protein, 15 aa, Mycobacterium
KPADPPGTPDDPEQT

SEQ ID NO: 513540 - protein, 5 aa, Mycobacterium
KPADV

SEQ ID NO: 513541 - protein, 8 aa, Mycobacterium
KPAEETPL

SEQ ID NO: 513542 - protein, 5 aa, Mycobacterium
KPAEG

SEQ ID NO: 513543 - protein, 13 aa, Mycobacterium
KPAEGIPGTERTP

SEQ ID NO: 513544 - protein, 12 aa, Mycobacterium
KPAEGVPGTERT

SEQ ID NO: 513545 - protein, 13 aa, Mycobacterium
KPAEGVQGTERTP

SEQ ID NO: 513546 - protein, 5 aa, Mycobacterium
KPAEI

SEQ ID NO: 513547 - protein, 13 aa, Mycobacterium
KPAESVPGTERTP

SEQ ID NO: 513548 - protein, 8 aa, Mycobacterium
KPAEVETA

SEQ ID NO: 513549 - protein, 6 aa, Mycobacterium
KPAFKD

SEQ ID NO: 513550 - protein, 6 aa, Mycobacterium
KPAFTD

SEQ ID NO: 513551 - protein, 6 aa, Mycobacterium
KPAFTE

SEQ ID NO: 513552 - protein, 7 aa, Mycobacterium
KPAGDSA

SEQ ID NO: 513553 - protein, 9 aa, Mycobacterium
KPAGHGIND

SEQ ID NO: 513554 - protein, 6 aa, Mycobacterium
KPAGIA

SEQ ID NO: 513555 - protein, 7 aa, Mycobacterium
KPAGPAR

SEQ ID NO: 513556 - protein, 21 aa, Mycobacterium
KPAGPPAPGQPGWNPQRGSAM

SEQ ID NO: 513557 - protein, 22 aa, Mycobacterium
KPAGPPGPGQPAWNPQRGSSMP

SEQ ID NO: 513558 - protein, 12 aa, Mycobacterium
KPAGPPSPGQPV

SEQ ID NO: 513559 - protein, 8 aa, Mycobacterium
KPAGSAEL

SEQ ID NO: 513560 - protein, 4 aa, Mycobacterium
KPAH

SEQ ID NO: 513561 - protein, 9 aa, Mycobacterium
KPAHAQSAA

SEQ ID NO: 513562 - protein, 4 aa, Mycobacterium
KPAI

SEQ ID NO: 513563 - protein, 77 aa, Mycobacterium
KPAISGLPGSAQAPATPSGPGIGGSPSAPAMPSAPSAGASPLSSSSGLASSGTSGAERAADATAAASAAGPRAPVDP

SEQ ID NO: 513564 - protein, 10 aa, Mycobacterium
KPAKDDKAEE

SEQ ID NO: 513565 - protein, 5 aa, Mycobacterium
KPAKE

SEQ ID NO: 513566 - protein, 12 aa, Mycobacterium
KPAKLSGGQRQR

SEQ ID NO: 513567 - protein, 8 aa, Mycobacterium
KPALGPAA

SEQ ID NO: 513568 - protein, 9 aa, Mycobacterium
KPALPTDDD

SEQ ID NO: 513569 - protein, 5 aa, Mycobacterium
KPALR

SEQ ID NO: 513570 - protein, 6 aa, Mycobacterium
KPALVS

SEQ ID NO: 513571 - protein, 4 aa, Mycobacterium
KPAM

SEQ ID NO: 513572 - protein, 15 aa, Mycobacterium
KPANPPGTPDDPDAA

SEQ ID NO: 513573 - protein, 9 aa, Mycobacterium
KPAPAPESI

SEQ ID NO: 513574 - protein, 8 aa, Mycobacterium
KPAPEAFS

SEQ ID NO: 513575 - protein, 6 aa, Mycobacterium
KPAPGL

SEQ ID NO: 513576 - protein, 8 aa, Mycobacterium
KPAPGTVR

SEQ ID NO: 513577 - protein, 7 aa, Mycobacterium
KPAPLTA

SEQ ID NO: 513578 - protein, 7 aa, Mycobacterium
KPAPPFV

SEQ ID NO: 513579 - protein, 15 aa, Mycobacterium
KPAPPLRGSMAPTDR

SEQ ID NO: 513580 - protein, 7 aa, Mycobacterium
KPAPSVS

SEQ ID NO: 513581 - protein, 9 aa, Mycobacterium
KPAPTADAI

SEQ ID NO: 513582 - protein, 5 aa, Mycobacterium
KPAQE

SEQ ID NO: 513583 - protein, 7 aa, Mycobacterium
KPAQGNV

SEQ ID NO: 513584 - protein, 6 aa, Mycobacterium
KPAQRI

SEQ ID NO: 513585 - protein, 5 aa, Mycobacterium
KPARE

SEQ ID NO: 513586 - protein, 9 aa, Mycobacterium
KPARIDTPI

SEQ ID NO: 513587 - protein, 9 aa, Mycobacterium
KPARPVPPW

SEQ ID NO: 513588 - protein, 13 aa, Mycobacterium
KPARVADAEQRLR

SEQ ID NO: 513589 - protein, 16 aa, Mycobacterium
KPASDIDRATARPTFD

SEQ ID NO: 513590 - protein, 8 aa, Mycobacterium
KPASEQPW

SEQ ID NO: 513591 - protein, 15 aa, Mycobacterium
KPASKQGVAAPRPSM

SEQ ID NO: 513592 - protein, 9 aa, Mycobacterium
KPASPEKDH

SEQ ID NO: 513593 - protein, 9 aa, Mycobacterium
KPASSGWES

SEQ ID NO: 513594 - protein, 8 aa, Mycobacterium
KPATSPVS

SEQ ID NO: 513595 - protein, 4 aa, Mycobacterium
KPAV

SEQ ID NO: 513596 - protein, 4 aa, Mycobacterium
KPDA

SEQ ID NO: 513597 - protein, 20 aa, Mycobacterium
KPDAGTIRADGETVVTTSRD

SEQ ID NO: 513598 - protein, 11 aa, Mycobacterium
KPDAHTPSEAA

SEQ ID NO: 513599 - protein, 8 aa, Mycobacterium
KPDAKGAH

SEQ ID NO: 513600 - protein, 9 aa, Mycobacterium
KPDAKGANV

SEQ ID NO: 513601 - protein, 17 aa, Mycobacterium
KPDAMKPAVQNATDKGI

SEQ ID NO: 513602 - protein, 10 aa, Mycobacterium
KPDDEGAADE

SEQ ID NO: 513603 - protein, 8 aa, Mycobacterium
KPDDFQDK

SEQ ID NO: 513604 - protein, 6 aa, Mycobacterium
KPDEGF

SEQ ID NO: 513605 - protein, 20 aa, Mycobacterium
KPDEIPHDTRPNAPAAYGDN

SEQ ID NO: 513606 - protein, 8 aa, Mycobacterium
KPDEKTPL

SEQ ID NO: 513607 - protein, 9 aa, Mycobacterium
KPDEPFQPY

SEQ ID NO: 513608 - protein, 16 aa, Mycobacterium
KPDEPFQPYARDPETL

SEQ ID NO: 513609 - protein, 16 aa, Mycobacterium
KPDEPFQPYNRDPETL

SEQ ID NO: 513610 - protein, 6 aa, Mycobacterium
KPDESR

SEQ ID NO: 513611 - protein, 8 aa, Mycobacterium
KPDETAAA

SEQ ID NO: 513612 - protein, 4 aa, Mycobacterium
KPDF

SEQ ID NO: 513613 - protein, 7 aa, Mycobacterium
KPDFQTE

SEQ ID NO: 513614 - protein, 4 aa, Mycobacterium
KPDG

SEQ ID NO: 513615 - protein, 7 aa, Mycobacterium
KPDGAGV

SEQ ID NO: 513616 - protein, 8 aa, Mycobacterium
KPDGDDEY

SEQ ID NO: 513617 - protein, 38 aa, Mycobacterium
KPDGGGDPKPPAKKTTTRKVAPKKAVADPRSRFRVVNG

SEQ ID NO: 513618 - protein, 6 aa, Mycobacterium
KPDGLT

SEQ ID NO: 513619 - protein, 16 aa, Mycobacterium
KPDGPGVRPVASTRTV

SEQ ID NO: 513620 - protein, 7 aa, Mycobacterium
KPDGSMR

SEQ ID NO: 513621 - protein, 7 aa, Mycobacterium
KPDGSPY

SEQ ID NO: 513622 - protein, 5 aa, Mycobacterium
KPDGT

SEQ ID NO: 513623 - protein, 8 aa, Mycobacterium
KPDHGRGE

SEQ ID NO: 513624 - protein, 4 aa, Mycobacterium
KPDI

SEQ ID NO: 513625 - protein, 5 aa, Mycobacterium
KPDIA

SEQ ID NO: 513626 - protein, 5 aa, Mycobacterium
KPDLG

SEQ ID NO: 513627 - protein, 15 aa, Mycobacterium
KPDLQSALGASSGGG

SEQ ID NO: 513628 - protein, 15 aa, Mycobacterium
KPDMQNSLGAGQGSA

SEQ ID NO: 513629 - protein, 7 aa, Mycobacterium
KPDNAAA

SEQ ID NO: 513630 - protein, 4 aa, Mycobacterium
KPDP

SEQ ID NO: 513631 - protein, 6 aa, Mycobacterium
KPDPAA

SEQ ID NO: 513632 - protein, 11 aa, Mycobacterium
KPDPDGQLAGD

SEQ ID NO: 513633 - protein, 6 aa, Mycobacterium
KPDPDK

SEQ ID NO: 513634 - protein, 7 aa, Mycobacterium
KPDPEQL

SEQ ID NO: 513635 - protein, 6 aa, Mycobacterium
KPDPLA

SEQ ID NO: 513636 - protein, 10 aa, Mycobacterium
KPDPNTPWNA

SEQ ID NO: 513637 - protein, 7 aa, Mycobacterium
KPDPSVY

SEQ ID NO: 513638 - protein, 4 aa, Mycobacterium
KPDQ

SEQ ID NO: 513639 - protein, 6 aa, Mycobacterium
KPDQFA

SEQ ID NO: 513640 - protein, 9 aa, Mycobacterium
KPDRPREDP

SEQ ID NO: 513641 - protein, 6 aa, Mycobacterium
KPDRSW

SEQ ID NO: 513642 - protein, 9 aa, Mycobacterium
KPDSGGGTY

SEQ ID NO: 513643 - protein, 7 aa, Mycobacterium
KPDSGRA

SEQ ID NO: 513644 - protein, 10 aa, Mycobacterium
KPDSQISRPP

SEQ ID NO: 513645 - protein, 17 aa, Mycobacterium
KPDSWPADTPDPPDRHY

SEQ ID NO: 513646 - protein, 7 aa, Mycobacterium
KPDTLYG

SEQ ID NO: 513647 - protein, 6 aa, Mycobacterium
KPDWQG

SEQ ID NO: 513648 - protein, 15 aa, Mycobacterium
KPDYDGYAEFAGPDA

SEQ ID NO: 513649 - protein, 9 aa, Mycobacterium
KPEADGGFS

SEQ ID NO: 513650 - protein, 8 aa, Mycobacterium
KPEAEGGF

SEQ ID NO: 513651 - protein, 7 aa, Mycobacterium
KPEAKKV

SEQ ID NO: 513652 - protein, 9 aa, Mycobacterium
KPEDAAKSE

SEQ ID NO: 513653 - protein, 13 aa, Mycobacterium
KPEDAEAIAAAGR

SEQ ID NO: 513654 - protein, 10 aa, Mycobacterium
KPEDFESVGE

SEQ ID NO: 513655 - protein, 8 aa, Mycobacterium
KPEDSEDR

SEQ ID NO: 513656 - protein, 5 aa, Mycobacterium
KPEDW

SEQ ID NO: 513657 - protein, 10 aa, Mycobacterium
KPEESERTFG

SEQ ID NO: 513658 - protein, 6 aa, Mycobacterium
KPEETI

SEQ ID NO: 513659 - protein, 5 aa, Mycobacterium
KPEEW

SEQ ID NO: 513660 - protein, 8 aa, Mycobacterium
KPEGLDKT

SEQ ID NO: 513661 - protein, 6 aa, Mycobacterium
KPEGSV

SEQ ID NO: 513662 - protein, 8 aa, Mycobacterium
KPEGVGQT

SEQ ID NO: 513663 - protein, 5 aa, Mycobacterium
KPEIS

SEQ ID NO: 513664 - protein, 6 aa, Mycobacterium
KPEKQQ

SEQ ID NO: 513665 - protein, 6 aa, Mycobacterium
KPELDR

SEQ ID NO: 513666 - protein, 9 aa, Mycobacterium
KPELGASNP

SEQ ID NO: 513667 - protein, 7 aa, Mycobacterium
KPELGPG

SEQ ID NO: 513668 - protein, 8 aa, Mycobacterium
KPENKAAL

SEQ ID NO: 513669 - protein, 7 aa, Mycobacterium
KPENKRA

SEQ ID NO: 513670 - protein, 15 aa, Mycobacterium
KPEPDNEIPQAASAH

SEQ ID NO: 513671 - protein, 5 aa, Mycobacterium
KPEPL

SEQ ID NO: 513672 - protein, 7 aa, Mycobacterium
KPEPVTQ

SEQ ID NO: 513673 - protein, 6 aa, Mycobacterium
KPEQEE

SEQ ID NO: 513674 - protein, 5 aa, Mycobacterium
KPEQQ

SEQ ID NO: 513675 - protein, 8 aa, Mycobacterium
KPEQTTRT

SEQ ID NO: 513676 - protein, 7 aa, Mycobacterium
KPERQRA

SEQ ID NO: 513677 - protein, 10 aa, Mycobacterium
KPERTTKKPK

SEQ ID NO: 513678 - protein, 10 aa, Mycobacterium
KPERVGSRNP

SEQ ID NO: 513679 - protein, 4 aa, Mycobacterium
KPES

SEQ ID NO: 513680 - protein, 13 aa, Mycobacterium
KPESDDVRDSPAL

SEQ ID NO: 513681 - protein, 7 aa, Mycobacterium
KPESPDA

SEQ ID NO: 513682 - protein, 41 aa, Mycobacterium
KPESQWLGGEKRKNRGAKENPEGSPAVKGEKPFTHEQHTAT

SEQ ID NO: 513683 - protein, 7 aa, Mycobacterium
KPESVDA

SEQ ID NO: 513684 - protein, 8 aa, Mycobacterium
KPESVETV

SEQ ID NO: 513685 - protein, 12 aa, Mycobacterium
KPETKNNPMPEI

SEQ ID NO: 513686 - protein, 5 aa, Mycobacterium
KPEVA

SEQ ID NO: 513687 - protein, 10 aa, Mycobacterium
KPEVAGPAEA

SEQ ID NO: 513688 - protein, 8 aa, Mycobacterium
KPEYSNLP

SEQ ID NO: 513689 - protein, 4 aa, Mycobacterium
KPFA

SEQ ID NO: 513690 - protein, 22 aa, Mycobacterium
KPFARNESEAATVAQAARDAGV

SEQ ID NO: 513691 - protein, 6 aa, Mycobacterium
KPFGGG

SEQ ID NO: 513692 - protein, 6 aa, Mycobacterium
KPFGLD

SEQ ID NO: 513693 - protein, 7 aa, Mycobacterium
KPFGTDQ

SEQ ID NO: 513694 - protein, 14 aa, Mycobacterium
KPFPNPLTPAAGST

SEQ ID NO: 513695 - protein, 4 aa, Mycobacterium
KPFT

SEQ ID NO: 513696 - protein, 7 aa, Mycobacterium
KPFTSTG

SEQ ID NO: 513697 - protein, 8 aa, Mycobacterium
KPGADGVA

SEQ ID NO: 513698 - protein, 7 aa, Mycobacterium
KPGAFGA

SEQ ID NO: 513699 - protein, 9 aa, Mycobacterium
KPGAGSLSI

SEQ ID NO: 513700 - protein, 11 aa, Mycobacterium
KPGAGSLSVGD

SEQ ID NO: 513701 - protein, 31 aa, Mycobacterium
KPGAITTTSAVRGQFKTNAASRAEALDLILR

SEQ ID NO: 513702 - protein, 14 aa, Mycobacterium
KPGAKVDARSERWR

SEQ ID NO: 513703 - protein, 11 aa, Mycobacterium
KPGANGPQVAA

SEQ ID NO: 513704 - protein, 6 aa, Mycobacterium
KPGASA

SEQ ID NO: 513705 - protein, 5 aa, Mycobacterium
KPGAT

SEQ ID NO: 513706 - protein, 11 aa, Mycobacterium
KPGAVTTTSAV

SEQ ID NO: 513707 - protein, 31 aa, Mycobacterium
KPGAVTTTSAVRGQFKTDKASRAEALDLILR

SEQ ID NO: 513708 - protein, 11 aa, Mycobacterium
KPGDALPSEGE

SEQ ID NO: 513709 - protein, 12 aa, Mycobacterium
KPGDPGDSGEEQ

SEQ ID NO: 513710 - protein, 6 aa, Mycobacterium
KPGEFN

SEQ ID NO: 513711 - protein, 10 aa, Mycobacterium
KPGEPLPADA

SEQ ID NO: 513712 - protein, 10 aa, Mycobacterium
KPGEPLPGDA

SEQ ID NO: 513713 - protein, 9 aa, Mycobacterium
KPGETDPMT

SEQ ID NO: 513714 - protein, 4 aa, Mycobacterium
KPGF

SEQ ID NO: 513715 - protein, 24 aa, Mycobacterium
KPGFARAGGVDPSARYSVEGNTTA

SEQ ID NO: 513716 - protein, 5 aa, Mycobacterium
KPGGE

SEQ ID NO: 513717 - protein, 18 aa, Mycobacterium
KPGGERTQCPADVDSSYS

SEQ ID NO: 513718 - protein, 15 aa, Mycobacterium
KPGGGAQRPEPQPEV

SEQ ID NO: 513719 - protein, 6 aa, Mycobacterium
KPGGLT

SEQ ID NO: 513720 - protein, 7 aa, Mycobacterium
KPGGMTS

SEQ ID NO: 513721 - protein, 10 aa, Mycobacterium
KPGGRDDATE

SEQ ID NO: 513722 - protein, 5 aa, Mycobacterium
KPGGV

SEQ ID NO: 513723 - protein, 6 aa, Mycobacterium
KPGHTA

SEQ ID NO: 513724 - protein, 12 aa, Mycobacterium
KPGISVRESADE

SEQ ID NO: 513725 - protein, 6 aa, Mycobacterium
KPGKPV

SEQ ID NO: 513726 - protein, 7 aa, Mycobacterium
KPGKPWR

SEQ ID NO: 513727 - protein, 7 aa, Mycobacterium
KPGLAAT

SEQ ID NO: 513728 - protein, 10 aa, Mycobacterium
KPGLPGLKGE

SEQ ID NO: 513729 - protein, 5 aa, Mycobacterium
KPGLR

SEQ ID NO: 513730 - protein, 7 aa, Mycobacterium
KPGLRQA

SEQ ID NO: 513731 - protein, 5 aa, Mycobacterium
KPGLT

SEQ ID NO: 513732 - protein, 4 aa, Mycobacterium
KPGN

SEQ ID NO: 513733 - protein, 12 aa, Mycobacterium
KPGNFTTRNRSS

SEQ ID NO: 513734 - protein, 6 aa, Mycobacterium
KPGNVK

SEQ ID NO: 513735 - protein, 4 aa, Mycobacterium
KPGP

SEQ ID NO: 513736 - protein, 11 aa, Mycobacterium
KPGPLEDTARQ

SEQ ID NO: 513737 - protein, 11 aa, Mycobacterium
KPGPLQDTAQR

SEQ ID NO: 513738 - protein, 8 aa, Mycobacterium
KPGPSNIP

SEQ ID NO: 513739 - protein, 13 aa, Mycobacterium
KPGPTKSSRPPTA

SEQ ID NO: 513740 - protein, 6 aa, Mycobacterium
KPGPVN

SEQ ID NO: 513741 - protein, 7 aa, Mycobacterium
KPGQPLT

SEQ ID NO: 513742 - protein, 9 aa, Mycobacterium
KPGQVQPTT

SEQ ID NO: 513743 - protein, 4 aa, Mycobacterium
KPGR

SEQ ID NO: 513744 - protein, 6 aa, Mycobacterium
KPGRHA

SEQ ID NO: 513745 - protein, 9 aa, Mycobacterium
KPGRSPSTE

SEQ ID NO: 513746 - protein, 5 aa, Mycobacterium
KPGSA

SEQ ID NO: 513747 - protein, 10 aa, Mycobacterium
KPGSATVPMP

SEQ ID NO: 513748 - protein, 7 aa, Mycobacterium
KPGSDWE

SEQ ID NO: 513749 - protein, 10 aa, Mycobacterium
KPGSGPREPG

SEQ ID NO: 513750 - protein, 17 aa, Mycobacterium
KPGSLSSSYDDRTQPMD

SEQ ID NO: 513751 - protein, 11 aa, Mycobacterium
KPGSMGRPLPG

SEQ ID NO: 513752 - protein, 8 aa, Mycobacterium
KPGSRDDA

SEQ ID NO: 513753 - protein, 9 aa, Mycobacterium
KPGSRDDAA

SEQ ID NO: 513754 - protein, 10 aa, Mycobacterium
KPGSRDDATE

SEQ ID NO: 513755 - protein, 14 aa, Mycobacterium
KPGSTGDPGAATDA

SEQ ID NO: 513756 - protein, 6 aa, Mycobacterium
KPGSYY

SEQ ID NO: 513757 - protein, 9 aa, Mycobacterium
KPGTDFTDP

SEQ ID NO: 513758 - protein, 6 aa, Mycobacterium
KPGTPL

SEQ ID NO: 513759 - protein, 5 aa, Mycobacterium
KPGTR

SEQ ID NO: 513760 - protein, 5 aa, Mycobacterium
KPGTS

SEQ ID NO: 513761 - protein, 13 aa, Mycobacterium
KPGTTEPDADLTK

SEQ ID NO: 513762 - protein, 25 aa, Mycobacterium
KPGTVTSWQPTAAAREVARQAPVSS

SEQ ID NO: 513763 - protein, 13 aa, Mycobacterium
KPGTYERQPATIH

SEQ ID NO: 513764 - protein, 5 aa, Mycobacterium
KPGVA

SEQ ID NO: 513765 - protein, 13 aa, Mycobacterium
KPGVGNDEGDGDE

SEQ ID NO: 513766 - protein, 5 aa, Mycobacterium
KPGVR

SEQ ID NO: 513767 - protein, 5 aa, Mycobacterium
KPGVT

SEQ ID NO: 513768 - protein, 20 aa, Mycobacterium
KPGVTTNAVTRTRAAVHPAA

SEQ ID NO: 513769 - protein, 10 aa, Mycobacterium
KPGWQKERQR

SEQ ID NO: 513770 - protein, 6 aa, Mycobacterium
KPGYDP

SEQ ID NO: 513771 - protein, 7 aa, Mycobacterium
KPGYGED

SEQ ID NO: 513772 - protein, 43 aa, Mycobacterium
KPGYTGPATEAAAPATDPTDTAGEDADARDSAEAADTGPLPLS

SEQ ID NO: 513773 - protein, 21 aa, Mycobacterium
KPGYTGPSPEKAAAAAATTRC

SEQ ID NO: 513774 - protein, 40 aa, Mycobacterium
KPGYTGPTTADATAASGPADADGDTTEADDGAGGDGLPLS

SEQ ID NO: 513775 - protein, 9 aa, Mycobacterium
KPHAPQGAQ

SEQ ID NO: 513776 - protein, 5 aa, Mycobacterium
KPHAS

SEQ ID NO: 513777 - protein, 6 aa, Mycobacterium
KPHDDP

SEQ ID NO: 513778 - protein, 7 aa, Mycobacterium
KPHDGVG

SEQ ID NO: 513779 - protein, 6 aa, Mycobacterium
KPHEAN

SEQ ID NO: 513780 - protein, 8 aa, Mycobacterium
KPHFAGER

SEQ ID NO: 513781 - protein, 5 aa, Mycobacterium
KPHGA

SEQ ID NO: 513782 - protein, 5 aa, Mycobacterium
KPHGV

SEQ ID NO: 513783 - protein, 7 aa, Mycobacterium
KPHLSGQ

SEQ ID NO: 513784 - protein, 7 aa, Mycobacterium
KPHPRGW

SEQ ID NO: 513785 - protein, 8 aa, Mycobacterium
KPHPSYNP

SEQ ID NO: 513786 - protein, 29 aa, Mycobacterium
KPHRESDGLDDAALEEAEKRKDEKSELEN

SEQ ID NO: 513787 - protein, 28 aa, Mycobacterium
KPHRESGDDPLTGDPATRTQTEPGETGF

SEQ ID NO: 513788 - protein, 27 aa, Mycobacterium
KPHRESLDDPLDGDPATKTQDEQGDLE

SEQ ID NO: 513789 - protein, 11 aa, Mycobacterium
KPHRETLEDPL

SEQ ID NO: 513790 - protein, 5 aa, Mycobacterium
KPHTV

SEQ ID NO: 513791 - protein, 6 aa, Mycobacterium
KPHTVT

SEQ ID NO: 513792 - protein, 8 aa, Mycobacterium
KPHVGSPQ

SEQ ID NO: 513793 - protein, 10 aa, Mycobacterium
KPIAQKYSTE

SEQ ID NO: 513794 - protein, 7 aa, Mycobacterium
KPIDDDT

SEQ ID NO: 513795 - protein, 7 aa, Mycobacterium
KPIDDQT

SEQ ID NO: 513796 - protein, 8 aa, Mycobacterium
KPIDEPTL

SEQ ID NO: 513797 - protein, 5 aa, Mycobacterium
KPIDG

SEQ ID NO: 513798 - protein, 5 aa, Mycobacterium
KPIDP

SEQ ID NO: 513799 - protein, 7 aa, Mycobacterium
KPIDSQT

SEQ ID NO: 513800 - protein, 4 aa, Mycobacterium
KPIE

SEQ ID NO: 513801 - protein, 5 aa, Mycobacterium
KPIEP

SEQ ID NO: 513802 - protein, 5 aa, Mycobacterium
KPIET

SEQ ID NO: 513803 - protein, 7 aa, Mycobacterium
KPIGSRQ

SEQ ID NO: 513804 - protein, 7 aa, Mycobacterium
KPIPAIE

SEQ ID NO: 513805 - protein, 7 aa, Mycobacterium
KPIPEDD

SEQ ID NO: 513806 - protein, 6 aa, Mycobacterium
KPIPEE

SEQ ID NO: 513807 - protein, 13 aa, Mycobacterium
KPIPGPYTQESRE

SEQ ID NO: 513808 - protein, 6 aa, Mycobacterium
KPIPPR

SEQ ID NO: 513809 - protein, 7 aa, Mycobacterium
KPIPTGK

SEQ ID NO: 513810 - protein, 4 aa, Mycobacterium
KPIR

SEQ ID NO: 513811 - protein, 9 aa, Mycobacterium
KPIRSGDQV

SEQ ID NO: 513812 - protein, 7 aa, Mycobacterium
KPISENA

SEQ ID NO: 513813 - protein, 5 aa, Mycobacterium
KPISP

SEQ ID NO: 513814 - protein, 11 aa, Mycobacterium
KPITDAGEEVK

SEQ ID NO: 513815 - protein, 16 aa, Mycobacterium
KPIVGPELSTAQREEL

SEQ ID NO: 513816 - protein, 7 aa, Mycobacterium
KPKAGKV

SEQ ID NO: 513817 - protein, 12 aa, Mycobacterium
KPKALSGGQRQR

SEQ ID NO: 513818 - protein, 13 aa, Mycobacterium
KPKGLDDATTEKL

SEQ ID NO: 513819 - protein, 10 aa, Mycobacterium
KPKGMDEEMT

SEQ ID NO: 513820 - protein, 10 aa, Mycobacterium
KPKGMDEKMT

SEQ ID NO: 513821 - protein, 11 aa, Mycobacterium
KPKGMDEKMTD

SEQ ID NO: 513822 - protein, 9 aa, Mycobacterium
KPKNQPLDG

SEQ ID NO: 513823 - protein, 7 aa, Mycobacterium
KPKPGRN

SEQ ID NO: 513824 - protein, 16 aa, Mycobacterium
KPKPKHSPLTSASAQG

SEQ ID NO: 513825 - protein, 8 aa, Mycobacterium
KPKPTTLR

SEQ ID NO: 513826 - protein, 11 aa, Mycobacterium
KPKRRTKAQIA

SEQ ID NO: 513827 - protein, 6 aa, Mycobacterium
KPKRYI

SEQ ID NO: 513828 - protein, 6 aa, Mycobacterium
KPKSLS

SEQ ID NO: 513829 - protein, 9 aa, Mycobacterium
KPKSRNDLQ

SEQ ID NO: 513830 - protein, 11 aa, Mycobacterium
KPKTKAGARVA

SEQ ID NO: 513831 - protein, 6 aa, Mycobacterium
KPKTRE

SEQ ID NO: 513832 - protein, 8 aa, Mycobacterium
KPKVRPNT

SEQ ID NO: 513833 - protein, 14 aa, Mycobacterium
KPLAAKGDCTYNGE

SEQ ID NO: 513834 - protein, 7 aa, Mycobacterium
KPLAGPG

SEQ ID NO: 513835 - protein, 7 aa, Mycobacterium
KPLDGSA

SEQ ID NO: 513836 - protein, 11 aa, Mycobacterium
KPLDQTAATPG

SEQ ID NO: 513837 - protein, 8 aa, Mycobacterium
KPLEPADE

SEQ ID NO: 513838 - protein, 8 aa, Mycobacterium
KPLERDAL

SEQ ID NO: 513839 - protein, 6 aa, Mycobacterium
KPLEYP

SEQ ID NO: 513840 - protein, 12 aa, Mycobacterium
KPLGRRGQDGLP

SEQ ID NO: 513841 - protein, 12 aa, Mycobacterium
KPLGRVSEPAEQ

SEQ ID NO: 513842 - protein, 4 aa, Mycobacterium
KPLH

SEQ ID NO: 513843 - protein, 10 aa, Mycobacterium
KPLPESRGEV

SEQ ID NO: 513844 - protein, 13 aa, Mycobacterium
KPLPGTGKPDPAR

SEQ ID NO: 513845 - protein, 6 aa, Mycobacterium
KPLPLS

SEQ ID NO: 513846 - protein, 5 aa, Mycobacterium
KPLPP

SEQ ID NO: 513847 - protein, 8 aa, Mycobacterium
KPLPPTGQ

SEQ ID NO: 513848 - protein, 4 aa, Mycobacterium
KPLQ

SEQ ID NO: 513849 - protein, 9 aa, Mycobacterium
KPLQPQQDR

SEQ ID NO: 513850 - protein, 8 aa, Mycobacterium
KPLSGAER

SEQ ID NO: 513851 - protein, 10 aa, Mycobacterium
KPLSKAERRA

SEQ ID NO: 513852 - protein, 9 aa, Mycobacterium
KPLSSAERR

SEQ ID NO: 513853 - protein, 8 aa, Mycobacterium
KPLSSSER

SEQ ID NO: 513854 - protein, 6 aa, Mycobacterium
KPLSVG

SEQ ID NO: 513855 - protein, 5 aa, Mycobacterium
KPLTD

SEQ ID NO: 513856 - protein, 4 aa, Mycobacterium
KPLW

SEQ ID NO: 513857 - protein, 5 aa, Mycobacterium
KPMAA

SEQ ID NO: 513858 - protein, 6 aa, Mycobacterium
KPMIAQ

SEQ ID NO: 513859 - protein, 6 aa, Mycobacterium
KPMIEQ

SEQ ID NO: 513860 - protein, 6 aa, Mycobacterium
KPMKTT

SEQ ID NO: 513861 - protein, 6 aa, Mycobacterium
KPMLEG

SEQ ID NO: 513862 - protein, 5 aa, Mycobacterium
KPMLP

SEQ ID NO: 513863 - protein, 7 aa, Mycobacterium
KPMPTWG

SEQ ID NO: 513864 - protein, 5 aa, Mycobacterium
KPMPW

SEQ ID NO: 513865 - protein, 11 aa, Mycobacterium
KPMRRTDPAGR

SEQ ID NO: 513866 - protein, 9 aa, Mycobacterium
KPMSAARAK

SEQ ID NO: 513867 - protein, 9 aa, Mycobacterium
KPMSAQRAK

SEQ ID NO: 513868 - protein, 5 aa, Mycobacterium
KPMSP

SEQ ID NO: 513869 - protein, 8 aa, Mycobacterium
KPMSSAER

SEQ ID NO: 513870 - protein, 12 aa, Mycobacterium
KPMVTTDPDTLA

SEQ ID NO: 513871 - protein, 6 aa, Mycobacterium
KPNAEE

SEQ ID NO: 513872 - protein, 21 aa, Mycobacterium
KPNAEPKPSDSTPKPKRRKGV

SEQ ID NO: 513873 - protein, 6 aa, Mycobacterium
KPNAPI

SEQ ID NO: 513874 - protein, 7 aa, Mycobacterium
KPNDVTD

SEQ ID NO: 513875 - protein, 12 aa, Mycobacterium
KPNEVTEEELRT

SEQ ID NO: 513876 - protein, 4 aa, Mycobacterium
KPNN

SEQ ID NO: 513877 - protein, 6 aa, Mycobacterium
KPNPFS

SEQ ID NO: 513878 - protein, 10 aa, Mycobacterium
KPNPKQPRQV

SEQ ID NO: 513879 - protein, 6 aa, Mycobacterium
KPNVGH

SEQ ID NO: 513880 - protein, 20 aa, Mycobacterium
KPNVLPSSTNPTRPHTRNTL

SEQ ID NO: 513881 - protein, 6 aa, Mycobacterium
KPNVVG

SEQ ID NO: 513882 - protein, 4 aa, Mycobacterium
KPNY

SEQ ID NO: 513883 - protein, 7 aa, Mycobacterium
KPPAERK

SEQ ID NO: 513884 - protein, 6 aa, Mycobacterium
KPPAFD

SEQ ID NO: 513885 - protein, 13 aa, Mycobacterium
KPPAFSDLEPRTE

SEQ ID NO: 513886 - protein, 7 aa, Mycobacterium
KPPAGGW

SEQ ID NO: 513887 - protein, 17 aa, Mycobacterium
KPPAINPGLEPEITPTD

SEQ ID NO: 513888 - protein, 18 aa, Mycobacterium
KPPAPKAPPRPRGPRRPA

SEQ ID NO: 513889 - protein, 20 aa, Mycobacterium
KPPAPTGDAAADRDATREEG

SEQ ID NO: 513890 - protein, 14 aa, Mycobacterium
KPPAPTLSPRRSTR

SEQ ID NO: 513891 - protein, 13 aa, Mycobacterium
KPPAVNEKITSTA

SEQ ID NO: 513892 - protein, 8 aa, Mycobacterium
KPPEERDA

SEQ ID NO: 513893 - protein, 8 aa, Mycobacterium
KPPEPKGI

SEQ ID NO: 513894 - protein, 8 aa, Mycobacterium
KPPEPKQI

SEQ ID NO: 513895 - protein, 14 aa, Mycobacterium
KPPESRSERDPWPT

SEQ ID NO: 513896 - protein, 4 aa, Mycobacterium
KPPG

SEQ ID NO: 513897 - protein, 11 aa, Mycobacterium
KPPGDVDPTAA

SEQ ID NO: 513898 - protein, 10 aa, Mycobacterium
KPPGPLPPGA

SEQ ID NO: 513899 - protein, 6 aa, Mycobacterium
KPPGQH

SEQ ID NO: 513900 - protein, 14 aa, Mycobacterium
KPPIGKRGYDKKSV

SEQ ID NO: 513901 - protein, 6 aa, Mycobacterium
KPPIPA

SEQ ID NO: 513902 - protein, 9 aa, Mycobacterium
KPPKPTFEA

SEQ ID NO: 513903 - protein, 4 aa, Mycobacterium
KPPL

SEQ ID NO: 513904 - protein, 6 aa, Mycobacterium
KPPLEP

SEQ ID NO: 513905 - protein, 13 aa, Mycobacterium
KPPLGRRGYDDAQ

SEQ ID NO: 513906 - protein, 5 aa, Mycobacterium
KPPLP

SEQ ID NO: 513907 - protein, 7 aa, Mycobacterium
KPPPFEE

SEQ ID NO: 513908 - protein, 8 aa, Mycobacterium
KPPPFSEL

SEQ ID NO: 513909 - protein, 7 aa, Mycobacterium
KPPPRGG

SEQ ID NO: 513910 - protein, 7 aa, Mycobacterium
KPPPSEG

SEQ ID NO: 513911 - protein, 8 aa, Mycobacterium
KPPRIDTP

SEQ ID NO: 513912 - protein, 16 aa, Mycobacterium
KPPRPLEATSIPAGGV

SEQ ID NO: 513913 - protein, 9 aa, Mycobacterium
KPPRPNSEE

SEQ ID NO: 513914 - protein, 6 aa, Mycobacterium
KPPRVR

SEQ ID NO: 513915 - protein, 6 aa, Mycobacterium
KPPSLY

SEQ ID NO: 513916 - protein, 92 aa, Mycobacterium
KPPSVKPPAEPAPPGPKPPESAPPAPPGKPEPGKPAPPAPGKPAPGPTDGPLPHSPTESKPPIGEPPTAGEPPKPIAAPPEPGGKPVVPPAA

SEQ ID NO: 513917 - protein, 15 aa, Mycobacterium
KPPTASNADLRTTAE

SEQ ID NO: 513918 - protein, 6 aa, Mycobacterium
KPPVAG

SEQ ID NO: 513919 - protein, 5 aa, Mycobacterium
KPPVN

SEQ ID NO: 513920 - protein, 4 aa, Mycobacterium
KPPW

SEQ ID NO: 513921 - protein, 4 aa, Mycobacterium
KPQA

SEQ ID NO: 513922 - protein, 26 aa, Mycobacterium
KPQAAPPQAPAPFEPPAAGTSLPTKL

SEQ ID NO: 513923 - protein, 6 aa, Mycobacterium
KPQADI

SEQ ID NO: 513924 - protein, 6 aa, Mycobacterium
KPQADV

SEQ ID NO: 513925 - protein, 5 aa, Mycobacterium
KPQDW

SEQ ID NO: 513926 - protein, 6 aa, Mycobacterium
KPQEQW

SEQ ID NO: 513927 - protein, 8 aa, Mycobacterium
KPQETAAA

SEQ ID NO: 513928 - protein, 6 aa, Mycobacterium
KPQEVI

SEQ ID NO: 513929 - protein, 8 aa, Mycobacterium
KPQGIRDA

SEQ ID NO: 513930 - protein, 13 aa, Mycobacterium
KPQGLDDKTTEKL

SEQ ID NO: 513931 - protein, 14 aa, Mycobacterium
KPQHPSQSTDHRAS

SEQ ID NO: 513932 - protein, 10 aa, Mycobacterium
KPQHRTQGEA

SEQ ID NO: 513933 - protein, 6 aa, Mycobacterium
KPQHVP

SEQ ID NO: 513934 - protein, 26 aa, Mycobacterium
KPQKVRRQPAAQQTASTSDAPEPPKQ

SEQ ID NO: 513935 - protein, 15 aa, Mycobacterium
KPQPAIDGSALPTAE

SEQ ID NO: 513936 - protein, 15 aa, Mycobacterium
KPQPAQRKRRSKPQM

SEQ ID NO: 513937 - protein, 6 aa, Mycobacterium
KPQPGY

SEQ ID NO: 513938 - protein, 11 aa, Mycobacterium
KPQPLDETAQE

SEQ ID NO: 513939 - protein, 9 aa, Mycobacterium
KPQQQAGPP

SEQ ID NO: 513940 - protein, 8 aa, Mycobacterium
KPQRATHS

SEQ ID NO: 513941 - protein, 6 aa, Mycobacterium
KPQRGA

SEQ ID NO: 513942 - protein, 8 aa, Mycobacterium
KPQSQASI

SEQ ID NO: 513943 - protein, 4 aa, Mycobacterium
KPQV

SEQ ID NO: 513944 - protein, 5 aa, Mycobacterium
KPQVV

SEQ ID NO: 513945 - protein, 5 aa, Mycobacterium
KPRAA

SEQ ID NO: 513946 - protein, 9 aa, Mycobacterium
KPRAAAASE

SEQ ID NO: 513947 - protein, 6 aa, Mycobacterium
KPRAEG

SEQ ID NO: 513948 - protein, 5 aa, Mycobacterium
KPRAV

SEQ ID NO: 513949 - protein, 16 aa, Mycobacterium
KPREDPGQEPGENPDA

SEQ ID NO: 513950 - protein, 6 aa, Mycobacterium
KPRFDP

SEQ ID NO: 513951 - protein, 14 aa, Mycobacterium
KPRFPSPLSKGQFT

SEQ ID NO: 513952 - protein, 5 aa, Mycobacterium
KPRGG

SEQ ID NO: 513953 - protein, 6 aa, Mycobacterium
KPRGGG

SEQ ID NO: 513954 - protein, 14 aa, Mycobacterium
KPRGPATDAGAGPR

SEQ ID NO: 513955 - protein, 13 aa, Mycobacterium
KPRGQFDQLQPFA

SEQ ID NO: 513956 - protein, 9 aa, Mycobacterium
KPRHTRSSA

SEQ ID NO: 513957 - protein, 5 aa, Mycobacterium
KPRIE

SEQ ID NO: 513958 - protein, 5 aa, Mycobacterium
KPRKT

SEQ ID NO: 513959 - protein, 22 aa, Mycobacterium
KPRLGGDQRFDETRRSSVQTGI

SEQ ID NO: 513960 - protein, 8 aa, Mycobacterium
KPRNAGLR

SEQ ID NO: 513961 - protein, 7 aa, Mycobacterium
KPRPDTD

SEQ ID NO: 513962 - protein, 8 aa, Mycobacterium
KPRPEWPA

SEQ ID NO: 513963 - protein, 7 aa, Mycobacterium
KPRPGET

SEQ ID NO: 513964 - protein, 6 aa, Mycobacterium
KPRPSD

SEQ ID NO: 513965 - protein, 8 aa, Mycobacterium
KPRPVPTP

SEQ ID NO: 513966 - protein, 6 aa, Mycobacterium
KPRQEQ

SEQ ID NO: 513967 - protein, 6 aa, Mycobacterium
KPRQER

SEQ ID NO: 513968 - protein, 5 aa, Mycobacterium
KPRQL

SEQ ID NO: 513969 - protein, 12 aa, Mycobacterium
KPRQLSGGQQQR

SEQ ID NO: 513970 - protein, 10 aa, Mycobacterium
KPRQRRSRET

SEQ ID NO: 513971 - protein, 17 aa, Mycobacterium
KPRRGRSSFAPDGGHGL

SEQ ID NO: 513972 - protein, 4 aa, Mycobacterium
KPRS

SEQ ID NO: 513973 - protein, 6 aa, Mycobacterium
KPRSAD

SEQ ID NO: 513974 - protein, 5 aa, Mycobacterium
KPRSH

SEQ ID NO: 513975 - protein, 6 aa, Mycobacterium
KPRSLS

SEQ ID NO: 513976 - protein, 14 aa, Mycobacterium
KPRTDINADGPTTL

SEQ ID NO: 513977 - protein, 8 aa, Mycobacterium
KPRTGPPE

SEQ ID NO: 513978 - protein, 8 aa, Mycobacterium
KPRTKGME

SEQ ID NO: 513979 - protein, 8 aa, Mycobacterium
KPRTLTPA

SEQ ID NO: 513980 - protein, 9 aa, Mycobacterium
KPRTPEAQF

SEQ ID NO: 513981 - protein, 6 aa, Mycobacterium
KPRVPA

SEQ ID NO: 513982 - protein, 14 aa, Mycobacterium
KPRVPKPEFNEPKP

SEQ ID NO: 513983 - protein, 5 aa, Mycobacterium
KPRVR

SEQ ID NO: 513984 - protein, 8 aa, Mycobacterium
KPRVSREI

SEQ ID NO: 513985 - protein, 6 aa, Mycobacterium
KPRYGD

SEQ ID NO: 513986 - protein, 8 aa, Mycobacterium
KPSADPFA

SEQ ID NO: 513987 - protein, 8 aa, Mycobacterium
KPSALTPE

SEQ ID NO: 513988 - protein, 8 aa, Mycobacterium
KPSAPDVS

SEQ ID NO: 513989 - protein, 13 aa, Mycobacterium
KPSDRSAAEYAGD

SEQ ID NO: 513990 - protein, 4 aa, Mycobacterium
KPSE

SEQ ID NO: 513991 - protein, 32 aa, Mycobacterium
KPSEAPGPDAAPKPKKRKGVGFATQPSDAFRA

SEQ ID NO: 513992 - protein, 7 aa, Mycobacterium
KPSEFSD

SEQ ID NO: 513993 - protein, 6 aa, Mycobacterium
KPSEFT

SEQ ID NO: 513994 - protein, 7 aa, Mycobacterium
KPSELAP

SEQ ID NO: 513995 - protein, 8 aa, Mycobacterium
KPSEQTPL

SEQ ID NO: 513996 - protein, 11 aa, Mycobacterium
KPSERCPATGR

SEQ ID NO: 513997 - protein, 14 aa, Mycobacterium
KPSGELKTKPTQHS

SEQ ID NO: 513998 - protein, 7 aa, Mycobacterium
KPSGGER

SEQ ID NO: 513999 - protein, 8 aa, Mycobacterium
KPSGKPYA

SEQ ID NO: 514000 - protein, 8 aa, Mycobacterium
KPSGLDKR

SEQ ID NO: 514001 - protein, 5 aa, Mycobacterium
KPSLE

SEQ ID NO: 514002 - protein, 5 aa, Mycobacterium
KPSNS

SEQ ID NO: 514003 - protein, 5 aa, Mycobacterium
KPSNT

SEQ ID NO: 514004 - protein, 4 aa, Mycobacterium
KPSP

SEQ ID NO: 514005 - protein, 5 aa, Mycobacterium
KPSPA

SEQ ID NO: 514006 - protein, 8 aa, Mycobacterium
KPSPGSVY

SEQ ID NO: 514007 - protein, 7 aa, Mycobacterium
KPSQGRI

SEQ ID NO: 514008 - protein, 12 aa, Mycobacterium
KPSQLSGGQRQR

SEQ ID NO: 514009 - protein, 9 aa, Mycobacterium
KPSREDLGR

SEQ ID NO: 514010 - protein, 7 aa, Mycobacterium
KPSREVS

SEQ ID NO: 514011 - protein, 14 aa, Mycobacterium
KPSRGLAPYGPQTG

SEQ ID NO: 514012 - protein, 16 aa, Mycobacterium
KPSRGLSPYGPQTGEP

SEQ ID NO: 514013 - protein, 9 aa, Mycobacterium
KPSRGRLPQ

SEQ ID NO: 514014 - protein, 14 aa, Mycobacterium
KPSRLQEAQRRLNG

SEQ ID NO: 514015 - protein, 4 aa, Mycobacterium
KPSS

SEQ ID NO: 514016 - protein, 8 aa, Mycobacterium
KPSSPGNV

SEQ ID NO: 514017 - protein, 21 aa, Mycobacterium
KPSSYPESYGITRDDGPLAGQ

SEQ ID NO: 514018 - protein, 10 aa, Mycobacterium
KPSTDTIPYQ

SEQ ID NO: 514019 - protein, 7 aa, Mycobacterium
KPSTEGA

SEQ ID NO: 514020 - protein, 7 aa, Mycobacterium
KPSTQTV

SEQ ID NO: 514021 - protein, 28 aa, Mycobacterium
KPSTRTRRLEGRTAVAANDTKRVNSLLN

SEQ ID NO: 514022 - protein, 5 aa, Mycobacterium
KPSVR

SEQ ID NO: 514023 - protein, 6 aa, Mycobacterium
KPSVRE

SEQ ID NO: 514024 - protein, 14 aa, Mycobacterium
KPSVRETEHANTYP

SEQ ID NO: 514025 - protein, 6 aa, Mycobacterium
KPSVTA

SEQ ID NO: 514026 - protein, 25 aa, Mycobacterium
KPSYTGPSSENAPAAGMTGQSGTVV

SEQ ID NO: 514027 - protein, 7 aa, Mycobacterium
KPTAAAA

SEQ ID NO: 514028 - protein, 24 aa, Mycobacterium
KPTAAMAPTPASAAPSATAGTAPL

SEQ ID NO: 514029 - protein, 5 aa, Mycobacterium
KPTAI

SEQ ID NO: 514030 - protein, 8 aa, Mycobacterium
KPTARSAI

SEQ ID NO: 514031 - protein, 12 aa, Mycobacterium
KPTDQLPGPGRQ

SEQ ID NO: 514032 - protein, 14 aa, Mycobacterium
KPTDSGGVVTPGTV

SEQ ID NO: 514033 - protein, 14 aa, Mycobacterium
KPTEGSAPGQPVTA

SEQ ID NO: 514034 - protein, 8 aa, Mycobacterium
KPTEREQT

SEQ ID NO: 514035 - protein, 7 aa, Mycobacterium
KPTFESG

SEQ ID NO: 514036 - protein, 17 aa, Mycobacterium
KPTGPSLLDDLETGDYP

SEQ ID NO: 514037 - protein, 7 aa, Mycobacterium
KPTGTIT

SEQ ID NO: 514038 - protein, 4 aa, Mycobacterium
KPTH

SEQ ID NO: 514039 - protein, 11 aa, Mycobacterium
KPTHGRIPRTG

SEQ ID NO: 514040 - protein, 11 aa, Mycobacterium
KPTKRTRRLDG

SEQ ID NO: 514041 - protein, 28 aa, Mycobacterium
KPTKRTRRLDGRTTVSAADNSRINKLLN

SEQ ID NO: 514042 - protein, 4 aa, Mycobacterium
KPTM

SEQ ID NO: 514043 - protein, 5 aa, Mycobacterium
KPTME

SEQ ID NO: 514044 - protein, 11 aa, Mycobacterium
KPTPEAYAAAR

SEQ ID NO: 514045 - protein, 7 aa, Mycobacterium
KPTPGMR

SEQ ID NO: 514046 - protein, 5 aa, Mycobacterium
KPTQE

SEQ ID NO: 514047 - protein, 5 aa, Mycobacterium
KPTQQ

SEQ ID NO: 514048 - protein, 6 aa, Mycobacterium
KPTRAD

SEQ ID NO: 514049 - protein, 6 aa, Mycobacterium
KPTRIG

SEQ ID NO: 514050 - protein, 5 aa, Mycobacterium
KPTSN

SEQ ID NO: 514051 - protein, 10 aa, Mycobacterium
KPTSRTRRLD

SEQ ID NO: 514052 - protein, 7 aa, Mycobacterium
KPTSVEQ

SEQ ID NO: 514053 - protein, 6 aa, Mycobacterium
KPTTPV

SEQ ID NO: 514054 - protein, 10 aa, Mycobacterium
KPTTTGFNPA

SEQ ID NO: 514055 - protein, 4 aa, Mycobacterium
KPTV

SEQ ID NO: 514056 - protein, 5 aa, Mycobacterium
KPTVA

SEQ ID NO: 514057 - protein, 6 aa, Mycobacterium
KPTVAE

SEQ ID NO: 514058 - protein, 5 aa, Mycobacterium
KPTVS

SEQ ID NO: 514059 - protein, 24 aa, Mycobacterium
KPTYDDAAREQIASARSSRAHDTA

SEQ ID NO: 514060 - protein, 9 aa, Mycobacterium
KPTYGRASR

SEQ ID NO: 514061 - protein, 6 aa, Mycobacterium
KPVAES

SEQ ID NO: 514062 - protein, 6 aa, Mycobacterium
KPVAGQ

SEQ ID NO: 514063 - protein, 14 aa, Mycobacterium
KPVARVSETRSTTV

SEQ ID NO: 514064 - protein, 11 aa, Mycobacterium
KPVATRAASGA

SEQ ID NO: 514065 - protein, 9 aa, Mycobacterium
KPVDDESLS

SEQ ID NO: 514066 - protein, 5 aa, Mycobacterium
KPVDE

SEQ ID NO: 514067 - protein, 11 aa, Mycobacterium
KPVEDAPAELG

SEQ ID NO: 514068 - protein, 6 aa, Mycobacterium
KPVEEL

SEQ ID NO: 514069 - protein, 12 aa, Mycobacterium
KPVEGADPRSGR

SEQ ID NO: 514070 - protein, 6 aa, Mycobacterium
KPVEPE

SEQ ID NO: 514071 - protein, 8 aa, Mycobacterium
KPVESGSL

SEQ ID NO: 514072 - protein, 8 aa, Mycobacterium
KPVGQNIS

SEQ ID NO: 514073 - protein, 11 aa, Mycobacterium
KPVGRRGEAGL

SEQ ID NO: 514074 - protein, 12 aa, Mycobacterium
KPVGRRGEDGLP

SEQ ID NO: 514075 - protein, 12 aa, Mycobacterium
KPVGRRGQGGLP

SEQ ID NO: 514076 - protein, 8 aa, Mycobacterium
KPVGTPDA

SEQ ID NO: 514077 - protein, 9 aa, Mycobacterium
KPVGTPDPG

SEQ ID NO: 514078 - protein, 4 aa, Mycobacterium
KPVN

SEQ ID NO: 514079 - protein, 7 aa, Mycobacterium
KPVNDDE

SEQ ID NO: 514080 - protein, 8 aa, Mycobacterium
KPVNDLSR

SEQ ID NO: 514081 - protein, 7 aa, Mycobacterium
KPVPGAD

SEQ ID NO: 514082 - protein, 7 aa, Mycobacterium
KPVPGAQ

SEQ ID NO: 514083 - protein, 6 aa, Mycobacterium
KPVPGQ

SEQ ID NO: 514084 - protein, 9 aa, Mycobacterium
KPVPGTSGR

SEQ ID NO: 514085 - protein, 6 aa, Mycobacterium
KPVPKT

SEQ ID NO: 514086 - protein, 7 aa, Mycobacterium
KPVPTQP

SEQ ID NO: 514087 - protein, 7 aa, Mycobacterium
KPVQPGG

SEQ ID NO: 514088 - protein, 5 aa, Mycobacterium
KPVQY

SEQ ID NO: 514089 - protein, 25 aa, Mycobacterium
KPVRQSTSKASSTASGSVTQRASEP

SEQ ID NO: 514090 - protein, 6 aa, Mycobacterium
KPVRSA

SEQ ID NO: 514091 - protein, 4 aa, Mycobacterium
KPVS

SEQ ID NO: 514092 - protein, 5 aa, Mycobacterium
KPVSA

SEQ ID NO: 514093 - protein, 10 aa, Mycobacterium
KPVSAGEGVS

SEQ ID NO: 514094 - protein, 6 aa, Mycobacterium
KPVSAN

SEQ ID NO: 514095 - protein, 16 aa, Mycobacterium
KPVTDPPDYAPDGGNV

SEQ ID NO: 514096 - protein, 7 aa, Mycobacterium
KPVTGTS

SEQ ID NO: 514097 - protein, 7 aa, Mycobacterium
KPVVATQ

SEQ ID NO: 514098 - protein, 10 aa, Mycobacterium
KPWGRDATPV

SEQ ID NO: 514099 - protein, 11 aa, Mycobacterium
KPWNTDDVRGL

SEQ ID NO: 514100 - protein, 4 aa, Mycobacterium
KPWP

SEQ ID NO: 514101 - protein, 11 aa, Mycobacterium
KPYGRAAGPAE

SEQ ID NO: 514102 - protein, 12 aa, Mycobacterium
KPYGRNASPAEQ

SEQ ID NO: 514103 - protein, 7 aa, Mycobacterium
KPYPART

SEQ ID NO: 514104 - protein, 6 aa, Mycobacterium
KPYPRG

SEQ ID NO: 514105 - protein, 6 aa, Mycobacterium
KPYQRH

SEQ ID NO: 514106 - protein, 8 aa, Mycobacterium
KPYQRPRP

SEQ ID NO: 514107 - protein, 6 aa, Mycobacterium
KPYRAA

SEQ ID NO: 514108 - protein, 6 aa, Mycobacterium
KPYSYT

SEQ ID NO: 514109 - protein, 4 aa, Mycobacterium
KQAA

SEQ ID NO: 514110 - protein, 12 aa, Mycobacterium
KQAAAEANRQLG

SEQ ID NO: 514111 - protein, 9 aa, Mycobacterium
KQAAANPPM

SEQ ID NO: 514112 - protein, 11 aa, Mycobacterium
KQAADAGHTLG

SEQ ID NO: 514113 - protein, 8 aa, Mycobacterium
KQAADTGA

SEQ ID NO: 514114 - protein, 8 aa, Mycobacterium
KQAAESHG

SEQ ID NO: 514115 - protein, 7 aa, Mycobacterium
KQAAGLG

SEQ ID NO: 514116 - protein, 7 aa, Mycobacterium
KQAAGVT

SEQ ID NO: 514117 - protein, 6 aa, Mycobacterium
KQAAQK

SEQ ID NO: 514118 - protein, 5 aa, Mycobacterium
KQAAR

SEQ ID NO: 514119 - protein, 6 aa, Mycobacterium
KQADAY

SEQ ID NO: 514120 - protein, 8 aa, Mycobacterium
KQADESKL

SEQ ID NO: 514121 - protein, 8 aa, Mycobacterium
KQADESQL

SEQ ID NO: 514122 - protein, 8 aa, Mycobacterium
KQADGGRA

SEQ ID NO: 514123 - protein, 6 aa, Mycobacterium
KQADTE

SEQ ID NO: 514124 - protein, 8 aa, Mycobacterium
KQAEEATD

SEQ ID NO: 514125 - protein, 11 aa, Mycobacterium
KQAEPAEDAVS

SEQ ID NO: 514126 - protein, 9 aa, Mycobacterium
KQAEQATDT

SEQ ID NO: 514127 - protein, 6 aa, Mycobacterium
KQAEQT

SEQ ID NO: 514128 - protein, 6 aa, Mycobacterium
KQAERA

SEQ ID NO: 514129 - protein, 4 aa, Mycobacterium
KQAG

SEQ ID NO: 514130 - protein, 6 aa, Mycobacterium
KQAGAA

SEQ ID NO: 514131 - protein, 6 aa, Mycobacterium
KQAGAS

SEQ ID NO: 514132 - protein, 10 aa, Mycobacterium
KQAGDPRSDL

SEQ ID NO: 514133 - protein, 6 aa, Mycobacterium
KQAGEL

SEQ ID NO: 514134 - protein, 7 aa, Mycobacterium
KQAGPDM

SEQ ID NO: 514135 - protein, 28 aa, Mycobacterium
KQAGRDAATAANATEPKPYGQTSENNYP

SEQ ID NO: 514136 - protein, 6 aa, Mycobacterium
KQAGSL

SEQ ID NO: 514137 - protein, 7 aa, Mycobacterium
KQAGVTR

SEQ ID NO: 514138 - protein, 8 aa, Mycobacterium
KQAHPNIS

SEQ ID NO: 514139 - protein, 12 aa, Mycobacterium
KQAIGRATNNVA

SEQ ID NO: 514140 - protein, 6 aa, Mycobacterium
KQAKDK

SEQ ID NO: 514141 - protein, 6 aa, Mycobacterium
KQAKDR

SEQ ID NO: 514142 - protein, 10 aa, Mycobacterium
KQAKRESRDE

SEQ ID NO: 514143 - protein, 4 aa, Mycobacterium
KQAL

SEQ ID NO: 514144 - protein, 8 aa, Mycobacterium
KQALASDR

SEQ ID NO: 514145 - protein, 7 aa, Mycobacterium
KQALDDG

SEQ ID NO: 514146 - protein, 10 aa, Mycobacterium
KQALKERKTI

SEQ ID NO: 514147 - protein, 11 aa, Mycobacterium
KQANPAEDAVS

SEQ ID NO: 514148 - protein, 6 aa, Mycobacterium
KQANQV

SEQ ID NO: 514149 - protein, 9 aa, Mycobacterium
KQANRAAEN

SEQ ID NO: 514150 - protein, 7 aa, Mycobacterium
KQAPQQQ

SEQ ID NO: 514151 - protein, 7 aa, Mycobacterium
KQAPYRR

SEQ ID NO: 514152 - protein, 22 aa, Mycobacterium
KQAQAANQQTDDRDYNEADTRD

SEQ ID NO: 514153 - protein, 12 aa, Mycobacterium
KQARDTRRSRRV

SEQ ID NO: 514154 - protein, 13 aa, Mycobacterium
KQAREALSDLGQD

SEQ ID NO: 514155 - protein, 6 aa, Mycobacterium
KQARPE

SEQ ID NO: 514156 - protein, 6 aa, Mycobacterium
KQASDL

SEQ ID NO: 514157 - protein, 9 aa, Mycobacterium
KQASGAPDF

SEQ ID NO: 514158 - protein, 5 aa, Mycobacterium
KQASH

SEQ ID NO: 514159 - protein, 9 aa, Mycobacterium
KQASSIAAL

SEQ ID NO: 514160 - protein, 6 aa, Mycobacterium
KQASTM

SEQ ID NO: 514161 - protein, 15 aa, Mycobacterium
KQATADNDPAAASAF

SEQ ID NO: 514162 - protein, 4 aa, Mycobacterium
KQAV

SEQ ID NO: 514163 - protein, 6 aa, Mycobacterium
KQCPPS

SEQ ID NO: 514164 - protein, 6 aa, Mycobacterium
KQDAAD

SEQ ID NO: 514165 - protein, 9 aa, Mycobacterium
KQDAEEGRR

SEQ ID NO: 514166 - protein, 7 aa, Mycobacterium
KQDATSA

SEQ ID NO: 514167 - protein, 6 aa, Mycobacterium
KQDFPS

SEQ ID NO: 514168 - protein, 11 aa, Mycobacterium
KQDGDPGYKAT

SEQ ID NO: 514169 - protein, 9 aa, Mycobacterium
KQDGRPQLS

SEQ ID NO: 514170 - protein, 8 aa, Mycobacterium
KQDLESGV

SEQ ID NO: 514171 - protein, 6 aa, Mycobacterium
KQDPAA

SEQ ID NO: 514172 - protein, 15 aa, Mycobacterium
KQDPDGWGKSPGFGT

SEQ ID NO: 514173 - protein, 6 aa, Mycobacterium
KQDSTS

SEQ ID NO: 514174 - protein, 8 aa, Mycobacterium
KQDSTTAT

SEQ ID NO: 514175 - protein, 8 aa, Mycobacterium
KQDTTSAN

SEQ ID NO: 514176 - protein, 8 aa, Mycobacterium
KQDTTSAQ

SEQ ID NO: 514177 - protein, 23 aa, Mycobacterium
KQEATRARRIRRTEEELEEGKRR

SEQ ID NO: 514178 - protein, 7 aa, Mycobacterium
KQEFPSS

SEQ ID NO: 514179 - protein, 8 aa, Mycobacterium
KQEFPSSE

SEQ ID NO: 514180 - protein, 7 aa, Mycobacterium
KQEGAKT

SEQ ID NO: 514181 - protein, 7 aa, Mycobacterium
KQEGPGA

SEQ ID NO: 514182 - protein, 6 aa, Mycobacterium
KQELRD

SEQ ID NO: 514183 - protein, 8 aa, Mycobacterium
KQEPINGE

SEQ ID NO: 514184 - protein, 42 aa, Mycobacterium
KQEPRPEPEPSADDGDEPDHDLPDHDEPEPPSLPTAEITTSC

SEQ ID NO: 514185 - protein, 8 aa, Mycobacterium
KQERPGRK

SEQ ID NO: 514186 - protein, 12 aa, Mycobacterium
KQEVARRGGPAV

SEQ ID NO: 514187 - protein, 8 aa, Mycobacterium
KQFAGSPN

SEQ ID NO: 514188 - protein, 10 aa, Mycobacterium
KQFEKTAEDP

SEQ ID NO: 514189 - protein, 6 aa, Mycobacterium
KQFGKP

SEQ ID NO: 514190 - protein, 4 aa, Mycobacterium
KQFP

SEQ ID NO: 514191 - protein, 7 aa, Mycobacterium
KQFPDPH

SEQ ID NO: 514192 - protein, 4 aa, Mycobacterium
KQFT

SEQ ID NO: 514193 - protein, 7 aa, Mycobacterium
KQGAEAA

SEQ ID NO: 514194 - protein, 6 aa, Mycobacterium
KQGAEV

SEQ ID NO: 514195 - protein, 12 aa, Mycobacterium
KQGAPTKKTGTT

SEQ ID NO: 514196 - protein, 12 aa, Mycobacterium
KQGAQPEPADPA

SEQ ID NO: 514197 - protein, 5 aa, Mycobacterium
KQGAR

SEQ ID NO: 514198 - protein, 7 aa, Mycobacterium
KQGEPPL

SEQ ID NO: 514199 - protein, 14 aa, Mycobacterium
KQGFSEAGVGPGRT

SEQ ID NO: 514200 - protein, 5 aa, Mycobacterium
KQGGL

SEQ ID NO: 514201 - protein, 10 aa, Mycobacterium
KQGHGAPNPT

SEQ ID NO: 514202 - protein, 11 aa, Mycobacterium
KQGHGEPNPSW

SEQ ID NO: 514203 - protein, 10 aa, Mycobacterium
KQGHGQPNPT

SEQ ID NO: 514204 - protein, 5 aa, Mycobacterium
KQGID

SEQ ID NO: 514205 - protein, 6 aa, Mycobacterium
KQGIGY

SEQ ID NO: 514206 - protein, 12 aa, Mycobacterium
KQGISGDDAKKI

SEQ ID NO: 514207 - protein, 6 aa, Mycobacterium
KQGLGS

SEQ ID NO: 514208 - protein, 23 aa, Mycobacterium
KQGLSTGLGDEGGFAPDLPGTKA

SEQ ID NO: 514209 - protein, 22 aa, Mycobacterium
KQGLSTGLGDEGGFAPDVAGTR

SEQ ID NO: 514210 - protein, 23 aa, Mycobacterium
KQGLSTGLGDEGGFAPNVAGTTA

SEQ ID NO: 514211 - protein, 7 aa, Mycobacterium
KQGMTEP

SEQ ID NO: 514212 - protein, 15 aa, Mycobacterium
KQGNHRSTLTGEEVG

SEQ ID NO: 514213 - protein, 9 aa, Mycobacterium
KQGPAPAEV

SEQ ID NO: 514214 - protein, 12 aa, Mycobacterium
KQGPAPKPFTAP

SEQ ID NO: 514215 - protein, 6 aa, Mycobacterium
KQGPEL

SEQ ID NO: 514216 - protein, 7 aa, Mycobacterium
KQGPLSA

SEQ ID NO: 514217 - protein, 10 aa, Mycobacterium
KQGPNGLEVR

SEQ ID NO: 514218 - protein, 10 aa, Mycobacterium
KQGRHDDAAE

SEQ ID NO: 514219 - protein, 9 aa, Mycobacterium
KQGRKVSQR

SEQ ID NO: 514220 - protein, 8 aa, Mycobacterium
KQGRRGFE

SEQ ID NO: 514221 - protein, 5 aa, Mycobacterium
KQGST

SEQ ID NO: 514222 - protein, 6 aa, Mycobacterium
KQGSTH

SEQ ID NO: 514223 - protein, 7 aa, Mycobacterium
KQGTATA

SEQ ID NO: 514224 - protein, 7 aa, Mycobacterium
KQGTGGS

SEQ ID NO: 514225 - protein, 8 aa, Mycobacterium
KQGTRTVR

SEQ ID NO: 514226 - protein, 4 aa, Mycobacterium
KQGV

SEQ ID NO: 514227 - protein, 4 aa, Mycobacterium
KQHA

SEQ ID NO: 514228 - protein, 7 aa, Mycobacterium
KQHAAGA

SEQ ID NO: 514229 - protein, 18 aa, Mycobacterium
KQHRAGSRLPGLPGPQGR

SEQ ID NO: 514230 - protein, 6 aa, Mycobacterium
KQHRDH

SEQ ID NO: 514231 - protein, 6 aa, Mycobacterium
KQHRQQ

SEQ ID NO: 514232 - protein, 15 aa, Mycobacterium
KQIDLGSDPAYVPDN

SEQ ID NO: 514233 - protein, 24 aa, Mycobacterium
KQIGRYARKGGPEPHGATERRLRE

SEQ ID NO: 514234 - protein, 12 aa, Mycobacterium
KQIGTGRERFER

SEQ ID NO: 514235 - protein, 6 aa, Mycobacterium
KQIPET

SEQ ID NO: 514236 - protein, 12 aa, Mycobacterium
KQISGAAKAPFG

SEQ ID NO: 514237 - protein, 7 aa, Mycobacterium
KQKAGAG

SEQ ID NO: 514238 - protein, 6 aa, Mycobacterium
KQKARV

SEQ ID NO: 514239 - protein, 15 aa, Mycobacterium
KQKHDRMQRKHGLTP

SEQ ID NO: 514240 - protein, 17 aa, Mycobacterium
KQKSVSARFGSKEPDKF

SEQ ID NO: 514241 - protein, 4 aa, Mycobacterium
KQKW

SEQ ID NO: 514242 - protein, 5 aa, Mycobacterium
KQKWE

SEQ ID NO: 514243 - protein, 17 aa, Mycobacterium
KQLAEKKAERKGSAQPV

SEQ ID NO: 514244 - protein, 18 aa, Mycobacterium
KQLAQKKAEGKGGAGKPL

SEQ ID NO: 514245 - protein, 17 aa, Mycobacterium
KQLAQRKAEQKGAGKPV

SEQ ID NO: 514246 - protein, 7 aa, Mycobacterium
KQLEDGT

SEQ ID NO: 514247 - protein, 6 aa, Mycobacterium
KQLGDR

SEQ ID NO: 514248 - protein, 8 aa, Mycobacterium
KQLGTYSD

SEQ ID NO: 514249 - protein, 6 aa, Mycobacterium
KQLKNN

SEQ ID NO: 514250 - protein, 4 aa, Mycobacterium
KQLR

SEQ ID NO: 514251 - protein, 7 aa, Mycobacterium
KQLRSAN

SEQ ID NO: 514252 - protein, 4 aa, Mycobacterium
KQLS

SEQ ID NO: 514253 - protein, 5 aa, Mycobacterium
KQLSA

SEQ ID NO: 514254 - protein, 5 aa, Mycobacterium
KQLTD

SEQ ID NO: 514255 - protein, 8 aa, Mycobacterium
KQMAKPGD

SEQ ID NO: 514256 - protein, 10 aa, Mycobacterium
KQNAGDPAYH

SEQ ID NO: 514257 - protein, 9 aa, Mycobacterium
KQNAGDPEY

SEQ ID NO: 514258 - protein, 10 aa, Mycobacterium
KQNAYAAASE

SEQ ID NO: 514259 - protein, 13 aa, Mycobacterium
KQNEARRTKESSD

SEQ ID NO: 514260 - protein, 6 aa, Mycobacterium
KQNHAA

SEQ ID NO: 514261 - protein, 7 aa, Mycobacterium
KQNPESP

SEQ ID NO: 514262 - protein, 8 aa, Mycobacterium
KQNPMSTS

SEQ ID NO: 514263 - protein, 14 aa, Mycobacterium
KQNSNKPGRAPTGL

SEQ ID NO: 514264 - protein, 7 aa, Mycobacterium
KQPANTK

SEQ ID NO: 514265 - protein, 4 aa, Mycobacterium
KQPD

SEQ ID NO: 514266 - protein, 7 aa, Mycobacterium
KQPEGRR

SEQ ID NO: 514267 - protein, 7 aa, Mycobacterium
KQPFTTT

SEQ ID NO: 514268 - protein, 9 aa, Mycobacterium
KQPGESRDQ

SEQ ID NO: 514269 - protein, 9 aa, Mycobacterium
KQPGESRNQ

SEQ ID NO: 514270 - protein, 9 aa, Mycobacterium
KQPHGSPRN

SEQ ID NO: 514271 - protein, 6 aa, Mycobacterium
KQPKRA

SEQ ID NO: 514272 - protein, 15 aa, Mycobacterium
KQPKTAPLAGNSIAT

SEQ ID NO: 514273 - protein, 5 aa, Mycobacterium
KQPMV

SEQ ID NO: 514274 - protein, 6 aa, Mycobacterium
KQPNQI

SEQ ID NO: 514275 - protein, 6 aa, Mycobacterium
KQPPGD

SEQ ID NO: 514276 - protein, 4 aa, Mycobacterium
KQPR

SEQ ID NO: 514277 - protein, 6 aa, Mycobacterium
KQPRSP

SEQ ID NO: 514278 - protein, 34 aa, Mycobacterium
KQPRTSTATPATATSAARTADATAAKQPPAAAAV

SEQ ID NO: 514279 - protein, 7 aa, Mycobacterium
KQPTITT

SEQ ID NO: 514280 - protein, 5 aa, Mycobacterium
KQPVK

SEQ ID NO: 514281 - protein, 6 aa, Mycobacterium
KQPVKN

SEQ ID NO: 514282 - protein, 5 aa, Mycobacterium
KQPVR

SEQ ID NO: 514283 - protein, 4 aa, Mycobacterium
KQQA

SEQ ID NO: 514284 - protein, 6 aa, Mycobacterium
KQQDIK

SEQ ID NO: 514285 - protein, 7 aa, Mycobacterium
KQQGGRA

SEQ ID NO: 514286 - protein, 7 aa, Mycobacterium
KQQGHSP

SEQ ID NO: 514287 - protein, 8 aa, Mycobacterium
KQQGNPTR

SEQ ID NO: 514288 - protein, 10 aa, Mycobacterium
KQQKTRERRI

SEQ ID NO: 514289 - protein, 6 aa, Mycobacterium
KQQQRV

SEQ ID NO: 514290 - protein, 20 aa, Mycobacterium
KQQRAQDGRYTLTPDGDATR

SEQ ID NO: 514291 - protein, 20 aa, Mycobacterium
KQQRAQEGRYTLTPEGDSTR

SEQ ID NO: 514292 - protein, 7 aa, Mycobacterium
KQQRPAA

SEQ ID NO: 514293 - protein, 8 aa, Mycobacterium
KQQRPAPA

SEQ ID NO: 514294 - protein, 8 aa, Mycobacterium
KQQRPATA

SEQ ID NO: 514295 - protein, 20 aa, Mycobacterium
KQQRRQQGRYTLTPDGDSTR

SEQ ID NO: 514296 - protein, 8 aa, Mycobacterium
KQQRSEGQ

SEQ ID NO: 514297 - protein, 6 aa, Mycobacterium
KQQTDW

SEQ ID NO: 514298 - protein, 8 aa, Mycobacterium
KQQVTRER

SEQ ID NO: 514299 - protein, 21 aa, Mycobacterium
KQQWPDKPLKTEGSSAPIPIP

SEQ ID NO: 514300 - protein, 9 aa, Mycobacterium
KQRADPDST

SEQ ID NO: 514301 - protein, 11 aa, Mycobacterium
KQRAEAGRGAA

SEQ ID NO: 514302 - protein, 11 aa, Mycobacterium
KQRAEERDMSQ

SEQ ID NO: 514303 - protein, 7 aa, Mycobacterium
KQRAGAS

SEQ ID NO: 514304 - protein, 8 aa, Mycobacterium
KQRAKQLG

SEQ ID NO: 514305 - protein, 25 aa, Mycobacterium
KQRAQSPGAAPGGPTSPTPEGGGIT

SEQ ID NO: 514306 - protein, 7 aa, Mycobacterium
KQRASVD

SEQ ID NO: 514307 - protein, 6 aa, Mycobacterium
KQRDEW

SEQ ID NO: 514308 - protein, 6 aa, Mycobacterium
KQRDRH

SEQ ID NO: 514309 - protein, 12 aa, Mycobacterium
KQRELPEPDDEF

SEQ ID NO: 514310 - protein, 8 aa, Mycobacterium
KQREQFGA

SEQ ID NO: 514311 - protein, 4 aa, Mycobacterium
KQRG

SEQ ID NO: 514312 - protein, 10 aa, Mycobacterium
KQRGPQDAPD

SEQ ID NO: 514313 - protein, 6 aa, Mycobacterium
KQRHRA

SEQ ID NO: 514314 - protein, 4 aa, Mycobacterium
KQRK

SEQ ID NO: 514315 - protein, 11 aa, Mycobacterium
KQRKGSVQSPK

SEQ ID NO: 514316 - protein, 7 aa, Mycobacterium
KQRKQFG

SEQ ID NO: 514317 - protein, 12 aa, Mycobacterium
KQRNGKPADATV

SEQ ID NO: 514318 - protein, 20 aa, Mycobacterium
KQRNQKGSGASVADLATDPD

SEQ ID NO: 514319 - protein, 11 aa, Mycobacterium
KQRNSKADHAA

SEQ ID NO: 514320 - protein, 20 aa, Mycobacterium
KQRPASSAESASTGAPGGIE

SEQ ID NO: 514321 - protein, 6 aa, Mycobacterium
KQRPDR

SEQ ID NO: 514322 - protein, 10 aa, Mycobacterium
KQRPEGSSAL

SEQ ID NO: 514323 - protein, 8 aa, Mycobacterium
KQRPEPDS

SEQ ID NO: 514324 - protein, 6 aa, Mycobacterium
KQRPML

SEQ ID NO: 514325 - protein, 9 aa, Mycobacterium
KQRPSSDTV

SEQ ID NO: 514326 - protein, 5 aa, Mycobacterium
KQRPV

SEQ ID NO: 514327 - protein, 9 aa, Mycobacterium
KQRQGPQIT

SEQ ID NO: 514328 - protein, 6 aa, Mycobacterium
KQRQKK

SEQ ID NO: 514329 - protein, 17 aa, Mycobacterium
KQRQLDREARTGKKTTA

SEQ ID NO: 514330 - protein, 17 aa, Mycobacterium
KQRQLDREARTGKRTTA

SEQ ID NO: 514331 - protein, 12 aa, Mycobacterium
KQRQPAEYPTEE

SEQ ID NO: 514332 - protein, 5 aa, Mycobacterium
KQRQQ

SEQ ID NO: 514333 - protein, 10 aa, Mycobacterium
KQRRAERAQR

SEQ ID NO: 514334 - protein, 14 aa, Mycobacterium
KQRRDEEDALSASR

SEQ ID NO: 514335 - protein, 9 aa, Mycobacterium
KQRRGTTPQ

SEQ ID NO: 514336 - protein, 6 aa, Mycobacterium
KQRSEA

SEQ ID NO: 514337 - protein, 7 aa, Mycobacterium
KQRSPEN

SEQ ID NO: 514338 - protein, 6 aa, Mycobacterium
KQRTEW

SEQ ID NO: 514339 - protein, 5 aa, Mycobacterium
KQRTQ

SEQ ID NO: 514340 - protein, 7 aa, Mycobacterium
KQRTRVE

SEQ ID NO: 514341 - protein, 7 aa, Mycobacterium
KQRTVGT

SEQ ID NO: 514342 - protein, 13 aa, Mycobacterium
KQRWPDEPAGHAY

SEQ ID NO: 514343 - protein, 4 aa, Mycobacterium
KQSA

SEQ ID NO: 514344 - protein, 5 aa, Mycobacterium
KQSAD

SEQ ID NO: 514345 - protein, 13 aa, Mycobacterium
KQSAGGVEVRGPQ

SEQ ID NO: 514346 - protein, 6 aa, Mycobacterium
KQSAVE

SEQ ID NO: 514347 - protein, 6 aa, Mycobacterium
KQSESN

SEQ ID NO: 514348 - protein, 6 aa, Mycobacterium
KQSGAD

SEQ ID NO: 514349 - protein, 7 aa, Mycobacterium
KQSGIGR

SEQ ID NO: 514350 - protein, 10 aa, Mycobacterium
KQSGIGREGG

SEQ ID NO: 514351 - protein, 14 aa, Mycobacterium
KQSGIGRENGPEGI

SEQ ID NO: 514352 - protein, 10 aa, Mycobacterium
KQSGLGRELG

SEQ ID NO: 514353 - protein, 19 aa, Mycobacterium
KQSGLGRELGPGALDEYTE

SEQ ID NO: 514354 - protein, 10 aa, Mycobacterium
KQSGPAAANG

SEQ ID NO: 514355 - protein, 7 aa, Mycobacterium
KQSGRYA

SEQ ID NO: 514356 - protein, 13 aa, Mycobacterium
KQSGVGRELGPDA

SEQ ID NO: 514357 - protein, 10 aa, Mycobacterium
KQSIPGTEKF

SEQ ID NO: 514358 - protein, 14 aa, Mycobacterium
KQSLTLAPDSERYR

SEQ ID NO: 514359 - protein, 14 aa, Mycobacterium
KQSLTLAPDSQRYR

SEQ ID NO: 514360 - protein, 11 aa, Mycobacterium
KQSQEQGGPAM

SEQ ID NO: 514361 - protein, 9 aa, Mycobacterium
KQSQGRAQT

SEQ ID NO: 514362 - protein, 5 aa, Mycobacterium
KQSRS

SEQ ID NO: 514363 - protein, 8 aa, Mycobacterium
KQSSHGLE

SEQ ID NO: 514364 - protein, 8 aa, Mycobacterium
KQSVTARA

SEQ ID NO: 514365 - protein, 16 aa, Mycobacterium
KQTDADVGSFDGGYGS

SEQ ID NO: 514366 - protein, 4 aa, Mycobacterium
KQTE

SEQ ID NO: 514367 - protein, 6 aa, Mycobacterium
KQTEDP

SEQ ID NO: 514368 - protein, 9 aa, Mycobacterium
KQTGKQLGA

SEQ ID NO: 514369 - protein, 10 aa, Mycobacterium
KQTGPDGKAT

SEQ ID NO: 514370 - protein, 7 aa, Mycobacterium
KQTLDDN

SEQ ID NO: 514371 - protein, 10 aa, Mycobacterium
KQTPGSRTQL

SEQ ID NO: 514372 - protein, 7 aa, Mycobacterium
KQTPMST

SEQ ID NO: 514373 - protein, 8 aa, Mycobacterium
KQTPMSTS

SEQ ID NO: 514374 - protein, 9 aa, Mycobacterium
KQTQAPVTR

SEQ ID NO: 514375 - protein, 5 aa, Mycobacterium
KQTTH

SEQ ID NO: 514376 - protein, 7 aa, Mycobacterium
KQVAPDK

SEQ ID NO: 514377 - protein, 11 aa, Mycobacterium
KQVEPTPGAAL

SEQ ID NO: 514378 - protein, 6 aa, Mycobacterium
KQVEVT

SEQ ID NO: 514379 - protein, 9 aa, Mycobacterium
KQVNDTGRR

SEQ ID NO: 514380 - protein, 10 aa, Mycobacterium
KQVPSSTGTR

SEQ ID NO: 514381 - protein, 12 aa, Mycobacterium
KQVSASAGEYQV

SEQ ID NO: 514382 - protein, 17 aa, Mycobacterium
KQVSGAAGDYQVDGAQT

SEQ ID NO: 514383 - protein, 13 aa, Mycobacterium
KQVSGAAGDYQVE

SEQ ID NO: 514384 - protein, 13 aa, Mycobacterium
KQVSGGAGNYQVE

SEQ ID NO: 514385 - protein, 14 aa, Mycobacterium
KQVSGTAGDYQVEG

SEQ ID NO: 514386 - protein, 10 aa, Mycobacterium
KQVTDTGRRA

SEQ ID NO: 514387 - protein, 6 aa, Mycobacterium
KQVTPA

SEQ ID NO: 514388 - protein, 8 aa, Mycobacterium
KQWDGNAD

SEQ ID NO: 514389 - protein, 4 aa, Mycobacterium
KQWP

SEQ ID NO: 514390 - protein, 5 aa, Mycobacterium
KQWPG

SEQ ID NO: 514391 - protein, 6 aa, Mycobacterium
KQWPTG

SEQ ID NO: 514392 - protein, 10 aa, Mycobacterium
KQYGRGRSAV

SEQ ID NO: 514393 - protein, 6 aa, Mycobacterium
KQYKVA

SEQ ID NO: 514394 - protein, 5 aa, Mycobacterium
KQYPQ

SEQ ID NO: 514395 - protein, 6 aa, Mycobacterium
KQYSQL

SEQ ID NO: 514396 - protein, 6 aa, Mycobacterium
KQYSQM

SEQ ID NO: 514397 - protein, 7 aa, Mycobacterium
KQYSQMD

SEQ ID NO: 514398 - protein, 14 aa, Mycobacterium
KQYSQMDRGAYQSA

SEQ ID NO: 514399 - protein, 8 aa, Mycobacterium
KRAAPTDD

SEQ ID NO: 514400 - protein, 16 aa, Mycobacterium
KRAAQLPAEQQAAVKS

SEQ ID NO: 514401 - protein, 6 aa, Mycobacterium
KRAAQR

SEQ ID NO: 514402 - protein, 5 aa, Mycobacterium
KRAAR

SEQ ID NO: 514403 - protein, 7 aa, Mycobacterium
KRAARAG

SEQ ID NO: 514404 - protein, 7 aa, Mycobacterium
KRADADQ

SEQ ID NO: 514405 - protein, 13 aa, Mycobacterium
KRADGPPGPDQPV

SEQ ID NO: 514406 - protein, 8 aa, Mycobacterium
KRADPTDD

SEQ ID NO: 514407 - protein, 8 aa, Mycobacterium
KRADSAAV

SEQ ID NO: 514408 - protein, 7 aa, Mycobacterium
KRAEDPL

SEQ ID NO: 514409 - protein, 9 aa, Mycobacterium
KRAEGKSHK

SEQ ID NO: 514410 - protein, 6 aa, Mycobacterium
KRAEGV

SEQ ID NO: 514411 - protein, 8 aa, Mycobacterium
KRAEPTDD

SEQ ID NO: 514412 - protein, 6 aa, Mycobacterium
KRAERE

SEQ ID NO: 514413 - protein, 6 aa, Mycobacterium
KRAESS

SEQ ID NO: 514414 - protein, 10 aa, Mycobacterium
KRAGADTELA

SEQ ID NO: 514415 - protein, 11 aa, Mycobacterium
KRAGGGASARI

SEQ ID NO: 514416 - protein, 6 aa, Mycobacterium
KRAGLA

SEQ ID NO: 514417 - protein, 7 aa, Mycobacterium
KRAGRAV

SEQ ID NO: 514418 - protein, 7 aa, Mycobacterium
KRAGRRV

SEQ ID NO: 514419 - protein, 9 aa, Mycobacterium
KRAGSDDVP

SEQ ID NO: 514420 - protein, 9 aa, Mycobacterium
KRAGTSKPA

SEQ ID NO: 514421 - protein, 6 aa, Mycobacterium
KRAGVN

SEQ ID NO: 514422 - protein, 4 aa, Mycobacterium
KRAH

SEQ ID NO: 514423 - protein, 4 aa, Mycobacterium
KRAK

SEQ ID NO: 514424 - protein, 9 aa, Mycobacterium
KRAKDQETA

SEQ ID NO: 514425 - protein, 11 aa, Mycobacterium
KRAKENYDDAT

SEQ ID NO: 514426 - protein, 6 aa, Mycobacterium
KRALDS

SEQ ID NO: 514427 - protein, 6 aa, Mycobacterium
KRANPK

SEQ ID NO: 514428 - protein, 10 aa, Mycobacterium
KRAPADDREL

SEQ ID NO: 514429 - protein, 9 aa, Mycobacterium
KRAPAKRPD

SEQ ID NO: 514430 - protein, 12 aa, Mycobacterium
KRAPAPATTDSD

SEQ ID NO: 514431 - protein, 6 aa, Mycobacterium
KRAPDR

SEQ ID NO: 514432 - protein, 11 aa, Mycobacterium
KRAPDTAEQVG

SEQ ID NO: 514433 - protein, 7 aa, Mycobacterium
KRAPELE

SEQ ID NO: 514434 - protein, 9 aa, Mycobacterium
KRAPKNRPD

SEQ ID NO: 514435 - protein, 10 aa, Mycobacterium
KRAPKNRPDY

SEQ ID NO: 514436 - protein, 6 aa, Mycobacterium
KRAPSV

SEQ ID NO: 514437 - protein, 8 aa, Mycobacterium
KRAPTDRE

SEQ ID NO: 514438 - protein, 15 aa, Mycobacterium
KRAQAEGYCPGDDPQ

SEQ ID NO: 514439 - protein, 9 aa, Mycobacterium
KRAQETEDL

SEQ ID NO: 514440 - protein, 13 aa, Mycobacterium
KRAQPVTPFDGWW

SEQ ID NO: 514441 - protein, 10 aa, Mycobacterium
KRAQQAEQIR

SEQ ID NO: 514442 - protein, 8 aa, Mycobacterium
KRAQSSKD

SEQ ID NO: 514443 - protein, 8 aa, Mycobacterium
KRARAGKT

SEQ ID NO: 514444 - protein, 6 aa, Mycobacterium
KRAREQ

SEQ ID NO: 514445 - protein, 7 aa, Mycobacterium
KRARNGL

SEQ ID NO: 514446 - protein, 5 aa, Mycobacterium
KRARV

SEQ ID NO: 514447 - protein, 13 aa, Mycobacterium
KRASANAALTLFD

SEQ ID NO: 514448 - protein, 7 aa, Mycobacterium
KRASDAL

SEQ ID NO: 514449 - protein, 12 aa, Mycobacterium
KRASHNPDWTGT

SEQ ID NO: 514450 - protein, 11 aa, Mycobacterium
KRASKSRPGEG

SEQ ID NO: 514451 - protein, 10 aa, Mycobacterium
KRASPSRGAL

SEQ ID NO: 514452 - protein, 20 aa, Mycobacterium
KRASPSRGALASIGDPAELA

SEQ ID NO: 514453 - protein, 10 aa, Mycobacterium
KRASPSRGEL

SEQ ID NO: 514454 - protein, 7 aa, Mycobacterium
KRASVNR

SEQ ID NO: 514455 - protein, 6 aa, Mycobacterium
KRATAQ

SEQ ID NO: 514456 - protein, 12 aa, Mycobacterium
KRATDVGARHDA

SEQ ID NO: 514457 - protein, 6 aa, Mycobacterium
KRATEG

SEQ ID NO: 514458 - protein, 6 aa, Mycobacterium
KRATER

SEQ ID NO: 514459 - protein, 6 aa, Mycobacterium
KRATES

SEQ ID NO: 514460 - protein, 7 aa, Mycobacterium
KRATIAS

SEQ ID NO: 514461 - protein, 6 aa, Mycobacterium
KRAVDA

SEQ ID NO: 514462 - protein, 8 aa, Mycobacterium
KRDAAGAA

SEQ ID NO: 514463 - protein, 16 aa, Mycobacterium
KRDAASRAEVLDLMMR

SEQ ID NO: 514464 - protein, 14 aa, Mycobacterium
KRDAAVGETVDGQS

SEQ ID NO: 514465 - protein, 7 aa, Mycobacterium
KRDADHA

SEQ ID NO: 514466 - protein, 5 aa, Mycobacterium
KRDAE

SEQ ID NO: 514467 - protein, 7 aa, Mycobacterium
KRDAEAY

SEQ ID NO: 514468 - protein, 7 aa, Mycobacterium
KRDAERL

SEQ ID NO: 514469 - protein, 9 aa, Mycobacterium
KRDAPQASP

SEQ ID NO: 514470 - protein, 16 aa, Mycobacterium
KRDAQESAAKSDDVHA

SEQ ID NO: 514471 - protein, 5 aa, Mycobacterium
KRDAT

SEQ ID NO: 514472 - protein, 6 aa, Mycobacterium
KRDDVQ

SEQ ID NO: 514473 - protein, 7 aa, Mycobacterium
KRDEHGR

SEQ ID NO: 514474 - protein, 6 aa, Mycobacterium
KRDGAG

SEQ ID NO: 514475 - protein, 22 aa, Mycobacterium
KRDGDNRDAGNRQQNNGGPRTE

SEQ ID NO: 514476 - protein, 6 aa, Mycobacterium
KRDGDR

SEQ ID NO: 514477 - protein, 7 aa, Mycobacterium
KRDGELA

SEQ ID NO: 514478 - protein, 10 aa, Mycobacterium
KRDGGRTGDQ

SEQ ID NO: 514479 - protein, 17 aa, Mycobacterium
KRDGGRVTTGGGVPDGL

SEQ ID NO: 514480 - protein, 9 aa, Mycobacterium
KRDGRLARS

SEQ ID NO: 514481 - protein, 9 aa, Mycobacterium
KRDGRPQLS

SEQ ID NO: 514482 - protein, 28 aa, Mycobacterium
KRDGSTGSSIVNASSTSGVTTYASTGPV

SEQ ID NO: 514483 - protein, 10 aa, Mycobacterium
KRDGTAARDA

SEQ ID NO: 514484 - protein, 5 aa, Mycobacterium
KRDGV

SEQ ID NO: 514485 - protein, 12 aa, Mycobacterium
KRDKAQGHLDAG

SEQ ID NO: 514486 - protein, 7 aa, Mycobacterium
KRDLSTT

SEQ ID NO: 514487 - protein, 8 aa, Mycobacterium
KRDPDGHG

SEQ ID NO: 514488 - protein, 7 aa, Mycobacterium
KRDPRCG

SEQ ID NO: 514489 - protein, 8 aa, Mycobacterium
KRDPRDQA

SEQ ID NO: 514490 - protein, 6 aa, Mycobacterium
KRDRLA

SEQ ID NO: 514491 - protein, 20 aa, Mycobacterium
KRDRLTPISQSRKIASAAPN

SEQ ID NO: 514492 - protein, 16 aa, Mycobacterium
KRDSEASSFASERAGE

SEQ ID NO: 514493 - protein, 16 aa, Mycobacterium
KRDSEATSNASQRAGE

SEQ ID NO: 514494 - protein, 10 aa, Mycobacterium
KRDSGGRSLA

SEQ ID NO: 514495 - protein, 14 aa, Mycobacterium
KRDSHFEDSARSDM

SEQ ID NO: 514496 - protein, 14 aa, Mycobacterium
KRDSTYQPGRRSSA

SEQ ID NO: 514497 - protein, 15 aa, Mycobacterium
KRDSTYQPGRRSSSW

SEQ ID NO: 514498 - protein, 5 aa, Mycobacterium
KRDSV

SEQ ID NO: 514499 - protein, 5 aa, Mycobacterium
KRDTN

SEQ ID NO: 514500 - protein, 5 aa, Mycobacterium
KRDTV

SEQ ID NO: 514501 - protein, 6 aa, Mycobacterium
KRDVPF

SEQ ID NO: 514502 - protein, 6 aa, Mycobacterium
KREAAQ

SEQ ID NO: 514503 - protein, 8 aa, Mycobacterium
KREAAQAK

SEQ ID NO: 514504 - protein, 8 aa, Mycobacterium
KREAARAK

SEQ ID NO: 514505 - protein, 6 aa, Mycobacterium
KREAGQ

SEQ ID NO: 514506 - protein, 10 aa, Mycobacterium
KREATASQRQ

SEQ ID NO: 514507 - protein, 23 aa, Mycobacterium
KREDEAHQTGKEIPTEYRYEDLL

SEQ ID NO: 514508 - protein, 19 aa, Mycobacterium
KREDGWGARTRMKDASSTD

SEQ ID NO: 514509 - protein, 4 aa, Mycobacterium
KREG

SEQ ID NO: 514510 - protein, 19 aa, Mycobacterium
KREGASLVTGGGRPPGKQF

SEQ ID NO: 514511 - protein, 8 aa, Mycobacterium
KREGDHYR

SEQ ID NO: 514512 - protein, 6 aa, Mycobacterium
KREGRE

SEQ ID NO: 514513 - protein, 8 aa, Mycobacterium
KREIRGRA

SEQ ID NO: 514514 - protein, 8 aa, Mycobacterium
KREKPWSE

SEQ ID NO: 514515 - protein, 9 aa, Mycobacterium
KRELGDTST

SEQ ID NO: 514516 - protein, 14 aa, Mycobacterium
KRELPPGYDSEKHF

SEQ ID NO: 514517 - protein, 5 aa, Mycobacterium
KRENL

SEQ ID NO: 514518 - protein, 9 aa, Mycobacterium
KRENPARTV

SEQ ID NO: 514519 - protein, 5 aa, Mycobacterium
KREPL

SEQ ID NO: 514520 - protein, 12 aa, Mycobacterium
KREQESGQVASR

SEQ ID NO: 514521 - protein, 11 aa, Mycobacterium
KRESKSRPSQG

SEQ ID NO: 514522 - protein, 5 aa, Mycobacterium
KRESL

SEQ ID NO: 514523 - protein, 11 aa, Mycobacterium
KRETAKDDGER

SEQ ID NO: 514524 - protein, 6 aa, Mycobacterium
KRETGI

SEQ ID NO: 514525 - protein, 12 aa, Mycobacterium
KRETSKDDGERL

SEQ ID NO: 514526 - protein, 9 aa, Mycobacterium
KREVDSGSL

SEQ ID NO: 514527 - protein, 10 aa, Mycobacterium
KREYHESASP

SEQ ID NO: 514528 - protein, 14 aa, Mycobacterium
KRFEPVDPKTSGEI

SEQ ID NO: 514529 - protein, 6 aa, Mycobacterium
KRFNTG

SEQ ID NO: 514530 - protein, 11 aa, Mycobacterium
KRFRKTGTGKI

SEQ ID NO: 514531 - protein, 10 aa, Mycobacterium
KRFRRTGTGK

SEQ ID NO: 514532 - protein, 11 aa, Mycobacterium
KRFRTTGSGKI

SEQ ID NO: 514533 - protein, 6 aa, Mycobacterium
KRGAAQ

SEQ ID NO: 514534 - protein, 9 aa, Mycobacterium
KRGARKSYT

SEQ ID NO: 514535 - protein, 15 aa, Mycobacterium
KRGATTVEPSAAAQE

SEQ ID NO: 514536 - protein, 10 aa, Mycobacterium
KRGDGDSESI

SEQ ID NO: 514537 - protein, 7 aa, Mycobacterium
KRGDIGT

SEQ ID NO: 514538 - protein, 8 aa, Mycobacterium
KRGDIGTT

SEQ ID NO: 514539 - protein, 8 aa, Mycobacterium
KRGDSDEE

SEQ ID NO: 514540 - protein, 10 aa, Mycobacterium
KRGDSDPDAM

SEQ ID NO: 514541 - protein, 11 aa, Mycobacterium
KRGDSSGETHD

SEQ ID NO: 514542 - protein, 4 aa, Mycobacterium
KRGE

SEQ ID NO: 514543 - protein, 16 aa, Mycobacterium
KRGEAGAHGLAYIPRS

SEQ ID NO: 514544 - protein, 22 aa, Mycobacterium
KRGEAGRSGSPLGQASGAPRKA

SEQ ID NO: 514545 - protein, 6 aa, Mycobacterium
KRGEPI

SEQ ID NO: 514546 - protein, 10 aa, Mycobacterium
KRGEQPPVGS

SEQ ID NO: 514547 - protein, 8 aa, Mycobacterium
KRGERQPL

SEQ ID NO: 514548 - protein, 9 aa, Mycobacterium
KRGERQPQA

SEQ ID NO: 514549 - protein, 20 aa, Mycobacterium
KRGERQPQPRMPIIEHALPN

SEQ ID NO: 514550 - protein, 6 aa, Mycobacterium
KRGERT

SEQ ID NO: 514551 - protein, 14 aa, Mycobacterium
KRGGGAIVNQSSTA

SEQ ID NO: 514552 - protein, 10 aa, Mycobacterium
KRGGRPGPGI

SEQ ID NO: 514553 - protein, 7 aa, Mycobacterium
KRGGSTI

SEQ ID NO: 514554 - protein, 10 aa, Mycobacterium
KRGGTPGPGI

SEQ ID NO: 514555 - protein, 11 aa, Mycobacterium
KRGGVPSRGPH

SEQ ID NO: 514556 - protein, 6 aa, Mycobacterium
KRGHLN

SEQ ID NO: 514557 - protein, 9 aa, Mycobacterium
KRGHNAEQI

SEQ ID NO: 514558 - protein, 9 aa, Mycobacterium
KRGHSAEQI

SEQ ID NO: 514559 - protein, 14 aa, Mycobacterium
KRGIQDETGVKPPW

SEQ ID NO: 514560 - protein, 13 aa, Mycobacterium
KRGIQEETGLKPA

SEQ ID NO: 514561 - protein, 6 aa, Mycobacterium
KRGITP

SEQ ID NO: 514562 - protein, 12 aa, Mycobacterium
KRGKDSRSLATE

SEQ ID NO: 514563 - protein, 5 aa, Mycobacterium
KRGKR

SEQ ID NO: 514564 - protein, 6 aa, Mycobacterium
KRGKRI

SEQ ID NO: 514565 - protein, 7 aa, Mycobacterium
KRGLNGF

SEQ ID NO: 514566 - protein, 15 aa, Mycobacterium
KRGNASAWAGVGAPD

SEQ ID NO: 514567 - protein, 7 aa, Mycobacterium
KRGPFED

SEQ ID NO: 514568 - protein, 6 aa, Mycobacterium
KRGPGI

SEQ ID NO: 514569 - protein, 7 aa, Mycobacterium
KRGPGLQ

SEQ ID NO: 514570 - protein, 8 aa, Mycobacterium
KRGQAQKG

SEQ ID NO: 514571 - protein, 7 aa, Mycobacterium
KRGQRQG

SEQ ID NO: 514572 - protein, 8 aa, Mycobacterium
KRGRAAEL

SEQ ID NO: 514573 - protein, 5 aa, Mycobacterium
KRGRE

SEQ ID NO: 514574 - protein, 6 aa, Mycobacterium
KRGRPQ

SEQ ID NO: 514575 - protein, 6 aa, Mycobacterium
KRGRPS

SEQ ID NO: 514576 - protein, 9 aa, Mycobacterium
KRGRQMGYS

SEQ ID NO: 514577 - protein, 5 aa, Mycobacterium
KRGSS

SEQ ID NO: 514578 - protein, 5 aa, Mycobacterium
KRGST

SEQ ID NO: 514579 - protein, 7 aa, Mycobacterium
KRGTPFP

SEQ ID NO: 514580 - protein, 7 aa, Mycobacterium
KRGVEVS

SEQ ID NO: 514581 - protein, 8 aa, Mycobacterium
KRGVRKSY

SEQ ID NO: 514582 - protein, 7 aa, Mycobacterium
KRGVSTE

SEQ ID NO: 514583 - protein, 4 aa, Mycobacterium
KRGW

SEQ ID NO: 514584 - protein, 9 aa, Mycobacterium
KRGYGPEKV

SEQ ID NO: 514585 - protein, 5 aa, Mycobacterium
KRHEH

SEQ ID NO: 514586 - protein, 9 aa, Mycobacterium
KRHGRPARE

SEQ ID NO: 514587 - protein, 10 aa, Mycobacterium
KRHGRPPRER

SEQ ID NO: 514588 - protein, 13 aa, Mycobacterium
KRHKQGRRTAREN

SEQ ID NO: 514589 - protein, 7 aa, Mycobacterium
KRHPDVQ

SEQ ID NO: 514590 - protein, 5 aa, Mycobacterium
KRHPG

SEQ ID NO: 514591 - protein, 6 aa, Mycobacterium
KRHPYR

SEQ ID NO: 514592 - protein, 13 aa, Mycobacterium
KRHQQGRRTAREN

SEQ ID NO: 514593 - protein, 6 aa, Mycobacterium
KRHRSE

SEQ ID NO: 514594 - protein, 7 aa, Mycobacterium
KRHWPTS

SEQ ID NO: 514595 - protein, 11 aa, Mycobacterium
KRIAAGAPAVR

SEQ ID NO: 514596 - protein, 8 aa, Mycobacterium
KRIAEAGG

SEQ ID NO: 514597 - protein, 7 aa, Mycobacterium
KRIATPD

SEQ ID NO: 514598 - protein, 7 aa, Mycobacterium
KRIDSAA

SEQ ID NO: 514599 - protein, 11 aa, Mycobacterium
KRIKDGAPAVR

SEQ ID NO: 514600 - protein, 8 aa, Mycobacterium
KRIKVTDP

SEQ ID NO: 514601 - protein, 10 aa, Mycobacterium
KRIPPQAENG

SEQ ID NO: 514602 - protein, 5 aa, Mycobacterium
KRIPS

SEQ ID NO: 514603 - protein, 6 aa, Mycobacterium
KRIRAN

SEQ ID NO: 514604 - protein, 34 aa, Mycobacterium
KRIRGRRAAGNTDQARQRCSRGCTDHKSAPPGPD

SEQ ID NO: 514605 - protein, 5 aa, Mycobacterium
KRIRT

SEQ ID NO: 514606 - protein, 12 aa, Mycobacterium
KRISGAGDEAFE

SEQ ID NO: 514607 - protein, 7 aa, Mycobacterium
KRITPGD

SEQ ID NO: 514608 - protein, 20 aa, Mycobacterium
KRKAYEDRAQAALGVVESEK

SEQ ID NO: 514609 - protein, 7 aa, Mycobacterium
KRKEKAL

SEQ ID NO: 514610 - protein, 5 aa, Mycobacterium
KRKFR

SEQ ID NO: 514611 - protein, 8 aa, Mycobacterium
KRKHADRG

SEQ ID NO: 514612 - protein, 14 aa, Mycobacterium
KRKPAQLSGGQQQR

SEQ ID NO: 514613 - protein, 9 aa, Mycobacterium
KRKPDEGPR

SEQ ID NO: 514614 - protein, 6 aa, Mycobacterium
KRKPYA

SEQ ID NO: 514615 - protein, 13 aa, Mycobacterium
KRKRRKRRESLEE

SEQ ID NO: 514616 - protein, 10 aa, Mycobacterium
KRKSFADQPY

SEQ ID NO: 514617 - protein, 16 aa, Mycobacterium
KRLGARTSGYDVRPEV

SEQ ID NO: 514618 - protein, 10 aa, Mycobacterium
KRLGDNRKRE

SEQ ID NO: 514619 - protein, 9 aa, Mycobacterium
KRLGEARKK

SEQ ID NO: 514620 - protein, 10 aa, Mycobacterium
KRLGEARKRD

SEQ ID NO: 514621 - protein, 10 aa, Mycobacterium
KRLGENRKRE

SEQ ID NO: 514622 - protein, 10 aa, Mycobacterium
KRLGENRRRD

SEQ ID NO: 514623 - protein, 9 aa, Mycobacterium
KRLGSDKGM

SEQ ID NO: 514624 - protein, 6 aa, Mycobacterium
KRLKEN

SEQ ID NO: 514625 - protein, 4 aa, Mycobacterium
KRLN

SEQ ID NO: 514626 - protein, 18 aa, Mycobacterium
KRLNQQHRGDQTGFVLRV

SEQ ID NO: 514627 - protein, 5 aa, Mycobacterium
KRLPG

SEQ ID NO: 514628 - protein, 8 aa, Mycobacterium
KRLPGSGL

SEQ ID NO: 514629 - protein, 7 aa, Mycobacterium
KRLPRPY

SEQ ID NO: 514630 - protein, 5 aa, Mycobacterium
KRLRA

SEQ ID NO: 514631 - protein, 5 aa, Mycobacterium
KRLSD

SEQ ID NO: 514632 - protein, 11 aa, Mycobacterium
KRLTDYPRPSV

SEQ ID NO: 514633 - protein, 13 aa, Mycobacterium
KRLTGAGDDQFET

SEQ ID NO: 514634 - protein, 14 aa, Mycobacterium
KRLTTADADRAAEA

SEQ ID NO: 514635 - protein, 6 aa, Mycobacterium
KRMRSE

SEQ ID NO: 514636 - protein, 6 aa, Mycobacterium
KRNAEQ

SEQ ID NO: 514637 - protein, 9 aa, Mycobacterium
KRNARTDRP

SEQ ID NO: 514638 - protein, 9 aa, Mycobacterium
KRNGDGPVE

SEQ ID NO: 514639 - protein, 7 aa, Mycobacterium
KRNGKAL

SEQ ID NO: 514640 - protein, 5 aa, Mycobacterium
KRNGM

SEQ ID NO: 514641 - protein, 7 aa, Mycobacterium
KRNKDKP

SEQ ID NO: 514642 - protein, 10 aa, Mycobacterium
KRNPAGKADY

SEQ ID NO: 514643 - protein, 9 aa, Mycobacterium
KRNPDGNNM

SEQ ID NO: 514644 - protein, 7 aa, Mycobacterium
KRNPDLD

SEQ ID NO: 514645 - protein, 8 aa, Mycobacterium
KRNPDTAD

SEQ ID NO: 514646 - protein, 6 aa, Mycobacterium
KRNPRS

SEQ ID NO: 514647 - protein, 7 aa, Mycobacterium
KRNQKGP

SEQ ID NO: 514648 - protein, 5 aa, Mycobacterium
KRNQV

SEQ ID NO: 514649 - protein, 6 aa, Mycobacterium
KRNRDK

SEQ ID NO: 514650 - protein, 9 aa, Mycobacterium
KRNRQINSP

SEQ ID NO: 514651 - protein, 22 aa, Mycobacterium
KRPAASGEAAPAPGGPNVTEVT

SEQ ID NO: 514652 - protein, 16 aa, Mycobacterium
KRPADLATKQAAASVG

SEQ ID NO: 514653 - protein, 13 aa, Mycobacterium
KRPADLDAARSGF

SEQ ID NO: 514654 - protein, 5 aa, Mycobacterium
KRPAH

SEQ ID NO: 514655 - protein, 6 aa, Mycobacterium
KRPAVR

SEQ ID NO: 514656 - protein, 5 aa, Mycobacterium
KRPAY

SEQ ID NO: 514657 - protein, 11 aa, Mycobacterium
KRPDGSLQHPP

SEQ ID NO: 514658 - protein, 6 aa, Mycobacterium
KRPDHD

SEQ ID NO: 514659 - protein, 5 aa, Mycobacterium
KRPDL

SEQ ID NO: 514660 - protein, 6 aa, Mycobacterium
KRPDYS

SEQ ID NO: 514661 - protein, 5 aa, Mycobacterium
KRPEL

SEQ ID NO: 514662 - protein, 8 aa, Mycobacterium
KRPETTAD

SEQ ID NO: 514663 - protein, 6 aa, Mycobacterium
KRPEVR

SEQ ID NO: 514664 - protein, 6 aa, Mycobacterium
KRPEVT

SEQ ID NO: 514665 - protein, 5 aa, Mycobacterium
KRPGA

SEQ ID NO: 514666 - protein, 6 aa, Mycobacterium
KRPGDV

SEQ ID NO: 514667 - protein, 7 aa, Mycobacterium
KRPGDVV

SEQ ID NO: 514668 - protein, 6 aa, Mycobacterium
KRPGGY

SEQ ID NO: 514669 - protein, 5 aa, Mycobacterium
KRPGL

SEQ ID NO: 514670 - protein, 7 aa, Mycobacterium
KRPGMPD

SEQ ID NO: 514671 - protein, 9 aa, Mycobacterium
KRPGMPDHG

SEQ ID NO: 514672 - protein, 7 aa, Mycobacterium
KRPGPEL

SEQ ID NO: 514673 - protein, 7 aa, Mycobacterium
KRPGPGM

SEQ ID NO: 514674 - protein, 27 aa, Mycobacterium
KRPGRKVDASPRTFGGVGRGAPPPKHQ

SEQ ID NO: 514675 - protein, 15 aa, Mycobacterium
KRPGRPPGASDTRDR

SEQ ID NO: 514676 - protein, 5 aa, Mycobacterium
KRPGS

SEQ ID NO: 514677 - protein, 29 aa, Mycobacterium
KRPGSAAAQAAEAAEKATGQPPAAETEQT

SEQ ID NO: 514678 - protein, 18 aa, Mycobacterium
KRPGSAADKAARKALGDE

SEQ ID NO: 514679 - protein, 7 aa, Mycobacterium
KRPGTGD

SEQ ID NO: 514680 - protein, 10 aa, Mycobacterium
KRPGTPAADF

SEQ ID NO: 514681 - protein, 15 aa, Mycobacterium
KRPGTPAADMPDQLP

SEQ ID NO: 514682 - protein, 13 aa, Mycobacterium
KRPGTPAAELDGQ

SEQ ID NO: 514683 - protein, 15 aa, Mycobacterium
KRPGTPAAELDGQLP

SEQ ID NO: 514684 - protein, 14 aa, Mycobacterium
KRPGTPAAELEGQI

SEQ ID NO: 514685 - protein, 10 aa, Mycobacterium
KRPGVTKPSL

SEQ ID NO: 514686 - protein, 5 aa, Mycobacterium
KRPHV

SEQ ID NO: 514687 - protein, 7 aa, Mycobacterium
KRPITRA

SEQ ID NO: 514688 - protein, 12 aa, Mycobacterium
KRPKADAHTTLA

SEQ ID NO: 514689 - protein, 9 aa, Mycobacterium
KRPKAEIAE

SEQ ID NO: 514690 - protein, 9 aa, Mycobacterium
KRPKAEIKA

SEQ ID NO: 514691 - protein, 9 aa, Mycobacterium
KRPKAEIRD

SEQ ID NO: 514692 - protein, 9 aa, Mycobacterium
KRPKAEVKA

SEQ ID NO: 514693 - protein, 10 aa, Mycobacterium
KRPKGPGPHA

SEQ ID NO: 514694 - protein, 8 aa, Mycobacterium
KRPKRTQV

SEQ ID NO: 514695 - protein, 6 aa, Mycobacterium
KRPLED

SEQ ID NO: 514696 - protein, 11 aa, Mycobacterium
KRPLGPGEDGD

SEQ ID NO: 514697 - protein, 5 aa, Mycobacterium
KRPLL

SEQ ID NO: 514698 - protein, 5 aa, Mycobacterium
KRPLS

SEQ ID NO: 514699 - protein, 6 aa, Mycobacterium
KRPMTR

SEQ ID NO: 514700 - protein, 4 aa, Mycobacterium
KRPN

SEQ ID NO: 514701 - protein, 5 aa, Mycobacterium
KRPPA

SEQ ID NO: 514702 - protein, 9 aa, Mycobacterium
KRPPEEGRA

SEQ ID NO: 514703 - protein, 8 aa, Mycobacterium
KRPPERAR

SEQ ID NO: 514704 - protein, 13 aa, Mycobacterium
KRPPQFPSLNSTD

SEQ ID NO: 514705 - protein, 12 aa, Mycobacterium
KRPQAAAEKRAE

SEQ ID NO: 514706 - protein, 5 aa, Mycobacterium
KRPQM

SEQ ID NO: 514707 - protein, 15 aa, Mycobacterium
KRPQPVTSADTPGEA

SEQ ID NO: 514708 - protein, 8 aa, Mycobacterium
KRPQRPAY

SEQ ID NO: 514709 - protein, 4 aa, Mycobacterium
KRPR

SEQ ID NO: 514710 - protein, 8 aa, Mycobacterium
KRPRAEIK

SEQ ID NO: 514711 - protein, 6 aa, Mycobacterium
KRPREV

SEQ ID NO: 514712 - protein, 19 aa, Mycobacterium
KRPRGRPRKNPLPDADTAA

SEQ ID NO: 514713 - protein, 36 aa, Mycobacterium
KRPRKSAAEVAGPDASAAPDSKAGPDSKAGSNSKDS

SEQ ID NO: 514714 - protein, 7 aa, Mycobacterium
KRPRLGV

SEQ ID NO: 514715 - protein, 5 aa, Mycobacterium
KRPRN

SEQ ID NO: 514716 - protein, 10 aa, Mycobacterium
KRPRPQGDQV

SEQ ID NO: 514717 - protein, 5 aa, Mycobacterium
KRPSF

SEQ ID NO: 514718 - protein, 19 aa, Mycobacterium
KRPSGTADTVAATGGTSLN

SEQ ID NO: 514719 - protein, 6 aa, Mycobacterium
KRPSIR

SEQ ID NO: 514720 - protein, 6 aa, Mycobacterium
KRPSPR

SEQ ID NO: 514721 - protein, 4 aa, Mycobacterium
KRPT

SEQ ID NO: 514722 - protein, 17 aa, Mycobacterium
KRPTDLATKQAAASAGQ

SEQ ID NO: 514723 - protein, 8 aa, Mycobacterium
KRPTEPVA

SEQ ID NO: 514724 - protein, 6 aa, Mycobacterium
KRPTLS

SEQ ID NO: 514725 - protein, 8 aa, Mycobacterium
KRPTSAEV

SEQ ID NO: 514726 - protein, 10 aa, Mycobacterium
KRPTSDEVGE

SEQ ID NO: 514727 - protein, 10 aa, Mycobacterium
KRPVDAAEPE

SEQ ID NO: 514728 - protein, 7 aa, Mycobacterium
KRPVGSR

SEQ ID NO: 514729 - protein, 7 aa, Mycobacterium
KRPVSER

SEQ ID NO: 514730 - protein, 6 aa, Mycobacterium
KRPVTA

SEQ ID NO: 514731 - protein, 5 aa, Mycobacterium
KRPVV

SEQ ID NO: 514732 - protein, 6 aa, Mycobacterium
KRPVVA

SEQ ID NO: 514733 - protein, 6 aa, Mycobacterium
KRQAAQ

SEQ ID NO: 514734 - protein, 11 aa, Mycobacterium
KRQAGGDTADQ

SEQ ID NO: 514735 - protein, 6 aa, Mycobacterium
KRQAKL

SEQ ID NO: 514736 - protein, 17 aa, Mycobacterium
KRQASPGHAFGPDTPWQ

SEQ ID NO: 514737 - protein, 17 aa, Mycobacterium
KRQASSGHAFAPDTPWQ

SEQ ID NO: 514738 - protein, 6 aa, Mycobacterium
KRQDRG

SEQ ID NO: 514739 - protein, 7 aa, Mycobacterium
KRQGEWT

SEQ ID NO: 514740 - protein, 9 aa, Mycobacterium
KRQGPARFS

SEQ ID NO: 514741 - protein, 11 aa, Mycobacterium
KRQGQSIDSDM

SEQ ID NO: 514742 - protein, 6 aa, Mycobacterium
KRQKEY

SEQ ID NO: 514743 - protein, 5 aa, Mycobacterium
KRQKF

SEQ ID NO: 514744 - protein, 9 aa, Mycobacterium
KRQKQSGEQ

SEQ ID NO: 514745 - protein, 20 aa, Mycobacterium
KRQPPADPSGGVLRRALGRF

SEQ ID NO: 514746 - protein, 9 aa, Mycobacterium
KRQPTAATQ

SEQ ID NO: 514747 - protein, 5 aa, Mycobacterium
KRQQR

SEQ ID NO: 514748 - protein, 17 aa, Mycobacterium
KRQRQSGSYLYFLLERD

SEQ ID NO: 514749 - protein, 8 aa, Mycobacterium
KRQRQTAE

SEQ ID NO: 514750 - protein, 14 aa, Mycobacterium
KRQRRERGSINPDD

SEQ ID NO: 514751 - protein, 18 aa, Mycobacterium
KRQSAPGHAFGPDTPWQA

SEQ ID NO: 514752 - protein, 8 aa, Mycobacterium
KRQSERTK

SEQ ID NO: 514753 - protein, 6 aa, Mycobacterium
KRQSHR

SEQ ID NO: 514754 - protein, 8 aa, Mycobacterium
KRQSPADD

SEQ ID NO: 514755 - protein, 7 aa, Mycobacterium
KRQTDQR

SEQ ID NO: 514756 - protein, 13 aa, Mycobacterium
KRQVAGRSGDTIC

SEQ ID NO: 514757 - protein, 11 aa, Mycobacterium
KRQVGGDTADQ

SEQ ID NO: 514758 - protein, 8 aa, Mycobacterium
KRRAEPTD

SEQ ID NO: 514759 - protein, 9 aa, Mycobacterium
KRRAEPTGD

SEQ ID NO: 514760 - protein, 9 aa, Mycobacterium
KRRAETRGR

SEQ ID NO: 514761 - protein, 8 aa, Mycobacterium
KRRAHPQN

SEQ ID NO: 514762 - protein, 7 aa, Mycobacterium
KRRARPQ

SEQ ID NO: 514763 - protein, 10 aa, Mycobacterium
KRRDEPPNLE

SEQ ID NO: 514764 - protein, 10 aa, Mycobacterium
KRRDETGLSV

SEQ ID NO: 514765 - protein, 12 aa, Mycobacterium
KRRDGGDSHAQA

SEQ ID NO: 514766 - protein, 11 aa, Mycobacterium
KRRDKGTVEAT

SEQ ID NO: 514767 - protein, 11 aa, Mycobacterium
KRRDTSVDPPQ

SEQ ID NO: 514768 - protein, 8 aa, Mycobacterium
KRREATGI

SEQ ID NO: 514769 - protein, 9 aa, Mycobacterium
KRRENPQDD

SEQ ID NO: 514770 - protein, 8 aa, Mycobacterium
KRREPPTE

SEQ ID NO: 514771 - protein, 6 aa, Mycobacterium
KRRGAR

SEQ ID NO: 514772 - protein, 7 aa, Mycobacterium
KRRGATT

SEQ ID NO: 514773 - protein, 7 aa, Mycobacterium
KRRGEAE

SEQ ID NO: 514774 - protein, 11 aa, Mycobacterium
KRRGEEPRRDS

SEQ ID NO: 514775 - protein, 7 aa, Mycobacterium
KRRGGGI

SEQ ID NO: 514776 - protein, 17 aa, Mycobacterium
KRRGGLPVSPPSGVSTQ

SEQ ID NO: 514777 - protein, 10 aa, Mycobacterium
KRRGGRPGIG

SEQ ID NO: 514778 - protein, 14 aa, Mycobacterium
KRRGIGVSNTPDVL

SEQ ID NO: 514779 - protein, 6 aa, Mycobacterium
KRRGKG

SEQ ID NO: 514780 - protein, 7 aa, Mycobacterium
KRRGQTL

SEQ ID NO: 514781 - protein, 14 aa, Mycobacterium
KRRGRKGLPGAPAH

SEQ ID NO: 514782 - protein, 11 aa, Mycobacterium
KRRIDPETGEV

SEQ ID NO: 514783 - protein, 55 aa, Mycobacterium
KRRIDPNTGAVREEAKAAESKAATAEPGASASGAAGSATSGPAAAASEGGSDADV

SEQ ID NO: 514784 - protein, 9 aa, Mycobacterium
KRRKRPGSI

SEQ ID NO: 514785 - protein, 4 aa, Mycobacterium
KRRN

SEQ ID NO: 514786 - protein, 5 aa, Mycobacterium
KRRNG

SEQ ID NO: 514787 - protein, 16 aa, Mycobacterium
KRRNGREQLASGDVEA

SEQ ID NO: 514788 - protein, 7 aa, Mycobacterium
KRRNPQA

SEQ ID NO: 514789 - protein, 4 aa, Mycobacterium
KRRP

SEQ ID NO: 514790 - protein, 6 aa, Mycobacterium
KRRPDF

SEQ ID NO: 514791 - protein, 8 aa, Mycobacterium
KRRPEASR

SEQ ID NO: 514792 - protein, 10 aa, Mycobacterium
KRRPGPGDQA

SEQ ID NO: 514793 - protein, 7 aa, Mycobacterium
KRRPGVG

SEQ ID NO: 514794 - protein, 5 aa, Mycobacterium
KRRPP

SEQ ID NO: 514795 - protein, 11 aa, Mycobacterium
KRRPPKSGQLV

SEQ ID NO: 514796 - protein, 5 aa, Mycobacterium
KRRQP

SEQ ID NO: 514797 - protein, 7 aa, Mycobacterium
KRRRAVR

SEQ ID NO: 514798 - protein, 14 aa, Mycobacterium
KRRRGKNGKVGPPV

SEQ ID NO: 514799 - protein, 13 aa, Mycobacterium
KRRRGREQLASGD

SEQ ID NO: 514800 - protein, 16 aa, Mycobacterium
KRRRGREQLASGDVAT

SEQ ID NO: 514801 - protein, 10 aa, Mycobacterium
KRRRTGRGDA

SEQ ID NO: 514802 - protein, 9 aa, Mycobacterium
KRRSEGDRR

SEQ ID NO: 514803 - protein, 13 aa, Mycobacterium
KRRTGARDSDFEA

SEQ ID NO: 514804 - protein, 6 aa, Mycobacterium
KRRTGY

SEQ ID NO: 514805 - protein, 7 aa, Mycobacterium
KRRTPRA

SEQ ID NO: 514806 - protein, 10 aa, Mycobacterium
KRRVDPETGE

SEQ ID NO: 514807 - protein, 6 aa, Mycobacterium
KRRVPA

SEQ ID NO: 514808 - protein, 7 aa, Mycobacterium
KRRVPAT

SEQ ID NO: 514809 - protein, 9 aa, Mycobacterium
KRSARGQGH

SEQ ID NO: 514810 - protein, 12 aa, Mycobacterium
KRSAVSLSNGEI

SEQ ID NO: 514811 - protein, 6 aa, Mycobacterium
KRSDAI

SEQ ID NO: 514812 - protein, 22 aa, Mycobacterium
KRSDEAAAGTEEWHDPREDGAL

SEQ ID NO: 514813 - protein, 20 aa, Mycobacterium
KRSDGTIDGNETERHIISTL

SEQ ID NO: 514814 - protein, 8 aa, Mycobacterium
KRSDTDIE

SEQ ID NO: 514815 - protein, 24 aa, Mycobacterium
KRSEADAPEGADDADDAEAPDDEA

SEQ ID NO: 514816 - protein, 7 aa, Mycobacterium
KRSEGGV

SEQ ID NO: 514817 - protein, 7 aa, Mycobacterium
KRSGAEV

SEQ ID NO: 514818 - protein, 8 aa, Mycobacterium
KRSGAEVV

SEQ ID NO: 514819 - protein, 11 aa, Mycobacterium
KRSGAQPSARR

SEQ ID NO: 514820 - protein, 6 aa, Mycobacterium
KRSGAT

SEQ ID NO: 514821 - protein, 7 aa, Mycobacterium
KRSGGIH

SEQ ID NO: 514822 - protein, 17 aa, Mycobacterium
KRSGGVDIQTNRTSQRG

SEQ ID NO: 514823 - protein, 17 aa, Mycobacterium
KRSGGVDLETNRTSQRG

SEQ ID NO: 514824 - protein, 6 aa, Mycobacterium
KRSGKP

SEQ ID NO: 514825 - protein, 9 aa, Mycobacterium
KRSGLSRPT

SEQ ID NO: 514826 - protein, 5 aa, Mycobacterium
KRSGV

SEQ ID NO: 514827 - protein, 10 aa, Mycobacterium
KRSGYGRELS

SEQ ID NO: 514828 - protein, 9 aa, Mycobacterium
KRSIGPDKI

SEQ ID NO: 514829 - protein, 15 aa, Mycobacterium
KRSITVDTRTDAGKD

SEQ ID NO: 514830 - protein, 14 aa, Mycobacterium
KRSLAIDTKSPEGL

SEQ ID NO: 514831 - protein, 6 aa, Mycobacterium
KRSLTA

SEQ ID NO: 514832 - protein, 19 aa, Mycobacterium
KRSPAAAWPGWPSWPPRPA

SEQ ID NO: 514833 - protein, 6 aa, Mycobacterium
KRSPAV

SEQ ID NO: 514834 - protein, 8 aa, Mycobacterium
KRSPDLSH

SEQ ID NO: 514835 - protein, 8 aa, Mycobacterium
KRSPLAPS

SEQ ID NO: 514836 - protein, 7 aa, Mycobacterium
KRSRRMT

SEQ ID NO: 514837 - protein, 18 aa, Mycobacterium
KRSTDADTSASAGGTSLN

SEQ ID NO: 514838 - protein, 7 aa, Mycobacterium
KRSTEEW

SEQ ID NO: 514839 - protein, 21 aa, Mycobacterium
KRSTGSGPTAASIDDCVVLSE

SEQ ID NO: 514840 - protein, 8 aa, Mycobacterium
KRSTREAL

SEQ ID NO: 514841 - protein, 4 aa, Mycobacterium
KRSV

SEQ ID NO: 514842 - protein, 9 aa, Mycobacterium
KRSVPNSVP

SEQ ID NO: 514843 - protein, 7 aa, Mycobacterium
KRSVSAP

SEQ ID NO: 514844 - protein, 16 aa, Mycobacterium
KRSVTYPPGAQGLSAE

SEQ ID NO: 514845 - protein, 13 aa, Mycobacterium
KRSVVADPGVEDD

SEQ ID NO: 514846 - protein, 7 aa, Mycobacterium
KRSVVGT

SEQ ID NO: 514847 - protein, 7 aa, Mycobacterium
KRTAAER

SEQ ID NO: 514848 - protein, 17 aa, Mycobacterium
KRTAGGIRVGINHVRTP

SEQ ID NO: 514849 - protein, 14 aa, Mycobacterium
KRTAQKVADELGER

SEQ ID NO: 514850 - protein, 13 aa, Mycobacterium
KRTAQKVADELKE

SEQ ID NO: 514851 - protein, 13 aa, Mycobacterium
KRTAQKVSDELAE

SEQ ID NO: 514852 - protein, 14 aa, Mycobacterium
KRTAQKVSDELAER

SEQ ID NO: 514853 - protein, 9 aa, Mycobacterium
KRTARGHGH

SEQ ID NO: 514854 - protein, 10 aa, Mycobacterium
KRTASSMSTA

SEQ ID NO: 514855 - protein, 8 aa, Mycobacterium
KRTATSMA

SEQ ID NO: 514856 - protein, 7 aa, Mycobacterium
KRTDADE

SEQ ID NO: 514857 - protein, 7 aa, Mycobacterium
KRTDADQ

SEQ ID NO: 514858 - protein, 9 aa, Mycobacterium
KRTDGGYGS

SEQ ID NO: 514859 - protein, 8 aa, Mycobacterium
KRTDPVTA

SEQ ID NO: 514860 - protein, 9 aa, Mycobacterium
KRTDRDPKQ

SEQ ID NO: 514861 - protein, 7 aa, Mycobacterium
KRTERDE

SEQ ID NO: 514862 - protein, 6 aa, Mycobacterium
KRTESS

SEQ ID NO: 514863 - protein, 8 aa, Mycobacterium
KRTFPKPI

SEQ ID NO: 514864 - protein, 5 aa, Mycobacterium
KRTFT

SEQ ID NO: 514865 - protein, 10 aa, Mycobacterium
KRTGAADDPL

SEQ ID NO: 514866 - protein, 12 aa, Mycobacterium
KRTGDDAVSATI

SEQ ID NO: 514867 - protein, 11 aa, Mycobacterium
KRTGEQEEVRS

SEQ ID NO: 514868 - protein, 7 aa, Mycobacterium
KRTGHSA

SEQ ID NO: 514869 - protein, 5 aa, Mycobacterium
KRTGL

SEQ ID NO: 514870 - protein, 5 aa, Mycobacterium
KRTGQ

SEQ ID NO: 514871 - protein, 5 aa, Mycobacterium
KRTGT

SEQ ID NO: 514872 - protein, 5 aa, Mycobacterium
KRTHD

SEQ ID NO: 514873 - protein, 6 aa, Mycobacterium
KRTHQS

SEQ ID NO: 514874 - protein, 5 aa, Mycobacterium
KRTLS

SEQ ID NO: 514875 - protein, 5 aa, Mycobacterium
KRTPD

SEQ ID NO: 514876 - protein, 15 aa, Mycobacterium
KRTPGGSSGGSAAAV

SEQ ID NO: 514877 - protein, 16 aa, Mycobacterium
KRTPGTGCSSLTGQHE

SEQ ID NO: 514878 - protein, 11 aa, Mycobacterium
KRTPKLARTRS

SEQ ID NO: 514879 - protein, 7 aa, Mycobacterium
KRTPMST

SEQ ID NO: 514880 - protein, 18 aa, Mycobacterium
KRTPPASDDEGGEETVTV

SEQ ID NO: 514881 - protein, 7 aa, Mycobacterium
KRTPRMA

SEQ ID NO: 514882 - protein, 10 aa, Mycobacterium
KRTPTTPTQL

SEQ ID NO: 514883 - protein, 6 aa, Mycobacterium
KRTPVR

SEQ ID NO: 514884 - protein, 5 aa, Mycobacterium
KRTSD

SEQ ID NO: 514885 - protein, 9 aa, Mycobacterium
KRTSHGSTL

SEQ ID NO: 514886 - protein, 8 aa, Mycobacterium
KRTSPPYV

SEQ ID NO: 514887 - protein, 9 aa, Mycobacterium
KRTSPTALS

SEQ ID NO: 514888 - protein, 15 aa, Mycobacterium
KRTSRPIPVVVLSPK

SEQ ID NO: 514889 - protein, 6 aa, Mycobacterium
KRTSTA

SEQ ID NO: 514890 - protein, 13 aa, Mycobacterium
KRTTKSPQVGQQQ

SEQ ID NO: 514891 - protein, 15 aa, Mycobacterium
KRTTRQIPVIVLTPV

SEQ ID NO: 514892 - protein, 9 aa, Mycobacterium
KRTTSYPAS

SEQ ID NO: 514893 - protein, 4 aa, Mycobacterium
KRTV

SEQ ID NO: 514894 - protein, 6 aa, Mycobacterium
KRTVER

SEQ ID NO: 514895 - protein, 6 aa, Mycobacterium
KRVDAQ

SEQ ID NO: 514896 - protein, 6 aa, Mycobacterium
KRVDTA

SEQ ID NO: 514897 - protein, 10 aa, Mycobacterium
KRVENEQRRE

SEQ ID NO: 514898 - protein, 8 aa, Mycobacterium
KRVGSPEL

SEQ ID NO: 514899 - protein, 5 aa, Mycobacterium
KRVHT

SEQ ID NO: 514900 - protein, 9 aa, Mycobacterium
KRVKRSPHA

SEQ ID NO: 514901 - protein, 13 aa, Mycobacterium
KRVPDTAFASPPS

SEQ ID NO: 514902 - protein, 10 aa, Mycobacterium
KRVPDYPKGV

SEQ ID NO: 514903 - protein, 11 aa, Mycobacterium
KRVPGDVPSDA

SEQ ID NO: 514904 - protein, 6 aa, Mycobacterium
KRVPGS

SEQ ID NO: 514905 - protein, 7 aa, Mycobacterium
KRVPPGS

SEQ ID NO: 514906 - protein, 7 aa, Mycobacterium
KRVPRKS

SEQ ID NO: 514907 - protein, 4 aa, Mycobacterium
KRVR

SEQ ID NO: 514908 - protein, 11 aa, Mycobacterium
KRVSDDEMAGH

SEQ ID NO: 514909 - protein, 5 aa, Mycobacterium
KRVSY

SEQ ID NO: 514910 - protein, 7 aa, Mycobacterium
KRWETGD

SEQ ID NO: 514911 - protein, 9 aa, Mycobacterium
KRWPEERTT

SEQ ID NO: 514912 - protein, 5 aa, Mycobacterium
KRWPP

SEQ ID NO: 514913 - protein, 6 aa, Mycobacterium
KRWSGA

SEQ ID NO: 514914 - protein, 18 aa, Mycobacterium
KRWSPQWSDEQREKGYAG

SEQ ID NO: 514915 - protein, 10 aa, Mycobacterium
KRYAATENKI

SEQ ID NO: 514916 - protein, 11 aa, Mycobacterium
KRYDAKGPAAV

SEQ ID NO: 514917 - protein, 8 aa, Mycobacterium
KRYDHQAP

SEQ ID NO: 514918 - protein, 10 aa, Mycobacterium
KRYDNTQYRH

SEQ ID NO: 514919 - protein, 6 aa, Mycobacterium
KRYEEA

SEQ ID NO: 514920 - protein, 7 aa, Mycobacterium
KRYGDAA

SEQ ID NO: 514921 - protein, 12 aa, Mycobacterium
KRYGKRNKAAAD

SEQ ID NO: 514922 - protein, 11 aa, Mycobacterium
KRYGNAQYQRA

SEQ ID NO: 514923 - protein, 7 aa, Mycobacterium
KRYGTDF

SEQ ID NO: 514924 - protein, 4 aa, Mycobacterium
KRYI

SEQ ID NO: 514925 - protein, 9 aa, Mycobacterium
KRYKTAELD

SEQ ID NO: 514926 - protein, 5 aa, Mycobacterium
KRYPS

SEQ ID NO: 514927 - protein, 15 aa, Mycobacterium
KRYSGKRDLAQPYGA

SEQ ID NO: 514928 - protein, 7 aa, Mycobacterium
KRYSRDT

SEQ ID NO: 514929 - protein, 12 aa, Mycobacterium
KRYTGERDLENP

SEQ ID NO: 514930 - protein, 4 aa, Mycobacterium
KSAA

SEQ ID NO: 514931 - protein, 36 aa, Mycobacterium
KSAAAAEAEAAAASTSSSSRSDDSASQGGSLANDEQ

SEQ ID NO: 514932 - protein, 17 aa, Mycobacterium
KSAAAARQARATAALDA

SEQ ID NO: 514933 - protein, 25 aa, Mycobacterium
KSAAEGVAKAAEAALPAVSGAGLGS

SEQ ID NO: 514934 - protein, 13 aa, Mycobacterium
KSAAEKAGRDPAS

SEQ ID NO: 514935 - protein, 20 aa, Mycobacterium
KSAAEPDSSVSTHDARHASS

SEQ ID NO: 514936 - protein, 10 aa, Mycobacterium
KSAAETTGGL

SEQ ID NO: 514937 - protein, 7 aa, Mycobacterium
KSAAGVT

SEQ ID NO: 514938 - protein, 7 aa, Mycobacterium
KSAALQA

SEQ ID NO: 514939 - protein, 6 aa, Mycobacterium
KSAAMG

SEQ ID NO: 514940 - protein, 22 aa, Mycobacterium
KSAAQQQERVRHEGSADYETPV

SEQ ID NO: 514941 - protein, 12 aa, Mycobacterium
KSAAQQQQRVRR

SEQ ID NO: 514942 - protein, 9 aa, Mycobacterium
KSAARRRSQ

SEQ ID NO: 514943 - protein, 14 aa, Mycobacterium
KSAATMPGTPDQPA

SEQ ID NO: 514944 - protein, 10 aa, Mycobacterium
KSAATNEADP

SEQ ID NO: 514945 - protein, 4 aa, Mycobacterium
KSAD

SEQ ID NO: 514946 - protein, 6 aa, Mycobacterium
KSADAG

SEQ ID NO: 514947 - protein, 6 aa, Mycobacterium
KSADAS

SEQ ID NO: 514948 - protein, 6 aa, Mycobacterium
KSADEI

SEQ ID NO: 514949 - protein, 13 aa, Mycobacterium
KSADPDKQVDAHY

SEQ ID NO: 514950 - protein, 9 aa, Mycobacterium
KSADPETKS

SEQ ID NO: 514951 - protein, 6 aa, Mycobacterium
KSAEKQ

SEQ ID NO: 514952 - protein, 10 aa, Mycobacterium
KSAEPDADAT

SEQ ID NO: 514953 - protein, 9 aa, Mycobacterium
KSAEPTLRD

SEQ ID NO: 514954 - protein, 5 aa, Mycobacterium
KSAEY

SEQ ID NO: 514955 - protein, 8 aa, Mycobacterium
KSAFDDGE

SEQ ID NO: 514956 - protein, 7 aa, Mycobacterium
KSAFDGP

SEQ ID NO: 514957 - protein, 4 aa, Mycobacterium
KSAG

SEQ ID NO: 514958 - protein, 7 aa, Mycobacterium
KSAGAIK

SEQ ID NO: 514959 - protein, 23 aa, Mycobacterium
KSAGDRPVLTPRAQTRWRSTTSG

SEQ ID NO: 514960 - protein, 15 aa, Mycobacterium
KSAGEVCSGESGDRA

SEQ ID NO: 514961 - protein, 6 aa, Mycobacterium
KSAGGL

SEQ ID NO: 514962 - protein, 9 aa, Mycobacterium
KSAGIDPAY

SEQ ID NO: 514963 - protein, 6 aa, Mycobacterium
KSAGRK

SEQ ID NO: 514964 - protein, 5 aa, Mycobacterium
KSAIT

SEQ ID NO: 514965 - protein, 4 aa, Mycobacterium
KSAK

SEQ ID NO: 514966 - protein, 9 aa, Mycobacterium
KSALDSDDF

SEQ ID NO: 514967 - protein, 6 aa, Mycobacterium
KSALES

SEQ ID NO: 514968 - protein, 6 aa, Mycobacterium
KSALGA

SEQ ID NO: 514969 - protein, 5 aa, Mycobacterium
KSALP

SEQ ID NO: 514970 - protein, 7 aa, Mycobacterium
KSALPFR

SEQ ID NO: 514971 - protein, 5 aa, Mycobacterium
KSAPF

SEQ ID NO: 514972 - protein, 9 aa, Mycobacterium
KSAPTVTGL

SEQ ID NO: 514973 - protein, 11 aa, Mycobacterium
KSARAKYDESQ

SEQ ID NO: 514974 - protein, 8 aa, Mycobacterium
KSARLDNS

SEQ ID NO: 514975 - protein, 8 aa, Mycobacterium
KSARPAAG

SEQ ID NO: 514976 - protein, 4 aa, Mycobacterium
KSAS

SEQ ID NO: 514977 - protein, 11 aa, Mycobacterium
KSASEEDRQRI

SEQ ID NO: 514978 - protein, 13 aa, Mycobacterium
KSASETRGSDKKE

SEQ ID NO: 514979 - protein, 6 aa, Mycobacterium
KSASNR

SEQ ID NO: 514980 - protein, 8 aa, Mycobacterium
KSASPQKR

SEQ ID NO: 514981 - protein, 8 aa, Mycobacterium
KSATGVQI

SEQ ID NO: 514982 - protein, 18 aa, Mycobacterium
KSAVEAGAKLTAAGERKG

SEQ ID NO: 514983 - protein, 7 aa, Mycobacterium
KSAVMGG

SEQ ID NO: 514984 - protein, 6 aa, Mycobacterium
KSAWDY

SEQ ID NO: 514985 - protein, 8 aa, Mycobacterium
KSAYSGPI

SEQ ID NO: 514986 - protein, 6 aa, Mycobacterium
KSCAAE

SEQ ID NO: 514987 - protein, 6 aa, Mycobacterium
KSCAAQ

SEQ ID NO: 514988 - protein, 7 aa, Mycobacterium
KSCAPAG

SEQ ID NO: 514989 - protein, 6 aa, Mycobacterium
KSCTQE

SEQ ID NO: 514990 - protein, 7 aa, Mycobacterium
KSDAGKQ

SEQ ID NO: 514991 - protein, 9 aa, Mycobacterium
KSDAGNRTY

SEQ ID NO: 514992 - protein, 10 aa, Mycobacterium
KSDANTTPVL

SEQ ID NO: 514993 - protein, 14 aa, Mycobacterium
KSDASAPNARPVAS

SEQ ID NO: 514994 - protein, 8 aa, Mycobacterium
KSDAVDDE

SEQ ID NO: 514995 - protein, 10 aa, Mycobacterium
KSDDDARARL

SEQ ID NO: 514996 - protein, 9 aa, Mycobacterium
KSDDEARAR

SEQ ID NO: 514997 - protein, 9 aa, Mycobacterium
KSDDERGGN

SEQ ID NO: 514998 - protein, 8 aa, Mycobacterium
KSDDVLQR

SEQ ID NO: 514999 - protein, 4 aa, Mycobacterium
KSDE

SEQ ID NO: 515000 - protein, 15 aa, Mycobacterium
KSDEATTASSGGPRY

SEQ ID NO: 515001 - protein, 9 aa, Mycobacterium
KSDEEARRR

SEQ ID NO: 515002 - protein, 6 aa, Mycobacterium
KSDEGR

SEQ ID NO: 515003 - protein, 7 aa, Mycobacterium
KSDEGRA

SEQ ID NO: 515004 - protein, 7 aa, Mycobacterium
KSDEMAS

SEQ ID NO: 515005 - protein, 4 aa, Mycobacterium
KSDG

SEQ ID NO: 515006 - protein, 8 aa, Mycobacterium
KSDGLSEM

SEQ ID NO: 515007 - protein, 8 aa, Mycobacterium
KSDGQNWA

SEQ ID NO: 515008 - protein, 8 aa, Mycobacterium
KSDGTPLT

SEQ ID NO: 515009 - protein, 5 aa, Mycobacterium
KSDGY

SEQ ID NO: 515010 - protein, 8 aa, Mycobacterium
KSDHGGPF

SEQ ID NO: 515011 - protein, 4 aa, Mycobacterium
KSDL

SEQ ID NO: 515012 - protein, 5 aa, Mycobacterium
KSDLA

SEQ ID NO: 515013 - protein, 5 aa, Mycobacterium
KSDLE

SEQ ID NO: 515014 - protein, 14 aa, Mycobacterium
KSDLERQESKEKTG

SEQ ID NO: 515015 - protein, 9 aa, Mycobacterium
KSDLTQRYG

SEQ ID NO: 515016 - protein, 8 aa, Mycobacterium
KSDMEKPV

SEQ ID NO: 515017 - protein, 8 aa, Mycobacterium
KSDMSTLT

SEQ ID NO: 515018 - protein, 10 aa, Mycobacterium
KSDNVPRTVQ

SEQ ID NO: 515019 - protein, 6 aa, Mycobacterium
KSDPDL

SEQ ID NO: 515020 - protein, 7 aa, Mycobacterium
KSDPDLS

SEQ ID NO: 515021 - protein, 9 aa, Mycobacterium
KSDPDSRRN

SEQ ID NO: 515022 - protein, 5 aa, Mycobacterium
KSDPE

SEQ ID NO: 515023 - protein, 6 aa, Mycobacterium
KSDPEL

SEQ ID NO: 515024 - protein, 14 aa, Mycobacterium
KSDPVDDARRGGDE

SEQ ID NO: 515025 - protein, 7 aa, Mycobacterium
KSDPVLA

SEQ ID NO: 515026 - protein, 25 aa, Mycobacterium
KSDPYKGKGIRYEGEQIRRKVGKTG

SEQ ID NO: 515027 - protein, 5 aa, Mycobacterium
KSDQL

SEQ ID NO: 515028 - protein, 7 aa, Mycobacterium
KSDQRTA

SEQ ID NO: 515029 - protein, 8 aa, Mycobacterium
KSDRDGVL

SEQ ID NO: 515030 - protein, 8 aa, Mycobacterium
KSDRRELA

SEQ ID NO: 515031 - protein, 8 aa, Mycobacterium
KSDRSWRE

SEQ ID NO: 515032 - protein, 5 aa, Mycobacterium
KSDSE

SEQ ID NO: 515033 - protein, 8 aa, Mycobacterium
KSDSGQAA

SEQ ID NO: 515034 - protein, 9 aa, Mycobacterium
KSDTEARAR

SEQ ID NO: 515035 - protein, 8 aa, Mycobacterium
KSDTSSYC

SEQ ID NO: 515036 - protein, 8 aa, Mycobacterium
KSDYPDGV

SEQ ID NO: 515037 - protein, 7 aa, Mycobacterium
KSEAAQR

SEQ ID NO: 515038 - protein, 14 aa, Mycobacterium
KSEADANVRARSGL

SEQ ID NO: 515039 - protein, 32 aa, Mycobacterium
KSEADMPHPDATKPPAEPRAPTPGLPGPRAGE

SEQ ID NO: 515040 - protein, 10 aa, Mycobacterium
KSEAEPMPVP

SEQ ID NO: 515041 - protein, 7 aa, Mycobacterium
KSEAGEI

SEQ ID NO: 515042 - protein, 8 aa, Mycobacterium
KSEAGNRT

SEQ ID NO: 515043 - protein, 12 aa, Mycobacterium
KSEAKTATAENI

SEQ ID NO: 515044 - protein, 15 aa, Mycobacterium
KSEARPDLGSGEGAK

SEQ ID NO: 515045 - protein, 5 aa, Mycobacterium
KSEDV

SEQ ID NO: 515046 - protein, 15 aa, Mycobacterium
KSEERRLSRRPDVRA

SEQ ID NO: 515047 - protein, 4 aa, Mycobacterium
KSEF

SEQ ID NO: 515048 - protein, 21 aa, Mycobacterium
KSEGAKVVTGGERAELGGDLN

SEQ ID NO: 515049 - protein, 23 aa, Mycobacterium
KSEGARIVTGGERADLGGDLSGG

SEQ ID NO: 515050 - protein, 6 aa, Mycobacterium
KSEIAD

SEQ ID NO: 515051 - protein, 13 aa, Mycobacterium
KSELGLTKGRAET

SEQ ID NO: 515052 - protein, 19 aa, Mycobacterium
KSELPSTLKKSDAKAQRTF

SEQ ID NO: 515053 - protein, 36 aa, Mycobacterium
KSELPSTLQKSDEKAQRTFTKTHDAAAEQYGEGERA

SEQ ID NO: 515054 - protein, 19 aa, Mycobacterium
KSELPSTLQRSNAKAQRTF

SEQ ID NO: 515055 - protein, 20 aa, Mycobacterium
KSELPSTLRRSDAKAQRTFA

SEQ ID NO: 515056 - protein, 9 aa, Mycobacterium
KSELSPEEQ

SEQ ID NO: 515057 - protein, 4 aa, Mycobacterium
KSEP

SEQ ID NO: 515058 - protein, 7 aa, Mycobacterium
KSEPMGL

SEQ ID NO: 515059 - protein, 10 aa, Mycobacterium
KSEQYRDSGY

SEQ ID NO: 515060 - protein, 6 aa, Mycobacterium
KSERGF

SEQ ID NO: 515061 - protein, 8 aa, Mycobacterium
KSERPYGS

SEQ ID NO: 515062 - protein, 6 aa, Mycobacterium
KSERVT

SEQ ID NO: 515063 - protein, 23 aa, Mycobacterium
KSERVTAAAARRARSGRPSGDLG

SEQ ID NO: 515064 - protein, 12 aa, Mycobacterium
KSESAQARANRI

SEQ ID NO: 515065 - protein, 10 aa, Mycobacterium
KSESGGPVPS

SEQ ID NO: 515066 - protein, 7 aa, Mycobacterium
KSETGRE

SEQ ID NO: 515067 - protein, 6 aa, Mycobacterium
KSETKL

SEQ ID NO: 515068 - protein, 6 aa, Mycobacterium
KSEVSE

SEQ ID NO: 515069 - protein, 14 aa, Mycobacterium
KSFAAGDSDLQPLN

SEQ ID NO: 515070 - protein, 19 aa, Mycobacterium
KSFAPRGRTGGREWLTAIT

SEQ ID NO: 515071 - protein, 9 aa, Mycobacterium
KSFDSGDPG

SEQ ID NO: 515072 - protein, 12 aa, Mycobacterium
KSFEGKTTRTTI

SEQ ID NO: 515073 - protein, 5 aa, Mycobacterium
KSFGG

SEQ ID NO: 515074 - protein, 6 aa, Mycobacterium
KSFGKG

SEQ ID NO: 515075 - protein, 20 aa, Mycobacterium
KSFPAPTDLPKISSRPASPL

SEQ ID NO: 515076 - protein, 13 aa, Mycobacterium
KSFPGSTPANDYP

SEQ ID NO: 515077 - protein, 18 aa, Mycobacterium
KSFPQPDDLGAPPGSPVV

SEQ ID NO: 515078 - protein, 17 aa, Mycobacterium
KSFSSDADGYARSEGGG

SEQ ID NO: 515079 - protein, 4 aa, Mycobacterium
KSGA

SEQ ID NO: 515080 - protein, 6 aa, Mycobacterium
KSGAAK

SEQ ID NO: 515081 - protein, 7 aa, Mycobacterium
KSGADAI

SEQ ID NO: 515082 - protein, 7 aa, Mycobacterium
KSGADAV

SEQ ID NO: 515083 - protein, 10 aa, Mycobacterium
KSGADDTREA

SEQ ID NO: 515084 - protein, 10 aa, Mycobacterium
KSGADEAAAP

SEQ ID NO: 515085 - protein, 5 aa, Mycobacterium
KSGAL

SEQ ID NO: 515086 - protein, 14 aa, Mycobacterium
KSGALGKPKSEEVE

SEQ ID NO: 515087 - protein, 8 aa, Mycobacterium
KSGANASV

SEQ ID NO: 515088 - protein, 8 aa, Mycobacterium
KSGANPPI

SEQ ID NO: 515089 - protein, 8 aa, Mycobacterium
KSGAPGVE

SEQ ID NO: 515090 - protein, 10 aa, Mycobacterium
KSGAPLPPEV

SEQ ID NO: 515091 - protein, 8 aa, Mycobacterium
KSGAPSFV

SEQ ID NO: 515092 - protein, 9 aa, Mycobacterium
KSGAREVTA

SEQ ID NO: 515093 - protein, 10 aa, Mycobacterium
KSGASAGGHA

SEQ ID NO: 515094 - protein, 11 aa, Mycobacterium
KSGASARSQAA

SEQ ID NO: 515095 - protein, 7 aa, Mycobacterium
KSGASIG

SEQ ID NO: 515096 - protein, 11 aa, Mycobacterium
KSGATDAKQLS

SEQ ID NO: 515097 - protein, 9 aa, Mycobacterium
KSGATGNMT

SEQ ID NO: 515098 - protein, 6 aa, Mycobacterium
KSGATT

SEQ ID NO: 515099 - protein, 6 aa, Mycobacterium
KSGAYT

SEQ ID NO: 515100 - protein, 7 aa, Mycobacterium
KSGDDAI

SEQ ID NO: 515101 - protein, 7 aa, Mycobacterium
KSGDDAV

SEQ ID NO: 515102 - protein, 7 aa, Mycobacterium
KSGDGIG

SEQ ID NO: 515103 - protein, 6 aa, Mycobacterium
KSGDGM

SEQ ID NO: 515104 - protein, 12 aa, Mycobacterium
KSGDPGDSGEEQ

SEQ ID NO: 515105 - protein, 5 aa, Mycobacterium
KSGDR

SEQ ID NO: 515106 - protein, 9 aa, Mycobacterium
KSGDRPTSM

SEQ ID NO: 515107 - protein, 16 aa, Mycobacterium
KSGEAAAEGVAGAAGM

SEQ ID NO: 515108 - protein, 7 aa, Mycobacterium
KSGEGAL

SEQ ID NO: 515109 - protein, 6 aa, Mycobacterium
KSGEGI

SEQ ID NO: 515110 - protein, 6 aa, Mycobacterium
KSGEIK

SEQ ID NO: 515111 - protein, 9 aa, Mycobacterium
KSGEPELST

SEQ ID NO: 515112 - protein, 9 aa, Mycobacterium
KSGEPGEST

SEQ ID NO: 515113 - protein, 6 aa, Mycobacterium
KSGEQL

SEQ ID NO: 515114 - protein, 5 aa, Mycobacterium
KSGET

SEQ ID NO: 515115 - protein, 4 aa, Mycobacterium
KSGF

SEQ ID NO: 515116 - protein, 13 aa, Mycobacterium
KSGFRAAGNKRRH

SEQ ID NO: 515117 - protein, 16 aa, Mycobacterium
KSGFVSDDDAAELSRR

SEQ ID NO: 515118 - protein, 10 aa, Mycobacterium
KSGGADGNRD

SEQ ID NO: 515119 - protein, 7 aa, Mycobacterium
KSGGADV

SEQ ID NO: 515120 - protein, 12 aa, Mycobacterium
KSGGAGVSGREQ

SEQ ID NO: 515121 - protein, 8 aa, Mycobacterium
KSGGAMNA

SEQ ID NO: 515122 - protein, 10 aa, Mycobacterium
KSGGAPEVEL

SEQ ID NO: 515123 - protein, 7 aa, Mycobacterium
KSGGDAI

SEQ ID NO: 515124 - protein, 8 aa, Mycobacterium
KSGGDGAY

SEQ ID NO: 515125 - protein, 6 aa, Mycobacterium
KSGGDV

SEQ ID NO: 515126 - protein, 9 aa, Mycobacterium
KSGGENVYP

SEQ ID NO: 515127 - protein, 6 aa, Mycobacterium
KSGGHL

SEQ ID NO: 515128 - protein, 6 aa, Mycobacterium
KSGGPL

SEQ ID NO: 515129 - protein, 78 aa, Mycobacterium
KSGGQTADGEHNTGGNGGNGGDGSEPGPGGNGAGGAGGNGGTGGTTAGGSGNGGNGGNGGNGGADGTPGTAGTTGANN

SEQ ID NO: 515130 - protein, 7 aa, Mycobacterium
KSGGVTI

SEQ ID NO: 515131 - protein, 14 aa, Mycobacterium
KSGHGEFAAPPIKP

SEQ ID NO: 515132 - protein, 4 aa, Mycobacterium
KSGI

SEQ ID NO: 515133 - protein, 12 aa, Mycobacterium
KSGIGREFGPEG

SEQ ID NO: 515134 - protein, 16 aa, Mycobacterium
KSGITDLRTPRQATQT

SEQ ID NO: 515135 - protein, 5 aa, Mycobacterium
KSGKI

SEQ ID NO: 515136 - protein, 8 aa, Mycobacterium
KSGKLRDL

SEQ ID NO: 515137 - protein, 9 aa, Mycobacterium
KSGKLRDLR

SEQ ID NO: 515138 - protein, 7 aa, Mycobacterium
KSGKTTI

SEQ ID NO: 515139 - protein, 4 aa, Mycobacterium
KSGL

SEQ ID NO: 515140 - protein, 11 aa, Mycobacterium
KSGLAKPRDGR

SEQ ID NO: 515141 - protein, 11 aa, Mycobacterium
KSGLARQKDHS

SEQ ID NO: 515142 - protein, 7 aa, Mycobacterium
KSGLGAL

SEQ ID NO: 515143 - protein, 6 aa, Mycobacterium
KSGLPD

SEQ ID NO: 515144 - protein, 17 aa, Mycobacterium
KSGLPSRAEVSDAAMGA

SEQ ID NO: 515145 - protein, 8 aa, Mycobacterium
KSGLTKEV

SEQ ID NO: 515146 - protein, 6 aa, Mycobacterium
KSGNAA

SEQ ID NO: 515147 - protein, 7 aa, Mycobacterium
KSGNCEV

SEQ ID NO: 515148 - protein, 11 aa, Mycobacterium
KSGNGSARVGD

SEQ ID NO: 515149 - protein, 10 aa, Mycobacterium
KSGNPAERAA

SEQ ID NO: 515150 - protein, 7 aa, Mycobacterium
KSGNWDK

SEQ ID NO: 515151 - protein, 16 aa, Mycobacterium
KSGPGPTTPPHPPVHD

SEQ ID NO: 515152 - protein, 8 aa, Mycobacterium
KSGPHPER

SEQ ID NO: 515153 - protein, 8 aa, Mycobacterium
KSGQAEGA

SEQ ID NO: 515154 - protein, 21 aa, Mycobacterium
KSGQGTDIPLGTPVAGRTAPE

SEQ ID NO: 515155 - protein, 10 aa, Mycobacterium
KSGQHTGRTE

SEQ ID NO: 515156 - protein, 7 aa, Mycobacterium
KSGQTRC

SEQ ID NO: 515157 - protein, 5 aa, Mycobacterium
KSGQV

SEQ ID NO: 515158 - protein, 7 aa, Mycobacterium
KSGRAYD

SEQ ID NO: 515159 - protein, 5 aa, Mycobacterium
KSGRY

SEQ ID NO: 515160 - protein, 11 aa, Mycobacterium
KSGSANPSPKL

SEQ ID NO: 515161 - protein, 6 aa, Mycobacterium
KSGSDV

SEQ ID NO: 515162 - protein, 6 aa, Mycobacterium
KSGSDY

SEQ ID NO: 515163 - protein, 11 aa, Mycobacterium
KSGSEEDETAW

SEQ ID NO: 515164 - protein, 6 aa, Mycobacterium
KSGSEY

SEQ ID NO: 515165 - protein, 8 aa, Mycobacterium
KSGSGQSL

SEQ ID NO: 515166 - protein, 5 aa, Mycobacterium
KSGSL

SEQ ID NO: 515167 - protein, 8 aa, Mycobacterium
KSGSQRKL

SEQ ID NO: 515168 - protein, 8 aa, Mycobacterium
KSGSQTEL

SEQ ID NO: 515169 - protein, 8 aa, Mycobacterium
KSGSRAPW

SEQ ID NO: 515170 - protein, 8 aa, Mycobacterium
KSGSTRCQ

SEQ ID NO: 515171 - protein, 8 aa, Mycobacterium
KSGSWDKD

SEQ ID NO: 515172 - protein, 8 aa, Mycobacterium
KSGTEVKA

SEQ ID NO: 515173 - protein, 6 aa, Mycobacterium
KSGTLD

SEQ ID NO: 515174 - protein, 4 aa, Mycobacterium
KSGV

SEQ ID NO: 515175 - protein, 6 aa, Mycobacterium
KSGVAF

SEQ ID NO: 515176 - protein, 13 aa, Mycobacterium
KSGVEPDSGEKQS

SEQ ID NO: 515177 - protein, 7 aa, Mycobacterium
KSGVGTR

SEQ ID NO: 515178 - protein, 7 aa, Mycobacterium
KSGVHGP

SEQ ID NO: 515179 - protein, 11 aa, Mycobacterium
KSGVTGPTGTL

SEQ ID NO: 515180 - protein, 11 aa, Mycobacterium
KSGYGREKGYE

SEQ ID NO: 515181 - protein, 14 aa, Mycobacterium
KSGYGSYLLQLLQR

SEQ ID NO: 515182 - protein, 8 aa, Mycobacterium
KSGYRPVA

SEQ ID NO: 515183 - protein, 16 aa, Mycobacterium
KSHDAAADQYGSEERA

SEQ ID NO: 515184 - protein, 7 aa, Mycobacterium
KSHEGFD

SEQ ID NO: 515185 - protein, 10 aa, Mycobacterium
KSHGASTPVA

SEQ ID NO: 515186 - protein, 9 aa, Mycobacterium
KSHGQSQAG

SEQ ID NO: 515187 - protein, 24 aa, Mycobacterium
KSHGTTVRGTVEGKITSDTEAAGR

SEQ ID NO: 515188 - protein, 4 aa, Mycobacterium
KSHH

SEQ ID NO: 515189 - protein, 12 aa, Mycobacterium
KSHPADDGGKGL

SEQ ID NO: 515190 - protein, 11 aa, Mycobacterium
KSHPADEGGKA

SEQ ID NO: 515191 - protein, 7 aa, Mycobacterium
KSHPTGD

SEQ ID NO: 515192 - protein, 6 aa, Mycobacterium
KSHQQL

SEQ ID NO: 515193 - protein, 6 aa, Mycobacterium
KSHRSH

SEQ ID NO: 515194 - protein, 12 aa, Mycobacterium
KSHRTSDPGNDL

SEQ ID NO: 515195 - protein, 11 aa, Mycobacterium
KSHSKTYSTRA

SEQ ID NO: 515196 - protein, 6 aa, Mycobacterium
KSHSVT

SEQ ID NO: 515197 - protein, 7 aa, Mycobacterium
KSIADGA

SEQ ID NO: 515198 - protein, 6 aa, Mycobacterium
KSIATT

SEQ ID NO: 515199 - protein, 4 aa, Mycobacterium
KSID

SEQ ID NO: 515200 - protein, 12 aa, Mycobacterium
KSIDPSEDPDRR

SEQ ID NO: 515201 - protein, 13 aa, Mycobacterium
KSIDQGLRQRSQA

SEQ ID NO: 515202 - protein, 8 aa, Mycobacterium
KSIDVDAA

SEQ ID NO: 515203 - protein, 10 aa, Mycobacterium
KSIGGKARQQ

SEQ ID NO: 515204 - protein, 5 aa, Mycobacterium
KSIGM

SEQ ID NO: 515205 - protein, 5 aa, Mycobacterium
KSINT

SEQ ID NO: 515206 - protein, 5 aa, Mycobacterium
KSIPL

SEQ ID NO: 515207 - protein, 8 aa, Mycobacterium
KSIPVSPQ

SEQ ID NO: 515208 - protein, 7 aa, Mycobacterium
KSIQAAA

SEQ ID NO: 515209 - protein, 4 aa, Mycobacterium
KSIR

SEQ ID NO: 515210 - protein, 6 aa, Mycobacterium
KSIRST

SEQ ID NO: 515211 - protein, 6 aa, Mycobacterium
KSISRN

SEQ ID NO: 515212 - protein, 7 aa, Mycobacterium
KSISTEA

SEQ ID NO: 515213 - protein, 16 aa, Mycobacterium
KSITGVKNQDIGGTLT

SEQ ID NO: 515214 - protein, 14 aa, Mycobacterium
KSITMGRAGEYSSV

SEQ ID NO: 515215 - protein, 6 aa, Mycobacterium
KSKAAH

SEQ ID NO: 515216 - protein, 8 aa, Mycobacterium
KSKAALAA

SEQ ID NO: 515217 - protein, 9 aa, Mycobacterium
KSKADIDTT

SEQ ID NO: 515218 - protein, 8 aa, Mycobacterium
KSKAGDTV

SEQ ID NO: 515219 - protein, 8 aa, Mycobacterium
KSKAGETV

SEQ ID NO: 515220 - protein, 7 aa, Mycobacterium
KSKCPPN

SEQ ID NO: 515221 - protein, 10 aa, Mycobacterium
KSKGEGGNGS

SEQ ID NO: 515222 - protein, 7 aa, Mycobacterium
KSKGRAA

SEQ ID NO: 515223 - protein, 9 aa, Mycobacterium
KSKKSRRTV

SEQ ID NO: 515224 - protein, 5 aa, Mycobacterium
KSKLG

SEQ ID NO: 515225 - protein, 13 aa, Mycobacterium
KSKMDAAGHYSRP

SEQ ID NO: 515226 - protein, 8 aa, Mycobacterium
KSKNASAA

SEQ ID NO: 515227 - protein, 9 aa, Mycobacterium
KSKNASAAY

SEQ ID NO: 515228 - protein, 7 aa, Mycobacterium
KSKPYTL

SEQ ID NO: 515229 - protein, 7 aa, Mycobacterium
KSKRVTK

SEQ ID NO: 515230 - protein, 7 aa, Mycobacterium
KSKSLTL

SEQ ID NO: 515231 - protein, 9 aa, Mycobacterium
KSKTPGHPE

SEQ ID NO: 515232 - protein, 10 aa, Mycobacterium
KSKTQTAENI

SEQ ID NO: 515233 - protein, 7 aa, Mycobacterium
KSKTTFR

SEQ ID NO: 515234 - protein, 10 aa, Mycobacterium
KSKVTSEGEK

SEQ ID NO: 515235 - protein, 8 aa, Mycobacterium
KSKYKSGE

SEQ ID NO: 515236 - protein, 6 aa, Mycobacterium
KSLAAS

SEQ ID NO: 515237 - protein, 9 aa, Mycobacterium
KSLARDGEM

SEQ ID NO: 515238 - protein, 8 aa, Mycobacterium
KSLDENQR

SEQ ID NO: 515239 - protein, 7 aa, Mycobacterium
KSLGAQS

SEQ ID NO: 515240 - protein, 7 aa, Mycobacterium
KSLGRPL

SEQ ID NO: 515241 - protein, 6 aa, Mycobacterium
KSLGTA

SEQ ID NO: 515242 - protein, 11 aa, Mycobacterium
KSLKNSVSPDE

SEQ ID NO: 515243 - protein, 5 aa, Mycobacterium
KSLLP

SEQ ID NO: 515244 - protein, 10 aa, Mycobacterium
KSLPLTTSVS

SEQ ID NO: 515245 - protein, 6 aa, Mycobacterium
KSLPRS

SEQ ID NO: 515246 - protein, 7 aa, Mycobacterium
KSLQDGS

SEQ ID NO: 515247 - protein, 4 aa, Mycobacterium
KSLR

SEQ ID NO: 515248 - protein, 5 aa, Mycobacterium
KSLRD

SEQ ID NO: 515249 - protein, 7 aa, Mycobacterium
KSLREGH

SEQ ID NO: 515250 - protein, 10 aa, Mycobacterium
KSLREGQASL

SEQ ID NO: 515251 - protein, 11 aa, Mycobacterium
KSLRQGADSTT

SEQ ID NO: 515252 - protein, 7 aa, Mycobacterium
KSLRTRA

SEQ ID NO: 515253 - protein, 9 aa, Mycobacterium
KSLSAGEKD

SEQ ID NO: 515254 - protein, 5 aa, Mycobacterium
KSLSD

SEQ ID NO: 515255 - protein, 9 aa, Mycobacterium
KSLSGATMR

SEQ ID NO: 515256 - protein, 13 aa, Mycobacterium
KSLTARRNERSSD

SEQ ID NO: 515257 - protein, 22 aa, Mycobacterium
KSLTEEDAAAIQATELGSATKD

SEQ ID NO: 515258 - protein, 7 aa, Mycobacterium
KSLTGGW

SEQ ID NO: 515259 - protein, 8 aa, Mycobacterium
KSLTLDPQ

SEQ ID NO: 515260 - protein, 12 aa, Mycobacterium
KSMAESPYNPVA

SEQ ID NO: 515261 - protein, 10 aa, Mycobacterium
KSMEADLGQS

SEQ ID NO: 515262 - protein, 11 aa, Mycobacterium
KSMRDQAVPGH

SEQ ID NO: 515263 - protein, 10 aa, Mycobacterium
KSNAGHAQAA

SEQ ID NO: 515264 - protein, 11 aa, Mycobacterium
KSNAGHSQAAS

SEQ ID NO: 515265 - protein, 5 aa, Mycobacterium
KSNEY

SEQ ID NO: 515266 - protein, 8 aa, Mycobacterium
KSNGLSTS

SEQ ID NO: 515267 - protein, 5 aa, Mycobacterium
KSNGY

SEQ ID NO: 515268 - protein, 5 aa, Mycobacterium
KSNNF

SEQ ID NO: 515269 - protein, 9 aa, Mycobacterium
KSNNYPRSV

SEQ ID NO: 515270 - protein, 7 aa, Mycobacterium
KSNPTEF

SEQ ID NO: 515271 - protein, 6 aa, Mycobacterium
KSNRVV

SEQ ID NO: 515272 - protein, 6 aa, Mycobacterium
KSNTEV

SEQ ID NO: 515273 - protein, 7 aa, Mycobacterium
KSNTGHT

SEQ ID NO: 515274 - protein, 20 aa, Mycobacterium
KSPAAKAARERAQLEGKAAV

SEQ ID NO: 515275 - protein, 8 aa, Mycobacterium
KSPAASGL

SEQ ID NO: 515276 - protein, 7 aa, Mycobacterium
KSPADQV

SEQ ID NO: 515277 - protein, 7 aa, Mycobacterium
KSPAGHS

SEQ ID NO: 515278 - protein, 9 aa, Mycobacterium
KSPAPSSSD

SEQ ID NO: 515279 - protein, 24 aa, Mycobacterium
KSPDNGTAKGAAKTAAKTASKTGD

SEQ ID NO: 515280 - protein, 7 aa, Mycobacterium
KSPDSGN

SEQ ID NO: 515281 - protein, 8 aa, Mycobacterium
KSPEAPKI

SEQ ID NO: 515282 - protein, 10 aa, Mycobacterium
KSPEDAQRRE

SEQ ID NO: 515283 - protein, 6 aa, Mycobacterium
KSPESV

SEQ ID NO: 515284 - protein, 6 aa, Mycobacterium
KSPFSI

SEQ ID NO: 515285 - protein, 7 aa, Mycobacterium
KSPGDQV

SEQ ID NO: 515286 - protein, 7 aa, Mycobacterium
KSPGHDI

SEQ ID NO: 515287 - protein, 24 aa, Mycobacterium
KSPGHDQHVERSGRRPVDDVLEFR

SEQ ID NO: 515288 - protein, 6 aa, Mycobacterium
KSPGLK

SEQ ID NO: 515289 - protein, 6 aa, Mycobacterium
KSPGYF

SEQ ID NO: 515290 - protein, 15 aa, Mycobacterium
KSPHWTGASNSPRTY

SEQ ID NO: 515291 - protein, 4 aa, Mycobacterium
KSPI

SEQ ID NO: 515292 - protein, 6 aa, Mycobacterium
KSPIAE

SEQ ID NO: 515293 - protein, 6 aa, Mycobacterium
KSPIEN

SEQ ID NO: 515294 - protein, 8 aa, Mycobacterium
KSPLHDPD

SEQ ID NO: 515295 - protein, 8 aa, Mycobacterium
KSPPKGID

SEQ ID NO: 515296 - protein, 7 aa, Mycobacterium
KSPPTEG

SEQ ID NO: 515297 - protein, 10 aa, Mycobacterium
KSPSALRSQA

SEQ ID NO: 515298 - protein, 5 aa, Mycobacterium
KSPSF

SEQ ID NO: 515299 - protein, 9 aa, Mycobacterium
KSPSGKSDF

SEQ ID NO: 515300 - protein, 5 aa, Mycobacterium
KSPSV

SEQ ID NO: 515301 - protein, 6 aa, Mycobacterium
KSPSVQ

SEQ ID NO: 515302 - protein, 8 aa, Mycobacterium
KSPTAPYL

SEQ ID NO: 515303 - protein, 21 aa, Mycobacterium
KSPTDGSAKPSITRSRIPFRD

SEQ ID NO: 515304 - protein, 7 aa, Mycobacterium
KSPTKSC

SEQ ID NO: 515305 - protein, 14 aa, Mycobacterium
KSPTPLSGSQAAGG

SEQ ID NO: 515306 - protein, 7 aa, Mycobacterium
KSPTTSR

SEQ ID NO: 515307 - protein, 15 aa, Mycobacterium
KSPTWTEELTYEPVA

SEQ ID NO: 515308 - protein, 4 aa, Mycobacterium
KSPV

SEQ ID NO: 515309 - protein, 6 aa, Mycobacterium
KSPVDT

SEQ ID NO: 515310 - protein, 7 aa, Mycobacterium
KSPVHDP

SEQ ID NO: 515311 - protein, 5 aa, Mycobacterium
KSPYR

SEQ ID NO: 515312 - protein, 10 aa, Mycobacterium
KSQAVDRDTR

SEQ ID NO: 515313 - protein, 9 aa, Mycobacterium
KSQDPARYA

SEQ ID NO: 515314 - protein, 7 aa, Mycobacterium
KSQDYDD

SEQ ID NO: 515315 - protein, 6 aa, Mycobacterium
KSQGAE

SEQ ID NO: 515316 - protein, 5 aa, Mycobacterium
KSQGF

SEQ ID NO: 515317 - protein, 8 aa, Mycobacterium
KSQGSQAD

SEQ ID NO: 515318 - protein, 9 aa, Mycobacterium
KSQGSQADD

SEQ ID NO: 515319 - protein, 9 aa, Mycobacterium
KSQGSQANE

SEQ ID NO: 515320 - protein, 4 aa, Mycobacterium
KSQI

SEQ ID NO: 515321 - protein, 5 aa, Mycobacterium
KSQIG

SEQ ID NO: 515322 - protein, 5 aa, Mycobacterium
KSQNA

SEQ ID NO: 515323 - protein, 7 aa, Mycobacterium
KSQNQKG

SEQ ID NO: 515324 - protein, 4 aa, Mycobacterium
KSQP

SEQ ID NO: 515325 - protein, 10 aa, Mycobacterium
KSQPSYDGRP

SEQ ID NO: 515326 - protein, 10 aa, Mycobacterium
KSQRSAAKTV

SEQ ID NO: 515327 - protein, 16 aa, Mycobacterium
KSQSGAQSGSELEDRG

SEQ ID NO: 515328 - protein, 13 aa, Mycobacterium
KSQSKDGSQPNAA

SEQ ID NO: 515329 - protein, 6 aa, Mycobacterium
KSQTAA

SEQ ID NO: 515330 - protein, 14 aa, Mycobacterium
KSQTAAYGSLPTEG

SEQ ID NO: 515331 - protein, 8 aa, Mycobacterium
KSQVSWED

SEQ ID NO: 515332 - protein, 14 aa, Mycobacterium
KSRAAAADAASGAA

SEQ ID NO: 515333 - protein, 9 aa, Mycobacterium
KSRAAAAQA

SEQ ID NO: 515334 - protein, 20 aa, Mycobacterium
KSRADHTPSTEQEDTPAALT

SEQ ID NO: 515335 - protein, 8 aa, Mycobacterium
KSRAERRE

SEQ ID NO: 515336 - protein, 6 aa, Mycobacterium
KSRAEV

SEQ ID NO: 515337 - protein, 7 aa, Mycobacterium
KSRAGFK

SEQ ID NO: 515338 - protein, 11 aa, Mycobacterium
KSRARGNTPEE

SEQ ID NO: 515339 - protein, 15 aa, Mycobacterium
KSRARHDGGVTASPG

SEQ ID NO: 515340 - protein, 6 aa, Mycobacterium
KSRATF

SEQ ID NO: 515341 - protein, 7 aa, Mycobacterium
KSRDAEA

SEQ ID NO: 515342 - protein, 10 aa, Mycobacterium
KSRDDEDSYT

SEQ ID NO: 515343 - protein, 7 aa, Mycobacterium
KSREAEA

SEQ ID NO: 515344 - protein, 9 aa, Mycobacterium
KSREGYKYG

SEQ ID NO: 515345 - protein, 7 aa, Mycobacterium
KSREQIP

SEQ ID NO: 515346 - protein, 7 aa, Mycobacterium
KSRFTQG

SEQ ID NO: 515347 - protein, 6 aa, Mycobacterium
KSRGAK

SEQ ID NO: 515348 - protein, 11 aa, Mycobacterium
KSRGMGRNGPW

SEQ ID NO: 515349 - protein, 6 aa, Mycobacterium
KSRGTE

SEQ ID NO: 515350 - protein, 6 aa, Mycobacterium
KSRGVD

SEQ ID NO: 515351 - protein, 5 aa, Mycobacterium
KSRHQ

SEQ ID NO: 515352 - protein, 18 aa, Mycobacterium
KSRLDGAGYEGRRPDQPQ

SEQ ID NO: 515353 - protein, 13 aa, Mycobacterium
KSRLDNASSDQPE

SEQ ID NO: 515354 - protein, 13 aa, Mycobacterium
KSRLDNRRPDQPE

SEQ ID NO: 515355 - protein, 4 aa, Mycobacterium
KSRM

SEQ ID NO: 515356 - protein, 8 aa, Mycobacterium
KSRNDIEQ

SEQ ID NO: 515357 - protein, 8 aa, Mycobacterium
KSRNPGDD

SEQ ID NO: 515358 - protein, 6 aa, Mycobacterium
KSRNQK

SEQ ID NO: 515359 - protein, 10 aa, Mycobacterium
KSRPDLANTV

SEQ ID NO: 515360 - protein, 5 aa, Mycobacterium
KSRPY

SEQ ID NO: 515361 - protein, 7 aa, Mycobacterium
KSRQAEA

SEQ ID NO: 515362 - protein, 7 aa, Mycobacterium
KSRQPKS

SEQ ID NO: 515363 - protein, 5 aa, Mycobacterium
KSRQQ

SEQ ID NO: 515364 - protein, 8 aa, Mycobacterium
KSRQRPGS

SEQ ID NO: 515365 - protein, 7 aa, Mycobacterium
KSRREWE

SEQ ID NO: 515366 - protein, 6 aa, Mycobacterium
KSRRPV

SEQ ID NO: 515367 - protein, 6 aa, Mycobacterium
KSRSIP

SEQ ID NO: 515368 - protein, 5 aa, Mycobacterium
KSRSL

SEQ ID NO: 515369 - protein, 7 aa, Mycobacterium
KSRSNYA

SEQ ID NO: 515370 - protein, 7 aa, Mycobacterium
KSRSTWE

SEQ ID NO: 515371 - protein, 7 aa, Mycobacterium
KSRTGEV

SEQ ID NO: 515372 - protein, 17 aa, Mycobacterium
KSRTGTLATIGPDGQPH

SEQ ID NO: 515373 - protein, 11 aa, Mycobacterium
KSRTKETDLSI

SEQ ID NO: 515374 - protein, 7 aa, Mycobacterium
KSRTQAV

SEQ ID NO: 515375 - protein, 7 aa, Mycobacterium
KSRTRGY

SEQ ID NO: 515376 - protein, 14 aa, Mycobacterium
KSRVDIKRKPSEYV

SEQ ID NO: 515377 - protein, 9 aa, Mycobacterium
KSRYGDDPA

SEQ ID NO: 515378 - protein, 9 aa, Mycobacterium
KSRYGDDSG

SEQ ID NO: 515379 - protein, 7 aa, Mycobacterium
KSRYGQP

SEQ ID NO: 515380 - protein, 20 aa, Mycobacterium
KSRYLEPSGAGPLGSDTGFP

SEQ ID NO: 515381 - protein, 11 aa, Mycobacterium
KSSAADDQRRR

SEQ ID NO: 515382 - protein, 20 aa, Mycobacterium
KSSADSAAAATQHETAAAAY

SEQ ID NO: 515383 - protein, 6 aa, Mycobacterium
KSSAGI

SEQ ID NO: 515384 - protein, 6 aa, Mycobacterium
KSSAGV

SEQ ID NO: 515385 - protein, 10 aa, Mycobacterium
KSSAQSHDAE

SEQ ID NO: 515386 - protein, 8 aa, Mycobacterium
KSSARPAL

SEQ ID NO: 515387 - protein, 8 aa, Mycobacterium
KSSDAGFT

SEQ ID NO: 515388 - protein, 7 aa, Mycobacterium
KSSDGIS

SEQ ID NO: 515389 - protein, 9 aa, Mycobacterium
KSSDGRQWE

SEQ ID NO: 515390 - protein, 7 aa, Mycobacterium
KSSDKAY

SEQ ID NO: 515391 - protein, 5 aa, Mycobacterium
KSSDY

SEQ ID NO: 515392 - protein, 6 aa, Mycobacterium
KSSEDV

SEQ ID NO: 515393 - protein, 6 aa, Mycobacterium
KSSEFA

SEQ ID NO: 515394 - protein, 20 aa, Mycobacterium
KSSEPAATGDADLGQSGQEQ

SEQ ID NO: 515395 - protein, 6 aa, Mycobacterium
KSSEPI

SEQ ID NO: 515396 - protein, 10 aa, Mycobacterium
KSSGPEDGAV

SEQ ID NO: 515397 - protein, 6 aa, Mycobacterium
KSSGRV

SEQ ID NO: 515398 - protein, 8 aa, Mycobacterium
KSSGTLST

SEQ ID NO: 515399 - protein, 13 aa, Mycobacterium
KSSGVGSEESTEE

SEQ ID NO: 515400 - protein, 9 aa, Mycobacterium
KSSGYGKDL

SEQ ID NO: 515401 - protein, 28 aa, Mycobacterium
KSSKRTRRLDGRTTVAANDTKRVKSLLN

SEQ ID NO: 515402 - protein, 6 aa, Mycobacterium
KSSMSQ

SEQ ID NO: 515403 - protein, 6 aa, Mycobacterium
KSSNEE

SEQ ID NO: 515404 - protein, 11 aa, Mycobacterium
KSSNSLSRKDP

SEQ ID NO: 515405 - protein, 8 aa, Mycobacterium
KSSPDLPA

SEQ ID NO: 515406 - protein, 8 aa, Mycobacterium
KSSPPVAV

SEQ ID NO: 515407 - protein, 33 aa, Mycobacterium
KSSQSAQRSPEQVKDNPGTTLTKDGNTTTISEG

SEQ ID NO: 515408 - protein, 6 aa, Mycobacterium
KSSREV

SEQ ID NO: 515409 - protein, 8 aa, Mycobacterium
KSSRSPEI

SEQ ID NO: 515410 - protein, 8 aa, Mycobacterium
KSSSAPAA

SEQ ID NO: 515411 - protein, 8 aa, Mycobacterium
KSSSDPQV

SEQ ID NO: 515412 - protein, 8 aa, Mycobacterium
KSSSPGLE

SEQ ID NO: 515413 - protein, 11 aa, Mycobacterium
KSSSQSRDPEL

SEQ ID NO: 515414 - protein, 6 aa, Mycobacterium
KSSTCP

SEQ ID NO: 515415 - protein, 18 aa, Mycobacterium
KSSTGSSGSSSPSAAGPQ

SEQ ID NO: 515416 - protein, 28 aa, Mycobacterium
KSSTRTRRLEGRTTVSANDTKRVNALLN

SEQ ID NO: 515417 - protein, 10 aa, Mycobacterium
KSSTSKDPVV

SEQ ID NO: 515418 - protein, 7 aa, Mycobacterium
KSSVAKE

SEQ ID NO: 515419 - protein, 8 aa, Mycobacterium
KSSVAKGL

SEQ ID NO: 515420 - protein, 5 aa, Mycobacterium
KSSVS

SEQ ID NO: 515421 - protein, 7 aa, Mycobacterium
KSSWQQT

SEQ ID NO: 515422 - protein, 7 aa, Mycobacterium
KSSYGQP

SEQ ID NO: 515423 - protein, 15 aa, Mycobacterium
KSSYGSGKGKDAMTS

SEQ ID NO: 515424 - protein, 15 aa, Mycobacterium
KSSYGTGKGPDTITS

SEQ ID NO: 515425 - protein, 4 aa, Mycobacterium
KSTA

SEQ ID NO: 515426 - protein, 7 aa, Mycobacterium
KSTAAGR

SEQ ID NO: 515427 - protein, 11 aa, Mycobacterium
KSTAGANPYAH

SEQ ID NO: 515428 - protein, 6 aa, Mycobacterium
KSTAHQ

SEQ ID NO: 515429 - protein, 5 aa, Mycobacterium
KSTAS

SEQ ID NO: 515430 - protein, 7 aa, Mycobacterium
KSTDDVG

SEQ ID NO: 515431 - protein, 5 aa, Mycobacterium
KSTDI

SEQ ID NO: 515432 - protein, 8 aa, Mycobacterium
KSTDKNGI

SEQ ID NO: 515433 - protein, 4 aa, Mycobacterium
KSTE

SEQ ID NO: 515434 - protein, 8 aa, Mycobacterium
KSTGDGHL

SEQ ID NO: 515435 - protein, 13 aa, Mycobacterium
KSTGGDFSPNDEV

SEQ ID NO: 515436 - protein, 7 aa, Mycobacterium
KSTGISP

SEQ ID NO: 515437 - protein, 7 aa, Mycobacterium
KSTGLDV

SEQ ID NO: 515438 - protein, 7 aa, Mycobacterium
KSTGLEV

SEQ ID NO: 515439 - protein, 8 aa, Mycobacterium
KSTGNGYP

SEQ ID NO: 515440 - protein, 7 aa, Mycobacterium
KSTGRRN

SEQ ID NO: 515441 - protein, 8 aa, Mycobacterium
KSTGTLST

SEQ ID NO: 515442 - protein, 4 aa, Mycobacterium
KSTI

SEQ ID NO: 515443 - protein, 8 aa, Mycobacterium
KSTLGHPG

SEQ ID NO: 515444 - protein, 7 aa, Mycobacterium
KSTLYKS

SEQ ID NO: 515445 - protein, 6 aa, Mycobacterium
KSTNAP

SEQ ID NO: 515446 - protein, 7 aa, Mycobacterium
KSTPAMT

SEQ ID NO: 515447 - protein, 8 aa, Mycobacterium
KSTPERPV

SEQ ID NO: 515448 - protein, 7 aa, Mycobacterium
KSTPGTR

SEQ ID NO: 515449 - protein, 6 aa, Mycobacterium
KSTPPF

SEQ ID NO: 515450 - protein, 14 aa, Mycobacterium
KSTQLGRDETLQDT

SEQ ID NO: 515451 - protein, 6 aa, Mycobacterium
KSTQNQ

SEQ ID NO: 515452 - protein, 6 aa, Mycobacterium
KSTQVG

SEQ ID NO: 515453 - protein, 5 aa, Mycobacterium
KSTRR

SEQ ID NO: 515454 - protein, 5 aa, Mycobacterium
KSTTR

SEQ ID NO: 515455 - protein, 7 aa, Mycobacterium
KSTVSRK

SEQ ID NO: 515456 - protein, 14 aa, Mycobacterium
KSTYTSAAPVTTRR

SEQ ID NO: 515457 - protein, 4 aa, Mycobacterium
KSVA

SEQ ID NO: 515458 - protein, 16 aa, Mycobacterium
KSVAAKGGWGPGSDGD

SEQ ID NO: 515459 - protein, 7 aa, Mycobacterium
KSVAGRS

SEQ ID NO: 515460 - protein, 7 aa, Mycobacterium
KSVAPGV

SEQ ID NO: 515461 - protein, 9 aa, Mycobacterium
KSVARRDIS

SEQ ID NO: 515462 - protein, 4 aa, Mycobacterium
KSVD

SEQ ID NO: 515463 - protein, 12 aa, Mycobacterium
KSVDGKPPVVTR

SEQ ID NO: 515464 - protein, 10 aa, Mycobacterium
KSVDPDSKSV

SEQ ID NO: 515465 - protein, 11 aa, Mycobacterium
KSVECDGGTSI

SEQ ID NO: 515466 - protein, 5 aa, Mycobacterium
KSVEE

SEQ ID NO: 515467 - protein, 15 aa, Mycobacterium
KSVETPDDAGDGEAE

SEQ ID NO: 515468 - protein, 4 aa, Mycobacterium
KSVG

SEQ ID NO: 515469 - protein, 12 aa, Mycobacterium
KSVGGRSSEDGE

SEQ ID NO: 515470 - protein, 10 aa, Mycobacterium
KSVGTPDPGA

SEQ ID NO: 515471 - protein, 5 aa, Mycobacterium
KSVND

SEQ ID NO: 515472 - protein, 11 aa, Mycobacterium
KSVNGTPISGD

SEQ ID NO: 515473 - protein, 15 aa, Mycobacterium
KSVPDDVDVAGSPAR

SEQ ID NO: 515474 - protein, 7 aa, Mycobacterium
KSVPEQE

SEQ ID NO: 515475 - protein, 4 aa, Mycobacterium
KSVQ

SEQ ID NO: 515476 - protein, 5 aa, Mycobacterium
KSVRG

SEQ ID NO: 515477 - protein, 4 aa, Mycobacterium
KSVS

SEQ ID NO: 515478 - protein, 6 aa, Mycobacterium
KSVSPA

SEQ ID NO: 515479 - protein, 7 aa, Mycobacterium
KSVSPSL

SEQ ID NO: 515480 - protein, 7 aa, Mycobacterium
KSVTADV

SEQ ID NO: 515481 - protein, 15 aa, Mycobacterium
KSVTNPDGTGVRGKA

SEQ ID NO: 515482 - protein, 17 aa, Mycobacterium
KSVTNPDGTGVRGKDGV

SEQ ID NO: 515483 - protein, 16 aa, Mycobacterium
KSVTNPDGTGVRGKEA

SEQ ID NO: 515484 - protein, 14 aa, Mycobacterium
KSVTPEQAGKHPTW

SEQ ID NO: 515485 - protein, 14 aa, Mycobacterium
KSVTTFGPYSPGQA

SEQ ID NO: 515486 - protein, 4 aa, Mycobacterium
KSVV

SEQ ID NO: 515487 - protein, 7 aa, Mycobacterium
KSVVASG

SEQ ID NO: 515488 - protein, 13 aa, Mycobacterium
KSVVTADGQRHSY

SEQ ID NO: 515489 - protein, 4 aa, Mycobacterium
KSYG

SEQ ID NO: 515490 - protein, 5 aa, Mycobacterium
KSYGG

SEQ ID NO: 515491 - protein, 8 aa, Mycobacterium
KSYGRRPA

SEQ ID NO: 515492 - protein, 4 aa, Mycobacterium
KSYP

SEQ ID NO: 515493 - protein, 6 aa, Mycobacterium
KSYPSM

SEQ ID NO: 515494 - protein, 5 aa, Mycobacterium
KSYRD

SEQ ID NO: 515495 - protein, 9 aa, Mycobacterium
KSYRETGGG

SEQ ID NO: 515496 - protein, 5 aa, Mycobacterium
KSYRG

SEQ ID NO: 515497 - protein, 13 aa, Mycobacterium
KSYRSRGRRDRKT

SEQ ID NO: 515498 - protein, 6 aa, Mycobacterium
KSYVSQ

SEQ ID NO: 515499 - protein, 4 aa, Mycobacterium
KTAA

SEQ ID NO: 515500 - protein, 5 aa, Mycobacterium
KTAAA

SEQ ID NO: 515501 - protein, 8 aa, Mycobacterium
KTAAAARA

SEQ ID NO: 515502 - protein, 9 aa, Mycobacterium
KTAAAQAGG

SEQ ID NO: 515503 - protein, 6 aa, Mycobacterium
KTAAEQ

SEQ ID NO: 515504 - protein, 7 aa, Mycobacterium
KTAAKLQ

SEQ ID NO: 515505 - protein, 13 aa, Mycobacterium
KTAALKGSPQRRG

SEQ ID NO: 515506 - protein, 15 aa, Mycobacterium
KTAATPAPTSDQEPV

SEQ ID NO: 515507 - protein, 4 aa, Mycobacterium
KTAD

SEQ ID NO: 515508 - protein, 10 aa, Mycobacterium
KTADDPDTFS

SEQ ID NO: 515509 - protein, 5 aa, Mycobacterium
KTADH

SEQ ID NO: 515510 - protein, 6 aa, Mycobacterium
KTADQV

SEQ ID NO: 515511 - protein, 4 aa, Mycobacterium
KTAE

SEQ ID NO: 515512 - protein, 5 aa, Mycobacterium
KTAEQ

SEQ ID NO: 515513 - protein, 7 aa, Mycobacterium
KTAEQRL

SEQ ID NO: 515514 - protein, 8 aa, Mycobacterium
KTAFAERE

SEQ ID NO: 515515 - protein, 5 aa, Mycobacterium
KTAGA

SEQ ID NO: 515516 - protein, 7 aa, Mycobacterium
KTAGEGK

SEQ ID NO: 515517 - protein, 7 aa, Mycobacterium
KTAGFSA

SEQ ID NO: 515518 - protein, 5 aa, Mycobacterium
KTAGG

SEQ ID NO: 515519 - protein, 9 aa, Mycobacterium
KTAHGGKGV

SEQ ID NO: 515520 - protein, 10 aa, Mycobacterium
KTAHGQAHGQ

SEQ ID NO: 515521 - protein, 8 aa, Mycobacterium
KTAKPDPR

SEQ ID NO: 515522 - protein, 17 aa, Mycobacterium
KTALDPAGILNPGVLLD

SEQ ID NO: 515523 - protein, 12 aa, Mycobacterium
KTAMSRETLSRP

SEQ ID NO: 515524 - protein, 5 aa, Mycobacterium
KTANA

SEQ ID NO: 515525 - protein, 21 aa, Mycobacterium
KTANKGRDDITPEDARHPDLD

SEQ ID NO: 515526 - protein, 6 aa, Mycobacterium
KTANTY

SEQ ID NO: 515527 - protein, 16 aa, Mycobacterium
KTAPAGSFSAGGHDTD

SEQ ID NO: 515528 - protein, 5 aa, Mycobacterium
KTAPE

SEQ ID NO: 515529 - protein, 10 aa, Mycobacterium
KTAPRPEGSG

SEQ ID NO: 515530 - protein, 33 aa, Mycobacterium
KTAPRRGGQPANGTGSSGAARRGNRLPRDERRG

SEQ ID NO: 515531 - protein, 5 aa, Mycobacterium
KTAPV

SEQ ID NO: 515532 - protein, 5 aa, Mycobacterium
KTAQA

SEQ ID NO: 515533 - protein, 12 aa, Mycobacterium
KTAQQRGQHGEY

SEQ ID NO: 515534 - protein, 6 aa, Mycobacterium
KTAQTA

SEQ ID NO: 515535 - protein, 15 aa, Mycobacterium
KTARPDSAGFGDQPE

SEQ ID NO: 515536 - protein, 8 aa, Mycobacterium
KTASDFDE

SEQ ID NO: 515537 - protein, 7 aa, Mycobacterium
KTASGEV

SEQ ID NO: 515538 - protein, 12 aa, Mycobacterium
KTASKQKPEPIV

SEQ ID NO: 515539 - protein, 4 aa, Mycobacterium
KTAT

SEQ ID NO: 515540 - protein, 15 aa, Mycobacterium
KTATAAAEAVFARAA

SEQ ID NO: 515541 - protein, 6 aa, Mycobacterium
KTATFD

SEQ ID NO: 515542 - protein, 11 aa, Mycobacterium
KTATTEELPGA

SEQ ID NO: 515543 - protein, 24 aa, Mycobacterium
KTATTKPVTIPKDKAQSGYRPNAE

SEQ ID NO: 515544 - protein, 6 aa, Mycobacterium
KTATTV

SEQ ID NO: 515545 - protein, 14 aa, Mycobacterium
KTAYDRSQEIDPSR

SEQ ID NO: 515546 - protein, 8 aa, Mycobacterium
KTAYTPGR

SEQ ID NO: 515547 - protein, 16 aa, Mycobacterium
KTDAASRAEALDLILR

SEQ ID NO: 515548 - protein, 7 aa, Mycobacterium
KTDAHDE

SEQ ID NO: 515549 - protein, 17 aa, Mycobacterium
KTDARGDDDLPLRPWWT

SEQ ID NO: 515550 - protein, 7 aa, Mycobacterium
KTDATQR

SEQ ID NO: 515551 - protein, 6 aa, Mycobacterium
KTDDVT

SEQ ID NO: 515552 - protein, 7 aa, Mycobacterium
KTDFSGV

SEQ ID NO: 515553 - protein, 7 aa, Mycobacterium
KTDFTGV

SEQ ID NO: 515554 - protein, 15 aa, Mycobacterium
KTDKPDTEGPPDKRS

SEQ ID NO: 515555 - protein, 4 aa, Mycobacterium
KTDN

SEQ ID NO: 515556 - protein, 5 aa, Mycobacterium
KTDNA

SEQ ID NO: 515557 - protein, 8 aa, Mycobacterium
KTDNERAK

SEQ ID NO: 515558 - protein, 7 aa, Mycobacterium
KTDNRTT

SEQ ID NO: 515559 - protein, 10 aa, Mycobacterium
KTDPAPGPGE

SEQ ID NO: 515560 - protein, 12 aa, Mycobacterium
KTDPGVANPVEP

SEQ ID NO: 515561 - protein, 7 aa, Mycobacterium
KTDPQIA

SEQ ID NO: 515562 - protein, 9 aa, Mycobacterium
KTDPSARHK

SEQ ID NO: 515563 - protein, 9 aa, Mycobacterium
KTDQHDSER

SEQ ID NO: 515564 - protein, 10 aa, Mycobacterium
KTDRGRLATG

SEQ ID NO: 515565 - protein, 6 aa, Mycobacterium
KTDRLA

SEQ ID NO: 515566 - protein, 7 aa, Mycobacterium
KTDRLAK

SEQ ID NO: 515567 - protein, 7 aa, Mycobacterium
KTDRYAR

SEQ ID NO: 515568 - protein, 4 aa, Mycobacterium
KTDS

SEQ ID NO: 515569 - protein, 7 aa, Mycobacterium
KTDSATL

SEQ ID NO: 515570 - protein, 5 aa, Mycobacterium
KTDSL

SEQ ID NO: 515571 - protein, 8 aa, Mycobacterium
KTDSSREV

SEQ ID NO: 515572 - protein, 6 aa, Mycobacterium
KTDSVR

SEQ ID NO: 515573 - protein, 18 aa, Mycobacterium
KTDVDPSQQRLGGADSIA

SEQ ID NO: 515574 - protein, 14 aa, Mycobacterium
KTDWPETDHPRRAA

SEQ ID NO: 515575 - protein, 6 aa, Mycobacterium
KTDYGA

SEQ ID NO: 515576 - protein, 8 aa, Mycobacterium
KTEADGES

SEQ ID NO: 515577 - protein, 7 aa, Mycobacterium
KTEADQS

SEQ ID NO: 515578 - protein, 7 aa, Mycobacterium
KTEAEGE

SEQ ID NO: 515579 - protein, 5 aa, Mycobacterium
KTEAL

SEQ ID NO: 515580 - protein, 10 aa, Mycobacterium
KTEDSTDLKA

SEQ ID NO: 515581 - protein, 6 aa, Mycobacterium
KTEEAK

SEQ ID NO: 515582 - protein, 4 aa, Mycobacterium
KTEF

SEQ ID NO: 515583 - protein, 7 aa, Mycobacterium
KTEGGNH

SEQ ID NO: 515584 - protein, 6 aa, Mycobacterium
KTEGHS

SEQ ID NO: 515585 - protein, 6 aa, Mycobacterium
KTEGIT

SEQ ID NO: 515586 - protein, 6 aa, Mycobacterium
KTEGVP

SEQ ID NO: 515587 - protein, 14 aa, Mycobacterium
KTEHEATHEVDDND

SEQ ID NO: 515588 - protein, 9 aa, Mycobacterium
KTEHPNGAP

SEQ ID NO: 515589 - protein, 4 aa, Mycobacterium
KTEI

SEQ ID NO: 515590 - protein, 13 aa, Mycobacterium
KTEPTGGNARPVA

SEQ ID NO: 515591 - protein, 12 aa, Mycobacterium
KTEPVGPNAEER

SEQ ID NO: 515592 - protein, 15 aa, Mycobacterium
KTEQHPNATKDSDGR

SEQ ID NO: 515593 - protein, 4 aa, Mycobacterium
KTER

SEQ ID NO: 515594 - protein, 13 aa, Mycobacterium
KTEREADSSGRTR

SEQ ID NO: 515595 - protein, 6 aa, Mycobacterium
KTERPT

SEQ ID NO: 515596 - protein, 8 aa, Mycobacterium
KTESAAQV

SEQ ID NO: 515597 - protein, 12 aa, Mycobacterium
KTESGQPIPSYN

SEQ ID NO: 515598 - protein, 13 aa, Mycobacterium
KTESGSPIPSYDA

SEQ ID NO: 515599 - protein, 10 aa, Mycobacterium
KTETPGPRGS

SEQ ID NO: 515600 - protein, 5 aa, Mycobacterium
KTFEV

SEQ ID NO: 515601 - protein, 7 aa, Mycobacterium
KTFGGDP

SEQ ID NO: 515602 - protein, 6 aa, Mycobacterium
KTFGIG

SEQ ID NO: 515603 - protein, 6 aa, Mycobacterium
KTFGIS

SEQ ID NO: 515604 - protein, 6 aa, Mycobacterium
KTFGMS

SEQ ID NO: 515605 - protein, 4 aa, Mycobacterium
KTFP

SEQ ID NO: 515606 - protein, 10 aa, Mycobacterium
KTFPVPDGLD

SEQ ID NO: 515607 - protein, 23 aa, Mycobacterium
KTFRSDRYPEYKATRSATPDEFR

SEQ ID NO: 515608 - protein, 4 aa, Mycobacterium
KTFT

SEQ ID NO: 515609 - protein, 8 aa, Mycobacterium
KTFTPPAQ

SEQ ID NO: 515610 - protein, 5 aa, Mycobacterium
KTGAA

SEQ ID NO: 515611 - protein, 5 aa, Mycobacterium
KTGAM

SEQ ID NO: 515612 - protein, 6 aa, Mycobacterium
KTGAPI

SEQ ID NO: 515613 - protein, 6 aa, Mycobacterium
KTGARP

SEQ ID NO: 515614 - protein, 5 aa, Mycobacterium
KTGAS

SEQ ID NO: 515615 - protein, 21 aa, Mycobacterium
KTGASGVTEREQDPLTPAARD

SEQ ID NO: 515616 - protein, 8 aa, Mycobacterium
KTGATASG

SEQ ID NO: 515617 - protein, 7 aa, Mycobacterium
KTGATQR

SEQ ID NO: 515618 - protein, 24 aa, Mycobacterium
KTGDALPDDERLPSGLYADDRTRQ

SEQ ID NO: 515619 - protein, 7 aa, Mycobacterium
KTGDLGG

SEQ ID NO: 515620 - protein, 24 aa, Mycobacterium
KTGDPAPPKIEGTEAKSSEGGVTE

SEQ ID NO: 515621 - protein, 11 aa, Mycobacterium
KTGDPGDSDLQ

SEQ ID NO: 515622 - protein, 4 aa, Mycobacterium
KTGE

SEQ ID NO: 515623 - protein, 5 aa, Mycobacterium
KTGED

SEQ ID NO: 515624 - protein, 7 aa, Mycobacterium
KTGEEFT

SEQ ID NO: 515625 - protein, 6 aa, Mycobacterium
KTGEQL

SEQ ID NO: 515626 - protein, 6 aa, Mycobacterium
KTGFPG

SEQ ID NO: 515627 - protein, 6 aa, Mycobacterium
KTGFSG

SEQ ID NO: 515628 - protein, 6 aa, Mycobacterium
KTGGAQ

SEQ ID NO: 515629 - protein, 7 aa, Mycobacterium
KTGGETL

SEQ ID NO: 515630 - protein, 13 aa, Mycobacterium
KTGGGTNITPSEV

SEQ ID NO: 515631 - protein, 31 aa, Mycobacterium
KTGGGVDPLTDAPAPITAQQRKESGIDAKPD

SEQ ID NO: 515632 - protein, 35 aa, Mycobacterium
KTGGGVDPLTDAPAPITAQQRKESGIDAKPEKVDR

SEQ ID NO: 515633 - protein, 35 aa, Mycobacterium
KTGGGVDPLTEAPAPITAQQRKEAGIDAKPKQVEG

SEQ ID NO: 515634 - protein, 35 aa, Mycobacterium
KTGGGVDPLTNAPAPITAQQRKESGIDAKPKPVDR

SEQ ID NO: 515635 - protein, 7 aa, Mycobacterium
KTGGTGW

SEQ ID NO: 515636 - protein, 13 aa, Mycobacterium
KTGHSDRPGDPTL

SEQ ID NO: 515637 - protein, 12 aa, Mycobacterium
KTGHSRPPEDAT

SEQ ID NO: 515638 - protein, 13 aa, Mycobacterium
KTGIASPALRPTE

SEQ ID NO: 515639 - protein, 6 aa, Mycobacterium
KTGIPY

SEQ ID NO: 515640 - protein, 4 aa, Mycobacterium
KTGK

SEQ ID NO: 515641 - protein, 11 aa, Mycobacterium
KTGKAPAAARE

SEQ ID NO: 515642 - protein, 10 aa, Mycobacterium
KTGKPGHVQP

SEQ ID NO: 515643 - protein, 8 aa, Mycobacterium
KTGKQARA

SEQ ID NO: 515644 - protein, 6 aa, Mycobacterium
KTGKVA

SEQ ID NO: 515645 - protein, 9 aa, Mycobacterium
KTGLPADQF

SEQ ID NO: 515646 - protein, 7 aa, Mycobacterium
KTGLRTQ

SEQ ID NO: 515647 - protein, 4 aa, Mycobacterium
KTGM

SEQ ID NO: 515648 - protein, 5 aa, Mycobacterium
KTGMK

SEQ ID NO: 515649 - protein, 13 aa, Mycobacterium
KTGNAEPPKDPTL

SEQ ID NO: 515650 - protein, 4 aa, Mycobacterium
KTGP

SEQ ID NO: 515651 - protein, 5 aa, Mycobacterium
KTGPA

SEQ ID NO: 515652 - protein, 8 aa, Mycobacterium
KTGPEYGE

SEQ ID NO: 515653 - protein, 15 aa, Mycobacterium
KTGPVAGLPFLPPGA

SEQ ID NO: 515654 - protein, 14 aa, Mycobacterium
KTGQADDPRVQEKA

SEQ ID NO: 515655 - protein, 11 aa, Mycobacterium
KTGQAGNERVE

SEQ ID NO: 515656 - protein, 7 aa, Mycobacterium
KTGQPGH

SEQ ID NO: 515657 - protein, 5 aa, Mycobacterium
KTGQQ

SEQ ID NO: 515658 - protein, 7 aa, Mycobacterium
KTGQQVE

SEQ ID NO: 515659 - protein, 5 aa, Mycobacterium
KTGQR

SEQ ID NO: 515660 - protein, 12 aa, Mycobacterium
KTGQYTVSPGDT

SEQ ID NO: 515661 - protein, 4 aa, Mycobacterium
KTGR

SEQ ID NO: 515662 - protein, 8 aa, Mycobacterium
KTGRAPRA

SEQ ID NO: 515663 - protein, 5 aa, Mycobacterium
KTGRF

SEQ ID NO: 515664 - protein, 7 aa, Mycobacterium
KTGRPGH

SEQ ID NO: 515665 - protein, 6 aa, Mycobacterium
KTGRPY

SEQ ID NO: 515666 - protein, 5 aa, Mycobacterium
KTGRR

SEQ ID NO: 515667 - protein, 9 aa, Mycobacterium
KTGRSGDHL

SEQ ID NO: 515668 - protein, 5 aa, Mycobacterium
KTGRV

SEQ ID NO: 515669 - protein, 4 aa, Mycobacterium
KTGS

SEQ ID NO: 515670 - protein, 15 aa, Mycobacterium
KTGSENGPLANSRTG

SEQ ID NO: 515671 - protein, 5 aa, Mycobacterium
KTGSL

SEQ ID NO: 515672 - protein, 7 aa, Mycobacterium
KTGSPYA

SEQ ID NO: 515673 - protein, 5 aa, Mycobacterium
KTGTP

SEQ ID NO: 515674 - protein, 5 aa, Mycobacterium
KTGTV

SEQ ID NO: 515675 - protein, 6 aa, Mycobacterium
KTGVDE

SEQ ID NO: 515676 - protein, 8 aa, Mycobacterium
KTGYPQRM

SEQ ID NO: 515677 - protein, 8 aa, Mycobacterium
KTGYTTYD

SEQ ID NO: 515678 - protein, 16 aa, Mycobacterium
KTHAASQSGERAPKHR

SEQ ID NO: 515679 - protein, 9 aa, Mycobacterium
KTHDKADDI

SEQ ID NO: 515680 - protein, 4 aa, Mycobacterium
KTHG

SEQ ID NO: 515681 - protein, 10 aa, Mycobacterium
KTHGPQGTEC

SEQ ID NO: 515682 - protein, 9 aa, Mycobacterium
KTHPGGTHR

SEQ ID NO: 515683 - protein, 18 aa, Mycobacterium
KTHTTGGRQGESFSSDGN

SEQ ID NO: 515684 - protein, 13 aa, Mycobacterium
KTIAEASGASGED

SEQ ID NO: 515685 - protein, 10 aa, Mycobacterium
KTIDSERTCP

SEQ ID NO: 515686 - protein, 6 aa, Mycobacterium
KTIEPG

SEQ ID NO: 515687 - protein, 8 aa, Mycobacterium
KTIESGSL

SEQ ID NO: 515688 - protein, 4 aa, Mycobacterium
KTIG

SEQ ID NO: 515689 - protein, 14 aa, Mycobacterium
KTIGGPDGQQDKEY

SEQ ID NO: 515690 - protein, 4 aa, Mycobacterium
KTIK

SEQ ID NO: 515691 - protein, 11 aa, Mycobacterium
KTINGVEAEDA

SEQ ID NO: 515692 - protein, 13 aa, Mycobacterium
KTIPADASYEPKW

SEQ ID NO: 515693 - protein, 7 aa, Mycobacterium
KTIPEGS

SEQ ID NO: 515694 - protein, 5 aa, Mycobacterium
KTIPT

SEQ ID NO: 515695 - protein, 6 aa, Mycobacterium
KTIRDG

SEQ ID NO: 515696 - protein, 8 aa, Mycobacterium
KTIRGANR

SEQ ID NO: 515697 - protein, 4 aa, Mycobacterium
KTIS

SEQ ID NO: 515698 - protein, 5 aa, Mycobacterium
KTISG

SEQ ID NO: 515699 - protein, 8 aa, Mycobacterium
KTITTGEG

SEQ ID NO: 515700 - protein, 4 aa, Mycobacterium
KTKA

SEQ ID NO: 515701 - protein, 9 aa, Mycobacterium
KTKAAERHV

SEQ ID NO: 515702 - protein, 10 aa, Mycobacterium
KTKAGKGCGS

SEQ ID NO: 515703 - protein, 14 aa, Mycobacterium
KTKALADGKPLHAE

SEQ ID NO: 515704 - protein, 11 aa, Mycobacterium
KTKAPSVVAGP

SEQ ID NO: 515705 - protein, 16 aa, Mycobacterium
KTKATPADQAVDDYRA

SEQ ID NO: 515706 - protein, 6 aa, Mycobacterium
KTKDED

SEQ ID NO: 515707 - protein, 8 aa, Mycobacterium
KTKDTARL

SEQ ID NO: 515708 - protein, 8 aa, Mycobacterium
KTKGRPAI

SEQ ID NO: 515709 - protein, 21 aa, Mycobacterium
KTKPLSPAPDRAEPGYRPSTA

SEQ ID NO: 515710 - protein, 8 aa, Mycobacterium
KTKRPAFN

SEQ ID NO: 515711 - protein, 9 aa, Mycobacterium
KTKSLTDKP

SEQ ID NO: 515712 - protein, 7 aa, Mycobacterium
KTKTDAL

SEQ ID NO: 515713 - protein, 7 aa, Mycobacterium
KTKTRDE

SEQ ID NO: 515714 - protein, 15 aa, Mycobacterium
KTKTTPADQAVDDYR

SEQ ID NO: 515715 - protein, 7 aa, Mycobacterium
KTKVGDT

SEQ ID NO: 515716 - protein, 5 aa, Mycobacterium
KTKYE

SEQ ID NO: 515717 - protein, 4 aa, Mycobacterium
KTLA

SEQ ID NO: 515718 - protein, 12 aa, Mycobacterium
KTLADAAGDIQR

SEQ ID NO: 515719 - protein, 10 aa, Mycobacterium
KTLAGSHPDG

SEQ ID NO: 515720 - protein, 4 aa, Mycobacterium
KTLD

SEQ ID NO: 515721 - protein, 11 aa, Mycobacterium
KTLEPAAEETA

SEQ ID NO: 515722 - protein, 4 aa, Mycobacterium
KTLG

SEQ ID NO: 515723 - protein, 8 aa, Mycobacterium
KTLGGSSS

SEQ ID NO: 515724 - protein, 7 aa, Mycobacterium
KTLGRRG

SEQ ID NO: 515725 - protein, 11 aa, Mycobacterium
KTLKSAKAETL

SEQ ID NO: 515726 - protein, 8 aa, Mycobacterium
KTLNDDAA

SEQ ID NO: 515727 - protein, 7 aa, Mycobacterium
KTLNRQK

SEQ ID NO: 515728 - protein, 6 aa, Mycobacterium
KTLPAD

SEQ ID NO: 515729 - protein, 6 aa, Mycobacterium
KTLPAS

SEQ ID NO: 515730 - protein, 9 aa, Mycobacterium
KTLPDAERR

SEQ ID NO: 515731 - protein, 5 aa, Mycobacterium
KTLPG

SEQ ID NO: 515732 - protein, 6 aa, Mycobacterium
KTLPNG

SEQ ID NO: 515733 - protein, 7 aa, Mycobacterium
KTLPQRQ

SEQ ID NO: 515734 - protein, 7 aa, Mycobacterium
KTLPTGA

SEQ ID NO: 515735 - protein, 4 aa, Mycobacterium
KTLR

SEQ ID NO: 515736 - protein, 6 aa, Mycobacterium
KTLRDA

SEQ ID NO: 515737 - protein, 7 aa, Mycobacterium
KTLSDPN

SEQ ID NO: 515738 - protein, 8 aa, Mycobacterium
KTLSDPNR

SEQ ID NO: 515739 - protein, 6 aa, Mycobacterium
KTLSGS

SEQ ID NO: 515740 - protein, 11 aa, Mycobacterium
KTLSSPSTLSA

SEQ ID NO: 515741 - protein, 5 aa, Mycobacterium
KTLTR

SEQ ID NO: 515742 - protein, 5 aa, Mycobacterium
KTMQA

SEQ ID NO: 515743 - protein, 14 aa, Mycobacterium
KTMRDEKHKRSGYD

SEQ ID NO: 515744 - protein, 6 aa, Mycobacterium
KTMSPE

SEQ ID NO: 515745 - protein, 12 aa, Mycobacterium
KTMSSASGPKLD

SEQ ID NO: 515746 - protein, 6 aa, Mycobacterium
KTNAYV

SEQ ID NO: 515747 - protein, 18 aa, Mycobacterium
KTNDPLSGVTSPFLVWAR

SEQ ID NO: 515748 - protein, 9 aa, Mycobacterium
KTNDQTGDI

SEQ ID NO: 515749 - protein, 13 aa, Mycobacterium
KTNEELAALMAGA

SEQ ID NO: 515750 - protein, 18 aa, Mycobacterium
KTNERARLRNKSVKSSLR

SEQ ID NO: 515751 - protein, 5 aa, Mycobacterium
KTNEY

SEQ ID NO: 515752 - protein, 10 aa, Mycobacterium
KTNGQPFSDD

SEQ ID NO: 515753 - protein, 6 aa, Mycobacterium
KTNGRI

SEQ ID NO: 515754 - protein, 13 aa, Mycobacterium
KTNIGHTDTAAGV

SEQ ID NO: 515755 - protein, 5 aa, Mycobacterium
KTNLG

SEQ ID NO: 515756 - protein, 5 aa, Mycobacterium
KTNPD

SEQ ID NO: 515757 - protein, 5 aa, Mycobacterium
KTNPG

SEQ ID NO: 515758 - protein, 8 aa, Mycobacterium
KTNPPMTT

SEQ ID NO: 515759 - protein, 5 aa, Mycobacterium
KTNRA

SEQ ID NO: 515760 - protein, 14 aa, Mycobacterium
KTNRADRDKSLAAT

SEQ ID NO: 515761 - protein, 6 aa, Mycobacterium
KTNTTI

SEQ ID NO: 515762 - protein, 6 aa, Mycobacterium
KTNTVE

SEQ ID NO: 515763 - protein, 4 aa, Mycobacterium
KTNV

SEQ ID NO: 515764 - protein, 6 aa, Mycobacterium
KTPAEA

SEQ ID NO: 515765 - protein, 6 aa, Mycobacterium
KTPAEQ

SEQ ID NO: 515766 - protein, 16 aa, Mycobacterium
KTPAEWASKGTGPPYA

SEQ ID NO: 515767 - protein, 11 aa, Mycobacterium
KTPAGKVEGSI

SEQ ID NO: 515768 - protein, 12 aa, Mycobacterium
KTPAGRRAARRM

SEQ ID NO: 515769 - protein, 7 aa, Mycobacterium
KTPAPHG

SEQ ID NO: 515770 - protein, 6 aa, Mycobacterium
KTPARR

SEQ ID NO: 515771 - protein, 5 aa, Mycobacterium
KTPAS

SEQ ID NO: 515772 - protein, 12 aa, Mycobacterium
KTPDGEGELTLP

SEQ ID NO: 515773 - protein, 10 aa, Mycobacterium
KTPDGKVDGS

SEQ ID NO: 515774 - protein, 7 aa, Mycobacterium
KTPEGYY

SEQ ID NO: 515775 - protein, 6 aa, Mycobacterium
KTPEQL

SEQ ID NO: 515776 - protein, 7 aa, Mycobacterium
KTPESLM

SEQ ID NO: 515777 - protein, 8 aa, Mycobacterium
KTPETAGL

SEQ ID NO: 515778 - protein, 6 aa, Mycobacterium
KTPFGT

SEQ ID NO: 515779 - protein, 7 aa, Mycobacterium
KTPGAKG

SEQ ID NO: 515780 - protein, 9 aa, Mycobacterium
KTPGDPGAL

SEQ ID NO: 515781 - protein, 6 aa, Mycobacterium
KTPGGM

SEQ ID NO: 515782 - protein, 7 aa, Mycobacterium
KTPGRVR

SEQ ID NO: 515783 - protein, 5 aa, Mycobacterium
KTPGS

SEQ ID NO: 515784 - protein, 6 aa, Mycobacterium
KTPGVR

SEQ ID NO: 515785 - protein, 7 aa, Mycobacterium
KTPGWAG

SEQ ID NO: 515786 - protein, 4 aa, Mycobacterium
KTPH

SEQ ID NO: 515787 - protein, 9 aa, Mycobacterium
KTPHEGPLP

SEQ ID NO: 515788 - protein, 4 aa, Mycobacterium
KTPI

SEQ ID NO: 515789 - protein, 7 aa, Mycobacterium
KTPKAEI

SEQ ID NO: 515790 - protein, 8 aa, Mycobacterium
KTPKAEVR

SEQ ID NO: 515791 - protein, 7 aa, Mycobacterium
KTPKAQI

SEQ ID NO: 515792 - protein, 6 aa, Mycobacterium
KTPKEL

SEQ ID NO: 515793 - protein, 8 aa, Mycobacterium
KTPKPEIR

SEQ ID NO: 515794 - protein, 8 aa, Mycobacterium
KTPKSLPP

SEQ ID NO: 515795 - protein, 5 aa, Mycobacterium
KTPMA

SEQ ID NO: 515796 - protein, 7 aa, Mycobacterium
KTPMNPG

SEQ ID NO: 515797 - protein, 7 aa, Mycobacterium
KTPMQKR

SEQ ID NO: 515798 - protein, 4 aa, Mycobacterium
KTPP

SEQ ID NO: 515799 - protein, 8 aa, Mycobacterium
KTPPAEVE

SEQ ID NO: 515800 - protein, 9 aa, Mycobacterium
KTPPAGSFS

SEQ ID NO: 515801 - protein, 5 aa, Mycobacterium
KTPPF

SEQ ID NO: 515802 - protein, 31 aa, Mycobacterium
KTPPPLPDTPPVSALPDTPPLGAPAPTEPPL

SEQ ID NO: 515803 - protein, 4 aa, Mycobacterium
KTPQ

SEQ ID NO: 515804 - protein, 5 aa, Mycobacterium
KTPQL

SEQ ID NO: 515805 - protein, 5 aa, Mycobacterium
KTPQV

SEQ ID NO: 515806 - protein, 6 aa, Mycobacterium
KTPRFT

SEQ ID NO: 515807 - protein, 7 aa, Mycobacterium
KTPRGTT

SEQ ID NO: 515808 - protein, 9 aa, Mycobacterium
KTPSNDPLT

SEQ ID NO: 515809 - protein, 25 aa, Mycobacterium
KTPSQMPSGSGGSAPGGGADAAGQM

SEQ ID NO: 515810 - protein, 5 aa, Mycobacterium
KTPSV

SEQ ID NO: 515811 - protein, 15 aa, Mycobacterium
KTPSWTDELTYEPVA

SEQ ID NO: 515812 - protein, 14 aa, Mycobacterium
KTPTFSPRLFETGD

SEQ ID NO: 515813 - protein, 6 aa, Mycobacterium
KTPTID

SEQ ID NO: 515814 - protein, 15 aa, Mycobacterium
KTPTWSQELTYEPVS

SEQ ID NO: 515815 - protein, 14 aa, Mycobacterium
KTPTWTNDLTAQTA

SEQ ID NO: 515816 - protein, 5 aa, Mycobacterium
KTPTY

SEQ ID NO: 515817 - protein, 6 aa, Mycobacterium
KTPTYA

SEQ ID NO: 515818 - protein, 9 aa, Mycobacterium
KTPVTASYN

SEQ ID NO: 515819 - protein, 8 aa, Mycobacterium
KTPYGQPK

SEQ ID NO: 515820 - protein, 16 aa, Mycobacterium
KTQDGYRSSGSKPIGS

SEQ ID NO: 515821 - protein, 8 aa, Mycobacterium
KTQDPQRY

SEQ ID NO: 515822 - protein, 4 aa, Mycobacterium
KTQG

SEQ ID NO: 515823 - protein, 14 aa, Mycobacterium
KTQIDQVESTAASL

SEQ ID NO: 515824 - protein, 19 aa, Mycobacterium
KTQPEPGPDEGQESGAGPA

SEQ ID NO: 515825 - protein, 8 aa, Mycobacterium
KTQPGGRT

SEQ ID NO: 515826 - protein, 13 aa, Mycobacterium
KTQPPLVLDDLVA

SEQ ID NO: 515827 - protein, 12 aa, Mycobacterium
KTQSADSGPRAI

SEQ ID NO: 515828 - protein, 12 aa, Mycobacterium
KTQSPSAAHDLD

SEQ ID NO: 515829 - protein, 4 aa, Mycobacterium
KTQT

SEQ ID NO: 515830 - protein, 27 aa, Mycobacterium
KTQTPNPKIAGTLGETADAVQRAGGRA

SEQ ID NO: 515831 - protein, 7 aa, Mycobacterium
KTRADLE

SEQ ID NO: 515832 - protein, 16 aa, Mycobacterium
KTRAELEAEGQRHGVP

SEQ ID NO: 515833 - protein, 7 aa, Mycobacterium
KTRAESF

SEQ ID NO: 515834 - protein, 13 aa, Mycobacterium
KTRAREGDESRPA

SEQ ID NO: 515835 - protein, 4 aa, Mycobacterium
KTRD

SEQ ID NO: 515836 - protein, 6 aa, Mycobacterium
KTRDAE

SEQ ID NO: 515837 - protein, 6 aa, Mycobacterium
KTRDCD

SEQ ID NO: 515838 - protein, 6 aa, Mycobacterium
KTRDGN

SEQ ID NO: 515839 - protein, 8 aa, Mycobacterium
KTRELSNE

SEQ ID NO: 515840 - protein, 6 aa, Mycobacterium
KTRESA

SEQ ID NO: 515841 - protein, 5 aa, Mycobacterium
KTRFN

SEQ ID NO: 515842 - protein, 5 aa, Mycobacterium
KTRGA

SEQ ID NO: 515843 - protein, 9 aa, Mycobacterium
KTRGHSPQQ

SEQ ID NO: 515844 - protein, 6 aa, Mycobacterium
KTRIDR

SEQ ID NO: 515845 - protein, 10 aa, Mycobacterium
KTRKANAAAF

SEQ ID NO: 515846 - protein, 11 aa, Mycobacterium
KTRKQSRPGVR

SEQ ID NO: 515847 - protein, 5 aa, Mycobacterium
KTRLD

SEQ ID NO: 515848 - protein, 11 aa, Mycobacterium
KTRLSTGPEYE

SEQ ID NO: 515849 - protein, 27 aa, Mycobacterium
KTRLTGKTRLTGDTRLASDAAARLARD

SEQ ID NO: 515850 - protein, 10 aa, Mycobacterium
KTRNADEVSA

SEQ ID NO: 515851 - protein, 5 aa, Mycobacterium
KTRNE

SEQ ID NO: 515852 - protein, 14 aa, Mycobacterium
KTRNGADPANPPLQ

SEQ ID NO: 515853 - protein, 13 aa, Mycobacterium
KTRPDAAAACRGG

SEQ ID NO: 515854 - protein, 14 aa, Mycobacterium
KTRPDAASACRGGQ

SEQ ID NO: 515855 - protein, 9 aa, Mycobacterium
KTRPETAAD

SEQ ID NO: 515856 - protein, 8 aa, Mycobacterium
KTRPGGDQ

SEQ ID NO: 515857 - protein, 7 aa, Mycobacterium
KTRPNGH

SEQ ID NO: 515858 - protein, 12 aa, Mycobacterium
KTRPPSQRAQRD

SEQ ID NO: 515859 - protein, 15 aa, Mycobacterium
KTRPVQPKKPTGEST

SEQ ID NO: 515860 - protein, 9 aa, Mycobacterium
KTRQEKGVE

SEQ ID NO: 515861 - protein, 6 aa, Mycobacterium
KTRQRT

SEQ ID NO: 515862 - protein, 10 aa, Mycobacterium
KTRSATDTLA

SEQ ID NO: 515863 - protein, 12 aa, Mycobacterium
KTRSEPPHEGAR

SEQ ID NO: 515864 - protein, 8 aa, Mycobacterium
KTRVGRRG

SEQ ID NO: 515865 - protein, 7 aa, Mycobacterium
KTSAELD

SEQ ID NO: 515866 - protein, 7 aa, Mycobacterium
KTSAPDK

SEQ ID NO: 515867 - protein, 8 aa, Mycobacterium
KTSDADLQ

SEQ ID NO: 515868 - protein, 5 aa, Mycobacterium
KTSDI

SEQ ID NO: 515869 - protein, 15 aa, Mycobacterium
KTSEANGPLANSRTG

SEQ ID NO: 515870 - protein, 8 aa, Mycobacterium
KTSEGQEA

SEQ ID NO: 515871 - protein, 7 aa, Mycobacterium
KTSFNTG

SEQ ID NO: 515872 - protein, 20 aa, Mycobacterium
KTSGCTRNLRTGDENDDPDQ

SEQ ID NO: 515873 - protein, 14 aa, Mycobacterium
KTSGIGARFGGPEG

SEQ ID NO: 515874 - protein, 7 aa, Mycobacterium
KTSGRAS

SEQ ID NO: 515875 - protein, 7 aa, Mycobacterium
KTSGSRG

SEQ ID NO: 515876 - protein, 8 aa, Mycobacterium
KTSGSRPN

SEQ ID NO: 515877 - protein, 12 aa, Mycobacterium
KTSIATSCGQET

SEQ ID NO: 515878 - protein, 12 aa, Mycobacterium
KTSKKVVKLLDA

SEQ ID NO: 515879 - protein, 4 aa, Mycobacterium
KTSL

SEQ ID NO: 515880 - protein, 21 aa, Mycobacterium
KTSNDRPKPEQPPQPKRRKGV

SEQ ID NO: 515881 - protein, 6 aa, Mycobacterium
KTSSAD

SEQ ID NO: 515882 - protein, 8 aa, Mycobacterium
KTSSAPAA

SEQ ID NO: 515883 - protein, 11 aa, Mycobacterium
KTSSSASEPDR

SEQ ID NO: 515884 - protein, 7 aa, Mycobacterium
KTSSVHH

SEQ ID NO: 515885 - protein, 6 aa, Mycobacterium
KTSTAH

SEQ ID NO: 515886 - protein, 7 aa, Mycobacterium
KTSTDHA

SEQ ID NO: 515887 - protein, 6 aa, Mycobacterium
KTSTIE

SEQ ID NO: 515888 - protein, 9 aa, Mycobacterium
KTSTVEHED

SEQ ID NO: 515889 - protein, 6 aa, Mycobacterium
KTSTVK

SEQ ID NO: 515890 - protein, 10 aa, Mycobacterium
KTSVGKFDKK

SEQ ID NO: 515891 - protein, 6 aa, Mycobacterium
KTSVRE

SEQ ID NO: 515892 - protein, 10 aa, Mycobacterium
KTTAAGQQYG

SEQ ID NO: 515893 - protein, 7 aa, Mycobacterium
KTTADYP

SEQ ID NO: 515894 - protein, 8 aa, Mycobacterium
KTTAEQRA

SEQ ID NO: 515895 - protein, 9 aa, Mycobacterium
KTTAEQRAG

SEQ ID NO: 515896 - protein, 8 aa, Mycobacterium
KTTAGPVT

SEQ ID NO: 515897 - protein, 12 aa, Mycobacterium
KTTATRTPSGYR

SEQ ID NO: 515898 - protein, 12 aa, Mycobacterium
KTTAVRTPSGYR

SEQ ID NO: 515899 - protein, 7 aa, Mycobacterium
KTTEHRP

SEQ ID NO: 515900 - protein, 6 aa, Mycobacterium
KTTFTE

SEQ ID NO: 515901 - protein, 9 aa, Mycobacterium
KTTGEDCTN

SEQ ID NO: 515902 - protein, 8 aa, Mycobacterium
KTTGGLDD

SEQ ID NO: 515903 - protein, 18 aa, Mycobacterium
KTTGGRATERHQDAVTPE

SEQ ID NO: 515904 - protein, 9 aa, Mycobacterium
KTTGQDCTN

SEQ ID NO: 515905 - protein, 7 aa, Mycobacterium
KTTGTMQ

SEQ ID NO: 515906 - protein, 8 aa, Mycobacterium
KTTKGKPE

SEQ ID NO: 515907 - protein, 16 aa, Mycobacterium
KTTKKDSADLGPEPER

SEQ ID NO: 515908 - protein, 6 aa, Mycobacterium
KTTMSD

SEQ ID NO: 515909 - protein, 14 aa, Mycobacterium
KTTNSSGEDQQEKL

SEQ ID NO: 515910 - protein, 9 aa, Mycobacterium
KTTPSQRQK

SEQ ID NO: 515911 - protein, 5 aa, Mycobacterium
KTTPT

SEQ ID NO: 515912 - protein, 6 aa, Mycobacterium
KTTQAR

SEQ ID NO: 515913 - protein, 7 aa, Mycobacterium
KTTQGAS

SEQ ID NO: 515914 - protein, 7 aa, Mycobacterium
KTTQLGG

SEQ ID NO: 515915 - protein, 5 aa, Mycobacterium
KTTRD

SEQ ID NO: 515916 - protein, 5 aa, Mycobacterium
KTTRV

SEQ ID NO: 515917 - protein, 6 aa, Mycobacterium
KTTSAE

SEQ ID NO: 515918 - protein, 6 aa, Mycobacterium
KTTSVN

SEQ ID NO: 515919 - protein, 4 aa, Mycobacterium
KTTT

SEQ ID NO: 515920 - protein, 9 aa, Mycobacterium
KTTTEQRAQ

SEQ ID NO: 515921 - protein, 8 aa, Mycobacterium
KTTTGREL

SEQ ID NO: 515922 - protein, 5 aa, Mycobacterium
KTTTL

SEQ ID NO: 515923 - protein, 6 aa, Mycobacterium
KTTTLG

SEQ ID NO: 515924 - protein, 7 aa, Mycobacterium
KTTTLGG

SEQ ID NO: 515925 - protein, 8 aa, Mycobacterium
KTTTPEYS

SEQ ID NO: 515926 - protein, 6 aa, Mycobacterium
KTTTTI

SEQ ID NO: 515927 - protein, 6 aa, Mycobacterium
KTTTVA

SEQ ID NO: 515928 - protein, 6 aa, Mycobacterium
KTTTVD

SEQ ID NO: 515929 - protein, 6 aa, Mycobacterium
KTTTVE

SEQ ID NO: 515930 - protein, 5 aa, Mycobacterium
KTTVT

SEQ ID NO: 515931 - protein, 12 aa, Mycobacterium
KTVADSKGDIQR

SEQ ID NO: 515932 - protein, 10 aa, Mycobacterium
KTVADSLGDI

SEQ ID NO: 515933 - protein, 12 aa, Mycobacterium
KTVADSRGDVQR

SEQ ID NO: 515934 - protein, 8 aa, Mycobacterium
KTVASGPL

SEQ ID NO: 515935 - protein, 5 aa, Mycobacterium
KTVDE

SEQ ID NO: 515936 - protein, 6 aa, Mycobacterium
KTVDGF

SEQ ID NO: 515937 - protein, 13 aa, Mycobacterium
KTVEAGAPAPEAV

SEQ ID NO: 515938 - protein, 13 aa, Mycobacterium
KTVEEHGSDAPDV

SEQ ID NO: 515939 - protein, 16 aa, Mycobacterium
KTVESAAGAAPAATSD

SEQ ID NO: 515940 - protein, 13 aa, Mycobacterium
KTVESPDHPGKAQ

SEQ ID NO: 515941 - protein, 18 aa, Mycobacterium
KTVKRKRTGTALTPQETQ

SEQ ID NO: 515942 - protein, 10 aa, Mycobacterium
KTVKTYPKTD

SEQ ID NO: 515943 - protein, 6 aa, Mycobacterium
KTVPAG

SEQ ID NO: 515944 - protein, 7 aa, Mycobacterium
KTVPDAK

SEQ ID NO: 515945 - protein, 5 aa, Mycobacterium
KTVPG

SEQ ID NO: 515946 - protein, 14 aa, Mycobacterium
KTVPGDDAAANLGT

SEQ ID NO: 515947 - protein, 10 aa, Mycobacterium
KTVPGDTAAQ

SEQ ID NO: 515948 - protein, 11 aa, Mycobacterium
KTVPGDTAAQH

SEQ ID NO: 515949 - protein, 10 aa, Mycobacterium
KTVPGDTATS

SEQ ID NO: 515950 - protein, 7 aa, Mycobacterium
KTVPTPP

SEQ ID NO: 515951 - protein, 5 aa, Mycobacterium
KTVSD

SEQ ID NO: 515952 - protein, 15 aa, Mycobacterium
KTVSRSSSSTYAEDS

SEQ ID NO: 515953 - protein, 6 aa, Mycobacterium
KTVTAV

SEQ ID NO: 515954 - protein, 80 aa, Mycobacterium
KTVTDEANRARRAAASQAKADERADEKADEKAEETVEETTEAPAEESTEAAAEETVEETTEAPAEESTEAAEESEAKDDT

SEQ ID NO: 515955 - protein, 5 aa, Mycobacterium
KTVTE

SEQ ID NO: 515956 - protein, 22 aa, Mycobacterium
KTVTERWPSGIKDGAEFVIPTM

SEQ ID NO: 515957 - protein, 7 aa, Mycobacterium
KTVTQRW

SEQ ID NO: 515958 - protein, 28 aa, Mycobacterium
KTVTSEADRARRVASTKKAEAPAEEAKV

SEQ ID NO: 515959 - protein, 23 aa, Mycobacterium
KTVTSEADRARRVKASKKSDAPV

SEQ ID NO: 515960 - protein, 99 aa, Mycobacterium
KTVTSEADRARRVKASKKSDAPVAAAAAPQAAVEPEEAVGPTAEEATAEAGETKPETQASEASDEPTKAQAEAEDKADKAVAARAEAEAAEKANDEADE

SEQ ID NO: 515961 - protein, 26 aa, Mycobacterium
KTVTSEADRARRVKASKQASQDVAAP

SEQ ID NO: 515962 - protein, 53 aa, Mycobacterium
KTVTSEANRARRADAAQKVAAAAAPQAAVEPEVTEGPSADEAEAVAETPIADE

SEQ ID NO: 515963 - protein, 22 aa, Mycobacterium
KTVTSRWPSGIKDGAEFSIPTM

SEQ ID NO: 515964 - protein, 5 aa, Mycobacterium
KTVYP

SEQ ID NO: 515965 - protein, 4 aa, Mycobacterium
KTWE

SEQ ID NO: 515966 - protein, 5 aa, Mycobacterium
KTWER

SEQ ID NO: 515967 - protein, 5 aa, Mycobacterium
KTWKA

SEQ ID NO: 515968 - protein, 6 aa, Mycobacterium
KTWKEG

SEQ ID NO: 515969 - protein, 7 aa, Mycobacterium
KTWKPGD

SEQ ID NO: 515970 - protein, 5 aa, Mycobacterium
KTWNT

SEQ ID NO: 515971 - protein, 8 aa, Mycobacterium
KTWSNPAE

SEQ ID NO: 515972 - protein, 8 aa, Mycobacterium
KTWSTSAF

SEQ ID NO: 515973 - protein, 7 aa, Mycobacterium
KTWTTPR

SEQ ID NO: 515974 - protein, 7 aa, Mycobacterium
KTYDPDN

SEQ ID NO: 515975 - protein, 12 aa, Mycobacterium
KTYGDDDGNEHR

SEQ ID NO: 515976 - protein, 7 aa, Mycobacterium
KTYGHTS

SEQ ID NO: 515977 - protein, 7 aa, Mycobacterium
KTYGRTS

SEQ ID NO: 515978 - protein, 13 aa, Mycobacterium
KTYGTTDPRHPGV

SEQ ID NO: 515979 - protein, 5 aa, Mycobacterium
KTYNA

SEQ ID NO: 515980 - protein, 15 aa, Mycobacterium
KTYNPAEGLPVREGQ

SEQ ID NO: 515981 - protein, 5 aa, Mycobacterium
KTYPQ

SEQ ID NO: 515982 - protein, 7 aa, Mycobacterium
KTYRDFS

SEQ ID NO: 515983 - protein, 4 aa, Mycobacterium
KVAA

SEQ ID NO: 515984 - protein, 5 aa, Mycobacterium
KVAAA

SEQ ID NO: 515985 - protein, 17 aa, Mycobacterium
KVAAGNAQRLFKDKIPA

SEQ ID NO: 515986 - protein, 21 aa, Mycobacterium
KVAATTGASVSVTADPRSAVA

SEQ ID NO: 515987 - protein, 5 aa, Mycobacterium
KVADA

SEQ ID NO: 515988 - protein, 31 aa, Mycobacterium
KVADDREAEGVAGKPSDRESAPTLGSENEPP

SEQ ID NO: 515989 - protein, 8 aa, Mycobacterium
KVADQAGK

SEQ ID NO: 515990 - protein, 26 aa, Mycobacterium
KVADRASDAYDKARDAAGRLRAEEEK

SEQ ID NO: 515991 - protein, 8 aa, Mycobacterium
KVAEADRT

SEQ ID NO: 515992 - protein, 13 aa, Mycobacterium
KVAEDADEQRSER

SEQ ID NO: 515993 - protein, 31 aa, Mycobacterium
KVAEEREAEGVPGKPSDRERAAPGGSEDEPP

SEQ ID NO: 515994 - protein, 10 aa, Mycobacterium
KVAEPGQTLA

SEQ ID NO: 515995 - protein, 11 aa, Mycobacterium
KVAEPGQTLAD

SEQ ID NO: 515996 - protein, 11 aa, Mycobacterium
KVAEPGQTLDE

SEQ ID NO: 515997 - protein, 31 aa, Mycobacterium
KVAGDREAEDVPGKPSDREHAAVRGSDNEPP

SEQ ID NO: 515998 - protein, 11 aa, Mycobacterium
KVAGPRDPGCP

SEQ ID NO: 515999 - protein, 5 aa, Mycobacterium
KVAGW

SEQ ID NO: 516000 - protein, 8 aa, Mycobacterium
KVAKQRAQ

SEQ ID NO: 516001 - protein, 4 aa, Mycobacterium
KVAP

SEQ ID NO: 516002 - protein, 7 aa, Mycobacterium
KVAPATA

SEQ ID NO: 516003 - protein, 5 aa, Mycobacterium
KVAPG

SEQ ID NO: 516004 - protein, 10 aa, Mycobacterium
KVAPGRMNRP

SEQ ID NO: 516005 - protein, 9 aa, Mycobacterium
KVAPSPARV

SEQ ID NO: 516006 - protein, 5 aa, Mycobacterium
KVAQP

SEQ ID NO: 516007 - protein, 9 aa, Mycobacterium
KVARGESVP

SEQ ID NO: 516008 - protein, 26 aa, Mycobacterium
KVARNRKKAAEKGEREDTAEKRRANV

SEQ ID NO: 516009 - protein, 9 aa, Mycobacterium
KVARPNAPF

SEQ ID NO: 516010 - protein, 4 aa, Mycobacterium
KVAS

SEQ ID NO: 516011 - protein, 16 aa, Mycobacterium
KVASGPLGRSDQITGA

SEQ ID NO: 516012 - protein, 18 aa, Mycobacterium
KVASRYPAQLSGGEQQRV

SEQ ID NO: 516013 - protein, 5 aa, Mycobacterium
KVASW

SEQ ID NO: 516014 - protein, 9 aa, Mycobacterium
KVATKRTAV

SEQ ID NO: 516015 - protein, 6 aa, Mycobacterium
KVATRA

SEQ ID NO: 516016 - protein, 9 aa, Mycobacterium
KVCDQGDHR

SEQ ID NO: 516017 - protein, 4 aa, Mycobacterium
KVDA

SEQ ID NO: 516018 - protein, 10 aa, Mycobacterium
KVDADADPAV

SEQ ID NO: 516019 - protein, 10 aa, Mycobacterium
KVDAKQPEDY

SEQ ID NO: 516020 - protein, 8 aa, Mycobacterium
KVDARGQT

SEQ ID NO: 516021 - protein, 8 aa, Mycobacterium
KVDDAEAR

SEQ ID NO: 516022 - protein, 6 aa, Mycobacterium
KVDDDI

SEQ ID NO: 516023 - protein, 10 aa, Mycobacterium
KVDDPEARRT

SEQ ID NO: 516024 - protein, 6 aa, Mycobacterium
KVDDRA

SEQ ID NO: 516025 - protein, 7 aa, Mycobacterium
KVDEVTS

SEQ ID NO: 516026 - protein, 4 aa, Mycobacterium
KVDG

SEQ ID NO: 516027 - protein, 8 aa, Mycobacterium
KVDGASQP

SEQ ID NO: 516028 - protein, 11 aa, Mycobacterium
KVDGSGGIRGP

SEQ ID NO: 516029 - protein, 11 aa, Mycobacterium
KVDPAADPAAA

SEQ ID NO: 516030 - protein, 9 aa, Mycobacterium
KVDPANPAY

SEQ ID NO: 516031 - protein, 9 aa, Mycobacterium
KVDPAQTAD

SEQ ID NO: 516032 - protein, 14 aa, Mycobacterium
KVDPDDPESNQRKV

SEQ ID NO: 516033 - protein, 7 aa, Mycobacterium
KVDPDNP

SEQ ID NO: 516034 - protein, 8 aa, Mycobacterium
KVDPGNPA

SEQ ID NO: 516035 - protein, 7 aa, Mycobacterium
KVDPQSD

SEQ ID NO: 516036 - protein, 7 aa, Mycobacterium
KVDPRSD

SEQ ID NO: 516037 - protein, 9 aa, Mycobacterium
KVDPTADPA

SEQ ID NO: 516038 - protein, 21 aa, Mycobacterium
KVDQGNQDAQHTDQSAAGAWH

SEQ ID NO: 516039 - protein, 4 aa, Mycobacterium
KVDR

SEQ ID NO: 516040 - protein, 5 aa, Mycobacterium
KVDRT

SEQ ID NO: 516041 - protein, 11 aa, Mycobacterium
KVDSDKAEADA

SEQ ID NO: 516042 - protein, 19 aa, Mycobacterium
KVDSGSQVINSTKGKKERL

SEQ ID NO: 516043 - protein, 9 aa, Mycobacterium
KVDSHGREV

SEQ ID NO: 516044 - protein, 38 aa, Mycobacterium
KVDSTVSAEGRAAGAQAQWSAAATSVTTGTGDTATAGE

SEQ ID NO: 516045 - protein, 14 aa, Mycobacterium
KVDTRDASYLGRVN

SEQ ID NO: 516046 - protein, 14 aa, Mycobacterium
KVDTRDGSYLGRVN

SEQ ID NO: 516047 - protein, 8 aa, Mycobacterium
KVEAGYDP

SEQ ID NO: 516048 - protein, 24 aa, Mycobacterium
KVEAKKVDKAVQDSVKKSKPPEIK

SEQ ID NO: 516049 - protein, 14 aa, Mycobacterium
KVEDDTERAGRKVS

SEQ ID NO: 516050 - protein, 8 aa, Mycobacterium
KVEDGRTD

SEQ ID NO: 516051 - protein, 9 aa, Mycobacterium
KVEDTQRRE

SEQ ID NO: 516052 - protein, 9 aa, Mycobacterium
KVEDTQRRQ

SEQ ID NO: 516053 - protein, 6 aa, Mycobacterium
KVEETA

SEQ ID NO: 516054 - protein, 9 aa, Mycobacterium
KVEEVRDGG

SEQ ID NO: 516055 - protein, 4 aa, Mycobacterium
KVEG

SEQ ID NO: 516056 - protein, 18 aa, Mycobacterium
KVEGDTAAVQQALNVALT

SEQ ID NO: 516057 - protein, 5 aa, Mycobacterium
KVEGR

SEQ ID NO: 516058 - protein, 7 aa, Mycobacterium
KVEGRRN

SEQ ID NO: 516059 - protein, 9 aa, Mycobacterium
KVEGTQGSR

SEQ ID NO: 516060 - protein, 8 aa, Mycobacterium
KVENDRSV

SEQ ID NO: 516061 - protein, 8 aa, Mycobacterium
KVEPPQGD

SEQ ID NO: 516062 - protein, 10 aa, Mycobacterium
KVEPPSGDPL

SEQ ID NO: 516063 - protein, 5 aa, Mycobacterium
KVEQG

SEQ ID NO: 516064 - protein, 22 aa, Mycobacterium
KVERLGADAARPHRVTHRKLTR

SEQ ID NO: 516065 - protein, 8 aa, Mycobacterium
KVERRSAR

SEQ ID NO: 516066 - protein, 6 aa, Mycobacterium
KVERVQ

SEQ ID NO: 516067 - protein, 7 aa, Mycobacterium
KVESFGG

SEQ ID NO: 516068 - protein, 12 aa, Mycobacterium
KVESISDNGAEV

SEQ ID NO: 516069 - protein, 12 aa, Mycobacterium
KVETDTPRGPAG

SEQ ID NO: 516070 - protein, 10 aa, Mycobacterium
KVGADEGEVT

SEQ ID NO: 516071 - protein, 9 aa, Mycobacterium
KVGAGLDET

SEQ ID NO: 516072 - protein, 4 aa, Mycobacterium
KVGD

SEQ ID NO: 516073 - protein, 9 aa, Mycobacterium
KVGDAGNED

SEQ ID NO: 516074 - protein, 11 aa, Mycobacterium
KVGDKAKAFDD

SEQ ID NO: 516075 - protein, 16 aa, Mycobacterium
KVGDPGDQSAIGPVAS

SEQ ID NO: 516076 - protein, 20 aa, Mycobacterium
KVGDPSDKKAIGPVASKAQF

SEQ ID NO: 516077 - protein, 15 aa, Mycobacterium
KVGDTIDSKTGGKYS

SEQ ID NO: 516078 - protein, 13 aa, Mycobacterium
KVGEAPKQSGIAL

SEQ ID NO: 516079 - protein, 14 aa, Mycobacterium
KVGEAPKQSGIALP

SEQ ID NO: 516080 - protein, 5 aa, Mycobacterium
KVGEE

SEQ ID NO: 516081 - protein, 9 aa, Mycobacterium
KVGEESALT

SEQ ID NO: 516082 - protein, 6 aa, Mycobacterium
KVGEET

SEQ ID NO: 516083 - protein, 7 aa, Mycobacterium
KVGEHTG

SEQ ID NO: 516084 - protein, 13 aa, Mycobacterium
KVGESRTYTVPSG

SEQ ID NO: 516085 - protein, 7 aa, Mycobacterium
KVGETNP

SEQ ID NO: 516086 - protein, 7 aa, Mycobacterium
KVGGADA

SEQ ID NO: 516087 - protein, 6 aa, Mycobacterium
KVGGAR

SEQ ID NO: 516088 - protein, 7 aa, Mycobacterium
KVGGDDG

SEQ ID NO: 516089 - protein, 7 aa, Mycobacterium
KVGGDGV

SEQ ID NO: 516090 - protein, 11 aa, Mycobacterium
KVGGRGKAGGV

SEQ ID NO: 516091 - protein, 21 aa, Mycobacterium
KVGGRGKAGGVKYAATPDDAF

SEQ ID NO: 516092 - protein, 21 aa, Mycobacterium
KVGGRGKAGGVKYAATPDDAL

SEQ ID NO: 516093 - protein, 23 aa, Mycobacterium
KVGGRGKAGGVKYAATPDDAYEH

SEQ ID NO: 516094 - protein, 13 aa, Mycobacterium
KVGGRNEHASGYE

SEQ ID NO: 516095 - protein, 8 aa, Mycobacterium
KVGLDDPI

SEQ ID NO: 516096 - protein, 7 aa, Mycobacterium
KVGLDSP

SEQ ID NO: 516097 - protein, 6 aa, Mycobacterium
KVGNFS

SEQ ID NO: 516098 - protein, 23 aa, Mycobacterium
KVGNGDAVVRPSGAGIHEVDVKI

SEQ ID NO: 516099 - protein, 17 aa, Mycobacterium
KVGPAGAAAPALNGNAV

SEQ ID NO: 516100 - protein, 16 aa, Mycobacterium
KVGPAGSAATAPAVNG

SEQ ID NO: 516101 - protein, 5 aa, Mycobacterium
KVGPD

SEQ ID NO: 516102 - protein, 10 aa, Mycobacterium
KVGPDVGTPT

SEQ ID NO: 516103 - protein, 6 aa, Mycobacterium
KVGPEQ

SEQ ID NO: 516104 - protein, 10 aa, Mycobacterium
KVGPGDTAAA

SEQ ID NO: 516105 - protein, 8 aa, Mycobacterium
KVGPGESL

SEQ ID NO: 516106 - protein, 8 aa, Mycobacterium
KVGPGKAQ

SEQ ID NO: 516107 - protein, 8 aa, Mycobacterium
KVGQASGH

SEQ ID NO: 516108 - protein, 10 aa, Mycobacterium
KVGRAEPNRR

SEQ ID NO: 516109 - protein, 9 aa, Mycobacterium
KVGRGSPWA

SEQ ID NO: 516110 - protein, 10 aa, Mycobacterium
KVGRSQDANY

SEQ ID NO: 516111 - protein, 20 aa, Mycobacterium
KVGSADDATAIGPVASRTQF

SEQ ID NO: 516112 - protein, 8 aa, Mycobacterium
KVGSAGRA

SEQ ID NO: 516113 - protein, 15 aa, Mycobacterium
KVGSDDDHAAAAADG

SEQ ID NO: 516114 - protein, 7 aa, Mycobacterium
KVGSEDV

SEQ ID NO: 516115 - protein, 5 aa, Mycobacterium
KVGSR

SEQ ID NO: 516116 - protein, 5 aa, Mycobacterium
KVGSS

SEQ ID NO: 516117 - protein, 4 aa, Mycobacterium
KVGT

SEQ ID NO: 516118 - protein, 9 aa, Mycobacterium
KVGTAGDSD

SEQ ID NO: 516119 - protein, 5 aa, Mycobacterium
KVGTD

SEQ ID NO: 516120 - protein, 15 aa, Mycobacterium
KVGTPQAVYREPNDR

SEQ ID NO: 516121 - protein, 15 aa, Mycobacterium
KVGTSRRFSSATPET

SEQ ID NO: 516122 - protein, 15 aa, Mycobacterium
KVGTTRRFSTTTRES

SEQ ID NO: 516123 - protein, 8 aa, Mycobacterium
KVHPDDEA

SEQ ID NO: 516124 - protein, 12 aa, Mycobacterium
KVHYGDKTPVSL

SEQ ID NO: 516125 - protein, 5 aa, Mycobacterium
KVKAA

SEQ ID NO: 516126 - protein, 9 aa, Mycobacterium
KVKGKVGDA

SEQ ID NO: 516127 - protein, 8 aa, Mycobacterium
KVKNQAEV

SEQ ID NO: 516128 - protein, 7 aa, Mycobacterium
KVKPALD

SEQ ID NO: 516129 - protein, 6 aa, Mycobacterium
KVKPGY

SEQ ID NO: 516130 - protein, 5 aa, Mycobacterium
KVKQR

SEQ ID NO: 516131 - protein, 15 aa, Mycobacterium
KVKSERDSAAVKSSL

SEQ ID NO: 516132 - protein, 17 aa, Mycobacterium
KVKSERDSGAVKSSLAE

SEQ ID NO: 516133 - protein, 6 aa, Mycobacterium
KVKSGD

SEQ ID NO: 516134 - protein, 8 aa, Mycobacterium
KVKTDKVD

SEQ ID NO: 516135 - protein, 18 aa, Mycobacterium
KVLDEDGNEVEPGSGKRG

SEQ ID NO: 516136 - protein, 7 aa, Mycobacterium
KVLPGGT

SEQ ID NO: 516137 - protein, 8 aa, Mycobacterium
KVLPGGTG

SEQ ID NO: 516138 - protein, 7 aa, Mycobacterium
KVNADPL

SEQ ID NO: 516139 - protein, 8 aa, Mycobacterium
KVNALGPT

SEQ ID NO: 516140 - protein, 9 aa, Mycobacterium
KVNALGPTM

SEQ ID NO: 516141 - protein, 10 aa, Mycobacterium
KVNAQQPDDY

SEQ ID NO: 516142 - protein, 12 aa, Mycobacterium
KVNAQSEGERAA

SEQ ID NO: 516143 - protein, 9 aa, Mycobacterium
KVNDELGHD

SEQ ID NO: 516144 - protein, 49 aa, Mycobacterium
KVNKASRSGGGGGGFGSGGGGSRQSEPKDDPWGSAPASGSFSGADDEPP

SEQ ID NO: 516145 - protein, 5 aa, Mycobacterium
KVNKT

SEQ ID NO: 516146 - protein, 8 aa, Mycobacterium
KVNPNGGA

SEQ ID NO: 516147 - protein, 5 aa, Mycobacterium
KVNTD

SEQ ID NO: 516148 - protein, 6 aa, Mycobacterium
KVNVNG

SEQ ID NO: 516149 - protein, 5 aa, Mycobacterium
KVPAD

SEQ ID NO: 516150 - protein, 7 aa, Mycobacterium
KVPAGRR

SEQ ID NO: 516151 - protein, 12 aa, Mycobacterium
KVPASVSGGTAT

SEQ ID NO: 516152 - protein, 5 aa, Mycobacterium
KVPAT

SEQ ID NO: 516153 - protein, 10 aa, Mycobacterium
KVPDEATAGD

SEQ ID NO: 516154 - protein, 7 aa, Mycobacterium
KVPDELR

SEQ ID NO: 516155 - protein, 9 aa, Mycobacterium
KVPDPDGGY

SEQ ID NO: 516156 - protein, 6 aa, Mycobacterium
KVPECE

SEQ ID NO: 516157 - protein, 7 aa, Mycobacterium
KVPEGTA

SEQ ID NO: 516158 - protein, 4 aa, Mycobacterium
KVPF

SEQ ID NO: 516159 - protein, 4 aa, Mycobacterium
KVPG

SEQ ID NO: 516160 - protein, 5 aa, Mycobacterium
KVPGA

SEQ ID NO: 516161 - protein, 7 aa, Mycobacterium
KVPGAEA

SEQ ID NO: 516162 - protein, 5 aa, Mycobacterium
KVPGR

SEQ ID NO: 516163 - protein, 8 aa, Mycobacterium
KVPGSGGV

SEQ ID NO: 516164 - protein, 7 aa, Mycobacterium
KVPKDQV

SEQ ID NO: 516165 - protein, 15 aa, Mycobacterium
KVPKSLPKGLGTETV

SEQ ID NO: 516166 - protein, 7 aa, Mycobacterium
KVPLETA

SEQ ID NO: 516167 - protein, 5 aa, Mycobacterium
KVPLT

SEQ ID NO: 516168 - protein, 8 aa, Mycobacterium
KVPPAVRA

SEQ ID NO: 516169 - protein, 5 aa, Mycobacterium
KVPPG

SEQ ID NO: 516170 - protein, 9 aa, Mycobacterium
KVPPSGSPG

SEQ ID NO: 516171 - protein, 7 aa, Mycobacterium
KVPPSPD

SEQ ID NO: 516172 - protein, 8 aa, Mycobacterium
KVPQPGDV

SEQ ID NO: 516173 - protein, 4 aa, Mycobacterium
KVPR

SEQ ID NO: 516174 - protein, 13 aa, Mycobacterium
KVPRDKRSERRDE

SEQ ID NO: 516175 - protein, 10 aa, Mycobacterium
KVPREQQADL

SEQ ID NO: 516176 - protein, 9 aa, Mycobacterium
KVPRERAAD

SEQ ID NO: 516177 - protein, 9 aa, Mycobacterium
KVPRERAAE

SEQ ID NO: 516178 - protein, 10 aa, Mycobacterium
KVPRERSAEL

SEQ ID NO: 516179 - protein, 10 aa, Mycobacterium
KVPRERTAEL

SEQ ID NO: 516180 - protein, 7 aa, Mycobacterium
KVPRFAG

SEQ ID NO: 516181 - protein, 6 aa, Mycobacterium
KVPRPA

SEQ ID NO: 516182 - protein, 4 aa, Mycobacterium
KVPS

SEQ ID NO: 516183 - protein, 13 aa, Mycobacterium
KVPSWQYPGGYAE

SEQ ID NO: 516184 - protein, 7 aa, Mycobacterium
KVPTDRK

SEQ ID NO: 516185 - protein, 6 aa, Mycobacterium
KVPTPL

SEQ ID NO: 516186 - protein, 6 aa, Mycobacterium
KVPTSR

SEQ ID NO: 516187 - protein, 8 aa, Mycobacterium
KVPVEDGT

SEQ ID NO: 516188 - protein, 13 aa, Mycobacterium
KVPVGPAPTPSGW

SEQ ID NO: 516189 - protein, 7 aa, Mycobacterium
KVPVKDA

SEQ ID NO: 516190 - protein, 5 aa, Mycobacterium
KVQGG

SEQ ID NO: 516191 - protein, 9 aa, Mycobacterium
KVQGPGPVT

SEQ ID NO: 516192 - protein, 12 aa, Mycobacterium
KVQNQVSERNEW

SEQ ID NO: 516193 - protein, 21 aa, Mycobacterium
KVQPSTGAAAAAAPNGAVPAG

SEQ ID NO: 516194 - protein, 4 aa, Mycobacterium
KVQR

SEQ ID NO: 516195 - protein, 9 aa, Mycobacterium
KVRAAHTPA

SEQ ID NO: 516196 - protein, 8 aa, Mycobacterium
KVRAERPT

SEQ ID NO: 516197 - protein, 19 aa, Mycobacterium
KVRAGYDAPFPDKTYQAGA

SEQ ID NO: 516198 - protein, 7 aa, Mycobacterium
KVRAPDG

SEQ ID NO: 516199 - protein, 36 aa, Mycobacterium
KVRAQESAKPRRRSWQNPGGNSTKRREAHMRRIRRL

SEQ ID NO: 516200 - protein, 22 aa, Mycobacterium
KVRDAGEADWSDPQAQARAEQF

SEQ ID NO: 516201 - protein, 54 aa, Mycobacterium
KVRDAGEADWSDPQAQARAEQFRTRAEQYEQQAQKAAAAGRTKEAEEARANAEQ

SEQ ID NO: 516202 - protein, 22 aa, Mycobacterium
KVRDAGESDWADPQAQARAEQF

SEQ ID NO: 516203 - protein, 8 aa, Mycobacterium
KVRDDPRS

SEQ ID NO: 516204 - protein, 6 aa, Mycobacterium
KVRDRA

SEQ ID NO: 516205 - protein, 23 aa, Mycobacterium
KVREAGESGWGDPEAEARAEQFR

SEQ ID NO: 516206 - protein, 21 aa, Mycobacterium
KVREAGESNWSDPQAQARAEQ

SEQ ID NO: 516207 - protein, 10 aa, Mycobacterium
KVRETSSNTT

SEQ ID NO: 516208 - protein, 8 aa, Mycobacterium
KVRGAGVP

SEQ ID NO: 516209 - protein, 5 aa, Mycobacterium
KVRGE

SEQ ID NO: 516210 - protein, 7 aa, Mycobacterium
KVRGEMA

SEQ ID NO: 516211 - protein, 14 aa, Mycobacterium
KVRGGPPADDPQDL

SEQ ID NO: 516212 - protein, 5 aa, Mycobacterium
KVRGR

SEQ ID NO: 516213 - protein, 17 aa, Mycobacterium
KVRNPGATREFRIVRGK

SEQ ID NO: 516214 - protein, 5 aa, Mycobacterium
KVRPG

SEQ ID NO: 516215 - protein, 6 aa, Mycobacterium
KVRPGE

SEQ ID NO: 516216 - protein, 6 aa, Mycobacterium
KVRPSE

SEQ ID NO: 516217 - protein, 12 aa, Mycobacterium
KVRQSGNSAPVH

SEQ ID NO: 516218 - protein, 5 aa, Mycobacterium
KVRRA

SEQ ID NO: 516219 - protein, 6 aa, Mycobacterium
KVRRPD

SEQ ID NO: 516220 - protein, 13 aa, Mycobacterium
KVRTGGPVEDPED

SEQ ID NO: 516221 - protein, 8 aa, Mycobacterium
KVRTPTTT

SEQ ID NO: 516222 - protein, 5 aa, Mycobacterium
KVRTR

SEQ ID NO: 516223 - protein, 14 aa, Mycobacterium
KVRTRAADLERTGR

SEQ ID NO: 516224 - protein, 19 aa, Mycobacterium
KVRTYATPREKKVTGWPFR

SEQ ID NO: 516225 - protein, 5 aa, Mycobacterium
KVRVE

SEQ ID NO: 516226 - protein, 16 aa, Mycobacterium
KVRVPGANGPVEVSPR

SEQ ID NO: 516227 - protein, 12 aa, Mycobacterium
KVSAADNPGAVA

SEQ ID NO: 516228 - protein, 7 aa, Mycobacterium
KVSAEET

SEQ ID NO: 516229 - protein, 9 aa, Mycobacterium
KVSAEETAE

SEQ ID NO: 516230 - protein, 9 aa, Mycobacterium
KVSAGGMPD

SEQ ID NO: 516231 - protein, 4 aa, Mycobacterium
KVSD

SEQ ID NO: 516232 - protein, 7 aa, Mycobacterium
KVSDDDM

SEQ ID NO: 516233 - protein, 9 aa, Mycobacterium
KVSETTAHG

SEQ ID NO: 516234 - protein, 9 aa, Mycobacterium
KVSETTEHG

SEQ ID NO: 516235 - protein, 9 aa, Mycobacterium
KVSETTQHG

SEQ ID NO: 516236 - protein, 8 aa, Mycobacterium
KVSGDDAA

SEQ ID NO: 516237 - protein, 6 aa, Mycobacterium
KVSGGA

SEQ ID NO: 516238 - protein, 9 aa, Mycobacterium
KVSGTAERP

SEQ ID NO: 516239 - protein, 9 aa, Mycobacterium
KVSGTDARP

SEQ ID NO: 516240 - protein, 5 aa, Mycobacterium
KVSGV

SEQ ID NO: 516241 - protein, 9 aa, Mycobacterium
KVSKDRVGE

SEQ ID NO: 516242 - protein, 8 aa, Mycobacterium
KVSKERVA

SEQ ID NO: 516243 - protein, 10 aa, Mycobacterium
KVSKQPANRE

SEQ ID NO: 516244 - protein, 15 aa, Mycobacterium
KVSLPGRSLLVLRKT

SEQ ID NO: 516245 - protein, 15 aa, Mycobacterium
KVSLPSRSLLILRKT

SEQ ID NO: 516246 - protein, 6 aa, Mycobacterium
KVSNRP

SEQ ID NO: 516247 - protein, 19 aa, Mycobacterium
KVSNSPAGTGLNAATGEYE

SEQ ID NO: 516248 - protein, 10 aa, Mycobacterium
KVSPDGHTVT

SEQ ID NO: 516249 - protein, 7 aa, Mycobacterium
KVSPISC

SEQ ID NO: 516250 - protein, 12 aa, Mycobacterium
KVSSGTDTGSLR

SEQ ID NO: 516251 - protein, 6 aa, Mycobacterium
KVSTGY

SEQ ID NO: 516252 - protein, 9 aa, Mycobacterium
KVTAEATQE

SEQ ID NO: 516253 - protein, 10 aa, Mycobacterium
KVTDSTGADV

SEQ ID NO: 516254 - protein, 8 aa, Mycobacterium
KVTEEVTE

SEQ ID NO: 516255 - protein, 8 aa, Mycobacterium
KVTEPADL

SEQ ID NO: 516256 - protein, 5 aa, Mycobacterium
KVTES

SEQ ID NO: 516257 - protein, 10 aa, Mycobacterium
KVTGAAFPGG

SEQ ID NO: 516258 - protein, 7 aa, Mycobacterium
KVTGGRP

SEQ ID NO: 516259 - protein, 8 aa, Mycobacterium
KVTGPDGV

SEQ ID NO: 516260 - protein, 6 aa, Mycobacterium
KVTGTA

SEQ ID NO: 516261 - protein, 7 aa, Mycobacterium
KVTNAAK

SEQ ID NO: 516262 - protein, 6 aa, Mycobacterium
KVTPDS

SEQ ID NO: 516263 - protein, 7 aa, Mycobacterium
KVTPDYR

SEQ ID NO: 516264 - protein, 14 aa, Mycobacterium
KVTRDENGTRTDAR

SEQ ID NO: 516265 - protein, 7 aa, Mycobacterium
KVTSDEL

SEQ ID NO: 516266 - protein, 8 aa, Mycobacterium
KVTSGELG

SEQ ID NO: 516267 - protein, 8 aa, Mycobacterium
KVTSTELG

SEQ ID NO: 516268 - protein, 6 aa, Mycobacterium
KVTTPG

SEQ ID NO: 516269 - protein, 11 aa, Mycobacterium
KVTTPKSDAGI

SEQ ID NO: 516270 - protein, 5 aa, Mycobacterium
KVVED

SEQ ID NO: 516271 - protein, 7 aa, Mycobacterium
KVVGGRD

SEQ ID NO: 516272 - protein, 9 aa, Mycobacterium
KVVGKGAAD

SEQ ID NO: 516273 - protein, 4 aa, Mycobacterium
KVVT

SEQ ID NO: 516274 - protein, 5 aa, Mycobacterium
KVYDG

SEQ ID NO: 516275 - protein, 10 aa, Mycobacterium
KVYGSTKALD

SEQ ID NO: 516276 - protein, 12 aa, Mycobacterium
KWDKESGQVVRT

SEQ ID NO: 516277 - protein, 7 aa, Mycobacterium
KWEPTAG

SEQ ID NO: 516278 - protein, 14 aa, Mycobacterium
KWESPQSPTPSDGS

SEQ ID NO: 516279 - protein, 13 aa, Mycobacterium
KWESSQSPTPNTS

SEQ ID NO: 516280 - protein, 5 aa, Mycobacterium
KWGAR

SEQ ID NO: 516281 - protein, 8 aa, Mycobacterium
KWGARGGA

SEQ ID NO: 516282 - protein, 5 aa, Mycobacterium
KWGGE

SEQ ID NO: 516283 - protein, 8 aa, Mycobacterium
KWGPRGDT

SEQ ID NO: 516284 - protein, 8 aa, Mycobacterium
KWGRRGSA

SEQ ID NO: 516285 - protein, 6 aa, Mycobacterium
KWGSSG

SEQ ID NO: 516286 - protein, 17 aa, Mycobacterium
KWGTGYSKQQATRPQTL

SEQ ID NO: 516287 - protein, 17 aa, Mycobacterium
KWGTGYSKQQSTRPQTL

SEQ ID NO: 516288 - protein, 5 aa, Mycobacterium
KWPDI

SEQ ID NO: 516289 - protein, 5 aa, Mycobacterium
KWPPM

SEQ ID NO: 516290 - protein, 9 aa, Mycobacterium
KWQGPAATA

SEQ ID NO: 516291 - protein, 5 aa, Mycobacterium
KWTAE

SEQ ID NO: 516292 - protein, 7 aa, Mycobacterium
KWTDPSA

SEQ ID NO: 516293 - protein, 5 aa, Mycobacterium
KYAAK

SEQ ID NO: 516294 - protein, 10 aa, Mycobacterium
KYADAPAHRV

SEQ ID NO: 516295 - protein, 6 aa, Mycobacterium
KYADDP

SEQ ID NO: 516296 - protein, 9 aa, Mycobacterium
KYADEGHPM

SEQ ID NO: 516297 - protein, 8 aa, Mycobacterium
KYAEDTGT

SEQ ID NO: 516298 - protein, 13 aa, Mycobacterium
KYAEERARRLRPD

SEQ ID NO: 516299 - protein, 5 aa, Mycobacterium
KYAES

SEQ ID NO: 516300 - protein, 6 aa, Mycobacterium
KYAGAA

SEQ ID NO: 516301 - protein, 6 aa, Mycobacterium
KYAGQK

SEQ ID NO: 516302 - protein, 8 aa, Mycobacterium
KYAGRAGD

SEQ ID NO: 516303 - protein, 14 aa, Mycobacterium
KYAGVGRPASTKSA

SEQ ID NO: 516304 - protein, 8 aa, Mycobacterium
KYAKERQA

SEQ ID NO: 516305 - protein, 8 aa, Mycobacterium
KYAKGNRA

SEQ ID NO: 516306 - protein, 6 aa, Mycobacterium
KYAPDI

SEQ ID NO: 516307 - protein, 8 aa, Mycobacterium
KYASAGAD

SEQ ID NO: 516308 - protein, 5 aa, Mycobacterium
KYATD

SEQ ID NO: 516309 - protein, 5 aa, Mycobacterium
KYDEA

SEQ ID NO: 516310 - protein, 8 aa, Mycobacterium
KYDEKEHA

SEQ ID NO: 516311 - protein, 5 aa, Mycobacterium
KYDEQ

SEQ ID NO: 516312 - protein, 6 aa, Mycobacterium
KYDGTL

SEQ ID NO: 516313 - protein, 7 aa, Mycobacterium
KYDGTRT

SEQ ID NO: 516314 - protein, 9 aa, Mycobacterium
KYDPEDSSE

SEQ ID NO: 516315 - protein, 19 aa, Mycobacterium
KYEAAQKARESRRNQQQTV

SEQ ID NO: 516316 - protein, 15 aa, Mycobacterium
KYEAQAAQIFHQVTG

SEQ ID NO: 516317 - protein, 12 aa, Mycobacterium
KYEGEARKGNTI

SEQ ID NO: 516318 - protein, 8 aa, Mycobacterium
KYEGSNGP

SEQ ID NO: 516319 - protein, 9 aa, Mycobacterium
KYEKDGSAR

SEQ ID NO: 516320 - protein, 15 aa, Mycobacterium
KYEPAELAEGQTRPD

SEQ ID NO: 516321 - protein, 14 aa, Mycobacterium
KYEPAVGSEGQVGP

SEQ ID NO: 516322 - protein, 8 aa, Mycobacterium
KYEPLQNE

SEQ ID NO: 516323 - protein, 15 aa, Mycobacterium
KYEPPSGPEGQAGPD

SEQ ID NO: 516324 - protein, 13 aa, Mycobacterium
KYERAGRPARTKA

SEQ ID NO: 516325 - protein, 17 aa, Mycobacterium
KYESEIDSVRQREDRDR

SEQ ID NO: 516326 - protein, 19 aa, Mycobacterium
KYETAQKARESRKNQQQTV

SEQ ID NO: 516327 - protein, 10 aa, Mycobacterium
KYFPAPGLEP

SEQ ID NO: 516328 - protein, 8 aa, Mycobacterium
KYGAPTYA

SEQ ID NO: 516329 - protein, 9 aa, Mycobacterium
KYGATPVES

SEQ ID NO: 516330 - protein, 4 aa, Mycobacterium
KYGD

SEQ ID NO: 516331 - protein, 7 aa, Mycobacterium
KYGDDAA

SEQ ID NO: 516332 - protein, 7 aa, Mycobacterium
KYGDRAP

SEQ ID NO: 516333 - protein, 9 aa, Mycobacterium
KYGDSPAMR

SEQ ID NO: 516334 - protein, 4 aa, Mycobacterium
KYGG

SEQ ID NO: 516335 - protein, 7 aa, Mycobacterium
KYGGNPD

SEQ ID NO: 516336 - protein, 7 aa, Mycobacterium
KYGGNPN

SEQ ID NO: 516337 - protein, 7 aa, Mycobacterium
KYGGRRP

SEQ ID NO: 516338 - protein, 5 aa, Mycobacterium
KYGHP

SEQ ID NO: 516339 - protein, 6 aa, Mycobacterium
KYGKNL

SEQ ID NO: 516340 - protein, 5 aa, Mycobacterium
KYGKT

SEQ ID NO: 516341 - protein, 5 aa, Mycobacterium
KYGKV

SEQ ID NO: 516342 - protein, 4 aa, Mycobacterium
KYGN

SEQ ID NO: 516343 - protein, 6 aa, Mycobacterium
KYGNKL

SEQ ID NO: 516344 - protein, 6 aa, Mycobacterium
KYGPER

SEQ ID NO: 516345 - protein, 30 aa, Mycobacterium
KYGPGGPFHPDTPGAWADSRKVRSAALPAE

SEQ ID NO: 516346 - protein, 10 aa, Mycobacterium
KYGPTTRRPV

SEQ ID NO: 516347 - protein, 12 aa, Mycobacterium
KYGQGPGPGENI

SEQ ID NO: 516348 - protein, 6 aa, Mycobacterium
KYGQGV

SEQ ID NO: 516349 - protein, 9 aa, Mycobacterium
KYGRHADDQ

SEQ ID NO: 516350 - protein, 6 aa, Mycobacterium
KYGRKI

SEQ ID NO: 516351 - protein, 5 aa, Mycobacterium
KYGRT

SEQ ID NO: 516352 - protein, 4 aa, Mycobacterium
KYGS

SEQ ID NO: 516353 - protein, 6 aa, Mycobacterium
KYGSHS

SEQ ID NO: 516354 - protein, 6 aa, Mycobacterium
KYGSKI

SEQ ID NO: 516355 - protein, 6 aa, Mycobacterium
KYGSLP

SEQ ID NO: 516356 - protein, 12 aa, Mycobacterium
KYGSNTIERDRA

SEQ ID NO: 516357 - protein, 9 aa, Mycobacterium
KYGSRAAKA

SEQ ID NO: 516358 - protein, 17 aa, Mycobacterium
KYGTDGVTRPGQNQSGV

SEQ ID NO: 516359 - protein, 9 aa, Mycobacterium
KYGTEEQKK

SEQ ID NO: 516360 - protein, 7 aa, Mycobacterium
KYGTSDN

SEQ ID NO: 516361 - protein, 5 aa, Mycobacterium
KYGTV

SEQ ID NO: 516362 - protein, 5 aa, Mycobacterium
KYGVP

SEQ ID NO: 516363 - protein, 7 aa, Mycobacterium
KYGVTPE

SEQ ID NO: 516364 - protein, 6 aa, Mycobacterium
KYKEEA

SEQ ID NO: 516365 - protein, 4 aa, Mycobacterium
KYLG

SEQ ID NO: 516366 - protein, 5 aa, Mycobacterium
KYNGL

SEQ ID NO: 516367 - protein, 17 aa, Mycobacterium
KYNPPNGGPADSDATSV

SEQ ID NO: 516368 - protein, 12 aa, Mycobacterium
KYNSSRGPSFSS

SEQ ID NO: 516369 - protein, 13 aa, Mycobacterium
KYNSTRGTSYSAY

SEQ ID NO: 516370 - protein, 4 aa, Mycobacterium
KYPA

SEQ ID NO: 516371 - protein, 10 aa, Mycobacterium
KYPDGSTPPV

SEQ ID NO: 516372 - protein, 5 aa, Mycobacterium
KYPDV

SEQ ID NO: 516373 - protein, 6 aa, Mycobacterium
KYPGGE

SEQ ID NO: 516374 - protein, 5 aa, Mycobacterium
KYPKA

SEQ ID NO: 516375 - protein, 6 aa, Mycobacterium
KYPPDF

SEQ ID NO: 516376 - protein, 5 aa, Mycobacterium
KYPPI

SEQ ID NO: 516377 - protein, 6 aa, Mycobacterium
KYPRTD

SEQ ID NO: 516378 - protein, 14 aa, Mycobacterium
KYPTPQPATPKAVA

SEQ ID NO: 516379 - protein, 4 aa, Mycobacterium
KYQA

SEQ ID NO: 516380 - protein, 18 aa, Mycobacterium
KYQAKAGAFNSAADATDY

SEQ ID NO: 516381 - protein, 8 aa, Mycobacterium
KYQPTSED

SEQ ID NO: 516382 - protein, 7 aa, Mycobacterium
KYQQARR

SEQ ID NO: 516383 - protein, 5 aa, Mycobacterium
KYQQR

SEQ ID NO: 516384 - protein, 17 aa, Mycobacterium
KYQQRPSESVEEDQQLP

SEQ ID NO: 516385 - protein, 7 aa, Mycobacterium
KYQRPGD

SEQ ID NO: 516386 - protein, 18 aa, Mycobacterium
KYQTKASAFSSAADATDY

SEQ ID NO: 516387 - protein, 10 aa, Mycobacterium
KYQVTSGSIT

SEQ ID NO: 516388 - protein, 11 aa, Mycobacterium
KYRDEARPRAG

SEQ ID NO: 516389 - protein, 5 aa, Mycobacterium
KYRDI

SEQ ID NO: 516390 - protein, 7 aa, Mycobacterium
KYRDRAP

SEQ ID NO: 516391 - protein, 15 aa, Mycobacterium
KYRERERRERGEGGL

SEQ ID NO: 516392 - protein, 4 aa, Mycobacterium
KYRR

SEQ ID NO: 516393 - protein, 12 aa, Mycobacterium
KYRRDSAAVDSA

SEQ ID NO: 516394 - protein, 16 aa, Mycobacterium
KYRREREKRLRPEGSR

SEQ ID NO: 516395 - protein, 18 aa, Mycobacterium
KYRRGETGRLSDRPSAME

SEQ ID NO: 516396 - protein, 5 aa, Mycobacterium
KYRRT

SEQ ID NO: 516397 - protein, 8 aa, Mycobacterium
KYRSGGVG

SEQ ID NO: 516398 - protein, 6 aa, Mycobacterium
KYSDRR

SEQ ID NO: 516399 - protein, 6 aa, Mycobacterium
KYSETR

SEQ ID NO: 516400 - protein, 19 aa, Mycobacterium
KYSHDQPDGVAAQQYPPDE

SEQ ID NO: 516401 - protein, 7 aa, Mycobacterium
KYSPPAH

SEQ ID NO: 516402 - protein, 13 aa, Mycobacterium
KYSSSRGPSFSSY

SEQ ID NO: 516403 - protein, 8 aa, Mycobacterium
KYSYERRA

SEQ ID NO: 516404 - protein, 7 aa, Mycobacterium
KYTAPEI

SEQ ID NO: 516405 - protein, 4 aa, Mycobacterium
KYTE

SEQ ID NO: 516406 - protein, 5 aa, Mycobacterium
KYTED

SEQ ID NO: 516407 - protein, 5 aa, Mycobacterium
KYTNQ

SEQ ID NO: 516408 - protein, 8 aa, Mycobacterium
KYTPLGES

SEQ ID NO: 516409 - protein, 4 aa, Mycobacterium
KYTS

SEQ ID NO: 516410 - protein, 6 aa, Mycobacterium
KYTSGL

SEQ ID NO: 516411 - protein, 10 aa, Mycobacterium
KYVDTSPELS

SEQ ID NO: 516412 - protein, 13 aa, Mycobacterium
KYYDPDPDTPGRM

SEQ ID NO: 516413 - protein, 4 aa, Mycobacterium
LAAA

SEQ ID NO: 516414 - protein, 5 aa, Mycobacterium
LAAAA

SEQ ID NO: 516415 - protein, 19 aa, Mycobacterium
LAAAAGGAAAGCGHAGDGN

SEQ ID NO: 516416 - protein, 12 aa, Mycobacterium
LAAAAPAGAERS

SEQ ID NO: 516417 - protein, 61 aa, Mycobacterium
LAAAAPASDRPRRERPSGTRPRRSGSAGTTATSTEAGRAATSDAPAAGTAAAAEAPAESTE

SEQ ID NO: 516418 - protein, 9 aa, Mycobacterium
LAAAAPGWI

SEQ ID NO: 516419 - protein, 9 aa, Mycobacterium
LAAADEVPP

SEQ ID NO: 516420 - protein, 11 aa, Mycobacterium
LAAADGSPVPA

SEQ ID NO: 516421 - protein, 14 aa, Mycobacterium
LAAAENSDDPAERQ

SEQ ID NO: 516422 - protein, 11 aa, Mycobacterium
LAAAERREAAN

SEQ ID NO: 516423 - protein, 7 aa, Mycobacterium
LAAAGAG

SEQ ID NO: 516424 - protein, 9 aa, Mycobacterium
LAAAGDDSL

SEQ ID NO: 516425 - protein, 6 aa, Mycobacterium
LAAAGG

SEQ ID NO: 516426 - protein, 13 aa, Mycobacterium
LAAAGPAAVRDLL

SEQ ID NO: 516427 - protein, 11 aa, Mycobacterium
LAAAGQSPGVR

SEQ ID NO: 516428 - protein, 10 aa, Mycobacterium
LAAAPGDKAP

SEQ ID NO: 516429 - protein, 8 aa, Mycobacterium
LAAAPHAK

SEQ ID NO: 516430 - protein, 21 aa, Mycobacterium
LAAAPKAADGRFAVPRILGEP

SEQ ID NO: 516431 - protein, 8 aa, Mycobacterium
LAAAQKPT

SEQ ID NO: 516432 - protein, 9 aa, Mycobacterium
LAAASQTTQ

SEQ ID NO: 516433 - protein, 15 aa, Mycobacterium
LAAASSSLSSLGSSI

SEQ ID NO: 516434 - protein, 8 aa, Mycobacterium
LAAASSVS

SEQ ID NO: 516435 - protein, 7 aa, Mycobacterium
LAAASTY

SEQ ID NO: 516436 - protein, 8 aa, Mycobacterium
LAAATSPY

SEQ ID NO: 516437 - protein, 24 aa, Mycobacterium
LAAATTDRLRRQKEAQRVRDDVPD

SEQ ID NO: 516438 - protein, 23 aa, Mycobacterium
LAAATTDRLRRQKQANRVRDDVP

SEQ ID NO: 516439 - protein, 4 aa, Mycobacterium
LAAD

SEQ ID NO: 516440 - protein, 10 aa, Mycobacterium
LAADADAPVR

SEQ ID NO: 516441 - protein, 10 aa, Mycobacterium
LAADAEKRGW

SEQ ID NO: 516442 - protein, 21 aa, Mycobacterium
LAADDALNTPAGRDADRARID

SEQ ID NO: 516443 - protein, 10 aa, Mycobacterium
LAADDGVDPR

SEQ ID NO: 516444 - protein, 7 aa, Mycobacterium
LAADDNR

SEQ ID NO: 516445 - protein, 10 aa, Mycobacterium
LAADDQRHRV

SEQ ID NO: 516446 - protein, 9 aa, Mycobacterium
LAADGDPGT

SEQ ID NO: 516447 - protein, 14 aa, Mycobacterium
LAADGKTKEDLGRE

SEQ ID NO: 516448 - protein, 8 aa, Mycobacterium
LAADGQAA

SEQ ID NO: 516449 - protein, 9 aa, Mycobacterium
LAADPDRPI

SEQ ID NO: 516450 - protein, 12 aa, Mycobacterium
LAADPGPATIDE

SEQ ID NO: 516451 - protein, 8 aa, Mycobacterium
LAADRAPR

SEQ ID NO: 516452 - protein, 21 aa, Mycobacterium
LAADRGVTAEISTATESPNHR

SEQ ID NO: 516453 - protein, 9 aa, Mycobacterium
LAADTAESL

SEQ ID NO: 516454 - protein, 11 aa, Mycobacterium
LAADTPGAARL

SEQ ID NO: 516455 - protein, 10 aa, Mycobacterium
LAAEANRRRR

SEQ ID NO: 516456 - protein, 7 aa, Mycobacterium
LAAEEEA

SEQ ID NO: 516457 - protein, 9 aa, Mycobacterium
LAAEEPDRL

SEQ ID NO: 516458 - protein, 10 aa, Mycobacterium
LAAEGDALTD

SEQ ID NO: 516459 - protein, 13 aa, Mycobacterium
LAAEGDNSLRAQY

SEQ ID NO: 516460 - protein, 10 aa, Mycobacterium
LAAEGDPVKR

SEQ ID NO: 516461 - protein, 18 aa, Mycobacterium
LAAEGGAHQSIKTPSIGL

SEQ ID NO: 516462 - protein, 11 aa, Mycobacterium
LAAEGHDVKSR

SEQ ID NO: 516463 - protein, 7 aa, Mycobacterium
LAAEGKQ

SEQ ID NO: 516464 - protein, 6 aa, Mycobacterium
LAAEGT

SEQ ID NO: 516465 - protein, 5 aa, Mycobacterium
LAAEP

SEQ ID NO: 516466 - protein, 13 aa, Mycobacterium
LAAEPAQESVDDG

SEQ ID NO: 516467 - protein, 17 aa, Mycobacterium
LAAEPDSQAKALAAGRA

SEQ ID NO: 516468 - protein, 15 aa, Mycobacterium
LAAEPKTDAVVGGST

SEQ ID NO: 516469 - protein, 5 aa, Mycobacterium
LAAER

SEQ ID NO: 516470 - protein, 21 aa, Mycobacterium
LAAERGVSAEITKASESPNHR

SEQ ID NO: 516471 - protein, 6 aa, Mycobacterium
LAAESR

SEQ ID NO: 516472 - protein, 7 aa, Mycobacterium
LAAETQA

SEQ ID NO: 516473 - protein, 18 aa, Mycobacterium
LAAGAASAAGGTASSMSA

SEQ ID NO: 516474 - protein, 10 aa, Mycobacterium
LAAGADDVSA

SEQ ID NO: 516475 - protein, 10 aa, Mycobacterium
LAAGAGSSTY

SEQ ID NO: 516476 - protein, 6 aa, Mycobacterium
LAAGAS

SEQ ID NO: 516477 - protein, 9 aa, Mycobacterium
LAAGASGTA

SEQ ID NO: 516478 - protein, 6 aa, Mycobacterium
LAAGDA

SEQ ID NO: 516479 - protein, 10 aa, Mycobacterium
LAAGDAGATE

SEQ ID NO: 516480 - protein, 7 aa, Mycobacterium
LAAGDGA

SEQ ID NO: 516481 - protein, 8 aa, Mycobacterium
LAAGEPVE

SEQ ID NO: 516482 - protein, 6 aa, Mycobacterium
LAAGEQ

SEQ ID NO: 516483 - protein, 8 aa, Mycobacterium
LAAGESDL

SEQ ID NO: 516484 - protein, 5 aa, Mycobacterium
LAAGG

SEQ ID NO: 516485 - protein, 6 aa, Mycobacterium
LAAGGG

SEQ ID NO: 516486 - protein, 7 aa, Mycobacterium
LAAGGGL

SEQ ID NO: 516487 - protein, 10 aa, Mycobacterium
LAAGGSAPLR

SEQ ID NO: 516488 - protein, 8 aa, Mycobacterium
LAAGLDKE

SEQ ID NO: 516489 - protein, 12 aa, Mycobacterium
LAAGNGAVAPQG

SEQ ID NO: 516490 - protein, 7 aa, Mycobacterium
LAAGNPW

SEQ ID NO: 516491 - protein, 5 aa, Mycobacterium
LAAGP

SEQ ID NO: 516492 - protein, 62 aa, Mycobacterium
LAAGPANSAGPANTTVAASSAGAAQDNPVPAGTTRTTGAPDTAEPPDAPVADQPATATTGTA

SEQ ID NO: 516493 - protein, 12 aa, Mycobacterium
LAAGPGEPDGKE

SEQ ID NO: 516494 - protein, 6 aa, Mycobacterium
LAAGQA

SEQ ID NO: 516495 - protein, 29 aa, Mycobacterium
LAAGQDIQRGPPRPVPSSDAGIASTSIPE

SEQ ID NO: 516496 - protein, 9 aa, Mycobacterium
LAAGQGPVL

SEQ ID NO: 516497 - protein, 6 aa, Mycobacterium
LAAGQV

SEQ ID NO: 516498 - protein, 5 aa, Mycobacterium
LAAGR

SEQ ID NO: 516499 - protein, 16 aa, Mycobacterium
LAAGSGTPPIGSPVPG

SEQ ID NO: 516500 - protein, 13 aa, Mycobacterium
LAAGSYADATGFT

SEQ ID NO: 516501 - protein, 14 aa, Mycobacterium
LAAGTDGKDGKAPT

SEQ ID NO: 516502 - protein, 8 aa, Mycobacterium
LAAGTGPA

SEQ ID NO: 516503 - protein, 10 aa, Mycobacterium
LAAGTGVPEE

SEQ ID NO: 516504 - protein, 7 aa, Mycobacterium
LAAGTQA

SEQ ID NO: 516505 - protein, 13 aa, Mycobacterium
LAAGTSAQPPDRM

SEQ ID NO: 516506 - protein, 7 aa, Mycobacterium
LAAGTTE

SEQ ID NO: 516507 - protein, 8 aa, Mycobacterium
LAAGTVVG

SEQ ID NO: 516508 - protein, 19 aa, Mycobacterium
LAAGVSDSTEMLRAAASAL

SEQ ID NO: 516509 - protein, 8 aa, Mycobacterium
LAAHDGNR

SEQ ID NO: 516510 - protein, 8 aa, Mycobacterium
LAAKPTTV

SEQ ID NO: 516511 - protein, 7 aa, Mycobacterium
LAAKTAD

SEQ ID NO: 516512 - protein, 17 aa, Mycobacterium
LAAKYGDRFNPPASLLD

SEQ ID NO: 516513 - protein, 4 aa, Mycobacterium
LAAN

SEQ ID NO: 516514 - protein, 10 aa, Mycobacterium
LAANAAEETM

SEQ ID NO: 516515 - protein, 5 aa, Mycobacterium
LAAND

SEQ ID NO: 516516 - protein, 5 aa, Mycobacterium
LAANG

SEQ ID NO: 516517 - protein, 19 aa, Mycobacterium
LAANPDVAQKIRDGKVAAA

SEQ ID NO: 516518 - protein, 7 aa, Mycobacterium
LAANPGA

SEQ ID NO: 516519 - protein, 11 aa, Mycobacterium
LAAPAATADPA

SEQ ID NO: 516520 - protein, 13 aa, Mycobacterium
LAAPATGATGVKS

SEQ ID NO: 516521 - protein, 5 aa, Mycobacterium
LAAPD

SEQ ID NO: 516522 - protein, 16 aa, Mycobacterium
LAAPDSGFPPEDAPEG

SEQ ID NO: 516523 - protein, 9 aa, Mycobacterium
LAAPDTNTA

SEQ ID NO: 516524 - protein, 18 aa, Mycobacterium
LAAPEAGRARADRERQRQ

SEQ ID NO: 516525 - protein, 8 aa, Mycobacterium
LAAPETPR

SEQ ID NO: 516526 - protein, 5 aa, Mycobacterium
LAAPG

SEQ ID NO: 516527 - protein, 7 aa, Mycobacterium
LAAPGDD

SEQ ID NO: 516528 - protein, 12 aa, Mycobacterium
LAAPGNTPTLDE

SEQ ID NO: 516529 - protein, 11 aa, Mycobacterium
LAAPGNVPSLD

SEQ ID NO: 516530 - protein, 7 aa, Mycobacterium
LAAPISG

SEQ ID NO: 516531 - protein, 9 aa, Mycobacterium
LAAPPDDLG

SEQ ID NO: 516532 - protein, 8 aa, Mycobacterium
LAAPPETL

SEQ ID NO: 516533 - protein, 10 aa, Mycobacterium
LAAPPPETAR

SEQ ID NO: 516534 - protein, 10 aa, Mycobacterium
LAAPPPQTAR

SEQ ID NO: 516535 - protein, 10 aa, Mycobacterium
LAAPPPSTAR

SEQ ID NO: 516536 - protein, 9 aa, Mycobacterium
LAAPPQPTI

SEQ ID NO: 516537 - protein, 7 aa, Mycobacterium
LAAPRAG

SEQ ID NO: 516538 - protein, 32 aa, Mycobacterium
LAAPRPDEQQVSGASAWGAGPLGSRGTARTQT

SEQ ID NO: 516539 - protein, 37 aa, Mycobacterium
LAAPSTLSAYASAQATTTSGPYAAAPTEPAAYGGTQP

SEQ ID NO: 516540 - protein, 18 aa, Mycobacterium
LAAPTDEGVGEGDRRTEG

SEQ ID NO: 516541 - protein, 17 aa, Mycobacterium
LAAPTQFSVPGSAAEVT

SEQ ID NO: 516542 - protein, 9 aa, Mycobacterium
LAAPTTNDA

SEQ ID NO: 516543 - protein, 7 aa, Mycobacterium
LAAQASA

SEQ ID NO: 516544 - protein, 13 aa, Mycobacterium
LAAQNTGAASATT

SEQ ID NO: 516545 - protein, 16 aa, Mycobacterium
LAAQQRQKYNAKLKAA

SEQ ID NO: 516546 - protein, 12 aa, Mycobacterium
LAAQRADQTLTT

SEQ ID NO: 516547 - protein, 18 aa, Mycobacterium
LAAQRSVGVETEEIDESE

SEQ ID NO: 516548 - protein, 8 aa, Mycobacterium
LAAQSTSR

SEQ ID NO: 516549 - protein, 5 aa, Mycobacterium
LAARA

SEQ ID NO: 516550 - protein, 9 aa, Mycobacterium
LAAREAVPE

SEQ ID NO: 516551 - protein, 11 aa, Mycobacterium
LAARGDQRSAV

SEQ ID NO: 516552 - protein, 13 aa, Mycobacterium
LAARGERAAPVEQ

SEQ ID NO: 516553 - protein, 53 aa, Mycobacterium
LAARGSASGRARRKSAEPAPDDLDAPAEAAAAAAAKKKARARRRRAGTATDRA

SEQ ID NO: 516554 - protein, 6 aa, Mycobacterium
LAARGV

SEQ ID NO: 516555 - protein, 12 aa, Mycobacterium
LAARQGEKSYAQ

SEQ ID NO: 516556 - protein, 8 aa, Mycobacterium
LAARQSGK

SEQ ID NO: 516557 - protein, 11 aa, Mycobacterium
LAARTEVGLPP

SEQ ID NO: 516558 - protein, 4 aa, Mycobacterium
LAAS

SEQ ID NO: 516559 - protein, 8 aa, Mycobacterium
LAASAGDV

SEQ ID NO: 516560 - protein, 30 aa, Mycobacterium
LAASAGKGIKVGGTVNKKDEDEDDKDLTAI

SEQ ID NO: 516561 - protein, 9 aa, Mycobacterium
LAASAGVAP

SEQ ID NO: 516562 - protein, 17 aa, Mycobacterium
LAASASWAANGKITGDD

SEQ ID NO: 516563 - protein, 7 aa, Mycobacterium
LAASDEA

SEQ ID NO: 516564 - protein, 7 aa, Mycobacterium
LAASESY

SEQ ID NO: 516565 - protein, 10 aa, Mycobacterium
LAASGDRGEV

SEQ ID NO: 516566 - protein, 11 aa, Mycobacterium
LAASGPSAPLR

SEQ ID NO: 516567 - protein, 6 aa, Mycobacterium
LAASGR

SEQ ID NO: 516568 - protein, 7 aa, Mycobacterium
LAASPAT

SEQ ID NO: 516569 - protein, 8 aa, Mycobacterium
LAASPGDL

SEQ ID NO: 516570 - protein, 7 aa, Mycobacterium
LAASPSA

SEQ ID NO: 516571 - protein, 17 aa, Mycobacterium
LAASQDSAQGETDSGAS

SEQ ID NO: 516572 - protein, 11 aa, Mycobacterium
LAASQSADISS

SEQ ID NO: 516573 - protein, 9 aa, Mycobacterium
LAASRGRTG

SEQ ID NO: 516574 - protein, 10 aa, Mycobacterium
LAASRNAALE

SEQ ID NO: 516575 - protein, 9 aa, Mycobacterium
LAASSADEL

SEQ ID NO: 516576 - protein, 9 aa, Mycobacterium
LAASSDGKY

SEQ ID NO: 516577 - protein, 9 aa, Mycobacterium
LAASSESAV

SEQ ID NO: 516578 - protein, 10 aa, Mycobacterium
LAASTGVPEE

SEQ ID NO: 516579 - protein, 10 aa, Mycobacterium
LAASTGVPPE

SEQ ID NO: 516580 - protein, 9 aa, Mycobacterium
LAATAEGIA

SEQ ID NO: 516581 - protein, 5 aa, Mycobacterium
LAATD

SEQ ID NO: 516582 - protein, 8 aa, Mycobacterium
LAATDDEI

SEQ ID NO: 516583 - protein, 12 aa, Mycobacterium
LAATDLDEDDLA

SEQ ID NO: 516584 - protein, 14 aa, Mycobacterium
LAATDSSGYLDPGY

SEQ ID NO: 516585 - protein, 5 aa, Mycobacterium
LAATG

SEQ ID NO: 516586 - protein, 6 aa, Mycobacterium
LAATGD

SEQ ID NO: 516587 - protein, 8 aa, Mycobacterium
LAATGESW

SEQ ID NO: 516588 - protein, 7 aa, Mycobacterium
LAATGTP

SEQ ID NO: 516589 - protein, 9 aa, Mycobacterium
LAATGTSVA

SEQ ID NO: 516590 - protein, 16 aa, Mycobacterium
LAATKGTVAVGGDSDA

SEQ ID NO: 516591 - protein, 7 aa, Mycobacterium
LAATPAP

SEQ ID NO: 516592 - protein, 7 aa, Mycobacterium
LAATPDA

SEQ ID NO: 516593 - protein, 7 aa, Mycobacterium
LAATPQP

SEQ ID NO: 516594 - protein, 8 aa, Mycobacterium
LAATQGKL

SEQ ID NO: 516595 - protein, 6 aa, Mycobacterium
LAATRP

SEQ ID NO: 516596 - protein, 6 aa, Mycobacterium
LAATSA

SEQ ID NO: 516597 - protein, 7 aa, Mycobacterium
LAATSEA

SEQ ID NO: 516598 - protein, 7 aa, Mycobacterium
LAATSGL

SEQ ID NO: 516599 - protein, 11 aa, Mycobacterium
LAATTNRIAER

SEQ ID NO: 516600 - protein, 4 aa, Mycobacterium
LAAY

SEQ ID NO: 516601 - protein, 4 aa, Mycobacterium
LADA

SEQ ID NO: 516602 - protein, 5 aa, Mycobacterium
LADAA

SEQ ID NO: 516603 - protein, 18 aa, Mycobacterium
LADAAAADRRRAAGDTAP

SEQ ID NO: 516604 - protein, 13 aa, Mycobacterium
LADAADSDAYDEA

SEQ ID NO: 516605 - protein, 18 aa, Mycobacterium
LADAAEADRRRAAGDTAP

SEQ ID NO: 516606 - protein, 13 aa, Mycobacterium
LADAAESTDYDEA

SEQ ID NO: 516607 - protein, 9 aa, Mycobacterium
LADADRATL

SEQ ID NO: 516608 - protein, 5 aa, Mycobacterium
LADAG

SEQ ID NO: 516609 - protein, 6 aa, Mycobacterium
LADAGA

SEQ ID NO: 516610 - protein, 24 aa, Mycobacterium
LADAGAGQESEDEDQGEDDQEAGE

SEQ ID NO: 516611 - protein, 8 aa, Mycobacterium
LADAGGDT

SEQ ID NO: 516612 - protein, 8 aa, Mycobacterium
LADAGQRL

SEQ ID NO: 516613 - protein, 11 aa, Mycobacterium
LADAKDEADRR

SEQ ID NO: 516614 - protein, 12 aa, Mycobacterium
LADASGATASVA

SEQ ID NO: 516615 - protein, 7 aa, Mycobacterium
LADASPR

SEQ ID NO: 516616 - protein, 10 aa, Mycobacterium
LADATAGLKG

SEQ ID NO: 516617 - protein, 15 aa, Mycobacterium
LADATDGDHPIPPGD

SEQ ID NO: 516618 - protein, 9 aa, Mycobacterium
LADDAPEWG

SEQ ID NO: 516619 - protein, 8 aa, Mycobacterium
LADDATAD

SEQ ID NO: 516620 - protein, 7 aa, Mycobacterium
LADDERA

SEQ ID NO: 516621 - protein, 10 aa, Mycobacterium
LADDLGPGSV

SEQ ID NO: 516622 - protein, 6 aa, Mycobacterium
LADDNR

SEQ ID NO: 516623 - protein, 7 aa, Mycobacterium
LADDPRF

SEQ ID NO: 516624 - protein, 9 aa, Mycobacterium
LADDPTGTD

SEQ ID NO: 516625 - protein, 9 aa, Mycobacterium
LADDSTIGR

SEQ ID NO: 516626 - protein, 9 aa, Mycobacterium
LADDSTVGR

SEQ ID NO: 516627 - protein, 6 aa, Mycobacterium
LADDYD

SEQ ID NO: 516628 - protein, 6 aa, Mycobacterium
LADEAA

SEQ ID NO: 516629 - protein, 5 aa, Mycobacterium
LADEG

SEQ ID NO: 516630 - protein, 7 aa, Mycobacterium
LADEGIE

SEQ ID NO: 516631 - protein, 8 aa, Mycobacterium
LADESAAD

SEQ ID NO: 516632 - protein, 6 aa, Mycobacterium
LADESP

SEQ ID NO: 516633 - protein, 15 aa, Mycobacterium
LADESSQSPQAGMPP

SEQ ID NO: 516634 - protein, 7 aa, Mycobacterium
LADETAS

SEQ ID NO: 516635 - protein, 8 aa, Mycobacterium
LADETGGH

SEQ ID NO: 516636 - protein, 10 aa, Mycobacterium
LADETPDGFE

SEQ ID NO: 516637 - protein, 7 aa, Mycobacterium
LADETPR

SEQ ID NO: 516638 - protein, 20 aa, Mycobacterium
LADGADKRERYAEVEEATNR

SEQ ID NO: 516639 - protein, 6 aa, Mycobacterium
LADGAE

SEQ ID NO: 516640 - protein, 23 aa, Mycobacterium
LADGAPLGVGTPATAGAVNPGVA

SEQ ID NO: 516641 - protein, 6 aa, Mycobacterium
LADGDA

SEQ ID NO: 516642 - protein, 17 aa, Mycobacterium
LADGDAGWDASAPVQLP

SEQ ID NO: 516643 - protein, 6 aa, Mycobacterium
LADGDR

SEQ ID NO: 516644 - protein, 6 aa, Mycobacterium
LADGEE

SEQ ID NO: 516645 - protein, 13 aa, Mycobacterium
LADGEKTWAKTSL

SEQ ID NO: 516646 - protein, 7 aa, Mycobacterium
LADGGAG

SEQ ID NO: 516647 - protein, 7 aa, Mycobacterium
LADGGGQ

SEQ ID NO: 516648 - protein, 14 aa, Mycobacterium
LADGGPASAARDHA

SEQ ID NO: 516649 - protein, 16 aa, Mycobacterium
LADGGRARITTAAGTA

SEQ ID NO: 516650 - protein, 6 aa, Mycobacterium
LADGGW

SEQ ID NO: 516651 - protein, 8 aa, Mycobacterium
LADGIDAT

SEQ ID NO: 516652 - protein, 7 aa, Mycobacterium
LADGKAA

SEQ ID NO: 516653 - protein, 6 aa, Mycobacterium
LADGKV

SEQ ID NO: 516654 - protein, 6 aa, Mycobacterium
LADGNA

SEQ ID NO: 516655 - protein, 9 aa, Mycobacterium
LADGPAHAA

SEQ ID NO: 516656 - protein, 8 aa, Mycobacterium
LADGPAKV

SEQ ID NO: 516657 - protein, 9 aa, Mycobacterium
LADGPLPTH

SEQ ID NO: 516658 - protein, 17 aa, Mycobacterium
LADGPLPTHYEPHESPV

SEQ ID NO: 516659 - protein, 18 aa, Mycobacterium
LADGREYGLDATTTRTIG

SEQ ID NO: 516660 - protein, 6 aa, Mycobacterium
LADGRQ

SEQ ID NO: 516661 - protein, 6 aa, Mycobacterium
LADGRT

SEQ ID NO: 516662 - protein, 5 aa, Mycobacterium
LADGS

SEQ ID NO: 516663 - protein, 6 aa, Mycobacterium
LADGSD

SEQ ID NO: 516664 - protein, 9 aa, Mycobacterium
LADGSPAGA

SEQ ID NO: 516665 - protein, 20 aa, Mycobacterium
LADGSQDTARDVSAAKVAAA

SEQ ID NO: 516666 - protein, 21 aa, Mycobacterium
LADGSSDTARDVSAAKVAAAD

SEQ ID NO: 516667 - protein, 7 aa, Mycobacterium
LADGTPV

SEQ ID NO: 516668 - protein, 10 aa, Mycobacterium
LADHPDQRRD

SEQ ID NO: 516669 - protein, 5 aa, Mycobacterium
LADHS

SEQ ID NO: 516670 - protein, 11 aa, Mycobacterium
LADKARASAGA

SEQ ID NO: 516671 - protein, 6 aa, Mycobacterium
LADKGI

SEQ ID NO: 516672 - protein, 12 aa, Mycobacterium
LADKIGQALSAG

SEQ ID NO: 516673 - protein, 8 aa, Mycobacterium
LADKPAGV

SEQ ID NO: 516674 - protein, 8 aa, Mycobacterium
LADKPDAT

SEQ ID NO: 516675 - protein, 9 aa, Mycobacterium
LADKTLPNL

SEQ ID NO: 516676 - protein, 20 aa, Mycobacterium
LADNGSKEQTWQSMLTPHGM

SEQ ID NO: 516677 - protein, 10 aa, Mycobacterium
LADNTDPERM

SEQ ID NO: 516678 - protein, 5 aa, Mycobacterium
LADPA

SEQ ID NO: 516679 - protein, 13 aa, Mycobacterium
LADPAEYAQASGG

SEQ ID NO: 516680 - protein, 6 aa, Mycobacterium
LADPAK

SEQ ID NO: 516681 - protein, 11 aa, Mycobacterium
LADPDAEKEAF

SEQ ID NO: 516682 - protein, 12 aa, Mycobacterium
LADPDAPTGKET

SEQ ID NO: 516683 - protein, 8 aa, Mycobacterium
LADPDDNN

SEQ ID NO: 516684 - protein, 6 aa, Mycobacterium
LADPDR

SEQ ID NO: 516685 - protein, 8 aa, Mycobacterium
LADPDSRV

SEQ ID NO: 516686 - protein, 6 aa, Mycobacterium
LADPDT

SEQ ID NO: 516687 - protein, 8 aa, Mycobacterium
LADPDTEL

SEQ ID NO: 516688 - protein, 15 aa, Mycobacterium
LADPERHCKILVTPE

SEQ ID NO: 516689 - protein, 7 aa, Mycobacterium
LADPGER

SEQ ID NO: 516690 - protein, 8 aa, Mycobacterium
LADPGPDE

SEQ ID NO: 516691 - protein, 6 aa, Mycobacterium
LADPGR

SEQ ID NO: 516692 - protein, 7 aa, Mycobacterium
LADPGSA

SEQ ID NO: 516693 - protein, 10 aa, Mycobacterium
LADPGSPQAV

SEQ ID NO: 516694 - protein, 9 aa, Mycobacterium
LADPPANAE

SEQ ID NO: 516695 - protein, 9 aa, Mycobacterium
LADPPPAGS

SEQ ID NO: 516696 - protein, 10 aa, Mycobacterium
LADPPPGSDL

SEQ ID NO: 516697 - protein, 11 aa, Mycobacterium
LADPPPGSGLK

SEQ ID NO: 516698 - protein, 8 aa, Mycobacterium
LADPPPQV

SEQ ID NO: 516699 - protein, 7 aa, Mycobacterium
LADPQRT

SEQ ID NO: 516700 - protein, 9 aa, Mycobacterium
LADPSKPTR

SEQ ID NO: 516701 - protein, 9 aa, Mycobacterium
LADPSQYLS

SEQ ID NO: 516702 - protein, 7 aa, Mycobacterium
LADPSST

SEQ ID NO: 516703 - protein, 7 aa, Mycobacterium
LADPTGY

SEQ ID NO: 516704 - protein, 17 aa, Mycobacterium
LADPYTAPAPLGSPDDV

SEQ ID NO: 516705 - protein, 12 aa, Mycobacterium
LADQDATAADAT

SEQ ID NO: 516706 - protein, 12 aa, Mycobacterium
LADQESTLANRR

SEQ ID NO: 516707 - protein, 18 aa, Mycobacterium
LADQGTSTLRRKQARQAA

SEQ ID NO: 516708 - protein, 9 aa, Mycobacterium
LADQKQDEA

SEQ ID NO: 516709 - protein, 6 aa, Mycobacterium
LADQTL

SEQ ID NO: 516710 - protein, 7 aa, Mycobacterium
LADQTNS

SEQ ID NO: 516711 - protein, 16 aa, Mycobacterium
LADRADAAIAPDEGAY

SEQ ID NO: 516712 - protein, 10 aa, Mycobacterium
LADREGSLPM

SEQ ID NO: 516713 - protein, 5 aa, Mycobacterium
LADRG

SEQ ID NO: 516714 - protein, 14 aa, Mycobacterium
LADRGAVASPQTRD

SEQ ID NO: 516715 - protein, 11 aa, Mycobacterium
LADRPGSPVTA

SEQ ID NO: 516716 - protein, 12 aa, Mycobacterium
LADRPPMKVLRP

SEQ ID NO: 516717 - protein, 12 aa, Mycobacterium
LADRPPMQAIRP

SEQ ID NO: 516718 - protein, 12 aa, Mycobacterium
LADRPPMSVLRP

SEQ ID NO: 516719 - protein, 12 aa, Mycobacterium
LADRPPMTTLRP

SEQ ID NO: 516720 - protein, 13 aa, Mycobacterium
LADRPVPKTPPRI

SEQ ID NO: 516721 - protein, 11 aa, Mycobacterium
LADRSDPKAAN

SEQ ID NO: 516722 - protein, 5 aa, Mycobacterium
LADRV

SEQ ID NO: 516723 - protein, 7 aa, Mycobacterium
LADSARQ

SEQ ID NO: 516724 - protein, 11 aa, Mycobacterium
LADSATAADGA

SEQ ID NO: 516725 - protein, 6 aa, Mycobacterium
LADSDA

SEQ ID NO: 516726 - protein, 8 aa, Mycobacterium
LADSDGDG

SEQ ID NO: 516727 - protein, 7 aa, Mycobacterium
LADSDGQ

SEQ ID NO: 516728 - protein, 5 aa, Mycobacterium
LADSG

SEQ ID NO: 516729 - protein, 6 aa, Mycobacterium
LADSGE

SEQ ID NO: 516730 - protein, 8 aa, Mycobacterium
LADSGGDG

SEQ ID NO: 516731 - protein, 7 aa, Mycobacterium
LADSGID

SEQ ID NO: 516732 - protein, 9 aa, Mycobacterium
LADSGSTFD

SEQ ID NO: 516733 - protein, 9 aa, Mycobacterium
LADSGSTMA

SEQ ID NO: 516734 - protein, 19 aa, Mycobacterium
LADSLRKDAPKVSIEDGPW

SEQ ID NO: 516735 - protein, 5 aa, Mycobacterium
LADSQ

SEQ ID NO: 516736 - protein, 5 aa, Mycobacterium
LADSR

SEQ ID NO: 516737 - protein, 11 aa, Mycobacterium
LADSRDDADPL

SEQ ID NO: 516738 - protein, 17 aa, Mycobacterium
LADSRKAARRTINEGGV

SEQ ID NO: 516739 - protein, 9 aa, Mycobacterium
LADSSDTQR

SEQ ID NO: 516740 - protein, 12 aa, Mycobacterium
LADSTDWGATSA

SEQ ID NO: 516741 - protein, 5 aa, Mycobacterium
LADTD

SEQ ID NO: 516742 - protein, 7 aa, Mycobacterium
LADTDHR

SEQ ID NO: 516743 - protein, 10 aa, Mycobacterium
LADTGEAQAY

SEQ ID NO: 516744 - protein, 9 aa, Mycobacterium
LADTGHRHP

SEQ ID NO: 516745 - protein, 7 aa, Mycobacterium
LADTNTE

SEQ ID NO: 516746 - protein, 9 aa, Mycobacterium
LADTRAASL

SEQ ID NO: 516747 - protein, 7 aa, Mycobacterium
LADTSDQ

SEQ ID NO: 516748 - protein, 16 aa, Mycobacterium
LADTVDRARAEAGLDS

SEQ ID NO: 516749 - protein, 11 aa, Mycobacterium
LADYPDQRAEL

SEQ ID NO: 516750 - protein, 33 aa, Mycobacterium
LAEAAAADEMAKASADSVSDADEEPTTEQGTSA

SEQ ID NO: 516751 - protein, 13 aa, Mycobacterium
LAEAAKAGTDGNQ

SEQ ID NO: 516752 - protein, 13 aa, Mycobacterium
LAEAAKAGTDGTE

SEQ ID NO: 516753 - protein, 14 aa, Mycobacterium
LAEAAKANSDGSDV

SEQ ID NO: 516754 - protein, 16 aa, Mycobacterium
LAEAAPERTAEWSART

SEQ ID NO: 516755 - protein, 9 aa, Mycobacterium
LAEADGDFD

SEQ ID NO: 516756 - protein, 6 aa, Mycobacterium
LAEAEG

SEQ ID NO: 516757 - protein, 14 aa, Mycobacterium
LAEAEGAVQSDGHP

SEQ ID NO: 516758 - protein, 16 aa, Mycobacterium
LAEAEQSRKPISPLTD

SEQ ID NO: 516759 - protein, 5 aa, Mycobacterium
LAEAG

SEQ ID NO: 516760 - protein, 6 aa, Mycobacterium
LAEAGA

SEQ ID NO: 516761 - protein, 9 aa, Mycobacterium
LAEAGGARK

SEQ ID NO: 516762 - protein, 13 aa, Mycobacterium
LAEAGKDVDPAEL

SEQ ID NO: 516763 - protein, 6 aa, Mycobacterium
LAEAGR

SEQ ID NO: 516764 - protein, 16 aa, Mycobacterium
LAEAGRAVAPGVTTDE

SEQ ID NO: 516765 - protein, 9 aa, Mycobacterium
LAEANPEIA

SEQ ID NO: 516766 - protein, 6 aa, Mycobacterium
LAEAPA

SEQ ID NO: 516767 - protein, 21 aa, Mycobacterium
LAEAPAAADGRFAVPQILGDS

SEQ ID NO: 516768 - protein, 9 aa, Mycobacterium
LAEAPGPDL

SEQ ID NO: 516769 - protein, 10 aa, Mycobacterium
LAEAPSAVDG

SEQ ID NO: 516770 - protein, 5 aa, Mycobacterium
LAEAQ

SEQ ID NO: 516771 - protein, 10 aa, Mycobacterium
LAEAQENGDV

SEQ ID NO: 516772 - protein, 10 aa, Mycobacterium
LAEAQNDPEV

SEQ ID NO: 516773 - protein, 5 aa, Mycobacterium
LAEAR

SEQ ID NO: 516774 - protein, 7 aa, Mycobacterium
LAEARAK

SEQ ID NO: 516775 - protein, 35 aa, Mycobacterium
LAEARKGGGAAPVYEAPKPEKKPEPAKPEPTPAPV

SEQ ID NO: 516776 - protein, 6 aa, Mycobacterium
LAEARS

SEQ ID NO: 516777 - protein, 7 aa, Mycobacterium
LAEARTA

SEQ ID NO: 516778 - protein, 16 aa, Mycobacterium
LAEATAPTRPHAGVES

SEQ ID NO: 516779 - protein, 15 aa, Mycobacterium
LAEATEADKRLARGE

SEQ ID NO: 516780 - protein, 9 aa, Mycobacterium
LAEATGDPD

SEQ ID NO: 516781 - protein, 9 aa, Mycobacterium
LAEATGGAV

SEQ ID NO: 516782 - protein, 7 aa, Mycobacterium
LAEATRD

SEQ ID NO: 516783 - protein, 8 aa, Mycobacterium
LAEDEKER

SEQ ID NO: 516784 - protein, 5 aa, Mycobacterium
LAEDG

SEQ ID NO: 516785 - protein, 8 aa, Mycobacterium
LAEDPTVD

SEQ ID NO: 516786 - protein, 10 aa, Mycobacterium
LAEDRGSFPA

SEQ ID NO: 516787 - protein, 13 aa, Mycobacterium
LAEDRRSNHHDDL

SEQ ID NO: 516788 - protein, 18 aa, Mycobacterium
LAEEARTVSELSGTADAL

SEQ ID NO: 516789 - protein, 18 aa, Mycobacterium
LAEEDTDAAGDELALVDL

SEQ ID NO: 516790 - protein, 39 aa, Mycobacterium
LAEEEPDVSADDVAEVGADGPRGRAHRGQIDGAPEDGQS

SEQ ID NO: 516791 - protein, 8 aa, Mycobacterium
LAEEGTTF

SEQ ID NO: 516792 - protein, 10 aa, Mycobacterium
LAEEKDPYGI

SEQ ID NO: 516793 - protein, 6 aa, Mycobacterium
LAEEPA

SEQ ID NO: 516794 - protein, 14 aa, Mycobacterium
LAEEPQPQDEPTQA

SEQ ID NO: 516795 - protein, 7 aa, Mycobacterium
LAEERGI

SEQ ID NO: 516796 - protein, 9 aa, Mycobacterium
LAEERGVTA

SEQ ID NO: 516797 - protein, 10 aa, Mycobacterium
LAEESGKRIR

SEQ ID NO: 516798 - protein, 7 aa, Mycobacterium
LAEETER

SEQ ID NO: 516799 - protein, 10 aa, Mycobacterium
LAEETGDAAK

SEQ ID NO: 516800 - protein, 5 aa, Mycobacterium
LAEGA

SEQ ID NO: 516801 - protein, 14 aa, Mycobacterium
LAEGAGDGSNLPGD

SEQ ID NO: 516802 - protein, 5 aa, Mycobacterium
LAEGD

SEQ ID NO: 516803 - protein, 15 aa, Mycobacterium
LAEGDAAATVEQRTS

SEQ ID NO: 516804 - protein, 13 aa, Mycobacterium
LAEGGEHVEEVSD

SEQ ID NO: 516805 - protein, 8 aa, Mycobacterium
LAEGGPGA

SEQ ID NO: 516806 - protein, 9 aa, Mycobacterium
LAEGKGDKV

SEQ ID NO: 516807 - protein, 8 aa, Mycobacterium
LAEGLSAT

SEQ ID NO: 516808 - protein, 8 aa, Mycobacterium
LAEGPDAL

SEQ ID NO: 516809 - protein, 9 aa, Mycobacterium
LAEGPGGLR

SEQ ID NO: 516810 - protein, 7 aa, Mycobacterium
LAEGPVA

SEQ ID NO: 516811 - protein, 9 aa, Mycobacterium
LAEGQPGPV

SEQ ID NO: 516812 - protein, 7 aa, Mycobacterium
LAEGSGQ

SEQ ID NO: 516813 - protein, 6 aa, Mycobacterium
LAEGSS

SEQ ID NO: 516814 - protein, 7 aa, Mycobacterium
LAEGSSI

SEQ ID NO: 516815 - protein, 6 aa, Mycobacterium
LAEGTA

SEQ ID NO: 516816 - protein, 9 aa, Mycobacterium
LAEGTDPGL

SEQ ID NO: 516817 - protein, 4 aa, Mycobacterium
LAEH

SEQ ID NO: 516818 - protein, 8 aa, Mycobacterium
LAEHGAQP

SEQ ID NO: 516819 - protein, 12 aa, Mycobacterium
LAEHGDERRATT

SEQ ID NO: 516820 - protein, 9 aa, Mycobacterium
LAEHPDQRR

SEQ ID NO: 516821 - protein, 4 aa, Mycobacterium
LAEI

SEQ ID NO: 516822 - protein, 10 aa, Mycobacterium
LAEKGVAARR

SEQ ID NO: 516823 - protein, 14 aa, Mycobacterium
LAEKKKENGGTGTY

SEQ ID NO: 516824 - protein, 12 aa, Mycobacterium
LAEKKKQTGQPV

SEQ ID NO: 516825 - protein, 8 aa, Mycobacterium
LAENADTT

SEQ ID NO: 516826 - protein, 12 aa, Mycobacterium
LAENAESAADLE

SEQ ID NO: 516827 - protein, 7 aa, Mycobacterium
LAENEET

SEQ ID NO: 516828 - protein, 5 aa, Mycobacterium
LAEPA

SEQ ID NO: 516829 - protein, 27 aa, Mycobacterium
LAEPADDATVVSDDGYQIGEEHPEVRE

SEQ ID NO: 516830 - protein, 9 aa, Mycobacterium
LAEPADSRA

SEQ ID NO: 516831 - protein, 11 aa, Mycobacterium
LAEPDESSRQL

SEQ ID NO: 516832 - protein, 8 aa, Mycobacterium
LAEPDRAA

SEQ ID NO: 516833 - protein, 11 aa, Mycobacterium
LAEPDRDRATD

SEQ ID NO: 516834 - protein, 5 aa, Mycobacterium
LAEPE

SEQ ID NO: 516835 - protein, 8 aa, Mycobacterium
LAEPERPL

SEQ ID NO: 516836 - protein, 5 aa, Mycobacterium
LAEPG

SEQ ID NO: 516837 - protein, 12 aa, Mycobacterium
LAEPGAEPGRVV

SEQ ID NO: 516838 - protein, 6 aa, Mycobacterium
LAEPGH

SEQ ID NO: 516839 - protein, 23 aa, Mycobacterium
LAEPGRSGLTAPATTARRDGGQW

SEQ ID NO: 516840 - protein, 5 aa, Mycobacterium
LAEPN

SEQ ID NO: 516841 - protein, 6 aa, Mycobacterium
LAEPPG

SEQ ID NO: 516842 - protein, 7 aa, Mycobacterium
LAEPPTE

SEQ ID NO: 516843 - protein, 7 aa, Mycobacterium
LAEPQPM

SEQ ID NO: 516844 - protein, 22 aa, Mycobacterium
LAEPSKAELAAYDEGGPAPARR

SEQ ID NO: 516845 - protein, 9 aa, Mycobacterium
LAEPSKSDY

SEQ ID NO: 516846 - protein, 11 aa, Mycobacterium
LAEPTREDAEP

SEQ ID NO: 516847 - protein, 5 aa, Mycobacterium
LAEQA

SEQ ID NO: 516848 - protein, 9 aa, Mycobacterium
LAEQAAEAG

SEQ ID NO: 516849 - protein, 12 aa, Mycobacterium
LAEQAARQDAAE

SEQ ID NO: 516850 - protein, 13 aa, Mycobacterium
LAEQAGGTVGRYS

SEQ ID NO: 516851 - protein, 15 aa, Mycobacterium
LAEQAGSQAVAAAGA

SEQ ID NO: 516852 - protein, 11 aa, Mycobacterium
LAEQASAQTSP

SEQ ID NO: 516853 - protein, 6 aa, Mycobacterium
LAEQED

SEQ ID NO: 516854 - protein, 6 aa, Mycobacterium
LAEQEE

SEQ ID NO: 516855 - protein, 24 aa, Mycobacterium
LAEQGSSREEFDAETRTEAEKAVK

SEQ ID NO: 516856 - protein, 16 aa, Mycobacterium
LAEQNRDEPGEEENKV

SEQ ID NO: 516857 - protein, 6 aa, Mycobacterium
LAEQRE

SEQ ID NO: 516858 - protein, 10 aa, Mycobacterium
LAEQRGNDAG

SEQ ID NO: 516859 - protein, 7 aa, Mycobacterium
LAEQSGM

SEQ ID NO: 516860 - protein, 7 aa, Mycobacterium
LAEQTGG

SEQ ID NO: 516861 - protein, 12 aa, Mycobacterium
LAEQTGGTVGRY

SEQ ID NO: 516862 - protein, 8 aa, Mycobacterium
LAEQTTAA

SEQ ID NO: 516863 - protein, 12 aa, Mycobacterium
LAERAPGPDQHP

SEQ ID NO: 516864 - protein, 8 aa, Mycobacterium
LAERASEK

SEQ ID NO: 516865 - protein, 7 aa, Mycobacterium
LAERASR

SEQ ID NO: 516866 - protein, 20 aa, Mycobacterium
LAERDAADRAEPRRRELPER

SEQ ID NO: 516867 - protein, 11 aa, Mycobacterium
LAERDGLEHER

SEQ ID NO: 516868 - protein, 12 aa, Mycobacterium
LAERDGRRGQEH

SEQ ID NO: 516869 - protein, 5 aa, Mycobacterium
LAERG

SEQ ID NO: 516870 - protein, 6 aa, Mycobacterium
LAERGR

SEQ ID NO: 516871 - protein, 11 aa, Mycobacterium
LAERGSADPRY

SEQ ID NO: 516872 - protein, 6 aa, Mycobacterium
LAERGT

SEQ ID NO: 516873 - protein, 8 aa, Mycobacterium
LAERKGKL

SEQ ID NO: 516874 - protein, 7 aa, Mycobacterium
LAERPGL

SEQ ID NO: 516875 - protein, 13 aa, Mycobacterium
LAERPIPKTAPRI

SEQ ID NO: 516876 - protein, 9 aa, Mycobacterium
LAERTEDPD

SEQ ID NO: 516877 - protein, 8 aa, Mycobacterium
LAERTGLP

SEQ ID NO: 516878 - protein, 15 aa, Mycobacterium
LAERTTPWAAEPATH

SEQ ID NO: 516879 - protein, 5 aa, Mycobacterium
LAERY

SEQ ID NO: 516880 - protein, 10 aa, Mycobacterium
LAESANDPET

SEQ ID NO: 516881 - protein, 7 aa, Mycobacterium
LAESGAT

SEQ ID NO: 516882 - protein, 9 aa, Mycobacterium
LAESGAVST

SEQ ID NO: 516883 - protein, 6 aa, Mycobacterium
LAESGQ

SEQ ID NO: 516884 - protein, 9 aa, Mycobacterium
LAESGVQST

SEQ ID NO: 516885 - protein, 12 aa, Mycobacterium
LAESGVSMSPRK

SEQ ID NO: 516886 - protein, 12 aa, Mycobacterium
LAESGYAATESV

SEQ ID NO: 516887 - protein, 8 aa, Mycobacterium
LAESGYGA

SEQ ID NO: 516888 - protein, 7 aa, Mycobacterium
LAESPYA

SEQ ID NO: 516889 - protein, 10 aa, Mycobacterium
LAESQHRGSA

SEQ ID NO: 516890 - protein, 12 aa, Mycobacterium
LAESTAAGYQNP

SEQ ID NO: 516891 - protein, 11 aa, Mycobacterium
LAESVRSESEV

SEQ ID NO: 516892 - protein, 4 aa, Mycobacterium
LAET

SEQ ID NO: 516893 - protein, 19 aa, Mycobacterium
LAETDSNDGDGLGGSTGLG

SEQ ID NO: 516894 - protein, 7 aa, Mycobacterium
LAETEAQ

SEQ ID NO: 516895 - protein, 20 aa, Mycobacterium
LAETEPVPALPERPLPPVPE

SEQ ID NO: 516896 - protein, 8 aa, Mycobacterium
LAETGAQN

SEQ ID NO: 516897 - protein, 7 aa, Mycobacterium
LAETGHS

SEQ ID NO: 516898 - protein, 6 aa, Mycobacterium
LAETGR

SEQ ID NO: 516899 - protein, 8 aa, Mycobacterium
LAETKPDV

SEQ ID NO: 516900 - protein, 7 aa, Mycobacterium
LAETPAP

SEQ ID NO: 516901 - protein, 6 aa, Mycobacterium
LAETPR

SEQ ID NO: 516902 - protein, 6 aa, Mycobacterium
LAETQG

SEQ ID NO: 516903 - protein, 6 aa, Mycobacterium
LAETRT

SEQ ID NO: 516904 - protein, 5 aa, Mycobacterium
LAETS

SEQ ID NO: 516905 - protein, 9 aa, Mycobacterium
LAETSTSAT

SEQ ID NO: 516906 - protein, 11 aa, Mycobacterium
LAETTAEHESG

SEQ ID NO: 516907 - protein, 9 aa, Mycobacterium
LAETTSRED

SEQ ID NO: 516908 - protein, 8 aa, Mycobacterium
LAEYDQSD

SEQ ID NO: 516909 - protein, 11 aa, Mycobacterium
LAGAAASFSSV

SEQ ID NO: 516910 - protein, 7 aa, Mycobacterium
LAGAAKR

SEQ ID NO: 516911 - protein, 11 aa, Mycobacterium
LAGAASPLAGL

SEQ ID NO: 516912 - protein, 5 aa, Mycobacterium
LAGAD

SEQ ID NO: 516913 - protein, 12 aa, Mycobacterium
LAGADGSLDPVQ

SEQ ID NO: 516914 - protein, 9 aa, Mycobacterium
LAGADSPTE

SEQ ID NO: 516915 - protein, 6 aa, Mycobacterium
LAGAGA

SEQ ID NO: 516916 - protein, 10 aa, Mycobacterium
LAGAGAGNSD

SEQ ID NO: 516917 - protein, 10 aa, Mycobacterium
LAGAGDAGTV

SEQ ID NO: 516918 - protein, 8 aa, Mycobacterium
LAGAGGTA

SEQ ID NO: 516919 - protein, 12 aa, Mycobacterium
LAGAGLPGLPGV

SEQ ID NO: 516920 - protein, 9 aa, Mycobacterium
LAGAGPGQL

SEQ ID NO: 516921 - protein, 8 aa, Mycobacterium
LAGAGSGL

SEQ ID NO: 516922 - protein, 13 aa, Mycobacterium
LAGAGTARRGVPP

SEQ ID NO: 516923 - protein, 30 aa, Mycobacterium
LAGAPAPAAPAAPAAPATGANPVAPLLAAL

SEQ ID NO: 516924 - protein, 8 aa, Mycobacterium
LAGAPEAM

SEQ ID NO: 516925 - protein, 9 aa, Mycobacterium
LAGAPEAPT

SEQ ID NO: 516926 - protein, 6 aa, Mycobacterium
LAGAQP

SEQ ID NO: 516927 - protein, 12 aa, Mycobacterium
LAGASGQANYAA

SEQ ID NO: 516928 - protein, 14 aa, Mycobacterium
LAGASGQANYAAGN

SEQ ID NO: 516929 - protein, 5 aa, Mycobacterium
LAGAT

SEQ ID NO: 516930 - protein, 21 aa, Mycobacterium
LAGATANNAPAITAGRPVSKH

SEQ ID NO: 516931 - protein, 30 aa, Mycobacterium
LAGATQDDELQAGRMKEAEARRGDLSRICS

SEQ ID NO: 516932 - protein, 19 aa, Mycobacterium
LAGDARAQADSTAADNSFS

SEQ ID NO: 516933 - protein, 7 aa, Mycobacterium
LAGDEVS

SEQ ID NO: 516934 - protein, 9 aa, Mycobacterium
LAGDGEEAN

SEQ ID NO: 516935 - protein, 6 aa, Mycobacterium
LAGDGI

SEQ ID NO: 516936 - protein, 6 aa, Mycobacterium
LAGDGN

SEQ ID NO: 516937 - protein, 11 aa, Mycobacterium
LAGDGTAKPGT

SEQ ID NO: 516938 - protein, 7 aa, Mycobacterium
LAGDGVD

SEQ ID NO: 516939 - protein, 9 aa, Mycobacterium
LAGDNYSTR

SEQ ID NO: 516940 - protein, 7 aa, Mycobacterium
LAGDPAF

SEQ ID NO: 516941 - protein, 14 aa, Mycobacterium
LAGDPPARVRPPGA

SEQ ID NO: 516942 - protein, 19 aa, Mycobacterium
LAGDPRYATPDDRQRHAEA

SEQ ID NO: 516943 - protein, 10 aa, Mycobacterium
LAGDQGAAGR

SEQ ID NO: 516944 - protein, 12 aa, Mycobacterium
LAGEADYGEVPP

SEQ ID NO: 516945 - protein, 8 aa, Mycobacterium
LAGEANLG

SEQ ID NO: 516946 - protein, 7 aa, Mycobacterium
LAGEDDA

SEQ ID NO: 516947 - protein, 19 aa, Mycobacterium
LAGEERAARAPSVAGASID

SEQ ID NO: 516948 - protein, 11 aa, Mycobacterium
LAGEERAPAPA

SEQ ID NO: 516949 - protein, 6 aa, Mycobacterium
LAGEPA

SEQ ID NO: 516950 - protein, 7 aa, Mycobacterium
LAGEPAD

SEQ ID NO: 516951 - protein, 7 aa, Mycobacterium
LAGEPEL

SEQ ID NO: 516952 - protein, 9 aa, Mycobacterium
LAGEPGGDR

SEQ ID NO: 516953 - protein, 10 aa, Mycobacterium
LAGEPRDSVP

SEQ ID NO: 516954 - protein, 9 aa, Mycobacterium
LAGEPSYKQ

SEQ ID NO: 516955 - protein, 5 aa, Mycobacterium
LAGET

SEQ ID NO: 516956 - protein, 6 aa, Mycobacterium
LAGETG

SEQ ID NO: 516957 - protein, 8 aa, Mycobacterium
LAGETGRR

SEQ ID NO: 516958 - protein, 9 aa, Mycobacterium
LAGETPQQQ

SEQ ID NO: 516959 - protein, 8 aa, Mycobacterium
LAGGASGI

SEQ ID NO: 516960 - protein, 9 aa, Mycobacterium
LAGGATSNW

SEQ ID NO: 516961 - protein, 14 aa, Mycobacterium
LAGGDGGDGGQGGF

SEQ ID NO: 516962 - protein, 9 aa, Mycobacterium
LAGGDPGAC

SEQ ID NO: 516963 - protein, 9 aa, Mycobacterium
LAGGDPQAA

SEQ ID NO: 516964 - protein, 21 aa, Mycobacterium
LAGGEADDAESRLPQLTQGQR

SEQ ID NO: 516965 - protein, 21 aa, Mycobacterium
LAGGEADDAESRLPQLTRGQR

SEQ ID NO: 516966 - protein, 7 aa, Mycobacterium
LAGGEKG

SEQ ID NO: 516967 - protein, 11 aa, Mycobacterium
LAGGEKGRPRY

SEQ ID NO: 516968 - protein, 10 aa, Mycobacterium
LAGGEPDGMP

SEQ ID NO: 516969 - protein, 6 aa, Mycobacterium
LAGGER

SEQ ID NO: 516970 - protein, 42 aa, Mycobacterium
LAGGESDDAESRLPNLTQGQRVDAADLSADGHQTSPPARYTE

SEQ ID NO: 516971 - protein, 32 aa, Mycobacterium
LAGGESVRPAAAGDIAGAGQGGGAAGRGMAGG

SEQ ID NO: 516972 - protein, 14 aa, Mycobacterium
LAGGGEQYRRSSPN

SEQ ID NO: 516973 - protein, 8 aa, Mycobacterium
LAGGGLST

SEQ ID NO: 516974 - protein, 8 aa, Mycobacterium
LAGGGPKY

SEQ ID NO: 516975 - protein, 12 aa, Mycobacterium
LAGGGTEDAAGA

SEQ ID NO: 516976 - protein, 31 aa, Mycobacterium
LAGGLGSAAGMSSAGAALSASLGGAGSIGGL

SEQ ID NO: 516977 - protein, 5 aa, Mycobacterium
LAGGN

SEQ ID NO: 516978 - protein, 8 aa, Mycobacterium
LAGGPDQA

SEQ ID NO: 516979 - protein, 25 aa, Mycobacterium
LAGGPDSRQAFAASPDHDTDLPGGM

SEQ ID NO: 516980 - protein, 17 aa, Mycobacterium
LAGGPENTDADHDDAPP

SEQ ID NO: 516981 - protein, 7 aa, Mycobacterium
LAGGPVD

SEQ ID NO: 516982 - protein, 9 aa, Mycobacterium
LAGGQAARK

SEQ ID NO: 516983 - protein, 5 aa, Mycobacterium
LAGGR

SEQ ID NO: 516984 - protein, 13 aa, Mycobacterium
LAGGRAPGPLLSI

SEQ ID NO: 516985 - protein, 13 aa, Mycobacterium
LAGGRAPGPLQSI

SEQ ID NO: 516986 - protein, 7 aa, Mycobacterium
LAGGSAG

SEQ ID NO: 516987 - protein, 12 aa, Mycobacterium
LAGGSGPSAGAG

SEQ ID NO: 516988 - protein, 8 aa, Mycobacterium
LAGGSPQH

SEQ ID NO: 516989 - protein, 8 aa, Mycobacterium
LAGGSSTS

SEQ ID NO: 516990 - protein, 5 aa, Mycobacterium
LAGGT

SEQ ID NO: 516991 - protein, 6 aa, Mycobacterium
LAGGTG

SEQ ID NO: 516992 - protein, 9 aa, Mycobacterium
LAGGTPQRA

SEQ ID NO: 516993 - protein, 5 aa, Mycobacterium
LAGHA

SEQ ID NO: 516994 - protein, 9 aa, Mycobacterium
LAGHPDAAR

SEQ ID NO: 516995 - protein, 6 aa, Mycobacterium
LAGISG

SEQ ID NO: 516996 - protein, 7 aa, Mycobacterium
LAGISGS

SEQ ID NO: 516997 - protein, 12 aa, Mycobacterium
LAGKAEKWGPLS

SEQ ID NO: 516998 - protein, 11 aa, Mycobacterium
LAGKANADADV

SEQ ID NO: 516999 - protein, 9 aa, Mycobacterium
LAGKKDRRH

SEQ ID NO: 517000 - protein, 6 aa, Mycobacterium
LAGKPK

SEQ ID NO: 517001 - protein, 9 aa, Mycobacterium
LAGKRRSTL

SEQ ID NO: 517002 - protein, 11 aa, Mycobacterium
LAGKSKDEVNA

SEQ ID NO: 517003 - protein, 11 aa, Mycobacterium
LAGLPDKLRSR

SEQ ID NO: 517004 - protein, 6 aa, Mycobacterium
LAGLPG

SEQ ID NO: 517005 - protein, 5 aa, Mycobacterium
LAGLS

SEQ ID NO: 517006 - protein, 6 aa, Mycobacterium
LAGNAT

SEQ ID NO: 517007 - protein, 10 aa, Mycobacterium
LAGNDSIDPR

SEQ ID NO: 517008 - protein, 5 aa, Mycobacterium
LAGNG

SEQ ID NO: 517009 - protein, 7 aa, Mycobacterium
LAGNGDR

SEQ ID NO: 517010 - protein, 33 aa, Mycobacterium
LAGNGGNGGTGGDGGAGGDGGNGGNGGAGGAGG

SEQ ID NO: 517011 - protein, 12 aa, Mycobacterium
LAGNKDKVNEAV

SEQ ID NO: 517012 - protein, 10 aa, Mycobacterium
LAGNPAVDTA

SEQ ID NO: 517013 - protein, 7 aa, Mycobacterium
LAGNPIR

SEQ ID NO: 517014 - protein, 7 aa, Mycobacterium
LAGNPPV

SEQ ID NO: 517015 - protein, 9 aa, Mycobacterium
LAGNPSWDA

SEQ ID NO: 517016 - protein, 6 aa, Mycobacterium
LAGNTA

SEQ ID NO: 517017 - protein, 7 aa, Mycobacterium
LAGNTGY

SEQ ID NO: 517018 - protein, 9 aa, Mycobacterium
LAGPAAQQR

SEQ ID NO: 517019 - protein, 7 aa, Mycobacterium
LAGPAAS

SEQ ID NO: 517020 - protein, 19 aa, Mycobacterium
LAGPAQPPHPEDPDDPFDD

SEQ ID NO: 517021 - protein, 7 aa, Mycobacterium
LAGPARK

SEQ ID NO: 517022 - protein, 8 aa, Mycobacterium
LAGPDDQL

SEQ ID NO: 517023 - protein, 10 aa, Mycobacterium
LAGPDGALDP

SEQ ID NO: 517024 - protein, 11 aa, Mycobacterium
LAGPDKADGVR

SEQ ID NO: 517025 - protein, 9 aa, Mycobacterium
LAGPDQNNI

SEQ ID NO: 517026 - protein, 7 aa, Mycobacterium
LAGPDSG

SEQ ID NO: 517027 - protein, 9 aa, Mycobacterium
LAGPDTAQQ

SEQ ID NO: 517028 - protein, 9 aa, Mycobacterium
LAGPDTPVG

SEQ ID NO: 517029 - protein, 20 aa, Mycobacterium
LAGPEAPAVGLPPAARADMA

SEQ ID NO: 517030 - protein, 5 aa, Mycobacterium
LAGPG

SEQ ID NO: 517031 - protein, 15 aa, Mycobacterium
LAGPGAAAAGAGPKY

SEQ ID NO: 517032 - protein, 11 aa, Mycobacterium
LAGPGDVDVEN

SEQ ID NO: 517033 - protein, 6 aa, Mycobacterium
LAGPGE

SEQ ID NO: 517034 - protein, 28 aa, Mycobacterium
LAGPGGAGGDGGASLGRSGGSGGAGGNA

SEQ ID NO: 517035 - protein, 10 aa, Mycobacterium
LAGPGPVDVE

SEQ ID NO: 517036 - protein, 13 aa, Mycobacterium
LAGPGQNLAKQQG

SEQ ID NO: 517037 - protein, 8 aa, Mycobacterium
LAGPGTPF

SEQ ID NO: 517038 - protein, 6 aa, Mycobacterium
LAGPGV

SEQ ID NO: 517039 - protein, 5 aa, Mycobacterium
LAGPI

SEQ ID NO: 517040 - protein, 6 aa, Mycobacterium
LAGPNR

SEQ ID NO: 517041 - protein, 6 aa, Mycobacterium
LAGPPA

SEQ ID NO: 517042 - protein, 11 aa, Mycobacterium
LAGPPDDERIP

SEQ ID NO: 517043 - protein, 11 aa, Mycobacterium
LAGPQAAANPF

SEQ ID NO: 517044 - protein, 9 aa, Mycobacterium
LAGPQAGQR

SEQ ID NO: 517045 - protein, 6 aa, Mycobacterium
LAGPRR

SEQ ID NO: 517046 - protein, 6 aa, Mycobacterium
LAGPSE

SEQ ID NO: 517047 - protein, 10 aa, Mycobacterium
LAGPSEAAGY

SEQ ID NO: 517048 - protein, 10 aa, Mycobacterium
LAGPSENPAR

SEQ ID NO: 517049 - protein, 8 aa, Mycobacterium
LAGPSGSA

SEQ ID NO: 517050 - protein, 5 aa, Mycobacterium
LAGPT

SEQ ID NO: 517051 - protein, 6 aa, Mycobacterium
LAGPTW

SEQ ID NO: 517052 - protein, 13 aa, Mycobacterium
LAGPVEKLAYRPG

SEQ ID NO: 517053 - protein, 5 aa, Mycobacterium
LAGQR

SEQ ID NO: 517054 - protein, 33 aa, Mycobacterium
LAGQRARSRAASDPGRARDSYERDDELQQRTGD

SEQ ID NO: 517055 - protein, 26 aa, Mycobacterium
LAGQRARSRAESDPGRARDSYERDDE

SEQ ID NO: 517056 - protein, 5 aa, Mycobacterium
LAGQS

SEQ ID NO: 517057 - protein, 7 aa, Mycobacterium
LAGQSVP

SEQ ID NO: 517058 - protein, 5 aa, Mycobacterium
LAGQT

SEQ ID NO: 517059 - protein, 29 aa, Mycobacterium
LAGQVDSTFDTGCSGGPGSTNSSQFWLVR

SEQ ID NO: 517060 - protein, 6 aa, Mycobacterium
LAGRAA

SEQ ID NO: 517061 - protein, 7 aa, Mycobacterium
LAGRADQ

SEQ ID NO: 517062 - protein, 14 aa, Mycobacterium
LAGRAEDDGEEGGF

SEQ ID NO: 517063 - protein, 16 aa, Mycobacterium
LAGRAGDGEEGFSDGS

SEQ ID NO: 517064 - protein, 18 aa, Mycobacterium
LAGRAPAKPVGQLTGEDH

SEQ ID NO: 517065 - protein, 19 aa, Mycobacterium
LAGRAPAKSAGQLTGDDEA

SEQ ID NO: 517066 - protein, 5 aa, Mycobacterium
LAGRG

SEQ ID NO: 517067 - protein, 8 aa, Mycobacterium
LAGRGGTA

SEQ ID NO: 517068 - protein, 5 aa, Mycobacterium
LAGRN

SEQ ID NO: 517069 - protein, 16 aa, Mycobacterium
LAGRPEPTGVKATDDI

SEQ ID NO: 517070 - protein, 7 aa, Mycobacterium
LAGRPFG

SEQ ID NO: 517071 - protein, 15 aa, Mycobacterium
LAGRPRFVTAVKRLV

SEQ ID NO: 517072 - protein, 9 aa, Mycobacterium
LAGRPSPEA

SEQ ID NO: 517073 - protein, 9 aa, Mycobacterium
LAGRPTPEA

SEQ ID NO: 517074 - protein, 11 aa, Mycobacterium
LAGRPTRANFR

SEQ ID NO: 517075 - protein, 5 aa, Mycobacterium
LAGRR

SEQ ID NO: 517076 - protein, 12 aa, Mycobacterium
LAGRRGRRLNPR

SEQ ID NO: 517077 - protein, 10 aa, Mycobacterium
LAGRSEVGRA

SEQ ID NO: 517078 - protein, 12 aa, Mycobacterium
LAGSAARQASLE

SEQ ID NO: 517079 - protein, 12 aa, Mycobacterium
LAGSAARRARVD

SEQ ID NO: 517080 - protein, 5 aa, Mycobacterium
LAGSD

SEQ ID NO: 517081 - protein, 10 aa, Mycobacterium
LAGSDRAQRW

SEQ ID NO: 517082 - protein, 7 aa, Mycobacterium
LAGSDSF

SEQ ID NO: 517083 - protein, 9 aa, Mycobacterium
LAGSDSFAE

SEQ ID NO: 517084 - protein, 10 aa, Mycobacterium
LAGSDSFGDP

SEQ ID NO: 517085 - protein, 8 aa, Mycobacterium
LAGSDSGL

SEQ ID NO: 517086 - protein, 8 aa, Mycobacterium
LAGSEDRA

SEQ ID NO: 517087 - protein, 27 aa, Mycobacterium
LAGSENEESEARAAGRASRFREETRSE

SEQ ID NO: 517088 - protein, 8 aa, Mycobacterium
LAGSEPTI

SEQ ID NO: 517089 - protein, 6 aa, Mycobacterium
LAGSGA

SEQ ID NO: 517090 - protein, 9 aa, Mycobacterium
LAGSGAADA

SEQ ID NO: 517091 - protein, 13 aa, Mycobacterium
LAGSGGNGGNAGA

SEQ ID NO: 517092 - protein, 8 aa, Mycobacterium
LAGSGGRL

SEQ ID NO: 517093 - protein, 8 aa, Mycobacterium
LAGSGGRR

SEQ ID NO: 517094 - protein, 7 aa, Mycobacterium
LAGSGKP

SEQ ID NO: 517095 - protein, 7 aa, Mycobacterium
LAGSGRW

SEQ ID NO: 517096 - protein, 20 aa, Mycobacterium
LAGSHDPAPGKSYGGETPLA

SEQ ID NO: 517097 - protein, 7 aa, Mycobacterium
LAGSNTV

SEQ ID NO: 517098 - protein, 7 aa, Mycobacterium
LAGSPMK

SEQ ID NO: 517099 - protein, 7 aa, Mycobacterium
LAGSPTA

SEQ ID NO: 517100 - protein, 10 aa, Mycobacterium
LAGSSRETIN

SEQ ID NO: 517101 - protein, 12 aa, Mycobacterium
LAGSSTGATDDG

SEQ ID NO: 517102 - protein, 11 aa, Mycobacterium
LAGSTDERDRP

SEQ ID NO: 517103 - protein, 4 aa, Mycobacterium
LAGT

SEQ ID NO: 517104 - protein, 6 aa, Mycobacterium
LAGTAR

SEQ ID NO: 517105 - protein, 28 aa, Mycobacterium
LAGTATAATGATAETTGSRATAATGSAA

SEQ ID NO: 517106 - protein, 9 aa, Mycobacterium
LAGTDGDGV

SEQ ID NO: 517107 - protein, 7 aa, Mycobacterium
LAGTDKS

SEQ ID NO: 517108 - protein, 17 aa, Mycobacterium
LAGTDSAELTKTFGPTT

SEQ ID NO: 517109 - protein, 5 aa, Mycobacterium
LAGTE

SEQ ID NO: 517110 - protein, 6 aa, Mycobacterium
LAGTER

SEQ ID NO: 517111 - protein, 5 aa, Mycobacterium
LAGTG

SEQ ID NO: 517112 - protein, 11 aa, Mycobacterium
LAGTGADTGTL

SEQ ID NO: 517113 - protein, 28 aa, Mycobacterium
LAGTGAGDSTELEDDGVGDSWEASDDWR

SEQ ID NO: 517114 - protein, 20 aa, Mycobacterium
LAGTGGAGGELFGANGMDGL

SEQ ID NO: 517115 - protein, 18 aa, Mycobacterium
LAGTGKLGAEVTPDEGKA

SEQ ID NO: 517116 - protein, 7 aa, Mycobacterium
LAGTGRR

SEQ ID NO: 517117 - protein, 6 aa, Mycobacterium
LAGTGV

SEQ ID NO: 517118 - protein, 15 aa, Mycobacterium
LAGTGVARAGAAPMA

SEQ ID NO: 517119 - protein, 6 aa, Mycobacterium
LAGTNT

SEQ ID NO: 517120 - protein, 25 aa, Mycobacterium
LAGTPAGPAVATATADSASSTSPTV

SEQ ID NO: 517121 - protein, 9 aa, Mycobacterium
LAGTPASVL

SEQ ID NO: 517122 - protein, 8 aa, Mycobacterium
LAGTPDAT

SEQ ID NO: 517123 - protein, 9 aa, Mycobacterium
LAGTPEGPW

SEQ ID NO: 517124 - protein, 6 aa, Mycobacterium
LAGTPV

SEQ ID NO: 517125 - protein, 5 aa, Mycobacterium
LAGTQ

SEQ ID NO: 517126 - protein, 8 aa, Mycobacterium
LAGTQSDL

SEQ ID NO: 517127 - protein, 6 aa, Mycobacterium
LAGTRA

SEQ ID NO: 517128 - protein, 13 aa, Mycobacterium
LAGTRALGRGAAH

SEQ ID NO: 517129 - protein, 27 aa, Mycobacterium
LAGTRALGRGEARDREARDDLESNSKE

SEQ ID NO: 517130 - protein, 5 aa, Mycobacterium
LAGTS

SEQ ID NO: 517131 - protein, 11 aa, Mycobacterium
LAGTTTPTAAQ

SEQ ID NO: 517132 - protein, 5 aa, Mycobacterium
LAGYD

SEQ ID NO: 517133 - protein, 6 aa, Mycobacterium
LAGYTD

SEQ ID NO: 517134 - protein, 4 aa, Mycobacterium
LAHA

SEQ ID NO: 517135 - protein, 7 aa, Mycobacterium
LAHDTDK

SEQ ID NO: 517136 - protein, 4 aa, Mycobacterium
LAHG

SEQ ID NO: 517137 - protein, 7 aa, Mycobacterium
LAHGSGD

SEQ ID NO: 517138 - protein, 22 aa, Mycobacterium
LAHKPTPQTKPGLTAERATNIK

SEQ ID NO: 517139 - protein, 80 aa, Mycobacterium
LAHKSTAQTKLTSAAEPAAETKPGLTTQPAAESKSEPTTDSGLTAKAHSQTRLRADPKAQTGASLTGKSTLKTGSDAQAG

SEQ ID NO: 517140 - protein, 6 aa, Mycobacterium
LAHPGR

SEQ ID NO: 517141 - protein, 22 aa, Mycobacterium
LAHPPTRPPPAVPPCPGPTGER

SEQ ID NO: 517142 - protein, 4 aa, Mycobacterium
LAIP

SEQ ID NO: 517143 - protein, 12 aa, Mycobacterium
LAIPDDTSIAQE

SEQ ID NO: 517144 - protein, 12 aa, Mycobacterium
LAIPDGTSVAQQ

SEQ ID NO: 517145 - protein, 25 aa, Mycobacterium
LAKAAEGDVDADSVRAGLEKSGITL

SEQ ID NO: 517146 - protein, 11 aa, Mycobacterium
LAKADDLNSPH

SEQ ID NO: 517147 - protein, 19 aa, Mycobacterium
LAKADEGVRARAIEFLDSR

SEQ ID NO: 517148 - protein, 8 aa, Mycobacterium
LAKADGAR

SEQ ID NO: 517149 - protein, 8 aa, Mycobacterium
LAKAQAAD

SEQ ID NO: 517150 - protein, 14 aa, Mycobacterium
LAKETASAKQDATV

SEQ ID NO: 517151 - protein, 13 aa, Mycobacterium
LAKETSSKKYDAT

SEQ ID NO: 517152 - protein, 14 aa, Mycobacterium
LAKETSSSKQDATV

SEQ ID NO: 517153 - protein, 13 aa, Mycobacterium
LAKETSSTKQDAT

SEQ ID NO: 517154 - protein, 14 aa, Mycobacterium
LAKETSSTKQDATV

SEQ ID NO: 517155 - protein, 10 aa, Mycobacterium
LAKGGAGNRD

SEQ ID NO: 517156 - protein, 16 aa, Mycobacterium
LAKGHGAADWSKRPLP

SEQ ID NO: 517157 - protein, 16 aa, Mycobacterium
LAKGHPHAQERDNALS

SEQ ID NO: 517158 - protein, 8 aa, Mycobacterium
LAKGNTQA

SEQ ID NO: 517159 - protein, 6 aa, Mycobacterium
LAKGSW

SEQ ID NO: 517160 - protein, 7 aa, Mycobacterium
LAKKDAD

SEQ ID NO: 517161 - protein, 10 aa, Mycobacterium
LAKNAKQAKK

SEQ ID NO: 517162 - protein, 8 aa, Mycobacterium
LAKPATEA

SEQ ID NO: 517163 - protein, 6 aa, Mycobacterium
LAKPGA

SEQ ID NO: 517164 - protein, 9 aa, Mycobacterium
LAKPGTVDE

SEQ ID NO: 517165 - protein, 8 aa, Mycobacterium
LAKPKPRF

SEQ ID NO: 517166 - protein, 7 aa, Mycobacterium
LAKPRTD

SEQ ID NO: 517167 - protein, 8 aa, Mycobacterium
LAKPSRPF

SEQ ID NO: 517168 - protein, 5 aa, Mycobacterium
LAKPT

SEQ ID NO: 517169 - protein, 5 aa, Mycobacterium
LAKQA

SEQ ID NO: 517170 - protein, 4 aa, Mycobacterium
LAKR

SEQ ID NO: 517171 - protein, 6 aa, Mycobacterium
LAKRGA

SEQ ID NO: 517172 - protein, 8 aa, Mycobacterium
LAKRGGAE

SEQ ID NO: 517173 - protein, 9 aa, Mycobacterium
LAKSASVED

SEQ ID NO: 517174 - protein, 10 aa, Mycobacterium
LAKSATAEEI

SEQ ID NO: 517175 - protein, 12 aa, Mycobacterium
LAKSDDATRETL

SEQ ID NO: 517176 - protein, 6 aa, Mycobacterium
LAKSGA

SEQ ID NO: 517177 - protein, 8 aa, Mycobacterium
LAKSRGWS

SEQ ID NO: 517178 - protein, 34 aa, Mycobacterium
LAKSSGGSDHKDAGGKQSRAHGPVESRREFRRKS

SEQ ID NO: 517179 - protein, 4 aa, Mycobacterium
LAKT

SEQ ID NO: 517180 - protein, 13 aa, Mycobacterium
LAKTADPHIEATG

SEQ ID NO: 517181 - protein, 5 aa, Mycobacterium
LAKTD

SEQ ID NO: 517182 - protein, 12 aa, Mycobacterium
LAKTDEDTRKTF

SEQ ID NO: 517183 - protein, 7 aa, Mycobacterium
LAKTGRY

SEQ ID NO: 517184 - protein, 9 aa, Mycobacterium
LAKTPDDRT

SEQ ID NO: 517185 - protein, 11 aa, Mycobacterium
LAKTPNDPNAL

SEQ ID NO: 517186 - protein, 7 aa, Mycobacterium
LAKYGRR

SEQ ID NO: 517187 - protein, 6 aa, Mycobacterium
LALDPE

SEQ ID NO: 517188 - protein, 4 aa, Mycobacterium
LANA

SEQ ID NO: 517189 - protein, 9 aa, Mycobacterium
LANAGKSIG

SEQ ID NO: 517190 - protein, 18 aa, Mycobacterium
LANAGNDNQGWSNTGNNN

SEQ ID NO: 517191 - protein, 31 aa, Mycobacterium
LANAGSTVLSSTPKPAKTAGEKVTDEGEGGN

SEQ ID NO: 517192 - protein, 8 aa, Mycobacterium
LANAGTAV

SEQ ID NO: 517193 - protein, 9 aa, Mycobacterium
LANAPSEAF

SEQ ID NO: 517194 - protein, 9 aa, Mycobacterium
LANASNSRE

SEQ ID NO: 517195 - protein, 7 aa, Mycobacterium
LANDGEP

SEQ ID NO: 517196 - protein, 6 aa, Mycobacterium
LANDRA

SEQ ID NO: 517197 - protein, 14 aa, Mycobacterium
LANDTDAKGNSMID

SEQ ID NO: 517198 - protein, 9 aa, Mycobacterium
LANELAPKG

SEQ ID NO: 517199 - protein, 9 aa, Mycobacterium
LANGASAEQ

SEQ ID NO: 517200 - protein, 9 aa, Mycobacterium
LANGATGDQ

SEQ ID NO: 517201 - protein, 8 aa, Mycobacterium
LANGDPAG

SEQ ID NO: 517202 - protein, 6 aa, Mycobacterium
LANGGD

SEQ ID NO: 517203 - protein, 9 aa, Mycobacterium
LANGGRPYS

SEQ ID NO: 517204 - protein, 4 aa, Mycobacterium
LANN

SEQ ID NO: 517205 - protein, 5 aa, Mycobacterium
LANNR

SEQ ID NO: 517206 - protein, 8 aa, Mycobacterium
LANPAEGE

SEQ ID NO: 517207 - protein, 11 aa, Mycobacterium
LANPDEDASGI

SEQ ID NO: 517208 - protein, 17 aa, Mycobacterium
LANPDLPQRVSSGAPLE

SEQ ID NO: 517209 - protein, 6 aa, Mycobacterium
LANPDV

SEQ ID NO: 517210 - protein, 6 aa, Mycobacterium
LANPSD

SEQ ID NO: 517211 - protein, 9 aa, Mycobacterium
LANPSFGDD

SEQ ID NO: 517212 - protein, 7 aa, Mycobacterium
LANPTIS

SEQ ID NO: 517213 - protein, 24 aa, Mycobacterium
LANQGASSQKELETKGREAGRAAT

SEQ ID NO: 517214 - protein, 10 aa, Mycobacterium
LANQTAEAVQ

SEQ ID NO: 517215 - protein, 5 aa, Mycobacterium
LANSA

SEQ ID NO: 517216 - protein, 6 aa, Mycobacterium
LANSAP

SEQ ID NO: 517217 - protein, 7 aa, Mycobacterium
LANSDTS

SEQ ID NO: 517218 - protein, 26 aa, Mycobacterium
LANSPVSGSLGNAGVSAGLGESATVG

SEQ ID NO: 517219 - protein, 8 aa, Mycobacterium
LANSSVPD

SEQ ID NO: 517220 - protein, 7 aa, Mycobacterium
LANTASG

SEQ ID NO: 517221 - protein, 9 aa, Mycobacterium
LANTGDGNI

SEQ ID NO: 517222 - protein, 13 aa, Mycobacterium
LANTGFGNSGSNN

SEQ ID NO: 517223 - protein, 9 aa, Mycobacterium
LANTGNGNI

SEQ ID NO: 517224 - protein, 14 aa, Mycobacterium
LANTGNGNSGVGFT

SEQ ID NO: 517225 - protein, 9 aa, Mycobacterium
LANTGSNNF

SEQ ID NO: 517226 - protein, 7 aa, Mycobacterium
LANYGNS

SEQ ID NO: 517227 - protein, 5 aa, Mycobacterium
LAPAA

SEQ ID NO: 517228 - protein, 9 aa, Mycobacterium
LAPAAAQRC

SEQ ID NO: 517229 - protein, 7 aa, Mycobacterium
LAPAADD

SEQ ID NO: 517230 - protein, 10 aa, Mycobacterium
LAPAAGDEIS

SEQ ID NO: 517231 - protein, 21 aa, Mycobacterium
LAPAAKAASEGAKAAAGLPAV

SEQ ID NO: 517232 - protein, 6 aa, Mycobacterium
LAPAAT

SEQ ID NO: 517233 - protein, 10 aa, Mycobacterium
LAPAATPGVL

SEQ ID NO: 517234 - protein, 10 aa, Mycobacterium
LAPADTAGLD

SEQ ID NO: 517235 - protein, 11 aa, Mycobacterium
LAPADTAGLDP

SEQ ID NO: 517236 - protein, 7 aa, Mycobacterium
LAPADTI

SEQ ID NO: 517237 - protein, 8 aa, Mycobacterium
LAPAEPPP

SEQ ID NO: 517238 - protein, 7 aa, Mycobacterium
LAPAESA

SEQ ID NO: 517239 - protein, 6 aa, Mycobacterium
LAPAGA

SEQ ID NO: 517240 - protein, 11 aa, Mycobacterium
LAPAGDPKRLQ

SEQ ID NO: 517241 - protein, 12 aa, Mycobacterium
LAPAKEGDADIR

SEQ ID NO: 517242 - protein, 22 aa, Mycobacterium
LAPAKEGDADIRCPNSRSCPAQ

SEQ ID NO: 517243 - protein, 9 aa, Mycobacterium
LAPALAAGG

SEQ ID NO: 517244 - protein, 9 aa, Mycobacterium
LAPALATGN

SEQ ID NO: 517245 - protein, 11 aa, Mycobacterium
LAPAPLPDEVS

SEQ ID NO: 517246 - protein, 12 aa, Mycobacterium
LAPAPNRYATAP

SEQ ID NO: 517247 - protein, 7 aa, Mycobacterium
LAPAPPY

SEQ ID NO: 517248 - protein, 16 aa, Mycobacterium
LAPAPRLTTRTSDEIA

SEQ ID NO: 517249 - protein, 8 aa, Mycobacterium
LAPAQADE

SEQ ID NO: 517250 - protein, 33 aa, Mycobacterium
LAPAQPITPPAPPLPPLDPPAPPAPPVPPLPPR

SEQ ID NO: 517251 - protein, 16 aa, Mycobacterium
LAPAQSSATAASPTKQ

SEQ ID NO: 517252 - protein, 16 aa, Mycobacterium
LAPARPYREYNKTSGD

SEQ ID NO: 517253 - protein, 9 aa, Mycobacterium
LAPATQQDV

SEQ ID NO: 517254 - protein, 4 aa, Mycobacterium
LAPD

SEQ ID NO: 517255 - protein, 5 aa, Mycobacterium
LAPDA

SEQ ID NO: 517256 - protein, 11 aa, Mycobacterium
LAPDAAPSGQH

SEQ ID NO: 517257 - protein, 9 aa, Mycobacterium
LAPDAEPVQ

SEQ ID NO: 517258 - protein, 5 aa, Mycobacterium
LAPDD

SEQ ID NO: 517259 - protein, 9 aa, Mycobacterium
LAPDDSAGE

SEQ ID NO: 517260 - protein, 9 aa, Mycobacterium
LAPDDSVSD

SEQ ID NO: 517261 - protein, 9 aa, Mycobacterium
LAPDDTTQT

SEQ ID NO: 517262 - protein, 7 aa, Mycobacterium
LAPDEAA

SEQ ID NO: 517263 - protein, 8 aa, Mycobacterium
LAPDEAAA

SEQ ID NO: 517264 - protein, 8 aa, Mycobacterium
LAPDEAER

SEQ ID NO: 517265 - protein, 6 aa, Mycobacterium
LAPDED

SEQ ID NO: 517266 - protein, 12 aa, Mycobacterium
LAPDEDELARSG

SEQ ID NO: 517267 - protein, 10 aa, Mycobacterium
LAPDEPRPVT

SEQ ID NO: 517268 - protein, 5 aa, Mycobacterium
LAPDG

SEQ ID NO: 517269 - protein, 6 aa, Mycobacterium
LAPDGA

SEQ ID NO: 517270 - protein, 9 aa, Mycobacterium
LAPDGPDRV

SEQ ID NO: 517271 - protein, 7 aa, Mycobacterium
LAPDGPV

SEQ ID NO: 517272 - protein, 6 aa, Mycobacterium
LAPDGS

SEQ ID NO: 517273 - protein, 11 aa, Mycobacterium
LAPDGSPDTGF

SEQ ID NO: 517274 - protein, 16 aa, Mycobacterium
LAPDGTRDTGFAGREM

SEQ ID NO: 517275 - protein, 5 aa, Mycobacterium
LAPDH

SEQ ID NO: 517276 - protein, 5 aa, Mycobacterium
LAPDN

SEQ ID NO: 517277 - protein, 7 aa, Mycobacterium
LAPDPAE

SEQ ID NO: 517278 - protein, 21 aa, Mycobacterium
LAPDPEPDQPTASSVKPPAAL

SEQ ID NO: 517279 - protein, 10 aa, Mycobacterium
LAPDPSDYRG

SEQ ID NO: 517280 - protein, 5 aa, Mycobacterium
LAPDR

SEQ ID NO: 517281 - protein, 6 aa, Mycobacterium
LAPDRG

SEQ ID NO: 517282 - protein, 7 aa, Mycobacterium
LAPDTYT

SEQ ID NO: 517283 - protein, 18 aa, Mycobacterium
LAPDVPKPPFPPSPPVAS

SEQ ID NO: 517284 - protein, 8 aa, Mycobacterium
LAPEDSVS

SEQ ID NO: 517285 - protein, 16 aa, Mycobacterium
LAPEGGALRPDQHRPG

SEQ ID NO: 517286 - protein, 9 aa, Mycobacterium
LAPEGQEQQ

SEQ ID NO: 517287 - protein, 5 aa, Mycobacterium
LAPEH

SEQ ID NO: 517288 - protein, 6 aa, Mycobacterium
LAPENR

SEQ ID NO: 517289 - protein, 7 aa, Mycobacterium
LAPEPND

SEQ ID NO: 517290 - protein, 7 aa, Mycobacterium
LAPEQGL

SEQ ID NO: 517291 - protein, 9 aa, Mycobacterium
LAPEQPETA

SEQ ID NO: 517292 - protein, 8 aa, Mycobacterium
LAPEQRRR

SEQ ID NO: 517293 - protein, 5 aa, Mycobacterium
LAPER

SEQ ID NO: 517294 - protein, 8 aa, Mycobacterium
LAPESRPA

SEQ ID NO: 517295 - protein, 6 aa, Mycobacterium
LAPETG

SEQ ID NO: 517296 - protein, 6 aa, Mycobacterium
LAPETP

SEQ ID NO: 517297 - protein, 5 aa, Mycobacterium
LAPEV

SEQ ID NO: 517298 - protein, 9 aa, Mycobacterium
LAPGASERT

SEQ ID NO: 517299 - protein, 14 aa, Mycobacterium
LAPGATGISVHYHD

SEQ ID NO: 517300 - protein, 19 aa, Mycobacterium
LAPGAVAPAPLGRKRPGRD

SEQ ID NO: 517301 - protein, 5 aa, Mycobacterium
LAPGD

SEQ ID NO: 517302 - protein, 10 aa, Mycobacterium
LAPGDDERGT

SEQ ID NO: 517303 - protein, 10 aa, Mycobacterium
LAPGDGGAEL

SEQ ID NO: 517304 - protein, 9 aa, Mycobacterium
LAPGDRDLD

SEQ ID NO: 517305 - protein, 8 aa, Mycobacterium
LAPGEKAP

SEQ ID NO: 517306 - protein, 5 aa, Mycobacterium
LAPGG

SEQ ID NO: 517307 - protein, 7 aa, Mycobacterium
LAPGGKA

SEQ ID NO: 517308 - protein, 7 aa, Mycobacterium
LAPGGRA

SEQ ID NO: 517309 - protein, 5 aa, Mycobacterium
LAPGK

SEQ ID NO: 517310 - protein, 12 aa, Mycobacterium
LAPGPAVADDES

SEQ ID NO: 517311 - protein, 12 aa, Mycobacterium
LAPGPDATTDDE

SEQ ID NO: 517312 - protein, 5 aa, Mycobacterium
LAPGQ

SEQ ID NO: 517313 - protein, 12 aa, Mycobacterium
LAPGRFASPEQL

SEQ ID NO: 517314 - protein, 7 aa, Mycobacterium
LAPGRPC

SEQ ID NO: 517315 - protein, 15 aa, Mycobacterium
LAPGSRLSGVAPQAG

SEQ ID NO: 517316 - protein, 7 aa, Mycobacterium
LAPGSSV

SEQ ID NO: 517317 - protein, 19 aa, Mycobacterium
LAPGTALPAPTGVFPRYQV

SEQ ID NO: 517318 - protein, 9 aa, Mycobacterium
LAPGTEGGW

SEQ ID NO: 517319 - protein, 17 aa, Mycobacterium
LAPGTITPTPLRRKRLP

SEQ ID NO: 517320 - protein, 6 aa, Mycobacterium
LAPGTP

SEQ ID NO: 517321 - protein, 9 aa, Mycobacterium
LAPGTPLRD

SEQ ID NO: 517322 - protein, 28 aa, Mycobacterium
LAPGTSAPVAAASRPQLPTGPLTSASAA

SEQ ID NO: 517323 - protein, 7 aa, Mycobacterium
LAPGTSL

SEQ ID NO: 517324 - protein, 18 aa, Mycobacterium
LAPGTVTPVPLRKKRVTG

SEQ ID NO: 517325 - protein, 10 aa, Mycobacterium
LAPHGGESRI

SEQ ID NO: 517326 - protein, 14 aa, Mycobacterium
LAPHGPDARLDPGP

SEQ ID NO: 517327 - protein, 7 aa, Mycobacterium
LAPHGPN

SEQ ID NO: 517328 - protein, 6 aa, Mycobacterium
LAPKAP

SEQ ID NO: 517329 - protein, 15 aa, Mycobacterium
LAPKAPKMFVTYRDK

SEQ ID NO: 517330 - protein, 11 aa, Mycobacterium
LAPKDPESVQW

SEQ ID NO: 517331 - protein, 31 aa, Mycobacterium
LAPKDSTVATALPGPGGSVGAVADQRAPFPS

SEQ ID NO: 517332 - protein, 9 aa, Mycobacterium
LAPKGSPQV

SEQ ID NO: 517333 - protein, 9 aa, Mycobacterium
LAPKGTESR

SEQ ID NO: 517334 - protein, 9 aa, Mycobacterium
LAPKSLTGT

SEQ ID NO: 517335 - protein, 7 aa, Mycobacterium
LAPLPGP

SEQ ID NO: 517336 - protein, 4 aa, Mycobacterium
LAPN

SEQ ID NO: 517337 - protein, 9 aa, Mycobacterium
LAPNAPGSI

SEQ ID NO: 517338 - protein, 5 aa, Mycobacterium
LAPNE

SEQ ID NO: 517339 - protein, 12 aa, Mycobacterium
LAPNGVKATGTV

SEQ ID NO: 517340 - protein, 4 aa, Mycobacterium
LAPP

SEQ ID NO: 517341 - protein, 9 aa, Mycobacterium
LAPPADESL

SEQ ID NO: 517342 - protein, 6 aa, Mycobacterium
LAPPAE

SEQ ID NO: 517343 - protein, 8 aa, Mycobacterium
LAPPAETL

SEQ ID NO: 517344 - protein, 13 aa, Mycobacterium
LAPPAHADPDTER

SEQ ID NO: 517345 - protein, 8 aa, Mycobacterium
LAPPAPSV

SEQ ID NO: 517346 - protein, 7 aa, Mycobacterium
LAPPARS

SEQ ID NO: 517347 - protein, 5 aa, Mycobacterium
LAPPD

SEQ ID NO: 517348 - protein, 13 aa, Mycobacterium
LAPPDPKFASEPA

SEQ ID NO: 517349 - protein, 12 aa, Mycobacterium
LAPPDPTWPDQA

SEQ ID NO: 517350 - protein, 15 aa, Mycobacterium
LAPPDWSPDSPSTSV

SEQ ID NO: 517351 - protein, 7 aa, Mycobacterium
LAPPECA

SEQ ID NO: 517352 - protein, 7 aa, Mycobacterium
LAPPEEI

SEQ ID NO: 517353 - protein, 13 aa, Mycobacterium
LAPPEGGDAGGFA

SEQ ID NO: 517354 - protein, 9 aa, Mycobacterium
LAPPESDRI

SEQ ID NO: 517355 - protein, 14 aa, Mycobacterium
LAPPEVDESAESRP

SEQ ID NO: 517356 - protein, 6 aa, Mycobacterium
LAPPGA

SEQ ID NO: 517357 - protein, 16 aa, Mycobacterium
LAPPGNGTTLATHTAR

SEQ ID NO: 517358 - protein, 7 aa, Mycobacterium
LAPPGRD

SEQ ID NO: 517359 - protein, 8 aa, Mycobacterium
LAPPPADD

SEQ ID NO: 517360 - protein, 10 aa, Mycobacterium
LAPPPDDPRL

SEQ ID NO: 517361 - protein, 8 aa, Mycobacterium
LAPPPETL

SEQ ID NO: 517362 - protein, 8 aa, Mycobacterium
LAPPPPVV

SEQ ID NO: 517363 - protein, 6 aa, Mycobacterium
LAPPPV

SEQ ID NO: 517364 - protein, 7 aa, Mycobacterium
LAPPPVV

SEQ ID NO: 517365 - protein, 8 aa, Mycobacterium
LAPPSAPL

SEQ ID NO: 517366 - protein, 16 aa, Mycobacterium
LAPPSLEGTDTKLRPA

SEQ ID NO: 517367 - protein, 6 aa, Mycobacterium
LAPPSV

SEQ ID NO: 517368 - protein, 7 aa, Mycobacterium
LAPPTAR

SEQ ID NO: 517369 - protein, 8 aa, Mycobacterium
LAPPTARG

SEQ ID NO: 517370 - protein, 8 aa, Mycobacterium
LAPPTGRG

SEQ ID NO: 517371 - protein, 6 aa, Mycobacterium
LAPPVG

SEQ ID NO: 517372 - protein, 13 aa, Mycobacterium
LAPPVGGERALPA

SEQ ID NO: 517373 - protein, 9 aa, Mycobacterium
LAPPVGPDL

SEQ ID NO: 517374 - protein, 8 aa, Mycobacterium
LAPQARNL

SEQ ID NO: 517375 - protein, 5 aa, Mycobacterium
LAPQE

SEQ ID NO: 517376 - protein, 8 aa, Mycobacterium
LAPQGEAD

SEQ ID NO: 517377 - protein, 8 aa, Mycobacterium
LAPQGKAD

SEQ ID NO: 517378 - protein, 7 aa, Mycobacterium
LAPQGPV

SEQ ID NO: 517379 - protein, 9 aa, Mycobacterium
LAPQHEAAQ

SEQ ID NO: 517380 - protein, 22 aa, Mycobacterium
LAPQPAGAGAAVEPVQKRPGDI

SEQ ID NO: 517381 - protein, 8 aa, Mycobacterium
LAPQPMSS

SEQ ID NO: 517382 - protein, 7 aa, Mycobacterium
LAPQPPR

SEQ ID NO: 517383 - protein, 13 aa, Mycobacterium
LAPRAEASGPLGA

SEQ ID NO: 517384 - protein, 9 aa, Mycobacterium
LAPRAEEAL

SEQ ID NO: 517385 - protein, 16 aa, Mycobacterium
LAPRDDEERQKAIDAG

SEQ ID NO: 517386 - protein, 7 aa, Mycobacterium
LAPRGKT

SEQ ID NO: 517387 - protein, 9 aa, Mycobacterium
LAPRNNGAE

SEQ ID NO: 517388 - protein, 6 aa, Mycobacterium
LAPRNR

SEQ ID NO: 517389 - protein, 6 aa, Mycobacterium
LAPRPG

SEQ ID NO: 517390 - protein, 8 aa, Mycobacterium
LAPRPGDI

SEQ ID NO: 517391 - protein, 16 aa, Mycobacterium
LAPRPTGNAQGSGNPF

SEQ ID NO: 517392 - protein, 14 aa, Mycobacterium
LAPRRGQNFDSGVT

SEQ ID NO: 517393 - protein, 14 aa, Mycobacterium
LAPRRGQSFDSGVG

SEQ ID NO: 517394 - protein, 14 aa, Mycobacterium
LAPRRGQSFDSGVS

SEQ ID NO: 517395 - protein, 15 aa, Mycobacterium
LAPRRGQSFDSGVSD

SEQ ID NO: 517396 - protein, 17 aa, Mycobacterium
LAPRTEKAIGSNPHANG

SEQ ID NO: 517397 - protein, 6 aa, Mycobacterium
LAPSAA

SEQ ID NO: 517398 - protein, 17 aa, Mycobacterium
LAPSAGIAAAPAAGIPG

SEQ ID NO: 517399 - protein, 10 aa, Mycobacterium
LAPSARQPAV

SEQ ID NO: 517400 - protein, 15 aa, Mycobacterium
LAPSDASELKARADA

SEQ ID NO: 517401 - protein, 9 aa, Mycobacterium
LAPSDDSNV

SEQ ID NO: 517402 - protein, 12 aa, Mycobacterium
LAPSDTDPVWDS

SEQ ID NO: 517403 - protein, 9 aa, Mycobacterium
LAPSGAGWE

SEQ ID NO: 517404 - protein, 8 aa, Mycobacterium
LAPSGDRG

SEQ ID NO: 517405 - protein, 17 aa, Mycobacterium
LAPSGDRRMSANPHANG

SEQ ID NO: 517406 - protein, 8 aa, Mycobacterium
LAPSGEVK

SEQ ID NO: 517407 - protein, 7 aa, Mycobacterium
LAPSGQL

SEQ ID NO: 517408 - protein, 8 aa, Mycobacterium
LAPSNNPL

SEQ ID NO: 517409 - protein, 21 aa, Mycobacterium
LAPSPNGQLDVDGNRREAAAP

SEQ ID NO: 517410 - protein, 13 aa, Mycobacterium
LAPSQTARARGAE

SEQ ID NO: 517411 - protein, 5 aa, Mycobacterium
LAPSS

SEQ ID NO: 517412 - protein, 7 aa, Mycobacterium
LAPSSRA

SEQ ID NO: 517413 - protein, 5 aa, Mycobacterium
LAPTA

SEQ ID NO: 517414 - protein, 7 aa, Mycobacterium
LAPTAAD

SEQ ID NO: 517415 - protein, 6 aa, Mycobacterium
LAPTAP

SEQ ID NO: 517416 - protein, 15 aa, Mycobacterium
LAPTDAADLAARADA

SEQ ID NO: 517417 - protein, 15 aa, Mycobacterium
LAPTDASELKARADA

SEQ ID NO: 517418 - protein, 6 aa, Mycobacterium
LAPTDV

SEQ ID NO: 517419 - protein, 5 aa, Mycobacterium
LAPTE

SEQ ID NO: 517420 - protein, 15 aa, Mycobacterium
LAPTESVEPVPQRQP

SEQ ID NO: 517421 - protein, 5 aa, Mycobacterium
LAPTG

SEQ ID NO: 517422 - protein, 20 aa, Mycobacterium
LAPTGDKPSAEISRPFDKGR

SEQ ID NO: 517423 - protein, 14 aa, Mycobacterium
LAPTGPVRTPDDDG

SEQ ID NO: 517424 - protein, 7 aa, Mycobacterium
LAPTGQA

SEQ ID NO: 517425 - protein, 10 aa, Mycobacterium
LAPTGRRADI

SEQ ID NO: 517426 - protein, 6 aa, Mycobacterium
LAPTGV

SEQ ID NO: 517427 - protein, 7 aa, Mycobacterium
LAPTGYS

SEQ ID NO: 517428 - protein, 12 aa, Mycobacterium
LAPTLGGPARRA

SEQ ID NO: 517429 - protein, 8 aa, Mycobacterium
LAPTPDEI

SEQ ID NO: 517430 - protein, 13 aa, Mycobacterium
LAPTPLKPGKGPI

SEQ ID NO: 517431 - protein, 22 aa, Mycobacterium
LAPTRPLDPPPPAQAAPTMTTG

SEQ ID NO: 517432 - protein, 5 aa, Mycobacterium
LAPTS

SEQ ID NO: 517433 - protein, 17 aa, Mycobacterium
LAPTSTVRGWERLRILL

SEQ ID NO: 517434 - protein, 9 aa, Mycobacterium
LAPVGPPRR

SEQ ID NO: 517435 - protein, 4 aa, Mycobacterium
LAPY

SEQ ID NO: 517436 - protein, 10 aa, Mycobacterium
LAPYNASKAG

SEQ ID NO: 517437 - protein, 4 aa, Mycobacterium
LAQA

SEQ ID NO: 517438 - protein, 7 aa, Mycobacterium
LAQAARR

SEQ ID NO: 517439 - protein, 7 aa, Mycobacterium
LAQADPG

SEQ ID NO: 517440 - protein, 5 aa, Mycobacterium
LAQAG

SEQ ID NO: 517441 - protein, 54 aa, Mycobacterium
LAQAGEDHLESGPEPEPEPDPPGGGQAAESPAAQSNSTTPQKPPRPSAPPSKTF

SEQ ID NO: 517442 - protein, 8 aa, Mycobacterium
LAQAKGSK

SEQ ID NO: 517443 - protein, 9 aa, Mycobacterium
LAQAPAPVV

SEQ ID NO: 517444 - protein, 12 aa, Mycobacterium
LAQARSRLNPGA

SEQ ID NO: 517445 - protein, 11 aa, Mycobacterium
LAQDDNGVDVG

SEQ ID NO: 517446 - protein, 6 aa, Mycobacterium
LAQDGA

SEQ ID NO: 517447 - protein, 7 aa, Mycobacterium
LAQDPSH

SEQ ID NO: 517448 - protein, 8 aa, Mycobacterium
LAQEKTGE

SEQ ID NO: 517449 - protein, 9 aa, Mycobacterium
LAQEKTGEA

SEQ ID NO: 517450 - protein, 6 aa, Mycobacterium
LAQEPD

SEQ ID NO: 517451 - protein, 5 aa, Mycobacterium
LAQGA

SEQ ID NO: 517452 - protein, 6 aa, Mycobacterium
LAQGAT

SEQ ID NO: 517453 - protein, 19 aa, Mycobacterium
LAQGATALAGGQPYADGPL

SEQ ID NO: 517454 - protein, 14 aa, Mycobacterium
LAQGDTDQRVVGSP

SEQ ID NO: 517455 - protein, 8 aa, Mycobacterium
LAQGPTTA

SEQ ID NO: 517456 - protein, 6 aa, Mycobacterium
LAQGRA

SEQ ID NO: 517457 - protein, 6 aa, Mycobacterium
LAQGRN

SEQ ID NO: 517458 - protein, 7 aa, Mycobacterium
LAQGSAT

SEQ ID NO: 517459 - protein, 7 aa, Mycobacterium
LAQGSVQ

SEQ ID NO: 517460 - protein, 12 aa, Mycobacterium
LAQHGDQRRATT

SEQ ID NO: 517461 - protein, 16 aa, Mycobacterium
LAQKEGRHNDAAELES

SEQ ID NO: 517462 - protein, 4 aa, Mycobacterium
LAQN

SEQ ID NO: 517463 - protein, 8 aa, Mycobacterium
LAQPRPLD

SEQ ID NO: 517464 - protein, 16 aa, Mycobacterium
LAQPRSNGCSYADSPH

SEQ ID NO: 517465 - protein, 14 aa, Mycobacterium
LAQPSGVSPADDGG

SEQ ID NO: 517466 - protein, 20 aa, Mycobacterium
LAQPYPGELPEGAPAPKAFG

SEQ ID NO: 517467 - protein, 6 aa, Mycobacterium
LAQQAA

SEQ ID NO: 517468 - protein, 12 aa, Mycobacterium
LAQQGDSSAVPF

SEQ ID NO: 517469 - protein, 8 aa, Mycobacterium
LAQQQGMD

SEQ ID NO: 517470 - protein, 10 aa, Mycobacterium
LAQRAQARAG

SEQ ID NO: 517471 - protein, 11 aa, Mycobacterium
LAQRASAAEHP

SEQ ID NO: 517472 - protein, 12 aa, Mycobacterium
LAQRDGEAAAEA

SEQ ID NO: 517473 - protein, 13 aa, Mycobacterium
LAQRGRGVHPPPR

SEQ ID NO: 517474 - protein, 5 aa, Mycobacterium
LAQRR

SEQ ID NO: 517475 - protein, 6 aa, Mycobacterium
LAQRTD

SEQ ID NO: 517476 - protein, 18 aa, Mycobacterium
LAQRTNPAGRTGGVAEAL

SEQ ID NO: 517477 - protein, 13 aa, Mycobacterium
LAQRTNPRGLTGG

SEQ ID NO: 517478 - protein, 9 aa, Mycobacterium
LAQRVPGDE

SEQ ID NO: 517479 - protein, 4 aa, Mycobacterium
LAQS

SEQ ID NO: 517480 - protein, 14 aa, Mycobacterium
LAQSESEAETANSS

SEQ ID NO: 517481 - protein, 5 aa, Mycobacterium
LAQSG

SEQ ID NO: 517482 - protein, 15 aa, Mycobacterium
LAQSGSDCVAPASPD

SEQ ID NO: 517483 - protein, 14 aa, Mycobacterium
LAQSGSFGNPSAYQ

SEQ ID NO: 517484 - protein, 14 aa, Mycobacterium
LAQSGSLDPGRAMA

SEQ ID NO: 517485 - protein, 7 aa, Mycobacterium
LAQSKGA

SEQ ID NO: 517486 - protein, 6 aa, Mycobacterium
LAQSPT

SEQ ID NO: 517487 - protein, 10 aa, Mycobacterium
LAQTAENNGF

SEQ ID NO: 517488 - protein, 12 aa, Mycobacterium
LAQTAQAADAAG

SEQ ID NO: 517489 - protein, 14 aa, Mycobacterium
LAQTASLDGPIPRD

SEQ ID NO: 517490 - protein, 6 aa, Mycobacterium
LAQTGR

SEQ ID NO: 517491 - protein, 8 aa, Mycobacterium
LAQTGRRT

SEQ ID NO: 517492 - protein, 7 aa, Mycobacterium
LAQTGTG

SEQ ID NO: 517493 - protein, 8 aa, Mycobacterium
LAQTRDAV

SEQ ID NO: 517494 - protein, 6 aa, Mycobacterium
LAQTTA

SEQ ID NO: 517495 - protein, 9 aa, Mycobacterium
LAQTTSELG

SEQ ID NO: 517496 - protein, 12 aa, Mycobacterium
LAQTTSPPQLED

SEQ ID NO: 517497 - protein, 4 aa, Mycobacterium
LARA

SEQ ID NO: 517498 - protein, 11 aa, Mycobacterium
LARADTAAEPV

SEQ ID NO: 517499 - protein, 5 aa, Mycobacterium
LARAG

SEQ ID NO: 517500 - protein, 6 aa, Mycobacterium
LARAGA

SEQ ID NO: 517501 - protein, 14 aa, Mycobacterium
LARAGKAIDSGAAE

SEQ ID NO: 517502 - protein, 7 aa, Mycobacterium
LARAPRT

SEQ ID NO: 517503 - protein, 5 aa, Mycobacterium
LARAR

SEQ ID NO: 517504 - protein, 8 aa, Mycobacterium
LARASAAG

SEQ ID NO: 517505 - protein, 15 aa, Mycobacterium
LARASSSTGKTEATY

SEQ ID NO: 517506 - protein, 6 aa, Mycobacterium
LARDGY

SEQ ID NO: 517507 - protein, 7 aa, Mycobacterium
LAREDED

SEQ ID NO: 517508 - protein, 6 aa, Mycobacterium
LAREGA

SEQ ID NO: 517509 - protein, 11 aa, Mycobacterium
LAREGEKLGQP

SEQ ID NO: 517510 - protein, 18 aa, Mycobacterium
LAREPRRGPRLPVQNIRS

SEQ ID NO: 517511 - protein, 4 aa, Mycobacterium
LARG

SEQ ID NO: 517512 - protein, 18 aa, Mycobacterium
LARGAADPARNGSDLPAG

SEQ ID NO: 517513 - protein, 10 aa, Mycobacterium
LARGDAQCSY

SEQ ID NO: 517514 - protein, 7 aa, Mycobacterium
LARGESL

SEQ ID NO: 517515 - protein, 9 aa, Mycobacterium
LARGGDRDE

SEQ ID NO: 517516 - protein, 12 aa, Mycobacterium
LARGGEPDRASD

SEQ ID NO: 517517 - protein, 6 aa, Mycobacterium
LARGGG

SEQ ID NO: 517518 - protein, 7 aa, Mycobacterium
LARGIST

SEQ ID NO: 517519 - protein, 6 aa, Mycobacterium
LARGKS

SEQ ID NO: 517520 - protein, 7 aa, Mycobacterium
LARGPGN

SEQ ID NO: 517521 - protein, 5 aa, Mycobacterium
LARGR

SEQ ID NO: 517522 - protein, 6 aa, Mycobacterium
LARGSG

SEQ ID NO: 517523 - protein, 13 aa, Mycobacterium
LARKAGDAVRSGD

SEQ ID NO: 517524 - protein, 15 aa, Mycobacterium
LARKEGRHDDAAEIE

SEQ ID NO: 517525 - protein, 15 aa, Mycobacterium
LARKEGRSADAAELD

SEQ ID NO: 517526 - protein, 10 aa, Mycobacterium
LARKGKRARE

SEQ ID NO: 517527 - protein, 9 aa, Mycobacterium
LARNESRGC

SEQ ID NO: 517528 - protein, 5 aa, Mycobacterium
LARNN

SEQ ID NO: 517529 - protein, 8 aa, Mycobacterium
LARNNPDA

SEQ ID NO: 517530 - protein, 9 aa, Mycobacterium
LARPDGPRL

SEQ ID NO: 517531 - protein, 11 aa, Mycobacterium
LARPDRPHRVR

SEQ ID NO: 517532 - protein, 7 aa, Mycobacterium
LARPDSI

SEQ ID NO: 517533 - protein, 5 aa, Mycobacterium
LARPE

SEQ ID NO: 517534 - protein, 14 aa, Mycobacterium
LARPEPPSTDYTRR

SEQ ID NO: 517535 - protein, 9 aa, Mycobacterium
LARPGATAR

SEQ ID NO: 517536 - protein, 8 aa, Mycobacterium
LARPGDEI

SEQ ID NO: 517537 - protein, 7 aa, Mycobacterium
LARPGGL

SEQ ID NO: 517538 - protein, 15 aa, Mycobacterium
LARPGPPSSDYTRRQ

SEQ ID NO: 517539 - protein, 13 aa, Mycobacterium
LARPGPPSTEYTR

SEQ ID NO: 517540 - protein, 8 aa, Mycobacterium
LARPGSEI

SEQ ID NO: 517541 - protein, 8 aa, Mycobacterium
LARPGTDI

SEQ ID NO: 517542 - protein, 6 aa, Mycobacterium
LARPQR

SEQ ID NO: 517543 - protein, 6 aa, Mycobacterium
LARPSI

SEQ ID NO: 517544 - protein, 6 aa, Mycobacterium
LARPSM

SEQ ID NO: 517545 - protein, 13 aa, Mycobacterium
LARPTAPLNVTGN

SEQ ID NO: 517546 - protein, 6 aa, Mycobacterium
LARPTR

SEQ ID NO: 517547 - protein, 5 aa, Mycobacterium
LARQA

SEQ ID NO: 517548 - protein, 7 aa, Mycobacterium
LARQGQL

SEQ ID NO: 517549 - protein, 6 aa, Mycobacterium
LARQKT

SEQ ID NO: 517550 - protein, 9 aa, Mycobacterium
LARQKTPER

SEQ ID NO: 517551 - protein, 5 aa, Mycobacterium
LARQP

SEQ ID NO: 517552 - protein, 11 aa, Mycobacterium
LARQRDAAAAA

SEQ ID NO: 517553 - protein, 11 aa, Mycobacterium
LARQSTDVGAP

SEQ ID NO: 517554 - protein, 9 aa, Mycobacterium
LARRAPSAT

SEQ ID NO: 517555 - protein, 8 aa, Mycobacterium
LARRDDRG

SEQ ID NO: 517556 - protein, 6 aa, Mycobacterium
LARREP

SEQ ID NO: 517557 - protein, 15 aa, Mycobacterium
LARRGAEYGVGTGPI

SEQ ID NO: 517558 - protein, 9 aa, Mycobacterium
LARRNAGGD

SEQ ID NO: 517559 - protein, 9 aa, Mycobacterium
LARRNANGD

SEQ ID NO: 517560 - protein, 5 aa, Mycobacterium
LARRP

SEQ ID NO: 517561 - protein, 10 aa, Mycobacterium
LARRPDQRAA

SEQ ID NO: 517562 - protein, 9 aa, Mycobacterium
LARRQGEAA

SEQ ID NO: 517563 - protein, 7 aa, Mycobacterium
LARRSTA

SEQ ID NO: 517564 - protein, 8 aa, Mycobacterium
LARRTDRD

SEQ ID NO: 517565 - protein, 19 aa, Mycobacterium
LARRTNPDGLTGSAAEALR

SEQ ID NO: 517566 - protein, 7 aa, Mycobacterium
LARRTSA

SEQ ID NO: 517567 - protein, 17 aa, Mycobacterium
LARSAGEVIGSEARSRG

SEQ ID NO: 517568 - protein, 6 aa, Mycobacterium
LARSAK

SEQ ID NO: 517569 - protein, 6 aa, Mycobacterium
LARSAN

SEQ ID NO: 517570 - protein, 19 aa, Mycobacterium
LARSATATPEETSDDDEWV

SEQ ID NO: 517571 - protein, 10 aa, Mycobacterium
LARSDESAAA

SEQ ID NO: 517572 - protein, 23 aa, Mycobacterium
LARSDSSAAALTAAGADVHRGSL

SEQ ID NO: 517573 - protein, 19 aa, Mycobacterium
LARSDTNQGSEGLSPQQAS

SEQ ID NO: 517574 - protein, 6 aa, Mycobacterium
LARSEK

SEQ ID NO: 517575 - protein, 11 aa, Mycobacterium
LARSESEGQRR

SEQ ID NO: 517576 - protein, 8 aa, Mycobacterium
LARSGRSP

SEQ ID NO: 517577 - protein, 13 aa, Mycobacterium
LARSGSSIDPKRA

SEQ ID NO: 517578 - protein, 7 aa, Mycobacterium
LARSPKV

SEQ ID NO: 517579 - protein, 7 aa, Mycobacterium
LARSPQV

SEQ ID NO: 517580 - protein, 5 aa, Mycobacterium
LARSS

SEQ ID NO: 517581 - protein, 9 aa, Mycobacterium
LARSSAALA

SEQ ID NO: 517582 - protein, 11 aa, Mycobacterium
LARSSAPNAPV

SEQ ID NO: 517583 - protein, 12 aa, Mycobacterium
LARSSGADGEWS

SEQ ID NO: 517584 - protein, 8 aa, Mycobacterium
LARSTGDD

SEQ ID NO: 517585 - protein, 11 aa, Mycobacterium
LARTAGTAAID

SEQ ID NO: 517586 - protein, 5 aa, Mycobacterium
LARTG

SEQ ID NO: 517587 - protein, 6 aa, Mycobacterium
LARTGE

SEQ ID NO: 517588 - protein, 21 aa, Mycobacterium
LARTPTTPPPTVPPCPGPLGE

SEQ ID NO: 517589 - protein, 17 aa, Mycobacterium
LARTSAQPERDARAAGV

SEQ ID NO: 517590 - protein, 12 aa, Mycobacterium
LARTSQEWTRET

SEQ ID NO: 517591 - protein, 9 aa, Mycobacterium
LARTTTREV

SEQ ID NO: 517592 - protein, 6 aa, Mycobacterium
LASAAD

SEQ ID NO: 517593 - protein, 11 aa, Mycobacterium
LASAADSFGSV

SEQ ID NO: 517594 - protein, 14 aa, Mycobacterium
LASAARGQEDVPAQ

SEQ ID NO: 517595 - protein, 15 aa, Mycobacterium
LASAARNSAGFGAPR

SEQ ID NO: 517596 - protein, 6 aa, Mycobacterium
LASAEA

SEQ ID NO: 517597 - protein, 9 aa, Mycobacterium
LASAEANPI

SEQ ID NO: 517598 - protein, 7 aa, Mycobacterium
LASAGAQ

SEQ ID NO: 517599 - protein, 14 aa, Mycobacterium
LASAGEAPPVSDGS

SEQ ID NO: 517600 - protein, 6 aa, Mycobacterium
LASAKA

SEQ ID NO: 517601 - protein, 8 aa, Mycobacterium
LASAKVNA

SEQ ID NO: 517602 - protein, 20 aa, Mycobacterium
LASAPGAPSDTPEPAQPTDA

SEQ ID NO: 517603 - protein, 24 aa, Mycobacterium
LASAPGGKGGNQAVAAARAGAATS

SEQ ID NO: 517604 - protein, 10 aa, Mycobacterium
LASAPNAPKT

SEQ ID NO: 517605 - protein, 9 aa, Mycobacterium
LASAQGNQS

SEQ ID NO: 517606 - protein, 11 aa, Mycobacterium
LASASGPRIGA

SEQ ID NO: 517607 - protein, 16 aa, Mycobacterium
LASATRRLSAALSDES

SEQ ID NO: 517608 - protein, 21 aa, Mycobacterium
LASATTGAAVRADGGYVDSIL

SEQ ID NO: 517609 - protein, 9 aa, Mycobacterium
LASATTGGA

SEQ ID NO: 517610 - protein, 4 aa, Mycobacterium
LASD

SEQ ID NO: 517611 - protein, 8 aa, Mycobacterium
LASDDSVE

SEQ ID NO: 517612 - protein, 10 aa, Mycobacterium
LASDDTPAGA

SEQ ID NO: 517613 - protein, 8 aa, Mycobacterium
LASDESVE

SEQ ID NO: 517614 - protein, 6 aa, Mycobacterium
LASDGH

SEQ ID NO: 517615 - protein, 19 aa, Mycobacterium
LASDPDLADNAGRRAQRPR

SEQ ID NO: 517616 - protein, 8 aa, Mycobacterium
LASDPSVE

SEQ ID NO: 517617 - protein, 23 aa, Mycobacterium
LASDPTSESRTPASFRAPNGAME

SEQ ID NO: 517618 - protein, 9 aa, Mycobacterium
LASDSTSVA

SEQ ID NO: 517619 - protein, 10 aa, Mycobacterium
LASEANRRRR

SEQ ID NO: 517620 - protein, 8 aa, Mycobacterium
LASEARHG

SEQ ID NO: 517621 - protein, 9 aa, Mycobacterium
LASEGADPI

SEQ ID NO: 517622 - protein, 11 aa, Mycobacterium
LASEGSTRGSF

SEQ ID NO: 517623 - protein, 9 aa, Mycobacterium
LASEKKCGH

SEQ ID NO: 517624 - protein, 15 aa, Mycobacterium
LASEKNGMMICTDCA

SEQ ID NO: 517625 - protein, 15 aa, Mycobacterium
LASEKNGQLICTDCA

SEQ ID NO: 517626 - protein, 15 aa, Mycobacterium
LASEKNGVMICTDCA

SEQ ID NO: 517627 - protein, 10 aa, Mycobacterium
LASEQSADIA

SEQ ID NO: 517628 - protein, 8 aa, Mycobacterium
LASETGAI

SEQ ID NO: 517629 - protein, 12 aa, Mycobacterium
LASGDPGSVSAN

SEQ ID NO: 517630 - protein, 7 aa, Mycobacterium
LASGDVN

SEQ ID NO: 517631 - protein, 9 aa, Mycobacterium
LASGGAGRR

SEQ ID NO: 517632 - protein, 17 aa, Mycobacterium
LASGGAGTGATAAPTQA

SEQ ID NO: 517633 - protein, 7 aa, Mycobacterium
LASGGPS

SEQ ID NO: 517634 - protein, 6 aa, Mycobacterium
LASGGR

SEQ ID NO: 517635 - protein, 12 aa, Mycobacterium
LASGGRGPGGTR

SEQ ID NO: 517636 - protein, 8 aa, Mycobacterium
LASGNSYY

SEQ ID NO: 517637 - protein, 9 aa, Mycobacterium
LASGPAPAA

SEQ ID NO: 517638 - protein, 15 aa, Mycobacterium
LASGPDGPEGPEGKE

SEQ ID NO: 517639 - protein, 6 aa, Mycobacterium
LASGRP

SEQ ID NO: 517640 - protein, 12 aa, Mycobacterium
LASGRRDAAGRL

SEQ ID NO: 517641 - protein, 11 aa, Mycobacterium
LASGRREHAQQ

SEQ ID NO: 517642 - protein, 5 aa, Mycobacterium
LASGS

SEQ ID NO: 517643 - protein, 14 aa, Mycobacterium
LASGSPQNNPRVPT

SEQ ID NO: 517644 - protein, 10 aa, Mycobacterium
LASGTDGLTK

SEQ ID NO: 517645 - protein, 6 aa, Mycobacterium
LASHGP

SEQ ID NO: 517646 - protein, 7 aa, Mycobacterium
LASHGTP

SEQ ID NO: 517647 - protein, 12 aa, Mycobacterium
LASKAEAAELKP

SEQ ID NO: 517648 - protein, 9 aa, Mycobacterium
LASKEEPEV

SEQ ID NO: 517649 - protein, 9 aa, Mycobacterium
LASKGPNPL

SEQ ID NO: 517650 - protein, 4 aa, Mycobacterium
LASL

SEQ ID NO: 517651 - protein, 7 aa, Mycobacterium
LASNGPT

SEQ ID NO: 517652 - protein, 7 aa, Mycobacterium
LASNRPL

SEQ ID NO: 517653 - protein, 4 aa, Mycobacterium
LASP

SEQ ID NO: 517654 - protein, 13 aa, Mycobacterium
LASPAASTAGLPQ

SEQ ID NO: 517655 - protein, 10 aa, Mycobacterium
LASPADVDAA

SEQ ID NO: 517656 - protein, 11 aa, Mycobacterium
LASPAKEVRTF

SEQ ID NO: 517657 - protein, 11 aa, Mycobacterium
LASPALTQTTS

SEQ ID NO: 517658 - protein, 10 aa, Mycobacterium
LASPASQGSH

SEQ ID NO: 517659 - protein, 8 aa, Mycobacterium
LASPDRTR

SEQ ID NO: 517660 - protein, 9 aa, Mycobacterium
LASPGDERE

SEQ ID NO: 517661 - protein, 9 aa, Mycobacterium
LASPGERDE

SEQ ID NO: 517662 - protein, 6 aa, Mycobacterium
LASPGG

SEQ ID NO: 517663 - protein, 8 aa, Mycobacterium
LASPGPAE

SEQ ID NO: 517664 - protein, 9 aa, Mycobacterium
LASPGPSEL

SEQ ID NO: 517665 - protein, 10 aa, Mycobacterium
LASPGRPGRR

SEQ ID NO: 517666 - protein, 8 aa, Mycobacterium
LASPGSVS

SEQ ID NO: 517667 - protein, 14 aa, Mycobacterium
LASPGTGDFARDTR

SEQ ID NO: 517668 - protein, 22 aa, Mycobacterium
LASPLKSGRTGQYTEAQRAERI

SEQ ID NO: 517669 - protein, 5 aa, Mycobacterium
LASPP

SEQ ID NO: 517670 - protein, 6 aa, Mycobacterium
LASPPE

SEQ ID NO: 517671 - protein, 7 aa, Mycobacterium
LASPPER

SEQ ID NO: 517672 - protein, 11 aa, Mycobacterium
LASPPKEVRTF

SEQ ID NO: 517673 - protein, 7 aa, Mycobacterium
LASPQIA

SEQ ID NO: 517674 - protein, 7 aa, Mycobacterium
LASPQVA

SEQ ID NO: 517675 - protein, 10 aa, Mycobacterium
LASPSASGVT

SEQ ID NO: 517676 - protein, 16 aa, Mycobacterium
LASPSTMTTYGARPDL

SEQ ID NO: 517677 - protein, 6 aa, Mycobacterium
LASPTG

SEQ ID NO: 517678 - protein, 9 aa, Mycobacterium
LASPVGRGR

SEQ ID NO: 517679 - protein, 4 aa, Mycobacterium
LASQ

SEQ ID NO: 517680 - protein, 9 aa, Mycobacterium
LASQAANTL

SEQ ID NO: 517681 - protein, 8 aa, Mycobacterium
LASQPEPM

SEQ ID NO: 517682 - protein, 16 aa, Mycobacterium
LASQPGDFGDEGRPGG

SEQ ID NO: 517683 - protein, 7 aa, Mycobacterium
LASRDDP

SEQ ID NO: 517684 - protein, 7 aa, Mycobacterium
LASRDEQ

SEQ ID NO: 517685 - protein, 6 aa, Mycobacterium
LASRGF

SEQ ID NO: 517686 - protein, 7 aa, Mycobacterium
LASRGVP

SEQ ID NO: 517687 - protein, 21 aa, Mycobacterium
LASRPEKLAGSRFGRRRKESD

SEQ ID NO: 517688 - protein, 7 aa, Mycobacterium
LASRSEA

SEQ ID NO: 517689 - protein, 33 aa, Mycobacterium
LASSAAGSHPFTSTSDKSLTGPANRNHTTGGHD

SEQ ID NO: 517690 - protein, 13 aa, Mycobacterium
LASSDTASAEAVA

SEQ ID NO: 517691 - protein, 8 aa, Mycobacterium
LASSEDQP

SEQ ID NO: 517692 - protein, 5 aa, Mycobacterium
LASSG

SEQ ID NO: 517693 - protein, 7 aa, Mycobacterium
LASSGNV

SEQ ID NO: 517694 - protein, 12 aa, Mycobacterium
LASSGRAVSTRR

SEQ ID NO: 517695 - protein, 6 aa, Mycobacterium
LASSPD

SEQ ID NO: 517696 - protein, 18 aa, Mycobacterium
LASSPTWKSSNPPSSTVT

SEQ ID NO: 517697 - protein, 8 aa, Mycobacterium
LASSRSPL

SEQ ID NO: 517698 - protein, 5 aa, Mycobacterium
LASSS

SEQ ID NO: 517699 - protein, 10 aa, Mycobacterium
LASSTGPGRR

SEQ ID NO: 517700 - protein, 5 aa, Mycobacterium
LASSV

SEQ ID NO: 517701 - protein, 9 aa, Mycobacterium
LASTAADPI

SEQ ID NO: 517702 - protein, 7 aa, Mycobacterium
LASTARA

SEQ ID NO: 517703 - protein, 5 aa, Mycobacterium
LASTG

SEQ ID NO: 517704 - protein, 7 aa, Mycobacterium
LASTPKI

SEQ ID NO: 517705 - protein, 34 aa, Mycobacterium
LASTPKPPKTAGEKVTDEGDGGTKIAEYLVAQKL

SEQ ID NO: 517706 - protein, 5 aa, Mycobacterium
LASTR

SEQ ID NO: 517707 - protein, 7 aa, Mycobacterium
LASTRPM

SEQ ID NO: 517708 - protein, 11 aa, Mycobacterium
LASTSAEQARQ

SEQ ID NO: 517709 - protein, 6 aa, Mycobacterium
LASTSI

SEQ ID NO: 517710 - protein, 9 aa, Mycobacterium
LASTTPEKA

SEQ ID NO: 517711 - protein, 16 aa, Mycobacterium
LASTTSLPTAAPSLPG

SEQ ID NO: 517712 - protein, 22 aa, Mycobacterium
LASYDGRNRVNPPLRESADAAA

SEQ ID NO: 517713 - protein, 4 aa, Mycobacterium
LATA

SEQ ID NO: 517714 - protein, 17 aa, Mycobacterium
LATAASSFNSATATLAG

SEQ ID NO: 517715 - protein, 14 aa, Mycobacterium
LATAATALGNNNTI

SEQ ID NO: 517716 - protein, 19 aa, Mycobacterium
LATAGGATTGAPKTKTSVR

SEQ ID NO: 517717 - protein, 17 aa, Mycobacterium
LATAGKVGAEVSPEDAK

SEQ ID NO: 517718 - protein, 16 aa, Mycobacterium
LATAGPDREDAGSPDD

SEQ ID NO: 517719 - protein, 8 aa, Mycobacterium
LATAGPSY

SEQ ID NO: 517720 - protein, 16 aa, Mycobacterium
LATAQKATRPRKPEGV

SEQ ID NO: 517721 - protein, 24 aa, Mycobacterium
LATAREKAGAIGAPEGVWYGQRQL

SEQ ID NO: 517722 - protein, 5 aa, Mycobacterium
LATAT

SEQ ID NO: 517723 - protein, 7 aa, Mycobacterium
LATATER

SEQ ID NO: 517724 - protein, 7 aa, Mycobacterium
LATATES

SEQ ID NO: 517725 - protein, 4 aa, Mycobacterium
LATD

SEQ ID NO: 517726 - protein, 5 aa, Mycobacterium
LATDA

SEQ ID NO: 517727 - protein, 12 aa, Mycobacterium
LATDASVTDEQL

SEQ ID NO: 517728 - protein, 13 aa, Mycobacterium
LATDDEARERRKR

SEQ ID NO: 517729 - protein, 9 aa, Mycobacterium
LATDDSPAR

SEQ ID NO: 517730 - protein, 5 aa, Mycobacterium
LATDE

SEQ ID NO: 517731 - protein, 10 aa, Mycobacterium
LATDEGGRTV

SEQ ID NO: 517732 - protein, 7 aa, Mycobacterium
LATDEGT

SEQ ID NO: 517733 - protein, 10 aa, Mycobacterium
LATDEQARAR

SEQ ID NO: 517734 - protein, 7 aa, Mycobacterium
LATDGEL

SEQ ID NO: 517735 - protein, 10 aa, Mycobacterium
LATDGPSDRV

SEQ ID NO: 517736 - protein, 9 aa, Mycobacterium
LATDGSPAR

SEQ ID NO: 517737 - protein, 8 aa, Mycobacterium
LATDPAAQ

SEQ ID NO: 517738 - protein, 6 aa, Mycobacterium
LATDPD

SEQ ID NO: 517739 - protein, 12 aa, Mycobacterium
LATDPEARDRRE

SEQ ID NO: 517740 - protein, 13 aa, Mycobacterium
LATDPEARERRKR

SEQ ID NO: 517741 - protein, 12 aa, Mycobacterium
LATDPEARQRRE

SEQ ID NO: 517742 - protein, 9 aa, Mycobacterium
LATDPSSSG

SEQ ID NO: 517743 - protein, 10 aa, Mycobacterium
LATDQSSDIA

SEQ ID NO: 517744 - protein, 10 aa, Mycobacterium
LATDSAASWE

SEQ ID NO: 517745 - protein, 8 aa, Mycobacterium
LATDTAAG

SEQ ID NO: 517746 - protein, 11 aa, Mycobacterium
LATDTEKTMNT

SEQ ID NO: 517747 - protein, 4 aa, Mycobacterium
LATE

SEQ ID NO: 517748 - protein, 6 aa, Mycobacterium
LATEGG

SEQ ID NO: 517749 - protein, 5 aa, Mycobacterium
LATEM

SEQ ID NO: 517750 - protein, 10 aa, Mycobacterium
LATEPAEAPM

SEQ ID NO: 517751 - protein, 10 aa, Mycobacterium
LATEQSADIT

SEQ ID NO: 517752 - protein, 21 aa, Mycobacterium
LATERGVEASIDTESESPNHR

SEQ ID NO: 517753 - protein, 5 aa, Mycobacterium
LATGA

SEQ ID NO: 517754 - protein, 7 aa, Mycobacterium
LATGASM

SEQ ID NO: 517755 - protein, 8 aa, Mycobacterium
LATGAYPR

SEQ ID NO: 517756 - protein, 5 aa, Mycobacterium
LATGD

SEQ ID NO: 517757 - protein, 7 aa, Mycobacterium
LATGDQV

SEQ ID NO: 517758 - protein, 10 aa, Mycobacterium
LATGESNGVT

SEQ ID NO: 517759 - protein, 6 aa, Mycobacterium
LATGEV

SEQ ID NO: 517760 - protein, 5 aa, Mycobacterium
LATGG

SEQ ID NO: 517761 - protein, 11 aa, Mycobacterium
LATGGAGSVVQ

SEQ ID NO: 517762 - protein, 7 aa, Mycobacterium
LATGGRT

SEQ ID NO: 517763 - protein, 6 aa, Mycobacterium
LATGNP

SEQ ID NO: 517764 - protein, 9 aa, Mycobacterium
LATGRELGG

SEQ ID NO: 517765 - protein, 12 aa, Mycobacterium
LATGRGNGGITI

SEQ ID NO: 517766 - protein, 8 aa, Mycobacterium
LATGRTIA

SEQ ID NO: 517767 - protein, 5 aa, Mycobacterium
LATGS

SEQ ID NO: 517768 - protein, 6 aa, Mycobacterium
LATGST

SEQ ID NO: 517769 - protein, 13 aa, Mycobacterium
LATGTASASGTAI

SEQ ID NO: 517770 - protein, 8 aa, Mycobacterium
LATGTPAP

SEQ ID NO: 517771 - protein, 6 aa, Mycobacterium
LATGTR

SEQ ID NO: 517772 - protein, 9 aa, Mycobacterium
LATHPGAGK

SEQ ID NO: 517773 - protein, 21 aa, Mycobacterium
LATIGSTVGAANAAAAANTTS

SEQ ID NO: 517774 - protein, 9 aa, Mycobacterium
LATKAATPL

SEQ ID NO: 517775 - protein, 7 aa, Mycobacterium
LATKDAE

SEQ ID NO: 517776 - protein, 16 aa, Mycobacterium
LATKKRTITNAAGEQI

SEQ ID NO: 517777 - protein, 12 aa, Mycobacterium
LATNADEPAIDD

SEQ ID NO: 517778 - protein, 7 aa, Mycobacterium
LATNQSQ

SEQ ID NO: 517779 - protein, 8 aa, Mycobacterium
LATNRKAQ

SEQ ID NO: 517780 - protein, 17 aa, Mycobacterium
LATPADLREAPETVGRP

SEQ ID NO: 517781 - protein, 10 aa, Mycobacterium
LATPAQWRQG

SEQ ID NO: 517782 - protein, 5 aa, Mycobacterium
LATPD

SEQ ID NO: 517783 - protein, 16 aa, Mycobacterium
LATPDDAHAQPRPDSG

SEQ ID NO: 517784 - protein, 8 aa, Mycobacterium
LATPDDLA

SEQ ID NO: 517785 - protein, 19 aa, Mycobacterium
LATPDQGFTSSQAAARASL

SEQ ID NO: 517786 - protein, 8 aa, Mycobacterium
LATPDTSV

SEQ ID NO: 517787 - protein, 6 aa, Mycobacterium
LATPGQ

SEQ ID NO: 517788 - protein, 8 aa, Mycobacterium
LATPGSVS

SEQ ID NO: 517789 - protein, 8 aa, Mycobacterium
LATPPPRI

SEQ ID NO: 517790 - protein, 9 aa, Mycobacterium
LATPRQAKA

SEQ ID NO: 517791 - protein, 7 aa, Mycobacterium
LATPSGS

SEQ ID NO: 517792 - protein, 4 aa, Mycobacterium
LATQ

SEQ ID NO: 517793 - protein, 6 aa, Mycobacterium
LATQSD

SEQ ID NO: 517794 - protein, 21 aa, Mycobacterium
LATRGDEKLSTSAVGERIRSL

SEQ ID NO: 517795 - protein, 6 aa, Mycobacterium
LATRGL

SEQ ID NO: 517796 - protein, 54 aa, Mycobacterium
LATRGSGSSPAPATPSPTAGGGAAAATRPAATPSVPAAAAGTNIPGLPSGLPPG

SEQ ID NO: 517797 - protein, 17 aa, Mycobacterium
LATRYPAQLSGGQQQRV

SEQ ID NO: 517798 - protein, 4 aa, Mycobacterium
LATS

SEQ ID NO: 517799 - protein, 7 aa, Mycobacterium
LATSESD

SEQ ID NO: 517800 - protein, 6 aa, Mycobacterium
LATSGR

SEQ ID NO: 517801 - protein, 7 aa, Mycobacterium
LATSGTH

SEQ ID NO: 517802 - protein, 14 aa, Mycobacterium
LATSLNDASTWAQA

SEQ ID NO: 517803 - protein, 22 aa, Mycobacterium
LATSPSTAASAVAATGGDTGSI

SEQ ID NO: 517804 - protein, 9 aa, Mycobacterium
LATSQDGGT

SEQ ID NO: 517805 - protein, 9 aa, Mycobacterium
LATSSEPHS

SEQ ID NO: 517806 - protein, 5 aa, Mycobacterium
LATST

SEQ ID NO: 517807 - protein, 7 aa, Mycobacterium
LATTAAA

SEQ ID NO: 517808 - protein, 6 aa, Mycobacterium
LATTAL

SEQ ID NO: 517809 - protein, 10 aa, Mycobacterium
LATTDSVPEA

SEQ ID NO: 517810 - protein, 5 aa, Mycobacterium
LATTE

SEQ ID NO: 517811 - protein, 9 aa, Mycobacterium
LATTGDKST

SEQ ID NO: 517812 - protein, 8 aa, Mycobacterium
LATTGDYA

SEQ ID NO: 517813 - protein, 6 aa, Mycobacterium
LATTGR

SEQ ID NO: 517814 - protein, 7 aa, Mycobacterium
LATTPRA

SEQ ID NO: 517815 - protein, 9 aa, Mycobacterium
LATTSKEAI

SEQ ID NO: 517816 - protein, 6 aa, Mycobacterium
LATTTG

SEQ ID NO: 517817 - protein, 6 aa, Mycobacterium
LAVGPT

SEQ ID NO: 517818 - protein, 10 aa, Mycobacterium
LAVPASAAYA

SEQ ID NO: 517819 - protein, 9 aa, Mycobacterium
LAVPGPKRQ

SEQ ID NO: 517820 - protein, 14 aa, Mycobacterium
LAVQGRKDAKLQKR

SEQ ID NO: 517821 - protein, 11 aa, Mycobacterium
LCPQGDLGRQV

SEQ ID NO: 517822 - protein, 10 aa, Mycobacterium
LCTGSGSGLR

SEQ ID NO: 517823 - protein, 4 aa, Mycobacterium
LDAA

SEQ ID NO: 517824 - protein, 8 aa, Mycobacterium
LDAAAPTA

SEQ ID NO: 517825 - protein, 7 aa, Mycobacterium
LDAADGE

SEQ ID NO: 517826 - protein, 8 aa, Mycobacterium
LDAADRGE

SEQ ID NO: 517827 - protein, 8 aa, Mycobacterium
LDAAEEGE

SEQ ID NO: 517828 - protein, 9 aa, Mycobacterium
LDAAEGWDG

SEQ ID NO: 517829 - protein, 10 aa, Mycobacterium
LDAAGDNPAN

SEQ ID NO: 517830 - protein, 8 aa, Mycobacterium
LDAAGGAK

SEQ ID NO: 517831 - protein, 20 aa, Mycobacterium
LDAAGSGSGCAAGSAGSACA

SEQ ID NO: 517832 - protein, 9 aa, Mycobacterium
LDAAKRARR

SEQ ID NO: 517833 - protein, 10 aa, Mycobacterium
LDAANADQLT

SEQ ID NO: 517834 - protein, 14 aa, Mycobacterium
LDAAPGNARFSSAE

SEQ ID NO: 517835 - protein, 6 aa, Mycobacterium
LDAAQR

SEQ ID NO: 517836 - protein, 6 aa, Mycobacterium
LDAARA

SEQ ID NO: 517837 - protein, 7 aa, Mycobacterium
LDAARTA

SEQ ID NO: 517838 - protein, 9 aa, Mycobacterium
LDAATDDER

SEQ ID NO: 517839 - protein, 7 aa, Mycobacterium
LDAATRG

SEQ ID NO: 517840 - protein, 15 aa, Mycobacterium
LDAATSTNADVPVPV

SEQ ID NO: 517841 - protein, 11 aa, Mycobacterium
LDADDLDGAVQ

SEQ ID NO: 517842 - protein, 6 aa, Mycobacterium
LDADEA

SEQ ID NO: 517843 - protein, 9 aa, Mycobacterium
LDADERQRM

SEQ ID NO: 517844 - protein, 11 aa, Mycobacterium
LDADGKEVTLE

SEQ ID NO: 517845 - protein, 11 aa, Mycobacterium
LDADGKPVEIE

SEQ ID NO: 517846 - protein, 10 aa, Mycobacterium
LDADGNPVAL

SEQ ID NO: 517847 - protein, 6 aa, Mycobacterium
LDADGR

SEQ ID NO: 517848 - protein, 11 aa, Mycobacterium
LDADGSPITLE

SEQ ID NO: 517849 - protein, 10 aa, Mycobacterium
LDADGTPITI

SEQ ID NO: 517850 - protein, 9 aa, Mycobacterium
LDADPARAK

SEQ ID NO: 517851 - protein, 8 aa, Mycobacterium
LDADQTDV

SEQ ID NO: 517852 - protein, 7 aa, Mycobacterium
LDADTYQ

SEQ ID NO: 517853 - protein, 7 aa, Mycobacterium
LDAEDTA

SEQ ID NO: 517854 - protein, 5 aa, Mycobacterium
LDAEE

SEQ ID NO: 517855 - protein, 11 aa, Mycobacterium
LDAEGANTDSL

SEQ ID NO: 517856 - protein, 8 aa, Mycobacterium
LDAEGGEH

SEQ ID NO: 517857 - protein, 11 aa, Mycobacterium
LDAEGSERETE

SEQ ID NO: 517858 - protein, 9 aa, Mycobacterium
LDAENSNRQ

SEQ ID NO: 517859 - protein, 8 aa, Mycobacterium
LDAEPPGD

SEQ ID NO: 517860 - protein, 9 aa, Mycobacterium
LDAESAPAI

SEQ ID NO: 517861 - protein, 9 aa, Mycobacterium
LDAETALQT

SEQ ID NO: 517862 - protein, 7 aa, Mycobacterium
LDAETRA

SEQ ID NO: 517863 - protein, 24 aa, Mycobacterium
LDAETSEGRTVEEQYEQRQRAAAE

SEQ ID NO: 517864 - protein, 24 aa, Mycobacterium
LDAETTESRSVEEQYEKRQRAAAE

SEQ ID NO: 517865 - protein, 7 aa, Mycobacterium
LDAGAAP

SEQ ID NO: 517866 - protein, 6 aa, Mycobacterium
LDAGDE

SEQ ID NO: 517867 - protein, 6 aa, Mycobacterium
LDAGDL

SEQ ID NO: 517868 - protein, 8 aa, Mycobacterium
LDAGEAQR

SEQ ID NO: 517869 - protein, 11 aa, Mycobacterium
LDAGEGSPFDS

SEQ ID NO: 517870 - protein, 6 aa, Mycobacterium
LDAGEQ

SEQ ID NO: 517871 - protein, 9 aa, Mycobacterium
LDAGETLPT

SEQ ID NO: 517872 - protein, 11 aa, Mycobacterium
LDAGGEPSLGD

SEQ ID NO: 517873 - protein, 8 aa, Mycobacterium
LDAGGGSH

SEQ ID NO: 517874 - protein, 10 aa, Mycobacterium
LDAGGNGRQY

SEQ ID NO: 517875 - protein, 9 aa, Mycobacterium
LDAGGRQRR

SEQ ID NO: 517876 - protein, 9 aa, Mycobacterium
LDAGGSEDL

SEQ ID NO: 517877 - protein, 15 aa, Mycobacterium
LDAGKDNPAAKPPRF

SEQ ID NO: 517878 - protein, 8 aa, Mycobacterium
LDAGPLPK

SEQ ID NO: 517879 - protein, 9 aa, Mycobacterium
LDAGPLPVT

SEQ ID NO: 517880 - protein, 8 aa, Mycobacterium
LDAGQPTY

SEQ ID NO: 517881 - protein, 5 aa, Mycobacterium
LDAGR

SEQ ID NO: 517882 - protein, 6 aa, Mycobacterium
LDAGRD

SEQ ID NO: 517883 - protein, 9 aa, Mycobacterium
LDAGRRAPY

SEQ ID NO: 517884 - protein, 9 aa, Mycobacterium
LDAGSAGAH

SEQ ID NO: 517885 - protein, 9 aa, Mycobacterium
LDAGTSTPF

SEQ ID NO: 517886 - protein, 8 aa, Mycobacterium
LDAGVPPD

SEQ ID NO: 517887 - protein, 5 aa, Mycobacterium
LDAGY

SEQ ID NO: 517888 - protein, 4 aa, Mycobacterium
LDAH

SEQ ID NO: 517889 - protein, 5 aa, Mycobacterium
LDAHG

SEQ ID NO: 517890 - protein, 123 aa, Mycobacterium
LDAKAATRKERADAKLKGARDEAIEDRREAQAATQQEIQDARKTAEQRKREAAQSAQQQSAAAKRRADEAADRQKRTVESAKRQVETRTQAAEKAASKAAAAKIDEAEDKLGEAAEKRTEADR

SEQ ID NO: 517891 - protein, 8 aa, Mycobacterium
LDANHPDK

SEQ ID NO: 517892 - protein, 7 aa, Mycobacterium
LDANRNS

SEQ ID NO: 517893 - protein, 4 aa, Mycobacterium
LDAP

SEQ ID NO: 517894 - protein, 18 aa, Mycobacterium
LDAPAPDDDDTLFISGAL

SEQ ID NO: 517895 - protein, 12 aa, Mycobacterium
LDAPDSAESAHR

SEQ ID NO: 517896 - protein, 6 aa, Mycobacterium
LDAPER

SEQ ID NO: 517897 - protein, 7 aa, Mycobacterium
LDAPETA

SEQ ID NO: 517898 - protein, 8 aa, Mycobacterium
LDAPPALQ

SEQ ID NO: 517899 - protein, 11 aa, Mycobacterium
LDAPPEERQRA

SEQ ID NO: 517900 - protein, 9 aa, Mycobacterium
LDAPPELTA

SEQ ID NO: 517901 - protein, 8 aa, Mycobacterium
LDAPPGSR

SEQ ID NO: 517902 - protein, 30 aa, Mycobacterium
LDAPQVDKEGNPTGETKTVNRDQGLRETTL

SEQ ID NO: 517903 - protein, 8 aa, Mycobacterium
LDAPRAEV

SEQ ID NO: 517904 - protein, 11 aa, Mycobacterium
LDAPRKQRHTA

SEQ ID NO: 517905 - protein, 9 aa, Mycobacterium
LDAQDTAEL

SEQ ID NO: 517906 - protein, 10 aa, Mycobacterium
LDAQPDGALP

SEQ ID NO: 517907 - protein, 11 aa, Mycobacterium
LDAQPDGQLPA

SEQ ID NO: 517908 - protein, 22 aa, Mycobacterium
LDAQPGRRPEISPRRLAGRADA

SEQ ID NO: 517909 - protein, 4 aa, Mycobacterium
LDAR

SEQ ID NO: 517910 - protein, 14 aa, Mycobacterium
LDARGGTASPQTRD

SEQ ID NO: 517911 - protein, 10 aa, Mycobacterium
LDARGLPGSL

SEQ ID NO: 517912 - protein, 7 aa, Mycobacterium
LDARTDD

SEQ ID NO: 517913 - protein, 11 aa, Mycobacterium
LDASQAEGRGT

SEQ ID NO: 517914 - protein, 9 aa, Mycobacterium
LDASQQARV

SEQ ID NO: 517915 - protein, 8 aa, Mycobacterium
LDASSAGY

SEQ ID NO: 517916 - protein, 9 aa, Mycobacterium
LDASSDEVA

SEQ ID NO: 517917 - protein, 8 aa, Mycobacterium
LDASTNRL

SEQ ID NO: 517918 - protein, 124 aa, Mycobacterium
LDATAATRKKQADAELAGARDEAIEERQQAQAATAQEIAEARNAAGDRKRQAADSAQKASASAKQRVDEAAAKQKDAVESAKRQVENRTQAAERAASKASAAKLDEAEDKLGEAADKRAEADRV

SEQ ID NO: 517919 - protein, 5 aa, Mycobacterium
LDATG

SEQ ID NO: 517920 - protein, 8 aa, Mycobacterium
LDATPEAV

SEQ ID NO: 517921 - protein, 7 aa, Mycobacterium
LDATQGT

SEQ ID NO: 517922 - protein, 8 aa, Mycobacterium
LDATQGTR

SEQ ID NO: 517923 - protein, 7 aa, Mycobacterium
LDATREK

SEQ ID NO: 517924 - protein, 12 aa, Mycobacterium
LDATSKAQLDRG

SEQ ID NO: 517925 - protein, 6 aa, Mycobacterium
LDATTE

SEQ ID NO: 517926 - protein, 4 aa, Mycobacterium
LDAV

SEQ ID NO: 517927 - protein, 7 aa, Mycobacterium
LDAYARG

SEQ ID NO: 517928 - protein, 8 aa, Mycobacterium
LDAYENQD

SEQ ID NO: 517929 - protein, 9 aa, Mycobacterium
LDDADDAVQ

SEQ ID NO: 517930 - protein, 10 aa, Mycobacterium
LDDADENPGV

SEQ ID NO: 517931 - protein, 5 aa, Mycobacterium
LDDAG

SEQ ID NO: 517932 - protein, 6 aa, Mycobacterium
LDDAGV

SEQ ID NO: 517933 - protein, 9 aa, Mycobacterium
LDDANTAGT

SEQ ID NO: 517934 - protein, 7 aa, Mycobacterium
LDDATKR

SEQ ID NO: 517935 - protein, 4 aa, Mycobacterium
LDDD

SEQ ID NO: 517936 - protein, 14 aa, Mycobacterium
LDDDDDSLQCTVCA

SEQ ID NO: 517937 - protein, 56 aa, Mycobacterium
LDDDDEDEDDDIDELDDDEDSDDEDEDDDEDDDSDFDDDDEDEDSDEDDEEEPVAA

SEQ ID NO: 517938 - protein, 13 aa, Mycobacterium
LDDDDRERLNAVA

SEQ ID NO: 517939 - protein, 7 aa, Mycobacterium
LDDDDSE

SEQ ID NO: 517940 - protein, 15 aa, Mycobacterium
LDDDEDGEGLPPEDI

SEQ ID NO: 517941 - protein, 24 aa, Mycobacterium
LDDDETGQDEQAHRDTADRDRIGP

SEQ ID NO: 517942 - protein, 8 aa, Mycobacterium
LDDDGRRQ

SEQ ID NO: 517943 - protein, 7 aa, Mycobacterium
LDDDPDE

SEQ ID NO: 517944 - protein, 9 aa, Mycobacterium
LDDDRTQVT

SEQ ID NO: 517945 - protein, 12 aa, Mycobacterium
LDDDTRRDLDAA

SEQ ID NO: 517946 - protein, 9 aa, Mycobacterium
LDDDTTERH

SEQ ID NO: 517947 - protein, 4 aa, Mycobacterium
LDDE

SEQ ID NO: 517948 - protein, 6 aa, Mycobacterium
LDDEAA

SEQ ID NO: 517949 - protein, 14 aa, Mycobacterium
LDDEAREAARQQAA

SEQ ID NO: 517950 - protein, 5 aa, Mycobacterium
LDDEG

SEQ ID NO: 517951 - protein, 6 aa, Mycobacterium
LDDEGN

SEQ ID NO: 517952 - protein, 6 aa, Mycobacterium
LDDEGQ

SEQ ID NO: 517953 - protein, 9 aa, Mycobacterium
LDDEPDAAF

SEQ ID NO: 517954 - protein, 9 aa, Mycobacterium
LDDEPDYAA

SEQ ID NO: 517955 - protein, 10 aa, Mycobacterium
LDDEPDYGAA

SEQ ID NO: 517956 - protein, 7 aa, Mycobacterium
LDDEPGL

SEQ ID NO: 517957 - protein, 12 aa, Mycobacterium
LDDEPKFTTAQA

SEQ ID NO: 517958 - protein, 9 aa, Mycobacterium
LDDEQQQAL

SEQ ID NO: 517959 - protein, 22 aa, Mycobacterium
LDDESDADGEGTGKTPQLPPED

SEQ ID NO: 517960 - protein, 9 aa, Mycobacterium
LDDETADRH

SEQ ID NO: 517961 - protein, 6 aa, Mycobacterium
LDDETM

SEQ ID NO: 517962 - protein, 11 aa, Mycobacterium
LDDETPDGFEG

SEQ ID NO: 517963 - protein, 6 aa, Mycobacterium
LDDGAR

SEQ ID NO: 517964 - protein, 6 aa, Mycobacterium
LDDGEG

SEQ ID NO: 517965 - protein, 6 aa, Mycobacterium
LDDGEV

SEQ ID NO: 517966 - protein, 5 aa, Mycobacterium
LDDGG

SEQ ID NO: 517967 - protein, 8 aa, Mycobacterium
LDDGGEEH

SEQ ID NO: 517968 - protein, 13 aa, Mycobacterium
LDDGKANALSPDM

SEQ ID NO: 517969 - protein, 10 aa, Mycobacterium
LDDGKPDLAP

SEQ ID NO: 517970 - protein, 6 aa, Mycobacterium
LDDGLR

SEQ ID NO: 517971 - protein, 8 aa, Mycobacterium
LDDGPARV

SEQ ID NO: 517972 - protein, 7 aa, Mycobacterium
LDDGPRG

SEQ ID NO: 517973 - protein, 6 aa, Mycobacterium
LDDGQM

SEQ ID NO: 517974 - protein, 6 aa, Mycobacterium
LDDGRS

SEQ ID NO: 517975 - protein, 6 aa, Mycobacterium
LDDGRT

SEQ ID NO: 517976 - protein, 16 aa, Mycobacterium
LDDGSGVSGGAGRLPA

SEQ ID NO: 517977 - protein, 8 aa, Mycobacterium
LDDGSHGL

SEQ ID NO: 517978 - protein, 7 aa, Mycobacterium
LDDGSVR

SEQ ID NO: 517979 - protein, 16 aa, Mycobacterium
LDDGTRFRPDPATYTG

SEQ ID NO: 517980 - protein, 5 aa, Mycobacterium
LDDGY

SEQ ID NO: 517981 - protein, 7 aa, Mycobacterium
LDDKPTY

SEQ ID NO: 517982 - protein, 7 aa, Mycobacterium
LDDMPDD

SEQ ID NO: 517983 - protein, 12 aa, Mycobacterium
LDDPAADTGKQT

SEQ ID NO: 517984 - protein, 7 aa, Mycobacterium
LDDPAEQ

SEQ ID NO: 517985 - protein, 7 aa, Mycobacterium
LDDPAGA

SEQ ID NO: 517986 - protein, 6 aa, Mycobacterium
LDDPAR

SEQ ID NO: 517987 - protein, 7 aa, Mycobacterium
LDDPDEL

SEQ ID NO: 517988 - protein, 8 aa, Mycobacterium
LDDPDGVG

SEQ ID NO: 517989 - protein, 11 aa, Mycobacterium
LDDPDLRTENF

SEQ ID NO: 517990 - protein, 13 aa, Mycobacterium
LDDPDSAAVGEAG

SEQ ID NO: 517991 - protein, 8 aa, Mycobacterium
LDDPDTGT

SEQ ID NO: 517992 - protein, 12 aa, Mycobacterium
LDDPGADTGKRT

SEQ ID NO: 517993 - protein, 8 aa, Mycobacterium
LDDPGPGM

SEQ ID NO: 517994 - protein, 7 aa, Mycobacterium
LDDPGRT

SEQ ID NO: 517995 - protein, 6 aa, Mycobacterium
LDDPGV

SEQ ID NO: 517996 - protein, 13 aa, Mycobacterium
LDDPKATTGKSTQ

SEQ ID NO: 517997 - protein, 5 aa, Mycobacterium
LDDPN

SEQ ID NO: 517998 - protein, 6 aa, Mycobacterium
LDDPNE

SEQ ID NO: 517999 - protein, 9 aa, Mycobacterium
LDDPPPAKM

SEQ ID NO: 518000 - protein, 7 aa, Mycobacterium
LDDPPQE

SEQ ID NO: 518001 - protein, 7 aa, Mycobacterium
LDDPPWR

SEQ ID NO: 518002 - protein, 5 aa, Mycobacterium
LDDPQ

SEQ ID NO: 518003 - protein, 7 aa, Mycobacterium
LDDPQTR

SEQ ID NO: 518004 - protein, 7 aa, Mycobacterium
LDDPQVA

SEQ ID NO: 518005 - protein, 7 aa, Mycobacterium
LDDPRDL

SEQ ID NO: 518006 - protein, 33 aa, Mycobacterium
LDDPSAPEPPPNEGASRCEAPAAPTPAHKRYPT

SEQ ID NO: 518007 - protein, 10 aa, Mycobacterium
LDDPSDAATI

SEQ ID NO: 518008 - protein, 6 aa, Mycobacterium
LDDPSL

SEQ ID NO: 518009 - protein, 10 aa, Mycobacterium
LDDPSTHDEI

SEQ ID NO: 518010 - protein, 6 aa, Mycobacterium
LDDPVT

SEQ ID NO: 518011 - protein, 17 aa, Mycobacterium
LDDQAEKALKAHAEGRL

SEQ ID NO: 518012 - protein, 8 aa, Mycobacterium
LDDQAERA

SEQ ID NO: 518013 - protein, 8 aa, Mycobacterium
LDDQGGTA

SEQ ID NO: 518014 - protein, 17 aa, Mycobacterium
LDDQPGQYPPTDTGCDG

SEQ ID NO: 518015 - protein, 6 aa, Mycobacterium
LDDQPV

SEQ ID NO: 518016 - protein, 6 aa, Mycobacterium
LDDQQT

SEQ ID NO: 518017 - protein, 10 aa, Mycobacterium
LDDQSSGLSA

SEQ ID NO: 518018 - protein, 5 aa, Mycobacterium
LDDRA

SEQ ID NO: 518019 - protein, 12 aa, Mycobacterium
LDDRGAAASGVA

SEQ ID NO: 518020 - protein, 6 aa, Mycobacterium
LDDRPA

SEQ ID NO: 518021 - protein, 8 aa, Mycobacterium
LDDRPEVR

SEQ ID NO: 518022 - protein, 14 aa, Mycobacterium
LDDRPPFPCGIDVA

SEQ ID NO: 518023 - protein, 5 aa, Mycobacterium
LDDRR

SEQ ID NO: 518024 - protein, 8 aa, Mycobacterium
LDDRSTRL

SEQ ID NO: 518025 - protein, 5 aa, Mycobacterium
LDDSA

SEQ ID NO: 518026 - protein, 10 aa, Mycobacterium
LDDSAPTRYE

SEQ ID NO: 518027 - protein, 9 aa, Mycobacterium
LDDSDDPAQ

SEQ ID NO: 518028 - protein, 7 aa, Mycobacterium
LDDSGFD

SEQ ID NO: 518029 - protein, 13 aa, Mycobacterium
LDDSKKLGEKERE

SEQ ID NO: 518030 - protein, 12 aa, Mycobacterium
LDDSKKLTEAAR

SEQ ID NO: 518031 - protein, 12 aa, Mycobacterium
LDDSKKLTEGAR

SEQ ID NO: 518032 - protein, 12 aa, Mycobacterium
LDDSKKLTEKAR

SEQ ID NO: 518033 - protein, 10 aa, Mycobacterium
LDDSRGQRWD

SEQ ID NO: 518034 - protein, 14 aa, Mycobacterium
LDDTAPQPRDWIIW

SEQ ID NO: 518035 - protein, 7 aa, Mycobacterium
LDDTDET

SEQ ID NO: 518036 - protein, 6 aa, Mycobacterium
LDDTEG

SEQ ID NO: 518037 - protein, 12 aa, Mycobacterium
LDDTGASASSGK

SEQ ID NO: 518038 - protein, 27 aa, Mycobacterium
LDDTMEGEDVTVGADTGDVDAPSTGAC

SEQ ID NO: 518039 - protein, 6 aa, Mycobacterium
LDDTPE

SEQ ID NO: 518040 - protein, 13 aa, Mycobacterium
LDDTQSAAEGRAN

SEQ ID NO: 518041 - protein, 8 aa, Mycobacterium
LDDTSPDC

SEQ ID NO: 518042 - protein, 10 aa, Mycobacterium
LDDTTLGTDA

SEQ ID NO: 518043 - protein, 6 aa, Mycobacterium
LDDTTS

SEQ ID NO: 518044 - protein, 8 aa, Mycobacterium
LDDYEQPR

SEQ ID NO: 518045 - protein, 20 aa, Mycobacterium
LDDYQGYPSAAIEGTYENQG

SEQ ID NO: 518046 - protein, 6 aa, Mycobacterium
LDEAAG

SEQ ID NO: 518047 - protein, 25 aa, Mycobacterium
LDEAATNYERTDAAKAGDLDGEMHG

SEQ ID NO: 518048 - protein, 9 aa, Mycobacterium
LDEADDPAP

SEQ ID NO: 518049 - protein, 13 aa, Mycobacterium
LDEADEADNRTTA

SEQ ID NO: 518050 - protein, 6 aa, Mycobacterium
LDEAEA

SEQ ID NO: 518051 - protein, 11 aa, Mycobacterium
LDEAEAESSPF

SEQ ID NO: 518052 - protein, 12 aa, Mycobacterium
LDEAEASRHRLR

SEQ ID NO: 518053 - protein, 18 aa, Mycobacterium
LDEAGDVVSGAARDKLSD

SEQ ID NO: 518054 - protein, 6 aa, Mycobacterium
LDEAGG

SEQ ID NO: 518055 - protein, 6 aa, Mycobacterium
LDEAGH

SEQ ID NO: 518056 - protein, 7 aa, Mycobacterium
LDEAGNV

SEQ ID NO: 518057 - protein, 8 aa, Mycobacterium
LDEAGQNM

SEQ ID NO: 518058 - protein, 8 aa, Mycobacterium
LDEAPATT

SEQ ID NO: 518059 - protein, 18 aa, Mycobacterium
LDEAPEAVAATTETAARN

SEQ ID NO: 518060 - protein, 9 aa, Mycobacterium
LDEAQHDPE

SEQ ID NO: 518061 - protein, 7 aa, Mycobacterium
LDEAREA

SEQ ID NO: 518062 - protein, 18 aa, Mycobacterium
LDEARQAEEQIARGNHRG

SEQ ID NO: 518063 - protein, 12 aa, Mycobacterium
LDEARRDALNST

SEQ ID NO: 518064 - protein, 5 aa, Mycobacterium
LDEAV

SEQ ID NO: 518065 - protein, 9 aa, Mycobacterium
LDEDASPAY

SEQ ID NO: 518066 - protein, 6 aa, Mycobacterium
LDEDDD

SEQ ID NO: 518067 - protein, 8 aa, Mycobacterium
LDEDDDWQ

SEQ ID NO: 518068 - protein, 9 aa, Mycobacterium
LDEDGPRAE

SEQ ID NO: 518069 - protein, 17 aa, Mycobacterium
LDEDPDYEGAAAALEKA

SEQ ID NO: 518070 - protein, 8 aa, Mycobacterium
LDEDPEAA

SEQ ID NO: 518071 - protein, 7 aa, Mycobacterium
LDEDSAP

SEQ ID NO: 518072 - protein, 6 aa, Mycobacterium
LDEDSD

SEQ ID NO: 518073 - protein, 8 aa, Mycobacterium
LDEDSDDV

SEQ ID NO: 518074 - protein, 13 aa, Mycobacterium
LDEDTRGRLNALA

SEQ ID NO: 518075 - protein, 5 aa, Mycobacterium
LDEEG

SEQ ID NO: 518076 - protein, 14 aa, Mycobacterium
LDEEGNPVQPGSGV

SEQ ID NO: 518077 - protein, 7 aa, Mycobacterium
LDEEGSG

SEQ ID NO: 518078 - protein, 8 aa, Mycobacterium
LDEEPDAA

SEQ ID NO: 518079 - protein, 17 aa, Mycobacterium
LDEEPDYEGAAAGLEKA

SEQ ID NO: 518080 - protein, 7 aa, Mycobacterium
LDEESAA

SEQ ID NO: 518081 - protein, 7 aa, Mycobacterium
LDEGAGS

SEQ ID NO: 518082 - protein, 9 aa, Mycobacterium
LDEGDSAYL

SEQ ID NO: 518083 - protein, 10 aa, Mycobacterium
LDEGEPYGLP

SEQ ID NO: 518084 - protein, 8 aa, Mycobacterium
LDEGEVPS

SEQ ID NO: 518085 - protein, 10 aa, Mycobacterium
LDEGKPDLAP

SEQ ID NO: 518086 - protein, 11 aa, Mycobacterium
LDEGKPDLAPP

SEQ ID NO: 518087 - protein, 6 aa, Mycobacterium
LDEGQV

SEQ ID NO: 518088 - protein, 25 aa, Mycobacterium
LDEGREAFESRERGGRAGKTVLIVR

SEQ ID NO: 518089 - protein, 4 aa, Mycobacterium
LDEH

SEQ ID NO: 518090 - protein, 5 aa, Mycobacterium
LDEHN

SEQ ID NO: 518091 - protein, 4 aa, Mycobacterium
LDEK

SEQ ID NO: 518092 - protein, 7 aa, Mycobacterium
LDEKQIG

SEQ ID NO: 518093 - protein, 13 aa, Mycobacterium
LDEKSAGKELKDT

SEQ ID NO: 518094 - protein, 23 aa, Mycobacterium
LDELTDDDIREAARAEVARILNP

SEQ ID NO: 518095 - protein, 7 aa, Mycobacterium
LDENTLA

SEQ ID NO: 518096 - protein, 4 aa, Mycobacterium
LDEP

SEQ ID NO: 518097 - protein, 5 aa, Mycobacterium
LDEPA

SEQ ID NO: 518098 - protein, 8 aa, Mycobacterium
LDEPAAQN

SEQ ID NO: 518099 - protein, 7 aa, Mycobacterium
LDEPDAA

SEQ ID NO: 518100 - protein, 5 aa, Mycobacterium
LDEPG

SEQ ID NO: 518101 - protein, 6 aa, Mycobacterium
LDEPHT

SEQ ID NO: 518102 - protein, 7 aa, Mycobacterium
LDEPNPG

SEQ ID NO: 518103 - protein, 5 aa, Mycobacterium
LDEPP

SEQ ID NO: 518104 - protein, 7 aa, Mycobacterium
LDEPRDI

SEQ ID NO: 518105 - protein, 7 aa, Mycobacterium
LDEPRSD

SEQ ID NO: 518106 - protein, 4 aa, Mycobacterium
LDEQ

SEQ ID NO: 518107 - protein, 45 aa, Mycobacterium
LDEQAGGEADDAESRLPNLTQGQRVDAKDLTADGHTTSPPARYTE

SEQ ID NO: 518108 - protein, 39 aa, Mycobacterium
LDEQANAKLSADQKAVKDAEKAARAAADAEWRPKYQASE

SEQ ID NO: 518109 - protein, 8 aa, Mycobacterium
LDEQASAE

SEQ ID NO: 518110 - protein, 7 aa, Mycobacterium
LDEQPAS

SEQ ID NO: 518111 - protein, 9 aa, Mycobacterium
LDEQPDGTT

SEQ ID NO: 518112 - protein, 10 aa, Mycobacterium
LDEQRKDPAH

SEQ ID NO: 518113 - protein, 11 aa, Mycobacterium
LDEQSGATSFS

SEQ ID NO: 518114 - protein, 5 aa, Mycobacterium
LDEQY

SEQ ID NO: 518115 - protein, 4 aa, Mycobacterium
LDER

SEQ ID NO: 518116 - protein, 5 aa, Mycobacterium
LDERG

SEQ ID NO: 518117 - protein, 9 aa, Mycobacterium
LDERGEGPI

SEQ ID NO: 518118 - protein, 16 aa, Mycobacterium
LDERGGSELPLRPWWQ

SEQ ID NO: 518119 - protein, 14 aa, Mycobacterium
LDERGITPSPQTRD

SEQ ID NO: 518120 - protein, 8 aa, Mycobacterium
LDERPDEE

SEQ ID NO: 518121 - protein, 7 aa, Mycobacterium
LDERTDA

SEQ ID NO: 518122 - protein, 4 aa, Mycobacterium
LDES

SEQ ID NO: 518123 - protein, 5 aa, Mycobacterium
LDESD

SEQ ID NO: 518124 - protein, 17 aa, Mycobacterium
LDESDEMEAAPQDGRPD

SEQ ID NO: 518125 - protein, 12 aa, Mycobacterium
LDESETDRVTGR

SEQ ID NO: 518126 - protein, 8 aa, Mycobacterium
LDESGAAR

SEQ ID NO: 518127 - protein, 9 aa, Mycobacterium
LDESGVPSF

SEQ ID NO: 518128 - protein, 12 aa, Mycobacterium
LDESLGESRLPD

SEQ ID NO: 518129 - protein, 8 aa, Mycobacterium
LDESQNAK

SEQ ID NO: 518130 - protein, 14 aa, Mycobacterium
LDESRGKRQPESRF

SEQ ID NO: 518131 - protein, 11 aa, Mycobacterium
LDESRSRPFEP

SEQ ID NO: 518132 - protein, 16 aa, Mycobacterium
LDESSTTRMVRLHSDA

SEQ ID NO: 518133 - protein, 4 aa, Mycobacterium
LDET

SEQ ID NO: 518134 - protein, 20 aa, Mycobacterium
LDETDSAADESTDDPEAIPD

SEQ ID NO: 518135 - protein, 6 aa, Mycobacterium
LDETEA

SEQ ID NO: 518136 - protein, 10 aa, Mycobacterium
LDETESMEPD

SEQ ID NO: 518137 - protein, 8 aa, Mycobacterium
LDETGAAR

SEQ ID NO: 518138 - protein, 6 aa, Mycobacterium
LDETPG

SEQ ID NO: 518139 - protein, 7 aa, Mycobacterium
LDETSNR

SEQ ID NO: 518140 - protein, 9 aa, Mycobacterium
LDETSTASW

SEQ ID NO: 518141 - protein, 8 aa, Mycobacterium
LDETTRDE

SEQ ID NO: 518142 - protein, 6 aa, Mycobacterium
LDGAAR

SEQ ID NO: 518143 - protein, 8 aa, Mycobacterium
LDGADPTI

SEQ ID NO: 518144 - protein, 6 aa, Mycobacterium
LDGAER

SEQ ID NO: 518145 - protein, 5 aa, Mycobacterium
LDGAG

SEQ ID NO: 518146 - protein, 7 aa, Mycobacterium
LDGAHGA

SEQ ID NO: 518147 - protein, 12 aa, Mycobacterium
LDGAPAAKSDKL

SEQ ID NO: 518148 - protein, 6 aa, Mycobacterium
LDGAPD

SEQ ID NO: 518149 - protein, 10 aa, Mycobacterium
LDGAPPDMTE

SEQ ID NO: 518150 - protein, 7 aa, Mycobacterium
LDGARDS

SEQ ID NO: 518151 - protein, 11 aa, Mycobacterium
LDGARESLGCT

SEQ ID NO: 518152 - protein, 7 aa, Mycobacterium
LDGARPD

SEQ ID NO: 518153 - protein, 8 aa, Mycobacterium
LDGARQAL

SEQ ID NO: 518154 - protein, 10 aa, Mycobacterium
LDGARSGPRL

SEQ ID NO: 518155 - protein, 9 aa, Mycobacterium
LDGASDTAW

SEQ ID NO: 518156 - protein, 8 aa, Mycobacterium
LDGATQRG

SEQ ID NO: 518157 - protein, 5 aa, Mycobacterium
LDGAV

SEQ ID NO: 518158 - protein, 6 aa, Mycobacterium
LDGDAL

SEQ ID NO: 518159 - protein, 10 aa, Mycobacterium
LDGDARGGAA

SEQ ID NO: 518160 - protein, 9 aa, Mycobacterium
LDGDDAAAA

SEQ ID NO: 518161 - protein, 20 aa, Mycobacterium
LDGDDPDLGARRLDPDRDRA

SEQ ID NO: 518162 - protein, 7 aa, Mycobacterium
LDGDDPL

SEQ ID NO: 518163 - protein, 5 aa, Mycobacterium
LDGDG

SEQ ID NO: 518164 - protein, 18 aa, Mycobacterium
LDGDGAYGDGADESVTAY

SEQ ID NO: 518165 - protein, 7 aa, Mycobacterium
LDGDGRL

SEQ ID NO: 518166 - protein, 7 aa, Mycobacterium
LDGDKRE

SEQ ID NO: 518167 - protein, 5 aa, Mycobacterium
LDGDL

SEQ ID NO: 518168 - protein, 15 aa, Mycobacterium
LDGDLGSDGSTVQDR

SEQ ID NO: 518169 - protein, 6 aa, Mycobacterium
LDGDPA

SEQ ID NO: 518170 - protein, 6 aa, Mycobacterium
LDGDPG

SEQ ID NO: 518171 - protein, 7 aa, Mycobacterium
LDGDPGL

SEQ ID NO: 518172 - protein, 9 aa, Mycobacterium
LDGDQYSEQ

SEQ ID NO: 518173 - protein, 5 aa, Mycobacterium
LDGDR

SEQ ID NO: 518174 - protein, 6 aa, Mycobacterium
LDGDTE

SEQ ID NO: 518175 - protein, 16 aa, Mycobacterium
LDGDTGRRFPSPDRKD

SEQ ID NO: 518176 - protein, 12 aa, Mycobacterium
LDGDVRNSGVER

SEQ ID NO: 518177 - protein, 4 aa, Mycobacterium
LDGE

SEQ ID NO: 518178 - protein, 6 aa, Mycobacterium
LDGEAG

SEQ ID NO: 518179 - protein, 8 aa, Mycobacterium
LDGEAPRL

SEQ ID NO: 518180 - protein, 12 aa, Mycobacterium
LDGEDVSARAQI

SEQ ID NO: 518181 - protein, 6 aa, Mycobacterium
LDGEKR

SEQ ID NO: 518182 - protein, 6 aa, Mycobacterium
LDGEPT

SEQ ID NO: 518183 - protein, 7 aa, Mycobacterium
LDGEPVG

SEQ ID NO: 518184 - protein, 26 aa, Mycobacterium
LDGEQREAARQKADEERAEAEKRERR

SEQ ID NO: 518185 - protein, 6 aa, Mycobacterium
LDGETH

SEQ ID NO: 518186 - protein, 8 aa, Mycobacterium
LDGETVNV

SEQ ID NO: 518187 - protein, 7 aa, Mycobacterium
LDGGADD

SEQ ID NO: 518188 - protein, 10 aa, Mycobacterium
LDGGAESQKA

SEQ ID NO: 518189 - protein, 12 aa, Mycobacterium
LDGGAGGAGGNA

SEQ ID NO: 518190 - protein, 17 aa, Mycobacterium
LDGGATSQSSKVQGREP

SEQ ID NO: 518191 - protein, 8 aa, Mycobacterium
LDGGDQVV

SEQ ID NO: 518192 - protein, 7 aa, Mycobacterium
LDGGESE

SEQ ID NO: 518193 - protein, 18 aa, Mycobacterium
LDGGGCDEDTSYSPRFDG

SEQ ID NO: 518194 - protein, 9 aa, Mycobacterium
LDGGGPKRL

SEQ ID NO: 518195 - protein, 8 aa, Mycobacterium
LDGGGPQL

SEQ ID NO: 518196 - protein, 19 aa, Mycobacterium
LDGGGRGFAHDGAAGDHAE

SEQ ID NO: 518197 - protein, 10 aa, Mycobacterium
LDGGKNIARD

SEQ ID NO: 518198 - protein, 9 aa, Mycobacterium
LDGGKPTVD

SEQ ID NO: 518199 - protein, 10 aa, Mycobacterium
LDGGNGGSGG

SEQ ID NO: 518200 - protein, 8 aa, Mycobacterium
LDGGNRMP

SEQ ID NO: 518201 - protein, 10 aa, Mycobacterium
LDGGPDADFD

SEQ ID NO: 518202 - protein, 23 aa, Mycobacterium
LDGGPDSRQAFAASPEDNPMPGG

SEQ ID NO: 518203 - protein, 19 aa, Mycobacterium
LDGGPGTPGPIDSVPEPPT

SEQ ID NO: 518204 - protein, 19 aa, Mycobacterium
LDGGRDAPGPSDSASAPTS

SEQ ID NO: 518205 - protein, 7 aa, Mycobacterium
LDGGREF

SEQ ID NO: 518206 - protein, 8 aa, Mycobacterium
LDGGRNIA

SEQ ID NO: 518207 - protein, 22 aa, Mycobacterium
LDGGSDGAEPTAPWSEGGSALE

SEQ ID NO: 518208 - protein, 10 aa, Mycobacterium
LDGGSITDPG

SEQ ID NO: 518209 - protein, 24 aa, Mycobacterium
LDGGTDSRQAFAASPDDTKMPGGM

SEQ ID NO: 518210 - protein, 10 aa, Mycobacterium
LDGGTHTGAE

SEQ ID NO: 518211 - protein, 9 aa, Mycobacterium
LDGGTNLGA

SEQ ID NO: 518212 - protein, 6 aa, Mycobacterium
LDGGTW

SEQ ID NO: 518213 - protein, 16 aa, Mycobacterium
LDGIDDPLDTPPRPAP

SEQ ID NO: 518214 - protein, 4 aa, Mycobacterium
LDGK

SEQ ID NO: 518215 - protein, 7 aa, Mycobacterium
LDGKQDN

SEQ ID NO: 518216 - protein, 9 aa, Mycobacterium
LDGKRATSH

SEQ ID NO: 518217 - protein, 7 aa, Mycobacterium
LDGKRPD

SEQ ID NO: 518218 - protein, 9 aa, Mycobacterium
LDGLPGRTA

SEQ ID NO: 518219 - protein, 10 aa, Mycobacterium
LDGNEIKTSD

SEQ ID NO: 518220 - protein, 11 aa, Mycobacterium
LDGNLGPVTTA

SEQ ID NO: 518221 - protein, 11 aa, Mycobacterium
LDGNNAPSEPY

SEQ ID NO: 518222 - protein, 7 aa, Mycobacterium
LDGNPSL

SEQ ID NO: 518223 - protein, 7 aa, Mycobacterium
LDGNTRR

SEQ ID NO: 518224 - protein, 6 aa, Mycobacterium
LDGPAA

SEQ ID NO: 518225 - protein, 8 aa, Mycobacterium
LDGPAQRA

SEQ ID NO: 518226 - protein, 8 aa, Mycobacterium
LDGPDGAP

SEQ ID NO: 518227 - protein, 15 aa, Mycobacterium
LDGPDSATAGTVGEA

SEQ ID NO: 518228 - protein, 10 aa, Mycobacterium
LDGPDSNLPG

SEQ ID NO: 518229 - protein, 5 aa, Mycobacterium
LDGPG

SEQ ID NO: 518230 - protein, 9 aa, Mycobacterium
LDGPGDADF

SEQ ID NO: 518231 - protein, 6 aa, Mycobacterium
LDGPGL

SEQ ID NO: 518232 - protein, 9 aa, Mycobacterium
LDGPKDSQV

SEQ ID NO: 518233 - protein, 7 aa, Mycobacterium
LDGPKQN

SEQ ID NO: 518234 - protein, 7 aa, Mycobacterium
LDGPLAE

SEQ ID NO: 518235 - protein, 7 aa, Mycobacterium
LDGPPDG

SEQ ID NO: 518236 - protein, 11 aa, Mycobacterium
LDGPPDPRDEE

SEQ ID NO: 518237 - protein, 8 aa, Mycobacterium
LDGPPDVA

SEQ ID NO: 518238 - protein, 15 aa, Mycobacterium
LDGPPPPGYEYNSPV

SEQ ID NO: 518239 - protein, 7 aa, Mycobacterium
LDGPRDS

SEQ ID NO: 518240 - protein, 8 aa, Mycobacterium
LDGPRDSQ

SEQ ID NO: 518241 - protein, 19 aa, Mycobacterium
LDGPRRARAVSAAKATIAR

SEQ ID NO: 518242 - protein, 12 aa, Mycobacterium
LDGPSENRARLR

SEQ ID NO: 518243 - protein, 10 aa, Mycobacterium
LDGPSGPTAD

SEQ ID NO: 518244 - protein, 10 aa, Mycobacterium
LDGPSRPPMS

SEQ ID NO: 518245 - protein, 20 aa, Mycobacterium
LDGPVPASAFPDSTETHQTA

SEQ ID NO: 518246 - protein, 4 aa, Mycobacterium
LDGQ

SEQ ID NO: 518247 - protein, 7 aa, Mycobacterium
LDGQEPG

SEQ ID NO: 518248 - protein, 7 aa, Mycobacterium
LDGQGDD

SEQ ID NO: 518249 - protein, 7 aa, Mycobacterium
LDGQGRV

SEQ ID NO: 518250 - protein, 23 aa, Mycobacterium
LDGQLGQAQSQRSESEKRATQWQ

SEQ ID NO: 518251 - protein, 6 aa, Mycobacterium
LDGQPG

SEQ ID NO: 518252 - protein, 7 aa, Mycobacterium
LDGQSAA

SEQ ID NO: 518253 - protein, 8 aa, Mycobacterium
LDGQSEVS

SEQ ID NO: 518254 - protein, 10 aa, Mycobacterium
LDGQSGAGTL

SEQ ID NO: 518255 - protein, 9 aa, Mycobacterium
LDGQTPVEV

SEQ ID NO: 518256 - protein, 8 aa, Mycobacterium
LDGRADPG

SEQ ID NO: 518257 - protein, 8 aa, Mycobacterium
LDGRAGPG

SEQ ID NO: 518258 - protein, 19 aa, Mycobacterium
LDGRARSAHSTVGPDEADR

SEQ ID NO: 518259 - protein, 20 aa, Mycobacterium
LDGRARSPHSNVDKQDAAKV

SEQ ID NO: 518260 - protein, 7 aa, Mycobacterium
LDGRDPL

SEQ ID NO: 518261 - protein, 8 aa, Mycobacterium
LDGREAVD

SEQ ID NO: 518262 - protein, 7 aa, Mycobacterium
LDGRKRD

SEQ ID NO: 518263 - protein, 14 aa, Mycobacterium
LDGRPHRPTHPRDA

SEQ ID NO: 518264 - protein, 7 aa, Mycobacterium
LDGRQGQ

SEQ ID NO: 518265 - protein, 11 aa, Mycobacterium
LDGRTYAGAPV

SEQ ID NO: 518266 - protein, 5 aa, Mycobacterium
LDGSD

SEQ ID NO: 518267 - protein, 7 aa, Mycobacterium
LDGSDPL

SEQ ID NO: 518268 - protein, 5 aa, Mycobacterium
LDGSG

SEQ ID NO: 518269 - protein, 9 aa, Mycobacterium
LDGSGERTF

SEQ ID NO: 518270 - protein, 10 aa, Mycobacterium
LDGSGLGDGA

SEQ ID NO: 518271 - protein, 9 aa, Mycobacterium
LDGSGTVRD

SEQ ID NO: 518272 - protein, 6 aa, Mycobacterium
LDGSHR

SEQ ID NO: 518273 - protein, 14 aa, Mycobacterium
LDGSPAGGGSAAQT

SEQ ID NO: 518274 - protein, 14 aa, Mycobacterium
LDGSPASGGSAAQT

SEQ ID NO: 518275 - protein, 6 aa, Mycobacterium
LDGSPL

SEQ ID NO: 518276 - protein, 7 aa, Mycobacterium
LDGSPLQ

SEQ ID NO: 518277 - protein, 12 aa, Mycobacterium
LDGSPLREVSST

SEQ ID NO: 518278 - protein, 7 aa, Mycobacterium
LDGSPMR

SEQ ID NO: 518279 - protein, 14 aa, Mycobacterium
LDGSPMRYNQSDPY

SEQ ID NO: 518280 - protein, 9 aa, Mycobacterium
LDGSPQGRT

SEQ ID NO: 518281 - protein, 6 aa, Mycobacterium
LDGSPV

SEQ ID NO: 518282 - protein, 5 aa, Mycobacterium
LDGSR

SEQ ID NO: 518283 - protein, 9 aa, Mycobacterium
LDGSRGPGT

SEQ ID NO: 518284 - protein, 10 aa, Mycobacterium
LDGSTEQARV

SEQ ID NO: 518285 - protein, 10 aa, Mycobacterium
LDGSTEQSRV

SEQ ID NO: 518286 - protein, 12 aa, Mycobacterium
LDGSTGYLTTQQ

SEQ ID NO: 518287 - protein, 8 aa, Mycobacterium
LDGTAAPR

SEQ ID NO: 518288 - protein, 7 aa, Mycobacterium
LDGTAKG

SEQ ID NO: 518289 - protein, 6 aa, Mycobacterium
LDGTAQ

SEQ ID NO: 518290 - protein, 12 aa, Mycobacterium
LDGTDDGRRRAV

SEQ ID NO: 518291 - protein, 6 aa, Mycobacterium
LDGTDW

SEQ ID NO: 518292 - protein, 8 aa, Mycobacterium
LDGTGEDA

SEQ ID NO: 518293 - protein, 7 aa, Mycobacterium
LDGTGRA

SEQ ID NO: 518294 - protein, 19 aa, Mycobacterium
LDGTPSDDEPAVAAGEAPD

SEQ ID NO: 518295 - protein, 9 aa, Mycobacterium
LDGTQFKEG

SEQ ID NO: 518296 - protein, 6 aa, Mycobacterium
LDGTRQ

SEQ ID NO: 518297 - protein, 6 aa, Mycobacterium
LDGTTE

SEQ ID NO: 518298 - protein, 18 aa, Mycobacterium
LDGTTVPYESLSGGAKEQ

SEQ ID NO: 518299 - protein, 4 aa, Mycobacterium
LDGW

SEQ ID NO: 518300 - protein, 6 aa, Mycobacterium
LDGYRR

SEQ ID NO: 518301 - protein, 5 aa, Mycobacterium
LDGYS

SEQ ID NO: 518302 - protein, 9 aa, Mycobacterium
LDHASKGRI

SEQ ID NO: 518303 - protein, 4 aa, Mycobacterium
LDHG

SEQ ID NO: 518304 - protein, 8 aa, Mycobacterium
LDHGPSGI

SEQ ID NO: 518305 - protein, 6 aa, Mycobacterium
LDHGRE

SEQ ID NO: 518306 - protein, 13 aa, Mycobacterium
LDHNRDQARSLRT

SEQ ID NO: 518307 - protein, 4 aa, Mycobacterium
LDHP

SEQ ID NO: 518308 - protein, 5 aa, Mycobacterium
LDHPS

SEQ ID NO: 518309 - protein, 6 aa, Mycobacterium
LDHPTA

SEQ ID NO: 518310 - protein, 7 aa, Mycobacterium
LDHTTTA

SEQ ID NO: 518311 - protein, 13 aa, Mycobacterium
LDKAETKAKYGEE

SEQ ID NO: 518312 - protein, 12 aa, Mycobacterium
LDKAETKARYGD

SEQ ID NO: 518313 - protein, 15 aa, Mycobacterium
LDKAGGKTRNADQTI

SEQ ID NO: 518314 - protein, 7 aa, Mycobacterium
LDKAPGV

SEQ ID NO: 518315 - protein, 11 aa, Mycobacterium
LDKARERADEL

SEQ ID NO: 518316 - protein, 10 aa, Mycobacterium
LDKGSAALSI

SEQ ID NO: 518317 - protein, 5 aa, Mycobacterium
LDKPG

SEQ ID NO: 518318 - protein, 12 aa, Mycobacterium
LDKQGKDPQSFR

SEQ ID NO: 518319 - protein, 13 aa, Mycobacterium
LDKRALPAATPIT

SEQ ID NO: 518320 - protein, 9 aa, Mycobacterium
LDKSGAARM

SEQ ID NO: 518321 - protein, 12 aa, Mycobacterium
LDKSPTIPSGIF

SEQ ID NO: 518322 - protein, 9 aa, Mycobacterium
LDKTGRDKL

SEQ ID NO: 518323 - protein, 6 aa, Mycobacterium
LDKTVA

SEQ ID NO: 518324 - protein, 9 aa, Mycobacterium
LDLDGDGRF

SEQ ID NO: 518325 - protein, 24 aa, Mycobacterium
LDLGEGADAADATDTAEDQAPEIP

SEQ ID NO: 518326 - protein, 18 aa, Mycobacterium
LDLGPQRRQRSPPQDAQH

SEQ ID NO: 518327 - protein, 8 aa, Mycobacterium
LDLPEAPA

SEQ ID NO: 518328 - protein, 10 aa, Mycobacterium
LDLPEDASPA

SEQ ID NO: 518329 - protein, 10 aa, Mycobacterium
LDLPPEAEEL

SEQ ID NO: 518330 - protein, 11 aa, Mycobacterium
LDLPPSPPKAC

SEQ ID NO: 518331 - protein, 4 aa, Mycobacterium
LDLR

SEQ ID NO: 518332 - protein, 8 aa, Mycobacterium
LDNDHPDR

SEQ ID NO: 518333 - protein, 4 aa, Mycobacterium
LDNG

SEQ ID NO: 518334 - protein, 18 aa, Mycobacterium
LDNGARPEPDVTDAYDEA

SEQ ID NO: 518335 - protein, 12 aa, Mycobacterium
LDNGDLGPSQVR

SEQ ID NO: 518336 - protein, 11 aa, Mycobacterium
LDNGKFRSRAE

SEQ ID NO: 518337 - protein, 13 aa, Mycobacterium
LDNGNVRGRAILV

SEQ ID NO: 518338 - protein, 7 aa, Mycobacterium
LDNKRQA

SEQ ID NO: 518339 - protein, 4 aa, Mycobacterium
LDNP

SEQ ID NO: 518340 - protein, 11 aa, Mycobacterium
LDNPDSGTITI

SEQ ID NO: 518341 - protein, 7 aa, Mycobacterium
LDNPEHA

SEQ ID NO: 518342 - protein, 15 aa, Mycobacterium
LDNPEPAETYSSSPH

SEQ ID NO: 518343 - protein, 5 aa, Mycobacterium
LDNPG

SEQ ID NO: 518344 - protein, 6 aa, Mycobacterium
LDNPRA

SEQ ID NO: 518345 - protein, 9 aa, Mycobacterium
LDNPTSNSI

SEQ ID NO: 518346 - protein, 4 aa, Mycobacterium
LDNR

SEQ ID NO: 518347 - protein, 6 aa, Mycobacterium
LDNRRY

SEQ ID NO: 518348 - protein, 5 aa, Mycobacterium
LDPAA

SEQ ID NO: 518349 - protein, 12 aa, Mycobacterium
LDPAAERQRAEQ

SEQ ID NO: 518350 - protein, 16 aa, Mycobacterium
LDPAAESEVAPQTERP

SEQ ID NO: 518351 - protein, 16 aa, Mycobacterium
LDPAAETEVAPQADRP

SEQ ID NO: 518352 - protein, 16 aa, Mycobacterium
LDPAAETEVAPQTEKP

SEQ ID NO: 518353 - protein, 16 aa, Mycobacterium
LDPAAETEVAPQTQKP

SEQ ID NO: 518354 - protein, 9 aa, Mycobacterium
LDPADDRGF

SEQ ID NO: 518355 - protein, 9 aa, Mycobacterium
LDPADERKQ

SEQ ID NO: 518356 - protein, 11 aa, Mycobacterium
LDPADLSHSQT

SEQ ID NO: 518357 - protein, 8 aa, Mycobacterium
LDPADRDA

SEQ ID NO: 518358 - protein, 9 aa, Mycobacterium
LDPAEPEIP

SEQ ID NO: 518359 - protein, 12 aa, Mycobacterium
LDPAETLRDGSA

SEQ ID NO: 518360 - protein, 12 aa, Mycobacterium
LDPAGADADQQV

SEQ ID NO: 518361 - protein, 12 aa, Mycobacterium
LDPAGAPADELP

SEQ ID NO: 518362 - protein, 9 aa, Mycobacterium
LDPAGERKQ

SEQ ID NO: 518363 - protein, 7 aa, Mycobacterium
LDPAGLD

SEQ ID NO: 518364 - protein, 13 aa, Mycobacterium
LDPAGRPAKSGGT

SEQ ID NO: 518365 - protein, 13 aa, Mycobacterium
LDPAGRPARSGGA

SEQ ID NO: 518366 - protein, 7 aa, Mycobacterium
LDPAGRV

SEQ ID NO: 518367 - protein, 11 aa, Mycobacterium
LDPAKARALAN

SEQ ID NO: 518368 - protein, 5 aa, Mycobacterium
LDPAN

SEQ ID NO: 518369 - protein, 8 aa, Mycobacterium
LDPANTVA

SEQ ID NO: 518370 - protein, 12 aa, Mycobacterium
LDPAPDDAQATA

SEQ ID NO: 518371 - protein, 6 aa, Mycobacterium
LDPAPG

SEQ ID NO: 518372 - protein, 10 aa, Mycobacterium
LDPAPTGTTA

SEQ ID NO: 518373 - protein, 7 aa, Mycobacterium
LDPAQRE

SEQ ID NO: 518374 - protein, 16 aa, Mycobacterium
LDPARVAKKRNDHHAP

SEQ ID NO: 518375 - protein, 5 aa, Mycobacterium
LDPAS

SEQ ID NO: 518376 - protein, 12 aa, Mycobacterium
LDPASLAGSSTA

SEQ ID NO: 518377 - protein, 22 aa, Mycobacterium
LDPASYGQQPHPTTDEPRTDRD

SEQ ID NO: 518378 - protein, 6 aa, Mycobacterium
LDPATE

SEQ ID NO: 518379 - protein, 9 aa, Mycobacterium
LDPATGALE

SEQ ID NO: 518380 - protein, 7 aa, Mycobacterium
LDPATPQ

SEQ ID NO: 518381 - protein, 8 aa, Mycobacterium
LDPATPRQ

SEQ ID NO: 518382 - protein, 8 aa, Mycobacterium
LDPATQAA

SEQ ID NO: 518383 - protein, 9 aa, Mycobacterium
LDPATRGDL

SEQ ID NO: 518384 - protein, 7 aa, Mycobacterium
LDPATRT

SEQ ID NO: 518385 - protein, 6 aa, Mycobacterium
LDPAVA

SEQ ID NO: 518386 - protein, 9 aa, Mycobacterium
LDPCSRGRR

SEQ ID NO: 518387 - protein, 6 aa, Mycobacterium
LDPDAD

SEQ ID NO: 518388 - protein, 8 aa, Mycobacterium
LDPDASLG

SEQ ID NO: 518389 - protein, 8 aa, Mycobacterium
LDPDDAVA

SEQ ID NO: 518390 - protein, 10 aa, Mycobacterium
LDPDDPDVPK

SEQ ID NO: 518391 - protein, 7 aa, Mycobacterium
LDPDDQQ

SEQ ID NO: 518392 - protein, 58 aa, Mycobacterium
LDPDDSDDEPADLDEDTDGGGEDTEQPASSGEPQPLPTGPTTVTLPNGDTITAASPEL

SEQ ID NO: 518393 - protein, 6 aa, Mycobacterium
LDPDEP

SEQ ID NO: 518394 - protein, 12 aa, Mycobacterium
LDPDFGRGQSAY

SEQ ID NO: 518395 - protein, 10 aa, Mycobacterium
LDPDGDDPHI

SEQ ID NO: 518396 - protein, 6 aa, Mycobacterium
LDPDGI

SEQ ID NO: 518397 - protein, 12 aa, Mycobacterium
LDPDGILNPGAA

SEQ ID NO: 518398 - protein, 12 aa, Mycobacterium
LDPDGILNPGTL

SEQ ID NO: 518399 - protein, 9 aa, Mycobacterium
LDPDGPDRV

SEQ ID NO: 518400 - protein, 8 aa, Mycobacterium
LDPDKASR

SEQ ID NO: 518401 - protein, 10 aa, Mycobacterium
LDPDKDKPSL

SEQ ID NO: 518402 - protein, 5 aa, Mycobacterium
LDPDN

SEQ ID NO: 518403 - protein, 7 aa, Mycobacterium
LDPDQRQ

SEQ ID NO: 518404 - protein, 8 aa, Mycobacterium
LDPDRGGV

SEQ ID NO: 518405 - protein, 7 aa, Mycobacterium
LDPDRTY

SEQ ID NO: 518406 - protein, 7 aa, Mycobacterium
LDPDSMT

SEQ ID NO: 518407 - protein, 5 aa, Mycobacterium
LDPDT

SEQ ID NO: 518408 - protein, 9 aa, Mycobacterium
LDPDTEKLR

SEQ ID NO: 518409 - protein, 12 aa, Mycobacterium
LDPDVQSSVKSA

SEQ ID NO: 518410 - protein, 5 aa, Mycobacterium
LDPEA

SEQ ID NO: 518411 - protein, 19 aa, Mycobacterium
LDPEAAAAGAAAVAAQGAK

SEQ ID NO: 518412 - protein, 20 aa, Mycobacterium
LDPEAAAAGAAAVASQGAAK

SEQ ID NO: 518413 - protein, 20 aa, Mycobacterium
LDPEAAAAGAAAVASQGTAK

SEQ ID NO: 518414 - protein, 17 aa, Mycobacterium
LDPEAARRAAWEGFSLT

SEQ ID NO: 518415 - protein, 6 aa, Mycobacterium
LDPEAQ

SEQ ID NO: 518416 - protein, 6 aa, Mycobacterium
LDPEAR

SEQ ID NO: 518417 - protein, 10 aa, Mycobacterium
LDPEASRPWQ

SEQ ID NO: 518418 - protein, 7 aa, Mycobacterium
LDPEATT

SEQ ID NO: 518419 - protein, 5 aa, Mycobacterium
LDPEP

SEQ ID NO: 518420 - protein, 9 aa, Mycobacterium
LDPEPEPQP

SEQ ID NO: 518421 - protein, 5 aa, Mycobacterium
LDPEQ

SEQ ID NO: 518422 - protein, 9 aa, Mycobacterium
LDPERAAGG

SEQ ID NO: 518423 - protein, 8 aa, Mycobacterium
LDPERTPL

SEQ ID NO: 518424 - protein, 6 aa, Mycobacterium
LDPESV

SEQ ID NO: 518425 - protein, 13 aa, Mycobacterium
LDPETDSDTPVGR

SEQ ID NO: 518426 - protein, 8 aa, Mycobacterium
LDPETEKL

SEQ ID NO: 518427 - protein, 4 aa, Mycobacterium
LDPG

SEQ ID NO: 518428 - protein, 16 aa, Mycobacterium
LDPGAESEVAPQTERP

SEQ ID NO: 518429 - protein, 6 aa, Mycobacterium
LDPGAP

SEQ ID NO: 518430 - protein, 7 aa, Mycobacterium
LDPGAPL

SEQ ID NO: 518431 - protein, 8 aa, Mycobacterium
LDPGATVE

SEQ ID NO: 518432 - protein, 11 aa, Mycobacterium
LDPGEAPLQAA

SEQ ID NO: 518433 - protein, 7 aa, Mycobacterium
LDPGGLD

SEQ ID NO: 518434 - protein, 12 aa, Mycobacterium
LDPGGPATSTYT

SEQ ID NO: 518435 - protein, 9 aa, Mycobacterium
LDPGGTFSG

SEQ ID NO: 518436 - protein, 9 aa, Mycobacterium
LDPGRGPQR

SEQ ID NO: 518437 - protein, 14 aa, Mycobacterium
LDPGRNPGLTREQV

SEQ ID NO: 518438 - protein, 5 aa, Mycobacterium
LDPGS

SEQ ID NO: 518439 - protein, 16 aa, Mycobacterium
LDPGSDFETDSDSRNV

SEQ ID NO: 518440 - protein, 7 aa, Mycobacterium
LDPGSEP

SEQ ID NO: 518441 - protein, 6 aa, Mycobacterium
LDPGSG

SEQ ID NO: 518442 - protein, 11 aa, Mycobacterium
LDPGSGPDGII

SEQ ID NO: 518443 - protein, 12 aa, Mycobacterium
LDPGSLSLGRAD

SEQ ID NO: 518444 - protein, 6 aa, Mycobacterium
LDPGTF

SEQ ID NO: 518445 - protein, 9 aa, Mycobacterium
LDPGTQATI

SEQ ID NO: 518446 - protein, 6 aa, Mycobacterium
LDPHGL

SEQ ID NO: 518447 - protein, 9 aa, Mycobacterium
LDPHPAPDE

SEQ ID NO: 518448 - protein, 5 aa, Mycobacterium
LDPHR

SEQ ID NO: 518449 - protein, 6 aa, Mycobacterium
LDPITT

SEQ ID NO: 518450 - protein, 9 aa, Mycobacterium
LDPKGASTV

SEQ ID NO: 518451 - protein, 9 aa, Mycobacterium
LDPKGTGQQ

SEQ ID NO: 518452 - protein, 40 aa, Mycobacterium
LDPKNADDLGDTDDRRADANADAHTDPAAPPESDSSLNSK

SEQ ID NO: 518453 - protein, 7 aa, Mycobacterium
LDPKQEQ

SEQ ID NO: 518454 - protein, 7 aa, Mycobacterium
LDPKSIA

SEQ ID NO: 518455 - protein, 4 aa, Mycobacterium
LDPL

SEQ ID NO: 518456 - protein, 6 aa, Mycobacterium
LDPLAQ

SEQ ID NO: 518457 - protein, 10 aa, Mycobacterium
LDPLATPAQG

SEQ ID NO: 518458 - protein, 7 aa, Mycobacterium
LDPLDNK

SEQ ID NO: 518459 - protein, 8 aa, Mycobacterium
LDPLGDDD

SEQ ID NO: 518460 - protein, 8 aa, Mycobacterium
LDPMDSEQ

SEQ ID NO: 518461 - protein, 5 aa, Mycobacterium
LDPNG

SEQ ID NO: 518462 - protein, 5 aa, Mycobacterium
LDPNN

SEQ ID NO: 518463 - protein, 6 aa, Mycobacterium
LDPNSS

SEQ ID NO: 518464 - protein, 18 aa, Mycobacterium
LDPNTGTVSADPDSREYR

SEQ ID NO: 518465 - protein, 12 aa, Mycobacterium
LDPPAASPEPEA

SEQ ID NO: 518466 - protein, 10 aa, Mycobacterium
LDPPADPGGL

SEQ ID NO: 518467 - protein, 13 aa, Mycobacterium
LDPPATPDDPTST

SEQ ID NO: 518468 - protein, 9 aa, Mycobacterium
LDPPDLGGL

SEQ ID NO: 518469 - protein, 7 aa, Mycobacterium
LDPPGDD

SEQ ID NO: 518470 - protein, 8 aa, Mycobacterium
LDPPGDGE

SEQ ID NO: 518471 - protein, 31 aa, Mycobacterium
LDPPGEHTDHPKDVRSTARDRTTTPSDQGAS

SEQ ID NO: 518472 - protein, 9 aa, Mycobacterium
LDPPGHTPY

SEQ ID NO: 518473 - protein, 8 aa, Mycobacterium
LDPPGPDE

SEQ ID NO: 518474 - protein, 8 aa, Mycobacterium
LDPPGPGE

SEQ ID NO: 518475 - protein, 8 aa, Mycobacterium
LDPPGSGE

SEQ ID NO: 518476 - protein, 6 aa, Mycobacterium
LDPPGV

SEQ ID NO: 518477 - protein, 7 aa, Mycobacterium
LDPPHAG

SEQ ID NO: 518478 - protein, 6 aa, Mycobacterium
LDPPKA

SEQ ID NO: 518479 - protein, 17 aa, Mycobacterium
LDPPPIPRLLETTTECS

SEQ ID NO: 518480 - protein, 23 aa, Mycobacterium
LDPPPVHPAPTADEDLQAKPAAQ

SEQ ID NO: 518481 - protein, 7 aa, Mycobacterium
LDPPQEG

SEQ ID NO: 518482 - protein, 7 aa, Mycobacterium
LDPPRAG

SEQ ID NO: 518483 - protein, 8 aa, Mycobacterium
LDPPRSGE

SEQ ID NO: 518484 - protein, 8 aa, Mycobacterium
LDPPTGRI

SEQ ID NO: 518485 - protein, 5 aa, Mycobacterium
LDPQG

SEQ ID NO: 518486 - protein, 5 aa, Mycobacterium
LDPQL

SEQ ID NO: 518487 - protein, 6 aa, Mycobacterium
LDPQPA

SEQ ID NO: 518488 - protein, 17 aa, Mycobacterium
LDPQPKHGVPINQGLQH

SEQ ID NO: 518489 - protein, 9 aa, Mycobacterium
LDPQPTVVA

SEQ ID NO: 518490 - protein, 6 aa, Mycobacterium
LDPQRL

SEQ ID NO: 518491 - protein, 8 aa, Mycobacterium
LDPQRPGH

SEQ ID NO: 518492 - protein, 6 aa, Mycobacterium
LDPQRV

SEQ ID NO: 518493 - protein, 7 aa, Mycobacterium
LDPQSVP

SEQ ID NO: 518494 - protein, 7 aa, Mycobacterium
LDPQTPQ

SEQ ID NO: 518495 - protein, 4 aa, Mycobacterium
LDPR

SEQ ID NO: 518496 - protein, 12 aa, Mycobacterium
LDPRDDAQARAV

SEQ ID NO: 518497 - protein, 12 aa, Mycobacterium
LDPREQSEVGAR

SEQ ID NO: 518498 - protein, 18 aa, Mycobacterium
LDPRFGSDSSARHRSSGA

SEQ ID NO: 518499 - protein, 14 aa, Mycobacterium
LDPRGYLNPAVLFA

SEQ ID NO: 518500 - protein, 9 aa, Mycobacterium
LDPRPAPDE

SEQ ID NO: 518501 - protein, 8 aa, Mycobacterium
LDPRPQPR

SEQ ID NO: 518502 - protein, 9 aa, Mycobacterium
LDPRPSPDE

SEQ ID NO: 518503 - protein, 6 aa, Mycobacterium
LDPRRL

SEQ ID NO: 518504 - protein, 5 aa, Mycobacterium
LDPRV

SEQ ID NO: 518505 - protein, 6 aa, Mycobacterium
LDPSAG

SEQ ID NO: 518506 - protein, 7 aa, Mycobacterium
LDPSEAV

SEQ ID NO: 518507 - protein, 9 aa, Mycobacterium
LDPSESRKA

SEQ ID NO: 518508 - protein, 5 aa, Mycobacterium
LDPSG

SEQ ID NO: 518509 - protein, 6 aa, Mycobacterium
LDPSGN

SEQ ID NO: 518510 - protein, 7 aa, Mycobacterium
LDPSPAI

SEQ ID NO: 518511 - protein, 7 aa, Mycobacterium
LDPSPGS

SEQ ID NO: 518512 - protein, 11 aa, Mycobacterium
LDPSQAPAGKD

SEQ ID NO: 518513 - protein, 6 aa, Mycobacterium
LDPSQL

SEQ ID NO: 518514 - protein, 11 aa, Mycobacterium
LDPSRNKGLPP

SEQ ID NO: 518515 - protein, 10 aa, Mycobacterium
LDPSRNPGLD

SEQ ID NO: 518516 - protein, 9 aa, Mycobacterium
LDPSSKPNH

SEQ ID NO: 518517 - protein, 6 aa, Mycobacterium
LDPSTG

SEQ ID NO: 518518 - protein, 16 aa, Mycobacterium
LDPSTQPPASPEVTKE

SEQ ID NO: 518519 - protein, 6 aa, Mycobacterium
LDPSVA

SEQ ID NO: 518520 - protein, 9 aa, Mycobacterium
LDPTATGAA

SEQ ID NO: 518521 - protein, 7 aa, Mycobacterium
LDPTEAV

SEQ ID NO: 518522 - protein, 5 aa, Mycobacterium
LDPTG

SEQ ID NO: 518523 - protein, 11 aa, Mycobacterium
LDPTPADEESL

SEQ ID NO: 518524 - protein, 8 aa, Mycobacterium
LDPTRPPH

SEQ ID NO: 518525 - protein, 6 aa, Mycobacterium
LDPTRR

SEQ ID NO: 518526 - protein, 13 aa, Mycobacterium
LDPTRTGSGPIKA

SEQ ID NO: 518527 - protein, 14 aa, Mycobacterium
LDPTSAGAARENIT

SEQ ID NO: 518528 - protein, 6 aa, Mycobacterium
LDPTTD

SEQ ID NO: 518529 - protein, 6 aa, Mycobacterium
LDPTTE

SEQ ID NO: 518530 - protein, 10 aa, Mycobacterium
LDPVETPDEY

SEQ ID NO: 518531 - protein, 11 aa, Mycobacterium
LDPVETPDEYQ

SEQ ID NO: 518532 - protein, 12 aa, Mycobacterium
LDPVSRGPHAAK

SEQ ID NO: 518533 - protein, 6 aa, Mycobacterium
LDPYTG

SEQ ID NO: 518534 - protein, 23 aa, Mycobacterium
LDQAPYAAPPVNAPGRNDRVDAR

SEQ ID NO: 518535 - protein, 5 aa, Mycobacterium
LDQDA

SEQ ID NO: 518536 - protein, 7 aa, Mycobacterium
LDQDEVD

SEQ ID NO: 518537 - protein, 5 aa, Mycobacterium
LDQDG

SEQ ID NO: 518538 - protein, 5 aa, Mycobacterium
LDQDQ

SEQ ID NO: 518539 - protein, 6 aa, Mycobacterium
LDQDSA

SEQ ID NO: 518540 - protein, 9 aa, Mycobacterium
LDQEGRDDL

SEQ ID NO: 518541 - protein, 10 aa, Mycobacterium
LDQETRDGAR

SEQ ID NO: 518542 - protein, 7 aa, Mycobacterium
LDQGTAA

SEQ ID NO: 518543 - protein, 16 aa, Mycobacterium
LDQHARTRATRQRAKE

SEQ ID NO: 518544 - protein, 15 aa, Mycobacterium
LDQPAGTLSGGEKTR

SEQ ID NO: 518545 - protein, 10 aa, Mycobacterium
LDQPDSGNIT

SEQ ID NO: 518546 - protein, 9 aa, Mycobacterium
LDQPDSGTV

SEQ ID NO: 518547 - protein, 13 aa, Mycobacterium
LDQPDSGTVTING

SEQ ID NO: 518548 - protein, 7 aa, Mycobacterium
LDQPDTA

SEQ ID NO: 518549 - protein, 7 aa, Mycobacterium
LDQPPKA

SEQ ID NO: 518550 - protein, 12 aa, Mycobacterium
LDQPPQTNEVGR

SEQ ID NO: 518551 - protein, 13 aa, Mycobacterium
LDQPPQTNEVGRS

SEQ ID NO: 518552 - protein, 12 aa, Mycobacterium
LDQPRSGKADLT

SEQ ID NO: 518553 - protein, 8 aa, Mycobacterium
LDQPSHSR

SEQ ID NO: 518554 - protein, 4 aa, Mycobacterium
LDQR

SEQ ID NO: 518555 - protein, 20 aa, Mycobacterium
LDQRAGDGLTAEQRDEAVKA

SEQ ID NO: 518556 - protein, 16 aa, Mycobacterium
LDQRPGHPQPPEPTPP

SEQ ID NO: 518557 - protein, 11 aa, Mycobacterium
LDQRSETTSFS

SEQ ID NO: 518558 - protein, 12 aa, Mycobacterium
LDQTPKFTDPER

SEQ ID NO: 518559 - protein, 20 aa, Mycobacterium
LDQTPRPRLPGVGTPWGTGS

SEQ ID NO: 518560 - protein, 6 aa, Mycobacterium
LDQTYP

SEQ ID NO: 518561 - protein, 4 aa, Mycobacterium
LDRA

SEQ ID NO: 518562 - protein, 14 aa, Mycobacterium
LDRAAAKNRLAEAP

SEQ ID NO: 518563 - protein, 6 aa, Mycobacterium
LDRAGD

SEQ ID NO: 518564 - protein, 7 aa, Mycobacterium
LDRAGYR

SEQ ID NO: 518565 - protein, 8 aa, Mycobacterium
LDRDDAEL

SEQ ID NO: 518566 - protein, 9 aa, Mycobacterium
LDRDESPFR

SEQ ID NO: 518567 - protein, 9 aa, Mycobacterium
LDRDGRGDI

SEQ ID NO: 518568 - protein, 10 aa, Mycobacterium
LDRDGRGDVI

SEQ ID NO: 518569 - protein, 12 aa, Mycobacterium
LDRDGTDTRNYG

SEQ ID NO: 518570 - protein, 5 aa, Mycobacterium
LDRDP

SEQ ID NO: 518571 - protein, 7 aa, Mycobacterium
LDRDPRT

SEQ ID NO: 518572 - protein, 9 aa, Mycobacterium
LDRDTARTR

SEQ ID NO: 518573 - protein, 15 aa, Mycobacterium
LDREPRERAHDAGAD

SEQ ID NO: 518574 - protein, 17 aa, Mycobacterium
LDREPSADPLPAAHPDD

SEQ ID NO: 518575 - protein, 5 aa, Mycobacterium
LDREQ

SEQ ID NO: 518576 - protein, 6 aa, Mycobacterium
LDREQV

SEQ ID NO: 518577 - protein, 10 aa, Mycobacterium
LDRGAAPEAL

SEQ ID NO: 518578 - protein, 10 aa, Mycobacterium
LDRGENADAA

SEQ ID NO: 518579 - protein, 7 aa, Mycobacterium
LDRGGGE

SEQ ID NO: 518580 - protein, 7 aa, Mycobacterium
LDRGGNI

SEQ ID NO: 518581 - protein, 13 aa, Mycobacterium
LDRGHADAAGRGV

SEQ ID NO: 518582 - protein, 6 aa, Mycobacterium
LDRGPT

SEQ ID NO: 518583 - protein, 7 aa, Mycobacterium
LDRGRSL

SEQ ID NO: 518584 - protein, 18 aa, Mycobacterium
LDRGVSAGKITERERDAA

SEQ ID NO: 518585 - protein, 4 aa, Mycobacterium
LDRH

SEQ ID NO: 518586 - protein, 5 aa, Mycobacterium
LDRKD

SEQ ID NO: 518587 - protein, 9 aa, Mycobacterium
LDRKPTDSE

SEQ ID NO: 518588 - protein, 20 aa, Mycobacterium
LDRNPDYNSAPADAKHQGPA

SEQ ID NO: 518589 - protein, 6 aa, Mycobacterium
LDRPAL

SEQ ID NO: 518590 - protein, 11 aa, Mycobacterium
LDRPAQGESGQ

SEQ ID NO: 518591 - protein, 5 aa, Mycobacterium
LDRPD

SEQ ID NO: 518592 - protein, 6 aa, Mycobacterium
LDRPDA

SEQ ID NO: 518593 - protein, 8 aa, Mycobacterium
LDRPDAKA

SEQ ID NO: 518594 - protein, 10 aa, Mycobacterium
LDRPDSGTVT

SEQ ID NO: 518595 - protein, 6 aa, Mycobacterium
LDRPGL

SEQ ID NO: 518596 - protein, 7 aa, Mycobacterium
LDRPNAK

SEQ ID NO: 518597 - protein, 7 aa, Mycobacterium
LDRPPGD

SEQ ID NO: 518598 - protein, 7 aa, Mycobacterium
LDRPSIG

SEQ ID NO: 518599 - protein, 5 aa, Mycobacterium
LDRPT

SEQ ID NO: 518600 - protein, 5 aa, Mycobacterium
LDRRE

SEQ ID NO: 518601 - protein, 7 aa, Mycobacterium
LDRRSDD

SEQ ID NO: 518602 - protein, 9 aa, Mycobacterium
LDRRTATIG

SEQ ID NO: 518603 - protein, 6 aa, Mycobacterium
LDRSAG

SEQ ID NO: 518604 - protein, 9 aa, Mycobacterium
LDRSAPDSV

SEQ ID NO: 518605 - protein, 9 aa, Mycobacterium
LDRSDDPTR

SEQ ID NO: 518606 - protein, 9 aa, Mycobacterium
LDRSDPGID

SEQ ID NO: 518607 - protein, 7 aa, Mycobacterium
LDRSESR

SEQ ID NO: 518608 - protein, 7 aa, Mycobacterium
LDRSGGL

SEQ ID NO: 518609 - protein, 8 aa, Mycobacterium
LDRSGVDG

SEQ ID NO: 518610 - protein, 5 aa, Mycobacterium
LDRSN

SEQ ID NO: 518611 - protein, 5 aa, Mycobacterium
LDRSP

SEQ ID NO: 518612 - protein, 6 aa, Mycobacterium
LDRSPF

SEQ ID NO: 518613 - protein, 12 aa, Mycobacterium
LDRSPSAKEATH

SEQ ID NO: 518614 - protein, 6 aa, Mycobacterium
LDRSRQ

SEQ ID NO: 518615 - protein, 7 aa, Mycobacterium
LDRSTNR

SEQ ID NO: 518616 - protein, 8 aa, Mycobacterium
LDRSTTNR

SEQ ID NO: 518617 - protein, 4 aa, Mycobacterium
LDRT

SEQ ID NO: 518618 - protein, 7 aa, Mycobacterium
LDRTDNR

SEQ ID NO: 518619 - protein, 6 aa, Mycobacterium
LDRTKS

SEQ ID NO: 518620 - protein, 14 aa, Mycobacterium
LDRTPVADFGPAEQ

SEQ ID NO: 518621 - protein, 8 aa, Mycobacterium
LDRTSREL

SEQ ID NO: 518622 - protein, 10 aa, Mycobacterium
LDRTSSGTGL

SEQ ID NO: 518623 - protein, 8 aa, Mycobacterium
LDRTSTGV

SEQ ID NO: 518624 - protein, 4 aa, Mycobacterium
LDSA

SEQ ID NO: 518625 - protein, 15 aa, Mycobacterium
LDSAGESGGLPHDRP

SEQ ID NO: 518626 - protein, 8 aa, Mycobacterium
LDSAGGDG

SEQ ID NO: 518627 - protein, 5 aa, Mycobacterium
LDSAL

SEQ ID NO: 518628 - protein, 8 aa, Mycobacterium
LDSAPKAI

SEQ ID NO: 518629 - protein, 7 aa, Mycobacterium
LDSAPPA

SEQ ID NO: 518630 - protein, 8 aa, Mycobacterium
LDSAPPEF

SEQ ID NO: 518631 - protein, 5 aa, Mycobacterium
LDSAT

SEQ ID NO: 518632 - protein, 9 aa, Mycobacterium
LDSATDDER

SEQ ID NO: 518633 - protein, 7 aa, Mycobacterium
LDSATDS

SEQ ID NO: 518634 - protein, 7 aa, Mycobacterium
LDSDDEL

SEQ ID NO: 518635 - protein, 12 aa, Mycobacterium
LDSDGSDTCAAD

SEQ ID NO: 518636 - protein, 10 aa, Mycobacterium
LDSDKKGLSE

SEQ ID NO: 518637 - protein, 9 aa, Mycobacterium
LDSDPDEAF

SEQ ID NO: 518638 - protein, 9 aa, Mycobacterium
LDSDPGANV

SEQ ID NO: 518639 - protein, 10 aa, Mycobacterium
LDSDRSAAAR

SEQ ID NO: 518640 - protein, 16 aa, Mycobacterium
LDSDSDPASLKSIVVP

SEQ ID NO: 518641 - protein, 10 aa, Mycobacterium
LDSDSEPAAL

SEQ ID NO: 518642 - protein, 6 aa, Mycobacterium
LDSEAR

SEQ ID NO: 518643 - protein, 12 aa, Mycobacterium
LDSEARRRGQRV

SEQ ID NO: 518644 - protein, 8 aa, Mycobacterium
LDSEKAGK

SEQ ID NO: 518645 - protein, 9 aa, Mycobacterium
LDSEPGASV

SEQ ID NO: 518646 - protein, 9 aa, Mycobacterium
LDSEPGLAD

SEQ ID NO: 518647 - protein, 9 aa, Mycobacterium
LDSEPGSNV

SEQ ID NO: 518648 - protein, 6 aa, Mycobacterium
LDSEQL

SEQ ID NO: 518649 - protein, 11 aa, Mycobacterium
LDSEQRDTLRN

SEQ ID NO: 518650 - protein, 5 aa, Mycobacterium
LDSET

SEQ ID NO: 518651 - protein, 8 aa, Mycobacterium
LDSETRQG

SEQ ID NO: 518652 - protein, 6 aa, Mycobacterium
LDSEVG

SEQ ID NO: 518653 - protein, 4 aa, Mycobacterium
LDSG

SEQ ID NO: 518654 - protein, 10 aa, Mycobacterium
LDSGDGHAGR

SEQ ID NO: 518655 - protein, 16 aa, Mycobacterium
LDSGDRLRREAAERAA

SEQ ID NO: 518656 - protein, 5 aa, Mycobacterium
LDSGG

SEQ ID NO: 518657 - protein, 27 aa, Mycobacterium
LDSGGADGAADADTHHEPMSTSGLSAE

SEQ ID NO: 518658 - protein, 7 aa, Mycobacterium
LDSGKPV

SEQ ID NO: 518659 - protein, 10 aa, Mycobacterium
LDSGKRDTLR

SEQ ID NO: 518660 - protein, 9 aa, Mycobacterium
LDSGKTATS

SEQ ID NO: 518661 - protein, 6 aa, Mycobacterium
LDSGPI

SEQ ID NO: 518662 - protein, 6 aa, Mycobacterium
LDSGPV

SEQ ID NO: 518663 - protein, 5 aa, Mycobacterium
LDSGR

SEQ ID NO: 518664 - protein, 19 aa, Mycobacterium
LDSGRQSGGFQGPATDTER

SEQ ID NO: 518665 - protein, 7 aa, Mycobacterium
LDSGRYR

SEQ ID NO: 518666 - protein, 13 aa, Mycobacterium
LDSGSVASPYRET

SEQ ID NO: 518667 - protein, 6 aa, Mycobacterium
LDSGTA

SEQ ID NO: 518668 - protein, 8 aa, Mycobacterium
LDSGTGAA

SEQ ID NO: 518669 - protein, 8 aa, Mycobacterium
LDSGTPVR

SEQ ID NO: 518670 - protein, 12 aa, Mycobacterium
LDSINSAKLGVA

SEQ ID NO: 518671 - protein, 7 aa, Mycobacterium
LDSKERE

SEQ ID NO: 518672 - protein, 12 aa, Mycobacterium
LDSLPENARRQV

SEQ ID NO: 518673 - protein, 5 aa, Mycobacterium
LDSNA

SEQ ID NO: 518674 - protein, 8 aa, Mycobacterium
LDSNTANQ

SEQ ID NO: 518675 - protein, 19 aa, Mycobacterium
LDSPARAGEFTALLARRLS

SEQ ID NO: 518676 - protein, 10 aa, Mycobacterium
LDSPDDANLS

SEQ ID NO: 518677 - protein, 14 aa, Mycobacterium
LDSPDDARRLPPGA

SEQ ID NO: 518678 - protein, 15 aa, Mycobacterium
LDSPDPAETYSNSPH

SEQ ID NO: 518679 - protein, 5 aa, Mycobacterium
LDSPE

SEQ ID NO: 518680 - protein, 7 aa, Mycobacterium
LDSPEEK

SEQ ID NO: 518681 - protein, 7 aa, Mycobacterium
LDSPEKE

SEQ ID NO: 518682 - protein, 7 aa, Mycobacterium
LDSPGAA

SEQ ID NO: 518683 - protein, 12 aa, Mycobacterium
LDSPGEPTQGAA

SEQ ID NO: 518684 - protein, 9 aa, Mycobacterium
LDSPGGHDR

SEQ ID NO: 518685 - protein, 8 aa, Mycobacterium
LDSPKGKQ

SEQ ID NO: 518686 - protein, 10 aa, Mycobacterium
LDSPNRASDL

SEQ ID NO: 518687 - protein, 6 aa, Mycobacterium
LDSPPD

SEQ ID NO: 518688 - protein, 18 aa, Mycobacterium
LDSPRELAPAAPARPGTA

SEQ ID NO: 518689 - protein, 11 aa, Mycobacterium
LDSPRPWSAEP

SEQ ID NO: 518690 - protein, 7 aa, Mycobacterium
LDSPRSF

SEQ ID NO: 518691 - protein, 4 aa, Mycobacterium
LDSQ

SEQ ID NO: 518692 - protein, 8 aa, Mycobacterium
LDSQGGHY

SEQ ID NO: 518693 - protein, 12 aa, Mycobacterium
LDSQPRGGRYDG

SEQ ID NO: 518694 - protein, 9 aa, Mycobacterium
LDSRGVGRA

SEQ ID NO: 518695 - protein, 24 aa, Mycobacterium
LDSRRRQARAMGGPERLDKQHGLG

SEQ ID NO: 518696 - protein, 13 aa, Mycobacterium
LDSRSAKKVTDDV

SEQ ID NO: 518697 - protein, 7 aa, Mycobacterium
LDSSEAV

SEQ ID NO: 518698 - protein, 11 aa, Mycobacterium
LDSSGPGQQIS

SEQ ID NO: 518699 - protein, 12 aa, Mycobacterium
LDSSGPRALRDG

SEQ ID NO: 518700 - protein, 10 aa, Mycobacterium
LDSSGQPDLT

SEQ ID NO: 518701 - protein, 9 aa, Mycobacterium
LDSSNSAAL

SEQ ID NO: 518702 - protein, 8 aa, Mycobacterium
LDSSPMKS

SEQ ID NO: 518703 - protein, 7 aa, Mycobacterium
LDSTAGA

SEQ ID NO: 518704 - protein, 8 aa, Mycobacterium
LDSTDGDD

SEQ ID NO: 518705 - protein, 14 aa, Mycobacterium
LDSTDGDLTGPAAE

SEQ ID NO: 518706 - protein, 7 aa, Mycobacterium
LDSTEAV

SEQ ID NO: 518707 - protein, 7 aa, Mycobacterium
LDSTPGV

SEQ ID NO: 518708 - protein, 7 aa, Mycobacterium
LDSTSRE

SEQ ID NO: 518709 - protein, 8 aa, Mycobacterium
LDSVPDGQ

SEQ ID NO: 518710 - protein, 5 aa, Mycobacterium
LDSYR

SEQ ID NO: 518711 - protein, 7 aa, Mycobacterium
LDTAAGR

SEQ ID NO: 518712 - protein, 6 aa, Mycobacterium
LDTAAN

SEQ ID NO: 518713 - protein, 20 aa, Mycobacterium
LDTAARAGDIEAGSSQDRAR

SEQ ID NO: 518714 - protein, 9 aa, Mycobacterium
LDTADATAA

SEQ ID NO: 518715 - protein, 8 aa, Mycobacterium
LDTAETGP

SEQ ID NO: 518716 - protein, 5 aa, Mycobacterium
LDTAG

SEQ ID NO: 518717 - protein, 6 aa, Mycobacterium
LDTAGA

SEQ ID NO: 518718 - protein, 10 aa, Mycobacterium
LDTAPGGVTG

SEQ ID NO: 518719 - protein, 9 aa, Mycobacterium
LDTAPSTAQ

SEQ ID NO: 518720 - protein, 11 aa, Mycobacterium
LDTARQTLSGA

SEQ ID NO: 518721 - protein, 6 aa, Mycobacterium
LDTARR

SEQ ID NO: 518722 - protein, 20 aa, Mycobacterium
LDTARRARARRASGRASRRA

SEQ ID NO: 518723 - protein, 7 aa, Mycobacterium
LDTARRT

SEQ ID NO: 518724 - protein, 5 aa, Mycobacterium
LDTAT

SEQ ID NO: 518725 - protein, 9 aa, Mycobacterium
LDTATAGDN

SEQ ID NO: 518726 - protein, 7 aa, Mycobacterium
LDTATGK

SEQ ID NO: 518727 - protein, 8 aa, Mycobacterium
LDTATSLR

SEQ ID NO: 518728 - protein, 9 aa, Mycobacterium
LDTATSTGR

SEQ ID NO: 518729 - protein, 4 aa, Mycobacterium
LDTD

SEQ ID NO: 518730 - protein, 9 aa, Mycobacterium
LDTDASTGC

SEQ ID NO: 518731 - protein, 14 aa, Mycobacterium
LDTDDADDDWEGAE

SEQ ID NO: 518732 - protein, 5 aa, Mycobacterium
LDTDE

SEQ ID NO: 518733 - protein, 11 aa, Mycobacterium
LDTDEDDRLTR

SEQ ID NO: 518734 - protein, 9 aa, Mycobacterium
LDTDGRPIE

SEQ ID NO: 518735 - protein, 10 aa, Mycobacterium
LDTDKSPASI

SEQ ID NO: 518736 - protein, 6 aa, Mycobacterium
LDTDPA

SEQ ID NO: 518737 - protein, 6 aa, Mycobacterium
LDTDPD

SEQ ID NO: 518738 - protein, 7 aa, Mycobacterium
LDTDPRL

SEQ ID NO: 518739 - protein, 8 aa, Mycobacterium
LDTDPRLS

SEQ ID NO: 518740 - protein, 8 aa, Mycobacterium
LDTDQRAT

SEQ ID NO: 518741 - protein, 10 aa, Mycobacterium
LDTDSNETLR

SEQ ID NO: 518742 - protein, 8 aa, Mycobacterium
LDTEATGL

SEQ ID NO: 518743 - protein, 8 aa, Mycobacterium
LDTEGPCD

SEQ ID NO: 518744 - protein, 9 aa, Mycobacterium
LDTEGRSQV

SEQ ID NO: 518745 - protein, 6 aa, Mycobacterium
LDTEKI

SEQ ID NO: 518746 - protein, 11 aa, Mycobacterium
LDTEKIEASYR

SEQ ID NO: 518747 - protein, 10 aa, Mycobacterium
LDTEKTPAAV

SEQ ID NO: 518748 - protein, 5 aa, Mycobacterium
LDTEP

SEQ ID NO: 518749 - protein, 5 aa, Mycobacterium
LDTER

SEQ ID NO: 518750 - protein, 6 aa, Mycobacterium
LDTERS

SEQ ID NO: 518751 - protein, 5 aa, Mycobacterium
LDTET

SEQ ID NO: 518752 - protein, 4 aa, Mycobacterium
LDTG

SEQ ID NO: 518753 - protein, 11 aa, Mycobacterium
LDTGEEGSDNR

SEQ ID NO: 518754 - protein, 6 aa, Mycobacterium
LDTGGA

SEQ ID NO: 518755 - protein, 47 aa, Mycobacterium
LDTGGAGGAGGSAGALSGTGGAGGAGGIGVGGGGGGGGVGGAGGNAG

SEQ ID NO: 518756 - protein, 8 aa, Mycobacterium
LDTGGGAC

SEQ ID NO: 518757 - protein, 9 aa, Mycobacterium
LDTGGGEVL

SEQ ID NO: 518758 - protein, 28 aa, Mycobacterium
LDTGGHAPSGGAPPQGPPNPAAGRKPRT

SEQ ID NO: 518759 - protein, 6 aa, Mycobacterium
LDTGGP

SEQ ID NO: 518760 - protein, 9 aa, Mycobacterium
LDTGRTRRG

SEQ ID NO: 518761 - protein, 8 aa, Mycobacterium
LDTGTTAL

SEQ ID NO: 518762 - protein, 4 aa, Mycobacterium
LDTH

SEQ ID NO: 518763 - protein, 10 aa, Mycobacterium
LDTKPPGAAL

SEQ ID NO: 518764 - protein, 9 aa, Mycobacterium
LDTKRHSPR

SEQ ID NO: 518765 - protein, 8 aa, Mycobacterium
LDTKRYSP

SEQ ID NO: 518766 - protein, 34 aa, Mycobacterium
LDTNREDLRATHKRAATAVASANRLSEEARTGLT

SEQ ID NO: 518767 - protein, 4 aa, Mycobacterium
LDTP

SEQ ID NO: 518768 - protein, 8 aa, Mycobacterium
LDTPAGAR

SEQ ID NO: 518769 - protein, 7 aa, Mycobacterium
LDTPASA

SEQ ID NO: 518770 - protein, 15 aa, Mycobacterium
LDTPDPAETYSNSPH

SEQ ID NO: 518771 - protein, 5 aa, Mycobacterium
LDTPG

SEQ ID NO: 518772 - protein, 10 aa, Mycobacterium
LDTPGDLPGP

SEQ ID NO: 518773 - protein, 7 aa, Mycobacterium
LDTPKAL

SEQ ID NO: 518774 - protein, 6 aa, Mycobacterium
LDTPNA

SEQ ID NO: 518775 - protein, 11 aa, Mycobacterium
LDTPSAPEVSF

SEQ ID NO: 518776 - protein, 7 aa, Mycobacterium
LDTPSEE

SEQ ID NO: 518777 - protein, 13 aa, Mycobacterium
LDTPTDPKAAEHA

SEQ ID NO: 518778 - protein, 8 aa, Mycobacterium
LDTPTTAQ

SEQ ID NO: 518779 - protein, 7 aa, Mycobacterium
LDTPTYQ

SEQ ID NO: 518780 - protein, 7 aa, Mycobacterium
LDTQSPL

SEQ ID NO: 518781 - protein, 25 aa, Mycobacterium
LDTRALPAPDYRGAAPYRAPATATE

SEQ ID NO: 518782 - protein, 12 aa, Mycobacterium
LDTRALPAPEFQ

SEQ ID NO: 518783 - protein, 24 aa, Mycobacterium
LDTRALPAPEYRDADRYRAPGDAV

SEQ ID NO: 518784 - protein, 24 aa, Mycobacterium
LDTRALPAPEYRSADRDLAPATPV

SEQ ID NO: 518785 - protein, 13 aa, Mycobacterium
LDTRALPAPEYSD

SEQ ID NO: 518786 - protein, 24 aa, Mycobacterium
LDTRALPAPEYSDADHYRAPSTAV

SEQ ID NO: 518787 - protein, 5 aa, Mycobacterium
LDTRG

SEQ ID NO: 518788 - protein, 6 aa, Mycobacterium
LDTRGV

SEQ ID NO: 518789 - protein, 5 aa, Mycobacterium
LDTRP

SEQ ID NO: 518790 - protein, 10 aa, Mycobacterium
LDTRPPGAEL

SEQ ID NO: 518791 - protein, 18 aa, Mycobacterium
LDTRPPGAELTPLGRDQA

SEQ ID NO: 518792 - protein, 19 aa, Mycobacterium
LDTRPPGAELTPLGRDQAR

SEQ ID NO: 518793 - protein, 25 aa, Mycobacterium
LDTSADAGAAAAADLATDTAPAGVG

SEQ ID NO: 518794 - protein, 11 aa, Mycobacterium
LDTSAYPPMGP

SEQ ID NO: 518795 - protein, 12 aa, Mycobacterium
LDTSGPQALRDG

SEQ ID NO: 518796 - protein, 10 aa, Mycobacterium
LDTSGQTSPY

SEQ ID NO: 518797 - protein, 21 aa, Mycobacterium
LDTSPDTTEVPDRGTEATPGY

SEQ ID NO: 518798 - protein, 33 aa, Mycobacterium
LDTSPDTTEVSDRGIEATPAHRDRDCPQPGPDN

SEQ ID NO: 518799 - protein, 13 aa, Mycobacterium
LDTSPKGDPPGSV

SEQ ID NO: 518800 - protein, 10 aa, Mycobacterium
LDTSQPTAWT

SEQ ID NO: 518801 - protein, 9 aa, Mycobacterium
LDTSRGTQH

SEQ ID NO: 518802 - protein, 17 aa, Mycobacterium
LDTSRVDRASGYLTTQQ

SEQ ID NO: 518803 - protein, 10 aa, Mycobacterium
LDTSSGDVTA

SEQ ID NO: 518804 - protein, 7 aa, Mycobacterium
LDTSSLP

SEQ ID NO: 518805 - protein, 11 aa, Mycobacterium
LDTSTADGARR

SEQ ID NO: 518806 - protein, 8 aa, Mycobacterium
LDTTAPTA

SEQ ID NO: 518807 - protein, 10 aa, Mycobacterium
LDTTDPKHPF

SEQ ID NO: 518808 - protein, 8 aa, Mycobacterium
LDTTGAGD

SEQ ID NO: 518809 - protein, 9 aa, Mycobacterium
LDTTKAAEH

SEQ ID NO: 518810 - protein, 10 aa, Mycobacterium
LDTTNRDAAR

SEQ ID NO: 518811 - protein, 5 aa, Mycobacterium
LDTTP

SEQ ID NO: 518812 - protein, 49 aa, Mycobacterium
LDTTPNPSTPAAATVTPSSSQAPAAPPPAAPTGGGGTPTGMGGGGMGGG

SEQ ID NO: 518813 - protein, 9 aa, Mycobacterium
LDTTQAAER

SEQ ID NO: 518814 - protein, 6 aa, Mycobacterium
LDTTVN

SEQ ID NO: 518815 - protein, 6 aa, Mycobacterium
LDVDAD

SEQ ID NO: 518816 - protein, 7 aa, Mycobacterium
LDVDADG

SEQ ID NO: 518817 - protein, 6 aa, Mycobacterium
LDVDTS

SEQ ID NO: 518818 - protein, 42 aa, Mycobacterium
LDVEEDSDSDDSDERSADAGSGFGRPRRRRAAGRPAGPPIHV

SEQ ID NO: 518819 - protein, 12 aa, Mycobacterium
LDVGADDEYRRE

SEQ ID NO: 518820 - protein, 13 aa, Mycobacterium
LDVGGEGAATTEV

SEQ ID NO: 518821 - protein, 12 aa, Mycobacterium
LDVGTDTGSPVV

SEQ ID NO: 518822 - protein, 6 aa, Mycobacterium
LDVPEG

SEQ ID NO: 518823 - protein, 6 aa, Mycobacterium
LDVPGA

SEQ ID NO: 518824 - protein, 12 aa, Mycobacterium
LDVPGADIDSYR

SEQ ID NO: 518825 - protein, 8 aa, Mycobacterium
LDVSGHPA

SEQ ID NO: 518826 - protein, 8 aa, Mycobacterium
LDVSGPQE

SEQ ID NO: 518827 - protein, 4 aa, Mycobacterium
LDVT

SEQ ID NO: 518828 - protein, 8 aa, Mycobacterium
LDYPAPNK

SEQ ID NO: 518829 - protein, 10 aa, Mycobacterium
LDYPEDKTEL

SEQ ID NO: 518830 - protein, 21 aa, Mycobacterium
LEAAAGKALTGGGTLLPMSDV

SEQ ID NO: 518831 - protein, 16 aa, Mycobacterium
LEAAAGRVRGQRWGPR

SEQ ID NO: 518832 - protein, 7 aa, Mycobacterium
LEAAAKS

SEQ ID NO: 518833 - protein, 13 aa, Mycobacterium
LEAAGDTGTALPA

SEQ ID NO: 518834 - protein, 12 aa, Mycobacterium
LEAAGRRGAAGR

SEQ ID NO: 518835 - protein, 7 aa, Mycobacterium
LEAAGTA

SEQ ID NO: 518836 - protein, 6 aa, Mycobacterium
LEAANN

SEQ ID NO: 518837 - protein, 7 aa, Mycobacterium
LEAATGG

SEQ ID NO: 518838 - protein, 4 aa, Mycobacterium
LEAD

SEQ ID NO: 518839 - protein, 11 aa, Mycobacterium
LEADESLPSMP

SEQ ID NO: 518840 - protein, 7 aa, Mycobacterium
LEADNRG

SEQ ID NO: 518841 - protein, 5 aa, Mycobacterium
LEADQ

SEQ ID NO: 518842 - protein, 4 aa, Mycobacterium
LEAE

SEQ ID NO: 518843 - protein, 22 aa, Mycobacterium
LEAEGAKSDVRRKVRDGGEREM

SEQ ID NO: 518844 - protein, 22 aa, Mycobacterium
LEAEGAKSDVRRKVRDSGEREM

SEQ ID NO: 518845 - protein, 13 aa, Mycobacterium
LEAEPVGPTTQAY

SEQ ID NO: 518846 - protein, 6 aa, Mycobacterium
LEAESS

SEQ ID NO: 518847 - protein, 8 aa, Mycobacterium
LEAGADDY

SEQ ID NO: 518848 - protein, 10 aa, Mycobacterium
LEAGAGNDGD

SEQ ID NO: 518849 - protein, 9 aa, Mycobacterium
LEAGESLPT

SEQ ID NO: 518850 - protein, 6 aa, Mycobacterium
LEAGGA

SEQ ID NO: 518851 - protein, 8 aa, Mycobacterium
LEAGGGRP

SEQ ID NO: 518852 - protein, 10 aa, Mycobacterium
LEAGQGAAEL

SEQ ID NO: 518853 - protein, 11 aa, Mycobacterium
LEAGQSETELN

SEQ ID NO: 518854 - protein, 12 aa, Mycobacterium
LEAGRPVGVSRL

SEQ ID NO: 518855 - protein, 12 aa, Mycobacterium
LEAGRSVTETAG

SEQ ID NO: 518856 - protein, 8 aa, Mycobacterium
LEAGSTPP

SEQ ID NO: 518857 - protein, 17 aa, Mycobacterium
LEAHGGKSLGEGPAQSW

SEQ ID NO: 518858 - protein, 13 aa, Mycobacterium
LEANKDKAIEVTS

SEQ ID NO: 518859 - protein, 6 aa, Mycobacterium
LEANSA

SEQ ID NO: 518860 - protein, 21 aa, Mycobacterium
LEAPAQAGADVSGVEGLPAGS

SEQ ID NO: 518861 - protein, 5 aa, Mycobacterium
LEAPD

SEQ ID NO: 518862 - protein, 11 aa, Mycobacterium
LEAPDSPARAR

SEQ ID NO: 518863 - protein, 11 aa, Mycobacterium
LEAPEDADLGT

SEQ ID NO: 518864 - protein, 7 aa, Mycobacterium
LEAPGSD

SEQ ID NO: 518865 - protein, 8 aa, Mycobacterium
LEAPKGSI

SEQ ID NO: 518866 - protein, 10 aa, Mycobacterium
LEAPKPDITS

SEQ ID NO: 518867 - protein, 15 aa, Mycobacterium
LEAPPPGVHGAPNNP

SEQ ID NO: 518868 - protein, 8 aa, Mycobacterium
LEAPSRDD

SEQ ID NO: 518869 - protein, 10 aa, Mycobacterium
LEAPTTDRDT

SEQ ID NO: 518870 - protein, 7 aa, Mycobacterium
LEAQAGG

SEQ ID NO: 518871 - protein, 9 aa, Mycobacterium
LEAQKPDPL

SEQ ID NO: 518872 - protein, 5 aa, Mycobacterium
LEARG

SEQ ID NO: 518873 - protein, 6 aa, Mycobacterium
LEARGK

SEQ ID NO: 518874 - protein, 8 aa, Mycobacterium
LEARGKKA

SEQ ID NO: 518875 - protein, 6 aa, Mycobacterium
LEASDA

SEQ ID NO: 518876 - protein, 10 aa, Mycobacterium
LEASERAEVA

SEQ ID NO: 518877 - protein, 10 aa, Mycobacterium
LEASGRPDSD

SEQ ID NO: 518878 - protein, 18 aa, Mycobacterium
LEASSASGAVGATQPSTL

SEQ ID NO: 518879 - protein, 11 aa, Mycobacterium
LEASSDPQDLA

SEQ ID NO: 518880 - protein, 6 aa, Mycobacterium
LEASSG

SEQ ID NO: 518881 - protein, 9 aa, Mycobacterium
LEASSGERR

SEQ ID NO: 518882 - protein, 9 aa, Mycobacterium
LEASSGPLA

SEQ ID NO: 518883 - protein, 9 aa, Mycobacterium
LEASSGRRR

SEQ ID NO: 518884 - protein, 10 aa, Mycobacterium
LEASTQEPTY

SEQ ID NO: 518885 - protein, 6 aa, Mycobacterium
LEASTV

SEQ ID NO: 518886 - protein, 14 aa, Mycobacterium
LEATARYTAPPTAP

SEQ ID NO: 518887 - protein, 8 aa, Mycobacterium
LEATDRTD

SEQ ID NO: 518888 - protein, 5 aa, Mycobacterium
LEATE

SEQ ID NO: 518889 - protein, 5 aa, Mycobacterium
LEATR

SEQ ID NO: 518890 - protein, 7 aa, Mycobacterium
LEATTTE

SEQ ID NO: 518891 - protein, 11 aa, Mycobacterium
LEDAAASQSAW

SEQ ID NO: 518892 - protein, 30 aa, Mycobacterium
LEDAGDLAEGDAARLTGSGGQRVTATDEPA

SEQ ID NO: 518893 - protein, 10 aa, Mycobacterium
LEDAGEPNRP

SEQ ID NO: 518894 - protein, 15 aa, Mycobacterium
LEDAGGWPARDTAQR

SEQ ID NO: 518895 - protein, 9 aa, Mycobacterium
LEDAGLSGD

SEQ ID NO: 518896 - protein, 6 aa, Mycobacterium
LEDAGS

SEQ ID NO: 518897 - protein, 10 aa, Mycobacterium
LEDANGLSAG

SEQ ID NO: 518898 - protein, 22 aa, Mycobacterium
LEDAPQAWREQQSGPHVKIAVA

SEQ ID NO: 518899 - protein, 9 aa, Mycobacterium
LEDAQQRDG

SEQ ID NO: 518900 - protein, 22 aa, Mycobacterium
LEDAQRGELGLPKTTSSSPRRI

SEQ ID NO: 518901 - protein, 8 aa, Mycobacterium
LEDDDTAA

SEQ ID NO: 518902 - protein, 7 aa, Mycobacterium
LEDDGPD

SEQ ID NO: 518903 - protein, 8 aa, Mycobacterium
LEDDPAHP

SEQ ID NO: 518904 - protein, 7 aa, Mycobacterium
LEDDPSH

SEQ ID NO: 518905 - protein, 10 aa, Mycobacterium
LEDDPSNPKH

SEQ ID NO: 518906 - protein, 6 aa, Mycobacterium
LEDDRT

SEQ ID NO: 518907 - protein, 16 aa, Mycobacterium
LEDDSVTVRDRDEMTQ

SEQ ID NO: 518908 - protein, 59 aa, Mycobacterium
LEDEDEAASDEAEGDDDSDEGDDAEDGDGAKAPAAAAPGTPSDEEEIAEPSEKDKASGD

SEQ ID NO: 518909 - protein, 7 aa, Mycobacterium
LEDEGPD

SEQ ID NO: 518910 - protein, 17 aa, Mycobacterium
LEDGDELADKAIEQEQM

SEQ ID NO: 518911 - protein, 17 aa, Mycobacterium
LEDGEGYAVSTKQTGRL

SEQ ID NO: 518912 - protein, 6 aa, Mycobacterium
LEDGEL

SEQ ID NO: 518913 - protein, 6 aa, Mycobacterium
LEDGEP

SEQ ID NO: 518914 - protein, 8 aa, Mycobacterium
LEDGGMNR

SEQ ID NO: 518915 - protein, 10 aa, Mycobacterium
LEDGHRSPVG

SEQ ID NO: 518916 - protein, 11 aa, Mycobacterium
LEDGPSARSAW

SEQ ID NO: 518917 - protein, 6 aa, Mycobacterium
LEDGRD

SEQ ID NO: 518918 - protein, 9 aa, Mycobacterium
LEDGSGSKF

SEQ ID NO: 518919 - protein, 14 aa, Mycobacterium
LEDGSHVAADTDAM

SEQ ID NO: 518920 - protein, 6 aa, Mycobacterium
LEDGST

SEQ ID NO: 518921 - protein, 14 aa, Mycobacterium
LEDGTDTARARRGE

SEQ ID NO: 518922 - protein, 6 aa, Mycobacterium
LEDGTQ

SEQ ID NO: 518923 - protein, 6 aa, Mycobacterium
LEDGTR

SEQ ID NO: 518924 - protein, 6 aa, Mycobacterium
LEDGTT

SEQ ID NO: 518925 - protein, 8 aa, Mycobacterium
LEDKARRR

SEQ ID NO: 518926 - protein, 7 aa, Mycobacterium
LEDNEPG

SEQ ID NO: 518927 - protein, 26 aa, Mycobacterium
LEDNGGPVAPAETTRPAPVVSENRSG

SEQ ID NO: 518928 - protein, 7 aa, Mycobacterium
LEDNGRL

SEQ ID NO: 518929 - protein, 18 aa, Mycobacterium
LEDPATGEPLATNDDDGV

SEQ ID NO: 518930 - protein, 8 aa, Mycobacterium
LEDPDTGL

SEQ ID NO: 518931 - protein, 6 aa, Mycobacterium
LEDPEF

SEQ ID NO: 518932 - protein, 5 aa, Mycobacterium
LEDPG

SEQ ID NO: 518933 - protein, 14 aa, Mycobacterium
LEDPNLDPTSRSQL

SEQ ID NO: 518934 - protein, 5 aa, Mycobacterium
LEDPP

SEQ ID NO: 518935 - protein, 7 aa, Mycobacterium
LEDPPEN

SEQ ID NO: 518936 - protein, 7 aa, Mycobacterium
LEDPQAE

SEQ ID NO: 518937 - protein, 18 aa, Mycobacterium
LEDPRAYAGAALSLLVDS

SEQ ID NO: 518938 - protein, 4 aa, Mycobacterium
LEDR

SEQ ID NO: 518939 - protein, 8 aa, Mycobacterium
LEDRAGSI

SEQ ID NO: 518940 - protein, 8 aa, Mycobacterium
LEDRARDI

SEQ ID NO: 518941 - protein, 7 aa, Mycobacterium
LEDRNDD

SEQ ID NO: 518942 - protein, 10 aa, Mycobacterium
LEDRNDDAAV

SEQ ID NO: 518943 - protein, 10 aa, Mycobacterium
LEDRPKDTDR

SEQ ID NO: 518944 - protein, 11 aa, Mycobacterium
LEDRRQPTTTL

SEQ ID NO: 518945 - protein, 14 aa, Mycobacterium
LEDRSARGKVVVAV

SEQ ID NO: 518946 - protein, 12 aa, Mycobacterium
LEDRTDEAAHDE

SEQ ID NO: 518947 - protein, 6 aa, Mycobacterium
LEDSGA

SEQ ID NO: 518948 - protein, 6 aa, Mycobacterium
LEDSGS

SEQ ID NO: 518949 - protein, 6 aa, Mycobacterium
LEDSGT

SEQ ID NO: 518950 - protein, 6 aa, Mycobacterium
LEDSQP

SEQ ID NO: 518951 - protein, 6 aa, Mycobacterium
LEDSSD

SEQ ID NO: 518952 - protein, 9 aa, Mycobacterium
LEDSTVASA

SEQ ID NO: 518953 - protein, 4 aa, Mycobacterium
LEDT

SEQ ID NO: 518954 - protein, 7 aa, Mycobacterium
LEDTELD

SEQ ID NO: 518955 - protein, 7 aa, Mycobacterium
LEDTELG

SEQ ID NO: 518956 - protein, 5 aa, Mycobacterium
LEDTG

SEQ ID NO: 518957 - protein, 6 aa, Mycobacterium
LEDTNR

SEQ ID NO: 518958 - protein, 4 aa, Mycobacterium
LEEA

SEQ ID NO: 518959 - protein, 32 aa, Mycobacterium
LEEADRTSSNDLRKASASVDAEHNSASTQPAA

SEQ ID NO: 518960 - protein, 9 aa, Mycobacterium
LEEARANED

SEQ ID NO: 518961 - protein, 10 aa, Mycobacterium
LEEAREKGDH

SEQ ID NO: 518962 - protein, 8 aa, Mycobacterium
LEEARRGL

SEQ ID NO: 518963 - protein, 10 aa, Mycobacterium
LEEASLRRPT

SEQ ID NO: 518964 - protein, 8 aa, Mycobacterium
LEEASNAK

SEQ ID NO: 518965 - protein, 8 aa, Mycobacterium
LEEASQAV

SEQ ID NO: 518966 - protein, 6 aa, Mycobacterium
LEEDEV

SEQ ID NO: 518967 - protein, 13 aa, Mycobacterium
LEEDKKAPDAPGW

SEQ ID NO: 518968 - protein, 4 aa, Mycobacterium
LEEE

SEQ ID NO: 518969 - protein, 4 aa, Mycobacterium
LEEG

SEQ ID NO: 518970 - protein, 11 aa, Mycobacterium
LEEGEPHGLPG

SEQ ID NO: 518971 - protein, 9 aa, Mycobacterium
LEEGPDGRE

SEQ ID NO: 518972 - protein, 7 aa, Mycobacterium
LEEHAGP

SEQ ID NO: 518973 - protein, 14 aa, Mycobacterium
LEENPEDPGAGPVD

SEQ ID NO: 518974 - protein, 7 aa, Mycobacterium
LEENPPD

SEQ ID NO: 518975 - protein, 5 aa, Mycobacterium
LEENQ

SEQ ID NO: 518976 - protein, 4 aa, Mycobacterium
LEEP

SEQ ID NO: 518977 - protein, 12 aa, Mycobacterium
LEEPADPAPGRT

SEQ ID NO: 518978 - protein, 5 aa, Mycobacterium
LEEPD

SEQ ID NO: 518979 - protein, 13 aa, Mycobacterium
LEEQGVADSVTAD

SEQ ID NO: 518980 - protein, 9 aa, Mycobacterium
LEEQPDGTT

SEQ ID NO: 518981 - protein, 6 aa, Mycobacterium
LEEQPT

SEQ ID NO: 518982 - protein, 7 aa, Mycobacterium
LEERARR

SEQ ID NO: 518983 - protein, 8 aa, Mycobacterium
LEERGDAE

SEQ ID NO: 518984 - protein, 9 aa, Mycobacterium
LEERGDAEV

SEQ ID NO: 518985 - protein, 12 aa, Mycobacterium
LEERGDAEVDTT

SEQ ID NO: 518986 - protein, 8 aa, Mycobacterium
LEERTRTS

SEQ ID NO: 518987 - protein, 9 aa, Mycobacterium
LEESRSGKL

SEQ ID NO: 518988 - protein, 12 aa, Mycobacterium
LEESSTAPAPGD

SEQ ID NO: 518989 - protein, 6 aa, Mycobacterium
LEETAL

SEQ ID NO: 518990 - protein, 6 aa, Mycobacterium
LEETRT

SEQ ID NO: 518991 - protein, 9 aa, Mycobacterium
LEGAGTPFK

SEQ ID NO: 518992 - protein, 6 aa, Mycobacterium
LEGAHR

SEQ ID NO: 518993 - protein, 6 aa, Mycobacterium
LEGAPE

SEQ ID NO: 518994 - protein, 9 aa, Mycobacterium
LEGAQGPKV

SEQ ID NO: 518995 - protein, 10 aa, Mycobacterium
LEGASAKRVT

SEQ ID NO: 518996 - protein, 12 aa, Mycobacterium
LEGATDEDRERV

SEQ ID NO: 518997 - protein, 12 aa, Mycobacterium
LEGATDEDRQRV

SEQ ID NO: 518998 - protein, 8 aa, Mycobacterium
LEGATPTW

SEQ ID NO: 518999 - protein, 23 aa, Mycobacterium
LEGCPSGGYKHPQRKFTVCTEVQ

SEQ ID NO: 519000 - protein, 4 aa, Mycobacterium
LEGD

SEQ ID NO: 519001 - protein, 9 aa, Mycobacterium
LEGDAEWGK

SEQ ID NO: 519002 - protein, 5 aa, Mycobacterium
LEGDD

SEQ ID NO: 519003 - protein, 7 aa, Mycobacterium
LEGDGIS

SEQ ID NO: 519004 - protein, 9 aa, Mycobacterium
LEGDGPEAL

SEQ ID NO: 519005 - protein, 11 aa, Mycobacterium
LEGDNQKQADY

SEQ ID NO: 519006 - protein, 6 aa, Mycobacterium
LEGDPK

SEQ ID NO: 519007 - protein, 10 aa, Mycobacterium
LEGDSASYDG

SEQ ID NO: 519008 - protein, 8 aa, Mycobacterium
LEGDTGAS

SEQ ID NO: 519009 - protein, 10 aa, Mycobacterium
LEGDTGASAF

SEQ ID NO: 519010 - protein, 10 aa, Mycobacterium
LEGDTGASGL

SEQ ID NO: 519011 - protein, 13 aa, Mycobacterium
LEGDTGASGVARQ

SEQ ID NO: 519012 - protein, 5 aa, Mycobacterium
LEGED

SEQ ID NO: 519013 - protein, 6 aa, Mycobacterium
LEGEGV

SEQ ID NO: 519014 - protein, 9 aa, Mycobacterium
LEGEPGAEE

SEQ ID NO: 519015 - protein, 6 aa, Mycobacterium
LEGESE

SEQ ID NO: 519016 - protein, 31 aa, Mycobacterium
LEGETPAAAATPEARDAQVSAAASAHGYAPD

SEQ ID NO: 519017 - protein, 5 aa, Mycobacterium
LEGGA

SEQ ID NO: 519018 - protein, 7 aa, Mycobacterium
LEGGAGP

SEQ ID NO: 519019 - protein, 6 aa, Mycobacterium
LEGGAT

SEQ ID NO: 519020 - protein, 21 aa, Mycobacterium
LEGGEAFTKEEAPTELDATDV

SEQ ID NO: 519021 - protein, 22 aa, Mycobacterium
LEGGEAFTTEEQPKELDETEDV

SEQ ID NO: 519022 - protein, 7 aa, Mycobacterium
LEGGEGT

SEQ ID NO: 519023 - protein, 6 aa, Mycobacterium
LEGGGG

SEQ ID NO: 519024 - protein, 9 aa, Mycobacterium
LEGGPRPTH

SEQ ID NO: 519025 - protein, 11 aa, Mycobacterium
LEGGRRGGPAN

SEQ ID NO: 519026 - protein, 9 aa, Mycobacterium
LEGGSRARG

SEQ ID NO: 519027 - protein, 9 aa, Mycobacterium
LEGGSRPTH

SEQ ID NO: 519028 - protein, 4 aa, Mycobacterium
LEGK

SEQ ID NO: 519029 - protein, 5 aa, Mycobacterium
LEGKA

SEQ ID NO: 519030 - protein, 10 aa, Mycobacterium
LEGKSAGEYM

SEQ ID NO: 519031 - protein, 4 aa, Mycobacterium
LEGP

SEQ ID NO: 519032 - protein, 8 aa, Mycobacterium
LEGPDREI

SEQ ID NO: 519033 - protein, 13 aa, Mycobacterium
LEGPGKSTLAQHI

SEQ ID NO: 519034 - protein, 5 aa, Mycobacterium
LEGPR

SEQ ID NO: 519035 - protein, 11 aa, Mycobacterium
LEGPSYTRPPT

SEQ ID NO: 519036 - protein, 7 aa, Mycobacterium
LEGPTTF

SEQ ID NO: 519037 - protein, 5 aa, Mycobacterium
LEGPV

SEQ ID NO: 519038 - protein, 9 aa, Mycobacterium
LEGQDNGMN

SEQ ID NO: 519039 - protein, 20 aa, Mycobacterium
LEGRDGPLGSPGGAAKIGPL

SEQ ID NO: 519040 - protein, 7 aa, Mycobacterium
LEGREAV

SEQ ID NO: 519041 - protein, 7 aa, Mycobacterium
LEGRPYA

SEQ ID NO: 519042 - protein, 25 aa, Mycobacterium
LEGRSRRPLPSGLGTPSSAPTDQIT

SEQ ID NO: 519043 - protein, 10 aa, Mycobacterium
LEGRTVQERG

SEQ ID NO: 519044 - protein, 5 aa, Mycobacterium
LEGSD

SEQ ID NO: 519045 - protein, 6 aa, Mycobacterium
LEGSHA

SEQ ID NO: 519046 - protein, 4 aa, Mycobacterium
LEGT

SEQ ID NO: 519047 - protein, 6 aa, Mycobacterium
LEGTAG

SEQ ID NO: 519048 - protein, 6 aa, Mycobacterium
LEGTEK

SEQ ID NO: 519049 - protein, 5 aa, Mycobacterium
LEGTG

SEQ ID NO: 519050 - protein, 6 aa, Mycobacterium
LEGTGG

SEQ ID NO: 519051 - protein, 9 aa, Mycobacterium
LEGTGPLRP

SEQ ID NO: 519052 - protein, 8 aa, Mycobacterium
LEGTSGPV

SEQ ID NO: 519053 - protein, 16 aa, Mycobacterium
LEGVSAAEGSARAGLS

SEQ ID NO: 519054 - protein, 9 aa, Mycobacterium
LEHPDGAET

SEQ ID NO: 519055 - protein, 10 aa, Mycobacterium
LEHPTRADAE

SEQ ID NO: 519056 - protein, 6 aa, Mycobacterium
LEHPTT

SEQ ID NO: 519057 - protein, 9 aa, Mycobacterium
LEHSDTYPQ

SEQ ID NO: 519058 - protein, 5 aa, Mycobacterium
LEHSS

SEQ ID NO: 519059 - protein, 9 aa, Mycobacterium
LEHTDRAQP

SEQ ID NO: 519060 - protein, 13 aa, Mycobacterium
LEKDALREVAKGK

SEQ ID NO: 519061 - protein, 13 aa, Mycobacterium
LEKDALREVARGK

SEQ ID NO: 519062 - protein, 11 aa, Mycobacterium
LEKDGRGARTV

SEQ ID NO: 519063 - protein, 13 aa, Mycobacterium
LEKGAGVAVTGGG

SEQ ID NO: 519064 - protein, 9 aa, Mycobacterium
LEKGEPPRV

SEQ ID NO: 519065 - protein, 8 aa, Mycobacterium
LEKGETDG

SEQ ID NO: 519066 - protein, 7 aa, Mycobacterium
LEKGETL

SEQ ID NO: 519067 - protein, 6 aa, Mycobacterium
LEKGTD

SEQ ID NO: 519068 - protein, 7 aa, Mycobacterium
LEKGTRA

SEQ ID NO: 519069 - protein, 10 aa, Mycobacterium
LEKKTASGEI

SEQ ID NO: 519070 - protein, 5 aa, Mycobacterium
LEKMG

SEQ ID NO: 519071 - protein, 8 aa, Mycobacterium
LEKPANQI

SEQ ID NO: 519072 - protein, 11 aa, Mycobacterium
LEKPSPREQAD

SEQ ID NO: 519073 - protein, 4 aa, Mycobacterium
LEKQ

SEQ ID NO: 519074 - protein, 9 aa, Mycobacterium
LEKRPQPKP

SEQ ID NO: 519075 - protein, 17 aa, Mycobacterium
LEKRQKSRQTRASRDAL

SEQ ID NO: 519076 - protein, 6 aa, Mycobacterium
LEKTDY

SEQ ID NO: 519077 - protein, 16 aa, Mycobacterium
LELNGNSTRLMWADGV

SEQ ID NO: 519078 - protein, 15 aa, Mycobacterium
LELPGAASTYSSRAA

SEQ ID NO: 519079 - protein, 8 aa, Mycobacterium
LELPGSSH

SEQ ID NO: 519080 - protein, 11 aa, Mycobacterium
LELSSTKPTTI

SEQ ID NO: 519081 - protein, 8 aa, Mycobacterium
LELTPAGA

SEQ ID NO: 519082 - protein, 7 aa, Mycobacterium
LENAGTE

SEQ ID NO: 519083 - protein, 9 aa, Mycobacterium
LENARPQIR

SEQ ID NO: 519084 - protein, 4 aa, Mycobacterium
LEND

SEQ ID NO: 519085 - protein, 7 aa, Mycobacterium
LENEDAA

SEQ ID NO: 519086 - protein, 8 aa, Mycobacterium
LENGDDEI

SEQ ID NO: 519087 - protein, 8 aa, Mycobacterium
LENGGNDA

SEQ ID NO: 519088 - protein, 10 aa, Mycobacterium
LENGKVGAEL

SEQ ID NO: 519089 - protein, 9 aa, Mycobacterium
LENGSPVRG

SEQ ID NO: 519090 - protein, 9 aa, Mycobacterium
LENHNGDAA

SEQ ID NO: 519091 - protein, 7 aa, Mycobacterium
LENKTDN

SEQ ID NO: 519092 - protein, 6 aa, Mycobacterium
LENPGL

SEQ ID NO: 519093 - protein, 9 aa, Mycobacterium
LENPGPDDF

SEQ ID NO: 519094 - protein, 10 aa, Mycobacterium
LENPGPDDFA

SEQ ID NO: 519095 - protein, 9 aa, Mycobacterium
LENPGPDDL

SEQ ID NO: 519096 - protein, 8 aa, Mycobacterium
LENPTSEQ

SEQ ID NO: 519097 - protein, 5 aa, Mycobacterium
LENQG

SEQ ID NO: 519098 - protein, 7 aa, Mycobacterium
LENRGSP

SEQ ID NO: 519099 - protein, 10 aa, Mycobacterium
LENRNDDEAV

SEQ ID NO: 519100 - protein, 14 aa, Mycobacterium
LENRSAKGKVVLKL

SEQ ID NO: 519101 - protein, 10 aa, Mycobacterium
LENRSDDDAV

SEQ ID NO: 519102 - protein, 15 aa, Mycobacterium
LENRTARGKVVLRVR

SEQ ID NO: 519103 - protein, 15 aa, Mycobacterium
LENRTARGKVVVRVR

SEQ ID NO: 519104 - protein, 8 aa, Mycobacterium
LENSEDRA

SEQ ID NO: 519105 - protein, 7 aa, Mycobacterium
LENTGTE

SEQ ID NO: 519106 - protein, 22 aa, Mycobacterium
LENTQQTQPYPDGYSDGTTAHH

SEQ ID NO: 519107 - protein, 6 aa, Mycobacterium
LENVTR

SEQ ID NO: 519108 - protein, 7 aa, Mycobacterium
LEPAADR

SEQ ID NO: 519109 - protein, 5 aa, Mycobacterium
LEPAD

SEQ ID NO: 519110 - protein, 6 aa, Mycobacterium
LEPADA

SEQ ID NO: 519111 - protein, 13 aa, Mycobacterium
LEPAEPEPEQMKI

SEQ ID NO: 519112 - protein, 13 aa, Mycobacterium
LEPAGGESSPTLP

SEQ ID NO: 519113 - protein, 7 aa, Mycobacterium
LEPAGPG

SEQ ID NO: 519114 - protein, 13 aa, Mycobacterium
LEPAGSGPENDRR

SEQ ID NO: 519115 - protein, 11 aa, Mycobacterium
LEPANRLTPGT

SEQ ID NO: 519116 - protein, 8 aa, Mycobacterium
LEPAQREA

SEQ ID NO: 519117 - protein, 6 aa, Mycobacterium
LEPARA

SEQ ID NO: 519118 - protein, 6 aa, Mycobacterium
LEPATG

SEQ ID NO: 519119 - protein, 10 aa, Mycobacterium
LEPATGAPGL

SEQ ID NO: 519120 - protein, 19 aa, Mycobacterium
LEPATLPEPPSDNLNEAGR

SEQ ID NO: 519121 - protein, 8 aa, Mycobacterium
LEPDADDA

SEQ ID NO: 519122 - protein, 5 aa, Mycobacterium
LEPDD

SEQ ID NO: 519123 - protein, 5 aa, Mycobacterium
LEPDE

SEQ ID NO: 519124 - protein, 10 aa, Mycobacterium
LEPDEAVRAG

SEQ ID NO: 519125 - protein, 7 aa, Mycobacterium
LEPDEVE

SEQ ID NO: 519126 - protein, 10 aa, Mycobacterium
LEPDPAAMAE

SEQ ID NO: 519127 - protein, 9 aa, Mycobacterium
LEPDQAADA

SEQ ID NO: 519128 - protein, 13 aa, Mycobacterium
LEPDSGRVKRGKT

SEQ ID NO: 519129 - protein, 10 aa, Mycobacterium
LEPDSKSSKS

SEQ ID NO: 519130 - protein, 10 aa, Mycobacterium
LEPDVSYSSR

SEQ ID NO: 519131 - protein, 4 aa, Mycobacterium
LEPE

SEQ ID NO: 519132 - protein, 11 aa, Mycobacterium
LEPEDSAGTLV

SEQ ID NO: 519133 - protein, 10 aa, Mycobacterium
LEPEDSPARV

SEQ ID NO: 519134 - protein, 6 aa, Mycobacterium
LEPEEA

SEQ ID NO: 519135 - protein, 7 aa, Mycobacterium
LEPEKAS

SEQ ID NO: 519136 - protein, 6 aa, Mycobacterium
LEPEKE

SEQ ID NO: 519137 - protein, 19 aa, Mycobacterium
LEPESRLRPQAEDAAAGAA

SEQ ID NO: 519138 - protein, 15 aa, Mycobacterium
LEPGAAACESAGTPV

SEQ ID NO: 519139 - protein, 11 aa, Mycobacterium
LEPGARLPSER

SEQ ID NO: 519140 - protein, 8 aa, Mycobacterium
LEPGAYSR

SEQ ID NO: 519141 - protein, 20 aa, Mycobacterium
LEPGDRAGPEQRVRANASRW

SEQ ID NO: 519142 - protein, 8 aa, Mycobacterium
LEPGESKA

SEQ ID NO: 519143 - protein, 16 aa, Mycobacterium
LEPGGRPDAPEPGPAM

SEQ ID NO: 519144 - protein, 16 aa, Mycobacterium
LEPGGRPDTPEPGPSM

SEQ ID NO: 519145 - protein, 6 aa, Mycobacterium
LEPGGY

SEQ ID NO: 519146 - protein, 6 aa, Mycobacterium
LEPGIG

SEQ ID NO: 519147 - protein, 7 aa, Mycobacterium
LEPGPEL

SEQ ID NO: 519148 - protein, 8 aa, Mycobacterium
LEPGPGVG

SEQ ID NO: 519149 - protein, 8 aa, Mycobacterium
LEPGPPKP

SEQ ID NO: 519150 - protein, 10 aa, Mycobacterium
LEPGPTASGL

SEQ ID NO: 519151 - protein, 15 aa, Mycobacterium
LEPGQPLDPQERTAV

SEQ ID NO: 519152 - protein, 9 aa, Mycobacterium
LEPGRDPIS

SEQ ID NO: 519153 - protein, 10 aa, Mycobacterium
LEPGRDPVSD

SEQ ID NO: 519154 - protein, 5 aa, Mycobacterium
LEPGT

SEQ ID NO: 519155 - protein, 8 aa, Mycobacterium
LEPGTPDG

SEQ ID NO: 519156 - protein, 10 aa, Mycobacterium
LEPGTPTPEA

SEQ ID NO: 519157 - protein, 6 aa, Mycobacterium
LEPGTS

SEQ ID NO: 519158 - protein, 4 aa, Mycobacterium
LEPK

SEQ ID NO: 519159 - protein, 10 aa, Mycobacterium
LEPKGDKTVV

SEQ ID NO: 519160 - protein, 26 aa, Mycobacterium
LEPKPEPEPKPDPRRSIRTNPGDGYT

SEQ ID NO: 519161 - protein, 4 aa, Mycobacterium
LEPL

SEQ ID NO: 519162 - protein, 29 aa, Mycobacterium
LEPLKSQTLSDAEEKRRQNLGKNGPRDVT

SEQ ID NO: 519163 - protein, 12 aa, Mycobacterium
LEPLRTDESPFA

SEQ ID NO: 519164 - protein, 5 aa, Mycobacterium
LEPLS

SEQ ID NO: 519165 - protein, 5 aa, Mycobacterium
LEPMP

SEQ ID NO: 519166 - protein, 9 aa, Mycobacterium
LEPNGPTEK

SEQ ID NO: 519167 - protein, 5 aa, Mycobacterium
LEPNL

SEQ ID NO: 519168 - protein, 6 aa, Mycobacterium
LEPNSP

SEQ ID NO: 519169 - protein, 15 aa, Mycobacterium
LEPPATANPGILPAG

SEQ ID NO: 519170 - protein, 7 aa, Mycobacterium
LEPPEDA

SEQ ID NO: 519171 - protein, 10 aa, Mycobacterium
LEPPEDPDVE

SEQ ID NO: 519172 - protein, 10 aa, Mycobacterium
LEPPLPPVPD

SEQ ID NO: 519173 - protein, 5 aa, Mycobacterium
LEPPR

SEQ ID NO: 519174 - protein, 7 aa, Mycobacterium
LEPPRDP

SEQ ID NO: 519175 - protein, 7 aa, Mycobacterium
LEPPREP

SEQ ID NO: 519176 - protein, 10 aa, Mycobacterium
LEPPVSPDDD

SEQ ID NO: 519177 - protein, 4 aa, Mycobacterium
LEPQ

SEQ ID NO: 519178 - protein, 6 aa, Mycobacterium
LEPQAA

SEQ ID NO: 519179 - protein, 5 aa, Mycobacterium
LEPQR

SEQ ID NO: 519180 - protein, 4 aa, Mycobacterium
LEPR

SEQ ID NO: 519181 - protein, 8 aa, Mycobacterium
LEPRAQQL

SEQ ID NO: 519182 - protein, 9 aa, Mycobacterium
LEPREPEVP

SEQ ID NO: 519183 - protein, 11 aa, Mycobacterium
LEPRLDEPGVA

SEQ ID NO: 519184 - protein, 10 aa, Mycobacterium
LEPRNNAGGA

SEQ ID NO: 519185 - protein, 24 aa, Mycobacterium
LEPRPEPDLRPQPQPSITKTSDEQ

SEQ ID NO: 519186 - protein, 6 aa, Mycobacterium
LEPRPP

SEQ ID NO: 519187 - protein, 16 aa, Mycobacterium
LEPRPSVHRGDSVEQA

SEQ ID NO: 519188 - protein, 7 aa, Mycobacterium
LEPRRPW

SEQ ID NO: 519189 - protein, 7 aa, Mycobacterium
LEPSALP

SEQ ID NO: 519190 - protein, 10 aa, Mycobacterium
LEPSALPPGE

SEQ ID NO: 519191 - protein, 8 aa, Mycobacterium
LEPSATQT

SEQ ID NO: 519192 - protein, 12 aa, Mycobacterium
LEPSDATDANGG

SEQ ID NO: 519193 - protein, 16 aa, Mycobacterium
LEPSDEPRGAPSSRKA

SEQ ID NO: 519194 - protein, 10 aa, Mycobacterium
LEPSDKSQVR

SEQ ID NO: 519195 - protein, 6 aa, Mycobacterium
LEPSDR

SEQ ID NO: 519196 - protein, 5 aa, Mycobacterium
LEPSE

SEQ ID NO: 519197 - protein, 9 aa, Mycobacterium
LEPSGAGAR

SEQ ID NO: 519198 - protein, 15 aa, Mycobacterium
LEPSGGGGRDGRQGM

SEQ ID NO: 519199 - protein, 7 aa, Mycobacterium
LEPSGYT

SEQ ID NO: 519200 - protein, 10 aa, Mycobacterium
LEPSIRQRDP

SEQ ID NO: 519201 - protein, 9 aa, Mycobacterium
LEPSKGTAA

SEQ ID NO: 519202 - protein, 18 aa, Mycobacterium
LEPSSAPRGVASSRTSVG

SEQ ID NO: 519203 - protein, 8 aa, Mycobacterium
LEPSSLRD

SEQ ID NO: 519204 - protein, 13 aa, Mycobacterium
LEPSTAARGIASS

SEQ ID NO: 519205 - protein, 8 aa, Mycobacterium
LEPSTGEL

SEQ ID NO: 519206 - protein, 4 aa, Mycobacterium
LEPT

SEQ ID NO: 519207 - protein, 5 aa, Mycobacterium
LEPTG

SEQ ID NO: 519208 - protein, 19 aa, Mycobacterium
LEPTGPRAVEGRNRTETVR

SEQ ID NO: 519209 - protein, 6 aa, Mycobacterium
LEPTGT

SEQ ID NO: 519210 - protein, 7 aa, Mycobacterium
LEPTNDA

SEQ ID NO: 519211 - protein, 7 aa, Mycobacterium
LEPTPLP

SEQ ID NO: 519212 - protein, 8 aa, Mycobacterium
LEPTRAGS

SEQ ID NO: 519213 - protein, 9 aa, Mycobacterium
LEPTSGQSF

SEQ ID NO: 519214 - protein, 7 aa, Mycobacterium
LEPTSTV

SEQ ID NO: 519215 - protein, 20 aa, Mycobacterium
LEPYRDELKGDRRRGAIGNQ

SEQ ID NO: 519216 - protein, 12 aa, Mycobacterium
LEPYRHPSYPGR

SEQ ID NO: 519217 - protein, 7 aa, Mycobacterium
LEPYRRG

SEQ ID NO: 519218 - protein, 8 aa, Mycobacterium
LEQAERPR

SEQ ID NO: 519219 - protein, 7 aa, Mycobacterium
LEQAESK

SEQ ID NO: 519220 - protein, 9 aa, Mycobacterium
LEQAESKLD

SEQ ID NO: 519221 - protein, 8 aa, Mycobacterium
LEQAGART

SEQ ID NO: 519222 - protein, 12 aa, Mycobacterium
LEQARPVGVSPV

SEQ ID NO: 519223 - protein, 15 aa, Mycobacterium
LEQGPDRTPERPGHD

SEQ ID NO: 519224 - protein, 6 aa, Mycobacterium
LEQGRG

SEQ ID NO: 519225 - protein, 6 aa, Mycobacterium
LEQGSR

SEQ ID NO: 519226 - protein, 8 aa, Mycobacterium
LEQGTNKR

SEQ ID NO: 519227 - protein, 7 aa, Mycobacterium
LEQGTNY

SEQ ID NO: 519228 - protein, 7 aa, Mycobacterium
LEQPATQ

SEQ ID NO: 519229 - protein, 10 aa, Mycobacterium
LEQPGESRIG

SEQ ID NO: 519230 - protein, 9 aa, Mycobacterium
LEQPGLNED

SEQ ID NO: 519231 - protein, 10 aa, Mycobacterium
LEQPGTRRRV

SEQ ID NO: 519232 - protein, 13 aa, Mycobacterium
LEQPRAALQEAGA

SEQ ID NO: 519233 - protein, 13 aa, Mycobacterium
LEQPRAALTDAGA

SEQ ID NO: 519234 - protein, 14 aa, Mycobacterium
LEQPRRPGQTAREE

SEQ ID NO: 519235 - protein, 6 aa, Mycobacterium
LEQPRS

SEQ ID NO: 519236 - protein, 9 aa, Mycobacterium
LEQPTREDF

SEQ ID NO: 519237 - protein, 12 aa, Mycobacterium
LEQPVGAGAGVG

SEQ ID NO: 519238 - protein, 11 aa, Mycobacterium
LEQQGATGEEL

SEQ ID NO: 519239 - protein, 9 aa, Mycobacterium
LEQQGRPAR

SEQ ID NO: 519240 - protein, 5 aa, Mycobacterium
LEQRA

SEQ ID NO: 519241 - protein, 5 aa, Mycobacterium
LEQRG

SEQ ID NO: 519242 - protein, 8 aa, Mycobacterium
LEQSGGRV

SEQ ID NO: 519243 - protein, 10 aa, Mycobacterium
LEQSGPTVSQ

SEQ ID NO: 519244 - protein, 20 aa, Mycobacterium
LEQSRRERSSRREELSASLN

SEQ ID NO: 519245 - protein, 6 aa, Mycobacterium
LEQTDR

SEQ ID NO: 519246 - protein, 5 aa, Mycobacterium
LEQTG

SEQ ID NO: 519247 - protein, 12 aa, Mycobacterium
LEQTRPIGVSPV

SEQ ID NO: 519248 - protein, 4 aa, Mycobacterium
LEQY

SEQ ID NO: 519249 - protein, 4 aa, Mycobacterium
LERA

SEQ ID NO: 519250 - protein, 10 aa, Mycobacterium
LERAAGSMTP

SEQ ID NO: 519251 - protein, 7 aa, Mycobacterium
LERAERP

SEQ ID NO: 519252 - protein, 5 aa, Mycobacterium
LERAH

SEQ ID NO: 519253 - protein, 8 aa, Mycobacterium
LERAKGAA

SEQ ID NO: 519254 - protein, 6 aa, Mycobacterium
LERANG

SEQ ID NO: 519255 - protein, 11 aa, Mycobacterium
LERAQETAAPI

SEQ ID NO: 519256 - protein, 14 aa, Mycobacterium
LERAQETAAPIAES

SEQ ID NO: 519257 - protein, 14 aa, Mycobacterium
LERARAKATKAGAA

SEQ ID NO: 519258 - protein, 6 aa, Mycobacterium
LERASQ

SEQ ID NO: 519259 - protein, 6 aa, Mycobacterium
LERDDA

SEQ ID NO: 519260 - protein, 7 aa, Mycobacterium
LERDEAG

SEQ ID NO: 519261 - protein, 6 aa, Mycobacterium
LERDGA

SEQ ID NO: 519262 - protein, 7 aa, Mycobacterium
LERDGAG

SEQ ID NO: 519263 - protein, 11 aa, Mycobacterium
LERDGAGDGAA

SEQ ID NO: 519264 - protein, 6 aa, Mycobacterium
LERDGG

SEQ ID NO: 519265 - protein, 9 aa, Mycobacterium
LERDPEKCE

SEQ ID NO: 519266 - protein, 8 aa, Mycobacterium
LERDQSAL

SEQ ID NO: 519267 - protein, 7 aa, Mycobacterium
LERDSEG

SEQ ID NO: 519268 - protein, 12 aa, Mycobacterium
LEREARKTERIT

SEQ ID NO: 519269 - protein, 13 aa, Mycobacterium
LEREDPDSDGPVD

SEQ ID NO: 519270 - protein, 5 aa, Mycobacterium
LEREG

SEQ ID NO: 519271 - protein, 11 aa, Mycobacterium
LEREQARAAQR

SEQ ID NO: 519272 - protein, 4 aa, Mycobacterium
LERG

SEQ ID NO: 519273 - protein, 5 aa, Mycobacterium
LERGD

SEQ ID NO: 519274 - protein, 17 aa, Mycobacterium
LERGDRVAATARDTASL

SEQ ID NO: 519275 - protein, 14 aa, Mycobacterium
LERGGLRPGRRSAL

SEQ ID NO: 519276 - protein, 8 aa, Mycobacterium
LERGRSDA

SEQ ID NO: 519277 - protein, 11 aa, Mycobacterium
LERHGPGRVPT

SEQ ID NO: 519278 - protein, 10 aa, Mycobacterium
LERHGQANSW

SEQ ID NO: 519279 - protein, 7 aa, Mycobacterium
LERKADD

SEQ ID NO: 519280 - protein, 10 aa, Mycobacterium
LERKTAADGV

SEQ ID NO: 519281 - protein, 4 aa, Mycobacterium
LERN

SEQ ID NO: 519282 - protein, 10 aa, Mycobacterium
LERNDPADLP

SEQ ID NO: 519283 - protein, 10 aa, Mycobacterium
LERNDRAAQA

SEQ ID NO: 519284 - protein, 6 aa, Mycobacterium
LERPRS

SEQ ID NO: 519285 - protein, 21 aa, Mycobacterium
LERQAKRAERQAAKAAREAVS

SEQ ID NO: 519286 - protein, 14 aa, Mycobacterium
LERQEGSPIRILVR

SEQ ID NO: 519287 - protein, 9 aa, Mycobacterium
LERQPGQIG

SEQ ID NO: 519288 - protein, 10 aa, Mycobacterium
LERRAGDGPC

SEQ ID NO: 519289 - protein, 10 aa, Mycobacterium
LERRKQRTRA

SEQ ID NO: 519290 - protein, 10 aa, Mycobacterium
LERRQAADIP

SEQ ID NO: 519291 - protein, 16 aa, Mycobacterium
LERRQKSRHTRAARDA

SEQ ID NO: 519292 - protein, 10 aa, Mycobacterium
LERRSGDGPC

SEQ ID NO: 519293 - protein, 8 aa, Mycobacterium
LERRTSTI

SEQ ID NO: 519294 - protein, 14 aa, Mycobacterium
LERSAGRARARGGM

SEQ ID NO: 519295 - protein, 8 aa, Mycobacterium
LERSDREH

SEQ ID NO: 519296 - protein, 13 aa, Mycobacterium
LERSETAQVSEGE

SEQ ID NO: 519297 - protein, 9 aa, Mycobacterium
LERSGSWSE

SEQ ID NO: 519298 - protein, 12 aa, Mycobacterium
LERSSEQSPEGG

SEQ ID NO: 519299 - protein, 20 aa, Mycobacterium
LERTESRGGHTRDDHPAMDS

SEQ ID NO: 519300 - protein, 5 aa, Mycobacterium
LERTS

SEQ ID NO: 519301 - protein, 5 aa, Mycobacterium
LESAA

SEQ ID NO: 519302 - protein, 9 aa, Mycobacterium
LESAARGYT

SEQ ID NO: 519303 - protein, 7 aa, Mycobacterium
LESAGAA

SEQ ID NO: 519304 - protein, 6 aa, Mycobacterium
LESAGH

SEQ ID NO: 519305 - protein, 6 aa, Mycobacterium
LESAGR

SEQ ID NO: 519306 - protein, 9 aa, Mycobacterium
LESAPLPPH

SEQ ID NO: 519307 - protein, 10 aa, Mycobacterium
LESAQNDPEV

SEQ ID NO: 519308 - protein, 8 aa, Mycobacterium
LESATSGR

SEQ ID NO: 519309 - protein, 11 aa, Mycobacterium
LESDASDPKLW

SEQ ID NO: 519310 - protein, 5 aa, Mycobacterium
LESDG

SEQ ID NO: 519311 - protein, 9 aa, Mycobacterium
LESDPGAKV

SEQ ID NO: 519312 - protein, 7 aa, Mycobacterium
LESDRPH

SEQ ID NO: 519313 - protein, 7 aa, Mycobacterium
LESDTPA

SEQ ID NO: 519314 - protein, 4 aa, Mycobacterium
LESE

SEQ ID NO: 519315 - protein, 6 aa, Mycobacterium
LESEGR

SEQ ID NO: 519316 - protein, 9 aa, Mycobacterium
LESENPEAV

SEQ ID NO: 519317 - protein, 6 aa, Mycobacterium
LESEPG

SEQ ID NO: 519318 - protein, 9 aa, Mycobacterium
LESEPGAKV

SEQ ID NO: 519319 - protein, 7 aa, Mycobacterium
LESEPRG

SEQ ID NO: 519320 - protein, 6 aa, Mycobacterium
LESGAG

SEQ ID NO: 519321 - protein, 14 aa, Mycobacterium
LESGAGHAATGGGS

SEQ ID NO: 519322 - protein, 8 aa, Mycobacterium
LESGDNFD

SEQ ID NO: 519323 - protein, 9 aa, Mycobacterium
LESGDQGRS

SEQ ID NO: 519324 - protein, 5 aa, Mycobacterium
LESGE

SEQ ID NO: 519325 - protein, 13 aa, Mycobacterium
LESGEEADGGAGD

SEQ ID NO: 519326 - protein, 9 aa, Mycobacterium
LESGEREEL

SEQ ID NO: 519327 - protein, 8 aa, Mycobacterium
LESGERRT

SEQ ID NO: 519328 - protein, 6 aa, Mycobacterium
LESGES

SEQ ID NO: 519329 - protein, 11 aa, Mycobacterium
LESGETSSAEL

SEQ ID NO: 519330 - protein, 6 aa, Mycobacterium
LESGEV

SEQ ID NO: 519331 - protein, 6 aa, Mycobacterium
LESGKR

SEQ ID NO: 519332 - protein, 12 aa, Mycobacterium
LESGPSSRTGLQ

SEQ ID NO: 519333 - protein, 5 aa, Mycobacterium
LESGS

SEQ ID NO: 519334 - protein, 16 aa, Mycobacterium
LESGSAAWRPQNKAER

SEQ ID NO: 519335 - protein, 9 aa, Mycobacterium
LESGSPVRG

SEQ ID NO: 519336 - protein, 7 aa, Mycobacterium
LESGSRV

SEQ ID NO: 519337 - protein, 17 aa, Mycobacterium
LESGSWADATGLSVDDG

SEQ ID NO: 519338 - protein, 17 aa, Mycobacterium
LESGSWADATGLSVEDG

SEQ ID NO: 519339 - protein, 5 aa, Mycobacterium
LESGT

SEQ ID NO: 519340 - protein, 9 aa, Mycobacterium
LESGTADQV

SEQ ID NO: 519341 - protein, 18 aa, Mycobacterium
LESGTDGWPPDGRAPRRR

SEQ ID NO: 519342 - protein, 18 aa, Mycobacterium
LESGTDSWPPDGRAPRRD

SEQ ID NO: 519343 - protein, 5 aa, Mycobacterium
LESGV

SEQ ID NO: 519344 - protein, 26 aa, Mycobacterium
LESKKVSKTQAVTSNLTGSLAGKVED

SEQ ID NO: 519345 - protein, 6 aa, Mycobacterium
LESLGD

SEQ ID NO: 519346 - protein, 10 aa, Mycobacterium
LESLSSSDGQ

SEQ ID NO: 519347 - protein, 4 aa, Mycobacterium
LESN

SEQ ID NO: 519348 - protein, 13 aa, Mycobacterium
LESNRDKAIEVTS

SEQ ID NO: 519349 - protein, 15 aa, Mycobacterium
LESNRDSRQYAGPER

SEQ ID NO: 519350 - protein, 13 aa, Mycobacterium
LESNREKAIEVTS

SEQ ID NO: 519351 - protein, 10 aa, Mycobacterium
LESPAGRQIQ

SEQ ID NO: 519352 - protein, 10 aa, Mycobacterium
LESPEDADSM

SEQ ID NO: 519353 - protein, 7 aa, Mycobacterium
LESPIGE

SEQ ID NO: 519354 - protein, 8 aa, Mycobacterium
LESPQVAP

SEQ ID NO: 519355 - protein, 5 aa, Mycobacterium
LESPR

SEQ ID NO: 519356 - protein, 7 aa, Mycobacterium
LESPTIA

SEQ ID NO: 519357 - protein, 5 aa, Mycobacterium
LESRG

SEQ ID NO: 519358 - protein, 9 aa, Mycobacterium
LESRPSETE

SEQ ID NO: 519359 - protein, 8 aa, Mycobacterium
LESRPVGR

SEQ ID NO: 519360 - protein, 7 aa, Mycobacterium
LESRRDE

SEQ ID NO: 519361 - protein, 5 aa, Mycobacterium
LESSE

SEQ ID NO: 519362 - protein, 9 aa, Mycobacterium
LESSGAKTD

SEQ ID NO: 519363 - protein, 8 aa, Mycobacterium
LESSPDLD

SEQ ID NO: 519364 - protein, 9 aa, Mycobacterium
LESSSGQRR

SEQ ID NO: 519365 - protein, 6 aa, Mycobacterium
LESTDT

SEQ ID NO: 519366 - protein, 9 aa, Mycobacterium
LESTIAPDA

SEQ ID NO: 519367 - protein, 10 aa, Mycobacterium
LESTPSGMRR

SEQ ID NO: 519368 - protein, 9 aa, Mycobacterium
LESTTSPSV

SEQ ID NO: 519369 - protein, 6 aa, Mycobacterium
LESTVG

SEQ ID NO: 519370 - protein, 8 aa, Mycobacterium
LESYEPEQ

SEQ ID NO: 519371 - protein, 4 aa, Mycobacterium
LETA

SEQ ID NO: 519372 - protein, 7 aa, Mycobacterium
LETAATA

SEQ ID NO: 519373 - protein, 5 aa, Mycobacterium
LETAG

SEQ ID NO: 519374 - protein, 6 aa, Mycobacterium
LETAGL

SEQ ID NO: 519375 - protein, 30 aa, Mycobacterium
LETAKFGSAGRDEVSTAVSHASAKTNENFE

SEQ ID NO: 519376 - protein, 7 aa, Mycobacterium
LETASAQ

SEQ ID NO: 519377 - protein, 8 aa, Mycobacterium
LETASRGY

SEQ ID NO: 519378 - protein, 5 aa, Mycobacterium
LETAT

SEQ ID NO: 519379 - protein, 12 aa, Mycobacterium
LETDEPALGSEP

SEQ ID NO: 519380 - protein, 9 aa, Mycobacterium
LETENPDAV

SEQ ID NO: 519381 - protein, 19 aa, Mycobacterium
LETENPDAVANVKARMEAD

SEQ ID NO: 519382 - protein, 20 aa, Mycobacterium
LETENPEAAANVKARLEAES

SEQ ID NO: 519383 - protein, 15 aa, Mycobacterium
LETEQQQLQAYITQG

SEQ ID NO: 519384 - protein, 8 aa, Mycobacterium
LETESGET

SEQ ID NO: 519385 - protein, 9 aa, Mycobacterium
LETESRDSG

SEQ ID NO: 519386 - protein, 4 aa, Mycobacterium
LETG

SEQ ID NO: 519387 - protein, 11 aa, Mycobacterium
LETGDDGRPRQ

SEQ ID NO: 519388 - protein, 10 aa, Mycobacterium
LETGDSPTEA

SEQ ID NO: 519389 - protein, 5 aa, Mycobacterium
LETGP

SEQ ID NO: 519390 - protein, 14 aa, Mycobacterium
LETGPVEPAPGNVA

SEQ ID NO: 519391 - protein, 11 aa, Mycobacterium
LETGSTASSHQ

SEQ ID NO: 519392 - protein, 6 aa, Mycobacterium
LETGTG

SEQ ID NO: 519393 - protein, 4 aa, Mycobacterium
LETI

SEQ ID NO: 519394 - protein, 4 aa, Mycobacterium
LETL

SEQ ID NO: 519395 - protein, 14 aa, Mycobacterium
LETNGSSIDGLPAL

SEQ ID NO: 519396 - protein, 9 aa, Mycobacterium
LETPAATGR

SEQ ID NO: 519397 - protein, 10 aa, Mycobacterium
LETPAETRAL

SEQ ID NO: 519398 - protein, 13 aa, Mycobacterium
LETPAITEQRRRE

SEQ ID NO: 519399 - protein, 7 aa, Mycobacterium
LETPGAG

SEQ ID NO: 519400 - protein, 9 aa, Mycobacterium
LETPSRVDE

SEQ ID NO: 519401 - protein, 6 aa, Mycobacterium
LETQHG

SEQ ID NO: 519402 - protein, 6 aa, Mycobacterium
LETQNA

SEQ ID NO: 519403 - protein, 9 aa, Mycobacterium
LETQQRTNR

SEQ ID NO: 519404 - protein, 5 aa, Mycobacterium
LETQY

SEQ ID NO: 519405 - protein, 6 aa, Mycobacterium
LETRDR

SEQ ID NO: 519406 - protein, 12 aa, Mycobacterium
LETRTTLARNAT

SEQ ID NO: 519407 - protein, 7 aa, Mycobacterium
LETSAEG

SEQ ID NO: 519408 - protein, 7 aa, Mycobacterium
LETSDAL

SEQ ID NO: 519409 - protein, 6 aa, Mycobacterium
LETSHE

SEQ ID NO: 519410 - protein, 26 aa, Mycobacterium
LETSQASAAPAPGPRPAAREYRDGPV

SEQ ID NO: 519411 - protein, 15 aa, Mycobacterium
LETSQTSARTPPGLD

SEQ ID NO: 519412 - protein, 10 aa, Mycobacterium
LETSSPGHGS

SEQ ID NO: 519413 - protein, 17 aa, Mycobacterium
LETSTAEIKNLLTRALE

SEQ ID NO: 519414 - protein, 6 aa, Mycobacterium
LETTAS

SEQ ID NO: 519415 - protein, 5 aa, Mycobacterium
LETTG

SEQ ID NO: 519416 - protein, 14 aa, Mycobacterium
LETTQTLTRAPGPW

SEQ ID NO: 519417 - protein, 12 aa, Mycobacterium
LETTRAPQASEH

SEQ ID NO: 519418 - protein, 13 aa, Mycobacterium
LETTRAPQASEHT

SEQ ID NO: 519419 - protein, 7 aa, Mycobacterium
LETTSSA

SEQ ID NO: 519420 - protein, 15 aa, Mycobacterium
LETYDGRNRVNPPLR

SEQ ID NO: 519421 - protein, 22 aa, Mycobacterium
LETYDGRNRVNPPLREAEDAAA

SEQ ID NO: 519422 - protein, 4 aa, Mycobacterium
LEVE

SEQ ID NO: 519423 - protein, 7 aa, Mycobacterium
LEYGPPL

SEQ ID NO: 519424 - protein, 13 aa, Mycobacterium
LFGSPGQANYATA

SEQ ID NO: 519425 - protein, 13 aa, Mycobacterium
LFGTPEKPPMGPG

SEQ ID NO: 519426 - protein, 12 aa, Mycobacterium
LFPPGTDGSIGT

SEQ ID NO: 519427 - protein, 7 aa, Mycobacterium
LFPPPDG

SEQ ID NO: 519428 - protein, 5 aa, Mycobacterium
LFSSS

SEQ ID NO: 519429 - protein, 5 aa, Mycobacterium
LGAAA

SEQ ID NO: 519430 - protein, 11 aa, Mycobacterium
LGAAADSFASV

SEQ ID NO: 519431 - protein, 9 aa, Mycobacterium
LGAAADSFS

SEQ ID NO: 519432 - protein, 16 aa, Mycobacterium
LGAAAEAAAGPTTGVA

SEQ ID NO: 519433 - protein, 8 aa, Mycobacterium
LGAAAQSF

SEQ ID NO: 519434 - protein, 16 aa, Mycobacterium
LGAADGDEKVRTAASC

SEQ ID NO: 519435 - protein, 15 aa, Mycobacterium
LGAAEASFETGAEPG

SEQ ID NO: 519436 - protein, 6 aa, Mycobacterium
LGAAEE

SEQ ID NO: 519437 - protein, 8 aa, Mycobacterium
LGAAGAAA

SEQ ID NO: 519438 - protein, 15 aa, Mycobacterium
LGAAGATVDPGKHPQ

SEQ ID NO: 519439 - protein, 16 aa, Mycobacterium
LGAAGSGAADEPTEIA

SEQ ID NO: 519440 - protein, 7 aa, Mycobacterium
LGAAGTR

SEQ ID NO: 519441 - protein, 9 aa, Mycobacterium
LGAAPTAEH

SEQ ID NO: 519442 - protein, 9 aa, Mycobacterium
LGAAPTAER

SEQ ID NO: 519443 - protein, 10 aa, Mycobacterium
LGAAPTAQRR

SEQ ID NO: 519444 - protein, 6 aa, Mycobacterium
LGAAQR

SEQ ID NO: 519445 - protein, 7 aa, Mycobacterium
LGAATAV

SEQ ID NO: 519446 - protein, 12 aa, Mycobacterium
LGAATDAGLSPL

SEQ ID NO: 519447 - protein, 8 aa, Mycobacterium
LGAATGAG

SEQ ID NO: 519448 - protein, 4 aa, Mycobacterium
LGAD

SEQ ID NO: 519449 - protein, 8 aa, Mycobacterium
LGADADEA

SEQ ID NO: 519450 - protein, 12 aa, Mycobacterium
LGADDATGDPEV

SEQ ID NO: 519451 - protein, 7 aa, Mycobacterium
LGADDGV

SEQ ID NO: 519452 - protein, 11 aa, Mycobacterium
LGADEPGSPAD

SEQ ID NO: 519453 - protein, 10 aa, Mycobacterium
LGADEREVGD

SEQ ID NO: 519454 - protein, 9 aa, Mycobacterium
LGADETEVD

SEQ ID NO: 519455 - protein, 10 aa, Mycobacterium
LGADGAGRTP

SEQ ID NO: 519456 - protein, 11 aa, Mycobacterium
LGADGAPVDIE

SEQ ID NO: 519457 - protein, 9 aa, Mycobacterium
LGADGEQSG

SEQ ID NO: 519458 - protein, 13 aa, Mycobacterium
LGADGGADGDVKF

SEQ ID NO: 519459 - protein, 8 aa, Mycobacterium
LGADPGEA

SEQ ID NO: 519460 - protein, 7 aa, Mycobacterium
LGADPGR

SEQ ID NO: 519461 - protein, 5 aa, Mycobacterium
LGADR

SEQ ID NO: 519462 - protein, 8 aa, Mycobacterium
LGADSSAK

SEQ ID NO: 519463 - protein, 8 aa, Mycobacterium
LGADSSAR

SEQ ID NO: 519464 - protein, 9 aa, Mycobacterium
LGAEAAANE

SEQ ID NO: 519465 - protein, 6 aa, Mycobacterium
LGAEAR

SEQ ID NO: 519466 - protein, 11 aa, Mycobacterium
LGAEATDPERR

SEQ ID NO: 519467 - protein, 6 aa, Mycobacterium
LGAEGA

SEQ ID NO: 519468 - protein, 5 aa, Mycobacterium
LGAEK

SEQ ID NO: 519469 - protein, 7 aa, Mycobacterium
LGAEPDD

SEQ ID NO: 519470 - protein, 37 aa, Mycobacterium
LGAEPEPETGTGLRTEPGLNTGPEAQADLAGKPNLAA

SEQ ID NO: 519471 - protein, 7 aa, Mycobacterium
LGAEPKV

SEQ ID NO: 519472 - protein, 7 aa, Mycobacterium
LGAEPSA

SEQ ID NO: 519473 - protein, 11 aa, Mycobacterium
LGAESEGERAA

SEQ ID NO: 519474 - protein, 4 aa, Mycobacterium
LGAG

SEQ ID NO: 519475 - protein, 6 aa, Mycobacterium
LGAGAA

SEQ ID NO: 519476 - protein, 8 aa, Mycobacterium
LGAGAGGH

SEQ ID NO: 519477 - protein, 15 aa, Mycobacterium
LGAGAPSAVSGTGVR

SEQ ID NO: 519478 - protein, 9 aa, Mycobacterium
LGAGDYSDL

SEQ ID NO: 519479 - protein, 8 aa, Mycobacterium
LGAGEQGT

SEQ ID NO: 519480 - protein, 17 aa, Mycobacterium
LGAGGAAAISTDPRTGL

SEQ ID NO: 519481 - protein, 8 aa, Mycobacterium
LGAGGFDD

SEQ ID NO: 519482 - protein, 7 aa, Mycobacterium
LGAGGFE

SEQ ID NO: 519483 - protein, 9 aa, Mycobacterium
LGAGGGRAA

SEQ ID NO: 519484 - protein, 7 aa, Mycobacterium
LGAGGHA

SEQ ID NO: 519485 - protein, 7 aa, Mycobacterium
LGAGGHT

SEQ ID NO: 519486 - protein, 13 aa, Mycobacterium
LGAGGISGPPVAE

SEQ ID NO: 519487 - protein, 13 aa, Mycobacterium
LGAGGISGPPVAR

SEQ ID NO: 519488 - protein, 9 aa, Mycobacterium
LGAGGNEDQ

SEQ ID NO: 519489 - protein, 9 aa, Mycobacterium
LGAGGSEEQ

SEQ ID NO: 519490 - protein, 18 aa, Mycobacterium
LGAGGTGKGTAGTMRGAA

SEQ ID NO: 519491 - protein, 20 aa, Mycobacterium
LGAGGTGKGTAGTMRGSAGA

SEQ ID NO: 519492 - protein, 5 aa, Mycobacterium
LGAGP

SEQ ID NO: 519493 - protein, 8 aa, Mycobacterium
LGAGPASR

SEQ ID NO: 519494 - protein, 13 aa, Mycobacterium
LGAGPGADGAGGV

SEQ ID NO: 519495 - protein, 7 aa, Mycobacterium
LGAGPGD

SEQ ID NO: 519496 - protein, 19 aa, Mycobacterium
LGAGPGGPMTVASPGGGFG

SEQ ID NO: 519497 - protein, 17 aa, Mycobacterium
LGAGRTDVDNPLEPYGS

SEQ ID NO: 519498 - protein, 16 aa, Mycobacterium
LGAGSPSNNRRSTSAE

SEQ ID NO: 519499 - protein, 9 aa, Mycobacterium
LGAGSTSLA

SEQ ID NO: 519500 - protein, 7 aa, Mycobacterium
LGAGTEG

SEQ ID NO: 519501 - protein, 8 aa, Mycobacterium
LGAGYATR

SEQ ID NO: 519502 - protein, 9 aa, Mycobacterium
LGAHRERRE

SEQ ID NO: 519503 - protein, 4 aa, Mycobacterium
LGAI

SEQ ID NO: 519504 - protein, 8 aa, Mycobacterium
LGAKPDIS

SEQ ID NO: 519505 - protein, 8 aa, Mycobacterium
LGAKSNSL

SEQ ID NO: 519506 - protein, 5 aa, Mycobacterium
LGAKT

SEQ ID NO: 519507 - protein, 7 aa, Mycobacterium
LGANATA

SEQ ID NO: 519508 - protein, 7 aa, Mycobacterium
LGANSST

SEQ ID NO: 519509 - protein, 4 aa, Mycobacterium
LGAP

SEQ ID NO: 519510 - protein, 7 aa, Mycobacterium
LGAPAHG

SEQ ID NO: 519511 - protein, 5 aa, Mycobacterium
LGAPC

SEQ ID NO: 519512 - protein, 6 aa, Mycobacterium
LGAPDD

SEQ ID NO: 519513 - protein, 12 aa, Mycobacterium
LGAPDGTVPDSD

SEQ ID NO: 519514 - protein, 56 aa, Mycobacterium
LGAPDPGAPHRRRVPGAAEGGTIRRSGGARHAGGLRGRQRPAPAVSGHRGVPGGRR

SEQ ID NO: 519515 - protein, 5 aa, Mycobacterium
LGAPE

SEQ ID NO: 519516 - protein, 12 aa, Mycobacterium
LGAPEGSVGAPD

SEQ ID NO: 519517 - protein, 8 aa, Mycobacterium
LGAPGFDG

SEQ ID NO: 519518 - protein, 14 aa, Mycobacterium
LGAPGGDLPALDPD

SEQ ID NO: 519519 - protein, 19 aa, Mycobacterium
LGAPGNSGAGGAGGNAGTL

SEQ ID NO: 519520 - protein, 14 aa, Mycobacterium
LGAPGPAPDASAAA

SEQ ID NO: 519521 - protein, 12 aa, Mycobacterium
LGAPGPAPDESV

SEQ ID NO: 519522 - protein, 11 aa, Mycobacterium
LGAPGQANYAA

SEQ ID NO: 519523 - protein, 9 aa, Mycobacterium
LGAPGQTIN

SEQ ID NO: 519524 - protein, 9 aa, Mycobacterium
LGAPGSASV

SEQ ID NO: 519525 - protein, 8 aa, Mycobacterium
LGAPPTTV

SEQ ID NO: 519526 - protein, 5 aa, Mycobacterium
LGAPR

SEQ ID NO: 519527 - protein, 10 aa, Mycobacterium
LGAPSEEGCV

SEQ ID NO: 519528 - protein, 5 aa, Mycobacterium
LGAPT

SEQ ID NO: 519529 - protein, 16 aa, Mycobacterium
LGAPTSPEGDAEGGAR

SEQ ID NO: 519530 - protein, 5 aa, Mycobacterium
LGAQE

SEQ ID NO: 519531 - protein, 21 aa, Mycobacterium
LGAQGGKPEDLRGLGGAPGSL

SEQ ID NO: 519532 - protein, 11 aa, Mycobacterium
LGAQGLNAGLG

SEQ ID NO: 519533 - protein, 6 aa, Mycobacterium
LGAQNA

SEQ ID NO: 519534 - protein, 9 aa, Mycobacterium
LGAQQREGY

SEQ ID NO: 519535 - protein, 9 aa, Mycobacterium
LGAQRSGAD

SEQ ID NO: 519536 - protein, 5 aa, Mycobacterium
LGAQS

SEQ ID NO: 519537 - protein, 17 aa, Mycobacterium
LGAQSNTGDGIRAGQEF

SEQ ID NO: 519538 - protein, 8 aa, Mycobacterium
LGAQSQDG

SEQ ID NO: 519539 - protein, 6 aa, Mycobacterium
LGARAD

SEQ ID NO: 519540 - protein, 7 aa, Mycobacterium
LGARDDS

SEQ ID NO: 519541 - protein, 9 aa, Mycobacterium
LGARDGKGF

SEQ ID NO: 519542 - protein, 9 aa, Mycobacterium
LGARPGGRR

SEQ ID NO: 519543 - protein, 13 aa, Mycobacterium
LGASAGGLPPDNV

SEQ ID NO: 519544 - protein, 7 aa, Mycobacterium
LGASATY

SEQ ID NO: 519545 - protein, 9 aa, Mycobacterium
LGASATYSV

SEQ ID NO: 519546 - protein, 8 aa, Mycobacterium
LGASDPTI

SEQ ID NO: 519547 - protein, 8 aa, Mycobacterium
LGASDVPA

SEQ ID NO: 519548 - protein, 8 aa, Mycobacterium
LGASESGV

SEQ ID NO: 519549 - protein, 6 aa, Mycobacterium
LGASGA

SEQ ID NO: 519550 - protein, 14 aa, Mycobacterium
LGASGGRVGQRTNE

SEQ ID NO: 519551 - protein, 10 aa, Mycobacterium
LGASGGSNGG

SEQ ID NO: 519552 - protein, 19 aa, Mycobacterium
LGASGGSPEQDAELARLAS

SEQ ID NO: 519553 - protein, 8 aa, Mycobacterium
LGASPENV

SEQ ID NO: 519554 - protein, 7 aa, Mycobacterium
LGASRSE

SEQ ID NO: 519555 - protein, 7 aa, Mycobacterium
LGATAEA

SEQ ID NO: 519556 - protein, 5 aa, Mycobacterium
LGATD

SEQ ID NO: 519557 - protein, 5 aa, Mycobacterium
LGATE

SEQ ID NO: 519558 - protein, 12 aa, Mycobacterium
LGATGAGHGTPG

SEQ ID NO: 519559 - protein, 11 aa, Mycobacterium
LGATGGEGQTH

SEQ ID NO: 519560 - protein, 7 aa, Mycobacterium
LGATGVD

SEQ ID NO: 519561 - protein, 5 aa, Mycobacterium
LGATK

SEQ ID NO: 519562 - protein, 12 aa, Mycobacterium
LGATKPDPKGTE

SEQ ID NO: 519563 - protein, 8 aa, Mycobacterium
LGATPGSR

SEQ ID NO: 519564 - protein, 14 aa, Mycobacterium
LGATPPAAPAAPGI

SEQ ID NO: 519565 - protein, 11 aa, Mycobacterium
LGATPQPAGAA

SEQ ID NO: 519566 - protein, 11 aa, Mycobacterium
LGATPTADRRT

SEQ ID NO: 519567 - protein, 14 aa, Mycobacterium
LGATQGSVVRIGVS

SEQ ID NO: 519568 - protein, 12 aa, Mycobacterium
LGATSRANSAVP

SEQ ID NO: 519569 - protein, 7 aa, Mycobacterium
LGATTDT

SEQ ID NO: 519570 - protein, 7 aa, Mycobacterium
LGATTGE

SEQ ID NO: 519571 - protein, 4 aa, Mycobacterium
LGAV

SEQ ID NO: 519572 - protein, 12 aa, Mycobacterium
LGDAADRQRVSD

SEQ ID NO: 519573 - protein, 9 aa, Mycobacterium
LGDAAEPAY

SEQ ID NO: 519574 - protein, 5 aa, Mycobacterium
LGDAD

SEQ ID NO: 519575 - protein, 12 aa, Mycobacterium
LGDADADPDVSK

SEQ ID NO: 519576 - protein, 5 aa, Mycobacterium
LGDAE

SEQ ID NO: 519577 - protein, 6 aa, Mycobacterium
LGDAGA

SEQ ID NO: 519578 - protein, 10 aa, Mycobacterium
LGDAGDSRAN

SEQ ID NO: 519579 - protein, 10 aa, Mycobacterium
LGDAGGADPL

SEQ ID NO: 519580 - protein, 8 aa, Mycobacterium
LGDAPETV

SEQ ID NO: 519581 - protein, 21 aa, Mycobacterium
LGDAQGAYENADQSGQQGVGQ

SEQ ID NO: 519582 - protein, 12 aa, Mycobacterium
LGDARDPDNPAG

SEQ ID NO: 519583 - protein, 6 aa, Mycobacterium
LGDAYD

SEQ ID NO: 519584 - protein, 4 aa, Mycobacterium
LGDD

SEQ ID NO: 519585 - protein, 10 aa, Mycobacterium
LGDDAASPRY

SEQ ID NO: 519586 - protein, 7 aa, Mycobacterium
LGDDADK

SEQ ID NO: 519587 - protein, 10 aa, Mycobacterium
LGDDAPPSVQ

SEQ ID NO: 519588 - protein, 9 aa, Mycobacterium
LGDDATARQ

SEQ ID NO: 519589 - protein, 6 aa, Mycobacterium
LGDDDV

SEQ ID NO: 519590 - protein, 7 aa, Mycobacterium
LGDDEEK

SEQ ID NO: 519591 - protein, 6 aa, Mycobacterium
LGDDEQ

SEQ ID NO: 519592 - protein, 5 aa, Mycobacterium
LGDDG

SEQ ID NO: 519593 - protein, 11 aa, Mycobacterium
LGDDGARQRRT

SEQ ID NO: 519594 - protein, 8 aa, Mycobacterium
LGDDGDFG

SEQ ID NO: 519595 - protein, 6 aa, Mycobacterium
LGDDGR

SEQ ID NO: 519596 - protein, 7 aa, Mycobacterium
LGDDGSV

SEQ ID NO: 519597 - protein, 5 aa, Mycobacterium
LGDDL

SEQ ID NO: 519598 - protein, 7 aa, Mycobacterium
LGDDNPF

SEQ ID NO: 519599 - protein, 10 aa, Mycobacterium
LGDDPADLGA

SEQ ID NO: 519600 - protein, 8 aa, Mycobacterium
LGDDPELA

SEQ ID NO: 519601 - protein, 7 aa, Mycobacterium
LGDDQNS

SEQ ID NO: 519602 - protein, 6 aa, Mycobacterium
LGDDRT

SEQ ID NO: 519603 - protein, 11 aa, Mycobacterium
LGDDSLTDSND

SEQ ID NO: 519604 - protein, 9 aa, Mycobacterium
LGDDSQSVS

SEQ ID NO: 519605 - protein, 11 aa, Mycobacterium
LGDDTGADEAL

SEQ ID NO: 519606 - protein, 7 aa, Mycobacterium
LGDEAGA

SEQ ID NO: 519607 - protein, 20 aa, Mycobacterium
LGDEDKRHGGFGGAPKFPPS

SEQ ID NO: 519608 - protein, 7 aa, Mycobacterium
LGDEEQN

SEQ ID NO: 519609 - protein, 6 aa, Mycobacterium
LGDEER

SEQ ID NO: 519610 - protein, 6 aa, Mycobacterium
LGDEGD

SEQ ID NO: 519611 - protein, 10 aa, Mycobacterium
LGDEITPETP

SEQ ID NO: 519612 - protein, 6 aa, Mycobacterium
LGDEPA

SEQ ID NO: 519613 - protein, 8 aa, Mycobacterium
LGDEPAYD

SEQ ID NO: 519614 - protein, 7 aa, Mycobacterium
LGDEPQN

SEQ ID NO: 519615 - protein, 11 aa, Mycobacterium
LGDEPRYRPSR

SEQ ID NO: 519616 - protein, 25 aa, Mycobacterium
LGDEPVPQADPNQPWPGQLPEPSPA

SEQ ID NO: 519617 - protein, 6 aa, Mycobacterium
LGDERA

SEQ ID NO: 519618 - protein, 7 aa, Mycobacterium
LGDERAE

SEQ ID NO: 519619 - protein, 9 aa, Mycobacterium
LGDETQQAL

SEQ ID NO: 519620 - protein, 6 aa, Mycobacterium
LGDGAP

SEQ ID NO: 519621 - protein, 17 aa, Mycobacterium
LGDGATLATGGRRPPAL

SEQ ID NO: 519622 - protein, 7 aa, Mycobacterium
LGDGAYD

SEQ ID NO: 519623 - protein, 7 aa, Mycobacterium
LGDGDAT

SEQ ID NO: 519624 - protein, 40 aa, Mycobacterium
LGDGEGSKSPSEKFASGKPSGIALGGPAASNEQPTTRSGH

SEQ ID NO: 519625 - protein, 8 aa, Mycobacterium
LGDGEVRT

SEQ ID NO: 519626 - protein, 5 aa, Mycobacterium
LGDGG

SEQ ID NO: 519627 - protein, 28 aa, Mycobacterium
LGDGGAGGAGGEAELAAGGAGGSGGVGG

SEQ ID NO: 519628 - protein, 46 aa, Mycobacterium
LGDGGAGGTGGSSHYGDGGDGGAGGAAGQLSGGGGAGGQGGQGNIA

SEQ ID NO: 519629 - protein, 6 aa, Mycobacterium
LGDGGL

SEQ ID NO: 519630 - protein, 9 aa, Mycobacterium
LGDGGRTLD

SEQ ID NO: 519631 - protein, 7 aa, Mycobacterium
LGDGRAK

SEQ ID NO: 519632 - protein, 7 aa, Mycobacterium
LGDGRTR

SEQ ID NO: 519633 - protein, 8 aa, Mycobacterium
LGDGTDVE

SEQ ID NO: 519634 - protein, 6 aa, Mycobacterium
LGDGTI

SEQ ID NO: 519635 - protein, 10 aa, Mycobacterium
LGDGTPGARI

SEQ ID NO: 519636 - protein, 6 aa, Mycobacterium
LGDGTS

SEQ ID NO: 519637 - protein, 5 aa, Mycobacterium
LGDGV

SEQ ID NO: 519638 - protein, 7 aa, Mycobacterium
LGDHRNS

SEQ ID NO: 519639 - protein, 6 aa, Mycobacterium
LGDKDG

SEQ ID NO: 519640 - protein, 9 aa, Mycobacterium
LGDKEDKSK

SEQ ID NO: 519641 - protein, 9 aa, Mycobacterium
LGDKQHASA

SEQ ID NO: 519642 - protein, 6 aa, Mycobacterium
LGDLPR

SEQ ID NO: 519643 - protein, 4 aa, Mycobacterium
LGDN

SEQ ID NO: 519644 - protein, 5 aa, Mycobacterium
LGDPA

SEQ ID NO: 519645 - protein, 9 aa, Mycobacterium
LGDPAANAA

SEQ ID NO: 519646 - protein, 9 aa, Mycobacterium
LGDPAETYG

SEQ ID NO: 519647 - protein, 8 aa, Mycobacterium
LGDPARDL

SEQ ID NO: 519648 - protein, 7 aa, Mycobacterium
LGDPDEI

SEQ ID NO: 519649 - protein, 11 aa, Mycobacterium
LGDPDTSTDDD

SEQ ID NO: 519650 - protein, 6 aa, Mycobacterium
LGDPEA

SEQ ID NO: 519651 - protein, 17 aa, Mycobacterium
LGDPERPLSAADYDRPR

SEQ ID NO: 519652 - protein, 6 aa, Mycobacterium
LGDPGL

SEQ ID NO: 519653 - protein, 7 aa, Mycobacterium
LGDPGSF

SEQ ID NO: 519654 - protein, 13 aa, Mycobacterium
LGDPKDPTTEMGP

SEQ ID NO: 519655 - protein, 5 aa, Mycobacterium
LGDPP

SEQ ID NO: 519656 - protein, 11 aa, Mycobacterium
LGDPPGGWPEP

SEQ ID NO: 519657 - protein, 13 aa, Mycobacterium
LGDPPGGWPEPLR

SEQ ID NO: 519658 - protein, 8 aa, Mycobacterium
LGDPPPVD

SEQ ID NO: 519659 - protein, 5 aa, Mycobacterium
LGDPQ

SEQ ID NO: 519660 - protein, 7 aa, Mycobacterium
LGDPQAA

SEQ ID NO: 519661 - protein, 7 aa, Mycobacterium
LGDPQEA

SEQ ID NO: 519662 - protein, 8 aa, Mycobacterium
LGDPQPEW

SEQ ID NO: 519663 - protein, 11 aa, Mycobacterium
LGDPQWATDDE

SEQ ID NO: 519664 - protein, 6 aa, Mycobacterium
LGDPRA

SEQ ID NO: 519665 - protein, 7 aa, Mycobacterium
LGDPRLS

SEQ ID NO: 519666 - protein, 17 aa, Mycobacterium
LGDPRSTLRATTDRNGA

SEQ ID NO: 519667 - protein, 4 aa, Mycobacterium
LGDQ

SEQ ID NO: 519668 - protein, 9 aa, Mycobacterium
LGDQADEAI

SEQ ID NO: 519669 - protein, 6 aa, Mycobacterium
LGDQGV

SEQ ID NO: 519670 - protein, 6 aa, Mycobacterium
LGDQQG

SEQ ID NO: 519671 - protein, 7 aa, Mycobacterium
LGDQRSA

SEQ ID NO: 519672 - protein, 5 aa, Mycobacterium
LGDRA

SEQ ID NO: 519673 - protein, 16 aa, Mycobacterium
LGDRGALEARLDKVLD

SEQ ID NO: 519674 - protein, 12 aa, Mycobacterium
LGDRGDRTSRVP

SEQ ID NO: 519675 - protein, 6 aa, Mycobacterium
LGDRGG

SEQ ID NO: 519676 - protein, 15 aa, Mycobacterium
LGDRQRKALLEKFDF

SEQ ID NO: 519677 - protein, 15 aa, Mycobacterium
LGDRQRKALLEKFDQ

SEQ ID NO: 519678 - protein, 15 aa, Mycobacterium
LGDRQRKALLERFDF

SEQ ID NO: 519679 - protein, 9 aa, Mycobacterium
LGDRRATSA

SEQ ID NO: 519680 - protein, 6 aa, Mycobacterium
LGDRRD

SEQ ID NO: 519681 - protein, 10 aa, Mycobacterium
LGDRSGGIGS

SEQ ID NO: 519682 - protein, 10 aa, Mycobacterium
LGDRSSAPIE

SEQ ID NO: 519683 - protein, 7 aa, Mycobacterium
LGDRTRR

SEQ ID NO: 519684 - protein, 11 aa, Mycobacterium
LGDSDEAELDP

SEQ ID NO: 519685 - protein, 8 aa, Mycobacterium
LGDSDSDD

SEQ ID NO: 519686 - protein, 13 aa, Mycobacterium
LGDSEGDWGDGSF

SEQ ID NO: 519687 - protein, 10 aa, Mycobacterium
LGDSESPDVR

SEQ ID NO: 519688 - protein, 17 aa, Mycobacterium
LGDSNVGFGNAGDHNVG

SEQ ID NO: 519689 - protein, 9 aa, Mycobacterium
LGDSPSQPR

SEQ ID NO: 519690 - protein, 13 aa, Mycobacterium
LGDSSSRRIDTGR

SEQ ID NO: 519691 - protein, 16 aa, Mycobacterium
LGDSSVGFGNAGDHNV

SEQ ID NO: 519692 - protein, 8 aa, Mycobacterium
LGDSWTDS

SEQ ID NO: 519693 - protein, 6 aa, Mycobacterium
LGDTFD

SEQ ID NO: 519694 - protein, 11 aa, Mycobacterium
LGDTGRPDSSV

SEQ ID NO: 519695 - protein, 6 aa, Mycobacterium
LGDTGT

SEQ ID NO: 519696 - protein, 9 aa, Mycobacterium
LGDTPAEDV

SEQ ID NO: 519697 - protein, 10 aa, Mycobacterium
LGDTPAGDVN

SEQ ID NO: 519698 - protein, 9 aa, Mycobacterium
LGDTSALAP

SEQ ID NO: 519699 - protein, 7 aa, Mycobacterium
LGDTSAP

SEQ ID NO: 519700 - protein, 10 aa, Mycobacterium
LGDTTDFNTD

SEQ ID NO: 519701 - protein, 6 aa, Mycobacterium
LGDTYS

SEQ ID NO: 519702 - protein, 12 aa, Mycobacterium
LGDVGDRDSPLA

SEQ ID NO: 519703 - protein, 13 aa, Mycobacterium
LGDVGPVQKRCLA

SEQ ID NO: 519704 - protein, 8 aa, Mycobacterium
LGDVGRPR

SEQ ID NO: 519705 - protein, 4 aa, Mycobacterium
LGEA

SEQ ID NO: 519706 - protein, 5 aa, Mycobacterium
LGEAA

SEQ ID NO: 519707 - protein, 5 aa, Mycobacterium
LGEAD

SEQ ID NO: 519708 - protein, 6 aa, Mycobacterium
LGEAER

SEQ ID NO: 519709 - protein, 5 aa, Mycobacterium
LGEAG

SEQ ID NO: 519710 - protein, 8 aa, Mycobacterium
LGEAKDAY

SEQ ID NO: 519711 - protein, 14 aa, Mycobacterium
LGEAPDRHQRLDDA

SEQ ID NO: 519712 - protein, 17 aa, Mycobacterium
LGEAPRRERDGELGGQP

SEQ ID NO: 519713 - protein, 7 aa, Mycobacterium
LGEATAA

SEQ ID NO: 519714 - protein, 11 aa, Mycobacterium
LGEATAAPPRI

SEQ ID NO: 519715 - protein, 4 aa, Mycobacterium
LGEC

SEQ ID NO: 519716 - protein, 8 aa, Mycobacterium
LGEDAGAR

SEQ ID NO: 519717 - protein, 8 aa, Mycobacterium
LGEDASAR

SEQ ID NO: 519718 - protein, 13 aa, Mycobacterium
LGEDDADVEAQET

SEQ ID NO: 519719 - protein, 13 aa, Mycobacterium
LGEDDASDQDYSE

SEQ ID NO: 519720 - protein, 13 aa, Mycobacterium
LGEDEATDGDYSE

SEQ ID NO: 519721 - protein, 13 aa, Mycobacterium
LGEDEATDQDYSE

SEQ ID NO: 519722 - protein, 13 aa, Mycobacterium
LGEDGATDQDYSE

SEQ ID NO: 519723 - protein, 8 aa, Mycobacterium
LGEDGKPL

SEQ ID NO: 519724 - protein, 8 aa, Mycobacterium
LGEDGKPV

SEQ ID NO: 519725 - protein, 10 aa, Mycobacterium
LGEDGRSPWP

SEQ ID NO: 519726 - protein, 7 aa, Mycobacterium
LGEDPAQ

SEQ ID NO: 519727 - protein, 9 aa, Mycobacterium
LGEDPHSPR

SEQ ID NO: 519728 - protein, 13 aa, Mycobacterium
LGEDQATDADYSE

SEQ ID NO: 519729 - protein, 10 aa, Mycobacterium
LGEDRIDPAP

SEQ ID NO: 519730 - protein, 11 aa, Mycobacterium
LGEDRSAAAAL

SEQ ID NO: 519731 - protein, 11 aa, Mycobacterium
LGEDRVDPAPV

SEQ ID NO: 519732 - protein, 9 aa, Mycobacterium
LGEDSDQLA

SEQ ID NO: 519733 - protein, 7 aa, Mycobacterium
LGEDYPA

SEQ ID NO: 519734 - protein, 9 aa, Mycobacterium
LGEEAEPAY

SEQ ID NO: 519735 - protein, 14 aa, Mycobacterium
LGEEDASAADTAQI

SEQ ID NO: 519736 - protein, 22 aa, Mycobacterium
LGEEDGESAGGSLSGRSGQPSG

SEQ ID NO: 519737 - protein, 7 aa, Mycobacterium
LGEEDKA

SEQ ID NO: 519738 - protein, 16 aa, Mycobacterium
LGEEGRLGLSDGRAVA

SEQ ID NO: 519739 - protein, 7 aa, Mycobacterium
LGEEGSG

SEQ ID NO: 519740 - protein, 12 aa, Mycobacterium
LGEEITPATPAE

SEQ ID NO: 519741 - protein, 11 aa, Mycobacterium
LGEEITPDTPV

SEQ ID NO: 519742 - protein, 10 aa, Mycobacterium
LGEEITPEAT

SEQ ID NO: 519743 - protein, 11 aa, Mycobacterium
LGEEITPQTSV

SEQ ID NO: 519744 - protein, 13 aa, Mycobacterium
LGEETELRAETDG

SEQ ID NO: 519745 - protein, 4 aa, Mycobacterium
LGEG

SEQ ID NO: 519746 - protein, 16 aa, Mycobacterium
LGEGAARLETDDEGVG

SEQ ID NO: 519747 - protein, 18 aa, Mycobacterium
LGEGATEVQREIIARSLV

SEQ ID NO: 519748 - protein, 5 aa, Mycobacterium
LGEGG

SEQ ID NO: 519749 - protein, 14 aa, Mycobacterium
LGEGGDGGQQRRAV

SEQ ID NO: 519750 - protein, 7 aa, Mycobacterium
LGEGGLP

SEQ ID NO: 519751 - protein, 6 aa, Mycobacterium
LGEGGN

SEQ ID NO: 519752 - protein, 9 aa, Mycobacterium
LGEGPDDLA

SEQ ID NO: 519753 - protein, 7 aa, Mycobacterium
LGEGPDT

SEQ ID NO: 519754 - protein, 6 aa, Mycobacterium
LGEGQF

SEQ ID NO: 519755 - protein, 6 aa, Mycobacterium
LGEGRA

SEQ ID NO: 519756 - protein, 6 aa, Mycobacterium
LGEGSG

SEQ ID NO: 519757 - protein, 16 aa, Mycobacterium
LGEGSMDPDADLGAAG

SEQ ID NO: 519758 - protein, 8 aa, Mycobacterium
LGEGTARP

SEQ ID NO: 519759 - protein, 4 aa, Mycobacterium
LGEH

SEQ ID NO: 519760 - protein, 7 aa, Mycobacterium
LGEHNDE

SEQ ID NO: 519761 - protein, 5 aa, Mycobacterium
LGEHR

SEQ ID NO: 519762 - protein, 7 aa, Mycobacterium
LGEKTVG

SEQ ID NO: 519763 - protein, 20 aa, Mycobacterium
LGELEQATAERPQQRAAQRR

SEQ ID NO: 519764 - protein, 5 aa, Mycobacterium
LGELG

SEQ ID NO: 519765 - protein, 10 aa, Mycobacterium
LGELRSRSNP

SEQ ID NO: 519766 - protein, 6 aa, Mycobacterium
LGENAE

SEQ ID NO: 519767 - protein, 24 aa, Mycobacterium
LGENSDAPTDGGSRPSPADPDDEL

SEQ ID NO: 519768 - protein, 20 aa, Mycobacterium
LGEPAGGPRGGSSSMPHKRN

SEQ ID NO: 519769 - protein, 10 aa, Mycobacterium
LGEPDPQSLD

SEQ ID NO: 519770 - protein, 5 aa, Mycobacterium
LGEPE

SEQ ID NO: 519771 - protein, 8 aa, Mycobacterium
LGEPEATD

SEQ ID NO: 519772 - protein, 7 aa, Mycobacterium
LGEPEDL

SEQ ID NO: 519773 - protein, 13 aa, Mycobacterium
LGEPESGPAKVQV

SEQ ID NO: 519774 - protein, 7 aa, Mycobacterium
LGEPGDG

SEQ ID NO: 519775 - protein, 13 aa, Mycobacterium
LGEPLSAAQTARA

SEQ ID NO: 519776 - protein, 12 aa, Mycobacterium
LGEPLSAEQTAR

SEQ ID NO: 519777 - protein, 13 aa, Mycobacterium
LGEPLSAEQTARA

SEQ ID NO: 519778 - protein, 13 aa, Mycobacterium
LGEPLTAEQTARA

SEQ ID NO: 519779 - protein, 25 aa, Mycobacterium
LGEPNRSKAAQGARSKARAFGWVID

SEQ ID NO: 519780 - protein, 16 aa, Mycobacterium
LGEPPGDAELDEDRRE

SEQ ID NO: 519781 - protein, 14 aa, Mycobacterium
LGEPRPDAPGAASG

SEQ ID NO: 519782 - protein, 9 aa, Mycobacterium
LGEPTPETH

SEQ ID NO: 519783 - protein, 5 aa, Mycobacterium
LGEPV

SEQ ID NO: 519784 - protein, 4 aa, Mycobacterium
LGEQ

SEQ ID NO: 519785 - protein, 7 aa, Mycobacterium
LGEQAAA

SEQ ID NO: 519786 - protein, 8 aa, Mycobacterium
LGEQASAR

SEQ ID NO: 519787 - protein, 5 aa, Mycobacterium
LGEQE

SEQ ID NO: 519788 - protein, 6 aa, Mycobacterium
LGEQPE

SEQ ID NO: 519789 - protein, 11 aa, Mycobacterium
LGEQPGPPSDL

SEQ ID NO: 519790 - protein, 6 aa, Mycobacterium
LGEQPL

SEQ ID NO: 519791 - protein, 8 aa, Mycobacterium
LGEQPTSA

SEQ ID NO: 519792 - protein, 6 aa, Mycobacterium
LGEQSG

SEQ ID NO: 519793 - protein, 16 aa, Mycobacterium
LGEQTATGAEESEPSR

SEQ ID NO: 519794 - protein, 5 aa, Mycobacterium
LGERA

SEQ ID NO: 519795 - protein, 8 aa, Mycobacterium
LGERAADS

SEQ ID NO: 519796 - protein, 9 aa, Mycobacterium
LGERADDAI

SEQ ID NO: 519797 - protein, 7 aa, Mycobacterium
LGERDPN

SEQ ID NO: 519798 - protein, 6 aa, Mycobacterium
LGERET

SEQ ID NO: 519799 - protein, 7 aa, Mycobacterium
LGERGEH

SEQ ID NO: 519800 - protein, 6 aa, Mycobacterium
LGERGG

SEQ ID NO: 519801 - protein, 9 aa, Mycobacterium
LGERGGARD

SEQ ID NO: 519802 - protein, 8 aa, Mycobacterium
LGERPDIQ

SEQ ID NO: 519803 - protein, 11 aa, Mycobacterium
LGERPDVQAQL

SEQ ID NO: 519804 - protein, 7 aa, Mycobacterium
LGERPEG

SEQ ID NO: 519805 - protein, 14 aa, Mycobacterium
LGERPSVPADATRH

SEQ ID NO: 519806 - protein, 12 aa, Mycobacterium
LGERSDTVPADA

SEQ ID NO: 519807 - protein, 4 aa, Mycobacterium
LGES

SEQ ID NO: 519808 - protein, 5 aa, Mycobacterium
LGESA

SEQ ID NO: 519809 - protein, 9 aa, Mycobacterium
LGESAAAVA

SEQ ID NO: 519810 - protein, 6 aa, Mycobacterium
LGESAE

SEQ ID NO: 519811 - protein, 7 aa, Mycobacterium
LGESATY

SEQ ID NO: 519812 - protein, 8 aa, Mycobacterium
LGESEFSR

SEQ ID NO: 519813 - protein, 6 aa, Mycobacterium
LGESGA

SEQ ID NO: 519814 - protein, 11 aa, Mycobacterium
LGESPAQASAD

SEQ ID NO: 519815 - protein, 8 aa, Mycobacterium
LGESPLDP

SEQ ID NO: 519816 - protein, 8 aa, Mycobacterium
LGESPPGD

SEQ ID NO: 519817 - protein, 15 aa, Mycobacterium
LGESTETRGSTALRG

SEQ ID NO: 519818 - protein, 12 aa, Mycobacterium
LGETAPTLKGLS

SEQ ID NO: 519819 - protein, 6 aa, Mycobacterium
LGETEF

SEQ ID NO: 519820 - protein, 19 aa, Mycobacterium
LGETETNDQGDGRDSARAN

SEQ ID NO: 519821 - protein, 6 aa, Mycobacterium
LGETGA

SEQ ID NO: 519822 - protein, 13 aa, Mycobacterium
LGETKTENEEQEL

SEQ ID NO: 519823 - protein, 6 aa, Mycobacterium
LGETRI

SEQ ID NO: 519824 - protein, 36 aa, Mycobacterium
LGETRQTVRASGAPHPLAARPNSDAAPAPPRVNPAR

SEQ ID NO: 519825 - protein, 42 aa, Mycobacterium
LGETRQTVRASPAPHPLAARPNPDAAPAARRVNRAPAKVPYT

SEQ ID NO: 519826 - protein, 16 aa, Mycobacterium
LGETRSNGCSYADSPH

SEQ ID NO: 519827 - protein, 7 aa, Mycobacterium
LGETSAR

SEQ ID NO: 519828 - protein, 6 aa, Mycobacterium
LGETSP

SEQ ID NO: 519829 - protein, 12 aa, Mycobacterium
LGEYERAQPSER

SEQ ID NO: 519830 - protein, 6 aa, Mycobacterium
LGEYQA

SEQ ID NO: 519831 - protein, 8 aa, Mycobacterium
LGGAAGTR

SEQ ID NO: 519832 - protein, 11 aa, Mycobacterium
LGGADAAGFGV

SEQ ID NO: 519833 - protein, 9 aa, Mycobacterium
LGGADAKGG

SEQ ID NO: 519834 - protein, 12 aa, Mycobacterium
LGGADEQAKRGN

SEQ ID NO: 519835 - protein, 7 aa, Mycobacterium
LGGADEV

SEQ ID NO: 519836 - protein, 7 aa, Mycobacterium
LGGADPR

SEQ ID NO: 519837 - protein, 10 aa, Mycobacterium
LGGAEDGEVG

SEQ ID NO: 519838 - protein, 6 aa, Mycobacterium
LGGAEM

SEQ ID NO: 519839 - protein, 9 aa, Mycobacterium
LGGAEQGLN

SEQ ID NO: 519840 - protein, 10 aa, Mycobacterium
LGGAGASARE

SEQ ID NO: 519841 - protein, 38 aa, Mycobacterium
LGGAGGDGGLGGNGGVGGDGAQGGLGGNGGVRNSDNLS

SEQ ID NO: 519842 - protein, 6 aa, Mycobacterium
LGGAGP

SEQ ID NO: 519843 - protein, 6 aa, Mycobacterium
LGGAGR

SEQ ID NO: 519844 - protein, 8 aa, Mycobacterium
LGGAGRST

SEQ ID NO: 519845 - protein, 9 aa, Mycobacterium
LGGAHDDRR

SEQ ID NO: 519846 - protein, 12 aa, Mycobacterium
LGGAPAATAVTD

SEQ ID NO: 519847 - protein, 13 aa, Mycobacterium
LGGAPASTAVTDS

SEQ ID NO: 519848 - protein, 17 aa, Mycobacterium
LGGAPATVDAVSSARPR

SEQ ID NO: 519849 - protein, 9 aa, Mycobacterium
LGGAPSEAM

SEQ ID NO: 519850 - protein, 5 aa, Mycobacterium
LGGAR

SEQ ID NO: 519851 - protein, 6 aa, Mycobacterium
LGGARD

SEQ ID NO: 519852 - protein, 7 aa, Mycobacterium
LGGARRA

SEQ ID NO: 519853 - protein, 18 aa, Mycobacterium
LGGARRTGTAQGGPRSRS

SEQ ID NO: 519854 - protein, 7 aa, Mycobacterium
LGGARSA

SEQ ID NO: 519855 - protein, 9 aa, Mycobacterium
LGGASTVAE

SEQ ID NO: 519856 - protein, 6 aa, Mycobacterium
LGGATA

SEQ ID NO: 519857 - protein, 7 aa, Mycobacterium
LGGATET

SEQ ID NO: 519858 - protein, 10 aa, Mycobacterium
LGGATRPGQV

SEQ ID NO: 519859 - protein, 7 aa, Mycobacterium
LGGATSA

SEQ ID NO: 519860 - protein, 13 aa, Mycobacterium
LGGATSGVGNTSD

SEQ ID NO: 519861 - protein, 8 aa, Mycobacterium
LGGDADSA

SEQ ID NO: 519862 - protein, 7 aa, Mycobacterium
LGGDAGT

SEQ ID NO: 519863 - protein, 10 aa, Mycobacterium
LGGDAQLPGA

SEQ ID NO: 519864 - protein, 21 aa, Mycobacterium
LGGDASDVRASVKPSRPVDTW

SEQ ID NO: 519865 - protein, 5 aa, Mycobacterium
LGGDD

SEQ ID NO: 519866 - protein, 19 aa, Mycobacterium
LGGDDAPADVAGYGPIPAS

SEQ ID NO: 519867 - protein, 6 aa, Mycobacterium
LGGDDD

SEQ ID NO: 519868 - protein, 14 aa, Mycobacterium
LGGDDEAVVYAGTG

SEQ ID NO: 519869 - protein, 7 aa, Mycobacterium
LGGDDFD

SEQ ID NO: 519870 - protein, 9 aa, Mycobacterium
LGGDDQAAE

SEQ ID NO: 519871 - protein, 6 aa, Mycobacterium
LGGDDS

SEQ ID NO: 519872 - protein, 14 aa, Mycobacterium
LGGDEEATVYAGTG

SEQ ID NO: 519873 - protein, 14 aa, Mycobacterium
LGGDEEAVVYAGTG

SEQ ID NO: 519874 - protein, 7 aa, Mycobacterium
LGGDEPV

SEQ ID NO: 519875 - protein, 5 aa, Mycobacterium
LGGDG

SEQ ID NO: 519876 - protein, 9 aa, Mycobacterium
LGGDGGGLL

SEQ ID NO: 519877 - protein, 11 aa, Mycobacterium
LGGDGGSPWPS

SEQ ID NO: 519878 - protein, 25 aa, Mycobacterium
LGGDGGTGGDGGAGGTTGGSGGAGG

SEQ ID NO: 519879 - protein, 12 aa, Mycobacterium
LGGDGGTGGNAG

SEQ ID NO: 519880 - protein, 20 aa, Mycobacterium
LGGDGGTGGQLFGNMGLNGP

SEQ ID NO: 519881 - protein, 6 aa, Mycobacterium
LGGDGK

SEQ ID NO: 519882 - protein, 7 aa, Mycobacterium
LGGDGSR

SEQ ID NO: 519883 - protein, 6 aa, Mycobacterium
LGGDPA

SEQ ID NO: 519884 - protein, 7 aa, Mycobacterium
LGGDPAS

SEQ ID NO: 519885 - protein, 13 aa, Mycobacterium
LGGDPDKVNPLSP

SEQ ID NO: 519886 - protein, 17 aa, Mycobacterium
LGGDPGGPVPAPSSGFG

SEQ ID NO: 519887 - protein, 12 aa, Mycobacterium
LGGDPNKVNPLA

SEQ ID NO: 519888 - protein, 7 aa, Mycobacterium
LGGDPTF

SEQ ID NO: 519889 - protein, 7 aa, Mycobacterium
LGGDPTV

SEQ ID NO: 519890 - protein, 12 aa, Mycobacterium
LGGDRTGDGSGL

SEQ ID NO: 519891 - protein, 10 aa, Mycobacterium
LGGDSANGTQ

SEQ ID NO: 519892 - protein, 22 aa, Mycobacterium
LGGDSESAEPAAPEPEPDPEDE

SEQ ID NO: 519893 - protein, 6 aa, Mycobacterium
LGGDSI

SEQ ID NO: 519894 - protein, 12 aa, Mycobacterium
LGGDTDDARPGW

SEQ ID NO: 519895 - protein, 5 aa, Mycobacterium
LGGEA

SEQ ID NO: 519896 - protein, 7 aa, Mycobacterium
LGGEAAL

SEQ ID NO: 519897 - protein, 15 aa, Mycobacterium
LGGEARTERPDPAGP

SEQ ID NO: 519898 - protein, 7 aa, Mycobacterium
LGGEDPL

SEQ ID NO: 519899 - protein, 10 aa, Mycobacterium
LGGEEDRPQA

SEQ ID NO: 519900 - protein, 5 aa, Mycobacterium
LGGEG

SEQ ID NO: 519901 - protein, 6 aa, Mycobacterium
LGGEGQ

SEQ ID NO: 519902 - protein, 13 aa, Mycobacterium
LGGEGYDVDSGRS

SEQ ID NO: 519903 - protein, 8 aa, Mycobacterium
LGGEPALG

SEQ ID NO: 519904 - protein, 9 aa, Mycobacterium
LGGEPGLGA

SEQ ID NO: 519905 - protein, 11 aa, Mycobacterium
LGGEPHRTAGG

SEQ ID NO: 519906 - protein, 9 aa, Mycobacterium
LGGEQDHRI

SEQ ID NO: 519907 - protein, 25 aa, Mycobacterium
LGGEQRSFRQPVAPRAEPECVQATL

SEQ ID NO: 519908 - protein, 7 aa, Mycobacterium
LGGEQSG

SEQ ID NO: 519909 - protein, 8 aa, Mycobacterium
LGGESDTI

SEQ ID NO: 519910 - protein, 9 aa, Mycobacterium
LGGESTDLV

SEQ ID NO: 519911 - protein, 5 aa, Mycobacterium
LGGEV

SEQ ID NO: 519912 - protein, 5 aa, Mycobacterium
LGGEY

SEQ ID NO: 519913 - protein, 14 aa, Mycobacterium
LGGGAAGSFDGSAD

SEQ ID NO: 519914 - protein, 9 aa, Mycobacterium
LGGGAANAI

SEQ ID NO: 519915 - protein, 7 aa, Mycobacterium
LGGGAHV

SEQ ID NO: 519916 - protein, 9 aa, Mycobacterium
LGGGAPTMA

SEQ ID NO: 519917 - protein, 7 aa, Mycobacterium
LGGGATA

SEQ ID NO: 519918 - protein, 5 aa, Mycobacterium
LGGGD

SEQ ID NO: 519919 - protein, 11 aa, Mycobacterium
LGGGDDPEFTE

SEQ ID NO: 519920 - protein, 11 aa, Mycobacterium
LGGGDEPATIT

SEQ ID NO: 519921 - protein, 11 aa, Mycobacterium
LGGGDGATLAD

SEQ ID NO: 519922 - protein, 12 aa, Mycobacterium
LGGGDGATLADP

SEQ ID NO: 519923 - protein, 8 aa, Mycobacterium
LGGGEQTR

SEQ ID NO: 519924 - protein, 5 aa, Mycobacterium
LGGGG

SEQ ID NO: 519925 - protein, 6 aa, Mycobacterium
LGGGGG

SEQ ID NO: 519926 - protein, 54 aa, Mycobacterium
LGGGGGGGGIGGAPLGEPAGLAGTDSVRPAAAGDIAGAAQGKAAAGSGMGGGGM

SEQ ID NO: 519927 - protein, 114 aa, Mycobacterium
LGGGGTGGSGGAGGAAGDGGDGATGVSGGDGSSGGNGGNPGVGGAGGAGGTGAGGARAADGATGNSPTSGGNGGNGGAGADAIGSGQSGGAGGAGGNGGRVGNGGNGGAGGNGF

SEQ ID NO: 519928 - protein, 6 aa, Mycobacterium
LGGGLP

SEQ ID NO: 519929 - protein, 10 aa, Mycobacterium
LGGGNNGSFN

SEQ ID NO: 519930 - protein, 50 aa, Mycobacterium
LGGGNTGGHNFGSGNTGGHNFGNGNSGNHNVGGGNYGNSNFGSGNIGSGN

SEQ ID NO: 519931 - protein, 7 aa, Mycobacterium
LGGGPTF

SEQ ID NO: 519932 - protein, 13 aa, Mycobacterium
LGGGPVATGVSDS

SEQ ID NO: 519933 - protein, 6 aa, Mycobacterium
LGGGRN

SEQ ID NO: 519934 - protein, 6 aa, Mycobacterium
LGGGRS

SEQ ID NO: 519935 - protein, 8 aa, Mycobacterium
LGGGSGLG

SEQ ID NO: 519936 - protein, 7 aa, Mycobacterium
LGGGSHD

SEQ ID NO: 519937 - protein, 6 aa, Mycobacterium
LGGGSP

SEQ ID NO: 519938 - protein, 6 aa, Mycobacterium
LGGGSS

SEQ ID NO: 519939 - protein, 11 aa, Mycobacterium
LGGGSVSDSGL

SEQ ID NO: 519940 - protein, 11 aa, Mycobacterium
LGGGSVSGDGV

SEQ ID NO: 519941 - protein, 13 aa, Mycobacterium
LGGGTKLSRAENH

SEQ ID NO: 519942 - protein, 15 aa, Mycobacterium
LGGGTRTDVPDPPGP

SEQ ID NO: 519943 - protein, 12 aa, Mycobacterium
LGGHASGRPDNH

SEQ ID NO: 519944 - protein, 7 aa, Mycobacterium
LGGHGNA

SEQ ID NO: 519945 - protein, 6 aa, Mycobacterium
LGGHGS

SEQ ID NO: 519946 - protein, 6 aa, Mycobacterium
LGGHGT

SEQ ID NO: 519947 - protein, 17 aa, Mycobacterium
LGGHKPAVYAPKGALGH

SEQ ID NO: 519948 - protein, 12 aa, Mycobacterium
LGGHPDLGTNNY

SEQ ID NO: 519949 - protein, 15 aa, Mycobacterium
LGGHRPVRAKIVDAD

SEQ ID NO: 519950 - protein, 10 aa, Mycobacterium
LGGKDPGTLG

SEQ ID NO: 519951 - protein, 5 aa, Mycobacterium
LGGKG

SEQ ID NO: 519952 - protein, 6 aa, Mycobacterium
LGGKGA

SEQ ID NO: 519953 - protein, 10 aa, Mycobacterium
LGGKGANQAV

SEQ ID NO: 519954 - protein, 27 aa, Mycobacterium
LGGKGQPTGPAPAGAPAPGQPAMPGPQ

SEQ ID NO: 519955 - protein, 6 aa, Mycobacterium
LGGKSA

SEQ ID NO: 519956 - protein, 15 aa, Mycobacterium
LGGKSKESKPGASGK

SEQ ID NO: 519957 - protein, 7 aa, Mycobacterium
LGGKSPQ

SEQ ID NO: 519958 - protein, 7 aa, Mycobacterium
LGGKTRR

SEQ ID NO: 519959 - protein, 11 aa, Mycobacterium
LGGKVEGTVGP

SEQ ID NO: 519960 - protein, 5 aa, Mycobacterium
LGGLG

SEQ ID NO: 519961 - protein, 15 aa, Mycobacterium
LGGLGGTYASRTLPG

SEQ ID NO: 519962 - protein, 6 aa, Mycobacterium
LGGLTR

SEQ ID NO: 519963 - protein, 7 aa, Mycobacterium
LGGMSSD

SEQ ID NO: 519964 - protein, 17 aa, Mycobacterium
LGGNAVRNARDLKAALS

SEQ ID NO: 519965 - protein, 12 aa, Mycobacterium
LGGNEQSRQRHV

SEQ ID NO: 519966 - protein, 5 aa, Mycobacterium
LGGNG

SEQ ID NO: 519967 - protein, 26 aa, Mycobacterium
LGGNGGSGGHGGIGNVGGKGGAGAAG

SEQ ID NO: 519968 - protein, 4 aa, Mycobacterium
LGGP

SEQ ID NO: 519969 - protein, 6 aa, Mycobacterium
LGGPAE

SEQ ID NO: 519970 - protein, 9 aa, Mycobacterium
LGGPDENPF

SEQ ID NO: 519971 - protein, 11 aa, Mycobacterium
LGGPDGEGTGF

SEQ ID NO: 519972 - protein, 7 aa, Mycobacterium
LGGPDRN

SEQ ID NO: 519973 - protein, 6 aa, Mycobacterium
LGGPEA

SEQ ID NO: 519974 - protein, 7 aa, Mycobacterium
LGGPEGR

SEQ ID NO: 519975 - protein, 10 aa, Mycobacterium
LGGPETHHKK

SEQ ID NO: 519976 - protein, 13 aa, Mycobacterium
LGGPGAGERGTEP

SEQ ID NO: 519977 - protein, 7 aa, Mycobacterium
LGGPGAV

SEQ ID NO: 519978 - protein, 6 aa, Mycobacterium
LGGPGF

SEQ ID NO: 519979 - protein, 31 aa, Mycobacterium
LGGPGGAGGDGGDTFGGGSGGAGGAGGDGGW

SEQ ID NO: 519980 - protein, 32 aa, Mycobacterium
LGGPGGESDDWSDDPDDEQSPADADAGELPGT

SEQ ID NO: 519981 - protein, 8 aa, Mycobacterium
LGGPGHPG

SEQ ID NO: 519982 - protein, 17 aa, Mycobacterium
LGGPGLGASGSGPRYGV

SEQ ID NO: 519983 - protein, 11 aa, Mycobacterium
LGGPGRNAAVT

SEQ ID NO: 519984 - protein, 7 aa, Mycobacterium
LGGPGVD

SEQ ID NO: 519985 - protein, 6 aa, Mycobacterium
LGGPIT

SEQ ID NO: 519986 - protein, 5 aa, Mycobacterium
LGGPN

SEQ ID NO: 519987 - protein, 16 aa, Mycobacterium
LGGPPGGPAGNAARAT

SEQ ID NO: 519988 - protein, 10 aa, Mycobacterium
LGGPPTPDDL

SEQ ID NO: 519989 - protein, 12 aa, Mycobacterium
LGGPQDDAVRTT

SEQ ID NO: 519990 - protein, 9 aa, Mycobacterium
LGGPQEGGV

SEQ ID NO: 519991 - protein, 6 aa, Mycobacterium
LGGPQK

SEQ ID NO: 519992 - protein, 7 aa, Mycobacterium
LGGPQTY

SEQ ID NO: 519993 - protein, 7 aa, Mycobacterium
LGGPRAP

SEQ ID NO: 519994 - protein, 7 aa, Mycobacterium
LGGPSAY

SEQ ID NO: 519995 - protein, 17 aa, Mycobacterium
LGGPTQALATADEPVHS

SEQ ID NO: 519996 - protein, 7 aa, Mycobacterium
LGGPTSA

SEQ ID NO: 519997 - protein, 8 aa, Mycobacterium
LGGPTSAE

SEQ ID NO: 519998 - protein, 9 aa, Mycobacterium
LGGPTSSEI

SEQ ID NO: 519999 - protein, 4 aa, Mycobacterium
LGGQ

SEQ ID NO: 520000 - protein, 5 aa, Mycobacterium
LGGQA

SEQ ID NO: 520001 - protein, 5 aa, Mycobacterium
LGGQE

SEQ ID NO: 520002 - protein, 8 aa, Mycobacterium
LGGQGGEL

SEQ ID NO: 520003 - protein, 10 aa, Mycobacterium
LGGQGNTEDS

SEQ ID NO: 520004 - protein, 7 aa, Mycobacterium
LGGQGRL

SEQ ID NO: 520005 - protein, 7 aa, Mycobacterium
LGGQGYG

SEQ ID NO: 520006 - protein, 19 aa, Mycobacterium
LGGQNNTVSAETGTGGANI

SEQ ID NO: 520007 - protein, 5 aa, Mycobacterium
LGGQS

SEQ ID NO: 520008 - protein, 9 aa, Mycobacterium
LGGQSGARV

SEQ ID NO: 520009 - protein, 7 aa, Mycobacterium
LGGQTAL

SEQ ID NO: 520010 - protein, 8 aa, Mycobacterium
LGGQTALN

SEQ ID NO: 520011 - protein, 5 aa, Mycobacterium
LGGRA

SEQ ID NO: 520012 - protein, 16 aa, Mycobacterium
LGGRAGDADARDAEVT

SEQ ID NO: 520013 - protein, 18 aa, Mycobacterium
LGGRAGDASAKDSEVSAV

SEQ ID NO: 520014 - protein, 15 aa, Mycobacterium
LGGRAGDPAARDAEV

SEQ ID NO: 520015 - protein, 13 aa, Mycobacterium
LGGRAGDPTARDA

SEQ ID NO: 520016 - protein, 7 aa, Mycobacterium
LGGRAGY

SEQ ID NO: 520017 - protein, 6 aa, Mycobacterium
LGGRDA

SEQ ID NO: 520018 - protein, 8 aa, Mycobacterium
LGGRDPHA

SEQ ID NO: 520019 - protein, 16 aa, Mycobacterium
LGGREPVRRSGATPGS

SEQ ID NO: 520020 - protein, 7 aa, Mycobacterium
LGGRGRS

SEQ ID NO: 520021 - protein, 14 aa, Mycobacterium
LGGRNLDPEKYARD

SEQ ID NO: 520022 - protein, 7 aa, Mycobacterium
LGGRPPY

SEQ ID NO: 520023 - protein, 11 aa, Mycobacterium
LGGRQDAQAQL

SEQ ID NO: 520024 - protein, 12 aa, Mycobacterium
LGGRRATSAKLP

SEQ ID NO: 520025 - protein, 11 aa, Mycobacterium
LGGRRRLPAGT

SEQ ID NO: 520026 - protein, 14 aa, Mycobacterium
LGGRSNSGEGGEDV

SEQ ID NO: 520027 - protein, 9 aa, Mycobacterium
LGGRTGAGG

SEQ ID NO: 520028 - protein, 18 aa, Mycobacterium
LGGRTKPLALPENAQNGA

SEQ ID NO: 520029 - protein, 4 aa, Mycobacterium
LGGS

SEQ ID NO: 520030 - protein, 8 aa, Mycobacterium
LGGSAASD

SEQ ID NO: 520031 - protein, 19 aa, Mycobacterium
LGGSAISAGLGEANSISGL

SEQ ID NO: 520032 - protein, 11 aa, Mycobacterium
LGGSASDVQPD

SEQ ID NO: 520033 - protein, 10 aa, Mycobacterium
LGGSDDPSNL

SEQ ID NO: 520034 - protein, 12 aa, Mycobacterium
LGGSDEADHDQV

SEQ ID NO: 520035 - protein, 12 aa, Mycobacterium
LGGSDEDETAWR

SEQ ID NO: 520036 - protein, 6 aa, Mycobacterium
LGGSDR

SEQ ID NO: 520037 - protein, 12 aa, Mycobacterium
LGGSEGDWGDGS

SEQ ID NO: 520038 - protein, 13 aa, Mycobacterium
LGGSERSGQQEMA

SEQ ID NO: 520039 - protein, 6 aa, Mycobacterium
LGGSGG

SEQ ID NO: 520040 - protein, 11 aa, Mycobacterium
LGGSGGLAGHP

SEQ ID NO: 520041 - protein, 13 aa, Mycobacterium
LGGSGKLETTVSD

SEQ ID NO: 520042 - protein, 17 aa, Mycobacterium
LGGSGWSSDPLASPQLR

SEQ ID NO: 520043 - protein, 8 aa, Mycobacterium
LGGSKGIE

SEQ ID NO: 520044 - protein, 16 aa, Mycobacterium
LGGSNEGEGADAGPAH

SEQ ID NO: 520045 - protein, 9 aa, Mycobacterium
LGGSNPDGR

SEQ ID NO: 520046 - protein, 7 aa, Mycobacterium
LGGSPPY

SEQ ID NO: 520047 - protein, 7 aa, Mycobacterium
LGGSPTA

SEQ ID NO: 520048 - protein, 15 aa, Mycobacterium
LGGSRAQGTHRPDSD

SEQ ID NO: 520049 - protein, 13 aa, Mycobacterium
LGGSRDGTGAGHN

SEQ ID NO: 520050 - protein, 6 aa, Mycobacterium
LGGSSN

SEQ ID NO: 520051 - protein, 14 aa, Mycobacterium
LGGSSSRRADGAYR

SEQ ID NO: 520052 - protein, 14 aa, Mycobacterium
LGGSSSRRADGTYR

SEQ ID NO: 520053 - protein, 15 aa, Mycobacterium
LGGSTKINPSGGALA

SEQ ID NO: 520054 - protein, 9 aa, Mycobacterium
LGGSTVPAA

SEQ ID NO: 520055 - protein, 6 aa, Mycobacterium
LGGTAG

SEQ ID NO: 520056 - protein, 24 aa, Mycobacterium
LGGTALRPAPVGAYPAGASAYGAE

SEQ ID NO: 520057 - protein, 8 aa, Mycobacterium
LGGTAPKR

SEQ ID NO: 520058 - protein, 13 aa, Mycobacterium
LGGTDLPTTKAET

SEQ ID NO: 520059 - protein, 21 aa, Mycobacterium
LGGTDPKASAAPRRRPPTRDP

SEQ ID NO: 520060 - protein, 9 aa, Mycobacterium
LGGTERAGQ

SEQ ID NO: 520061 - protein, 6 aa, Mycobacterium
LGGTGD

SEQ ID NO: 520062 - protein, 10 aa, Mycobacterium
LGGTGEQYSG

SEQ ID NO: 520063 - protein, 35 aa, Mycobacterium
LGGTGGTGGNGGNGGAGGAGGGLGGQGGVGGTGGV

SEQ ID NO: 520064 - protein, 14 aa, Mycobacterium
LGGTGQLESTVSDE

SEQ ID NO: 520065 - protein, 8 aa, Mycobacterium
LGGTLTDG

SEQ ID NO: 520066 - protein, 9 aa, Mycobacterium
LGGTPGKGF

SEQ ID NO: 520067 - protein, 8 aa, Mycobacterium
LGGTPGQG

SEQ ID NO: 520068 - protein, 9 aa, Mycobacterium
LGGTPPKVD

SEQ ID NO: 520069 - protein, 7 aa, Mycobacterium
LGGTPPY

SEQ ID NO: 520070 - protein, 12 aa, Mycobacterium
LGGTPRPSSPVA

SEQ ID NO: 520071 - protein, 7 aa, Mycobacterium
LGGTPRW

SEQ ID NO: 520072 - protein, 7 aa, Mycobacterium
LGGTQRL

SEQ ID NO: 520073 - protein, 13 aa, Mycobacterium
LGGTRTAKAVSKR

SEQ ID NO: 520074 - protein, 5 aa, Mycobacterium
LGGTT

SEQ ID NO: 520075 - protein, 6 aa, Mycobacterium
LGGTTV

SEQ ID NO: 520076 - protein, 4 aa, Mycobacterium
LGGV

SEQ ID NO: 520077 - protein, 9 aa, Mycobacterium
LGGVETPSV

SEQ ID NO: 520078 - protein, 21 aa, Mycobacterium
LGGVGGSGNVGGNGGAGGAGG

SEQ ID NO: 520079 - protein, 21 aa, Mycobacterium
LGGVPGSDNGFHTDPKTGLLT

SEQ ID NO: 520080 - protein, 7 aa, Mycobacterium
LGGYGQS

SEQ ID NO: 520081 - protein, 9 aa, Mycobacterium
LGHAGQGAL

SEQ ID NO: 520082 - protein, 5 aa, Mycobacterium
LGHAP

SEQ ID NO: 520083 - protein, 7 aa, Mycobacterium
LGHDPRD

SEQ ID NO: 520084 - protein, 13 aa, Mycobacterium
LGHDRDGNGGMDG

SEQ ID NO: 520085 - protein, 13 aa, Mycobacterium
LGHDSDGNGGMPG

SEQ ID NO: 520086 - protein, 18 aa, Mycobacterium
LGHETADAANEFADPYQV

SEQ ID NO: 520087 - protein, 4 aa, Mycobacterium
LGHP

SEQ ID NO: 520088 - protein, 6 aa, Mycobacterium
LGHPAG

SEQ ID NO: 520089 - protein, 11 aa, Mycobacterium
LGHPAPSNGDL

SEQ ID NO: 520090 - protein, 8 aa, Mycobacterium
LGHPEAQA

SEQ ID NO: 520091 - protein, 9 aa, Mycobacterium
LGHPPPSCG

SEQ ID NO: 520092 - protein, 9 aa, Mycobacterium
LGHPQPSCG

SEQ ID NO: 520093 - protein, 14 aa, Mycobacterium
LGHPQPSSGDLTPW

SEQ ID NO: 520094 - protein, 27 aa, Mycobacterium
LGHPQRDPHGDPIPGPDGQVPTPPARQ

SEQ ID NO: 520095 - protein, 5 aa, Mycobacterium
LGHPR

SEQ ID NO: 520096 - protein, 7 aa, Mycobacterium
LGHPSGL

SEQ ID NO: 520097 - protein, 26 aa, Mycobacterium
LGHPTRDPHGDPIPAADGQVPTPPAR

SEQ ID NO: 520098 - protein, 4 aa, Mycobacterium
LGHR

SEQ ID NO: 520099 - protein, 5 aa, Mycobacterium
LGHSG

SEQ ID NO: 520100 - protein, 4 aa, Mycobacterium
LGHT

SEQ ID NO: 520101 - protein, 12 aa, Mycobacterium
LGIEPQGPLRSM

SEQ ID NO: 520102 - protein, 5 aa, Mycobacterium
LGIES

SEQ ID NO: 520103 - protein, 5 aa, Mycobacterium
LGING

SEQ ID NO: 520104 - protein, 5 aa, Mycobacterium
LGIPE

SEQ ID NO: 520105 - protein, 13 aa, Mycobacterium
LGIPGPGPDGRPR

SEQ ID NO: 520106 - protein, 5 aa, Mycobacterium
LGISR

SEQ ID NO: 520107 - protein, 7 aa, Mycobacterium
LGKAGQT

SEQ ID NO: 520108 - protein, 10 aa, Mycobacterium
LGKAPQRGTQ

SEQ ID NO: 520109 - protein, 6 aa, Mycobacterium
LGKEDI

SEQ ID NO: 520110 - protein, 12 aa, Mycobacterium
LGKENSSRPRYD

SEQ ID NO: 520111 - protein, 11 aa, Mycobacterium
LGKETAGMSPA

SEQ ID NO: 520112 - protein, 6 aa, Mycobacterium
LGKGDS

SEQ ID NO: 520113 - protein, 7 aa, Mycobacterium
LGKGEFS

SEQ ID NO: 520114 - protein, 9 aa, Mycobacterium
LGKGLTASS

SEQ ID NO: 520115 - protein, 10 aa, Mycobacterium
LGKGLTASSL

SEQ ID NO: 520116 - protein, 8 aa, Mycobacterium
LGKGRTAR

SEQ ID NO: 520117 - protein, 7 aa, Mycobacterium
LGKGSAV

SEQ ID NO: 520118 - protein, 13 aa, Mycobacterium
LGKITQEQRSSEY

SEQ ID NO: 520119 - protein, 4 aa, Mycobacterium
LGKP

SEQ ID NO: 520120 - protein, 9 aa, Mycobacterium
LGKPDKKAV

SEQ ID NO: 520121 - protein, 13 aa, Mycobacterium
LGKPDYGLPAAQE

SEQ ID NO: 520122 - protein, 8 aa, Mycobacterium
LGKPGRAR

SEQ ID NO: 520123 - protein, 13 aa, Mycobacterium
LGKPNYAQPVKKV

SEQ ID NO: 520124 - protein, 17 aa, Mycobacterium
LGKPPGGSAVTVEPGGA

SEQ ID NO: 520125 - protein, 17 aa, Mycobacterium
LGKRRDSSASTLSGGER

SEQ ID NO: 520126 - protein, 8 aa, Mycobacterium
LGKSAPEI

SEQ ID NO: 520127 - protein, 11 aa, Mycobacterium
LGKSPKGTPGA

SEQ ID NO: 520128 - protein, 4 aa, Mycobacterium
LGKT

SEQ ID NO: 520129 - protein, 7 aa, Mycobacterium
LGKTAEQ

SEQ ID NO: 520130 - protein, 8 aa, Mycobacterium
LGKTAGEI

SEQ ID NO: 520131 - protein, 5 aa, Mycobacterium
LGKTQ

SEQ ID NO: 520132 - protein, 22 aa, Mycobacterium
LGLANSGNGNLGGFNSGGGTSA

SEQ ID NO: 520133 - protein, 9 aa, Mycobacterium
LGLEDGSKP

SEQ ID NO: 520134 - protein, 18 aa, Mycobacterium
LGLGGTNPAQVTTTTLTE

SEQ ID NO: 520135 - protein, 6 aa, Mycobacterium
LGLPAD

SEQ ID NO: 520136 - protein, 8 aa, Mycobacterium
LGLPDDAA

SEQ ID NO: 520137 - protein, 8 aa, Mycobacterium
LGLPDDTK

SEQ ID NO: 520138 - protein, 13 aa, Mycobacterium
LGLPDESYYREEQ

SEQ ID NO: 520139 - protein, 8 aa, Mycobacterium
LGLPDGAK

SEQ ID NO: 520140 - protein, 8 aa, Mycobacterium
LGLPDSAK

SEQ ID NO: 520141 - protein, 16 aa, Mycobacterium
LGLPKPANGDLTPWSE

SEQ ID NO: 520142 - protein, 9 aa, Mycobacterium
LGLPPPAAL

SEQ ID NO: 520143 - protein, 8 aa, Mycobacterium
LGLPPSQV

SEQ ID NO: 520144 - protein, 10 aa, Mycobacterium
LGLPSDERSL

SEQ ID NO: 520145 - protein, 9 aa, Mycobacterium
LGLPTDPAK

SEQ ID NO: 520146 - protein, 10 aa, Mycobacterium
LGLSTGGYTR

SEQ ID NO: 520147 - protein, 4 aa, Mycobacterium
LGLT

SEQ ID NO: 520148 - protein, 5 aa, Mycobacterium
LGLTG

SEQ ID NO: 520149 - protein, 12 aa, Mycobacterium
LGLTPSRLDTQA

SEQ ID NO: 520150 - protein, 14 aa, Mycobacterium
LGNAPALPGPSSEV

SEQ ID NO: 520151 - protein, 5 aa, Mycobacterium
LGNAR

SEQ ID NO: 520152 - protein, 6 aa, Mycobacterium
LGNARA

SEQ ID NO: 520153 - protein, 4 aa, Mycobacterium
LGND

SEQ ID NO: 520154 - protein, 6 aa, Mycobacterium
LGNDGQ

SEQ ID NO: 520155 - protein, 4 aa, Mycobacterium
LGNE

SEQ ID NO: 520156 - protein, 7 aa, Mycobacterium
LGNEEQP

SEQ ID NO: 520157 - protein, 8 aa, Mycobacterium
LGNEGDGW

SEQ ID NO: 520158 - protein, 9 aa, Mycobacterium
LGNEHERRE

SEQ ID NO: 520159 - protein, 15 aa, Mycobacterium
LGNEPQDVLMFGKAV

SEQ ID NO: 520160 - protein, 12 aa, Mycobacterium
LGNGAVQATVST

SEQ ID NO: 520161 - protein, 7 aa, Mycobacterium
LGNGEPV

SEQ ID NO: 520162 - protein, 44 aa, Mycobacterium
LGNGGAGGAGGNGGDGGGYVTSGNAPRGGGNGGEAGDGGLGGSA

SEQ ID NO: 520163 - protein, 7 aa, Mycobacterium
LGNGGDV

SEQ ID NO: 520164 - protein, 8 aa, Mycobacterium
LGNGGTAY

SEQ ID NO: 520165 - protein, 23 aa, Mycobacterium
LGNGGTGGAGGAGANGGAGGSAG

SEQ ID NO: 520166 - protein, 19 aa, Mycobacterium
LGNGNLGSANIGNTNFGTA

SEQ ID NO: 520167 - protein, 12 aa, Mycobacterium
LGNGRPTEINGT

SEQ ID NO: 520168 - protein, 14 aa, Mycobacterium
LGNHANASSEVEYD

SEQ ID NO: 520169 - protein, 18 aa, Mycobacterium
LGNHGDTVRATSRSLPPA

SEQ ID NO: 520170 - protein, 6 aa, Mycobacterium
LGNKEI

SEQ ID NO: 520171 - protein, 17 aa, Mycobacterium
LGNKGNANLGSGNTGIG

SEQ ID NO: 520172 - protein, 4 aa, Mycobacterium
LGNP

SEQ ID NO: 520173 - protein, 6 aa, Mycobacterium
LGNPAT

SEQ ID NO: 520174 - protein, 15 aa, Mycobacterium
LGNPDPAETYSSSPH

SEQ ID NO: 520175 - protein, 22 aa, Mycobacterium
LGNPDWADDPALDTHQGRAEAH

SEQ ID NO: 520176 - protein, 6 aa, Mycobacterium
LGNPEE

SEQ ID NO: 520177 - protein, 7 aa, Mycobacterium
LGNPEEF

SEQ ID NO: 520178 - protein, 10 aa, Mycobacterium
LGNPKDNRAA

SEQ ID NO: 520179 - protein, 23 aa, Mycobacterium
LGNPSSGHAAGRAAADALRDARR

SEQ ID NO: 520180 - protein, 9 aa, Mycobacterium
LGNPSWQSS

SEQ ID NO: 520181 - protein, 6 aa, Mycobacterium
LGNPTA

SEQ ID NO: 520182 - protein, 7 aa, Mycobacterium
LGNQEEV

SEQ ID NO: 520183 - protein, 6 aa, Mycobacterium
LGNQGD

SEQ ID NO: 520184 - protein, 14 aa, Mycobacterium
LGNQGSGRGSLGEE

SEQ ID NO: 520185 - protein, 15 aa, Mycobacterium
LGNQPDGAVLVDQSG

SEQ ID NO: 520186 - protein, 10 aa, Mycobacterium
LGNQRPGSLR

SEQ ID NO: 520187 - protein, 16 aa, Mycobacterium
LGNRADVASRITAVLD

SEQ ID NO: 520188 - protein, 16 aa, Mycobacterium
LGNRAGSSAQDATEVA

SEQ ID NO: 520189 - protein, 7 aa, Mycobacterium
LGNRPDG

SEQ ID NO: 520190 - protein, 14 aa, Mycobacterium
LGNRPDGAVLVDQS

SEQ ID NO: 520191 - protein, 15 aa, Mycobacterium
LGNRPDGAVLVDRSE

SEQ ID NO: 520192 - protein, 8 aa, Mycobacterium
LGNSGDNN

SEQ ID NO: 520193 - protein, 19 aa, Mycobacterium
LGNSGSNNVGFGNTGNGNI

SEQ ID NO: 520194 - protein, 6 aa, Mycobacterium
LGNSGV

SEQ ID NO: 520195 - protein, 6 aa, Mycobacterium
LGNSPA

SEQ ID NO: 520196 - protein, 4 aa, Mycobacterium
LGNT

SEQ ID NO: 520197 - protein, 8 aa, Mycobacterium
LGNTASKP

SEQ ID NO: 520198 - protein, 7 aa, Mycobacterium
LGNTEEV

SEQ ID NO: 520199 - protein, 16 aa, Mycobacterium
LGNTGHELSGFLNDAM

SEQ ID NO: 520200 - protein, 12 aa, Mycobacterium
LGNTRARTRTGA

SEQ ID NO: 520201 - protein, 4 aa, Mycobacterium
LGPA

SEQ ID NO: 520202 - protein, 10 aa, Mycobacterium
LGPAAARESY

SEQ ID NO: 520203 - protein, 7 aa, Mycobacterium
LGPAAGE

SEQ ID NO: 520204 - protein, 9 aa, Mycobacterium
LGPAANTTA

SEQ ID NO: 520205 - protein, 9 aa, Mycobacterium
LGPAAPTAS

SEQ ID NO: 520206 - protein, 10 aa, Mycobacterium
LGPAARPLQR

SEQ ID NO: 520207 - protein, 7 aa, Mycobacterium
LGPAATL

SEQ ID NO: 520208 - protein, 5 aa, Mycobacterium
LGPAD

SEQ ID NO: 520209 - protein, 7 aa, Mycobacterium
LGPADDE

SEQ ID NO: 520210 - protein, 6 aa, Mycobacterium
LGPADR

SEQ ID NO: 520211 - protein, 9 aa, Mycobacterium
LGPADVSDL

SEQ ID NO: 520212 - protein, 20 aa, Mycobacterium
LGPAEKAPKGASRDGRRRPT

SEQ ID NO: 520213 - protein, 5 aa, Mycobacterium
LGPAG

SEQ ID NO: 520214 - protein, 6 aa, Mycobacterium
LGPAHT

SEQ ID NO: 520215 - protein, 6 aa, Mycobacterium
LGPALT

SEQ ID NO: 520216 - protein, 8 aa, Mycobacterium
LGPAPNHG

SEQ ID NO: 520217 - protein, 59 aa, Mycobacterium
LGPAPSEGPKPKPPGGKQKHDKWSGSSQPAEGSSAKWSEDGDAGLDGAAAEGNGGDQHD

SEQ ID NO: 520218 - protein, 9 aa, Mycobacterium
LGPARATAS

SEQ ID NO: 520219 - protein, 7 aa, Mycobacterium
LGPARDG

SEQ ID NO: 520220 - protein, 5 aa, Mycobacterium
LGPAS

SEQ ID NO: 520221 - protein, 9 aa, Mycobacterium
LGPASPERV

SEQ ID NO: 520222 - protein, 9 aa, Mycobacterium
LGPATAGQI

SEQ ID NO: 520223 - protein, 8 aa, Mycobacterium
LGPATDDE

SEQ ID NO: 520224 - protein, 13 aa, Mycobacterium
LGPAVDERCGPPL

SEQ ID NO: 520225 - protein, 12 aa, Mycobacterium
LGPAYGGENAEF

SEQ ID NO: 520226 - protein, 6 aa, Mycobacterium
LGPDAL

SEQ ID NO: 520227 - protein, 10 aa, Mycobacterium
LGPDAPEQVT

SEQ ID NO: 520228 - protein, 8 aa, Mycobacterium
LGPDATQA

SEQ ID NO: 520229 - protein, 9 aa, Mycobacterium
LGPDATQAV

SEQ ID NO: 520230 - protein, 10 aa, Mycobacterium
LGPDDDPAEV

SEQ ID NO: 520231 - protein, 7 aa, Mycobacterium
LGPDDVA

SEQ ID NO: 520232 - protein, 5 aa, Mycobacterium
LGPDE

SEQ ID NO: 520233 - protein, 12 aa, Mycobacterium
LGPDEIASGRDE

SEQ ID NO: 520234 - protein, 6 aa, Mycobacterium
LGPDEP

SEQ ID NO: 520235 - protein, 11 aa, Mycobacterium
LGPDGGPGVAD

SEQ ID NO: 520236 - protein, 16 aa, Mycobacterium
LGPDGKPLTDKGELEL

SEQ ID NO: 520237 - protein, 12 aa, Mycobacterium
LGPDGLGNSPEH

SEQ ID NO: 520238 - protein, 9 aa, Mycobacterium
LGPDGTPLP

SEQ ID NO: 520239 - protein, 12 aa, Mycobacterium
LGPDNKPVGTRS

SEQ ID NO: 520240 - protein, 5 aa, Mycobacterium
LGPDP

SEQ ID NO: 520241 - protein, 8 aa, Mycobacterium
LGPDPAAT

SEQ ID NO: 520242 - protein, 14 aa, Mycobacterium
LGPDPLRNDADPSW

SEQ ID NO: 520243 - protein, 9 aa, Mycobacterium
LGPDPVGEG

SEQ ID NO: 520244 - protein, 6 aa, Mycobacterium
LGPDRG

SEQ ID NO: 520245 - protein, 9 aa, Mycobacterium
LGPDRVKPG

SEQ ID NO: 520246 - protein, 10 aa, Mycobacterium
LGPDRVKPGD

SEQ ID NO: 520247 - protein, 6 aa, Mycobacterium
LGPDSD

SEQ ID NO: 520248 - protein, 5 aa, Mycobacterium
LGPDT

SEQ ID NO: 520249 - protein, 7 aa, Mycobacterium
LGPDTAK

SEQ ID NO: 520250 - protein, 10 aa, Mycobacterium
LGPDTETVRN

SEQ ID NO: 520251 - protein, 11 aa, Mycobacterium
LGPDTETVRNR

SEQ ID NO: 520252 - protein, 10 aa, Mycobacterium
LGPDTVRPAS

SEQ ID NO: 520253 - protein, 6 aa, Mycobacterium
LGPDTY

SEQ ID NO: 520254 - protein, 6 aa, Mycobacterium
LGPEAG

SEQ ID NO: 520255 - protein, 9 aa, Mycobacterium
LGPEARRSG

SEQ ID NO: 520256 - protein, 15 aa, Mycobacterium
LGPEARTEQPDPPGP

SEQ ID NO: 520257 - protein, 5 aa, Mycobacterium
LGPED

SEQ ID NO: 520258 - protein, 12 aa, Mycobacterium
LGPEDENLAPDG

SEQ ID NO: 520259 - protein, 8 aa, Mycobacterium
LGPEDPAV

SEQ ID NO: 520260 - protein, 6 aa, Mycobacterium
LGPEEA

SEQ ID NO: 520261 - protein, 8 aa, Mycobacterium
LGPEGGGV

SEQ ID NO: 520262 - protein, 7 aa, Mycobacterium
LGPEGKD

SEQ ID NO: 520263 - protein, 12 aa, Mycobacterium
LGPEGQAGPSLE

SEQ ID NO: 520264 - protein, 5 aa, Mycobacterium
LGPEP

SEQ ID NO: 520265 - protein, 7 aa, Mycobacterium
LGPEPDD

SEQ ID NO: 520266 - protein, 7 aa, Mycobacterium
LGPEPSD

SEQ ID NO: 520267 - protein, 6 aa, Mycobacterium
LGPEQA

SEQ ID NO: 520268 - protein, 6 aa, Mycobacterium
LGPEQC

SEQ ID NO: 520269 - protein, 6 aa, Mycobacterium
LGPERA

SEQ ID NO: 520270 - protein, 6 aa, Mycobacterium
LGPERL

SEQ ID NO: 520271 - protein, 8 aa, Mycobacterium
LGPERVKP

SEQ ID NO: 520272 - protein, 9 aa, Mycobacterium
LGPERVKPG

SEQ ID NO: 520273 - protein, 9 aa, Mycobacterium
LGPESAVAG

SEQ ID NO: 520274 - protein, 7 aa, Mycobacterium
LGPESGF

SEQ ID NO: 520275 - protein, 5 aa, Mycobacterium
LGPEV

SEQ ID NO: 520276 - protein, 11 aa, Mycobacterium
LGPEVDGWSEG

SEQ ID NO: 520277 - protein, 11 aa, Mycobacterium
LGPEVTGWDEG

SEQ ID NO: 520278 - protein, 8 aa, Mycobacterium
LGPEYGDW

SEQ ID NO: 520279 - protein, 4 aa, Mycobacterium
LGPF

SEQ ID NO: 520280 - protein, 8 aa, Mycobacterium
LGPFPTDR

SEQ ID NO: 520281 - protein, 5 aa, Mycobacterium
LGPGA

SEQ ID NO: 520282 - protein, 9 aa, Mycobacterium
LGPGADERR

SEQ ID NO: 520283 - protein, 12 aa, Mycobacterium
LGPGAGDNAAAA

SEQ ID NO: 520284 - protein, 15 aa, Mycobacterium
LGPGARTETPDPPGP

SEQ ID NO: 520285 - protein, 7 aa, Mycobacterium
LGPGATV

SEQ ID NO: 520286 - protein, 5 aa, Mycobacterium
LGPGD

SEQ ID NO: 520287 - protein, 8 aa, Mycobacterium
LGPGDEFE

SEQ ID NO: 520288 - protein, 18 aa, Mycobacterium
LGPGDSDWMTPQSRRELA

SEQ ID NO: 520289 - protein, 6 aa, Mycobacterium
LGPGDT

SEQ ID NO: 520290 - protein, 15 aa, Mycobacterium
LGPGDTAGRPRGLGD

SEQ ID NO: 520291 - protein, 7 aa, Mycobacterium
LGPGDTD

SEQ ID NO: 520292 - protein, 5 aa, Mycobacterium
LGPGE

SEQ ID NO: 520293 - protein, 9 aa, Mycobacterium
LGPGEGGGW

SEQ ID NO: 520294 - protein, 10 aa, Mycobacterium
LGPGEQYRTR

SEQ ID NO: 520295 - protein, 12 aa, Mycobacterium
LGPGGGDDGGTV

SEQ ID NO: 520296 - protein, 7 aa, Mycobacterium
LGPGGLD

SEQ ID NO: 520297 - protein, 6 aa, Mycobacterium
LGPGGP

SEQ ID NO: 520298 - protein, 5 aa, Mycobacterium
LGPGK

SEQ ID NO: 520299 - protein, 8 aa, Mycobacterium
LGPGKDKQ

SEQ ID NO: 520300 - protein, 12 aa, Mycobacterium
LGPGKNAAYETE

SEQ ID NO: 520301 - protein, 5 aa, Mycobacterium
LGPGP

SEQ ID NO: 520302 - protein, 7 aa, Mycobacterium
LGPGPAD

SEQ ID NO: 520303 - protein, 9 aa, Mycobacterium
LGPGPDGAG

SEQ ID NO: 520304 - protein, 15 aa, Mycobacterium
LGPGPSRPADEPLYD

SEQ ID NO: 520305 - protein, 17 aa, Mycobacterium
LGPGPTQPPTPPLRDPD

SEQ ID NO: 520306 - protein, 6 aa, Mycobacterium
LGPGRT

SEQ ID NO: 520307 - protein, 7 aa, Mycobacterium
LGPGRTG

SEQ ID NO: 520308 - protein, 6 aa, Mycobacterium
LGPGTG

SEQ ID NO: 520309 - protein, 14 aa, Mycobacterium
LGPGTSTSAASQAL

SEQ ID NO: 520310 - protein, 4 aa, Mycobacterium
LGPH

SEQ ID NO: 520311 - protein, 11 aa, Mycobacterium
LGPHAGPVRDG

SEQ ID NO: 520312 - protein, 6 aa, Mycobacterium
LGPHGR

SEQ ID NO: 520313 - protein, 8 aa, Mycobacterium
LGPHGSVG

SEQ ID NO: 520314 - protein, 6 aa, Mycobacterium
LGPKGR

SEQ ID NO: 520315 - protein, 4 aa, Mycobacterium
LGPL

SEQ ID NO: 520316 - protein, 15 aa, Mycobacterium
LGPLAGGLGGFGLPG

SEQ ID NO: 520317 - protein, 9 aa, Mycobacterium
LGPLAGGRT

SEQ ID NO: 520318 - protein, 9 aa, Mycobacterium
LGPLERPPY

SEQ ID NO: 520319 - protein, 19 aa, Mycobacterium
LGPLGPSAGLPGDPGDDRG

SEQ ID NO: 520320 - protein, 11 aa, Mycobacterium
LGPNATDTAVA

SEQ ID NO: 520321 - protein, 10 aa, Mycobacterium
LGPNEGPPTL

SEQ ID NO: 520322 - protein, 15 aa, Mycobacterium
LGPNGPTDSAPGDSS

SEQ ID NO: 520323 - protein, 10 aa, Mycobacterium
LGPNGSGKSS

SEQ ID NO: 520324 - protein, 9 aa, Mycobacterium
LGPNPDAAD

SEQ ID NO: 520325 - protein, 9 aa, Mycobacterium
LGPNPNWDS

SEQ ID NO: 520326 - protein, 11 aa, Mycobacterium
LGPNRWQDQPA

SEQ ID NO: 520327 - protein, 17 aa, Mycobacterium
LGPNSTQERIVVVRADA

SEQ ID NO: 520328 - protein, 9 aa, Mycobacterium
LGPPADPEC

SEQ ID NO: 520329 - protein, 14 aa, Mycobacterium
LGPPASPVPRQPVT

SEQ ID NO: 520330 - protein, 9 aa, Mycobacterium
LGPPDSAAE

SEQ ID NO: 520331 - protein, 24 aa, Mycobacterium
LGPPEKAPKGAGPRAGGRRRSSKP

SEQ ID NO: 520332 - protein, 18 aa, Mycobacterium
LGPPESGARPDGIRDSGG

SEQ ID NO: 520333 - protein, 9 aa, Mycobacterium
LGPPGDWAP

SEQ ID NO: 520334 - protein, 7 aa, Mycobacterium
LGPPGGG

SEQ ID NO: 520335 - protein, 7 aa, Mycobacterium
LGPPKVA

SEQ ID NO: 520336 - protein, 27 aa, Mycobacterium
LGPPMSAAAGGAGPLAAAGAGAGITGG

SEQ ID NO: 520337 - protein, 7 aa, Mycobacterium
LGPPNAG

SEQ ID NO: 520338 - protein, 10 aa, Mycobacterium
LGPPPAEGPG

SEQ ID NO: 520339 - protein, 13 aa, Mycobacterium
LGPPPDFPVPVDR

SEQ ID NO: 520340 - protein, 8 aa, Mycobacterium
LGPPPSDL

SEQ ID NO: 520341 - protein, 6 aa, Mycobacterium
LGPPQL

SEQ ID NO: 520342 - protein, 22 aa, Mycobacterium
LGPPQRAPAGAGKRSDGRRQPS

SEQ ID NO: 520343 - protein, 15 aa, Mycobacterium
LGPPREQLRRLEAEV

SEQ ID NO: 520344 - protein, 11 aa, Mycobacterium
LGPPTGTGSVS

SEQ ID NO: 520345 - protein, 12 aa, Mycobacterium
LGPPTVDSKEKF

SEQ ID NO: 520346 - protein, 6 aa, Mycobacterium
LGPQAL

SEQ ID NO: 520347 - protein, 6 aa, Mycobacterium
LGPQAY

SEQ ID NO: 520348 - protein, 6 aa, Mycobacterium
LGPQDA

SEQ ID NO: 520349 - protein, 6 aa, Mycobacterium
LGPQDC

SEQ ID NO: 520350 - protein, 11 aa, Mycobacterium
LGPQEESPPGI

SEQ ID NO: 520351 - protein, 12 aa, Mycobacterium
LGPQGPNGTSVT

SEQ ID NO: 520352 - protein, 6 aa, Mycobacterium
LGPQKA

SEQ ID NO: 520353 - protein, 8 aa, Mycobacterium
LGPQPAAA

SEQ ID NO: 520354 - protein, 6 aa, Mycobacterium
LGPQPV

SEQ ID NO: 520355 - protein, 5 aa, Mycobacterium
LGPQR

SEQ ID NO: 520356 - protein, 6 aa, Mycobacterium
LGPQTD

SEQ ID NO: 520357 - protein, 10 aa, Mycobacterium
LGPQTPPDIA

SEQ ID NO: 520358 - protein, 8 aa, Mycobacterium
LGPREQAI

SEQ ID NO: 520359 - protein, 7 aa, Mycobacterium
LGPRPGQ

SEQ ID NO: 520360 - protein, 6 aa, Mycobacterium
LGPRST

SEQ ID NO: 520361 - protein, 6 aa, Mycobacterium
LGPRSV

SEQ ID NO: 520362 - protein, 17 aa, Mycobacterium
LGPRTDVRRGADGPDRR

SEQ ID NO: 520363 - protein, 5 aa, Mycobacterium
LGPSA

SEQ ID NO: 520364 - protein, 9 aa, Mycobacterium
LGPSAPTAS

SEQ ID NO: 520365 - protein, 8 aa, Mycobacterium
LGPSAQHR

SEQ ID NO: 520366 - protein, 20 aa, Mycobacterium
LGPSATAATDPCAASEVART

SEQ ID NO: 520367 - protein, 5 aa, Mycobacterium
LGPSD

SEQ ID NO: 520368 - protein, 10 aa, Mycobacterium
LGPSDAKGQL

SEQ ID NO: 520369 - protein, 13 aa, Mycobacterium
LGPSEIKQKNPQA

SEQ ID NO: 520370 - protein, 10 aa, Mycobacterium
LGPSGDGGPP

SEQ ID NO: 520371 - protein, 12 aa, Mycobacterium
LGPSGGNADGEI

SEQ ID NO: 520372 - protein, 9 aa, Mycobacterium
LGPSGKRPA

SEQ ID NO: 520373 - protein, 12 aa, Mycobacterium
LGPSGKRPAAIA

SEQ ID NO: 520374 - protein, 11 aa, Mycobacterium
LGPSGKRPAYI

SEQ ID NO: 520375 - protein, 7 aa, Mycobacterium
LGPSGQV

SEQ ID NO: 520376 - protein, 11 aa, Mycobacterium
LGPSGSGKSTL

SEQ ID NO: 520377 - protein, 10 aa, Mycobacterium
LGPSGSGKTT

SEQ ID NO: 520378 - protein, 14 aa, Mycobacterium
LGPSLSNRGRRSVA

SEQ ID NO: 520379 - protein, 13 aa, Mycobacterium
LGPSLSRRGRRSV

SEQ ID NO: 520380 - protein, 9 aa, Mycobacterium
LGPSPGPGR

SEQ ID NO: 520381 - protein, 5 aa, Mycobacterium
LGPSR

SEQ ID NO: 520382 - protein, 5 aa, Mycobacterium
LGPSS

SEQ ID NO: 520383 - protein, 6 aa, Mycobacterium
LGPSSY

SEQ ID NO: 520384 - protein, 5 aa, Mycobacterium
LGPST

SEQ ID NO: 520385 - protein, 5 aa, Mycobacterium
LGPTA

SEQ ID NO: 520386 - protein, 15 aa, Mycobacterium
LGPTAGLPGNPEDDR

SEQ ID NO: 520387 - protein, 6 aa, Mycobacterium
LGPTAI

SEQ ID NO: 520388 - protein, 5 aa, Mycobacterium
LGPTE

SEQ ID NO: 520389 - protein, 9 aa, Mycobacterium
LGPTEAPLA

SEQ ID NO: 520390 - protein, 6 aa, Mycobacterium
LGPTGA

SEQ ID NO: 520391 - protein, 10 aa, Mycobacterium
LGPTGSGKTT

SEQ ID NO: 520392 - protein, 8 aa, Mycobacterium
LGPTGVGG

SEQ ID NO: 520393 - protein, 6 aa, Mycobacterium
LGPTHT

SEQ ID NO: 520394 - protein, 7 aa, Mycobacterium
LGPTSGA

SEQ ID NO: 520395 - protein, 10 aa, Mycobacterium
LGPTTAAGGW

SEQ ID NO: 520396 - protein, 24 aa, Mycobacterium
LGPTTRTASISPDVNDPGARNVSY

SEQ ID NO: 520397 - protein, 8 aa, Mycobacterium
LGPTTTPE

SEQ ID NO: 520398 - protein, 6 aa, Mycobacterium
LGPTVD

SEQ ID NO: 520399 - protein, 5 aa, Mycobacterium
LGPVA

SEQ ID NO: 520400 - protein, 6 aa, Mycobacterium
LGPVAA

SEQ ID NO: 520401 - protein, 7 aa, Mycobacterium
LGPVDRR

SEQ ID NO: 520402 - protein, 5 aa, Mycobacterium
LGPVP

SEQ ID NO: 520403 - protein, 7 aa, Mycobacterium
LGPVRQP

SEQ ID NO: 520404 - protein, 12 aa, Mycobacterium
LGPVTSDQYRDK

SEQ ID NO: 520405 - protein, 7 aa, Mycobacterium
LGPYTPH

SEQ ID NO: 520406 - protein, 7 aa, Mycobacterium
LGQAKDA

SEQ ID NO: 520407 - protein, 20 aa, Mycobacterium
LGQANPANSPAPAAAAPGGA

SEQ ID NO: 520408 - protein, 9 aa, Mycobacterium
LGQARRGSR

SEQ ID NO: 520409 - protein, 7 aa, Mycobacterium
LGQASGP

SEQ ID NO: 520410 - protein, 13 aa, Mycobacterium
LGQATAGAASPTV

SEQ ID NO: 520411 - protein, 11 aa, Mycobacterium
LGQDARAAEEE

SEQ ID NO: 520412 - protein, 20 aa, Mycobacterium
LGQDARSLAEEARAAAGAIG

SEQ ID NO: 520413 - protein, 12 aa, Mycobacterium
LGQEDPQTARTT

SEQ ID NO: 520414 - protein, 16 aa, Mycobacterium
LGQERSNGCSYADSPH

SEQ ID NO: 520415 - protein, 4 aa, Mycobacterium
LGQG

SEQ ID NO: 520416 - protein, 27 aa, Mycobacterium
LGQGAGQGAGMTTPGLQQPAAPSPAPA

SEQ ID NO: 520417 - protein, 18 aa, Mycobacterium
LGQGDPEHGAEPREDIGE

SEQ ID NO: 520418 - protein, 5 aa, Mycobacterium
LGQGG

SEQ ID NO: 520419 - protein, 8 aa, Mycobacterium
LGQGGTSF

SEQ ID NO: 520420 - protein, 15 aa, Mycobacterium
LGQGHGPVSALFRLA

SEQ ID NO: 520421 - protein, 19 aa, Mycobacterium
LGQGRRGARRQRQDAEPPV

SEQ ID NO: 520422 - protein, 11 aa, Mycobacterium
LGQGRSDDDPL

SEQ ID NO: 520423 - protein, 5 aa, Mycobacterium
LGQHT

SEQ ID NO: 520424 - protein, 6 aa, Mycobacterium
LGQNAA

SEQ ID NO: 520425 - protein, 4 aa, Mycobacterium
LGQP

SEQ ID NO: 520426 - protein, 6 aa, Mycobacterium
LGQPEE

SEQ ID NO: 520427 - protein, 16 aa, Mycobacterium
LGQPGGEQRRQRRFRR

SEQ ID NO: 520428 - protein, 9 aa, Mycobacterium
LGQPPDGNR

SEQ ID NO: 520429 - protein, 8 aa, Mycobacterium
LGQPPSGY

SEQ ID NO: 520430 - protein, 27 aa, Mycobacterium
LGQPRGQRIASEPPANQAGRTQRTRRT

SEQ ID NO: 520431 - protein, 6 aa, Mycobacterium
LGQPRQ

SEQ ID NO: 520432 - protein, 15 aa, Mycobacterium
LGQPRSNGCSYADSP

SEQ ID NO: 520433 - protein, 12 aa, Mycobacterium
LGQQGRAADASA

SEQ ID NO: 520434 - protein, 5 aa, Mycobacterium
LGQQN

SEQ ID NO: 520435 - protein, 6 aa, Mycobacterium
LGQRAA

SEQ ID NO: 520436 - protein, 8 aa, Mycobacterium
LGQRGPTE

SEQ ID NO: 520437 - protein, 5 aa, Mycobacterium
LGQRP

SEQ ID NO: 520438 - protein, 6 aa, Mycobacterium
LGQRSI

SEQ ID NO: 520439 - protein, 4 aa, Mycobacterium
LGQS

SEQ ID NO: 520440 - protein, 6 aa, Mycobacterium
LGQSPG

SEQ ID NO: 520441 - protein, 4 aa, Mycobacterium
LGQT

SEQ ID NO: 520442 - protein, 8 aa, Mycobacterium
LGQTDDPA

SEQ ID NO: 520443 - protein, 5 aa, Mycobacterium
LGQTG

SEQ ID NO: 520444 - protein, 13 aa, Mycobacterium
LGQTKASGQPQAG

SEQ ID NO: 520445 - protein, 13 aa, Mycobacterium
LGQTPGTYAAPVT

SEQ ID NO: 520446 - protein, 20 aa, Mycobacterium
LGQTPRPKLPDAAPGTPTTI

SEQ ID NO: 520447 - protein, 5 aa, Mycobacterium
LGQTR

SEQ ID NO: 520448 - protein, 11 aa, Mycobacterium
LGRAAAPAEIA

SEQ ID NO: 520449 - protein, 9 aa, Mycobacterium
LGRAARGDV

SEQ ID NO: 520450 - protein, 6 aa, Mycobacterium
LGRADD

SEQ ID NO: 520451 - protein, 7 aa, Mycobacterium
LGRADDP

SEQ ID NO: 520452 - protein, 6 aa, Mycobacterium
LGRADG

SEQ ID NO: 520453 - protein, 7 aa, Mycobacterium
LGRAEFP

SEQ ID NO: 520454 - protein, 10 aa, Mycobacterium
LGRAGEPDEV

SEQ ID NO: 520455 - protein, 10 aa, Mycobacterium
LGRAGGDHRR

SEQ ID NO: 520456 - protein, 8 aa, Mycobacterium
LGRAGLTE

SEQ ID NO: 520457 - protein, 8 aa, Mycobacterium
LGRANDRS

SEQ ID NO: 520458 - protein, 10 aa, Mycobacterium
LGRAPNAGEL

SEQ ID NO: 520459 - protein, 7 aa, Mycobacterium
LGRAPRG

SEQ ID NO: 520460 - protein, 10 aa, Mycobacterium
LGRAPTAGEL

SEQ ID NO: 520461 - protein, 9 aa, Mycobacterium
LGRAPTASE

SEQ ID NO: 520462 - protein, 9 aa, Mycobacterium
LGRAPTATE

SEQ ID NO: 520463 - protein, 10 aa, Mycobacterium
LGRAPTPSEL

SEQ ID NO: 520464 - protein, 14 aa, Mycobacterium
LGRAQAAAAQADAL

SEQ ID NO: 520465 - protein, 6 aa, Mycobacterium
LGRATN

SEQ ID NO: 520466 - protein, 4 aa, Mycobacterium
LGRD

SEQ ID NO: 520467 - protein, 5 aa, Mycobacterium
LGRDA

SEQ ID NO: 520468 - protein, 12 aa, Mycobacterium
LGRDAGSATAPQ

SEQ ID NO: 520469 - protein, 10 aa, Mycobacterium
LGRDPAGDGF

SEQ ID NO: 520470 - protein, 11 aa, Mycobacterium
LGRDPAGDGYG

SEQ ID NO: 520471 - protein, 12 aa, Mycobacterium
LGRDPDGVRAEA

SEQ ID NO: 520472 - protein, 12 aa, Mycobacterium
LGRDPDSVRAEA

SEQ ID NO: 520473 - protein, 8 aa, Mycobacterium
LGRDPGQQ

SEQ ID NO: 520474 - protein, 8 aa, Mycobacterium
LGRDPKEI

SEQ ID NO: 520475 - protein, 45 aa, Mycobacterium
LGRDQPAAPPPPPPPPESPAPTSPAGTPPPPGLSGAGAEAAKRLD

SEQ ID NO: 520476 - protein, 10 aa, Mycobacterium
LGRDRTRHQV

SEQ ID NO: 520477 - protein, 9 aa, Mycobacterium
LGRDSDPTV

SEQ ID NO: 520478 - protein, 11 aa, Mycobacterium
LGRDSRAISAA

SEQ ID NO: 520479 - protein, 9 aa, Mycobacterium
LGREAADRL

SEQ ID NO: 520480 - protein, 5 aa, Mycobacterium
LGRED

SEQ ID NO: 520481 - protein, 6 aa, Mycobacterium
LGREPG

SEQ ID NO: 520482 - protein, 12 aa, Mycobacterium
LGREPREDEFEP

SEQ ID NO: 520483 - protein, 9 aa, Mycobacterium
LGREPRPYP

SEQ ID NO: 520484 - protein, 9 aa, Mycobacterium
LGREQAARA

SEQ ID NO: 520485 - protein, 7 aa, Mycobacterium
LGRERGG

SEQ ID NO: 520486 - protein, 7 aa, Mycobacterium
LGRESGY

SEQ ID NO: 520487 - protein, 5 aa, Mycobacterium
LGRGE

SEQ ID NO: 520488 - protein, 5 aa, Mycobacterium
LGRGM

SEQ ID NO: 520489 - protein, 10 aa, Mycobacterium
LGRGPAAPVA

SEQ ID NO: 520490 - protein, 10 aa, Mycobacterium
LGRGPAISAE

SEQ ID NO: 520491 - protein, 11 aa, Mycobacterium
LGRGPAVSGDD

SEQ ID NO: 520492 - protein, 12 aa, Mycobacterium
LGRGPAVSSEDE

SEQ ID NO: 520493 - protein, 7 aa, Mycobacterium
LGRGPGN

SEQ ID NO: 520494 - protein, 6 aa, Mycobacterium
LGRGPS

SEQ ID NO: 520495 - protein, 8 aa, Mycobacterium
LGRGRGGG

SEQ ID NO: 520496 - protein, 11 aa, Mycobacterium
LGRGSGLAAEG

SEQ ID NO: 520497 - protein, 13 aa, Mycobacterium
LGRGYSGPRPIPG

SEQ ID NO: 520498 - protein, 12 aa, Mycobacterium
LGRKEDASDDSR

SEQ ID NO: 520499 - protein, 9 aa, Mycobacterium
LGRNQSGRA

SEQ ID NO: 520500 - protein, 4 aa, Mycobacterium
LGRP

SEQ ID NO: 520501 - protein, 6 aa, Mycobacterium
LGRPAE

SEQ ID NO: 520502 - protein, 10 aa, Mycobacterium
LGRPAEPDEV

SEQ ID NO: 520503 - protein, 6 aa, Mycobacterium
LGRPAT

SEQ ID NO: 520504 - protein, 7 aa, Mycobacterium
LGRPDEL

SEQ ID NO: 520505 - protein, 9 aa, Mycobacterium
LGRPDGESA

SEQ ID NO: 520506 - protein, 9 aa, Mycobacterium
LGRPDGLTV

SEQ ID NO: 520507 - protein, 9 aa, Mycobacterium
LGRPDGTSA

SEQ ID NO: 520508 - protein, 7 aa, Mycobacterium
LGRPDPQ

SEQ ID NO: 520509 - protein, 11 aa, Mycobacterium
LGRPEYATPVG

SEQ ID NO: 520510 - protein, 5 aa, Mycobacterium
LGRPG

SEQ ID NO: 520511 - protein, 6 aa, Mycobacterium
LGRPGA

SEQ ID NO: 520512 - protein, 10 aa, Mycobacterium
LGRPGAADEV

SEQ ID NO: 520513 - protein, 11 aa, Mycobacterium
LGRPGGERETQ

SEQ ID NO: 520514 - protein, 9 aa, Mycobacterium
LGRPGGTSA

SEQ ID NO: 520515 - protein, 7 aa, Mycobacterium
LGRPGLT

SEQ ID NO: 520516 - protein, 25 aa, Mycobacterium
LGRPGPHRRYAAQTSDIPYGPGGRD

SEQ ID NO: 520517 - protein, 25 aa, Mycobacterium
LGRPGPHRRYAAQTSDISYGPRGRD

SEQ ID NO: 520518 - protein, 10 aa, Mycobacterium
LGRPGQATAH

SEQ ID NO: 520519 - protein, 10 aa, Mycobacterium
LGRPGQPDEI

SEQ ID NO: 520520 - protein, 7 aa, Mycobacterium
LGRPGSG

SEQ ID NO: 520521 - protein, 10 aa, Mycobacterium
LGRPGTPQDC

SEQ ID NO: 520522 - protein, 11 aa, Mycobacterium
LGRPGTQRETQ

SEQ ID NO: 520523 - protein, 6 aa, Mycobacterium
LGRPKA

SEQ ID NO: 520524 - protein, 5 aa, Mycobacterium
LGRPN

SEQ ID NO: 520525 - protein, 9 aa, Mycobacterium
LGRPNGARL

SEQ ID NO: 520526 - protein, 6 aa, Mycobacterium
LGRPRA

SEQ ID NO: 520527 - protein, 13 aa, Mycobacterium
LGRPRGDSGVGPR

SEQ ID NO: 520528 - protein, 6 aa, Mycobacterium
LGRPRR

SEQ ID NO: 520529 - protein, 8 aa, Mycobacterium
LGRPSEHT

SEQ ID NO: 520530 - protein, 8 aa, Mycobacterium
LGRPSRPT

SEQ ID NO: 520531 - protein, 9 aa, Mycobacterium
LGRPSRRPQ

SEQ ID NO: 520532 - protein, 5 aa, Mycobacterium
LGRPT

SEQ ID NO: 520533 - protein, 9 aa, Mycobacterium
LGRPTQATA

SEQ ID NO: 520534 - protein, 5 aa, Mycobacterium
LGRPV

SEQ ID NO: 520535 - protein, 14 aa, Mycobacterium
LGRPVGARGEQTRQ

SEQ ID NO: 520536 - protein, 7 aa, Mycobacterium
LGRPVGE

SEQ ID NO: 520537 - protein, 4 aa, Mycobacterium
LGRQ

SEQ ID NO: 520538 - protein, 6 aa, Mycobacterium
LGRQEP

SEQ ID NO: 520539 - protein, 7 aa, Mycobacterium
LGRQPER

SEQ ID NO: 520540 - protein, 6 aa, Mycobacterium
LGRQPV

SEQ ID NO: 520541 - protein, 13 aa, Mycobacterium
LGRRAHSARVERA

SEQ ID NO: 520542 - protein, 10 aa, Mycobacterium
LGRREEPTLR

SEQ ID NO: 520543 - protein, 6 aa, Mycobacterium
LGRRGG

SEQ ID NO: 520544 - protein, 7 aa, Mycobacterium
LGRRGLE

SEQ ID NO: 520545 - protein, 11 aa, Mycobacterium
LGRRGNRGLGG

SEQ ID NO: 520546 - protein, 8 aa, Mycobacterium
LGRRPGGL

SEQ ID NO: 520547 - protein, 7 aa, Mycobacterium
LGRRPGS

SEQ ID NO: 520548 - protein, 9 aa, Mycobacterium
LGRRPHPRA

SEQ ID NO: 520549 - protein, 58 aa, Mycobacterium
LGRRPRGGRGARGAARPPARRHHRTRRPAAADRCGRPGHRDDQAQASDGRRAQGAEGH

SEQ ID NO: 520550 - protein, 6 aa, Mycobacterium
LGRRRP

SEQ ID NO: 520551 - protein, 7 aa, Mycobacterium
LGRRRPD

SEQ ID NO: 520552 - protein, 30 aa, Mycobacterium
LGRRRQHAREMGGPERLDKHRGKGKLDARA

SEQ ID NO: 520553 - protein, 6 aa, Mycobacterium
LGRSAA

SEQ ID NO: 520554 - protein, 12 aa, Mycobacterium
LGRSAGGLPPDG

SEQ ID NO: 520555 - protein, 5 aa, Mycobacterium
LGRSD

SEQ ID NO: 520556 - protein, 10 aa, Mycobacterium
LGRSDQDMSR

SEQ ID NO: 520557 - protein, 7 aa, Mycobacterium
LGRSEGA

SEQ ID NO: 520558 - protein, 9 aa, Mycobacterium
LGRSENTVS

SEQ ID NO: 520559 - protein, 6 aa, Mycobacterium
LGRSGE

SEQ ID NO: 520560 - protein, 11 aa, Mycobacterium
LGRSGGAPATV

SEQ ID NO: 520561 - protein, 10 aa, Mycobacterium
LGRSGKTKLS

SEQ ID NO: 520562 - protein, 9 aa, Mycobacterium
LGRSGQTKL

SEQ ID NO: 520563 - protein, 6 aa, Mycobacterium
LGRSGS

SEQ ID NO: 520564 - protein, 7 aa, Mycobacterium
LGRSPGL

SEQ ID NO: 520565 - protein, 8 aa, Mycobacterium
LGRSPTAH

SEQ ID NO: 520566 - protein, 14 aa, Mycobacterium
LGRSSSAHTESIEK

SEQ ID NO: 520567 - protein, 15 aa, Mycobacterium
LGRSSTADVDADRSF

SEQ ID NO: 520568 - protein, 15 aa, Mycobacterium
LGRSTSAYNQDLGKK

SEQ ID NO: 520569 - protein, 14 aa, Mycobacterium
LGRSTSAYNQGLGK

SEQ ID NO: 520570 - protein, 10 aa, Mycobacterium
LGRTAQPEEI

SEQ ID NO: 520571 - protein, 6 aa, Mycobacterium
LGRTDN

SEQ ID NO: 520572 - protein, 6 aa, Mycobacterium
LGRTEV

SEQ ID NO: 520573 - protein, 5 aa, Mycobacterium
LGRTH

SEQ ID NO: 520574 - protein, 7 aa, Mycobacterium
LGRTPAQ

SEQ ID NO: 520575 - protein, 14 aa, Mycobacterium
LGRTQGGNNNGYCQ

SEQ ID NO: 520576 - protein, 9 aa, Mycobacterium
LGRTRGEGN

SEQ ID NO: 520577 - protein, 6 aa, Mycobacterium
LGRVPE

SEQ ID NO: 520578 - protein, 11 aa, Mycobacterium
LGRVSGPAEQA

SEQ ID NO: 520579 - protein, 4 aa, Mycobacterium
LGSA

SEQ ID NO: 520580 - protein, 7 aa, Mycobacterium
LGSAAAA

SEQ ID NO: 520581 - protein, 81 aa, Mycobacterium
LGSAAQPPATGSAVPVATTNTAPPPAPGGPAAPTPTTTDTPAATPDAEATTDADADEDQAPSDTEPETEPDADAEPEIPQE

SEQ ID NO: 520582 - protein, 6 aa, Mycobacterium
LGSAAT

SEQ ID NO: 520583 - protein, 23 aa, Mycobacterium
LGSAAVPAGVASSECGSLTAEPG

SEQ ID NO: 520584 - protein, 21 aa, Mycobacterium
LGSADDDFGSGETGAEARSQE

SEQ ID NO: 520585 - protein, 10 aa, Mycobacterium
LGSADPGIPP

SEQ ID NO: 520586 - protein, 8 aa, Mycobacterium
LGSADSAH

SEQ ID NO: 520587 - protein, 25 aa, Mycobacterium
LGSAESRRGGLPRTTELRTPAGATA

SEQ ID NO: 520588 - protein, 24 aa, Mycobacterium
LGSAGNASSLHTTGRAARRRIEES

SEQ ID NO: 520589 - protein, 8 aa, Mycobacterium
LGSAGTAR

SEQ ID NO: 520590 - protein, 9 aa, Mycobacterium
LGSAGTPAV

SEQ ID NO: 520591 - protein, 6 aa, Mycobacterium
LGSAPQ

SEQ ID NO: 520592 - protein, 18 aa, Mycobacterium
LGSAPWSQDVAKSAAAQN

SEQ ID NO: 520593 - protein, 8 aa, Mycobacterium
LGSAQDQL

SEQ ID NO: 520594 - protein, 12 aa, Mycobacterium
LGSARASGMPYG

SEQ ID NO: 520595 - protein, 12 aa, Mycobacterium
LGSARATGIPYG

SEQ ID NO: 520596 - protein, 12 aa, Mycobacterium
LGSARATGMPYG

SEQ ID NO: 520597 - protein, 9 aa, Mycobacterium
LGSARRGFD

SEQ ID NO: 520598 - protein, 12 aa, Mycobacterium
LGSARSTGMPYG

SEQ ID NO: 520599 - protein, 6 aa, Mycobacterium
LGSASD

SEQ ID NO: 520600 - protein, 7 aa, Mycobacterium
LGSATAR

SEQ ID NO: 520601 - protein, 20 aa, Mycobacterium
LGSATRDIPFEGGESSDMPG

SEQ ID NO: 520602 - protein, 15 aa, Mycobacterium
LGSDAAVNTQRRDLS

SEQ ID NO: 520603 - protein, 8 aa, Mycobacterium
LGSDDPKF

SEQ ID NO: 520604 - protein, 7 aa, Mycobacterium
LGSDENV

SEQ ID NO: 520605 - protein, 6 aa, Mycobacterium
LGSDGD

SEQ ID NO: 520606 - protein, 22 aa, Mycobacterium
LGSDGDAKAVTSRRLGRPDVTG

SEQ ID NO: 520607 - protein, 9 aa, Mycobacterium
LGSDGGGSI

SEQ ID NO: 520608 - protein, 10 aa, Mycobacterium
LGSDGGGSIR

SEQ ID NO: 520609 - protein, 10 aa, Mycobacterium
LGSDGNTATS

SEQ ID NO: 520610 - protein, 5 aa, Mycobacterium
LGSDH

SEQ ID NO: 520611 - protein, 7 aa, Mycobacterium
LGSDPGD

SEQ ID NO: 520612 - protein, 9 aa, Mycobacterium
LGSDPRLDA

SEQ ID NO: 520613 - protein, 10 aa, Mycobacterium
LGSDPSVVRT

SEQ ID NO: 520614 - protein, 11 aa, Mycobacterium
LGSDPSVVRTE

SEQ ID NO: 520615 - protein, 10 aa, Mycobacterium
LGSDRRQATA

SEQ ID NO: 520616 - protein, 17 aa, Mycobacterium
LGSDRTERYLSLIYDAL

SEQ ID NO: 520617 - protein, 13 aa, Mycobacterium
LGSDSAAHEDGMS

SEQ ID NO: 520618 - protein, 10 aa, Mycobacterium
LGSDTGGSIR

SEQ ID NO: 520619 - protein, 21 aa, Mycobacterium
LGSDTGRIAGATTSLADYNRA

SEQ ID NO: 520620 - protein, 22 aa, Mycobacterium
LGSDTGRIAGATTSLADYNRSG

SEQ ID NO: 520621 - protein, 4 aa, Mycobacterium
LGSE

SEQ ID NO: 520622 - protein, 6 aa, Mycobacterium
LGSEAA

SEQ ID NO: 520623 - protein, 15 aa, Mycobacterium
LGSEARTEQPDPPGP

SEQ ID NO: 520624 - protein, 7 aa, Mycobacterium
LGSEDGR

SEQ ID NO: 520625 - protein, 11 aa, Mycobacterium
LGSEGNTGDGI

SEQ ID NO: 520626 - protein, 5 aa, Mycobacterium
LGSEH

SEQ ID NO: 520627 - protein, 5 aa, Mycobacterium
LGSEP

SEQ ID NO: 520628 - protein, 8 aa, Mycobacterium
LGSEPAYA

SEQ ID NO: 520629 - protein, 9 aa, Mycobacterium
LGSEPWSTE

SEQ ID NO: 520630 - protein, 11 aa, Mycobacterium
LGSEQKTTPPE

SEQ ID NO: 520631 - protein, 18 aa, Mycobacterium
LGSEQTAAAEGKVGNVRR

SEQ ID NO: 520632 - protein, 5 aa, Mycobacterium
LGSER

SEQ ID NO: 520633 - protein, 7 aa, Mycobacterium
LGSETEI

SEQ ID NO: 520634 - protein, 10 aa, Mycobacterium
LGSETGRIHG

SEQ ID NO: 520635 - protein, 11 aa, Mycobacterium
LGSETGRIHGA

SEQ ID NO: 520636 - protein, 8 aa, Mycobacterium
LGSEVDDE

SEQ ID NO: 520637 - protein, 4 aa, Mycobacterium
LGSG

SEQ ID NO: 520638 - protein, 17 aa, Mycobacterium
LGSGAQASAGDKRPDFD

SEQ ID NO: 520639 - protein, 9 aa, Mycobacterium
LGSGDDPDL

SEQ ID NO: 520640 - protein, 20 aa, Mycobacterium
LGSGEGSQQNSESSSRGGLG

SEQ ID NO: 520641 - protein, 8 aa, Mycobacterium
LGSGEYKQ

SEQ ID NO: 520642 - protein, 19 aa, Mycobacterium
LGSGGSGATLRSPAGWTPP

SEQ ID NO: 520643 - protein, 43 aa, Mycobacterium
LGSGGSGGAGGGSNGDGGAGGTGGSGGQIVGDGGAGGAGGQGD

SEQ ID NO: 520644 - protein, 8 aa, Mycobacterium
LGSGGTKR

SEQ ID NO: 520645 - protein, 8 aa, Mycobacterium
LGSGHNRR

SEQ ID NO: 520646 - protein, 5 aa, Mycobacterium
LGSGI

SEQ ID NO: 520647 - protein, 9 aa, Mycobacterium
LGSGNHGDL

SEQ ID NO: 520648 - protein, 9 aa, Mycobacterium
LGSGNLGSA

SEQ ID NO: 520649 - protein, 26 aa, Mycobacterium
LGSGNTGNANLGSGNTGNANFGGGNT

SEQ ID NO: 520650 - protein, 9 aa, Mycobacterium
LGSGNVGDL

SEQ ID NO: 520651 - protein, 11 aa, Mycobacterium
LGSGPENQAPV

SEQ ID NO: 520652 - protein, 5 aa, Mycobacterium
LGSGQ

SEQ ID NO: 520653 - protein, 7 aa, Mycobacterium
LGSGQEL

SEQ ID NO: 520654 - protein, 8 aa, Mycobacterium
LGSGQELP

SEQ ID NO: 520655 - protein, 8 aa, Mycobacterium
LGSGQNTK

SEQ ID NO: 520656 - protein, 6 aa, Mycobacterium
LGSGQR

SEQ ID NO: 520657 - protein, 8 aa, Mycobacterium
LGSGRAEL

SEQ ID NO: 520658 - protein, 6 aa, Mycobacterium
LGSGRI

SEQ ID NO: 520659 - protein, 7 aa, Mycobacterium
LGSGRRY

SEQ ID NO: 520660 - protein, 8 aa, Mycobacterium
LGSGRSDR

SEQ ID NO: 520661 - protein, 9 aa, Mycobacterium
LGSGRSDRF

SEQ ID NO: 520662 - protein, 8 aa, Mycobacterium
LGSGRTDR

SEQ ID NO: 520663 - protein, 9 aa, Mycobacterium
LGSGRTDTF

SEQ ID NO: 520664 - protein, 10 aa, Mycobacterium
LGSGSAGSVI

SEQ ID NO: 520665 - protein, 5 aa, Mycobacterium
LGSGV

SEQ ID NO: 520666 - protein, 17 aa, Mycobacterium
LGSHKPAVYAPKSALGH

SEQ ID NO: 520667 - protein, 4 aa, Mycobacterium
LGSI

SEQ ID NO: 520668 - protein, 11 aa, Mycobacterium
LGSKAQTRSDE

SEQ ID NO: 520669 - protein, 10 aa, Mycobacterium
LGSKDQGTLG

SEQ ID NO: 520670 - protein, 6 aa, Mycobacterium
LGSLGD

SEQ ID NO: 520671 - protein, 5 aa, Mycobacterium
LGSMD

SEQ ID NO: 520672 - protein, 4 aa, Mycobacterium
LGSN

SEQ ID NO: 520673 - protein, 10 aa, Mycobacterium
LGSNGTTKLS

SEQ ID NO: 520674 - protein, 9 aa, Mycobacterium
LGSNSRDKP

SEQ ID NO: 520675 - protein, 9 aa, Mycobacterium
LGSPAAKAA

SEQ ID NO: 520676 - protein, 6 aa, Mycobacterium
LGSPAD

SEQ ID NO: 520677 - protein, 6 aa, Mycobacterium
LGSPDE

SEQ ID NO: 520678 - protein, 15 aa, Mycobacterium
LGSPDPAETYSNSPH

SEQ ID NO: 520679 - protein, 15 aa, Mycobacterium
LGSPDPAETYSSSPH

SEQ ID NO: 520680 - protein, 9 aa, Mycobacterium
LGSPDQVRE

SEQ ID NO: 520681 - protein, 13 aa, Mycobacterium
LGSPDSAAGYGAT

SEQ ID NO: 520682 - protein, 5 aa, Mycobacterium
LGSPE

SEQ ID NO: 520683 - protein, 9 aa, Mycobacterium
LGSPEDAIT

SEQ ID NO: 520684 - protein, 29 aa, Mycobacterium
LGSPGGAAKVGLTENDPDAVKSLEIRAEA

SEQ ID NO: 520685 - protein, 17 aa, Mycobacterium
LGSPGGAAKVGMTEHDP

SEQ ID NO: 520686 - protein, 8 aa, Mycobacterium
LGSPGQAA

SEQ ID NO: 520687 - protein, 14 aa, Mycobacterium
LGSPGQAAYAAANA

SEQ ID NO: 520688 - protein, 12 aa, Mycobacterium
LGSPGQANYATA

SEQ ID NO: 520689 - protein, 9 aa, Mycobacterium
LGSPGQSAY

SEQ ID NO: 520690 - protein, 5 aa, Mycobacterium
LGSPK

SEQ ID NO: 520691 - protein, 7 aa, Mycobacterium
LGSPLGE

SEQ ID NO: 520692 - protein, 8 aa, Mycobacterium
LGSPNTDN

SEQ ID NO: 520693 - protein, 6 aa, Mycobacterium
LGSPPP

SEQ ID NO: 520694 - protein, 10 aa, Mycobacterium
LGSPPPPDTV

SEQ ID NO: 520695 - protein, 16 aa, Mycobacterium
LGSPQGLAESKRLTTA

SEQ ID NO: 520696 - protein, 7 aa, Mycobacterium
LGSPRDD

SEQ ID NO: 520697 - protein, 22 aa, Mycobacterium
LGSPSWAAEPRLATAAGRRTHE

SEQ ID NO: 520698 - protein, 6 aa, Mycobacterium
LGSPTA

SEQ ID NO: 520699 - protein, 15 aa, Mycobacterium
LGSPTDADDDAAVGR

SEQ ID NO: 520700 - protein, 9 aa, Mycobacterium
LGSQATDGF

SEQ ID NO: 520701 - protein, 13 aa, Mycobacterium
LGSQDDAADQNGL

SEQ ID NO: 520702 - protein, 8 aa, Mycobacterium
LGSQEQKQ

SEQ ID NO: 520703 - protein, 12 aa, Mycobacterium
LGSQGVQNGGID

SEQ ID NO: 520704 - protein, 11 aa, Mycobacterium
LGSQRTVPASI

SEQ ID NO: 520705 - protein, 11 aa, Mycobacterium
LGSRESQRRRD

SEQ ID NO: 520706 - protein, 8 aa, Mycobacterium
LGSRGPGV

SEQ ID NO: 520707 - protein, 12 aa, Mycobacterium
LGSRGPKESKYA

SEQ ID NO: 520708 - protein, 8 aa, Mycobacterium
LGSRGVAE

SEQ ID NO: 520709 - protein, 6 aa, Mycobacterium
LGSRHQ

SEQ ID NO: 520710 - protein, 6 aa, Mycobacterium
LGSRNV

SEQ ID NO: 520711 - protein, 5 aa, Mycobacterium
LGSRR

SEQ ID NO: 520712 - protein, 9 aa, Mycobacterium
LGSRTPGVM

SEQ ID NO: 520713 - protein, 6 aa, Mycobacterium
LGSSAD

SEQ ID NO: 520714 - protein, 9 aa, Mycobacterium
LGSSASHRK

SEQ ID NO: 520715 - protein, 5 aa, Mycobacterium
LGSSD

SEQ ID NO: 520716 - protein, 6 aa, Mycobacterium
LGSSGA

SEQ ID NO: 520717 - protein, 7 aa, Mycobacterium
LGSSGAL

SEQ ID NO: 520718 - protein, 17 aa, Mycobacterium
LGSSGPGWSADQPNGVG

SEQ ID NO: 520719 - protein, 9 aa, Mycobacterium
LGSSGSPLS

SEQ ID NO: 520720 - protein, 15 aa, Mycobacterium
LGSSGVQPDSLPKRA

SEQ ID NO: 520721 - protein, 7 aa, Mycobacterium
LGSSGVS

SEQ ID NO: 520722 - protein, 6 aa, Mycobacterium
LGSSHG

SEQ ID NO: 520723 - protein, 6 aa, Mycobacterium
LGSSHT

SEQ ID NO: 520724 - protein, 8 aa, Mycobacterium
LGSSKGRI

SEQ ID NO: 520725 - protein, 23 aa, Mycobacterium
LGSSLDPSTPPEKNDTNKYGTGQ

SEQ ID NO: 520726 - protein, 13 aa, Mycobacterium
LGSSLDTATGQQQ

SEQ ID NO: 520727 - protein, 8 aa, Mycobacterium
LGSSPDVN

SEQ ID NO: 520728 - protein, 10 aa, Mycobacterium
LGSSPLAPVA

SEQ ID NO: 520729 - protein, 19 aa, Mycobacterium
LGSSPNGRESAPSSTRSTS

SEQ ID NO: 520730 - protein, 9 aa, Mycobacterium
LGSSPRNRF

SEQ ID NO: 520731 - protein, 10 aa, Mycobacterium
LGSSPTADRY

SEQ ID NO: 520732 - protein, 7 aa, Mycobacterium
LGSSRPP

SEQ ID NO: 520733 - protein, 7 aa, Mycobacterium
LGSSSGL

SEQ ID NO: 520734 - protein, 8 aa, Mycobacterium
LGSTEPLA

SEQ ID NO: 520735 - protein, 9 aa, Mycobacterium
LGSTGLGRD

SEQ ID NO: 520736 - protein, 9 aa, Mycobacterium
LGSTGSGGR

SEQ ID NO: 520737 - protein, 9 aa, Mycobacterium
LGSTGSPLS

SEQ ID NO: 520738 - protein, 8 aa, Mycobacterium
LGSTIGAA

SEQ ID NO: 520739 - protein, 6 aa, Mycobacterium
LGSTQD

SEQ ID NO: 520740 - protein, 8 aa, Mycobacterium
LGSTRSAA

SEQ ID NO: 520741 - protein, 6 aa, Mycobacterium
LGSTTS

SEQ ID NO: 520742 - protein, 6 aa, Mycobacterium
LGSVDA

SEQ ID NO: 520743 - protein, 8 aa, Mycobacterium
LGSVPGAQ

SEQ ID NO: 520744 - protein, 29 aa, Mycobacterium
LGSVPKEERADAGKRVNAARAEAQRSYDE

SEQ ID NO: 520745 - protein, 9 aa, Mycobacterium
LGSVTSTDV

SEQ ID NO: 520746 - protein, 16 aa, Mycobacterium
LGSYAEPGWASETGWP

SEQ ID NO: 520747 - protein, 15 aa, Mycobacterium
LGTAAKDLGWIPPWW

SEQ ID NO: 520748 - protein, 6 aa, Mycobacterium
LGTAEL

SEQ ID NO: 520749 - protein, 11 aa, Mycobacterium
LGTAEPAPLSQ

SEQ ID NO: 520750 - protein, 16 aa, Mycobacterium
LGTAGDAVEVKDGYGR

SEQ ID NO: 520751 - protein, 8 aa, Mycobacterium
LGTAGDGG

SEQ ID NO: 520752 - protein, 8 aa, Mycobacterium
LGTAGTAT

SEQ ID NO: 520753 - protein, 5 aa, Mycobacterium
LGTAR

SEQ ID NO: 520754 - protein, 9 aa, Mycobacterium
LGTASTEQL

SEQ ID NO: 520755 - protein, 9 aa, Mycobacterium
LGTATEDGL

SEQ ID NO: 520756 - protein, 6 aa, Mycobacterium
LGTATH

SEQ ID NO: 520757 - protein, 6 aa, Mycobacterium
LGTATR

SEQ ID NO: 520758 - protein, 5 aa, Mycobacterium
LGTAY

SEQ ID NO: 520759 - protein, 17 aa, Mycobacterium
LGTAYGEAKLDSEASYF

SEQ ID NO: 520760 - protein, 4 aa, Mycobacterium
LGTD

SEQ ID NO: 520761 - protein, 8 aa, Mycobacterium
LGTDAGRS

SEQ ID NO: 520762 - protein, 18 aa, Mycobacterium
LGTDDDAAALKSEVKDGY

SEQ ID NO: 520763 - protein, 11 aa, Mycobacterium
LGTDDTVSASD

SEQ ID NO: 520764 - protein, 7 aa, Mycobacterium
LGTDEPI

SEQ ID NO: 520765 - protein, 11 aa, Mycobacterium
LGTDGGARAPL

SEQ ID NO: 520766 - protein, 10 aa, Mycobacterium
LGTDPASGNP

SEQ ID NO: 520767 - protein, 5 aa, Mycobacterium
LGTDQ

SEQ ID NO: 520768 - protein, 7 aa, Mycobacterium
LGTDRAA

SEQ ID NO: 520769 - protein, 7 aa, Mycobacterium
LGTEDDA

SEQ ID NO: 520770 - protein, 9 aa, Mycobacterium
LGTEGRASA

SEQ ID NO: 520771 - protein, 9 aa, Mycobacterium
LGTELGGEL

SEQ ID NO: 520772 - protein, 6 aa, Mycobacterium
LGTERH

SEQ ID NO: 520773 - protein, 19 aa, Mycobacterium
LGTGAGRAAASASLASANK

SEQ ID NO: 520774 - protein, 16 aa, Mycobacterium
LGTGDGTLTAADYGRR

SEQ ID NO: 520775 - protein, 18 aa, Mycobacterium
LGTGEPALTGQQTKPATH

SEQ ID NO: 520776 - protein, 12 aa, Mycobacterium
LGTGEQRGYEVS

SEQ ID NO: 520777 - protein, 11 aa, Mycobacterium
LGTGESSQPAC

SEQ ID NO: 520778 - protein, 7 aa, Mycobacterium
LGTGGAN

SEQ ID NO: 520779 - protein, 6 aa, Mycobacterium
LGTGGK

SEQ ID NO: 520780 - protein, 27 aa, Mycobacterium
LGTGGTGGAGARLAGGAGGTGGAGGAG

SEQ ID NO: 520781 - protein, 41 aa, Mycobacterium
LGTGGTGGAGGAGGILGGTGGQGGIGGFGETGAGDGGSGGI

SEQ ID NO: 520782 - protein, 7 aa, Mycobacterium
LGTGKTS

SEQ ID NO: 520783 - protein, 13 aa, Mycobacterium
LGTGNSDKAEEER

SEQ ID NO: 520784 - protein, 10 aa, Mycobacterium
LGTGPKSARH

SEQ ID NO: 520785 - protein, 12 aa, Mycobacterium
LGTGRAISGILG

SEQ ID NO: 520786 - protein, 21 aa, Mycobacterium
LGTGRAVEPAEPDDDETDSGI

SEQ ID NO: 520787 - protein, 20 aa, Mycobacterium
LGTGRGPNLSAGIGNSGDLN

SEQ ID NO: 520788 - protein, 7 aa, Mycobacterium
LGTGRPL

SEQ ID NO: 520789 - protein, 6 aa, Mycobacterium
LGTGSL

SEQ ID NO: 520790 - protein, 5 aa, Mycobacterium
LGTGT

SEQ ID NO: 520791 - protein, 6 aa, Mycobacterium
LGTGTH

SEQ ID NO: 520792 - protein, 4 aa, Mycobacterium
LGTH

SEQ ID NO: 520793 - protein, 5 aa, Mycobacterium
LGTID

SEQ ID NO: 520794 - protein, 8 aa, Mycobacterium
LGTIPGTA

SEQ ID NO: 520795 - protein, 4 aa, Mycobacterium
LGTK

SEQ ID NO: 520796 - protein, 11 aa, Mycobacterium
LGTKGGLRTDA

SEQ ID NO: 520797 - protein, 12 aa, Mycobacterium
LGTKGGLRTDTA

SEQ ID NO: 520798 - protein, 25 aa, Mycobacterium
LGTKGGLRTDTRARVRGRDGEPIPG

SEQ ID NO: 520799 - protein, 11 aa, Mycobacterium
LGTKTQTSKLQ

SEQ ID NO: 520800 - protein, 7 aa, Mycobacterium
LGTLDED

SEQ ID NO: 520801 - protein, 7 aa, Mycobacterium
LGTLPGD

SEQ ID NO: 520802 - protein, 15 aa, Mycobacterium
LGTLPKEQRADAGKA

SEQ ID NO: 520803 - protein, 10 aa, Mycobacterium
LGTLSSQTRL

SEQ ID NO: 520804 - protein, 18 aa, Mycobacterium
LGTLTDEAAEWMAKFGGR

SEQ ID NO: 520805 - protein, 15 aa, Mycobacterium
LGTLTNAEHADASAA

SEQ ID NO: 520806 - protein, 12 aa, Mycobacterium
LGTNPKSLPHEA

SEQ ID NO: 520807 - protein, 16 aa, Mycobacterium
LGTNPRKGHKTGAGER

SEQ ID NO: 520808 - protein, 18 aa, Mycobacterium
LGTNPRKGTKTGEGERDV

SEQ ID NO: 520809 - protein, 16 aa, Mycobacterium
LGTNPRKSSKTGDGVR

SEQ ID NO: 520810 - protein, 18 aa, Mycobacterium
LGTNPRKSTKTGAGERDV

SEQ ID NO: 520811 - protein, 11 aa, Mycobacterium
LGTNYRSDAPL

SEQ ID NO: 520812 - protein, 6 aa, Mycobacterium
LGTPAA

SEQ ID NO: 520813 - protein, 6 aa, Mycobacterium
LGTPAD

SEQ ID NO: 520814 - protein, 9 aa, Mycobacterium
LGTPAEYAD

SEQ ID NO: 520815 - protein, 7 aa, Mycobacterium
LGTPDKK

SEQ ID NO: 520816 - protein, 8 aa, Mycobacterium
LGTPDTEN

SEQ ID NO: 520817 - protein, 8 aa, Mycobacterium
LGTPEQTW

SEQ ID NO: 520818 - protein, 5 aa, Mycobacterium
LGTPG

SEQ ID NO: 520819 - protein, 12 aa, Mycobacterium
LGTPGQGAYAAA

SEQ ID NO: 520820 - protein, 6 aa, Mycobacterium
LGTPLT

SEQ ID NO: 520821 - protein, 6 aa, Mycobacterium
LGTPPA

SEQ ID NO: 520822 - protein, 6 aa, Mycobacterium
LGTPQV

SEQ ID NO: 520823 - protein, 8 aa, Mycobacterium
LGTPRAVS

SEQ ID NO: 520824 - protein, 7 aa, Mycobacterium
LGTPREV

SEQ ID NO: 520825 - protein, 20 aa, Mycobacterium
LGTPRPVSEQRIYKAIDAVA

SEQ ID NO: 520826 - protein, 9 aa, Mycobacterium
LGTPSSPGT

SEQ ID NO: 520827 - protein, 16 aa, Mycobacterium
LGTPTQRKAARTLPDG

SEQ ID NO: 520828 - protein, 8 aa, Mycobacterium
LGTRDGSS

SEQ ID NO: 520829 - protein, 6 aa, Mycobacterium
LGTRRG

SEQ ID NO: 520830 - protein, 19 aa, Mycobacterium
LGTRTPGLPENQRVVERIA

SEQ ID NO: 520831 - protein, 6 aa, Mycobacterium
LGTSGD

SEQ ID NO: 520832 - protein, 11 aa, Mycobacterium
LGTSGDDGTGI

SEQ ID NO: 520833 - protein, 6 aa, Mycobacterium
LGTSGE

SEQ ID NO: 520834 - protein, 8 aa, Mycobacterium
LGTSGKVS

SEQ ID NO: 520835 - protein, 8 aa, Mycobacterium
LGTSGNAE

SEQ ID NO: 520836 - protein, 18 aa, Mycobacterium
LGTSPASAKKHASRARER

SEQ ID NO: 520837 - protein, 19 aa, Mycobacterium
LGTSRQGFQSAQESCKESL

SEQ ID NO: 520838 - protein, 13 aa, Mycobacterium
LGTSRRPATAAER

SEQ ID NO: 520839 - protein, 6 aa, Mycobacterium
LGTSSV

SEQ ID NO: 520840 - protein, 11 aa, Mycobacterium
LGTSTGPPTAV

SEQ ID NO: 520841 - protein, 14 aa, Mycobacterium
LGTSTSSQLPSTSP

SEQ ID NO: 520842 - protein, 12 aa, Mycobacterium
LGTSYKPHSGKH

SEQ ID NO: 520843 - protein, 7 aa, Mycobacterium
LGTTAGD

SEQ ID NO: 520844 - protein, 14 aa, Mycobacterium
LGTTATAEEITDTA

SEQ ID NO: 520845 - protein, 6 aa, Mycobacterium
LGTTPA

SEQ ID NO: 520846 - protein, 8 aa, Mycobacterium
LGTTPDTV

SEQ ID NO: 520847 - protein, 5 aa, Mycobacterium
LGTTR

SEQ ID NO: 520848 - protein, 8 aa, Mycobacterium
LGTTRDVP

SEQ ID NO: 520849 - protein, 11 aa, Mycobacterium
LGTVGDDGTGI

SEQ ID NO: 520850 - protein, 10 aa, Mycobacterium
LGTVSEDTDL

SEQ ID NO: 520851 - protein, 7 aa, Mycobacterium
LGTVTPA

SEQ ID NO: 520852 - protein, 8 aa, Mycobacterium
LGTYAPPT

SEQ ID NO: 520853 - protein, 7 aa, Mycobacterium
LGTYGPP

SEQ ID NO: 520854 - protein, 4 aa, Mycobacterium
LGVA

SEQ ID NO: 520855 - protein, 11 aa, Mycobacterium
LGVDARAQQID

SEQ ID NO: 520856 - protein, 5 aa, Mycobacterium
LGVDP

SEQ ID NO: 520857 - protein, 7 aa, Mycobacterium
LGVDPEA

SEQ ID NO: 520858 - protein, 8 aa, Mycobacterium
LGVEPESG

SEQ ID NO: 520859 - protein, 12 aa, Mycobacterium
LGVETGAATSPA

SEQ ID NO: 520860 - protein, 8 aa, Mycobacterium
LGVETTRD

SEQ ID NO: 520861 - protein, 6 aa, Mycobacterium
LGVGGR

SEQ ID NO: 520862 - protein, 9 aa, Mycobacterium
LGVGGRHDG

SEQ ID NO: 520863 - protein, 14 aa, Mycobacterium
LGVGPATARVVAHH

SEQ ID NO: 520864 - protein, 7 aa, Mycobacterium
LGVGQGD

SEQ ID NO: 520865 - protein, 16 aa, Mycobacterium
LGVGSDSVRTNANADA

SEQ ID NO: 520866 - protein, 7 aa, Mycobacterium
LGVGTEA

SEQ ID NO: 520867 - protein, 17 aa, Mycobacterium
LGVKTGEGFYTYPNSSD

SEQ ID NO: 520868 - protein, 10 aa, Mycobacterium
LGVNPSNDGN

SEQ ID NO: 520869 - protein, 7 aa, Mycobacterium
LGVPASL

SEQ ID NO: 520870 - protein, 5 aa, Mycobacterium
LGVPD

SEQ ID NO: 520871 - protein, 5 aa, Mycobacterium
LGVPG

SEQ ID NO: 520872 - protein, 13 aa, Mycobacterium
LGVPGSNGLPGTI

SEQ ID NO: 520873 - protein, 12 aa, Mycobacterium
LGVPPDYGDGER

SEQ ID NO: 520874 - protein, 7 aa, Mycobacterium
LGVPTSP

SEQ ID NO: 520875 - protein, 7 aa, Mycobacterium
LGVSPRG

SEQ ID NO: 520876 - protein, 9 aa, Mycobacterium
LGVSQSTLS

SEQ ID NO: 520877 - protein, 4 aa, Mycobacterium
LGVT

SEQ ID NO: 520878 - protein, 19 aa, Mycobacterium
LGVTNPGYRPGDSATALPA

SEQ ID NO: 520879 - protein, 14 aa, Mycobacterium
LGVTTEEAAAWRDA

SEQ ID NO: 520880 - protein, 4 aa, Mycobacterium
LGYG

SEQ ID NO: 520881 - protein, 5 aa, Mycobacterium
LGYGD

SEQ ID NO: 520882 - protein, 18 aa, Mycobacterium
LGYGGPQPQPQQPQPYGA

SEQ ID NO: 520883 - protein, 10 aa, Mycobacterium
LGYGPASGRG

SEQ ID NO: 520884 - protein, 11 aa, Mycobacterium
LGYGSPKQYKH

SEQ ID NO: 520885 - protein, 5 aa, Mycobacterium
LGYGT

SEQ ID NO: 520886 - protein, 11 aa, Mycobacterium
LGYPGPDPVAR

SEQ ID NO: 520887 - protein, 19 aa, Mycobacterium
LGYPGPDPVARSLRTRKAG

SEQ ID NO: 520888 - protein, 27 aa, Mycobacterium
LGYPTRDPHGDPIPAADGKVPTPPARQ

SEQ ID NO: 520889 - protein, 10 aa, Mycobacterium
LGYQGPGNTT

SEQ ID NO: 520890 - protein, 15 aa, Mycobacterium
LGYQPPARYAATCTH

SEQ ID NO: 520891 - protein, 7 aa, Mycobacterium
LHADRTG

SEQ ID NO: 520892 - protein, 26 aa, Mycobacterium
LHAPQTPKRHSSRACPRTLPAEMPCR

SEQ ID NO: 520893 - protein, 15 aa, Mycobacterium
LHDADDPGSAEASNM

SEQ ID NO: 520894 - protein, 4 aa, Mycobacterium
LHDG

SEQ ID NO: 520895 - protein, 6 aa, Mycobacterium
LHDGRD

SEQ ID NO: 520896 - protein, 30 aa, Mycobacterium
LHDPPTELPQRNPQNHTETGLVPTEPVSAT

SEQ ID NO: 520897 - protein, 7 aa, Mycobacterium
LHEDGDQ

SEQ ID NO: 520898 - protein, 12 aa, Mycobacterium
LHENGASKSELA

SEQ ID NO: 520899 - protein, 5 aa, Mycobacterium
LHEPE

SEQ ID NO: 520900 - protein, 10 aa, Mycobacterium
LHEPPPDPYD

SEQ ID NO: 520901 - protein, 10 aa, Mycobacterium
LHEPSTATTV

SEQ ID NO: 520902 - protein, 4 aa, Mycobacterium
LHER

SEQ ID NO: 520903 - protein, 17 aa, Mycobacterium
LHESATDPLAVAQQLEG

SEQ ID NO: 520904 - protein, 5 aa, Mycobacterium
LHGAK

SEQ ID NO: 520905 - protein, 6 aa, Mycobacterium
LHGDAR

SEQ ID NO: 520906 - protein, 7 aa, Mycobacterium
LHGDDDQ

SEQ ID NO: 520907 - protein, 5 aa, Mycobacterium
LHGDP

SEQ ID NO: 520908 - protein, 7 aa, Mycobacterium
LHGDPGR

SEQ ID NO: 520909 - protein, 6 aa, Mycobacterium
LHGGAN

SEQ ID NO: 520910 - protein, 9 aa, Mycobacterium
LHGNPETTV

SEQ ID NO: 520911 - protein, 11 aa, Mycobacterium
LHGPAGKPCPA

SEQ ID NO: 520912 - protein, 11 aa, Mycobacterium
LHGPPGDRRYN

SEQ ID NO: 520913 - protein, 13 aa, Mycobacterium
LHGRKTTGSIVLV

SEQ ID NO: 520914 - protein, 19 aa, Mycobacterium
LHGRPKKGVTNVLRKSAVT

SEQ ID NO: 520915 - protein, 4 aa, Mycobacterium
LHGS

SEQ ID NO: 520916 - protein, 8 aa, Mycobacterium
LHGSDAIQ

SEQ ID NO: 520917 - protein, 7 aa, Mycobacterium
LHGTPTR

SEQ ID NO: 520918 - protein, 9 aa, Mycobacterium
LHNEGRDYA

SEQ ID NO: 520919 - protein, 7 aa, Mycobacterium
LHNPAGV

SEQ ID NO: 520920 - protein, 8 aa, Mycobacterium
LHNPPSLK

SEQ ID NO: 520921 - protein, 7 aa, Mycobacterium
LHNSAGR

SEQ ID NO: 520922 - protein, 4 aa, Mycobacterium
LHPA

SEQ ID NO: 520923 - protein, 6 aa, Mycobacterium
LHPDAA

SEQ ID NO: 520924 - protein, 17 aa, Mycobacterium
LHPDDQDPIDPDEPTTL

SEQ ID NO: 520925 - protein, 14 aa, Mycobacterium
LHPDRNSDPGAAER

SEQ ID NO: 520926 - protein, 13 aa, Mycobacterium
LHPEPPAHTRAGS

SEQ ID NO: 520927 - protein, 16 aa, Mycobacterium
LHPGPGRRPQGRPGAV

SEQ ID NO: 520928 - protein, 9 aa, Mycobacterium
LHPNEDGMT

SEQ ID NO: 520929 - protein, 5 aa, Mycobacterium
LHPPA

SEQ ID NO: 520930 - protein, 6 aa, Mycobacterium
LHPPAN

SEQ ID NO: 520931 - protein, 9 aa, Mycobacterium
LHPPPDSTL

SEQ ID NO: 520932 - protein, 12 aa, Mycobacterium
LHPRPDAPANAE

SEQ ID NO: 520933 - protein, 17 aa, Mycobacterium
LHPTKKSPAQRPRRTRR

SEQ ID NO: 520934 - protein, 8 aa, Mycobacterium
LHQTDPES

SEQ ID NO: 520935 - protein, 10 aa, Mycobacterium
LHRDDPRRDT

SEQ ID NO: 520936 - protein, 5 aa, Mycobacterium
LHRGR

SEQ ID NO: 520937 - protein, 9 aa, Mycobacterium
LHRQPTPGE

SEQ ID NO: 520938 - protein, 5 aa, Mycobacterium
LHRRN

SEQ ID NO: 520939 - protein, 9 aa, Mycobacterium
LHRRPGPGL

SEQ ID NO: 520940 - protein, 11 aa, Mycobacterium
LHRSPDYAPNE

SEQ ID NO: 520941 - protein, 14 aa, Mycobacterium
LHRSSGRTAGNGSL

SEQ ID NO: 520942 - protein, 4 aa, Mycobacterium
LHSG

SEQ ID NO: 520943 - protein, 5 aa, Mycobacterium
LHSPL

SEQ ID NO: 520944 - protein, 14 aa, Mycobacterium
LHSRPDEARKAGRR

SEQ ID NO: 520945 - protein, 5 aa, Mycobacterium
LHSRT

SEQ ID NO: 520946 - protein, 7 aa, Mycobacterium
LHSTRGR

SEQ ID NO: 520947 - protein, 7 aa, Mycobacterium
LHSTSTL

SEQ ID NO: 520948 - protein, 17 aa, Mycobacterium
LHTATTDGVLGDADRDH

SEQ ID NO: 520949 - protein, 8 aa, Mycobacterium
LHTEGGHQ

SEQ ID NO: 520950 - protein, 6 aa, Mycobacterium
LHTGDQ

SEQ ID NO: 520951 - protein, 5 aa, Mycobacterium
LHTNR

SEQ ID NO: 520952 - protein, 5 aa, Mycobacterium
LHTSP

SEQ ID NO: 520953 - protein, 12 aa, Mycobacterium
LIGGSDSNEARG

SEQ ID NO: 520954 - protein, 10 aa, Mycobacterium
LIGGSGYQNY

SEQ ID NO: 520955 - protein, 24 aa, Mycobacterium
LIGTGGAGGMGGAGGGAGGMGGSG

SEQ ID NO: 520956 - protein, 4 aa, Mycobacterium
LIPD

SEQ ID NO: 520957 - protein, 5 aa, Mycobacterium
LIPDG

SEQ ID NO: 520958 - protein, 8 aa, Mycobacterium
LIPGTDAK

SEQ ID NO: 520959 - protein, 8 aa, Mycobacterium
LISGGPNC

SEQ ID NO: 520960 - protein, 13 aa, Mycobacterium
LISPGPSQYRPAT

SEQ ID NO: 520961 - protein, 11 aa, Mycobacterium
LITGGDSGIGR

SEQ ID NO: 520962 - protein, 8 aa, Mycobacterium
LKAADAGV

SEQ ID NO: 520963 - protein, 17 aa, Mycobacterium
LKAAREGKIFPRPGSAA

SEQ ID NO: 520964 - protein, 4 aa, Mycobacterium
LKAD

SEQ ID NO: 520965 - protein, 7 aa, Mycobacterium
LKADDRL

SEQ ID NO: 520966 - protein, 7 aa, Mycobacterium
LKADKSK

SEQ ID NO: 520967 - protein, 14 aa, Mycobacterium
LKADPNSDPTRPGI

SEQ ID NO: 520968 - protein, 7 aa, Mycobacterium
LKAEPGQ

SEQ ID NO: 520969 - protein, 15 aa, Mycobacterium
LKAESGAPPIGSPVP

SEQ ID NO: 520970 - protein, 14 aa, Mycobacterium
LKAGDPVSIDGTSR

SEQ ID NO: 520971 - protein, 9 aa, Mycobacterium
LKAGGADAA

SEQ ID NO: 520972 - protein, 8 aa, Mycobacterium
LKAGGARD

SEQ ID NO: 520973 - protein, 12 aa, Mycobacterium
LKAGGPPAKIGR

SEQ ID NO: 520974 - protein, 7 aa, Mycobacterium
LKAGKST

SEQ ID NO: 520975 - protein, 6 aa, Mycobacterium
LKAGQR

SEQ ID NO: 520976 - protein, 15 aa, Mycobacterium
LKAGTEVDFKVADVG

SEQ ID NO: 520977 - protein, 16 aa, Mycobacterium
LKAGTEVTFEVGDAGG

SEQ ID NO: 520978 - protein, 11 aa, Mycobacterium
LKAGYEKGASI

SEQ ID NO: 520979 - protein, 4 aa, Mycobacterium
LKAP

SEQ ID NO: 520980 - protein, 9 aa, Mycobacterium
LKAPSSCEV

SEQ ID NO: 520981 - protein, 13 aa, Mycobacterium
LKAQAEAEKAEQS

SEQ ID NO: 520982 - protein, 11 aa, Mycobacterium
LKAQRDSDRAA

SEQ ID NO: 520983 - protein, 8 aa, Mycobacterium
LKARDSGR

SEQ ID NO: 520984 - protein, 13 aa, Mycobacterium
LKAREAEKTEQPA

SEQ ID NO: 520985 - protein, 7 aa, Mycobacterium
LKAREDA

SEQ ID NO: 520986 - protein, 15 aa, Mycobacterium
LKARPGETTIEPGGH

SEQ ID NO: 520987 - protein, 7 aa, Mycobacterium
LKASASK

SEQ ID NO: 520988 - protein, 11 aa, Mycobacterium
LKATPAAATEP

SEQ ID NO: 520989 - protein, 8 aa, Mycobacterium
LKATTVRD

SEQ ID NO: 520990 - protein, 18 aa, Mycobacterium
LKAVNSQAVSGQPVAPQP

SEQ ID NO: 520991 - protein, 12 aa, Mycobacterium
LKDAAAELARNL

SEQ ID NO: 520992 - protein, 10 aa, Mycobacterium
LKDDELGRGG

SEQ ID NO: 520993 - protein, 8 aa, Mycobacterium
LKDDGRYE

SEQ ID NO: 520994 - protein, 9 aa, Mycobacterium
LKDDPDQLR

SEQ ID NO: 520995 - protein, 6 aa, Mycobacterium
LKDDPE

SEQ ID NO: 520996 - protein, 4 aa, Mycobacterium
LKDG

SEQ ID NO: 520997 - protein, 7 aa, Mycobacterium
LKDGRYE

SEQ ID NO: 520998 - protein, 5 aa, Mycobacterium
LKDGT

SEQ ID NO: 520999 - protein, 5 aa, Mycobacterium
LKDLK

SEQ ID NO: 521000 - protein, 9 aa, Mycobacterium
LKDPAAGRT

SEQ ID NO: 521001 - protein, 8 aa, Mycobacterium
LKDPADRR

SEQ ID NO: 521002 - protein, 17 aa, Mycobacterium
LKDPRKAGVGGMTSGAG

SEQ ID NO: 521003 - protein, 10 aa, Mycobacterium
LKDRDPEQRR

SEQ ID NO: 521004 - protein, 10 aa, Mycobacterium
LKDRGKPGGV

SEQ ID NO: 521005 - protein, 8 aa, Mycobacterium
LKDSGVST

SEQ ID NO: 521006 - protein, 17 aa, Mycobacterium
LKDTSRTELTADDTLGI

SEQ ID NO: 521007 - protein, 13 aa, Mycobacterium
LKDTTRLSSAKGD

SEQ ID NO: 521008 - protein, 11 aa, Mycobacterium
LKEAGDQTAAL

SEQ ID NO: 521009 - protein, 22 aa, Mycobacterium
LKEDPDLSEISGYTEDSGEGRW

SEQ ID NO: 521010 - protein, 9 aa, Mycobacterium
LKEEDTDGL

SEQ ID NO: 521011 - protein, 12 aa, Mycobacterium
LKEGAKGAGKAI

SEQ ID NO: 521012 - protein, 8 aa, Mycobacterium
LKEGEEKF

SEQ ID NO: 521013 - protein, 5 aa, Mycobacterium
LKEGR

SEQ ID NO: 521014 - protein, 17 aa, Mycobacterium
LKEGSKSREKAEEQGLE

SEQ ID NO: 521015 - protein, 16 aa, Mycobacterium
LKEGSKSRPKVSEQGL

SEQ ID NO: 521016 - protein, 6 aa, Mycobacterium
LKEHGP

SEQ ID NO: 521017 - protein, 7 aa, Mycobacterium
LKEMSDD

SEQ ID NO: 521018 - protein, 7 aa, Mycobacterium
LKENPEQ

SEQ ID NO: 521019 - protein, 10 aa, Mycobacterium
LKEPTRADAE

SEQ ID NO: 521020 - protein, 23 aa, Mycobacterium
LKEQGSSREEFDADNRANAEKAI

SEQ ID NO: 521021 - protein, 12 aa, Mycobacterium
LKERAGRRVGTA

SEQ ID NO: 521022 - protein, 7 aa, Mycobacterium
LKERTGA

SEQ ID NO: 521023 - protein, 8 aa, Mycobacterium
LKESPDES

SEQ ID NO: 521024 - protein, 5 aa, Mycobacterium
LKETS

SEQ ID NO: 521025 - protein, 20 aa, Mycobacterium
LKETSKRKVEVQRNKGLGEM

SEQ ID NO: 521026 - protein, 48 aa, Mycobacterium
LKETTEAAEVSDDTATSEVSEATTDEATTDEAADAAGAPDEPAEEVDP

SEQ ID NO: 521027 - protein, 6 aa, Mycobacterium
LKGAGR

SEQ ID NO: 521028 - protein, 9 aa, Mycobacterium
LKGAPMPAP

SEQ ID NO: 521029 - protein, 9 aa, Mycobacterium
LKGDEAKGV

SEQ ID NO: 521030 - protein, 12 aa, Mycobacterium
LKGDGGSSWGTQ

SEQ ID NO: 521031 - protein, 11 aa, Mycobacterium
LKGDGKGQGPV

SEQ ID NO: 521032 - protein, 8 aa, Mycobacterium
LKGDHGDV

SEQ ID NO: 521033 - protein, 10 aa, Mycobacterium
LKGEAGPRIS

SEQ ID NO: 521034 - protein, 14 aa, Mycobacterium
LKGEDGQGAESTFA

SEQ ID NO: 521035 - protein, 8 aa, Mycobacterium
LKGGTSEP

SEQ ID NO: 521036 - protein, 16 aa, Mycobacterium
LKGKKVSASVGSAGHG

SEQ ID NO: 521037 - protein, 10 aa, Mycobacterium
LKGPAVSTDD

SEQ ID NO: 521038 - protein, 13 aa, Mycobacterium
LKGPGSGKALAGM

SEQ ID NO: 521039 - protein, 6 aa, Mycobacterium
LKGQVP

SEQ ID NO: 521040 - protein, 4 aa, Mycobacterium
LKGR

SEQ ID NO: 521041 - protein, 24 aa, Mycobacterium
LKGRAEAIASGQLQPAPVQQPPTQ

SEQ ID NO: 521042 - protein, 10 aa, Mycobacterium
LKGSQAQATR

SEQ ID NO: 521043 - protein, 7 aa, Mycobacterium
LKGSQGL

SEQ ID NO: 521044 - protein, 9 aa, Mycobacterium
LKGVRSDAK

SEQ ID NO: 521045 - protein, 20 aa, Mycobacterium
LKHSTQGRIGSTAGAVSTSA

SEQ ID NO: 521046 - protein, 5 aa, Mycobacterium
LKKAA

SEQ ID NO: 521047 - protein, 19 aa, Mycobacterium
LKKEGDKPLPAVDDKGNAI

SEQ ID NO: 521048 - protein, 20 aa, Mycobacterium
LKKGGDAADGEAARIPETAA

SEQ ID NO: 521049 - protein, 6 aa, Mycobacterium
LKKGQQ

SEQ ID NO: 521050 - protein, 7 aa, Mycobacterium
LKKGTLE

SEQ ID NO: 521051 - protein, 10 aa, Mycobacterium
LKKPGSSHAW

SEQ ID NO: 521052 - protein, 10 aa, Mycobacterium
LKKSARGEYE

SEQ ID NO: 521053 - protein, 10 aa, Mycobacterium
LKKSATAEEI

SEQ ID NO: 521054 - protein, 16 aa, Mycobacterium
LKKSQPSSVQHKGDRD

SEQ ID NO: 521055 - protein, 9 aa, Mycobacterium
LKKTTGRSV

SEQ ID NO: 521056 - protein, 6 aa, Mycobacterium
LKLDSG

SEQ ID NO: 521057 - protein, 59 aa, Mycobacterium
LKMPGSGGLSGAGSVTPASGAGAVGSGGLNPAAGLSSTAAGAGLPSAAGAGTPPPSDFS

SEQ ID NO: 521058 - protein, 12 aa, Mycobacterium
LKNGAPPAKIGR

SEQ ID NO: 521059 - protein, 8 aa, Mycobacterium
LKNGTGEF

SEQ ID NO: 521060 - protein, 18 aa, Mycobacterium
LKNPDAAPVPELKKPDDG

SEQ ID NO: 521061 - protein, 6 aa, Mycobacterium
LKNPDL

SEQ ID NO: 521062 - protein, 9 aa, Mycobacterium
LKNPGPDDL

SEQ ID NO: 521063 - protein, 9 aa, Mycobacterium
LKNPGPEDL

SEQ ID NO: 521064 - protein, 11 aa, Mycobacterium
LKNQTYNTPAI

SEQ ID NO: 521065 - protein, 10 aa, Mycobacterium
LKNSPASRTF

SEQ ID NO: 521066 - protein, 20 aa, Mycobacterium
LKNTNSSGLGTSGVGNVGDS

SEQ ID NO: 521067 - protein, 44 aa, Mycobacterium
LKNTTRAAIGAGRSATAPAETGRNTAAPRPSARPAAGSPRAPHG

SEQ ID NO: 521068 - protein, 4 aa, Mycobacterium
LKPA

SEQ ID NO: 521069 - protein, 5 aa, Mycobacterium
LKPAD

SEQ ID NO: 521070 - protein, 19 aa, Mycobacterium
LKPADGRFGCGPSKVRPEQ

SEQ ID NO: 521071 - protein, 6 aa, Mycobacterium
LKPADI

SEQ ID NO: 521072 - protein, 7 aa, Mycobacterium
LKPAGQR

SEQ ID NO: 521073 - protein, 7 aa, Mycobacterium
LKPATDY

SEQ ID NO: 521074 - protein, 53 aa, Mycobacterium
LKPAVGAKPDKPADKPSTEKSSSEKSGSSSEGSSHSSESKSHSSEGKSHSGSK

SEQ ID NO: 521075 - protein, 6 aa, Mycobacterium
LKPDDR

SEQ ID NO: 521076 - protein, 5 aa, Mycobacterium
LKPDE

SEQ ID NO: 521077 - protein, 13 aa, Mycobacterium
LKPDGGTCQQADG

SEQ ID NO: 521078 - protein, 5 aa, Mycobacterium
LKPDN

SEQ ID NO: 521079 - protein, 13 aa, Mycobacterium
LKPDSGRVTRRGG

SEQ ID NO: 521080 - protein, 4 aa, Mycobacterium
LKPE

SEQ ID NO: 521081 - protein, 8 aa, Mycobacterium
LKPEDRDA

SEQ ID NO: 521082 - protein, 5 aa, Mycobacterium
LKPFS

SEQ ID NO: 521083 - protein, 4 aa, Mycobacterium
LKPG

SEQ ID NO: 521084 - protein, 8 aa, Mycobacterium
LKPGAYSR

SEQ ID NO: 521085 - protein, 6 aa, Mycobacterium
LKPGDK

SEQ ID NO: 521086 - protein, 9 aa, Mycobacterium
LKPGDRLAT

SEQ ID NO: 521087 - protein, 14 aa, Mycobacterium
LKPGDRLPSERELG

SEQ ID NO: 521088 - protein, 5 aa, Mycobacterium
LKPGE

SEQ ID NO: 521089 - protein, 16 aa, Mycobacterium
LKPGEISQHARDTLDG

SEQ ID NO: 521090 - protein, 7 aa, Mycobacterium
LKPGEVR

SEQ ID NO: 521091 - protein, 5 aa, Mycobacterium
LKPGG

SEQ ID NO: 521092 - protein, 13 aa, Mycobacterium
LKPGGHYEAQHFA

SEQ ID NO: 521093 - protein, 8 aa, Mycobacterium
LKPGPAAL

SEQ ID NO: 521094 - protein, 7 aa, Mycobacterium
LKPGPTM

SEQ ID NO: 521095 - protein, 8 aa, Mycobacterium
LKPGPTMV

SEQ ID NO: 521096 - protein, 6 aa, Mycobacterium
LKPGRA

SEQ ID NO: 521097 - protein, 12 aa, Mycobacterium
LKPGSPAYRYLL

SEQ ID NO: 521098 - protein, 8 aa, Mycobacterium
LKPGSPDG

SEQ ID NO: 521099 - protein, 20 aa, Mycobacterium
LKPGVSLPAPTGVFPKYQVP

SEQ ID NO: 521100 - protein, 4 aa, Mycobacterium
LKPN

SEQ ID NO: 521101 - protein, 5 aa, Mycobacterium
LKPNG

SEQ ID NO: 521102 - protein, 6 aa, Mycobacterium
LKPPAP

SEQ ID NO: 521103 - protein, 8 aa, Mycobacterium
LKPPAPVR

SEQ ID NO: 521104 - protein, 9 aa, Mycobacterium
LKPPKGKRW

SEQ ID NO: 521105 - protein, 9 aa, Mycobacterium
LKPPQPGQF

SEQ ID NO: 521106 - protein, 6 aa, Mycobacterium
LKPPRQ

SEQ ID NO: 521107 - protein, 15 aa, Mycobacterium
LKPPVTEAGSRTAGL

SEQ ID NO: 521108 - protein, 7 aa, Mycobacterium
LKPRGPS

SEQ ID NO: 521109 - protein, 21 aa, Mycobacterium
LKPRGTTEFGTRTETKNVNSL

SEQ ID NO: 521110 - protein, 4 aa, Mycobacterium
LKPS

SEQ ID NO: 521111 - protein, 20 aa, Mycobacterium
LKPSGAAKFGTRTETKNVNS

SEQ ID NO: 521112 - protein, 6 aa, Mycobacterium
LKPSLN

SEQ ID NO: 521113 - protein, 21 aa, Mycobacterium
LKPTGQAEFGTRTETKNVNSL

SEQ ID NO: 521114 - protein, 8 aa, Mycobacterium
LKPVTPGG

SEQ ID NO: 521115 - protein, 7 aa, Mycobacterium
LKPYPHT

SEQ ID NO: 521116 - protein, 8 aa, Mycobacterium
LKPYSRDT

SEQ ID NO: 521117 - protein, 4 aa, Mycobacterium
LKQA

SEQ ID NO: 521118 - protein, 9 aa, Mycobacterium
LKQAGPQSN

SEQ ID NO: 521119 - protein, 7 aa, Mycobacterium
LKQGQTV

SEQ ID NO: 521120 - protein, 4 aa, Mycobacterium
LKQK

SEQ ID NO: 521121 - protein, 39 aa, Mycobacterium
LKQSGAADDVSAPETPRAPVATQAGAPAGSARLSDRERE

SEQ ID NO: 521122 - protein, 7 aa, Mycobacterium
LKQSGAK

SEQ ID NO: 521123 - protein, 8 aa, Mycobacterium
LKQSGGKV

SEQ ID NO: 521124 - protein, 17 aa, Mycobacterium
LKRDDTLAANYREYLSA

SEQ ID NO: 521125 - protein, 8 aa, Mycobacterium
LKRDGEGI

SEQ ID NO: 521126 - protein, 13 aa, Mycobacterium
LKREKDDATEVRE

SEQ ID NO: 521127 - protein, 14 aa, Mycobacterium
LKRGGQSVSISETH

SEQ ID NO: 521128 - protein, 8 aa, Mycobacterium
LKRGGRQR

SEQ ID NO: 521129 - protein, 5 aa, Mycobacterium
LKRKG

SEQ ID NO: 521130 - protein, 5 aa, Mycobacterium
LKRPD

SEQ ID NO: 521131 - protein, 8 aa, Mycobacterium
LKRQGEWT

SEQ ID NO: 521132 - protein, 16 aa, Mycobacterium
LKRRESEADLAAGAAT

SEQ ID NO: 521133 - protein, 9 aa, Mycobacterium
LKRRTEETL

SEQ ID NO: 521134 - protein, 10 aa, Mycobacterium
LKRSDSERVV

SEQ ID NO: 521135 - protein, 11 aa, Mycobacterium
LKSAAETTGGL

SEQ ID NO: 521136 - protein, 7 aa, Mycobacterium
LKSAGAA

SEQ ID NO: 521137 - protein, 12 aa, Mycobacterium
LKSAGRSVSAGL

SEQ ID NO: 521138 - protein, 15 aa, Mycobacterium
LKSAPTVAAPKPKLH

SEQ ID NO: 521139 - protein, 6 aa, Mycobacterium
LKSASD

SEQ ID NO: 521140 - protein, 8 aa, Mycobacterium
LKSATSVV

SEQ ID NO: 521141 - protein, 8 aa, Mycobacterium
LKSDEGRG

SEQ ID NO: 521142 - protein, 7 aa, Mycobacterium
LKSDQGR

SEQ ID NO: 521143 - protein, 10 aa, Mycobacterium
LKSDRAESHR

SEQ ID NO: 521144 - protein, 11 aa, Mycobacterium
LKSDSDAKVRP

SEQ ID NO: 521145 - protein, 17 aa, Mycobacterium
LKSEGQSADLNTDEPYT

SEQ ID NO: 521146 - protein, 4 aa, Mycobacterium
LKSG

SEQ ID NO: 521147 - protein, 10 aa, Mycobacterium
LKSGDKGKSC

SEQ ID NO: 521148 - protein, 16 aa, Mycobacterium
LKSGGPLEYRMYCFAK

SEQ ID NO: 521149 - protein, 19 aa, Mycobacterium
LKSGPLRDAGSDTLPGGTE

SEQ ID NO: 521150 - protein, 7 aa, Mycobacterium
LKSGQRV

SEQ ID NO: 521151 - protein, 15 aa, Mycobacterium
LKSGTAVNVEVTDVG

SEQ ID NO: 521152 - protein, 17 aa, Mycobacterium
LKSGTEVTFSVADTVLP

SEQ ID NO: 521153 - protein, 12 aa, Mycobacterium
LKSPEMASAGAD

SEQ ID NO: 521154 - protein, 7 aa, Mycobacterium
LKSPQHV

SEQ ID NO: 521155 - protein, 12 aa, Mycobacterium
LKSPSQAAPRPA

SEQ ID NO: 521156 - protein, 6 aa, Mycobacterium
LKSPTF

SEQ ID NO: 521157 - protein, 7 aa, Mycobacterium
LKSQGHT

SEQ ID NO: 521158 - protein, 5 aa, Mycobacterium
LKSRG

SEQ ID NO: 521159 - protein, 9 aa, Mycobacterium
LKSSDGGRA

SEQ ID NO: 521160 - protein, 10 aa, Mycobacterium
LKSSGRPDAD

SEQ ID NO: 521161 - protein, 9 aa, Mycobacterium
LKSSTEERV

SEQ ID NO: 521162 - protein, 16 aa, Mycobacterium
LKSSTEGRRLDVPEIV

SEQ ID NO: 521163 - protein, 8 aa, Mycobacterium
LKSTAGDV

SEQ ID NO: 521164 - protein, 9 aa, Mycobacterium
LKSTAYQYD

SEQ ID NO: 521165 - protein, 7 aa, Mycobacterium
LKSTPKI

SEQ ID NO: 521166 - protein, 5 aa, Mycobacterium
LKSTV

SEQ ID NO: 521167 - protein, 8 aa, Mycobacterium
LKSVANED

SEQ ID NO: 521168 - protein, 4 aa, Mycobacterium
LKTA

SEQ ID NO: 521169 - protein, 5 aa, Mycobacterium
LKTAR

SEQ ID NO: 521170 - protein, 6 aa, Mycobacterium
LKTDDD

SEQ ID NO: 521171 - protein, 6 aa, Mycobacterium
LKTDRR

SEQ ID NO: 521172 - protein, 4 aa, Mycobacterium
LKTE

SEQ ID NO: 521173 - protein, 13 aa, Mycobacterium
LKTEDNEAEWGFT

SEQ ID NO: 521174 - protein, 9 aa, Mycobacterium
LKTGEDAEL

SEQ ID NO: 521175 - protein, 4 aa, Mycobacterium
LKTP

SEQ ID NO: 521176 - protein, 12 aa, Mycobacterium
LKTPEDLEALAE

SEQ ID NO: 521177 - protein, 7 aa, Mycobacterium
LKTPGSA

SEQ ID NO: 521178 - protein, 12 aa, Mycobacterium
LKTRKTDEVTES

SEQ ID NO: 521179 - protein, 11 aa, Mycobacterium
LKTRNSDEVTA

SEQ ID NO: 521180 - protein, 6 aa, Mycobacterium
LKTRPE

SEQ ID NO: 521181 - protein, 5 aa, Mycobacterium
LKTTA

SEQ ID NO: 521182 - protein, 18 aa, Mycobacterium
LKTTTAAYPTLGSDLGSM

SEQ ID NO: 521183 - protein, 15 aa, Mycobacterium
LKVDSRDGGYLGRVN

SEQ ID NO: 521184 - protein, 11 aa, Mycobacterium
LKVPSDEVPTR

SEQ ID NO: 521185 - protein, 11 aa, Mycobacterium
LKVPSEEVPGR

SEQ ID NO: 521186 - protein, 4 aa, Mycobacterium
LKVT

SEQ ID NO: 521187 - protein, 11 aa, Mycobacterium
LKYDPDDSSEQ

SEQ ID NO: 521188 - protein, 9 aa, Mycobacterium
LLDSDGEQR

SEQ ID NO: 521189 - protein, 7 aa, Mycobacterium
LLGDDRE

SEQ ID NO: 521190 - protein, 14 aa, Mycobacterium
LLGGGGKKKSDADV

SEQ ID NO: 521191 - protein, 18 aa, Mycobacterium
LLGGPGGAGGSGGAAGPA

SEQ ID NO: 521192 - protein, 6 aa, Mycobacterium
LLGGSE

SEQ ID NO: 521193 - protein, 6 aa, Mycobacterium
LLGPDR

SEQ ID NO: 521194 - protein, 10 aa, Mycobacterium
LLGPGDVPQA

SEQ ID NO: 521195 - protein, 21 aa, Mycobacterium
LLGPGGASAVFGPQKGATPFD

SEQ ID NO: 521196 - protein, 7 aa, Mycobacterium
LLGPNRP

SEQ ID NO: 521197 - protein, 7 aa, Mycobacterium
LLGPTAT

SEQ ID NO: 521198 - protein, 5 aa, Mycobacterium
LLGRG

SEQ ID NO: 521199 - protein, 21 aa, Mycobacterium
LLGSGHNRRVQDGDPSIHAET

SEQ ID NO: 521200 - protein, 12 aa, Mycobacterium
LLGSPGQGAYAA

SEQ ID NO: 521201 - protein, 11 aa, Mycobacterium
LLGSTSRTLAT

SEQ ID NO: 521202 - protein, 12 aa, Mycobacterium
LLPDDGSEADEQ

SEQ ID NO: 521203 - protein, 13 aa, Mycobacterium
LLPDDPEERDDGL

SEQ ID NO: 521204 - protein, 4 aa, Mycobacterium
LLPG

SEQ ID NO: 521205 - protein, 5 aa, Mycobacterium
LLPGG

SEQ ID NO: 521206 - protein, 6 aa, Mycobacterium
LLPGNG

SEQ ID NO: 521207 - protein, 13 aa, Mycobacterium
LLPGNKPQKSSKV

SEQ ID NO: 521208 - protein, 23 aa, Mycobacterium
LLPGNSTSFTITGDGAEPTRRRP

SEQ ID NO: 521209 - protein, 8 aa, Mycobacterium
LLPPPAPR

SEQ ID NO: 521210 - protein, 7 aa, Mycobacterium
LLPPPGI

SEQ ID NO: 521211 - protein, 19 aa, Mycobacterium
LLPPPGQSPAFDPSGTYAE

SEQ ID NO: 521212 - protein, 21 aa, Mycobacterium
LLPPPPQPPGREPIHRRRIGG

SEQ ID NO: 521213 - protein, 11 aa, Mycobacterium
LLPPPQQPLGR

SEQ ID NO: 521214 - protein, 12 aa, Mycobacterium
LLPTDTDTNTRE

SEQ ID NO: 521215 - protein, 11 aa, Mycobacterium
LLSESAKARIA

SEQ ID NO: 521216 - protein, 12 aa, Mycobacterium
LLSTPAAPSSVS

SEQ ID NO: 521217 - protein, 11 aa, Mycobacterium
LLTGPDAQIAG

SEQ ID NO: 521218 - protein, 21 aa, Mycobacterium
LLTPGAGNSGLLTPGAGNSGG

SEQ ID NO: 521219 - protein, 9 aa, Mycobacterium
LMPPSGGRA

SEQ ID NO: 521220 - protein, 8 aa, Mycobacterium
LMRPSGAR

SEQ ID NO: 521221 - protein, 13 aa, Mycobacterium
LNAAEAKAAAEGT

SEQ ID NO: 521222 - protein, 13 aa, Mycobacterium
LNAAEQKANSGGA

SEQ ID NO: 521223 - protein, 12 aa, Mycobacterium
LNAAEQRAGERG

SEQ ID NO: 521224 - protein, 13 aa, Mycobacterium
LNAAESKAGTDGS

SEQ ID NO: 521225 - protein, 7 aa, Mycobacterium
LNAAKNP

SEQ ID NO: 521226 - protein, 5 aa, Mycobacterium
LNAAS

SEQ ID NO: 521227 - protein, 13 aa, Mycobacterium
LNADDKHRGASEA

SEQ ID NO: 521228 - protein, 5 aa, Mycobacterium
LNADG

SEQ ID NO: 521229 - protein, 14 aa, Mycobacterium
LNADGTPTGQGGSK

SEQ ID NO: 521230 - protein, 9 aa, Mycobacterium
LNADKTVEQ

SEQ ID NO: 521231 - protein, 6 aa, Mycobacterium
LNADSE

SEQ ID NO: 521232 - protein, 7 aa, Mycobacterium
LNAEGRP

SEQ ID NO: 521233 - protein, 10 aa, Mycobacterium
LNAETGGKGK

SEQ ID NO: 521234 - protein, 10 aa, Mycobacterium
LNAGKDDHGI

SEQ ID NO: 521235 - protein, 9 aa, Mycobacterium
LNAGKGKRA

SEQ ID NO: 521236 - protein, 5 aa, Mycobacterium
LNAGR

SEQ ID NO: 521237 - protein, 8 aa, Mycobacterium
LNAGSTGF

SEQ ID NO: 521238 - protein, 8 aa, Mycobacterium
LNAGTGNF

SEQ ID NO: 521239 - protein, 6 aa, Mycobacterium
LNAKGV

SEQ ID NO: 521240 - protein, 15 aa, Mycobacterium
LNANEQAKKDDNPLN

SEQ ID NO: 521241 - protein, 8 aa, Mycobacterium
LNANPDCT

SEQ ID NO: 521242 - protein, 6 aa, Mycobacterium
LNAPAT

SEQ ID NO: 521243 - protein, 17 aa, Mycobacterium
LNAPDTDRAEAVTPGEL

SEQ ID NO: 521244 - protein, 9 aa, Mycobacterium
LNAPEGGDA

SEQ ID NO: 521245 - protein, 11 aa, Mycobacterium
LNAPGKNATAE

SEQ ID NO: 521246 - protein, 7 aa, Mycobacterium
LNAPTDT

SEQ ID NO: 521247 - protein, 12 aa, Mycobacterium
LNAQGGSGCAAR

SEQ ID NO: 521248 - protein, 15 aa, Mycobacterium
LNAQNAAAAAPTTGV

SEQ ID NO: 521249 - protein, 4 aa, Mycobacterium
LNAR

SEQ ID NO: 521250 - protein, 9 aa, Mycobacterium
LNARAQGIA

SEQ ID NO: 521251 - protein, 16 aa, Mycobacterium
LNAREPGDRRVQLVPC

SEQ ID NO: 521252 - protein, 5 aa, Mycobacterium
LNARN

SEQ ID NO: 521253 - protein, 8 aa, Mycobacterium
LNARTKER

SEQ ID NO: 521254 - protein, 7 aa, Mycobacterium
LNATAAA

SEQ ID NO: 521255 - protein, 9 aa, Mycobacterium
LNATDSPAR

SEQ ID NO: 521256 - protein, 25 aa, Mycobacterium
LNATERAAEGGRGRVTPKATPRPTL

SEQ ID NO: 521257 - protein, 7 aa, Mycobacterium
LNATGHT

SEQ ID NO: 521258 - protein, 6 aa, Mycobacterium
LNATYG

SEQ ID NO: 521259 - protein, 9 aa, Mycobacterium
LNDADPYSA

SEQ ID NO: 521260 - protein, 15 aa, Mycobacterium
LNDAKTKALKLCLAA

SEQ ID NO: 521261 - protein, 11 aa, Mycobacterium
LNDDHDDPANI

SEQ ID NO: 521262 - protein, 11 aa, Mycobacterium
LNDDRSDPANI

SEQ ID NO: 521263 - protein, 6 aa, Mycobacterium
LNDDSR

SEQ ID NO: 521264 - protein, 14 aa, Mycobacterium
LNDDTKPRKLRPGD

SEQ ID NO: 521265 - protein, 7 aa, Mycobacterium
LNDEPAY

SEQ ID NO: 521266 - protein, 15 aa, Mycobacterium
LNDGAEPRRHPNGAH

SEQ ID NO: 521267 - protein, 9 aa, Mycobacterium
LNDGATATL

SEQ ID NO: 521268 - protein, 8 aa, Mycobacterium
LNDGESDL

SEQ ID NO: 521269 - protein, 9 aa, Mycobacterium
LNDGGAGKL

SEQ ID NO: 521270 - protein, 8 aa, Mycobacterium
LNDGGHTL

SEQ ID NO: 521271 - protein, 11 aa, Mycobacterium
LNDGKTPKTVK

SEQ ID NO: 521272 - protein, 7 aa, Mycobacterium
LNDGTPV

SEQ ID NO: 521273 - protein, 16 aa, Mycobacterium
LNDGTRLREDPMTFAG

SEQ ID NO: 521274 - protein, 16 aa, Mycobacterium
LNDGTRLRPDPDTYEG

SEQ ID NO: 521275 - protein, 16 aa, Mycobacterium
LNDGTRLRPDPNTFDG

SEQ ID NO: 521276 - protein, 16 aa, Mycobacterium
LNDGTRVREDPLTYNG

SEQ ID NO: 521277 - protein, 9 aa, Mycobacterium
LNDNEDKSK

SEQ ID NO: 521278 - protein, 6 aa, Mycobacterium
LNDNEP

SEQ ID NO: 521279 - protein, 9 aa, Mycobacterium
LNDPDAEGR

SEQ ID NO: 521280 - protein, 8 aa, Mycobacterium
LNDPESTV

SEQ ID NO: 521281 - protein, 5 aa, Mycobacterium
LNDPN

SEQ ID NO: 521282 - protein, 12 aa, Mycobacterium
LNDPQNVTAPGY

SEQ ID NO: 521283 - protein, 13 aa, Mycobacterium
LNDQGEVAARPAK

SEQ ID NO: 521284 - protein, 18 aa, Mycobacterium
LNDRGEPAPKSARWGKTS

SEQ ID NO: 521285 - protein, 36 aa, Mycobacterium
LNDRSGPSAGRGRRAAAGRAPPRPAVAGDQTGAEHH

SEQ ID NO: 521286 - protein, 5 aa, Mycobacterium
LNDRV

SEQ ID NO: 521287 - protein, 4 aa, Mycobacterium
LNDT

SEQ ID NO: 521288 - protein, 6 aa, Mycobacterium
LNDTKI

SEQ ID NO: 521289 - protein, 15 aa, Mycobacterium
LNDTKTKALKLCMAS

SEQ ID NO: 521290 - protein, 15 aa, Mycobacterium
LNDTKTKALKMCMAS

SEQ ID NO: 521291 - protein, 13 aa, Mycobacterium
LNEAEIKAGAADG

SEQ ID NO: 521292 - protein, 28 aa, Mycobacterium
LNEAKAENESSPNGPQERTPTPPSGSKI

SEQ ID NO: 521293 - protein, 12 aa, Mycobacterium
LNEAQGRSPDLG

SEQ ID NO: 521294 - protein, 7 aa, Mycobacterium
LNEDDAN

SEQ ID NO: 521295 - protein, 14 aa, Mycobacterium
LNEDGTVRKPGQNY

SEQ ID NO: 521296 - protein, 7 aa, Mycobacterium
LNEDPDL

SEQ ID NO: 521297 - protein, 6 aa, Mycobacterium
LNEEEK

SEQ ID NO: 521298 - protein, 5 aa, Mycobacterium
LNEES

SEQ ID NO: 521299 - protein, 7 aa, Mycobacterium
LNEETRV

SEQ ID NO: 521300 - protein, 8 aa, Mycobacterium
LNEGGRMA

SEQ ID NO: 521301 - protein, 11 aa, Mycobacterium
LNEGSTPKTVQ

SEQ ID NO: 521302 - protein, 7 aa, Mycobacterium
LNEGTAV

SEQ ID NO: 521303 - protein, 9 aa, Mycobacterium
LNEKKHPNS

SEQ ID NO: 521304 - protein, 5 aa, Mycobacterium
LNEPA

SEQ ID NO: 521305 - protein, 26 aa, Mycobacterium
LNEPGAALPDRPSTTFAGGRLSGTKV

SEQ ID NO: 521306 - protein, 25 aa, Mycobacterium
LNEPGAPLPDRPSTSFAGGRLSGTK

SEQ ID NO: 521307 - protein, 18 aa, Mycobacterium
LNEPGTALPDRPSTTFAD

SEQ ID NO: 521308 - protein, 10 aa, Mycobacterium
LNEPSRRTAE

SEQ ID NO: 521309 - protein, 12 aa, Mycobacterium
LNEQPAPHTRNR

SEQ ID NO: 521310 - protein, 5 aa, Mycobacterium
LNERA

SEQ ID NO: 521311 - protein, 8 aa, Mycobacterium
LNERAQEI

SEQ ID NO: 521312 - protein, 19 aa, Mycobacterium
LNERETGKLRADARGGVDA

SEQ ID NO: 521313 - protein, 7 aa, Mycobacterium
LNERPRK

SEQ ID NO: 521314 - protein, 10 aa, Mycobacterium
LNERTPGRGV

SEQ ID NO: 521315 - protein, 11 aa, Mycobacterium
LNFPDSGEIER

SEQ ID NO: 521316 - protein, 14 aa, Mycobacterium
LNGAATAAPHRRRG

SEQ ID NO: 521317 - protein, 8 aa, Mycobacterium
LNGAPVDT

SEQ ID NO: 521318 - protein, 10 aa, Mycobacterium
LNGARDPLRL

SEQ ID NO: 521319 - protein, 11 aa, Mycobacterium
LNGARQVPGRH

SEQ ID NO: 521320 - protein, 105 aa, Mycobacterium
LNGASTATATGGIGGNGGDGGTANGSNGGNGGAGGYASTTGTGTASAGNGGRGGDGTATVATGGTGGVGGNAHAPAGSPVPGVGGKGGNPGPGGKPGPNGADGIV

SEQ ID NO: 521321 - protein, 8 aa, Mycobacterium
LNGDDNQY

SEQ ID NO: 521322 - protein, 6 aa, Mycobacterium
LNGDGE

SEQ ID NO: 521323 - protein, 22 aa, Mycobacterium
LNGDGSGENFTGINNTSGIQTQ

SEQ ID NO: 521324 - protein, 15 aa, Mycobacterium
LNGDPTADGVAANRT

SEQ ID NO: 521325 - protein, 6 aa, Mycobacterium
LNGEGE

SEQ ID NO: 521326 - protein, 9 aa, Mycobacterium
LNGEPLDDG

SEQ ID NO: 521327 - protein, 15 aa, Mycobacterium
LNGEPTPDGAPANRT

SEQ ID NO: 521328 - protein, 5 aa, Mycobacterium
LNGEY

SEQ ID NO: 521329 - protein, 7 aa, Mycobacterium
LNGGAGR

SEQ ID NO: 521330 - protein, 9 aa, Mycobacterium
LNGGAPPKM

SEQ ID NO: 521331 - protein, 7 aa, Mycobacterium
LNGGSGN

SEQ ID NO: 521332 - protein, 8 aa, Mycobacterium
LNGGSGPG

SEQ ID NO: 521333 - protein, 6 aa, Mycobacterium
LNGLQQ

SEQ ID NO: 521334 - protein, 9 aa, Mycobacterium
LNGNGELTG

SEQ ID NO: 521335 - protein, 7 aa, Mycobacterium
LNGNPDA

SEQ ID NO: 521336 - protein, 4 aa, Mycobacterium
LNGP

SEQ ID NO: 521337 - protein, 8 aa, Mycobacterium
LNGPATSG

SEQ ID NO: 521338 - protein, 5 aa, Mycobacterium
LNGPQ

SEQ ID NO: 521339 - protein, 6 aa, Mycobacterium
LNGPTS

SEQ ID NO: 521340 - protein, 7 aa, Mycobacterium
LNGPVGH

SEQ ID NO: 521341 - protein, 4 aa, Mycobacterium
LNGQ

SEQ ID NO: 521342 - protein, 10 aa, Mycobacterium
LNGRDGLGAP

SEQ ID NO: 521343 - protein, 12 aa, Mycobacterium
LNGSDRLGDAVG

SEQ ID NO: 521344 - protein, 8 aa, Mycobacterium
LNGSGEMT

SEQ ID NO: 521345 - protein, 10 aa, Mycobacterium
LNGSTGLNGQ

SEQ ID NO: 521346 - protein, 20 aa, Mycobacterium
LNGTEIDTGTGSAVMGDPAE

SEQ ID NO: 521347 - protein, 16 aa, Mycobacterium
LNGTGGTQNGSLTPQQ

SEQ ID NO: 521348 - protein, 14 aa, Mycobacterium
LNGTKNPVLAGDAA

SEQ ID NO: 521349 - protein, 5 aa, Mycobacterium
LNGTP

SEQ ID NO: 521350 - protein, 5 aa, Mycobacterium
LNGTQ

SEQ ID NO: 521351 - protein, 7 aa, Mycobacterium
LNGTWSD

SEQ ID NO: 521352 - protein, 18 aa, Mycobacterium
LNGTYRNREAVDSAALAN

SEQ ID NO: 521353 - protein, 6 aa, Mycobacterium
LNGVTS

SEQ ID NO: 521354 - protein, 10 aa, Mycobacterium
LNHPTPPSAL

SEQ ID NO: 521355 - protein, 17 aa, Mycobacterium
LNIGGDDDDVDVPPFMR

SEQ ID NO: 521356 - protein, 8 aa, Mycobacterium
LNLGSGNI

SEQ ID NO: 521357 - protein, 28 aa, Mycobacterium
LNLGSGNTGGINLGSGNTGSFNPGWGNA

SEQ ID NO: 521358 - protein, 8 aa, Mycobacterium
LNLPGSNH

SEQ ID NO: 521359 - protein, 4 aa, Mycobacterium
LNNE

SEQ ID NO: 521360 - protein, 11 aa, Mycobacterium
LNNGKTPKTVK

SEQ ID NO: 521361 - protein, 8 aa, Mycobacterium
LNNPDAAN

SEQ ID NO: 521362 - protein, 6 aa, Mycobacterium
LNNRGR

SEQ ID NO: 521363 - protein, 8 aa, Mycobacterium
LNNRPDPV

SEQ ID NO: 521364 - protein, 11 aa, Mycobacterium
LNNSDDNLESD

SEQ ID NO: 521365 - protein, 7 aa, Mycobacterium
LNNSGTT

SEQ ID NO: 521366 - protein, 5 aa, Mycobacterium
LNNTS

SEQ ID NO: 521367 - protein, 8 aa, Mycobacterium
LNPADSVS

SEQ ID NO: 521368 - protein, 24 aa, Mycobacterium
LNPAGKVDKKAIRKPYWRNQTRQV

SEQ ID NO: 521369 - protein, 18 aa, Mycobacterium
LNPAPAAVRTKSASLADY

SEQ ID NO: 521370 - protein, 50 aa, Mycobacterium
LNPAPATPPAATPITPPAGVDSSANTGNANAGTGSPANAGPRGAGSGYTS

SEQ ID NO: 521371 - protein, 8 aa, Mycobacterium
LNPAPTRD

SEQ ID NO: 521372 - protein, 12 aa, Mycobacterium
LNPARAAAVSGG

SEQ ID NO: 521373 - protein, 9 aa, Mycobacterium
LNPASDAEH

SEQ ID NO: 521374 - protein, 6 aa, Mycobacterium
LNPATG

SEQ ID NO: 521375 - protein, 7 aa, Mycobacterium
LNPATGD

SEQ ID NO: 521376 - protein, 7 aa, Mycobacterium
LNPATGS

SEQ ID NO: 521377 - protein, 8 aa, Mycobacterium
LNPAYGQQ

SEQ ID NO: 521378 - protein, 5 aa, Mycobacterium
LNPDE

SEQ ID NO: 521379 - protein, 6 aa, Mycobacterium
LNPDEG

SEQ ID NO: 521380 - protein, 7 aa, Mycobacterium
LNPDENS

SEQ ID NO: 521381 - protein, 16 aa, Mycobacterium
LNPDGSVAARGGYDQL

SEQ ID NO: 521382 - protein, 11 aa, Mycobacterium
LNPDGTLRDEA

SEQ ID NO: 521383 - protein, 10 aa, Mycobacterium
LNPDKQPNSY

SEQ ID NO: 521384 - protein, 8 aa, Mycobacterium
LNPDPGGT

SEQ ID NO: 521385 - protein, 7 aa, Mycobacterium
LNPDSAD

SEQ ID NO: 521386 - protein, 8 aa, Mycobacterium
LNPDSAGM

SEQ ID NO: 521387 - protein, 5 aa, Mycobacterium
LNPDV

SEQ ID NO: 521388 - protein, 5 aa, Mycobacterium
LNPEK

SEQ ID NO: 521389 - protein, 10 aa, Mycobacterium
LNPEKQPNSY

SEQ ID NO: 521390 - protein, 4 aa, Mycobacterium
LNPG

SEQ ID NO: 521391 - protein, 8 aa, Mycobacterium
LNPGDAKF

SEQ ID NO: 521392 - protein, 11 aa, Mycobacterium
LNPGGSSKDRI

SEQ ID NO: 521393 - protein, 7 aa, Mycobacterium
LNPGNYN

SEQ ID NO: 521394 - protein, 8 aa, Mycobacterium
LNPGNYNT

SEQ ID NO: 521395 - protein, 22 aa, Mycobacterium
LNPHPGKGYRHTPNGPLSPDGR

SEQ ID NO: 521396 - protein, 5 aa, Mycobacterium
LNPKH

SEQ ID NO: 521397 - protein, 6 aa, Mycobacterium
LNPLPS

SEQ ID NO: 521398 - protein, 5 aa, Mycobacterium
LNPND

SEQ ID NO: 521399 - protein, 9 aa, Mycobacterium
LNPNNQRVE

SEQ ID NO: 521400 - protein, 8 aa, Mycobacterium
LNPNPSRV

SEQ ID NO: 521401 - protein, 6 aa, Mycobacterium
LNPNTG

SEQ ID NO: 521402 - protein, 10 aa, Mycobacterium
LNPNTSTGDW

SEQ ID NO: 521403 - protein, 17 aa, Mycobacterium
LNPPDPAFATPGGGAIT

SEQ ID NO: 521404 - protein, 9 aa, Mycobacterium
LNPPDPTNW

SEQ ID NO: 521405 - protein, 6 aa, Mycobacterium
LNPPEL

SEQ ID NO: 521406 - protein, 11 aa, Mycobacterium
LNPPGQSAAGR

SEQ ID NO: 521407 - protein, 6 aa, Mycobacterium
LNPPIP

SEQ ID NO: 521408 - protein, 9 aa, Mycobacterium
LNPPNPSDW

SEQ ID NO: 521409 - protein, 12 aa, Mycobacterium
LNPPPDSAELSS

SEQ ID NO: 521410 - protein, 7 aa, Mycobacterium
LNPPPTH

SEQ ID NO: 521411 - protein, 8 aa, Mycobacterium
LNPPPTRD

SEQ ID NO: 521412 - protein, 6 aa, Mycobacterium
LNPPSA

SEQ ID NO: 521413 - protein, 40 aa, Mycobacterium
LNPPVPPTAYSPPAPTPTPAPTPTPTPGSTSGSGTGTGGL

SEQ ID NO: 521414 - protein, 40 aa, Mycobacterium
LNPPVPPTAYSPPAPTPTPTPDPTPTPGSTSGSGTGTGGL

SEQ ID NO: 521415 - protein, 7 aa, Mycobacterium
LNPQQRA

SEQ ID NO: 521416 - protein, 6 aa, Mycobacterium
LNPQTG

SEQ ID NO: 521417 - protein, 9 aa, Mycobacterium
LNPRARVDT

SEQ ID NO: 521418 - protein, 7 aa, Mycobacterium
LNPRLGR

SEQ ID NO: 521419 - protein, 7 aa, Mycobacterium
LNPRSRE

SEQ ID NO: 521420 - protein, 7 aa, Mycobacterium
LNPRTRQ

SEQ ID NO: 521421 - protein, 4 aa, Mycobacterium
LNPS

SEQ ID NO: 521422 - protein, 15 aa, Mycobacterium
LNPSAAQIADAAGVG

SEQ ID NO: 521423 - protein, 9 aa, Mycobacterium
LNPSGDPDQ

SEQ ID NO: 521424 - protein, 6 aa, Mycobacterium
LNPSRS

SEQ ID NO: 521425 - protein, 15 aa, Mycobacterium
LNPSSAATPARVSAG

SEQ ID NO: 521426 - protein, 10 aa, Mycobacterium
LNPSSSHGVT

SEQ ID NO: 521427 - protein, 9 aa, Mycobacterium
LNPSTGEVQ

SEQ ID NO: 521428 - protein, 13 aa, Mycobacterium
LNPTGRMGTPREV

SEQ ID NO: 521429 - protein, 9 aa, Mycobacterium
LNPTGSFKD

SEQ ID NO: 521430 - protein, 9 aa, Mycobacterium
LNPTPAISA

SEQ ID NO: 521431 - protein, 9 aa, Mycobacterium
LNPTPPLPT

SEQ ID NO: 521432 - protein, 17 aa, Mycobacterium
LNPTSAATAPPAPVSAG

SEQ ID NO: 521433 - protein, 6 aa, Mycobacterium
LNPTTH

SEQ ID NO: 521434 - protein, 8 aa, Mycobacterium
LNPTYGQG

SEQ ID NO: 521435 - protein, 13 aa, Mycobacterium
LNPYRRQHSGVDA

SEQ ID NO: 521436 - protein, 7 aa, Mycobacterium
LNQAAKE

SEQ ID NO: 521437 - protein, 30 aa, Mycobacterium
LNQDAGNPPIPGPAPDNPPPAPGDWSGNPT

SEQ ID NO: 521438 - protein, 9 aa, Mycobacterium
LNQGGEPVD

SEQ ID NO: 521439 - protein, 8 aa, Mycobacterium
LNQGPGFP

SEQ ID NO: 521440 - protein, 6 aa, Mycobacterium
LNQKPG

SEQ ID NO: 521441 - protein, 8 aa, Mycobacterium
LNQNRDSM

SEQ ID NO: 521442 - protein, 4 aa, Mycobacterium
LNQQ

SEQ ID NO: 521443 - protein, 4 aa, Mycobacterium
LNQS

SEQ ID NO: 521444 - protein, 10 aa, Mycobacterium
LNQSDLPPGE

SEQ ID NO: 521445 - protein, 4 aa, Mycobacterium
LNRG

SEQ ID NO: 521446 - protein, 7 aa, Mycobacterium
LNRGGAP

SEQ ID NO: 521447 - protein, 10 aa, Mycobacterium
LNRKPSDSEI

SEQ ID NO: 521448 - protein, 19 aa, Mycobacterium
LNRPAGAGDVATTAYTGTD

SEQ ID NO: 521449 - protein, 6 aa, Mycobacterium
LNRQET

SEQ ID NO: 521450 - protein, 16 aa, Mycobacterium
LNRRNGSELAGQYPYA

SEQ ID NO: 521451 - protein, 7 aa, Mycobacterium
LNRSDAG

SEQ ID NO: 521452 - protein, 7 aa, Mycobacterium
LNRTGSS

SEQ ID NO: 521453 - protein, 16 aa, Mycobacterium
LNRTTDAGPGKPGTVL

SEQ ID NO: 521454 - protein, 4 aa, Mycobacterium
LNSA

SEQ ID NO: 521455 - protein, 18 aa, Mycobacterium
LNSAKSDEPRLISTPDSR

SEQ ID NO: 521456 - protein, 15 aa, Mycobacterium
LNSATAAASASTTGI

SEQ ID NO: 521457 - protein, 4 aa, Mycobacterium
LNSD

SEQ ID NO: 521458 - protein, 7 aa, Mycobacterium
LNSDELR

SEQ ID NO: 521459 - protein, 9 aa, Mycobacterium
LNSDPHPSP

SEQ ID NO: 521460 - protein, 5 aa, Mycobacterium
LNSGA

SEQ ID NO: 521461 - protein, 6 aa, Mycobacterium
LNSGAD

SEQ ID NO: 521462 - protein, 16 aa, Mycobacterium
LNSGDIGSLSSDSSGA

SEQ ID NO: 521463 - protein, 17 aa, Mycobacterium
LNSGEGSESGVGNYGVG

SEQ ID NO: 521464 - protein, 5 aa, Mycobacterium
LNSGH

SEQ ID NO: 521465 - protein, 8 aa, Mycobacterium
LNSGPATL

SEQ ID NO: 521466 - protein, 17 aa, Mycobacterium
LNSGSGNIGFGNSGNNN

SEQ ID NO: 521467 - protein, 18 aa, Mycobacterium
LNSGSGNIGFGNSGTGNV

SEQ ID NO: 521468 - protein, 17 aa, Mycobacterium
LNSGSGNLGFGNSGTGN

SEQ ID NO: 521469 - protein, 10 aa, Mycobacterium
LNSGTGNTGL

SEQ ID NO: 521470 - protein, 8 aa, Mycobacterium
LNSGTGNV

SEQ ID NO: 521471 - protein, 11 aa, Mycobacterium
LNSLSAAETEL

SEQ ID NO: 521472 - protein, 4 aa, Mycobacterium
LNSN

SEQ ID NO: 521473 - protein, 4 aa, Mycobacterium
LNSP

SEQ ID NO: 521474 - protein, 10 aa, Mycobacterium
LNSPPPRISG

SEQ ID NO: 521475 - protein, 4 aa, Mycobacterium
LNSQ

SEQ ID NO: 521476 - protein, 4 aa, Mycobacterium
LNSR

SEQ ID NO: 521477 - protein, 8 aa, Mycobacterium
LNSRPRKT

SEQ ID NO: 521478 - protein, 9 aa, Mycobacterium
LNSRPRPTL

SEQ ID NO: 521479 - protein, 14 aa, Mycobacterium
LNSTNGTTVNNAPV

SEQ ID NO: 521480 - protein, 7 aa, Mycobacterium
LNSVPGP

SEQ ID NO: 521481 - protein, 9 aa, Mycobacterium
LNTAGGQLS

SEQ ID NO: 521482 - protein, 11 aa, Mycobacterium
LNTATDSVETR

SEQ ID NO: 521483 - protein, 4 aa, Mycobacterium
LNTD

SEQ ID NO: 521484 - protein, 19 aa, Mycobacterium
LNTDGAQCATAPVGSVDTA

SEQ ID NO: 521485 - protein, 12 aa, Mycobacterium
LNTEPPVGDQGV

SEQ ID NO: 521486 - protein, 4 aa, Mycobacterium
LNTG

SEQ ID NO: 521487 - protein, 13 aa, Mycobacterium
LNTGFGNAGANNL

SEQ ID NO: 521488 - protein, 14 aa, Mycobacterium
LNTGIGSPVDQNVA

SEQ ID NO: 521489 - protein, 14 aa, Mycobacterium
LNTHGGQLSAGRTH

SEQ ID NO: 521490 - protein, 11 aa, Mycobacterium
LNTHGGQLSEG

SEQ ID NO: 521491 - protein, 5 aa, Mycobacterium
LNTND

SEQ ID NO: 521492 - protein, 7 aa, Mycobacterium
LNTPGTV

SEQ ID NO: 521493 - protein, 11 aa, Mycobacterium
LNTRDTIARGR

SEQ ID NO: 521494 - protein, 7 aa, Mycobacterium
LNTRYPD

SEQ ID NO: 521495 - protein, 5 aa, Mycobacterium
LNTSV

SEQ ID NO: 521496 - protein, 11 aa, Mycobacterium
LNTTDDDGVSV

SEQ ID NO: 521497 - protein, 9 aa, Mycobacterium
LNTYGGQLS

SEQ ID NO: 521498 - protein, 5 aa, Mycobacterium
LNVSG

SEQ ID NO: 521499 - protein, 4 aa, Mycobacterium
LNVT

SEQ ID NO: 521500 - protein, 8 aa, Mycobacterium
LNYDNPAV

SEQ ID NO: 521501 - protein, 7 aa, Mycobacterium
LNYENPA

SEQ ID NO: 521502 - protein, 4 aa, Mycobacterium
LPAA

SEQ ID NO: 521503 - protein, 5 aa, Mycobacterium
LPAAA

SEQ ID NO: 521504 - protein, 6 aa, Mycobacterium
LPAAAA

SEQ ID NO: 521505 - protein, 15 aa, Mycobacterium
LPAAAGSPALTVTGT

SEQ ID NO: 521506 - protein, 7 aa, Mycobacterium
LPAAAGT

SEQ ID NO: 521507 - protein, 6 aa, Mycobacterium
LPAAAK

SEQ ID NO: 521508 - protein, 10 aa, Mycobacterium
LPAAEEAKAV

SEQ ID NO: 521509 - protein, 27 aa, Mycobacterium
LPAAERPEPLRPSDDDELAHPPTDEPL

SEQ ID NO: 521510 - protein, 6 aa, Mycobacterium
LPAAET

SEQ ID NO: 521511 - protein, 5 aa, Mycobacterium
LPAAG

SEQ ID NO: 521512 - protein, 8 aa, Mycobacterium
LPAAGADT

SEQ ID NO: 521513 - protein, 13 aa, Mycobacterium
LPAAGSAAAPLPT

SEQ ID NO: 521514 - protein, 8 aa, Mycobacterium
LPAAGSSF

SEQ ID NO: 521515 - protein, 5 aa, Mycobacterium
LPAAL

SEQ ID NO: 521516 - protein, 6 aa, Mycobacterium
LPAALD

SEQ ID NO: 521517 - protein, 20 aa, Mycobacterium
LPAAPAQQGPAVTASGRTPL

SEQ ID NO: 521518 - protein, 9 aa, Mycobacterium
LPAAPATDE

SEQ ID NO: 521519 - protein, 7 aa, Mycobacterium
LPAAPIG

SEQ ID NO: 521520 - protein, 35 aa, Mycobacterium
LPAAPLTETSMATPTESDEPHANPSPTPPSASSAD

SEQ ID NO: 521521 - protein, 17 aa, Mycobacterium
LPAAPQRLGPADLAPYE

SEQ ID NO: 521522 - protein, 8 aa, Mycobacterium
LPAAQSLA

SEQ ID NO: 521523 - protein, 6 aa, Mycobacterium
LPAAQT

SEQ ID NO: 521524 - protein, 8 aa, Mycobacterium
LPAASALG

SEQ ID NO: 521525 - protein, 14 aa, Mycobacterium
LPAASETGERPRSV

SEQ ID NO: 521526 - protein, 13 aa, Mycobacterium
LPAASETLERPRS

SEQ ID NO: 521527 - protein, 9 aa, Mycobacterium
LPAASGGAH

SEQ ID NO: 521528 - protein, 5 aa, Mycobacterium
LPAAT

SEQ ID NO: 521529 - protein, 19 aa, Mycobacterium
LPAAYAKQVNKAQAFSDAA

SEQ ID NO: 521530 - protein, 6 aa, Mycobacterium
LPADAA

SEQ ID NO: 521531 - protein, 6 aa, Mycobacterium
LPADAG

SEQ ID NO: 521532 - protein, 12 aa, Mycobacterium
LPADAGERTRAD

SEQ ID NO: 521533 - protein, 9 aa, Mycobacterium
LPADARDYG

SEQ ID NO: 521534 - protein, 8 aa, Mycobacterium
LPADASAL

SEQ ID NO: 521535 - protein, 7 aa, Mycobacterium
LPADEAR

SEQ ID NO: 521536 - protein, 7 aa, Mycobacterium
LPADEIT

SEQ ID NO: 521537 - protein, 10 aa, Mycobacterium
LPADGKAPAA

SEQ ID NO: 521538 - protein, 7 aa, Mycobacterium
LPADGNR

SEQ ID NO: 521539 - protein, 6 aa, Mycobacterium
LPADGP

SEQ ID NO: 521540 - protein, 7 aa, Mycobacterium
LPADGPD

SEQ ID NO: 521541 - protein, 7 aa, Mycobacterium
LPADGSR

SEQ ID NO: 521542 - protein, 6 aa, Mycobacterium
LPADGT

SEQ ID NO: 521543 - protein, 11 aa, Mycobacterium
LPADKAEKLAS

SEQ ID NO: 521544 - protein, 5 aa, Mycobacterium
LPADM

SEQ ID NO: 521545 - protein, 10 aa, Mycobacterium
LPADPADSNF

SEQ ID NO: 521546 - protein, 16 aa, Mycobacterium
LPADPASLIAPSGAEI

SEQ ID NO: 521547 - protein, 18 aa, Mycobacterium
LPADPATDEALGATTRPD

SEQ ID NO: 521548 - protein, 8 aa, Mycobacterium
LPADPGQP

SEQ ID NO: 521549 - protein, 14 aa, Mycobacterium
LPADPPHAASGSEI

SEQ ID NO: 521550 - protein, 6 aa, Mycobacterium
LPADQA

SEQ ID NO: 521551 - protein, 10 aa, Mycobacterium
LPADQGTGLG

SEQ ID NO: 521552 - protein, 10 aa, Mycobacterium
LPADRAGSAY

SEQ ID NO: 521553 - protein, 6 aa, Mycobacterium
LPADRR

SEQ ID NO: 521554 - protein, 12 aa, Mycobacterium
LPADSNGAIATT

SEQ ID NO: 521555 - protein, 5 aa, Mycobacterium
LPADT

SEQ ID NO: 521556 - protein, 8 aa, Mycobacterium
LPADTANL

SEQ ID NO: 521557 - protein, 12 aa, Mycobacterium
LPADTANLRDGV

SEQ ID NO: 521558 - protein, 13 aa, Mycobacterium
LPADTANLRQGAS

SEQ ID NO: 521559 - protein, 8 aa, Mycobacterium
LPADTAVD

SEQ ID NO: 521560 - protein, 7 aa, Mycobacterium
LPADTPV

SEQ ID NO: 521561 - protein, 7 aa, Mycobacterium
LPADTVS

SEQ ID NO: 521562 - protein, 4 aa, Mycobacterium
LPAE

SEQ ID NO: 521563 - protein, 10 aa, Mycobacterium
LPAEAARIGA

SEQ ID NO: 521564 - protein, 8 aa, Mycobacterium
LPAEAEEL

SEQ ID NO: 521565 - protein, 8 aa, Mycobacterium
LPAEANRA

SEQ ID NO: 521566 - protein, 7 aa, Mycobacterium
LPAEAWP

SEQ ID NO: 521567 - protein, 11 aa, Mycobacterium
LPAEDDANRER

SEQ ID NO: 521568 - protein, 12 aa, Mycobacterium
LPAEEAAAADSF

SEQ ID NO: 521569 - protein, 16 aa, Mycobacterium
LPAEGDGATSLPGAPV

SEQ ID NO: 521570 - protein, 9 aa, Mycobacterium
LPAEGSYAS

SEQ ID NO: 521571 - protein, 6 aa, Mycobacterium
LPAEPD

SEQ ID NO: 521572 - protein, 6 aa, Mycobacterium
LPAEPM

SEQ ID NO: 521573 - protein, 10 aa, Mycobacterium
LPAEPPPGVA

SEQ ID NO: 521574 - protein, 6 aa, Mycobacterium
LPAEPV

SEQ ID NO: 521575 - protein, 9 aa, Mycobacterium
LPAEPVRPA

SEQ ID NO: 521576 - protein, 10 aa, Mycobacterium
LPAEQAADGI

SEQ ID NO: 521577 - protein, 7 aa, Mycobacterium
LPAEQQR

SEQ ID NO: 521578 - protein, 5 aa, Mycobacterium
LPAES

SEQ ID NO: 521579 - protein, 9 aa, Mycobacterium
LPAESRDEL

SEQ ID NO: 521580 - protein, 9 aa, Mycobacterium
LPAETAPAP

SEQ ID NO: 521581 - protein, 14 aa, Mycobacterium
LPAETELATGPEAA

SEQ ID NO: 521582 - protein, 9 aa, Mycobacterium
LPAETGPAP

SEQ ID NO: 521583 - protein, 8 aa, Mycobacterium
LPAETTAS

SEQ ID NO: 521584 - protein, 5 aa, Mycobacterium
LPAEV

SEQ ID NO: 521585 - protein, 12 aa, Mycobacterium
LPAEVSKPRITG

SEQ ID NO: 521586 - protein, 6 aa, Mycobacterium
LPAEYS

SEQ ID NO: 521587 - protein, 15 aa, Mycobacterium
LPAGAAAGSSLTDSA

SEQ ID NO: 521588 - protein, 10 aa, Mycobacterium
LPAGAGAAAA

SEQ ID NO: 521589 - protein, 15 aa, Mycobacterium
LPAGAGDGSPLPGGA

SEQ ID NO: 521590 - protein, 9 aa, Mycobacterium
LPAGAGSMG

SEQ ID NO: 521591 - protein, 12 aa, Mycobacterium
LPAGAGTLSGTD

SEQ ID NO: 521592 - protein, 10 aa, Mycobacterium
LPAGAQPPDL

SEQ ID NO: 521593 - protein, 5 aa, Mycobacterium
LPAGD

SEQ ID NO: 521594 - protein, 12 aa, Mycobacterium
LPAGDPAKGDLV

SEQ ID NO: 521595 - protein, 9 aa, Mycobacterium
LPAGDPKRA

SEQ ID NO: 521596 - protein, 8 aa, Mycobacterium
LPAGEASN

SEQ ID NO: 521597 - protein, 7 aa, Mycobacterium
LPAGEPA

SEQ ID NO: 521598 - protein, 8 aa, Mycobacterium
LPAGEQVA

SEQ ID NO: 521599 - protein, 10 aa, Mycobacterium
LPAGETAARA

SEQ ID NO: 521600 - protein, 6 aa, Mycobacterium
LPAGEV

SEQ ID NO: 521601 - protein, 6 aa, Mycobacterium
LPAGGR

SEQ ID NO: 521602 - protein, 6 aa, Mycobacterium
LPAGHG

SEQ ID NO: 521603 - protein, 12 aa, Mycobacterium
LPAGLNPGGIEP

SEQ ID NO: 521604 - protein, 7 aa, Mycobacterium
LPAGPAK

SEQ ID NO: 521605 - protein, 18 aa, Mycobacterium
LPAGPAYYPDGELTDEPE

SEQ ID NO: 521606 - protein, 8 aa, Mycobacterium
LPAGPGQV

SEQ ID NO: 521607 - protein, 7 aa, Mycobacterium
LPAGPPK

SEQ ID NO: 521608 - protein, 7 aa, Mycobacterium
LPAGSPK

SEQ ID NO: 521609 - protein, 6 aa, Mycobacterium
LPAGSS

SEQ ID NO: 521610 - protein, 14 aa, Mycobacterium
LPAGTAAASQAEVD

SEQ ID NO: 521611 - protein, 17 aa, Mycobacterium
LPAGTLPDGGPFTEAGD

SEQ ID NO: 521612 - protein, 18 aa, Mycobacterium
LPAGTLPDGGPFTEAGDK

SEQ ID NO: 521613 - protein, 6 aa, Mycobacterium
LPAGTR

SEQ ID NO: 521614 - protein, 6 aa, Mycobacterium
LPAGVE

SEQ ID NO: 521615 - protein, 6 aa, Mycobacterium
LPAGVS

SEQ ID NO: 521616 - protein, 5 aa, Mycobacterium
LPAGY

SEQ ID NO: 521617 - protein, 5 aa, Mycobacterium
LPAHP

SEQ ID NO: 521618 - protein, 9 aa, Mycobacterium
LPAIDDPDE

SEQ ID NO: 521619 - protein, 4 aa, Mycobacterium
LPAK

SEQ ID NO: 521620 - protein, 37 aa, Mycobacterium
LPAKPNPVPRMPTSHPGRGNGPASAASSPCTKPYWRW

SEQ ID NO: 521621 - protein, 6 aa, Mycobacterium
LPAKQE

SEQ ID NO: 521622 - protein, 11 aa, Mycobacterium
LPAKTKDAALG

SEQ ID NO: 521623 - protein, 15 aa, Mycobacterium
LPAMPGSAIKPGGVA

SEQ ID NO: 521624 - protein, 8 aa, Mycobacterium
LPAMTPDS

SEQ ID NO: 521625 - protein, 13 aa, Mycobacterium
LPANATAKIGQTS

SEQ ID NO: 521626 - protein, 14 aa, Mycobacterium
LPANATAKVGQTSL

SEQ ID NO: 521627 - protein, 9 aa, Mycobacterium
LPANGDARA

SEQ ID NO: 521628 - protein, 9 aa, Mycobacterium
LPANPDTAV

SEQ ID NO: 521629 - protein, 14 aa, Mycobacterium
LPANRPSPLAGRTS

SEQ ID NO: 521630 - protein, 5 aa, Mycobacterium
LPAPA

SEQ ID NO: 521631 - protein, 8 aa, Mycobacterium
LPAPAGRG

SEQ ID NO: 521632 - protein, 12 aa, Mycobacterium
LPAPAPGGEQAP

SEQ ID NO: 521633 - protein, 8 aa, Mycobacterium
LPAPARPA

SEQ ID NO: 521634 - protein, 10 aa, Mycobacterium
LPAPASETEA

SEQ ID NO: 521635 - protein, 7 aa, Mycobacterium
LPAPASY

SEQ ID NO: 521636 - protein, 6 aa, Mycobacterium
LPAPAV

SEQ ID NO: 521637 - protein, 8 aa, Mycobacterium
LPAPDDDQ

SEQ ID NO: 521638 - protein, 10 aa, Mycobacterium
LPAPDDPVRS

SEQ ID NO: 521639 - protein, 8 aa, Mycobacterium
LPAPDGAA

SEQ ID NO: 521640 - protein, 7 aa, Mycobacterium
LPAPDLP

SEQ ID NO: 521641 - protein, 5 aa, Mycobacterium
LPAPE

SEQ ID NO: 521642 - protein, 13 aa, Mycobacterium
LPAPEDTPIDPAE

SEQ ID NO: 521643 - protein, 7 aa, Mycobacterium
LPAPEFD

SEQ ID NO: 521644 - protein, 21 aa, Mycobacterium
LPAPEGTDKLGAEMPPSPALS

SEQ ID NO: 521645 - protein, 7 aa, Mycobacterium
LPAPEHS

SEQ ID NO: 521646 - protein, 8 aa, Mycobacterium
LPAPEYSD

SEQ ID NO: 521647 - protein, 11 aa, Mycobacterium
LPAPGDDEQLG

SEQ ID NO: 521648 - protein, 9 aa, Mycobacterium
LPAPGGRRE

SEQ ID NO: 521649 - protein, 11 aa, Mycobacterium
LPAPGIGSGGY

SEQ ID NO: 521650 - protein, 11 aa, Mycobacterium
LPAPGLGSGGY

SEQ ID NO: 521651 - protein, 9 aa, Mycobacterium
LPAPGPGEV

SEQ ID NO: 521652 - protein, 6 aa, Mycobacterium
LPAPGR

SEQ ID NO: 521653 - protein, 6 aa, Mycobacterium
LPAPHD

SEQ ID NO: 521654 - protein, 7 aa, Mycobacterium
LPAPHSV

SEQ ID NO: 521655 - protein, 6 aa, Mycobacterium
LPAPIG

SEQ ID NO: 521656 - protein, 12 aa, Mycobacterium
LPAPIKPTAVPL

SEQ ID NO: 521657 - protein, 9 aa, Mycobacterium
LPAPKTSSV

SEQ ID NO: 521658 - protein, 7 aa, Mycobacterium
LPAPNPG

SEQ ID NO: 521659 - protein, 9 aa, Mycobacterium
LPAPPADDV

SEQ ID NO: 521660 - protein, 7 aa, Mycobacterium
LPAPPDT

SEQ ID NO: 521661 - protein, 18 aa, Mycobacterium
LPAPPLPNGRLKPRPNPA

SEQ ID NO: 521662 - protein, 8 aa, Mycobacterium
LPAPPLPT

SEQ ID NO: 521663 - protein, 9 aa, Mycobacterium
LPAPPLPTA

SEQ ID NO: 521664 - protein, 9 aa, Mycobacterium
LPAPPLPTT

SEQ ID NO: 521665 - protein, 7 aa, Mycobacterium
LPAPPPY

SEQ ID NO: 521666 - protein, 8 aa, Mycobacterium
LPAPPRAA

SEQ ID NO: 521667 - protein, 8 aa, Mycobacterium
LPAPPSYR

SEQ ID NO: 521668 - protein, 5 aa, Mycobacterium
LPAPQ

SEQ ID NO: 521669 - protein, 7 aa, Mycobacterium
LPAPQTE

SEQ ID NO: 521670 - protein, 15 aa, Mycobacterium
LPAPRAAMTCALEAL

SEQ ID NO: 521671 - protein, 13 aa, Mycobacterium
LPAPRADGTEMHR

SEQ ID NO: 521672 - protein, 15 aa, Mycobacterium
LPAPREAMACALEAS

SEQ ID NO: 521673 - protein, 7 aa, Mycobacterium
LPAPRFG

SEQ ID NO: 521674 - protein, 6 aa, Mycobacterium
LPAPRP

SEQ ID NO: 521675 - protein, 9 aa, Mycobacterium
LPAPRPTDT

SEQ ID NO: 521676 - protein, 6 aa, Mycobacterium
LPAPRQ

SEQ ID NO: 521677 - protein, 7 aa, Mycobacterium
LPAPRVS

SEQ ID NO: 521678 - protein, 11 aa, Mycobacterium
LPAPRYGTATT

SEQ ID NO: 521679 - protein, 7 aa, Mycobacterium
LPAPSEP

SEQ ID NO: 521680 - protein, 7 aa, Mycobacterium
LPAPSPA

SEQ ID NO: 521681 - protein, 9 aa, Mycobacterium
LPAPSTAVQ

SEQ ID NO: 521682 - protein, 18 aa, Mycobacterium
LPAPTGLPDAGALPSRPR

SEQ ID NO: 521683 - protein, 9 aa, Mycobacterium
LPAPTGSPI

SEQ ID NO: 521684 - protein, 8 aa, Mycobacterium
LPAPTSAQ

SEQ ID NO: 521685 - protein, 12 aa, Mycobacterium
LPAPVKPTAVPL

SEQ ID NO: 521686 - protein, 7 aa, Mycobacterium
LPAPYRE

SEQ ID NO: 521687 - protein, 5 aa, Mycobacterium
LPAQD

SEQ ID NO: 521688 - protein, 107 aa, Mycobacterium
LPAQDATPAPSSAPQQAPGWQPPRFSPPEGTLAPQGQDTPPPPPWAQQAGPHQQGTPSESYGSSSQLGRPPQGVSEAALGGRHGAPQPAGHADPSQVARPYPPAEEH

SEQ ID NO: 521689 - protein, 6 aa, Mycobacterium
LPAQDT

SEQ ID NO: 521690 - protein, 6 aa, Mycobacterium
LPAQPA

SEQ ID NO: 521691 - protein, 8 aa, Mycobacterium
LPAQPAEP

SEQ ID NO: 521692 - protein, 6 aa, Mycobacterium
LPAQYA

SEQ ID NO: 521693 - protein, 11 aa, Mycobacterium
LPARADGTGVN

SEQ ID NO: 521694 - protein, 8 aa, Mycobacterium
LPAREAKG

SEQ ID NO: 521695 - protein, 9 aa, Mycobacterium
LPARGNTVY

SEQ ID NO: 521696 - protein, 6 aa, Mycobacterium
LPARPA

SEQ ID NO: 521697 - protein, 13 aa, Mycobacterium
LPARPETSDSETL

SEQ ID NO: 521698 - protein, 8 aa, Mycobacterium
LPARPGVV

SEQ ID NO: 521699 - protein, 10 aa, Mycobacterium
LPARPTPTGL

SEQ ID NO: 521700 - protein, 5 aa, Mycobacterium
LPARR

SEQ ID NO: 521701 - protein, 5 aa, Mycobacterium
LPARS

SEQ ID NO: 521702 - protein, 6 aa, Mycobacterium
LPARYG

SEQ ID NO: 521703 - protein, 8 aa, Mycobacterium
LPARYGQA

SEQ ID NO: 521704 - protein, 4 aa, Mycobacterium
LPAS

SEQ ID NO: 521705 - protein, 7 aa, Mycobacterium
LPASAAG

SEQ ID NO: 521706 - protein, 25 aa, Mycobacterium
LPASERRHDGHDTRTQQVTGPEDSR

SEQ ID NO: 521707 - protein, 6 aa, Mycobacterium
LPASGR

SEQ ID NO: 521708 - protein, 9 aa, Mycobacterium
LPASPAAIS

SEQ ID NO: 521709 - protein, 16 aa, Mycobacterium
LPASPASIAALLEEGK

SEQ ID NO: 521710 - protein, 16 aa, Mycobacterium
LPASPASIVSLLEEAS

SEQ ID NO: 521711 - protein, 16 aa, Mycobacterium
LPASPASVASLLAGAS

SEQ ID NO: 521712 - protein, 8 aa, Mycobacterium
LPASQERV

SEQ ID NO: 521713 - protein, 8 aa, Mycobacterium
LPASQREE

SEQ ID NO: 521714 - protein, 11 aa, Mycobacterium
LPASRRDDSAV

SEQ ID NO: 521715 - protein, 14 aa, Mycobacterium
LPASSQVRSSIDVP

SEQ ID NO: 521716 - protein, 16 aa, Mycobacterium
LPASTPRFSPEDRREQ

SEQ ID NO: 521717 - protein, 4 aa, Mycobacterium
LPAT

SEQ ID NO: 521718 - protein, 6 aa, Mycobacterium
LPATAG

SEQ ID NO: 521719 - protein, 14 aa, Mycobacterium
LPATDRRVTGYDAT

SEQ ID NO: 521720 - protein, 5 aa, Mycobacterium
LPATE

SEQ ID NO: 521721 - protein, 6 aa, Mycobacterium
LPATEQ

SEQ ID NO: 521722 - protein, 5 aa, Mycobacterium
LPATG

SEQ ID NO: 521723 - protein, 8 aa, Mycobacterium
LPATGSNK

SEQ ID NO: 521724 - protein, 10 aa, Mycobacterium
LPATGTSPVK

SEQ ID NO: 521725 - protein, 6 aa, Mycobacterium
LPATPA

SEQ ID NO: 521726 - protein, 8 aa, Mycobacterium
LPATPRGL

SEQ ID NO: 521727 - protein, 11 aa, Mycobacterium
LPATQTRPLTA

SEQ ID NO: 521728 - protein, 8 aa, Mycobacterium
LPATRESA

SEQ ID NO: 521729 - protein, 6 aa, Mycobacterium
LPATRP

SEQ ID NO: 521730 - protein, 8 aa, Mycobacterium
LPATTPDP

SEQ ID NO: 521731 - protein, 5 aa, Mycobacterium
LPAVP

SEQ ID NO: 521732 - protein, 14 aa, Mycobacterium
LPAYPANRATVPQD

SEQ ID NO: 521733 - protein, 16 aa, Mycobacterium
LPCNADQRGGRPGDRG

SEQ ID NO: 521734 - protein, 17 aa, Mycobacterium
LPCRTEAAGRPRPPSAP

SEQ ID NO: 521735 - protein, 4 aa, Mycobacterium
LPCT

SEQ ID NO: 521736 - protein, 26 aa, Mycobacterium
LPDAAPPATPAPAAERIRSAAESSKY

SEQ ID NO: 521737 - protein, 11 aa, Mycobacterium
LPDAAPPEPLC

SEQ ID NO: 521738 - protein, 9 aa, Mycobacterium
LPDAARSLG

SEQ ID NO: 521739 - protein, 7 aa, Mycobacterium
LPDAATR

SEQ ID NO: 521740 - protein, 10 aa, Mycobacterium
LPDADGNTVS

SEQ ID NO: 521741 - protein, 8 aa, Mycobacterium
LPDAGTRK

SEQ ID NO: 521742 - protein, 8 aa, Mycobacterium
LPDAGTRR

SEQ ID NO: 521743 - protein, 11 aa, Mycobacterium
LPDAKSPDLRG

SEQ ID NO: 521744 - protein, 11 aa, Mycobacterium
LPDALPPSRSL

SEQ ID NO: 521745 - protein, 5 aa, Mycobacterium
LPDAP

SEQ ID NO: 521746 - protein, 12 aa, Mycobacterium
LPDAPAGRPDEA

SEQ ID NO: 521747 - protein, 8 aa, Mycobacterium
LPDAPDDD

SEQ ID NO: 521748 - protein, 14 aa, Mycobacterium
LPDAPKLPRAGTPA

SEQ ID NO: 521749 - protein, 8 aa, Mycobacterium
LPDAQGRI

SEQ ID NO: 521750 - protein, 7 aa, Mycobacterium
LPDASGD

SEQ ID NO: 521751 - protein, 5 aa, Mycobacterium
LPDAT

SEQ ID NO: 521752 - protein, 6 aa, Mycobacterium
LPDATA

SEQ ID NO: 521753 - protein, 10 aa, Mycobacterium
LPDATTEALD

SEQ ID NO: 521754 - protein, 5 aa, Mycobacterium
LPDDA

SEQ ID NO: 521755 - protein, 16 aa, Mycobacterium
LPDDAAGAPEDSTPTP

SEQ ID NO: 521756 - protein, 11 aa, Mycobacterium
LPDDADPAETL

SEQ ID NO: 521757 - protein, 5 aa, Mycobacterium
LPDDD

SEQ ID NO: 521758 - protein, 8 aa, Mycobacterium
LPDDDGGA

SEQ ID NO: 521759 - protein, 7 aa, Mycobacterium
LPDDERA

SEQ ID NO: 521760 - protein, 11 aa, Mycobacterium
LPDDEYPHLGG

SEQ ID NO: 521761 - protein, 9 aa, Mycobacterium
LPDDGGVTA

SEQ ID NO: 521762 - protein, 9 aa, Mycobacterium
LPDDGSTAH

SEQ ID NO: 521763 - protein, 5 aa, Mycobacterium
LPDDL

SEQ ID NO: 521764 - protein, 5 aa, Mycobacterium
LPDDP

SEQ ID NO: 521765 - protein, 9 aa, Mycobacterium
LPDDPAEAM

SEQ ID NO: 521766 - protein, 10 aa, Mycobacterium
LPDDPAGDEA

SEQ ID NO: 521767 - protein, 9 aa, Mycobacterium
LPDDPEPEL

SEQ ID NO: 521768 - protein, 5 aa, Mycobacterium
LPDDQ

SEQ ID NO: 521769 - protein, 8 aa, Mycobacterium
LPDDRAAV

SEQ ID NO: 521770 - protein, 13 aa, Mycobacterium
LPDDSLASTGQSG

SEQ ID NO: 521771 - protein, 6 aa, Mycobacterium
LPDDSR

SEQ ID NO: 521772 - protein, 5 aa, Mycobacterium
LPDDT

SEQ ID NO: 521773 - protein, 6 aa, Mycobacterium
LPDDTE

SEQ ID NO: 521774 - protein, 14 aa, Mycobacterium
LPDDVNAPSDSGEA

SEQ ID NO: 521775 - protein, 15 aa, Mycobacterium
LPDDVRQDPTWAQSG

SEQ ID NO: 521776 - protein, 13 aa, Mycobacterium
LPDDVSDDDRDAA

SEQ ID NO: 521777 - protein, 6 aa, Mycobacterium
LPDEDV

SEQ ID NO: 521778 - protein, 5 aa, Mycobacterium
LPDEG

SEQ ID NO: 521779 - protein, 5 aa, Mycobacterium
LPDEH

SEQ ID NO: 521780 - protein, 6 aa, Mycobacterium
LPDEHS

SEQ ID NO: 521781 - protein, 5 aa, Mycobacterium
LPDEL

SEQ ID NO: 521782 - protein, 9 aa, Mycobacterium
LPDEPQPGT

SEQ ID NO: 521783 - protein, 6 aa, Mycobacterium
LPDEPW

SEQ ID NO: 521784 - protein, 5 aa, Mycobacterium
LPDEQ

SEQ ID NO: 521785 - protein, 6 aa, Mycobacterium
LPDEQR

SEQ ID NO: 521786 - protein, 9 aa, Mycobacterium
LPDERIQRR

SEQ ID NO: 521787 - protein, 6 aa, Mycobacterium
LPDERR

SEQ ID NO: 521788 - protein, 10 aa, Mycobacterium
LPDESRRKTV

SEQ ID NO: 521789 - protein, 5 aa, Mycobacterium
LPDET

SEQ ID NO: 521790 - protein, 8 aa, Mycobacterium
LPDETVQD

SEQ ID NO: 521791 - protein, 8 aa, Mycobacterium
LPDETVQE

SEQ ID NO: 521792 - protein, 15 aa, Mycobacterium
LPDGADEDDIKATYD

SEQ ID NO: 521793 - protein, 6 aa, Mycobacterium
LPDGAE

SEQ ID NO: 521794 - protein, 7 aa, Mycobacterium
LPDGARQ

SEQ ID NO: 521795 - protein, 8 aa, Mycobacterium
LPDGARQL

SEQ ID NO: 521796 - protein, 10 aa, Mycobacterium
LPDGASASID

SEQ ID NO: 521797 - protein, 6 aa, Mycobacterium
LPDGAV

SEQ ID NO: 521798 - protein, 8 aa, Mycobacterium
LPDGDDER

SEQ ID NO: 521799 - protein, 17 aa, Mycobacterium
LPDGDDPADPSQIVGTR

SEQ ID NO: 521800 - protein, 5 aa, Mycobacterium
LPDGE

SEQ ID NO: 521801 - protein, 7 aa, Mycobacterium
LPDGFPD

SEQ ID NO: 521802 - protein, 6 aa, Mycobacterium
LPDGGA

SEQ ID NO: 521803 - protein, 6 aa, Mycobacterium
LPDGGP

SEQ ID NO: 521804 - protein, 9 aa, Mycobacterium
LPDGGVRTT

SEQ ID NO: 521805 - protein, 14 aa, Mycobacterium
LPDGHPDDPGEAET

SEQ ID NO: 521806 - protein, 8 aa, Mycobacterium
LPDGHPDE

SEQ ID NO: 521807 - protein, 9 aa, Mycobacterium
LPDGHPGRL

SEQ ID NO: 521808 - protein, 25 aa, Mycobacterium
LPDGIPSNDGALNDDTRPRKLRPGD

SEQ ID NO: 521809 - protein, 5 aa, Mycobacterium
LPDGM

SEQ ID NO: 521810 - protein, 5 aa, Mycobacterium
LPDGP

SEQ ID NO: 521811 - protein, 11 aa, Mycobacterium
LPDGPAPMQEK

SEQ ID NO: 521812 - protein, 7 aa, Mycobacterium
LPDGPAR

SEQ ID NO: 521813 - protein, 10 aa, Mycobacterium
LPDGPDGPRA

SEQ ID NO: 521814 - protein, 6 aa, Mycobacterium
LPDGPG

SEQ ID NO: 521815 - protein, 9 aa, Mycobacterium
LPDGPPDFS

SEQ ID NO: 521816 - protein, 8 aa, Mycobacterium
LPDGQRQQ

SEQ ID NO: 521817 - protein, 11 aa, Mycobacterium
LPDGQSSLERI

SEQ ID NO: 521818 - protein, 5 aa, Mycobacterium
LPDGS

SEQ ID NO: 521819 - protein, 11 aa, Mycobacterium
LPDGSDVQPSY

SEQ ID NO: 521820 - protein, 12 aa, Mycobacterium
LPDGSPAPTREL

SEQ ID NO: 521821 - protein, 12 aa, Mycobacterium
LPDGSPTQPAYL

SEQ ID NO: 521822 - protein, 6 aa, Mycobacterium
LPDGSR

SEQ ID NO: 521823 - protein, 6 aa, Mycobacterium
LPDGST

SEQ ID NO: 521824 - protein, 15 aa, Mycobacterium
LPDGSTAWKRSPGGL

SEQ ID NO: 521825 - protein, 15 aa, Mycobacterium
LPDGSTEWKRSPGGL

SEQ ID NO: 521826 - protein, 13 aa, Mycobacterium
LPDGSTTMAPNAV

SEQ ID NO: 521827 - protein, 9 aa, Mycobacterium
LPDGSTYDL

SEQ ID NO: 521828 - protein, 26 aa, Mycobacterium
LPDGTAVSSGEGGGVRIGGGGAYQPQ

SEQ ID NO: 521829 - protein, 6 aa, Mycobacterium
LPDGTD

SEQ ID NO: 521830 - protein, 7 aa, Mycobacterium
LPDGTDF

SEQ ID NO: 521831 - protein, 6 aa, Mycobacterium
LPDGTE

SEQ ID NO: 521832 - protein, 14 aa, Mycobacterium
LPDGTESSPEDDDF

SEQ ID NO: 521833 - protein, 10 aa, Mycobacterium
LPDGTGAGDL

SEQ ID NO: 521834 - protein, 8 aa, Mycobacterium
LPDGTGGT

SEQ ID NO: 521835 - protein, 26 aa, Mycobacterium
LPDGTPVSSGEGGGVKIGGGGAYQPQ

SEQ ID NO: 521836 - protein, 26 aa, Mycobacterium
LPDGTPVSSGEGGGVRVGGGGAYQDQ

SEQ ID NO: 521837 - protein, 17 aa, Mycobacterium
LPDGTSVAADDPGVDDR

SEQ ID NO: 521838 - protein, 15 aa, Mycobacterium
LPDGTTRWKRSPGGL

SEQ ID NO: 521839 - protein, 15 aa, Mycobacterium
LPDGTTTWKRSPGGL

SEQ ID NO: 521840 - protein, 20 aa, Mycobacterium
LPDGTTVSTDDGPRPGTTYE

SEQ ID NO: 521841 - protein, 11 aa, Mycobacterium
LPDGTVADDNA

SEQ ID NO: 521842 - protein, 7 aa, Mycobacterium
LPDGVPS

SEQ ID NO: 521843 - protein, 4 aa, Mycobacterium
LPDH

SEQ ID NO: 521844 - protein, 7 aa, Mycobacterium
LPDHGQA

SEQ ID NO: 521845 - protein, 5 aa, Mycobacterium
LPDID

SEQ ID NO: 521846 - protein, 13 aa, Mycobacterium
LPDISKRAEPQRL

SEQ ID NO: 521847 - protein, 13 aa, Mycobacterium
LPDKAARERTTRR

SEQ ID NO: 521848 - protein, 10 aa, Mycobacterium
LPDKARPSAR

SEQ ID NO: 521849 - protein, 9 aa, Mycobacterium
LPDKGEPAP

SEQ ID NO: 521850 - protein, 5 aa, Mycobacterium
LPDKI

SEQ ID NO: 521851 - protein, 6 aa, Mycobacterium
LPDKQR

SEQ ID NO: 521852 - protein, 9 aa, Mycobacterium
LPDKQRARA

SEQ ID NO: 521853 - protein, 8 aa, Mycobacterium
LPDKQRQH

SEQ ID NO: 521854 - protein, 23 aa, Mycobacterium
LPDLGEAEHQAPAATISFVRAVR

SEQ ID NO: 521855 - protein, 5 aa, Mycobacterium
LPDNA

SEQ ID NO: 521856 - protein, 6 aa, Mycobacterium
LPDNEI

SEQ ID NO: 521857 - protein, 12 aa, Mycobacterium
LPDNNDAPGYPP

SEQ ID NO: 521858 - protein, 11 aa, Mycobacterium
LPDNPDGPAPE

SEQ ID NO: 521859 - protein, 4 aa, Mycobacterium
LPDP

SEQ ID NO: 521860 - protein, 9 aa, Mycobacterium
LPDPADPDH

SEQ ID NO: 521861 - protein, 9 aa, Mycobacterium
LPDPADPGH

SEQ ID NO: 521862 - protein, 13 aa, Mycobacterium
LPDPAGGVSKPQP

SEQ ID NO: 521863 - protein, 10 aa, Mycobacterium
LPDPAPGTGE

SEQ ID NO: 521864 - protein, 8 aa, Mycobacterium
LPDPDHAA

SEQ ID NO: 521865 - protein, 9 aa, Mycobacterium
LPDPDQAAQ

SEQ ID NO: 521866 - protein, 6 aa, Mycobacterium
LPDPEA

SEQ ID NO: 521867 - protein, 9 aa, Mycobacterium
LPDPERPHR

SEQ ID NO: 521868 - protein, 5 aa, Mycobacterium
LPDPF

SEQ ID NO: 521869 - protein, 6 aa, Mycobacterium
LPDPFT

SEQ ID NO: 521870 - protein, 6 aa, Mycobacterium
LPDPGQ

SEQ ID NO: 521871 - protein, 7 aa, Mycobacterium
LPDPGSL

SEQ ID NO: 521872 - protein, 5 aa, Mycobacterium
LPDPH

SEQ ID NO: 521873 - protein, 6 aa, Mycobacterium
LPDPNA

SEQ ID NO: 521874 - protein, 7 aa, Mycobacterium
LPDPPRH

SEQ ID NO: 521875 - protein, 11 aa, Mycobacterium
LPDPPSGDTVT

SEQ ID NO: 521876 - protein, 6 aa, Mycobacterium
LPDPRL

SEQ ID NO: 521877 - protein, 7 aa, Mycobacterium
LPDPRPA

SEQ ID NO: 521878 - protein, 8 aa, Mycobacterium
LPDPSAPV

SEQ ID NO: 521879 - protein, 7 aa, Mycobacterium
LPDPSPD

SEQ ID NO: 521880 - protein, 8 aa, Mycobacterium
LPDPTDAR

SEQ ID NO: 521881 - protein, 7 aa, Mycobacterium
LPDPTGY

SEQ ID NO: 521882 - protein, 16 aa, Mycobacterium
LPDPVGSKVPSDAETV

SEQ ID NO: 521883 - protein, 19 aa, Mycobacterium
LPDPVGTKVPVPSNAETVA

SEQ ID NO: 521884 - protein, 8 aa, Mycobacterium
LPDPVQEA

SEQ ID NO: 521885 - protein, 12 aa, Mycobacterium
LPDQAAGMERPR

SEQ ID NO: 521886 - protein, 12 aa, Mycobacterium
LPDQDDPAAFGP

SEQ ID NO: 521887 - protein, 6 aa, Mycobacterium
LPDQGT

SEQ ID NO: 521888 - protein, 6 aa, Mycobacterium
LPDQPA

SEQ ID NO: 521889 - protein, 9 aa, Mycobacterium
LPDQPGSAD

SEQ ID NO: 521890 - protein, 10 aa, Mycobacterium
LPDQPPDPDL

SEQ ID NO: 521891 - protein, 12 aa, Mycobacterium
LPDRAPPIPRPF

SEQ ID NO: 521892 - protein, 5 aa, Mycobacterium
LPDRD

SEQ ID NO: 521893 - protein, 7 aa, Mycobacterium
LPDRDGG

SEQ ID NO: 521894 - protein, 9 aa, Mycobacterium
LPDRDSAAA

SEQ ID NO: 521895 - protein, 11 aa, Mycobacterium
LPDRERAARRL

SEQ ID NO: 521896 - protein, 9 aa, Mycobacterium
LPDRGPQTW

SEQ ID NO: 521897 - protein, 5 aa, Mycobacterium
LPDRP

SEQ ID NO: 521898 - protein, 8 aa, Mycobacterium
LPDRPATR

SEQ ID NO: 521899 - protein, 8 aa, Mycobacterium
LPDRQHPG

SEQ ID NO: 521900 - protein, 7 aa, Mycobacterium
LPDRQRQ

SEQ ID NO: 521901 - protein, 7 aa, Mycobacterium
LPDRQRR

SEQ ID NO: 521902 - protein, 18 aa, Mycobacterium
LPDRTAGVDYPAGTTARR

SEQ ID NO: 521903 - protein, 6 aa, Mycobacterium
LPDRTW

SEQ ID NO: 521904 - protein, 5 aa, Mycobacterium
LPDRY

SEQ ID NO: 521905 - protein, 8 aa, Mycobacterium
LPDSARSE

SEQ ID NO: 521906 - protein, 6 aa, Mycobacterium
LPDSEI

SEQ ID NO: 521907 - protein, 9 aa, Mycobacterium
LPDSGGVEF

SEQ ID NO: 521908 - protein, 11 aa, Mycobacterium
LPDSGGVVRGK

SEQ ID NO: 521909 - protein, 13 aa, Mycobacterium
LPDSGQLAPGEAI

SEQ ID NO: 521910 - protein, 6 aa, Mycobacterium
LPDSLA

SEQ ID NO: 521911 - protein, 8 aa, Mycobacterium
LPDSLNGR

SEQ ID NO: 521912 - protein, 7 aa, Mycobacterium
LPDSPAP

SEQ ID NO: 521913 - protein, 9 aa, Mycobacterium
LPDSPDDDT

SEQ ID NO: 521914 - protein, 5 aa, Mycobacterium
LPDSR

SEQ ID NO: 521915 - protein, 6 aa, Mycobacterium
LPDSRR

SEQ ID NO: 521916 - protein, 14 aa, Mycobacterium
LPDSTHSANDASAA

SEQ ID NO: 521917 - protein, 7 aa, Mycobacterium
LPDSTVR

SEQ ID NO: 521918 - protein, 4 aa, Mycobacterium
LPDT

SEQ ID NO: 521919 - protein, 13 aa, Mycobacterium
LPDTAKRQVRRAQ

SEQ ID NO: 521920 - protein, 9 aa, Mycobacterium
LPDTAPVNS

SEQ ID NO: 521921 - protein, 7 aa, Mycobacterium
LPDTATA

SEQ ID NO: 521922 - protein, 8 aa, Mycobacterium
LPDTDDAN

SEQ ID NO: 521923 - protein, 9 aa, Mycobacterium
LPDTDDVRE

SEQ ID NO: 521924 - protein, 16 aa, Mycobacterium
LPDTDHSLKAGSRGPT

SEQ ID NO: 521925 - protein, 18 aa, Mycobacterium
LPDTDPAVLTDAAALVHS

SEQ ID NO: 521926 - protein, 5 aa, Mycobacterium
LPDTE

SEQ ID NO: 521927 - protein, 7 aa, Mycobacterium
LPDTEPG

SEQ ID NO: 521928 - protein, 11 aa, Mycobacterium
LPDTGPYQLPE

SEQ ID NO: 521929 - protein, 6 aa, Mycobacterium
LPDTIE

SEQ ID NO: 521930 - protein, 8 aa, Mycobacterium
LPDTKPGV

SEQ ID NO: 521931 - protein, 7 aa, Mycobacterium
LPDTLRS

SEQ ID NO: 521932 - protein, 6 aa, Mycobacterium
LPDTPE

SEQ ID NO: 521933 - protein, 6 aa, Mycobacterium
LPDTPN

SEQ ID NO: 521934 - protein, 17 aa, Mycobacterium
LPDTPTGGHSGKTVAES

SEQ ID NO: 521935 - protein, 13 aa, Mycobacterium
LPDTSARAHHDGD

SEQ ID NO: 521936 - protein, 5 aa, Mycobacterium
LPDTT

SEQ ID NO: 521937 - protein, 9 aa, Mycobacterium
LPDTTAVPT

SEQ ID NO: 521938 - protein, 8 aa, Mycobacterium
LPDTTGGR

SEQ ID NO: 521939 - protein, 5 aa, Mycobacterium
LPDVP

SEQ ID NO: 521940 - protein, 4 aa, Mycobacterium
LPEA

SEQ ID NO: 521941 - protein, 9 aa, Mycobacterium
LPEAADDHR

SEQ ID NO: 521942 - protein, 13 aa, Mycobacterium
LPEAAESAQLPES

SEQ ID NO: 521943 - protein, 8 aa, Mycobacterium
LPEAEQDN

SEQ ID NO: 521944 - protein, 9 aa, Mycobacterium
LPEAGHERQ

SEQ ID NO: 521945 - protein, 13 aa, Mycobacterium
LPEAKSQVSWEDP

SEQ ID NO: 521946 - protein, 8 aa, Mycobacterium
LPEAPRPY

SEQ ID NO: 521947 - protein, 11 aa, Mycobacterium
LPEAPSAAQLR

SEQ ID NO: 521948 - protein, 11 aa, Mycobacterium
LPEAPSAPQLR

SEQ ID NO: 521949 - protein, 11 aa, Mycobacterium
LPEAPSPAQLR

SEQ ID NO: 521950 - protein, 11 aa, Mycobacterium
LPEATGSETAL

SEQ ID NO: 521951 - protein, 11 aa, Mycobacterium
LPEATSDAYPG

SEQ ID NO: 521952 - protein, 4 aa, Mycobacterium
LPED

SEQ ID NO: 521953 - protein, 5 aa, Mycobacterium
LPEDA

SEQ ID NO: 521954 - protein, 22 aa, Mycobacterium
LPEDDDHPYRTGPWRPQTTEWD

SEQ ID NO: 521955 - protein, 23 aa, Mycobacterium
LPEDDDHPYRTGPWRPQTTEWDD

SEQ ID NO: 521956 - protein, 8 aa, Mycobacterium
LPEDDQAE

SEQ ID NO: 521957 - protein, 5 aa, Mycobacterium
LPEDE

SEQ ID NO: 521958 - protein, 6 aa, Mycobacterium
LPEDEQ

SEQ ID NO: 521959 - protein, 8 aa, Mycobacterium
LPEDEQAD

SEQ ID NO: 521960 - protein, 7 aa, Mycobacterium
LPEDEQQ

SEQ ID NO: 521961 - protein, 8 aa, Mycobacterium
LPEDIDKG

SEQ ID NO: 521962 - protein, 5 aa, Mycobacterium
LPEDL

SEQ ID NO: 521963 - protein, 12 aa, Mycobacterium
LPEDLQPYQEEN

SEQ ID NO: 521964 - protein, 7 aa, Mycobacterium
LPEDNPL

SEQ ID NO: 521965 - protein, 7 aa, Mycobacterium
LPEDNPV

SEQ ID NO: 521966 - protein, 8 aa, Mycobacterium
LPEDPAEG

SEQ ID NO: 521967 - protein, 13 aa, Mycobacterium
LPEDPDAKPRPLA

SEQ ID NO: 521968 - protein, 6 aa, Mycobacterium
LPEDPW

SEQ ID NO: 521969 - protein, 13 aa, Mycobacterium
LPEDRGGLGGGAE

SEQ ID NO: 521970 - protein, 6 aa, Mycobacterium
LPEDRR

SEQ ID NO: 521971 - protein, 7 aa, Mycobacterium
LPEDTDD

SEQ ID NO: 521972 - protein, 8 aa, Mycobacterium
LPEDTPAS

SEQ ID NO: 521973 - protein, 11 aa, Mycobacterium
LPEDTRVPTDG

SEQ ID NO: 521974 - protein, 14 aa, Mycobacterium
LPEDVNAPSDSGEA

SEQ ID NO: 521975 - protein, 13 aa, Mycobacterium
LPEDYQASELTPG

SEQ ID NO: 521976 - protein, 9 aa, Mycobacterium
LPEEAKSMA

SEQ ID NO: 521977 - protein, 26 aa, Mycobacterium
LPEEAQKSLGAQVPHPARLGDPDEYG

SEQ ID NO: 521978 - protein, 26 aa, Mycobacterium
LPEEAQKSLGKQVPHPARLGDPDEYG

SEQ ID NO: 521979 - protein, 8 aa, Mycobacterium
LPEEAQSM

SEQ ID NO: 521980 - protein, 13 aa, Mycobacterium
LPEEATAQPLPGG

SEQ ID NO: 521981 - protein, 5 aa, Mycobacterium
LPEED

SEQ ID NO: 521982 - protein, 5 aa, Mycobacterium
LPEEE

SEQ ID NO: 521983 - protein, 12 aa, Mycobacterium
LPEEGGAASAVK

SEQ ID NO: 521984 - protein, 6 aa, Mycobacterium
LPEEHT

SEQ ID NO: 521985 - protein, 5 aa, Mycobacterium
LPEEI

SEQ ID NO: 521986 - protein, 6 aa, Mycobacterium
LPEEIG

SEQ ID NO: 521987 - protein, 6 aa, Mycobacterium
LPEEKR

SEQ ID NO: 521988 - protein, 11 aa, Mycobacterium
LPEEKRQAALA

SEQ ID NO: 521989 - protein, 5 aa, Mycobacterium
LPEEL

SEQ ID NO: 521990 - protein, 11 aa, Mycobacterium
LPEELQPYQAD

SEQ ID NO: 521991 - protein, 12 aa, Mycobacterium
LPEENGGIGGGP

SEQ ID NO: 521992 - protein, 6 aa, Mycobacterium
LPEEPE

SEQ ID NO: 521993 - protein, 12 aa, Mycobacterium
LPEESGGIGGGA

SEQ ID NO: 521994 - protein, 6 aa, Mycobacterium
LPEGAA

SEQ ID NO: 521995 - protein, 8 aa, Mycobacterium
LPEGAGTL

SEQ ID NO: 521996 - protein, 9 aa, Mycobacterium
LPEGANTEV

SEQ ID NO: 521997 - protein, 9 aa, Mycobacterium
LPEGASGFT

SEQ ID NO: 521998 - protein, 11 aa, Mycobacterium
LPEGAVTPQGI

SEQ ID NO: 521999 - protein, 5 aa, Mycobacterium
LPEGE

SEQ ID NO: 522000 - protein, 9 aa, Mycobacterium
LPEGGWPPT

SEQ ID NO: 522001 - protein, 22 aa, Mycobacterium
LPEGHPDALNDDTRPRKLRPGD

SEQ ID NO: 522002 - protein, 13 aa, Mycobacterium
LPEGKRQAALAEA

SEQ ID NO: 522003 - protein, 5 aa, Mycobacterium
LPEGP

SEQ ID NO: 522004 - protein, 12 aa, Mycobacterium
LPEGPAPKKAFG

SEQ ID NO: 522005 - protein, 8 aa, Mycobacterium
LPEGPGRA

SEQ ID NO: 522006 - protein, 12 aa, Mycobacterium
LPEGPPAPKAFG

SEQ ID NO: 522007 - protein, 12 aa, Mycobacterium
LPEGPPPSKAFG

SEQ ID NO: 522008 - protein, 6 aa, Mycobacterium
LPEGPR

SEQ ID NO: 522009 - protein, 7 aa, Mycobacterium
LPEGQPE

SEQ ID NO: 522010 - protein, 5 aa, Mycobacterium
LPEGR

SEQ ID NO: 522011 - protein, 5 aa, Mycobacterium
LPEGS

SEQ ID NO: 522012 - protein, 6 aa, Mycobacterium
LPEGSD

SEQ ID NO: 522013 - protein, 8 aa, Mycobacterium
LPEGSEAL

SEQ ID NO: 522014 - protein, 11 aa, Mycobacterium
LPEGSPAPAED

SEQ ID NO: 522015 - protein, 8 aa, Mycobacterium
LPEGTPAD

SEQ ID NO: 522016 - protein, 9 aa, Mycobacterium
LPEGTPADQ

SEQ ID NO: 522017 - protein, 9 aa, Mycobacterium
LPEGTPPDK

SEQ ID NO: 522018 - protein, 9 aa, Mycobacterium
LPEGTRRPV

SEQ ID NO: 522019 - protein, 9 aa, Mycobacterium
LPEGTTAAQ

SEQ ID NO: 522020 - protein, 12 aa, Mycobacterium
LPEGTTAASNAE

SEQ ID NO: 522021 - protein, 5 aa, Mycobacterium
LPEGW

SEQ ID NO: 522022 - protein, 15 aa, Mycobacterium
LPEGYKATEVTPGEY

SEQ ID NO: 522023 - protein, 4 aa, Mycobacterium
LPEH

SEQ ID NO: 522024 - protein, 14 aa, Mycobacterium
LPEHAPDFARRSPI

SEQ ID NO: 522025 - protein, 12 aa, Mycobacterium
LPEHAPKYARRA

SEQ ID NO: 522026 - protein, 12 aa, Mycobacterium
LPEHAPRFARRR

SEQ ID NO: 522027 - protein, 6 aa, Mycobacterium
LPEHKP

SEQ ID NO: 522028 - protein, 4 aa, Mycobacterium
LPEK

SEQ ID NO: 522029 - protein, 6 aa, Mycobacterium
LPEKAR

SEQ ID NO: 522030 - protein, 7 aa, Mycobacterium
LPEKPPH

SEQ ID NO: 522031 - protein, 11 aa, Mycobacterium
LPEKPSTAQLR

SEQ ID NO: 522032 - protein, 8 aa, Mycobacterium
LPEKRRAQ

SEQ ID NO: 522033 - protein, 8 aa, Mycobacterium
LPEKTAEV

SEQ ID NO: 522034 - protein, 4 aa, Mycobacterium
LPEL

SEQ ID NO: 522035 - protein, 23 aa, Mycobacterium
LPELGKAAEQVPATTIKFVRAVR

SEQ ID NO: 522036 - protein, 7 aa, Mycobacterium
LPEMPEP

SEQ ID NO: 522037 - protein, 9 aa, Mycobacterium
LPENSGRYR

SEQ ID NO: 522038 - protein, 12 aa, Mycobacterium
LPEPADPADEWD

SEQ ID NO: 522039 - protein, 25 aa, Mycobacterium
LPEPARESLGKQVPHPSRLGSPDEY

SEQ ID NO: 522040 - protein, 11 aa, Mycobacterium
LPEPDDPADNW

SEQ ID NO: 522041 - protein, 6 aa, Mycobacterium
LPEPDE

SEQ ID NO: 522042 - protein, 8 aa, Mycobacterium
LPEPDRDA

SEQ ID NO: 522043 - protein, 6 aa, Mycobacterium
LPEPEP

SEQ ID NO: 522044 - protein, 7 aa, Mycobacterium
LPEPEPL

SEQ ID NO: 522045 - protein, 16 aa, Mycobacterium
LPEPEQATTSTAGTRE

SEQ ID NO: 522046 - protein, 17 aa, Mycobacterium
LPEPGAGDTPDNQPSLS

SEQ ID NO: 522047 - protein, 11 aa, Mycobacterium
LPEPGDPSEKI

SEQ ID NO: 522048 - protein, 9 aa, Mycobacterium
LPEPGDPTH

SEQ ID NO: 522049 - protein, 7 aa, Mycobacterium
LPEPGDV

SEQ ID NO: 522050 - protein, 9 aa, Mycobacterium
LPEPGEPKR

SEQ ID NO: 522051 - protein, 9 aa, Mycobacterium
LPEPGESKR

SEQ ID NO: 522052 - protein, 9 aa, Mycobacterium
LPEPGGRDE

SEQ ID NO: 522053 - protein, 8 aa, Mycobacterium
LPEPGSYA

SEQ ID NO: 522054 - protein, 14 aa, Mycobacterium
LPEPHGAEDARDAI

SEQ ID NO: 522055 - protein, 6 aa, Mycobacterium
LPEPKS

SEQ ID NO: 522056 - protein, 6 aa, Mycobacterium
LPEPPA

SEQ ID NO: 522057 - protein, 6 aa, Mycobacterium
LPEPPS

SEQ ID NO: 522058 - protein, 13 aa, Mycobacterium
LPEPPSAAQARGS

SEQ ID NO: 522059 - protein, 7 aa, Mycobacterium
LPEPPTA

SEQ ID NO: 522060 - protein, 9 aa, Mycobacterium
LPEPPTGDV

SEQ ID NO: 522061 - protein, 11 aa, Mycobacterium
LPEPQPGPGTV

SEQ ID NO: 522062 - protein, 9 aa, Mycobacterium
LPEPRASAA

SEQ ID NO: 522063 - protein, 11 aa, Mycobacterium
LPEPRSTAQLR

SEQ ID NO: 522064 - protein, 9 aa, Mycobacterium
LPEPSDPRH

SEQ ID NO: 522065 - protein, 11 aa, Mycobacterium
LPEPSSTAQVR

SEQ ID NO: 522066 - protein, 10 aa, Mycobacterium
LPEPSTALDA

SEQ ID NO: 522067 - protein, 10 aa, Mycobacterium
LPEPTASSAF

SEQ ID NO: 522068 - protein, 11 aa, Mycobacterium
LPEPTASSAFT

SEQ ID NO: 522069 - protein, 7 aa, Mycobacterium
LPEPTDA

SEQ ID NO: 522070 - protein, 8 aa, Mycobacterium
LPEPTDAM

SEQ ID NO: 522071 - protein, 12 aa, Mycobacterium
LPEPTDDPADPS

SEQ ID NO: 522072 - protein, 6 aa, Mycobacterium
LPEPTR

SEQ ID NO: 522073 - protein, 21 aa, Mycobacterium
LPEPTRGDRQPPAAAPGSAPT

SEQ ID NO: 522074 - protein, 15 aa, Mycobacterium
LPEPTSDEYLSGTTF

SEQ ID NO: 522075 - protein, 9 aa, Mycobacterium
LPEPTSVDG

SEQ ID NO: 522076 - protein, 17 aa, Mycobacterium
LPEPTSVDGIDQEPMDG

SEQ ID NO: 522077 - protein, 17 aa, Mycobacterium
LPEPTSVDGVEQEPMDG

SEQ ID NO: 522078 - protein, 13 aa, Mycobacterium
LPEPTTTLTDHDA

SEQ ID NO: 522079 - protein, 5 aa, Mycobacterium
LPEPV

SEQ ID NO: 522080 - protein, 11 aa, Mycobacterium
LPEPVGGNGGG

SEQ ID NO: 522081 - protein, 8 aa, Mycobacterium
LPEQDQAE

SEQ ID NO: 522082 - protein, 5 aa, Mycobacterium
LPEQE

SEQ ID NO: 522083 - protein, 6 aa, Mycobacterium
LPEQKR

SEQ ID NO: 522084 - protein, 6 aa, Mycobacterium
LPEQLS

SEQ ID NO: 522085 - protein, 5 aa, Mycobacterium
LPEQP

SEQ ID NO: 522086 - protein, 9 aa, Mycobacterium
LPEQPEPGT

SEQ ID NO: 522087 - protein, 8 aa, Mycobacterium
LPEQQRQQ

SEQ ID NO: 522088 - protein, 7 aa, Mycobacterium
LPEQRQR

SEQ ID NO: 522089 - protein, 13 aa, Mycobacterium
LPEQRRALSERSA

SEQ ID NO: 522090 - protein, 9 aa, Mycobacterium
LPEQSRRKT

SEQ ID NO: 522091 - protein, 5 aa, Mycobacterium
LPEQT

SEQ ID NO: 522092 - protein, 5 aa, Mycobacterium
LPERA

SEQ ID NO: 522093 - protein, 12 aa, Mycobacterium
LPERAAADPPQP

SEQ ID NO: 522094 - protein, 8 aa, Mycobacterium
LPERADAT

SEQ ID NO: 522095 - protein, 12 aa, Mycobacterium
LPERAHSNQNYD

SEQ ID NO: 522096 - protein, 8 aa, Mycobacterium
LPERDGEE

SEQ ID NO: 522097 - protein, 6 aa, Mycobacterium
LPERDQ

SEQ ID NO: 522098 - protein, 10 aa, Mycobacterium
LPEREEHDER

SEQ ID NO: 522099 - protein, 12 aa, Mycobacterium
LPERERAAKRLG

SEQ ID NO: 522100 - protein, 8 aa, Mycobacterium
LPERGAPG

SEQ ID NO: 522101 - protein, 13 aa, Mycobacterium
LPERGVAKPNHDS

SEQ ID NO: 522102 - protein, 8 aa, Mycobacterium
LPERKPGL

SEQ ID NO: 522103 - protein, 10 aa, Mycobacterium
LPERNTGAGV

SEQ ID NO: 522104 - protein, 5 aa, Mycobacterium
LPERP

SEQ ID NO: 522105 - protein, 21 aa, Mycobacterium
LPERPRRRRAAGRPAGPPIHV

SEQ ID NO: 522106 - protein, 7 aa, Mycobacterium
LPERQRK

SEQ ID NO: 522107 - protein, 14 aa, Mycobacterium
LPERSGVVRDSGTQ

SEQ ID NO: 522108 - protein, 14 aa, Mycobacterium
LPESAGGGGGDGAD

SEQ ID NO: 522109 - protein, 8 aa, Mycobacterium
LPESDQAE

SEQ ID NO: 522110 - protein, 5 aa, Mycobacterium
LPESE

SEQ ID NO: 522111 - protein, 12 aa, Mycobacterium
LPESERVQIFFD

SEQ ID NO: 522112 - protein, 6 aa, Mycobacterium
LPESES

SEQ ID NO: 522113 - protein, 8 aa, Mycobacterium
LPESESTL

SEQ ID NO: 522114 - protein, 8 aa, Mycobacterium
LPESGRWS

SEQ ID NO: 522115 - protein, 6 aa, Mycobacterium
LPESGY

SEQ ID NO: 522116 - protein, 10 aa, Mycobacterium
LPESKGEVAY

SEQ ID NO: 522117 - protein, 14 aa, Mycobacterium
LPESRTPALSAAEQ

SEQ ID NO: 522118 - protein, 11 aa, Mycobacterium
LPESSKAGQRL

SEQ ID NO: 522119 - protein, 12 aa, Mycobacterium
LPESTGSSRPER

SEQ ID NO: 522120 - protein, 4 aa, Mycobacterium
LPET

SEQ ID NO: 522121 - protein, 17 aa, Mycobacterium
LPETAEPEIGSDPRIPT

SEQ ID NO: 522122 - protein, 5 aa, Mycobacterium
LPETD

SEQ ID NO: 522123 - protein, 11 aa, Mycobacterium
LPETDEQTPRT

SEQ ID NO: 522124 - protein, 7 aa, Mycobacterium
LPETDPA

SEQ ID NO: 522125 - protein, 7 aa, Mycobacterium
LPETLEK

SEQ ID NO: 522126 - protein, 6 aa, Mycobacterium
LPETPD

SEQ ID NO: 522127 - protein, 7 aa, Mycobacterium
LPETPQF

SEQ ID NO: 522128 - protein, 5 aa, Mycobacterium
LPETV

SEQ ID NO: 522129 - protein, 8 aa, Mycobacterium
LPEVPEPL

SEQ ID NO: 522130 - protein, 5 aa, Mycobacterium
LPEVS

SEQ ID NO: 522131 - protein, 12 aa, Mycobacterium
LPEVTAQSGTEL

SEQ ID NO: 522132 - protein, 4 aa, Mycobacterium
LPEW

SEQ ID NO: 522133 - protein, 17 aa, Mycobacterium
LPEYPGDPKNEEETEIK

SEQ ID NO: 522134 - protein, 5 aa, Mycobacterium
LPEYR

SEQ ID NO: 522135 - protein, 5 aa, Mycobacterium
LPFDD

SEQ ID NO: 522136 - protein, 8 aa, Mycobacterium
LPFDPPAR

SEQ ID NO: 522137 - protein, 7 aa, Mycobacterium
LPFPPEP

SEQ ID NO: 522138 - protein, 8 aa, Mycobacterium
LPFSPGAE

SEQ ID NO: 522139 - protein, 26 aa, Mycobacterium
LPFTASGKVKKSELAQQLSELLAHPK

SEQ ID NO: 522140 - protein, 16 aa, Mycobacterium
LPGAADADIGDTPELG

SEQ ID NO: 522141 - protein, 14 aa, Mycobacterium
LPGAADPEVSNAEE

SEQ ID NO: 522142 - protein, 15 aa, Mycobacterium
LPGAADSDVGDSAEL

SEQ ID NO: 522143 - protein, 12 aa, Mycobacterium
LPGAADSDVGQV

SEQ ID NO: 522144 - protein, 15 aa, Mycobacterium
LPGAARAAAEAEEGK

SEQ ID NO: 522145 - protein, 12 aa, Mycobacterium
LPGAARAAAQAA

SEQ ID NO: 522146 - protein, 9 aa, Mycobacterium
LPGAASTNI

SEQ ID NO: 522147 - protein, 8 aa, Mycobacterium
LPGADACS

SEQ ID NO: 522148 - protein, 18 aa, Mycobacterium
LPGADASREFTGRAEQGT

SEQ ID NO: 522149 - protein, 11 aa, Mycobacterium
LPGAEEEKRGI

SEQ ID NO: 522150 - protein, 8 aa, Mycobacterium
LPGAENAR

SEQ ID NO: 522151 - protein, 9 aa, Mycobacterium
LPGAGCTED

SEQ ID NO: 522152 - protein, 9 aa, Mycobacterium
LPGAGCTEE

SEQ ID NO: 522153 - protein, 8 aa, Mycobacterium
LPGAGGRV

SEQ ID NO: 522154 - protein, 9 aa, Mycobacterium
LPGAKETAA

SEQ ID NO: 522155 - protein, 7 aa, Mycobacterium
LPGANGK

SEQ ID NO: 522156 - protein, 7 aa, Mycobacterium
LPGANGR

SEQ ID NO: 522157 - protein, 16 aa, Mycobacterium
LPGAPAPIPTPGHSGG

SEQ ID NO: 522158 - protein, 6 aa, Mycobacterium
LPGAPE

SEQ ID NO: 522159 - protein, 20 aa, Mycobacterium
LPGAPISPRRGGKPNPAPST

SEQ ID NO: 522160 - protein, 14 aa, Mycobacterium
LPGAPKPADGFGSG

SEQ ID NO: 522161 - protein, 6 aa, Mycobacterium
LPGAPQ

SEQ ID NO: 522162 - protein, 7 aa, Mycobacterium
LPGAPRL

SEQ ID NO: 522163 - protein, 5 aa, Mycobacterium
LPGAQ

SEQ ID NO: 522164 - protein, 8 aa, Mycobacterium
LPGASPDM

SEQ ID NO: 522165 - protein, 8 aa, Mycobacterium
LPGASRSD

SEQ ID NO: 522166 - protein, 5 aa, Mycobacterium
LPGAT

SEQ ID NO: 522167 - protein, 15 aa, Mycobacterium
LPGATKINPSGGALA

SEQ ID NO: 522168 - protein, 7 aa, Mycobacterium
LPGATRG

SEQ ID NO: 522169 - protein, 9 aa, Mycobacterium
LPGDDPGPV

SEQ ID NO: 522170 - protein, 8 aa, Mycobacterium
LPGDDRRA

SEQ ID NO: 522171 - protein, 25 aa, Mycobacterium
LPGDGADAYRDGHGTDTRNYGGVQG

SEQ ID NO: 522172 - protein, 9 aa, Mycobacterium
LPGDGDQLR

SEQ ID NO: 522173 - protein, 14 aa, Mycobacterium
LPGDGLREFAFAPL

SEQ ID NO: 522174 - protein, 21 aa, Mycobacterium
LPGDGPGGSKGGTPDGPPPKA

SEQ ID NO: 522175 - protein, 10 aa, Mycobacterium
LPGDGPQSVA

SEQ ID NO: 522176 - protein, 13 aa, Mycobacterium
LPGDGPQTPTPKA

SEQ ID NO: 522177 - protein, 12 aa, Mycobacterium
LPGDGYGSFEDA

SEQ ID NO: 522178 - protein, 6 aa, Mycobacterium
LPGDHS

SEQ ID NO: 522179 - protein, 8 aa, Mycobacterium
LPGDPARY

SEQ ID NO: 522180 - protein, 9 aa, Mycobacterium
LPGDPDAEA

SEQ ID NO: 522181 - protein, 10 aa, Mycobacterium
LPGDPEFGDP

SEQ ID NO: 522182 - protein, 12 aa, Mycobacterium
LPGDPGFDSAAG

SEQ ID NO: 522183 - protein, 12 aa, Mycobacterium
LPGDPGYDSAGG

SEQ ID NO: 522184 - protein, 8 aa, Mycobacterium
LPGDPIPA

SEQ ID NO: 522185 - protein, 8 aa, Mycobacterium
LPGDPKKV

SEQ ID NO: 522186 - protein, 8 aa, Mycobacterium
LPGDPRKV

SEQ ID NO: 522187 - protein, 6 aa, Mycobacterium
LPGDPT

SEQ ID NO: 522188 - protein, 9 aa, Mycobacterium
LPGDVNSPA

SEQ ID NO: 522189 - protein, 7 aa, Mycobacterium
LPGEAGW

SEQ ID NO: 522190 - protein, 12 aa, Mycobacterium
LPGEAGYERATP

SEQ ID NO: 522191 - protein, 6 aa, Mycobacterium
LPGEDV

SEQ ID NO: 522192 - protein, 11 aa, Mycobacterium
LPGEGASPAVG

SEQ ID NO: 522193 - protein, 17 aa, Mycobacterium
LPGEGPPTAGARAARGL

SEQ ID NO: 522194 - protein, 8 aa, Mycobacterium
LPGEPADY

SEQ ID NO: 522195 - protein, 6 aa, Mycobacterium
LPGEPP

SEQ ID NO: 522196 - protein, 5 aa, Mycobacterium
LPGER

SEQ ID NO: 522197 - protein, 6 aa, Mycobacterium
LPGERS

SEQ ID NO: 522198 - protein, 9 aa, Mycobacterium
LPGESGADV

SEQ ID NO: 522199 - protein, 7 aa, Mycobacterium
LPGETAL

SEQ ID NO: 522200 - protein, 6 aa, Mycobacterium
LPGETH

SEQ ID NO: 522201 - protein, 8 aa, Mycobacterium
LPGETRHD

SEQ ID NO: 522202 - protein, 5 aa, Mycobacterium
LPGEW

SEQ ID NO: 522203 - protein, 4 aa, Mycobacterium
LPGF

SEQ ID NO: 522204 - protein, 17 aa, Mycobacterium
LPGFGYSDKPSTTGWGT

SEQ ID NO: 522205 - protein, 5 aa, Mycobacterium
LPGFP

SEQ ID NO: 522206 - protein, 5 aa, Mycobacterium
LPGGA

SEQ ID NO: 522207 - protein, 28 aa, Mycobacterium
LPGGAGPQRAEHHAGGRVQPRPRLGDRR

SEQ ID NO: 522208 - protein, 18 aa, Mycobacterium
LPGGAGRFPTVNPATEEV

SEQ ID NO: 522209 - protein, 6 aa, Mycobacterium
LPGGAK

SEQ ID NO: 522210 - protein, 10 aa, Mycobacterium
LPGGAPERRA

SEQ ID NO: 522211 - protein, 8 aa, Mycobacterium
LPGGDAAV

SEQ ID NO: 522212 - protein, 9 aa, Mycobacterium
LPGGDAAVR

SEQ ID NO: 522213 - protein, 5 aa, Mycobacterium
LPGGE

SEQ ID NO: 522214 - protein, 6 aa, Mycobacterium
LPGGEG

SEQ ID NO: 522215 - protein, 6 aa, Mycobacterium
LPGGEP

SEQ ID NO: 522216 - protein, 9 aa, Mycobacterium
LPGGESAND

SEQ ID NO: 522217 - protein, 10 aa, Mycobacterium
LPGGESGEDV

SEQ ID NO: 522218 - protein, 8 aa, Mycobacterium
LPGGESGF

SEQ ID NO: 522219 - protein, 6 aa, Mycobacterium
LPGGET

SEQ ID NO: 522220 - protein, 9 aa, Mycobacterium
LPGGETAQQ

SEQ ID NO: 522221 - protein, 8 aa, Mycobacterium
LPGGEVTP

SEQ ID NO: 522222 - protein, 5 aa, Mycobacterium
LPGGG

SEQ ID NO: 522223 - protein, 11 aa, Mycobacterium
LPGGGDDTHAV

SEQ ID NO: 522224 - protein, 6 aa, Mycobacterium
LPGGGF

SEQ ID NO: 522225 - protein, 8 aa, Mycobacterium
LPGGGQIG

SEQ ID NO: 522226 - protein, 14 aa, Mycobacterium
LPGGGRRLDQTADG

SEQ ID NO: 522227 - protein, 7 aa, Mycobacterium
LPGGGTV

SEQ ID NO: 522228 - protein, 16 aa, Mycobacterium
LPGGIDRADQRGRREH

SEQ ID NO: 522229 - protein, 17 aa, Mycobacterium
LPGGKQIDGTATAIDDQ

SEQ ID NO: 522230 - protein, 15 aa, Mycobacterium
LPGGKVADGESEPQA

SEQ ID NO: 522231 - protein, 8 aa, Mycobacterium
LPGGMPAG

SEQ ID NO: 522232 - protein, 5 aa, Mycobacterium
LPGGN

SEQ ID NO: 522233 - protein, 6 aa, Mycobacterium
LPGGND

SEQ ID NO: 522234 - protein, 6 aa, Mycobacterium
LPGGNT

SEQ ID NO: 522235 - protein, 11 aa, Mycobacterium
LPGGPLATAPL

SEQ ID NO: 522236 - protein, 9 aa, Mycobacterium
LPGGPLSKL

SEQ ID NO: 522237 - protein, 18 aa, Mycobacterium
LPGGPLSKVGKAGSRAAD

SEQ ID NO: 522238 - protein, 9 aa, Mycobacterium
LPGGPPDFS

SEQ ID NO: 522239 - protein, 9 aa, Mycobacterium
LPGGPPEIG

SEQ ID NO: 522240 - protein, 11 aa, Mycobacterium
LPGGQVRNDED

SEQ ID NO: 522241 - protein, 11 aa, Mycobacterium
LPGGQYRKRDQ

SEQ ID NO: 522242 - protein, 13 aa, Mycobacterium
LPGGQYRKREQLA

SEQ ID NO: 522243 - protein, 13 aa, Mycobacterium
LPGGQYRKRGQLA

SEQ ID NO: 522244 - protein, 12 aa, Mycobacterium
LPGGQYRKRTQL

SEQ ID NO: 522245 - protein, 5 aa, Mycobacterium
LPGGR

SEQ ID NO: 522246 - protein, 16 aa, Mycobacterium
LPGGRPPDIAADTAAP

SEQ ID NO: 522247 - protein, 16 aa, Mycobacterium
LPGGRSAGSDAVSSPR

SEQ ID NO: 522248 - protein, 14 aa, Mycobacterium
LPGGSAVSVEPGGA

SEQ ID NO: 522249 - protein, 8 aa, Mycobacterium
LPGGSIPG

SEQ ID NO: 522250 - protein, 11 aa, Mycobacterium
LPGGSPRPYGG

SEQ ID NO: 522251 - protein, 5 aa, Mycobacterium
LPGGT

SEQ ID NO: 522252 - protein, 16 aa, Mycobacterium
LPGGVEKADLRGQREH

SEQ ID NO: 522253 - protein, 10 aa, Mycobacterium
LPGGYSDSEL

SEQ ID NO: 522254 - protein, 9 aa, Mycobacterium
LPGGYSDTE

SEQ ID NO: 522255 - protein, 4 aa, Mycobacterium
LPGH

SEQ ID NO: 522256 - protein, 14 aa, Mycobacterium
LPGHAPSGLGFRPD

SEQ ID NO: 522257 - protein, 7 aa, Mycobacterium
LPGHDDG

SEQ ID NO: 522258 - protein, 16 aa, Mycobacterium
LPGHGPELSDLSAASA

SEQ ID NO: 522259 - protein, 5 aa, Mycobacterium
LPGHP

SEQ ID NO: 522260 - protein, 11 aa, Mycobacterium
LPGHPESGEER

SEQ ID NO: 522261 - protein, 8 aa, Mycobacterium
LPGHPGHD

SEQ ID NO: 522262 - protein, 14 aa, Mycobacterium
LPGHSPSGLGFRPD

SEQ ID NO: 522263 - protein, 5 aa, Mycobacterium
LPGHT

SEQ ID NO: 522264 - protein, 14 aa, Mycobacterium
LPGHTPSGLGFRPD

SEQ ID NO: 522265 - protein, 5 aa, Mycobacterium
LPGIG

SEQ ID NO: 522266 - protein, 15 aa, Mycobacterium
LPGIGEPAAQNRRER

SEQ ID NO: 522267 - protein, 8 aa, Mycobacterium
LPGKASQQ

SEQ ID NO: 522268 - protein, 9 aa, Mycobacterium
LPGKDGKRT

SEQ ID NO: 522269 - protein, 9 aa, Mycobacterium
LPGKDGNRT

SEQ ID NO: 522270 - protein, 12 aa, Mycobacterium
LPGKSAKFPASY

SEQ ID NO: 522271 - protein, 10 aa, Mycobacterium
LPGLADGEGA

SEQ ID NO: 522272 - protein, 13 aa, Mycobacterium
LPGLDSSHRDEVA

SEQ ID NO: 522273 - protein, 5 aa, Mycobacterium
LPGLE

SEQ ID NO: 522274 - protein, 15 aa, Mycobacterium
LPGLEPDHPMPPSTG

SEQ ID NO: 522275 - protein, 5 aa, Mycobacterium
LPGLG

SEQ ID NO: 522276 - protein, 13 aa, Mycobacterium
LPGLSDQREPGRI

SEQ ID NO: 522277 - protein, 4 aa, Mycobacterium
LPGM

SEQ ID NO: 522278 - protein, 8 aa, Mycobacterium
LPGNATAT

SEQ ID NO: 522279 - protein, 10 aa, Mycobacterium
LPGNDYAGDE

SEQ ID NO: 522280 - protein, 12 aa, Mycobacterium
LPGNGSIGGHKG

SEQ ID NO: 522281 - protein, 9 aa, Mycobacterium
LPGNGVGQG

SEQ ID NO: 522282 - protein, 16 aa, Mycobacterium
LPGNPTAIPTPGHTGG

SEQ ID NO: 522283 - protein, 7 aa, Mycobacterium
LPGNRPD

SEQ ID NO: 522284 - protein, 11 aa, Mycobacterium
LPGNSNDPHAV

SEQ ID NO: 522285 - protein, 4 aa, Mycobacterium
LPGP

SEQ ID NO: 522286 - protein, 22 aa, Mycobacterium
LPGPATGLTGDGHGKAYASARG

SEQ ID NO: 522287 - protein, 7 aa, Mycobacterium
LPGPAVP

SEQ ID NO: 522288 - protein, 6 aa, Mycobacterium
LPGPDL

SEQ ID NO: 522289 - protein, 7 aa, Mycobacterium
LPGPDSR

SEQ ID NO: 522290 - protein, 5 aa, Mycobacterium
LPGPF

SEQ ID NO: 522291 - protein, 7 aa, Mycobacterium
LPGPGAI

SEQ ID NO: 522292 - protein, 9 aa, Mycobacterium
LPGPGEEKR

SEQ ID NO: 522293 - protein, 9 aa, Mycobacterium
LPGPGGRAE

SEQ ID NO: 522294 - protein, 10 aa, Mycobacterium
LPGPHGSAVP

SEQ ID NO: 522295 - protein, 10 aa, Mycobacterium
LPGPHYETPA

SEQ ID NO: 522296 - protein, 5 aa, Mycobacterium
LPGPL

SEQ ID NO: 522297 - protein, 6 aa, Mycobacterium
LPGPLA

SEQ ID NO: 522298 - protein, 8 aa, Mycobacterium
LPGPNAAV

SEQ ID NO: 522299 - protein, 7 aa, Mycobacterium
LPGPNGK

SEQ ID NO: 522300 - protein, 9 aa, Mycobacterium
LPGPNSAVK

SEQ ID NO: 522301 - protein, 10 aa, Mycobacterium
LPGPPIPGEV

SEQ ID NO: 522302 - protein, 6 aa, Mycobacterium
LPGPPR

SEQ ID NO: 522303 - protein, 11 aa, Mycobacterium
LPGPPVSERDA

SEQ ID NO: 522304 - protein, 13 aa, Mycobacterium
LPGPSDEPKANGL

SEQ ID NO: 522305 - protein, 6 aa, Mycobacterium
LPGPSH

SEQ ID NO: 522306 - protein, 13 aa, Mycobacterium
LPGPSIEASPVRY

SEQ ID NO: 522307 - protein, 13 aa, Mycobacterium
LPGPSPEPKANGL

SEQ ID NO: 522308 - protein, 16 aa, Mycobacterium
LPGPTEFSVPGSAAEV

SEQ ID NO: 522309 - protein, 6 aa, Mycobacterium
LPGPTK

SEQ ID NO: 522310 - protein, 6 aa, Mycobacterium
LPGPTR

SEQ ID NO: 522311 - protein, 5 aa, Mycobacterium
LPGPV

SEQ ID NO: 522312 - protein, 6 aa, Mycobacterium
LPGPVQ

SEQ ID NO: 522313 - protein, 5 aa, Mycobacterium
LPGQD

SEQ ID NO: 522314 - protein, 5 aa, Mycobacterium
LPGQG

SEQ ID NO: 522315 - protein, 8 aa, Mycobacterium
LPGQGGGF

SEQ ID NO: 522316 - protein, 12 aa, Mycobacterium
LPGQGGNGGNAN

SEQ ID NO: 522317 - protein, 7 aa, Mycobacterium
LPGQHGT

SEQ ID NO: 522318 - protein, 6 aa, Mycobacterium
LPGQLN

SEQ ID NO: 522319 - protein, 10 aa, Mycobacterium
LPGQPDHESI

SEQ ID NO: 522320 - protein, 9 aa, Mycobacterium
LPGQPLDAA

SEQ ID NO: 522321 - protein, 8 aa, Mycobacterium
LPGQPPEV

SEQ ID NO: 522322 - protein, 11 aa, Mycobacterium
LPGQPTPASLG

SEQ ID NO: 522323 - protein, 5 aa, Mycobacterium
LPGQR

SEQ ID NO: 522324 - protein, 6 aa, Mycobacterium
LPGQRL

SEQ ID NO: 522325 - protein, 17 aa, Mycobacterium
LPGQRSGQQQPNRLTAA

SEQ ID NO: 522326 - protein, 20 aa, Mycobacterium
LPGQRSGQQQPNRLTAAEGV

SEQ ID NO: 522327 - protein, 7 aa, Mycobacterium
LPGQSIR

SEQ ID NO: 522328 - protein, 6 aa, Mycobacterium
LPGQSL

SEQ ID NO: 522329 - protein, 20 aa, Mycobacterium
LPGRDAPLGSPGGAAKMGPL

SEQ ID NO: 522330 - protein, 20 aa, Mycobacterium
LPGRDEPLGSPGGAAKIGPL

SEQ ID NO: 522331 - protein, 21 aa, Mycobacterium
LPGRDEPLGSPGGAAKVGPLG

SEQ ID NO: 522332 - protein, 17 aa, Mycobacterium
LPGRDGPLGSPGGAAKI

SEQ ID NO: 522333 - protein, 6 aa, Mycobacterium
LPGREN

SEQ ID NO: 522334 - protein, 9 aa, Mycobacterium
LPGRGAATV

SEQ ID NO: 522335 - protein, 7 aa, Mycobacterium
LPGRGAS

SEQ ID NO: 522336 - protein, 7 aa, Mycobacterium
LPGRGDT

SEQ ID NO: 522337 - protein, 8 aa, Mycobacterium
LPGRGPWQ

SEQ ID NO: 522338 - protein, 6 aa, Mycobacterium
LPGRGR

SEQ ID NO: 522339 - protein, 9 aa, Mycobacterium
LPGRGSTTV

SEQ ID NO: 522340 - protein, 8 aa, Mycobacterium
LPGRHAPA

SEQ ID NO: 522341 - protein, 8 aa, Mycobacterium
LPGRHAPG

SEQ ID NO: 522342 - protein, 13 aa, Mycobacterium
LPGRPAPLHPNPA

SEQ ID NO: 522343 - protein, 5 aa, Mycobacterium
LPGRR

SEQ ID NO: 522344 - protein, 5 aa, Mycobacterium
LPGRT

SEQ ID NO: 522345 - protein, 16 aa, Mycobacterium
LPGSARRRRRENADRV

SEQ ID NO: 522346 - protein, 10 aa, Mycobacterium
LPGSASPVAI

SEQ ID NO: 522347 - protein, 6 aa, Mycobacterium
LPGSDD

SEQ ID NO: 522348 - protein, 11 aa, Mycobacterium
LPGSEGSFQKS

SEQ ID NO: 522349 - protein, 5 aa, Mycobacterium
LPGSF

SEQ ID NO: 522350 - protein, 13 aa, Mycobacterium
LPGSGDIPTDPYP

SEQ ID NO: 522351 - protein, 7 aa, Mycobacterium
LPGSGGD

SEQ ID NO: 522352 - protein, 11 aa, Mycobacterium
LPGSGMKADPQ

SEQ ID NO: 522353 - protein, 6 aa, Mycobacterium
LPGSGT

SEQ ID NO: 522354 - protein, 9 aa, Mycobacterium
LPGSGTLGP

SEQ ID NO: 522355 - protein, 5 aa, Mycobacterium
LPGSI

SEQ ID NO: 522356 - protein, 5 aa, Mycobacterium
LPGSL

SEQ ID NO: 522357 - protein, 9 aa, Mycobacterium
LPGSNPFGA

SEQ ID NO: 522358 - protein, 9 aa, Mycobacterium
LPGSNPFGR

SEQ ID NO: 522359 - protein, 11 aa, Mycobacterium
LPGSNPMGDDM

SEQ ID NO: 522360 - protein, 7 aa, Mycobacterium
LPGSPWH

SEQ ID NO: 522361 - protein, 11 aa, Mycobacterium
LPGSSPRPYGG

SEQ ID NO: 522362 - protein, 12 aa, Mycobacterium
LPGSSSPTASRA

SEQ ID NO: 522363 - protein, 13 aa, Mycobacterium
LPGSSVRSTAIGN

SEQ ID NO: 522364 - protein, 11 aa, Mycobacterium
LPGSTPRPYGG

SEQ ID NO: 522365 - protein, 13 aa, Mycobacterium
LPGTALPPPRPED

SEQ ID NO: 522366 - protein, 7 aa, Mycobacterium
LPGTASS

SEQ ID NO: 522367 - protein, 8 aa, Mycobacterium
LPGTDRRA

SEQ ID NO: 522368 - protein, 7 aa, Mycobacterium
LPGTDTD

SEQ ID NO: 522369 - protein, 9 aa, Mycobacterium
LPGTELTNR

SEQ ID NO: 522370 - protein, 5 aa, Mycobacterium
LPGTG

SEQ ID NO: 522371 - protein, 9 aa, Mycobacterium
LPGTGAGAY

SEQ ID NO: 522372 - protein, 8 aa, Mycobacterium
LPGTGAGD

SEQ ID NO: 522373 - protein, 10 aa, Mycobacterium
LPGTGSPAPL

SEQ ID NO: 522374 - protein, 8 aa, Mycobacterium
LPGTNNLT

SEQ ID NO: 522375 - protein, 6 aa, Mycobacterium
LPGTNV

SEQ ID NO: 522376 - protein, 6 aa, Mycobacterium
LPGTPD

SEQ ID NO: 522377 - protein, 9 aa, Mycobacterium
LPGTSAVPT

SEQ ID NO: 522378 - protein, 15 aa, Mycobacterium
LPGTSPADEQARRTA

SEQ ID NO: 522379 - protein, 10 aa, Mycobacterium
LPGTSSAETY

SEQ ID NO: 522380 - protein, 12 aa, Mycobacterium
LPGTTSVHSSGL

SEQ ID NO: 522381 - protein, 5 aa, Mycobacterium
LPGTY

SEQ ID NO: 522382 - protein, 6 aa, Mycobacterium
LPGVDP

SEQ ID NO: 522383 - protein, 10 aa, Mycobacterium
LPGVGPKSAQ

SEQ ID NO: 522384 - protein, 30 aa, Mycobacterium
LPGVNQADPGPAPADDAVRRTHGAASATRC

SEQ ID NO: 522385 - protein, 13 aa, Mycobacterium
LPGVPDNGPGDGD

SEQ ID NO: 522386 - protein, 14 aa, Mycobacterium
LPGVPGGDAMDPAL

SEQ ID NO: 522387 - protein, 8 aa, Mycobacterium
LPGVPPGV

SEQ ID NO: 522388 - protein, 7 aa, Mycobacterium
LPGVPRD

SEQ ID NO: 522389 - protein, 6 aa, Mycobacterium
LPGVSD

SEQ ID NO: 522390 - protein, 5 aa, Mycobacterium
LPGWD

SEQ ID NO: 522391 - protein, 5 aa, Mycobacterium
LPGYG

SEQ ID NO: 522392 - protein, 14 aa, Mycobacterium
LPGYKGRNVSERGG

SEQ ID NO: 522393 - protein, 13 aa, Mycobacterium
LPGYPGASVKTGN

SEQ ID NO: 522394 - protein, 12 aa, Mycobacterium
LPGYPGGTVKTG

SEQ ID NO: 522395 - protein, 10 aa, Mycobacterium
LPGYSPGDTD

SEQ ID NO: 522396 - protein, 6 aa, Mycobacterium
LPHAAT

SEQ ID NO: 522397 - protein, 8 aa, Mycobacterium
LPHDAEDR

SEQ ID NO: 522398 - protein, 8 aa, Mycobacterium
LPHGTGKT

SEQ ID NO: 522399 - protein, 4 aa, Mycobacterium
LPHP

SEQ ID NO: 522400 - protein, 6 aa, Mycobacterium
LPHPDD

SEQ ID NO: 522401 - protein, 8 aa, Mycobacterium
LPHPDGPP

SEQ ID NO: 522402 - protein, 7 aa, Mycobacterium
LPHPGDD

SEQ ID NO: 522403 - protein, 9 aa, Mycobacterium
LPHPSRTYS

SEQ ID NO: 522404 - protein, 12 aa, Mycobacterium
LPHPTGGSNARR

SEQ ID NO: 522405 - protein, 6 aa, Mycobacterium
LPHQPQ

SEQ ID NO: 522406 - protein, 6 aa, Mycobacterium
LPHSSQ

SEQ ID NO: 522407 - protein, 16 aa, Mycobacterium
LPHSSQALARGGQPVS

SEQ ID NO: 522408 - protein, 14 aa, Mycobacterium
LPHSSQAQAVGGQP

SEQ ID NO: 522409 - protein, 21 aa, Mycobacterium
LPHTAKGSLDRRAVAQQFGGQ

SEQ ID NO: 522410 - protein, 21 aa, Mycobacterium
LPHTAKGSLDRRAVAQRFGPP

SEQ ID NO: 522411 - protein, 13 aa, Mycobacterium
LPHTSSGKVDRRA

SEQ ID NO: 522412 - protein, 6 aa, Mycobacterium
LPHVPG

SEQ ID NO: 522413 - protein, 4 aa, Mycobacterium
LPID

SEQ ID NO: 522414 - protein, 9 aa, Mycobacterium
LPIDTDPDL

SEQ ID NO: 522415 - protein, 14 aa, Mycobacterium
LPIGPRSPSFPEVE

SEQ ID NO: 522416 - protein, 14 aa, Mycobacterium
LPIGTDGAADDGAA

SEQ ID NO: 522417 - protein, 8 aa, Mycobacterium
LPINTNGG

SEQ ID NO: 522418 - protein, 13 aa, Mycobacterium
LPINTSGGQLSGG

SEQ ID NO: 522419 - protein, 12 aa, Mycobacterium
LPIPDYDERTVQ

SEQ ID NO: 522420 - protein, 27 aa, Mycobacterium
LPKAPSSKTVGKSSRAEATLDQQQQQQ

SEQ ID NO: 522421 - protein, 7 aa, Mycobacterium
LPKASAH

SEQ ID NO: 522422 - protein, 11 aa, Mycobacterium
LPKATKPSPWR

SEQ ID NO: 522423 - protein, 6 aa, Mycobacterium
LPKDPD

SEQ ID NO: 522424 - protein, 6 aa, Mycobacterium
LPKDTD

SEQ ID NO: 522425 - protein, 5 aa, Mycobacterium
LPKEL

SEQ ID NO: 522426 - protein, 11 aa, Mycobacterium
LPKGDPRRYDP

SEQ ID NO: 522427 - protein, 7 aa, Mycobacterium
LPKGDSA

SEQ ID NO: 522428 - protein, 6 aa, Mycobacterium
LPKGNA

SEQ ID NO: 522429 - protein, 15 aa, Mycobacterium
LPKGSTAELRSATPL

SEQ ID NO: 522430 - protein, 5 aa, Mycobacterium
LPKGY

SEQ ID NO: 522431 - protein, 4 aa, Mycobacterium
LPKH

SEQ ID NO: 522432 - protein, 6 aa, Mycobacterium
LPKIPT

SEQ ID NO: 522433 - protein, 7 aa, Mycobacterium
LPKLSSD

SEQ ID NO: 522434 - protein, 4 aa, Mycobacterium
LPKP

SEQ ID NO: 522435 - protein, 6 aa, Mycobacterium
LPKPAP

SEQ ID NO: 522436 - protein, 7 aa, Mycobacterium
LPKPEPL

SEQ ID NO: 522437 - protein, 5 aa, Mycobacterium
LPKPG

SEQ ID NO: 522438 - protein, 5 aa, Mycobacterium
LPKPH

SEQ ID NO: 522439 - protein, 7 aa, Mycobacterium
LPKPKTS

SEQ ID NO: 522440 - protein, 5 aa, Mycobacterium
LPKPP

SEQ ID NO: 522441 - protein, 7 aa, Mycobacterium
LPKPTTQ

SEQ ID NO: 522442 - protein, 6 aa, Mycobacterium
LPKPTV

SEQ ID NO: 522443 - protein, 6 aa, Mycobacterium
LPKPVT

SEQ ID NO: 522444 - protein, 9 aa, Mycobacterium
LPKQGNKHP

SEQ ID NO: 522445 - protein, 10 aa, Mycobacterium
LPKQGSRKPW

SEQ ID NO: 522446 - protein, 8 aa, Mycobacterium
LPKRDHKP

SEQ ID NO: 522447 - protein, 6 aa, Mycobacterium
LPKRGR

SEQ ID NO: 522448 - protein, 7 aa, Mycobacterium
LPKRGVS

SEQ ID NO: 522449 - protein, 7 aa, Mycobacterium
LPKRPVQ

SEQ ID NO: 522450 - protein, 6 aa, Mycobacterium
LPKRRL

SEQ ID NO: 522451 - protein, 6 aa, Mycobacterium
LPKRRP

SEQ ID NO: 522452 - protein, 4 aa, Mycobacterium
LPKS

SEQ ID NO: 522453 - protein, 12 aa, Mycobacterium
LPKSDDPWVSSP

SEQ ID NO: 522454 - protein, 12 aa, Mycobacterium
LPKSGSRGPWKA

SEQ ID NO: 522455 - protein, 27 aa, Mycobacterium
LPKSRLPEAAPTKKPRPDRRADLTRPS

SEQ ID NO: 522456 - protein, 10 aa, Mycobacterium
LPKSSRDRRR

SEQ ID NO: 522457 - protein, 8 aa, Mycobacterium
LPKSWDPA

SEQ ID NO: 522458 - protein, 10 aa, Mycobacterium
LPKSWDPGAM

SEQ ID NO: 522459 - protein, 10 aa, Mycobacterium
LPKSWDPGAV

SEQ ID NO: 522460 - protein, 7 aa, Mycobacterium
LPKTEPL

SEQ ID NO: 522461 - protein, 35 aa, Mycobacterium
LPKTESGKLNRPGLPPPAVSTRGSVEPSRTGTERA

SEQ ID NO: 522462 - protein, 7 aa, Mycobacterium
LPKTNDY

SEQ ID NO: 522463 - protein, 32 aa, Mycobacterium
LPLAGTPASPPAATGPVAPANPLSGPPRGNIA

SEQ ID NO: 522464 - protein, 9 aa, Mycobacterium
LPLDNGQSA

SEQ ID NO: 522465 - protein, 22 aa, Mycobacterium
LPLDSATPAHVRPDTEDHHDGP

SEQ ID NO: 522466 - protein, 7 aa, Mycobacterium
LPLEPRS

SEQ ID NO: 522467 - protein, 5 aa, Mycobacterium
LPLPD

SEQ ID NO: 522468 - protein, 12 aa, Mycobacterium
LPLPQAKATAKA

SEQ ID NO: 522469 - protein, 13 aa, Mycobacterium
LPLPSRAHDGDAG

SEQ ID NO: 522470 - protein, 12 aa, Mycobacterium
LPLQSTDPEAPF

SEQ ID NO: 522471 - protein, 4 aa, Mycobacterium
LPLS

SEQ ID NO: 522472 - protein, 11 aa, Mycobacterium
LPLSNRSDDHL

SEQ ID NO: 522473 - protein, 4 aa, Mycobacterium
LPLT

SEQ ID NO: 522474 - protein, 12 aa, Mycobacterium
LPMETDEDGQIV

SEQ ID NO: 522475 - protein, 13 aa, Mycobacterium
LPMETDPDAGDGR

SEQ ID NO: 522476 - protein, 6 aa, Mycobacterium
LPMGES

SEQ ID NO: 522477 - protein, 6 aa, Mycobacterium
LPMPPS

SEQ ID NO: 522478 - protein, 5 aa, Mycobacterium
LPMPQ

SEQ ID NO: 522479 - protein, 9 aa, Mycobacterium
LPNADPEYQ

SEQ ID NO: 522480 - protein, 6 aa, Mycobacterium
LPNAGH

SEQ ID NO: 522481 - protein, 7 aa, Mycobacterium
LPNANGR

SEQ ID NO: 522482 - protein, 5 aa, Mycobacterium
LPNAS

SEQ ID NO: 522483 - protein, 6 aa, Mycobacterium
LPNATE

SEQ ID NO: 522484 - protein, 6 aa, Mycobacterium
LPNDGE

SEQ ID NO: 522485 - protein, 14 aa, Mycobacterium
LPNEDADVSKEIEK

SEQ ID NO: 522486 - protein, 10 aa, Mycobacterium
LPNEGETAPD

SEQ ID NO: 522487 - protein, 7 aa, Mycobacterium
LPNGDAA

SEQ ID NO: 522488 - protein, 6 aa, Mycobacterium
LPNGQP

SEQ ID NO: 522489 - protein, 7 aa, Mycobacterium
LPNGRPA

SEQ ID NO: 522490 - protein, 7 aa, Mycobacterium
LPNNRAE

SEQ ID NO: 522491 - protein, 9 aa, Mycobacterium
LPNPADPSH

SEQ ID NO: 522492 - protein, 9 aa, Mycobacterium
LPNPADPTH

SEQ ID NO: 522493 - protein, 6 aa, Mycobacterium
LPNPAL

SEQ ID NO: 522494 - protein, 8 aa, Mycobacterium
LPNPDGPP

SEQ ID NO: 522495 - protein, 6 aa, Mycobacterium
LPNPEA

SEQ ID NO: 522496 - protein, 5 aa, Mycobacterium
LPNPG

SEQ ID NO: 522497 - protein, 10 aa, Mycobacterium
LPNPGPGRTA

SEQ ID NO: 522498 - protein, 7 aa, Mycobacterium
LPNPPQL

SEQ ID NO: 522499 - protein, 8 aa, Mycobacterium
LPNPQRQN

SEQ ID NO: 522500 - protein, 7 aa, Mycobacterium
LPNPSRV

SEQ ID NO: 522501 - protein, 6 aa, Mycobacterium
LPNPTD

SEQ ID NO: 522502 - protein, 29 aa, Mycobacterium
LPNPTSAVPPDRAADPGRRTISPTEAAGN

SEQ ID NO: 522503 - protein, 9 aa, Mycobacterium
LPNQPGRSA

SEQ ID NO: 522504 - protein, 11 aa, Mycobacterium
LPNRAVPGDGA

SEQ ID NO: 522505 - protein, 6 aa, Mycobacterium
LPNRDG

SEQ ID NO: 522506 - protein, 14 aa, Mycobacterium
LPNRDGETMVNSDG

SEQ ID NO: 522507 - protein, 9 aa, Mycobacterium
LPNRGNVSS

SEQ ID NO: 522508 - protein, 8 aa, Mycobacterium
LPNRQDVK

SEQ ID NO: 522509 - protein, 6 aa, Mycobacterium
LPNRTE

SEQ ID NO: 522510 - protein, 6 aa, Mycobacterium
LPNRTY

SEQ ID NO: 522511 - protein, 10 aa, Mycobacterium
LPNSAGEMYT

SEQ ID NO: 522512 - protein, 5 aa, Mycobacterium
LPNSG

SEQ ID NO: 522513 - protein, 16 aa, Mycobacterium
LPNSVSGSIPSDPETF

SEQ ID NO: 522514 - protein, 8 aa, Mycobacterium
LPNTAGQA

SEQ ID NO: 522515 - protein, 5 aa, Mycobacterium
LPNTG

SEQ ID NO: 522516 - protein, 6 aa, Mycobacterium
LPNTQY

SEQ ID NO: 522517 - protein, 6 aa, Mycobacterium
LPNTTK

SEQ ID NO: 522518 - protein, 6 aa, Mycobacterium
LPNVSQ

SEQ ID NO: 522519 - protein, 16 aa, Mycobacterium
LPPAAAGTAGTTDRTS

SEQ ID NO: 522520 - protein, 10 aa, Mycobacterium
LPPAASEAEA

SEQ ID NO: 522521 - protein, 10 aa, Mycobacterium
LPPAATEEEA

SEQ ID NO: 522522 - protein, 6 aa, Mycobacterium
LPPAAV

SEQ ID NO: 522523 - protein, 14 aa, Mycobacterium
LPPADARVTGYDSA

SEQ ID NO: 522524 - protein, 11 aa, Mycobacterium
LPPADLTPSQL

SEQ ID NO: 522525 - protein, 17 aa, Mycobacterium
LPPADRASVRLTSLTVA

SEQ ID NO: 522526 - protein, 6 aa, Mycobacterium
LPPAEA

SEQ ID NO: 522527 - protein, 7 aa, Mycobacterium
LPPAEAE

SEQ ID NO: 522528 - protein, 8 aa, Mycobacterium
LPPAEQQR

SEQ ID NO: 522529 - protein, 13 aa, Mycobacterium
LPPAERSPAGYRD

SEQ ID NO: 522530 - protein, 5 aa, Mycobacterium
LPPAG

SEQ ID NO: 522531 - protein, 10 aa, Mycobacterium
LPPAGADTPD

SEQ ID NO: 522532 - protein, 9 aa, Mycobacterium
LPPAGRNRT

SEQ ID NO: 522533 - protein, 15 aa, Mycobacterium
LPPAINPGRHKTWGQ

SEQ ID NO: 522534 - protein, 24 aa, Mycobacterium
LPPALTDRATSRHLPPSLETPTRA

SEQ ID NO: 522535 - protein, 15 aa, Mycobacterium
LPPAPDDYPTFPDKS

SEQ ID NO: 522536 - protein, 12 aa, Mycobacterium
LPPAPEPPTDDE

SEQ ID NO: 522537 - protein, 12 aa, Mycobacterium
LPPAPNRYAAVS

SEQ ID NO: 522538 - protein, 8 aa, Mycobacterium
LPPAPPTT

SEQ ID NO: 522539 - protein, 14 aa, Mycobacterium
LPPAPPWPPCSLFQ

SEQ ID NO: 522540 - protein, 8 aa, Mycobacterium
LPPAPRIP

SEQ ID NO: 522541 - protein, 6 aa, Mycobacterium
LPPAPT

SEQ ID NO: 522542 - protein, 7 aa, Mycobacterium
LPPAQTP

SEQ ID NO: 522543 - protein, 13 aa, Mycobacterium
LPPARGDARSGDA

SEQ ID NO: 522544 - protein, 11 aa, Mycobacterium
LPPARPGAPSD

SEQ ID NO: 522545 - protein, 10 aa, Mycobacterium
LPPARPGLAG

SEQ ID NO: 522546 - protein, 8 aa, Mycobacterium
LPPARPSV

SEQ ID NO: 522547 - protein, 11 aa, Mycobacterium
LPPARRGRSDM

SEQ ID NO: 522548 - protein, 7 aa, Mycobacterium
LPPARRP

SEQ ID NO: 522549 - protein, 14 aa, Mycobacterium
LPPASETSERPRSV

SEQ ID NO: 522550 - protein, 7 aa, Mycobacterium
LPPASTL

SEQ ID NO: 522551 - protein, 8 aa, Mycobacterium
LPPASTTA

SEQ ID NO: 522552 - protein, 16 aa, Mycobacterium
LPPATASRVSTTSYSW

SEQ ID NO: 522553 - protein, 11 aa, Mycobacterium
LPPATGDGNTF

SEQ ID NO: 522554 - protein, 7 aa, Mycobacterium
LPPATPH

SEQ ID NO: 522555 - protein, 16 aa, Mycobacterium
LPPATSTQIADAAGLN

SEQ ID NO: 522556 - protein, 5 aa, Mycobacterium
LPPAV

SEQ ID NO: 522557 - protein, 5 aa, Mycobacterium
LPPDA

SEQ ID NO: 522558 - protein, 6 aa, Mycobacterium
LPPDAV

SEQ ID NO: 522559 - protein, 16 aa, Mycobacterium
LPPDDIGYGHSPEEVA

SEQ ID NO: 522560 - protein, 7 aa, Mycobacterium
LPPDDPL

SEQ ID NO: 522561 - protein, 12 aa, Mycobacterium
LPPDDPRRRRPD

SEQ ID NO: 522562 - protein, 15 aa, Mycobacterium
LPPDEQRAEDVFGGG

SEQ ID NO: 522563 - protein, 12 aa, Mycobacterium
LPPDGIASATAA

SEQ ID NO: 522564 - protein, 7 aa, Mycobacterium
LPPDGTT

SEQ ID NO: 522565 - protein, 6 aa, Mycobacterium
LPPDHP

SEQ ID NO: 522566 - protein, 7 aa, Mycobacterium
LPPDPAA

SEQ ID NO: 522567 - protein, 6 aa, Mycobacterium
LPPDPD

SEQ ID NO: 522568 - protein, 9 aa, Mycobacterium
LPPDPRDAE

SEQ ID NO: 522569 - protein, 5 aa, Mycobacterium
LPPDQ

SEQ ID NO: 522570 - protein, 10 aa, Mycobacterium
LPPDRGTGLG

SEQ ID NO: 522571 - protein, 11 aa, Mycobacterium
LPPDRGTGLGK

SEQ ID NO: 522572 - protein, 7 aa, Mycobacterium
LPPDRPA

SEQ ID NO: 522573 - protein, 8 aa, Mycobacterium
LPPDSADS

SEQ ID NO: 522574 - protein, 7 aa, Mycobacterium
LPPDSAV

SEQ ID NO: 522575 - protein, 8 aa, Mycobacterium
LPPDSEQH

SEQ ID NO: 522576 - protein, 6 aa, Mycobacterium
LPPDSW

SEQ ID NO: 522577 - protein, 5 aa, Mycobacterium
LPPDT

SEQ ID NO: 522578 - protein, 11 aa, Mycobacterium
LPPDTRRVTPE

SEQ ID NO: 522579 - protein, 6 aa, Mycobacterium
LPPDVE

SEQ ID NO: 522580 - protein, 7 aa, Mycobacterium
LPPEAAQ

SEQ ID NO: 522581 - protein, 6 aa, Mycobacterium
LPPEAK

SEQ ID NO: 522582 - protein, 8 aa, Mycobacterium
LPPEDEDA

SEQ ID NO: 522583 - protein, 6 aa, Mycobacterium
LPPEDV

SEQ ID NO: 522584 - protein, 15 aa, Mycobacterium
LPPEEAANIPQAPTQ

SEQ ID NO: 522585 - protein, 7 aa, Mycobacterium
LPPEGAS

SEQ ID NO: 522586 - protein, 6 aa, Mycobacterium
LPPEGE

SEQ ID NO: 522587 - protein, 8 aa, Mycobacterium
LPPEGGHD

SEQ ID NO: 522588 - protein, 8 aa, Mycobacterium
LPPEGRFG

SEQ ID NO: 522589 - protein, 9 aa, Mycobacterium
LPPEGRFGS

SEQ ID NO: 522590 - protein, 7 aa, Mycobacterium
LPPEGTA

SEQ ID NO: 522591 - protein, 7 aa, Mycobacterium
LPPEGTQ

SEQ ID NO: 522592 - protein, 6 aa, Mycobacterium
LPPEKL

SEQ ID NO: 522593 - protein, 9 aa, Mycobacterium
LPPEKQPAV

SEQ ID NO: 522594 - protein, 7 aa, Mycobacterium
LPPEPAE

SEQ ID NO: 522595 - protein, 8 aa, Mycobacterium
LPPEPDGA

SEQ ID NO: 522596 - protein, 24 aa, Mycobacterium
LPPEPEPEPEPEPEPEPEPEPEPE

SEQ ID NO: 522597 - protein, 7 aa, Mycobacterium
LPPEPQD

SEQ ID NO: 522598 - protein, 7 aa, Mycobacterium
LPPEPRD

SEQ ID NO: 522599 - protein, 10 aa, Mycobacterium
LPPEQGTGLG

SEQ ID NO: 522600 - protein, 10 aa, Mycobacterium
LPPEQRRQRA

SEQ ID NO: 522601 - protein, 6 aa, Mycobacterium
LPPEQV

SEQ ID NO: 522602 - protein, 6 aa, Mycobacterium
LPPERI

SEQ ID NO: 522603 - protein, 7 aa, Mycobacterium
LPPERLP

SEQ ID NO: 522604 - protein, 7 aa, Mycobacterium
LPPERQA

SEQ ID NO: 522605 - protein, 5 aa, Mycobacterium
LPPES

SEQ ID NO: 522606 - protein, 7 aa, Mycobacterium
LPPESAW

SEQ ID NO: 522607 - protein, 29 aa, Mycobacterium
LPPESGPVDRLPDAGTEQDHYSPSASVQL

SEQ ID NO: 522608 - protein, 7 aa, Mycobacterium
LPPESGT

SEQ ID NO: 522609 - protein, 6 aa, Mycobacterium
LPPETT

SEQ ID NO: 522610 - protein, 13 aa, Mycobacterium
LPPEVGPNPRPIA

SEQ ID NO: 522611 - protein, 7 aa, Mycobacterium
LPPEVNS

SEQ ID NO: 522612 - protein, 4 aa, Mycobacterium
LPPF

SEQ ID NO: 522613 - protein, 5 aa, Mycobacterium
LPPFE

SEQ ID NO: 522614 - protein, 5 aa, Mycobacterium
LPPGA

SEQ ID NO: 522615 - protein, 9 aa, Mycobacterium
LPPGAAASY

SEQ ID NO: 522616 - protein, 18 aa, Mycobacterium
LPPGADPDKAAYNHSPQA

SEQ ID NO: 522617 - protein, 7 aa, Mycobacterium
LPPGAEP

SEQ ID NO: 522618 - protein, 7 aa, Mycobacterium
LPPGAGV

SEQ ID NO: 522619 - protein, 13 aa, Mycobacterium
LPPGAGVDAAEAS

SEQ ID NO: 522620 - protein, 14 aa, Mycobacterium
LPPGAGVDAESASQ

SEQ ID NO: 522621 - protein, 8 aa, Mycobacterium
LPPGATEI

SEQ ID NO: 522622 - protein, 9 aa, Mycobacterium
LPPGAWPPT

SEQ ID NO: 522623 - protein, 8 aa, Mycobacterium
LPPGDARD

SEQ ID NO: 522624 - protein, 5 aa, Mycobacterium
LPPGE

SEQ ID NO: 522625 - protein, 7 aa, Mycobacterium
LPPGGAH

SEQ ID NO: 522626 - protein, 6 aa, Mycobacterium
LPPGGG

SEQ ID NO: 522627 - protein, 14 aa, Mycobacterium
LPPGGSIDAHTGPA

SEQ ID NO: 522628 - protein, 6 aa, Mycobacterium
LPPGID

SEQ ID NO: 522629 - protein, 7 aa, Mycobacterium
LPPGINP

SEQ ID NO: 522630 - protein, 13 aa, Mycobacterium
LPPGINPTKAKQW

SEQ ID NO: 522631 - protein, 6 aa, Mycobacterium
LPPGIP

SEQ ID NO: 522632 - protein, 12 aa, Mycobacterium
LPPGLNPGGIEP

SEQ ID NO: 522633 - protein, 8 aa, Mycobacterium
LPPGPAFY

SEQ ID NO: 522634 - protein, 12 aa, Mycobacterium
LPPGPGEQVRRG

SEQ ID NO: 522635 - protein, 48 aa, Mycobacterium
LPPGPNPPVPGLPQPPNAGQLQPNAAPVPQPQPAPAPPPPSIAGAPTS

SEQ ID NO: 522636 - protein, 11 aa, Mycobacterium
LPPGQPAPAGW

SEQ ID NO: 522637 - protein, 6 aa, Mycobacterium
LPPGRA

SEQ ID NO: 522638 - protein, 12 aa, Mycobacterium
LPPGRPGGRPWT

SEQ ID NO: 522639 - protein, 6 aa, Mycobacterium
LPPGRR

SEQ ID NO: 522640 - protein, 7 aa, Mycobacterium
LPPGRSD

SEQ ID NO: 522641 - protein, 6 aa, Mycobacterium
LPPGSD

SEQ ID NO: 522642 - protein, 7 aa, Mycobacterium
LPPGSLG

SEQ ID NO: 522643 - protein, 11 aa, Mycobacterium
LPPGSPTAKVT

SEQ ID NO: 522644 - protein, 6 aa, Mycobacterium
LPPGSR

SEQ ID NO: 522645 - protein, 6 aa, Mycobacterium
LPPGSY

SEQ ID NO: 522646 - protein, 7 aa, Mycobacterium
LPPGTEP

SEQ ID NO: 522647 - protein, 6 aa, Mycobacterium
LPPGTW

SEQ ID NO: 522648 - protein, 7 aa, Mycobacterium
LPPGVDT

SEQ ID NO: 522649 - protein, 18 aa, Mycobacterium
LPPGVPEPMSAPRTSFNT

SEQ ID NO: 522650 - protein, 17 aa, Mycobacterium
LPPGYEASTGIPDAASP

SEQ ID NO: 522651 - protein, 6 aa, Mycobacterium
LPPGYR

SEQ ID NO: 522652 - protein, 5 aa, Mycobacterium
LPPHP

SEQ ID NO: 522653 - protein, 6 aa, Mycobacterium
LPPHRG

SEQ ID NO: 522654 - protein, 11 aa, Mycobacterium
LPPHRYSQAEV

SEQ ID NO: 522655 - protein, 4 aa, Mycobacterium
LPPI

SEQ ID NO: 522656 - protein, 9 aa, Mycobacterium
LPPIDEPDT

SEQ ID NO: 522657 - protein, 12 aa, Mycobacterium
LPPIGKKPAGKK

SEQ ID NO: 522658 - protein, 12 aa, Mycobacterium
LPPITGKGLYAN

SEQ ID NO: 522659 - protein, 9 aa, Mycobacterium
LPPKAGNYT

SEQ ID NO: 522660 - protein, 31 aa, Mycobacterium
LPPKKASGRKPAKATKSAKTTKSAKTSQPRR

SEQ ID NO: 522661 - protein, 12 aa, Mycobacterium
LPPKNPTAPMSW

SEQ ID NO: 522662 - protein, 4 aa, Mycobacterium
LPPL

SEQ ID NO: 522663 - protein, 21 aa, Mycobacterium
LPPLGPRESRPQLPDLPAEPV

SEQ ID NO: 522664 - protein, 14 aa, Mycobacterium
LPPLNGDNLDPRLH

SEQ ID NO: 522665 - protein, 26 aa, Mycobacterium
LPPLPPAPLTPPAAAAEQPPADFATP

SEQ ID NO: 522666 - protein, 7 aa, Mycobacterium
LPPLPSD

SEQ ID NO: 522667 - protein, 5 aa, Mycobacterium
LPPLS

SEQ ID NO: 522668 - protein, 6 aa, Mycobacterium
LPPNEQ

SEQ ID NO: 522669 - protein, 5 aa, Mycobacterium
LPPNT

SEQ ID NO: 522670 - protein, 8 aa, Mycobacterium
LPPNTGTL

SEQ ID NO: 522671 - protein, 5 aa, Mycobacterium
LPPNV

SEQ ID NO: 522672 - protein, 7 aa, Mycobacterium
LPPPAAL

SEQ ID NO: 522673 - protein, 11 aa, Mycobacterium
LPPPAATPSLT

SEQ ID NO: 522674 - protein, 6 aa, Mycobacterium
LPPPAG

SEQ ID NO: 522675 - protein, 17 aa, Mycobacterium
LPPPARTASGYRDYGPE

SEQ ID NO: 522676 - protein, 6 aa, Mycobacterium
LPPPAS

SEQ ID NO: 522677 - protein, 6 aa, Mycobacterium
LPPPCT

SEQ ID NO: 522678 - protein, 14 aa, Mycobacterium
LPPPDAEPAGDPRR

SEQ ID NO: 522679 - protein, 11 aa, Mycobacterium
LPPPEDPEFTE

SEQ ID NO: 522680 - protein, 12 aa, Mycobacterium
LPPPGEVSAVCI

SEQ ID NO: 522681 - protein, 9 aa, Mycobacterium
LPPPGGRAE

SEQ ID NO: 522682 - protein, 8 aa, Mycobacterium
LPPPGPGG

SEQ ID NO: 522683 - protein, 14 aa, Mycobacterium
LPPPGRDGVGSAEQ

SEQ ID NO: 522684 - protein, 15 aa, Mycobacterium
LPPPGREGAAAAEQL

SEQ ID NO: 522685 - protein, 13 aa, Mycobacterium
LPPPGTAAEVDES

SEQ ID NO: 522686 - protein, 17 aa, Mycobacterium
LPPPGTPVTAPADPSHL

SEQ ID NO: 522687 - protein, 20 aa, Mycobacterium
LPPPGTPVTDPIDPARLEPG

SEQ ID NO: 522688 - protein, 15 aa, Mycobacterium
LPPPGTPVTNPVDPS

SEQ ID NO: 522689 - protein, 14 aa, Mycobacterium
LPPPGTRGYPLPVP

SEQ ID NO: 522690 - protein, 6 aa, Mycobacterium
LPPPGY

SEQ ID NO: 522691 - protein, 13 aa, Mycobacterium
LPPPLSSTTSVSA

SEQ ID NO: 522692 - protein, 14 aa, Mycobacterium
LPPPPADPEPPEDR

SEQ ID NO: 522693 - protein, 9 aa, Mycobacterium
LPPPPAPLD

SEQ ID NO: 522694 - protein, 11 aa, Mycobacterium
LPPPPDLPPGE

SEQ ID NO: 522695 - protein, 13 aa, Mycobacterium
LPPPPPSADPVPA

SEQ ID NO: 522696 - protein, 13 aa, Mycobacterium
LPPPPQPPGREPV

SEQ ID NO: 522697 - protein, 11 aa, Mycobacterium
LPPPPSASRSW

SEQ ID NO: 522698 - protein, 7 aa, Mycobacterium
LPPPPTP

SEQ ID NO: 522699 - protein, 8 aa, Mycobacterium
LPPPPVGA

SEQ ID NO: 522700 - protein, 7 aa, Mycobacterium
LPPPRAG

SEQ ID NO: 522701 - protein, 15 aa, Mycobacterium
LPPPREQLRRLESEV

SEQ ID NO: 522702 - protein, 7 aa, Mycobacterium
LPPPSGE

SEQ ID NO: 522703 - protein, 17 aa, Mycobacterium
LPPPTPRRPLADVLRLN

SEQ ID NO: 522704 - protein, 8 aa, Mycobacterium
LPPPVGRA

SEQ ID NO: 522705 - protein, 7 aa, Mycobacterium
LPPQALR

SEQ ID NO: 522706 - protein, 8 aa, Mycobacterium
LPPQAVRQ

SEQ ID NO: 522707 - protein, 37 aa, Mycobacterium
LPPQGPPPAAPSAGGSTPAAPSIPAEPGGGSPGPGTG

SEQ ID NO: 522708 - protein, 5 aa, Mycobacterium
LPPQL

SEQ ID NO: 522709 - protein, 6 aa, Mycobacterium
LPPQND

SEQ ID NO: 522710 - protein, 14 aa, Mycobacterium
LPPQPDHAVGSSRL

SEQ ID NO: 522711 - protein, 9 aa, Mycobacterium
LPPQRHRDT

SEQ ID NO: 522712 - protein, 7 aa, Mycobacterium
LPPQSDL

SEQ ID NO: 522713 - protein, 8 aa, Mycobacterium
LPPQTLTG

SEQ ID NO: 522714 - protein, 57 aa, Mycobacterium
LPPQTSDPSGLARQAAATANNSGTTVSRSSASLAGRSSAAARLGQQASSAAATTTPT

SEQ ID NO: 522715 - protein, 4 aa, Mycobacterium
LPPR

SEQ ID NO: 522716 - protein, 5 aa, Mycobacterium
LPPRA

SEQ ID NO: 522717 - protein, 6 aa, Mycobacterium
LPPRDA

SEQ ID NO: 522718 - protein, 6 aa, Mycobacterium
LPPRDP

SEQ ID NO: 522719 - protein, 6 aa, Mycobacterium
LPPRDQ

SEQ ID NO: 522720 - protein, 6 aa, Mycobacterium
LPPRDS

SEQ ID NO: 522721 - protein, 7 aa, Mycobacterium
LPPREDR

SEQ ID NO: 522722 - protein, 7 aa, Mycobacterium
LPPRERA

SEQ ID NO: 522723 - protein, 12 aa, Mycobacterium
LPPRPGRPTGWP

SEQ ID NO: 522724 - protein, 6 aa, Mycobacterium
LPPRPP

SEQ ID NO: 522725 - protein, 19 aa, Mycobacterium
LPPRQGHTPLGHEPAGEIA

SEQ ID NO: 522726 - protein, 14 aa, Mycobacterium
LPPRRATSHPWPPW

SEQ ID NO: 522727 - protein, 13 aa, Mycobacterium
LPPRRSGPDGART

SEQ ID NO: 522728 - protein, 5 aa, Mycobacterium
LPPRS

SEQ ID NO: 522729 - protein, 10 aa, Mycobacterium
LPPRSGRPHD

SEQ ID NO: 522730 - protein, 6 aa, Mycobacterium
LPPRTR

SEQ ID NO: 522731 - protein, 5 aa, Mycobacterium
LPPRV

SEQ ID NO: 522732 - protein, 5 aa, Mycobacterium
LPPSA

SEQ ID NO: 522733 - protein, 9 aa, Mycobacterium
LPPSAAAFR

SEQ ID NO: 522734 - protein, 25 aa, Mycobacterium
LPPSADGGPCRPPQHTSKAAAPRIE

SEQ ID NO: 522735 - protein, 10 aa, Mycobacterium
LPPSAGVTNP

SEQ ID NO: 522736 - protein, 9 aa, Mycobacterium
LPPSATEVH

SEQ ID NO: 522737 - protein, 6 aa, Mycobacterium
LPPSAV

SEQ ID NO: 522738 - protein, 5 aa, Mycobacterium
LPPSE

SEQ ID NO: 522739 - protein, 7 aa, Mycobacterium
LPPSEAP

SEQ ID NO: 522740 - protein, 12 aa, Mycobacterium
LPPSEDFESGPR

SEQ ID NO: 522741 - protein, 12 aa, Mycobacterium
LPPSEDFESGTA

SEQ ID NO: 522742 - protein, 9 aa, Mycobacterium
LPPSGALSG

SEQ ID NO: 522743 - protein, 6 aa, Mycobacterium
LPPSGV

SEQ ID NO: 522744 - protein, 9 aa, Mycobacterium
LPPSPAKAV

SEQ ID NO: 522745 - protein, 6 aa, Mycobacterium
LPPSPQ

SEQ ID NO: 522746 - protein, 7 aa, Mycobacterium
LPPSPTA

SEQ ID NO: 522747 - protein, 5 aa, Mycobacterium
LPPSQ

SEQ ID NO: 522748 - protein, 23 aa, Mycobacterium
LPPSQQEIDEYEQARERGEQVSA

SEQ ID NO: 522749 - protein, 13 aa, Mycobacterium
LPPSRNRQPGTMV

SEQ ID NO: 522750 - protein, 10 aa, Mycobacterium
LPPSSAWTER

SEQ ID NO: 522751 - protein, 8 aa, Mycobacterium
LPPSTGEA

SEQ ID NO: 522752 - protein, 12 aa, Mycobacterium
LPPSTSAQIAEA

SEQ ID NO: 522753 - protein, 9 aa, Mycobacterium
LPPSTSTQI

SEQ ID NO: 522754 - protein, 12 aa, Mycobacterium
LPPSTSTQIADA

SEQ ID NO: 522755 - protein, 11 aa, Mycobacterium
LPPSVTLDPGA

SEQ ID NO: 522756 - protein, 8 aa, Mycobacterium
LPPTAGNY

SEQ ID NO: 522757 - protein, 8 aa, Mycobacterium
LPPTDGTY

SEQ ID NO: 522758 - protein, 6 aa, Mycobacterium
LPPTLP

SEQ ID NO: 522759 - protein, 7 aa, Mycobacterium
LPPTNRE

SEQ ID NO: 522760 - protein, 12 aa, Mycobacterium
LPPTPGEAPEGA

SEQ ID NO: 522761 - protein, 20 aa, Mycobacterium
LPPTSNSDNYESAMGPPRLA

SEQ ID NO: 522762 - protein, 6 aa, Mycobacterium
LPPTSW

SEQ ID NO: 522763 - protein, 5 aa, Mycobacterium
LPPTT

SEQ ID NO: 522764 - protein, 7 aa, Mycobacterium
LPPTTAQ

SEQ ID NO: 522765 - protein, 5 aa, Mycobacterium
LPPTV

SEQ ID NO: 522766 - protein, 5 aa, Mycobacterium
LPPVA

SEQ ID NO: 522767 - protein, 11 aa, Mycobacterium
LPPVDGDDAPF

SEQ ID NO: 522768 - protein, 6 aa, Mycobacterium
LPPVDP

SEQ ID NO: 522769 - protein, 6 aa, Mycobacterium
LPPVNA

SEQ ID NO: 522770 - protein, 9 aa, Mycobacterium
LPPVPDTPG

SEQ ID NO: 522771 - protein, 13 aa, Mycobacterium
LPPVPRPQVPTTQ

SEQ ID NO: 522772 - protein, 5 aa, Mycobacterium
LPPVQ

SEQ ID NO: 522773 - protein, 13 aa, Mycobacterium
LPPVQAEDTYVSA

SEQ ID NO: 522774 - protein, 18 aa, Mycobacterium
LPPVSGPAPAAAHAGENV

SEQ ID NO: 522775 - protein, 29 aa, Mycobacterium
LPPVSGPAPADPAASSGDGADQGQTQPAV

SEQ ID NO: 522776 - protein, 8 aa, Mycobacterium
LPPYPGWP

SEQ ID NO: 522777 - protein, 11 aa, Mycobacterium
LPPYTGPPDAL

SEQ ID NO: 522778 - protein, 4 aa, Mycobacterium
LPQA

SEQ ID NO: 522779 - protein, 10 aa, Mycobacterium
LPQAASDDNA

SEQ ID NO: 522780 - protein, 5 aa, Mycobacterium
LPQAE

SEQ ID NO: 522781 - protein, 4 aa, Mycobacterium
LPQD

SEQ ID NO: 522782 - protein, 5 aa, Mycobacterium
LPQDE

SEQ ID NO: 522783 - protein, 7 aa, Mycobacterium
LPQDNPL

SEQ ID NO: 522784 - protein, 5 aa, Mycobacterium
LPQDP

SEQ ID NO: 522785 - protein, 10 aa, Mycobacterium
LPQDPKEGDL

SEQ ID NO: 522786 - protein, 17 aa, Mycobacterium
LPQDRPKSSRRVESPVD

SEQ ID NO: 522787 - protein, 5 aa, Mycobacterium
LPQEA

SEQ ID NO: 522788 - protein, 12 aa, Mycobacterium
LPQEQSQRAGHI

SEQ ID NO: 522789 - protein, 13 aa, Mycobacterium
LPQEQSQRPGHVP

SEQ ID NO: 522790 - protein, 17 aa, Mycobacterium
LPQGARVAPGSADGQKS

SEQ ID NO: 522791 - protein, 41 aa, Mycobacterium
LPQGDASVRRDADGAGKHPAHHRTAHPGHVPRQPGPRLPHP

SEQ ID NO: 522792 - protein, 7 aa, Mycobacterium
LPQGDYA

SEQ ID NO: 522793 - protein, 7 aa, Mycobacterium
LPQGGTD

SEQ ID NO: 522794 - protein, 18 aa, Mycobacterium
LPQGPAYYPDGELTDEPE

SEQ ID NO: 522795 - protein, 8 aa, Mycobacterium
LPQGPNPV

SEQ ID NO: 522796 - protein, 5 aa, Mycobacterium
LPQGR

SEQ ID NO: 522797 - protein, 8 aa, Mycobacterium
LPQGRSSE

SEQ ID NO: 522798 - protein, 11 aa, Mycobacterium
LPQGVEADRER

SEQ ID NO: 522799 - protein, 5 aa, Mycobacterium
LPQGY

SEQ ID NO: 522800 - protein, 8 aa, Mycobacterium
LPQGYDNS

SEQ ID NO: 522801 - protein, 6 aa, Mycobacterium
LPQKGL

SEQ ID NO: 522802 - protein, 10 aa, Mycobacterium
LPQLSEPVAT

SEQ ID NO: 522803 - protein, 4 aa, Mycobacterium
LPQP

SEQ ID NO: 522804 - protein, 7 aa, Mycobacterium
LPQPDSA

SEQ ID NO: 522805 - protein, 9 aa, Mycobacterium
LPQPGTARD

SEQ ID NO: 522806 - protein, 30 aa, Mycobacterium
LPQPKRAARHQLTGAETRRNDRARRLTRRS

SEQ ID NO: 522807 - protein, 11 aa, Mycobacterium
LPQPPEENPQA

SEQ ID NO: 522808 - protein, 6 aa, Mycobacterium
LPQPPL

SEQ ID NO: 522809 - protein, 5 aa, Mycobacterium
LPQPQ

SEQ ID NO: 522810 - protein, 7 aa, Mycobacterium
LPQPRDH

SEQ ID NO: 522811 - protein, 7 aa, Mycobacterium
LPQPRPA

SEQ ID NO: 522812 - protein, 7 aa, Mycobacterium
LPQQAEE

SEQ ID NO: 522813 - protein, 6 aa, Mycobacterium
LPQQAG

SEQ ID NO: 522814 - protein, 8 aa, Mycobacterium
LPQQERQD

SEQ ID NO: 522815 - protein, 21 aa, Mycobacterium
LPQQGHSVPPAVPAAAAAASG

SEQ ID NO: 522816 - protein, 4 aa, Mycobacterium
LPQR

SEQ ID NO: 522817 - protein, 6 aa, Mycobacterium
LPQRDR

SEQ ID NO: 522818 - protein, 6 aa, Mycobacterium
LPQRER

SEQ ID NO: 522819 - protein, 8 aa, Mycobacterium
LPQRPDPH

SEQ ID NO: 522820 - protein, 5 aa, Mycobacterium
LPQRQ

SEQ ID NO: 522821 - protein, 6 aa, Mycobacterium
LPQRQR

SEQ ID NO: 522822 - protein, 7 aa, Mycobacterium
LPQSQRP

SEQ ID NO: 522823 - protein, 11 aa, Mycobacterium
LPQSSRDEDHL

SEQ ID NO: 522824 - protein, 7 aa, Mycobacterium
LPQSTAT

SEQ ID NO: 522825 - protein, 6 aa, Mycobacterium
LPQSTV

SEQ ID NO: 522826 - protein, 4 aa, Mycobacterium
LPQT

SEQ ID NO: 522827 - protein, 5 aa, Mycobacterium
LPQTA

SEQ ID NO: 522828 - protein, 25 aa, Mycobacterium
LPQTAPPSSSPRPPSKRSSRPAPEK

SEQ ID NO: 522829 - protein, 11 aa, Mycobacterium
LPQTATDERLE

SEQ ID NO: 522830 - protein, 8 aa, Mycobacterium
LPQTATTK

SEQ ID NO: 522831 - protein, 7 aa, Mycobacterium
LPQTPDT

SEQ ID NO: 522832 - protein, 6 aa, Mycobacterium
LPQTPE

SEQ ID NO: 522833 - protein, 8 aa, Mycobacterium
LPQTSTGK

SEQ ID NO: 522834 - protein, 5 aa, Mycobacterium
LPQTT

SEQ ID NO: 522835 - protein, 7 aa, Mycobacterium
LPQVPES

SEQ ID NO: 522836 - protein, 11 aa, Mycobacterium
LPQVSDPAAPA

SEQ ID NO: 522837 - protein, 7 aa, Mycobacterium
LPQYSTA

SEQ ID NO: 522838 - protein, 4 aa, Mycobacterium
LPRA

SEQ ID NO: 522839 - protein, 5 aa, Mycobacterium
LPRAE

SEQ ID NO: 522840 - protein, 9 aa, Mycobacterium
LPRAERGEI

SEQ ID NO: 522841 - protein, 6 aa, Mycobacterium
LPRAGS

SEQ ID NO: 522842 - protein, 5 aa, Mycobacterium
LPRAK

SEQ ID NO: 522843 - protein, 15 aa, Mycobacterium
LPRAKSPVLQALEML

SEQ ID NO: 522844 - protein, 5 aa, Mycobacterium
LPRAQ

SEQ ID NO: 522845 - protein, 5 aa, Mycobacterium
LPRAT

SEQ ID NO: 522846 - protein, 5 aa, Mycobacterium
LPRDD

SEQ ID NO: 522847 - protein, 16 aa, Mycobacterium
LPRDDDDALAPPLDET

SEQ ID NO: 522848 - protein, 16 aa, Mycobacterium
LPRDDTAEHVAEPTAH

SEQ ID NO: 522849 - protein, 7 aa, Mycobacterium
LPRDEQQ

SEQ ID NO: 522850 - protein, 11 aa, Mycobacterium
LPRDGDGAVQH

SEQ ID NO: 522851 - protein, 7 aa, Mycobacterium
LPRDPDE

SEQ ID NO: 522852 - protein, 8 aa, Mycobacterium
LPRDPDEL

SEQ ID NO: 522853 - protein, 7 aa, Mycobacterium
LPRDPGE

SEQ ID NO: 522854 - protein, 19 aa, Mycobacterium
LPRDPRSQQPWNPEPLAGN

SEQ ID NO: 522855 - protein, 6 aa, Mycobacterium
LPRDRA

SEQ ID NO: 522856 - protein, 7 aa, Mycobacterium
LPRDSDD

SEQ ID NO: 522857 - protein, 10 aa, Mycobacterium
LPRDSSPVRL

SEQ ID NO: 522858 - protein, 4 aa, Mycobacterium
LPRE

SEQ ID NO: 522859 - protein, 13 aa, Mycobacterium
LPREERAGNEIPR

SEQ ID NO: 522860 - protein, 10 aa, Mycobacterium
LPREEVKPKV

SEQ ID NO: 522861 - protein, 6 aa, Mycobacterium
LPRERA

SEQ ID NO: 522862 - protein, 8 aa, Mycobacterium
LPRERADQ

SEQ ID NO: 522863 - protein, 4 aa, Mycobacterium
LPRG

SEQ ID NO: 522864 - protein, 7 aa, Mycobacterium
LPRGGAE

SEQ ID NO: 522865 - protein, 11 aa, Mycobacterium
LPRGGDQRTEY

SEQ ID NO: 522866 - protein, 11 aa, Mycobacterium
LPRGGRLPSER

SEQ ID NO: 522867 - protein, 8 aa, Mycobacterium
LPRGGTDV

SEQ ID NO: 522868 - protein, 6 aa, Mycobacterium
LPRGGV

SEQ ID NO: 522869 - protein, 10 aa, Mycobacterium
LPRGRQPITS

SEQ ID NO: 522870 - protein, 6 aa, Mycobacterium
LPRGRR

SEQ ID NO: 522871 - protein, 9 aa, Mycobacterium
LPRGRRPIT

SEQ ID NO: 522872 - protein, 5 aa, Mycobacterium
LPRGS

SEQ ID NO: 522873 - protein, 10 aa, Mycobacterium
LPRGSDVDVT

SEQ ID NO: 522874 - protein, 19 aa, Mycobacterium
LPRGSTGKIQRNELQSRVT

SEQ ID NO: 522875 - protein, 13 aa, Mycobacterium
LPRGTSRTEGAET

SEQ ID NO: 522876 - protein, 6 aa, Mycobacterium
LPRHND

SEQ ID NO: 522877 - protein, 6 aa, Mycobacterium
LPRHTA

SEQ ID NO: 522878 - protein, 4 aa, Mycobacterium
LPRI

SEQ ID NO: 522879 - protein, 12 aa, Mycobacterium
LPRIPRANTNAP

SEQ ID NO: 522880 - protein, 4 aa, Mycobacterium
LPRK

SEQ ID NO: 522881 - protein, 9 aa, Mycobacterium
LPRKPSGDL

SEQ ID NO: 522882 - protein, 10 aa, Mycobacterium
LPRKPSGDLA

SEQ ID NO: 522883 - protein, 11 aa, Mycobacterium
LPRKPSGDLAR

SEQ ID NO: 522884 - protein, 8 aa, Mycobacterium
LPRKPSKD

SEQ ID NO: 522885 - protein, 7 aa, Mycobacterium
LPRKSDY

SEQ ID NO: 522886 - protein, 6 aa, Mycobacterium
LPRNGR

SEQ ID NO: 522887 - protein, 9 aa, Mycobacterium
LPRNPSGKV

SEQ ID NO: 522888 - protein, 19 aa, Mycobacterium
LPRPAGPTMTRKARRTDRP

SEQ ID NO: 522889 - protein, 9 aa, Mycobacterium
LPRPARDEL

SEQ ID NO: 522890 - protein, 7 aa, Mycobacterium
LPRPDAR

SEQ ID NO: 522891 - protein, 8 aa, Mycobacterium
LPRPEDSD

SEQ ID NO: 522892 - protein, 6 aa, Mycobacterium
LPRPEP

SEQ ID NO: 522893 - protein, 8 aa, Mycobacterium
LPRPGDDA

SEQ ID NO: 522894 - protein, 18 aa, Mycobacterium
LPRPGDQEDPEKAPSLDE

SEQ ID NO: 522895 - protein, 11 aa, Mycobacterium
LPRPGEPGAQR

SEQ ID NO: 522896 - protein, 9 aa, Mycobacterium
LPRPGGEAV

SEQ ID NO: 522897 - protein, 7 aa, Mycobacterium
LPRPGQT

SEQ ID NO: 522898 - protein, 6 aa, Mycobacterium
LPRPGR

SEQ ID NO: 522899 - protein, 7 aa, Mycobacterium
LPRPGSY

SEQ ID NO: 522900 - protein, 5 aa, Mycobacterium
LPRPK

SEQ ID NO: 522901 - protein, 11 aa, Mycobacterium
LPRPPEEDPQA

SEQ ID NO: 522902 - protein, 11 aa, Mycobacterium
LPRPPEEDRQG

SEQ ID NO: 522903 - protein, 7 aa, Mycobacterium
LPRPPQR

SEQ ID NO: 522904 - protein, 5 aa, Mycobacterium
LPRPQ

SEQ ID NO: 522905 - protein, 6 aa, Mycobacterium
LPRPQT

SEQ ID NO: 522906 - protein, 8 aa, Mycobacterium
LPRPQTQI

SEQ ID NO: 522907 - protein, 68 aa, Mycobacterium
LPRPSGPSSPSPLLGPGGTAHTLNSPPPPQPATPPPPAPQPAAPQGDPPGSSTGSGDPRGAGGPGAQM

SEQ ID NO: 522908 - protein, 6 aa, Mycobacterium
LPRPTA

SEQ ID NO: 522909 - protein, 10 aa, Mycobacterium
LPRQGSKPPW

SEQ ID NO: 522910 - protein, 12 aa, Mycobacterium
LPRRDLNPNETE

SEQ ID NO: 522911 - protein, 11 aa, Mycobacterium
LPRRGRPGAPA

SEQ ID NO: 522912 - protein, 6 aa, Mycobacterium
LPRRGS

SEQ ID NO: 522913 - protein, 5 aa, Mycobacterium
LPRRP

SEQ ID NO: 522914 - protein, 7 aa, Mycobacterium
LPRRPDS

SEQ ID NO: 522915 - protein, 5 aa, Mycobacterium
LPRRY

SEQ ID NO: 522916 - protein, 4 aa, Mycobacterium
LPRS

SEQ ID NO: 522917 - protein, 8 aa, Mycobacterium
LPRSAPVP

SEQ ID NO: 522918 - protein, 11 aa, Mycobacterium
LPRSATTSSLA

SEQ ID NO: 522919 - protein, 6 aa, Mycobacterium
LPRSDL

SEQ ID NO: 522920 - protein, 7 aa, Mycobacterium
LPRSETP

SEQ ID NO: 522921 - protein, 5 aa, Mycobacterium
LPRSP

SEQ ID NO: 522922 - protein, 6 aa, Mycobacterium
LPRSPI

SEQ ID NO: 522923 - protein, 6 aa, Mycobacterium
LPRSPM

SEQ ID NO: 522924 - protein, 7 aa, Mycobacterium
LPRSPQP

SEQ ID NO: 522925 - protein, 16 aa, Mycobacterium
LPRSSGGKIAKGQLRD

SEQ ID NO: 522926 - protein, 14 aa, Mycobacterium
LPRSSGGKVAKGRL

SEQ ID NO: 522927 - protein, 16 aa, Mycobacterium
LPRSSGGKVAKSALRE

SEQ ID NO: 522928 - protein, 8 aa, Mycobacterium
LPRSSTGK

SEQ ID NO: 522929 - protein, 6 aa, Mycobacterium
LPRSTE

SEQ ID NO: 522930 - protein, 5 aa, Mycobacterium
LPRTE

SEQ ID NO: 522931 - protein, 6 aa, Mycobacterium
LPRTGT

SEQ ID NO: 522932 - protein, 8 aa, Mycobacterium
LPRTHRRT

SEQ ID NO: 522933 - protein, 7 aa, Mycobacterium
LPRTPPW

SEQ ID NO: 522934 - protein, 9 aa, Mycobacterium
LPRTPRDAA

SEQ ID NO: 522935 - protein, 9 aa, Mycobacterium
LPRTPTGKL

SEQ ID NO: 522936 - protein, 8 aa, Mycobacterium
LPRTRRGI

SEQ ID NO: 522937 - protein, 5 aa, Mycobacterium
LPRVA

SEQ ID NO: 522938 - protein, 15 aa, Mycobacterium
LPRYPEGSTGEQIET

SEQ ID NO: 522939 - protein, 22 aa, Mycobacterium
LPSAANELGNVAGKTDEATGAL

SEQ ID NO: 522940 - protein, 7 aa, Mycobacterium
LPSAAPY

SEQ ID NO: 522941 - protein, 11 aa, Mycobacterium
LPSAARADDAV

SEQ ID NO: 522942 - protein, 8 aa, Mycobacterium
LPSAEPAQ

SEQ ID NO: 522943 - protein, 8 aa, Mycobacterium
LPSAEQTA

SEQ ID NO: 522944 - protein, 5 aa, Mycobacterium
LPSAG

SEQ ID NO: 522945 - protein, 14 aa, Mycobacterium
LPSAGDLGQFGPNP

SEQ ID NO: 522946 - protein, 12 aa, Mycobacterium
LPSAGGASGGVV

SEQ ID NO: 522947 - protein, 13 aa, Mycobacterium
LPSAGGGGGATVD

SEQ ID NO: 522948 - protein, 12 aa, Mycobacterium
LPSAKGKFPPTY

SEQ ID NO: 522949 - protein, 21 aa, Mycobacterium
LPSAKPDQTEDRTLERRPATR

SEQ ID NO: 522950 - protein, 9 aa, Mycobacterium
LPSAPPSPV

SEQ ID NO: 522951 - protein, 8 aa, Mycobacterium
LPSARDLN

SEQ ID NO: 522952 - protein, 7 aa, Mycobacterium
LPSATSG

SEQ ID NO: 522953 - protein, 6 aa, Mycobacterium
LPSAVD

SEQ ID NO: 522954 - protein, 4 aa, Mycobacterium
LPSD

SEQ ID NO: 522955 - protein, 11 aa, Mycobacterium
LPSDASTLETK

SEQ ID NO: 522956 - protein, 10 aa, Mycobacterium
LPSDGSARAE

SEQ ID NO: 522957 - protein, 12 aa, Mycobacterium
LPSDGSGKAPAA

SEQ ID NO: 522958 - protein, 30 aa, Mycobacterium
LPSDPAPAQNAVAPATSAAPTTAPTPSGLG

SEQ ID NO: 522959 - protein, 6 aa, Mycobacterium
LPSDRA

SEQ ID NO: 522960 - protein, 10 aa, Mycobacterium
LPSDRGTGLG

SEQ ID NO: 522961 - protein, 11 aa, Mycobacterium
LPSDRVPTSKD

SEQ ID NO: 522962 - protein, 11 aa, Mycobacterium
LPSDTANLREG

SEQ ID NO: 522963 - protein, 8 aa, Mycobacterium
LPSDTGEL

SEQ ID NO: 522964 - protein, 8 aa, Mycobacterium
LPSDVRPG

SEQ ID NO: 522965 - protein, 4 aa, Mycobacterium
LPSE

SEQ ID NO: 522966 - protein, 13 aa, Mycobacterium
LPSEAATLERPRS

SEQ ID NO: 522967 - protein, 18 aa, Mycobacterium
LPSEAEALDRPRSSSDIP

SEQ ID NO: 522968 - protein, 8 aa, Mycobacterium
LPSEESAT

SEQ ID NO: 522969 - protein, 17 aa, Mycobacterium
LPSEHDAAASCAPGART

SEQ ID NO: 522970 - protein, 6 aa, Mycobacterium
LPSEPA

SEQ ID NO: 522971 - protein, 6 aa, Mycobacterium
LPSEPH

SEQ ID NO: 522972 - protein, 7 aa, Mycobacterium
LPSEQKD

SEQ ID NO: 522973 - protein, 5 aa, Mycobacterium
LPSET

SEQ ID NO: 522974 - protein, 6 aa, Mycobacterium
LPSEVR

SEQ ID NO: 522975 - protein, 11 aa, Mycobacterium
LPSEVSDPVDA

SEQ ID NO: 522976 - protein, 7 aa, Mycobacterium
LPSFAGR

SEQ ID NO: 522977 - protein, 5 aa, Mycobacterium
LPSFE

SEQ ID NO: 522978 - protein, 4 aa, Mycobacterium
LPSG

SEQ ID NO: 522979 - protein, 25 aa, Mycobacterium
LPSGAEPPAVGTAPDAEPPAAGPLV

SEQ ID NO: 522980 - protein, 8 aa, Mycobacterium
LPSGASVK

SEQ ID NO: 522981 - protein, 10 aa, Mycobacterium
LPSGDPVDPI

SEQ ID NO: 522982 - protein, 11 aa, Mycobacterium
LPSGDQDDPSV

SEQ ID NO: 522983 - protein, 13 aa, Mycobacterium
LPSGEPARAGADG

SEQ ID NO: 522984 - protein, 6 aa, Mycobacterium
LPSGEY

SEQ ID NO: 522985 - protein, 6 aa, Mycobacterium
LPSGGQ

SEQ ID NO: 522986 - protein, 6 aa, Mycobacterium
LPSGGR

SEQ ID NO: 522987 - protein, 7 aa, Mycobacterium
LPSGGRG

SEQ ID NO: 522988 - protein, 13 aa, Mycobacterium
LPSGHSATAPLAE

SEQ ID NO: 522989 - protein, 7 aa, Mycobacterium
LPSGPTA

SEQ ID NO: 522990 - protein, 11 aa, Mycobacterium
LPSGQVDNDDD

SEQ ID NO: 522991 - protein, 5 aa, Mycobacterium
LPSGR

SEQ ID NO: 522992 - protein, 12 aa, Mycobacterium
LPSGRGWATHQR

SEQ ID NO: 522993 - protein, 8 aa, Mycobacterium
LPSGRRDD

SEQ ID NO: 522994 - protein, 10 aa, Mycobacterium
LPSGRSNYGL

SEQ ID NO: 522995 - protein, 5 aa, Mycobacterium
LPSGS

SEQ ID NO: 522996 - protein, 6 aa, Mycobacterium
LPSGSP

SEQ ID NO: 522997 - protein, 22 aa, Mycobacterium
LPSGTENRYPHELSGGQRQRAN

SEQ ID NO: 522998 - protein, 7 aa, Mycobacterium
LPSGTPV

SEQ ID NO: 522999 - protein, 8 aa, Mycobacterium
LPSGTRST

SEQ ID NO: 523000 - protein, 5 aa, Mycobacterium
LPSGV

SEQ ID NO: 523001 - protein, 13 aa, Mycobacterium
LPSHEPAPNLTKL

SEQ ID NO: 523002 - protein, 8 aa, Mycobacterium
LPSHPGHE

SEQ ID NO: 523003 - protein, 8 aa, Mycobacterium
LPSHPNHD

SEQ ID NO: 523004 - protein, 15 aa, Mycobacterium
LPSHTADTPRPTHEE

SEQ ID NO: 523005 - protein, 4 aa, Mycobacterium
LPSI

SEQ ID NO: 523006 - protein, 12 aa, Mycobacterium
LPSKEAIGQTAA

SEQ ID NO: 523007 - protein, 9 aa, Mycobacterium
LPSKEAVTT

SEQ ID NO: 523008 - protein, 8 aa, Mycobacterium
LPSKGLDA

SEQ ID NO: 523009 - protein, 11 aa, Mycobacterium
LPSKLATQTLG

SEQ ID NO: 523010 - protein, 4 aa, Mycobacterium
LPSL

SEQ ID NO: 523011 - protein, 12 aa, Mycobacterium
LPSNPRAGLSDE

SEQ ID NO: 523012 - protein, 5 aa, Mycobacterium
LPSNR

SEQ ID NO: 523013 - protein, 15 aa, Mycobacterium
LPSNRLNDGKVDKRG

SEQ ID NO: 523014 - protein, 4 aa, Mycobacterium
LPSP

SEQ ID NO: 523015 - protein, 8 aa, Mycobacterium
LPSPASPL

SEQ ID NO: 523016 - protein, 7 aa, Mycobacterium
LPSPASQ

SEQ ID NO: 523017 - protein, 7 aa, Mycobacterium
LPSPATA

SEQ ID NO: 523018 - protein, 15 aa, Mycobacterium
LPSPATAAVGDDRGT

SEQ ID NO: 523019 - protein, 9 aa, Mycobacterium
LPSPDPAPI

SEQ ID NO: 523020 - protein, 5 aa, Mycobacterium
LPSPE

SEQ ID NO: 523021 - protein, 11 aa, Mycobacterium
LPSPEEAAAAE

SEQ ID NO: 523022 - protein, 9 aa, Mycobacterium
LPSPGDDTE

SEQ ID NO: 523023 - protein, 9 aa, Mycobacterium
LPSPGGRAE

SEQ ID NO: 523024 - protein, 6 aa, Mycobacterium
LPSPGV

SEQ ID NO: 523025 - protein, 16 aa, Mycobacterium
LPSPLPPAKTAAGTWG

SEQ ID NO: 523026 - protein, 11 aa, Mycobacterium
LPSPNAMEVGP

SEQ ID NO: 523027 - protein, 7 aa, Mycobacterium
LPSPNRQ

SEQ ID NO: 523028 - protein, 16 aa, Mycobacterium
LPSPPRGYNPAPAPEW

SEQ ID NO: 523029 - protein, 15 aa, Mycobacterium
LPSPPRPPAPAPVPD

SEQ ID NO: 523030 - protein, 16 aa, Mycobacterium
LPSPPRPVTPAPPPEW

SEQ ID NO: 523031 - protein, 7 aa, Mycobacterium
LPSPRHE

SEQ ID NO: 523032 - protein, 8 aa, Mycobacterium
LPSPRNTE

SEQ ID NO: 523033 - protein, 7 aa, Mycobacterium
LPSPRPP

SEQ ID NO: 523034 - protein, 10 aa, Mycobacterium
LPSPSATVQS

SEQ ID NO: 523035 - protein, 11 aa, Mycobacterium
LPSPSDPLEEP

SEQ ID NO: 523036 - protein, 10 aa, Mycobacterium
LPSPTDRERG

SEQ ID NO: 523037 - protein, 8 aa, Mycobacterium
LPSPTHER

SEQ ID NO: 523038 - protein, 14 aa, Mycobacterium
LPSPVVPPKPSASA

SEQ ID NO: 523039 - protein, 6 aa, Mycobacterium
LPSPYG

SEQ ID NO: 523040 - protein, 6 aa, Mycobacterium
LPSPYH

SEQ ID NO: 523041 - protein, 6 aa, Mycobacterium
LPSPYT

SEQ ID NO: 523042 - protein, 7 aa, Mycobacterium
LPSQTQQ

SEQ ID NO: 523043 - protein, 6 aa, Mycobacterium
LPSRDR

SEQ ID NO: 523044 - protein, 11 aa, Mycobacterium
LPSRELNPNET

SEQ ID NO: 523045 - protein, 6 aa, Mycobacterium
LPSRES

SEQ ID NO: 523046 - protein, 7 aa, Mycobacterium
LPSRGDV

SEQ ID NO: 523047 - protein, 8 aa, Mycobacterium
LPSRGISE

SEQ ID NO: 523048 - protein, 5 aa, Mycobacterium
LPSRP

SEQ ID NO: 523049 - protein, 7 aa, Mycobacterium
LPSRPAV

SEQ ID NO: 523050 - protein, 8 aa, Mycobacterium
LPSRPDPH

SEQ ID NO: 523051 - protein, 9 aa, Mycobacterium
LPSRPDPQA

SEQ ID NO: 523052 - protein, 8 aa, Mycobacterium
LPSRPPEF

SEQ ID NO: 523053 - protein, 8 aa, Mycobacterium
LPSRPSAW

SEQ ID NO: 523054 - protein, 7 aa, Mycobacterium
LPSRPSH

SEQ ID NO: 523055 - protein, 9 aa, Mycobacterium
LPSRPSSWR

SEQ ID NO: 523056 - protein, 6 aa, Mycobacterium
LPSRSA

SEQ ID NO: 523057 - protein, 5 aa, Mycobacterium
LPSRY

SEQ ID NO: 523058 - protein, 7 aa, Mycobacterium
LPSRYGQ

SEQ ID NO: 523059 - protein, 21 aa, Mycobacterium
LPSRYSEAVSTSDLKPLGQPE

SEQ ID NO: 523060 - protein, 6 aa, Mycobacterium
LPSSAR

SEQ ID NO: 523061 - protein, 10 aa, Mycobacterium
LPSSARTGSR

SEQ ID NO: 523062 - protein, 10 aa, Mycobacterium
LPSSDPMKAT

SEQ ID NO: 523063 - protein, 9 aa, Mycobacterium
LPSSDPRRA

SEQ ID NO: 523064 - protein, 10 aa, Mycobacterium
LPSSEAVTTN

SEQ ID NO: 523065 - protein, 6 aa, Mycobacterium
LPSSGE

SEQ ID NO: 523066 - protein, 6 aa, Mycobacterium
LPSSGG

SEQ ID NO: 523067 - protein, 14 aa, Mycobacterium
LPSSGGGGGGATID

SEQ ID NO: 523068 - protein, 11 aa, Mycobacterium
LPSSPAKAVQE

SEQ ID NO: 523069 - protein, 12 aa, Mycobacterium
LPSSPGVTGAAA

SEQ ID NO: 523070 - protein, 14 aa, Mycobacterium
LPSSPGVTGASAAD

SEQ ID NO: 523071 - protein, 8 aa, Mycobacterium
LPSSPRQA

SEQ ID NO: 523072 - protein, 13 aa, Mycobacterium
LPSSQARAFEAGQ

SEQ ID NO: 523073 - protein, 12 aa, Mycobacterium
LPSSTNPTRPHT

SEQ ID NO: 523074 - protein, 7 aa, Mycobacterium
LPSSVDE

SEQ ID NO: 523075 - protein, 5 aa, Mycobacterium
LPSTA

SEQ ID NO: 523076 - protein, 6 aa, Mycobacterium
LPSTAA

SEQ ID NO: 523077 - protein, 6 aa, Mycobacterium
LPSTAT

SEQ ID NO: 523078 - protein, 8 aa, Mycobacterium
LPSTATNK

SEQ ID NO: 523079 - protein, 8 aa, Mycobacterium
LPSTDDLP

SEQ ID NO: 523080 - protein, 6 aa, Mycobacterium
LPSTDE

SEQ ID NO: 523081 - protein, 9 aa, Mycobacterium
LPSTDGNRL

SEQ ID NO: 523082 - protein, 5 aa, Mycobacterium
LPSTG

SEQ ID NO: 523083 - protein, 7 aa, Mycobacterium
LPSTGAG

SEQ ID NO: 523084 - protein, 5 aa, Mycobacterium
LPSTL

SEQ ID NO: 523085 - protein, 7 aa, Mycobacterium
LPSTPAG

SEQ ID NO: 523086 - protein, 8 aa, Mycobacterium
LPSTPNVK

SEQ ID NO: 523087 - protein, 7 aa, Mycobacterium
LPSTPSH

SEQ ID NO: 523088 - protein, 12 aa, Mycobacterium
LPSTRARRPFED

SEQ ID NO: 523089 - protein, 12 aa, Mycobacterium
LPSTRQPPGARH

SEQ ID NO: 523090 - protein, 5 aa, Mycobacterium
LPSTS

SEQ ID NO: 523091 - protein, 12 aa, Mycobacterium
LPSTSPAHAVRP

SEQ ID NO: 523092 - protein, 10 aa, Mycobacterium
LPSTSPAQTM

SEQ ID NO: 523093 - protein, 17 aa, Mycobacterium
LPSTSVSSGPPDLGGVP

SEQ ID NO: 523094 - protein, 11 aa, Mycobacterium
LPSTTSDAEIR

SEQ ID NO: 523095 - protein, 4 aa, Mycobacterium
LPSV

SEQ ID NO: 523096 - protein, 12 aa, Mycobacterium
LPSVGSAAPGFT

SEQ ID NO: 523097 - protein, 8 aa, Mycobacterium
LPSYETSF

SEQ ID NO: 523098 - protein, 5 aa, Mycobacterium
LPTAA

SEQ ID NO: 523099 - protein, 7 aa, Mycobacterium
LPTAAGL

SEQ ID NO: 523100 - protein, 16 aa, Mycobacterium
LPTAARAAANATPESR

SEQ ID NO: 523101 - protein, 5 aa, Mycobacterium
LPTAP

SEQ ID NO: 523102 - protein, 12 aa, Mycobacterium
LPTAPVSAVGDP

SEQ ID NO: 523103 - protein, 6 aa, Mycobacterium
LPTAQA

SEQ ID NO: 523104 - protein, 11 aa, Mycobacterium
LPTARRTAADV

SEQ ID NO: 523105 - protein, 11 aa, Mycobacterium
LPTASGPLENP

SEQ ID NO: 523106 - protein, 5 aa, Mycobacterium
LPTAV

SEQ ID NO: 523107 - protein, 4 aa, Mycobacterium
LPTD

SEQ ID NO: 523108 - protein, 8 aa, Mycobacterium
LPTDAEEW

SEQ ID NO: 523109 - protein, 5 aa, Mycobacterium
LPTDD

SEQ ID NO: 523110 - protein, 6 aa, Mycobacterium
LPTDDL

SEQ ID NO: 523111 - protein, 5 aa, Mycobacterium
LPTDE

SEQ ID NO: 523112 - protein, 6 aa, Mycobacterium
LPTDGR

SEQ ID NO: 523113 - protein, 5 aa, Mycobacterium
LPTDH

SEQ ID NO: 523114 - protein, 8 aa, Mycobacterium
LPTDPAAT

SEQ ID NO: 523115 - protein, 12 aa, Mycobacterium
LPTDPDKLADEL

SEQ ID NO: 523116 - protein, 5 aa, Mycobacterium
LPTDQ

SEQ ID NO: 523117 - protein, 6 aa, Mycobacterium
LPTDRN

SEQ ID NO: 523118 - protein, 5 aa, Mycobacterium
LPTDS

SEQ ID NO: 523119 - protein, 5 aa, Mycobacterium
LPTDT

SEQ ID NO: 523120 - protein, 9 aa, Mycobacterium
LPTDTDDDV

SEQ ID NO: 523121 - protein, 11 aa, Mycobacterium
LPTEADGLSSH

SEQ ID NO: 523122 - protein, 24 aa, Mycobacterium
LPTEAPGGVTYQPPCPDVPAPESL

SEQ ID NO: 523123 - protein, 10 aa, Mycobacterium
LPTEASPMNT

SEQ ID NO: 523124 - protein, 6 aa, Mycobacterium
LPTEEE

SEQ ID NO: 523125 - protein, 10 aa, Mycobacterium
LPTEGHPQNH

SEQ ID NO: 523126 - protein, 9 aa, Mycobacterium
LPTEGPTQS

SEQ ID NO: 523127 - protein, 9 aa, Mycobacterium
LPTEGRGGR

SEQ ID NO: 523128 - protein, 9 aa, Mycobacterium
LPTEKGRIT

SEQ ID NO: 523129 - protein, 8 aa, Mycobacterium
LPTENGAR

SEQ ID NO: 523130 - protein, 9 aa, Mycobacterium
LPTEPGAGA

SEQ ID NO: 523131 - protein, 11 aa, Mycobacterium
LPTEPTRRGRR

SEQ ID NO: 523132 - protein, 12 aa, Mycobacterium
LPTEPTRRGRRN

SEQ ID NO: 523133 - protein, 12 aa, Mycobacterium
LPTFSSAPTDHA

SEQ ID NO: 523134 - protein, 17 aa, Mycobacterium
LPTGAGGGIHPVCPGWL

SEQ ID NO: 523135 - protein, 26 aa, Mycobacterium
LPTGATRARRETYPTRDAAEVRRDEL

SEQ ID NO: 523136 - protein, 15 aa, Mycobacterium
LPTGERARAGADGVD

SEQ ID NO: 523137 - protein, 13 aa, Mycobacterium
LPTGERVRAGGDG

SEQ ID NO: 523138 - protein, 9 aa, Mycobacterium
LPTGESAHA

SEQ ID NO: 523139 - protein, 5 aa, Mycobacterium
LPTGF

SEQ ID NO: 523140 - protein, 8 aa, Mycobacterium
LPTGGSWP

SEQ ID NO: 523141 - protein, 7 aa, Mycobacterium
LPTGGTS

SEQ ID NO: 523142 - protein, 8 aa, Mycobacterium
LPTGHSAP

SEQ ID NO: 523143 - protein, 5 aa, Mycobacterium
LPTGI

SEQ ID NO: 523144 - protein, 11 aa, Mycobacterium
LPTGKTARYNA

SEQ ID NO: 523145 - protein, 7 aa, Mycobacterium
LPTGLKD

SEQ ID NO: 523146 - protein, 11 aa, Mycobacterium
LPTGPAPNRSG

SEQ ID NO: 523147 - protein, 14 aa, Mycobacterium
LPTGPSESPAPVSP

SEQ ID NO: 523148 - protein, 26 aa, Mycobacterium
LPTGQTRARQESYPTREAAEARRDEL

SEQ ID NO: 523149 - protein, 10 aa, Mycobacterium
LPTGRPAQLD

SEQ ID NO: 523150 - protein, 23 aa, Mycobacterium
LPTGSALRPATDAIAADPAADHS

SEQ ID NO: 523151 - protein, 7 aa, Mycobacterium
LPTGSAQ

SEQ ID NO: 523152 - protein, 8 aa, Mycobacterium
LPTGTSVA

SEQ ID NO: 523153 - protein, 7 aa, Mycobacterium
LPTGVKD

SEQ ID NO: 523154 - protein, 17 aa, Mycobacterium
LPTGVKDEFDALKERLA

SEQ ID NO: 523155 - protein, 17 aa, Mycobacterium
LPTGVKDEFEALKQRLS

SEQ ID NO: 523156 - protein, 6 aa, Mycobacterium
LPTGVR

SEQ ID NO: 523157 - protein, 6 aa, Mycobacterium
LPTHGG

SEQ ID NO: 523158 - protein, 22 aa, Mycobacterium
LPTHGGTALTGGAFGEANYPAL

SEQ ID NO: 523159 - protein, 8 aa, Mycobacterium
LPTHSRET

SEQ ID NO: 523160 - protein, 7 aa, Mycobacterium
LPTKGDV

SEQ ID NO: 523161 - protein, 6 aa, Mycobacterium
LPTLGG

SEQ ID NO: 523162 - protein, 9 aa, Mycobacterium
LPTLQQRGE

SEQ ID NO: 523163 - protein, 10 aa, Mycobacterium
LPTLSPEDSL

SEQ ID NO: 523164 - protein, 9 aa, Mycobacterium
LPTLTSKEQ

SEQ ID NO: 523165 - protein, 6 aa, Mycobacterium
LPTMRG

SEQ ID NO: 523166 - protein, 4 aa, Mycobacterium
LPTN

SEQ ID NO: 523167 - protein, 7 aa, Mycobacterium
LPTNATG

SEQ ID NO: 523168 - protein, 8 aa, Mycobacterium
LPTNATGK

SEQ ID NO: 523169 - protein, 8 aa, Mycobacterium
LPTNEPVY

SEQ ID NO: 523170 - protein, 8 aa, Mycobacterium
LPTNQRPA

SEQ ID NO: 523171 - protein, 11 aa, Mycobacterium
LPTPAAGPVGI

SEQ ID NO: 523172 - protein, 29 aa, Mycobacterium
LPTPAPTKPDGPVATGPLAADERSRTDTV

SEQ ID NO: 523173 - protein, 8 aa, Mycobacterium
LPTPDGDG

SEQ ID NO: 523174 - protein, 6 aa, Mycobacterium
LPTPDI

SEQ ID NO: 523175 - protein, 6 aa, Mycobacterium
LPTPDQ

SEQ ID NO: 523176 - protein, 11 aa, Mycobacterium
LPTPEPDEPPP

SEQ ID NO: 523177 - protein, 12 aa, Mycobacterium
LPTPEQAAAAEE

SEQ ID NO: 523178 - protein, 13 aa, Mycobacterium
LPTPEQAAAAEKE

SEQ ID NO: 523179 - protein, 23 aa, Mycobacterium
LPTPEQADANQAQVFSTRYGGDH

SEQ ID NO: 523180 - protein, 6 aa, Mycobacterium
LPTPET

SEQ ID NO: 523181 - protein, 9 aa, Mycobacterium
LPTPGGNTF

SEQ ID NO: 523182 - protein, 20 aa, Mycobacterium
LPTPGQDTVEVAAGAKESVS

SEQ ID NO: 523183 - protein, 6 aa, Mycobacterium
LPTPGV

SEQ ID NO: 523184 - protein, 38 aa, Mycobacterium
LPTPLDAETSTPSKDTPADTDEDSGADEDSSQTAQTEE

SEQ ID NO: 523185 - protein, 8 aa, Mycobacterium
LPTPPPPI

SEQ ID NO: 523186 - protein, 10 aa, Mycobacterium
LPTPPQLDDA

SEQ ID NO: 523187 - protein, 22 aa, Mycobacterium
LPTPQQPPGREPQLRRRRADLK

SEQ ID NO: 523188 - protein, 8 aa, Mycobacterium
LPTPRRDR

SEQ ID NO: 523189 - protein, 5 aa, Mycobacterium
LPTPS

SEQ ID NO: 523190 - protein, 16 aa, Mycobacterium
LPTPSESAFGRDPEIK

SEQ ID NO: 523191 - protein, 9 aa, Mycobacterium
LPTPSGNTF

SEQ ID NO: 523192 - protein, 6 aa, Mycobacterium
LPTPSR

SEQ ID NO: 523193 - protein, 8 aa, Mycobacterium
LPTPTANA

SEQ ID NO: 523194 - protein, 6 aa, Mycobacterium
LPTPVT

SEQ ID NO: 523195 - protein, 6 aa, Mycobacterium
LPTPYH

SEQ ID NO: 523196 - protein, 6 aa, Mycobacterium
LPTQAD

SEQ ID NO: 523197 - protein, 11 aa, Mycobacterium
LPTQGHPQNHS

SEQ ID NO: 523198 - protein, 10 aa, Mycobacterium
LPTQPETAAP

SEQ ID NO: 523199 - protein, 4 aa, Mycobacterium
LPTR

SEQ ID NO: 523200 - protein, 22 aa, Mycobacterium
LPTREAADADLARKASSYRRDE

SEQ ID NO: 523201 - protein, 16 aa, Mycobacterium
LPTREPPPGGGQNAPL

SEQ ID NO: 523202 - protein, 9 aa, Mycobacterium
LPTRERSDG

SEQ ID NO: 523203 - protein, 9 aa, Mycobacterium
LPTRGTQTL

SEQ ID NO: 523204 - protein, 10 aa, Mycobacterium
LPTRLSDGGF

SEQ ID NO: 523205 - protein, 5 aa, Mycobacterium
LPTRP

SEQ ID NO: 523206 - protein, 6 aa, Mycobacterium
LPTRPT

SEQ ID NO: 523207 - protein, 5 aa, Mycobacterium
LPTRR

SEQ ID NO: 523208 - protein, 5 aa, Mycobacterium
LPTRS

SEQ ID NO: 523209 - protein, 6 aa, Mycobacterium
LPTRYS

SEQ ID NO: 523210 - protein, 5 aa, Mycobacterium
LPTSG

SEQ ID NO: 523211 - protein, 10 aa, Mycobacterium
LPTSGGAAAE

SEQ ID NO: 523212 - protein, 11 aa, Mycobacterium
LPTSGGAAAKV

SEQ ID NO: 523213 - protein, 10 aa, Mycobacterium
LPTSGGDAAK

SEQ ID NO: 523214 - protein, 6 aa, Mycobacterium
LPTSGI

SEQ ID NO: 523215 - protein, 8 aa, Mycobacterium
LPTSPAES

SEQ ID NO: 523216 - protein, 11 aa, Mycobacterium
LPTSPDYTGNT

SEQ ID NO: 523217 - protein, 11 aa, Mycobacterium
LPTSPGYNGNT

SEQ ID NO: 523218 - protein, 10 aa, Mycobacterium
LPTSPGYSGV

SEQ ID NO: 523219 - protein, 20 aa, Mycobacterium
LPTSRAPGQPAAFPASPKFK

SEQ ID NO: 523220 - protein, 6 aa, Mycobacterium
LPTSSD

SEQ ID NO: 523221 - protein, 5 aa, Mycobacterium
LPTTA

SEQ ID NO: 523222 - protein, 15 aa, Mycobacterium
LPTTAIPAAGGDEVS

SEQ ID NO: 523223 - protein, 7 aa, Mycobacterium
LPTTATG

SEQ ID NO: 523224 - protein, 7 aa, Mycobacterium
LPTTATN

SEQ ID NO: 523225 - protein, 8 aa, Mycobacterium
LPTTAVGK

SEQ ID NO: 523226 - protein, 9 aa, Mycobacterium
LPTTERPDG

SEQ ID NO: 523227 - protein, 17 aa, Mycobacterium
LPTTPEPHNTSAPSRGR

SEQ ID NO: 523228 - protein, 7 aa, Mycobacterium
LPTTPPP

SEQ ID NO: 523229 - protein, 8 aa, Mycobacterium
LPTTPVGK

SEQ ID NO: 523230 - protein, 12 aa, Mycobacterium
LPTTRPATPARV

SEQ ID NO: 523231 - protein, 5 aa, Mycobacterium
LPTTT

SEQ ID NO: 523232 - protein, 16 aa, Mycobacterium
LPTTTIGSYPQTSAIR

SEQ ID NO: 523233 - protein, 12 aa, Mycobacterium
LPTVSGSVPPTV

SEQ ID NO: 523234 - protein, 5 aa, Mycobacterium
LPTVT

SEQ ID NO: 523235 - protein, 4 aa, Mycobacterium
LPTY

SEQ ID NO: 523236 - protein, 5 aa, Mycobacterium
LPTYD

SEQ ID NO: 523237 - protein, 5 aa, Mycobacterium
LPTYE

SEQ ID NO: 523238 - protein, 6 aa, Mycobacterium
LPTYNT

SEQ ID NO: 523239 - protein, 11 aa, Mycobacterium
LPVAPAQTGSR

SEQ ID NO: 523240 - protein, 4 aa, Mycobacterium
LPVD

SEQ ID NO: 523241 - protein, 9 aa, Mycobacterium
LPVDADDPD

SEQ ID NO: 523242 - protein, 6 aa, Mycobacterium
LPVDDA

SEQ ID NO: 523243 - protein, 13 aa, Mycobacterium
LPVEAKDRDKPAF

SEQ ID NO: 523244 - protein, 9 aa, Mycobacterium
LPVESTKPV

SEQ ID NO: 523245 - protein, 6 aa, Mycobacterium
LPVGPD

SEQ ID NO: 523246 - protein, 14 aa, Mycobacterium
LPVGPPPGVTPTPL

SEQ ID NO: 523247 - protein, 11 aa, Mycobacterium
LPVGPPPGVVP

SEQ ID NO: 523248 - protein, 9 aa, Mycobacterium
LPVGPTRRA

SEQ ID NO: 523249 - protein, 7 aa, Mycobacterium
LPVGQRR

SEQ ID NO: 523250 - protein, 20 aa, Mycobacterium
LPVNPSGGLKAKGHPPGATG

SEQ ID NO: 523251 - protein, 5 aa, Mycobacterium
LPVPH

SEQ ID NO: 523252 - protein, 5 aa, Mycobacterium
LPVPQ

SEQ ID NO: 523253 - protein, 11 aa, Mycobacterium
LPVPQGQEGQI

SEQ ID NO: 523254 - protein, 7 aa, Mycobacterium
LPVPSSM

SEQ ID NO: 523255 - protein, 6 aa, Mycobacterium
LPVPTA

SEQ ID NO: 523256 - protein, 7 aa, Mycobacterium
LPVPTGQ

SEQ ID NO: 523257 - protein, 9 aa, Mycobacterium
LPVQDAPAL

SEQ ID NO: 523258 - protein, 4 aa, Mycobacterium
LPVS

SEQ ID NO: 523259 - protein, 15 aa, Mycobacterium
LPVSDQRARAEASGA

SEQ ID NO: 523260 - protein, 5 aa, Mycobacterium
LPVTG

SEQ ID NO: 523261 - protein, 6 aa, Mycobacterium
LPWPTE

SEQ ID NO: 523262 - protein, 5 aa, Mycobacterium
LPYAT

SEQ ID NO: 523263 - protein, 9 aa, Mycobacterium
LPYATTDAG

SEQ ID NO: 523264 - protein, 9 aa, Mycobacterium
LPYATTEPG

SEQ ID NO: 523265 - protein, 10 aa, Mycobacterium
LPYEPRTAYR

SEQ ID NO: 523266 - protein, 13 aa, Mycobacterium
LPYHESNKISEAD

SEQ ID NO: 523267 - protein, 17 aa, Mycobacterium
LPYPDAASVSSRSSVAR

SEQ ID NO: 523268 - protein, 7 aa, Mycobacterium
LPYPDGE

SEQ ID NO: 523269 - protein, 6 aa, Mycobacterium
LPYPPG

SEQ ID NO: 523270 - protein, 30 aa, Mycobacterium
LPYPPNYPKMPGEPKRVQPSRDTDLKRDTK

SEQ ID NO: 523271 - protein, 23 aa, Mycobacterium
LPYPPNYPKMPGEPPRVQPSKKV

SEQ ID NO: 523272 - protein, 9 aa, Mycobacterium
LPYPSAGAR

SEQ ID NO: 523273 - protein, 6 aa, Mycobacterium
LPYPTT

SEQ ID NO: 523274 - protein, 12 aa, Mycobacterium
LPYRSDADSPEL

SEQ ID NO: 523275 - protein, 5 aa, Mycobacterium
LPYSA

SEQ ID NO: 523276 - protein, 5 aa, Mycobacterium
LPYTS

SEQ ID NO: 523277 - protein, 5 aa, Mycobacterium
LPYTT

SEQ ID NO: 523278 - protein, 4 aa, Mycobacterium
LQAA

SEQ ID NO: 523279 - protein, 10 aa, Mycobacterium
LQAADDAQIR

SEQ ID NO: 523280 - protein, 10 aa, Mycobacterium
LQAADDAQVR

SEQ ID NO: 523281 - protein, 10 aa, Mycobacterium
LQAAEDAQIR

SEQ ID NO: 523282 - protein, 5 aa, Mycobacterium
LQAAP

SEQ ID NO: 523283 - protein, 10 aa, Mycobacterium
LQAAQDAQIR

SEQ ID NO: 523284 - protein, 15 aa, Mycobacterium
LQAAQTAGQAAAAAA

SEQ ID NO: 523285 - protein, 7 aa, Mycobacterium
LQADGGF

SEQ ID NO: 523286 - protein, 10 aa, Mycobacterium
LQADGSLAAE

SEQ ID NO: 523287 - protein, 9 aa, Mycobacterium
LQADSGLSL

SEQ ID NO: 523288 - protein, 13 aa, Mycobacterium
LQAEDDRIGDVRG

SEQ ID NO: 523289 - protein, 6 aa, Mycobacterium
LQAGER

SEQ ID NO: 523290 - protein, 13 aa, Mycobacterium
LQAGGAGLWELIT

SEQ ID NO: 523291 - protein, 7 aa, Mycobacterium
LQAGGRH

SEQ ID NO: 523292 - protein, 22 aa, Mycobacterium
LQAGNAAAAGPTTAVAPAASDA

SEQ ID NO: 523293 - protein, 7 aa, Mycobacterium
LQAGQGA

SEQ ID NO: 523294 - protein, 28 aa, Mycobacterium
LQAGSAETARPEPSDGVTVNGGPGTVTR

SEQ ID NO: 523295 - protein, 10 aa, Mycobacterium
LQAGSPAQIS

SEQ ID NO: 523296 - protein, 6 aa, Mycobacterium
LQAGSS

SEQ ID NO: 523297 - protein, 8 aa, Mycobacterium
LQAGTAER

SEQ ID NO: 523298 - protein, 8 aa, Mycobacterium
LQAGTDAK

SEQ ID NO: 523299 - protein, 8 aa, Mycobacterium
LQAPGLTA

SEQ ID NO: 523300 - protein, 7 aa, Mycobacterium
LQAPGPV

SEQ ID NO: 523301 - protein, 8 aa, Mycobacterium
LQAPGSAV

SEQ ID NO: 523302 - protein, 8 aa, Mycobacterium
LQAPRPDD

SEQ ID NO: 523303 - protein, 6 aa, Mycobacterium
LQAPYG

SEQ ID NO: 523304 - protein, 35 aa, Mycobacterium
LQAQNQASVTSGGVTAGINQAPPGMPVDPTNPNNT

SEQ ID NO: 523305 - protein, 8 aa, Mycobacterium
LQAQPDVD

SEQ ID NO: 523306 - protein, 5 aa, Mycobacterium
LQAQT

SEQ ID NO: 523307 - protein, 8 aa, Mycobacterium
LQAQTGSS

SEQ ID NO: 523308 - protein, 16 aa, Mycobacterium
LQARAGAGRGDGKPVV

SEQ ID NO: 523309 - protein, 5 aa, Mycobacterium
LQARG

SEQ ID NO: 523310 - protein, 10 aa, Mycobacterium
LQARKQSAVA

SEQ ID NO: 523311 - protein, 5 aa, Mycobacterium
LQARP

SEQ ID NO: 523312 - protein, 7 aa, Mycobacterium
LQARPAP

SEQ ID NO: 523313 - protein, 7 aa, Mycobacterium
LQARRDR

SEQ ID NO: 523314 - protein, 10 aa, Mycobacterium
LQASAQASSW

SEQ ID NO: 523315 - protein, 8 aa, Mycobacterium
LQASGNDD

SEQ ID NO: 523316 - protein, 14 aa, Mycobacterium
LQASGTAFSGAVQS

SEQ ID NO: 523317 - protein, 10 aa, Mycobacterium
LQATASAYSS

SEQ ID NO: 523318 - protein, 7 aa, Mycobacterium
LQATDSV

SEQ ID NO: 523319 - protein, 5 aa, Mycobacterium
LQATE

SEQ ID NO: 523320 - protein, 5 aa, Mycobacterium
LQATR

SEQ ID NO: 523321 - protein, 10 aa, Mycobacterium
LQDAARAYSG

SEQ ID NO: 523322 - protein, 8 aa, Mycobacterium
LQDASGAL

SEQ ID NO: 523323 - protein, 6 aa, Mycobacterium
LQDASK

SEQ ID NO: 523324 - protein, 5 aa, Mycobacterium
LQDDG

SEQ ID NO: 523325 - protein, 12 aa, Mycobacterium
LQDDGDALDAQA

SEQ ID NO: 523326 - protein, 9 aa, Mycobacterium
LQDEDEEPA

SEQ ID NO: 523327 - protein, 5 aa, Mycobacterium
LQDEG

SEQ ID NO: 523328 - protein, 6 aa, Mycobacterium
LQDEGA

SEQ ID NO: 523329 - protein, 15 aa, Mycobacterium
LQDGEPHLSGTARPP

SEQ ID NO: 523330 - protein, 11 aa, Mycobacterium
LQDGGTTREYD

SEQ ID NO: 523331 - protein, 8 aa, Mycobacterium
LQDGRRKV

SEQ ID NO: 523332 - protein, 4 aa, Mycobacterium
LQDH

SEQ ID NO: 523333 - protein, 6 aa, Mycobacterium
LQDKKE

SEQ ID NO: 523334 - protein, 130 aa, Mycobacterium
LQDKVDKATQALKDSATGSIKQTRGAITSTITNTAESATSAVTGGGTSAAAAEGTKDAKAKDSDSGKHHEDGSAGSPNKVKVKTPSESGGKHRAPDASGGGSSGSNAGGGSDGSGSHGGSGAGGGKHSAG

SEQ ID NO: 523335 - protein, 6 aa, Mycobacterium
LQDNGF

SEQ ID NO: 523336 - protein, 7 aa, Mycobacterium
LQDPTGR

SEQ ID NO: 523337 - protein, 4 aa, Mycobacterium
LQDQ

SEQ ID NO: 523338 - protein, 5 aa, Mycobacterium
LQDQG

SEQ ID NO: 523339 - protein, 7 aa, Mycobacterium
LQDRAGS

SEQ ID NO: 523340 - protein, 8 aa, Mycobacterium
LQDRGPGI

SEQ ID NO: 523341 - protein, 14 aa, Mycobacterium
LQDSGKKVHVRWWL

SEQ ID NO: 523342 - protein, 9 aa, Mycobacterium
LQDSGSTFD

SEQ ID NO: 523343 - protein, 12 aa, Mycobacterium
LQDSTGIRATTD

SEQ ID NO: 523344 - protein, 7 aa, Mycobacterium
LQDSTPS

SEQ ID NO: 523345 - protein, 9 aa, Mycobacterium
LQDTDSGSE

SEQ ID NO: 523346 - protein, 8 aa, Mycobacterium
LQEDKEPV

SEQ ID NO: 523347 - protein, 9 aa, Mycobacterium
LQEEGEEPA

SEQ ID NO: 523348 - protein, 21 aa, Mycobacterium
LQEESARSGRDGVTALPRPKR

SEQ ID NO: 523349 - protein, 19 aa, Mycobacterium
LQEGDDVLGPDGQPPITAQ

SEQ ID NO: 523350 - protein, 5 aa, Mycobacterium
LQEIS

SEQ ID NO: 523351 - protein, 9 aa, Mycobacterium
LQEKADEYR

SEQ ID NO: 523352 - protein, 5 aa, Mycobacterium
LQEMS

SEQ ID NO: 523353 - protein, 5 aa, Mycobacterium
LQENG

SEQ ID NO: 523354 - protein, 6 aa, Mycobacterium
LQEPDG

SEQ ID NO: 523355 - protein, 5 aa, Mycobacterium
LQEPI

SEQ ID NO: 523356 - protein, 53 aa, Mycobacterium
LQEPVGAGTAAGNTLRGTEVGYEPPSRLRSTDSSWASSSAKVNVPVGRSFLPK

SEQ ID NO: 523357 - protein, 9 aa, Mycobacterium
LQESGEEPA

SEQ ID NO: 523358 - protein, 11 aa, Mycobacterium
LQESGEQTAAL

SEQ ID NO: 523359 - protein, 5 aa, Mycobacterium
LQESS

SEQ ID NO: 523360 - protein, 6 aa, Mycobacterium
LQETGA

SEQ ID NO: 523361 - protein, 5 aa, Mycobacterium
LQGAG

SEQ ID NO: 523362 - protein, 9 aa, Mycobacterium
LQGAPRGAP

SEQ ID NO: 523363 - protein, 10 aa, Mycobacterium
LQGASGRKLG

SEQ ID NO: 523364 - protein, 12 aa, Mycobacterium
LQGDPASQRPDA

SEQ ID NO: 523365 - protein, 12 aa, Mycobacterium
LQGDPASSRPDA

SEQ ID NO: 523366 - protein, 13 aa, Mycobacterium
LQGDPDSRKPDAH

SEQ ID NO: 523367 - protein, 11 aa, Mycobacterium
LQGDPGSALPD

SEQ ID NO: 523368 - protein, 13 aa, Mycobacterium
LQGDPSSDKPDAH

SEQ ID NO: 523369 - protein, 9 aa, Mycobacterium
LQGEDPGAV

SEQ ID NO: 523370 - protein, 9 aa, Mycobacterium
LQGERPEDY

SEQ ID NO: 523371 - protein, 5 aa, Mycobacterium
LQGGD

SEQ ID NO: 523372 - protein, 5 aa, Mycobacterium
LQGGE

SEQ ID NO: 523373 - protein, 9 aa, Mycobacterium
LQGGGLGYA

SEQ ID NO: 523374 - protein, 6 aa, Mycobacterium
LQGGGV

SEQ ID NO: 523375 - protein, 13 aa, Mycobacterium
LQGGPAEKISRGD

SEQ ID NO: 523376 - protein, 6 aa, Mycobacterium
LQGGSP

SEQ ID NO: 523377 - protein, 7 aa, Mycobacterium
LQGHGYG

SEQ ID NO: 523378 - protein, 5 aa, Mycobacterium
LQGKG

SEQ ID NO: 523379 - protein, 26 aa, Mycobacterium
LQGKGYNVPDYPANPKTDDEKKIKDR

SEQ ID NO: 523380 - protein, 11 aa, Mycobacterium
LQGKPGTVKEA

SEQ ID NO: 523381 - protein, 8 aa, Mycobacterium
LQGKTRKE

SEQ ID NO: 523382 - protein, 9 aa, Mycobacterium
LQGKTRTSV

SEQ ID NO: 523383 - protein, 4 aa, Mycobacterium
LQGN

SEQ ID NO: 523384 - protein, 8 aa, Mycobacterium
LQGPATDR

SEQ ID NO: 523385 - protein, 8 aa, Mycobacterium
LQGPDDQL

SEQ ID NO: 523386 - protein, 11 aa, Mycobacterium
LQGPDEPVAAG

SEQ ID NO: 523387 - protein, 12 aa, Mycobacterium
LQGPNSSLPIPD

SEQ ID NO: 523388 - protein, 17 aa, Mycobacterium
LQGPVKSVTTAEGQTVR

SEQ ID NO: 523389 - protein, 17 aa, Mycobacterium
LQGPVKSVTTAEGRTVR

SEQ ID NO: 523390 - protein, 10 aa, Mycobacterium
LQGQTPAEQE

SEQ ID NO: 523391 - protein, 7 aa, Mycobacterium
LQGRGDR

SEQ ID NO: 523392 - protein, 10 aa, Mycobacterium
LQGRGPARAE

SEQ ID NO: 523393 - protein, 9 aa, Mycobacterium
LQGRITDTD

SEQ ID NO: 523394 - protein, 6 aa, Mycobacterium
LQGRPI

SEQ ID NO: 523395 - protein, 4 aa, Mycobacterium
LQGS

SEQ ID NO: 523396 - protein, 7 aa, Mycobacterium
LQGSPLS

SEQ ID NO: 523397 - protein, 9 aa, Mycobacterium
LQGSSGPIE

SEQ ID NO: 523398 - protein, 8 aa, Mycobacterium
LQGTAEYR

SEQ ID NO: 523399 - protein, 5 aa, Mycobacterium
LQGTE

SEQ ID NO: 523400 - protein, 6 aa, Mycobacterium
LQGTRE

SEQ ID NO: 523401 - protein, 11 aa, Mycobacterium
LQGTTGGERDL

SEQ ID NO: 523402 - protein, 13 aa, Mycobacterium
LQHGDKRSLRAAA

SEQ ID NO: 523403 - protein, 5 aa, Mycobacterium
LQHPP

SEQ ID NO: 523404 - protein, 8 aa, Mycobacterium
LQHRSGVD

SEQ ID NO: 523405 - protein, 15 aa, Mycobacterium
LQHRSNAGLTPGEPV

SEQ ID NO: 523406 - protein, 7 aa, Mycobacterium
LQIPEGG

SEQ ID NO: 523407 - protein, 20 aa, Mycobacterium
LQIPPPSKKEQRSQRRKGET

SEQ ID NO: 523408 - protein, 8 aa, Mycobacterium
LQKEDPTL

SEQ ID NO: 523409 - protein, 9 aa, Mycobacterium
LQKKSEEVL

SEQ ID NO: 523410 - protein, 7 aa, Mycobacterium
LQKPRTT

SEQ ID NO: 523411 - protein, 8 aa, Mycobacterium
LQKRSTGK

SEQ ID NO: 523412 - protein, 9 aa, Mycobacterium
LQKSGLSAA

SEQ ID NO: 523413 - protein, 8 aa, Mycobacterium
LQNEPPGD

SEQ ID NO: 523414 - protein, 5 aa, Mycobacterium
LQNKP

SEQ ID NO: 523415 - protein, 9 aa, Mycobacterium
LQNKSNEMS

SEQ ID NO: 523416 - protein, 19 aa, Mycobacterium
LQNQRGLRREQARHAGAEA

SEQ ID NO: 523417 - protein, 4 aa, Mycobacterium
LQNR

SEQ ID NO: 523418 - protein, 16 aa, Mycobacterium
LQNRDPDWADTSGPKY

SEQ ID NO: 523419 - protein, 7 aa, Mycobacterium
LQNRGSG

SEQ ID NO: 523420 - protein, 7 aa, Mycobacterium
LQNSARN

SEQ ID NO: 523421 - protein, 16 aa, Mycobacterium
LQNSARSSAGSDNSSG

SEQ ID NO: 523422 - protein, 9 aa, Mycobacterium
LQNTGSGAT

SEQ ID NO: 523423 - protein, 18 aa, Mycobacterium
LQPAAEDDDAHTPGDEPL

SEQ ID NO: 523424 - protein, 5 aa, Mycobacterium
LQPAD

SEQ ID NO: 523425 - protein, 8 aa, Mycobacterium
LQPADECR

SEQ ID NO: 523426 - protein, 10 aa, Mycobacterium
LQPAPEDIST

SEQ ID NO: 523427 - protein, 10 aa, Mycobacterium
LQPAREDVST

SEQ ID NO: 523428 - protein, 6 aa, Mycobacterium
LQPATA

SEQ ID NO: 523429 - protein, 14 aa, Mycobacterium
LQPATAEVRAGAGV

SEQ ID NO: 523430 - protein, 13 aa, Mycobacterium
LQPDAAERIGTSV

SEQ ID NO: 523431 - protein, 12 aa, Mycobacterium
LQPDGKGPINTE

SEQ ID NO: 523432 - protein, 8 aa, Mycobacterium
LQPDGRPH

SEQ ID NO: 523433 - protein, 12 aa, Mycobacterium
LQPDGTPQNSPV

SEQ ID NO: 523434 - protein, 15 aa, Mycobacterium
LQPDSAAVSETARAQ

SEQ ID NO: 523435 - protein, 12 aa, Mycobacterium
LQPDSGRVTRRS

SEQ ID NO: 523436 - protein, 10 aa, Mycobacterium
LQPDTDGRPP

SEQ ID NO: 523437 - protein, 6 aa, Mycobacterium
LQPDTR

SEQ ID NO: 523438 - protein, 4 aa, Mycobacterium
LQPE

SEQ ID NO: 523439 - protein, 5 aa, Mycobacterium
LQPEA

SEQ ID NO: 523440 - protein, 12 aa, Mycobacterium
LQPEQDAPAPPL

SEQ ID NO: 523441 - protein, 13 aa, Mycobacterium
LQPESTGAPPDLR

SEQ ID NO: 523442 - protein, 6 aa, Mycobacterium
LQPETR

SEQ ID NO: 523443 - protein, 10 aa, Mycobacterium
LQPGAEDLST

SEQ ID NO: 523444 - protein, 10 aa, Mycobacterium
LQPGAKGSRL

SEQ ID NO: 523445 - protein, 5 aa, Mycobacterium
LQPGD

SEQ ID NO: 523446 - protein, 6 aa, Mycobacterium
LQPGDD

SEQ ID NO: 523447 - protein, 11 aa, Mycobacterium
LQPGEPPWTDG

SEQ ID NO: 523448 - protein, 7 aa, Mycobacterium
LQPGEYS

SEQ ID NO: 523449 - protein, 12 aa, Mycobacterium
LQPGKRPRSSMA

SEQ ID NO: 523450 - protein, 5 aa, Mycobacterium
LQPGP

SEQ ID NO: 523451 - protein, 20 aa, Mycobacterium
LQPGPEGGPYVSDPAPTTRQ

SEQ ID NO: 523452 - protein, 6 aa, Mycobacterium
LQPGPG

SEQ ID NO: 523453 - protein, 6 aa, Mycobacterium
LQPGPI

SEQ ID NO: 523454 - protein, 6 aa, Mycobacterium
LQPGPT

SEQ ID NO: 523455 - protein, 6 aa, Mycobacterium
LQPGPV

SEQ ID NO: 523456 - protein, 8 aa, Mycobacterium
LQPGQEDD

SEQ ID NO: 523457 - protein, 10 aa, Mycobacterium
LQPGSEDLST

SEQ ID NO: 523458 - protein, 15 aa, Mycobacterium
LQPGSGDVAETARAQ

SEQ ID NO: 523459 - protein, 12 aa, Mycobacterium
LQPGSPAYRYLL

SEQ ID NO: 523460 - protein, 8 aa, Mycobacterium
LQPGTIDG

SEQ ID NO: 523461 - protein, 9 aa, Mycobacterium
LQPGTRDPL

SEQ ID NO: 523462 - protein, 11 aa, Mycobacterium
LQPGWQKQRQR

SEQ ID NO: 523463 - protein, 5 aa, Mycobacterium
LQPHS

SEQ ID NO: 523464 - protein, 6 aa, Mycobacterium
LQPKEN

SEQ ID NO: 523465 - protein, 7 aa, Mycobacterium
LQPKPEA

SEQ ID NO: 523466 - protein, 5 aa, Mycobacterium
LQPLR

SEQ ID NO: 523467 - protein, 11 aa, Mycobacterium
LQPNAGSQGEL

SEQ ID NO: 523468 - protein, 12 aa, Mycobacterium
LQPNAGSQGEYS

SEQ ID NO: 523469 - protein, 6 aa, Mycobacterium
LQPNDP

SEQ ID NO: 523470 - protein, 7 aa, Mycobacterium
LQPNDPA

SEQ ID NO: 523471 - protein, 6 aa, Mycobacterium
LQPNSR

SEQ ID NO: 523472 - protein, 4 aa, Mycobacterium
LQPQ

SEQ ID NO: 523473 - protein, 9 aa, Mycobacterium
LQPQPGFSS

SEQ ID NO: 523474 - protein, 9 aa, Mycobacterium
LQPQQGFSG

SEQ ID NO: 523475 - protein, 11 aa, Mycobacterium
LQPQSALPTGD

SEQ ID NO: 523476 - protein, 5 aa, Mycobacterium
LQPRD

SEQ ID NO: 523477 - protein, 16 aa, Mycobacterium
LQPRDVSAAKVAAGEA

SEQ ID NO: 523478 - protein, 8 aa, Mycobacterium
LQPRHGPG

SEQ ID NO: 523479 - protein, 9 aa, Mycobacterium
LQPRPAPDE

SEQ ID NO: 523480 - protein, 12 aa, Mycobacterium
LQPRPNAEPGSV

SEQ ID NO: 523481 - protein, 7 aa, Mycobacterium
LQPRTPT

SEQ ID NO: 523482 - protein, 5 aa, Mycobacterium
LQPRV

SEQ ID NO: 523483 - protein, 8 aa, Mycobacterium
LQPSDDEF

SEQ ID NO: 523484 - protein, 6 aa, Mycobacterium
LQPSDI

SEQ ID NO: 523485 - protein, 13 aa, Mycobacterium
LQPSEPPSADTHK

SEQ ID NO: 523486 - protein, 8 aa, Mycobacterium
LQPSGGLR

SEQ ID NO: 523487 - protein, 9 aa, Mycobacterium
LQPSHNPQV

SEQ ID NO: 523488 - protein, 5 aa, Mycobacterium
LQPTG

SEQ ID NO: 523489 - protein, 16 aa, Mycobacterium
LQPTPGRCCVVVAASA

SEQ ID NO: 523490 - protein, 6 aa, Mycobacterium
LQPVPA

SEQ ID NO: 523491 - protein, 23 aa, Mycobacterium
LQPVSGSASAPALRRLQRYRRLS

SEQ ID NO: 523492 - protein, 5 aa, Mycobacterium
LQPYP

SEQ ID NO: 523493 - protein, 5 aa, Mycobacterium
LQQAG

SEQ ID NO: 523494 - protein, 9 aa, Mycobacterium
LQQATPAAV

SEQ ID NO: 523495 - protein, 6 aa, Mycobacterium
LQQDPA

SEQ ID NO: 523496 - protein, 22 aa, Mycobacterium
LQQDTEAAVRTRSDLDTPAGAR

SEQ ID NO: 523497 - protein, 5 aa, Mycobacterium
LQQEA

SEQ ID NO: 523498 - protein, 9 aa, Mycobacterium
LQQERPGRR

SEQ ID NO: 523499 - protein, 18 aa, Mycobacterium
LQQPAAGSPFLNGKRRFV

SEQ ID NO: 523500 - protein, 23 aa, Mycobacterium
LQQPVGAATTASSTASSSASSSS

SEQ ID NO: 523501 - protein, 6 aa, Mycobacterium
LQQRRT

SEQ ID NO: 523502 - protein, 9 aa, Mycobacterium
LQQRTSNLP

SEQ ID NO: 523503 - protein, 4 aa, Mycobacterium
LQQS

SEQ ID NO: 523504 - protein, 5 aa, Mycobacterium
LQQSG

SEQ ID NO: 523505 - protein, 12 aa, Mycobacterium
LQQTRQRGYAVD

SEQ ID NO: 523506 - protein, 6 aa, Mycobacterium
LQQTSR

SEQ ID NO: 523507 - protein, 21 aa, Mycobacterium
LQRAGAPADEVPPSHTRSTVA

SEQ ID NO: 523508 - protein, 16 aa, Mycobacterium
LQRAGEPAVTRGGRTV

SEQ ID NO: 523509 - protein, 8 aa, Mycobacterium
LQRAKRGH

SEQ ID NO: 523510 - protein, 11 aa, Mycobacterium
LQRAQETAAPI

SEQ ID NO: 523511 - protein, 14 aa, Mycobacterium
LQRASAAIDSGAAE

SEQ ID NO: 523512 - protein, 24 aa, Mycobacterium
LQRDDDYATLGKPPCDWDDPAARE

SEQ ID NO: 523513 - protein, 16 aa, Mycobacterium
LQRDGDGGPWRIERPP

SEQ ID NO: 523514 - protein, 12 aa, Mycobacterium
LQRDHESAAAVT

SEQ ID NO: 523515 - protein, 7 aa, Mycobacterium
LQRDSDD

SEQ ID NO: 523516 - protein, 9 aa, Mycobacterium
LQRDTDDTV

SEQ ID NO: 523517 - protein, 8 aa, Mycobacterium
LQRDTNDT

SEQ ID NO: 523518 - protein, 5 aa, Mycobacterium
LQRER

SEQ ID NO: 523519 - protein, 15 aa, Mycobacterium
LQREREVAEQREATI

SEQ ID NO: 523520 - protein, 27 aa, Mycobacterium
LQRGGAAPEDADGADPTDEEDGETDDD

SEQ ID NO: 523521 - protein, 16 aa, Mycobacterium
LQRGGHTSTATTPDAP

SEQ ID NO: 523522 - protein, 5 aa, Mycobacterium
LQRGQ

SEQ ID NO: 523523 - protein, 18 aa, Mycobacterium
LQRGQAALTGPVARGDAA

SEQ ID NO: 523524 - protein, 18 aa, Mycobacterium
LQRGQSALTGPVARGDAA

SEQ ID NO: 523525 - protein, 7 aa, Mycobacterium
LQRGRNG

SEQ ID NO: 523526 - protein, 14 aa, Mycobacterium
LQRGRSGDSPGDFG

SEQ ID NO: 523527 - protein, 16 aa, Mycobacterium
LQRHSNADLASGEPIE

SEQ ID NO: 523528 - protein, 4 aa, Mycobacterium
LQRK

SEQ ID NO: 523529 - protein, 7 aa, Mycobacterium
LQRKASR

SEQ ID NO: 523530 - protein, 7 aa, Mycobacterium
LQRNPGV

SEQ ID NO: 523531 - protein, 9 aa, Mycobacterium
LQRPEEVAA

SEQ ID NO: 523532 - protein, 6 aa, Mycobacterium
LQRPPD

SEQ ID NO: 523533 - protein, 7 aa, Mycobacterium
LQRPRRG

SEQ ID NO: 523534 - protein, 10 aa, Mycobacterium
LQRPSKTRKR

SEQ ID NO: 523535 - protein, 7 aa, Mycobacterium
LQRPSTV

SEQ ID NO: 523536 - protein, 4 aa, Mycobacterium
LQRR

SEQ ID NO: 523537 - protein, 8 aa, Mycobacterium
LQRRADGQ

SEQ ID NO: 523538 - protein, 5 aa, Mycobacterium
LQRRG

SEQ ID NO: 523539 - protein, 12 aa, Mycobacterium
LQRSADYAPDAA

SEQ ID NO: 523540 - protein, 8 aa, Mycobacterium
LQRSESDL

SEQ ID NO: 523541 - protein, 12 aa, Mycobacterium
LQRSGTPAAPVR

SEQ ID NO: 523542 - protein, 7 aa, Mycobacterium
LQRSPHN

SEQ ID NO: 523543 - protein, 12 aa, Mycobacterium
LQRSSRDLSDVP

SEQ ID NO: 523544 - protein, 6 aa, Mycobacterium
LQRTAP

SEQ ID NO: 523545 - protein, 20 aa, Mycobacterium
LQRTESRGGHTRDDHPSMDS

SEQ ID NO: 523546 - protein, 18 aa, Mycobacterium
LQRTESRGGHTRDDYPEM

SEQ ID NO: 523547 - protein, 18 aa, Mycobacterium
LQRTESRGGHTRDDYPKM

SEQ ID NO: 523548 - protein, 11 aa, Mycobacterium
LQRTGRPGGQI

SEQ ID NO: 523549 - protein, 6 aa, Mycobacterium
LQRTKE

SEQ ID NO: 523550 - protein, 6 aa, Mycobacterium
LQRVPE

SEQ ID NO: 523551 - protein, 9 aa, Mycobacterium
LQRYEDKRA

SEQ ID NO: 523552 - protein, 6 aa, Mycobacterium
LQSAKD

SEQ ID NO: 523553 - protein, 6 aa, Mycobacterium
LQSAQP

SEQ ID NO: 523554 - protein, 13 aa, Mycobacterium
LQSATRAFDDGRP

SEQ ID NO: 523555 - protein, 11 aa, Mycobacterium
LQSDAPPLPAD

SEQ ID NO: 523556 - protein, 11 aa, Mycobacterium
LQSDITTETSR

SEQ ID NO: 523557 - protein, 25 aa, Mycobacterium
LQSDTSSSTGTGSGPADEPEAEKSA

SEQ ID NO: 523558 - protein, 6 aa, Mycobacterium
LQSEQA

SEQ ID NO: 523559 - protein, 9 aa, Mycobacterium
LQSERPDDY

SEQ ID NO: 523560 - protein, 5 aa, Mycobacterium
LQSEW

SEQ ID NO: 523561 - protein, 5 aa, Mycobacterium
LQSGG

SEQ ID NO: 523562 - protein, 7 aa, Mycobacterium
LQSGPAE

SEQ ID NO: 523563 - protein, 7 aa, Mycobacterium
LQSGSSW

SEQ ID NO: 523564 - protein, 6 aa, Mycobacterium
LQSHGG

SEQ ID NO: 523565 - protein, 14 aa, Mycobacterium
LQSKDAADAPLTTR

SEQ ID NO: 523566 - protein, 11 aa, Mycobacterium
LQSNARAGGAH

SEQ ID NO: 523567 - protein, 5 aa, Mycobacterium
LQSPA

SEQ ID NO: 523568 - protein, 8 aa, Mycobacterium
LQSPADIG

SEQ ID NO: 523569 - protein, 8 aa, Mycobacterium
LQSPDADG

SEQ ID NO: 523570 - protein, 9 aa, Mycobacterium
LQSPERGVG

SEQ ID NO: 523571 - protein, 5 aa, Mycobacterium
LQSPG

SEQ ID NO: 523572 - protein, 6 aa, Mycobacterium
LQSPGF

SEQ ID NO: 523573 - protein, 14 aa, Mycobacterium
LQSPPESPKGEPAV

SEQ ID NO: 523574 - protein, 7 aa, Mycobacterium
LQSPTKS

SEQ ID NO: 523575 - protein, 7 aa, Mycobacterium
LQSQPGL

SEQ ID NO: 523576 - protein, 4 aa, Mycobacterium
LQSR

SEQ ID NO: 523577 - protein, 9 aa, Mycobacterium
LQSSPTASL

SEQ ID NO: 523578 - protein, 6 aa, Mycobacterium
LQSTAA

SEQ ID NO: 523579 - protein, 10 aa, Mycobacterium
LQSTADSYQA

SEQ ID NO: 523580 - protein, 9 aa, Mycobacterium
LQSTASSYD

SEQ ID NO: 523581 - protein, 9 aa, Mycobacterium
LQSTASSYG

SEQ ID NO: 523582 - protein, 11 aa, Mycobacterium
LQSTATSYAAT

SEQ ID NO: 523583 - protein, 10 aa, Mycobacterium
LQSTQGLTEP

SEQ ID NO: 523584 - protein, 7 aa, Mycobacterium
LQSTSQG

SEQ ID NO: 523585 - protein, 4 aa, Mycobacterium
LQSV

SEQ ID NO: 523586 - protein, 7 aa, Mycobacterium
LQSWPSA

SEQ ID NO: 523587 - protein, 7 aa, Mycobacterium
LQTAATN

SEQ ID NO: 523588 - protein, 6 aa, Mycobacterium
LQTAQP

SEQ ID NO: 523589 - protein, 4 aa, Mycobacterium
LQTD

SEQ ID NO: 523590 - protein, 8 aa, Mycobacterium
LQTDTGEH

SEQ ID NO: 523591 - protein, 10 aa, Mycobacterium
LQTGASLQQR

SEQ ID NO: 523592 - protein, 12 aa, Mycobacterium
LQTGGADLAQQR

SEQ ID NO: 523593 - protein, 6 aa, Mycobacterium
LQTGGT

SEQ ID NO: 523594 - protein, 17 aa, Mycobacterium
LQTGPTGVRPGTAGLRP

SEQ ID NO: 523595 - protein, 9 aa, Mycobacterium
LQTGSEGSG

SEQ ID NO: 523596 - protein, 15 aa, Mycobacterium
LQTGSRAVAETARAQ

SEQ ID NO: 523597 - protein, 4 aa, Mycobacterium
LQTH

SEQ ID NO: 523598 - protein, 5 aa, Mycobacterium
LQTHG

SEQ ID NO: 523599 - protein, 10 aa, Mycobacterium
LQTPAGRQHP

SEQ ID NO: 523600 - protein, 7 aa, Mycobacterium
LQTPESD

SEQ ID NO: 523601 - protein, 5 aa, Mycobacterium
LQTPK

SEQ ID NO: 523602 - protein, 20 aa, Mycobacterium
LQTRAGTLTPTAGSHPRSAG

SEQ ID NO: 523603 - protein, 6 aa, Mycobacterium
LQTRGS

SEQ ID NO: 523604 - protein, 8 aa, Mycobacterium
LQTRRDRL

SEQ ID NO: 523605 - protein, 10 aa, Mycobacterium
LQTSAPASQW

SEQ ID NO: 523606 - protein, 7 aa, Mycobacterium
LQTSAPV

SEQ ID NO: 523607 - protein, 10 aa, Mycobacterium
LQTSASASNW

SEQ ID NO: 523608 - protein, 7 aa, Mycobacterium
LQTSASL

SEQ ID NO: 523609 - protein, 23 aa, Mycobacterium
LQTSDDPDPEEQRELEARAAGLK

SEQ ID NO: 523610 - protein, 17 aa, Mycobacterium
LQTSEQVDADLRNPHER

SEQ ID NO: 523611 - protein, 11 aa, Mycobacterium
LQTSGTPGDIA

SEQ ID NO: 523612 - protein, 14 aa, Mycobacterium
LQTSRAAAKLGEGW

SEQ ID NO: 523613 - protein, 4 aa, Mycobacterium
LQTT

SEQ ID NO: 523614 - protein, 5 aa, Mycobacterium
LQTTA

SEQ ID NO: 523615 - protein, 6 aa, Mycobacterium
LQTTAE

SEQ ID NO: 523616 - protein, 8 aa, Mycobacterium
LQTTEACG

SEQ ID NO: 523617 - protein, 12 aa, Mycobacterium
LQTTGASYSSTI

SEQ ID NO: 523618 - protein, 10 aa, Mycobacterium
LQTTGEGGIS

SEQ ID NO: 523619 - protein, 9 aa, Mycobacterium
LQTTGSGST

SEQ ID NO: 523620 - protein, 8 aa, Mycobacterium
LQTTGYNK

SEQ ID NO: 523621 - protein, 5 aa, Mycobacterium
LQTTR

SEQ ID NO: 523622 - protein, 12 aa, Mycobacterium
LQVGPGNEPGVQ

SEQ ID NO: 523623 - protein, 5 aa, Mycobacterium
LQVPD

SEQ ID NO: 523624 - protein, 6 aa, Mycobacterium
LQVPDS

SEQ ID NO: 523625 - protein, 10 aa, Mycobacterium
LQVTEQERQE

SEQ ID NO: 523626 - protein, 8 aa, Mycobacterium
LQYPAPNK

SEQ ID NO: 523627 - protein, 5 aa, Mycobacterium
LQYSG

SEQ ID NO: 523628 - protein, 15 aa, Mycobacterium
LRAAAEDSKKYFARR

SEQ ID NO: 523629 - protein, 6 aa, Mycobacterium
LRAADG

SEQ ID NO: 523630 - protein, 9 aa, Mycobacterium
LRAAGTPDD

SEQ ID NO: 523631 - protein, 19 aa, Mycobacterium
LRAATDPAAQGGQYYGPSG

SEQ ID NO: 523632 - protein, 13 aa, Mycobacterium
LRAATKEARRLRP

SEQ ID NO: 523633 - protein, 8 aa, Mycobacterium
LRADEPDL

SEQ ID NO: 523634 - protein, 8 aa, Mycobacterium
LRADGGRR

SEQ ID NO: 523635 - protein, 10 aa, Mycobacterium
LRADGGTAVA

SEQ ID NO: 523636 - protein, 10 aa, Mycobacterium
LRADGKEGHL

SEQ ID NO: 523637 - protein, 6 aa, Mycobacterium
LRADGR

SEQ ID NO: 523638 - protein, 8 aa, Mycobacterium
LRADGRPR

SEQ ID NO: 523639 - protein, 10 aa, Mycobacterium
LRADGYDPAS

SEQ ID NO: 523640 - protein, 6 aa, Mycobacterium
LRADRE

SEQ ID NO: 523641 - protein, 9 aa, Mycobacterium
LRAEAADTA

SEQ ID NO: 523642 - protein, 8 aa, Mycobacterium
LRAEGGPY

SEQ ID NO: 523643 - protein, 8 aa, Mycobacterium
LRAERDKL

SEQ ID NO: 523644 - protein, 9 aa, Mycobacterium
LRAESDTDA

SEQ ID NO: 523645 - protein, 6 aa, Mycobacterium
LRAGAD

SEQ ID NO: 523646 - protein, 6 aa, Mycobacterium
LRAGAV

SEQ ID NO: 523647 - protein, 9 aa, Mycobacterium
LRAGGAGIP

SEQ ID NO: 523648 - protein, 7 aa, Mycobacterium
LRAGGAR

SEQ ID NO: 523649 - protein, 23 aa, Mycobacterium
LRAGGGDPDSATVRPESEVEGYL

SEQ ID NO: 523650 - protein, 14 aa, Mycobacterium
LRAGKVANDFPDAT

SEQ ID NO: 523651 - protein, 11 aa, Mycobacterium
LRAGLSGAHPV

SEQ ID NO: 523652 - protein, 12 aa, Mycobacterium
LRAGRTERDVRN

SEQ ID NO: 523653 - protein, 6 aa, Mycobacterium
LRANSA

SEQ ID NO: 523654 - protein, 10 aa, Mycobacterium
LRANSSTERA

SEQ ID NO: 523655 - protein, 7 aa, Mycobacterium
LRAPADS

SEQ ID NO: 523656 - protein, 17 aa, Mycobacterium
LRAPAQARMRDGGDIDR

SEQ ID NO: 523657 - protein, 14 aa, Mycobacterium
LRAPDGLGDAVGRS

SEQ ID NO: 523658 - protein, 7 aa, Mycobacterium
LRAPGAS

SEQ ID NO: 523659 - protein, 10 aa, Mycobacterium
LRAPGDPVTR

SEQ ID NO: 523660 - protein, 8 aa, Mycobacterium
LRAPGDRL

SEQ ID NO: 523661 - protein, 6 aa, Mycobacterium
LRAPNA

SEQ ID NO: 523662 - protein, 16 aa, Mycobacterium
LRAPPEPAGNGVTTRY

SEQ ID NO: 523663 - protein, 7 aa, Mycobacterium
LRAPQTP

SEQ ID NO: 523664 - protein, 11 aa, Mycobacterium
LRAPSPDALTD

SEQ ID NO: 523665 - protein, 9 aa, Mycobacterium
LRAQENARL

SEQ ID NO: 523666 - protein, 5 aa, Mycobacterium
LRAQG

SEQ ID NO: 523667 - protein, 12 aa, Mycobacterium
LRAQGRITKAEG

SEQ ID NO: 523668 - protein, 5 aa, Mycobacterium
LRARG

SEQ ID NO: 523669 - protein, 5 aa, Mycobacterium
LRARP

SEQ ID NO: 523670 - protein, 7 aa, Mycobacterium
LRARRDR

SEQ ID NO: 523671 - protein, 4 aa, Mycobacterium
LRAS

SEQ ID NO: 523672 - protein, 12 aa, Mycobacterium
LRASDDESVPPA

SEQ ID NO: 523673 - protein, 10 aa, Mycobacterium
LRASDTVTGR

SEQ ID NO: 523674 - protein, 8 aa, Mycobacterium
LRASGAQT

SEQ ID NO: 523675 - protein, 8 aa, Mycobacterium
LRASPKEV

SEQ ID NO: 523676 - protein, 5 aa, Mycobacterium
LRASR

SEQ ID NO: 523677 - protein, 14 aa, Mycobacterium
LRASRTGGGEIPRY

SEQ ID NO: 523678 - protein, 8 aa, Mycobacterium
LRASTRKA

SEQ ID NO: 523679 - protein, 12 aa, Mycobacterium
LRATEGKDLGDL

SEQ ID NO: 523680 - protein, 5 aa, Mycobacterium
LRATQ

SEQ ID NO: 523681 - protein, 6 aa, Mycobacterium
LRATQD

SEQ ID NO: 523682 - protein, 6 aa, Mycobacterium
LRATSD

SEQ ID NO: 523683 - protein, 9 aa, Mycobacterium
LRDAADDPE

SEQ ID NO: 523684 - protein, 7 aa, Mycobacterium
LRDAGAG

SEQ ID NO: 523685 - protein, 9 aa, Mycobacterium
LRDAGYTEL

SEQ ID NO: 523686 - protein, 9 aa, Mycobacterium
LRDAKGRTA

SEQ ID NO: 523687 - protein, 8 aa, Mycobacterium
LRDAPDEK

SEQ ID NO: 523688 - protein, 10 aa, Mycobacterium
LRDASSDPAV

SEQ ID NO: 523689 - protein, 9 aa, Mycobacterium
LRDDADPRH

SEQ ID NO: 523690 - protein, 13 aa, Mycobacterium
LRDDAGKARRSAV

SEQ ID NO: 523691 - protein, 11 aa, Mycobacterium
LRDDDPASAVG

SEQ ID NO: 523692 - protein, 18 aa, Mycobacterium
LRDDDPGSATGVSTIGSS

SEQ ID NO: 523693 - protein, 18 aa, Mycobacterium
LRDDDPSSATGVSTIGSS

SEQ ID NO: 523694 - protein, 10 aa, Mycobacterium
LRDDDPSTAI

SEQ ID NO: 523695 - protein, 5 aa, Mycobacterium
LRDDE

SEQ ID NO: 523696 - protein, 8 aa, Mycobacterium
LRDDGEPH

SEQ ID NO: 523697 - protein, 8 aa, Mycobacterium
LRDDGSTT

SEQ ID NO: 523698 - protein, 7 aa, Mycobacterium
LRDDGYH

SEQ ID NO: 523699 - protein, 9 aa, Mycobacterium
LRDDPNELR

SEQ ID NO: 523700 - protein, 12 aa, Mycobacterium
LRDDRKDTFERR

SEQ ID NO: 523701 - protein, 7 aa, Mycobacterium
LRDDRSA

SEQ ID NO: 523702 - protein, 11 aa, Mycobacterium
LRDEARGAGMR

SEQ ID NO: 523703 - protein, 16 aa, Mycobacterium
LRDEDIDADHAQAAAD

SEQ ID NO: 523704 - protein, 10 aa, Mycobacterium
LRDEGASNDR

SEQ ID NO: 523705 - protein, 8 aa, Mycobacterium
LRDEGRDA

SEQ ID NO: 523706 - protein, 6 aa, Mycobacterium
LRDEGT

SEQ ID NO: 523707 - protein, 9 aa, Mycobacterium
LRDEQQSQF

SEQ ID NO: 523708 - protein, 10 aa, Mycobacterium
LRDGDGQRAL

SEQ ID NO: 523709 - protein, 12 aa, Mycobacterium
LRDGDRARAATA

SEQ ID NO: 523710 - protein, 7 aa, Mycobacterium
LRDGEGK

SEQ ID NO: 523711 - protein, 6 aa, Mycobacterium
LRDGEP

SEQ ID NO: 523712 - protein, 13 aa, Mycobacterium
LRDGEPSRWNSAA

SEQ ID NO: 523713 - protein, 10 aa, Mycobacterium
LRDGGPAPVR

SEQ ID NO: 523714 - protein, 9 aa, Mycobacterium
LRDGGSAVQ

SEQ ID NO: 523715 - protein, 17 aa, Mycobacterium
LRDGGTISSRRVTASQS

SEQ ID NO: 523716 - protein, 6 aa, Mycobacterium
LRDGGY

SEQ ID NO: 523717 - protein, 10 aa, Mycobacterium
LRDGPGGLPP

SEQ ID NO: 523718 - protein, 8 aa, Mycobacterium
LRDGRGPA

SEQ ID NO: 523719 - protein, 7 aa, Mycobacterium
LRDGRPV

SEQ ID NO: 523720 - protein, 11 aa, Mycobacterium
LRDGRTVDDTS

SEQ ID NO: 523721 - protein, 11 aa, Mycobacterium
LRDGSDTAQVA

SEQ ID NO: 523722 - protein, 8 aa, Mycobacterium
LRDGSGVK

SEQ ID NO: 523723 - protein, 6 aa, Mycobacterium
LRDGSV

SEQ ID NO: 523724 - protein, 7 aa, Mycobacterium
LRDGSVE

SEQ ID NO: 523725 - protein, 14 aa, Mycobacterium
LRDGTAEGADPGAL

SEQ ID NO: 523726 - protein, 11 aa, Mycobacterium
LRDGTATDDDV

SEQ ID NO: 523727 - protein, 7 aa, Mycobacterium
LRDKMGD

SEQ ID NO: 523728 - protein, 6 aa, Mycobacterium
LRDKRA

SEQ ID NO: 523729 - protein, 11 aa, Mycobacterium
LRDKRDKRMPR

SEQ ID NO: 523730 - protein, 4 aa, Mycobacterium
LRDM

SEQ ID NO: 523731 - protein, 4 aa, Mycobacterium
LRDN

SEQ ID NO: 523732 - protein, 15 aa, Mycobacterium
LRDNGLDPVETPDEY

SEQ ID NO: 523733 - protein, 9 aa, Mycobacterium
LRDNPDQLR

SEQ ID NO: 523734 - protein, 6 aa, Mycobacterium
LRDNQA

SEQ ID NO: 523735 - protein, 10 aa, Mycobacterium
LRDPAATTAL

SEQ ID NO: 523736 - protein, 9 aa, Mycobacterium
LRDPAPERL

SEQ ID NO: 523737 - protein, 10 aa, Mycobacterium
LRDPDSPRRI

SEQ ID NO: 523738 - protein, 7 aa, Mycobacterium
LRDPEGL

SEQ ID NO: 523739 - protein, 14 aa, Mycobacterium
LRDPGARSDPEGAQ

SEQ ID NO: 523740 - protein, 9 aa, Mycobacterium
LRDPGRAGI

SEQ ID NO: 523741 - protein, 8 aa, Mycobacterium
LRDPQPRR

SEQ ID NO: 523742 - protein, 6 aa, Mycobacterium
LRDPST

SEQ ID NO: 523743 - protein, 6 aa, Mycobacterium
LRDPTE

SEQ ID NO: 523744 - protein, 4 aa, Mycobacterium
LRDQ

SEQ ID NO: 523745 - protein, 15 aa, Mycobacterium
LRDQQAAADRAKAGV

SEQ ID NO: 523746 - protein, 14 aa, Mycobacterium
LRDQQAAADRAKAS

SEQ ID NO: 523747 - protein, 6 aa, Mycobacterium
LRDRAA

SEQ ID NO: 523748 - protein, 10 aa, Mycobacterium
LRDRAPEERH

SEQ ID NO: 523749 - protein, 9 aa, Mycobacterium
LRDREGGRL

SEQ ID NO: 523750 - protein, 11 aa, Mycobacterium
LRDSAATPEDV

SEQ ID NO: 523751 - protein, 5 aa, Mycobacterium
LRDSD

SEQ ID NO: 523752 - protein, 10 aa, Mycobacterium
LRDSDAGRQV

SEQ ID NO: 523753 - protein, 6 aa, Mycobacterium
LRDSEP

SEQ ID NO: 523754 - protein, 7 aa, Mycobacterium
LRDSGAN

SEQ ID NO: 523755 - protein, 10 aa, Mycobacterium
LRDSGYRGTV

SEQ ID NO: 523756 - protein, 5 aa, Mycobacterium
LRDSP

SEQ ID NO: 523757 - protein, 9 aa, Mycobacterium
LRDSRPTAV

SEQ ID NO: 523758 - protein, 7 aa, Mycobacterium
LRDSTAG

SEQ ID NO: 523759 - protein, 8 aa, Mycobacterium
LRDSTAGR

SEQ ID NO: 523760 - protein, 8 aa, Mycobacterium
LRDTANPT

SEQ ID NO: 523761 - protein, 12 aa, Mycobacterium
LRDTGSAVRVAN

SEQ ID NO: 523762 - protein, 6 aa, Mycobacterium
LRDTPA

SEQ ID NO: 523763 - protein, 15 aa, Mycobacterium
LRDTSDGQQYDETDG

SEQ ID NO: 523764 - protein, 8 aa, Mycobacterium
LRDTSTSA

SEQ ID NO: 523765 - protein, 8 aa, Mycobacterium
LRDTSTTA

SEQ ID NO: 523766 - protein, 7 aa, Mycobacterium
LRDTTSA

SEQ ID NO: 523767 - protein, 4 aa, Mycobacterium
LRDV

SEQ ID NO: 523768 - protein, 4 aa, Mycobacterium
LREA

SEQ ID NO: 523769 - protein, 17 aa, Mycobacterium
LREAADDLESMRDGQHD

SEQ ID NO: 523770 - protein, 8 aa, Mycobacterium
LREAAEPQ

SEQ ID NO: 523771 - protein, 11 aa, Mycobacterium
LREADGTTPLS

SEQ ID NO: 523772 - protein, 9 aa, Mycobacterium
LREAEGSVA

SEQ ID NO: 523773 - protein, 7 aa, Mycobacterium
LREAGGG

SEQ ID NO: 523774 - protein, 7 aa, Mycobacterium
LREAPTL

SEQ ID NO: 523775 - protein, 7 aa, Mycobacterium
LREAQDL

SEQ ID NO: 523776 - protein, 4 aa, Mycobacterium
LRED

SEQ ID NO: 523777 - protein, 7 aa, Mycobacterium
LREDPEG

SEQ ID NO: 523778 - protein, 9 aa, Mycobacterium
LREDRPPDL

SEQ ID NO: 523779 - protein, 9 aa, Mycobacterium
LREDSGKVR

SEQ ID NO: 523780 - protein, 4 aa, Mycobacterium
LREE

SEQ ID NO: 523781 - protein, 9 aa, Mycobacterium
LREEADPVT

SEQ ID NO: 523782 - protein, 7 aa, Mycobacterium
LREEAGD

SEQ ID NO: 523783 - protein, 7 aa, Mycobacterium
LREEGES

SEQ ID NO: 523784 - protein, 8 aa, Mycobacterium
LREEPDPI

SEQ ID NO: 523785 - protein, 7 aa, Mycobacterium
LREETGL

SEQ ID NO: 523786 - protein, 4 aa, Mycobacterium
LREG

SEQ ID NO: 523787 - protein, 8 aa, Mycobacterium
LREGADPR

SEQ ID NO: 523788 - protein, 5 aa, Mycobacterium
LREGD

SEQ ID NO: 523789 - protein, 27 aa, Mycobacterium
LREGDEMREGDPSRWNSAADKRWTPLR

SEQ ID NO: 523790 - protein, 6 aa, Mycobacterium
LREGDR

SEQ ID NO: 523791 - protein, 7 aa, Mycobacterium
LREGGGD

SEQ ID NO: 523792 - protein, 5 aa, Mycobacterium
LREGP

SEQ ID NO: 523793 - protein, 19 aa, Mycobacterium
LREGPQSLARATAEVCRAL

SEQ ID NO: 523794 - protein, 5 aa, Mycobacterium
LREGS

SEQ ID NO: 523795 - protein, 9 aa, Mycobacterium
LREGSRDAR

SEQ ID NO: 523796 - protein, 14 aa, Mycobacterium
LREGTGSSARDAAG

SEQ ID NO: 523797 - protein, 6 aa, Mycobacterium
LREMPG

SEQ ID NO: 523798 - protein, 8 aa, Mycobacterium
LRENASDM

SEQ ID NO: 523799 - protein, 6 aa, Mycobacterium
LRENTT

SEQ ID NO: 523800 - protein, 5 aa, Mycobacterium
LREPD

SEQ ID NO: 523801 - protein, 7 aa, Mycobacterium
LREPDGP

SEQ ID NO: 523802 - protein, 10 aa, Mycobacterium
LREPEPPWLP

SEQ ID NO: 523803 - protein, 6 aa, Mycobacterium
LREPER

SEQ ID NO: 523804 - protein, 15 aa, Mycobacterium
LREPGDTGDVPTGRA

SEQ ID NO: 523805 - protein, 23 aa, Mycobacterium
LREPGPRVADAAAADADAGADSG

SEQ ID NO: 523806 - protein, 5 aa, Mycobacterium
LREPH

SEQ ID NO: 523807 - protein, 5 aa, Mycobacterium
LREPS

SEQ ID NO: 523808 - protein, 5 aa, Mycobacterium
LREPV

SEQ ID NO: 523809 - protein, 8 aa, Mycobacterium
LREQRDDA

SEQ ID NO: 523810 - protein, 11 aa, Mycobacterium
LREREKAATRE

SEQ ID NO: 523811 - protein, 15 aa, Mycobacterium
LRERGLDPVETPEEY

SEQ ID NO: 523812 - protein, 10 aa, Mycobacterium
LRERKKAATR

SEQ ID NO: 523813 - protein, 18 aa, Mycobacterium
LRERTDARVKAALAAVPP

SEQ ID NO: 523814 - protein, 6 aa, Mycobacterium
LRERTG

SEQ ID NO: 523815 - protein, 6 aa, Mycobacterium
LRERTQ

SEQ ID NO: 523816 - protein, 8 aa, Mycobacterium
LRERTRPI

SEQ ID NO: 523817 - protein, 8 aa, Mycobacterium
LRESAPDV

SEQ ID NO: 523818 - protein, 17 aa, Mycobacterium
LRESDPQFRAAQPDPAV

SEQ ID NO: 523819 - protein, 6 aa, Mycobacterium
LRESGD

SEQ ID NO: 523820 - protein, 23 aa, Mycobacterium
LRESGGDPREAEVRPPDEVEGYL

SEQ ID NO: 523821 - protein, 6 aa, Mycobacterium
LRESHP

SEQ ID NO: 523822 - protein, 10 aa, Mycobacterium
LRESKDTMGP

SEQ ID NO: 523823 - protein, 7 aa, Mycobacterium
LRESKGV

SEQ ID NO: 523824 - protein, 10 aa, Mycobacterium
LRESRDQQAV

SEQ ID NO: 523825 - protein, 23 aa, Mycobacterium
LRETGGDPREAHLRPGGQVEGYL

SEQ ID NO: 523826 - protein, 23 aa, Mycobacterium
LRETGGDPREASVRPAGQVEGYS

SEQ ID NO: 523827 - protein, 23 aa, Mycobacterium
LRETGQDPREAEIRPAGEVENYK

SEQ ID NO: 523828 - protein, 10 aa, Mycobacterium
LRETGSGGVE

SEQ ID NO: 523829 - protein, 6 aa, Mycobacterium
LRETMG

SEQ ID NO: 523830 - protein, 12 aa, Mycobacterium
LRGAAESARDVA

SEQ ID NO: 523831 - protein, 11 aa, Mycobacterium
LRGADDPGFDS

SEQ ID NO: 523832 - protein, 11 aa, Mycobacterium
LRGAEAKRARA

SEQ ID NO: 523833 - protein, 10 aa, Mycobacterium
LRGAENVGHH

SEQ ID NO: 523834 - protein, 7 aa, Mycobacterium
LRGAGRD

SEQ ID NO: 523835 - protein, 11 aa, Mycobacterium
LRGASAARAQT

SEQ ID NO: 523836 - protein, 10 aa, Mycobacterium
LRGDAENARR

SEQ ID NO: 523837 - protein, 7 aa, Mycobacterium
LRGDDLT

SEQ ID NO: 523838 - protein, 9 aa, Mycobacterium
LRGDEASAQ

SEQ ID NO: 523839 - protein, 23 aa, Mycobacterium
LRGDEDEEEEEDSPDAAAAEPID

SEQ ID NO: 523840 - protein, 9 aa, Mycobacterium
LRGDEEIGQ

SEQ ID NO: 523841 - protein, 21 aa, Mycobacterium
LRGDPGPFGNGTGAELGTGRS

SEQ ID NO: 523842 - protein, 6 aa, Mycobacterium
LRGDRA

SEQ ID NO: 523843 - protein, 9 aa, Mycobacterium
LRGDSPEPV

SEQ ID NO: 523844 - protein, 8 aa, Mycobacterium
LRGDTEGA

SEQ ID NO: 523845 - protein, 7 aa, Mycobacterium
LRGDTQR

SEQ ID NO: 523846 - protein, 4 aa, Mycobacterium
LRGE

SEQ ID NO: 523847 - protein, 12 aa, Mycobacterium
LRGEADARQVAG

SEQ ID NO: 523848 - protein, 10 aa, Mycobacterium
LRGEAGALQV

SEQ ID NO: 523849 - protein, 12 aa, Mycobacterium
LRGEAGARQVAG

SEQ ID NO: 523850 - protein, 12 aa, Mycobacterium
LRGEAGDRQVAD

SEQ ID NO: 523851 - protein, 12 aa, Mycobacterium
LRGEAGDRQVAG

SEQ ID NO: 523852 - protein, 11 aa, Mycobacterium
LRGEAGERQVA

SEQ ID NO: 523853 - protein, 12 aa, Mycobacterium
LRGEAGERQVED

SEQ ID NO: 523854 - protein, 15 aa, Mycobacterium
LRGEAGPLQVEGART

SEQ ID NO: 523855 - protein, 6 aa, Mycobacterium
LRGEGA

SEQ ID NO: 523856 - protein, 23 aa, Mycobacterium
LRGEPADYPPPGGYRGGYPDEAR

SEQ ID NO: 523857 - protein, 9 aa, Mycobacterium
LRGGADAAS

SEQ ID NO: 523858 - protein, 8 aa, Mycobacterium
LRGGGAQA

SEQ ID NO: 523859 - protein, 5 aa, Mycobacterium
LRGGK

SEQ ID NO: 523860 - protein, 10 aa, Mycobacterium
LRGGKPEQLR

SEQ ID NO: 523861 - protein, 10 aa, Mycobacterium
LRGGKTGLRA

SEQ ID NO: 523862 - protein, 7 aa, Mycobacterium
LRGGPAP

SEQ ID NO: 523863 - protein, 19 aa, Mycobacterium
LRGGPSGTPAGHPAANLAL

SEQ ID NO: 523864 - protein, 14 aa, Mycobacterium
LRGGPTRLKASGKD

SEQ ID NO: 523865 - protein, 11 aa, Mycobacterium
LRGGQDGRDIE

SEQ ID NO: 523866 - protein, 16 aa, Mycobacterium
LRGGRPPLVIDSDGTV

SEQ ID NO: 523867 - protein, 6 aa, Mycobacterium
LRGGSG

SEQ ID NO: 523868 - protein, 8 aa, Mycobacterium
LRGGTADL

SEQ ID NO: 523869 - protein, 14 aa, Mycobacterium
LRGGYQQTAFPDDR

SEQ ID NO: 523870 - protein, 4 aa, Mycobacterium
LRGK

SEQ ID NO: 523871 - protein, 11 aa, Mycobacterium
LRGKGRLTDAD

SEQ ID NO: 523872 - protein, 17 aa, Mycobacterium
LRGKGRLTDADIEATTR

SEQ ID NO: 523873 - protein, 6 aa, Mycobacterium
LRGKKV

SEQ ID NO: 523874 - protein, 6 aa, Mycobacterium
LRGKPQ

SEQ ID NO: 523875 - protein, 10 aa, Mycobacterium
LRGKSPYGAP

SEQ ID NO: 523876 - protein, 4 aa, Mycobacterium
LRGN

SEQ ID NO: 523877 - protein, 7 aa, Mycobacterium
LRGNPRQ

SEQ ID NO: 523878 - protein, 5 aa, Mycobacterium
LRGNV

SEQ ID NO: 523879 - protein, 7 aa, Mycobacterium
LRGPAAA

SEQ ID NO: 523880 - protein, 10 aa, Mycobacterium
LRGPAADARI

SEQ ID NO: 523881 - protein, 6 aa, Mycobacterium
LRGPDR

SEQ ID NO: 523882 - protein, 5 aa, Mycobacterium
LRGPG

SEQ ID NO: 523883 - protein, 11 aa, Mycobacterium
LRGPGDSRPTL

SEQ ID NO: 523884 - protein, 6 aa, Mycobacterium
LRGPGL

SEQ ID NO: 523885 - protein, 8 aa, Mycobacterium
LRGPGVTA

SEQ ID NO: 523886 - protein, 11 aa, Mycobacterium
LRGPLRGGPDG

SEQ ID NO: 523887 - protein, 10 aa, Mycobacterium
LRGPRAQARI

SEQ ID NO: 523888 - protein, 11 aa, Mycobacterium
LRGPRPAPRLG

SEQ ID NO: 523889 - protein, 10 aa, Mycobacterium
LRGPSSGFQT

SEQ ID NO: 523890 - protein, 8 aa, Mycobacterium
LRGPTGRT

SEQ ID NO: 523891 - protein, 4 aa, Mycobacterium
LRGQ

SEQ ID NO: 523892 - protein, 10 aa, Mycobacterium
LRGQAGDLQV

SEQ ID NO: 523893 - protein, 9 aa, Mycobacterium
LRGQAGELQ

SEQ ID NO: 523894 - protein, 6 aa, Mycobacterium
LRGQGF

SEQ ID NO: 523895 - protein, 5 aa, Mycobacterium
LRGQY

SEQ ID NO: 523896 - protein, 4 aa, Mycobacterium
LRGR

SEQ ID NO: 523897 - protein, 14 aa, Mycobacterium
LRGRAGRQGDPGSS

SEQ ID NO: 523898 - protein, 13 aa, Mycobacterium
LRGRDQPTVAAPR

SEQ ID NO: 523899 - protein, 13 aa, Mycobacterium
LRGRGAESAAPLG

SEQ ID NO: 523900 - protein, 5 aa, Mycobacterium
LRGRP

SEQ ID NO: 523901 - protein, 5 aa, Mycobacterium
LRGRQ

SEQ ID NO: 523902 - protein, 26 aa, Mycobacterium
LRGRQGARSTTALPGPDRTGSATTGL

SEQ ID NO: 523903 - protein, 7 aa, Mycobacterium
LRGRRGI

SEQ ID NO: 523904 - protein, 6 aa, Mycobacterium
LRGRSG

SEQ ID NO: 523905 - protein, 10 aa, Mycobacterium
LRGRSVEGTG

SEQ ID NO: 523906 - protein, 6 aa, Mycobacterium
LRGRTD

SEQ ID NO: 523907 - protein, 7 aa, Mycobacterium
LRGSATG

SEQ ID NO: 523908 - protein, 5 aa, Mycobacterium
LRGSD

SEQ ID NO: 523909 - protein, 9 aa, Mycobacterium
LRGSDGSPL

SEQ ID NO: 523910 - protein, 7 aa, Mycobacterium
LRGSGRP

SEQ ID NO: 523911 - protein, 9 aa, Mycobacterium
LRGSGSNTL

SEQ ID NO: 523912 - protein, 6 aa, Mycobacterium
LRGSLA

SEQ ID NO: 523913 - protein, 6 aa, Mycobacterium
LRGSPA

SEQ ID NO: 523914 - protein, 17 aa, Mycobacterium
LRGSPTNYAVPATSSGL

SEQ ID NO: 523915 - protein, 9 aa, Mycobacterium
LRGSRTPDE

SEQ ID NO: 523916 - protein, 9 aa, Mycobacterium
LRGSRTPDR

SEQ ID NO: 523917 - protein, 20 aa, Mycobacterium
LRGSTAGVAGATAAGIPASA

SEQ ID NO: 523918 - protein, 4 aa, Mycobacterium
LRGT

SEQ ID NO: 523919 - protein, 8 aa, Mycobacterium
LRGTARAT

SEQ ID NO: 523920 - protein, 6 aa, Mycobacterium
LRGTDS

SEQ ID NO: 523921 - protein, 6 aa, Mycobacterium
LRGTED

SEQ ID NO: 523922 - protein, 5 aa, Mycobacterium
LRGTG

SEQ ID NO: 523923 - protein, 8 aa, Mycobacterium
LRGTGPAA

SEQ ID NO: 523924 - protein, 8 aa, Mycobacterium
LRGTGRDC

SEQ ID NO: 523925 - protein, 7 aa, Mycobacterium
LRGTGRS

SEQ ID NO: 523926 - protein, 6 aa, Mycobacterium
LRGTGS

SEQ ID NO: 523927 - protein, 13 aa, Mycobacterium
LRGTQNVYPVDVS

SEQ ID NO: 523928 - protein, 5 aa, Mycobacterium
LRGTR

SEQ ID NO: 523929 - protein, 15 aa, Mycobacterium
LRGTRKAEEAAESAR

SEQ ID NO: 523930 - protein, 15 aa, Mycobacterium
LRGTRRAEEAAESAR

SEQ ID NO: 523931 - protein, 8 aa, Mycobacterium
LRGTSSND

SEQ ID NO: 523932 - protein, 20 aa, Mycobacterium
LRGVPTRAVKSPADLDELAN

SEQ ID NO: 523933 - protein, 6 aa, Mycobacterium
LRHAPG

SEQ ID NO: 523934 - protein, 12 aa, Mycobacterium
LRHGASSALVVR

SEQ ID NO: 523935 - protein, 7 aa, Mycobacterium
LRHPDRE

SEQ ID NO: 523936 - protein, 31 aa, Mycobacterium
LRHPRGRQDTRGRGDGAPHQPAPGDVGAQHP

SEQ ID NO: 523937 - protein, 9 aa, Mycobacterium
LRHSGGNID

SEQ ID NO: 523938 - protein, 6 aa, Mycobacterium
LRKAMG

SEQ ID NO: 523939 - protein, 8 aa, Mycobacterium
LRKANAQH

SEQ ID NO: 523940 - protein, 6 aa, Mycobacterium
LRKGAA

SEQ ID NO: 523941 - protein, 5 aa, Mycobacterium
LRKGD

SEQ ID NO: 523942 - protein, 12 aa, Mycobacterium
LRKGERPAGYPA

SEQ ID NO: 523943 - protein, 8 aa, Mycobacterium
LRKPGPRQ

SEQ ID NO: 523944 - protein, 9 aa, Mycobacterium
LRKPGPRQA

SEQ ID NO: 523945 - protein, 16 aa, Mycobacterium
LRKPRARVGARSGCGR

SEQ ID NO: 523946 - protein, 6 aa, Mycobacterium
LRKPST

SEQ ID NO: 523947 - protein, 4 aa, Mycobacterium
LRKR

SEQ ID NO: 523948 - protein, 10 aa, Mycobacterium
LRKRGSDQRP

SEQ ID NO: 523949 - protein, 7 aa, Mycobacterium
LRKRSPR

SEQ ID NO: 523950 - protein, 4 aa, Mycobacterium
LRKS

SEQ ID NO: 523951 - protein, 9 aa, Mycobacterium
LRKSNAQHN

SEQ ID NO: 523952 - protein, 6 aa, Mycobacterium
LRKSRS

SEQ ID NO: 523953 - protein, 9 aa, Mycobacterium
LRKTNAEHN

SEQ ID NO: 523954 - protein, 6 aa, Mycobacterium
LRNADG

SEQ ID NO: 523955 - protein, 9 aa, Mycobacterium
LRNAEEAPN

SEQ ID NO: 523956 - protein, 7 aa, Mycobacterium
LRNAGAT

SEQ ID NO: 523957 - protein, 8 aa, Mycobacterium
LRNDEPDL

SEQ ID NO: 523958 - protein, 5 aa, Mycobacterium
LRNDG

SEQ ID NO: 523959 - protein, 4 aa, Mycobacterium
LRNE

SEQ ID NO: 523960 - protein, 12 aa, Mycobacterium
LRNEPAQWPELL

SEQ ID NO: 523961 - protein, 10 aa, Mycobacterium
LRNGALNPNA

SEQ ID NO: 523962 - protein, 7 aa, Mycobacterium
LRNGNER

SEQ ID NO: 523963 - protein, 12 aa, Mycobacterium
LRNGTIDTAEYE

SEQ ID NO: 523964 - protein, 11 aa, Mycobacterium
LRNKPGEPLPV

SEQ ID NO: 523965 - protein, 12 aa, Mycobacterium
LRNPGDPVPANL

SEQ ID NO: 523966 - protein, 15 aa, Mycobacterium
LRNPKPAADAARPTL

SEQ ID NO: 523967 - protein, 7 aa, Mycobacterium
LRNQATD

SEQ ID NO: 523968 - protein, 7 aa, Mycobacterium
LRNQGKQ

SEQ ID NO: 523969 - protein, 12 aa, Mycobacterium
LRNSGEPTVHDA

SEQ ID NO: 523970 - protein, 12 aa, Mycobacterium
LRNSRTGAVTAR

SEQ ID NO: 523971 - protein, 7 aa, Mycobacterium
LRNSSGT

SEQ ID NO: 523972 - protein, 7 aa, Mycobacterium
LRNTGTE

SEQ ID NO: 523973 - protein, 6 aa, Mycobacterium
LRNTSL

SEQ ID NO: 523974 - protein, 5 aa, Mycobacterium
LRNYP

SEQ ID NO: 523975 - protein, 16 aa, Mycobacterium
LRPADGPLTSSPGESL

SEQ ID NO: 523976 - protein, 15 aa, Mycobacterium
LRPAGDRVKTDARDA

SEQ ID NO: 523977 - protein, 5 aa, Mycobacterium
LRPAP

SEQ ID NO: 523978 - protein, 8 aa, Mycobacterium
LRPAPDTM

SEQ ID NO: 523979 - protein, 13 aa, Mycobacterium
LRPARGRGRATRA

SEQ ID NO: 523980 - protein, 14 aa, Mycobacterium
LRPATLTEGRDDVS

SEQ ID NO: 523981 - protein, 6 aa, Mycobacterium
LRPDAP

SEQ ID NO: 523982 - protein, 6 aa, Mycobacterium
LRPDDE

SEQ ID NO: 523983 - protein, 10 aa, Mycobacterium
LRPDELGKAA

SEQ ID NO: 523984 - protein, 8 aa, Mycobacterium
LRPDGASP

SEQ ID NO: 523985 - protein, 12 aa, Mycobacterium
LRPDGKPPHPSW

SEQ ID NO: 523986 - protein, 6 aa, Mycobacterium
LRPDGR

SEQ ID NO: 523987 - protein, 12 aa, Mycobacterium
LRPDKTPDEVVW

SEQ ID NO: 523988 - protein, 7 aa, Mycobacterium
LRPDPEV

SEQ ID NO: 523989 - protein, 7 aa, Mycobacterium
LRPDPSD

SEQ ID NO: 523990 - protein, 7 aa, Mycobacterium
LRPDPTN

SEQ ID NO: 523991 - protein, 5 aa, Mycobacterium
LRPDQ

SEQ ID NO: 523992 - protein, 11 aa, Mycobacterium
LRPDREPPHPS

SEQ ID NO: 523993 - protein, 8 aa, Mycobacterium
LRPDRPSV

SEQ ID NO: 523994 - protein, 8 aa, Mycobacterium
LRPDRRTA

SEQ ID NO: 523995 - protein, 16 aa, Mycobacterium
LRPDSDDARVRATRET

SEQ ID NO: 523996 - protein, 6 aa, Mycobacterium
LRPDSI

SEQ ID NO: 523997 - protein, 9 aa, Mycobacterium
LRPDSSPHR

SEQ ID NO: 523998 - protein, 5 aa, Mycobacterium
LRPDT

SEQ ID NO: 523999 - protein, 8 aa, Mycobacterium
LRPDTEQK

SEQ ID NO: 524000 - protein, 8 aa, Mycobacterium
LRPEAEEK

SEQ ID NO: 524001 - protein, 5 aa, Mycobacterium
LRPED

SEQ ID NO: 524002 - protein, 8 aa, Mycobacterium
LRPEGKAG

SEQ ID NO: 524003 - protein, 9 aa, Mycobacterium
LRPEGKQGQ

SEQ ID NO: 524004 - protein, 9 aa, Mycobacterium
LRPEGKRGQ

SEQ ID NO: 524005 - protein, 9 aa, Mycobacterium
LRPEGRQGP

SEQ ID NO: 524006 - protein, 8 aa, Mycobacterium
LRPEGTAG

SEQ ID NO: 524007 - protein, 5 aa, Mycobacterium
LRPEN

SEQ ID NO: 524008 - protein, 11 aa, Mycobacterium
LRPEPNAPESH

SEQ ID NO: 524009 - protein, 5 aa, Mycobacterium
LRPGA

SEQ ID NO: 524010 - protein, 6 aa, Mycobacterium
LRPGAT

SEQ ID NO: 524011 - protein, 5 aa, Mycobacterium
LRPGD

SEQ ID NO: 524012 - protein, 7 aa, Mycobacterium
LRPGDAV

SEQ ID NO: 524013 - protein, 23 aa, Mycobacterium
LRPGDPILGEEGGGPADPAATPV

SEQ ID NO: 524014 - protein, 25 aa, Mycobacterium
LRPGDPILGEEGGGPTDPAGTPPGS

SEQ ID NO: 524015 - protein, 25 aa, Mycobacterium
LRPGDPIVGEEGGGPADSAPAPDDA

SEQ ID NO: 524016 - protein, 6 aa, Mycobacterium
LRPGER

SEQ ID NO: 524017 - protein, 7 aa, Mycobacterium
LRPGERA

SEQ ID NO: 524018 - protein, 12 aa, Mycobacterium
LRPGGALQGTAV

SEQ ID NO: 524019 - protein, 16 aa, Mycobacterium
LRPGGGAKLARSAGSG

SEQ ID NO: 524020 - protein, 13 aa, Mycobacterium
LRPGGHYADQHFA

SEQ ID NO: 524021 - protein, 14 aa, Mycobacterium
LRPGGRRGARRPQR

SEQ ID NO: 524022 - protein, 6 aa, Mycobacterium
LRPGGT

SEQ ID NO: 524023 - protein, 7 aa, Mycobacterium
LRPGGTA

SEQ ID NO: 524024 - protein, 8 aa, Mycobacterium
LRPGHPDL

SEQ ID NO: 524025 - protein, 17 aa, Mycobacterium
LRPGKPGEHDLEDVERP

SEQ ID NO: 524026 - protein, 6 aa, Mycobacterium
LRPGKR

SEQ ID NO: 524027 - protein, 5 aa, Mycobacterium
LRPGN

SEQ ID NO: 524028 - protein, 10 aa, Mycobacterium
LRPGPQHAPT

SEQ ID NO: 524029 - protein, 5 aa, Mycobacterium
LRPGQ

SEQ ID NO: 524030 - protein, 11 aa, Mycobacterium
LRPGRGETPPV

SEQ ID NO: 524031 - protein, 8 aa, Mycobacterium
LRPGRSTF

SEQ ID NO: 524032 - protein, 5 aa, Mycobacterium
LRPGS

SEQ ID NO: 524033 - protein, 5 aa, Mycobacterium
LRPGT

SEQ ID NO: 524034 - protein, 19 aa, Mycobacterium
LRPGTTDARRIDSTTTLPR

SEQ ID NO: 524035 - protein, 10 aa, Mycobacterium
LRPGVGAGGP

SEQ ID NO: 524036 - protein, 10 aa, Mycobacterium
LRPGVGPGGP

SEQ ID NO: 524037 - protein, 11 aa, Mycobacterium
LRPGVGRGGGV

SEQ ID NO: 524038 - protein, 10 aa, Mycobacterium
LRPGVGTGGP

SEQ ID NO: 524039 - protein, 19 aa, Mycobacterium
LRPHDDPDNPWSAKNTKQH

SEQ ID NO: 524040 - protein, 12 aa, Mycobacterium
LRPKDYGEARTI

SEQ ID NO: 524041 - protein, 9 aa, Mycobacterium
LRPPAGSAR

SEQ ID NO: 524042 - protein, 5 aa, Mycobacterium
LRPPD

SEQ ID NO: 524043 - protein, 11 aa, Mycobacterium
LRPPDGVDAQD

SEQ ID NO: 524044 - protein, 6 aa, Mycobacterium
LRPPDR

SEQ ID NO: 524045 - protein, 9 aa, Mycobacterium
LRPPGDQGA

SEQ ID NO: 524046 - protein, 10 aa, Mycobacterium
LRPPPWTGPG

SEQ ID NO: 524047 - protein, 5 aa, Mycobacterium
LRPPQ

SEQ ID NO: 524048 - protein, 17 aa, Mycobacterium
LRPPQRAPRLGEHTAQY

SEQ ID NO: 524049 - protein, 5 aa, Mycobacterium
LRPPS

SEQ ID NO: 524050 - protein, 15 aa, Mycobacterium
LRPPTAAPKLGAHTD

SEQ ID NO: 524051 - protein, 7 aa, Mycobacterium
LRPPTDL

SEQ ID NO: 524052 - protein, 8 aa, Mycobacterium
LRPQAADE

SEQ ID NO: 524053 - protein, 8 aa, Mycobacterium
LRPQETVG

SEQ ID NO: 524054 - protein, 6 aa, Mycobacterium
LRPQSS

SEQ ID NO: 524055 - protein, 20 aa, Mycobacterium
LRPRADPSAPWPGKLPDPAP

SEQ ID NO: 524056 - protein, 5 aa, Mycobacterium
LRPRE

SEQ ID NO: 524057 - protein, 10 aa, Mycobacterium
LRPREAQQEM

SEQ ID NO: 524058 - protein, 9 aa, Mycobacterium
LRPRGFSDD

SEQ ID NO: 524059 - protein, 11 aa, Mycobacterium
LRPRPDAPPGT

SEQ ID NO: 524060 - protein, 6 aa, Mycobacterium
LRPRPE

SEQ ID NO: 524061 - protein, 7 aa, Mycobacterium
LRPRPEI

SEQ ID NO: 524062 - protein, 9 aa, Mycobacterium
LRPRPPVGT

SEQ ID NO: 524063 - protein, 7 aa, Mycobacterium
LRPRTRQ

SEQ ID NO: 524064 - protein, 11 aa, Mycobacterium
LRPSDDDHSFT

SEQ ID NO: 524065 - protein, 8 aa, Mycobacterium
LRPSDQPE

SEQ ID NO: 524066 - protein, 20 aa, Mycobacterium
LRPSEREALARNGPEPPRGD

SEQ ID NO: 524067 - protein, 20 aa, Mycobacterium
LRPSEREALDRDGMGSPEGD

SEQ ID NO: 524068 - protein, 6 aa, Mycobacterium
LRPSGR

SEQ ID NO: 524069 - protein, 26 aa, Mycobacterium
LRPSNQTKVSLTTTSEAPLREGGTYG

SEQ ID NO: 524070 - protein, 6 aa, Mycobacterium
LRPSPD

SEQ ID NO: 524071 - protein, 7 aa, Mycobacterium
LRPSRAI

SEQ ID NO: 524072 - protein, 9 aa, Mycobacterium
LRPSRDTRR

SEQ ID NO: 524073 - protein, 5 aa, Mycobacterium
LRPSV

SEQ ID NO: 524074 - protein, 38 aa, Mycobacterium
LRPTAAAPPATPSAAAGPVSGAPVAPSPGSSPSAGGPF

SEQ ID NO: 524075 - protein, 6 aa, Mycobacterium
LRPTKL

SEQ ID NO: 524076 - protein, 6 aa, Mycobacterium
LRPTSG

SEQ ID NO: 524077 - protein, 8 aa, Mycobacterium
LRPTTNLA

SEQ ID NO: 524078 - protein, 16 aa, Mycobacterium
LRPYQDADRVAADPEY

SEQ ID NO: 524079 - protein, 7 aa, Mycobacterium
LRPYTRD

SEQ ID NO: 524080 - protein, 9 aa, Mycobacterium
LRQAGDGSF

SEQ ID NO: 524081 - protein, 9 aa, Mycobacterium
LRQASDGTF

SEQ ID NO: 524082 - protein, 8 aa, Mycobacterium
LRQDDRTG

SEQ ID NO: 524083 - protein, 4 aa, Mycobacterium
LRQE

SEQ ID NO: 524084 - protein, 4 aa, Mycobacterium
LRQG

SEQ ID NO: 524085 - protein, 6 aa, Mycobacterium
LRQGTR

SEQ ID NO: 524086 - protein, 6 aa, Mycobacterium
LRQHSG

SEQ ID NO: 524087 - protein, 6 aa, Mycobacterium
LRQPDD

SEQ ID NO: 524088 - protein, 5 aa, Mycobacterium
LRQPG

SEQ ID NO: 524089 - protein, 10 aa, Mycobacterium
LRQPGAELKK

SEQ ID NO: 524090 - protein, 10 aa, Mycobacterium
LRQPRDKGPV

SEQ ID NO: 524091 - protein, 19 aa, Mycobacterium
LRQPTGTTGPAGPAGPAVT

SEQ ID NO: 524092 - protein, 6 aa, Mycobacterium
LRQPTV

SEQ ID NO: 524093 - protein, 4 aa, Mycobacterium
LRQQ

SEQ ID NO: 524094 - protein, 16 aa, Mycobacterium
LRQQAASGQPGPEGAG

SEQ ID NO: 524095 - protein, 16 aa, Mycobacterium
LRQQATMGQPGPEGAG

SEQ ID NO: 524096 - protein, 9 aa, Mycobacterium
LRQQHGQGG

SEQ ID NO: 524097 - protein, 9 aa, Mycobacterium
LRQQHGQGR

SEQ ID NO: 524098 - protein, 13 aa, Mycobacterium
LRQQSDRLNGQLT

SEQ ID NO: 524099 - protein, 7 aa, Mycobacterium
LRQRTRP

SEQ ID NO: 524100 - protein, 5 aa, Mycobacterium
LRQSE

SEQ ID NO: 524101 - protein, 10 aa, Mycobacterium
LRQSGSTAQM

SEQ ID NO: 524102 - protein, 8 aa, Mycobacterium
LRQSSTTA

SEQ ID NO: 524103 - protein, 6 aa, Mycobacterium
LRQSTE

SEQ ID NO: 524104 - protein, 6 aa, Mycobacterium
LRQSTQ

SEQ ID NO: 524105 - protein, 9 aa, Mycobacterium
LRQSTQPKA

SEQ ID NO: 524106 - protein, 17 aa, Mycobacterium
LRQTARDLPELGRTAGK

SEQ ID NO: 524107 - protein, 7 aa, Mycobacterium
LRRAGYK

SEQ ID NO: 524108 - protein, 7 aa, Mycobacterium
LRRAPGA

SEQ ID NO: 524109 - protein, 4 aa, Mycobacterium
LRRD

SEQ ID NO: 524110 - protein, 5 aa, Mycobacterium
LRRDP

SEQ ID NO: 524111 - protein, 12 aa, Mycobacterium
LRRDRGAYSVTD

SEQ ID NO: 524112 - protein, 8 aa, Mycobacterium
LRRDTVGD

SEQ ID NO: 524113 - protein, 16 aa, Mycobacterium
LRREAADGVRSAGQGR

SEQ ID NO: 524114 - protein, 12 aa, Mycobacterium
LRREKDDVTEVR

SEQ ID NO: 524115 - protein, 6 aa, Mycobacterium
LRREPG

SEQ ID NO: 524116 - protein, 8 aa, Mycobacterium
LRREPGQI

SEQ ID NO: 524117 - protein, 9 aa, Mycobacterium
LRREQSRPC

SEQ ID NO: 524118 - protein, 7 aa, Mycobacterium
LRRERER

SEQ ID NO: 524119 - protein, 5 aa, Mycobacterium
LRRGD

SEQ ID NO: 524120 - protein, 9 aa, Mycobacterium
LRRGESDHA

SEQ ID NO: 524121 - protein, 14 aa, Mycobacterium
LRRGGERHASLREG

SEQ ID NO: 524122 - protein, 13 aa, Mycobacterium
LRRGGRPAPDGAG

SEQ ID NO: 524123 - protein, 10 aa, Mycobacterium
LRRGHRDDAA

SEQ ID NO: 524124 - protein, 7 aa, Mycobacterium
LRRGPAD

SEQ ID NO: 524125 - protein, 6 aa, Mycobacterium
LRRGST

SEQ ID NO: 524126 - protein, 4 aa, Mycobacterium
LRRP

SEQ ID NO: 524127 - protein, 8 aa, Mycobacterium
LRRPDGAK

SEQ ID NO: 524128 - protein, 7 aa, Mycobacterium
LRRPEPG

SEQ ID NO: 524129 - protein, 5 aa, Mycobacterium
LRRPG

SEQ ID NO: 524130 - protein, 10 aa, Mycobacterium
LRRPGSTTEV

SEQ ID NO: 524131 - protein, 9 aa, Mycobacterium
LRRPGTRVG

SEQ ID NO: 524132 - protein, 8 aa, Mycobacterium
LRRPRGIP

SEQ ID NO: 524133 - protein, 7 aa, Mycobacterium
LRRPRRR

SEQ ID NO: 524134 - protein, 6 aa, Mycobacterium
LRRPSA

SEQ ID NO: 524135 - protein, 14 aa, Mycobacterium
LRRQRTELTDQPEG

SEQ ID NO: 524136 - protein, 7 aa, Mycobacterium
LRRRDQG

SEQ ID NO: 524137 - protein, 8 aa, Mycobacterium
LRRRDQGR

SEQ ID NO: 524138 - protein, 5 aa, Mycobacterium
LRRRG

SEQ ID NO: 524139 - protein, 6 aa, Mycobacterium
LRRRGA

SEQ ID NO: 524140 - protein, 5 aa, Mycobacterium
LRRRN

SEQ ID NO: 524141 - protein, 8 aa, Mycobacterium
LRRRNEEA

SEQ ID NO: 524142 - protein, 4 aa, Mycobacterium
LRRS

SEQ ID NO: 524143 - protein, 7 aa, Mycobacterium
LRRSARA

SEQ ID NO: 524144 - protein, 9 aa, Mycobacterium
LRRSDPAEL

SEQ ID NO: 524145 - protein, 8 aa, Mycobacterium
LRRSGARL

SEQ ID NO: 524146 - protein, 7 aa, Mycobacterium
LRRSGRA

SEQ ID NO: 524147 - protein, 7 aa, Mycobacterium
LRRSPHN

SEQ ID NO: 524148 - protein, 14 aa, Mycobacterium
LRRSSSGLPVCADC

SEQ ID NO: 524149 - protein, 5 aa, Mycobacterium
LRRST

SEQ ID NO: 524150 - protein, 7 aa, Mycobacterium
LRRTAAA

SEQ ID NO: 524151 - protein, 20 aa, Mycobacterium
LRRTDEQARNHPDGAQGLNP

SEQ ID NO: 524152 - protein, 10 aa, Mycobacterium
LRRTGADDDG

SEQ ID NO: 524153 - protein, 10 aa, Mycobacterium
LRRTKDRRKV

SEQ ID NO: 524154 - protein, 4 aa, Mycobacterium
LRSA

SEQ ID NO: 524155 - protein, 7 aa, Mycobacterium
LRSAAAG

SEQ ID NO: 524156 - protein, 9 aa, Mycobacterium
LRSAATGYG

SEQ ID NO: 524157 - protein, 17 aa, Mycobacterium
LRSADSDWSDALPRRKT

SEQ ID NO: 524158 - protein, 9 aa, Mycobacterium
LRSAETTIP

SEQ ID NO: 524159 - protein, 13 aa, Mycobacterium
LRSAQGDPGGPFA

SEQ ID NO: 524160 - protein, 18 aa, Mycobacterium
LRSASAALADAGQRLQDG

SEQ ID NO: 524161 - protein, 7 aa, Mycobacterium
LRSASDP

SEQ ID NO: 524162 - protein, 7 aa, Mycobacterium
LRSDADV

SEQ ID NO: 524163 - protein, 12 aa, Mycobacterium
LRSDDDDWGQAG

SEQ ID NO: 524164 - protein, 19 aa, Mycobacterium
LRSDEQRHRIAPGREPDEG

SEQ ID NO: 524165 - protein, 9 aa, Mycobacterium
LRSDGDSWT

SEQ ID NO: 524166 - protein, 11 aa, Mycobacterium
LRSDGKRNRDR

SEQ ID NO: 524167 - protein, 8 aa, Mycobacterium
LRSDGTRI

SEQ ID NO: 524168 - protein, 12 aa, Mycobacterium
LRSDRETARSIN

SEQ ID NO: 524169 - protein, 11 aa, Mycobacterium
LRSEERETTVA

SEQ ID NO: 524170 - protein, 9 aa, Mycobacterium
LRSEKRGHW

SEQ ID NO: 524171 - protein, 5 aa, Mycobacterium
LRSEL

SEQ ID NO: 524172 - protein, 16 aa, Mycobacterium
LRSEPAEALPSDPDWA

SEQ ID NO: 524173 - protein, 15 aa, Mycobacterium
LRSEPAEPLPSDPDW

SEQ ID NO: 524174 - protein, 9 aa, Mycobacterium
LRSEQRASL

SEQ ID NO: 524175 - protein, 10 aa, Mycobacterium
LRSESGKSAL

SEQ ID NO: 524176 - protein, 5 aa, Mycobacterium
LRSGA

SEQ ID NO: 524177 - protein, 11 aa, Mycobacterium
LRSGAGAAPLR

SEQ ID NO: 524178 - protein, 12 aa, Mycobacterium
LRSGAGDRTVSS

SEQ ID NO: 524179 - protein, 13 aa, Mycobacterium
LRSGATAWVYVFA

SEQ ID NO: 524180 - protein, 15 aa, Mycobacterium
LRSGATTAVKRPAEL

SEQ ID NO: 524181 - protein, 6 aa, Mycobacterium
LRSGDA

SEQ ID NO: 524182 - protein, 6 aa, Mycobacterium
LRSGDE

SEQ ID NO: 524183 - protein, 7 aa, Mycobacterium
LRSGDRA

SEQ ID NO: 524184 - protein, 12 aa, Mycobacterium
LRSGDRVDRNEI

SEQ ID NO: 524185 - protein, 5 aa, Mycobacterium
LRSGE

SEQ ID NO: 524186 - protein, 6 aa, Mycobacterium
LRSGEA

SEQ ID NO: 524187 - protein, 13 aa, Mycobacterium
LRSGEPKAPTRGA

SEQ ID NO: 524188 - protein, 8 aa, Mycobacterium
LRSGGPVR

SEQ ID NO: 524189 - protein, 7 aa, Mycobacterium
LRSGGSD

SEQ ID NO: 524190 - protein, 5 aa, Mycobacterium
LRSGL

SEQ ID NO: 524191 - protein, 13 aa, Mycobacterium
LRSGPPASTCHGR

SEQ ID NO: 524192 - protein, 7 aa, Mycobacterium
LRSGRKR

SEQ ID NO: 524193 - protein, 11 aa, Mycobacterium
LRSGRNEVRRP

SEQ ID NO: 524194 - protein, 7 aa, Mycobacterium
LRSGSGR

SEQ ID NO: 524195 - protein, 7 aa, Mycobacterium
LRSGSNA

SEQ ID NO: 524196 - protein, 12 aa, Mycobacterium
LRSGSPPPPTRG

SEQ ID NO: 524197 - protein, 10 aa, Mycobacterium
LRSGTDPESF

SEQ ID NO: 524198 - protein, 9 aa, Mycobacterium
LRSGTTTLE

SEQ ID NO: 524199 - protein, 15 aa, Mycobacterium
LRSGVGSPTAFANST

SEQ ID NO: 524200 - protein, 15 aa, Mycobacterium
LRSGVGSPTAFASST

SEQ ID NO: 524201 - protein, 14 aa, Mycobacterium
LRSGVGSPTAFATE

SEQ ID NO: 524202 - protein, 11 aa, Mycobacterium
LRSKPTEYTQY

SEQ ID NO: 524203 - protein, 7 aa, Mycobacterium
LRSKSVD

SEQ ID NO: 524204 - protein, 6 aa, Mycobacterium
LRSNGV

SEQ ID NO: 524205 - protein, 5 aa, Mycobacterium
LRSPA

SEQ ID NO: 524206 - protein, 8 aa, Mycobacterium
LRSPEDSH

SEQ ID NO: 524207 - protein, 10 aa, Mycobacterium
LRSPGDTQTM

SEQ ID NO: 524208 - protein, 15 aa, Mycobacterium
LRSPKPATDATRQTL

SEQ ID NO: 524209 - protein, 8 aa, Mycobacterium
LRSPNRGM

SEQ ID NO: 524210 - protein, 5 aa, Mycobacterium
LRSPR

SEQ ID NO: 524211 - protein, 5 aa, Mycobacterium
LRSPS

SEQ ID NO: 524212 - protein, 32 aa, Mycobacterium
LRSPSAAADGESTPSSAVHSPTSTRLSERERE

SEQ ID NO: 524213 - protein, 13 aa, Mycobacterium
LRSQAAAASRHLV

SEQ ID NO: 524214 - protein, 5 aa, Mycobacterium
LRSQK

SEQ ID NO: 524215 - protein, 11 aa, Mycobacterium
LRSQSQPKGAV

SEQ ID NO: 524216 - protein, 4 aa, Mycobacterium
LRSR

SEQ ID NO: 524217 - protein, 9 aa, Mycobacterium
LRSRADTEL

SEQ ID NO: 524218 - protein, 7 aa, Mycobacterium
LRSRAEH

SEQ ID NO: 524219 - protein, 7 aa, Mycobacterium
LRSRKDG

SEQ ID NO: 524220 - protein, 8 aa, Mycobacterium
LRSRNSTD

SEQ ID NO: 524221 - protein, 5 aa, Mycobacterium
LRSRP

SEQ ID NO: 524222 - protein, 7 aa, Mycobacterium
LRSRPDL

SEQ ID NO: 524223 - protein, 8 aa, Mycobacterium
LRSRPSLD

SEQ ID NO: 524224 - protein, 8 aa, Mycobacterium
LRSRREGA

SEQ ID NO: 524225 - protein, 10 aa, Mycobacterium
LRSRRGAEVP

SEQ ID NO: 524226 - protein, 5 aa, Mycobacterium
LRSSA

SEQ ID NO: 524227 - protein, 9 aa, Mycobacterium
LRSSAQSPD

SEQ ID NO: 524228 - protein, 20 aa, Mycobacterium
LRSSDADTINTGLSPSDEDV

SEQ ID NO: 524229 - protein, 8 aa, Mycobacterium
LRSSGDGA

SEQ ID NO: 524230 - protein, 7 aa, Mycobacterium
LRSSGLS

SEQ ID NO: 524231 - protein, 6 aa, Mycobacterium
LRSSPD

SEQ ID NO: 524232 - protein, 6 aa, Mycobacterium
LRSSTR

SEQ ID NO: 524233 - protein, 8 aa, Mycobacterium
LRSTAASY

SEQ ID NO: 524234 - protein, 11 aa, Mycobacterium
LRSTATKTDGG

SEQ ID NO: 524235 - protein, 15 aa, Mycobacterium
LRSTGDLARRTQGAG

SEQ ID NO: 524236 - protein, 7 aa, Mycobacterium
LRSTGPV

SEQ ID NO: 524237 - protein, 14 aa, Mycobacterium
LRSTGTTYPAPGEG

SEQ ID NO: 524238 - protein, 8 aa, Mycobacterium
LRSTKAPV

SEQ ID NO: 524239 - protein, 8 aa, Mycobacterium
LRSTSAPV

SEQ ID NO: 524240 - protein, 13 aa, Mycobacterium
LRSTSEGVLPRLF

SEQ ID NO: 524241 - protein, 7 aa, Mycobacterium
LRTAAAD

SEQ ID NO: 524242 - protein, 13 aa, Mycobacterium
LRTAEDTHGPEGL

SEQ ID NO: 524243 - protein, 14 aa, Mycobacterium
LRTASLDEVLCVLQ

SEQ ID NO: 524244 - protein, 25 aa, Mycobacterium
LRTASSAYQGVDEQAGESLDKQIIE

SEQ ID NO: 524245 - protein, 5 aa, Mycobacterium
LRTDD

SEQ ID NO: 524246 - protein, 12 aa, Mycobacterium
LRTDESGTGTEI

SEQ ID NO: 524247 - protein, 5 aa, Mycobacterium
LRTDG

SEQ ID NO: 524248 - protein, 13 aa, Mycobacterium
LRTDGADPAEVNG

SEQ ID NO: 524249 - protein, 14 aa, Mycobacterium
LRTDKSVRDVELDL

SEQ ID NO: 524250 - protein, 7 aa, Mycobacterium
LRTDNEY

SEQ ID NO: 524251 - protein, 20 aa, Mycobacterium
LRTDTQSAVDEQRRSIQGEC

SEQ ID NO: 524252 - protein, 4 aa, Mycobacterium
LRTE

SEQ ID NO: 524253 - protein, 8 aa, Mycobacterium
LRTEADGI

SEQ ID NO: 524254 - protein, 17 aa, Mycobacterium
LRTEAGKPMKASTDGMV

SEQ ID NO: 524255 - protein, 11 aa, Mycobacterium
LRTEAREAKMS

SEQ ID NO: 524256 - protein, 8 aa, Mycobacterium
LRTEASQD

SEQ ID NO: 524257 - protein, 9 aa, Mycobacterium
LRTEEDAAA

SEQ ID NO: 524258 - protein, 13 aa, Mycobacterium
LRTETVDGGGYPV

SEQ ID NO: 524259 - protein, 11 aa, Mycobacterium
LRTGAPQAAEA

SEQ ID NO: 524260 - protein, 10 aa, Mycobacterium
LRTGDRVDRN

SEQ ID NO: 524261 - protein, 5 aa, Mycobacterium
LRTGE

SEQ ID NO: 524262 - protein, 7 aa, Mycobacterium
LRTGGPV

SEQ ID NO: 524263 - protein, 19 aa, Mycobacterium
LRTGPSQPDASETLPGGTE

SEQ ID NO: 524264 - protein, 15 aa, Mycobacterium
LRTGPTRLKSSGKDY

SEQ ID NO: 524265 - protein, 8 aa, Mycobacterium
LRTGRRER

SEQ ID NO: 524266 - protein, 9 aa, Mycobacterium
LRTGSPPVV

SEQ ID NO: 524267 - protein, 9 aa, Mycobacterium
LRTGSQQEF

SEQ ID NO: 524268 - protein, 8 aa, Mycobacterium
LRTGTEER

SEQ ID NO: 524269 - protein, 5 aa, Mycobacterium
LRTNA

SEQ ID NO: 524270 - protein, 10 aa, Mycobacterium
LRTNAGGCDR

SEQ ID NO: 524271 - protein, 11 aa, Mycobacterium
LRTNSRRREEY

SEQ ID NO: 524272 - protein, 10 aa, Mycobacterium
LRTPAAENRV

SEQ ID NO: 524273 - protein, 10 aa, Mycobacterium
LRTPEGREQY

SEQ ID NO: 524274 - protein, 10 aa, Mycobacterium
LRTPGDPVTR

SEQ ID NO: 524275 - protein, 9 aa, Mycobacterium
LRTPGGAGI

SEQ ID NO: 524276 - protein, 9 aa, Mycobacterium
LRTPGGART

SEQ ID NO: 524277 - protein, 5 aa, Mycobacterium
LRTPK

SEQ ID NO: 524278 - protein, 7 aa, Mycobacterium
LRTPKGV

SEQ ID NO: 524279 - protein, 7 aa, Mycobacterium
LRTPRPG

SEQ ID NO: 524280 - protein, 7 aa, Mycobacterium
LRTPSTT

SEQ ID NO: 524281 - protein, 9 aa, Mycobacterium
LRTPTAESA

SEQ ID NO: 524282 - protein, 8 aa, Mycobacterium
LRTPTTDA

SEQ ID NO: 524283 - protein, 4 aa, Mycobacterium
LRTQ

SEQ ID NO: 524284 - protein, 11 aa, Mycobacterium
LRTQKQRYQTE

SEQ ID NO: 524285 - protein, 7 aa, Mycobacterium
LRTQPDL

SEQ ID NO: 524286 - protein, 9 aa, Mycobacterium
LRTQRRGKG

SEQ ID NO: 524287 - protein, 12 aa, Mycobacterium
LRTQTDSRGRTA

SEQ ID NO: 524288 - protein, 4 aa, Mycobacterium
LRTR

SEQ ID NO: 524289 - protein, 5 aa, Mycobacterium
LRTRA

SEQ ID NO: 524290 - protein, 10 aa, Mycobacterium
LRTRDLTDDQ

SEQ ID NO: 524291 - protein, 26 aa, Mycobacterium
LRTRPDISEEAREKIGGLNAQRFYNL

SEQ ID NO: 524292 - protein, 6 aa, Mycobacterium
LRTRRT

SEQ ID NO: 524293 - protein, 12 aa, Mycobacterium
LRTRTGAPITAA

SEQ ID NO: 524294 - protein, 5 aa, Mycobacterium
LRTSA

SEQ ID NO: 524295 - protein, 12 aa, Mycobacterium
LRTSAGTHDYAA

SEQ ID NO: 524296 - protein, 10 aa, Mycobacterium
LRTSAQSPDL

SEQ ID NO: 524297 - protein, 6 aa, Mycobacterium
LRTSDG

SEQ ID NO: 524298 - protein, 10 aa, Mycobacterium
LRTSSDPVSQ

SEQ ID NO: 524299 - protein, 7 aa, Mycobacterium
LRTSTPG

SEQ ID NO: 524300 - protein, 12 aa, Mycobacterium
LRTTAGTHDYVT

SEQ ID NO: 524301 - protein, 11 aa, Mycobacterium
LRTTARAEGDT

SEQ ID NO: 524302 - protein, 14 aa, Mycobacterium
LRTTGAKSGKPREV

SEQ ID NO: 524303 - protein, 22 aa, Mycobacterium
LRTTQQECDKRLNDAKTEAERR

SEQ ID NO: 524304 - protein, 7 aa, Mycobacterium
LRTTSAP

SEQ ID NO: 524305 - protein, 11 aa, Mycobacterium
LRTTTDNRQRV

SEQ ID NO: 524306 - protein, 10 aa, Mycobacterium
LRTYGSGGSG

SEQ ID NO: 524307 - protein, 7 aa, Mycobacterium
LRTYPGS

SEQ ID NO: 524308 - protein, 4 aa, Mycobacterium
LRVD

SEQ ID NO: 524309 - protein, 8 aa, Mycobacterium
LRYNDDGS

SEQ ID NO: 524310 - protein, 7 aa, Mycobacterium
LSAAANG

SEQ ID NO: 524311 - protein, 9 aa, Mycobacterium
LSAADGRRL

SEQ ID NO: 524312 - protein, 6 aa, Mycobacterium
LSAAEQ

SEQ ID NO: 524313 - protein, 16 aa, Mycobacterium
LSAAERRRSEAAFADA

SEQ ID NO: 524314 - protein, 6 aa, Mycobacterium
LSAAGS

SEQ ID NO: 524315 - protein, 8 aa, Mycobacterium
LSAAGSPV

SEQ ID NO: 524316 - protein, 12 aa, Mycobacterium
LSAAPGAGGKPI

SEQ ID NO: 524317 - protein, 15 aa, Mycobacterium
LSAAPGGPGPLSGFG

SEQ ID NO: 524318 - protein, 14 aa, Mycobacterium
LSAAPGLPRSGTEI

SEQ ID NO: 524319 - protein, 5 aa, Mycobacterium
LSAAQ

SEQ ID NO: 524320 - protein, 15 aa, Mycobacterium
LSAAQAEAIRREPDD

SEQ ID NO: 524321 - protein, 10 aa, Mycobacterium
LSAAQDSAVR

SEQ ID NO: 524322 - protein, 9 aa, Mycobacterium
LSAAQSRLG

SEQ ID NO: 524323 - protein, 7 aa, Mycobacterium
LSAARES

SEQ ID NO: 524324 - protein, 22 aa, Mycobacterium
LSAARGAAESLPPPQASGAQEL

SEQ ID NO: 524325 - protein, 11 aa, Mycobacterium
LSAARSTEFTD

SEQ ID NO: 524326 - protein, 5 aa, Mycobacterium
LSAAS

SEQ ID NO: 524327 - protein, 8 aa, Mycobacterium
LSAASDGR

SEQ ID NO: 524328 - protein, 12 aa, Mycobacterium
LSAATAAGASHA

SEQ ID NO: 524329 - protein, 11 aa, Mycobacterium
LSAATAAGASY

SEQ ID NO: 524330 - protein, 5 aa, Mycobacterium
LSADD

SEQ ID NO: 524331 - protein, 8 aa, Mycobacterium
LSADDPAD

SEQ ID NO: 524332 - protein, 7 aa, Mycobacterium
LSADDPI

SEQ ID NO: 524333 - protein, 5 aa, Mycobacterium
LSADE

SEQ ID NO: 524334 - protein, 12 aa, Mycobacterium
LSADGDPDPVTA

SEQ ID NO: 524335 - protein, 7 aa, Mycobacterium
LSADGDR

SEQ ID NO: 524336 - protein, 11 aa, Mycobacterium
LSADGEPSHPG

SEQ ID NO: 524337 - protein, 6 aa, Mycobacterium
LSADGI

SEQ ID NO: 524338 - protein, 7 aa, Mycobacterium
LSADGQV

SEQ ID NO: 524339 - protein, 7 aa, Mycobacterium
LSADGSQ

SEQ ID NO: 524340 - protein, 7 aa, Mycobacterium
LSADGSR

SEQ ID NO: 524341 - protein, 8 aa, Mycobacterium
LSADGSTV

SEQ ID NO: 524342 - protein, 16 aa, Mycobacterium
LSADGVDCGDPVWPIR

SEQ ID NO: 524343 - protein, 10 aa, Mycobacterium
LSADPDDTQV

SEQ ID NO: 524344 - protein, 8 aa, Mycobacterium
LSADPGRA

SEQ ID NO: 524345 - protein, 8 aa, Mycobacterium
LSADPSVE

SEQ ID NO: 524346 - protein, 6 aa, Mycobacterium
LSADQR

SEQ ID NO: 524347 - protein, 5 aa, Mycobacterium
LSADR

SEQ ID NO: 524348 - protein, 10 aa, Mycobacterium
LSADRDDADF

SEQ ID NO: 524349 - protein, 6 aa, Mycobacterium
LSADRL

SEQ ID NO: 524350 - protein, 8 aa, Mycobacterium
LSAEAKQD

SEQ ID NO: 524351 - protein, 18 aa, Mycobacterium
LSAEDARRYEAVGPAVIR

SEQ ID NO: 524352 - protein, 7 aa, Mycobacterium
LSAEDAS

SEQ ID NO: 524353 - protein, 24 aa, Mycobacterium
LSAEEAAAAVDAGRRIADEEVDAG

SEQ ID NO: 524354 - protein, 16 aa, Mycobacterium
LSAEEADATANGRPLA

SEQ ID NO: 524355 - protein, 19 aa, Mycobacterium
LSAEETEDTRHGRPLRPAG

SEQ ID NO: 524356 - protein, 7 aa, Mycobacterium
LSAEGAE

SEQ ID NO: 524357 - protein, 10 aa, Mycobacterium
LSAEGDRAAA

SEQ ID NO: 524358 - protein, 6 aa, Mycobacterium
LSAEGS

SEQ ID NO: 524359 - protein, 7 aa, Mycobacterium
LSAEGSR

SEQ ID NO: 524360 - protein, 5 aa, Mycobacterium
LSAEL

SEQ ID NO: 524361 - protein, 6 aa, Mycobacterium
LSAEQR

SEQ ID NO: 524362 - protein, 8 aa, Mycobacterium
LSAEQRAE

SEQ ID NO: 524363 - protein, 12 aa, Mycobacterium
LSAESDHGVSGN

SEQ ID NO: 524364 - protein, 9 aa, Mycobacterium
LSAETGLQP

SEQ ID NO: 524365 - protein, 15 aa, Mycobacterium
LSAGADDVGRAEEDL

SEQ ID NO: 524366 - protein, 17 aa, Mycobacterium
LSAGAGAYSGAEASSAG

SEQ ID NO: 524367 - protein, 6 aa, Mycobacterium
LSAGAS

SEQ ID NO: 524368 - protein, 60 aa, Mycobacterium
LSAGATAPEQVAGSADPTDATFARGASGHSCSGSAVSSWSASPTVAEEPRGAAGSAHAAV

SEQ ID NO: 524369 - protein, 11 aa, Mycobacterium
LSAGDDAQAAA

SEQ ID NO: 524370 - protein, 6 aa, Mycobacterium
LSAGDE

SEQ ID NO: 524371 - protein, 11 aa, Mycobacterium
LSAGDTDVDEA

SEQ ID NO: 524372 - protein, 19 aa, Mycobacterium
LSAGEADAAANGRSLPAAG

SEQ ID NO: 524373 - protein, 9 aa, Mycobacterium
LSAGEALPM

SEQ ID NO: 524374 - protein, 8 aa, Mycobacterium
LSAGERAD

SEQ ID NO: 524375 - protein, 7 aa, Mycobacterium
LSAGGDT

SEQ ID NO: 524376 - protein, 7 aa, Mycobacterium
LSAGGGV

SEQ ID NO: 524377 - protein, 7 aa, Mycobacterium
LSAGGRR

SEQ ID NO: 524378 - protein, 10 aa, Mycobacterium
LSAGGTDRGA

SEQ ID NO: 524379 - protein, 8 aa, Mycobacterium
LSAGMSND

SEQ ID NO: 524380 - protein, 7 aa, Mycobacterium
LSAGQPG

SEQ ID NO: 524381 - protein, 14 aa, Mycobacterium
LSAGQSPGAASSIG

SEQ ID NO: 524382 - protein, 5 aa, Mycobacterium
LSAGR

SEQ ID NO: 524383 - protein, 11 aa, Mycobacterium
LSAGSSGAAVT

SEQ ID NO: 524384 - protein, 6 aa, Mycobacterium
LSAGTV

SEQ ID NO: 524385 - protein, 5 aa, Mycobacterium
LSAGY

SEQ ID NO: 524386 - protein, 4 aa, Mycobacterium
LSAK

SEQ ID NO: 524387 - protein, 7 aa, Mycobacterium
LSAKESH

SEQ ID NO: 524388 - protein, 8 aa, Mycobacterium
LSAKGSRL

SEQ ID NO: 524389 - protein, 5 aa, Mycobacterium
LSAKP

SEQ ID NO: 524390 - protein, 6 aa, Mycobacterium
LSAKQI

SEQ ID NO: 524391 - protein, 9 aa, Mycobacterium
LSALSSQAH

SEQ ID NO: 524392 - protein, 7 aa, Mycobacterium
LSANAES

SEQ ID NO: 524393 - protein, 9 aa, Mycobacterium
LSANASVAR

SEQ ID NO: 524394 - protein, 5 aa, Mycobacterium
LSANG

SEQ ID NO: 524395 - protein, 11 aa, Mycobacterium
LSANGKRIYRP

SEQ ID NO: 524396 - protein, 22 aa, Mycobacterium
LSANGTRSGVDETAGSSWTDKL

SEQ ID NO: 524397 - protein, 7 aa, Mycobacterium
LSANTDY

SEQ ID NO: 524398 - protein, 19 aa, Mycobacterium
LSAPAATTTATSVKAPTSI

SEQ ID NO: 524399 - protein, 6 aa, Mycobacterium
LSAPAG

SEQ ID NO: 524400 - protein, 12 aa, Mycobacterium
LSAPAGAGKTHS

SEQ ID NO: 524401 - protein, 19 aa, Mycobacterium
LSAPAPQYGEGDTRGERMG

SEQ ID NO: 524402 - protein, 18 aa, Mycobacterium
LSAPASAASQVSGAGSAL

SEQ ID NO: 524403 - protein, 6 aa, Mycobacterium
LSAPAV

SEQ ID NO: 524404 - protein, 7 aa, Mycobacterium
LSAPAVK

SEQ ID NO: 524405 - protein, 10 aa, Mycobacterium
LSAPDGDRLD

SEQ ID NO: 524406 - protein, 7 aa, Mycobacterium
LSAPERE

SEQ ID NO: 524407 - protein, 7 aa, Mycobacterium
LSAPESS

SEQ ID NO: 524408 - protein, 8 aa, Mycobacterium
LSAPETAA

SEQ ID NO: 524409 - protein, 5 aa, Mycobacterium
LSAPG

SEQ ID NO: 524410 - protein, 6 aa, Mycobacterium
LSAPGA

SEQ ID NO: 524411 - protein, 8 aa, Mycobacterium
LSAPGKKI

SEQ ID NO: 524412 - protein, 8 aa, Mycobacterium
LSAPGKKL

SEQ ID NO: 524413 - protein, 6 aa, Mycobacterium
LSAPGS

SEQ ID NO: 524414 - protein, 8 aa, Mycobacterium
LSAPGSKL

SEQ ID NO: 524415 - protein, 13 aa, Mycobacterium
LSAPGSKLATENI

SEQ ID NO: 524416 - protein, 26 aa, Mycobacterium
LSAPGSKLATEYHPDNGTTMSQRARE

SEQ ID NO: 524417 - protein, 7 aa, Mycobacterium
LSAPGSQ

SEQ ID NO: 524418 - protein, 9 aa, Mycobacterium
LSAPGSQVA

SEQ ID NO: 524419 - protein, 10 aa, Mycobacterium
LSAPGSQVAA

SEQ ID NO: 524420 - protein, 31 aa, Mycobacterium
LSAPGSRLASEAVPNTADMDPGAARDRMREA

SEQ ID NO: 524421 - protein, 13 aa, Mycobacterium
LSAPGSRLATENI

SEQ ID NO: 524422 - protein, 27 aa, Mycobacterium
LSAPGSRLATESAPNPEPGDDEKLKER

SEQ ID NO: 524423 - protein, 29 aa, Mycobacterium
LSAPGSRLGAEAVPNTADMDPDAARERMQ

SEQ ID NO: 524424 - protein, 9 aa, Mycobacterium
LSAPGSRVA

SEQ ID NO: 524425 - protein, 9 aa, Mycobacterium
LSAPGSTLA

SEQ ID NO: 524426 - protein, 8 aa, Mycobacterium
LSAPGSTV

SEQ ID NO: 524427 - protein, 8 aa, Mycobacterium
LSAPGVAY

SEQ ID NO: 524428 - protein, 9 aa, Mycobacterium
LSAPPAAEI

SEQ ID NO: 524429 - protein, 15 aa, Mycobacterium
LSAPPPGMAPGRAHD

SEQ ID NO: 524430 - protein, 7 aa, Mycobacterium
LSAPRTP

SEQ ID NO: 524431 - protein, 6 aa, Mycobacterium
LSAPVG

SEQ ID NO: 524432 - protein, 5 aa, Mycobacterium
LSAQA

SEQ ID NO: 524433 - protein, 7 aa, Mycobacterium
LSAQAAQ

SEQ ID NO: 524434 - protein, 12 aa, Mycobacterium
LSAQEDSHSEGM

SEQ ID NO: 524435 - protein, 7 aa, Mycobacterium
LSAQEKE

SEQ ID NO: 524436 - protein, 8 aa, Mycobacterium
LSAQSGVD

SEQ ID NO: 524437 - protein, 10 aa, Mycobacterium
LSARKGELAD

SEQ ID NO: 524438 - protein, 8 aa, Mycobacterium
LSARQRRR

SEQ ID NO: 524439 - protein, 5 aa, Mycobacterium
LSARR

SEQ ID NO: 524440 - protein, 12 aa, Mycobacterium
LSASAAADTARR

SEQ ID NO: 524441 - protein, 9 aa, Mycobacterium
LSASAEGDL

SEQ ID NO: 524442 - protein, 9 aa, Mycobacterium
LSASAQKQL

SEQ ID NO: 524443 - protein, 16 aa, Mycobacterium
LSASASWAANGKITAD

SEQ ID NO: 524444 - protein, 5 aa, Mycobacterium
LSASG

SEQ ID NO: 524445 - protein, 9 aa, Mycobacterium
LSASGSRVA

SEQ ID NO: 524446 - protein, 17 aa, Mycobacterium
LSASKGAARRTIGEGGV

SEQ ID NO: 524447 - protein, 14 aa, Mycobacterium
LSASKGAARRTVAE

SEQ ID NO: 524448 - protein, 9 aa, Mycobacterium
LSASPLDRG

SEQ ID NO: 524449 - protein, 15 aa, Mycobacterium
LSASQPTPKSTSRRR

SEQ ID NO: 524450 - protein, 10 aa, Mycobacterium
LSASQREADE

SEQ ID NO: 524451 - protein, 9 aa, Mycobacterium
LSASREAQR

SEQ ID NO: 524452 - protein, 6 aa, Mycobacterium
LSASRL

SEQ ID NO: 524453 - protein, 13 aa, Mycobacterium
LSASRPAGKAGSA

SEQ ID NO: 524454 - protein, 9 aa, Mycobacterium
LSASRRRSL

SEQ ID NO: 524455 - protein, 5 aa, Mycobacterium
LSASS

SEQ ID NO: 524456 - protein, 23 aa, Mycobacterium
LSASSATSSIRESQRQQSLTTKA

SEQ ID NO: 524457 - protein, 10 aa, Mycobacterium
LSATADPTQL

SEQ ID NO: 524458 - protein, 6 aa, Mycobacterium
LSATAG

SEQ ID NO: 524459 - protein, 8 aa, Mycobacterium
LSATANDY

SEQ ID NO: 524460 - protein, 6 aa, Mycobacterium
LSATDA

SEQ ID NO: 524461 - protein, 7 aa, Mycobacterium
LSATDGA

SEQ ID NO: 524462 - protein, 6 aa, Mycobacterium
LSATEA

SEQ ID NO: 524463 - protein, 18 aa, Mycobacterium
LSATGDDGRDRATVDIEL

SEQ ID NO: 524464 - protein, 17 aa, Mycobacterium
LSATGQPCASDPAYRGR

SEQ ID NO: 524465 - protein, 13 aa, Mycobacterium
LSATREVAGPGPL

SEQ ID NO: 524466 - protein, 13 aa, Mycobacterium
LSATSASGGDVDG

SEQ ID NO: 524467 - protein, 8 aa, Mycobacterium
LSATTRES

SEQ ID NO: 524468 - protein, 6 aa, Mycobacterium
LSAYSA

SEQ ID NO: 524469 - protein, 17 aa, Mycobacterium
LSDAAAAVTEAGTPDLA

SEQ ID NO: 524470 - protein, 6 aa, Mycobacterium
LSDAAK

SEQ ID NO: 524471 - protein, 8 aa, Mycobacterium
LSDADAAN

SEQ ID NO: 524472 - protein, 9 aa, Mycobacterium
LSDAEAAPM

SEQ ID NO: 524473 - protein, 8 aa, Mycobacterium
LSDAERDQ

SEQ ID NO: 524474 - protein, 8 aa, Mycobacterium
LSDAETAT

SEQ ID NO: 524475 - protein, 10 aa, Mycobacterium
LSDAETEQAV

SEQ ID NO: 524476 - protein, 7 aa, Mycobacterium
LSDAETS

SEQ ID NO: 524477 - protein, 6 aa, Mycobacterium
LSDAGA

SEQ ID NO: 524478 - protein, 9 aa, Mycobacterium
LSDAGPTGW

SEQ ID NO: 524479 - protein, 7 aa, Mycobacterium
LSDAGRT

SEQ ID NO: 524480 - protein, 8 aa, Mycobacterium
LSDAGTDE

SEQ ID NO: 524481 - protein, 5 aa, Mycobacterium
LSDAH

SEQ ID NO: 524482 - protein, 6 aa, Mycobacterium
LSDAPW

SEQ ID NO: 524483 - protein, 9 aa, Mycobacterium
LSDARPTTV

SEQ ID NO: 524484 - protein, 9 aa, Mycobacterium
LSDATAGAG

SEQ ID NO: 524485 - protein, 5 aa, Mycobacterium
LSDAV

SEQ ID NO: 524486 - protein, 6 aa, Mycobacterium
LSDAVE

SEQ ID NO: 524487 - protein, 18 aa, Mycobacterium
LSDAVRRNAEESPDRPAY

SEQ ID NO: 524488 - protein, 4 aa, Mycobacterium
LSDD

SEQ ID NO: 524489 - protein, 9 aa, Mycobacterium
LSDDDDLSA

SEQ ID NO: 524490 - protein, 7 aa, Mycobacterium
LSDDDVE

SEQ ID NO: 524491 - protein, 9 aa, Mycobacterium
LSDDEIRQR

SEQ ID NO: 524492 - protein, 10 aa, Mycobacterium
LSDDEKQAGD

SEQ ID NO: 524493 - protein, 9 aa, Mycobacterium
LSDDEKRAA

SEQ ID NO: 524494 - protein, 6 aa, Mycobacterium
LSDDEP

SEQ ID NO: 524495 - protein, 6 aa, Mycobacterium
LSDDEV

SEQ ID NO: 524496 - protein, 5 aa, Mycobacterium
LSDDG

SEQ ID NO: 524497 - protein, 6 aa, Mycobacterium
LSDDGD

SEQ ID NO: 524498 - protein, 7 aa, Mycobacterium
LSDDGRR

SEQ ID NO: 524499 - protein, 15 aa, Mycobacterium
LSDDHTVSAAPYGSA

SEQ ID NO: 524500 - protein, 9 aa, Mycobacterium
LSDDPAGPR

SEQ ID NO: 524501 - protein, 6 aa, Mycobacterium
LSDDPE

SEQ ID NO: 524502 - protein, 7 aa, Mycobacterium
LSDDPSL

SEQ ID NO: 524503 - protein, 12 aa, Mycobacterium
LSDDQRSQIEEV

SEQ ID NO: 524504 - protein, 9 aa, Mycobacterium
LSDDTTGDQ

SEQ ID NO: 524505 - protein, 4 aa, Mycobacterium
LSDE

SEQ ID NO: 524506 - protein, 7 aa, Mycobacterium
LSDEARR

SEQ ID NO: 524507 - protein, 18 aa, Mycobacterium
LSDEDPAAELAAGRTPKL

SEQ ID NO: 524508 - protein, 7 aa, Mycobacterium
LSDEDVE

SEQ ID NO: 524509 - protein, 5 aa, Mycobacterium
LSDEE

SEQ ID NO: 524510 - protein, 9 aa, Mycobacterium
LSDEETESS

SEQ ID NO: 524511 - protein, 14 aa, Mycobacterium
LSDEHAAASSTAHA

SEQ ID NO: 524512 - protein, 6 aa, Mycobacterium
LSDEHK

SEQ ID NO: 524513 - protein, 9 aa, Mycobacterium
LSDEPDFAG

SEQ ID NO: 524514 - protein, 7 aa, Mycobacterium
LSDEPVG

SEQ ID NO: 524515 - protein, 9 aa, Mycobacterium
LSDEQQSRF

SEQ ID NO: 524516 - protein, 11 aa, Mycobacterium
LSDEQRTQIEE

SEQ ID NO: 524517 - protein, 15 aa, Mycobacterium
LSDETGGNAARGTRG

SEQ ID NO: 524518 - protein, 8 aa, Mycobacterium
LSDGDDVR

SEQ ID NO: 524519 - protein, 15 aa, Mycobacterium
LSDGDLGNLSSDENG

SEQ ID NO: 524520 - protein, 9 aa, Mycobacterium
LSDGDSRDT

SEQ ID NO: 524521 - protein, 15 aa, Mycobacterium
LSDGDSVTILPAVAG

SEQ ID NO: 524522 - protein, 9 aa, Mycobacterium
LSDGEGDTA

SEQ ID NO: 524523 - protein, 7 aa, Mycobacterium
LSDGESD

SEQ ID NO: 524524 - protein, 6 aa, Mycobacterium
LSDGET

SEQ ID NO: 524525 - protein, 12 aa, Mycobacterium
LSDGGPDAAAAA

SEQ ID NO: 524526 - protein, 12 aa, Mycobacterium
LSDGGPDAAERA

SEQ ID NO: 524527 - protein, 8 aa, Mycobacterium
LSDGGTLE

SEQ ID NO: 524528 - protein, 9 aa, Mycobacterium
LSDGIKDDI

SEQ ID NO: 524529 - protein, 18 aa, Mycobacterium
LSDGNAVSATANGFGNTA

SEQ ID NO: 524530 - protein, 8 aa, Mycobacterium
LSDGQANA

SEQ ID NO: 524531 - protein, 5 aa, Mycobacterium
LSDGR

SEQ ID NO: 524532 - protein, 7 aa, Mycobacterium
LSDGRAG

SEQ ID NO: 524533 - protein, 21 aa, Mycobacterium
LSDGSAETEITLPDEAPRHPG

SEQ ID NO: 524534 - protein, 16 aa, Mycobacterium
LSDGSVTVPTASTPKA

SEQ ID NO: 524535 - protein, 5 aa, Mycobacterium
LSDGT

SEQ ID NO: 524536 - protein, 8 aa, Mycobacterium
LSDGTPAP

SEQ ID NO: 524537 - protein, 10 aa, Mycobacterium
LSDGTPAPTL

SEQ ID NO: 524538 - protein, 8 aa, Mycobacterium
LSDGTRLD

SEQ ID NO: 524539 - protein, 13 aa, Mycobacterium
LSDGYAGPRSAGT

SEQ ID NO: 524540 - protein, 7 aa, Mycobacterium
LSDHGAA

SEQ ID NO: 524541 - protein, 16 aa, Mycobacterium
LSDHSVPDRGRHPLPS

SEQ ID NO: 524542 - protein, 7 aa, Mycobacterium
LSDKDIA

SEQ ID NO: 524543 - protein, 5 aa, Mycobacterium
LSDKS

SEQ ID NO: 524544 - protein, 7 aa, Mycobacterium
LSDLGRA

SEQ ID NO: 524545 - protein, 13 aa, Mycobacterium
LSDLGRDQAAAAA

SEQ ID NO: 524546 - protein, 5 aa, Mycobacterium
LSDLQ

SEQ ID NO: 524547 - protein, 10 aa, Mycobacterium
LSDNAQPGVR

SEQ ID NO: 524548 - protein, 6 aa, Mycobacterium
LSDNDL

SEQ ID NO: 524549 - protein, 5 aa, Mycobacterium
LSDNE

SEQ ID NO: 524550 - protein, 5 aa, Mycobacterium
LSDPA

SEQ ID NO: 524551 - protein, 6 aa, Mycobacterium
LSDPAA

SEQ ID NO: 524552 - protein, 7 aa, Mycobacterium
LSDPAEN

SEQ ID NO: 524553 - protein, 7 aa, Mycobacterium
LSDPAEQ

SEQ ID NO: 524554 - protein, 13 aa, Mycobacterium
LSDPARDRLAESG

SEQ ID NO: 524555 - protein, 7 aa, Mycobacterium
LSDPEDL

SEQ ID NO: 524556 - protein, 6 aa, Mycobacterium
LSDPGL

SEQ ID NO: 524557 - protein, 9 aa, Mycobacterium
LSDPGPADC

SEQ ID NO: 524558 - protein, 8 aa, Mycobacterium
LSDPGPAV

SEQ ID NO: 524559 - protein, 7 aa, Mycobacterium
LSDPGQV

SEQ ID NO: 524560 - protein, 16 aa, Mycobacterium
LSDPGVVTSGDVSTAF

SEQ ID NO: 524561 - protein, 7 aa, Mycobacterium
LSDPHGY

SEQ ID NO: 524562 - protein, 15 aa, Mycobacterium
LSDPPAGMAPGRAEN

SEQ ID NO: 524563 - protein, 9 aa, Mycobacterium
LSDPPDVSA

SEQ ID NO: 524564 - protein, 10 aa, Mycobacterium
LSDPPPPTDD

SEQ ID NO: 524565 - protein, 6 aa, Mycobacterium
LSDPPS

SEQ ID NO: 524566 - protein, 8 aa, Mycobacterium
LSDPPSAI

SEQ ID NO: 524567 - protein, 18 aa, Mycobacterium
LSDPPSDMAPGRAKDLSN

SEQ ID NO: 524568 - protein, 6 aa, Mycobacterium
LSDPRG

SEQ ID NO: 524569 - protein, 8 aa, Mycobacterium
LSDPRGAD

SEQ ID NO: 524570 - protein, 9 aa, Mycobacterium
LSDPRQAKA

SEQ ID NO: 524571 - protein, 8 aa, Mycobacterium
LSDPSGYG

SEQ ID NO: 524572 - protein, 10 aa, Mycobacterium
LSDPSPREVA

SEQ ID NO: 524573 - protein, 7 aa, Mycobacterium
LSDPSRL

SEQ ID NO: 524574 - protein, 8 aa, Mycobacterium
LSDPTDDH

SEQ ID NO: 524575 - protein, 7 aa, Mycobacterium
LSDPVQA

SEQ ID NO: 524576 - protein, 6 aa, Mycobacterium
LSDQDV

SEQ ID NO: 524577 - protein, 6 aa, Mycobacterium
LSDQEL

SEQ ID NO: 524578 - protein, 15 aa, Mycobacterium
LSDQVAKQARDSNFG

SEQ ID NO: 524579 - protein, 10 aa, Mycobacterium
LSDRADIAPE

SEQ ID NO: 524580 - protein, 7 aa, Mycobacterium
LSDRDDV

SEQ ID NO: 524581 - protein, 9 aa, Mycobacterium
LSDRQDLET

SEQ ID NO: 524582 - protein, 7 aa, Mycobacterium
LSDRRNR

SEQ ID NO: 524583 - protein, 17 aa, Mycobacterium
LSDRRRRAIGGRRPDRH

SEQ ID NO: 524584 - protein, 8 aa, Mycobacterium
LSDSAQLE

SEQ ID NO: 524585 - protein, 12 aa, Mycobacterium
LSDSDNSTTVDG

SEQ ID NO: 524586 - protein, 8 aa, Mycobacterium
LSDSERQE

SEQ ID NO: 524587 - protein, 8 aa, Mycobacterium
LSDSGPSV

SEQ ID NO: 524588 - protein, 5 aa, Mycobacterium
LSDSK

SEQ ID NO: 524589 - protein, 8 aa, Mycobacterium
LSDSQKKL

SEQ ID NO: 524590 - protein, 5 aa, Mycobacterium
LSDSS

SEQ ID NO: 524591 - protein, 8 aa, Mycobacterium
LSDTDARE

SEQ ID NO: 524592 - protein, 9 aa, Mycobacterium
LSDTDNQET

SEQ ID NO: 524593 - protein, 7 aa, Mycobacterium
LSDTQKK

SEQ ID NO: 524594 - protein, 6 aa, Mycobacterium
LSDVTR

SEQ ID NO: 524595 - protein, 4 aa, Mycobacterium
LSEA

SEQ ID NO: 524596 - protein, 7 aa, Mycobacterium
LSEAADA

SEQ ID NO: 524597 - protein, 12 aa, Mycobacterium
LSEAAGRDPADI

SEQ ID NO: 524598 - protein, 5 aa, Mycobacterium
LSEAD

SEQ ID NO: 524599 - protein, 14 aa, Mycobacterium
LSEADYRTATNEGG

SEQ ID NO: 524600 - protein, 15 aa, Mycobacterium
LSEADYRTATNQGRR

SEQ ID NO: 524601 - protein, 5 aa, Mycobacterium
LSEAE

SEQ ID NO: 524602 - protein, 21 aa, Mycobacterium
LSEAEKLADEVGRRRGAYEDK

SEQ ID NO: 524603 - protein, 6 aa, Mycobacterium
LSEAEQ

SEQ ID NO: 524604 - protein, 6 aa, Mycobacterium
LSEAER

SEQ ID NO: 524605 - protein, 13 aa, Mycobacterium
LSEAGGGDPPSAY

SEQ ID NO: 524606 - protein, 28 aa, Mycobacterium
LSEAGGGDPRGDRERGAAGRSGSPPSAY

SEQ ID NO: 524607 - protein, 9 aa, Mycobacterium
LSEAGSRAE

SEQ ID NO: 524608 - protein, 10 aa, Mycobacterium
LSEAGSRSEM

SEQ ID NO: 524609 - protein, 7 aa, Mycobacterium
LSEAGYT

SEQ ID NO: 524610 - protein, 7 aa, Mycobacterium
LSEANAK

SEQ ID NO: 524611 - protein, 7 aa, Mycobacterium
LSEANRK

SEQ ID NO: 524612 - protein, 9 aa, Mycobacterium
LSEAPSDLP

SEQ ID NO: 524613 - protein, 7 aa, Mycobacterium
LSEAPTH

SEQ ID NO: 524614 - protein, 7 aa, Mycobacterium
LSEAQTD

SEQ ID NO: 524615 - protein, 20 aa, Mycobacterium
LSEASEGSPQDIAKDRAGQL

SEQ ID NO: 524616 - protein, 9 aa, Mycobacterium
LSEASGGRF

SEQ ID NO: 524617 - protein, 14 aa, Mycobacterium
LSEATAAAAGPTTA

SEQ ID NO: 524618 - protein, 14 aa, Mycobacterium
LSEATAAAAGPTTD

SEQ ID NO: 524619 - protein, 6 aa, Mycobacterium
LSEATR

SEQ ID NO: 524620 - protein, 10 aa, Mycobacterium
LSEATRESLE

SEQ ID NO: 524621 - protein, 5 aa, Mycobacterium
LSEDD

SEQ ID NO: 524622 - protein, 8 aa, Mycobacterium
LSEDDAVA

SEQ ID NO: 524623 - protein, 7 aa, Mycobacterium
LSEDDRP

SEQ ID NO: 524624 - protein, 5 aa, Mycobacterium
LSEDE

SEQ ID NO: 524625 - protein, 10 aa, Mycobacterium
LSEDETERAV

SEQ ID NO: 524626 - protein, 11 aa, Mycobacterium
LSEDNEMSEGV

SEQ ID NO: 524627 - protein, 8 aa, Mycobacterium
LSEDPATS

SEQ ID NO: 524628 - protein, 6 aa, Mycobacterium
LSEDPD

SEQ ID NO: 524629 - protein, 6 aa, Mycobacterium
LSEDPE

SEQ ID NO: 524630 - protein, 7 aa, Mycobacterium
LSEDPPV

SEQ ID NO: 524631 - protein, 6 aa, Mycobacterium
LSEDPR

SEQ ID NO: 524632 - protein, 6 aa, Mycobacterium
LSEDPS

SEQ ID NO: 524633 - protein, 10 aa, Mycobacterium
LSEDPSDTTV

SEQ ID NO: 524634 - protein, 9 aa, Mycobacterium
LSEDTKTDG

SEQ ID NO: 524635 - protein, 9 aa, Mycobacterium
LSEDTPARY

SEQ ID NO: 524636 - protein, 4 aa, Mycobacterium
LSEE

SEQ ID NO: 524637 - protein, 11 aa, Mycobacterium
LSEEAAITGAQ

SEQ ID NO: 524638 - protein, 9 aa, Mycobacterium
LSEEEKDDW

SEQ ID NO: 524639 - protein, 8 aa, Mycobacterium
LSEEEKER

SEQ ID NO: 524640 - protein, 8 aa, Mycobacterium
LSEEETTF

SEQ ID NO: 524641 - protein, 12 aa, Mycobacterium
LSEEGADDPVRV

SEQ ID NO: 524642 - protein, 11 aa, Mycobacterium
LSEEGADNPVR

SEQ ID NO: 524643 - protein, 8 aa, Mycobacterium
LSEEGHAP

SEQ ID NO: 524644 - protein, 14 aa, Mycobacterium
LSEEGSDDTLDAGR

SEQ ID NO: 524645 - protein, 8 aa, Mycobacterium
LSEEHEAK

SEQ ID NO: 524646 - protein, 13 aa, Mycobacterium
LSEELTVVETALP

SEQ ID NO: 524647 - protein, 9 aa, Mycobacterium
LSEEPSRSA

SEQ ID NO: 524648 - protein, 10 aa, Mycobacterium
LSEEQARERG

SEQ ID NO: 524649 - protein, 4 aa, Mycobacterium
LSEG

SEQ ID NO: 524650 - protein, 7 aa, Mycobacterium
LSEGAGT

SEQ ID NO: 524651 - protein, 15 aa, Mycobacterium
LSEGASLVTEDESSK

SEQ ID NO: 524652 - protein, 8 aa, Mycobacterium
LSEGDDPV

SEQ ID NO: 524653 - protein, 11 aa, Mycobacterium
LSEGEGALASS

SEQ ID NO: 524654 - protein, 8 aa, Mycobacterium
LSEGERAR

SEQ ID NO: 524655 - protein, 7 aa, Mycobacterium
LSEGESD

SEQ ID NO: 524656 - protein, 12 aa, Mycobacterium
LSEGGDNAADEW

SEQ ID NO: 524657 - protein, 12 aa, Mycobacterium
LSEGGPDAAQRA

SEQ ID NO: 524658 - protein, 6 aa, Mycobacterium
LSEGPG

SEQ ID NO: 524659 - protein, 8 aa, Mycobacterium
LSEGPGES

SEQ ID NO: 524660 - protein, 9 aa, Mycobacterium
LSEGPGESW

SEQ ID NO: 524661 - protein, 7 aa, Mycobacterium
LSEGRQA

SEQ ID NO: 524662 - protein, 18 aa, Mycobacterium
LSEGSAGTFPTVNPATEE

SEQ ID NO: 524663 - protein, 7 aa, Mycobacterium
LSEGSGH

SEQ ID NO: 524664 - protein, 4 aa, Mycobacterium
LSEH

SEQ ID NO: 524665 - protein, 5 aa, Mycobacterium
LSEKE

SEQ ID NO: 524666 - protein, 10 aa, Mycobacterium
LSEKSERARK

SEQ ID NO: 524667 - protein, 4 aa, Mycobacterium
LSEL

SEQ ID NO: 524668 - protein, 7 aa, Mycobacterium
LSELPEA

SEQ ID NO: 524669 - protein, 5 aa, Mycobacterium
LSELT

SEQ ID NO: 524670 - protein, 12 aa, Mycobacterium
LSENKTPSLAEA

SEQ ID NO: 524671 - protein, 6 aa, Mycobacterium
LSENPD

SEQ ID NO: 524672 - protein, 6 aa, Mycobacterium
LSENSN

SEQ ID NO: 524673 - protein, 8 aa, Mycobacterium
LSENVDEA

SEQ ID NO: 524674 - protein, 7 aa, Mycobacterium
LSEPAAA

SEQ ID NO: 524675 - protein, 7 aa, Mycobacterium
LSEPASE

SEQ ID NO: 524676 - protein, 25 aa, Mycobacterium
LSEPDAEHNWDSDRRNAELDSDGVA

SEQ ID NO: 524677 - protein, 6 aa, Mycobacterium
LSEPEQ

SEQ ID NO: 524678 - protein, 7 aa, Mycobacterium
LSEPGDG

SEQ ID NO: 524679 - protein, 16 aa, Mycobacterium
LSEPGRHLPQQPATTF

SEQ ID NO: 524680 - protein, 12 aa, Mycobacterium
LSEPQAGSDAAA

SEQ ID NO: 524681 - protein, 10 aa, Mycobacterium
LSEPQYASRT

SEQ ID NO: 524682 - protein, 15 aa, Mycobacterium
LSEPRHTPRTDTNAA

SEQ ID NO: 524683 - protein, 25 aa, Mycobacterium
LSEPSAPGRGVSSTMPQKRNPIGSQ

SEQ ID NO: 524684 - protein, 6 aa, Mycobacterium
LSEPSK

SEQ ID NO: 524685 - protein, 9 aa, Mycobacterium
LSEPSKAEV

SEQ ID NO: 524686 - protein, 20 aa, Mycobacterium
LSEPTADNRGGSSSMPHKRN

SEQ ID NO: 524687 - protein, 9 aa, Mycobacterium
LSEPTRNTL

SEQ ID NO: 524688 - protein, 4 aa, Mycobacterium
LSEQ

SEQ ID NO: 524689 - protein, 19 aa, Mycobacterium
LSEQAASLAPEAYAATLGS

SEQ ID NO: 524690 - protein, 5 aa, Mycobacterium
LSEQD

SEQ ID NO: 524691 - protein, 18 aa, Mycobacterium
LSEQGAAPAKTLRADEAL

SEQ ID NO: 524692 - protein, 8 aa, Mycobacterium
LSEQGLGD

SEQ ID NO: 524693 - protein, 7 aa, Mycobacterium
LSEQPDQ

SEQ ID NO: 524694 - protein, 7 aa, Mycobacterium
LSEQRNA

SEQ ID NO: 524695 - protein, 10 aa, Mycobacterium
LSEQTQERES

SEQ ID NO: 524696 - protein, 5 aa, Mycobacterium
LSERA

SEQ ID NO: 524697 - protein, 6 aa, Mycobacterium
LSERAG

SEQ ID NO: 524698 - protein, 9 aa, Mycobacterium
LSEREREEL

SEQ ID NO: 524699 - protein, 8 aa, Mycobacterium
LSERTGLP

SEQ ID NO: 524700 - protein, 7 aa, Mycobacterium
LSERTND

SEQ ID NO: 524701 - protein, 5 aa, Mycobacterium
LSERV

SEQ ID NO: 524702 - protein, 4 aa, Mycobacterium
LSES

SEQ ID NO: 524703 - protein, 6 aa, Mycobacterium
LSESAD

SEQ ID NO: 524704 - protein, 8 aa, Mycobacterium
LSESASEI

SEQ ID NO: 524705 - protein, 7 aa, Mycobacterium
LSESDTP

SEQ ID NO: 524706 - protein, 10 aa, Mycobacterium
LSESEEADAI

SEQ ID NO: 524707 - protein, 9 aa, Mycobacterium
LSESEHRRT

SEQ ID NO: 524708 - protein, 11 aa, Mycobacterium
LSESERAQRRL

SEQ ID NO: 524709 - protein, 9 aa, Mycobacterium
LSESGLGDS

SEQ ID NO: 524710 - protein, 9 aa, Mycobacterium
LSESLGETL

SEQ ID NO: 524711 - protein, 10 aa, Mycobacterium
LSESLGSQRF

SEQ ID NO: 524712 - protein, 7 aa, Mycobacterium
LSESSPV

SEQ ID NO: 524713 - protein, 16 aa, Mycobacterium
LSETAAAARGIGAGDE

SEQ ID NO: 524714 - protein, 9 aa, Mycobacterium
LSETADPTA

SEQ ID NO: 524715 - protein, 5 aa, Mycobacterium
LSETD

SEQ ID NO: 524716 - protein, 7 aa, Mycobacterium
LSETDAQ

SEQ ID NO: 524717 - protein, 8 aa, Mycobacterium
LSETGDVA

SEQ ID NO: 524718 - protein, 7 aa, Mycobacterium
LSETGHS

SEQ ID NO: 524719 - protein, 7 aa, Mycobacterium
LSETPEA

SEQ ID NO: 524720 - protein, 6 aa, Mycobacterium
LSETTL

SEQ ID NO: 524721 - protein, 12 aa, Mycobacterium
LSEVSDSVGVPT

SEQ ID NO: 524722 - protein, 10 aa, Mycobacterium
LSEVSSEDWQ

SEQ ID NO: 524723 - protein, 13 aa, Mycobacterium
LSEVTEDDIREAA

SEQ ID NO: 524724 - protein, 4 aa, Mycobacterium
LSEY

SEQ ID NO: 524725 - protein, 7 aa, Mycobacterium
LSEYADS

SEQ ID NO: 524726 - protein, 9 aa, Mycobacterium
LSFGEGTRT

SEQ ID NO: 524727 - protein, 10 aa, Mycobacterium
LSFTGAASAA

SEQ ID NO: 524728 - protein, 21 aa, Mycobacterium
LSGAAARRTAAARRLLGVLRE

SEQ ID NO: 524729 - protein, 18 aa, Mycobacterium
LSGAAGGLNQPVNTASRH

SEQ ID NO: 524730 - protein, 8 aa, Mycobacterium
LSGADTEW

SEQ ID NO: 524731 - protein, 8 aa, Mycobacterium
LSGAEAER

SEQ ID NO: 524732 - protein, 9 aa, Mycobacterium
LSGAGGGNF

SEQ ID NO: 524733 - protein, 8 aa, Mycobacterium
LSGAGGPV

SEQ ID NO: 524734 - protein, 6 aa, Mycobacterium
LSGAGL

SEQ ID NO: 524735 - protein, 14 aa, Mycobacterium
LSGAGSGAEVEGGV

SEQ ID NO: 524736 - protein, 7 aa, Mycobacterium
LSGANEE

SEQ ID NO: 524737 - protein, 7 aa, Mycobacterium
LSGAPAT

SEQ ID NO: 524738 - protein, 22 aa, Mycobacterium
LSGAPDDADASAHSAADSLGRA

SEQ ID NO: 524739 - protein, 8 aa, Mycobacterium
LSGAPGLD

SEQ ID NO: 524740 - protein, 21 aa, Mycobacterium
LSGARTTGARLDGADLRGATV

SEQ ID NO: 524741 - protein, 27 aa, Mycobacterium
LSGASADASDQVDDDVDDSWADEDSWR

SEQ ID NO: 524742 - protein, 26 aa, Mycobacterium
LSGASPDTSDQVDDTEDSWDDEESWR

SEQ ID NO: 524743 - protein, 7 aa, Mycobacterium
LSGASVG

SEQ ID NO: 524744 - protein, 7 aa, Mycobacterium
LSGASYG

SEQ ID NO: 524745 - protein, 8 aa, Mycobacterium
LSGCATGN

SEQ ID NO: 524746 - protein, 12 aa, Mycobacterium
LSGDAPAATPLT

SEQ ID NO: 524747 - protein, 8 aa, Mycobacterium
LSGDAPSW

SEQ ID NO: 524748 - protein, 8 aa, Mycobacterium
LSGDDEIG

SEQ ID NO: 524749 - protein, 5 aa, Mycobacterium
LSGDE

SEQ ID NO: 524750 - protein, 9 aa, Mycobacterium
LSGDEKDEV

SEQ ID NO: 524751 - protein, 6 aa, Mycobacterium
LSGDGR

SEQ ID NO: 524752 - protein, 5 aa, Mycobacterium
LSGDH

SEQ ID NO: 524753 - protein, 5 aa, Mycobacterium
LSGDP

SEQ ID NO: 524754 - protein, 12 aa, Mycobacterium
LSGDPNIAATPI

SEQ ID NO: 524755 - protein, 13 aa, Mycobacterium
LSGDPNTTATPIG

SEQ ID NO: 524756 - protein, 8 aa, Mycobacterium
LSGDPQFT

SEQ ID NO: 524757 - protein, 7 aa, Mycobacterium
LSGDPQL

SEQ ID NO: 524758 - protein, 6 aa, Mycobacterium
LSGDPR

SEQ ID NO: 524759 - protein, 9 aa, Mycobacterium
LSGDPSAGY

SEQ ID NO: 524760 - protein, 12 aa, Mycobacterium
LSGDPSVRATPI

SEQ ID NO: 524761 - protein, 7 aa, Mycobacterium
LSGDPTL

SEQ ID NO: 524762 - protein, 8 aa, Mycobacterium
LSGDQQRA

SEQ ID NO: 524763 - protein, 26 aa, Mycobacterium
LSGDQRRALENTTTVTARRKGRPELS

SEQ ID NO: 524764 - protein, 18 aa, Mycobacterium
LSGDRRTYQQEPGNAREA

SEQ ID NO: 524765 - protein, 15 aa, Mycobacterium
LSGDRRTYQQEPGNM

SEQ ID NO: 524766 - protein, 15 aa, Mycobacterium
LSGDRSSNDIDPAPL

SEQ ID NO: 524767 - protein, 8 aa, Mycobacterium
LSGEAGIS

SEQ ID NO: 524768 - protein, 16 aa, Mycobacterium
LSGEALAEARSRLNPA

SEQ ID NO: 524769 - protein, 9 aa, Mycobacterium
LSGEALTDT

SEQ ID NO: 524770 - protein, 8 aa, Mycobacterium
LSGEEAER

SEQ ID NO: 524771 - protein, 7 aa, Mycobacterium
LSGEEDS

SEQ ID NO: 524772 - protein, 10 aa, Mycobacterium
LSGEGGPADI

SEQ ID NO: 524773 - protein, 8 aa, Mycobacterium
LSGEGSRR

SEQ ID NO: 524774 - protein, 5 aa, Mycobacterium
LSGEP

SEQ ID NO: 524775 - protein, 9 aa, Mycobacterium
LSGEPARTG

SEQ ID NO: 524776 - protein, 8 aa, Mycobacterium
LSGEPEYK

SEQ ID NO: 524777 - protein, 7 aa, Mycobacterium
LSGEPGV

SEQ ID NO: 524778 - protein, 10 aa, Mycobacterium
LSGEPRRDPI

SEQ ID NO: 524779 - protein, 7 aa, Mycobacterium
LSGEQAE

SEQ ID NO: 524780 - protein, 9 aa, Mycobacterium
LSGEQARDL

SEQ ID NO: 524781 - protein, 6 aa, Mycobacterium
LSGERA

SEQ ID NO: 524782 - protein, 5 aa, Mycobacterium
LSGES

SEQ ID NO: 524783 - protein, 6 aa, Mycobacterium
LSGESL

SEQ ID NO: 524784 - protein, 8 aa, Mycobacterium
LSGETPRC

SEQ ID NO: 524785 - protein, 13 aa, Mycobacterium
LSGFGGAGPMAAA

SEQ ID NO: 524786 - protein, 28 aa, Mycobacterium
LSGGAGPHGGSAVATNGRVHDAVLAALD

SEQ ID NO: 524787 - protein, 25 aa, Mycobacterium
LSGGDERRAPAPPEPEPEPREPRVT

SEQ ID NO: 524788 - protein, 22 aa, Mycobacterium
LSGGDIGTAAAETKAIATGDPR

SEQ ID NO: 524789 - protein, 10 aa, Mycobacterium
LSGGDRRAGA

SEQ ID NO: 524790 - protein, 5 aa, Mycobacterium
LSGGE

SEQ ID NO: 524791 - protein, 13 aa, Mycobacterium
LSGGELATDLVAA

SEQ ID NO: 524792 - protein, 7 aa, Mycobacterium
LSGGERL

SEQ ID NO: 524793 - protein, 8 aa, Mycobacterium
LSGGERQR

SEQ ID NO: 524794 - protein, 5 aa, Mycobacterium
LSGGG

SEQ ID NO: 524795 - protein, 11 aa, Mycobacterium
LSGGGAGNSDL

SEQ ID NO: 524796 - protein, 7 aa, Mycobacterium
LSGGGAV

SEQ ID NO: 524797 - protein, 6 aa, Mycobacterium
LSGGGE

SEQ ID NO: 524798 - protein, 8 aa, Mycobacterium
LSGGGEAL

SEQ ID NO: 524799 - protein, 9 aa, Mycobacterium
LSGGGGCDP

SEQ ID NO: 524800 - protein, 7 aa, Mycobacterium
LSGGGGH

SEQ ID NO: 524801 - protein, 8 aa, Mycobacterium
LSGGGKEV

SEQ ID NO: 524802 - protein, 13 aa, Mycobacterium
LSGGGSGGGEAGV

SEQ ID NO: 524803 - protein, 8 aa, Mycobacterium
LSGGGSPE

SEQ ID NO: 524804 - protein, 7 aa, Mycobacterium
LSGGGTA

SEQ ID NO: 524805 - protein, 19 aa, Mycobacterium
LSGGGTRTYDDASTYTENT

SEQ ID NO: 524806 - protein, 16 aa, Mycobacterium
LSGGKAVAEVGTGAGV

SEQ ID NO: 524807 - protein, 5 aa, Mycobacterium
LSGGN

SEQ ID NO: 524808 - protein, 7 aa, Mycobacterium
LSGGNQQ

SEQ ID NO: 524809 - protein, 8 aa, Mycobacterium
LSGGNQQK

SEQ ID NO: 524810 - protein, 8 aa, Mycobacterium
LSGGNSGL

SEQ ID NO: 524811 - protein, 8 aa, Mycobacterium
LSGGPLRA

SEQ ID NO: 524812 - protein, 6 aa, Mycobacterium
LSGGQA

SEQ ID NO: 524813 - protein, 8 aa, Mycobacterium
LSGGQAAR

SEQ ID NO: 524814 - protein, 7 aa, Mycobacterium
LSGGQAI

SEQ ID NO: 524815 - protein, 16 aa, Mycobacterium
LSGGQEIETNRTSQRG

SEQ ID NO: 524816 - protein, 9 aa, Mycobacterium
LSGGQQQRV

SEQ ID NO: 524817 - protein, 8 aa, Mycobacterium
LSGGQRAR

SEQ ID NO: 524818 - protein, 7 aa, Mycobacterium
LSGGQRK

SEQ ID NO: 524819 - protein, 8 aa, Mycobacterium
LSGGQRQQ

SEQ ID NO: 524820 - protein, 8 aa, Mycobacterium
LSGGQRTR

SEQ ID NO: 524821 - protein, 9 aa, Mycobacterium
LSGGQRTRA

SEQ ID NO: 524822 - protein, 16 aa, Mycobacterium
LSGGQSTPGGGDNPLG

SEQ ID NO: 524823 - protein, 5 aa, Mycobacterium
LSGGR

SEQ ID NO: 524824 - protein, 6 aa, Mycobacterium
LSGGRG

SEQ ID NO: 524825 - protein, 7 aa, Mycobacterium
LSGGTEE

SEQ ID NO: 524826 - protein, 16 aa, Mycobacterium
LSGGTPKDRKGKPRYD

SEQ ID NO: 524827 - protein, 10 aa, Mycobacterium
LSGGTRPASL

SEQ ID NO: 524828 - protein, 16 aa, Mycobacterium
LSGGTTSASGGVATPG

SEQ ID NO: 524829 - protein, 14 aa, Mycobacterium
LSGGYRLDSDPKTV

SEQ ID NO: 524830 - protein, 5 aa, Mycobacterium
LSGHA

SEQ ID NO: 524831 - protein, 13 aa, Mycobacterium
LSGHGDSGTRDSY

SEQ ID NO: 524832 - protein, 7 aa, Mycobacterium
LSGIGPE

SEQ ID NO: 524833 - protein, 5 aa, Mycobacterium
LSGIP

SEQ ID NO: 524834 - protein, 11 aa, Mycobacterium
LSGKDGTVTVG

SEQ ID NO: 524835 - protein, 6 aa, Mycobacterium
LSGKGT

SEQ ID NO: 524836 - protein, 5 aa, Mycobacterium
LSGKN

SEQ ID NO: 524837 - protein, 12 aa, Mycobacterium
LSGKPGTPEAAR

SEQ ID NO: 524838 - protein, 8 aa, Mycobacterium
LSGKPPHP

SEQ ID NO: 524839 - protein, 13 aa, Mycobacterium
LSGKPREERVESE

SEQ ID NO: 524840 - protein, 10 aa, Mycobacterium
LSGKQIPVSG

SEQ ID NO: 524841 - protein, 12 aa, Mycobacterium
LSGKRAARRVNE

SEQ ID NO: 524842 - protein, 6 aa, Mycobacterium
LSGKTR

SEQ ID NO: 524843 - protein, 5 aa, Mycobacterium
LSGLE

SEQ ID NO: 524844 - protein, 6 aa, Mycobacterium
LSGLGT

SEQ ID NO: 524845 - protein, 5 aa, Mycobacterium
LSGLP

SEQ ID NO: 524846 - protein, 7 aa, Mycobacterium
LSGLRPD

SEQ ID NO: 524847 - protein, 5 aa, Mycobacterium
LSGMG

SEQ ID NO: 524848 - protein, 19 aa, Mycobacterium
LSGMPGPLGTVADKSKGLV

SEQ ID NO: 524849 - protein, 10 aa, Mycobacterium
LSGNAPEDIQ

SEQ ID NO: 524850 - protein, 6 aa, Mycobacterium
LSGNKL

SEQ ID NO: 524851 - protein, 15 aa, Mycobacterium
LSGNPDTRGGSTIEQ

SEQ ID NO: 524852 - protein, 7 aa, Mycobacterium
LSGNPSL

SEQ ID NO: 524853 - protein, 6 aa, Mycobacterium
LSGNST

SEQ ID NO: 524854 - protein, 10 aa, Mycobacterium
LSGNSTNIGG

SEQ ID NO: 524855 - protein, 8 aa, Mycobacterium
LSGNTGRE

SEQ ID NO: 524856 - protein, 10 aa, Mycobacterium
LSGNTQESVR

SEQ ID NO: 524857 - protein, 9 aa, Mycobacterium
LSGPAARRV

SEQ ID NO: 524858 - protein, 10 aa, Mycobacterium
LSGPAGRFGE

SEQ ID NO: 524859 - protein, 35 aa, Mycobacterium
LSGPAKEALGRGASEVGTSTTTGDGGMTPEERGQS

SEQ ID NO: 524860 - protein, 9 aa, Mycobacterium
LSGPATDLE

SEQ ID NO: 524861 - protein, 9 aa, Mycobacterium
LSGPDGPPR

SEQ ID NO: 524862 - protein, 8 aa, Mycobacterium
LSGPDGRP

SEQ ID NO: 524863 - protein, 9 aa, Mycobacterium
LSGPDPDEA

SEQ ID NO: 524864 - protein, 12 aa, Mycobacterium
LSGPDQVTENLE

SEQ ID NO: 524865 - protein, 8 aa, Mycobacterium
LSGPDRET

SEQ ID NO: 524866 - protein, 8 aa, Mycobacterium
LSGPDWTP

SEQ ID NO: 524867 - protein, 5 aa, Mycobacterium
LSGPE

SEQ ID NO: 524868 - protein, 6 aa, Mycobacterium
LSGPER

SEQ ID NO: 524869 - protein, 7 aa, Mycobacterium
LSGPESI

SEQ ID NO: 524870 - protein, 5 aa, Mycobacterium
LSGPG

SEQ ID NO: 524871 - protein, 11 aa, Mycobacterium
LSGPGAEQPWQ

SEQ ID NO: 524872 - protein, 10 aa, Mycobacterium
LSGPGPVSLE

SEQ ID NO: 524873 - protein, 9 aa, Mycobacterium
LSGPGQGQV

SEQ ID NO: 524874 - protein, 6 aa, Mycobacterium
LSGPGS

SEQ ID NO: 524875 - protein, 10 aa, Mycobacterium
LSGPGVTAAQ

SEQ ID NO: 524876 - protein, 10 aa, Mycobacterium
LSGPHQPAPA

SEQ ID NO: 524877 - protein, 5 aa, Mycobacterium
LSGPL

SEQ ID NO: 524878 - protein, 15 aa, Mycobacterium
LSGPNEFRSEDGRTA

SEQ ID NO: 524879 - protein, 6 aa, Mycobacterium
LSGPPC

SEQ ID NO: 524880 - protein, 10 aa, Mycobacterium
LSGPPDTSWD

SEQ ID NO: 524881 - protein, 15 aa, Mycobacterium
LSGPPNGSGPSVTPP

SEQ ID NO: 524882 - protein, 9 aa, Mycobacterium
LSGPPYDGP

SEQ ID NO: 524883 - protein, 5 aa, Mycobacterium
LSGPQ

SEQ ID NO: 524884 - protein, 9 aa, Mycobacterium
LSGPSGPPV

SEQ ID NO: 524885 - protein, 10 aa, Mycobacterium
LSGPVPSEED

SEQ ID NO: 524886 - protein, 8 aa, Mycobacterium
LSGQAADG

SEQ ID NO: 524887 - protein, 18 aa, Mycobacterium
LSGQAADPFKIPPGTASG

SEQ ID NO: 524888 - protein, 18 aa, Mycobacterium
LSGQAPTDALSDGRAGTP

SEQ ID NO: 524889 - protein, 10 aa, Mycobacterium
LSGQDEAALQ

SEQ ID NO: 524890 - protein, 10 aa, Mycobacterium
LSGQDETTLQ

SEQ ID NO: 524891 - protein, 12 aa, Mycobacterium
LSGQDSKRGTFT

SEQ ID NO: 524892 - protein, 5 aa, Mycobacterium
LSGQG

SEQ ID NO: 524893 - protein, 7 aa, Mycobacterium
LSGQGTS

SEQ ID NO: 524894 - protein, 6 aa, Mycobacterium
LSGQHR

SEQ ID NO: 524895 - protein, 26 aa, Mycobacterium
LSGQREPGPAPSFQEYPDEPAEAAAV

SEQ ID NO: 524896 - protein, 8 aa, Mycobacterium
LSGRAPAR

SEQ ID NO: 524897 - protein, 15 aa, Mycobacterium
LSGREAEPGLPARTE

SEQ ID NO: 524898 - protein, 34 aa, Mycobacterium
LSGRGSAQPDPAAAADPSATQPNGQTDATHVAGP

SEQ ID NO: 524899 - protein, 51 aa, Mycobacterium
LSGRGTDARLERSERVGAAERKAARRQRRTGDDAERSDAEERRRTRGGGEE

SEQ ID NO: 524900 - protein, 8 aa, Mycobacterium
LSGRKPAR

SEQ ID NO: 524901 - protein, 8 aa, Mycobacterium
LSGRPAST

SEQ ID NO: 524902 - protein, 8 aa, Mycobacterium
LSGRPDTL

SEQ ID NO: 524903 - protein, 7 aa, Mycobacterium
LSGRQRK

SEQ ID NO: 524904 - protein, 19 aa, Mycobacterium
LSGRSGIKPASNQTRAKNP

SEQ ID NO: 524905 - protein, 9 aa, Mycobacterium
LSGRSPQTI

SEQ ID NO: 524906 - protein, 9 aa, Mycobacterium
LSGRTSADG

SEQ ID NO: 524907 - protein, 7 aa, Mycobacterium
LSGRTSW

SEQ ID NO: 524908 - protein, 6 aa, Mycobacterium
LSGRVG

SEQ ID NO: 524909 - protein, 9 aa, Mycobacterium
LSGRWDGDT

SEQ ID NO: 524910 - protein, 12 aa, Mycobacterium
LSGSAKTARPGL

SEQ ID NO: 524911 - protein, 8 aa, Mycobacterium
LSGSAPAV

SEQ ID NO: 524912 - protein, 12 aa, Mycobacterium
LSGSATEQPNLA

SEQ ID NO: 524913 - protein, 6 aa, Mycobacterium
LSGSDC

SEQ ID NO: 524914 - protein, 13 aa, Mycobacterium
LSGSDDTAETKPQ

SEQ ID NO: 524915 - protein, 11 aa, Mycobacterium
LSGSETPSEAI

SEQ ID NO: 524916 - protein, 5 aa, Mycobacterium
LSGSG

SEQ ID NO: 524917 - protein, 15 aa, Mycobacterium
LSGSGQDGAAGTAAM

SEQ ID NO: 524918 - protein, 10 aa, Mycobacterium
LSGSGRPTGL

SEQ ID NO: 524919 - protein, 10 aa, Mycobacterium
LSGSLGTAVP

SEQ ID NO: 524920 - protein, 11 aa, Mycobacterium
LSGSLSAGLPD

SEQ ID NO: 524921 - protein, 11 aa, Mycobacterium
LSGSNIGGIAE

SEQ ID NO: 524922 - protein, 26 aa, Mycobacterium
LSGSPRPPRWTAPRADEYTADPAPEV

SEQ ID NO: 524923 - protein, 16 aa, Mycobacterium
LSGSPVRYETATQEQW

SEQ ID NO: 524924 - protein, 9 aa, Mycobacterium
LSGSRQAQR

SEQ ID NO: 524925 - protein, 7 aa, Mycobacterium
LSGSSEV

SEQ ID NO: 524926 - protein, 7 aa, Mycobacterium
LSGSSGS

SEQ ID NO: 524927 - protein, 11 aa, Mycobacterium
LSGSSLATQSL

SEQ ID NO: 524928 - protein, 8 aa, Mycobacterium
LSGSTAGY

SEQ ID NO: 524929 - protein, 13 aa, Mycobacterium
LSGSTLASQSISP

SEQ ID NO: 524930 - protein, 10 aa, Mycobacterium
LSGSTPDGVR

SEQ ID NO: 524931 - protein, 10 aa, Mycobacterium
LSGTAARPAA

SEQ ID NO: 524932 - protein, 8 aa, Mycobacterium
LSGTAGRA

SEQ ID NO: 524933 - protein, 7 aa, Mycobacterium
LSGTEEI

SEQ ID NO: 524934 - protein, 5 aa, Mycobacterium
LSGTG

SEQ ID NO: 524935 - protein, 13 aa, Mycobacterium
LSGTGGGTAANDF

SEQ ID NO: 524936 - protein, 12 aa, Mycobacterium
LSGTGLRSTPQL

SEQ ID NO: 524937 - protein, 12 aa, Mycobacterium
LSGTGRGAGGKI

SEQ ID NO: 524938 - protein, 7 aa, Mycobacterium
LSGTPLG

SEQ ID NO: 524939 - protein, 7 aa, Mycobacterium
LSGTSTC

SEQ ID NO: 524940 - protein, 11 aa, Mycobacterium
LSGTTAAGGWQ

SEQ ID NO: 524941 - protein, 5 aa, Mycobacterium
LSGTV

SEQ ID NO: 524942 - protein, 6 aa, Mycobacterium
LSGTYR

SEQ ID NO: 524943 - protein, 5 aa, Mycobacterium
LSGVD

SEQ ID NO: 524944 - protein, 7 aa, Mycobacterium
LSGVDAA

SEQ ID NO: 524945 - protein, 9 aa, Mycobacterium
LSGVTEPGE

SEQ ID NO: 524946 - protein, 8 aa, Mycobacterium
LSGYTAKR

SEQ ID NO: 524947 - protein, 5 aa, Mycobacterium
LSHAQ

SEQ ID NO: 524948 - protein, 10 aa, Mycobacterium
LSHASDGGVR

SEQ ID NO: 524949 - protein, 9 aa, Mycobacterium
LSHDERQTT

SEQ ID NO: 524950 - protein, 21 aa, Mycobacterium
LSHEPPKMPQMPPPDSDPTEV

SEQ ID NO: 524951 - protein, 10 aa, Mycobacterium
LSHGDQESKH

SEQ ID NO: 524952 - protein, 8 aa, Mycobacterium
LSHPGLAP

SEQ ID NO: 524953 - protein, 11 aa, Mycobacterium
LSHPPSPEEVE

SEQ ID NO: 524954 - protein, 7 aa, Mycobacterium
LSHTQGE

SEQ ID NO: 524955 - protein, 7 aa, Mycobacterium
LSHTRDS

SEQ ID NO: 524956 - protein, 6 aa, Mycobacterium
LSHYSD

SEQ ID NO: 524957 - protein, 11 aa, Mycobacterium
LSHYSDGTTDI

SEQ ID NO: 524958 - protein, 8 aa, Mycobacterium
LSIGGGPP

SEQ ID NO: 524959 - protein, 8 aa, Mycobacterium
LSIKPTEL

SEQ ID NO: 524960 - protein, 17 aa, Mycobacterium
LSKAGDGAHVGRSTPVA

SEQ ID NO: 524961 - protein, 10 aa, Mycobacterium
LSKATAGLKG

SEQ ID NO: 524962 - protein, 6 aa, Mycobacterium
LSKDDV

SEQ ID NO: 524963 - protein, 10 aa, Mycobacterium
LSKDPAYKDQ

SEQ ID NO: 524964 - protein, 11 aa, Mycobacterium
LSKDPERRHES

SEQ ID NO: 524965 - protein, 8 aa, Mycobacterium
LSKDQAEY

SEQ ID NO: 524966 - protein, 15 aa, Mycobacterium
LSKDSTNGTGSADVA

SEQ ID NO: 524967 - protein, 6 aa, Mycobacterium
LSKESD

SEQ ID NO: 524968 - protein, 15 aa, Mycobacterium
LSKETADATSPVAGR

SEQ ID NO: 524969 - protein, 9 aa, Mycobacterium
LSKGERADV

SEQ ID NO: 524970 - protein, 9 aa, Mycobacterium
LSKHKTPER

SEQ ID NO: 524971 - protein, 8 aa, Mycobacterium
LSKKEAAD

SEQ ID NO: 524972 - protein, 8 aa, Mycobacterium
LSKLSEGK

SEQ ID NO: 524973 - protein, 4 aa, Mycobacterium
LSKN

SEQ ID NO: 524974 - protein, 8 aa, Mycobacterium
LSKNRSKR

SEQ ID NO: 524975 - protein, 9 aa, Mycobacterium
LSKNSDGSW

SEQ ID NO: 524976 - protein, 6 aa, Mycobacterium
LSKNYG

SEQ ID NO: 524977 - protein, 7 aa, Mycobacterium
LSKPDRV

SEQ ID NO: 524978 - protein, 7 aa, Mycobacterium
LSKPNPA

SEQ ID NO: 524979 - protein, 5 aa, Mycobacterium
LSKPT

SEQ ID NO: 524980 - protein, 11 aa, Mycobacterium
LSKQGNRIDST

SEQ ID NO: 524981 - protein, 8 aa, Mycobacterium
LSKQSGSP

SEQ ID NO: 524982 - protein, 5 aa, Mycobacterium
LSKQT

SEQ ID NO: 524983 - protein, 23 aa, Mycobacterium
LSKSASKLATETVSKASRNTSHR

SEQ ID NO: 524984 - protein, 8 aa, Mycobacterium
LSKSQQNL

SEQ ID NO: 524985 - protein, 6 aa, Mycobacterium
LSKSQV

SEQ ID NO: 524986 - protein, 6 aa, Mycobacterium
LSKSYG

SEQ ID NO: 524987 - protein, 7 aa, Mycobacterium
LSKSYGS

SEQ ID NO: 524988 - protein, 8 aa, Mycobacterium
LSKTEERE

SEQ ID NO: 524989 - protein, 7 aa, Mycobacterium
LSKTRGR

SEQ ID NO: 524990 - protein, 4 aa, Mycobacterium
LSLE

SEQ ID NO: 524991 - protein, 49 aa, Mycobacterium
LSLPESSTTATSTTANTLAAPTASAPTGSAVTAPAPTAPAGSTWPSTNP

SEQ ID NO: 524992 - protein, 6 aa, Mycobacterium
LSLPPD

SEQ ID NO: 524993 - protein, 8 aa, Mycobacterium
LSLPTSDH

SEQ ID NO: 524994 - protein, 10 aa, Mycobacterium
LSLPTSDNPI

SEQ ID NO: 524995 - protein, 8 aa, Mycobacterium
LSLSEDPP

SEQ ID NO: 524996 - protein, 10 aa, Mycobacterium
LSLSEDPPVT

SEQ ID NO: 524997 - protein, 4 aa, Mycobacterium
LSNA

SEQ ID NO: 524998 - protein, 6 aa, Mycobacterium
LSNAED

SEQ ID NO: 524999 - protein, 6 aa, Mycobacterium
LSNAEI

SEQ ID NO: 525000 - protein, 5 aa, Mycobacterium
LSNAN

SEQ ID NO: 525001 - protein, 18 aa, Mycobacterium
LSNAPESDRLNGSEPLSD

SEQ ID NO: 525002 - protein, 5 aa, Mycobacterium
LSNDE

SEQ ID NO: 525003 - protein, 8 aa, Mycobacterium
LSNDEAKA

SEQ ID NO: 525004 - protein, 8 aa, Mycobacterium
LSNDEVKT

SEQ ID NO: 525005 - protein, 9 aa, Mycobacterium
LSNDGSDVA

SEQ ID NO: 525006 - protein, 5 aa, Mycobacterium
LSNDP

SEQ ID NO: 525007 - protein, 12 aa, Mycobacterium
LSNEAANTGAQK

SEQ ID NO: 525008 - protein, 4 aa, Mycobacterium
LSNG

SEQ ID NO: 525009 - protein, 6 aa, Mycobacterium
LSNGAT

SEQ ID NO: 525010 - protein, 12 aa, Mycobacterium
LSNGGPGRGGPD

SEQ ID NO: 525011 - protein, 7 aa, Mycobacterium
LSNGGTA

SEQ ID NO: 525012 - protein, 18 aa, Mycobacterium
LSNGKVTQFDSDQLHIQP

SEQ ID NO: 525013 - protein, 7 aa, Mycobacterium
LSNGNTG

SEQ ID NO: 525014 - protein, 4 aa, Mycobacterium
LSNK

SEQ ID NO: 525015 - protein, 5 aa, Mycobacterium
LSNKD

SEQ ID NO: 525016 - protein, 6 aa, Mycobacterium
LSNKDI

SEQ ID NO: 525017 - protein, 4 aa, Mycobacterium
LSNP

SEQ ID NO: 525018 - protein, 17 aa, Mycobacterium
LSNPAEPLELPGPNGAV

SEQ ID NO: 525019 - protein, 7 aa, Mycobacterium
LSNPDAA

SEQ ID NO: 525020 - protein, 14 aa, Mycobacterium
LSNPGFTPPPSMVV

SEQ ID NO: 525021 - protein, 14 aa, Mycobacterium
LSNPKPAKPAEGDV

SEQ ID NO: 525022 - protein, 63 aa, Mycobacterium
LSNPNKSPMPATSETTPTTTPASEASTSETSPTTSTSPAPGGPGPTAGSAGSSDLLGGDAGDI

SEQ ID NO: 525023 - protein, 8 aa, Mycobacterium
LSNQEGGV

SEQ ID NO: 525024 - protein, 5 aa, Mycobacterium
LSNRE

SEQ ID NO: 525025 - protein, 6 aa, Mycobacterium
LSNREV

SEQ ID NO: 525026 - protein, 17 aa, Mycobacterium
LSNRTPTLAPSTRVSAP

SEQ ID NO: 525027 - protein, 6 aa, Mycobacterium
LSNSGI

SEQ ID NO: 525028 - protein, 14 aa, Mycobacterium
LSNSKGAARRTVAE

SEQ ID NO: 525029 - protein, 11 aa, Mycobacterium
LSNSSATMSRP

SEQ ID NO: 525030 - protein, 7 aa, Mycobacterium
LSNTDPI

SEQ ID NO: 525031 - protein, 6 aa, Mycobacterium
LSNTEI

SEQ ID NO: 525032 - protein, 6 aa, Mycobacterium
LSNTGR

SEQ ID NO: 525033 - protein, 8 aa, Mycobacterium
LSNTTRGA

SEQ ID NO: 525034 - protein, 20 aa, Mycobacterium
LSNYGNSNVGFNNQGNGNIG

SEQ ID NO: 525035 - protein, 4 aa, Mycobacterium
LSPA

SEQ ID NO: 525036 - protein, 10 aa, Mycobacterium
LSPAAAGSAQ

SEQ ID NO: 525037 - protein, 8 aa, Mycobacterium
LSPAAARS

SEQ ID NO: 525038 - protein, 5 aa, Mycobacterium
LSPAD

SEQ ID NO: 525039 - protein, 7 aa, Mycobacterium
LSPADAA

SEQ ID NO: 525040 - protein, 7 aa, Mycobacterium
LSPADGA

SEQ ID NO: 525041 - protein, 7 aa, Mycobacterium
LSPAEQA

SEQ ID NO: 525042 - protein, 5 aa, Mycobacterium
LSPAG

SEQ ID NO: 525043 - protein, 8 aa, Mycobacterium
LSPAGARR

SEQ ID NO: 525044 - protein, 10 aa, Mycobacterium
LSPAGDPHTG

SEQ ID NO: 525045 - protein, 6 aa, Mycobacterium
LSPAGE

SEQ ID NO: 525046 - protein, 11 aa, Mycobacterium
LSPAGSYRKTV

SEQ ID NO: 525047 - protein, 5 aa, Mycobacterium
LSPAH

SEQ ID NO: 525048 - protein, 7 aa, Mycobacterium
LSPANRA

SEQ ID NO: 525049 - protein, 10 aa, Mycobacterium
LSPAPDSSLH

SEQ ID NO: 525050 - protein, 7 aa, Mycobacterium
LSPAQLG

SEQ ID NO: 525051 - protein, 10 aa, Mycobacterium
LSPARAAAPE

SEQ ID NO: 525052 - protein, 10 aa, Mycobacterium
LSPASGKPLA

SEQ ID NO: 525053 - protein, 7 aa, Mycobacterium
LSPCQGS

SEQ ID NO: 525054 - protein, 12 aa, Mycobacterium
LSPDADPAEVAE

SEQ ID NO: 525055 - protein, 18 aa, Mycobacterium
LSPDAPRGRHTSGITQPP

SEQ ID NO: 525056 - protein, 8 aa, Mycobacterium
LSPDDGEM

SEQ ID NO: 525057 - protein, 7 aa, Mycobacterium
LSPDDHT

SEQ ID NO: 525058 - protein, 21 aa, Mycobacterium
LSPDDLAKAAEGDLDADTIRA

SEQ ID NO: 525059 - protein, 7 aa, Mycobacterium
LSPDEKY

SEQ ID NO: 525060 - protein, 6 aa, Mycobacterium
LSPDGR

SEQ ID NO: 525061 - protein, 8 aa, Mycobacterium
LSPDGTKG

SEQ ID NO: 525062 - protein, 6 aa, Mycobacterium
LSPDKI

SEQ ID NO: 525063 - protein, 5 aa, Mycobacterium
LSPDM

SEQ ID NO: 525064 - protein, 22 aa, Mycobacterium
LSPDPDAAFTGHDHSKGSYLPF

SEQ ID NO: 525065 - protein, 10 aa, Mycobacterium
LSPDRIPGFG

SEQ ID NO: 525066 - protein, 15 aa, Mycobacterium
LSPDRSGPLVSAWHP

SEQ ID NO: 525067 - protein, 5 aa, Mycobacterium
LSPEA

SEQ ID NO: 525068 - protein, 13 aa, Mycobacterium
LSPEADFEEQKDT

SEQ ID NO: 525069 - protein, 6 aa, Mycobacterium
LSPEAL

SEQ ID NO: 525070 - protein, 7 aa, Mycobacterium
LSPEARA

SEQ ID NO: 525071 - protein, 8 aa, Mycobacterium
LSPEARAT

SEQ ID NO: 525072 - protein, 5 aa, Mycobacterium
LSPEE

SEQ ID NO: 525073 - protein, 12 aa, Mycobacterium
LSPEEADSRRAE

SEQ ID NO: 525074 - protein, 7 aa, Mycobacterium
LSPEEGW

SEQ ID NO: 525075 - protein, 7 aa, Mycobacterium
LSPEEQQ

SEQ ID NO: 525076 - protein, 8 aa, Mycobacterium
LSPEERDN

SEQ ID NO: 525077 - protein, 16 aa, Mycobacterium
LSPEGGELRPDQHRPG

SEQ ID NO: 525078 - protein, 18 aa, Mycobacterium
LSPEGGGDPTTGAESASY

SEQ ID NO: 525079 - protein, 7 aa, Mycobacterium
LSPEINS

SEQ ID NO: 525080 - protein, 12 aa, Mycobacterium
LSPEKGIDSGSF

SEQ ID NO: 525081 - protein, 13 aa, Mycobacterium
LSPENYHDGPRAA

SEQ ID NO: 525082 - protein, 9 aa, Mycobacterium
LSPEPGAEQ

SEQ ID NO: 525083 - protein, 17 aa, Mycobacterium
LSPEQVRDGDASPRSDV

SEQ ID NO: 525084 - protein, 5 aa, Mycobacterium
LSPES

SEQ ID NO: 525085 - protein, 8 aa, Mycobacterium
LSPGARGE

SEQ ID NO: 525086 - protein, 12 aa, Mycobacterium
LSPGASAGVQQL

SEQ ID NO: 525087 - protein, 16 aa, Mycobacterium
LSPGATFKSTAKANAV

SEQ ID NO: 525088 - protein, 10 aa, Mycobacterium
LSPGATYAST

SEQ ID NO: 525089 - protein, 9 aa, Mycobacterium
LSPGATYRS

SEQ ID NO: 525090 - protein, 7 aa, Mycobacterium
LSPGDET

SEQ ID NO: 525091 - protein, 7 aa, Mycobacterium
LSPGDTV

SEQ ID NO: 525092 - protein, 6 aa, Mycobacterium
LSPGGF

SEQ ID NO: 525093 - protein, 7 aa, Mycobacterium
LSPGGSD

SEQ ID NO: 525094 - protein, 10 aa, Mycobacterium
LSPGGSSKDR

SEQ ID NO: 525095 - protein, 9 aa, Mycobacterium
LSPGKASQQ

SEQ ID NO: 525096 - protein, 11 aa, Mycobacterium
LSPGPVDGPRM

SEQ ID NO: 525097 - protein, 9 aa, Mycobacterium
LSPGPVDTS

SEQ ID NO: 525098 - protein, 6 aa, Mycobacterium
LSPGQR

SEQ ID NO: 525099 - protein, 6 aa, Mycobacterium
LSPGQV

SEQ ID NO: 525100 - protein, 9 aa, Mycobacterium
LSPGRPTTL

SEQ ID NO: 525101 - protein, 10 aa, Mycobacterium
LSPGSPAKVA

SEQ ID NO: 525102 - protein, 10 aa, Mycobacterium
LSPGSRLPTE

SEQ ID NO: 525103 - protein, 11 aa, Mycobacterium
LSPGSTPTRDE

SEQ ID NO: 525104 - protein, 7 aa, Mycobacterium
LSPGTQG

SEQ ID NO: 525105 - protein, 7 aa, Mycobacterium
LSPGTVD

SEQ ID NO: 525106 - protein, 7 aa, Mycobacterium
LSPGVPD

SEQ ID NO: 525107 - protein, 5 aa, Mycobacterium
LSPGW

SEQ ID NO: 525108 - protein, 7 aa, Mycobacterium
LSPHDDG

SEQ ID NO: 525109 - protein, 19 aa, Mycobacterium
LSPHPARSQVTTTTSPGER

SEQ ID NO: 525110 - protein, 7 aa, Mycobacterium
LSPHTPA

SEQ ID NO: 525111 - protein, 19 aa, Mycobacterium
LSPIAGEAAAAAGLSGECR

SEQ ID NO: 525112 - protein, 14 aa, Mycobacterium
LSPIPGTAPAVTTD

SEQ ID NO: 525113 - protein, 5 aa, Mycobacterium
LSPKA

SEQ ID NO: 525114 - protein, 11 aa, Mycobacterium
LSPKGSGTDVT

SEQ ID NO: 525115 - protein, 7 aa, Mycobacterium
LSPKGYR

SEQ ID NO: 525116 - protein, 6 aa, Mycobacterium
LSPKPG

SEQ ID NO: 525117 - protein, 6 aa, Mycobacterium
LSPKTA

SEQ ID NO: 525118 - protein, 17 aa, Mycobacterium
LSPKTSPVPIGSPVRGG

SEQ ID NO: 525119 - protein, 7 aa, Mycobacterium
LSPLDDL

SEQ ID NO: 525120 - protein, 5 aa, Mycobacterium
LSPLP

SEQ ID NO: 525121 - protein, 6 aa, Mycobacterium
LSPLPD

SEQ ID NO: 525122 - protein, 5 aa, Mycobacterium
LSPND

SEQ ID NO: 525123 - protein, 6 aa, Mycobacterium
LSPNDI

SEQ ID NO: 525124 - protein, 7 aa, Mycobacterium
LSPNPSV

SEQ ID NO: 525125 - protein, 11 aa, Mycobacterium
LSPNQTGPGAL

SEQ ID NO: 525126 - protein, 6 aa, Mycobacterium
LSPNRD

SEQ ID NO: 525127 - protein, 12 aa, Mycobacterium
LSPPAADRSWPW

SEQ ID NO: 525128 - protein, 13 aa, Mycobacterium
LSPPAANPDDDTV

SEQ ID NO: 525129 - protein, 9 aa, Mycobacterium
LSPPDEANR

SEQ ID NO: 525130 - protein, 6 aa, Mycobacterium
LSPPDL

SEQ ID NO: 525131 - protein, 8 aa, Mycobacterium
LSPPGAAA

SEQ ID NO: 525132 - protein, 8 aa, Mycobacterium
LSPPGSAH

SEQ ID NO: 525133 - protein, 8 aa, Mycobacterium
LSPPGSRH

SEQ ID NO: 525134 - protein, 24 aa, Mycobacterium
LSPPGSRIAAETAGNHADERREQM

SEQ ID NO: 525135 - protein, 8 aa, Mycobacterium
LSPPIGRA

SEQ ID NO: 525136 - protein, 9 aa, Mycobacterium
LSPPPPEQI

SEQ ID NO: 525137 - protein, 9 aa, Mycobacterium
LSPPQPEAA

SEQ ID NO: 525138 - protein, 8 aa, Mycobacterium
LSPPRPGM

SEQ ID NO: 525139 - protein, 6 aa, Mycobacterium
LSPPSV

SEQ ID NO: 525140 - protein, 9 aa, Mycobacterium
LSPPTAETT

SEQ ID NO: 525141 - protein, 6 aa, Mycobacterium
LSPPVD

SEQ ID NO: 525142 - protein, 7 aa, Mycobacterium
LSPPVTG

SEQ ID NO: 525143 - protein, 8 aa, Mycobacterium
LSPQARAR

SEQ ID NO: 525144 - protein, 6 aa, Mycobacterium
LSPQER

SEQ ID NO: 525145 - protein, 7 aa, Mycobacterium
LSPQGYE

SEQ ID NO: 525146 - protein, 10 aa, Mycobacterium
LSPQHDDGTR

SEQ ID NO: 525147 - protein, 5 aa, Mycobacterium
LSPQL

SEQ ID NO: 525148 - protein, 7 aa, Mycobacterium
LSPQTLD

SEQ ID NO: 525149 - protein, 5 aa, Mycobacterium
LSPRA

SEQ ID NO: 525150 - protein, 7 aa, Mycobacterium
LSPRAAK

SEQ ID NO: 525151 - protein, 7 aa, Mycobacterium
LSPRAAR

SEQ ID NO: 525152 - protein, 7 aa, Mycobacterium
LSPRALT

SEQ ID NO: 525153 - protein, 7 aa, Mycobacterium
LSPRATF

SEQ ID NO: 525154 - protein, 6 aa, Mycobacterium
LSPRDN

SEQ ID NO: 525155 - protein, 6 aa, Mycobacterium
LSPREN

SEQ ID NO: 525156 - protein, 6 aa, Mycobacterium
LSPRKS

SEQ ID NO: 525157 - protein, 6 aa, Mycobacterium
LSPRQV

SEQ ID NO: 525158 - protein, 6 aa, Mycobacterium
LSPRRW

SEQ ID NO: 525159 - protein, 6 aa, Mycobacterium
LSPRSK

SEQ ID NO: 525160 - protein, 5 aa, Mycobacterium
LSPSA

SEQ ID NO: 525161 - protein, 9 aa, Mycobacterium
LSPSAAAAL

SEQ ID NO: 525162 - protein, 6 aa, Mycobacterium
LSPSAL

SEQ ID NO: 525163 - protein, 6 aa, Mycobacterium
LSPSDT

SEQ ID NO: 525164 - protein, 17 aa, Mycobacterium
LSPSEEQMAEPGDARRR

SEQ ID NO: 525165 - protein, 9 aa, Mycobacterium
LSPSGSRIA

SEQ ID NO: 525166 - protein, 5 aa, Mycobacterium
LSPSL

SEQ ID NO: 525167 - protein, 9 aa, Mycobacterium
LSPSPAKAV

SEQ ID NO: 525168 - protein, 16 aa, Mycobacterium
LSPSPKPLYAKGSNAP

SEQ ID NO: 525169 - protein, 9 aa, Mycobacterium
LSPSRASDF

SEQ ID NO: 525170 - protein, 8 aa, Mycobacterium
LSPSRATD

SEQ ID NO: 525171 - protein, 10 aa, Mycobacterium
LSPSSASGLS

SEQ ID NO: 525172 - protein, 9 aa, Mycobacterium
LSPSSTADR

SEQ ID NO: 525173 - protein, 9 aa, Mycobacterium
LSPSTAAAV

SEQ ID NO: 525174 - protein, 8 aa, Mycobacterium
LSPTAGAV

SEQ ID NO: 525175 - protein, 12 aa, Mycobacterium
LSPTAGTVKRGK

SEQ ID NO: 525176 - protein, 11 aa, Mycobacterium
LSPTATLATTH

SEQ ID NO: 525177 - protein, 7 aa, Mycobacterium
LSPTDRA

SEQ ID NO: 525178 - protein, 5 aa, Mycobacterium
LSPTE

SEQ ID NO: 525179 - protein, 12 aa, Mycobacterium
LSPTEDERDGYV

SEQ ID NO: 525180 - protein, 8 aa, Mycobacterium
LSPTEDQP

SEQ ID NO: 525181 - protein, 6 aa, Mycobacterium
LSPTGD

SEQ ID NO: 525182 - protein, 14 aa, Mycobacterium
LSPTGPTPTPDDDG

SEQ ID NO: 525183 - protein, 8 aa, Mycobacterium
LSPTQRRR

SEQ ID NO: 525184 - protein, 11 aa, Mycobacterium
LSPTSALQTPE

SEQ ID NO: 525185 - protein, 6 aa, Mycobacterium
LSPVQR

SEQ ID NO: 525186 - protein, 6 aa, Mycobacterium
LSPVQY

SEQ ID NO: 525187 - protein, 4 aa, Mycobacterium
LSPY

SEQ ID NO: 525188 - protein, 14 aa, Mycobacterium
LSPYGPPAADAQAI

SEQ ID NO: 525189 - protein, 6 aa, Mycobacterium
LSPYPD

SEQ ID NO: 525190 - protein, 6 aa, Mycobacterium
LSPYTP

SEQ ID NO: 525191 - protein, 5 aa, Mycobacterium
LSQAD

SEQ ID NO: 525192 - protein, 8 aa, Mycobacterium
LSQAEDRE

SEQ ID NO: 525193 - protein, 9 aa, Mycobacterium
LSQAGAPDA

SEQ ID NO: 525194 - protein, 7 aa, Mycobacterium
LSQAKDA

SEQ ID NO: 525195 - protein, 14 aa, Mycobacterium
LSQDAIRRQSRPPD

SEQ ID NO: 525196 - protein, 10 aa, Mycobacterium
LSQDASGAAA

SEQ ID NO: 525197 - protein, 7 aa, Mycobacterium
LSQDDAS

SEQ ID NO: 525198 - protein, 20 aa, Mycobacterium
LSQDEDFDTPAKQAANRDRA

SEQ ID NO: 525199 - protein, 12 aa, Mycobacterium
LSQDGEVKSTAT

SEQ ID NO: 525200 - protein, 7 aa, Mycobacterium
LSQDSED

SEQ ID NO: 525201 - protein, 7 aa, Mycobacterium
LSQEEGV

SEQ ID NO: 525202 - protein, 9 aa, Mycobacterium
LSQEGPDRV

SEQ ID NO: 525203 - protein, 14 aa, Mycobacterium
LSQENRPRASLEGH

SEQ ID NO: 525204 - protein, 8 aa, Mycobacterium
LSQEQRDE

SEQ ID NO: 525205 - protein, 9 aa, Mycobacterium
LSQGARDRN

SEQ ID NO: 525206 - protein, 10 aa, Mycobacterium
LSQGARVDTN

SEQ ID NO: 525207 - protein, 8 aa, Mycobacterium
LSQGGTSF

SEQ ID NO: 525208 - protein, 7 aa, Mycobacterium
LSQGKGS

SEQ ID NO: 525209 - protein, 11 aa, Mycobacterium
LSQGKGVRSWS

SEQ ID NO: 525210 - protein, 11 aa, Mycobacterium
LSQGNSATVDD

SEQ ID NO: 525211 - protein, 11 aa, Mycobacterium
LSQGNSHGVET

SEQ ID NO: 525212 - protein, 11 aa, Mycobacterium
LSQGPDAAGRA

SEQ ID NO: 525213 - protein, 9 aa, Mycobacterium
LSQGRASGQ

SEQ ID NO: 525214 - protein, 6 aa, Mycobacterium
LSQGSG

SEQ ID NO: 525215 - protein, 9 aa, Mycobacterium
LSQGTVKGN

SEQ ID NO: 525216 - protein, 17 aa, Mycobacterium
LSQHRPSDWLTHDVVDG

SEQ ID NO: 525217 - protein, 9 aa, Mycobacterium
LSQNARTRN

SEQ ID NO: 525218 - protein, 8 aa, Mycobacterium
LSQPARDR

SEQ ID NO: 525219 - protein, 10 aa, Mycobacterium
LSQPATGTSI

SEQ ID NO: 525220 - protein, 11 aa, Mycobacterium
LSQPRKPEIPG

SEQ ID NO: 525221 - protein, 6 aa, Mycobacterium
LSQPTV

SEQ ID NO: 525222 - protein, 9 aa, Mycobacterium
LSQQQRDEL

SEQ ID NO: 525223 - protein, 10 aa, Mycobacterium
LSQQSRRAVR

SEQ ID NO: 525224 - protein, 17 aa, Mycobacterium
LSQRGGPLGAQADRDLD

SEQ ID NO: 525225 - protein, 6 aa, Mycobacterium
LSQRSI

SEQ ID NO: 525226 - protein, 7 aa, Mycobacterium
LSQRTDR

SEQ ID NO: 525227 - protein, 6 aa, Mycobacterium
LSQRYP

SEQ ID NO: 525228 - protein, 8 aa, Mycobacterium
LSQSESQV

SEQ ID NO: 525229 - protein, 20 aa, Mycobacterium
LSQSGQAEHQHGLTKAGDPL

SEQ ID NO: 525230 - protein, 5 aa, Mycobacterium
LSQSM

SEQ ID NO: 525231 - protein, 8 aa, Mycobacterium
LSQSPKDL

SEQ ID NO: 525232 - protein, 10 aa, Mycobacterium
LSQSYAGATM

SEQ ID NO: 525233 - protein, 11 aa, Mycobacterium
LSQSYSGASMD

SEQ ID NO: 525234 - protein, 4 aa, Mycobacterium
LSQT

SEQ ID NO: 525235 - protein, 14 aa, Mycobacterium
LSQTATLDGPIPRD

SEQ ID NO: 525236 - protein, 6 aa, Mycobacterium
LSQTTT

SEQ ID NO: 525237 - protein, 4 aa, Mycobacterium
LSRA

SEQ ID NO: 525238 - protein, 14 aa, Mycobacterium
LSRAARGEEDVPAQ

SEQ ID NO: 525239 - protein, 6 aa, Mycobacterium
LSRAES

SEQ ID NO: 525240 - protein, 5 aa, Mycobacterium
LSRAG

SEQ ID NO: 525241 - protein, 9 aa, Mycobacterium
LSRAGSPVR

SEQ ID NO: 525242 - protein, 9 aa, Mycobacterium
LSRAPEPMR

SEQ ID NO: 525243 - protein, 12 aa, Mycobacterium
LSRASHAGEDLS

SEQ ID NO: 525244 - protein, 12 aa, Mycobacterium
LSRASNATEDLE

SEQ ID NO: 525245 - protein, 8 aa, Mycobacterium
LSRATAKT

SEQ ID NO: 525246 - protein, 5 aa, Mycobacterium
LSRDD

SEQ ID NO: 525247 - protein, 19 aa, Mycobacterium
LSRDGAQVSATSAAREARD

SEQ ID NO: 525248 - protein, 13 aa, Mycobacterium
LSRDGSPTGDNPA

SEQ ID NO: 525249 - protein, 8 aa, Mycobacterium
LSRDPYPY

SEQ ID NO: 525250 - protein, 10 aa, Mycobacterium
LSRDRGAEHA

SEQ ID NO: 525251 - protein, 4 aa, Mycobacterium
LSRE

SEQ ID NO: 525252 - protein, 7 aa, Mycobacterium
LSREESA

SEQ ID NO: 525253 - protein, 6 aa, Mycobacterium
LSREGI

SEQ ID NO: 525254 - protein, 6 aa, Mycobacterium
LSREHR

SEQ ID NO: 525255 - protein, 5 aa, Mycobacterium
LSREI

SEQ ID NO: 525256 - protein, 15 aa, Mycobacterium
LSREPGQVAYSEAGM

SEQ ID NO: 525257 - protein, 8 aa, Mycobacterium
LSREQAAE

SEQ ID NO: 525258 - protein, 11 aa, Mycobacterium
LSRESVDENGF

SEQ ID NO: 525259 - protein, 8 aa, Mycobacterium
LSREVAGD

SEQ ID NO: 525260 - protein, 13 aa, Mycobacterium
LSRGETPEGYQQS

SEQ ID NO: 525261 - protein, 8 aa, Mycobacterium
LSRGFRGT

SEQ ID NO: 525262 - protein, 13 aa, Mycobacterium
LSRGGVEEALTTE

SEQ ID NO: 525263 - protein, 7 aa, Mycobacterium
LSRGPSL

SEQ ID NO: 525264 - protein, 6 aa, Mycobacterium
LSRGSP

SEQ ID NO: 525265 - protein, 10 aa, Mycobacterium
LSRGSSASVG

SEQ ID NO: 525266 - protein, 9 aa, Mycobacterium
LSRGTQRAR

SEQ ID NO: 525267 - protein, 5 aa, Mycobacterium
LSRID

SEQ ID NO: 525268 - protein, 12 aa, Mycobacterium
LSRKEYEKTKRK

SEQ ID NO: 525269 - protein, 13 aa, Mycobacterium
LSRKPGLSKTKLS

SEQ ID NO: 525270 - protein, 12 aa, Mycobacterium
LSRPATAQEVDR

SEQ ID NO: 525271 - protein, 8 aa, Mycobacterium
LSRPDAYD

SEQ ID NO: 525272 - protein, 7 aa, Mycobacterium
LSRPEET

SEQ ID NO: 525273 - protein, 9 aa, Mycobacterium
LSRPGGERR

SEQ ID NO: 525274 - protein, 8 aa, Mycobacterium
LSRPLNRD

SEQ ID NO: 525275 - protein, 15 aa, Mycobacterium
LSRPPDAGTPGDGAG

SEQ ID NO: 525276 - protein, 14 aa, Mycobacterium
LSRPRRSARPRRRP

SEQ ID NO: 525277 - protein, 9 aa, Mycobacterium
LSRPTPAGL

SEQ ID NO: 525278 - protein, 8 aa, Mycobacterium
LSRPTTRR

SEQ ID NO: 525279 - protein, 16 aa, Mycobacterium
LSRPTVDKHSTGGVGD

SEQ ID NO: 525280 - protein, 5 aa, Mycobacterium
LSRPW

SEQ ID NO: 525281 - protein, 12 aa, Mycobacterium
LSRQAEQTTEAM

SEQ ID NO: 525282 - protein, 18 aa, Mycobacterium
LSRQPDPAHEDSAATARR

SEQ ID NO: 525283 - protein, 9 aa, Mycobacterium
LSRQPRDAS

SEQ ID NO: 525284 - protein, 4 aa, Mycobacterium
LSRR

SEQ ID NO: 525285 - protein, 5 aa, Mycobacterium
LSRRG

SEQ ID NO: 525286 - protein, 10 aa, Mycobacterium
LSRRNHGRSR

SEQ ID NO: 525287 - protein, 12 aa, Mycobacterium
LSRRRRGAESTA

SEQ ID NO: 525288 - protein, 7 aa, Mycobacterium
LSRRSDY

SEQ ID NO: 525289 - protein, 11 aa, Mycobacterium
LSRRSGDGAER

SEQ ID NO: 525290 - protein, 13 aa, Mycobacterium
LSRRTPKAYRSKD

SEQ ID NO: 525291 - protein, 6 aa, Mycobacterium
LSRSAS

SEQ ID NO: 525292 - protein, 6 aa, Mycobacterium
LSRSGV

SEQ ID NO: 525293 - protein, 6 aa, Mycobacterium
LSRSIE

SEQ ID NO: 525294 - protein, 11 aa, Mycobacterium
LSRSPDSPERF

SEQ ID NO: 525295 - protein, 9 aa, Mycobacterium
LSRSPSENW

SEQ ID NO: 525296 - protein, 10 aa, Mycobacterium
LSRSSGAGST

SEQ ID NO: 525297 - protein, 5 aa, Mycobacterium
LSRST

SEQ ID NO: 525298 - protein, 12 aa, Mycobacterium
LSRSTASQRPPL

SEQ ID NO: 525299 - protein, 5 aa, Mycobacterium
LSRTA

SEQ ID NO: 525300 - protein, 9 aa, Mycobacterium
LSRTAKPDA

SEQ ID NO: 525301 - protein, 7 aa, Mycobacterium
LSRTDSE

SEQ ID NO: 525302 - protein, 7 aa, Mycobacterium
LSRTGAR

SEQ ID NO: 525303 - protein, 8 aa, Mycobacterium
LSRTGRAT

SEQ ID NO: 525304 - protein, 12 aa, Mycobacterium
LSRTPPTDGQSL

SEQ ID NO: 525305 - protein, 9 aa, Mycobacterium
LSRTTAASG

SEQ ID NO: 525306 - protein, 9 aa, Mycobacterium
LSRYGGGDE

SEQ ID NO: 525307 - protein, 10 aa, Mycobacterium
LSRYGGGDSP

SEQ ID NO: 525308 - protein, 16 aa, Mycobacterium
LSRYGGGEQPIPDLFL

SEQ ID NO: 525309 - protein, 26 aa, Mycobacterium
LSSAAAALAAPAAITPPAAPGADPVS

SEQ ID NO: 525310 - protein, 8 aa, Mycobacterium
LSSAAASY

SEQ ID NO: 525311 - protein, 11 aa, Mycobacterium
LSSAADSFGSV

SEQ ID NO: 525312 - protein, 13 aa, Mycobacterium
LSSAAKALKSEYQ

SEQ ID NO: 525313 - protein, 9 aa, Mycobacterium
LSSADDART

SEQ ID NO: 525314 - protein, 6 aa, Mycobacterium
LSSAEL

SEQ ID NO: 525315 - protein, 15 aa, Mycobacterium
LSSAEMGAARGAANA

SEQ ID NO: 525316 - protein, 7 aa, Mycobacterium
LSSAENA

SEQ ID NO: 525317 - protein, 11 aa, Mycobacterium
LSSAERAERGS

SEQ ID NO: 525318 - protein, 5 aa, Mycobacterium
LSSAG

SEQ ID NO: 525319 - protein, 9 aa, Mycobacterium
LSSAGAPGA

SEQ ID NO: 525320 - protein, 7 aa, Mycobacterium
LSSAGRL

SEQ ID NO: 525321 - protein, 7 aa, Mycobacterium
LSSAIGA

SEQ ID NO: 525322 - protein, 5 aa, Mycobacterium
LSSDA

SEQ ID NO: 525323 - protein, 8 aa, Mycobacterium
LSSDDARE

SEQ ID NO: 525324 - protein, 8 aa, Mycobacterium
LSSDDIEM

SEQ ID NO: 525325 - protein, 17 aa, Mycobacterium
LSSDEEKKKVGADQTEK

SEQ ID NO: 525326 - protein, 15 aa, Mycobacterium
LSSDEGPASDDPGEV

SEQ ID NO: 525327 - protein, 8 aa, Mycobacterium
LSSDGATA

SEQ ID NO: 525328 - protein, 8 aa, Mycobacterium
LSSDGDRA

SEQ ID NO: 525329 - protein, 5 aa, Mycobacterium
LSSDQ

SEQ ID NO: 525330 - protein, 4 aa, Mycobacterium
LSSE

SEQ ID NO: 525331 - protein, 5 aa, Mycobacterium
LSSEA

SEQ ID NO: 525332 - protein, 20 aa, Mycobacterium
LSSEDDAQFTASEGIPMPKT

SEQ ID NO: 525333 - protein, 12 aa, Mycobacterium
LSSEGGATTREQ

SEQ ID NO: 525334 - protein, 7 aa, Mycobacterium
LSSEQLD

SEQ ID NO: 525335 - protein, 12 aa, Mycobacterium
LSSETTAAAAGE

SEQ ID NO: 525336 - protein, 4 aa, Mycobacterium
LSSG

SEQ ID NO: 525337 - protein, 9 aa, Mycobacterium
LSSGAGNTG

SEQ ID NO: 525338 - protein, 14 aa, Mycobacterium
LSSGAHNGARGNSG

SEQ ID NO: 525339 - protein, 6 aa, Mycobacterium
LSSGEE

SEQ ID NO: 525340 - protein, 8 aa, Mycobacterium
LSSGGAAL

SEQ ID NO: 525341 - protein, 9 aa, Mycobacterium
LSSGGAALT

SEQ ID NO: 525342 - protein, 7 aa, Mycobacterium
LSSGGTR

SEQ ID NO: 525343 - protein, 6 aa, Mycobacterium
LSSGGY

SEQ ID NO: 525344 - protein, 8 aa, Mycobacterium
LSSGKAPR

SEQ ID NO: 525345 - protein, 18 aa, Mycobacterium
LSSGKATVESDSPVDNDA

SEQ ID NO: 525346 - protein, 8 aa, Mycobacterium
LSSGKQAD

SEQ ID NO: 525347 - protein, 10 aa, Mycobacterium
LSSGLQPGDV

SEQ ID NO: 525348 - protein, 6 aa, Mycobacterium
LSSGNG

SEQ ID NO: 525349 - protein, 10 aa, Mycobacterium
LSSGPAPTGD

SEQ ID NO: 525350 - protein, 7 aa, Mycobacterium
LSSGQEL

SEQ ID NO: 525351 - protein, 11 aa, Mycobacterium
LSSGQLTQSRP

SEQ ID NO: 525352 - protein, 5 aa, Mycobacterium
LSSGR

SEQ ID NO: 525353 - protein, 17 aa, Mycobacterium
LSSGRAENLHSAENSDK

SEQ ID NO: 525354 - protein, 15 aa, Mycobacterium
LSSGSPFERPVSGTD

SEQ ID NO: 525355 - protein, 7 aa, Mycobacterium
LSSGSQT

SEQ ID NO: 525356 - protein, 12 aa, Mycobacterium
LSSGSWSGPASV

SEQ ID NO: 525357 - protein, 9 aa, Mycobacterium
LSSGTGSSG

SEQ ID NO: 525358 - protein, 14 aa, Mycobacterium
LSSGTLTGAATTNA

SEQ ID NO: 525359 - protein, 7 aa, Mycobacterium
LSSGTQG

SEQ ID NO: 525360 - protein, 10 aa, Mycobacterium
LSSGVDEEPD

SEQ ID NO: 525361 - protein, 10 aa, Mycobacterium
LSSGVDEEPE

SEQ ID NO: 525362 - protein, 8 aa, Mycobacterium
LSSKAATL

SEQ ID NO: 525363 - protein, 5 aa, Mycobacterium
LSSKD

SEQ ID NO: 525364 - protein, 11 aa, Mycobacterium
LSSNGQPRDVA

SEQ ID NO: 525365 - protein, 9 aa, Mycobacterium
LSSNNAQQE

SEQ ID NO: 525366 - protein, 13 aa, Mycobacterium
LSSPAAANTELPP

SEQ ID NO: 525367 - protein, 15 aa, Mycobacterium
LSSPAQHSGRRTYTE

SEQ ID NO: 525368 - protein, 8 aa, Mycobacterium
LSSPAVRS

SEQ ID NO: 525369 - protein, 11 aa, Mycobacterium
LSSPAWAAAPD

SEQ ID NO: 525370 - protein, 5 aa, Mycobacterium
LSSPC

SEQ ID NO: 525371 - protein, 11 aa, Mycobacterium
LSSPDSAERAA

SEQ ID NO: 525372 - protein, 5 aa, Mycobacterium
LSSPE

SEQ ID NO: 525373 - protein, 10 aa, Mycobacterium
LSSPENAARY

SEQ ID NO: 525374 - protein, 12 aa, Mycobacterium
LSSPISPDAPLR

SEQ ID NO: 525375 - protein, 8 aa, Mycobacterium
LSSPSGLG

SEQ ID NO: 525376 - protein, 16 aa, Mycobacterium
LSSPTESSTGSTSGLS

SEQ ID NO: 525377 - protein, 8 aa, Mycobacterium
LSSPTSGE

SEQ ID NO: 525378 - protein, 9 aa, Mycobacterium
LSSQAGFDR

SEQ ID NO: 525379 - protein, 8 aa, Mycobacterium
LSSQARKY

SEQ ID NO: 525380 - protein, 9 aa, Mycobacterium
LSSQGNVAG

SEQ ID NO: 525381 - protein, 9 aa, Mycobacterium
LSSQHGATL

SEQ ID NO: 525382 - protein, 12 aa, Mycobacterium
LSSQPDSQDPQV

SEQ ID NO: 525383 - protein, 21 aa, Mycobacterium
LSSQSVSDRGAKRLRELLSRN

SEQ ID NO: 525384 - protein, 4 aa, Mycobacterium
LSSR

SEQ ID NO: 525385 - protein, 8 aa, Mycobacterium
LSSRARAA

SEQ ID NO: 525386 - protein, 5 aa, Mycobacterium
LSSRG

SEQ ID NO: 525387 - protein, 20 aa, Mycobacterium
LSSRGTDGPSNSDLTHREAV

SEQ ID NO: 525388 - protein, 14 aa, Mycobacterium
LSSRMTKPAESVDR

SEQ ID NO: 525389 - protein, 17 aa, Mycobacterium
LSSRPASQDDPQQQANT

SEQ ID NO: 525390 - protein, 7 aa, Mycobacterium
LSSRRGR

SEQ ID NO: 525391 - protein, 7 aa, Mycobacterium
LSSRRRG

SEQ ID NO: 525392 - protein, 7 aa, Mycobacterium
LSSRSEA

SEQ ID NO: 525393 - protein, 9 aa, Mycobacterium
LSSRSGDGI

SEQ ID NO: 525394 - protein, 18 aa, Mycobacterium
LSSSADQVQMTFGDAQEI

SEQ ID NO: 525395 - protein, 9 aa, Mycobacterium
LSSSAGARR

SEQ ID NO: 525396 - protein, 12 aa, Mycobacterium
LSSSANAAAYGL

SEQ ID NO: 525397 - protein, 8 aa, Mycobacterium
LSSSARAE

SEQ ID NO: 525398 - protein, 8 aa, Mycobacterium
LSSSARAR

SEQ ID NO: 525399 - protein, 12 aa, Mycobacterium
LSSSDVVGPVMP

SEQ ID NO: 525400 - protein, 18 aa, Mycobacterium
LSSSGELTAGGATFRPSA

SEQ ID NO: 525401 - protein, 7 aa, Mycobacterium
LSSSGSV

SEQ ID NO: 525402 - protein, 8 aa, Mycobacterium
LSSSPRQA

SEQ ID NO: 525403 - protein, 8 aa, Mycobacterium
LSSSQPAL

SEQ ID NO: 525404 - protein, 5 aa, Mycobacterium
LSSSS

SEQ ID NO: 525405 - protein, 6 aa, Mycobacterium
LSSSVA

SEQ ID NO: 525406 - protein, 16 aa, Mycobacterium
LSSSVGGNVGTNAGGM

SEQ ID NO: 525407 - protein, 11 aa, Mycobacterium
LSSTADSRGVE

SEQ ID NO: 525408 - protein, 9 aa, Mycobacterium
LSSTDNANG

SEQ ID NO: 525409 - protein, 23 aa, Mycobacterium
LSSTPKPPKTAGEKVADEGEGGN

SEQ ID NO: 525410 - protein, 9 aa, Mycobacterium
LSSTPRPER

SEQ ID NO: 525411 - protein, 8 aa, Mycobacterium
LSSTRQAV

SEQ ID NO: 525412 - protein, 7 aa, Mycobacterium
LSSTSAF

SEQ ID NO: 525413 - protein, 10 aa, Mycobacterium
LSSTTPGSGI

SEQ ID NO: 525414 - protein, 9 aa, Mycobacterium
LSSTYSAAA

SEQ ID NO: 525415 - protein, 4 aa, Mycobacterium
LSSV

SEQ ID NO: 525416 - protein, 7 aa, Mycobacterium
LSSYPNL

SEQ ID NO: 525417 - protein, 6 aa, Mycobacterium
LSSYTP

SEQ ID NO: 525418 - protein, 10 aa, Mycobacterium
LSTAAFGGDP

SEQ ID NO: 525419 - protein, 6 aa, Mycobacterium
LSTAAH

SEQ ID NO: 525420 - protein, 12 aa, Mycobacterium
LSTADAAAIGTA

SEQ ID NO: 525421 - protein, 10 aa, Mycobacterium
LSTAGRNARR

SEQ ID NO: 525422 - protein, 21 aa, Mycobacterium
LSTAMSGGASVAAAAPAVPDR

SEQ ID NO: 525423 - protein, 15 aa, Mycobacterium
LSTANMPTIPGRDAF

SEQ ID NO: 525424 - protein, 10 aa, Mycobacterium
LSTAPLAKRA

SEQ ID NO: 525425 - protein, 14 aa, Mycobacterium
LSTARDQLRAASAE

SEQ ID NO: 525426 - protein, 5 aa, Mycobacterium
LSTDD

SEQ ID NO: 525427 - protein, 10 aa, Mycobacterium
LSTDDGVTAA

SEQ ID NO: 525428 - protein, 6 aa, Mycobacterium
LSTDDV

SEQ ID NO: 525429 - protein, 11 aa, Mycobacterium
LSTDGKPLPGS

SEQ ID NO: 525430 - protein, 17 aa, Mycobacterium
LSTDGPNGVPGRDQRKR

SEQ ID NO: 525431 - protein, 7 aa, Mycobacterium
LSTDGRV

SEQ ID NO: 525432 - protein, 10 aa, Mycobacterium
LSTDPASRDT

SEQ ID NO: 525433 - protein, 12 aa, Mycobacterium
LSTDPATGRTTT

SEQ ID NO: 525434 - protein, 10 aa, Mycobacterium
LSTDPDDPEF

SEQ ID NO: 525435 - protein, 11 aa, Mycobacterium
LSTDPDDPEIR

SEQ ID NO: 525436 - protein, 6 aa, Mycobacterium
LSTDPR

SEQ ID NO: 525437 - protein, 17 aa, Mycobacterium
LSTDRAAEPELGPQPDL

SEQ ID NO: 525438 - protein, 10 aa, Mycobacterium
LSTDSDPAAV

SEQ ID NO: 525439 - protein, 7 aa, Mycobacterium
LSTDTAR

SEQ ID NO: 525440 - protein, 12 aa, Mycobacterium
LSTDTKDRALRT

SEQ ID NO: 525441 - protein, 9 aa, Mycobacterium
LSTDVSQRA

SEQ ID NO: 525442 - protein, 4 aa, Mycobacterium
LSTE

SEQ ID NO: 525443 - protein, 11 aa, Mycobacterium
LSTEDPSSAVG

SEQ ID NO: 525444 - protein, 7 aa, Mycobacterium
LSTEDQA

SEQ ID NO: 525445 - protein, 10 aa, Mycobacterium
LSTEEAEARR

SEQ ID NO: 525446 - protein, 8 aa, Mycobacterium
LSTEPDKA

SEQ ID NO: 525447 - protein, 7 aa, Mycobacterium
LSTEQAL

SEQ ID NO: 525448 - protein, 7 aa, Mycobacterium
LSTESDQ

SEQ ID NO: 525449 - protein, 4 aa, Mycobacterium
LSTF

SEQ ID NO: 525450 - protein, 8 aa, Mycobacterium
LSTFTGTP

SEQ ID NO: 525451 - protein, 4 aa, Mycobacterium
LSTG

SEQ ID NO: 525452 - protein, 12 aa, Mycobacterium
LSTGADGRPEQV

SEQ ID NO: 525453 - protein, 8 aa, Mycobacterium
LSTGCGKR

SEQ ID NO: 525454 - protein, 9 aa, Mycobacterium
LSTGDTDGV

SEQ ID NO: 525455 - protein, 10 aa, Mycobacterium
LSTGFDGPDT

SEQ ID NO: 525456 - protein, 18 aa, Mycobacterium
LSTGGTPRSPTTPAAGRG

SEQ ID NO: 525457 - protein, 17 aa, Mycobacterium
LSTGGYGGAGNARTQAW

SEQ ID NO: 525458 - protein, 9 aa, Mycobacterium
LSTGLEGTG

SEQ ID NO: 525459 - protein, 9 aa, Mycobacterium
LSTGNPDPA

SEQ ID NO: 525460 - protein, 6 aa, Mycobacterium
LSTGPI

SEQ ID NO: 525461 - protein, 5 aa, Mycobacterium
LSTGS

SEQ ID NO: 525462 - protein, 19 aa, Mycobacterium
LSTGSGSYAVTETANAAAT

SEQ ID NO: 525463 - protein, 7 aa, Mycobacterium
LSTGSPL

SEQ ID NO: 525464 - protein, 6 aa, Mycobacterium
LSTGYT

SEQ ID NO: 525465 - protein, 13 aa, Mycobacterium
LSTLTTAADPLTS

SEQ ID NO: 525466 - protein, 33 aa, Mycobacterium
LSTNGESSSQPSALDLPSATPNYSPGPLRNPFP

SEQ ID NO: 525467 - protein, 6 aa, Mycobacterium
LSTNPM

SEQ ID NO: 525468 - protein, 6 aa, Mycobacterium
LSTNPR

SEQ ID NO: 525469 - protein, 8 aa, Mycobacterium
LSTPADTR

SEQ ID NO: 525470 - protein, 10 aa, Mycobacterium
LSTPDGRELA

SEQ ID NO: 525471 - protein, 6 aa, Mycobacterium
LSTPDI

SEQ ID NO: 525472 - protein, 7 aa, Mycobacterium
LSTPDIT

SEQ ID NO: 525473 - protein, 10 aa, Mycobacterium
LSTPDTDEAA

SEQ ID NO: 525474 - protein, 7 aa, Mycobacterium
LSTPDVT

SEQ ID NO: 525475 - protein, 8 aa, Mycobacterium
LSTPEAPI

SEQ ID NO: 525476 - protein, 8 aa, Mycobacterium
LSTPEATT

SEQ ID NO: 525477 - protein, 12 aa, Mycobacterium
LSTPEGRRRAAD

SEQ ID NO: 525478 - protein, 8 aa, Mycobacterium
LSTPEHPI

SEQ ID NO: 525479 - protein, 8 aa, Mycobacterium
LSTPEPEY

SEQ ID NO: 525480 - protein, 8 aa, Mycobacterium
LSTPGDTR

SEQ ID NO: 525481 - protein, 13 aa, Mycobacterium
LSTPGGPSHQATD

SEQ ID NO: 525482 - protein, 8 aa, Mycobacterium
LSTPGGQD

SEQ ID NO: 525483 - protein, 8 aa, Mycobacterium
LSTPGSQV

SEQ ID NO: 525484 - protein, 7 aa, Mycobacterium
LSTPGVP

SEQ ID NO: 525485 - protein, 14 aa, Mycobacterium
LSTPLKKPAEDSSH

SEQ ID NO: 525486 - protein, 13 aa, Mycobacterium
LSTPQGRAQAADG

SEQ ID NO: 525487 - protein, 21 aa, Mycobacterium
LSTPQQPPGREPLHRRALARK

SEQ ID NO: 525488 - protein, 7 aa, Mycobacterium
LSTPQSI

SEQ ID NO: 525489 - protein, 18 aa, Mycobacterium
LSTPRDELAQRTAQLTRQ

SEQ ID NO: 525490 - protein, 7 aa, Mycobacterium
LSTPRRA

SEQ ID NO: 525491 - protein, 13 aa, Mycobacterium
LSTPSRPADANRR

SEQ ID NO: 525492 - protein, 9 aa, Mycobacterium
LSTPTNREA

SEQ ID NO: 525493 - protein, 5 aa, Mycobacterium
LSTQA

SEQ ID NO: 525494 - protein, 6 aa, Mycobacterium
LSTRDK

SEQ ID NO: 525495 - protein, 9 aa, Mycobacterium
LSTRDRIGQ

SEQ ID NO: 525496 - protein, 8 aa, Mycobacterium
LSTRGVKS

SEQ ID NO: 525497 - protein, 8 aa, Mycobacterium
LSTRPGFD

SEQ ID NO: 525498 - protein, 9 aa, Mycobacterium
LSTRPNATL

SEQ ID NO: 525499 - protein, 6 aa, Mycobacterium
LSTRTE

SEQ ID NO: 525500 - protein, 14 aa, Mycobacterium
LSTRVGELSGGQRR

SEQ ID NO: 525501 - protein, 7 aa, Mycobacterium
LSTSDIT

SEQ ID NO: 525502 - protein, 12 aa, Mycobacterium
LSTSDRDTIPKP

SEQ ID NO: 525503 - protein, 8 aa, Mycobacterium
LSTSPPKL

SEQ ID NO: 525504 - protein, 26 aa, Mycobacterium
LSTSQSPTHNDGSGQPVPSRSASRDE

SEQ ID NO: 525505 - protein, 19 aa, Mycobacterium
LSTSSGSYAATEAANAAAA

SEQ ID NO: 525506 - protein, 18 aa, Mycobacterium
LSTSSLSAHRDSDPTVAG

SEQ ID NO: 525507 - protein, 14 aa, Mycobacterium
LSTSTGELAQAAES

SEQ ID NO: 525508 - protein, 15 aa, Mycobacterium
LSTSTGELAQAAESA

SEQ ID NO: 525509 - protein, 7 aa, Mycobacterium
LSTSTGL

SEQ ID NO: 525510 - protein, 7 aa, Mycobacterium
LSTSVGK

SEQ ID NO: 525511 - protein, 16 aa, Mycobacterium
LSTTALRRERADEIDG

SEQ ID NO: 525512 - protein, 5 aa, Mycobacterium
LSTTD

SEQ ID NO: 525513 - protein, 21 aa, Mycobacterium
LSTTGPNGVPERKLRRHSPLE

SEQ ID NO: 525514 - protein, 5 aa, Mycobacterium
LSTVE

SEQ ID NO: 525515 - protein, 6 aa, Mycobacterium
LSTVRG

SEQ ID NO: 525516 - protein, 8 aa, Mycobacterium
LSTYPGPV

SEQ ID NO: 525517 - protein, 7 aa, Mycobacterium
LSVDEEG

SEQ ID NO: 525518 - protein, 4 aa, Mycobacterium
LSVE

SEQ ID NO: 525519 - protein, 10 aa, Mycobacterium
LSVGDSGDHE

SEQ ID NO: 525520 - protein, 12 aa, Mycobacterium
LSVGGDNSKPDH

SEQ ID NO: 525521 - protein, 7 aa, Mycobacterium
LSVGKDA

SEQ ID NO: 525522 - protein, 14 aa, Mycobacterium
LSVGRNNGSPVSEA

SEQ ID NO: 525523 - protein, 5 aa, Mycobacterium
LSVPS

SEQ ID NO: 525524 - protein, 6 aa, Mycobacterium
LSVQAS

SEQ ID NO: 525525 - protein, 5 aa, Mycobacterium
LSVSG

SEQ ID NO: 525526 - protein, 9 aa, Mycobacterium
LSYDGRNFS

SEQ ID NO: 525527 - protein, 8 aa, Mycobacterium
LSYDRGPI

SEQ ID NO: 525528 - protein, 25 aa, Mycobacterium
LSYGGHDRTAGPTVSAAVDALLGVA

SEQ ID NO: 525529 - protein, 14 aa, Mycobacterium
LSYGPQSDGSLGPE

SEQ ID NO: 525530 - protein, 13 aa, Mycobacterium
LSYGPQSDGSLSP

SEQ ID NO: 525531 - protein, 14 aa, Mycobacterium
LSYGPQSDGSLSPE

SEQ ID NO: 525532 - protein, 4 aa, Mycobacterium
LSYP

SEQ ID NO: 525533 - protein, 7 aa, Mycobacterium
LSYPGGE

SEQ ID NO: 525534 - protein, 6 aa, Mycobacterium
LSYPTE

SEQ ID NO: 525535 - protein, 12 aa, Mycobacterium
LTAAAASAQHPM

SEQ ID NO: 525536 - protein, 9 aa, Mycobacterium
LTAAAKANG

SEQ ID NO: 525537 - protein, 18 aa, Mycobacterium
LTAAGADVSAVESGPPLH

SEQ ID NO: 525538 - protein, 10 aa, Mycobacterium
LTAAGAPATF

SEQ ID NO: 525539 - protein, 8 aa, Mycobacterium
LTAAGDPW

SEQ ID NO: 525540 - protein, 7 aa, Mycobacterium
LTAAGQD

SEQ ID NO: 525541 - protein, 8 aa, Mycobacterium
LTAAGQDR

SEQ ID NO: 525542 - protein, 9 aa, Mycobacterium
LTAAGRTRA

SEQ ID NO: 525543 - protein, 9 aa, Mycobacterium
LTAANPDAV

SEQ ID NO: 525544 - protein, 5 aa, Mycobacterium
LTAAP

SEQ ID NO: 525545 - protein, 9 aa, Mycobacterium
LTAAPSTTQ

SEQ ID NO: 525546 - protein, 5 aa, Mycobacterium
LTAAQ

SEQ ID NO: 525547 - protein, 12 aa, Mycobacterium
LTAAQATATQAG

SEQ ID NO: 525548 - protein, 12 aa, Mycobacterium
LTAASGVRPAGK

SEQ ID NO: 525549 - protein, 6 aa, Mycobacterium
LTADDE

SEQ ID NO: 525550 - protein, 12 aa, Mycobacterium
LTADDQGGQHIQ

SEQ ID NO: 525551 - protein, 12 aa, Mycobacterium
LTADGPSGTSRL

SEQ ID NO: 525552 - protein, 6 aa, Mycobacterium
LTADGV

SEQ ID NO: 525553 - protein, 11 aa, Mycobacterium
LTADPARRAAR

SEQ ID NO: 525554 - protein, 6 aa, Mycobacterium
LTADQR

SEQ ID NO: 525555 - protein, 11 aa, Mycobacterium
LTADSTDGSGA

SEQ ID NO: 525556 - protein, 14 aa, Mycobacterium
LTADTAASVGARRV

SEQ ID NO: 525557 - protein, 4 aa, Mycobacterium
LTAE

SEQ ID NO: 525558 - protein, 9 aa, Mycobacterium
LTAEAAATH

SEQ ID NO: 525559 - protein, 10 aa, Mycobacterium
LTAEARSGAD

SEQ ID NO: 525560 - protein, 7 aa, Mycobacterium
LTAEDKA

SEQ ID NO: 525561 - protein, 9 aa, Mycobacterium
LTAEEPKEV

SEQ ID NO: 525562 - protein, 6 aa, Mycobacterium
LTAEGH

SEQ ID NO: 525563 - protein, 9 aa, Mycobacterium
LTAEQKRQD

SEQ ID NO: 525564 - protein, 19 aa, Mycobacterium
LTAEQTQRDTVTGQYGPGL

SEQ ID NO: 525565 - protein, 11 aa, Mycobacterium
LTAETELTGPL

SEQ ID NO: 525566 - protein, 14 aa, Mycobacterium
LTAETGKPAPLSAS

SEQ ID NO: 525567 - protein, 12 aa, Mycobacterium
LTAGAGPGTGKC

SEQ ID NO: 525568 - protein, 16 aa, Mycobacterium
LTAGAGTPPIGSPVPG

SEQ ID NO: 525569 - protein, 6 aa, Mycobacterium
LTAGAR

SEQ ID NO: 525570 - protein, 9 aa, Mycobacterium
LTAGDAGEA

SEQ ID NO: 525571 - protein, 10 aa, Mycobacterium
LTAGDASALN

SEQ ID NO: 525572 - protein, 19 aa, Mycobacterium
LTAGEAEATANGRPLAPAG

SEQ ID NO: 525573 - protein, 8 aa, Mycobacterium
LTAGERPA

SEQ ID NO: 525574 - protein, 17 aa, Mycobacterium
LTAGESFGEVESTKSVS

SEQ ID NO: 525575 - protein, 13 aa, Mycobacterium
LTAGGQDGELRGD

SEQ ID NO: 525576 - protein, 9 aa, Mycobacterium
LTAGGRAKL

SEQ ID NO: 525577 - protein, 11 aa, Mycobacterium
LTAGKGDKAAF

SEQ ID NO: 525578 - protein, 11 aa, Mycobacterium
LTAGPRHAAPS

SEQ ID NO: 525579 - protein, 6 aa, Mycobacterium
LTAGQT

SEQ ID NO: 525580 - protein, 12 aa, Mycobacterium
LTAGRGPGTGKC

SEQ ID NO: 525581 - protein, 19 aa, Mycobacterium
LTAGTAGVKGFKNAEPENI

SEQ ID NO: 525582 - protein, 19 aa, Mycobacterium
LTAGTDGAKGFRNAEPAEI

SEQ ID NO: 525583 - protein, 6 aa, Mycobacterium
LTAGTQ

SEQ ID NO: 525584 - protein, 4 aa, Mycobacterium
LTAK

SEQ ID NO: 525585 - protein, 5 aa, Mycobacterium
LTAKG

SEQ ID NO: 525586 - protein, 11 aa, Mycobacterium
LTAKPEQQGAG

SEQ ID NO: 525587 - protein, 6 aa, Mycobacterium
LTAKPV

SEQ ID NO: 525588 - protein, 12 aa, Mycobacterium
LTANADSTGVDN

SEQ ID NO: 525589 - protein, 10 aa, Mycobacterium
LTAPAPHHTR

SEQ ID NO: 525590 - protein, 26 aa, Mycobacterium
LTAPAPKRPATPEGKRTPAKGRGGAV

SEQ ID NO: 525591 - protein, 5 aa, Mycobacterium
LTAPG

SEQ ID NO: 525592 - protein, 10 aa, Mycobacterium
LTAPGRAPHS

SEQ ID NO: 525593 - protein, 10 aa, Mycobacterium
LTAPKDDYTK

SEQ ID NO: 525594 - protein, 7 aa, Mycobacterium
LTAPPPV

SEQ ID NO: 525595 - protein, 11 aa, Mycobacterium
LTAPPSTATGQ

SEQ ID NO: 525596 - protein, 9 aa, Mycobacterium
LTAPTAPTV

SEQ ID NO: 525597 - protein, 6 aa, Mycobacterium
LTAQEQ

SEQ ID NO: 525598 - protein, 11 aa, Mycobacterium
LTAQGLSGTEV

SEQ ID NO: 525599 - protein, 9 aa, Mycobacterium
LTAQGVDPA

SEQ ID NO: 525600 - protein, 7 aa, Mycobacterium
LTAQPAQ

SEQ ID NO: 525601 - protein, 4 aa, Mycobacterium
LTAR

SEQ ID NO: 525602 - protein, 17 aa, Mycobacterium
LTARDSGIDLRKNSEGW

SEQ ID NO: 525603 - protein, 12 aa, Mycobacterium
LTARGADGARHS

SEQ ID NO: 525604 - protein, 11 aa, Mycobacterium
LTARPQPADGV

SEQ ID NO: 525605 - protein, 4 aa, Mycobacterium
LTAS

SEQ ID NO: 525606 - protein, 6 aa, Mycobacterium
LTASAG

SEQ ID NO: 525607 - protein, 6 aa, Mycobacterium
LTASGH

SEQ ID NO: 525608 - protein, 7 aa, Mycobacterium
LTASGTA

SEQ ID NO: 525609 - protein, 16 aa, Mycobacterium
LTASGTATATRLGGPG

SEQ ID NO: 525610 - protein, 16 aa, Mycobacterium
LTASGWGPNLQHGSPP

SEQ ID NO: 525611 - protein, 16 aa, Mycobacterium
LTASHGSPMRTPLQES

SEQ ID NO: 525612 - protein, 9 aa, Mycobacterium
LTASKSELP

SEQ ID NO: 525613 - protein, 31 aa, Mycobacterium
LTASPSTEAPPSPATVAARKARGSSCMRKDP

SEQ ID NO: 525614 - protein, 17 aa, Mycobacterium
LTASQVKEVSDAPVEVG

SEQ ID NO: 525615 - protein, 10 aa, Mycobacterium
LTASYDDAAP

SEQ ID NO: 525616 - protein, 6 aa, Mycobacterium
LTATAT

SEQ ID NO: 525617 - protein, 6 aa, Mycobacterium
LTATDD

SEQ ID NO: 525618 - protein, 11 aa, Mycobacterium
LTATDEDLDAG

SEQ ID NO: 525619 - protein, 16 aa, Mycobacterium
LTATESDTTIVGPRGH

SEQ ID NO: 525620 - protein, 12 aa, Mycobacterium
LTATESGSRTDK

SEQ ID NO: 525621 - protein, 5 aa, Mycobacterium
LTATG

SEQ ID NO: 525622 - protein, 12 aa, Mycobacterium
LTATGVGAPVQA

SEQ ID NO: 525623 - protein, 10 aa, Mycobacterium
LTATNDFSEA

SEQ ID NO: 525624 - protein, 10 aa, Mycobacterium
LTATSGIRQR

SEQ ID NO: 525625 - protein, 5 aa, Mycobacterium
LTAVE

SEQ ID NO: 525626 - protein, 11 aa, Mycobacterium
LTAVPQPSEGI

SEQ ID NO: 525627 - protein, 13 aa, Mycobacterium
LTDAARRSVPGQH

SEQ ID NO: 525628 - protein, 11 aa, Mycobacterium
LTDADEGPPRI

SEQ ID NO: 525629 - protein, 9 aa, Mycobacterium
LTDADGPSV

SEQ ID NO: 525630 - protein, 10 aa, Mycobacterium
LTDADPDDCA

SEQ ID NO: 525631 - protein, 7 aa, Mycobacterium
LTDAGQT

SEQ ID NO: 525632 - protein, 7 aa, Mycobacterium
LTDAKGR

SEQ ID NO: 525633 - protein, 12 aa, Mycobacterium
LTDAPGNGAPLG

SEQ ID NO: 525634 - protein, 14 aa, Mycobacterium
LTDASSAAAGPTTN

SEQ ID NO: 525635 - protein, 10 aa, Mycobacterium
LTDDAGEVVG

SEQ ID NO: 525636 - protein, 11 aa, Mycobacterium
LTDDDENVRTA

SEQ ID NO: 525637 - protein, 7 aa, Mycobacterium
LTDDDGG

SEQ ID NO: 525638 - protein, 19 aa, Mycobacterium
LTDDERAARRRETGRPPAM

SEQ ID NO: 525639 - protein, 6 aa, Mycobacterium
LTDDET

SEQ ID NO: 525640 - protein, 11 aa, Mycobacterium
LTDDGNEGTTL

SEQ ID NO: 525641 - protein, 11 aa, Mycobacterium
LTDDHEDQASR

SEQ ID NO: 525642 - protein, 24 aa, Mycobacterium
LTDDIDTSSVDSDYYPPGSLPSYE

SEQ ID NO: 525643 - protein, 5 aa, Mycobacterium
LTDDP

SEQ ID NO: 525644 - protein, 9 aa, Mycobacterium
LTDDPQERL

SEQ ID NO: 525645 - protein, 30 aa, Mycobacterium
LTDDPYADVPPPEEPPGGTHTDTDEPTTWS

SEQ ID NO: 525646 - protein, 16 aa, Mycobacterium
LTDDQARSAPSASALS

SEQ ID NO: 525647 - protein, 12 aa, Mycobacterium
LTDDRVSSRSDI

SEQ ID NO: 525648 - protein, 15 aa, Mycobacterium
LTDDSGTSSLAQGCT

SEQ ID NO: 525649 - protein, 4 aa, Mycobacterium
LTDE

SEQ ID NO: 525650 - protein, 7 aa, Mycobacterium
LTDEDGF

SEQ ID NO: 525651 - protein, 5 aa, Mycobacterium
LTDEE

SEQ ID NO: 525652 - protein, 7 aa, Mycobacterium
LTDEGSE

SEQ ID NO: 525653 - protein, 6 aa, Mycobacterium
LTDEHK

SEQ ID NO: 525654 - protein, 16 aa, Mycobacterium
LTDEQARSTPSASALS

SEQ ID NO: 525655 - protein, 13 aa, Mycobacterium
LTDEQARSTPSVS

SEQ ID NO: 525656 - protein, 6 aa, Mycobacterium
LTDEQK

SEQ ID NO: 525657 - protein, 7 aa, Mycobacterium
LTDEQKR

SEQ ID NO: 525658 - protein, 10 aa, Mycobacterium
LTDEQKVTDN

SEQ ID NO: 525659 - protein, 6 aa, Mycobacterium
LTDERD

SEQ ID NO: 525660 - protein, 14 aa, Mycobacterium
LTDESGKTPGTDLR

SEQ ID NO: 525661 - protein, 11 aa, Mycobacterium
LTDESRRTDAT

SEQ ID NO: 525662 - protein, 11 aa, Mycobacterium
LTDETKKGYAD

SEQ ID NO: 525663 - protein, 4 aa, Mycobacterium
LTDG

SEQ ID NO: 525664 - protein, 5 aa, Mycobacterium
LTDGA

SEQ ID NO: 525665 - protein, 11 aa, Mycobacterium
LTDGADRRVST

SEQ ID NO: 525666 - protein, 7 aa, Mycobacterium
LTDGAKR

SEQ ID NO: 525667 - protein, 15 aa, Mycobacterium
LTDGAKVEVVTAVQG

SEQ ID NO: 525668 - protein, 7 aa, Mycobacterium
LTDGDAG

SEQ ID NO: 525669 - protein, 7 aa, Mycobacterium
LTDGDGV

SEQ ID NO: 525670 - protein, 9 aa, Mycobacterium
LTDGDGYRV

SEQ ID NO: 525671 - protein, 5 aa, Mycobacterium
LTDGG

SEQ ID NO: 525672 - protein, 7 aa, Mycobacterium
LTDGPDA

SEQ ID NO: 525673 - protein, 20 aa, Mycobacterium
LTDGPDLAARARTAVGDHPD

SEQ ID NO: 525674 - protein, 8 aa, Mycobacterium
LTDGQTST

SEQ ID NO: 525675 - protein, 9 aa, Mycobacterium
LTDGSEKEV

SEQ ID NO: 525676 - protein, 12 aa, Mycobacterium
LTDGSGGADAYA

SEQ ID NO: 525677 - protein, 8 aa, Mycobacterium
LTDGTEKE

SEQ ID NO: 525678 - protein, 10 aa, Mycobacterium
LTDGTELTPA

SEQ ID NO: 525679 - protein, 5 aa, Mycobacterium
LTDGY

SEQ ID NO: 525680 - protein, 13 aa, Mycobacterium
LTDGYGPCVGSGT

SEQ ID NO: 525681 - protein, 10 aa, Mycobacterium
LTDKDSAERD

SEQ ID NO: 525682 - protein, 6 aa, Mycobacterium
LTDKHG

SEQ ID NO: 525683 - protein, 6 aa, Mycobacterium
LTDKPV

SEQ ID NO: 525684 - protein, 9 aa, Mycobacterium
LTDKQGARL

SEQ ID NO: 525685 - protein, 6 aa, Mycobacterium
LTDKRP

SEQ ID NO: 525686 - protein, 5 aa, Mycobacterium
LTDLP

SEQ ID NO: 525687 - protein, 4 aa, Mycobacterium
LTDN

SEQ ID NO: 525688 - protein, 5 aa, Mycobacterium
LTDND

SEQ ID NO: 525689 - protein, 11 aa, Mycobacterium
LTDNPNEAREA

SEQ ID NO: 525690 - protein, 5 aa, Mycobacterium
LTDNS

SEQ ID NO: 525691 - protein, 4 aa, Mycobacterium
LTDP

SEQ ID NO: 525692 - protein, 12 aa, Mycobacterium
LTDPAADTGKKT

SEQ ID NO: 525693 - protein, 15 aa, Mycobacterium
LTDPAAIAAATDQVP

SEQ ID NO: 525694 - protein, 16 aa, Mycobacterium
LTDPAAKNAAPKKSVR

SEQ ID NO: 525695 - protein, 10 aa, Mycobacterium
LTDPAATAAL

SEQ ID NO: 525696 - protein, 17 aa, Mycobacterium
LTDPADAPAPADAANAP

SEQ ID NO: 525697 - protein, 13 aa, Mycobacterium
LTDPAKRKEYDET

SEQ ID NO: 525698 - protein, 6 aa, Mycobacterium
LTDPDD

SEQ ID NO: 525699 - protein, 7 aa, Mycobacterium
LTDPDEA

SEQ ID NO: 525700 - protein, 7 aa, Mycobacterium
LTDPDGP

SEQ ID NO: 525701 - protein, 11 aa, Mycobacterium
LTDPDTGAGET

SEQ ID NO: 525702 - protein, 10 aa, Mycobacterium
LTDPDVARAS

SEQ ID NO: 525703 - protein, 7 aa, Mycobacterium
LTDPENA

SEQ ID NO: 525704 - protein, 9 aa, Mycobacterium
LTDPERTYS

SEQ ID NO: 525705 - protein, 6 aa, Mycobacterium
LTDPGD

SEQ ID NO: 525706 - protein, 7 aa, Mycobacterium
LTDPGGL

SEQ ID NO: 525707 - protein, 6 aa, Mycobacterium
LTDPND

SEQ ID NO: 525708 - protein, 6 aa, Mycobacterium
LTDPPA

SEQ ID NO: 525709 - protein, 8 aa, Mycobacterium
LTDPPATL

SEQ ID NO: 525710 - protein, 14 aa, Mycobacterium
LTDPPKLKKQEKHD

SEQ ID NO: 525711 - protein, 9 aa, Mycobacterium
LTDPPPEPL

SEQ ID NO: 525712 - protein, 23 aa, Mycobacterium
LTDPPRAGGAITDNATDTPRRRR

SEQ ID NO: 525713 - protein, 13 aa, Mycobacterium
LTDPRAHGGDPAD

SEQ ID NO: 525714 - protein, 6 aa, Mycobacterium
LTDPRK

SEQ ID NO: 525715 - protein, 7 aa, Mycobacterium
LTDPSAD

SEQ ID NO: 525716 - protein, 13 aa, Mycobacterium
LTDPSALADTAGY

SEQ ID NO: 525717 - protein, 10 aa, Mycobacterium
LTDPSPGTSI

SEQ ID NO: 525718 - protein, 7 aa, Mycobacterium
LTDPSSD

SEQ ID NO: 525719 - protein, 8 aa, Mycobacterium
LTDPSSDL

SEQ ID NO: 525720 - protein, 22 aa, Mycobacterium
LTDPSTGRPLATNDSDGVVDPG

SEQ ID NO: 525721 - protein, 7 aa, Mycobacterium
LTDPTGY

SEQ ID NO: 525722 - protein, 8 aa, Mycobacterium
LTDQEAPA

SEQ ID NO: 525723 - protein, 8 aa, Mycobacterium
LTDQRGAE

SEQ ID NO: 525724 - protein, 4 aa, Mycobacterium
LTDR

SEQ ID NO: 525725 - protein, 14 aa, Mycobacterium
LTDRAGSVQKAIDD

SEQ ID NO: 525726 - protein, 5 aa, Mycobacterium
LTDRD

SEQ ID NO: 525727 - protein, 7 aa, Mycobacterium
LTDRDAV

SEQ ID NO: 525728 - protein, 6 aa, Mycobacterium
LTDRDD

SEQ ID NO: 525729 - protein, 10 aa, Mycobacterium
LTDRDTEREH

SEQ ID NO: 525730 - protein, 10 aa, Mycobacterium
LTDRGAATKA

SEQ ID NO: 525731 - protein, 7 aa, Mycobacterium
LTDRGDP

SEQ ID NO: 525732 - protein, 6 aa, Mycobacterium
LTDRGG

SEQ ID NO: 525733 - protein, 10 aa, Mycobacterium
LTDRGSPDAV

SEQ ID NO: 525734 - protein, 12 aa, Mycobacterium
LTDRSTSDERRE

SEQ ID NO: 525735 - protein, 4 aa, Mycobacterium
LTDS

SEQ ID NO: 525736 - protein, 8 aa, Mycobacterium
LTDSAGRA

SEQ ID NO: 525737 - protein, 15 aa, Mycobacterium
LTDSAPPPTAAPSSF

SEQ ID NO: 525738 - protein, 8 aa, Mycobacterium
LTDSAYRG

SEQ ID NO: 525739 - protein, 7 aa, Mycobacterium
LTDSHSD

SEQ ID NO: 525740 - protein, 9 aa, Mycobacterium
LTDSIAKGA

SEQ ID NO: 525741 - protein, 8 aa, Mycobacterium
LTDSNAAT

SEQ ID NO: 525742 - protein, 8 aa, Mycobacterium
LTDSPAGL

SEQ ID NO: 525743 - protein, 6 aa, Mycobacterium
LTDSPV

SEQ ID NO: 525744 - protein, 8 aa, Mycobacterium
LTDSSSDL

SEQ ID NO: 525745 - protein, 6 aa, Mycobacterium
LTDSTA

SEQ ID NO: 525746 - protein, 4 aa, Mycobacterium
LTDT

SEQ ID NO: 525747 - protein, 7 aa, Mycobacterium
LTDTAGR

SEQ ID NO: 525748 - protein, 8 aa, Mycobacterium
LTDTDPLD

SEQ ID NO: 525749 - protein, 7 aa, Mycobacterium
LTDTERD

SEQ ID NO: 525750 - protein, 8 aa, Mycobacterium
LTDTETRD

SEQ ID NO: 525751 - protein, 13 aa, Mycobacterium
LTDTEVSGVPIRK

SEQ ID NO: 525752 - protein, 6 aa, Mycobacterium
LTDTGE

SEQ ID NO: 525753 - protein, 8 aa, Mycobacterium
LTDTGRVQ

SEQ ID NO: 525754 - protein, 9 aa, Mycobacterium
LTDTPPETL

SEQ ID NO: 525755 - protein, 6 aa, Mycobacterium
LTDTQQ

SEQ ID NO: 525756 - protein, 5 aa, Mycobacterium
LTDTT

SEQ ID NO: 525757 - protein, 7 aa, Mycobacterium
LTDTTVK

SEQ ID NO: 525758 - protein, 5 aa, Mycobacterium
LTDTY

SEQ ID NO: 525759 - protein, 5 aa, Mycobacterium
LTDYK

SEQ ID NO: 525760 - protein, 4 aa, Mycobacterium
LTEA

SEQ ID NO: 525761 - protein, 14 aa, Mycobacterium
LTEAASAQRPSPAV

SEQ ID NO: 525762 - protein, 10 aa, Mycobacterium
LTEADRNTTR

SEQ ID NO: 525763 - protein, 6 aa, Mycobacterium
LTEADS

SEQ ID NO: 525764 - protein, 5 aa, Mycobacterium
LTEAG

SEQ ID NO: 525765 - protein, 8 aa, Mycobacterium
LTEAGAEV

SEQ ID NO: 525766 - protein, 8 aa, Mycobacterium
LTEAGQTL

SEQ ID NO: 525767 - protein, 11 aa, Mycobacterium
LTEAGSGDPYD

SEQ ID NO: 525768 - protein, 6 aa, Mycobacterium
LTEAGT

SEQ ID NO: 525769 - protein, 10 aa, Mycobacterium
LTEAQRAHRQ

SEQ ID NO: 525770 - protein, 10 aa, Mycobacterium
LTEARTAAAE

SEQ ID NO: 525771 - protein, 4 aa, Mycobacterium
LTEC

SEQ ID NO: 525772 - protein, 4 aa, Mycobacterium
LTED

SEQ ID NO: 525773 - protein, 25 aa, Mycobacterium
LTEDAARPDAVQRRHDAGGRTAREN

SEQ ID NO: 525774 - protein, 6 aa, Mycobacterium
LTEDAS

SEQ ID NO: 525775 - protein, 10 aa, Mycobacterium
LTEDEAATLA

SEQ ID NO: 525776 - protein, 7 aa, Mycobacterium
LTEDESA

SEQ ID NO: 525777 - protein, 6 aa, Mycobacterium
LTEDEV

SEQ ID NO: 525778 - protein, 7 aa, Mycobacterium
LTEDEVA

SEQ ID NO: 525779 - protein, 9 aa, Mycobacterium
LTEDGTADR

SEQ ID NO: 525780 - protein, 5 aa, Mycobacterium
LTEDL

SEQ ID NO: 525781 - protein, 24 aa, Mycobacterium
LTEDPEQRDSEELSDEVASTGAQR

SEQ ID NO: 525782 - protein, 12 aa, Mycobacterium
LTEDPEQRDVEE

SEQ ID NO: 525783 - protein, 13 aa, Mycobacterium
LTEDPEQRDVEEL

SEQ ID NO: 525784 - protein, 9 aa, Mycobacterium
LTEDPPARA

SEQ ID NO: 525785 - protein, 10 aa, Mycobacterium
LTEDSQRGDG

SEQ ID NO: 525786 - protein, 11 aa, Mycobacterium
LTEDVQATYGT

SEQ ID NO: 525787 - protein, 7 aa, Mycobacterium
LTEEAAA

SEQ ID NO: 525788 - protein, 8 aa, Mycobacterium
LTEEATAD

SEQ ID NO: 525789 - protein, 9 aa, Mycobacterium
LTEEATADR

SEQ ID NO: 525790 - protein, 15 aa, Mycobacterium
LTEEAYAKNAKRGRQ

SEQ ID NO: 525791 - protein, 15 aa, Mycobacterium
LTEEAYAKNPKRGRH

SEQ ID NO: 525792 - protein, 10 aa, Mycobacterium
LTEEDTGADP

SEQ ID NO: 525793 - protein, 16 aa, Mycobacterium
LTEEEIGEYSGERKEI

SEQ ID NO: 525794 - protein, 18 aa, Mycobacterium
LTEEGTAAAEKLDTPPWE

SEQ ID NO: 525795 - protein, 5 aa, Mycobacterium
LTEEL

SEQ ID NO: 525796 - protein, 5 aa, Mycobacterium
LTEEQ

SEQ ID NO: 525797 - protein, 11 aa, Mycobacterium
LTEEQRGQIEE

SEQ ID NO: 525798 - protein, 6 aa, Mycobacterium
LTEERS

SEQ ID NO: 525799 - protein, 6 aa, Mycobacterium
LTEESS

SEQ ID NO: 525800 - protein, 14 aa, Mycobacterium
LTEETGSDGRRRAR

SEQ ID NO: 525801 - protein, 6 aa, Mycobacterium
LTEGPL

SEQ ID NO: 525802 - protein, 5 aa, Mycobacterium
LTEGR

SEQ ID NO: 525803 - protein, 19 aa, Mycobacterium
LTEGSAAITPAPQTDDGPF

SEQ ID NO: 525804 - protein, 7 aa, Mycobacterium
LTEGSTP

SEQ ID NO: 525805 - protein, 10 aa, Mycobacterium
LTEKGQATRA

SEQ ID NO: 525806 - protein, 6 aa, Mycobacterium
LTEKGR

SEQ ID NO: 525807 - protein, 12 aa, Mycobacterium
LTENADSTGVDN

SEQ ID NO: 525808 - protein, 8 aa, Mycobacterium
LTENDPAK

SEQ ID NO: 525809 - protein, 10 aa, Mycobacterium
LTENDPDKLE

SEQ ID NO: 525810 - protein, 7 aa, Mycobacterium
LTEPADG

SEQ ID NO: 525811 - protein, 24 aa, Mycobacterium
LTEPDAERNWNSDRRNSELDEDGI

SEQ ID NO: 525812 - protein, 20 aa, Mycobacterium
LTEPDEGTTPTDVTPATPLG

SEQ ID NO: 525813 - protein, 24 aa, Mycobacterium
LTEPEAERNWNSDRRNADLDSEGI

SEQ ID NO: 525814 - protein, 6 aa, Mycobacterium
LTEPEF

SEQ ID NO: 525815 - protein, 7 aa, Mycobacterium
LTEPENA

SEQ ID NO: 525816 - protein, 7 aa, Mycobacterium
LTEPERS

SEQ ID NO: 525817 - protein, 7 aa, Mycobacterium
LTEPESG

SEQ ID NO: 525818 - protein, 8 aa, Mycobacterium
LTEPEYAT

SEQ ID NO: 525819 - protein, 10 aa, Mycobacterium
LTEPKAISSL

SEQ ID NO: 525820 - protein, 7 aa, Mycobacterium
LTEPSDA

SEQ ID NO: 525821 - protein, 10 aa, Mycobacterium
LTEPSRAAVR

SEQ ID NO: 525822 - protein, 21 aa, Mycobacterium
LTEPVDPDHPYGAGHAATAVV

SEQ ID NO: 525823 - protein, 12 aa, Mycobacterium
LTEQAANLGPQS

SEQ ID NO: 525824 - protein, 16 aa, Mycobacterium
LTEQDPGGDGTLPETL

SEQ ID NO: 525825 - protein, 9 aa, Mycobacterium
LTEQQRAEL

SEQ ID NO: 525826 - protein, 5 aa, Mycobacterium
LTERA

SEQ ID NO: 525827 - protein, 6 aa, Mycobacterium
LTERAE

SEQ ID NO: 525828 - protein, 13 aa, Mycobacterium
LTERCPSREDGRT

SEQ ID NO: 525829 - protein, 7 aa, Mycobacterium
LTERDSG

SEQ ID NO: 525830 - protein, 24 aa, Mycobacterium
LTERERAAARASRLERRGAANDAL

SEQ ID NO: 525831 - protein, 26 aa, Mycobacterium
LTERGATRADDRISEAGMEDRKREGY

SEQ ID NO: 525832 - protein, 11 aa, Mycobacterium
LTERGEFETEN

SEQ ID NO: 525833 - protein, 7 aa, Mycobacterium
LTERPGR

SEQ ID NO: 525834 - protein, 6 aa, Mycobacterium
LTERPR

SEQ ID NO: 525835 - protein, 6 aa, Mycobacterium
LTERPS

SEQ ID NO: 525836 - protein, 5 aa, Mycobacterium
LTERQ

SEQ ID NO: 525837 - protein, 16 aa, Mycobacterium
LTERQGDSVERIPTPQ

SEQ ID NO: 525838 - protein, 10 aa, Mycobacterium
LTERSQRLGS

SEQ ID NO: 525839 - protein, 10 aa, Mycobacterium
LTERSRRIGS

SEQ ID NO: 525840 - protein, 5 aa, Mycobacterium
LTERT

SEQ ID NO: 525841 - protein, 7 aa, Mycobacterium
LTESDAN

SEQ ID NO: 525842 - protein, 10 aa, Mycobacterium
LTESDDPDVR

SEQ ID NO: 525843 - protein, 7 aa, Mycobacterium
LTESEAH

SEQ ID NO: 525844 - protein, 7 aa, Mycobacterium
LTESESL

SEQ ID NO: 525845 - protein, 5 aa, Mycobacterium
LTESF

SEQ ID NO: 525846 - protein, 6 aa, Mycobacterium
LTESGL

SEQ ID NO: 525847 - protein, 6 aa, Mycobacterium
LTESGR

SEQ ID NO: 525848 - protein, 21 aa, Mycobacterium
LTESPAAETPPEEAPAAETPV

SEQ ID NO: 525849 - protein, 10 aa, Mycobacterium
LTESPQRGGP

SEQ ID NO: 525850 - protein, 21 aa, Mycobacterium
LTESPSTRAAARAATKGHTRN

SEQ ID NO: 525851 - protein, 18 aa, Mycobacterium
LTESPTESQTESPTESLT

SEQ ID NO: 525852 - protein, 101 aa, Mycobacterium
LTESQTESPTEALTESPTEAQTESLTESQTEAQTEAPTEAPTESPTEAQTESPTEAQTESPTEAQTEAPTEAPTESQTEAQTESLTESQTESPLPLAISSR

SEQ ID NO: 525853 - protein, 34 aa, Mycobacterium
LTESQTESPTEALTESPTESPTESQTESPTESLT

SEQ ID NO: 525854 - protein, 5 aa, Mycobacterium
LTEST

SEQ ID NO: 525855 - protein, 8 aa, Mycobacterium
LTESTDGW

SEQ ID NO: 525856 - protein, 20 aa, Mycobacterium
LTETAALSAAGATMQASEQA

SEQ ID NO: 525857 - protein, 6 aa, Mycobacterium
LTETDA

SEQ ID NO: 525858 - protein, 5 aa, Mycobacterium
LTETF

SEQ ID NO: 525859 - protein, 9 aa, Mycobacterium
LTETGAVTR

SEQ ID NO: 525860 - protein, 11 aa, Mycobacterium
LTETKDREYPV

SEQ ID NO: 525861 - protein, 7 aa, Mycobacterium
LTETPTP

SEQ ID NO: 525862 - protein, 6 aa, Mycobacterium
LTETRG

SEQ ID NO: 525863 - protein, 6 aa, Mycobacterium
LTETRT

SEQ ID NO: 525864 - protein, 7 aa, Mycobacterium
LTETSAA

SEQ ID NO: 525865 - protein, 7 aa, Mycobacterium
LTETSST

SEQ ID NO: 525866 - protein, 5 aa, Mycobacterium
LTETT

SEQ ID NO: 525867 - protein, 12 aa, Mycobacterium
LTETYTAGGASV

SEQ ID NO: 525868 - protein, 4 aa, Mycobacterium
LTGA

SEQ ID NO: 525869 - protein, 10 aa, Mycobacterium
LTGAAQAALD

SEQ ID NO: 525870 - protein, 5 aa, Mycobacterium
LTGAD

SEQ ID NO: 525871 - protein, 5 aa, Mycobacterium
LTGAE

SEQ ID NO: 525872 - protein, 15 aa, Mycobacterium
LTGAGKSQVGRRLGR

SEQ ID NO: 525873 - protein, 22 aa, Mycobacterium
LTGAGQKALQGLEQAAGPAMSG

SEQ ID NO: 525874 - protein, 10 aa, Mycobacterium
LTGAGTGAAR

SEQ ID NO: 525875 - protein, 9 aa, Mycobacterium
LTGAPQETV

SEQ ID NO: 525876 - protein, 10 aa, Mycobacterium
LTGARASALA

SEQ ID NO: 525877 - protein, 10 aa, Mycobacterium
LTGAYNDAEP

SEQ ID NO: 525878 - protein, 4 aa, Mycobacterium
LTGD

SEQ ID NO: 525879 - protein, 10 aa, Mycobacterium
LTGDAQDRQV

SEQ ID NO: 525880 - protein, 8 aa, Mycobacterium
LTGDDPSE

SEQ ID NO: 525881 - protein, 6 aa, Mycobacterium
LTGDED

SEQ ID NO: 525882 - protein, 8 aa, Mycobacterium
LTGDGATT

SEQ ID NO: 525883 - protein, 18 aa, Mycobacterium
LTGDGGASVTPLARQTRS

SEQ ID NO: 525884 - protein, 18 aa, Mycobacterium
LTGDGGPGMYEDGGPVPV

SEQ ID NO: 525885 - protein, 18 aa, Mycobacterium
LTGDGGPGMYESGDPVPV

SEQ ID NO: 525886 - protein, 6 aa, Mycobacterium
LTGDGR

SEQ ID NO: 525887 - protein, 13 aa, Mycobacterium
LTGDGVDVVRAHR

SEQ ID NO: 525888 - protein, 7 aa, Mycobacterium
LTGDPQL

SEQ ID NO: 525889 - protein, 12 aa, Mycobacterium
LTGDQTEDLGNA

SEQ ID NO: 525890 - protein, 16 aa, Mycobacterium
LTGDRIEDAVRKRQGV

SEQ ID NO: 525891 - protein, 12 aa, Mycobacterium
LTGDRSPVMSTA

SEQ ID NO: 525892 - protein, 4 aa, Mycobacterium
LTGE

SEQ ID NO: 525893 - protein, 8 aa, Mycobacterium
LTGEAPAA

SEQ ID NO: 525894 - protein, 9 aa, Mycobacterium
LTGEDERAR

SEQ ID NO: 525895 - protein, 6 aa, Mycobacterium
LTGEED

SEQ ID NO: 525896 - protein, 6 aa, Mycobacterium
LTGEER

SEQ ID NO: 525897 - protein, 20 aa, Mycobacterium
LTGEGERTAAGLADRAGGQV

SEQ ID NO: 525898 - protein, 10 aa, Mycobacterium
LTGEGGPGMY

SEQ ID NO: 525899 - protein, 6 aa, Mycobacterium
LTGEGT

SEQ ID NO: 525900 - protein, 22 aa, Mycobacterium
LTGEPDGPPTLPGYSSADNSTG

SEQ ID NO: 525901 - protein, 8 aa, Mycobacterium
LTGEPPAA

SEQ ID NO: 525902 - protein, 8 aa, Mycobacterium
LTGEPSRQ

SEQ ID NO: 525903 - protein, 9 aa, Mycobacterium
LTGEPVDDA

SEQ ID NO: 525904 - protein, 7 aa, Mycobacterium
LTGEQTH

SEQ ID NO: 525905 - protein, 6 aa, Mycobacterium
LTGEQY

SEQ ID NO: 525906 - protein, 5 aa, Mycobacterium
LTGER

SEQ ID NO: 525907 - protein, 10 aa, Mycobacterium
LTGERTIPGL

SEQ ID NO: 525908 - protein, 6 aa, Mycobacterium
LTGEVR

SEQ ID NO: 525909 - protein, 6 aa, Mycobacterium
LTGGAG

SEQ ID NO: 525910 - protein, 7 aa, Mycobacterium
LTGGAGV

SEQ ID NO: 525911 - protein, 6 aa, Mycobacterium
LTGGAL

SEQ ID NO: 525912 - protein, 6 aa, Mycobacterium
LTGGAS

SEQ ID NO: 525913 - protein, 5 aa, Mycobacterium
LTGGG

SEQ ID NO: 525914 - protein, 22 aa, Mycobacterium
LTGGGAAAAPAEAPAASGGGIG

SEQ ID NO: 525915 - protein, 10 aa, Mycobacterium
LTGGGDPAQL

SEQ ID NO: 525916 - protein, 9 aa, Mycobacterium
LTGGGGTDL

SEQ ID NO: 525917 - protein, 9 aa, Mycobacterium
LTGGGSGIG

SEQ ID NO: 525918 - protein, 10 aa, Mycobacterium
LTGGGSSATV

SEQ ID NO: 525919 - protein, 8 aa, Mycobacterium
LTGGHGAE

SEQ ID NO: 525920 - protein, 6 aa, Mycobacterium
LTGGLA

SEQ ID NO: 525921 - protein, 7 aa, Mycobacterium
LTGGLGE

SEQ ID NO: 525922 - protein, 9 aa, Mycobacterium
LTGGNAAGL

SEQ ID NO: 525923 - protein, 15 aa, Mycobacterium
LTGGPQPAPEEPCAS

SEQ ID NO: 525924 - protein, 7 aa, Mycobacterium
LTGGPSL

SEQ ID NO: 525925 - protein, 11 aa, Mycobacterium
LTGGSAPSGPG

SEQ ID NO: 525926 - protein, 8 aa, Mycobacterium
LTGGSPRY

SEQ ID NO: 525927 - protein, 15 aa, Mycobacterium
LTGGTEAGRSASIAT

SEQ ID NO: 525928 - protein, 9 aa, Mycobacterium
LTGGTERSH

SEQ ID NO: 525929 - protein, 17 aa, Mycobacterium
LTGGTGGSGGAGGAGGL

SEQ ID NO: 525930 - protein, 16 aa, Mycobacterium
LTGGTGKPSLAPDPVN

SEQ ID NO: 525931 - protein, 7 aa, Mycobacterium
LTGGTNR

SEQ ID NO: 525932 - protein, 7 aa, Mycobacterium
LTGGVDP

SEQ ID NO: 525933 - protein, 4 aa, Mycobacterium
LTGH

SEQ ID NO: 525934 - protein, 6 aa, Mycobacterium
LTGHEG

SEQ ID NO: 525935 - protein, 7 aa, Mycobacterium
LTGHPGV

SEQ ID NO: 525936 - protein, 4 aa, Mycobacterium
LTGK

SEQ ID NO: 525937 - protein, 8 aa, Mycobacterium
LTGKAGAE

SEQ ID NO: 525938 - protein, 8 aa, Mycobacterium
LTGKDAEL

SEQ ID NO: 525939 - protein, 10 aa, Mycobacterium
LTGKDEDRDV

SEQ ID NO: 525940 - protein, 10 aa, Mycobacterium
LTGKDSGTLS

SEQ ID NO: 525941 - protein, 5 aa, Mycobacterium
LTGKR

SEQ ID NO: 525942 - protein, 11 aa, Mycobacterium
LTGKSKDEVNA

SEQ ID NO: 525943 - protein, 11 aa, Mycobacterium
LTGKSKDEVTA

SEQ ID NO: 525944 - protein, 5 aa, Mycobacterium
LTGLN

SEQ ID NO: 525945 - protein, 6 aa, Mycobacterium
LTGLNN

SEQ ID NO: 525946 - protein, 10 aa, Mycobacterium
LTGNEHGSAL

SEQ ID NO: 525947 - protein, 29 aa, Mycobacterium
LTGNGKLDKRALPAPEYATAEYRAPEDPV

SEQ ID NO: 525948 - protein, 27 aa, Mycobacterium
LTGNGKLDKRALPSPEYTASEYRAPAD

SEQ ID NO: 525949 - protein, 9 aa, Mycobacterium
LTGNGRPHQ

SEQ ID NO: 525950 - protein, 6 aa, Mycobacterium
LTGNPT

SEQ ID NO: 525951 - protein, 14 aa, Mycobacterium
LTGNQTIPQLDNAP

SEQ ID NO: 525952 - protein, 5 aa, Mycobacterium
LTGNR

SEQ ID NO: 525953 - protein, 10 aa, Mycobacterium
LTGNRSAGTD

SEQ ID NO: 525954 - protein, 4 aa, Mycobacterium
LTGP

SEQ ID NO: 525955 - protein, 7 aa, Mycobacterium
LTGPAAA

SEQ ID NO: 525956 - protein, 12 aa, Mycobacterium
LTGPAADRAAAA

SEQ ID NO: 525957 - protein, 10 aa, Mycobacterium
LTGPAAGTLT

SEQ ID NO: 525958 - protein, 9 aa, Mycobacterium
LTGPAARRV

SEQ ID NO: 525959 - protein, 7 aa, Mycobacterium
LTGPADA

SEQ ID NO: 525960 - protein, 8 aa, Mycobacterium
LTGPAGLA

SEQ ID NO: 525961 - protein, 5 aa, Mycobacterium
LTGPD

SEQ ID NO: 525962 - protein, 7 aa, Mycobacterium
LTGPDGM

SEQ ID NO: 525963 - protein, 7 aa, Mycobacterium
LTGPDGS

SEQ ID NO: 525964 - protein, 13 aa, Mycobacterium
LTGPDKPADAPVE

SEQ ID NO: 525965 - protein, 177 aa, Mycobacterium
LTGPDPSPLTQGGKWGPSPNGPGMTPPLPASPLGSGGGSGGGGGRMPSLGSGSPSLASGFPSQLGSGTVPASAAPSAGAVSPASAAPLANSGSSFQSGLASGMGATSGMTASATPPAQPQQPMASTQPPVAAPSAAGPGMGPAGVGPGSGWTAQPVDSAGVSGGHGAGSAPIAGGGG

SEQ ID NO: 525966 - protein, 6 aa, Mycobacterium
LTGPEH

SEQ ID NO: 525967 - protein, 9 aa, Mycobacterium
LTGPENSGR

SEQ ID NO: 525968 - protein, 9 aa, Mycobacterium
LTGPEPPRG

SEQ ID NO: 525969 - protein, 14 aa, Mycobacterium
LTGPESRTRGGTFG

SEQ ID NO: 525970 - protein, 8 aa, Mycobacterium
LTGPETPR

SEQ ID NO: 525971 - protein, 13 aa, Mycobacterium
LTGPGADPDGPEV

SEQ ID NO: 525972 - protein, 10 aa, Mycobacterium
LTGPGGADHR

SEQ ID NO: 525973 - protein, 9 aa, Mycobacterium
LTGPGGRTI

SEQ ID NO: 525974 - protein, 6 aa, Mycobacterium
LTGPGL

SEQ ID NO: 525975 - protein, 11 aa, Mycobacterium
LTGPGLGGQSL

SEQ ID NO: 525976 - protein, 6 aa, Mycobacterium
LTGPGS

SEQ ID NO: 525977 - protein, 10 aa, Mycobacterium
LTGPGSERYL

SEQ ID NO: 525978 - protein, 5 aa, Mycobacterium
LTGPH

SEQ ID NO: 525979 - protein, 5 aa, Mycobacterium
LTGPL

SEQ ID NO: 525980 - protein, 6 aa, Mycobacterium
LTGPLG

SEQ ID NO: 525981 - protein, 8 aa, Mycobacterium
LTGPNGMS

SEQ ID NO: 525982 - protein, 14 aa, Mycobacterium
LTGPPGAQHYSDEE

SEQ ID NO: 525983 - protein, 7 aa, Mycobacterium
LTGPPGF

SEQ ID NO: 525984 - protein, 9 aa, Mycobacterium
LTGPPPPVA

SEQ ID NO: 525985 - protein, 5 aa, Mycobacterium
LTGPQ

SEQ ID NO: 525986 - protein, 8 aa, Mycobacterium
LTGPQAFT

SEQ ID NO: 525987 - protein, 9 aa, Mycobacterium
LTGPRDSPE

SEQ ID NO: 525988 - protein, 13 aa, Mycobacterium
LTGPRRPTSRPTM

SEQ ID NO: 525989 - protein, 22 aa, Mycobacterium
LTGPTERQQMSSPESSTATAQI

SEQ ID NO: 525990 - protein, 7 aa, Mycobacterium
LTGPTSI

SEQ ID NO: 525991 - protein, 7 aa, Mycobacterium
LTGPTVN

SEQ ID NO: 525992 - protein, 5 aa, Mycobacterium
LTGPV

SEQ ID NO: 525993 - protein, 13 aa, Mycobacterium
LTGPYRDRPSTEF

SEQ ID NO: 525994 - protein, 4 aa, Mycobacterium
LTGQ

SEQ ID NO: 525995 - protein, 8 aa, Mycobacterium
LTGQAREA

SEQ ID NO: 525996 - protein, 14 aa, Mycobacterium
LTGQATSVPGPGWT

SEQ ID NO: 525997 - protein, 5 aa, Mycobacterium
LTGQH

SEQ ID NO: 525998 - protein, 6 aa, Mycobacterium
LTGQHP

SEQ ID NO: 525999 - protein, 13 aa, Mycobacterium
LTGQPAKQAPFEP

SEQ ID NO: 526000 - protein, 14 aa, Mycobacterium
LTGQPAKQAPFEPL

SEQ ID NO: 526001 - protein, 15 aa, Mycobacterium
LTGQPAKQAPFEPLP

SEQ ID NO: 526002 - protein, 14 aa, Mycobacterium
LTGQPAKQAPFQPL

SEQ ID NO: 526003 - protein, 15 aa, Mycobacterium
LTGQPSKRAPFAPLP

SEQ ID NO: 526004 - protein, 6 aa, Mycobacterium
LTGRAE

SEQ ID NO: 526005 - protein, 5 aa, Mycobacterium
LTGRG

SEQ ID NO: 526006 - protein, 10 aa, Mycobacterium
LTGRGARWGG

SEQ ID NO: 526007 - protein, 6 aa, Mycobacterium
LTGRGE

SEQ ID NO: 526008 - protein, 8 aa, Mycobacterium
LTGRGETT

SEQ ID NO: 526009 - protein, 9 aa, Mycobacterium
LTGRGGGTV

SEQ ID NO: 526010 - protein, 9 aa, Mycobacterium
LTGRGKSKR

SEQ ID NO: 526011 - protein, 8 aa, Mycobacterium
LTGRGPGY

SEQ ID NO: 526012 - protein, 29 aa, Mycobacterium
LTGRPARTLASEPEAAARGARTTPGLPPD

SEQ ID NO: 526013 - protein, 9 aa, Mycobacterium
LTGRQKPLT

SEQ ID NO: 526014 - protein, 12 aa, Mycobacterium
LTGRRAASTGAH

SEQ ID NO: 526015 - protein, 6 aa, Mycobacterium
LTGRRP

SEQ ID NO: 526016 - protein, 7 aa, Mycobacterium
LTGRRSH

SEQ ID NO: 526017 - protein, 10 aa, Mycobacterium
LTGRSNNPWN

SEQ ID NO: 526018 - protein, 10 aa, Mycobacterium
LTGRTVGGPM

SEQ ID NO: 526019 - protein, 39 aa, Mycobacterium
LTGRVQASATKVAQASTGYRANEAKSAAQIAAVADRARD

SEQ ID NO: 526020 - protein, 4 aa, Mycobacterium
LTGS

SEQ ID NO: 526021 - protein, 6 aa, Mycobacterium
LTGSAL

SEQ ID NO: 526022 - protein, 9 aa, Mycobacterium
LTGSATGDI

SEQ ID NO: 526023 - protein, 10 aa, Mycobacterium
LTGSATVDGS

SEQ ID NO: 526024 - protein, 5 aa, Mycobacterium
LTGSD

SEQ ID NO: 526025 - protein, 16 aa, Mycobacterium
LTGSDSGPGRLPEAEE

SEQ ID NO: 526026 - protein, 10 aa, Mycobacterium
LTGSERAGAA

SEQ ID NO: 526027 - protein, 7 aa, Mycobacterium
LTGSGET

SEQ ID NO: 526028 - protein, 13 aa, Mycobacterium
LTGSGTSFSAARE

SEQ ID NO: 526029 - protein, 7 aa, Mycobacterium
LTGSKID

SEQ ID NO: 526030 - protein, 9 aa, Mycobacterium
LTGSLDPAG

SEQ ID NO: 526031 - protein, 12 aa, Mycobacterium
LTGSQTLDASTP

SEQ ID NO: 526032 - protein, 5 aa, Mycobacterium
LTGSR

SEQ ID NO: 526033 - protein, 11 aa, Mycobacterium
LTGSRDAALTA

SEQ ID NO: 526034 - protein, 21 aa, Mycobacterium
LTGSRVQDARLEEADLRGTRV

SEQ ID NO: 526035 - protein, 22 aa, Mycobacterium
LTGSSGPPGSPRAAETPLAQYN

SEQ ID NO: 526036 - protein, 12 aa, Mycobacterium
LTGSSTLHPGTP

SEQ ID NO: 526037 - protein, 4 aa, Mycobacterium
LTGT

SEQ ID NO: 526038 - protein, 8 aa, Mycobacterium
LTGTAPRS

SEQ ID NO: 526039 - protein, 14 aa, Mycobacterium
LTGTDEPPQPAPGS

SEQ ID NO: 526040 - protein, 16 aa, Mycobacterium
LTGTDSGSGRLPEAEE

SEQ ID NO: 526041 - protein, 7 aa, Mycobacterium
LTGTEAV

SEQ ID NO: 526042 - protein, 10 aa, Mycobacterium
LTGTGFSGDA

SEQ ID NO: 526043 - protein, 14 aa, Mycobacterium
LTGTPEPMEDQCAS

SEQ ID NO: 526044 - protein, 7 aa, Mycobacterium
LTGTPGA

SEQ ID NO: 526045 - protein, 8 aa, Mycobacterium
LTGTPMSV

SEQ ID NO: 526046 - protein, 7 aa, Mycobacterium
LTGTQKR

SEQ ID NO: 526047 - protein, 17 aa, Mycobacterium
LTGTQTTHQRYPDETDR

SEQ ID NO: 526048 - protein, 5 aa, Mycobacterium
LTGTR

SEQ ID NO: 526049 - protein, 18 aa, Mycobacterium
LTGTRAEPEAYYDSDDAN

SEQ ID NO: 526050 - protein, 7 aa, Mycobacterium
LTGTRGT

SEQ ID NO: 526051 - protein, 6 aa, Mycobacterium
LTGTSD

SEQ ID NO: 526052 - protein, 8 aa, Mycobacterium
LTGTSDTK

SEQ ID NO: 526053 - protein, 8 aa, Mycobacterium
LTGTTESV

SEQ ID NO: 526054 - protein, 8 aa, Mycobacterium
LTGTTGLG

SEQ ID NO: 526055 - protein, 6 aa, Mycobacterium
LTGVTE

SEQ ID NO: 526056 - protein, 6 aa, Mycobacterium
LTGWPR

SEQ ID NO: 526057 - protein, 7 aa, Mycobacterium
LTGWSSS

SEQ ID NO: 526058 - protein, 4 aa, Mycobacterium
LTGY

SEQ ID NO: 526059 - protein, 15 aa, Mycobacterium
LTGYRPGEKSSFREH

SEQ ID NO: 526060 - protein, 7 aa, Mycobacterium
LTGYRSG

SEQ ID NO: 526061 - protein, 7 aa, Mycobacterium
LTHGGTP

SEQ ID NO: 526062 - protein, 5 aa, Mycobacterium
LTHGR

SEQ ID NO: 526063 - protein, 6 aa, Mycobacterium
LTHRGG

SEQ ID NO: 526064 - protein, 7 aa, Mycobacterium
LTKAGAA

SEQ ID NO: 526065 - protein, 10 aa, Mycobacterium
LTKANEADKL

SEQ ID NO: 526066 - protein, 8 aa, Mycobacterium
LTKDPNAA

SEQ ID NO: 526067 - protein, 5 aa, Mycobacterium
LTKDQ

SEQ ID NO: 526068 - protein, 7 aa, Mycobacterium
LTKDQAE

SEQ ID NO: 526069 - protein, 8 aa, Mycobacterium
LTKDRDSQ

SEQ ID NO: 526070 - protein, 7 aa, Mycobacterium
LTKEGRD

SEQ ID NO: 526071 - protein, 8 aa, Mycobacterium
LTKENRDF

SEQ ID NO: 526072 - protein, 7 aa, Mycobacterium
LTKERRD

SEQ ID NO: 526073 - protein, 8 aa, Mycobacterium
LTKGVASA

SEQ ID NO: 526074 - protein, 6 aa, Mycobacterium
LTKKSS

SEQ ID NO: 526075 - protein, 4 aa, Mycobacterium
LTKN

SEQ ID NO: 526076 - protein, 16 aa, Mycobacterium
LTKPCGPAEGPYAAEP

SEQ ID NO: 526077 - protein, 9 aa, Mycobacterium
LTKPTGALG

SEQ ID NO: 526078 - protein, 8 aa, Mycobacterium
LTKPTRPD

SEQ ID NO: 526079 - protein, 6 aa, Mycobacterium
LTKPVA

SEQ ID NO: 526080 - protein, 7 aa, Mycobacterium
LTKTGSN

SEQ ID NO: 526081 - protein, 9 aa, Mycobacterium
LTKTRAPRT

SEQ ID NO: 526082 - protein, 32 aa, Mycobacterium
LTLGGGAETFSQTANGGEYKGKTLEAQAKERG

SEQ ID NO: 526083 - protein, 4 aa, Mycobacterium
LTLP

SEQ ID NO: 526084 - protein, 8 aa, Mycobacterium
LTLPDGEF

SEQ ID NO: 526085 - protein, 7 aa, Mycobacterium
LTLSEDP

SEQ ID NO: 526086 - protein, 8 aa, Mycobacterium
LTLSGDAD

SEQ ID NO: 526087 - protein, 8 aa, Mycobacterium
LTMSEDPA

SEQ ID NO: 526088 - protein, 7 aa, Mycobacterium
LTNDETL

SEQ ID NO: 526089 - protein, 6 aa, Mycobacterium
LTNDGT

SEQ ID NO: 526090 - protein, 19 aa, Mycobacterium
LTNEDGPLVRDGNTVRQRV

SEQ ID NO: 526091 - protein, 5 aa, Mycobacterium
LTNGD

SEQ ID NO: 526092 - protein, 4 aa, Mycobacterium
LTNK

SEQ ID NO: 526093 - protein, 8 aa, Mycobacterium
LTNNPGSS

SEQ ID NO: 526094 - protein, 10 aa, Mycobacterium
LTNNSSNANV

SEQ ID NO: 526095 - protein, 10 aa, Mycobacterium
LTNPAKPRAG

SEQ ID NO: 526096 - protein, 11 aa, Mycobacterium
LTNPASGRAED

SEQ ID NO: 526097 - protein, 6 aa, Mycobacterium
LTNPAY

SEQ ID NO: 526098 - protein, 17 aa, Mycobacterium
LTNPGDVLAERGPGAAR

SEQ ID NO: 526099 - protein, 12 aa, Mycobacterium
LTNPTAHGGRAE

SEQ ID NO: 526100 - protein, 13 aa, Mycobacterium
LTNPTAHGGRAED

SEQ ID NO: 526101 - protein, 4 aa, Mycobacterium
LTNQ

SEQ ID NO: 526102 - protein, 11 aa, Mycobacterium
LTNQNKSVGGQ

SEQ ID NO: 526103 - protein, 7 aa, Mycobacterium
LTNRRAP

SEQ ID NO: 526104 - protein, 13 aa, Mycobacterium
LTNSRQKFDEQRE

SEQ ID NO: 526105 - protein, 7 aa, Mycobacterium
LTNTGTD

SEQ ID NO: 526106 - protein, 7 aa, Mycobacterium
LTNTTTK

SEQ ID NO: 526107 - protein, 4 aa, Mycobacterium
LTNV

SEQ ID NO: 526108 - protein, 14 aa, Mycobacterium
LTPAAALDTPDAGL

SEQ ID NO: 526109 - protein, 10 aa, Mycobacterium
LTPAAERDID

SEQ ID NO: 526110 - protein, 7 aa, Mycobacterium
LTPAAQP

SEQ ID NO: 526111 - protein, 14 aa, Mycobacterium
LTPAATVDAPHTGL

SEQ ID NO: 526112 - protein, 5 aa, Mycobacterium
LTPAD

SEQ ID NO: 526113 - protein, 12 aa, Mycobacterium
LTPAEAAELDPQ

SEQ ID NO: 526114 - protein, 6 aa, Mycobacterium
LTPAER

SEQ ID NO: 526115 - protein, 12 aa, Mycobacterium
LTPAERAERGSH

SEQ ID NO: 526116 - protein, 15 aa, Mycobacterium
LTPAERRDAMARTDR

SEQ ID NO: 526117 - protein, 8 aa, Mycobacterium
LTPAGDSR

SEQ ID NO: 526118 - protein, 10 aa, Mycobacterium
LTPAGEPTLR

SEQ ID NO: 526119 - protein, 30 aa, Mycobacterium
LTPAGERNVSKRDDDRGEHEANPFAGAVGD

SEQ ID NO: 526120 - protein, 6 aa, Mycobacterium
LTPAGK

SEQ ID NO: 526121 - protein, 11 aa, Mycobacterium
LTPAGKELHER

SEQ ID NO: 526122 - protein, 7 aa, Mycobacterium
LTPAGRE

SEQ ID NO: 526123 - protein, 8 aa, Mycobacterium
LTPAPATA

SEQ ID NO: 526124 - protein, 6 aa, Mycobacterium
LTPAPG

SEQ ID NO: 526125 - protein, 5 aa, Mycobacterium
LTPAQ

SEQ ID NO: 526126 - protein, 6 aa, Mycobacterium
LTPAQG

SEQ ID NO: 526127 - protein, 6 aa, Mycobacterium
LTPAQY

SEQ ID NO: 526128 - protein, 16 aa, Mycobacterium
LTPARAEAVQRDRDEV

SEQ ID NO: 526129 - protein, 7 aa, Mycobacterium
LTPARAT

SEQ ID NO: 526130 - protein, 12 aa, Mycobacterium
LTPARKADLEPA

SEQ ID NO: 526131 - protein, 6 aa, Mycobacterium
LTPARQ

SEQ ID NO: 526132 - protein, 9 aa, Mycobacterium
LTPASPARA

SEQ ID NO: 526133 - protein, 18 aa, Mycobacterium
LTPATASGAAPSEQTRPQ

SEQ ID NO: 526134 - protein, 7 aa, Mycobacterium
LTPATDY

SEQ ID NO: 526135 - protein, 16 aa, Mycobacterium
LTPCEPGSAANSAGTL

SEQ ID NO: 526136 - protein, 5 aa, Mycobacterium
LTPDD

SEQ ID NO: 526137 - protein, 6 aa, Mycobacterium
LTPDDG

SEQ ID NO: 526138 - protein, 6 aa, Mycobacterium
LTPDDI

SEQ ID NO: 526139 - protein, 9 aa, Mycobacterium
LTPDDPEYR

SEQ ID NO: 526140 - protein, 5 aa, Mycobacterium
LTPDE

SEQ ID NO: 526141 - protein, 9 aa, Mycobacterium
LTPDEADEL

SEQ ID NO: 526142 - protein, 8 aa, Mycobacterium
LTPDEATA

SEQ ID NO: 526143 - protein, 6 aa, Mycobacterium
LTPDEF

SEQ ID NO: 526144 - protein, 7 aa, Mycobacterium
LTPDELS

SEQ ID NO: 526145 - protein, 5 aa, Mycobacterium
LTPDF

SEQ ID NO: 526146 - protein, 5 aa, Mycobacterium
LTPDG

SEQ ID NO: 526147 - protein, 6 aa, Mycobacterium
LTPDGD

SEQ ID NO: 526148 - protein, 8 aa, Mycobacterium
LTPDGDEA

SEQ ID NO: 526149 - protein, 8 aa, Mycobacterium
LTPDGEGT

SEQ ID NO: 526150 - protein, 16 aa, Mycobacterium
LTPDGHATNPPARYTE

SEQ ID NO: 526151 - protein, 16 aa, Mycobacterium
LTPDGHTTNPPARYTE

SEQ ID NO: 526152 - protein, 9 aa, Mycobacterium
LTPDGPTAS

SEQ ID NO: 526153 - protein, 6 aa, Mycobacterium
LTPDGQ

SEQ ID NO: 526154 - protein, 7 aa, Mycobacterium
LTPDGVT

SEQ ID NO: 526155 - protein, 6 aa, Mycobacterium
LTPDHP

SEQ ID NO: 526156 - protein, 5 aa, Mycobacterium
LTPDL

SEQ ID NO: 526157 - protein, 8 aa, Mycobacterium
LTPDLGPG

SEQ ID NO: 526158 - protein, 5 aa, Mycobacterium
LTPDP

SEQ ID NO: 526159 - protein, 17 aa, Mycobacterium
LTPDPEPDVPEARPPAL

SEQ ID NO: 526160 - protein, 5 aa, Mycobacterium
LTPDQ

SEQ ID NO: 526161 - protein, 6 aa, Mycobacterium
LTPDQI

SEQ ID NO: 526162 - protein, 8 aa, Mycobacterium
LTPDQSVE

SEQ ID NO: 526163 - protein, 5 aa, Mycobacterium
LTPDR

SEQ ID NO: 526164 - protein, 11 aa, Mycobacterium
LTPDREDVPSS

SEQ ID NO: 526165 - protein, 8 aa, Mycobacterium
LTPDRGDD

SEQ ID NO: 526166 - protein, 15 aa, Mycobacterium
LTPDRRARATVYTSG

SEQ ID NO: 526167 - protein, 21 aa, Mycobacterium
LTPDRSVEEQAQRIVDLLESR

SEQ ID NO: 526168 - protein, 10 aa, Mycobacterium
LTPDSDFDQA

SEQ ID NO: 526169 - protein, 10 aa, Mycobacterium
LTPDSEPVLT

SEQ ID NO: 526170 - protein, 9 aa, Mycobacterium
LTPDSEPVR

SEQ ID NO: 526171 - protein, 9 aa, Mycobacterium
LTPDSTPGE

SEQ ID NO: 526172 - protein, 17 aa, Mycobacterium
LTPDTRSATKDAAARAE

SEQ ID NO: 526173 - protein, 5 aa, Mycobacterium
LTPDY

SEQ ID NO: 526174 - protein, 4 aa, Mycobacterium
LTPE

SEQ ID NO: 526175 - protein, 10 aa, Mycobacterium
LTPECGDDGW

SEQ ID NO: 526176 - protein, 5 aa, Mycobacterium
LTPED

SEQ ID NO: 526177 - protein, 7 aa, Mycobacterium
LTPEDLR

SEQ ID NO: 526178 - protein, 7 aa, Mycobacterium
LTPEDRD

SEQ ID NO: 526179 - protein, 7 aa, Mycobacterium
LTPEELG

SEQ ID NO: 526180 - protein, 10 aa, Mycobacterium
LTPEELGGAL

SEQ ID NO: 526181 - protein, 10 aa, Mycobacterium
LTPEERMASN

SEQ ID NO: 526182 - protein, 7 aa, Mycobacterium
LTPEGAT

SEQ ID NO: 526183 - protein, 7 aa, Mycobacterium
LTPEGVR

SEQ ID NO: 526184 - protein, 7 aa, Mycobacterium
LTPEKMA

SEQ ID NO: 526185 - protein, 6 aa, Mycobacterium
LTPEMR

SEQ ID NO: 526186 - protein, 6 aa, Mycobacterium
LTPEPK

SEQ ID NO: 526187 - protein, 12 aa, Mycobacterium
LTPEQKDAEYHQ

SEQ ID NO: 526188 - protein, 7 aa, Mycobacterium
LTPEQKH

SEQ ID NO: 526189 - protein, 12 aa, Mycobacterium
LTPEQKHSIDDP

SEQ ID NO: 526190 - protein, 6 aa, Mycobacterium
LTPEQQ

SEQ ID NO: 526191 - protein, 7 aa, Mycobacterium
LTPEQQR

SEQ ID NO: 526192 - protein, 13 aa, Mycobacterium
LTPEQRAYLESHL

SEQ ID NO: 526193 - protein, 6 aa, Mycobacterium
LTPERP

SEQ ID NO: 526194 - protein, 7 aa, Mycobacterium
LTPERRD

SEQ ID NO: 526195 - protein, 6 aa, Mycobacterium
LTPESD

SEQ ID NO: 526196 - protein, 6 aa, Mycobacterium
LTPEVE

SEQ ID NO: 526197 - protein, 5 aa, Mycobacterium
LTPEY

SEQ ID NO: 526198 - protein, 5 aa, Mycobacterium
LTPGA

SEQ ID NO: 526199 - protein, 12 aa, Mycobacterium
LTPGADGIGGTS

SEQ ID NO: 526200 - protein, 7 aa, Mycobacterium
LTPGAEF

SEQ ID NO: 526201 - protein, 8 aa, Mycobacterium
LTPGARTT

SEQ ID NO: 526202 - protein, 7 aa, Mycobacterium
LTPGDDV

SEQ ID NO: 526203 - protein, 12 aa, Mycobacterium
LTPGDGDKRSAL

SEQ ID NO: 526204 - protein, 9 aa, Mycobacterium
LTPGDHEKR

SEQ ID NO: 526205 - protein, 9 aa, Mycobacterium
LTPGDHQKR

SEQ ID NO: 526206 - protein, 5 aa, Mycobacterium
LTPGE

SEQ ID NO: 526207 - protein, 7 aa, Mycobacterium
LTPGESL

SEQ ID NO: 526208 - protein, 6 aa, Mycobacterium
LTPGGD

SEQ ID NO: 526209 - protein, 11 aa, Mycobacterium
LTPGGLATQYS

SEQ ID NO: 526210 - protein, 16 aa, Mycobacterium
LTPGGLATQYSSAGQF

SEQ ID NO: 526211 - protein, 8 aa, Mycobacterium
LTPGGLTK

SEQ ID NO: 526212 - protein, 12 aa, Mycobacterium
LTPGGPTGFPQD

SEQ ID NO: 526213 - protein, 6 aa, Mycobacterium
LTPGGR

SEQ ID NO: 526214 - protein, 7 aa, Mycobacterium
LTPGGRT

SEQ ID NO: 526215 - protein, 18 aa, Mycobacterium
LTPGGTAWEGDAKDAALD

SEQ ID NO: 526216 - protein, 8 aa, Mycobacterium
LTPGHPEY

SEQ ID NO: 526217 - protein, 9 aa, Mycobacterium
LTPGKAAQQ

SEQ ID NO: 526218 - protein, 6 aa, Mycobacterium
LTPGPA

SEQ ID NO: 526219 - protein, 6 aa, Mycobacterium
LTPGPV

SEQ ID NO: 526220 - protein, 10 aa, Mycobacterium
LTPGPVRTDT

SEQ ID NO: 526221 - protein, 9 aa, Mycobacterium
LTPGQAYTT

SEQ ID NO: 526222 - protein, 17 aa, Mycobacterium
LTPGQFRRDSPTLDQGG

SEQ ID NO: 526223 - protein, 6 aa, Mycobacterium
LTPGRE

SEQ ID NO: 526224 - protein, 11 aa, Mycobacterium
LTPGSDPESAA

SEQ ID NO: 526225 - protein, 7 aa, Mycobacterium
LTPGSER

SEQ ID NO: 526226 - protein, 6 aa, Mycobacterium
LTPGSR

SEQ ID NO: 526227 - protein, 11 aa, Mycobacterium
LTPGSRSEDGR

SEQ ID NO: 526228 - protein, 6 aa, Mycobacterium
LTPGSV

SEQ ID NO: 526229 - protein, 6 aa, Mycobacterium
LTPKGG

SEQ ID NO: 526230 - protein, 7 aa, Mycobacterium
LTPKNGE

SEQ ID NO: 526231 - protein, 7 aa, Mycobacterium
LTPKNQD

SEQ ID NO: 526232 - protein, 11 aa, Mycobacterium
LTPKSSAEQLR

SEQ ID NO: 526233 - protein, 19 aa, Mycobacterium
LTPNDPAFQPGFEGADTTV

SEQ ID NO: 526234 - protein, 19 aa, Mycobacterium
LTPNDPDFQPGFEDADTTV

SEQ ID NO: 526235 - protein, 9 aa, Mycobacterium
LTPNDPRFQ

SEQ ID NO: 526236 - protein, 7 aa, Mycobacterium
LTPNGAT

SEQ ID NO: 526237 - protein, 9 aa, Mycobacterium
LTPNGKLDA

SEQ ID NO: 526238 - protein, 32 aa, Mycobacterium
LTPNGKLDARALPSPEYTDADRYRAPQTPVEE

SEQ ID NO: 526239 - protein, 11 aa, Mycobacterium
LTPNGKLDESA

SEQ ID NO: 526240 - protein, 31 aa, Mycobacterium
LTPNGKLDTGALPAPEYTGGRYRAPATPTEE

SEQ ID NO: 526241 - protein, 11 aa, Mycobacterium
LTPNGKLDTRA

SEQ ID NO: 526242 - protein, 30 aa, Mycobacterium
LTPNGKLDTRALPAPEYSDADQYRAPDNAV

SEQ ID NO: 526243 - protein, 31 aa, Mycobacterium
LTPNGKLDTRALPAPEYTGRGYRAPSNATEE

SEQ ID NO: 526244 - protein, 10 aa, Mycobacterium
LTPNGTAPGQ

SEQ ID NO: 526245 - protein, 20 aa, Mycobacterium
LTPNHPELQGDLPDGADTSV

SEQ ID NO: 526246 - protein, 4 aa, Mycobacterium
LTPP

SEQ ID NO: 526247 - protein, 13 aa, Mycobacterium
LTPPAASTHDDTV

SEQ ID NO: 526248 - protein, 7 aa, Mycobacterium
LTPPAEP

SEQ ID NO: 526249 - protein, 22 aa, Mycobacterium
LTPPAPAAPAAPATSSIPGLPA

SEQ ID NO: 526250 - protein, 9 aa, Mycobacterium
LTPPAPATR

SEQ ID NO: 526251 - protein, 14 aa, Mycobacterium
LTPPAPTTIASEAT

SEQ ID NO: 526252 - protein, 17 aa, Mycobacterium
LTPPDRSSISWPGSEDA

SEQ ID NO: 526253 - protein, 8 aa, Mycobacterium
LTPPDTAE

SEQ ID NO: 526254 - protein, 7 aa, Mycobacterium
LTPPELG

SEQ ID NO: 526255 - protein, 9 aa, Mycobacterium
LTPPEPPKD

SEQ ID NO: 526256 - protein, 13 aa, Mycobacterium
LTPPGDAVAESRA

SEQ ID NO: 526257 - protein, 15 aa, Mycobacterium
LTPPGGNGSGTNPEQ

SEQ ID NO: 526258 - protein, 7 aa, Mycobacterium
LTPPPEP

SEQ ID NO: 526259 - protein, 8 aa, Mycobacterium
LTPPQKRQ

SEQ ID NO: 526260 - protein, 5 aa, Mycobacterium
LTPPR

SEQ ID NO: 526261 - protein, 21 aa, Mycobacterium
LTPPSPGQPFQPTTAAVSSAH

SEQ ID NO: 526262 - protein, 9 aa, Mycobacterium
LTPPSSNKP

SEQ ID NO: 526263 - protein, 13 aa, Mycobacterium
LTPPTTATSSGRG

SEQ ID NO: 526264 - protein, 7 aa, Mycobacterium
LTPPTVA

SEQ ID NO: 526265 - protein, 14 aa, Mycobacterium
LTPPVPGHPSPARF

SEQ ID NO: 526266 - protein, 5 aa, Mycobacterium
LTPQA

SEQ ID NO: 526267 - protein, 32 aa, Mycobacterium
LTPQAKVRADEPLTEPAAPEVQPPEPNGRQPY

SEQ ID NO: 526268 - protein, 7 aa, Mycobacterium
LTPQEEA

SEQ ID NO: 526269 - protein, 7 aa, Mycobacterium
LTPQERA

SEQ ID NO: 526270 - protein, 14 aa, Mycobacterium
LTPQGGDLQSGTGS

SEQ ID NO: 526271 - protein, 6 aa, Mycobacterium
LTPQGR

SEQ ID NO: 526272 - protein, 5 aa, Mycobacterium
LTPQP

SEQ ID NO: 526273 - protein, 6 aa, Mycobacterium
LTPQQL

SEQ ID NO: 526274 - protein, 7 aa, Mycobacterium
LTPQQYP

SEQ ID NO: 526275 - protein, 6 aa, Mycobacterium
LTPQRR

SEQ ID NO: 526276 - protein, 5 aa, Mycobacterium
LTPQT

SEQ ID NO: 526277 - protein, 6 aa, Mycobacterium
LTPQTR

SEQ ID NO: 526278 - protein, 18 aa, Mycobacterium
LTPRDDQTVRVTSQQHGR

SEQ ID NO: 526279 - protein, 10 aa, Mycobacterium
LTPRDGQGFL

SEQ ID NO: 526280 - protein, 6 aa, Mycobacterium
LTPRDT

SEQ ID NO: 526281 - protein, 12 aa, Mycobacterium
LTPREGAAIGTA

SEQ ID NO: 526282 - protein, 6 aa, Mycobacterium
LTPRER

SEQ ID NO: 526283 - protein, 6 aa, Mycobacterium
LTPRGA

SEQ ID NO: 526284 - protein, 13 aa, Mycobacterium
LTPRGGDFQSATG

SEQ ID NO: 526285 - protein, 10 aa, Mycobacterium
LTPRGRERYD

SEQ ID NO: 526286 - protein, 17 aa, Mycobacterium
LTPRKGRRAAARSENLR

SEQ ID NO: 526287 - protein, 6 aa, Mycobacterium
LTPRNN

SEQ ID NO: 526288 - protein, 7 aa, Mycobacterium
LTPRNND

SEQ ID NO: 526289 - protein, 7 aa, Mycobacterium
LTPRNSD

SEQ ID NO: 526290 - protein, 7 aa, Mycobacterium
LTPRPGV

SEQ ID NO: 526291 - protein, 8 aa, Mycobacterium
LTPRPPSI

SEQ ID NO: 526292 - protein, 6 aa, Mycobacterium
LTPRQR

SEQ ID NO: 526293 - protein, 9 aa, Mycobacterium
LTPRTAEAD

SEQ ID NO: 526294 - protein, 15 aa, Mycobacterium
LTPRTLTRPELTPVA

SEQ ID NO: 526295 - protein, 7 aa, Mycobacterium
LTPRTPT

SEQ ID NO: 526296 - protein, 7 aa, Mycobacterium
LTPSAVS

SEQ ID NO: 526297 - protein, 5 aa, Mycobacterium
LTPSD

SEQ ID NO: 526298 - protein, 6 aa, Mycobacterium
LTPSDE

SEQ ID NO: 526299 - protein, 6 aa, Mycobacterium
LTPSDP

SEQ ID NO: 526300 - protein, 10 aa, Mycobacterium
LTPSERGEYE

SEQ ID NO: 526301 - protein, 6 aa, Mycobacterium
LTPSEY

SEQ ID NO: 526302 - protein, 5 aa, Mycobacterium
LTPSG

SEQ ID NO: 526303 - protein, 9 aa, Mycobacterium
LTPSGGGWV

SEQ ID NO: 526304 - protein, 6 aa, Mycobacterium
LTPSGI

SEQ ID NO: 526305 - protein, 15 aa, Mycobacterium
LTPSGVRTDDGVEYG

SEQ ID NO: 526306 - protein, 10 aa, Mycobacterium
LTPSKWTPTI

SEQ ID NO: 526307 - protein, 9 aa, Mycobacterium
LTPSQWDTP

SEQ ID NO: 526308 - protein, 7 aa, Mycobacterium
LTPSQYP

SEQ ID NO: 526309 - protein, 8 aa, Mycobacterium
LTPSSAHG

SEQ ID NO: 526310 - protein, 9 aa, Mycobacterium
LTPSSGQGP

SEQ ID NO: 526311 - protein, 9 aa, Mycobacterium
LTPSTGQTH

SEQ ID NO: 526312 - protein, 12 aa, Mycobacterium
LTPSTLNLPGQG

SEQ ID NO: 526313 - protein, 6 aa, Mycobacterium
LTPSTV

SEQ ID NO: 526314 - protein, 6 aa, Mycobacterium
LTPSVA

SEQ ID NO: 526315 - protein, 4 aa, Mycobacterium
LTPT

SEQ ID NO: 526316 - protein, 7 aa, Mycobacterium
LTPTAEE

SEQ ID NO: 526317 - protein, 9 aa, Mycobacterium
LTPTAKEVT

SEQ ID NO: 526318 - protein, 5 aa, Mycobacterium
LTPTD

SEQ ID NO: 526319 - protein, 5 aa, Mycobacterium
LTPTE

SEQ ID NO: 526320 - protein, 6 aa, Mycobacterium
LTPTER

SEQ ID NO: 526321 - protein, 5 aa, Mycobacterium
LTPTG

SEQ ID NO: 526322 - protein, 5 aa, Mycobacterium
LTPTN

SEQ ID NO: 526323 - protein, 12 aa, Mycobacterium
LTPTPAEHARRT

SEQ ID NO: 526324 - protein, 5 aa, Mycobacterium
LTPTQ

SEQ ID NO: 526325 - protein, 9 aa, Mycobacterium
LTPTSRGGR

SEQ ID NO: 526326 - protein, 6 aa, Mycobacterium
LTPTTA

SEQ ID NO: 526327 - protein, 6 aa, Mycobacterium
LTPTTR

SEQ ID NO: 526328 - protein, 7 aa, Mycobacterium
LTPTTTA

SEQ ID NO: 526329 - protein, 12 aa, Mycobacterium
LTPTTTQPGTAG

SEQ ID NO: 526330 - protein, 9 aa, Mycobacterium
LTPWSGSEY

SEQ ID NO: 526331 - protein, 9 aa, Mycobacterium
LTPWSGTEY

SEQ ID NO: 526332 - protein, 8 aa, Mycobacterium
LTQAQRPT

SEQ ID NO: 526333 - protein, 7 aa, Mycobacterium
LTQDATG

SEQ ID NO: 526334 - protein, 9 aa, Mycobacterium
LTQDPASPF

SEQ ID NO: 526335 - protein, 8 aa, Mycobacterium
LTQDPDTN

SEQ ID NO: 526336 - protein, 8 aa, Mycobacterium
LTQDPSAN

SEQ ID NO: 526337 - protein, 7 aa, Mycobacterium
LTQEETI

SEQ ID NO: 526338 - protein, 13 aa, Mycobacterium
LTQEKTDGPRRTL

SEQ ID NO: 526339 - protein, 6 aa, Mycobacterium
LTQEQT

SEQ ID NO: 526340 - protein, 14 aa, Mycobacterium
LTQGGGTDGEKPDR

SEQ ID NO: 526341 - protein, 8 aa, Mycobacterium
LTQGPGFP

SEQ ID NO: 526342 - protein, 7 aa, Mycobacterium
LTQGREA

SEQ ID NO: 526343 - protein, 11 aa, Mycobacterium
LTQMSDKTAPR

SEQ ID NO: 526344 - protein, 11 aa, Mycobacterium
LTQNPDAGPGS

SEQ ID NO: 526345 - protein, 7 aa, Mycobacterium
LTQPDAT

SEQ ID NO: 526346 - protein, 6 aa, Mycobacterium
LTQPDR

SEQ ID NO: 526347 - protein, 5 aa, Mycobacterium
LTQPE

SEQ ID NO: 526348 - protein, 8 aa, Mycobacterium
LTQPEYAT

SEQ ID NO: 526349 - protein, 5 aa, Mycobacterium
LTQPG

SEQ ID NO: 526350 - protein, 9 aa, Mycobacterium
LTQPPPGSI

SEQ ID NO: 526351 - protein, 6 aa, Mycobacterium
LTQPRD

SEQ ID NO: 526352 - protein, 6 aa, Mycobacterium
LTQPTV

SEQ ID NO: 526353 - protein, 10 aa, Mycobacterium
LTQQPKSLPP

SEQ ID NO: 526354 - protein, 4 aa, Mycobacterium
LTQR

SEQ ID NO: 526355 - protein, 6 aa, Mycobacterium
LTQSAD

SEQ ID NO: 526356 - protein, 5 aa, Mycobacterium
LTQSG

SEQ ID NO: 526357 - protein, 9 aa, Mycobacterium
LTQSPGDVA

SEQ ID NO: 526358 - protein, 8 aa, Mycobacterium
LTQSPRDV

SEQ ID NO: 526359 - protein, 7 aa, Mycobacterium
LTQTGTH

SEQ ID NO: 526360 - protein, 14 aa, Mycobacterium
LTQTHPDIPDNIRG

SEQ ID NO: 526361 - protein, 11 aa, Mycobacterium
LTQTHPDIPEQ

SEQ ID NO: 526362 - protein, 8 aa, Mycobacterium
LTQTHPDV

SEQ ID NO: 526363 - protein, 8 aa, Mycobacterium
LTQTPSAV

SEQ ID NO: 526364 - protein, 6 aa, Mycobacterium
LTQTSG

SEQ ID NO: 526365 - protein, 16 aa, Mycobacterium
LTQTSQLADQLDAKNQ

SEQ ID NO: 526366 - protein, 5 aa, Mycobacterium
LTQTT

SEQ ID NO: 526367 - protein, 8 aa, Mycobacterium
LTQVGGSG

SEQ ID NO: 526368 - protein, 5 aa, Mycobacterium
LTRAD

SEQ ID NO: 526369 - protein, 10 aa, Mycobacterium
LTRAGADTTR

SEQ ID NO: 526370 - protein, 6 aa, Mycobacterium
LTRAGI

SEQ ID NO: 526371 - protein, 6 aa, Mycobacterium
LTRARD

SEQ ID NO: 526372 - protein, 9 aa, Mycobacterium
LTRDAGQQL

SEQ ID NO: 526373 - protein, 8 aa, Mycobacterium
LTRDANQQ

SEQ ID NO: 526374 - protein, 8 aa, Mycobacterium
LTRDDAAE

SEQ ID NO: 526375 - protein, 7 aa, Mycobacterium
LTRDDAT

SEQ ID NO: 526376 - protein, 7 aa, Mycobacterium
LTRDGTR

SEQ ID NO: 526377 - protein, 7 aa, Mycobacterium
LTRDPAA

SEQ ID NO: 526378 - protein, 7 aa, Mycobacterium
LTRDPNA

SEQ ID NO: 526379 - protein, 11 aa, Mycobacterium
LTRDSERFGTR

SEQ ID NO: 526380 - protein, 6 aa, Mycobacterium
LTRDTG

SEQ ID NO: 526381 - protein, 10 aa, Mycobacterium
LTRDTGASLP

SEQ ID NO: 526382 - protein, 8 aa, Mycobacterium
LTRDTKTR

SEQ ID NO: 526383 - protein, 14 aa, Mycobacterium
LTREEGKTRAEAMG

SEQ ID NO: 526384 - protein, 6 aa, Mycobacterium
LTREHR

SEQ ID NO: 526385 - protein, 17 aa, Mycobacterium
LTREPDEVDDDWDDDDD

SEQ ID NO: 526386 - protein, 15 aa, Mycobacterium
LTREPGQVEVGEQGM

SEQ ID NO: 526387 - protein, 12 aa, Mycobacterium
LTREPRNGRTFE

SEQ ID NO: 526388 - protein, 26 aa, Mycobacterium
LTRGAASTRRGGGQGRERLARSTGGI

SEQ ID NO: 526389 - protein, 7 aa, Mycobacterium
LTRGEDR

SEQ ID NO: 526390 - protein, 7 aa, Mycobacterium
LTRGEEH

SEQ ID NO: 526391 - protein, 6 aa, Mycobacterium
LTRGGA

SEQ ID NO: 526392 - protein, 7 aa, Mycobacterium
LTRGNHA

SEQ ID NO: 526393 - protein, 4 aa, Mycobacterium
LTRK

SEQ ID NO: 526394 - protein, 7 aa, Mycobacterium
LTRKRRG

SEQ ID NO: 526395 - protein, 8 aa, Mycobacterium
LTRPDTYT

SEQ ID NO: 526396 - protein, 6 aa, Mycobacterium
LTRPGG

SEQ ID NO: 526397 - protein, 11 aa, Mycobacterium
LTRPKRPDISG

SEQ ID NO: 526398 - protein, 12 aa, Mycobacterium
LTRPKSPDIPGV

SEQ ID NO: 526399 - protein, 9 aa, Mycobacterium
LTRPLGEAE

SEQ ID NO: 526400 - protein, 9 aa, Mycobacterium
LTRPPHASA

SEQ ID NO: 526401 - protein, 5 aa, Mycobacterium
LTRPQ

SEQ ID NO: 526402 - protein, 5 aa, Mycobacterium
LTRPR

SEQ ID NO: 526403 - protein, 30 aa, Mycobacterium
LTRQASQSPPLSARSGPRGGVASVTNPGTS

SEQ ID NO: 526404 - protein, 5 aa, Mycobacterium
LTRQD

SEQ ID NO: 526405 - protein, 10 aa, Mycobacterium
LTRRADDKTR

SEQ ID NO: 526406 - protein, 5 aa, Mycobacterium
LTRRG

SEQ ID NO: 526407 - protein, 22 aa, Mycobacterium
LTRRGESTRKVPEGASCGPQST

SEQ ID NO: 526408 - protein, 16 aa, Mycobacterium
LTRRGKPHSFTSYEGA

SEQ ID NO: 526409 - protein, 6 aa, Mycobacterium
LTRRQT

SEQ ID NO: 526410 - protein, 6 aa, Mycobacterium
LTRRSG

SEQ ID NO: 526411 - protein, 8 aa, Mycobacterium
LTRRSPEA

SEQ ID NO: 526412 - protein, 4 aa, Mycobacterium
LTRS

SEQ ID NO: 526413 - protein, 7 aa, Mycobacterium
LTRSEAD

SEQ ID NO: 526414 - protein, 6 aa, Mycobacterium
LTRSEG

SEQ ID NO: 526415 - protein, 15 aa, Mycobacterium
LTRSGTDGVAQVDTT

SEQ ID NO: 526416 - protein, 9 aa, Mycobacterium
LTRSSFTST

SEQ ID NO: 526417 - protein, 8 aa, Mycobacterium
LTRTEPQS

SEQ ID NO: 526418 - protein, 10 aa, Mycobacterium
LTRTGTAAEA

SEQ ID NO: 526419 - protein, 14 aa, Mycobacterium
LTRTTRRSEEPPMP

SEQ ID NO: 526420 - protein, 10 aa, Mycobacterium
LTSAAASFES

SEQ ID NO: 526421 - protein, 8 aa, Mycobacterium
LTSAANEY

SEQ ID NO: 526422 - protein, 9 aa, Mycobacterium
LTSAASPAT

SEQ ID NO: 526423 - protein, 10 aa, Mycobacterium
LTSADDDDAV

SEQ ID NO: 526424 - protein, 10 aa, Mycobacterium
LTSAEEAHRL

SEQ ID NO: 526425 - protein, 5 aa, Mycobacterium
LTSAG

SEQ ID NO: 526426 - protein, 6 aa, Mycobacterium
LTSAGG

SEQ ID NO: 526427 - protein, 6 aa, Mycobacterium
LTSAPY

SEQ ID NO: 526428 - protein, 6 aa, Mycobacterium
LTSARG

SEQ ID NO: 526429 - protein, 11 aa, Mycobacterium
LTSASDVDSAF

SEQ ID NO: 526430 - protein, 5 aa, Mycobacterium
LTSAT

SEQ ID NO: 526431 - protein, 38 aa, Mycobacterium
LTSATKASAPATQRSAKRVATSARPTSARTRSRVRRPS

SEQ ID NO: 526432 - protein, 4 aa, Mycobacterium
LTSD

SEQ ID NO: 526433 - protein, 10 aa, Mycobacterium
LTSDATRLAG

SEQ ID NO: 526434 - protein, 13 aa, Mycobacterium
LTSDDRGVLIVPA

SEQ ID NO: 526435 - protein, 18 aa, Mycobacterium
LTSDEAAVADAAGATGVD

SEQ ID NO: 526436 - protein, 5 aa, Mycobacterium
LTSDI

SEQ ID NO: 526437 - protein, 5 aa, Mycobacterium
LTSDP

SEQ ID NO: 526438 - protein, 12 aa, Mycobacterium
LTSDPNPAIATA

SEQ ID NO: 526439 - protein, 11 aa, Mycobacterium
LTSDPSPAAQV

SEQ ID NO: 526440 - protein, 17 aa, Mycobacterium
LTSDQAKANYVKAAGKG

SEQ ID NO: 526441 - protein, 8 aa, Mycobacterium
LTSDREGL

SEQ ID NO: 526442 - protein, 4 aa, Mycobacterium
LTSE

SEQ ID NO: 526443 - protein, 12 aa, Mycobacterium
LTSEAVKERFTG

SEQ ID NO: 526444 - protein, 6 aa, Mycobacterium
LTSEEA

SEQ ID NO: 526445 - protein, 7 aa, Mycobacterium
LTSEERQ

SEQ ID NO: 526446 - protein, 5 aa, Mycobacterium
LTSEQ

SEQ ID NO: 526447 - protein, 8 aa, Mycobacterium
LTSESTRR

SEQ ID NO: 526448 - protein, 5 aa, Mycobacterium
LTSGD

SEQ ID NO: 526449 - protein, 13 aa, Mycobacterium
LTSGDERPGDGSI

SEQ ID NO: 526450 - protein, 7 aa, Mycobacterium
LTSGEKQ

SEQ ID NO: 526451 - protein, 8 aa, Mycobacterium
LTSGGGGM

SEQ ID NO: 526452 - protein, 12 aa, Mycobacterium
LTSGGGGSAGAI

SEQ ID NO: 526453 - protein, 25 aa, Mycobacterium
LTSGGNTEKSNAKAPSHLTGHQTKH

SEQ ID NO: 526454 - protein, 7 aa, Mycobacterium
LTSGKTA

SEQ ID NO: 526455 - protein, 9 aa, Mycobacterium
LTSGNVGLA

SEQ ID NO: 526456 - protein, 5 aa, Mycobacterium
LTSGP

SEQ ID NO: 526457 - protein, 6 aa, Mycobacterium
LTSGPQ

SEQ ID NO: 526458 - protein, 10 aa, Mycobacterium
LTSGRAVNGY

SEQ ID NO: 526459 - protein, 10 aa, Mycobacterium
LTSGRGSDSV

SEQ ID NO: 526460 - protein, 20 aa, Mycobacterium
LTSGRRPDLRPRAGNRLTHF

SEQ ID NO: 526461 - protein, 5 aa, Mycobacterium
LTSGT

SEQ ID NO: 526462 - protein, 13 aa, Mycobacterium
LTSGTGRAVTGGG

SEQ ID NO: 526463 - protein, 12 aa, Mycobacterium
LTSGTNQAGLGG

SEQ ID NO: 526464 - protein, 9 aa, Mycobacterium
LTSGTTASG

SEQ ID NO: 526465 - protein, 8 aa, Mycobacterium
LTSHPDVA

SEQ ID NO: 526466 - protein, 4 aa, Mycobacterium
LTSK

SEQ ID NO: 526467 - protein, 7 aa, Mycobacterium
LTSKDTQ

SEQ ID NO: 526468 - protein, 11 aa, Mycobacterium
LTSKTQELASQ

SEQ ID NO: 526469 - protein, 4 aa, Mycobacterium
LTSL

SEQ ID NO: 526470 - protein, 4 aa, Mycobacterium
LTSN

SEQ ID NO: 526471 - protein, 10 aa, Mycobacterium
LTSNGKMDRR

SEQ ID NO: 526472 - protein, 6 aa, Mycobacterium
LTSNGV

SEQ ID NO: 526473 - protein, 20 aa, Mycobacterium
LTSNNKLDTRALPAPEYGGL

SEQ ID NO: 526474 - protein, 5 aa, Mycobacterium
LTSPA

SEQ ID NO: 526475 - protein, 11 aa, Mycobacterium
LTSPAAPTQSI

SEQ ID NO: 526476 - protein, 10 aa, Mycobacterium
LTSPDAEPGF

SEQ ID NO: 526477 - protein, 25 aa, Mycobacterium
LTSPDQPHDQPVTVPAKPRPLTGNE

SEQ ID NO: 526478 - protein, 10 aa, Mycobacterium
LTSPDQPLDA

SEQ ID NO: 526479 - protein, 6 aa, Mycobacterium
LTSPDR

SEQ ID NO: 526480 - protein, 11 aa, Mycobacterium
LTSPGLGGQSL

SEQ ID NO: 526481 - protein, 6 aa, Mycobacterium
LTSPLE

SEQ ID NO: 526482 - protein, 15 aa, Mycobacterium
LTSPPAERPARSART

SEQ ID NO: 526483 - protein, 7 aa, Mycobacterium
LTSPPED

SEQ ID NO: 526484 - protein, 10 aa, Mycobacterium
LTSPRGKRQF

SEQ ID NO: 526485 - protein, 8 aa, Mycobacterium
LTSPTDPE

SEQ ID NO: 526486 - protein, 8 aa, Mycobacterium
LTSPTEAR

SEQ ID NO: 526487 - protein, 9 aa, Mycobacterium
LTSQGAKAR

SEQ ID NO: 526488 - protein, 5 aa, Mycobacterium
LTSRG

SEQ ID NO: 526489 - protein, 6 aa, Mycobacterium
LTSRGD

SEQ ID NO: 526490 - protein, 6 aa, Mycobacterium
LTSRGN

SEQ ID NO: 526491 - protein, 7 aa, Mycobacterium
LTSRGVE

SEQ ID NO: 526492 - protein, 9 aa, Mycobacterium
LTSRPGAQR

SEQ ID NO: 526493 - protein, 8 aa, Mycobacterium
LTSRPGQI

SEQ ID NO: 526494 - protein, 8 aa, Mycobacterium
LTSRQPAD

SEQ ID NO: 526495 - protein, 12 aa, Mycobacterium
LTSRSGGPMPQD

SEQ ID NO: 526496 - protein, 18 aa, Mycobacterium
LTSRTTASPVTNSDITRD

SEQ ID NO: 526497 - protein, 4 aa, Mycobacterium
LTSS

SEQ ID NO: 526498 - protein, 12 aa, Mycobacterium
LTSSDEEQYHHG

SEQ ID NO: 526499 - protein, 9 aa, Mycobacterium
LTSSGGEKI

SEQ ID NO: 526500 - protein, 8 aa, Mycobacterium
LTSSGGGM

SEQ ID NO: 526501 - protein, 14 aa, Mycobacterium
LTSSGSASGRPPGL

SEQ ID NO: 526502 - protein, 6 aa, Mycobacterium
LTSSNA

SEQ ID NO: 526503 - protein, 32 aa, Mycobacterium
LTSSNKLDTRALPAPEYANAEKNYRAPSNPVE

SEQ ID NO: 526504 - protein, 17 aa, Mycobacterium
LTSSPAKTSGSGSARTV

SEQ ID NO: 526505 - protein, 16 aa, Mycobacterium
LTSSPVTAHPKGRART

SEQ ID NO: 526506 - protein, 10 aa, Mycobacterium
LTSSSEDLKK

SEQ ID NO: 526507 - protein, 12 aa, Mycobacterium
LTSSVGDRSPVE

SEQ ID NO: 526508 - protein, 9 aa, Mycobacterium
LTSTDTSSY

SEQ ID NO: 526509 - protein, 10 aa, Mycobacterium
LTSTEGVTTT

SEQ ID NO: 526510 - protein, 10 aa, Mycobacterium
LTSTELSPAD

SEQ ID NO: 526511 - protein, 7 aa, Mycobacterium
LTSTENG

SEQ ID NO: 526512 - protein, 18 aa, Mycobacterium
LTSTPAATPARSGSARTV

SEQ ID NO: 526513 - protein, 17 aa, Mycobacterium
LTSVSGGTAVSASTDTE

SEQ ID NO: 526514 - protein, 11 aa, Mycobacterium
LTSYAEPGWAR

SEQ ID NO: 526515 - protein, 4 aa, Mycobacterium
LTTA

SEQ ID NO: 526516 - protein, 11 aa, Mycobacterium
LTTAEAANGIG

SEQ ID NO: 526517 - protein, 6 aa, Mycobacterium
LTTAGG

SEQ ID NO: 526518 - protein, 5 aa, Mycobacterium
LTTAN

SEQ ID NO: 526519 - protein, 6 aa, Mycobacterium
LTTAPD

SEQ ID NO: 526520 - protein, 7 aa, Mycobacterium
LTTAQET

SEQ ID NO: 526521 - protein, 6 aa, Mycobacterium
LTTARG

SEQ ID NO: 526522 - protein, 5 aa, Mycobacterium
LTTAS

SEQ ID NO: 526523 - protein, 5 aa, Mycobacterium
LTTAT

SEQ ID NO: 526524 - protein, 4 aa, Mycobacterium
LTTD

SEQ ID NO: 526525 - protein, 6 aa, Mycobacterium
LTTDRA

SEQ ID NO: 526526 - protein, 10 aa, Mycobacterium
LTTDRDATRP

SEQ ID NO: 526527 - protein, 6 aa, Mycobacterium
LTTDVD

SEQ ID NO: 526528 - protein, 6 aa, Mycobacterium
LTTDVS

SEQ ID NO: 526529 - protein, 4 aa, Mycobacterium
LTTE

SEQ ID NO: 526530 - protein, 8 aa, Mycobacterium
LTTEGDPW

SEQ ID NO: 526531 - protein, 15 aa, Mycobacterium
LTTEGPAAQVARDQT

SEQ ID NO: 526532 - protein, 15 aa, Mycobacterium
LTTEGPTAQVARDQT

SEQ ID NO: 526533 - protein, 10 aa, Mycobacterium
LTTEPGPLRP

SEQ ID NO: 526534 - protein, 16 aa, Mycobacterium
LTTERGRAAEQSVTES

SEQ ID NO: 526535 - protein, 10 aa, Mycobacterium
LTTETGAGQW

SEQ ID NO: 526536 - protein, 11 aa, Mycobacterium
LTTETGAGQWG

SEQ ID NO: 526537 - protein, 4 aa, Mycobacterium
LTTG

SEQ ID NO: 526538 - protein, 5 aa, Mycobacterium
LTTGE

SEQ ID NO: 526539 - protein, 13 aa, Mycobacterium
LTTGGDAWEGKAG

SEQ ID NO: 526540 - protein, 7 aa, Mycobacterium
LTTGGEV

SEQ ID NO: 526541 - protein, 6 aa, Mycobacterium
LTTGGT

SEQ ID NO: 526542 - protein, 13 aa, Mycobacterium
LTTGLEPARALPG

SEQ ID NO: 526543 - protein, 12 aa, Mycobacterium
LTTGPDSDVAAA

SEQ ID NO: 526544 - protein, 29 aa, Mycobacterium
LTTLPTSDAAPAAMPGLPGMPSAATGRAG

SEQ ID NO: 526545 - protein, 6 aa, Mycobacterium
LTTNAA

SEQ ID NO: 526546 - protein, 11 aa, Mycobacterium
LTTNGEQGSLD

SEQ ID NO: 526547 - protein, 10 aa, Mycobacterium
LTTNGKVDDA

SEQ ID NO: 526548 - protein, 6 aa, Mycobacterium
LTTNSD

SEQ ID NO: 526549 - protein, 13 aa, Mycobacterium
LTTPAAAADPPSL

SEQ ID NO: 526550 - protein, 12 aa, Mycobacterium
LTTPAGPSGSTV

SEQ ID NO: 526551 - protein, 7 aa, Mycobacterium
LTTPARR

SEQ ID NO: 526552 - protein, 10 aa, Mycobacterium
LTTPASGRAA

SEQ ID NO: 526553 - protein, 8 aa, Mycobacterium
LTTPDPAV

SEQ ID NO: 526554 - protein, 8 aa, Mycobacterium
LTTPEDIG

SEQ ID NO: 526555 - protein, 9 aa, Mycobacterium
LTTPGTPFN

SEQ ID NO: 526556 - protein, 10 aa, Mycobacterium
LTTPNGKPID

SEQ ID NO: 526557 - protein, 8 aa, Mycobacterium
LTTPPPVE

SEQ ID NO: 526558 - protein, 7 aa, Mycobacterium
LTTPRGS

SEQ ID NO: 526559 - protein, 18 aa, Mycobacterium
LTTPRTPSSGPPAPQASR

SEQ ID NO: 526560 - protein, 5 aa, Mycobacterium
LTTPT

SEQ ID NO: 526561 - protein, 7 aa, Mycobacterium
LTTPTQW

SEQ ID NO: 526562 - protein, 6 aa, Mycobacterium
LTTPVA

SEQ ID NO: 526563 - protein, 14 aa, Mycobacterium
LTTQGTPLRTPYAA

SEQ ID NO: 526564 - protein, 7 aa, Mycobacterium
LTTQQTQ

SEQ ID NO: 526565 - protein, 12 aa, Mycobacterium
LTTQVSTAEDGT

SEQ ID NO: 526566 - protein, 6 aa, Mycobacterium
LTTRQE

SEQ ID NO: 526567 - protein, 7 aa, Mycobacterium
LTTRSNV

SEQ ID NO: 526568 - protein, 5 aa, Mycobacterium
LTTRT

SEQ ID NO: 526569 - protein, 9 aa, Mycobacterium
LTTSGSGVD

SEQ ID NO: 526570 - protein, 5 aa, Mycobacterium
LTTSM

SEQ ID NO: 526571 - protein, 6 aa, Mycobacterium
LTTSPA

SEQ ID NO: 526572 - protein, 10 aa, Mycobacterium
LTTSRGTGRK

SEQ ID NO: 526573 - protein, 6 aa, Mycobacterium
LTTSRT

SEQ ID NO: 526574 - protein, 9 aa, Mycobacterium
LTTSRTPAL

SEQ ID NO: 526575 - protein, 9 aa, Mycobacterium
LTTSTEDLD

SEQ ID NO: 526576 - protein, 4 aa, Mycobacterium
LTTT

SEQ ID NO: 526577 - protein, 5 aa, Mycobacterium
LTTTD

SEQ ID NO: 526578 - protein, 8 aa, Mycobacterium
LTTTEACG

SEQ ID NO: 526579 - protein, 6 aa, Mycobacterium
LTTTEV

SEQ ID NO: 526580 - protein, 6 aa, Mycobacterium
LTTTPI

SEQ ID NO: 526581 - protein, 8 aa, Mycobacterium
LTTTPSGD

SEQ ID NO: 526582 - protein, 13 aa, Mycobacterium
LTTTRAPQPGEHT

SEQ ID NO: 526583 - protein, 35 aa, Mycobacterium
LTTTRETLSDASLDAEVRRSHEAGQRALGDVGGSP

SEQ ID NO: 526584 - protein, 7 aa, Mycobacterium
LTTTSPD

SEQ ID NO: 526585 - protein, 17 aa, Mycobacterium
LTTTTNRISEPIETVPR

SEQ ID NO: 526586 - protein, 12 aa, Mycobacterium
LTTVSAQRSLRE

SEQ ID NO: 526587 - protein, 7 aa, Mycobacterium
LTVTDKA

SEQ ID NO: 526588 - protein, 7 aa, Mycobacterium
LTVTGAG

SEQ ID NO: 526589 - protein, 8 aa, Mycobacterium
LTYGGTPA

SEQ ID NO: 526590 - protein, 6 aa, Mycobacterium
LTYGSP

SEQ ID NO: 526591 - protein, 12 aa, Mycobacterium
LTYRDANAAANR

SEQ ID NO: 526592 - protein, 9 aa, Mycobacterium
LVDGAPKPL

SEQ ID NO: 526593 - protein, 12 aa, Mycobacterium
LVDGEPESERGR

SEQ ID NO: 526594 - protein, 5 aa, Mycobacterium
LVDGG

SEQ ID NO: 526595 - protein, 15 aa, Mycobacterium
LVDGPGAHTIDTGDT

SEQ ID NO: 526596 - protein, 7 aa, Mycobacterium
LVDGTDM

SEQ ID NO: 526597 - protein, 4 aa, Mycobacterium
LVDT

SEQ ID NO: 526598 - protein, 6 aa, Mycobacterium
LVEPGD

SEQ ID NO: 526599 - protein, 26 aa, Mycobacterium
LVETPARNLPPLDARDSPWHYCPAVT

SEQ ID NO: 526600 - protein, 11 aa, Mycobacterium
LVGGPDAPTGF

SEQ ID NO: 526601 - protein, 12 aa, Mycobacterium
LVGGPDAPTGFD

SEQ ID NO: 526602 - protein, 12 aa, Mycobacterium
LVGGSSAAQIGI

SEQ ID NO: 526603 - protein, 9 aa, Mycobacterium
LVGGSTGLS

SEQ ID NO: 526604 - protein, 12 aa, Mycobacterium
LVGKNDPASDTL

SEQ ID NO: 526605 - protein, 9 aa, Mycobacterium
LVGPEDPDF

SEQ ID NO: 526606 - protein, 8 aa, Mycobacterium
LVGPPARL

SEQ ID NO: 526607 - protein, 6 aa, Mycobacterium
LVGPPG

SEQ ID NO: 526608 - protein, 12 aa, Mycobacterium
LVGSPGQGAYAA

SEQ ID NO: 526609 - protein, 13 aa, Mycobacterium
LVKPGTPLQPGQI

SEQ ID NO: 526610 - protein, 9 aa, Mycobacterium
LVPDPSLSI

SEQ ID NO: 526611 - protein, 31 aa, Mycobacterium
LVPGGANATGLAERDEPEHGQNGRSHREPQH

SEQ ID NO: 526612 - protein, 9 aa, Mycobacterium
LVPGPVATT

SEQ ID NO: 526613 - protein, 6 aa, Mycobacterium
LVPGSE

SEQ ID NO: 526614 - protein, 11 aa, Mycobacterium
LVPGSGPAPIG

SEQ ID NO: 526615 - protein, 5 aa, Mycobacterium
LVPGY

SEQ ID NO: 526616 - protein, 18 aa, Mycobacterium
LVPKTDAPQKGKDFTSDQ

SEQ ID NO: 526617 - protein, 26 aa, Mycobacterium
LVPPDTELSPVNPYSDVTGPQGEPWP

SEQ ID NO: 526618 - protein, 9 aa, Mycobacterium
LVPPGSPGA

SEQ ID NO: 526619 - protein, 11 aa, Mycobacterium
LVPPKDPARLG

SEQ ID NO: 526620 - protein, 5 aa, Mycobacterium
LVPPR

SEQ ID NO: 526621 - protein, 9 aa, Mycobacterium
LVPRSESGA

SEQ ID NO: 526622 - protein, 20 aa, Mycobacterium
LVPSGEEEDLQSSEDKVGPY

SEQ ID NO: 526623 - protein, 10 aa, Mycobacterium
LVPSGEQSSM

SEQ ID NO: 526624 - protein, 5 aa, Mycobacterium
LVPTD

SEQ ID NO: 526625 - protein, 6 aa, Mycobacterium
LVPTPR

SEQ ID NO: 526626 - protein, 5 aa, Mycobacterium
LVQDG

SEQ ID NO: 526627 - protein, 9 aa, Mycobacterium
LVRGGSDRL

SEQ ID NO: 526628 - protein, 8 aa, Mycobacterium
LVRPGDTE

SEQ ID NO: 526629 - protein, 12 aa, Mycobacterium
LVRQGTPDEFEG

SEQ ID NO: 526630 - protein, 6 aa, Mycobacterium
LVSEDD

SEQ ID NO: 526631 - protein, 11 aa, Mycobacterium
LVSGPDVSAAQ

SEQ ID NO: 526632 - protein, 13 aa, Mycobacterium
LVSGSDAKESRGV

SEQ ID NO: 526633 - protein, 9 aa, Mycobacterium
LVSSPDGGA

SEQ ID NO: 526634 - protein, 7 aa, Mycobacterium
LVSTRQG

SEQ ID NO: 526635 - protein, 16 aa, Mycobacterium
LVTDDGAAFVPHRIPL

SEQ ID NO: 526636 - protein, 8 aa, Mycobacterium
LVTEANRS

SEQ ID NO: 526637 - protein, 5 aa, Mycobacterium
LVTES

SEQ ID NO: 526638 - protein, 15 aa, Mycobacterium
LVTGDDAARHRIEEV

SEQ ID NO: 526639 - protein, 11 aa, Mycobacterium
LVTGGEKVDPG

SEQ ID NO: 526640 - protein, 11 aa, Mycobacterium
LVTGGGRPAGL

SEQ ID NO: 526641 - protein, 9 aa, Mycobacterium
LVTPDTPLR

SEQ ID NO: 526642 - protein, 8 aa, Mycobacterium
LVTPEQTA

SEQ ID NO: 526643 - protein, 4 aa, Mycobacterium
LVTS

SEQ ID NO: 526644 - protein, 9 aa, Mycobacterium
LVTSPGDPV

SEQ ID NO: 526645 - protein, 5 aa, Mycobacterium
LVTTP

SEQ ID NO: 526646 - protein, 31 aa, Mycobacterium
LWPEDAPAPDPAAGAPIPTATETPMAPPMPN

SEQ ID NO: 526647 - protein, 9 aa, Mycobacterium
LWPGSDEPI

SEQ ID NO: 526648 - protein, 13 aa, Mycobacterium
LWPPQDTASLSAA

SEQ ID NO: 526649 - protein, 4 aa, Mycobacterium
LWSS

SEQ ID NO: 526650 - protein, 28 aa, Mycobacterium
LYAESGGQIADEGTISGTGSGGSARAAV

SEQ ID NO: 526651 - protein, 6 aa, Mycobacterium
LYAPES

SEQ ID NO: 526652 - protein, 8 aa, Mycobacterium
LYAPQAQN

SEQ ID NO: 526653 - protein, 7 aa, Mycobacterium
LYEGTTA

SEQ ID NO: 526654 - protein, 5 aa, Mycobacterium
LYEPD

SEQ ID NO: 526655 - protein, 10 aa, Mycobacterium
LYEQTGRRPF

SEQ ID NO: 526656 - protein, 13 aa, Mycobacterium
LYETGAGGSAPKH

SEQ ID NO: 526657 - protein, 14 aa, Mycobacterium
LYETGAGGSAPKHV

SEQ ID NO: 526658 - protein, 9 aa, Mycobacterium
LYGGDQEHR

SEQ ID NO: 526659 - protein, 5 aa, Mycobacterium
LYGPD

SEQ ID NO: 526660 - protein, 12 aa, Mycobacterium
LYGPGDNFSAST

SEQ ID NO: 526661 - protein, 13 aa, Mycobacterium
LYGPGDNFSPSGS

SEQ ID NO: 526662 - protein, 13 aa, Mycobacterium
LYGPNDNYSPTGS

SEQ ID NO: 526663 - protein, 5 aa, Mycobacterium
LYGPP

SEQ ID NO: 526664 - protein, 8 aa, Mycobacterium
LYGSGATL

SEQ ID NO: 526665 - protein, 32 aa, Mycobacterium
LYGSHTESGEIGDSRDDGGIVQPPNPSVSGDE

SEQ ID NO: 526666 - protein, 10 aa, Mycobacterium
LYPDEAADSI

SEQ ID NO: 526667 - protein, 10 aa, Mycobacterium
LYPDPDRFDP

SEQ ID NO: 526668 - protein, 7 aa, Mycobacterium
LYPEGDT

SEQ ID NO: 526669 - protein, 10 aa, Mycobacterium
LYPEPDRFDP

SEQ ID NO: 526670 - protein, 8 aa, Mycobacterium
LYPERGEQ

SEQ ID NO: 526671 - protein, 10 aa, Mycobacterium
LYPGASAAEA

SEQ ID NO: 526672 - protein, 9 aa, Mycobacterium
LYPGPERFD

SEQ ID NO: 526673 - protein, 4 aa, Mycobacterium
LYPN

SEQ ID NO: 526674 - protein, 48 aa, Mycobacterium
LYPPPGSAARTEESAKAAPGRRRKPSPKPATAEPGPATGSGSRRRRAA

SEQ ID NO: 526675 - protein, 17 aa, Mycobacterium
LYPSDQPRRDETPAPRA

SEQ ID NO: 526676 - protein, 9 aa, Mycobacterium
LYPSKSDTQ

SEQ ID NO: 526677 - protein, 14 aa, Mycobacterium
LYSSSRKWTAGPRG

SEQ ID NO: 526678 - protein, 8 aa, Mycobacterium
LYSTAAPL

SEQ ID NO: 526679 - protein, 8 aa, Mycobacterium
LYSTYGSK

SEQ ID NO: 526680 - protein, 11 aa, Mycobacterium
LYTQRDSDSIG

SEQ ID NO: 526681 - protein, 22 aa, Mycobacterium
LYTRKPNNGEAKDGDVKDEEAV

SEQ ID NO: 526682 - protein, 13 aa, Mycobacterium
LYTSTDNAQTWQP

SEQ ID NO: 526683 - protein, 13 aa, Mycobacterium
MAAAKAAGKVRIE

SEQ ID NO: 526684 - protein, 11 aa, Mycobacterium
MAAAPSPPSPL

SEQ ID NO: 526685 - protein, 9 aa, Mycobacterium
MAADPDNTV

SEQ ID NO: 526686 - protein, 8 aa, Mycobacterium
MAAGAGGS

SEQ ID NO: 526687 - protein, 7 aa, Mycobacterium
MAAGPGI

SEQ ID NO: 526688 - protein, 25 aa, Mycobacterium
MAAGPGISPRAPGAPRGSGRSARNY

SEQ ID NO: 526689 - protein, 5 aa, Mycobacterium
MAAGT

SEQ ID NO: 526690 - protein, 7 aa, Mycobacterium
MAAKQGR

SEQ ID NO: 526691 - protein, 6 aa, Mycobacterium
MAAKSA

SEQ ID NO: 526692 - protein, 7 aa, Mycobacterium
MAAPADS

SEQ ID NO: 526693 - protein, 15 aa, Mycobacterium
MAAPEVSPGPEPMPV

SEQ ID NO: 526694 - protein, 16 aa, Mycobacterium
MAAPPHPVAPGSTERD

SEQ ID NO: 526695 - protein, 12 aa, Mycobacterium
MAARDQAEGAKW

SEQ ID NO: 526696 - protein, 13 aa, Mycobacterium
MAARGEPARGERY

SEQ ID NO: 526697 - protein, 7 aa, Mycobacterium
MAARSGV

SEQ ID NO: 526698 - protein, 4 aa, Mycobacterium
MAAS

SEQ ID NO: 526699 - protein, 5 aa, Mycobacterium
MAATA

SEQ ID NO: 526700 - protein, 10 aa, Mycobacterium
MADDASADRL

SEQ ID NO: 526701 - protein, 16 aa, Mycobacterium
MADDKDAFSEFVTADR

SEQ ID NO: 526702 - protein, 11 aa, Mycobacterium
MADDLGPASVQ

SEQ ID NO: 526703 - protein, 12 aa, Mycobacterium
MADEEARARLEQ

SEQ ID NO: 526704 - protein, 9 aa, Mycobacterium
MADGPGESW

SEQ ID NO: 526705 - protein, 5 aa, Mycobacterium
MADGS

SEQ ID NO: 526706 - protein, 4 aa, Mycobacterium
MADK

SEQ ID NO: 526707 - protein, 5 aa, Mycobacterium
MADPG

SEQ ID NO: 526708 - protein, 5 aa, Mycobacterium
MADPR

SEQ ID NO: 526709 - protein, 9 aa, Mycobacterium
MADPRPPDI

SEQ ID NO: 526710 - protein, 16 aa, Mycobacterium
MADPSAAAFAQSRQAR

SEQ ID NO: 526711 - protein, 7 aa, Mycobacterium
MADPTAL

SEQ ID NO: 526712 - protein, 7 aa, Mycobacterium
MADRGRG

SEQ ID NO: 526713 - protein, 5 aa, Mycobacterium
MADRR

SEQ ID NO: 526714 - protein, 21 aa, Mycobacterium
MADRSSRPHHSPNRTPTRTER

SEQ ID NO: 526715 - protein, 5 aa, Mycobacterium
MADSP

SEQ ID NO: 526716 - protein, 9 aa, Mycobacterium
MADSYDEQG

SEQ ID NO: 526717 - protein, 4 aa, Mycobacterium
MAEA

SEQ ID NO: 526718 - protein, 5 aa, Mycobacterium
MAEGD

SEQ ID NO: 526719 - protein, 5 aa, Mycobacterium
MAEID

SEQ ID NO: 526720 - protein, 10 aa, Mycobacterium
MAEKSREFAE

SEQ ID NO: 526721 - protein, 5 aa, Mycobacterium
MAEPG

SEQ ID NO: 526722 - protein, 6 aa, Mycobacterium
MAEPRY

SEQ ID NO: 526723 - protein, 8 aa, Mycobacterium
MAESDTRS

SEQ ID NO: 526724 - protein, 5 aa, Mycobacterium
MAETG

SEQ ID NO: 526725 - protein, 7 aa, Mycobacterium
MAETGSS

SEQ ID NO: 526726 - protein, 4 aa, Mycobacterium
MAGA

SEQ ID NO: 526727 - protein, 7 aa, Mycobacterium
MAGAGGK

SEQ ID NO: 526728 - protein, 10 aa, Mycobacterium
MAGAGGNGGS

SEQ ID NO: 526729 - protein, 11 aa, Mycobacterium
MAGDDPAGAQF

SEQ ID NO: 526730 - protein, 12 aa, Mycobacterium
MAGDRAPARPRE

SEQ ID NO: 526731 - protein, 12 aa, Mycobacterium
MAGEERTTGVSS

SEQ ID NO: 526732 - protein, 12 aa, Mycobacterium
MAGENNTTGVSS

SEQ ID NO: 526733 - protein, 7 aa, Mycobacterium
MAGGDEL

SEQ ID NO: 526734 - protein, 10 aa, Mycobacterium
MAGGPGTPEL

SEQ ID NO: 526735 - protein, 5 aa, Mycobacterium
MAGGS

SEQ ID NO: 526736 - protein, 8 aa, Mycobacterium
MAGGSADA

SEQ ID NO: 526737 - protein, 10 aa, Mycobacterium
MAGGSDRATT

SEQ ID NO: 526738 - protein, 5 aa, Mycobacterium
MAGPD

SEQ ID NO: 526739 - protein, 10 aa, Mycobacterium
MAGPGTSATY

SEQ ID NO: 526740 - protein, 6 aa, Mycobacterium
MAGPQV

SEQ ID NO: 526741 - protein, 17 aa, Mycobacterium
MAGPSGAMAGAQPADHG

SEQ ID NO: 526742 - protein, 9 aa, Mycobacterium
MAGQADVDA

SEQ ID NO: 526743 - protein, 5 aa, Mycobacterium
MAGRG

SEQ ID NO: 526744 - protein, 18 aa, Mycobacterium
MAGRGGAGGGAKSYSKDR

SEQ ID NO: 526745 - protein, 16 aa, Mycobacterium
MAGRGSGTGKSYSKDR

SEQ ID NO: 526746 - protein, 7 aa, Mycobacterium
MAGRGTD

SEQ ID NO: 526747 - protein, 7 aa, Mycobacterium
MAGRPTR

SEQ ID NO: 526748 - protein, 9 aa, Mycobacterium
MAGSDTRSV

SEQ ID NO: 526749 - protein, 5 aa, Mycobacterium
MAGSV

SEQ ID NO: 526750 - protein, 9 aa, Mycobacterium
MAHGGQPVS

SEQ ID NO: 526751 - protein, 9 aa, Mycobacterium
MAKKAGYDG

SEQ ID NO: 526752 - protein, 34 aa, Mycobacterium
MAKSSGATDHKDGGGKKPRVHGPVENRREFRRKS

SEQ ID NO: 526753 - protein, 34 aa, Mycobacterium
MAKSSTGSDHKDGAGKQSRAHGAAGNRREFRRKS

SEQ ID NO: 526754 - protein, 14 aa, Mycobacterium
MANGTAVKARELSG

SEQ ID NO: 526755 - protein, 5 aa, Mycobacterium
MAPAT

SEQ ID NO: 526756 - protein, 4 aa, Mycobacterium
MAPD

SEQ ID NO: 526757 - protein, 10 aa, Mycobacterium
MAPDEARQAE

SEQ ID NO: 526758 - protein, 9 aa, Mycobacterium
MAPDGGSSV

SEQ ID NO: 526759 - protein, 6 aa, Mycobacterium
MAPEAA

SEQ ID NO: 526760 - protein, 7 aa, Mycobacterium
MAPEGKD

SEQ ID NO: 526761 - protein, 5 aa, Mycobacterium
MAPGE

SEQ ID NO: 526762 - protein, 9 aa, Mycobacterium
MAPGEQPRW

SEQ ID NO: 526763 - protein, 10 aa, Mycobacterium
MAPGPQRDQA

SEQ ID NO: 526764 - protein, 38 aa, Mycobacterium
MAPKAAAQAVAGAAKAAGSALPAALSSAGLSGPAGAVG

SEQ ID NO: 526765 - protein, 6 aa, Mycobacterium
MAPKDG

SEQ ID NO: 526766 - protein, 4 aa, Mycobacterium
MAPN

SEQ ID NO: 526767 - protein, 5 aa, Mycobacterium
MAPNG

SEQ ID NO: 526768 - protein, 8 aa, Mycobacterium
MAPNPSAQ

SEQ ID NO: 526769 - protein, 4 aa, Mycobacterium
MAPP

SEQ ID NO: 526770 - protein, 27 aa, Mycobacterium
MAPPAPPRPGLGAGPHVGEAGGTLARQ

SEQ ID NO: 526771 - protein, 14 aa, Mycobacterium
MAPPDLPGDLESEP

SEQ ID NO: 526772 - protein, 6 aa, Mycobacterium
MAPPPD

SEQ ID NO: 526773 - protein, 11 aa, Mycobacterium
MAPPRTPAAPM

SEQ ID NO: 526774 - protein, 8 aa, Mycobacterium
MAPPSGDT

SEQ ID NO: 526775 - protein, 4 aa, Mycobacterium
MAPR

SEQ ID NO: 526776 - protein, 6 aa, Mycobacterium
MAPRKQ

SEQ ID NO: 526777 - protein, 8 aa, Mycobacterium
MAPRPDGV

SEQ ID NO: 526778 - protein, 8 aa, Mycobacterium
MAPSTELK

SEQ ID NO: 526779 - protein, 11 aa, Mycobacterium
MAPTPPDLDPV

SEQ ID NO: 526780 - protein, 10 aa, Mycobacterium
MAQGPGKIAK

SEQ ID NO: 526781 - protein, 12 aa, Mycobacterium
MAQGTGKTHPSM

SEQ ID NO: 526782 - protein, 28 aa, Mycobacterium
MAQTGNAASLHGAGRDARRRVEESRESI

SEQ ID NO: 526783 - protein, 8 aa, Mycobacterium
MARAKGGL

SEQ ID NO: 526784 - protein, 6 aa, Mycobacterium
MAREDE

SEQ ID NO: 526785 - protein, 11 aa, Mycobacterium
MARESSPPWSA

SEQ ID NO: 526786 - protein, 7 aa, Mycobacterium
MARGGSG

SEQ ID NO: 526787 - protein, 6 aa, Mycobacterium
MARNPK

SEQ ID NO: 526788 - protein, 4 aa, Mycobacterium
MARP

SEQ ID NO: 526789 - protein, 5 aa, Mycobacterium
MARPD

SEQ ID NO: 526790 - protein, 7 aa, Mycobacterium
MARSPRT

SEQ ID NO: 526791 - protein, 4 aa, Mycobacterium
MASA

SEQ ID NO: 526792 - protein, 9 aa, Mycobacterium
MASASDARC

SEQ ID NO: 526793 - protein, 9 aa, Mycobacterium
MASDPDNSI

SEQ ID NO: 526794 - protein, 8 aa, Mycobacterium
MASEDAAA

SEQ ID NO: 526795 - protein, 7 aa, Mycobacterium
MASERAG

SEQ ID NO: 526796 - protein, 8 aa, Mycobacterium
MASGAGAV

SEQ ID NO: 526797 - protein, 10 aa, Mycobacterium
MASGGAAGKC

SEQ ID NO: 526798 - protein, 10 aa, Mycobacterium
MASGGATLDG

SEQ ID NO: 526799 - protein, 18 aa, Mycobacterium
MASGGQQANQSANNNPLG

SEQ ID NO: 526800 - protein, 6 aa, Mycobacterium
MASGGT

SEQ ID NO: 526801 - protein, 13 aa, Mycobacterium
MASGSTGGKAAAK

SEQ ID NO: 526802 - protein, 29 aa, Mycobacterium
MASPARAAPAATAPMATAPTAAVSPLSSL

SEQ ID NO: 526803 - protein, 15 aa, Mycobacterium
MASPETEPGSRTTGL

SEQ ID NO: 526804 - protein, 9 aa, Mycobacterium
MASRDPRGL

SEQ ID NO: 526805 - protein, 4 aa, Mycobacterium
MASS

SEQ ID NO: 526806 - protein, 4 aa, Mycobacterium
MAST

SEQ ID NO: 526807 - protein, 9 aa, Mycobacterium
MASTDTSVR

SEQ ID NO: 526808 - protein, 27 aa, Mycobacterium
MATAGTARPHRRKERIPPGTAAKAAAA

SEQ ID NO: 526809 - protein, 10 aa, Mycobacterium
MATGEQVDVA

SEQ ID NO: 526810 - protein, 11 aa, Mycobacterium
MATNADSDTYR

SEQ ID NO: 526811 - protein, 10 aa, Mycobacterium
MATPGSGAGC

SEQ ID NO: 526812 - protein, 10 aa, Mycobacterium
MATPTPDAAD

SEQ ID NO: 526813 - protein, 11 aa, Mycobacterium
MATSGNPAAAI

SEQ ID NO: 526814 - protein, 10 aa, Mycobacterium
MATSQESRNA

SEQ ID NO: 526815 - protein, 17 aa, Mycobacterium
MATTPPGRAPELGADSG

SEQ ID NO: 526816 - protein, 14 aa, Mycobacterium
MDAAAGEATPTEVV

SEQ ID NO: 526817 - protein, 7 aa, Mycobacterium
MDAATDV

SEQ ID NO: 526818 - protein, 9 aa, Mycobacterium
MDAATGIKP

SEQ ID NO: 526819 - protein, 9 aa, Mycobacterium
MDADRRTEG

SEQ ID NO: 526820 - protein, 5 aa, Mycobacterium
MDADS

SEQ ID NO: 526821 - protein, 20 aa, Mycobacterium
MDAEEAAARAARRARPAGAP

SEQ ID NO: 526822 - protein, 10 aa, Mycobacterium
MDAEEAERAG

SEQ ID NO: 526823 - protein, 15 aa, Mycobacterium
MDAGADKAAALAAAS

SEQ ID NO: 526824 - protein, 9 aa, Mycobacterium
MDAGEGAGV

SEQ ID NO: 526825 - protein, 4 aa, Mycobacterium
MDAP

SEQ ID NO: 526826 - protein, 7 aa, Mycobacterium
MDAPAGL

SEQ ID NO: 526827 - protein, 29 aa, Mycobacterium
MDAPDASDQNPTPTRDYSRGDADAALRGS

SEQ ID NO: 526828 - protein, 7 aa, Mycobacterium
MDAPKHR

SEQ ID NO: 526829 - protein, 9 aa, Mycobacterium
MDAPPGGGF

SEQ ID NO: 526830 - protein, 21 aa, Mycobacterium
MDAPPPTEDFGRQPPQDLAAE

SEQ ID NO: 526831 - protein, 24 aa, Mycobacterium
MDAQEAAEKAARRAQRADPAGAAE

SEQ ID NO: 526832 - protein, 24 aa, Mycobacterium
MDAQEAAERAARRAQRAHPAGAPE

SEQ ID NO: 526833 - protein, 9 aa, Mycobacterium
MDATASPLS

SEQ ID NO: 526834 - protein, 6 aa, Mycobacterium
MDDDGL

SEQ ID NO: 526835 - protein, 7 aa, Mycobacterium
MDDGVPG

SEQ ID NO: 526836 - protein, 7 aa, Mycobacterium
MDDSDYT

SEQ ID NO: 526837 - protein, 6 aa, Mycobacterium
MDDSEP

SEQ ID NO: 526838 - protein, 11 aa, Mycobacterium
MDEIETKSISA

SEQ ID NO: 526839 - protein, 8 aa, Mycobacterium
MDEPATAR

SEQ ID NO: 526840 - protein, 8 aa, Mycobacterium
MDEPPAVG

SEQ ID NO: 526841 - protein, 4 aa, Mycobacterium
MDER

SEQ ID NO: 526842 - protein, 14 aa, Mycobacterium
MDESERRRAQIDPD

SEQ ID NO: 526843 - protein, 19 aa, Mycobacterium
MDETRAGQKPKDDPAEVAR

SEQ ID NO: 526844 - protein, 15 aa, Mycobacterium
MDGAEPATPNIGADQ

SEQ ID NO: 526845 - protein, 6 aa, Mycobacterium
MDGESK

SEQ ID NO: 526846 - protein, 35 aa, Mycobacterium
MDGGNGGNGGLFGGNGGNGGNGLGGGNGGNGGNAG

SEQ ID NO: 526847 - protein, 5 aa, Mycobacterium
MDGGQ

SEQ ID NO: 526848 - protein, 7 aa, Mycobacterium
MDGNPTL

SEQ ID NO: 526849 - protein, 4 aa, Mycobacterium
MDGP

SEQ ID NO: 526850 - protein, 6 aa, Mycobacterium
MDGPAS

SEQ ID NO: 526851 - protein, 8 aa, Mycobacterium
MDGPDGTV

SEQ ID NO: 526852 - protein, 6 aa, Mycobacterium
MDGQGT

SEQ ID NO: 526853 - protein, 4 aa, Mycobacterium
MDGS

SEQ ID NO: 526854 - protein, 8 aa, Mycobacterium
MDGSTSGR

SEQ ID NO: 526855 - protein, 11 aa, Mycobacterium
MDGSTTGGVAR

SEQ ID NO: 526856 - protein, 5 aa, Mycobacterium
MDGTD

SEQ ID NO: 526857 - protein, 7 aa, Mycobacterium
MDGTETE

SEQ ID NO: 526858 - protein, 10 aa, Mycobacterium
MDHDDARQRV

SEQ ID NO: 526859 - protein, 9 aa, Mycobacterium
MDKPAAEKR

SEQ ID NO: 526860 - protein, 8 aa, Mycobacterium
MDKQASDR

SEQ ID NO: 526861 - protein, 16 aa, Mycobacterium
MDKTGSWTDEPALEDP

SEQ ID NO: 526862 - protein, 7 aa, Mycobacterium
MDNSDDL

SEQ ID NO: 526863 - protein, 16 aa, Mycobacterium
MDPAAETEVAPQTERG

SEQ ID NO: 526864 - protein, 7 aa, Mycobacterium
MDPAEAR

SEQ ID NO: 526865 - protein, 25 aa, Mycobacterium
MDPAPLSSTPAQVAKATARALAKGR

SEQ ID NO: 526866 - protein, 9 aa, Mycobacterium
MDPDDSNSV

SEQ ID NO: 526867 - protein, 5 aa, Mycobacterium
MDPDT

SEQ ID NO: 526868 - protein, 7 aa, Mycobacterium
MDPDTVS

SEQ ID NO: 526869 - protein, 6 aa, Mycobacterium
MDPGQV

SEQ ID NO: 526870 - protein, 15 aa, Mycobacterium
MDPGRQGRMLRSVRR

SEQ ID NO: 526871 - protein, 4 aa, Mycobacterium
MDPI

SEQ ID NO: 526872 - protein, 7 aa, Mycobacterium
MDPRHTA

SEQ ID NO: 526873 - protein, 9 aa, Mycobacterium
MDPRKNPLH

SEQ ID NO: 526874 - protein, 8 aa, Mycobacterium
MDPSGANR

SEQ ID NO: 526875 - protein, 7 aa, Mycobacterium
MDPSGAS

SEQ ID NO: 526876 - protein, 6 aa, Mycobacterium
MDPSKI

SEQ ID NO: 526877 - protein, 7 aa, Mycobacterium
MDPTGAE

SEQ ID NO: 526878 - protein, 10 aa, Mycobacterium
MDPTKSAGKF

SEQ ID NO: 526879 - protein, 5 aa, Mycobacterium
MDQAN

SEQ ID NO: 526880 - protein, 16 aa, Mycobacterium
MDQNNAANIHSSGPQN

SEQ ID NO: 526881 - protein, 9 aa, Mycobacterium
MDREGRPRS

SEQ ID NO: 526882 - protein, 11 aa, Mycobacterium
MDRGGSLEDKL

SEQ ID NO: 526883 - protein, 8 aa, Mycobacterium
MDRGGSLQ

SEQ ID NO: 526884 - protein, 4 aa, Mycobacterium
MDRP

SEQ ID NO: 526885 - protein, 5 aa, Mycobacterium
MDRPA

SEQ ID NO: 526886 - protein, 12 aa, Mycobacterium
MDRPGGRRYEPG

SEQ ID NO: 526887 - protein, 11 aa, Mycobacterium
MDRTGRSRNDF

SEQ ID NO: 526888 - protein, 6 aa, Mycobacterium
MDSAHR

SEQ ID NO: 526889 - protein, 7 aa, Mycobacterium
MDSAHRD

SEQ ID NO: 526890 - protein, 8 aa, Mycobacterium
MDSDSDGW

SEQ ID NO: 526891 - protein, 10 aa, Mycobacterium
MDSGSGPKIG

SEQ ID NO: 526892 - protein, 6 aa, Mycobacterium
MDSGSP

SEQ ID NO: 526893 - protein, 15 aa, Mycobacterium
MDSNGAADQLRTSGT

SEQ ID NO: 526894 - protein, 6 aa, Mycobacterium
MDSPDF

SEQ ID NO: 526895 - protein, 6 aa, Mycobacterium
MDSPNF

SEQ ID NO: 526896 - protein, 7 aa, Mycobacterium
MDSPRHK

SEQ ID NO: 526897 - protein, 13 aa, Mycobacterium
MDSSRARYRMVLT

SEQ ID NO: 526898 - protein, 4 aa, Mycobacterium
MDTA

SEQ ID NO: 526899 - protein, 7 aa, Mycobacterium
MDTAQRG

SEQ ID NO: 526900 - protein, 7 aa, Mycobacterium
MDTERSR

SEQ ID NO: 526901 - protein, 5 aa, Mycobacterium
MDTGG

SEQ ID NO: 526902 - protein, 14 aa, Mycobacterium
MDTGGTRLVWSAPL

SEQ ID NO: 526903 - protein, 5 aa, Mycobacterium
MDTGP

SEQ ID NO: 526904 - protein, 7 aa, Mycobacterium
MDTPEMA

SEQ ID NO: 526905 - protein, 7 aa, Mycobacterium
MDTTGTD

SEQ ID NO: 526906 - protein, 18 aa, Mycobacterium
MDTTPGSEEASGSPVVTV

SEQ ID NO: 526907 - protein, 4 aa, Mycobacterium
MEAE

SEQ ID NO: 526908 - protein, 18 aa, Mycobacterium
MEAEEAAARASGRGGGSS

SEQ ID NO: 526909 - protein, 4 aa, Mycobacterium
MEAG

SEQ ID NO: 526910 - protein, 15 aa, Mycobacterium
MEAPPPGVHGAPNNP

SEQ ID NO: 526911 - protein, 8 aa, Mycobacterium
MEARRDDP

SEQ ID NO: 526912 - protein, 12 aa, Mycobacterium
MEARSGSRPVDA

SEQ ID NO: 526913 - protein, 7 aa, Mycobacterium
MEDARKT

SEQ ID NO: 526914 - protein, 11 aa, Mycobacterium
MEDDDDTDGWE

SEQ ID NO: 526915 - protein, 4 aa, Mycobacterium
MEDG

SEQ ID NO: 526916 - protein, 6 aa, Mycobacterium
MEDPQA

SEQ ID NO: 526917 - protein, 4 aa, Mycobacterium
MEDR

SEQ ID NO: 526918 - protein, 4 aa, Mycobacterium
MEDT

SEQ ID NO: 526919 - protein, 9 aa, Mycobacterium
MEEAAPYAA

SEQ ID NO: 526920 - protein, 9 aa, Mycobacterium
MEEDTGKLT

SEQ ID NO: 526921 - protein, 5 aa, Mycobacterium
MEEGR

SEQ ID NO: 526922 - protein, 19 aa, Mycobacterium
MEEKSAEFAEHGNRVYLPI

SEQ ID NO: 526923 - protein, 9 aa, Mycobacterium
MEGNSVEGR

SEQ ID NO: 526924 - protein, 9 aa, Mycobacterium
MEGNTEHGR

SEQ ID NO: 526925 - protein, 18 aa, Mycobacterium
MEGSATQLAQRRNQLSTR

SEQ ID NO: 526926 - protein, 10 aa, Mycobacterium
MEGSEPVTDL

SEQ ID NO: 526927 - protein, 9 aa, Mycobacterium
MEGSSPRRA

SEQ ID NO: 526928 - protein, 11 aa, Mycobacterium
MEGSTTGGVAR

SEQ ID NO: 526929 - protein, 5 aa, Mycobacterium
MEGTD

SEQ ID NO: 526930 - protein, 9 aa, Mycobacterium
MEHPDTAAR

SEQ ID NO: 526931 - protein, 5 aa, Mycobacterium
MEKPI

SEQ ID NO: 526932 - protein, 6 aa, Mycobacterium
MEKTGA

SEQ ID NO: 526933 - protein, 8 aa, Mycobacterium
MENDGAGA

SEQ ID NO: 526934 - protein, 7 aa, Mycobacterium
MENDGAS

SEQ ID NO: 526935 - protein, 8 aa, Mycobacterium
MENDGATA

SEQ ID NO: 526936 - protein, 7 aa, Mycobacterium
MENETRG

SEQ ID NO: 526937 - protein, 7 aa, Mycobacterium
MENRGSP

SEQ ID NO: 526938 - protein, 11 aa, Mycobacterium
MENSTTSAGGC

SEQ ID NO: 526939 - protein, 25 aa, Mycobacterium
MEPAPFASTPAQVADAAAKALARGK

SEQ ID NO: 526940 - protein, 9 aa, Mycobacterium
MEPGGPTSA

SEQ ID NO: 526941 - protein, 9 aa, Mycobacterium
MEPGRDPIS

SEQ ID NO: 526942 - protein, 6 aa, Mycobacterium
MEPGRR

SEQ ID NO: 526943 - protein, 4 aa, Mycobacterium
MEPH

SEQ ID NO: 526944 - protein, 11 aa, Mycobacterium
MEPNPSGSTGL

SEQ ID NO: 526945 - protein, 12 aa, Mycobacterium
MEPPPPPADVNG

SEQ ID NO: 526946 - protein, 9 aa, Mycobacterium
MEPPTGAAD

SEQ ID NO: 526947 - protein, 10 aa, Mycobacterium
MEPTADAATD

SEQ ID NO: 526948 - protein, 8 aa, Mycobacterium
MEPTAQAA

SEQ ID NO: 526949 - protein, 59 aa, Mycobacterium
MEQAGESAGPTPDPEPDPDPPGGGADADGSADGQPPQQNSSSHPSSSTRQSAPPSPTFK

SEQ ID NO: 526950 - protein, 11 aa, Mycobacterium
MEQARRSAEAL

SEQ ID NO: 526951 - protein, 4 aa, Mycobacterium
MEQT

SEQ ID NO: 526952 - protein, 13 aa, Mycobacterium
MEQTGGFEGRTKK

SEQ ID NO: 526953 - protein, 18 aa, Mycobacterium
MEREAAKDARLAGADPSW

SEQ ID NO: 526954 - protein, 7 aa, Mycobacterium
MERGESH

SEQ ID NO: 526955 - protein, 5 aa, Mycobacterium
MERQS

SEQ ID NO: 526956 - protein, 20 aa, Mycobacterium
MERSQARASRLQRRQEASEA

SEQ ID NO: 526957 - protein, 7 aa, Mycobacterium
MESAPEV

SEQ ID NO: 526958 - protein, 7 aa, Mycobacterium
MESDLPD

SEQ ID NO: 526959 - protein, 6 aa, Mycobacterium
MESEEL

SEQ ID NO: 526960 - protein, 10 aa, Mycobacterium
MESEPDGWGP

SEQ ID NO: 526961 - protein, 8 aa, Mycobacterium
MESERGYD

SEQ ID NO: 526962 - protein, 5 aa, Mycobacterium
MESGA

SEQ ID NO: 526963 - protein, 27 aa, Mycobacterium
MESGAGAPPQAGPPAGTPPVAPTAPSA

SEQ ID NO: 526964 - protein, 23 aa, Mycobacterium
MESNGSDGCVTGNQARSVYDTSY

SEQ ID NO: 526965 - protein, 16 aa, Mycobacterium
MESNKRRIQEMDESQT

SEQ ID NO: 526966 - protein, 7 aa, Mycobacterium
MESTDRA

SEQ ID NO: 526967 - protein, 4 aa, Mycobacterium
MESY

SEQ ID NO: 526968 - protein, 11 aa, Mycobacterium
METATGGVYGE

SEQ ID NO: 526969 - protein, 11 aa, Mycobacterium
METDDTARSRA

SEQ ID NO: 526970 - protein, 7 aa, Mycobacterium
METDPGG

SEQ ID NO: 526971 - protein, 4 aa, Mycobacterium
METE

SEQ ID NO: 526972 - protein, 7 aa, Mycobacterium
METNPQL

SEQ ID NO: 526973 - protein, 4 aa, Mycobacterium
METP

SEQ ID NO: 526974 - protein, 6 aa, Mycobacterium
METRGK

SEQ ID NO: 526975 - protein, 5 aa, Mycobacterium
METSA

SEQ ID NO: 526976 - protein, 10 aa, Mycobacterium
METSNLAQRS

SEQ ID NO: 526977 - protein, 5 aa, Mycobacterium
METTA

SEQ ID NO: 526978 - protein, 12 aa, Mycobacterium
METYESASEPAA

SEQ ID NO: 526979 - protein, 11 aa, Mycobacterium
MFKTSQGKYVA

SEQ ID NO: 526980 - protein, 12 aa, Mycobacterium
MFKTSQGKYVAP

SEQ ID NO: 526981 - protein, 4 aa, Mycobacterium
MFPG

SEQ ID NO: 526982 - protein, 12 aa, Mycobacterium
MGADGGADDRSE

SEQ ID NO: 526983 - protein, 8 aa, Mycobacterium
MGADGGAM

SEQ ID NO: 526984 - protein, 6 aa, Mycobacterium
MGADGR

SEQ ID NO: 526985 - protein, 30 aa, Mycobacterium
MGAGGEGGNKDKPVEKRVTAPGVPNGQPVR

SEQ ID NO: 526986 - protein, 30 aa, Mycobacterium
MGAGGTGGSKEKPAEKRVTAPGVPNGQPVK

SEQ ID NO: 526987 - protein, 12 aa, Mycobacterium
MGAKAGNKKAEL

SEQ ID NO: 526988 - protein, 16 aa, Mycobacterium
MGAPDAAATAADRLDT

SEQ ID NO: 526989 - protein, 15 aa, Mycobacterium
MGAPGKRSVARNRAG

SEQ ID NO: 526990 - protein, 21 aa, Mycobacterium
MGAPGQGQGNAKTKSSQQEQE

SEQ ID NO: 526991 - protein, 6 aa, Mycobacterium
MGAPGT

SEQ ID NO: 526992 - protein, 5 aa, Mycobacterium
MGAPS

SEQ ID NO: 526993 - protein, 6 aa, Mycobacterium
MGARRG

SEQ ID NO: 526994 - protein, 10 aa, Mycobacterium
MGARTTCPAR

SEQ ID NO: 526995 - protein, 4 aa, Mycobacterium
MGAT

SEQ ID NO: 526996 - protein, 42 aa, Mycobacterium
MGATAGSVAPAASAATPSPAPVATEEPAATAAPAERPGPAVA

SEQ ID NO: 526997 - protein, 5 aa, Mycobacterium
MGATE

SEQ ID NO: 526998 - protein, 7 aa, Mycobacterium
MGATPTG

SEQ ID NO: 526999 - protein, 8 aa, Mycobacterium
MGDAGLTG

SEQ ID NO: 527000 - protein, 5 aa, Mycobacterium
MGDGD

SEQ ID NO: 527001 - protein, 8 aa, Mycobacterium
MGDPDDPP

SEQ ID NO: 527002 - protein, 7 aa, Mycobacterium
MGDPGDP

SEQ ID NO: 527003 - protein, 7 aa, Mycobacterium
MGDPNDP

SEQ ID NO: 527004 - protein, 17 aa, Mycobacterium
MGDPPDAEAAARGGRHI

SEQ ID NO: 527005 - protein, 5 aa, Mycobacterium
MGEAE

SEQ ID NO: 527006 - protein, 8 aa, Mycobacterium
MGEDNRPP

SEQ ID NO: 527007 - protein, 4 aa, Mycobacterium
MGEG

SEQ ID NO: 527008 - protein, 5 aa, Mycobacterium
MGEGG

SEQ ID NO: 527009 - protein, 14 aa, Mycobacterium
MGEGPVQAARSGAG

SEQ ID NO: 527010 - protein, 15 aa, Mycobacterium
MGEPAAASLEGSVAS

SEQ ID NO: 527011 - protein, 15 aa, Mycobacterium
MGERGARNEPATADD

SEQ ID NO: 527012 - protein, 4 aa, Mycobacterium
MGES

SEQ ID NO: 527013 - protein, 6 aa, Mycobacterium
MGESTA

SEQ ID NO: 527014 - protein, 7 aa, Mycobacterium
MGETSRD

SEQ ID NO: 527015 - protein, 8 aa, Mycobacterium
MGGAAGAR

SEQ ID NO: 527016 - protein, 10 aa, Mycobacterium
MGGAAGGTLA

SEQ ID NO: 527017 - protein, 8 aa, Mycobacterium
MGGAASRQ

SEQ ID NO: 527018 - protein, 9 aa, Mycobacterium
MGGDEPNHQ

SEQ ID NO: 527019 - protein, 8 aa, Mycobacterium
MGGGTTEM

SEQ ID NO: 527020 - protein, 31 aa, Mycobacterium
MGGHGEGGNKEKPPEKRISAPGVPNGQPVKG

SEQ ID NO: 527021 - protein, 6 aa, Mycobacterium
MGGHTH

SEQ ID NO: 527022 - protein, 341 aa, Mycobacterium
MGGIGGTGGTGGNPGPGGIGGNGGDGGTGGPGGYGDTGFGTAGYAGGTGGTGGTGGAPGPGGSAAGNGGGGGIGGIGGTGGSGATTAGFAGGDGGKGGTGGTGGSAGAGAANGSGGTGGQGGYAGKGGYGGITNGTYEGMPGGVGGTGGAGGEGGLPGTGAGTAGSIGSAGNGGEGGFGGTGGNSYYAGNAGPGGQGGQGGAGANGAPGLAGGTGGAGGFGGTGGIANGTGNGGTGGKGGTGGDGGTGGTATTAGQTGGDGGDGGKGGGGGTGGKANGGDGGDGGDGGDGGAGGAGGNGDGAVGGIGGGGGTGGTGGTGTPPGGANGGPGKTGADGLGGHT

SEQ ID NO: 527023 - protein, 5 aa, Mycobacterium
MGGKN

SEQ ID NO: 527024 - protein, 6 aa, Mycobacterium
MGGPED

SEQ ID NO: 527025 - protein, 17 aa, Mycobacterium
MGGPGGPGPMGGPGRGF

SEQ ID NO: 527026 - protein, 11 aa, Mycobacterium
MGGQTGPAQAD

SEQ ID NO: 527027 - protein, 4 aa, Mycobacterium
MGGR

SEQ ID NO: 527028 - protein, 19 aa, Mycobacterium
MGGRDSSSNLDRSQPTMSI

SEQ ID NO: 527029 - protein, 5 aa, Mycobacterium
MGGRQ

SEQ ID NO: 527030 - protein, 8 aa, Mycobacterium
MGGRTSGV

SEQ ID NO: 527031 - protein, 5 aa, Mycobacterium
MGGSE

SEQ ID NO: 527032 - protein, 9 aa, Mycobacterium
MGGSTSTIS

SEQ ID NO: 527033 - protein, 7 aa, Mycobacterium
MGGTAEV

SEQ ID NO: 527034 - protein, 16 aa, Mycobacterium
MGGTATVDGAPVTGNA

SEQ ID NO: 527035 - protein, 10 aa, Mycobacterium
MGGTEDVGGR

SEQ ID NO: 527036 - protein, 10 aa, Mycobacterium
MGGTETVGGR

SEQ ID NO: 527037 - protein, 6 aa, Mycobacterium
MGGTQA

SEQ ID NO: 527038 - protein, 7 aa, Mycobacterium
MGGTSQI

SEQ ID NO: 527039 - protein, 12 aa, Mycobacterium
MGHPDAPGGSLD

SEQ ID NO: 527040 - protein, 13 aa, Mycobacterium
MGKASKPLPEGMR

SEQ ID NO: 527041 - protein, 5 aa, Mycobacterium
MGKGE

SEQ ID NO: 527042 - protein, 22 aa, Mycobacterium
MGKPRYKSSTTTRNLRTLAKVL

SEQ ID NO: 527043 - protein, 6 aa, Mycobacterium
MGKPSV

SEQ ID NO: 527044 - protein, 5 aa, Mycobacterium
MGNDR

SEQ ID NO: 527045 - protein, 19 aa, Mycobacterium
MGNHKGEGQWTNINDQLAA

SEQ ID NO: 527046 - protein, 9 aa, Mycobacterium
MGNSDGIPF

SEQ ID NO: 527047 - protein, 10 aa, Mycobacterium
MGNSNPKDNW

SEQ ID NO: 527048 - protein, 8 aa, Mycobacterium
MGNTGSHN

SEQ ID NO: 527049 - protein, 10 aa, Mycobacterium
MGNTNPKDNW

SEQ ID NO: 527050 - protein, 13 aa, Mycobacterium
MGPAAATAPPTSS

SEQ ID NO: 527051 - protein, 5 aa, Mycobacterium
MGPDA

SEQ ID NO: 527052 - protein, 8 aa, Mycobacterium
MGPDDDDV

SEQ ID NO: 527053 - protein, 8 aa, Mycobacterium
MGPEPNDS

SEQ ID NO: 527054 - protein, 6 aa, Mycobacterium
MGPEYT

SEQ ID NO: 527055 - protein, 4 aa, Mycobacterium
MGPG

SEQ ID NO: 527056 - protein, 8 aa, Mycobacterium
MGPGDDAV

SEQ ID NO: 527057 - protein, 36 aa, Mycobacterium
MGPGDPGGPRVAENTVTASQATSATSVTRTPGPTAP

SEQ ID NO: 527058 - protein, 7 aa, Mycobacterium
MGPGGKG

SEQ ID NO: 527059 - protein, 8 aa, Mycobacterium
MGPGQPAR

SEQ ID NO: 527060 - protein, 10 aa, Mycobacterium
MGPGSLPTDS

SEQ ID NO: 527061 - protein, 11 aa, Mycobacterium
MGPGTKLPTLG

SEQ ID NO: 527062 - protein, 12 aa, Mycobacterium
MGPNGSGKSTLS

SEQ ID NO: 527063 - protein, 7 aa, Mycobacterium
MGPPADP

SEQ ID NO: 527064 - protein, 8 aa, Mycobacterium
MGPPADPE

SEQ ID NO: 527065 - protein, 9 aa, Mycobacterium
MGPPADPGC

SEQ ID NO: 527066 - protein, 9 aa, Mycobacterium
MGPPADPTH

SEQ ID NO: 527067 - protein, 19 aa, Mycobacterium
MGPPERAPKGAGGAGGRRR

SEQ ID NO: 527068 - protein, 25 aa, Mycobacterium
MGPPERAPKGSGKRDKGTGGRRQSS

SEQ ID NO: 527069 - protein, 8 aa, Mycobacterium
MGPPPPDA

SEQ ID NO: 527070 - protein, 8 aa, Mycobacterium
MGPQTDGA

SEQ ID NO: 527071 - protein, 12 aa, Mycobacterium
MGPSAAGITNPR

SEQ ID NO: 527072 - protein, 7 aa, Mycobacterium
MGPSPTT

SEQ ID NO: 527073 - protein, 7 aa, Mycobacterium
MGPSYPE

SEQ ID NO: 527074 - protein, 5 aa, Mycobacterium
MGPTP

SEQ ID NO: 527075 - protein, 10 aa, Mycobacterium
MGQGRPDTGK

SEQ ID NO: 527076 - protein, 6 aa, Mycobacterium
MGQPDD

SEQ ID NO: 527077 - protein, 6 aa, Mycobacterium
MGQPED

SEQ ID NO: 527078 - protein, 7 aa, Mycobacterium
MGQPEDQ

SEQ ID NO: 527079 - protein, 13 aa, Mycobacterium
MGQQELDSAVGDG

SEQ ID NO: 527080 - protein, 10 aa, Mycobacterium
MGQRATGTGT

SEQ ID NO: 527081 - protein, 47 aa, Mycobacterium
MGQRPATAQQPGPRPGAPAHPPTDPGPRGLAAPAAPGRGRRRTRRGR

SEQ ID NO: 527082 - protein, 12 aa, Mycobacterium
MGQRTTASGTVT

SEQ ID NO: 527083 - protein, 7 aa, Mycobacterium
MGQSDNA

SEQ ID NO: 527084 - protein, 25 aa, Mycobacterium
MGRAEAKSGAAVRDGDGRTYAGAPV

SEQ ID NO: 527085 - protein, 10 aa, Mycobacterium
MGRAEPAYEG

SEQ ID NO: 527086 - protein, 7 aa, Mycobacterium
MGRAGSI

SEQ ID NO: 527087 - protein, 7 aa, Mycobacterium
MGRAPGN

SEQ ID NO: 527088 - protein, 9 aa, Mycobacterium
MGRATSGVQ

SEQ ID NO: 527089 - protein, 7 aa, Mycobacterium
MGREDPS

SEQ ID NO: 527090 - protein, 5 aa, Mycobacterium
MGRGK

SEQ ID NO: 527091 - protein, 7 aa, Mycobacterium
MGRGTAG

SEQ ID NO: 527092 - protein, 39 aa, Mycobacterium
MGRKSATRKSKGAKGKAGKKGKKGGARGPTPPKVKSPFG

SEQ ID NO: 527093 - protein, 12 aa, Mycobacterium
MGRNSAGFGAPR

SEQ ID NO: 527094 - protein, 7 aa, Mycobacterium
MGRPEDI

SEQ ID NO: 527095 - protein, 11 aa, Mycobacterium
MGRPEYPTPLG

SEQ ID NO: 527096 - protein, 10 aa, Mycobacterium
MGRPEYPTPV

SEQ ID NO: 527097 - protein, 7 aa, Mycobacterium
MGRPGDI

SEQ ID NO: 527098 - protein, 9 aa, Mycobacterium
MGRRAARAR

SEQ ID NO: 527099 - protein, 8 aa, Mycobacterium
MGRRPGAR

SEQ ID NO: 527100 - protein, 8 aa, Mycobacterium
MGRSTEYA

SEQ ID NO: 527101 - protein, 10 aa, Mycobacterium
MGSAGTAGSG

SEQ ID NO: 527102 - protein, 9 aa, Mycobacterium
MGSAPGESV

SEQ ID NO: 527103 - protein, 10 aa, Mycobacterium
MGSDAPLTRE

SEQ ID NO: 527104 - protein, 10 aa, Mycobacterium
MGSDAQKDAF

SEQ ID NO: 527105 - protein, 7 aa, Mycobacterium
MGSDGKL

SEQ ID NO: 527106 - protein, 19 aa, Mycobacterium
MGSDSTTGGEVTASTGPRI

SEQ ID NO: 527107 - protein, 18 aa, Mycobacterium
MGSEQTAAAEGKVGTVRR

SEQ ID NO: 527108 - protein, 8 aa, Mycobacterium
MGSGGMPS

SEQ ID NO: 527109 - protein, 9 aa, Mycobacterium
MGSGLASSA

SEQ ID NO: 527110 - protein, 10 aa, Mycobacterium
MGSGLSSSAA

SEQ ID NO: 527111 - protein, 16 aa, Mycobacterium
MGSGNPEESYEPQPMQ

SEQ ID NO: 527112 - protein, 8 aa, Mycobacterium
MGSGRGYD

SEQ ID NO: 527113 - protein, 10 aa, Mycobacterium
MGSKRSPERM

SEQ ID NO: 527114 - protein, 10 aa, Mycobacterium
MGSKRSTAKM

SEQ ID NO: 527115 - protein, 10 aa, Mycobacterium
MGSKRSTEKM

SEQ ID NO: 527116 - protein, 4 aa, Mycobacterium
MGSP

SEQ ID NO: 527117 - protein, 14 aa, Mycobacterium
MGSPAAASLEGSVA

SEQ ID NO: 527118 - protein, 10 aa, Mycobacterium
MGSPAAASLQ

SEQ ID NO: 527119 - protein, 11 aa, Mycobacterium
MGSPGQGAYAA

SEQ ID NO: 527120 - protein, 19 aa, Mycobacterium
MGSPKYQQDGHPATSGPGF

SEQ ID NO: 527121 - protein, 7 aa, Mycobacterium
MGSPRSF

SEQ ID NO: 527122 - protein, 6 aa, Mycobacterium
MGSQRL

SEQ ID NO: 527123 - protein, 6 aa, Mycobacterium
MGSQSL

SEQ ID NO: 527124 - protein, 7 aa, Mycobacterium
MGSTDMG

SEQ ID NO: 527125 - protein, 9 aa, Mycobacterium
MGSTDMGNV

SEQ ID NO: 527126 - protein, 8 aa, Mycobacterium
MGSTPQSL

SEQ ID NO: 527127 - protein, 16 aa, Mycobacterium
MGSTSTETTPPTAPGV

SEQ ID NO: 527128 - protein, 10 aa, Mycobacterium
MGTDDNSVVD

SEQ ID NO: 527129 - protein, 6 aa, Mycobacterium
MGTDER

SEQ ID NO: 527130 - protein, 4 aa, Mycobacterium
MGTE

SEQ ID NO: 527131 - protein, 16 aa, Mycobacterium
MGTGAPRKLSDEEQPH

SEQ ID NO: 527132 - protein, 12 aa, Mycobacterium
MGTGEPRDLQEN

SEQ ID NO: 527133 - protein, 5 aa, Mycobacterium
MGTGG

SEQ ID NO: 527134 - protein, 13 aa, Mycobacterium
MGTGLSGGATALD

SEQ ID NO: 527135 - protein, 12 aa, Mycobacterium
MGTKGGPRTDHD

SEQ ID NO: 527136 - protein, 13 aa, Mycobacterium
MGTKGGPRTDRDG

SEQ ID NO: 527137 - protein, 5 aa, Mycobacterium
MGTPA

SEQ ID NO: 527138 - protein, 5 aa, Mycobacterium
MGTPE

SEQ ID NO: 527139 - protein, 7 aa, Mycobacterium
MGTPPAS

SEQ ID NO: 527140 - protein, 5 aa, Mycobacterium
MGTQA

SEQ ID NO: 527141 - protein, 13 aa, Mycobacterium
MGTQGPPGPLPNI

SEQ ID NO: 527142 - protein, 6 aa, Mycobacterium
MGTRKS

SEQ ID NO: 527143 - protein, 11 aa, Mycobacterium
MGTRPDNSVVD

SEQ ID NO: 527144 - protein, 8 aa, Mycobacterium
MGTTRSAA

SEQ ID NO: 527145 - protein, 4 aa, Mycobacterium
MGVG

SEQ ID NO: 527146 - protein, 5 aa, Mycobacterium
MGVTG

SEQ ID NO: 527147 - protein, 6 aa, Mycobacterium
MGVTGA

SEQ ID NO: 527148 - protein, 14 aa, Mycobacterium
MGYAPAEADEAEQM

SEQ ID NO: 527149 - protein, 14 aa, Mycobacterium
MGYAPAEDDEAEQM

SEQ ID NO: 527150 - protein, 13 aa, Mycobacterium
MGYAPAENDEADQ

SEQ ID NO: 527151 - protein, 12 aa, Mycobacterium
MGYAPAENDVDE

SEQ ID NO: 527152 - protein, 10 aa, Mycobacterium
MGYGPAEADV

SEQ ID NO: 527153 - protein, 10 aa, Mycobacterium
MGYPGPDPVA

SEQ ID NO: 527154 - protein, 10 aa, Mycobacterium
MHDTTQAAGV

SEQ ID NO: 527155 - protein, 11 aa, Mycobacterium
MHGGEPHPGGF

SEQ ID NO: 527156 - protein, 4 aa, Mycobacterium
MHGP

SEQ ID NO: 527157 - protein, 5 aa, Mycobacterium
MHGPA

SEQ ID NO: 527158 - protein, 5 aa, Mycobacterium
MHGPE

SEQ ID NO: 527159 - protein, 8 aa, Mycobacterium
MHGPTKDR

SEQ ID NO: 527160 - protein, 4 aa, Mycobacterium
MHGR

SEQ ID NO: 527161 - protein, 5 aa, Mycobacterium
MHNRG

SEQ ID NO: 527162 - protein, 7 aa, Mycobacterium
MHPDGTA

SEQ ID NO: 527163 - protein, 6 aa, Mycobacterium
MHSSDA

SEQ ID NO: 527164 - protein, 15 aa, Mycobacterium
MHTEPPSHGPMGPHG

SEQ ID NO: 527165 - protein, 7 aa, Mycobacterium
MHTSGRV

SEQ ID NO: 527166 - protein, 12 aa, Mycobacterium
MIDEKTQGKYAQ

SEQ ID NO: 527167 - protein, 13 aa, Mycobacterium
MIKTGGENVASRE

SEQ ID NO: 527168 - protein, 15 aa, Mycobacterium
MIKTGGENVASREVE

SEQ ID NO: 527169 - protein, 9 aa, Mycobacterium
MKAAGGGSI

SEQ ID NO: 527170 - protein, 9 aa, Mycobacterium
MKANDAKRL

SEQ ID NO: 527171 - protein, 5 aa, Mycobacterium
MKDDP

SEQ ID NO: 527172 - protein, 9 aa, Mycobacterium
MKDPDRGYA

SEQ ID NO: 527173 - protein, 9 aa, Mycobacterium
MKDPGDGSI

SEQ ID NO: 527174 - protein, 11 aa, Mycobacterium
MKDSSGTANAV

SEQ ID NO: 527175 - protein, 6 aa, Mycobacterium
MKEGQE

SEQ ID NO: 527176 - protein, 7 aa, Mycobacterium
MKETGAD

SEQ ID NO: 527177 - protein, 10 aa, Mycobacterium
MKGLGGAGLG

SEQ ID NO: 527178 - protein, 8 aa, Mycobacterium
MKGNPPLQ

SEQ ID NO: 527179 - protein, 8 aa, Mycobacterium
MKGPDDRP

SEQ ID NO: 527180 - protein, 7 aa, Mycobacterium
MKGQPAM

SEQ ID NO: 527181 - protein, 4 aa, Mycobacterium
MKGT

SEQ ID NO: 527182 - protein, 8 aa, Mycobacterium
MKHPERGY

SEQ ID NO: 527183 - protein, 15 aa, Mycobacterium
MKKAPEKRHRVYQKE

SEQ ID NO: 527184 - protein, 7 aa, Mycobacterium
MKKTPKK

SEQ ID NO: 527185 - protein, 9 aa, Mycobacterium
MKKTPKKDC

SEQ ID NO: 527186 - protein, 8 aa, Mycobacterium
MKKTQRRR

SEQ ID NO: 527187 - protein, 8 aa, Mycobacterium
MKNPERGY

SEQ ID NO: 527188 - protein, 7 aa, Mycobacterium
MKPDDTG

SEQ ID NO: 527189 - protein, 20 aa, Mycobacterium
MKPDTSFADGDWRGKSPIFT

SEQ ID NO: 527190 - protein, 8 aa, Mycobacterium
MKPQSGEV

SEQ ID NO: 527191 - protein, 12 aa, Mycobacterium
MKPSDVAKQRRD

SEQ ID NO: 527192 - protein, 8 aa, Mycobacterium
MKPTGKAG

SEQ ID NO: 527193 - protein, 11 aa, Mycobacterium
MKQQSTRPQTV

SEQ ID NO: 527194 - protein, 5 aa, Mycobacterium
MKSEY

SEQ ID NO: 527195 - protein, 4 aa, Mycobacterium
MKSG

SEQ ID NO: 527196 - protein, 9 aa, Mycobacterium
MKSQDKLRT

SEQ ID NO: 527197 - protein, 7 aa, Mycobacterium
MKSTPGG

SEQ ID NO: 527198 - protein, 11 aa, Mycobacterium
MKTAYDPDRLA

SEQ ID NO: 527199 - protein, 8 aa, Mycobacterium
MKTGEGKT

SEQ ID NO: 527200 - protein, 5 aa, Mycobacterium
MLGPD

SEQ ID NO: 527201 - protein, 12 aa, Mycobacterium
MLGSPGQGAYAA

SEQ ID NO: 527202 - protein, 7 aa, Mycobacterium
MLPPENE

SEQ ID NO: 527203 - protein, 7 aa, Mycobacterium
MLPPKGR

SEQ ID NO: 527204 - protein, 10 aa, Mycobacterium
MLPPKGRRAM

SEQ ID NO: 527205 - protein, 10 aa, Mycobacterium
MLPTTEPTVN

SEQ ID NO: 527206 - protein, 7 aa, Mycobacterium
MLPTTRE

SEQ ID NO: 527207 - protein, 4 aa, Mycobacterium
MLSP

SEQ ID NO: 527208 - protein, 5 aa, Mycobacterium
MLSPD

SEQ ID NO: 527209 - protein, 87 aa, Mycobacterium
MMPPPGMTASPLAPYSPPGAGAAGAGSGVPSSPTSPAGGSSTAGAGAGGGSGPTGGGPGAPPMLTGNPGSSGPMSALAGSSSDVNPD

SEQ ID NO: 527210 - protein, 7 aa, Mycobacterium
MNADDAA

SEQ ID NO: 527211 - protein, 7 aa, Mycobacterium
MNAGGQL

SEQ ID NO: 527212 - protein, 7 aa, Mycobacterium
MNAGKDV

SEQ ID NO: 527213 - protein, 4 aa, Mycobacterium
MNDD

SEQ ID NO: 527214 - protein, 6 aa, Mycobacterium
MNDDEP

SEQ ID NO: 527215 - protein, 15 aa, Mycobacterium
MNDGTAGGYATNTAP

SEQ ID NO: 527216 - protein, 15 aa, Mycobacterium
MNDGTAGGYENNTAP

SEQ ID NO: 527217 - protein, 15 aa, Mycobacterium
MNDGTAGGYETNTAP

SEQ ID NO: 527218 - protein, 15 aa, Mycobacterium
MNDGTAGGYQTNTAP

SEQ ID NO: 527219 - protein, 15 aa, Mycobacterium
MNDQTAGGYQTNTAP

SEQ ID NO: 527220 - protein, 10 aa, Mycobacterium
MNDSSQAEQL

SEQ ID NO: 527221 - protein, 5 aa, Mycobacterium
MNEAS

SEQ ID NO: 527222 - protein, 7 aa, Mycobacterium
MNEETLE

SEQ ID NO: 527223 - protein, 5 aa, Mycobacterium
MNEPA

SEQ ID NO: 527224 - protein, 21 aa, Mycobacterium
MNEQDARSRVAAQASDEQRRA

SEQ ID NO: 527225 - protein, 18 aa, Mycobacterium
MNGGSRPDIGSPEGSTML

SEQ ID NO: 527226 - protein, 17 aa, Mycobacterium
MNGGSRPDMGGTGSQML

SEQ ID NO: 527227 - protein, 17 aa, Mycobacterium
MNGPSSSYLTASSPDDI

SEQ ID NO: 527228 - protein, 4 aa, Mycobacterium
MNGQ

SEQ ID NO: 527229 - protein, 12 aa, Mycobacterium
MNHTGTADSGNE

SEQ ID NO: 527230 - protein, 7 aa, Mycobacterium
MNKSGPA

SEQ ID NO: 527231 - protein, 11 aa, Mycobacterium
MNLGETDDTVT

SEQ ID NO: 527232 - protein, 8 aa, Mycobacterium
MNNETETA

SEQ ID NO: 527233 - protein, 5 aa, Mycobacterium
MNNST

SEQ ID NO: 527234 - protein, 7 aa, Mycobacterium
MNPANDY

SEQ ID NO: 527235 - protein, 6 aa, Mycobacterium
MNPDAP

SEQ ID NO: 527236 - protein, 14 aa, Mycobacterium
MNPDAQRSAAEAAG

SEQ ID NO: 527237 - protein, 6 aa, Mycobacterium
MNPDST

SEQ ID NO: 527238 - protein, 6 aa, Mycobacterium
MNPDSY

SEQ ID NO: 527239 - protein, 5 aa, Mycobacterium
MNPEQ

SEQ ID NO: 527240 - protein, 4 aa, Mycobacterium
MNPF

SEQ ID NO: 527241 - protein, 6 aa, Mycobacterium
MNPGSL

SEQ ID NO: 527242 - protein, 7 aa, Mycobacterium
MNPPGTA

SEQ ID NO: 527243 - protein, 7 aa, Mycobacterium
MNPRDRR

SEQ ID NO: 527244 - protein, 9 aa, Mycobacterium
MNPSTGEVQ

SEQ ID NO: 527245 - protein, 6 aa, Mycobacterium
MNRDQD

SEQ ID NO: 527246 - protein, 6 aa, Mycobacterium
MNRPGG

SEQ ID NO: 527247 - protein, 10 aa, Mycobacterium
MNSADTVAQV

SEQ ID NO: 527248 - protein, 10 aa, Mycobacterium
MNSEPTGTQN

SEQ ID NO: 527249 - protein, 4 aa, Mycobacterium
MNSG

SEQ ID NO: 527250 - protein, 9 aa, Mycobacterium
MNSRKPRLD

SEQ ID NO: 527251 - protein, 4 aa, Mycobacterium
MNTD

SEQ ID NO: 527252 - protein, 4 aa, Mycobacterium
MNTP

SEQ ID NO: 527253 - protein, 4 aa, Mycobacterium
MNTY

SEQ ID NO: 527254 - protein, 12 aa, Mycobacterium
MPAAPPPDDLPG

SEQ ID NO: 527255 - protein, 13 aa, Mycobacterium
MPAAPPPDGLPGL

SEQ ID NO: 527256 - protein, 17 aa, Mycobacterium
MPADGPVNAVTEDELRD

SEQ ID NO: 527257 - protein, 8 aa, Mycobacterium
MPADSPDA

SEQ ID NO: 527258 - protein, 10 aa, Mycobacterium
MPADSVESFG

SEQ ID NO: 527259 - protein, 5 aa, Mycobacterium
MPAEE

SEQ ID NO: 527260 - protein, 7 aa, Mycobacterium
MPAGPAK

SEQ ID NO: 527261 - protein, 12 aa, Mycobacterium
MPAHDADEVARR

SEQ ID NO: 527262 - protein, 6 aa, Mycobacterium
MPAKPA

SEQ ID NO: 527263 - protein, 8 aa, Mycobacterium
MPAKPARR

SEQ ID NO: 527264 - protein, 6 aa, Mycobacterium
MPAKSA

SEQ ID NO: 527265 - protein, 9 aa, Mycobacterium
MPAKSGVGG

SEQ ID NO: 527266 - protein, 11 aa, Mycobacterium
MPANRPDTDSL

SEQ ID NO: 527267 - protein, 9 aa, Mycobacterium
MPAPAGKTV

SEQ ID NO: 527268 - protein, 8 aa, Mycobacterium
MPAPGPGE

SEQ ID NO: 527269 - protein, 7 aa, Mycobacterium
MPAPQRL

SEQ ID NO: 527270 - protein, 10 aa, Mycobacterium
MPAPSRTGSQ

SEQ ID NO: 527271 - protein, 29 aa, Mycobacterium
MPAPTMPGGGLSPTTAGQGISPASLGQSV

SEQ ID NO: 527272 - protein, 8 aa, Mycobacterium
MPARSSSA

SEQ ID NO: 527273 - protein, 6 aa, Mycobacterium
MPASEA

SEQ ID NO: 527274 - protein, 8 aa, Mycobacterium
MPASPIGG

SEQ ID NO: 527275 - protein, 7 aa, Mycobacterium
MPASRKR

SEQ ID NO: 527276 - protein, 5 aa, Mycobacterium
MPATL

SEQ ID NO: 527277 - protein, 11 aa, Mycobacterium
MPATLSTAADE

SEQ ID NO: 527278 - protein, 4 aa, Mycobacterium
MPCA

SEQ ID NO: 527279 - protein, 4 aa, Mycobacterium
MPDA

SEQ ID NO: 527280 - protein, 9 aa, Mycobacterium
MPDDHANSI

SEQ ID NO: 527281 - protein, 9 aa, Mycobacterium
MPDDHPNSI

SEQ ID NO: 527282 - protein, 9 aa, Mycobacterium
MPDDHRNSI

SEQ ID NO: 527283 - protein, 16 aa, Mycobacterium
MPDDYDGRTDDNIKAN

SEQ ID NO: 527284 - protein, 4 aa, Mycobacterium
MPDG

SEQ ID NO: 527285 - protein, 6 aa, Mycobacterium
MPDGAY

SEQ ID NO: 527286 - protein, 14 aa, Mycobacterium
MPDGGGKFELTEDD

SEQ ID NO: 527287 - protein, 19 aa, Mycobacterium
MPDGQVSTNHAFAQLVVER

SEQ ID NO: 527288 - protein, 20 aa, Mycobacterium
MPDGSYGTDNIGSPASADTT

SEQ ID NO: 527289 - protein, 4 aa, Mycobacterium
MPDI

SEQ ID NO: 527290 - protein, 5 aa, Mycobacterium
MPDKE

SEQ ID NO: 527291 - protein, 6 aa, Mycobacterium
MPDKET

SEQ ID NO: 527292 - protein, 7 aa, Mycobacterium
MPDKPAT

SEQ ID NO: 527293 - protein, 7 aa, Mycobacterium
MPDKPGT

SEQ ID NO: 527294 - protein, 7 aa, Mycobacterium
MPDNATN

SEQ ID NO: 527295 - protein, 8 aa, Mycobacterium
MPDPDDPG

SEQ ID NO: 527296 - protein, 7 aa, Mycobacterium
MPDPDGN

SEQ ID NO: 527297 - protein, 8 aa, Mycobacterium
MPDPDTTF

SEQ ID NO: 527298 - protein, 22 aa, Mycobacterium
MPDPLPDHGDGPYWAPTATADR

SEQ ID NO: 527299 - protein, 6 aa, Mycobacterium
MPDPMP

SEQ ID NO: 527300 - protein, 5 aa, Mycobacterium
MPDPR

SEQ ID NO: 527301 - protein, 6 aa, Mycobacterium
MPDPRH

SEQ ID NO: 527302 - protein, 7 aa, Mycobacterium
MPDPTDP

SEQ ID NO: 527303 - protein, 5 aa, Mycobacterium
MPDQG

SEQ ID NO: 527304 - protein, 4 aa, Mycobacterium
MPDR

SEQ ID NO: 527305 - protein, 9 aa, Mycobacterium
MPDSGMPED

SEQ ID NO: 527306 - protein, 5 aa, Mycobacterium
MPDSP

SEQ ID NO: 527307 - protein, 6 aa, Mycobacterium
MPDSPF

SEQ ID NO: 527308 - protein, 13 aa, Mycobacterium
MPDTGTTVADGAQ

SEQ ID NO: 527309 - protein, 8 aa, Mycobacterium
MPDYPEEG

SEQ ID NO: 527310 - protein, 15 aa, Mycobacterium
MPDYPTPEQLEAAPR

SEQ ID NO: 527311 - protein, 12 aa, Mycobacterium
MPEAAATRVKAT

SEQ ID NO: 527312 - protein, 7 aa, Mycobacterium
MPEAAGQ

SEQ ID NO: 527313 - protein, 6 aa, Mycobacterium
MPEDAT

SEQ ID NO: 527314 - protein, 5 aa, Mycobacterium
MPEDG

SEQ ID NO: 527315 - protein, 9 aa, Mycobacterium
MPEDQAQEM

SEQ ID NO: 527316 - protein, 6 aa, Mycobacterium
MPEEQL

SEQ ID NO: 527317 - protein, 5 aa, Mycobacterium
MPEER

SEQ ID NO: 527318 - protein, 6 aa, Mycobacterium
MPEEVR

SEQ ID NO: 527319 - protein, 5 aa, Mycobacterium
MPEGA

SEQ ID NO: 527320 - protein, 8 aa, Mycobacterium
MPEGGPYQ

SEQ ID NO: 527321 - protein, 5 aa, Mycobacterium
MPEGL

SEQ ID NO: 527322 - protein, 5 aa, Mycobacterium
MPEGQ

SEQ ID NO: 527323 - protein, 21 aa, Mycobacterium
MPEGVPPAALRPEPRLPAPAG

SEQ ID NO: 527324 - protein, 8 aa, Mycobacterium
MPEHSDDA

SEQ ID NO: 527325 - protein, 11 aa, Mycobacterium
MPEKTAETVDP

SEQ ID NO: 527326 - protein, 11 aa, Mycobacterium
MPENSKAGERI

SEQ ID NO: 527327 - protein, 12 aa, Mycobacterium
MPESDDSPSEHE

SEQ ID NO: 527328 - protein, 5 aa, Mycobacterium
MPESP

SEQ ID NO: 527329 - protein, 9 aa, Mycobacterium
MPEVPGPES

SEQ ID NO: 527330 - protein, 11 aa, Mycobacterium
MPEVSPDGKTY

SEQ ID NO: 527331 - protein, 7 aa, Mycobacterium
MPGAGGT

SEQ ID NO: 527332 - protein, 14 aa, Mycobacterium
MPGAKGAASTLYQP

SEQ ID NO: 527333 - protein, 8 aa, Mycobacterium
MPGDPDQT

SEQ ID NO: 527334 - protein, 7 aa, Mycobacterium
MPGEADD

SEQ ID NO: 527335 - protein, 7 aa, Mycobacterium
MPGEEGK

SEQ ID NO: 527336 - protein, 5 aa, Mycobacterium
MPGFE

SEQ ID NO: 527337 - protein, 4 aa, Mycobacterium
MPGG

SEQ ID NO: 527338 - protein, 8 aa, Mycobacterium
MPGGAGTA

SEQ ID NO: 527339 - protein, 7 aa, Mycobacterium
MPGGATA

SEQ ID NO: 527340 - protein, 11 aa, Mycobacterium
MPGGPAESYES

SEQ ID NO: 527341 - protein, 7 aa, Mycobacterium
MPGGPGM

SEQ ID NO: 527342 - protein, 23 aa, Mycobacterium
MPGHSGMPSASAAPSESGTPTQS

SEQ ID NO: 527343 - protein, 4 aa, Mycobacterium
MPGI

SEQ ID NO: 527344 - protein, 6 aa, Mycobacterium
MPGLSD

SEQ ID NO: 527345 - protein, 6 aa, Mycobacterium
MPGLSN

SEQ ID NO: 527346 - protein, 8 aa, Mycobacterium
MPGLTQGK

SEQ ID NO: 527347 - protein, 10 aa, Mycobacterium
MPGLTQGKPF

SEQ ID NO: 527348 - protein, 9 aa, Mycobacterium
MPGMGGSGH

SEQ ID NO: 527349 - protein, 20 aa, Mycobacterium
MPGNAGGGLISGPGSGTSDS

SEQ ID NO: 527350 - protein, 8 aa, Mycobacterium
MPGNKDRY

SEQ ID NO: 527351 - protein, 6 aa, Mycobacterium
MPGPDD

SEQ ID NO: 527352 - protein, 11 aa, Mycobacterium
MPGPDGEEAGR

SEQ ID NO: 527353 - protein, 14 aa, Mycobacterium
MPGPDRHRPIPWPA

SEQ ID NO: 527354 - protein, 8 aa, Mycobacterium
MPGPGRTK

SEQ ID NO: 527355 - protein, 8 aa, Mycobacterium
MPGPPGTG

SEQ ID NO: 527356 - protein, 7 aa, Mycobacterium
MPGPPVR

SEQ ID NO: 527357 - protein, 8 aa, Mycobacterium
MPGPTGLS

SEQ ID NO: 527358 - protein, 8 aa, Mycobacterium
MPGPTGLT

SEQ ID NO: 527359 - protein, 8 aa, Mycobacterium
MPGQQESE

SEQ ID NO: 527360 - protein, 4 aa, Mycobacterium
MPGS

SEQ ID NO: 527361 - protein, 5 aa, Mycobacterium
MPGSC

SEQ ID NO: 527362 - protein, 11 aa, Mycobacterium
MPGSEAGMGLG

SEQ ID NO: 527363 - protein, 9 aa, Mycobacterium
MPGSGTPAE

SEQ ID NO: 527364 - protein, 10 aa, Mycobacterium
MPGSKSQTNR

SEQ ID NO: 527365 - protein, 9 aa, Mycobacterium
MPGSPDVAE

SEQ ID NO: 527366 - protein, 9 aa, Mycobacterium
MPGTELSNY

SEQ ID NO: 527367 - protein, 6 aa, Mycobacterium
MPGTTK

SEQ ID NO: 527368 - protein, 7 aa, Mycobacterium
MPGTTKL

SEQ ID NO: 527369 - protein, 14 aa, Mycobacterium
MPGVAGRHESDPVP

SEQ ID NO: 527370 - protein, 15 aa, Mycobacterium
MPGVAGRHESDPVPI

SEQ ID NO: 527371 - protein, 13 aa, Mycobacterium
MPHAPAPEECPGF

SEQ ID NO: 527372 - protein, 6 aa, Mycobacterium
MPHEES

SEQ ID NO: 527373 - protein, 7 aa, Mycobacterium
MPHTTPP

SEQ ID NO: 527374 - protein, 21 aa, Mycobacterium
MPIGGGKGGSDFDPKGRSDGE

SEQ ID NO: 527375 - protein, 20 aa, Mycobacterium
MPKPASATVYEPTDEGRSLE

SEQ ID NO: 527376 - protein, 13 aa, Mycobacterium
MPKPKRNYGRYSP

SEQ ID NO: 527377 - protein, 16 aa, Mycobacterium
MPKTKKTKTGYTTDAD

SEQ ID NO: 527378 - protein, 12 aa, Mycobacterium
MPLDPKRARPGF

SEQ ID NO: 527379 - protein, 11 aa, Mycobacterium
MPLNDAQPRIE

SEQ ID NO: 527380 - protein, 11 aa, Mycobacterium
MPLPSTDAAEL

SEQ ID NO: 527381 - protein, 4 aa, Mycobacterium
MPNP

SEQ ID NO: 527382 - protein, 14 aa, Mycobacterium
MPNPKTGTVTPDVT

SEQ ID NO: 527383 - protein, 8 aa, Mycobacterium
MPNPTGTV

SEQ ID NO: 527384 - protein, 4 aa, Mycobacterium
MPNQ

SEQ ID NO: 527385 - protein, 30 aa, Mycobacterium
MPNRGGASGLNGTTSRPGAPPTVMPRPLFG

SEQ ID NO: 527386 - protein, 18 aa, Mycobacterium
MPNSDGSYDRQETPRSPK

SEQ ID NO: 527387 - protein, 7 aa, Mycobacterium
MPNTNPI

SEQ ID NO: 527388 - protein, 4 aa, Mycobacterium
MPNW

SEQ ID NO: 527389 - protein, 9 aa, Mycobacterium
MPPAAGTGM

SEQ ID NO: 527390 - protein, 13 aa, Mycobacterium
MPPANLEPGASRK

SEQ ID NO: 527391 - protein, 8 aa, Mycobacterium
MPPAPQPE

SEQ ID NO: 527392 - protein, 12 aa, Mycobacterium
MPPASLEPGAPR

SEQ ID NO: 527393 - protein, 18 aa, Mycobacterium
MPPASMAPGAQPKLSAAA

SEQ ID NO: 527394 - protein, 8 aa, Mycobacterium
MPPDAPEG

SEQ ID NO: 527395 - protein, 6 aa, Mycobacterium
MPPDGA

SEQ ID NO: 527396 - protein, 11 aa, Mycobacterium
MPPDSSSADDN

SEQ ID NO: 527397 - protein, 10 aa, Mycobacterium
MPPEADHDVA

SEQ ID NO: 527398 - protein, 5 aa, Mycobacterium
MPPER

SEQ ID NO: 527399 - protein, 8 aa, Mycobacterium
MPPESDHD

SEQ ID NO: 527400 - protein, 4 aa, Mycobacterium
MPPG

SEQ ID NO: 527401 - protein, 13 aa, Mycobacterium
MPPGAPRAKPADV

SEQ ID NO: 527402 - protein, 18 aa, Mycobacterium
MPPGGEDPEYAAATRAAA

SEQ ID NO: 527403 - protein, 9 aa, Mycobacterium
MPPGPGEHT

SEQ ID NO: 527404 - protein, 7 aa, Mycobacterium
MPPGPTQ

SEQ ID NO: 527405 - protein, 6 aa, Mycobacterium
MPPGTA

SEQ ID NO: 527406 - protein, 11 aa, Mycobacterium
MPPGTAPPADR

SEQ ID NO: 527407 - protein, 10 aa, Mycobacterium
MPPGTAPTAD

SEQ ID NO: 527408 - protein, 11 aa, Mycobacterium
MPPGVPPGQPL

SEQ ID NO: 527409 - protein, 7 aa, Mycobacterium
MPPGYEG

SEQ ID NO: 527410 - protein, 11 aa, Mycobacterium
MPPLDGPAGGV

SEQ ID NO: 527411 - protein, 15 aa, Mycobacterium
MPPLESGGLHDGQTA

SEQ ID NO: 527412 - protein, 4 aa, Mycobacterium
MPPN

SEQ ID NO: 527413 - protein, 8 aa, Mycobacterium
MPPPEPGA

SEQ ID NO: 527414 - protein, 5 aa, Mycobacterium
MPPPK

SEQ ID NO: 527415 - protein, 7 aa, Mycobacterium
MPPPQWG

SEQ ID NO: 527416 - protein, 9 aa, Mycobacterium
MPPPSSGGI

SEQ ID NO: 527417 - protein, 26 aa, Mycobacterium
MPPQLRSGPPGPEPGPAAGGRGPAEE

SEQ ID NO: 527418 - protein, 4 aa, Mycobacterium
MPPR

SEQ ID NO: 527419 - protein, 7 aa, Mycobacterium
MPPRGSK

SEQ ID NO: 527420 - protein, 12 aa, Mycobacterium
MPPRKSAQRAAS

SEQ ID NO: 527421 - protein, 9 aa, Mycobacterium
MPPRPGERD

SEQ ID NO: 527422 - protein, 8 aa, Mycobacterium
MPPRPQER

SEQ ID NO: 527423 - protein, 13 aa, Mycobacterium
MPPSALASDKESW

SEQ ID NO: 527424 - protein, 6 aa, Mycobacterium
MPPSGE

SEQ ID NO: 527425 - protein, 21 aa, Mycobacterium
MPPSIPGDSGGPVWTPTSQGY

SEQ ID NO: 527426 - protein, 23 aa, Mycobacterium
MPPSPPAPKPGEDKPTVVTNRPN

SEQ ID NO: 527427 - protein, 13 aa, Mycobacterium
MPPSRGARPVTDA

SEQ ID NO: 527428 - protein, 7 aa, Mycobacterium
MPPSTAN

SEQ ID NO: 527429 - protein, 9 aa, Mycobacterium
MPPTTGTGM

SEQ ID NO: 527430 - protein, 11 aa, Mycobacterium
MPQKLTADTGI

SEQ ID NO: 527431 - protein, 12 aa, Mycobacterium
MPQPGRRERIDP

SEQ ID NO: 527432 - protein, 18 aa, Mycobacterium
MPQPGRRERIDPKRLAGR

SEQ ID NO: 527433 - protein, 12 aa, Mycobacterium
MPRAPRDLRATA

SEQ ID NO: 527434 - protein, 5 aa, Mycobacterium
MPREQ

SEQ ID NO: 527435 - protein, 8 aa, Mycobacterium
MPRGGPRA

SEQ ID NO: 527436 - protein, 4 aa, Mycobacterium
MPRL

SEQ ID NO: 527437 - protein, 7 aa, Mycobacterium
MPRPDDP

SEQ ID NO: 527438 - protein, 8 aa, Mycobacterium
MPRPPVPA

SEQ ID NO: 527439 - protein, 7 aa, Mycobacterium
MPRPQPP

SEQ ID NO: 527440 - protein, 7 aa, Mycobacterium
MPRPSAT

SEQ ID NO: 527441 - protein, 6 aa, Mycobacterium
MPRTYR

SEQ ID NO: 527442 - protein, 4 aa, Mycobacterium
MPRW

SEQ ID NO: 527443 - protein, 4 aa, Mycobacterium
MPSA

SEQ ID NO: 527444 - protein, 12 aa, Mycobacterium
MPSADDRFDDER

SEQ ID NO: 527445 - protein, 11 aa, Mycobacterium
MPSATAQRPGD

SEQ ID NO: 527446 - protein, 5 aa, Mycobacterium
MPSDL

SEQ ID NO: 527447 - protein, 4 aa, Mycobacterium
MPSG

SEQ ID NO: 527448 - protein, 7 aa, Mycobacterium
MPSGADG

SEQ ID NO: 527449 - protein, 22 aa, Mycobacterium
MPSGASSSTSPGSNSPTAPGLK

SEQ ID NO: 527450 - protein, 8 aa, Mycobacterium
MPSGDGRN

SEQ ID NO: 527451 - protein, 5 aa, Mycobacterium
MPSGG

SEQ ID NO: 527452 - protein, 4 aa, Mycobacterium
MPSI

SEQ ID NO: 527453 - protein, 28 aa, Mycobacterium
MPSNPQGCADGLSPRLANAGKAGPENTA

SEQ ID NO: 527454 - protein, 4 aa, Mycobacterium
MPSP

SEQ ID NO: 527455 - protein, 7 aa, Mycobacterium
MPSPLRD

SEQ ID NO: 527456 - protein, 7 aa, Mycobacterium
MPSPRRT

SEQ ID NO: 527457 - protein, 6 aa, Mycobacterium
MPSPSF

SEQ ID NO: 527458 - protein, 5 aa, Mycobacterium
MPSQR

SEQ ID NO: 527459 - protein, 20 aa, Mycobacterium
MPSRAPLGLAGRPSGLRNRR

SEQ ID NO: 527460 - protein, 5 aa, Mycobacterium
MPSRD

SEQ ID NO: 527461 - protein, 5 aa, Mycobacterium
MPSRS

SEQ ID NO: 527462 - protein, 8 aa, Mycobacterium
MPSRTTPL

SEQ ID NO: 527463 - protein, 7 aa, Mycobacterium
MPSSAGQ

SEQ ID NO: 527464 - protein, 11 aa, Mycobacterium
MPSSRYSEIAP

SEQ ID NO: 527465 - protein, 4 aa, Mycobacterium
MPST

SEQ ID NO: 527466 - protein, 8 aa, Mycobacterium
MPSTDGRD

SEQ ID NO: 527467 - protein, 5 aa, Mycobacterium
MPSTV

SEQ ID NO: 527468 - protein, 5 aa, Mycobacterium
MPTDG

SEQ ID NO: 527469 - protein, 17 aa, Mycobacterium
MPTDSPLPELARARRML

SEQ ID NO: 527470 - protein, 8 aa, Mycobacterium
MPTGPTGV

SEQ ID NO: 527471 - protein, 7 aa, Mycobacterium
MPTGRAE

SEQ ID NO: 527472 - protein, 8 aa, Mycobacterium
MPTGRRDD

SEQ ID NO: 527473 - protein, 66 aa, Mycobacterium
MPTHSTPAEPASTTPYREGYGGYGHGAYGGYGQGGYGGHGQGGYSHGAYGGHGGYGGYSHGAYGGY

SEQ ID NO: 527474 - protein, 11 aa, Mycobacterium
MPTITSGNTNA

SEQ ID NO: 527475 - protein, 11 aa, Mycobacterium
MPTKSYDNAQG

SEQ ID NO: 527476 - protein, 14 aa, Mycobacterium
MPTLPDAARPPGLA

SEQ ID NO: 527477 - protein, 9 aa, Mycobacterium
MPTNPDADL

SEQ ID NO: 527478 - protein, 8 aa, Mycobacterium
MPTPAELA

SEQ ID NO: 527479 - protein, 8 aa, Mycobacterium
MPTPAKPH

SEQ ID NO: 527480 - protein, 14 aa, Mycobacterium
MPTPDRHRPIPWPA

SEQ ID NO: 527481 - protein, 14 aa, Mycobacterium
MPTPDRNRPIPWPA

SEQ ID NO: 527482 - protein, 14 aa, Mycobacterium
MPTPDRRRPIPWPA

SEQ ID NO: 527483 - protein, 13 aa, Mycobacterium
MPTPEADPPPQDY

SEQ ID NO: 527484 - protein, 7 aa, Mycobacterium
MPTPEQA

SEQ ID NO: 527485 - protein, 14 aa, Mycobacterium
MPTPGPRSTMRRSD

SEQ ID NO: 527486 - protein, 6 aa, Mycobacterium
MPTQPE

SEQ ID NO: 527487 - protein, 14 aa, Mycobacterium
MPTSMGKDSTPTDN

SEQ ID NO: 527488 - protein, 4 aa, Mycobacterium
MPTT

SEQ ID NO: 527489 - protein, 11 aa, Mycobacterium
MPTTDTPLSGG

SEQ ID NO: 527490 - protein, 4 aa, Mycobacterium
MPTW

SEQ ID NO: 527491 - protein, 5 aa, Mycobacterium
MPVNA

SEQ ID NO: 527492 - protein, 14 aa, Mycobacterium
MPVPKDGMPIVLRP

SEQ ID NO: 527493 - protein, 5 aa, Mycobacterium
MPVPT

SEQ ID NO: 527494 - protein, 11 aa, Mycobacterium
MPVRPGEAGTP

SEQ ID NO: 527495 - protein, 7 aa, Mycobacterium
MPVTSGG

SEQ ID NO: 527496 - protein, 9 aa, Mycobacterium
MPWDPPDHL

SEQ ID NO: 527497 - protein, 14 aa, Mycobacterium
MPWPDDAGAPAPEL

SEQ ID NO: 527498 - protein, 8 aa, Mycobacterium
MPYATTEA

SEQ ID NO: 527499 - protein, 29 aa, Mycobacterium
MPYPPNYPKMPGEPKRVQPSRDTDRRNGK

SEQ ID NO: 527500 - protein, 29 aa, Mycobacterium
MPYPPNYPKMPGEPKRVQPSRDTGLKKDA

SEQ ID NO: 527501 - protein, 19 aa, Mycobacterium
MQAAAPAAAPAAAADPPSL

SEQ ID NO: 527502 - protein, 13 aa, Mycobacterium
MQAASDPRSDGAG

SEQ ID NO: 527503 - protein, 13 aa, Mycobacterium
MQAEDDRIGDVRG

SEQ ID NO: 527504 - protein, 8 aa, Mycobacterium
MQAEETAM

SEQ ID NO: 527505 - protein, 10 aa, Mycobacterium
MQAGQTRDSI

SEQ ID NO: 527506 - protein, 7 aa, Mycobacterium
MQAGSLT

SEQ ID NO: 527507 - protein, 5 aa, Mycobacterium
MQANI

SEQ ID NO: 527508 - protein, 4 aa, Mycobacterium
MQAT

SEQ ID NO: 527509 - protein, 7 aa, Mycobacterium
MQDAGAA

SEQ ID NO: 527510 - protein, 9 aa, Mycobacterium
MQDAKRTHE

SEQ ID NO: 527511 - protein, 9 aa, Mycobacterium
MQEEPGGAE

SEQ ID NO: 527512 - protein, 9 aa, Mycobacterium
MQEGEKRSL

SEQ ID NO: 527513 - protein, 11 aa, Mycobacterium
MQEPTDQPWGA

SEQ ID NO: 527514 - protein, 10 aa, Mycobacterium
MQEQVSSSLR

SEQ ID NO: 527515 - protein, 11 aa, Mycobacterium
MQEQVSSSLRS

SEQ ID NO: 527516 - protein, 10 aa, Mycobacterium
MQGDGTKLGF

SEQ ID NO: 527517 - protein, 8 aa, Mycobacterium
MQGGAKAH

SEQ ID NO: 527518 - protein, 9 aa, Mycobacterium
MQGGGDSAR

SEQ ID NO: 527519 - protein, 9 aa, Mycobacterium
MQGGTAATQ

SEQ ID NO: 527520 - protein, 15 aa, Mycobacterium
MQGRGAAKSYSKDRY

SEQ ID NO: 527521 - protein, 19 aa, Mycobacterium
MQGRGATGNLRGSYSKDRY

SEQ ID NO: 527522 - protein, 15 aa, Mycobacterium
MQGRGATKSYSKDRY

SEQ ID NO: 527523 - protein, 14 aa, Mycobacterium
MQGRGGAKSYSKDR

SEQ ID NO: 527524 - protein, 14 aa, Mycobacterium
MQGRGGGKSYSKDR

SEQ ID NO: 527525 - protein, 5 aa, Mycobacterium
MQGTN

SEQ ID NO: 527526 - protein, 18 aa, Mycobacterium
MQHQGQAAGYLPSNEQIA

SEQ ID NO: 527527 - protein, 9 aa, Mycobacterium
MQNDGDPER

SEQ ID NO: 527528 - protein, 10 aa, Mycobacterium
MQNSPGKLTA

SEQ ID NO: 527529 - protein, 6 aa, Mycobacterium
MQPAGK

SEQ ID NO: 527530 - protein, 8 aa, Mycobacterium
MQPDAPAV

SEQ ID NO: 527531 - protein, 6 aa, Mycobacterium
MQPDDE

SEQ ID NO: 527532 - protein, 9 aa, Mycobacterium
MQPGADEPV

SEQ ID NO: 527533 - protein, 6 aa, Mycobacterium
MQPGGD

SEQ ID NO: 527534 - protein, 14 aa, Mycobacterium
MQPNTTDKTTKTTV

SEQ ID NO: 527535 - protein, 6 aa, Mycobacterium
MQPPEQ

SEQ ID NO: 527536 - protein, 5 aa, Mycobacterium
MQPPP

SEQ ID NO: 527537 - protein, 7 aa, Mycobacterium
MQPPPLD

SEQ ID NO: 527538 - protein, 4 aa, Mycobacterium
MQPQ

SEQ ID NO: 527539 - protein, 65 aa, Mycobacterium
MQQAGEQAEAGPESNPETDPETDPDFDPDFDPPGGGATTDSDAAAPQGKPKSSSTRQSAPPAATF

SEQ ID NO: 527540 - protein, 4 aa, Mycobacterium
MQQG

SEQ ID NO: 527541 - protein, 8 aa, Mycobacterium
MQQGEKRS

SEQ ID NO: 527542 - protein, 4 aa, Mycobacterium
MQRR

SEQ ID NO: 527543 - protein, 8 aa, Mycobacterium
MQRRPTRR

SEQ ID NO: 527544 - protein, 6 aa, Mycobacterium
MQSDGI

SEQ ID NO: 527545 - protein, 8 aa, Mycobacterium
MQSPSEDL

SEQ ID NO: 527546 - protein, 7 aa, Mycobacterium
MQTPSED

SEQ ID NO: 527547 - protein, 5 aa, Mycobacterium
MQTQD

SEQ ID NO: 527548 - protein, 5 aa, Mycobacterium
MQVDP

SEQ ID NO: 527549 - protein, 5 aa, Mycobacterium
MQYSG

SEQ ID NO: 527550 - protein, 9 aa, Mycobacterium
MRAAQTRNL

SEQ ID NO: 527551 - protein, 12 aa, Mycobacterium
MRAASEAAASAH

SEQ ID NO: 527552 - protein, 9 aa, Mycobacterium
MRAEPSREY

SEQ ID NO: 527553 - protein, 7 aa, Mycobacterium
MRAGGSG

SEQ ID NO: 527554 - protein, 8 aa, Mycobacterium
MRAGPDDA

SEQ ID NO: 527555 - protein, 6 aa, Mycobacterium
MRAGPG

SEQ ID NO: 527556 - protein, 5 aa, Mycobacterium
MRATA

SEQ ID NO: 527557 - protein, 12 aa, Mycobacterium
MRATADDSNQRI

SEQ ID NO: 527558 - protein, 12 aa, Mycobacterium
MRATASPGSLDH

SEQ ID NO: 527559 - protein, 5 aa, Mycobacterium
MRDAA

SEQ ID NO: 527560 - protein, 20 aa, Mycobacterium
MRDASKTPEPVPRSRPVVGQ

SEQ ID NO: 527561 - protein, 14 aa, Mycobacterium
MRDDPNNPASQDPF

SEQ ID NO: 527562 - protein, 9 aa, Mycobacterium
MRDDREHPD

SEQ ID NO: 527563 - protein, 6 aa, Mycobacterium
MRDGAG

SEQ ID NO: 527564 - protein, 5 aa, Mycobacterium
MRDGK

SEQ ID NO: 527565 - protein, 7 aa, Mycobacterium
MRDPAEA

SEQ ID NO: 527566 - protein, 13 aa, Mycobacterium
MRDPGAPVPPNLG

SEQ ID NO: 527567 - protein, 10 aa, Mycobacterium
MRDPGKGYVP

SEQ ID NO: 527568 - protein, 7 aa, Mycobacterium
MRDPSRY

SEQ ID NO: 527569 - protein, 22 aa, Mycobacterium
MRDPTRTPEPVPAVKPEAGQDN

SEQ ID NO: 527570 - protein, 37 aa, Mycobacterium
MRDQGADPGDQPSANATIDEGSVAPADHCPDHHKETV

SEQ ID NO: 527571 - protein, 10 aa, Mycobacterium
MRDSSPSLAQ

SEQ ID NO: 527572 - protein, 26 aa, Mycobacterium
MRDTGADMAEKYKETSLGGLALNVVE

SEQ ID NO: 527573 - protein, 17 aa, Mycobacterium
MREAGTKTSWNDPDTAF

SEQ ID NO: 527574 - protein, 22 aa, Mycobacterium
MREDAAQSPGWEAGHEKNRQLA

SEQ ID NO: 527575 - protein, 4 aa, Mycobacterium
MREG

SEQ ID NO: 527576 - protein, 4 aa, Mycobacterium
MREN

SEQ ID NO: 527577 - protein, 11 aa, Mycobacterium
MRETRGAADHV

SEQ ID NO: 527578 - protein, 12 aa, Mycobacterium
MRETRGAADQVD

SEQ ID NO: 527579 - protein, 12 aa, Mycobacterium
MRETRGAPEGAD

SEQ ID NO: 527580 - protein, 17 aa, Mycobacterium
MRETRGLTGAAEGADPI

SEQ ID NO: 527581 - protein, 7 aa, Mycobacterium
MRGDQLQ

SEQ ID NO: 527582 - protein, 10 aa, Mycobacterium
MRGEGAPAPI

SEQ ID NO: 527583 - protein, 11 aa, Mycobacterium
MRGEGAPAPIW

SEQ ID NO: 527584 - protein, 12 aa, Mycobacterium
MRGEGAPSPIWE

SEQ ID NO: 527585 - protein, 5 aa, Mycobacterium
MRGGK

SEQ ID NO: 527586 - protein, 5 aa, Mycobacterium
MRGGL

SEQ ID NO: 527587 - protein, 13 aa, Mycobacterium
MRGGPTALDNGQG

SEQ ID NO: 527588 - protein, 7 aa, Mycobacterium
MRGGSAH

SEQ ID NO: 527589 - protein, 22 aa, Mycobacterium
MRGHDGPSSGPEADGNGWEGPD

SEQ ID NO: 527590 - protein, 5 aa, Mycobacterium
MRGPG

SEQ ID NO: 527591 - protein, 22 aa, Mycobacterium
MRGPGTPGAPGRGWSPSPDAPA

SEQ ID NO: 527592 - protein, 6 aa, Mycobacterium
MRGQDP

SEQ ID NO: 527593 - protein, 12 aa, Mycobacterium
MRGRPDAPMDSG

SEQ ID NO: 527594 - protein, 5 aa, Mycobacterium
MRGSD

SEQ ID NO: 527595 - protein, 7 aa, Mycobacterium
MRGSQSP

SEQ ID NO: 527596 - protein, 4 aa, Mycobacterium
MRGV

SEQ ID NO: 527597 - protein, 9 aa, Mycobacterium
MRGVPSKDR

SEQ ID NO: 527598 - protein, 7 aa, Mycobacterium
MRHSPAA

SEQ ID NO: 527599 - protein, 17 aa, Mycobacterium
MRKAGYKPARREGTREG

SEQ ID NO: 527600 - protein, 6 aa, Mycobacterium
MRKTAN

SEQ ID NO: 527601 - protein, 8 aa, Mycobacterium
MRNPETAG

SEQ ID NO: 527602 - protein, 13 aa, Mycobacterium
MRNREDPGSGPVD

SEQ ID NO: 527603 - protein, 5 aa, Mycobacterium
MRNRK

SEQ ID NO: 527604 - protein, 4 aa, Mycobacterium
MRPA

SEQ ID NO: 527605 - protein, 15 aa, Mycobacterium
MRPATGVTELPAADG

SEQ ID NO: 527606 - protein, 7 aa, Mycobacterium
MRPDGRH

SEQ ID NO: 527607 - protein, 10 aa, Mycobacterium
MRPDQVAGNT

SEQ ID NO: 527608 - protein, 4 aa, Mycobacterium
MRPE

SEQ ID NO: 527609 - protein, 10 aa, Mycobacterium
MRPEAEAARD

SEQ ID NO: 527610 - protein, 11 aa, Mycobacterium
MRPETTKEGLG

SEQ ID NO: 527611 - protein, 6 aa, Mycobacterium
MRPGGS

SEQ ID NO: 527612 - protein, 5 aa, Mycobacterium
MRPGR

SEQ ID NO: 527613 - protein, 4 aa, Mycobacterium
MRPN

SEQ ID NO: 527614 - protein, 8 aa, Mycobacterium
MRPNNPEV

SEQ ID NO: 527615 - protein, 6 aa, Mycobacterium
MRPPAE

SEQ ID NO: 527616 - protein, 32 aa, Mycobacterium
MRPPAPPGAPGMPGAPGAPGMPGMPGAPGAPG

SEQ ID NO: 527617 - protein, 5 aa, Mycobacterium
MRPPE

SEQ ID NO: 527618 - protein, 8 aa, Mycobacterium
MRPPGALP

SEQ ID NO: 527619 - protein, 47 aa, Mycobacterium
MRPPGAPGAPGAPGAPGMPPRPGAPGMPGMPGAPGAPGMPGMPGAPG

SEQ ID NO: 527620 - protein, 5 aa, Mycobacterium
MRPPN

SEQ ID NO: 527621 - protein, 7 aa, Mycobacterium
MRPPPYR

SEQ ID NO: 527622 - protein, 5 aa, Mycobacterium
MRPPV

SEQ ID NO: 527623 - protein, 6 aa, Mycobacterium
MRPQPR

SEQ ID NO: 527624 - protein, 13 aa, Mycobacterium
MRPRNGRMRTGQR

SEQ ID NO: 527625 - protein, 8 aa, Mycobacterium
MRPSGGRA

SEQ ID NO: 527626 - protein, 7 aa, Mycobacterium
MRPTSGR

SEQ ID NO: 527627 - protein, 5 aa, Mycobacterium
MRQEG

SEQ ID NO: 527628 - protein, 7 aa, Mycobacterium
MRQRAAG

SEQ ID NO: 527629 - protein, 4 aa, Mycobacterium
MRRA

SEQ ID NO: 527630 - protein, 24 aa, Mycobacterium
MRRAGGNGAAAAPPAAVAEALGGQ

SEQ ID NO: 527631 - protein, 9 aa, Mycobacterium
MRRAGSGLG

SEQ ID NO: 527632 - protein, 14 aa, Mycobacterium
MRRARPKPKTDPQA

SEQ ID NO: 527633 - protein, 12 aa, Mycobacterium
MRRDGELAGQVS

SEQ ID NO: 527634 - protein, 12 aa, Mycobacterium
MRREEREQTTAA

SEQ ID NO: 527635 - protein, 13 aa, Mycobacterium
MRRGAQSANARWG

SEQ ID NO: 527636 - protein, 8 aa, Mycobacterium
MRRNKKAF

SEQ ID NO: 527637 - protein, 10 aa, Mycobacterium
MRSAGSGDWS

SEQ ID NO: 527638 - protein, 6 aa, Mycobacterium
MRSDDH

SEQ ID NO: 527639 - protein, 10 aa, Mycobacterium
MRSDPEGGTN

SEQ ID NO: 527640 - protein, 9 aa, Mycobacterium
MRSEGTEFR

SEQ ID NO: 527641 - protein, 47 aa, Mycobacterium
MRSEQDDPDAATEKLNSRAQADNGDARQRRRSAGGLSAQDLLRREGR

SEQ ID NO: 527642 - protein, 5 aa, Mycobacterium
MRSGG

SEQ ID NO: 527643 - protein, 7 aa, Mycobacterium
MRSGQSH

SEQ ID NO: 527644 - protein, 9 aa, Mycobacterium
MRSKRDERA

SEQ ID NO: 527645 - protein, 9 aa, Mycobacterium
MRSNPGAGG

SEQ ID NO: 527646 - protein, 7 aa, Mycobacterium
MRSPSVA

SEQ ID NO: 527647 - protein, 7 aa, Mycobacterium
MRSQDRR

SEQ ID NO: 527648 - protein, 5 aa, Mycobacterium
MRSQQ

SEQ ID NO: 527649 - protein, 14 aa, Mycobacterium
MRSRGGPNHRGRRT

SEQ ID NO: 527650 - protein, 9 aa, Mycobacterium
MRTDDPDDT

SEQ ID NO: 527651 - protein, 19 aa, Mycobacterium
MRTDTQTWATTDGPPRSEL

SEQ ID NO: 527652 - protein, 13 aa, Mycobacterium
MRTGNSVAPQDDT

SEQ ID NO: 527653 - protein, 8 aa, Mycobacterium
MRTGTEKL

SEQ ID NO: 527654 - protein, 5 aa, Mycobacterium
MRTPS

SEQ ID NO: 527655 - protein, 5 aa, Mycobacterium
MRTQD

SEQ ID NO: 527656 - protein, 4 aa, Mycobacterium
MRTR

SEQ ID NO: 527657 - protein, 5 aa, Mycobacterium
MRTRR

SEQ ID NO: 527658 - protein, 15 aa, Mycobacterium
MSAAQKRDARREVAS

SEQ ID NO: 527659 - protein, 21 aa, Mycobacterium
MSAATGAAAGAVSSRAAEQQR

SEQ ID NO: 527660 - protein, 22 aa, Mycobacterium
MSAATGYADGPPCNLQGPADPI

SEQ ID NO: 527661 - protein, 5 aa, Mycobacterium
MSADA

SEQ ID NO: 527662 - protein, 8 aa, Mycobacterium
MSADAARE

SEQ ID NO: 527663 - protein, 9 aa, Mycobacterium
MSADEAADA

SEQ ID NO: 527664 - protein, 6 aa, Mycobacterium
MSADER

SEQ ID NO: 527665 - protein, 5 aa, Mycobacterium
MSADG

SEQ ID NO: 527666 - protein, 5 aa, Mycobacterium
MSAEE

SEQ ID NO: 527667 - protein, 11 aa, Mycobacterium
MSAEEREETGN

SEQ ID NO: 527668 - protein, 15 aa, Mycobacterium
MSAENAPAAAPTTGV

SEQ ID NO: 527669 - protein, 9 aa, Mycobacterium
MSAGSAGTF

SEQ ID NO: 527670 - protein, 7 aa, Mycobacterium
MSAGSGA

SEQ ID NO: 527671 - protein, 19 aa, Mycobacterium
MSAGSGIRHSETNESATRP

SEQ ID NO: 527672 - protein, 19 aa, Mycobacterium
MSAGTGVQHSEKNASSDKP

SEQ ID NO: 527673 - protein, 5 aa, Mycobacterium
MSAKG

SEQ ID NO: 527674 - protein, 7 aa, Mycobacterium
MSAPDPA

SEQ ID NO: 527675 - protein, 5 aa, Mycobacterium
MSAPG

SEQ ID NO: 527676 - protein, 8 aa, Mycobacterium
MSAPGSRV

SEQ ID NO: 527677 - protein, 6 aa, Mycobacterium
MSAPND

SEQ ID NO: 527678 - protein, 7 aa, Mycobacterium
MSAPTKD

SEQ ID NO: 527679 - protein, 9 aa, Mycobacterium
MSAPTSGEC

SEQ ID NO: 527680 - protein, 5 aa, Mycobacterium
MSAQG

SEQ ID NO: 527681 - protein, 6 aa, Mycobacterium
MSAQGS

SEQ ID NO: 527682 - protein, 8 aa, Mycobacterium
MSAQQRAT

SEQ ID NO: 527683 - protein, 10 aa, Mycobacterium
MSARPESAPH

SEQ ID NO: 527684 - protein, 12 aa, Mycobacterium
MSASAARSRPAL

SEQ ID NO: 527685 - protein, 8 aa, Mycobacterium
MSASERAA

SEQ ID NO: 527686 - protein, 8 aa, Mycobacterium
MSASNRAN

SEQ ID NO: 527687 - protein, 5 aa, Mycobacterium
MSATE

SEQ ID NO: 527688 - protein, 5 aa, Mycobacterium
MSATG

SEQ ID NO: 527689 - protein, 7 aa, Mycobacterium
MSATRPP

SEQ ID NO: 527690 - protein, 9 aa, Mycobacterium
MSDAEARAY

SEQ ID NO: 527691 - protein, 11 aa, Mycobacterium
MSDAERTLADH

SEQ ID NO: 527692 - protein, 16 aa, Mycobacterium
MSDARPEAAPKHGSTR

SEQ ID NO: 527693 - protein, 4 aa, Mycobacterium
MSDD

SEQ ID NO: 527694 - protein, 7 aa, Mycobacterium
MSDDDSV

SEQ ID NO: 527695 - protein, 9 aa, Mycobacterium
MSDEESRAL

SEQ ID NO: 527696 - protein, 7 aa, Mycobacterium
MSDGDDP

SEQ ID NO: 527697 - protein, 10 aa, Mycobacterium
MSDPDKPNIA

SEQ ID NO: 527698 - protein, 8 aa, Mycobacterium
MSDPETGH

SEQ ID NO: 527699 - protein, 12 aa, Mycobacterium
MSDPGDGQHWGE

SEQ ID NO: 527700 - protein, 9 aa, Mycobacterium
MSDRTTQAQ

SEQ ID NO: 527701 - protein, 9 aa, Mycobacterium
MSDTPDNVN

SEQ ID NO: 527702 - protein, 7 aa, Mycobacterium
MSDTPEN

SEQ ID NO: 527703 - protein, 5 aa, Mycobacterium
MSEEQ

SEQ ID NO: 527704 - protein, 29 aa, Mycobacterium
MSEPASNGNERRSEHRDGVAQPLPEPATR

SEQ ID NO: 527705 - protein, 11 aa, Mycobacterium
MSEPGAGSDLA

SEQ ID NO: 527706 - protein, 17 aa, Mycobacterium
MSEPTGASGPNSDEQAA

SEQ ID NO: 527707 - protein, 6 aa, Mycobacterium
MSEPTR

SEQ ID NO: 527708 - protein, 9 aa, Mycobacterium
MSEQQPSAI

SEQ ID NO: 527709 - protein, 7 aa, Mycobacterium
MSESAAQ

SEQ ID NO: 527710 - protein, 13 aa, Mycobacterium
MSESAGPAPVRRR

SEQ ID NO: 527711 - protein, 9 aa, Mycobacterium
MSESNTVPP

SEQ ID NO: 527712 - protein, 7 aa, Mycobacterium
MSETSSG

SEQ ID NO: 527713 - protein, 44 aa, Mycobacterium
MSGAAPGASAASAAAGAAATEASLGAGGGSASLGGAGMSATSFT

SEQ ID NO: 527714 - protein, 6 aa, Mycobacterium
MSGAQA

SEQ ID NO: 527715 - protein, 11 aa, Mycobacterium
MSGDPQENTVD

SEQ ID NO: 527716 - protein, 7 aa, Mycobacterium
MSGESDP

SEQ ID NO: 527717 - protein, 11 aa, Mycobacterium
MSGGIPQSNRS

SEQ ID NO: 527718 - protein, 12 aa, Mycobacterium
MSGHGNAPHAAE

SEQ ID NO: 527719 - protein, 11 aa, Mycobacterium
MSGKPNIPTLP

SEQ ID NO: 527720 - protein, 11 aa, Mycobacterium
MSGKPRVPTLP

SEQ ID NO: 527721 - protein, 12 aa, Mycobacterium
MSGNAESPGAAA

SEQ ID NO: 527722 - protein, 7 aa, Mycobacterium
MSGNPDL

SEQ ID NO: 527723 - protein, 14 aa, Mycobacterium
MSGQPLDAQARPSV

SEQ ID NO: 527724 - protein, 12 aa, Mycobacterium
MSGQPLGDDARP

SEQ ID NO: 527725 - protein, 34 aa, Mycobacterium
MSGRGTDARIDKTDRVGAAERRQARRVRRGQVEP

SEQ ID NO: 527726 - protein, 33 aa, Mycobacterium
MSGRGTDARLERNERVGAAERKAARQQRRERGE

SEQ ID NO: 527727 - protein, 12 aa, Mycobacterium
MSGRMGSDRVTT

SEQ ID NO: 527728 - protein, 13 aa, Mycobacterium
MSGRMGSDRVTTQ

SEQ ID NO: 527729 - protein, 5 aa, Mycobacterium
MSGRN

SEQ ID NO: 527730 - protein, 7 aa, Mycobacterium
MSGRSAD

SEQ ID NO: 527731 - protein, 4 aa, Mycobacterium
MSGS

SEQ ID NO: 527732 - protein, 11 aa, Mycobacterium
MSGSGKGGAKY

SEQ ID NO: 527733 - protein, 9 aa, Mycobacterium
MSGSRKPNA

SEQ ID NO: 527734 - protein, 8 aa, Mycobacterium
MSGSSLSR

SEQ ID NO: 527735 - protein, 13 aa, Mycobacterium
MSGSTDPNSNGGF

SEQ ID NO: 527736 - protein, 8 aa, Mycobacterium
MSGTHEAN

SEQ ID NO: 527737 - protein, 15 aa, Mycobacterium
MSGTNAHAIVAIPEA

SEQ ID NO: 527738 - protein, 7 aa, Mycobacterium
MSGTSGL

SEQ ID NO: 527739 - protein, 5 aa, Mycobacterium
MSGYA

SEQ ID NO: 527740 - protein, 18 aa, Mycobacterium
MSKDDTGSGTAAASAGSV

SEQ ID NO: 527741 - protein, 10 aa, Mycobacterium
MSKDPLSRYP

SEQ ID NO: 527742 - protein, 5 aa, Mycobacterium
MSKKK

SEQ ID NO: 527743 - protein, 11 aa, Mycobacterium
MSKPAASAGRA

SEQ ID NO: 527744 - protein, 11 aa, Mycobacterium
MSKPAESIGTT

SEQ ID NO: 527745 - protein, 21 aa, Mycobacterium
MSKPGESATRAADLLENEVSV

SEQ ID NO: 527746 - protein, 4 aa, Mycobacterium
MSKS

SEQ ID NO: 527747 - protein, 7 aa, Mycobacterium
MSKSRGN

SEQ ID NO: 527748 - protein, 10 aa, Mycobacterium
MSNGSGADAG

SEQ ID NO: 527749 - protein, 5 aa, Mycobacterium
MSNPA

SEQ ID NO: 527750 - protein, 20 aa, Mycobacterium
MSNPQQPQQVTKSFELDVTC

SEQ ID NO: 527751 - protein, 7 aa, Mycobacterium
MSPAGTI

SEQ ID NO: 527752 - protein, 14 aa, Mycobacterium
MSPAPLSSTPPQVA

SEQ ID NO: 527753 - protein, 11 aa, Mycobacterium
MSPDDARQAEW

SEQ ID NO: 527754 - protein, 6 aa, Mycobacterium
MSPDGK

SEQ ID NO: 527755 - protein, 9 aa, Mycobacterium
MSPDPSCTL

SEQ ID NO: 527756 - protein, 4 aa, Mycobacterium
MSPE

SEQ ID NO: 527757 - protein, 5 aa, Mycobacterium
MSPET

SEQ ID NO: 527758 - protein, 19 aa, Mycobacterium
MSPGAAGTFPTINPATEEV

SEQ ID NO: 527759 - protein, 8 aa, Mycobacterium
MSPGRGPK

SEQ ID NO: 527760 - protein, 6 aa, Mycobacterium
MSPGTR

SEQ ID NO: 527761 - protein, 8 aa, Mycobacterium
MSPHPEGG

SEQ ID NO: 527762 - protein, 10 aa, Mycobacterium
MSPKKPRSLG

SEQ ID NO: 527763 - protein, 4 aa, Mycobacterium
MSPL

SEQ ID NO: 527764 - protein, 7 aa, Mycobacterium
MSPPSVN

SEQ ID NO: 527765 - protein, 5 aa, Mycobacterium
MSPQD

SEQ ID NO: 527766 - protein, 6 aa, Mycobacterium
MSPQTY

SEQ ID NO: 527767 - protein, 7 aa, Mycobacterium
MSPRPDI

SEQ ID NO: 527768 - protein, 4 aa, Mycobacterium
MSPS

SEQ ID NO: 527769 - protein, 7 aa, Mycobacterium
MSPSDQR

SEQ ID NO: 527770 - protein, 6 aa, Mycobacterium
MSPTEA

SEQ ID NO: 527771 - protein, 6 aa, Mycobacterium
MSPTQA

SEQ ID NO: 527772 - protein, 6 aa, Mycobacterium
MSPTRK

SEQ ID NO: 527773 - protein, 11 aa, Mycobacterium
MSPTTQASAQA

SEQ ID NO: 527774 - protein, 5 aa, Mycobacterium
MSPVY

SEQ ID NO: 527775 - protein, 5 aa, Mycobacterium
MSPYP

SEQ ID NO: 527776 - protein, 6 aa, Mycobacterium
MSQGKG

SEQ ID NO: 527777 - protein, 9 aa, Mycobacterium
MSQPDTGEL

SEQ ID NO: 527778 - protein, 12 aa, Mycobacterium
MSQSSNDTFPTA

SEQ ID NO: 527779 - protein, 11 aa, Mycobacterium
MSQTESEQMKE

SEQ ID NO: 527780 - protein, 7 aa, Mycobacterium
MSQYTKG

SEQ ID NO: 527781 - protein, 12 aa, Mycobacterium
MSRAASRKRAEE

SEQ ID NO: 527782 - protein, 8 aa, Mycobacterium
MSRADTRQ

SEQ ID NO: 527783 - protein, 10 aa, Mycobacterium
MSRAGSIGPL

SEQ ID NO: 527784 - protein, 4 aa, Mycobacterium
MSRG

SEQ ID NO: 527785 - protein, 7 aa, Mycobacterium
MSRGDLS

SEQ ID NO: 527786 - protein, 6 aa, Mycobacterium
MSRGEH

SEQ ID NO: 527787 - protein, 11 aa, Mycobacterium
MSRGSTLEDKL

SEQ ID NO: 527788 - protein, 13 aa, Mycobacterium
MSRNEPTETGERG

SEQ ID NO: 527789 - protein, 5 aa, Mycobacterium
MSRPD

SEQ ID NO: 527790 - protein, 32 aa, Mycobacterium
MSRQAGGRAGGSGGGVGLRGPGETKIETDRRR

SEQ ID NO: 527791 - protein, 9 aa, Mycobacterium
MSRRQARDR

SEQ ID NO: 527792 - protein, 12 aa, Mycobacterium
MSRRQARTRAGE

SEQ ID NO: 527793 - protein, 6 aa, Mycobacterium
MSRRRG

SEQ ID NO: 527794 - protein, 8 aa, Mycobacterium
MSRRSGQP

SEQ ID NO: 527795 - protein, 7 aa, Mycobacterium
MSRRTGQ

SEQ ID NO: 527796 - protein, 11 aa, Mycobacterium
MSRSDRESNTV

SEQ ID NO: 527797 - protein, 10 aa, Mycobacterium
MSRSDRETNT

SEQ ID NO: 527798 - protein, 7 aa, Mycobacterium
MSRSKRE

SEQ ID NO: 527799 - protein, 18 aa, Mycobacterium
MSRTPMGSSLANGGRPYS

SEQ ID NO: 527800 - protein, 4 aa, Mycobacterium
MSSA

SEQ ID NO: 527801 - protein, 8 aa, Mycobacterium
MSSADANY

SEQ ID NO: 527802 - protein, 5 aa, Mycobacterium
MSSAG

SEQ ID NO: 527803 - protein, 10 aa, Mycobacterium
MSSDAAREYK

SEQ ID NO: 527804 - protein, 4 aa, Mycobacterium
MSSE

SEQ ID NO: 527805 - protein, 17 aa, Mycobacterium
MSSGSYAVTEAANAAAT

SEQ ID NO: 527806 - protein, 11 aa, Mycobacterium
MSSPDARREAA

SEQ ID NO: 527807 - protein, 19 aa, Mycobacterium
MSSPPGDDPDGGSAAEHQG

SEQ ID NO: 527808 - protein, 27 aa, Mycobacterium
MSSSFGSSFAQGAATGKPADAGSHSLA

SEQ ID NO: 527809 - protein, 17 aa, Mycobacterium
MSSSGKGQSKINGPDEV

SEQ ID NO: 527810 - protein, 15 aa, Mycobacterium
MSSTAARALTPGDPV

SEQ ID NO: 527811 - protein, 5 aa, Mycobacterium
MSSTE

SEQ ID NO: 527812 - protein, 14 aa, Mycobacterium
MSSYASAETANAAQ

SEQ ID NO: 527813 - protein, 4 aa, Mycobacterium
MSTA

SEQ ID NO: 527814 - protein, 7 aa, Mycobacterium
MSTAGYG

SEQ ID NO: 527815 - protein, 5 aa, Mycobacterium
MSTER

SEQ ID NO: 527816 - protein, 6 aa, Mycobacterium
MSTGDE

SEQ ID NO: 527817 - protein, 15 aa, Mycobacterium
MSTGGTPSSSTPMGA

SEQ ID NO: 527818 - protein, 10 aa, Mycobacterium
MSTNPQRSAA

SEQ ID NO: 527819 - protein, 18 aa, Mycobacterium
MSTPASRSGSMRAADTDR

SEQ ID NO: 527820 - protein, 5 aa, Mycobacterium
MSTPD

SEQ ID NO: 527821 - protein, 12 aa, Mycobacterium
MSTRPRKADPGR

SEQ ID NO: 527822 - protein, 7 aa, Mycobacterium
MSTSGEV

SEQ ID NO: 527823 - protein, 17 aa, Mycobacterium
MSTSPPGAADRLTGRPG

SEQ ID NO: 527824 - protein, 6 aa, Mycobacterium
MSYPPS

SEQ ID NO: 527825 - protein, 9 aa, Mycobacterium
MSYSAGSDY

SEQ ID NO: 527826 - protein, 9 aa, Mycobacterium
MTAADGPTV

SEQ ID NO: 527827 - protein, 16 aa, Mycobacterium
MTAAQKKQIRSEIAGG

SEQ ID NO: 527828 - protein, 18 aa, Mycobacterium
MTAAQKKQVRDEVASGQA

SEQ ID NO: 527829 - protein, 7 aa, Mycobacterium
MTADDPG

SEQ ID NO: 527830 - protein, 11 aa, Mycobacterium
MTADRDRAVTE

SEQ ID NO: 527831 - protein, 8 aa, Mycobacterium
MTAEDEEI

SEQ ID NO: 527832 - protein, 5 aa, Mycobacterium
MTAEQ

SEQ ID NO: 527833 - protein, 12 aa, Mycobacterium
MTAGEDPEYADV

SEQ ID NO: 527834 - protein, 13 aa, Mycobacterium
MTAGEDPEYADVD

SEQ ID NO: 527835 - protein, 16 aa, Mycobacterium
MTAGQKKDVRAAVAGG

SEQ ID NO: 527836 - protein, 12 aa, Mycobacterium
MTAGQKKQVRAE

SEQ ID NO: 527837 - protein, 6 aa, Mycobacterium
MTAGSG

SEQ ID NO: 527838 - protein, 9 aa, Mycobacterium
MTANGFSEG

SEQ ID NO: 527839 - protein, 5 aa, Mycobacterium
MTAPA

SEQ ID NO: 527840 - protein, 11 aa, Mycobacterium
MTAPDATTQQA

SEQ ID NO: 527841 - protein, 9 aa, Mycobacterium
MTAPEKVTG

SEQ ID NO: 527842 - protein, 9 aa, Mycobacterium
MTAPETVTG

SEQ ID NO: 527843 - protein, 5 aa, Mycobacterium
MTAPG

SEQ ID NO: 527844 - protein, 7 aa, Mycobacterium
MTAPGDP

SEQ ID NO: 527845 - protein, 12 aa, Mycobacterium
MTAPGPDGAPRV

SEQ ID NO: 527846 - protein, 16 aa, Mycobacterium
MTAPPHPRAAGATDKD

SEQ ID NO: 527847 - protein, 9 aa, Mycobacterium
MTARERADA

SEQ ID NO: 527848 - protein, 8 aa, Mycobacterium
MTASDDPL

SEQ ID NO: 527849 - protein, 5 aa, Mycobacterium
MTAST

SEQ ID NO: 527850 - protein, 6 aa, Mycobacterium
MTDDER

SEQ ID NO: 527851 - protein, 6 aa, Mycobacterium
MTDEER

SEQ ID NO: 527852 - protein, 6 aa, Mycobacterium
MTDEQR

SEQ ID NO: 527853 - protein, 9 aa, Mycobacterium
MTDKTAPRV

SEQ ID NO: 527854 - protein, 7 aa, Mycobacterium
MTDLPDE

SEQ ID NO: 527855 - protein, 6 aa, Mycobacterium
MTDPQL

SEQ ID NO: 527856 - protein, 6 aa, Mycobacterium
MTDPSA

SEQ ID NO: 527857 - protein, 5 aa, Mycobacterium
MTDRT

SEQ ID NO: 527858 - protein, 7 aa, Mycobacterium
MTDSATE

SEQ ID NO: 527859 - protein, 8 aa, Mycobacterium
MTDTEPQW

SEQ ID NO: 527860 - protein, 5 aa, Mycobacterium
MTEAA

SEQ ID NO: 527861 - protein, 12 aa, Mycobacterium
MTEDAAPGESLA

SEQ ID NO: 527862 - protein, 5 aa, Mycobacterium
MTEDE

SEQ ID NO: 527863 - protein, 27 aa, Mycobacterium
MTEKQGGSDVRAGTTQATPNADGTYSL

SEQ ID NO: 527864 - protein, 27 aa, Mycobacterium
MTEKQGGSDVRAGTTQATPNGDGSYTL

SEQ ID NO: 527865 - protein, 26 aa, Mycobacterium
MTEKQGGSDVRAGTTTATPSADGSYT

SEQ ID NO: 527866 - protein, 10 aa, Mycobacterium
MTEPPRGIPD

SEQ ID NO: 527867 - protein, 5 aa, Mycobacterium
MTERG

SEQ ID NO: 527868 - protein, 7 aa, Mycobacterium
MTEYDPE

SEQ ID NO: 527869 - protein, 4 aa, Mycobacterium
MTGD

SEQ ID NO: 527870 - protein, 24 aa, Mycobacterium
MTGDPDGPPTLPGYSSADNSTGLT

SEQ ID NO: 527871 - protein, 12 aa, Mycobacterium
MTGDSDGKAPTA

SEQ ID NO: 527872 - protein, 4 aa, Mycobacterium
MTGE

SEQ ID NO: 527873 - protein, 9 aa, Mycobacterium
MTGEGMTAR

SEQ ID NO: 527874 - protein, 6 aa, Mycobacterium
MTGEPL

SEQ ID NO: 527875 - protein, 10 aa, Mycobacterium
MTGGAESLNV

SEQ ID NO: 527876 - protein, 5 aa, Mycobacterium
MTGGG

SEQ ID NO: 527877 - protein, 7 aa, Mycobacterium
MTGGQDV

SEQ ID NO: 527878 - protein, 9 aa, Mycobacterium
MTGGQQAVG

SEQ ID NO: 527879 - protein, 8 aa, Mycobacterium
MTGGQRAV

SEQ ID NO: 527880 - protein, 10 aa, Mycobacterium
MTGGRSNGLP

SEQ ID NO: 527881 - protein, 10 aa, Mycobacterium
MTGGSRGDIG

SEQ ID NO: 527882 - protein, 10 aa, Mycobacterium
MTGGTDPEYA

SEQ ID NO: 527883 - protein, 9 aa, Mycobacterium
MTGNEDPEY

SEQ ID NO: 527884 - protein, 13 aa, Mycobacterium
MTGNPHDITDEQV

SEQ ID NO: 527885 - protein, 8 aa, Mycobacterium
MTGPAPAE

SEQ ID NO: 527886 - protein, 6 aa, Mycobacterium
MTGPDA

SEQ ID NO: 527887 - protein, 9 aa, Mycobacterium
MTGPGDDPY

SEQ ID NO: 527888 - protein, 9 aa, Mycobacterium
MTGPGDETW

SEQ ID NO: 527889 - protein, 39 aa, Mycobacterium
MTGPPSAALAGTTLTDSVQPVAGAAAPPRPRWCRVPGRR

SEQ ID NO: 527890 - protein, 5 aa, Mycobacterium
MTGPR

SEQ ID NO: 527891 - protein, 9 aa, Mycobacterium
MTGPRDDPY

SEQ ID NO: 527892 - protein, 8 aa, Mycobacterium
MTGPRDEP

SEQ ID NO: 527893 - protein, 8 aa, Mycobacterium
MTGPSDDP

SEQ ID NO: 527894 - protein, 11 aa, Mycobacterium
MTGPSNTSQDV

SEQ ID NO: 527895 - protein, 10 aa, Mycobacterium
MTGQTSVASY

SEQ ID NO: 527896 - protein, 7 aa, Mycobacterium
MTGRGTD

SEQ ID NO: 527897 - protein, 9 aa, Mycobacterium
MTGRRRPDT

SEQ ID NO: 527898 - protein, 4 aa, Mycobacterium
MTGS

SEQ ID NO: 527899 - protein, 11 aa, Mycobacterium
MTGSEDPEYAD

SEQ ID NO: 527900 - protein, 6 aa, Mycobacterium
MTGTDA

SEQ ID NO: 527901 - protein, 11 aa, Mycobacterium
MTKPAESPVTA

SEQ ID NO: 527902 - protein, 10 aa, Mycobacterium
MTKPAESVAR

SEQ ID NO: 527903 - protein, 12 aa, Mycobacterium
MTKPGESATRAA

SEQ ID NO: 527904 - protein, 18 aa, Mycobacterium
MTLPSEANTQVAGGAPAQ

SEQ ID NO: 527905 - protein, 10 aa, Mycobacterium
MTLTEGAAAA

SEQ ID NO: 527906 - protein, 7 aa, Mycobacterium
MTMPPST

SEQ ID NO: 527907 - protein, 8 aa, Mycobacterium
MTNEETQD

SEQ ID NO: 527908 - protein, 7 aa, Mycobacterium
MTNGRTA

SEQ ID NO: 527909 - protein, 11 aa, Mycobacterium
MTNGTDKPRGF

SEQ ID NO: 527910 - protein, 4 aa, Mycobacterium
MTNN

SEQ ID NO: 527911 - protein, 6 aa, Mycobacterium
MTNSPV

SEQ ID NO: 527912 - protein, 4 aa, Mycobacterium
MTPA

SEQ ID NO: 527913 - protein, 5 aa, Mycobacterium
MTPAD

SEQ ID NO: 527914 - protein, 7 aa, Mycobacterium
MTPADAE

SEQ ID NO: 527915 - protein, 16 aa, Mycobacterium
MTPAGDDPERSDGEER

SEQ ID NO: 527916 - protein, 24 aa, Mycobacterium
MTPAPLSSTPAQVAEATARALARG

SEQ ID NO: 527917 - protein, 6 aa, Mycobacterium
MTPAQA

SEQ ID NO: 527918 - protein, 7 aa, Mycobacterium
MTPATDG

SEQ ID NO: 527919 - protein, 6 aa, Mycobacterium
MTPDER

SEQ ID NO: 527920 - protein, 9 aa, Mycobacterium
MTPDERRAA

SEQ ID NO: 527921 - protein, 5 aa, Mycobacterium
MTPEQ

SEQ ID NO: 527922 - protein, 6 aa, Mycobacterium
MTPGPG

SEQ ID NO: 527923 - protein, 5 aa, Mycobacterium
MTPPA

SEQ ID NO: 527924 - protein, 10 aa, Mycobacterium
MTPPERDTTV

SEQ ID NO: 527925 - protein, 12 aa, Mycobacterium
MTPPERQTTADG

SEQ ID NO: 527926 - protein, 17 aa, Mycobacterium
MTPPERRTTTDGFESQF

SEQ ID NO: 527927 - protein, 5 aa, Mycobacterium
MTPPP

SEQ ID NO: 527928 - protein, 12 aa, Mycobacterium
MTPPQRQQTRDG

SEQ ID NO: 527929 - protein, 11 aa, Mycobacterium
MTPPSIASPGW

SEQ ID NO: 527930 - protein, 20 aa, Mycobacterium
MTPQAASATMPSGQRYGGDD

SEQ ID NO: 527931 - protein, 6 aa, Mycobacterium
MTPQQA

SEQ ID NO: 527932 - protein, 8 aa, Mycobacterium
MTPQQRAD

SEQ ID NO: 527933 - protein, 8 aa, Mycobacterium
MTPQRGVG

SEQ ID NO: 527934 - protein, 7 aa, Mycobacterium
MTPRRDG

SEQ ID NO: 527935 - protein, 6 aa, Mycobacterium
MTPRSA

SEQ ID NO: 527936 - protein, 16 aa, Mycobacterium
MTPSGKIQKFKLREQY

SEQ ID NO: 527937 - protein, 5 aa, Mycobacterium
MTPTA

SEQ ID NO: 527938 - protein, 6 aa, Mycobacterium
MTPTEA

SEQ ID NO: 527939 - protein, 18 aa, Mycobacterium
MTPTQSTMPGMSGMSDED

SEQ ID NO: 527940 - protein, 21 aa, Mycobacterium
MTQAPGGKGGNQAVAAARAGA

SEQ ID NO: 527941 - protein, 7 aa, Mycobacterium
MTQEPGR

SEQ ID NO: 527942 - protein, 6 aa, Mycobacterium
MTQGAD

SEQ ID NO: 527943 - protein, 6 aa, Mycobacterium
MTQGRT

SEQ ID NO: 527944 - protein, 15 aa, Mycobacterium
MTQNHPSVPEELRGT

SEQ ID NO: 527945 - protein, 8 aa, Mycobacterium
MTQRRDEP

SEQ ID NO: 527946 - protein, 8 aa, Mycobacterium
MTQRRTQT

SEQ ID NO: 527947 - protein, 7 aa, Mycobacterium
MTQRSGQ

SEQ ID NO: 527948 - protein, 14 aa, Mycobacterium
MTQSTAQASSNTVS

SEQ ID NO: 527949 - protein, 12 aa, Mycobacterium
MTQTHPGIPEEL

SEQ ID NO: 527950 - protein, 10 aa, Mycobacterium
MTQTHPGVPE

SEQ ID NO: 527951 - protein, 11 aa, Mycobacterium
MTRGAGRRDVD

SEQ ID NO: 527952 - protein, 9 aa, Mycobacterium
MTRGAPPKS

SEQ ID NO: 527953 - protein, 11 aa, Mycobacterium
MTRGDDNKLGP

SEQ ID NO: 527954 - protein, 5 aa, Mycobacterium
MTRPR

SEQ ID NO: 527955 - protein, 19 aa, Mycobacterium
MTRSEQAAPTVAEQVDAKA

SEQ ID NO: 527956 - protein, 5 aa, Mycobacterium
MTRSP

SEQ ID NO: 527957 - protein, 5 aa, Mycobacterium
MTRST

SEQ ID NO: 527958 - protein, 4 aa, Mycobacterium
MTRT

SEQ ID NO: 527959 - protein, 5 aa, Mycobacterium
MTSDD

SEQ ID NO: 527960 - protein, 7 aa, Mycobacterium
MTSEDAA

SEQ ID NO: 527961 - protein, 6 aa, Mycobacterium
MTSGDA

SEQ ID NO: 527962 - protein, 6 aa, Mycobacterium
MTSGEE

SEQ ID NO: 527963 - protein, 8 aa, Mycobacterium
MTSGKTAK

SEQ ID NO: 527964 - protein, 11 aa, Mycobacterium
MTSGSNTSVRL

SEQ ID NO: 527965 - protein, 11 aa, Mycobacterium
MTSPEGRSKYA

SEQ ID NO: 527966 - protein, 5 aa, Mycobacterium
MTSPN

SEQ ID NO: 527967 - protein, 10 aa, Mycobacterium
MTSPVTDPAW

SEQ ID NO: 527968 - protein, 9 aa, Mycobacterium
MTSQRSTVN

SEQ ID NO: 527969 - protein, 9 aa, Mycobacterium
MTSRDLTEN

SEQ ID NO: 527970 - protein, 9 aa, Mycobacterium
MTSSATGRE

SEQ ID NO: 527971 - protein, 15 aa, Mycobacterium
MTSSQTERSPIEQPA

SEQ ID NO: 527972 - protein, 7 aa, Mycobacterium
MTSSSEL

SEQ ID NO: 527973 - protein, 20 aa, Mycobacterium
MTSSTDNTDDVVTYMGITKA

SEQ ID NO: 527974 - protein, 7 aa, Mycobacterium
MTSTSSV

SEQ ID NO: 527975 - protein, 11 aa, Mycobacterium
MTTDGTRRRHL

SEQ ID NO: 527976 - protein, 12 aa, Mycobacterium
MTTDPHAVTDEQ

SEQ ID NO: 527977 - protein, 14 aa, Mycobacterium
MTTDPHSVTDEQVE

SEQ ID NO: 527978 - protein, 12 aa, Mycobacterium
MTTDPHTVTDEQ

SEQ ID NO: 527979 - protein, 14 aa, Mycobacterium
MTTDPHTVTDEQVD

SEQ ID NO: 527980 - protein, 11 aa, Mycobacterium
MTTGDGQQTNV

SEQ ID NO: 527981 - protein, 6 aa, Mycobacterium
MTTGEE

SEQ ID NO: 527982 - protein, 24 aa, Mycobacterium
MTTPAESVAKAADLAENFASSRRS

SEQ ID NO: 527983 - protein, 9 aa, Mycobacterium
MTTPDTGET

SEQ ID NO: 527984 - protein, 8 aa, Mycobacterium
MTTPEGPQ

SEQ ID NO: 527985 - protein, 7 aa, Mycobacterium
MTTPGQR

SEQ ID NO: 527986 - protein, 11 aa, Mycobacterium
MTTPKGTTADG

SEQ ID NO: 527987 - protein, 14 aa, Mycobacterium
MTTPPWDTKAPKEN

SEQ ID NO: 527988 - protein, 12 aa, Mycobacterium
MTTQDRVTGERG

SEQ ID NO: 527989 - protein, 12 aa, Mycobacterium
MTTRPQQDIGRT

SEQ ID NO: 527990 - protein, 5 aa, Mycobacterium
MTTSS

SEQ ID NO: 527991 - protein, 5 aa, Mycobacterium
MTTTE

SEQ ID NO: 527992 - protein, 8 aa, Mycobacterium
MTYGDGDG

SEQ ID NO: 527993 - protein, 12 aa, Mycobacterium
MTYGEANATANR

SEQ ID NO: 527994 - protein, 4 aa, Mycobacterium
MVDD

SEQ ID NO: 527995 - protein, 9 aa, Mycobacterium
MVDPGDGTI

SEQ ID NO: 527996 - protein, 6 aa, Mycobacterium
MVGETK

SEQ ID NO: 527997 - protein, 150 aa, Mycobacterium
MVGNGGGGGTGGNGGNGGNGNAGGGPGIGGNGAEGGAGGSGGSSSGNGGAGGKGGSGGTGGAGQFGNTGGNGANGTFDNGGDGRGGAGGTGGTGGTGGDGGVGGNGGAGGKAISPTGQDGAQGAGGNGGAGGTGGNGGFGGSGGSGADGT

SEQ ID NO: 527998 - protein, 4 aa, Mycobacterium
MVPT

SEQ ID NO: 527999 - protein, 11 aa, Mycobacterium
MVPTGPDNPYG

SEQ ID NO: 528000 - protein, 10 aa, Mycobacterium
MVRDGTADEF

SEQ ID NO: 528001 - protein, 6 aa, Mycobacterium
MVRQDQ

SEQ ID NO: 528002 - protein, 30 aa, Mycobacterium
MVSGGGKKPYRQKGTGRARQGSTRAPQFTG

SEQ ID NO: 528003 - protein, 7 aa, Mycobacterium
MVTPTGQ

SEQ ID NO: 528004 - protein, 12 aa, Mycobacterium
MYETGAGGSAPK

SEQ ID NO: 528005 - protein, 19 aa, Mycobacterium
MYGADGKLKDTKAVNPEST

SEQ ID NO: 528006 - protein, 28 aa, Mycobacterium
MYPGPDGVVRSTNRAGGLEGGMTNGQPL

SEQ ID NO: 528007 - protein, 10 aa, Mycobacterium
MYSGPGAGSL

SEQ ID NO: 528008 - protein, 10 aa, Mycobacterium
MYSGPGPESL

SEQ ID NO: 528009 - protein, 9 aa, Mycobacterium
MYSGPGSAS

SEQ ID NO: 528010 - protein, 10 aa, Mycobacterium
MYSGPGSGPL

SEQ ID NO: 528011 - protein, 10 aa, Mycobacterium
MYSGPGSGSM

SEQ ID NO: 528012 - protein, 8 aa, Mycobacterium
MYTGPGAE

SEQ ID NO: 528013 - protein, 10 aa, Mycobacterium
MYTGPGAGPM

SEQ ID NO: 528014 - protein, 10 aa, Mycobacterium
MYTGPGPESM

SEQ ID NO: 528015 - protein, 14 aa, Mycobacterium
MYTGPGSASLRTAA

SEQ ID NO: 528016 - protein, 11 aa, Mycobacterium
MYTGPGSTPMV

SEQ ID NO: 528017 - protein, 10 aa, Mycobacterium
NAAAAGPTTG

SEQ ID NO: 528018 - protein, 10 aa, Mycobacterium
NAAAAGPTTS

SEQ ID NO: 528019 - protein, 8 aa, Mycobacterium
NAAAAIPT

SEQ ID NO: 528020 - protein, 9 aa, Mycobacterium
NAAAALPTT

SEQ ID NO: 528021 - protein, 7 aa, Mycobacterium
NAAAAQE

SEQ ID NO: 528022 - protein, 23 aa, Mycobacterium
NAAAAQGTSSVGRKGGKARSYPD

SEQ ID NO: 528023 - protein, 13 aa, Mycobacterium
NAAADADGPVATT

SEQ ID NO: 528024 - protein, 12 aa, Mycobacterium
NAAADAGRNPDD

SEQ ID NO: 528025 - protein, 7 aa, Mycobacterium
NAAADEK

SEQ ID NO: 528026 - protein, 11 aa, Mycobacterium
NAAADTGGPLA

SEQ ID NO: 528027 - protein, 19 aa, Mycobacterium
NAAAEETASVGGGQDQEAL

SEQ ID NO: 528028 - protein, 7 aa, Mycobacterium
NAAAESV

SEQ ID NO: 528029 - protein, 8 aa, Mycobacterium
NAAAGAER

SEQ ID NO: 528030 - protein, 27 aa, Mycobacterium
NAAAGPSDAVATELEASAGRAQTRGGI

SEQ ID NO: 528031 - protein, 9 aa, Mycobacterium
NAAAGQPVP

SEQ ID NO: 528032 - protein, 20 aa, Mycobacterium
NAAAGRPDDAPMEPGQPVSD

SEQ ID NO: 528033 - protein, 6 aa, Mycobacterium
NAAAGT

SEQ ID NO: 528034 - protein, 9 aa, Mycobacterium
NAAALPADP

SEQ ID NO: 528035 - protein, 20 aa, Mycobacterium
NAAANADGPLATTGLYPPGS

SEQ ID NO: 528036 - protein, 12 aa, Mycobacterium
NAAAQAAAIPTT

SEQ ID NO: 528037 - protein, 13 aa, Mycobacterium
NAAAQAKKAVEQN

SEQ ID NO: 528038 - protein, 7 aa, Mycobacterium
NAAARAG

SEQ ID NO: 528039 - protein, 5 aa, Mycobacterium
NAAAS

SEQ ID NO: 528040 - protein, 6 aa, Mycobacterium
NAAASR

SEQ ID NO: 528041 - protein, 7 aa, Mycobacterium
NAAAWPA

SEQ ID NO: 528042 - protein, 19 aa, Mycobacterium
NAADPGTASAIASAANNHA

SEQ ID NO: 528043 - protein, 9 aa, Mycobacterium
NAADPHNPT

SEQ ID NO: 528044 - protein, 11 aa, Mycobacterium
NAADPPPGPRA

SEQ ID NO: 528045 - protein, 9 aa, Mycobacterium
NAADSADVG

SEQ ID NO: 528046 - protein, 10 aa, Mycobacterium
NAADSSRTTA

SEQ ID NO: 528047 - protein, 15 aa, Mycobacterium
NAADTSTPAVDDLDD

SEQ ID NO: 528048 - protein, 6 aa, Mycobacterium
NAADVT

SEQ ID NO: 528049 - protein, 4 aa, Mycobacterium
NAAE

SEQ ID NO: 528050 - protein, 9 aa, Mycobacterium
NAAEKSRVE

SEQ ID NO: 528051 - protein, 8 aa, Mycobacterium
NAAENPRD

SEQ ID NO: 528052 - protein, 8 aa, Mycobacterium
NAAEPELA

SEQ ID NO: 528053 - protein, 15 aa, Mycobacterium
NAAEPEPDAEDVPDT

SEQ ID NO: 528054 - protein, 7 aa, Mycobacterium
NAAEQGR

SEQ ID NO: 528055 - protein, 9 aa, Mycobacterium
NAAERGAQL

SEQ ID NO: 528056 - protein, 7 aa, Mycobacterium
NAAERRT

SEQ ID NO: 528057 - protein, 21 aa, Mycobacterium
NAAETAPASAAAVEADAEVAD

SEQ ID NO: 528058 - protein, 6 aa, Mycobacterium
NAAGDR

SEQ ID NO: 528059 - protein, 8 aa, Mycobacterium
NAAGDTGK

SEQ ID NO: 528060 - protein, 6 aa, Mycobacterium
NAAGDV

SEQ ID NO: 528061 - protein, 7 aa, Mycobacterium
NAAGGAV

SEQ ID NO: 528062 - protein, 6 aa, Mycobacterium
NAAGGH

SEQ ID NO: 528063 - protein, 32 aa, Mycobacterium
NAAGGKADSAALDVGDRDAAVAAAERAAALGQ

SEQ ID NO: 528064 - protein, 5 aa, Mycobacterium
NAAGI

SEQ ID NO: 528065 - protein, 8 aa, Mycobacterium
NAAGITGS

SEQ ID NO: 528066 - protein, 7 aa, Mycobacterium
NAAGPAL

SEQ ID NO: 528067 - protein, 11 aa, Mycobacterium
NAAGPAPEDSV

SEQ ID NO: 528068 - protein, 5 aa, Mycobacterium
NAAGQ

SEQ ID NO: 528069 - protein, 12 aa, Mycobacterium
NAAGQAKKAVEQ

SEQ ID NO: 528070 - protein, 15 aa, Mycobacterium
NAAGQAYANGWGQSL

SEQ ID NO: 528071 - protein, 6 aa, Mycobacterium
NAAGRA

SEQ ID NO: 528072 - protein, 12 aa, Mycobacterium
NAAGRGPDQGPL

SEQ ID NO: 528073 - protein, 8 aa, Mycobacterium
NAAGRPVR

SEQ ID NO: 528074 - protein, 9 aa, Mycobacterium
NAAGRSADD

SEQ ID NO: 528075 - protein, 10 aa, Mycobacterium
NAAGSDDVDA

SEQ ID NO: 528076 - protein, 18 aa, Mycobacterium
NAAGTEAMTRAEGSAGHP

SEQ ID NO: 528077 - protein, 10 aa, Mycobacterium
NAAGTESMTR

SEQ ID NO: 528078 - protein, 7 aa, Mycobacterium
NAAGTSV

SEQ ID NO: 528079 - protein, 8 aa, Mycobacterium
NAAGVGKG

SEQ ID NO: 528080 - protein, 13 aa, Mycobacterium
NAAHEAGNAEITP

SEQ ID NO: 528081 - protein, 13 aa, Mycobacterium
NAAHEAGNGEITP

SEQ ID NO: 528082 - protein, 13 aa, Mycobacterium
NAAHGGRSDPTLV

SEQ ID NO: 528083 - protein, 9 aa, Mycobacterium
NAAHPGLTK

SEQ ID NO: 528084 - protein, 13 aa, Mycobacterium
NAAHQGANDEITP

SEQ ID NO: 528085 - protein, 8 aa, Mycobacterium
NAAHSDPA

SEQ ID NO: 528086 - protein, 5 aa, Mycobacterium
NAAHT

SEQ ID NO: 528087 - protein, 7 aa, Mycobacterium
NAAKTPV

SEQ ID NO: 528088 - protein, 4 aa, Mycobacterium
NAAL

SEQ ID NO: 528089 - protein, 13 aa, Mycobacterium
NAANAAAAAPTTT

SEQ ID NO: 528090 - protein, 12 aa, Mycobacterium
NAANGPDETVAT

SEQ ID NO: 528091 - protein, 7 aa, Mycobacterium
NAANLGG

SEQ ID NO: 528092 - protein, 7 aa, Mycobacterium
NAANTQL

SEQ ID NO: 528093 - protein, 12 aa, Mycobacterium
NAANTQLRHGGG

SEQ ID NO: 528094 - protein, 8 aa, Mycobacterium
NAANTTLR

SEQ ID NO: 528095 - protein, 4 aa, Mycobacterium
NAAP

SEQ ID NO: 528096 - protein, 15 aa, Mycobacterium
NAAPDAEVRATAKRA

SEQ ID NO: 528097 - protein, 9 aa, Mycobacterium
NAAPDPEVR

SEQ ID NO: 528098 - protein, 10 aa, Mycobacterium
NAAPDPEVRA

SEQ ID NO: 528099 - protein, 6 aa, Mycobacterium
NAAPDR

SEQ ID NO: 528100 - protein, 11 aa, Mycobacterium
NAAPDSKPAVI

SEQ ID NO: 528101 - protein, 13 aa, Mycobacterium
NAAPDSKPSVIGE

SEQ ID NO: 528102 - protein, 20 aa, Mycobacterium
NAAPESGEPGAAVTSIAAPN

SEQ ID NO: 528103 - protein, 10 aa, Mycobacterium
NAAPESGPGA

SEQ ID NO: 528104 - protein, 8 aa, Mycobacterium
NAAPGGAD

SEQ ID NO: 528105 - protein, 9 aa, Mycobacterium
NAAPGQPVP

SEQ ID NO: 528106 - protein, 6 aa, Mycobacterium
NAAPLT

SEQ ID NO: 528107 - protein, 5 aa, Mycobacterium
NAAPR

SEQ ID NO: 528108 - protein, 5 aa, Mycobacterium
NAAPT

SEQ ID NO: 528109 - protein, 9 aa, Mycobacterium
NAAPTNVAD

SEQ ID NO: 528110 - protein, 28 aa, Mycobacterium
NAAPTPSLRNTAKRAINDVRRGVVAVDA

SEQ ID NO: 528111 - protein, 7 aa, Mycobacterium
NAAPTVK

SEQ ID NO: 528112 - protein, 15 aa, Mycobacterium
NAAQGMTAGRRDIEG

SEQ ID NO: 528113 - protein, 7 aa, Mycobacterium
NAAQGTR

SEQ ID NO: 528114 - protein, 5 aa, Mycobacterium
NAAQL

SEQ ID NO: 528115 - protein, 11 aa, Mycobacterium
NAARAAGASYA

SEQ ID NO: 528116 - protein, 9 aa, Mycobacterium
NAARASKAT

SEQ ID NO: 528117 - protein, 12 aa, Mycobacterium
NAARCGAGDADR

SEQ ID NO: 528118 - protein, 8 aa, Mycobacterium
NAARDRVG

SEQ ID NO: 528119 - protein, 9 aa, Mycobacterium
NAAREGNSS

SEQ ID NO: 528120 - protein, 9 aa, Mycobacterium
NAARMRSSA

SEQ ID NO: 528121 - protein, 19 aa, Mycobacterium
NAARPTTSASLTRISGQIS

SEQ ID NO: 528122 - protein, 6 aa, Mycobacterium
NAARQA

SEQ ID NO: 528123 - protein, 10 aa, Mycobacterium
NAARRAREHR

SEQ ID NO: 528124 - protein, 12 aa, Mycobacterium
NAARRETSCRGE

SEQ ID NO: 528125 - protein, 6 aa, Mycobacterium
NAARRV

SEQ ID NO: 528126 - protein, 5 aa, Mycobacterium
NAART

SEQ ID NO: 528127 - protein, 8 aa, Mycobacterium
NAARTQAR

SEQ ID NO: 528128 - protein, 4 aa, Mycobacterium
NAAS

SEQ ID NO: 528129 - protein, 10 aa, Mycobacterium
NAASDAGRFN

SEQ ID NO: 528130 - protein, 9 aa, Mycobacterium
NAASDPHDN

SEQ ID NO: 528131 - protein, 11 aa, Mycobacterium
NAASEQARSKL

SEQ ID NO: 528132 - protein, 8 aa, Mycobacterium
NAASGGTY

SEQ ID NO: 528133 - protein, 6 aa, Mycobacterium
NAASHG

SEQ ID NO: 528134 - protein, 9 aa, Mycobacterium
NAASLGPLS

SEQ ID NO: 528135 - protein, 7 aa, Mycobacterium
NAASQVN

SEQ ID NO: 528136 - protein, 14 aa, Mycobacterium
NAASRAEALDLILR

SEQ ID NO: 528137 - protein, 7 aa, Mycobacterium
NAASRAG

SEQ ID NO: 528138 - protein, 14 aa, Mycobacterium
NAASRSEALDLILR

SEQ ID NO: 528139 - protein, 5 aa, Mycobacterium
NAASS

SEQ ID NO: 528140 - protein, 9 aa, Mycobacterium
NAASSALAP

SEQ ID NO: 528141 - protein, 6 aa, Mycobacterium
NAASVT

SEQ ID NO: 528142 - protein, 13 aa, Mycobacterium
NAATAAAAAPTTG

SEQ ID NO: 528143 - protein, 19 aa, Mycobacterium
NAATAEKDAEFRANATAKE

SEQ ID NO: 528144 - protein, 21 aa, Mycobacterium
NAATAEKDAELQANAKAKEGL

SEQ ID NO: 528145 - protein, 21 aa, Mycobacterium
NAATAEKDAELRANAEAKESL

SEQ ID NO: 528146 - protein, 10 aa, Mycobacterium
NAATESQRGN

SEQ ID NO: 528147 - protein, 8 aa, Mycobacterium
NAATGAAL

SEQ ID NO: 528148 - protein, 8 aa, Mycobacterium
NAATGDEV

SEQ ID NO: 528149 - protein, 9 aa, Mycobacterium
NAATGGHGN

SEQ ID NO: 528150 - protein, 6 aa, Mycobacterium
NAATGS

SEQ ID NO: 528151 - protein, 7 aa, Mycobacterium
NAATGYD

SEQ ID NO: 528152 - protein, 7 aa, Mycobacterium
NAATNSL

SEQ ID NO: 528153 - protein, 8 aa, Mycobacterium
NAATRRGV

SEQ ID NO: 528154 - protein, 9 aa, Mycobacterium
NAATSMTTG

SEQ ID NO: 528155 - protein, 4 aa, Mycobacterium
NAAY

SEQ ID NO: 528156 - protein, 6 aa, Mycobacterium
NAAYGA

SEQ ID NO: 528157 - protein, 6 aa, Mycobacterium
NAAYQA

SEQ ID NO: 528158 - protein, 5 aa, Mycobacterium
NAAYS

SEQ ID NO: 528159 - protein, 7 aa, Mycobacterium
NAAYSAA

SEQ ID NO: 528160 - protein, 5 aa, Mycobacterium
NAAYT

SEQ ID NO: 528161 - protein, 8 aa, Mycobacterium
NACGANDG

SEQ ID NO: 528162 - protein, 11 aa, Mycobacterium
NACGANDGAAA

SEQ ID NO: 528163 - protein, 8 aa, Mycobacterium
NADAADMD

SEQ ID NO: 528164 - protein, 5 aa, Mycobacterium
NADAE

SEQ ID NO: 528165 - protein, 9 aa, Mycobacterium
NADAEPAVT

SEQ ID NO: 528166 - protein, 11 aa, Mycobacterium
NADAHAGHTET

SEQ ID NO: 528167 - protein, 8 aa, Mycobacterium
NADAHELG

SEQ ID NO: 528168 - protein, 12 aa, Mycobacterium
NADATLEEAQEN

SEQ ID NO: 528169 - protein, 6 aa, Mycobacterium
NADDAG

SEQ ID NO: 528170 - protein, 21 aa, Mycobacterium
NADDDLSRQPSRFRGDRNREV

SEQ ID NO: 528171 - protein, 6 aa, Mycobacterium
NADDDV

SEQ ID NO: 528172 - protein, 8 aa, Mycobacterium
NADDERLP

SEQ ID NO: 528173 - protein, 5 aa, Mycobacterium
NADDS

SEQ ID NO: 528174 - protein, 13 aa, Mycobacterium
NADDTAFAGDPAK

SEQ ID NO: 528175 - protein, 4 aa, Mycobacterium
NADE

SEQ ID NO: 528176 - protein, 23 aa, Mycobacterium
NADEDEAAESISESDADTAESPE

SEQ ID NO: 528177 - protein, 19 aa, Mycobacterium
NADEGDADPDEDAAGTTAG

SEQ ID NO: 528178 - protein, 5 aa, Mycobacterium
NADEL

SEQ ID NO: 528179 - protein, 7 aa, Mycobacterium
NADELSG

SEQ ID NO: 528180 - protein, 9 aa, Mycobacterium
NADENTTVP

SEQ ID NO: 528181 - protein, 10 aa, Mycobacterium
NADERDASEA

SEQ ID NO: 528182 - protein, 6 aa, Mycobacterium
NADGAP

SEQ ID NO: 528183 - protein, 13 aa, Mycobacterium
NADGGADVVNGRE

SEQ ID NO: 528184 - protein, 13 aa, Mycobacterium
NADGGAGGAGGNG

SEQ ID NO: 528185 - protein, 7 aa, Mycobacterium
NADGGEA

SEQ ID NO: 528186 - protein, 13 aa, Mycobacterium
NADGGSPASDGFN

SEQ ID NO: 528187 - protein, 9 aa, Mycobacterium
NADGKEVAG

SEQ ID NO: 528188 - protein, 14 aa, Mycobacterium
NADGPTSDAESGHF

SEQ ID NO: 528189 - protein, 7 aa, Mycobacterium
NADGPVL

SEQ ID NO: 528190 - protein, 13 aa, Mycobacterium
NADGQPVASAADA

SEQ ID NO: 528191 - protein, 9 aa, Mycobacterium
NADGSTAQM

SEQ ID NO: 528192 - protein, 6 aa, Mycobacterium
NADGSV

SEQ ID NO: 528193 - protein, 6 aa, Mycobacterium
NADGTL

SEQ ID NO: 528194 - protein, 88 aa, Mycobacterium
NADGTPCSDIGTAGPGGATGQIPGGPGGTAGPGGASGAIPGGPGGAAGPDGATGSIPGGPAGTAGPDGATGVIPGGPGGTAGPGGASG

SEQ ID NO: 528195 - protein, 7 aa, Mycobacterium
NADGYGL

SEQ ID NO: 528196 - protein, 9 aa, Mycobacterium
NADHADAAA

SEQ ID NO: 528197 - protein, 6 aa, Mycobacterium
NADKAA

SEQ ID NO: 528198 - protein, 6 aa, Mycobacterium
NADKPY

SEQ ID NO: 528199 - protein, 12 aa, Mycobacterium
NADNRANLTIST

SEQ ID NO: 528200 - protein, 7 aa, Mycobacterium
NADPAPI

SEQ ID NO: 528201 - protein, 7 aa, Mycobacterium
NADPASV

SEQ ID NO: 528202 - protein, 5 aa, Mycobacterium
NADPD

SEQ ID NO: 528203 - protein, 19 aa, Mycobacterium
NADPDAQSRRIETEKVTRV

SEQ ID NO: 528204 - protein, 6 aa, Mycobacterium
NADPDL

SEQ ID NO: 528205 - protein, 7 aa, Mycobacterium
NADPDRL

SEQ ID NO: 528206 - protein, 9 aa, Mycobacterium
NADPDSLED

SEQ ID NO: 528207 - protein, 6 aa, Mycobacterium
NADPDV

SEQ ID NO: 528208 - protein, 6 aa, Mycobacterium
NADPER

SEQ ID NO: 528209 - protein, 11 aa, Mycobacterium
NADPNADEDTR

SEQ ID NO: 528210 - protein, 25 aa, Mycobacterium
NADPNASAESLDEAQAKIKAALTQI

SEQ ID NO: 528211 - protein, 6 aa, Mycobacterium
NADPRG

SEQ ID NO: 528212 - protein, 6 aa, Mycobacterium
NADPSW

SEQ ID NO: 528213 - protein, 6 aa, Mycobacterium
NADPTR

SEQ ID NO: 528214 - protein, 9 aa, Mycobacterium
NADQPNGDT

SEQ ID NO: 528215 - protein, 14 aa, Mycobacterium
NADQTAPEDPREAL

SEQ ID NO: 528216 - protein, 7 aa, Mycobacterium
NADQTFD

SEQ ID NO: 528217 - protein, 6 aa, Mycobacterium
NADQVG

SEQ ID NO: 528218 - protein, 6 aa, Mycobacterium
NADRAQ

SEQ ID NO: 528219 - protein, 7 aa, Mycobacterium
NADRKGG

SEQ ID NO: 528220 - protein, 8 aa, Mycobacterium
NADRKGGH

SEQ ID NO: 528221 - protein, 9 aa, Mycobacterium
NADRSGPLG

SEQ ID NO: 528222 - protein, 4 aa, Mycobacterium
NADS

SEQ ID NO: 528223 - protein, 6 aa, Mycobacterium
NADSDI

SEQ ID NO: 528224 - protein, 11 aa, Mycobacterium
NADSDVAGTQT

SEQ ID NO: 528225 - protein, 11 aa, Mycobacterium
NADSGEMPNTV

SEQ ID NO: 528226 - protein, 7 aa, Mycobacterium
NADSGPA

SEQ ID NO: 528227 - protein, 8 aa, Mycobacterium
NADSIADG

SEQ ID NO: 528228 - protein, 8 aa, Mycobacterium
NADSRGVE

SEQ ID NO: 528229 - protein, 10 aa, Mycobacterium
NADTELADGE

SEQ ID NO: 528230 - protein, 7 aa, Mycobacterium
NADTGEI

SEQ ID NO: 528231 - protein, 11 aa, Mycobacterium
NADTIEEAAEA

SEQ ID NO: 528232 - protein, 11 aa, Mycobacterium
NADTIEQAAEA

SEQ ID NO: 528233 - protein, 17 aa, Mycobacterium
NADTSAALPRPATGDEL

SEQ ID NO: 528234 - protein, 11 aa, Mycobacterium
NADTSGGGGIG

SEQ ID NO: 528235 - protein, 8 aa, Mycobacterium
NADTSVAM

SEQ ID NO: 528236 - protein, 10 aa, Mycobacterium
NADTTRTGSW

SEQ ID NO: 528237 - protein, 8 aa, Mycobacterium
NAEAAAAL

SEQ ID NO: 528238 - protein, 9 aa, Mycobacterium
NAEAAAALR

SEQ ID NO: 528239 - protein, 7 aa, Mycobacterium
NAEAAQR

SEQ ID NO: 528240 - protein, 21 aa, Mycobacterium
NAEAGDSTDEVETDPDATDEE

SEQ ID NO: 528241 - protein, 24 aa, Mycobacterium
NAEALDPEDLEKESVKVRKPAPKK

SEQ ID NO: 528242 - protein, 6 aa, Mycobacterium
NAEALT

SEQ ID NO: 528243 - protein, 19 aa, Mycobacterium
NAEANADEAVEEVEGAESE

SEQ ID NO: 528244 - protein, 9 aa, Mycobacterium
NAEARRTGG

SEQ ID NO: 528245 - protein, 8 aa, Mycobacterium
NAEATQEA

SEQ ID NO: 528246 - protein, 5 aa, Mycobacterium
NAEAV

SEQ ID NO: 528247 - protein, 6 aa, Mycobacterium
NAECSP

SEQ ID NO: 528248 - protein, 5 aa, Mycobacterium
NAEDF

SEQ ID NO: 528249 - protein, 9 aa, Mycobacterium
NAEDLDEPA

SEQ ID NO: 528250 - protein, 10 aa, Mycobacterium
NAEDLGGGDI

SEQ ID NO: 528251 - protein, 12 aa, Mycobacterium
NAEDNSGSWPAS

SEQ ID NO: 528252 - protein, 7 aa, Mycobacterium
NAEDPKL

SEQ ID NO: 528253 - protein, 7 aa, Mycobacterium
NAEDPKV

SEQ ID NO: 528254 - protein, 6 aa, Mycobacterium
NAEEFR

SEQ ID NO: 528255 - protein, 11 aa, Mycobacterium
NAEEIAAASDR

SEQ ID NO: 528256 - protein, 20 aa, Mycobacterium
NAEENADEAVAEATDTDESS

SEQ ID NO: 528257 - protein, 20 aa, Mycobacterium
NAEENADEVVEEAEGAAESD

SEQ ID NO: 528258 - protein, 19 aa, Mycobacterium
NAEESEEAIGETDDGNGSG

SEQ ID NO: 528259 - protein, 7 aa, Mycobacterium
NAEGAEA

SEQ ID NO: 528260 - protein, 8 aa, Mycobacterium
NAEGAERV

SEQ ID NO: 528261 - protein, 7 aa, Mycobacterium
NAEGESA

SEQ ID NO: 528262 - protein, 7 aa, Mycobacterium
NAEGGEA

SEQ ID NO: 528263 - protein, 14 aa, Mycobacterium
NAEHGDVAAADDGL

SEQ ID NO: 528264 - protein, 13 aa, Mycobacterium
NAEHSSSGLRSAE

SEQ ID NO: 528265 - protein, 6 aa, Mycobacterium
NAEHTG

SEQ ID NO: 528266 - protein, 12 aa, Mycobacterium
NAEHTSTGLRSA

SEQ ID NO: 528267 - protein, 13 aa, Mycobacterium
NAEHTSTGLRSAE

SEQ ID NO: 528268 - protein, 16 aa, Mycobacterium
NAEIPGVGPSESEVGP

SEQ ID NO: 528269 - protein, 7 aa, Mycobacterium
NAEKAQG

SEQ ID NO: 528270 - protein, 10 aa, Mycobacterium
NAEKDTSQWV

SEQ ID NO: 528271 - protein, 12 aa, Mycobacterium
NAEKGKAAAEAI

SEQ ID NO: 528272 - protein, 9 aa, Mycobacterium
NAEKGKHRH

SEQ ID NO: 528273 - protein, 10 aa, Mycobacterium
NAEKGNANSF

SEQ ID NO: 528274 - protein, 21 aa, Mycobacterium
NAEKLSGAPQYDAGKPPRAGN

SEQ ID NO: 528275 - protein, 6 aa, Mycobacterium
NAELDE

SEQ ID NO: 528276 - protein, 9 aa, Mycobacterium
NAENGDPAR

SEQ ID NO: 528277 - protein, 7 aa, Mycobacterium
NAENGGG

SEQ ID NO: 528278 - protein, 5 aa, Mycobacterium
NAEPA

SEQ ID NO: 528279 - protein, 8 aa, Mycobacterium
NAEPGQDC

SEQ ID NO: 528280 - protein, 13 aa, Mycobacterium
NAEQAGATGPLPA

SEQ ID NO: 528281 - protein, 10 aa, Mycobacterium
NAEQAGPGSV

SEQ ID NO: 528282 - protein, 14 aa, Mycobacterium
NAEQAGVSGPLPDV

SEQ ID NO: 528283 - protein, 5 aa, Mycobacterium
NAEQQ

SEQ ID NO: 528284 - protein, 9 aa, Mycobacterium
NAERAHTAS

SEQ ID NO: 528285 - protein, 12 aa, Mycobacterium
NAERATDWRGNN

SEQ ID NO: 528286 - protein, 13 aa, Mycobacterium
NAERATDWRGNNN

SEQ ID NO: 528287 - protein, 6 aa, Mycobacterium
NAERIR

SEQ ID NO: 528288 - protein, 9 aa, Mycobacterium
NAERRGVPP

SEQ ID NO: 528289 - protein, 7 aa, Mycobacterium
NAERSPT

SEQ ID NO: 528290 - protein, 12 aa, Mycobacterium
NAERTGEGPPRL

SEQ ID NO: 528291 - protein, 13 aa, Mycobacterium
NAERVGGTQSSWG

SEQ ID NO: 528292 - protein, 10 aa, Mycobacterium
NAESAHEART

SEQ ID NO: 528293 - protein, 9 aa, Mycobacterium
NAESASRDA

SEQ ID NO: 528294 - protein, 7 aa, Mycobacterium
NAESPER

SEQ ID NO: 528295 - protein, 18 aa, Mycobacterium
NAESQAQVAATARRAEDL

SEQ ID NO: 528296 - protein, 10 aa, Mycobacterium
NAESSLNGPV

SEQ ID NO: 528297 - protein, 17 aa, Mycobacterium
NAESVDSTAATAPASAH

SEQ ID NO: 528298 - protein, 4 aa, Mycobacterium
NAET

SEQ ID NO: 528299 - protein, 15 aa, Mycobacterium
NAETAKALAGGGPKY

SEQ ID NO: 528300 - protein, 10 aa, Mycobacterium
NAETELPDGQ

SEQ ID NO: 528301 - protein, 7 aa, Mycobacterium
NAETNAR

SEQ ID NO: 528302 - protein, 6 aa, Mycobacterium
NAETYD

SEQ ID NO: 528303 - protein, 5 aa, Mycobacterium
NAEVG

SEQ ID NO: 528304 - protein, 6 aa, Mycobacterium
NAEVSG

SEQ ID NO: 528305 - protein, 7 aa, Mycobacterium
NAEVSGP

SEQ ID NO: 528306 - protein, 5 aa, Mycobacterium
NAEVT

SEQ ID NO: 528307 - protein, 6 aa, Mycobacterium
NAEWND

SEQ ID NO: 528308 - protein, 5 aa, Mycobacterium
NAEYH

SEQ ID NO: 528309 - protein, 9 aa, Mycobacterium
NAFDEQTEE

SEQ ID NO: 528310 - protein, 10 aa, Mycobacterium
NAFDKTDNRV

SEQ ID NO: 528311 - protein, 7 aa, Mycobacterium
NAFEDPA

SEQ ID NO: 528312 - protein, 8 aa, Mycobacterium
NAFEDPAE

SEQ ID NO: 528313 - protein, 7 aa, Mycobacterium
NAFGANK

SEQ ID NO: 528314 - protein, 8 aa, Mycobacterium
NAFGEDPI

SEQ ID NO: 528315 - protein, 9 aa, Mycobacterium
NAFGEPPTA

SEQ ID NO: 528316 - protein, 11 aa, Mycobacterium
NAFGPPRDRDE

SEQ ID NO: 528317 - protein, 5 aa, Mycobacterium
NAFGS

SEQ ID NO: 528318 - protein, 12 aa, Mycobacterium
NAFHNPDDPLQL

SEQ ID NO: 528319 - protein, 10 aa, Mycobacterium
NAFHSPDDPL

SEQ ID NO: 528320 - protein, 12 aa, Mycobacterium
NAFHSPDDPLQL

SEQ ID NO: 528321 - protein, 7 aa, Mycobacterium
NAFQDQA

SEQ ID NO: 528322 - protein, 8 aa, Mycobacterium
NAFSGDAR

SEQ ID NO: 528323 - protein, 12 aa, Mycobacterium
NAFTPEALTPKA

SEQ ID NO: 528324 - protein, 11 aa, Mycobacterium
NAGAARGEDPL

SEQ ID NO: 528325 - protein, 7 aa, Mycobacterium
NAGAEDQ

SEQ ID NO: 528326 - protein, 8 aa, Mycobacterium
NAGAEEAV

SEQ ID NO: 528327 - protein, 8 aa, Mycobacterium
NAGAELPQ

SEQ ID NO: 528328 - protein, 12 aa, Mycobacterium
NAGAGGAGGAGQ

SEQ ID NO: 528329 - protein, 19 aa, Mycobacterium
NAGAGGNGGVGGDGNAADH

SEQ ID NO: 528330 - protein, 37 aa, Mycobacterium
NAGAGGNGGVGGDGNAADNGLVGGTGGVGGAGGSAGL

SEQ ID NO: 528331 - protein, 36 aa, Mycobacterium
NAGAGGNGGVGGDGNAADSGLVGGAGGVGGAGGAAG

SEQ ID NO: 528332 - protein, 14 aa, Mycobacterium
NAGAGNFGAGNSGL

SEQ ID NO: 528333 - protein, 20 aa, Mycobacterium
NAGAGNNGTANMGAGNFGTG

SEQ ID NO: 528334 - protein, 6 aa, Mycobacterium
NAGAMG

SEQ ID NO: 528335 - protein, 5 aa, Mycobacterium
NAGAN

SEQ ID NO: 528336 - protein, 13 aa, Mycobacterium
NAGANADGPIATT

SEQ ID NO: 528337 - protein, 16 aa, Mycobacterium
NAGANNIGFGNSGNNN

SEQ ID NO: 528338 - protein, 6 aa, Mycobacterium
NAGANV

SEQ ID NO: 528339 - protein, 9 aa, Mycobacterium
NAGAPWDPL

SEQ ID NO: 528340 - protein, 9 aa, Mycobacterium
NAGAQVEDD

SEQ ID NO: 528341 - protein, 17 aa, Mycobacterium
NAGATPDSLNNKKKPRT

SEQ ID NO: 528342 - protein, 6 aa, Mycobacterium
NAGATV

SEQ ID NO: 528343 - protein, 4 aa, Mycobacterium
NAGD

SEQ ID NO: 528344 - protein, 10 aa, Mycobacterium
NAGDAQHGAD

SEQ ID NO: 528345 - protein, 5 aa, Mycobacterium
NAGDE

SEQ ID NO: 528346 - protein, 7 aa, Mycobacterium
NAGDEPA

SEQ ID NO: 528347 - protein, 8 aa, Mycobacterium
NAGDEVRR

SEQ ID NO: 528348 - protein, 10 aa, Mycobacterium
NAGDIDTAVN

SEQ ID NO: 528349 - protein, 5 aa, Mycobacterium
NAGDK

SEQ ID NO: 528350 - protein, 9 aa, Mycobacterium
NAGDTGEAL

SEQ ID NO: 528351 - protein, 8 aa, Mycobacterium
NAGDTGEV

SEQ ID NO: 528352 - protein, 8 aa, Mycobacterium
NAGDTNTG

SEQ ID NO: 528353 - protein, 12 aa, Mycobacterium
NAGEADAPSPRQ

SEQ ID NO: 528354 - protein, 8 aa, Mycobacterium
NAGEALGD

SEQ ID NO: 528355 - protein, 20 aa, Mycobacterium
NAGEFNAGSFNSGNHNTGHF

SEQ ID NO: 528356 - protein, 8 aa, Mycobacterium
NAGEQLPP

SEQ ID NO: 528357 - protein, 6 aa, Mycobacterium
NAGETF

SEQ ID NO: 528358 - protein, 7 aa, Mycobacterium
NAGEVSA

SEQ ID NO: 528359 - protein, 6 aa, Mycobacterium
NAGFSD

SEQ ID NO: 528360 - protein, 6 aa, Mycobacterium
NAGFTD

SEQ ID NO: 528361 - protein, 4 aa, Mycobacterium
NAGG

SEQ ID NO: 528362 - protein, 12 aa, Mycobacterium
NAGGAIPPPPGY

SEQ ID NO: 528363 - protein, 7 aa, Mycobacterium
NAGGAKG

SEQ ID NO: 528364 - protein, 14 aa, Mycobacterium
NAGGAKGLAPVSDA

SEQ ID NO: 528365 - protein, 12 aa, Mycobacterium
NAGGAKGLEPVA

SEQ ID NO: 528366 - protein, 7 aa, Mycobacterium
NAGGARD

SEQ ID NO: 528367 - protein, 14 aa, Mycobacterium
NAGGARGLAPVADS

SEQ ID NO: 528368 - protein, 11 aa, Mycobacterium
NAGGARGLEPV

SEQ ID NO: 528369 - protein, 15 aa, Mycobacterium
NAGGARGLESISDAD

SEQ ID NO: 528370 - protein, 19 aa, Mycobacterium
NAGGDRLAEQAEADPAARQ

SEQ ID NO: 528371 - protein, 16 aa, Mycobacterium
NAGGFNQGLANSGNNN

SEQ ID NO: 528372 - protein, 9 aa, Mycobacterium
NAGGGATKP

SEQ ID NO: 528373 - protein, 6 aa, Mycobacterium
NAGGGD

SEQ ID NO: 528374 - protein, 7 aa, Mycobacterium
NAGGGFP

SEQ ID NO: 528375 - protein, 32 aa, Mycobacterium
NAGGGIVAESDPDDEVDETTTKFRTILTGLGV

SEQ ID NO: 528376 - protein, 16 aa, Mycobacterium
NAGGGTFAATEDTTDD

SEQ ID NO: 528377 - protein, 6 aa, Mycobacterium
NAGGKA

SEQ ID NO: 528378 - protein, 10 aa, Mycobacterium
NAGGLTSNPG

SEQ ID NO: 528379 - protein, 5 aa, Mycobacterium
NAGGM

SEQ ID NO: 528380 - protein, 19 aa, Mycobacterium
NAGGMSRATQLTADGYEKT

SEQ ID NO: 528381 - protein, 7 aa, Mycobacterium
NAGGPHA

SEQ ID NO: 528382 - protein, 7 aa, Mycobacterium
NAGGRIH

SEQ ID NO: 528383 - protein, 6 aa, Mycobacterium
NAGGRP

SEQ ID NO: 528384 - protein, 34 aa, Mycobacterium
NAGGSNDGREGGRGRRDNRDDRRGGRDNAEKSNY

SEQ ID NO: 528385 - protein, 7 aa, Mycobacterium
NAGGSPY

SEQ ID NO: 528386 - protein, 8 aa, Mycobacterium
NAGGSPYA

SEQ ID NO: 528387 - protein, 9 aa, Mycobacterium
NAGGSPYAL

SEQ ID NO: 528388 - protein, 18 aa, Mycobacterium
NAGGSPYVPASEASARFS

SEQ ID NO: 528389 - protein, 17 aa, Mycobacterium
NAGGSPYVPTAESSAKF

SEQ ID NO: 528390 - protein, 14 aa, Mycobacterium
NAGGSRPDGIAKTP

SEQ ID NO: 528391 - protein, 40 aa, Mycobacterium
NAGGTITTSTGTGGAGGSGTGLGNTGGDGGAADLTVPPPA

SEQ ID NO: 528392 - protein, 17 aa, Mycobacterium
NAGGTQPRPAIATSSRY

SEQ ID NO: 528393 - protein, 9 aa, Mycobacterium
NAGHETDPV

SEQ ID NO: 528394 - protein, 10 aa, Mycobacterium
NAGHGGISGR

SEQ ID NO: 528395 - protein, 10 aa, Mycobacterium
NAGHGGVSGR

SEQ ID NO: 528396 - protein, 13 aa, Mycobacterium
NAGHGGVSGRYKG

SEQ ID NO: 528397 - protein, 16 aa, Mycobacterium
NAGIDNAGGFSSGNLN

SEQ ID NO: 528398 - protein, 7 aa, Mycobacterium
NAGIDPA

SEQ ID NO: 528399 - protein, 5 aa, Mycobacterium
NAGIG

SEQ ID NO: 528400 - protein, 6 aa, Mycobacterium
NAGKAG

SEQ ID NO: 528401 - protein, 9 aa, Mycobacterium
NAGKPDDGA

SEQ ID NO: 528402 - protein, 15 aa, Mycobacterium
NAGKPGTKLGSEREL

SEQ ID NO: 528403 - protein, 19 aa, Mycobacterium
NAGKPTQPALTPRPRPTPL

SEQ ID NO: 528404 - protein, 8 aa, Mycobacterium
NAGKPTSV

SEQ ID NO: 528405 - protein, 7 aa, Mycobacterium
NAGKQTV

SEQ ID NO: 528406 - protein, 15 aa, Mycobacterium
NAGKSRPDGIGKTPI

SEQ ID NO: 528407 - protein, 7 aa, Mycobacterium
NAGLPNA

SEQ ID NO: 528408 - protein, 10 aa, Mycobacterium
NAGLPSRADV

SEQ ID NO: 528409 - protein, 7 aa, Mycobacterium
NAGLRED

SEQ ID NO: 528410 - protein, 8 aa, Mycobacterium
NAGLREDT

SEQ ID NO: 528411 - protein, 8 aa, Mycobacterium
NAGLREGS

SEQ ID NO: 528412 - protein, 6 aa, Mycobacterium
NAGLSA

SEQ ID NO: 528413 - protein, 6 aa, Mycobacterium
NAGLTA

SEQ ID NO: 528414 - protein, 5 aa, Mycobacterium
NAGMP

SEQ ID NO: 528415 - protein, 8 aa, Mycobacterium
NAGMQPSE

SEQ ID NO: 528416 - protein, 4 aa, Mycobacterium
NAGN

SEQ ID NO: 528417 - protein, 13 aa, Mycobacterium
NAGNAGADGFGNR

SEQ ID NO: 528418 - protein, 7 aa, Mycobacterium
NAGNNNF

SEQ ID NO: 528419 - protein, 8 aa, Mycobacterium
NAGNTDTG

SEQ ID NO: 528420 - protein, 10 aa, Mycobacterium
NAGPADLSNP

SEQ ID NO: 528421 - protein, 6 aa, Mycobacterium
NAGPDG

SEQ ID NO: 528422 - protein, 9 aa, Mycobacterium
NAGPENAGD

SEQ ID NO: 528423 - protein, 8 aa, Mycobacterium
NAGPFGRL

SEQ ID NO: 528424 - protein, 7 aa, Mycobacterium
NAGPGKR

SEQ ID NO: 528425 - protein, 9 aa, Mycobacterium
NAGPGTNGS

SEQ ID NO: 528426 - protein, 5 aa, Mycobacterium
NAGPV

SEQ ID NO: 528427 - protein, 11 aa, Mycobacterium
NAGPVDDPPLR

SEQ ID NO: 528428 - protein, 10 aa, Mycobacterium
NAGQGNVGAA

SEQ ID NO: 528429 - protein, 7 aa, Mycobacterium
NAGQGVD

SEQ ID NO: 528430 - protein, 7 aa, Mycobacterium
NAGQLSA

SEQ ID NO: 528431 - protein, 7 aa, Mycobacterium
NAGQNRL

SEQ ID NO: 528432 - protein, 5 aa, Mycobacterium
NAGQP

SEQ ID NO: 528433 - protein, 14 aa, Mycobacterium
NAGQPITSSTLTEE

SEQ ID NO: 528434 - protein, 11 aa, Mycobacterium
NAGQPPPFPNA

SEQ ID NO: 528435 - protein, 4 aa, Mycobacterium
NAGR

SEQ ID NO: 528436 - protein, 10 aa, Mycobacterium
NAGRASKDVD

SEQ ID NO: 528437 - protein, 7 aa, Mycobacterium
NAGRDRV

SEQ ID NO: 528438 - protein, 5 aa, Mycobacterium
NAGRH

SEQ ID NO: 528439 - protein, 5 aa, Mycobacterium
NAGRL

SEQ ID NO: 528440 - protein, 7 aa, Mycobacterium
NAGRRTQ

SEQ ID NO: 528441 - protein, 6 aa, Mycobacterium
NAGSAG

SEQ ID NO: 528442 - protein, 13 aa, Mycobacterium
NAGSAGKPPRPIP

SEQ ID NO: 528443 - protein, 6 aa, Mycobacterium
NAGSDA

SEQ ID NO: 528444 - protein, 8 aa, Mycobacterium
NAGSEASA

SEQ ID NO: 528445 - protein, 8 aa, Mycobacterium
NAGSERVP

SEQ ID NO: 528446 - protein, 14 aa, Mycobacterium
NAGSGGQGGAGGDG

SEQ ID NO: 528447 - protein, 29 aa, Mycobacterium
NAGSGNVGYENAGGANVGFGNSGSDNTGF

SEQ ID NO: 528448 - protein, 20 aa, Mycobacterium
NAGSGSDSGVGNRGTGNSGL

SEQ ID NO: 528449 - protein, 11 aa, Mycobacterium
NAGSLGADPGR

SEQ ID NO: 528450 - protein, 15 aa, Mycobacterium
NAGSLNQGFANTGDH

SEQ ID NO: 528451 - protein, 11 aa, Mycobacterium
NAGSPDDIDKD

SEQ ID NO: 528452 - protein, 9 aa, Mycobacterium
NAGSPEVDP

SEQ ID NO: 528453 - protein, 9 aa, Mycobacterium
NAGSPEVDS

SEQ ID NO: 528454 - protein, 9 aa, Mycobacterium
NAGSPEVDT

SEQ ID NO: 528455 - protein, 7 aa, Mycobacterium
NAGSRIA

SEQ ID NO: 528456 - protein, 18 aa, Mycobacterium
NAGSYNTGIGNAGGTNTG

SEQ ID NO: 528457 - protein, 9 aa, Mycobacterium
NAGTASVAR

SEQ ID NO: 528458 - protein, 17 aa, Mycobacterium
NAGTGFNTGVGNTGSFN

SEQ ID NO: 528459 - protein, 10 aa, Mycobacterium
NAGTGGAGGY

SEQ ID NO: 528460 - protein, 6 aa, Mycobacterium
NAGTGQ

SEQ ID NO: 528461 - protein, 9 aa, Mycobacterium
NAGTGSSSG

SEQ ID NO: 528462 - protein, 7 aa, Mycobacterium
NAGTGVA

SEQ ID NO: 528463 - protein, 13 aa, Mycobacterium
NAGTNAGTTSTGL

SEQ ID NO: 528464 - protein, 9 aa, Mycobacterium
NAGTNGPLP

SEQ ID NO: 528465 - protein, 26 aa, Mycobacterium
NAGTPGAKLGSERDLAEKYGTSRSSL

SEQ ID NO: 528466 - protein, 7 aa, Mycobacterium
NAGTPGW

SEQ ID NO: 528467 - protein, 8 aa, Mycobacterium
NAGTPREL

SEQ ID NO: 528468 - protein, 9 aa, Mycobacterium
NAGTSPVDP

SEQ ID NO: 528469 - protein, 655 aa, Mycobacterium
NAGTTGAGGDGGNGGNGGLAGNGGAGGNGDASNPNGGTGGNGANPGAGGAGGAGGNGSRTGAPGTTGNTPTTAAGHGGKGGDGFSPATSGQDGGSGGKGGDAGRFGNGGNGGNGGNGAAGDAAGSGHTGGNGGAGGGGGNAGQFGEPGTGGSGGNGGKGGDGAAGGLAQAGGNGGEGGAGGNAGAGGLSGTGDSTGNAGTGGNGGAGGNGGTGGDGSDGGPGGAGGKGGNSGPGGTNGTGGHGGNGGTGGDGGDGASGVGLGKAGGTGATGGNGGNAGSGGAAGTGGTGGTNGSAGTGGTGGTGGNGGAGDKGAVGDSGFAGGTGGAGGTGGNSGPGGTNGTGGHGGNGGTGGDGGDGASGVGQGKAGGTGATGGNGGNAGSGGAAGTGGDASGGGTNGSAGTGGTGGTGGNGGDGDKGAVGDSGFAGGTGGAGGTGGNSGPGGTNGTGGHGGNGGTGGDGGDGASGVGQGKAGGTGATGGSGGNAGSGGAAGTGGNGGTNGNAGTGGTGGTGGNGGDGDKGAVGDSGFAGGTGGNGGTGGNSGPGGTNGTGGHGGNGGTGGDGGDGRNGSTGAIGGNGGTGGTGGIGGTAGTGGTGGSAGSAGTGGTGGNGGAGDSGASGGTGGTGGEGGAGIGGKDGGTGGTGGTGGTGGAGV

SEQ ID NO: 528470 - protein, 5 aa, Mycobacterium
NAGTV

SEQ ID NO: 528471 - protein, 5 aa, Mycobacterium
NAGVD

SEQ ID NO: 528472 - protein, 15 aa, Mycobacterium
NAGVDEARKWIAEPH

SEQ ID NO: 528473 - protein, 57 aa, Mycobacterium
NAGVGGAGGASTVANGGAGGAGGAGGLLGGGGLGGAGGASTSATASGGAGGQGGAAG

SEQ ID NO: 528474 - protein, 5 aa, Mycobacterium
NAGVP

SEQ ID NO: 528475 - protein, 5 aa, Mycobacterium
NAGVR

SEQ ID NO: 528476 - protein, 8 aa, Mycobacterium
NAGVREGT

SEQ ID NO: 528477 - protein, 7 aa, Mycobacterium
NAGVREN

SEQ ID NO: 528478 - protein, 13 aa, Mycobacterium
NAGYHGGAAPAEA

SEQ ID NO: 528479 - protein, 12 aa, Mycobacterium
NAGYKGFRLLGA

SEQ ID NO: 528480 - protein, 5 aa, Mycobacterium
NAGYR

SEQ ID NO: 528481 - protein, 6 aa, Mycobacterium
NAHAAG

SEQ ID NO: 528482 - protein, 6 aa, Mycobacterium
NAHADR

SEQ ID NO: 528483 - protein, 5 aa, Mycobacterium
NAHDR

SEQ ID NO: 528484 - protein, 5 aa, Mycobacterium
NAHEE

SEQ ID NO: 528485 - protein, 25 aa, Mycobacterium
NAHGQKVQSAGSNMAGTDSAVGSSW

SEQ ID NO: 528486 - protein, 25 aa, Mycobacterium
NAHGQKVQTAGANMASTDSAVGSSW

SEQ ID NO: 528487 - protein, 25 aa, Mycobacterium
NAHGQKVQTAGSNMNSTDSAVGSSW

SEQ ID NO: 528488 - protein, 9 aa, Mycobacterium
NAHKQARKP

SEQ ID NO: 528489 - protein, 7 aa, Mycobacterium
NAHPDAL

SEQ ID NO: 528490 - protein, 30 aa, Mycobacterium
NAHPDVQAAADEVTAANNDDGVGRVLERWW

SEQ ID NO: 528491 - protein, 30 aa, Mycobacterium
NAHPEAKAAADEVTTTNAEDGVATVLERWW

SEQ ID NO: 528492 - protein, 30 aa, Mycobacterium
NAHPEARAAANEVTATNNDDGVAKVLERWW

SEQ ID NO: 528493 - protein, 5 aa, Mycobacterium
NAHRR

SEQ ID NO: 528494 - protein, 4 aa, Mycobacterium
NAIA

SEQ ID NO: 528495 - protein, 10 aa, Mycobacterium
NAIEETTGRT

SEQ ID NO: 528496 - protein, 5 aa, Mycobacterium
NAIGP

SEQ ID NO: 528497 - protein, 27 aa, Mycobacterium
NAIGPPGQSRGARRRPGRLARLDPCQH

SEQ ID NO: 528498 - protein, 12 aa, Mycobacterium
NAIGRLETDGTL

SEQ ID NO: 528499 - protein, 11 aa, Mycobacterium
NAIPADPNGAW

SEQ ID NO: 528500 - protein, 7 aa, Mycobacterium
NAIPPAR

SEQ ID NO: 528501 - protein, 7 aa, Mycobacterium
NAIPQSG

SEQ ID NO: 528502 - protein, 9 aa, Mycobacterium
NAIPQTGTM

SEQ ID NO: 528503 - protein, 9 aa, Mycobacterium
NAIPRDPDL

SEQ ID NO: 528504 - protein, 5 aa, Mycobacterium
NAIQG

SEQ ID NO: 528505 - protein, 25 aa, Mycobacterium
NAIRTSTPATSNSSWRATLAATAEE

SEQ ID NO: 528506 - protein, 7 aa, Mycobacterium
NAISGIP

SEQ ID NO: 528507 - protein, 6 aa, Mycobacterium
NAITPK

SEQ ID NO: 528508 - protein, 7 aa, Mycobacterium
NAKAAVE

SEQ ID NO: 528509 - protein, 6 aa, Mycobacterium
NAKANA

SEQ ID NO: 528510 - protein, 8 aa, Mycobacterium
NAKASGFS

SEQ ID NO: 528511 - protein, 5 aa, Mycobacterium
NAKAV

SEQ ID NO: 528512 - protein, 11 aa, Mycobacterium
NAKAYRKAKLP

SEQ ID NO: 528513 - protein, 8 aa, Mycobacterium
NAKDEARR

SEQ ID NO: 528514 - protein, 7 aa, Mycobacterium
NAKFADT

SEQ ID NO: 528515 - protein, 9 aa, Mycobacterium
NAKGATKGT

SEQ ID NO: 528516 - protein, 8 aa, Mycobacterium
NAKGDRLE

SEQ ID NO: 528517 - protein, 8 aa, Mycobacterium
NAKGVSVT

SEQ ID NO: 528518 - protein, 4 aa, Mycobacterium
NAKN

SEQ ID NO: 528519 - protein, 9 aa, Mycobacterium
NAKNTTETN

SEQ ID NO: 528520 - protein, 7 aa, Mycobacterium
NAKPDEL

SEQ ID NO: 528521 - protein, 10 aa, Mycobacterium
NAKPDQIPAE

SEQ ID NO: 528522 - protein, 7 aa, Mycobacterium
NAKPDQL

SEQ ID NO: 528523 - protein, 5 aa, Mycobacterium
NAKPQ

SEQ ID NO: 528524 - protein, 12 aa, Mycobacterium
NAKPTQVARRDT

SEQ ID NO: 528525 - protein, 10 aa, Mycobacterium
NAKREAASGK

SEQ ID NO: 528526 - protein, 16 aa, Mycobacterium
NAKRGDASAWAGVGTP

SEQ ID NO: 528527 - protein, 5 aa, Mycobacterium
NAKRT

SEQ ID NO: 528528 - protein, 11 aa, Mycobacterium
NAKRTGQRQAG

SEQ ID NO: 528529 - protein, 9 aa, Mycobacterium
NAKSPDELR

SEQ ID NO: 528530 - protein, 9 aa, Mycobacterium
NAKSPQAQR

SEQ ID NO: 528531 - protein, 7 aa, Mycobacterium
NAKSTGT

SEQ ID NO: 528532 - protein, 4 aa, Mycobacterium
NAKT

SEQ ID NO: 528533 - protein, 16 aa, Mycobacterium
NAKTDPSTGKKTLKAK

SEQ ID NO: 528534 - protein, 9 aa, Mycobacterium
NAKVTDRYG

SEQ ID NO: 528535 - protein, 9 aa, Mycobacterium
NALAGRPHL

SEQ ID NO: 528536 - protein, 7 aa, Mycobacterium
NALAQPL

SEQ ID NO: 528537 - protein, 9 aa, Mycobacterium
NALDDDGSI

SEQ ID NO: 528538 - protein, 7 aa, Mycobacterium
NALDDIP

SEQ ID NO: 528539 - protein, 6 aa, Mycobacterium
NALDTT

SEQ ID NO: 528540 - protein, 18 aa, Mycobacterium
NALGGEDEERDKNHNGAN

SEQ ID NO: 528541 - protein, 9 aa, Mycobacterium
NALGSDPWS

SEQ ID NO: 528542 - protein, 14 aa, Mycobacterium
NALHTSGSSQRDRV

SEQ ID NO: 528543 - protein, 7 aa, Mycobacterium
NALNNRD

SEQ ID NO: 528544 - protein, 7 aa, Mycobacterium
NALPDSS

SEQ ID NO: 528545 - protein, 7 aa, Mycobacterium
NALPGSS

SEQ ID NO: 528546 - protein, 5 aa, Mycobacterium
NALPN

SEQ ID NO: 528547 - protein, 11 aa, Mycobacterium
NALQKASERLE

SEQ ID NO: 528548 - protein, 10 aa, Mycobacterium
NALREDGQHS

SEQ ID NO: 528549 - protein, 15 aa, Mycobacterium
NALRGEKDSDRPFAP

SEQ ID NO: 528550 - protein, 6 aa, Mycobacterium
NALRPG

SEQ ID NO: 528551 - protein, 8 aa, Mycobacterium
NALRPGDT

SEQ ID NO: 528552 - protein, 9 aa, Mycobacterium
NALSAKESH

SEQ ID NO: 528553 - protein, 7 aa, Mycobacterium
NALSPRS

SEQ ID NO: 528554 - protein, 7 aa, Mycobacterium
NALSRGG

SEQ ID NO: 528555 - protein, 6 aa, Mycobacterium
NALTEP

SEQ ID NO: 528556 - protein, 24 aa, Mycobacterium
NAMREEAAQSPGWEAGHEKNRQLA

SEQ ID NO: 528557 - protein, 13 aa, Mycobacterium
NANAARGEDPDFH

SEQ ID NO: 528558 - protein, 6 aa, Mycobacterium
NANADA

SEQ ID NO: 528559 - protein, 6 aa, Mycobacterium
NANGAG

SEQ ID NO: 528560 - protein, 11 aa, Mycobacterium
NANGAGSAAGS

SEQ ID NO: 528561 - protein, 6 aa, Mycobacterium
NANGGR

SEQ ID NO: 528562 - protein, 8 aa, Mycobacterium
NANGKLDG

SEQ ID NO: 528563 - protein, 8 aa, Mycobacterium
NANGKLDS

SEQ ID NO: 528564 - protein, 9 aa, Mycobacterium
NANGSQHDI

SEQ ID NO: 528565 - protein, 6 aa, Mycobacterium
NANPDC

SEQ ID NO: 528566 - protein, 8 aa, Mycobacterium
NANPDGNL

SEQ ID NO: 528567 - protein, 6 aa, Mycobacterium
NANPEC

SEQ ID NO: 528568 - protein, 7 aa, Mycobacterium
NANPECT

SEQ ID NO: 528569 - protein, 12 aa, Mycobacterium
NANPEPAATAGQ

SEQ ID NO: 528570 - protein, 6 aa, Mycobacterium
NANPPI

SEQ ID NO: 528571 - protein, 6 aa, Mycobacterium
NANPQA

SEQ ID NO: 528572 - protein, 28 aa, Mycobacterium
NANPQPYGDDGYQGRWATPANTAEEPFN

SEQ ID NO: 528573 - protein, 7 aa, Mycobacterium
NANPSDG

SEQ ID NO: 528574 - protein, 8 aa, Mycobacterium
NANREYQR

SEQ ID NO: 528575 - protein, 8 aa, Mycobacterium
NANRQGAA

SEQ ID NO: 528576 - protein, 8 aa, Mycobacterium
NANRSLSR

SEQ ID NO: 528577 - protein, 12 aa, Mycobacterium
NANSAGTAFTSD

SEQ ID NO: 528578 - protein, 7 aa, Mycobacterium
NANSDAR

SEQ ID NO: 528579 - protein, 7 aa, Mycobacterium
NANSDCT

SEQ ID NO: 528580 - protein, 12 aa, Mycobacterium
NANSGSGSGCTT

SEQ ID NO: 528581 - protein, 18 aa, Mycobacterium
NANSQNPAEFYTSEFVAP

SEQ ID NO: 528582 - protein, 7 aa, Mycobacterium
NANTRSI

SEQ ID NO: 528583 - protein, 5 aa, Mycobacterium
NANWG

SEQ ID NO: 528584 - protein, 6 aa, Mycobacterium
NANYPE

SEQ ID NO: 528585 - protein, 18 aa, Mycobacterium
NAPADTAADDRAGATQLP

SEQ ID NO: 528586 - protein, 5 aa, Mycobacterium
NAPAE

SEQ ID NO: 528587 - protein, 54 aa, Mycobacterium
NAPAGQAPDTKKPAQPDRLAKTAEATTTSSPASTETKTHQSPGKPDAGNTQVTH

SEQ ID NO: 528588 - protein, 8 aa, Mycobacterium
NAPAGQSV

SEQ ID NO: 528589 - protein, 13 aa, Mycobacterium
NAPAHIVNPEVLG

SEQ ID NO: 528590 - protein, 8 aa, Mycobacterium
NAPAIAAA

SEQ ID NO: 528591 - protein, 12 aa, Mycobacterium
NAPAIAAAEGSY

SEQ ID NO: 528592 - protein, 9 aa, Mycobacterium
NAPAIAATE

SEQ ID NO: 528593 - protein, 12 aa, Mycobacterium
NAPAIAATEGAY

SEQ ID NO: 528594 - protein, 12 aa, Mycobacterium
NAPAIAATEGTY

SEQ ID NO: 528595 - protein, 12 aa, Mycobacterium
NAPAIAATESAY

SEQ ID NO: 528596 - protein, 9 aa, Mycobacterium
NAPAIATAE

SEQ ID NO: 528597 - protein, 9 aa, Mycobacterium
NAPAPGEEV

SEQ ID NO: 528598 - protein, 16 aa, Mycobacterium
NAPAPPIHRRVLAALR

SEQ ID NO: 528599 - protein, 6 aa, Mycobacterium
NAPAQT

SEQ ID NO: 528600 - protein, 9 aa, Mycobacterium
NAPASASPI

SEQ ID NO: 528601 - protein, 8 aa, Mycobacterium
NAPASTSA

SEQ ID NO: 528602 - protein, 5 aa, Mycobacterium
NAPAT

SEQ ID NO: 528603 - protein, 8 aa, Mycobacterium
NAPATGHL

SEQ ID NO: 528604 - protein, 5 aa, Mycobacterium
NAPAV

SEQ ID NO: 528605 - protein, 4 aa, Mycobacterium
NAPD

SEQ ID NO: 528606 - protein, 8 aa, Mycobacterium
NAPDIPKE

SEQ ID NO: 528607 - protein, 6 aa, Mycobacterium
NAPDRK

SEQ ID NO: 528608 - protein, 7 aa, Mycobacterium
NAPDSGN

SEQ ID NO: 528609 - protein, 9 aa, Mycobacterium
NAPDTYNKG

SEQ ID NO: 528610 - protein, 9 aa, Mycobacterium
NAPEADTAA

SEQ ID NO: 528611 - protein, 7 aa, Mycobacterium
NAPFQGV

SEQ ID NO: 528612 - protein, 4 aa, Mycobacterium
NAPG

SEQ ID NO: 528613 - protein, 9 aa, Mycobacterium
NAPGGGADH

SEQ ID NO: 528614 - protein, 10 aa, Mycobacterium
NAPGGGGQGD

SEQ ID NO: 528615 - protein, 13 aa, Mycobacterium
NAPGGKPRRAGVS

SEQ ID NO: 528616 - protein, 5 aa, Mycobacterium
NAPGI

SEQ ID NO: 528617 - protein, 7 aa, Mycobacterium
NAPGIEH

SEQ ID NO: 528618 - protein, 7 aa, Mycobacterium
NAPGMTN

SEQ ID NO: 528619 - protein, 10 aa, Mycobacterium
NAPGQRIPRT

SEQ ID NO: 528620 - protein, 26 aa, Mycobacterium
NAPGSETPVTEDPAGNAGGPPLPPGY

SEQ ID NO: 528621 - protein, 12 aa, Mycobacterium
NAPGSRDGARTT

SEQ ID NO: 528622 - protein, 5 aa, Mycobacterium
NAPGV

SEQ ID NO: 528623 - protein, 6 aa, Mycobacterium
NAPGWS

SEQ ID NO: 528624 - protein, 6 aa, Mycobacterium
NAPHPR

SEQ ID NO: 528625 - protein, 12 aa, Mycobacterium
NAPIATTRGSFD

SEQ ID NO: 528626 - protein, 4 aa, Mycobacterium
NAPK

SEQ ID NO: 528627 - protein, 11 aa, Mycobacterium
NAPKADDHDGV

SEQ ID NO: 528628 - protein, 13 aa, Mycobacterium
NAPLGQPATDGAR

SEQ ID NO: 528629 - protein, 16 aa, Mycobacterium
NAPLSVAAGKRTATLT

SEQ ID NO: 528630 - protein, 7 aa, Mycobacterium
NAPNADR

SEQ ID NO: 528631 - protein, 7 aa, Mycobacterium
NAPNEPD

SEQ ID NO: 528632 - protein, 4 aa, Mycobacterium
NAPP

SEQ ID NO: 528633 - protein, 6 aa, Mycobacterium
NAPPAV

SEQ ID NO: 528634 - protein, 6 aa, Mycobacterium
NAPPPI

SEQ ID NO: 528635 - protein, 5 aa, Mycobacterium
NAPQV

SEQ ID NO: 528636 - protein, 41 aa, Mycobacterium
NAPQYGPPPGNQPWPQAGGFGGGPGQPPHVPPGPPQSYADR

SEQ ID NO: 528637 - protein, 4 aa, Mycobacterium
NAPR

SEQ ID NO: 528638 - protein, 7 aa, Mycobacterium
NAPRDPR

SEQ ID NO: 528639 - protein, 7 aa, Mycobacterium
NAPRELE

SEQ ID NO: 528640 - protein, 15 aa, Mycobacterium
NAPRGDQTRPRAGSR

SEQ ID NO: 528641 - protein, 8 aa, Mycobacterium
NAPRGEGM

SEQ ID NO: 528642 - protein, 13 aa, Mycobacterium
NAPRGEQGRLRAG

SEQ ID NO: 528643 - protein, 8 aa, Mycobacterium
NAPRPAGL

SEQ ID NO: 528644 - protein, 11 aa, Mycobacterium
NAPRPSPARSR

SEQ ID NO: 528645 - protein, 5 aa, Mycobacterium
NAPRR

SEQ ID NO: 528646 - protein, 5 aa, Mycobacterium
NAPRY

SEQ ID NO: 528647 - protein, 6 aa, Mycobacterium
NAPSGC

SEQ ID NO: 528648 - protein, 6 aa, Mycobacterium
NAPSIA

SEQ ID NO: 528649 - protein, 7 aa, Mycobacterium
NAPSQAL

SEQ ID NO: 528650 - protein, 4 aa, Mycobacterium
NAPT

SEQ ID NO: 528651 - protein, 8 aa, Mycobacterium
NAPTAPPK

SEQ ID NO: 528652 - protein, 7 aa, Mycobacterium
NAPTGIA

SEQ ID NO: 528653 - protein, 8 aa, Mycobacterium
NAPTGSRL

SEQ ID NO: 528654 - protein, 14 aa, Mycobacterium
NAPTKSCDQGRHDD

SEQ ID NO: 528655 - protein, 5 aa, Mycobacterium
NAPTL

SEQ ID NO: 528656 - protein, 9 aa, Mycobacterium
NAPTPDDLP

SEQ ID NO: 528657 - protein, 6 aa, Mycobacterium
NAPTPE

SEQ ID NO: 528658 - protein, 6 aa, Mycobacterium
NAPTQT

SEQ ID NO: 528659 - protein, 9 aa, Mycobacterium
NAPTSTSPI

SEQ ID NO: 528660 - protein, 6 aa, Mycobacterium
NAPTVA

SEQ ID NO: 528661 - protein, 4 aa, Mycobacterium
NAPV

SEQ ID NO: 528662 - protein, 8 aa, Mycobacterium
NAPVAAPG

SEQ ID NO: 528663 - protein, 8 aa, Mycobacterium
NAPVTAPA

SEQ ID NO: 528664 - protein, 4 aa, Mycobacterium
NAPW

SEQ ID NO: 528665 - protein, 5 aa, Mycobacterium
NAPWD

SEQ ID NO: 528666 - protein, 9 aa, Mycobacterium
NAPYEAPEN

SEQ ID NO: 528667 - protein, 7 aa, Mycobacterium
NAPYTTL

SEQ ID NO: 528668 - protein, 5 aa, Mycobacterium
NAQAA

SEQ ID NO: 528669 - protein, 7 aa, Mycobacterium
NAQADRP

SEQ ID NO: 528670 - protein, 16 aa, Mycobacterium
NAQAERDELSDSERAQ

SEQ ID NO: 528671 - protein, 13 aa, Mycobacterium
NAQAQALARSSTG

SEQ ID NO: 528672 - protein, 6 aa, Mycobacterium
NAQART

SEQ ID NO: 528673 - protein, 7 aa, Mycobacterium
NAQATDL

SEQ ID NO: 528674 - protein, 8 aa, Mycobacterium
NAQGPEAG

SEQ ID NO: 528675 - protein, 7 aa, Mycobacterium
NAQGVEA

SEQ ID NO: 528676 - protein, 5 aa, Mycobacterium
NAQLE

SEQ ID NO: 528677 - protein, 5 aa, Mycobacterium
NAQMS

SEQ ID NO: 528678 - protein, 5 aa, Mycobacterium
NAQNA

SEQ ID NO: 528679 - protein, 18 aa, Mycobacterium
NAQPAAGTELTGTELTGV

SEQ ID NO: 528680 - protein, 15 aa, Mycobacterium
NAQPIAEGDPANPSH

SEQ ID NO: 528681 - protein, 8 aa, Mycobacterium
NAQPNRPI

SEQ ID NO: 528682 - protein, 5 aa, Mycobacterium
NAQPT

SEQ ID NO: 528683 - protein, 6 aa, Mycobacterium
NAQPTR

SEQ ID NO: 528684 - protein, 26 aa, Mycobacterium
NAQPYDSDGAPVANRIQPGKRPRSSM

SEQ ID NO: 528685 - protein, 4 aa, Mycobacterium
NAQQ

SEQ ID NO: 528686 - protein, 7 aa, Mycobacterium
NAQQAGG

SEQ ID NO: 528687 - protein, 9 aa, Mycobacterium
NAQQALSRS

SEQ ID NO: 528688 - protein, 10 aa, Mycobacterium
NAQQALSRSD

SEQ ID NO: 528689 - protein, 8 aa, Mycobacterium
NAQQGYKP

SEQ ID NO: 528690 - protein, 8 aa, Mycobacterium
NAQQKDLD

SEQ ID NO: 528691 - protein, 14 aa, Mycobacterium
NAQQMQERIKSRRG

SEQ ID NO: 528692 - protein, 9 aa, Mycobacterium
NAQQQSNGR

SEQ ID NO: 528693 - protein, 6 aa, Mycobacterium
NAQRAA

SEQ ID NO: 528694 - protein, 7 aa, Mycobacterium
NAQRAGG

SEQ ID NO: 528695 - protein, 9 aa, Mycobacterium
NAQRAHTAS

SEQ ID NO: 528696 - protein, 9 aa, Mycobacterium
NAQRMTGEG

SEQ ID NO: 528697 - protein, 7 aa, Mycobacterium
NAQRSID

SEQ ID NO: 528698 - protein, 6 aa, Mycobacterium
NAQRTL

SEQ ID NO: 528699 - protein, 9 aa, Mycobacterium
NAQSEPSSV

SEQ ID NO: 528700 - protein, 18 aa, Mycobacterium
NAQTEDSQPPVEGSDPLD

SEQ ID NO: 528701 - protein, 7 aa, Mycobacterium
NAQTSCS

SEQ ID NO: 528702 - protein, 7 aa, Mycobacterium
NAQTYQA

SEQ ID NO: 528703 - protein, 7 aa, Mycobacterium
NARAARD

SEQ ID NO: 528704 - protein, 6 aa, Mycobacterium
NARAAW

SEQ ID NO: 528705 - protein, 8 aa, Mycobacterium
NARAERGN

SEQ ID NO: 528706 - protein, 5 aa, Mycobacterium
NARAG

SEQ ID NO: 528707 - protein, 16 aa, Mycobacterium
NARAGLANRVGARSAR

SEQ ID NO: 528708 - protein, 9 aa, Mycobacterium
NARAQAGGL

SEQ ID NO: 528709 - protein, 19 aa, Mycobacterium
NARAQNIAKTAASAGSGDF

SEQ ID NO: 528710 - protein, 9 aa, Mycobacterium
NARARGQEL

SEQ ID NO: 528711 - protein, 28 aa, Mycobacterium
NARATGPTGPTSAGVTTVTGDTNPNTCR

SEQ ID NO: 528712 - protein, 11 aa, Mycobacterium
NARATGQRERR

SEQ ID NO: 528713 - protein, 18 aa, Mycobacterium
NARDHGDRTALEASGDKL

SEQ ID NO: 528714 - protein, 11 aa, Mycobacterium
NARDKTGTDPV

SEQ ID NO: 528715 - protein, 6 aa, Mycobacterium
NARDNV

SEQ ID NO: 528716 - protein, 20 aa, Mycobacterium
NARDRTFASPYSARKTPIAT

SEQ ID NO: 528717 - protein, 6 aa, Mycobacterium
NARDSY

SEQ ID NO: 528718 - protein, 5 aa, Mycobacterium
NARER

SEQ ID NO: 528719 - protein, 6 aa, Mycobacterium
NARFSD

SEQ ID NO: 528720 - protein, 8 aa, Mycobacterium
NARFTEGS

SEQ ID NO: 528721 - protein, 8 aa, Mycobacterium
NARGADAT

SEQ ID NO: 528722 - protein, 6 aa, Mycobacterium
NARGER

SEQ ID NO: 528723 - protein, 19 aa, Mycobacterium
NARHGLNNPNARYRKEASV

SEQ ID NO: 528724 - protein, 6 aa, Mycobacterium
NARHHG

SEQ ID NO: 528725 - protein, 19 aa, Mycobacterium
NARKAGTEVTHQDKDGKDV

SEQ ID NO: 528726 - protein, 19 aa, Mycobacterium
NARKAGTTVSHKDKDGNDI

SEQ ID NO: 528727 - protein, 5 aa, Mycobacterium
NARKR

SEQ ID NO: 528728 - protein, 12 aa, Mycobacterium
NARLGTAPVGTS

SEQ ID NO: 528729 - protein, 8 aa, Mycobacterium
NARNGQSL

SEQ ID NO: 528730 - protein, 6 aa, Mycobacterium
NARNPR

SEQ ID NO: 528731 - protein, 10 aa, Mycobacterium
NARNRGRDPL

SEQ ID NO: 528732 - protein, 5 aa, Mycobacterium
NARPG

SEQ ID NO: 528733 - protein, 8 aa, Mycobacterium
NARPPTPE

SEQ ID NO: 528734 - protein, 8 aa, Mycobacterium
NARPRSVD

SEQ ID NO: 528735 - protein, 9 aa, Mycobacterium
NARPSETAA

SEQ ID NO: 528736 - protein, 16 aa, Mycobacterium
NARQATAEPVMRTLIM

SEQ ID NO: 528737 - protein, 6 aa, Mycobacterium
NARRRG

SEQ ID NO: 528738 - protein, 6 aa, Mycobacterium
NARRRQ

SEQ ID NO: 528739 - protein, 12 aa, Mycobacterium
NARRRREDGSWV

SEQ ID NO: 528740 - protein, 5 aa, Mycobacterium
NARRS

SEQ ID NO: 528741 - protein, 20 aa, Mycobacterium
NARRSRTSTVRGWDSMPAIV

SEQ ID NO: 528742 - protein, 7 aa, Mycobacterium
NARSASE

SEQ ID NO: 528743 - protein, 7 aa, Mycobacterium
NARSEEV

SEQ ID NO: 528744 - protein, 8 aa, Mycobacterium
NARSFDDE

SEQ ID NO: 528745 - protein, 8 aa, Mycobacterium
NARTAADY

SEQ ID NO: 528746 - protein, 8 aa, Mycobacterium
NARTAANY

SEQ ID NO: 528747 - protein, 9 aa, Mycobacterium
NARTDDMRT

SEQ ID NO: 528748 - protein, 12 aa, Mycobacterium
NARTDQGRTLRE

SEQ ID NO: 528749 - protein, 9 aa, Mycobacterium
NARTPGKGV

SEQ ID NO: 528750 - protein, 6 aa, Mycobacterium
NARTRE

SEQ ID NO: 528751 - protein, 6 aa, Mycobacterium
NARTTV

SEQ ID NO: 528752 - protein, 5 aa, Mycobacterium
NARVG

SEQ ID NO: 528753 - protein, 19 aa, Mycobacterium
NARYSPPALPLDGRPDEAQ

SEQ ID NO: 528754 - protein, 11 aa, Mycobacterium
NARYTAQQDAP

SEQ ID NO: 528755 - protein, 9 aa, Mycobacterium
NASAADSLS

SEQ ID NO: 528756 - protein, 10 aa, Mycobacterium
NASAADTQPY

SEQ ID NO: 528757 - protein, 14 aa, Mycobacterium
NASAATFVPPEAEW

SEQ ID NO: 528758 - protein, 8 aa, Mycobacterium
NASADRLT

SEQ ID NO: 528759 - protein, 16 aa, Mycobacterium
NASAGLANRVGARRAD

SEQ ID NO: 528760 - protein, 8 aa, Mycobacterium
NASAGWAN

SEQ ID NO: 528761 - protein, 23 aa, Mycobacterium
NASAKNTGAPDHRQRTQAIPGTA

SEQ ID NO: 528762 - protein, 15 aa, Mycobacterium
NASALTGGSGGTPRG

SEQ ID NO: 528763 - protein, 10 aa, Mycobacterium
NASASAATLT

SEQ ID NO: 528764 - protein, 10 aa, Mycobacterium
NASASGGKKV

SEQ ID NO: 528765 - protein, 7 aa, Mycobacterium
NASATGS

SEQ ID NO: 528766 - protein, 10 aa, Mycobacterium
NASEEDADAA

SEQ ID NO: 528767 - protein, 14 aa, Mycobacterium
NASERGSVRAAHPQ

SEQ ID NO: 528768 - protein, 8 aa, Mycobacterium
NASGAPAI

SEQ ID NO: 528769 - protein, 6 aa, Mycobacterium
NASGAQ

SEQ ID NO: 528770 - protein, 9 aa, Mycobacterium
NASGAVDDG

SEQ ID NO: 528771 - protein, 5 aa, Mycobacterium
NASGG

SEQ ID NO: 528772 - protein, 7 aa, Mycobacterium
NASGKPE

SEQ ID NO: 528773 - protein, 7 aa, Mycobacterium
NASGPEH

SEQ ID NO: 528774 - protein, 5 aa, Mycobacterium
NASGQ

SEQ ID NO: 528775 - protein, 6 aa, Mycobacterium
NASGRA

SEQ ID NO: 528776 - protein, 10 aa, Mycobacterium
NASGRSPAAW

SEQ ID NO: 528777 - protein, 11 aa, Mycobacterium
NASGRSPAGWT

SEQ ID NO: 528778 - protein, 8 aa, Mycobacterium
NASGSTSP

SEQ ID NO: 528779 - protein, 28 aa, Mycobacterium
NASKNEAGAVGPGPATPARAAGDGGGQL

SEQ ID NO: 528780 - protein, 10 aa, Mycobacterium
NASPADGDAA

SEQ ID NO: 528781 - protein, 7 aa, Mycobacterium
NASPARP

SEQ ID NO: 528782 - protein, 6 aa, Mycobacterium
NASPDL

SEQ ID NO: 528783 - protein, 8 aa, Mycobacterium
NASPDRLT

SEQ ID NO: 528784 - protein, 13 aa, Mycobacterium
NASPDTLQQRHGR

SEQ ID NO: 528785 - protein, 10 aa, Mycobacterium
NASPEHGAAA

SEQ ID NO: 528786 - protein, 7 aa, Mycobacterium
NASPIDG

SEQ ID NO: 528787 - protein, 7 aa, Mycobacterium
NASPLQS

SEQ ID NO: 528788 - protein, 6 aa, Mycobacterium
NASPQR

SEQ ID NO: 528789 - protein, 8 aa, Mycobacterium
NASPVTRA

SEQ ID NO: 528790 - protein, 7 aa, Mycobacterium
NASQSTL

SEQ ID NO: 528791 - protein, 4 aa, Mycobacterium
NASR

SEQ ID NO: 528792 - protein, 6 aa, Mycobacterium
NASRAA

SEQ ID NO: 528793 - protein, 9 aa, Mycobacterium
NASRAPQQV

SEQ ID NO: 528794 - protein, 9 aa, Mycobacterium
NASRDDVGG

SEQ ID NO: 528795 - protein, 11 aa, Mycobacterium
NASRQLPRTTS

SEQ ID NO: 528796 - protein, 8 aa, Mycobacterium
NASRSAAE

SEQ ID NO: 528797 - protein, 9 aa, Mycobacterium
NASRSADEV

SEQ ID NO: 528798 - protein, 8 aa, Mycobacterium
NASRSAGE

SEQ ID NO: 528799 - protein, 9 aa, Mycobacterium
NASRSAGQV

SEQ ID NO: 528800 - protein, 7 aa, Mycobacterium
NASRSTG

SEQ ID NO: 528801 - protein, 4 aa, Mycobacterium
NASS

SEQ ID NO: 528802 - protein, 8 aa, Mycobacterium
NASSADMA

SEQ ID NO: 528803 - protein, 6 aa, Mycobacterium
NASSAV

SEQ ID NO: 528804 - protein, 9 aa, Mycobacterium
NASSVPERD

SEQ ID NO: 528805 - protein, 7 aa, Mycobacterium
NASTEQL

SEQ ID NO: 528806 - protein, 8 aa, Mycobacterium
NASTHDGS

SEQ ID NO: 528807 - protein, 5 aa, Mycobacterium
NASTL

SEQ ID NO: 528808 - protein, 8 aa, Mycobacterium
NASTPGNW

SEQ ID NO: 528809 - protein, 9 aa, Mycobacterium
NASTPGSWA

SEQ ID NO: 528810 - protein, 5 aa, Mycobacterium
NASTR

SEQ ID NO: 528811 - protein, 5 aa, Mycobacterium
NASTS

SEQ ID NO: 528812 - protein, 6 aa, Mycobacterium
NASVSQ

SEQ ID NO: 528813 - protein, 16 aa, Mycobacterium
NASVTPRPTSPSPQQP

SEQ ID NO: 528814 - protein, 7 aa, Mycobacterium
NASWTRT

SEQ ID NO: 528815 - protein, 4 aa, Mycobacterium
NATA

SEQ ID NO: 528816 - protein, 7 aa, Mycobacterium
NATAASY

SEQ ID NO: 528817 - protein, 22 aa, Mycobacterium
NATAEPRERPPGENTTTLRRNG

SEQ ID NO: 528818 - protein, 8 aa, Mycobacterium
NATAGGAA

SEQ ID NO: 528819 - protein, 10 aa, Mycobacterium
NATAGPVTGR

SEQ ID NO: 528820 - protein, 6 aa, Mycobacterium
NATAGY

SEQ ID NO: 528821 - protein, 7 aa, Mycobacterium
NATAGYR

SEQ ID NO: 528822 - protein, 9 aa, Mycobacterium
NATARQTKT

SEQ ID NO: 528823 - protein, 8 aa, Mycobacterium
NATATAGY

SEQ ID NO: 528824 - protein, 11 aa, Mycobacterium
NATDGAEGTRE

SEQ ID NO: 528825 - protein, 9 aa, Mycobacterium
NATDGPVSG

SEQ ID NO: 528826 - protein, 5 aa, Mycobacterium
NATDI

SEQ ID NO: 528827 - protein, 6 aa, Mycobacterium
NATDNE

SEQ ID NO: 528828 - protein, 8 aa, Mycobacterium
NATDQPIG

SEQ ID NO: 528829 - protein, 10 aa, Mycobacterium
NATEADRDAA

SEQ ID NO: 528830 - protein, 6 aa, Mycobacterium
NATENV

SEQ ID NO: 528831 - protein, 12 aa, Mycobacterium
NATERAEGQHLP

SEQ ID NO: 528832 - protein, 5 aa, Mycobacterium
NATEV

SEQ ID NO: 528833 - protein, 7 aa, Mycobacterium
NATFGQP

SEQ ID NO: 528834 - protein, 7 aa, Mycobacterium
NATGEEI

SEQ ID NO: 528835 - protein, 9 aa, Mycobacterium
NATGGGQLS

SEQ ID NO: 528836 - protein, 16 aa, Mycobacterium
NATGHPSFVMSNSFSN

SEQ ID NO: 528837 - protein, 6 aa, Mycobacterium
NATGKN

SEQ ID NO: 528838 - protein, 6 aa, Mycobacterium
NATGLT

SEQ ID NO: 528839 - protein, 7 aa, Mycobacterium
NATGLTA

SEQ ID NO: 528840 - protein, 8 aa, Mycobacterium
NATGPGNI

SEQ ID NO: 528841 - protein, 15 aa, Mycobacterium
NATGQSADAIDESTP

SEQ ID NO: 528842 - protein, 6 aa, Mycobacterium
NATGRG

SEQ ID NO: 528843 - protein, 6 aa, Mycobacterium
NATGRV

SEQ ID NO: 528844 - protein, 5 aa, Mycobacterium
NATGT

SEQ ID NO: 528845 - protein, 9 aa, Mycobacterium
NATGTALPP

SEQ ID NO: 528846 - protein, 7 aa, Mycobacterium
NATKSLP

SEQ ID NO: 528847 - protein, 14 aa, Mycobacterium
NATKTQISGRNKQL

SEQ ID NO: 528848 - protein, 4 aa, Mycobacterium
NATN

SEQ ID NO: 528849 - protein, 7 aa, Mycobacterium
NATPAMD

SEQ ID NO: 528850 - protein, 7 aa, Mycobacterium
NATPDER

SEQ ID NO: 528851 - protein, 7 aa, Mycobacterium
NATPEEA

SEQ ID NO: 528852 - protein, 5 aa, Mycobacterium
NATPG

SEQ ID NO: 528853 - protein, 8 aa, Mycobacterium
NATPGADG

SEQ ID NO: 528854 - protein, 8 aa, Mycobacterium
NATPGPDG

SEQ ID NO: 528855 - protein, 6 aa, Mycobacterium
NATPIE

SEQ ID NO: 528856 - protein, 9 aa, Mycobacterium
NATPPSPEL

SEQ ID NO: 528857 - protein, 5 aa, Mycobacterium
NATPV

SEQ ID NO: 528858 - protein, 13 aa, Mycobacterium
NATRADPEAHRRP

SEQ ID NO: 528859 - protein, 10 aa, Mycobacterium
NATRANPDYL

SEQ ID NO: 528860 - protein, 7 aa, Mycobacterium
NATRELS

SEQ ID NO: 528861 - protein, 14 aa, Mycobacterium
NATRGATGLNGTTI

SEQ ID NO: 528862 - protein, 15 aa, Mycobacterium
NATRGNIDVTLVVTD

SEQ ID NO: 528863 - protein, 15 aa, Mycobacterium
NATRGNIEVTLTVTD

SEQ ID NO: 528864 - protein, 9 aa, Mycobacterium
NATRGPMPA

SEQ ID NO: 528865 - protein, 32 aa, Mycobacterium
NATRSNPDYLPGTSLPPGIRATADAAEALQNA

SEQ ID NO: 528866 - protein, 9 aa, Mycobacterium
NATRTETQI

SEQ ID NO: 528867 - protein, 7 aa, Mycobacterium
NATSNEA

SEQ ID NO: 528868 - protein, 9 aa, Mycobacterium
NATSPDELR

SEQ ID NO: 528869 - protein, 5 aa, Mycobacterium
NATSV

SEQ ID NO: 528870 - protein, 6 aa, Mycobacterium
NATTAV

SEQ ID NO: 528871 - protein, 8 aa, Mycobacterium
NATTDEPF

SEQ ID NO: 528872 - protein, 6 aa, Mycobacterium
NATTIE

SEQ ID NO: 528873 - protein, 6 aa, Mycobacterium
NATTIQ

SEQ ID NO: 528874 - protein, 8 aa, Mycobacterium
NATTMGAA

SEQ ID NO: 528875 - protein, 11 aa, Mycobacterium
NATTPERAAVA

SEQ ID NO: 528876 - protein, 9 aa, Mycobacterium
NATTPVDPR

SEQ ID NO: 528877 - protein, 6 aa, Mycobacterium
NATTTV

SEQ ID NO: 528878 - protein, 6 aa, Mycobacterium
NATVRS

SEQ ID NO: 528879 - protein, 7 aa, Mycobacterium
NATVRSS

SEQ ID NO: 528880 - protein, 12 aa, Mycobacterium
NATYAVEEPGCG

SEQ ID NO: 528881 - protein, 7 aa, Mycobacterium
NAVAGTE

SEQ ID NO: 528882 - protein, 6 aa, Mycobacterium
NAVDPA

SEQ ID NO: 528883 - protein, 14 aa, Mycobacterium
NAVGGESRVCAPDG

SEQ ID NO: 528884 - protein, 10 aa, Mycobacterium
NAVGGQGGHH

SEQ ID NO: 528885 - protein, 10 aa, Mycobacterium
NAVGPGEKSA

SEQ ID NO: 528886 - protein, 12 aa, Mycobacterium
NAVGPQSGLRSA

SEQ ID NO: 528887 - protein, 5 aa, Mycobacterium
NAVGS

SEQ ID NO: 528888 - protein, 10 aa, Mycobacterium
NAVNSRAGGW

SEQ ID NO: 528889 - protein, 8 aa, Mycobacterium
NAVPDGGV

SEQ ID NO: 528890 - protein, 10 aa, Mycobacterium
NAVPGQASPL

SEQ ID NO: 528891 - protein, 19 aa, Mycobacterium
NAVPSQTTAVRGWETMPTF

SEQ ID NO: 528892 - protein, 17 aa, Mycobacterium
NAVQGSQLASASPSCEY

SEQ ID NO: 528893 - protein, 6 aa, Mycobacterium
NAVRGA

SEQ ID NO: 528894 - protein, 7 aa, Mycobacterium
NAVRPQG

SEQ ID NO: 528895 - protein, 17 aa, Mycobacterium
NAVRPQGRALTDDDRSV

SEQ ID NO: 528896 - protein, 8 aa, Mycobacterium
NAVSSGPA

SEQ ID NO: 528897 - protein, 30 aa, Mycobacterium
NAVTPGGAGGQGGAGGDGGAGGAGGVGGTG

SEQ ID NO: 528898 - protein, 10 aa, Mycobacterium
NAWQGDTGLT

SEQ ID NO: 528899 - protein, 10 aa, Mycobacterium
NAWQGDTGVT

SEQ ID NO: 528900 - protein, 5 aa, Mycobacterium
NAWRT

SEQ ID NO: 528901 - protein, 5 aa, Mycobacterium
NAYAE

SEQ ID NO: 528902 - protein, 11 aa, Mycobacterium
NAYAGDEHEHT

SEQ ID NO: 528903 - protein, 6 aa, Mycobacterium
NAYESA

SEQ ID NO: 528904 - protein, 8 aa, Mycobacterium
NAYGPRGF

SEQ ID NO: 528905 - protein, 7 aa, Mycobacterium
NAYPRTL

SEQ ID NO: 528906 - protein, 4 aa, Mycobacterium
NAYR

SEQ ID NO: 528907 - protein, 13 aa, Mycobacterium
NAYSRSARAGDPE

SEQ ID NO: 528908 - protein, 6 aa, Mycobacterium
NAYTAS

SEQ ID NO: 528909 - protein, 8 aa, Mycobacterium
NAYTDQAT

SEQ ID NO: 528910 - protein, 6 aa, Mycobacterium
NAYTGG

SEQ ID NO: 528911 - protein, 5 aa, Mycobacterium
NCAPS

SEQ ID NO: 528912 - protein, 8 aa, Mycobacterium
NCARDGGA

SEQ ID NO: 528913 - protein, 7 aa, Mycobacterium
NCDPAKF

SEQ ID NO: 528914 - protein, 6 aa, Mycobacterium
NCDPDE

SEQ ID NO: 528915 - protein, 5 aa, Mycobacterium
NCDPG

SEQ ID NO: 528916 - protein, 7 aa, Mycobacterium
NCDSAED

SEQ ID NO: 528917 - protein, 5 aa, Mycobacterium
NCGAS

SEQ ID NO: 528918 - protein, 6 aa, Mycobacterium
NCGNRQ

SEQ ID NO: 528919 - protein, 5 aa, Mycobacterium
NCGRS

SEQ ID NO: 528920 - protein, 5 aa, Mycobacterium
NCGST

SEQ ID NO: 528921 - protein, 5 aa, Mycobacterium
NCPQR

SEQ ID NO: 528922 - protein, 17 aa, Mycobacterium
NCSAADTGLLANTQVPR

SEQ ID NO: 528923 - protein, 9 aa, Mycobacterium
NDAADADRV

SEQ ID NO: 528924 - protein, 6 aa, Mycobacterium
NDAAGI

SEQ ID NO: 528925 - protein, 5 aa, Mycobacterium
NDAAP

SEQ ID NO: 528926 - protein, 8 aa, Mycobacterium
NDAAPALR

SEQ ID NO: 528927 - protein, 13 aa, Mycobacterium
NDAAPSPADASAA

SEQ ID NO: 528928 - protein, 8 aa, Mycobacterium
NDAARSKI

SEQ ID NO: 528929 - protein, 19 aa, Mycobacterium
NDAASADAGPLPGPGARPS

SEQ ID NO: 528930 - protein, 5 aa, Mycobacterium
NDAAT

SEQ ID NO: 528931 - protein, 7 aa, Mycobacterium
NDADGDF

SEQ ID NO: 528932 - protein, 8 aa, Mycobacterium
NDADPYSA

SEQ ID NO: 528933 - protein, 5 aa, Mycobacterium
NDAEL

SEQ ID NO: 528934 - protein, 6 aa, Mycobacterium
NDAELR

SEQ ID NO: 528935 - protein, 5 aa, Mycobacterium
NDAER

SEQ ID NO: 528936 - protein, 6 aa, Mycobacterium
NDAERR

SEQ ID NO: 528937 - protein, 6 aa, Mycobacterium
NDAETP

SEQ ID NO: 528938 - protein, 4 aa, Mycobacterium
NDAG

SEQ ID NO: 528939 - protein, 10 aa, Mycobacterium
NDAGDAASAA

SEQ ID NO: 528940 - protein, 15 aa, Mycobacterium
NDAGEGGDVTASGGI

SEQ ID NO: 528941 - protein, 13 aa, Mycobacterium
NDAGGAPGTDDFN

SEQ ID NO: 528942 - protein, 16 aa, Mycobacterium
NDAGGSDNTTVVVIDL

SEQ ID NO: 528943 - protein, 7 aa, Mycobacterium
NDAGGTD

SEQ ID NO: 528944 - protein, 8 aa, Mycobacterium
NDAGGTDF

SEQ ID NO: 528945 - protein, 10 aa, Mycobacterium
NDAGPEPVSG

SEQ ID NO: 528946 - protein, 5 aa, Mycobacterium
NDAGT

SEQ ID NO: 528947 - protein, 18 aa, Mycobacterium
NDAGVDGVGGAGGAGGAA

SEQ ID NO: 528948 - protein, 4 aa, Mycobacterium
NDAK

SEQ ID NO: 528949 - protein, 7 aa, Mycobacterium
NDAKEGA

SEQ ID NO: 528950 - protein, 8 aa, Mycobacterium
NDAKTGKP

SEQ ID NO: 528951 - protein, 17 aa, Mycobacterium
NDALKAAAAALQKVVTR

SEQ ID NO: 528952 - protein, 7 aa, Mycobacterium
NDALPEA

SEQ ID NO: 528953 - protein, 4 aa, Mycobacterium
NDAN

SEQ ID NO: 528954 - protein, 5 aa, Mycobacterium
NDANI

SEQ ID NO: 528955 - protein, 12 aa, Mycobacterium
NDAPGGGERPRL

SEQ ID NO: 528956 - protein, 7 aa, Mycobacterium
NDAPGQT

SEQ ID NO: 528957 - protein, 7 aa, Mycobacterium
NDAPIRA

SEQ ID NO: 528958 - protein, 5 aa, Mycobacterium
NDAPV

SEQ ID NO: 528959 - protein, 8 aa, Mycobacterium
NDAPVSRA

SEQ ID NO: 528960 - protein, 6 aa, Mycobacterium
NDAQKQ

SEQ ID NO: 528961 - protein, 33 aa, Mycobacterium
NDAQSQPFTTNPELKPQPSSTPPPPPPLPPTPF

SEQ ID NO: 528962 - protein, 33 aa, Mycobacterium
NDAQSQPFTTNPELRPQPSSTPPPPPPLPPTPF

SEQ ID NO: 528963 - protein, 7 aa, Mycobacterium
NDARATI

SEQ ID NO: 528964 - protein, 5 aa, Mycobacterium
NDARV

SEQ ID NO: 528965 - protein, 4 aa, Mycobacterium
NDAS

SEQ ID NO: 528966 - protein, 7 aa, Mycobacterium
NDASTGD

SEQ ID NO: 528967 - protein, 5 aa, Mycobacterium
NDASV

SEQ ID NO: 528968 - protein, 5 aa, Mycobacterium
NDATV

SEQ ID NO: 528969 - protein, 12 aa, Mycobacterium
NDAVDPDSLQPE

SEQ ID NO: 528970 - protein, 7 aa, Mycobacterium
NDAVEES

SEQ ID NO: 528971 - protein, 6 aa, Mycobacterium
NDAVPQ

SEQ ID NO: 528972 - protein, 29 aa, Mycobacterium
NDAVQPDARPKLGLNQPEAVLSGRTPDEP

SEQ ID NO: 528973 - protein, 16 aa, Mycobacterium
NDAVTYPQDGPDQMAA

SEQ ID NO: 528974 - protein, 4 aa, Mycobacterium
NDDA

SEQ ID NO: 528975 - protein, 10 aa, Mycobacterium
NDDAAEAERM

SEQ ID NO: 528976 - protein, 10 aa, Mycobacterium
NDDAASAERM

SEQ ID NO: 528977 - protein, 5 aa, Mycobacterium
NDDAF

SEQ ID NO: 528978 - protein, 8 aa, Mycobacterium
NDDAGGGT

SEQ ID NO: 528979 - protein, 9 aa, Mycobacterium
NDDCPAPRT

SEQ ID NO: 528980 - protein, 10 aa, Mycobacterium
NDDDATGERM

SEQ ID NO: 528981 - protein, 15 aa, Mycobacterium
NDDDRLSDETAAARQ

SEQ ID NO: 528982 - protein, 5 aa, Mycobacterium
NDDEI

SEQ ID NO: 528983 - protein, 5 aa, Mycobacterium
NDDEK

SEQ ID NO: 528984 - protein, 10 aa, Mycobacterium
NDDEKTRSAC

SEQ ID NO: 528985 - protein, 5 aa, Mycobacterium
NDDEQ

SEQ ID NO: 528986 - protein, 7 aa, Mycobacterium
NDDFQDK

SEQ ID NO: 528987 - protein, 10 aa, Mycobacterium
NDDGAFEDQW

SEQ ID NO: 528988 - protein, 11 aa, Mycobacterium
NDDGAIEEAGP

SEQ ID NO: 528989 - protein, 11 aa, Mycobacterium
NDDGAIEEPWP

SEQ ID NO: 528990 - protein, 13 aa, Mycobacterium
NDDGAMDDSLPEH

SEQ ID NO: 528991 - protein, 19 aa, Mycobacterium
NDDGIAAERAATVGNGGHY

SEQ ID NO: 528992 - protein, 15 aa, Mycobacterium
NDDGISGSMAGGYSR

SEQ ID NO: 528993 - protein, 8 aa, Mycobacterium
NDDGLSPL

SEQ ID NO: 528994 - protein, 8 aa, Mycobacterium
NDDGSAWD

SEQ ID NO: 528995 - protein, 10 aa, Mycobacterium
NDDGSDSANI

SEQ ID NO: 528996 - protein, 11 aa, Mycobacterium
NDDGSIEQPWP

SEQ ID NO: 528997 - protein, 16 aa, Mycobacterium
NDDGSTSVIEEPDVEG

SEQ ID NO: 528998 - protein, 20 aa, Mycobacterium
NDDGSVSVADAADTASQPCY

SEQ ID NO: 528999 - protein, 17 aa, Mycobacterium
NDDGTTSVIDDPDEEGE

SEQ ID NO: 529000 - protein, 5 aa, Mycobacterium
NDDHG

SEQ ID NO: 529001 - protein, 10 aa, Mycobacterium
NDDLGRSSAE

SEQ ID NO: 529002 - protein, 7 aa, Mycobacterium
NDDNGRQ

SEQ ID NO: 529003 - protein, 7 aa, Mycobacterium
NDDPALN

SEQ ID NO: 529004 - protein, 9 aa, Mycobacterium
NDDPARAVR

SEQ ID NO: 529005 - protein, 6 aa, Mycobacterium
NDDPEF

SEQ ID NO: 529006 - protein, 7 aa, Mycobacterium
NDDPGVA

SEQ ID NO: 529007 - protein, 5 aa, Mycobacterium
NDDPP

SEQ ID NO: 529008 - protein, 19 aa, Mycobacterium
NDDPQRQPVSRPERRNSVH

SEQ ID NO: 529009 - protein, 6 aa, Mycobacterium
NDDPRE

SEQ ID NO: 529010 - protein, 10 aa, Mycobacterium
NDDPRLADTD

SEQ ID NO: 529011 - protein, 6 aa, Mycobacterium
NDDPSE

SEQ ID NO: 529012 - protein, 7 aa, Mycobacterium
NDDPSEV

SEQ ID NO: 529013 - protein, 8 aa, Mycobacterium
NDDPSQLD

SEQ ID NO: 529014 - protein, 16 aa, Mycobacterium
NDDQDTAPADSADSLN

SEQ ID NO: 529015 - protein, 8 aa, Mycobacterium
NDDQQLGG

SEQ ID NO: 529016 - protein, 8 aa, Mycobacterium
NDDREAAE

SEQ ID NO: 529017 - protein, 7 aa, Mycobacterium
NDDRNDR

SEQ ID NO: 529018 - protein, 7 aa, Mycobacterium
NDDRRRS

SEQ ID NO: 529019 - protein, 4 aa, Mycobacterium
NDDS

SEQ ID NO: 529020 - protein, 14 aa, Mycobacterium
NDDSKPWRSTPVGN

SEQ ID NO: 529021 - protein, 8 aa, Mycobacterium
NDDSTIGR

SEQ ID NO: 529022 - protein, 10 aa, Mycobacterium
NDDTATVGPE

SEQ ID NO: 529023 - protein, 6 aa, Mycobacterium
NDDTGF

SEQ ID NO: 529024 - protein, 5 aa, Mycobacterium
NDDTN

SEQ ID NO: 529025 - protein, 14 aa, Mycobacterium
NDDVDQAPTTPPTV

SEQ ID NO: 529026 - protein, 10 aa, Mycobacterium
NDEAAEAERM

SEQ ID NO: 529027 - protein, 26 aa, Mycobacterium
NDEAAIPAAQEAVGAADDTGNPTAQS

SEQ ID NO: 529028 - protein, 11 aa, Mycobacterium
NDEAASAQRMS

SEQ ID NO: 529029 - protein, 5 aa, Mycobacterium
NDEAL

SEQ ID NO: 529030 - protein, 8 aa, Mycobacterium
NDECPQKA

SEQ ID NO: 529031 - protein, 7 aa, Mycobacterium
NDEDGAL

SEQ ID NO: 529032 - protein, 8 aa, Mycobacterium
NDEDRARR

SEQ ID NO: 529033 - protein, 4 aa, Mycobacterium
NDEE

SEQ ID NO: 529034 - protein, 7 aa, Mycobacterium
NDEEEYR

SEQ ID NO: 529035 - protein, 5 aa, Mycobacterium
NDEEK

SEQ ID NO: 529036 - protein, 6 aa, Mycobacterium
NDEELD

SEQ ID NO: 529037 - protein, 7 aa, Mycobacterium
NDEGRAQ

SEQ ID NO: 529038 - protein, 7 aa, Mycobacterium
NDEGTTV

SEQ ID NO: 529039 - protein, 5 aa, Mycobacterium
NDEHA

SEQ ID NO: 529040 - protein, 9 aa, Mycobacterium
NDEHPAHYD

SEQ ID NO: 529041 - protein, 12 aa, Mycobacterium
NDEKNGGTGAFP

SEQ ID NO: 529042 - protein, 10 aa, Mycobacterium
NDEKSFSSCT

SEQ ID NO: 529043 - protein, 7 aa, Mycobacterium
NDEKYPN

SEQ ID NO: 529044 - protein, 8 aa, Mycobacterium
NDELRAPM

SEQ ID NO: 529045 - protein, 12 aa, Mycobacterium
NDENVTARTRSA

SEQ ID NO: 529046 - protein, 56 aa, Mycobacterium
NDEPDKGKRNDRRDGGQNRNQNRGGGQRNKGGNSGGNKGGNNRGNKGGRRDQPMGS

SEQ ID NO: 529047 - protein, 6 aa, Mycobacterium
NDEPIR

SEQ ID NO: 529048 - protein, 61 aa, Mycobacterium
NDEPQRDRANRADRAPKPRGGADSKLRRDQRNPHHAKGAGRRDSSSSGSSMAQALRDAGFG

SEQ ID NO: 529049 - protein, 8 aa, Mycobacterium
NDEPTDVS

SEQ ID NO: 529050 - protein, 15 aa, Mycobacterium
NDEPTPAAAHPESQL

SEQ ID NO: 529051 - protein, 8 aa, Mycobacterium
NDEQGESP

SEQ ID NO: 529052 - protein, 8 aa, Mycobacterium
NDEQGQSP

SEQ ID NO: 529053 - protein, 16 aa, Mycobacterium
NDEQRGAWPPKKIADE

SEQ ID NO: 529054 - protein, 6 aa, Mycobacterium
NDEQVG

SEQ ID NO: 529055 - protein, 7 aa, Mycobacterium
NDESAVD

SEQ ID NO: 529056 - protein, 6 aa, Mycobacterium
NDESLR

SEQ ID NO: 529057 - protein, 13 aa, Mycobacterium
NDESQKGPRAPKH

SEQ ID NO: 529058 - protein, 6 aa, Mycobacterium
NDESTL

SEQ ID NO: 529059 - protein, 10 aa, Mycobacterium
NDETDGARAY

SEQ ID NO: 529060 - protein, 12 aa, Mycobacterium
NDETHTGLAGHD

SEQ ID NO: 529061 - protein, 8 aa, Mycobacterium
NDEYAGPR

SEQ ID NO: 529062 - protein, 9 aa, Mycobacterium
NDEYAGPRL

SEQ ID NO: 529063 - protein, 7 aa, Mycobacterium
NDEYGEE

SEQ ID NO: 529064 - protein, 14 aa, Mycobacterium
NDFPETRLTPDTDY

SEQ ID NO: 529065 - protein, 6 aa, Mycobacterium
NDFSAA

SEQ ID NO: 529066 - protein, 16 aa, Mycobacterium
NDFSPAKVTQLLLWAM

SEQ ID NO: 529067 - protein, 17 aa, Mycobacterium
NDGAEALPPMTPPSRRR

SEQ ID NO: 529068 - protein, 11 aa, Mycobacterium
NDGAEPKRHPF

SEQ ID NO: 529069 - protein, 5 aa, Mycobacterium
NDGAG

SEQ ID NO: 529070 - protein, 10 aa, Mycobacterium
NDGAGREETR

SEQ ID NO: 529071 - protein, 7 aa, Mycobacterium
NDGAGYI

SEQ ID NO: 529072 - protein, 8 aa, Mycobacterium
NDGAIGDI

SEQ ID NO: 529073 - protein, 17 aa, Mycobacterium
NDGARTVPPRENGGNHD

SEQ ID NO: 529074 - protein, 7 aa, Mycobacterium
NDGASAA

SEQ ID NO: 529075 - protein, 6 aa, Mycobacterium
NDGATI

SEQ ID NO: 529076 - protein, 4 aa, Mycobacterium
NDGC

SEQ ID NO: 529077 - protein, 10 aa, Mycobacterium
NDGDDADRVE

SEQ ID NO: 529078 - protein, 7 aa, Mycobacterium
NDGDDID

SEQ ID NO: 529079 - protein, 6 aa, Mycobacterium
NDGDLR

SEQ ID NO: 529080 - protein, 5 aa, Mycobacterium
NDGEI

SEQ ID NO: 529081 - protein, 7 aa, Mycobacterium
NDGEPEF

SEQ ID NO: 529082 - protein, 4 aa, Mycobacterium
NDGF

SEQ ID NO: 529083 - protein, 13 aa, Mycobacterium
NDGGAAAAAGLPS

SEQ ID NO: 529084 - protein, 11 aa, Mycobacterium
NDGGGGDSFAT

SEQ ID NO: 529085 - protein, 7 aa, Mycobacterium
NDGGHTL

SEQ ID NO: 529086 - protein, 6 aa, Mycobacterium
NDGGKA

SEQ ID NO: 529087 - protein, 8 aa, Mycobacterium
NDGGTEKV

SEQ ID NO: 529088 - protein, 9 aa, Mycobacterium
NDGGTEKVE

SEQ ID NO: 529089 - protein, 8 aa, Mycobacterium
NDGGTETV

SEQ ID NO: 529090 - protein, 9 aa, Mycobacterium
NDGGTETVT

SEQ ID NO: 529091 - protein, 6 aa, Mycobacterium
NDGGTL

SEQ ID NO: 529092 - protein, 4 aa, Mycobacterium
NDGI

SEQ ID NO: 529093 - protein, 15 aa, Mycobacterium
NDGIGGAGGAGGSGG

SEQ ID NO: 529094 - protein, 10 aa, Mycobacterium
NDGIGHDAGD

SEQ ID NO: 529095 - protein, 5 aa, Mycobacterium
NDGKR

SEQ ID NO: 529096 - protein, 9 aa, Mycobacterium
NDGKTPKTV

SEQ ID NO: 529097 - protein, 7 aa, Mycobacterium
NDGNGRI

SEQ ID NO: 529098 - protein, 11 aa, Mycobacterium
NDGPAPGHPPP

SEQ ID NO: 529099 - protein, 9 aa, Mycobacterium
NDGPGDGRV

SEQ ID NO: 529100 - protein, 6 aa, Mycobacterium
NDGPHP

SEQ ID NO: 529101 - protein, 7 aa, Mycobacterium
NDGPIRA

SEQ ID NO: 529102 - protein, 7 aa, Mycobacterium
NDGPSAL

SEQ ID NO: 529103 - protein, 9 aa, Mycobacterium
NDGQKMSKS

SEQ ID NO: 529104 - protein, 14 aa, Mycobacterium
NDGQKMSKSLRNYP

SEQ ID NO: 529105 - protein, 15 aa, Mycobacterium
NDGQKMSKSLRNYPD

SEQ ID NO: 529106 - protein, 15 aa, Mycobacterium
NDGRDVQGPPAADSA

SEQ ID NO: 529107 - protein, 7 aa, Mycobacterium
NDGRIDG

SEQ ID NO: 529108 - protein, 6 aa, Mycobacterium
NDGSFN

SEQ ID NO: 529109 - protein, 6 aa, Mycobacterium
NDGSFP

SEQ ID NO: 529110 - protein, 6 aa, Mycobacterium
NDGSLP

SEQ ID NO: 529111 - protein, 9 aa, Mycobacterium
NDGSPAGVA

SEQ ID NO: 529112 - protein, 9 aa, Mycobacterium
NDGSSVADY

SEQ ID NO: 529113 - protein, 13 aa, Mycobacterium
NDGTEPQRRPHGA

SEQ ID NO: 529114 - protein, 7 aa, Mycobacterium
NDGTPEA

SEQ ID NO: 529115 - protein, 8 aa, Mycobacterium
NDGTPEAY

SEQ ID NO: 529116 - protein, 7 aa, Mycobacterium
NDGTPEE

SEQ ID NO: 529117 - protein, 7 aa, Mycobacterium
NDGVAGA

SEQ ID NO: 529118 - protein, 10 aa, Mycobacterium
NDGVDGSGTR

SEQ ID NO: 529119 - protein, 10 aa, Mycobacterium
NDGVGGRYTA

SEQ ID NO: 529120 - protein, 10 aa, Mycobacterium
NDGVQGPSVA

SEQ ID NO: 529121 - protein, 7 aa, Mycobacterium
NDGVSQT

SEQ ID NO: 529122 - protein, 15 aa, Mycobacterium
NDGVTETAQDRKARG

SEQ ID NO: 529123 - protein, 4 aa, Mycobacterium
NDGY

SEQ ID NO: 529124 - protein, 5 aa, Mycobacterium
NDGYA

SEQ ID NO: 529125 - protein, 9 aa, Mycobacterium
NDHDSVGGN

SEQ ID NO: 529126 - protein, 4 aa, Mycobacterium
NDHG

SEQ ID NO: 529127 - protein, 7 aa, Mycobacterium
NDHLPEG

SEQ ID NO: 529128 - protein, 5 aa, Mycobacterium
NDHLS

SEQ ID NO: 529129 - protein, 7 aa, Mycobacterium
NDHPEDF

SEQ ID NO: 529130 - protein, 6 aa, Mycobacterium
NDHPTL

SEQ ID NO: 529131 - protein, 8 aa, Mycobacterium
NDHRRDST

SEQ ID NO: 529132 - protein, 18 aa, Mycobacterium
NDIDPEIDNTAEVETQTE

SEQ ID NO: 529133 - protein, 5 aa, Mycobacterium
NDIGG

SEQ ID NO: 529134 - protein, 6 aa, Mycobacterium
NDINAA

SEQ ID NO: 529135 - protein, 8 aa, Mycobacterium
NDIPTTER

SEQ ID NO: 529136 - protein, 9 aa, Mycobacterium
NDITGPRSV

SEQ ID NO: 529137 - protein, 8 aa, Mycobacterium
NDKARDRL

SEQ ID NO: 529138 - protein, 8 aa, Mycobacterium
NDKGEFVT

SEQ ID NO: 529139 - protein, 21 aa, Mycobacterium
NDKHNEANGEDNNDGESHNRS

SEQ ID NO: 529140 - protein, 8 aa, Mycobacterium
NDKNPRSA

SEQ ID NO: 529141 - protein, 8 aa, Mycobacterium
NDKPADTH

SEQ ID NO: 529142 - protein, 10 aa, Mycobacterium
NDKPAPHGDY

SEQ ID NO: 529143 - protein, 8 aa, Mycobacterium
NDKSQIDD

SEQ ID NO: 529144 - protein, 8 aa, Mycobacterium
NDKSSRSA

SEQ ID NO: 529145 - protein, 13 aa, Mycobacterium
NDLAGIGSTLSQA

SEQ ID NO: 529146 - protein, 7 aa, Mycobacterium
NDLAPNG

SEQ ID NO: 529147 - protein, 13 aa, Mycobacterium
NDLARGGDALTDR

SEQ ID NO: 529148 - protein, 4 aa, Mycobacterium
NDLD

SEQ ID NO: 529149 - protein, 8 aa, Mycobacterium
NDLDTAQK

SEQ ID NO: 529150 - protein, 5 aa, Mycobacterium
NDLER

SEQ ID NO: 529151 - protein, 7 aa, Mycobacterium
NDLGGIG

SEQ ID NO: 529152 - protein, 8 aa, Mycobacterium
NDLGSPAM

SEQ ID NO: 529153 - protein, 8 aa, Mycobacterium
NDLPRRAP

SEQ ID NO: 529154 - protein, 7 aa, Mycobacterium
NDLRGAD

SEQ ID NO: 529155 - protein, 6 aa, Mycobacterium
NDLSAA

SEQ ID NO: 529156 - protein, 6 aa, Mycobacterium
NDLSGI

SEQ ID NO: 529157 - protein, 5 aa, Mycobacterium
NDLSH

SEQ ID NO: 529158 - protein, 11 aa, Mycobacterium
NDLSPGDDHSL

SEQ ID NO: 529159 - protein, 8 aa, Mycobacterium
NDMAPRDR

SEQ ID NO: 529160 - protein, 4 aa, Mycobacterium
NDMR

SEQ ID NO: 529161 - protein, 7 aa, Mycobacterium
NDNDPAI

SEQ ID NO: 529162 - protein, 7 aa, Mycobacterium
NDNDPQV

SEQ ID NO: 529163 - protein, 15 aa, Mycobacterium
NDNGAVTDTSTIGAA

SEQ ID NO: 529164 - protein, 8 aa, Mycobacterium
NDNGRVRS

SEQ ID NO: 529165 - protein, 6 aa, Mycobacterium
NDNPAV

SEQ ID NO: 529166 - protein, 6 aa, Mycobacterium
NDNRLG

SEQ ID NO: 529167 - protein, 16 aa, Mycobacterium
NDNTAAEATASGVGGN

SEQ ID NO: 529168 - protein, 9 aa, Mycobacterium
NDNTGSGRS

SEQ ID NO: 529169 - protein, 7 aa, Mycobacterium
NDNTTPT

SEQ ID NO: 529170 - protein, 8 aa, Mycobacterium
NDPAAAAA

SEQ ID NO: 529171 - protein, 5 aa, Mycobacterium
NDPAE

SEQ ID NO: 529172 - protein, 6 aa, Mycobacterium
NDPAEL

SEQ ID NO: 529173 - protein, 6 aa, Mycobacterium
NDPAET

SEQ ID NO: 529174 - protein, 5 aa, Mycobacterium
NDPAG

SEQ ID NO: 529175 - protein, 6 aa, Mycobacterium
NDPAGA

SEQ ID NO: 529176 - protein, 15 aa, Mycobacterium
NDPAGVRPTNGAGRA

SEQ ID NO: 529177 - protein, 9 aa, Mycobacterium
NDPAHPDHA

SEQ ID NO: 529178 - protein, 8 aa, Mycobacterium
NDPALPEL

SEQ ID NO: 529179 - protein, 5 aa, Mycobacterium
NDPAM

SEQ ID NO: 529180 - protein, 6 aa, Mycobacterium
NDPASA

SEQ ID NO: 529181 - protein, 11 aa, Mycobacterium
NDPATGQPMTT

SEQ ID NO: 529182 - protein, 12 aa, Mycobacterium
NDPATGQPMTTS

SEQ ID NO: 529183 - protein, 6 aa, Mycobacterium
NDPAVI

SEQ ID NO: 529184 - protein, 7 aa, Mycobacterium
NDPDAAR

SEQ ID NO: 529185 - protein, 12 aa, Mycobacterium
NDPDAARPVAGA

SEQ ID NO: 529186 - protein, 15 aa, Mycobacterium
NDPDAAVPVAGATEA

SEQ ID NO: 529187 - protein, 6 aa, Mycobacterium
NDPDAN

SEQ ID NO: 529188 - protein, 10 aa, Mycobacterium
NDPDAPTKDQ

SEQ ID NO: 529189 - protein, 7 aa, Mycobacterium
NDPDART

SEQ ID NO: 529190 - protein, 5 aa, Mycobacterium
NDPDG

SEQ ID NO: 529191 - protein, 10 aa, Mycobacterium
NDPDKGANGI

SEQ ID NO: 529192 - protein, 5 aa, Mycobacterium
NDPDL

SEQ ID NO: 529193 - protein, 6 aa, Mycobacterium
NDPDRL

SEQ ID NO: 529194 - protein, 9 aa, Mycobacterium
NDPDRLTTP

SEQ ID NO: 529195 - protein, 8 aa, Mycobacterium
NDPDRRNA

SEQ ID NO: 529196 - protein, 7 aa, Mycobacterium
NDPDSTF

SEQ ID NO: 529197 - protein, 9 aa, Mycobacterium
NDPEANAER

SEQ ID NO: 529198 - protein, 5 aa, Mycobacterium
NDPEH

SEQ ID NO: 529199 - protein, 6 aa, Mycobacterium
NDPESL

SEQ ID NO: 529200 - protein, 5 aa, Mycobacterium
NDPEV

SEQ ID NO: 529201 - protein, 15 aa, Mycobacterium
NDPEVDPETGKPWSG

SEQ ID NO: 529202 - protein, 4 aa, Mycobacterium
NDPG

SEQ ID NO: 529203 - protein, 9 aa, Mycobacterium
NDPGANAER

SEQ ID NO: 529204 - protein, 9 aa, Mycobacterium
NDPGATAER

SEQ ID NO: 529205 - protein, 8 aa, Mycobacterium
NDPGMDGT

SEQ ID NO: 529206 - protein, 7 aa, Mycobacterium
NDPGRRV

SEQ ID NO: 529207 - protein, 9 aa, Mycobacterium
NDPGVPGGR

SEQ ID NO: 529208 - protein, 4 aa, Mycobacterium
NDPI

SEQ ID NO: 529209 - protein, 18 aa, Mycobacterium
NDPLAARATGAVADAEGT

SEQ ID NO: 529210 - protein, 5 aa, Mycobacterium
NDPLG

SEQ ID NO: 529211 - protein, 6 aa, Mycobacterium
NDPNQG

SEQ ID NO: 529212 - protein, 6 aa, Mycobacterium
NDPPPC

SEQ ID NO: 529213 - protein, 5 aa, Mycobacterium
NDPPR

SEQ ID NO: 529214 - protein, 8 aa, Mycobacterium
NDPPSIRS

SEQ ID NO: 529215 - protein, 15 aa, Mycobacterium
NDPPTDPETGKPWSG

SEQ ID NO: 529216 - protein, 10 aa, Mycobacterium
NDPPVTPEEP

SEQ ID NO: 529217 - protein, 10 aa, Mycobacterium
NDPQAEAERM

SEQ ID NO: 529218 - protein, 5 aa, Mycobacterium
NDPQD

SEQ ID NO: 529219 - protein, 14 aa, Mycobacterium
NDPQFAAAKPATAI

SEQ ID NO: 529220 - protein, 19 aa, Mycobacterium
NDPQFRAAAPSPEVTEAAH

SEQ ID NO: 529221 - protein, 6 aa, Mycobacterium
NDPQLQ

SEQ ID NO: 529222 - protein, 20 aa, Mycobacterium
NDPQRAAAVREASRADRERY

SEQ ID NO: 529223 - protein, 7 aa, Mycobacterium
NDPREFR

SEQ ID NO: 529224 - protein, 13 aa, Mycobacterium
NDPRGFASTRTRE

SEQ ID NO: 529225 - protein, 6 aa, Mycobacterium
NDPRGI

SEQ ID NO: 529226 - protein, 8 aa, Mycobacterium
NDPRHPTQ

SEQ ID NO: 529227 - protein, 5 aa, Mycobacterium
NDPRL

SEQ ID NO: 529228 - protein, 11 aa, Mycobacterium
NDPRPTPETRD

SEQ ID NO: 529229 - protein, 13 aa, Mycobacterium
NDPRTLAQRRADA

SEQ ID NO: 529230 - protein, 8 aa, Mycobacterium
NDPRTPDY

SEQ ID NO: 529231 - protein, 6 aa, Mycobacterium
NDPRTV

SEQ ID NO: 529232 - protein, 22 aa, Mycobacterium
NDPRTWNQRRADAAGALGRGEA

SEQ ID NO: 529233 - protein, 5 aa, Mycobacterium
NDPRV

SEQ ID NO: 529234 - protein, 9 aa, Mycobacterium
NDPSAWPGL

SEQ ID NO: 529235 - protein, 9 aa, Mycobacterium
NDPSRSREE

SEQ ID NO: 529236 - protein, 4 aa, Mycobacterium
NDPT

SEQ ID NO: 529237 - protein, 12 aa, Mycobacterium
NDPTADGGGQTI

SEQ ID NO: 529238 - protein, 5 aa, Mycobacterium
NDPTL

SEQ ID NO: 529239 - protein, 6 aa, Mycobacterium
NDPTLA

SEQ ID NO: 529240 - protein, 7 aa, Mycobacterium
NDPTLEA

SEQ ID NO: 529241 - protein, 5 aa, Mycobacterium
NDPTM

SEQ ID NO: 529242 - protein, 5 aa, Mycobacterium
NDPTP

SEQ ID NO: 529243 - protein, 5 aa, Mycobacterium
NDPTV

SEQ ID NO: 529244 - protein, 4 aa, Mycobacterium
NDPV

SEQ ID NO: 529245 - protein, 7 aa, Mycobacterium
NDPVDAD

SEQ ID NO: 529246 - protein, 7 aa, Mycobacterium
NDQASEL

SEQ ID NO: 529247 - protein, 9 aa, Mycobacterium
NDQDATDDR

SEQ ID NO: 529248 - protein, 10 aa, Mycobacterium
NDQDRTLPCN

SEQ ID NO: 529249 - protein, 5 aa, Mycobacterium
NDQEL

SEQ ID NO: 529250 - protein, 9 aa, Mycobacterium
NDQGATDQR

SEQ ID NO: 529251 - protein, 10 aa, Mycobacterium
NDQGDPPFQG

SEQ ID NO: 529252 - protein, 10 aa, Mycobacterium
NDQGDPPYRS

SEQ ID NO: 529253 - protein, 7 aa, Mycobacterium
NDQIRQQ

SEQ ID NO: 529254 - protein, 8 aa, Mycobacterium
NDQKSNLS

SEQ ID NO: 529255 - protein, 11 aa, Mycobacterium
NDQRIHGTNRR

SEQ ID NO: 529256 - protein, 5 aa, Mycobacterium
NDQTF

SEQ ID NO: 529257 - protein, 7 aa, Mycobacterium
NDQTPEL

SEQ ID NO: 529258 - protein, 6 aa, Mycobacterium
NDRAAL

SEQ ID NO: 529259 - protein, 8 aa, Mycobacterium
NDRAQNIA

SEQ ID NO: 529260 - protein, 9 aa, Mycobacterium
NDRAQREAR

SEQ ID NO: 529261 - protein, 5 aa, Mycobacterium
NDRAR

SEQ ID NO: 529262 - protein, 8 aa, Mycobacterium
NDRASGRQ

SEQ ID NO: 529263 - protein, 5 aa, Mycobacterium
NDRDG

SEQ ID NO: 529264 - protein, 7 aa, Mycobacterium
NDRDGGD

SEQ ID NO: 529265 - protein, 6 aa, Mycobacterium
NDRDLS

SEQ ID NO: 529266 - protein, 10 aa, Mycobacterium
NDRDTADGLR

SEQ ID NO: 529267 - protein, 8 aa, Mycobacterium
NDRDTNGD

SEQ ID NO: 529268 - protein, 10 aa, Mycobacterium
NDRDTPQAVP

SEQ ID NO: 529269 - protein, 8 aa, Mycobacterium
NDRDTTQL

SEQ ID NO: 529270 - protein, 5 aa, Mycobacterium
NDREH

SEQ ID NO: 529271 - protein, 6 aa, Mycobacterium
NDRENF

SEQ ID NO: 529272 - protein, 16 aa, Mycobacterium
NDRETALRDQQERHGA

SEQ ID NO: 529273 - protein, 9 aa, Mycobacterium
NDRETTQTV

SEQ ID NO: 529274 - protein, 15 aa, Mycobacterium
NDRFPNGLGNNDDQV

SEQ ID NO: 529275 - protein, 4 aa, Mycobacterium
NDRG

SEQ ID NO: 529276 - protein, 6 aa, Mycobacterium
NDRGDG

SEQ ID NO: 529277 - protein, 18 aa, Mycobacterium
NDRGMVGDHGDAAEAIQR

SEQ ID NO: 529278 - protein, 8 aa, Mycobacterium
NDRGRRVV

SEQ ID NO: 529279 - protein, 12 aa, Mycobacterium
NDRGTMTSAAPK

SEQ ID NO: 529280 - protein, 6 aa, Mycobacterium
NDRGTV

SEQ ID NO: 529281 - protein, 5 aa, Mycobacterium
NDRIT

SEQ ID NO: 529282 - protein, 10 aa, Mycobacterium
NDRNGHPAGD

SEQ ID NO: 529283 - protein, 20 aa, Mycobacterium
NDRNREPDVAQQAPQGAGID

SEQ ID NO: 529284 - protein, 5 aa, Mycobacterium
NDRPD

SEQ ID NO: 529285 - protein, 9 aa, Mycobacterium
NDRPPDHQY

SEQ ID NO: 529286 - protein, 8 aa, Mycobacterium
NDRPPDRH

SEQ ID NO: 529287 - protein, 8 aa, Mycobacterium
NDRPTGTF

SEQ ID NO: 529288 - protein, 10 aa, Mycobacterium
NDRQRPADLT

SEQ ID NO: 529289 - protein, 28 aa, Mycobacterium
NDRREEGDLRENGGYHAAREQQGQEEAR

SEQ ID NO: 529290 - protein, 14 aa, Mycobacterium
NDRRGTDGSRGHRR

SEQ ID NO: 529291 - protein, 6 aa, Mycobacterium
NDRRSA

SEQ ID NO: 529292 - protein, 10 aa, Mycobacterium
NDRSAMRDPG

SEQ ID NO: 529293 - protein, 9 aa, Mycobacterium
NDRSEGDLR

SEQ ID NO: 529294 - protein, 13 aa, Mycobacterium
NDRTDSRRNFDGR

SEQ ID NO: 529295 - protein, 6 aa, Mycobacterium
NDRTDV

SEQ ID NO: 529296 - protein, 5 aa, Mycobacterium
NDRTH

SEQ ID NO: 529297 - protein, 22 aa, Mycobacterium
NDRVAPAAAARRTARKAGPLGQ

SEQ ID NO: 529298 - protein, 7 aa, Mycobacterium
NDRVREN

SEQ ID NO: 529299 - protein, 13 aa, Mycobacterium
NDRYSRGKGDRNL

SEQ ID NO: 529300 - protein, 14 aa, Mycobacterium
NDSAPSRRGRSMPP

SEQ ID NO: 529301 - protein, 13 aa, Mycobacterium
NDSASSVTGSLSD

SEQ ID NO: 529302 - protein, 6 aa, Mycobacterium
NDSCSN

SEQ ID NO: 529303 - protein, 5 aa, Mycobacterium
NDSDC

SEQ ID NO: 529304 - protein, 7 aa, Mycobacterium
NDSDRDI

SEQ ID NO: 529305 - protein, 8 aa, Mycobacterium
NDSDYGLG

SEQ ID NO: 529306 - protein, 15 aa, Mycobacterium
NDSEKTASSRHPAHE

SEQ ID NO: 529307 - protein, 7 aa, Mycobacterium
NDSFNEN

SEQ ID NO: 529308 - protein, 6 aa, Mycobacterium
NDSGAQ

SEQ ID NO: 529309 - protein, 9 aa, Mycobacterium
NDSGGLARQ

SEQ ID NO: 529310 - protein, 6 aa, Mycobacterium
NDSGHN

SEQ ID NO: 529311 - protein, 13 aa, Mycobacterium
NDSGPVTPIAVPS

SEQ ID NO: 529312 - protein, 10 aa, Mycobacterium
NDSGRPGTPL

SEQ ID NO: 529313 - protein, 9 aa, Mycobacterium
NDSKADLST

SEQ ID NO: 529314 - protein, 5 aa, Mycobacterium
NDSLT

SEQ ID NO: 529315 - protein, 7 aa, Mycobacterium
NDSLTPD

SEQ ID NO: 529316 - protein, 5 aa, Mycobacterium
NDSMS

SEQ ID NO: 529317 - protein, 10 aa, Mycobacterium
NDSPDTDRSG

SEQ ID NO: 529318 - protein, 18 aa, Mycobacterium
NDSPGRGARRISADGAPT

SEQ ID NO: 529319 - protein, 14 aa, Mycobacterium
NDSPTLDGKPESSL

SEQ ID NO: 529320 - protein, 24 aa, Mycobacterium
NDSPVNDDSNTAFGGEKSSGVGRF

SEQ ID NO: 529321 - protein, 7 aa, Mycobacterium
NDSQLAS

SEQ ID NO: 529322 - protein, 31 aa, Mycobacterium
NDSQLPSSAPSTPTEAAPSTPAGPKKPDGVT

SEQ ID NO: 529323 - protein, 11 aa, Mycobacterium
NDSQVDGPTHT

SEQ ID NO: 529324 - protein, 6 aa, Mycobacterium
NDSRSE

SEQ ID NO: 529325 - protein, 7 aa, Mycobacterium
NDSSGFF

SEQ ID NO: 529326 - protein, 9 aa, Mycobacterium
NDSSLGPAV

SEQ ID NO: 529327 - protein, 7 aa, Mycobacterium
NDSSPHW

SEQ ID NO: 529328 - protein, 18 aa, Mycobacterium
NDSTAFAGGETGDEGNRD

SEQ ID NO: 529329 - protein, 4 aa, Mycobacterium
NDSV

SEQ ID NO: 529330 - protein, 7 aa, Mycobacterium
NDTAADH

SEQ ID NO: 529331 - protein, 6 aa, Mycobacterium
NDTALR

SEQ ID NO: 529332 - protein, 6 aa, Mycobacterium
NDTAQR

SEQ ID NO: 529333 - protein, 23 aa, Mycobacterium
NDTARAAGQAAADLQRAGGGLGE

SEQ ID NO: 529334 - protein, 13 aa, Mycobacterium
NDTARAAGQAAKD

SEQ ID NO: 529335 - protein, 4 aa, Mycobacterium
NDTD

SEQ ID NO: 529336 - protein, 6 aa, Mycobacterium
NDTDYG

SEQ ID NO: 529337 - protein, 5 aa, Mycobacterium
NDTES

SEQ ID NO: 529338 - protein, 7 aa, Mycobacterium
NDTGESV

SEQ ID NO: 529339 - protein, 7 aa, Mycobacterium
NDTGGAV

SEQ ID NO: 529340 - protein, 18 aa, Mycobacterium
NDTGGSLAGAGGDPAPAH

SEQ ID NO: 529341 - protein, 8 aa, Mycobacterium
NDTGTPEQ

SEQ ID NO: 529342 - protein, 7 aa, Mycobacterium
NDTHGHA

SEQ ID NO: 529343 - protein, 5 aa, Mycobacterium
NDTHY

SEQ ID NO: 529344 - protein, 13 aa, Mycobacterium
NDTIDGKQRSRSV

SEQ ID NO: 529345 - protein, 20 aa, Mycobacterium
NDTITLDDGSTTTVTSPDQV

SEQ ID NO: 529346 - protein, 5 aa, Mycobacterium
NDTKA

SEQ ID NO: 529347 - protein, 14 aa, Mycobacterium
NDTLTGSAAGAAAA

SEQ ID NO: 529348 - protein, 10 aa, Mycobacterium
NDTNVPPSES

SEQ ID NO: 529349 - protein, 7 aa, Mycobacterium
NDTNYGL

SEQ ID NO: 529350 - protein, 10 aa, Mycobacterium
NDTPSSTAGF

SEQ ID NO: 529351 - protein, 7 aa, Mycobacterium
NDTPYGL

SEQ ID NO: 529352 - protein, 8 aa, Mycobacterium
NDTRELSS

SEQ ID NO: 529353 - protein, 6 aa, Mycobacterium
NDTRIS

SEQ ID NO: 529354 - protein, 7 aa, Mycobacterium
NDTRRGW

SEQ ID NO: 529355 - protein, 5 aa, Mycobacterium
NDTRT

SEQ ID NO: 529356 - protein, 7 aa, Mycobacterium
NDTSAMD

SEQ ID NO: 529357 - protein, 7 aa, Mycobacterium
NDTSYGL

SEQ ID NO: 529358 - protein, 5 aa, Mycobacterium
NDTTA

SEQ ID NO: 529359 - protein, 8 aa, Mycobacterium
NDTTLSPR

SEQ ID NO: 529360 - protein, 9 aa, Mycobacterium
NDTTRNSMS

SEQ ID NO: 529361 - protein, 11 aa, Mycobacterium
NDTTSATTPMT

SEQ ID NO: 529362 - protein, 6 aa, Mycobacterium
NDTTYG

SEQ ID NO: 529363 - protein, 8 aa, Mycobacterium
NDTVGAAN

SEQ ID NO: 529364 - protein, 9 aa, Mycobacterium
NDTVGTQDT

SEQ ID NO: 529365 - protein, 6 aa, Mycobacterium
NDTVND

SEQ ID NO: 529366 - protein, 13 aa, Mycobacterium
NDVAKTSIGKPKR

SEQ ID NO: 529367 - protein, 6 aa, Mycobacterium
NDVGGA

SEQ ID NO: 529368 - protein, 5 aa, Mycobacterium
NDVNA

SEQ ID NO: 529369 - protein, 10 aa, Mycobacterium
NDVPADPPGY

SEQ ID NO: 529370 - protein, 4 aa, Mycobacterium
NDVR

SEQ ID NO: 529371 - protein, 14 aa, Mycobacterium
NDVSARDAATPLSG

SEQ ID NO: 529372 - protein, 14 aa, Mycobacterium
NDVSARDQQRKDGQ

SEQ ID NO: 529373 - protein, 15 aa, Mycobacterium
NDVTNADTSGTPGPE

SEQ ID NO: 529374 - protein, 8 aa, Mycobacterium
NDVTPNDE

SEQ ID NO: 529375 - protein, 7 aa, Mycobacterium
NDVTSWS

SEQ ID NO: 529376 - protein, 6 aa, Mycobacterium
NDWDDV

SEQ ID NO: 529377 - protein, 12 aa, Mycobacterium
NDYADRKNNRQA

SEQ ID NO: 529378 - protein, 13 aa, Mycobacterium
NDYADRKNNRQAV

SEQ ID NO: 529379 - protein, 23 aa, Mycobacterium
NDYAEGKADTITGIQTNDDTGDI

SEQ ID NO: 529380 - protein, 4 aa, Mycobacterium
NDYD

SEQ ID NO: 529381 - protein, 6 aa, Mycobacterium
NDYGND

SEQ ID NO: 529382 - protein, 11 aa, Mycobacterium
NDYGSLQHGGP

SEQ ID NO: 529383 - protein, 6 aa, Mycobacterium
NDYQPT

SEQ ID NO: 529384 - protein, 7 aa, Mycobacterium
NDYRAAA

SEQ ID NO: 529385 - protein, 4 aa, Mycobacterium
NDYS

SEQ ID NO: 529386 - protein, 4 aa, Mycobacterium
NDYT

SEQ ID NO: 529387 - protein, 4 aa, Mycobacterium
NEAA

SEQ ID NO: 529388 - protein, 9 aa, Mycobacterium
NEAAASSGV

SEQ ID NO: 529389 - protein, 7 aa, Mycobacterium
NEAADRD

SEQ ID NO: 529390 - protein, 5 aa, Mycobacterium
NEAAR

SEQ ID NO: 529391 - protein, 6 aa, Mycobacterium
NEAART

SEQ ID NO: 529392 - protein, 7 aa, Mycobacterium
NEADEPA

SEQ ID NO: 529393 - protein, 24 aa, Mycobacterium
NEADGSRADGQSPAAAATSEKDIA

SEQ ID NO: 529394 - protein, 9 aa, Mycobacterium
NEADTAPLA

SEQ ID NO: 529395 - protein, 5 aa, Mycobacterium
NEADV

SEQ ID NO: 529396 - protein, 15 aa, Mycobacterium
NEAEAVLERDRPASS

SEQ ID NO: 529397 - protein, 8 aa, Mycobacterium
NEAELAPT

SEQ ID NO: 529398 - protein, 6 aa, Mycobacterium
NEAELG

SEQ ID NO: 529399 - protein, 5 aa, Mycobacterium
NEAFR

SEQ ID NO: 529400 - protein, 8 aa, Mycobacterium
NEAFRDGY

SEQ ID NO: 529401 - protein, 4 aa, Mycobacterium
NEAG

SEQ ID NO: 529402 - protein, 5 aa, Mycobacterium
NEAGA

SEQ ID NO: 529403 - protein, 8 aa, Mycobacterium
NEAGDRDI

SEQ ID NO: 529404 - protein, 9 aa, Mycobacterium
NEAGGLNES

SEQ ID NO: 529405 - protein, 9 aa, Mycobacterium
NEAGGRDAV

SEQ ID NO: 529406 - protein, 6 aa, Mycobacterium
NEAGGV

SEQ ID NO: 529407 - protein, 5 aa, Mycobacterium
NEAGI

SEQ ID NO: 529408 - protein, 11 aa, Mycobacterium
NEAGSTSSFTA

SEQ ID NO: 529409 - protein, 20 aa, Mycobacterium
NEAGSVGSFTAAGTSYATHN

SEQ ID NO: 529410 - protein, 12 aa, Mycobacterium
NEAHAAGNGEIA

SEQ ID NO: 529411 - protein, 69 aa, Mycobacterium
NEAIGAAAKDSPLQEKYGHTAEPPARPQPSPQDPQAPQAQSDYPPVPSNEPVPPMPEPAEPKGEKGPSM

SEQ ID NO: 529412 - protein, 5 aa, Mycobacterium
NEAIY

SEQ ID NO: 529413 - protein, 5 aa, Mycobacterium
NEANA

SEQ ID NO: 529414 - protein, 12 aa, Mycobacterium
NEANGIDPKPLR

SEQ ID NO: 529415 - protein, 12 aa, Mycobacterium
NEANGIDPQPLR

SEQ ID NO: 529416 - protein, 15 aa, Mycobacterium
NEANTEPIADSGFDS

SEQ ID NO: 529417 - protein, 9 aa, Mycobacterium
NEANTEPIV

SEQ ID NO: 529418 - protein, 9 aa, Mycobacterium
NEANTQPLA

SEQ ID NO: 529419 - protein, 5 aa, Mycobacterium
NEANV

SEQ ID NO: 529420 - protein, 4 aa, Mycobacterium
NEAP

SEQ ID NO: 529421 - protein, 7 aa, Mycobacterium
NEAQTTD

SEQ ID NO: 529422 - protein, 6 aa, Mycobacterium
NEARAQ

SEQ ID NO: 529423 - protein, 19 aa, Mycobacterium
NEARAQPGNFATADSAEAY

SEQ ID NO: 529424 - protein, 9 aa, Mycobacterium
NEARDEGKR

SEQ ID NO: 529425 - protein, 6 aa, Mycobacterium
NEAREG

SEQ ID NO: 529426 - protein, 10 aa, Mycobacterium
NEARGLDPAL

SEQ ID NO: 529427 - protein, 7 aa, Mycobacterium
NEARTYA

SEQ ID NO: 529428 - protein, 8 aa, Mycobacterium
NEASESDI

SEQ ID NO: 529429 - protein, 7 aa, Mycobacterium
NEASRVP

SEQ ID NO: 529430 - protein, 10 aa, Mycobacterium
NEASSGPEAH

SEQ ID NO: 529431 - protein, 11 aa, Mycobacterium
NEATDGRSGAI

SEQ ID NO: 529432 - protein, 10 aa, Mycobacterium
NEATDGVGGA

SEQ ID NO: 529433 - protein, 5 aa, Mycobacterium
NEATG

SEQ ID NO: 529434 - protein, 9 aa, Mycobacterium
NEATGAETV

SEQ ID NO: 529435 - protein, 11 aa, Mycobacterium
NEATGSPTGFR

SEQ ID NO: 529436 - protein, 10 aa, Mycobacterium
NEATRSRDEL

SEQ ID NO: 529437 - protein, 9 aa, Mycobacterium
NEATRSREE

SEQ ID NO: 529438 - protein, 4 aa, Mycobacterium
NEAV

SEQ ID NO: 529439 - protein, 6 aa, Mycobacterium
NEAVPQ

SEQ ID NO: 529440 - protein, 4 aa, Mycobacterium
NECP

SEQ ID NO: 529441 - protein, 4 aa, Mycobacterium
NECR

SEQ ID NO: 529442 - protein, 4 aa, Mycobacterium
NEDA

SEQ ID NO: 529443 - protein, 8 aa, Mycobacterium
NEDADPSV

SEQ ID NO: 529444 - protein, 5 aa, Mycobacterium
NEDAI

SEQ ID NO: 529445 - protein, 7 aa, Mycobacterium
NEDAQEK

SEQ ID NO: 529446 - protein, 8 aa, Mycobacterium
NEDATEDA

SEQ ID NO: 529447 - protein, 8 aa, Mycobacterium
NEDDQAAL

SEQ ID NO: 529448 - protein, 4 aa, Mycobacterium
NEDE

SEQ ID NO: 529449 - protein, 9 aa, Mycobacterium
NEDEDVSKE

SEQ ID NO: 529450 - protein, 13 aa, Mycobacterium
NEDESARAFRSVR

SEQ ID NO: 529451 - protein, 8 aa, Mycobacterium
NEDETKAV

SEQ ID NO: 529452 - protein, 8 aa, Mycobacterium
NEDGAAGC

SEQ ID NO: 529453 - protein, 6 aa, Mycobacterium
NEDGAH

SEQ ID NO: 529454 - protein, 6 aa, Mycobacterium
NEDGAW

SEQ ID NO: 529455 - protein, 9 aa, Mycobacterium
NEDGDRTSA

SEQ ID NO: 529456 - protein, 10 aa, Mycobacterium
NEDGSNVTKD

SEQ ID NO: 529457 - protein, 6 aa, Mycobacterium
NEDGTF

SEQ ID NO: 529458 - protein, 5 aa, Mycobacterium
NEDGV

SEQ ID NO: 529459 - protein, 6 aa, Mycobacterium
NEDHAG

SEQ ID NO: 529460 - protein, 46 aa, Mycobacterium
NEDKKNDKLDEARTKYSTETLDADSTVALGTDGSFAKAEEGAKKCP

SEQ ID NO: 529461 - protein, 4 aa, Mycobacterium
NEDL

SEQ ID NO: 529462 - protein, 12 aa, Mycobacterium
NEDLPNTTNPDD

SEQ ID NO: 529463 - protein, 5 aa, Mycobacterium
NEDNR

SEQ ID NO: 529464 - protein, 7 aa, Mycobacterium
NEDPGAR

SEQ ID NO: 529465 - protein, 6 aa, Mycobacterium
NEDPNA

SEQ ID NO: 529466 - protein, 4 aa, Mycobacterium
NEDQ

SEQ ID NO: 529467 - protein, 6 aa, Mycobacterium
NEDQGI

SEQ ID NO: 529468 - protein, 13 aa, Mycobacterium
NEDQPESSDDPRV

SEQ ID NO: 529469 - protein, 14 aa, Mycobacterium
NEDQPPGSRDIPDN

SEQ ID NO: 529470 - protein, 15 aa, Mycobacterium
NEDQPTPSDDPRVAS

SEQ ID NO: 529471 - protein, 8 aa, Mycobacterium
NEDQPVDN

SEQ ID NO: 529472 - protein, 8 aa, Mycobacterium
NEDQSVDT

SEQ ID NO: 529473 - protein, 8 aa, Mycobacterium
NEDRPERL

SEQ ID NO: 529474 - protein, 4 aa, Mycobacterium
NEDS

SEQ ID NO: 529475 - protein, 5 aa, Mycobacterium
NEDSE

SEQ ID NO: 529476 - protein, 15 aa, Mycobacterium
NEDSIPTKSYDNAEG

SEQ ID NO: 529477 - protein, 14 aa, Mycobacterium
NEDTDTLDGDDKAA

SEQ ID NO: 529478 - protein, 4 aa, Mycobacterium
NEEA

SEQ ID NO: 529479 - protein, 13 aa, Mycobacterium
NEEAAEARLAQGN

SEQ ID NO: 529480 - protein, 13 aa, Mycobacterium
NEEAAEARLAQGQ

SEQ ID NO: 529481 - protein, 5 aa, Mycobacterium
NEEAN

SEQ ID NO: 529482 - protein, 5 aa, Mycobacterium
NEEDL

SEQ ID NO: 529483 - protein, 8 aa, Mycobacterium
NEEEANEW

SEQ ID NO: 529484 - protein, 7 aa, Mycobacterium
NEEETRA

SEQ ID NO: 529485 - protein, 7 aa, Mycobacterium
NEEETVG

SEQ ID NO: 529486 - protein, 7 aa, Mycobacterium
NEEEWEA

SEQ ID NO: 529487 - protein, 6 aa, Mycobacterium
NEEHEA

SEQ ID NO: 529488 - protein, 7 aa, Mycobacterium
NEEHGAK

SEQ ID NO: 529489 - protein, 10 aa, Mycobacterium
NEENASGGRI

SEQ ID NO: 529490 - protein, 10 aa, Mycobacterium
NEENASGGRV

SEQ ID NO: 529491 - protein, 4 aa, Mycobacterium
NEEP

SEQ ID NO: 529492 - protein, 12 aa, Mycobacterium
NEEQCRKSISEH

SEQ ID NO: 529493 - protein, 6 aa, Mycobacterium
NEEQGI

SEQ ID NO: 529494 - protein, 7 aa, Mycobacterium
NEEQKSK

SEQ ID NO: 529495 - protein, 5 aa, Mycobacterium
NEESM

SEQ ID NO: 529496 - protein, 10 aa, Mycobacterium
NEETHQPTPY

SEQ ID NO: 529497 - protein, 9 aa, Mycobacterium
NEETRSELN

SEQ ID NO: 529498 - protein, 4 aa, Mycobacterium
NEEW

SEQ ID NO: 529499 - protein, 13 aa, Mycobacterium
NEFGPSATRGVGG

SEQ ID NO: 529500 - protein, 21 aa, Mycobacterium
NEFQRTGRGYSAQQATRPQTL

SEQ ID NO: 529501 - protein, 7 aa, Mycobacterium
NEGAARD

SEQ ID NO: 529502 - protein, 9 aa, Mycobacterium
NEGADRTLR

SEQ ID NO: 529503 - protein, 10 aa, Mycobacterium
NEGADSTHSP

SEQ ID NO: 529504 - protein, 14 aa, Mycobacterium
NEGAGKDSVDPRDR

SEQ ID NO: 529505 - protein, 10 aa, Mycobacterium
NEGAPGKGPL

SEQ ID NO: 529506 - protein, 11 aa, Mycobacterium
NEGAPGRGPTL

SEQ ID NO: 529507 - protein, 10 aa, Mycobacterium
NEGAPPGQHY

SEQ ID NO: 529508 - protein, 8 aa, Mycobacterium
NEGAPRDL

SEQ ID NO: 529509 - protein, 6 aa, Mycobacterium
NEGAVS

SEQ ID NO: 529510 - protein, 9 aa, Mycobacterium
NEGDRQAGE

SEQ ID NO: 529511 - protein, 9 aa, Mycobacterium
NEGDRQTGE

SEQ ID NO: 529512 - protein, 24 aa, Mycobacterium
NEGEQQTRAQQRTKSSTSDHAESM

SEQ ID NO: 529513 - protein, 4 aa, Mycobacterium
NEGF

SEQ ID NO: 529514 - protein, 5 aa, Mycobacterium
NEGFG

SEQ ID NO: 529515 - protein, 8 aa, Mycobacterium
NEGGFKPQ

SEQ ID NO: 529516 - protein, 11 aa, Mycobacterium
NEGGGIQVDGN

SEQ ID NO: 529517 - protein, 5 aa, Mycobacterium
NEGGT

SEQ ID NO: 529518 - protein, 9 aa, Mycobacterium
NEGGTDTVT

SEQ ID NO: 529519 - protein, 7 aa, Mycobacterium
NEGLRSR

SEQ ID NO: 529520 - protein, 17 aa, Mycobacterium
NEGNSNTGLANSGNVNT

SEQ ID NO: 529521 - protein, 7 aa, Mycobacterium
NEGPCNQ

SEQ ID NO: 529522 - protein, 7 aa, Mycobacterium
NEGPGFP

SEQ ID NO: 529523 - protein, 4 aa, Mycobacterium
NEGQ

SEQ ID NO: 529524 - protein, 40 aa, Mycobacterium
NEGQAQQDKADAQRSAAKKEAAAEKARGKAKAAEAREKAE

SEQ ID NO: 529525 - protein, 5 aa, Mycobacterium
NEGQG

SEQ ID NO: 529526 - protein, 7 aa, Mycobacterium
NEGQGVR

SEQ ID NO: 529527 - protein, 10 aa, Mycobacterium
NEGRAQLAEA

SEQ ID NO: 529528 - protein, 5 aa, Mycobacterium
NEGRD

SEQ ID NO: 529529 - protein, 5 aa, Mycobacterium
NEGRI

SEQ ID NO: 529530 - protein, 18 aa, Mycobacterium
NEGRVKAAQAEKAAREAA

SEQ ID NO: 529531 - protein, 16 aa, Mycobacterium
NEGRVQAAQRAKDQQK

SEQ ID NO: 529532 - protein, 16 aa, Mycobacterium
NEGRVQAAQRLKEQQG

SEQ ID NO: 529533 - protein, 11 aa, Mycobacterium
NEGSDSTHSPE

SEQ ID NO: 529534 - protein, 9 aa, Mycobacterium
NEGSRAVAE

SEQ ID NO: 529535 - protein, 9 aa, Mycobacterium
NEGTEGAER

SEQ ID NO: 529536 - protein, 11 aa, Mycobacterium
NEGTEGAERAV

SEQ ID NO: 529537 - protein, 13 aa, Mycobacterium
NEGTEGAERAVDG

SEQ ID NO: 529538 - protein, 10 aa, Mycobacterium
NEGTEGAERG

SEQ ID NO: 529539 - protein, 14 aa, Mycobacterium
NEGTEGAQRALTGI

SEQ ID NO: 529540 - protein, 5 aa, Mycobacterium
NEGTK

SEQ ID NO: 529541 - protein, 7 aa, Mycobacterium
NEGVPDD

SEQ ID NO: 529542 - protein, 10 aa, Mycobacterium
NEGVPGDSER

SEQ ID NO: 529543 - protein, 8 aa, Mycobacterium
NEGVPGDV

SEQ ID NO: 529544 - protein, 6 aa, Mycobacterium
NEGVPR

SEQ ID NO: 529545 - protein, 5 aa, Mycobacterium
NEGYD

SEQ ID NO: 529546 - protein, 18 aa, Mycobacterium
NEGYDDMRSGRNIRGLIR

SEQ ID NO: 529547 - protein, 18 aa, Mycobacterium
NEGYEDMRSGKNIRGLVR

SEQ ID NO: 529548 - protein, 7 aa, Mycobacterium
NEGYGGT

SEQ ID NO: 529549 - protein, 9 aa, Mycobacterium
NEGYPNNNF

SEQ ID NO: 529550 - protein, 18 aa, Mycobacterium
NEGYQDMRSGRNIRGLVR

SEQ ID NO: 529551 - protein, 5 aa, Mycobacterium
NEHDE

SEQ ID NO: 529552 - protein, 13 aa, Mycobacterium
NEHDEKRLTSCGR

SEQ ID NO: 529553 - protein, 8 aa, Mycobacterium
NEHDTERI

SEQ ID NO: 529554 - protein, 7 aa, Mycobacterium
NEHERRR

SEQ ID NO: 529555 - protein, 8 aa, Mycobacterium
NEHGGPVR

SEQ ID NO: 529556 - protein, 11 aa, Mycobacterium
NEHGRAGNSHA

SEQ ID NO: 529557 - protein, 12 aa, Mycobacterium
NEHGYGTASMPG

SEQ ID NO: 529558 - protein, 12 aa, Mycobacterium
NEHQGIAPTRNH

SEQ ID NO: 529559 - protein, 5 aa, Mycobacterium
NEHSE

SEQ ID NO: 529560 - protein, 6 aa, Mycobacterium
NEHSEK

SEQ ID NO: 529561 - protein, 11 aa, Mycobacterium
NEHSRTNGAAL

SEQ ID NO: 529562 - protein, 9 aa, Mycobacterium
NEIAEARRG

SEQ ID NO: 529563 - protein, 7 aa, Mycobacterium
NEIARDS

SEQ ID NO: 529564 - protein, 6 aa, Mycobacterium
NEIDGA

SEQ ID NO: 529565 - protein, 9 aa, Mycobacterium
NEIDGRTSY

SEQ ID NO: 529566 - protein, 8 aa, Mycobacterium
NEIPETAL

SEQ ID NO: 529567 - protein, 6 aa, Mycobacterium
NEIRPG

SEQ ID NO: 529568 - protein, 12 aa, Mycobacterium
NEISQQFSGQGS

SEQ ID NO: 529569 - protein, 9 aa, Mycobacterium
NEKAASSGA

SEQ ID NO: 529570 - protein, 6 aa, Mycobacterium
NEKAYP

SEQ ID NO: 529571 - protein, 6 aa, Mycobacterium
NEKHGG

SEQ ID NO: 529572 - protein, 21 aa, Mycobacterium
NEKHNEANGEANRDGESHNRS

SEQ ID NO: 529573 - protein, 20 aa, Mycobacterium
NEKHNEANGENNQDGETYNR

SEQ ID NO: 529574 - protein, 20 aa, Mycobacterium
NEKHNSANGEDNRDGESHNR

SEQ ID NO: 529575 - protein, 4 aa, Mycobacterium
NEKM

SEQ ID NO: 529576 - protein, 6 aa, Mycobacterium
NEKYAR

SEQ ID NO: 529577 - protein, 10 aa, Mycobacterium
NELADSARQL

SEQ ID NO: 529578 - protein, 5 aa, Mycobacterium
NELAP

SEQ ID NO: 529579 - protein, 4 aa, Mycobacterium
NELE

SEQ ID NO: 529580 - protein, 8 aa, Mycobacterium
NELEADGT

SEQ ID NO: 529581 - protein, 5 aa, Mycobacterium
NELGG

SEQ ID NO: 529582 - protein, 7 aa, Mycobacterium
NELGPRG

SEQ ID NO: 529583 - protein, 8 aa, Mycobacterium
NELGPSGI

SEQ ID NO: 529584 - protein, 14 aa, Mycobacterium
NELGQAQAATNTAM

SEQ ID NO: 529585 - protein, 5 aa, Mycobacterium
NELGR

SEQ ID NO: 529586 - protein, 7 aa, Mycobacterium
NELGRTA

SEQ ID NO: 529587 - protein, 6 aa, Mycobacterium
NELNNR

SEQ ID NO: 529588 - protein, 11 aa, Mycobacterium
NELPERTWETR

SEQ ID NO: 529589 - protein, 5 aa, Mycobacterium
NELPH

SEQ ID NO: 529590 - protein, 10 aa, Mycobacterium
NELSGGQQQR

SEQ ID NO: 529591 - protein, 12 aa, Mycobacterium
NELTTPPPVLRA

SEQ ID NO: 529592 - protein, 4 aa, Mycobacterium
NEMP

SEQ ID NO: 529593 - protein, 6 aa, Mycobacterium
NEMPSR

SEQ ID NO: 529594 - protein, 12 aa, Mycobacterium
NENADMGGGPAM

SEQ ID NO: 529595 - protein, 16 aa, Mycobacterium
NENGKSIGGQLSPDGL

SEQ ID NO: 529596 - protein, 11 aa, Mycobacterium
NENGNGRLKTE

SEQ ID NO: 529597 - protein, 8 aa, Mycobacterium
NENGSRRW

SEQ ID NO: 529598 - protein, 5 aa, Mycobacterium
NENHG

SEQ ID NO: 529599 - protein, 4 aa, Mycobacterium
NENI

SEQ ID NO: 529600 - protein, 6 aa, Mycobacterium
NENNRS

SEQ ID NO: 529601 - protein, 4 aa, Mycobacterium
NENR

SEQ ID NO: 529602 - protein, 10 aa, Mycobacterium
NENRAGIEQA

SEQ ID NO: 529603 - protein, 5 aa, Mycobacterium
NEPAA

SEQ ID NO: 529604 - protein, 16 aa, Mycobacterium
NEPADSSASGIHEFPS

SEQ ID NO: 529605 - protein, 14 aa, Mycobacterium
NEPAPDPADLARQA

SEQ ID NO: 529606 - protein, 8 aa, Mycobacterium
NEPAPGAW

SEQ ID NO: 529607 - protein, 9 aa, Mycobacterium
NEPAPGAWS

SEQ ID NO: 529608 - protein, 4 aa, Mycobacterium
NEPD

SEQ ID NO: 529609 - protein, 8 aa, Mycobacterium
NEPDDVKR

SEQ ID NO: 529610 - protein, 7 aa, Mycobacterium
NEPDGDA

SEQ ID NO: 529611 - protein, 12 aa, Mycobacterium
NEPDKPRVHPDD

SEQ ID NO: 529612 - protein, 12 aa, Mycobacterium
NEPDVDQTNGMP

SEQ ID NO: 529613 - protein, 4 aa, Mycobacterium
NEPE

SEQ ID NO: 529614 - protein, 10 aa, Mycobacterium
NEPEPGAWPN

SEQ ID NO: 529615 - protein, 7 aa, Mycobacterium
NEPERDQ

SEQ ID NO: 529616 - protein, 7 aa, Mycobacterium
NEPERYA

SEQ ID NO: 529617 - protein, 6 aa, Mycobacterium
NEPFSS

SEQ ID NO: 529618 - protein, 10 aa, Mycobacterium
NEPGERPELA

SEQ ID NO: 529619 - protein, 16 aa, Mycobacterium
NEPGESAASGTHEFPS

SEQ ID NO: 529620 - protein, 9 aa, Mycobacterium
NEPGRDYTG

SEQ ID NO: 529621 - protein, 8 aa, Mycobacterium
NEPGRTEW

SEQ ID NO: 529622 - protein, 12 aa, Mycobacterium
NEPGSSLASRTR

SEQ ID NO: 529623 - protein, 13 aa, Mycobacterium
NEPGTSFTSTTHR

SEQ ID NO: 529624 - protein, 5 aa, Mycobacterium
NEPGV

SEQ ID NO: 529625 - protein, 16 aa, Mycobacterium
NEPHAGTWGGGGATDW

SEQ ID NO: 529626 - protein, 4 aa, Mycobacterium
NEPI

SEQ ID NO: 529627 - protein, 12 aa, Mycobacterium
NEPLTVSGTGLQ

SEQ ID NO: 529628 - protein, 5 aa, Mycobacterium
NEPMP

SEQ ID NO: 529629 - protein, 12 aa, Mycobacterium
NEPNPVCEFAYW

SEQ ID NO: 529630 - protein, 4 aa, Mycobacterium
NEPP

SEQ ID NO: 529631 - protein, 12 aa, Mycobacterium
NEPPDDARDEIE

SEQ ID NO: 529632 - protein, 14 aa, Mycobacterium
NEPPNGPALPGNEA

SEQ ID NO: 529633 - protein, 4 aa, Mycobacterium
NEPS

SEQ ID NO: 529634 - protein, 16 aa, Mycobacterium
NEPSDSSASGTHEFPS

SEQ ID NO: 529635 - protein, 7 aa, Mycobacterium
NEPSPRE

SEQ ID NO: 529636 - protein, 5 aa, Mycobacterium
NEPTL

SEQ ID NO: 529637 - protein, 7 aa, Mycobacterium
NEPTPQF

SEQ ID NO: 529638 - protein, 16 aa, Mycobacterium
NEPTPVASGDITADPH

SEQ ID NO: 529639 - protein, 13 aa, Mycobacterium
NEPTRDQTDNLPF

SEQ ID NO: 529640 - protein, 9 aa, Mycobacterium
NEPTVTELG

SEQ ID NO: 529641 - protein, 6 aa, Mycobacterium
NEPVGN

SEQ ID NO: 529642 - protein, 4 aa, Mycobacterium
NEQA

SEQ ID NO: 529643 - protein, 6 aa, Mycobacterium
NEQAGP

SEQ ID NO: 529644 - protein, 7 aa, Mycobacterium
NEQAKRG

SEQ ID NO: 529645 - protein, 6 aa, Mycobacterium
NEQART

SEQ ID NO: 529646 - protein, 9 aa, Mycobacterium
NEQATADAF

SEQ ID NO: 529647 - protein, 9 aa, Mycobacterium
NEQATDEAF

SEQ ID NO: 529648 - protein, 9 aa, Mycobacterium
NEQATEEAF

SEQ ID NO: 529649 - protein, 12 aa, Mycobacterium
NEQATLEEAQEN

SEQ ID NO: 529650 - protein, 9 aa, Mycobacterium
NEQATRDAF

SEQ ID NO: 529651 - protein, 4 aa, Mycobacterium
NEQE

SEQ ID NO: 529652 - protein, 6 aa, Mycobacterium
NEQEER

SEQ ID NO: 529653 - protein, 5 aa, Mycobacterium
NEQET

SEQ ID NO: 529654 - protein, 4 aa, Mycobacterium
NEQG

SEQ ID NO: 529655 - protein, 8 aa, Mycobacterium
NEQGEPVP

SEQ ID NO: 529656 - protein, 8 aa, Mycobacterium
NEQGKLTA

SEQ ID NO: 529657 - protein, 5 aa, Mycobacterium
NEQGY

SEQ ID NO: 529658 - protein, 6 aa, Mycobacterium
NEQHPA

SEQ ID NO: 529659 - protein, 4 aa, Mycobacterium
NEQI

SEQ ID NO: 529660 - protein, 7 aa, Mycobacterium
NEQQAID

SEQ ID NO: 529661 - protein, 5 aa, Mycobacterium
NEQQR

SEQ ID NO: 529662 - protein, 7 aa, Mycobacterium
NEQQREG

SEQ ID NO: 529663 - protein, 7 aa, Mycobacterium
NEQRDDI

SEQ ID NO: 529664 - protein, 6 aa, Mycobacterium
NEQRRG

SEQ ID NO: 529665 - protein, 7 aa, Mycobacterium
NEQTHQP

SEQ ID NO: 529666 - protein, 4 aa, Mycobacterium
NEQV

SEQ ID NO: 529667 - protein, 12 aa, Mycobacterium
NEQWSNNATGAV

SEQ ID NO: 529668 - protein, 10 aa, Mycobacterium
NERAGAQGVG

SEQ ID NO: 529669 - protein, 9 aa, Mycobacterium
NERARRISG

SEQ ID NO: 529670 - protein, 4 aa, Mycobacterium
NERC

SEQ ID NO: 529671 - protein, 4 aa, Mycobacterium
NERD

SEQ ID NO: 529672 - protein, 8 aa, Mycobacterium
NERDAGPR

SEQ ID NO: 529673 - protein, 6 aa, Mycobacterium
NERDAV

SEQ ID NO: 529674 - protein, 8 aa, Mycobacterium
NERDGASL

SEQ ID NO: 529675 - protein, 18 aa, Mycobacterium
NERDIEPSAMPGTDGKWR

SEQ ID NO: 529676 - protein, 7 aa, Mycobacterium
NERESEV

SEQ ID NO: 529677 - protein, 15 aa, Mycobacterium
NERHPGGTYSQAGVG

SEQ ID NO: 529678 - protein, 6 aa, Mycobacterium
NERLAA

SEQ ID NO: 529679 - protein, 7 aa, Mycobacterium
NERPAHT

SEQ ID NO: 529680 - protein, 10 aa, Mycobacterium
NERPEHDRDR

SEQ ID NO: 529681 - protein, 9 aa, Mycobacterium
NERPESAAD

SEQ ID NO: 529682 - protein, 14 aa, Mycobacterium
NERPGLANHEPQPT

SEQ ID NO: 529683 - protein, 16 aa, Mycobacterium
NERPGLANHEPQPTAA

SEQ ID NO: 529684 - protein, 16 aa, Mycobacterium
NERPGLANHEPQPTAQ

SEQ ID NO: 529685 - protein, 5 aa, Mycobacterium
NERPL

SEQ ID NO: 529686 - protein, 5 aa, Mycobacterium
NERPQ

SEQ ID NO: 529687 - protein, 7 aa, Mycobacterium
NERPVPP

SEQ ID NO: 529688 - protein, 14 aa, Mycobacterium
NERQWKPDDPAPDL

SEQ ID NO: 529689 - protein, 28 aa, Mycobacterium
NERREEGDLRENGGYHAAREEQGQQEAR

SEQ ID NO: 529690 - protein, 7 aa, Mycobacterium
NERRRLD

SEQ ID NO: 529691 - protein, 7 aa, Mycobacterium
NERSQLQ

SEQ ID NO: 529692 - protein, 11 aa, Mycobacterium
NERSQLQNKTR

SEQ ID NO: 529693 - protein, 7 aa, Mycobacterium
NERSSEV

SEQ ID NO: 529694 - protein, 10 aa, Mycobacterium
NERSTALNKT

SEQ ID NO: 529695 - protein, 12 aa, Mycobacterium
NERTEGDHRANA

SEQ ID NO: 529696 - protein, 5 aa, Mycobacterium
NERTQ

SEQ ID NO: 529697 - protein, 6 aa, Mycobacterium
NERTQQ

SEQ ID NO: 529698 - protein, 11 aa, Mycobacterium
NERVKQNAPAF

SEQ ID NO: 529699 - protein, 9 aa, Mycobacterium
NESAAVGLP

SEQ ID NO: 529700 - protein, 9 aa, Mycobacterium
NESAGNGKI

SEQ ID NO: 529701 - protein, 8 aa, Mycobacterium
NESAPYDR

SEQ ID NO: 529702 - protein, 7 aa, Mycobacterium
NESASAG

SEQ ID NO: 529703 - protein, 12 aa, Mycobacterium
NESASSASSDAP

SEQ ID NO: 529704 - protein, 10 aa, Mycobacterium
NESDATISAT

SEQ ID NO: 529705 - protein, 10 aa, Mycobacterium
NESDGERIGY

SEQ ID NO: 529706 - protein, 8 aa, Mycobacterium
NESDPGVI

SEQ ID NO: 529707 - protein, 6 aa, Mycobacterium
NESDTA

SEQ ID NO: 529708 - protein, 7 aa, Mycobacterium
NESEAQQ

SEQ ID NO: 529709 - protein, 7 aa, Mycobacterium
NESEPSV

SEQ ID NO: 529710 - protein, 8 aa, Mycobacterium
NESGAKTV

SEQ ID NO: 529711 - protein, 6 aa, Mycobacterium
NESGDE

SEQ ID NO: 529712 - protein, 33 aa, Mycobacterium
NESLGGSGSVGGSTAVGGGAHTGVGGGVSTGVG

SEQ ID NO: 529713 - protein, 6 aa, Mycobacterium
NESLSN

SEQ ID NO: 529714 - protein, 6 aa, Mycobacterium
NESQDD

SEQ ID NO: 529715 - protein, 6 aa, Mycobacterium
NESQKQ

SEQ ID NO: 529716 - protein, 7 aa, Mycobacterium
NESQYNS

SEQ ID NO: 529717 - protein, 8 aa, Mycobacterium
NESRPGAA

SEQ ID NO: 529718 - protein, 10 aa, Mycobacterium
NESRYEGTPL

SEQ ID NO: 529719 - protein, 17 aa, Mycobacterium
NESVNSYTAAYDGTDLD

SEQ ID NO: 529720 - protein, 7 aa, Mycobacterium
NETARSA

SEQ ID NO: 529721 - protein, 8 aa, Mycobacterium
NETATSES

SEQ ID NO: 529722 - protein, 6 aa, Mycobacterium
NETDEP

SEQ ID NO: 529723 - protein, 7 aa, Mycobacterium
NETDEPA

SEQ ID NO: 529724 - protein, 9 aa, Mycobacterium
NETDTVPSV

SEQ ID NO: 529725 - protein, 9 aa, Mycobacterium
NETEDEETV

SEQ ID NO: 529726 - protein, 14 aa, Mycobacterium
NETEPGDPSPEVDA

SEQ ID NO: 529727 - protein, 6 aa, Mycobacterium
NETERE

SEQ ID NO: 529728 - protein, 4 aa, Mycobacterium
NETG

SEQ ID NO: 529729 - protein, 17 aa, Mycobacterium
NETGESHQPVDIPNDSP

SEQ ID NO: 529730 - protein, 20 aa, Mycobacterium
NETGGNGQAAVTAETSEEDL

SEQ ID NO: 529731 - protein, 7 aa, Mycobacterium
NETGLDA

SEQ ID NO: 529732 - protein, 6 aa, Mycobacterium
NETGLL

SEQ ID NO: 529733 - protein, 6 aa, Mycobacterium
NETHAE

SEQ ID NO: 529734 - protein, 8 aa, Mycobacterium
NETLREQA

SEQ ID NO: 529735 - protein, 6 aa, Mycobacterium
NETNSV

SEQ ID NO: 529736 - protein, 17 aa, Mycobacterium
NETPPDPARAPEHGQHT

SEQ ID NO: 529737 - protein, 5 aa, Mycobacterium
NETRT

SEQ ID NO: 529738 - protein, 4 aa, Mycobacterium
NETS

SEQ ID NO: 529739 - protein, 11 aa, Mycobacterium
NETSKYNPQYD

SEQ ID NO: 529740 - protein, 6 aa, Mycobacterium
NETSTG

SEQ ID NO: 529741 - protein, 5 aa, Mycobacterium
NETTE

SEQ ID NO: 529742 - protein, 21 aa, Mycobacterium
NETTEQPDGTRIATETGAPVT

SEQ ID NO: 529743 - protein, 7 aa, Mycobacterium
NETTTNL

SEQ ID NO: 529744 - protein, 7 aa, Mycobacterium
NETWNAK

SEQ ID NO: 529745 - protein, 13 aa, Mycobacterium
NEVAQANGYTTGG

SEQ ID NO: 529746 - protein, 5 aa, Mycobacterium
NEVAR

SEQ ID NO: 529747 - protein, 4 aa, Mycobacterium
NEVE

SEQ ID NO: 529748 - protein, 8 aa, Mycobacterium
NEVEPGPL

SEQ ID NO: 529749 - protein, 9 aa, Mycobacterium
NEVGDARAY

SEQ ID NO: 529750 - protein, 6 aa, Mycobacterium
NEVGQE

SEQ ID NO: 529751 - protein, 11 aa, Mycobacterium
NEVPGATDRDR

SEQ ID NO: 529752 - protein, 9 aa, Mycobacterium
NEVPPGAEG

SEQ ID NO: 529753 - protein, 6 aa, Mycobacterium
NEVPRD

SEQ ID NO: 529754 - protein, 6 aa, Mycobacterium
NEVPSR

SEQ ID NO: 529755 - protein, 5 aa, Mycobacterium
NEVRA

SEQ ID NO: 529756 - protein, 4 aa, Mycobacterium
NEVS

SEQ ID NO: 529757 - protein, 20 aa, Mycobacterium
NEVTAPNSEDGVAKVLERWW

SEQ ID NO: 529758 - protein, 5 aa, Mycobacterium
NEVTR

SEQ ID NO: 529759 - protein, 9 aa, Mycobacterium
NEYASAANE

SEQ ID NO: 529760 - protein, 14 aa, Mycobacterium
NEYEDRDGNRRSSL

SEQ ID NO: 529761 - protein, 15 aa, Mycobacterium
NEYPLATSRDLEEAG

SEQ ID NO: 529762 - protein, 9 aa, Mycobacterium
NEYRSAPTD

SEQ ID NO: 529763 - protein, 5 aa, Mycobacterium
NFAEE

SEQ ID NO: 529764 - protein, 5 aa, Mycobacterium
NFAPA

SEQ ID NO: 529765 - protein, 15 aa, Mycobacterium
NFAPSSHTTASTHST

SEQ ID NO: 529766 - protein, 6 aa, Mycobacterium
NFASDG

SEQ ID NO: 529767 - protein, 5 aa, Mycobacterium
NFDAG

SEQ ID NO: 529768 - protein, 16 aa, Mycobacterium
NFDGAGRQLGPLRRTR

SEQ ID NO: 529769 - protein, 7 aa, Mycobacterium
NFDGEAA

SEQ ID NO: 529770 - protein, 6 aa, Mycobacterium
NFDNGA

SEQ ID NO: 529771 - protein, 6 aa, Mycobacterium
NFDPVP

SEQ ID NO: 529772 - protein, 8 aa, Mycobacterium
NFDSPSHR

SEQ ID NO: 529773 - protein, 21 aa, Mycobacterium
NFEDANDAWPRPAARGESGTL

SEQ ID NO: 529774 - protein, 5 aa, Mycobacterium
NFEGG

SEQ ID NO: 529775 - protein, 7 aa, Mycobacterium
NFESGAR

SEQ ID NO: 529776 - protein, 7 aa, Mycobacterium
NFESPSY

SEQ ID NO: 529777 - protein, 5 aa, Mycobacterium
NFETP

SEQ ID NO: 529778 - protein, 8 aa, Mycobacterium
NFETPSHA

SEQ ID NO: 529779 - protein, 9 aa, Mycobacterium
NFGDASGSR

SEQ ID NO: 529780 - protein, 4 aa, Mycobacterium
NFGG

SEQ ID NO: 529781 - protein, 6 aa, Mycobacterium
NFGGAA

SEQ ID NO: 529782 - protein, 7 aa, Mycobacterium
NFGGGRT

SEQ ID NO: 529783 - protein, 19 aa, Mycobacterium
NFGGNNTGAFNSGSGWSNS

SEQ ID NO: 529784 - protein, 12 aa, Mycobacterium
NFGHAQAAGGGL

SEQ ID NO: 529785 - protein, 10 aa, Mycobacterium
NFGHTEAAAG

SEQ ID NO: 529786 - protein, 11 aa, Mycobacterium
NFGHTQSAAGA

SEQ ID NO: 529787 - protein, 12 aa, Mycobacterium
NFGHTQSTSGPL

SEQ ID NO: 529788 - protein, 10 aa, Mycobacterium
NFGPASGRGD

SEQ ID NO: 529789 - protein, 7 aa, Mycobacterium
NFGPRGA

SEQ ID NO: 529790 - protein, 11 aa, Mycobacterium
NFGQTAEEFGH

SEQ ID NO: 529791 - protein, 13 aa, Mycobacterium
NFGSAPELDPGLA

SEQ ID NO: 529792 - protein, 10 aa, Mycobacterium
NFKTQGGLTT

SEQ ID NO: 529793 - protein, 20 aa, Mycobacterium
NFNASGDTTAAGSGTGKRTV

SEQ ID NO: 529794 - protein, 10 aa, Mycobacterium
NFNPDCAQAG

SEQ ID NO: 529795 - protein, 4 aa, Mycobacterium
NFPA

SEQ ID NO: 529796 - protein, 12 aa, Mycobacterium
NFPDDDATSPMD

SEQ ID NO: 529797 - protein, 16 aa, Mycobacterium
NFPSATAPQGVSTPNG

SEQ ID NO: 529798 - protein, 9 aa, Mycobacterium
NFSDGKPHS

SEQ ID NO: 529799 - protein, 4 aa, Mycobacterium
NFSE

SEQ ID NO: 529800 - protein, 7 aa, Mycobacterium
NFSGSGC

SEQ ID NO: 529801 - protein, 8 aa, Mycobacterium
NFSPANVA

SEQ ID NO: 529802 - protein, 6 aa, Mycobacterium
NFSPRT

SEQ ID NO: 529803 - protein, 10 aa, Mycobacterium
NFTAPNPQIE

SEQ ID NO: 529804 - protein, 5 aa, Mycobacterium
NFTDD

SEQ ID NO: 529805 - protein, 7 aa, Mycobacterium
NFTPEPA

SEQ ID NO: 529806 - protein, 9 aa, Mycobacterium
NFTPEPEGF

SEQ ID NO: 529807 - protein, 10 aa, Mycobacterium
NFTPEPTAFA

SEQ ID NO: 529808 - protein, 8 aa, Mycobacterium
NFTPGPRA

SEQ ID NO: 529809 - protein, 9 aa, Mycobacterium
NFTQTSDDE

SEQ ID NO: 529810 - protein, 11 aa, Mycobacterium
NFTRTRNGYDP

SEQ ID NO: 529811 - protein, 10 aa, Mycobacterium
NFTSEPDGFE

SEQ ID NO: 529812 - protein, 10 aa, Mycobacterium
NFTSEPEAFR

SEQ ID NO: 529813 - protein, 12 aa, Mycobacterium
NFTTARTGADRS

SEQ ID NO: 529814 - protein, 6 aa, Mycobacterium
NGAAAA

SEQ ID NO: 529815 - protein, 9 aa, Mycobacterium
NGAAAAGGI

SEQ ID NO: 529816 - protein, 7 aa, Mycobacterium
NGAAAQR

SEQ ID NO: 529817 - protein, 9 aa, Mycobacterium
NGAAARTGD

SEQ ID NO: 529818 - protein, 29 aa, Mycobacterium
NGAAELTDPVRAGGALSEHEVDTTRRRRR

SEQ ID NO: 529819 - protein, 12 aa, Mycobacterium
NGAAEVARHRLD

SEQ ID NO: 529820 - protein, 11 aa, Mycobacterium
NGAAGFGRDPD

SEQ ID NO: 529821 - protein, 12 aa, Mycobacterium
NGAAGGVGGAGG

SEQ ID NO: 529822 - protein, 17 aa, Mycobacterium
NGAAGSVDSATTGPVQP

SEQ ID NO: 529823 - protein, 15 aa, Mycobacterium
NGAAGTAAHPNGGAG

SEQ ID NO: 529824 - protein, 15 aa, Mycobacterium
NGAAGTAANPTGGAG

SEQ ID NO: 529825 - protein, 18 aa, Mycobacterium
NGAAGTPGSGANGQDGGL

SEQ ID NO: 529826 - protein, 9 aa, Mycobacterium
NGAAPGGGL

SEQ ID NO: 529827 - protein, 13 aa, Mycobacterium
NGAAPIPHNDDSV

SEQ ID NO: 529828 - protein, 8 aa, Mycobacterium
NGAAPLSA

SEQ ID NO: 529829 - protein, 12 aa, Mycobacterium
NGAASDQEAPDT

SEQ ID NO: 529830 - protein, 7 aa, Mycobacterium
NGAASRL

SEQ ID NO: 529831 - protein, 7 aa, Mycobacterium
NGAATAK

SEQ ID NO: 529832 - protein, 14 aa, Mycobacterium
NGAATEPDDRPQDE

SEQ ID NO: 529833 - protein, 6 aa, Mycobacterium
NGAAVG

SEQ ID NO: 529834 - protein, 4 aa, Mycobacterium
NGAD

SEQ ID NO: 529835 - protein, 16 aa, Mycobacterium
NGADATTPGQPGGDGG

SEQ ID NO: 529836 - protein, 10 aa, Mycobacterium
NGADDGDELN

SEQ ID NO: 529837 - protein, 7 aa, Mycobacterium
NGADEPA

SEQ ID NO: 529838 - protein, 17 aa, Mycobacterium
NGADGAAGTGADGGAGG

SEQ ID NO: 529839 - protein, 16 aa, Mycobacterium
NGADGAAGTGQAGAAG

SEQ ID NO: 529840 - protein, 16 aa, Mycobacterium
NGADGAAGTGQTGQAG

SEQ ID NO: 529841 - protein, 14 aa, Mycobacterium
NGADGAPGQAGADG

SEQ ID NO: 529842 - protein, 15 aa, Mycobacterium
NGADGAPGQAGGDGG

SEQ ID NO: 529843 - protein, 14 aa, Mycobacterium
NGADGAPGQNGAAG

SEQ ID NO: 529844 - protein, 17 aa, Mycobacterium
NGADGAPGSGANGADGG

SEQ ID NO: 529845 - protein, 19 aa, Mycobacterium
NGADGATVGGIGTPGGAGG

SEQ ID NO: 529846 - protein, 11 aa, Mycobacterium
NGADGGISPYE

SEQ ID NO: 529847 - protein, 14 aa, Mycobacterium
NGADGGPGQAGGAG

SEQ ID NO: 529848 - protein, 19 aa, Mycobacterium
NGADGGTVGGIGQPGGPGG

SEQ ID NO: 529849 - protein, 17 aa, Mycobacterium
NGADGINGTGQSGGDGG

SEQ ID NO: 529850 - protein, 15 aa, Mycobacterium
NGADGTAANPNGGAG

SEQ ID NO: 529851 - protein, 16 aa, Mycobacterium
NGADGTAASPNGGAGG

SEQ ID NO: 529852 - protein, 15 aa, Mycobacterium
NGADGTAPGQAGGAG

SEQ ID NO: 529853 - protein, 16 aa, Mycobacterium
NGADGTAPGQAGGDGG

SEQ ID NO: 529854 - protein, 20 aa, Mycobacterium
NGADGYTNAQGVGTAGKPGG

SEQ ID NO: 529855 - protein, 11 aa, Mycobacterium
NGADHDDASEI

SEQ ID NO: 529856 - protein, 8 aa, Mycobacterium
NGADIDAA

SEQ ID NO: 529857 - protein, 6 aa, Mycobacterium
NGAENQ

SEQ ID NO: 529858 - protein, 7 aa, Mycobacterium
NGAETAA

SEQ ID NO: 529859 - protein, 8 aa, Mycobacterium
NGAEVSSA

SEQ ID NO: 529860 - protein, 4 aa, Mycobacterium
NGAG

SEQ ID NO: 529861 - protein, 20 aa, Mycobacterium
NGAGAGTVPDPYDPSRTHAP

SEQ ID NO: 529862 - protein, 10 aa, Mycobacterium
NGAGGGDGGL

SEQ ID NO: 529863 - protein, 19 aa, Mycobacterium
NGAGIGSDGTPTGQPVVTV

SEQ ID NO: 529864 - protein, 7 aa, Mycobacterium
NGAGKST

SEQ ID NO: 529865 - protein, 6 aa, Mycobacterium
NGAGKT

SEQ ID NO: 529866 - protein, 15 aa, Mycobacterium
NGAGNPKQRDNVPGV

SEQ ID NO: 529867 - protein, 7 aa, Mycobacterium
NGAGPGE

SEQ ID NO: 529868 - protein, 6 aa, Mycobacterium
NGAGRA

SEQ ID NO: 529869 - protein, 6 aa, Mycobacterium
NGAGRG

SEQ ID NO: 529870 - protein, 11 aa, Mycobacterium
NGAGSEGRHEA

SEQ ID NO: 529871 - protein, 9 aa, Mycobacterium
NGAGSGSGF

SEQ ID NO: 529872 - protein, 31 aa, Mycobacterium
NGAGSSASGISIGGAGGAGTAGGYGGSGNYA

SEQ ID NO: 529873 - protein, 29 aa, Mycobacterium
NGAGSSASGSAIGGYGGAGTTGGLGGVGG

SEQ ID NO: 529874 - protein, 30 aa, Mycobacterium
NGAGSSVATGAATGGVGGAGSTGGIGGAGN

SEQ ID NO: 529875 - protein, 7 aa, Mycobacterium
NGAGSTV

SEQ ID NO: 529876 - protein, 8 aa, Mycobacterium
NGAGTGPQ

SEQ ID NO: 529877 - protein, 6 aa, Mycobacterium
NGAGTV

SEQ ID NO: 529878 - protein, 8 aa, Mycobacterium
NGAGVEGI

SEQ ID NO: 529879 - protein, 7 aa, Mycobacterium
NGAITRD

SEQ ID NO: 529880 - protein, 4 aa, Mycobacterium
NGAL

SEQ ID NO: 529881 - protein, 8 aa, Mycobacterium
NGALASPE

SEQ ID NO: 529882 - protein, 15 aa, Mycobacterium
NGALGGKITGAGGGG

SEQ ID NO: 529883 - protein, 4 aa, Mycobacterium
NGAM

SEQ ID NO: 529884 - protein, 17 aa, Mycobacterium
NGANAAPGSGANGGDGG

SEQ ID NO: 529885 - protein, 5 aa, Mycobacterium
NGAND

SEQ ID NO: 529886 - protein, 17 aa, Mycobacterium
NGANGAAGTGANGGDGG

SEQ ID NO: 529887 - protein, 17 aa, Mycobacterium
NGANGAAGTGASGGDGG

SEQ ID NO: 529888 - protein, 17 aa, Mycobacterium
NGANGADGTGAAGGDGG

SEQ ID NO: 529889 - protein, 17 aa, Mycobacterium
NGANGADGTGQNGGDGG

SEQ ID NO: 529890 - protein, 14 aa, Mycobacterium
NGANGAPGADGQAG

SEQ ID NO: 529891 - protein, 17 aa, Mycobacterium
NGANGAPGTGAAGAPGG

SEQ ID NO: 529892 - protein, 16 aa, Mycobacterium
NGANGAPGTGADGGAA

SEQ ID NO: 529893 - protein, 16 aa, Mycobacterium
NGANGAPGTGANGAAG

SEQ ID NO: 529894 - protein, 16 aa, Mycobacterium
NGANGAPGTGANGGAG

SEQ ID NO: 529895 - protein, 17 aa, Mycobacterium
NGANGAPGTGAPGGPGG

SEQ ID NO: 529896 - protein, 15 aa, Mycobacterium
NGANGGPGQPGGPGG

SEQ ID NO: 529897 - protein, 15 aa, Mycobacterium
NGANGTATSPNGGAG

SEQ ID NO: 529898 - protein, 16 aa, Mycobacterium
NGANGTATSPNGGAGG

SEQ ID NO: 529899 - protein, 17 aa, Mycobacterium
NGANGTPGLGTDGAPGG

SEQ ID NO: 529900 - protein, 16 aa, Mycobacterium
NGANGTPGTGADGAAG

SEQ ID NO: 529901 - protein, 17 aa, Mycobacterium
NGANGTPGTGADGAPGG

SEQ ID NO: 529902 - protein, 19 aa, Mycobacterium
NGANGTTVNGVGTPGGDGG

SEQ ID NO: 529903 - protein, 19 aa, Mycobacterium
NGANGTTVNGVGTPGGPGG

SEQ ID NO: 529904 - protein, 17 aa, Mycobacterium
NGANGVDGTGAAGGDGG

SEQ ID NO: 529905 - protein, 9 aa, Mycobacterium
NGAPATTVT

SEQ ID NO: 529906 - protein, 6 aa, Mycobacterium
NGAPAV

SEQ ID NO: 529907 - protein, 8 aa, Mycobacterium
NGAPDEAI

SEQ ID NO: 529908 - protein, 9 aa, Mycobacterium
NGAPDIGPH

SEQ ID NO: 529909 - protein, 17 aa, Mycobacterium
NGAPGATGSGASGSPGG

SEQ ID NO: 529910 - protein, 13 aa, Mycobacterium
NGAPGSGAEPRLT

SEQ ID NO: 529911 - protein, 17 aa, Mycobacterium
NGAPGVAGVNGGAGEAG

SEQ ID NO: 529912 - protein, 42 aa, Mycobacterium
NGAPKPPPGGPAGGPPADGVTETPAPDAATRTRYQPIPVTVE

SEQ ID NO: 529913 - protein, 6 aa, Mycobacterium
NGAPLP

SEQ ID NO: 529914 - protein, 8 aa, Mycobacterium
NGAPPPDI

SEQ ID NO: 529915 - protein, 8 aa, Mycobacterium
NGAPPPQV

SEQ ID NO: 529916 - protein, 6 aa, Mycobacterium
NGAPVD

SEQ ID NO: 529917 - protein, 5 aa, Mycobacterium
NGAQP

SEQ ID NO: 529918 - protein, 20 aa, Mycobacterium
NGAQPHPYEPGDATAPQSVY

SEQ ID NO: 529919 - protein, 6 aa, Mycobacterium
NGAQVR

SEQ ID NO: 529920 - protein, 11 aa, Mycobacterium
NGARALEATAA

SEQ ID NO: 529921 - protein, 7 aa, Mycobacterium
NGAREGL

SEQ ID NO: 529922 - protein, 19 aa, Mycobacterium
NGARGPSPASGRYPQRLPG

SEQ ID NO: 529923 - protein, 7 aa, Mycobacterium
NGARHSG

SEQ ID NO: 529924 - protein, 6 aa, Mycobacterium
NGARPE

SEQ ID NO: 529925 - protein, 6 aa, Mycobacterium
NGARPK

SEQ ID NO: 529926 - protein, 10 aa, Mycobacterium
NGARQVPGRH

SEQ ID NO: 529927 - protein, 6 aa, Mycobacterium
NGARRV

SEQ ID NO: 529928 - protein, 7 aa, Mycobacterium
NGARSTY

SEQ ID NO: 529929 - protein, 13 aa, Mycobacterium
NGASAEGGPTGSV

SEQ ID NO: 529930 - protein, 9 aa, Mycobacterium
NGASAEGTI

SEQ ID NO: 529931 - protein, 9 aa, Mycobacterium
NGASAEGTL

SEQ ID NO: 529932 - protein, 9 aa, Mycobacterium
NGASAEGTV

SEQ ID NO: 529933 - protein, 7 aa, Mycobacterium
NGASASA

SEQ ID NO: 529934 - protein, 17 aa, Mycobacterium
NGASASAIAAGRPVDTS

SEQ ID NO: 529935 - protein, 17 aa, Mycobacterium
NGASASAVAGGKAVDTS

SEQ ID NO: 529936 - protein, 16 aa, Mycobacterium
NGASASAVAGGRPVET

SEQ ID NO: 529937 - protein, 9 aa, Mycobacterium
NGASFTSGK

SEQ ID NO: 529938 - protein, 17 aa, Mycobacterium
NGASGAPGTGQAGGDGG

SEQ ID NO: 529939 - protein, 15 aa, Mycobacterium
NGASGEGGPNGSVNE

SEQ ID NO: 529940 - protein, 9 aa, Mycobacterium
NGASGEGTL

SEQ ID NO: 529941 - protein, 14 aa, Mycobacterium
NGASLRGHNSPDMA

SEQ ID NO: 529942 - protein, 7 aa, Mycobacterium
NGASPAV

SEQ ID NO: 529943 - protein, 4 aa, Mycobacterium
NGAT

SEQ ID NO: 529944 - protein, 6 aa, Mycobacterium
NGATAR

SEQ ID NO: 529945 - protein, 7 aa, Mycobacterium
NGATGDR

SEQ ID NO: 529946 - protein, 40 aa, Mycobacterium
NGATGGSAGLAGGGGDAGVIGNGGAGGSGGKGAAGSTLGG

SEQ ID NO: 529947 - protein, 8 aa, Mycobacterium
NGATISDA

SEQ ID NO: 529948 - protein, 13 aa, Mycobacterium
NGATQTARARHEA

SEQ ID NO: 529949 - protein, 13 aa, Mycobacterium
NGATTSAEVTGGA

SEQ ID NO: 529950 - protein, 11 aa, Mycobacterium
NGAVGGAGGAG

SEQ ID NO: 529951 - protein, 7 aa, Mycobacterium
NGAWGQS

SEQ ID NO: 529952 - protein, 6 aa, Mycobacterium
NGAWSI

SEQ ID NO: 529953 - protein, 5 aa, Mycobacterium
NGAYD

SEQ ID NO: 529954 - protein, 8 aa, Mycobacterium
NGAYGRKQ

SEQ ID NO: 529955 - protein, 8 aa, Mycobacterium
NGAYNQDQ

SEQ ID NO: 529956 - protein, 8 aa, Mycobacterium
NGAYNQQQ

SEQ ID NO: 529957 - protein, 8 aa, Mycobacterium
NGAYNQRQ

SEQ ID NO: 529958 - protein, 7 aa, Mycobacterium
NGAYQRK

SEQ ID NO: 529959 - protein, 9 aa, Mycobacterium
NGCDQTSAQ

SEQ ID NO: 529960 - protein, 6 aa, Mycobacterium
NGCGKS

SEQ ID NO: 529961 - protein, 6 aa, Mycobacterium
NGCGMP

SEQ ID NO: 529962 - protein, 4 aa, Mycobacterium
NGDA

SEQ ID NO: 529963 - protein, 17 aa, Mycobacterium
NGDAANSALGGCRIYLE

SEQ ID NO: 529964 - protein, 5 aa, Mycobacterium
NGDAL

SEQ ID NO: 529965 - protein, 6 aa, Mycobacterium
NGDASE

SEQ ID NO: 529966 - protein, 12 aa, Mycobacterium
NGDAWSAGHSVS

SEQ ID NO: 529967 - protein, 9 aa, Mycobacterium
NGDCGSTRE

SEQ ID NO: 529968 - protein, 6 aa, Mycobacterium
NGDDDT

SEQ ID NO: 529969 - protein, 6 aa, Mycobacterium
NGDEER

SEQ ID NO: 529970 - protein, 11 aa, Mycobacterium
NGDEHDDPIGA

SEQ ID NO: 529971 - protein, 8 aa, Mycobacterium
NGDEIADV

SEQ ID NO: 529972 - protein, 14 aa, Mycobacterium
NGDELAAQARSHPD

SEQ ID NO: 529973 - protein, 14 aa, Mycobacterium
NGDELADQARAHPD

SEQ ID NO: 529974 - protein, 14 aa, Mycobacterium
NGDELAGQARSHPN

SEQ ID NO: 529975 - protein, 15 aa, Mycobacterium
NGDELGDQARANPDA

SEQ ID NO: 529976 - protein, 11 aa, Mycobacterium
NGDELPPGQAG

SEQ ID NO: 529977 - protein, 9 aa, Mycobacterium
NGDERQNSL

SEQ ID NO: 529978 - protein, 6 aa, Mycobacterium
NGDERS

SEQ ID NO: 529979 - protein, 8 aa, Mycobacterium
NGDESDTE

SEQ ID NO: 529980 - protein, 4 aa, Mycobacterium
NGDG

SEQ ID NO: 529981 - protein, 5 aa, Mycobacterium
NGDGA

SEQ ID NO: 529982 - protein, 16 aa, Mycobacterium
NGDGLAPYDPALTPAQ

SEQ ID NO: 529983 - protein, 5 aa, Mycobacterium
NGDGN

SEQ ID NO: 529984 - protein, 11 aa, Mycobacterium
NGDGNVTKRGG

SEQ ID NO: 529985 - protein, 8 aa, Mycobacterium
NGDGPAIE

SEQ ID NO: 529986 - protein, 16 aa, Mycobacterium
NGDGPQAGGFGGRTNP

SEQ ID NO: 529987 - protein, 8 aa, Mycobacterium
NGDGRGGV

SEQ ID NO: 529988 - protein, 13 aa, Mycobacterium
NGDGTDTGLPAEE

SEQ ID NO: 529989 - protein, 6 aa, Mycobacterium
NGDHAG

SEQ ID NO: 529990 - protein, 8 aa, Mycobacterium
NGDINDPF

SEQ ID NO: 529991 - protein, 13 aa, Mycobacterium
NGDINQAQRERTI

SEQ ID NO: 529992 - protein, 13 aa, Mycobacterium
NGDINQSQRERTI

SEQ ID NO: 529993 - protein, 12 aa, Mycobacterium
NGDIPQQQRERT

SEQ ID NO: 529994 - protein, 11 aa, Mycobacterium
NGDITKQNNDV

SEQ ID NO: 529995 - protein, 4 aa, Mycobacterium
NGDL

SEQ ID NO: 529996 - protein, 7 aa, Mycobacterium
NGDPGGV

SEQ ID NO: 529997 - protein, 7 aa, Mycobacterium
NGDPGKG

SEQ ID NO: 529998 - protein, 9 aa, Mycobacterium
NGDPIPITT

SEQ ID NO: 529999 - protein, 10 aa, Mycobacterium
NGDQKLSSNV

SEQ ID NO: 530000 - protein, 8 aa, Mycobacterium
NGDQSDSE

SEQ ID NO: 530001 - protein, 6 aa, Mycobacterium
NGDRAE

SEQ ID NO: 530002 - protein, 9 aa, Mycobacterium
NGDSATARA

SEQ ID NO: 530003 - protein, 9 aa, Mycobacterium
NGDSGKLRA

SEQ ID NO: 530004 - protein, 8 aa, Mycobacterium
NGDSGQAA

SEQ ID NO: 530005 - protein, 5 aa, Mycobacterium
NGDSQ

SEQ ID NO: 530006 - protein, 15 aa, Mycobacterium
NGDSREIVGAGDDSH

SEQ ID NO: 530007 - protein, 8 aa, Mycobacterium
NGDSRSIV

SEQ ID NO: 530008 - protein, 8 aa, Mycobacterium
NGDSRVPT

SEQ ID NO: 530009 - protein, 5 aa, Mycobacterium
NGDTG

SEQ ID NO: 530010 - protein, 9 aa, Mycobacterium
NGDTVTSPA

SEQ ID NO: 530011 - protein, 10 aa, Mycobacterium
NGDVAGPAEL

SEQ ID NO: 530012 - protein, 15 aa, Mycobacterium
NGDVGAKAQALAEAG

SEQ ID NO: 530013 - protein, 9 aa, Mycobacterium
NGDVGAKAR

SEQ ID NO: 530014 - protein, 14 aa, Mycobacterium
NGDVNGDRQGDPSL

SEQ ID NO: 530015 - protein, 5 aa, Mycobacterium
NGDVR

SEQ ID NO: 530016 - protein, 9 aa, Mycobacterium
NGDVRAKAS

SEQ ID NO: 530017 - protein, 82 aa, Mycobacterium
NGDVTGGAAGDGGNGAHGGNGGVGGEASTGGATAVSGSGGNGGNAEAAGGAGGNGGRGGFAQATSSVAGGNGGNGGNGHDTD

SEQ ID NO: 530018 - protein, 16 aa, Mycobacterium
NGDYGPDSAMARSTKR

SEQ ID NO: 530019 - protein, 5 aa, Mycobacterium
NGDYI

SEQ ID NO: 530020 - protein, 10 aa, Mycobacterium
NGEAAGREID

SEQ ID NO: 530021 - protein, 11 aa, Mycobacterium
NGEAAKQTLAQ

SEQ ID NO: 530022 - protein, 8 aa, Mycobacterium
NGEACEAG

SEQ ID NO: 530023 - protein, 5 aa, Mycobacterium
NGEAF

SEQ ID NO: 530024 - protein, 6 aa, Mycobacterium
NGEAGR

SEQ ID NO: 530025 - protein, 5 aa, Mycobacterium
NGEAL

SEQ ID NO: 530026 - protein, 7 aa, Mycobacterium
NGEASQT

SEQ ID NO: 530027 - protein, 4 aa, Mycobacterium
NGEE

SEQ ID NO: 530028 - protein, 10 aa, Mycobacterium
NGEEGEPASF

SEQ ID NO: 530029 - protein, 10 aa, Mycobacterium
NGEEGEPASL

SEQ ID NO: 530030 - protein, 10 aa, Mycobacterium
NGEEGEPASV

SEQ ID NO: 530031 - protein, 10 aa, Mycobacterium
NGEEGEPTSI

SEQ ID NO: 530032 - protein, 15 aa, Mycobacterium
NGEELTDQARANPDA

SEQ ID NO: 530033 - protein, 7 aa, Mycobacterium
NGEEREI

SEQ ID NO: 530034 - protein, 7 aa, Mycobacterium
NGEFPGR

SEQ ID NO: 530035 - protein, 4 aa, Mycobacterium
NGEG

SEQ ID NO: 530036 - protein, 23 aa, Mycobacterium
NGEGAYDDGVETTTRLAQILLAP

SEQ ID NO: 530037 - protein, 23 aa, Mycobacterium
NGEGGYDDGVETTTRLAQILLAP

SEQ ID NO: 530038 - protein, 8 aa, Mycobacterium
NGEGPVET

SEQ ID NO: 530039 - protein, 9 aa, Mycobacterium
NGEKINSES

SEQ ID NO: 530040 - protein, 4 aa, Mycobacterium
NGEL

SEQ ID NO: 530041 - protein, 15 aa, Mycobacterium
NGELGATGTDTATSA

SEQ ID NO: 530042 - protein, 9 aa, Mycobacterium
NGELKQHSR

SEQ ID NO: 530043 - protein, 6 aa, Mycobacterium
NGELNA

SEQ ID NO: 530044 - protein, 11 aa, Mycobacterium
NGENDGTGADV

SEQ ID NO: 530045 - protein, 7 aa, Mycobacterium
NGEPAPV

SEQ ID NO: 530046 - protein, 7 aa, Mycobacterium
NGEPCRP

SEQ ID NO: 530047 - protein, 8 aa, Mycobacterium
NGEPEATV

SEQ ID NO: 530048 - protein, 8 aa, Mycobacterium
NGEPELNS

SEQ ID NO: 530049 - protein, 6 aa, Mycobacterium
NGEPFT

SEQ ID NO: 530050 - protein, 8 aa, Mycobacterium
NGEPGESV

SEQ ID NO: 530051 - protein, 10 aa, Mycobacterium
NGEPGTGQHV

SEQ ID NO: 530052 - protein, 8 aa, Mycobacterium
NGEPIGAS

SEQ ID NO: 530053 - protein, 6 aa, Mycobacterium
NGEPLD

SEQ ID NO: 530054 - protein, 5 aa, Mycobacterium
NGEPQ

SEQ ID NO: 530055 - protein, 6 aa, Mycobacterium
NGEPQG

SEQ ID NO: 530056 - protein, 11 aa, Mycobacterium
NGEPRQESHSS

SEQ ID NO: 530057 - protein, 6 aa, Mycobacterium
NGEPVA

SEQ ID NO: 530058 - protein, 15 aa, Mycobacterium
NGEPVGPADLDDAEE

SEQ ID NO: 530059 - protein, 9 aa, Mycobacterium
NGEPYSKTH

SEQ ID NO: 530060 - protein, 6 aa, Mycobacterium
NGEQLE

SEQ ID NO: 530061 - protein, 23 aa, Mycobacterium
NGEQRSQYDEDRPAPDRQRDSAM

SEQ ID NO: 530062 - protein, 17 aa, Mycobacterium
NGEQSWPGSGPAPVKPF

SEQ ID NO: 530063 - protein, 5 aa, Mycobacterium
NGEQV

SEQ ID NO: 530064 - protein, 34 aa, Mycobacterium
NGERRRIADPPTGSVPAAKVRGSAAAAPPTEPTC

SEQ ID NO: 530065 - protein, 5 aa, Mycobacterium
NGERV

SEQ ID NO: 530066 - protein, 4 aa, Mycobacterium
NGES

SEQ ID NO: 530067 - protein, 5 aa, Mycobacterium
NGESG

SEQ ID NO: 530068 - protein, 6 aa, Mycobacterium
NGESGL

SEQ ID NO: 530069 - protein, 11 aa, Mycobacterium
NGESIATGQVP

SEQ ID NO: 530070 - protein, 10 aa, Mycobacterium
NGESIEDHRS

SEQ ID NO: 530071 - protein, 9 aa, Mycobacterium
NGESKRIEQ

SEQ ID NO: 530072 - protein, 8 aa, Mycobacterium
NGESMADH

SEQ ID NO: 530073 - protein, 8 aa, Mycobacterium
NGESPVPP

SEQ ID NO: 530074 - protein, 11 aa, Mycobacterium
NGESVDDHRKR

SEQ ID NO: 530075 - protein, 9 aa, Mycobacterium
NGETADGAP

SEQ ID NO: 530076 - protein, 17 aa, Mycobacterium
NGETARVPDHVIALRRD

SEQ ID NO: 530077 - protein, 22 aa, Mycobacterium
NGETLQEARNAAGGRVAEGVTS

SEQ ID NO: 530078 - protein, 7 aa, Mycobacterium
NGETNYG

SEQ ID NO: 530079 - protein, 17 aa, Mycobacterium
NGETPIAEALAGQRARR

SEQ ID NO: 530080 - protein, 7 aa, Mycobacterium
NGETVEG

SEQ ID NO: 530081 - protein, 11 aa, Mycobacterium
NGEVPSTGEPF

SEQ ID NO: 530082 - protein, 7 aa, Mycobacterium
NGEYGRA

SEQ ID NO: 530083 - protein, 4 aa, Mycobacterium
NGFD

SEQ ID NO: 530084 - protein, 14 aa, Mycobacterium
NGFDATATDLSAPT

SEQ ID NO: 530085 - protein, 6 aa, Mycobacterium
NGFDDG

SEQ ID NO: 530086 - protein, 14 aa, Mycobacterium
NGFDPTAVRMVVTR

SEQ ID NO: 530087 - protein, 14 aa, Mycobacterium
NGFDPTPVRMVVES

SEQ ID NO: 530088 - protein, 5 aa, Mycobacterium
NGFGK

SEQ ID NO: 530089 - protein, 13 aa, Mycobacterium
NGFHKPDDARRAF

SEQ ID NO: 530090 - protein, 14 aa, Mycobacterium
NGFHKPDDARRAFD

SEQ ID NO: 530091 - protein, 59 aa, Mycobacterium
NGFNTDSVQPPRSITGDDLKPGAGPSLAEPRMGGAGLNAGATHTDQNLSAPNAPGPRVN

SEQ ID NO: 530092 - protein, 10 aa, Mycobacterium
NGFPGTSATF

SEQ ID NO: 530093 - protein, 11 aa, Mycobacterium
NGFPVEQQRRQ

SEQ ID NO: 530094 - protein, 4 aa, Mycobacterium
NGFS

SEQ ID NO: 530095 - protein, 5 aa, Mycobacterium
NGFSE

SEQ ID NO: 530096 - protein, 6 aa, Mycobacterium
NGFSEK

SEQ ID NO: 530097 - protein, 17 aa, Mycobacterium
NGGAAAASLGSGRQRPG

SEQ ID NO: 530098 - protein, 17 aa, Mycobacterium
NGGAADGDDVDGRPQEE

SEQ ID NO: 530099 - protein, 49 aa, Mycobacterium
NGGAANVGVGNGGGGNMGFGNSGTENTGSFNSGGDNGPNGGNTGSFNSG

SEQ ID NO: 530100 - protein, 8 aa, Mycobacterium
NGGADRHP

SEQ ID NO: 530101 - protein, 21 aa, Mycobacterium
NGGADRNRASAPDGLATDVPD

SEQ ID NO: 530102 - protein, 8 aa, Mycobacterium
NGGAETGE

SEQ ID NO: 530103 - protein, 47 aa, Mycobacterium
NGGAGFNNGATAGAAGGNGGNAGLIGNGGAGGNGGAGAAGGTGGNGG

SEQ ID NO: 530104 - protein, 25 aa, Mycobacterium
NGGAGGAGATGGGNTGGIGGDGGNA

SEQ ID NO: 530105 - protein, 32 aa, Mycobacterium
NGGAGGAGGAGAPGPVSFNGNNGGNGGNGGAA

SEQ ID NO: 530106 - protein, 13 aa, Mycobacterium
NGGAGGAGGAGTA

SEQ ID NO: 530107 - protein, 15 aa, Mycobacterium
NGGAGGAGGASAIPL

SEQ ID NO: 530108 - protein, 33 aa, Mycobacterium
NGGAGGAGGASGAGIGGDSLGGSGGNGGNGGIS

SEQ ID NO: 530109 - protein, 12 aa, Mycobacterium
NGGAGGAGGESF

SEQ ID NO: 530110 - protein, 31 aa, Mycobacterium
NGGAGGAGGHGGGGPGMGGDGGDGGDGGRAQ

SEQ ID NO: 530111 - protein, 10 aa, Mycobacterium
NGGAGGAGGL

SEQ ID NO: 530112 - protein, 58 aa, Mycobacterium
NGGAGGAGGLGGLGGVGGAGATGADAANPTTTGQAGGDGGNGGAGGAGGDGGGGGKSG

SEQ ID NO: 530113 - protein, 10 aa, Mycobacterium
NGGAGGAGGS

SEQ ID NO: 530114 - protein, 27 aa, Mycobacterium
NGGAGGAGGTSGNGGGTGGAGGAAGSG

SEQ ID NO: 530115 - protein, 19 aa, Mycobacterium
NGGAGGAGGVGANGGGGGN

SEQ ID NO: 530116 - protein, 33 aa, Mycobacterium
NGGAGGAGGVGGAGIGTGGLGSNGGNGGTGGIG

SEQ ID NO: 530117 - protein, 25 aa, Mycobacterium
NGGAGGAGGVGGAGVSGGVGGTGGN

SEQ ID NO: 530118 - protein, 51 aa, Mycobacterium
NGGAGGAGTATHTAGGNGGDAGLIGNGGAGGAGFNAGNGAAGGAGGAGGHG

SEQ ID NO: 530119 - protein, 35 aa, Mycobacterium
NGGAGGDGGAGGASQEFGDSGGNGGNGGAGGASGA

SEQ ID NO: 530120 - protein, 40 aa, Mycobacterium
NGGAGGDGGAGGEGGDSSGGAASAGGDGGAGGAGGAGANG

SEQ ID NO: 530121 - protein, 38 aa, Mycobacterium
NGGAGGDGGATGTPGTYSDGTGTGSVYQTSDGGGGGDG

SEQ ID NO: 530122 - protein, 20 aa, Mycobacterium
NGGAGGDSSSMGNSGNGGNA

SEQ ID NO: 530123 - protein, 24 aa, Mycobacterium
NGGAGGGGGDGINVGGKGGAGGAA

SEQ ID NO: 530124 - protein, 22 aa, Mycobacterium
NGGAGGGGTAAHPAGGNGGAAG

SEQ ID NO: 530125 - protein, 21 aa, Mycobacterium
NGGAGGHGGAGGAGGIGGNGG

SEQ ID NO: 530126 - protein, 28 aa, Mycobacterium
NGGAGGHGGPGVAGVNGGNAGQGGHGGN

SEQ ID NO: 530127 - protein, 76 aa, Mycobacterium
NGGAGGIGGAGGVVGSSEGGVDGGVGGSGGSGGATGLLGNGGAGGTGGQGGDGGRGFDGSLGAGGAGGTGAVGGSG

SEQ ID NO: 530128 - protein, 31 aa, Mycobacterium
NGGAGGIGGIGASGSFGAPSGQGGNGGIGGA

SEQ ID NO: 530129 - protein, 35 aa, Mycobacterium
NGGAGGIGGTGGSGGAGAPGGIGGGGGGGGIGTAT

SEQ ID NO: 530130 - protein, 36 aa, Mycobacterium
NGGAGGIGGTGGSGLDGPDSGAAGGAGGSGGSGGAA

SEQ ID NO: 530131 - protein, 21 aa, Mycobacterium
NGGAGGIGGTSAGSGGAGGAG

SEQ ID NO: 530132 - protein, 19 aa, Mycobacterium
NGGAGGMGGTGSTAGAGGS

SEQ ID NO: 530133 - protein, 33 aa, Mycobacterium
NGGAGGNAGDGGVGGTGFDGGDGGVGGQGGSSG

SEQ ID NO: 530134 - protein, 15 aa, Mycobacterium
NGGAGGNGATGGTGF

SEQ ID NO: 530135 - protein, 20 aa, Mycobacterium
NGGAGGNGFSNASGGLGGQA

SEQ ID NO: 530136 - protein, 11 aa, Mycobacterium
NGGAGGNGGDA

SEQ ID NO: 530137 - protein, 19 aa, Mycobacterium
NGGAGGNGGQGGDAGANGF

SEQ ID NO: 530138 - protein, 22 aa, Mycobacterium
NGGAGGNGGTASTGGAGGGGGA

SEQ ID NO: 530139 - protein, 28 aa, Mycobacterium
NGGAGGPGGAGGNAGLIGNGGAGGSGAA

SEQ ID NO: 530140 - protein, 15 aa, Mycobacterium
NGGAGGQGGAGAAAV

SEQ ID NO: 530141 - protein, 101 aa, Mycobacterium
NGGAGGQGGTGMAGTDGTNPTPTGTAGTGASGTPFSGDGHAGSGHTGDNGAPGENGGTGGTGGEATGAGGIGGTGGNGGAAGSGGANGGDGGVGGAATDTF

SEQ ID NO: 530142 - protein, 45 aa, Mycobacterium
NGGAGGSGAAGGNGGAGGAAGLVGNGGAGGAGGNNAAGGSGGAGG

SEQ ID NO: 530143 - protein, 21 aa, Mycobacterium
NGGAGGSGAAGQAGGAGGAAG

SEQ ID NO: 530144 - protein, 43 aa, Mycobacterium
NGGAGGSGAAGQAGGAGGAAGLIGSGGAGGIGGTGAAGGKGGN

SEQ ID NO: 530145 - protein, 21 aa, Mycobacterium
NGGAGGSGAAGQAGGDGGAAG

SEQ ID NO: 530146 - protein, 23 aa, Mycobacterium
NGGAGGSGAAGSGQNGGAGGAAG

SEQ ID NO: 530147 - protein, 21 aa, Mycobacterium
NGGAGGSGADGQNGGAGGNAG

SEQ ID NO: 530148 - protein, 22 aa, Mycobacterium
NGGAGGSGAPGMPGGNGGDAGL

SEQ ID NO: 530149 - protein, 20 aa, Mycobacterium
NGGAGGSGAPGQSGGTGGAA

SEQ ID NO: 530150 - protein, 22 aa, Mycobacterium
NGGAGGSGASGQAGGAGGAAGL

SEQ ID NO: 530151 - protein, 23 aa, Mycobacterium
NGGAGGSGATGLTGGAGGNGGAA

SEQ ID NO: 530152 - protein, 27 aa, Mycobacterium
NGGAGGSGAVNGLGTGQAGGNGGAAGL

SEQ ID NO: 530153 - protein, 33 aa, Mycobacterium
NGGAGGSGGAGGAGIGTGGFGGSGGNGGTGGIG

SEQ ID NO: 530154 - protein, 25 aa, Mycobacterium
NGGAGGSGGMSGSGTGLPGGNGGAG

SEQ ID NO: 530155 - protein, 38 aa, Mycobacterium
NGGAGGSGGQGGNGGSAIETGNGGAAGAGGTGGAGGHG

SEQ ID NO: 530156 - protein, 23 aa, Mycobacterium
NGGAGGSGGTAHPTGGRGGNAGL

SEQ ID NO: 530157 - protein, 23 aa, Mycobacterium
NGGAGGSGGTGQNGGNGGPAGLF

SEQ ID NO: 530158 - protein, 26 aa, Mycobacterium
NGGAGGSGTPGTASVAGGNGGNGGAG

SEQ ID NO: 530159 - protein, 27 aa, Mycobacterium
NGGAGGSGTPPGLGSAGGTGGTGGAAG

SEQ ID NO: 530160 - protein, 24 aa, Mycobacterium
NGGAGGSGTSSTTADGGKGGSGGA

SEQ ID NO: 530161 - protein, 23 aa, Mycobacterium
NGGAGGTGAQGATGGGAGGTGGN

SEQ ID NO: 530162 - protein, 25 aa, Mycobacterium
NGGAGGTGGFGETGGEGGAGGGAGW

SEQ ID NO: 530163 - protein, 78 aa, Mycobacterium
NGGAGGTGGVGGSGGTGAAGGAGGTGGDGGTATGNFDPTGTAAQGQEGGDGGSGADSTGIGGNGGNGGVGGNGGNGGR

SEQ ID NO: 530164 - protein, 23 aa, Mycobacterium
NGGAGGTGSAANPDGGNGGAAGL

SEQ ID NO: 530165 - protein, 80 aa, Mycobacterium
NGGAGGVGGTGGTGGGGGTGTVAGGINGISGDGGSGGAGGPGGNAQTIGNGGDGGNGGDGGVGANPGTGGIGAAGGTGGT

SEQ ID NO: 530166 - protein, 23 aa, Mycobacterium
NGGAGGVGGVGATGLAGGTGGAA

SEQ ID NO: 530167 - protein, 9 aa, Mycobacterium
NGGAGYTST

SEQ ID NO: 530168 - protein, 7 aa, Mycobacterium
NGGANDG

SEQ ID NO: 530169 - protein, 6 aa, Mycobacterium
NGGAPE

SEQ ID NO: 530170 - protein, 8 aa, Mycobacterium
NGGARPHT

SEQ ID NO: 530171 - protein, 24 aa, Mycobacterium
NGGARRIDGDQTDTERSAINGGKA

SEQ ID NO: 530172 - protein, 8 aa, Mycobacterium
NGGARRNP

SEQ ID NO: 530173 - protein, 13 aa, Mycobacterium
NGGASRPDGIAKQ

SEQ ID NO: 530174 - protein, 5 aa, Mycobacterium
NGGAV

SEQ ID NO: 530175 - protein, 4 aa, Mycobacterium
NGGD

SEQ ID NO: 530176 - protein, 8 aa, Mycobacterium
NGGDERYP

SEQ ID NO: 530177 - protein, 35 aa, Mycobacterium
NGGDGADGTAPGQAGGRGGDAGFIGSGGKGGRGTD

SEQ ID NO: 530178 - protein, 26 aa, Mycobacterium
NGGDGGAGAAATIGNAAGNGGAGGNA

SEQ ID NO: 530179 - protein, 50 aa, Mycobacterium
NGGDGGAGAAGQAGGRGGDAGLIGTGGAGGAGGAGGAGGNGGAGGAGGRG

SEQ ID NO: 530180 - protein, 71 aa, Mycobacterium
NGGDGGAGGDGGVGGTGGIGGAGGNGGVGGDGSSSGTGAGGSGGDATDGGTGGDGGSGGGFGTGGAGGTGG

SEQ ID NO: 530181 - protein, 25 aa, Mycobacterium
NGGDGGAGGIGTAGLAGSGGTGGSA

SEQ ID NO: 530182 - protein, 32 aa, Mycobacterium
NGGDGGDGGAGGAGGTGGSAGTGGAGGNGGNA

SEQ ID NO: 530183 - protein, 25 aa, Mycobacterium
NGGDGGDGGNSFQGNGGDGGIGGNA

SEQ ID NO: 530184 - protein, 27 aa, Mycobacterium
NGGDGGDGGNSLASLAGAGGAAGNAGL

SEQ ID NO: 530185 - protein, 38 aa, Mycobacterium
NGGDGGHGGTGGGGGRGINGADGGHGGDGGTGGAAGSA

SEQ ID NO: 530186 - protein, 83 aa, Mycobacterium
NGGDGGNSGSGGTFESAGGSVLSGAQGGGFAASAGNGGNSGLFGNGGSGGNGGNGGLGQAASGDDSQGGIGGDGAQGGNGGKA

SEQ ID NO: 530187 - protein, 22 aa, Mycobacterium
NGGDGGSGASGQIGGTGGSAGL

SEQ ID NO: 530188 - protein, 35 aa, Mycobacterium
NGGDGGSGGAGGTGGTGGAGGAGAAGGAGGNGSTQ

SEQ ID NO: 530189 - protein, 21 aa, Mycobacterium
NGGDGGSGTPGTATSPAGGRW

SEQ ID NO: 530190 - protein, 19 aa, Mycobacterium
NGGDGGTGGGTGTDGLGGT

SEQ ID NO: 530191 - protein, 7 aa, Mycobacterium
NGGDTPA

SEQ ID NO: 530192 - protein, 5 aa, Mycobacterium
NGGEA

SEQ ID NO: 530193 - protein, 6 aa, Mycobacterium
NGGEPR

SEQ ID NO: 530194 - protein, 14 aa, Mycobacterium
NGGEPTDPSTTVEG

SEQ ID NO: 530195 - protein, 7 aa, Mycobacterium
NGGEPVD

SEQ ID NO: 530196 - protein, 4 aa, Mycobacterium
NGGF

SEQ ID NO: 530197 - protein, 6 aa, Mycobacterium
NGGFDA

SEQ ID NO: 530198 - protein, 6 aa, Mycobacterium
NGGFEL

SEQ ID NO: 530199 - protein, 4 aa, Mycobacterium
NGGG

SEQ ID NO: 530200 - protein, 7 aa, Mycobacterium
NGGGGAK

SEQ ID NO: 530201 - protein, 8 aa, Mycobacterium
NGGGGAKY

SEQ ID NO: 530202 - protein, 67 aa, Mycobacterium
NGGGGGAGGIGGGGGTGAVGGTGGAGGAGGDSEFAGGNGNTGGDGGTGGTGGAGGDGGNGGAGGAGG

SEQ ID NO: 530203 - protein, 10 aa, Mycobacterium
NGGGGGDAGL

SEQ ID NO: 530204 - protein, 11 aa, Mycobacterium
NGGGGGTGGFG

SEQ ID NO: 530205 - protein, 14 aa, Mycobacterium
NGGGGGVGGVGGVG

SEQ ID NO: 530206 - protein, 7 aa, Mycobacterium
NGGGKTT

SEQ ID NO: 530207 - protein, 7 aa, Mycobacterium
NGGGLGQ

SEQ ID NO: 530208 - protein, 9 aa, Mycobacterium
NGGGLNPAA

SEQ ID NO: 530209 - protein, 7 aa, Mycobacterium
NGGGNDG

SEQ ID NO: 530210 - protein, 8 aa, Mycobacterium
NGGGPGEL

SEQ ID NO: 530211 - protein, 16 aa, Mycobacterium
NGGGRRTSSSGSATTC

SEQ ID NO: 530212 - protein, 13 aa, Mycobacterium
NGGGSRPDGIAKQ

SEQ ID NO: 530213 - protein, 14 aa, Mycobacterium
NGGGSRPDGIAKQE

SEQ ID NO: 530214 - protein, 6 aa, Mycobacterium
NGGGTV

SEQ ID NO: 530215 - protein, 6 aa, Mycobacterium
NGGGVL

SEQ ID NO: 530216 - protein, 12 aa, Mycobacterium
NGGGYTSAKHAQ

SEQ ID NO: 530217 - protein, 33 aa, Mycobacterium
NGGHGGNGGDGGTTGIARGDNGGDGGNGGNGGW

SEQ ID NO: 530218 - protein, 41 aa, Mycobacterium
NGGHGGTGGAGGTLSGIGGHGGAGGLGQVSGGAGGDGGNGG

SEQ ID NO: 530219 - protein, 34 aa, Mycobacterium
NGGHGGTGGTGSAAGGPGGSGGAGGTGGAGGHGG

SEQ ID NO: 530220 - protein, 9 aa, Mycobacterium
NGGHLQPST

SEQ ID NO: 530221 - protein, 6 aa, Mycobacterium
NGGHST

SEQ ID NO: 530222 - protein, 7 aa, Mycobacterium
NGGIASK

SEQ ID NO: 530223 - protein, 22 aa, Mycobacterium
NGGIGGDGGVAANGGAGGQGGL

SEQ ID NO: 530224 - protein, 20 aa, Mycobacterium
NGGIGGQGGAGGIGGAGGSA

SEQ ID NO: 530225 - protein, 15 aa, Mycobacterium
NGGILSEQTALILEG

SEQ ID NO: 530226 - protein, 12 aa, Mycobacterium
NGGKLPGVPDDE

SEQ ID NO: 530227 - protein, 6 aa, Mycobacterium
NGGKSD

SEQ ID NO: 530228 - protein, 6 aa, Mycobacterium
NGGKSS

SEQ ID NO: 530229 - protein, 22 aa, Mycobacterium
NGGKYNPAAPFGGYKKSGVGRE

SEQ ID NO: 530230 - protein, 5 aa, Mycobacterium
NGGLA

SEQ ID NO: 530231 - protein, 14 aa, Mycobacterium
NGGLDDRRSSNGYL

SEQ ID NO: 530232 - protein, 26 aa, Mycobacterium
NGGLGGGGGSGSINNGGNGGSGGTGG

SEQ ID NO: 530233 - protein, 4 aa, Mycobacterium
NGGM

SEQ ID NO: 530234 - protein, 20 aa, Mycobacterium
NGGMGGAGGAGAAGGAGGTG

SEQ ID NO: 530235 - protein, 11 aa, Mycobacterium
NGGNAGIGGAG

SEQ ID NO: 530236 - protein, 23 aa, Mycobacterium
NGGNAGTGGAGPSNGGNGVGGTG

SEQ ID NO: 530237 - protein, 22 aa, Mycobacterium
NGGNAGTGGTGLSTGSTGAGGI

SEQ ID NO: 530238 - protein, 23 aa, Mycobacterium
NGGNAGVGGASTTNGGTGVGGTG

SEQ ID NO: 530239 - protein, 23 aa, Mycobacterium
NGGNAGVGGTGPAAGATGVGGTS

SEQ ID NO: 530240 - protein, 26 aa, Mycobacterium
NGGNGAAGAIEQHGAGAVGGAGGAAG

SEQ ID NO: 530241 - protein, 22 aa, Mycobacterium
NGGNGAAGDFGQAGGGGGSAGL

SEQ ID NO: 530242 - protein, 22 aa, Mycobacterium
NGGNGAMGGTGPTVGATGAGGM

SEQ ID NO: 530243 - protein, 24 aa, Mycobacterium
NGGNGANGGNTGAPGTLSGGGTGT

SEQ ID NO: 530244 - protein, 23 aa, Mycobacterium
NGGNGAPGANPGVAGGAGGAAGL

SEQ ID NO: 530245 - protein, 21 aa, Mycobacterium
NGGNGAPGAVGQAGGAGGAAG

SEQ ID NO: 530246 - protein, 45 aa, Mycobacterium
NGGNGAPGTNQGVAGGNGGSAGLIGNGGAGGLGGPGGAGGAGGHG

SEQ ID NO: 530247 - protein, 24 aa, Mycobacterium
NGGNGASGAPGQAGGAGGDAGLIG

SEQ ID NO: 530248 - protein, 47 aa, Mycobacterium
NGGNGFSPTTAGAPGGNGGSAGLIGNGGAGGSGGAGAAGGVGGNGGG

SEQ ID NO: 530249 - protein, 23 aa, Mycobacterium
NGGNGFSQTTAGVAGGSGGAAGL

SEQ ID NO: 530250 - protein, 24 aa, Mycobacterium
NGGNGGAGAGSDQGGTGGTGGTGG

SEQ ID NO: 530251 - protein, 27 aa, Mycobacterium
NGGNGGAGGHGFGAGTPGKGGGGGTAG

SEQ ID NO: 530252 - protein, 11 aa, Mycobacterium
NGGNGGAGGVG

SEQ ID NO: 530253 - protein, 24 aa, Mycobacterium
NGGNGGASTNLGAVGGAGGSAGLI

SEQ ID NO: 530254 - protein, 20 aa, Mycobacterium
NGGNGGHATAAGSTPGTGGL

SEQ ID NO: 530255 - protein, 8 aa, Mycobacterium
NGGNGGIG

SEQ ID NO: 530256 - protein, 23 aa, Mycobacterium
NGGNGGIGGAGPTPGGNGIGGTS

SEQ ID NO: 530257 - protein, 10 aa, Mycobacterium
NGGNGGMGGM

SEQ ID NO: 530258 - protein, 11 aa, Mycobacterium
NGGNGGMGGTA

SEQ ID NO: 530259 - protein, 24 aa, Mycobacterium
NGGNGGNAGSGGTSGFEGVAGQGG

SEQ ID NO: 530260 - protein, 21 aa, Mycobacterium
NGGNGGNAGSGGVGPGIAGAA

SEQ ID NO: 530261 - protein, 35 aa, Mycobacterium
NGGNGGNAGTGPTTGAGGTGGTGGNLLGVNGFDGL

SEQ ID NO: 530262 - protein, 38 aa, Mycobacterium
NGGNGGNGAAGATAGTDGKGGAGGTGGTLLGEDGLNGL

SEQ ID NO: 530263 - protein, 51 aa, Mycobacterium
NGGNGGNGGAGQAGGGGGSAGLLGNGGNGGNGGPGIPGGPGPAGGNGGNGG

SEQ ID NO: 530264 - protein, 27 aa, Mycobacterium
NGGNGGNGGAVVTGGTPGGGGNGGTGG

SEQ ID NO: 530265 - protein, 17 aa, Mycobacterium
NGGNGGNGGDGGTRPKG

SEQ ID NO: 530266 - protein, 26 aa, Mycobacterium
NGGNGGNGGNGGNVGTGTPGAGGSGG

SEQ ID NO: 530267 - protein, 19 aa, Mycobacterium
NGGNGGNGGPDQPGGAGGC

SEQ ID NO: 530268 - protein, 27 aa, Mycobacterium
NGGNGGNGGTDGTGAPTGSPGAGGTGG

SEQ ID NO: 530269 - protein, 10 aa, Mycobacterium
NGGNGGNGGV

SEQ ID NO: 530270 - protein, 17 aa, Mycobacterium
NGGNGGNTGNGGTFQAS

SEQ ID NO: 530271 - protein, 55 aa, Mycobacterium
NGGNGGSGAAGQAGGNGGSAGLLGNGGAGGAGGAGASGAAGDSGLTGGNGGIGGA

SEQ ID NO: 530272 - protein, 56 aa, Mycobacterium
NGGNGGSGAAGQAGGNGGSAGLLGNGGNGGAGGAGAAGASGVSGQAGGSGGMGGSG

SEQ ID NO: 530273 - protein, 19 aa, Mycobacterium
NGGNGGSGAAGQTGGDGGV

SEQ ID NO: 530274 - protein, 20 aa, Mycobacterium
NGGNGGSGAAGQVGGTGGAA

SEQ ID NO: 530275 - protein, 22 aa, Mycobacterium
NGGNGGSGAPGGNGGAGGSAGL

SEQ ID NO: 530276 - protein, 35 aa, Mycobacterium
NGGNGGSGAPGLPGGRGGDAGLVGNGGQGGAGGNA

SEQ ID NO: 530277 - protein, 22 aa, Mycobacterium
NGGNGGSGAPGQAGGAGGSAGL

SEQ ID NO: 530278 - protein, 23 aa, Mycobacterium
NGGNGGSGAPGQRGGDGGDAGLL

SEQ ID NO: 530279 - protein, 22 aa, Mycobacterium
NGGNGGSGATGQVGGSGGAAGL

SEQ ID NO: 530280 - protein, 36 aa, Mycobacterium
NGGNGGSGAVGQNGGNGGSAGLWGNGGNGAPGGAGA

SEQ ID NO: 530281 - protein, 21 aa, Mycobacterium
NGGNGGSGGLAQAGGNGGAAG

SEQ ID NO: 530282 - protein, 52 aa, Mycobacterium
NGGNGGSGGPGQLGGNGGSAGLIGNGGAGGAGGPGTPPRWSAKPAGRAAAAG

SEQ ID NO: 530283 - protein, 20 aa, Mycobacterium
NGGNGGSGGVGQAGGAGGAA

SEQ ID NO: 530284 - protein, 22 aa, Mycobacterium
NGGNGGSGGVGQNGGSGGSAGL

SEQ ID NO: 530285 - protein, 19 aa, Mycobacterium
NGGNGGSGLAGQAGGVGGA

SEQ ID NO: 530286 - protein, 22 aa, Mycobacterium
NGGNGGTGAAGQAGGNGGAAGL

SEQ ID NO: 530287 - protein, 23 aa, Mycobacterium
NGGNGGTSTNAATAGGAGGSAGL

SEQ ID NO: 530288 - protein, 23 aa, Mycobacterium
NGGNGGTSTTAGVAGGDGGAAGL

SEQ ID NO: 530289 - protein, 11 aa, Mycobacterium
NGGNGGVGGIG

SEQ ID NO: 530290 - protein, 22 aa, Mycobacterium
NGGNGGVGGVGETPGGDGGGGI

SEQ ID NO: 530291 - protein, 44 aa, Mycobacterium
NGGNGWNSTTGGAAGGNGGDAGLLGNGGTGGSGGALAPGGTGGV

SEQ ID NO: 530292 - protein, 23 aa, Mycobacterium
NGGNGYSETTAGVAGGAGGAAGL

SEQ ID NO: 530293 - protein, 48 aa, Mycobacterium
NGGNGYSFTSGGLQNGGSGGSAGLIGNGGNGGNGFLGGTGGAGGSGGW

SEQ ID NO: 530294 - protein, 35 aa, Mycobacterium
NGGNGYSFTSGGTQSGGTGGSAGLIGNGGNGGNGF

SEQ ID NO: 530295 - protein, 46 aa, Mycobacterium
NGGNGYSQTASGVPGGAGGPAGLIGNGGAGGTGGTGAPGGAGGNGG

SEQ ID NO: 530296 - protein, 35 aa, Mycobacterium
NGGNGYSQTDGGLAGGKGGNAGLIGNGGAGGNGGD

SEQ ID NO: 530297 - protein, 23 aa, Mycobacterium
NGGNGYSQTTPGLTGGTGGTAGL

SEQ ID NO: 530298 - protein, 5 aa, Mycobacterium
NGGNH

SEQ ID NO: 530299 - protein, 13 aa, Mycobacterium
NGGNPGSGGDGGS

SEQ ID NO: 530300 - protein, 7 aa, Mycobacterium
NGGNRTV

SEQ ID NO: 530301 - protein, 31 aa, Mycobacterium
NGGNSGDVGLSGAGTPGLPGNGGLLIGTIGN

SEQ ID NO: 530302 - protein, 4 aa, Mycobacterium
NGGP

SEQ ID NO: 530303 - protein, 7 aa, Mycobacterium
NGGPCRG

SEQ ID NO: 530304 - protein, 5 aa, Mycobacterium
NGGPL

SEQ ID NO: 530305 - protein, 6 aa, Mycobacterium
NGGPPI

SEQ ID NO: 530306 - protein, 6 aa, Mycobacterium
NGGPSV

SEQ ID NO: 530307 - protein, 15 aa, Mycobacterium
NGGPVKPSDKPPRPF

SEQ ID NO: 530308 - protein, 27 aa, Mycobacterium
NGGRGGAGGDGANLAGGGNGGNGGDTR

SEQ ID NO: 530309 - protein, 21 aa, Mycobacterium
NGGRGGDGVAGQAGGRGGSAG

SEQ ID NO: 530310 - protein, 12 aa, Mycobacterium
NGGRGGDSTAVG

SEQ ID NO: 530311 - protein, 43 aa, Mycobacterium
NGGRGGDSTLAGVSGGGGGDAGLIGNGGAGGTGGNGGSGGLGG

SEQ ID NO: 530312 - protein, 7 aa, Mycobacterium
NGGRIDG

SEQ ID NO: 530313 - protein, 178 aa, Mycobacterium
NGGRPTPVQPPQPRPDSVAPTSPVTANGDPRDRGVPARTEDEERRDPWGAGEQPNAQGGGAPSGGEPQQPQTPQEAPVSPPVAEQPPQATQQSGQQESSPAGGQQGGGQQGGAPGGSPGGSPGGGSPGGGMPTTGKGTEPRLPTDPSLKPAAAGGGSSGGGGGGGGVPAGPLQPAVGA

SEQ ID NO: 530314 - protein, 4 aa, Mycobacterium
NGGS

SEQ ID NO: 530315 - protein, 17 aa, Mycobacterium
NGGSGAAGQNGENGGAA

SEQ ID NO: 530316 - protein, 43 aa, Mycobacterium
NGGSGGAGGAGGMGGNGGNGVGNPGDGGDGGGGGAGASGGDGG

SEQ ID NO: 530317 - protein, 10 aa, Mycobacterium
NGGSGGAGGW

SEQ ID NO: 530318 - protein, 49 aa, Mycobacterium
NGGSGGDGGVGGTGGTGGAGGSGAGGGVGGDGSSRGGIGGNGGSGANSM

SEQ ID NO: 530319 - protein, 39 aa, Mycobacterium
NGGSGGLGGVGGQATGATTSSDLGGVGGAGGNGGSGAHG

SEQ ID NO: 530320 - protein, 17 aa, Mycobacterium
NGGSGGQGGLAGTADPV

SEQ ID NO: 530321 - protein, 31 aa, Mycobacterium
NGGSGGQGGTGLAGADGVNYSNGTAGPGAWG

SEQ ID NO: 530322 - protein, 21 aa, Mycobacterium
NGGSGGSGAAGQAGGAGGAAG

SEQ ID NO: 530323 - protein, 20 aa, Mycobacterium
NGGSGGSGAAGSVGGNGGAA

SEQ ID NO: 530324 - protein, 20 aa, Mycobacterium
NGGSGGSGAPGHDGGNGGAA

SEQ ID NO: 530325 - protein, 22 aa, Mycobacterium
NGGSGGSGAPGKPGGNGGSAGL

SEQ ID NO: 530326 - protein, 8 aa, Mycobacterium
NGGSGWNS

SEQ ID NO: 530327 - protein, 7 aa, Mycobacterium
NGGSNDV

SEQ ID NO: 530328 - protein, 7 aa, Mycobacterium
NGGSRST

SEQ ID NO: 530329 - protein, 11 aa, Mycobacterium
NGGSSGNSIET

SEQ ID NO: 530330 - protein, 6 aa, Mycobacterium
NGGSST

SEQ ID NO: 530331 - protein, 10 aa, Mycobacterium
NGGSTGNSLE

SEQ ID NO: 530332 - protein, 11 aa, Mycobacterium
NGGTAKREIDA

SEQ ID NO: 530333 - protein, 7 aa, Mycobacterium
NGGTAQL

SEQ ID NO: 530334 - protein, 7 aa, Mycobacterium
NGGTEAV

SEQ ID NO: 530335 - protein, 13 aa, Mycobacterium
NGGTGGAAGDLAS

SEQ ID NO: 530336 - protein, 23 aa, Mycobacterium
NGGTGGAGGAGGTGGVGGQVNAE

SEQ ID NO: 530337 - protein, 23 aa, Mycobacterium
NGGTGGISTRAGVPGGAGGAAGL

SEQ ID NO: 530338 - protein, 21 aa, Mycobacterium
NGGTGGNGGLSGNGAAGGTGG

SEQ ID NO: 530339 - protein, 9 aa, Mycobacterium
NGGTGGPGG

SEQ ID NO: 530340 - protein, 30 aa, Mycobacterium
NGGTGGRGGLGASATSFAGGSGGAGGAGGV

SEQ ID NO: 530341 - protein, 45 aa, Mycobacterium
NGGTGGSGAPGQNGGAGGNAGLLGSGGTGGVGGAGATGGTGGTGG

SEQ ID NO: 530342 - protein, 19 aa, Mycobacterium
NGGTGGSGLGGGGNGGNAV

SEQ ID NO: 530343 - protein, 25 aa, Mycobacterium
NGGTGGTGGVGTGNIAGGAGGFGGS

SEQ ID NO: 530344 - protein, 30 aa, Mycobacterium
NGGTGGVGGTGGMGGAGAAGGTGGDGGNAG

SEQ ID NO: 530345 - protein, 9 aa, Mycobacterium
NGGTRDPIA

SEQ ID NO: 530346 - protein, 9 aa, Mycobacterium
NGGTRLAEG

SEQ ID NO: 530347 - protein, 7 aa, Mycobacterium
NGGTVDG

SEQ ID NO: 530348 - protein, 14 aa, Mycobacterium
NGGTYGGVESRNRQ

SEQ ID NO: 530349 - protein, 4 aa, Mycobacterium
NGGV

SEQ ID NO: 530350 - protein, 7 aa, Mycobacterium
NGGVGEA

SEQ ID NO: 530351 - protein, 67 aa, Mycobacterium
NGGVGGAGGVGAFGSGGTGGNGGAGGAVGNGGAGGDAGSSGNLSPAGGGKGGNAKLVGNGGDGGAGV

SEQ ID NO: 530352 - protein, 23 aa, Mycobacterium
NGGVGGDGQYGTTSSAGGIGGNG

SEQ ID NO: 530353 - protein, 56 aa, Mycobacterium
NGGVGGTGGTSRFGGLGGNGGVGGKAGLIGNGGDGGAGGNSGSATGTGGNGGAGGS

SEQ ID NO: 530354 - protein, 21 aa, Mycobacterium
NGGVGGVGGVGAGDGGAGGRA

SEQ ID NO: 530355 - protein, 6 aa, Mycobacterium
NGGVPS

SEQ ID NO: 530356 - protein, 13 aa, Mycobacterium
NGGVSRSVHPTRA

SEQ ID NO: 530357 - protein, 5 aa, Mycobacterium
NGGWQ

SEQ ID NO: 530358 - protein, 5 aa, Mycobacterium
NGGWS

SEQ ID NO: 530359 - protein, 6 aa, Mycobacterium
NGGYGA

SEQ ID NO: 530360 - protein, 7 aa, Mycobacterium
NGGYGTV

SEQ ID NO: 530361 - protein, 6 aa, Mycobacterium
NGGYNT

SEQ ID NO: 530362 - protein, 14 aa, Mycobacterium
NGHATAAPVAPLPA

SEQ ID NO: 530363 - protein, 11 aa, Mycobacterium
NGHATVDESSR

SEQ ID NO: 530364 - protein, 9 aa, Mycobacterium
NGHEASGRS

SEQ ID NO: 530365 - protein, 6 aa, Mycobacterium
NGHEPI

SEQ ID NO: 530366 - protein, 12 aa, Mycobacterium
NGHGEKPAIPPE

SEQ ID NO: 530367 - protein, 6 aa, Mycobacterium
NGHGRE

SEQ ID NO: 530368 - protein, 5 aa, Mycobacterium
NGHNA

SEQ ID NO: 530369 - protein, 10 aa, Mycobacterium
NGHNSTAPAA

SEQ ID NO: 530370 - protein, 22 aa, Mycobacterium
NGHNVSARGRIPADVIDAFHAA

SEQ ID NO: 530371 - protein, 22 aa, Mycobacterium
NGHNVSTRGRIPADVIDAFHAA

SEQ ID NO: 530372 - protein, 6 aa, Mycobacterium
NGHPGA

SEQ ID NO: 530373 - protein, 6 aa, Mycobacterium
NGHPGY

SEQ ID NO: 530374 - protein, 4 aa, Mycobacterium
NGHQ

SEQ ID NO: 530375 - protein, 7 aa, Mycobacterium
NGHRAGN

SEQ ID NO: 530376 - protein, 8 aa, Mycobacterium
NGHRGGSA

SEQ ID NO: 530377 - protein, 4 aa, Mycobacterium
NGHT

SEQ ID NO: 530378 - protein, 6 aa, Mycobacterium
NGHTTA

SEQ ID NO: 530379 - protein, 4 aa, Mycobacterium
NGIE

SEQ ID NO: 530380 - protein, 7 aa, Mycobacterium
NGIEPSE

SEQ ID NO: 530381 - protein, 8 aa, Mycobacterium
NGIGNRSL

SEQ ID NO: 530382 - protein, 9 aa, Mycobacterium
NGIGQSDAA

SEQ ID NO: 530383 - protein, 5 aa, Mycobacterium
NGIGR

SEQ ID NO: 530384 - protein, 4 aa, Mycobacterium
NGIP

SEQ ID NO: 530385 - protein, 9 aa, Mycobacterium
NGIPASASS

SEQ ID NO: 530386 - protein, 6 aa, Mycobacterium
NGIPTT

SEQ ID NO: 530387 - protein, 5 aa, Mycobacterium
NGIPY

SEQ ID NO: 530388 - protein, 4 aa, Mycobacterium
NGIT

SEQ ID NO: 530389 - protein, 9 aa, Mycobacterium
NGKAGQDKG

SEQ ID NO: 530390 - protein, 5 aa, Mycobacterium
NGKDL

SEQ ID NO: 530391 - protein, 4 aa, Mycobacterium
NGKE

SEQ ID NO: 530392 - protein, 5 aa, Mycobacterium
NGKEL

SEQ ID NO: 530393 - protein, 6 aa, Mycobacterium
NGKELE

SEQ ID NO: 530394 - protein, 8 aa, Mycobacterium
NGKFGGTF

SEQ ID NO: 530395 - protein, 6 aa, Mycobacterium
NGKGAF

SEQ ID NO: 530396 - protein, 7 aa, Mycobacterium
NGKGGQP

SEQ ID NO: 530397 - protein, 8 aa, Mycobacterium
NGKGGQPV

SEQ ID NO: 530398 - protein, 8 aa, Mycobacterium
NGKGQKKL

SEQ ID NO: 530399 - protein, 9 aa, Mycobacterium
NGKGQKKLR

SEQ ID NO: 530400 - protein, 5 aa, Mycobacterium
NGKGR

SEQ ID NO: 530401 - protein, 12 aa, Mycobacterium
NGKLPRNTAAWI

SEQ ID NO: 530402 - protein, 7 aa, Mycobacterium
NGKPIRE

SEQ ID NO: 530403 - protein, 8 aa, Mycobacterium
NGKPIREA

SEQ ID NO: 530404 - protein, 8 aa, Mycobacterium
NGKPITGR

SEQ ID NO: 530405 - protein, 15 aa, Mycobacterium
NGKPVEEAKKRPEFT

SEQ ID NO: 530406 - protein, 6 aa, Mycobacterium
NGKRAG

SEQ ID NO: 530407 - protein, 8 aa, Mycobacterium
NGKRATTH

SEQ ID NO: 530408 - protein, 9 aa, Mycobacterium
NGKSAQPQF

SEQ ID NO: 530409 - protein, 9 aa, Mycobacterium
NGKSCAGGV

SEQ ID NO: 530410 - protein, 9 aa, Mycobacterium
NGKSPQAQR

SEQ ID NO: 530411 - protein, 14 aa, Mycobacterium
NGLAPAAVDDDGPS

SEQ ID NO: 530412 - protein, 7 aa, Mycobacterium
NGLAPAE

SEQ ID NO: 530413 - protein, 8 aa, Mycobacterium
NGLARGGL

SEQ ID NO: 530414 - protein, 8 aa, Mycobacterium
NGLDGTGV

SEQ ID NO: 530415 - protein, 6 aa, Mycobacterium
NGLDPH

SEQ ID NO: 530416 - protein, 5 aa, Mycobacterium
NGLEP

SEQ ID NO: 530417 - protein, 21 aa, Mycobacterium
NGLEPSPVSPGLGRDSETGQV

SEQ ID NO: 530418 - protein, 8 aa, Mycobacterium
NGLETQED

SEQ ID NO: 530419 - protein, 6 aa, Mycobacterium
NGLGDR

SEQ ID NO: 530420 - protein, 14 aa, Mycobacterium
NGLGGEAYRTSPLD

SEQ ID NO: 530421 - protein, 12 aa, Mycobacterium
NGLGNSGNINTG

SEQ ID NO: 530422 - protein, 28 aa, Mycobacterium
NGLGTISTSLSGSRGSRAVRAGRYSPGL

SEQ ID NO: 530423 - protein, 4 aa, Mycobacterium
NGLH

SEQ ID NO: 530424 - protein, 4 aa, Mycobacterium
NGLN

SEQ ID NO: 530425 - protein, 5 aa, Mycobacterium
NGLNG

SEQ ID NO: 530426 - protein, 44 aa, Mycobacterium
NGLNGAAAGGLGPEAAAAGASMGGMGAAGGGGGGLLSGSSALSS

SEQ ID NO: 530427 - protein, 16 aa, Mycobacterium
NGLNQKSAELRESAAT

SEQ ID NO: 530428 - protein, 29 aa, Mycobacterium
NGLNRTAEGLPSESEIAARAQDGRGLTRP

SEQ ID NO: 530429 - protein, 6 aa, Mycobacterium
NGLPAD

SEQ ID NO: 530430 - protein, 7 aa, Mycobacterium
NGLPADS

SEQ ID NO: 530431 - protein, 6 aa, Mycobacterium
NGLPEG

SEQ ID NO: 530432 - protein, 6 aa, Mycobacterium
NGLPPE

SEQ ID NO: 530433 - protein, 6 aa, Mycobacterium
NGLPQL

SEQ ID NO: 530434 - protein, 6 aa, Mycobacterium
NGLPTR

SEQ ID NO: 530435 - protein, 4 aa, Mycobacterium
NGLR

SEQ ID NO: 530436 - protein, 9 aa, Mycobacterium
NGLRGQVTA

SEQ ID NO: 530437 - protein, 14 aa, Mycobacterium
NGLRGTPNSAHYTA

SEQ ID NO: 530438 - protein, 9 aa, Mycobacterium
NGLRRGDAI

SEQ ID NO: 530439 - protein, 8 aa, Mycobacterium
NGLSNLGD

SEQ ID NO: 530440 - protein, 17 aa, Mycobacterium
NGLTGAPAAAATQGEGS

SEQ ID NO: 530441 - protein, 8 aa, Mycobacterium
NGLTQQTR

SEQ ID NO: 530442 - protein, 9 aa, Mycobacterium
NGLTRRDVA

SEQ ID NO: 530443 - protein, 9 aa, Mycobacterium
NGMDPPEHT

SEQ ID NO: 530444 - protein, 9 aa, Mycobacterium
NGMGSRLDP

SEQ ID NO: 530445 - protein, 6 aa, Mycobacterium
NGMPEE

SEQ ID NO: 530446 - protein, 20 aa, Mycobacterium
NGMSTGAPAAAGANSISAGA

SEQ ID NO: 530447 - protein, 5 aa, Mycobacterium
NGMTG

SEQ ID NO: 530448 - protein, 8 aa, Mycobacterium
NGMTPIPT

SEQ ID NO: 530449 - protein, 6 aa, Mycobacterium
NGMTYG

SEQ ID NO: 530450 - protein, 23 aa, Mycobacterium
NGNAAAAATTTNVASAAADEVST

SEQ ID NO: 530451 - protein, 8 aa, Mycobacterium
NGNAPDSL

SEQ ID NO: 530452 - protein, 7 aa, Mycobacterium
NGNCYRS

SEQ ID NO: 530453 - protein, 14 aa, Mycobacterium
NGNDTSGFQNHGDF

SEQ ID NO: 530454 - protein, 5 aa, Mycobacterium
NGNEY

SEQ ID NO: 530455 - protein, 4 aa, Mycobacterium
NGNF

SEQ ID NO: 530456 - protein, 29 aa, Mycobacterium
NGNFGGGNIGPGNVGDGNNGSTNLGSGNL

SEQ ID NO: 530457 - protein, 17 aa, Mycobacterium
NGNGDDAVAEESLSNNQ

SEQ ID NO: 530458 - protein, 14 aa, Mycobacterium
NGNGGRAGEPAGYK

SEQ ID NO: 530459 - protein, 16 aa, Mycobacterium
NGNGSTHPDHDEDERV

SEQ ID NO: 530460 - protein, 4 aa, Mycobacterium
NGNI

SEQ ID NO: 530461 - protein, 45 aa, Mycobacterium
NGNIGNGNAGSGNTGNANGGSGNTGDGNLGSGNVGNTNLGSGNGS

SEQ ID NO: 530462 - protein, 18 aa, Mycobacterium
NGNIGNTNFGSGNNGNLN

SEQ ID NO: 530463 - protein, 4 aa, Mycobacterium
NGNK

SEQ ID NO: 530464 - protein, 15 aa, Mycobacterium
NGNKFSNKELGKGEA

SEQ ID NO: 530465 - protein, 5 aa, Mycobacterium
NGNKI

SEQ ID NO: 530466 - protein, 9 aa, Mycobacterium
NGNLTGDAV

SEQ ID NO: 530467 - protein, 10 aa, Mycobacterium
NGNNDPATAS

SEQ ID NO: 530468 - protein, 15 aa, Mycobacterium
NGNPAPLTAGPSPAA

SEQ ID NO: 530469 - protein, 6 aa, Mycobacterium
NGNPDF

SEQ ID NO: 530470 - protein, 11 aa, Mycobacterium
NGNPEGKSHRE

SEQ ID NO: 530471 - protein, 7 aa, Mycobacterium
NGNPEQL

SEQ ID NO: 530472 - protein, 23 aa, Mycobacterium
NGNPIDGGPMGADGSTGNNHTQE

SEQ ID NO: 530473 - protein, 8 aa, Mycobacterium
NGNQEQRD

SEQ ID NO: 530474 - protein, 5 aa, Mycobacterium
NGNQV

SEQ ID NO: 530475 - protein, 4 aa, Mycobacterium
NGNR

SEQ ID NO: 530476 - protein, 13 aa, Mycobacterium
NGNRGPGASPQGV

SEQ ID NO: 530477 - protein, 5 aa, Mycobacterium
NGNRW

SEQ ID NO: 530478 - protein, 5 aa, Mycobacterium
NGNSF

SEQ ID NO: 530479 - protein, 17 aa, Mycobacterium
NGNSSNGDQPAAFDVDK

SEQ ID NO: 530480 - protein, 4 aa, Mycobacterium
NGNT

SEQ ID NO: 530481 - protein, 28 aa, Mycobacterium
NGNVGDYNLGSGNLGSENVGSSNIGSGN

SEQ ID NO: 530482 - protein, 5 aa, Mycobacterium
NGPAE

SEQ ID NO: 530483 - protein, 19 aa, Mycobacterium
NGPAKEAHAGERANPVSTG

SEQ ID NO: 530484 - protein, 7 aa, Mycobacterium
NGPALSF

SEQ ID NO: 530485 - protein, 9 aa, Mycobacterium
NGPAPDGYP

SEQ ID NO: 530486 - protein, 9 aa, Mycobacterium
NGPAPVGYD

SEQ ID NO: 530487 - protein, 7 aa, Mycobacterium
NGPATLD

SEQ ID NO: 530488 - protein, 7 aa, Mycobacterium
NGPAYGG

SEQ ID NO: 530489 - protein, 9 aa, Mycobacterium
NGPCWSPDG

SEQ ID NO: 530490 - protein, 6 aa, Mycobacterium
NGPDAA

SEQ ID NO: 530491 - protein, 11 aa, Mycobacterium
NGPDNLPSREQ

SEQ ID NO: 530492 - protein, 5 aa, Mycobacterium
NGPDV

SEQ ID NO: 530493 - protein, 9 aa, Mycobacterium
NGPDYDLSQ

SEQ ID NO: 530494 - protein, 6 aa, Mycobacterium
NGPELT

SEQ ID NO: 530495 - protein, 5 aa, Mycobacterium
NGPEM

SEQ ID NO: 530496 - protein, 5 aa, Mycobacterium
NGPFS

SEQ ID NO: 530497 - protein, 4 aa, Mycobacterium
NGPG

SEQ ID NO: 530498 - protein, 6 aa, Mycobacterium
NGPGHT

SEQ ID NO: 530499 - protein, 8 aa, Mycobacterium
NGPGPDTL

SEQ ID NO: 530500 - protein, 6 aa, Mycobacterium
NGPGPT

SEQ ID NO: 530501 - protein, 6 aa, Mycobacterium
NGPGRS

SEQ ID NO: 530502 - protein, 6 aa, Mycobacterium
NGPGRT

SEQ ID NO: 530503 - protein, 8 aa, Mycobacterium
NGPGTDRC

SEQ ID NO: 530504 - protein, 8 aa, Mycobacterium
NGPGTGYD

SEQ ID NO: 530505 - protein, 9 aa, Mycobacterium
NGPHLPERH

SEQ ID NO: 530506 - protein, 4 aa, Mycobacterium
NGPI

SEQ ID NO: 530507 - protein, 14 aa, Mycobacterium
NGPIEGTSNFGVFR

SEQ ID NO: 530508 - protein, 5 aa, Mycobacterium
NGPIG

SEQ ID NO: 530509 - protein, 6 aa, Mycobacterium
NGPIPR

SEQ ID NO: 530510 - protein, 8 aa, Mycobacterium
NGPISPDK

SEQ ID NO: 530511 - protein, 6 aa, Mycobacterium
NGPKAW

SEQ ID NO: 530512 - protein, 7 aa, Mycobacterium
NGPKMAG

SEQ ID NO: 530513 - protein, 5 aa, Mycobacterium
NGPLA

SEQ ID NO: 530514 - protein, 5 aa, Mycobacterium
NGPLE

SEQ ID NO: 530515 - protein, 6 aa, Mycobacterium
NGPLSA

SEQ ID NO: 530516 - protein, 4 aa, Mycobacterium
NGPM

SEQ ID NO: 530517 - protein, 12 aa, Mycobacterium
NGPMREDSPVRP

SEQ ID NO: 530518 - protein, 7 aa, Mycobacterium
NGPNGGS

SEQ ID NO: 530519 - protein, 9 aa, Mycobacterium
NGPNPREAT

SEQ ID NO: 530520 - protein, 8 aa, Mycobacterium
NGPNPRQA

SEQ ID NO: 530521 - protein, 5 aa, Mycobacterium
NGPPH

SEQ ID NO: 530522 - protein, 4 aa, Mycobacterium
NGPR

SEQ ID NO: 530523 - protein, 18 aa, Mycobacterium
NGPRAAALPPSGTGEGRQ

SEQ ID NO: 530524 - protein, 5 aa, Mycobacterium
NGPRL

SEQ ID NO: 530525 - protein, 13 aa, Mycobacterium
NGPRPAKATAGAC

SEQ ID NO: 530526 - protein, 5 aa, Mycobacterium
NGPRS

SEQ ID NO: 530527 - protein, 5 aa, Mycobacterium
NGPSA

SEQ ID NO: 530528 - protein, 6 aa, Mycobacterium
NGPSAV

SEQ ID NO: 530529 - protein, 7 aa, Mycobacterium
NGPSDQP

SEQ ID NO: 530530 - protein, 8 aa, Mycobacterium
NGPSFCSG

SEQ ID NO: 530531 - protein, 15 aa, Mycobacterium
NGPSGALPLANGPEE

SEQ ID NO: 530532 - protein, 7 aa, Mycobacterium
NGPSGGQ

SEQ ID NO: 530533 - protein, 6 aa, Mycobacterium
NGPSPV

SEQ ID NO: 530534 - protein, 13 aa, Mycobacterium
NGPTDPVKGPDPW

SEQ ID NO: 530535 - protein, 15 aa, Mycobacterium
NGPTGEQHVAYLKRP

SEQ ID NO: 530536 - protein, 5 aa, Mycobacterium
NGPTH

SEQ ID NO: 530537 - protein, 7 aa, Mycobacterium
NGPTNEP

SEQ ID NO: 530538 - protein, 8 aa, Mycobacterium
NGPTPDIS

SEQ ID NO: 530539 - protein, 9 aa, Mycobacterium
NGPTPGVTD

SEQ ID NO: 530540 - protein, 5 aa, Mycobacterium
NGPTQ

SEQ ID NO: 530541 - protein, 6 aa, Mycobacterium
NGPTQA

SEQ ID NO: 530542 - protein, 12 aa, Mycobacterium
NGPVRGVDDGRV

SEQ ID NO: 530543 - protein, 4 aa, Mycobacterium
NGQA

SEQ ID NO: 530544 - protein, 5 aa, Mycobacterium
NGQAA

SEQ ID NO: 530545 - protein, 8 aa, Mycobacterium
NGQDPAAV

SEQ ID NO: 530546 - protein, 4 aa, Mycobacterium
NGQE

SEQ ID NO: 530547 - protein, 8 aa, Mycobacterium
NGQERQNA

SEQ ID NO: 530548 - protein, 12 aa, Mycobacterium
NGQFGENLTTRD

SEQ ID NO: 530549 - protein, 9 aa, Mycobacterium
NGQGEDVVS

SEQ ID NO: 530550 - protein, 5 aa, Mycobacterium
NGQGG

SEQ ID NO: 530551 - protein, 5 aa, Mycobacterium
NGQGV

SEQ ID NO: 530552 - protein, 24 aa, Mycobacterium
NGQHSTGQTDTGGNGGRGGDGGTF

SEQ ID NO: 530553 - protein, 5 aa, Mycobacterium
NGQLG

SEQ ID NO: 530554 - protein, 12 aa, Mycobacterium
NGQLPSADNPGY

SEQ ID NO: 530555 - protein, 11 aa, Mycobacterium
NGQLSPGLPAP

SEQ ID NO: 530556 - protein, 10 aa, Mycobacterium
NGQNTRHAER

SEQ ID NO: 530557 - protein, 12 aa, Mycobacterium
NGQNTRHAERYR

SEQ ID NO: 530558 - protein, 11 aa, Mycobacterium
NGQNTRQAEQY

SEQ ID NO: 530559 - protein, 5 aa, Mycobacterium
NGQPE

SEQ ID NO: 530560 - protein, 6 aa, Mycobacterium
NGQPGA

SEQ ID NO: 530561 - protein, 14 aa, Mycobacterium
NGQPGGSGGAGGDA

SEQ ID NO: 530562 - protein, 9 aa, Mycobacterium
NGQPGYGEG

SEQ ID NO: 530563 - protein, 7 aa, Mycobacterium
NGQPHPA

SEQ ID NO: 530564 - protein, 7 aa, Mycobacterium
NGQPLTP

SEQ ID NO: 530565 - protein, 7 aa, Mycobacterium
NGQPVQA

SEQ ID NO: 530566 - protein, 15 aa, Mycobacterium
NGQRAGISEDDQQRW

SEQ ID NO: 530567 - protein, 8 aa, Mycobacterium
NGQRRTLA

SEQ ID NO: 530568 - protein, 8 aa, Mycobacterium
NGQSFCSG

SEQ ID NO: 530569 - protein, 10 aa, Mycobacterium
NGQTGLPSAG

SEQ ID NO: 530570 - protein, 12 aa, Mycobacterium
NGQTGVSCAPRD

SEQ ID NO: 530571 - protein, 10 aa, Mycobacterium
NGQYDNDQDA

SEQ ID NO: 530572 - protein, 4 aa, Mycobacterium
NGRA

SEQ ID NO: 530573 - protein, 13 aa, Mycobacterium
NGRADVAPATRSR

SEQ ID NO: 530574 - protein, 4 aa, Mycobacterium
NGRD

SEQ ID NO: 530575 - protein, 5 aa, Mycobacterium
NGRDN

SEQ ID NO: 530576 - protein, 10 aa, Mycobacterium
NGRDSNAQRL

SEQ ID NO: 530577 - protein, 4 aa, Mycobacterium
NGRE

SEQ ID NO: 530578 - protein, 13 aa, Mycobacterium
NGRERMTTPVPKR

SEQ ID NO: 530579 - protein, 10 aa, Mycobacterium
NGRFNEPPPA

SEQ ID NO: 530580 - protein, 4 aa, Mycobacterium
NGRG

SEQ ID NO: 530581 - protein, 5 aa, Mycobacterium
NGRGG

SEQ ID NO: 530582 - protein, 12 aa, Mycobacterium
NGRGIPANTARC

SEQ ID NO: 530583 - protein, 5 aa, Mycobacterium
NGRGQ

SEQ ID NO: 530584 - protein, 4 aa, Mycobacterium
NGRH

SEQ ID NO: 530585 - protein, 4 aa, Mycobacterium
NGRI

SEQ ID NO: 530586 - protein, 4 aa, Mycobacterium
NGRK

SEQ ID NO: 530587 - protein, 17 aa, Mycobacterium
NGRLDETAPPAGAPPAT

SEQ ID NO: 530588 - protein, 9 aa, Mycobacterium
NGRLGGTFG

SEQ ID NO: 530589 - protein, 9 aa, Mycobacterium
NGRNATSNN

SEQ ID NO: 530590 - protein, 5 aa, Mycobacterium
NGRNP

SEQ ID NO: 530591 - protein, 4 aa, Mycobacterium
NGRP

SEQ ID NO: 530592 - protein, 8 aa, Mycobacterium
NGRPARER

SEQ ID NO: 530593 - protein, 7 aa, Mycobacterium
NGRPGPV

SEQ ID NO: 530594 - protein, 10 aa, Mycobacterium
NGRPITETKA

SEQ ID NO: 530595 - protein, 9 aa, Mycobacterium
NGRPRRAGV

SEQ ID NO: 530596 - protein, 11 aa, Mycobacterium
NGRPTSDAVEG

SEQ ID NO: 530597 - protein, 14 aa, Mycobacterium
NGRPVPGPDVDAGP

SEQ ID NO: 530598 - protein, 15 aa, Mycobacterium
NGRRDGTTVCLDYRC

SEQ ID NO: 530599 - protein, 8 aa, Mycobacterium
NGRRIPGS

SEQ ID NO: 530600 - protein, 7 aa, Mycobacterium
NGRRPQA

SEQ ID NO: 530601 - protein, 19 aa, Mycobacterium
NGRRRTRCYSPASAEGAEA

SEQ ID NO: 530602 - protein, 8 aa, Mycobacterium
NGRRSAQS

SEQ ID NO: 530603 - protein, 11 aa, Mycobacterium
NGRRSDGDGPV

SEQ ID NO: 530604 - protein, 9 aa, Mycobacterium
NGRRSSESL

SEQ ID NO: 530605 - protein, 8 aa, Mycobacterium
NGRRTDQG

SEQ ID NO: 530606 - protein, 6 aa, Mycobacterium
NGRSAA

SEQ ID NO: 530607 - protein, 6 aa, Mycobacterium
NGRSAH

SEQ ID NO: 530608 - protein, 14 aa, Mycobacterium
NGRSFASKQGGPQI

SEQ ID NO: 530609 - protein, 8 aa, Mycobacterium
NGRSGDHR

SEQ ID NO: 530610 - protein, 6 aa, Mycobacterium
NGRSGY

SEQ ID NO: 530611 - protein, 8 aa, Mycobacterium
NGRSSPYA

SEQ ID NO: 530612 - protein, 11 aa, Mycobacterium
NGRSYDPTTGA

SEQ ID NO: 530613 - protein, 4 aa, Mycobacterium
NGRT

SEQ ID NO: 530614 - protein, 11 aa, Mycobacterium
NGRTASRVDET

SEQ ID NO: 530615 - protein, 5 aa, Mycobacterium
NGRTP

SEQ ID NO: 530616 - protein, 9 aa, Mycobacterium
NGRTVDSPH

SEQ ID NO: 530617 - protein, 4 aa, Mycobacterium
NGRV

SEQ ID NO: 530618 - protein, 5 aa, Mycobacterium
NGRVG

SEQ ID NO: 530619 - protein, 8 aa, Mycobacterium
NGRVHPPA

SEQ ID NO: 530620 - protein, 4 aa, Mycobacterium
NGRY

SEQ ID NO: 530621 - protein, 13 aa, Mycobacterium
NGSACTSQKYEPS

SEQ ID NO: 530622 - protein, 7 aa, Mycobacterium
NGSAGAG

SEQ ID NO: 530623 - protein, 18 aa, Mycobacterium
NGSAGAYAAADAASASSL

SEQ ID NO: 530624 - protein, 11 aa, Mycobacterium
NGSAGGAGGNA

SEQ ID NO: 530625 - protein, 9 aa, Mycobacterium
NGSALTAKS

SEQ ID NO: 530626 - protein, 17 aa, Mycobacterium
NGSASSVAAASESLNSN

SEQ ID NO: 530627 - protein, 4 aa, Mycobacterium
NGSC

SEQ ID NO: 530628 - protein, 10 aa, Mycobacterium
NGSDADTVRV

SEQ ID NO: 530629 - protein, 6 aa, Mycobacterium
NGSEAA

SEQ ID NO: 530630 - protein, 16 aa, Mycobacterium
NGSEAGLPRGSEPGVT

SEQ ID NO: 530631 - protein, 8 aa, Mycobacterium
NGSEPISA

SEQ ID NO: 530632 - protein, 7 aa, Mycobacterium
NGSEPVS

SEQ ID NO: 530633 - protein, 8 aa, Mycobacterium
NGSEPVSI

SEQ ID NO: 530634 - protein, 16 aa, Mycobacterium
NGSESGPSRESEPGVT

SEQ ID NO: 530635 - protein, 5 aa, Mycobacterium
NGSFD

SEQ ID NO: 530636 - protein, 7 aa, Mycobacterium
NGSFGTR

SEQ ID NO: 530637 - protein, 4 aa, Mycobacterium
NGSG

SEQ ID NO: 530638 - protein, 7 aa, Mycobacterium
NGSGGFE

SEQ ID NO: 530639 - protein, 7 aa, Mycobacterium
NGSGGSR

SEQ ID NO: 530640 - protein, 5 aa, Mycobacterium
NGSGI

SEQ ID NO: 530641 - protein, 15 aa, Mycobacterium
NGSGIPDGNTRHSGL

SEQ ID NO: 530642 - protein, 6 aa, Mycobacterium
NGSGIQ

SEQ ID NO: 530643 - protein, 16 aa, Mycobacterium
NGSGKPTQRDGAPGVR

SEQ ID NO: 530644 - protein, 7 aa, Mycobacterium
NGSGKST

SEQ ID NO: 530645 - protein, 7 aa, Mycobacterium
NGSGKTT

SEQ ID NO: 530646 - protein, 16 aa, Mycobacterium
NGSGNPKQRDGRPGVR

SEQ ID NO: 530647 - protein, 7 aa, Mycobacterium
NGSGPEL

SEQ ID NO: 530648 - protein, 6 aa, Mycobacterium
NGSGRW

SEQ ID NO: 530649 - protein, 6 aa, Mycobacterium
NGSGVA

SEQ ID NO: 530650 - protein, 7 aa, Mycobacterium
NGSGVSV

SEQ ID NO: 530651 - protein, 6 aa, Mycobacterium
NGSGVT

SEQ ID NO: 530652 - protein, 8 aa, Mycobacterium
NGSIGAGG

SEQ ID NO: 530653 - protein, 4 aa, Mycobacterium
NGSL

SEQ ID NO: 530654 - protein, 6 aa, Mycobacterium
NGSLGH

SEQ ID NO: 530655 - protein, 14 aa, Mycobacterium
NGSLTGYGGGLDRK

SEQ ID NO: 530656 - protein, 12 aa, Mycobacterium
NGSLTGYGGGLE

SEQ ID NO: 530657 - protein, 4 aa, Mycobacterium
NGSM

SEQ ID NO: 530658 - protein, 5 aa, Mycobacterium
NGSNE

SEQ ID NO: 530659 - protein, 18 aa, Mycobacterium
NGSNFGTNAPGGEAFPGP

SEQ ID NO: 530660 - protein, 5 aa, Mycobacterium
NGSPA

SEQ ID NO: 530661 - protein, 15 aa, Mycobacterium
NGSPAYPRSEEEIRA

SEQ ID NO: 530662 - protein, 5 aa, Mycobacterium
NGSPE

SEQ ID NO: 530663 - protein, 9 aa, Mycobacterium
NGSPEDATA

SEQ ID NO: 530664 - protein, 13 aa, Mycobacterium
NGSPEPLSGEDIS

SEQ ID NO: 530665 - protein, 8 aa, Mycobacterium
NGSPGVNT

SEQ ID NO: 530666 - protein, 7 aa, Mycobacterium
NGSPGVS

SEQ ID NO: 530667 - protein, 9 aa, Mycobacterium
NGSPRAMET

SEQ ID NO: 530668 - protein, 8 aa, Mycobacterium
NGSPRATG

SEQ ID NO: 530669 - protein, 6 aa, Mycobacterium
NGSPSG

SEQ ID NO: 530670 - protein, 14 aa, Mycobacterium
NGSPSIRPATRRRV

SEQ ID NO: 530671 - protein, 8 aa, Mycobacterium
NGSQIPRE

SEQ ID NO: 530672 - protein, 8 aa, Mycobacterium
NGSQRAAG

SEQ ID NO: 530673 - protein, 5 aa, Mycobacterium
NGSSA

SEQ ID NO: 530674 - protein, 11 aa, Mycobacterium
NGSSATHAGGG

SEQ ID NO: 530675 - protein, 8 aa, Mycobacterium
NGSSDRTL

SEQ ID NO: 530676 - protein, 12 aa, Mycobacterium
NGSSGEGQNGTI

SEQ ID NO: 530677 - protein, 7 aa, Mycobacterium
NGSSRFD

SEQ ID NO: 530678 - protein, 4 aa, Mycobacterium
NGST

SEQ ID NO: 530679 - protein, 16 aa, Mycobacterium
NGSTDGAPEEAVERHP

SEQ ID NO: 530680 - protein, 12 aa, Mycobacterium
NGSTDGTPEAAV

SEQ ID NO: 530681 - protein, 16 aa, Mycobacterium
NGSTDGTPEEAEQRYP

SEQ ID NO: 530682 - protein, 12 aa, Mycobacterium
NGSTDGTPQAAV

SEQ ID NO: 530683 - protein, 5 aa, Mycobacterium
NGSTG

SEQ ID NO: 530684 - protein, 8 aa, Mycobacterium
NGSTTGDR

SEQ ID NO: 530685 - protein, 9 aa, Mycobacterium
NGSVAGPVQ

SEQ ID NO: 530686 - protein, 9 aa, Mycobacterium
NGSVSLSSQ

SEQ ID NO: 530687 - protein, 14 aa, Mycobacterium
NGSWGEVDPAEVER

SEQ ID NO: 530688 - protein, 9 aa, Mycobacterium
NGSYADYPR

SEQ ID NO: 530689 - protein, 8 aa, Mycobacterium
NGSYNTGG

SEQ ID NO: 530690 - protein, 4 aa, Mycobacterium
NGTA

SEQ ID NO: 530691 - protein, 6 aa, Mycobacterium
NGTAAG

SEQ ID NO: 530692 - protein, 8 aa, Mycobacterium
NGTAAGAG

SEQ ID NO: 530693 - protein, 9 aa, Mycobacterium
NGTAAGAGA

SEQ ID NO: 530694 - protein, 14 aa, Mycobacterium
NGTAGADGKATGSA

SEQ ID NO: 530695 - protein, 26 aa, Mycobacterium
NGTAKDLKGVGDVRGKTGEAEFAGGS

SEQ ID NO: 530696 - protein, 7 aa, Mycobacterium
NGTAKEI

SEQ ID NO: 530697 - protein, 9 aa, Mycobacterium
NGTANGKAA

SEQ ID NO: 530698 - protein, 6 aa, Mycobacterium
NGTAQA

SEQ ID NO: 530699 - protein, 6 aa, Mycobacterium
NGTAQV

SEQ ID NO: 530700 - protein, 11 aa, Mycobacterium
NGTASRETDTL

SEQ ID NO: 530701 - protein, 8 aa, Mycobacterium
NGTDEQKK

SEQ ID NO: 530702 - protein, 13 aa, Mycobacterium
NGTDERVDEAYDD

SEQ ID NO: 530703 - protein, 7 aa, Mycobacterium
NGTDGEI

SEQ ID NO: 530704 - protein, 7 aa, Mycobacterium
NGTDGNI

SEQ ID NO: 530705 - protein, 6 aa, Mycobacterium
NGTDKI

SEQ ID NO: 530706 - protein, 14 aa, Mycobacterium
NGTDPSTHRAGTPT

SEQ ID NO: 530707 - protein, 8 aa, Mycobacterium
NGTDSLNV

SEQ ID NO: 530708 - protein, 4 aa, Mycobacterium
NGTE

SEQ ID NO: 530709 - protein, 14 aa, Mycobacterium
NGTEAQKAIKTAEQ

SEQ ID NO: 530710 - protein, 5 aa, Mycobacterium
NGTEE

SEQ ID NO: 530711 - protein, 5 aa, Mycobacterium
NGTEF

SEQ ID NO: 530712 - protein, 6 aa, Mycobacterium
NGTEYG

SEQ ID NO: 530713 - protein, 7 aa, Mycobacterium
NGTGKTS

SEQ ID NO: 530714 - protein, 7 aa, Mycobacterium
NGTGSLN

SEQ ID NO: 530715 - protein, 4 aa, Mycobacterium
NGTH

SEQ ID NO: 530716 - protein, 10 aa, Mycobacterium
NGTHNPRPGV

SEQ ID NO: 530717 - protein, 12 aa, Mycobacterium
NGTIPGDAPFGG

SEQ ID NO: 530718 - protein, 7 aa, Mycobacterium
NGTLDHD

SEQ ID NO: 530719 - protein, 6 aa, Mycobacterium
NGTLNG

SEQ ID NO: 530720 - protein, 5 aa, Mycobacterium
NGTLR

SEQ ID NO: 530721 - protein, 4 aa, Mycobacterium
NGTM

SEQ ID NO: 530722 - protein, 5 aa, Mycobacterium
NGTNG

SEQ ID NO: 530723 - protein, 17 aa, Mycobacterium
NGTPAPAGSGADGTPGG

SEQ ID NO: 530724 - protein, 6 aa, Mycobacterium
NGTPGF

SEQ ID NO: 530725 - protein, 7 aa, Mycobacterium
NGTPGVS

SEQ ID NO: 530726 - protein, 7 aa, Mycobacterium
NGTPIDA

SEQ ID NO: 530727 - protein, 7 aa, Mycobacterium
NGTPIEG

SEQ ID NO: 530728 - protein, 8 aa, Mycobacterium
NGTPPPEV

SEQ ID NO: 530729 - protein, 7 aa, Mycobacterium
NGTPRTK

SEQ ID NO: 530730 - protein, 10 aa, Mycobacterium
NGTPSELGGA

SEQ ID NO: 530731 - protein, 11 aa, Mycobacterium
NGTPSELGGAN

SEQ ID NO: 530732 - protein, 5 aa, Mycobacterium
NGTPV

SEQ ID NO: 530733 - protein, 7 aa, Mycobacterium
NGTPVDA

SEQ ID NO: 530734 - protein, 7 aa, Mycobacterium
NGTPYGL

SEQ ID NO: 530735 - protein, 4 aa, Mycobacterium
NGTQ

SEQ ID NO: 530736 - protein, 8 aa, Mycobacterium
NGTQQERD

SEQ ID NO: 530737 - protein, 6 aa, Mycobacterium
NGTQQG

SEQ ID NO: 530738 - protein, 4 aa, Mycobacterium
NGTR

SEQ ID NO: 530739 - protein, 5 aa, Mycobacterium
NGTRL

SEQ ID NO: 530740 - protein, 7 aa, Mycobacterium
NGTSLDD

SEQ ID NO: 530741 - protein, 9 aa, Mycobacterium
NGTSPDEAI

SEQ ID NO: 530742 - protein, 8 aa, Mycobacterium
NGTSPENL

SEQ ID NO: 530743 - protein, 7 aa, Mycobacterium
NGTSYGG

SEQ ID NO: 530744 - protein, 8 aa, Mycobacterium
NGTTAGLN

SEQ ID NO: 530745 - protein, 5 aa, Mycobacterium
NGTTR

SEQ ID NO: 530746 - protein, 6 aa, Mycobacterium
NGTTRR

SEQ ID NO: 530747 - protein, 11 aa, Mycobacterium
NGTVSRTVRDT

SEQ ID NO: 530748 - protein, 5 aa, Mycobacterium
NGTVT

SEQ ID NO: 530749 - protein, 5 aa, Mycobacterium
NGTWS

SEQ ID NO: 530750 - protein, 6 aa, Mycobacterium
NGVAED

SEQ ID NO: 530751 - protein, 6 aa, Mycobacterium
NGVAGR

SEQ ID NO: 530752 - protein, 10 aa, Mycobacterium
NGVANDSDDD

SEQ ID NO: 530753 - protein, 10 aa, Mycobacterium
NGVANDSDED

SEQ ID NO: 530754 - protein, 14 aa, Mycobacterium
NGVAPGYAHRSGLT

SEQ ID NO: 530755 - protein, 8 aa, Mycobacterium
NGVASGDA

SEQ ID NO: 530756 - protein, 7 aa, Mycobacterium
NGVATAR

SEQ ID NO: 530757 - protein, 5 aa, Mycobacterium
NGVDD

SEQ ID NO: 530758 - protein, 6 aa, Mycobacterium
NGVDED

SEQ ID NO: 530759 - protein, 7 aa, Mycobacterium
NGVDPAP

SEQ ID NO: 530760 - protein, 4 aa, Mycobacterium
NGVE

SEQ ID NO: 530761 - protein, 18 aa, Mycobacterium
NGVERKDYNSLGSRRGNH

SEQ ID NO: 530762 - protein, 4 aa, Mycobacterium
NGVG

SEQ ID NO: 530763 - protein, 17 aa, Mycobacterium
NGVGDKHDSPPQASKRG

SEQ ID NO: 530764 - protein, 9 aa, Mycobacterium
NGVGKSSVV

SEQ ID NO: 530765 - protein, 12 aa, Mycobacterium
NGVGLPRGDEPE

SEQ ID NO: 530766 - protein, 6 aa, Mycobacterium
NGVKQQ

SEQ ID NO: 530767 - protein, 10 aa, Mycobacterium
NGVNGGVGSA

SEQ ID NO: 530768 - protein, 11 aa, Mycobacterium
NGVNGGVGSAV

SEQ ID NO: 530769 - protein, 10 aa, Mycobacterium
NGVPAPDGTV

SEQ ID NO: 530770 - protein, 14 aa, Mycobacterium
NGVPSGDWPPYRGP

SEQ ID NO: 530771 - protein, 22 aa, Mycobacterium
NGVPTAARPGKLVRGRQSAPVP

SEQ ID NO: 530772 - protein, 22 aa, Mycobacterium
NGVPTAARPGKLVRGRRSAPVP

SEQ ID NO: 530773 - protein, 20 aa, Mycobacterium
NGVPTAARPGRLVRGRQSAP

SEQ ID NO: 530774 - protein, 12 aa, Mycobacterium
NGVPTDARPGKL

SEQ ID NO: 530775 - protein, 13 aa, Mycobacterium
NGVRRGADAPLRG

SEQ ID NO: 530776 - protein, 19 aa, Mycobacterium
NGVSQEGIAAGAGQAGKIG

SEQ ID NO: 530777 - protein, 7 aa, Mycobacterium
NGVTRDE

SEQ ID NO: 530778 - protein, 6 aa, Mycobacterium
NGVTRE

SEQ ID NO: 530779 - protein, 12 aa, Mycobacterium
NGVVGDGTTTAT

SEQ ID NO: 530780 - protein, 4 aa, Mycobacterium
NGWD

SEQ ID NO: 530781 - protein, 4 aa, Mycobacterium
NGWE

SEQ ID NO: 530782 - protein, 5 aa, Mycobacterium
NGWPA

SEQ ID NO: 530783 - protein, 11 aa, Mycobacterium
NGWPESDEDTF

SEQ ID NO: 530784 - protein, 9 aa, Mycobacterium
NGWSPDKAE

SEQ ID NO: 530785 - protein, 13 aa, Mycobacterium
NGWTGADDKAQAR

SEQ ID NO: 530786 - protein, 10 aa, Mycobacterium
NGYADGLQKS

SEQ ID NO: 530787 - protein, 19 aa, Mycobacterium
NGYATEEDTLAGGPRVDSE

SEQ ID NO: 530788 - protein, 11 aa, Mycobacterium
NGYDETTTDQI

SEQ ID NO: 530789 - protein, 8 aa, Mycobacterium
NGYGNSKW

SEQ ID NO: 530790 - protein, 14 aa, Mycobacterium
NGYPASTPEDLAET

SEQ ID NO: 530791 - protein, 5 aa, Mycobacterium
NGYPG

SEQ ID NO: 530792 - protein, 10 aa, Mycobacterium
NGYPPALPED

SEQ ID NO: 530793 - protein, 5 aa, Mycobacterium
NGYQP

SEQ ID NO: 530794 - protein, 8 aa, Mycobacterium
NGYRDTTM

SEQ ID NO: 530795 - protein, 4 aa, Mycobacterium
NGYS

SEQ ID NO: 530796 - protein, 6 aa, Mycobacterium
NGYSDT

SEQ ID NO: 530797 - protein, 4 aa, Mycobacterium
NGYT

SEQ ID NO: 530798 - protein, 8 aa, Mycobacterium
NGYTATAT

SEQ ID NO: 530799 - protein, 8 aa, Mycobacterium
NGYTGDAT

SEQ ID NO: 530800 - protein, 6 aa, Mycobacterium
NGYTPI

SEQ ID NO: 530801 - protein, 6 aa, Mycobacterium
NGYTQS

SEQ ID NO: 530802 - protein, 6 aa, Mycobacterium
NGYTRD

SEQ ID NO: 530803 - protein, 6 aa, Mycobacterium
NGYTRE

SEQ ID NO: 530804 - protein, 9 aa, Mycobacterium
NGYVEDSGM

SEQ ID NO: 530805 - protein, 5 aa, Mycobacterium
NGYVT

SEQ ID NO: 530806 - protein, 6 aa, Mycobacterium
NHAEGA

SEQ ID NO: 530807 - protein, 4 aa, Mycobacterium
NHAG

SEQ ID NO: 530808 - protein, 14 aa, Mycobacterium
NHAGPQSVSQQAGA

SEQ ID NO: 530809 - protein, 6 aa, Mycobacterium
NHAPGG

SEQ ID NO: 530810 - protein, 7 aa, Mycobacterium
NHAPHGR

SEQ ID NO: 530811 - protein, 7 aa, Mycobacterium
NHAPRRN

SEQ ID NO: 530812 - protein, 5 aa, Mycobacterium
NHAQR

SEQ ID NO: 530813 - protein, 4 aa, Mycobacterium
NHAR

SEQ ID NO: 530814 - protein, 16 aa, Mycobacterium
NHARGAASRIRGNSAS

SEQ ID NO: 530815 - protein, 10 aa, Mycobacterium
NHDAPEARAA

SEQ ID NO: 530816 - protein, 4 aa, Mycobacterium
NHDG

SEQ ID NO: 530817 - protein, 7 aa, Mycobacterium
NHDGGRD

SEQ ID NO: 530818 - protein, 6 aa, Mycobacterium
NHDNAT

SEQ ID NO: 530819 - protein, 6 aa, Mycobacterium
NHDPLD

SEQ ID NO: 530820 - protein, 6 aa, Mycobacterium
NHDPVS

SEQ ID NO: 530821 - protein, 5 aa, Mycobacterium
NHDQA

SEQ ID NO: 530822 - protein, 7 aa, Mycobacterium
NHDQIGE

SEQ ID NO: 530823 - protein, 9 aa, Mycobacterium
NHDRSGLHE

SEQ ID NO: 530824 - protein, 13 aa, Mycobacterium
NHDSHEGAADSTI

SEQ ID NO: 530825 - protein, 5 aa, Mycobacterium
NHDSP

SEQ ID NO: 530826 - protein, 11 aa, Mycobacterium
NHDVEGAAAHG

SEQ ID NO: 530827 - protein, 7 aa, Mycobacterium
NHEDSPG

SEQ ID NO: 530828 - protein, 4 aa, Mycobacterium
NHEP

SEQ ID NO: 530829 - protein, 14 aa, Mycobacterium
NHEPESAEQAEQDV

SEQ ID NO: 530830 - protein, 7 aa, Mycobacterium
NHEPRKR

SEQ ID NO: 530831 - protein, 7 aa, Mycobacterium
NHEPRRN

SEQ ID NO: 530832 - protein, 6 aa, Mycobacterium
NHFPTP

SEQ ID NO: 530833 - protein, 11 aa, Mycobacterium
NHGAAASMTGT

SEQ ID NO: 530834 - protein, 8 aa, Mycobacterium
NHGAGATA

SEQ ID NO: 530835 - protein, 5 aa, Mycobacterium
NHGAR

SEQ ID NO: 530836 - protein, 5 aa, Mycobacterium
NHGGD

SEQ ID NO: 530837 - protein, 9 aa, Mycobacterium
NHGGSPIDT

SEQ ID NO: 530838 - protein, 6 aa, Mycobacterium
NHGGTK

SEQ ID NO: 530839 - protein, 6 aa, Mycobacterium
NHGNNN

SEQ ID NO: 530840 - protein, 5 aa, Mycobacterium
NHGPD

SEQ ID NO: 530841 - protein, 7 aa, Mycobacterium
NHGRRER

SEQ ID NO: 530842 - protein, 10 aa, Mycobacterium
NHGTDGAGRP

SEQ ID NO: 530843 - protein, 11 aa, Mycobacterium
NHGTDPKTRGR

SEQ ID NO: 530844 - protein, 4 aa, Mycobacterium
NHHS

SEQ ID NO: 530845 - protein, 21 aa, Mycobacterium
NHIGPATAAAQLPAKRLPVGI

SEQ ID NO: 530846 - protein, 11 aa, Mycobacterium
NHKNADEALRS

SEQ ID NO: 530847 - protein, 14 aa, Mycobacterium
NHLAGPPDDPRIPD

SEQ ID NO: 530848 - protein, 15 aa, Mycobacterium
NHLAGPPDDSRIPDE

SEQ ID NO: 530849 - protein, 9 aa, Mycobacterium
NHLGDRDEH

SEQ ID NO: 530850 - protein, 10 aa, Mycobacterium
NHLGQNTPAI

SEQ ID NO: 530851 - protein, 8 aa, Mycobacterium
NHNGGGKP

SEQ ID NO: 530852 - protein, 6 aa, Mycobacterium
NHNGRQ

SEQ ID NO: 530853 - protein, 12 aa, Mycobacterium
NHNMTSRQARRR

SEQ ID NO: 530854 - protein, 14 aa, Mycobacterium
NHPAPETKLDDTID

SEQ ID NO: 530855 - protein, 9 aa, Mycobacterium
NHPAPHTNL

SEQ ID NO: 530856 - protein, 7 aa, Mycobacterium
NHPAPRD

SEQ ID NO: 530857 - protein, 6 aa, Mycobacterium
NHPAQL

SEQ ID NO: 530858 - protein, 8 aa, Mycobacterium
NHPDARPI

SEQ ID NO: 530859 - protein, 7 aa, Mycobacterium
NHPDERW

SEQ ID NO: 530860 - protein, 8 aa, Mycobacterium
NHPDERWP

SEQ ID NO: 530861 - protein, 8 aa, Mycobacterium
NHPDGEAE

SEQ ID NO: 530862 - protein, 7 aa, Mycobacterium
NHPDQRR

SEQ ID NO: 530863 - protein, 22 aa, Mycobacterium
NHPDRNPGNKSAEDRYKAVSEA

SEQ ID NO: 530864 - protein, 38 aa, Mycobacterium
NHPDRNPGNQAAEDRYKAVSEAKDVLSDPAKRKEYDET

SEQ ID NO: 530865 - protein, 38 aa, Mycobacterium
NHPDRNPGNSAAEERYKEASEAKEVLTDPAKRKEYDET

SEQ ID NO: 530866 - protein, 4 aa, Mycobacterium
NHPE

SEQ ID NO: 530867 - protein, 6 aa, Mycobacterium
NHPEQS

SEQ ID NO: 530868 - protein, 5 aa, Mycobacterium
NHPET

SEQ ID NO: 530869 - protein, 7 aa, Mycobacterium
NHPGGPE

SEQ ID NO: 530870 - protein, 7 aa, Mycobacterium
NHPGTSQ

SEQ ID NO: 530871 - protein, 10 aa, Mycobacterium
NHPHDQPDDH

SEQ ID NO: 530872 - protein, 4 aa, Mycobacterium
NHPI

SEQ ID NO: 530873 - protein, 14 aa, Mycobacterium
NHPLAGGSGPSVGA

SEQ ID NO: 530874 - protein, 15 aa, Mycobacterium
NHPLAGGSGPTTGAG

SEQ ID NO: 530875 - protein, 8 aa, Mycobacterium
NHPNGEAD

SEQ ID NO: 530876 - protein, 9 aa, Mycobacterium
NHPRSAELP

SEQ ID NO: 530877 - protein, 6 aa, Mycobacterium
NHPRYA

SEQ ID NO: 530878 - protein, 7 aa, Mycobacterium
NHPRYAS

SEQ ID NO: 530879 - protein, 9 aa, Mycobacterium
NHPSGMDGA

SEQ ID NO: 530880 - protein, 14 aa, Mycobacterium
NHPVDPPATPEEGY

SEQ ID NO: 530881 - protein, 4 aa, Mycobacterium
NHPW

SEQ ID NO: 530882 - protein, 6 aa, Mycobacterium
NHQASE

SEQ ID NO: 530883 - protein, 23 aa, Mycobacterium
NHQNADQQSAMNNAGAPAFPPTA

SEQ ID NO: 530884 - protein, 7 aa, Mycobacterium
NHQPGGH

SEQ ID NO: 530885 - protein, 13 aa, Mycobacterium
NHQRPQRDSQGLR

SEQ ID NO: 530886 - protein, 7 aa, Mycobacterium
NHRDSPR

SEQ ID NO: 530887 - protein, 4 aa, Mycobacterium
NHRG

SEQ ID NO: 530888 - protein, 6 aa, Mycobacterium
NHRGGT

SEQ ID NO: 530889 - protein, 7 aa, Mycobacterium
NHRGGTL

SEQ ID NO: 530890 - protein, 16 aa, Mycobacterium
NHRGGTVLGPSASPLG

SEQ ID NO: 530891 - protein, 7 aa, Mycobacterium
NHRGTRG

SEQ ID NO: 530892 - protein, 6 aa, Mycobacterium
NHRKGD

SEQ ID NO: 530893 - protein, 6 aa, Mycobacterium
NHRNAD

SEQ ID NO: 530894 - protein, 5 aa, Mycobacterium
NHRPD

SEQ ID NO: 530895 - protein, 5 aa, Mycobacterium
NHRPE

SEQ ID NO: 530896 - protein, 7 aa, Mycobacterium
NHRPNEL

SEQ ID NO: 530897 - protein, 10 aa, Mycobacterium
NHRTDEYGGT

SEQ ID NO: 530898 - protein, 11 aa, Mycobacterium
NHRTPGSAVSA

SEQ ID NO: 530899 - protein, 13 aa, Mycobacterium
NHSALNDADDKLA

SEQ ID NO: 530900 - protein, 9 aa, Mycobacterium
NHSATTGYD

SEQ ID NO: 530901 - protein, 6 aa, Mycobacterium
NHSGAG

SEQ ID NO: 530902 - protein, 7 aa, Mycobacterium
NHSGGGL

SEQ ID NO: 530903 - protein, 5 aa, Mycobacterium
NHSGV

SEQ ID NO: 530904 - protein, 5 aa, Mycobacterium
NHSQA

SEQ ID NO: 530905 - protein, 5 aa, Mycobacterium
NHSTG

SEQ ID NO: 530906 - protein, 18 aa, Mycobacterium
NHTAPAEPADQLVTVGDL

SEQ ID NO: 530907 - protein, 43 aa, Mycobacterium
NHTDTTPQHPEKQVRQSPGKAATAPATKATTPSGATLEVTGGD

SEQ ID NO: 530908 - protein, 7 aa, Mycobacterium
NHTERNE

SEQ ID NO: 530909 - protein, 7 aa, Mycobacterium
NHTGISP

SEQ ID NO: 530910 - protein, 10 aa, Mycobacterium
NHTQLGDPVK

SEQ ID NO: 530911 - protein, 5 aa, Mycobacterium
NHTSD

SEQ ID NO: 530912 - protein, 6 aa, Mycobacterium
NHTSSE

SEQ ID NO: 530913 - protein, 7 aa, Mycobacterium
NHTSSQH

SEQ ID NO: 530914 - protein, 7 aa, Mycobacterium
NHVPAPP

SEQ ID NO: 530915 - protein, 5 aa, Mycobacterium
NHVQA

SEQ ID NO: 530916 - protein, 6 aa, Mycobacterium
NHVRAD

SEQ ID NO: 530917 - protein, 6 aa, Mycobacterium
NHYGTS

SEQ ID NO: 530918 - protein, 7 aa, Mycobacterium
NHYPDDI

SEQ ID NO: 530919 - protein, 7 aa, Mycobacterium
NHYPTDI

SEQ ID NO: 530920 - protein, 7 aa, Mycobacterium
NIAAKTA

SEQ ID NO: 530921 - protein, 20 aa, Mycobacterium
NIAAPGGTTWEATPRTRRST

SEQ ID NO: 530922 - protein, 10 aa, Mycobacterium
NIADGKTVHP

SEQ ID NO: 530923 - protein, 12 aa, Mycobacterium
NIAGGDETLPYT

SEQ ID NO: 530924 - protein, 12 aa, Mycobacterium
NIAGGDETMPYT

SEQ ID NO: 530925 - protein, 6 aa, Mycobacterium
NIAGTD

SEQ ID NO: 530926 - protein, 11 aa, Mycobacterium
NIAGTGGAGGA

SEQ ID NO: 530927 - protein, 5 aa, Mycobacterium
NIAQE

SEQ ID NO: 530928 - protein, 12 aa, Mycobacterium
NIARSRDIAPGR

SEQ ID NO: 530929 - protein, 6 aa, Mycobacterium
NIATNA

SEQ ID NO: 530930 - protein, 12 aa, Mycobacterium
NIATRSERTGFY

SEQ ID NO: 530931 - protein, 10 aa, Mycobacterium
NIDADGANYE

SEQ ID NO: 530932 - protein, 14 aa, Mycobacterium
NIDAKSLKKGQTVR

SEQ ID NO: 530933 - protein, 4 aa, Mycobacterium
NIDG

SEQ ID NO: 530934 - protein, 12 aa, Mycobacterium
NIDGKGASYGTH

SEQ ID NO: 530935 - protein, 8 aa, Mycobacterium
NIDPGDDI

SEQ ID NO: 530936 - protein, 5 aa, Mycobacterium
NIDSS

SEQ ID NO: 530937 - protein, 7 aa, Mycobacterium
NIDTNRS

SEQ ID NO: 530938 - protein, 6 aa, Mycobacterium
NIEEGG

SEQ ID NO: 530939 - protein, 21 aa, Mycobacterium
NIEESNDRVAATESFDTPTGH

SEQ ID NO: 530940 - protein, 6 aa, Mycobacterium
NIEGAR

SEQ ID NO: 530941 - protein, 6 aa, Mycobacterium
NIEGKP

SEQ ID NO: 530942 - protein, 14 aa, Mycobacterium
NIEGPAVATDERGR

SEQ ID NO: 530943 - protein, 5 aa, Mycobacterium
NIEGS

SEQ ID NO: 530944 - protein, 7 aa, Mycobacterium
NIENGGS

SEQ ID NO: 530945 - protein, 13 aa, Mycobacterium
NIEPDQGAQDKAA

SEQ ID NO: 530946 - protein, 13 aa, Mycobacterium
NIEPSDPDLQTTA

SEQ ID NO: 530947 - protein, 11 aa, Mycobacterium
NIERGASYAVE

SEQ ID NO: 530948 - protein, 4 aa, Mycobacterium
NIGA

SEQ ID NO: 530949 - protein, 5 aa, Mycobacterium
NIGAG

SEQ ID NO: 530950 - protein, 7 aa, Mycobacterium
NIGDSAR

SEQ ID NO: 530951 - protein, 5 aa, Mycobacterium
NIGDT

SEQ ID NO: 530952 - protein, 7 aa, Mycobacterium
NIGEEKR

SEQ ID NO: 530953 - protein, 12 aa, Mycobacterium
NIGESARRRGDD

SEQ ID NO: 530954 - protein, 7 aa, Mycobacterium
NIGESSE

SEQ ID NO: 530955 - protein, 5 aa, Mycobacterium
NIGEY

SEQ ID NO: 530956 - protein, 17 aa, Mycobacterium
NIGGGNNGNNNLGAGNY

SEQ ID NO: 530957 - protein, 6 aa, Mycobacterium
NIGGGQ

SEQ ID NO: 530958 - protein, 9 aa, Mycobacterium
NIGGNGNVG

SEQ ID NO: 530959 - protein, 5 aa, Mycobacterium
NIGGY

SEQ ID NO: 530960 - protein, 12 aa, Mycobacterium
NIGHSESAAGTV

SEQ ID NO: 530961 - protein, 13 aa, Mycobacterium
NIGHTGAAAGAAG

SEQ ID NO: 530962 - protein, 10 aa, Mycobacterium
NIGHTGPASG

SEQ ID NO: 530963 - protein, 10 aa, Mycobacterium
NIGHTQAAAG

SEQ ID NO: 530964 - protein, 12 aa, Mycobacterium
NIGNDNIGNGNV

SEQ ID NO: 530965 - protein, 14 aa, Mycobacterium
NIGNSAVTSSVAEE

SEQ ID NO: 530966 - protein, 18 aa, Mycobacterium
NIGNSNTGIANSGNVDTG

SEQ ID NO: 530967 - protein, 4 aa, Mycobacterium
NIGP

SEQ ID NO: 530968 - protein, 8 aa, Mycobacterium
NIGPEPAA

SEQ ID NO: 530969 - protein, 6 aa, Mycobacterium
NIGPET

SEQ ID NO: 530970 - protein, 7 aa, Mycobacterium
NIGPGNL

SEQ ID NO: 530971 - protein, 6 aa, Mycobacterium
NIGPNT

SEQ ID NO: 530972 - protein, 9 aa, Mycobacterium
NIGPTPEAV

SEQ ID NO: 530973 - protein, 20 aa, Mycobacterium
NIGPVEQDGHADERRPRSKP

SEQ ID NO: 530974 - protein, 4 aa, Mycobacterium
NIGS

SEQ ID NO: 530975 - protein, 31 aa, Mycobacterium
NIGSGNLGSGNTGNANFGSGNNGNLNFGDGN

SEQ ID NO: 530976 - protein, 8 aa, Mycobacterium
NIGSGNVG

SEQ ID NO: 530977 - protein, 11 aa, Mycobacterium
NIGSQQSGLAN

SEQ ID NO: 530978 - protein, 5 aa, Mycobacterium
NIGSY

SEQ ID NO: 530979 - protein, 14 aa, Mycobacterium
NIGTLTDDAGSPID

SEQ ID NO: 530980 - protein, 9 aa, Mycobacterium
NIGTRSGGA

SEQ ID NO: 530981 - protein, 7 aa, Mycobacterium
NIIGRGQ

SEQ ID NO: 530982 - protein, 6 aa, Mycobacterium
NIKGPG

SEQ ID NO: 530983 - protein, 4 aa, Mycobacterium
NIKP

SEQ ID NO: 530984 - protein, 9 aa, Mycobacterium
NIKSSDPAT

SEQ ID NO: 530985 - protein, 6 aa, Mycobacterium
NILPPR

SEQ ID NO: 530986 - protein, 6 aa, Mycobacterium
NIMPPP

SEQ ID NO: 530987 - protein, 7 aa, Mycobacterium
NIPATGG

SEQ ID NO: 530988 - protein, 23 aa, Mycobacterium
NIPCGSDSAPSSRTRAPTPTPGL

SEQ ID NO: 530989 - protein, 4 aa, Mycobacterium
NIPD

SEQ ID NO: 530990 - protein, 18 aa, Mycobacterium
NIPDADEHTSQDATSAGV

SEQ ID NO: 530991 - protein, 7 aa, Mycobacterium
NIPERGG

SEQ ID NO: 530992 - protein, 5 aa, Mycobacterium
NIPGY

SEQ ID NO: 530993 - protein, 10 aa, Mycobacterium
NIPHPNEPGA

SEQ ID NO: 530994 - protein, 9 aa, Mycobacterium
NIPKGEYGA

SEQ ID NO: 530995 - protein, 12 aa, Mycobacterium
NIPKSAGGPGCT

SEQ ID NO: 530996 - protein, 37 aa, Mycobacterium
NIPPERYSQSNGTPGPDQTTMSTGDAGKRVACGVIGA

SEQ ID NO: 530997 - protein, 6 aa, Mycobacterium
NIPPGA

SEQ ID NO: 530998 - protein, 13 aa, Mycobacterium
NIPPPPARPEVPQ

SEQ ID NO: 530999 - protein, 9 aa, Mycobacterium
NIPPSGIET

SEQ ID NO: 531000 - protein, 5 aa, Mycobacterium
NIPQE

SEQ ID NO: 531001 - protein, 4 aa, Mycobacterium
NIPS

SEQ ID NO: 531002 - protein, 9 aa, Mycobacterium
NIPSSGPAI

SEQ ID NO: 531003 - protein, 4 aa, Mycobacterium
NIPT

SEQ ID NO: 531004 - protein, 4 aa, Mycobacterium
NIPV

SEQ ID NO: 531005 - protein, 14 aa, Mycobacterium
NIQAQPPADGVPPA

SEQ ID NO: 531006 - protein, 24 aa, Mycobacterium
NIRECGGGDGAAARVGRLVHDDRD

SEQ ID NO: 531007 - protein, 4 aa, Mycobacterium
NIRP

SEQ ID NO: 531008 - protein, 6 aa, Mycobacterium
NIRPDC

SEQ ID NO: 531009 - protein, 6 aa, Mycobacterium
NIRPDI

SEQ ID NO: 531010 - protein, 11 aa, Mycobacterium
NISEKERRERE

SEQ ID NO: 531011 - protein, 17 aa, Mycobacterium
NISGNDALDALAQPTVF

SEQ ID NO: 531012 - protein, 5 aa, Mycobacterium
NISGQ

SEQ ID NO: 531013 - protein, 6 aa, Mycobacterium
NISPGD

SEQ ID NO: 531014 - protein, 7 aa, Mycobacterium
NISRGNA

SEQ ID NO: 531015 - protein, 4 aa, Mycobacterium
NISS

SEQ ID NO: 531016 - protein, 5 aa, Mycobacterium
NITAE

SEQ ID NO: 531017 - protein, 10 aa, Mycobacterium
NITAGDTGPW

SEQ ID NO: 531018 - protein, 12 aa, Mycobacterium
NITDDQARACAA

SEQ ID NO: 531019 - protein, 14 aa, Mycobacterium
NITDDQARACAQTG

SEQ ID NO: 531020 - protein, 5 aa, Mycobacterium
NITES

SEQ ID NO: 531021 - protein, 8 aa, Mycobacterium
NITGAGPV

SEQ ID NO: 531022 - protein, 7 aa, Mycobacterium
NITGDDG

SEQ ID NO: 531023 - protein, 5 aa, Mycobacterium
NITGR

SEQ ID NO: 531024 - protein, 4 aa, Mycobacterium
NITH

SEQ ID NO: 531025 - protein, 5 aa, Mycobacterium
NITPE

SEQ ID NO: 531026 - protein, 5 aa, Mycobacterium
NITPQ

SEQ ID NO: 531027 - protein, 14 aa, Mycobacterium
NITQHEEARRRRSR

SEQ ID NO: 531028 - protein, 6 aa, Mycobacterium
NITRTG

SEQ ID NO: 531029 - protein, 6 aa, Mycobacterium
NITSGG

SEQ ID NO: 531030 - protein, 4 aa, Mycobacterium
NITT

SEQ ID NO: 531031 - protein, 9 aa, Mycobacterium
NITTRAGSI

SEQ ID NO: 531032 - protein, 9 aa, Mycobacterium
NIVGRGQDA

SEQ ID NO: 531033 - protein, 7 aa, Mycobacterium
NIYPTAD

SEQ ID NO: 531034 - protein, 7 aa, Mycobacterium
NIYSPEV

SEQ ID NO: 531035 - protein, 28 aa, Mycobacterium
NKAAAAVSKSVTDSLKPVTGTVKPVTKD

SEQ ID NO: 531036 - protein, 19 aa, Mycobacterium
NKAADEAAERERREEEAYA

SEQ ID NO: 531037 - protein, 21 aa, Mycobacterium
NKAADHDMENAAGIDNQGEPI

SEQ ID NO: 531038 - protein, 13 aa, Mycobacterium
NKAADNAGRPAPR

SEQ ID NO: 531039 - protein, 10 aa, Mycobacterium
NKAASRAEAV

SEQ ID NO: 531040 - protein, 13 aa, Mycobacterium
NKADKGEDPQAAE

SEQ ID NO: 531041 - protein, 13 aa, Mycobacterium
NKADLDDAGFSDD

SEQ ID NO: 531042 - protein, 12 aa, Mycobacterium
NKAETKAKYGDE

SEQ ID NO: 531043 - protein, 11 aa, Mycobacterium
NKAETKARYGE

SEQ ID NO: 531044 - protein, 11 aa, Mycobacterium
NKAETKERYGD

SEQ ID NO: 531045 - protein, 21 aa, Mycobacterium
NKAGGANVNQLTSSEPDDVES

SEQ ID NO: 531046 - protein, 7 aa, Mycobacterium
NKAGLKP

SEQ ID NO: 531047 - protein, 9 aa, Mycobacterium
NKAIPPDRL

SEQ ID NO: 531048 - protein, 8 aa, Mycobacterium
NKAKRELG

SEQ ID NO: 531049 - protein, 10 aa, Mycobacterium
NKAKTSTAPA

SEQ ID NO: 531050 - protein, 5 aa, Mycobacterium
NKALN

SEQ ID NO: 531051 - protein, 4 aa, Mycobacterium
NKAR

SEQ ID NO: 531052 - protein, 9 aa, Mycobacterium
NKARGEAVA

SEQ ID NO: 531053 - protein, 26 aa, Mycobacterium
NKATEGLDEETKRKVLSTNAKNFFGM

SEQ ID NO: 531054 - protein, 8 aa, Mycobacterium
NKAVEANY

SEQ ID NO: 531055 - protein, 6 aa, Mycobacterium
NKCGAQ

SEQ ID NO: 531056 - protein, 16 aa, Mycobacterium
NKDDEYQRSADEGDSM

SEQ ID NO: 531057 - protein, 29 aa, Mycobacterium
NKDGKPNYVTDSAASATGWTTGTKTYNGA

SEQ ID NO: 531058 - protein, 9 aa, Mycobacterium
NKDGTPTGG

SEQ ID NO: 531059 - protein, 8 aa, Mycobacterium
NKDNGRIR

SEQ ID NO: 531060 - protein, 6 aa, Mycobacterium
NKDRTT

SEQ ID NO: 531061 - protein, 8 aa, Mycobacterium
NKDSPAAA

SEQ ID NO: 531062 - protein, 10 aa, Mycobacterium
NKDVTKRTAV

SEQ ID NO: 531063 - protein, 21 aa, Mycobacterium
NKEAAEDAKAKLEAAGASVTV

SEQ ID NO: 531064 - protein, 8 aa, Mycobacterium
NKEITGKP

SEQ ID NO: 531065 - protein, 11 aa, Mycobacterium
NKENPVERASA

SEQ ID NO: 531066 - protein, 7 aa, Mycobacterium
NKEQGKI

SEQ ID NO: 531067 - protein, 8 aa, Mycobacterium
NKETKLDN

SEQ ID NO: 531068 - protein, 7 aa, Mycobacterium
NKETREP

SEQ ID NO: 531069 - protein, 7 aa, Mycobacterium
NKFDRSR

SEQ ID NO: 531070 - protein, 20 aa, Mycobacterium
NKFSGSAREAITAAGGSATE

SEQ ID NO: 531071 - protein, 10 aa, Mycobacterium
NKGALSESAA

SEQ ID NO: 531072 - protein, 18 aa, Mycobacterium
NKGDGNIGFGNGGPANLS

SEQ ID NO: 531073 - protein, 13 aa, Mycobacterium
NKGEADPRPALGS

SEQ ID NO: 531074 - protein, 10 aa, Mycobacterium
NKGEKMSKSI

SEQ ID NO: 531075 - protein, 19 aa, Mycobacterium
NKGESGRNGPNPDTFDYVP

SEQ ID NO: 531076 - protein, 7 aa, Mycobacterium
NKGHGID

SEQ ID NO: 531077 - protein, 6 aa, Mycobacterium
NKGPDD

SEQ ID NO: 531078 - protein, 7 aa, Mycobacterium
NKGQPGR

SEQ ID NO: 531079 - protein, 8 aa, Mycobacterium
NKGQWTEP

SEQ ID NO: 531080 - protein, 5 aa, Mycobacterium
NKGRG

SEQ ID NO: 531081 - protein, 9 aa, Mycobacterium
NKGRPDHHD

SEQ ID NO: 531082 - protein, 10 aa, Mycobacterium
NKGRTGAPRA

SEQ ID NO: 531083 - protein, 8 aa, Mycobacterium
NKGTDRTR

SEQ ID NO: 531084 - protein, 11 aa, Mycobacterium
NKGVKSTGSAA

SEQ ID NO: 531085 - protein, 5 aa, Mycobacterium
NKGVQ

SEQ ID NO: 531086 - protein, 4 aa, Mycobacterium
NKHE

SEQ ID NO: 531087 - protein, 10 aa, Mycobacterium
NKHFQPSDSQ

SEQ ID NO: 531088 - protein, 8 aa, Mycobacterium
NKHGVRTD

SEQ ID NO: 531089 - protein, 6 aa, Mycobacterium
NKHKPS

SEQ ID NO: 531090 - protein, 6 aa, Mycobacterium
NKHRVT

SEQ ID NO: 531091 - protein, 4 aa, Mycobacterium
NKHY

SEQ ID NO: 531092 - protein, 5 aa, Mycobacterium
NKHYG

SEQ ID NO: 531093 - protein, 9 aa, Mycobacterium
NKIAANPAD

SEQ ID NO: 531094 - protein, 13 aa, Mycobacterium
NKIGRREEPRDLD

SEQ ID NO: 531095 - protein, 20 aa, Mycobacterium
NKIPNSKEASISKAKAGRMA

SEQ ID NO: 531096 - protein, 19 aa, Mycobacterium
NKIPNSKEASMSKAKAGRM

SEQ ID NO: 531097 - protein, 4 aa, Mycobacterium
NKKG

SEQ ID NO: 531098 - protein, 6 aa, Mycobacterium
NKKGVT

SEQ ID NO: 531099 - protein, 9 aa, Mycobacterium
NKKTEDPDL

SEQ ID NO: 531100 - protein, 4 aa, Mycobacterium
NKLP

SEQ ID NO: 531101 - protein, 4 aa, Mycobacterium
NKNE

SEQ ID NO: 531102 - protein, 9 aa, Mycobacterium
NKNGLAGKS

SEQ ID NO: 531103 - protein, 9 aa, Mycobacterium
NKNYAKSKL

SEQ ID NO: 531104 - protein, 24 aa, Mycobacterium
NKPADGMSKSAGGREWRVGHQLDR

SEQ ID NO: 531105 - protein, 6 aa, Mycobacterium
NKPAEL

SEQ ID NO: 531106 - protein, 14 aa, Mycobacterium
NKPAEPRPRDDAGI

SEQ ID NO: 531107 - protein, 5 aa, Mycobacterium
NKPAV

SEQ ID NO: 531108 - protein, 10 aa, Mycobacterium
NKPDDTAQTF

SEQ ID NO: 531109 - protein, 7 aa, Mycobacterium
NKPDQGV

SEQ ID NO: 531110 - protein, 9 aa, Mycobacterium
NKPDTETLK

SEQ ID NO: 531111 - protein, 6 aa, Mycobacterium
NKPEGV

SEQ ID NO: 531112 - protein, 5 aa, Mycobacterium
NKPFG

SEQ ID NO: 531113 - protein, 6 aa, Mycobacterium
NKPGRN

SEQ ID NO: 531114 - protein, 5 aa, Mycobacterium
NKPHA

SEQ ID NO: 531115 - protein, 13 aa, Mycobacterium
NKPHGAKPSTVYP

SEQ ID NO: 531116 - protein, 12 aa, Mycobacterium
NKPHGERPSAVY

SEQ ID NO: 531117 - protein, 13 aa, Mycobacterium
NKPHGERPSTVYP

SEQ ID NO: 531118 - protein, 14 aa, Mycobacterium
NKPHGERPSTVYPQ

SEQ ID NO: 531119 - protein, 17 aa, Mycobacterium
NKPHGSRPSKVYPNDKL

SEQ ID NO: 531120 - protein, 19 aa, Mycobacterium
NKPHGTRPSTVYPQDKLPD

SEQ ID NO: 531121 - protein, 8 aa, Mycobacterium
NKPHRQDR

SEQ ID NO: 531122 - protein, 6 aa, Mycobacterium
NKPIDL

SEQ ID NO: 531123 - protein, 12 aa, Mycobacterium
NKPKSSENPREP

SEQ ID NO: 531124 - protein, 8 aa, Mycobacterium
NKPLTETA

SEQ ID NO: 531125 - protein, 9 aa, Mycobacterium
NKPLTPDDL

SEQ ID NO: 531126 - protein, 12 aa, Mycobacterium
NKPNPGGDPGGM

SEQ ID NO: 531127 - protein, 4 aa, Mycobacterium
NKPP

SEQ ID NO: 531128 - protein, 7 aa, Mycobacterium
NKPPAKK

SEQ ID NO: 531129 - protein, 8 aa, Mycobacterium
NKPPTNPV

SEQ ID NO: 531130 - protein, 8 aa, Mycobacterium
NKPSNADV

SEQ ID NO: 531131 - protein, 14 aa, Mycobacterium
NKPVTESLYPSSPE

SEQ ID NO: 531132 - protein, 13 aa, Mycobacterium
NKPYTDSLPQMPE

SEQ ID NO: 531133 - protein, 7 aa, Mycobacterium
NKQARTE

SEQ ID NO: 531134 - protein, 4 aa, Mycobacterium
NKQG

SEQ ID NO: 531135 - protein, 5 aa, Mycobacterium
NKQGW

SEQ ID NO: 531136 - protein, 6 aa, Mycobacterium
NKQIDV

SEQ ID NO: 531137 - protein, 4 aa, Mycobacterium
NKQR

SEQ ID NO: 531138 - protein, 6 aa, Mycobacterium
NKQYEQ

SEQ ID NO: 531139 - protein, 4 aa, Mycobacterium
NKRA

SEQ ID NO: 531140 - protein, 5 aa, Mycobacterium
NKRAG

SEQ ID NO: 531141 - protein, 18 aa, Mycobacterium
NKRAPGDQFSDGSYDPSV

SEQ ID NO: 531142 - protein, 4 aa, Mycobacterium
NKRD

SEQ ID NO: 531143 - protein, 12 aa, Mycobacterium
NKRDTDDMGKRA

SEQ ID NO: 531144 - protein, 13 aa, Mycobacterium
NKRERAKADRRDQ

SEQ ID NO: 531145 - protein, 10 aa, Mycobacterium
NKRERSDTFD

SEQ ID NO: 531146 - protein, 10 aa, Mycobacterium
NKRGQDIGPT

SEQ ID NO: 531147 - protein, 6 aa, Mycobacterium
NKRLND

SEQ ID NO: 531148 - protein, 5 aa, Mycobacterium
NKRPE

SEQ ID NO: 531149 - protein, 6 aa, Mycobacterium
NKRPEA

SEQ ID NO: 531150 - protein, 7 aa, Mycobacterium
NKRPRSV

SEQ ID NO: 531151 - protein, 13 aa, Mycobacterium
NKRRHELSPTVRA

SEQ ID NO: 531152 - protein, 17 aa, Mycobacterium
NKRSLTLDSTTEAGAEI

SEQ ID NO: 531153 - protein, 17 aa, Mycobacterium
NKRSLTLDTTTAEGREV

SEQ ID NO: 531154 - protein, 5 aa, Mycobacterium
NKRTG

SEQ ID NO: 531155 - protein, 7 aa, Mycobacterium
NKRYEIS

SEQ ID NO: 531156 - protein, 8 aa, Mycobacterium
NKRYQEAS

SEQ ID NO: 531157 - protein, 17 aa, Mycobacterium
NKRYSGERDLAQPYGAT

SEQ ID NO: 531158 - protein, 10 aa, Mycobacterium
NKSAARAAAV

SEQ ID NO: 531159 - protein, 6 aa, Mycobacterium
NKSALA

SEQ ID NO: 531160 - protein, 11 aa, Mycobacterium
NKSATPSGPGY

SEQ ID NO: 531161 - protein, 9 aa, Mycobacterium
NKSCSQQTV

SEQ ID NO: 531162 - protein, 7 aa, Mycobacterium
NKSDDVL

SEQ ID NO: 531163 - protein, 10 aa, Mycobacterium
NKSDGTQDEI

SEQ ID NO: 531164 - protein, 13 aa, Mycobacterium
NKSEKSEDPAAAE

SEQ ID NO: 531165 - protein, 4 aa, Mycobacterium
NKSG

SEQ ID NO: 531166 - protein, 14 aa, Mycobacterium
NKSKALYQQSLCAT

SEQ ID NO: 531167 - protein, 8 aa, Mycobacterium
NKSTDNTA

SEQ ID NO: 531168 - protein, 12 aa, Mycobacterium
NKSTLGTSQATI

SEQ ID NO: 531169 - protein, 11 aa, Mycobacterium
NKSVKKDGTES

SEQ ID NO: 531170 - protein, 5 aa, Mycobacterium
NKTAH

SEQ ID NO: 531171 - protein, 13 aa, Mycobacterium
NKTDKAEDPKAAE

SEQ ID NO: 531172 - protein, 4 aa, Mycobacterium
NKTE

SEQ ID NO: 531173 - protein, 29 aa, Mycobacterium
NKTEDKGSQAESSEQRGAGSLSEESTGTW

SEQ ID NO: 531174 - protein, 8 aa, Mycobacterium
NKTEPYSG

SEQ ID NO: 531175 - protein, 7 aa, Mycobacterium
NKTERYS

SEQ ID NO: 531176 - protein, 8 aa, Mycobacterium
NKTFHPSG

SEQ ID NO: 531177 - protein, 10 aa, Mycobacterium
NKTGSTDGFG

SEQ ID NO: 531178 - protein, 23 aa, Mycobacterium
NKTGYHKRQGHRQRLTVLKVTGI

SEQ ID NO: 531179 - protein, 7 aa, Mycobacterium
NKTIDPV

SEQ ID NO: 531180 - protein, 4 aa, Mycobacterium
NKTL

SEQ ID NO: 531181 - protein, 10 aa, Mycobacterium
NKTLGGPLGP

SEQ ID NO: 531182 - protein, 8 aa, Mycobacterium
NKTNGVTP

SEQ ID NO: 531183 - protein, 9 aa, Mycobacterium
NKTPQGIDT

SEQ ID NO: 531184 - protein, 8 aa, Mycobacterium
NKTPRREA

SEQ ID NO: 531185 - protein, 9 aa, Mycobacterium
NKTSERPYR

SEQ ID NO: 531186 - protein, 7 aa, Mycobacterium
NKTSIDK

SEQ ID NO: 531187 - protein, 6 aa, Mycobacterium
NKVDDY

SEQ ID NO: 531188 - protein, 7 aa, Mycobacterium
NKVEEGR

SEQ ID NO: 531189 - protein, 7 aa, Mycobacterium
NKVPAAS

SEQ ID NO: 531190 - protein, 5 aa, Mycobacterium
NKVPG

SEQ ID NO: 531191 - protein, 8 aa, Mycobacterium
NKVPGARA

SEQ ID NO: 531192 - protein, 7 aa, Mycobacterium
NKVPGAS

SEQ ID NO: 531193 - protein, 6 aa, Mycobacterium
NKVPNA

SEQ ID NO: 531194 - protein, 15 aa, Mycobacterium
NKVPPSINYTGPNPY

SEQ ID NO: 531195 - protein, 9 aa, Mycobacterium
NKVPRTPRL

SEQ ID NO: 531196 - protein, 6 aa, Mycobacterium
NKVQSG

SEQ ID NO: 531197 - protein, 6 aa, Mycobacterium
NKYPDR

SEQ ID NO: 531198 - protein, 4 aa, Mycobacterium
NLAA

SEQ ID NO: 531199 - protein, 10 aa, Mycobacterium
NLAADPDRPL

SEQ ID NO: 531200 - protein, 6 aa, Mycobacterium
NLAAGP

SEQ ID NO: 531201 - protein, 6 aa, Mycobacterium
NLADQT

SEQ ID NO: 531202 - protein, 5 aa, Mycobacterium
NLADR

SEQ ID NO: 531203 - protein, 11 aa, Mycobacterium
NLAEAGSAREV

SEQ ID NO: 531204 - protein, 5 aa, Mycobacterium
NLAEQ

SEQ ID NO: 531205 - protein, 27 aa, Mycobacterium
NLAERPAAADLAREAEELAAGQTRRAA

SEQ ID NO: 531206 - protein, 12 aa, Mycobacterium
NLAGDDGHGDID

SEQ ID NO: 531207 - protein, 6 aa, Mycobacterium
NLAGRT

SEQ ID NO: 531208 - protein, 8 aa, Mycobacterium
NLAGSPEI

SEQ ID NO: 531209 - protein, 8 aa, Mycobacterium
NLAGSQPL

SEQ ID NO: 531210 - protein, 17 aa, Mycobacterium
NLANGEDNRDGESHNRS

SEQ ID NO: 531211 - protein, 7 aa, Mycobacterium
NLANGGG

SEQ ID NO: 531212 - protein, 5 aa, Mycobacterium
NLAPE

SEQ ID NO: 531213 - protein, 8 aa, Mycobacterium
NLAPSESI

SEQ ID NO: 531214 - protein, 7 aa, Mycobacterium
NLARPGD

SEQ ID NO: 531215 - protein, 8 aa, Mycobacterium
NLASGGSG

SEQ ID NO: 531216 - protein, 7 aa, Mycobacterium
NLASHGD

SEQ ID NO: 531217 - protein, 8 aa, Mycobacterium
NLDAGKEA

SEQ ID NO: 531218 - protein, 5 aa, Mycobacterium
NLDDA

SEQ ID NO: 531219 - protein, 21 aa, Mycobacterium
NLDEAAKTAVTARVQNNGQSC

SEQ ID NO: 531220 - protein, 12 aa, Mycobacterium
NLDEGEPYSLPG

SEQ ID NO: 531221 - protein, 5 aa, Mycobacterium
NLDEH

SEQ ID NO: 531222 - protein, 11 aa, Mycobacterium
NLDESGEYSLP

SEQ ID NO: 531223 - protein, 12 aa, Mycobacterium
NLDGAANADDIR

SEQ ID NO: 531224 - protein, 7 aa, Mycobacterium
NLDGDDG

SEQ ID NO: 531225 - protein, 9 aa, Mycobacterium
NLDGGAGKL

SEQ ID NO: 531226 - protein, 4 aa, Mycobacterium
NLDK

SEQ ID NO: 531227 - protein, 10 aa, Mycobacterium
NLDKAARAAT

SEQ ID NO: 531228 - protein, 9 aa, Mycobacterium
NLDPDAAQA

SEQ ID NO: 531229 - protein, 7 aa, Mycobacterium
NLDPDDV

SEQ ID NO: 531230 - protein, 10 aa, Mycobacterium
NLDPDGPLAE

SEQ ID NO: 531231 - protein, 5 aa, Mycobacterium
NLDPE

SEQ ID NO: 531232 - protein, 6 aa, Mycobacterium
NLDPEA

SEQ ID NO: 531233 - protein, 6 aa, Mycobacterium
NLDPND

SEQ ID NO: 531234 - protein, 6 aa, Mycobacterium
NLDPPW

SEQ ID NO: 531235 - protein, 9 aa, Mycobacterium
NLDSDQPIG

SEQ ID NO: 531236 - protein, 6 aa, Mycobacterium
NLDSSR

SEQ ID NO: 531237 - protein, 4 aa, Mycobacterium
NLDT

SEQ ID NO: 531238 - protein, 8 aa, Mycobacterium
NLDTRPAF

SEQ ID NO: 531239 - protein, 9 aa, Mycobacterium
NLEAGGGNV

SEQ ID NO: 531240 - protein, 6 aa, Mycobacterium
NLEEPS

SEQ ID NO: 531241 - protein, 20 aa, Mycobacterium
NLEKSARNEPLTRPRPGHAD

SEQ ID NO: 531242 - protein, 9 aa, Mycobacterium
NLENNSLDT

SEQ ID NO: 531243 - protein, 6 aa, Mycobacterium
NLERLS

SEQ ID NO: 531244 - protein, 8 aa, Mycobacterium
NLESAGGS

SEQ ID NO: 531245 - protein, 7 aa, Mycobacterium
NLESGAR

SEQ ID NO: 531246 - protein, 7 aa, Mycobacterium
NLGAESR

SEQ ID NO: 531247 - protein, 16 aa, Mycobacterium
NLGAGNVTVTGDPAQF

SEQ ID NO: 531248 - protein, 7 aa, Mycobacterium
NLGDAAG

SEQ ID NO: 531249 - protein, 12 aa, Mycobacterium
NLGDEPRYRPSA

SEQ ID NO: 531250 - protein, 9 aa, Mycobacterium
NLGDPDVRE

SEQ ID NO: 531251 - protein, 5 aa, Mycobacterium
NLGDR

SEQ ID NO: 531252 - protein, 13 aa, Mycobacterium
NLGDSSVGLANAG

SEQ ID NO: 531253 - protein, 6 aa, Mycobacterium
NLGDTK

SEQ ID NO: 531254 - protein, 4 aa, Mycobacterium
NLGE

SEQ ID NO: 531255 - protein, 5 aa, Mycobacterium
NLGEA

SEQ ID NO: 531256 - protein, 8 aa, Mycobacterium
NLGEAAGT

SEQ ID NO: 531257 - protein, 7 aa, Mycobacterium
NLGEGRR

SEQ ID NO: 531258 - protein, 8 aa, Mycobacterium
NLGGARTN

SEQ ID NO: 531259 - protein, 9 aa, Mycobacterium
NLGGGAGHL

SEQ ID NO: 531260 - protein, 5 aa, Mycobacterium
NLGGR

SEQ ID NO: 531261 - protein, 8 aa, Mycobacterium
NLGHTEAA

SEQ ID NO: 531262 - protein, 11 aa, Mycobacterium
NLGNGNTGNLN

SEQ ID NO: 531263 - protein, 16 aa, Mycobacterium
NLGNSNLGIGSTGNHD

SEQ ID NO: 531264 - protein, 16 aa, Mycobacterium
NLGPEPHDSLLYAKIL

SEQ ID NO: 531265 - protein, 8 aa, Mycobacterium
NLGPGEQA

SEQ ID NO: 531266 - protein, 11 aa, Mycobacterium
NLGPLSANRTG

SEQ ID NO: 531267 - protein, 7 aa, Mycobacterium
NLGRATE

SEQ ID NO: 531268 - protein, 8 aa, Mycobacterium
NLGRDAAE

SEQ ID NO: 531269 - protein, 5 aa, Mycobacterium
NLGRK

SEQ ID NO: 531270 - protein, 6 aa, Mycobacterium
NLGRPG

SEQ ID NO: 531271 - protein, 6 aa, Mycobacterium
NLGRPS

SEQ ID NO: 531272 - protein, 14 aa, Mycobacterium
NLGRSDDDPAPRTL

SEQ ID NO: 531273 - protein, 13 aa, Mycobacterium
NLGRSDPDPAPRT

SEQ ID NO: 531274 - protein, 5 aa, Mycobacterium
NLGSN

SEQ ID NO: 531275 - protein, 6 aa, Mycobacterium
NLGSSG

SEQ ID NO: 531276 - protein, 21 aa, Mycobacterium
NLGSVGPNSGFGHTGANNSGF

SEQ ID NO: 531277 - protein, 5 aa, Mycobacterium
NLGTE

SEQ ID NO: 531278 - protein, 7 aa, Mycobacterium
NLGTERH

SEQ ID NO: 531279 - protein, 8 aa, Mycobacterium
NLGTERHH

SEQ ID NO: 531280 - protein, 8 aa, Mycobacterium
NLGTQRHH

SEQ ID NO: 531281 - protein, 7 aa, Mycobacterium
NLGYGSA

SEQ ID NO: 531282 - protein, 6 aa, Mycobacterium
NLGYGT

SEQ ID NO: 531283 - protein, 11 aa, Mycobacterium
NLGYPPPHSRT

SEQ ID NO: 531284 - protein, 8 aa, Mycobacterium
NLHPTGGH

SEQ ID NO: 531285 - protein, 9 aa, Mycobacterium
NLHQGGTIR

SEQ ID NO: 531286 - protein, 10 aa, Mycobacterium
NLHRGARDGL

SEQ ID NO: 531287 - protein, 7 aa, Mycobacterium
NLHTRGS

SEQ ID NO: 531288 - protein, 4 aa, Mycobacterium
NLKE

SEQ ID NO: 531289 - protein, 4 aa, Mycobacterium
NLKP

SEQ ID NO: 531290 - protein, 7 aa, Mycobacterium
NLNDAGT

SEQ ID NO: 531291 - protein, 8 aa, Mycobacterium
NLNGTATA

SEQ ID NO: 531292 - protein, 13 aa, Mycobacterium
NLNPAQAHGSGDV

SEQ ID NO: 531293 - protein, 9 aa, Mycobacterium
NLNPRTGER

SEQ ID NO: 531294 - protein, 6 aa, Mycobacterium
NLNSEP

SEQ ID NO: 531295 - protein, 6 aa, Mycobacterium
NLNSTA

SEQ ID NO: 531296 - protein, 57 aa, Mycobacterium
NLNTSIASSATQAGPNSGFGNTGTGLSGFNNSGVDTSGIQNAQYETTKTLPPPAPPI

SEQ ID NO: 531297 - protein, 6 aa, Mycobacterium
NLPADG

SEQ ID NO: 531298 - protein, 9 aa, Mycobacterium
NLPAESTVE

SEQ ID NO: 531299 - protein, 9 aa, Mycobacterium
NLPATDADE

SEQ ID NO: 531300 - protein, 17 aa, Mycobacterium
NLPDAADPSLNTIRVLA

SEQ ID NO: 531301 - protein, 23 aa, Mycobacterium
NLPDGHPDALNDDTRPRKLRPGD

SEQ ID NO: 531302 - protein, 16 aa, Mycobacterium
NLPDPADPQMGSIRVM

SEQ ID NO: 531303 - protein, 9 aa, Mycobacterium
NLPDRSGDG

SEQ ID NO: 531304 - protein, 5 aa, Mycobacterium
NLPDT

SEQ ID NO: 531305 - protein, 8 aa, Mycobacterium
NLPDTPSV

SEQ ID NO: 531306 - protein, 11 aa, Mycobacterium
NLPEATQAEAG

SEQ ID NO: 531307 - protein, 11 aa, Mycobacterium
NLPEEDRRRLR

SEQ ID NO: 531308 - protein, 19 aa, Mycobacterium
NLPEGASTQNLSLDGQGRV

SEQ ID NO: 531309 - protein, 5 aa, Mycobacterium
NLPES

SEQ ID NO: 531310 - protein, 9 aa, Mycobacterium
NLPESPLTA

SEQ ID NO: 531311 - protein, 7 aa, Mycobacterium
NLPETAS

SEQ ID NO: 531312 - protein, 6 aa, Mycobacterium
NLPETG

SEQ ID NO: 531313 - protein, 9 aa, Mycobacterium
NLPETTAEN

SEQ ID NO: 531314 - protein, 28 aa, Mycobacterium
NLPGSAGLDAGLANSASYATGGTATLSS

SEQ ID NO: 531315 - protein, 7 aa, Mycobacterium
NLPGSTE

SEQ ID NO: 531316 - protein, 13 aa, Mycobacterium
NLPGTSPETRERV

SEQ ID NO: 531317 - protein, 18 aa, Mycobacterium
NLPGYQGQGGAGSASTLG

SEQ ID NO: 531318 - protein, 8 aa, Mycobacterium
NLPKGPEC

SEQ ID NO: 531319 - protein, 8 aa, Mycobacterium
NLPKSETR

SEQ ID NO: 531320 - protein, 8 aa, Mycobacterium
NLPKSGGA

SEQ ID NO: 531321 - protein, 4 aa, Mycobacterium
NLPP

SEQ ID NO: 531322 - protein, 6 aa, Mycobacterium
NLPPAT

SEQ ID NO: 531323 - protein, 8 aa, Mycobacterium
NLPPDSGL

SEQ ID NO: 531324 - protein, 9 aa, Mycobacterium
NLPPDTGLD

SEQ ID NO: 531325 - protein, 5 aa, Mycobacterium
NLPPE

SEQ ID NO: 531326 - protein, 6 aa, Mycobacterium
NLPPET

SEQ ID NO: 531327 - protein, 18 aa, Mycobacterium
NLPPGPDHLRNTAPRPGS

SEQ ID NO: 531328 - protein, 13 aa, Mycobacterium
NLPPLPGRCGPAS

SEQ ID NO: 531329 - protein, 13 aa, Mycobacterium
NLPPQQDEPHPNR

SEQ ID NO: 531330 - protein, 8 aa, Mycobacterium
NLPPRGLE

SEQ ID NO: 531331 - protein, 4 aa, Mycobacterium
NLPQ

SEQ ID NO: 531332 - protein, 12 aa, Mycobacterium
NLPRQQKGLHSK

SEQ ID NO: 531333 - protein, 7 aa, Mycobacterium
NLPRTGG

SEQ ID NO: 531334 - protein, 5 aa, Mycobacterium
NLPSQ

SEQ ID NO: 531335 - protein, 10 aa, Mycobacterium
NLPSRHEGGE

SEQ ID NO: 531336 - protein, 12 aa, Mycobacterium
NLPSRPASYDAE

SEQ ID NO: 531337 - protein, 10 aa, Mycobacterium
NLPSRRADGQ

SEQ ID NO: 531338 - protein, 11 aa, Mycobacterium
NLPSRREGGDL

SEQ ID NO: 531339 - protein, 18 aa, Mycobacterium
NLPSSLSSVGTLDSGTAG

SEQ ID NO: 531340 - protein, 7 aa, Mycobacterium
NLPTEGG

SEQ ID NO: 531341 - protein, 13 aa, Mycobacterium
NLPTPEEAAAAEA

SEQ ID NO: 531342 - protein, 7 aa, Mycobacterium
NLPTSGG

SEQ ID NO: 531343 - protein, 8 aa, Mycobacterium
NLPTTATN

SEQ ID NO: 531344 - protein, 18 aa, Mycobacterium
NLPTTPWATNAEGRGPAW

SEQ ID NO: 531345 - protein, 5 aa, Mycobacterium
NLQAE

SEQ ID NO: 531346 - protein, 5 aa, Mycobacterium
NLQDH

SEQ ID NO: 531347 - protein, 9 aa, Mycobacterium
NLQDNSLDT

SEQ ID NO: 531348 - protein, 11 aa, Mycobacterium
NLQGASGRKLG

SEQ ID NO: 531349 - protein, 12 aa, Mycobacterium
NLQGNSGRKLGD

SEQ ID NO: 531350 - protein, 10 aa, Mycobacterium
NLQGNSGRKV

SEQ ID NO: 531351 - protein, 11 aa, Mycobacterium
NLQGNSGRRLG

SEQ ID NO: 531352 - protein, 8 aa, Mycobacterium
NLQGNSLD

SEQ ID NO: 531353 - protein, 13 aa, Mycobacterium
NLQPSSDETPGYQ

SEQ ID NO: 531354 - protein, 6 aa, Mycobacterium
NLQQQA

SEQ ID NO: 531355 - protein, 7 aa, Mycobacterium
NLQRDAD

SEQ ID NO: 531356 - protein, 5 aa, Mycobacterium
NLQRE

SEQ ID NO: 531357 - protein, 7 aa, Mycobacterium
NLQREPE

SEQ ID NO: 531358 - protein, 11 aa, Mycobacterium
NLQRTTQTIAD

SEQ ID NO: 531359 - protein, 4 aa, Mycobacterium
NLQS

SEQ ID NO: 531360 - protein, 6 aa, Mycobacterium
NLQSEE

SEQ ID NO: 531361 - protein, 8 aa, Mycobacterium
NLQSQGNE

SEQ ID NO: 531362 - protein, 11 aa, Mycobacterium
NLRADSSAEKL

SEQ ID NO: 531363 - protein, 10 aa, Mycobacterium
NLRADSSVEK

SEQ ID NO: 531364 - protein, 7 aa, Mycobacterium
NLRDPRQ

SEQ ID NO: 531365 - protein, 6 aa, Mycobacterium
NLRDQA

SEQ ID NO: 531366 - protein, 11 aa, Mycobacterium
NLRDREPDEVP

SEQ ID NO: 531367 - protein, 7 aa, Mycobacterium
NLRNSST

SEQ ID NO: 531368 - protein, 10 aa, Mycobacterium
NLRPEGRNGP

SEQ ID NO: 531369 - protein, 7 aa, Mycobacterium
NLRPGDR

SEQ ID NO: 531370 - protein, 6 aa, Mycobacterium
NLRPGN

SEQ ID NO: 531371 - protein, 8 aa, Mycobacterium
NLRPNSSV

SEQ ID NO: 531372 - protein, 9 aa, Mycobacterium
NLRPNSSVE

SEQ ID NO: 531373 - protein, 5 aa, Mycobacterium
NLRRR

SEQ ID NO: 531374 - protein, 4 aa, Mycobacterium
NLRT

SEQ ID NO: 531375 - protein, 16 aa, Mycobacterium
NLSAADAGPRPVPTSA

SEQ ID NO: 531376 - protein, 5 aa, Mycobacterium
NLSAK

SEQ ID NO: 531377 - protein, 5 aa, Mycobacterium
NLSAN

SEQ ID NO: 531378 - protein, 5 aa, Mycobacterium
NLSAS

SEQ ID NO: 531379 - protein, 6 aa, Mycobacterium
NLSDNG

SEQ ID NO: 531380 - protein, 5 aa, Mycobacterium
NLSEE

SEQ ID NO: 531381 - protein, 16 aa, Mycobacterium
NLSEPPLPQGDSALTS

SEQ ID NO: 531382 - protein, 10 aa, Mycobacterium
NLSEPQYNTM

SEQ ID NO: 531383 - protein, 10 aa, Mycobacterium
NLSESARALE

SEQ ID NO: 531384 - protein, 17 aa, Mycobacterium
NLSETPPSGGTSTGSAL

SEQ ID NO: 531385 - protein, 7 aa, Mycobacterium
NLSETST

SEQ ID NO: 531386 - protein, 5 aa, Mycobacterium
NLSGE

SEQ ID NO: 531387 - protein, 5 aa, Mycobacterium
NLSGI

SEQ ID NO: 531388 - protein, 8 aa, Mycobacterium
NLSGLPPT

SEQ ID NO: 531389 - protein, 5 aa, Mycobacterium
NLSGS

SEQ ID NO: 531390 - protein, 8 aa, Mycobacterium
NLSKSLAK

SEQ ID NO: 531391 - protein, 9 aa, Mycobacterium
NLSKSLAKD

SEQ ID NO: 531392 - protein, 8 aa, Mycobacterium
NLSNAKGD

SEQ ID NO: 531393 - protein, 13 aa, Mycobacterium
NLSPDDRATVYTS

SEQ ID NO: 531394 - protein, 6 aa, Mycobacterium
NLSPEE

SEQ ID NO: 531395 - protein, 10 aa, Mycobacterium
NLSPGAVPTL

SEQ ID NO: 531396 - protein, 24 aa, Mycobacterium
NLSPGGNGLRNLGSNGQQRPGPTY

SEQ ID NO: 531397 - protein, 6 aa, Mycobacterium
NLSPTD

SEQ ID NO: 531398 - protein, 4 aa, Mycobacterium
NLSS

SEQ ID NO: 531399 - protein, 9 aa, Mycobacterium
NLSSRRRGL

SEQ ID NO: 531400 - protein, 8 aa, Mycobacterium
NLSSSEIA

SEQ ID NO: 531401 - protein, 13 aa, Mycobacterium
NLSVSATAPPEAV

SEQ ID NO: 531402 - protein, 4 aa, Mycobacterium
NLTA

SEQ ID NO: 531403 - protein, 7 aa, Mycobacterium
NLTAEPR

SEQ ID NO: 531404 - protein, 10 aa, Mycobacterium
NLTDAERAGL

SEQ ID NO: 531405 - protein, 10 aa, Mycobacterium
NLTDAERDGL

SEQ ID NO: 531406 - protein, 7 aa, Mycobacterium
NLTDDLS

SEQ ID NO: 531407 - protein, 9 aa, Mycobacterium
NLTEGGAAM

SEQ ID NO: 531408 - protein, 6 aa, Mycobacterium
NLTEQG

SEQ ID NO: 531409 - protein, 5 aa, Mycobacterium
NLTER

SEQ ID NO: 531410 - protein, 7 aa, Mycobacterium
NLTESAG

SEQ ID NO: 531411 - protein, 17 aa, Mycobacterium
NLTGDPRRWPNDRGNSG

SEQ ID NO: 531412 - protein, 16 aa, Mycobacterium
NLTGDPRRWPNDYGNS

SEQ ID NO: 531413 - protein, 10 aa, Mycobacterium
NLTGHAKGGA

SEQ ID NO: 531414 - protein, 12 aa, Mycobacterium
NLTGNRATAVEG

SEQ ID NO: 531415 - protein, 13 aa, Mycobacterium
NLTGRANAKTVPL

SEQ ID NO: 531416 - protein, 5 aa, Mycobacterium
NLTGT

SEQ ID NO: 531417 - protein, 38 aa, Mycobacterium
NLTGTDASGNTTQTTVTVDDKTKYTKQTSANTEAIAPG

SEQ ID NO: 531418 - protein, 7 aa, Mycobacterium
NLTGTRR

SEQ ID NO: 531419 - protein, 4 aa, Mycobacterium
NLTP

SEQ ID NO: 531420 - protein, 5 aa, Mycobacterium
NLTPA

SEQ ID NO: 531421 - protein, 8 aa, Mycobacterium
NLTPAPRA

SEQ ID NO: 531422 - protein, 5 aa, Mycobacterium
NLTPG

SEQ ID NO: 531423 - protein, 7 aa, Mycobacterium
NLTPGQR

SEQ ID NO: 531424 - protein, 8 aa, Mycobacterium
NLTPPRTI

SEQ ID NO: 531425 - protein, 9 aa, Mycobacterium
NLTRDPDQL

SEQ ID NO: 531426 - protein, 6 aa, Mycobacterium
NLVGSS

SEQ ID NO: 531427 - protein, 13 aa, Mycobacterium
NLVPTDPAEGSVD

SEQ ID NO: 531428 - protein, 16 aa, Mycobacterium
NLYPGDPNGGGSGRKS

SEQ ID NO: 531429 - protein, 7 aa, Mycobacterium
NLYSKQD

SEQ ID NO: 531430 - protein, 18 aa, Mycobacterium
NMADGDRLAASSRSPEIM

SEQ ID NO: 531431 - protein, 6 aa, Mycobacterium
NMAETT

SEQ ID NO: 531432 - protein, 6 aa, Mycobacterium
NMARSG

SEQ ID NO: 531433 - protein, 21 aa, Mycobacterium
NMDAPPPSEDFGRQPPQDLAA

SEQ ID NO: 531434 - protein, 8 aa, Mycobacterium
NMENNSLD

SEQ ID NO: 531435 - protein, 10 aa, Mycobacterium
NMGDGQTGLF

SEQ ID NO: 531436 - protein, 8 aa, Mycobacterium
NMGGTDPR

SEQ ID NO: 531437 - protein, 10 aa, Mycobacterium
NMGHSQAAAG

SEQ ID NO: 531438 - protein, 11 aa, Mycobacterium
NMGNQRAASRL

SEQ ID NO: 531439 - protein, 6 aa, Mycobacterium
NMPCSP

SEQ ID NO: 531440 - protein, 6 aa, Mycobacterium
NMPQSA

SEQ ID NO: 531441 - protein, 28 aa, Mycobacterium
NMPRDPRATPIVTEPEQAVPIPGHPDAA

SEQ ID NO: 531442 - protein, 13 aa, Mycobacterium
NMPSGTAQRPGDV

SEQ ID NO: 531443 - protein, 5 aa, Mycobacterium
NMPVE

SEQ ID NO: 531444 - protein, 10 aa, Mycobacterium
NMQPNADEPV

SEQ ID NO: 531445 - protein, 5 aa, Mycobacterium
NMRTG

SEQ ID NO: 531446 - protein, 9 aa, Mycobacterium
NMSKPDKVT

SEQ ID NO: 531447 - protein, 8 aa, Mycobacterium
NMSTDGTW

SEQ ID NO: 531448 - protein, 8 aa, Mycobacterium
NMTNSGDM

SEQ ID NO: 531449 - protein, 4 aa, Mycobacterium
NNAA

SEQ ID NO: 531450 - protein, 6 aa, Mycobacterium
NNAADV

SEQ ID NO: 531451 - protein, 10 aa, Mycobacterium
NNAAKTTIAP

SEQ ID NO: 531452 - protein, 13 aa, Mycobacterium
NNAANGLNTHTEA

SEQ ID NO: 531453 - protein, 8 aa, Mycobacterium
NNADDALA

SEQ ID NO: 531454 - protein, 5 aa, Mycobacterium
NNADN

SEQ ID NO: 531455 - protein, 8 aa, Mycobacterium
NNADTLAS

SEQ ID NO: 531456 - protein, 6 aa, Mycobacterium
NNAEEA

SEQ ID NO: 531457 - protein, 10 aa, Mycobacterium
NNAERPFSRD

SEQ ID NO: 531458 - protein, 8 aa, Mycobacterium
NNAERTLA

SEQ ID NO: 531459 - protein, 8 aa, Mycobacterium
NNAGDRRQ

SEQ ID NO: 531460 - protein, 5 aa, Mycobacterium
NNAGE

SEQ ID NO: 531461 - protein, 8 aa, Mycobacterium
NNAGGAPF

SEQ ID NO: 531462 - protein, 10 aa, Mycobacterium
NNAGNGDTGL

SEQ ID NO: 531463 - protein, 22 aa, Mycobacterium
NNAKSERKPRVGSTQRRLPNKA

SEQ ID NO: 531464 - protein, 6 aa, Mycobacterium
NNAKVA

SEQ ID NO: 531465 - protein, 19 aa, Mycobacterium
NNANRAGSGCLDRTDGGLT

SEQ ID NO: 531466 - protein, 20 aa, Mycobacterium
NNANRLTSPMRRRPDGTYEE

SEQ ID NO: 531467 - protein, 25 aa, Mycobacterium
NNANRYDSYQRRTSRPIPIFALTPA

SEQ ID NO: 531468 - protein, 9 aa, Mycobacterium
NNAPQHRRH

SEQ ID NO: 531469 - protein, 8 aa, Mycobacterium
NNAPVDPP

SEQ ID NO: 531470 - protein, 17 aa, Mycobacterium
NNARAKAEAKQGTASPV

SEQ ID NO: 531471 - protein, 16 aa, Mycobacterium
NNARAKASAGQGTSTS

SEQ ID NO: 531472 - protein, 5 aa, Mycobacterium
NNARV

SEQ ID NO: 531473 - protein, 9 aa, Mycobacterium
NNASANTQN

SEQ ID NO: 531474 - protein, 7 aa, Mycobacterium
NNASKDP

SEQ ID NO: 531475 - protein, 10 aa, Mycobacterium
NNASRSAPEV

SEQ ID NO: 531476 - protein, 10 aa, Mycobacterium
NNCSTGSTAL

SEQ ID NO: 531477 - protein, 5 aa, Mycobacterium
NNDAD

SEQ ID NO: 531478 - protein, 5 aa, Mycobacterium
NNDAQ

SEQ ID NO: 531479 - protein, 8 aa, Mycobacterium
NNDDDTVS

SEQ ID NO: 531480 - protein, 9 aa, Mycobacterium
NNDDEIGRT

SEQ ID NO: 531481 - protein, 7 aa, Mycobacterium
NNDEAAA

SEQ ID NO: 531482 - protein, 7 aa, Mycobacterium
NNDEAVR

SEQ ID NO: 531483 - protein, 7 aa, Mycobacterium
NNDGDLP

SEQ ID NO: 531484 - protein, 7 aa, Mycobacterium
NNDGPAL

SEQ ID NO: 531485 - protein, 8 aa, Mycobacterium
NNDGPALR

SEQ ID NO: 531486 - protein, 8 aa, Mycobacterium
NNDGPDLR

SEQ ID NO: 531487 - protein, 7 aa, Mycobacterium
NNDGTYD

SEQ ID NO: 531488 - protein, 7 aa, Mycobacterium
NNDKDKH

SEQ ID NO: 531489 - protein, 11 aa, Mycobacterium
NNDQSTPVPSC

SEQ ID NO: 531490 - protein, 4 aa, Mycobacterium
NNDS

SEQ ID NO: 531491 - protein, 8 aa, Mycobacterium
NNDTDRDV

SEQ ID NO: 531492 - protein, 6 aa, Mycobacterium
NNDTTL

SEQ ID NO: 531493 - protein, 8 aa, Mycobacterium
NNDTVGAA

SEQ ID NO: 531494 - protein, 10 aa, Mycobacterium
NNDYTSSVAR

SEQ ID NO: 531495 - protein, 10 aa, Mycobacterium
NNEERPFSRD

SEQ ID NO: 531496 - protein, 15 aa, Mycobacterium
NNEGGGPGAAEGEGI

SEQ ID NO: 531497 - protein, 8 aa, Mycobacterium
NNERAYDK

SEQ ID NO: 531498 - protein, 7 aa, Mycobacterium
NNERAYQ

SEQ ID NO: 531499 - protein, 6 aa, Mycobacterium
NNEVGK

SEQ ID NO: 531500 - protein, 12 aa, Mycobacterium
NNEVPGATERDH

SEQ ID NO: 531501 - protein, 13 aa, Mycobacterium
NNEVPGATERDHG

SEQ ID NO: 531502 - protein, 12 aa, Mycobacterium
NNFDPTRRSGRV

SEQ ID NO: 531503 - protein, 7 aa, Mycobacterium
NNFEPHT

SEQ ID NO: 531504 - protein, 7 aa, Mycobacterium
NNFGSGN

SEQ ID NO: 531505 - protein, 15 aa, Mycobacterium
NNFSPSQVTQFLLLA

SEQ ID NO: 531506 - protein, 8 aa, Mycobacterium
NNGAGNVG

SEQ ID NO: 531507 - protein, 22 aa, Mycobacterium
NNGANRNFPSTCATTPREYLAR

SEQ ID NO: 531508 - protein, 14 aa, Mycobacterium
NNGARQYDGSQVPL

SEQ ID NO: 531509 - protein, 6 aa, Mycobacterium
NNGAST

SEQ ID NO: 531510 - protein, 7 aa, Mycobacterium
NNGDFAG

SEQ ID NO: 531511 - protein, 10 aa, Mycobacterium
NNGESATAIS

SEQ ID NO: 531512 - protein, 13 aa, Mycobacterium
NNGEVVAEGRSDA

SEQ ID NO: 531513 - protein, 7 aa, Mycobacterium
NNGFSEK

SEQ ID NO: 531514 - protein, 7 aa, Mycobacterium
NNGHGRW

SEQ ID NO: 531515 - protein, 11 aa, Mycobacterium
NNGHPEDAVSR

SEQ ID NO: 531516 - protein, 4 aa, Mycobacterium
NNGI

SEQ ID NO: 531517 - protein, 5 aa, Mycobacterium
NNGKD

SEQ ID NO: 531518 - protein, 12 aa, Mycobacterium
NNGKSATAISIP

SEQ ID NO: 531519 - protein, 7 aa, Mycobacterium
NNGLTAS

SEQ ID NO: 531520 - protein, 7 aa, Mycobacterium
NNGPAEL

SEQ ID NO: 531521 - protein, 12 aa, Mycobacterium
NNGPAGTGSPVN

SEQ ID NO: 531522 - protein, 5 aa, Mycobacterium
NNGPL

SEQ ID NO: 531523 - protein, 19 aa, Mycobacterium
NNGPSAVLGPTSQTAPGVV

SEQ ID NO: 531524 - protein, 8 aa, Mycobacterium
NNGQTVAR

SEQ ID NO: 531525 - protein, 9 aa, Mycobacterium
NNGRDTSSA

SEQ ID NO: 531526 - protein, 6 aa, Mycobacterium
NNGRPG

SEQ ID NO: 531527 - protein, 36 aa, Mycobacterium
NNGTATGTATGGNGGNGGNGDADGHRGGKGGDGGEA

SEQ ID NO: 531528 - protein, 7 aa, Mycobacterium
NNGTGNF

SEQ ID NO: 531529 - protein, 6 aa, Mycobacterium
NNGTMP

SEQ ID NO: 531530 - protein, 6 aa, Mycobacterium
NNGTQT

SEQ ID NO: 531531 - protein, 10 aa, Mycobacterium
NNGTSATAIS

SEQ ID NO: 531532 - protein, 4 aa, Mycobacterium
NNGV

SEQ ID NO: 531533 - protein, 18 aa, Mycobacterium
NNGVGNSGIGNVGDGNAG

SEQ ID NO: 531534 - protein, 5 aa, Mycobacterium
NNHND

SEQ ID NO: 531535 - protein, 18 aa, Mycobacterium
NNHRTDSNGFSIKDQLRG

SEQ ID NO: 531536 - protein, 6 aa, Mycobacterium
NNIAKD

SEQ ID NO: 531537 - protein, 6 aa, Mycobacterium
NNIGPA

SEQ ID NO: 531538 - protein, 8 aa, Mycobacterium
NNIPSGAF

SEQ ID NO: 531539 - protein, 6 aa, Mycobacterium
NNIPTQ

SEQ ID NO: 531540 - protein, 20 aa, Mycobacterium
NNKLNGAARRSVAPTSPAVP

SEQ ID NO: 531541 - protein, 10 aa, Mycobacterium
NNKPQQVQDA

SEQ ID NO: 531542 - protein, 9 aa, Mycobacterium
NNKQSARNF

SEQ ID NO: 531543 - protein, 7 aa, Mycobacterium
NNKVRIP

SEQ ID NO: 531544 - protein, 7 aa, Mycobacterium
NNLGDSK

SEQ ID NO: 531545 - protein, 10 aa, Mycobacterium
NNLGSPDEYA

SEQ ID NO: 531546 - protein, 7 aa, Mycobacterium
NNLHGRG

SEQ ID NO: 531547 - protein, 10 aa, Mycobacterium
NNLPESDSPQ

SEQ ID NO: 531548 - protein, 8 aa, Mycobacterium
NNLPSGAF

SEQ ID NO: 531549 - protein, 6 aa, Mycobacterium
NNLSRP

SEQ ID NO: 531550 - protein, 4 aa, Mycobacterium
NNNA

SEQ ID NO: 531551 - protein, 7 aa, Mycobacterium
NNNGGFP

SEQ ID NO: 531552 - protein, 8 aa, Mycobacterium
NNNGSLPE

SEQ ID NO: 531553 - protein, 7 aa, Mycobacterium
NNNGTFP

SEQ ID NO: 531554 - protein, 7 aa, Mycobacterium
NNNNGRQ

SEQ ID NO: 531555 - protein, 7 aa, Mycobacterium
NNNQNRY

SEQ ID NO: 531556 - protein, 11 aa, Mycobacterium
NNNRSHATAGG

SEQ ID NO: 531557 - protein, 7 aa, Mycobacterium
NNNSRSL

SEQ ID NO: 531558 - protein, 5 aa, Mycobacterium
NNNTA

SEQ ID NO: 531559 - protein, 15 aa, Mycobacterium
NNNTAAGASAVGTGN

SEQ ID NO: 531560 - protein, 4 aa, Mycobacterium
NNNV

SEQ ID NO: 531561 - protein, 16 aa, Mycobacterium
NNPAAAISRAASDLRE

SEQ ID NO: 531562 - protein, 10 aa, Mycobacterium
NNPAAATARA

SEQ ID NO: 531563 - protein, 10 aa, Mycobacterium
NNPAAATVRA

SEQ ID NO: 531564 - protein, 13 aa, Mycobacterium
NNPADARPLADAA

SEQ ID NO: 531565 - protein, 13 aa, Mycobacterium
NNPADARPLPGAA

SEQ ID NO: 531566 - protein, 10 aa, Mycobacterium
NNPAGATARA

SEQ ID NO: 531567 - protein, 8 aa, Mycobacterium
NNPAKRVG

SEQ ID NO: 531568 - protein, 7 aa, Mycobacterium
NNPANSV

SEQ ID NO: 531569 - protein, 10 aa, Mycobacterium
NNPAQRNSYD

SEQ ID NO: 531570 - protein, 10 aa, Mycobacterium
NNPDATTMPK

SEQ ID NO: 531571 - protein, 10 aa, Mycobacterium
NNPDGATEVA

SEQ ID NO: 531572 - protein, 7 aa, Mycobacterium
NNPDGSL

SEQ ID NO: 531573 - protein, 10 aa, Mycobacterium
NNPDNQGPNL

SEQ ID NO: 531574 - protein, 5 aa, Mycobacterium
NNPDQ

SEQ ID NO: 531575 - protein, 6 aa, Mycobacterium
NNPEGL

SEQ ID NO: 531576 - protein, 13 aa, Mycobacterium
NNPEQRNSYDASM

SEQ ID NO: 531577 - protein, 7 aa, Mycobacterium
NNPGLTI

SEQ ID NO: 531578 - protein, 6 aa, Mycobacterium
NNPGNH

SEQ ID NO: 531579 - protein, 8 aa, Mycobacterium
NNPGPQIR

SEQ ID NO: 531580 - protein, 15 aa, Mycobacterium
NNPHAPRRPRSTEVA

SEQ ID NO: 531581 - protein, 10 aa, Mycobacterium
NNPKQRNSYD

SEQ ID NO: 531582 - protein, 12 aa, Mycobacterium
NNPKQRNSYDAA

SEQ ID NO: 531583 - protein, 12 aa, Mycobacterium
NNPLPRRRRLGN

SEQ ID NO: 531584 - protein, 5 aa, Mycobacterium
NNPME

SEQ ID NO: 531585 - protein, 6 aa, Mycobacterium
NNPNGG

SEQ ID NO: 531586 - protein, 10 aa, Mycobacterium
NNPPGPEPLP

SEQ ID NO: 531587 - protein, 5 aa, Mycobacterium
NNPRR

SEQ ID NO: 531588 - protein, 7 aa, Mycobacterium
NNPSPRI

SEQ ID NO: 531589 - protein, 18 aa, Mycobacterium
NNPSTQLRPRDPDPDSRA

SEQ ID NO: 531590 - protein, 9 aa, Mycobacterium
NNPTRRNAY

SEQ ID NO: 531591 - protein, 8 aa, Mycobacterium
NNPTSSPY

SEQ ID NO: 531592 - protein, 6 aa, Mycobacterium
NNPVAR

SEQ ID NO: 531593 - protein, 20 aa, Mycobacterium
NNPVEAARAHREKRAPRWDP

SEQ ID NO: 531594 - protein, 8 aa, Mycobacterium
NNPYGNGT

SEQ ID NO: 531595 - protein, 12 aa, Mycobacterium
NNPYRDKIAESG

SEQ ID NO: 531596 - protein, 6 aa, Mycobacterium
NNQAAH

SEQ ID NO: 531597 - protein, 10 aa, Mycobacterium
NNQAGASAGI

SEQ ID NO: 531598 - protein, 68 aa, Mycobacterium
NNQGGNGGNGANGSGPGGAGGAGGDGGASTAGGAATGGKGGHGGNGAASDLSGGNGGAAGAGGNGGNA

SEQ ID NO: 531599 - protein, 20 aa, Mycobacterium
NNQPAPHGDYPDQASGPQRT

SEQ ID NO: 531600 - protein, 7 aa, Mycobacterium
NNQRDGF

SEQ ID NO: 531601 - protein, 7 aa, Mycobacterium
NNQSGVD

SEQ ID NO: 531602 - protein, 5 aa, Mycobacterium
NNREM

SEQ ID NO: 531603 - protein, 19 aa, Mycobacterium
NNRFTRKRSGTGGGTKSTD

SEQ ID NO: 531604 - protein, 10 aa, Mycobacterium
NNRGKKSVSV

SEQ ID NO: 531605 - protein, 9 aa, Mycobacterium
NNRGKKSVT

SEQ ID NO: 531606 - protein, 8 aa, Mycobacterium
NNRPAETE

SEQ ID NO: 531607 - protein, 8 aa, Mycobacterium
NNRPEGAR

SEQ ID NO: 531608 - protein, 12 aa, Mycobacterium
NNRPHDLVVVPV

SEQ ID NO: 531609 - protein, 8 aa, Mycobacterium
NNRPRKSL

SEQ ID NO: 531610 - protein, 8 aa, Mycobacterium
NNRPRPTL

SEQ ID NO: 531611 - protein, 12 aa, Mycobacterium
NNRPTRPGSIDR

SEQ ID NO: 531612 - protein, 12 aa, Mycobacterium
NNRRGPAPLDRG

SEQ ID NO: 531613 - protein, 9 aa, Mycobacterium
NNRSTVSGG

SEQ ID NO: 531614 - protein, 10 aa, Mycobacterium
NNRVEAEAKR

SEQ ID NO: 531615 - protein, 10 aa, Mycobacterium
NNRVNGENTF

SEQ ID NO: 531616 - protein, 5 aa, Mycobacterium
NNRVR

SEQ ID NO: 531617 - protein, 7 aa, Mycobacterium
NNSAQVE

SEQ ID NO: 531618 - protein, 10 aa, Mycobacterium
NNSASSVSSA

SEQ ID NO: 531619 - protein, 5 aa, Mycobacterium
NNSAV

SEQ ID NO: 531620 - protein, 7 aa, Mycobacterium
NNSDGFP

SEQ ID NO: 531621 - protein, 4 aa, Mycobacterium
NNSG

SEQ ID NO: 531622 - protein, 10 aa, Mycobacterium
NNSGPGAEAV

SEQ ID NO: 531623 - protein, 6 aa, Mycobacterium
NNSLGA

SEQ ID NO: 531624 - protein, 7 aa, Mycobacterium
NNSNARE

SEQ ID NO: 531625 - protein, 7 aa, Mycobacterium
NNSNPAA

SEQ ID NO: 531626 - protein, 7 aa, Mycobacterium
NNSPRFT

SEQ ID NO: 531627 - protein, 15 aa, Mycobacterium
NNSRRARAARRRKRR

SEQ ID NO: 531628 - protein, 11 aa, Mycobacterium
NNSSEINPDQA

SEQ ID NO: 531629 - protein, 7 aa, Mycobacterium
NNSSRAI

SEQ ID NO: 531630 - protein, 7 aa, Mycobacterium
NNSSRAL

SEQ ID NO: 531631 - protein, 7 aa, Mycobacterium
NNSSRSF

SEQ ID NO: 531632 - protein, 9 aa, Mycobacterium
NNSTDDTAA

SEQ ID NO: 531633 - protein, 14 aa, Mycobacterium
NNSTDDTAGVAARH

SEQ ID NO: 531634 - protein, 9 aa, Mycobacterium
NNSTDGTAA

SEQ ID NO: 531635 - protein, 15 aa, Mycobacterium
NNSTDNTAAVAGRHG

SEQ ID NO: 531636 - protein, 11 aa, Mycobacterium
NNSTDRTAEVA

SEQ ID NO: 531637 - protein, 6 aa, Mycobacterium
NNSTVR

SEQ ID NO: 531638 - protein, 7 aa, Mycobacterium
NNSTYGL

SEQ ID NO: 531639 - protein, 7 aa, Mycobacterium
NNTAGRD

SEQ ID NO: 531640 - protein, 12 aa, Mycobacterium
NNTASASAIGAG

SEQ ID NO: 531641 - protein, 11 aa, Mycobacterium
NNTAWSSRYER

SEQ ID NO: 531642 - protein, 7 aa, Mycobacterium
NNTEARI

SEQ ID NO: 531643 - protein, 6 aa, Mycobacterium
NNTELG

SEQ ID NO: 531644 - protein, 6 aa, Mycobacterium
NNTESG

SEQ ID NO: 531645 - protein, 6 aa, Mycobacterium
NNTGGA

SEQ ID NO: 531646 - protein, 8 aa, Mycobacterium
NNTGSAKT

SEQ ID NO: 531647 - protein, 8 aa, Mycobacterium
NNTISASS

SEQ ID NO: 531648 - protein, 27 aa, Mycobacterium
NNTKRGTDGEPPADASNPRNDNKSGQI

SEQ ID NO: 531649 - protein, 4 aa, Mycobacterium
NNTP

SEQ ID NO: 531650 - protein, 5 aa, Mycobacterium
NNTPL

SEQ ID NO: 531651 - protein, 5 aa, Mycobacterium
NNTPV

SEQ ID NO: 531652 - protein, 7 aa, Mycobacterium
NNTPVNT

SEQ ID NO: 531653 - protein, 5 aa, Mycobacterium
NNTRE

SEQ ID NO: 531654 - protein, 8 aa, Mycobacterium
NNTRSARY

SEQ ID NO: 531655 - protein, 7 aa, Mycobacterium
NNTSRDS

SEQ ID NO: 531656 - protein, 7 aa, Mycobacterium
NNTSTVS

SEQ ID NO: 531657 - protein, 6 aa, Mycobacterium
NNTSYG

SEQ ID NO: 531658 - protein, 4 aa, Mycobacterium
NNVA

SEQ ID NO: 531659 - protein, 4 aa, Mycobacterium
NNVH

SEQ ID NO: 531660 - protein, 8 aa, Mycobacterium
NNVPSGAF

SEQ ID NO: 531661 - protein, 20 aa, Mycobacterium
NNVPVASPVQDAGANAQNGA

SEQ ID NO: 531662 - protein, 5 aa, Mycobacterium
NNWQD

SEQ ID NO: 531663 - protein, 9 aa, Mycobacterium
NNYAGTIGR

SEQ ID NO: 531664 - protein, 15 aa, Mycobacterium
NNYEGQEQASQQILC

SEQ ID NO: 531665 - protein, 6 aa, Mycobacterium
NNYSGI

SEQ ID NO: 531666 - protein, 7 aa, Mycobacterium
NPAAAEL

SEQ ID NO: 531667 - protein, 6 aa, Mycobacterium
NPAAAL

SEQ ID NO: 531668 - protein, 7 aa, Mycobacterium
NPAAARA

SEQ ID NO: 531669 - protein, 10 aa, Mycobacterium
NPAAGDPEGY

SEQ ID NO: 531670 - protein, 16 aa, Mycobacterium
NPAALGDGIRAGQRVG

SEQ ID NO: 531671 - protein, 8 aa, Mycobacterium
NPAAMGDG

SEQ ID NO: 531672 - protein, 9 aa, Mycobacterium
NPAARANFS

SEQ ID NO: 531673 - protein, 6 aa, Mycobacterium
NPAATT

SEQ ID NO: 531674 - protein, 5 aa, Mycobacterium
NPADA

SEQ ID NO: 531675 - protein, 8 aa, Mycobacterium
NPADAKTV

SEQ ID NO: 531676 - protein, 8 aa, Mycobacterium
NPADATES

SEQ ID NO: 531677 - protein, 6 aa, Mycobacterium
NPADAV

SEQ ID NO: 531678 - protein, 8 aa, Mycobacterium
NPADDSAF

SEQ ID NO: 531679 - protein, 9 aa, Mycobacterium
NPADGGRAP

SEQ ID NO: 531680 - protein, 9 aa, Mycobacterium
NPADGGRDV

SEQ ID NO: 531681 - protein, 29 aa, Mycobacterium
NPADPEPCTAGTPTQAQIDNDQRSLAQRQ

SEQ ID NO: 531682 - protein, 29 aa, Mycobacterium
NPADPEPCTYGTPTQAQIDNDQRSLAQRQ

SEQ ID NO: 531683 - protein, 6 aa, Mycobacterium
NPADPP

SEQ ID NO: 531684 - protein, 8 aa, Mycobacterium
NPADTSSV

SEQ ID NO: 531685 - protein, 5 aa, Mycobacterium
NPADY

SEQ ID NO: 531686 - protein, 4 aa, Mycobacterium
NPAE

SEQ ID NO: 531687 - protein, 5 aa, Mycobacterium
NPAEA

SEQ ID NO: 531688 - protein, 8 aa, Mycobacterium
NPAEAKTV

SEQ ID NO: 531689 - protein, 21 aa, Mycobacterium
NPAEFRTATADPADDPTPQVP

SEQ ID NO: 531690 - protein, 19 aa, Mycobacterium
NPAEGWAGAAAETCAEAQR

SEQ ID NO: 531691 - protein, 7 aa, Mycobacterium
NPAEPPS

SEQ ID NO: 531692 - protein, 14 aa, Mycobacterium
NPAEQSRRVARGTA

SEQ ID NO: 531693 - protein, 13 aa, Mycobacterium
NPAETDGAAKLYD

SEQ ID NO: 531694 - protein, 4 aa, Mycobacterium
NPAF

SEQ ID NO: 531695 - protein, 13 aa, Mycobacterium
NPAGATISDGSAL

SEQ ID NO: 531696 - protein, 9 aa, Mycobacterium
NPAGDPRRA

SEQ ID NO: 531697 - protein, 8 aa, Mycobacterium
NPAGDRPL

SEQ ID NO: 531698 - protein, 7 aa, Mycobacterium
NPAGFSS

SEQ ID NO: 531699 - protein, 8 aa, Mycobacterium
NPAGNRPL

SEQ ID NO: 531700 - protein, 7 aa, Mycobacterium
NPAGPRI

SEQ ID NO: 531701 - protein, 11 aa, Mycobacterium
NPAGPTTPIGP

SEQ ID NO: 531702 - protein, 7 aa, Mycobacterium
NPAGRAT

SEQ ID NO: 531703 - protein, 13 aa, Mycobacterium
NPAGWTGAKGAPT

SEQ ID NO: 531704 - protein, 4 aa, Mycobacterium
NPAI

SEQ ID NO: 531705 - protein, 5 aa, Mycobacterium
NPAIN

SEQ ID NO: 531706 - protein, 6 aa, Mycobacterium
NPAKGL

SEQ ID NO: 531707 - protein, 9 aa, Mycobacterium
NPAKNSSAE

SEQ ID NO: 531708 - protein, 6 aa, Mycobacterium
NPAKTI

SEQ ID NO: 531709 - protein, 9 aa, Mycobacterium
NPAKTLAAR

SEQ ID NO: 531710 - protein, 6 aa, Mycobacterium
NPALPT

SEQ ID NO: 531711 - protein, 6 aa, Mycobacterium
NPALTA

SEQ ID NO: 531712 - protein, 4 aa, Mycobacterium
NPAN

SEQ ID NO: 531713 - protein, 7 aa, Mycobacterium
NPANADT

SEQ ID NO: 531714 - protein, 5 aa, Mycobacterium
NPANG

SEQ ID NO: 531715 - protein, 7 aa, Mycobacterium
NPANGEP

SEQ ID NO: 531716 - protein, 25 aa, Mycobacterium
NPANIGGQRDGWAPRGVYVNNFVFV

SEQ ID NO: 531717 - protein, 8 aa, Mycobacterium
NPANSDTV

SEQ ID NO: 531718 - protein, 7 aa, Mycobacterium
NPANTNA

SEQ ID NO: 531719 - protein, 12 aa, Mycobacterium
NPAPQLRSGGLG

SEQ ID NO: 531720 - protein, 8 aa, Mycobacterium
NPAPRPAD

SEQ ID NO: 531721 - protein, 238 aa, Mycobacterium
NPAPSNRLDAPSNPGGPEAPVRPPEPPGPTTHNPGGTRPPGGGDGPPPESPHRPVGPADPGPTRGDAPPPHTPSTPEPSHPGSSSVGEPGIRGNPEPSHTPPSVDHTPQHAPEPATPAAQNDAPHTSAESNSTPTHQPSTSDAPASTHSPTQHIGGSVGGEHSAISSDSNIGSAEHHRPVTDESRNWADEQAHRPAEQQPAHNAAAEQPVTHDRNSAETNESREPAYSSAVNGPQPAM

SEQ ID NO: 531722 - protein, 10 aa, Mycobacterium
NPAPSPGDEL

SEQ ID NO: 531723 - protein, 7 aa, Mycobacterium
NPAPTAG

SEQ ID NO: 531724 - protein, 6 aa, Mycobacterium
NPAPYT

SEQ ID NO: 531725 - protein, 9 aa, Mycobacterium
NPAPYTANQ

SEQ ID NO: 531726 - protein, 7 aa, Mycobacterium
NPAQRQK

SEQ ID NO: 531727 - protein, 19 aa, Mycobacterium
NPARCGPAGHGDDASTRDS

SEQ ID NO: 531728 - protein, 15 aa, Mycobacterium
NPARIGQAALLKPHL

SEQ ID NO: 531729 - protein, 8 aa, Mycobacterium
NPARPGDI

SEQ ID NO: 531730 - protein, 6 aa, Mycobacterium
NPARPL

SEQ ID NO: 531731 - protein, 8 aa, Mycobacterium
NPARRARY

SEQ ID NO: 531732 - protein, 5 aa, Mycobacterium
NPARS

SEQ ID NO: 531733 - protein, 14 aa, Mycobacterium
NPARVARGAPDLGE

SEQ ID NO: 531734 - protein, 9 aa, Mycobacterium
NPASGEAAR

SEQ ID NO: 531735 - protein, 12 aa, Mycobacterium
NPASHQDDSHSE

SEQ ID NO: 531736 - protein, 13 aa, Mycobacterium
NPASHQEDSFSPE

SEQ ID NO: 531737 - protein, 15 aa, Mycobacterium
NPASHQQDSHSDGLL

SEQ ID NO: 531738 - protein, 9 aa, Mycobacterium
NPASKSRTW

SEQ ID NO: 531739 - protein, 5 aa, Mycobacterium
NPASL

SEQ ID NO: 531740 - protein, 10 aa, Mycobacterium
NPASLSDPAA

SEQ ID NO: 531741 - protein, 11 aa, Mycobacterium
NPASLSDPSEM

SEQ ID NO: 531742 - protein, 8 aa, Mycobacterium
NPASLTGQ

SEQ ID NO: 531743 - protein, 6 aa, Mycobacterium
NPATDG

SEQ ID NO: 531744 - protein, 11 aa, Mycobacterium
NPATDSPHAAG

SEQ ID NO: 531745 - protein, 11 aa, Mycobacterium
NPATDSPQAAA

SEQ ID NO: 531746 - protein, 6 aa, Mycobacterium
NPATEE

SEQ ID NO: 531747 - protein, 11 aa, Mycobacterium
NPATEEPLGEV

SEQ ID NO: 531748 - protein, 19 aa, Mycobacterium
NPATEEPLGEVADASKEDM

SEQ ID NO: 531749 - protein, 19 aa, Mycobacterium
NPATEESLGEVADASKEDM

SEQ ID NO: 531750 - protein, 8 aa, Mycobacterium
NPATEETL

SEQ ID NO: 531751 - protein, 8 aa, Mycobacterium
NPATERPF

SEQ ID NO: 531752 - protein, 11 aa, Mycobacterium
NPATGEAARKL

SEQ ID NO: 531753 - protein, 15 aa, Mycobacterium
NPATGEAARKLHDDA

SEQ ID NO: 531754 - protein, 8 aa, Mycobacterium
NPATGESV

SEQ ID NO: 531755 - protein, 8 aa, Mycobacterium
NPATGETV

SEQ ID NO: 531756 - protein, 7 aa, Mycobacterium
NPATGQP

SEQ ID NO: 531757 - protein, 5 aa, Mycobacterium
NPATI

SEQ ID NO: 531758 - protein, 7 aa, Mycobacterium
NPATITG

SEQ ID NO: 531759 - protein, 9 aa, Mycobacterium
NPATLGDPA

SEQ ID NO: 531760 - protein, 9 aa, Mycobacterium
NPATLGPQM

SEQ ID NO: 531761 - protein, 10 aa, Mycobacterium
NPATLSDPAA

SEQ ID NO: 531762 - protein, 9 aa, Mycobacterium
NPATLTDPA

SEQ ID NO: 531763 - protein, 6 aa, Mycobacterium
NPATMG

SEQ ID NO: 531764 - protein, 13 aa, Mycobacterium
NPATPRPTNGPRA

SEQ ID NO: 531765 - protein, 18 aa, Mycobacterium
NPATQLRPRDPDPDSPAA

SEQ ID NO: 531766 - protein, 7 aa, Mycobacterium
NPATVTG

SEQ ID NO: 531767 - protein, 7 aa, Mycobacterium
NPAVPQD

SEQ ID NO: 531768 - protein, 6 aa, Mycobacterium
NPAVRD

SEQ ID NO: 531769 - protein, 7 aa, Mycobacterium
NPAVRTE

SEQ ID NO: 531770 - protein, 10 aa, Mycobacterium
NPAYGSDRQS

SEQ ID NO: 531771 - protein, 13 aa, Mycobacterium
NPCSRRTAPPMGK

SEQ ID NO: 531772 - protein, 20 aa, Mycobacterium
NPCSRRTAPPMGTQKPYVAT

SEQ ID NO: 531773 - protein, 5 aa, Mycobacterium
NPDAA

SEQ ID NO: 531774 - protein, 7 aa, Mycobacterium
NPDADLR

SEQ ID NO: 531775 - protein, 12 aa, Mycobacterium
NPDALADGGYRL

SEQ ID NO: 531776 - protein, 9 aa, Mycobacterium
NPDAPKHKG

SEQ ID NO: 531777 - protein, 17 aa, Mycobacterium
NPDAPLYADPQTTAQLG

SEQ ID NO: 531778 - protein, 9 aa, Mycobacterium
NPDAPTRDQ

SEQ ID NO: 531779 - protein, 7 aa, Mycobacterium
NPDARRA

SEQ ID NO: 531780 - protein, 8 aa, Mycobacterium
NPDATAEA

SEQ ID NO: 531781 - protein, 9 aa, Mycobacterium
NPDATRATL

SEQ ID NO: 531782 - protein, 13 aa, Mycobacterium
NPDAVPGQKAAKT

SEQ ID NO: 531783 - protein, 5 aa, Mycobacterium
NPDAW

SEQ ID NO: 531784 - protein, 15 aa, Mycobacterium
NPDCPAKIDDGRATS

SEQ ID NO: 531785 - protein, 9 aa, Mycobacterium
NPDCPKPRT

SEQ ID NO: 531786 - protein, 14 aa, Mycobacterium
NPDCTAKVDDGRGS

SEQ ID NO: 531787 - protein, 13 aa, Mycobacterium
NPDDEVNGRPHGM

SEQ ID NO: 531788 - protein, 6 aa, Mycobacterium
NPDDLD

SEQ ID NO: 531789 - protein, 8 aa, Mycobacterium
NPDDPGTA

SEQ ID NO: 531790 - protein, 9 aa, Mycobacterium
NPDDPGTSI

SEQ ID NO: 531791 - protein, 6 aa, Mycobacterium
NPDDSF

SEQ ID NO: 531792 - protein, 6 aa, Mycobacterium
NPDEAV

SEQ ID NO: 531793 - protein, 6 aa, Mycobacterium
NPDEDL

SEQ ID NO: 531794 - protein, 9 aa, Mycobacterium
NPDEDLSTG

SEQ ID NO: 531795 - protein, 10 aa, Mycobacterium
NPDENGDWRR

SEQ ID NO: 531796 - protein, 6 aa, Mycobacterium
NPDENS

SEQ ID NO: 531797 - protein, 5 aa, Mycobacterium
NPDEW

SEQ ID NO: 531798 - protein, 4 aa, Mycobacterium
NPDF

SEQ ID NO: 531799 - protein, 6 aa, Mycobacterium
NPDFSP

SEQ ID NO: 531800 - protein, 8 aa, Mycobacterium
NPDFTPGE

SEQ ID NO: 531801 - protein, 6 aa, Mycobacterium
NPDGEA

SEQ ID NO: 531802 - protein, 5 aa, Mycobacterium
NPDGF

SEQ ID NO: 531803 - protein, 5 aa, Mycobacterium
NPDGG

SEQ ID NO: 531804 - protein, 9 aa, Mycobacterium
NPDGKSRRE

SEQ ID NO: 531805 - protein, 9 aa, Mycobacterium
NPDGPPPAK

SEQ ID NO: 531806 - protein, 5 aa, Mycobacterium
NPDGS

SEQ ID NO: 531807 - protein, 8 aa, Mycobacterium
NPDGSDTW

SEQ ID NO: 531808 - protein, 8 aa, Mycobacterium
NPDGSPQA

SEQ ID NO: 531809 - protein, 8 aa, Mycobacterium
NPDGSPQV

SEQ ID NO: 531810 - protein, 15 aa, Mycobacterium
NPDGSSQLSRTTPDI

SEQ ID NO: 531811 - protein, 14 aa, Mycobacterium
NPDGTGGDLKRSNR

SEQ ID NO: 531812 - protein, 6 aa, Mycobacterium
NPDGTQ

SEQ ID NO: 531813 - protein, 22 aa, Mycobacterium
NPDGTQRIEDTGPYGRERQRTL

SEQ ID NO: 531814 - protein, 4 aa, Mycobacterium
NPDH

SEQ ID NO: 531815 - protein, 18 aa, Mycobacterium
NPDHAGDVAATGAEPVTA

SEQ ID NO: 531816 - protein, 14 aa, Mycobacterium
NPDHARPHPESTTA

SEQ ID NO: 531817 - protein, 18 aa, Mycobacterium
NPDHRDDIAATGATPVQA

SEQ ID NO: 531818 - protein, 16 aa, Mycobacterium
NPDHSDDVAATGATPV

SEQ ID NO: 531819 - protein, 5 aa, Mycobacterium
NPDHV

SEQ ID NO: 531820 - protein, 4 aa, Mycobacterium
NPDK

SEQ ID NO: 531821 - protein, 5 aa, Mycobacterium
NPDKF

SEQ ID NO: 531822 - protein, 12 aa, Mycobacterium
NPDKFSGTPLRE

SEQ ID NO: 531823 - protein, 16 aa, Mycobacterium
NPDKFTGSPLGTAVRR

SEQ ID NO: 531824 - protein, 6 aa, Mycobacterium
NPDKLA

SEQ ID NO: 531825 - protein, 15 aa, Mycobacterium
NPDKLAALDGPRVIT

SEQ ID NO: 531826 - protein, 5 aa, Mycobacterium
NPDLP

SEQ ID NO: 531827 - protein, 14 aa, Mycobacterium
NPDLTGLQQQADSY

SEQ ID NO: 531828 - protein, 6 aa, Mycobacterium
NPDMAD

SEQ ID NO: 531829 - protein, 7 aa, Mycobacterium
NPDMADE

SEQ ID NO: 531830 - protein, 12 aa, Mycobacterium
NPDNPNQPPYSP

SEQ ID NO: 531831 - protein, 9 aa, Mycobacterium
NPDPANDTV

SEQ ID NO: 531832 - protein, 12 aa, Mycobacterium
NPDPARSEEDLE

SEQ ID NO: 531833 - protein, 10 aa, Mycobacterium
NPDPDVPGTC

SEQ ID NO: 531834 - protein, 6 aa, Mycobacterium
NPDPEI

SEQ ID NO: 531835 - protein, 12 aa, Mycobacterium
NPDPEIHPDAAR

SEQ ID NO: 531836 - protein, 13 aa, Mycobacterium
NPDPEIHPDAARK

SEQ ID NO: 531837 - protein, 5 aa, Mycobacterium
NPDPM

SEQ ID NO: 531838 - protein, 5 aa, Mycobacterium
NPDPW

SEQ ID NO: 531839 - protein, 5 aa, Mycobacterium
NPDQA

SEQ ID NO: 531840 - protein, 5 aa, Mycobacterium
NPDQL

SEQ ID NO: 531841 - protein, 6 aa, Mycobacterium
NPDQLG

SEQ ID NO: 531842 - protein, 7 aa, Mycobacterium
NPDQLTP

SEQ ID NO: 531843 - protein, 6 aa, Mycobacterium
NPDRLA

SEQ ID NO: 531844 - protein, 19 aa, Mycobacterium
NPDRPETIHPDDEASARRM

SEQ ID NO: 531845 - protein, 10 aa, Mycobacterium
NPDRRHGAER

SEQ ID NO: 531846 - protein, 6 aa, Mycobacterium
NPDRSE

SEQ ID NO: 531847 - protein, 16 aa, Mycobacterium
NPDRTGGNSHCQAPAI

SEQ ID NO: 531848 - protein, 8 aa, Mycobacterium
NPDRVPPE

SEQ ID NO: 531849 - protein, 9 aa, Mycobacterium
NPDSALDPR

SEQ ID NO: 531850 - protein, 5 aa, Mycobacterium
NPDSF

SEQ ID NO: 531851 - protein, 9 aa, Mycobacterium
NPDSIEDKN

SEQ ID NO: 531852 - protein, 6 aa, Mycobacterium
NPDSIT

SEQ ID NO: 531853 - protein, 10 aa, Mycobacterium
NPDTDLSTGR

SEQ ID NO: 531854 - protein, 30 aa, Mycobacterium
NPDTKTASTSESENPAIPSPKPKSGAPLRN

SEQ ID NO: 531855 - protein, 4 aa, Mycobacterium
NPDV

SEQ ID NO: 531856 - protein, 12 aa, Mycobacterium
NPDVRSTSELTG

SEQ ID NO: 531857 - protein, 18 aa, Mycobacterium
NPDVTGPSAEGPLPATGS

SEQ ID NO: 531858 - protein, 8 aa, Mycobacterium
NPDWSRTQ

SEQ ID NO: 531859 - protein, 7 aa, Mycobacterium
NPDYARN

SEQ ID NO: 531860 - protein, 4 aa, Mycobacterium
NPEA

SEQ ID NO: 531861 - protein, 6 aa, Mycobacterium
NPEAAN

SEQ ID NO: 531862 - protein, 8 aa, Mycobacterium
NPEAGPLH

SEQ ID NO: 531863 - protein, 7 aa, Mycobacterium
NPEAHTH

SEQ ID NO: 531864 - protein, 6 aa, Mycobacterium
NPEALA

SEQ ID NO: 531865 - protein, 11 aa, Mycobacterium
NPEANKEARKF

SEQ ID NO: 531866 - protein, 14 aa, Mycobacterium
NPEARDRVAAKRSE

SEQ ID NO: 531867 - protein, 9 aa, Mycobacterium
NPEATAATL

SEQ ID NO: 531868 - protein, 12 aa, Mycobacterium
NPEATAATLTPD

SEQ ID NO: 531869 - protein, 8 aa, Mycobacterium
NPEATADA

SEQ ID NO: 531870 - protein, 14 aa, Mycobacterium
NPEATQSPAGMPRG

SEQ ID NO: 531871 - protein, 7 aa, Mycobacterium
NPECAPA

SEQ ID NO: 531872 - protein, 9 aa, Mycobacterium
NPECPKPRT

SEQ ID NO: 531873 - protein, 5 aa, Mycobacterium
NPECT

SEQ ID NO: 531874 - protein, 7 aa, Mycobacterium
NPEDEQK

SEQ ID NO: 531875 - protein, 9 aa, Mycobacterium
NPEDPRGAV

SEQ ID NO: 531876 - protein, 6 aa, Mycobacterium
NPEEFS

SEQ ID NO: 531877 - protein, 4 aa, Mycobacterium
NPEF

SEQ ID NO: 531878 - protein, 5 aa, Mycobacterium
NPEFT

SEQ ID NO: 531879 - protein, 7 aa, Mycobacterium
NPEGFDP

SEQ ID NO: 531880 - protein, 8 aa, Mycobacterium
NPEGPLDD

SEQ ID NO: 531881 - protein, 21 aa, Mycobacterium
NPEGSLVGKQPPANPAPARPL

SEQ ID NO: 531882 - protein, 4 aa, Mycobacterium
NPEH

SEQ ID NO: 531883 - protein, 4 aa, Mycobacterium
NPEI

SEQ ID NO: 531884 - protein, 10 aa, Mycobacterium
NPEIEEGKGF

SEQ ID NO: 531885 - protein, 8 aa, Mycobacterium
NPEKGNAA

SEQ ID NO: 531886 - protein, 5 aa, Mycobacterium
NPELR

SEQ ID NO: 531887 - protein, 8 aa, Mycobacterium
NPENERRM

SEQ ID NO: 531888 - protein, 6 aa, Mycobacterium
NPENGY

SEQ ID NO: 531889 - protein, 10 aa, Mycobacterium
NPENPDAAGW

SEQ ID NO: 531890 - protein, 14 aa, Mycobacterium
NPENWTKTYPGSAH

SEQ ID NO: 531891 - protein, 5 aa, Mycobacterium
NPEPA

SEQ ID NO: 531892 - protein, 65 aa, Mycobacterium
NPEPAQSAPADNQQVATAPPPEPVRPAAEPVRPATKPAGAAGAGNGSPAAAPTKAAAPPPAEGDE

SEQ ID NO: 531893 - protein, 5 aa, Mycobacterium
NPEPE

SEQ ID NO: 531894 - protein, 10 aa, Mycobacterium
NPEPPARYPS

SEQ ID NO: 531895 - protein, 7 aa, Mycobacterium
NPEPPEC

SEQ ID NO: 531896 - protein, 35 aa, Mycobacterium
NPEPTGEPPSSAPATGDGQPAASAPQAKPAPAAQP

SEQ ID NO: 531897 - protein, 10 aa, Mycobacterium
NPEPTPLSGS

SEQ ID NO: 531898 - protein, 15 aa, Mycobacterium
NPEPTPLSSSATVTL

SEQ ID NO: 531899 - protein, 8 aa, Mycobacterium
NPEPTSGL

SEQ ID NO: 531900 - protein, 5 aa, Mycobacterium
NPEPV

SEQ ID NO: 531901 - protein, 4 aa, Mycobacterium
NPEQ

SEQ ID NO: 531902 - protein, 11 aa, Mycobacterium
NPERHQELDGS

SEQ ID NO: 531903 - protein, 6 aa, Mycobacterium
NPERIT

SEQ ID NO: 531904 - protein, 9 aa, Mycobacterium
NPERRQVGT

SEQ ID NO: 531905 - protein, 10 aa, Mycobacterium
NPERRQVGTQ

SEQ ID NO: 531906 - protein, 23 aa, Mycobacterium
NPERTPLSDSATVSLRETASEAL

SEQ ID NO: 531907 - protein, 12 aa, Mycobacterium
NPESARHDDPEH

SEQ ID NO: 531908 - protein, 6 aa, Mycobacterium
NPESIT

SEQ ID NO: 531909 - protein, 6 aa, Mycobacterium
NPESLT

SEQ ID NO: 531910 - protein, 10 aa, Mycobacterium
NPESPDDAGW

SEQ ID NO: 531911 - protein, 17 aa, Mycobacterium
NPESREPLSPYGTSNAA

SEQ ID NO: 531912 - protein, 8 aa, Mycobacterium
NPESRTYD

SEQ ID NO: 531913 - protein, 76 aa, Mycobacterium
NPESTQEATEPAVEKPAVAPAKPAAAPAKPAPAPAPAKPAAGPPAAGNGSPAAAPSAKPAAAPAKAPAPPPAEGDE

SEQ ID NO: 531914 - protein, 6 aa, Mycobacterium
NPETGE

SEQ ID NO: 531915 - protein, 9 aa, Mycobacterium
NPETGHEQM

SEQ ID NO: 531916 - protein, 5 aa, Mycobacterium
NPETT

SEQ ID NO: 531917 - protein, 10 aa, Mycobacterium
NPEVEVPADP

SEQ ID NO: 531918 - protein, 9 aa, Mycobacterium
NPEVTLQDG

SEQ ID NO: 531919 - protein, 8 aa, Mycobacterium
NPEWNAPD

SEQ ID NO: 531920 - protein, 8 aa, Mycobacterium
NPEWQAPD

SEQ ID NO: 531921 - protein, 20 aa, Mycobacterium
NPEWQERAREESARLGDGPL

SEQ ID NO: 531922 - protein, 21 aa, Mycobacterium
NPEWQERAREESARLGDGPLD

SEQ ID NO: 531923 - protein, 71 aa, Mycobacterium
NPEYGDGGAGGNGGNGSSGGDGGSGGTGGRSGAGIYNKGGTGGVGGDGGNGTNGAGGKGGSGGNGGRGADA

SEQ ID NO: 531924 - protein, 8 aa, Mycobacterium
NPEYPDQT

SEQ ID NO: 531925 - protein, 6 aa, Mycobacterium
NPEYPP

SEQ ID NO: 531926 - protein, 18 aa, Mycobacterium
NPFAGGAEQIPGGGSGIQ

SEQ ID NO: 531927 - protein, 6 aa, Mycobacterium
NPFDDE

SEQ ID NO: 531928 - protein, 9 aa, Mycobacterium
NPFNTPAAE

SEQ ID NO: 531929 - protein, 6 aa, Mycobacterium
NPFPPL

SEQ ID NO: 531930 - protein, 6 aa, Mycobacterium
NPFPRT

SEQ ID NO: 531931 - protein, 7 aa, Mycobacterium
NPFSGKG

SEQ ID NO: 531932 - protein, 4 aa, Mycobacterium
NPFT

SEQ ID NO: 531933 - protein, 6 aa, Mycobacterium
NPFTGA

SEQ ID NO: 531934 - protein, 4 aa, Mycobacterium
NPFV

SEQ ID NO: 531935 - protein, 7 aa, Mycobacterium
NPGAAAH

SEQ ID NO: 531936 - protein, 9 aa, Mycobacterium
NPGAAMPDD

SEQ ID NO: 531937 - protein, 6 aa, Mycobacterium
NPGADV

SEQ ID NO: 531938 - protein, 6 aa, Mycobacterium
NPGARA

SEQ ID NO: 531939 - protein, 19 aa, Mycobacterium
NPGARQEQADTIAEWASKR

SEQ ID NO: 531940 - protein, 4 aa, Mycobacterium
NPGD

SEQ ID NO: 531941 - protein, 21 aa, Mycobacterium
NPGDDSLTGSIRGNRGRTYTT

SEQ ID NO: 531942 - protein, 11 aa, Mycobacterium
NPGDGPHAYTA

SEQ ID NO: 531943 - protein, 6 aa, Mycobacterium
NPGDID

SEQ ID NO: 531944 - protein, 7 aa, Mycobacterium
NPGDLER

SEQ ID NO: 531945 - protein, 10 aa, Mycobacterium
NPGDPTPTVG

SEQ ID NO: 531946 - protein, 7 aa, Mycobacterium
NPGDPWA

SEQ ID NO: 531947 - protein, 10 aa, Mycobacterium
NPGDSPEQKL

SEQ ID NO: 531948 - protein, 6 aa, Mycobacterium
NPGDSV

SEQ ID NO: 531949 - protein, 9 aa, Mycobacterium
NPGDTYART

SEQ ID NO: 531950 - protein, 15 aa, Mycobacterium
NPGDVLADEGPGAAR

SEQ ID NO: 531951 - protein, 7 aa, Mycobacterium
NPGDVTA

SEQ ID NO: 531952 - protein, 11 aa, Mycobacterium
NPGEAKNTYGT

SEQ ID NO: 531953 - protein, 6 aa, Mycobacterium
NPGEIT

SEQ ID NO: 531954 - protein, 5 aa, Mycobacterium
NPGEL

SEQ ID NO: 531955 - protein, 9 aa, Mycobacterium
NPGENYART

SEQ ID NO: 531956 - protein, 8 aa, Mycobacterium
NPGESKTA

SEQ ID NO: 531957 - protein, 11 aa, Mycobacterium
NPGESREEAEL

SEQ ID NO: 531958 - protein, 11 aa, Mycobacterium
NPGEVAAGTIP

SEQ ID NO: 531959 - protein, 9 aa, Mycobacterium
NPGEVADGA

SEQ ID NO: 531960 - protein, 4 aa, Mycobacterium
NPGF

SEQ ID NO: 531961 - protein, 7 aa, Mycobacterium
NPGFDHG

SEQ ID NO: 531962 - protein, 8 aa, Mycobacterium
NPGFDPGN

SEQ ID NO: 531963 - protein, 11 aa, Mycobacterium
NPGFNDPRQPE

SEQ ID NO: 531964 - protein, 6 aa, Mycobacterium
NPGGAG

SEQ ID NO: 531965 - protein, 8 aa, Mycobacterium
NPGGGYPD

SEQ ID NO: 531966 - protein, 11 aa, Mycobacterium
NPGGPDERTHI

SEQ ID NO: 531967 - protein, 9 aa, Mycobacterium
NPGGPGGSA

SEQ ID NO: 531968 - protein, 9 aa, Mycobacterium
NPGGPGISG

SEQ ID NO: 531969 - protein, 20 aa, Mycobacterium
NPGGRALGTPPTTATAGAHA

SEQ ID NO: 531970 - protein, 15 aa, Mycobacterium
NPGGTNEEFAKGNLK

SEQ ID NO: 531971 - protein, 5 aa, Mycobacterium
NPGGY

SEQ ID NO: 531972 - protein, 17 aa, Mycobacterium
NPGGYGNNGWASVACAV

SEQ ID NO: 531973 - protein, 6 aa, Mycobacterium
NPGHDV

SEQ ID NO: 531974 - protein, 8 aa, Mycobacterium
NPGHGGSL

SEQ ID NO: 531975 - protein, 8 aa, Mycobacterium
NPGHPAPA

SEQ ID NO: 531976 - protein, 5 aa, Mycobacterium
NPGHV

SEQ ID NO: 531977 - protein, 4 aa, Mycobacterium
NPGI

SEQ ID NO: 531978 - protein, 14 aa, Mycobacterium
NPGIEADSPGGPTM

SEQ ID NO: 531979 - protein, 15 aa, Mycobacterium
NPGISAAEAAADLGV

SEQ ID NO: 531980 - protein, 7 aa, Mycobacterium
NPGITEQ

SEQ ID NO: 531981 - protein, 5 aa, Mycobacterium
NPGKA

SEQ ID NO: 531982 - protein, 13 aa, Mycobacterium
NPGKDDDGNPIDY

SEQ ID NO: 531983 - protein, 14 aa, Mycobacterium
NPGKDDDGNPIDYA

SEQ ID NO: 531984 - protein, 10 aa, Mycobacterium
NPGKDDEGNI

SEQ ID NO: 531985 - protein, 18 aa, Mycobacterium
NPGKGDDGNPIDYSSTSM

SEQ ID NO: 531986 - protein, 8 aa, Mycobacterium
NPGKGGSI

SEQ ID NO: 531987 - protein, 11 aa, Mycobacterium
NPGKRTSGTGP

SEQ ID NO: 531988 - protein, 5 aa, Mycobacterium
NPGLA

SEQ ID NO: 531989 - protein, 17 aa, Mycobacterium
NPGLGQAEANAAAWEQG

SEQ ID NO: 531990 - protein, 6 aa, Mycobacterium
NPGLQQ

SEQ ID NO: 531991 - protein, 18 aa, Mycobacterium
NPGNRFDTPLSSTGAFAG

SEQ ID NO: 531992 - protein, 12 aa, Mycobacterium
NPGNRFNTPLST

SEQ ID NO: 531993 - protein, 17 aa, Mycobacterium
NPGNYNTGLANSGDVNT

SEQ ID NO: 531994 - protein, 18 aa, Mycobacterium
NPGNYNTGLANSGDVNTG

SEQ ID NO: 531995 - protein, 5 aa, Mycobacterium
NPGPE

SEQ ID NO: 531996 - protein, 8 aa, Mycobacterium
NPGPEETP

SEQ ID NO: 531997 - protein, 5 aa, Mycobacterium
NPGPF

SEQ ID NO: 531998 - protein, 7 aa, Mycobacterium
NPGPGDT

SEQ ID NO: 531999 - protein, 7 aa, Mycobacterium
NPGPGWG

SEQ ID NO: 532000 - protein, 5 aa, Mycobacterium
NPGPH

SEQ ID NO: 532001 - protein, 9 aa, Mycobacterium
NPGPPTGLG

SEQ ID NO: 532002 - protein, 9 aa, Mycobacterium
NPGPQYATT

SEQ ID NO: 532003 - protein, 11 aa, Mycobacterium
NPGPSAEELRQ

SEQ ID NO: 532004 - protein, 7 aa, Mycobacterium
NPGPTDT

SEQ ID NO: 532005 - protein, 9 aa, Mycobacterium
NPGPTYAKT

SEQ ID NO: 532006 - protein, 7 aa, Mycobacterium
NPGPVAA

SEQ ID NO: 532007 - protein, 7 aa, Mycobacterium
NPGPVQT

SEQ ID NO: 532008 - protein, 8 aa, Mycobacterium
NPGQGGTI

SEQ ID NO: 532009 - protein, 9 aa, Mycobacterium
NPGQSDERV

SEQ ID NO: 532010 - protein, 15 aa, Mycobacterium
NPGQSRDEREQDDLQ

SEQ ID NO: 532011 - protein, 12 aa, Mycobacterium
NPGQSVDPKADG

SEQ ID NO: 532012 - protein, 18 aa, Mycobacterium
NPGQTRTAMSDGGQPPEA

SEQ ID NO: 532013 - protein, 6 aa, Mycobacterium
NPGREV

SEQ ID NO: 532014 - protein, 6 aa, Mycobacterium
NPGRRG

SEQ ID NO: 532015 - protein, 9 aa, Mycobacterium
NPGRSSYQA

SEQ ID NO: 532016 - protein, 5 aa, Mycobacterium
NPGRY

SEQ ID NO: 532017 - protein, 4 aa, Mycobacterium
NPGS

SEQ ID NO: 532018 - protein, 6 aa, Mycobacterium
NPGSDG

SEQ ID NO: 532019 - protein, 9 aa, Mycobacterium
NPGSDPVAA

SEQ ID NO: 532020 - protein, 9 aa, Mycobacterium
NPGTALPAE

SEQ ID NO: 532021 - protein, 8 aa, Mycobacterium
NPGTEATA

SEQ ID NO: 532022 - protein, 11 aa, Mycobacterium
NPGTGEAARKL

SEQ ID NO: 532023 - protein, 7 aa, Mycobacterium
NPGTGFE

SEQ ID NO: 532024 - protein, 5 aa, Mycobacterium
NPGTS

SEQ ID NO: 532025 - protein, 6 aa, Mycobacterium
NPGTSL

SEQ ID NO: 532026 - protein, 9 aa, Mycobacterium
NPGTTSQER

SEQ ID NO: 532027 - protein, 11 aa, Mycobacterium
NPGTVDAQGVA

SEQ ID NO: 532028 - protein, 4 aa, Mycobacterium
NPGV

SEQ ID NO: 532029 - protein, 5 aa, Mycobacterium
NPGVA

SEQ ID NO: 532030 - protein, 6 aa, Mycobacterium
NPGVAK

SEQ ID NO: 532031 - protein, 7 aa, Mycobacterium
NPGVDKS

SEQ ID NO: 532032 - protein, 5 aa, Mycobacterium
NPGVG

SEQ ID NO: 532033 - protein, 6 aa, Mycobacterium
NPGVPG

SEQ ID NO: 532034 - protein, 6 aa, Mycobacterium
NPGVRD

SEQ ID NO: 532035 - protein, 12 aa, Mycobacterium
NPGVTSEFPEPT

SEQ ID NO: 532036 - protein, 4 aa, Mycobacterium
NPGY

SEQ ID NO: 532037 - protein, 6 aa, Mycobacterium
NPGYAA

SEQ ID NO: 532038 - protein, 7 aa, Mycobacterium
NPHADTE

SEQ ID NO: 532039 - protein, 5 aa, Mycobacterium
NPHDP

SEQ ID NO: 532040 - protein, 5 aa, Mycobacterium
NPHGD

SEQ ID NO: 532041 - protein, 6 aa, Mycobacterium
NPHGDR

SEQ ID NO: 532042 - protein, 5 aa, Mycobacterium
NPHGV

SEQ ID NO: 532043 - protein, 13 aa, Mycobacterium
NPHHPEPEAHAAQ

SEQ ID NO: 532044 - protein, 8 aa, Mycobacterium
NPHPPTEA

SEQ ID NO: 532045 - protein, 4 aa, Mycobacterium
NPHQ

SEQ ID NO: 532046 - protein, 13 aa, Mycobacterium
NPHRARKPRSVET

SEQ ID NO: 532047 - protein, 12 aa, Mycobacterium
NPHRPKPTDLDG

SEQ ID NO: 532048 - protein, 13 aa, Mycobacterium
NPHRPRPSDLDGL

SEQ ID NO: 532049 - protein, 4 aa, Mycobacterium
NPHT

SEQ ID NO: 532050 - protein, 5 aa, Mycobacterium
NPHTG

SEQ ID NO: 532051 - protein, 7 aa, Mycobacterium
NPIAEKS

SEQ ID NO: 532052 - protein, 6 aa, Mycobacterium
NPIENE

SEQ ID NO: 532053 - protein, 5 aa, Mycobacterium
NPIEQ

SEQ ID NO: 532054 - protein, 14 aa, Mycobacterium
NPIPATQAPTTHRN

SEQ ID NO: 532055 - protein, 10 aa, Mycobacterium
NPIPPATLPD

SEQ ID NO: 532056 - protein, 4 aa, Mycobacterium
NPIS

SEQ ID NO: 532057 - protein, 10 aa, Mycobacterium
NPITGDNEPF

SEQ ID NO: 532058 - protein, 7 aa, Mycobacterium
NPITPEE

SEQ ID NO: 532059 - protein, 6 aa, Mycobacterium
NPKADV

SEQ ID NO: 532060 - protein, 5 aa, Mycobacterium
NPKAQ

SEQ ID NO: 532061 - protein, 8 aa, Mycobacterium
NPKATAEA

SEQ ID NO: 532062 - protein, 8 aa, Mycobacterium
NPKAVASE

SEQ ID NO: 532063 - protein, 5 aa, Mycobacterium
NPKCS

SEQ ID NO: 532064 - protein, 5 aa, Mycobacterium
NPKDG

SEQ ID NO: 532065 - protein, 10 aa, Mycobacterium
NPKEANDSRC

SEQ ID NO: 532066 - protein, 5 aa, Mycobacterium
NPKEI

SEQ ID NO: 532067 - protein, 8 aa, Mycobacterium
NPKGTVQA

SEQ ID NO: 532068 - protein, 14 aa, Mycobacterium
NPKHERTKAFLSKV

SEQ ID NO: 532069 - protein, 14 aa, Mycobacterium
NPKHPRLQDFLSKV

SEQ ID NO: 532070 - protein, 12 aa, Mycobacterium
NPKIEGNETVDG

SEQ ID NO: 532071 - protein, 5 aa, Mycobacterium
NPKNL

SEQ ID NO: 532072 - protein, 4 aa, Mycobacterium
NPKP

SEQ ID NO: 532073 - protein, 13 aa, Mycobacterium
NPKPAAQAAAPAV

SEQ ID NO: 532074 - protein, 5 aa, Mycobacterium
NPKPC

SEQ ID NO: 532075 - protein, 8 aa, Mycobacterium
NPKPGDEF

SEQ ID NO: 532076 - protein, 10 aa, Mycobacterium
NPKQPDSNRI

SEQ ID NO: 532077 - protein, 14 aa, Mycobacterium
NPKSAAAAAAPAVD

SEQ ID NO: 532078 - protein, 16 aa, Mycobacterium
NPKSERAKDFLGKILG

SEQ ID NO: 532079 - protein, 16 aa, Mycobacterium
NPKSERAKDFLGKILH

SEQ ID NO: 532080 - protein, 15 aa, Mycobacterium
NPKSGRWNPDASARA

SEQ ID NO: 532081 - protein, 6 aa, Mycobacterium
NPKTAR

SEQ ID NO: 532082 - protein, 7 aa, Mycobacterium
NPKVASD

SEQ ID NO: 532083 - protein, 5 aa, Mycobacterium
NPKVG

SEQ ID NO: 532084 - protein, 10 aa, Mycobacterium
NPKVTFQTRS

SEQ ID NO: 532085 - protein, 4 aa, Mycobacterium
NPLA

SEQ ID NO: 532086 - protein, 11 aa, Mycobacterium
NPLADADSKIR

SEQ ID NO: 532087 - protein, 6 aa, Mycobacterium
NPLDDP

SEQ ID NO: 532088 - protein, 6 aa, Mycobacterium
NPLEDP

SEQ ID NO: 532089 - protein, 6 aa, Mycobacterium
NPLEGE

SEQ ID NO: 532090 - protein, 8 aa, Mycobacterium
NPLEPTRS

SEQ ID NO: 532091 - protein, 8 aa, Mycobacterium
NPLETDEL

SEQ ID NO: 532092 - protein, 6 aa, Mycobacterium
NPLGGT

SEQ ID NO: 532093 - protein, 6 aa, Mycobacterium
NPLGTA

SEQ ID NO: 532094 - protein, 8 aa, Mycobacterium
NPLGTDAP

SEQ ID NO: 532095 - protein, 21 aa, Mycobacterium
NPLGTDAPEHELHDRRVLTGG

SEQ ID NO: 532096 - protein, 10 aa, Mycobacterium
NPLGTEAPDH

SEQ ID NO: 532097 - protein, 6 aa, Mycobacterium
NPLPGG

SEQ ID NO: 532098 - protein, 7 aa, Mycobacterium
NPLPGNG

SEQ ID NO: 532099 - protein, 5 aa, Mycobacterium
NPLPR

SEQ ID NO: 532100 - protein, 6 aa, Mycobacterium
NPLQPD

SEQ ID NO: 532101 - protein, 4 aa, Mycobacterium
NPLR

SEQ ID NO: 532102 - protein, 13 aa, Mycobacterium
NPLRGQNNVQGSC

SEQ ID NO: 532103 - protein, 6 aa, Mycobacterium
NPLSDS

SEQ ID NO: 532104 - protein, 8 aa, Mycobacterium
NPLSGHGA

SEQ ID NO: 532105 - protein, 6 aa, Mycobacterium
NPLSSD

SEQ ID NO: 532106 - protein, 8 aa, Mycobacterium
NPLTGEQT

SEQ ID NO: 532107 - protein, 33 aa, Mycobacterium
NPLTGPSAVTNPAGIAGQAAAVGQAAGSVPQTG

SEQ ID NO: 532108 - protein, 6 aa, Mycobacterium
NPLTPE

SEQ ID NO: 532109 - protein, 6 aa, Mycobacterium
NPLTSL

SEQ ID NO: 532110 - protein, 7 aa, Mycobacterium
NPMGTEQ

SEQ ID NO: 532111 - protein, 4 aa, Mycobacterium
NPNA

SEQ ID NO: 532112 - protein, 8 aa, Mycobacterium
NPNAPPKL

SEQ ID NO: 532113 - protein, 10 aa, Mycobacterium
NPNAPTGKET

SEQ ID NO: 532114 - protein, 4 aa, Mycobacterium
NPNE

SEQ ID NO: 532115 - protein, 5 aa, Mycobacterium
NPNGI

SEQ ID NO: 532116 - protein, 12 aa, Mycobacterium
NPNGSTNVGDTV

SEQ ID NO: 532117 - protein, 9 aa, Mycobacterium
NPNLANNTE

SEQ ID NO: 532118 - protein, 9 aa, Mycobacterium
NPNNPTGDS

SEQ ID NO: 532119 - protein, 6 aa, Mycobacterium
NPNPAV

SEQ ID NO: 532120 - protein, 8 aa, Mycobacterium
NPNPELPV

SEQ ID NO: 532121 - protein, 8 aa, Mycobacterium
NPNPGLPV

SEQ ID NO: 532122 - protein, 12 aa, Mycobacterium
NPNPYTGSPQGI

SEQ ID NO: 532123 - protein, 8 aa, Mycobacterium
NPNRPNGG

SEQ ID NO: 532124 - protein, 8 aa, Mycobacterium
NPNRRARQ

SEQ ID NO: 532125 - protein, 6 aa, Mycobacterium
NPNSPW

SEQ ID NO: 532126 - protein, 5 aa, Mycobacterium
NPNTG

SEQ ID NO: 532127 - protein, 14 aa, Mycobacterium
NPNWSRTFPKGREV

SEQ ID NO: 532128 - protein, 4 aa, Mycobacterium
NPNY

SEQ ID NO: 532129 - protein, 9 aa, Mycobacterium
NPPADDSSA

SEQ ID NO: 532130 - protein, 6 aa, Mycobacterium
NPPADL

SEQ ID NO: 532131 - protein, 7 aa, Mycobacterium
NPPADRG

SEQ ID NO: 532132 - protein, 25 aa, Mycobacterium
NPPAELAEGARRAAASCPALAIKIE

SEQ ID NO: 532133 - protein, 25 aa, Mycobacterium
NPPAGQPQGQTTSAMNAAGVMSAVT

SEQ ID NO: 532134 - protein, 8 aa, Mycobacterium
NPPAGSQQ

SEQ ID NO: 532135 - protein, 18 aa, Mycobacterium
NPPALLTPGTRVQFREVT

SEQ ID NO: 532136 - protein, 7 aa, Mycobacterium
NPPAPFE

SEQ ID NO: 532137 - protein, 16 aa, Mycobacterium
NPPAVTGDAAADRDAF

SEQ ID NO: 532138 - protein, 6 aa, Mycobacterium
NPPAWY

SEQ ID NO: 532139 - protein, 10 aa, Mycobacterium
NPPDPAQDSL

SEQ ID NO: 532140 - protein, 6 aa, Mycobacterium
NPPDRP

SEQ ID NO: 532141 - protein, 7 aa, Mycobacterium
NPPDRPW

SEQ ID NO: 532142 - protein, 9 aa, Mycobacterium
NPPDVSGLG

SEQ ID NO: 532143 - protein, 11 aa, Mycobacterium
NPPEASAPGSL

SEQ ID NO: 532144 - protein, 12 aa, Mycobacterium
NPPEPLELPGPM

SEQ ID NO: 532145 - protein, 7 aa, Mycobacterium
NPPERLN

SEQ ID NO: 532146 - protein, 7 aa, Mycobacterium
NPPERLT

SEQ ID NO: 532147 - protein, 11 aa, Mycobacterium
NPPEVGAPGSL

SEQ ID NO: 532148 - protein, 4 aa, Mycobacterium
NPPF

SEQ ID NO: 532149 - protein, 5 aa, Mycobacterium
NPPFD

SEQ ID NO: 532150 - protein, 8 aa, Mycobacterium
NPPFGRKS

SEQ ID NO: 532151 - protein, 14 aa, Mycobacterium
NPPGAVSAVTGDGS

SEQ ID NO: 532152 - protein, 10 aa, Mycobacterium
NPPGNPKASF

SEQ ID NO: 532153 - protein, 17 aa, Mycobacterium
NPPGPAYGDTISGTNLA

SEQ ID NO: 532154 - protein, 18 aa, Mycobacterium
NPPGPAYGDTISGTNLAG

SEQ ID NO: 532155 - protein, 9 aa, Mycobacterium
NPPGPRSEN

SEQ ID NO: 532156 - protein, 7 aa, Mycobacterium
NPPGSGL

SEQ ID NO: 532157 - protein, 17 aa, Mycobacterium
NPPGSQARRARGPRALG

SEQ ID NO: 532158 - protein, 15 aa, Mycobacterium
NPPGSRAGGPRALQS

SEQ ID NO: 532159 - protein, 10 aa, Mycobacterium
NPPGSTASGW

SEQ ID NO: 532160 - protein, 10 aa, Mycobacterium
NPPGSTATGL

SEQ ID NO: 532161 - protein, 13 aa, Mycobacterium
NPPGTAPSQATGL

SEQ ID NO: 532162 - protein, 13 aa, Mycobacterium
NPPGTSGERAEDD

SEQ ID NO: 532163 - protein, 6 aa, Mycobacterium
NPPGTV

SEQ ID NO: 532164 - protein, 4 aa, Mycobacterium
NPPI

SEQ ID NO: 532165 - protein, 9 aa, Mycobacterium
NPPIDKRDR

SEQ ID NO: 532166 - protein, 4 aa, Mycobacterium
NPPL

SEQ ID NO: 532167 - protein, 8 aa, Mycobacterium
NPPLREAS

SEQ ID NO: 532168 - protein, 12 aa, Mycobacterium
NPPLRRPSGPKA

SEQ ID NO: 532169 - protein, 15 aa, Mycobacterium
NPPNEQQPRPAVPEQ

SEQ ID NO: 532170 - protein, 7 aa, Mycobacterium
NPPPPLS

SEQ ID NO: 532171 - protein, 8 aa, Mycobacterium
NPPPRPDR

SEQ ID NO: 532172 - protein, 7 aa, Mycobacterium
NPPPYDE

SEQ ID NO: 532173 - protein, 6 aa, Mycobacterium
NPPQRL

SEQ ID NO: 532174 - protein, 6 aa, Mycobacterium
NPPRAL

SEQ ID NO: 532175 - protein, 10 aa, Mycobacterium
NPPRSPSRNH

SEQ ID NO: 532176 - protein, 15 aa, Mycobacterium
NPPSMQRGDINDPKL

SEQ ID NO: 532177 - protein, 7 aa, Mycobacterium
NPPSPSQ

SEQ ID NO: 532178 - protein, 6 aa, Mycobacterium
NPPSRD

SEQ ID NO: 532179 - protein, 7 aa, Mycobacterium
NPPSSAR

SEQ ID NO: 532180 - protein, 6 aa, Mycobacterium
NPPSTV

SEQ ID NO: 532181 - protein, 4 aa, Mycobacterium
NPPT

SEQ ID NO: 532182 - protein, 18 aa, Mycobacterium
NPPTDTTPATNPPTPTPH

SEQ ID NO: 532183 - protein, 18 aa, Mycobacterium
NPPTDTTPATNPTTPTPH

SEQ ID NO: 532184 - protein, 15 aa, Mycobacterium
NPPTRAAAKISPDGT

SEQ ID NO: 532185 - protein, 14 aa, Mycobacterium
NPPTSDEISQLKPG

SEQ ID NO: 532186 - protein, 14 aa, Mycobacterium
NPPVGVGRQFSCEP

SEQ ID NO: 532187 - protein, 12 aa, Mycobacterium
NPPVQPVAGPPG

SEQ ID NO: 532188 - protein, 7 aa, Mycobacterium
NPPYDPW

SEQ ID NO: 532189 - protein, 16 aa, Mycobacterium
NPPYLGKKQRTAAQTE

SEQ ID NO: 532190 - protein, 6 aa, Mycobacterium
NPPYVP

SEQ ID NO: 532191 - protein, 5 aa, Mycobacterium
NPPYY

SEQ ID NO: 532192 - protein, 5 aa, Mycobacterium
NPQAA

SEQ ID NO: 532193 - protein, 5 aa, Mycobacterium
NPQAL

SEQ ID NO: 532194 - protein, 15 aa, Mycobacterium
NPQAPTVRSTVVRGA

SEQ ID NO: 532195 - protein, 7 aa, Mycobacterium
NPQAQRA

SEQ ID NO: 532196 - protein, 7 aa, Mycobacterium
NPQARTY

SEQ ID NO: 532197 - protein, 4 aa, Mycobacterium
NPQE

SEQ ID NO: 532198 - protein, 10 aa, Mycobacterium
NPQETDLSDR

SEQ ID NO: 532199 - protein, 12 aa, Mycobacterium
NPQFEAPRHVNR

SEQ ID NO: 532200 - protein, 5 aa, Mycobacterium
NPQGR

SEQ ID NO: 532201 - protein, 6 aa, Mycobacterium
NPQGSV

SEQ ID NO: 532202 - protein, 6 aa, Mycobacterium
NPQGTV

SEQ ID NO: 532203 - protein, 4 aa, Mycobacterium
NPQH

SEQ ID NO: 532204 - protein, 6 aa, Mycobacterium
NPQHEY

SEQ ID NO: 532205 - protein, 10 aa, Mycobacterium
NPQHGLSGTT

SEQ ID NO: 532206 - protein, 9 aa, Mycobacterium
NPQHPPEHP

SEQ ID NO: 532207 - protein, 7 aa, Mycobacterium
NPQHPYT

SEQ ID NO: 532208 - protein, 8 aa, Mycobacterium
NPQIDEAA

SEQ ID NO: 532209 - protein, 5 aa, Mycobacterium
NPQLT

SEQ ID NO: 532210 - protein, 6 aa, Mycobacterium
NPQPEA

SEQ ID NO: 532211 - protein, 9 aa, Mycobacterium
NPQQPDTSC

SEQ ID NO: 532212 - protein, 6 aa, Mycobacterium
NPQQRQ

SEQ ID NO: 532213 - protein, 4 aa, Mycobacterium
NPQR

SEQ ID NO: 532214 - protein, 7 aa, Mycobacterium
NPQRDLP

SEQ ID NO: 532215 - protein, 11 aa, Mycobacterium
NPQRSAGRDGL

SEQ ID NO: 532216 - protein, 6 aa, Mycobacterium
NPQRTQ

SEQ ID NO: 532217 - protein, 8 aa, Mycobacterium
NPQSAEGI

SEQ ID NO: 532218 - protein, 8 aa, Mycobacterium
NPQSPINT

SEQ ID NO: 532219 - protein, 10 aa, Mycobacterium
NPQSSTPEEV

SEQ ID NO: 532220 - protein, 16 aa, Mycobacterium
NPQTDRAKDFLGKILH

SEQ ID NO: 532221 - protein, 9 aa, Mycobacterium
NPQTGAGTI

SEQ ID NO: 532222 - protein, 11 aa, Mycobacterium
NPQVESYRGRN

SEQ ID NO: 532223 - protein, 6 aa, Mycobacterium
NPQVQA

SEQ ID NO: 532224 - protein, 8 aa, Mycobacterium
NPQWQSPD

SEQ ID NO: 532225 - protein, 5 aa, Mycobacterium
NPQWV

SEQ ID NO: 532226 - protein, 4 aa, Mycobacterium
NPRA

SEQ ID NO: 532227 - protein, 5 aa, Mycobacterium
NPRAD

SEQ ID NO: 532228 - protein, 5 aa, Mycobacterium
NPRAE

SEQ ID NO: 532229 - protein, 5 aa, Mycobacterium
NPRAL

SEQ ID NO: 532230 - protein, 5 aa, Mycobacterium
NPRAR

SEQ ID NO: 532231 - protein, 6 aa, Mycobacterium
NPRATS

SEQ ID NO: 532232 - protein, 4 aa, Mycobacterium
NPRD

SEQ ID NO: 532233 - protein, 7 aa, Mycobacterium
NPRDDYT

SEQ ID NO: 532234 - protein, 4 aa, Mycobacterium
NPRE

SEQ ID NO: 532235 - protein, 5 aa, Mycobacterium
NPREA

SEQ ID NO: 532236 - protein, 15 aa, Mycobacterium
NPRFPSPLSKAGNVR

SEQ ID NO: 532237 - protein, 6 aa, Mycobacterium
NPRFSP

SEQ ID NO: 532238 - protein, 5 aa, Mycobacterium
NPRGA

SEQ ID NO: 532239 - protein, 18 aa, Mycobacterium
NPRGGPLPPVDAGGYAGA

SEQ ID NO: 532240 - protein, 20 aa, Mycobacterium
NPRGGVPDMPTPATPPDPTW

SEQ ID NO: 532241 - protein, 5 aa, Mycobacterium
NPRGL

SEQ ID NO: 532242 - protein, 13 aa, Mycobacterium
NPRHGASGPGRDI

SEQ ID NO: 532243 - protein, 13 aa, Mycobacterium
NPRIAGPAPWKPM

SEQ ID NO: 532244 - protein, 10 aa, Mycobacterium
NPRIEESAAT

SEQ ID NO: 532245 - protein, 25 aa, Mycobacterium
NPRKPRGKHDAETENHRGELLAQLG

SEQ ID NO: 532246 - protein, 8 aa, Mycobacterium
NPRLGDRI

SEQ ID NO: 532247 - protein, 6 aa, Mycobacterium
NPRLGP

SEQ ID NO: 532248 - protein, 5 aa, Mycobacterium
NPRLQ

SEQ ID NO: 532249 - protein, 15 aa, Mycobacterium
NPRMRTDATPGQGDD

SEQ ID NO: 532250 - protein, 10 aa, Mycobacterium
NPRNAGRLDQ

SEQ ID NO: 532251 - protein, 6 aa, Mycobacterium
NPRPED

SEQ ID NO: 532252 - protein, 6 aa, Mycobacterium
NPRPSE

SEQ ID NO: 532253 - protein, 11 aa, Mycobacterium
NPRPTNPAGKM

SEQ ID NO: 532254 - protein, 4 aa, Mycobacterium
NPRQ

SEQ ID NO: 532255 - protein, 12 aa, Mycobacterium
NPRQPRGITTRR

SEQ ID NO: 532256 - protein, 9 aa, Mycobacterium
NPRRAPKLA

SEQ ID NO: 532257 - protein, 9 aa, Mycobacterium
NPRRASGRE

SEQ ID NO: 532258 - protein, 8 aa, Mycobacterium
NPRRGADS

SEQ ID NO: 532259 - protein, 19 aa, Mycobacterium
NPRRGHSALGGRPPVSRLA

SEQ ID NO: 532260 - protein, 15 aa, Mycobacterium
NPRRQLSSLSDLDRL

SEQ ID NO: 532261 - protein, 4 aa, Mycobacterium
NPRS

SEQ ID NO: 532262 - protein, 9 aa, Mycobacterium
NPRSDVSYT

SEQ ID NO: 532263 - protein, 4 aa, Mycobacterium
NPRT

SEQ ID NO: 532264 - protein, 9 aa, Mycobacterium
NPRTAGPVP

SEQ ID NO: 532265 - protein, 7 aa, Mycobacterium
NPRTGDR

SEQ ID NO: 532266 - protein, 19 aa, Mycobacterium
NPRTGKERELSAARAARSK

SEQ ID NO: 532267 - protein, 12 aa, Mycobacterium
NPRTGKTAATVS

SEQ ID NO: 532268 - protein, 8 aa, Mycobacterium
NPRTGKTV

SEQ ID NO: 532269 - protein, 6 aa, Mycobacterium
NPRTGY

SEQ ID NO: 532270 - protein, 4 aa, Mycobacterium
NPRV

SEQ ID NO: 532271 - protein, 8 aa, Mycobacterium
NPRVDSPW

SEQ ID NO: 532272 - protein, 5 aa, Mycobacterium
NPRVG

SEQ ID NO: 532273 - protein, 8 aa, Mycobacterium
NPSAAARR

SEQ ID NO: 532274 - protein, 12 aa, Mycobacterium
NPSAAGGSEPTF

SEQ ID NO: 532275 - protein, 9 aa, Mycobacterium
NPSAPPPSL

SEQ ID NO: 532276 - protein, 7 aa, Mycobacterium
NPSAPVS

SEQ ID NO: 532277 - protein, 9 aa, Mycobacterium
NPSASQGSM

SEQ ID NO: 532278 - protein, 6 aa, Mycobacterium
NPSDQQ

SEQ ID NO: 532279 - protein, 9 aa, Mycobacterium
NPSDWPEGK

SEQ ID NO: 532280 - protein, 7 aa, Mycobacterium
NPSEAKT

SEQ ID NO: 532281 - protein, 8 aa, Mycobacterium
NPSEAKTV

SEQ ID NO: 532282 - protein, 5 aa, Mycobacterium
NPSGA

SEQ ID NO: 532283 - protein, 15 aa, Mycobacterium
NPSGGPLAGAPATAT

SEQ ID NO: 532284 - protein, 20 aa, Mycobacterium
NPSGLPWQEPDEASESLGRT

SEQ ID NO: 532285 - protein, 8 aa, Mycobacterium
NPSGPAAV

SEQ ID NO: 532286 - protein, 12 aa, Mycobacterium
NPSGQRPAETAL

SEQ ID NO: 532287 - protein, 7 aa, Mycobacterium
NPSGRLA

SEQ ID NO: 532288 - protein, 12 aa, Mycobacterium
NPSGTSAGRSAV

SEQ ID NO: 532289 - protein, 5 aa, Mycobacterium
NPSGV

SEQ ID NO: 532290 - protein, 5 aa, Mycobacterium
NPSIT

SEQ ID NO: 532291 - protein, 8 aa, Mycobacterium
NPSNSLQK

SEQ ID NO: 532292 - protein, 14 aa, Mycobacterium
NPSNWTKTYPGSAH

SEQ ID NO: 532293 - protein, 8 aa, Mycobacterium
NPSPAAAL

SEQ ID NO: 532294 - protein, 11 aa, Mycobacterium
NPSPASPARRA

SEQ ID NO: 532295 - protein, 6 aa, Mycobacterium
NPSPEE

SEQ ID NO: 532296 - protein, 5 aa, Mycobacterium
NPSPH

SEQ ID NO: 532297 - protein, 24 aa, Mycobacterium
NPSPKRQFSSDQARARVDRGPGRW

SEQ ID NO: 532298 - protein, 16 aa, Mycobacterium
NPSPPDVTVSVHQGRQ

SEQ ID NO: 532299 - protein, 17 aa, Mycobacterium
NPSPPEVTVSVRRGEEP

SEQ ID NO: 532300 - protein, 11 aa, Mycobacterium
NPSPPPPTAYG

SEQ ID NO: 532301 - protein, 13 aa, Mycobacterium
NPSPSGALDRRHP

SEQ ID NO: 532302 - protein, 4 aa, Mycobacterium
NPSQ

SEQ ID NO: 532303 - protein, 17 aa, Mycobacterium
NPSQLEKVRENPDLTAG

SEQ ID NO: 532304 - protein, 9 aa, Mycobacterium
NPSRDISSL

SEQ ID NO: 532305 - protein, 12 aa, Mycobacterium
NPSRGDERTKAD

SEQ ID NO: 532306 - protein, 11 aa, Mycobacterium
NPSRGDERTRA

SEQ ID NO: 532307 - protein, 10 aa, Mycobacterium
NPSRLGDEEL

SEQ ID NO: 532308 - protein, 10 aa, Mycobacterium
NPSRLSDDEL

SEQ ID NO: 532309 - protein, 10 aa, Mycobacterium
NPSRLSEDDL

SEQ ID NO: 532310 - protein, 7 aa, Mycobacterium
NPSRRNE

SEQ ID NO: 532311 - protein, 15 aa, Mycobacterium
NPSSYDGDLTDQGAA

SEQ ID NO: 532312 - protein, 9 aa, Mycobacterium
NPSTGEVQS

SEQ ID NO: 532313 - protein, 7 aa, Mycobacterium
NPSTVGP

SEQ ID NO: 532314 - protein, 6 aa, Mycobacterium
NPSVAV

SEQ ID NO: 532315 - protein, 31 aa, Mycobacterium
NPSVEETSTGAPGAVKVGTPKGSVTQLSDGS

SEQ ID NO: 532316 - protein, 12 aa, Mycobacterium
NPSVPDDDVTPE

SEQ ID NO: 532317 - protein, 25 aa, Mycobacterium
NPSVTVQDGDTVIEGTAREVEGDER

SEQ ID NO: 532318 - protein, 4 aa, Mycobacterium
NPTA

SEQ ID NO: 532319 - protein, 7 aa, Mycobacterium
NPTAGEA

SEQ ID NO: 532320 - protein, 12 aa, Mycobacterium
NPTAGLKSQPVD

SEQ ID NO: 532321 - protein, 8 aa, Mycobacterium
NPTAPKEH

SEQ ID NO: 532322 - protein, 8 aa, Mycobacterium
NPTATAEA

SEQ ID NO: 532323 - protein, 4 aa, Mycobacterium
NPTD

SEQ ID NO: 532324 - protein, 7 aa, Mycobacterium
NPTDGHP

SEQ ID NO: 532325 - protein, 7 aa, Mycobacterium
NPTDKPV

SEQ ID NO: 532326 - protein, 8 aa, Mycobacterium
NPTDPAAF

SEQ ID NO: 532327 - protein, 10 aa, Mycobacterium
NPTDRDQDAE

SEQ ID NO: 532328 - protein, 13 aa, Mycobacterium
NPTFPAPELNNPT

SEQ ID NO: 532329 - protein, 14 aa, Mycobacterium
NPTGASLTPQRRDE

SEQ ID NO: 532330 - protein, 38 aa, Mycobacterium
NPTGATIGDGVATGTITDDDTVVTPGTGGVNSGNPGDA

SEQ ID NO: 532331 - protein, 9 aa, Mycobacterium
NPTGATYST

SEQ ID NO: 532332 - protein, 8 aa, Mycobacterium
NPTGGAVD

SEQ ID NO: 532333 - protein, 6 aa, Mycobacterium
NPTGGN

SEQ ID NO: 532334 - protein, 11 aa, Mycobacterium
NPTGNRPAEAA

SEQ ID NO: 532335 - protein, 6 aa, Mycobacterium
NPTGPG

SEQ ID NO: 532336 - protein, 7 aa, Mycobacterium
NPTGPRP

SEQ ID NO: 532337 - protein, 11 aa, Mycobacterium
NPTGQRPAEAA

SEQ ID NO: 532338 - protein, 12 aa, Mycobacterium
NPTGQRPAETAL

SEQ ID NO: 532339 - protein, 12 aa, Mycobacterium
NPTGRMATPQEV

SEQ ID NO: 532340 - protein, 8 aa, Mycobacterium
NPTGSTYS

SEQ ID NO: 532341 - protein, 12 aa, Mycobacterium
NPTGTADHGPDL

SEQ ID NO: 532342 - protein, 6 aa, Mycobacterium
NPTGTF

SEQ ID NO: 532343 - protein, 12 aa, Mycobacterium
NPTGVVPKGPDL

SEQ ID NO: 532344 - protein, 16 aa, Mycobacterium
NPTHERTQRFLHAVLD

SEQ ID NO: 532345 - protein, 7 aa, Mycobacterium
NPTIEGR

SEQ ID NO: 532346 - protein, 11 aa, Mycobacterium
NPTIPQPTRYT

SEQ ID NO: 532347 - protein, 6 aa, Mycobacterium
NPTKKG

SEQ ID NO: 532348 - protein, 5 aa, Mycobacterium
NPTNG

SEQ ID NO: 532349 - protein, 7 aa, Mycobacterium
NPTNPTA

SEQ ID NO: 532350 - protein, 8 aa, Mycobacterium
NPTNPTGV

SEQ ID NO: 532351 - protein, 12 aa, Mycobacterium
NPTNSGAAGSPY

SEQ ID NO: 532352 - protein, 11 aa, Mycobacterium
NPTPGAPDGPW

SEQ ID NO: 532353 - protein, 7 aa, Mycobacterium
NPTPGLT

SEQ ID NO: 532354 - protein, 17 aa, Mycobacterium
NPTPGSEWDASPKAAER

SEQ ID NO: 532355 - protein, 16 aa, Mycobacterium
NPTPGSEWDASPKAVE

SEQ ID NO: 532356 - protein, 18 aa, Mycobacterium
NPTPGSEWDASPKPAERE

SEQ ID NO: 532357 - protein, 16 aa, Mycobacterium
NPTPGSEWDASPKPVE

SEQ ID NO: 532358 - protein, 17 aa, Mycobacterium
NPTPGSQWDASPKPVER

SEQ ID NO: 532359 - protein, 5 aa, Mycobacterium
NPTPQ

SEQ ID NO: 532360 - protein, 24 aa, Mycobacterium
NPTPRGRATSQRDNRETQRAATVV

SEQ ID NO: 532361 - protein, 6 aa, Mycobacterium
NPTPVT

SEQ ID NO: 532362 - protein, 8 aa, Mycobacterium
NPTPVTGQ

SEQ ID NO: 532363 - protein, 6 aa, Mycobacterium
NPTQRE

SEQ ID NO: 532364 - protein, 12 aa, Mycobacterium
NPTQVVPKGPDL

SEQ ID NO: 532365 - protein, 4 aa, Mycobacterium
NPTR

SEQ ID NO: 532366 - protein, 8 aa, Mycobacterium
NPTRGAAE

SEQ ID NO: 532367 - protein, 8 aa, Mycobacterium
NPTRGPAE

SEQ ID NO: 532368 - protein, 6 aa, Mycobacterium
NPTRGS

SEQ ID NO: 532369 - protein, 8 aa, Mycobacterium
NPTRGTAD

SEQ ID NO: 532370 - protein, 5 aa, Mycobacterium
NPTRH

SEQ ID NO: 532371 - protein, 7 aa, Mycobacterium
NPTRPDL

SEQ ID NO: 532372 - protein, 14 aa, Mycobacterium
NPTRRGDALRRDAD

SEQ ID NO: 532373 - protein, 8 aa, Mycobacterium
NPTRRGEA

SEQ ID NO: 532374 - protein, 8 aa, Mycobacterium
NPTRRPSW

SEQ ID NO: 532375 - protein, 5 aa, Mycobacterium
NPTRS

SEQ ID NO: 532376 - protein, 5 aa, Mycobacterium
NPTRV

SEQ ID NO: 532377 - protein, 12 aa, Mycobacterium
NPTSRAEAHPAE

SEQ ID NO: 532378 - protein, 6 aa, Mycobacterium
NPTSRE

SEQ ID NO: 532379 - protein, 8 aa, Mycobacterium
NPTTGCDR

SEQ ID NO: 532380 - protein, 13 aa, Mycobacterium
NPTVKSAINTAAR

SEQ ID NO: 532381 - protein, 12 aa, Mycobacterium
NPTVKSAINTGV

SEQ ID NO: 532382 - protein, 8 aa, Mycobacterium
NPTVKSGI

SEQ ID NO: 532383 - protein, 9 aa, Mycobacterium
NPTVKSGIN

SEQ ID NO: 532384 - protein, 16 aa, Mycobacterium
NPTVTSVAGEYGKTPA

SEQ ID NO: 532385 - protein, 7 aa, Mycobacterium
NPVAKRS

SEQ ID NO: 532386 - protein, 5 aa, Mycobacterium
NPVAR

SEQ ID NO: 532387 - protein, 16 aa, Mycobacterium
NPVATGDGIRAGQRIG

SEQ ID NO: 532388 - protein, 13 aa, Mycobacterium
NPVATPATVAPDA

SEQ ID NO: 532389 - protein, 4 aa, Mycobacterium
NPVD

SEQ ID NO: 532390 - protein, 6 aa, Mycobacterium
NPVDEW

SEQ ID NO: 532391 - protein, 8 aa, Mycobacterium
NPVDPDTL

SEQ ID NO: 532392 - protein, 10 aa, Mycobacterium
NPVDQEGTYA

SEQ ID NO: 532393 - protein, 16 aa, Mycobacterium
NPVDQEGTYPLSEAQT

SEQ ID NO: 532394 - protein, 17 aa, Mycobacterium
NPVDQEGTYPLSEAQTD

SEQ ID NO: 532395 - protein, 7 aa, Mycobacterium
NPVEEWA

SEQ ID NO: 532396 - protein, 26 aa, Mycobacterium
NPVGAGHTITSSARATASGVAESVGA

SEQ ID NO: 532397 - protein, 9 aa, Mycobacterium
NPVGAPEFA

SEQ ID NO: 532398 - protein, 6 aa, Mycobacterium
NPVHPT

SEQ ID NO: 532399 - protein, 5 aa, Mycobacterium
NPVLP

SEQ ID NO: 532400 - protein, 9 aa, Mycobacterium
NPVPEPKPF

SEQ ID NO: 532401 - protein, 5 aa, Mycobacterium
NPVPI

SEQ ID NO: 532402 - protein, 5 aa, Mycobacterium
NPVPL

SEQ ID NO: 532403 - protein, 6 aa, Mycobacterium
NPVPPG

SEQ ID NO: 532404 - protein, 8 aa, Mycobacterium
NPVPPISA

SEQ ID NO: 532405 - protein, 18 aa, Mycobacterium
NPVPWSRPAESDLLPPEL

SEQ ID NO: 532406 - protein, 10 aa, Mycobacterium
NPVRTTGGKI

SEQ ID NO: 532407 - protein, 5 aa, Mycobacterium
NPVRV

SEQ ID NO: 532408 - protein, 7 aa, Mycobacterium
NPVSNPA

SEQ ID NO: 532409 - protein, 4 aa, Mycobacterium
NPVT

SEQ ID NO: 532410 - protein, 13 aa, Mycobacterium
NPVTAHKAGTVTG

SEQ ID NO: 532411 - protein, 12 aa, Mycobacterium
NPVTAHKDGTIT

SEQ ID NO: 532412 - protein, 10 aa, Mycobacterium
NPVTGADEPF

SEQ ID NO: 532413 - protein, 10 aa, Mycobacterium
NPVTGDDEPF

SEQ ID NO: 532414 - protein, 6 aa, Mycobacterium
NPVTGE

SEQ ID NO: 532415 - protein, 5 aa, Mycobacterium
NPVTN

SEQ ID NO: 532416 - protein, 9 aa, Mycobacterium
NPVTPDPFA

SEQ ID NO: 532417 - protein, 18 aa, Mycobacterium
NPWDTEYSAGASSSGSGA

SEQ ID NO: 532418 - protein, 19 aa, Mycobacterium
NPWDTTKTAGGSSGGSAAA

SEQ ID NO: 532419 - protein, 20 aa, Mycobacterium
NPWGSDVTPGGSSGGSAAAV

SEQ ID NO: 532420 - protein, 16 aa, Mycobacterium
NPWHGRPASATLALPP

SEQ ID NO: 532421 - protein, 15 aa, Mycobacterium
NPWRGPPVPYDTPVT

SEQ ID NO: 532422 - protein, 4 aa, Mycobacterium
NPWT

SEQ ID NO: 532423 - protein, 5 aa, Mycobacterium
NPWTY

SEQ ID NO: 532424 - protein, 10 aa, Mycobacterium
NPYADKPRLD

SEQ ID NO: 532425 - protein, 9 aa, Mycobacterium
NPYATGPAR

SEQ ID NO: 532426 - protein, 9 aa, Mycobacterium
NPYDKSDTV

SEQ ID NO: 532427 - protein, 9 aa, Mycobacterium
NPYDVGAEG

SEQ ID NO: 532428 - protein, 4 aa, Mycobacterium
NPYG

SEQ ID NO: 532429 - protein, 11 aa, Mycobacterium
NPYGPPDWQPR

SEQ ID NO: 532430 - protein, 12 aa, Mycobacterium
NPYGPPDWQPRQ

SEQ ID NO: 532431 - protein, 4 aa, Mycobacterium
NPYP

SEQ ID NO: 532432 - protein, 12 aa, Mycobacterium
NPYPETAPADRP

SEQ ID NO: 532433 - protein, 11 aa, Mycobacterium
NPYPETAPAQR

SEQ ID NO: 532434 - protein, 12 aa, Mycobacterium
NPYPETAPPGRP

SEQ ID NO: 532435 - protein, 13 aa, Mycobacterium
NPYPETAPPQRKP

SEQ ID NO: 532436 - protein, 15 aa, Mycobacterium
NPYPLGATYDGAGTN

SEQ ID NO: 532437 - protein, 7 aa, Mycobacterium
NQAAAKG

SEQ ID NO: 532438 - protein, 7 aa, Mycobacterium
NQAAEAA

SEQ ID NO: 532439 - protein, 12 aa, Mycobacterium
NQAALPPPGPRQ

SEQ ID NO: 532440 - protein, 16 aa, Mycobacterium
NQAANKKSALALALNK

SEQ ID NO: 532441 - protein, 16 aa, Mycobacterium
NQAANKKSALAQALNK

SEQ ID NO: 532442 - protein, 16 aa, Mycobacterium
NQAANKKSALARALNK

SEQ ID NO: 532443 - protein, 17 aa, Mycobacterium
NQAANKKSALARALNKL

SEQ ID NO: 532444 - protein, 17 aa, Mycobacterium
NQAANKKSALARTLNKL

SEQ ID NO: 532445 - protein, 16 aa, Mycobacterium
NQAANRKSALARALNK

SEQ ID NO: 532446 - protein, 7 aa, Mycobacterium
NQADEGR

SEQ ID NO: 532447 - protein, 9 aa, Mycobacterium
NQADELKDE

SEQ ID NO: 532448 - protein, 6 aa, Mycobacterium
NQADRD

SEQ ID NO: 532449 - protein, 4 aa, Mycobacterium
NQAE

SEQ ID NO: 532450 - protein, 6 aa, Mycobacterium
NQAERR

SEQ ID NO: 532451 - protein, 5 aa, Mycobacterium
NQAGY

SEQ ID NO: 532452 - protein, 5 aa, Mycobacterium
NQAIG

SEQ ID NO: 532453 - protein, 12 aa, Mycobacterium
NQANGIDPQPLR

SEQ ID NO: 532454 - protein, 10 aa, Mycobacterium
NQANYAASKA

SEQ ID NO: 532455 - protein, 9 aa, Mycobacterium
NQAPERPRQ

SEQ ID NO: 532456 - protein, 7 aa, Mycobacterium
NQAPGTL

SEQ ID NO: 532457 - protein, 14 aa, Mycobacterium
NQAPPLENYNPATS

SEQ ID NO: 532458 - protein, 6 aa, Mycobacterium
NQARPE

SEQ ID NO: 532459 - protein, 11 aa, Mycobacterium
NQASDASGHQQ

SEQ ID NO: 532460 - protein, 6 aa, Mycobacterium
NQASTN

SEQ ID NO: 532461 - protein, 5 aa, Mycobacterium
NQATI

SEQ ID NO: 532462 - protein, 21 aa, Mycobacterium
NQATTAAKDKGNGMKSPSRQA

SEQ ID NO: 532463 - protein, 4 aa, Mycobacterium
NQAV

SEQ ID NO: 532464 - protein, 6 aa, Mycobacterium
NQAVEA

SEQ ID NO: 532465 - protein, 5 aa, Mycobacterium
NQAVS

SEQ ID NO: 532466 - protein, 11 aa, Mycobacterium
NQDAEKAGDWK

SEQ ID NO: 532467 - protein, 18 aa, Mycobacterium
NQDDYNAGNFGAYQASVV

SEQ ID NO: 532468 - protein, 9 aa, Mycobacterium
NQDGQYSLT

SEQ ID NO: 532469 - protein, 5 aa, Mycobacterium
NQDHR

SEQ ID NO: 532470 - protein, 4 aa, Mycobacterium
NQDK

SEQ ID NO: 532471 - protein, 9 aa, Mycobacterium
NQDKHGTAY

SEQ ID NO: 532472 - protein, 4 aa, Mycobacterium
NQDL

SEQ ID NO: 532473 - protein, 6 aa, Mycobacterium
NQDPEI

SEQ ID NO: 532474 - protein, 7 aa, Mycobacterium
NQDSDPR

SEQ ID NO: 532475 - protein, 5 aa, Mycobacterium
NQDSG

SEQ ID NO: 532476 - protein, 7 aa, Mycobacterium
NQDTTFG

SEQ ID NO: 532477 - protein, 6 aa, Mycobacterium
NQDVEL

SEQ ID NO: 532478 - protein, 9 aa, Mycobacterium
NQDVSQRGV

SEQ ID NO: 532479 - protein, 5 aa, Mycobacterium
NQEFG

SEQ ID NO: 532480 - protein, 4 aa, Mycobacterium
NQEL

SEQ ID NO: 532481 - protein, 6 aa, Mycobacterium
NQEQAG

SEQ ID NO: 532482 - protein, 4 aa, Mycobacterium
NQER

SEQ ID NO: 532483 - protein, 6 aa, Mycobacterium
NQESRV

SEQ ID NO: 532484 - protein, 19 aa, Mycobacterium
NQETLEKAAAEVAERTGRR

SEQ ID NO: 532485 - protein, 7 aa, Mycobacterium
NQGAEST

SEQ ID NO: 532486 - protein, 8 aa, Mycobacterium
NQGARTAV

SEQ ID NO: 532487 - protein, 24 aa, Mycobacterium
NQGDIDKQSITGATATATHGTGAR

SEQ ID NO: 532488 - protein, 12 aa, Mycobacterium
NQGDNQAGILGQ

SEQ ID NO: 532489 - protein, 4 aa, Mycobacterium
NQGG

SEQ ID NO: 532490 - protein, 7 aa, Mycobacterium
NQGHTAD

SEQ ID NO: 532491 - protein, 23 aa, Mycobacterium
NQGLATGLGDEGGFAPDVAGTKA

SEQ ID NO: 532492 - protein, 7 aa, Mycobacterium
NQGPDRD

SEQ ID NO: 532493 - protein, 7 aa, Mycobacterium
NQGPDRE

SEQ ID NO: 532494 - protein, 6 aa, Mycobacterium
NQGPVG

SEQ ID NO: 532495 - protein, 8 aa, Mycobacterium
NQGRTSRY

SEQ ID NO: 532496 - protein, 9 aa, Mycobacterium
NQGSTVEQA

SEQ ID NO: 532497 - protein, 7 aa, Mycobacterium
NQGWRGS

SEQ ID NO: 532498 - protein, 6 aa, Mycobacterium
NQGYDD

SEQ ID NO: 532499 - protein, 19 aa, Mycobacterium
NQGYQDLRDGKNIRGVIVH

SEQ ID NO: 532500 - protein, 12 aa, Mycobacterium
NQHARNESEVGG

SEQ ID NO: 532501 - protein, 6 aa, Mycobacterium
NQHAYS

SEQ ID NO: 532502 - protein, 5 aa, Mycobacterium
NQHGP

SEQ ID NO: 532503 - protein, 6 aa, Mycobacterium
NQHGPD

SEQ ID NO: 532504 - protein, 6 aa, Mycobacterium
NQHGPS

SEQ ID NO: 532505 - protein, 7 aa, Mycobacterium
NQHGPSS

SEQ ID NO: 532506 - protein, 6 aa, Mycobacterium
NQHGPT

SEQ ID NO: 532507 - protein, 7 aa, Mycobacterium
NQHGPTS

SEQ ID NO: 532508 - protein, 5 aa, Mycobacterium
NQHQT

SEQ ID NO: 532509 - protein, 6 aa, Mycobacterium
NQHSQI

SEQ ID NO: 532510 - protein, 4 aa, Mycobacterium
NQIE

SEQ ID NO: 532511 - protein, 6 aa, Mycobacterium
NQIGDG

SEQ ID NO: 532512 - protein, 5 aa, Mycobacterium
NQIPA

SEQ ID NO: 532513 - protein, 8 aa, Mycobacterium
NQIPPGMS

SEQ ID NO: 532514 - protein, 12 aa, Mycobacterium
NQIRDGNDNRVH

SEQ ID NO: 532515 - protein, 9 aa, Mycobacterium
NQIRSRGAE

SEQ ID NO: 532516 - protein, 6 aa, Mycobacterium
NQKGGE

SEQ ID NO: 532517 - protein, 12 aa, Mycobacterium
NQKGSDDTPLED

SEQ ID NO: 532518 - protein, 11 aa, Mycobacterium
NQKGSPDTPLE

SEQ ID NO: 532519 - protein, 4 aa, Mycobacterium
NQLE

SEQ ID NO: 532520 - protein, 6 aa, Mycobacterium
NQLKSK

SEQ ID NO: 532521 - protein, 6 aa, Mycobacterium
NQLKTK

SEQ ID NO: 532522 - protein, 4 aa, Mycobacterium
NQLP

SEQ ID NO: 532523 - protein, 7 aa, Mycobacterium
NQLPPGS

SEQ ID NO: 532524 - protein, 5 aa, Mycobacterium
NQLRD

SEQ ID NO: 532525 - protein, 6 aa, Mycobacterium
NQLRES

SEQ ID NO: 532526 - protein, 12 aa, Mycobacterium
NQLSDDADDLEV

SEQ ID NO: 532527 - protein, 10 aa, Mycobacterium
NQLSGGQRQR

SEQ ID NO: 532528 - protein, 13 aa, Mycobacterium
NQLSTGDIDADEA

SEQ ID NO: 532529 - protein, 14 aa, Mycobacterium
NQNANTAMGTAQAG

SEQ ID NO: 532530 - protein, 16 aa, Mycobacterium
NQNDVRGTKAKASLDR

SEQ ID NO: 532531 - protein, 6 aa, Mycobacterium
NQNGTV

SEQ ID NO: 532532 - protein, 5 aa, Mycobacterium
NQNHG

SEQ ID NO: 532533 - protein, 8 aa, Mycobacterium
NQNNQPVS

SEQ ID NO: 532534 - protein, 10 aa, Mycobacterium
NQNPGTTKHG

SEQ ID NO: 532535 - protein, 6 aa, Mycobacterium
NQNPIG

SEQ ID NO: 532536 - protein, 13 aa, Mycobacterium
NQPAAVVKVATAA

SEQ ID NO: 532537 - protein, 17 aa, Mycobacterium
NQPALEEAATRVETYTD

SEQ ID NO: 532538 - protein, 7 aa, Mycobacterium
NQPAWEA

SEQ ID NO: 532539 - protein, 7 aa, Mycobacterium
NQPDATA

SEQ ID NO: 532540 - protein, 6 aa, Mycobacterium
NQPDID

SEQ ID NO: 532541 - protein, 7 aa, Mycobacterium
NQPDVAE

SEQ ID NO: 532542 - protein, 6 aa, Mycobacterium
NQPEGT

SEQ ID NO: 532543 - protein, 11 aa, Mycobacterium
NQPFLPPPGPR

SEQ ID NO: 532544 - protein, 6 aa, Mycobacterium
NQPGGA

SEQ ID NO: 532545 - protein, 10 aa, Mycobacterium
NQPGLATDAH

SEQ ID NO: 532546 - protein, 6 aa, Mycobacterium
NQPGTV

SEQ ID NO: 532547 - protein, 6 aa, Mycobacterium
NQPHGA

SEQ ID NO: 532548 - protein, 14 aa, Mycobacterium
NQPHGPRPSTVYPQ

SEQ ID NO: 532549 - protein, 5 aa, Mycobacterium
NQPNR

SEQ ID NO: 532550 - protein, 4 aa, Mycobacterium
NQPP

SEQ ID NO: 532551 - protein, 7 aa, Mycobacterium
NQPPLPA

SEQ ID NO: 532552 - protein, 30 aa, Mycobacterium
NQPRADTGHDGSSGLQGETGSSGTKRVRER

SEQ ID NO: 532553 - protein, 7 aa, Mycobacterium
NQPRPDN

SEQ ID NO: 532554 - protein, 9 aa, Mycobacterium
NQPRREMAE

SEQ ID NO: 532555 - protein, 13 aa, Mycobacterium
NQPSAAIESPGGD

SEQ ID NO: 532556 - protein, 20 aa, Mycobacterium
NQPSIPRTEAQRRSRLEGTT

SEQ ID NO: 532557 - protein, 5 aa, Mycobacterium
NQPSM

SEQ ID NO: 532558 - protein, 16 aa, Mycobacterium
NQPSQTVDPAGPLTQA

SEQ ID NO: 532559 - protein, 5 aa, Mycobacterium
NQPSV

SEQ ID NO: 532560 - protein, 5 aa, Mycobacterium
NQPTQ

SEQ ID NO: 532561 - protein, 14 aa, Mycobacterium
NQPTSVDAADGLRA

SEQ ID NO: 532562 - protein, 14 aa, Mycobacterium
NQPTSVDAADGLRT

SEQ ID NO: 532563 - protein, 14 aa, Mycobacterium
NQPTSVDSADGLRA

SEQ ID NO: 532564 - protein, 7 aa, Mycobacterium
NQPTTGM

SEQ ID NO: 532565 - protein, 19 aa, Mycobacterium
NQPTTRITSVGSTNFSGGL

SEQ ID NO: 532566 - protein, 7 aa, Mycobacterium
NQPWSES

SEQ ID NO: 532567 - protein, 9 aa, Mycobacterium
NQQAPLTSS

SEQ ID NO: 532568 - protein, 11 aa, Mycobacterium
NQQFDSAEGSM

SEQ ID NO: 532569 - protein, 11 aa, Mycobacterium
NQQQLSAPQEI

SEQ ID NO: 532570 - protein, 8 aa, Mycobacterium
NQQTGRAA

SEQ ID NO: 532571 - protein, 18 aa, Mycobacterium
NQQTREPLAPYGGSSPAM

SEQ ID NO: 532572 - protein, 7 aa, Mycobacterium
NQQVGAE

SEQ ID NO: 532573 - protein, 8 aa, Mycobacterium
NQRELSAS

SEQ ID NO: 532574 - protein, 5 aa, Mycobacterium
NQRET

SEQ ID NO: 532575 - protein, 4 aa, Mycobacterium
NQRF

SEQ ID NO: 532576 - protein, 6 aa, Mycobacterium
NQRGGL

SEQ ID NO: 532577 - protein, 6 aa, Mycobacterium
NQRGNE

SEQ ID NO: 532578 - protein, 13 aa, Mycobacterium
NQRGYSPGARPVG

SEQ ID NO: 532579 - protein, 13 aa, Mycobacterium
NQRHRANGGRQAG

SEQ ID NO: 532580 - protein, 9 aa, Mycobacterium
NQRNGGYTV

SEQ ID NO: 532581 - protein, 8 aa, Mycobacterium
NQRRPSQE

SEQ ID NO: 532582 - protein, 15 aa, Mycobacterium
NQRRREAAATETAAA

SEQ ID NO: 532583 - protein, 10 aa, Mycobacterium
NQRSEELNTA

SEQ ID NO: 532584 - protein, 9 aa, Mycobacterium
NQRSEGVDR

SEQ ID NO: 532585 - protein, 10 aa, Mycobacterium
NQRTEDPSVE

SEQ ID NO: 532586 - protein, 9 aa, Mycobacterium
NQRVEPDEI

SEQ ID NO: 532587 - protein, 5 aa, Mycobacterium
NQSAV

SEQ ID NO: 532588 - protein, 31 aa, Mycobacterium
NQSCPPPTTTRRPPRGDRRNRQKTCHATDFP

SEQ ID NO: 532589 - protein, 11 aa, Mycobacterium
NQSFDAAEGSM

SEQ ID NO: 532590 - protein, 12 aa, Mycobacterium
NQSFDQGRHTEA

SEQ ID NO: 532591 - protein, 10 aa, Mycobacterium
NQSGPAAANG

SEQ ID NO: 532592 - protein, 8 aa, Mycobacterium
NQSGPGLG

SEQ ID NO: 532593 - protein, 8 aa, Mycobacterium
NQSGREDL

SEQ ID NO: 532594 - protein, 6 aa, Mycobacterium
NQSGRT

SEQ ID NO: 532595 - protein, 7 aa, Mycobacterium
NQSGSFG

SEQ ID NO: 532596 - protein, 6 aa, Mycobacterium
NQSGVA

SEQ ID NO: 532597 - protein, 7 aa, Mycobacterium
NQSHTAT

SEQ ID NO: 532598 - protein, 6 aa, Mycobacterium
NQSLGT

SEQ ID NO: 532599 - protein, 16 aa, Mycobacterium
NQSPAAYSKAAAEAGF

SEQ ID NO: 532600 - protein, 10 aa, Mycobacterium
NQSPEEGRRR

SEQ ID NO: 532601 - protein, 16 aa, Mycobacterium
NQSPTAYSKAAAEAGF

SEQ ID NO: 532602 - protein, 16 aa, Mycobacterium
NQSPTAYSKAAAQAGF

SEQ ID NO: 532603 - protein, 17 aa, Mycobacterium
NQSPTAYSRAAAEAGFE

SEQ ID NO: 532604 - protein, 13 aa, Mycobacterium
NQSPYPPGGPIPR

SEQ ID NO: 532605 - protein, 5 aa, Mycobacterium
NQSVV

SEQ ID NO: 532606 - protein, 23 aa, Mycobacterium
NQTDKEWRTAADGPHKRSRASDL

SEQ ID NO: 532607 - protein, 10 aa, Mycobacterium
NQTEEAGRRR

SEQ ID NO: 532608 - protein, 7 aa, Mycobacterium
NQTEGSA

SEQ ID NO: 532609 - protein, 5 aa, Mycobacterium
NQTEL

SEQ ID NO: 532610 - protein, 6 aa, Mycobacterium
NQTGAQ

SEQ ID NO: 532611 - protein, 9 aa, Mycobacterium
NQTGETEDV

SEQ ID NO: 532612 - protein, 8 aa, Mycobacterium
NQTGLPPE

SEQ ID NO: 532613 - protein, 5 aa, Mycobacterium
NQTGS

SEQ ID NO: 532614 - protein, 7 aa, Mycobacterium
NQTGSTA

SEQ ID NO: 532615 - protein, 9 aa, Mycobacterium
NQTGSTPIL

SEQ ID NO: 532616 - protein, 7 aa, Mycobacterium
NQTGTTA

SEQ ID NO: 532617 - protein, 9 aa, Mycobacterium
NQTGTTPIL

SEQ ID NO: 532618 - protein, 5 aa, Mycobacterium
NQTID

SEQ ID NO: 532619 - protein, 15 aa, Mycobacterium
NQTLAEGDRPEPALR

SEQ ID NO: 532620 - protein, 5 aa, Mycobacterium
NQTNT

SEQ ID NO: 532621 - protein, 9 aa, Mycobacterium
NQTPASARE

SEQ ID NO: 532622 - protein, 8 aa, Mycobacterium
NQTPDGAA

SEQ ID NO: 532623 - protein, 7 aa, Mycobacterium
NQTPESA

SEQ ID NO: 532624 - protein, 8 aa, Mycobacterium
NQTPESAR

SEQ ID NO: 532625 - protein, 9 aa, Mycobacterium
NQTPESARE

SEQ ID NO: 532626 - protein, 9 aa, Mycobacterium
NQTPSSARD

SEQ ID NO: 532627 - protein, 4 aa, Mycobacterium
NQTQ

SEQ ID NO: 532628 - protein, 7 aa, Mycobacterium
NQTTARA

SEQ ID NO: 532629 - protein, 9 aa, Mycobacterium
NQTTPDLDT

SEQ ID NO: 532630 - protein, 4 aa, Mycobacterium
NQVD

SEQ ID NO: 532631 - protein, 5 aa, Mycobacterium
NQVGG

SEQ ID NO: 532632 - protein, 11 aa, Mycobacterium
NQVKSGVPFTD

SEQ ID NO: 532633 - protein, 5 aa, Mycobacterium
NQVRG

SEQ ID NO: 532634 - protein, 8 aa, Mycobacterium
NQVRPENR

SEQ ID NO: 532635 - protein, 7 aa, Mycobacterium
NQVSARR

SEQ ID NO: 532636 - protein, 5 aa, Mycobacterium
NQVSR

SEQ ID NO: 532637 - protein, 6 aa, Mycobacterium
NQVSRL

SEQ ID NO: 532638 - protein, 4 aa, Mycobacterium
NQWP

SEQ ID NO: 532639 - protein, 4 aa, Mycobacterium
NQYA

SEQ ID NO: 532640 - protein, 17 aa, Mycobacterium
NQYAPPPPYPASDPYEP

SEQ ID NO: 532641 - protein, 13 aa, Mycobacterium
NQYPPGDMSVWNW

SEQ ID NO: 532642 - protein, 7 aa, Mycobacterium
NQYPPGI

SEQ ID NO: 532643 - protein, 7 aa, Mycobacterium
NQYPPGL

SEQ ID NO: 532644 - protein, 8 aa, Mycobacterium
NQYPPGLG

SEQ ID NO: 532645 - protein, 9 aa, Mycobacterium
NQYQSNPPR

SEQ ID NO: 532646 - protein, 5 aa, Mycobacterium
NQYTR

SEQ ID NO: 532647 - protein, 11 aa, Mycobacterium
NRAAASAIDPP

SEQ ID NO: 532648 - protein, 5 aa, Mycobacterium
NRAAD

SEQ ID NO: 532649 - protein, 7 aa, Mycobacterium
NRAAGSL

SEQ ID NO: 532650 - protein, 8 aa, Mycobacterium
NRAAQAAS

SEQ ID NO: 532651 - protein, 11 aa, Mycobacterium
NRAASPSAARA

SEQ ID NO: 532652 - protein, 10 aa, Mycobacterium
NRAASPSTAR

SEQ ID NO: 532653 - protein, 16 aa, Mycobacterium
NRAATATGDKAAALPP

SEQ ID NO: 532654 - protein, 8 aa, Mycobacterium
NRADERWP

SEQ ID NO: 532655 - protein, 7 aa, Mycobacterium
NRADGSP

SEQ ID NO: 532656 - protein, 7 aa, Mycobacterium
NRADNRV

SEQ ID NO: 532657 - protein, 12 aa, Mycobacterium
NRADQRGKARAT

SEQ ID NO: 532658 - protein, 5 aa, Mycobacterium
NRADT

SEQ ID NO: 532659 - protein, 5 aa, Mycobacterium
NRADV

SEQ ID NO: 532660 - protein, 8 aa, Mycobacterium
NRAEAARD

SEQ ID NO: 532661 - protein, 10 aa, Mycobacterium
NRAEGKKHPW

SEQ ID NO: 532662 - protein, 14 aa, Mycobacterium
NRAEPDLKSGRGGL

SEQ ID NO: 532663 - protein, 7 aa, Mycobacterium
NRAEPGS

SEQ ID NO: 532664 - protein, 9 aa, Mycobacterium
NRAEQAYEA

SEQ ID NO: 532665 - protein, 7 aa, Mycobacterium
NRAETQQ

SEQ ID NO: 532666 - protein, 7 aa, Mycobacterium
NRAGAAH

SEQ ID NO: 532667 - protein, 16 aa, Mycobacterium
NRAGATTPAPQRRKPI

SEQ ID NO: 532668 - protein, 7 aa, Mycobacterium
NRAGPLT

SEQ ID NO: 532669 - protein, 9 aa, Mycobacterium
NRAGRDKAR

SEQ ID NO: 532670 - protein, 14 aa, Mycobacterium
NRAGTSTPTPPRRK

SEQ ID NO: 532671 - protein, 5 aa, Mycobacterium
NRAGV

SEQ ID NO: 532672 - protein, 10 aa, Mycobacterium
NRAKRNNPGV

SEQ ID NO: 532673 - protein, 6 aa, Mycobacterium
NRALSA

SEQ ID NO: 532674 - protein, 12 aa, Mycobacterium
NRANAANTESAG

SEQ ID NO: 532675 - protein, 10 aa, Mycobacterium
NRANARSGTV

SEQ ID NO: 532676 - protein, 7 aa, Mycobacterium
NRANPYP

SEQ ID NO: 532677 - protein, 12 aa, Mycobacterium
NRANQRGKLKPA

SEQ ID NO: 532678 - protein, 8 aa, Mycobacterium
NRAPAKVQ

SEQ ID NO: 532679 - protein, 8 aa, Mycobacterium
NRAPARVP

SEQ ID NO: 532680 - protein, 16 aa, Mycobacterium
NRAPDGGHIKDAPAGV

SEQ ID NO: 532681 - protein, 8 aa, Mycobacterium
NRAPGGDV

SEQ ID NO: 532682 - protein, 9 aa, Mycobacterium
NRAPTPSEL

SEQ ID NO: 532683 - protein, 6 aa, Mycobacterium
NRAQTA

SEQ ID NO: 532684 - protein, 17 aa, Mycobacterium
NRARDRLRRESARPAKE

SEQ ID NO: 532685 - protein, 8 aa, Mycobacterium
NRARGEAV

SEQ ID NO: 532686 - protein, 7 aa, Mycobacterium
NRARPAP

SEQ ID NO: 532687 - protein, 18 aa, Mycobacterium
NRARQLAEAAKDTVGAAR

SEQ ID NO: 532688 - protein, 6 aa, Mycobacterium
NRARTL

SEQ ID NO: 532689 - protein, 8 aa, Mycobacterium
NRASGAEI

SEQ ID NO: 532690 - protein, 6 aa, Mycobacterium
NRASTL

SEQ ID NO: 532691 - protein, 6 aa, Mycobacterium
NRATAS

SEQ ID NO: 532692 - protein, 16 aa, Mycobacterium
NRATERYGPSCAGAPP

SEQ ID NO: 532693 - protein, 19 aa, Mycobacterium
NRATLEDQGLRDVADDAAA

SEQ ID NO: 532694 - protein, 11 aa, Mycobacterium
NRATRYSEVDR

SEQ ID NO: 532695 - protein, 11 aa, Mycobacterium
NRAVKEDAAQG

SEQ ID NO: 532696 - protein, 7 aa, Mycobacterium
NRAVPAG

SEQ ID NO: 532697 - protein, 11 aa, Mycobacterium
NRAYSDGDRDG

SEQ ID NO: 532698 - protein, 8 aa, Mycobacterium
NRCEPKDA

SEQ ID NO: 532699 - protein, 7 aa, Mycobacterium
NRCKGGN

SEQ ID NO: 532700 - protein, 8 aa, Mycobacterium
NRCPPTTF

SEQ ID NO: 532701 - protein, 8 aa, Mycobacterium
NRCRSDDT

SEQ ID NO: 532702 - protein, 8 aa, Mycobacterium
NRDAPGNQ

SEQ ID NO: 532703 - protein, 9 aa, Mycobacterium
NRDAPRAPE

SEQ ID NO: 532704 - protein, 12 aa, Mycobacterium
NRDAQGGRLKSA

SEQ ID NO: 532705 - protein, 12 aa, Mycobacterium
NRDAQRGRLKTA

SEQ ID NO: 532706 - protein, 20 aa, Mycobacterium
NRDARKFADPNSFRPDRQNV

SEQ ID NO: 532707 - protein, 5 aa, Mycobacterium
NRDDA

SEQ ID NO: 532708 - protein, 11 aa, Mycobacterium
NRDDEVFPEPD

SEQ ID NO: 532709 - protein, 13 aa, Mycobacterium
NRDDPGDDSGNVT

SEQ ID NO: 532710 - protein, 9 aa, Mycobacterium
NRDDPPYQG

SEQ ID NO: 532711 - protein, 5 aa, Mycobacterium
NRDDR

SEQ ID NO: 532712 - protein, 11 aa, Mycobacterium
NRDDSDEISTN

SEQ ID NO: 532713 - protein, 8 aa, Mycobacterium
NRDDTSAF

SEQ ID NO: 532714 - protein, 5 aa, Mycobacterium
NRDED

SEQ ID NO: 532715 - protein, 6 aa, Mycobacterium
NRDEDV

SEQ ID NO: 532716 - protein, 7 aa, Mycobacterium
NRDEDVF

SEQ ID NO: 532717 - protein, 5 aa, Mycobacterium
NRDEE

SEQ ID NO: 532718 - protein, 7 aa, Mycobacterium
NRDEEKF

SEQ ID NO: 532719 - protein, 6 aa, Mycobacterium
NRDEEV

SEQ ID NO: 532720 - protein, 6 aa, Mycobacterium
NRDEHA

SEQ ID NO: 532721 - protein, 5 aa, Mycobacterium
NRDEK

SEQ ID NO: 532722 - protein, 10 aa, Mycobacterium
NRDERHFDEP

SEQ ID NO: 532723 - protein, 11 aa, Mycobacterium
NRDERRYRDPD

SEQ ID NO: 532724 - protein, 8 aa, Mycobacterium
NRDESKFA

SEQ ID NO: 532725 - protein, 6 aa, Mycobacterium
NRDGAF

SEQ ID NO: 532726 - protein, 10 aa, Mycobacterium
NRDGEHTTTD

SEQ ID NO: 532727 - protein, 9 aa, Mycobacterium
NRDGEIPDA

SEQ ID NO: 532728 - protein, 10 aa, Mycobacterium
NRDGKPVTSA

SEQ ID NO: 532729 - protein, 10 aa, Mycobacterium
NRDGQHTTTD

SEQ ID NO: 532730 - protein, 11 aa, Mycobacterium
NRDGQPVTSAA

SEQ ID NO: 532731 - protein, 12 aa, Mycobacterium
NRDGTDEHSGDD

SEQ ID NO: 532732 - protein, 8 aa, Mycobacterium
NRDGVSVE

SEQ ID NO: 532733 - protein, 6 aa, Mycobacterium
NRDHPE

SEQ ID NO: 532734 - protein, 11 aa, Mycobacterium
NRDHRQFPPDG

SEQ ID NO: 532735 - protein, 10 aa, Mycobacterium
NRDHRRFAPD

SEQ ID NO: 532736 - protein, 11 aa, Mycobacterium
NRDHRRFPPNG

SEQ ID NO: 532737 - protein, 5 aa, Mycobacterium
NRDLA

SEQ ID NO: 532738 - protein, 6 aa, Mycobacterium
NRDLKR

SEQ ID NO: 532739 - protein, 10 aa, Mycobacterium
NRDNTVSASL

SEQ ID NO: 532740 - protein, 11 aa, Mycobacterium
NRDNVADPDGR

SEQ ID NO: 532741 - protein, 5 aa, Mycobacterium
NRDPA

SEQ ID NO: 532742 - protein, 6 aa, Mycobacterium
NRDPAI

SEQ ID NO: 532743 - protein, 6 aa, Mycobacterium
NRDPAQ

SEQ ID NO: 532744 - protein, 8 aa, Mycobacterium
NRDPAQFK

SEQ ID NO: 532745 - protein, 6 aa, Mycobacterium
NRDPAV

SEQ ID NO: 532746 - protein, 12 aa, Mycobacterium
NRDPLGLGAPSR

SEQ ID NO: 532747 - protein, 10 aa, Mycobacterium
NRDPLRYRDP

SEQ ID NO: 532748 - protein, 8 aa, Mycobacterium
NRDPNGDL

SEQ ID NO: 532749 - protein, 5 aa, Mycobacterium
NRDPR

SEQ ID NO: 532750 - protein, 11 aa, Mycobacterium
NRDPRKFPEPD

SEQ ID NO: 532751 - protein, 9 aa, Mycobacterium
NRDPRQFNS

SEQ ID NO: 532752 - protein, 17 aa, Mycobacterium
NRDPRRFDNPDRFDPLR

SEQ ID NO: 532753 - protein, 12 aa, Mycobacterium
NRDPRRFDNPNR

SEQ ID NO: 532754 - protein, 10 aa, Mycobacterium
NRDPRRYHDP

SEQ ID NO: 532755 - protein, 10 aa, Mycobacterium
NRDPRRYTDP

SEQ ID NO: 532756 - protein, 15 aa, Mycobacterium
NRDPRRYTDPDTYDI

SEQ ID NO: 532757 - protein, 14 aa, Mycobacterium
NRDPRRYTDPDTYN

SEQ ID NO: 532758 - protein, 10 aa, Mycobacterium
NRDPSHFDAP

SEQ ID NO: 532759 - protein, 9 aa, Mycobacterium
NRDPSRFEN

SEQ ID NO: 532760 - protein, 7 aa, Mycobacterium
NRDPTHF

SEQ ID NO: 532761 - protein, 6 aa, Mycobacterium
NRDPVQ

SEQ ID NO: 532762 - protein, 25 aa, Mycobacterium
NRDQKTDGDNREQHHTDTGADTGTV

SEQ ID NO: 532763 - protein, 4 aa, Mycobacterium
NRDR

SEQ ID NO: 532764 - protein, 14 aa, Mycobacterium
NRDRDLSPAPELGA

SEQ ID NO: 532765 - protein, 11 aa, Mycobacterium
NRDRSRDPHAD

SEQ ID NO: 532766 - protein, 9 aa, Mycobacterium
NRDRTNDQV

SEQ ID NO: 532767 - protein, 5 aa, Mycobacterium
NRDSH

SEQ ID NO: 532768 - protein, 18 aa, Mycobacterium
NRDSQCPAELRNRRTRAA

SEQ ID NO: 532769 - protein, 5 aa, Mycobacterium
NRDSR

SEQ ID NO: 532770 - protein, 4 aa, Mycobacterium
NRDT

SEQ ID NO: 532771 - protein, 10 aa, Mycobacterium
NRDTAASGRP

SEQ ID NO: 532772 - protein, 10 aa, Mycobacterium
NRDTEDTIGY

SEQ ID NO: 532773 - protein, 9 aa, Mycobacterium
NRDTGRFEN

SEQ ID NO: 532774 - protein, 5 aa, Mycobacterium
NRDTL

SEQ ID NO: 532775 - protein, 12 aa, Mycobacterium
NRDTQRGRLKTA

SEQ ID NO: 532776 - protein, 4 aa, Mycobacterium
NREA

SEQ ID NO: 532777 - protein, 6 aa, Mycobacterium
NREAAE

SEQ ID NO: 532778 - protein, 8 aa, Mycobacterium
NREAAQRA

SEQ ID NO: 532779 - protein, 11 aa, Mycobacterium
NREAEKAGDWK

SEQ ID NO: 532780 - protein, 12 aa, Mycobacterium
NREAQRGRLKPA

SEQ ID NO: 532781 - protein, 8 aa, Mycobacterium
NREDPPYQ

SEQ ID NO: 532782 - protein, 5 aa, Mycobacterium
NREEP

SEQ ID NO: 532783 - protein, 7 aa, Mycobacterium
NREEPRK

SEQ ID NO: 532784 - protein, 10 aa, Mycobacterium
NREGGVGPVA

SEQ ID NO: 532785 - protein, 13 aa, Mycobacterium
NREGKADAKTRQG

SEQ ID NO: 532786 - protein, 8 aa, Mycobacterium
NREGLPEQ

SEQ ID NO: 532787 - protein, 6 aa, Mycobacterium
NREGLS

SEQ ID NO: 532788 - protein, 7 aa, Mycobacterium
NREGLSA

SEQ ID NO: 532789 - protein, 8 aa, Mycobacterium
NREGQPAF

SEQ ID NO: 532790 - protein, 15 aa, Mycobacterium
NREINTRNVKKDDPR

SEQ ID NO: 532791 - protein, 7 aa, Mycobacterium
NRELRPD

SEQ ID NO: 532792 - protein, 7 aa, Mycobacterium
NRELTTA

SEQ ID NO: 532793 - protein, 17 aa, Mycobacterium
NRENGAHPINDSPQVQG

SEQ ID NO: 532794 - protein, 6 aa, Mycobacterium
NREPEL

SEQ ID NO: 532795 - protein, 19 aa, Mycobacterium
NREPLNANEELKKAGNPLD

SEQ ID NO: 532796 - protein, 19 aa, Mycobacterium
NREPLNDTEQIKHDDGPLN

SEQ ID NO: 532797 - protein, 7 aa, Mycobacterium
NREQERM

SEQ ID NO: 532798 - protein, 7 aa, Mycobacterium
NREQPIP

SEQ ID NO: 532799 - protein, 6 aa, Mycobacterium
NRESER

SEQ ID NO: 532800 - protein, 5 aa, Mycobacterium
NRETM

SEQ ID NO: 532801 - protein, 23 aa, Mycobacterium
NRFDGTPADVADDRELMHLYLGG

SEQ ID NO: 532802 - protein, 17 aa, Mycobacterium
NRFSDSGEQPAQPTPFT

SEQ ID NO: 532803 - protein, 4 aa, Mycobacterium
NRGA

SEQ ID NO: 532804 - protein, 7 aa, Mycobacterium
NRGAAPE

SEQ ID NO: 532805 - protein, 10 aa, Mycobacterium
NRGAEAADRP

SEQ ID NO: 532806 - protein, 15 aa, Mycobacterium
NRGAEGEKALATSGS

SEQ ID NO: 532807 - protein, 16 aa, Mycobacterium
NRGAGASDVPKATSAY

SEQ ID NO: 532808 - protein, 13 aa, Mycobacterium
NRGAGKSSNPKSF

SEQ ID NO: 532809 - protein, 19 aa, Mycobacterium
NRGAPSHTQNMGFALEVPD

SEQ ID NO: 532810 - protein, 10 aa, Mycobacterium
NRGAPTPGFG

SEQ ID NO: 532811 - protein, 4 aa, Mycobacterium
NRGD

SEQ ID NO: 532812 - protein, 6 aa, Mycobacterium
NRGDEM

SEQ ID NO: 532813 - protein, 9 aa, Mycobacterium
NRGDLSADD

SEQ ID NO: 532814 - protein, 8 aa, Mycobacterium
NRGDNAGS

SEQ ID NO: 532815 - protein, 5 aa, Mycobacterium
NRGDR

SEQ ID NO: 532816 - protein, 12 aa, Mycobacterium
NRGDRGAASELA

SEQ ID NO: 532817 - protein, 7 aa, Mycobacterium
NRGDRYG

SEQ ID NO: 532818 - protein, 13 aa, Mycobacterium
NRGDSSDDSGGHV

SEQ ID NO: 532819 - protein, 6 aa, Mycobacterium
NRGDWA

SEQ ID NO: 532820 - protein, 4 aa, Mycobacterium
NRGE

SEQ ID NO: 532821 - protein, 4 aa, Mycobacterium
NRGG

SEQ ID NO: 532822 - protein, 11 aa, Mycobacterium
NRGGALAETTY

SEQ ID NO: 532823 - protein, 8 aa, Mycobacterium
NRGGAPWN

SEQ ID NO: 532824 - protein, 7 aa, Mycobacterium
NRGGDAW

SEQ ID NO: 532825 - protein, 8 aa, Mycobacterium
NRGGDRRL

SEQ ID NO: 532826 - protein, 14 aa, Mycobacterium
NRGGEGDKEAARNK

SEQ ID NO: 532827 - protein, 10 aa, Mycobacterium
NRGGEKFSAR

SEQ ID NO: 532828 - protein, 10 aa, Mycobacterium
NRGGEKINAE

SEQ ID NO: 532829 - protein, 5 aa, Mycobacterium
NRGGR

SEQ ID NO: 532830 - protein, 6 aa, Mycobacterium
NRGGRT

SEQ ID NO: 532831 - protein, 10 aa, Mycobacterium
NRGIRPESKF

SEQ ID NO: 532832 - protein, 7 aa, Mycobacterium
NRGKKSI

SEQ ID NO: 532833 - protein, 7 aa, Mycobacterium
NRGKRSI

SEQ ID NO: 532834 - protein, 6 aa, Mycobacterium
NRGLGS

SEQ ID NO: 532835 - protein, 10 aa, Mycobacterium
NRGNPAGRAD

SEQ ID NO: 532836 - protein, 5 aa, Mycobacterium
NRGNR

SEQ ID NO: 532837 - protein, 9 aa, Mycobacterium
NRGPDSGAG

SEQ ID NO: 532838 - protein, 17 aa, Mycobacterium
NRGPEQRTDKRPQVSDL

SEQ ID NO: 532839 - protein, 26 aa, Mycobacterium
NRGPEQRTDKRPQVSDLRESGSLEQD

SEQ ID NO: 532840 - protein, 25 aa, Mycobacterium
NRGPEQRVDKTPQLSDLRESGNLEQ

SEQ ID NO: 532841 - protein, 7 aa, Mycobacterium
NRGPRPA

SEQ ID NO: 532842 - protein, 14 aa, Mycobacterium
NRGPVGKIQPPSLP

SEQ ID NO: 532843 - protein, 8 aa, Mycobacterium
NRGQATTA

SEQ ID NO: 532844 - protein, 10 aa, Mycobacterium
NRGQDAADTI

SEQ ID NO: 532845 - protein, 10 aa, Mycobacterium
NRGQDPAETI

SEQ ID NO: 532846 - protein, 7 aa, Mycobacterium
NRGQRKG

SEQ ID NO: 532847 - protein, 7 aa, Mycobacterium
NRGRPNV

SEQ ID NO: 532848 - protein, 9 aa, Mycobacterium
NRGRTAGPT

SEQ ID NO: 532849 - protein, 12 aa, Mycobacterium
NRGSARAAHRDA

SEQ ID NO: 532850 - protein, 13 aa, Mycobacterium
NRGSGKADDARKL

SEQ ID NO: 532851 - protein, 7 aa, Mycobacterium
NRGSHAE

SEQ ID NO: 532852 - protein, 8 aa, Mycobacterium
NRGSPTAN

SEQ ID NO: 532853 - protein, 4 aa, Mycobacterium
NRGT

SEQ ID NO: 532854 - protein, 7 aa, Mycobacterium
NRGTATA

SEQ ID NO: 532855 - protein, 8 aa, Mycobacterium
NRGTATTA

SEQ ID NO: 532856 - protein, 10 aa, Mycobacterium
NRGTDAAGRP

SEQ ID NO: 532857 - protein, 7 aa, Mycobacterium
NRGTDAL

SEQ ID NO: 532858 - protein, 10 aa, Mycobacterium
NRGTDPQDYD

SEQ ID NO: 532859 - protein, 9 aa, Mycobacterium
NRGTGGEVQ

SEQ ID NO: 532860 - protein, 8 aa, Mycobacterium
NRGTIGGS

SEQ ID NO: 532861 - protein, 7 aa, Mycobacterium
NRGTTTD

SEQ ID NO: 532862 - protein, 8 aa, Mycobacterium
NRGWSAAE

SEQ ID NO: 532863 - protein, 8 aa, Mycobacterium
NRHGQTRT

SEQ ID NO: 532864 - protein, 10 aa, Mycobacterium
NRHGRSEAAR

SEQ ID NO: 532865 - protein, 9 aa, Mycobacterium
NRHPDGDWS

SEQ ID NO: 532866 - protein, 6 aa, Mycobacterium
NRHPEL

SEQ ID NO: 532867 - protein, 6 aa, Mycobacterium
NRHPPP

SEQ ID NO: 532868 - protein, 7 aa, Mycobacterium
NRHPSIA

SEQ ID NO: 532869 - protein, 5 aa, Mycobacterium
NRHPV

SEQ ID NO: 532870 - protein, 4 aa, Mycobacterium
NRHR

SEQ ID NO: 532871 - protein, 5 aa, Mycobacterium
NRHRG

SEQ ID NO: 532872 - protein, 8 aa, Mycobacterium
NRHRGARG

SEQ ID NO: 532873 - protein, 15 aa, Mycobacterium
NRHRGTPQPLDDQTT

SEQ ID NO: 532874 - protein, 9 aa, Mycobacterium
NRHRPRSTF

SEQ ID NO: 532875 - protein, 12 aa, Mycobacterium
NRHTGGLETYRR

SEQ ID NO: 532876 - protein, 7 aa, Mycobacterium
NRIATAR

SEQ ID NO: 532877 - protein, 6 aa, Mycobacterium
NRIDGP

SEQ ID NO: 532878 - protein, 6 aa, Mycobacterium
NRIENP

SEQ ID NO: 532879 - protein, 12 aa, Mycobacterium
NRIGAESGEFGD

SEQ ID NO: 532880 - protein, 17 aa, Mycobacterium
NRIGGRVNTTRDWGPPL

SEQ ID NO: 532881 - protein, 8 aa, Mycobacterium
NRIGRARA

SEQ ID NO: 532882 - protein, 12 aa, Mycobacterium
NRIGTESEEFGD

SEQ ID NO: 532883 - protein, 7 aa, Mycobacterium
NRINPGD

SEQ ID NO: 532884 - protein, 21 aa, Mycobacterium
NRIPNSKEASMGKAKAARVAS

SEQ ID NO: 532885 - protein, 7 aa, Mycobacterium
NRIPPGS

SEQ ID NO: 532886 - protein, 7 aa, Mycobacterium
NRIQDPA

SEQ ID NO: 532887 - protein, 4 aa, Mycobacterium
NRIS

SEQ ID NO: 532888 - protein, 7 aa, Mycobacterium
NRISPDA

SEQ ID NO: 532889 - protein, 5 aa, Mycobacterium
NRKAS

SEQ ID NO: 532890 - protein, 11 aa, Mycobacterium
NRKDKAAEAIP

SEQ ID NO: 532891 - protein, 19 aa, Mycobacterium
NRKGRNNNPISEPGEVGSP

SEQ ID NO: 532892 - protein, 19 aa, Mycobacterium
NRKKAADKGSGEDRKANVN

SEQ ID NO: 532893 - protein, 12 aa, Mycobacterium
NRKLDKAASKGV

SEQ ID NO: 532894 - protein, 5 aa, Mycobacterium
NRKND

SEQ ID NO: 532895 - protein, 8 aa, Mycobacterium
NRKNPEEG

SEQ ID NO: 532896 - protein, 5 aa, Mycobacterium
NRKTE

SEQ ID NO: 532897 - protein, 4 aa, Mycobacterium
NRKW

SEQ ID NO: 532898 - protein, 4 aa, Mycobacterium
NRLD

SEQ ID NO: 532899 - protein, 15 aa, Mycobacterium
NRLEADAGLADGGYR

SEQ ID NO: 532900 - protein, 14 aa, Mycobacterium
NRLEHDAGEAWRRG

SEQ ID NO: 532901 - protein, 7 aa, Mycobacterium
NRLGGET

SEQ ID NO: 532902 - protein, 10 aa, Mycobacterium
NRLGRRGAKW

SEQ ID NO: 532903 - protein, 31 aa, Mycobacterium
NRLGSDPKNTNYAGGNTSAKGTDTDPVTGQP

SEQ ID NO: 532904 - protein, 9 aa, Mycobacterium
NRLPGKTGD

SEQ ID NO: 532905 - protein, 15 aa, Mycobacterium
NRLPGRHEDAARGAE

SEQ ID NO: 532906 - protein, 6 aa, Mycobacterium
NRLPGV

SEQ ID NO: 532907 - protein, 11 aa, Mycobacterium
NRLPSPGSRRN

SEQ ID NO: 532908 - protein, 9 aa, Mycobacterium
NRLRSKDSE

SEQ ID NO: 532909 - protein, 9 aa, Mycobacterium
NRLSTGDID

SEQ ID NO: 532910 - protein, 8 aa, Mycobacterium
NRLTPAQR

SEQ ID NO: 532911 - protein, 12 aa, Mycobacterium
NRMTEPTAQAEL

SEQ ID NO: 532912 - protein, 5 aa, Mycobacterium
NRNAV

SEQ ID NO: 532913 - protein, 6 aa, Mycobacterium
NRNDDA

SEQ ID NO: 532914 - protein, 6 aa, Mycobacterium
NRNDTI

SEQ ID NO: 532915 - protein, 4 aa, Mycobacterium
NRNF

SEQ ID NO: 532916 - protein, 8 aa, Mycobacterium
NRNFEGRI

SEQ ID NO: 532917 - protein, 7 aa, Mycobacterium
NRNGGRR

SEQ ID NO: 532918 - protein, 16 aa, Mycobacterium
NRNGTTPPAAPRRKPI

SEQ ID NO: 532919 - protein, 4 aa, Mycobacterium
NRNI

SEQ ID NO: 532920 - protein, 8 aa, Mycobacterium
NRNKKSVT

SEQ ID NO: 532921 - protein, 6 aa, Mycobacterium
NRNKQS

SEQ ID NO: 532922 - protein, 6 aa, Mycobacterium
NRNKRS

SEQ ID NO: 532923 - protein, 4 aa, Mycobacterium
NRNP

SEQ ID NO: 532924 - protein, 7 aa, Mycobacterium
NRNPTSD

SEQ ID NO: 532925 - protein, 4 aa, Mycobacterium
NRNQ

SEQ ID NO: 532926 - protein, 10 aa, Mycobacterium
NRNQGTLEES

SEQ ID NO: 532927 - protein, 9 aa, Mycobacterium
NRNQIRERA

SEQ ID NO: 532928 - protein, 7 aa, Mycobacterium
NRNQRHR

SEQ ID NO: 532929 - protein, 10 aa, Mycobacterium
NRNQRPTSRM

SEQ ID NO: 532930 - protein, 13 aa, Mycobacterium
NRNSEGRNNFDNP

SEQ ID NO: 532931 - protein, 4 aa, Mycobacterium
NRNT

SEQ ID NO: 532932 - protein, 4 aa, Mycobacterium
NRPA

SEQ ID NO: 532933 - protein, 25 aa, Mycobacterium
NRPAPPPPVPPPARPAARLGADNEA

SEQ ID NO: 532934 - protein, 7 aa, Mycobacterium
NRPAVTD

SEQ ID NO: 532935 - protein, 10 aa, Mycobacterium
NRPDADSDTV

SEQ ID NO: 532936 - protein, 5 aa, Mycobacterium
NRPDG

SEQ ID NO: 532937 - protein, 8 aa, Mycobacterium
NRPDHPDG

SEQ ID NO: 532938 - protein, 8 aa, Mycobacterium
NRPDPTPA

SEQ ID NO: 532939 - protein, 6 aa, Mycobacterium
NRPDQL

SEQ ID NO: 532940 - protein, 6 aa, Mycobacterium
NRPDRL

SEQ ID NO: 532941 - protein, 9 aa, Mycobacterium
NRPDSLNSL

SEQ ID NO: 532942 - protein, 9 aa, Mycobacterium
NRPDSPRPR

SEQ ID NO: 532943 - protein, 12 aa, Mycobacterium
NRPDTGSDAEYS

SEQ ID NO: 532944 - protein, 4 aa, Mycobacterium
NRPE

SEQ ID NO: 532945 - protein, 12 aa, Mycobacterium
NRPEATAETITD

SEQ ID NO: 532946 - protein, 7 aa, Mycobacterium
NRPEGLD

SEQ ID NO: 532947 - protein, 7 aa, Mycobacterium
NRPEGLG

SEQ ID NO: 532948 - protein, 9 aa, Mycobacterium
NRPEKGNAI

SEQ ID NO: 532949 - protein, 7 aa, Mycobacterium
NRPEQGN

SEQ ID NO: 532950 - protein, 6 aa, Mycobacterium
NRPERF

SEQ ID NO: 532951 - protein, 7 aa, Mycobacterium
NRPESLN

SEQ ID NO: 532952 - protein, 5 aa, Mycobacterium
NRPFD

SEQ ID NO: 532953 - protein, 9 aa, Mycobacterium
NRPFTSEDQ

SEQ ID NO: 532954 - protein, 4 aa, Mycobacterium
NRPG

SEQ ID NO: 532955 - protein, 9 aa, Mycobacterium
NRPGEPLPV

SEQ ID NO: 532956 - protein, 10 aa, Mycobacterium
NRPGGPGDEY

SEQ ID NO: 532957 - protein, 7 aa, Mycobacterium
NRPGGSV

SEQ ID NO: 532958 - protein, 13 aa, Mycobacterium
NRPGMSGDSTSWE

SEQ ID NO: 532959 - protein, 6 aa, Mycobacterium
NRPGQL

SEQ ID NO: 532960 - protein, 10 aa, Mycobacterium
NRPGRAVSTE

SEQ ID NO: 532961 - protein, 9 aa, Mycobacterium
NRPGSRNAL

SEQ ID NO: 532962 - protein, 5 aa, Mycobacterium
NRPGV

SEQ ID NO: 532963 - protein, 12 aa, Mycobacterium
NRPGVGDRGERA

SEQ ID NO: 532964 - protein, 9 aa, Mycobacterium
NRPGVRENT

SEQ ID NO: 532965 - protein, 13 aa, Mycobacterium
NRPGVRENTRAEV

SEQ ID NO: 532966 - protein, 11 aa, Mycobacterium
NRPIPTPPTLG

SEQ ID NO: 532967 - protein, 18 aa, Mycobacterium
NRPKNAKVATNQQGGPMQ

SEQ ID NO: 532968 - protein, 14 aa, Mycobacterium
NRPKPKARARRKVS

SEQ ID NO: 532969 - protein, 13 aa, Mycobacterium
NRPKVGPRREEAQ

SEQ ID NO: 532970 - protein, 5 aa, Mycobacterium
NRPMT

SEQ ID NO: 532971 - protein, 9 aa, Mycobacterium
NRPNIPDFD

SEQ ID NO: 532972 - protein, 7 aa, Mycobacterium
NRPNIPE

SEQ ID NO: 532973 - protein, 9 aa, Mycobacterium
NRPPASPPR

SEQ ID NO: 532974 - protein, 10 aa, Mycobacterium
NRPPAYGTLP

SEQ ID NO: 532975 - protein, 6 aa, Mycobacterium
NRPPEP

SEQ ID NO: 532976 - protein, 9 aa, Mycobacterium
NRPPKERPR

SEQ ID NO: 532977 - protein, 5 aa, Mycobacterium
NRPPR

SEQ ID NO: 532978 - protein, 7 aa, Mycobacterium
NRPPTPH

SEQ ID NO: 532979 - protein, 6 aa, Mycobacterium
NRPQRE

SEQ ID NO: 532980 - protein, 9 aa, Mycobacterium
NRPQSRNAL

SEQ ID NO: 532981 - protein, 11 aa, Mycobacterium
NRPQSRNALSA

SEQ ID NO: 532982 - protein, 4 aa, Mycobacterium
NRPR

SEQ ID NO: 532983 - protein, 9 aa, Mycobacterium
NRPRASVDP

SEQ ID NO: 532984 - protein, 14 aa, Mycobacterium
NRPRHTLEDRSPAE

SEQ ID NO: 532985 - protein, 18 aa, Mycobacterium
NRPSETVTLSRPQDGITA

SEQ ID NO: 532986 - protein, 6 aa, Mycobacterium
NRPSGA

SEQ ID NO: 532987 - protein, 19 aa, Mycobacterium
NRPSGPPSASSADKDRAGI

SEQ ID NO: 532988 - protein, 19 aa, Mycobacterium
NRPTDGDRSRSARNNRATY

SEQ ID NO: 532989 - protein, 7 aa, Mycobacterium
NRPTHYR

SEQ ID NO: 532990 - protein, 5 aa, Mycobacterium
NRPTM

SEQ ID NO: 532991 - protein, 6 aa, Mycobacterium
NRPTTG

SEQ ID NO: 532992 - protein, 14 aa, Mycobacterium
NRPTTKFEGKAHTV

SEQ ID NO: 532993 - protein, 6 aa, Mycobacterium
NRPVSG

SEQ ID NO: 532994 - protein, 17 aa, Mycobacterium
NRPVSGYYNGHDTGVDA

SEQ ID NO: 532995 - protein, 12 aa, Mycobacterium
NRPYPGDHPVQQ

SEQ ID NO: 532996 - protein, 6 aa, Mycobacterium
NRQAAQ

SEQ ID NO: 532997 - protein, 4 aa, Mycobacterium
NRQD

SEQ ID NO: 532998 - protein, 10 aa, Mycobacterium
NRQDGAASYE

SEQ ID NO: 532999 - protein, 11 aa, Mycobacterium
NRQDGAASYEE

SEQ ID NO: 533000 - protein, 13 aa, Mycobacterium
NRQHENNGQRQAG

SEQ ID NO: 533001 - protein, 8 aa, Mycobacterium
NRQPEAEE

SEQ ID NO: 533002 - protein, 21 aa, Mycobacterium
NRQPETGESQGPIRRLLGRIG

SEQ ID NO: 533003 - protein, 10 aa, Mycobacterium
NRQPLNGTYP

SEQ ID NO: 533004 - protein, 11 aa, Mycobacterium
NRQPLNGTYPE

SEQ ID NO: 533005 - protein, 9 aa, Mycobacterium
NRQPPRAPE

SEQ ID NO: 533006 - protein, 8 aa, Mycobacterium
NRQPRADG

SEQ ID NO: 533007 - protein, 11 aa, Mycobacterium
NRQPSAEVMTR

SEQ ID NO: 533008 - protein, 4 aa, Mycobacterium
NRQR

SEQ ID NO: 533009 - protein, 13 aa, Mycobacterium
NRQRHGRGERITE

SEQ ID NO: 533010 - protein, 6 aa, Mycobacterium
NRQRSV

SEQ ID NO: 533011 - protein, 5 aa, Mycobacterium
NRQSG

SEQ ID NO: 533012 - protein, 17 aa, Mycobacterium
NRQSHPAGATPFAVASA

SEQ ID NO: 533013 - protein, 4 aa, Mycobacterium
NRQV

SEQ ID NO: 533014 - protein, 10 aa, Mycobacterium
NRRAGSQGVG

SEQ ID NO: 533015 - protein, 12 aa, Mycobacterium
NRRATDSSTVPD

SEQ ID NO: 533016 - protein, 9 aa, Mycobacterium
NRRATQSKA

SEQ ID NO: 533017 - protein, 5 aa, Mycobacterium
NRRDD

SEQ ID NO: 533018 - protein, 15 aa, Mycobacterium
NRRDDAGVDEQDAAA

SEQ ID NO: 533019 - protein, 10 aa, Mycobacterium
NRRDLTAGQA

SEQ ID NO: 533020 - protein, 6 aa, Mycobacterium
NRREAR

SEQ ID NO: 533021 - protein, 9 aa, Mycobacterium
NRREPPLAA

SEQ ID NO: 533022 - protein, 5 aa, Mycobacterium
NRRFD

SEQ ID NO: 533023 - protein, 17 aa, Mycobacterium
NRRGEPAPKTTAWGKTS

SEQ ID NO: 533024 - protein, 6 aa, Mycobacterium
NRRGGR

SEQ ID NO: 533025 - protein, 10 aa, Mycobacterium
NRRGNATRES

SEQ ID NO: 533026 - protein, 6 aa, Mycobacterium
NRRGQN

SEQ ID NO: 533027 - protein, 7 aa, Mycobacterium
NRRGRAA

SEQ ID NO: 533028 - protein, 10 aa, Mycobacterium
NRRGRDKARG

SEQ ID NO: 533029 - protein, 7 aa, Mycobacterium
NRRGRDV

SEQ ID NO: 533030 - protein, 8 aa, Mycobacterium
NRRGRPAR

SEQ ID NO: 533031 - protein, 17 aa, Mycobacterium
NRRGSAAGDRQDDPTPI

SEQ ID NO: 533032 - protein, 12 aa, Mycobacterium
NRRHHRGSAESF

SEQ ID NO: 533033 - protein, 11 aa, Mycobacterium
NRRHHRTTAES

SEQ ID NO: 533034 - protein, 4 aa, Mycobacterium
NRRK

SEQ ID NO: 533035 - protein, 7 aa, Mycobacterium
NRRPAPG

SEQ ID NO: 533036 - protein, 6 aa, Mycobacterium
NRRPAR

SEQ ID NO: 533037 - protein, 8 aa, Mycobacterium
NRRPPAGG

SEQ ID NO: 533038 - protein, 6 aa, Mycobacterium
NRRPPC

SEQ ID NO: 533039 - protein, 9 aa, Mycobacterium
NRRPPDPNQ

SEQ ID NO: 533040 - protein, 10 aa, Mycobacterium
NRRPPEPAGE

SEQ ID NO: 533041 - protein, 6 aa, Mycobacterium
NRRPPR

SEQ ID NO: 533042 - protein, 8 aa, Mycobacterium
NRRPRGSY

SEQ ID NO: 533043 - protein, 8 aa, Mycobacterium
NRRPTGER

SEQ ID NO: 533044 - protein, 11 aa, Mycobacterium
NRRQAKTRADE

SEQ ID NO: 533045 - protein, 6 aa, Mycobacterium
NRRQAR

SEQ ID NO: 533046 - protein, 6 aa, Mycobacterium
NRRQTK

SEQ ID NO: 533047 - protein, 7 aa, Mycobacterium
NRRRART

SEQ ID NO: 533048 - protein, 12 aa, Mycobacterium
NRRRERGLPSPT

SEQ ID NO: 533049 - protein, 10 aa, Mycobacterium
NRRRTLTAKD

SEQ ID NO: 533050 - protein, 9 aa, Mycobacterium
NRRSAATPS

SEQ ID NO: 533051 - protein, 9 aa, Mycobacterium
NRRSAPPVG

SEQ ID NO: 533052 - protein, 11 aa, Mycobacterium
NRRSESATDTT

SEQ ID NO: 533053 - protein, 7 aa, Mycobacterium
NRRSGGD

SEQ ID NO: 533054 - protein, 10 aa, Mycobacterium
NRRSPPGIQT

SEQ ID NO: 533055 - protein, 8 aa, Mycobacterium
NRRSRDVA

SEQ ID NO: 533056 - protein, 18 aa, Mycobacterium
NRRSRDVPEVRSTHAGGG

SEQ ID NO: 533057 - protein, 22 aa, Mycobacterium
NRRSTARVTGSIPGAPASLTGD

SEQ ID NO: 533058 - protein, 8 aa, Mycobacterium
NRRTAADY

SEQ ID NO: 533059 - protein, 7 aa, Mycobacterium
NRRTDRR

SEQ ID NO: 533060 - protein, 8 aa, Mycobacterium
NRRTGNNF

SEQ ID NO: 533061 - protein, 8 aa, Mycobacterium
NRRTTSDT

SEQ ID NO: 533062 - protein, 7 aa, Mycobacterium
NRRYQEA

SEQ ID NO: 533063 - protein, 18 aa, Mycobacterium
NRSAEGDDIARPVSRGLD

SEQ ID NO: 533064 - protein, 8 aa, Mycobacterium
NRSAPAAA

SEQ ID NO: 533065 - protein, 15 aa, Mycobacterium
NRSDASTPTPPRRKP

SEQ ID NO: 533066 - protein, 13 aa, Mycobacterium
NRSDSTTSPPGIS

SEQ ID NO: 533067 - protein, 5 aa, Mycobacterium
NRSDV

SEQ ID NO: 533068 - protein, 5 aa, Mycobacterium
NRSEA

SEQ ID NO: 533069 - protein, 6 aa, Mycobacterium
NRSKRS

SEQ ID NO: 533070 - protein, 22 aa, Mycobacterium
NRSLQPTKGTRAEQAVRRSAKT

SEQ ID NO: 533071 - protein, 5 aa, Mycobacterium
NRSLS

SEQ ID NO: 533072 - protein, 4 aa, Mycobacterium
NRSN

SEQ ID NO: 533073 - protein, 9 aa, Mycobacterium
NRSPAKAAQ

SEQ ID NO: 533074 - protein, 9 aa, Mycobacterium
NRSPDGAVE

SEQ ID NO: 533075 - protein, 12 aa, Mycobacterium
NRSPDGELTPAD

SEQ ID NO: 533076 - protein, 6 aa, Mycobacterium
NRSPLP

SEQ ID NO: 533077 - protein, 16 aa, Mycobacterium
NRSQDDPLTLSTGNAA

SEQ ID NO: 533078 - protein, 4 aa, Mycobacterium
NRSR

SEQ ID NO: 533079 - protein, 5 aa, Mycobacterium
NRSRR

SEQ ID NO: 533080 - protein, 8 aa, Mycobacterium
NRSRTRAA

SEQ ID NO: 533081 - protein, 26 aa, Mycobacterium
NRSSAPDEPVAASRPRIPSARERAGA

SEQ ID NO: 533082 - protein, 7 aa, Mycobacterium
NRSSGGL

SEQ ID NO: 533083 - protein, 6 aa, Mycobacterium
NRSSLG

SEQ ID NO: 533084 - protein, 6 aa, Mycobacterium
NRSTVA

SEQ ID NO: 533085 - protein, 4 aa, Mycobacterium
NRSV

SEQ ID NO: 533086 - protein, 26 aa, Mycobacterium
NRSYDAKALNPYRRQHSGVESKKGQW

SEQ ID NO: 533087 - protein, 5 aa, Mycobacterium
NRTAD

SEQ ID NO: 533088 - protein, 8 aa, Mycobacterium
NRTAGASL

SEQ ID NO: 533089 - protein, 6 aa, Mycobacterium
NRTAQG

SEQ ID NO: 533090 - protein, 11 aa, Mycobacterium
NRTARDPRPTA

SEQ ID NO: 533091 - protein, 7 aa, Mycobacterium
NRTATDL

SEQ ID NO: 533092 - protein, 9 aa, Mycobacterium
NRTDGTQTE

SEQ ID NO: 533093 - protein, 10 aa, Mycobacterium
NRTDRPGHLT

SEQ ID NO: 533094 - protein, 5 aa, Mycobacterium
NRTEE

SEQ ID NO: 533095 - protein, 8 aa, Mycobacterium
NRTEGFSG

SEQ ID NO: 533096 - protein, 16 aa, Mycobacterium
NRTELGRQMDSLRDGP

SEQ ID NO: 533097 - protein, 9 aa, Mycobacterium
NRTETATDY

SEQ ID NO: 533098 - protein, 4 aa, Mycobacterium
NRTG

SEQ ID NO: 533099 - protein, 9 aa, Mycobacterium
NRTGETEDV

SEQ ID NO: 533100 - protein, 12 aa, Mycobacterium
NRTGLQHQAQSG

SEQ ID NO: 533101 - protein, 12 aa, Mycobacterium
NRTGSRPRLTDD

SEQ ID NO: 533102 - protein, 6 aa, Mycobacterium
NRTGTV

SEQ ID NO: 533103 - protein, 7 aa, Mycobacterium
NRTHPSA

SEQ ID NO: 533104 - protein, 13 aa, Mycobacterium
NRTKSHGQRQAGH

SEQ ID NO: 533105 - protein, 11 aa, Mycobacterium
NRTLDKEPRWR

SEQ ID NO: 533106 - protein, 4 aa, Mycobacterium
NRTN

SEQ ID NO: 533107 - protein, 8 aa, Mycobacterium
NRTPAALA

SEQ ID NO: 533108 - protein, 6 aa, Mycobacterium
NRTPGA

SEQ ID NO: 533109 - protein, 13 aa, Mycobacterium
NRTPNRGPGAEGA

SEQ ID NO: 533110 - protein, 10 aa, Mycobacterium
NRTPPKTQSA

SEQ ID NO: 533111 - protein, 12 aa, Mycobacterium
NRTPSLASCSSA

SEQ ID NO: 533112 - protein, 8 aa, Mycobacterium
NRTRGPLT

SEQ ID NO: 533113 - protein, 12 aa, Mycobacterium
NRTRKQLKQARR

SEQ ID NO: 533114 - protein, 5 aa, Mycobacterium
NRTRY

SEQ ID NO: 533115 - protein, 13 aa, Mycobacterium
NRTSGPRRPAGGA

SEQ ID NO: 533116 - protein, 8 aa, Mycobacterium
NRTSTAER

SEQ ID NO: 533117 - protein, 13 aa, Mycobacterium
NRTSTYPSTEQTL

SEQ ID NO: 533118 - protein, 14 aa, Mycobacterium
NRTTEAGPGEPGSV

SEQ ID NO: 533119 - protein, 8 aa, Mycobacterium
NRTTQAGL

SEQ ID NO: 533120 - protein, 12 aa, Mycobacterium
NRTTTGNTRPGQ

SEQ ID NO: 533121 - protein, 10 aa, Mycobacterium
NRTVGDPDAK

SEQ ID NO: 533122 - protein, 6 aa, Mycobacterium
NRTVNA

SEQ ID NO: 533123 - protein, 17 aa, Mycobacterium
NRTYGLDTERGETMQPQ

SEQ ID NO: 533124 - protein, 9 aa, Mycobacterium
NRVGARGAQ

SEQ ID NO: 533125 - protein, 9 aa, Mycobacterium
NRVGARSAD

SEQ ID NO: 533126 - protein, 8 aa, Mycobacterium
NRVGGTWR

SEQ ID NO: 533127 - protein, 12 aa, Mycobacterium
NRVKDGDATAHP

SEQ ID NO: 533128 - protein, 5 aa, Mycobacterium
NRVPN

SEQ ID NO: 533129 - protein, 7 aa, Mycobacterium
NRVPPGS

SEQ ID NO: 533130 - protein, 4 aa, Mycobacterium
NRVQ

SEQ ID NO: 533131 - protein, 9 aa, Mycobacterium
NRVRGGGAQ

SEQ ID NO: 533132 - protein, 4 aa, Mycobacterium
NRVT

SEQ ID NO: 533133 - protein, 21 aa, Mycobacterium
NRWRRPASENRGYSPPKSESL

SEQ ID NO: 533134 - protein, 4 aa, Mycobacterium
NRYA

SEQ ID NO: 533135 - protein, 8 aa, Mycobacterium
NRYAESEH

SEQ ID NO: 533136 - protein, 9 aa, Mycobacterium
NRYAPAARR

SEQ ID NO: 533137 - protein, 6 aa, Mycobacterium
NRYATA

SEQ ID NO: 533138 - protein, 5 aa, Mycobacterium
NRYGA

SEQ ID NO: 533139 - protein, 8 aa, Mycobacterium
NRYGRTRS

SEQ ID NO: 533140 - protein, 7 aa, Mycobacterium
NRYGSGY

SEQ ID NO: 533141 - protein, 17 aa, Mycobacterium
NRYGYSPPGHRQGRGVD

SEQ ID NO: 533142 - protein, 7 aa, Mycobacterium
NRYNEIS

SEQ ID NO: 533143 - protein, 5 aa, Mycobacterium
NRYPD

SEQ ID NO: 533144 - protein, 7 aa, Mycobacterium
NRYPDNG

SEQ ID NO: 533145 - protein, 15 aa, Mycobacterium
NRYPPPPPYPAPDPF

SEQ ID NO: 533146 - protein, 5 aa, Mycobacterium
NRYRN

SEQ ID NO: 533147 - protein, 4 aa, Mycobacterium
NSAA

SEQ ID NO: 533148 - protein, 10 aa, Mycobacterium
NSAAADLSPA

SEQ ID NO: 533149 - protein, 15 aa, Mycobacterium
NSAAPPATPEDLAET

SEQ ID NO: 533150 - protein, 8 aa, Mycobacterium
NSAAPSVA

SEQ ID NO: 533151 - protein, 8 aa, Mycobacterium
NSAAPSVD

SEQ ID NO: 533152 - protein, 11 aa, Mycobacterium
NSAATLTRPDA

SEQ ID NO: 533153 - protein, 6 aa, Mycobacterium
NSADED

SEQ ID NO: 533154 - protein, 12 aa, Mycobacterium
NSADGADGAIDP

SEQ ID NO: 533155 - protein, 11 aa, Mycobacterium
NSADPPPGPRA

SEQ ID NO: 533156 - protein, 8 aa, Mycobacterium
NSADRTTL

SEQ ID NO: 533157 - protein, 6 aa, Mycobacterium
NSADSA

SEQ ID NO: 533158 - protein, 6 aa, Mycobacterium
NSAEED

SEQ ID NO: 533159 - protein, 11 aa, Mycobacterium
NSAEPPPGPRA

SEQ ID NO: 533160 - protein, 7 aa, Mycobacterium
NSAETDA

SEQ ID NO: 533161 - protein, 9 aa, Mycobacterium
NSAGITTTS

SEQ ID NO: 533162 - protein, 14 aa, Mycobacterium
NSAGKLGPHPYPAG

SEQ ID NO: 533163 - protein, 15 aa, Mycobacterium
NSAGKPGLSVGPGNA

SEQ ID NO: 533164 - protein, 10 aa, Mycobacterium
NSAGPGSPVA

SEQ ID NO: 533165 - protein, 8 aa, Mycobacterium
NSAGTQSG

SEQ ID NO: 533166 - protein, 4 aa, Mycobacterium
NSAI

SEQ ID NO: 533167 - protein, 4 aa, Mycobacterium
NSAK

SEQ ID NO: 533168 - protein, 6 aa, Mycobacterium
NSAKPY

SEQ ID NO: 533169 - protein, 4 aa, Mycobacterium
NSAL

SEQ ID NO: 533170 - protein, 15 aa, Mycobacterium
NSALPGSALSRNPAV

SEQ ID NO: 533171 - protein, 4 aa, Mycobacterium
NSAM

SEQ ID NO: 533172 - protein, 12 aa, Mycobacterium
NSANTAGQEGRE

SEQ ID NO: 533173 - protein, 8 aa, Mycobacterium
NSAPGSRI

SEQ ID NO: 533174 - protein, 8 aa, Mycobacterium
NSAPGVNT

SEQ ID NO: 533175 - protein, 7 aa, Mycobacterium
NSAPLRP

SEQ ID NO: 533176 - protein, 6 aa, Mycobacterium
NSAPSH

SEQ ID NO: 533177 - protein, 8 aa, Mycobacterium
NSAPSLPS

SEQ ID NO: 533178 - protein, 16 aa, Mycobacterium
NSAQLQAEHDAQPKVA

SEQ ID NO: 533179 - protein, 5 aa, Mycobacterium
NSARD

SEQ ID NO: 533180 - protein, 7 aa, Mycobacterium
NSARSQL

SEQ ID NO: 533181 - protein, 8 aa, Mycobacterium
NSARTPAG

SEQ ID NO: 533182 - protein, 15 aa, Mycobacterium
NSASADPAEGQAPKP

SEQ ID NO: 533183 - protein, 12 aa, Mycobacterium
NSASKSKAVADS

SEQ ID NO: 533184 - protein, 13 aa, Mycobacterium
NSASKSKAVADSE

SEQ ID NO: 533185 - protein, 13 aa, Mycobacterium
NSASTYPTTEQTL

SEQ ID NO: 533186 - protein, 5 aa, Mycobacterium
NSATA

SEQ ID NO: 533187 - protein, 27 aa, Mycobacterium
NSATGWPRRGSPNTRSATTAAAIPEAR

SEQ ID NO: 533188 - protein, 8 aa, Mycobacterium
NSATKAGI

SEQ ID NO: 533189 - protein, 9 aa, Mycobacterium
NSATKAGVK

SEQ ID NO: 533190 - protein, 14 aa, Mycobacterium
NSATKELRASGDPD

SEQ ID NO: 533191 - protein, 7 aa, Mycobacterium
NSATQAG

SEQ ID NO: 533192 - protein, 14 aa, Mycobacterium
NSATQSSAGSARQT

SEQ ID NO: 533193 - protein, 4 aa, Mycobacterium
NSAV

SEQ ID NO: 533194 - protein, 13 aa, Mycobacterium
NSAVGASYGSILT

SEQ ID NO: 533195 - protein, 11 aa, Mycobacterium
NSCGSSAQAYG

SEQ ID NO: 533196 - protein, 6 aa, Mycobacterium
NSDAAL

SEQ ID NO: 533197 - protein, 8 aa, Mycobacterium
NSDAAPMA

SEQ ID NO: 533198 - protein, 6 aa, Mycobacterium
NSDAAR

SEQ ID NO: 533199 - protein, 11 aa, Mycobacterium
NSDAFDEPRVG

SEQ ID NO: 533200 - protein, 10 aa, Mycobacterium
NSDAKRKAAG

SEQ ID NO: 533201 - protein, 7 aa, Mycobacterium
NSDAPAI

SEQ ID NO: 533202 - protein, 5 aa, Mycobacterium
NSDDR

SEQ ID NO: 533203 - protein, 11 aa, Mycobacterium
NSDEENLTPQE

SEQ ID NO: 533204 - protein, 6 aa, Mycobacterium
NSDEER

SEQ ID NO: 533205 - protein, 5 aa, Mycobacterium
NSDGE

SEQ ID NO: 533206 - protein, 5 aa, Mycobacterium
NSDGG

SEQ ID NO: 533207 - protein, 16 aa, Mycobacterium
NSDGKEIAGEIGPDGV

SEQ ID NO: 533208 - protein, 5 aa, Mycobacterium
NSDGR

SEQ ID NO: 533209 - protein, 13 aa, Mycobacterium
NSDGRPVSGGADA

SEQ ID NO: 533210 - protein, 6 aa, Mycobacterium
NSDGRR

SEQ ID NO: 533211 - protein, 5 aa, Mycobacterium
NSDHG

SEQ ID NO: 533212 - protein, 10 aa, Mycobacterium
NSDLEGTPQL

SEQ ID NO: 533213 - protein, 7 aa, Mycobacterium
NSDNALP

SEQ ID NO: 533214 - protein, 6 aa, Mycobacterium
NSDNPA

SEQ ID NO: 533215 - protein, 8 aa, Mycobacterium
NSDPDEAD

SEQ ID NO: 533216 - protein, 8 aa, Mycobacterium
NSDPDVND

SEQ ID NO: 533217 - protein, 5 aa, Mycobacterium
NSDPG

SEQ ID NO: 533218 - protein, 18 aa, Mycobacterium
NSDPPSQAAFNANSSQYL

SEQ ID NO: 533219 - protein, 7 aa, Mycobacterium
NSDPYGD

SEQ ID NO: 533220 - protein, 13 aa, Mycobacterium
NSDQSEGGEQDGL

SEQ ID NO: 533221 - protein, 8 aa, Mycobacterium
NSDQSPGI

SEQ ID NO: 533222 - protein, 5 aa, Mycobacterium
NSDRA

SEQ ID NO: 533223 - protein, 5 aa, Mycobacterium
NSDRY

SEQ ID NO: 533224 - protein, 8 aa, Mycobacterium
NSDSGYER

SEQ ID NO: 533225 - protein, 9 aa, Mycobacterium
NSDTTKTAL

SEQ ID NO: 533226 - protein, 6 aa, Mycobacterium
NSDVQA

SEQ ID NO: 533227 - protein, 8 aa, Mycobacterium
NSDVSPPI

SEQ ID NO: 533228 - protein, 4 aa, Mycobacterium
NSEA

SEQ ID NO: 533229 - protein, 13 aa, Mycobacterium
NSEALSNANGVSM

SEQ ID NO: 533230 - protein, 7 aa, Mycobacterium
NSEAPAI

SEQ ID NO: 533231 - protein, 14 aa, Mycobacterium
NSEAPTAVGSDVAG

SEQ ID NO: 533232 - protein, 17 aa, Mycobacterium
NSEATEAAVEELGGSEV

SEQ ID NO: 533233 - protein, 6 aa, Mycobacterium
NSEATQ

SEQ ID NO: 533234 - protein, 4 aa, Mycobacterium
NSED

SEQ ID NO: 533235 - protein, 8 aa, Mycobacterium
NSEGGAAL

SEQ ID NO: 533236 - protein, 5 aa, Mycobacterium
NSEGL

SEQ ID NO: 533237 - protein, 8 aa, Mycobacterium
NSEGSQLA

SEQ ID NO: 533238 - protein, 16 aa, Mycobacterium
NSEHDRMRASSDVDAR

SEQ ID NO: 533239 - protein, 7 aa, Mycobacterium
NSEHGSL

SEQ ID NO: 533240 - protein, 6 aa, Mycobacterium
NSEKQA

SEQ ID NO: 533241 - protein, 6 aa, Mycobacterium
NSEMQV

SEQ ID NO: 533242 - protein, 7 aa, Mycobacterium
NSEPADM

SEQ ID NO: 533243 - protein, 8 aa, Mycobacterium
NSEPATAR

SEQ ID NO: 533244 - protein, 9 aa, Mycobacterium
NSEPGPGPL

SEQ ID NO: 533245 - protein, 15 aa, Mycobacterium
NSEPLGDEEAIDRSG

SEQ ID NO: 533246 - protein, 10 aa, Mycobacterium
NSEPTAPTEC

SEQ ID NO: 533247 - protein, 8 aa, Mycobacterium
NSEQAAAV

SEQ ID NO: 533248 - protein, 5 aa, Mycobacterium
NSERD

SEQ ID NO: 533249 - protein, 38 aa, Mycobacterium
NSERHAARARRAEARADAGRRHPSSLTNGAPVHDPAET

SEQ ID NO: 533250 - protein, 8 aa, Mycobacterium
NSERIRGA

SEQ ID NO: 533251 - protein, 11 aa, Mycobacterium
NSERRKDRAQV

SEQ ID NO: 533252 - protein, 13 aa, Mycobacterium
NSESDLRALAQLQ

SEQ ID NO: 533253 - protein, 10 aa, Mycobacterium
NSETGEESRL

SEQ ID NO: 533254 - protein, 6 aa, Mycobacterium
NSETGL

SEQ ID NO: 533255 - protein, 15 aa, Mycobacterium
NSETGRTWGKTEPGW

SEQ ID NO: 533256 - protein, 5 aa, Mycobacterium
NSETR

SEQ ID NO: 533257 - protein, 5 aa, Mycobacterium
NSEVT

SEQ ID NO: 533258 - protein, 9 aa, Mycobacterium
NSEYGKANR

SEQ ID NO: 533259 - protein, 6 aa, Mycobacterium
NSFAEA

SEQ ID NO: 533260 - protein, 12 aa, Mycobacterium
NSFDPSMSPPGK

SEQ ID NO: 533261 - protein, 12 aa, Mycobacterium
NSFEAQAARDGL

SEQ ID NO: 533262 - protein, 8 aa, Mycobacterium
NSFEGHRT

SEQ ID NO: 533263 - protein, 17 aa, Mycobacterium
NSFGGPHADPEAAGDGG

SEQ ID NO: 533264 - protein, 27 aa, Mycobacterium
NSFPGSSGTGGDPGGTGGNGGAGGSGG

SEQ ID NO: 533265 - protein, 13 aa, Mycobacterium
NSFSSDGKTWQGD

SEQ ID NO: 533266 - protein, 6 aa, Mycobacterium
NSFTGT

SEQ ID NO: 533267 - protein, 6 aa, Mycobacterium
NSFTKA

SEQ ID NO: 533268 - protein, 5 aa, Mycobacterium
NSGAA

SEQ ID NO: 533269 - protein, 10 aa, Mycobacterium
NSGAGNSGFF

SEQ ID NO: 533270 - protein, 9 aa, Mycobacterium
NSGAGNTGL

SEQ ID NO: 533271 - protein, 16 aa, Mycobacterium
NSGAHNTGAFNAGGYN

SEQ ID NO: 533272 - protein, 10 aa, Mycobacterium
NSGAIDTGFG

SEQ ID NO: 533273 - protein, 9 aa, Mycobacterium
NSGANNSGF

SEQ ID NO: 533274 - protein, 6 aa, Mycobacterium
NSGASL

SEQ ID NO: 533275 - protein, 11 aa, Mycobacterium
NSGATAVVEGT

SEQ ID NO: 533276 - protein, 13 aa, Mycobacterium
NSGATSGATTQKG

SEQ ID NO: 533277 - protein, 4 aa, Mycobacterium
NSGD

SEQ ID NO: 533278 - protein, 5 aa, Mycobacterium
NSGDG

SEQ ID NO: 533279 - protein, 44 aa, Mycobacterium
NSGDGGRNSGWVNSGDGGQNSGLHNTGDTSSGGFNTGSGQSGFF

SEQ ID NO: 533280 - protein, 7 aa, Mycobacterium
NSGDGLS

SEQ ID NO: 533281 - protein, 19 aa, Mycobacterium
NSGDGSASGFGNGGGSNSG

SEQ ID NO: 533282 - protein, 12 aa, Mycobacterium
NSGDGSSSGFGN

SEQ ID NO: 533283 - protein, 10 aa, Mycobacterium
NSGDGSVSGF

SEQ ID NO: 533284 - protein, 6 aa, Mycobacterium
NSGDNG

SEQ ID NO: 533285 - protein, 8 aa, Mycobacterium
NSGDPSWP

SEQ ID NO: 533286 - protein, 29 aa, Mycobacterium
NSGDSNTGYAGSGNYNTGGFNSGASNTGF

SEQ ID NO: 533287 - protein, 6 aa, Mycobacterium
NSGDTE

SEQ ID NO: 533288 - protein, 7 aa, Mycobacterium
NSGDYNT

SEQ ID NO: 533289 - protein, 6 aa, Mycobacterium
NSGEEL

SEQ ID NO: 533290 - protein, 10 aa, Mycobacterium
NSGEGSASGF

SEQ ID NO: 533291 - protein, 10 aa, Mycobacterium
NSGEGSTSGF

SEQ ID NO: 533292 - protein, 7 aa, Mycobacterium
NSGERWD

SEQ ID NO: 533293 - protein, 8 aa, Mycobacterium
NSGEWDGE

SEQ ID NO: 533294 - protein, 4 aa, Mycobacterium
NSGG

SEQ ID NO: 533295 - protein, 9 aa, Mycobacterium
NSGGAGEVA

SEQ ID NO: 533296 - protein, 10 aa, Mycobacterium
NSGGGGASGL

SEQ ID NO: 533297 - protein, 6 aa, Mycobacterium
NSGGGS

SEQ ID NO: 533298 - protein, 17 aa, Mycobacterium
NSGGKTAEAAAHQNAGL

SEQ ID NO: 533299 - protein, 17 aa, Mycobacterium
NSGGNVFGSGNRANATI

SEQ ID NO: 533300 - protein, 9 aa, Mycobacterium
NSGGPYPSH

SEQ ID NO: 533301 - protein, 9 aa, Mycobacterium
NSGGSATFI

SEQ ID NO: 533302 - protein, 12 aa, Mycobacterium
NSGGSSATTNTG

SEQ ID NO: 533303 - protein, 5 aa, Mycobacterium
NSGGT

SEQ ID NO: 533304 - protein, 8 aa, Mycobacterium
NSGGTGSL

SEQ ID NO: 533305 - protein, 11 aa, Mycobacterium
NSGGVPARAVS

SEQ ID NO: 533306 - protein, 8 aa, Mycobacterium
NSGHPIGN

SEQ ID NO: 533307 - protein, 7 aa, Mycobacterium
NSGHSTL

SEQ ID NO: 533308 - protein, 10 aa, Mycobacterium
NSGINPDDLA

SEQ ID NO: 533309 - protein, 14 aa, Mycobacterium
NSGINPGSTAGTEG

SEQ ID NO: 533310 - protein, 7 aa, Mycobacterium
NSGLRNY

SEQ ID NO: 533311 - protein, 13 aa, Mycobacterium
NSGNDNTGIGNSG

SEQ ID NO: 533312 - protein, 9 aa, Mycobacterium
NSGNHNSGW

SEQ ID NO: 533313 - protein, 53 aa, Mycobacterium
NSGNNDPGLRNTTVREPVSGAPVLPGSGIPKSTFYPSREPADPGTGIKLPVRS

SEQ ID NO: 533314 - protein, 7 aa, Mycobacterium
NSGNSPL

SEQ ID NO: 533315 - protein, 6 aa, Mycobacterium
NSGNTI

SEQ ID NO: 533316 - protein, 8 aa, Mycobacterium
NSGNTNTG

SEQ ID NO: 533317 - protein, 15 aa, Mycobacterium
NSGNTNTGFGNGGSV

SEQ ID NO: 533318 - protein, 7 aa, Mycobacterium
NSGPAIA

SEQ ID NO: 533319 - protein, 10 aa, Mycobacterium
NSGPGAGSGF

SEQ ID NO: 533320 - protein, 10 aa, Mycobacterium
NSGPGGVSGF

SEQ ID NO: 533321 - protein, 9 aa, Mycobacterium
NSGPGPEPL

SEQ ID NO: 533322 - protein, 6 aa, Mycobacterium
NSGPGT

SEQ ID NO: 533323 - protein, 5 aa, Mycobacterium
NSGPL

SEQ ID NO: 533324 - protein, 9 aa, Mycobacterium
NSGPLPDEI

SEQ ID NO: 533325 - protein, 9 aa, Mycobacterium
NSGPLPEEI

SEQ ID NO: 533326 - protein, 9 aa, Mycobacterium
NSGPLPEEV

SEQ ID NO: 533327 - protein, 4 aa, Mycobacterium
NSGQ

SEQ ID NO: 533328 - protein, 6 aa, Mycobacterium
NSGQDC

SEQ ID NO: 533329 - protein, 12 aa, Mycobacterium
NSGQKDAATAQT

SEQ ID NO: 533330 - protein, 4 aa, Mycobacterium
NSGR

SEQ ID NO: 533331 - protein, 11 aa, Mycobacterium
NSGRAWPPGGQ

SEQ ID NO: 533332 - protein, 5 aa, Mycobacterium
NSGRF

SEQ ID NO: 533333 - protein, 25 aa, Mycobacterium
NSGRGAAARRSASQRADSASRHPSV

SEQ ID NO: 533334 - protein, 4 aa, Mycobacterium
NSGS

SEQ ID NO: 533335 - protein, 9 aa, Mycobacterium
NSGSAGELV

SEQ ID NO: 533336 - protein, 8 aa, Mycobacterium
NSGSERSN

SEQ ID NO: 533337 - protein, 8 aa, Mycobacterium
NSGSGGFN

SEQ ID NO: 533338 - protein, 16 aa, Mycobacterium
NSGSGNIGIGNSGTNN

SEQ ID NO: 533339 - protein, 9 aa, Mycobacterium
NSGSGNSGF

SEQ ID NO: 533340 - protein, 20 aa, Mycobacterium
NSGSGNSGLFNSGNDNSGFF

SEQ ID NO: 533341 - protein, 19 aa, Mycobacterium
NSGSGNTGFGNSGNTNTGF

SEQ ID NO: 533342 - protein, 16 aa, Mycobacterium
NSGSGNTGIFNSGSNN

SEQ ID NO: 533343 - protein, 16 aa, Mycobacterium
NSGSGNVGIGNSGTNN

SEQ ID NO: 533344 - protein, 8 aa, Mycobacterium
NSGSKPPF

SEQ ID NO: 533345 - protein, 12 aa, Mycobacterium
NSGSLASDEAQD

SEQ ID NO: 533346 - protein, 18 aa, Mycobacterium
NSGSLNTGIGNTGSTNTG

SEQ ID NO: 533347 - protein, 8 aa, Mycobacterium
NSGSPEDL

SEQ ID NO: 533348 - protein, 8 aa, Mycobacterium
NSGSPEEL

SEQ ID NO: 533349 - protein, 8 aa, Mycobacterium
NSGSSGTV

SEQ ID NO: 533350 - protein, 11 aa, Mycobacterium
NSGSTIESNDA

SEQ ID NO: 533351 - protein, 9 aa, Mycobacterium
NSGTANSGV

SEQ ID NO: 533352 - protein, 16 aa, Mycobacterium
NSGTAQSGIGNSGTNF

SEQ ID NO: 533353 - protein, 17 aa, Mycobacterium
NSGTDTSGFQNSTGGAY

SEQ ID NO: 533354 - protein, 8 aa, Mycobacterium
NSGTEATM

SEQ ID NO: 533355 - protein, 8 aa, Mycobacterium
NSGTGNFG

SEQ ID NO: 533356 - protein, 9 aa, Mycobacterium
NSGTGNSGF

SEQ ID NO: 533357 - protein, 9 aa, Mycobacterium
NSGTGNTGI

SEQ ID NO: 533358 - protein, 12 aa, Mycobacterium
NSGTGNTGVGNA

SEQ ID NO: 533359 - protein, 5 aa, Mycobacterium
NSGTN

SEQ ID NO: 533360 - protein, 9 aa, Mycobacterium
NSGTNLPAT

SEQ ID NO: 533361 - protein, 9 aa, Mycobacterium
NSGTNNTGL

SEQ ID NO: 533362 - protein, 11 aa, Mycobacterium
NSGTPIPSNVT

SEQ ID NO: 533363 - protein, 8 aa, Mycobacterium
NSGTPSRA

SEQ ID NO: 533364 - protein, 8 aa, Mycobacterium
NSGTSLPA

SEQ ID NO: 533365 - protein, 17 aa, Mycobacterium
NSGTSPTAPHRRNWPDA

SEQ ID NO: 533366 - protein, 8 aa, Mycobacterium
NSGTTIPQ

SEQ ID NO: 533367 - protein, 4 aa, Mycobacterium
NSGV

SEQ ID NO: 533368 - protein, 7 aa, Mycobacterium
NSGVEES

SEQ ID NO: 533369 - protein, 10 aa, Mycobacterium
NSGVQAVNGG

SEQ ID NO: 533370 - protein, 5 aa, Mycobacterium
NSGVR

SEQ ID NO: 533371 - protein, 6 aa, Mycobacterium
NSGVRA

SEQ ID NO: 533372 - protein, 4 aa, Mycobacterium
NSHD

SEQ ID NO: 533373 - protein, 5 aa, Mycobacterium
NSHEA

SEQ ID NO: 533374 - protein, 11 aa, Mycobacterium
NSHGRNGDGDT

SEQ ID NO: 533375 - protein, 24 aa, Mycobacterium
NSHNKGEGGGARVEAGYAARGEAW

SEQ ID NO: 533376 - protein, 4 aa, Mycobacterium
NSHP

SEQ ID NO: 533377 - protein, 6 aa, Mycobacterium
NSHPAA

SEQ ID NO: 533378 - protein, 10 aa, Mycobacterium
NSIEATAAQI

SEQ ID NO: 533379 - protein, 11 aa, Mycobacterium
NSILPEDRQKA

SEQ ID NO: 533380 - protein, 11 aa, Mycobacterium
NSIPEGPPVGT

SEQ ID NO: 533381 - protein, 11 aa, Mycobacterium
NSISAAPSNRV

SEQ ID NO: 533382 - protein, 7 aa, Mycobacterium
NSISPGV

SEQ ID NO: 533383 - protein, 10 aa, Mycobacterium
NSIVPARTPR

SEQ ID NO: 533384 - protein, 7 aa, Mycobacterium
NSKAQAA

SEQ ID NO: 533385 - protein, 7 aa, Mycobacterium
NSKGDEM

SEQ ID NO: 533386 - protein, 10 aa, Mycobacterium
NSKGSGALGA

SEQ ID NO: 533387 - protein, 8 aa, Mycobacterium
NSKHNPLH

SEQ ID NO: 533388 - protein, 10 aa, Mycobacterium
NSKPAAEEVA

SEQ ID NO: 533389 - protein, 8 aa, Mycobacterium
NSKPAVRR

SEQ ID NO: 533390 - protein, 13 aa, Mycobacterium
NSKTPGMATTDSD

SEQ ID NO: 533391 - protein, 6 aa, Mycobacterium
NSKVDS

SEQ ID NO: 533392 - protein, 8 aa, Mycobacterium
NSLANPHH

SEQ ID NO: 533393 - protein, 6 aa, Mycobacterium
NSLAPY

SEQ ID NO: 533394 - protein, 15 aa, Mycobacterium
NSLAQQSRRNPDGTG

SEQ ID NO: 533395 - protein, 4 aa, Mycobacterium
NSLD

SEQ ID NO: 533396 - protein, 9 aa, Mycobacterium
NSLDPATVE

SEQ ID NO: 533397 - protein, 6 aa, Mycobacterium
NSLDPE

SEQ ID NO: 533398 - protein, 7 aa, Mycobacterium
NSLDTSA

SEQ ID NO: 533399 - protein, 9 aa, Mycobacterium
NSLEEQMEA

SEQ ID NO: 533400 - protein, 8 aa, Mycobacterium
NSLGGGTA

SEQ ID NO: 533401 - protein, 8 aa, Mycobacterium
NSLGKHVS

SEQ ID NO: 533402 - protein, 7 aa, Mycobacterium
NSLGNHV

SEQ ID NO: 533403 - protein, 13 aa, Mycobacterium
NSLHRSKADESYQ

SEQ ID NO: 533404 - protein, 4 aa, Mycobacterium
NSLP

SEQ ID NO: 533405 - protein, 4 aa, Mycobacterium
NSLQ

SEQ ID NO: 533406 - protein, 9 aa, Mycobacterium
NSLQDGPIG

SEQ ID NO: 533407 - protein, 4 aa, Mycobacterium
NSLR

SEQ ID NO: 533408 - protein, 6 aa, Mycobacterium
NSLRAR

SEQ ID NO: 533409 - protein, 9 aa, Mycobacterium
NSLRHSGAT

SEQ ID NO: 533410 - protein, 54 aa, Mycobacterium
NSLSDRPAALDEAREAQARAAEQARAAAAKQARREHAEGRERGKAAATGPGRAA

SEQ ID NO: 533411 - protein, 54 aa, Mycobacterium
NSLSDRPAALDEAREAQARATEQARAAAANQARREHAEGRARGKAAATGPGRTA

SEQ ID NO: 533412 - protein, 7 aa, Mycobacterium
NSLSEDD

SEQ ID NO: 533413 - protein, 6 aa, Mycobacterium
NSLSRP

SEQ ID NO: 533414 - protein, 5 aa, Mycobacterium
NSLTA

SEQ ID NO: 533415 - protein, 6 aa, Mycobacterium
NSLTES

SEQ ID NO: 533416 - protein, 6 aa, Mycobacterium
NSLYTD

SEQ ID NO: 533417 - protein, 5 aa, Mycobacterium
NSMSS

SEQ ID NO: 533418 - protein, 13 aa, Mycobacterium
NSMTTNGLSTSRS

SEQ ID NO: 533419 - protein, 8 aa, Mycobacterium
NSMTTNGV

SEQ ID NO: 533420 - protein, 18 aa, Mycobacterium
NSNAEAEQTLSHARNEAD

SEQ ID NO: 533421 - protein, 6 aa, Mycobacterium
NSNETI

SEQ ID NO: 533422 - protein, 5 aa, Mycobacterium
NSNGD

SEQ ID NO: 533423 - protein, 6 aa, Mycobacterium
NSNGDG

SEQ ID NO: 533424 - protein, 9 aa, Mycobacterium
NSNGQSVAQ

SEQ ID NO: 533425 - protein, 15 aa, Mycobacterium
NSNMDGSLNTAATET

SEQ ID NO: 533426 - protein, 8 aa, Mycobacterium
NSNPNAGI

SEQ ID NO: 533427 - protein, 6 aa, Mycobacterium
NSPAEK

SEQ ID NO: 533428 - protein, 9 aa, Mycobacterium
NSPAIAATE

SEQ ID NO: 533429 - protein, 20 aa, Mycobacterium
NSPATTRQQQTLATSGASYP

SEQ ID NO: 533430 - protein, 10 aa, Mycobacterium
NSPDAVAPHG

SEQ ID NO: 533431 - protein, 12 aa, Mycobacterium
NSPDCEWKDRRS

SEQ ID NO: 533432 - protein, 8 aa, Mycobacterium
NSPDGYRT

SEQ ID NO: 533433 - protein, 8 aa, Mycobacterium
NSPDPFDS

SEQ ID NO: 533434 - protein, 14 aa, Mycobacterium
NSPEAARRAAADGI

SEQ ID NO: 533435 - protein, 7 aa, Mycobacterium
NSPECGA

SEQ ID NO: 533436 - protein, 11 aa, Mycobacterium
NSPEDRQAIAE

SEQ ID NO: 533437 - protein, 7 aa, Mycobacterium
NSPEGRA

SEQ ID NO: 533438 - protein, 8 aa, Mycobacterium
NSPEKFTD

SEQ ID NO: 533439 - protein, 10 aa, Mycobacterium
NSPETLAPHG

SEQ ID NO: 533440 - protein, 4 aa, Mycobacterium
NSPG

SEQ ID NO: 533441 - protein, 7 aa, Mycobacterium
NSPGAAA

SEQ ID NO: 533442 - protein, 7 aa, Mycobacterium
NSPGART

SEQ ID NO: 533443 - protein, 14 aa, Mycobacterium
NSPGASALQGLTAQ

SEQ ID NO: 533444 - protein, 6 aa, Mycobacterium
NSPGFE

SEQ ID NO: 533445 - protein, 10 aa, Mycobacterium
NSPGGSVTAS

SEQ ID NO: 533446 - protein, 5 aa, Mycobacterium
NSPGL

SEQ ID NO: 533447 - protein, 5 aa, Mycobacterium
NSPGQ

SEQ ID NO: 533448 - protein, 6 aa, Mycobacterium
NSPGRL

SEQ ID NO: 533449 - protein, 6 aa, Mycobacterium
NSPGSM

SEQ ID NO: 533450 - protein, 13 aa, Mycobacterium
NSPGTIDAGYRGE

SEQ ID NO: 533451 - protein, 17 aa, Mycobacterium
NSPGTPMTTEPVQGGPV

SEQ ID NO: 533452 - protein, 6 aa, Mycobacterium
NSPGWR

SEQ ID NO: 533453 - protein, 14 aa, Mycobacterium
NSPHHQGATPLENA

SEQ ID NO: 533454 - protein, 4 aa, Mycobacterium
NSPI

SEQ ID NO: 533455 - protein, 7 aa, Mycobacterium
NSPIGNN

SEQ ID NO: 533456 - protein, 10 aa, Mycobacterium
NSPIKDGKKT

SEQ ID NO: 533457 - protein, 6 aa, Mycobacterium
NSPIPL

SEQ ID NO: 533458 - protein, 10 aa, Mycobacterium
NSPKNSLPQD

SEQ ID NO: 533459 - protein, 4 aa, Mycobacterium
NSPL

SEQ ID NO: 533460 - protein, 10 aa, Mycobacterium
NSPLDGKAAE

SEQ ID NO: 533461 - protein, 5 aa, Mycobacterium
NSPMG

SEQ ID NO: 533462 - protein, 52 aa, Mycobacterium
NSPNIAGGSQPAKQPKPKEGEGEGEDPLKGGNQKGGGPNGGKPGPSGHADDP

SEQ ID NO: 533463 - protein, 15 aa, Mycobacterium
NSPPNPDGPTALQNS

SEQ ID NO: 533464 - protein, 16 aa, Mycobacterium
NSPPNPDGPTALQSSG

SEQ ID NO: 533465 - protein, 6 aa, Mycobacterium
NSPPPL

SEQ ID NO: 533466 - protein, 12 aa, Mycobacterium
NSPQAGSGTPEQ

SEQ ID NO: 533467 - protein, 6 aa, Mycobacterium
NSPQSP

SEQ ID NO: 533468 - protein, 8 aa, Mycobacterium
NSPRAKAY

SEQ ID NO: 533469 - protein, 14 aa, Mycobacterium
NSPRPQSALPADDQ

SEQ ID NO: 533470 - protein, 6 aa, Mycobacterium
NSPRQT

SEQ ID NO: 533471 - protein, 6 aa, Mycobacterium
NSPRTY

SEQ ID NO: 533472 - protein, 4 aa, Mycobacterium
NSPS

SEQ ID NO: 533473 - protein, 9 aa, Mycobacterium
NSPSGQAYR

SEQ ID NO: 533474 - protein, 15 aa, Mycobacterium
NSPSGVGTVVFNYPP

SEQ ID NO: 533475 - protein, 9 aa, Mycobacterium
NSPSNPGPL

SEQ ID NO: 533476 - protein, 13 aa, Mycobacterium
NSPSSKDAAEETV

SEQ ID NO: 533477 - protein, 15 aa, Mycobacterium
NSPSSVAVSGETGAV

SEQ ID NO: 533478 - protein, 8 aa, Mycobacterium
NSPTAGLA

SEQ ID NO: 533479 - protein, 6 aa, Mycobacterium
NSPTFD

SEQ ID NO: 533480 - protein, 15 aa, Mycobacterium
NSPTLVAGQTLIAPI

SEQ ID NO: 533481 - protein, 6 aa, Mycobacterium
NSPTPA

SEQ ID NO: 533482 - protein, 6 aa, Mycobacterium
NSPTYR

SEQ ID NO: 533483 - protein, 4 aa, Mycobacterium
NSPV

SEQ ID NO: 533484 - protein, 6 aa, Mycobacterium
NSPVAT

SEQ ID NO: 533485 - protein, 7 aa, Mycobacterium
NSPVDGY

SEQ ID NO: 533486 - protein, 10 aa, Mycobacterium
NSPVGNGENV

SEQ ID NO: 533487 - protein, 8 aa, Mycobacterium
NSPYGNGT

SEQ ID NO: 533488 - protein, 8 aa, Mycobacterium
NSQARQGI

SEQ ID NO: 533489 - protein, 4 aa, Mycobacterium
NSQD

SEQ ID NO: 533490 - protein, 5 aa, Mycobacterium
NSQER

SEQ ID NO: 533491 - protein, 4 aa, Mycobacterium
NSQF

SEQ ID NO: 533492 - protein, 13 aa, Mycobacterium
NSQGDSPFRPSTH

SEQ ID NO: 533493 - protein, 16 aa, Mycobacterium
NSQGGKPKDGSDLPRL

SEQ ID NO: 533494 - protein, 11 aa, Mycobacterium
NSQGPDALQTR

SEQ ID NO: 533495 - protein, 5 aa, Mycobacterium
NSQGT

SEQ ID NO: 533496 - protein, 6 aa, Mycobacterium
NSQGYS

SEQ ID NO: 533497 - protein, 7 aa, Mycobacterium
NSQGYSR

SEQ ID NO: 533498 - protein, 4 aa, Mycobacterium
NSQL

SEQ ID NO: 533499 - protein, 5 aa, Mycobacterium
NSQLR

SEQ ID NO: 533500 - protein, 5 aa, Mycobacterium
NSQNY

SEQ ID NO: 533501 - protein, 10 aa, Mycobacterium
NSQPSNGCPV

SEQ ID NO: 533502 - protein, 15 aa, Mycobacterium
NSQRGRGRLRHYSNC

SEQ ID NO: 533503 - protein, 4 aa, Mycobacterium
NSQS

SEQ ID NO: 533504 - protein, 7 aa, Mycobacterium
NSQYGGE

SEQ ID NO: 533505 - protein, 6 aa, Mycobacterium
NSQYGL

SEQ ID NO: 533506 - protein, 8 aa, Mycobacterium
NSRALAEA

SEQ ID NO: 533507 - protein, 24 aa, Mycobacterium
NSRALPGGGDMGAPSRGSQDQRSV

SEQ ID NO: 533508 - protein, 14 aa, Mycobacterium
NSRASVRSDPEKSV

SEQ ID NO: 533509 - protein, 4 aa, Mycobacterium
NSRG

SEQ ID NO: 533510 - protein, 6 aa, Mycobacterium
NSRGAD

SEQ ID NO: 533511 - protein, 6 aa, Mycobacterium
NSRGER

SEQ ID NO: 533512 - protein, 8 aa, Mycobacterium
NSRGTTRV

SEQ ID NO: 533513 - protein, 15 aa, Mycobacterium
NSRHGLQNPNARYRK

SEQ ID NO: 533514 - protein, 5 aa, Mycobacterium
NSRHT

SEQ ID NO: 533515 - protein, 4 aa, Mycobacterium
NSRP

SEQ ID NO: 533516 - protein, 11 aa, Mycobacterium
NSRPERRDPPR

SEQ ID NO: 533517 - protein, 11 aa, Mycobacterium
NSRPERRDPPT

SEQ ID NO: 533518 - protein, 15 aa, Mycobacterium
NSRPHAARPPDRPIP

SEQ ID NO: 533519 - protein, 5 aa, Mycobacterium
NSRPL

SEQ ID NO: 533520 - protein, 12 aa, Mycobacterium
NSRPTRAEASDV

SEQ ID NO: 533521 - protein, 6 aa, Mycobacterium
NSRPVE

SEQ ID NO: 533522 - protein, 18 aa, Mycobacterium
NSRQPGRQIPIGYRTATI

SEQ ID NO: 533523 - protein, 10 aa, Mycobacterium
NSRRAPAYDG

SEQ ID NO: 533524 - protein, 11 aa, Mycobacterium
NSRRENPTDDL

SEQ ID NO: 533525 - protein, 6 aa, Mycobacterium
NSRRGQ

SEQ ID NO: 533526 - protein, 5 aa, Mycobacterium
NSRSD

SEQ ID NO: 533527 - protein, 12 aa, Mycobacterium
NSRSDDAVVPPE

SEQ ID NO: 533528 - protein, 8 aa, Mycobacterium
NSRSGDTR

SEQ ID NO: 533529 - protein, 8 aa, Mycobacterium
NSRSKYRP

SEQ ID NO: 533530 - protein, 21 aa, Mycobacterium
NSRSTTTSAARPSVATTPCSP

SEQ ID NO: 533531 - protein, 4 aa, Mycobacterium
NSRT

SEQ ID NO: 533532 - protein, 7 aa, Mycobacterium
NSRTADV

SEQ ID NO: 533533 - protein, 6 aa, Mycobacterium
NSRTAL

SEQ ID NO: 533534 - protein, 7 aa, Mycobacterium
NSRTRAA

SEQ ID NO: 533535 - protein, 7 aa, Mycobacterium
NSRTRAV

SEQ ID NO: 533536 - protein, 4 aa, Mycobacterium
NSRV

SEQ ID NO: 533537 - protein, 7 aa, Mycobacterium
NSRVPSA

SEQ ID NO: 533538 - protein, 8 aa, Mycobacterium
NSRVRSEQ

SEQ ID NO: 533539 - protein, 20 aa, Mycobacterium
NSSADTVGNSVNDALSQPLK

SEQ ID NO: 533540 - protein, 21 aa, Mycobacterium
NSSAPAAPGVSAGLGEAASVG

SEQ ID NO: 533541 - protein, 12 aa, Mycobacterium
NSSASKSKVIAD

SEQ ID NO: 533542 - protein, 7 aa, Mycobacterium
NSSATAY

SEQ ID NO: 533543 - protein, 9 aa, Mycobacterium
NSSATMARP

SEQ ID NO: 533544 - protein, 23 aa, Mycobacterium
NSSATPADVESANGSCPSRRAAA

SEQ ID NO: 533545 - protein, 45 aa, Mycobacterium
NSSDDNSGFGNSSSGGHNSGAANSGSGGYNAGFGNSNTGGGSTGY

SEQ ID NO: 533546 - protein, 9 aa, Mycobacterium
NSSDPQRIG

SEQ ID NO: 533547 - protein, 6 aa, Mycobacterium
NSSDVY

SEQ ID NO: 533548 - protein, 9 aa, Mycobacterium
NSSEIPERD

SEQ ID NO: 533549 - protein, 6 aa, Mycobacterium
NSSETL

SEQ ID NO: 533550 - protein, 6 aa, Mycobacterium
NSSEVP

SEQ ID NO: 533551 - protein, 13 aa, Mycobacterium
NSSGGTYQAGEAQ

SEQ ID NO: 533552 - protein, 23 aa, Mycobacterium
NSSGLRQTKAGRPKSDEKTRTLG

SEQ ID NO: 533553 - protein, 8 aa, Mycobacterium
NSSGVTAR

SEQ ID NO: 533554 - protein, 7 aa, Mycobacterium
NSSHSTL

SEQ ID NO: 533555 - protein, 8 aa, Mycobacterium
NSSPAFTP

SEQ ID NO: 533556 - protein, 14 aa, Mycobacterium
NSSPEPLPVQPSPD

SEQ ID NO: 533557 - protein, 5 aa, Mycobacterium
NSSPV

SEQ ID NO: 533558 - protein, 10 aa, Mycobacterium
NSSQGGGSKD

SEQ ID NO: 533559 - protein, 7 aa, Mycobacterium
NSSSFPS

SEQ ID NO: 533560 - protein, 11 aa, Mycobacterium
NSSTADLPTAA

SEQ ID NO: 533561 - protein, 9 aa, Mycobacterium
NSSTKGIDG

SEQ ID NO: 533562 - protein, 5 aa, Mycobacterium
NSSVP

SEQ ID NO: 533563 - protein, 8 aa, Mycobacterium
NSSVTAEE

SEQ ID NO: 533564 - protein, 11 aa, Mycobacterium
NSSYTGTAIPA

SEQ ID NO: 533565 - protein, 8 aa, Mycobacterium
NSTAALGN

SEQ ID NO: 533566 - protein, 25 aa, Mycobacterium
NSTADASTTAAKRSDRVSNEAQRRR

SEQ ID NO: 533567 - protein, 6 aa, Mycobacterium
NSTAER

SEQ ID NO: 533568 - protein, 9 aa, Mycobacterium
NSTAGGAYV

SEQ ID NO: 533569 - protein, 11 aa, Mycobacterium
NSTAIAATEAE

SEQ ID NO: 533570 - protein, 5 aa, Mycobacterium
NSTAL

SEQ ID NO: 533571 - protein, 14 aa, Mycobacterium
NSTAPPPYAITPPP

SEQ ID NO: 533572 - protein, 8 aa, Mycobacterium
NSTASRWQ

SEQ ID NO: 533573 - protein, 6 aa, Mycobacterium
NSTDIA

SEQ ID NO: 533574 - protein, 5 aa, Mycobacterium
NSTDR

SEQ ID NO: 533575 - protein, 12 aa, Mycobacterium
NSTDRGRLAPGQ

SEQ ID NO: 533576 - protein, 10 aa, Mycobacterium
NSTEGEPGLQ

SEQ ID NO: 533577 - protein, 6 aa, Mycobacterium
NSTEGY

SEQ ID NO: 533578 - protein, 6 aa, Mycobacterium
NSTEID

SEQ ID NO: 533579 - protein, 16 aa, Mycobacterium
NSTENSGGGDDRAAQE

SEQ ID NO: 533580 - protein, 6 aa, Mycobacterium
NSTEPV

SEQ ID NO: 533581 - protein, 12 aa, Mycobacterium
NSTERDRARERL

SEQ ID NO: 533582 - protein, 6 aa, Mycobacterium
NSTETV

SEQ ID NO: 533583 - protein, 6 aa, Mycobacterium
NSTGGL

SEQ ID NO: 533584 - protein, 17 aa, Mycobacterium
NSTGGNYKKNDGSADWM

SEQ ID NO: 533585 - protein, 8 aa, Mycobacterium
NSTGGSGL

SEQ ID NO: 533586 - protein, 21 aa, Mycobacterium
NSTHDSTEYYTDAGPGTPGRA

SEQ ID NO: 533587 - protein, 9 aa, Mycobacterium
NSTIGTGTK

SEQ ID NO: 533588 - protein, 4 aa, Mycobacterium
NSTL

SEQ ID NO: 533589 - protein, 4 aa, Mycobacterium
NSTM

SEQ ID NO: 533590 - protein, 12 aa, Mycobacterium
NSTNGTTVNNAP

SEQ ID NO: 533591 - protein, 6 aa, Mycobacterium
NSTPEK

SEQ ID NO: 533592 - protein, 4 aa, Mycobacterium
NSTQ

SEQ ID NO: 533593 - protein, 7 aa, Mycobacterium
NSTQNCR

SEQ ID NO: 533594 - protein, 16 aa, Mycobacterium
NSTTEASAAAIESDGS

SEQ ID NO: 533595 - protein, 12 aa, Mycobacterium
NSTTLSNRDGVS

SEQ ID NO: 533596 - protein, 8 aa, Mycobacterium
NSTTMEPH
